United States Patent 8,969,254 (OLIGONUCLEOTIDE ARRAY FOR TISSUE TYPING) - sequence listing, part 5

SEQ ID NO: 96786 - DNA, 41 bp, Artificial Sequence
  Description of Artificial Sequence: Synthetic oligonucleotide
agttaaggataaagcttttgaactagaactcagctgggttg

SEQ ID NO: 96787 - DNA, 40 bp, Artificial Sequence
  Description of Artificial Sequence: Synthetic oligonucleotide
gttaaggataaagcttttgaactagaactcagctgggttg

SEQ ID NO: 96788 - DNA, 40 bp, Artificial Sequence
  Description of Artificial Sequence: Synthetic oligonucleotide
ttaaggataaagcttttgaactagaactcagctgggttgg

SEQ ID NO: 96789 - DNA, 39 bp, Artificial Sequence
  Description of Artificial Sequence: Synthetic oligonucleotide
taaggataaagcttttgaactagaactcagctgggttgg

SEQ ID NO: 96790 - DNA, 38 bp, Artificial Sequence
  Description of Artificial Sequence: Synthetic oligonucleotide
aaggataaagcttttgaactagaactcagctgggttgg

SEQ ID NO: 96791 - DNA, 37 bp, Artificial Sequence
  Description of Artificial Sequence: Synthetic oligonucleotide
aggataaagcttttgaactagaactcagctgggttgg

SEQ ID NO: 96792 - DNA, 36 bp, Artificial Sequence
  Description of Artificial Sequence: Synthetic oligonucleotide
ggataaagcttttgaactagaactcagctgggttgg

SEQ ID NO: 96793 - DNA, 37 bp, Artificial Sequence
  Description of Artificial Sequence: Synthetic oligonucleotide
gataaagcttttgaactagaactcagctgggttggtg

SEQ ID NO: 96794 - DNA, 43 bp, Artificial Sequence
  Description of Artificial Sequence: Synthetic oligonucleotide
ataaagcttttgaactagaactcagctgggttggtgaattaac

SEQ ID NO: 96795 - DNA, 42 bp, Artificial Sequence
  Description of Artificial Sequence: Synthetic oligonucleotide
taaagcttttgaactagaactcagctgggttggtgaattaac

SEQ ID NO: 96796 - DNA, 41 bp, Artificial Sequence
  Description of Artificial Sequence: Synthetic oligonucleotide
aaagcttttgaactagaactcagctgggttggtgaattaac

SEQ ID NO: 96797 - DNA, 40 bp, Artificial Sequence
  Description of Artificial Sequence: Synthetic oligonucleotide
aagcttttgaactagaactcagctgggttggtgaattaac

SEQ ID NO: 96798 - DNA, 39 bp, Artificial Sequence
  Description of Artificial Sequence: Synthetic oligonucleotide
agcttttgaactagaactcagctgggttggtgaattaac

SEQ ID NO: 96799 - DNA, 38 bp, Artificial Sequence
  Description of Artificial Sequence: Synthetic oligonucleotide
gcttttgaactagaactcagctgggttggtgaattaac

SEQ ID NO: 96800 - DNA, 42 bp, Artificial Sequence
  Description of Artificial Sequence: Synthetic oligonucleotide
cttttgaactagaactcagctgggttggtgaattaactaatg

SEQ ID NO: 96801 - DNA, 42 bp, Artificial Sequence
  Description of Artificial Sequence: Synthetic oligonucleotide
ttttgaactagaactcagctgggttggtgaattaactaatgg

SEQ ID NO: 96802 - DNA, 41 bp, Artificial Sequence
  Description of Artificial Sequence: Synthetic oligonucleotide
tttgaactagaactcagctgggttggtgaattaactaatgg

SEQ ID NO: 96803 - DNA, 40 bp, Artificial Sequence
  Description of Artificial Sequence: Synthetic oligonucleotide
ttgaactagaactcagctgggttggtgaattaactaatgg

SEQ ID NO: 96804 - DNA, 39 bp, Artificial Sequence
  Description of Artificial Sequence: Synthetic oligonucleotide
tgaactagaactcagctgggttggtgaattaactaatgg

SEQ ID NO: 96805 - DNA, 38 bp, Artificial Sequence
  Description of Artificial Sequence: Synthetic oligonucleotide
gaactagaactcagctgggttggtgaattaactaatgg

SEQ ID NO: 96806 - DNA, 40 bp, Artificial Sequence
  Description of Artificial Sequence: Synthetic oligonucleotide
aactagaactcagctgggttggtgaattaactaatggaag

SEQ ID NO: 96807 - DNA, 39 bp, Artificial Sequence
  Description of Artificial Sequence: Synthetic oligonucleotide
actagaactcagctgggttggtgaattaactaatggaag

SEQ ID NO: 96808 - DNA, 38 bp, Artificial Sequence
  Description of Artificial Sequence: Synthetic oligonucleotide
ctagaactcagctgggttggtgaattaactaatggaag

SEQ ID NO: 96809 - DNA, 39 bp, Artificial Sequence
  Description of Artificial Sequence: Synthetic oligonucleotide
tagaactcagctgggttggtgaattaactaatggaagac

SEQ ID NO: 96810 - DNA, 38 bp, Artificial Sequence
  Description of Artificial Sequence: Synthetic oligonucleotide
agaactcagctgggttggtgaattaactaatggaagac

SEQ ID NO: 96811 - DNA, 37 bp, Artificial Sequence
  Description of Artificial Sequence: Synthetic oligonucleotide
gaactcagctgggttggtgaattaactaatggaagac

SEQ ID NO: 96812 - DNA, 39 bp, Artificial Sequence
  Description of Artificial Sequence: Synthetic oligonucleotide
aactcagctgggttggtgaattaactaatggaagacatg

SEQ ID NO: 96813 - DNA, 38 bp, Artificial Sequence
  Description of Artificial Sequence: Synthetic oligonucleotide
actcagctgggttggtgaattaactaatggaagacatg

SEQ ID NO: 96814 - DNA, 37 bp, Artificial Sequence
  Description of Artificial Sequence: Synthetic oligonucleotide
ctcagctgggttggtgaattaactaatggaagacatg

SEQ ID NO: 96815 - DNA, 42 bp, Artificial Sequence
  Description of Artificial Sequence: Synthetic oligonucleotide
tcagctgggttggtgaattaactaatggaagacatgaaattg

SEQ ID NO: 96816 - DNA, 41 bp, Artificial Sequence
  Description of Artificial Sequence: Synthetic oligonucleotide
cagctgggttggtgaattaactaatggaagacatgaaattg

SEQ ID NO: 96817 - DNA, 43 bp, Artificial Sequence
  Description of Artificial Sequence: Synthetic oligonucleotide
agctgggttggtgaattaactaatggaagacatgaaattgttc

SEQ ID NO: 96818 - DNA, 42 bp, Artificial Sequence
  Description of Artificial Sequence: Synthetic oligonucleotide
gctgggttggtgaattaactaatggaagacatgaaattgttc

SEQ ID NO: 96819 - DNA, 42 bp, Artificial Sequence
  Description of Artificial Sequence: Synthetic oligonucleotide
ctgggttggtgaattaactaatggaagacatgaaattgttcc

SEQ ID NO: 96820 - DNA, 46 bp, Artificial Sequence
  Description of Artificial Sequence: Synthetic oligonucleotide
tgggttggtgaattaactaatggaagacatgaaattgttccaaaag

SEQ ID NO: 96821 - DNA, 45 bp, Artificial Sequence
  Description of Artificial Sequence: Synthetic oligonucleotide
gggttggtgaattaactaatggaagacatgaaattgttccaaaag

SEQ ID NO: 96822 - DNA, 51 bp, Artificial Sequence
  Description of Artificial Sequence: Synthetic oligonucleotide
ggttggtgaattaactaatggaagacatgaaattgttccaaaagatataag

SEQ ID NO: 96823 - DNA, 52 bp, Artificial Sequence
  Description of Artificial Sequence: Synthetic oligonucleotide
gttggtgaattaactaatggaagacatgaaattgttccaaaagatataagag

SEQ ID NO: 96824 - DNA, 54 bp, Artificial Sequence
  Description of Artificial Sequence: Synthetic oligonucleotide
ttggtgaattaactaatggaagacatgaaattgttccaaaagatataagagaag

SEQ ID NO: 96825 - DNA, 53 bp, Artificial Sequence
  Description of Artificial Sequence: Synthetic oligonucleotide
tggtgaattaactaatggaagacatgaaattgttccaaaagatataagagaag

SEQ ID NO: 96826 - DNA, 52 bp, Artificial Sequence
  Description of Artificial Sequence: Synthetic oligonucleotide
ggtgaattaactaatggaagacatgaaattgttccaaaagatataagagaag

SEQ ID NO: 96827 - DNA, 54 bp, Artificial Sequence
  Description of Artificial Sequence: Synthetic oligonucleotide
gtgaattaactaatggaagacatgaaattgttccaaaagatataagagaagaag

SEQ ID NO: 96828 - DNA, 54 bp, Artificial Sequence
  Description of Artificial Sequence: Synthetic oligonucleotide
tgaattaactaatggaagacatgaaattgttccaaaagatataagagaagaagc

SEQ ID NO: 96829 - DNA, 53 bp, Artificial Sequence
  Description of Artificial Sequence: Synthetic oligonucleotide
gaattaactaatggaagacatgaaattgttccaaaagatataagagaagaagc

SEQ ID NO: 96830 - DNA, 54 bp, Artificial Sequence
  Description of Artificial Sequence: Synthetic oligonucleotide
aattaactaatggaagacatgaaattgttccaaaagatataagagaagaagcag

SEQ ID NO: 96831 - DNA, 53 bp, Artificial Sequence
  Description of Artificial Sequence: Synthetic oligonucleotide
attaactaatggaagacatgaaattgttccaaaagatataagagaagaagcag

SEQ ID NO: 96832 - DNA, 52 bp, Artificial Sequence
  Description of Artificial Sequence: Synthetic oligonucleotide
ttaactaatggaagacatgaaattgttccaaaagatataagagaagaagcag

SEQ ID NO: 96833 - DNA, 51 bp, Artificial Sequence
  Description of Artificial Sequence: Synthetic oligonucleotide
taactaatggaagacatgaaattgttccaaaagatataagagaagaagcag

SEQ ID NO: 96834 - DNA, 50 bp, Artificial Sequence
  Description of Artificial Sequence: Synthetic oligonucleotide
aactaatggaagacatgaaattgttccaaaagatataagagaagaagcag

SEQ ID NO: 96835 - DNA, 49 bp, Artificial Sequence
  Description of Artificial Sequence: Synthetic oligonucleotide
actaatggaagacatgaaattgttccaaaagatataagagaagaagcag

SEQ ID NO: 96836 - DNA, 48 bp, Artificial Sequence
  Description of Artificial Sequence: Synthetic oligonucleotide
ctaatggaagacatgaaattgttccaaaagatataagagaagaagcag

SEQ ID NO: 96837 - DNA, 49 bp, Artificial Sequence
  Description of Artificial Sequence: Synthetic oligonucleotide
taatggaagacatgaaattgttccaaaagatataagagaagaagcagag

SEQ ID NO: 96838 - DNA, 48 bp, Artificial Sequence
  Description of Artificial Sequence: Synthetic oligonucleotide
aatggaagacatgaaattgttccaaaagatataagagaagaagcagag

SEQ ID NO: 96839 - DNA, 47 bp, Artificial Sequence
  Description of Artificial Sequence: Synthetic oligonucleotide
atggaagacatgaaattgttccaaaagatataagagaagaagcagag

SEQ ID NO: 96840 - DNA, 46 bp, Artificial Sequence
  Description of Artificial Sequence: Synthetic oligonucleotide
tggaagacatgaaattgttccaaaagatataagagaagaagcagag

SEQ ID NO: 96841 - DNA, 45 bp, Artificial Sequence
  Description of Artificial Sequence: Synthetic oligonucleotide
ggaagacatgaaattgttccaaaagatataagagaagaagcagag

SEQ ID NO: 96842 - DNA, 51 bp, Artificial Sequence
  Description of Artificial Sequence: Synthetic oligonucleotide
gaagacatgaaattgttccaaaagatataagagaagaagcagagaaatatg

SEQ ID NO: 96843 - DNA, 51 bp, Artificial Sequence
  Description of Artificial Sequence: Synthetic oligonucleotide
aagacatgaaattgttccaaaagatataagagaagaagcagagaaatatgc

SEQ ID NO: 96844 - DNA, 50 bp, Artificial Sequence
  Description of Artificial Sequence: Synthetic oligonucleotide
agacatgaaattgttccaaaagatataagagaagaagcagagaaatatgc

SEQ ID NO: 96845 - DNA, 49 bp, Artificial Sequence
  Description of Artificial Sequence: Synthetic oligonucleotide
gacatgaaattgttccaaaagatataagagaagaagcagagaaatatgc

SEQ ID NO: 96846 - DNA, 52 bp, Artificial Sequence
  Description of Artificial Sequence: Synthetic oligonucleotide
acatgaaattgttccaaaagatataagagaagaagcagagaaatatgctaag

SEQ ID NO: 96847 - DNA, 51 bp, Artificial Sequence
  Description of Artificial Sequence: Synthetic oligonucleotide
catgaaattgttccaaaagatataagagaagaagcagagaaatatgctaag

SEQ ID NO: 96848 - DNA, 51 bp, Artificial Sequence
  Description of Artificial Sequence: Synthetic oligonucleotide
atgaaattgttccaaaagatataagagaagaagcagagaaatatgctaagg

SEQ ID NO: 96849 - DNA, 50 bp, Artificial Sequence
  Description of Artificial Sequence: Synthetic oligonucleotide
tgaaattgttccaaaagatataagagaagaagcagagaaatatgctaagg

SEQ ID NO: 96850 - DNA, 49 bp, Artificial Sequence
  Description of Artificial Sequence: Synthetic oligonucleotide
gaaattgttccaaaagatataagagaagaagcagagaaatatgctaagg

SEQ ID NO: 96851 - DNA, 52 bp, Artificial Sequence
  Description of Artificial Sequence: Synthetic oligonucleotide
aaattgttccaaaagatataagagaagaagcagagaaatatgctaaggaatc

SEQ ID NO: 96852 - DNA, 51 bp, Artificial Sequence
  Description of Artificial Sequence: Synthetic oligonucleotide
aattgttccaaaagatataagagaagaagcagagaaatatgctaaggaatc

SEQ ID NO: 96853 - DNA, 50 bp, Artificial Sequence
  Description of Artificial Sequence: Synthetic oligonucleotide
attgttccaaaagatataagagaagaagcagagaaatatgctaaggaatc

SEQ ID NO: 96854 - DNA, 49 bp, Artificial Sequence
  Description of Artificial Sequence: Synthetic oligonucleotide
ttgttccaaaagatataagagaagaagcagagaaatatgctaaggaatc

SEQ ID NO: 96855 - DNA, 48 bp, Artificial Sequence
  Description of Artificial Sequence: Synthetic oligonucleotide
tgttccaaaagatataagagaagaagcagagaaatatgctaaggaatc

SEQ ID NO: 96856 - DNA, 47 bp, Artificial Sequence
  Description of Artificial Sequence: Synthetic oligonucleotide
gttccaaaagatataagagaagaagcagagaaatatgctaaggaatc

SEQ ID NO: 96857 - DNA, 48 bp, Artificial Sequence
  Description of Artificial Sequence: Synthetic oligonucleotide
ttccaaaagatataagagaagaagcagagaaatatgctaaggaatctc

SEQ ID NO: 96858 - DNA, 47 bp, Artificial Sequence
  Description of Artificial Sequence: Synthetic oligonucleotide
tccaaaagatataagagaagaagcagagaaatatgctaaggaatctc

SEQ ID NO: 96859 - DNA, 46 bp, Artificial Sequence
  Description of Artificial Sequence: Synthetic oligonucleotide
ccaaaagatataagagaagaagcagagaaatatgctaaggaatctc

SEQ ID NO: 96860 - DNA, 47 bp, Artificial Sequence
  Description of Artificial Sequence: Synthetic oligonucleotide
caaaagatataagagaagaagcagagaaatatgctaaggaatctctg

SEQ ID NO: 96861 - DNA, 49 bp, Artificial Sequence
  Description of Artificial Sequence: Synthetic oligonucleotide
aaaagatataagagaagaagcagagaaatatgctaaggaatctctgaag

SEQ ID NO: 96862 - DNA, 48 bp, Artificial Sequence
  Description of Artificial Sequence: Synthetic oligonucleotide
aaagatataagagaagaagcagagaaatatgctaaggaatctctgaag

SEQ ID NO: 96863 - DNA, 47 bp, Artificial Sequence
  Description of Artificial Sequence: Synthetic oligonucleotide
aagatataagagaagaagcagagaaatatgctaaggaatctctgaag

SEQ ID NO: 96864 - DNA, 46 bp, Artificial Sequence
  Description of Artificial Sequence: Synthetic oligonucleotide
agatataagagaagaagcagagaaatatgctaaggaatctctgaag

SEQ ID NO: 96865 - DNA, 45 bp, Artificial Sequence
  Description of Artificial Sequence: Synthetic oligonucleotide
gatataagagaagaagcagagaaatatgctaaggaatctctgaag

SEQ ID NO: 96866 - DNA, 45 bp, Artificial Sequence
  Description of Artificial Sequence: Synthetic oligonucleotide
atataagagaagaagcagagaaatatgctaaggaatctctgaagg

SEQ ID NO: 96867 - DNA, 44 bp, Artificial Sequence
  Description of Artificial Sequence: Synthetic oligonucleotide
tataagagaagaagcagagaaatatgctaaggaatctctgaagg

SEQ ID NO: 96868 - DNA, 43 bp, Artificial Sequence
  Description of Artificial Sequence: Synthetic oligonucleotide
ataagagaagaagcagagaaatatgctaaggaatctctgaagg

SEQ ID NO: 96869 - DNA, 42 bp, Artificial Sequence
  Description of Artificial Sequence: Synthetic oligonucleotide
taagagaagaagcagagaaatatgctaaggaatctctgaagg

SEQ ID NO: 96870 - DNA, 41 bp, Artificial Sequence
  Description of Artificial Sequence: Synthetic oligonucleotide
aagagaagaagcagagaaatatgctaaggaatctctgaagg

SEQ ID NO: 96871 - DNA, 40 bp, Artificial Sequence
  Description of Artificial Sequence: Synthetic oligonucleotide
agagaagaagcagagaaatatgctaaggaatctctgaagg

SEQ ID NO: 96872 - DNA, 39 bp, Artificial Sequence
  Description of Artificial Sequence: Synthetic oligonucleotide
gagaagaagcagagaaatatgctaaggaatctctgaagg

SEQ ID NO: 96873 - DNA, 41 bp, Artificial Sequence
  Description of Artificial Sequence: Synthetic oligonucleotide
agaagaagcagagaaatatgctaaggaatctctgaaggaag

SEQ ID NO: 96874 - DNA, 40 bp, Artificial Sequence
  Description of Artificial Sequence: Synthetic oligonucleotide
gaagaagcagagaaatatgctaaggaatctctgaaggaag

SEQ ID NO: 96875 - DNA, 42 bp, Artificial Sequence
  Description of Artificial Sequence: Synthetic oligonucleotide
aagaagcagagaaatatgctaaggaatctctgaaggaagaag

SEQ ID NO: 96876 - DNA, 41 bp, Artificial Sequence
  Description of Artificial Sequence: Synthetic oligonucleotide
agaagcagagaaatatgctaaggaatctctgaaggaagaag

SEQ ID NO: 96877 - DNA, 40 bp, Artificial Sequence
  Description of Artificial Sequence: Synthetic oligonucleotide
gaagcagagaaatatgctaaggaatctctgaaggaagaag

SEQ ID NO: 96878 - DNA, 42 bp, Artificial Sequence
  Description of Artificial Sequence: Synthetic oligonucleotide
aagcagagaaatatgctaaggaatctctgaaggaagaagatg

SEQ ID NO: 96879 - DNA, 41 bp, Artificial Sequence
  Description of Artificial Sequence: Synthetic oligonucleotide
agcagagaaatatgctaaggaatctctgaaggaagaagatg

SEQ ID NO: 96880 - DNA, 40 bp, Artificial Sequence
  Description of Artificial Sequence: Synthetic oligonucleotide
gcagagaaatatgctaaggaatctctgaaggaagaagatg

SEQ ID NO: 96881 - DNA, 43 bp, Artificial Sequence
  Description of Artificial Sequence: Synthetic oligonucleotide
cagagaaatatgctaaggaatctctgaaggaagaagatgaatc

SEQ ID NO: 96882 - DNA, 44 bp, Artificial Sequence
  Description of Artificial Sequence: Synthetic oligonucleotide
agagaaatatgctaaggaatctctgaaggaagaagatgaatcag

SEQ ID NO: 96883 - DNA, 43 bp, Artificial Sequence
  Description of Artificial Sequence: Synthetic oligonucleotide
gagaaatatgctaaggaatctctgaaggaagaagatgaatcag

SEQ ID NO: 96884 - DNA, 45 bp, Artificial Sequence
  Description of Artificial Sequence: Synthetic oligonucleotide
agaaatatgctaaggaatctctgaaggaagaagatgaatcagatg

SEQ ID NO: 96885 - DNA, 44 bp, Artificial Sequence
  Description of Artificial Sequence: Synthetic oligonucleotide
gaaatatgctaaggaatctctgaaggaagaagatgaatcagatg

SEQ ID NO: 96886 - DNA, 46 bp, Artificial Sequence
  Description of Artificial Sequence: Synthetic oligonucleotide
aaatatgctaaggaatctctgaaggaagaagatgaatcagatgatg

SEQ ID NO: 96887 - DNA, 45 bp, Artificial Sequence
  Description of Artificial Sequence: Synthetic oligonucleotide
aatatgctaaggaatctctgaaggaagaagatgaatcagatgatg

SEQ ID NO: 96888 - DNA, 44 bp, Artificial Sequence
  Description of Artificial Sequence: Synthetic oligonucleotide
atatgctaaggaatctctgaaggaagaagatgaatcagatgatg

SEQ ID NO: 96889 - DNA, 43 bp, Artificial Sequence
  Description of Artificial Sequence: Synthetic oligonucleotide
tatgctaaggaatctctgaaggaagaagatgaatcagatgatg

SEQ ID NO: 96890 - DNA, 42 bp, Artificial Sequence
  Description of Artificial Sequence: Synthetic oligonucleotide
atgctaaggaatctctgaaggaagaagatgaatcagatgatg

SEQ ID NO: 96891 - DNA, 41 bp, Artificial Sequence
  Description of Artificial Sequence: Synthetic oligonucleotide
tgctaaggaatctctgaaggaagaagatgaatcagatgatg

SEQ ID NO: 96892 - DNA, 40 bp, Artificial Sequence
  Description of Artificial Sequence: Synthetic oligonucleotide
gctaaggaatctctgaaggaagaagatgaatcagatgatg

SEQ ID NO: 96893 - DNA, 47 bp, Artificial Sequence
  Description of Artificial Sequence: Synthetic oligonucleotide
ctaaggaatctctgaaggaagaagatgaatcagatgatgataatatg

SEQ ID NO: 96894 - DNA, 33 bp, Artificial Sequence
  Description of Artificial Sequence: Synthetic oligonucleotide
tctacagtgctgttagaccttttggctgcagtg

SEQ ID NO: 96895 - DNA, 32 bp, Artificial Sequence
  Description of Artificial Sequence: Synthetic oligonucleotide
ctacagtgctgttagaccttttggctgcagtg

SEQ ID NO: 96896 - DNA, 33 bp, Artificial Sequence
  Description of Artificial Sequence: Synthetic oligonucleotide
tacagtgctgttagaccttttggctgcagtgtg

SEQ ID NO: 96897 - DNA, 32 bp, Artificial Sequence
  Description of Artificial Sequence: Synthetic oligonucleotide
acagtgctgttagaccttttggctgcagtgtg

SEQ ID NO: 96898 - DNA, 31 bp, Artificial Sequence
  Description of Artificial Sequence: Synthetic oligonucleotide
cagtgctgttagaccttttggctgcagtgtg

SEQ ID NO: 96899 - DNA, 34 bp, Artificial Sequence
  Description of Artificial Sequence: Synthetic oligonucleotide
agtgctgttagaccttttggctgcagtgtgaatg

SEQ ID NO: 96900 - DNA, 33 bp, Artificial Sequence
  Description of Artificial Sequence: Synthetic oligonucleotide
gtgctgttagaccttttggctgcagtgtgaatg

SEQ ID NO: 96901 - DNA, 34 bp, Artificial Sequence
  Description of Artificial Sequence: Synthetic oligonucleotide
tgctgttagaccttttggctgcagtgtgaatgac

SEQ ID NO: 96902 - DNA, 33 bp, Artificial Sequence
  Description of Artificial Sequence: Synthetic oligonucleotide
gctgttagaccttttggctgcagtgtgaatgac

SEQ ID NO: 96903 - DNA, 33 bp, Artificial Sequence
  Description of Artificial Sequence: Synthetic oligonucleotide
ctgttagaccttttggctgcagtgtgaatgacg

SEQ ID NO: 96904 - DNA, 33 bp, Artificial Sequence
  Description of Artificial Sequence: Synthetic oligonucleotide
tgttagaccttttggctgcagtgtgaatgacgg

SEQ ID NO: 96905 - DNA, 32 bp, Artificial Sequence
  Description of Artificial Sequence: Synthetic oligonucleotide
gttagaccttttggctgcagtgtgaatgacgg

SEQ ID NO: 96906 - DNA, 33 bp, Artificial Sequence
  Description of Artificial Sequence: Synthetic oligonucleotide
ttagaccttttggctgcagtgtgaatgacggtg

SEQ ID NO: 96907 - DNA, 32 bp, Artificial Sequence
  Description of Artificial Sequence: Synthetic oligonucleotide
tagaccttttggctgcagtgtgaatgacggtg

SEQ ID NO: 96908 - DNA, 31 bp, Artificial Sequence
  Description of Artificial Sequence: Synthetic oligonucleotide
agaccttttggctgcagtgtgaatgacggtg

SEQ ID NO: 96909 - DNA, 30 bp, Artificial Sequence
  Description of Artificial Sequence: Synthetic oligonucleotide
gaccttttggctgcagtgtgaatgacggtg

SEQ ID NO: 96910 - DNA, 30 bp, Artificial Sequence
  Description of Artificial Sequence: Synthetic oligonucleotide
accttttggctgcagtgtgaatgacggtgc

SEQ ID NO: 96911 - DNA, 29 bp, Artificial Sequence
  Description of Artificial Sequence: Synthetic oligonucleotide
ccttttggctgcagtgtgaatgacggtgc

SEQ ID NO: 96912 - DNA, 29 bp, Artificial Sequence
  Description of Artificial Sequence: Synthetic oligonucleotide
cttttggctgcagtgtgaatgacggtgcg

SEQ ID NO: 96913 - DNA, 29 bp, Artificial Sequence
  Description of Artificial Sequence: Synthetic oligonucleotide
ttttggctgcagtgtgaatgacggtgcgc

SEQ ID NO: 96914 - DNA, 28 bp, Artificial Sequence
  Description of Artificial Sequence: Synthetic oligonucleotide
tttggctgcagtgtgaatgacggtgcgc

SEQ ID NO: 96915 - DNA, 27 bp, Artificial Sequence
  Description of Artificial Sequence: Synthetic oligonucleotide
ttggctgcagtgtgaatgacggtgcgc

SEQ ID NO: 96916 - DNA, 27 bp, Artificial Sequence
  Description of Artificial Sequence: Synthetic oligonucleotide
tggctgcagtgtgaatgacggtgcgca

SEQ ID NO: 96917 - DNA, 27 bp, Artificial Sequence
  Description of Artificial Sequence: Synthetic oligonucleotide
ggctgcagtgtgaatgacggtgcgcaa

SEQ ID NO: 96918 - DNA, 27 bp, Artificial Sequence
  Description of Artificial Sequence: Synthetic oligonucleotide
gctgcagtgtgaatgacggtgcgcaac

SEQ ID NO: 96919 - DNA, 28 bp, Artificial Sequence
  Description of Artificial Sequence: Synthetic oligonucleotide
ctgcagtgtgaatgacggtgcgcaactc

SEQ ID NO: 96920 - DNA, 30 bp, Artificial Sequence
  Description of Artificial Sequence: Synthetic oligonucleotide
tgcagtgtgaatgacggtgcgcaactctac

SEQ ID NO: 96921 - DNA, 29 bp, Artificial Sequence
  Description of Artificial Sequence: Synthetic oligonucleotide
gcagtgtgaatgacggtgcgcaactctac

SEQ ID NO: 96922 - DNA, 40 bp, Artificial Sequence
  Description of Artificial Sequence: Synthetic oligonucleotide
atgtctcgaagatatgactccaggaccactatattttctc

SEQ ID NO: 96923 - DNA, 39 bp, Artificial Sequence
  Description of Artificial Sequence: Synthetic oligonucleotide
tgtctcgaagatatgactccaggaccactatattttctc

SEQ ID NO: 96924 - DNA, 38 bp, Artificial Sequence
  Description of Artificial Sequence: Synthetic oligonucleotide
gtctcgaagatatgactccaggaccactatattttctc

SEQ ID NO: 96925 - DNA, 38 bp, Artificial Sequence
  Description of Artificial Sequence: Synthetic oligonucleotide
tctcgaagatatgactccaggaccactatattttctcc

SEQ ID NO: 96926 - DNA, 37 bp, Artificial Sequence
  Description of Artificial Sequence: Synthetic oligonucleotide
ctcgaagatatgactccaggaccactatattttctcc

SEQ ID NO: 96927 - DNA, 38 bp, Artificial Sequence
  Description of Artificial Sequence: Synthetic oligonucleotide
tcgaagatatgactccaggaccactatattttctccag

SEQ ID NO: 96928 - DNA, 37 bp, Artificial Sequence
  Description of Artificial Sequence: Synthetic oligonucleotide
cgaagatatgactccaggaccactatattttctccag

SEQ ID NO: 96929 - DNA, 39 bp, Artificial Sequence
  Description of Artificial Sequence: Synthetic oligonucleotide
gaagatatgactccaggaccactatattttctccagaag

SEQ ID NO: 96930 - DNA, 39 bp, Artificial Sequence
  Description of Artificial Sequence: Synthetic oligonucleotide
aagatatgactccaggaccactatattttctccagaagg

SEQ ID NO: 96931 - DNA, 38 bp, Artificial Sequence
  Description of Artificial Sequence: Synthetic oligonucleotide
agatatgactccaggaccactatattttctccagaagg

SEQ ID NO: 96932 - DNA, 37 bp, Artificial Sequence
  Description of Artificial Sequence: Synthetic oligonucleotide
gatatgactccaggaccactatattttctccagaagg

SEQ ID NO: 96933 - DNA, 38 bp, Artificial Sequence
  Description of Artificial Sequence: Synthetic oligonucleotide
atatgactccaggaccactatattttctccagaaggtc

SEQ ID NO: 96934 - DNA, 37 bp, Artificial Sequence
  Description of Artificial Sequence: Synthetic oligonucleotide
tatgactccaggaccactatattttctccagaaggtc

SEQ ID NO: 96935 - DNA, 36 bp, Artificial Sequence
  Description of Artificial Sequence: Synthetic oligonucleotide
atgactccaggaccactatattttctccagaaggtc

SEQ ID NO: 96936 - DNA, 35 bp, Artificial Sequence
  Description of Artificial Sequence: Synthetic oligonucleotide
tgactccaggaccactatattttctccagaaggtc

SEQ ID NO: 96937 - DNA, 34 bp, Artificial Sequence
  Description of Artificial Sequence: Synthetic oligonucleotide
gactccaggaccactatattttctccagaaggtc

SEQ ID NO: 96938 - DNA, 34 bp, Artificial Sequence
  Description of Artificial Sequence: Synthetic oligonucleotide
actccaggaccactatattttctccagaaggtcg

SEQ ID NO: 96939 - DNA, 33 bp, Artificial Sequence
  Description of Artificial Sequence: Synthetic oligonucleotide
ctccaggaccactatattttctccagaaggtcg

SEQ ID NO: 96940 - DNA, 33 bp, Artificial Sequence
  Description of Artificial Sequence: Synthetic oligonucleotide
tccaggaccactatattttctccagaaggtcgc

SEQ ID NO: 96941 - DNA, 32 bp, Artificial Sequence
  Description of Artificial Sequence: Synthetic oligonucleotide
ccaggaccactatattttctccagaaggtcgc

SEQ ID NO: 96942 - DNA, 37 bp, Artificial Sequence
  Description of Artificial Sequence: Synthetic oligonucleotide
caggaccactatattttctccagaaggtcgcttatac

SEQ ID NO: 96943 - DNA, 37 bp, Artificial Sequence
  Description of Artificial Sequence: Synthetic oligonucleotide
aggaccactatattttctccagaaggtcgcttatacc

SEQ ID NO: 96944 - DNA, 36 bp, Artificial Sequence
  Description of Artificial Sequence: Synthetic oligonucleotide
ggaccactatattttctccagaaggtcgcttatacc

SEQ ID NO: 96945 - DNA, 38 bp, Artificial Sequence
  Description of Artificial Sequence: Synthetic oligonucleotide
gaccactatattttctccagaaggtcgcttataccaag

SEQ ID NO: 96946 - DNA, 40 bp, Artificial Sequence
  Description of Artificial Sequence: Synthetic oligonucleotide
accactatattttctccagaaggtcgcttataccaagttg

SEQ ID NO: 96947 - DNA, 39 bp, Artificial Sequence
  Description of Artificial Sequence: Synthetic oligonucleotide
ccactatattttctccagaaggtcgcttataccaagttg

SEQ ID NO: 96948 - DNA, 44 bp, Artificial Sequence
  Description of Artificial Sequence: Synthetic oligonucleotide
cactatattttctccagaaggtcgcttataccaagttgaatatg

SEQ ID NO: 96949 - DNA, 44 bp, Artificial Sequence
  Description of Artificial Sequence: Synthetic oligonucleotide
actatattttctccagaaggtcgcttataccaagttgaatatgc

SEQ ID NO: 96950 - DNA, 43 bp, Artificial Sequence
  Description of Artificial Sequence: Synthetic oligonucleotide
ctatattttctccagaaggtcgcttataccaagttgaatatgc

SEQ ID NO: 96951 - DNA, 43 bp, Artificial Sequence
  Description of Artificial Sequence: Synthetic oligonucleotide
tatattttctccagaaggtcgcttataccaagttgaatatgcc

SEQ ID NO: 96952 - DNA, 42 bp, Artificial Sequence
  Description of Artificial Sequence: Synthetic oligonucleotide
atattttctccagaaggtcgcttataccaagttgaatatgcc

SEQ ID NO: 96953 - DNA, 41 bp, Artificial Sequence
  Description of Artificial Sequence: Synthetic oligonucleotide
tattttctccagaaggtcgcttataccaagttgaatatgcc

SEQ ID NO: 96954 - DNA, 40 bp, Artificial Sequence
  Description of Artificial Sequence: Synthetic oligonucleotide
attttctccagaaggtcgcttataccaagttgaatatgcc

SEQ ID NO: 96955 - DNA, 39 bp, Artificial Sequence
  Description of Artificial Sequence: Synthetic oligonucleotide
ttttctccagaaggtcgcttataccaagttgaatatgcc

SEQ ID NO: 96956 - DNA, 38 bp, Artificial Sequence
  Description of Artificial Sequence: Synthetic oligonucleotide
tttctccagaaggtcgcttataccaagttgaatatgcc

SEQ ID NO: 96957 - DNA, 37 bp, Artificial Sequence
  Description of Artificial Sequence: Synthetic oligonucleotide
ttctccagaaggtcgcttataccaagttgaatatgcc

SEQ ID NO: 96958 - DNA, 36 bp, Artificial Sequence
  Description of Artificial Sequence: Synthetic oligonucleotide
tctccagaaggtcgcttataccaagttgaatatgcc

SEQ ID NO: 96959 - DNA, 35 bp, Artificial Sequence
  Description of Artificial Sequence: Synthetic oligonucleotide
ctccagaaggtcgcttataccaagttgaatatgcc

SEQ ID NO: 96960 - DNA, 37 bp, Artificial Sequence
  Description of Artificial Sequence: Synthetic oligonucleotide
tccagaaggtcgcttataccaagttgaatatgccatg

SEQ ID NO: 96961 - DNA, 36 bp, Artificial Sequence
  Description of Artificial Sequence: Synthetic oligonucleotide
ccagaaggtcgcttataccaagttgaatatgccatg

SEQ ID NO: 96962 - DNA, 36 bp, Artificial Sequence
  Description of Artificial Sequence: Synthetic oligonucleotide
cagaaggtcgcttataccaagttgaatatgccatgg

SEQ ID NO: 96963 - DNA, 38 bp, Artificial Sequence
  Description of Artificial Sequence: Synthetic oligonucleotide
agaaggtcgcttataccaagttgaatatgccatggaag

SEQ ID NO: 96964 - DNA, 37 bp, Artificial Sequence
  Description of Artificial Sequence: Synthetic oligonucleotide
gaaggtcgcttataccaagttgaatatgccatggaag

SEQ ID NO: 96965 - DNA, 37 bp, Artificial Sequence
  Description of Artificial Sequence: Synthetic oligonucleotide
aaggtcgcttataccaagttgaatatgccatggaagc

SEQ ID NO: 96966 - DNA, 36 bp, Artificial Sequence
  Description of Artificial Sequence: Synthetic oligonucleotide
aggtcgcttataccaagttgaatatgccatggaagc

SEQ ID NO: 96967 - DNA, 35 bp, Artificial Sequence
  Description of Artificial Sequence: Synthetic oligonucleotide
ggtcgcttataccaagttgaatatgccatggaagc

SEQ ID NO: 96968 - DNA, 39 bp, Artificial Sequence
  Description of Artificial Sequence: Synthetic oligonucleotide
gtcgcttataccaagttgaatatgccatggaagctattg

SEQ ID NO: 96969 - DNA, 39 bp, Artificial Sequence
  Description of Artificial Sequence: Synthetic oligonucleotide
tcgcttataccaagttgaatatgccatggaagctattgg

SEQ ID NO: 96970 - DNA, 38 bp, Artificial Sequence
  Description of Artificial Sequence: Synthetic oligonucleotide
cgcttataccaagttgaatatgccatggaagctattgg

SEQ ID NO: 96971 - DNA, 39 bp, Artificial Sequence
  Description of Artificial Sequence: Synthetic oligonucleotide
gcttataccaagttgaatatgccatggaagctattggac

SEQ ID NO: 96972 - DNA, 41 bp, Artificial Sequence
  Description of Artificial Sequence: Synthetic oligonucleotide
cttataccaagttgaatatgccatggaagctattggacatg

SEQ ID NO: 96973 - DNA, 41 bp, Artificial Sequence
  Description of Artificial Sequence: Synthetic oligonucleotide
ttataccaagttgaatatgccatggaagctattggacatgc

SEQ ID NO: 96974 - DNA, 40 bp, Artificial Sequence
  Description of Artificial Sequence: Synthetic oligonucleotide
tataccaagttgaatatgccatggaagctattggacatgc

SEQ ID NO: 96975 - DNA, 39 bp, Artificial Sequence
  Description of Artificial Sequence: Synthetic oligonucleotide
ataccaagttgaatatgccatggaagctattggacatgc

SEQ ID NO: 96976 - DNA, 38 bp, Artificial Sequence
  Description of Artificial Sequence: Synthetic oligonucleotide
taccaagttgaatatgccatggaagctattggacatgc

SEQ ID NO: 96977 - DNA, 37 bp, Artificial Sequence
  Description of Artificial Sequence: Synthetic oligonucleotide
accaagttgaatatgccatggaagctattggacatgc

SEQ ID NO: 96978 - DNA, 36 bp, Artificial Sequence
  Description of Artificial Sequence: Synthetic oligonucleotide
ccaagttgaatatgccatggaagctattggacatgc

SEQ ID NO: 96979 - DNA, 37 bp, Artificial Sequence
  Description of Artificial Sequence: Synthetic oligonucleotide
caagttgaatatgccatggaagctattggacatgcag

SEQ ID NO: 96980 - DNA, 37 bp, Artificial Sequence
  Description of Artificial Sequence: Synthetic oligonucleotide
aagttgaatatgccatggaagctattggacatgcagg

SEQ ID NO: 96981 - DNA, 36 bp, Artificial Sequence
  Description of Artificial Sequence: Synthetic oligonucleotide
agttgaatatgccatggaagctattggacatgcagg

SEQ ID NO: 96982 - DNA, 35 bp, Artificial Sequence
  Description of Artificial Sequence: Synthetic oligonucleotide
gttgaatatgccatggaagctattggacatgcagg

SEQ ID NO: 96983 - DNA, 35 bp, Artificial Sequence
  Description of Artificial Sequence: Synthetic oligonucleotide
ttgaatatgccatggaagctattggacatgcaggc

SEQ ID NO: 96984 - DNA, 34 bp, Artificial Sequence
  Description of Artificial Sequence: Synthetic oligonucleotide
tgaatatgccatggaagctattggacatgcaggc

SEQ ID NO: 96985 - DNA, 33 bp, Artificial Sequence
  Description of Artificial Sequence: Synthetic oligonucleotide
gaatatgccatggaagctattggacatgcaggc

SEQ ID NO: 96986 - DNA, 34 bp, Artificial Sequence
  Description of Artificial Sequence: Synthetic oligonucleotide
aatatgccatggaagctattggacatgcaggcac

SEQ ID NO: 96987 - DNA, 33 bp, Artificial Sequence
  Description of Artificial Sequence: Synthetic oligonucleotide
atatgccatggaagctattggacatgcaggcac

SEQ ID NO: 96988 - DNA, 32 bp, Artificial Sequence
  Description of Artificial Sequence: Synthetic oligonucleotide
tatgccatggaagctattggacatgcaggcac

SEQ ID NO: 96989 - DNA, 31 bp, Artificial Sequence
  Description of Artificial Sequence: Synthetic oligonucleotide
atgccatggaagctattggacatgcaggcac

SEQ ID NO: 96990 - DNA, 30 bp, Artificial Sequence
  Description of Artificial Sequence: Synthetic oligonucleotide
tgccatggaagctattggacatgcaggcac

SEQ ID NO: 96991 - DNA, 29 bp, Artificial Sequence
  Description of Artificial Sequence: Synthetic oligonucleotide
gccatggaagctattggacatgcaggcac

SEQ ID NO: 96992 - DNA, 29 bp, Artificial Sequence
  Description of Artificial Sequence: Synthetic oligonucleotide
ccatggaagctattggacatgcaggcacc

SEQ ID NO: 96993 - DNA, 30 bp, Artificial Sequence
  Description of Artificial Sequence: Synthetic oligonucleotide
catggaagctattggacatgcaggcacctg

SEQ ID NO: 96994 - DNA, 33 bp, Artificial Sequence
  Description of Artificial Sequence: Synthetic oligonucleotide
atggaagctattggacatgcaggcacctgtttg

SEQ ID NO: 96995 - DNA, 32 bp, Artificial Sequence
  Description of Artificial Sequence: Synthetic oligonucleotide
tggaagctattggacatgcaggcacctgtttg

SEQ ID NO: 96996 - DNA, 31 bp, Artificial Sequence
  Description of Artificial Sequence: Synthetic oligonucleotide
ggaagctattggacatgcaggcacctgtttg

SEQ ID NO: 96997 - DNA, 31 bp, Artificial Sequence
  Description of Artificial Sequence: Synthetic oligonucleotide
gaagctattggacatgcaggcacctgtttgg

SEQ ID NO: 96998 - DNA, 31 bp, Artificial Sequence
  Description of Artificial Sequence: Synthetic oligonucleotide
aagctattggacatgcaggcacctgtttggg

SEQ ID NO: 96999 - DNA, 30 bp, Artificial Sequence
  Description of Artificial Sequence: Synthetic oligonucleotide
agctattggacatgcaggcacctgtttggg

SEQ ID NO: 97000 - DNA, 29 bp, Artificial Sequence
  Description of Artificial Sequence: Synthetic oligonucleotide
gctattggacatgcaggcacctgtttggg

SEQ ID NO: 97001 - DNA, 36 bp, Artificial Sequence
  Description of Artificial Sequence: Synthetic oligonucleotide
ctattggacatgcaggcacctgtttgggaattttag

SEQ ID NO: 97002 - DNA, 36 bp, Artificial Sequence
  Description of Artificial Sequence: Synthetic oligonucleotide
tattggacatgcaggcacctgtttgggaattttagc

SEQ ID NO: 97003 - DNA, 35 bp, Artificial Sequence
  Description of Artificial Sequence: Synthetic oligonucleotide
attggacatgcaggcacctgtttgggaattttagc

SEQ ID NO: 97004 - DNA, 34 bp, Artificial Sequence
  Description of Artificial Sequence: Synthetic oligonucleotide
ttggacatgcaggcacctgtttgggaattttagc

SEQ ID NO: 97005 - DNA, 33 bp, Artificial Sequence
  Description of Artificial Sequence: Synthetic oligonucleotide
tggacatgcaggcacctgtttgggaattttagc

SEQ ID NO: 97006 - DNA, 32 bp, Artificial Sequence
  Description of Artificial Sequence: Synthetic oligonucleotide
ggacatgcaggcacctgtttgggaattttagc

SEQ ID NO: 97007 - DNA, 36 bp, Artificial Sequence
  Description of Artificial Sequence: Synthetic oligonucleotide
gacatgcaggcacctgtttgggaattttagcaaatg

SEQ ID NO: 97008 - DNA, 38 bp, Artificial Sequence
  Description of Artificial Sequence: Synthetic oligonucleotide
acatgcaggcacctgtttgggaattttagcaaatgatg

SEQ ID NO: 97009 - DNA, 37 bp, Artificial Sequence
  Description of Artificial Sequence: Synthetic oligonucleotide
catgcaggcacctgtttgggaattttagcaaatgatg

SEQ ID NO: 97010 - DNA, 37 bp, Artificial Sequence
  Description of Artificial Sequence: Synthetic oligonucleotide
atgcaggcacctgtttgggaattttagcaaatgatgg

SEQ ID NO: 97011 - DNA, 36 bp, Artificial Sequence
  Description of Artificial Sequence: Synthetic oligonucleotide
tgcaggcacctgtttgggaattttagcaaatgatgg

SEQ ID NO: 97012 - DNA, 35 bp, Artificial Sequence
  Description of Artificial Sequence: Synthetic oligonucleotide
gcaggcacctgtttgggaattttagcaaatgatgg

SEQ ID NO: 97013 - DNA, 36 bp, Artificial Sequence
  Description of Artificial Sequence: Synthetic oligonucleotide
caggcacctgtttgggaattttagcaaatgatggtg

SEQ ID NO: 97014 - DNA, 40 bp, Artificial Sequence
  Description of Artificial Sequence: Synthetic oligonucleotide
aggcacctgtttgggaattttagcaaatgatggtgttttg

SEQ ID NO: 97015 - DNA, 39 bp, Artificial Sequence
  Description of Artificial Sequence: Synthetic oligonucleotide
ggcacctgtttgggaattttagcaaatgatggtgttttg

SEQ ID NO: 97016 - DNA, 39 bp, Artificial Sequence
  Description of Artificial Sequence: Synthetic oligonucleotide
gcacctgtttgggaattttagcaaatgatggtgttttgc

SEQ ID NO: 97017 - DNA, 41 bp, Artificial Sequence
  Description of Artificial Sequence: Synthetic oligonucleotide
cacctgtttgggaattttagcaaatgatggtgttttgcttg

SEQ ID NO: 97018 - DNA, 41 bp, Artificial Sequence
  Description of Artificial Sequence: Synthetic oligonucleotide
acctgtttgggaattttagcaaatgatggtgttttgcttgc

SEQ ID NO: 97019 - DNA, 40 bp, Artificial Sequence
  Description of Artificial Sequence: Synthetic oligonucleotide
cctgtttgggaattttagcaaatgatggtgttttgcttgc

SEQ ID NO: 97020 - DNA, 41 bp, Artificial Sequence
  Description of Artificial Sequence: Synthetic oligonucleotide
ctgtttgggaattttagcaaatgatggtgttttgcttgcag

SEQ ID NO: 97021 - DNA, 41 bp, Artificial Sequence
  Description of Artificial Sequence: Synthetic oligonucleotide
tgtttgggaattttagcaaatgatggtgttttgcttgcagc

SEQ ID NO: 97022 - DNA, 40 bp, Artificial Sequence
  Description of Artificial Sequence: Synthetic oligonucleotide
gtttgggaattttagcaaatgatggtgttttgcttgcagc

SEQ ID NO: 97023 - DNA, 41 bp, Artificial Sequence
  Description of Artificial Sequence: Synthetic oligonucleotide
tttgggaattttagcaaatgatggtgttttgcttgcagcag

SEQ ID NO: 97024 - DNA, 40 bp, Artificial Sequence
  Description of Artificial Sequence: Synthetic oligonucleotide
ttgggaattttagcaaatgatggtgttttgcttgcagcag

SEQ ID NO: 97025 - DNA, 39 bp, Artificial Sequence
  Description of Artificial Sequence: Synthetic oligonucleotide
tgggaattttagcaaatgatggtgttttgcttgcagcag

SEQ ID NO: 97026 - DNA, 38 bp, Artificial Sequence
  Description of Artificial Sequence: Synthetic oligonucleotide
gggaattttagcaaatgatggtgttttgcttgcagcag

SEQ ID NO: 97027 - DNA, 39 bp, Artificial Sequence
  Description of Artificial Sequence: Synthetic oligonucleotide
ggaattttagcaaatgatggtgttttgcttgcagcagag

SEQ ID NO: 97028 - DNA, 40 bp, Artificial Sequence
  Description of Artificial Sequence: Synthetic oligonucleotide
gaattttagcaaatgatggtgttttgcttgcagcagagag

SEQ ID NO: 97029 - DNA, 41 bp, Artificial Sequence
  Description of Artificial Sequence: Synthetic oligonucleotide
aattttagcaaatgatggtgttttgcttgcagcagagagac

SEQ ID NO: 97030 - DNA, 40 bp, Artificial Sequence
  Description of Artificial Sequence: Synthetic oligonucleotide
attttagcaaatgatggtgttttgcttgcagcagagagac

SEQ ID NO: 97031 - DNA, 39 bp, Artificial Sequence
  Description of Artificial Sequence: Synthetic oligonucleotide
ttttagcaaatgatggtgttttgcttgcagcagagagac

SEQ ID NO: 97032 - DNA, 38 bp, Artificial Sequence
  Description of Artificial Sequence: Synthetic oligonucleotide
tttagcaaatgatggtgttttgcttgcagcagagagac

SEQ ID NO: 97033 - DNA, 37 bp, Artificial Sequence
  Description of Artificial Sequence: Synthetic oligonucleotide
ttagcaaatgatggtgttttgcttgcagcagagagac

SEQ ID NO: 97034 - DNA, 36 bp, Artificial Sequence
  Description of Artificial Sequence: Synthetic oligonucleotide
tagcaaatgatggtgttttgcttgcagcagagagac

SEQ ID NO: 97035 - DNA, 35 bp, Artificial Sequence
  Description of Artificial Sequence: Synthetic oligonucleotide
agcaaatgatggtgttttgcttgcagcagagagac

SEQ ID NO: 97036 - DNA, 34 bp, Artificial Sequence
  Description of Artificial Sequence: Synthetic oligonucleotide
gcaaatgatggtgttttgcttgcagcagagagac

SEQ ID NO: 97037 - DNA, 34 bp, Artificial Sequence
  Description of Artificial Sequence: Synthetic oligonucleotide
caaatgatggtgttttgcttgcagcagagagacg

SEQ ID NO: 97038 - DNA, 34 bp, Artificial Sequence
  Description of Artificial Sequence: Synthetic oligonucleotide
aaatgatggtgttttgcttgcagcagagagacgc

SEQ ID NO: 97039 - DNA, 33 bp, Artificial Sequence
  Description of Artificial Sequence: Synthetic oligonucleotide
aatgatggtgttttgcttgcagcagagagacgc

SEQ ID NO: 97040 - DNA, 32 bp, Artificial Sequence
  Description of Artificial Sequence: Synthetic oligonucleotide
atgatggtgttttgcttgcagcagagagacgc

SEQ ID NO: 97041 - DNA, 31 bp, Artificial Sequence
  Description of Artificial Sequence: Synthetic oligonucleotide
tgatggtgttttgcttgcagcagagagacgc

SEQ ID NO: 97042 - DNA, 30 bp, Artificial Sequence
  Description of Artificial Sequence: Synthetic oligonucleotide
gatggtgttttgcttgcagcagagagacgc

SEQ ID NO: 97043 - DNA, 32 bp, Artificial Sequence
  Description of Artificial Sequence: Synthetic oligonucleotide
atggtgttttgcttgcagcagagagacgcaac

SEQ ID NO: 97044 - DNA, 31 bp, Artificial Sequence
  Description of Artificial Sequence: Synthetic oligonucleotide
tggtgttttgcttgcagcagagagacgcaac

SEQ ID NO: 97045 - DNA, 30 bp, Artificial Sequence
  Description of Artificial Sequence: Synthetic oligonucleotide
ggtgttttgcttgcagcagagagacgcaac

SEQ ID NO: 97046 - DNA, 32 bp, Artificial Sequence
  Description of Artificial Sequence: Synthetic oligonucleotide
gtgttttgcttgcagcagagagacgcaacatc

SEQ ID NO: 97047 - DNA, 32 bp, Artificial Sequence
  Description of Artificial Sequence: Synthetic oligonucleotide
tgttttgcttgcagcagagagacgcaacatcc

SEQ ID NO: 97048 - DNA, 31 bp, Artificial Sequence
  Description of Artificial Sequence: Synthetic oligonucleotide
gttttgcttgcagcagagagacgcaacatcc

SEQ ID NO: 97049 - DNA, 32 bp, Artificial Sequence
  Description of Artificial Sequence: Synthetic oligonucleotide
ttttgcttgcagcagagagacgcaacatccac

SEQ ID NO: 97050 - DNA, 31 bp, Artificial Sequence
  Description of Artificial Sequence: Synthetic oligonucleotide
tttgcttgcagcagagagacgcaacatccac

SEQ ID NO: 97051 - DNA, 30 bp, Artificial Sequence
  Description of Artificial Sequence: Synthetic oligonucleotide
ttgcttgcagcagagagacgcaacatccac

SEQ ID NO: 97052 - DNA, 29 bp, Artificial Sequence
  Description of Artificial Sequence: Synthetic oligonucleotide
tgcttgcagcagagagacgcaacatccac

SEQ ID NO: 97053 - DNA, 28 bp, Artificial Sequence
  Description of Artificial Sequence: Synthetic oligonucleotide
gcttgcagcagagagacgcaacatccac

SEQ ID NO: 97054 - DNA, 30 bp, Artificial Sequence
  Description of Artificial Sequence: Synthetic oligonucleotide
cttgcagcagagagacgcaacatccacaag

SEQ ID NO: 97055 - DNA, 30 bp, Artificial Sequence
  Description of Artificial Sequence: Synthetic oligonucleotide
ttgcagcagagagacgcaacatccacaagc

SEQ ID NO: 97056 - DNA, 29 bp, Artificial Sequence
  Description of Artificial Sequence: Synthetic oligonucleotide
tgcagcagagagacgcaacatccacaagc

SEQ ID NO: 97057 - DNA, 28 bp, Artificial Sequence
  Description of Artificial Sequence: Synthetic oligonucleotide
gcagcagagagacgcaacatccacaagc

SEQ ID NO: 97058 - DNA, 30 bp, Artificial Sequence
  Description of Artificial Sequence: Synthetic oligonucleotide
cagcagagagacgcaacatccacaagcttc

SEQ ID NO: 97059 - DNA, 32 bp, Artificial Sequence
  Description of Artificial Sequence: Synthetic oligonucleotide
agcagagagacgcaacatccacaagcttcttg

SEQ ID NO: 97060 - DNA, 31 bp, Artificial Sequence
  Description of Artificial Sequence: Synthetic oligonucleotide
gcagagagacgcaacatccacaagcttcttg

SEQ ID NO: 97061 - DNA, 33 bp, Artificial Sequence
  Description of Artificial Sequence: Synthetic oligonucleotide
cagagagacgcaacatccacaagcttcttgatg

SEQ ID NO: 97062 - DNA, 35 bp, Artificial Sequence
  Description of Artificial Sequence: Synthetic oligonucleotide
agagagacgcaacatccacaagcttcttgatgaag

SEQ ID NO: 97063 - DNA, 34 bp, Artificial Sequence
  Description of Artificial Sequence: Synthetic oligonucleotide
gagagacgcaacatccacaagcttcttgatgaag

SEQ ID NO: 97064 - DNA, 35 bp, Artificial Sequence
  Description of Artificial Sequence: Synthetic oligonucleotide
agagacgcaacatccacaagcttcttgatgaagtc

SEQ ID NO: 97065 - DNA, 34 bp, Artificial Sequence
  Description of Artificial Sequence: Synthetic oligonucleotide
gagacgcaacatccacaagcttcttgatgaagtc

SEQ ID NO: 97066 - DNA, 41 bp, Artificial Sequence
  Description of Artificial Sequence: Synthetic oligonucleotide
agacgcaacatccacaagcttcttgatgaagtctttttttc

SEQ ID NO: 97067 - DNA, 40 bp, Artificial Sequence
  Description of Artificial Sequence: Synthetic oligonucleotide
gacgcaacatccacaagcttcttgatgaagtctttttttc

SEQ ID NO: 97068 - DNA, 41 bp, Artificial Sequence
  Description of Artificial Sequence: Synthetic oligonucleotide
acgcaacatccacaagcttcttgatgaagtctttttttctg

SEQ ID NO: 97069 - DNA, 40 bp, Artificial Sequence
  Description of Artificial Sequence: Synthetic oligonucleotide
cgcaacatccacaagcttcttgatgaagtctttttttctg

SEQ ID NO: 97070 - DNA, 54 bp, Artificial Sequence
  Description of Artificial Sequence: Synthetic oligonucleotide
gcaacatccacaagcttcttgatgaagtctttttttctgaaaaaatttataaac

SEQ ID NO: 97071 - DNA, 55 bp, Artificial Sequence
  Description of Artificial Sequence: Synthetic oligonucleotide
caacatccacaagcttcttgatgaagtctttttttctgaaaaaatttataaactc

SEQ ID NO: 97072 - DNA, 58 bp, Artificial Sequence
  Description of Artificial Sequence: Synthetic oligonucleotide
aacatccacaagcttcttgatgaagtctttttttctgaaaaaatttataaactcaatg

SEQ ID NO: 97073 - DNA, 57 bp, Artificial Sequence
  Description of Artificial Sequence: Synthetic oligonucleotide
acatccacaagcttcttgatgaagtctttttttctgaaaaaatttataaactcaatg

SEQ ID NO: 97074 - DNA, 56 bp, Artificial Sequence
  Description of Artificial Sequence: Synthetic oligonucleotide
catccacaagcttcttgatgaagtctttttttctgaaaaaatttataaactcaatg

SEQ ID NO: 97075 - DNA, 57 bp, Artificial Sequence
  Description of Artificial Sequence: Synthetic oligonucleotide
atccacaagcttcttgatgaagtctttttttctgaaaaaatttataaactcaatgag

SEQ ID NO: 97076 - DNA, 56 bp, Artificial Sequence
  Description of Artificial Sequence: Synthetic oligonucleotide
tccacaagcttcttgatgaagtctttttttctgaaaaaatttataaactcaatgag

SEQ ID NO: 97077 - DNA, 55 bp, Artificial Sequence
  Description of Artificial Sequence: Synthetic oligonucleotide
ccacaagcttcttgatgaagtctttttttctgaaaaaatttataaactcaatgag

SEQ ID NO: 97078 - DNA, 55 bp, Artificial Sequence
  Description of Artificial Sequence: Synthetic oligonucleotide
cacaagcttcttgatgaagtctttttttctgaaaaaatttataaactcaatgagg

SEQ ID NO: 97079 - DNA, 56 bp, Artificial Sequence
  Description of Artificial Sequence: Synthetic oligonucleotide
acaagcttcttgatgaagtctttttttctgaaaaaatttataaactcaatgaggac

SEQ ID NO: 97080 - DNA, 55 bp, Artificial Sequence
  Description of Artificial Sequence: Synthetic oligonucleotide
caagcttcttgatgaagtctttttttctgaaaaaatttataaactcaatgaggac

SEQ ID NO: 97081 - DNA, 57 bp, Artificial Sequence
  Description of Artificial Sequence: Synthetic oligonucleotide
aagcttcttgatgaagtctttttttctgaaaaaatttataaactcaatgaggacatg

SEQ ID NO: 97082 - DNA, 56 bp, Artificial Sequence
  Description of Artificial Sequence: Synthetic oligonucleotide
agcttcttgatgaagtctttttttctgaaaaaatttataaactcaatgaggacatg

SEQ ID NO: 97083 - DNA, 55 bp, Artificial Sequence
  Description of Artificial Sequence: Synthetic oligonucleotide
gcttcttgatgaagtctttttttctgaaaaaatttataaactcaatgaggacatg

SEQ ID NO: 97084 - DNA, 55 bp, Artificial Sequence
  Description of Artificial Sequence: Synthetic oligonucleotide
cttcttgatgaagtctttttttctgaaaaaatttataaactcaatgaggacatgg

SEQ ID NO: 97085 - DNA, 55 bp, Artificial Sequence
  Description of Artificial Sequence: Synthetic oligonucleotide
ttcttgatgaagtctttttttctgaaaaaatttataaactcaatgaggacatggc

SEQ ID NO: 97086 - DNA, 54 bp, Artificial Sequence
  Description of Artificial Sequence: Synthetic oligonucleotide
tcttgatgaagtctttttttctgaaaaaatttataaactcaatgaggacatggc

SEQ ID NO: 97087 - DNA, 53 bp, Artificial Sequence
  Description of Artificial Sequence: Synthetic oligonucleotide
cttgatgaagtctttttttctgaaaaaatttataaactcaatgaggacatggc

SEQ ID NO: 97088 - DNA, 55 bp, Artificial Sequence
  Description of Artificial Sequence: Synthetic oligonucleotide
ttgatgaagtctttttttctgaaaaaatttataaactcaatgaggacatggcttg

SEQ ID NO: 97089 - DNA, 54 bp, Artificial Sequence
  Description of Artificial Sequence: Synthetic oligonucleotide
tgatgaagtctttttttctgaaaaaatttataaactcaatgaggacatggcttg

SEQ ID NO: 97090 - DNA, 53 bp, Artificial Sequence
  Description of Artificial Sequence: Synthetic oligonucleotide
gatgaagtctttttttctgaaaaaatttataaactcaatgaggacatggcttg

SEQ ID NO: 97091 - DNA, 53 bp, Artificial Sequence
  Description of Artificial Sequence: Synthetic oligonucleotide
atgaagtctttttttctgaaaaaatttataaactcaatgaggacatggcttgc

SEQ ID NO: 97092 - DNA, 52 bp, Artificial Sequence
  Description of Artificial Sequence: Synthetic oligonucleotide
tgaagtctttttttctgaaaaaatttataaactcaatgaggacatggcttgc

SEQ ID NO: 97093 - DNA, 51 bp, Artificial Sequence
  Description of Artificial Sequence: Synthetic oligonucleotide
gaagtctttttttctgaaaaaatttataaactcaatgaggacatggcttgc

SEQ ID NO: 97094 - DNA, 52 bp, Artificial Sequence
  Description of Artificial Sequence: Synthetic oligonucleotide
aagtctttttttctgaaaaaatttataaactcaatgaggacatggcttgcag

SEQ ID NO: 97095 - DNA, 51 bp, Artificial Sequence
  Description of Artificial Sequence: Synthetic oligonucleotide
agtctttttttctgaaaaaatttataaactcaatgaggacatggcttgcag

SEQ ID NO: 97096 - DNA, 50 bp, Artificial Sequence
  Description of Artificial Sequence: Synthetic oligonucleotide
gtctttttttctgaaaaaatttataaactcaatgaggacatggcttgcag

SEQ ID NO: 97097 - DNA, 51 bp, Artificial Sequence
  Description of Artificial Sequence: Synthetic oligonucleotide
tctttttttctgaaaaaatttataaactcaatgaggacatggcttgcagtg

SEQ ID NO: 97098 - DNA, 50 bp, Artificial Sequence
  Description of Artificial Sequence: Synthetic oligonucleotide
ctttttttctgaaaaaatttataaactcaatgaggacatggcttgcagtg

SEQ ID NO: 97099 - DNA, 51 bp, Artificial Sequence
  Description of Artificial Sequence: Synthetic oligonucleotide
tttttttctgaaaaaatttataaactcaatgaggacatggcttgcagtgtg

SEQ ID NO: 97100 - DNA, 50 bp, Artificial Sequence
  Description of Artificial Sequence: Synthetic oligonucleotide
ttttttctgaaaaaatttataaactcaatgaggacatggcttgcagtgtg

SEQ ID NO: 97101 - DNA, 49 bp, Artificial Sequence
  Description of Artificial Sequence: Synthetic oligonucleotide
tttttctgaaaaaatttataaactcaatgaggacatggcttgcagtgtg

SEQ ID NO: 97102 - DNA, 48 bp, Artificial Sequence
  Description of Artificial Sequence: Synthetic oligonucleotide
ttttctgaaaaaatttataaactcaatgaggacatggcttgcagtgtg

SEQ ID NO: 97103 - DNA, 47 bp, Artificial Sequence
  Description of Artificial Sequence: Synthetic oligonucleotide
tttctgaaaaaatttataaactcaatgaggacatggcttgcagtgtg

SEQ ID NO: 97104 - DNA, 46 bp, Artificial Sequence
  Description of Artificial Sequence: Synthetic oligonucleotide
ttctgaaaaaatttataaactcaatgaggacatggcttgcagtgtg

SEQ ID NO: 97105 - DNA, 45 bp, Artificial Sequence
  Description of Artificial Sequence: Synthetic oligonucleotide
tctgaaaaaatttataaactcaatgaggacatggcttgcagtgtg

SEQ ID NO: 97106 - DNA, 44 bp, Artificial Sequence
  Description of Artificial Sequence: Synthetic oligonucleotide
ctgaaaaaatttataaactcaatgaggacatggcttgcagtgtg

SEQ ID NO: 97107 - DNA, 44 bp, Artificial Sequence
  Description of Artificial Sequence: Synthetic oligonucleotide
tgaaaaaatttataaactcaatgaggacatggcttgcagtgtgg

SEQ ID NO: 97108 - DNA, 43 bp, Artificial Sequence
  Description of Artificial Sequence: Synthetic oligonucleotide
gaaaaaatttataaactcaatgaggacatggcttgcagtgtgg

SEQ ID NO: 97109 - DNA, 43 bp, Artificial Sequence
  Description of Artificial Sequence: Synthetic oligonucleotide
aaaaaatttataaactcaatgaggacatggcttgcagtgtggc

SEQ ID NO: 97110 - DNA, 42 bp, Artificial Sequence
  Description of Artificial Sequence: Synthetic oligonucleotide
aaaaatttataaactcaatgaggacatggcttgcagtgtggc

SEQ ID NO: 97111 - DNA, 41 bp, Artificial Sequence
  Description of Artificial Sequence: Synthetic oligonucleotide
aaaatttataaactcaatgaggacatggcttgcagtgtggc

SEQ ID NO: 97112 - DNA, 40 bp, Artificial Sequence
  Description of Artificial Sequence: Synthetic oligonucleotide
aaatttataaactcaatgaggacatggcttgcagtgtggc

SEQ ID NO: 97113 - DNA, 39 bp, Artificial Sequence
  Description of Artificial Sequence: Synthetic oligonucleotide
aatttataaactcaatgaggacatggcttgcagtgtggc

SEQ ID NO: 97114 - DNA, 38 bp, Artificial Sequence
  Description of Artificial Sequence: Synthetic oligonucleotide
atttataaactcaatgaggacatggcttgcagtgtggc

SEQ ID NO: 97115 - DNA, 37 bp, Artificial Sequence
  Description of Artificial Sequence: Synthetic oligonucleotide
tttataaactcaatgaggacatggcttgcagtgtggc

SEQ ID NO: 97116 - DNA, 36 bp, Artificial Sequence
  Description of Artificial Sequence: Synthetic oligonucleotide
ttataaactcaatgaggacatggcttgcagtgtggc

SEQ ID NO: 97117 - DNA, 35 bp, Artificial Sequence
  Description of Artificial Sequence: Synthetic oligonucleotide
tataaactcaatgaggacatggcttgcagtgtggc

SEQ ID NO: 97118 - DNA, 34 bp, Artificial Sequence
  Description of Artificial Sequence: Synthetic oligonucleotide
ataaactcaatgaggacatggcttgcagtgtggc

SEQ ID NO: 97119 - DNA, 33 bp, Artificial Sequence
  Description of Artificial Sequence: Synthetic oligonucleotide
taaactcaatgaggacatggcttgcagtgtggc

SEQ ID NO: 97120 - DNA, 32 bp, Artificial Sequence
  Description of Artificial Sequence: Synthetic oligonucleotide
aaactcaatgaggacatggcttgcagtgtggc

SEQ ID NO: 97121 - DNA, 31 bp, Artificial Sequence
  Description of Artificial Sequence: Synthetic oligonucleotide
aactcaatgaggacatggcttgcagtgtggc

SEQ ID NO: 97122 - DNA, 30 bp, Artificial Sequence
  Description of Artificial Sequence: Synthetic oligonucleotide
actcaatgaggacatggcttgcagtgtggc

SEQ ID NO: 97123 - DNA, 29 bp, Artificial Sequence
  Description of Artificial Sequence: Synthetic oligonucleotide
ctcaatgaggacatggcttgcagtgtggc

SEQ ID NO: 97124 - DNA, 30 bp, Artificial Sequence
  Description of Artificial Sequence: Synthetic oligonucleotide
tcaatgaggacatggcttgcagtgtggcag

SEQ ID NO: 97125 - DNA, 29 bp, Artificial Sequence
  Description of Artificial Sequence: Synthetic oligonucleotide
caatgaggacatggcttgcagtgtggcag

SEQ ID NO: 97126 - DNA, 29 bp, Artificial Sequence
  Description of Artificial Sequence: Synthetic oligonucleotide
aatgaggacatggcttgcagtgtggcagg

SEQ ID NO: 97127 - DNA, 28 bp, Artificial Sequence
  Description of Artificial Sequence: Synthetic oligonucleotide
atgaggacatggcttgcagtgtggcagg

SEQ ID NO: 97128 - DNA, 27 bp, Artificial Sequence
  Description of Artificial Sequence: Synthetic oligonucleotide
tgaggacatggcttgcagtgtggcagg

SEQ ID NO: 97129 - DNA, 26 bp, Artificial Sequence
  Description of Artificial Sequence: Synthetic oligonucleotide
gaggacatggcttgcagtgtggcagg

SEQ ID NO: 97130 - DNA, 27 bp, Artificial Sequence
  Description of Artificial Sequence: Synthetic oligonucleotide
aggacatggcttgcagtgtggcaggca

SEQ ID NO: 97131 - DNA, 27 bp, Artificial Sequence
  Description of Artificial Sequence: Synthetic oligonucleotide
ggacatggcttgcagtgtggcaggcat

SEQ ID NO: 97132 - DNA, 29 bp, Artificial Sequence
  Description of Artificial Sequence: Synthetic oligonucleotide
gacatggcttgcagtgtggcaggcataac

SEQ ID NO: 97133 - DNA, 31 bp, Artificial Sequence
  Description of Artificial Sequence: Synthetic oligonucleotide
acatggcttgcagtgtggcaggcataacttc

SEQ ID NO: 97134 - DNA, 30 bp, Artificial Sequence
  Description of Artificial Sequence: Synthetic oligonucleotide
catggcttgcagtgtggcaggcataacttc

SEQ ID NO: 97135 - DNA, 31 bp, Artificial Sequence
  Description of Artificial Sequence: Synthetic oligonucleotide
atggcttgcagtgtggcaggcataacttctg

SEQ ID NO: 97136 - DNA, 30 bp, Artificial Sequence
  Description of Artificial Sequence: Synthetic oligonucleotide
tggcttgcagtgtggcaggcataacttctg

SEQ ID NO: 97137 - DNA, 29 bp, Artificial Sequence
  Description of Artificial Sequence: Synthetic oligonucleotide
ggcttgcagtgtggcaggcataacttctg

SEQ ID NO: 97138 - DNA, 31 bp, Artificial Sequence
  Description of Artificial Sequence: Synthetic oligonucleotide
gcttgcagtgtggcaggcataacttctgatg

SEQ ID NO: 97139 - DNA, 31 bp, Artificial Sequence
  Description of Artificial Sequence: Synthetic oligonucleotide
cttgcagtgtggcaggcataacttctgatgc

SEQ ID NO: 97140 - DNA, 35 bp, Artificial Sequence
  Description of Artificial Sequence: Synthetic oligonucleotide
ttgcagtgtggcaggcataacttctgatgctaatg

SEQ ID NO: 97141 - DNA, 34 bp, Artificial Sequence
  Description of Artificial Sequence: Synthetic oligonucleotide
tgcagtgtggcaggcataacttctgatgctaatg

SEQ ID NO: 97142 - DNA, 33 bp, Artificial Sequence
  Description of Artificial Sequence: Synthetic oligonucleotide
gcagtgtggcaggcataacttctgatgctaatg

SEQ ID NO: 97143 - DNA, 35 bp, Artificial Sequence
  Description of Artificial Sequence: Synthetic oligonucleotide
cagtgtggcaggcataacttctgatgctaatgttc

SEQ ID NO: 97144 - DNA, 36 bp, Artificial Sequence
  Description of Artificial Sequence: Synthetic oligonucleotide
agtgtggcaggcataacttctgatgctaatgttctg

SEQ ID NO: 97145 - DNA, 35 bp, Artificial Sequence
  Description of Artificial Sequence: Synthetic oligonucleotide
gtgtggcaggcataacttctgatgctaatgttctg

SEQ ID NO: 97146 - DNA, 36 bp, Artificial Sequence
  Description of Artificial Sequence: Synthetic oligonucleotide
tgtggcaggcataacttctgatgctaatgttctgac

SEQ ID NO: 97147 - DNA, 35 bp, Artificial Sequence
  Description of Artificial Sequence: Synthetic oligonucleotide
gtggcaggcataacttctgatgctaatgttctgac

SEQ ID NO: 97148 - DNA, 39 bp, Artificial Sequence
  Description of Artificial Sequence: Synthetic oligonucleotide
tggcaggcataacttctgatgctaatgttctgactaatg

SEQ ID NO: 97149 - DNA, 38 bp, Artificial Sequence
  Description of Artificial Sequence: Synthetic oligonucleotide
ggcaggcataacttctgatgctaatgttctgactaatg

SEQ ID NO: 97150 - DNA, 40 bp, Artificial Sequence
  Description of Artificial Sequence: Synthetic oligonucleotide
gcaggcataacttctgatgctaatgttctgactaatgaac

SEQ ID NO: 97151 - DNA, 43 bp, Artificial Sequence
  Description of Artificial Sequence: Synthetic oligonucleotide
caggcataacttctgatgctaatgttctgactaatgaactaag

SEQ ID NO: 97152 - DNA, 43 bp, Artificial Sequence
  Description of Artificial Sequence: Synthetic oligonucleotide
aggcataacttctgatgctaatgttctgactaatgaactaagg

SEQ ID NO: 97153 - DNA, 42 bp, Artificial Sequence
  Description of Artificial Sequence: Synthetic oligonucleotide
ggcataacttctgatgctaatgttctgactaatgaactaagg

SEQ ID NO: 97154 - DNA, 42 bp, Artificial Sequence
  Description of Artificial Sequence: Synthetic oligonucleotide
gcataacttctgatgctaatgttctgactaatgaactaaggc

SEQ ID NO: 97155 - DNA, 43 bp, Artificial Sequence
  Description of Artificial Sequence: Synthetic oligonucleotide
cataacttctgatgctaatgttctgactaatgaactaaggctc

SEQ ID NO: 97156 - DNA, 46 bp, Artificial Sequence
  Description of Artificial Sequence: Synthetic oligonucleotide
ataacttctgatgctaatgttctgactaatgaactaaggctcattg

SEQ ID NO: 97157 - DNA, 45 bp, Artificial Sequence
  Description of Artificial Sequence: Synthetic oligonucleotide
taacttctgatgctaatgttctgactaatgaactaaggctcattg

SEQ ID NO: 97158 - DNA, 44 bp, Artificial Sequence
  Description of Artificial Sequence: Synthetic oligonucleotide
aacttctgatgctaatgttctgactaatgaactaaggctcattg

SEQ ID NO: 97159 - DNA, 43 bp, Artificial Sequence
  Description of Artificial Sequence: Synthetic oligonucleotide
acttctgatgctaatgttctgactaatgaactaaggctcattg

SEQ ID NO: 97160 - DNA, 42 bp, Artificial Sequence
  Description of Artificial Sequence: Synthetic oligonucleotide
cttctgatgctaatgttctgactaatgaactaaggctcattg

SEQ ID NO: 97161 - DNA, 42 bp, Artificial Sequence
  Description of Artificial Sequence: Synthetic oligonucleotide
ttctgatgctaatgttctgactaatgaactaaggctcattgc

SEQ ID NO: 97162 - DNA, 41 bp, Artificial Sequence
  Description of Artificial Sequence: Synthetic oligonucleotide
tctgatgctaatgttctgactaatgaactaaggctcattgc

SEQ ID NO: 97163 - DNA, 40 bp, Artificial Sequence
  Description of Artificial Sequence: Synthetic oligonucleotide
ctgatgctaatgttctgactaatgaactaaggctcattgc

SEQ ID NO: 97164 - DNA, 41 bp, Artificial Sequence
  Description of Artificial Sequence: Synthetic oligonucleotide
tgatgctaatgttctgactaatgaactaaggctcattgctc

SEQ ID NO: 97165 - DNA, 40 bp, Artificial Sequence
  Description of Artificial Sequence: Synthetic oligonucleotide
gatgctaatgttctgactaatgaactaaggctcattgctc

SEQ ID NO: 97166 - DNA, 43 bp, Artificial Sequence
  Description of Artificial Sequence: Synthetic oligonucleotide
atgctaatgttctgactaatgaactaaggctcattgctcaaag

SEQ ID NO: 97167 - DNA, 42 bp, Artificial Sequence
  Description of Artificial Sequence: Synthetic oligonucleotide
tgctaatgttctgactaatgaactaaggctcattgctcaaag

SEQ ID NO: 97168 - DNA, 41 bp, Artificial Sequence
  Description of Artificial Sequence: Synthetic oligonucleotide
gctaatgttctgactaatgaactaaggctcattgctcaaag

SEQ ID NO: 97169 - DNA, 41 bp, Artificial Sequence
  Description of Artificial Sequence: Synthetic oligonucleotide
ctaatgttctgactaatgaactaaggctcattgctcaaagg

SEQ ID NO: 97170 - DNA, 50 bp, Artificial Sequence
  Description of Artificial Sequence: Synthetic oligonucleotide
taatgttctgactaatgaactaaggctcattgctcaaaggtatttattac

SEQ ID NO: 97171 - DNA, 49 bp, Artificial Sequence
  Description of Artificial Sequence: Synthetic oligonucleotide
aatgttctgactaatgaactaaggctcattgctcaaaggtatttattac

SEQ ID NO: 97172 - DNA, 48 bp, Artificial Sequence
  Description of Artificial Sequence: Synthetic oligonucleotide
atgttctgactaatgaactaaggctcattgctcaaaggtatttattac

SEQ ID NO: 97173 - DNA, 47 bp, Artificial Sequence
  Description of Artificial Sequence: Synthetic oligonucleotide
tgttctgactaatgaactaaggctcattgctcaaaggtatttattac

SEQ ID NO: 97174 - DNA, 46 bp, Artificial Sequence
  Description of Artificial Sequence: Synthetic oligonucleotide
gttctgactaatgaactaaggctcattgctcaaaggtatttattac

SEQ ID NO: 97175 - DNA, 47 bp, Artificial Sequence
  Description of Artificial Sequence: Synthetic oligonucleotide
ttctgactaatgaactaaggctcattgctcaaaggtatttattacag

SEQ ID NO: 97176 - DNA, 46 bp, Artificial Sequence
  Description of Artificial Sequence: Synthetic oligonucleotide
tctgactaatgaactaaggctcattgctcaaaggtatttattacag

SEQ ID NO: 97177 - DNA, 45 bp, Artificial Sequence
  Description of Artificial Sequence: Synthetic oligonucleotide
ctgactaatgaactaaggctcattgctcaaaggtatttattacag

SEQ ID NO: 97178 - DNA, 48 bp, Artificial Sequence
  Description of Artificial Sequence: Synthetic oligonucleotide
tgactaatgaactaaggctcattgctcaaaggtatttattacagtatc

SEQ ID NO: 97179 - DNA, 47 bp, Artificial Sequence
  Description of Artificial Sequence: Synthetic oligonucleotide
gactaatgaactaaggctcattgctcaaaggtatttattacagtatc

SEQ ID NO: 97180 - DNA, 48 bp, Artificial Sequence
  Description of Artificial Sequence: Synthetic oligonucleotide
actaatgaactaaggctcattgctcaaaggtatttattacagtatcag

SEQ ID NO: 97181 - DNA, 47 bp, Artificial Sequence
  Description of Artificial Sequence: Synthetic oligonucleotide
ctaatgaactaaggctcattgctcaaaggtatttattacagtatcag

SEQ ID NO: 97182 - DNA, 47 bp, Artificial Sequence
  Description of Artificial Sequence: Synthetic oligonucleotide
taatgaactaaggctcattgctcaaaggtatttattacagtatcagg

SEQ ID NO: 97183 - DNA, 46 bp, Artificial Sequence
  Description of Artificial Sequence: Synthetic oligonucleotide
aatgaactaaggctcattgctcaaaggtatttattacagtatcagg

SEQ ID NO: 97184 - DNA, 45 bp, Artificial Sequence
  Description of Artificial Sequence: Synthetic oligonucleotide
atgaactaaggctcattgctcaaaggtatttattacagtatcagg

SEQ ID NO: 97185 - DNA, 44 bp, Artificial Sequence
  Description of Artificial Sequence: Synthetic oligonucleotide
tgaactaaggctcattgctcaaaggtatttattacagtatcagg

SEQ ID NO: 97186 - DNA, 43 bp, Artificial Sequence
  Description of Artificial Sequence: Synthetic oligonucleotide
gaactaaggctcattgctcaaaggtatttattacagtatcagg

SEQ ID NO: 97187 - DNA, 44 bp, Artificial Sequence
  Description of Artificial Sequence: Synthetic oligonucleotide
aactaaggctcattgctcaaaggtatttattacagtatcaggag

SEQ ID NO: 97188 - DNA, 43 bp, Artificial Sequence
  Description of Artificial Sequence: Synthetic oligonucleotide
actaaggctcattgctcaaaggtatttattacagtatcaggag

SEQ ID NO: 97189 - DNA, 42 bp, Artificial Sequence
  Description of Artificial Sequence: Synthetic oligonucleotide
ctaaggctcattgctcaaaggtatttattacagtatcaggag

SEQ ID NO: 97190 - DNA, 42 bp, Artificial Sequence
  Description of Artificial Sequence: Synthetic oligonucleotide
taaggctcattgctcaaaggtatttattacagtatcaggagc

SEQ ID NO: 97191 - DNA, 41 bp, Artificial Sequence
  Description of Artificial Sequence: Synthetic oligonucleotide
aaggctcattgctcaaaggtatttattacagtatcaggagc

SEQ ID NO: 97192 - DNA, 40 bp, Artificial Sequence
  Description of Artificial Sequence: Synthetic oligonucleotide
aggctcattgctcaaaggtatttattacagtatcaggagc

SEQ ID NO: 97193 - DNA, 39 bp, Artificial Sequence
  Description of Artificial Sequence: Synthetic oligonucleotide
ggctcattgctcaaaggtatttattacagtatcaggagc

SEQ ID NO: 97194 - DNA, 39 bp, Artificial Sequence
  Description of Artificial Sequence: Synthetic oligonucleotide
gctcattgctcaaaggtatttattacagtatcaggagcc

SEQ ID NO: 97195 - DNA, 43 bp, Artificial Sequence
  Description of Artificial Sequence: Synthetic oligonucleotide
ctcattgctcaaaggtatttattacagtatcaggagccaatac

SEQ ID NO: 97196 - DNA, 43 bp, Artificial Sequence
  Description of Artificial Sequence: Synthetic oligonucleotide
tcattgctcaaaggtatttattacagtatcaggagccaatacc

SEQ ID NO: 97197 - DNA, 42 bp, Artificial Sequence
  Description of Artificial Sequence: Synthetic oligonucleotide
cattgctcaaaggtatttattacagtatcaggagccaatacc

SEQ ID NO: 97198 - DNA, 44 bp, Artificial Sequence
  Description of Artificial Sequence: Synthetic oligonucleotide
attgctcaaaggtatttattacagtatcaggagccaataccttg

SEQ ID NO: 97199 - DNA, 43 bp, Artificial Sequence
  Description of Artificial Sequence: Synthetic oligonucleotide
ttgctcaaaggtatttattacagtatcaggagccaataccttg

SEQ ID NO: 97200 - DNA, 42 bp, Artificial Sequence
  Description of Artificial Sequence: Synthetic oligonucleotide
tgctcaaaggtatttattacagtatcaggagccaataccttg

SEQ ID NO: 97201 - DNA, 41 bp, Artificial Sequence
  Description of Artificial Sequence: Synthetic oligonucleotide
gctcaaaggtatttattacagtatcaggagccaataccttg

SEQ ID NO: 97202 - DNA, 42 bp, Artificial Sequence
  Description of Artificial Sequence: Synthetic oligonucleotide
ctcaaaggtatttattacagtatcaggagccaataccttgtg

SEQ ID NO: 97203 - DNA, 43 bp, Artificial Sequence
  Description of Artificial Sequence: Synthetic oligonucleotide
tcaaaggtatttattacagtatcaggagccaataccttgtgag

SEQ ID NO: 97204 - DNA, 42 bp, Artificial Sequence
  Description of Artificial Sequence: Synthetic oligonucleotide
caaaggtatttattacagtatcaggagccaataccttgtgag

SEQ ID NO: 97205 - DNA, 42 bp, Artificial Sequence
  Description of Artificial Sequence: Synthetic oligonucleotide
aaaggtatttattacagtatcaggagccaataccttgtgagc

SEQ ID NO: 97206 - DNA, 41 bp, Artificial Sequence
  Description of Artificial Sequence: Synthetic oligonucleotide
aaggtatttattacagtatcaggagccaataccttgtgagc

SEQ ID NO: 97207 - DNA, 40 bp, Artificial Sequence
  Description of Artificial Sequence: Synthetic oligonucleotide
aggtatttattacagtatcaggagccaataccttgtgagc

SEQ ID NO: 97208 - DNA, 39 bp, Artificial Sequence
  Description of Artificial Sequence: Synthetic oligonucleotide
ggtatttattacagtatcaggagccaataccttgtgagc

SEQ ID NO: 97209 - DNA, 40 bp, Artificial Sequence
  Description of Artificial Sequence: Synthetic oligonucleotide
gtatttattacagtatcaggagccaataccttgtgagcag

SEQ ID NO: 97210 - DNA, 42 bp, Artificial Sequence
  Description of Artificial Sequence: Synthetic oligonucleotide
tatttattacagtatcaggagccaataccttgtgagcagttg

SEQ ID NO: 97211 - DNA, 41 bp, Artificial Sequence
  Description of Artificial Sequence: Synthetic oligonucleotide
atttattacagtatcaggagccaataccttgtgagcagttg

SEQ ID NO: 97212 - DNA, 40 bp, Artificial Sequence
  Description of Artificial Sequence: Synthetic oligonucleotide
tttattacagtatcaggagccaataccttgtgagcagttg

SEQ ID NO: 97213 - DNA, 39 bp, Artificial Sequence
  Description of Artificial Sequence: Synthetic oligonucleotide
ttattacagtatcaggagccaataccttgtgagcagttg

SEQ ID NO: 97214 - DNA, 38 bp, Artificial Sequence
  Description of Artificial Sequence: Synthetic oligonucleotide
tattacagtatcaggagccaataccttgtgagcagttg

SEQ ID NO: 97215 - DNA, 37 bp, Artificial Sequence
  Description of Artificial Sequence: Synthetic oligonucleotide
attacagtatcaggagccaataccttgtgagcagttg

SEQ ID NO: 97216 - DNA, 36 bp, Artificial Sequence
  Description of Artificial Sequence: Synthetic oligonucleotide
ttacagtatcaggagccaataccttgtgagcagttg

SEQ ID NO: 97217 - DNA, 35 bp, Artificial Sequence
  Description of Artificial Sequence: Synthetic oligonucleotide
tacagtatcaggagccaataccttgtgagcagttg

SEQ ID NO: 97218 - DNA, 34 bp, Artificial Sequence
  Description of Artificial Sequence: Synthetic oligonucleotide
acagtatcaggagccaataccttgtgagcagttg

SEQ ID NO: 97219 - DNA, 33 bp, Artificial Sequence
  Description of Artificial Sequence: Synthetic oligonucleotide
cagtatcaggagccaataccttgtgagcagttg

SEQ ID NO: 97220 - DNA, 33 bp, Artificial Sequence
  Description of Artificial Sequence: Synthetic oligonucleotide
agtatcaggagccaataccttgtgagcagttgg

SEQ ID NO: 97221 - DNA, 32 bp, Artificial Sequence
  Description of Artificial Sequence: Synthetic oligonucleotide
gtatcaggagccaataccttgtgagcagttgg

SEQ ID NO: 97222 - DNA, 35 bp, Artificial Sequence
  Description of Artificial Sequence: Synthetic oligonucleotide
tatcaggagccaataccttgtgagcagttggttac

SEQ ID NO: 97223 - DNA, 34 bp, Artificial Sequence
  Description of Artificial Sequence: Synthetic oligonucleotide
atcaggagccaataccttgtgagcagttggttac

SEQ ID NO: 97224 - DNA, 33 bp, Artificial Sequence
  Description of Artificial Sequence: Synthetic oligonucleotide
tcaggagccaataccttgtgagcagttggttac

SEQ ID NO: 97225 - DNA, 32 bp, Artificial Sequence
  Description of Artificial Sequence: Synthetic oligonucleotide
caggagccaataccttgtgagcagttggttac

SEQ ID NO: 97226 - DNA, 33 bp, Artificial Sequence
  Description of Artificial Sequence: Synthetic oligonucleotide
aggagccaataccttgtgagcagttggttacag

SEQ ID NO: 97227 - DNA, 32 bp, Artificial Sequence
  Description of Artificial Sequence: Synthetic oligonucleotide
ggagccaataccttgtgagcagttggttacag

SEQ ID NO: 97228 - DNA, 32 bp, Artificial Sequence
  Description of Artificial Sequence: Synthetic oligonucleotide
gagccaataccttgtgagcagttggttacagc

SEQ ID NO: 97229 - DNA, 32 bp, Artificial Sequence
  Description of Artificial Sequence: Synthetic oligonucleotide
agccaataccttgtgagcagttggttacagcg

SEQ ID NO: 97230 - DNA, 31 bp, Artificial Sequence
  Description of Artificial Sequence: Synthetic oligonucleotide
gccaataccttgtgagcagttggttacagcg

SEQ ID NO: 97231 - DNA, 31 bp, Artificial Sequence
  Description of Artificial Sequence: Synthetic oligonucleotide
ccaataccttgtgagcagttggttacagcgc

SEQ ID NO: 97232 - DNA, 32 bp, Artificial Sequence
  Description of Artificial Sequence: Synthetic oligonucleotide
caataccttgtgagcagttggttacagcgctg

SEQ ID NO: 97233 - DNA, 33 bp, Artificial Sequence
  Description of Artificial Sequence: Synthetic oligonucleotide
aataccttgtgagcagttggttacagcgctgtg

SEQ ID NO: 97234 - DNA, 32 bp, Artificial Sequence
  Description of Artificial Sequence: Synthetic oligonucleotide
ataccttgtgagcagttggttacagcgctgtg

SEQ ID NO: 97235 - DNA, 31 bp, Artificial Sequence
  Description of Artificial Sequence: Synthetic oligonucleotide
taccttgtgagcagttggttacagcgctgtg

SEQ ID NO: 97236 - DNA, 30 bp, Artificial Sequence
  Description of Artificial Sequence: Synthetic oligonucleotide
accttgtgagcagttggttacagcgctgtg

SEQ ID NO: 97237 - DNA, 29 bp, Artificial Sequence
  Description of Artificial Sequence: Synthetic oligonucleotide
ccttgtgagcagttggttacagcgctgtg

SEQ ID NO: 97238 - DNA, 30 bp, Artificial Sequence
  Description of Artificial Sequence: Synthetic oligonucleotide
cttgtgagcagttggttacagcgctgtgtg

SEQ ID NO: 97239 - DNA, 34 bp, Artificial Sequence
  Description of Artificial Sequence: Synthetic oligonucleotide
ttgtgagcagttggttacagcgctgtgtgatatc

SEQ ID NO: 97240 - DNA, 33 bp, Artificial Sequence
  Description of Artificial Sequence: Synthetic oligonucleotide
tgtgagcagttggttacagcgctgtgtgatatc

SEQ ID NO: 97241 - DNA, 32 bp, Artificial Sequence
  Description of Artificial Sequence: Synthetic oligonucleotide
gtgagcagttggttacagcgctgtgtgatatc

SEQ ID NO: 97242 - DNA, 35 bp, Artificial Sequence
  Description of Artificial Sequence: Synthetic oligonucleotide
tgagcagttggttacagcgctgtgtgatatcaaac

SEQ ID NO: 97243 - DNA, 34 bp, Artificial Sequence
  Description of Artificial Sequence: Synthetic oligonucleotide
gagcagttggttacagcgctgtgtgatatcaaac

SEQ ID NO: 97244 - DNA, 36 bp, Artificial Sequence
  Description of Artificial Sequence: Synthetic oligonucleotide
agcagttggttacagcgctgtgtgatatcaaacaag

SEQ ID NO: 97245 - DNA, 35 bp, Artificial Sequence
  Description of Artificial Sequence: Synthetic oligonucleotide
gcagttggttacagcgctgtgtgatatcaaacaag

SEQ ID NO: 97246 - DNA, 35 bp, Artificial Sequence
  Description of Artificial Sequence: Synthetic oligonucleotide
cagttggttacagcgctgtgtgatatcaaacaagc

SEQ ID NO: 97247 - DNA, 40 bp, Artificial Sequence
  Description of Artificial Sequence: Synthetic oligonucleotide
agttggttacagcgctgtgtgatatcaaacaagcttatac

SEQ ID NO: 97248 - DNA, 39 bp, Artificial Sequence
  Description of Artificial Sequence: Synthetic oligonucleotide
gttggttacagcgctgtgtgatatcaaacaagcttatac

SEQ ID NO: 97249 - DNA, 40 bp, Artificial Sequence
  Description of Artificial Sequence: Synthetic oligonucleotide
ttggttacagcgctgtgtgatatcaaacaagcttatacac

SEQ ID NO: 97250 - DNA, 39 bp, Artificial Sequence
  Description of Artificial Sequence: Synthetic oligonucleotide
tggttacagcgctgtgtgatatcaaacaagcttatacac

SEQ ID NO: 97251 - DNA, 38 bp, Artificial Sequence
  Description of Artificial Sequence: Synthetic oligonucleotide
ggttacagcgctgtgtgatatcaaacaagcttatacac

SEQ ID NO: 97252 - DNA, 43 bp, Artificial Sequence
  Description of Artificial Sequence: Synthetic oligonucleotide
gttacagcgctgtgtgatatcaaacaagcttatacacaatttg

SEQ ID NO: 97253 - DNA, 43 bp, Artificial Sequence
  Description of Artificial Sequence: Synthetic oligonucleotide
ttacagcgctgtgtgatatcaaacaagcttatacacaatttgg

SEQ ID NO: 97254 - DNA, 42 bp, Artificial Sequence
  Description of Artificial Sequence: Synthetic oligonucleotide
tacagcgctgtgtgatatcaaacaagcttatacacaatttgg

SEQ ID NO: 97255 - DNA, 41 bp, Artificial Sequence
  Description of Artificial Sequence: Synthetic oligonucleotide
acagcgctgtgtgatatcaaacaagcttatacacaatttgg

SEQ ID NO: 97256 - DNA, 40 bp, Artificial Sequence
  Description of Artificial Sequence: Synthetic oligonucleotide
cagcgctgtgtgatatcaaacaagcttatacacaatttgg

SEQ ID NO: 97257 - DNA, 41 bp, Artificial Sequence
  Description of Artificial Sequence: Synthetic oligonucleotide
agcgctgtgtgatatcaaacaagcttatacacaatttggag

SEQ ID NO: 97258 - DNA, 40 bp, Artificial Sequence
  Description of Artificial Sequence: Synthetic oligonucleotide
gcgctgtgtgatatcaaacaagcttatacacaatttggag

SEQ ID NO: 97259 - DNA, 40 bp, Artificial Sequence
  Description of Artificial Sequence: Synthetic oligonucleotide
cgctgtgtgatatcaaacaagcttatacacaatttggagg

SEQ ID NO: 97260 - DNA, 44 bp, Artificial Sequence
  Description of Artificial Sequence: Synthetic oligonucleotide
gctgtgtgatatcaaacaagcttatacacaatttggaggaaaac

SEQ ID NO: 97261 - DNA, 44 bp, Artificial Sequence
  Description of Artificial Sequence: Synthetic oligonucleotide
ctgtgtgatatcaaacaagcttatacacaatttggaggaaaacg

SEQ ID NO: 97262 - DNA, 45 bp, Artificial Sequence
  Description of Artificial Sequence: Synthetic oligonucleotide
tgtgtgatatcaaacaagcttatacacaatttggaggaaaacgtc

SEQ ID NO: 97263 - DNA, 44 bp, Artificial Sequence
  Description of Artificial Sequence: Synthetic oligonucleotide
gtgtgatatcaaacaagcttatacacaatttggaggaaaacgtc

SEQ ID NO: 97264 - DNA, 44 bp, Artificial Sequence
  Description of Artificial Sequence: Synthetic oligonucleotide
tgtgatatcaaacaagcttatacacaatttggaggaaaacgtcc

SEQ ID NO: 97265 - DNA, 43 bp, Artificial Sequence
  Description of Artificial Sequence: Synthetic oligonucleotide
gtgatatcaaacaagcttatacacaatttggaggaaaacgtcc

SEQ ID NO: 97266 - DNA, 43 bp, Artificial Sequence
  Description of Artificial Sequence: Synthetic oligonucleotide
tgatatcaaacaagcttatacacaatttggaggaaaacgtccc

SEQ ID NO: 97267 - DNA, 42 bp, Artificial Sequence
  Description of Artificial Sequence: Synthetic oligonucleotide
gatatcaaacaagcttatacacaatttggaggaaaacgtccc

SEQ ID NO: 97268 - DNA, 45 bp, Artificial Sequence
  Description of Artificial Sequence: Synthetic oligonucleotide
atatcaaacaagcttatacacaatttggaggaaaacgtccctttg

SEQ ID NO: 97269 - DNA, 44 bp, Artificial Sequence
  Description of Artificial Sequence: Synthetic oligonucleotide
tatcaaacaagcttatacacaatttggaggaaaacgtccctttg

SEQ ID NO: 97270 - DNA, 43 bp, Artificial Sequence
  Description of Artificial Sequence: Synthetic oligonucleotide
atcaaacaagcttatacacaatttggaggaaaacgtccctttg

SEQ ID NO: 97271 - DNA, 42 bp, Artificial Sequence
  Description of Artificial Sequence: Synthetic oligonucleotide
tcaaacaagcttatacacaatttggaggaaaacgtccctttg

SEQ ID NO: 97272 - DNA, 41 bp, Artificial Sequence
  Description of Artificial Sequence: Synthetic oligonucleotide
caaacaagcttatacacaatttggaggaaaacgtccctttg

SEQ ID NO: 97273 - DNA, 41 bp, Artificial Sequence
  Description of Artificial Sequence: Synthetic oligonucleotide
aaacaagcttatacacaatttggaggaaaacgtccctttgg

SEQ ID NO: 97274 - DNA, 40 bp, Artificial Sequence
  Description of Artificial Sequence: Synthetic oligonucleotide
aacaagcttatacacaatttggaggaaaacgtccctttgg

SEQ ID NO: 97275 - DNA, 39 bp, Artificial Sequence
  Description of Artificial Sequence: Synthetic oligonucleotide
acaagcttatacacaatttggaggaaaacgtccctttgg

SEQ ID NO: 97276 - DNA, 38 bp, Artificial Sequence
  Description of Artificial Sequence: Synthetic oligonucleotide
caagcttatacacaatttggaggaaaacgtccctttgg

SEQ ID NO: 97277 - DNA, 39 bp, Artificial Sequence
  Description of Artificial Sequence: Synthetic oligonucleotide
aagcttatacacaatttggaggaaaacgtccctttggtg

SEQ ID NO: 97278 - DNA, 38 bp, Artificial Sequence
  Description of Artificial Sequence: Synthetic oligonucleotide
agcttatacacaatttggaggaaaacgtccctttggtg

SEQ ID NO: 97279 - DNA, 37 bp, Artificial Sequence
  Description of Artificial Sequence: Synthetic oligonucleotide
gcttatacacaatttggaggaaaacgtccctttggtg

SEQ ID NO: 97280 - DNA, 40 bp, Artificial Sequence
  Description of Artificial Sequence: Synthetic oligonucleotide
cttatacacaatttggaggaaaacgtccctttggtgtttc

SEQ ID NO: 97281 - DNA, 43 bp, Artificial Sequence
  Description of Artificial Sequence: Synthetic oligonucleotide
ttatacacaatttggaggaaaacgtccctttggtgtttcattg

SEQ ID NO: 97282 - DNA, 42 bp, Artificial Sequence
  Description of Artificial Sequence: Synthetic oligonucleotide
tatacacaatttggaggaaaacgtccctttggtgtttcattg

SEQ ID NO: 97283 - DNA, 41 bp, Artificial Sequence
  Description of Artificial Sequence: Synthetic oligonucleotide
atacacaatttggaggaaaacgtccctttggtgtttcattg

SEQ ID NO: 97284 - DNA, 40 bp, Artificial Sequence
  Description of Artificial Sequence: Synthetic oligonucleotide
tacacaatttggaggaaaacgtccctttggtgtttcattg

SEQ ID NO: 97285 - DNA, 39 bp, Artificial Sequence
  Description of Artificial Sequence: Synthetic oligonucleotide
acacaatttggaggaaaacgtccctttggtgtttcattg

SEQ ID NO: 97286 - DNA, 38 bp, Artificial Sequence
  Description of Artificial Sequence: Synthetic oligonucleotide
cacaatttggaggaaaacgtccctttggtgtttcattg

SEQ ID NO: 97287 - DNA, 38 bp, Artificial Sequence
  Description of Artificial Sequence: Synthetic oligonucleotide
acaatttggaggaaaacgtccctttggtgtttcattgc

SEQ ID NO: 97288 - DNA, 37 bp, Artificial Sequence
  Description of Artificial Sequence: Synthetic oligonucleotide
caatttggaggaaaacgtccctttggtgtttcattgc

SEQ ID NO: 97289 - DNA, 38 bp, Artificial Sequence
  Description of Artificial Sequence: Synthetic oligonucleotide
aatttggaggaaaacgtccctttggtgtttcattgctg

SEQ ID NO: 97290 - DNA, 37 bp, Artificial Sequence
  Description of Artificial Sequence: Synthetic oligonucleotide
atttggaggaaaacgtccctttggtgtttcattgctg

SEQ ID NO: 97291 - DNA, 36 bp, Artificial Sequence
  Description of Artificial Sequence: Synthetic oligonucleotide
tttggaggaaaacgtccctttggtgtttcattgctg

SEQ ID NO: 97292 - DNA, 35 bp, Artificial Sequence
  Description of Artificial Sequence: Synthetic oligonucleotide
ttggaggaaaacgtccctttggtgtttcattgctg

SEQ ID NO: 97293 - DNA, 34 bp, Artificial Sequence
  Description of Artificial Sequence: Synthetic oligonucleotide
tggaggaaaacgtccctttggtgtttcattgctg

SEQ ID NO: 97294 - DNA, 33 bp, Artificial Sequence
  Description of Artificial Sequence: Synthetic oligonucleotide
ggaggaaaacgtccctttggtgtttcattgctg

SEQ ID NO: 97295 - DNA, 35 bp, Artificial Sequence
  Description of Artificial Sequence: Synthetic oligonucleotide
gaggaaaacgtccctttggtgtttcattgctgtac

SEQ ID NO: 97296 - DNA, 38 bp, Artificial Sequence
  Description of Artificial Sequence: Synthetic oligonucleotide
aggaaaacgtccctttggtgtttcattgctgtacattg

SEQ ID NO: 97297 - DNA, 37 bp, Artificial Sequence
  Description of Artificial Sequence: Synthetic oligonucleotide
ggaaaacgtccctttggtgtttcattgctgtacattg

SEQ ID NO: 97298 - DNA, 37 bp, Artificial Sequence
  Description of Artificial Sequence: Synthetic oligonucleotide
gaaaacgtccctttggtgtttcattgctgtacattgg

SEQ ID NO: 97299 - DNA, 37 bp, Artificial Sequence
  Description of Artificial Sequence: Synthetic oligonucleotide
aaaacgtccctttggtgtttcattgctgtacattggc

SEQ ID NO: 97300 - DNA, 36 bp, Artificial Sequence
  Description of Artificial Sequence: Synthetic oligonucleotide
aaacgtccctttggtgtttcattgctgtacattggc

SEQ ID NO: 97301 - DNA, 35 bp, Artificial Sequence
  Description of Artificial Sequence: Synthetic oligonucleotide
aacgtccctttggtgtttcattgctgtacattggc

SEQ ID NO: 97302 - DNA, 34 bp, Artificial Sequence
  Description of Artificial Sequence: Synthetic oligonucleotide
acgtccctttggtgtttcattgctgtacattggc

SEQ ID NO: 97303 - DNA, 33 bp, Artificial Sequence
  Description of Artificial Sequence: Synthetic oligonucleotide
cgtccctttggtgtttcattgctgtacattggc

SEQ ID NO: 97304 - DNA, 34 bp, Artificial Sequence
  Description of Artificial Sequence: Synthetic oligonucleotide
gtccctttggtgtttcattgctgtacattggctg

SEQ ID NO: 97305 - DNA, 34 bp, Artificial Sequence
  Description of Artificial Sequence: Synthetic oligonucleotide
tccctttggtgtttcattgctgtacattggctgg

SEQ ID NO: 97306 - DNA, 33 bp, Artificial Sequence
  Description of Artificial Sequence: Synthetic oligonucleotide
ccctttggtgtttcattgctgtacattggctgg

SEQ ID NO: 97307 - DNA, 33 bp, Artificial Sequence
  Description of Artificial Sequence: Synthetic oligonucleotide
cctttggtgtttcattgctgtacattggctggg

SEQ ID NO: 97308 - DNA, 37 bp, Artificial Sequence
  Description of Artificial Sequence: Synthetic oligonucleotide
ctttggtgtttcattgctgtacattggctgggataag

SEQ ID NO: 97309 - DNA, 37 bp, Artificial Sequence
  Description of Artificial Sequence: Synthetic oligonucleotide
tttggtgtttcattgctgtacattggctgggataagc

SEQ ID NO: 97310 - DNA, 36 bp, Artificial Sequence
  Description of Artificial Sequence: Synthetic oligonucleotide
ttggtgtttcattgctgtacattggctgggataagc

SEQ ID NO: 97311 - DNA, 35 bp, Artificial Sequence
  Description of Artificial Sequence: Synthetic oligonucleotide
tggtgtttcattgctgtacattggctgggataagc

SEQ ID NO: 97312 - DNA, 34 bp, Artificial Sequence
  Description of Artificial Sequence: Synthetic oligonucleotide
ggtgtttcattgctgtacattggctgggataagc

SEQ ID NO: 97313 - DNA, 35 bp, Artificial Sequence
  Description of Artificial Sequence: Synthetic oligonucleotide
gtgtttcattgctgtacattggctgggataagcac

SEQ ID NO: 97314 - DNA, 38 bp, Artificial Sequence
  Description of Artificial Sequence: Synthetic oligonucleotide
tgtttcattgctgtacattggctgggataagcactatg

SEQ ID NO: 97315 - DNA, 37 bp, Artificial Sequence
  Description of Artificial Sequence: Synthetic oligonucleotide
gtttcattgctgtacattggctgggataagcactatg

SEQ ID NO: 97316 - DNA, 37 bp, Artificial Sequence
  Description of Artificial Sequence: Synthetic oligonucleotide
tttcattgctgtacattggctgggataagcactatgg

SEQ ID NO: 97317 - DNA, 36 bp, Artificial Sequence
  Description of Artificial Sequence: Synthetic oligonucleotide
ttcattgctgtacattggctgggataagcactatgg

SEQ ID NO: 97318 - DNA, 35 bp, Artificial Sequence
  Description of Artificial Sequence: Synthetic oligonucleotide
tcattgctgtacattggctgggataagcactatgg

SEQ ID NO: 97319 - DNA, 34 bp, Artificial Sequence
  Description of Artificial Sequence: Synthetic oligonucleotide
cattgctgtacattggctgggataagcactatgg

SEQ ID NO: 97320 - DNA, 34 bp, Artificial Sequence
  Description of Artificial Sequence: Synthetic oligonucleotide
attgctgtacattggctgggataagcactatggc

SEQ ID NO: 97321 - DNA, 33 bp, Artificial Sequence
  Description of Artificial Sequence: Synthetic oligonucleotide
ttgctgtacattggctgggataagcactatggc

SEQ ID NO: 97322 - DNA, 32 bp, Artificial Sequence
  Description of Artificial Sequence: Synthetic oligonucleotide
tgctgtacattggctgggataagcactatggc

SEQ ID NO: 97323 - DNA, 31 bp, Artificial Sequence
  Description of Artificial Sequence: Synthetic oligonucleotide
gctgtacattggctgggataagcactatggc

SEQ ID NO: 97324 - DNA, 34 bp, Artificial Sequence
  Description of Artificial Sequence: Synthetic oligonucleotide
ctgtacattggctgggataagcactatggctttc

SEQ ID NO: 97325 - DNA, 35 bp, Artificial Sequence
  Description of Artificial Sequence: Synthetic oligonucleotide
tgtacattggctgggataagcactatggctttcag

SEQ ID NO: 97326 - DNA, 34 bp, Artificial Sequence
  Description of Artificial Sequence: Synthetic oligonucleotide
gtacattggctgggataagcactatggctttcag

SEQ ID NO: 97327 - DNA, 34 bp, Artificial Sequence
  Description of Artificial Sequence: Synthetic oligonucleotide
tacattggctgggataagcactatggctttcagc

SEQ ID NO: 97328 - DNA, 33 bp, Artificial Sequence
  Description of Artificial Sequence: Synthetic oligonucleotide
acattggctgggataagcactatggctttcagc

SEQ ID NO: 97329 - DNA, 32 bp, Artificial Sequence
  Description of Artificial Sequence: Synthetic oligonucleotide
cattggctgggataagcactatggctttcagc

SEQ ID NO: 97330 - DNA, 33 bp, Artificial Sequence
  Description of Artificial Sequence: Synthetic oligonucleotide
attggctgggataagcactatggctttcagctc

SEQ ID NO: 97331 - DNA, 32 bp, Artificial Sequence
  Description of Artificial Sequence: Synthetic oligonucleotide
ttggctgggataagcactatggctttcagctc

SEQ ID NO: 97332 - DNA, 31 bp, Artificial Sequence
  Description of Artificial Sequence: Synthetic oligonucleotide
tggctgggataagcactatggctttcagctc

SEQ ID NO: 97333 - DNA, 30 bp, Artificial Sequence
  Description of Artificial Sequence: Synthetic oligonucleotide
ggctgggataagcactatggctttcagctc

SEQ ID NO: 97334 - DNA, 33 bp, Artificial Sequence
  Description of Artificial Sequence: Synthetic oligonucleotide
gctgggataagcactatggctttcagctctatc

SEQ ID NO: 97335 - DNA, 34 bp, Artificial Sequence
  Description of Artificial Sequence: Synthetic oligonucleotide
ctgggataagcactatggctttcagctctatcag

SEQ ID NO: 97336 - DNA, 35 bp, Artificial Sequence
  Description of Artificial Sequence: Synthetic oligonucleotide
tgggataagcactatggctttcagctctatcagag

SEQ ID NO: 97337 - DNA, 34 bp, Artificial Sequence
  Description of Artificial Sequence: Synthetic oligonucleotide
gggataagcactatggctttcagctctatcagag

SEQ ID NO: 97338 - DNA, 35 bp, Artificial Sequence
  Description of Artificial Sequence: Synthetic oligonucleotide
ggataagcactatggctttcagctctatcagagtg

SEQ ID NO: 97339 - DNA, 36 bp, Artificial Sequence
  Description of Artificial Sequence: Synthetic oligonucleotide
gataagcactatggctttcagctctatcagagtgac

SEQ ID NO: 97340 - DNA, 36 bp, Artificial Sequence
  Description of Artificial Sequence: Synthetic oligonucleotide
ataagcactatggctttcagctctatcagagtgacc

SEQ ID NO: 97341 - DNA, 35 bp, Artificial Sequence
  Description of Artificial Sequence: Synthetic oligonucleotide
taagcactatggctttcagctctatcagagtgacc

SEQ ID NO: 97342 - DNA, 34 bp, Artificial Sequence
  Description of Artificial Sequence: Synthetic oligonucleotide
aagcactatggctttcagctctatcagagtgacc

SEQ ID NO: 97343 - DNA, 33 bp, Artificial Sequence
  Description of Artificial Sequence: Synthetic oligonucleotide
agcactatggctttcagctctatcagagtgacc

SEQ ID NO: 97344 - DNA, 32 bp, Artificial Sequence
  Description of Artificial Sequence: Synthetic oligonucleotide
gcactatggctttcagctctatcagagtgacc

SEQ ID NO: 97345 - DNA, 32 bp, Artificial Sequence
  Description of Artificial Sequence: Synthetic oligonucleotide
cactatggctttcagctctatcagagtgaccc

SEQ ID NO: 97346 - DNA, 34 bp, Artificial Sequence
  Description of Artificial Sequence: Synthetic oligonucleotide
actatggctttcagctctatcagagtgaccctag

SEQ ID NO: 97347 - DNA, 33 bp, Artificial Sequence
  Description of Artificial Sequence: Synthetic oligonucleotide
ctatggctttcagctctatcagagtgaccctag

SEQ ID NO: 97348 - DNA, 34 bp, Artificial Sequence
  Description of Artificial Sequence: Synthetic oligonucleotide
tatggctttcagctctatcagagtgaccctagtg

SEQ ID NO: 97349 - DNA, 33 bp, Artificial Sequence
  Description of Artificial Sequence: Synthetic oligonucleotide
atggctttcagctctatcagagtgaccctagtg

SEQ ID NO: 97350 - DNA, 32 bp, Artificial Sequence
  Description of Artificial Sequence: Synthetic oligonucleotide
tggctttcagctctatcagagtgaccctagtg

SEQ ID NO: 97351 - DNA, 31 bp, Artificial Sequence
  Description of Artificial Sequence: Synthetic oligonucleotide
ggctttcagctctatcagagtgaccctagtg

SEQ ID NO: 97352 - DNA, 31 bp, Artificial Sequence
  Description of Artificial Sequence: Synthetic oligonucleotide
gctttcagctctatcagagtgaccctagtgg

SEQ ID NO: 97353 - DNA, 37 bp, Artificial Sequence
  Description of Artificial Sequence: Synthetic oligonucleotide
ctttcagctctatcagagtgaccctagtggaaattac

SEQ ID NO: 97354 - DNA, 37 bp, Artificial Sequence
  Description of Artificial Sequence: Synthetic oligonucleotide
tttcagctctatcagagtgaccctagtggaaattacg

SEQ ID NO: 97355 - DNA, 36 bp, Artificial Sequence
  Description of Artificial Sequence: Synthetic oligonucleotide
ttcagctctatcagagtgaccctagtggaaattacg

SEQ ID NO: 97356 - DNA, 35 bp, Artificial Sequence
  Description of Artificial Sequence: Synthetic oligonucleotide
tcagctctatcagagtgaccctagtggaaattacg

SEQ ID NO: 97357 - DNA, 34 bp, Artificial Sequence
  Description of Artificial Sequence: Synthetic oligonucleotide
cagctctatcagagtgaccctagtggaaattacg

SEQ ID NO: 97358 - DNA, 34 bp, Artificial Sequence
  Description of Artificial Sequence: Synthetic oligonucleotide
agctctatcagagtgaccctagtggaaattacgg

SEQ ID NO: 97359 - DNA, 33 bp, Artificial Sequence
  Description of Artificial Sequence: Synthetic oligonucleotide
gctctatcagagtgaccctagtggaaattacgg

SEQ ID NO: 97360 - DNA, 33 bp, Artificial Sequence
  Description of Artificial Sequence: Synthetic oligonucleotide
ctctatcagagtgaccctagtggaaattacggg

SEQ ID NO: 97361 - DNA, 33 bp, Artificial Sequence
  Description of Artificial Sequence: Synthetic oligonucleotide
tctatcagagtgaccctagtggaaattacgggg

SEQ ID NO: 97362 - DNA, 32 bp, Artificial Sequence
  Description of Artificial Sequence: Synthetic oligonucleotide
ctatcagagtgaccctagtggaaattacgggg

SEQ ID NO: 97363 - DNA, 32 bp, Artificial Sequence
  Description of Artificial Sequence: Synthetic oligonucleotide
tatcagagtgaccctagtggaaattacggggg

SEQ ID NO: 97364 - DNA, 31 bp, Artificial Sequence
  Description of Artificial Sequence: Synthetic oligonucleotide
atcagagtgaccctagtggaaattacggggg

SEQ ID NO: 97365 - DNA, 30 bp, Artificial Sequence
  Description of Artificial Sequence: Synthetic oligonucleotide
tcagagtgaccctagtggaaattacggggg

SEQ ID NO: 97366 - DNA, 29 bp, Artificial Sequence
  Description of Artificial Sequence: Synthetic oligonucleotide
cagagtgaccctagtggaaattacggggg

SEQ ID NO: 97367 - DNA, 31 bp, Artificial Sequence
  Description of Artificial Sequence: Synthetic oligonucleotide
agagtgaccctagtggaaattacgggggatg

SEQ ID NO: 97368 - DNA, 30 bp, Artificial Sequence
  Description of Artificial Sequence: Synthetic oligonucleotide
gagtgaccctagtggaaattacgggggatg

SEQ ID NO: 97369 - DNA, 30 bp, Artificial Sequence
  Description of Artificial Sequence: Synthetic oligonucleotide
agtgaccctagtggaaattacgggggatgg

SEQ ID NO: 97370 - DNA, 29 bp, Artificial Sequence
  Description of Artificial Sequence: Synthetic oligonucleotide
gtgaccctagtggaaattacgggggatgg

SEQ ID NO: 97371 - DNA, 31 bp, Artificial Sequence
  Description of Artificial Sequence: Synthetic oligonucleotide
tgaccctagtggaaattacgggggatggaag

SEQ ID NO: 97372 - DNA, 30 bp, Artificial Sequence
  Description of Artificial Sequence: Synthetic oligonucleotide
gaccctagtggaaattacgggggatggaag

SEQ ID NO: 97373 - DNA, 30 bp, Artificial Sequence
  Description of Artificial Sequence: Synthetic oligonucleotide
accctagtggaaattacgggggatggaagg

SEQ ID NO: 97374 - DNA, 29 bp, Artificial Sequence
  Description of Artificial Sequence: Synthetic oligonucleotide
ccctagtggaaattacgggggatggaagg

SEQ ID NO: 97375 - DNA, 29 bp, Artificial Sequence
  Description of Artificial Sequence: Synthetic oligonucleotide
cctagtggaaattacgggggatggaaggc

SEQ ID NO: 97376 - DNA, 29 bp, Artificial Sequence
  Description of Artificial Sequence: Synthetic oligonucleotide
ctagtggaaattacgggggatggaaggcc

SEQ ID NO: 97377 - DNA, 30 bp, Artificial Sequence
  Description of Artificial Sequence: Synthetic oligonucleotide
tagtggaaattacgggggatggaaggccac

SEQ ID NO: 97378 - DNA, 29 bp, Artificial Sequence
  Description of Artificial Sequence: Synthetic oligonucleotide
agtggaaattacgggggatggaaggccac

SEQ ID NO: 97379 - DNA, 28 bp, Artificial Sequence
  Description of Artificial Sequence: Synthetic oligonucleotide
gtggaaattacgggggatggaaggccac

SEQ ID NO: 97380 - DNA, 30 bp, Artificial Sequence
  Description of Artificial Sequence: Synthetic oligonucleotide
tggaaattacgggggatggaaggccacatg

SEQ ID NO: 97381 - DNA, 29 bp, Artificial Sequence
  Description of Artificial Sequence: Synthetic oligonucleotide
ggaaattacgggggatggaaggccacatg

SEQ ID NO: 97382 - DNA, 29 bp, Artificial Sequence
  Description of Artificial Sequence: Synthetic oligonucleotide
gaaattacgggggatggaaggccacatgc

SEQ ID NO: 97383 - DNA, 32 bp, Artificial Sequence
  Description of Artificial Sequence: Synthetic oligonucleotide
aaattacgggggatggaaggccacatgcattg

SEQ ID NO: 97384 - DNA, 31 bp, Artificial Sequence
  Description of Artificial Sequence: Synthetic oligonucleotide
aattacgggggatggaaggccacatgcattg

SEQ ID NO: 97385 - DNA, 30 bp, Artificial Sequence
  Description of Artificial Sequence: Synthetic oligonucleotide
attacgggggatggaaggccacatgcattg

SEQ ID NO: 97386 - DNA, 29 bp, Artificial Sequence
  Description of Artificial Sequence: Synthetic oligonucleotide
ttacgggggatggaaggccacatgcattg

SEQ ID NO: 97387 - DNA, 28 bp, Artificial Sequence
  Description of Artificial Sequence: Synthetic oligonucleotide
tacgggggatggaaggccacatgcattg

SEQ ID NO: 97388 - DNA, 27 bp, Artificial Sequence
  Description of Artificial Sequence: Synthetic oligonucleotide
acgggggatggaaggccacatgcattg

SEQ ID NO: 97389 - DNA, 26 bp, Artificial Sequence
  Description of Artificial Sequence: Synthetic oligonucleotide
cgggggatggaaggccacatgcattg

SEQ ID NO: 97390 - DNA, 27 bp, Artificial Sequence
  Description of Artificial Sequence: Synthetic oligonucleotide
gggggatggaaggccacatgcattgga

SEQ ID NO: 97391 - DNA, 34 bp, Artificial Sequence
  Description of Artificial Sequence: Synthetic oligonucleotide
ggggatggaaggccacatgcattggaaataatag

SEQ ID NO: 97392 - DNA, 34 bp, Artificial Sequence
  Description of Artificial Sequence: Synthetic oligonucleotide
gggatggaaggccacatgcattggaaataatagc

SEQ ID NO: 97393 - DNA, 34 bp, Artificial Sequence
  Description of Artificial Sequence: Synthetic oligonucleotide
ggatggaaggccacatgcattggaaataatagcg

SEQ ID NO: 97394 - DNA, 34 bp, Artificial Sequence
  Description of Artificial Sequence: Synthetic oligonucleotide
gatggaaggccacatgcattggaaataatagcgc

SEQ ID NO: 97395 - DNA, 35 bp, Artificial Sequence
  Description of Artificial Sequence: Synthetic oligonucleotide
atggaaggccacatgcattggaaataatagcgctg

SEQ ID NO: 97396 - DNA, 34 bp, Artificial Sequence
  Description of Artificial Sequence: Synthetic oligonucleotide
tggaaggccacatgcattggaaataatagcgctg

SEQ ID NO: 97397 - DNA, 33 bp, Artificial Sequence
  Description of Artificial Sequence: Synthetic oligonucleotide
ggaaggccacatgcattggaaataatagcgctg

SEQ ID NO: 97398 - DNA, 33 bp, Artificial Sequence
  Description of Artificial Sequence: Synthetic oligonucleotide
gaaggccacatgcattggaaataatagcgctgc

SEQ ID NO: 97399 - DNA, 34 bp, Artificial Sequence
  Description of Artificial Sequence: Synthetic oligonucleotide
aaggccacatgcattggaaataatagcgctgcag

SEQ ID NO: 97400 - DNA, 33 bp, Artificial Sequence
  Description of Artificial Sequence: Synthetic oligonucleotide
aggccacatgcattggaaataatagcgctgcag

SEQ ID NO: 97401 - DNA, 32 bp, Artificial Sequence
  Description of Artificial Sequence: Synthetic oligonucleotide
ggccacatgcattggaaataatagcgctgcag

SEQ ID NO: 97402 - DNA, 32 bp, Artificial Sequence
  Description of Artificial Sequence: Synthetic oligonucleotide
gccacatgcattggaaataatagcgctgcagc

SEQ ID NO: 97403 - DNA, 33 bp, Artificial Sequence
  Description of Artificial Sequence: Synthetic oligonucleotide
ccacatgcattggaaataatagcgctgcagctg

SEQ ID NO: 97404 - DNA, 34 bp, Artificial Sequence
  Description of Artificial Sequence: Synthetic oligonucleotide
cacatgcattggaaataatagcgctgcagctgtg

SEQ ID NO: 97405 - DNA, 35 bp, Artificial Sequence
  Description of Artificial Sequence: Synthetic oligonucleotide
acatgcattggaaataatagcgctgcagctgtgtc

SEQ ID NO: 97406 - DNA, 34 bp, Artificial Sequence
  Description of Artificial Sequence: Synthetic oligonucleotide
catgcattggaaataatagcgctgcagctgtgtc

SEQ ID NO: 97407 - DNA, 37 bp, Artificial Sequence
  Description of Artificial Sequence: Synthetic oligonucleotide
atgcattggaaataatagcgctgcagctgtgtcaatg

SEQ ID NO: 97408 - DNA, 36 bp, Artificial Sequence
  Description of Artificial Sequence: Synthetic oligonucleotide
tgcattggaaataatagcgctgcagctgtgtcaatg

SEQ ID NO: 97409 - DNA, 35 bp, Artificial Sequence
  Description of Artificial Sequence: Synthetic oligonucleotide
gcattggaaataatagcgctgcagctgtgtcaatg

SEQ ID NO: 97410 - DNA, 37 bp, Artificial Sequence
  Description of Artificial Sequence: Synthetic oligonucleotide
cattggaaataatagcgctgcagctgtgtcaatgttg

SEQ ID NO: 97411 - DNA, 40 bp, Artificial Sequence
  Description of Artificial Sequence: Synthetic oligonucleotide
attggaaataatagcgctgcagctgtgtcaatgttgaaac

SEQ ID NO: 97412 - DNA, 39 bp, Artificial Sequence
  Description of Artificial Sequence: Synthetic oligonucleotide
ttggaaataatagcgctgcagctgtgtcaatgttgaaac

SEQ ID NO: 97413 - DNA, 38 bp, Artificial Sequence
  Description of Artificial Sequence: Synthetic oligonucleotide
tggaaataatagcgctgcagctgtgtcaatgttgaaac

SEQ ID NO: 97414 - DNA, 37 bp, Artificial Sequence
  Description of Artificial Sequence: Synthetic oligonucleotide
ggaaataatagcgctgcagctgtgtcaatgttgaaac

SEQ ID NO: 97415 - DNA, 39 bp, Artificial Sequence
  Description of Artificial Sequence: Synthetic oligonucleotide
gaaataatagcgctgcagctgtgtcaatgttgaaacaag

SEQ ID NO: 97416 - DNA, 40 bp, Artificial Sequence
  Description of Artificial Sequence: Synthetic oligonucleotide
aaataatagcgctgcagctgtgtcaatgttgaaacaagac

SEQ ID NO: 97417 - DNA, 39 bp, Artificial Sequence
  Description of Artificial Sequence: Synthetic oligonucleotide
aataatagcgctgcagctgtgtcaatgttgaaacaagac

SEQ ID NO: 97418 - DNA, 38 bp, Artificial Sequence
  Description of Artificial Sequence: Synthetic oligonucleotide
ataatagcgctgcagctgtgtcaatgttgaaacaagac

SEQ ID NO: 97419 - DNA, 37 bp, Artificial Sequence
  Description of Artificial Sequence: Synthetic oligonucleotide
taatagcgctgcagctgtgtcaatgttgaaacaagac

SEQ ID NO: 97420 - DNA, 36 bp, Artificial Sequence
  Description of Artificial Sequence: Synthetic oligonucleotide
aatagcgctgcagctgtgtcaatgttgaaacaagac

SEQ ID NO: 97421 - DNA, 35 bp, Artificial Sequence
  Description of Artificial Sequence: Synthetic oligonucleotide
atagcgctgcagctgtgtcaatgttgaaacaagac

SEQ ID NO: 97422 - DNA, 34 bp, Artificial Sequence
  Description of Artificial Sequence: Synthetic oligonucleotide
tagcgctgcagctgtgtcaatgttgaaacaagac

SEQ ID NO: 97423 - DNA, 33 bp, Artificial Sequence
  Description of Artificial Sequence: Synthetic oligonucleotide
agcgctgcagctgtgtcaatgttgaaacaagac

SEQ ID NO: 97424 - DNA, 32 bp, Artificial Sequence
  Description of Artificial Sequence: Synthetic oligonucleotide
gcgctgcagctgtgtcaatgttgaaacaagac

SEQ ID NO: 97425 - DNA, 38 bp, Artificial Sequence
  Description of Artificial Sequence: Synthetic oligonucleotide
cgctgcagctgtgtcaatgttgaaacaagactataaag

SEQ ID NO: 97426 - DNA, 40 bp, Artificial Sequence
  Description of Artificial Sequence: Synthetic oligonucleotide
gctgcagctgtgtcaatgttgaaacaagactataaagaag

SEQ ID NO: 97427 - DNA, 40 bp, Artificial Sequence
  Description of Artificial Sequence: Synthetic oligonucleotide
ctgcagctgtgtcaatgttgaaacaagactataaagaagg

SEQ ID NO: 97428 - DNA, 41 bp, Artificial Sequence
  Description of Artificial Sequence: Synthetic oligonucleotide
tgcagctgtgtcaatgttgaaacaagactataaagaaggag

SEQ ID NO: 97429 - DNA, 40 bp, Artificial Sequence
  Description of Artificial Sequence: Synthetic oligonucleotide
gcagctgtgtcaatgttgaaacaagactataaagaaggag

SEQ ID NO: 97430 - DNA, 44 bp, Artificial Sequence
  Description of Artificial Sequence: Synthetic oligonucleotide
cagctgtgtcaatgttgaaacaagactataaagaaggagaaatg

SEQ ID NO: 97431 - DNA, 45 bp, Artificial Sequence
  Description of Artificial Sequence: Synthetic oligonucleotide
agctgtgtcaatgttgaaacaagactataaagaaggagaaatgac

SEQ ID NO: 97432 - DNA, 44 bp, Artificial Sequence
  Description of Artificial Sequence: Synthetic oligonucleotide
gctgtgtcaatgttgaaacaagactataaagaaggagaaatgac

SEQ ID NO: 97433 - DNA, 44 bp, Artificial Sequence
  Description of Artificial Sequence: Synthetic oligonucleotide
ctgtgtcaatgttgaaacaagactataaagaaggagaaatgacc

SEQ ID NO: 97434 - DNA, 46 bp, Artificial Sequence
  Description of Artificial Sequence: Synthetic oligonucleotide
tgtgtcaatgttgaaacaagactataaagaaggagaaatgaccttg

SEQ ID NO: 97435 - DNA, 45 bp, Artificial Sequence
  Description of Artificial Sequence: Synthetic oligonucleotide
gtgtcaatgttgaaacaagactataaagaaggagaaatgaccttg

SEQ ID NO: 97436 - DNA, 47 bp, Artificial Sequence
  Description of Artificial Sequence: Synthetic oligonucleotide
tgtcaatgttgaaacaagactataaagaaggagaaatgaccttgaag

SEQ ID NO: 97437 - DNA, 46 bp, Artificial Sequence
  Description of Artificial Sequence: Synthetic oligonucleotide
gtcaatgttgaaacaagactataaagaaggagaaatgaccttgaag

SEQ ID NO: 97438 - DNA, 47 bp, Artificial Sequence
  Description of Artificial Sequence: Synthetic oligonucleotide
tcaatgttgaaacaagactataaagaaggagaaatgaccttgaagtc

SEQ ID NO: 97439 - DNA, 46 bp, Artificial Sequence
  Description of Artificial Sequence: Synthetic oligonucleotide
caatgttgaaacaagactataaagaaggagaaatgaccttgaagtc

SEQ ID NO: 97440 - DNA, 47 bp, Artificial Sequence
  Description of Artificial Sequence: Synthetic oligonucleotide
aatgttgaaacaagactataaagaaggagaaatgaccttgaagtcag

SEQ ID NO: 97441 - DNA, 46 bp, Artificial Sequence
  Description of Artificial Sequence: Synthetic oligonucleotide
atgttgaaacaagactataaagaaggagaaatgaccttgaagtcag

SEQ ID NO: 97442 - DNA, 45 bp, Artificial Sequence
  Description of Artificial Sequence: Synthetic oligonucleotide
tgttgaaacaagactataaagaaggagaaatgaccttgaagtcag

SEQ ID NO: 97443 - DNA, 44 bp, Artificial Sequence
  Description of Artificial Sequence: Synthetic oligonucleotide
gttgaaacaagactataaagaaggagaaatgaccttgaagtcag

SEQ ID NO: 97444 - DNA, 44 bp, Artificial Sequence
  Description of Artificial Sequence: Synthetic oligonucleotide
ttgaaacaagactataaagaaggagaaatgaccttgaagtcagc

SEQ ID NO: 97445 - DNA, 43 bp, Artificial Sequence
  Description of Artificial Sequence: Synthetic oligonucleotide
tgaaacaagactataaagaaggagaaatgaccttgaagtcagc

SEQ ID NO: 97446 - DNA, 42 bp, Artificial Sequence
  Description of Artificial Sequence: Synthetic oligonucleotide
gaaacaagactataaagaaggagaaatgaccttgaagtcagc

SEQ ID NO: 97447 - DNA, 43 bp, Artificial Sequence
  Description of Artificial Sequence: Synthetic oligonucleotide
aaacaagactataaagaaggagaaatgaccttgaagtcagcac

SEQ ID NO: 97448 - DNA, 42 bp, Artificial Sequence
  Description of Artificial Sequence: Synthetic oligonucleotide
aacaagactataaagaaggagaaatgaccttgaagtcagcac

SEQ ID NO: 97449 - DNA, 41 bp, Artificial Sequence
  Description of Artificial Sequence: Synthetic oligonucleotide
acaagactataaagaaggagaaatgaccttgaagtcagcac

SEQ ID NO: 97450 - DNA, 40 bp, Artificial Sequence
  Description of Artificial Sequence: Synthetic oligonucleotide
caagactataaagaaggagaaatgaccttgaagtcagcac

SEQ ID NO: 97451 - DNA, 42 bp, Artificial Sequence
  Description of Artificial Sequence: Synthetic oligonucleotide
aagactataaagaaggagaaatgaccttgaagtcagcacttg

SEQ ID NO: 97452 - DNA, 41 bp, Artificial Sequence
  Description of Artificial Sequence: Synthetic oligonucleotide
agactataaagaaggagaaatgaccttgaagtcagcacttg

SEQ ID NO: 97453 - DNA, 40 bp, Artificial Sequence
  Description of Artificial Sequence: Synthetic oligonucleotide
gactataaagaaggagaaatgaccttgaagtcagcacttg

SEQ ID NO: 97454 - DNA, 40 bp, Artificial Sequence
  Description of Artificial Sequence: Synthetic oligonucleotide
actataaagaaggagaaatgaccttgaagtcagcacttgc

SEQ ID NO: 97455 - DNA, 39 bp, Artificial Sequence
  Description of Artificial Sequence: Synthetic oligonucleotide
ctataaagaaggagaaatgaccttgaagtcagcacttgc

SEQ ID NO: 97456 - DNA, 43 bp, Artificial Sequence
  Description of Artificial Sequence: Synthetic oligonucleotide
tataaagaaggagaaatgaccttgaagtcagcacttgctttag

SEQ ID NO: 97457 - DNA, 42 bp, Artificial Sequence
  Description of Artificial Sequence: Synthetic oligonucleotide
ataaagaaggagaaatgaccttgaagtcagcacttgctttag

SEQ ID NO: 97458 - DNA, 41 bp, Artificial Sequence
  Description of Artificial Sequence: Synthetic oligonucleotide
taaagaaggagaaatgaccttgaagtcagcacttgctttag

SEQ ID NO: 97459 - DNA, 40 bp, Artificial Sequence
  Description of Artificial Sequence: Synthetic oligonucleotide
aaagaaggagaaatgaccttgaagtcagcacttgctttag

SEQ ID NO: 97460 - DNA, 39 bp, Artificial Sequence
  Description of Artificial Sequence: Synthetic oligonucleotide
aagaaggagaaatgaccttgaagtcagcacttgctttag

SEQ ID NO: 97461 - DNA, 38 bp, Artificial Sequence
  Description of Artificial Sequence: Synthetic oligonucleotide
agaaggagaaatgaccttgaagtcagcacttgctttag

SEQ ID NO: 97462 - DNA, 37 bp, Artificial Sequence
  Description of Artificial Sequence: Synthetic oligonucleotide
gaaggagaaatgaccttgaagtcagcacttgctttag

SEQ ID NO: 97463 - DNA, 37 bp, Artificial Sequence
  Description of Artificial Sequence: Synthetic oligonucleotide
aaggagaaatgaccttgaagtcagcacttgctttagc

SEQ ID NO: 97464 - DNA, 36 bp, Artificial Sequence
  Description of Artificial Sequence: Synthetic oligonucleotide
aggagaaatgaccttgaagtcagcacttgctttagc

SEQ ID NO: 97465 - DNA, 35 bp, Artificial Sequence
  Description of Artificial Sequence: Synthetic oligonucleotide
ggagaaatgaccttgaagtcagcacttgctttagc

SEQ ID NO: 97466 - DNA, 38 bp, Artificial Sequence
  Description of Artificial Sequence: Synthetic oligonucleotide
gagaaatgaccttgaagtcagcacttgctttagctatc

SEQ ID NO: 97467 - DNA, 41 bp, Artificial Sequence
  Description of Artificial Sequence: Synthetic oligonucleotide
agaaatgaccttgaagtcagcacttgctttagctatcaaag

SEQ ID NO: 97468 - DNA, 40 bp, Artificial Sequence
  Description of Artificial Sequence: Synthetic oligonucleotide
gaaatgaccttgaagtcagcacttgctttagctatcaaag

SEQ ID NO: 97469 - DNA, 42 bp, Artificial Sequence
  Description of Artificial Sequence: Synthetic oligonucleotide
aaatgaccttgaagtcagcacttgctttagctatcaaagtac

SEQ ID NO: 97470 - DNA, 41 bp, Artificial Sequence
  Description of Artificial Sequence: Synthetic oligonucleotide
aatgaccttgaagtcagcacttgctttagctatcaaagtac

SEQ ID NO: 97471 - DNA, 40 bp, Artificial Sequence
  Description of Artificial Sequence: Synthetic oligonucleotide
atgaccttgaagtcagcacttgctttagctatcaaagtac

SEQ ID NO: 97472 - DNA, 39 bp, Artificial Sequence
  Description of Artificial Sequence: Synthetic oligonucleotide
tgaccttgaagtcagcacttgctttagctatcaaagtac

SEQ ID NO: 97473 - DNA, 38 bp, Artificial Sequence
  Description of Artificial Sequence: Synthetic oligonucleotide
gaccttgaagtcagcacttgctttagctatcaaagtac

SEQ ID NO: 97474 - DNA, 45 bp, Artificial Sequence
  Description of Artificial Sequence: Synthetic oligonucleotide
accttgaagtcagcacttgctttagctatcaaagtactaaataag

SEQ ID NO: 97475 - DNA, 44 bp, Artificial Sequence
  Description of Artificial Sequence: Synthetic oligonucleotide
ccttgaagtcagcacttgctttagctatcaaagtactaaataag

SEQ ID NO: 97476 - DNA, 45 bp, Artificial Sequence
  Description of Artificial Sequence: Synthetic oligonucleotide
cttgaagtcagcacttgctttagctatcaaagtactaaataagac

SEQ ID NO: 97477 - DNA, 45 bp, Artificial Sequence
  Description of Artificial Sequence: Synthetic oligonucleotide
ttgaagtcagcacttgctttagctatcaaagtactaaataagacc

SEQ ID NO: 97478 - DNA, 44 bp, Artificial Sequence
  Description of Artificial Sequence: Synthetic oligonucleotide
tgaagtcagcacttgctttagctatcaaagtactaaataagacc

SEQ ID NO: 97479 - DNA, 43 bp, Artificial Sequence
  Description of Artificial Sequence: Synthetic oligonucleotide
gaagtcagcacttgctttagctatcaaagtactaaataagacc

SEQ ID NO: 97480 - DNA, 45 bp, Artificial Sequence
  Description of Artificial Sequence: Synthetic oligonucleotide
aagtcagcacttgctttagctatcaaagtactaaataagaccatg

SEQ ID NO: 97481 - DNA, 44 bp, Artificial Sequence
  Description of Artificial Sequence: Synthetic oligonucleotide
agtcagcacttgctttagctatcaaagtactaaataagaccatg

SEQ ID NO: 97482 - DNA, 43 bp, Artificial Sequence
  Description of Artificial Sequence: Synthetic oligonucleotide
gtcagcacttgctttagctatcaaagtactaaataagaccatg

SEQ ID NO: 97483 - DNA, 43 bp, Artificial Sequence
  Description of Artificial Sequence: Synthetic oligonucleotide
tcagcacttgctttagctatcaaagtactaaataagaccatgg

SEQ ID NO: 97484 - DNA, 42 bp, Artificial Sequence
  Description of Artificial Sequence: Synthetic oligonucleotide
cagcacttgctttagctatcaaagtactaaataagaccatgg

SEQ ID NO: 97485 - DNA, 44 bp, Artificial Sequence
  Description of Artificial Sequence: Synthetic oligonucleotide
agcacttgctttagctatcaaagtactaaataagaccatggatg

SEQ ID NO: 97486 - DNA, 43 bp, Artificial Sequence
  Description of Artificial Sequence: Synthetic oligonucleotide
gcacttgctttagctatcaaagtactaaataagaccatggatg

SEQ ID NO: 97487 - DNA, 46 bp, Artificial Sequence
  Description of Artificial Sequence: Synthetic oligonucleotide
cacttgctttagctatcaaagtactaaataagaccatggatgttag

SEQ ID NO: 97488 - DNA, 50 bp, Artificial Sequence
  Description of Artificial Sequence: Synthetic oligonucleotide
acttgctttagctatcaaagtactaaataagaccatggatgttagtaaac

SEQ ID NO: 97489 - DNA, 49 bp, Artificial Sequence
  Description of Artificial Sequence: Synthetic oligonucleotide
cttgctttagctatcaaagtactaaataagaccatggatgttagtaaac

SEQ ID NO: 97490 - DNA, 50 bp, Artificial Sequence
  Description of Artificial Sequence: Synthetic oligonucleotide
ttgctttagctatcaaagtactaaataagaccatggatgttagtaaactc

SEQ ID NO: 97491 - DNA, 49 bp, Artificial Sequence
  Description of Artificial Sequence: Synthetic oligonucleotide
tgctttagctatcaaagtactaaataagaccatggatgttagtaaactc

SEQ ID NO: 97492 - DNA, 48 bp, Artificial Sequence
  Description of Artificial Sequence: Synthetic oligonucleotide
gctttagctatcaaagtactaaataagaccatggatgttagtaaactc

SEQ ID NO: 97493 - DNA, 49 bp, Artificial Sequence
  Description of Artificial Sequence: Synthetic oligonucleotide
ctttagctatcaaagtactaaataagaccatggatgttagtaaactctc

SEQ ID NO: 97494 - DNA, 50 bp, Artificial Sequence
  Description of Artificial Sequence: Synthetic oligonucleotide
tttagctatcaaagtactaaataagaccatggatgttagtaaactctctg

SEQ ID NO: 97495 - DNA, 49 bp, Artificial Sequence
  Description of Artificial Sequence: Synthetic oligonucleotide
ttagctatcaaagtactaaataagaccatggatgttagtaaactctctg

SEQ ID NO: 97496 - DNA, 48 bp, Artificial Sequence
  Description of Artificial Sequence: Synthetic oligonucleotide
tagctatcaaagtactaaataagaccatggatgttagtaaactctctg

SEQ ID NO: 97497 - DNA, 47 bp, Artificial Sequence
  Description of Artificial Sequence: Synthetic oligonucleotide
agctatcaaagtactaaataagaccatggatgttagtaaactctctg

SEQ ID NO: 97498 - DNA, 46 bp, Artificial Sequence
  Description of Artificial Sequence: Synthetic oligonucleotide
gctatcaaagtactaaataagaccatggatgttagtaaactctctg

SEQ ID NO: 97499 - DNA, 46 bp, Artificial Sequence
  Description of Artificial Sequence: Synthetic oligonucleotide
ctatcaaagtactaaataagaccatggatgttagtaaactctctgc

SEQ ID NO: 97500 - DNA, 47 bp, Artificial Sequence
  Description of Artificial Sequence: Synthetic oligonucleotide
tatcaaagtactaaataagaccatggatgttagtaaactctctgctg

SEQ ID NO: 97501 - DNA, 46 bp, Artificial Sequence
  Description of Artificial Sequence: Synthetic oligonucleotide
atcaaagtactaaataagaccatggatgttagtaaactctctgctg

SEQ ID NO: 97502 - DNA, 45 bp, Artificial Sequence
  Description of Artificial Sequence: Synthetic oligonucleotide
tcaaagtactaaataagaccatggatgttagtaaactctctgctg

SEQ ID NO: 97503 - DNA, 44 bp, Artificial Sequence
  Description of Artificial Sequence: Synthetic oligonucleotide
caaagtactaaataagaccatggatgttagtaaactctctgctg

SEQ ID NO: 97504 - DNA, 49 bp, Artificial Sequence
  Description of Artificial Sequence: Synthetic oligonucleotide
aaagtactaaataagaccatggatgttagtaaactctctgctgaaaaag

SEQ ID NO: 97505 - DNA, 48 bp, Artificial Sequence
  Description of Artificial Sequence: Synthetic oligonucleotide
aagtactaaataagaccatggatgttagtaaactctctgctgaaaaag

SEQ ID NO: 97506 - DNA, 47 bp, Artificial Sequence
  Description of Artificial Sequence: Synthetic oligonucleotide
agtactaaataagaccatggatgttagtaaactctctgctgaaaaag

SEQ ID NO: 97507 - DNA, 46 bp, Artificial Sequence
  Description of Artificial Sequence: Synthetic oligonucleotide
gtactaaataagaccatggatgttagtaaactctctgctgaaaaag

SEQ ID NO: 97508 - DNA, 47 bp, Artificial Sequence
  Description of Artificial Sequence: Synthetic oligonucleotide
tactaaataagaccatggatgttagtaaactctctgctgaaaaagtg

SEQ ID NO: 97509 - DNA, 46 bp, Artificial Sequence
  Description of Artificial Sequence: Synthetic oligonucleotide
actaaataagaccatggatgttagtaaactctctgctgaaaaagtg

SEQ ID NO: 97510 - DNA, 45 bp, Artificial Sequence
  Description of Artificial Sequence: Synthetic oligonucleotide
ctaaataagaccatggatgttagtaaactctctgctgaaaaagtg

SEQ ID NO: 97511 - DNA, 45 bp, Artificial Sequence
  Description of Artificial Sequence: Synthetic oligonucleotide
taaataagaccatggatgttagtaaactctctgctgaaaaagtgg

SEQ ID NO: 97512 - DNA, 44 bp, Artificial Sequence
  Description of Artificial Sequence: Synthetic oligonucleotide
aaataagaccatggatgttagtaaactctctgctgaaaaagtgg

SEQ ID NO: 97513 - DNA, 43 bp, Artificial Sequence
  Description of Artificial Sequence: Synthetic oligonucleotide
aataagaccatggatgttagtaaactctctgctgaaaaagtgg

SEQ ID NO: 97514 - DNA, 42 bp, Artificial Sequence
  Description of Artificial Sequence: Synthetic oligonucleotide
ataagaccatggatgttagtaaactctctgctgaaaaagtgg

SEQ ID NO: 97515 - DNA, 41 bp, Artificial Sequence
  Description of Artificial Sequence: Synthetic oligonucleotide
taagaccatggatgttagtaaactctctgctgaaaaagtgg

SEQ ID NO: 97516 - DNA, 40 bp, Artificial Sequence
  Description of Artificial Sequence: Synthetic oligonucleotide
aagaccatggatgttagtaaactctctgctgaaaaagtgg

SEQ ID NO: 97517 - DNA, 39 bp, Artificial Sequence
  Description of Artificial Sequence: Synthetic oligonucleotide
agaccatggatgttagtaaactctctgctgaaaaagtgg

SEQ ID NO: 97518 - DNA, 38 bp, Artificial Sequence
  Description of Artificial Sequence: Synthetic oligonucleotide
gaccatggatgttagtaaactctctgctgaaaaagtgg

SEQ ID NO: 97519 - DNA, 43 bp, Artificial Sequence
  Description of Artificial Sequence: Synthetic oligonucleotide
accatggatgttagtaaactctctgctgaaaaagtggaaattg

SEQ ID NO: 97520 - DNA, 42 bp, Artificial Sequence
  Description of Artificial Sequence: Synthetic oligonucleotide
ccatggatgttagtaaactctctgctgaaaaagtggaaattg

SEQ ID NO: 97521 - DNA, 42 bp, Artificial Sequence
  Description of Artificial Sequence: Synthetic oligonucleotide
catggatgttagtaaactctctgctgaaaaagtggaaattgc

SEQ ID NO: 97522 - DNA, 44 bp, Artificial Sequence
  Description of Artificial Sequence: Synthetic oligonucleotide
atggatgttagtaaactctctgctgaaaaagtggaaattgcaac

SEQ ID NO: 97523 - DNA, 43 bp, Artificial Sequence
  Description of Artificial Sequence: Synthetic oligonucleotide
tggatgttagtaaactctctgctgaaaaagtggaaattgcaac

SEQ ID NO: 97524 - DNA, 42 bp, Artificial Sequence
  Description of Artificial Sequence: Synthetic oligonucleotide
ggatgttagtaaactctctgctgaaaaagtggaaattgcaac

SEQ ID NO: 97525 - DNA, 43 bp, Artificial Sequence
  Description of Artificial Sequence: Synthetic oligonucleotide
gatgttagtaaactctctgctgaaaaagtggaaattgcaacac

SEQ ID NO: 97526 - DNA, 46 bp, Artificial Sequence
  Description of Artificial Sequence: Synthetic oligonucleotide
atgttagtaaactctctgctgaaaaagtggaaattgcaacactaac

SEQ ID NO: 97527 - DNA, 45 bp, Artificial Sequence
  Description of Artificial Sequence: Synthetic oligonucleotide
tgttagtaaactctctgctgaaaaagtggaaattgcaacactaac

SEQ ID NO: 97528 - DNA, 44 bp, Artificial Sequence
  Description of Artificial Sequence: Synthetic oligonucleotide
gttagtaaactctctgctgaaaaagtggaaattgcaacactaac

SEQ ID NO: 97529 - DNA, 46 bp, Artificial Sequence
  Description of Artificial Sequence: Synthetic oligonucleotide
ttagtaaactctctgctgaaaaagtggaaattgcaacactaacaag

SEQ ID NO: 97530 - DNA, 45 bp, Artificial Sequence
  Description of Artificial Sequence: Synthetic oligonucleotide
tagtaaactctctgctgaaaaagtggaaattgcaacactaacaag

SEQ ID NO: 97531 - DNA, 44 bp, Artificial Sequence
  Description of Artificial Sequence: Synthetic oligonucleotide
agtaaactctctgctgaaaaagtggaaattgcaacactaacaag

SEQ ID NO: 97532 - DNA, 43 bp, Artificial Sequence
  Description of Artificial Sequence: Synthetic oligonucleotide
gtaaactctctgctgaaaaagtggaaattgcaacactaacaag

SEQ ID NO: 97533 - DNA, 44 bp, Artificial Sequence
  Description of Artificial Sequence: Synthetic oligonucleotide
taaactctctgctgaaaaagtggaaattgcaacactaacaagag

SEQ ID NO: 97534 - DNA, 43 bp, Artificial Sequence
  Description of Artificial Sequence: Synthetic oligonucleotide
aaactctctgctgaaaaagtggaaattgcaacactaacaagag

SEQ ID NO: 97535 - DNA, 42 bp, Artificial Sequence
  Description of Artificial Sequence: Synthetic oligonucleotide
aactctctgctgaaaaagtggaaattgcaacactaacaagag

SEQ ID NO: 97536 - DNA, 41 bp, Artificial Sequence
  Description of Artificial Sequence: Synthetic oligonucleotide
actctctgctgaaaaagtggaaattgcaacactaacaagag

SEQ ID NO: 97537 - DNA, 40 bp, Artificial Sequence
  Description of Artificial Sequence: Synthetic oligonucleotide
ctctctgctgaaaaagtggaaattgcaacactaacaagag

SEQ ID NO: 97538 - DNA, 41 bp, Artificial Sequence
  Description of Artificial Sequence: Synthetic oligonucleotide
tctctgctgaaaaagtggaaattgcaacactaacaagagag

SEQ ID NO: 97539 - DNA, 40 bp, Artificial Sequence
  Description of Artificial Sequence: Synthetic oligonucleotide
ctctgctgaaaaagtggaaattgcaacactaacaagagag

SEQ ID NO: 97540 - DNA, 43 bp, Artificial Sequence
  Description of Artificial Sequence: Synthetic oligonucleotide
tctgctgaaaaagtggaaattgcaacactaacaagagagaatg

SEQ ID NO: 97541 - DNA, 42 bp, Artificial Sequence
  Description of Artificial Sequence: Synthetic oligonucleotide
ctgctgaaaaagtggaaattgcaacactaacaagagagaatg

SEQ ID NO: 97542 - DNA, 42 bp, Artificial Sequence
  Description of Artificial Sequence: Synthetic oligonucleotide
tgctgaaaaagtggaaattgcaacactaacaagagagaatgg

SEQ ID NO: 97543 - DNA, 41 bp, Artificial Sequence
  Description of Artificial Sequence: Synthetic oligonucleotide
gctgaaaaagtggaaattgcaacactaacaagagagaatgg

SEQ ID NO: 97544 - DNA, 44 bp, Artificial Sequence
  Description of Artificial Sequence: Synthetic oligonucleotide
ctgaaaaagtggaaattgcaacactaacaagagagaatggaaag

SEQ ID NO: 97545 - DNA, 45 bp, Artificial Sequence
  Description of Artificial Sequence: Synthetic oligonucleotide
tgaaaaagtggaaattgcaacactaacaagagagaatggaaagac

SEQ ID NO: 97546 - DNA, 44 bp, Artificial Sequence
  Description of Artificial Sequence: Synthetic oligonucleotide
gaaaaagtggaaattgcaacactaacaagagagaatggaaagac

SEQ ID NO: 97547 - DNA, 45 bp, Artificial Sequence
  Description of Artificial Sequence: Synthetic oligonucleotide
aaaaagtggaaattgcaacactaacaagagagaatggaaagacag

SEQ ID NO: 97548 - DNA, 44 bp, Artificial Sequence
  Description of Artificial Sequence: Synthetic oligonucleotide
aaaagtggaaattgcaacactaacaagagagaatggaaagacag

SEQ ID NO: 97549 - DNA, 43 bp, Artificial Sequence
  Description of Artificial Sequence: Synthetic oligonucleotide
aaagtggaaattgcaacactaacaagagagaatggaaagacag

SEQ ID NO: 97550 - DNA, 42 bp, Artificial Sequence
  Description of Artificial Sequence: Synthetic oligonucleotide
aagtggaaattgcaacactaacaagagagaatggaaagacag

SEQ ID NO: 97551 - DNA, 41 bp, Artificial Sequence
  Description of Artificial Sequence: Synthetic oligonucleotide
agtggaaattgcaacactaacaagagagaatggaaagacag

SEQ ID NO: 97552 - DNA, 40 bp, Artificial Sequence
  Description of Artificial Sequence: Synthetic oligonucleotide
gtggaaattgcaacactaacaagagagaatggaaagacag

SEQ ID NO: 97553 - DNA, 44 bp, Artificial Sequence
  Description of Artificial Sequence: Synthetic oligonucleotide
tggaaattgcaacactaacaagagagaatggaaagacagtaatc

SEQ ID NO: 97554 - DNA, 43 bp, Artificial Sequence
  Description of Artificial Sequence: Synthetic oligonucleotide
ggaaattgcaacactaacaagagagaatggaaagacagtaatc

SEQ ID NO: 97555 - DNA, 44 bp, Artificial Sequence
  Description of Artificial Sequence: Synthetic oligonucleotide
gaaattgcaacactaacaagagagaatggaaagacagtaatcag

SEQ ID NO: 97556 - DNA, 45 bp, Artificial Sequence
  Description of Artificial Sequence: Synthetic oligonucleotide
aaattgcaacactaacaagagagaatggaaagacagtaatcagag

SEQ ID NO: 97557 - DNA, 44 bp, Artificial Sequence
  Description of Artificial Sequence: Synthetic oligonucleotide
aattgcaacactaacaagagagaatggaaagacagtaatcagag

SEQ ID NO: 97558 - DNA, 43 bp, Artificial Sequence
  Description of Artificial Sequence: Synthetic oligonucleotide
attgcaacactaacaagagagaatggaaagacagtaatcagag

SEQ ID NO: 97559 - DNA, 42 bp, Artificial Sequence
  Description of Artificial Sequence: Synthetic oligonucleotide
ttgcaacactaacaagagagaatggaaagacagtaatcagag

SEQ ID NO: 97560 - DNA, 41 bp, Artificial Sequence
  Description of Artificial Sequence: Synthetic oligonucleotide
tgcaacactaacaagagagaatggaaagacagtaatcagag

SEQ ID NO: 97561 - DNA, 40 bp, Artificial Sequence
  Description of Artificial Sequence: Synthetic oligonucleotide
gcaacactaacaagagagaatggaaagacagtaatcagag

SEQ ID NO: 97562 - DNA, 42 bp, Artificial Sequence
  Description of Artificial Sequence: Synthetic oligonucleotide
caacactaacaagagagaatggaaagacagtaatcagagttc

SEQ ID NO: 97563 - DNA, 43 bp, Artificial Sequence
  Description of Artificial Sequence: Synthetic oligonucleotide
aacactaacaagagagaatggaaagacagtaatcagagttctc

SEQ ID NO: 97564 - DNA, 42 bp, Artificial Sequence
  Description of Artificial Sequence: Synthetic oligonucleotide
acactaacaagagagaatggaaagacagtaatcagagttctc

SEQ ID NO: 97565 - DNA, 41 bp, Artificial Sequence
  Description of Artificial Sequence: Synthetic oligonucleotide
cactaacaagagagaatggaaagacagtaatcagagttctc

SEQ ID NO: 97566 - DNA, 44 bp, Artificial Sequence
  Description of Artificial Sequence: Synthetic oligonucleotide
actaacaagagagaatggaaagacagtaatcagagttctcaaac

SEQ ID NO: 97567 - DNA, 43 bp, Artificial Sequence
  Description of Artificial Sequence: Synthetic oligonucleotide
ctaacaagagagaatggaaagacagtaatcagagttctcaaac

SEQ ID NO: 97568 - DNA, 48 bp, Artificial Sequence
  Description of Artificial Sequence: Synthetic oligonucleotide
taacaagagagaatggaaagacagtaatcagagttctcaaacaaaaag

SEQ ID NO: 97569 - DNA, 47 bp, Artificial Sequence
  Description of Artificial Sequence: Synthetic oligonucleotide
aacaagagagaatggaaagacagtaatcagagttctcaaacaaaaag

SEQ ID NO: 97570 - DNA, 46 bp, Artificial Sequence
  Description of Artificial Sequence: Synthetic oligonucleotide
acaagagagaatggaaagacagtaatcagagttctcaaacaaaaag

SEQ ID NO: 97571 - DNA, 45 bp, Artificial Sequence
  Description of Artificial Sequence: Synthetic oligonucleotide
caagagagaatggaaagacagtaatcagagttctcaaacaaaaag

SEQ ID NO: 97572 - DNA, 47 bp, Artificial Sequence
  Description of Artificial Sequence: Synthetic oligonucleotide
aagagagaatggaaagacagtaatcagagttctcaaacaaaaagaag

SEQ ID NO: 97573 - DNA, 46 bp, Artificial Sequence
  Description of Artificial Sequence: Synthetic oligonucleotide
agagagaatggaaagacagtaatcagagttctcaaacaaaaagaag

SEQ ID NO: 97574 - DNA, 45 bp, Artificial Sequence
  Description of Artificial Sequence: Synthetic oligonucleotide
gagagaatggaaagacagtaatcagagttctcaaacaaaaagaag

SEQ ID NO: 97575 - DNA, 46 bp, Artificial Sequence
  Description of Artificial Sequence: Synthetic oligonucleotide
agagaatggaaagacagtaatcagagttctcaaacaaaaagaagtg

SEQ ID NO: 97576 - DNA, 45 bp, Artificial Sequence
  Description of Artificial Sequence: Synthetic oligonucleotide
gagaatggaaagacagtaatcagagttctcaaacaaaaagaagtg

SEQ ID NO: 97577 - DNA, 45 bp, Artificial Sequence
  Description of Artificial Sequence: Synthetic oligonucleotide
agaatggaaagacagtaatcagagttctcaaacaaaaagaagtgg

SEQ ID NO: 97578 - DNA, 44 bp, Artificial Sequence
  Description of Artificial Sequence: Synthetic oligonucleotide
gaatggaaagacagtaatcagagttctcaaacaaaaagaagtgg

SEQ ID NO: 97579 - DNA, 45 bp, Artificial Sequence
  Description of Artificial Sequence: Synthetic oligonucleotide
aatggaaagacagtaatcagagttctcaaacaaaaagaagtggag

SEQ ID NO: 97580 - DNA, 44 bp, Artificial Sequence
  Description of Artificial Sequence: Synthetic oligonucleotide
atggaaagacagtaatcagagttctcaaacaaaaagaagtggag

SEQ ID NO: 97581 - DNA, 43 bp, Artificial Sequence
  Description of Artificial Sequence: Synthetic oligonucleotide
tggaaagacagtaatcagagttctcaaacaaaaagaagtggag

SEQ ID NO: 97582 - DNA, 42 bp, Artificial Sequence
  Description of Artificial Sequence: Synthetic oligonucleotide
ggaaagacagtaatcagagttctcaaacaaaaagaagtggag

SEQ ID NO: 97583 - DNA, 42 bp, Artificial Sequence
  Description of Artificial Sequence: Synthetic oligonucleotide
gaaagacagtaatcagagttctcaaacaaaaagaagtggagc

SEQ ID NO: 97584 - DNA, 43 bp, Artificial Sequence
  Description of Artificial Sequence: Synthetic oligonucleotide
aaagacagtaatcagagttctcaaacaaaaagaagtggagcag

SEQ ID NO: 97585 - DNA, 42 bp, Artificial Sequence
  Description of Artificial Sequence: Synthetic oligonucleotide
aagacagtaatcagagttctcaaacaaaaagaagtggagcag

SEQ ID NO: 97586 - DNA, 41 bp, Artificial Sequence
  Description of Artificial Sequence: Synthetic oligonucleotide
agacagtaatcagagttctcaaacaaaaagaagtggagcag

SEQ ID NO: 97587 - DNA, 40 bp, Artificial Sequence
  Description of Artificial Sequence: Synthetic oligonucleotide
gacagtaatcagagttctcaaacaaaaagaagtggagcag

SEQ ID NO: 97588 - DNA, 42 bp, Artificial Sequence
  Description of Artificial Sequence: Synthetic oligonucleotide
acagtaatcagagttctcaaacaaaaagaagtggagcagttg

SEQ ID NO: 97589 - DNA, 41 bp, Artificial Sequence
  Description of Artificial Sequence: Synthetic oligonucleotide
cagtaatcagagttctcaaacaaaaagaagtggagcagttg

SEQ ID NO: 97590 - DNA, 43 bp, Artificial Sequence
  Description of Artificial Sequence: Synthetic oligonucleotide
agtaatcagagttctcaaacaaaaagaagtggagcagttgatc

SEQ ID NO: 97591 - DNA, 42 bp, Artificial Sequence
  Description of Artificial Sequence: Synthetic oligonucleotide
gtaatcagagttctcaaacaaaaagaagtggagcagttgatc

SEQ ID NO: 97592 - DNA, 48 bp, Artificial Sequence
  Description of Artificial Sequence: Synthetic oligonucleotide
taatcagagttctcaaacaaaaagaagtggagcagttgatcaaaaaac

SEQ ID NO: 97593 - DNA, 47 bp, Artificial Sequence
  Description of Artificial Sequence: Synthetic oligonucleotide
aatcagagttctcaaacaaaaagaagtggagcagttgatcaaaaaac

SEQ ID NO: 97594 - DNA, 46 bp, Artificial Sequence
  Description of Artificial Sequence: Synthetic oligonucleotide
atcagagttctcaaacaaaaagaagtggagcagttgatcaaaaaac

SEQ ID NO: 97595 - DNA, 45 bp, Artificial Sequence
  Description of Artificial Sequence: Synthetic oligonucleotide
tcagagttctcaaacaaaaagaagtggagcagttgatcaaaaaac

SEQ ID NO: 97596 - DNA, 44 bp, Artificial Sequence
  Description of Artificial Sequence: Synthetic oligonucleotide
cagagttctcaaacaaaaagaagtggagcagttgatcaaaaaac

SEQ ID NO: 97597 - DNA, 46 bp, Artificial Sequence
  Description of Artificial Sequence: Synthetic oligonucleotide
agagttctcaaacaaaaagaagtggagcagttgatcaaaaaacatg

SEQ ID NO: 97598 - DNA, 45 bp, Artificial Sequence
  Description of Artificial Sequence: Synthetic oligonucleotide
gagttctcaaacaaaaagaagtggagcagttgatcaaaaaacatg

SEQ ID NO: 97599 - DNA, 46 bp, Artificial Sequence
  Description of Artificial Sequence: Synthetic oligonucleotide
agttctcaaacaaaaagaagtggagcagttgatcaaaaaacatgag

SEQ ID NO: 97600 - DNA, 45 bp, Artificial Sequence
  Description of Artificial Sequence: Synthetic oligonucleotide
gttctcaaacaaaaagaagtggagcagttgatcaaaaaacatgag

SEQ ID NO: 97601 - DNA, 45 bp, Artificial Sequence
  Description of Artificial Sequence: Synthetic oligonucleotide
ttctcaaacaaaaagaagtggagcagttgatcaaaaaacatgagg

SEQ ID NO: 97602 - DNA, 44 bp, Artificial Sequence
  Description of Artificial Sequence: Synthetic oligonucleotide
tctcaaacaaaaagaagtggagcagttgatcaaaaaacatgagg

SEQ ID NO: 97603 - DNA, 43 bp, Artificial Sequence
  Description of Artificial Sequence: Synthetic oligonucleotide
ctcaaacaaaaagaagtggagcagttgatcaaaaaacatgagg

SEQ ID NO: 97604 - DNA, 45 bp, Artificial Sequence
  Description of Artificial Sequence: Synthetic oligonucleotide
tcaaacaaaaagaagtggagcagttgatcaaaaaacatgaggaag

SEQ ID NO: 97605 - DNA, 44 bp, Artificial Sequence
  Description of Artificial Sequence: Synthetic oligonucleotide
caaacaaaaagaagtggagcagttgatcaaaaaacatgaggaag

SEQ ID NO: 97606 - DNA, 46 bp, Artificial Sequence
  Description of Artificial Sequence: Synthetic oligonucleotide
aaacaaaaagaagtggagcagttgatcaaaaaacatgaggaagaag

SEQ ID NO: 97607 - DNA, 45 bp, Artificial Sequence
  Description of Artificial Sequence: Synthetic oligonucleotide
aacaaaaagaagtggagcagttgatcaaaaaacatgaggaagaag

SEQ ID NO: 97608 - DNA, 44 bp, Artificial Sequence
  Description of Artificial Sequence: Synthetic oligonucleotide
acaaaaagaagtggagcagttgatcaaaaaacatgaggaagaag

SEQ ID NO: 97609 - DNA, 43 bp, Artificial Sequence
  Description of Artificial Sequence: Synthetic oligonucleotide
caaaaagaagtggagcagttgatcaaaaaacatgaggaagaag

SEQ ID NO: 97610 - DNA, 45 bp, Artificial Sequence
  Description of Artificial Sequence: Synthetic oligonucleotide
aaaaagaagtggagcagttgatcaaaaaacatgaggaagaagaag

SEQ ID NO: 97611 - DNA, 44 bp, Artificial Sequence
  Description of Artificial Sequence: Synthetic oligonucleotide
aaaagaagtggagcagttgatcaaaaaacatgaggaagaagaag

SEQ ID NO: 97612 - DNA, 43 bp, Artificial Sequence
  Description of Artificial Sequence: Synthetic oligonucleotide
aaagaagtggagcagttgatcaaaaaacatgaggaagaagaag

SEQ ID NO: 97613 - DNA, 42 bp, Artificial Sequence
  Description of Artificial Sequence: Synthetic oligonucleotide
aagaagtggagcagttgatcaaaaaacatgaggaagaagaag

SEQ ID NO: 97614 - DNA, 41 bp, Artificial Sequence
  Description of Artificial Sequence: Synthetic oligonucleotide
agaagtggagcagttgatcaaaaaacatgaggaagaagaag

SEQ ID NO: 97615 - DNA, 40 bp, Artificial Sequence
  Description of Artificial Sequence: Synthetic oligonucleotide
gaagtggagcagttgatcaaaaaacatgaggaagaagaag

SEQ ID NO: 97616 - DNA, 40 bp, Artificial Sequence
  Description of Artificial Sequence: Synthetic oligonucleotide
aagtggagcagttgatcaaaaaacatgaggaagaagaagc

SEQ ID NO: 97617 - DNA, 39 bp, Artificial Sequence
  Description of Artificial Sequence: Synthetic oligonucleotide
agtggagcagttgatcaaaaaacatgaggaagaagaagc

SEQ ID NO: 97618 - DNA, 38 bp, Artificial Sequence
  Description of Artificial Sequence: Synthetic oligonucleotide
gtggagcagttgatcaaaaaacatgaggaagaagaagc

SEQ ID NO: 97619 - DNA, 38 bp, Artificial Sequence
  Description of Artificial Sequence: Synthetic oligonucleotide
tggagcagttgatcaaaaaacatgaggaagaagaagcc

SEQ ID NO: 97620 - DNA, 37 bp, Artificial Sequence
  Description of Artificial Sequence: Synthetic oligonucleotide
ggagcagttgatcaaaaaacatgaggaagaagaagcc

SEQ ID NO: 97621 - DNA, 40 bp, Artificial Sequence
  Description of Artificial Sequence: Synthetic oligonucleotide
gagcagttgatcaaaaaacatgaggaagaagaagccaaag

SEQ ID NO: 97622 - DNA, 40 bp, Artificial Sequence
  Description of Artificial Sequence: Synthetic oligonucleotide
agcagttgatcaaaaaacatgaggaagaagaagccaaagc

SEQ ID NO: 97623 - DNA, 39 bp, Artificial Sequence
  Description of Artificial Sequence: Synthetic oligonucleotide
gcagttgatcaaaaaacatgaggaagaagaagccaaagc

SEQ ID NO: 97624 - DNA, 40 bp, Artificial Sequence
  Description of Artificial Sequence: Synthetic oligonucleotide
cagttgatcaaaaaacatgaggaagaagaagccaaagctg

SEQ ID NO: 97625 - DNA, 41 bp, Artificial Sequence
  Description of Artificial Sequence: Synthetic oligonucleotide
agttgatcaaaaaacatgaggaagaagaagccaaagctgag

SEQ ID NO: 97626 - DNA, 40 bp, Artificial Sequence
  Description of Artificial Sequence: Synthetic oligonucleotide
gttgatcaaaaaacatgaggaagaagaagccaaagctgag

SEQ ID NO: 97627 - DNA, 40 bp, Artificial Sequence
  Description of Artificial Sequence: Synthetic oligonucleotide
ttgatcaaaaaacatgaggaagaagaagccaaagctgagc

SEQ ID NO: 97628 - DNA, 39 bp, Artificial Sequence
  Description of Artificial Sequence: Synthetic oligonucleotide
tgatcaaaaaacatgaggaagaagaagccaaagctgagc

SEQ ID NO: 97629 - DNA, 38 bp, Artificial Sequence
  Description of Artificial Sequence: Synthetic oligonucleotide
gatcaaaaaacatgaggaagaagaagccaaagctgagc

SEQ ID NO: 97630 - DNA, 38 bp, Artificial Sequence
  Description of Artificial Sequence: Synthetic oligonucleotide
atcaaaaaacatgaggaagaagaagccaaagctgagcg

SEQ ID NO: 97631 - DNA, 37 bp, Artificial Sequence
  Description of Artificial Sequence: Synthetic oligonucleotide
tcaaaaaacatgaggaagaagaagccaaagctgagcg

SEQ ID NO: 97632 - DNA, 36 bp, Artificial Sequence
  Description of Artificial Sequence: Synthetic oligonucleotide
caaaaaacatgaggaagaagaagccaaagctgagcg

SEQ ID NO: 97633 - DNA, 37 bp, Artificial Sequence
  Description of Artificial Sequence: Synthetic oligonucleotide
aaaaaacatgaggaagaagaagccaaagctgagcgtg

SEQ ID NO: 97634 - DNA, 36 bp, Artificial Sequence
  Description of Artificial Sequence: Synthetic oligonucleotide
aaaaacatgaggaagaagaagccaaagctgagcgtg

SEQ ID NO: 97635 - DNA, 35 bp, Artificial Sequence
  Description of Artificial Sequence: Synthetic oligonucleotide
aaaacatgaggaagaagaagccaaagctgagcgtg

SEQ ID NO: 97636 - DNA, 34 bp, Artificial Sequence
  Description of Artificial Sequence: Synthetic oligonucleotide
aaacatgaggaagaagaagccaaagctgagcgtg

SEQ ID NO: 97637 - DNA, 33 bp, Artificial Sequence
  Description of Artificial Sequence: Synthetic oligonucleotide
aacatgaggaagaagaagccaaagctgagcgtg

SEQ ID NO: 97638 - DNA, 32 bp, Artificial Sequence
  Description of Artificial Sequence: Synthetic oligonucleotide
acatgaggaagaagaagccaaagctgagcgtg

SEQ ID NO: 97639 - DNA, 31 bp, Artificial Sequence
  Description of Artificial Sequence: Synthetic oligonucleotide
catgaggaagaagaagccaaagctgagcgtg

SEQ ID NO: 97640 - DNA, 32 bp, Artificial Sequence
  Description of Artificial Sequence: Synthetic oligonucleotide
atgaggaagaagaagccaaagctgagcgtgag

SEQ ID NO: 97641 - DNA, 31 bp, Artificial Sequence
  Description of Artificial Sequence: Synthetic oligonucleotide
tgaggaagaagaagccaaagctgagcgtgag

SEQ ID NO: 97642 - DNA, 30 bp, Artificial Sequence
  Description of Artificial Sequence: Synthetic oligonucleotide
gaggaagaagaagccaaagctgagcgtgag

SEQ ID NO: 97643 - DNA, 32 bp, Artificial Sequence
  Description of Artificial Sequence: Synthetic oligonucleotide
aggaagaagaagccaaagctgagcgtgagaag

SEQ ID NO: 97644 - DNA, 31 bp, Artificial Sequence
  Description of Artificial Sequence: Synthetic oligonucleotide
ggaagaagaagccaaagctgagcgtgagaag

SEQ ID NO: 97645 - DNA, 34 bp, Artificial Sequence
  Description of Artificial Sequence: Synthetic oligonucleotide
gaagaagaagccaaagctgagcgtgagaagaaag

SEQ ID NO: 97646 - DNA, 39 bp, Artificial Sequence
  Description of Artificial Sequence: Synthetic oligonucleotide
aagaagaagccaaagctgagcgtgagaagaaagaaaaag

SEQ ID NO: 97647 - DNA, 38 bp, Artificial Sequence
  Description of Artificial Sequence: Synthetic oligonucleotide
agaagaagccaaagctgagcgtgagaagaaagaaaaag

SEQ ID NO: 97648 - DNA, 37 bp, Artificial Sequence
  Description of Artificial Sequence: Synthetic oligonucleotide
gaagaagccaaagctgagcgtgagaagaaagaaaaag

SEQ ID NO: 97649 - DNA, 39 bp, Artificial Sequence
  Description of Artificial Sequence: Synthetic oligonucleotide
aagaagccaaagctgagcgtgagaagaaagaaaaagaac

SEQ ID NO: 97650 - DNA, 38 bp, Artificial Sequence
  Description of Artificial Sequence: Synthetic oligonucleotide
agaagccaaagctgagcgtgagaagaaagaaaaagaac

SEQ ID NO: 97651 - DNA, 37 bp, Artificial Sequence
  Description of Artificial Sequence: Synthetic oligonucleotide
gaagccaaagctgagcgtgagaagaaagaaaaagaac

SEQ ID NO: 97652 - DNA, 38 bp, Artificial Sequence
  Description of Artificial Sequence: Synthetic oligonucleotide
aagccaaagctgagcgtgagaagaaagaaaaagaacag

SEQ ID NO: 97653 - DNA, 37 bp, Artificial Sequence
  Description of Artificial Sequence: Synthetic oligonucleotide
agccaaagctgagcgtgagaagaaagaaaaagaacag

SEQ ID NO: 97654 - DNA, 36 bp, Artificial Sequence
  Description of Artificial Sequence: Synthetic oligonucleotide
gccaaagctgagcgtgagaagaaagaaaaagaacag

SEQ ID NO: 97655 - DNA, 39 bp, Artificial Sequence
  Description of Artificial Sequence: Synthetic oligonucleotide
ccaaagctgagcgtgagaagaaagaaaaagaacagaaag

SEQ ID NO: 97656 - DNA, 43 bp, Artificial Sequence
  Description of Artificial Sequence: Synthetic oligonucleotide
caaagctgagcgtgagaagaaagaaaaagaacagaaagaaaag

SEQ ID NO: 97657 - DNA, 43 bp, Artificial Sequence
  Description of Artificial Sequence: Synthetic oligonucleotide
aaagctgagcgtgagaagaaagaaaaagaacagaaagaaaagg

SEQ ID NO: 97658 - DNA, 42 bp, Artificial Sequence
  Description of Artificial Sequence: Synthetic oligonucleotide
aagctgagcgtgagaagaaagaaaaagaacagaaagaaaagg

SEQ ID NO: 97659 - DNA, 41 bp, Artificial Sequence
  Description of Artificial Sequence: Synthetic oligonucleotide
agctgagcgtgagaagaaagaaaaagaacagaaagaaaagg

SEQ ID NO: 97660 - DNA, 40 bp, Artificial Sequence
  Description of Artificial Sequence: Synthetic oligonucleotide
gctgagcgtgagaagaaagaaaaagaacagaaagaaaagg

SEQ ID NO: 97661 - DNA, 47 bp, Artificial Sequence
  Description of Artificial Sequence: Synthetic oligonucleotide
ctgagcgtgagaagaaagaaaaagaacagaaagaaaaggataaatag

SEQ ID NO: 97662 - DNA, 37 bp, Artificial Sequence
  Description of Artificial Sequence: Synthetic oligonucleotide
atatgactccaggaccactatattttctccagaaggg

SEQ ID NO: 97663 - DNA, 36 bp, Artificial Sequence
  Description of Artificial Sequence: Synthetic oligonucleotide
tatgactccaggaccactatattttctccagaaggg

SEQ ID NO: 97664 - DNA, 35 bp, Artificial Sequence
  Description of Artificial Sequence: Synthetic oligonucleotide
atgactccaggaccactatattttctccagaaggg

SEQ ID NO: 97665 - DNA, 34 bp, Artificial Sequence
  Description of Artificial Sequence: Synthetic oligonucleotide
tgactccaggaccactatattttctccagaaggg

SEQ ID NO: 97666 - DNA, 33 bp, Artificial Sequence
  Description of Artificial Sequence: Synthetic oligonucleotide
gactccaggaccactatattttctccagaaggg

SEQ ID NO: 97667 - DNA, 34 bp, Artificial Sequence
  Description of Artificial Sequence: Synthetic oligonucleotide
actccaggaccactatattttctccagaagggac

SEQ ID NO: 97668 - DNA, 33 bp, Artificial Sequence
  Description of Artificial Sequence: Synthetic oligonucleotide
ctccaggaccactatattttctccagaagggac

SEQ ID NO: 97669 - DNA, 35 bp, Artificial Sequence
  Description of Artificial Sequence: Synthetic oligonucleotide
tccaggaccactatattttctccagaagggacatg

SEQ ID NO: 97670 - DNA, 34 bp, Artificial Sequence
  Description of Artificial Sequence: Synthetic oligonucleotide
ccaggaccactatattttctccagaagggacatg

SEQ ID NO: 97671 - DNA, 34 bp, Artificial Sequence
  Description of Artificial Sequence: Synthetic oligonucleotide
caggaccactatattttctccagaagggacatgg

SEQ ID NO: 97672 - DNA, 34 bp, Artificial Sequence
  Description of Artificial Sequence: Synthetic oligonucleotide
aggaccactatattttctccagaagggacatggc

SEQ ID NO: 97673 - DNA, 33 bp, Artificial Sequence
  Description of Artificial Sequence: Synthetic oligonucleotide
ggaccactatattttctccagaagggacatggc

SEQ ID NO: 97674 - DNA, 35 bp, Artificial Sequence
  Description of Artificial Sequence: Synthetic oligonucleotide
gaccactatattttctccagaagggacatggcttg

SEQ ID NO: 97675 - DNA, 35 bp, Artificial Sequence
  Description of Artificial Sequence: Synthetic oligonucleotide
accactatattttctccagaagggacatggcttgc

SEQ ID NO: 97676 - DNA, 34 bp, Artificial Sequence
  Description of Artificial Sequence: Synthetic oligonucleotide
ccactatattttctccagaagggacatggcttgc

SEQ ID NO: 97677 - DNA, 35 bp, Artificial Sequence
  Description of Artificial Sequence: Synthetic oligonucleotide
cactatattttctccagaagggacatggcttgcag

SEQ ID NO: 97678 - DNA, 36 bp, Artificial Sequence
  Description of Artificial Sequence: Synthetic oligonucleotide
actatattttctccagaagggacatggcttgcagtg

SEQ ID NO: 97679 - DNA, 35 bp, Artificial Sequence
  Description of Artificial Sequence: Synthetic oligonucleotide
ctatattttctccagaagggacatggcttgcagtg

SEQ ID NO: 97680 - DNA, 36 bp, Artificial Sequence
  Description of Artificial Sequence: Synthetic oligonucleotide
tatattttctccagaagggacatggcttgcagtgtg

SEQ ID NO: 97681 - DNA, 35 bp, Artificial Sequence
  Description of Artificial Sequence: Synthetic oligonucleotide
atattttctccagaagggacatggcttgcagtgtg

SEQ ID NO: 97682 - DNA, 34 bp, Artificial Sequence
  Description of Artificial Sequence: Synthetic oligonucleotide
tattttctccagaagggacatggcttgcagtgtg

SEQ ID NO: 97683 - DNA, 33 bp, Artificial Sequence
  Description of Artificial Sequence: Synthetic oligonucleotide
attttctccagaagggacatggcttgcagtgtg

SEQ ID NO: 97684 - DNA, 32 bp, Artificial Sequence
  Description of Artificial Sequence: Synthetic oligonucleotide
ttttctccagaagggacatggcttgcagtgtg

SEQ ID NO: 97685 - DNA, 31 bp, Artificial Sequence
  Description of Artificial Sequence: Synthetic oligonucleotide
tttctccagaagggacatggcttgcagtgtg

SEQ ID NO: 97686 - DNA, 30 bp, Artificial Sequence
  Description of Artificial Sequence: Synthetic oligonucleotide
ttctccagaagggacatggcttgcagtgtg

SEQ ID NO: 97687 - DNA, 29 bp, Artificial Sequence
  Description of Artificial Sequence: Synthetic oligonucleotide
tctccagaagggacatggcttgcagtgtg

SEQ ID NO: 97688 - DNA, 28 bp, Artificial Sequence
  Description of Artificial Sequence: Synthetic oligonucleotide
ctccagaagggacatggcttgcagtgtg

SEQ ID NO: 97689 - DNA, 28 bp, Artificial Sequence
  Description of Artificial Sequence: Synthetic oligonucleotide
tccagaagggacatggcttgcagtgtgg

SEQ ID NO: 97690 - DNA, 27 bp, Artificial Sequence
  Description of Artificial Sequence: Synthetic oligonucleotide
ccagaagggacatggcttgcagtgtgg

SEQ ID NO: 97691 - DNA, 27 bp, Artificial Sequence
  Description of Artificial Sequence: Synthetic oligonucleotide
cagaagggacatggcttgcagtgtggc

SEQ ID NO: 97692 - DNA, 28 bp, Artificial Sequence
  Description of Artificial Sequence: Synthetic oligonucleotide
agaagggacatggcttgcagtgtggcag

SEQ ID NO: 97693 - DNA, 27 bp, Artificial Sequence
  Description of Artificial Sequence: Synthetic oligonucleotide
gaagggacatggcttgcagtgtggcag

SEQ ID NO: 97694 - DNA, 27 bp, Artificial Sequence
  Description of Artificial Sequence: Synthetic oligonucleotide
aagggacatggcttgcagtgtggcagg

SEQ ID NO: 97695 - DNA, 26 bp, Artificial Sequence
  Description of Artificial Sequence: Synthetic oligonucleotide
agggacatggcttgcagtgtggcagg

SEQ ID NO: 97696 - DNA, 25 bp, Artificial Sequence
  Description of Artificial Sequence: Synthetic oligonucleotide
gggacatggcttgcagtgtggcagg

SEQ ID NO: 97697 - DNA, 29 bp, Artificial Sequence
  Description of Artificial Sequence: Synthetic oligonucleotide
atggcgtctcgatatgacagggcgatcac

SEQ ID NO: 97698 - DNA, 28 bp, Artificial Sequence
  Description of Artificial Sequence: Synthetic oligonucleotide
tggcgtctcgatatgacagggcgatcac

SEQ ID NO: 97699 - DNA, 27 bp, Artificial Sequence
  Description of Artificial Sequence: Synthetic oligonucleotide
ggcgtctcgatatgacagggcgatcac

SEQ ID NO: 97700 - DNA, 28 bp, Artificial Sequence
  Description of Artificial Sequence: Synthetic oligonucleotide
gcgtctcgatatgacagggcgatcactg

SEQ ID NO: 97701 - DNA, 29 bp, Artificial Sequence
  Description of Artificial Sequence: Synthetic oligonucleotide
cgtctcgatatgacagggcgatcactgtc

SEQ ID NO: 97702 - DNA, 31 bp, Artificial Sequence
  Description of Artificial Sequence: Synthetic oligonucleotide
gtctcgatatgacagggcgatcactgtcttc

SEQ ID NO: 97703 - DNA, 32 bp, Artificial Sequence
  Description of Artificial Sequence: Synthetic oligonucleotide
tctcgatatgacagggcgatcactgtcttctc

SEQ ID NO: 97704 - DNA, 31 bp, Artificial Sequence
  Description of Artificial Sequence: Synthetic oligonucleotide
ctcgatatgacagggcgatcactgtcttctc

SEQ ID NO: 97705 - DNA, 31 bp, Artificial Sequence
  Description of Artificial Sequence: Synthetic oligonucleotide
tcgatatgacagggcgatcactgtcttctcc

SEQ ID NO: 97706 - DNA, 30 bp, Artificial Sequence
  Description of Artificial Sequence: Synthetic oligonucleotide
cgatatgacagggcgatcactgtcttctcc

SEQ ID NO: 97707 - DNA, 30 bp, Artificial Sequence
  Description of Artificial Sequence: Synthetic oligonucleotide
gatatgacagggcgatcactgtcttctccc

SEQ ID NO: 97708 - DNA, 30 bp, Artificial Sequence
  Description of Artificial Sequence: Synthetic oligonucleotide
atatgacagggcgatcactgtcttctcccc

SEQ ID NO: 97709 - DNA, 29 bp, Artificial Sequence
  Description of Artificial Sequence: Synthetic oligonucleotide
tatgacagggcgatcactgtcttctcccc

SEQ ID NO: 97710 - DNA, 28 bp, Artificial Sequence
  Description of Artificial Sequence: Synthetic oligonucleotide
atgacagggcgatcactgtcttctcccc

SEQ ID NO: 97711 - DNA, 27 bp, Artificial Sequence
  Description of Artificial Sequence: Synthetic oligonucleotide
tgacagggcgatcactgtcttctcccc

SEQ ID NO: 97712 - DNA, 27 bp, Artificial Sequence
  Description of Artificial Sequence: Synthetic oligonucleotide
gacagggcgatcactgtcttctcccca

SEQ ID NO: 97713 - DNA, 27 bp, Artificial Sequence
  Description of Artificial Sequence: Synthetic oligonucleotide
acagggcgatcactgtcttctccccag

SEQ ID NO: 97714 - DNA, 27 bp, Artificial Sequence
  Description of Artificial Sequence: Synthetic oligonucleotide
cagggcgatcactgtcttctccccaga

SEQ ID NO: 97715 - DNA, 27 bp, Artificial Sequence
  Description of Artificial Sequence: Synthetic oligonucleotide
agggcgatcactgtcttctccccagac

SEQ ID NO: 97716 - DNA, 26 bp, Artificial Sequence
  Description of Artificial Sequence: Synthetic oligonucleotide
gggcgatcactgtcttctccccagac

SEQ ID NO: 97717 - DNA, 26 bp, Artificial Sequence
  Description of Artificial Sequence: Synthetic oligonucleotide
ggcgatcactgtcttctccccagacg

SEQ ID NO: 97718 - DNA, 27 bp, Artificial Sequence
  Description of Artificial Sequence: Synthetic oligonucleotide
gcgatcactgtcttctccccagacgga

SEQ ID NO: 97719 - DNA, 27 bp, Artificial Sequence
  Description of Artificial Sequence: Synthetic oligonucleotide
cgatcactgtcttctccccagacggac

SEQ ID NO: 97720 - DNA, 28 bp, Artificial Sequence
  Description of Artificial Sequence: Synthetic oligonucleotide
gatcactgtcttctccccagacggacac

SEQ ID NO: 97721 - DNA, 28 bp, Artificial Sequence
  Description of Artificial Sequence: Synthetic oligonucleotide
atcactgtcttctccccagacggacacc

SEQ ID NO: 97722 - DNA, 27 bp, Artificial Sequence
  Description of Artificial Sequence: Synthetic oligonucleotide
tcactgtcttctccccagacggacacc

SEQ ID NO: 97723 - DNA, 27 bp, Artificial Sequence
  Description of Artificial Sequence: Synthetic oligonucleotide
cactgtcttctccccagacggacacct

SEQ ID NO: 97724 - DNA, 31 bp, Artificial Sequence
  Description of Artificial Sequence: Synthetic oligonucleotide
actgtcttctccccagacggacacctttttc

SEQ ID NO: 97725 - DNA, 30 bp, Artificial Sequence
  Description of Artificial Sequence: Synthetic oligonucleotide
ctgtcttctccccagacggacacctttttc

SEQ ID NO: 97726 - DNA, 32 bp, Artificial Sequence
  Description of Artificial Sequence: Synthetic oligonucleotide
tgtcttctccccagacggacacctttttcaag

SEQ ID NO: 97727 - DNA, 31 bp, Artificial Sequence
  Description of Artificial Sequence: Synthetic oligonucleotide
gtcttctccccagacggacacctttttcaag

SEQ ID NO: 97728 - DNA, 33 bp, Artificial Sequence
  Description of Artificial Sequence: Synthetic oligonucleotide
tcttctccccagacggacacctttttcaagttg

SEQ ID NO: 97729 - DNA, 32 bp, Artificial Sequence
  Description of Artificial Sequence: Synthetic oligonucleotide
cttctccccagacggacacctttttcaagttg

SEQ ID NO: 97730 - DNA, 37 bp, Artificial Sequence
  Description of Artificial Sequence: Synthetic oligonucleotide
ttctccccagacggacacctttttcaagttgaatatg

SEQ ID NO: 97731 - DNA, 36 bp, Artificial Sequence
  Description of Artificial Sequence: Synthetic oligonucleotide
tctccccagacggacacctttttcaagttgaatatg

SEQ ID NO: 97732 - DNA, 35 bp, Artificial Sequence
  Description of Artificial Sequence: Synthetic oligonucleotide
ctccccagacggacacctttttcaagttgaatatg

SEQ ID NO: 97733 - DNA, 35 bp, Artificial Sequence
  Description of Artificial Sequence: Synthetic oligonucleotide
tccccagacggacacctttttcaagttgaatatgc

SEQ ID NO: 97734 - DNA, 34 bp, Artificial Sequence
  Description of Artificial Sequence: Synthetic oligonucleotide
ccccagacggacacctttttcaagttgaatatgc

SEQ ID NO: 97735 - DNA, 34 bp, Artificial Sequence
  Description of Artificial Sequence: Synthetic oligonucleotide
cccagacggacacctttttcaagttgaatatgcc

SEQ ID NO: 97736 - DNA, 34 bp, Artificial Sequence
  Description of Artificial Sequence: Synthetic oligonucleotide
ccagacggacacctttttcaagttgaatatgccc

SEQ ID NO: 97737 - DNA, 35 bp, Artificial Sequence
  Description of Artificial Sequence: Synthetic oligonucleotide
cagacggacacctttttcaagttgaatatgcccag

SEQ ID NO: 97738 - DNA, 35 bp, Artificial Sequence
  Description of Artificial Sequence: Synthetic oligonucleotide
agacggacacctttttcaagttgaatatgcccagg

SEQ ID NO: 97739 - DNA, 34 bp, Artificial Sequence
  Description of Artificial Sequence: Synthetic oligonucleotide
gacggacacctttttcaagttgaatatgcccagg

SEQ ID NO: 97740 - DNA, 36 bp, Artificial Sequence
  Description of Artificial Sequence: Synthetic oligonucleotide
acggacacctttttcaagttgaatatgcccaggaag

SEQ ID NO: 97741 - DNA, 35 bp, Artificial Sequence
  Description of Artificial Sequence: Synthetic oligonucleotide
cggacacctttttcaagttgaatatgcccaggaag

SEQ ID NO: 97742 - DNA, 35 bp, Artificial Sequence
  Description of Artificial Sequence: Synthetic oligonucleotide
ggacacctttttcaagttgaatatgcccaggaagc

SEQ ID NO: 97743 - DNA, 35 bp, Artificial Sequence
  Description of Artificial Sequence: Synthetic oligonucleotide
gacacctttttcaagttgaatatgcccaggaagcg

SEQ ID NO: 97744 - DNA, 35 bp, Artificial Sequence
  Description of Artificial Sequence: Synthetic oligonucleotide
acacctttttcaagttgaatatgcccaggaagcgg

SEQ ID NO: 97745 - DNA, 34 bp, Artificial Sequence
  Description of Artificial Sequence: Synthetic oligonucleotide
cacctttttcaagttgaatatgcccaggaagcgg

SEQ ID NO: 97746 - DNA, 35 bp, Artificial Sequence
  Description of Artificial Sequence: Synthetic oligonucleotide
acctttttcaagttgaatatgcccaggaagcggtg

SEQ ID NO: 97747 - DNA, 34 bp, Artificial Sequence
  Description of Artificial Sequence: Synthetic oligonucleotide
cctttttcaagttgaatatgcccaggaagcggtg

SEQ ID NO: 97748 - DNA, 36 bp, Artificial Sequence
  Description of Artificial Sequence: Synthetic oligonucleotide
ctttttcaagttgaatatgcccaggaagcggtgaag

SEQ ID NO: 97749 - DNA, 39 bp, Artificial Sequence
  Description of Artificial Sequence: Synthetic oligonucleotide
tttttcaagttgaatatgcccaggaagcggtgaagaaag

SEQ ID NO: 97750 - DNA, 38 bp, Artificial Sequence
  Description of Artificial Sequence: Synthetic oligonucleotide
ttttcaagttgaatatgcccaggaagcggtgaagaaag

SEQ ID NO: 97751 - DNA, 37 bp, Artificial Sequence
  Description of Artificial Sequence: Synthetic oligonucleotide
tttcaagttgaatatgcccaggaagcggtgaagaaag

SEQ ID NO: 97752 - DNA, 36 bp, Artificial Sequence
  Description of Artificial Sequence: Synthetic oligonucleotide
ttcaagttgaatatgcccaggaagcggtgaagaaag

SEQ ID NO: 97753 - DNA, 35 bp, Artificial Sequence
  Description of Artificial Sequence: Synthetic oligonucleotide
tcaagttgaatatgcccaggaagcggtgaagaaag

SEQ ID NO: 97754 - DNA, 34 bp, Artificial Sequence
  Description of Artificial Sequence: Synthetic oligonucleotide
caagttgaatatgcccaggaagcggtgaagaaag

SEQ ID NO: 97755 - DNA, 34 bp, Artificial Sequence
  Description of Artificial Sequence: Synthetic oligonucleotide
aagttgaatatgcccaggaagcggtgaagaaagg

SEQ ID NO: 97756 - DNA, 33 bp, Artificial Sequence
  Description of Artificial Sequence: Synthetic oligonucleotide
agttgaatatgcccaggaagcggtgaagaaagg

SEQ ID NO: 97757 - DNA, 32 bp, Artificial Sequence
  Description of Artificial Sequence: Synthetic oligonucleotide
gttgaatatgcccaggaagcggtgaagaaagg

SEQ ID NO: 97758 - DNA, 34 bp, Artificial Sequence
  Description of Artificial Sequence: Synthetic oligonucleotide
ttgaatatgcccaggaagcggtgaagaaaggatc

SEQ ID NO: 97759 - DNA, 33 bp, Artificial Sequence
  Description of Artificial Sequence: Synthetic oligonucleotide
tgaatatgcccaggaagcggtgaagaaaggatc

SEQ ID NO: 97760 - DNA, 32 bp, Artificial Sequence
  Description of Artificial Sequence: Synthetic oligonucleotide
gaatatgcccaggaagcggtgaagaaaggatc

SEQ ID NO: 97761 - DNA, 32 bp, Artificial Sequence
  Description of Artificial Sequence: Synthetic oligonucleotide
aatatgcccaggaagcggtgaagaaaggatcc

SEQ ID NO: 97762 - DNA, 31 bp, Artificial Sequence
  Description of Artificial Sequence: Synthetic oligonucleotide
atatgcccaggaagcggtgaagaaaggatcc

SEQ ID NO: 97763 - DNA, 30 bp, Artificial Sequence
  Description of Artificial Sequence: Synthetic oligonucleotide
tatgcccaggaagcggtgaagaaaggatcc

SEQ ID NO: 97764 - DNA, 29 bp, Artificial Sequence
  Description of Artificial Sequence: Synthetic oligonucleotide
atgcccaggaagcggtgaagaaaggatcc

SEQ ID NO: 97765 - DNA, 28 bp, Artificial Sequence
  Description of Artificial Sequence: Synthetic oligonucleotide
tgcccaggaagcggtgaagaaaggatcc

SEQ ID NO: 97766 - DNA, 27 bp, Artificial Sequence
  Description of Artificial Sequence: Synthetic oligonucleotide
gcccaggaagcggtgaagaaaggatcc

SEQ ID NO: 97767 - DNA, 28 bp, Artificial Sequence
  Description of Artificial Sequence: Synthetic oligonucleotide
cccaggaagcggtgaagaaaggatccac

SEQ ID NO: 97768 - DNA, 28 bp, Artificial Sequence
  Description of Artificial Sequence: Synthetic oligonucleotide
ccaggaagcggtgaagaaaggatccacc

SEQ ID NO: 97769 - DNA, 28 bp, Artificial Sequence
  Description of Artificial Sequence: Synthetic oligonucleotide
caggaagcggtgaagaaaggatccaccg

SEQ ID NO: 97770 - DNA, 28 bp, Artificial Sequence
  Description of Artificial Sequence: Synthetic oligonucleotide
aggaagcggtgaagaaaggatccaccgc

SEQ ID NO: 97771 - DNA, 27 bp, Artificial Sequence
  Description of Artificial Sequence: Synthetic oligonucleotide
ggaagcggtgaagaaaggatccaccgc

SEQ ID NO: 97772 - DNA, 27 bp, Artificial Sequence
  Description of Artificial Sequence: Synthetic oligonucleotide
gaagcggtgaagaaaggatccaccgcg

SEQ ID NO: 97773 - DNA, 27 bp, Artificial Sequence
  Description of Artificial Sequence: Synthetic oligonucleotide
aagcggtgaagaaaggatccaccgcgg

SEQ ID NO: 97774 - DNA, 27 bp, Artificial Sequence
  Description of Artificial Sequence: Synthetic oligonucleotide
agcggtgaagaaaggatccaccgcggt

SEQ ID NO: 97775 - DNA, 26 bp, Artificial Sequence
  Description of Artificial Sequence: Synthetic oligonucleotide
gcggtgaagaaaggatccaccgcggt

SEQ ID NO: 97776 - DNA, 26 bp, Artificial Sequence
  Description of Artificial Sequence: Synthetic oligonucleotide
cggtgaagaaaggatccaccgcggtc

SEQ ID NO: 97777 - DNA, 26 bp, Artificial Sequence
  Description of Artificial Sequence: Synthetic oligonucleotide
ggtgaagaaaggatccaccgcggtcg

SEQ ID NO: 97778 - DNA, 27 bp, Artificial Sequence
  Description of Artificial Sequence: Synthetic oligonucleotide
gtgaagaaaggatccaccgcggtcgga

SEQ ID NO: 97779 - DNA, 30 bp, Artificial Sequence
  Description of Artificial Sequence: Synthetic oligonucleotide
tgaagaaaggatccaccgcggtcggaattc

SEQ ID NO: 97780 - DNA, 29 bp, Artificial Sequence
  Description of Artificial Sequence: Synthetic oligonucleotide
gaagaaaggatccaccgcggtcggaattc

SEQ ID NO: 97781 - DNA, 29 bp, Artificial Sequence
  Description of Artificial Sequence: Synthetic oligonucleotide
aagaaaggatccaccgcggtcggaattcg

SEQ ID NO: 97782 - DNA, 28 bp, Artificial Sequence
  Description of Artificial Sequence: Synthetic oligonucleotide
agaaaggatccaccgcggtcggaattcg

SEQ ID NO: 97783 - DNA, 27 bp, Artificial Sequence
  Description of Artificial Sequence: Synthetic oligonucleotide
gaaaggatccaccgcggtcggaattcg

SEQ ID NO: 97784 - DNA, 28 bp, Artificial Sequence
  Description of Artificial Sequence: Synthetic oligonucleotide
aaaggatccaccgcggtcggaattcgag

SEQ ID NO: 97785 - DNA, 27 bp, Artificial Sequence
  Description of Artificial Sequence: Synthetic oligonucleotide
aaggatccaccgcggtcggaattcgag

SEQ ID NO: 97786 - DNA, 26 bp, Artificial Sequence
  Description of Artificial Sequence: Synthetic oligonucleotide
aggatccaccgcggtcggaattcgag

SEQ ID NO: 97787 - DNA, 25 bp, Artificial Sequence
  Description of Artificial Sequence: Synthetic oligonucleotide
ggatccaccgcggtcggaattcgag

SEQ ID NO: 97788 - DNA, 27 bp, Artificial Sequence
  Description of Artificial Sequence: Synthetic oligonucleotide
gatccaccgcggtcggaattcgaggta

SEQ ID NO: 97789 - DNA, 27 bp, Artificial Sequence
  Description of Artificial Sequence: Synthetic oligonucleotide
atccaccgcggtcggaattcgaggtac

SEQ ID NO: 97790 - DNA, 26 bp, Artificial Sequence
  Description of Artificial Sequence: Synthetic oligonucleotide
tccaccgcggtcggaattcgaggtac

SEQ ID NO: 97791 - DNA, 25 bp, Artificial Sequence
  Description of Artificial Sequence: Synthetic oligonucleotide
ccaccgcggtcggaattcgaggtac

SEQ ID NO: 97792 - DNA, 27 bp, Artificial Sequence
  Description of Artificial Sequence: Synthetic oligonucleotide
caccgcggtcggaattcgaggtaccaa

SEQ ID NO: 97793 - DNA, 31 bp, Artificial Sequence
  Description of Artificial Sequence: Synthetic oligonucleotide
accgcggtcggaattcgaggtaccaatatag

SEQ ID NO: 97794 - DNA, 30 bp, Artificial Sequence
  Description of Artificial Sequence: Synthetic oligonucleotide
ccgcggtcggaattcgaggtaccaatatag

SEQ ID NO: 97795 - DNA, 32 bp, Artificial Sequence
  Description of Artificial Sequence: Synthetic oligonucleotide
cgcggtcggaattcgaggtaccaatatagttg

SEQ ID NO: 97796 - DNA, 34 bp, Artificial Sequence
  Description of Artificial Sequence: Synthetic oligonucleotide
gcggtcggaattcgaggtaccaatatagttgttc

SEQ ID NO: 97797 - DNA, 36 bp, Artificial Sequence
  Description of Artificial Sequence: Synthetic oligonucleotide
cggtcggaattcgaggtaccaatatagttgttcttg

SEQ ID NO: 97798 - DNA, 36 bp, Artificial Sequence
  Description of Artificial Sequence: Synthetic oligonucleotide
ggtcggaattcgaggtaccaatatagttgttcttgg

SEQ ID NO: 97799 - DNA, 36 bp, Artificial Sequence
  Description of Artificial Sequence: Synthetic oligonucleotide
gtcggaattcgaggtaccaatatagttgttcttggg

SEQ ID NO: 97800 - DNA, 36 bp, Artificial Sequence
  Description of Artificial Sequence: Synthetic oligonucleotide
tcggaattcgaggtaccaatatagttgttcttgggg

SEQ ID NO: 97801 - DNA, 35 bp, Artificial Sequence
  Description of Artificial Sequence: Synthetic oligonucleotide
cggaattcgaggtaccaatatagttgttcttgggg

SEQ ID NO: 97802 - DNA, 37 bp, Artificial Sequence
  Description of Artificial Sequence: Synthetic oligonucleotide
ggaattcgaggtaccaatatagttgttcttggggtag

SEQ ID NO: 97803 - DNA, 46 bp, Artificial Sequence
  Description of Artificial Sequence: Synthetic oligonucleotide
gaattcgaggtaccaatatagttgttcttggggtagaaaaaaaatc

SEQ ID NO: 97804 - DNA, 47 bp, Artificial Sequence
  Description of Artificial Sequence: Synthetic oligonucleotide
aattcgaggtaccaatatagttgttcttggggtagaaaaaaaatctg

SEQ ID NO: 97805 - DNA, 46 bp, Artificial Sequence
  Description of Artificial Sequence: Synthetic oligonucleotide
attcgaggtaccaatatagttgttcttggggtagaaaaaaaatctg

SEQ ID NO: 97806 - DNA, 45 bp, Artificial Sequence
  Description of Artificial Sequence: Synthetic oligonucleotide
ttcgaggtaccaatatagttgttcttggggtagaaaaaaaatctg

SEQ ID NO: 97807 - DNA, 44 bp, Artificial Sequence
  Description of Artificial Sequence: Synthetic oligonucleotide
tcgaggtaccaatatagttgttcttggggtagaaaaaaaatctg

SEQ ID NO: 97808 - DNA, 43 bp, Artificial Sequence
  Description of Artificial Sequence: Synthetic oligonucleotide
cgaggtaccaatatagttgttcttggggtagaaaaaaaatctg

SEQ ID NO: 97809 - DNA, 45 bp, Artificial Sequence
  Description of Artificial Sequence: Synthetic oligonucleotide
gaggtaccaatatagttgttcttggggtagaaaaaaaatctgttg

SEQ ID NO: 97810 - DNA, 45 bp, Artificial Sequence
  Description of Artificial Sequence: Synthetic oligonucleotide
aggtaccaatatagttgttcttggggtagaaaaaaaatctgttgc

SEQ ID NO: 97811 - DNA, 44 bp, Artificial Sequence
  Description of Artificial Sequence: Synthetic oligonucleotide
ggtaccaatatagttgttcttggggtagaaaaaaaatctgttgc

SEQ ID NO: 97812 - DNA, 44 bp, Artificial Sequence
  Description of Artificial Sequence: Synthetic oligonucleotide
gtaccaatatagttgttcttggggtagaaaaaaaatctgttgcc

SEQ ID NO: 97813 - DNA, 46 bp, Artificial Sequence
  Description of Artificial Sequence: Synthetic oligonucleotide
taccaatatagttgttcttggggtagaaaaaaaatctgttgccaag

SEQ ID NO: 97814 - DNA, 45 bp, Artificial Sequence
  Description of Artificial Sequence: Synthetic oligonucleotide
accaatatagttgttcttggggtagaaaaaaaatctgttgccaag

SEQ ID NO: 97815 - DNA, 44 bp, Artificial Sequence
  Description of Artificial Sequence: Synthetic oligonucleotide
ccaatatagttgttcttggggtagaaaaaaaatctgttgccaag

SEQ ID NO: 97816 - DNA, 44 bp, Artificial Sequence
  Description of Artificial Sequence: Synthetic oligonucleotide
caatatagttgttcttggggtagaaaaaaaatctgttgccaagc

SEQ ID NO: 97817 - DNA, 46 bp, Artificial Sequence
  Description of Artificial Sequence: Synthetic oligonucleotide
aatatagttgttcttggggtagaaaaaaaatctgttgccaagcttc

SEQ ID NO: 97818 - DNA, 45 bp, Artificial Sequence
  Description of Artificial Sequence: Synthetic oligonucleotide
atatagttgttcttggggtagaaaaaaaatctgttgccaagcttc

SEQ ID NO: 97819 - DNA, 44 bp, Artificial Sequence
  Description of Artificial Sequence: Synthetic oligonucleotide
tatagttgttcttggggtagaaaaaaaatctgttgccaagcttc

SEQ ID NO: 97820 - DNA, 43 bp, Artificial Sequence
  Description of Artificial Sequence: Synthetic oligonucleotide
atagttgttcttggggtagaaaaaaaatctgttgccaagcttc

SEQ ID NO: 97821 - DNA, 42 bp, Artificial Sequence
  Description of Artificial Sequence: Synthetic oligonucleotide
tagttgttcttggggtagaaaaaaaatctgttgccaagcttc

SEQ ID NO: 97822 - DNA, 41 bp, Artificial Sequence
  Description of Artificial Sequence: Synthetic oligonucleotide
agttgttcttggggtagaaaaaaaatctgttgccaagcttc

SEQ ID NO: 97823 - DNA, 40 bp, Artificial Sequence
  Description of Artificial Sequence: Synthetic oligonucleotide
gttgttcttggggtagaaaaaaaatctgttgccaagcttc

SEQ ID NO: 97824 - DNA, 42 bp, Artificial Sequence
  Description of Artificial Sequence: Synthetic oligonucleotide
ttgttcttggggtagaaaaaaaatctgttgccaagcttcaag

SEQ ID NO: 97825 - DNA, 41 bp, Artificial Sequence
  Description of Artificial Sequence: Synthetic oligonucleotide
tgttcttggggtagaaaaaaaatctgttgccaagcttcaag

SEQ ID NO: 97826 - DNA, 40 bp, Artificial Sequence
  Description of Artificial Sequence: Synthetic oligonucleotide
gttcttggggtagaaaaaaaatctgttgccaagcttcaag

SEQ ID NO: 97827 - DNA, 42 bp, Artificial Sequence
  Description of Artificial Sequence: Synthetic oligonucleotide
ttcttggggtagaaaaaaaatctgttgccaagcttcaagatg

SEQ ID NO: 97828 - DNA, 41 bp, Artificial Sequence
  Description of Artificial Sequence: Synthetic oligonucleotide
tcttggggtagaaaaaaaatctgttgccaagcttcaagatg

SEQ ID NO: 97829 - DNA, 40 bp, Artificial Sequence
  Description of Artificial Sequence: Synthetic oligonucleotide
cttggggtagaaaaaaaatctgttgccaagcttcaagatg

SEQ ID NO: 97830 - DNA, 43 bp, Artificial Sequence
  Description of Artificial Sequence: Synthetic oligonucleotide
ttggggtagaaaaaaaatctgttgccaagcttcaagatgaaag

SEQ ID NO: 97831 - DNA, 42 bp, Artificial Sequence
  Description of Artificial Sequence: Synthetic oligonucleotide
tggggtagaaaaaaaatctgttgccaagcttcaagatgaaag

SEQ ID NO: 97832 - DNA, 41 bp, Artificial Sequence
  Description of Artificial Sequence: Synthetic oligonucleotide
ggggtagaaaaaaaatctgttgccaagcttcaagatgaaag

SEQ ID NO: 97833 - DNA, 43 bp, Artificial Sequence
  Description of Artificial Sequence: Synthetic oligonucleotide
gggtagaaaaaaaatctgttgccaagcttcaagatgaaagaac

SEQ ID NO: 97834 - DNA, 44 bp, Artificial Sequence
  Description of Artificial Sequence: Synthetic oligonucleotide
ggtagaaaaaaaatctgttgccaagcttcaagatgaaagaactg

SEQ ID NO: 97835 - DNA, 45 bp, Artificial Sequence
  Description of Artificial Sequence: Synthetic oligonucleotide
gtagaaaaaaaatctgttgccaagcttcaagatgaaagaactgtg

SEQ ID NO: 97836 - DNA, 46 bp, Artificial Sequence
  Description of Artificial Sequence: Synthetic oligonucleotide
tagaaaaaaaatctgttgccaagcttcaagatgaaagaactgtgag

SEQ ID NO: 97837 - DNA, 45 bp, Artificial Sequence
  Description of Artificial Sequence: Synthetic oligonucleotide
agaaaaaaaatctgttgccaagcttcaagatgaaagaactgtgag

SEQ ID NO: 97838 - DNA, 44 bp, Artificial Sequence
  Description of Artificial Sequence: Synthetic oligonucleotide
gaaaaaaaatctgttgccaagcttcaagatgaaagaactgtgag

SEQ ID NO: 97839 - DNA, 44 bp, Artificial Sequence
  Description of Artificial Sequence: Synthetic oligonucleotide
aaaaaaaatctgttgccaagcttcaagatgaaagaactgtgagg

SEQ ID NO: 97840 - DNA, 43 bp, Artificial Sequence
  Description of Artificial Sequence: Synthetic oligonucleotide
aaaaaaatctgttgccaagcttcaagatgaaagaactgtgagg

SEQ ID NO: 97841 - DNA, 42 bp, Artificial Sequence
  Description of Artificial Sequence: Synthetic oligonucleotide
aaaaaatctgttgccaagcttcaagatgaaagaactgtgagg

SEQ ID NO: 97842 - DNA, 41 bp, Artificial Sequence
  Description of Artificial Sequence: Synthetic oligonucleotide
aaaaatctgttgccaagcttcaagatgaaagaactgtgagg

SEQ ID NO: 97843 - DNA, 40 bp, Artificial Sequence
  Description of Artificial Sequence: Synthetic oligonucleotide
aaaatctgttgccaagcttcaagatgaaagaactgtgagg

SEQ ID NO: 97844 - DNA, 39 bp, Artificial Sequence
  Description of Artificial Sequence: Synthetic oligonucleotide
aaatctgttgccaagcttcaagatgaaagaactgtgagg

SEQ ID NO: 97845 - DNA, 38 bp, Artificial Sequence
  Description of Artificial Sequence: Synthetic oligonucleotide
aatctgttgccaagcttcaagatgaaagaactgtgagg

SEQ ID NO: 97846 - DNA, 37 bp, Artificial Sequence
  Description of Artificial Sequence: Synthetic oligonucleotide
atctgttgccaagcttcaagatgaaagaactgtgagg

SEQ ID NO: 97847 - DNA, 36 bp, Artificial Sequence
  Description of Artificial Sequence: Synthetic oligonucleotide
tctgttgccaagcttcaagatgaaagaactgtgagg

SEQ ID NO: 97848 - DNA, 35 bp, Artificial Sequence
  Description of Artificial Sequence: Synthetic oligonucleotide
ctgttgccaagcttcaagatgaaagaactgtgagg

SEQ ID NO: 97849 - DNA, 42 bp, Artificial Sequence
  Description of Artificial Sequence: Synthetic oligonucleotide
tgttgccaagcttcaagatgaaagaactgtgaggaaaatttg

SEQ ID NO: 97850 - DNA, 41 bp, Artificial Sequence
  Description of Artificial Sequence: Synthetic oligonucleotide
gttgccaagcttcaagatgaaagaactgtgaggaaaatttg

SEQ ID NO: 97851 - DNA, 42 bp, Artificial Sequence
  Description of Artificial Sequence: Synthetic oligonucleotide
ttgccaagcttcaagatgaaagaactgtgaggaaaatttgtg

SEQ ID NO: 97852 - DNA, 41 bp, Artificial Sequence
  Description of Artificial Sequence: Synthetic oligonucleotide
tgccaagcttcaagatgaaagaactgtgaggaaaatttgtg

SEQ ID NO: 97853 - DNA, 40 bp, Artificial Sequence
  Description of Artificial Sequence: Synthetic oligonucleotide
gccaagcttcaagatgaaagaactgtgaggaaaatttgtg

SEQ ID NO: 97854 - DNA, 40 bp, Artificial Sequence
  Description of Artificial Sequence: Synthetic oligonucleotide
ccaagcttcaagatgaaagaactgtgaggaaaatttgtgc

SEQ ID NO: 97855 - DNA, 40 bp, Artificial Sequence
  Description of Artificial Sequence: Synthetic oligonucleotide
caagcttcaagatgaaagaactgtgaggaaaatttgtgcc

SEQ ID NO: 97856 - DNA, 40 bp, Artificial Sequence
  Description of Artificial Sequence: Synthetic oligonucleotide
aagcttcaagatgaaagaactgtgaggaaaatttgtgccc

SEQ ID NO: 97857 - DNA, 39 bp, Artificial Sequence
  Description of Artificial Sequence: Synthetic oligonucleotide
agcttcaagatgaaagaactgtgaggaaaatttgtgccc

SEQ ID NO: 97858 - DNA, 38 bp, Artificial Sequence
  Description of Artificial Sequence: Synthetic oligonucleotide
gcttcaagatgaaagaactgtgaggaaaatttgtgccc

SEQ ID NO: 97859 - DNA, 40 bp, Artificial Sequence
  Description of Artificial Sequence: Synthetic oligonucleotide
cttcaagatgaaagaactgtgaggaaaatttgtgcccttg

SEQ ID NO: 97860 - DNA, 42 bp, Artificial Sequence
  Description of Artificial Sequence: Synthetic oligonucleotide
ttcaagatgaaagaactgtgaggaaaatttgtgcccttgatg

SEQ ID NO: 97861 - DNA, 41 bp, Artificial Sequence
  Description of Artificial Sequence: Synthetic oligonucleotide
tcaagatgaaagaactgtgaggaaaatttgtgcccttgatg

SEQ ID NO: 97862 - DNA, 40 bp, Artificial Sequence
  Description of Artificial Sequence: Synthetic oligonucleotide
caagatgaaagaactgtgaggaaaatttgtgcccttgatg

SEQ ID NO: 97863 - DNA, 41 bp, Artificial Sequence
  Description of Artificial Sequence: Synthetic oligonucleotide
aagatgaaagaactgtgaggaaaatttgtgcccttgatgac

SEQ ID NO: 97864 - DNA, 40 bp, Artificial Sequence
  Description of Artificial Sequence: Synthetic oligonucleotide
agatgaaagaactgtgaggaaaatttgtgcccttgatgac

SEQ ID NO: 97865 - DNA, 39 bp, Artificial Sequence
  Description of Artificial Sequence: Synthetic oligonucleotide
gatgaaagaactgtgaggaaaatttgtgcccttgatgac

SEQ ID NO: 97866 - DNA, 39 bp, Artificial Sequence
  Description of Artificial Sequence: Synthetic oligonucleotide
atgaaagaactgtgaggaaaatttgtgcccttgatgacc

SEQ ID NO: 97867 - DNA, 38 bp, Artificial Sequence
  Description of Artificial Sequence: Synthetic oligonucleotide
tgaaagaactgtgaggaaaatttgtgcccttgatgacc

SEQ ID NO: 97868 - DNA, 37 bp, Artificial Sequence
  Description of Artificial Sequence: Synthetic oligonucleotide
gaaagaactgtgaggaaaatttgtgcccttgatgacc

SEQ ID NO: 97869 - DNA, 39 bp, Artificial Sequence
  Description of Artificial Sequence: Synthetic oligonucleotide
aaagaactgtgaggaaaatttgtgcccttgatgaccatg

SEQ ID NO: 97870 - DNA, 38 bp, Artificial Sequence
  Description of Artificial Sequence: Synthetic oligonucleotide
aagaactgtgaggaaaatttgtgcccttgatgaccatg

SEQ ID NO: 97871 - DNA, 37 bp, Artificial Sequence
  Description of Artificial Sequence: Synthetic oligonucleotide
agaactgtgaggaaaatttgtgcccttgatgaccatg

SEQ ID NO: 97872 - DNA, 36 bp, Artificial Sequence
  Description of Artificial Sequence: Synthetic oligonucleotide
gaactgtgaggaaaatttgtgcccttgatgaccatg

SEQ ID NO: 97873 - DNA, 37 bp, Artificial Sequence
  Description of Artificial Sequence: Synthetic oligonucleotide
aactgtgaggaaaatttgtgcccttgatgaccatgtc

SEQ ID NO: 97874 - DNA, 36 bp, Artificial Sequence
  Description of Artificial Sequence: Synthetic oligonucleotide
actgtgaggaaaatttgtgcccttgatgaccatgtc

SEQ ID NO: 97875 - DNA, 35 bp, Artificial Sequence
  Description of Artificial Sequence: Synthetic oligonucleotide
ctgtgaggaaaatttgtgcccttgatgaccatgtc

SEQ ID NO: 97876 - DNA, 36 bp, Artificial Sequence
  Description of Artificial Sequence: Synthetic oligonucleotide
tgtgaggaaaatttgtgcccttgatgaccatgtctg

SEQ ID NO: 97877 - DNA, 35 bp, Artificial Sequence
  Description of Artificial Sequence: Synthetic oligonucleotide
gtgaggaaaatttgtgcccttgatgaccatgtctg

SEQ ID NO: 97878 - DNA, 35 bp, Artificial Sequence
  Description of Artificial Sequence: Synthetic oligonucleotide
tgaggaaaatttgtgcccttgatgaccatgtctgc

SEQ ID NO: 97879 - DNA, 34 bp, Artificial Sequence
  Description of Artificial Sequence: Synthetic oligonucleotide
gaggaaaatttgtgcccttgatgaccatgtctgc

SEQ ID NO: 97880 - DNA, 36 bp, Artificial Sequence
  Description of Artificial Sequence: Synthetic oligonucleotide
aggaaaatttgtgcccttgatgaccatgtctgcatg

SEQ ID NO: 97881 - DNA, 35 bp, Artificial Sequence
  Description of Artificial Sequence: Synthetic oligonucleotide
ggaaaatttgtgcccttgatgaccatgtctgcatg

SEQ ID NO: 97882 - DNA, 35 bp, Artificial Sequence
  Description of Artificial Sequence: Synthetic oligonucleotide
gaaaatttgtgcccttgatgaccatgtctgcatgg

SEQ ID NO: 97883 - DNA, 35 bp, Artificial Sequence
  Description of Artificial Sequence: Synthetic oligonucleotide
aaaatttgtgcccttgatgaccatgtctgcatggc

SEQ ID NO: 97884 - DNA, 34 bp, Artificial Sequence
  Description of Artificial Sequence: Synthetic oligonucleotide
aaatttgtgcccttgatgaccatgtctgcatggc

SEQ ID NO: 97885 - DNA, 33 bp, Artificial Sequence
  Description of Artificial Sequence: Synthetic oligonucleotide
aatttgtgcccttgatgaccatgtctgcatggc

SEQ ID NO: 97886 - DNA, 32 bp, Artificial Sequence
  Description of Artificial Sequence: Synthetic oligonucleotide
atttgtgcccttgatgaccatgtctgcatggc

SEQ ID NO: 97887 - DNA, 31 bp, Artificial Sequence
  Description of Artificial Sequence: Synthetic oligonucleotide
tttgtgcccttgatgaccatgtctgcatggc

SEQ ID NO: 97888 - DNA, 30 bp, Artificial Sequence
  Description of Artificial Sequence: Synthetic oligonucleotide
ttgtgcccttgatgaccatgtctgcatggc

SEQ ID NO: 97889 - DNA, 29 bp, Artificial Sequence
  Description of Artificial Sequence: Synthetic oligonucleotide
tgtgcccttgatgaccatgtctgcatggc

SEQ ID NO: 97890 - DNA, 28 bp, Artificial Sequence
  Description of Artificial Sequence: Synthetic oligonucleotide
gtgcccttgatgaccatgtctgcatggc

SEQ ID NO: 97891 - DNA, 32 bp, Artificial Sequence
  Description of Artificial Sequence: Synthetic oligonucleotide
tgcccttgatgaccatgtctgcatggcttttg

SEQ ID NO: 97892 - DNA, 31 bp, Artificial Sequence
  Description of Artificial Sequence: Synthetic oligonucleotide
gcccttgatgaccatgtctgcatggcttttg

SEQ ID NO: 97893 - DNA, 31 bp, Artificial Sequence
  Description of Artificial Sequence: Synthetic oligonucleotide
cccttgatgaccatgtctgcatggcttttgc

SEQ ID NO: 97894 - DNA, 32 bp, Artificial Sequence
  Description of Artificial Sequence: Synthetic oligonucleotide
ccttgatgaccatgtctgcatggcttttgcag

SEQ ID NO: 97895 - DNA, 36 bp, Artificial Sequence
  Description of Artificial Sequence: Synthetic oligonucleotide
cttgatgaccatgtctgcatggcttttgcagttttg

SEQ ID NO: 97896 - DNA, 37 bp, Artificial Sequence
  Description of Artificial Sequence: Synthetic oligonucleotide
ttgatgaccatgtctgcatggcttttgcagttttgac

SEQ ID NO: 97897 - DNA, 36 bp, Artificial Sequence
  Description of Artificial Sequence: Synthetic oligonucleotide
tgatgaccatgtctgcatggcttttgcagttttgac

SEQ ID NO: 97898 - DNA, 35 bp, Artificial Sequence
  Description of Artificial Sequence: Synthetic oligonucleotide
gatgaccatgtctgcatggcttttgcagttttgac

SEQ ID NO: 97899 - DNA, 45 bp, Artificial Sequence
  Description of Artificial Sequence: Synthetic oligonucleotide
atgaccatgtctgcatggcttttgcagttttgacaatttttatag

SEQ ID NO: 97900 - DNA, 44 bp, Artificial Sequence
  Description of Artificial Sequence: Synthetic oligonucleotide
tgaccatgtctgcatggcttttgcagttttgacaatttttatag

SEQ ID NO: 97901 - DNA, 43 bp, Artificial Sequence
  Description of Artificial Sequence: Synthetic oligonucleotide
gaccatgtctgcatggcttttgcagttttgacaatttttatag

SEQ ID NO: 97902 - DNA, 43 bp, Artificial Sequence
  Description of Artificial Sequence: Synthetic oligonucleotide
accatgtctgcatggcttttgcagttttgacaatttttatagg

SEQ ID NO: 97903 - DNA, 42 bp, Artificial Sequence
  Description of Artificial Sequence: Synthetic oligonucleotide
ccatgtctgcatggcttttgcagttttgacaatttttatagg

SEQ ID NO: 97904 - DNA, 43 bp, Artificial Sequence
  Description of Artificial Sequence: Synthetic oligonucleotide
catgtctgcatggcttttgcagttttgacaatttttataggac

SEQ ID NO: 97905 - DNA, 46 bp, Artificial Sequence
  Description of Artificial Sequence: Synthetic oligonucleotide
atgtctgcatggcttttgcagttttgacaatttttataggacttac

SEQ ID NO: 97906 - DNA, 45 bp, Artificial Sequence
  Description of Artificial Sequence: Synthetic oligonucleotide
tgtctgcatggcttttgcagttttgacaatttttataggacttac

SEQ ID NO: 97907 - DNA, 44 bp, Artificial Sequence
  Description of Artificial Sequence: Synthetic oligonucleotide
gtctgcatggcttttgcagttttgacaatttttataggacttac

SEQ ID NO: 97908 - DNA, 45 bp, Artificial Sequence
  Description of Artificial Sequence: Synthetic oligonucleotide
tctgcatggcttttgcagttttgacaatttttataggacttactg

SEQ ID NO: 97909 - DNA, 44 bp, Artificial Sequence
  Description of Artificial Sequence: Synthetic oligonucleotide
ctgcatggcttttgcagttttgacaatttttataggacttactg

SEQ ID NO: 97910 - DNA, 44 bp, Artificial Sequence
  Description of Artificial Sequence: Synthetic oligonucleotide
tgcatggcttttgcagttttgacaatttttataggacttactgc

SEQ ID NO: 97911 - DNA, 43 bp, Artificial Sequence
  Description of Artificial Sequence: Synthetic oligonucleotide
gcatggcttttgcagttttgacaatttttataggacttactgc

SEQ ID NO: 97912 - DNA, 44 bp, Artificial Sequence
  Description of Artificial Sequence: Synthetic oligonucleotide
catggcttttgcagttttgacaatttttataggacttactgctg

SEQ ID NO: 97913 - DNA, 46 bp, Artificial Sequence
  Description of Artificial Sequence: Synthetic oligonucleotide
atggcttttgcagttttgacaatttttataggacttactgctgatg

SEQ ID NO: 97914 - DNA, 45 bp, Artificial Sequence
  Description of Artificial Sequence: Synthetic oligonucleotide
tggcttttgcagttttgacaatttttataggacttactgctgatg

SEQ ID NO: 97915 - DNA, 44 bp, Artificial Sequence
  Description of Artificial Sequence: Synthetic oligonucleotide
ggcttttgcagttttgacaatttttataggacttactgctgatg

SEQ ID NO: 97916 - DNA, 44 bp, Artificial Sequence
  Description of Artificial Sequence: Synthetic oligonucleotide
gcttttgcagttttgacaatttttataggacttactgctgatgc

SEQ ID NO: 97917 - DNA, 46 bp, Artificial Sequence
  Description of Artificial Sequence: Synthetic oligonucleotide
cttttgcagttttgacaatttttataggacttactgctgatgctag

SEQ ID NO: 97918 - DNA, 47 bp, Artificial Sequence
  Description of Artificial Sequence: Synthetic oligonucleotide
ttttgcagttttgacaatttttataggacttactgctgatgctagag

SEQ ID NO: 97919 - DNA, 46 bp, Artificial Sequence
  Description of Artificial Sequence: Synthetic oligonucleotide
tttgcagttttgacaatttttataggacttactgctgatgctagag

SEQ ID NO: 97920 - DNA, 45 bp, Artificial Sequence
  Description of Artificial Sequence: Synthetic oligonucleotide
ttgcagttttgacaatttttataggacttactgctgatgctagag

SEQ ID NO: 97921 - DNA, 44 bp, Artificial Sequence
  Description of Artificial Sequence: Synthetic oligonucleotide
tgcagttttgacaatttttataggacttactgctgatgctagag

SEQ ID NO: 97922 - DNA, 43 bp, Artificial Sequence
  Description of Artificial Sequence: Synthetic oligonucleotide
gcagttttgacaatttttataggacttactgctgatgctagag

SEQ ID NO: 97923 - DNA, 45 bp, Artificial Sequence
  Description of Artificial Sequence: Synthetic oligonucleotide
cagttttgacaatttttataggacttactgctgatgctagagtag

SEQ ID NO: 97924 - DNA, 52 bp, Artificial Sequence
  Description of Artificial Sequence: Synthetic oligonucleotide
agttttgacaatttttataggacttactgctgatgctagagtagtaataaac

SEQ ID NO: 97925 - DNA, 51 bp, Artificial Sequence
  Description of Artificial Sequence: Synthetic oligonucleotide
gttttgacaatttttataggacttactgctgatgctagagtagtaataaac

SEQ ID NO: 97926 - DNA, 52 bp, Artificial Sequence
  Description of Artificial Sequence: Synthetic oligonucleotide
ttttgacaatttttataggacttactgctgatgctagagtagtaataaacag

SEQ ID NO: 97927 - DNA, 51 bp, Artificial Sequence
  Description of Artificial Sequence: Synthetic oligonucleotide
tttgacaatttttataggacttactgctgatgctagagtagtaataaacag

SEQ ID NO: 97928 - DNA, 50 bp, Artificial Sequence
  Description of Artificial Sequence: Synthetic oligonucleotide
ttgacaatttttataggacttactgctgatgctagagtagtaataaacag

SEQ ID NO: 97929 - DNA, 49 bp, Artificial Sequence
  Description of Artificial Sequence: Synthetic oligonucleotide
tgacaatttttataggacttactgctgatgctagagtagtaataaacag

SEQ ID NO: 97930 - DNA, 48 bp, Artificial Sequence
  Description of Artificial Sequence: Synthetic oligonucleotide
gacaatttttataggacttactgctgatgctagagtagtaataaacag

SEQ ID NO: 97931 - DNA, 49 bp, Artificial Sequence
  Description of Artificial Sequence: Synthetic oligonucleotide
acaatttttataggacttactgctgatgctagagtagtaataaacagag

SEQ ID NO: 97932 - DNA, 48 bp, Artificial Sequence
  Description of Artificial Sequence: Synthetic oligonucleotide
caatttttataggacttactgctgatgctagagtagtaataaacagag

SEQ ID NO: 97933 - DNA, 48 bp, Artificial Sequence
  Description of Artificial Sequence: Synthetic oligonucleotide
aatttttataggacttactgctgatgctagagtagtaataaacagagc

SEQ ID NO: 97934 - DNA, 47 bp, Artificial Sequence
  Description of Artificial Sequence: Synthetic oligonucleotide
atttttataggacttactgctgatgctagagtagtaataaacagagc

SEQ ID NO: 97935 - DNA, 46 bp, Artificial Sequence
  Description of Artificial Sequence: Synthetic oligonucleotide
tttttataggacttactgctgatgctagagtagtaataaacagagc

SEQ ID NO: 97936 - DNA, 45 bp, Artificial Sequence
  Description of Artificial Sequence: Synthetic oligonucleotide
ttttataggacttactgctgatgctagagtagtaataaacagagc

SEQ ID NO: 97937 - DNA, 44 bp, Artificial Sequence
  Description of Artificial Sequence: Synthetic oligonucleotide
tttataggacttactgctgatgctagagtagtaataaacagagc

SEQ ID NO: 97938 - DNA, 43 bp, Artificial Sequence
  Description of Artificial Sequence: Synthetic oligonucleotide
ttataggacttactgctgatgctagagtagtaataaacagagc

SEQ ID NO: 97939 - DNA, 42 bp, Artificial Sequence
  Description of Artificial Sequence: Synthetic oligonucleotide
tataggacttactgctgatgctagagtagtaataaacagagc

SEQ ID NO: 97940 - DNA, 41 bp, Artificial Sequence
  Description of Artificial Sequence: Synthetic oligonucleotide
ataggacttactgctgatgctagagtagtaataaacagagc

SEQ ID NO: 97941 - DNA, 40 bp, Artificial Sequence
  Description of Artificial Sequence: Synthetic oligonucleotide
taggacttactgctgatgctagagtagtaataaacagagc

SEQ ID NO: 97942 - DNA, 39 bp, Artificial Sequence
  Description of Artificial Sequence: Synthetic oligonucleotide
aggacttactgctgatgctagagtagtaataaacagagc

SEQ ID NO: 97943 - DNA, 38 bp, Artificial Sequence
  Description of Artificial Sequence: Synthetic oligonucleotide
ggacttactgctgatgctagagtagtaataaacagagc

SEQ ID NO: 97944 - DNA, 38 bp, Artificial Sequence
  Description of Artificial Sequence: Synthetic oligonucleotide
gacttactgctgatgctagagtagtaataaacagagcc

SEQ ID NO: 97945 - DNA, 38 bp, Artificial Sequence
  Description of Artificial Sequence: Synthetic oligonucleotide
acttactgctgatgctagagtagtaataaacagagccc

SEQ ID NO: 97946 - DNA, 37 bp, Artificial Sequence
  Description of Artificial Sequence: Synthetic oligonucleotide
cttactgctgatgctagagtagtaataaacagagccc

SEQ ID NO: 97947 - DNA, 37 bp, Artificial Sequence
  Description of Artificial Sequence: Synthetic oligonucleotide
ttactgctgatgctagagtagtaataaacagagcccg

SEQ ID NO: 97948 - DNA, 36 bp, Artificial Sequence
  Description of Artificial Sequence: Synthetic oligonucleotide
tactgctgatgctagagtagtaataaacagagcccg

SEQ ID NO: 97949 - DNA, 35 bp, Artificial Sequence
  Description of Artificial Sequence: Synthetic oligonucleotide
actgctgatgctagagtagtaataaacagagcccg

SEQ ID NO: 97950 - DNA, 34 bp, Artificial Sequence
  Description of Artificial Sequence: Synthetic oligonucleotide
ctgctgatgctagagtagtaataaacagagcccg

SEQ ID NO: 97951 - DNA, 35 bp, Artificial Sequence
  Description of Artificial Sequence: Synthetic oligonucleotide
tgctgatgctagagtagtaataaacagagcccgtg

SEQ ID NO: 97952 - DNA, 34 bp, Artificial Sequence
  Description of Artificial Sequence: Synthetic oligonucleotide
gctgatgctagagtagtaataaacagagcccgtg

SEQ ID NO: 97953 - DNA, 35 bp, Artificial Sequence
  Description of Artificial Sequence: Synthetic oligonucleotide
ctgatgctagagtagtaataaacagagcccgtgtg

SEQ ID NO: 97954 - DNA, 35 bp, Artificial Sequence
  Description of Artificial Sequence: Synthetic oligonucleotide
tgatgctagagtagtaataaacagagcccgtgtgg

SEQ ID NO: 97955 - DNA, 34 bp, Artificial Sequence
  Description of Artificial Sequence: Synthetic oligonucleotide
gatgctagagtagtaataaacagagcccgtgtgg

SEQ ID NO: 97956 - DNA, 35 bp, Artificial Sequence
  Description of Artificial Sequence: Synthetic oligonucleotide
atgctagagtagtaataaacagagcccgtgtggag

SEQ ID NO: 97957 - DNA, 34 bp, Artificial Sequence
  Description of Artificial Sequence: Synthetic oligonucleotide
tgctagagtagtaataaacagagcccgtgtggag

SEQ ID NO: 97958 - DNA, 33 bp, Artificial Sequence
  Description of Artificial Sequence: Synthetic oligonucleotide
gctagagtagtaataaacagagcccgtgtggag

SEQ ID NO: 97959 - DNA, 34 bp, Artificial Sequence
  Description of Artificial Sequence: Synthetic oligonucleotide
ctagagtagtaataaacagagcccgtgtggagtg

SEQ ID NO: 97960 - DNA, 34 bp, Artificial Sequence
  Description of Artificial Sequence: Synthetic oligonucleotide
tagagtagtaataaacagagcccgtgtggagtgc

SEQ ID NO: 97961 - DNA, 33 bp, Artificial Sequence
  Description of Artificial Sequence: Synthetic oligonucleotide
agagtagtaataaacagagcccgtgtggagtgc

SEQ ID NO: 97962 - DNA, 32 bp, Artificial Sequence
  Description of Artificial Sequence: Synthetic oligonucleotide
gagtagtaataaacagagcccgtgtggagtgc

SEQ ID NO: 97963 - DNA, 32 bp, Artificial Sequence
  Description of Artificial Sequence: Synthetic oligonucleotide
agtagtaataaacagagcccgtgtggagtgcc

SEQ ID NO: 97964 - DNA, 31 bp, Artificial Sequence
  Description of Artificial Sequence: Synthetic oligonucleotide
gtagtaataaacagagcccgtgtggagtgcc

SEQ ID NO: 97965 - DNA, 32 bp, Artificial Sequence
  Description of Artificial Sequence: Synthetic oligonucleotide
tagtaataaacagagcccgtgtggagtgccag

SEQ ID NO: 97966 - DNA, 31 bp, Artificial Sequence
  Description of Artificial Sequence: Synthetic oligonucleotide
agtaataaacagagcccgtgtggagtgccag

SEQ ID NO: 97967 - DNA, 30 bp, Artificial Sequence
  Description of Artificial Sequence: Synthetic oligonucleotide
gtaataaacagagcccgtgtggagtgccag

SEQ ID NO: 97968 - DNA, 31 bp, Artificial Sequence
  Description of Artificial Sequence: Synthetic oligonucleotide
taataaacagagcccgtgtggagtgccagag

SEQ ID NO: 97969 - DNA, 30 bp, Artificial Sequence
  Description of Artificial Sequence: Synthetic oligonucleotide
aataaacagagcccgtgtggagtgccagag

SEQ ID NO: 97970 - DNA, 29 bp, Artificial Sequence
  Description of Artificial Sequence: Synthetic oligonucleotide
ataaacagagcccgtgtggagtgccagag

SEQ ID NO: 97971 - DNA, 28 bp, Artificial Sequence
  Description of Artificial Sequence: Synthetic oligonucleotide
taaacagagcccgtgtggagtgccagag

SEQ ID NO: 97972 - DNA, 27 bp, Artificial Sequence
  Description of Artificial Sequence: Synthetic oligonucleotide
aaacagagcccgtgtggagtgccagag

SEQ ID NO: 97973 - DNA, 26 bp, Artificial Sequence
  Description of Artificial Sequence: Synthetic oligonucleotide
aacagagcccgtgtggagtgccagag

SEQ ID NO: 97974 - DNA, 25 bp, Artificial Sequence
  Description of Artificial Sequence: Synthetic oligonucleotide
acagagcccgtgtggagtgccagag

SEQ ID NO: 97975 - DNA, 24 bp, Artificial Sequence
  Description of Artificial Sequence: Synthetic oligonucleotide
cagagcccgtgtggagtgccagag

SEQ ID NO: 97976 - DNA, 24 bp, Artificial Sequence
  Description of Artificial Sequence: Synthetic oligonucleotide
agagcccgtgtggagtgccagagc

SEQ ID NO: 97977 - DNA, 23 bp, Artificial Sequence
  Description of Artificial Sequence: Synthetic oligonucleotide
gagcccgtgtggagtgccagagc

SEQ ID NO: 97978 - DNA, 27 bp, Artificial Sequence
  Description of Artificial Sequence: Synthetic oligonucleotide
agcccgtgtggagtgccagagccataa

SEQ ID NO: 97979 - DNA, 26 bp, Artificial Sequence
  Description of Artificial Sequence: Synthetic oligonucleotide
gcccgtgtggagtgccagagccataa

SEQ ID NO: 97980 - DNA, 26 bp, Artificial Sequence
  Description of Artificial Sequence: Synthetic oligonucleotide
cccgtgtggagtgccagagccataag

SEQ ID NO: 97981 - DNA, 27 bp, Artificial Sequence
  Description of Artificial Sequence: Synthetic oligonucleotide
ccgtgtggagtgccagagccataagct

SEQ ID NO: 97982 - DNA, 29 bp, Artificial Sequence
  Description of Artificial Sequence: Synthetic oligonucleotide
cgtgtggagtgccagagccataagcttac

SEQ ID NO: 97983 - DNA, 29 bp, Artificial Sequence
  Description of Artificial Sequence: Synthetic oligonucleotide
gtgtggagtgccagagccataagcttacg

SEQ ID NO: 97984 - DNA, 29 bp, Artificial Sequence
  Description of Artificial Sequence: Synthetic oligonucleotide
tgtggagtgccagagccataagcttacgg

SEQ ID NO: 97985 - DNA, 28 bp, Artificial Sequence
  Description of Artificial Sequence: Synthetic oligonucleotide
gtggagtgccagagccataagcttacgg

SEQ ID NO: 97986 - DNA, 30 bp, Artificial Sequence
  Description of Artificial Sequence: Synthetic oligonucleotide
tggagtgccagagccataagcttacggttg

SEQ ID NO: 97987 - DNA, 29 bp, Artificial Sequence
  Description of Artificial Sequence: Synthetic oligonucleotide
ggagtgccagagccataagcttacggttg

SEQ ID NO: 97988 - DNA, 30 bp, Artificial Sequence
  Description of Artificial Sequence: Synthetic oligonucleotide
gagtgccagagccataagcttacggttgag

SEQ ID NO: 97989 - DNA, 30 bp, Artificial Sequence
  Description of Artificial Sequence: Synthetic oligonucleotide
agtgccagagccataagcttacggttgagg

SEQ ID NO: 97990 - DNA, 29 bp, Artificial Sequence
  Description of Artificial Sequence: Synthetic oligonucleotide
gtgccagagccataagcttacggttgagg

SEQ ID NO: 97991 - DNA, 30 bp, Artificial Sequence
  Description of Artificial Sequence: Synthetic oligonucleotide
tgccagagccataagcttacggttgaggac

SEQ ID NO: 97992 - DNA, 29 bp, Artificial Sequence
  Description of Artificial Sequence: Synthetic oligonucleotide
gccagagccataagcttacggttgaggac

SEQ ID NO: 97993 - DNA, 29 bp, Artificial Sequence
  Description of Artificial Sequence: Synthetic oligonucleotide
ccagagccataagcttacggttgaggacc

SEQ ID NO: 97994 - DNA, 29 bp, Artificial Sequence
  Description of Artificial Sequence: Synthetic oligonucleotide
cagagccataagcttacggttgaggaccc

SEQ ID NO: 97995 - DNA, 30 bp, Artificial Sequence
  Description of Artificial Sequence: Synthetic oligonucleotide
agagccataagcttacggttgaggacccag

SEQ ID NO: 97996 - DNA, 29 bp, Artificial Sequence
  Description of Artificial Sequence: Synthetic oligonucleotide
gagccataagcttacggttgaggacccag

SEQ ID NO: 97997 - DNA, 30 bp, Artificial Sequence
  Description of Artificial Sequence: Synthetic oligonucleotide
agccataagcttacggttgaggacccagtc

SEQ ID NO: 97998 - DNA, 29 bp, Artificial Sequence
  Description of Artificial Sequence: Synthetic oligonucleotide
gccataagcttacggttgaggacccagtc

SEQ ID NO: 97999 - DNA, 30 bp, Artificial Sequence
  Description of Artificial Sequence: Synthetic oligonucleotide
ccataagcttacggttgaggacccagtcac

SEQ ID NO: 98000 - DNA, 31 bp, Artificial Sequence
  Description of Artificial Sequence: Synthetic oligonucleotide
cataagcttacggttgaggacccagtcactg

SEQ ID NO: 98001 - DNA, 33 bp, Artificial Sequence
  Description of Artificial Sequence: Synthetic oligonucleotide
ataagcttacggttgaggacccagtcactgtag

SEQ ID NO: 98002 - DNA, 32 bp, Artificial Sequence
  Description of Artificial Sequence: Synthetic oligonucleotide
taagcttacggttgaggacccagtcactgtag

SEQ ID NO: 98003 - DNA, 31 bp, Artificial Sequence
  Description of Artificial Sequence: Synthetic oligonucleotide
aagcttacggttgaggacccagtcactgtag

SEQ ID NO: 98004 - DNA, 30 bp, Artificial Sequence
  Description of Artificial Sequence: Synthetic oligonucleotide
agcttacggttgaggacccagtcactgtag

SEQ ID NO: 98005 - DNA, 29 bp, Artificial Sequence
  Description of Artificial Sequence: Synthetic oligonucleotide
gcttacggttgaggacccagtcactgtag

SEQ ID NO: 98006 - DNA, 33 bp, Artificial Sequence
  Description of Artificial Sequence: Synthetic oligonucleotide
cttacggttgaggacccagtcactgtagaatac

SEQ ID NO: 98007 - DNA, 37 bp, Artificial Sequence
  Description of Artificial Sequence: Synthetic oligonucleotide
ttacggttgaggacccagtcactgtagaatacataac

SEQ ID NO: 98008 - DNA, 36 bp, Artificial Sequence
  Description of Artificial Sequence: Synthetic oligonucleotide
tacggttgaggacccagtcactgtagaatacataac

SEQ ID NO: 98009 - DNA, 35 bp, Artificial Sequence
  Description of Artificial Sequence: Synthetic oligonucleotide
acggttgaggacccagtcactgtagaatacataac

SEQ ID NO: 98010 - DNA, 34 bp, Artificial Sequence
  Description of Artificial Sequence: Synthetic oligonucleotide
cggttgaggacccagtcactgtagaatacataac

SEQ ID NO: 98011 - DNA, 35 bp, Artificial Sequence
  Description of Artificial Sequence: Synthetic oligonucleotide
ggttgaggacccagtcactgtagaatacataactc

SEQ ID NO: 98012 - DNA, 35 bp, Artificial Sequence
  Description of Artificial Sequence: Synthetic oligonucleotide
gttgaggacccagtcactgtagaatacataactcg

SEQ ID NO: 98013 - DNA, 35 bp, Artificial Sequence
  Description of Artificial Sequence: Synthetic oligonucleotide
ttgaggacccagtcactgtagaatacataactcgc

SEQ ID NO: 98014 - DNA, 34 bp, Artificial Sequence
  Description of Artificial Sequence: Synthetic oligonucleotide
tgaggacccagtcactgtagaatacataactcgc

SEQ ID NO: 98015 - DNA, 33 bp, Artificial Sequence
  Description of Artificial Sequence: Synthetic oligonucleotide
gaggacccagtcactgtagaatacataactcgc

SEQ ID NO: 98016 - DNA, 35 bp, Artificial Sequence
  Description of Artificial Sequence: Synthetic oligonucleotide
aggacccagtcactgtagaatacataactcgcttc

SEQ ID NO: 98017 - DNA, 34 bp, Artificial Sequence
  Description of Artificial Sequence: Synthetic oligonucleotide
ggacccagtcactgtagaatacataactcgcttc

SEQ ID NO: 98018 - DNA, 37 bp, Artificial Sequence
  Description of Artificial Sequence: Synthetic oligonucleotide
gacccagtcactgtagaatacataactcgcttcatag

SEQ ID NO: 98019 - DNA, 37 bp, Artificial Sequence
  Description of Artificial Sequence: Synthetic oligonucleotide
acccagtcactgtagaatacataactcgcttcatagc

SEQ ID NO: 98020 - DNA, 36 bp, Artificial Sequence
  Description of Artificial Sequence: Synthetic oligonucleotide
cccagtcactgtagaatacataactcgcttcatagc

SEQ ID NO: 98021 - DNA, 38 bp, Artificial Sequence
  Description of Artificial Sequence: Synthetic oligonucleotide
ccagtcactgtagaatacataactcgcttcatagcaac

SEQ ID NO: 98022 - DNA, 44 bp, Artificial Sequence
  Description of Artificial Sequence: Synthetic oligonucleotide
cagtcactgtagaatacataactcgcttcatagcaactttaaag

SEQ ID NO: 98023 - DNA, 44 bp, Artificial Sequence
  Description of Artificial Sequence: Synthetic oligonucleotide
agtcactgtagaatacataactcgcttcatagcaactttaaagc

SEQ ID NO: 98024 - DNA, 43 bp, Artificial Sequence
  Description of Artificial Sequence: Synthetic oligonucleotide
gtcactgtagaatacataactcgcttcatagcaactttaaagc

SEQ ID NO: 98025 - DNA, 44 bp, Artificial Sequence
  Description of Artificial Sequence: Synthetic oligonucleotide
tcactgtagaatacataactcgcttcatagcaactttaaagcag

SEQ ID NO: 98026 - DNA, 43 bp, Artificial Sequence
  Description of Artificial Sequence: Synthetic oligonucleotide
cactgtagaatacataactcgcttcatagcaactttaaagcag

SEQ ID NO: 98027 - DNA, 50 bp, Artificial Sequence
  Description of Artificial Sequence: Synthetic oligonucleotide
actgtagaatacataactcgcttcatagcaactttaaagcagaaatatac

SEQ ID NO: 98028 - DNA, 49 bp, Artificial Sequence
  Description of Artificial Sequence: Synthetic oligonucleotide
ctgtagaatacataactcgcttcatagcaactttaaagcagaaatatac

SEQ ID NO: 98029 - DNA, 49 bp, Artificial Sequence
  Description of Artificial Sequence: Synthetic oligonucleotide
tgtagaatacataactcgcttcatagcaactttaaagcagaaatatacc

SEQ ID NO: 98030 - DNA, 48 bp, Artificial Sequence
  Description of Artificial Sequence: Synthetic oligonucleotide
gtagaatacataactcgcttcatagcaactttaaagcagaaatatacc

SEQ ID NO: 98031 - DNA, 48 bp, Artificial Sequence
  Description of Artificial Sequence: Synthetic oligonucleotide
tagaatacataactcgcttcatagcaactttaaagcagaaatataccc

SEQ ID NO: 98032 - DNA, 47 bp, Artificial Sequence
  Description of Artificial Sequence: Synthetic oligonucleotide
agaatacataactcgcttcatagcaactttaaagcagaaatataccc

SEQ ID NO: 98033 - DNA, 46 bp, Artificial Sequence
  Description of Artificial Sequence: Synthetic oligonucleotide
gaatacataactcgcttcatagcaactttaaagcagaaatataccc

SEQ ID NO: 98034 - DNA, 49 bp, Artificial Sequence
  Description of Artificial Sequence: Synthetic oligonucleotide
aatacataactcgcttcatagcaactttaaagcagaaatatacccaaag

SEQ ID NO: 98035 - DNA, 48 bp, Artificial Sequence
  Description of Artificial Sequence: Synthetic oligonucleotide
atacataactcgcttcatagcaactttaaagcagaaatatacccaaag

SEQ ID NO: 98036 - DNA, 47 bp, Artificial Sequence
  Description of Artificial Sequence: Synthetic oligonucleotide
tacataactcgcttcatagcaactttaaagcagaaatatacccaaag

SEQ ID NO: 98037 - DNA, 46 bp, Artificial Sequence
  Description of Artificial Sequence: Synthetic oligonucleotide
acataactcgcttcatagcaactttaaagcagaaatatacccaaag

SEQ ID NO: 98038 - DNA, 45 bp, Artificial Sequence
  Description of Artificial Sequence: Synthetic oligonucleotide
cataactcgcttcatagcaactttaaagcagaaatatacccaaag

SEQ ID NO: 98039 - DNA, 45 bp, Artificial Sequence
  Description of Artificial Sequence: Synthetic oligonucleotide
ataactcgcttcatagcaactttaaagcagaaatatacccaaagc

SEQ ID NO: 98040 - DNA, 44 bp, Artificial Sequence
  Description of Artificial Sequence: Synthetic oligonucleotide
taactcgcttcatagcaactttaaagcagaaatatacccaaagc

SEQ ID NO: 98041 - DNA, 43 bp, Artificial Sequence
  Description of Artificial Sequence: Synthetic oligonucleotide
aactcgcttcatagcaactttaaagcagaaatatacccaaagc

SEQ ID NO: 98042 - DNA, 42 bp, Artificial Sequence
  Description of Artificial Sequence: Synthetic oligonucleotide
actcgcttcatagcaactttaaagcagaaatatacccaaagc

SEQ ID NO: 98043 - DNA, 41 bp, Artificial Sequence
  Description of Artificial Sequence: Synthetic oligonucleotide
ctcgcttcatagcaactttaaagcagaaatatacccaaagc

SEQ ID NO: 98044 - DNA, 44 bp, Artificial Sequence
  Description of Artificial Sequence: Synthetic oligonucleotide
tcgcttcatagcaactttaaagcagaaatatacccaaagcaatg

SEQ ID NO: 98045 - DNA, 43 bp, Artificial Sequence
  Description of Artificial Sequence: Synthetic oligonucleotide
cgcttcatagcaactttaaagcagaaatatacccaaagcaatg

SEQ ID NO: 98046 - DNA, 43 bp, Artificial Sequence
  Description of Artificial Sequence: Synthetic oligonucleotide
gcttcatagcaactttaaagcagaaatatacccaaagcaatgg

SEQ ID NO: 98047 - DNA, 44 bp, Artificial Sequence
  Description of Artificial Sequence: Synthetic oligonucleotide
cttcatagcaactttaaagcagaaatatacccaaagcaatggac

SEQ ID NO: 98048 - DNA, 44 bp, Artificial Sequence
  Description of Artificial Sequence: Synthetic oligonucleotide
ttcatagcaactttaaagcagaaatatacccaaagcaatggacg

SEQ ID NO: 98049 - DNA, 43 bp, Artificial Sequence
  Description of Artificial Sequence: Synthetic oligonucleotide
tcatagcaactttaaagcagaaatatacccaaagcaatggacg

SEQ ID NO: 98050 - DNA, 42 bp, Artificial Sequence
  Description of Artificial Sequence: Synthetic oligonucleotide
catagcaactttaaagcagaaatatacccaaagcaatggacg

SEQ ID NO: 98051 - DNA, 44 bp, Artificial Sequence
  Description of Artificial Sequence: Synthetic oligonucleotide
atagcaactttaaagcagaaatatacccaaagcaatggacgaag

SEQ ID NO: 98052 - DNA, 43 bp, Artificial Sequence
  Description of Artificial Sequence: Synthetic oligonucleotide
tagcaactttaaagcagaaatatacccaaagcaatggacgaag

SEQ ID NO: 98053 - DNA, 42 bp, Artificial Sequence
  Description of Artificial Sequence: Synthetic oligonucleotide
agcaactttaaagcagaaatatacccaaagcaatggacgaag

SEQ ID NO: 98054 - DNA, 41 bp, Artificial Sequence
  Description of Artificial Sequence: Synthetic oligonucleotide
gcaactttaaagcagaaatatacccaaagcaatggacgaag

SEQ ID NO: 98055 - DNA, 42 bp, Artificial Sequence
  Description of Artificial Sequence: Synthetic oligonucleotide
caactttaaagcagaaatatacccaaagcaatggacgaagac

SEQ ID NO: 98056 - DNA, 42 bp, Artificial Sequence
  Description of Artificial Sequence: Synthetic oligonucleotide
aactttaaagcagaaatatacccaaagcaatggacgaagacc

SEQ ID NO: 98057 - DNA, 41 bp, Artificial Sequence
  Description of Artificial Sequence: Synthetic oligonucleotide
actttaaagcagaaatatacccaaagcaatggacgaagacc

SEQ ID NO: 98058 - DNA, 40 bp, Artificial Sequence
  Description of Artificial Sequence: Synthetic oligonucleotide
ctttaaagcagaaatatacccaaagcaatggacgaagacc

SEQ ID NO: 98059 - DNA, 44 bp, Artificial Sequence
  Description of Artificial Sequence: Synthetic oligonucleotide
tttaaagcagaaatatacccaaagcaatggacgaagaccttttg

SEQ ID NO: 98060 - DNA, 43 bp, Artificial Sequence
  Description of Artificial Sequence: Synthetic oligonucleotide
ttaaagcagaaatatacccaaagcaatggacgaagaccttttg

SEQ ID NO: 98061 - DNA, 42 bp, Artificial Sequence
  Description of Artificial Sequence: Synthetic oligonucleotide
taaagcagaaatatacccaaagcaatggacgaagaccttttg

SEQ ID NO: 98062 - DNA, 41 bp, Artificial Sequence
  Description of Artificial Sequence: Synthetic oligonucleotide
aaagcagaaatatacccaaagcaatggacgaagaccttttg

SEQ ID NO: 98063 - DNA, 40 bp, Artificial Sequence
  Description of Artificial Sequence: Synthetic oligonucleotide
aagcagaaatatacccaaagcaatggacgaagaccttttg

SEQ ID NO: 98064 - DNA, 39 bp, Artificial Sequence
  Description of Artificial Sequence: Synthetic oligonucleotide
agcagaaatatacccaaagcaatggacgaagaccttttg

SEQ ID NO: 98065 - DNA, 38 bp, Artificial Sequence
  Description of Artificial Sequence: Synthetic oligonucleotide
gcagaaatatacccaaagcaatggacgaagaccttttg

SEQ ID NO: 98066 - DNA, 38 bp, Artificial Sequence
  Description of Artificial Sequence: Synthetic oligonucleotide
cagaaatatacccaaagcaatggacgaagaccttttgg

SEQ ID NO: 98067 - DNA, 43 bp, Artificial Sequence
  Description of Artificial Sequence: Synthetic oligonucleotide
agaaatatacccaaagcaatggacgaagaccttttggtatttc

SEQ ID NO: 98068 - DNA, 42 bp, Artificial Sequence
  Description of Artificial Sequence: Synthetic oligonucleotide
gaaatatacccaaagcaatggacgaagaccttttggtatttc

SEQ ID NO: 98069 - DNA, 43 bp, Artificial Sequence
  Description of Artificial Sequence: Synthetic oligonucleotide
aaatatacccaaagcaatggacgaagaccttttggtatttctg

SEQ ID NO: 98070 - DNA, 42 bp, Artificial Sequence
  Description of Artificial Sequence: Synthetic oligonucleotide
aatatacccaaagcaatggacgaagaccttttggtatttctg

SEQ ID NO: 98071 - DNA, 41 bp, Artificial Sequence
  Description of Artificial Sequence: Synthetic oligonucleotide
atatacccaaagcaatggacgaagaccttttggtatttctg

SEQ ID NO: 98072 - DNA, 40 bp, Artificial Sequence
  Description of Artificial Sequence: Synthetic oligonucleotide
tatacccaaagcaatggacgaagaccttttggtatttctg

SEQ ID NO: 98073 - DNA, 39 bp, Artificial Sequence
  Description of Artificial Sequence: Synthetic oligonucleotide
atacccaaagcaatggacgaagaccttttggtatttctg

SEQ ID NO: 98074 - DNA, 38 bp, Artificial Sequence
  Description of Artificial Sequence: Synthetic oligonucleotide
tacccaaagcaatggacgaagaccttttggtatttctg

SEQ ID NO: 98075 - DNA, 37 bp, Artificial Sequence
  Description of Artificial Sequence: Synthetic oligonucleotide
acccaaagcaatggacgaagaccttttggtatttctg

SEQ ID NO: 98076 - DNA, 36 bp, Artificial Sequence
  Description of Artificial Sequence: Synthetic oligonucleotide
cccaaagcaatggacgaagaccttttggtatttctg

SEQ ID NO: 98077 - DNA, 36 bp, Artificial Sequence
  Description of Artificial Sequence: Synthetic oligonucleotide
ccaaagcaatggacgaagaccttttggtatttctgc

SEQ ID NO: 98078 - DNA, 36 bp, Artificial Sequence
  Description of Artificial Sequence: Synthetic oligonucleotide
caaagcaatggacgaagaccttttggtatttctgcc

SEQ ID NO: 98079 - DNA, 42 bp, Artificial Sequence
  Description of Artificial Sequence: Synthetic oligonucleotide
aaagcaatggacgaagaccttttggtatttctgccttaattg

SEQ ID NO: 98080 - DNA, 41 bp, Artificial Sequence
  Description of Artificial Sequence: Synthetic oligonucleotide
aagcaatggacgaagaccttttggtatttctgccttaattg

SEQ ID NO: 98081 - DNA, 40 bp, Artificial Sequence
  Description of Artificial Sequence: Synthetic oligonucleotide
agcaatggacgaagaccttttggtatttctgccttaattg

SEQ ID NO: 98082 - DNA, 39 bp, Artificial Sequence
  Description of Artificial Sequence: Synthetic oligonucleotide
gcaatggacgaagaccttttggtatttctgccttaattg

SEQ ID NO: 98083 - DNA, 41 bp, Artificial Sequence
  Description of Artificial Sequence: Synthetic oligonucleotide
caatggacgaagaccttttggtatttctgccttaattgtag

SEQ ID NO: 98084 - DNA, 41 bp, Artificial Sequence
  Description of Artificial Sequence: Synthetic oligonucleotide
aatggacgaagaccttttggtatttctgccttaattgtagg

SEQ ID NO: 98085 - DNA, 40 bp, Artificial Sequence
  Description of Artificial Sequence: Synthetic oligonucleotide
atggacgaagaccttttggtatttctgccttaattgtagg

SEQ ID NO: 98086 - DNA, 39 bp, Artificial Sequence
  Description of Artificial Sequence: Synthetic oligonucleotide
tggacgaagaccttttggtatttctgccttaattgtagg

SEQ ID NO: 98087 - DNA, 38 bp, Artificial Sequence
  Description of Artificial Sequence: Synthetic oligonucleotide
ggacgaagaccttttggtatttctgccttaattgtagg

SEQ ID NO: 98088 - DNA, 42 bp, Artificial Sequence
  Description of Artificial Sequence: Synthetic oligonucleotide
gacgaagaccttttggtatttctgccttaattgtaggttttg

SEQ ID NO: 98089 - DNA, 44 bp, Artificial Sequence
  Description of Artificial Sequence: Synthetic oligonucleotide
acgaagaccttttggtatttctgccttaattgtaggttttgatg

SEQ ID NO: 98090 - DNA, 43 bp, Artificial Sequence
  Description of Artificial Sequence: Synthetic oligonucleotide
cgaagaccttttggtatttctgccttaattgtaggttttgatg

SEQ ID NO: 98091 - DNA, 45 bp, Artificial Sequence
  Description of Artificial Sequence: Synthetic oligonucleotide
gaagaccttttggtatttctgccttaattgtaggttttgatgatg

SEQ ID NO: 98092 - DNA, 47 bp, Artificial Sequence
  Description of Artificial Sequence: Synthetic oligonucleotide
aagaccttttggtatttctgccttaattgtaggttttgatgatgatg

SEQ ID NO: 98093 - DNA, 46 bp, Artificial Sequence
  Description of Artificial Sequence: Synthetic oligonucleotide
agaccttttggtatttctgccttaattgtaggttttgatgatgatg

SEQ ID NO: 98094 - DNA, 45 bp, Artificial Sequence
  Description of Artificial Sequence: Synthetic oligonucleotide
gaccttttggtatttctgccttaattgtaggttttgatgatgatg

SEQ ID NO: 98095 - DNA, 45 bp, Artificial Sequence
  Description of Artificial Sequence: Synthetic oligonucleotide
accttttggtatttctgccttaattgtaggttttgatgatgatgg

SEQ ID NO: 98096 - DNA, 44 bp, Artificial Sequence
  Description of Artificial Sequence: Synthetic oligonucleotide
ccttttggtatttctgccttaattgtaggttttgatgatgatgg

SEQ ID NO: 98097 - DNA, 47 bp, Artificial Sequence
  Description of Artificial Sequence: Synthetic oligonucleotide
cttttggtatttctgccttaattgtaggttttgatgatgatggtatc

SEQ ID NO: 98098 - DNA, 48 bp, Artificial Sequence
  Description of Artificial Sequence: Synthetic oligonucleotide
ttttggtatttctgccttaattgtaggttttgatgatgatggtatctc

SEQ ID NO: 98099 - DNA, 47 bp, Artificial Sequence
  Description of Artificial Sequence: Synthetic oligonucleotide
tttggtatttctgccttaattgtaggttttgatgatgatggtatctc

SEQ ID NO: 98100 - DNA, 46 bp, Artificial Sequence
  Description of Artificial Sequence: Synthetic oligonucleotide
ttggtatttctgccttaattgtaggttttgatgatgatggtatctc

SEQ ID NO: 98101 - DNA, 45 bp, Artificial Sequence
  Description of Artificial Sequence: Synthetic oligonucleotide
tggtatttctgccttaattgtaggttttgatgatgatggtatctc

SEQ ID NO: 98102 - DNA, 44 bp, Artificial Sequence
  Description of Artificial Sequence: Synthetic oligonucleotide
ggtatttctgccttaattgtaggttttgatgatgatggtatctc

SEQ ID NO: 98103 - DNA, 46 bp, Artificial Sequence
  Description of Artificial Sequence: Synthetic oligonucleotide
gtatttctgccttaattgtaggttttgatgatgatggtatctcaag

SEQ ID NO: 98104 - DNA, 49 bp, Artificial Sequence
  Description of Artificial Sequence: Synthetic oligonucleotide
tatttctgccttaattgtaggttttgatgatgatggtatctcaagattg

SEQ ID NO: 98105 - DNA, 48 bp, Artificial Sequence
  Description of Artificial Sequence: Synthetic oligonucleotide
atttctgccttaattgtaggttttgatgatgatggtatctcaagattg

SEQ ID NO: 98106 - DNA, 47 bp, Artificial Sequence
  Description of Artificial Sequence: Synthetic oligonucleotide
tttctgccttaattgtaggttttgatgatgatggtatctcaagattg

SEQ ID NO: 98107 - DNA, 46 bp, Artificial Sequence
  Description of Artificial Sequence: Synthetic oligonucleotide
ttctgccttaattgtaggttttgatgatgatggtatctcaagattg

SEQ ID NO: 98108 - DNA, 45 bp, Artificial Sequence
  Description of Artificial Sequence: Synthetic oligonucleotide
tctgccttaattgtaggttttgatgatgatggtatctcaagattg

SEQ ID NO: 98109 - DNA, 44 bp, Artificial Sequence
  Description of Artificial Sequence: Synthetic oligonucleotide
ctgccttaattgtaggttttgatgatgatggtatctcaagattg

SEQ ID NO: 98110 - DNA, 47 bp, Artificial Sequence
  Description of Artificial Sequence: Synthetic oligonucleotide
tgccttaattgtaggttttgatgatgatggtatctcaagattgtatc

SEQ ID NO: 98111 - DNA, 46 bp, Artificial Sequence
  Description of Artificial Sequence: Synthetic oligonucleotide
gccttaattgtaggttttgatgatgatggtatctcaagattgtatc

SEQ ID NO: 98112 - DNA, 47 bp, Artificial Sequence
  Description of Artificial Sequence: Synthetic oligonucleotide
ccttaattgtaggttttgatgatgatggtatctcaagattgtatcag

SEQ ID NO: 98113 - DNA, 48 bp, Artificial Sequence
  Description of Artificial Sequence: Synthetic oligonucleotide
cttaattgtaggttttgatgatgatggtatctcaagattgtatcagac

SEQ ID NO: 98114 - DNA, 49 bp, Artificial Sequence
  Description of Artificial Sequence: Synthetic oligonucleotide
ttaattgtaggttttgatgatgatggtatctcaagattgtatcagacag

SEQ ID NO: 98115 - DNA, 48 bp, Artificial Sequence
  Description of Artificial Sequence: Synthetic oligonucleotide
taattgtaggttttgatgatgatggtatctcaagattgtatcagacag

SEQ ID NO: 98116 - DNA, 47 bp, Artificial Sequence
  Description of Artificial Sequence: Synthetic oligonucleotide
aattgtaggttttgatgatgatggtatctcaagattgtatcagacag

SEQ ID NO: 98117 - DNA, 46 bp, Artificial Sequence
  Description of Artificial Sequence: Synthetic oligonucleotide
attgtaggttttgatgatgatggtatctcaagattgtatcagacag

SEQ ID NO: 98118 - DNA, 45 bp, Artificial Sequence
  Description of Artificial Sequence: Synthetic oligonucleotide
ttgtaggttttgatgatgatggtatctcaagattgtatcagacag

SEQ ID NO: 98119 - DNA, 44 bp, Artificial Sequence
  Description of Artificial Sequence: Synthetic oligonucleotide
tgtaggttttgatgatgatggtatctcaagattgtatcagacag

SEQ ID NO: 98120 - DNA, 43 bp, Artificial Sequence
  Description of Artificial Sequence: Synthetic oligonucleotide
gtaggttttgatgatgatggtatctcaagattgtatcagacag

SEQ ID NO: 98121 - DNA, 45 bp, Artificial Sequence
  Description of Artificial Sequence: Synthetic oligonucleotide
taggttttgatgatgatggtatctcaagattgtatcagacagatc

SEQ ID NO: 98122 - DNA, 44 bp, Artificial Sequence
  Description of Artificial Sequence: Synthetic oligonucleotide
aggttttgatgatgatggtatctcaagattgtatcagacagatc

SEQ ID NO: 98123 - DNA, 43 bp, Artificial Sequence
  Description of Artificial Sequence: Synthetic oligonucleotide
ggttttgatgatgatggtatctcaagattgtatcagacagatc

SEQ ID NO: 98124 - DNA, 43 bp, Artificial Sequence
  Description of Artificial Sequence: Synthetic oligonucleotide
gttttgatgatgatggtatctcaagattgtatcagacagatcc

SEQ ID NO: 98125 - DNA, 45 bp, Artificial Sequence
  Description of Artificial Sequence: Synthetic oligonucleotide
ttttgatgatgatggtatctcaagattgtatcagacagatccttc

SEQ ID NO: 98126 - DNA, 44 bp, Artificial Sequence
  Description of Artificial Sequence: Synthetic oligonucleotide
tttgatgatgatggtatctcaagattgtatcagacagatccttc

SEQ ID NO: 98127 - DNA, 43 bp, Artificial Sequence
  Description of Artificial Sequence: Synthetic oligonucleotide
ttgatgatgatggtatctcaagattgtatcagacagatccttc

SEQ ID NO: 98128 - DNA, 42 bp, Artificial Sequence
  Description of Artificial Sequence: Synthetic oligonucleotide
tgatgatgatggtatctcaagattgtatcagacagatccttc

SEQ ID NO: 98129 - DNA, 41 bp, Artificial Sequence
  Description of Artificial Sequence: Synthetic oligonucleotide
gatgatgatggtatctcaagattgtatcagacagatccttc

SEQ ID NO: 98130 - DNA, 42 bp, Artificial Sequence
  Description of Artificial Sequence: Synthetic oligonucleotide
atgatgatggtatctcaagattgtatcagacagatccttctg

SEQ ID NO: 98131 - DNA, 41 bp, Artificial Sequence
  Description of Artificial Sequence: Synthetic oligonucleotide
tgatgatggtatctcaagattgtatcagacagatccttctg

SEQ ID NO: 98132 - DNA, 40 bp, Artificial Sequence
  Description of Artificial Sequence: Synthetic oligonucleotide
gatgatggtatctcaagattgtatcagacagatccttctg

SEQ ID NO: 98133 - DNA, 40 bp, Artificial Sequence
  Description of Artificial Sequence: Synthetic oligonucleotide
atgatggtatctcaagattgtatcagacagatccttctgg

SEQ ID NO: 98134 - DNA, 39 bp, Artificial Sequence
  Description of Artificial Sequence: Synthetic oligonucleotide
tgatggtatctcaagattgtatcagacagatccttctgg

SEQ ID NO: 98135 - DNA, 38 bp, Artificial Sequence
  Description of Artificial Sequence: Synthetic oligonucleotide
gatggtatctcaagattgtatcagacagatccttctgg

SEQ ID NO: 98136 - DNA, 40 bp, Artificial Sequence
  Description of Artificial Sequence: Synthetic oligonucleotide
atggtatctcaagattgtatcagacagatccttctggtac

SEQ ID NO: 98137 - DNA, 39 bp, Artificial Sequence
  Description of Artificial Sequence: Synthetic oligonucleotide
tggtatctcaagattgtatcagacagatccttctggtac

SEQ ID NO: 98138 - DNA, 38 bp, Artificial Sequence
  Description of Artificial Sequence: Synthetic oligonucleotide
ggtatctcaagattgtatcagacagatccttctggtac

SEQ ID NO: 98139 - DNA, 42 bp, Artificial Sequence
  Description of Artificial Sequence: Synthetic oligonucleotide
gtatctcaagattgtatcagacagatccttctggtacttatc

SEQ ID NO: 98140 - DNA, 44 bp, Artificial Sequence
  Description of Artificial Sequence: Synthetic oligonucleotide
tatctcaagattgtatcagacagatccttctggtacttatcatg

SEQ ID NO: 98141 - DNA, 43 bp, Artificial Sequence
  Description of Artificial Sequence: Synthetic oligonucleotide
atctcaagattgtatcagacagatccttctggtacttatcatg

SEQ ID NO: 98142 - DNA, 42 bp, Artificial Sequence
  Description of Artificial Sequence: Synthetic oligonucleotide
tctcaagattgtatcagacagatccttctggtacttatcatg

SEQ ID NO: 98143 - DNA, 41 bp, Artificial Sequence
  Description of Artificial Sequence: Synthetic oligonucleotide
ctcaagattgtatcagacagatccttctggtacttatcatg

SEQ ID NO: 98144 - DNA, 41 bp, Artificial Sequence
  Description of Artificial Sequence: Synthetic oligonucleotide
tcaagattgtatcagacagatccttctggtacttatcatgc

SEQ ID NO: 98145 - DNA, 40 bp, Artificial Sequence
  Description of Artificial Sequence: Synthetic oligonucleotide
caagattgtatcagacagatccttctggtacttatcatgc

SEQ ID NO: 98146 - DNA, 42 bp, Artificial Sequence
  Description of Artificial Sequence: Synthetic oligonucleotide
aagattgtatcagacagatccttctggtacttatcatgcttg

SEQ ID NO: 98147 - DNA, 41 bp, Artificial Sequence
  Description of Artificial Sequence: Synthetic oligonucleotide
agattgtatcagacagatccttctggtacttatcatgcttg

SEQ ID NO: 98148 - DNA, 40 bp, Artificial Sequence
  Description of Artificial Sequence: Synthetic oligonucleotide
gattgtatcagacagatccttctggtacttatcatgcttg

SEQ ID NO: 98149 - DNA, 40 bp, Artificial Sequence
  Description of Artificial Sequence: Synthetic oligonucleotide
attgtatcagacagatccttctggtacttatcatgcttgg

SEQ ID NO: 98150 - DNA, 39 bp, Artificial Sequence
  Description of Artificial Sequence: Synthetic oligonucleotide
ttgtatcagacagatccttctggtacttatcatgcttgg

SEQ ID NO: 98151 - DNA, 38 bp, Artificial Sequence
  Description of Artificial Sequence: Synthetic oligonucleotide
tgtatcagacagatccttctggtacttatcatgcttgg

SEQ ID NO: 98152 - DNA, 37 bp, Artificial Sequence
  Description of Artificial Sequence: Synthetic oligonucleotide
gtatcagacagatccttctggtacttatcatgcttgg

SEQ ID NO: 98153 - DNA, 39 bp, Artificial Sequence
  Description of Artificial Sequence: Synthetic oligonucleotide
tatcagacagatccttctggtacttatcatgcttggaag

SEQ ID NO: 98154 - DNA, 38 bp, Artificial Sequence
  Description of Artificial Sequence: Synthetic oligonucleotide
atcagacagatccttctggtacttatcatgcttggaag

SEQ ID NO: 98155 - DNA, 37 bp, Artificial Sequence
  Description of Artificial Sequence: Synthetic oligonucleotide
tcagacagatccttctggtacttatcatgcttggaag

SEQ ID NO: 98156 - DNA, 36 bp, Artificial Sequence
  Description of Artificial Sequence: Synthetic oligonucleotide
cagacagatccttctggtacttatcatgcttggaag

SEQ ID NO: 98157 - DNA, 36 bp, Artificial Sequence
  Description of Artificial Sequence: Synthetic oligonucleotide
agacagatccttctggtacttatcatgcttggaagg

SEQ ID NO: 98158 - DNA, 35 bp, Artificial Sequence
  Description of Artificial Sequence: Synthetic oligonucleotide
gacagatccttctggtacttatcatgcttggaagg

SEQ ID NO: 98159 - DNA, 35 bp, Artificial Sequence
  Description of Artificial Sequence: Synthetic oligonucleotide
acagatccttctggtacttatcatgcttggaaggc

SEQ ID NO: 98160 - DNA, 34 bp, Artificial Sequence
  Description of Artificial Sequence: Synthetic oligonucleotide
cagatccttctggtacttatcatgcttggaaggc

SEQ ID NO: 98161 - DNA, 38 bp, Artificial Sequence
  Description of Artificial Sequence: Synthetic oligonucleotide
agatccttctggtacttatcatgcttggaaggcaaatg

SEQ ID NO: 98162 - DNA, 37 bp, Artificial Sequence
  Description of Artificial Sequence: Synthetic oligonucleotide
gatccttctggtacttatcatgcttggaaggcaaatg

SEQ ID NO: 98163 - DNA, 37 bp, Artificial Sequence
  Description of Artificial Sequence: Synthetic oligonucleotide
atccttctggtacttatcatgcttggaaggcaaatgc

SEQ ID NO: 98164 - DNA, 36 bp, Artificial Sequence
  Description of Artificial Sequence: Synthetic oligonucleotide
tccttctggtacttatcatgcttggaaggcaaatgc

SEQ ID NO: 98165 - DNA, 35 bp, Artificial Sequence
  Description of Artificial Sequence: Synthetic oligonucleotide
ccttctggtacttatcatgcttggaaggcaaatgc

SEQ ID NO: 98166 - DNA, 39 bp, Artificial Sequence
  Description of Artificial Sequence: Synthetic oligonucleotide
cttctggtacttatcatgcttggaaggcaaatgcaatag

SEQ ID NO: 98167 - DNA, 39 bp, Artificial Sequence
  Description of Artificial Sequence: Synthetic oligonucleotide
ttctggtacttatcatgcttggaaggcaaatgcaatagg

SEQ ID NO: 98168 - DNA, 38 bp, Artificial Sequence
  Description of Artificial Sequence: Synthetic oligonucleotide
tctggtacttatcatgcttggaaggcaaatgcaatagg

SEQ ID NO: 98169 - DNA, 37 bp, Artificial Sequence
  Description of Artificial Sequence: Synthetic oligonucleotide
ctggtacttatcatgcttggaaggcaaatgcaatagg

SEQ ID NO: 98170 - DNA, 37 bp, Artificial Sequence
  Description of Artificial Sequence: Synthetic oligonucleotide
tggtacttatcatgcttggaaggcaaatgcaataggc

SEQ ID NO: 98171 - DNA, 36 bp, Artificial Sequence
  Description of Artificial Sequence: Synthetic oligonucleotide
ggtacttatcatgcttggaaggcaaatgcaataggc

SEQ ID NO: 98172 - DNA, 36 bp, Artificial Sequence
  Description of Artificial Sequence: Synthetic oligonucleotide
gtacttatcatgcttggaaggcaaatgcaataggcc

SEQ ID NO: 98173 - DNA, 36 bp, Artificial Sequence
  Description of Artificial Sequence: Synthetic oligonucleotide
tacttatcatgcttggaaggcaaatgcaataggccg

SEQ ID NO: 98174 - DNA, 35 bp, Artificial Sequence
  Description of Artificial Sequence: Synthetic oligonucleotide
acttatcatgcttggaaggcaaatgcaataggccg

SEQ ID NO: 98175 - DNA, 34 bp, Artificial Sequence
  Description of Artificial Sequence: Synthetic oligonucleotide
cttatcatgcttggaaggcaaatgcaataggccg

SEQ ID NO: 98176 - DNA, 36 bp, Artificial Sequence
  Description of Artificial Sequence: Synthetic oligonucleotide
ttatcatgcttggaaggcaaatgcaataggccgaag

SEQ ID NO: 98177 - DNA, 35 bp, Artificial Sequence
  Description of Artificial Sequence: Synthetic oligonucleotide
tatcatgcttggaaggcaaatgcaataggccgaag

SEQ ID NO: 98178 - DNA, 34 bp, Artificial Sequence
  Description of Artificial Sequence: Synthetic oligonucleotide
atcatgcttggaaggcaaatgcaataggccgaag

SEQ ID NO: 98179 - DNA, 33 bp, Artificial Sequence
  Description of Artificial Sequence: Synthetic oligonucleotide
tcatgcttggaaggcaaatgcaataggccgaag

SEQ ID NO: 98180 - DNA, 32 bp, Artificial Sequence
  Description of Artificial Sequence: Synthetic oligonucleotide
catgcttggaaggcaaatgcaataggccgaag

SEQ ID NO: 98181 - DNA, 33 bp, Artificial Sequence
  Description of Artificial Sequence: Synthetic oligonucleotide
atgcttggaaggcaaatgcaataggccgaagtg

SEQ ID NO: 98182 - DNA, 32 bp, Artificial Sequence
  Description of Artificial Sequence: Synthetic oligonucleotide
tgcttggaaggcaaatgcaataggccgaagtg

SEQ ID NO: 98183 - DNA, 31 bp, Artificial Sequence
  Description of Artificial Sequence: Synthetic oligonucleotide
gcttggaaggcaaatgcaataggccgaagtg

SEQ ID NO: 98184 - DNA, 31 bp, Artificial Sequence
  Description of Artificial Sequence: Synthetic oligonucleotide
cttggaaggcaaatgcaataggccgaagtgc

SEQ ID NO: 98185 - DNA, 36 bp, Artificial Sequence
  Description of Artificial Sequence: Synthetic oligonucleotide
ttggaaggcaaatgcaataggccgaagtgctaaaac

SEQ ID NO: 98186 - DNA, 35 bp, Artificial Sequence
  Description of Artificial Sequence: Synthetic oligonucleotide
tggaaggcaaatgcaataggccgaagtgctaaaac

SEQ ID NO: 98187 - DNA, 34 bp, Artificial Sequence
  Description of Artificial Sequence: Synthetic oligonucleotide
ggaaggcaaatgcaataggccgaagtgctaaaac

SEQ ID NO: 98188 - DNA, 35 bp, Artificial Sequence
  Description of Artificial Sequence: Synthetic oligonucleotide
gaaggcaaatgcaataggccgaagtgctaaaactg

SEQ ID NO: 98189 - DNA, 37 bp, Artificial Sequence
  Description of Artificial Sequence: Synthetic oligonucleotide
aaggcaaatgcaataggccgaagtgctaaaactgttc

SEQ ID NO: 98190 - DNA, 36 bp, Artificial Sequence
  Description of Artificial Sequence: Synthetic oligonucleotide
aggcaaatgcaataggccgaagtgctaaaactgttc

SEQ ID NO: 98191 - DNA, 35 bp, Artificial Sequence
  Description of Artificial Sequence: Synthetic oligonucleotide
ggcaaatgcaataggccgaagtgctaaaactgttc

SEQ ID NO: 98192 - DNA, 35 bp, Artificial Sequence
  Description of Artificial Sequence: Synthetic oligonucleotide
gcaaatgcaataggccgaagtgctaaaactgttcg

SEQ ID NO: 98193 - DNA, 36 bp, Artificial Sequence
  Description of Artificial Sequence: Synthetic oligonucleotide
caaatgcaataggccgaagtgctaaaactgttcgag

SEQ ID NO: 98194 - DNA, 41 bp, Artificial Sequence
  Description of Artificial Sequence: Synthetic oligonucleotide
aaatgcaataggccgaagtgctaaaactgttcgagaatttc

SEQ ID NO: 98195 - DNA, 40 bp, Artificial Sequence
  Description of Artificial Sequence: Synthetic oligonucleotide
aatgcaataggccgaagtgctaaaactgttcgagaatttc

SEQ ID NO: 98196 - DNA, 39 bp, Artificial Sequence
  Description of Artificial Sequence: Synthetic oligonucleotide
atgcaataggccgaagtgctaaaactgttcgagaatttc

SEQ ID NO: 98197 - DNA, 38 bp, Artificial Sequence
  Description of Artificial Sequence: Synthetic oligonucleotide
tgcaataggccgaagtgctaaaactgttcgagaatttc

SEQ ID NO: 98198 - DNA, 37 bp, Artificial Sequence
  Description of Artificial Sequence: Synthetic oligonucleotide
gcaataggccgaagtgctaaaactgttcgagaatttc

SEQ ID NO: 98199 - DNA, 39 bp, Artificial Sequence
  Description of Artificial Sequence: Synthetic oligonucleotide
caataggccgaagtgctaaaactgttcgagaatttctag

SEQ ID NO: 98200 - DNA, 43 bp, Artificial Sequence
  Description of Artificial Sequence: Synthetic oligonucleotide
aataggccgaagtgctaaaactgttcgagaatttctagaaaag

SEQ ID NO: 98201 - DNA, 42 bp, Artificial Sequence
  Description of Artificial Sequence: Synthetic oligonucleotide
ataggccgaagtgctaaaactgttcgagaatttctagaaaag

SEQ ID NO: 98202 - DNA, 41 bp, Artificial Sequence
  Description of Artificial Sequence: Synthetic oligonucleotide
taggccgaagtgctaaaactgttcgagaatttctagaaaag

SEQ ID NO: 98203 - DNA, 40 bp, Artificial Sequence
  Description of Artificial Sequence: Synthetic oligonucleotide
aggccgaagtgctaaaactgttcgagaatttctagaaaag

SEQ ID NO: 98204 - DNA, 39 bp, Artificial Sequence
  Description of Artificial Sequence: Synthetic oligonucleotide
ggccgaagtgctaaaactgttcgagaatttctagaaaag

SEQ ID NO: 98205 - DNA, 44 bp, Artificial Sequence
  Description of Artificial Sequence: Synthetic oligonucleotide
gccgaagtgctaaaactgttcgagaatttctagaaaagaattac

SEQ ID NO: 98206 - DNA, 45 bp, Artificial Sequence
  Description of Artificial Sequence: Synthetic oligonucleotide
ccgaagtgctaaaactgttcgagaatttctagaaaagaattacac

SEQ ID NO: 98207 - DNA, 46 bp, Artificial Sequence
  Description of Artificial Sequence: Synthetic oligonucleotide
cgaagtgctaaaactgttcgagaatttctagaaaagaattacacag

SEQ ID NO: 98208 - DNA, 48 bp, Artificial Sequence
  Description of Artificial Sequence: Synthetic oligonucleotide
gaagtgctaaaactgttcgagaatttctagaaaagaattacacagaag

SEQ ID NO: 98209 - DNA, 50 bp, Artificial Sequence
  Description of Artificial Sequence: Synthetic oligonucleotide
aagtgctaaaactgttcgagaatttctagaaaagaattacacagaagatg

SEQ ID NO: 98210 - DNA, 49 bp, Artificial Sequence
  Description of Artificial Sequence: Synthetic oligonucleotide
agtgctaaaactgttcgagaatttctagaaaagaattacacagaagatg

SEQ ID NO: 98211 - DNA, 48 bp, Artificial Sequence
  Description of Artificial Sequence: Synthetic oligonucleotide
gtgctaaaactgttcgagaatttctagaaaagaattacacagaagatg

SEQ ID NO: 98212 - DNA, 48 bp, Artificial Sequence
  Description of Artificial Sequence: Synthetic oligonucleotide
tgctaaaactgttcgagaatttctagaaaagaattacacagaagatgc

SEQ ID NO: 98213 - DNA, 47 bp, Artificial Sequence
  Description of Artificial Sequence: Synthetic oligonucleotide
gctaaaactgttcgagaatttctagaaaagaattacacagaagatgc

SEQ ID NO: 98214 - DNA, 47 bp, Artificial Sequence
  Description of Artificial Sequence: Synthetic oligonucleotide
ctaaaactgttcgagaatttctagaaaagaattacacagaagatgcc

SEQ ID NO: 98215 - DNA, 50 bp, Artificial Sequence
  Description of Artificial Sequence: Synthetic oligonucleotide
taaaactgttcgagaatttctagaaaagaattacacagaagatgccatag

SEQ ID NO: 98216 - DNA, 49 bp, Artificial Sequence
  Description of Artificial Sequence: Synthetic oligonucleotide
aaaactgttcgagaatttctagaaaagaattacacagaagatgccatag

SEQ ID NO: 98217 - DNA, 48 bp, Artificial Sequence
  Description of Artificial Sequence: Synthetic oligonucleotide
aaactgttcgagaatttctagaaaagaattacacagaagatgccatag

SEQ ID NO: 98218 - DNA, 47 bp, Artificial Sequence
  Description of Artificial Sequence: Synthetic oligonucleotide
aactgttcgagaatttctagaaaagaattacacagaagatgccatag

SEQ ID NO: 98219 - DNA, 46 bp, Artificial Sequence
  Description of Artificial Sequence: Synthetic oligonucleotide
actgttcgagaatttctagaaaagaattacacagaagatgccatag

SEQ ID NO: 98220 - DNA, 45 bp, Artificial Sequence
  Description of Artificial Sequence: Synthetic oligonucleotide
ctgttcgagaatttctagaaaagaattacacagaagatgccatag

SEQ ID NO: 98221 - DNA, 45 bp, Artificial Sequence
  Description of Artificial Sequence: Synthetic oligonucleotide
tgttcgagaatttctagaaaagaattacacagaagatgccatagc

SEQ ID NO: 98222 - DNA, 44 bp, Artificial Sequence
  Description of Artificial Sequence: Synthetic oligonucleotide
gttcgagaatttctagaaaagaattacacagaagatgccatagc

SEQ ID NO: 98223 - DNA, 46 bp, Artificial Sequence
  Description of Artificial Sequence: Synthetic oligonucleotide
ttcgagaatttctagaaaagaattacacagaagatgccatagcaag

SEQ ID NO: 98224 - DNA, 45 bp, Artificial Sequence
  Description of Artificial Sequence: Synthetic oligonucleotide
tcgagaatttctagaaaagaattacacagaagatgccatagcaag

SEQ ID NO: 98225 - DNA, 44 bp, Artificial Sequence
  Description of Artificial Sequence: Synthetic oligonucleotide
cgagaatttctagaaaagaattacacagaagatgccatagcaag

SEQ ID NO: 98226 - DNA, 45 bp, Artificial Sequence
  Description of Artificial Sequence: Synthetic oligonucleotide
gagaatttctagaaaagaattacacagaagatgccatagcaagtg

SEQ ID NO: 98227 - DNA, 46 bp, Artificial Sequence
  Description of Artificial Sequence: Synthetic oligonucleotide
agaatttctagaaaagaattacacagaagatgccatagcaagtgac

SEQ ID NO: 98228 - DNA, 45 bp, Artificial Sequence
  Description of Artificial Sequence: Synthetic oligonucleotide
gaatttctagaaaagaattacacagaagatgccatagcaagtgac

SEQ ID NO: 98229 - DNA, 46 bp, Artificial Sequence
  Description of Artificial Sequence: Synthetic oligonucleotide
aatttctagaaaagaattacacagaagatgccatagcaagtgacag

SEQ ID NO: 98230 - DNA, 45 bp, Artificial Sequence
  Description of Artificial Sequence: Synthetic oligonucleotide
atttctagaaaagaattacacagaagatgccatagcaagtgacag

SEQ ID NO: 98231 - DNA, 44 bp, Artificial Sequence
  Description of Artificial Sequence: Synthetic oligonucleotide
tttctagaaaagaattacacagaagatgccatagcaagtgacag

SEQ ID NO: 98232 - DNA, 43 bp, Artificial Sequence
  Description of Artificial Sequence: Synthetic oligonucleotide
ttctagaaaagaattacacagaagatgccatagcaagtgacag

SEQ ID NO: 98233 - DNA, 42 bp, Artificial Sequence
  Description of Artificial Sequence: Synthetic oligonucleotide
tctagaaaagaattacacagaagatgccatagcaagtgacag

SEQ ID NO: 98234 - DNA, 41 bp, Artificial Sequence
  Description of Artificial Sequence: Synthetic oligonucleotide
ctagaaaagaattacacagaagatgccatagcaagtgacag

SEQ ID NO: 98235 - DNA, 42 bp, Artificial Sequence
  Description of Artificial Sequence: Synthetic oligonucleotide
tagaaaagaattacacagaagatgccatagcaagtgacagtg

SEQ ID NO: 98236 - DNA, 41 bp, Artificial Sequence
  Description of Artificial Sequence: Synthetic oligonucleotide
agaaaagaattacacagaagatgccatagcaagtgacagtg

SEQ ID NO: 98237 - DNA, 40 bp, Artificial Sequence
  Description of Artificial Sequence: Synthetic oligonucleotide
gaaaagaattacacagaagatgccatagcaagtgacagtg

SEQ ID NO: 98238 - DNA, 42 bp, Artificial Sequence
  Description of Artificial Sequence: Synthetic oligonucleotide
aaaagaattacacagaagatgccatagcaagtgacagtgaag

SEQ ID NO: 98239 - DNA, 41 bp, Artificial Sequence
  Description of Artificial Sequence: Synthetic oligonucleotide
aaagaattacacagaagatgccatagcaagtgacagtgaag

SEQ ID NO: 98240 - DNA, 40 bp, Artificial Sequence
  Description of Artificial Sequence: Synthetic oligonucleotide
aagaattacacagaagatgccatagcaagtgacagtgaag

SEQ ID NO: 98241 - DNA, 39 bp, Artificial Sequence
  Description of Artificial Sequence: Synthetic oligonucleotide
agaattacacagaagatgccatagcaagtgacagtgaag

SEQ ID NO: 98242 - DNA, 38 bp, Artificial Sequence
  Description of Artificial Sequence: Synthetic oligonucleotide
gaattacacagaagatgccatagcaagtgacagtgaag

SEQ ID NO: 98243 - DNA, 38 bp, Artificial Sequence
  Description of Artificial Sequence: Synthetic oligonucleotide
aattacacagaagatgccatagcaagtgacagtgaagc

SEQ ID NO: 98244 - DNA, 37 bp, Artificial Sequence
  Description of Artificial Sequence: Synthetic oligonucleotide
attacacagaagatgccatagcaagtgacagtgaagc

SEQ ID NO: 98245 - DNA, 36 bp, Artificial Sequence
  Description of Artificial Sequence: Synthetic oligonucleotide
ttacacagaagatgccatagcaagtgacagtgaagc

SEQ ID NO: 98246 - DNA, 35 bp, Artificial Sequence
  Description of Artificial Sequence: Synthetic oligonucleotide
tacacagaagatgccatagcaagtgacagtgaagc

SEQ ID NO: 98247 - DNA, 34 bp, Artificial Sequence
  Description of Artificial Sequence: Synthetic oligonucleotide
acacagaagatgccatagcaagtgacagtgaagc

SEQ ID NO: 98248 - DNA, 33 bp, Artificial Sequence
  Description of Artificial Sequence: Synthetic oligonucleotide
cacagaagatgccatagcaagtgacagtgaagc

SEQ ID NO: 98249 - DNA, 36 bp, Artificial Sequence
  Description of Artificial Sequence: Synthetic oligonucleotide
acagaagatgccatagcaagtgacagtgaagctatc

SEQ ID NO: 98250 - DNA, 35 bp, Artificial Sequence
  Description of Artificial Sequence: Synthetic oligonucleotide
cagaagatgccatagcaagtgacagtgaagctatc

SEQ ID NO: 98251 - DNA, 37 bp, Artificial Sequence
  Description of Artificial Sequence: Synthetic oligonucleotide
agaagatgccatagcaagtgacagtgaagctatcaag

SEQ ID NO: 98252 - DNA, 36 bp, Artificial Sequence
  Description of Artificial Sequence: Synthetic oligonucleotide
gaagatgccatagcaagtgacagtgaagctatcaag

SEQ ID NO: 98253 - DNA, 39 bp, Artificial Sequence
  Description of Artificial Sequence: Synthetic oligonucleotide
aagatgccatagcaagtgacagtgaagctatcaagttag

SEQ ID NO: 98254 - DNA, 38 bp, Artificial Sequence
  Description of Artificial Sequence: Synthetic oligonucleotide
agatgccatagcaagtgacagtgaagctatcaagttag

SEQ ID NO: 98255 - DNA, 37 bp, Artificial Sequence
  Description of Artificial Sequence: Synthetic oligonucleotide
gatgccatagcaagtgacagtgaagctatcaagttag

SEQ ID NO: 98256 - DNA, 37 bp, Artificial Sequence
  Description of Artificial Sequence: Synthetic oligonucleotide
atgccatagcaagtgacagtgaagctatcaagttagc

SEQ ID NO: 98257 - DNA, 36 bp, Artificial Sequence
  Description of Artificial Sequence: Synthetic oligonucleotide
tgccatagcaagtgacagtgaagctatcaagttagc

SEQ ID NO: 98258 - DNA, 35 bp, Artificial Sequence
  Description of Artificial Sequence: Synthetic oligonucleotide
gccatagcaagtgacagtgaagctatcaagttagc

SEQ ID NO: 98259 - DNA, 42 bp, Artificial Sequence
  Description of Artificial Sequence: Synthetic oligonucleotide
ccatagcaagtgacagtgaagctatcaagttagcaataaaag

SEQ ID NO: 98260 - DNA, 42 bp, Artificial Sequence
  Description of Artificial Sequence: Synthetic oligonucleotide
catagcaagtgacagtgaagctatcaagttagcaataaaagc

SEQ ID NO: 98261 - DNA, 45 bp, Artificial Sequence
  Description of Artificial Sequence: Synthetic oligonucleotide
atagcaagtgacagtgaagctatcaagttagcaataaaagctttg

SEQ ID NO: 98262 - DNA, 44 bp, Artificial Sequence
  Description of Artificial Sequence: Synthetic oligonucleotide
tagcaagtgacagtgaagctatcaagttagcaataaaagctttg

SEQ ID NO: 98263 - DNA, 43 bp, Artificial Sequence
  Description of Artificial Sequence: Synthetic oligonucleotide
agcaagtgacagtgaagctatcaagttagcaataaaagctttg

SEQ ID NO: 98264 - DNA, 42 bp, Artificial Sequence
  Description of Artificial Sequence: Synthetic oligonucleotide
gcaagtgacagtgaagctatcaagttagcaataaaagctttg

SEQ ID NO: 98265 - DNA, 42 bp, Artificial Sequence
  Description of Artificial Sequence: Synthetic oligonucleotide
caagtgacagtgaagctatcaagttagcaataaaagctttgc

SEQ ID NO: 98266 - DNA, 44 bp, Artificial Sequence
  Description of Artificial Sequence: Synthetic oligonucleotide
aagtgacagtgaagctatcaagttagcaataaaagctttgctag

SEQ ID NO: 98267 - DNA, 43 bp, Artificial Sequence
  Description of Artificial Sequence: Synthetic oligonucleotide
agtgacagtgaagctatcaagttagcaataaaagctttgctag

SEQ ID NO: 98268 - DNA, 42 bp, Artificial Sequence
  Description of Artificial Sequence: Synthetic oligonucleotide
gtgacagtgaagctatcaagttagcaataaaagctttgctag

SEQ ID NO: 98269 - DNA, 44 bp, Artificial Sequence
  Description of Artificial Sequence: Synthetic oligonucleotide
tgacagtgaagctatcaagttagcaataaaagctttgctagaag

SEQ ID NO: 98270 - DNA, 43 bp, Artificial Sequence
  Description of Artificial Sequence: Synthetic oligonucleotide
gacagtgaagctatcaagttagcaataaaagctttgctagaag

SEQ ID NO: 98271 - DNA, 45 bp, Artificial Sequence
  Description of Artificial Sequence: Synthetic oligonucleotide
acagtgaagctatcaagttagcaataaaagctttgctagaagttg

SEQ ID NO: 98272 - DNA, 44 bp, Artificial Sequence
  Description of Artificial Sequence: Synthetic oligonucleotide
cagtgaagctatcaagttagcaataaaagctttgctagaagttg

SEQ ID NO: 98273 - DNA, 45 bp, Artificial Sequence
  Description of Artificial Sequence: Synthetic oligonucleotide
agtgaagctatcaagttagcaataaaagctttgctagaagttgtc

SEQ ID NO: 98274 - DNA, 44 bp, Artificial Sequence
  Description of Artificial Sequence: Synthetic oligonucleotide
gtgaagctatcaagttagcaataaaagctttgctagaagttgtc

SEQ ID NO: 98275 - DNA, 44 bp, Artificial Sequence
  Description of Artificial Sequence: Synthetic oligonucleotide
tgaagctatcaagttagcaataaaagctttgctagaagttgtcc

SEQ ID NO: 98276 - DNA, 43 bp, Artificial Sequence
  Description of Artificial Sequence: Synthetic oligonucleotide
gaagctatcaagttagcaataaaagctttgctagaagttgtcc

SEQ ID NO: 98277 - DNA, 44 bp, Artificial Sequence
  Description of Artificial Sequence: Synthetic oligonucleotide
aagctatcaagttagcaataaaagctttgctagaagttgtccag

SEQ ID NO: 98278 - DNA, 43 bp, Artificial Sequence
  Description of Artificial Sequence: Synthetic oligonucleotide
agctatcaagttagcaataaaagctttgctagaagttgtccag

SEQ ID NO: 98279 - DNA, 42 bp, Artificial Sequence
  Description of Artificial Sequence: Synthetic oligonucleotide
gctatcaagttagcaataaaagctttgctagaagttgtccag

SEQ ID NO: 98280 - DNA, 43 bp, Artificial Sequence
  Description of Artificial Sequence: Synthetic oligonucleotide
ctatcaagttagcaataaaagctttgctagaagttgtccagtc

SEQ ID NO: 98281 - DNA, 44 bp, Artificial Sequence
  Description of Artificial Sequence: Synthetic oligonucleotide
tatcaagttagcaataaaagctttgctagaagttgtccagtctg

SEQ ID NO: 98282 - DNA, 43 bp, Artificial Sequence
  Description of Artificial Sequence: Synthetic oligonucleotide
atcaagttagcaataaaagctttgctagaagttgtccagtctg

SEQ ID NO: 98283 - DNA, 42 bp, Artificial Sequence
  Description of Artificial Sequence: Synthetic oligonucleotide
tcaagttagcaataaaagctttgctagaagttgtccagtctg

SEQ ID NO: 98284 - DNA, 41 bp, Artificial Sequence
  Description of Artificial Sequence: Synthetic oligonucleotide
caagttagcaataaaagctttgctagaagttgtccagtctg

SEQ ID NO: 98285 - DNA, 41 bp, Artificial Sequence
  Description of Artificial Sequence: Synthetic oligonucleotide
aagttagcaataaaagctttgctagaagttgtccagtctgg

SEQ ID NO: 98286 - DNA, 40 bp, Artificial Sequence
  Description of Artificial Sequence: Synthetic oligonucleotide
agttagcaataaaagctttgctagaagttgtccagtctgg

SEQ ID NO: 98287 - DNA, 39 bp, Artificial Sequence
  Description of Artificial Sequence: Synthetic oligonucleotide
gttagcaataaaagctttgctagaagttgtccagtctgg

SEQ ID NO: 98288 - DNA, 40 bp, Artificial Sequence
  Description of Artificial Sequence: Synthetic oligonucleotide
ttagcaataaaagctttgctagaagttgtccagtctggtg

SEQ ID NO: 98289 - DNA, 39 bp, Artificial Sequence
  Description of Artificial Sequence: Synthetic oligonucleotide
tagcaataaaagctttgctagaagttgtccagtctggtg

SEQ ID NO: 98290 - DNA, 38 bp, Artificial Sequence
  Description of Artificial Sequence: Synthetic oligonucleotide
agcaataaaagctttgctagaagttgtccagtctggtg

SEQ ID NO: 98291 - DNA, 37 bp, Artificial Sequence
  Description of Artificial Sequence: Synthetic oligonucleotide
gcaataaaagctttgctagaagttgtccagtctggtg

SEQ ID NO: 98292 - DNA, 37 bp, Artificial Sequence
  Description of Artificial Sequence: Synthetic oligonucleotide
caataaaagctttgctagaagttgtccagtctggtgg

SEQ ID NO: 98293 - DNA, 43 bp, Artificial Sequence
  Description of Artificial Sequence: Synthetic oligonucleotide
aataaaagctttgctagaagttgtccagtctggtggaaaaaac

SEQ ID NO: 98294 - DNA, 42 bp, Artificial Sequence
  Description of Artificial Sequence: Synthetic oligonucleotide
ataaaagctttgctagaagttgtccagtctggtggaaaaaac

SEQ ID NO: 98295 - DNA, 41 bp, Artificial Sequence
  Description of Artificial Sequence: Synthetic oligonucleotide
taaaagctttgctagaagttgtccagtctggtggaaaaaac

SEQ ID NO: 98296 - DNA, 40 bp, Artificial Sequence
  Description of Artificial Sequence: Synthetic oligonucleotide
aaaagctttgctagaagttgtccagtctggtggaaaaaac

SEQ ID NO: 98297 - DNA, 39 bp, Artificial Sequence
  Description of Artificial Sequence: Synthetic oligonucleotide
aaagctttgctagaagttgtccagtctggtggaaaaaac

SEQ ID NO: 98298 - DNA, 38 bp, Artificial Sequence
  Description of Artificial Sequence: Synthetic oligonucleotide
aagctttgctagaagttgtccagtctggtggaaaaaac

SEQ ID NO: 98299 - DNA, 37 bp, Artificial Sequence
  Description of Artificial Sequence: Synthetic oligonucleotide
agctttgctagaagttgtccagtctggtggaaaaaac

SEQ ID NO: 98300 - DNA, 36 bp, Artificial Sequence
  Description of Artificial Sequence: Synthetic oligonucleotide
gctttgctagaagttgtccagtctggtggaaaaaac

SEQ ID NO: 98301 - DNA, 39 bp, Artificial Sequence
  Description of Artificial Sequence: Synthetic oligonucleotide
ctttgctagaagttgtccagtctggtggaaaaaacattg

SEQ ID NO: 98302 - DNA, 41 bp, Artificial Sequence
  Description of Artificial Sequence: Synthetic oligonucleotide
tttgctagaagttgtccagtctggtggaaaaaacattgaac

SEQ ID NO: 98303 - DNA, 40 bp, Artificial Sequence
  Description of Artificial Sequence: Synthetic oligonucleotide
ttgctagaagttgtccagtctggtggaaaaaacattgaac

SEQ ID NO: 98304 - DNA, 39 bp, Artificial Sequence
  Description of Artificial Sequence: Synthetic oligonucleotide
tgctagaagttgtccagtctggtggaaaaaacattgaac

SEQ ID NO: 98305 - DNA, 38 bp, Artificial Sequence
  Description of Artificial Sequence: Synthetic oligonucleotide
gctagaagttgtccagtctggtggaaaaaacattgaac

SEQ ID NO: 98306 - DNA, 40 bp, Artificial Sequence
  Description of Artificial Sequence: Synthetic oligonucleotide
ctagaagttgtccagtctggtggaaaaaacattgaacttg

SEQ ID NO: 98307 - DNA, 40 bp, Artificial Sequence
  Description of Artificial Sequence: Synthetic oligonucleotide
tagaagttgtccagtctggtggaaaaaacattgaacttgc

SEQ ID NO: 98308 - DNA, 39 bp, Artificial Sequence
  Description of Artificial Sequence: Synthetic oligonucleotide
agaagttgtccagtctggtggaaaaaacattgaacttgc

SEQ ID NO: 98309 - DNA, 38 bp, Artificial Sequence
  Description of Artificial Sequence: Synthetic oligonucleotide
gaagttgtccagtctggtggaaaaaacattgaacttgc

SEQ ID NO: 98310 - DNA, 46 bp, Artificial Sequence
  Description of Artificial Sequence: Synthetic oligonucleotide
aagttgtccagtctggtggaaaaaacattgaacttgctataataag

SEQ ID NO: 98311 - DNA, 45 bp, Artificial Sequence
  Description of Artificial Sequence: Synthetic oligonucleotide
agttgtccagtctggtggaaaaaacattgaacttgctataataag

SEQ ID NO: 98312 - DNA, 44 bp, Artificial Sequence
  Description of Artificial Sequence: Synthetic oligonucleotide
gttgtccagtctggtggaaaaaacattgaacttgctataataag

SEQ ID NO: 98313 - DNA, 46 bp, Artificial Sequence
  Description of Artificial Sequence: Synthetic oligonucleotide
ttgtccagtctggtggaaaaaacattgaacttgctataataagaag

SEQ ID NO: 98314 - DNA, 45 bp, Artificial Sequence
  Description of Artificial Sequence: Synthetic oligonucleotide
tgtccagtctggtggaaaaaacattgaacttgctataataagaag

SEQ ID NO: 98315 - DNA, 44 bp, Artificial Sequence
  Description of Artificial Sequence: Synthetic oligonucleotide
gtccagtctggtggaaaaaacattgaacttgctataataagaag

SEQ ID NO: 98316 - DNA, 48 bp, Artificial Sequence
  Description of Artificial Sequence: Synthetic oligonucleotide
tccagtctggtggaaaaaacattgaacttgctataataagaagaaatc

SEQ ID NO: 98317 - DNA, 47 bp, Artificial Sequence
  Description of Artificial Sequence: Synthetic oligonucleotide
ccagtctggtggaaaaaacattgaacttgctataataagaagaaatc

SEQ ID NO: 98318 - DNA, 49 bp, Artificial Sequence
  Description of Artificial Sequence: Synthetic oligonucleotide
cagtctggtggaaaaaacattgaacttgctataataagaagaaatcaac

SEQ ID NO: 98319 - DNA, 49 bp, Artificial Sequence
  Description of Artificial Sequence: Synthetic oligonucleotide
agtctggtggaaaaaacattgaacttgctataataagaagaaatcaacc

SEQ ID NO: 98320 - DNA, 48 bp, Artificial Sequence
  Description of Artificial Sequence: Synthetic oligonucleotide
gtctggtggaaaaaacattgaacttgctataataagaagaaatcaacc

SEQ ID NO: 98321 - DNA, 51 bp, Artificial Sequence
  Description of Artificial Sequence: Synthetic oligonucleotide
tctggtggaaaaaacattgaacttgctataataagaagaaatcaacctttg

SEQ ID NO: 98322 - DNA, 50 bp, Artificial Sequence
  Description of Artificial Sequence: Synthetic oligonucleotide
ctggtggaaaaaacattgaacttgctataataagaagaaatcaacctttg

SEQ ID NO: 98323 - DNA, 52 bp, Artificial Sequence
  Description of Artificial Sequence: Synthetic oligonucleotide
tggtggaaaaaacattgaacttgctataataagaagaaatcaacctttgaag

SEQ ID NO: 98324 - DNA, 51 bp, Artificial Sequence
  Description of Artificial Sequence: Synthetic oligonucleotide
ggtggaaaaaacattgaacttgctataataagaagaaatcaacctttgaag

SEQ ID NO: 98325 - DNA, 53 bp, Artificial Sequence
  Description of Artificial Sequence: Synthetic oligonucleotide
gtggaaaaaacattgaacttgctataataagaagaaatcaacctttgaagatg

SEQ ID NO: 98326 - DNA, 57 bp, Artificial Sequence
  Description of Artificial Sequence: Synthetic oligonucleotide
tggaaaaaacattgaacttgctataataagaagaaatcaacctttgaagatgtttag

SEQ ID NO: 98327 - DNA, 56 bp, Artificial Sequence
  Description of Artificial Sequence: Synthetic oligonucleotide
ggaaaaaacattgaacttgctataataagaagaaatcaacctttgaagatgtttag

SEQ ID NO: 98328 - DNA, 57 bp, Artificial Sequence
  Description of Artificial Sequence: Synthetic oligonucleotide
gaaaaaacattgaacttgctataataagaagaaatcaacctttgaagatgtttagtg

SEQ ID NO: 98329 - DNA, 57 bp, Artificial Sequence
  Description of Artificial Sequence: Synthetic oligonucleotide
aaaaaacattgaacttgctataataagaagaaatcaacctttgaagatgtttagtgc

SEQ ID NO: 98330 - DNA, 56 bp, Artificial Sequence
  Description of Artificial Sequence: Synthetic oligonucleotide
aaaaacattgaacttgctataataagaagaaatcaacctttgaagatgtttagtgc

SEQ ID NO: 98331 - DNA, 55 bp, Artificial Sequence
  Description of Artificial Sequence: Synthetic oligonucleotide
aaaacattgaacttgctataataagaagaaatcaacctttgaagatgtttagtgc

SEQ ID NO: 98332 - DNA, 54 bp, Artificial Sequence
  Description of Artificial Sequence: Synthetic oligonucleotide
aaacattgaacttgctataataagaagaaatcaacctttgaagatgtttagtgc

SEQ ID NO: 98333 - DNA, 53 bp, Artificial Sequence
  Description of Artificial Sequence: Synthetic oligonucleotide
aacattgaacttgctataataagaagaaatcaacctttgaagatgtttagtgc

SEQ ID NO: 98334 - DNA, 52 bp, Artificial Sequence
  Description of Artificial Sequence: Synthetic oligonucleotide
acattgaacttgctataataagaagaaatcaacctttgaagatgtttagtgc

SEQ ID NO: 98335 - DNA, 51 bp, Artificial Sequence
  Description of Artificial Sequence: Synthetic oligonucleotide
cattgaacttgctataataagaagaaatcaacctttgaagatgtttagtgc

SEQ ID NO: 98336 - DNA, 55 bp, Artificial Sequence
  Description of Artificial Sequence: Synthetic oligonucleotide
attgaacttgctataataagaagaaatcaacctttgaagatgtttagtgcaaaag

SEQ ID NO: 98337 - DNA, 54 bp, Artificial Sequence
  Description of Artificial Sequence: Synthetic oligonucleotide
ttgaacttgctataataagaagaaatcaacctttgaagatgtttagtgcaaaag

SEQ ID NO: 98338 - DNA, 53 bp, Artificial Sequence
  Description of Artificial Sequence: Synthetic oligonucleotide
tgaacttgctataataagaagaaatcaacctttgaagatgtttagtgcaaaag

SEQ ID NO: 98339 - DNA, 52 bp, Artificial Sequence
  Description of Artificial Sequence: Synthetic oligonucleotide
gaacttgctataataagaagaaatcaacctttgaagatgtttagtgcaaaag

SEQ ID NO: 98340 - DNA, 54 bp, Artificial Sequence
  Description of Artificial Sequence: Synthetic oligonucleotide
aacttgctataataagaagaaatcaacctttgaagatgtttagtgcaaaagaag

SEQ ID NO: 98341 - DNA, 53 bp, Artificial Sequence
  Description of Artificial Sequence: Synthetic oligonucleotide
acttgctataataagaagaaatcaacctttgaagatgtttagtgcaaaagaag

SEQ ID NO: 98342 - DNA, 52 bp, Artificial Sequence
  Description of Artificial Sequence: Synthetic oligonucleotide
cttgctataataagaagaaatcaacctttgaagatgtttagtgcaaaagaag

SEQ ID NO: 98343 - DNA, 54 bp, Artificial Sequence
  Description of Artificial Sequence: Synthetic oligonucleotide
ttgctataataagaagaaatcaacctttgaagatgtttagtgcaaaagaagttg

SEQ ID NO: 98344 - DNA, 53 bp, Artificial Sequence
  Description of Artificial Sequence: Synthetic oligonucleotide
tgctataataagaagaaatcaacctttgaagatgtttagtgcaaaagaagttg

SEQ ID NO: 98345 - DNA, 52 bp, Artificial Sequence
  Description of Artificial Sequence: Synthetic oligonucleotide
gctataataagaagaaatcaacctttgaagatgtttagtgcaaaagaagttg

SEQ ID NO: 98346 - DNA, 60 bp, Artificial Sequence
  Description of Artificial Sequence: Synthetic oligonucleotide
ctataataagaagaaatcaacctttgaagatgtttagtgcaaaagaagttgaattatatg

SEQ ID NO: 98347 - DNA, 60 bp, Artificial Sequence
  Description of Artificial Sequence: Synthetic oligonucleotide
tataataagaagaaatcaacctttgaagatgtttagtgcaaaagaagttgaattatatgt

SEQ ID NO: 98348 - DNA, 60 bp, Artificial Sequence
  Description of Artificial Sequence: Synthetic oligonucleotide
ataataagaagaaatcaacctttgaagatgtttagtgcaaaagaagttgaattatatgta

SEQ ID NO: 98349 - DNA, 60 bp, Artificial Sequence
  Description of Artificial Sequence: Synthetic oligonucleotide
taataagaagaaatcaacctttgaagatgtttagtgcaaaagaagttgaattatatgtaa

SEQ ID NO: 98350 - DNA, 60 bp, Artificial Sequence
  Description of Artificial Sequence: Synthetic oligonucleotide
aataagaagaaatcaacctttgaagatgtttagtgcaaaagaagttgaattatatgtaac

SEQ ID NO: 98351 - DNA, 59 bp, Artificial Sequence
  Description of Artificial Sequence: Synthetic oligonucleotide
ataagaagaaatcaacctttgaagatgtttagtgcaaaagaagttgaattatatgtaac

SEQ ID NO: 98352 - DNA, 58 bp, Artificial Sequence
  Description of Artificial Sequence: Synthetic oligonucleotide
taagaagaaatcaacctttgaagatgtttagtgcaaaagaagttgaattatatgtaac

SEQ ID NO: 98353 - DNA, 57 bp, Artificial Sequence
  Description of Artificial Sequence: Synthetic oligonucleotide
aagaagaaatcaacctttgaagatgtttagtgcaaaagaagttgaattatatgtaac

SEQ ID NO: 98354 - DNA, 56 bp, Artificial Sequence
  Description of Artificial Sequence: Synthetic oligonucleotide
agaagaaatcaacctttgaagatgtttagtgcaaaagaagttgaattatatgtaac

SEQ ID NO: 98355 - DNA, 55 bp, Artificial Sequence
  Description of Artificial Sequence: Synthetic oligonucleotide
gaagaaatcaacctttgaagatgtttagtgcaaaagaagttgaattatatgtaac

SEQ ID NO: 98356 - DNA, 56 bp, Artificial Sequence
  Description of Artificial Sequence: Synthetic oligonucleotide
aagaaatcaacctttgaagatgtttagtgcaaaagaagttgaattatatgtaactg

SEQ ID NO: 98357 - DNA, 55 bp, Artificial Sequence
  Description of Artificial Sequence: Synthetic oligonucleotide
agaaatcaacctttgaagatgtttagtgcaaaagaagttgaattatatgtaactg

SEQ ID NO: 98358 - DNA, 54 bp, Artificial Sequence
  Description of Artificial Sequence: Synthetic oligonucleotide
gaaatcaacctttgaagatgtttagtgcaaaagaagttgaattatatgtaactg

SEQ ID NO: 98359 - DNA, 59 bp, Artificial Sequence
  Description of Artificial Sequence: Synthetic oligonucleotide
aaatcaacctttgaagatgtttagtgcaaaagaagttgaattatatgtaactgaaatag

SEQ ID NO: 98360 - DNA, 58 bp, Artificial Sequence
  Description of Artificial Sequence: Synthetic oligonucleotide
aatcaacctttgaagatgtttagtgcaaaagaagttgaattatatgtaactgaaatag

SEQ ID NO: 98361 - DNA, 57 bp, Artificial Sequence
  Description of Artificial Sequence: Synthetic oligonucleotide
atcaacctttgaagatgtttagtgcaaaagaagttgaattatatgtaactgaaatag

SEQ ID NO: 98362 - DNA, 56 bp, Artificial Sequence
  Description of Artificial Sequence: Synthetic oligonucleotide
tcaacctttgaagatgtttagtgcaaaagaagttgaattatatgtaactgaaatag

SEQ ID NO: 98363 - DNA, 55 bp, Artificial Sequence
  Description of Artificial Sequence: Synthetic oligonucleotide
caacctttgaagatgtttagtgcaaaagaagttgaattatatgtaactgaaatag

SEQ ID NO: 98364 - DNA, 59 bp, Artificial Sequence
  Description of Artificial Sequence: Synthetic oligonucleotide
aacctttgaagatgtttagtgcaaaagaagttgaattatatgtaactgaaatagaaaag

SEQ ID NO: 98365 - DNA, 58 bp, Artificial Sequence
  Description of Artificial Sequence: Synthetic oligonucleotide
acctttgaagatgtttagtgcaaaagaagttgaattatatgtaactgaaatagaaaag

SEQ ID NO: 98366 - DNA, 57 bp, Artificial Sequence
  Description of Artificial Sequence: Synthetic oligonucleotide
cctttgaagatgtttagtgcaaaagaagttgaattatatgtaactgaaatagaaaag

SEQ ID NO: 98367 - DNA, 57 bp, Artificial Sequence
  Description of Artificial Sequence: Synthetic oligonucleotide
ctttgaagatgtttagtgcaaaagaagttgaattatatgtaactgaaatagaaaagg

SEQ ID NO: 98368 - DNA, 60 bp, Artificial Sequence
  Description of Artificial Sequence: Synthetic oligonucleotide
tttgaagatgtttagtgcaaaagaagttgaattatatgtaactgaaatagaaaaggaaaa

SEQ ID NO: 98369 - DNA, 60 bp, Artificial Sequence
  Description of Artificial Sequence: Synthetic oligonucleotide
ttgaagatgtttagtgcaaaagaagttgaattatatgtaactgaaatagaaaaggaaaag

SEQ ID NO: 98370 - DNA, 59 bp, Artificial Sequence
  Description of Artificial Sequence: Synthetic oligonucleotide
tgaagatgtttagtgcaaaagaagttgaattatatgtaactgaaatagaaaaggaaaag

SEQ ID NO: 98371 - DNA, 58 bp, Artificial Sequence
  Description of Artificial Sequence: Synthetic oligonucleotide
gaagatgtttagtgcaaaagaagttgaattatatgtaactgaaatagaaaaggaaaag

SEQ ID NO: 98372 - DNA, 58 bp, Artificial Sequence
  Description of Artificial Sequence: Synthetic oligonucleotide
aagatgtttagtgcaaaagaagttgaattatatgtaactgaaatagaaaaggaaaagg

SEQ ID NO: 98373 - DNA, 57 bp, Artificial Sequence
  Description of Artificial Sequence: Synthetic oligonucleotide
agatgtttagtgcaaaagaagttgaattatatgtaactgaaatagaaaaggaaaagg

SEQ ID NO: 98374 - DNA, 56 bp, Artificial Sequence
  Description of Artificial Sequence: Synthetic oligonucleotide
gatgtttagtgcaaaagaagttgaattatatgtaactgaaatagaaaaggaaaagg

SEQ ID NO: 98375 - DNA, 58 bp, Artificial Sequence
  Description of Artificial Sequence: Synthetic oligonucleotide
atgtttagtgcaaaagaagttgaattatatgtaactgaaatagaaaaggaaaaggaag

SEQ ID NO: 98376 - DNA, 57 bp, Artificial Sequence
  Description of Artificial Sequence: Synthetic oligonucleotide
tgtttagtgcaaaagaagttgaattatatgtaactgaaatagaaaaggaaaaggaag

SEQ ID NO: 98377 - DNA, 56 bp, Artificial Sequence
  Description of Artificial Sequence: Synthetic oligonucleotide
gtttagtgcaaaagaagttgaattatatgtaactgaaatagaaaaggaaaaggaag

SEQ ID NO: 98378 - DNA, 58 bp, Artificial Sequence
  Description of Artificial Sequence: Synthetic oligonucleotide
tttagtgcaaaagaagttgaattatatgtaactgaaatagaaaaggaaaaggaagaag

SEQ ID NO: 98379 - DNA, 57 bp, Artificial Sequence
  Description of Artificial Sequence: Synthetic oligonucleotide
ttagtgcaaaagaagttgaattatatgtaactgaaatagaaaaggaaaaggaagaag

SEQ ID NO: 98380 - DNA, 56 bp, Artificial Sequence
  Description of Artificial Sequence: Synthetic oligonucleotide
tagtgcaaaagaagttgaattatatgtaactgaaatagaaaaggaaaaggaagaag

SEQ ID NO: 98381 - DNA, 55 bp, Artificial Sequence
  Description of Artificial Sequence: Synthetic oligonucleotide
agtgcaaaagaagttgaattatatgtaactgaaatagaaaaggaaaaggaagaag

SEQ ID NO: 98382 - DNA, 54 bp, Artificial Sequence
  Description of Artificial Sequence: Synthetic oligonucleotide
gtgcaaaagaagttgaattatatgtaactgaaatagaaaaggaaaaggaagaag

SEQ ID NO: 98383 - DNA, 54 bp, Artificial Sequence
  Description of Artificial Sequence: Synthetic oligonucleotide
tgcaaaagaagttgaattatatgtaactgaaatagaaaaggaaaaggaagaagc

SEQ ID NO: 98384 - DNA, 53 bp, Artificial Sequence
  Description of Artificial Sequence: Synthetic oligonucleotide
gcaaaagaagttgaattatatgtaactgaaatagaaaaggaaaaggaagaagc

SEQ ID NO: 98385 - DNA, 54 bp, Artificial Sequence
  Description of Artificial Sequence: Synthetic oligonucleotide
caaaagaagttgaattatatgtaactgaaatagaaaaggaaaaggaagaagcag

SEQ ID NO: 98386 - DNA, 55 bp, Artificial Sequence
  Description of Artificial Sequence: Synthetic oligonucleotide
aaaagaagttgaattatatgtaactgaaatagaaaaggaaaaggaagaagcagag

SEQ ID NO: 98387 - DNA, 54 bp, Artificial Sequence
  Description of Artificial Sequence: Synthetic oligonucleotide
aaagaagttgaattatatgtaactgaaatagaaaaggaaaaggaagaagcagag

SEQ ID NO: 98388 - DNA, 53 bp, Artificial Sequence
  Description of Artificial Sequence: Synthetic oligonucleotide
aagaagttgaattatatgtaactgaaatagaaaaggaaaaggaagaagcagag

SEQ ID NO: 98389 - DNA, 52 bp, Artificial Sequence
  Description of Artificial Sequence: Synthetic oligonucleotide
agaagttgaattatatgtaactgaaatagaaaaggaaaaggaagaagcagag

SEQ ID NO: 98390 - DNA, 51 bp, Artificial Sequence
  Description of Artificial Sequence: Synthetic oligonucleotide
gaagttgaattatatgtaactgaaatagaaaaggaaaaggaagaagcagag

SEQ ID NO: 98391 - DNA, 53 bp, Artificial Sequence
  Description of Artificial Sequence: Synthetic oligonucleotide
aagttgaattatatgtaactgaaatagaaaaggaaaaggaagaagcagagaag

SEQ ID NO: 98392 - DNA, 52 bp, Artificial Sequence
  Description of Artificial Sequence: Synthetic oligonucleotide
agttgaattatatgtaactgaaatagaaaaggaaaaggaagaagcagagaag

SEQ ID NO: 98393 - DNA, 51 bp, Artificial Sequence
  Description of Artificial Sequence: Synthetic oligonucleotide
gttgaattatatgtaactgaaatagaaaaggaaaaggaagaagcagagaag

SEQ ID NO: 98394 - DNA, 58 bp, Artificial Sequence
  Description of Artificial Sequence: Synthetic oligonucleotide
ttgaattatatgtaactgaaatagaaaaggaaaaggaagaagcagagaagaaaaaatc

SEQ ID NO: 98395 - DNA, 57 bp, Artificial Sequence
  Description of Artificial Sequence: Synthetic oligonucleotide
tgaattatatgtaactgaaatagaaaaggaaaaggaagaagcagagaagaaaaaatc

SEQ ID NO: 98396 - DNA, 56 bp, Artificial Sequence
  Description of Artificial Sequence: Synthetic oligonucleotide
gaattatatgtaactgaaatagaaaaggaaaaggaagaagcagagaagaaaaaatc

SEQ ID NO: 98397 - DNA, 59 bp, Artificial Sequence
  Description of Artificial Sequence: Synthetic oligonucleotide
aattatatgtaactgaaatagaaaaggaaaaggaagaagcagagaagaaaaaatcaaag

SEQ ID NO: 98398 - DNA, 58 bp, Artificial Sequence
  Description of Artificial Sequence: Synthetic oligonucleotide
attatatgtaactgaaatagaaaaggaaaaggaagaagcagagaagaaaaaatcaaag

SEQ ID NO: 98399 - DNA, 57 bp, Artificial Sequence
  Description of Artificial Sequence: Synthetic oligonucleotide
ttatatgtaactgaaatagaaaaggaaaaggaagaagcagagaagaaaaaatcaaag

SEQ ID NO: 98400 - DNA, 56 bp, Artificial Sequence
  Description of Artificial Sequence: Synthetic oligonucleotide
tatatgtaactgaaatagaaaaggaaaaggaagaagcagagaagaaaaaatcaaag

SEQ ID NO: 98401 - DNA, 55 bp, Artificial Sequence
  Description of Artificial Sequence: Synthetic oligonucleotide
atatgtaactgaaatagaaaaggaaaaggaagaagcagagaagaaaaaatcaaag

SEQ ID NO: 98402 - DNA, 54 bp, Artificial Sequence
  Description of Artificial Sequence: Synthetic oligonucleotide
tatgtaactgaaatagaaaaggaaaaggaagaagcagagaagaaaaaatcaaag

SEQ ID NO: 98403 - DNA, 53 bp, Artificial Sequence
  Description of Artificial Sequence: Synthetic oligonucleotide
atgtaactgaaatagaaaaggaaaaggaagaagcagagaagaaaaaatcaaag

SEQ ID NO: 98404 - DNA, 52 bp, Artificial Sequence
  Description of Artificial Sequence: Synthetic oligonucleotide
tgtaactgaaatagaaaaggaaaaggaagaagcagagaagaaaaaatcaaag

SEQ ID NO: 98405 - DNA, 51 bp, Artificial Sequence
  Description of Artificial Sequence: Synthetic oligonucleotide
gtaactgaaatagaaaaggaaaaggaagaagcagagaagaaaaaatcaaag

SEQ ID NO: 98406 - DNA, 55 bp, Artificial Sequence
  Description of Artificial Sequence: Synthetic oligonucleotide
taactgaaatagaaaaggaaaaggaagaagcagagaagaaaaaatcaaagaaatc

SEQ ID NO: 98407 - DNA, 54 bp, Artificial Sequence
  Description of Artificial Sequence: Synthetic oligonucleotide
aactgaaatagaaaaggaaaaggaagaagcagagaagaaaaaatcaaagaaatc

SEQ ID NO: 98408 - DNA, 53 bp, Artificial Sequence
  Description of Artificial Sequence: Synthetic oligonucleotide
actgaaatagaaaaggaaaaggaagaagcagagaagaaaaaatcaaagaaatc

SEQ ID NO: 98409 - DNA, 52 bp, Artificial Sequence
  Description of Artificial Sequence: Synthetic oligonucleotide
ctgaaatagaaaaggaaaaggaagaagcagagaagaaaaaatcaaagaaatc

SEQ ID NO: 98410 - DNA, 53 bp, Artificial Sequence
  Description of Artificial Sequence: Synthetic oligonucleotide
tgaaatagaaaaggaaaaggaagaagcagagaagaaaaaatcaaagaaatctg

SEQ ID NO: 98411 - DNA, 52 bp, Artificial Sequence
  Description of Artificial Sequence: Synthetic oligonucleotide
gaaatagaaaaggaaaaggaagaagcagagaagaaaaaatcaaagaaatctg

SEQ ID NO: 98412 - DNA, 53 bp, Artificial Sequence
  Description of Artificial Sequence: Synthetic oligonucleotide
aaatagaaaaggaaaaggaagaagcagagaagaaaaaatcaaagaaatctgtc

SEQ ID NO: 98413 - DNA, 52 bp, Artificial Sequence
  Description of Artificial Sequence: Synthetic oligonucleotide
aatagaaaaggaaaaggaagaagcagagaagaaaaaatcaaagaaatctgtc

SEQ ID NO: 98414 - DNA, 51 bp, Artificial Sequence
  Description of Artificial Sequence: Synthetic oligonucleotide
atagaaaaggaaaaggaagaagcagagaagaaaaaatcaaagaaatctgtc

SEQ ID NO: 98415 - DNA, 50 bp, Artificial Sequence
  Description of Artificial Sequence: Synthetic oligonucleotide
tagaaaaggaaaaggaagaagcagagaagaaaaaatcaaagaaatctgtc

SEQ ID NO: 98416 - DNA, 49 bp, Artificial Sequence
  Description of Artificial Sequence: Synthetic oligonucleotide
agaaaaggaaaaggaagaagcagagaagaaaaaatcaaagaaatctgtc

SEQ ID NO: 98417 - DNA, 48 bp, Artificial Sequence
  Description of Artificial Sequence: Synthetic oligonucleotide
gaaaaggaaaaggaagaagcagagaagaaaaaatcaaagaaatctgtc

SEQ ID NO: 98418 - DNA, 32 bp, Artificial Sequence
  Description of Artificial Sequence: Synthetic oligonucleotide
cttgatgaccatgtctgcatggcttttgcagg

SEQ ID NO: 98419 - DNA, 33 bp, Artificial Sequence
  Description of Artificial Sequence: Synthetic oligonucleotide
ttgatgaccatgtctgcatggcttttgcaggac

SEQ ID NO: 98420 - DNA, 32 bp, Artificial Sequence
  Description of Artificial Sequence: Synthetic oligonucleotide
tgatgaccatgtctgcatggcttttgcaggac

SEQ ID NO: 98421 - DNA, 31 bp, Artificial Sequence
  Description of Artificial Sequence: Synthetic oligonucleotide
gatgaccatgtctgcatggcttttgcaggac

SEQ ID NO: 98422 - DNA, 34 bp, Artificial Sequence
  Description of Artificial Sequence: Synthetic oligonucleotide
atgaccatgtctgcatggcttttgcaggacttac

SEQ ID NO: 98423 - DNA, 33 bp, Artificial Sequence
  Description of Artificial Sequence: Synthetic oligonucleotide
tgaccatgtctgcatggcttttgcaggacttac

SEQ ID NO: 98424 - DNA, 32 bp, Artificial Sequence
  Description of Artificial Sequence: Synthetic oligonucleotide
gaccatgtctgcatggcttttgcaggacttac

SEQ ID NO: 98425 - DNA, 33 bp, Artificial Sequence
  Description of Artificial Sequence: Synthetic oligonucleotide
accatgtctgcatggcttttgcaggacttactg

SEQ ID NO: 98426 - DNA, 32 bp, Artificial Sequence
  Description of Artificial Sequence: Synthetic oligonucleotide
ccatgtctgcatggcttttgcaggacttactg

SEQ ID NO: 98427 - DNA, 32 bp, Artificial Sequence
  Description of Artificial Sequence: Synthetic oligonucleotide
catgtctgcatggcttttgcaggacttactgc

SEQ ID NO: 98428 - DNA, 33 bp, Artificial Sequence
  Description of Artificial Sequence: Synthetic oligonucleotide
atgtctgcatggcttttgcaggacttactgctg

SEQ ID NO: 98429 - DNA, 32 bp, Artificial Sequence
  Description of Artificial Sequence: Synthetic oligonucleotide
tgtctgcatggcttttgcaggacttactgctg

SEQ ID NO: 98430 - DNA, 31 bp, Artificial Sequence
  Description of Artificial Sequence: Synthetic oligonucleotide
gtctgcatggcttttgcaggacttactgctg

SEQ ID NO: 98431 - DNA, 33 bp, Artificial Sequence
  Description of Artificial Sequence: Synthetic oligonucleotide
tctgcatggcttttgcaggacttactgctgatg

SEQ ID NO: 98432 - DNA, 32 bp, Artificial Sequence
  Description of Artificial Sequence: Synthetic oligonucleotide
ctgcatggcttttgcaggacttactgctgatg

SEQ ID NO: 98433 - DNA, 32 bp, Artificial Sequence
  Description of Artificial Sequence: Synthetic oligonucleotide
tgcatggcttttgcaggacttactgctgatgc

SEQ ID NO: 98434 - DNA, 31 bp, Artificial Sequence
  Description of Artificial Sequence: Synthetic oligonucleotide
gcatggcttttgcaggacttactgctgatgc

SEQ ID NO: 98435 - DNA, 33 bp, Artificial Sequence
  Description of Artificial Sequence: Synthetic oligonucleotide
catggcttttgcaggacttactgctgatgctag

SEQ ID NO: 98436 - DNA, 34 bp, Artificial Sequence
  Description of Artificial Sequence: Synthetic oligonucleotide
atggcttttgcaggacttactgctgatgctagag

SEQ ID NO: 98437 - DNA, 33 bp, Artificial Sequence
  Description of Artificial Sequence: Synthetic oligonucleotide
tggcttttgcaggacttactgctgatgctagag

SEQ ID NO: 98438 - DNA, 32 bp, Artificial Sequence
  Description of Artificial Sequence: Synthetic oligonucleotide
ggcttttgcaggacttactgctgatgctagag

SEQ ID NO: 98439 - DNA, 34 bp, Artificial Sequence
  Description of Artificial Sequence: Synthetic oligonucleotide
gcttttgcaggacttactgctgatgctagagtag

SEQ ID NO: 98440 - DNA, 41 bp, Artificial Sequence
  Description of Artificial Sequence: Synthetic oligonucleotide
cttttgcaggacttactgctgatgctagagtagtaataaac

SEQ ID NO: 98441 - DNA, 42 bp, Artificial Sequence
  Description of Artificial Sequence: Synthetic oligonucleotide
ttttgcaggacttactgctgatgctagagtagtaataaacag

SEQ ID NO: 98442 - DNA, 41 bp, Artificial Sequence
  Description of Artificial Sequence: Synthetic oligonucleotide
tttgcaggacttactgctgatgctagagtagtaataaacag

SEQ ID NO: 98443 - DNA, 40 bp, Artificial Sequence
  Description of Artificial Sequence: Synthetic oligonucleotide
ttgcaggacttactgctgatgctagagtagtaataaacag

SEQ ID NO: 98444 - DNA, 39 bp, Artificial Sequence
  Description of Artificial Sequence: Synthetic oligonucleotide
tgcaggacttactgctgatgctagagtagtaataaacag

SEQ ID NO: 98445 - DNA, 38 bp, Artificial Sequence
  Description of Artificial Sequence: Synthetic oligonucleotide
gcaggacttactgctgatgctagagtagtaataaacag

SEQ ID NO: 98446 - DNA, 39 bp, Artificial Sequence
  Description of Artificial Sequence: Synthetic oligonucleotide
caggacttactgctgatgctagagtagtaataaacagag

SEQ ID NO: 98447 - DNA, 26 bp, Artificial Sequence
  Description of Artificial Sequence: Synthetic oligonucleotide
gatccaccgcggtcggaattcgagga

SEQ ID NO: 98448 - DNA, 27 bp, Artificial Sequence
  Description of Artificial Sequence: Synthetic oligonucleotide
atccaccgcggtcggaattcgaggact

SEQ ID NO: 98449 - DNA, 27 bp, Artificial Sequence
  Description of Artificial Sequence: Synthetic oligonucleotide
tccaccgcggtcggaattcgaggactt

SEQ ID NO: 98450 - DNA, 27 bp, Artificial Sequence
  Description of Artificial Sequence: Synthetic oligonucleotide
ccaccgcggtcggaattcgaggactta

SEQ ID NO: 98451 - DNA, 27 bp, Artificial Sequence
  Description of Artificial Sequence: Synthetic oligonucleotide
caccgcggtcggaattcgaggacttac

SEQ ID NO: 98452 - DNA, 28 bp, Artificial Sequence
  Description of Artificial Sequence: Synthetic oligonucleotide
accgcggtcggaattcgaggacttactg

SEQ ID NO: 98453 - DNA, 27 bp, Artificial Sequence
  Description of Artificial Sequence: Synthetic oligonucleotide
ccgcggtcggaattcgaggacttactg

SEQ ID NO: 98454 - DNA, 27 bp, Artificial Sequence
  Description of Artificial Sequence: Synthetic oligonucleotide
cgcggtcggaattcgaggacttactgc

SEQ ID NO: 98455 - DNA, 28 bp, Artificial Sequence
  Description of Artificial Sequence: Synthetic oligonucleotide
gcggtcggaattcgaggacttactgctg

SEQ ID NO: 98456 - DNA, 30 bp, Artificial Sequence
  Description of Artificial Sequence: Synthetic oligonucleotide
cggtcggaattcgaggacttactgctgatg

SEQ ID NO: 98457 - DNA, 30 bp, Artificial Sequence
  Description of Artificial Sequence: Synthetic oligonucleotide
ggtcggaattcgaggacttactgctgatgc

SEQ ID NO: 98458 - DNA, 32 bp, Artificial Sequence
  Description of Artificial Sequence: Synthetic oligonucleotide
gtcggaattcgaggacttactgctgatgctag

SEQ ID NO: 98459 - DNA, 33 bp, Artificial Sequence
  Description of Artificial Sequence: Synthetic oligonucleotide
tcggaattcgaggacttactgctgatgctagag

SEQ ID NO: 98460 - DNA, 32 bp, Artificial Sequence
  Description of Artificial Sequence: Synthetic oligonucleotide
cggaattcgaggacttactgctgatgctagag

SEQ ID NO: 98461 - DNA, 34 bp, Artificial Sequence
  Description of Artificial Sequence: Synthetic oligonucleotide
ggaattcgaggacttactgctgatgctagagtag

SEQ ID NO: 98462 - DNA, 41 bp, Artificial Sequence
  Description of Artificial Sequence: Synthetic oligonucleotide
gaattcgaggacttactgctgatgctagagtagtaataaac

SEQ ID NO: 98463 - DNA, 42 bp, Artificial Sequence
  Description of Artificial Sequence: Synthetic oligonucleotide
aattcgaggacttactgctgatgctagagtagtaataaacag

SEQ ID NO: 98464 - DNA, 41 bp, Artificial Sequence
  Description of Artificial Sequence: Synthetic oligonucleotide
attcgaggacttactgctgatgctagagtagtaataaacag

SEQ ID NO: 98465 - DNA, 40 bp, Artificial Sequence
  Description of Artificial Sequence: Synthetic oligonucleotide
ttcgaggacttactgctgatgctagagtagtaataaacag

SEQ ID NO: 98466 - DNA, 39 bp, Artificial Sequence
  Description of Artificial Sequence: Synthetic oligonucleotide
tcgaggacttactgctgatgctagagtagtaataaacag

SEQ ID NO: 98467 - DNA, 38 bp, Artificial Sequence
  Description of Artificial Sequence: Synthetic oligonucleotide
cgaggacttactgctgatgctagagtagtaataaacag

SEQ ID NO: 98468 - DNA, 39 bp, Artificial Sequence
  Description of Artificial Sequence: Synthetic oligonucleotide
gaggacttactgctgatgctagagtagtaataaacagag

SEQ ID NO: 98469 - DNA, 27 bp, Artificial Sequence
  Description of Artificial Sequence: Synthetic oligonucleotide
atggcgcttgccagcgtgttggagaga

SEQ ID NO: 98470 - DNA, 26 bp, Artificial Sequence
  Description of Artificial Sequence: Synthetic oligonucleotide
tggcgcttgccagcgtgttggagaga

SEQ ID NO: 98471 - DNA, 25 bp, Artificial Sequence
  Description of Artificial Sequence: Synthetic oligonucleotide
ggcgcttgccagcgtgttggagaga

SEQ ID NO: 98472 - DNA, 25 bp, Artificial Sequence
  Description of Artificial Sequence: Synthetic oligonucleotide
gcgcttgccagcgtgttggagagac

SEQ ID NO: 98473 - DNA, 25 bp, Artificial Sequence
  Description of Artificial Sequence: Synthetic oligonucleotide
cgcttgccagcgtgttggagagacc

SEQ ID NO: 98474 - DNA, 25 bp, Artificial Sequence
  Description of Artificial Sequence: Synthetic oligonucleotide
gcttgccagcgtgttggagagaccg

SEQ ID NO: 98475 - DNA, 27 bp, Artificial Sequence
  Description of Artificial Sequence: Synthetic oligonucleotide
cttgccagcgtgttggagagaccgcta

SEQ ID NO: 98476 - DNA, 27 bp, Artificial Sequence
  Description of Artificial Sequence: Synthetic oligonucleotide
ttgccagcgtgttggagagaccgctac

SEQ ID NO: 98477 - DNA, 26 bp, Artificial Sequence
  Description of Artificial Sequence: Synthetic oligonucleotide
tgccagcgtgttggagagaccgctac

SEQ ID NO: 98478 - DNA, 25 bp, Artificial Sequence
  Description of Artificial Sequence: Synthetic oligonucleotide
gccagcgtgttggagagaccgctac

SEQ ID NO: 98479 - DNA, 25 bp, Artificial Sequence
  Description of Artificial Sequence: Synthetic oligonucleotide
ccagcgtgttggagagaccgctacc

SEQ ID NO: 98480 - DNA, 25 bp, Artificial Sequence
  Description of Artificial Sequence: Synthetic oligonucleotide
cagcgtgttggagagaccgctaccg

SEQ ID NO: 98481 - DNA, 26 bp, Artificial Sequence
  Description of Artificial Sequence: Synthetic oligonucleotide
agcgtgttggagagaccgctaccggt

SEQ ID NO: 98482 - DNA, 25 bp, Artificial Sequence
  Description of Artificial Sequence: Synthetic oligonucleotide
gcgtgttggagagaccgctaccggt

SEQ ID NO: 98483 - DNA, 27 bp, Artificial Sequence
  Description of Artificial Sequence: Synthetic oligonucleotide
cgtgttggagagaccgctaccggtgaa

SEQ ID NO: 98484 - DNA, 27 bp, Artificial Sequence
  Description of Artificial Sequence: Synthetic oligonucleotide
gtgttggagagaccgctaccggtgaac

SEQ ID NO: 98485 - DNA, 27 bp, Artificial Sequence
  Description of Artificial Sequence: Synthetic oligonucleotide
tgttggagagaccgctaccggtgaacc

SEQ ID NO: 98486 - DNA, 27 bp, Artificial Sequence
  Description of Artificial Sequence: Synthetic oligonucleotide
gttggagagaccgctaccggtgaacca

SEQ ID NO: 98487 - DNA, 27 bp, Artificial Sequence
  Description of Artificial Sequence: Synthetic oligonucleotide
ttggagagaccgctaccggtgaaccag

SEQ ID NO: 98488 - DNA, 26 bp, Artificial Sequence
  Description of Artificial Sequence: Synthetic oligonucleotide
tggagagaccgctaccggtgaaccag

SEQ ID NO: 98489 - DNA, 25 bp, Artificial Sequence
  Description of Artificial Sequence: Synthetic oligonucleotide
ggagagaccgctaccggtgaaccag

SEQ ID NO: 98490 - DNA, 25 bp, Artificial Sequence
  Description of Artificial Sequence: Synthetic oligonucleotide
gagagaccgctaccggtgaaccagc

SEQ ID NO: 98491 - DNA, 25 bp, Artificial Sequence
  Description of Artificial Sequence: Synthetic oligonucleotide
agagaccgctaccggtgaaccagcg

SEQ ID NO: 98492 - DNA, 24 bp, Artificial Sequence
  Description of Artificial Sequence: Synthetic oligonucleotide
gagaccgctaccggtgaaccagcg

SEQ ID NO: 98493 - DNA, 24 bp, Artificial Sequence
  Description of Artificial Sequence: Synthetic oligonucleotide
agaccgctaccggtgaaccagcgc

SEQ ID NO: 98494 - DNA, 23 bp, Artificial Sequence
  Description of Artificial Sequence: Synthetic oligonucleotide
gaccgctaccggtgaaccagcgc

SEQ ID NO: 98495 - DNA, 23 bp, Artificial Sequence
  Description of Artificial Sequence: Synthetic oligonucleotide
accgctaccggtgaaccagcgcg

SEQ ID NO: 98496 - DNA, 22 bp, Artificial Sequence
  Description of Artificial Sequence: Synthetic oligonucleotide
ccgctaccggtgaaccagcgcg

SEQ ID NO: 98497 - DNA, 22 bp, Artificial Sequence
  Description of Artificial Sequence: Synthetic oligonucleotide
cgctaccggtgaaccagcgcgg

SEQ ID NO: 98498 - DNA, 27 bp, Artificial Sequence
  Description of Artificial Sequence: Synthetic oligonucleotide
gctaccggtgaaccagcgcgggttttt

SEQ ID NO: 98499 - DNA, 27 bp, Artificial Sequence
  Description of Artificial Sequence: Synthetic oligonucleotide
ctaccggtgaaccagcgcgggtttttc

SEQ ID NO: 98500 - DNA, 27 bp, Artificial Sequence
  Description of Artificial Sequence: Synthetic oligonucleotide
taccggtgaaccagcgcgggtttttcg

SEQ ID NO: 98501 - DNA, 26 bp, Artificial Sequence
  Description of Artificial Sequence: Synthetic oligonucleotide
accggtgaaccagcgcgggtttttcg

SEQ ID NO: 98502 - DNA, 25 bp, Artificial Sequence
  Description of Artificial Sequence: Synthetic oligonucleotide
ccggtgaaccagcgcgggtttttcg

SEQ ID NO: 98503 - DNA, 26 bp, Artificial Sequence
  Description of Artificial Sequence: Synthetic oligonucleotide
cggtgaaccagcgcgggtttttcgga

SEQ ID NO: 98504 - DNA, 27 bp, Artificial Sequence
  Description of Artificial Sequence: Synthetic oligonucleotide
ggtgaaccagcgcgggtttttcggact

SEQ ID NO: 98505 - DNA, 28 bp, Artificial Sequence
  Description of Artificial Sequence: Synthetic oligonucleotide
gtgaaccagcgcgggtttttcggacttg

SEQ ID NO: 98506 - DNA, 28 bp, Artificial Sequence
  Description of Artificial Sequence: Synthetic oligonucleotide
tgaaccagcgcgggtttttcggacttgg

SEQ ID NO: 98507 - DNA, 27 bp, Artificial Sequence
  Description of Artificial Sequence: Synthetic oligonucleotide
gaaccagcgcgggtttttcggacttgg

SEQ ID NO: 98508 - DNA, 27 bp, Artificial Sequence
  Description of Artificial Sequence: Synthetic oligonucleotide
aaccagcgcgggtttttcggacttggg

SEQ ID NO: 98509 - DNA, 26 bp, Artificial Sequence
  Description of Artificial Sequence: Synthetic oligonucleotide
accagcgcgggtttttcggacttggg

SEQ ID NO: 98510 - DNA, 25 bp, Artificial Sequence
  Description of Artificial Sequence: Synthetic oligonucleotide
ccagcgcgggtttttcggacttggg

SEQ ID NO: 98511 - DNA, 25 bp, Artificial Sequence
  Description of Artificial Sequence: Synthetic oligonucleotide
cagcgcgggtttttcggacttgggg

SEQ ID NO: 98512 - DNA, 26 bp, Artificial Sequence
  Description of Artificial Sequence: Synthetic oligonucleotide
agcgcgggtttttcggacttgggggt

SEQ ID NO: 98513 - DNA, 25 bp, Artificial Sequence
  Description of Artificial Sequence: Synthetic oligonucleotide
gcgcgggtttttcggacttgggggt

SEQ ID NO: 98514 - DNA, 25 bp, Artificial Sequence
  Description of Artificial Sequence: Synthetic oligonucleotide
cgcgggtttttcggacttgggggtc

SEQ ID NO: 98515 - DNA, 26 bp, Artificial Sequence
  Description of Artificial Sequence: Synthetic oligonucleotide
gcgggtttttcggacttgggggtcgt

SEQ ID NO: 98516 - DNA, 26 bp, Artificial Sequence
  Description of Artificial Sequence: Synthetic oligonucleotide
cgggtttttcggacttgggggtcgtg

SEQ ID NO: 98517 - DNA, 27 bp, Artificial Sequence
  Description of Artificial Sequence: Synthetic oligonucleotide
gggtttttcggacttgggggtcgtgca

SEQ ID NO: 98518 - DNA, 27 bp, Artificial Sequence
  Description of Artificial Sequence: Synthetic oligonucleotide
ggtttttcggacttgggggtcgtgcag

SEQ ID NO: 98519 - DNA, 29 bp, Artificial Sequence
  Description of Artificial Sequence: Synthetic oligonucleotide
gtttttcggacttgggggtcgtgcagatc

SEQ ID NO: 98520 - DNA, 30 bp, Artificial Sequence
  Description of Artificial Sequence: Synthetic oligonucleotide
tttttcggacttgggggtcgtgcagatctg

SEQ ID NO: 98521 - DNA, 29 bp, Artificial Sequence
  Description of Artificial Sequence: Synthetic oligonucleotide
ttttcggacttgggggtcgtgcagatctg

SEQ ID NO: 98522 - DNA, 28 bp, Artificial Sequence
  Description of Artificial Sequence: Synthetic oligonucleotide
tttcggacttgggggtcgtgcagatctg

SEQ ID NO: 98523 - DNA, 27 bp, Artificial Sequence
  Description of Artificial Sequence: Synthetic oligonucleotide
ttcggacttgggggtcgtgcagatctg

SEQ ID NO: 98524 - DNA, 26 bp, Artificial Sequence
  Description of Artificial Sequence: Synthetic oligonucleotide
tcggacttgggggtcgtgcagatctg

SEQ ID NO: 98525 - DNA, 25 bp, Artificial Sequence
  Description of Artificial Sequence: Synthetic oligonucleotide
cggacttgggggtcgtgcagatctg

SEQ ID NO: 98526 - DNA, 26 bp, Artificial Sequence
  Description of Artificial Sequence: Synthetic oligonucleotide
ggacttgggggtcgtgcagatctgct

SEQ ID NO: 98527 - DNA, 26 bp, Artificial Sequence
  Description of Artificial Sequence: Synthetic oligonucleotide
gacttgggggtcgtgcagatctgctg

SEQ ID NO: 98528 - DNA, 27 bp, Artificial Sequence
  Description of Artificial Sequence: Synthetic oligonucleotide
acttgggggtcgtgcagatctgctgga

SEQ ID NO: 98529 - DNA, 27 bp, Artificial Sequence
  Description of Artificial Sequence: Synthetic oligonucleotide
cttgggggtcgtgcagatctgctggat

SEQ ID NO: 98530 - DNA, 27 bp, Artificial Sequence
  Description of Artificial Sequence: Synthetic oligonucleotide
ttgggggtcgtgcagatctgctggatc

SEQ ID NO: 98531 - DNA, 27 bp, Artificial Sequence
  Description of Artificial Sequence: Synthetic oligonucleotide
tgggggtcgtgcagatctgctggatct

SEQ ID NO: 98532 - DNA, 27 bp, Artificial Sequence
  Description of Artificial Sequence: Synthetic oligonucleotide
gggggtcgtgcagatctgctggatcta

SEQ ID NO: 98533 - DNA, 27 bp, Artificial Sequence
  Description of Artificial Sequence: Synthetic oligonucleotide
ggggtcgtgcagatctgctggatctag

SEQ ID NO: 98534 - DNA, 27 bp, Artificial Sequence
  Description of Artificial Sequence: Synthetic oligonucleotide
gggtcgtgcagatctgctggatctagg

SEQ ID NO: 98535 - DNA, 28 bp, Artificial Sequence
  Description of Artificial Sequence: Synthetic oligonucleotide
ggtcgtgcagatctgctggatctaggtc

SEQ ID NO: 98536 - DNA, 28 bp, Artificial Sequence
  Description of Artificial Sequence: Synthetic oligonucleotide
gtcgtgcagatctgctggatctaggtcc

SEQ ID NO: 98537 - DNA, 29 bp, Artificial Sequence
  Description of Artificial Sequence: Synthetic oligonucleotide
tcgtgcagatctgctggatctaggtccag

SEQ ID NO: 98538 - DNA, 28 bp, Artificial Sequence
  Description of Artificial Sequence: Synthetic oligonucleotide
cgtgcagatctgctggatctaggtccag

SEQ ID NO: 98539 - DNA, 28 bp, Artificial Sequence
  Description of Artificial Sequence: Synthetic oligonucleotide
gtgcagatctgctggatctaggtccagg

SEQ ID NO: 98540 - DNA, 28 bp, Artificial Sequence
  Description of Artificial Sequence: Synthetic oligonucleotide
tgcagatctgctggatctaggtccaggg

SEQ ID NO: 98541 - DNA, 27 bp, Artificial Sequence
  Description of Artificial Sequence: Synthetic oligonucleotide
gcagatctgctggatctaggtccaggg

SEQ ID NO: 98542 - DNA, 28 bp, Artificial Sequence
  Description of Artificial Sequence: Synthetic oligonucleotide
cagatctgctggatctaggtccagggag

SEQ ID NO: 98543 - DNA, 29 bp, Artificial Sequence
  Description of Artificial Sequence: Synthetic oligonucleotide
agatctgctggatctaggtccagggagtc

SEQ ID NO: 98544 - DNA, 28 bp, Artificial Sequence
  Description of Artificial Sequence: Synthetic oligonucleotide
gatctgctggatctaggtccagggagtc

SEQ ID NO: 98545 - DNA, 29 bp, Artificial Sequence
  Description of Artificial Sequence: Synthetic oligonucleotide
atctgctggatctaggtccagggagtctc

SEQ ID NO: 98546 - DNA, 28 bp, Artificial Sequence
  Description of Artificial Sequence: Synthetic oligonucleotide
tctgctggatctaggtccagggagtctc

SEQ ID NO: 98547 - DNA, 27 bp, Artificial Sequence
  Description of Artificial Sequence: Synthetic oligonucleotide
ctgctggatctaggtccagggagtctc

SEQ ID NO: 98548 - DNA, 28 bp, Artificial Sequence
  Description of Artificial Sequence: Synthetic oligonucleotide
tgctggatctaggtccagggagtctcag

SEQ ID NO: 98549 - DNA, 27 bp, Artificial Sequence
  Description of Artificial Sequence: Synthetic oligonucleotide
gctggatctaggtccagggagtctcag

SEQ ID NO: 98550 - DNA, 28 bp, Artificial Sequence
  Description of Artificial Sequence: Synthetic oligonucleotide
ctggatctaggtccagggagtctcagtg

SEQ ID NO: 98551 - DNA, 30 bp, Artificial Sequence
  Description of Artificial Sequence: Synthetic oligonucleotide
tggatctaggtccagggagtctcagtgatg

SEQ ID NO: 98552 - DNA, 29 bp, Artificial Sequence
  Description of Artificial Sequence: Synthetic oligonucleotide
ggatctaggtccagggagtctcagtgatg

SEQ ID NO: 98553 - DNA, 29 bp, Artificial Sequence
  Description of Artificial Sequence: Synthetic oligonucleotide
gatctaggtccagggagtctcagtgatgg

SEQ ID NO: 98554 - DNA, 30 bp, Artificial Sequence
  Description of Artificial Sequence: Synthetic oligonucleotide
atctaggtccagggagtctcagtgatggtc

SEQ ID NO: 98555 - DNA, 29 bp, Artificial Sequence
  Description of Artificial Sequence: Synthetic oligonucleotide
tctaggtccagggagtctcagtgatggtc

SEQ ID NO: 98556 - DNA, 28 bp, Artificial Sequence
  Description of Artificial Sequence: Synthetic oligonucleotide
ctaggtccagggagtctcagtgatggtc

SEQ ID NO: 98557 - DNA, 29 bp, Artificial Sequence
  Description of Artificial Sequence: Synthetic oligonucleotide
taggtccagggagtctcagtgatggtctg

SEQ ID NO: 98558 - DNA, 28 bp, Artificial Sequence
  Description of Artificial Sequence: Synthetic oligonucleotide
aggtccagggagtctcagtgatggtctg

SEQ ID NO: 98559 - DNA, 27 bp, Artificial Sequence
  Description of Artificial Sequence: Synthetic oligonucleotide
ggtccagggagtctcagtgatggtctg

SEQ ID NO: 98560 - DNA, 28 bp, Artificial Sequence
  Description of Artificial Sequence: Synthetic oligonucleotide
gtccagggagtctcagtgatggtctgag

SEQ ID NO: 98561 - DNA, 28 bp, Artificial Sequence
  Description of Artificial Sequence: Synthetic oligonucleotide
tccagggagtctcagtgatggtctgagc

SEQ ID NO: 98562 - DNA, 27 bp, Artificial Sequence
  Description of Artificial Sequence: Synthetic oligonucleotide
ccagggagtctcagtgatggtctgagc

SEQ ID NO: 98563 - DNA, 27 bp, Artificial Sequence
  Description of Artificial Sequence: Synthetic oligonucleotide
cagggagtctcagtgatggtctgagcc

SEQ ID NO: 98564 - DNA, 28 bp, Artificial Sequence
  Description of Artificial Sequence: Synthetic oligonucleotide
agggagtctcagtgatggtctgagcctg

SEQ ID NO: 98565 - DNA, 27 bp, Artificial Sequence
  Description of Artificial Sequence: Synthetic oligonucleotide
gggagtctcagtgatggtctgagcctg

SEQ ID NO: 98566 - DNA, 27 bp, Artificial Sequence
  Description of Artificial Sequence: Synthetic oligonucleotide
ggagtctcagtgatggtctgagcctgg

SEQ ID NO: 98567 - DNA, 27 bp, Artificial Sequence
  Description of Artificial Sequence: Synthetic oligonucleotide
gagtctcagtgatggtctgagcctggc

SEQ ID NO: 98568 - DNA, 27 bp, Artificial Sequence
  Description of Artificial Sequence: Synthetic oligonucleotide
agtctcagtgatggtctgagcctggcc

SEQ ID NO: 98569 - DNA, 26 bp, Artificial Sequence
  Description of Artificial Sequence: Synthetic oligonucleotide
gtctcagtgatggtctgagcctggcc

SEQ ID NO: 98570 - DNA, 26 bp, Artificial Sequence
  Description of Artificial Sequence: Synthetic oligonucleotide
tctcagtgatggtctgagcctggccg

SEQ ID NO: 98571 - DNA, 25 bp, Artificial Sequence
  Description of Artificial Sequence: Synthetic oligonucleotide
ctcagtgatggtctgagcctggccg

SEQ ID NO: 98572 - DNA, 25 bp, Artificial Sequence
  Description of Artificial Sequence: Synthetic oligonucleotide
tcagtgatggtctgagcctggccgc

SEQ ID NO: 98573 - DNA, 24 bp, Artificial Sequence
  Description of Artificial Sequence: Synthetic oligonucleotide
cagtgatggtctgagcctggccgc

SEQ ID NO: 98574 - DNA, 24 bp, Artificial Sequence
  Description of Artificial Sequence: Synthetic oligonucleotide
agtgatggtctgagcctggccgcg

SEQ ID NO: 98575 - DNA, 23 bp, Artificial Sequence
  Description of Artificial Sequence: Synthetic oligonucleotide
gtgatggtctgagcctggccgcg

SEQ ID NO: 98576 - DNA, 23 bp, Artificial Sequence
  Description of Artificial Sequence: Synthetic oligonucleotide
tgatggtctgagcctggccgcgc

SEQ ID NO: 98577 - DNA, 22 bp, Artificial Sequence
  Description of Artificial Sequence: Synthetic oligonucleotide
gatggtctgagcctggccgcgc

SEQ ID NO: 98578 - DNA, 23 bp, Artificial Sequence
  Description of Artificial Sequence: Synthetic oligonucleotide
atggtctgagcctggccgcgcca

SEQ ID NO: 98579 - DNA, 22 bp, Artificial Sequence
  Description of Artificial Sequence: Synthetic oligonucleotide
tggtctgagcctggccgcgcca

SEQ ID NO: 98580 - DNA, 21 bp, Artificial Sequence
  Description of Artificial Sequence: Synthetic oligonucleotide
ggtctgagcctggccgcgcca

SEQ ID NO: 98581 - DNA, 21 bp, Artificial Sequence
  Description of Artificial Sequence: Synthetic oligonucleotide
gtctgagcctggccgcgccag

SEQ ID NO: 98582 - DNA, 21 bp, Artificial Sequence
  Description of Artificial Sequence: Synthetic oligonucleotide
tctgagcctggccgcgccagg

SEQ ID NO: 98583 - DNA, 20 bp, Artificial Sequence
  Description of Artificial Sequence: Synthetic oligonucleotide
ctgagcctggccgcgccagg

SEQ ID NO: 98584 - DNA, 21 bp, Artificial Sequence
  Description of Artificial Sequence: Synthetic oligonucleotide
tgagcctggccgcgccaggct

SEQ ID NO: 98585 - DNA, 20 bp, Artificial Sequence
  Description of Artificial Sequence: Synthetic oligonucleotide
gagcctggccgcgccaggct

SEQ ID NO: 98586 - DNA, 20 bp, Artificial Sequence
  Description of Artificial Sequence: Synthetic oligonucleotide
agcctggccgcgccaggctg

SEQ ID NO: 98587 - DNA, 20 bp, Artificial Sequence
  Description of Artificial Sequence: Synthetic oligonucleotide
gcctggccgcgccaggctgt

SEQ ID NO: 98588 - DNA, 20 bp, Artificial Sequence
  Description of Artificial Sequence: Synthetic oligonucleotide
cctggccgcgccaggctggt

SEQ ID NO: 98589 - DNA, 20 bp, Artificial Sequence
  Description of Artificial Sequence: Synthetic oligonucleotide
ctggccgcgccaggctgggt

SEQ ID NO: 98590 - DNA, 20 bp, Artificial Sequence
  Description of Artificial Sequence: Synthetic oligonucleotide
tggccgcgccaggctggggt

SEQ ID NO: 98591 - DNA, 20 bp, Artificial Sequence
  Description of Artificial Sequence: Synthetic oligonucleotide
ggccgcgccaggctggggtt

SEQ ID NO: 98592 - DNA, 20 bp, Artificial Sequence
  Description of Artificial Sequence: Synthetic oligonucleotide
gccgcgccaggctggggtgt

SEQ ID NO: 98593 - DNA, 20 bp, Artificial Sequence
  Description of Artificial Sequence: Synthetic oligonucleotide
ccgcgccaggctggggtgtc

SEQ ID NO: 98594 - DNA, 20 bp, Artificial Sequence
  Description of Artificial Sequence: Synthetic oligonucleotide
cgcgccaggctggggtgtcc

SEQ ID NO: 98595 - DNA, 21 bp, Artificial Sequence
  Description of Artificial Sequence: Synthetic oligonucleotide
gcgccaggctggggtgtccca

SEQ ID NO: 98596 - DNA, 23 bp, Artificial Sequence
  Description of Artificial Sequence: Synthetic oligonucleotide
cgccaggctggggtgtcccagaa

SEQ ID NO: 98597 - DNA, 24 bp, Artificial Sequence
  Description of Artificial Sequence: Synthetic oligonucleotide
gccaggctggggtgtcccagaaga

SEQ ID NO: 98598 - DNA, 24 bp, Artificial Sequence
  Description of Artificial Sequence: Synthetic oligonucleotide
ccaggctggggtgtcccagaagag

SEQ ID NO: 98599 - DNA, 24 bp, Artificial Sequence
  Description of Artificial Sequence: Synthetic oligonucleotide
caggctggggtgtcccagaagagc

SEQ ID NO: 98600 - DNA, 25 bp, Artificial Sequence
  Description of Artificial Sequence: Synthetic oligonucleotide
aggctggggtgtcccagaagagcca

SEQ ID NO: 98601 - DNA, 24 bp, Artificial Sequence
  Description of Artificial Sequence: Synthetic oligonucleotide
ggctggggtgtcccagaagagcca

SEQ ID NO: 98602 - DNA, 24 bp, Artificial Sequence
  Description of Artificial Sequence: Synthetic oligonucleotide
gctggggtgtcccagaagagccag

SEQ ID NO: 98603 - DNA, 27 bp, Artificial Sequence
  Description of Artificial Sequence: Synthetic oligonucleotide
ctggggtgtcccagaagagccaggaat

SEQ ID NO: 98604 - DNA, 27 bp, Artificial Sequence
  Description of Artificial Sequence: Synthetic oligonucleotide
tggggtgtcccagaagagccaggaatc

SEQ ID NO: 98605 - DNA, 26 bp, Artificial Sequence
  Description of Artificial Sequence: Synthetic oligonucleotide
ggggtgtcccagaagagccaggaatc

SEQ ID NO: 98606 - DNA, 27 bp, Artificial Sequence
  Description of Artificial Sequence: Synthetic oligonucleotide
gggtgtcccagaagagccaggaatcga

SEQ ID NO: 98607 - DNA, 30 bp, Artificial Sequence
  Description of Artificial Sequence: Synthetic oligonucleotide
ggtgtcccagaagagccaggaatcgaaatg

SEQ ID NO: 98608 - DNA, 30 bp, Artificial Sequence
  Description of Artificial Sequence: Synthetic oligonucleotide
gtgtcccagaagagccaggaatcgaaatgc

SEQ ID NO: 98609 - DNA, 32 bp, Artificial Sequence
  Description of Artificial Sequence: Synthetic oligonucleotide
tgtcccagaagagccaggaatcgaaatgcttc

SEQ ID NO: 98610 - DNA, 31 bp, Artificial Sequence
  Description of Artificial Sequence: Synthetic oligonucleotide
gtcccagaagagccaggaatcgaaatgcttc

SEQ ID NO: 98611 - DNA, 33 bp, Artificial Sequence
  Description of Artificial Sequence: Synthetic oligonucleotide
tcccagaagagccaggaatcgaaatgcttcatg

SEQ ID NO: 98612 - DNA, 32 bp, Artificial Sequence
  Description of Artificial Sequence: Synthetic oligonucleotide
cccagaagagccaggaatcgaaatgcttcatg

SEQ ID NO: 98613 - DNA, 32 bp, Artificial Sequence
  Description of Artificial Sequence: Synthetic oligonucleotide
ccagaagagccaggaatcgaaatgcttcatgg

SEQ ID NO: 98614 - DNA, 34 bp, Artificial Sequence
  Description of Artificial Sequence: Synthetic oligonucleotide
cagaagagccaggaatcgaaatgcttcatggaac

SEQ ID NO: 98615 - DNA, 36 bp, Artificial Sequence
  Description of Artificial Sequence: Synthetic oligonucleotide
agaagagccaggaatcgaaatgcttcatggaacaac

SEQ ID NO: 98616 - DNA, 35 bp, Artificial Sequence
  Description of Artificial Sequence: Synthetic oligonucleotide
gaagagccaggaatcgaaatgcttcatggaacaac

SEQ ID NO: 98617 - DNA, 35 bp, Artificial Sequence
  Description of Artificial Sequence: Synthetic oligonucleotide
aagagccaggaatcgaaatgcttcatggaacaacc

SEQ ID NO: 98618 - DNA, 34 bp, Artificial Sequence
  Description of Artificial Sequence: Synthetic oligonucleotide
agagccaggaatcgaaatgcttcatggaacaacc

SEQ ID NO: 98619 - DNA, 33 bp, Artificial Sequence
  Description of Artificial Sequence: Synthetic oligonucleotide
gagccaggaatcgaaatgcttcatggaacaacc

SEQ ID NO: 98620 - DNA, 34 bp, Artificial Sequence
  Description of Artificial Sequence: Synthetic oligonucleotide
agccaggaatcgaaatgcttcatggaacaaccac

SEQ ID NO: 98621 - DNA, 33 bp, Artificial Sequence
  Description of Artificial Sequence: Synthetic oligonucleotide
gccaggaatcgaaatgcttcatggaacaaccac

SEQ ID NO: 98622 - DNA, 33 bp, Artificial Sequence
  Description of Artificial Sequence: Synthetic oligonucleotide
ccaggaatcgaaatgcttcatggaacaaccacc

SEQ ID NO: 98623 - DNA, 33 bp, Artificial Sequence
  Description of Artificial Sequence: Synthetic oligonucleotide
caggaatcgaaatgcttcatggaacaaccaccc

SEQ ID NO: 98624 - DNA, 34 bp, Artificial Sequence
  Description of Artificial Sequence: Synthetic oligonucleotide
aggaatcgaaatgcttcatggaacaaccaccctg

SEQ ID NO: 98625 - DNA, 33 bp, Artificial Sequence
  Description of Artificial Sequence: Synthetic oligonucleotide
ggaatcgaaatgcttcatggaacaaccaccctg

SEQ ID NO: 98626 - DNA, 33 bp, Artificial Sequence
  Description of Artificial Sequence: Synthetic oligonucleotide
gaatcgaaatgcttcatggaacaaccaccctgg

SEQ ID NO: 98627 - DNA, 33 bp, Artificial Sequence
  Description of Artificial Sequence: Synthetic oligonucleotide
aatcgaaatgcttcatggaacaaccaccctggc

SEQ ID NO: 98628 - DNA, 32 bp, Artificial Sequence
  Description of Artificial Sequence: Synthetic oligonucleotide
atcgaaatgcttcatggaacaaccaccctggc

SEQ ID NO: 98629 - DNA, 31 bp, Artificial Sequence
  Description of Artificial Sequence: Synthetic oligonucleotide
tcgaaatgcttcatggaacaaccaccctggc

SEQ ID NO: 98630 - DNA, 30 bp, Artificial Sequence
  Description of Artificial Sequence: Synthetic oligonucleotide
cgaaatgcttcatggaacaaccaccctggc

SEQ ID NO: 98631 - DNA, 30 bp, Artificial Sequence
  Description of Artificial Sequence: Synthetic oligonucleotide
gaaatgcttcatggaacaaccaccctggcc

SEQ ID NO: 98632 - DNA, 32 bp, Artificial Sequence
  Description of Artificial Sequence: Synthetic oligonucleotide
aaatgcttcatggaacaaccaccctggccttc

SEQ ID NO: 98633 - DNA, 31 bp, Artificial Sequence
  Description of Artificial Sequence: Synthetic oligonucleotide
aatgcttcatggaacaaccaccctggccttc

SEQ ID NO: 98634 - DNA, 30 bp, Artificial Sequence
  Description of Artificial Sequence: Synthetic oligonucleotide
atgcttcatggaacaaccaccctggccttc

SEQ ID NO: 98635 - DNA, 29 bp, Artificial Sequence
  Description of Artificial Sequence: Synthetic oligonucleotide
tgcttcatggaacaaccaccctggccttc

SEQ ID NO: 98636 - DNA, 28 bp, Artificial Sequence
  Description of Artificial Sequence: Synthetic oligonucleotide
gcttcatggaacaaccaccctggccttc

SEQ ID NO: 98637 - DNA, 30 bp, Artificial Sequence
  Description of Artificial Sequence: Synthetic oligonucleotide
cttcatggaacaaccaccctggccttcaag

SEQ ID NO: 98638 - DNA, 32 bp, Artificial Sequence
  Description of Artificial Sequence: Synthetic oligonucleotide
ttcatggaacaaccaccctggccttcaagttc

SEQ ID NO: 98639 - DNA, 31 bp, Artificial Sequence
  Description of Artificial Sequence: Synthetic oligonucleotide
tcatggaacaaccaccctggccttcaagttc

SEQ ID NO: 98640 - DNA, 30 bp, Artificial Sequence
  Description of Artificial Sequence: Synthetic oligonucleotide
catggaacaaccaccctggccttcaagttc

SEQ ID NO: 98641 - DNA, 30 bp, Artificial Sequence
  Description of Artificial Sequence: Synthetic oligonucleotide
atggaacaaccaccctggccttcaagttcc

SEQ ID NO: 98642 - DNA, 29 bp, Artificial Sequence
  Description of Artificial Sequence: Synthetic oligonucleotide
tggaacaaccaccctggccttcaagttcc

SEQ ID NO: 98643 - DNA, 28 bp, Artificial Sequence
  Description of Artificial Sequence: Synthetic oligonucleotide
ggaacaaccaccctggccttcaagttcc

SEQ ID NO: 98644 - DNA, 28 bp, Artificial Sequence
  Description of Artificial Sequence: Synthetic oligonucleotide
gaacaaccaccctggccttcaagttccg

SEQ ID NO: 98645 - DNA, 28 bp, Artificial Sequence
  Description of Artificial Sequence: Synthetic oligonucleotide
aacaaccaccctggccttcaagttccgc

SEQ ID NO: 98646 - DNA, 27 bp, Artificial Sequence
  Description of Artificial Sequence: Synthetic oligonucleotide
acaaccaccctggccttcaagttccgc

SEQ ID NO: 98647 - DNA, 26 bp, Artificial Sequence
  Description of Artificial Sequence: Synthetic oligonucleotide
caaccaccctggccttcaagttccgc

SEQ ID NO: 98648 - DNA, 27 bp, Artificial Sequence
  Description of Artificial Sequence: Synthetic oligonucleotide
aaccaccctggccttcaagttccgcca

SEQ ID NO: 98649 - DNA, 27 bp, Artificial Sequence
  Description of Artificial Sequence: Synthetic oligonucleotide
accaccctggccttcaagttccgccat

SEQ ID NO: 98650 - DNA, 26 bp, Artificial Sequence
  Description of Artificial Sequence: Synthetic oligonucleotide
ccaccctggccttcaagttccgccat

SEQ ID NO: 98651 - DNA, 26 bp, Artificial Sequence
  Description of Artificial Sequence: Synthetic oligonucleotide
caccctggccttcaagttccgccatg

SEQ ID NO: 98652 - DNA, 27 bp, Artificial Sequence
  Description of Artificial Sequence: Synthetic oligonucleotide
accctggccttcaagttccgccatgga

SEQ ID NO: 98653 - DNA, 26 bp, Artificial Sequence
  Description of Artificial Sequence: Synthetic oligonucleotide
ccctggccttcaagttccgccatgga

SEQ ID NO: 98654 - DNA, 27 bp, Artificial Sequence
  Description of Artificial Sequence: Synthetic oligonucleotide
cctggccttcaagttccgccatggagt

SEQ ID NO: 98655 - DNA, 27 bp, Artificial Sequence
  Description of Artificial Sequence: Synthetic oligonucleotide
ctggccttcaagttccgccatggagtc

SEQ ID NO: 98656 - DNA, 30 bp, Artificial Sequence
  Description of Artificial Sequence: Synthetic oligonucleotide
tggccttcaagttccgccatggagtcatag

SEQ ID NO: 98657 - DNA, 29 bp, Artificial Sequence
  Description of Artificial Sequence: Synthetic oligonucleotide
ggccttcaagttccgccatggagtcatag

SEQ ID NO: 98658 - DNA, 31 bp, Artificial Sequence
  Description of Artificial Sequence: Synthetic oligonucleotide
gccttcaagttccgccatggagtcatagttg

SEQ ID NO: 98659 - DNA, 31 bp, Artificial Sequence
  Description of Artificial Sequence: Synthetic oligonucleotide
ccttcaagttccgccatggagtcatagttgc

SEQ ID NO: 98660 - DNA, 32 bp, Artificial Sequence
  Description of Artificial Sequence: Synthetic oligonucleotide
cttcaagttccgccatggagtcatagttgcag

SEQ ID NO: 98661 - DNA, 32 bp, Artificial Sequence
  Description of Artificial Sequence: Synthetic oligonucleotide
ttcaagttccgccatggagtcatagttgcagc

SEQ ID NO: 98662 - DNA, 31 bp, Artificial Sequence
  Description of Artificial Sequence: Synthetic oligonucleotide
tcaagttccgccatggagtcatagttgcagc

SEQ ID NO: 98663 - DNA, 30 bp, Artificial Sequence
  Description of Artificial Sequence: Synthetic oligonucleotide
caagttccgccatggagtcatagttgcagc

SEQ ID NO: 98664 - DNA, 31 bp, Artificial Sequence
  Description of Artificial Sequence: Synthetic oligonucleotide
aagttccgccatggagtcatagttgcagctg

SEQ ID NO: 98665 - DNA, 30 bp, Artificial Sequence
  Description of Artificial Sequence: Synthetic oligonucleotide
agttccgccatggagtcatagttgcagctg

SEQ ID NO: 98666 - DNA, 29 bp, Artificial Sequence
  Description of Artificial Sequence: Synthetic oligonucleotide
gttccgccatggagtcatagttgcagctg

SEQ ID NO: 98667 - DNA, 30 bp, Artificial Sequence
  Description of Artificial Sequence: Synthetic oligonucleotide
ttccgccatggagtcatagttgcagctgac

SEQ ID NO: 98668 - DNA, 29 bp, Artificial Sequence
  Description of Artificial Sequence: Synthetic oligonucleotide
tccgccatggagtcatagttgcagctgac

SEQ ID NO: 98669 - DNA, 28 bp, Artificial Sequence
  Description of Artificial Sequence: Synthetic oligonucleotide
ccgccatggagtcatagttgcagctgac

SEQ ID NO: 98670 - DNA, 29 bp, Artificial Sequence
  Description of Artificial Sequence: Synthetic oligonucleotide
cgccatggagtcatagttgcagctgactc

SEQ ID NO: 98671 - DNA, 29 bp, Artificial Sequence
  Description of Artificial Sequence: Synthetic oligonucleotide
gccatggagtcatagttgcagctgactcc

SEQ ID NO: 98672 - DNA, 30 bp, Artificial Sequence
  Description of Artificial Sequence: Synthetic oligonucleotide
ccatggagtcatagttgcagctgactccag

SEQ ID NO: 98673 - DNA, 30 bp, Artificial Sequence
  Description of Artificial Sequence: Synthetic oligonucleotide
catggagtcatagttgcagctgactccagg

SEQ ID NO: 98674 - DNA, 30 bp, Artificial Sequence
  Description of Artificial Sequence: Synthetic oligonucleotide
atggagtcatagttgcagctgactccaggg

SEQ ID NO: 98675 - DNA, 29 bp, Artificial Sequence
  Description of Artificial Sequence: Synthetic oligonucleotide
tggagtcatagttgcagctgactccaggg

SEQ ID NO: 98676 - DNA, 28 bp, Artificial Sequence
  Description of Artificial Sequence: Synthetic oligonucleotide
ggagtcatagttgcagctgactccaggg

SEQ ID NO: 98677 - DNA, 28 bp, Artificial Sequence
  Description of Artificial Sequence: Synthetic oligonucleotide
gagtcatagttgcagctgactccagggc

SEQ ID NO: 98678 - DNA, 30 bp, Artificial Sequence
  Description of Artificial Sequence: Synthetic oligonucleotide
agtcatagttgcagctgactccagggctac

SEQ ID NO: 98679 - DNA, 29 bp, Artificial Sequence
  Description of Artificial Sequence: Synthetic oligonucleotide
gtcatagttgcagctgactccagggctac

SEQ ID NO: 98680 - DNA, 30 bp, Artificial Sequence
  Description of Artificial Sequence: Synthetic oligonucleotide
tcatagttgcagctgactccagggctacag

SEQ ID NO: 98681 - DNA, 29 bp, Artificial Sequence
  Description of Artificial Sequence: Synthetic oligonucleotide
catagttgcagctgactccagggctacag

SEQ ID NO: 98682 - DNA, 29 bp, Artificial Sequence
  Description of Artificial Sequence: Synthetic oligonucleotide
atagttgcagctgactccagggctacagc

SEQ ID NO: 98683 - DNA, 28 bp, Artificial Sequence
  Description of Artificial Sequence: Synthetic oligonucleotide
tagttgcagctgactccagggctacagc

SEQ ID NO: 98684 - DNA, 27 bp, Artificial Sequence
  Description of Artificial Sequence: Synthetic oligonucleotide
agttgcagctgactccagggctacagc

SEQ ID NO: 98685 - DNA, 26 bp, Artificial Sequence
  Description of Artificial Sequence: Synthetic oligonucleotide
gttgcagctgactccagggctacagc

SEQ ID NO: 98686 - DNA, 26 bp, Artificial Sequence
  Description of Artificial Sequence: Synthetic oligonucleotide
ttgcagctgactccagggctacagcg

SEQ ID NO: 98687 - DNA, 25 bp, Artificial Sequence
  Description of Artificial Sequence: Synthetic oligonucleotide
tgcagctgactccagggctacagcg

SEQ ID NO: 98688 - DNA, 24 bp, Artificial Sequence
  Description of Artificial Sequence: Synthetic oligonucleotide
gcagctgactccagggctacagcg

SEQ ID NO: 98689 - DNA, 24 bp, Artificial Sequence
  Description of Artificial Sequence: Synthetic oligonucleotide
cagctgactccagggctacagcgg

SEQ ID NO: 98690 - DNA, 25 bp, Artificial Sequence
  Description of Artificial Sequence: Synthetic oligonucleotide
agctgactccagggctacagcgggt

SEQ ID NO: 98691 - DNA, 24 bp, Artificial Sequence
  Description of Artificial Sequence: Synthetic oligonucleotide
gctgactccagggctacagcgggt

SEQ ID NO: 98692 - DNA, 24 bp, Artificial Sequence
  Description of Artificial Sequence: Synthetic oligonucleotide
ctgactccagggctacagcgggtg

SEQ ID NO: 98693 - DNA, 27 bp, Artificial Sequence
  Description of Artificial Sequence: Synthetic oligonucleotide
tgactccagggctacagcgggtgctta

SEQ ID NO: 98694 - DNA, 26 bp, Artificial Sequence
  Description of Artificial Sequence: Synthetic oligonucleotide
gactccagggctacagcgggtgctta

SEQ ID NO: 98695 - DNA, 27 bp, Artificial Sequence
  Description of Artificial Sequence: Synthetic oligonucleotide
actccagggctacagcgggtgcttaca

SEQ ID NO: 98696 - DNA, 27 bp, Artificial Sequence
  Description of Artificial Sequence: Synthetic oligonucleotide
ctccagggctacagcgggtgcttacat

SEQ ID NO: 98697 - DNA, 28 bp, Artificial Sequence
  Description of Artificial Sequence: Synthetic oligonucleotide
tccagggctacagcgggtgcttacattg

SEQ ID NO: 98698 - DNA, 27 bp, Artificial Sequence
  Description of Artificial Sequence: Synthetic oligonucleotide
ccagggctacagcgggtgcttacattg

SEQ ID NO: 98699 - DNA, 27 bp, Artificial Sequence
  Description of Artificial Sequence: Synthetic oligonucleotide
cagggctacagcgggtgcttacattgc

SEQ ID NO: 98700 - DNA, 27 bp, Artificial Sequence
  Description of Artificial Sequence: Synthetic oligonucleotide
agggctacagcgggtgcttacattgcc

SEQ ID NO: 98701 - DNA, 27 bp, Artificial Sequence
  Description of Artificial Sequence: Synthetic oligonucleotide
gggctacagcgggtgcttacattgcct

SEQ ID NO: 98702 - DNA, 27 bp, Artificial Sequence
  Description of Artificial Sequence: Synthetic oligonucleotide
ggctacagcgggtgcttacattgcctc

SEQ ID NO: 98703 - DNA, 27 bp, Artificial Sequence
  Description of Artificial Sequence: Synthetic oligonucleotide
gctacagcgggtgcttacattgcctcc

SEQ ID NO: 98704 - DNA, 27 bp, Artificial Sequence
  Description of Artificial Sequence: Synthetic oligonucleotide
ctacagcgggtgcttacattgcctccc

SEQ ID NO: 98705 - DNA, 28 bp, Artificial Sequence
  Description of Artificial Sequence: Synthetic oligonucleotide
tacagcgggtgcttacattgcctcccag

SEQ ID NO: 98706 - DNA, 27 bp, Artificial Sequence
  Description of Artificial Sequence: Synthetic oligonucleotide
acagcgggtgcttacattgcctcccag

SEQ ID NO: 98707 - DNA, 27 bp, Artificial Sequence
  Description of Artificial Sequence: Synthetic oligonucleotide
cagcgggtgcttacattgcctcccaga

SEQ ID NO: 98708 - DNA, 27 bp, Artificial Sequence
  Description of Artificial Sequence: Synthetic oligonucleotide
agcgggtgcttacattgcctcccagac

SEQ ID NO: 98709 - DNA, 26 bp, Artificial Sequence
  Description of Artificial Sequence: Synthetic oligonucleotide
gcgggtgcttacattgcctcccagac

SEQ ID NO: 98710 - DNA, 26 bp, Artificial Sequence
  Description of Artificial Sequence: Synthetic oligonucleotide
cgggtgcttacattgcctcccagacg

SEQ ID NO: 98711 - DNA, 27 bp, Artificial Sequence
  Description of Artificial Sequence: Synthetic oligonucleotide
gggtgcttacattgcctcccagacggt

SEQ ID NO: 98712 - DNA, 27 bp, Artificial Sequence
  Description of Artificial Sequence: Synthetic oligonucleotide
ggtgcttacattgcctcccagacggtg

SEQ ID NO: 98713 - DNA, 29 bp, Artificial Sequence
  Description of Artificial Sequence: Synthetic oligonucleotide
gtgcttacattgcctcccagacggtgaag

SEQ ID NO: 98714 - DNA, 31 bp, Artificial Sequence
  Description of Artificial Sequence: Synthetic oligonucleotide
tgcttacattgcctcccagacggtgaagaag

SEQ ID NO: 98715 - DNA, 30 bp, Artificial Sequence
  Description of Artificial Sequence: Synthetic oligonucleotide
gcttacattgcctcccagacggtgaagaag

SEQ ID NO: 98716 - DNA, 30 bp, Artificial Sequence
  Description of Artificial Sequence: Synthetic oligonucleotide
cttacattgcctcccagacggtgaagaagg

SEQ ID NO: 98717 - DNA, 31 bp, Artificial Sequence
  Description of Artificial Sequence: Synthetic oligonucleotide
ttacattgcctcccagacggtgaagaaggtg

SEQ ID NO: 98718 - DNA, 30 bp, Artificial Sequence
  Description of Artificial Sequence: Synthetic oligonucleotide
tacattgcctcccagacggtgaagaaggtg

SEQ ID NO: 98719 - DNA, 29 bp, Artificial Sequence
  Description of Artificial Sequence: Synthetic oligonucleotide
acattgcctcccagacggtgaagaaggtg

SEQ ID NO: 98720 - DNA, 28 bp, Artificial Sequence
  Description of Artificial Sequence: Synthetic oligonucleotide
cattgcctcccagacggtgaagaaggtg

SEQ ID NO: 98721 - DNA, 31 bp, Artificial Sequence
  Description of Artificial Sequence: Synthetic oligonucleotide
attgcctcccagacggtgaagaaggtgatag

SEQ ID NO: 98722 - DNA, 30 bp, Artificial Sequence
  Description of Artificial Sequence: Synthetic oligonucleotide
ttgcctcccagacggtgaagaaggtgatag

SEQ ID NO: 98723 - DNA, 29 bp, Artificial Sequence
  Description of Artificial Sequence: Synthetic oligonucleotide
tgcctcccagacggtgaagaaggtgatag

SEQ ID NO: 98724 - DNA, 28 bp, Artificial Sequence
  Description of Artificial Sequence: Synthetic oligonucleotide
gcctcccagacggtgaagaaggtgatag

SEQ ID NO: 98725 - DNA, 29 bp, Artificial Sequence
  Description of Artificial Sequence: Synthetic oligonucleotide
cctcccagacggtgaagaaggtgatagag

SEQ ID NO: 98726 - DNA, 31 bp, Artificial Sequence
  Description of Artificial Sequence: Synthetic oligonucleotide
ctcccagacggtgaagaaggtgatagagatc

SEQ ID NO: 98727 - DNA, 33 bp, Artificial Sequence
  Description of Artificial Sequence: Synthetic oligonucleotide
tcccagacggtgaagaaggtgatagagatcaac

SEQ ID NO: 98728 - DNA, 32 bp, Artificial Sequence
  Description of Artificial Sequence: Synthetic oligonucleotide
cccagacggtgaagaaggtgatagagatcaac

SEQ ID NO: 98729 - DNA, 32 bp, Artificial Sequence
  Description of Artificial Sequence: Synthetic oligonucleotide
ccagacggtgaagaaggtgatagagatcaacc

SEQ ID NO: 98730 - DNA, 32 bp, Artificial Sequence
  Description of Artificial Sequence: Synthetic oligonucleotide
cagacggtgaagaaggtgatagagatcaaccc

SEQ ID NO: 98731 - DNA, 35 bp, Artificial Sequence
  Description of Artificial Sequence: Synthetic oligonucleotide
agacggtgaagaaggtgatagagatcaacccatac

SEQ ID NO: 98732 - DNA, 34 bp, Artificial Sequence
  Description of Artificial Sequence: Synthetic oligonucleotide
gacggtgaagaaggtgatagagatcaacccatac

SEQ ID NO: 98733 - DNA, 34 bp, Artificial Sequence
  Description of Artificial Sequence: Synthetic oligonucleotide
acggtgaagaaggtgatagagatcaacccatacc

SEQ ID NO: 98734 - DNA, 33 bp, Artificial Sequence
  Description of Artificial Sequence: Synthetic oligonucleotide
cggtgaagaaggtgatagagatcaacccatacc

SEQ ID NO: 98735 - DNA, 34 bp, Artificial Sequence
  Description of Artificial Sequence: Synthetic oligonucleotide
ggtgaagaaggtgatagagatcaacccatacctg

SEQ ID NO: 98736 - DNA, 34 bp, Artificial Sequence
  Description of Artificial Sequence: Synthetic oligonucleotide
gtgaagaaggtgatagagatcaacccatacctgc

SEQ ID NO: 98737 - DNA, 36 bp, Artificial Sequence
  Description of Artificial Sequence: Synthetic oligonucleotide
tgaagaaggtgatagagatcaacccatacctgctag

SEQ ID NO: 98738 - DNA, 35 bp, Artificial Sequence
  Description of Artificial Sequence: Synthetic oligonucleotide
gaagaaggtgatagagatcaacccatacctgctag

SEQ ID NO: 98739 - DNA, 35 bp, Artificial Sequence
  Description of Artificial Sequence: Synthetic oligonucleotide
aagaaggtgatagagatcaacccatacctgctagg

SEQ ID NO: 98740 - DNA, 34 bp, Artificial Sequence
  Description of Artificial Sequence: Synthetic oligonucleotide
agaaggtgatagagatcaacccatacctgctagg

SEQ ID NO: 98741 - DNA, 33 bp, Artificial Sequence
  Description of Artificial Sequence: Synthetic oligonucleotide
gaaggtgatagagatcaacccatacctgctagg

SEQ ID NO: 98742 - DNA, 33 bp, Artificial Sequence
  Description of Artificial Sequence: Synthetic oligonucleotide
aaggtgatagagatcaacccatacctgctaggc

SEQ ID NO: 98743 - DNA, 32 bp, Artificial Sequence
  Description of Artificial Sequence: Synthetic oligonucleotide
aggtgatagagatcaacccatacctgctaggc

SEQ ID NO: 98744 - DNA, 31 bp, Artificial Sequence
  Description of Artificial Sequence: Synthetic oligonucleotide
ggtgatagagatcaacccatacctgctaggc

SEQ ID NO: 98745 - DNA, 32 bp, Artificial Sequence
  Description of Artificial Sequence: Synthetic oligonucleotide
gtgatagagatcaacccatacctgctaggcac

SEQ ID NO: 98746 - DNA, 32 bp, Artificial Sequence
  Description of Artificial Sequence: Synthetic oligonucleotide
tgatagagatcaacccatacctgctaggcacc

SEQ ID NO: 98747 - DNA, 31 bp, Artificial Sequence
  Description of Artificial Sequence: Synthetic oligonucleotide
gatagagatcaacccatacctgctaggcacc

SEQ ID NO: 98748 - DNA, 33 bp, Artificial Sequence
  Description of Artificial Sequence: Synthetic oligonucleotide
atagagatcaacccatacctgctaggcaccatg

SEQ ID NO: 98749 - DNA, 32 bp, Artificial Sequence
  Description of Artificial Sequence: Synthetic oligonucleotide
tagagatcaacccatacctgctaggcaccatg

SEQ ID NO: 98750 - DNA, 31 bp, Artificial Sequence
  Description of Artificial Sequence: Synthetic oligonucleotide
agagatcaacccatacctgctaggcaccatg

SEQ ID NO: 98751 - DNA, 30 bp, Artificial Sequence
  Description of Artificial Sequence: Synthetic oligonucleotide
gagatcaacccatacctgctaggcaccatg

SEQ ID NO: 98752 - DNA, 30 bp, Artificial Sequence
  Description of Artificial Sequence: Synthetic oligonucleotide
agatcaacccatacctgctaggcaccatgg

SEQ ID NO: 98753 - DNA, 29 bp, Artificial Sequence
  Description of Artificial Sequence: Synthetic oligonucleotide
gatcaacccatacctgctaggcaccatgg

SEQ ID NO: 98754 - DNA, 29 bp, Artificial Sequence
  Description of Artificial Sequence: Synthetic oligonucleotide
atcaacccatacctgctaggcaccatggc

SEQ ID NO: 98755 - DNA, 28 bp, Artificial Sequence
  Description of Artificial Sequence: Synthetic oligonucleotide
tcaacccatacctgctaggcaccatggc

SEQ ID NO: 98756 - DNA, 27 bp, Artificial Sequence
  Description of Artificial Sequence: Synthetic oligonucleotide
caacccatacctgctaggcaccatggc

SEQ ID NO: 98757 - DNA, 28 bp, Artificial Sequence
  Description of Artificial Sequence: Synthetic oligonucleotide
aacccatacctgctaggcaccatggctg

SEQ ID NO: 98758 - DNA, 27 bp, Artificial Sequence
  Description of Artificial Sequence: Synthetic oligonucleotide
acccatacctgctaggcaccatggctg

SEQ ID NO: 98759 - DNA, 26 bp, Artificial Sequence
  Description of Artificial Sequence: Synthetic oligonucleotide
cccatacctgctaggcaccatggctg

SEQ ID NO: 98760 - DNA, 26 bp, Artificial Sequence
  Description of Artificial Sequence: Synthetic oligonucleotide
ccatacctgctaggcaccatggctgg

SEQ ID NO: 98761 - DNA, 26 bp, Artificial Sequence
  Description of Artificial Sequence: Synthetic oligonucleotide
catacctgctaggcaccatggctggg

SEQ ID NO: 98762 - DNA, 26 bp, Artificial Sequence
  Description of Artificial Sequence: Synthetic oligonucleotide
atacctgctaggcaccatggctgggg

SEQ ID NO: 98763 - DNA, 25 bp, Artificial Sequence
  Description of Artificial Sequence: Synthetic oligonucleotide
tacctgctaggcaccatggctgggg

SEQ ID NO: 98764 - DNA, 24 bp, Artificial Sequence
  Description of Artificial Sequence: Synthetic oligonucleotide
acctgctaggcaccatggctgggg

SEQ ID NO: 98765 - DNA, 23 bp, Artificial Sequence
  Description of Artificial Sequence: Synthetic oligonucleotide
cctgctaggcaccatggctgggg

SEQ ID NO: 98766 - DNA, 23 bp, Artificial Sequence
  Description of Artificial Sequence: Synthetic oligonucleotide
ctgctaggcaccatggctggggg

SEQ ID NO: 98767 - DNA, 23 bp, Artificial Sequence
  Description of Artificial Sequence: Synthetic oligonucleotide
tgctaggcaccatggctgggggc

SEQ ID NO: 98768 - DNA, 22 bp, Artificial Sequence
  Description of Artificial Sequence: Synthetic oligonucleotide
gctaggcaccatggctgggggc

SEQ ID NO: 98769 - DNA, 22 bp, Artificial Sequence
  Description of Artificial Sequence: Synthetic oligonucleotide
ctaggcaccatggctgggggcg

SEQ ID NO: 98770 - DNA, 23 bp, Artificial Sequence
  Description of Artificial Sequence: Synthetic oligonucleotide
taggcaccatggctgggggcgca

SEQ ID NO: 98771 - DNA, 22 bp, Artificial Sequence
  Description of Artificial Sequence: Synthetic oligonucleotide
aggcaccatggctgggggcgca

SEQ ID NO: 98772 - DNA, 21 bp, Artificial Sequence
  Description of Artificial Sequence: Synthetic oligonucleotide
ggcaccatggctgggggcgca

SEQ ID NO: 98773 - DNA, 21 bp, Artificial Sequence
  Description of Artificial Sequence: Synthetic oligonucleotide
gcaccatggctgggggcgcag

SEQ ID NO: 98774 - DNA, 21 bp, Artificial Sequence
  Description of Artificial Sequence: Synthetic oligonucleotide
caccatggctgggggcgcagc

SEQ ID NO: 98775 - DNA, 21 bp, Artificial Sequence
  Description of Artificial Sequence: Synthetic oligonucleotide
accatggctgggggcgcagcg

SEQ ID NO: 98776 - DNA, 20 bp, Artificial Sequence
  Description of Artificial Sequence: Synthetic oligonucleotide
ccatggctgggggcgcagcg

SEQ ID NO: 98777 - DNA, 23 bp, Artificial Sequence
  Description of Artificial Sequence: Synthetic oligonucleotide
catggctgggggcgcagcggatt

SEQ ID NO: 98778 - DNA, 23 bp, Artificial Sequence
  Description of Artificial Sequence: Synthetic oligonucleotide
atggctgggggcgcagcggattg

SEQ ID NO: 98779 - DNA, 22 bp, Artificial Sequence
  Description of Artificial Sequence: Synthetic oligonucleotide
tggctgggggcgcagcggattg

SEQ ID NO: 98780 - DNA, 21 bp, Artificial Sequence
  Description of Artificial Sequence: Synthetic oligonucleotide
ggctgggggcgcagcggattg

SEQ ID NO: 98781 - DNA, 22 bp, Artificial Sequence
  Description of Artificial Sequence: Synthetic oligonucleotide
gctgggggcgcagcggattgca

SEQ ID NO: 98782 - DNA, 22 bp, Artificial Sequence
  Description of Artificial Sequence: Synthetic oligonucleotide
ctgggggcgcagcggattgcag

SEQ ID NO: 98783 - DNA, 24 bp, Artificial Sequence
  Description of Artificial Sequence: Synthetic oligonucleotide
tgggggcgcagcggattgcagctt

SEQ ID NO: 98784 - DNA, 23 bp, Artificial Sequence
  Description of Artificial Sequence: Synthetic oligonucleotide
gggggcgcagcggattgcagctt

SEQ ID NO: 98785 - DNA, 24 bp, Artificial Sequence
  Description of Artificial Sequence: Synthetic oligonucleotide
ggggcgcagcggattgcagcttct

SEQ ID NO: 98786 - DNA, 24 bp, Artificial Sequence
  Description of Artificial Sequence: Synthetic oligonucleotide
gggcgcagcggattgcagcttctg

SEQ ID NO: 98787 - DNA, 24 bp, Artificial Sequence
  Description of Artificial Sequence: Synthetic oligonucleotide
ggcgcagcggattgcagcttctgg

SEQ ID NO: 98788 - DNA, 26 bp, Artificial Sequence
  Description of Artificial Sequence: Synthetic oligonucleotide
gcgcagcggattgcagcttctgggaa

SEQ ID NO: 98789 - DNA, 26 bp, Artificial Sequence
  Description of Artificial Sequence: Synthetic oligonucleotide
cgcagcggattgcagcttctgggaac

SEQ ID NO: 98790 - DNA, 26 bp, Artificial Sequence
  Description of Artificial Sequence: Synthetic oligonucleotide
gcagcggattgcagcttctgggaacg

SEQ ID NO: 98791 - DNA, 26 bp, Artificial Sequence
  Description of Artificial Sequence: Synthetic oligonucleotide
cagcggattgcagcttctgggaacgg

SEQ ID NO: 98792 - DNA, 27 bp, Artificial Sequence
  Description of Artificial Sequence: Synthetic oligonucleotide
agcggattgcagcttctgggaacggct

SEQ ID NO: 98793 - DNA, 26 bp, Artificial Sequence
  Description of Artificial Sequence: Synthetic oligonucleotide
gcggattgcagcttctgggaacggct

SEQ ID NO: 98794 - DNA, 27 bp, Artificial Sequence
  Description of Artificial Sequence: Synthetic oligonucleotide
cggattgcagcttctgggaacggctgt

SEQ ID NO: 98795 - DNA, 28 bp, Artificial Sequence
  Description of Artificial Sequence: Synthetic oligonucleotide
ggattgcagcttctgggaacggctgttg

SEQ ID NO: 98796 - DNA, 28 bp, Artificial Sequence
  Description of Artificial Sequence: Synthetic oligonucleotide
gattgcagcttctgggaacggctgttgg

SEQ ID NO: 98797 - DNA, 28 bp, Artificial Sequence
  Description of Artificial Sequence: Synthetic oligonucleotide
attgcagcttctgggaacggctgttggc

SEQ ID NO: 98798 - DNA, 27 bp, Artificial Sequence
  Description of Artificial Sequence: Synthetic oligonucleotide
ttgcagcttctgggaacggctgttggc

SEQ ID NO: 98799 - DNA, 27 bp, Artificial Sequence
  Description of Artificial Sequence: Synthetic oligonucleotide
tgcagcttctgggaacggctgttggct

SEQ ID NO: 98800 - DNA, 26 bp, Artificial Sequence
  Description of Artificial Sequence: Synthetic oligonucleotide
gcagcttctgggaacggctgttggct

SEQ ID NO: 98801 - DNA, 26 bp, Artificial Sequence
  Description of Artificial Sequence: Synthetic oligonucleotide
cagcttctgggaacggctgttggctc

SEQ ID NO: 98802 - DNA, 26 bp, Artificial Sequence
  Description of Artificial Sequence: Synthetic oligonucleotide
agcttctgggaacggctgttggctcg

SEQ ID NO: 98803 - DNA, 25 bp, Artificial Sequence
  Description of Artificial Sequence: Synthetic oligonucleotide
gcttctgggaacggctgttggctcg

SEQ ID NO: 98804 - DNA, 25 bp, Artificial Sequence
  Description of Artificial Sequence: Synthetic oligonucleotide
cttctgggaacggctgttggctcgg

SEQ ID NO: 98805 - DNA, 27 bp, Artificial Sequence
  Description of Artificial Sequence: Synthetic oligonucleotide
ttctgggaacggctgttggctcggcaa

SEQ ID NO: 98806 - DNA, 27 bp, Artificial Sequence
  Description of Artificial Sequence: Synthetic oligonucleotide
tctgggaacggctgttggctcggcaat

SEQ ID NO: 98807 - DNA, 26 bp, Artificial Sequence
  Description of Artificial Sequence: Synthetic oligonucleotide
ctgggaacggctgttggctcggcaat

SEQ ID NO: 98808 - DNA, 27 bp, Artificial Sequence
  Description of Artificial Sequence: Synthetic oligonucleotide
tgggaacggctgttggctcggcaatgt

SEQ ID NO: 98809 - DNA, 26 bp, Artificial Sequence
  Description of Artificial Sequence: Synthetic oligonucleotide
gggaacggctgttggctcggcaatgt

SEQ ID NO: 98810 - DNA, 26 bp, Artificial Sequence
  Description of Artificial Sequence: Synthetic oligonucleotide
ggaacggctgttggctcggcaatgtc

SEQ ID NO: 98811 - DNA, 27 bp, Artificial Sequence
  Description of Artificial Sequence: Synthetic oligonucleotide
gaacggctgttggctcggcaatgtcga

SEQ ID NO: 98812 - DNA, 29 bp, Artificial Sequence
  Description of Artificial Sequence: Synthetic oligonucleotide
aacggctgttggctcggcaatgtcgaatc

SEQ ID NO: 98813 - DNA, 28 bp, Artificial Sequence
  Description of Artificial Sequence: Synthetic oligonucleotide
acggctgttggctcggcaatgtcgaatc

SEQ ID NO: 98814 - DNA, 27 bp, Artificial Sequence
  Description of Artificial Sequence: Synthetic oligonucleotide
cggctgttggctcggcaatgtcgaatc

SEQ ID NO: 98815 - DNA, 30 bp, Artificial Sequence
  Description of Artificial Sequence: Synthetic oligonucleotide
ggctgttggctcggcaatgtcgaatctatg

SEQ ID NO: 98816 - DNA, 31 bp, Artificial Sequence
  Description of Artificial Sequence: Synthetic oligonucleotide
gctgttggctcggcaatgtcgaatctatgag

SEQ ID NO: 98817 - DNA, 31 bp, Artificial Sequence
  Description of Artificial Sequence: Synthetic oligonucleotide
ctgttggctcggcaatgtcgaatctatgagc

SEQ ID NO: 98818 - DNA, 33 bp, Artificial Sequence
  Description of Artificial Sequence: Synthetic oligonucleotide
tgttggctcggcaatgtcgaatctatgagcttc

SEQ ID NO: 98819 - DNA, 32 bp, Artificial Sequence
  Description of Artificial Sequence: Synthetic oligonucleotide
gttggctcggcaatgtcgaatctatgagcttc

SEQ ID NO: 98820 - DNA, 32 bp, Artificial Sequence
  Description of Artificial Sequence: Synthetic oligonucleotide
ttggctcggcaatgtcgaatctatgagcttcg

SEQ ID NO: 98821 - DNA, 31 bp, Artificial Sequence
  Description of Artificial Sequence: Synthetic oligonucleotide
tggctcggcaatgtcgaatctatgagcttcg

SEQ ID NO: 98822 - DNA, 30 bp, Artificial Sequence
  Description of Artificial Sequence: Synthetic oligonucleotide
ggctcggcaatgtcgaatctatgagcttcg

SEQ ID NO: 98823 - DNA, 36 bp, Artificial Sequence
  Description of Artificial Sequence: Synthetic oligonucleotide
gctcggcaatgtcgaatctatgagcttcgaaataag

SEQ ID NO: 98824 - DNA, 36 bp, Artificial Sequence
  Description of Artificial Sequence: Synthetic oligonucleotide
ctcggcaatgtcgaatctatgagcttcgaaataagg

SEQ ID NO: 98825 - DNA, 38 bp, Artificial Sequence
  Description of Artificial Sequence: Synthetic oligonucleotide
tcggcaatgtcgaatctatgagcttcgaaataaggaac

SEQ ID NO: 98826 - DNA, 37 bp, Artificial Sequence
  Description of Artificial Sequence: Synthetic oligonucleotide
cggcaatgtcgaatctatgagcttcgaaataaggaac

SEQ ID NO: 98827 - DNA, 37 bp, Artificial Sequence
  Description of Artificial Sequence: Synthetic oligonucleotide
ggcaatgtcgaatctatgagcttcgaaataaggaacg

SEQ ID NO: 98828 - DNA, 37 bp, Artificial Sequence
  Description of Artificial Sequence: Synthetic oligonucleotide
gcaatgtcgaatctatgagcttcgaaataaggaacgc

SEQ ID NO: 98829 - DNA, 39 bp, Artificial Sequence
  Description of Artificial Sequence: Synthetic oligonucleotide
caatgtcgaatctatgagcttcgaaataaggaacgcatc

SEQ ID NO: 98830 - DNA, 40 bp, Artificial Sequence
  Description of Artificial Sequence: Synthetic oligonucleotide
aatgtcgaatctatgagcttcgaaataaggaacgcatctc

SEQ ID NO: 98831 - DNA, 39 bp, Artificial Sequence
  Description of Artificial Sequence: Synthetic oligonucleotide
atgtcgaatctatgagcttcgaaataaggaacgcatctc

SEQ ID NO: 98832 - DNA, 38 bp, Artificial Sequence
  Description of Artificial Sequence: Synthetic oligonucleotide
tgtcgaatctatgagcttcgaaataaggaacgcatctc

SEQ ID NO: 98833 - DNA, 37 bp, Artificial Sequence
  Description of Artificial Sequence: Synthetic oligonucleotide
gtcgaatctatgagcttcgaaataaggaacgcatctc

SEQ ID NO: 98834 - DNA, 38 bp, Artificial Sequence
  Description of Artificial Sequence: Synthetic oligonucleotide
tcgaatctatgagcttcgaaataaggaacgcatctctg

SEQ ID NO: 98835 - DNA, 37 bp, Artificial Sequence
  Description of Artificial Sequence: Synthetic oligonucleotide
cgaatctatgagcttcgaaataaggaacgcatctctg

SEQ ID NO: 98836 - DNA, 39 bp, Artificial Sequence
  Description of Artificial Sequence: Synthetic oligonucleotide
gaatctatgagcttcgaaataaggaacgcatctctgtag

SEQ ID NO: 98837 - DNA, 39 bp, Artificial Sequence
  Description of Artificial Sequence: Synthetic oligonucleotide
aatctatgagcttcgaaataaggaacgcatctctgtagc

SEQ ID NO: 98838 - DNA, 38 bp, Artificial Sequence
  Description of Artificial Sequence: Synthetic oligonucleotide
atctatgagcttcgaaataaggaacgcatctctgtagc

SEQ ID NO: 98839 - DNA, 37 bp, Artificial Sequence
  Description of Artificial Sequence: Synthetic oligonucleotide
tctatgagcttcgaaataaggaacgcatctctgtagc

SEQ ID NO: 98840 - DNA, 36 bp, Artificial Sequence
  Description of Artificial Sequence: Synthetic oligonucleotide
ctatgagcttcgaaataaggaacgcatctctgtagc

SEQ ID NO: 98841 - DNA, 37 bp, Artificial Sequence
  Description of Artificial Sequence: Synthetic oligonucleotide
tatgagcttcgaaataaggaacgcatctctgtagcag

SEQ ID NO: 98842 - DNA, 36 bp, Artificial Sequence
  Description of Artificial Sequence: Synthetic oligonucleotide
atgagcttcgaaataaggaacgcatctctgtagcag

SEQ ID NO: 98843 - DNA, 35 bp, Artificial Sequence
  Description of Artificial Sequence: Synthetic oligonucleotide
tgagcttcgaaataaggaacgcatctctgtagcag

SEQ ID NO: 98844 - DNA, 34 bp, Artificial Sequence
  Description of Artificial Sequence: Synthetic oligonucleotide
gagcttcgaaataaggaacgcatctctgtagcag

SEQ ID NO: 98845 - DNA, 34 bp, Artificial Sequence
  Description of Artificial Sequence: Synthetic oligonucleotide
agcttcgaaataaggaacgcatctctgtagcagc

SEQ ID NO: 98846 - DNA, 33 bp, Artificial Sequence
  Description of Artificial Sequence: Synthetic oligonucleotide
gcttcgaaataaggaacgcatctctgtagcagc

SEQ ID NO: 98847 - DNA, 34 bp, Artificial Sequence
  Description of Artificial Sequence: Synthetic oligonucleotide
cttcgaaataaggaacgcatctctgtagcagctg

SEQ ID NO: 98848 - DNA, 34 bp, Artificial Sequence
  Description of Artificial Sequence: Synthetic oligonucleotide
ttcgaaataaggaacgcatctctgtagcagctgc

SEQ ID NO: 98849 - DNA, 33 bp, Artificial Sequence
  Description of Artificial Sequence: Synthetic oligonucleotide
tcgaaataaggaacgcatctctgtagcagctgc

SEQ ID NO: 98850 - DNA, 32 bp, Artificial Sequence
  Description of Artificial Sequence: Synthetic oligonucleotide
cgaaataaggaacgcatctctgtagcagctgc

SEQ ID NO: 98851 - DNA, 32 bp, Artificial Sequence
  Description of Artificial Sequence: Synthetic oligonucleotide
gaaataaggaacgcatctctgtagcagctgcc

SEQ ID NO: 98852 - DNA, 33 bp, Artificial Sequence
  Description of Artificial Sequence: Synthetic oligonucleotide
aaataaggaacgcatctctgtagcagctgcctc

SEQ ID NO: 98853 - DNA, 32 bp, Artificial Sequence
  Description of Artificial Sequence: Synthetic oligonucleotide
aataaggaacgcatctctgtagcagctgcctc

SEQ ID NO: 98854 - DNA, 31 bp, Artificial Sequence
  Description of Artificial Sequence: Synthetic oligonucleotide
ataaggaacgcatctctgtagcagctgcctc

SEQ ID NO: 98855 - DNA, 30 bp, Artificial Sequence
  Description of Artificial Sequence: Synthetic oligonucleotide
taaggaacgcatctctgtagcagctgcctc

SEQ ID NO: 98856 - DNA, 29 bp, Artificial Sequence
  Description of Artificial Sequence: Synthetic oligonucleotide
aaggaacgcatctctgtagcagctgcctc

SEQ ID NO: 98857 - DNA, 28 bp, Artificial Sequence
  Description of Artificial Sequence: Synthetic oligonucleotide
aggaacgcatctctgtagcagctgcctc

SEQ ID NO: 98858 - DNA, 27 bp, Artificial Sequence
  Description of Artificial Sequence: Synthetic oligonucleotide
ggaacgcatctctgtagcagctgcctc

SEQ ID NO: 98859 - DNA, 27 bp, Artificial Sequence
  Description of Artificial Sequence: Synthetic oligonucleotide
gaacgcatctctgtagcagctgcctcc

SEQ ID NO: 98860 - DNA, 30 bp, Artificial Sequence
  Description of Artificial Sequence: Synthetic oligonucleotide
aacgcatctctgtagcagctgcctccaaac

SEQ ID NO: 98861 - DNA, 29 bp, Artificial Sequence
  Description of Artificial Sequence: Synthetic oligonucleotide
acgcatctctgtagcagctgcctccaaac

SEQ ID NO: 98862 - DNA, 28 bp, Artificial Sequence
  Description of Artificial Sequence: Synthetic oligonucleotide
cgcatctctgtagcagctgcctccaaac

SEQ ID NO: 98863 - DNA, 29 bp, Artificial Sequence
  Description of Artificial Sequence: Synthetic oligonucleotide
gcatctctgtagcagctgcctccaaactg

SEQ ID NO: 98864 - DNA, 29 bp, Artificial Sequence
  Description of Artificial Sequence: Synthetic oligonucleotide
catctctgtagcagctgcctccaaactgc

SEQ ID NO: 98865 - DNA, 31 bp, Artificial Sequence
  Description of Artificial Sequence: Synthetic oligonucleotide
atctctgtagcagctgcctccaaactgcttg

SEQ ID NO: 98866 - DNA, 30 bp, Artificial Sequence
  Description of Artificial Sequence: Synthetic oligonucleotide
tctctgtagcagctgcctccaaactgcttg

SEQ ID NO: 98867 - DNA, 29 bp, Artificial Sequence
  Description of Artificial Sequence: Synthetic oligonucleotide
ctctgtagcagctgcctccaaactgcttg

SEQ ID NO: 98868 - DNA, 29 bp, Artificial Sequence
  Description of Artificial Sequence: Synthetic oligonucleotide
tctgtagcagctgcctccaaactgcttgc

SEQ ID NO: 98869 - DNA, 28 bp, Artificial Sequence
  Description of Artificial Sequence: Synthetic oligonucleotide
ctgtagcagctgcctccaaactgcttgc

SEQ ID NO: 98870 - DNA, 28 bp, Artificial Sequence
  Description of Artificial Sequence: Synthetic oligonucleotide
tgtagcagctgcctccaaactgcttgcc

SEQ ID NO: 98871 - DNA, 27 bp, Artificial Sequence
  Description of Artificial Sequence: Synthetic oligonucleotide
gtagcagctgcctccaaactgcttgcc

SEQ ID NO: 98872 - DNA, 29 bp, Artificial Sequence
  Description of Artificial Sequence: Synthetic oligonucleotide
tagcagctgcctccaaactgcttgccaac

SEQ ID NO: 98873 - DNA, 28 bp, Artificial Sequence
  Description of Artificial Sequence: Synthetic oligonucleotide
agcagctgcctccaaactgcttgccaac

SEQ ID NO: 98874 - DNA, 27 bp, Artificial Sequence
  Description of Artificial Sequence: Synthetic oligonucleotide
gcagctgcctccaaactgcttgccaac

SEQ ID NO: 98875 - DNA, 29 bp, Artificial Sequence
  Description of Artificial Sequence: Synthetic oligonucleotide
cagctgcctccaaactgcttgccaacatg

SEQ ID NO: 98876 - DNA, 29 bp, Artificial Sequence
  Description of Artificial Sequence: Synthetic oligonucleotide
agctgcctccaaactgcttgccaacatgg

SEQ ID NO: 98877 - DNA, 28 bp, Artificial Sequence
  Description of Artificial Sequence: Synthetic oligonucleotide
gctgcctccaaactgcttgccaacatgg

SEQ ID NO: 98878 - DNA, 29 bp, Artificial Sequence
  Description of Artificial Sequence: Synthetic oligonucleotide
ctgcctccaaactgcttgccaacatggtg

SEQ ID NO: 98879 - DNA, 32 bp, Artificial Sequence
  Description of Artificial Sequence: Synthetic oligonucleotide
tgcctccaaactgcttgccaacatggtgtatc

SEQ ID NO: 98880 - DNA, 31 bp, Artificial Sequence
  Description of Artificial Sequence: Synthetic oligonucleotide
gcctccaaactgcttgccaacatggtgtatc

SEQ ID NO: 98881 - DNA, 32 bp, Artificial Sequence
  Description of Artificial Sequence: Synthetic oligonucleotide
cctccaaactgcttgccaacatggtgtatcag

SEQ ID NO: 98882 - DNA, 34 bp, Artificial Sequence
  Description of Artificial Sequence: Synthetic oligonucleotide
ctccaaactgcttgccaacatggtgtatcagtac

SEQ ID NO: 98883 - DNA, 37 bp, Artificial Sequence
  Description of Artificial Sequence: Synthetic oligonucleotide
tccaaactgcttgccaacatggtgtatcagtacaaag

SEQ ID NO: 98884 - DNA, 36 bp, Artificial Sequence
  Description of Artificial Sequence: Synthetic oligonucleotide
ccaaactgcttgccaacatggtgtatcagtacaaag

SEQ ID NO: 98885 - DNA, 36 bp, Artificial Sequence
  Description of Artificial Sequence: Synthetic oligonucleotide
caaactgcttgccaacatggtgtatcagtacaaagg

SEQ ID NO: 98886 - DNA, 36 bp, Artificial Sequence
  Description of Artificial Sequence: Synthetic oligonucleotide
aaactgcttgccaacatggtgtatcagtacaaaggc

SEQ ID NO: 98887 - DNA, 35 bp, Artificial Sequence
  Description of Artificial Sequence: Synthetic oligonucleotide
aactgcttgccaacatggtgtatcagtacaaaggc

SEQ ID NO: 98888 - DNA, 34 bp, Artificial Sequence
  Description of Artificial Sequence: Synthetic oligonucleotide
actgcttgccaacatggtgtatcagtacaaaggc

SEQ ID NO: 98889 - DNA, 33 bp, Artificial Sequence
  Description of Artificial Sequence: Synthetic oligonucleotide
ctgcttgccaacatggtgtatcagtacaaaggc

SEQ ID NO: 98890 - DNA, 35 bp, Artificial Sequence
  Description of Artificial Sequence: Synthetic oligonucleotide
tgcttgccaacatggtgtatcagtacaaaggcatg

SEQ ID NO: 98891 - DNA, 34 bp, Artificial Sequence
  Description of Artificial Sequence: Synthetic oligonucleotide
gcttgccaacatggtgtatcagtacaaaggcatg

SEQ ID NO: 98892 - DNA, 34 bp, Artificial Sequence
  Description of Artificial Sequence: Synthetic oligonucleotide
cttgccaacatggtgtatcagtacaaaggcatgg

SEQ ID NO: 98893 - DNA, 34 bp, Artificial Sequence
  Description of Artificial Sequence: Synthetic oligonucleotide
ttgccaacatggtgtatcagtacaaaggcatggg

SEQ ID NO: 98894 - DNA, 33 bp, Artificial Sequence
  Description of Artificial Sequence: Synthetic oligonucleotide
tgccaacatggtgtatcagtacaaaggcatggg

SEQ ID NO: 98895 - DNA, 32 bp, Artificial Sequence
  Description of Artificial Sequence: Synthetic oligonucleotide
gccaacatggtgtatcagtacaaaggcatggg

SEQ ID NO: 98896 - DNA, 32 bp, Artificial Sequence
  Description of Artificial Sequence: Synthetic oligonucleotide
ccaacatggtgtatcagtacaaaggcatgggg

SEQ ID NO: 98897 - DNA, 32 bp, Artificial Sequence
  Description of Artificial Sequence: Synthetic oligonucleotide
caacatggtgtatcagtacaaaggcatggggc

SEQ ID NO: 98898 - DNA, 33 bp, Artificial Sequence
  Description of Artificial Sequence: Synthetic oligonucleotide
aacatggtgtatcagtacaaaggcatggggctg

SEQ ID NO: 98899 - DNA, 32 bp, Artificial Sequence
  Description of Artificial Sequence: Synthetic oligonucleotide
acatggtgtatcagtacaaaggcatggggctg

SEQ ID NO: 98900 - DNA, 31 bp, Artificial Sequence
  Description of Artificial Sequence: Synthetic oligonucleotide
catggtgtatcagtacaaaggcatggggctg

SEQ ID NO: 98901 - DNA, 32 bp, Artificial Sequence
  Description of Artificial Sequence: Synthetic oligonucleotide
atggtgtatcagtacaaaggcatggggctgtc

SEQ ID NO: 98902 - DNA, 31 bp, Artificial Sequence
  Description of Artificial Sequence: Synthetic oligonucleotide
tggtgtatcagtacaaaggcatggggctgtc

SEQ ID NO: 98903 - DNA, 30 bp, Artificial Sequence
  Description of Artificial Sequence: Synthetic oligonucleotide
ggtgtatcagtacaaaggcatggggctgtc

SEQ ID NO: 98904 - DNA, 30 bp, Artificial Sequence
  Description of Artificial Sequence: Synthetic oligonucleotide
gtgtatcagtacaaaggcatggggctgtcc

SEQ ID NO: 98905 - DNA, 32 bp, Artificial Sequence
  Description of Artificial Sequence: Synthetic oligonucleotide
tgtatcagtacaaaggcatggggctgtccatg

SEQ ID NO: 98906 - DNA, 31 bp, Artificial Sequence
  Description of Artificial Sequence: Synthetic oligonucleotide
gtatcagtacaaaggcatggggctgtccatg

SEQ ID NO: 98907 - DNA, 31 bp, Artificial Sequence
  Description of Artificial Sequence: Synthetic oligonucleotide
tatcagtacaaaggcatggggctgtccatgg

SEQ ID NO: 98908 - DNA, 30 bp, Artificial Sequence
  Description of Artificial Sequence: Synthetic oligonucleotide
atcagtacaaaggcatggggctgtccatgg

SEQ ID NO: 98909 - DNA, 29 bp, Artificial Sequence
  Description of Artificial Sequence: Synthetic oligonucleotide
tcagtacaaaggcatggggctgtccatgg

SEQ ID NO: 98910 - DNA, 28 bp, Artificial Sequence
  Description of Artificial Sequence: Synthetic oligonucleotide
cagtacaaaggcatggggctgtccatgg

SEQ ID NO: 98911 - DNA, 28 bp, Artificial Sequence
  Description of Artificial Sequence: Synthetic oligonucleotide
agtacaaaggcatggggctgtccatggg

SEQ ID NO: 98912 - DNA, 27 bp, Artificial Sequence
  Description of Artificial Sequence: Synthetic oligonucleotide
gtacaaaggcatggggctgtccatggg

SEQ ID NO: 98913 - DNA, 27 bp, Artificial Sequence
  Description of Artificial Sequence: Synthetic oligonucleotide
tacaaaggcatggggctgtccatgggc

SEQ ID NO: 98914 - DNA, 27 bp, Artificial Sequence
  Description of Artificial Sequence: Synthetic oligonucleotide
acaaaggcatggggctgtccatgggca

SEQ ID NO: 98915 - DNA, 26 bp, Artificial Sequence
  Description of Artificial Sequence: Synthetic oligonucleotide
caaaggcatggggctgtccatgggca

SEQ ID NO: 98916 - DNA, 26 bp, Artificial Sequence
  Description of Artificial Sequence: Synthetic oligonucleotide
aaaggcatggggctgtccatgggcac

SEQ ID NO: 98917 - DNA, 25 bp, Artificial Sequence
  Description of Artificial Sequence: Synthetic oligonucleotide
aaggcatggggctgtccatgggcac

SEQ ID NO: 98918 - DNA, 24 bp, Artificial Sequence
  Description of Artificial Sequence: Synthetic oligonucleotide
aggcatggggctgtccatgggcac

SEQ ID NO: 98919 - DNA, 23 bp, Artificial Sequence
  Description of Artificial Sequence: Synthetic oligonucleotide
ggcatggggctgtccatgggcac

SEQ ID NO: 98920 - DNA, 25 bp, Artificial Sequence
  Description of Artificial Sequence: Synthetic oligonucleotide
gcatggggctgtccatgggcaccat

SEQ ID NO: 98921 - DNA, 27 bp, Artificial Sequence
  Description of Artificial Sequence: Synthetic oligonucleotide
catggggctgtccatgggcaccatgat

SEQ ID NO: 98922 - DNA, 27 bp, Artificial Sequence
  Description of Artificial Sequence: Synthetic oligonucleotide
atggggctgtccatgggcaccatgatc

SEQ ID NO: 98923 - DNA, 27 bp, Artificial Sequence
  Description of Artificial Sequence: Synthetic oligonucleotide
tggggctgtccatgggcaccatgatct

SEQ ID NO: 98924 - DNA, 26 bp, Artificial Sequence
  Description of Artificial Sequence: Synthetic oligonucleotide
ggggctgtccatgggcaccatgatct

SEQ ID NO: 98925 - DNA, 27 bp, Artificial Sequence
  Description of Artificial Sequence: Synthetic oligonucleotide
gggctgtccatgggcaccatgatctgt

SEQ ID NO: 98926 - DNA, 27 bp, Artificial Sequence
  Description of Artificial Sequence: Synthetic oligonucleotide
ggctgtccatgggcaccatgatctgtg

SEQ ID NO: 98927 - DNA, 27 bp, Artificial Sequence
  Description of Artificial Sequence: Synthetic oligonucleotide
gctgtccatgggcaccatgatctgtgg

SEQ ID NO: 98928 - DNA, 27 bp, Artificial Sequence
  Description of Artificial Sequence: Synthetic oligonucleotide
ctgtccatgggcaccatgatctgtggc

SEQ ID NO: 98929 - DNA, 28 bp, Artificial Sequence
  Description of Artificial Sequence: Synthetic oligonucleotide
tgtccatgggcaccatgatctgtggctg

SEQ ID NO: 98930 - DNA, 27 bp, Artificial Sequence
  Description of Artificial Sequence: Synthetic oligonucleotide
gtccatgggcaccatgatctgtggctg

SEQ ID NO: 98931 - DNA, 27 bp, Artificial Sequence
  Description of Artificial Sequence: Synthetic oligonucleotide
tccatgggcaccatgatctgtggctgg

SEQ ID NO: 98932 - DNA, 26 bp, Artificial Sequence
  Description of Artificial Sequence: Synthetic oligonucleotide
ccatgggcaccatgatctgtggctgg

SEQ ID NO: 98933 - DNA, 27 bp, Artificial Sequence
  Description of Artificial Sequence: Synthetic oligonucleotide
catgggcaccatgatctgtggctggga

SEQ ID NO: 98934 - DNA, 30 bp, Artificial Sequence
  Description of Artificial Sequence: Synthetic oligonucleotide
atgggcaccatgatctgtggctgggataag

SEQ ID NO: 98935 - DNA, 29 bp, Artificial Sequence
  Description of Artificial Sequence: Synthetic oligonucleotide
tgggcaccatgatctgtggctgggataag

SEQ ID NO: 98936 - DNA, 28 bp, Artificial Sequence
  Description of Artificial Sequence: Synthetic oligonucleotide
gggcaccatgatctgtggctgggataag

SEQ ID NO: 98937 - DNA, 29 bp, Artificial Sequence
  Description of Artificial Sequence: Synthetic oligonucleotide
ggcaccatgatctgtggctgggataagag

SEQ ID NO: 98938 - DNA, 30 bp, Artificial Sequence
  Description of Artificial Sequence: Synthetic oligonucleotide
gcaccatgatctgtggctgggataagagag

SEQ ID NO: 98939 - DNA, 30 bp, Artificial Sequence
  Description of Artificial Sequence: Synthetic oligonucleotide
caccatgatctgtggctgggataagagagg

SEQ ID NO: 98940 - DNA, 30 bp, Artificial Sequence
  Description of Artificial Sequence: Synthetic oligonucleotide
accatgatctgtggctgggataagagaggc

SEQ ID NO: 98941 - DNA, 29 bp, Artificial Sequence
  Description of Artificial Sequence: Synthetic oligonucleotide
ccatgatctgtggctgggataagagaggc

SEQ ID NO: 98942 - DNA, 29 bp, Artificial Sequence
  Description of Artificial Sequence: Synthetic oligonucleotide
catgatctgtggctgggataagagaggcc

SEQ ID NO: 98943 - DNA, 29 bp, Artificial Sequence
  Description of Artificial Sequence: Synthetic oligonucleotide
atgatctgtggctgggataagagaggccc

SEQ ID NO: 98944 - DNA, 28 bp, Artificial Sequence
  Description of Artificial Sequence: Synthetic oligonucleotide
tgatctgtggctgggataagagaggccc

SEQ ID NO: 98945 - DNA, 27 bp, Artificial Sequence
  Description of Artificial Sequence: Synthetic oligonucleotide
gatctgtggctgggataagagaggccc

SEQ ID NO: 98946 - DNA, 28 bp, Artificial Sequence
  Description of Artificial Sequence: Synthetic oligonucleotide
atctgtggctgggataagagaggccctg

SEQ ID NO: 98947 - DNA, 27 bp, Artificial Sequence
  Description of Artificial Sequence: Synthetic oligonucleotide
tctgtggctgggataagagaggccctg

SEQ ID NO: 98948 - DNA, 26 bp, Artificial Sequence
  Description of Artificial Sequence: Synthetic oligonucleotide
ctgtggctgggataagagaggccctg

SEQ ID NO: 98949 - DNA, 26 bp, Artificial Sequence
  Description of Artificial Sequence: Synthetic oligonucleotide
tgtggctgggataagagaggccctgg

SEQ ID NO: 98950 - DNA, 25 bp, Artificial Sequence
  Description of Artificial Sequence: Synthetic oligonucleotide
gtggctgggataagagaggccctgg

SEQ ID NO: 98951 - DNA, 25 bp, Artificial Sequence
  Description of Artificial Sequence: Synthetic oligonucleotide
tggctgggataagagaggccctggc

SEQ ID NO: 98952 - DNA, 24 bp, Artificial Sequence
  Description of Artificial Sequence: Synthetic oligonucleotide
ggctgggataagagaggccctggc

SEQ ID NO: 98953 - DNA, 25 bp, Artificial Sequence
  Description of Artificial Sequence: Synthetic oligonucleotide
gctgggataagagaggccctggcct

SEQ ID NO: 98954 - DNA, 27 bp, Artificial Sequence
  Description of Artificial Sequence: Synthetic oligonucleotide
ctgggataagagaggccctggcctcta

SEQ ID NO: 98955 - DNA, 27 bp, Artificial Sequence
  Description of Artificial Sequence: Synthetic oligonucleotide
tgggataagagaggccctggcctctac

SEQ ID NO: 98956 - DNA, 27 bp, Artificial Sequence
  Description of Artificial Sequence: Synthetic oligonucleotide
gggataagagaggccctggcctctact

SEQ ID NO: 98957 - DNA, 28 bp, Artificial Sequence
  Description of Artificial Sequence: Synthetic oligonucleotide
ggataagagaggccctggcctctactac

SEQ ID NO: 98958 - DNA, 28 bp, Artificial Sequence
  Description of Artificial Sequence: Synthetic oligonucleotide
gataagagaggccctggcctctactacg

SEQ ID NO: 98959 - DNA, 29 bp, Artificial Sequence
  Description of Artificial Sequence: Synthetic oligonucleotide
ataagagaggccctggcctctactacgtg

SEQ ID NO: 98960 - DNA, 28 bp, Artificial Sequence
  Description of Artificial Sequence: Synthetic oligonucleotide
taagagaggccctggcctctactacgtg

SEQ ID NO: 98961 - DNA, 27 bp, Artificial Sequence
  Description of Artificial Sequence: Synthetic oligonucleotide
aagagaggccctggcctctactacgtg

SEQ ID NO: 98962 - DNA, 26 bp, Artificial Sequence
  Description of Artificial Sequence: Synthetic oligonucleotide
agagaggccctggcctctactacgtg

SEQ ID NO: 98963 - DNA, 25 bp, Artificial Sequence
  Description of Artificial Sequence: Synthetic oligonucleotide
gagaggccctggcctctactacgtg

SEQ ID NO: 98964 - DNA, 26 bp, Artificial Sequence
  Description of Artificial Sequence: Synthetic oligonucleotide
agaggccctggcctctactacgtgga

SEQ ID NO: 98965 - DNA, 25 bp, Artificial Sequence
  Description of Artificial Sequence: Synthetic oligonucleotide
gaggccctggcctctactacgtgga

SEQ ID NO: 98966 - DNA, 26 bp, Artificial Sequence
  Description of Artificial Sequence: Synthetic oligonucleotide
aggccctggcctctactacgtggaca

SEQ ID NO: 98967 - DNA, 25 bp, Artificial Sequence
  Description of Artificial Sequence: Synthetic oligonucleotide
ggccctggcctctactacgtggaca

SEQ ID NO: 98968 - DNA, 26 bp, Artificial Sequence
  Description of Artificial Sequence: Synthetic oligonucleotide
gccctggcctctactacgtggacagt

SEQ ID NO: 98969 - DNA, 27 bp, Artificial Sequence
  Description of Artificial Sequence: Synthetic oligonucleotide
ccctggcctctactacgtggacagtga

SEQ ID NO: 98970 - DNA, 28 bp, Artificial Sequence
  Description of Artificial Sequence: Synthetic oligonucleotide
cctggcctctactacgtggacagtgaag

SEQ ID NO: 98971 - DNA, 28 bp, Artificial Sequence
  Description of Artificial Sequence: Synthetic oligonucleotide
ctggcctctactacgtggacagtgaagg

SEQ ID NO: 98972 - DNA, 28 bp, Artificial Sequence
  Description of Artificial Sequence: Synthetic oligonucleotide
tggcctctactacgtggacagtgaaggg

SEQ ID NO: 98973 - DNA, 27 bp, Artificial Sequence
  Description of Artificial Sequence: Synthetic oligonucleotide
ggcctctactacgtggacagtgaaggg

SEQ ID NO: 98974 - DNA, 29 bp, Artificial Sequence
  Description of Artificial Sequence: Synthetic oligonucleotide
gcctctactacgtggacagtgaagggaac

SEQ ID NO: 98975 - DNA, 29 bp, Artificial Sequence
  Description of Artificial Sequence: Synthetic oligonucleotide
cctctactacgtggacagtgaagggaacc

SEQ ID NO: 98976 - DNA, 29 bp, Artificial Sequence
  Description of Artificial Sequence: Synthetic oligonucleotide
ctctactacgtggacagtgaagggaaccg

SEQ ID NO: 98977 - DNA, 29 bp, Artificial Sequence
  Description of Artificial Sequence: Synthetic oligonucleotide
tctactacgtggacagtgaagggaaccgg

SEQ ID NO: 98978 - DNA, 28 bp, Artificial Sequence
  Description of Artificial Sequence: Synthetic oligonucleotide
ctactacgtggacagtgaagggaaccgg

SEQ ID NO: 98979 - DNA, 32 bp, Artificial Sequence
  Description of Artificial Sequence: Synthetic oligonucleotide
tactacgtggacagtgaagggaaccggatttc

SEQ ID NO: 98980 - DNA, 31 bp, Artificial Sequence
  Description of Artificial Sequence: Synthetic oligonucleotide
actacgtggacagtgaagggaaccggatttc

SEQ ID NO: 98981 - DNA, 30 bp, Artificial Sequence
  Description of Artificial Sequence: Synthetic oligonucleotide
ctacgtggacagtgaagggaaccggatttc

SEQ ID NO: 98982 - DNA, 31 bp, Artificial Sequence
  Description of Artificial Sequence: Synthetic oligonucleotide
tacgtggacagtgaagggaaccggatttcag

SEQ ID NO: 98983 - DNA, 30 bp, Artificial Sequence
  Description of Artificial Sequence: Synthetic oligonucleotide
acgtggacagtgaagggaaccggatttcag

SEQ ID NO: 98984 - DNA, 29 bp, Artificial Sequence
  Description of Artificial Sequence: Synthetic oligonucleotide
cgtggacagtgaagggaaccggatttcag

SEQ ID NO: 98985 - DNA, 29 bp, Artificial Sequence
  Description of Artificial Sequence: Synthetic oligonucleotide
gtggacagtgaagggaaccggatttcagg

SEQ ID NO: 98986 - DNA, 29 bp, Artificial Sequence
  Description of Artificial Sequence: Synthetic oligonucleotide
tggacagtgaagggaaccggatttcaggg

SEQ ID NO: 98987 - DNA, 28 bp, Artificial Sequence
  Description of Artificial Sequence: Synthetic oligonucleotide
ggacagtgaagggaaccggatttcaggg

SEQ ID NO: 98988 - DNA, 28 bp, Artificial Sequence
  Description of Artificial Sequence: Synthetic oligonucleotide
gacagtgaagggaaccggatttcagggg

SEQ ID NO: 98989 - DNA, 28 bp, Artificial Sequence
  Description of Artificial Sequence: Synthetic oligonucleotide
acagtgaagggaaccggatttcaggggc

SEQ ID NO: 98990 - DNA, 27 bp, Artificial Sequence
  Description of Artificial Sequence: Synthetic oligonucleotide
cagtgaagggaaccggatttcaggggc

SEQ ID NO: 98991 - DNA, 27 bp, Artificial Sequence
  Description of Artificial Sequence: Synthetic oligonucleotide
agtgaagggaaccggatttcaggggcc

SEQ ID NO: 98992 - DNA, 27 bp, Artificial Sequence
  Description of Artificial Sequence: Synthetic oligonucleotide
gtgaagggaaccggatttcaggggcca

SEQ ID NO: 98993 - DNA, 27 bp, Artificial Sequence
  Description of Artificial Sequence: Synthetic oligonucleotide
tgaagggaaccggatttcaggggccac

SEQ ID NO: 98994 - DNA, 26 bp, Artificial Sequence
  Description of Artificial Sequence: Synthetic oligonucleotide
gaagggaaccggatttcaggggccac

SEQ ID NO: 98995 - DNA, 27 bp, Artificial Sequence
  Description of Artificial Sequence: Synthetic oligonucleotide
aagggaaccggatttcaggggccacct

SEQ ID NO: 98996 - DNA, 27 bp, Artificial Sequence
  Description of Artificial Sequence: Synthetic oligonucleotide
agggaaccggatttcaggggccacctt

SEQ ID NO: 98997 - DNA, 26 bp, Artificial Sequence
  Description of Artificial Sequence: Synthetic oligonucleotide
gggaaccggatttcaggggccacctt

SEQ ID NO: 98998 - DNA, 27 bp, Artificial Sequence
  Description of Artificial Sequence: Synthetic oligonucleotide
ggaaccggatttcaggggccaccttct

SEQ ID NO: 98999 - DNA, 27 bp, Artificial Sequence
  Description of Artificial Sequence: Synthetic oligonucleotide
gaaccggatttcaggggccaccttctc

SEQ ID NO: 99000 - DNA, 28 bp, Artificial Sequence
  Description of Artificial Sequence: Synthetic oligonucleotide
aaccggatttcaggggccaccttctctg

SEQ ID NO: 99001 - DNA, 27 bp, Artificial Sequence
  Description of Artificial Sequence: Synthetic oligonucleotide
accggatttcaggggccaccttctctg

SEQ ID NO: 99002 - DNA, 27 bp, Artificial Sequence
  Description of Artificial Sequence: Synthetic oligonucleotide
ccggatttcaggggccaccttctctgt

SEQ ID NO: 99003 - DNA, 28 bp, Artificial Sequence
  Description of Artificial Sequence: Synthetic oligonucleotide
cggatttcaggggccaccttctctgtag

SEQ ID NO: 99004 - DNA, 28 bp, Artificial Sequence
  Description of Artificial Sequence: Synthetic oligonucleotide
ggatttcaggggccaccttctctgtagg

SEQ ID NO: 99005 - DNA, 30 bp, Artificial Sequence
  Description of Artificial Sequence: Synthetic oligonucleotide
gatttcaggggccaccttctctgtaggttc

SEQ ID NO: 99006 - DNA, 31 bp, Artificial Sequence
  Description of Artificial Sequence: Synthetic oligonucleotide
atttcaggggccaccttctctgtaggttctg

SEQ ID NO: 99007 - DNA, 30 bp, Artificial Sequence
  Description of Artificial Sequence: Synthetic oligonucleotide
tttcaggggccaccttctctgtaggttctg

SEQ ID NO: 99008 - DNA, 29 bp, Artificial Sequence
  Description of Artificial Sequence: Synthetic oligonucleotide
ttcaggggccaccttctctgtaggttctg

SEQ ID NO: 99009 - DNA, 28 bp, Artificial Sequence
  Description of Artificial Sequence: Synthetic oligonucleotide
tcaggggccaccttctctgtaggttctg

SEQ ID NO: 99010 - DNA, 27 bp, Artificial Sequence
  Description of Artificial Sequence: Synthetic oligonucleotide
caggggccaccttctctgtaggttctg

SEQ ID NO: 99011 - DNA, 27 bp, Artificial Sequence
  Description of Artificial Sequence: Synthetic oligonucleotide
aggggccaccttctctgtaggttctgg

SEQ ID NO: 99012 - DNA, 26 bp, Artificial Sequence
  Description of Artificial Sequence: Synthetic oligonucleotide
ggggccaccttctctgtaggttctgg

SEQ ID NO: 99013 - DNA, 27 bp, Artificial Sequence
  Description of Artificial Sequence: Synthetic oligonucleotide
gggccaccttctctgtaggttctggct

SEQ ID NO: 99014 - DNA, 27 bp, Artificial Sequence
  Description of Artificial Sequence: Synthetic oligonucleotide
ggccaccttctctgtaggttctggctc

SEQ ID NO: 99015 - DNA, 28 bp, Artificial Sequence
  Description of Artificial Sequence: Synthetic oligonucleotide
gccaccttctctgtaggttctggctctg

SEQ ID NO: 99016 - DNA, 29 bp, Artificial Sequence
  Description of Artificial Sequence: Synthetic oligonucleotide
ccaccttctctgtaggttctggctctgtg

SEQ ID NO: 99017 - DNA, 32 bp, Artificial Sequence
  Description of Artificial Sequence: Synthetic oligonucleotide
caccttctctgtaggttctggctctgtgtatg

SEQ ID NO: 99018 - DNA, 32 bp, Artificial Sequence
  Description of Artificial Sequence: Synthetic oligonucleotide
accttctctgtaggttctggctctgtgtatgc

SEQ ID NO: 99019 - DNA, 31 bp, Artificial Sequence
  Description of Artificial Sequence: Synthetic oligonucleotide
ccttctctgtaggttctggctctgtgtatgc

SEQ ID NO: 99020 - DNA, 35 bp, Artificial Sequence
  Description of Artificial Sequence: Synthetic oligonucleotide
cttctctgtaggttctggctctgtgtatgcatatg

SEQ ID NO: 99021 - DNA, 35 bp, Artificial Sequence
  Description of Artificial Sequence: Synthetic oligonucleotide
ttctctgtaggttctggctctgtgtatgcatatgg

SEQ ID NO: 99022 - DNA, 34 bp, Artificial Sequence
  Description of Artificial Sequence: Synthetic oligonucleotide
tctctgtaggttctggctctgtgtatgcatatgg

SEQ ID NO: 99023 - DNA, 33 bp, Artificial Sequence
  Description of Artificial Sequence: Synthetic oligonucleotide
ctctgtaggttctggctctgtgtatgcatatgg

SEQ ID NO: 99024 - DNA, 33 bp, Artificial Sequence
  Description of Artificial Sequence: Synthetic oligonucleotide
tctgtaggttctggctctgtgtatgcatatggg

SEQ ID NO: 99025 - DNA, 32 bp, Artificial Sequence
  Description of Artificial Sequence: Synthetic oligonucleotide
ctgtaggttctggctctgtgtatgcatatggg

SEQ ID NO: 99026 - DNA, 32 bp, Artificial Sequence
  Description of Artificial Sequence: Synthetic oligonucleotide
tgtaggttctggctctgtgtatgcatatgggg

SEQ ID NO: 99027 - DNA, 31 bp, Artificial Sequence
  Description of Artificial Sequence: Synthetic oligonucleotide
gtaggttctggctctgtgtatgcatatgggg

SEQ ID NO: 99028 - DNA, 32 bp, Artificial Sequence
  Description of Artificial Sequence: Synthetic oligonucleotide
taggttctggctctgtgtatgcatatggggtc

SEQ ID NO: 99029 - DNA, 31 bp, Artificial Sequence
  Description of Artificial Sequence: Synthetic oligonucleotide
aggttctggctctgtgtatgcatatggggtc

SEQ ID NO: 99030 - DNA, 30 bp, Artificial Sequence
  Description of Artificial Sequence: Synthetic oligonucleotide
ggttctggctctgtgtatgcatatggggtc

SEQ ID NO: 99031 - DNA, 32 bp, Artificial Sequence
  Description of Artificial Sequence: Synthetic oligonucleotide
gttctggctctgtgtatgcatatggggtcatg

SEQ ID NO: 99032 - DNA, 32 bp, Artificial Sequence
  Description of Artificial Sequence: Synthetic oligonucleotide
ttctggctctgtgtatgcatatggggtcatgg

SEQ ID NO: 99033 - DNA, 31 bp, Artificial Sequence
  Description of Artificial Sequence: Synthetic oligonucleotide
tctggctctgtgtatgcatatggggtcatgg

SEQ ID NO: 99034 - DNA, 30 bp, Artificial Sequence
  Description of Artificial Sequence: Synthetic oligonucleotide
ctggctctgtgtatgcatatggggtcatgg

SEQ ID NO: 99035 - DNA, 32 bp, Artificial Sequence
  Description of Artificial Sequence: Synthetic oligonucleotide
tggctctgtgtatgcatatggggtcatggatc

SEQ ID NO: 99036 - DNA, 31 bp, Artificial Sequence
  Description of Artificial Sequence: Synthetic oligonucleotide
ggctctgtgtatgcatatggggtcatggatc

SEQ ID NO: 99037 - DNA, 31 bp, Artificial Sequence
  Description of Artificial Sequence: Synthetic oligonucleotide
gctctgtgtatgcatatggggtcatggatcg

SEQ ID NO: 99038 - DNA, 31 bp, Artificial Sequence
  Description of Artificial Sequence: Synthetic oligonucleotide
ctctgtgtatgcatatggggtcatggatcgg

SEQ ID NO: 99039 - DNA, 31 bp, Artificial Sequence
  Description of Artificial Sequence: Synthetic oligonucleotide
tctgtgtatgcatatggggtcatggatcggg

SEQ ID NO: 99040 - DNA, 30 bp, Artificial Sequence
  Description of Artificial Sequence: Synthetic oligonucleotide
ctgtgtatgcatatggggtcatggatcggg

SEQ ID NO: 99041 - DNA, 30 bp, Artificial Sequence
  Description of Artificial Sequence: Synthetic oligonucleotide
tgtgtatgcatatggggtcatggatcgggg

SEQ ID NO: 99042 - DNA, 29 bp, Artificial Sequence
  Description of Artificial Sequence: Synthetic oligonucleotide
gtgtatgcatatggggtcatggatcgggg

SEQ ID NO: 99043 - DNA, 29 bp, Artificial Sequence
  Description of Artificial Sequence: Synthetic oligonucleotide
tgtatgcatatggggtcatggatcggggc

SEQ ID NO: 99044 - DNA, 28 bp, Artificial Sequence
  Description of Artificial Sequence: Synthetic oligonucleotide
gtatgcatatggggtcatggatcggggc

SEQ ID NO: 99045 - DNA, 32 bp, Artificial Sequence
  Description of Artificial Sequence: Synthetic oligonucleotide
tatgcatatggggtcatggatcggggctattc

SEQ ID NO: 99046 - DNA, 31 bp, Artificial Sequence
  Description of Artificial Sequence: Synthetic oligonucleotide
atgcatatggggtcatggatcggggctattc

SEQ ID NO: 99047 - DNA, 30 bp, Artificial Sequence
  Description of Artificial Sequence: Synthetic oligonucleotide
tgcatatggggtcatggatcggggctattc

SEQ ID NO: 99048 - DNA, 29 bp, Artificial Sequence
  Description of Artificial Sequence: Synthetic oligonucleotide
gcatatggggtcatggatcggggctattc

SEQ ID NO: 99049 - DNA, 29 bp, Artificial Sequence
  Description of Artificial Sequence: Synthetic oligonucleotide
catatggggtcatggatcggggctattcc

SEQ ID NO: 99050 - DNA, 32 bp, Artificial Sequence
  Description of Artificial Sequence: Synthetic oligonucleotide
atatggggtcatggatcggggctattcctatg

SEQ ID NO: 99051 - DNA, 31 bp, Artificial Sequence
  Description of Artificial Sequence: Synthetic oligonucleotide
tatggggtcatggatcggggctattcctatg

SEQ ID NO: 99052 - DNA, 30 bp, Artificial Sequence
  Description of Artificial Sequence: Synthetic oligonucleotide
atggggtcatggatcggggctattcctatg

SEQ ID NO: 99053 - DNA, 29 bp, Artificial Sequence
  Description of Artificial Sequence: Synthetic oligonucleotide
tggggtcatggatcggggctattcctatg

SEQ ID NO: 99054 - DNA, 28 bp, Artificial Sequence
  Description of Artificial Sequence: Synthetic oligonucleotide
ggggtcatggatcggggctattcctatg

SEQ ID NO: 99055 - DNA, 29 bp, Artificial Sequence
  Description of Artificial Sequence: Synthetic oligonucleotide
gggtcatggatcggggctattcctatgac

SEQ ID NO: 99056 - DNA, 29 bp, Artificial Sequence
  Description of Artificial Sequence: Synthetic oligonucleotide
ggtcatggatcggggctattcctatgacc

SEQ ID NO: 99057 - DNA, 30 bp, Artificial Sequence
  Description of Artificial Sequence: Synthetic oligonucleotide
gtcatggatcggggctattcctatgacctg

SEQ ID NO: 99058 - DNA, 30 bp, Artificial Sequence
  Description of Artificial Sequence: Synthetic oligonucleotide
tcatggatcggggctattcctatgacctgg

SEQ ID NO: 99059 - DNA, 29 bp, Artificial Sequence
  Description of Artificial Sequence: Synthetic oligonucleotide
catggatcggggctattcctatgacctgg

SEQ ID NO: 99060 - DNA, 31 bp, Artificial Sequence
  Description of Artificial Sequence: Synthetic oligonucleotide
atggatcggggctattcctatgacctggaag

SEQ ID NO: 99061 - DNA, 30 bp, Artificial Sequence
  Description of Artificial Sequence: Synthetic oligonucleotide
tggatcggggctattcctatgacctggaag

SEQ ID NO: 99062 - DNA, 29 bp, Artificial Sequence
  Description of Artificial Sequence: Synthetic oligonucleotide
ggatcggggctattcctatgacctggaag

SEQ ID NO: 99063 - DNA, 30 bp, Artificial Sequence
  Description of Artificial Sequence: Synthetic oligonucleotide
gatcggggctattcctatgacctggaagtg

SEQ ID NO: 99064 - DNA, 30 bp, Artificial Sequence
  Description of Artificial Sequence: Synthetic oligonucleotide
atcggggctattcctatgacctggaagtgg

SEQ ID NO: 99065 - DNA, 29 bp, Artificial Sequence
  Description of Artificial Sequence: Synthetic oligonucleotide
tcggggctattcctatgacctggaagtgg

SEQ ID NO: 99066 - DNA, 28 bp, Artificial Sequence
  Description of Artificial Sequence: Synthetic oligonucleotide
cggggctattcctatgacctggaagtgg

SEQ ID NO: 99067 - DNA, 29 bp, Artificial Sequence
  Description of Artificial Sequence: Synthetic oligonucleotide
ggggctattcctatgacctggaagtggag

SEQ ID NO: 99068 - DNA, 29 bp, Artificial Sequence
  Description of Artificial Sequence: Synthetic oligonucleotide
gggctattcctatgacctggaagtggagc

SEQ ID NO: 99069 - DNA, 30 bp, Artificial Sequence
  Description of Artificial Sequence: Synthetic oligonucleotide
ggctattcctatgacctggaagtggagcag

SEQ ID NO: 99070 - DNA, 30 bp, Artificial Sequence
  Description of Artificial Sequence: Synthetic oligonucleotide
gctattcctatgacctggaagtggagcagg

SEQ ID NO: 99071 - DNA, 30 bp, Artificial Sequence
  Description of Artificial Sequence: Synthetic oligonucleotide
ctattcctatgacctggaagtggagcaggc

SEQ ID NO: 99072 - DNA, 30 bp, Artificial Sequence
  Description of Artificial Sequence: Synthetic oligonucleotide
tattcctatgacctggaagtggagcaggcc

SEQ ID NO: 99073 - DNA, 29 bp, Artificial Sequence
  Description of Artificial Sequence: Synthetic oligonucleotide
attcctatgacctggaagtggagcaggcc

SEQ ID NO: 99074 - DNA, 28 bp, Artificial Sequence
  Description of Artificial Sequence: Synthetic oligonucleotide
ttcctatgacctggaagtggagcaggcc

SEQ ID NO: 99075 - DNA, 27 bp, Artificial Sequence
  Description of Artificial Sequence: Synthetic oligonucleotide
tcctatgacctggaagtggagcaggcc

SEQ ID NO: 99076 - DNA, 27 bp, Artificial Sequence
  Description of Artificial Sequence: Synthetic oligonucleotide
cctatgacctggaagtggagcaggcct

SEQ ID NO: 99077 - DNA, 29 bp, Artificial Sequence
  Description of Artificial Sequence: Synthetic oligonucleotide
ctatgacctggaagtggagcaggcctatg

SEQ ID NO: 99078 - DNA, 31 bp, Artificial Sequence
  Description of Artificial Sequence: Synthetic oligonucleotide
tatgacctggaagtggagcaggcctatgatc

SEQ ID NO: 99079 - DNA, 30 bp, Artificial Sequence
  Description of Artificial Sequence: Synthetic oligonucleotide
atgacctggaagtggagcaggcctatgatc

SEQ ID NO: 99080 - DNA, 29 bp, Artificial Sequence
  Description of Artificial Sequence: Synthetic oligonucleotide
tgacctggaagtggagcaggcctatgatc

SEQ ID NO: 99081 - DNA, 28 bp, Artificial Sequence
  Description of Artificial Sequence: Synthetic oligonucleotide
gacctggaagtggagcaggcctatgatc

SEQ ID NO: 99082 - DNA, 29 bp, Artificial Sequence
  Description of Artificial Sequence: Synthetic oligonucleotide
acctggaagtggagcaggcctatgatctg

SEQ ID NO: 99083 - DNA, 28 bp, Artificial Sequence
  Description of Artificial Sequence: Synthetic oligonucleotide
cctggaagtggagcaggcctatgatctg

SEQ ID NO: 99084 - DNA, 28 bp, Artificial Sequence
  Description of Artificial Sequence: Synthetic oligonucleotide
ctggaagtggagcaggcctatgatctgg

SEQ ID NO: 99085 - DNA, 28 bp, Artificial Sequence
  Description of Artificial Sequence: Synthetic oligonucleotide
tggaagtggagcaggcctatgatctggc

SEQ ID NO: 99086 - DNA, 27 bp, Artificial Sequence
  Description of Artificial Sequence: Synthetic oligonucleotide
ggaagtggagcaggcctatgatctggc

SEQ ID NO: 99087 - DNA, 27 bp, Artificial Sequence
  Description of Artificial Sequence: Synthetic oligonucleotide
gaagtggagcaggcctatgatctggcc

SEQ ID NO: 99088 - DNA, 27 bp, Artificial Sequence
  Description of Artificial Sequence: Synthetic oligonucleotide
aagtggagcaggcctatgatctggccc

SEQ ID NO: 99089 - DNA, 26 bp, Artificial Sequence
  Description of Artificial Sequence: Synthetic oligonucleotide
agtggagcaggcctatgatctggccc

SEQ ID NO: 99090 - DNA, 25 bp, Artificial Sequence
  Description of Artificial Sequence: Synthetic oligonucleotide
gtggagcaggcctatgatctggccc

SEQ ID NO: 99091 - DNA, 26 bp, Artificial Sequence
  Description of Artificial Sequence: Synthetic oligonucleotide
tggagcaggcctatgatctggcccgt

SEQ ID NO: 99092 - DNA, 25 bp, Artificial Sequence
  Description of Artificial Sequence: Synthetic oligonucleotide
ggagcaggcctatgatctggcccgt

SEQ ID NO: 99093 - DNA, 25 bp, Artificial Sequence
  Description of Artificial Sequence: Synthetic oligonucleotide
gagcaggcctatgatctggcccgtc

SEQ ID NO: 99094 - DNA, 26 bp, Artificial Sequence
  Description of Artificial Sequence: Synthetic oligonucleotide
agcaggcctatgatctggcccgtcga

SEQ ID NO: 99095 - DNA, 25 bp, Artificial Sequence
  Description of Artificial Sequence: Synthetic oligonucleotide
gcaggcctatgatctggcccgtcga

SEQ ID NO: 99096 - DNA, 25 bp, Artificial Sequence
  Description of Artificial Sequence: Synthetic oligonucleotide
caggcctatgatctggcccgtcgag

SEQ ID NO: 99097 - DNA, 25 bp, Artificial Sequence
  Description of Artificial Sequence: Synthetic oligonucleotide
aggcctatgatctggcccgtcgagc

SEQ ID NO: 99098 - DNA, 24 bp, Artificial Sequence
  Description of Artificial Sequence: Synthetic oligonucleotide
ggcctatgatctggcccgtcgagc

SEQ ID NO: 99099 - DNA, 26 bp, Artificial Sequence
  Description of Artificial Sequence: Synthetic oligonucleotide
gcctatgatctggcccgtcgagccat

SEQ ID NO: 99100 - DNA, 27 bp, Artificial Sequence
  Description of Artificial Sequence: Synthetic oligonucleotide
cctatgatctggcccgtcgagccatct

SEQ ID NO: 99101 - DNA, 28 bp, Artificial Sequence
  Description of Artificial Sequence: Synthetic oligonucleotide
ctatgatctggcccgtcgagccatctac

SEQ ID NO: 99102 - DNA, 28 bp, Artificial Sequence
  Description of Artificial Sequence: Synthetic oligonucleotide
tatgatctggcccgtcgagccatctacc

SEQ ID NO: 99103 - DNA, 27 bp, Artificial Sequence
  Description of Artificial Sequence: Synthetic oligonucleotide
atgatctggcccgtcgagccatctacc

SEQ ID NO: 99104 - DNA, 27 bp, Artificial Sequence
  Description of Artificial Sequence: Synthetic oligonucleotide
tgatctggcccgtcgagccatctacca

SEQ ID NO: 99105 - DNA, 27 bp, Artificial Sequence
  Description of Artificial Sequence: Synthetic oligonucleotide
gatctggcccgtcgagccatctaccaa

SEQ ID NO: 99106 - DNA, 27 bp, Artificial Sequence
  Description of Artificial Sequence: Synthetic oligonucleotide
atctggcccgtcgagccatctaccaag

SEQ ID NO: 99107 - DNA, 26 bp, Artificial Sequence
  Description of Artificial Sequence: Synthetic oligonucleotide
tctggcccgtcgagccatctaccaag

SEQ ID NO: 99108 - DNA, 25 bp, Artificial Sequence
  Description of Artificial Sequence: Synthetic oligonucleotide
ctggcccgtcgagccatctaccaag

SEQ ID NO: 99109 - DNA, 25 bp, Artificial Sequence
  Description of Artificial Sequence: Synthetic oligonucleotide
tggcccgtcgagccatctaccaagc

SEQ ID NO: 99110 - DNA, 24 bp, Artificial Sequence
  Description of Artificial Sequence: Synthetic oligonucleotide
ggcccgtcgagccatctaccaagc

SEQ ID NO: 99111 - DNA, 25 bp, Artificial Sequence
  Description of Artificial Sequence: Synthetic oligonucleotide
gcccgtcgagccatctaccaagcca

SEQ ID NO: 99112 - DNA, 25 bp, Artificial Sequence
  Description of Artificial Sequence: Synthetic oligonucleotide
cccgtcgagccatctaccaagccac

SEQ ID NO: 99113 - DNA, 27 bp, Artificial Sequence
  Description of Artificial Sequence: Synthetic oligonucleotide
ccgtcgagccatctaccaagccaccta

SEQ ID NO: 99114 - DNA, 27 bp, Artificial Sequence
  Description of Artificial Sequence: Synthetic oligonucleotide
cgtcgagccatctaccaagccacctac

SEQ ID NO: 99115 - DNA, 28 bp, Artificial Sequence
  Description of Artificial Sequence: Synthetic oligonucleotide
gtcgagccatctaccaagccacctacag

SEQ ID NO: 99116 - DNA, 29 bp, Artificial Sequence
  Description of Artificial Sequence: Synthetic oligonucleotide
tcgagccatctaccaagccacctacagag

SEQ ID NO: 99117 - DNA, 28 bp, Artificial Sequence
  Description of Artificial Sequence: Synthetic oligonucleotide
cgagccatctaccaagccacctacagag

SEQ ID NO: 99118 - DNA, 30 bp, Artificial Sequence
  Description of Artificial Sequence: Synthetic oligonucleotide
gagccatctaccaagccacctacagagatg

SEQ ID NO: 99119 - DNA, 30 bp, Artificial Sequence
  Description of Artificial Sequence: Synthetic oligonucleotide
agccatctaccaagccacctacagagatgc

SEQ ID NO: 99120 - DNA, 29 bp, Artificial Sequence
  Description of Artificial Sequence: Synthetic oligonucleotide
gccatctaccaagccacctacagagatgc

SEQ ID NO: 99121 - DNA, 29 bp, Artificial Sequence
  Description of Artificial Sequence: Synthetic oligonucleotide
ccatctaccaagccacctacagagatgcc

SEQ ID NO: 99122 - DNA, 31 bp, Artificial Sequence
  Description of Artificial Sequence: Synthetic oligonucleotide
catctaccaagccacctacagagatgcctac

SEQ ID NO: 99123 - DNA, 32 bp, Artificial Sequence
  Description of Artificial Sequence: Synthetic oligonucleotide
atctaccaagccacctacagagatgcctactc

SEQ ID NO: 99124 - DNA, 31 bp, Artificial Sequence
  Description of Artificial Sequence: Synthetic oligonucleotide
tctaccaagccacctacagagatgcctactc

SEQ ID NO: 99125 - DNA, 30 bp, Artificial Sequence
  Description of Artificial Sequence: Synthetic oligonucleotide
ctaccaagccacctacagagatgcctactc

SEQ ID NO: 99126 - DNA, 31 bp, Artificial Sequence
  Description of Artificial Sequence: Synthetic oligonucleotide
taccaagccacctacagagatgcctactcag

SEQ ID NO: 99127 - DNA, 30 bp, Artificial Sequence
  Description of Artificial Sequence: Synthetic oligonucleotide
accaagccacctacagagatgcctactcag

SEQ ID NO: 99128 - DNA, 29 bp, Artificial Sequence
  Description of Artificial Sequence: Synthetic oligonucleotide
ccaagccacctacagagatgcctactcag

SEQ ID NO: 99129 - DNA, 29 bp, Artificial Sequence
  Description of Artificial Sequence: Synthetic oligonucleotide
caagccacctacagagatgcctactcagg

SEQ ID NO: 99130 - DNA, 30 bp, Artificial Sequence
  Description of Artificial Sequence: Synthetic oligonucleotide
aagccacctacagagatgcctactcaggag

SEQ ID NO: 99131 - DNA, 29 bp, Artificial Sequence
  Description of Artificial Sequence: Synthetic oligonucleotide
agccacctacagagatgcctactcaggag

SEQ ID NO: 99132 - DNA, 28 bp, Artificial Sequence
  Description of Artificial Sequence: Synthetic oligonucleotide
gccacctacagagatgcctactcaggag

SEQ ID NO: 99133 - DNA, 28 bp, Artificial Sequence
  Description of Artificial Sequence: Synthetic oligonucleotide
ccacctacagagatgcctactcaggagg

SEQ ID NO: 99134 - DNA, 29 bp, Artificial Sequence
  Description of Artificial Sequence: Synthetic oligonucleotide
cacctacagagatgcctactcaggaggtg

SEQ ID NO: 99135 - DNA, 29 bp, Artificial Sequence
  Description of Artificial Sequence: Synthetic oligonucleotide
acctacagagatgcctactcaggaggtgc

SEQ ID NO: 99136 - DNA, 28 bp, Artificial Sequence
  Description of Artificial Sequence: Synthetic oligonucleotide
cctacagagatgcctactcaggaggtgc

SEQ ID NO: 99137 - DNA, 29 bp, Artificial Sequence
  Description of Artificial Sequence: Synthetic oligonucleotide
ctacagagatgcctactcaggaggtgcag

SEQ ID NO: 99138 - DNA, 30 bp, Artificial Sequence
  Description of Artificial Sequence: Synthetic oligonucleotide
tacagagatgcctactcaggaggtgcagtc

SEQ ID NO: 99139 - DNA, 29 bp, Artificial Sequence
  Description of Artificial Sequence: Synthetic oligonucleotide
acagagatgcctactcaggaggtgcagtc

SEQ ID NO: 99140 - DNA, 28 bp, Artificial Sequence
  Description of Artificial Sequence: Synthetic oligonucleotide
cagagatgcctactcaggaggtgcagtc

SEQ ID NO: 99141 - DNA, 30 bp, Artificial Sequence
  Description of Artificial Sequence: Synthetic oligonucleotide
agagatgcctactcaggaggtgcagtcaac

SEQ ID NO: 99142 - DNA, 29 bp, Artificial Sequence
  Description of Artificial Sequence: Synthetic oligonucleotide
gagatgcctactcaggaggtgcagtcaac

SEQ ID NO: 99143 - DNA, 29 bp, Artificial Sequence
  Description of Artificial Sequence: Synthetic oligonucleotide
agatgcctactcaggaggtgcagtcaacc

SEQ ID NO: 99144 - DNA, 28 bp, Artificial Sequence
  Description of Artificial Sequence: Synthetic oligonucleotide
gatgcctactcaggaggtgcagtcaacc

SEQ ID NO: 99145 - DNA, 29 bp, Artificial Sequence
  Description of Artificial Sequence: Synthetic oligonucleotide
atgcctactcaggaggtgcagtcaacctc

SEQ ID NO: 99146 - DNA, 28 bp, Artificial Sequence
  Description of Artificial Sequence: Synthetic oligonucleotide
tgcctactcaggaggtgcagtcaacctc

SEQ ID NO: 99147 - DNA, 27 bp, Artificial Sequence
  Description of Artificial Sequence: Synthetic oligonucleotide
gcctactcaggaggtgcagtcaacctc

SEQ ID NO: 99148 - DNA, 29 bp, Artificial Sequence
  Description of Artificial Sequence: Synthetic oligonucleotide
cctactcaggaggtgcagtcaacctctac

SEQ ID NO: 99149 - DNA, 29 bp, Artificial Sequence
  Description of Artificial Sequence: Synthetic oligonucleotide
ctactcaggaggtgcagtcaacctctacc

SEQ ID NO: 99150 - DNA, 30 bp, Artificial Sequence
  Description of Artificial Sequence: Synthetic oligonucleotide
tactcaggaggtgcagtcaacctctaccac

SEQ ID NO: 99151 - DNA, 29 bp, Artificial Sequence
  Description of Artificial Sequence: Synthetic oligonucleotide
actcaggaggtgcagtcaacctctaccac

SEQ ID NO: 99152 - DNA, 28 bp, Artificial Sequence
  Description of Artificial Sequence: Synthetic oligonucleotide
ctcaggaggtgcagtcaacctctaccac

SEQ ID NO: 99153 - DNA, 28 bp, Artificial Sequence
  Description of Artificial Sequence: Synthetic oligonucleotide
tcaggaggtgcagtcaacctctaccacg

SEQ ID NO: 99154 - DNA, 27 bp, Artificial Sequence
  Description of Artificial Sequence: Synthetic oligonucleotide
caggaggtgcagtcaacctctaccacg

SEQ ID NO: 99155 - DNA, 28 bp, Artificial Sequence
  Description of Artificial Sequence: Synthetic oligonucleotide
aggaggtgcagtcaacctctaccacgtg

SEQ ID NO: 99156 - DNA, 27 bp, Artificial Sequence
  Description of Artificial Sequence: Synthetic oligonucleotide
ggaggtgcagtcaacctctaccacgtg

SEQ ID NO: 99157 - DNA, 27 bp, Artificial Sequence
  Description of Artificial Sequence: Synthetic oligonucleotide
gaggtgcagtcaacctctaccacgtgc

SEQ ID NO: 99158 - DNA, 27 bp, Artificial Sequence
  Description of Artificial Sequence: Synthetic oligonucleotide
aggtgcagtcaacctctaccacgtgcg

SEQ ID NO: 99159 - DNA, 26 bp, Artificial Sequence
  Description of Artificial Sequence: Synthetic oligonucleotide
ggtgcagtcaacctctaccacgtgcg

SEQ ID NO: 99160 - DNA, 26 bp, Artificial Sequence
  Description of Artificial Sequence: Synthetic oligonucleotide
gtgcagtcaacctctaccacgtgcgg

SEQ ID NO: 99161 - DNA, 27 bp, Artificial Sequence
  Description of Artificial Sequence: Synthetic oligonucleotide
tgcagtcaacctctaccacgtgcggga

SEQ ID NO: 99162 - DNA, 26 bp, Artificial Sequence
  Description of Artificial Sequence: Synthetic oligonucleotide
gcagtcaacctctaccacgtgcggga

SEQ ID NO: 99163 - DNA, 26 bp, Artificial Sequence
  Description of Artificial Sequence: Synthetic oligonucleotide
cagtcaacctctaccacgtgcgggag

SEQ ID NO: 99164 - DNA, 27 bp, Artificial Sequence
  Description of Artificial Sequence: Synthetic oligonucleotide
agtcaacctctaccacgtgcgggagga

SEQ ID NO: 99165 - DNA, 27 bp, Artificial Sequence
  Description of Artificial Sequence: Synthetic oligonucleotide
gtcaacctctaccacgtgcgggaggat

SEQ ID NO: 99166 - DNA, 27 bp, Artificial Sequence
  Description of Artificial Sequence: Synthetic oligonucleotide
tcaacctctaccacgtgcgggaggatg

SEQ ID NO: 99167 - DNA, 26 bp, Artificial Sequence
  Description of Artificial Sequence: Synthetic oligonucleotide
caacctctaccacgtgcgggaggatg

SEQ ID NO: 99168 - DNA, 26 bp, Artificial Sequence
  Description of Artificial Sequence: Synthetic oligonucleotide
aacctctaccacgtgcgggaggatgg

SEQ ID NO: 99169 - DNA, 25 bp, Artificial Sequence
  Description of Artificial Sequence: Synthetic oligonucleotide
acctctaccacgtgcgggaggatgg

SEQ ID NO: 99170 - DNA, 24 bp, Artificial Sequence
  Description of Artificial Sequence: Synthetic oligonucleotide
cctctaccacgtgcgggaggatgg

SEQ ID NO: 99171 - DNA, 25 bp, Artificial Sequence
  Description of Artificial Sequence: Synthetic oligonucleotide
ctctaccacgtgcgggaggatggct

SEQ ID NO: 99172 - DNA, 25 bp, Artificial Sequence
  Description of Artificial Sequence: Synthetic oligonucleotide
tctaccacgtgcgggaggatggctg

SEQ ID NO: 99173 - DNA, 24 bp, Artificial Sequence
  Description of Artificial Sequence: Synthetic oligonucleotide
ctaccacgtgcgggaggatggctg

SEQ ID NO: 99174 - DNA, 26 bp, Artificial Sequence
  Description of Artificial Sequence: Synthetic oligonucleotide
taccacgtgcgggaggatggctggat

SEQ ID NO: 99175 - DNA, 25 bp, Artificial Sequence
  Description of Artificial Sequence: Synthetic oligonucleotide
accacgtgcgggaggatggctggat

SEQ ID NO: 99176 - DNA, 24 bp, Artificial Sequence
  Description of Artificial Sequence: Synthetic oligonucleotide
ccacgtgcgggaggatggctggat

SEQ ID NO: 99177 - DNA, 24 bp, Artificial Sequence
  Description of Artificial Sequence: Synthetic oligonucleotide
cacgtgcgggaggatggctggatc

SEQ ID NO: 99178 - DNA, 24 bp, Artificial Sequence
  Description of Artificial Sequence: Synthetic oligonucleotide
acgtgcgggaggatggctggatcc

SEQ ID NO: 99179 - DNA, 23 bp, Artificial Sequence
  Description of Artificial Sequence: Synthetic oligonucleotide
cgtgcgggaggatggctggatcc

SEQ ID NO: 99180 - DNA, 24 bp, Artificial Sequence
  Description of Artificial Sequence: Synthetic oligonucleotide
gtgcgggaggatggctggatccga

SEQ ID NO: 99181 - DNA, 25 bp, Artificial Sequence
  Description of Artificial Sequence: Synthetic oligonucleotide
tgcgggaggatggctggatccgagt

SEQ ID NO: 99182 - DNA, 24 bp, Artificial Sequence
  Description of Artificial Sequence: Synthetic oligonucleotide
gcgggaggatggctggatccgagt

SEQ ID NO: 99183 - DNA, 25 bp, Artificial Sequence
  Description of Artificial Sequence: Synthetic oligonucleotide
cgggaggatggctggatccgagtct

SEQ ID NO: 99184 - DNA, 25 bp, Artificial Sequence
  Description of Artificial Sequence: Synthetic oligonucleotide
gggaggatggctggatccgagtctc

SEQ ID NO: 99185 - DNA, 26 bp, Artificial Sequence
  Description of Artificial Sequence: Synthetic oligonucleotide
ggaggatggctggatccgagtctcca

SEQ ID NO: 99186 - DNA, 27 bp, Artificial Sequence
  Description of Artificial Sequence: Synthetic oligonucleotide
gaggatggctggatccgagtctccagt

SEQ ID NO: 99187 - DNA, 27 bp, Artificial Sequence
  Description of Artificial Sequence: Synthetic oligonucleotide
aggatggctggatccgagtctccagtg

SEQ ID NO: 99188 - DNA, 27 bp, Artificial Sequence
  Description of Artificial Sequence: Synthetic oligonucleotide
ggatggctggatccgagtctccagtga

SEQ ID NO: 99189 - DNA, 27 bp, Artificial Sequence
  Description of Artificial Sequence: Synthetic oligonucleotide
gatggctggatccgagtctccagtgac

SEQ ID NO: 99190 - DNA, 30 bp, Artificial Sequence
  Description of Artificial Sequence: Synthetic oligonucleotide
atggctggatccgagtctccagtgacaatg

SEQ ID NO: 99191 - DNA, 29 bp, Artificial Sequence
  Description of Artificial Sequence: Synthetic oligonucleotide
tggctggatccgagtctccagtgacaatg

SEQ ID NO: 99192 - DNA, 28 bp, Artificial Sequence
  Description of Artificial Sequence: Synthetic oligonucleotide
ggctggatccgagtctccagtgacaatg

SEQ ID NO: 99193 - DNA, 29 bp, Artificial Sequence
  Description of Artificial Sequence: Synthetic oligonucleotide
gctggatccgagtctccagtgacaatgtg

SEQ ID NO: 99194 - DNA, 29 bp, Artificial Sequence
  Description of Artificial Sequence: Synthetic oligonucleotide
ctggatccgagtctccagtgacaatgtgg

SEQ ID NO: 99195 - DNA, 29 bp, Artificial Sequence
  Description of Artificial Sequence: Synthetic oligonucleotide
tggatccgagtctccagtgacaatgtggc

SEQ ID NO: 99196 - DNA, 28 bp, Artificial Sequence
  Description of Artificial Sequence: Synthetic oligonucleotide
ggatccgagtctccagtgacaatgtggc

SEQ ID NO: 99197 - DNA, 29 bp, Artificial Sequence
  Description of Artificial Sequence: Synthetic oligonucleotide
gatccgagtctccagtgacaatgtggctg

SEQ ID NO: 99198 - DNA, 31 bp, Artificial Sequence
  Description of Artificial Sequence: Synthetic oligonucleotide
atccgagtctccagtgacaatgtggctgatc

SEQ ID NO: 99199 - DNA, 30 bp, Artificial Sequence
  Description of Artificial Sequence: Synthetic oligonucleotide
tccgagtctccagtgacaatgtggctgatc

SEQ ID NO: 99200 - DNA, 29 bp, Artificial Sequence
  Description of Artificial Sequence: Synthetic oligonucleotide
ccgagtctccagtgacaatgtggctgatc

SEQ ID NO: 99201 - DNA, 31 bp, Artificial Sequence
  Description of Artificial Sequence: Synthetic oligonucleotide
cgagtctccagtgacaatgtggctgatctac

SEQ ID NO: 99202 - DNA, 33 bp, Artificial Sequence
  Description of Artificial Sequence: Synthetic oligonucleotide
gagtctccagtgacaatgtggctgatctacatg

SEQ ID NO: 99203 - DNA, 34 bp, Artificial Sequence
  Description of Artificial Sequence: Synthetic oligonucleotide
agtctccagtgacaatgtggctgatctacatgag

SEQ ID NO: 99204 - DNA, 33 bp, Artificial Sequence
  Description of Artificial Sequence: Synthetic oligonucleotide
gtctccagtgacaatgtggctgatctacatgag

SEQ ID NO: 99205 - DNA, 35 bp, Artificial Sequence
  Description of Artificial Sequence: Synthetic oligonucleotide
tctccagtgacaatgtggctgatctacatgagaag

SEQ ID NO: 99206 - DNA, 34 bp, Artificial Sequence
  Description of Artificial Sequence: Synthetic oligonucleotide
ctccagtgacaatgtggctgatctacatgagaag

SEQ ID NO: 99207 - DNA, 38 bp, Artificial Sequence
  Description of Artificial Sequence: Synthetic oligonucleotide
tccagtgacaatgtggctgatctacatgagaagtatag

SEQ ID NO: 99208 - DNA, 37 bp, Artificial Sequence
  Description of Artificial Sequence: Synthetic oligonucleotide
ccagtgacaatgtggctgatctacatgagaagtatag

SEQ ID NO: 99209 - DNA, 38 bp, Artificial Sequence
  Description of Artificial Sequence: Synthetic oligonucleotide
cagtgacaatgtggctgatctacatgagaagtatagtg

SEQ ID NO: 99210 - DNA, 38 bp, Artificial Sequence
  Description of Artificial Sequence: Synthetic oligonucleotide
agtgacaatgtggctgatctacatgagaagtatagtgg

SEQ ID NO: 99211 - DNA, 37 bp, Artificial Sequence
  Description of Artificial Sequence: Synthetic oligonucleotide
gtgacaatgtggctgatctacatgagaagtatagtgg

SEQ ID NO: 99212 - DNA, 37 bp, Artificial Sequence
  Description of Artificial Sequence: Synthetic oligonucleotide
tgacaatgtggctgatctacatgagaagtatagtggc

SEQ ID NO: 99213 - DNA, 36 bp, Artificial Sequence
  Description of Artificial Sequence: Synthetic oligonucleotide
gacaatgtggctgatctacatgagaagtatagtggc

SEQ ID NO: 99214 - DNA, 37 bp, Artificial Sequence
  Description of Artificial Sequence: Synthetic oligonucleotide
acaatgtggctgatctacatgagaagtatagtggctc

SEQ ID NO: 99215 - DNA, 36 bp, Artificial Sequence
  Description of Artificial Sequence: Synthetic oligonucleotide
caatgtggctgatctacatgagaagtatagtggctc

SEQ ID NO: 99216 - DNA, 38 bp, Artificial Sequence
  Description of Artificial Sequence: Synthetic oligonucleotide
aatgtggctgatctacatgagaagtatagtggctctac

SEQ ID NO: 99217 - DNA, 37 bp, Artificial Sequence
  Description of Artificial Sequence: Synthetic oligonucleotide
atgtggctgatctacatgagaagtatagtggctctac

SEQ ID NO: 99218 - DNA, 36 bp, Artificial Sequence
  Description of Artificial Sequence: Synthetic oligonucleotide
tgtggctgatctacatgagaagtatagtggctctac

SEQ ID NO: 99219 - DNA, 35 bp, Artificial Sequence
  Description of Artificial Sequence: Synthetic oligonucleotide
gtggctgatctacatgagaagtatagtggctctac

SEQ ID NO: 99220 - DNA, 35 bp, Artificial Sequence
  Description of Artificial Sequence: Synthetic oligonucleotide
tggctgatctacatgagaagtatagtggctctacc

SEQ ID NO: 99221 - DNA, 34 bp, Artificial Sequence
  Description of Artificial Sequence: Synthetic oligonucleotide
ggctgatctacatgagaagtatagtggctctacc

SEQ ID NO: 99222 - DNA, 34 bp, Artificial Sequence
  Description of Artificial Sequence: Synthetic oligonucleotide
gctgatctacatgagaagtatagtggctctaccc

SEQ ID NO: 99223 - DNA, 34 bp, Artificial Sequence
  Description of Artificial Sequence: Synthetic oligonucleotide
ctgatctacatgagaagtatagtggctctacccc

SEQ ID NO: 99224 - DNA, 34 bp, Artificial Sequence
  Description of Artificial Sequence: Synthetic oligonucleotide
tgatctacatgagaagtatagtggctctaccccc

SEQ ID NO: 99225 - DNA, 33 bp, Artificial Sequence
  Description of Artificial Sequence: Synthetic oligonucleotide
gatctacatgagaagtatagtggctctaccccc

SEQ ID NO: 99226 - DNA, 34 bp, Artificial Sequence
  Description of Artificial Sequence: Synthetic oligonucleotide
atctacatgagaagtatagtggctctaccccctg

SEQ ID NO: 99227 - DNA, 33 bp, Artificial Sequence
  Description of Artificial Sequence: Synthetic oligonucleotide
tctacatgagaagtatagtggctctaccccctg

SEQ ID NO: 99228 - DNA, 32 bp, Artificial Sequence
  Description of Artificial Sequence: Synthetic oligonucleotide
ctacatgagaagtatagtggctctaccccctg

SEQ ID NO: 99229 - DNA, 27 bp, Artificial Sequence
  Description of Artificial Sequence: Synthetic oligonucleotide
ctgtggctgggataagagaggccctgt

SEQ ID NO: 99230 - DNA, 27 bp, Artificial Sequence
  Description of Artificial Sequence: Synthetic oligonucleotide
tgtggctgggataagagaggccctgtg

SEQ ID NO: 99231 - DNA, 27 bp, Artificial Sequence
  Description of Artificial Sequence: Synthetic oligonucleotide
gtggctgggataagagaggccctgtgt

SEQ ID NO: 99232 - DNA, 27 bp, Artificial Sequence
  Description of Artificial Sequence: Synthetic oligonucleotide
tggctgggataagagaggccctgtgtc

SEQ ID NO: 99233 - DNA, 27 bp, Artificial Sequence
  Description of Artificial Sequence: Synthetic oligonucleotide
ggctgggataagagaggccctgtgtct

SEQ ID NO: 99234 - DNA, 27 bp, Artificial Sequence
  Description of Artificial Sequence: Synthetic oligonucleotide
gctgggataagagaggccctgtgtctg

SEQ ID NO: 99235 - DNA, 29 bp, Artificial Sequence
  Description of Artificial Sequence: Synthetic oligonucleotide
ctgggataagagaggccctgtgtctgaag

SEQ ID NO: 99236 - DNA, 31 bp, Artificial Sequence
  Description of Artificial Sequence: Synthetic oligonucleotide
tgggataagagaggccctgtgtctgaagttc

SEQ ID NO: 99237 - DNA, 30 bp, Artificial Sequence
  Description of Artificial Sequence: Synthetic oligonucleotide
gggataagagaggccctgtgtctgaagttc

SEQ ID NO: 99238 - DNA, 31 bp, Artificial Sequence
  Description of Artificial Sequence: Synthetic oligonucleotide
ggataagagaggccctgtgtctgaagttctg

SEQ ID NO: 99239 - DNA, 32 bp, Artificial Sequence
  Description of Artificial Sequence: Synthetic oligonucleotide
gataagagaggccctgtgtctgaagttctgtg

SEQ ID NO: 99240 - DNA, 32 bp, Artificial Sequence
  Description of Artificial Sequence: Synthetic oligonucleotide
ataagagaggccctgtgtctgaagttctgtgc

SEQ ID NO: 99241 - DNA, 31 bp, Artificial Sequence
  Description of Artificial Sequence: Synthetic oligonucleotide
taagagaggccctgtgtctgaagttctgtgc

SEQ ID NO: 99242 - DNA, 30 bp, Artificial Sequence
  Description of Artificial Sequence: Synthetic oligonucleotide
aagagaggccctgtgtctgaagttctgtgc

SEQ ID NO: 99243 - DNA, 29 bp, Artificial Sequence
  Description of Artificial Sequence: Synthetic oligonucleotide
agagaggccctgtgtctgaagttctgtgc

SEQ ID NO: 99244 - DNA, 28 bp, Artificial Sequence
  Description of Artificial Sequence: Synthetic oligonucleotide
gagaggccctgtgtctgaagttctgtgc

SEQ ID NO: 99245 - DNA, 30 bp, Artificial Sequence
  Description of Artificial Sequence: Synthetic oligonucleotide
agaggccctgtgtctgaagttctgtgcttg

SEQ ID NO: 99246 - DNA, 29 bp, Artificial Sequence
  Description of Artificial Sequence: Synthetic oligonucleotide
gaggccctgtgtctgaagttctgtgcttg

SEQ ID NO: 99247 - DNA, 32 bp, Artificial Sequence
  Description of Artificial Sequence: Synthetic oligonucleotide
aggccctgtgtctgaagttctgtgcttgaaac

SEQ ID NO: 99248 - DNA, 31 bp, Artificial Sequence
  Description of Artificial Sequence: Synthetic oligonucleotide
ggccctgtgtctgaagttctgtgcttgaaac

SEQ ID NO: 99249 - DNA, 31 bp, Artificial Sequence
  Description of Artificial Sequence: Synthetic oligonucleotide
gccctgtgtctgaagttctgtgcttgaaacc

SEQ ID NO: 99250 - DNA, 34 bp, Artificial Sequence
  Description of Artificial Sequence: Synthetic oligonucleotide
ccctgtgtctgaagttctgtgcttgaaacctaag

SEQ ID NO: 99251 - DNA, 35 bp, Artificial Sequence
  Description of Artificial Sequence: Synthetic oligonucleotide
cctgtgtctgaagttctgtgcttgaaacctaagtc

SEQ ID NO: 99252 - DNA, 39 bp, Artificial Sequence
  Description of Artificial Sequence: Synthetic oligonucleotide
ctgtgtctgaagttctgtgcttgaaacctaagtcatttg

SEQ ID NO: 99253 - DNA, 39 bp, Artificial Sequence
  Description of Artificial Sequence: Synthetic oligonucleotide
tgtgtctgaagttctgtgcttgaaacctaagtcatttgg

SEQ ID NO: 99254 - DNA, 38 bp, Artificial Sequence
  Description of Artificial Sequence: Synthetic oligonucleotide
gtgtctgaagttctgtgcttgaaacctaagtcatttgg

SEQ ID NO: 99255 - DNA, 41 bp, Artificial Sequence
  Description of Artificial Sequence: Synthetic oligonucleotide
tgtctgaagttctgtgcttgaaacctaagtcatttggaatg

SEQ ID NO: 99256 - DNA, 40 bp, Artificial Sequence
  Description of Artificial Sequence: Synthetic oligonucleotide
gtctgaagttctgtgcttgaaacctaagtcatttggaatg

SEQ ID NO: 99257 - DNA, 42 bp, Artificial Sequence
  Description of Artificial Sequence: Synthetic oligonucleotide
tctgaagttctgtgcttgaaacctaagtcatttggaatgtac

SEQ ID NO: 99258 - DNA, 41 bp, Artificial Sequence
  Description of Artificial Sequence: Synthetic oligonucleotide
ctgaagttctgtgcttgaaacctaagtcatttggaatgtac

SEQ ID NO: 99259 - DNA, 43 bp, Artificial Sequence
  Description of Artificial Sequence: Synthetic oligonucleotide
tgaagttctgtgcttgaaacctaagtcatttggaatgtacttg

SEQ ID NO: 99260 - DNA, 42 bp, Artificial Sequence
  Description of Artificial Sequence: Synthetic oligonucleotide
gaagttctgtgcttgaaacctaagtcatttggaatgtacttg

SEQ ID NO: 99261 - DNA, 46 bp, Artificial Sequence
  Description of Artificial Sequence: Synthetic oligonucleotide
aagttctgtgcttgaaacctaagtcatttggaatgtacttgttttg

SEQ ID NO: 99262 - DNA, 45 bp, Artificial Sequence
  Description of Artificial Sequence: Synthetic oligonucleotide
agttctgtgcttgaaacctaagtcatttggaatgtacttgttttg

SEQ ID NO: 99263 - DNA, 44 bp, Artificial Sequence
  Description of Artificial Sequence: Synthetic oligonucleotide
gttctgtgcttgaaacctaagtcatttggaatgtacttgttttg

SEQ ID NO: 99264 - DNA, 45 bp, Artificial Sequence
  Description of Artificial Sequence: Synthetic oligonucleotide
ttctgtgcttgaaacctaagtcatttggaatgtacttgttttgtg

SEQ ID NO: 99265 - DNA, 44 bp, Artificial Sequence
  Description of Artificial Sequence: Synthetic oligonucleotide
tctgtgcttgaaacctaagtcatttggaatgtacttgttttgtg

SEQ ID NO: 99266 - DNA, 43 bp, Artificial Sequence
  Description of Artificial Sequence: Synthetic oligonucleotide
ctgtgcttgaaacctaagtcatttggaatgtacttgttttgtg

SEQ ID NO: 99267 - DNA, 43 bp, Artificial Sequence
  Description of Artificial Sequence: Synthetic oligonucleotide
tgtgcttgaaacctaagtcatttggaatgtacttgttttgtgg

SEQ ID NO: 99268 - DNA, 42 bp, Artificial Sequence
  Description of Artificial Sequence: Synthetic oligonucleotide
gtgcttgaaacctaagtcatttggaatgtacttgttttgtgg

SEQ ID NO: 99269 - DNA, 42 bp, Artificial Sequence
  Description of Artificial Sequence: Synthetic oligonucleotide
tgcttgaaacctaagtcatttggaatgtacttgttttgtggg

SEQ ID NO: 99270 - DNA, 41 bp, Artificial Sequence
  Description of Artificial Sequence: Synthetic oligonucleotide
gcttgaaacctaagtcatttggaatgtacttgttttgtggg

SEQ ID NO: 99271 - DNA, 42 bp, Artificial Sequence
  Description of Artificial Sequence: Synthetic oligonucleotide
cttgaaacctaagtcatttggaatgtacttgttttgtgggtg

SEQ ID NO: 99272 - DNA, 43 bp, Artificial Sequence
  Description of Artificial Sequence: Synthetic oligonucleotide
ttgaaacctaagtcatttggaatgtacttgttttgtgggtgtg

SEQ ID NO: 99273 - DNA, 42 bp, Artificial Sequence
  Description of Artificial Sequence: Synthetic oligonucleotide
tgaaacctaagtcatttggaatgtacttgttttgtgggtgtg

SEQ ID NO: 99274 - DNA, 41 bp, Artificial Sequence
  Description of Artificial Sequence: Synthetic oligonucleotide
gaaacctaagtcatttggaatgtacttgttttgtgggtgtg

SEQ ID NO: 99275 - DNA, 41 bp, Artificial Sequence
  Description of Artificial Sequence: Synthetic oligonucleotide
aaacctaagtcatttggaatgtacttgttttgtgggtgtgc

SEQ ID NO: 99276 - DNA, 40 bp, Artificial Sequence
  Description of Artificial Sequence: Synthetic oligonucleotide
aacctaagtcatttggaatgtacttgttttgtgggtgtgc

SEQ ID NO: 99277 - DNA, 39 bp, Artificial Sequence
  Description of Artificial Sequence: Synthetic oligonucleotide
acctaagtcatttggaatgtacttgttttgtgggtgtgc

SEQ ID NO: 99278 - DNA, 38 bp, Artificial Sequence
  Description of Artificial Sequence: Synthetic oligonucleotide
cctaagtcatttggaatgtacttgttttgtgggtgtgc

SEQ ID NO: 99279 - DNA, 39 bp, Artificial Sequence
  Description of Artificial Sequence: Synthetic oligonucleotide
ctaagtcatttggaatgtacttgttttgtgggtgtgctg

SEQ ID NO: 99280 - DNA, 40 bp, Artificial Sequence
  Description of Artificial Sequence: Synthetic oligonucleotide
taagtcatttggaatgtacttgttttgtgggtgtgctgag

SEQ ID NO: 99281 - DNA, 39 bp, Artificial Sequence
  Description of Artificial Sequence: Synthetic oligonucleotide
aagtcatttggaatgtacttgttttgtgggtgtgctgag

SEQ ID NO: 99282 - DNA, 38 bp, Artificial Sequence
  Description of Artificial Sequence: Synthetic oligonucleotide
agtcatttggaatgtacttgttttgtgggtgtgctgag

SEQ ID NO: 99283 - DNA, 37 bp, Artificial Sequence
  Description of Artificial Sequence: Synthetic oligonucleotide
gtcatttggaatgtacttgttttgtgggtgtgctgag

SEQ ID NO: 99284 - DNA, 38 bp, Artificial Sequence
  Description of Artificial Sequence: Synthetic oligonucleotide
tcatttggaatgtacttgttttgtgggtgtgctgagag

SEQ ID NO: 99285 - DNA, 37 bp, Artificial Sequence
  Description of Artificial Sequence: Synthetic oligonucleotide
catttggaatgtacttgttttgtgggtgtgctgagag

SEQ ID NO: 99286 - DNA, 37 bp, Artificial Sequence
  Description of Artificial Sequence: Synthetic oligonucleotide
atttggaatgtacttgttttgtgggtgtgctgagagg

SEQ ID NO: 99287 - DNA, 36 bp, Artificial Sequence
  Description of Artificial Sequence: Synthetic oligonucleotide
tttggaatgtacttgttttgtgggtgtgctgagagg

SEQ ID NO: 99288 - DNA, 35 bp, Artificial Sequence
  Description of Artificial Sequence: Synthetic oligonucleotide
ttggaatgtacttgttttgtgggtgtgctgagagg

SEQ ID NO: 99289 - DNA, 34 bp, Artificial Sequence
  Description of Artificial Sequence: Synthetic oligonucleotide
tggaatgtacttgttttgtgggtgtgctgagagg

SEQ ID NO: 99290 - DNA, 33 bp, Artificial Sequence
  Description of Artificial Sequence: Synthetic oligonucleotide
ggaatgtacttgttttgtgggtgtgctgagagg

SEQ ID NO: 99291 - DNA, 35 bp, Artificial Sequence
  Description of Artificial Sequence: Synthetic oligonucleotide
gaatgtacttgttttgtgggtgtgctgagaggatc

SEQ ID NO: 99292 - DNA, 35 bp, Artificial Sequence
  Description of Artificial Sequence: Synthetic oligonucleotide
aatgtacttgttttgtgggtgtgctgagaggatcg

SEQ ID NO: 99293 - DNA, 34 bp, Artificial Sequence
  Description of Artificial Sequence: Synthetic oligonucleotide
atgtacttgttttgtgggtgtgctgagaggatcg

SEQ ID NO: 99294 - DNA, 33 bp, Artificial Sequence
  Description of Artificial Sequence: Synthetic oligonucleotide
tgtacttgttttgtgggtgtgctgagaggatcg

SEQ ID NO: 99295 - DNA, 32 bp, Artificial Sequence
  Description of Artificial Sequence: Synthetic oligonucleotide
gtacttgttttgtgggtgtgctgagaggatcg

SEQ ID NO: 99296 - DNA, 32 bp, Artificial Sequence
  Description of Artificial Sequence: Synthetic oligonucleotide
tacttgttttgtgggtgtgctgagaggatcgg

SEQ ID NO: 99297 - DNA, 31 bp, Artificial Sequence
  Description of Artificial Sequence: Synthetic oligonucleotide
acttgttttgtgggtgtgctgagaggatcgg

SEQ ID NO: 99298 - DNA, 30 bp, Artificial Sequence
  Description of Artificial Sequence: Synthetic oligonucleotide
cttgttttgtgggtgtgctgagaggatcgg

SEQ ID NO: 99299 - DNA, 30 bp, Artificial Sequence
  Description of Artificial Sequence: Synthetic oligonucleotide
ttgttttgtgggtgtgctgagaggatcggc

SEQ ID NO: 99300 - DNA, 29 bp, Artificial Sequence
  Description of Artificial Sequence: Synthetic oligonucleotide
tgttttgtgggtgtgctgagaggatcggc

SEQ ID NO: 99301 - DNA, 28 bp, Artificial Sequence
  Description of Artificial Sequence: Synthetic oligonucleotide
gttttgtgggtgtgctgagaggatcggc

SEQ ID NO: 99302 - DNA, 30 bp, Artificial Sequence
  Description of Artificial Sequence: Synthetic oligonucleotide
ttttgtgggtgtgctgagaggatcggcaac

SEQ ID NO: 99303 - DNA, 29 bp, Artificial Sequence
  Description of Artificial Sequence: Synthetic oligonucleotide
tttgtgggtgtgctgagaggatcggcaac

SEQ ID NO: 99304 - DNA, 28 bp, Artificial Sequence
  Description of Artificial Sequence: Synthetic oligonucleotide
ttgtgggtgtgctgagaggatcggcaac

SEQ ID NO: 99305 - DNA, 27 bp, Artificial Sequence
  Description of Artificial Sequence: Synthetic oligonucleotide
tgtgggtgtgctgagaggatcggcaac

SEQ ID NO: 99306 - DNA, 27 bp, Artificial Sequence
  Description of Artificial Sequence: Synthetic oligonucleotide
gtgggtgtgctgagaggatcggcaaca

SEQ ID NO: 99307 - DNA, 28 bp, Artificial Sequence
  Description of Artificial Sequence: Synthetic oligonucleotide
tgggtgtgctgagaggatcggcaacatg

SEQ ID NO: 99308 - DNA, 27 bp, Artificial Sequence
  Description of Artificial Sequence: Synthetic oligonucleotide
gggtgtgctgagaggatcggcaacatg

SEQ ID NO: 99309 - DNA, 27 bp, Artificial Sequence
  Description of Artificial Sequence: Synthetic oligonucleotide
ggtgtgctgagaggatcggcaacatgg

SEQ ID NO: 99310 - DNA, 27 bp, Artificial Sequence
  Description of Artificial Sequence: Synthetic oligonucleotide
gtgtgctgagaggatcggcaacatggc

SEQ ID NO: 99311 - DNA, 29 bp, Artificial Sequence
  Description of Artificial Sequence: Synthetic oligonucleotide
tgtgctgagaggatcggcaacatggcaag

SEQ ID NO: 99312 - DNA, 28 bp, Artificial Sequence
  Description of Artificial Sequence: Synthetic oligonucleotide
gtgctgagaggatcggcaacatggcaag

SEQ ID NO: 99313 - DNA, 28 bp, Artificial Sequence
  Description of Artificial Sequence: Synthetic oligonucleotide
tgctgagaggatcggcaacatggcaagg

SEQ ID NO: 99314 - DNA, 27 bp, Artificial Sequence
  Description of Artificial Sequence: Synthetic oligonucleotide
gctgagaggatcggcaacatggcaagg

SEQ ID NO: 99315 - DNA, 27 bp, Artificial Sequence
  Description of Artificial Sequence: Synthetic oligonucleotide
ctgagaggatcggcaacatggcaaggc

SEQ ID NO: 99316 - DNA, 27 bp, Artificial Sequence
  Description of Artificial Sequence: Synthetic oligonucleotide
tgagaggatcggcaacatggcaaggcc

SEQ ID NO: 99317 - DNA, 27 bp, Artificial Sequence
  Description of Artificial Sequence: Synthetic oligonucleotide
gagaggatcggcaacatggcaaggcct

SEQ ID NO: 99318 - DNA, 27 bp, Artificial Sequence
  Description of Artificial Sequence: Synthetic oligonucleotide
agaggatcggcaacatggcaaggcctc

SEQ ID NO: 99319 - DNA, 27 bp, Artificial Sequence
  Description of Artificial Sequence: Synthetic oligonucleotide
gaggatcggcaacatggcaaggcctct

SEQ ID NO: 99320 - DNA, 28 bp, Artificial Sequence
  Description of Artificial Sequence: Synthetic oligonucleotide
aggatcggcaacatggcaaggcctctac

SEQ ID NO: 99321 - DNA, 27 bp, Artificial Sequence
  Description of Artificial Sequence: Synthetic oligonucleotide
ggatcggcaacatggcaaggcctctac

SEQ ID NO: 99322 - DNA, 29 bp, Artificial Sequence
  Description of Artificial Sequence: Synthetic oligonucleotide
gatcggcaacatggcaaggcctctactac

SEQ ID NO: 99323 - DNA, 29 bp, Artificial Sequence
  Description of Artificial Sequence: Synthetic oligonucleotide
atcggcaacatggcaaggcctctactacg

SEQ ID NO: 99324 - DNA, 28 bp, Artificial Sequence
  Description of Artificial Sequence: Synthetic oligonucleotide
tcggcaacatggcaaggcctctactacg

SEQ ID NO: 99325 - DNA, 27 bp, Artificial Sequence
  Description of Artificial Sequence: Synthetic oligonucleotide
cggcaacatggcaaggcctctactacg

SEQ ID NO: 99326 - DNA, 28 bp, Artificial Sequence
  Description of Artificial Sequence: Synthetic oligonucleotide
ggcaacatggcaaggcctctactacgtg

SEQ ID NO: 99327 - DNA, 28 bp, Artificial Sequence
  Description of Artificial Sequence: Synthetic oligonucleotide
gcaacatggcaaggcctctactacgtgg

SEQ ID NO: 99328 - DNA, 29 bp, Artificial Sequence
  Description of Artificial Sequence: Synthetic oligonucleotide
caacatggcaaggcctctactacgtggac

SEQ ID NO: 99329 - DNA, 30 bp, Artificial Sequence
  Description of Artificial Sequence: Synthetic oligonucleotide
aacatggcaaggcctctactacgtggacag

SEQ ID NO: 99330 - DNA, 29 bp, Artificial Sequence
  Description of Artificial Sequence: Synthetic oligonucleotide
acatggcaaggcctctactacgtggacag

SEQ ID NO: 99331 - DNA, 28 bp, Artificial Sequence
  Description of Artificial Sequence: Synthetic oligonucleotide
catggcaaggcctctactacgtggacag

SEQ ID NO: 99332 - DNA, 29 bp, Artificial Sequence
  Description of Artificial Sequence: Synthetic oligonucleotide
atggcaaggcctctactacgtggacagtg

SEQ ID NO: 99333 - DNA, 28 bp, Artificial Sequence
  Description of Artificial Sequence: Synthetic oligonucleotide
tggcaaggcctctactacgtggacagtg

SEQ ID NO: 99334 - DNA, 27 bp, Artificial Sequence
  Description of Artificial Sequence: Synthetic oligonucleotide
ggcaaggcctctactacgtggacagtg

SEQ ID NO: 99335 - DNA, 25 bp, Artificial Sequence
  Description of Artificial Sequence: Synthetic oligonucleotide
atgctcataggaacccccaccccgc

SEQ ID NO: 99336 - DNA, 24 bp, Artificial Sequence
  Description of Artificial Sequence: Synthetic oligonucleotide
tgctcataggaacccccaccccgc

SEQ ID NO: 99337 - DNA, 23 bp, Artificial Sequence
  Description of Artificial Sequence: Synthetic oligonucleotide
gctcataggaacccccaccccgc

SEQ ID NO: 99338 - DNA, 24 bp, Artificial Sequence
  Description of Artificial Sequence: Synthetic oligonucleotide
ctcataggaacccccaccccgcgt

SEQ ID NO: 99339 - DNA, 25 bp, Artificial Sequence
  Description of Artificial Sequence: Synthetic oligonucleotide
tcataggaacccccaccccgcgtga

SEQ ID NO: 99340 - DNA, 24 bp, Artificial Sequence
  Description of Artificial Sequence: Synthetic oligonucleotide
cataggaacccccaccccgcgtga

SEQ ID NO: 99341 - DNA, 25 bp, Artificial Sequence
  Description of Artificial Sequence: Synthetic oligonucleotide
ataggaacccccaccccgcgtgaca

SEQ ID NO: 99342 - DNA, 24 bp, Artificial Sequence
  Description of Artificial Sequence: Synthetic oligonucleotide
taggaacccccaccccgcgtgaca

SEQ ID NO: 99343 - DNA, 23 bp, Artificial Sequence
  Description of Artificial Sequence: Synthetic oligonucleotide
aggaacccccaccccgcgtgaca

SEQ ID NO: 99344 - DNA, 22 bp, Artificial Sequence
  Description of Artificial Sequence: Synthetic oligonucleotide
ggaacccccaccccgcgtgaca

SEQ ID NO: 99345 - DNA, 24 bp, Artificial Sequence
  Description of Artificial Sequence: Synthetic oligonucleotide
gaacccccaccccgcgtgacacta

SEQ ID NO: 99346 - DNA, 25 bp, Artificial Sequence
  Description of Artificial Sequence: Synthetic oligonucleotide
aacccccaccccgcgtgacactact

SEQ ID NO: 99347 - DNA, 24 bp, Artificial Sequence
  Description of Artificial Sequence: Synthetic oligonucleotide
acccccaccccgcgtgacactact

SEQ ID NO: 99348 - DNA, 23 bp, Artificial Sequence
  Description of Artificial Sequence: Synthetic oligonucleotide
cccccaccccgcgtgacactact

SEQ ID NO: 99349 - DNA, 23 bp, Artificial Sequence
  Description of Artificial Sequence: Synthetic oligonucleotide
ccccaccccgcgtgacactactc

SEQ ID NO: 99350 - DNA, 23 bp, Artificial Sequence
  Description of Artificial Sequence: Synthetic oligonucleotide
cccaccccgcgtgacactactcc

SEQ ID NO: 99351 - DNA, 24 bp, Artificial Sequence
  Description of Artificial Sequence: Synthetic oligonucleotide
ccaccccgcgtgacactactccca

SEQ ID NO: 99352 - DNA, 24 bp, Artificial Sequence
  Description of Artificial Sequence: Synthetic oligonucleotide
caccccgcgtgacactactcccag

SEQ ID NO: 99353 - DNA, 25 bp, Artificial Sequence
  Description of Artificial Sequence: Synthetic oligonucleotide
accccgcgtgacactactcccagct

SEQ ID NO: 99354 - DNA, 24 bp, Artificial Sequence
  Description of Artificial Sequence: Synthetic oligonucleotide
ccccgcgtgacactactcccagct

SEQ ID NO: 99355 - DNA, 24 bp, Artificial Sequence
  Description of Artificial Sequence: Synthetic oligonucleotide
cccgcgtgacactactcccagctc

SEQ ID NO: 99356 - DNA, 25 bp, Artificial Sequence
  Description of Artificial Sequence: Synthetic oligonucleotide
ccgcgtgacactactcccagctcct

SEQ ID NO: 99357 - DNA, 25 bp, Artificial Sequence
  Description of Artificial Sequence: Synthetic oligonucleotide
cgcgtgacactactcccagctcctg

SEQ ID NO: 99358 - DNA, 25 bp, Artificial Sequence
  Description of Artificial Sequence: Synthetic oligonucleotide
gcgtgacactactcccagctcctgg

SEQ ID NO: 99359 - DNA, 26 bp, Artificial Sequence
  Description of Artificial Sequence: Synthetic oligonucleotide
cgtgacactactcccagctcctggct

SEQ ID NO: 99360 - DNA, 27 bp, Artificial Sequence
  Description of Artificial Sequence: Synthetic oligonucleotide
gtgacactactcccagctcctggctga

SEQ ID NO: 99361 - DNA, 27 bp, Artificial Sequence
  Description of Artificial Sequence: Synthetic oligonucleotide
tgacactactcccagctcctggctgac

SEQ ID NO: 99362 - DNA, 27 bp, Artificial Sequence
  Description of Artificial Sequence: Synthetic oligonucleotide
gacactactcccagctcctggctgact

SEQ ID NO: 99363 - DNA, 28 bp, Artificial Sequence
  Description of Artificial Sequence: Synthetic oligonucleotide
acactactcccagctcctggctgacttc

SEQ ID NO: 99364 - DNA, 27 bp, Artificial Sequence
  Description of Artificial Sequence: Synthetic oligonucleotide
cactactcccagctcctggctgacttc

SEQ ID NO: 99365 - DNA, 29 bp, Artificial Sequence
  Description of Artificial Sequence: Synthetic oligonucleotide
actactcccagctcctggctgacttctag

SEQ ID NO: 99366 - DNA, 28 bp, Artificial Sequence
  Description of Artificial Sequence: Synthetic oligonucleotide
ctactcccagctcctggctgacttctag

SEQ ID NO: 99367 - DNA, 29 bp, Artificial Sequence
  Description of Artificial Sequence: Synthetic oligonucleotide
tactcccagctcctggctgacttctagtc

SEQ ID NO: 99368 - DNA, 28 bp, Artificial Sequence
  Description of Artificial Sequence: Synthetic oligonucleotide
actcccagctcctggctgacttctagtc

SEQ ID NO: 99369 - DNA, 27 bp, Artificial Sequence
  Description of Artificial Sequence: Synthetic oligonucleotide
ctcccagctcctggctgacttctagtc

SEQ ID NO: 99370 - DNA, 29 bp, Artificial Sequence
  Description of Artificial Sequence: Synthetic oligonucleotide
tcccagctcctggctgacttctagtcttc

SEQ ID NO: 99371 - DNA, 28 bp, Artificial Sequence
  Description of Artificial Sequence: Synthetic oligonucleotide
cccagctcctggctgacttctagtcttc

SEQ ID NO: 99372 - DNA, 29 bp, Artificial Sequence
  Description of Artificial Sequence: Synthetic oligonucleotide
ccagctcctggctgacttctagtcttctg

SEQ ID NO: 99373 - DNA, 29 bp, Artificial Sequence
  Description of Artificial Sequence: Synthetic oligonucleotide
cagctcctggctgacttctagtcttctgg

SEQ ID NO: 99374 - DNA, 31 bp, Artificial Sequence
  Description of Artificial Sequence: Synthetic oligonucleotide
agctcctggctgacttctagtcttctggttg

SEQ ID NO: 99375 - DNA, 30 bp, Artificial Sequence
  Description of Artificial Sequence: Synthetic oligonucleotide
gctcctggctgacttctagtcttctggttg

SEQ ID NO: 99376 - DNA, 32 bp, Artificial Sequence
  Description of Artificial Sequence: Synthetic oligonucleotide
ctcctggctgacttctagtcttctggttgaag

SEQ ID NO: 99377 - DNA, 32 bp, Artificial Sequence
  Description of Artificial Sequence: Synthetic oligonucleotide
tcctggctgacttctagtcttctggttgaagc

SEQ ID NO: 99378 - DNA, 31 bp, Artificial Sequence
  Description of Artificial Sequence: Synthetic oligonucleotide
cctggctgacttctagtcttctggttgaagc

SEQ ID NO: 99379 - DNA, 32 bp, Artificial Sequence
  Description of Artificial Sequence: Synthetic oligonucleotide
ctggctgacttctagtcttctggttgaagctg

SEQ ID NO: 99380 - DNA, 32 bp, Artificial Sequence
  Description of Artificial Sequence: Synthetic oligonucleotide
tggctgacttctagtcttctggttgaagctgc

SEQ ID NO: 99381 - DNA, 31 bp, Artificial Sequence
  Description of Artificial Sequence: Synthetic oligonucleotide
ggctgacttctagtcttctggttgaagctgc

SEQ ID NO: 99382 - DNA, 31 bp, Artificial Sequence
  Description of Artificial Sequence: Synthetic oligonucleotide
gctgacttctagtcttctggttgaagctgcg

SEQ ID NO: 99383 - DNA, 31 bp, Artificial Sequence
  Description of Artificial Sequence: Synthetic oligonucleotide
ctgacttctagtcttctggttgaagctgcgc

SEQ ID NO: 99384 - DNA, 31 bp, Artificial Sequence
  Description of Artificial Sequence: Synthetic oligonucleotide
tgacttctagtcttctggttgaagctgcgcc

SEQ ID NO: 99385 - DNA, 30 bp, Artificial Sequence
  Description of Artificial Sequence: Synthetic oligonucleotide
gacttctagtcttctggttgaagctgcgcc

SEQ ID NO: 99386 - DNA, 34 bp, Artificial Sequence
  Description of Artificial Sequence: Synthetic oligonucleotide
acttctagtcttctggttgaagctgcgcctttag

SEQ ID NO: 99387 - DNA, 33 bp, Artificial Sequence
  Description of Artificial Sequence: Synthetic oligonucleotide
cttctagtcttctggttgaagctgcgcctttag

SEQ ID NO: 99388 - DNA, 35 bp, Artificial Sequence
  Description of Artificial Sequence: Synthetic oligonucleotide
ttctagtcttctggttgaagctgcgcctttagatg

SEQ ID NO: 99389 - DNA, 34 bp, Artificial Sequence
  Description of Artificial Sequence: Synthetic oligonucleotide
tctagtcttctggttgaagctgcgcctttagatg

SEQ ID NO: 99390 - DNA, 33 bp, Artificial Sequence
  Description of Artificial Sequence: Synthetic oligonucleotide
ctagtcttctggttgaagctgcgcctttagatg

SEQ ID NO: 99391 - DNA, 34 bp, Artificial Sequence
  Description of Artificial Sequence: Synthetic oligonucleotide
tagtcttctggttgaagctgcgcctttagatgac

SEQ ID NO: 99392 - DNA, 33 bp, Artificial Sequence
  Description of Artificial Sequence: Synthetic oligonucleotide
agtcttctggttgaagctgcgcctttagatgac

SEQ ID NO: 99393 - DNA, 32 bp, Artificial Sequence
  Description of Artificial Sequence: Synthetic oligonucleotide
gtcttctggttgaagctgcgcctttagatgac

SEQ ID NO: 99394 - DNA, 33 bp, Artificial Sequence
  Description of Artificial Sequence: Synthetic oligonucleotide
tcttctggttgaagctgcgcctttagatgacac

SEQ ID NO: 99395 - DNA, 32 bp, Artificial Sequence
  Description of Artificial Sequence: Synthetic oligonucleotide
cttctggttgaagctgcgcctttagatgacac

SEQ ID NO: 99396 - DNA, 32 bp, Artificial Sequence
  Description of Artificial Sequence: Synthetic oligonucleotide
ttctggttgaagctgcgcctttagatgacacg

SEQ ID NO: 99397 - DNA, 31 bp, Artificial Sequence
  Description of Artificial Sequence: Synthetic oligonucleotide
tctggttgaagctgcgcctttagatgacacg

SEQ ID NO: 99398 - DNA, 30 bp, Artificial Sequence
  Description of Artificial Sequence: Synthetic oligonucleotide
ctggttgaagctgcgcctttagatgacacg

SEQ ID NO: 99399 - DNA, 31 bp, Artificial Sequence
  Description of Artificial Sequence: Synthetic oligonucleotide
tggttgaagctgcgcctttagatgacacgac

SEQ ID NO: 99400 - DNA, 30 bp, Artificial Sequence
  Description of Artificial Sequence: Synthetic oligonucleotide
ggttgaagctgcgcctttagatgacacgac

SEQ ID NO: 99401 - DNA, 30 bp, Artificial Sequence
  Description of Artificial Sequence: Synthetic oligonucleotide
gttgaagctgcgcctttagatgacacgacc

SEQ ID NO: 99402 - DNA, 30 bp, Artificial Sequence
  Description of Artificial Sequence: Synthetic oligonucleotide
ttgaagctgcgcctttagatgacacgaccc

SEQ ID NO: 99403 - DNA, 29 bp, Artificial Sequence
  Description of Artificial Sequence: Synthetic oligonucleotide
tgaagctgcgcctttagatgacacgaccc

SEQ ID NO: 99404 - DNA, 28 bp, Artificial Sequence
  Description of Artificial Sequence: Synthetic oligonucleotide
gaagctgcgcctttagatgacacgaccc

SEQ ID NO: 99405 - DNA, 30 bp, Artificial Sequence
  Description of Artificial Sequence: Synthetic oligonucleotide
aagctgcgcctttagatgacacgaccctac

SEQ ID NO: 99406 - DNA, 29 bp, Artificial Sequence
  Description of Artificial Sequence: Synthetic oligonucleotide
agctgcgcctttagatgacacgaccctac

SEQ ID NO: 99407 - DNA, 28 bp, Artificial Sequence
  Description of Artificial Sequence: Synthetic oligonucleotide
gctgcgcctttagatgacacgaccctac

SEQ ID NO: 99408 - DNA, 28 bp, Artificial Sequence
  Description of Artificial Sequence: Synthetic oligonucleotide
ctgcgcctttagatgacacgaccctacc

SEQ ID NO: 99409 - DNA, 28 bp, Artificial Sequence
  Description of Artificial Sequence: Synthetic oligonucleotide
tgcgcctttagatgacacgaccctaccc

SEQ ID NO: 99410 - DNA, 27 bp, Artificial Sequence
  Description of Artificial Sequence: Synthetic oligonucleotide
gcgcctttagatgacacgaccctaccc

SEQ ID NO: 99411 - DNA, 28 bp, Artificial Sequence
  Description of Artificial Sequence: Synthetic oligonucleotide
cgcctttagatgacacgaccctacccac

SEQ ID NO: 99412 - DNA, 28 bp, Artificial Sequence
  Description of Artificial Sequence: Synthetic oligonucleotide
gcctttagatgacacgaccctacccacc

SEQ ID NO: 99413 - DNA, 28 bp, Artificial Sequence
  Description of Artificial Sequence: Synthetic oligonucleotide
cctttagatgacacgaccctacccaccc

SEQ ID NO: 99414 - DNA, 28 bp, Artificial Sequence
  Description of Artificial Sequence: Synthetic oligonucleotide
ctttagatgacacgaccctacccacccc

SEQ ID NO: 99415 - DNA, 29 bp, Artificial Sequence
  Description of Artificial Sequence: Synthetic oligonucleotide
tttagatgacacgaccctacccacccctg

SEQ ID NO: 99416 - DNA, 28 bp, Artificial Sequence
  Description of Artificial Sequence: Synthetic oligonucleotide
ttagatgacacgaccctacccacccctg

SEQ ID NO: 99417 - DNA, 27 bp, Artificial Sequence
  Description of Artificial Sequence: Synthetic oligonucleotide
tagatgacacgaccctacccacccctg

SEQ ID NO: 99418 - DNA, 27 bp, Artificial Sequence
  Description of Artificial Sequence: Synthetic oligonucleotide
agatgacacgaccctacccacccctgt

SEQ ID NO: 99419 - DNA, 27 bp, Artificial Sequence
  Description of Artificial Sequence: Synthetic oligonucleotide
gatgacacgaccctacccacccctgtt

SEQ ID NO: 99420 - DNA, 28 bp, Artificial Sequence
  Description of Artificial Sequence: Synthetic oligonucleotide
atgacacgaccctacccacccctgtttc

SEQ ID NO: 99421 - DNA, 27 bp, Artificial Sequence
  Description of Artificial Sequence: Synthetic oligonucleotide
tgacacgaccctacccacccctgtttc

SEQ ID NO: 99422 - DNA, 26 bp, Artificial Sequence
  Description of Artificial Sequence: Synthetic oligonucleotide
gacacgaccctacccacccctgtttc

SEQ ID NO: 99423 - DNA, 27 bp, Artificial Sequence
  Description of Artificial Sequence: Synthetic oligonucleotide
acacgaccctacccacccctgtttcca

SEQ ID NO: 99424 - DNA, 26 bp, Artificial Sequence
  Description of Artificial Sequence: Synthetic oligonucleotide
cacgaccctacccacccctgtttcca

SEQ ID NO: 99425 - DNA, 26 bp, Artificial Sequence
  Description of Artificial Sequence: Synthetic oligonucleotide
acgaccctacccacccctgtttccag

SEQ ID NO: 99426 - DNA, 25 bp, Artificial Sequence
  Description of Artificial Sequence: Synthetic oligonucleotide
cgaccctacccacccctgtttccag

SEQ ID NO: 99427 - DNA, 25 bp, Artificial Sequence
  Description of Artificial Sequence: Synthetic oligonucleotide
gaccctacccacccctgtttccagc

SEQ ID NO: 99428 - DNA, 25 bp, Artificial Sequence
  Description of Artificial Sequence: Synthetic oligonucleotide
accctacccacccctgtttccagcg

SEQ ID NO: 99429 - DNA, 24 bp, Artificial Sequence
  Description of Artificial Sequence: Synthetic oligonucleotide
ccctacccacccctgtttccagcg

SEQ ID NO: 99430 - DNA, 26 bp, Artificial Sequence
  Description of Artificial Sequence: Synthetic oligonucleotide
cctacccacccctgtttccagcggat

SEQ ID NO: 99431 - DNA, 26 bp, Artificial Sequence
  Description of Artificial Sequence: Synthetic oligonucleotide
ctacccacccctgtttccagcggatg

SEQ ID NO: 99432 - DNA, 26 bp, Artificial Sequence
  Description of Artificial Sequence: Synthetic oligonucleotide
tacccacccctgtttccagcggatgc

SEQ ID NO: 99433 - DNA, 25 bp, Artificial Sequence
  Description of Artificial Sequence: Synthetic oligonucleotide
acccacccctgtttccagcggatgc

SEQ ID NO: 99434 - DNA, 24 bp, Artificial Sequence
  Description of Artificial Sequence: Synthetic oligonucleotide
cccacccctgtttccagcggatgc

SEQ ID NO: 99435 - DNA, 24 bp, Artificial Sequence
  Description of Artificial Sequence: Synthetic oligonucleotide
ccacccctgtttccagcggatgcc

SEQ ID NO: 99436 - DNA, 24 bp, Artificial Sequence
  Description of Artificial Sequence: Synthetic oligonucleotide
cacccctgtttccagcggatgccc

SEQ ID NO: 99437 - DNA, 24 bp, Artificial Sequence
  Description of Artificial Sequence: Synthetic oligonucleotide
acccctgtttccagcggatgcccg

SEQ ID NO: 99438 - DNA, 23 bp, Artificial Sequence
  Description of Artificial Sequence: Synthetic oligonucleotide
cccctgtttccagcggatgcccg

SEQ ID NO: 99439 - DNA, 23 bp, Artificial Sequence
  Description of Artificial Sequence: Synthetic oligonucleotide
ccctgtttccagcggatgcccgg

SEQ ID NO: 99440 - DNA, 23 bp, Artificial Sequence
  Description of Artificial Sequence: Synthetic oligonucleotide
cctgtttccagcggatgcccggg

SEQ ID NO: 99441 - DNA, 23 bp, Artificial Sequence
  Description of Artificial Sequence: Synthetic oligonucleotide
ctgtttccagcggatgcccgggc

SEQ ID NO: 99442 - DNA, 24 bp, Artificial Sequence
  Description of Artificial Sequence: Synthetic oligonucleotide
tgtttccagcggatgcccgggcct

SEQ ID NO: 99443 - DNA, 23 bp, Artificial Sequence
  Description of Artificial Sequence: Synthetic oligonucleotide
gtttccagcggatgcccgggcct

SEQ ID NO: 99444 - DNA, 23 bp, Artificial Sequence
  Description of Artificial Sequence: Synthetic oligonucleotide
tttccagcggatgcccgggcctg

SEQ ID NO: 99445 - DNA, 22 bp, Artificial Sequence
  Description of Artificial Sequence: Synthetic oligonucleotide
ttccagcggatgcccgggcctg

SEQ ID NO: 99446 - DNA, 21 bp, Artificial Sequence
  Description of Artificial Sequence: Synthetic oligonucleotide
tccagcggatgcccgggcctg

SEQ ID NO: 99447 - DNA, 20 bp, Artificial Sequence
  Description of Artificial Sequence: Synthetic oligonucleotide
ccagcggatgcccgggcctg

SEQ ID NO: 99448 - DNA, 21 bp, Artificial Sequence
  Description of Artificial Sequence: Synthetic oligonucleotide
cagcggatgcccgggcctgga

SEQ ID NO: 99449 - DNA, 21 bp, Artificial Sequence
  Description of Artificial Sequence: Synthetic oligonucleotide
agcggatgcccgggcctggag

SEQ ID NO: 99450 - DNA, 20 bp, Artificial Sequence
  Description of Artificial Sequence: Synthetic oligonucleotide
gcggatgcccgggcctggag

SEQ ID NO: 99451 - DNA, 20 bp, Artificial Sequence
  Description of Artificial Sequence: Synthetic oligonucleotide
cggatgcccgggcctggagc

SEQ ID NO: 99452 - DNA, 20 bp, Artificial Sequence
  Description of Artificial Sequence: Synthetic oligonucleotide
ggatgcccgggcctggagcc

SEQ ID NO: 99453 - DNA, 21 bp, Artificial Sequence
  Description of Artificial Sequence: Synthetic oligonucleotide
gatgcccgggcctggagccca

SEQ ID NO: 99454 - DNA, 22 bp, Artificial Sequence
  Description of Artificial Sequence: Synthetic oligonucleotide
atgcccgggcctggagcccaca

SEQ ID NO: 99455 - DNA, 21 bp, Artificial Sequence
  Description of Artificial Sequence: Synthetic oligonucleotide
tgcccgggcctggagcccaca

SEQ ID NO: 99456 - DNA, 20 bp, Artificial Sequence
  Description of Artificial Sequence: Synthetic oligonucleotide
gcccgggcctggagcccaca

SEQ ID NO: 99457 - DNA, 24 bp, Artificial Sequence
  Description of Artificial Sequence: Synthetic oligonucleotide
cccgggcctggagcccacagaatt

SEQ ID NO: 99458 - DNA, 26 bp, Artificial Sequence
  Description of Artificial Sequence: Synthetic oligonucleotide
ccgggcctggagcccacagaattctt

SEQ ID NO: 99459 - DNA, 26 bp, Artificial Sequence
  Description of Artificial Sequence: Synthetic oligonucleotide
cgggcctggagcccacagaattcttc

SEQ ID NO: 99460 - DNA, 27 bp, Artificial Sequence
  Description of Artificial Sequence: Synthetic oligonucleotide
gggcctggagcccacagaattcttcca

SEQ ID NO: 99461 - DNA, 27 bp, Artificial Sequence
  Description of Artificial Sequence: Synthetic oligonucleotide
ggcctggagcccacagaattcttccag

SEQ ID NO: 99462 - DNA, 28 bp, Artificial Sequence
  Description of Artificial Sequence: Synthetic oligonucleotide
gcctggagcccacagaattcttccagtc

SEQ ID NO: 99463 - DNA, 28 bp, Artificial Sequence
  Description of Artificial Sequence: Synthetic oligonucleotide
cctggagcccacagaattcttccagtcc

SEQ ID NO: 99464 - DNA, 28 bp, Artificial Sequence
  Description of Artificial Sequence: Synthetic oligonucleotide
ctggagcccacagaattcttccagtccc

SEQ ID NO: 99465 - DNA, 29 bp, Artificial Sequence
  Description of Artificial Sequence: Synthetic oligonucleotide
tggagcccacagaattcttccagtccctg

SEQ ID NO: 99466 - DNA, 28 bp, Artificial Sequence
  Description of Artificial Sequence: Synthetic oligonucleotide
ggagcccacagaattcttccagtccctg

SEQ ID NO: 99467 - DNA, 28 bp, Artificial Sequence
  Description of Artificial Sequence: Synthetic oligonucleotide
gagcccacagaattcttccagtccctgg

SEQ ID NO: 99468 - DNA, 28 bp, Artificial Sequence
  Description of Artificial Sequence: Synthetic oligonucleotide
agcccacagaattcttccagtccctggg

SEQ ID NO: 99469 - DNA, 27 bp, Artificial Sequence
  Description of Artificial Sequence: Synthetic oligonucleotide
gcccacagaattcttccagtccctggg

SEQ ID NO: 99470 - DNA, 28 bp, Artificial Sequence
  Description of Artificial Sequence: Synthetic oligonucleotide
cccacagaattcttccagtccctgggtg

SEQ ID NO: 99471 - DNA, 28 bp, Artificial Sequence
  Description of Artificial Sequence: Synthetic oligonucleotide
ccacagaattcttccagtccctgggtgg

SEQ ID NO: 99472 - DNA, 28 bp, Artificial Sequence
  Description of Artificial Sequence: Synthetic oligonucleotide
cacagaattcttccagtccctgggtggg

SEQ ID NO: 99473 - DNA, 28 bp, Artificial Sequence
  Description of Artificial Sequence: Synthetic oligonucleotide
acagaattcttccagtccctgggtgggg

SEQ ID NO: 99474 - DNA, 27 bp, Artificial Sequence
  Description of Artificial Sequence: Synthetic oligonucleotide
cagaattcttccagtccctgggtgggg

SEQ ID NO: 99475 - DNA, 28 bp, Artificial Sequence
  Description of Artificial Sequence: Synthetic oligonucleotide
agaattcttccagtccctgggtggggac

SEQ ID NO: 99476 - DNA, 27 bp, Artificial Sequence
  Description of Artificial Sequence: Synthetic oligonucleotide
gaattcttccagtccctgggtggggac

SEQ ID NO: 99477 - DNA, 27 bp, Artificial Sequence
  Description of Artificial Sequence: Synthetic oligonucleotide
aattcttccagtccctgggtggggacg

SEQ ID NO: 99478 - DNA, 26 bp, Artificial Sequence
  Description of Artificial Sequence: Synthetic oligonucleotide
attcttccagtccctgggtggggacg

SEQ ID NO: 99479 - DNA, 25 bp, Artificial Sequence
  Description of Artificial Sequence: Synthetic oligonucleotide
ttcttccagtccctgggtggggacg

SEQ ID NO: 99480 - DNA, 24 bp, Artificial Sequence
  Description of Artificial Sequence: Synthetic oligonucleotide
tcttccagtccctgggtggggacg

SEQ ID NO: 99481 - DNA, 23 bp, Artificial Sequence
  Description of Artificial Sequence: Synthetic oligonucleotide
cttccagtccctgggtggggacg

SEQ ID NO: 99482 - DNA, 24 bp, Artificial Sequence
  Description of Artificial Sequence: Synthetic oligonucleotide
ttccagtccctgggtggggacgga

SEQ ID NO: 99483 - DNA, 23 bp, Artificial Sequence
  Description of Artificial Sequence: Synthetic oligonucleotide
tccagtccctgggtggggacgga

SEQ ID NO: 99484 - DNA, 22 bp, Artificial Sequence
  Description of Artificial Sequence: Synthetic oligonucleotide
ccagtccctgggtggggacgga

SEQ ID NO: 99485 - DNA, 25 bp, Artificial Sequence
  Description of Artificial Sequence: Synthetic oligonucleotide
cagtccctgggtggggacggagaaa

SEQ ID NO: 99486 - DNA, 25 bp, Artificial Sequence
  Description of Artificial Sequence: Synthetic oligonucleotide
agtccctgggtggggacggagaaag

SEQ ID NO: 99487 - DNA, 24 bp, Artificial Sequence
  Description of Artificial Sequence: Synthetic oligonucleotide
gtccctgggtggggacggagaaag

SEQ ID NO: 99488 - DNA, 26 bp, Artificial Sequence
  Description of Artificial Sequence: Synthetic oligonucleotide
tccctgggtggggacggagaaaggaa

SEQ ID NO: 99489 - DNA, 25 bp, Artificial Sequence
  Description of Artificial Sequence: Synthetic oligonucleotide
ccctgggtggggacggagaaaggaa

SEQ ID NO: 99490 - DNA, 25 bp, Artificial Sequence
  Description of Artificial Sequence: Synthetic oligonucleotide
cctgggtggggacggagaaaggaac

SEQ ID NO: 99491 - DNA, 27 bp, Artificial Sequence
  Description of Artificial Sequence: Synthetic oligonucleotide
ctgggtggggacggagaaaggaacgtt

SEQ ID NO: 99492 - DNA, 27 bp, Artificial Sequence
  Description of Artificial Sequence: Synthetic oligonucleotide
tgggtggggacggagaaaggaacgttc

SEQ ID NO: 99493 - DNA, 27 bp, Artificial Sequence
  Description of Artificial Sequence: Synthetic oligonucleotide
gggtggggacggagaaaggaacgttca

SEQ ID NO: 99494 - DNA, 27 bp, Artificial Sequence
  Description of Artificial Sequence: Synthetic oligonucleotide
ggtggggacggagaaaggaacgttcag

SEQ ID NO: 99495 - DNA, 30 bp, Artificial Sequence
  Description of Artificial Sequence: Synthetic oligonucleotide
gtggggacggagaaaggaacgttcagattg

SEQ ID NO: 99496 - DNA, 31 bp, Artificial Sequence
  Description of Artificial Sequence: Synthetic oligonucleotide
tggggacggagaaaggaacgttcagattgag

SEQ ID NO: 99497 - DNA, 30 bp, Artificial Sequence
  Description of Artificial Sequence: Synthetic oligonucleotide
ggggacggagaaaggaacgttcagattgag

SEQ ID NO: 99498 - DNA, 32 bp, Artificial Sequence
  Description of Artificial Sequence: Synthetic oligonucleotide
gggacggagaaaggaacgttcagattgagatg

SEQ ID NO: 99499 - DNA, 32 bp, Artificial Sequence
  Description of Artificial Sequence: Synthetic oligonucleotide
ggacggagaaaggaacgttcagattgagatgg

SEQ ID NO: 99500 - DNA, 32 bp, Artificial Sequence
  Description of Artificial Sequence: Synthetic oligonucleotide
gacggagaaaggaacgttcagattgagatggc

SEQ ID NO: 99501 - DNA, 32 bp, Artificial Sequence
  Description of Artificial Sequence: Synthetic oligonucleotide
acggagaaaggaacgttcagattgagatggcc

SEQ ID NO: 99502 - DNA, 31 bp, Artificial Sequence
  Description of Artificial Sequence: Synthetic oligonucleotide
cggagaaaggaacgttcagattgagatggcc

SEQ ID NO: 99503 - DNA, 31 bp, Artificial Sequence
  Description of Artificial Sequence: Synthetic oligonucleotide
ggagaaaggaacgttcagattgagatggccc

SEQ ID NO: 99504 - DNA, 33 bp, Artificial Sequence
  Description of Artificial Sequence: Synthetic oligonucleotide
gagaaaggaacgttcagattgagatggcccatg

SEQ ID NO: 99505 - DNA, 33 bp, Artificial Sequence
  Description of Artificial Sequence: Synthetic oligonucleotide
agaaaggaacgttcagattgagatggcccatgg

SEQ ID NO: 99506 - DNA, 32 bp, Artificial Sequence
  Description of Artificial Sequence: Synthetic oligonucleotide
gaaaggaacgttcagattgagatggcccatgg

SEQ ID NO: 99507 - DNA, 32 bp, Artificial Sequence
  Description of Artificial Sequence: Synthetic oligonucleotide
aaaggaacgttcagattgagatggcccatggc

SEQ ID NO: 99508 - DNA, 31 bp, Artificial Sequence
  Description of Artificial Sequence: Synthetic oligonucleotide
aaggaacgttcagattgagatggcccatggc

SEQ ID NO: 99509 - DNA, 30 bp, Artificial Sequence
  Description of Artificial Sequence: Synthetic oligonucleotide
aggaacgttcagattgagatggcccatggc

SEQ ID NO: 99510 - DNA, 29 bp, Artificial Sequence
  Description of Artificial Sequence: Synthetic oligonucleotide
ggaacgttcagattgagatggcccatggc

SEQ ID NO: 99511 - DNA, 30 bp, Artificial Sequence
  Description of Artificial Sequence: Synthetic oligonucleotide
gaacgttcagattgagatggcccatggcac

SEQ ID NO: 99512 - DNA, 30 bp, Artificial Sequence
  Description of Artificial Sequence: Synthetic oligonucleotide
aacgttcagattgagatggcccatggcacc

SEQ ID NO: 99513 - DNA, 29 bp, Artificial Sequence
  Description of Artificial Sequence: Synthetic oligonucleotide
acgttcagattgagatggcccatggcacc

SEQ ID NO: 99514 - DNA, 28 bp, Artificial Sequence
  Description of Artificial Sequence: Synthetic oligonucleotide
cgttcagattgagatggcccatggcacc

SEQ ID NO: 99515 - DNA, 29 bp, Artificial Sequence
  Description of Artificial Sequence: Synthetic oligonucleotide
gttcagattgagatggcccatggcaccac

SEQ ID NO: 99516 - DNA, 29 bp, Artificial Sequence
  Description of Artificial Sequence: Synthetic oligonucleotide
ttcagattgagatggcccatggcaccacc

SEQ ID NO: 99517 - DNA, 28 bp, Artificial Sequence
  Description of Artificial Sequence: Synthetic oligonucleotide
tcagattgagatggcccatggcaccacc

SEQ ID NO: 99518 - DNA, 27 bp, Artificial Sequence
  Description of Artificial Sequence: Synthetic oligonucleotide
cagattgagatggcccatggcaccacc

SEQ ID NO: 99519 - DNA, 28 bp, Artificial Sequence
  Description of Artificial Sequence: Synthetic oligonucleotide
agattgagatggcccatggcaccaccac

SEQ ID NO: 99520 - DNA, 27 bp, Artificial Sequence
  Description of Artificial Sequence: Synthetic oligonucleotide
gattgagatggcccatggcaccaccac

SEQ ID NO: 99521 - DNA, 27 bp, Artificial Sequence
  Description of Artificial Sequence: Synthetic oligonucleotide
attgagatggcccatggcaccaccacg

SEQ ID NO: 99522 - DNA, 26 bp, Artificial Sequence
  Description of Artificial Sequence: Synthetic oligonucleotide
ttgagatggcccatggcaccaccacg

SEQ ID NO: 99523 - DNA, 25 bp, Artificial Sequence
  Description of Artificial Sequence: Synthetic oligonucleotide
tgagatggcccatggcaccaccacg

SEQ ID NO: 99524 - DNA, 24 bp, Artificial Sequence
  Description of Artificial Sequence: Synthetic oligonucleotide
gagatggcccatggcaccaccacg

SEQ ID NO: 99525 - DNA, 25 bp, Artificial Sequence
  Description of Artificial Sequence: Synthetic oligonucleotide
agatggcccatggcaccaccacgct

SEQ ID NO: 99526 - DNA, 24 bp, Artificial Sequence
  Description of Artificial Sequence: Synthetic oligonucleotide
gatggcccatggcaccaccacgct

SEQ ID NO: 99527 - DNA, 24 bp, Artificial Sequence
  Description of Artificial Sequence: Synthetic oligonucleotide
atggcccatggcaccaccacgctc

SEQ ID NO: 99528 - DNA, 23 bp, Artificial Sequence
  Description of Artificial Sequence: Synthetic oligonucleotide
tggcccatggcaccaccacgctc

SEQ ID NO: 99529 - DNA, 22 bp, Artificial Sequence
  Description of Artificial Sequence: Synthetic oligonucleotide
ggcccatggcaccaccacgctc

SEQ ID NO: 99530 - DNA, 22 bp, Artificial Sequence
  Description of Artificial Sequence: Synthetic oligonucleotide
gcccatggcaccaccacgctcg

SEQ ID NO: 99531 - DNA, 22 bp, Artificial Sequence
  Description of Artificial Sequence: Synthetic oligonucleotide
cccatggcaccaccacgctcgc

SEQ ID NO: 99532 - DNA, 24 bp, Artificial Sequence
  Description of Artificial Sequence: Synthetic oligonucleotide
ccatggcaccaccacgctcgcctt

SEQ ID NO: 99533 - DNA, 26 bp, Artificial Sequence
  Description of Artificial Sequence: Synthetic oligonucleotide
catggcaccaccacgctcgccttcaa

SEQ ID NO: 99534 - DNA, 27 bp, Artificial Sequence
  Description of Artificial Sequence: Synthetic oligonucleotide
atggcaccaccacgctcgccttcaagt

SEQ ID NO: 99535 - DNA, 27 bp, Artificial Sequence
  Description of Artificial Sequence: Synthetic oligonucleotide
tggcaccaccacgctcgccttcaagtt

SEQ ID NO: 99536 - DNA, 26 bp, Artificial Sequence
  Description of Artificial Sequence: Synthetic oligonucleotide
ggcaccaccacgctcgccttcaagtt

SEQ ID NO: 99537 - DNA, 26 bp, Artificial Sequence
  Description of Artificial Sequence: Synthetic oligonucleotide
gcaccaccacgctcgccttcaagttc

SEQ ID NO: 99538 - DNA, 27 bp, Artificial Sequence
  Description of Artificial Sequence: Synthetic oligonucleotide
caccaccacgctcgccttcaagttcca

SEQ ID NO: 99539 - DNA, 27 bp, Artificial Sequence
  Description of Artificial Sequence: Synthetic oligonucleotide
accaccacgctcgccttcaagttccag

SEQ ID NO: 99540 - DNA, 26 bp, Artificial Sequence
  Description of Artificial Sequence: Synthetic oligonucleotide
ccaccacgctcgccttcaagttccag

SEQ ID NO: 99541 - DNA, 27 bp, Artificial Sequence
  Description of Artificial Sequence: Synthetic oligonucleotide
caccacgctcgccttcaagttccagca

SEQ ID NO: 99542 - DNA, 28 bp, Artificial Sequence
  Description of Artificial Sequence: Synthetic oligonucleotide
accacgctcgccttcaagttccagcatg

SEQ ID NO: 99543 - DNA, 27 bp, Artificial Sequence
  Description of Artificial Sequence: Synthetic oligonucleotide
ccacgctcgccttcaagttccagcatg

SEQ ID NO: 99544 - DNA, 27 bp, Artificial Sequence
  Description of Artificial Sequence: Synthetic oligonucleotide
cacgctcgccttcaagttccagcatgg

SEQ ID NO: 99545 - DNA, 28 bp, Artificial Sequence
  Description of Artificial Sequence: Synthetic oligonucleotide
acgctcgccttcaagttccagcatggag

SEQ ID NO: 99546 - DNA, 27 bp, Artificial Sequence
  Description of Artificial Sequence: Synthetic oligonucleotide
cgctcgccttcaagttccagcatggag

SEQ ID NO: 99547 - DNA, 28 bp, Artificial Sequence
  Description of Artificial Sequence: Synthetic oligonucleotide
gctcgccttcaagttccagcatggagtg

SEQ ID NO: 99548 - DNA, 31 bp, Artificial Sequence
  Description of Artificial Sequence: Synthetic oligonucleotide
ctcgccttcaagttccagcatggagtgattg

SEQ ID NO: 99549 - DNA, 31 bp, Artificial Sequence
  Description of Artificial Sequence: Synthetic oligonucleotide
tcgccttcaagttccagcatggagtgattgc

SEQ ID NO: 99550 - DNA, 30 bp, Artificial Sequence
  Description of Artificial Sequence: Synthetic oligonucleotide
cgccttcaagttccagcatggagtgattgc

SEQ ID NO: 99551 - DNA, 31 bp, Artificial Sequence
  Description of Artificial Sequence: Synthetic oligonucleotide
gccttcaagttccagcatggagtgattgcag

SEQ ID NO: 99552 - DNA, 31 bp, Artificial Sequence
  Description of Artificial Sequence: Synthetic oligonucleotide
ccttcaagttccagcatggagtgattgcagc

SEQ ID NO: 99553 - DNA, 32 bp, Artificial Sequence
  Description of Artificial Sequence: Synthetic oligonucleotide
cttcaagttccagcatggagtgattgcagcag

SEQ ID NO: 99554 - DNA, 33 bp, Artificial Sequence
  Description of Artificial Sequence: Synthetic oligonucleotide
ttcaagttccagcatggagtgattgcagcagtg

SEQ ID NO: 99555 - DNA, 32 bp, Artificial Sequence
  Description of Artificial Sequence: Synthetic oligonucleotide
tcaagttccagcatggagtgattgcagcagtg

SEQ ID NO: 99556 - DNA, 31 bp, Artificial Sequence
  Description of Artificial Sequence: Synthetic oligonucleotide
caagttccagcatggagtgattgcagcagtg

SEQ ID NO: 99557 - DNA, 31 bp, Artificial Sequence
  Description of Artificial Sequence: Synthetic oligonucleotide
aagttccagcatggagtgattgcagcagtgg

SEQ ID NO: 99558 - DNA, 30 bp, Artificial Sequence
  Description of Artificial Sequence: Synthetic oligonucleotide
agttccagcatggagtgattgcagcagtgg

SEQ ID NO: 99559 - DNA, 29 bp, Artificial Sequence
  Description of Artificial Sequence: Synthetic oligonucleotide
gttccagcatggagtgattgcagcagtgg

SEQ ID NO: 99560 - DNA, 32 bp, Artificial Sequence
  Description of Artificial Sequence: Synthetic oligonucleotide
ttccagcatggagtgattgcagcagtggattc

SEQ ID NO: 99561 - DNA, 31 bp, Artificial Sequence
  Description of Artificial Sequence: Synthetic oligonucleotide
tccagcatggagtgattgcagcagtggattc

SEQ ID NO: 99562 - DNA, 30 bp, Artificial Sequence
  Description of Artificial Sequence: Synthetic oligonucleotide
ccagcatggagtgattgcagcagtggattc

SEQ ID NO: 99563 - DNA, 31 bp, Artificial Sequence
  Description of Artificial Sequence: Synthetic oligonucleotide
cagcatggagtgattgcagcagtggattctc

SEQ ID NO: 99564 - DNA, 31 bp, Artificial Sequence
  Description of Artificial Sequence: Synthetic oligonucleotide
agcatggagtgattgcagcagtggattctcg

SEQ ID NO: 99565 - DNA, 30 bp, Artificial Sequence
  Description of Artificial Sequence: Synthetic oligonucleotide
gcatggagtgattgcagcagtggattctcg

SEQ ID NO: 99566 - DNA, 30 bp, Artificial Sequence
  Description of Artificial Sequence: Synthetic oligonucleotide
catggagtgattgcagcagtggattctcgg

SEQ ID NO: 99567 - DNA, 30 bp, Artificial Sequence
  Description of Artificial Sequence: Synthetic oligonucleotide
atggagtgattgcagcagtggattctcggg

SEQ ID NO: 99568 - DNA, 29 bp, Artificial Sequence
  Description of Artificial Sequence: Synthetic oligonucleotide
tggagtgattgcagcagtggattctcggg

SEQ ID NO: 99569 - DNA, 28 bp, Artificial Sequence
  Description of Artificial Sequence: Synthetic oligonucleotide
ggagtgattgcagcagtggattctcggg

SEQ ID NO: 99570 - DNA, 28 bp, Artificial Sequence
  Description of Artificial Sequence: Synthetic oligonucleotide
gagtgattgcagcagtggattctcgggc

SEQ ID NO: 99571 - DNA, 28 bp, Artificial Sequence
  Description of Artificial Sequence: Synthetic oligonucleotide
agtgattgcagcagtggattctcgggcc

SEQ ID NO: 99572 - DNA, 27 bp, Artificial Sequence
  Description of Artificial Sequence: Synthetic oligonucleotide
gtgattgcagcagtggattctcgggcc

SEQ ID NO: 99573 - DNA, 28 bp, Artificial Sequence
  Description of Artificial Sequence: Synthetic oligonucleotide
tgattgcagcagtggattctcgggcctc

SEQ ID NO: 99574 - DNA, 27 bp, Artificial Sequence
  Description of Artificial Sequence: Synthetic oligonucleotide
gattgcagcagtggattctcgggcctc

SEQ ID NO: 99575 - DNA, 28 bp, Artificial Sequence
  Description of Artificial Sequence: Synthetic oligonucleotide
attgcagcagtggattctcgggcctcag

SEQ ID NO: 99576 - DNA, 27 bp, Artificial Sequence
  Description of Artificial Sequence: Synthetic oligonucleotide
ttgcagcagtggattctcgggcctcag

SEQ ID NO: 99577 - DNA, 26 bp, Artificial Sequence
  Description of Artificial Sequence: Synthetic oligonucleotide
tgcagcagtggattctcgggcctcag

SEQ ID NO: 99578 - DNA, 25 bp, Artificial Sequence
  Description of Artificial Sequence: Synthetic oligonucleotide
gcagcagtggattctcgggcctcag

SEQ ID NO: 99579 - DNA, 26 bp, Artificial Sequence
  Description of Artificial Sequence: Synthetic oligonucleotide
cagcagtggattctcgggcctcagct

SEQ ID NO: 99580 - DNA, 26 bp, Artificial Sequence
  Description of Artificial Sequence: Synthetic oligonucleotide
agcagtggattctcgggcctcagctg

SEQ ID NO: 99581 - DNA, 25 bp, Artificial Sequence
  Description of Artificial Sequence: Synthetic oligonucleotide
gcagtggattctcgggcctcagctg

SEQ ID NO: 99582 - DNA, 25 bp, Artificial Sequence
  Description of Artificial Sequence: Synthetic oligonucleotide
cagtggattctcgggcctcagctgg

SEQ ID NO: 99583 - DNA, 26 bp, Artificial Sequence
  Description of Artificial Sequence: Synthetic oligonucleotide
agtggattctcgggcctcagctgggt

SEQ ID NO: 99584 - DNA, 25 bp, Artificial Sequence
  Description of Artificial Sequence: Synthetic oligonucleotide
gtggattctcgggcctcagctgggt

SEQ ID NO: 99585 - DNA, 25 bp, Artificial Sequence
  Description of Artificial Sequence: Synthetic oligonucleotide
tggattctcgggcctcagctgggtc

SEQ ID NO: 99586 - DNA, 24 bp, Artificial Sequence
  Description of Artificial Sequence: Synthetic oligonucleotide
ggattctcgggcctcagctgggtc

SEQ ID NO: 99587 - DNA, 26 bp, Artificial Sequence
  Description of Artificial Sequence: Synthetic oligonucleotide
gattctcgggcctcagctgggtccta

SEQ ID NO: 99588 - DNA, 27 bp, Artificial Sequence
  Description of Artificial Sequence: Synthetic oligonucleotide
attctcgggcctcagctgggtcctaca

SEQ ID NO: 99589 - DNA, 27 bp, Artificial Sequence
  Description of Artificial Sequence: Synthetic oligonucleotide
ttctcgggcctcagctgggtcctacat

SEQ ID NO: 99590 - DNA, 27 bp, Artificial Sequence
  Description of Artificial Sequence: Synthetic oligonucleotide
tctcgggcctcagctgggtcctacatt

SEQ ID NO: 99591 - DNA, 27 bp, Artificial Sequence
  Description of Artificial Sequence: Synthetic oligonucleotide
ctcgggcctcagctgggtcctacatta

SEQ ID NO: 99592 - DNA, 27 bp, Artificial Sequence
  Description of Artificial Sequence: Synthetic oligonucleotide
tcgggcctcagctgggtcctacattag

SEQ ID NO: 99593 - DNA, 27 bp, Artificial Sequence
  Description of Artificial Sequence: Synthetic oligonucleotide
cgggcctcagctgggtcctacattagt

SEQ ID NO: 99594 - DNA, 27 bp, Artificial Sequence
  Description of Artificial Sequence: Synthetic oligonucleotide
gggcctcagctgggtcctacattagtg

SEQ ID NO: 99595 - DNA, 27 bp, Artificial Sequence
  Description of Artificial Sequence: Synthetic oligonucleotide
ggcctcagctgggtcctacattagtgc

SEQ ID NO: 99596 - DNA, 27 bp, Artificial Sequence
  Description of Artificial Sequence: Synthetic oligonucleotide
gcctcagctgggtcctacattagtgcc

SEQ ID NO: 99597 - DNA, 30 bp, Artificial Sequence
  Description of Artificial Sequence: Synthetic oligonucleotide
cctcagctgggtcctacattagtgccttac

SEQ ID NO: 99598 - DNA, 30 bp, Artificial Sequence
  Description of Artificial Sequence: Synthetic oligonucleotide
ctcagctgggtcctacattagtgccttacg

SEQ ID NO: 99599 - DNA, 30 bp, Artificial Sequence
  Description of Artificial Sequence: Synthetic oligonucleotide
tcagctgggtcctacattagtgccttacgg

SEQ ID NO: 99600 - DNA, 29 bp, Artificial Sequence
  Description of Artificial Sequence: Synthetic oligonucleotide
cagctgggtcctacattagtgccttacgg

SEQ ID NO: 99601 - DNA, 29 bp, Artificial Sequence
  Description of Artificial Sequence: Synthetic oligonucleotide
agctgggtcctacattagtgccttacggg

SEQ ID NO: 99602 - DNA, 28 bp, Artificial Sequence
  Description of Artificial Sequence: Synthetic oligonucleotide
gctgggtcctacattagtgccttacggg

SEQ ID NO: 99603 - DNA, 29 bp, Artificial Sequence
  Description of Artificial Sequence: Synthetic oligonucleotide
ctgggtcctacattagtgccttacgggtg

SEQ ID NO: 99604 - DNA, 31 bp, Artificial Sequence
  Description of Artificial Sequence: Synthetic oligonucleotide
tgggtcctacattagtgccttacgggtgaac

SEQ ID NO: 99605 - DNA, 30 bp, Artificial Sequence
  Description of Artificial Sequence: Synthetic oligonucleotide
gggtcctacattagtgccttacgggtgaac

SEQ ID NO: 99606 - DNA, 32 bp, Artificial Sequence
  Description of Artificial Sequence: Synthetic oligonucleotide
ggtcctacattagtgccttacgggtgaacaag

SEQ ID NO: 99607 - DNA, 32 bp, Artificial Sequence
  Description of Artificial Sequence: Synthetic oligonucleotide
gtcctacattagtgccttacgggtgaacaagg

SEQ ID NO: 99608 - DNA, 33 bp, Artificial Sequence
  Description of Artificial Sequence: Synthetic oligonucleotide
tcctacattagtgccttacgggtgaacaaggtg

SEQ ID NO: 99609 - DNA, 32 bp, Artificial Sequence
  Description of Artificial Sequence: Synthetic oligonucleotide
cctacattagtgccttacgggtgaacaaggtg

SEQ ID NO: 99610 - DNA, 35 bp, Artificial Sequence
  Description of Artificial Sequence: Synthetic oligonucleotide
ctacattagtgccttacgggtgaacaaggtgattg

SEQ ID NO: 99611 - DNA, 36 bp, Artificial Sequence
  Description of Artificial Sequence: Synthetic oligonucleotide
tacattagtgccttacgggtgaacaaggtgattgag

SEQ ID NO: 99612 - DNA, 35 bp, Artificial Sequence
  Description of Artificial Sequence: Synthetic oligonucleotide
acattagtgccttacgggtgaacaaggtgattgag

SEQ ID NO: 99613 - DNA, 34 bp, Artificial Sequence
  Description of Artificial Sequence: Synthetic oligonucleotide
cattagtgccttacgggtgaacaaggtgattgag

SEQ ID NO: 99614 - DNA, 39 bp, Artificial Sequence
  Description of Artificial Sequence: Synthetic oligonucleotide
attagtgccttacgggtgaacaaggtgattgagattaac

SEQ ID NO: 99615 - DNA, 38 bp, Artificial Sequence
  Description of Artificial Sequence: Synthetic oligonucleotide
ttagtgccttacgggtgaacaaggtgattgagattaac

SEQ ID NO: 99616 - DNA, 37 bp, Artificial Sequence
  Description of Artificial Sequence: Synthetic oligonucleotide
tagtgccttacgggtgaacaaggtgattgagattaac

SEQ ID NO: 99617 - DNA, 36 bp, Artificial Sequence
  Description of Artificial Sequence: Synthetic oligonucleotide
agtgccttacgggtgaacaaggtgattgagattaac

SEQ ID NO: 99618 - DNA, 35 bp, Artificial Sequence
  Description of Artificial Sequence: Synthetic oligonucleotide
gtgccttacgggtgaacaaggtgattgagattaac

SEQ ID NO: 99619 - DNA, 35 bp, Artificial Sequence
  Description of Artificial Sequence: Synthetic oligonucleotide
tgccttacgggtgaacaaggtgattgagattaacc

SEQ ID NO: 99620 - DNA, 34 bp, Artificial Sequence
  Description of Artificial Sequence: Synthetic oligonucleotide
gccttacgggtgaacaaggtgattgagattaacc

SEQ ID NO: 99621 - DNA, 34 bp, Artificial Sequence
  Description of Artificial Sequence: Synthetic oligonucleotide
ccttacgggtgaacaaggtgattgagattaaccc

SEQ ID NO: 99622 - DNA, 37 bp, Artificial Sequence
  Description of Artificial Sequence: Synthetic oligonucleotide
cttacgggtgaacaaggtgattgagattaacccttac

SEQ ID NO: 99623 - DNA, 37 bp, Artificial Sequence
  Description of Artificial Sequence: Synthetic oligonucleotide
ttacgggtgaacaaggtgattgagattaacccttacc

SEQ ID NO: 99624 - DNA, 36 bp, Artificial Sequence
  Description of Artificial Sequence: Synthetic oligonucleotide
tacgggtgaacaaggtgattgagattaacccttacc

SEQ ID NO: 99625 - DNA, 35 bp, Artificial Sequence
  Description of Artificial Sequence: Synthetic oligonucleotide
acgggtgaacaaggtgattgagattaacccttacc

SEQ ID NO: 99626 - DNA, 34 bp, Artificial Sequence
  Description of Artificial Sequence: Synthetic oligonucleotide
cgggtgaacaaggtgattgagattaacccttacc

SEQ ID NO: 99627 - DNA, 35 bp, Artificial Sequence
  Description of Artificial Sequence: Synthetic oligonucleotide
gggtgaacaaggtgattgagattaacccttacctg

SEQ ID NO: 99628 - DNA, 35 bp, Artificial Sequence
  Description of Artificial Sequence: Synthetic oligonucleotide
ggtgaacaaggtgattgagattaacccttacctgc

SEQ ID NO: 99629 - DNA, 37 bp, Artificial Sequence
  Description of Artificial Sequence: Synthetic oligonucleotide
gtgaacaaggtgattgagattaacccttacctgcttg

SEQ ID NO: 99630 - DNA, 37 bp, Artificial Sequence
  Description of Artificial Sequence: Synthetic oligonucleotide
tgaacaaggtgattgagattaacccttacctgcttgg

SEQ ID NO: 99631 - DNA, 36 bp, Artificial Sequence
  Description of Artificial Sequence: Synthetic oligonucleotide
gaacaaggtgattgagattaacccttacctgcttgg

SEQ ID NO: 99632 - DNA, 36 bp, Artificial Sequence
  Description of Artificial Sequence: Synthetic oligonucleotide
aacaaggtgattgagattaacccttacctgcttggc

SEQ ID NO: 99633 - DNA, 35 bp, Artificial Sequence
  Description of Artificial Sequence: Synthetic oligonucleotide
acaaggtgattgagattaacccttacctgcttggc

SEQ ID NO: 99634 - DNA, 34 bp, Artificial Sequence
  Description of Artificial Sequence: Synthetic oligonucleotide
caaggtgattgagattaacccttacctgcttggc

SEQ ID NO: 99635 - DNA, 35 bp, Artificial Sequence
  Description of Artificial Sequence: Synthetic oligonucleotide
aaggtgattgagattaacccttacctgcttggcac

SEQ ID NO: 99636 - DNA, 34 bp, Artificial Sequence
  Description of Artificial Sequence: Synthetic oligonucleotide
aggtgattgagattaacccttacctgcttggcac

SEQ ID NO: 99637 - DNA, 33 bp, Artificial Sequence
  Description of Artificial Sequence: Synthetic oligonucleotide
ggtgattgagattaacccttacctgcttggcac

SEQ ID NO: 99638 - DNA, 33 bp, Artificial Sequence
  Description of Artificial Sequence: Synthetic oligonucleotide
gtgattgagattaacccttacctgcttggcacc

SEQ ID NO: 99639 - DNA, 35 bp, Artificial Sequence
  Description of Artificial Sequence: Synthetic oligonucleotide
tgattgagattaacccttacctgcttggcaccatg

SEQ ID NO: 99640 - DNA, 34 bp, Artificial Sequence
  Description of Artificial Sequence: Synthetic oligonucleotide
gattgagattaacccttacctgcttggcaccatg

SEQ ID NO: 99641 - DNA, 35 bp, Artificial Sequence
  Description of Artificial Sequence: Synthetic oligonucleotide
attgagattaacccttacctgcttggcaccatgtc

SEQ ID NO: 99642 - DNA, 34 bp, Artificial Sequence
  Description of Artificial Sequence: Synthetic oligonucleotide
ttgagattaacccttacctgcttggcaccatgtc

SEQ ID NO: 99643 - DNA, 33 bp, Artificial Sequence
  Description of Artificial Sequence: Synthetic oligonucleotide
tgagattaacccttacctgcttggcaccatgtc

SEQ ID NO: 99644 - DNA, 32 bp, Artificial Sequence
  Description of Artificial Sequence: Synthetic oligonucleotide
gagattaacccttacctgcttggcaccatgtc

SEQ ID NO: 99645 - DNA, 33 bp, Artificial Sequence
  Description of Artificial Sequence: Synthetic oligonucleotide
agattaacccttacctgcttggcaccatgtctg

SEQ ID NO: 99646 - DNA, 32 bp, Artificial Sequence
  Description of Artificial Sequence: Synthetic oligonucleotide
gattaacccttacctgcttggcaccatgtctg

SEQ ID NO: 99647 - DNA, 32 bp, Artificial Sequence
  Description of Artificial Sequence: Synthetic oligonucleotide
attaacccttacctgcttggcaccatgtctgg

SEQ ID NO: 99648 - DNA, 31 bp, Artificial Sequence
  Description of Artificial Sequence: Synthetic oligonucleotide
ttaacccttacctgcttggcaccatgtctgg

SEQ ID NO: 99649 - DNA, 30 bp, Artificial Sequence
  Description of Artificial Sequence: Synthetic oligonucleotide
taacccttacctgcttggcaccatgtctgg

SEQ ID NO: 99650 - DNA, 29 bp, Artificial Sequence
  Description of Artificial Sequence: Synthetic oligonucleotide
aacccttacctgcttggcaccatgtctgg

SEQ ID NO: 99651 - DNA, 28 bp, Artificial Sequence
  Description of Artificial Sequence: Synthetic oligonucleotide
acccttacctgcttggcaccatgtctgg

SEQ ID NO: 99652 - DNA, 27 bp, Artificial Sequence
  Description of Artificial Sequence: Synthetic oligonucleotide
cccttacctgcttggcaccatgtctgg

SEQ ID NO: 99653 - DNA, 27 bp, Artificial Sequence
  Description of Artificial Sequence: Synthetic oligonucleotide
ccttacctgcttggcaccatgtctggc

SEQ ID NO: 99654 - DNA, 28 bp, Artificial Sequence
  Description of Artificial Sequence: Synthetic oligonucleotide
cttacctgcttggcaccatgtctggctg

SEQ ID NO: 99655 - DNA, 29 bp, Artificial Sequence
  Description of Artificial Sequence: Synthetic oligonucleotide
ttacctgcttggcaccatgtctggctgtg

SEQ ID NO: 99656 - DNA, 28 bp, Artificial Sequence
  Description of Artificial Sequence: Synthetic oligonucleotide
tacctgcttggcaccatgtctggctgtg

SEQ ID NO: 99657 - DNA, 27 bp, Artificial Sequence
  Description of Artificial Sequence: Synthetic oligonucleotide
acctgcttggcaccatgtctggctgtg

SEQ ID NO: 99658 - DNA, 26 bp, Artificial Sequence
  Description of Artificial Sequence: Synthetic oligonucleotide
cctgcttggcaccatgtctggctgtg

SEQ ID NO: 99659 - DNA, 27 bp, Artificial Sequence
  Description of Artificial Sequence: Synthetic oligonucleotide
ctgcttggcaccatgtctggctgtgca

SEQ ID NO: 99660 - DNA, 27 bp, Artificial Sequence
  Description of Artificial Sequence: Synthetic oligonucleotide
tgcttggcaccatgtctggctgtgcag

SEQ ID NO: 99661 - DNA, 26 bp, Artificial Sequence
  Description of Artificial Sequence: Synthetic oligonucleotide
gcttggcaccatgtctggctgtgcag

SEQ ID NO: 99662 - DNA, 27 bp, Artificial Sequence
  Description of Artificial Sequence: Synthetic oligonucleotide
cttggcaccatgtctggctgtgcagca

SEQ ID NO: 99663 - DNA, 27 bp, Artificial Sequence
  Description of Artificial Sequence: Synthetic oligonucleotide
ttggcaccatgtctggctgtgcagcag

SEQ ID NO: 99664 - DNA, 27 bp, Artificial Sequence
  Description of Artificial Sequence: Synthetic oligonucleotide
tggcaccatgtctggctgtgcagcaga

SEQ ID NO: 99665 - DNA, 26 bp, Artificial Sequence
  Description of Artificial Sequence: Synthetic oligonucleotide
ggcaccatgtctggctgtgcagcaga

SEQ ID NO: 99666 - DNA, 27 bp, Artificial Sequence
  Description of Artificial Sequence: Synthetic oligonucleotide
gcaccatgtctggctgtgcagcagact

SEQ ID NO: 99667 - DNA, 27 bp, Artificial Sequence
  Description of Artificial Sequence: Synthetic oligonucleotide
caccatgtctggctgtgcagcagactg

SEQ ID NO: 99668 - DNA, 28 bp, Artificial Sequence
  Description of Artificial Sequence: Synthetic oligonucleotide
accatgtctggctgtgcagcagactgtc

SEQ ID NO: 99669 - DNA, 27 bp, Artificial Sequence
  Description of Artificial Sequence: Synthetic oligonucleotide
ccatgtctggctgtgcagcagactgtc

SEQ ID NO: 99670 - DNA, 28 bp, Artificial Sequence
  Description of Artificial Sequence: Synthetic oligonucleotide
catgtctggctgtgcagcagactgtcag

SEQ ID NO: 99671 - DNA, 30 bp, Artificial Sequence
  Description of Artificial Sequence: Synthetic oligonucleotide
atgtctggctgtgcagcagactgtcagtac

SEQ ID NO: 99672 - DNA, 29 bp, Artificial Sequence
  Description of Artificial Sequence: Synthetic oligonucleotide
tgtctggctgtgcagcagactgtcagtac

SEQ ID NO: 99673 - DNA, 28 bp, Artificial Sequence
  Description of Artificial Sequence: Synthetic oligonucleotide
gtctggctgtgcagcagactgtcagtac

SEQ ID NO: 99674 - DNA, 29 bp, Artificial Sequence
  Description of Artificial Sequence: Synthetic oligonucleotide
tctggctgtgcagcagactgtcagtactg

SEQ ID NO: 99675 - DNA, 28 bp, Artificial Sequence
  Description of Artificial Sequence: Synthetic oligonucleotide
ctggctgtgcagcagactgtcagtactg

SEQ ID NO: 99676 - DNA, 28 bp, Artificial Sequence
  Description of Artificial Sequence: Synthetic oligonucleotide
tggctgtgcagcagactgtcagtactgg

SEQ ID NO: 99677 - DNA, 27 bp, Artificial Sequence
  Description of Artificial Sequence: Synthetic oligonucleotide
ggctgtgcagcagactgtcagtactgg

SEQ ID NO: 99678 - DNA, 27 bp, Artificial Sequence
  Description of Artificial Sequence: Synthetic oligonucleotide
gctgtgcagcagactgtcagtactggg

SEQ ID NO: 99679 - DNA, 28 bp, Artificial Sequence
  Description of Artificial Sequence: Synthetic oligonucleotide
ctgtgcagcagactgtcagtactgggag

SEQ ID NO: 99680 - DNA, 28 bp, Artificial Sequence
  Description of Artificial Sequence: Synthetic oligonucleotide
tgtgcagcagactgtcagtactgggagc

SEQ ID NO: 99681 - DNA, 27 bp, Artificial Sequence
  Description of Artificial Sequence: Synthetic oligonucleotide
gtgcagcagactgtcagtactgggagc

SEQ ID NO: 99682 - DNA, 27 bp, Artificial Sequence
  Description of Artificial Sequence: Synthetic oligonucleotide
tgcagcagactgtcagtactgggagcg

SEQ ID NO: 99683 - DNA, 26 bp, Artificial Sequence
  Description of Artificial Sequence: Synthetic oligonucleotide
gcagcagactgtcagtactgggagcg

SEQ ID NO: 99684 - DNA, 26 bp, Artificial Sequence
  Description of Artificial Sequence: Synthetic oligonucleotide
cagcagactgtcagtactgggagcgc

SEQ ID NO: 99685 - DNA, 27 bp, Artificial Sequence
  Description of Artificial Sequence: Synthetic oligonucleotide
agcagactgtcagtactgggagcgcct

SEQ ID NO: 99686 - DNA, 26 bp, Artificial Sequence
  Description of Artificial Sequence: Synthetic oligonucleotide
gcagactgtcagtactgggagcgcct

SEQ ID NO: 99687 - DNA, 26 bp, Artificial Sequence
  Description of Artificial Sequence: Synthetic oligonucleotide
cagactgtcagtactgggagcgcctg

SEQ ID NO: 99688 - DNA, 27 bp, Artificial Sequence
  Description of Artificial Sequence: Synthetic oligonucleotide
agactgtcagtactgggagcgcctgct

SEQ ID NO: 99689 - DNA, 26 bp, Artificial Sequence
  Description of Artificial Sequence: Synthetic oligonucleotide
gactgtcagtactgggagcgcctgct

SEQ ID NO: 99690 - DNA, 26 bp, Artificial Sequence
  Description of Artificial Sequence: Synthetic oligonucleotide
actgtcagtactgggagcgcctgctg

SEQ ID NO: 99691 - DNA, 25 bp, Artificial Sequence
  Description of Artificial Sequence: Synthetic oligonucleotide
ctgtcagtactgggagcgcctgctg

SEQ ID NO: 99692 - DNA, 25 bp, Artificial Sequence
  Description of Artificial Sequence: Synthetic oligonucleotide
tgtcagtactgggagcgcctgctgg

SEQ ID NO: 99693 - DNA, 24 bp, Artificial Sequence
  Description of Artificial Sequence: Synthetic oligonucleotide
gtcagtactgggagcgcctgctgg

SEQ ID NO: 99694 - DNA, 24 bp, Artificial Sequence
  Description of Artificial Sequence: Synthetic oligonucleotide
tcagtactgggagcgcctgctggc

SEQ ID NO: 99695 - DNA, 23 bp, Artificial Sequence
  Description of Artificial Sequence: Synthetic oligonucleotide
cagtactgggagcgcctgctggc

SEQ ID NO: 99696 - DNA, 25 bp, Artificial Sequence
  Description of Artificial Sequence: Synthetic oligonucleotide
agtactgggagcgcctgctggccaa

SEQ ID NO: 99697 - DNA, 24 bp, Artificial Sequence
  Description of Artificial Sequence: Synthetic oligonucleotide
gtactgggagcgcctgctggccaa

SEQ ID NO: 99698 - DNA, 24 bp, Artificial Sequence
  Description of Artificial Sequence: Synthetic oligonucleotide
tactgggagcgcctgctggccaag

SEQ ID NO: 99699 - DNA, 23 bp, Artificial Sequence
  Description of Artificial Sequence: Synthetic oligonucleotide
actgggagcgcctgctggccaag

SEQ ID NO: 99700 - DNA, 22 bp, Artificial Sequence
  Description of Artificial Sequence: Synthetic oligonucleotide
ctgggagcgcctgctggccaag

SEQ ID NO: 99701 - DNA, 25 bp, Artificial Sequence
  Description of Artificial Sequence: Synthetic oligonucleotide
tgggagcgcctgctggccaaggaat

SEQ ID NO: 99702 - DNA, 24 bp, Artificial Sequence
  Description of Artificial Sequence: Synthetic oligonucleotide
gggagcgcctgctggccaaggaat

SEQ ID NO: 99703 - DNA, 24 bp, Artificial Sequence
  Description of Artificial Sequence: Synthetic oligonucleotide
ggagcgcctgctggccaaggaatg

SEQ ID NO: 99704 - DNA, 25 bp, Artificial Sequence
  Description of Artificial Sequence: Synthetic oligonucleotide
gagcgcctgctggccaaggaatgca

SEQ ID NO: 99705 - DNA, 25 bp, Artificial Sequence
  Description of Artificial Sequence: Synthetic oligonucleotide
agcgcctgctggccaaggaatgcag

SEQ ID NO: 99706 - DNA, 24 bp, Artificial Sequence
  Description of Artificial Sequence: Synthetic oligonucleotide
gcgcctgctggccaaggaatgcag

SEQ ID NO: 99707 - DNA, 24 bp, Artificial Sequence
  Description of Artificial Sequence: Synthetic oligonucleotide
cgcctgctggccaaggaatgcagg

SEQ ID NO: 99708 - DNA, 25 bp, Artificial Sequence
  Description of Artificial Sequence: Synthetic oligonucleotide
gcctgctggccaaggaatgcaggct

SEQ ID NO: 99709 - DNA, 27 bp, Artificial Sequence
  Description of Artificial Sequence: Synthetic oligonucleotide
cctgctggccaaggaatgcaggctgta

SEQ ID NO: 99710 - DNA, 27 bp, Artificial Sequence
  Description of Artificial Sequence: Synthetic oligonucleotide
ctgctggccaaggaatgcaggctgtac

SEQ ID NO: 99711 - DNA, 30 bp, Artificial Sequence
  Description of Artificial Sequence: Synthetic oligonucleotide
tgctggccaaggaatgcaggctgtactatc

SEQ ID NO: 99712 - DNA, 29 bp, Artificial Sequence
  Description of Artificial Sequence: Synthetic oligonucleotide
gctggccaaggaatgcaggctgtactatc

SEQ ID NO: 99713 - DNA, 30 bp, Artificial Sequence
  Description of Artificial Sequence: Synthetic oligonucleotide
ctggccaaggaatgcaggctgtactatctg

SEQ ID NO: 99714 - DNA, 30 bp, Artificial Sequence
  Description of Artificial Sequence: Synthetic oligonucleotide
tggccaaggaatgcaggctgtactatctgc

SEQ ID NO: 99715 - DNA, 29 bp, Artificial Sequence
  Description of Artificial Sequence: Synthetic oligonucleotide
ggccaaggaatgcaggctgtactatctgc

SEQ ID NO: 99716 - DNA, 29 bp, Artificial Sequence
  Description of Artificial Sequence: Synthetic oligonucleotide
gccaaggaatgcaggctgtactatctgcg

SEQ ID NO: 99717 - DNA, 33 bp, Artificial Sequence
  Description of Artificial Sequence: Synthetic oligonucleotide
ccaaggaatgcaggctgtactatctgcgaaatg

SEQ ID NO: 99718 - DNA, 33 bp, Artificial Sequence
  Description of Artificial Sequence: Synthetic oligonucleotide
caaggaatgcaggctgtactatctgcgaaatgg

SEQ ID NO: 99719 - DNA, 34 bp, Artificial Sequence
  Description of Artificial Sequence: Synthetic oligonucleotide
aaggaatgcaggctgtactatctgcgaaatggag

SEQ ID NO: 99720 - DNA, 33 bp, Artificial Sequence
  Description of Artificial Sequence: Synthetic oligonucleotide
aggaatgcaggctgtactatctgcgaaatggag

SEQ ID NO: 99721 - DNA, 32 bp, Artificial Sequence
  Description of Artificial Sequence: Synthetic oligonucleotide
ggaatgcaggctgtactatctgcgaaatggag

SEQ ID NO: 99722 - DNA, 34 bp, Artificial Sequence
  Description of Artificial Sequence: Synthetic oligonucleotide
gaatgcaggctgtactatctgcgaaatggagaac

SEQ ID NO: 99723 - DNA, 34 bp, Artificial Sequence
  Description of Artificial Sequence: Synthetic oligonucleotide
aatgcaggctgtactatctgcgaaatggagaacg

SEQ ID NO: 99724 - DNA, 33 bp, Artificial Sequence
  Description of Artificial Sequence: Synthetic oligonucleotide
atgcaggctgtactatctgcgaaatggagaacg

SEQ ID NO: 99725 - DNA, 32 bp, Artificial Sequence
  Description of Artificial Sequence: Synthetic oligonucleotide
tgcaggctgtactatctgcgaaatggagaacg

SEQ ID NO: 99726 - DNA, 31 bp, Artificial Sequence
  Description of Artificial Sequence: Synthetic oligonucleotide
gcaggctgtactatctgcgaaatggagaacg

SEQ ID NO: 99727 - DNA, 36 bp, Artificial Sequence
  Description of Artificial Sequence: Synthetic oligonucleotide
caggctgtactatctgcgaaatggagaacgtatttc

SEQ ID NO: 99728 - DNA, 37 bp, Artificial Sequence
  Description of Artificial Sequence: Synthetic oligonucleotide
aggctgtactatctgcgaaatggagaacgtatttcag

SEQ ID NO: 99729 - DNA, 36 bp, Artificial Sequence
  Description of Artificial Sequence: Synthetic oligonucleotide
ggctgtactatctgcgaaatggagaacgtatttcag

SEQ ID NO: 99730 - DNA, 37 bp, Artificial Sequence
  Description of Artificial Sequence: Synthetic oligonucleotide
gctgtactatctgcgaaatggagaacgtatttcagtg

SEQ ID NO: 99731 - DNA, 38 bp, Artificial Sequence
  Description of Artificial Sequence: Synthetic oligonucleotide
ctgtactatctgcgaaatggagaacgtatttcagtgtc

SEQ ID NO: 99732 - DNA, 38 bp, Artificial Sequence
  Description of Artificial Sequence: Synthetic oligonucleotide
tgtactatctgcgaaatggagaacgtatttcagtgtcg

SEQ ID NO: 99733 - DNA, 37 bp, Artificial Sequence
  Description of Artificial Sequence: Synthetic oligonucleotide
gtactatctgcgaaatggagaacgtatttcagtgtcg

SEQ ID NO: 99734 - DNA, 37 bp, Artificial Sequence
  Description of Artificial Sequence: Synthetic oligonucleotide
tactatctgcgaaatggagaacgtatttcagtgtcgg

SEQ ID NO: 99735 - DNA, 36 bp, Artificial Sequence
  Description of Artificial Sequence: Synthetic oligonucleotide
actatctgcgaaatggagaacgtatttcagtgtcgg

SEQ ID NO: 99736 - DNA, 35 bp, Artificial Sequence
  Description of Artificial Sequence: Synthetic oligonucleotide
ctatctgcgaaatggagaacgtatttcagtgtcgg

SEQ ID NO: 99737 - DNA, 35 bp, Artificial Sequence
  Description of Artificial Sequence: Synthetic oligonucleotide
tatctgcgaaatggagaacgtatttcagtgtcggc

SEQ ID NO: 99738 - DNA, 34 bp, Artificial Sequence
  Description of Artificial Sequence: Synthetic oligonucleotide
atctgcgaaatggagaacgtatttcagtgtcggc

SEQ ID NO: 99739 - DNA, 33 bp, Artificial Sequence
  Description of Artificial Sequence: Synthetic oligonucleotide
tctgcgaaatggagaacgtatttcagtgtcggc

SEQ ID NO: 99740 - DNA, 32 bp, Artificial Sequence
  Description of Artificial Sequence: Synthetic oligonucleotide
ctgcgaaatggagaacgtatttcagtgtcggc

SEQ ID NO: 99741 - DNA, 33 bp, Artificial Sequence
  Description of Artificial Sequence: Synthetic oligonucleotide
tgcgaaatggagaacgtatttcagtgtcggcag

SEQ ID NO: 99742 - DNA, 32 bp, Artificial Sequence
  Description of Artificial Sequence: Synthetic oligonucleotide
gcgaaatggagaacgtatttcagtgtcggcag

SEQ ID NO: 99743 - DNA, 32 bp, Artificial Sequence
  Description of Artificial Sequence: Synthetic oligonucleotide
cgaaatggagaacgtatttcagtgtcggcagc

SEQ ID NO: 99744 - DNA, 32 bp, Artificial Sequence
  Description of Artificial Sequence: Synthetic oligonucleotide
gaaatggagaacgtatttcagtgtcggcagcc

SEQ ID NO: 99745 - DNA, 33 bp, Artificial Sequence
  Description of Artificial Sequence: Synthetic oligonucleotide
aaatggagaacgtatttcagtgtcggcagcctc

SEQ ID NO: 99746 - DNA, 32 bp, Artificial Sequence
  Description of Artificial Sequence: Synthetic oligonucleotide
aatggagaacgtatttcagtgtcggcagcctc

SEQ ID NO: 99747 - DNA, 31 bp, Artificial Sequence
  Description of Artificial Sequence: Synthetic oligonucleotide
atggagaacgtatttcagtgtcggcagcctc

SEQ ID NO: 99748 - DNA, 30 bp, Artificial Sequence
  Description of Artificial Sequence: Synthetic oligonucleotide
tggagaacgtatttcagtgtcggcagcctc

SEQ ID NO: 99749 - DNA, 29 bp, Artificial Sequence
  Description of Artificial Sequence: Synthetic oligonucleotide
ggagaacgtatttcagtgtcggcagcctc

SEQ ID NO: 99750 - DNA, 29 bp, Artificial Sequence
  Description of Artificial Sequence: Synthetic oligonucleotide
gagaacgtatttcagtgtcggcagcctcc

SEQ ID NO: 99751 - DNA, 31 bp, Artificial Sequence
  Description of Artificial Sequence: Synthetic oligonucleotide
agaacgtatttcagtgtcggcagcctccaag

SEQ ID NO: 99752 - DNA, 30 bp, Artificial Sequence
  Description of Artificial Sequence: Synthetic oligonucleotide
gaacgtatttcagtgtcggcagcctccaag

SEQ ID NO: 99753 - DNA, 30 bp, Artificial Sequence
  Description of Artificial Sequence: Synthetic oligonucleotide
aacgtatttcagtgtcggcagcctccaagc

SEQ ID NO: 99754 - DNA, 29 bp, Artificial Sequence
  Description of Artificial Sequence: Synthetic oligonucleotide
acgtatttcagtgtcggcagcctccaagc

SEQ ID NO: 99755 - DNA, 28 bp, Artificial Sequence
  Description of Artificial Sequence: Synthetic oligonucleotide
cgtatttcagtgtcggcagcctccaagc

SEQ ID NO: 99756 - DNA, 29 bp, Artificial Sequence
  Description of Artificial Sequence: Synthetic oligonucleotide
gtatttcagtgtcggcagcctccaagctg

SEQ ID NO: 99757 - DNA, 29 bp, Artificial Sequence
  Description of Artificial Sequence: Synthetic oligonucleotide
tatttcagtgtcggcagcctccaagctgc

SEQ ID NO: 99758 - DNA, 28 bp, Artificial Sequence
  Description of Artificial Sequence: Synthetic oligonucleotide
atttcagtgtcggcagcctccaagctgc

SEQ ID NO: 99759 - DNA, 27 bp, Artificial Sequence
  Description of Artificial Sequence: Synthetic oligonucleotide
tttcagtgtcggcagcctccaagctgc

SEQ ID NO: 99760 - DNA, 27 bp, Artificial Sequence
  Description of Artificial Sequence: Synthetic oligonucleotide
ttcagtgtcggcagcctccaagctgct

SEQ ID NO: 99761 - DNA, 26 bp, Artificial Sequence
  Description of Artificial Sequence: Synthetic oligonucleotide
tcagtgtcggcagcctccaagctgct

SEQ ID NO: 99762 - DNA, 25 bp, Artificial Sequence
  Description of Artificial Sequence: Synthetic oligonucleotide
cagtgtcggcagcctccaagctgct

SEQ ID NO: 99763 - DNA, 26 bp, Artificial Sequence
  Description of Artificial Sequence: Synthetic oligonucleotide
agtgtcggcagcctccaagctgctgt

SEQ ID NO: 99764 - DNA, 25 bp, Artificial Sequence
  Description of Artificial Sequence: Synthetic oligonucleotide
gtgtcggcagcctccaagctgctgt

SEQ ID NO: 99765 - DNA, 25 bp, Artificial Sequence
  Description of Artificial Sequence: Synthetic oligonucleotide
tgtcggcagcctccaagctgctgtc

SEQ ID NO: 99766 - DNA, 24 bp, Artificial Sequence
  Description of Artificial Sequence: Synthetic oligonucleotide
gtcggcagcctccaagctgctgtc

SEQ ID NO: 99767 - DNA, 26 bp, Artificial Sequence
  Description of Artificial Sequence: Synthetic oligonucleotide
tcggcagcctccaagctgctgtccaa

SEQ ID NO: 99768 - DNA, 25 bp, Artificial Sequence
  Description of Artificial Sequence: Synthetic oligonucleotide
cggcagcctccaagctgctgtccaa

SEQ ID NO: 99769 - DNA, 27 bp, Artificial Sequence
  Description of Artificial Sequence: Synthetic oligonucleotide
ggcagcctccaagctgctgtccaacat

SEQ ID NO: 99770 - DNA, 27 bp, Artificial Sequence
  Description of Artificial Sequence: Synthetic oligonucleotide
gcagcctccaagctgctgtccaacatg

SEQ ID NO: 99771 - DNA, 29 bp, Artificial Sequence
  Description of Artificial Sequence: Synthetic oligonucleotide
cagcctccaagctgctgtccaacatgatg

SEQ ID NO: 99772 - DNA, 30 bp, Artificial Sequence
  Description of Artificial Sequence: Synthetic oligonucleotide
agcctccaagctgctgtccaacatgatgtg

SEQ ID NO: 99773 - DNA, 29 bp, Artificial Sequence
  Description of Artificial Sequence: Synthetic oligonucleotide
gcctccaagctgctgtccaacatgatgtg

SEQ ID NO: 99774 - DNA, 29 bp, Artificial Sequence
  Description of Artificial Sequence: Synthetic oligonucleotide
cctccaagctgctgtccaacatgatgtgc

SEQ ID NO: 99775 - DNA, 29 bp, Artificial Sequence
  Description of Artificial Sequence: Synthetic oligonucleotide
ctccaagctgctgtccaacatgatgtgcc

SEQ ID NO: 99776 - DNA, 30 bp, Artificial Sequence
  Description of Artificial Sequence: Synthetic oligonucleotide
tccaagctgctgtccaacatgatgtgccag

SEQ ID NO: 99777 - DNA, 29 bp, Artificial Sequence
  Description of Artificial Sequence: Synthetic oligonucleotide
ccaagctgctgtccaacatgatgtgccag

SEQ ID NO: 99778 - DNA, 31 bp, Artificial Sequence
  Description of Artificial Sequence: Synthetic oligonucleotide
caagctgctgtccaacatgatgtgccagtac

SEQ ID NO: 99779 - DNA, 31 bp, Artificial Sequence
  Description of Artificial Sequence: Synthetic oligonucleotide
aagctgctgtccaacatgatgtgccagtacc

SEQ ID NO: 99780 - DNA, 30 bp, Artificial Sequence
  Description of Artificial Sequence: Synthetic oligonucleotide
agctgctgtccaacatgatgtgccagtacc

SEQ ID NO: 99781 - DNA, 29 bp, Artificial Sequence
  Description of Artificial Sequence: Synthetic oligonucleotide
gctgctgtccaacatgatgtgccagtacc

SEQ ID NO: 99782 - DNA, 29 bp, Artificial Sequence
  Description of Artificial Sequence: Synthetic oligonucleotide
ctgctgtccaacatgatgtgccagtaccg

SEQ ID NO: 99783 - DNA, 29 bp, Artificial Sequence
  Description of Artificial Sequence: Synthetic oligonucleotide
tgctgtccaacatgatgtgccagtaccgg

SEQ ID NO: 99784 - DNA, 28 bp, Artificial Sequence
  Description of Artificial Sequence: Synthetic oligonucleotide
gctgtccaacatgatgtgccagtaccgg

SEQ ID NO: 99785 - DNA, 28 bp, Artificial Sequence
  Description of Artificial Sequence: Synthetic oligonucleotide
ctgtccaacatgatgtgccagtaccggg

SEQ ID NO: 99786 - DNA, 28 bp, Artificial Sequence
  Description of Artificial Sequence: Synthetic oligonucleotide
tgtccaacatgatgtgccagtaccgggg

SEQ ID NO: 99787 - DNA, 27 bp, Artificial Sequence
  Description of Artificial Sequence: Synthetic oligonucleotide
gtccaacatgatgtgccagtaccgggg

SEQ ID NO: 99788 - DNA, 27 bp, Artificial Sequence
  Description of Artificial Sequence: Synthetic oligonucleotide
tccaacatgatgtgccagtaccggggc

SEQ ID NO: 99789 - DNA, 27 bp, Artificial Sequence
  Description of Artificial Sequence: Synthetic oligonucleotide
ccaacatgatgtgccagtaccggggca

SEQ ID NO: 99790 - DNA, 28 bp, Artificial Sequence
  Description of Artificial Sequence: Synthetic oligonucleotide
caacatgatgtgccagtaccggggcatg

SEQ ID NO: 99791 - DNA, 28 bp, Artificial Sequence
  Description of Artificial Sequence: Synthetic oligonucleotide
aacatgatgtgccagtaccggggcatgg

SEQ ID NO: 99792 - DNA, 27 bp, Artificial Sequence
  Description of Artificial Sequence: Synthetic oligonucleotide
acatgatgtgccagtaccggggcatgg

SEQ ID NO: 99793 - DNA, 26 bp, Artificial Sequence
  Description of Artificial Sequence: Synthetic oligonucleotide
catgatgtgccagtaccggggcatgg

SEQ ID NO: 99794 - DNA, 26 bp, Artificial Sequence
  Description of Artificial Sequence: Synthetic oligonucleotide
atgatgtgccagtaccggggcatggg

SEQ ID NO: 99795 - DNA, 25 bp, Artificial Sequence
  Description of Artificial Sequence: Synthetic oligonucleotide
tgatgtgccagtaccggggcatggg

SEQ ID NO: 99796 - DNA, 24 bp, Artificial Sequence
  Description of Artificial Sequence: Synthetic oligonucleotide
gatgtgccagtaccggggcatggg

SEQ ID NO: 99797 - DNA, 24 bp, Artificial Sequence
  Description of Artificial Sequence: Synthetic oligonucleotide
atgtgccagtaccggggcatgggc

SEQ ID NO: 99798 - DNA, 23 bp, Artificial Sequence
  Description of Artificial Sequence: Synthetic oligonucleotide
tgtgccagtaccggggcatgggc

SEQ ID NO: 99799 - DNA, 22 bp, Artificial Sequence
  Description of Artificial Sequence: Synthetic oligonucleotide
gtgccagtaccggggcatgggc

SEQ ID NO: 99800 - DNA, 23 bp, Artificial Sequence
  Description of Artificial Sequence: Synthetic oligonucleotide
tgccagtaccggggcatgggcct

SEQ ID NO: 99801 - DNA, 22 bp, Artificial Sequence
  Description of Artificial Sequence: Synthetic oligonucleotide
gccagtaccggggcatgggcct

SEQ ID NO: 99802 - DNA, 23 bp, Artificial Sequence
  Description of Artificial Sequence: Synthetic oligonucleotide
ccagtaccggggcatgggcctct

SEQ ID NO: 99803 - DNA, 26 bp, Artificial Sequence
  Description of Artificial Sequence: Synthetic oligonucleotide
cagtaccggggcatgggcctctctat

SEQ ID NO: 99804 - DNA, 26 bp, Artificial Sequence
  Description of Artificial Sequence: Synthetic oligonucleotide
agtaccggggcatgggcctctctatg

SEQ ID NO: 99805 - DNA, 25 bp, Artificial Sequence
  Description of Artificial Sequence: Synthetic oligonucleotide
gtaccggggcatgggcctctctatg

SEQ ID NO: 99806 - DNA, 25 bp, Artificial Sequence
  Description of Artificial Sequence: Synthetic oligonucleotide
taccggggcatgggcctctctatgg

SEQ ID NO: 99807 - DNA, 24 bp, Artificial Sequence
  Description of Artificial Sequence: Synthetic oligonucleotide
accggggcatgggcctctctatgg

SEQ ID NO: 99808 - DNA, 23 bp, Artificial Sequence
  Description of Artificial Sequence: Synthetic oligonucleotide
ccggggcatgggcctctctatgg

SEQ ID NO: 99809 - DNA, 23 bp, Artificial Sequence
  Description of Artificial Sequence: Synthetic oligonucleotide
cggggcatgggcctctctatggg

SEQ ID NO: 99810 - DNA, 24 bp, Artificial Sequence
  Description of Artificial Sequence: Synthetic oligonucleotide
ggggcatgggcctctctatgggca

SEQ ID NO: 99811 - DNA, 27 bp, Artificial Sequence
  Description of Artificial Sequence: Synthetic oligonucleotide
gggcatgggcctctctatgggcagtat

SEQ ID NO: 99812 - DNA, 27 bp, Artificial Sequence
  Description of Artificial Sequence: Synthetic oligonucleotide
ggcatgggcctctctatgggcagtatg

SEQ ID NO: 99813 - DNA, 29 bp, Artificial Sequence
  Description of Artificial Sequence: Synthetic oligonucleotide
gcatgggcctctctatgggcagtatgatc

SEQ ID NO: 99814 - DNA, 30 bp, Artificial Sequence
  Description of Artificial Sequence: Synthetic oligonucleotide
catgggcctctctatgggcagtatgatctg

SEQ ID NO: 99815 - DNA, 31 bp, Artificial Sequence
  Description of Artificial Sequence: Synthetic oligonucleotide
atgggcctctctatgggcagtatgatctgtg

SEQ ID NO: 99816 - DNA, 30 bp, Artificial Sequence
  Description of Artificial Sequence: Synthetic oligonucleotide
tgggcctctctatgggcagtatgatctgtg

SEQ ID NO: 99817 - DNA, 29 bp, Artificial Sequence
  Description of Artificial Sequence: Synthetic oligonucleotide
gggcctctctatgggcagtatgatctgtg

SEQ ID NO: 99818 - DNA, 29 bp, Artificial Sequence
  Description of Artificial Sequence: Synthetic oligonucleotide
ggcctctctatgggcagtatgatctgtgg

SEQ ID NO: 99819 - DNA, 29 bp, Artificial Sequence
  Description of Artificial Sequence: Synthetic oligonucleotide
gcctctctatgggcagtatgatctgtggc

SEQ ID NO: 99820 - DNA, 30 bp, Artificial Sequence
  Description of Artificial Sequence: Synthetic oligonucleotide
cctctctatgggcagtatgatctgtggctg

SEQ ID NO: 99821 - DNA, 30 bp, Artificial Sequence
  Description of Artificial Sequence: Synthetic oligonucleotide
ctctctatgggcagtatgatctgtggctgg

SEQ ID NO: 99822 - DNA, 30 bp, Artificial Sequence
  Description of Artificial Sequence: Synthetic oligonucleotide
tctctatgggcagtatgatctgtggctggg

SEQ ID NO: 99823 - DNA, 29 bp, Artificial Sequence
  Description of Artificial Sequence: Synthetic oligonucleotide
ctctatgggcagtatgatctgtggctggg

SEQ ID NO: 99824 - DNA, 33 bp, Artificial Sequence
  Description of Artificial Sequence: Synthetic oligonucleotide
tctatgggcagtatgatctgtggctgggataag

SEQ ID NO: 99825 - DNA, 32 bp, Artificial Sequence
  Description of Artificial Sequence: Synthetic oligonucleotide
ctatgggcagtatgatctgtggctgggataag

SEQ ID NO: 99826 - DNA, 34 bp, Artificial Sequence
  Description of Artificial Sequence: Synthetic oligonucleotide
tatgggcagtatgatctgtggctgggataagaag

SEQ ID NO: 99827 - DNA, 33 bp, Artificial Sequence
  Description of Artificial Sequence: Synthetic oligonucleotide
atgggcagtatgatctgtggctgggataagaag

SEQ ID NO: 99828 - DNA, 32 bp, Artificial Sequence
  Description of Artificial Sequence: Synthetic oligonucleotide
tgggcagtatgatctgtggctgggataagaag

SEQ ID NO: 99829 - DNA, 31 bp, Artificial Sequence
  Description of Artificial Sequence: Synthetic oligonucleotide
gggcagtatgatctgtggctgggataagaag

SEQ ID NO: 99830 - DNA, 31 bp, Artificial Sequence
  Description of Artificial Sequence: Synthetic oligonucleotide
ggcagtatgatctgtggctgggataagaagg

SEQ ID NO: 99831 - DNA, 31 bp, Artificial Sequence
  Description of Artificial Sequence: Synthetic oligonucleotide
gcagtatgatctgtggctgggataagaaggg

SEQ ID NO: 99832 - DNA, 32 bp, Artificial Sequence
  Description of Artificial Sequence: Synthetic oligonucleotide
cagtatgatctgtggctgggataagaagggtc

SEQ ID NO: 99833 - DNA, 32 bp, Artificial Sequence
  Description of Artificial Sequence: Synthetic oligonucleotide
agtatgatctgtggctgggataagaagggtcc

SEQ ID NO: 99834 - DNA, 31 bp, Artificial Sequence
  Description of Artificial Sequence: Synthetic oligonucleotide
gtatgatctgtggctgggataagaagggtcc

SEQ ID NO: 99835 - DNA, 32 bp, Artificial Sequence
  Description of Artificial Sequence: Synthetic oligonucleotide
tatgatctgtggctgggataagaagggtcctg

SEQ ID NO: 99836 - DNA, 31 bp, Artificial Sequence
  Description of Artificial Sequence: Synthetic oligonucleotide
atgatctgtggctgggataagaagggtcctg

SEQ ID NO: 99837 - DNA, 30 bp, Artificial Sequence
  Description of Artificial Sequence: Synthetic oligonucleotide
tgatctgtggctgggataagaagggtcctg

SEQ ID NO: 99838 - DNA, 29 bp, Artificial Sequence
  Description of Artificial Sequence: Synthetic oligonucleotide
gatctgtggctgggataagaagggtcctg

SEQ ID NO: 99839 - DNA, 29 bp, Artificial Sequence
  Description of Artificial Sequence: Synthetic oligonucleotide
atctgtggctgggataagaagggtcctgg

SEQ ID NO: 99840 - DNA, 28 bp, Artificial Sequence
  Description of Artificial Sequence: Synthetic oligonucleotide
tctgtggctgggataagaagggtcctgg

SEQ ID NO: 99841 - DNA, 27 bp, Artificial Sequence
  Description of Artificial Sequence: Synthetic oligonucleotide
ctgtggctgggataagaagggtcctgg

SEQ ID NO: 99842 - DNA, 28 bp, Artificial Sequence
  Description of Artificial Sequence: Synthetic oligonucleotide
tgtggctgggataagaagggtcctggac

SEQ ID NO: 99843 - DNA, 27 bp, Artificial Sequence
  Description of Artificial Sequence: Synthetic oligonucleotide
gtggctgggataagaagggtcctggac

SEQ ID NO: 99844 - DNA, 28 bp, Artificial Sequence
  Description of Artificial Sequence: Synthetic oligonucleotide
tggctgggataagaagggtcctggactc

SEQ ID NO: 99845 - DNA, 27 bp, Artificial Sequence
  Description of Artificial Sequence: Synthetic oligonucleotide
ggctgggataagaagggtcctggactc

SEQ ID NO: 99846 - DNA, 29 bp, Artificial Sequence
  Description of Artificial Sequence: Synthetic oligonucleotide
gctgggataagaagggtcctggactctac

SEQ ID NO: 99847 - DNA, 31 bp, Artificial Sequence
  Description of Artificial Sequence: Synthetic oligonucleotide
ctgggataagaagggtcctggactctactac

SEQ ID NO: 99848 - DNA, 31 bp, Artificial Sequence
  Description of Artificial Sequence: Synthetic oligonucleotide
tgggataagaagggtcctggactctactacg

SEQ ID NO: 99849 - DNA, 30 bp, Artificial Sequence
  Description of Artificial Sequence: Synthetic oligonucleotide
gggataagaagggtcctggactctactacg

SEQ ID NO: 99850 - DNA, 31 bp, Artificial Sequence
  Description of Artificial Sequence: Synthetic oligonucleotide
ggataagaagggtcctggactctactacgtg

SEQ ID NO: 99851 - DNA, 31 bp, Artificial Sequence
  Description of Artificial Sequence: Synthetic oligonucleotide
gataagaagggtcctggactctactacgtgg

SEQ ID NO: 99852 - DNA, 33 bp, Artificial Sequence
  Description of Artificial Sequence: Synthetic oligonucleotide
ataagaagggtcctggactctactacgtggatg

SEQ ID NO: 99853 - DNA, 32 bp, Artificial Sequence
  Description of Artificial Sequence: Synthetic oligonucleotide
taagaagggtcctggactctactacgtggatg

SEQ ID NO: 99854 - DNA, 31 bp, Artificial Sequence
  Description of Artificial Sequence: Synthetic oligonucleotide
aagaagggtcctggactctactacgtggatg

SEQ ID NO: 99855 - DNA, 30 bp, Artificial Sequence
  Description of Artificial Sequence: Synthetic oligonucleotide
agaagggtcctggactctactacgtggatg

SEQ ID NO: 99856 - DNA, 29 bp, Artificial Sequence
  Description of Artificial Sequence: Synthetic oligonucleotide
gaagggtcctggactctactacgtggatg

SEQ ID NO: 99857 - DNA, 31 bp, Artificial Sequence
  Description of Artificial Sequence: Synthetic oligonucleotide
aagggtcctggactctactacgtggatgaac

SEQ ID NO: 99858 - DNA, 30 bp, Artificial Sequence
  Description of Artificial Sequence: Synthetic oligonucleotide
agggtcctggactctactacgtggatgaac

SEQ ID NO: 99859 - DNA, 29 bp, Artificial Sequence
  Description of Artificial Sequence: Synthetic oligonucleotide
gggtcctggactctactacgtggatgaac

SEQ ID NO: 99860 - DNA, 31 bp, Artificial Sequence
  Description of Artificial Sequence: Synthetic oligonucleotide
ggtcctggactctactacgtggatgaacatg

SEQ ID NO: 99861 - DNA, 31 bp, Artificial Sequence
  Description of Artificial Sequence: Synthetic oligonucleotide
gtcctggactctactacgtggatgaacatgg

SEQ ID NO: 99862 - DNA, 31 bp, Artificial Sequence
  Description of Artificial Sequence: Synthetic oligonucleotide
tcctggactctactacgtggatgaacatggg

SEQ ID NO: 99863 - DNA, 30 bp, Artificial Sequence
  Description of Artificial Sequence: Synthetic oligonucleotide
cctggactctactacgtggatgaacatggg

SEQ ID NO: 99864 - DNA, 31 bp, Artificial Sequence
  Description of Artificial Sequence: Synthetic oligonucleotide
ctggactctactacgtggatgaacatgggac

SEQ ID NO: 99865 - DNA, 32 bp, Artificial Sequence
  Description of Artificial Sequence: Synthetic oligonucleotide
tggactctactacgtggatgaacatgggactc

SEQ ID NO: 99866 - DNA, 31 bp, Artificial Sequence
  Description of Artificial Sequence: Synthetic oligonucleotide
ggactctactacgtggatgaacatgggactc

SEQ ID NO: 99867 - DNA, 31 bp, Artificial Sequence
  Description of Artificial Sequence: Synthetic oligonucleotide
gactctactacgtggatgaacatgggactcg

SEQ ID NO: 99868 - DNA, 31 bp, Artificial Sequence
  Description of Artificial Sequence: Synthetic oligonucleotide
actctactacgtggatgaacatgggactcgg

SEQ ID NO: 99869 - DNA, 30 bp, Artificial Sequence
  Description of Artificial Sequence: Synthetic oligonucleotide
ctctactacgtggatgaacatgggactcgg

SEQ ID NO: 99870 - DNA, 30 bp, Artificial Sequence
  Description of Artificial Sequence: Synthetic oligonucleotide
tctactacgtggatgaacatgggactcggc

SEQ ID NO: 99871 - DNA, 29 bp, Artificial Sequence
  Description of Artificial Sequence: Synthetic oligonucleotide
ctactacgtggatgaacatgggactcggc

SEQ ID NO: 99872 - DNA, 30 bp, Artificial Sequence
  Description of Artificial Sequence: Synthetic oligonucleotide
tactacgtggatgaacatgggactcggctc

SEQ ID NO: 99873 - DNA, 29 bp, Artificial Sequence
  Description of Artificial Sequence: Synthetic oligonucleotide
actacgtggatgaacatgggactcggctc

SEQ ID NO: 99874 - DNA, 28 bp, Artificial Sequence
  Description of Artificial Sequence: Synthetic oligonucleotide
ctacgtggatgaacatgggactcggctc

SEQ ID NO: 99875 - DNA, 29 bp, Artificial Sequence
  Description of Artificial Sequence: Synthetic oligonucleotide
tacgtggatgaacatgggactcggctctc

SEQ ID NO: 99876 - DNA, 28 bp, Artificial Sequence
  Description of Artificial Sequence: Synthetic oligonucleotide
acgtggatgaacatgggactcggctctc

SEQ ID NO: 99877 - DNA, 27 bp, Artificial Sequence
  Description of Artificial Sequence: Synthetic oligonucleotide
cgtggatgaacatgggactcggctctc

SEQ ID NO: 99878 - DNA, 28 bp, Artificial Sequence
  Description of Artificial Sequence: Synthetic oligonucleotide
gtggatgaacatgggactcggctctcag

SEQ ID NO: 99879 - DNA, 28 bp, Artificial Sequence
  Description of Artificial Sequence: Synthetic oligonucleotide
tggatgaacatgggactcggctctcagg

SEQ ID NO: 99880 - DNA, 27 bp, Artificial Sequence
  Description of Artificial Sequence: Synthetic oligonucleotide
ggatgaacatgggactcggctctcagg

SEQ ID NO: 99881 - DNA, 33 bp, Artificial Sequence
  Description of Artificial Sequence: Synthetic oligonucleotide
gatgaacatgggactcggctctcaggaaatatg

SEQ ID NO: 99882 - DNA, 35 bp, Artificial Sequence
  Description of Artificial Sequence: Synthetic oligonucleotide
atgaacatgggactcggctctcaggaaatatgttc

SEQ ID NO: 99883 - DNA, 34 bp, Artificial Sequence
  Description of Artificial Sequence: Synthetic oligonucleotide
tgaacatgggactcggctctcaggaaatatgttc

SEQ ID NO: 99884 - DNA, 33 bp, Artificial Sequence
  Description of Artificial Sequence: Synthetic oligonucleotide
gaacatgggactcggctctcaggaaatatgttc

SEQ ID NO: 99885 - DNA, 34 bp, Artificial Sequence
  Description of Artificial Sequence: Synthetic oligonucleotide
aacatgggactcggctctcaggaaatatgttctc

SEQ ID NO: 99886 - DNA, 33 bp, Artificial Sequence
  Description of Artificial Sequence: Synthetic oligonucleotide
acatgggactcggctctcaggaaatatgttctc

SEQ ID NO: 99887 - DNA, 32 bp, Artificial Sequence
  Description of Artificial Sequence: Synthetic oligonucleotide
catgggactcggctctcaggaaatatgttctc

SEQ ID NO: 99888 - DNA, 32 bp, Artificial Sequence
  Description of Artificial Sequence: Synthetic oligonucleotide
atgggactcggctctcaggaaatatgttctcc

SEQ ID NO: 99889 - DNA, 31 bp, Artificial Sequence
  Description of Artificial Sequence: Synthetic oligonucleotide
tgggactcggctctcaggaaatatgttctcc

SEQ ID NO: 99890 - DNA, 30 bp, Artificial Sequence
  Description of Artificial Sequence: Synthetic oligonucleotide
gggactcggctctcaggaaatatgttctcc

SEQ ID NO: 99891 - DNA, 31 bp, Artificial Sequence
  Description of Artificial Sequence: Synthetic oligonucleotide
ggactcggctctcaggaaatatgttctccac

SEQ ID NO: 99892 - DNA, 31 bp, Artificial Sequence
  Description of Artificial Sequence: Synthetic oligonucleotide
gactcggctctcaggaaatatgttctccacg

SEQ ID NO: 99893 - DNA, 31 bp, Artificial Sequence
  Description of Artificial Sequence: Synthetic oligonucleotide
actcggctctcaggaaatatgttctccacgg

SEQ ID NO: 99894 - DNA, 30 bp, Artificial Sequence
  Description of Artificial Sequence: Synthetic oligonucleotide
ctcggctctcaggaaatatgttctccacgg

SEQ ID NO: 99895 - DNA, 30 bp, Artificial Sequence
  Description of Artificial Sequence: Synthetic oligonucleotide
tcggctctcaggaaatatgttctccacggg

SEQ ID NO: 99896 - DNA, 29 bp, Artificial Sequence
  Description of Artificial Sequence: Synthetic oligonucleotide
cggctctcaggaaatatgttctccacggg

SEQ ID NO: 99897 - DNA, 31 bp, Artificial Sequence
  Description of Artificial Sequence: Synthetic oligonucleotide
ggctctcaggaaatatgttctccacgggtag

SEQ ID NO: 99898 - DNA, 32 bp, Artificial Sequence
  Description of Artificial Sequence: Synthetic oligonucleotide
gctctcaggaaatatgttctccacgggtagtg

SEQ ID NO: 99899 - DNA, 32 bp, Artificial Sequence
  Description of Artificial Sequence: Synthetic oligonucleotide
ctctcaggaaatatgttctccacgggtagtgg

SEQ ID NO: 99900 - DNA, 32 bp, Artificial Sequence
  Description of Artificial Sequence: Synthetic oligonucleotide
tctcaggaaatatgttctccacgggtagtggg

SEQ ID NO: 99901 - DNA, 31 bp, Artificial Sequence
  Description of Artificial Sequence: Synthetic oligonucleotide
ctcaggaaatatgttctccacgggtagtggg

SEQ ID NO: 99902 - DNA, 33 bp, Artificial Sequence
  Description of Artificial Sequence: Synthetic oligonucleotide
tcaggaaatatgttctccacgggtagtgggaac

SEQ ID NO: 99903 - DNA, 32 bp, Artificial Sequence
  Description of Artificial Sequence: Synthetic oligonucleotide
caggaaatatgttctccacgggtagtgggaac

SEQ ID NO: 99904 - DNA, 33 bp, Artificial Sequence
  Description of Artificial Sequence: Synthetic oligonucleotide
aggaaatatgttctccacgggtagtgggaacac

SEQ ID NO: 99905 - DNA, 32 bp, Artificial Sequence
  Description of Artificial Sequence: Synthetic oligonucleotide
ggaaatatgttctccacgggtagtgggaacac

SEQ ID NO: 99906 - DNA, 36 bp, Artificial Sequence
  Description of Artificial Sequence: Synthetic oligonucleotide
gaaatatgttctccacgggtagtgggaacacttatg

SEQ ID NO: 99907 - DNA, 36 bp, Artificial Sequence
  Description of Artificial Sequence: Synthetic oligonucleotide
aaatatgttctccacgggtagtgggaacacttatgc

SEQ ID NO: 99908 - DNA, 35 bp, Artificial Sequence
  Description of Artificial Sequence: Synthetic oligonucleotide
aatatgttctccacgggtagtgggaacacttatgc

SEQ ID NO: 99909 - DNA, 34 bp, Artificial Sequence
  Description of Artificial Sequence: Synthetic oligonucleotide
atatgttctccacgggtagtgggaacacttatgc

SEQ ID NO: 99910 - DNA, 33 bp, Artificial Sequence
  Description of Artificial Sequence: Synthetic oligonucleotide
tatgttctccacgggtagtgggaacacttatgc

SEQ ID NO: 99911 - DNA, 32 bp, Artificial Sequence
  Description of Artificial Sequence: Synthetic oligonucleotide
atgttctccacgggtagtgggaacacttatgc

SEQ ID NO: 99912 - DNA, 31 bp, Artificial Sequence
  Description of Artificial Sequence: Synthetic oligonucleotide
tgttctccacgggtagtgggaacacttatgc

SEQ ID NO: 99913 - DNA, 30 bp, Artificial Sequence
  Description of Artificial Sequence: Synthetic oligonucleotide
gttctccacgggtagtgggaacacttatgc

SEQ ID NO: 99914 - DNA, 30 bp, Artificial Sequence
  Description of Artificial Sequence: Synthetic oligonucleotide
ttctccacgggtagtgggaacacttatgcc

SEQ ID NO: 99915 - DNA, 29 bp, Artificial Sequence
  Description of Artificial Sequence: Synthetic oligonucleotide
tctccacgggtagtgggaacacttatgcc

SEQ ID NO: 99916 - DNA, 28 bp, Artificial Sequence
  Description of Artificial Sequence: Synthetic oligonucleotide
ctccacgggtagtgggaacacttatgcc

SEQ ID NO: 99917 - DNA, 30 bp, Artificial Sequence
  Description of Artificial Sequence: Synthetic oligonucleotide
tccacgggtagtgggaacacttatgcctac

SEQ ID NO: 99918 - DNA, 29 bp, Artificial Sequence
  Description of Artificial Sequence: Synthetic oligonucleotide
ccacgggtagtgggaacacttatgcctac

SEQ ID NO: 99919 - DNA, 29 bp, Artificial Sequence
  Description of Artificial Sequence: Synthetic oligonucleotide
cacgggtagtgggaacacttatgcctacg

SEQ ID NO: 99920 - DNA, 29 bp, Artificial Sequence
  Description of Artificial Sequence: Synthetic oligonucleotide
acgggtagtgggaacacttatgcctacgg

SEQ ID NO: 99921 - DNA, 28 bp, Artificial Sequence
  Description of Artificial Sequence: Synthetic oligonucleotide
cgggtagtgggaacacttatgcctacgg

SEQ ID NO: 99922 - DNA, 28 bp, Artificial Sequence
  Description of Artificial Sequence: Synthetic oligonucleotide
gggtagtgggaacacttatgcctacggg

SEQ ID NO: 99923 - DNA, 28 bp, Artificial Sequence
  Description of Artificial Sequence: Synthetic oligonucleotide
ggtagtgggaacacttatgcctacgggg

SEQ ID NO: 99924 - DNA, 29 bp, Artificial Sequence
  Description of Artificial Sequence: Synthetic oligonucleotide
gtagtgggaacacttatgcctacggggtc

SEQ ID NO: 99925 - DNA, 31 bp, Artificial Sequence
  Description of Artificial Sequence: Synthetic oligonucleotide
tagtgggaacacttatgcctacggggtcatg

SEQ ID NO: 99926 - DNA, 30 bp, Artificial Sequence
  Description of Artificial Sequence: Synthetic oligonucleotide
agtgggaacacttatgcctacggggtcatg

SEQ ID NO: 99927 - DNA, 29 bp, Artificial Sequence
  Description of Artificial Sequence: Synthetic oligonucleotide
gtgggaacacttatgcctacggggtcatg

SEQ ID NO: 99928 - DNA, 29 bp, Artificial Sequence
  Description of Artificial Sequence: Synthetic oligonucleotide
tgggaacacttatgcctacggggtcatgg

SEQ ID NO: 99929 - DNA, 28 bp, Artificial Sequence
  Description of Artificial Sequence: Synthetic oligonucleotide
gggaacacttatgcctacggggtcatgg

SEQ ID NO: 99930 - DNA, 29 bp, Artificial Sequence
  Description of Artificial Sequence: Synthetic oligonucleotide
ggaacacttatgcctacggggtcatggac

SEQ ID NO: 99931 - DNA, 30 bp, Artificial Sequence
  Description of Artificial Sequence: Synthetic oligonucleotide
gaacacttatgcctacggggtcatggacag

SEQ ID NO: 99932 - DNA, 31 bp, Artificial Sequence
  Description of Artificial Sequence: Synthetic oligonucleotide
aacacttatgcctacggggtcatggacagtg

SEQ ID NO: 99933 - DNA, 30 bp, Artificial Sequence
  Description of Artificial Sequence: Synthetic oligonucleotide
acacttatgcctacggggtcatggacagtg

SEQ ID NO: 99934 - DNA, 29 bp, Artificial Sequence
  Description of Artificial Sequence: Synthetic oligonucleotide
cacttatgcctacggggtcatggacagtg

SEQ ID NO: 99935 - DNA, 29 bp, Artificial Sequence
  Description of Artificial Sequence: Synthetic oligonucleotide
acttatgcctacggggtcatggacagtgg

SEQ ID NO: 99936 - DNA, 28 bp, Artificial Sequence
  Description of Artificial Sequence: Synthetic oligonucleotide
cttatgcctacggggtcatggacagtgg

SEQ ID NO: 99937 - DNA, 28 bp, Artificial Sequence
  Description of Artificial Sequence: Synthetic oligonucleotide
ttatgcctacggggtcatggacagtggc

SEQ ID NO: 99938 - DNA, 27 bp, Artificial Sequence
  Description of Artificial Sequence: Synthetic oligonucleotide
tatgcctacggggtcatggacagtggc

SEQ ID NO: 99939 - DNA, 27 bp, Artificial Sequence
  Description of Artificial Sequence: Synthetic oligonucleotide
atgcctacggggtcatggacagtggct

SEQ ID NO: 99940 - DNA, 27 bp, Artificial Sequence
  Description of Artificial Sequence: Synthetic oligonucleotide
tgcctacggggtcatggacagtggcta

SEQ ID NO: 99941 - DNA, 27 bp, Artificial Sequence
  Description of Artificial Sequence: Synthetic oligonucleotide
gcctacggggtcatggacagtggctat

SEQ ID NO: 99942 - DNA, 27 bp, Artificial Sequence
  Description of Artificial Sequence: Synthetic oligonucleotide
cctacggggtcatggacagtggctatc

SEQ ID NO: 99943 - DNA, 27 bp, Artificial Sequence
  Description of Artificial Sequence: Synthetic oligonucleotide
ctacggggtcatggacagtggctatcg

SEQ ID NO: 99944 - DNA, 27 bp, Artificial Sequence
  Description of Artificial Sequence: Synthetic oligonucleotide
tacggggtcatggacagtggctatcgg

SEQ ID NO: 99945 - DNA, 26 bp, Artificial Sequence
  Description of Artificial Sequence: Synthetic oligonucleotide
acggggtcatggacagtggctatcgg

SEQ ID NO: 99946 - DNA, 25 bp, Artificial Sequence
  Description of Artificial Sequence: Synthetic oligonucleotide
cggggtcatggacagtggctatcgg

SEQ ID NO: 99947 - DNA, 25 bp, Artificial Sequence
  Description of Artificial Sequence: Synthetic oligonucleotide
ggggtcatggacagtggctatcggc

SEQ ID NO: 99948 - DNA, 27 bp, Artificial Sequence
  Description of Artificial Sequence: Synthetic oligonucleotide
gggtcatggacagtggctatcggccta

SEQ ID NO: 99949 - DNA, 29 bp, Artificial Sequence
  Description of Artificial Sequence: Synthetic oligonucleotide
ggtcatggacagtggctatcggcctaatc

SEQ ID NO: 99950 - DNA, 32 bp, Artificial Sequence
  Description of Artificial Sequence: Synthetic oligonucleotide
gtcatggacagtggctatcggcctaatcttag

SEQ ID NO: 99951 - DNA, 32 bp, Artificial Sequence
  Description of Artificial Sequence: Synthetic oligonucleotide
tcatggacagtggctatcggcctaatcttagc

SEQ ID NO: 99952 - DNA, 31 bp, Artificial Sequence
  Description of Artificial Sequence: Synthetic oligonucleotide
catggacagtggctatcggcctaatcttagc

SEQ ID NO: 99953 - DNA, 31 bp, Artificial Sequence
  Description of Artificial Sequence: Synthetic oligonucleotide
atggacagtggctatcggcctaatcttagcc

SEQ ID NO: 99954 - DNA, 30 bp, Artificial Sequence
  Description of Artificial Sequence: Synthetic oligonucleotide
tggacagtggctatcggcctaatcttagcc

SEQ ID NO: 99955 - DNA, 29 bp, Artificial Sequence
  Description of Artificial Sequence: Synthetic oligonucleotide
ggacagtggctatcggcctaatcttagcc

SEQ ID NO: 99956 - DNA, 29 bp, Artificial Sequence
  Description of Artificial Sequence: Synthetic oligonucleotide
gacagtggctatcggcctaatcttagccc

SEQ ID NO: 99957 - DNA, 30 bp, Artificial Sequence
  Description of Artificial Sequence: Synthetic oligonucleotide
acagtggctatcggcctaatcttagccctg

SEQ ID NO: 99958 - DNA, 29 bp, Artificial Sequence
  Description of Artificial Sequence: Synthetic oligonucleotide
cagtggctatcggcctaatcttagccctg

SEQ ID NO: 99959 - DNA, 31 bp, Artificial Sequence
  Description of Artificial Sequence: Synthetic oligonucleotide
agtggctatcggcctaatcttagccctgaag

SEQ ID NO: 99960 - DNA, 30 bp, Artificial Sequence
  Description of Artificial Sequence: Synthetic oligonucleotide
gtggctatcggcctaatcttagccctgaag

SEQ ID NO: 99961 - DNA, 31 bp, Artificial Sequence
  Description of Artificial Sequence: Synthetic oligonucleotide
tggctatcggcctaatcttagccctgaagag

SEQ ID NO: 99962 - DNA, 30 bp, Artificial Sequence
  Description of Artificial Sequence: Synthetic oligonucleotide
ggctatcggcctaatcttagccctgaagag

SEQ ID NO: 99963 - DNA, 30 bp, Artificial Sequence
  Description of Artificial Sequence: Synthetic oligonucleotide
gctatcggcctaatcttagccctgaagagg

SEQ ID NO: 99964 - DNA, 30 bp, Artificial Sequence
  Description of Artificial Sequence: Synthetic oligonucleotide
ctatcggcctaatcttagccctgaagaggc

SEQ ID NO: 99965 - DNA, 30 bp, Artificial Sequence
  Description of Artificial Sequence: Synthetic oligonucleotide
tatcggcctaatcttagccctgaagaggcc

SEQ ID NO: 99966 - DNA, 29 bp, Artificial Sequence
  Description of Artificial Sequence: Synthetic oligonucleotide
atcggcctaatcttagccctgaagaggcc

SEQ ID NO: 99967 - DNA, 28 bp, Artificial Sequence
  Description of Artificial Sequence: Synthetic oligonucleotide
tcggcctaatcttagccctgaagaggcc

SEQ ID NO: 99968 - DNA, 27 bp, Artificial Sequence
  Description of Artificial Sequence: Synthetic oligonucleotide
cggcctaatcttagccctgaagaggcc

SEQ ID NO: 99969 - DNA, 30 bp, Artificial Sequence
  Description of Artificial Sequence: Synthetic oligonucleotide
ggcctaatcttagccctgaagaggcctatg

SEQ ID NO: 99970 - DNA, 31 bp, Artificial Sequence
  Description of Artificial Sequence: Synthetic oligonucleotide
gcctaatcttagccctgaagaggcctatgac

SEQ ID NO: 99971 - DNA, 31 bp, Artificial Sequence
  Description of Artificial Sequence: Synthetic oligonucleotide
cctaatcttagccctgaagaggcctatgacc

SEQ ID NO: 99972 - DNA, 33 bp, Artificial Sequence
  Description of Artificial Sequence: Synthetic oligonucleotide
ctaatcttagccctgaagaggcctatgaccttg

SEQ ID NO: 99973 - DNA, 33 bp, Artificial Sequence
  Description of Artificial Sequence: Synthetic oligonucleotide
taatcttagccctgaagaggcctatgaccttgg

SEQ ID NO: 99974 - DNA, 32 bp, Artificial Sequence
  Description of Artificial Sequence: Synthetic oligonucleotide
aatcttagccctgaagaggcctatgaccttgg

SEQ ID NO: 99975 - DNA, 31 bp, Artificial Sequence
  Description of Artificial Sequence: Synthetic oligonucleotide
atcttagccctgaagaggcctatgaccttgg

SEQ ID NO: 99976 - DNA, 30 bp, Artificial Sequence
  Description of Artificial Sequence: Synthetic oligonucleotide
tcttagccctgaagaggcctatgaccttgg

SEQ ID NO: 99977 - DNA, 29 bp, Artificial Sequence
  Description of Artificial Sequence: Synthetic oligonucleotide
cttagccctgaagaggcctatgaccttgg

SEQ ID NO: 99978 - DNA, 29 bp, Artificial Sequence
  Description of Artificial Sequence: Synthetic oligonucleotide
ttagccctgaagaggcctatgaccttggc

SEQ ID NO: 99979 - DNA, 28 bp, Artificial Sequence
  Description of Artificial Sequence: Synthetic oligonucleotide
tagccctgaagaggcctatgaccttggc

SEQ ID NO: 99980 - DNA, 27 bp, Artificial Sequence
  Description of Artificial Sequence: Synthetic oligonucleotide
agccctgaagaggcctatgaccttggc

SEQ ID NO: 99981 - DNA, 26 bp, Artificial Sequence
  Description of Artificial Sequence: Synthetic oligonucleotide
gccctgaagaggcctatgaccttggc

SEQ ID NO: 99982 - DNA, 26 bp, Artificial Sequence
  Description of Artificial Sequence: Synthetic oligonucleotide
ccctgaagaggcctatgaccttggcc

SEQ ID NO: 99983 - DNA, 26 bp, Artificial Sequence
  Description of Artificial Sequence: Synthetic oligonucleotide
cctgaagaggcctatgaccttggccg

SEQ ID NO: 99984 - DNA, 27 bp, Artificial Sequence
  Description of Artificial Sequence: Synthetic oligonucleotide
ctgaagaggcctatgaccttggccgca

SEQ ID NO: 99985 - DNA, 27 bp, Artificial Sequence
  Description of Artificial Sequence: Synthetic oligonucleotide
tgaagaggcctatgaccttggccgcag

SEQ ID NO: 99986 - DNA, 26 bp, Artificial Sequence
  Description of Artificial Sequence: Synthetic oligonucleotide
gaagaggcctatgaccttggccgcag

SEQ ID NO: 99987 - DNA, 26 bp, Artificial Sequence
  Description of Artificial Sequence: Synthetic oligonucleotide
aagaggcctatgaccttggccgcagg

SEQ ID NO: 99988 - DNA, 25 bp, Artificial Sequence
  Description of Artificial Sequence: Synthetic oligonucleotide
agaggcctatgaccttggccgcagg

SEQ ID NO: 99989 - DNA, 24 bp, Artificial Sequence
  Description of Artificial Sequence: Synthetic oligonucleotide
gaggcctatgaccttggccgcagg

SEQ ID NO: 99990 - DNA, 24 bp, Artificial Sequence
  Description of Artificial Sequence: Synthetic oligonucleotide
aggcctatgaccttggccgcaggg

SEQ ID NO: 99991 - DNA, 23 bp, Artificial Sequence
  Description of Artificial Sequence: Synthetic oligonucleotide
ggcctatgaccttggccgcaggg

SEQ ID NO: 99992 - DNA, 27 bp, Artificial Sequence
  Description of Artificial Sequence: Synthetic oligonucleotide
gcctatgaccttggccgcagggctatt

SEQ ID NO: 99993 - DNA, 27 bp, Artificial Sequence
  Description of Artificial Sequence: Synthetic oligonucleotide
cctatgaccttggccgcagggctattg

SEQ ID NO: 99994 - DNA, 27 bp, Artificial Sequence
  Description of Artificial Sequence: Synthetic oligonucleotide
ctatgaccttggccgcagggctattgc

SEQ ID NO: 99995 - DNA, 31 bp, Artificial Sequence
  Description of Artificial Sequence: Synthetic oligonucleotide
tatgaccttggccgcagggctattgcttatg

SEQ ID NO: 99996 - DNA, 30 bp, Artificial Sequence
  Description of Artificial Sequence: Synthetic oligonucleotide
atgaccttggccgcagggctattgcttatg

SEQ ID NO: 99997 - DNA, 29 bp, Artificial Sequence
  Description of Artificial Sequence: Synthetic oligonucleotide
tgaccttggccgcagggctattgcttatg

SEQ ID NO: 99998 - DNA, 28 bp, Artificial Sequence
  Description of Artificial Sequence: Synthetic oligonucleotide
gaccttggccgcagggctattgcttatg

SEQ ID NO: 99999 - DNA, 28 bp, Artificial Sequence
  Description of Artificial Sequence: Synthetic oligonucleotide
accttggccgcagggctattgcttatgc

SEQ ID NO: 100000 - DNA, 27 bp, Artificial Sequence
  Description of Artificial Sequence: Synthetic oligonucleotide
ccttggccgcagggctattgcttatgc

SEQ ID NO: 100001 - DNA, 27 bp, Artificial Sequence
  Description of Artificial Sequence: Synthetic oligonucleotide
cttggccgcagggctattgcttatgcc

SEQ ID NO: 100002 - DNA, 28 bp, Artificial Sequence
  Description of Artificial Sequence: Synthetic oligonucleotide
ttggccgcagggctattgcttatgccac

SEQ ID NO: 100003 - DNA, 27 bp, Artificial Sequence
  Description of Artificial Sequence: Synthetic oligonucleotide
tggccgcagggctattgcttatgccac

SEQ ID NO: 100004 - DNA, 27 bp, Artificial Sequence
  Description of Artificial Sequence: Synthetic oligonucleotide
ggccgcagggctattgcttatgccact

SEQ ID NO: 100005 - DNA, 27 bp, Artificial Sequence
  Description of Artificial Sequence: Synthetic oligonucleotide
gccgcagggctattgcttatgccactc

SEQ ID NO: 100006 - DNA, 28 bp, Artificial Sequence
  Description of Artificial Sequence: Synthetic oligonucleotide
ccgcagggctattgcttatgccactcac

SEQ ID NO: 100007 - DNA, 29 bp, Artificial Sequence
  Description of Artificial Sequence: Synthetic oligonucleotide
cgcagggctattgcttatgccactcacag

SEQ ID NO: 100008 - DNA, 30 bp, Artificial Sequence
  Description of Artificial Sequence: Synthetic oligonucleotide
gcagggctattgcttatgccactcacagag

SEQ ID NO: 100009 - DNA, 31 bp, Artificial Sequence
  Description of Artificial Sequence: Synthetic oligonucleotide
cagggctattgcttatgccactcacagagac

SEQ ID NO: 100010 - DNA, 32 bp, Artificial Sequence
  Description of Artificial Sequence: Synthetic oligonucleotide
agggctattgcttatgccactcacagagacag

SEQ ID NO: 100011 - DNA, 31 bp, Artificial Sequence
  Description of Artificial Sequence: Synthetic oligonucleotide
gggctattgcttatgccactcacagagacag

SEQ ID NO: 100012 - DNA, 31 bp, Artificial Sequence
  Description of Artificial Sequence: Synthetic oligonucleotide
ggctattgcttatgccactcacagagacagc

SEQ ID NO: 100013 - DNA, 35 bp, Artificial Sequence
  Description of Artificial Sequence: Synthetic oligonucleotide
gctattgcttatgccactcacagagacagctattc

SEQ ID NO: 100014 - DNA, 36 bp, Artificial Sequence
  Description of Artificial Sequence: Synthetic oligonucleotide
ctattgcttatgccactcacagagacagctattctg

SEQ ID NO: 100015 - DNA, 36 bp, Artificial Sequence
  Description of Artificial Sequence: Synthetic oligonucleotide
tattgcttatgccactcacagagacagctattctgg

SEQ ID NO: 100016 - DNA, 35 bp, Artificial Sequence
  Description of Artificial Sequence: Synthetic oligonucleotide
attgcttatgccactcacagagacagctattctgg

SEQ ID NO: 100017 - DNA, 34 bp, Artificial Sequence
  Description of Artificial Sequence: Synthetic oligonucleotide
ttgcttatgccactcacagagacagctattctgg

SEQ ID NO: 100018 - DNA, 33 bp, Artificial Sequence
  Description of Artificial Sequence: Synthetic oligonucleotide
tgcttatgccactcacagagacagctattctgg

SEQ ID NO: 100019 - DNA, 32 bp, Artificial Sequence
  Description of Artificial Sequence: Synthetic oligonucleotide
gcttatgccactcacagagacagctattctgg

SEQ ID NO: 100020 - DNA, 33 bp, Artificial Sequence
  Description of Artificial Sequence: Synthetic oligonucleotide
cttatgccactcacagagacagctattctggag

SEQ ID NO: 100021 - DNA, 33 bp, Artificial Sequence
  Description of Artificial Sequence: Synthetic oligonucleotide
ttatgccactcacagagacagctattctggagg

SEQ ID NO: 100022 - DNA, 32 bp, Artificial Sequence
  Description of Artificial Sequence: Synthetic oligonucleotide
tatgccactcacagagacagctattctggagg

SEQ ID NO: 100023 - DNA, 31 bp, Artificial Sequence
  Description of Artificial Sequence: Synthetic oligonucleotide
atgccactcacagagacagctattctggagg

SEQ ID NO: 100024 - DNA, 30 bp, Artificial Sequence
  Description of Artificial Sequence: Synthetic oligonucleotide
tgccactcacagagacagctattctggagg

SEQ ID NO: 100025 - DNA, 29 bp, Artificial Sequence
  Description of Artificial Sequence: Synthetic oligonucleotide
gccactcacagagacagctattctggagg

SEQ ID NO: 100026 - DNA, 29 bp, Artificial Sequence
  Description of Artificial Sequence: Synthetic oligonucleotide
ccactcacagagacagctattctggaggc

SEQ ID NO: 100027 - DNA, 29 bp, Artificial Sequence
  Description of Artificial Sequence: Synthetic oligonucleotide
cactcacagagacagctattctggaggcg

SEQ ID NO: 100028 - DNA, 31 bp, Artificial Sequence
  Description of Artificial Sequence: Synthetic oligonucleotide
actcacagagacagctattctggaggcgttg

SEQ ID NO: 100029 - DNA, 30 bp, Artificial Sequence
  Description of Artificial Sequence: Synthetic oligonucleotide
ctcacagagacagctattctggaggcgttg

SEQ ID NO: 100030 - DNA, 31 bp, Artificial Sequence
  Description of Artificial Sequence: Synthetic oligonucleotide
tcacagagacagctattctggaggcgttgtc

SEQ ID NO: 100031 - DNA, 30 bp, Artificial Sequence
  Description of Artificial Sequence: Synthetic oligonucleotide
cacagagacagctattctggaggcgttgtc

SEQ ID NO: 100032 - DNA, 35 bp, Artificial Sequence
  Description of Artificial Sequence: Synthetic oligonucleotide
acagagacagctattctggaggcgttgtcaatatg

SEQ ID NO: 100033 - DNA, 34 bp, Artificial Sequence
  Description of Artificial Sequence: Synthetic oligonucleotide
cagagacagctattctggaggcgttgtcaatatg

SEQ ID NO: 100034 - DNA, 36 bp, Artificial Sequence
  Description of Artificial Sequence: Synthetic oligonucleotide
agagacagctattctggaggcgttgtcaatatgtac

SEQ ID NO: 100035 - DNA, 35 bp, Artificial Sequence
  Description of Artificial Sequence: Synthetic oligonucleotide
gagacagctattctggaggcgttgtcaatatgtac

SEQ ID NO: 100036 - DNA, 35 bp, Artificial Sequence
  Description of Artificial Sequence: Synthetic oligonucleotide
agacagctattctggaggcgttgtcaatatgtacc

SEQ ID NO: 100037 - DNA, 34 bp, Artificial Sequence
  Description of Artificial Sequence: Synthetic oligonucleotide
gacagctattctggaggcgttgtcaatatgtacc

SEQ ID NO: 100038 - DNA, 35 bp, Artificial Sequence
  Description of Artificial Sequence: Synthetic oligonucleotide
acagctattctggaggcgttgtcaatatgtaccac

SEQ ID NO: 100039 - DNA, 34 bp, Artificial Sequence
  Description of Artificial Sequence: Synthetic oligonucleotide
cagctattctggaggcgttgtcaatatgtaccac

SEQ ID NO: 100040 - DNA, 36 bp, Artificial Sequence
  Description of Artificial Sequence: Synthetic oligonucleotide
agctattctggaggcgttgtcaatatgtaccacatg

SEQ ID NO: 100041 - DNA, 35 bp, Artificial Sequence
  Description of Artificial Sequence: Synthetic oligonucleotide
gctattctggaggcgttgtcaatatgtaccacatg

SEQ ID NO: 100042 - DNA, 37 bp, Artificial Sequence
  Description of Artificial Sequence: Synthetic oligonucleotide
ctattctggaggcgttgtcaatatgtaccacatgaag

SEQ ID NO: 100043 - DNA, 37 bp, Artificial Sequence
  Description of Artificial Sequence: Synthetic oligonucleotide
tattctggaggcgttgtcaatatgtaccacatgaagg

SEQ ID NO: 100044 - DNA, 36 bp, Artificial Sequence
  Description of Artificial Sequence: Synthetic oligonucleotide
attctggaggcgttgtcaatatgtaccacatgaagg

SEQ ID NO: 100045 - DNA, 35 bp, Artificial Sequence
  Description of Artificial Sequence: Synthetic oligonucleotide
ttctggaggcgttgtcaatatgtaccacatgaagg

SEQ ID NO: 100046 - DNA, 34 bp, Artificial Sequence
  Description of Artificial Sequence: Synthetic oligonucleotide
tctggaggcgttgtcaatatgtaccacatgaagg

SEQ ID NO: 100047 - DNA, 33 bp, Artificial Sequence
  Description of Artificial Sequence: Synthetic oligonucleotide
ctggaggcgttgtcaatatgtaccacatgaagg

SEQ ID NO: 100048 - DNA, 35 bp, Artificial Sequence
  Description of Artificial Sequence: Synthetic oligonucleotide
tggaggcgttgtcaatatgtaccacatgaaggaag

SEQ ID NO: 100049 - DNA, 34 bp, Artificial Sequence
  Description of Artificial Sequence: Synthetic oligonucleotide
ggaggcgttgtcaatatgtaccacatgaaggaag

SEQ ID NO: 100050 - DNA, 36 bp, Artificial Sequence
  Description of Artificial Sequence: Synthetic oligonucleotide
gaggcgttgtcaatatgtaccacatgaaggaagatg

SEQ ID NO: 100051 - DNA, 36 bp, Artificial Sequence
  Description of Artificial Sequence: Synthetic oligonucleotide
aggcgttgtcaatatgtaccacatgaaggaagatgg

SEQ ID NO: 100052 - DNA, 35 bp, Artificial Sequence
  Description of Artificial Sequence: Synthetic oligonucleotide
ggcgttgtcaatatgtaccacatgaaggaagatgg

SEQ ID NO: 100053 - DNA, 37 bp, Artificial Sequence
  Description of Artificial Sequence: Synthetic oligonucleotide
gcgttgtcaatatgtaccacatgaaggaagatggttg

SEQ ID NO: 100054 - DNA, 37 bp, Artificial Sequence
  Description of Artificial Sequence: Synthetic oligonucleotide
cgttgtcaatatgtaccacatgaaggaagatggttgg

SEQ ID NO: 100055 - DNA, 37 bp, Artificial Sequence
  Description of Artificial Sequence: Synthetic oligonucleotide
gttgtcaatatgtaccacatgaaggaagatggttggg

SEQ ID NO: 100056 - DNA, 38 bp, Artificial Sequence
  Description of Artificial Sequence: Synthetic oligonucleotide
ttgtcaatatgtaccacatgaaggaagatggttgggtg

SEQ ID NO: 100057 - DNA, 37 bp, Artificial Sequence
  Description of Artificial Sequence: Synthetic oligonucleotide
tgtcaatatgtaccacatgaaggaagatggttgggtg

SEQ ID NO: 100058 - DNA, 36 bp, Artificial Sequence
  Description of Artificial Sequence: Synthetic oligonucleotide
gtcaatatgtaccacatgaaggaagatggttgggtg

SEQ ID NO: 100059 - DNA, 39 bp, Artificial Sequence
  Description of Artificial Sequence: Synthetic oligonucleotide
tcaatatgtaccacatgaaggaagatggttgggtgaaag

SEQ ID NO: 100060 - DNA, 38 bp, Artificial Sequence
  Description of Artificial Sequence: Synthetic oligonucleotide
caatatgtaccacatgaaggaagatggttgggtgaaag

SEQ ID NO: 100061 - DNA, 40 bp, Artificial Sequence
  Description of Artificial Sequence: Synthetic oligonucleotide
aatatgtaccacatgaaggaagatggttgggtgaaagtag

SEQ ID NO: 100062 - DNA, 39 bp, Artificial Sequence
  Description of Artificial Sequence: Synthetic oligonucleotide
atatgtaccacatgaaggaagatggttgggtgaaagtag

SEQ ID NO: 100063 - DNA, 38 bp, Artificial Sequence
  Description of Artificial Sequence: Synthetic oligonucleotide
tatgtaccacatgaaggaagatggttgggtgaaagtag

SEQ ID NO: 100064 - DNA, 37 bp, Artificial Sequence
  Description of Artificial Sequence: Synthetic oligonucleotide
atgtaccacatgaaggaagatggttgggtgaaagtag

SEQ ID NO: 100065 - DNA, 36 bp, Artificial Sequence
  Description of Artificial Sequence: Synthetic oligonucleotide
tgtaccacatgaaggaagatggttgggtgaaagtag

SEQ ID NO: 100066 - DNA, 35 bp, Artificial Sequence
  Description of Artificial Sequence: Synthetic oligonucleotide
gtaccacatgaaggaagatggttgggtgaaagtag

SEQ ID NO: 100067 - DNA, 38 bp, Artificial Sequence
  Description of Artificial Sequence: Synthetic oligonucleotide
taccacatgaaggaagatggttgggtgaaagtagaaag

SEQ ID NO: 100068 - DNA, 37 bp, Artificial Sequence
  Description of Artificial Sequence: Synthetic oligonucleotide
accacatgaaggaagatggttgggtgaaagtagaaag

SEQ ID NO: 100069 - DNA, 36 bp, Artificial Sequence
  Description of Artificial Sequence: Synthetic oligonucleotide
ccacatgaaggaagatggttgggtgaaagtagaaag

SEQ ID NO: 100070 - DNA, 38 bp, Artificial Sequence
  Description of Artificial Sequence: Synthetic oligonucleotide
cacatgaaggaagatggttgggtgaaagtagaaagtac

SEQ ID NO: 100071 - DNA, 39 bp, Artificial Sequence
  Description of Artificial Sequence: Synthetic oligonucleotide
acatgaaggaagatggttgggtgaaagtagaaagtacag

SEQ ID NO: 100072 - DNA, 38 bp, Artificial Sequence
  Description of Artificial Sequence: Synthetic oligonucleotide
catgaaggaagatggttgggtgaaagtagaaagtacag

SEQ ID NO: 100073 - DNA, 40 bp, Artificial Sequence
  Description of Artificial Sequence: Synthetic oligonucleotide
atgaaggaagatggttgggtgaaagtagaaagtacagatg

SEQ ID NO: 100074 - DNA, 39 bp, Artificial Sequence
  Description of Artificial Sequence: Synthetic oligonucleotide
tgaaggaagatggttgggtgaaagtagaaagtacagatg

SEQ ID NO: 100075 - DNA, 38 bp, Artificial Sequence
  Description of Artificial Sequence: Synthetic oligonucleotide
gaaggaagatggttgggtgaaagtagaaagtacagatg

SEQ ID NO: 100076 - DNA, 39 bp, Artificial Sequence
  Description of Artificial Sequence: Synthetic oligonucleotide
aaggaagatggttgggtgaaagtagaaagtacagatgtc

SEQ ID NO: 100077 - DNA, 38 bp, Artificial Sequence
  Description of Artificial Sequence: Synthetic oligonucleotide
aggaagatggttgggtgaaagtagaaagtacagatgtc

SEQ ID NO: 100078 - DNA, 37 bp, Artificial Sequence
  Description of Artificial Sequence: Synthetic oligonucleotide
ggaagatggttgggtgaaagtagaaagtacagatgtc

SEQ ID NO: 100079 - DNA, 38 bp, Artificial Sequence
  Description of Artificial Sequence: Synthetic oligonucleotide
gaagatggttgggtgaaagtagaaagtacagatgtcag

SEQ ID NO: 100080 - DNA, 39 bp, Artificial Sequence
  Description of Artificial Sequence: Synthetic oligonucleotide
aagatggttgggtgaaagtagaaagtacagatgtcagtg

SEQ ID NO: 100081 - DNA, 38 bp, Artificial Sequence
  Description of Artificial Sequence: Synthetic oligonucleotide
agatggttgggtgaaagtagaaagtacagatgtcagtg

SEQ ID NO: 100082 - DNA, 37 bp, Artificial Sequence
  Description of Artificial Sequence: Synthetic oligonucleotide
gatggttgggtgaaagtagaaagtacagatgtcagtg

SEQ ID NO: 100083 - DNA, 38 bp, Artificial Sequence
  Description of Artificial Sequence: Synthetic oligonucleotide
atggttgggtgaaagtagaaagtacagatgtcagtgac

SEQ ID NO: 100084 - DNA, 37 bp, Artificial Sequence
  Description of Artificial Sequence: Synthetic oligonucleotide
tggttgggtgaaagtagaaagtacagatgtcagtgac

SEQ ID NO: 100085 - DNA, 36 bp, Artificial Sequence
  Description of Artificial Sequence: Synthetic oligonucleotide
ggttgggtgaaagtagaaagtacagatgtcagtgac

SEQ ID NO: 100086 - DNA, 36 bp, Artificial Sequence
  Description of Artificial Sequence: Synthetic oligonucleotide
gttgggtgaaagtagaaagtacagatgtcagtgacc

SEQ ID NO: 100087 - DNA, 37 bp, Artificial Sequence
  Description of Artificial Sequence: Synthetic oligonucleotide
ttgggtgaaagtagaaagtacagatgtcagtgacctg

SEQ ID NO: 100088 - DNA, 36 bp, Artificial Sequence
  Description of Artificial Sequence: Synthetic oligonucleotide
tgggtgaaagtagaaagtacagatgtcagtgacctg

SEQ ID NO: 100089 - DNA, 35 bp, Artificial Sequence
  Description of Artificial Sequence: Synthetic oligonucleotide
gggtgaaagtagaaagtacagatgtcagtgacctg

SEQ ID NO: 100090 - DNA, 35 bp, Artificial Sequence
  Description of Artificial Sequence: Synthetic oligonucleotide
ggtgaaagtagaaagtacagatgtcagtgacctgc

SEQ ID NO: 100091 - DNA, 36 bp, Artificial Sequence
  Description of Artificial Sequence: Synthetic oligonucleotide
gtgaaagtagaaagtacagatgtcagtgacctgctg

SEQ ID NO: 100092 - DNA, 36 bp, Artificial Sequence
  Description of Artificial Sequence: Synthetic oligonucleotide
tgaaagtagaaagtacagatgtcagtgacctgctgc

SEQ ID NO: 100093 - DNA, 35 bp, Artificial Sequence
  Description of Artificial Sequence: Synthetic oligonucleotide
gaaagtagaaagtacagatgtcagtgacctgctgc

SEQ ID NO: 100094 - DNA, 36 bp, Artificial Sequence
  Description of Artificial Sequence: Synthetic oligonucleotide
aaagtagaaagtacagatgtcagtgacctgctgcac

SEQ ID NO: 100095 - DNA, 35 bp, Artificial Sequence
  Description of Artificial Sequence: Synthetic oligonucleotide
aagtagaaagtacagatgtcagtgacctgctgcac

SEQ ID NO: 100096 - DNA, 34 bp, Artificial Sequence
  Description of Artificial Sequence: Synthetic oligonucleotide
agtagaaagtacagatgtcagtgacctgctgcac

SEQ ID NO: 100097 - DNA, 33 bp, Artificial Sequence
  Description of Artificial Sequence: Synthetic oligonucleotide
gtagaaagtacagatgtcagtgacctgctgcac

SEQ ID NO: 100098 - DNA, 33 bp, Artificial Sequence
  Description of Artificial Sequence: Synthetic oligonucleotide
tagaaagtacagatgtcagtgacctgctgcacc

SEQ ID NO: 100099 - DNA, 32 bp, Artificial Sequence
  Description of Artificial Sequence: Synthetic oligonucleotide
agaaagtacagatgtcagtgacctgctgcacc

SEQ ID NO: 100100 - DNA, 31 bp, Artificial Sequence
  Description of Artificial Sequence: Synthetic oligonucleotide
gaaagtacagatgtcagtgacctgctgcacc

SEQ ID NO: 100101 - DNA, 32 bp, Artificial Sequence
  Description of Artificial Sequence: Synthetic oligonucleotide
aaagtacagatgtcagtgacctgctgcaccag

SEQ ID NO: 100102 - DNA, 31 bp, Artificial Sequence
  Description of Artificial Sequence: Synthetic oligonucleotide
aagtacagatgtcagtgacctgctgcaccag

SEQ ID NO: 100103 - DNA, 30 bp, Artificial Sequence
  Description of Artificial Sequence: Synthetic oligonucleotide
agtacagatgtcagtgacctgctgcaccag

SEQ ID NO: 100104 - DNA, 29 bp, Artificial Sequence
  Description of Artificial Sequence: Synthetic oligonucleotide
gtacagatgtcagtgacctgctgcaccag

SEQ ID NO: 100105 - DNA, 31 bp, Artificial Sequence
  Description of Artificial Sequence: Synthetic oligonucleotide
tacagatgtcagtgacctgctgcaccagtac

SEQ ID NO: 100106 - DNA, 30 bp, Artificial Sequence
  Description of Artificial Sequence: Synthetic oligonucleotide
acagatgtcagtgacctgctgcaccagtac

SEQ ID NO: 100107 - DNA, 29 bp, Artificial Sequence
  Description of Artificial Sequence: Synthetic oligonucleotide
cagatgtcagtgacctgctgcaccagtac

SEQ ID NO: 100108 - DNA, 29 bp, Artificial Sequence
  Description of Artificial Sequence: Synthetic oligonucleotide
agatgtcagtgacctgctgcaccagtacc

SEQ ID NO: 100109 - DNA, 28 bp, Artificial Sequence
  Description of Artificial Sequence: Synthetic oligonucleotide
gatgtcagtgacctgctgcaccagtacc

SEQ ID NO: 100110 - DNA, 28 bp, Artificial Sequence
  Description of Artificial Sequence: Synthetic oligonucleotide
atgtcagtgacctgctgcaccagtaccg

SEQ ID NO: 100111 - DNA, 27 bp, Artificial Sequence
  Description of Artificial Sequence: Synthetic oligonucleotide
tgtcagtgacctgctgcaccagtaccg

SEQ ID NO: 100112 - DNA, 26 bp, Artificial Sequence
  Description of Artificial Sequence: Synthetic oligonucleotide
gtcagtgacctgctgcaccagtaccg

SEQ ID NO: 100113 - DNA, 26 bp, Artificial Sequence
  Description of Artificial Sequence: Synthetic oligonucleotide
tcagtgacctgctgcaccagtaccgg

SEQ ID NO: 100114 - DNA, 25 bp, Artificial Sequence
  Description of Artificial Sequence: Synthetic oligonucleotide
cagtgacctgctgcaccagtaccgg

SEQ ID NO: 100115 - DNA, 27 bp, Artificial Sequence
  Description of Artificial Sequence: Synthetic oligonucleotide
agtgacctgctgcaccagtaccgggaa

SEQ ID NO: 100116 - DNA, 26 bp, Artificial Sequence
  Description of Artificial Sequence: Synthetic oligonucleotide
gtgacctgctgcaccagtaccgggaa

SEQ ID NO: 100117 - DNA, 26 bp, Artificial Sequence
  Description of Artificial Sequence: Synthetic oligonucleotide
tgacctgctgcaccagtaccgggaag

SEQ ID NO: 100118 - DNA, 25 bp, Artificial Sequence
  Description of Artificial Sequence: Synthetic oligonucleotide
gacctgctgcaccagtaccgggaag

SEQ ID NO: 100119 - DNA, 25 bp, Artificial Sequence
  Description of Artificial Sequence: Synthetic oligonucleotide
acctgctgcaccagtaccgggaagc

SEQ ID NO: 100120 - DNA, 24 bp, Artificial Sequence
  Description of Artificial Sequence: Synthetic oligonucleotide
cctgctgcaccagtaccgggaagc

SEQ ID NO: 100121 - DNA, 27 bp, Artificial Sequence
  Description of Artificial Sequence: Synthetic oligonucleotide
ctgctgcaccagtaccgggaagccaat

SEQ ID NO: 100122 - DNA, 27 bp, Artificial Sequence
  Description of Artificial Sequence: Synthetic oligonucleotide
tgctgcaccagtaccgggaagccaatc

SEQ ID NO: 100123 - DNA, 27 bp, Artificial Sequence
  Description of Artificial Sequence: Synthetic oligonucleotide
gctgcaccagtaccgggaagccaatca

SEQ ID NO: 100124 - DNA, 28 bp, Artificial Sequence
  Description of Artificial Sequence: Synthetic oligonucleotide
atggcgctactagatgtatgcggagccc

SEQ ID NO: 100125 - DNA, 27 bp, Artificial Sequence
  Description of Artificial Sequence: Synthetic oligonucleotide
tggcgctactagatgtatgcggagccc

SEQ ID NO: 100126 - DNA, 26 bp, Artificial Sequence
  Description of Artificial Sequence: Synthetic oligonucleotide
ggcgctactagatgtatgcggagccc

SEQ ID NO: 100127 - DNA, 26 bp, Artificial Sequence
  Description of Artificial Sequence: Synthetic oligonucleotide
gcgctactagatgtatgcggagcccc

SEQ ID NO: 100128 - DNA, 26 bp, Artificial Sequence
  Description of Artificial Sequence: Synthetic oligonucleotide
cgctactagatgtatgcggagccccc

SEQ ID NO: 100129 - DNA, 26 bp, Artificial Sequence
  Description of Artificial Sequence: Synthetic oligonucleotide
gctactagatgtatgcggagcccccc

SEQ ID NO: 100130 - DNA, 27 bp, Artificial Sequence
  Description of Artificial Sequence: Synthetic oligonucleotide
ctactagatgtatgcggagccccccga

SEQ ID NO: 100131 - DNA, 27 bp, Artificial Sequence
  Description of Artificial Sequence: Synthetic oligonucleotide
tactagatgtatgcggagccccccgag

SEQ ID NO: 100132 - DNA, 26 bp, Artificial Sequence
  Description of Artificial Sequence: Synthetic oligonucleotide
actagatgtatgcggagccccccgag

SEQ ID NO: 100133 - DNA, 25 bp, Artificial Sequence
  Description of Artificial Sequence: Synthetic oligonucleotide
ctagatgtatgcggagccccccgag

SEQ ID NO: 100134 - DNA, 25 bp, Artificial Sequence
  Description of Artificial Sequence: Synthetic oligonucleotide
tagatgtatgcggagccccccgagg

SEQ ID NO: 100135 - DNA, 24 bp, Artificial Sequence
  Description of Artificial Sequence: Synthetic oligonucleotide
agatgtatgcggagccccccgagg

SEQ ID NO: 100136 - DNA, 23 bp, Artificial Sequence
  Description of Artificial Sequence: Synthetic oligonucleotide
gatgtatgcggagccccccgagg

SEQ ID NO: 100137 - DNA, 23 bp, Artificial Sequence
  Description of Artificial Sequence: Synthetic oligonucleotide
atgtatgcggagccccccgaggg

SEQ ID NO: 100138 - DNA, 22 bp, Artificial Sequence
  Description of Artificial Sequence: Synthetic oligonucleotide
tgtatgcggagccccccgaggg

SEQ ID NO: 100139 - DNA, 21 bp, Artificial Sequence
  Description of Artificial Sequence: Synthetic oligonucleotide
gtatgcggagccccccgaggg

SEQ ID NO: 100140 - DNA, 22 bp, Artificial Sequence
  Description of Artificial Sequence: Synthetic oligonucleotide
tatgcggagccccccgagggca

SEQ ID NO: 100141 - DNA, 21 bp, Artificial Sequence
  Description of Artificial Sequence: Synthetic oligonucleotide
atgcggagccccccgagggca

SEQ ID NO: 100142 - DNA, 20 bp, Artificial Sequence
  Description of Artificial Sequence: Synthetic oligonucleotide
tgcggagccccccgagggca

SEQ ID NO: 100143 - DNA, 20 bp, Artificial Sequence
  Description of Artificial Sequence: Synthetic oligonucleotide
gcggagccccccgagggcat

SEQ ID NO: 100144 - DNA, 20 bp, Artificial Sequence
  Description of Artificial Sequence: Synthetic oligonucleotide
cggagccccccgagggcagt

SEQ ID NO: 100145 - DNA, 20 bp, Artificial Sequence
  Description of Artificial Sequence: Synthetic oligonucleotide
ggagccccccgagggcagct

SEQ ID NO: 100146 - DNA, 20 bp, Artificial Sequence
  Description of Artificial Sequence: Synthetic oligonucleotide
gagccccccgagggcagcgt

SEQ ID NO: 100147 - DNA, 20 bp, Artificial Sequence
  Description of Artificial Sequence: Synthetic oligonucleotide
agccccccgagggcagcggt

SEQ ID NO: 100148 - DNA, 20 bp, Artificial Sequence
  Description of Artificial Sequence: Synthetic oligonucleotide
gccccccgagggcagcggtt

SEQ ID NO: 100149 - DNA, 20 bp, Artificial Sequence
  Description of Artificial Sequence: Synthetic oligonucleotide
ccccccgagggcagcggctt

SEQ ID NO: 100150 - DNA, 20 bp, Artificial Sequence
  Description of Artificial Sequence: Synthetic oligonucleotide
cccccgagggcagcggcctt

SEQ ID NO: 100151 - DNA, 20 bp, Artificial Sequence
  Description of Artificial Sequence: Synthetic oligonucleotide
ccccgagggcagcggccgtt

SEQ ID NO: 100152 - DNA, 21 bp, Artificial Sequence
  Description of Artificial Sequence: Synthetic oligonucleotide
cccgagggcagcggccggaat

SEQ ID NO: 100153 - DNA, 21 bp, Artificial Sequence
  Description of Artificial Sequence: Synthetic oligonucleotide
ccgagggcagcggccggaatc

SEQ ID NO: 100154 - DNA, 21 bp, Artificial Sequence
  Description of Artificial Sequence: Synthetic oligonucleotide
cgagggcagcggccggaatcg

SEQ ID NO: 100155 - DNA, 21 bp, Artificial Sequence
  Description of Artificial Sequence: Synthetic oligonucleotide
gagggcagcggccggaatcgg

SEQ ID NO: 100156 - DNA, 22 bp, Artificial Sequence
  Description of Artificial Sequence: Synthetic oligonucleotide
agggcagcggccggaatcggct

SEQ ID NO: 100157 - DNA, 21 bp, Artificial Sequence
  Description of Artificial Sequence: Synthetic oligonucleotide
gggcagcggccggaatcggct

SEQ ID NO: 100158 - DNA, 22 bp, Artificial Sequence
  Description of Artificial Sequence: Synthetic oligonucleotide
ggcagcggccggaatcggctct

SEQ ID NO: 100159 - DNA, 22 bp, Artificial Sequence
  Description of Artificial Sequence: Synthetic oligonucleotide
gcagcggccggaatcggctctc

SEQ ID NO: 100160 - DNA, 22 bp, Artificial Sequence
  Description of Artificial Sequence: Synthetic oligonucleotide
cagcggccggaatcggctctcc

SEQ ID NO: 100161 - DNA, 22 bp, Artificial Sequence
  Description of Artificial Sequence: Synthetic oligonucleotide
agcggccggaatcggctctccc

SEQ ID NO: 100162 - DNA, 21 bp, Artificial Sequence
  Description of Artificial Sequence: Synthetic oligonucleotide
gcggccggaatcggctctccc

SEQ ID NO: 100163 - DNA, 21 bp, Artificial Sequence
  Description of Artificial Sequence: Synthetic oligonucleotide
cggccggaatcggctctcccg

SEQ ID NO: 100164 - DNA, 23 bp, Artificial Sequence
  Description of Artificial Sequence: Synthetic oligonucleotide
ggccggaatcggctctcccggtt

SEQ ID NO: 100165 - DNA, 23 bp, Artificial Sequence
  Description of Artificial Sequence: Synthetic oligonucleotide
gccggaatcggctctcccggttg

SEQ ID NO: 100166 - DNA, 23 bp, Artificial Sequence
  Description of Artificial Sequence: Synthetic oligonucleotide
ccggaatcggctctcccggttgc

SEQ ID NO: 100167 - DNA, 23 bp, Artificial Sequence
  Description of Artificial Sequence: Synthetic oligonucleotide
cggaatcggctctcccggttgcg

SEQ ID NO: 100168 - DNA, 23 bp, Artificial Sequence
  Description of Artificial Sequence: Synthetic oligonucleotide
ggaatcggctctcccggttgcgg

SEQ ID NO: 100169 - DNA, 25 bp, Artificial Sequence
  Description of Artificial Sequence: Synthetic oligonucleotide
gaatcggctctcccggttgcgggaa

SEQ ID NO: 100170 - DNA, 25 bp, Artificial Sequence
  Description of Artificial Sequence: Synthetic oligonucleotide
aatcggctctcccggttgcgggaag

SEQ ID NO: 100171 - DNA, 24 bp, Artificial Sequence
  Description of Artificial Sequence: Synthetic oligonucleotide
atcggctctcccggttgcgggaag

SEQ ID NO: 100172 - DNA, 23 bp, Artificial Sequence
  Description of Artificial Sequence: Synthetic oligonucleotide
tcggctctcccggttgcgggaag

SEQ ID NO: 100173 - DNA, 22 bp, Artificial Sequence
  Description of Artificial Sequence: Synthetic oligonucleotide
cggctctcccggttgcgggaag

SEQ ID NO: 100174 - DNA, 22 bp, Artificial Sequence
  Description of Artificial Sequence: Synthetic oligonucleotide
ggctctcccggttgcgggaagc

SEQ ID NO: 100175 - DNA, 22 bp, Artificial Sequence
  Description of Artificial Sequence: Synthetic oligonucleotide
gctctcccggttgcgggaagcg

SEQ ID NO: 100176 - DNA, 22 bp, Artificial Sequence
  Description of Artificial Sequence: Synthetic oligonucleotide
ctctcccggttgcgggaagcgg

SEQ ID NO: 100177 - DNA, 22 bp, Artificial Sequence
  Description of Artificial Sequence: Synthetic oligonucleotide
tctcccggttgcgggaagcggg

SEQ ID NO: 100178 - DNA, 21 bp, Artificial Sequence
  Description of Artificial Sequence: Synthetic oligonucleotide
ctcccggttgcgggaagcggg

SEQ ID NO: 100179 - DNA, 21 bp, Artificial Sequence
  Description of Artificial Sequence: Synthetic oligonucleotide
tcccggttgcgggaagcgggc

SEQ ID NO: 100180 - DNA, 20 bp, Artificial Sequence
  Description of Artificial Sequence: Synthetic oligonucleotide
cccggttgcgggaagcgggc

SEQ ID NO: 100181 - DNA, 21 bp, Artificial Sequence
  Description of Artificial Sequence: Synthetic oligonucleotide
ccggttgcgggaagcgggcgt

SEQ ID NO: 100182 - DNA, 21 bp, Artificial Sequence
  Description of Artificial Sequence: Synthetic oligonucleotide
cggttgcgggaagcgggcgtc

SEQ ID NO: 100183 - DNA, 21 bp, Artificial Sequence
  Description of Artificial Sequence: Synthetic oligonucleotide
ggttgcgggaagcgggcgtcg

SEQ ID NO: 100184 - DNA, 22 bp, Artificial Sequence
  Description of Artificial Sequence: Synthetic oligonucleotide
gttgcgggaagcgggcgtcgct

SEQ ID NO: 100185 - DNA, 22 bp, Artificial Sequence
  Description of Artificial Sequence: Synthetic oligonucleotide
ttgcgggaagcgggcgtcgctc

SEQ ID NO: 100186 - DNA, 21 bp, Artificial Sequence
  Description of Artificial Sequence: Synthetic oligonucleotide
tgcgggaagcgggcgtcgctc

SEQ ID NO: 100187 - DNA, 20 bp, Artificial Sequence
  Description of Artificial Sequence: Synthetic oligonucleotide
gcgggaagcgggcgtcgctc

SEQ ID NO: 100188 - DNA, 20 bp, Artificial Sequence
  Description of Artificial Sequence: Synthetic oligonucleotide
cgggaagcgggcgtcgctcg

SEQ ID NO: 100189 - DNA, 21 bp, Artificial Sequence
  Description of Artificial Sequence: Synthetic oligonucleotide
gggaagcgggcgtcgctcgga

SEQ ID NO: 100190 - DNA, 21 bp, Artificial Sequence
  Description of Artificial Sequence: Synthetic oligonucleotide
ggaagcgggcgtcgctcggac

SEQ ID NO: 100191 - DNA, 21 bp, Artificial Sequence
  Description of Artificial Sequence: Synthetic oligonucleotide
gaagcgggcgtcgctcggacc

SEQ ID NO: 100192 - DNA, 22 bp, Artificial Sequence
  Description of Artificial Sequence: Synthetic oligonucleotide
aagcgggcgtcgctcggaccca

SEQ ID NO: 100193 - DNA, 21 bp, Artificial Sequence
  Description of Artificial Sequence: Synthetic oligonucleotide
agcgggcgtcgctcggaccca

SEQ ID NO: 100194 - DNA, 20 bp, Artificial Sequence
  Description of Artificial Sequence: Synthetic oligonucleotide
gcgggcgtcgctcggaccca

SEQ ID NO: 100195 - DNA, 20 bp, Artificial Sequence
  Description of Artificial Sequence: Synthetic oligonucleotide
cgggcgtcgctcggacccag

SEQ ID NO: 100196 - DNA, 21 bp, Artificial Sequence
  Description of Artificial Sequence: Synthetic oligonucleotide
gggcgtcgctcggacccagga

SEQ ID NO: 100197 - DNA, 22 bp, Artificial Sequence
  Description of Artificial Sequence: Synthetic oligonucleotide
ggcgtcgctcggacccaggaca

SEQ ID NO: 100198 - DNA, 24 bp, Artificial Sequence
  Description of Artificial Sequence: Synthetic oligonucleotide
gcgtcgctcggacccaggacacta

SEQ ID NO: 100199 - DNA, 25 bp, Artificial Sequence
  Description of Artificial Sequence: Synthetic oligonucleotide
cgtcgctcggacccaggacactaca

SEQ ID NO: 100200 - DNA, 27 bp, Artificial Sequence
  Description of Artificial Sequence: Synthetic oligonucleotide
gtcgctcggacccaggacactacagtt

SEQ ID NO: 100201 - DNA, 28 bp, Artificial Sequence
  Description of Artificial Sequence: Synthetic oligonucleotide
tcgctcggacccaggacactacagtttc

SEQ ID NO: 100202 - DNA, 27 bp, Artificial Sequence
  Description of Artificial Sequence: Synthetic oligonucleotide
cgctcggacccaggacactacagtttc

SEQ ID NO: 100203 - DNA, 28 bp, Artificial Sequence
  Description of Artificial Sequence: Synthetic oligonucleotide
gctcggacccaggacactacagtttctc

SEQ ID NO: 100204 - DNA, 31 bp, Artificial Sequence
  Description of Artificial Sequence: Synthetic oligonucleotide
ctcggacccaggacactacagtttctctatg

SEQ ID NO: 100205 - DNA, 31 bp, Artificial Sequence
  Description of Artificial Sequence: Synthetic oligonucleotide
tcggacccaggacactacagtttctctatgc

SEQ ID NO: 100206 - DNA, 30 bp, Artificial Sequence
  Description of Artificial Sequence: Synthetic oligonucleotide
cggacccaggacactacagtttctctatgc

SEQ ID NO: 100207 - DNA, 30 bp, Artificial Sequence
  Description of Artificial Sequence: Synthetic oligonucleotide
ggacccaggacactacagtttctctatgcg

SEQ ID NO: 100208 - DNA, 32 bp, Artificial Sequence
  Description of Artificial Sequence: Synthetic oligonucleotide
gacccaggacactacagtttctctatgcgatc

SEQ ID NO: 100209 - DNA, 33 bp, Artificial Sequence
  Description of Artificial Sequence: Synthetic oligonucleotide
acccaggacactacagtttctctatgcgatctc

SEQ ID NO: 100210 - DNA, 32 bp, Artificial Sequence
  Description of Artificial Sequence: Synthetic oligonucleotide
cccaggacactacagtttctctatgcgatctc

SEQ ID NO: 100211 - DNA, 32 bp, Artificial Sequence
  Description of Artificial Sequence: Synthetic oligonucleotide
ccaggacactacagtttctctatgcgatctcc

SEQ ID NO: 100212 - DNA, 33 bp, Artificial Sequence
  Description of Artificial Sequence: Synthetic oligonucleotide
caggacactacagtttctctatgcgatctccag

SEQ ID NO: 100213 - DNA, 34 bp, Artificial Sequence
  Description of Artificial Sequence: Synthetic oligonucleotide
aggacactacagtttctctatgcgatctccagag

SEQ ID NO: 100214 - DNA, 33 bp, Artificial Sequence
  Description of Artificial Sequence: Synthetic oligonucleotide
ggacactacagtttctctatgcgatctccagag

SEQ ID NO: 100215 - DNA, 33 bp, Artificial Sequence
  Description of Artificial Sequence: Synthetic oligonucleotide
gacactacagtttctctatgcgatctccagagc

SEQ ID NO: 100216 - DNA, 34 bp, Artificial Sequence
  Description of Artificial Sequence: Synthetic oligonucleotide
acactacagtttctctatgcgatctccagagctc

SEQ ID NO: 100217 - DNA, 33 bp, Artificial Sequence
  Description of Artificial Sequence: Synthetic oligonucleotide
cactacagtttctctatgcgatctccagagctc

SEQ ID NO: 100218 - DNA, 33 bp, Artificial Sequence
  Description of Artificial Sequence: Synthetic oligonucleotide
actacagtttctctatgcgatctccagagctcg

SEQ ID NO: 100219 - DNA, 32 bp, Artificial Sequence
  Description of Artificial Sequence: Synthetic oligonucleotide
ctacagtttctctatgcgatctccagagctcg

SEQ ID NO: 100220 - DNA, 32 bp, Artificial Sequence
  Description of Artificial Sequence: Synthetic oligonucleotide
tacagtttctctatgcgatctccagagctcgc

SEQ ID NO: 100221 - DNA, 31 bp, Artificial Sequence
  Description of Artificial Sequence: Synthetic oligonucleotide
acagtttctctatgcgatctccagagctcgc

SEQ ID NO: 100222 - DNA, 30 bp, Artificial Sequence
  Description of Artificial Sequence: Synthetic oligonucleotide
cagtttctctatgcgatctccagagctcgc

SEQ ID NO: 100223 - DNA, 34 bp, Artificial Sequence
  Description of Artificial Sequence: Synthetic oligonucleotide
agtttctctatgcgatctccagagctcgctttac

SEQ ID NO: 100224 - DNA, 33 bp, Artificial Sequence
  Description of Artificial Sequence: Synthetic oligonucleotide
gtttctctatgcgatctccagagctcgctttac

SEQ ID NO: 100225 - DNA, 33 bp, Artificial Sequence
  Description of Artificial Sequence: Synthetic oligonucleotide
tttctctatgcgatctccagagctcgctttacc

SEQ ID NO: 100226 - DNA, 32 bp, Artificial Sequence
  Description of Artificial Sequence: Synthetic oligonucleotide
ttctctatgcgatctccagagctcgctttacc

SEQ ID NO: 100227 - DNA, 31 bp, Artificial Sequence
  Description of Artificial Sequence: Synthetic oligonucleotide
tctctatgcgatctccagagctcgctttacc

SEQ ID NO: 100228 - DNA, 30 bp, Artificial Sequence
  Description of Artificial Sequence: Synthetic oligonucleotide
ctctatgcgatctccagagctcgctttacc

SEQ ID NO: 100229 - DNA, 30 bp, Artificial Sequence
  Description of Artificial Sequence: Synthetic oligonucleotide
tctatgcgatctccagagctcgctttaccc

SEQ ID NO: 100230 - DNA, 29 bp, Artificial Sequence
  Description of Artificial Sequence: Synthetic oligonucleotide
ctatgcgatctccagagctcgctttaccc

SEQ ID NO: 100231 - DNA, 29 bp, Artificial Sequence
  Description of Artificial Sequence: Synthetic oligonucleotide
tatgcgatctccagagctcgctttacccc

SEQ ID NO: 100232 - DNA, 28 bp, Artificial Sequence
  Description of Artificial Sequence: Synthetic oligonucleotide
atgcgatctccagagctcgctttacccc

SEQ ID NO: 100233 - DNA, 27 bp, Artificial Sequence
  Description of Artificial Sequence: Synthetic oligonucleotide
tgcgatctccagagctcgctttacccc

SEQ ID NO: 100234 - DNA, 26 bp, Artificial Sequence
  Description of Artificial Sequence: Synthetic oligonucleotide
gcgatctccagagctcgctttacccc

SEQ ID NO: 100235 - DNA, 26 bp, Artificial Sequence
  Description of Artificial Sequence: Synthetic oligonucleotide
cgatctccagagctcgctttaccccg

SEQ ID NO: 100236 - DNA, 26 bp, Artificial Sequence
  Description of Artificial Sequence: Synthetic oligonucleotide
gatctccagagctcgctttaccccgg

SEQ ID NO: 100237 - DNA, 26 bp, Artificial Sequence
  Description of Artificial Sequence: Synthetic oligonucleotide
atctccagagctcgctttaccccggg

SEQ ID NO: 100238 - DNA, 25 bp, Artificial Sequence
  Description of Artificial Sequence: Synthetic oligonucleotide
tctccagagctcgctttaccccggg

SEQ ID NO: 100239 - DNA, 24 bp, Artificial Sequence
  Description of Artificial Sequence: Synthetic oligonucleotide
ctccagagctcgctttaccccggg

SEQ ID NO: 100240 - DNA, 27 bp, Artificial Sequence
  Description of Artificial Sequence: Synthetic oligonucleotide
tccagagctcgctttaccccggggaat

SEQ ID NO: 100241 - DNA, 26 bp, Artificial Sequence
  Description of Artificial Sequence: Synthetic oligonucleotide
ccagagctcgctttaccccggggaat

SEQ ID NO: 100242 - DNA, 26 bp, Artificial Sequence
  Description of Artificial Sequence: Synthetic oligonucleotide
cagagctcgctttaccccggggaatg

SEQ ID NO: 100243 - DNA, 27 bp, Artificial Sequence
  Description of Artificial Sequence: Synthetic oligonucleotide
agagctcgctttaccccggggaatgca

SEQ ID NO: 100244 - DNA, 26 bp, Artificial Sequence
  Description of Artificial Sequence: Synthetic oligonucleotide
gagctcgctttaccccggggaatgca

SEQ ID NO: 100245 - DNA, 26 bp, Artificial Sequence
  Description of Artificial Sequence: Synthetic oligonucleotide
agctcgctttaccccggggaatgcag

SEQ ID NO: 100246 - DNA, 25 bp, Artificial Sequence
  Description of Artificial Sequence: Synthetic oligonucleotide
gctcgctttaccccggggaatgcag

SEQ ID NO: 100247 - DNA, 25 bp, Artificial Sequence
  Description of Artificial Sequence: Synthetic oligonucleotide
ctcgctttaccccggggaatgcagc

SEQ ID NO: 100248 - DNA, 25 bp, Artificial Sequence
  Description of Artificial Sequence: Synthetic oligonucleotide
tcgctttaccccggggaatgcagcc

SEQ ID NO: 100249 - DNA, 24 bp, Artificial Sequence
  Description of Artificial Sequence: Synthetic oligonucleotide
cgctttaccccggggaatgcagcc

SEQ ID NO: 100250 - DNA, 25 bp, Artificial Sequence
  Description of Artificial Sequence: Synthetic oligonucleotide
gctttaccccggggaatgcagccca

SEQ ID NO: 100251 - DNA, 26 bp, Artificial Sequence
  Description of Artificial Sequence: Synthetic oligonucleotide
ctttaccccggggaatgcagcccaca

SEQ ID NO: 100252 - DNA, 27 bp, Artificial Sequence
  Description of Artificial Sequence: Synthetic oligonucleotide
tttaccccggggaatgcagcccacaga

SEQ ID NO: 100253 - DNA, 27 bp, Artificial Sequence
  Description of Artificial Sequence: Synthetic oligonucleotide
ttaccccggggaatgcagcccacagaa

SEQ ID NO: 100254 - DNA, 27 bp, Artificial Sequence
  Description of Artificial Sequence: Synthetic oligonucleotide
taccccggggaatgcagcccacagaat

SEQ ID NO: 100255 - DNA, 27 bp, Artificial Sequence
  Description of Artificial Sequence: Synthetic oligonucleotide
accccggggaatgcagcccacagaatt

SEQ ID NO: 100256 - DNA, 26 bp, Artificial Sequence
  Description of Artificial Sequence: Synthetic oligonucleotide
ccccggggaatgcagcccacagaatt

SEQ ID NO: 100257 - DNA, 27 bp, Artificial Sequence
  Description of Artificial Sequence: Synthetic oligonucleotide
cccggggaatgcagcccacagaattct

SEQ ID NO: 100258 - DNA, 28 bp, Artificial Sequence
  Description of Artificial Sequence: Synthetic oligonucleotide
ccggggaatgcagcccacagaattcttc

SEQ ID NO: 100259 - DNA, 28 bp, Artificial Sequence
  Description of Artificial Sequence: Synthetic oligonucleotide
cggggaatgcagcccacagaattcttcc

SEQ ID NO: 100260 - DNA, 29 bp, Artificial Sequence
  Description of Artificial Sequence: Synthetic oligonucleotide
ggggaatgcagcccacagaattcttccag

SEQ ID NO: 100261 - DNA, 30 bp, Artificial Sequence
  Description of Artificial Sequence: Synthetic oligonucleotide
gggaatgcagcccacagaattcttccagtc

SEQ ID NO: 100262 - DNA, 30 bp, Artificial Sequence
  Description of Artificial Sequence: Synthetic oligonucleotide
ggaatgcagcccacagaattcttccagtcc

SEQ ID NO: 100263 - DNA, 30 bp, Artificial Sequence
  Description of Artificial Sequence: Synthetic oligonucleotide
gaatgcagcccacagaattcttccagtccc

SEQ ID NO: 100264 - DNA, 31 bp, Artificial Sequence
  Description of Artificial Sequence: Synthetic oligonucleotide
aatgcagcccacagaattcttccagtccctg

SEQ ID NO: 100265 - DNA, 30 bp, Artificial Sequence
  Description of Artificial Sequence: Synthetic oligonucleotide
atgcagcccacagaattcttccagtccctg

SEQ ID NO: 100266 - DNA, 29 bp, Artificial Sequence
  Description of Artificial Sequence: Synthetic oligonucleotide
tgcagcccacagaattcttccagtccctg

SEQ ID NO: 100267 - DNA, 28 bp, Artificial Sequence
  Description of Artificial Sequence: Synthetic oligonucleotide
gcagcccacagaattcttccagtccctg

SEQ ID NO: 100268 - DNA, 28 bp, Artificial Sequence
  Description of Artificial Sequence: Synthetic oligonucleotide
cagcccacagaattcttccagtccctgg

SEQ ID NO: 100269 - DNA, 31 bp, Artificial Sequence
  Description of Artificial Sequence: Synthetic oligonucleotide
atggaggagataggcatcttggtggagaagg

SEQ ID NO: 100270 - DNA, 30 bp, Artificial Sequence
  Description of Artificial Sequence: Synthetic oligonucleotide
tggaggagataggcatcttggtggagaagg

SEQ ID NO: 100271 - DNA, 29 bp, Artificial Sequence
  Description of Artificial Sequence: Synthetic oligonucleotide
ggaggagataggcatcttggtggagaagg

SEQ ID NO: 100272 - DNA, 29 bp, Artificial Sequence
  Description of Artificial Sequence: Synthetic oligonucleotide
gaggagataggcatcttggtggagaaggc

SEQ ID NO: 100273 - DNA, 30 bp, Artificial Sequence
  Description of Artificial Sequence: Synthetic oligonucleotide
aggagataggcatcttggtggagaaggctc

SEQ ID NO: 100274 - DNA, 29 bp, Artificial Sequence
  Description of Artificial Sequence: Synthetic oligonucleotide
ggagataggcatcttggtggagaaggctc

SEQ ID NO: 100275 - DNA, 30 bp, Artificial Sequence
  Description of Artificial Sequence: Synthetic oligonucleotide
gagataggcatcttggtggagaaggctcag

SEQ ID NO: 100276 - DNA, 30 bp, Artificial Sequence
  Description of Artificial Sequence: Synthetic oligonucleotide
agataggcatcttggtggagaaggctcagg

SEQ ID NO: 100277 - DNA, 29 bp, Artificial Sequence
  Description of Artificial Sequence: Synthetic oligonucleotide
gataggcatcttggtggagaaggctcagg

SEQ ID NO: 100278 - DNA, 31 bp, Artificial Sequence
  Description of Artificial Sequence: Synthetic oligonucleotide
ataggcatcttggtggagaaggctcaggatg

SEQ ID NO: 100279 - DNA, 30 bp, Artificial Sequence
  Description of Artificial Sequence: Synthetic oligonucleotide
taggcatcttggtggagaaggctcaggatg

SEQ ID NO: 100280 - DNA, 29 bp, Artificial Sequence
  Description of Artificial Sequence: Synthetic oligonucleotide
aggcatcttggtggagaaggctcaggatg

SEQ ID NO: 100281 - DNA, 28 bp, Artificial Sequence
  Description of Artificial Sequence: Synthetic oligonucleotide
ggcatcttggtggagaaggctcaggatg

SEQ ID NO: 100282 - DNA, 29 bp, Artificial Sequence
  Description of Artificial Sequence: Synthetic oligonucleotide
gcatcttggtggagaaggctcaggatgag

SEQ ID NO: 100283 - DNA, 31 bp, Artificial Sequence
  Description of Artificial Sequence: Synthetic oligonucleotide
catcttggtggagaaggctcaggatgagatc

SEQ ID NO: 100284 - DNA, 31 bp, Artificial Sequence
  Description of Artificial Sequence: Synthetic oligonucleotide
atcttggtggagaaggctcaggatgagatcc

SEQ ID NO: 100285 - DNA, 30 bp, Artificial Sequence
  Description of Artificial Sequence: Synthetic oligonucleotide
tcttggtggagaaggctcaggatgagatcc

SEQ ID NO: 100286 - DNA, 29 bp, Artificial Sequence
  Description of Artificial Sequence: Synthetic oligonucleotide
cttggtggagaaggctcaggatgagatcc

SEQ ID NO: 100287 - DNA, 29 bp, Artificial Sequence
  Description of Artificial Sequence: Synthetic oligonucleotide
ttggtggagaaggctcaggatgagatccc

SEQ ID NO: 100288 - DNA, 28 bp, Artificial Sequence
  Description of Artificial Sequence: Synthetic oligonucleotide
tggtggagaaggctcaggatgagatccc

SEQ ID NO: 100289 - DNA, 27 bp, Artificial Sequence
  Description of Artificial Sequence: Synthetic oligonucleotide
ggtggagaaggctcaggatgagatccc

SEQ ID NO: 100290 - DNA, 28 bp, Artificial Sequence
  Description of Artificial Sequence: Synthetic oligonucleotide
gtggagaaggctcaggatgagatcccag

SEQ ID NO: 100291 - DNA, 28 bp, Artificial Sequence
  Description of Artificial Sequence: Synthetic oligonucleotide
tggagaaggctcaggatgagatcccagc

SEQ ID NO: 100292 - DNA, 27 bp, Artificial Sequence
  Description of Artificial Sequence: Synthetic oligonucleotide
ggagaaggctcaggatgagatcccagc

SEQ ID NO: 100293 - DNA, 28 bp, Artificial Sequence
  Description of Artificial Sequence: Synthetic oligonucleotide
gagaaggctcaggatgagatcccagcac

SEQ ID NO: 100294 - DNA, 29 bp, Artificial Sequence
  Description of Artificial Sequence: Synthetic oligonucleotide
agaaggctcaggatgagatcccagcactg

SEQ ID NO: 100295 - DNA, 28 bp, Artificial Sequence
  Description of Artificial Sequence: Synthetic oligonucleotide
gaaggctcaggatgagatcccagcactg

SEQ ID NO: 100296 - DNA, 29 bp, Artificial Sequence
  Description of Artificial Sequence: Synthetic oligonucleotide
aaggctcaggatgagatcccagcactgtc

SEQ ID NO: 100297 - DNA, 28 bp, Artificial Sequence
  Description of Artificial Sequence: Synthetic oligonucleotide
aggctcaggatgagatcccagcactgtc

SEQ ID NO: 100298 - DNA, 27 bp, Artificial Sequence
  Description of Artificial Sequence: Synthetic oligonucleotide
ggctcaggatgagatcccagcactgtc

SEQ ID NO: 100299 - DNA, 27 bp, Artificial Sequence
  Description of Artificial Sequence: Synthetic oligonucleotide
gctcaggatgagatcccagcactgtcc

SEQ ID NO: 100300 - DNA, 27 bp, Artificial Sequence
  Description of Artificial Sequence: Synthetic oligonucleotide
ctcaggatgagatcccagcactgtccg

SEQ ID NO: 100301 - DNA, 28 bp, Artificial Sequence
  Description of Artificial Sequence: Synthetic oligonucleotide
tcaggatgagatcccagcactgtccgtg

SEQ ID NO: 100302 - DNA, 27 bp, Artificial Sequence
  Description of Artificial Sequence: Synthetic oligonucleotide
caggatgagatcccagcactgtccgtg

SEQ ID NO: 100303 - DNA, 28 bp, Artificial Sequence
  Description of Artificial Sequence: Synthetic oligonucleotide
aggatgagatcccagcactgtccgtgtc

SEQ ID NO: 100304 - DNA, 27 bp, Artificial Sequence
  Description of Artificial Sequence: Synthetic oligonucleotide
ggatgagatcccagcactgtccgtgtc

SEQ ID NO: 100305 - DNA, 27 bp, Artificial Sequence
  Description of Artificial Sequence: Synthetic oligonucleotide
gatgagatcccagcactgtccgtgtcc

SEQ ID NO: 100306 - DNA, 27 bp, Artificial Sequence
  Description of Artificial Sequence: Synthetic oligonucleotide
atgagatcccagcactgtccgtgtccc

SEQ ID NO: 100307 - DNA, 26 bp, Artificial Sequence
  Description of Artificial Sequence: Synthetic oligonucleotide
tgagatcccagcactgtccgtgtccc

SEQ ID NO: 100308 - DNA, 25 bp, Artificial Sequence
  Description of Artificial Sequence: Synthetic oligonucleotide
gagatcccagcactgtccgtgtccc

SEQ ID NO: 100309 - DNA, 25 bp, Artificial Sequence
  Description of Artificial Sequence: Synthetic oligonucleotide
agatcccagcactgtccgtgtcccg

SEQ ID NO: 100310 - DNA, 24 bp, Artificial Sequence
  Description of Artificial Sequence: Synthetic oligonucleotide
gatcccagcactgtccgtgtcccg

SEQ ID NO: 100311 - DNA, 24 bp, Artificial Sequence
  Description of Artificial Sequence: Synthetic oligonucleotide
atcccagcactgtccgtgtcccgg

SEQ ID NO: 100312 - DNA, 23 bp, Artificial Sequence
  Description of Artificial Sequence: Synthetic oligonucleotide
tcccagcactgtccgtgtcccgg

SEQ ID NO: 100313 - DNA, 22 bp, Artificial Sequence
  Description of Artificial Sequence: Synthetic oligonucleotide
cccagcactgtccgtgtcccgg

SEQ ID NO: 100314 - DNA, 22 bp, Artificial Sequence
  Description of Artificial Sequence: Synthetic oligonucleotide
ccagcactgtccgtgtcccggc

SEQ ID NO: 100315 - DNA, 22 bp, Artificial Sequence
  Description of Artificial Sequence: Synthetic oligonucleotide
cagcactgtccgtgtcccggcc

SEQ ID NO: 100316 - DNA, 22 bp, Artificial Sequence
  Description of Artificial Sequence: Synthetic oligonucleotide
agcactgtccgtgtcccggccc

SEQ ID NO: 100317 - DNA, 21 bp, Artificial Sequence
  Description of Artificial Sequence: Synthetic oligonucleotide
gcactgtccgtgtcccggccc

SEQ ID NO: 100318 - DNA, 22 bp, Artificial Sequence
  Description of Artificial Sequence: Synthetic oligonucleotide
cactgtccgtgtcccggcccca

SEQ ID NO: 100319 - DNA, 23 bp, Artificial Sequence
  Description of Artificial Sequence: Synthetic oligonucleotide
actgtccgtgtcccggccccaga

SEQ ID NO: 100320 - DNA, 22 bp, Artificial Sequence
  Description of Artificial Sequence: Synthetic oligonucleotide
ctgtccgtgtcccggccccaga

SEQ ID NO: 100321 - DNA, 22 bp, Artificial Sequence
  Description of Artificial Sequence: Synthetic oligonucleotide
tgtccgtgtcccggccccagac

SEQ ID NO: 100322 - DNA, 21 bp, Artificial Sequence
  Description of Artificial Sequence: Synthetic oligonucleotide
gtccgtgtcccggccccagac

SEQ ID NO: 100323 - DNA, 21 bp, Artificial Sequence
  Description of Artificial Sequence: Synthetic oligonucleotide
tccgtgtcccggccccagacc

SEQ ID NO: 100324 - DNA, 20 bp, Artificial Sequence
  Description of Artificial Sequence: Synthetic oligonucleotide
ccgtgtcccggccccagacc

SEQ ID NO: 100325 - DNA, 20 bp, Artificial Sequence
  Description of Artificial Sequence: Synthetic oligonucleotide
cgtgtcccggccccagaccg

SEQ ID NO: 100326 - DNA, 20 bp, Artificial Sequence
  Description of Artificial Sequence: Synthetic oligonucleotide
gtgtcccggccccagaccgg

SEQ ID NO: 100327 - DNA, 20 bp, Artificial Sequence
  Description of Artificial Sequence: Synthetic oligonucleotide
tgtcccggccccagaccggc

SEQ ID NO: 100328 - DNA, 20 bp, Artificial Sequence
  Description of Artificial Sequence: Synthetic oligonucleotide
gtcccggccccagaccggct

SEQ ID NO: 100329 - DNA, 20 bp, Artificial Sequence
  Description of Artificial Sequence: Synthetic oligonucleotide
tcccggccccagaccggcct

SEQ ID NO: 100330 - DNA, 20 bp, Artificial Sequence
  Description of Artificial Sequence: Synthetic oligonucleotide
cccggccccagaccggcctt

SEQ ID NO: 100331 - DNA, 20 bp, Artificial Sequence
  Description of Artificial Sequence: Synthetic oligonucleotide
ccggccccagaccggcctgt

SEQ ID NO: 100332 - DNA, 20 bp, Artificial Sequence
  Description of Artificial Sequence: Synthetic oligonucleotide
cggccccagaccggcctgtc

SEQ ID NO: 100333 - DNA, 22 bp, Artificial Sequence
  Description of Artificial Sequence: Synthetic oligonucleotide
ggccccagaccggcctgtcctt

SEQ ID NO: 100334 - DNA, 22 bp, Artificial Sequence
  Description of Artificial Sequence: Synthetic oligonucleotide
gccccagaccggcctgtccttc

SEQ ID NO: 100335 - DNA, 23 bp, Artificial Sequence
  Description of Artificial Sequence: Synthetic oligonucleotide
ccccagaccggcctgtccttcct

SEQ ID NO: 100336 - DNA, 23 bp, Artificial Sequence
  Description of Artificial Sequence: Synthetic oligonucleotide
cccagaccggcctgtccttcctg

SEQ ID NO: 100337 - DNA, 23 bp, Artificial Sequence
  Description of Artificial Sequence: Synthetic oligonucleotide
ccagaccggcctgtccttcctgg

SEQ ID NO: 100338 - DNA, 23 bp, Artificial Sequence
  Description of Artificial Sequence: Synthetic oligonucleotide
cagaccggcctgtccttcctggg

SEQ ID NO: 100339 - DNA, 23 bp, Artificial Sequence
  Description of Artificial Sequence: Synthetic oligonucleotide
agaccggcctgtccttcctgggc

SEQ ID NO: 100340 - DNA, 22 bp, Artificial Sequence
  Description of Artificial Sequence: Synthetic oligonucleotide
gaccggcctgtccttcctgggc

SEQ ID NO: 100341 - DNA, 22 bp, Artificial Sequence
  Description of Artificial Sequence: Synthetic oligonucleotide
accggcctgtccttcctgggcc

SEQ ID NO: 100342 - DNA, 21 bp, Artificial Sequence
  Description of Artificial Sequence: Synthetic oligonucleotide
ccggcctgtccttcctgggcc

SEQ ID NO: 100343 - DNA, 22 bp, Artificial Sequence
  Description of Artificial Sequence: Synthetic oligonucleotide
cggcctgtccttcctgggccct

SEQ ID NO: 100344 - DNA, 23 bp, Artificial Sequence
  Description of Artificial Sequence: Synthetic oligonucleotide
ggcctgtccttcctgggccctga

SEQ ID NO: 100345 - DNA, 23 bp, Artificial Sequence
  Description of Artificial Sequence: Synthetic oligonucleotide
gcctgtccttcctgggccctgag

SEQ ID NO: 100346 - DNA, 23 bp, Artificial Sequence
  Description of Artificial Sequence: Synthetic oligonucleotide
cctgtccttcctgggccctgagc

SEQ ID NO: 100347 - DNA, 24 bp, Artificial Sequence
  Description of Artificial Sequence: Synthetic oligonucleotide
ctgtccttcctgggccctgagcct

SEQ ID NO: 100348 - DNA, 25 bp, Artificial Sequence
  Description of Artificial Sequence: Synthetic oligonucleotide
tgtccttcctgggccctgagcctga

SEQ ID NO: 100349 - DNA, 24 bp, Artificial Sequence
  Description of Artificial Sequence: Synthetic oligonucleotide
gtccttcctgggccctgagcctga

SEQ ID NO: 100350 - DNA, 24 bp, Artificial Sequence
  Description of Artificial Sequence: Synthetic oligonucleotide
tccttcctgggccctgagcctgag

SEQ ID NO: 100351 - DNA, 23 bp, Artificial Sequence
  Description of Artificial Sequence: Synthetic oligonucleotide
ccttcctgggccctgagcctgag

SEQ ID NO: 100352 - DNA, 24 bp, Artificial Sequence
  Description of Artificial Sequence: Synthetic oligonucleotide
cttcctgggccctgagcctgagga

SEQ ID NO: 100353 - DNA, 24 bp, Artificial Sequence
  Description of Artificial Sequence: Synthetic oligonucleotide
ttcctgggccctgagcctgaggac

SEQ ID NO: 100354 - DNA, 23 bp, Artificial Sequence
  Description of Artificial Sequence: Synthetic oligonucleotide
tcctgggccctgagcctgaggac

SEQ ID NO: 100355 - DNA, 22 bp, Artificial Sequence
  Description of Artificial Sequence: Synthetic oligonucleotide
cctgggccctgagcctgaggac

SEQ ID NO: 100356 - DNA, 23 bp, Artificial Sequence
  Description of Artificial Sequence: Synthetic oligonucleotide
ctgggccctgagcctgaggacct

SEQ ID NO: 100357 - DNA, 23 bp, Artificial Sequence
  Description of Artificial Sequence: Synthetic oligonucleotide
tgggccctgagcctgaggacctg

SEQ ID NO: 100358 - DNA, 22 bp, Artificial Sequence
  Description of Artificial Sequence: Synthetic oligonucleotide
gggccctgagcctgaggacctg

SEQ ID NO: 100359 - DNA, 23 bp, Artificial Sequence
  Description of Artificial Sequence: Synthetic oligonucleotide
ggccctgagcctgaggacctgga

SEQ ID NO: 100360 - DNA, 23 bp, Artificial Sequence
  Description of Artificial Sequence: Synthetic oligonucleotide
gccctgagcctgaggacctggag

SEQ ID NO: 100361 - DNA, 24 bp, Artificial Sequence
  Description of Artificial Sequence: Synthetic oligonucleotide
ccctgagcctgaggacctggagga

SEQ ID NO: 100362 - DNA, 24 bp, Artificial Sequence
  Description of Artificial Sequence: Synthetic oligonucleotide
cctgagcctgaggacctggaggac

SEQ ID NO: 100363 - DNA, 25 bp, Artificial Sequence
  Description of Artificial Sequence: Synthetic oligonucleotide
ctgagcctgaggacctggaggacct

SEQ ID NO: 100364 - DNA, 27 bp, Artificial Sequence
  Description of Artificial Sequence: Synthetic oligonucleotide
tgagcctgaggacctggaggacctgta

SEQ ID NO: 100365 - DNA, 26 bp, Artificial Sequence
  Description of Artificial Sequence: Synthetic oligonucleotide
gagcctgaggacctggaggacctgta

SEQ ID NO: 100366 - DNA, 27 bp, Artificial Sequence
  Description of Artificial Sequence: Synthetic oligonucleotide
agcctgaggacctggaggacctgtaca

SEQ ID NO: 100367 - DNA, 26 bp, Artificial Sequence
  Description of Artificial Sequence: Synthetic oligonucleotide
gcctgaggacctggaggacctgtaca

SEQ ID NO: 100368 - DNA, 26 bp, Artificial Sequence
  Description of Artificial Sequence: Synthetic oligonucleotide
cctgaggacctggaggacctgtacag

SEQ ID NO: 100369 - DNA, 26 bp, Artificial Sequence
  Description of Artificial Sequence: Synthetic oligonucleotide
ctgaggacctggaggacctgtacagc

SEQ ID NO: 100370 - DNA, 26 bp, Artificial Sequence
  Description of Artificial Sequence: Synthetic oligonucleotide
tgaggacctggaggacctgtacagcc

SEQ ID NO: 100371 - DNA, 25 bp, Artificial Sequence
  Description of Artificial Sequence: Synthetic oligonucleotide
gaggacctggaggacctgtacagcc

SEQ ID NO: 100372 - DNA, 25 bp, Artificial Sequence
  Description of Artificial Sequence: Synthetic oligonucleotide
aggacctggaggacctgtacagccg

SEQ ID NO: 100373 - DNA, 24 bp, Artificial Sequence
  Description of Artificial Sequence: Synthetic oligonucleotide
ggacctggaggacctgtacagccg

SEQ ID NO: 100374 - DNA, 26 bp, Artificial Sequence
  Description of Artificial Sequence: Synthetic oligonucleotide
gacctggaggacctgtacagccgcta

SEQ ID NO: 100375 - DNA, 27 bp, Artificial Sequence
  Description of Artificial Sequence: Synthetic oligonucleotide
acctggaggacctgtacagccgctaca

SEQ ID NO: 100376 - DNA, 27 bp, Artificial Sequence
  Description of Artificial Sequence: Synthetic oligonucleotide
cctggaggacctgtacagccgctacaa

SEQ ID NO: 100377 - DNA, 27 bp, Artificial Sequence
  Description of Artificial Sequence: Synthetic oligonucleotide
ctggaggacctgtacagccgctacaag

SEQ ID NO: 100378 - DNA, 29 bp, Artificial Sequence
  Description of Artificial Sequence: Synthetic oligonucleotide
tggaggacctgtacagccgctacaagaag

SEQ ID NO: 100379 - DNA, 28 bp, Artificial Sequence
  Description of Artificial Sequence: Synthetic oligonucleotide
ggaggacctgtacagccgctacaagaag

SEQ ID NO: 100380 - DNA, 28 bp, Artificial Sequence
  Description of Artificial Sequence: Synthetic oligonucleotide
gaggacctgtacagccgctacaagaagc

SEQ ID NO: 100381 - DNA, 29 bp, Artificial Sequence
  Description of Artificial Sequence: Synthetic oligonucleotide
aggacctgtacagccgctacaagaagctg

SEQ ID NO: 100382 - DNA, 28 bp, Artificial Sequence
  Description of Artificial Sequence: Synthetic oligonucleotide
ggacctgtacagccgctacaagaagctg

SEQ ID NO: 100383 - DNA, 28 bp, Artificial Sequence
  Description of Artificial Sequence: Synthetic oligonucleotide
gacctgtacagccgctacaagaagctgc

SEQ ID NO: 100384 - DNA, 29 bp, Artificial Sequence
  Description of Artificial Sequence: Synthetic oligonucleotide
acctgtacagccgctacaagaagctgcag

SEQ ID NO: 100385 - DNA, 28 bp, Artificial Sequence
  Description of Artificial Sequence: Synthetic oligonucleotide
cctgtacagccgctacaagaagctgcag

SEQ ID NO: 100386 - DNA, 28 bp, Artificial Sequence
  Description of Artificial Sequence: Synthetic oligonucleotide
ctgtacagccgctacaagaagctgcagc

SEQ ID NO: 100387 - DNA, 30 bp, Artificial Sequence
  Description of Artificial Sequence: Synthetic oligonucleotide
tgtacagccgctacaagaagctgcagcaag

SEQ ID NO: 100388 - DNA, 29 bp, Artificial Sequence
  Description of Artificial Sequence: Synthetic oligonucleotide
gtacagccgctacaagaagctgcagcaag

SEQ ID NO: 100389 - DNA, 30 bp, Artificial Sequence
  Description of Artificial Sequence: Synthetic oligonucleotide
tacagccgctacaagaagctgcagcaagag

SEQ ID NO: 100390 - DNA, 29 bp, Artificial Sequence
  Description of Artificial Sequence: Synthetic oligonucleotide
acagccgctacaagaagctgcagcaagag

SEQ ID NO: 100391 - DNA, 28 bp, Artificial Sequence
  Description of Artificial Sequence: Synthetic oligonucleotide
cagccgctacaagaagctgcagcaagag

SEQ ID NO: 100392 - DNA, 28 bp, Artificial Sequence
  Description of Artificial Sequence: Synthetic oligonucleotide
agccgctacaagaagctgcagcaagagc

SEQ ID NO: 100393 - DNA, 27 bp, Artificial Sequence
  Description of Artificial Sequence: Synthetic oligonucleotide
gccgctacaagaagctgcagcaagagc

SEQ ID NO: 100394 - DNA, 28 bp, Artificial Sequence
  Description of Artificial Sequence: Synthetic oligonucleotide
ccgctacaagaagctgcagcaagagctg

SEQ ID NO: 100395 - DNA, 28 bp, Artificial Sequence
  Description of Artificial Sequence: Synthetic oligonucleotide
cgctacaagaagctgcagcaagagctgg

SEQ ID NO: 100396 - DNA, 29 bp, Artificial Sequence
  Description of Artificial Sequence: Synthetic oligonucleotide
gctacaagaagctgcagcaagagctggag

SEQ ID NO: 100397 - DNA, 31 bp, Artificial Sequence
  Description of Artificial Sequence: Synthetic oligonucleotide
ctacaagaagctgcagcaagagctggagttc

SEQ ID NO: 100398 - DNA, 31 bp, Artificial Sequence
  Description of Artificial Sequence: Synthetic oligonucleotide
tacaagaagctgcagcaagagctggagttcc

SEQ ID NO: 100399 - DNA, 30 bp, Artificial Sequence
  Description of Artificial Sequence: Synthetic oligonucleotide
acaagaagctgcagcaagagctggagttcc

SEQ ID NO: 100400 - DNA, 29 bp, Artificial Sequence
  Description of Artificial Sequence: Synthetic oligonucleotide
caagaagctgcagcaagagctggagttcc

SEQ ID NO: 100401 - DNA, 30 bp, Artificial Sequence
  Description of Artificial Sequence: Synthetic oligonucleotide
aagaagctgcagcaagagctggagttcctg

SEQ ID NO: 100402 - DNA, 29 bp, Artificial Sequence
  Description of Artificial Sequence: Synthetic oligonucleotide
agaagctgcagcaagagctggagttcctg

SEQ ID NO: 100403 - DNA, 28 bp, Artificial Sequence
  Description of Artificial Sequence: Synthetic oligonucleotide
gaagctgcagcaagagctggagttcctg

SEQ ID NO: 100404 - DNA, 28 bp, Artificial Sequence
  Description of Artificial Sequence: Synthetic oligonucleotide
aagctgcagcaagagctggagttcctgg

SEQ ID NO: 100405 - DNA, 27 bp, Artificial Sequence
  Description of Artificial Sequence: Synthetic oligonucleotide
agctgcagcaagagctggagttcctgg

SEQ ID NO: 100406 - DNA, 27 bp, Artificial Sequence
  Description of Artificial Sequence: Synthetic oligonucleotide
gctgcagcaagagctggagttcctgga

SEQ ID NO: 100407 - DNA, 27 bp, Artificial Sequence
  Description of Artificial Sequence: Synthetic oligonucleotide
ctgcagcaagagctggagttcctggag

SEQ ID NO: 100408 - DNA, 27 bp, Artificial Sequence
  Description of Artificial Sequence: Synthetic oligonucleotide
tgcagcaagagctggagttcctggagg

SEQ ID NO: 100409 - DNA, 27 bp, Artificial Sequence
  Description of Artificial Sequence: Synthetic oligonucleotide
gcagcaagagctggagttcctggaggt

SEQ ID NO: 100410 - DNA, 27 bp, Artificial Sequence
  Description of Artificial Sequence: Synthetic oligonucleotide
cagcaagagctggagttcctggaggtg

SEQ ID NO: 100411 - DNA, 27 bp, Artificial Sequence
  Description of Artificial Sequence: Synthetic oligonucleotide
agcaagagctggagttcctggaggtgc

SEQ ID NO: 100412 - DNA, 27 bp, Artificial Sequence
  Description of Artificial Sequence: Synthetic oligonucleotide
gcaagagctggagttcctggaggtgca

SEQ ID NO: 100413 - DNA, 27 bp, Artificial Sequence
  Description of Artificial Sequence: Synthetic oligonucleotide
caagagctggagttcctggaggtgcag

SEQ ID NO: 100414 - DNA, 27 bp, Artificial Sequence
  Description of Artificial Sequence: Synthetic oligonucleotide
aagagctggagttcctggaggtgcagg

SEQ ID NO: 100415 - DNA, 27 bp, Artificial Sequence
  Description of Artificial Sequence: Synthetic oligonucleotide
agagctggagttcctggaggtgcagga

SEQ ID NO: 100416 - DNA, 26 bp, Artificial Sequence
  Description of Artificial Sequence: Synthetic oligonucleotide
gagctggagttcctggaggtgcagga

SEQ ID NO: 100417 - DNA, 26 bp, Artificial Sequence
  Description of Artificial Sequence: Synthetic oligonucleotide
agctggagttcctggaggtgcaggag

SEQ ID NO: 100418 - DNA, 25 bp, Artificial Sequence
  Description of Artificial Sequence: Synthetic oligonucleotide
gctggagttcctggaggtgcaggag

SEQ ID NO: 100419 - DNA, 27 bp, Artificial Sequence
  Description of Artificial Sequence: Synthetic oligonucleotide
ctggagttcctggaggtgcaggaggaa

SEQ ID NO: 100420 - DNA, 29 bp, Artificial Sequence
  Description of Artificial Sequence: Synthetic oligonucleotide
tggagttcctggaggtgcaggaggaatac

SEQ ID NO: 100421 - DNA, 28 bp, Artificial Sequence
  Description of Artificial Sequence: Synthetic oligonucleotide
ggagttcctggaggtgcaggaggaatac

SEQ ID NO: 100422 - DNA, 30 bp, Artificial Sequence
  Description of Artificial Sequence: Synthetic oligonucleotide
gagttcctggaggtgcaggaggaatacatc

SEQ ID NO: 100423 - DNA, 33 bp, Artificial Sequence
  Description of Artificial Sequence: Synthetic oligonucleotide
agttcctggaggtgcaggaggaatacatcaaag

SEQ ID NO: 100424 - DNA, 32 bp, Artificial Sequence
  Description of Artificial Sequence: Synthetic oligonucleotide
gttcctggaggtgcaggaggaatacatcaaag

SEQ ID NO: 100425 - DNA, 34 bp, Artificial Sequence
  Description of Artificial Sequence: Synthetic oligonucleotide
ttcctggaggtgcaggaggaatacatcaaagatg

SEQ ID NO: 100426 - DNA, 33 bp, Artificial Sequence
  Description of Artificial Sequence: Synthetic oligonucleotide
tcctggaggtgcaggaggaatacatcaaagatg

SEQ ID NO: 100427 - DNA, 32 bp, Artificial Sequence
  Description of Artificial Sequence: Synthetic oligonucleotide
cctggaggtgcaggaggaatacatcaaagatg

SEQ ID NO: 100428 - DNA, 33 bp, Artificial Sequence
  Description of Artificial Sequence: Synthetic oligonucleotide
ctggaggtgcaggaggaatacatcaaagatgag

SEQ ID NO: 100429 - DNA, 33 bp, Artificial Sequence
  Description of Artificial Sequence: Synthetic oligonucleotide
tggaggtgcaggaggaatacatcaaagatgagc

SEQ ID NO: 100430 - DNA, 32 bp, Artificial Sequence
  Description of Artificial Sequence: Synthetic oligonucleotide
ggaggtgcaggaggaatacatcaaagatgagc

SEQ ID NO: 100431 - DNA, 36 bp, Artificial Sequence
  Description of Artificial Sequence: Synthetic oligonucleotide
gaggtgcaggaggaatacatcaaagatgagcaaaag

SEQ ID NO: 100432 - DNA, 38 bp, Artificial Sequence
  Description of Artificial Sequence: Synthetic oligonucleotide
aggtgcaggaggaatacatcaaagatgagcaaaagaac

SEQ ID NO: 100433 - DNA, 37 bp, Artificial Sequence
  Description of Artificial Sequence: Synthetic oligonucleotide
ggtgcaggaggaatacatcaaagatgagcaaaagaac

SEQ ID NO: 100434 - DNA, 37 bp, Artificial Sequence
  Description of Artificial Sequence: Synthetic oligonucleotide
gtgcaggaggaatacatcaaagatgagcaaaagaacc

SEQ ID NO: 100435 - DNA, 38 bp, Artificial Sequence
  Description of Artificial Sequence: Synthetic oligonucleotide
tgcaggaggaatacatcaaagatgagcaaaagaacctg

SEQ ID NO: 100436 - DNA, 37 bp, Artificial Sequence
  Description of Artificial Sequence: Synthetic oligonucleotide
gcaggaggaatacatcaaagatgagcaaaagaacctg

SEQ ID NO: 100437 - DNA, 42 bp, Artificial Sequence
  Description of Artificial Sequence: Synthetic oligonucleotide
caggaggaatacatcaaagatgagcaaaagaacctgaaaaag

SEQ ID NO: 100438 - DNA, 42 bp, Artificial Sequence
  Description of Artificial Sequence: Synthetic oligonucleotide
aggaggaatacatcaaagatgagcaaaagaacctgaaaaagg

SEQ ID NO: 100439 - DNA, 41 bp, Artificial Sequence
  Description of Artificial Sequence: Synthetic oligonucleotide
ggaggaatacatcaaagatgagcaaaagaacctgaaaaagg

SEQ ID NO: 100440 - DNA, 46 bp, Artificial Sequence
  Description of Artificial Sequence: Synthetic oligonucleotide
gaggaatacatcaaagatgagcaaaagaacctgaaaaaggaatttc

SEQ ID NO: 100441 - DNA, 47 bp, Artificial Sequence
  Description of Artificial Sequence: Synthetic oligonucleotide
aggaatacatcaaagatgagcaaaagaacctgaaaaaggaatttctc

SEQ ID NO: 100442 - DNA, 46 bp, Artificial Sequence
  Description of Artificial Sequence: Synthetic oligonucleotide
ggaatacatcaaagatgagcaaaagaacctgaaaaaggaatttctc

SEQ ID NO: 100443 - DNA, 46 bp, Artificial Sequence
  Description of Artificial Sequence: Synthetic oligonucleotide
gaatacatcaaagatgagcaaaagaacctgaaaaaggaatttctcc

SEQ ID NO: 100444 - DNA, 48 bp, Artificial Sequence
  Description of Artificial Sequence: Synthetic oligonucleotide
aatacatcaaagatgagcaaaagaacctgaaaaaggaatttctccatg

SEQ ID NO: 100445 - DNA, 47 bp, Artificial Sequence
  Description of Artificial Sequence: Synthetic oligonucleotide
atacatcaaagatgagcaaaagaacctgaaaaaggaatttctccatg

SEQ ID NO: 100446 - DNA, 46 bp, Artificial Sequence
  Description of Artificial Sequence: Synthetic oligonucleotide
tacatcaaagatgagcaaaagaacctgaaaaaggaatttctccatg

SEQ ID NO: 100447 - DNA, 45 bp, Artificial Sequence
  Description of Artificial Sequence: Synthetic oligonucleotide
acatcaaagatgagcaaaagaacctgaaaaaggaatttctccatg

SEQ ID NO: 100448 - DNA, 44 bp, Artificial Sequence
  Description of Artificial Sequence: Synthetic oligonucleotide
catcaaagatgagcaaaagaacctgaaaaaggaatttctccatg

SEQ ID NO: 100449 - DNA, 44 bp, Artificial Sequence
  Description of Artificial Sequence: Synthetic oligonucleotide
atcaaagatgagcaaaagaacctgaaaaaggaatttctccatgc

SEQ ID NO: 100450 - DNA, 43 bp, Artificial Sequence
  Description of Artificial Sequence: Synthetic oligonucleotide
tcaaagatgagcaaaagaacctgaaaaaggaatttctccatgc

SEQ ID NO: 100451 - DNA, 42 bp, Artificial Sequence
  Description of Artificial Sequence: Synthetic oligonucleotide
caaagatgagcaaaagaacctgaaaaaggaatttctccatgc

SEQ ID NO: 100452 - DNA, 42 bp, Artificial Sequence
  Description of Artificial Sequence: Synthetic oligonucleotide
aaagatgagcaaaagaacctgaaaaaggaatttctccatgcc

SEQ ID NO: 100453 - DNA, 41 bp, Artificial Sequence
  Description of Artificial Sequence: Synthetic oligonucleotide
aagatgagcaaaagaacctgaaaaaggaatttctccatgcc

SEQ ID NO: 100454 - DNA, 40 bp, Artificial Sequence
  Description of Artificial Sequence: Synthetic oligonucleotide
agatgagcaaaagaacctgaaaaaggaatttctccatgcc

SEQ ID NO: 100455 - DNA, 39 bp, Artificial Sequence
  Description of Artificial Sequence: Synthetic oligonucleotide
gatgagcaaaagaacctgaaaaaggaatttctccatgcc

SEQ ID NO: 100456 - DNA, 39 bp, Artificial Sequence
  Description of Artificial Sequence: Synthetic oligonucleotide
atgagcaaaagaacctgaaaaaggaatttctccatgccc

SEQ ID NO: 100457 - DNA, 38 bp, Artificial Sequence
  Description of Artificial Sequence: Synthetic oligonucleotide
tgagcaaaagaacctgaaaaaggaatttctccatgccc

SEQ ID NO: 100458 - DNA, 37 bp, Artificial Sequence
  Description of Artificial Sequence: Synthetic oligonucleotide
gagcaaaagaacctgaaaaaggaatttctccatgccc

SEQ ID NO: 100459 - DNA, 38 bp, Artificial Sequence
  Description of Artificial Sequence: Synthetic oligonucleotide
agcaaaagaacctgaaaaaggaatttctccatgcccag

SEQ ID NO: 100460 - DNA, 37 bp, Artificial Sequence
  Description of Artificial Sequence: Synthetic oligonucleotide
gcaaaagaacctgaaaaaggaatttctccatgcccag

SEQ ID NO: 100461 - DNA, 37 bp, Artificial Sequence
  Description of Artificial Sequence: Synthetic oligonucleotide
caaaagaacctgaaaaaggaatttctccatgcccagg

SEQ ID NO: 100462 - DNA, 38 bp, Artificial Sequence
  Description of Artificial Sequence: Synthetic oligonucleotide
aaaagaacctgaaaaaggaatttctccatgcccaggag

SEQ ID NO: 100463 - DNA, 37 bp, Artificial Sequence
  Description of Artificial Sequence: Synthetic oligonucleotide
aaagaacctgaaaaaggaatttctccatgcccaggag

SEQ ID NO: 100464 - DNA, 36 bp, Artificial Sequence
  Description of Artificial Sequence: Synthetic oligonucleotide
aagaacctgaaaaaggaatttctccatgcccaggag

SEQ ID NO: 100465 - DNA, 35 bp, Artificial Sequence
  Description of Artificial Sequence: Synthetic oligonucleotide
agaacctgaaaaaggaatttctccatgcccaggag

SEQ ID NO: 100466 - DNA, 34 bp, Artificial Sequence
  Description of Artificial Sequence: Synthetic oligonucleotide
gaacctgaaaaaggaatttctccatgcccaggag

SEQ ID NO: 100467 - DNA, 34 bp, Artificial Sequence
  Description of Artificial Sequence: Synthetic oligonucleotide
aacctgaaaaaggaatttctccatgcccaggagg

SEQ ID NO: 100468 - DNA, 33 bp, Artificial Sequence
  Description of Artificial Sequence: Synthetic oligonucleotide
acctgaaaaaggaatttctccatgcccaggagg

SEQ ID NO: 100469 - DNA, 32 bp, Artificial Sequence
  Description of Artificial Sequence: Synthetic oligonucleotide
cctgaaaaaggaatttctccatgcccaggagg

SEQ ID NO: 100470 - DNA, 33 bp, Artificial Sequence
  Description of Artificial Sequence: Synthetic oligonucleotide
ctgaaaaaggaatttctccatgcccaggaggag

SEQ ID NO: 100471 - DNA, 33 bp, Artificial Sequence
  Description of Artificial Sequence: Synthetic oligonucleotide
tgaaaaaggaatttctccatgcccaggaggagg

SEQ ID NO: 100472 - DNA, 32 bp, Artificial Sequence
  Description of Artificial Sequence: Synthetic oligonucleotide
gaaaaaggaatttctccatgcccaggaggagg

SEQ ID NO: 100473 - DNA, 33 bp, Artificial Sequence
  Description of Artificial Sequence: Synthetic oligonucleotide
aaaaaggaatttctccatgcccaggaggaggtg

SEQ ID NO: 100474 - DNA, 32 bp, Artificial Sequence
  Description of Artificial Sequence: Synthetic oligonucleotide
aaaaggaatttctccatgcccaggaggaggtg

SEQ ID NO: 100475 - DNA, 31 bp, Artificial Sequence
  Description of Artificial Sequence: Synthetic oligonucleotide
aaaggaatttctccatgcccaggaggaggtg

SEQ ID NO: 100476 - DNA, 30 bp, Artificial Sequence
  Description of Artificial Sequence: Synthetic oligonucleotide
aaggaatttctccatgcccaggaggaggtg

SEQ ID NO: 100477 - DNA, 29 bp, Artificial Sequence
  Description of Artificial Sequence: Synthetic oligonucleotide
aggaatttctccatgcccaggaggaggtg

SEQ ID NO: 100478 - DNA, 28 bp, Artificial Sequence
  Description of Artificial Sequence: Synthetic oligonucleotide
ggaatttctccatgcccaggaggaggtg

SEQ ID NO: 100479 - DNA, 30 bp, Artificial Sequence
  Description of Artificial Sequence: Synthetic oligonucleotide
gaatttctccatgcccaggaggaggtgaag

SEQ ID NO: 100480 - DNA, 30 bp, Artificial Sequence
  Description of Artificial Sequence: Synthetic oligonucleotide
aatttctccatgcccaggaggaggtgaagc

SEQ ID NO: 100481 - DNA, 29 bp, Artificial Sequence
  Description of Artificial Sequence: Synthetic oligonucleotide
atttctccatgcccaggaggaggtgaagc

SEQ ID NO: 100482 - DNA, 28 bp, Artificial Sequence
  Description of Artificial Sequence: Synthetic oligonucleotide
tttctccatgcccaggaggaggtgaagc

SEQ ID NO: 100483 - DNA, 27 bp, Artificial Sequence
  Description of Artificial Sequence: Synthetic oligonucleotide
ttctccatgcccaggaggaggtgaagc

SEQ ID NO: 100484 - DNA, 26 bp, Artificial Sequence
  Description of Artificial Sequence: Synthetic oligonucleotide
tctccatgcccaggaggaggtgaagc

SEQ ID NO: 100485 - DNA, 25 bp, Artificial Sequence
  Description of Artificial Sequence: Synthetic oligonucleotide
ctccatgcccaggaggaggtgaagc

SEQ ID NO: 100486 - DNA, 27 bp, Artificial Sequence
  Description of Artificial Sequence: Synthetic oligonucleotide
tccatgcccaggaggaggtgaagcgaa

SEQ ID NO: 100487 - DNA, 27 bp, Artificial Sequence
  Description of Artificial Sequence: Synthetic oligonucleotide
ccatgcccaggaggaggtgaagcgaat

SEQ ID NO: 100488 - DNA, 27 bp, Artificial Sequence
  Description of Artificial Sequence: Synthetic oligonucleotide
catgcccaggaggaggtgaagcgaatc

SEQ ID NO: 100489 - DNA, 27 bp, Artificial Sequence
  Description of Artificial Sequence: Synthetic oligonucleotide
atgcccaggaggaggtgaagcgaatcc

SEQ ID NO: 100490 - DNA, 27 bp, Artificial Sequence
  Description of Artificial Sequence: Synthetic oligonucleotide
tgcccaggaggaggtgaagcgaatcca

SEQ ID NO: 100491 - DNA, 27 bp, Artificial Sequence
  Description of Artificial Sequence: Synthetic oligonucleotide
gcccaggaggaggtgaagcgaatccaa

SEQ ID NO: 100492 - DNA, 28 bp, Artificial Sequence
  Description of Artificial Sequence: Synthetic oligonucleotide
cccaggaggaggtgaagcgaatccaaag

SEQ ID NO: 100493 - DNA, 28 bp, Artificial Sequence
  Description of Artificial Sequence: Synthetic oligonucleotide
ccaggaggaggtgaagcgaatccaaagc

SEQ ID NO: 100494 - DNA, 30 bp, Artificial Sequence
  Description of Artificial Sequence: Synthetic oligonucleotide
caggaggaggtgaagcgaatccaaagcatc

SEQ ID NO: 100495 - DNA, 30 bp, Artificial Sequence
  Description of Artificial Sequence: Synthetic oligonucleotide
aggaggaggtgaagcgaatccaaagcatcc

SEQ ID NO: 100496 - DNA, 29 bp, Artificial Sequence
  Description of Artificial Sequence: Synthetic oligonucleotide
ggaggaggtgaagcgaatccaaagcatcc

SEQ ID NO: 100497 - DNA, 29 bp, Artificial Sequence
  Description of Artificial Sequence: Synthetic oligonucleotide
gaggaggtgaagcgaatccaaagcatccc

SEQ ID NO: 100498 - DNA, 29 bp, Artificial Sequence
  Description of Artificial Sequence: Synthetic oligonucleotide
aggaggtgaagcgaatccaaagcatcccg

SEQ ID NO: 100499 - DNA, 28 bp, Artificial Sequence
  Description of Artificial Sequence: Synthetic oligonucleotide
ggaggtgaagcgaatccaaagcatcccg

SEQ ID NO: 100500 - DNA, 28 bp, Artificial Sequence
  Description of Artificial Sequence: Synthetic oligonucleotide
gaggtgaagcgaatccaaagcatcccgc

SEQ ID NO: 100501 - DNA, 29 bp, Artificial Sequence
  Description of Artificial Sequence: Synthetic oligonucleotide
aggtgaagcgaatccaaagcatcccgctg

SEQ ID NO: 100502 - DNA, 28 bp, Artificial Sequence
  Description of Artificial Sequence: Synthetic oligonucleotide
ggtgaagcgaatccaaagcatcccgctg

SEQ ID NO: 100503 - DNA, 28 bp, Artificial Sequence
  Description of Artificial Sequence: Synthetic oligonucleotide
gtgaagcgaatccaaagcatcccgctgg

SEQ ID NO: 100504 - DNA, 29 bp, Artificial Sequence
  Description of Artificial Sequence: Synthetic oligonucleotide
tgaagcgaatccaaagcatcccgctggtc

SEQ ID NO: 100505 - DNA, 28 bp, Artificial Sequence
  Description of Artificial Sequence: Synthetic oligonucleotide
gaagcgaatccaaagcatcccgctggtc

SEQ ID NO: 100506 - DNA, 30 bp, Artificial Sequence
  Description of Artificial Sequence: Synthetic oligonucleotide
aagcgaatccaaagcatcccgctggtcatc

SEQ ID NO: 100507 - DNA, 29 bp, Artificial Sequence
  Description of Artificial Sequence: Synthetic oligonucleotide
agcgaatccaaagcatcccgctggtcatc

SEQ ID NO: 100508 - DNA, 28 bp, Artificial Sequence
  Description of Artificial Sequence: Synthetic oligonucleotide
gcgaatccaaagcatcccgctggtcatc

SEQ ID NO: 100509 - DNA, 28 bp, Artificial Sequence
  Description of Artificial Sequence: Synthetic oligonucleotide
cgaatccaaagcatcccgctggtcatcg

SEQ ID NO: 100510 - DNA, 28 bp, Artificial Sequence
  Description of Artificial Sequence: Synthetic oligonucleotide
gaatccaaagcatcccgctggtcatcgg

SEQ ID NO: 100511 - DNA, 29 bp, Artificial Sequence
  Description of Artificial Sequence: Synthetic oligonucleotide
aatccaaagcatcccgctggtcatcggac

SEQ ID NO: 100512 - DNA, 28 bp, Artificial Sequence
  Description of Artificial Sequence: Synthetic oligonucleotide
atccaaagcatcccgctggtcatcggac

SEQ ID NO: 100513 - DNA, 27 bp, Artificial Sequence
  Description of Artificial Sequence: Synthetic oligonucleotide
tccaaagcatcccgctggtcatcggac

SEQ ID NO: 100514 - DNA, 27 bp, Artificial Sequence
  Description of Artificial Sequence: Synthetic oligonucleotide
ccaaagcatcccgctggtcatcggaca

SEQ ID NO: 100515 - DNA, 31 bp, Artificial Sequence
  Description of Artificial Sequence: Synthetic oligonucleotide
caaagcatcccgctggtcatcggacaatttc

SEQ ID NO: 100516 - DNA, 32 bp, Artificial Sequence
  Description of Artificial Sequence: Synthetic oligonucleotide
aaagcatcccgctggtcatcggacaatttctg

SEQ ID NO: 100517 - DNA, 31 bp, Artificial Sequence
  Description of Artificial Sequence: Synthetic oligonucleotide
aagcatcccgctggtcatcggacaatttctg

SEQ ID NO: 100518 - DNA, 30 bp, Artificial Sequence
  Description of Artificial Sequence: Synthetic oligonucleotide
agcatcccgctggtcatcggacaatttctg

SEQ ID NO: 100519 - DNA, 29 bp, Artificial Sequence
  Description of Artificial Sequence: Synthetic oligonucleotide
gcatcccgctggtcatcggacaatttctg

SEQ ID NO: 100520 - DNA, 29 bp, Artificial Sequence
  Description of Artificial Sequence: Synthetic oligonucleotide
catcccgctggtcatcggacaatttctgg

SEQ ID NO: 100521 - DNA, 30 bp, Artificial Sequence
  Description of Artificial Sequence: Synthetic oligonucleotide
atcccgctggtcatcggacaatttctggag

SEQ ID NO: 100522 - DNA, 29 bp, Artificial Sequence
  Description of Artificial Sequence: Synthetic oligonucleotide
tcccgctggtcatcggacaatttctggag

SEQ ID NO: 100523 - DNA, 28 bp, Artificial Sequence
  Description of Artificial Sequence: Synthetic oligonucleotide
cccgctggtcatcggacaatttctggag

SEQ ID NO: 100524 - DNA, 28 bp, Artificial Sequence
  Description of Artificial Sequence: Synthetic oligonucleotide
ccgctggtcatcggacaatttctggagg

SEQ ID NO: 100525 - DNA, 28 bp, Artificial Sequence
  Description of Artificial Sequence: Synthetic oligonucleotide
cgctggtcatcggacaatttctggaggc

SEQ ID NO: 100526 - DNA, 29 bp, Artificial Sequence
  Description of Artificial Sequence: Synthetic oligonucleotide
gctggtcatcggacaatttctggaggctg

SEQ ID NO: 100527 - DNA, 30 bp, Artificial Sequence
  Description of Artificial Sequence: Synthetic oligonucleotide
ctggtcatcggacaatttctggaggctgtg

SEQ ID NO: 100528 - DNA, 30 bp, Artificial Sequence
  Description of Artificial Sequence: Synthetic oligonucleotide
tggtcatcggacaatttctggaggctgtgg

SEQ ID NO: 100529 - DNA, 29 bp, Artificial Sequence
  Description of Artificial Sequence: Synthetic oligonucleotide
ggtcatcggacaatttctggaggctgtgg

SEQ ID NO: 100530 - DNA, 31 bp, Artificial Sequence
  Description of Artificial Sequence: Synthetic oligonucleotide
gtcatcggacaatttctggaggctgtggatc

SEQ ID NO: 100531 - DNA, 32 bp, Artificial Sequence
  Description of Artificial Sequence: Synthetic oligonucleotide
tcatcggacaatttctggaggctgtggatcag

SEQ ID NO: 100532 - DNA, 31 bp, Artificial Sequence
  Description of Artificial Sequence: Synthetic oligonucleotide
catcggacaatttctggaggctgtggatcag

SEQ ID NO: 100533 - DNA, 35 bp, Artificial Sequence
  Description of Artificial Sequence: Synthetic oligonucleotide
atcggacaatttctggaggctgtggatcagaatac

SEQ ID NO: 100534 - DNA, 34 bp, Artificial Sequence
  Description of Artificial Sequence: Synthetic oligonucleotide
tcggacaatttctggaggctgtggatcagaatac

SEQ ID NO: 100535 - DNA, 33 bp, Artificial Sequence
  Description of Artificial Sequence: Synthetic oligonucleotide
cggacaatttctggaggctgtggatcagaatac

SEQ ID NO: 100536 - DNA, 34 bp, Artificial Sequence
  Description of Artificial Sequence: Synthetic oligonucleotide
ggacaatttctggaggctgtggatcagaatacag

SEQ ID NO: 100537 - DNA, 34 bp, Artificial Sequence
  Description of Artificial Sequence: Synthetic oligonucleotide
gacaatttctggaggctgtggatcagaatacagc

SEQ ID NO: 100538 - DNA, 34 bp, Artificial Sequence
  Description of Artificial Sequence: Synthetic oligonucleotide
acaatttctggaggctgtggatcagaatacagcc

SEQ ID NO: 100539 - DNA, 33 bp, Artificial Sequence
  Description of Artificial Sequence: Synthetic oligonucleotide
caatttctggaggctgtggatcagaatacagcc

SEQ ID NO: 100540 - DNA, 35 bp, Artificial Sequence
  Description of Artificial Sequence: Synthetic oligonucleotide
aatttctggaggctgtggatcagaatacagccatc

SEQ ID NO: 100541 - DNA, 34 bp, Artificial Sequence
  Description of Artificial Sequence: Synthetic oligonucleotide
atttctggaggctgtggatcagaatacagccatc

SEQ ID NO: 100542 - DNA, 33 bp, Artificial Sequence
  Description of Artificial Sequence: Synthetic oligonucleotide
tttctggaggctgtggatcagaatacagccatc

SEQ ID NO: 100543 - DNA, 32 bp, Artificial Sequence
  Description of Artificial Sequence: Synthetic oligonucleotide
ttctggaggctgtggatcagaatacagccatc

SEQ ID NO: 100544 - DNA, 31 bp, Artificial Sequence
  Description of Artificial Sequence: Synthetic oligonucleotide
tctggaggctgtggatcagaatacagccatc

SEQ ID NO: 100545 - DNA, 30 bp, Artificial Sequence
  Description of Artificial Sequence: Synthetic oligonucleotide
ctggaggctgtggatcagaatacagccatc

SEQ ID NO: 100546 - DNA, 30 bp, Artificial Sequence
  Description of Artificial Sequence: Synthetic oligonucleotide
tggaggctgtggatcagaatacagccatcg

SEQ ID NO: 100547 - DNA, 29 bp, Artificial Sequence
  Description of Artificial Sequence: Synthetic oligonucleotide
ggaggctgtggatcagaatacagccatcg

SEQ ID NO: 100548 - DNA, 30 bp, Artificial Sequence
  Description of Artificial Sequence: Synthetic oligonucleotide
gaggctgtggatcagaatacagccatcgtg

SEQ ID NO: 100549 - DNA, 30 bp, Artificial Sequence
  Description of Artificial Sequence: Synthetic oligonucleotide
aggctgtggatcagaatacagccatcgtgg

SEQ ID NO: 100550 - DNA, 29 bp, Artificial Sequence
  Description of Artificial Sequence: Synthetic oligonucleotide
ggctgtggatcagaatacagccatcgtgg

SEQ ID NO: 100551 - DNA, 29 bp, Artificial Sequence
  Description of Artificial Sequence: Synthetic oligonucleotide
gctgtggatcagaatacagccatcgtggg

SEQ ID NO: 100552 - DNA, 29 bp, Artificial Sequence
  Description of Artificial Sequence: Synthetic oligonucleotide
ctgtggatcagaatacagccatcgtgggc

SEQ ID NO: 100553 - DNA, 30 bp, Artificial Sequence
  Description of Artificial Sequence: Synthetic oligonucleotide
tgtggatcagaatacagccatcgtgggctc

SEQ ID NO: 100554 - DNA, 29 bp, Artificial Sequence
  Description of Artificial Sequence: Synthetic oligonucleotide
gtggatcagaatacagccatcgtgggctc

SEQ ID NO: 100555 - DNA, 31 bp, Artificial Sequence
  Description of Artificial Sequence: Synthetic oligonucleotide
tggatcagaatacagccatcgtgggctctac

SEQ ID NO: 100556 - DNA, 30 bp, Artificial Sequence
  Description of Artificial Sequence: Synthetic oligonucleotide
ggatcagaatacagccatcgtgggctctac

SEQ ID NO: 100557 - DNA, 30 bp, Artificial Sequence
  Description of Artificial Sequence: Synthetic oligonucleotide
gatcagaatacagccatcgtgggctctacc

SEQ ID NO: 100558 - DNA, 31 bp, Artificial Sequence
  Description of Artificial Sequence: Synthetic oligonucleotide
atcagaatacagccatcgtgggctctaccac

SEQ ID NO: 100559 - DNA, 30 bp, Artificial Sequence
  Description of Artificial Sequence: Synthetic oligonucleotide
tcagaatacagccatcgtgggctctaccac

SEQ ID NO: 100560 - DNA, 29 bp, Artificial Sequence
  Description of Artificial Sequence: Synthetic oligonucleotide
cagaatacagccatcgtgggctctaccac

SEQ ID NO: 100561 - DNA, 30 bp, Artificial Sequence
  Description of Artificial Sequence: Synthetic oligonucleotide
agaatacagccatcgtgggctctaccacag

SEQ ID NO: 100562 - DNA, 29 bp, Artificial Sequence
  Description of Artificial Sequence: Synthetic oligonucleotide
gaatacagccatcgtgggctctaccacag

SEQ ID NO: 100563 - DNA, 29 bp, Artificial Sequence
  Description of Artificial Sequence: Synthetic oligonucleotide
aatacagccatcgtgggctctaccacagg

SEQ ID NO: 100564 - DNA, 28 bp, Artificial Sequence
  Description of Artificial Sequence: Synthetic oligonucleotide
atacagccatcgtgggctctaccacagg

SEQ ID NO: 100565 - DNA, 27 bp, Artificial Sequence
  Description of Artificial Sequence: Synthetic oligonucleotide
tacagccatcgtgggctctaccacagg

SEQ ID NO: 100566 - DNA, 26 bp, Artificial Sequence
  Description of Artificial Sequence: Synthetic oligonucleotide
acagccatcgtgggctctaccacagg

SEQ ID NO: 100567 - DNA, 25 bp, Artificial Sequence
  Description of Artificial Sequence: Synthetic oligonucleotide
cagccatcgtgggctctaccacagg

SEQ ID NO: 100568 - DNA, 26 bp, Artificial Sequence
  Description of Artificial Sequence: Synthetic oligonucleotide
agccatcgtgggctctaccacaggct

SEQ ID NO: 100569 - DNA, 25 bp, Artificial Sequence
  Description of Artificial Sequence: Synthetic oligonucleotide
gccatcgtgggctctaccacaggct

SEQ ID NO: 100570 - DNA, 25 bp, Artificial Sequence
  Description of Artificial Sequence: Synthetic oligonucleotide
ccatcgtgggctctaccacaggctc

SEQ ID NO: 100571 - DNA, 27 bp, Artificial Sequence
  Description of Artificial Sequence: Synthetic oligonucleotide
catcgtgggctctaccacaggctccaa

SEQ ID NO: 100572 - DNA, 27 bp, Artificial Sequence
  Description of Artificial Sequence: Synthetic oligonucleotide
atcgtgggctctaccacaggctccaac

SEQ ID NO: 100573 - DNA, 27 bp, Artificial Sequence
  Description of Artificial Sequence: Synthetic oligonucleotide
tcgtgggctctaccacaggctccaact

SEQ ID NO: 100574 - DNA, 27 bp, Artificial Sequence
  Description of Artificial Sequence: Synthetic oligonucleotide
cgtgggctctaccacaggctccaacta

SEQ ID NO: 100575 - DNA, 31 bp, Artificial Sequence
  Description of Artificial Sequence: Synthetic oligonucleotide
gtgggctctaccacaggctccaactattatg

SEQ ID NO: 100576 - DNA, 32 bp, Artificial Sequence
  Description of Artificial Sequence: Synthetic oligonucleotide
tgggctctaccacaggctccaactattatgtg

SEQ ID NO: 100577 - DNA, 31 bp, Artificial Sequence
  Description of Artificial Sequence: Synthetic oligonucleotide
gggctctaccacaggctccaactattatgtg

SEQ ID NO: 100578 - DNA, 31 bp, Artificial Sequence
  Description of Artificial Sequence: Synthetic oligonucleotide
ggctctaccacaggctccaactattatgtgc

SEQ ID NO: 100579 - DNA, 31 bp, Artificial Sequence
  Description of Artificial Sequence: Synthetic oligonucleotide
gctctaccacaggctccaactattatgtgcg

SEQ ID NO: 100580 - DNA, 31 bp, Artificial Sequence
  Description of Artificial Sequence: Synthetic oligonucleotide
ctctaccacaggctccaactattatgtgcgc

SEQ ID NO: 100581 - DNA, 33 bp, Artificial Sequence
  Description of Artificial Sequence: Synthetic oligonucleotide
tctaccacaggctccaactattatgtgcgcatc

SEQ ID NO: 100582 - DNA, 32 bp, Artificial Sequence
  Description of Artificial Sequence: Synthetic oligonucleotide
ctaccacaggctccaactattatgtgcgcatc

SEQ ID NO: 100583 - DNA, 32 bp, Artificial Sequence
  Description of Artificial Sequence: Synthetic oligonucleotide
taccacaggctccaactattatgtgcgcatcc

SEQ ID NO: 100584 - DNA, 31 bp, Artificial Sequence
  Description of Artificial Sequence: Synthetic oligonucleotide
accacaggctccaactattatgtgcgcatcc

SEQ ID NO: 100585 - DNA, 30 bp, Artificial Sequence
  Description of Artificial Sequence: Synthetic oligonucleotide
ccacaggctccaactattatgtgcgcatcc

SEQ ID NO: 100586 - DNA, 31 bp, Artificial Sequence
  Description of Artificial Sequence: Synthetic oligonucleotide
cacaggctccaactattatgtgcgcatcctg

SEQ ID NO: 100587 - DNA, 32 bp, Artificial Sequence
  Description of Artificial Sequence: Synthetic oligonucleotide
acaggctccaactattatgtgcgcatcctgag

SEQ ID NO: 100588 - DNA, 31 bp, Artificial Sequence
  Description of Artificial Sequence: Synthetic oligonucleotide
caggctccaactattatgtgcgcatcctgag

SEQ ID NO: 100589 - DNA, 31 bp, Artificial Sequence
  Description of Artificial Sequence: Synthetic oligonucleotide
aggctccaactattatgtgcgcatcctgagc

SEQ ID NO: 100590 - DNA, 30 bp, Artificial Sequence
  Description of Artificial Sequence: Synthetic oligonucleotide
ggctccaactattatgtgcgcatcctgagc

SEQ ID NO: 100591 - DNA, 31 bp, Artificial Sequence
  Description of Artificial Sequence: Synthetic oligonucleotide
gctccaactattatgtgcgcatcctgagcac

SEQ ID NO: 100592 - DNA, 31 bp, Artificial Sequence
  Description of Artificial Sequence: Synthetic oligonucleotide
ctccaactattatgtgcgcatcctgagcacc

SEQ ID NO: 100593 - DNA, 33 bp, Artificial Sequence
  Description of Artificial Sequence: Synthetic oligonucleotide
tccaactattatgtgcgcatcctgagcaccatc

SEQ ID NO: 100594 - DNA, 32 bp, Artificial Sequence
  Description of Artificial Sequence: Synthetic oligonucleotide
ccaactattatgtgcgcatcctgagcaccatc

SEQ ID NO: 100595 - DNA, 32 bp, Artificial Sequence
  Description of Artificial Sequence: Synthetic oligonucleotide
caactattatgtgcgcatcctgagcaccatcg

SEQ ID NO: 100596 - DNA, 34 bp, Artificial Sequence
  Description of Artificial Sequence: Synthetic oligonucleotide
aactattatgtgcgcatcctgagcaccatcgatc

SEQ ID NO: 100597 - DNA, 33 bp, Artificial Sequence
  Description of Artificial Sequence: Synthetic oligonucleotide
actattatgtgcgcatcctgagcaccatcgatc

SEQ ID NO: 100598 - DNA, 32 bp, Artificial Sequence
  Description of Artificial Sequence: Synthetic oligonucleotide
ctattatgtgcgcatcctgagcaccatcgatc

SEQ ID NO: 100599 - DNA, 32 bp, Artificial Sequence
  Description of Artificial Sequence: Synthetic oligonucleotide
tattatgtgcgcatcctgagcaccatcgatcg

SEQ ID NO: 100600 - DNA, 31 bp, Artificial Sequence
  Description of Artificial Sequence: Synthetic oligonucleotide
attatgtgcgcatcctgagcaccatcgatcg

SEQ ID NO: 100601 - DNA, 30 bp, Artificial Sequence
  Description of Artificial Sequence: Synthetic oligonucleotide
ttatgtgcgcatcctgagcaccatcgatcg

SEQ ID NO: 100602 - DNA, 29 bp, Artificial Sequence
  Description of Artificial Sequence: Synthetic oligonucleotide
tatgtgcgcatcctgagcaccatcgatcg

SEQ ID NO: 100603 - DNA, 28 bp, Artificial Sequence
  Description of Artificial Sequence: Synthetic oligonucleotide
atgtgcgcatcctgagcaccatcgatcg

SEQ ID NO: 100604 - DNA, 27 bp, Artificial Sequence
  Description of Artificial Sequence: Synthetic oligonucleotide
tgtgcgcatcctgagcaccatcgatcg

SEQ ID NO: 100605 - DNA, 26 bp, Artificial Sequence
  Description of Artificial Sequence: Synthetic oligonucleotide
gtgcgcatcctgagcaccatcgatcg

SEQ ID NO: 100606 - DNA, 26 bp, Artificial Sequence
  Description of Artificial Sequence: Synthetic oligonucleotide
tgcgcatcctgagcaccatcgatcgg

SEQ ID NO: 100607 - DNA, 25 bp, Artificial Sequence
  Description of Artificial Sequence: Synthetic oligonucleotide
gcgcatcctgagcaccatcgatcgg

SEQ ID NO: 100608 - DNA, 26 bp, Artificial Sequence
  Description of Artificial Sequence: Synthetic oligonucleotide
cgcatcctgagcaccatcgatcggga

SEQ ID NO: 100609 - DNA, 26 bp, Artificial Sequence
  Description of Artificial Sequence: Synthetic oligonucleotide
gcatcctgagcaccatcgatcgggag

SEQ ID NO: 100610 - DNA, 27 bp, Artificial Sequence
  Description of Artificial Sequence: Synthetic oligonucleotide
catcctgagcaccatcgatcgggagct

SEQ ID NO: 100611 - DNA, 27 bp, Artificial Sequence
  Description of Artificial Sequence: Synthetic oligonucleotide
atcctgagcaccatcgatcgggagctg

SEQ ID NO: 100612 - DNA, 26 bp, Artificial Sequence
  Description of Artificial Sequence: Synthetic oligonucleotide
tcctgagcaccatcgatcgggagctg

SEQ ID NO: 100613 - DNA, 25 bp, Artificial Sequence
  Description of Artificial Sequence: Synthetic oligonucleotide
cctgagcaccatcgatcgggagctg

SEQ ID NO: 100614 - DNA, 26 bp, Artificial Sequence
  Description of Artificial Sequence: Synthetic oligonucleotide
ctgagcaccatcgatcgggagctgct

SEQ ID NO: 100615 - DNA, 27 bp, Artificial Sequence
  Description of Artificial Sequence: Synthetic oligonucleotide
tgagcaccatcgatcgggagctgctca

SEQ ID NO: 100616 - DNA, 27 bp, Artificial Sequence
  Description of Artificial Sequence: Synthetic oligonucleotide
gagcaccatcgatcgggagctgctcaa

SEQ ID NO: 100617 - DNA, 27 bp, Artificial Sequence
  Description of Artificial Sequence: Synthetic oligonucleotide
agcaccatcgatcgggagctgctcaag

SEQ ID NO: 100618 - DNA, 26 bp, Artificial Sequence
  Description of Artificial Sequence: Synthetic oligonucleotide
gcaccatcgatcgggagctgctcaag

SEQ ID NO: 100619 - DNA, 26 bp, Artificial Sequence
  Description of Artificial Sequence: Synthetic oligonucleotide
caccatcgatcgggagctgctcaagc

SEQ ID NO: 100620 - DNA, 26 bp, Artificial Sequence
  Description of Artificial Sequence: Synthetic oligonucleotide
accatcgatcgggagctgctcaagcc

SEQ ID NO: 100621 - DNA, 25 bp, Artificial Sequence
  Description of Artificial Sequence: Synthetic oligonucleotide
ccatcgatcgggagctgctcaagcc

SEQ ID NO: 100622 - DNA, 27 bp, Artificial Sequence
  Description of Artificial Sequence: Synthetic oligonucleotide
catcgatcgggagctgctcaagcccaa

SEQ ID NO: 100623 - DNA, 27 bp, Artificial Sequence
  Description of Artificial Sequence: Synthetic oligonucleotide
atcgatcgggagctgctcaagcccaac

SEQ ID NO: 100624 - DNA, 26 bp, Artificial Sequence
  Description of Artificial Sequence: Synthetic oligonucleotide
tcgatcgggagctgctcaagcccaac

SEQ ID NO: 100625 - DNA, 25 bp, Artificial Sequence
  Description of Artificial Sequence: Synthetic oligonucleotide
cgatcgggagctgctcaagcccaac

SEQ ID NO: 100626 - DNA, 25 bp, Artificial Sequence
  Description of Artificial Sequence: Synthetic oligonucleotide
gatcgggagctgctcaagcccaacg

SEQ ID NO: 100627 - DNA, 25 bp, Artificial Sequence
  Description of Artificial Sequence: Synthetic oligonucleotide
atcgggagctgctcaagcccaacgc

SEQ ID NO: 100628 - DNA, 24 bp, Artificial Sequence
  Description of Artificial Sequence: Synthetic oligonucleotide
tcgggagctgctcaagcccaacgc

SEQ ID NO: 100629 - DNA, 23 bp, Artificial Sequence
  Description of Artificial Sequence: Synthetic oligonucleotide
cgggagctgctcaagcccaacgc

SEQ ID NO: 100630 - DNA, 24 bp, Artificial Sequence
  Description of Artificial Sequence: Synthetic oligonucleotide
gggagctgctcaagcccaacgcct

SEQ ID NO: 100631 - DNA, 25 bp, Artificial Sequence
  Description of Artificial Sequence: Synthetic oligonucleotide
ggagctgctcaagcccaacgcctca

SEQ ID NO: 100632 - DNA, 26 bp, Artificial Sequence
  Description of Artificial Sequence: Synthetic oligonucleotide
gagctgctcaagcccaacgcctcagt

SEQ ID NO: 100633 - DNA, 26 bp, Artificial Sequence
  Description of Artificial Sequence: Synthetic oligonucleotide
agctgctcaagcccaacgcctcagtg

SEQ ID NO: 100634 - DNA, 25 bp, Artificial Sequence
  Description of Artificial Sequence: Synthetic oligonucleotide
gctgctcaagcccaacgcctcagtg

SEQ ID NO: 100635 - DNA, 25 bp, Artificial Sequence
  Description of Artificial Sequence: Synthetic oligonucleotide
ctgctcaagcccaacgcctcagtgg

SEQ ID NO: 100636 - DNA, 25 bp, Artificial Sequence
  Description of Artificial Sequence: Synthetic oligonucleotide
tgctcaagcccaacgcctcagtggc

SEQ ID NO: 100637 - DNA, 24 bp, Artificial Sequence
  Description of Artificial Sequence: Synthetic oligonucleotide
gctcaagcccaacgcctcagtggc

SEQ ID NO: 100638 - DNA, 24 bp, Artificial Sequence
  Description of Artificial Sequence: Synthetic oligonucleotide
ctcaagcccaacgcctcagtggcc

SEQ ID NO: 100639 - DNA, 25 bp, Artificial Sequence
  Description of Artificial Sequence: Synthetic oligonucleotide
tcaagcccaacgcctcagtggccct

SEQ ID NO: 100640 - DNA, 24 bp, Artificial Sequence
  Description of Artificial Sequence: Synthetic oligonucleotide
caagcccaacgcctcagtggccct

SEQ ID NO: 100641 - DNA, 24 bp, Artificial Sequence
  Description of Artificial Sequence: Synthetic oligonucleotide
aagcccaacgcctcagtggccctc

SEQ ID NO: 100642 - DNA, 23 bp, Artificial Sequence
  Description of Artificial Sequence: Synthetic oligonucleotide
agcccaacgcctcagtggccctc

SEQ ID NO: 100643 - DNA, 22 bp, Artificial Sequence
  Description of Artificial Sequence: Synthetic oligonucleotide
gcccaacgcctcagtggccctc

SEQ ID NO: 100644 - DNA, 23 bp, Artificial Sequence
  Description of Artificial Sequence: Synthetic oligonucleotide
cccaacgcctcagtggccctcca

SEQ ID NO: 100645 - DNA, 25 bp, Artificial Sequence
  Description of Artificial Sequence: Synthetic oligonucleotide
ccaacgcctcagtggccctccacaa

SEQ ID NO: 100646 - DNA, 25 bp, Artificial Sequence
  Description of Artificial Sequence: Synthetic oligonucleotide
caacgcctcagtggccctccacaag

SEQ ID NO: 100647 - DNA, 26 bp, Artificial Sequence
  Description of Artificial Sequence: Synthetic oligonucleotide
aacgcctcagtggccctccacaagca

SEQ ID NO: 100648 - DNA, 25 bp, Artificial Sequence
  Description of Artificial Sequence: Synthetic oligonucleotide
acgcctcagtggccctccacaagca

SEQ ID NO: 100649 - DNA, 24 bp, Artificial Sequence
  Description of Artificial Sequence: Synthetic oligonucleotide
cgcctcagtggccctccacaagca

SEQ ID NO: 100650 - DNA, 25 bp, Artificial Sequence
  Description of Artificial Sequence: Synthetic oligonucleotide
gcctcagtggccctccacaagcaca

SEQ ID NO: 100651 - DNA, 25 bp, Artificial Sequence
  Description of Artificial Sequence: Synthetic oligonucleotide
cctcagtggccctccacaagcacag

SEQ ID NO: 100652 - DNA, 27 bp, Artificial Sequence
  Description of Artificial Sequence: Synthetic oligonucleotide
ctcagtggccctccacaagcacagcaa

SEQ ID NO: 100653 - DNA, 28 bp, Artificial Sequence
  Description of Artificial Sequence: Synthetic oligonucleotide
tcagtggccctccacaagcacagcaatg

SEQ ID NO: 100654 - DNA, 27 bp, Artificial Sequence
  Description of Artificial Sequence: Synthetic oligonucleotide
cagtggccctccacaagcacagcaatg

SEQ ID NO: 100655 - DNA, 27 bp, Artificial Sequence
  Description of Artificial Sequence: Synthetic oligonucleotide
agtggccctccacaagcacagcaatgc

SEQ ID NO: 100656 - DNA, 27 bp, Artificial Sequence
  Description of Artificial Sequence: Synthetic oligonucleotide
gtggccctccacaagcacagcaatgca

SEQ ID NO: 100657 - DNA, 27 bp, Artificial Sequence
  Description of Artificial Sequence: Synthetic oligonucleotide
tggccctccacaagcacagcaatgcac

SEQ ID NO: 100658 - DNA, 27 bp, Artificial Sequence
  Description of Artificial Sequence: Synthetic oligonucleotide
ggccctccacaagcacagcaatgcact

SEQ ID NO: 100659 - DNA, 27 bp, Artificial Sequence
  Description of Artificial Sequence: Synthetic oligonucleotide
gccctccacaagcacagcaatgcactg

SEQ ID NO: 100660 - DNA, 27 bp, Artificial Sequence
  Description of Artificial Sequence: Synthetic oligonucleotide
ccctccacaagcacagcaatgcactgg

SEQ ID NO: 100661 - DNA, 28 bp, Artificial Sequence
  Description of Artificial Sequence: Synthetic oligonucleotide
cctccacaagcacagcaatgcactggtg

SEQ ID NO: 100662 - DNA, 28 bp, Artificial Sequence
  Description of Artificial Sequence: Synthetic oligonucleotide
ctccacaagcacagcaatgcactggtgg

SEQ ID NO: 100663 - DNA, 29 bp, Artificial Sequence
  Description of Artificial Sequence: Synthetic oligonucleotide
tccacaagcacagcaatgcactggtggac

SEQ ID NO: 100664 - DNA, 28 bp, Artificial Sequence
  Description of Artificial Sequence: Synthetic oligonucleotide
ccacaagcacagcaatgcactggtggac

SEQ ID NO: 100665 - DNA, 28 bp, Artificial Sequence
  Description of Artificial Sequence: Synthetic oligonucleotide
cacaagcacagcaatgcactggtggacg

SEQ ID NO: 100666 - DNA, 29 bp, Artificial Sequence
  Description of Artificial Sequence: Synthetic oligonucleotide
acaagcacagcaatgcactggtggacgtg

SEQ ID NO: 100667 - DNA, 28 bp, Artificial Sequence
  Description of Artificial Sequence: Synthetic oligonucleotide
caagcacagcaatgcactggtggacgtg

SEQ ID NO: 100668 - DNA, 28 bp, Artificial Sequence
  Description of Artificial Sequence: Synthetic oligonucleotide
aagcacagcaatgcactggtggacgtgc

SEQ ID NO: 100669 - DNA, 27 bp, Artificial Sequence
  Description of Artificial Sequence: Synthetic oligonucleotide
agcacagcaatgcactggtggacgtgc

SEQ ID NO: 100670 - DNA, 27 bp, Artificial Sequence
  Description of Artificial Sequence: Synthetic oligonucleotide
gcacagcaatgcactggtggacgtgct

SEQ ID NO: 100671 - DNA, 27 bp, Artificial Sequence
  Description of Artificial Sequence: Synthetic oligonucleotide
cacagcaatgcactggtggacgtgctg

SEQ ID NO: 100672 - DNA, 27 bp, Artificial Sequence
  Description of Artificial Sequence: Synthetic oligonucleotide
acagcaatgcactggtggacgtgctgc

SEQ ID NO: 100673 - DNA, 26 bp, Artificial Sequence
  Description of Artificial Sequence: Synthetic oligonucleotide
cagcaatgcactggtggacgtgctgc

SEQ ID NO: 100674 - DNA, 26 bp, Artificial Sequence
  Description of Artificial Sequence: Synthetic oligonucleotide
agcaatgcactggtggacgtgctgcc

SEQ ID NO: 100675 - DNA, 25 bp, Artificial Sequence
  Description of Artificial Sequence: Synthetic oligonucleotide
gcaatgcactggtggacgtgctgcc

SEQ ID NO: 100676 - DNA, 25 bp, Artificial Sequence
  Description of Artificial Sequence: Synthetic oligonucleotide
caatgcactggtggacgtgctgccc

SEQ ID NO: 100677 - DNA, 25 bp, Artificial Sequence
  Description of Artificial Sequence: Synthetic oligonucleotide
aatgcactggtggacgtgctgcccc

SEQ ID NO: 100678 - DNA, 24 bp, Artificial Sequence
  Description of Artificial Sequence: Synthetic oligonucleotide
atgcactggtggacgtgctgcccc

SEQ ID NO: 100679 - DNA, 23 bp, Artificial Sequence
  Description of Artificial Sequence: Synthetic oligonucleotide
tgcactggtggacgtgctgcccc

SEQ ID NO: 100680 - DNA, 22 bp, Artificial Sequence
  Description of Artificial Sequence: Synthetic oligonucleotide
gcactggtggacgtgctgcccc

SEQ ID NO: 100681 - DNA, 22 bp, Artificial Sequence
  Description of Artificial Sequence: Synthetic oligonucleotide
cactggtggacgtgctgccccc

SEQ ID NO: 100682 - DNA, 22 bp, Artificial Sequence
  Description of Artificial Sequence: Synthetic oligonucleotide
actggtggacgtgctgcccccc

SEQ ID NO: 100683 - DNA, 21 bp, Artificial Sequence
  Description of Artificial Sequence: Synthetic oligonucleotide
ctggtggacgtgctgcccccc

SEQ ID NO: 100684 - DNA, 23 bp, Artificial Sequence
  Description of Artificial Sequence: Synthetic oligonucleotide
tggtggacgtgctgccccccgaa

SEQ ID NO: 100685 - DNA, 22 bp, Artificial Sequence
  Description of Artificial Sequence: Synthetic oligonucleotide
ggtggacgtgctgccccccgaa

SEQ ID NO: 100686 - DNA, 22 bp, Artificial Sequence
  Description of Artificial Sequence: Synthetic oligonucleotide
gtggacgtgctgccccccgaag

SEQ ID NO: 100687 - DNA, 22 bp, Artificial Sequence
  Description of Artificial Sequence: Synthetic oligonucleotide
tggacgtgctgccccccgaagc

SEQ ID NO: 100688 - DNA, 21 bp, Artificial Sequence
  Description of Artificial Sequence: Synthetic oligonucleotide
ggacgtgctgccccccgaagc

SEQ ID NO: 100689 - DNA, 21 bp, Artificial Sequence
  Description of Artificial Sequence: Synthetic oligonucleotide
gacgtgctgccccccgaagcc

SEQ ID NO: 100690 - DNA, 22 bp, Artificial Sequence
  Description of Artificial Sequence: Synthetic oligonucleotide
acgtgctgccccccgaagccga

SEQ ID NO: 100691 - DNA, 21 bp, Artificial Sequence
  Description of Artificial Sequence: Synthetic oligonucleotide
cgtgctgccccccgaagccga

SEQ ID NO: 100692 - DNA, 22 bp, Artificial Sequence
  Description of Artificial Sequence: Synthetic oligonucleotide
gtgctgccccccgaagccgaca

SEQ ID NO: 100693 - DNA, 22 bp, Artificial Sequence
  Description of Artificial Sequence: Synthetic oligonucleotide
tgctgccccccgaagccgacag

SEQ ID NO: 100694 - DNA, 21 bp, Artificial Sequence
  Description of Artificial Sequence: Synthetic oligonucleotide
gctgccccccgaagccgacag

SEQ ID NO: 100695 - DNA, 22 bp, Artificial Sequence
  Description of Artificial Sequence: Synthetic oligonucleotide
ctgccccccgaagccgacagca

SEQ ID NO: 100696 - DNA, 22 bp, Artificial Sequence
  Description of Artificial Sequence: Synthetic oligonucleotide
tgccccccgaagccgacagcag

SEQ ID NO: 100697 - DNA, 21 bp, Artificial Sequence
  Description of Artificial Sequence: Synthetic oligonucleotide
gccccccgaagccgacagcag

SEQ ID NO: 100698 - DNA, 23 bp, Artificial Sequence
  Description of Artificial Sequence: Synthetic oligonucleotide
ccccccgaagccgacagcagcat

SEQ ID NO: 100699 - DNA, 25 bp, Artificial Sequence
  Description of Artificial Sequence: Synthetic oligonucleotide
cccccgaagccgacagcagcatcat

SEQ ID NO: 100700 - DNA, 27 bp, Artificial Sequence
  Description of Artificial Sequence: Synthetic oligonucleotide
ccccgaagccgacagcagcatcatgat

SEQ ID NO: 100701 - DNA, 27 bp, Artificial Sequence
  Description of Artificial Sequence: Synthetic oligonucleotide
cccgaagccgacagcagcatcatgatg

SEQ ID NO: 100702 - DNA, 27 bp, Artificial Sequence
  Description of Artificial Sequence: Synthetic oligonucleotide
ccgaagccgacagcagcatcatgatgc

SEQ ID NO: 100703 - DNA, 28 bp, Artificial Sequence
  Description of Artificial Sequence: Synthetic oligonucleotide
cgaagccgacagcagcatcatgatgctc

SEQ ID NO: 100704 - DNA, 29 bp, Artificial Sequence
  Description of Artificial Sequence: Synthetic oligonucleotide
gaagccgacagcagcatcatgatgctcac

SEQ ID NO: 100705 - DNA, 29 bp, Artificial Sequence
  Description of Artificial Sequence: Synthetic oligonucleotide
aagccgacagcagcatcatgatgctcacc

SEQ ID NO: 100706 - DNA, 28 bp, Artificial Sequence
  Description of Artificial Sequence: Synthetic oligonucleotide
agccgacagcagcatcatgatgctcacc

SEQ ID NO: 100707 - DNA, 27 bp, Artificial Sequence
  Description of Artificial Sequence: Synthetic oligonucleotide
gccgacagcagcatcatgatgctcacc

SEQ ID NO: 100708 - DNA, 28 bp, Artificial Sequence
  Description of Artificial Sequence: Synthetic oligonucleotide
ccgacagcagcatcatgatgctcacctc

SEQ ID NO: 100709 - DNA, 29 bp, Artificial Sequence
  Description of Artificial Sequence: Synthetic oligonucleotide
cgacagcagcatcatgatgctcacctcag

SEQ ID NO: 100710 - DNA, 30 bp, Artificial Sequence
  Description of Artificial Sequence: Synthetic oligonucleotide
gacagcagcatcatgatgctcacctcagac

SEQ ID NO: 100711 - DNA, 30 bp, Artificial Sequence
  Description of Artificial Sequence: Synthetic oligonucleotide
acagcagcatcatgatgctcacctcagacc

SEQ ID NO: 100712 - DNA, 29 bp, Artificial Sequence
  Description of Artificial Sequence: Synthetic oligonucleotide
cagcagcatcatgatgctcacctcagacc

SEQ ID NO: 100713 - DNA, 30 bp, Artificial Sequence
  Description of Artificial Sequence: Synthetic oligonucleotide
agcagcatcatgatgctcacctcagaccag

SEQ ID NO: 100714 - DNA, 29 bp, Artificial Sequence
  Description of Artificial Sequence: Synthetic oligonucleotide
gcagcatcatgatgctcacctcagaccag

SEQ ID NO: 100715 - DNA, 31 bp, Artificial Sequence
  Description of Artificial Sequence: Synthetic oligonucleotide
cagcatcatgatgctcacctcagaccagaag

SEQ ID NO: 100716 - DNA, 31 bp, Artificial Sequence
  Description of Artificial Sequence: Synthetic oligonucleotide
agcatcatgatgctcacctcagaccagaagc

SEQ ID NO: 100717 - DNA, 30 bp, Artificial Sequence
  Description of Artificial Sequence: Synthetic oligonucleotide
gcatcatgatgctcacctcagaccagaagc

SEQ ID NO: 100718 - DNA, 30 bp, Artificial Sequence
  Description of Artificial Sequence: Synthetic oligonucleotide
catcatgatgctcacctcagaccagaagcc

SEQ ID NO: 100719 - DNA, 31 bp, Artificial Sequence
  Description of Artificial Sequence: Synthetic oligonucleotide
atcatgatgctcacctcagaccagaagccag

SEQ ID NO: 100720 - DNA, 30 bp, Artificial Sequence
  Description of Artificial Sequence: Synthetic oligonucleotide
tcatgatgctcacctcagaccagaagccag

SEQ ID NO: 100721 - DNA, 29 bp, Artificial Sequence
  Description of Artificial Sequence: Synthetic oligonucleotide
catgatgctcacctcagaccagaagccag

SEQ ID NO: 100722 - DNA, 31 bp, Artificial Sequence
  Description of Artificial Sequence: Synthetic oligonucleotide
atgatgctcacctcagaccagaagccagatg

SEQ ID NO: 100723 - DNA, 30 bp, Artificial Sequence
  Description of Artificial Sequence: Synthetic oligonucleotide
tgatgctcacctcagaccagaagccagatg

SEQ ID NO: 100724 - DNA, 29 bp, Artificial Sequence
  Description of Artificial Sequence: Synthetic oligonucleotide
gatgctcacctcagaccagaagccagatg

SEQ ID NO: 100725 - DNA, 30 bp, Artificial Sequence
  Description of Artificial Sequence: Synthetic oligonucleotide
atgctcacctcagaccagaagccagatgtg

SEQ ID NO: 100726 - DNA, 29 bp, Artificial Sequence
  Description of Artificial Sequence: Synthetic oligonucleotide
tgctcacctcagaccagaagccagatgtg

SEQ ID NO: 100727 - DNA, 28 bp, Artificial Sequence
  Description of Artificial Sequence: Synthetic oligonucleotide
gctcacctcagaccagaagccagatgtg

SEQ ID NO: 100728 - DNA, 30 bp, Artificial Sequence
  Description of Artificial Sequence: Synthetic oligonucleotide
ctcacctcagaccagaagccagatgtgatg

SEQ ID NO: 100729 - DNA, 32 bp, Artificial Sequence
  Description of Artificial Sequence: Synthetic oligonucleotide
tcacctcagaccagaagccagatgtgatgtac

SEQ ID NO: 100730 - DNA, 31 bp, Artificial Sequence
  Description of Artificial Sequence: Synthetic oligonucleotide
cacctcagaccagaagccagatgtgatgtac

SEQ ID NO: 100731 - DNA, 31 bp, Artificial Sequence
  Description of Artificial Sequence: Synthetic oligonucleotide
acctcagaccagaagccagatgtgatgtacg

SEQ ID NO: 100732 - DNA, 30 bp, Artificial Sequence
  Description of Artificial Sequence: Synthetic oligonucleotide
cctcagaccagaagccagatgtgatgtacg

SEQ ID NO: 100733 - DNA, 30 bp, Artificial Sequence
  Description of Artificial Sequence: Synthetic oligonucleotide
ctcagaccagaagccagatgtgatgtacgc

SEQ ID NO: 100734 - DNA, 30 bp, Artificial Sequence
  Description of Artificial Sequence: Synthetic oligonucleotide
tcagaccagaagccagatgtgatgtacgcg

SEQ ID NO: 100735 - DNA, 29 bp, Artificial Sequence
  Description of Artificial Sequence: Synthetic oligonucleotide
cagaccagaagccagatgtgatgtacgcg

SEQ ID NO: 100736 - DNA, 29 bp, Artificial Sequence
  Description of Artificial Sequence: Synthetic oligonucleotide
agaccagaagccagatgtgatgtacgcgg

SEQ ID NO: 100737 - DNA, 28 bp, Artificial Sequence
  Description of Artificial Sequence: Synthetic oligonucleotide
gaccagaagccagatgtgatgtacgcgg

SEQ ID NO: 100738 - DNA, 29 bp, Artificial Sequence
  Description of Artificial Sequence: Synthetic oligonucleotide
accagaagccagatgtgatgtacgcggac

SEQ ID NO: 100739 - DNA, 28 bp, Artificial Sequence
  Description of Artificial Sequence: Synthetic oligonucleotide
ccagaagccagatgtgatgtacgcggac

SEQ ID NO: 100740 - DNA, 30 bp, Artificial Sequence
  Description of Artificial Sequence: Synthetic oligonucleotide
cagaagccagatgtgatgtacgcggacatc

SEQ ID NO: 100741 - DNA, 30 bp, Artificial Sequence
  Description of Artificial Sequence: Synthetic oligonucleotide
agaagccagatgtgatgtacgcggacatcg

SEQ ID NO: 100742 - DNA, 29 bp, Artificial Sequence
  Description of Artificial Sequence: Synthetic oligonucleotide
gaagccagatgtgatgtacgcggacatcg

SEQ ID NO: 100743 - DNA, 29 bp, Artificial Sequence
  Description of Artificial Sequence: Synthetic oligonucleotide
aagccagatgtgatgtacgcggacatcgg

SEQ ID NO: 100744 - DNA, 28 bp, Artificial Sequence
  Description of Artificial Sequence: Synthetic oligonucleotide
agccagatgtgatgtacgcggacatcgg

SEQ ID NO: 100745 - DNA, 27 bp, Artificial Sequence
  Description of Artificial Sequence: Synthetic oligonucleotide
gccagatgtgatgtacgcggacatcgg

SEQ ID NO: 100746 - DNA, 28 bp, Artificial Sequence
  Description of Artificial Sequence: Synthetic oligonucleotide
ccagatgtgatgtacgcggacatcggag

SEQ ID NO: 100747 - DNA, 28 bp, Artificial Sequence
  Description of Artificial Sequence: Synthetic oligonucleotide
cagatgtgatgtacgcggacatcggagg

SEQ ID NO: 100748 - DNA, 28 bp, Artificial Sequence
  Description of Artificial Sequence: Synthetic oligonucleotide
agatgtgatgtacgcggacatcggaggc

SEQ ID NO: 100749 - DNA, 27 bp, Artificial Sequence
  Description of Artificial Sequence: Synthetic oligonucleotide
gatgtgatgtacgcggacatcggaggc

SEQ ID NO: 100750 - DNA, 29 bp, Artificial Sequence
  Description of Artificial Sequence: Synthetic oligonucleotide
atgtgatgtacgcggacatcggaggcatg

SEQ ID NO: 100751 - DNA, 28 bp, Artificial Sequence
  Description of Artificial Sequence: Synthetic oligonucleotide
tgtgatgtacgcggacatcggaggcatg

SEQ ID NO: 100752 - DNA, 27 bp, Artificial Sequence
  Description of Artificial Sequence: Synthetic oligonucleotide
gtgatgtacgcggacatcggaggcatg

SEQ ID NO: 100753 - DNA, 27 bp, Artificial Sequence
  Description of Artificial Sequence: Synthetic oligonucleotide
tgatgtacgcggacatcggaggcatgg

SEQ ID NO: 100754 - DNA, 27 bp, Artificial Sequence
  Description of Artificial Sequence: Synthetic oligonucleotide
gatgtacgcggacatcggaggcatgga

SEQ ID NO: 100755 - DNA, 27 bp, Artificial Sequence
  Description of Artificial Sequence: Synthetic oligonucleotide
atgtacgcggacatcggaggcatggac

SEQ ID NO: 100756 - DNA, 27 bp, Artificial Sequence
  Description of Artificial Sequence: Synthetic oligonucleotide
tgtacgcggacatcggaggcatggaca

SEQ ID NO: 100757 - DNA, 27 bp, Artificial Sequence
  Description of Artificial Sequence: Synthetic oligonucleotide
gtacgcggacatcggaggcatggacat

SEQ ID NO: 100758 - DNA, 27 bp, Artificial Sequence
  Description of Artificial Sequence: Synthetic oligonucleotide
tacgcggacatcggaggcatggacatc

SEQ ID NO: 100759 - DNA, 26 bp, Artificial Sequence
  Description of Artificial Sequence: Synthetic oligonucleotide
acgcggacatcggaggcatggacatc

SEQ ID NO: 100760 - DNA, 25 bp, Artificial Sequence
  Description of Artificial Sequence: Synthetic oligonucleotide
cgcggacatcggaggcatggacatc

SEQ ID NO: 100761 - DNA, 26 bp, Artificial Sequence
  Description of Artificial Sequence: Synthetic oligonucleotide
gcggacatcggaggcatggacatcca

SEQ ID NO: 100762 - DNA, 27 bp, Artificial Sequence
  Description of Artificial Sequence: Synthetic oligonucleotide
cggacatcggaggcatggacatccaga

SEQ ID NO: 100763 - DNA, 28 bp, Artificial Sequence
  Description of Artificial Sequence: Synthetic oligonucleotide
ggacatcggaggcatggacatccagaag

SEQ ID NO: 100764 - DNA, 28 bp, Artificial Sequence
  Description of Artificial Sequence: Synthetic oligonucleotide
gacatcggaggcatggacatccagaagc

SEQ ID NO: 100765 - DNA, 29 bp, Artificial Sequence
  Description of Artificial Sequence: Synthetic oligonucleotide
acatcggaggcatggacatccagaagcag

SEQ ID NO: 100766 - DNA, 28 bp, Artificial Sequence
  Description of Artificial Sequence: Synthetic oligonucleotide
catcggaggcatggacatccagaagcag

SEQ ID NO: 100767 - DNA, 28 bp, Artificial Sequence
  Description of Artificial Sequence: Synthetic oligonucleotide
atcggaggcatggacatccagaagcagg

SEQ ID NO: 100768 - DNA, 27 bp, Artificial Sequence
  Description of Artificial Sequence: Synthetic oligonucleotide
tcggaggcatggacatccagaagcagg

SEQ ID NO: 100769 - DNA, 27 bp, Artificial Sequence
  Description of Artificial Sequence: Synthetic oligonucleotide
cggaggcatggacatccagaagcagga

SEQ ID NO: 100770 - DNA, 27 bp, Artificial Sequence
  Description of Artificial Sequence: Synthetic oligonucleotide
ggaggcatggacatccagaagcaggag

SEQ ID NO: 100771 - DNA, 27 bp, Artificial Sequence
  Description of Artificial Sequence: Synthetic oligonucleotide
gaggcatggacatccagaagcaggagg

SEQ ID NO: 100772 - DNA, 28 bp, Artificial Sequence
  Description of Artificial Sequence: Synthetic oligonucleotide
aggcatggacatccagaagcaggaggtg

SEQ ID NO: 100773 - DNA, 27 bp, Artificial Sequence
  Description of Artificial Sequence: Synthetic oligonucleotide
ggcatggacatccagaagcaggaggtg

SEQ ID NO: 100774 - DNA, 27 bp, Artificial Sequence
  Description of Artificial Sequence: Synthetic oligonucleotide
gcatggacatccagaagcaggaggtgc

SEQ ID NO: 100775 - DNA, 27 bp, Artificial Sequence
  Description of Artificial Sequence: Synthetic oligonucleotide
catggacatccagaagcaggaggtgcg

SEQ ID NO: 100776 - DNA, 27 bp, Artificial Sequence
  Description of Artificial Sequence: Synthetic oligonucleotide
atggacatccagaagcaggaggtgcgg

SEQ ID NO: 100777 - DNA, 26 bp, Artificial Sequence
  Description of Artificial Sequence: Synthetic oligonucleotide
tggacatccagaagcaggaggtgcgg

SEQ ID NO: 100778 - DNA, 25 bp, Artificial Sequence
  Description of Artificial Sequence: Synthetic oligonucleotide
ggacatccagaagcaggaggtgcgg

SEQ ID NO: 100779 - DNA, 26 bp, Artificial Sequence
  Description of Artificial Sequence: Synthetic oligonucleotide
gacatccagaagcaggaggtgcggga

SEQ ID NO: 100780 - DNA, 26 bp, Artificial Sequence
  Description of Artificial Sequence: Synthetic oligonucleotide
acatccagaagcaggaggtgcgggag

SEQ ID NO: 100781 - DNA, 25 bp, Artificial Sequence
  Description of Artificial Sequence: Synthetic oligonucleotide
catccagaagcaggaggtgcgggag

SEQ ID NO: 100782 - DNA, 25 bp, Artificial Sequence
  Description of Artificial Sequence: Synthetic oligonucleotide
atccagaagcaggaggtgcgggagg

SEQ ID NO: 100783 - DNA, 24 bp, Artificial Sequence
  Description of Artificial Sequence: Synthetic oligonucleotide
tccagaagcaggaggtgcgggagg

SEQ ID NO: 100784 - DNA, 23 bp, Artificial Sequence
  Description of Artificial Sequence: Synthetic oligonucleotide
ccagaagcaggaggtgcgggagg

SEQ ID NO: 100785 - DNA, 23 bp, Artificial Sequence
  Description of Artificial Sequence: Synthetic oligonucleotide
cagaagcaggaggtgcgggaggc

SEQ ID NO: 100786 - DNA, 23 bp, Artificial Sequence
  Description of Artificial Sequence: Synthetic oligonucleotide
agaagcaggaggtgcgggaggcc

SEQ ID NO: 100787 - DNA, 22 bp, Artificial Sequence
  Description of Artificial Sequence: Synthetic oligonucleotide
gaagcaggaggtgcgggaggcc

SEQ ID NO: 100788 - DNA, 23 bp, Artificial Sequence
  Description of Artificial Sequence: Synthetic oligonucleotide
aagcaggaggtgcgggaggccgt

SEQ ID NO: 100789 - DNA, 22 bp, Artificial Sequence
  Description of Artificial Sequence: Synthetic oligonucleotide
agcaggaggtgcgggaggccgt

SEQ ID NO: 100790 - DNA, 21 bp, Artificial Sequence
  Description of Artificial Sequence: Synthetic oligonucleotide
gcaggaggtgcgggaggccgt

SEQ ID NO: 100791 - DNA, 21 bp, Artificial Sequence
  Description of Artificial Sequence: Synthetic oligonucleotide
caggaggtgcgggaggccgtg

SEQ ID NO: 100792 - DNA, 22 bp, Artificial Sequence
  Description of Artificial Sequence: Synthetic oligonucleotide
aggaggtgcgggaggccgtgga

SEQ ID NO: 100793 - DNA, 21 bp, Artificial Sequence
  Description of Artificial Sequence: Synthetic oligonucleotide
ggaggtgcgggaggccgtgga

SEQ ID NO: 100794 - DNA, 21 bp, Artificial Sequence
  Description of Artificial Sequence: Synthetic oligonucleotide
gaggtgcgggaggccgtggag

SEQ ID NO: 100795 - DNA, 22 bp, Artificial Sequence
  Description of Artificial Sequence: Synthetic oligonucleotide
aggtgcgggaggccgtggagct

SEQ ID NO: 100796 - DNA, 21 bp, Artificial Sequence
  Description of Artificial Sequence: Synthetic oligonucleotide
ggtgcgggaggccgtggagct

SEQ ID NO: 100797 - DNA, 21 bp, Artificial Sequence
  Description of Artificial Sequence: Synthetic oligonucleotide
gtgcgggaggccgtggagctc

SEQ ID NO: 100798 - DNA, 21 bp, Artificial Sequence
  Description of Artificial Sequence: Synthetic oligonucleotide
tgcgggaggccgtggagctcc

SEQ ID NO: 100799 - DNA, 20 bp, Artificial Sequence
  Description of Artificial Sequence: Synthetic oligonucleotide
gcgggaggccgtggagctcc

SEQ ID NO: 100800 - DNA, 20 bp, Artificial Sequence
  Description of Artificial Sequence: Synthetic oligonucleotide
cgggaggccgtggagctccc

SEQ ID NO: 100801 - DNA, 20 bp, Artificial Sequence
  Description of Artificial Sequence: Synthetic oligonucleotide
gggaggccgtggagctcccg

SEQ ID NO: 100802 - DNA, 21 bp, Artificial Sequence
  Description of Artificial Sequence: Synthetic oligonucleotide
ggaggccgtggagctcccgct

SEQ ID NO: 100803 - DNA, 22 bp, Artificial Sequence
  Description of Artificial Sequence: Synthetic oligonucleotide
gaggccgtggagctcccgctca

SEQ ID NO: 100804 - DNA, 22 bp, Artificial Sequence
  Description of Artificial Sequence: Synthetic oligonucleotide
aggccgtggagctcccgctcac

SEQ ID NO: 100805 - DNA, 21 bp, Artificial Sequence
  Description of Artificial Sequence: Synthetic oligonucleotide
ggccgtggagctcccgctcac

SEQ ID NO: 100806 - DNA, 21 bp, Artificial Sequence
  Description of Artificial Sequence: Synthetic oligonucleotide
gccgtggagctcccgctcacg

SEQ ID NO: 100807 - DNA, 25 bp, Artificial Sequence
  Description of Artificial Sequence: Synthetic oligonucleotide
ccgtggagctcccgctcacgcattt

SEQ ID NO: 100808 - DNA, 25 bp, Artificial Sequence
  Description of Artificial Sequence: Synthetic oligonucleotide
cgtggagctcccgctcacgcatttc

SEQ ID NO: 100809 - DNA, 26 bp, Artificial Sequence
  Description of Artificial Sequence: Synthetic oligonucleotide
gtggagctcccgctcacgcatttcga

SEQ ID NO: 100810 - DNA, 26 bp, Artificial Sequence
  Description of Artificial Sequence: Synthetic oligonucleotide
tggagctcccgctcacgcatttcgag

SEQ ID NO: 100811 - DNA, 25 bp, Artificial Sequence
  Description of Artificial Sequence: Synthetic oligonucleotide
ggagctcccgctcacgcatttcgag

SEQ ID NO: 100812 - DNA, 26 bp, Artificial Sequence
  Description of Artificial Sequence: Synthetic oligonucleotide
gagctcccgctcacgcatttcgagct

SEQ ID NO: 100813 - DNA, 27 bp, Artificial Sequence
  Description of Artificial Sequence: Synthetic oligonucleotide
agctcccgctcacgcatttcgagctct

SEQ ID NO: 100814 - DNA, 27 bp, Artificial Sequence
  Description of Artificial Sequence: Synthetic oligonucleotide
gctcccgctcacgcatttcgagctcta

SEQ ID NO: 100815 - DNA, 27 bp, Artificial Sequence
  Description of Artificial Sequence: Synthetic oligonucleotide
ctcccgctcacgcatttcgagctctac

SEQ ID NO: 100816 - DNA, 29 bp, Artificial Sequence
  Description of Artificial Sequence: Synthetic oligonucleotide
tcccgctcacgcatttcgagctctacaag

SEQ ID NO: 100817 - DNA, 28 bp, Artificial Sequence
  Description of Artificial Sequence: Synthetic oligonucleotide
cccgctcacgcatttcgagctctacaag

SEQ ID NO: 100818 - DNA, 28 bp, Artificial Sequence
  Description of Artificial Sequence: Synthetic oligonucleotide
ccgctcacgcatttcgagctctacaagc

SEQ ID NO: 100819 - DNA, 29 bp, Artificial Sequence
  Description of Artificial Sequence: Synthetic oligonucleotide
cgctcacgcatttcgagctctacaagcag

SEQ ID NO: 100820 - DNA, 31 bp, Artificial Sequence
  Description of Artificial Sequence: Synthetic oligonucleotide
gctcacgcatttcgagctctacaagcagatc

SEQ ID NO: 100821 - DNA, 31 bp, Artificial Sequence
  Description of Artificial Sequence: Synthetic oligonucleotide
ctcacgcatttcgagctctacaagcagatcg

SEQ ID NO: 100822 - DNA, 31 bp, Artificial Sequence
  Description of Artificial Sequence: Synthetic oligonucleotide
tcacgcatttcgagctctacaagcagatcgg

SEQ ID NO: 100823 - DNA, 30 bp, Artificial Sequence
  Description of Artificial Sequence: Synthetic oligonucleotide
cacgcatttcgagctctacaagcagatcgg

SEQ ID NO: 100824 - DNA, 30 bp, Artificial Sequence
  Description of Artificial Sequence: Synthetic oligonucleotide
acgcatttcgagctctacaagcagatcggc

SEQ ID NO: 100825 - DNA, 29 bp, Artificial Sequence
  Description of Artificial Sequence: Synthetic oligonucleotide
cgcatttcgagctctacaagcagatcggc

SEQ ID NO: 100826 - DNA, 31 bp, Artificial Sequence
  Description of Artificial Sequence: Synthetic oligonucleotide
gcatttcgagctctacaagcagatcggcatc

SEQ ID NO: 100827 - DNA, 31 bp, Artificial Sequence
  Description of Artificial Sequence: Synthetic oligonucleotide
catttcgagctctacaagcagatcggcatcg

SEQ ID NO: 100828 - DNA, 33 bp, Artificial Sequence
  Description of Artificial Sequence: Synthetic oligonucleotide
atttcgagctctacaagcagatcggcatcgatc

SEQ ID NO: 100829 - DNA, 32 bp, Artificial Sequence
  Description of Artificial Sequence: Synthetic oligonucleotide
tttcgagctctacaagcagatcggcatcgatc

SEQ ID NO: 100830 - DNA, 31 bp, Artificial Sequence
  Description of Artificial Sequence: Synthetic oligonucleotide
ttcgagctctacaagcagatcggcatcgatc

SEQ ID NO: 100831 - DNA, 30 bp, Artificial Sequence
  Description of Artificial Sequence: Synthetic oligonucleotide
tcgagctctacaagcagatcggcatcgatc

SEQ ID NO: 100832 - DNA, 29 bp, Artificial Sequence
  Description of Artificial Sequence: Synthetic oligonucleotide
cgagctctacaagcagatcggcatcgatc

SEQ ID NO: 100833 - DNA, 29 bp, Artificial Sequence
  Description of Artificial Sequence: Synthetic oligonucleotide
gagctctacaagcagatcggcatcgatcc

SEQ ID NO: 100834 - DNA, 29 bp, Artificial Sequence
  Description of Artificial Sequence: Synthetic oligonucleotide
agctctacaagcagatcggcatcgatccc

SEQ ID NO: 100835 - DNA, 28 bp, Artificial Sequence
  Description of Artificial Sequence: Synthetic oligonucleotide
gctctacaagcagatcggcatcgatccc

SEQ ID NO: 100836 - DNA, 28 bp, Artificial Sequence
  Description of Artificial Sequence: Synthetic oligonucleotide
ctctacaagcagatcggcatcgatcccc

SEQ ID NO: 100837 - DNA, 28 bp, Artificial Sequence
  Description of Artificial Sequence: Synthetic oligonucleotide
tctacaagcagatcggcatcgatccccc

SEQ ID NO: 100838 - DNA, 27 bp, Artificial Sequence
  Description of Artificial Sequence: Synthetic oligonucleotide
ctacaagcagatcggcatcgatccccc

SEQ ID NO: 100839 - DNA, 27 bp, Artificial Sequence
  Description of Artificial Sequence: Synthetic oligonucleotide
tacaagcagatcggcatcgatcccccc

SEQ ID NO: 100840 - DNA, 26 bp, Artificial Sequence
  Description of Artificial Sequence: Synthetic oligonucleotide
acaagcagatcggcatcgatcccccc

SEQ ID NO: 100841 - DNA, 25 bp, Artificial Sequence
  Description of Artificial Sequence: Synthetic oligonucleotide
caagcagatcggcatcgatcccccc

SEQ ID NO: 100842 - DNA, 25 bp, Artificial Sequence
  Description of Artificial Sequence: Synthetic oligonucleotide
aagcagatcggcatcgatccccccc

SEQ ID NO: 100843 - DNA, 24 bp, Artificial Sequence
  Description of Artificial Sequence: Synthetic oligonucleotide
agcagatcggcatcgatccccccc

SEQ ID NO: 100844 - DNA, 23 bp, Artificial Sequence
  Description of Artificial Sequence: Synthetic oligonucleotide
gcagatcggcatcgatccccccc

SEQ ID NO: 100845 - DNA, 24 bp, Artificial Sequence
  Description of Artificial Sequence: Synthetic oligonucleotide
cagatcggcatcgatcccccccga

SEQ ID NO: 100846 - DNA, 24 bp, Artificial Sequence
  Description of Artificial Sequence: Synthetic oligonucleotide
agatcggcatcgatcccccccgag

SEQ ID NO: 100847 - DNA, 23 bp, Artificial Sequence
  Description of Artificial Sequence: Synthetic oligonucleotide
gatcggcatcgatcccccccgag

SEQ ID NO: 100848 - DNA, 23 bp, Artificial Sequence
  Description of Artificial Sequence: Synthetic oligonucleotide
atcggcatcgatcccccccgagg

SEQ ID NO: 100849 - DNA, 22 bp, Artificial Sequence
  Description of Artificial Sequence: Synthetic oligonucleotide
tcggcatcgatcccccccgagg

SEQ ID NO: 100850 - DNA, 21 bp, Artificial Sequence
  Description of Artificial Sequence: Synthetic oligonucleotide
cggcatcgatcccccccgagg

SEQ ID NO: 100851 - DNA, 21 bp, Artificial Sequence
  Description of Artificial Sequence: Synthetic oligonucleotide
ggcatcgatcccccccgaggc

SEQ ID NO: 100852 - DNA, 22 bp, Artificial Sequence
  Description of Artificial Sequence: Synthetic oligonucleotide
gcatcgatcccccccgaggcgt

SEQ ID NO: 100853 - DNA, 22 bp, Artificial Sequence
  Description of Artificial Sequence: Synthetic oligonucleotide
catcgatcccccccgaggcgtc

SEQ ID NO: 100854 - DNA, 23 bp, Artificial Sequence
  Description of Artificial Sequence: Synthetic oligonucleotide
atcgatcccccccgaggcgtcct

SEQ ID NO: 100855 - DNA, 22 bp, Artificial Sequence
  Description of Artificial Sequence: Synthetic oligonucleotide
tcgatcccccccgaggcgtcct

SEQ ID NO: 100856 - DNA, 21 bp, Artificial Sequence
  Description of Artificial Sequence: Synthetic oligonucleotide
cgatcccccccgaggcgtcct

SEQ ID NO: 100857 - DNA, 23 bp, Artificial Sequence
  Description of Artificial Sequence: Synthetic oligonucleotide
gatcccccccgaggcgtcctcat

SEQ ID NO: 100858 - DNA, 26 bp, Artificial Sequence
  Description of Artificial Sequence: Synthetic oligonucleotide
atcccccccgaggcgtcctcatgtat

SEQ ID NO: 100859 - DNA, 25 bp, Artificial Sequence
  Description of Artificial Sequence: Synthetic oligonucleotide
tcccccccgaggcgtcctcatgtat

SEQ ID NO: 100860 - DNA, 24 bp, Artificial Sequence
  Description of Artificial Sequence: Synthetic oligonucleotide
cccccccgaggcgtcctcatgtat

SEQ ID NO: 100861 - DNA, 24 bp, Artificial Sequence
  Description of Artificial Sequence: Synthetic oligonucleotide
ccccccgaggcgtcctcatgtatg

SEQ ID NO: 100862 - DNA, 24 bp, Artificial Sequence
  Description of Artificial Sequence: Synthetic oligonucleotide
cccccgaggcgtcctcatgtatgg

SEQ ID NO: 100863 - DNA, 24 bp, Artificial Sequence
  Description of Artificial Sequence: Synthetic oligonucleotide
ccccgaggcgtcctcatgtatggc

SEQ ID NO: 100864 - DNA, 24 bp, Artificial Sequence
  Description of Artificial Sequence: Synthetic oligonucleotide
cccgaggcgtcctcatgtatggcc

SEQ ID NO: 100865 - DNA, 25 bp, Artificial Sequence
  Description of Artificial Sequence: Synthetic oligonucleotide
ccgaggcgtcctcatgtatggccca

SEQ ID NO: 100866 - DNA, 25 bp, Artificial Sequence
  Description of Artificial Sequence: Synthetic oligonucleotide
cgaggcgtcctcatgtatggcccac

SEQ ID NO: 100867 - DNA, 26 bp, Artificial Sequence
  Description of Artificial Sequence: Synthetic oligonucleotide
gaggcgtcctcatgtatggcccacct

SEQ ID NO: 100868 - DNA, 26 bp, Artificial Sequence
  Description of Artificial Sequence: Synthetic oligonucleotide
aggcgtcctcatgtatggcccacctg

SEQ ID NO: 100869 - DNA, 25 bp, Artificial Sequence
  Description of Artificial Sequence: Synthetic oligonucleotide
ggcgtcctcatgtatggcccacctg

SEQ ID NO: 100870 - DNA, 25 bp, Artificial Sequence
  Description of Artificial Sequence: Synthetic oligonucleotide
gcgtcctcatgtatggcccacctgg

SEQ ID NO: 100871 - DNA, 26 bp, Artificial Sequence
  Description of Artificial Sequence: Synthetic oligonucleotide
cgtcctcatgtatggcccacctggct

SEQ ID NO: 100872 - DNA, 27 bp, Artificial Sequence
  Description of Artificial Sequence: Synthetic oligonucleotide
gtcctcatgtatggcccacctggctgt

SEQ ID NO: 100873 - DNA, 27 bp, Artificial Sequence
  Description of Artificial Sequence: Synthetic oligonucleotide
tcctcatgtatggcccacctggctgtg

SEQ ID NO: 100874 - DNA, 26 bp, Artificial Sequence
  Description of Artificial Sequence: Synthetic oligonucleotide
cctcatgtatggcccacctggctgtg

SEQ ID NO: 100875 - DNA, 26 bp, Artificial Sequence
  Description of Artificial Sequence: Synthetic oligonucleotide
ctcatgtatggcccacctggctgtgg

SEQ ID NO: 100876 - DNA, 27 bp, Artificial Sequence
  Description of Artificial Sequence: Synthetic oligonucleotide
tcatgtatggcccacctggctgtggga

SEQ ID NO: 100877 - DNA, 27 bp, Artificial Sequence
  Description of Artificial Sequence: Synthetic oligonucleotide
catgtatggcccacctggctgtgggaa

SEQ ID NO: 100878 - DNA, 27 bp, Artificial Sequence
  Description of Artificial Sequence: Synthetic oligonucleotide
atgtatggcccacctggctgtgggaag

SEQ ID NO: 100879 - DNA, 27 bp, Artificial Sequence
  Description of Artificial Sequence: Synthetic oligonucleotide
tgtatggcccacctggctgtgggaaga

SEQ ID NO: 100880 - DNA, 26 bp, Artificial Sequence
  Description of Artificial Sequence: Synthetic oligonucleotide
gtatggcccacctggctgtgggaaga

SEQ ID NO: 100881 - DNA, 26 bp, Artificial Sequence
  Description of Artificial Sequence: Synthetic oligonucleotide
tatggcccacctggctgtgggaagac

SEQ ID NO: 100882 - DNA, 25 bp, Artificial Sequence
  Description of Artificial Sequence: Synthetic oligonucleotide
atggcccacctggctgtgggaagac

SEQ ID NO: 100883 - DNA, 24 bp, Artificial Sequence
  Description of Artificial Sequence: Synthetic oligonucleotide
tggcccacctggctgtgggaagac

SEQ ID NO: 100884 - DNA, 23 bp, Artificial Sequence
  Description of Artificial Sequence: Synthetic oligonucleotide
ggcccacctggctgtgggaagac

SEQ ID NO: 100885 - DNA, 25 bp, Artificial Sequence
  Description of Artificial Sequence: Synthetic oligonucleotide
gcccacctggctgtgggaagaccat

SEQ ID NO: 100886 - DNA, 27 bp, Artificial Sequence
  Description of Artificial Sequence: Synthetic oligonucleotide
cccacctggctgtgggaagaccatgtt

SEQ ID NO: 100887 - DNA, 27 bp, Artificial Sequence
  Description of Artificial Sequence: Synthetic oligonucleotide
ccacctggctgtgggaagaccatgttg

SEQ ID NO: 100888 - DNA, 27 bp, Artificial Sequence
  Description of Artificial Sequence: Synthetic oligonucleotide
cacctggctgtgggaagaccatgttgg

SEQ ID NO: 100889 - DNA, 27 bp, Artificial Sequence
  Description of Artificial Sequence: Synthetic oligonucleotide
acctggctgtgggaagaccatgttggc

SEQ ID NO: 100890 - DNA, 27 bp, Artificial Sequence
  Description of Artificial Sequence: Synthetic oligonucleotide
cctggctgtgggaagaccatgttggca

SEQ ID NO: 100891 - DNA, 29 bp, Artificial Sequence
  Description of Artificial Sequence: Synthetic oligonucleotide
ctggctgtgggaagaccatgttggcaaag

SEQ ID NO: 100892 - DNA, 29 bp, Artificial Sequence
  Description of Artificial Sequence: Synthetic oligonucleotide
tggctgtgggaagaccatgttggcaaagg

SEQ ID NO: 100893 - DNA, 28 bp, Artificial Sequence
  Description of Artificial Sequence: Synthetic oligonucleotide
ggctgtgggaagaccatgttggcaaagg

SEQ ID NO: 100894 - DNA, 28 bp, Artificial Sequence
  Description of Artificial Sequence: Synthetic oligonucleotide
gctgtgggaagaccatgttggcaaaggc

SEQ ID NO: 100895 - DNA, 28 bp, Artificial Sequence
  Description of Artificial Sequence: Synthetic oligonucleotide
ctgtgggaagaccatgttggcaaaggcg

SEQ ID NO: 100896 - DNA, 28 bp, Artificial Sequence
  Description of Artificial Sequence: Synthetic oligonucleotide
tgtgggaagaccatgttggcaaaggcgg

SEQ ID NO: 100897 - DNA, 27 bp, Artificial Sequence
  Description of Artificial Sequence: Synthetic oligonucleotide
gtgggaagaccatgttggcaaaggcgg

SEQ ID NO: 100898 - DNA, 28 bp, Artificial Sequence
  Description of Artificial Sequence: Synthetic oligonucleotide
tgggaagaccatgttggcaaaggcggtg

SEQ ID NO: 100899 - DNA, 27 bp, Artificial Sequence
  Description of Artificial Sequence: Synthetic oligonucleotide
gggaagaccatgttggcaaaggcggtg

SEQ ID NO: 100900 - DNA, 27 bp, Artificial Sequence
  Description of Artificial Sequence: Synthetic oligonucleotide
ggaagaccatgttggcaaaggcggtgg

SEQ ID NO: 100901 - DNA, 27 bp, Artificial Sequence
  Description of Artificial Sequence: Synthetic oligonucleotide
gaagaccatgttggcaaaggcggtggc

SEQ ID NO: 100902 - DNA, 28 bp, Artificial Sequence
  Description of Artificial Sequence: Synthetic oligonucleotide
aagaccatgttggcaaaggcggtggcac

SEQ ID NO: 100903 - DNA, 27 bp, Artificial Sequence
  Description of Artificial Sequence: Synthetic oligonucleotide
agaccatgttggcaaaggcggtggcac

SEQ ID NO: 100904 - DNA, 27 bp, Artificial Sequence
  Description of Artificial Sequence: Synthetic oligonucleotide
gaccatgttggcaaaggcggtggcaca

SEQ ID NO: 100905 - DNA, 28 bp, Artificial Sequence
  Description of Artificial Sequence: Synthetic oligonucleotide
accatgttggcaaaggcggtggcacatc

SEQ ID NO: 100906 - DNA, 27 bp, Artificial Sequence
  Description of Artificial Sequence: Synthetic oligonucleotide
ccatgttggcaaaggcggtggcacatc

SEQ ID NO: 100907 - DNA, 28 bp, Artificial Sequence
  Description of Artificial Sequence: Synthetic oligonucleotide
catgttggcaaaggcggtggcacatcac

SEQ ID NO: 100908 - DNA, 29 bp, Artificial Sequence
  Description of Artificial Sequence: Synthetic oligonucleotide
atgttggcaaaggcggtggcacatcacac

SEQ ID NO: 100909 - DNA, 28 bp, Artificial Sequence
  Description of Artificial Sequence: Synthetic oligonucleotide
tgttggcaaaggcggtggcacatcacac

SEQ ID NO: 100910 - DNA, 27 bp, Artificial Sequence
  Description of Artificial Sequence: Synthetic oligonucleotide
gttggcaaaggcggtggcacatcacac

SEQ ID NO: 100911 - DNA, 29 bp, Artificial Sequence
  Description of Artificial Sequence: Synthetic oligonucleotide
ttggcaaaggcggtggcacatcacacaac

SEQ ID NO: 100912 - DNA, 28 bp, Artificial Sequence
  Description of Artificial Sequence: Synthetic oligonucleotide
tggcaaaggcggtggcacatcacacaac

SEQ ID NO: 100913 - DNA, 27 bp, Artificial Sequence
  Description of Artificial Sequence: Synthetic oligonucleotide
ggcaaaggcggtggcacatcacacaac

SEQ ID NO: 100914 - DNA, 28 bp, Artificial Sequence
  Description of Artificial Sequence: Synthetic oligonucleotide
gcaaaggcggtggcacatcacacaacag

SEQ ID NO: 100915 - DNA, 28 bp, Artificial Sequence
  Description of Artificial Sequence: Synthetic oligonucleotide
caaaggcggtggcacatcacacaacagc

SEQ ID NO: 100916 - DNA, 29 bp, Artificial Sequence
  Description of Artificial Sequence: Synthetic oligonucleotide
aaaggcggtggcacatcacacaacagctg

SEQ ID NO: 100917 - DNA, 28 bp, Artificial Sequence
  Description of Artificial Sequence: Synthetic oligonucleotide
aaggcggtggcacatcacacaacagctg

SEQ ID NO: 100918 - DNA, 27 bp, Artificial Sequence
  Description of Artificial Sequence: Synthetic oligonucleotide
aggcggtggcacatcacacaacagctg

SEQ ID NO: 100919 - DNA, 26 bp, Artificial Sequence
  Description of Artificial Sequence: Synthetic oligonucleotide
ggcggtggcacatcacacaacagctg

SEQ ID NO: 100920 - DNA, 27 bp, Artificial Sequence
  Description of Artificial Sequence: Synthetic oligonucleotide
gcggtggcacatcacacaacagctgca

SEQ ID NO: 100921 - DNA, 29 bp, Artificial Sequence
  Description of Artificial Sequence: Synthetic oligonucleotide
cggtggcacatcacacaacagctgcattc

SEQ ID NO: 100922 - DNA, 31 bp, Artificial Sequence
  Description of Artificial Sequence: Synthetic oligonucleotide
ggtggcacatcacacaacagctgcattcatc

SEQ ID NO: 100923 - DNA, 31 bp, Artificial Sequence
  Description of Artificial Sequence: Synthetic oligonucleotide
gtggcacatcacacaacagctgcattcatcc

SEQ ID NO: 100924 - DNA, 31 bp, Artificial Sequence
  Description of Artificial Sequence: Synthetic oligonucleotide
tggcacatcacacaacagctgcattcatccg

SEQ ID NO: 100925 - DNA, 30 bp, Artificial Sequence
  Description of Artificial Sequence: Synthetic oligonucleotide
ggcacatcacacaacagctgcattcatccg

SEQ ID NO: 100926 - DNA, 30 bp, Artificial Sequence
  Description of Artificial Sequence: Synthetic oligonucleotide
gcacatcacacaacagctgcattcatccgg

SEQ ID NO: 100927 - DNA, 30 bp, Artificial Sequence
  Description of Artificial Sequence: Synthetic oligonucleotide
cacatcacacaacagctgcattcatccggg

SEQ ID NO: 100928 - DNA, 31 bp, Artificial Sequence
  Description of Artificial Sequence: Synthetic oligonucleotide
acatcacacaacagctgcattcatccgggtc

SEQ ID NO: 100929 - DNA, 30 bp, Artificial Sequence
  Description of Artificial Sequence: Synthetic oligonucleotide
catcacacaacagctgcattcatccgggtc

SEQ ID NO: 100930 - DNA, 30 bp, Artificial Sequence
  Description of Artificial Sequence: Synthetic oligonucleotide
atcacacaacagctgcattcatccgggtcg

SEQ ID NO: 100931 - DNA, 29 bp, Artificial Sequence
  Description of Artificial Sequence: Synthetic oligonucleotide
tcacacaacagctgcattcatccgggtcg

SEQ ID NO: 100932 - DNA, 28 bp, Artificial Sequence
  Description of Artificial Sequence: Synthetic oligonucleotide
cacacaacagctgcattcatccgggtcg

SEQ ID NO: 100933 - DNA, 29 bp, Artificial Sequence
  Description of Artificial Sequence: Synthetic oligonucleotide
acacaacagctgcattcatccgggtcgtg

SEQ ID NO: 100934 - DNA, 28 bp, Artificial Sequence
  Description of Artificial Sequence: Synthetic oligonucleotide
cacaacagctgcattcatccgggtcgtg

SEQ ID NO: 100935 - DNA, 28 bp, Artificial Sequence
  Description of Artificial Sequence: Synthetic oligonucleotide
acaacagctgcattcatccgggtcgtgg

SEQ ID NO: 100936 - DNA, 27 bp, Artificial Sequence
  Description of Artificial Sequence: Synthetic oligonucleotide
caacagctgcattcatccgggtcgtgg

SEQ ID NO: 100937 - DNA, 27 bp, Artificial Sequence
  Description of Artificial Sequence: Synthetic oligonucleotide
aacagctgcattcatccgggtcgtggg

SEQ ID NO: 100938 - DNA, 26 bp, Artificial Sequence
  Description of Artificial Sequence: Synthetic oligonucleotide
acagctgcattcatccgggtcgtggg

SEQ ID NO: 100939 - DNA, 25 bp, Artificial Sequence
  Description of Artificial Sequence: Synthetic oligonucleotide
cagctgcattcatccgggtcgtggg

SEQ ID NO: 100940 - DNA, 26 bp, Artificial Sequence
  Description of Artificial Sequence: Synthetic oligonucleotide
agctgcattcatccgggtcgtgggct

SEQ ID NO: 100941 - DNA, 25 bp, Artificial Sequence
  Description of Artificial Sequence: Synthetic oligonucleotide
gctgcattcatccgggtcgtgggct

SEQ ID NO: 100942 - DNA, 25 bp, Artificial Sequence
  Description of Artificial Sequence: Synthetic oligonucleotide
ctgcattcatccgggtcgtgggctc

SEQ ID NO: 100943 - DNA, 25 bp, Artificial Sequence
  Description of Artificial Sequence: Synthetic oligonucleotide
tgcattcatccgggtcgtgggctcg

SEQ ID NO: 100944 - DNA, 24 bp, Artificial Sequence
  Description of Artificial Sequence: Synthetic oligonucleotide
gcattcatccgggtcgtgggctcg

SEQ ID NO: 100945 - DNA, 25 bp, Artificial Sequence
  Description of Artificial Sequence: Synthetic oligonucleotide
cattcatccgggtcgtgggctcgga

SEQ ID NO: 100946 - DNA, 27 bp, Artificial Sequence
  Description of Artificial Sequence: Synthetic oligonucleotide
attcatccgggtcgtgggctcggagtt

SEQ ID NO: 100947 - DNA, 27 bp, Artificial Sequence
  Description of Artificial Sequence: Synthetic oligonucleotide
ttcatccgggtcgtgggctcggagttt

SEQ ID NO: 100948 - DNA, 26 bp, Artificial Sequence
  Description of Artificial Sequence: Synthetic oligonucleotide
tcatccgggtcgtgggctcggagttt

SEQ ID NO: 100949 - DNA, 25 bp, Artificial Sequence
  Description of Artificial Sequence: Synthetic oligonucleotide
catccgggtcgtgggctcggagttt

SEQ ID NO: 100950 - DNA, 27 bp, Artificial Sequence
  Description of Artificial Sequence: Synthetic oligonucleotide
atccgggtcgtgggctcggagtttgta

SEQ ID NO: 100951 - DNA, 26 bp, Artificial Sequence
  Description of Artificial Sequence: Synthetic oligonucleotide
tccgggtcgtgggctcggagtttgta

SEQ ID NO: 100952 - DNA, 25 bp, Artificial Sequence
  Description of Artificial Sequence: Synthetic oligonucleotide
ccgggtcgtgggctcggagtttgta

SEQ ID NO: 100953 - DNA, 26 bp, Artificial Sequence
  Description of Artificial Sequence: Synthetic oligonucleotide
cgggtcgtgggctcggagtttgtaca

SEQ ID NO: 100954 - DNA, 27 bp, Artificial Sequence
  Description of Artificial Sequence: Synthetic oligonucleotide
gggtcgtgggctcggagtttgtacaga

SEQ ID NO: 100955 - DNA, 28 bp, Artificial Sequence
  Description of Artificial Sequence: Synthetic oligonucleotide
ggtcgtgggctcggagtttgtacagaag

SEQ ID NO: 100956 - DNA, 31 bp, Artificial Sequence
  Description of Artificial Sequence: Synthetic oligonucleotide
gtcgtgggctcggagtttgtacagaagtatc

SEQ ID NO: 100957 - DNA, 32 bp, Artificial Sequence
  Description of Artificial Sequence: Synthetic oligonucleotide
tcgtgggctcggagtttgtacagaagtatctg

SEQ ID NO: 100958 - DNA, 31 bp, Artificial Sequence
  Description of Artificial Sequence: Synthetic oligonucleotide
cgtgggctcggagtttgtacagaagtatctg

SEQ ID NO: 100959 - DNA, 31 bp, Artificial Sequence
  Description of Artificial Sequence: Synthetic oligonucleotide
gtgggctcggagtttgtacagaagtatctgg

SEQ ID NO: 100960 - DNA, 31 bp, Artificial Sequence
  Description of Artificial Sequence: Synthetic oligonucleotide
tgggctcggagtttgtacagaagtatctggg

SEQ ID NO: 100961 - DNA, 30 bp, Artificial Sequence
  Description of Artificial Sequence: Synthetic oligonucleotide
gggctcggagtttgtacagaagtatctggg

SEQ ID NO: 100962 - DNA, 31 bp, Artificial Sequence
  Description of Artificial Sequence: Synthetic oligonucleotide
ggctcggagtttgtacagaagtatctgggtg

SEQ ID NO: 100963 - DNA, 32 bp, Artificial Sequence
  Description of Artificial Sequence: Synthetic oligonucleotide
gctcggagtttgtacagaagtatctgggtgag

SEQ ID NO: 100964 - DNA, 32 bp, Artificial Sequence
  Description of Artificial Sequence: Synthetic oligonucleotide
ctcggagtttgtacagaagtatctgggtgagg

SEQ ID NO: 100965 - DNA, 32 bp, Artificial Sequence
  Description of Artificial Sequence: Synthetic oligonucleotide
tcggagtttgtacagaagtatctgggtgaggg

SEQ ID NO: 100966 - DNA, 31 bp, Artificial Sequence
  Description of Artificial Sequence: Synthetic oligonucleotide
cggagtttgtacagaagtatctgggtgaggg

SEQ ID NO: 100967 - DNA, 31 bp, Artificial Sequence
  Description of Artificial Sequence: Synthetic oligonucleotide
ggagtttgtacagaagtatctgggtgagggc

SEQ ID NO: 100968 - DNA, 31 bp, Artificial Sequence
  Description of Artificial Sequence: Synthetic oligonucleotide
gagtttgtacagaagtatctgggtgagggcc

SEQ ID NO: 100969 - DNA, 31 bp, Artificial Sequence
  Description of Artificial Sequence: Synthetic oligonucleotide
agtttgtacagaagtatctgggtgagggccc

SEQ ID NO: 100970 - DNA, 30 bp, Artificial Sequence
  Description of Artificial Sequence: Synthetic oligonucleotide
gtttgtacagaagtatctgggtgagggccc

SEQ ID NO: 100971 - DNA, 30 bp, Artificial Sequence
  Description of Artificial Sequence: Synthetic oligonucleotide
tttgtacagaagtatctgggtgagggcccc

SEQ ID NO: 100972 - DNA, 29 bp, Artificial Sequence
  Description of Artificial Sequence: Synthetic oligonucleotide
ttgtacagaagtatctgggtgagggcccc

SEQ ID NO: 100973 - DNA, 28 bp, Artificial Sequence
  Description of Artificial Sequence: Synthetic oligonucleotide
tgtacagaagtatctgggtgagggcccc

SEQ ID NO: 100974 - DNA, 27 bp, Artificial Sequence
  Description of Artificial Sequence: Synthetic oligonucleotide
gtacagaagtatctgggtgagggcccc

SEQ ID NO: 100975 - DNA, 27 bp, Artificial Sequence
  Description of Artificial Sequence: Synthetic oligonucleotide
tacagaagtatctgggtgagggccccc

SEQ ID NO: 100976 - DNA, 26 bp, Artificial Sequence
  Description of Artificial Sequence: Synthetic oligonucleotide
acagaagtatctgggtgagggccccc

SEQ ID NO: 100977 - DNA, 25 bp, Artificial Sequence
  Description of Artificial Sequence: Synthetic oligonucleotide
cagaagtatctgggtgagggccccc

SEQ ID NO: 100978 - DNA, 25 bp, Artificial Sequence
  Description of Artificial Sequence: Synthetic oligonucleotide
agaagtatctgggtgagggcccccg

SEQ ID NO: 100979 - DNA, 24 bp, Artificial Sequence
  Description of Artificial Sequence: Synthetic oligonucleotide
gaagtatctgggtgagggcccccg

SEQ ID NO: 100980 - DNA, 26 bp, Artificial Sequence
  Description of Artificial Sequence: Synthetic oligonucleotide
aagtatctgggtgagggcccccgcat

SEQ ID NO: 100981 - DNA, 25 bp, Artificial Sequence
  Description of Artificial Sequence: Synthetic oligonucleotide
agtatctgggtgagggcccccgcat

SEQ ID NO: 100982 - DNA, 24 bp, Artificial Sequence
  Description of Artificial Sequence: Synthetic oligonucleotide
gtatctgggtgagggcccccgcat

SEQ ID NO: 100983 - DNA, 24 bp, Artificial Sequence
  Description of Artificial Sequence: Synthetic oligonucleotide
tatctgggtgagggcccccgcatg

SEQ ID NO: 100984 - DNA, 23 bp, Artificial Sequence
  Description of Artificial Sequence: Synthetic oligonucleotide
atctgggtgagggcccccgcatg

SEQ ID NO: 100985 - DNA, 22 bp, Artificial Sequence
  Description of Artificial Sequence: Synthetic oligonucleotide
tctgggtgagggcccccgcatg

SEQ ID NO: 100986 - DNA, 21 bp, Artificial Sequence
  Description of Artificial Sequence: Synthetic oligonucleotide
ctgggtgagggcccccgcatg

SEQ ID NO: 100987 - DNA, 22 bp, Artificial Sequence
  Description of Artificial Sequence: Synthetic oligonucleotide
tgggtgagggcccccgcatggt

SEQ ID NO: 100988 - DNA, 21 bp, Artificial Sequence
  Description of Artificial Sequence: Synthetic oligonucleotide
gggtgagggcccccgcatggt

SEQ ID NO: 100989 - DNA, 21 bp, Artificial Sequence
  Description of Artificial Sequence: Synthetic oligonucleotide
ggtgagggcccccgcatggtc

SEQ ID NO: 100990 - DNA, 21 bp, Artificial Sequence
  Description of Artificial Sequence: Synthetic oligonucleotide
gtgagggcccccgcatggtcc

SEQ ID NO: 100991 - DNA, 21 bp, Artificial Sequence
  Description of Artificial Sequence: Synthetic oligonucleotide
tgagggcccccgcatggtccg

SEQ ID NO: 100992 - DNA, 20 bp, Artificial Sequence
  Description of Artificial Sequence: Synthetic oligonucleotide
gagggcccccgcatggtccg

SEQ ID NO: 100993 - DNA, 20 bp, Artificial Sequence
  Description of Artificial Sequence: Synthetic oligonucleotide
agggcccccgcatggtccgg

SEQ ID NO: 100994 - DNA, 20 bp, Artificial Sequence
  Description of Artificial Sequence: Synthetic oligonucleotide
gggcccccgcatggtccggt

SEQ ID NO: 100995 - DNA, 21 bp, Artificial Sequence
  Description of Artificial Sequence: Synthetic oligonucleotide
ggcccccgcatggtccgggat

SEQ ID NO: 100996 - DNA, 22 bp, Artificial Sequence
  Description of Artificial Sequence: Synthetic oligonucleotide
gcccccgcatggtccgggatgt

SEQ ID NO: 100997 - DNA, 24 bp, Artificial Sequence
  Description of Artificial Sequence: Synthetic oligonucleotide
cccccgcatggtccgggatgtgtt

SEQ ID NO: 100998 - DNA, 24 bp, Artificial Sequence
  Description of Artificial Sequence: Synthetic oligonucleotide
ccccgcatggtccgggatgtgttc

SEQ ID NO: 100999 - DNA, 24 bp, Artificial Sequence
  Description of Artificial Sequence: Synthetic oligonucleotide
cccgcatggtccgggatgtgttcc

SEQ ID NO: 101000 - DNA, 24 bp, Artificial Sequence
  Description of Artificial Sequence: Synthetic oligonucleotide
ccgcatggtccgggatgtgttccg

SEQ ID NO: 101001 - DNA, 24 bp, Artificial Sequence
  Description of Artificial Sequence: Synthetic oligonucleotide
cgcatggtccgggatgtgttccgc

SEQ ID NO: 101002 - DNA, 25 bp, Artificial Sequence
  Description of Artificial Sequence: Synthetic oligonucleotide
gcatggtccgggatgtgttccgcct

SEQ ID NO: 101003 - DNA, 25 bp, Artificial Sequence
  Description of Artificial Sequence: Synthetic oligonucleotide
catggtccgggatgtgttccgcctg

SEQ ID NO: 101004 - DNA, 25 bp, Artificial Sequence
  Description of Artificial Sequence: Synthetic oligonucleotide
atggtccgggatgtgttccgcctgg

SEQ ID NO: 101005 - DNA, 24 bp, Artificial Sequence
  Description of Artificial Sequence: Synthetic oligonucleotide
tggtccgggatgtgttccgcctgg

SEQ ID NO: 101006 - DNA, 23 bp, Artificial Sequence
  Description of Artificial Sequence: Synthetic oligonucleotide
ggtccgggatgtgttccgcctgg

SEQ ID NO: 101007 - DNA, 23 bp, Artificial Sequence
  Description of Artificial Sequence: Synthetic oligonucleotide
gtccgggatgtgttccgcctggc

SEQ ID NO: 101008 - DNA, 25 bp, Artificial Sequence
  Description of Artificial Sequence: Synthetic oligonucleotide
tccgggatgtgttccgcctggccaa

SEQ ID NO: 101009 - DNA, 24 bp, Artificial Sequence
  Description of Artificial Sequence: Synthetic oligonucleotide
ccgggatgtgttccgcctggccaa

SEQ ID NO: 101010 - DNA, 24 bp, Artificial Sequence
  Description of Artificial Sequence: Synthetic oligonucleotide
cgggatgtgttccgcctggccaag

SEQ ID NO: 101011 - DNA, 25 bp, Artificial Sequence
  Description of Artificial Sequence: Synthetic oligonucleotide
gggatgtgttccgcctggccaagga

SEQ ID NO: 101012 - DNA, 27 bp, Artificial Sequence
  Description of Artificial Sequence: Synthetic oligonucleotide
ggatgtgttccgcctggccaaggagaa

SEQ ID NO: 101013 - DNA, 28 bp, Artificial Sequence
  Description of Artificial Sequence: Synthetic oligonucleotide
gatgtgttccgcctggccaaggagaatg

SEQ ID NO: 101014 - DNA, 28 bp, Artificial Sequence
  Description of Artificial Sequence: Synthetic oligonucleotide
atgtgttccgcctggccaaggagaatgc

SEQ ID NO: 101015 - DNA, 27 bp, Artificial Sequence
  Description of Artificial Sequence: Synthetic oligonucleotide
tgtgttccgcctggccaaggagaatgc

SEQ ID NO: 101016 - DNA, 27 bp, Artificial Sequence
  Description of Artificial Sequence: Synthetic oligonucleotide
gtgttccgcctggccaaggagaatgca

SEQ ID NO: 101017 - DNA, 27 bp, Artificial Sequence
  Description of Artificial Sequence: Synthetic oligonucleotide
tgttccgcctggccaaggagaatgcac

SEQ ID NO: 101018 - DNA, 26 bp, Artificial Sequence
  Description of Artificial Sequence: Synthetic oligonucleotide
gttccgcctggccaaggagaatgcac

SEQ ID NO: 101019 - DNA, 27 bp, Artificial Sequence
  Description of Artificial Sequence: Synthetic oligonucleotide
ttccgcctggccaaggagaatgcacct

SEQ ID NO: 101020 - DNA, 26 bp, Artificial Sequence
  Description of Artificial Sequence: Synthetic oligonucleotide
tccgcctggccaaggagaatgcacct

SEQ ID NO: 101021 - DNA, 25 bp, Artificial Sequence
  Description of Artificial Sequence: Synthetic oligonucleotide
ccgcctggccaaggagaatgcacct

SEQ ID NO: 101022 - DNA, 25 bp, Artificial Sequence
  Description of Artificial Sequence: Synthetic oligonucleotide
cgcctggccaaggagaatgcacctg

SEQ ID NO: 101023 - DNA, 25 bp, Artificial Sequence
  Description of Artificial Sequence: Synthetic oligonucleotide
gcctggccaaggagaatgcacctgc

SEQ ID NO: 101024 - DNA, 27 bp, Artificial Sequence
  Description of Artificial Sequence: Synthetic oligonucleotide
cctggccaaggagaatgcacctgccat

SEQ ID NO: 101025 - DNA, 27 bp, Artificial Sequence
  Description of Artificial Sequence: Synthetic oligonucleotide
ctggccaaggagaatgcacctgccatc

SEQ ID NO: 101026 - DNA, 29 bp, Artificial Sequence
  Description of Artificial Sequence: Synthetic oligonucleotide
tggccaaggagaatgcacctgccatcatc

SEQ ID NO: 101027 - DNA, 28 bp, Artificial Sequence
  Description of Artificial Sequence: Synthetic oligonucleotide
ggccaaggagaatgcacctgccatcatc

SEQ ID NO: 101028 - DNA, 30 bp, Artificial Sequence
  Description of Artificial Sequence: Synthetic oligonucleotide
gccaaggagaatgcacctgccatcatcttc

SEQ ID NO: 101029 - DNA, 33 bp, Artificial Sequence
  Description of Artificial Sequence: Synthetic oligonucleotide
ccaaggagaatgcacctgccatcatcttcatag

SEQ ID NO: 101030 - DNA, 34 bp, Artificial Sequence
  Description of Artificial Sequence: Synthetic oligonucleotide
caaggagaatgcacctgccatcatcttcatagac

SEQ ID NO: 101031 - DNA, 34 bp, Artificial Sequence
  Description of Artificial Sequence: Synthetic oligonucleotide
aaggagaatgcacctgccatcatcttcatagacg

SEQ ID NO: 101032 - DNA, 33 bp, Artificial Sequence
  Description of Artificial Sequence: Synthetic oligonucleotide
aggagaatgcacctgccatcatcttcatagacg

SEQ ID NO: 101033 - DNA, 32 bp, Artificial Sequence
  Description of Artificial Sequence: Synthetic oligonucleotide
ggagaatgcacctgccatcatcttcatagacg

SEQ ID NO: 101034 - DNA, 33 bp, Artificial Sequence
  Description of Artificial Sequence: Synthetic oligonucleotide
gagaatgcacctgccatcatcttcatagacgag

SEQ ID NO: 101035 - DNA, 36 bp, Artificial Sequence
  Description of Artificial Sequence: Synthetic oligonucleotide
agaatgcacctgccatcatcttcatagacgagattg

SEQ ID NO: 101036 - DNA, 35 bp, Artificial Sequence
  Description of Artificial Sequence: Synthetic oligonucleotide
gaatgcacctgccatcatcttcatagacgagattg

SEQ ID NO: 101037 - DNA, 37 bp, Artificial Sequence
  Description of Artificial Sequence: Synthetic oligonucleotide
aatgcacctgccatcatcttcatagacgagattgatg

SEQ ID NO: 101038 - DNA, 36 bp, Artificial Sequence
  Description of Artificial Sequence: Synthetic oligonucleotide
atgcacctgccatcatcttcatagacgagattgatg

SEQ ID NO: 101039 - DNA, 35 bp, Artificial Sequence
  Description of Artificial Sequence: Synthetic oligonucleotide
tgcacctgccatcatcttcatagacgagattgatg

SEQ ID NO: 101040 - DNA, 34 bp, Artificial Sequence
  Description of Artificial Sequence: Synthetic oligonucleotide
gcacctgccatcatcttcatagacgagattgatg

SEQ ID NO: 101041 - DNA, 34 bp, Artificial Sequence
  Description of Artificial Sequence: Synthetic oligonucleotide
cacctgccatcatcttcatagacgagattgatgc

SEQ ID NO: 101042 - DNA, 34 bp, Artificial Sequence
  Description of Artificial Sequence: Synthetic oligonucleotide
acctgccatcatcttcatagacgagattgatgcc

SEQ ID NO: 101043 - DNA, 33 bp, Artificial Sequence
  Description of Artificial Sequence: Synthetic oligonucleotide
cctgccatcatcttcatagacgagattgatgcc

SEQ ID NO: 101044 - DNA, 35 bp, Artificial Sequence
  Description of Artificial Sequence: Synthetic oligonucleotide
ctgccatcatcttcatagacgagattgatgccatc

SEQ ID NO: 101045 - DNA, 35 bp, Artificial Sequence
  Description of Artificial Sequence: Synthetic oligonucleotide
tgccatcatcttcatagacgagattgatgccatcg

SEQ ID NO: 101046 - DNA, 34 bp, Artificial Sequence
  Description of Artificial Sequence: Synthetic oligonucleotide
gccatcatcttcatagacgagattgatgccatcg

SEQ ID NO: 101047 - DNA, 34 bp, Artificial Sequence
  Description of Artificial Sequence: Synthetic oligonucleotide
ccatcatcttcatagacgagattgatgccatcgc

SEQ ID NO: 101048 - DNA, 34 bp, Artificial Sequence
  Description of Artificial Sequence: Synthetic oligonucleotide
catcatcttcatagacgagattgatgccatcgcc

SEQ ID NO: 101049 - DNA, 35 bp, Artificial Sequence
  Description of Artificial Sequence: Synthetic oligonucleotide
atcatcttcatagacgagattgatgccatcgccac

SEQ ID NO: 101050 - DNA, 34 bp, Artificial Sequence
  Description of Artificial Sequence: Synthetic oligonucleotide
tcatcttcatagacgagattgatgccatcgccac

SEQ ID NO: 101051 - DNA, 33 bp, Artificial Sequence
  Description of Artificial Sequence: Synthetic oligonucleotide
catcttcatagacgagattgatgccatcgccac

SEQ ID NO: 101052 - DNA, 33 bp, Artificial Sequence
  Description of Artificial Sequence: Synthetic oligonucleotide
atcttcatagacgagattgatgccatcgccacc

SEQ ID NO: 101053 - DNA, 32 bp, Artificial Sequence
  Description of Artificial Sequence: Synthetic oligonucleotide
tcttcatagacgagattgatgccatcgccacc

SEQ ID NO: 101054 - DNA, 31 bp, Artificial Sequence
  Description of Artificial Sequence: Synthetic oligonucleotide
cttcatagacgagattgatgccatcgccacc

SEQ ID NO: 101055 - DNA, 33 bp, Artificial Sequence
  Description of Artificial Sequence: Synthetic oligonucleotide
ttcatagacgagattgatgccatcgccaccaag

SEQ ID NO: 101056 - DNA, 32 bp, Artificial Sequence
  Description of Artificial Sequence: Synthetic oligonucleotide
tcatagacgagattgatgccatcgccaccaag

SEQ ID NO: 101057 - DNA, 31 bp, Artificial Sequence
  Description of Artificial Sequence: Synthetic oligonucleotide
catagacgagattgatgccatcgccaccaag

SEQ ID NO: 101058 - DNA, 32 bp, Artificial Sequence
  Description of Artificial Sequence: Synthetic oligonucleotide
atagacgagattgatgccatcgccaccaagag

SEQ ID NO: 101059 - DNA, 31 bp, Artificial Sequence
  Description of Artificial Sequence: Synthetic oligonucleotide
tagacgagattgatgccatcgccaccaagag

SEQ ID NO: 101060 - DNA, 30 bp, Artificial Sequence
  Description of Artificial Sequence: Synthetic oligonucleotide
agacgagattgatgccatcgccaccaagag

SEQ ID NO: 101061 - DNA, 29 bp, Artificial Sequence
  Description of Artificial Sequence: Synthetic oligonucleotide
gacgagattgatgccatcgccaccaagag

SEQ ID NO: 101062 - DNA, 32 bp, Artificial Sequence
  Description of Artificial Sequence: Synthetic oligonucleotide
acgagattgatgccatcgccaccaagagattc

SEQ ID NO: 101063 - DNA, 31 bp, Artificial Sequence
  Description of Artificial Sequence: Synthetic oligonucleotide
cgagattgatgccatcgccaccaagagattc

SEQ ID NO: 101064 - DNA, 31 bp, Artificial Sequence
  Description of Artificial Sequence: Synthetic oligonucleotide
gagattgatgccatcgccaccaagagattcg

SEQ ID NO: 101065 - DNA, 33 bp, Artificial Sequence
  Description of Artificial Sequence: Synthetic oligonucleotide
agattgatgccatcgccaccaagagattcgatg

SEQ ID NO: 101066 - DNA, 32 bp, Artificial Sequence
  Description of Artificial Sequence: Synthetic oligonucleotide
gattgatgccatcgccaccaagagattcgatg

SEQ ID NO: 101067 - DNA, 32 bp, Artificial Sequence
  Description of Artificial Sequence: Synthetic oligonucleotide
attgatgccatcgccaccaagagattcgatgc

SEQ ID NO: 101068 - DNA, 31 bp, Artificial Sequence
  Description of Artificial Sequence: Synthetic oligonucleotide
ttgatgccatcgccaccaagagattcgatgc

SEQ ID NO: 101069 - DNA, 30 bp, Artificial Sequence
  Description of Artificial Sequence: Synthetic oligonucleotide
tgatgccatcgccaccaagagattcgatgc

SEQ ID NO: 101070 - DNA, 29 bp, Artificial Sequence
  Description of Artificial Sequence: Synthetic oligonucleotide
gatgccatcgccaccaagagattcgatgc

SEQ ID NO: 101071 - DNA, 30 bp, Artificial Sequence
  Description of Artificial Sequence: Synthetic oligonucleotide
atgccatcgccaccaagagattcgatgctc

SEQ ID NO: 101072 - DNA, 29 bp, Artificial Sequence
  Description of Artificial Sequence: Synthetic oligonucleotide
tgccatcgccaccaagagattcgatgctc

SEQ ID NO: 101073 - DNA, 28 bp, Artificial Sequence
  Description of Artificial Sequence: Synthetic oligonucleotide
gccatcgccaccaagagattcgatgctc

SEQ ID NO: 101074 - DNA, 29 bp, Artificial Sequence
  Description of Artificial Sequence: Synthetic oligonucleotide
ccatcgccaccaagagattcgatgctcag

SEQ ID NO: 101075 - DNA, 30 bp, Artificial Sequence
  Description of Artificial Sequence: Synthetic oligonucleotide
catcgccaccaagagattcgatgctcagac

SEQ ID NO: 101076 - DNA, 31 bp, Artificial Sequence
  Description of Artificial Sequence: Synthetic oligonucleotide
atcgccaccaagagattcgatgctcagacag

SEQ ID NO: 101077 - DNA, 30 bp, Artificial Sequence
  Description of Artificial Sequence: Synthetic oligonucleotide
tcgccaccaagagattcgatgctcagacag

SEQ ID NO: 101078 - DNA, 29 bp, Artificial Sequence
  Description of Artificial Sequence: Synthetic oligonucleotide
cgccaccaagagattcgatgctcagacag

SEQ ID NO: 101079 - DNA, 29 bp, Artificial Sequence
  Description of Artificial Sequence: Synthetic oligonucleotide
gccaccaagagattcgatgctcagacagg

SEQ ID NO: 101080 - DNA, 29 bp, Artificial Sequence
  Description of Artificial Sequence: Synthetic oligonucleotide
ccaccaagagattcgatgctcagacaggg

SEQ ID NO: 101081 - DNA, 29 bp, Artificial Sequence
  Description of Artificial Sequence: Synthetic oligonucleotide
caccaagagattcgatgctcagacagggg

SEQ ID NO: 101082 - DNA, 29 bp, Artificial Sequence
  Description of Artificial Sequence: Synthetic oligonucleotide
accaagagattcgatgctcagacaggggc

SEQ ID NO: 101083 - DNA, 28 bp, Artificial Sequence
  Description of Artificial Sequence: Synthetic oligonucleotide
ccaagagattcgatgctcagacaggggc

SEQ ID NO: 101084 - DNA, 28 bp, Artificial Sequence
  Description of Artificial Sequence: Synthetic oligonucleotide
caagagattcgatgctcagacaggggcc

SEQ ID NO: 101085 - DNA, 28 bp, Artificial Sequence
  Description of Artificial Sequence: Synthetic oligonucleotide
aagagattcgatgctcagacaggggccg

SEQ ID NO: 101086 - DNA, 27 bp, Artificial Sequence
  Description of Artificial Sequence: Synthetic oligonucleotide
agagattcgatgctcagacaggggccg

SEQ ID NO: 101087 - DNA, 27 bp, Artificial Sequence
  Description of Artificial Sequence: Synthetic oligonucleotide
gagattcgatgctcagacaggggccga

SEQ ID NO: 101088 - DNA, 27 bp, Artificial Sequence
  Description of Artificial Sequence: Synthetic oligonucleotide
agattcgatgctcagacaggggccgac

SEQ ID NO: 101089 - DNA, 27 bp, Artificial Sequence
  Description of Artificial Sequence: Synthetic oligonucleotide
gattcgatgctcagacaggggccgaca

SEQ ID NO: 101090 - DNA, 27 bp, Artificial Sequence
  Description of Artificial Sequence: Synthetic oligonucleotide
attcgatgctcagacaggggccgacag

SEQ ID NO: 101091 - DNA, 26 bp, Artificial Sequence
  Description of Artificial Sequence: Synthetic oligonucleotide
ttcgatgctcagacaggggccgacag

SEQ ID NO: 101092 - DNA, 25 bp, Artificial Sequence
  Description of Artificial Sequence: Synthetic oligonucleotide
tcgatgctcagacaggggccgacag

SEQ ID NO: 101093 - DNA, 24 bp, Artificial Sequence
  Description of Artificial Sequence: Synthetic oligonucleotide
cgatgctcagacaggggccgacag

SEQ ID NO: 101094 - DNA, 24 bp, Artificial Sequence
  Description of Artificial Sequence: Synthetic oligonucleotide
gatgctcagacaggggccgacagg

SEQ ID NO: 101095 - DNA, 25 bp, Artificial Sequence
  Description of Artificial Sequence: Synthetic oligonucleotide
atgctcagacaggggccgacaggga

SEQ ID NO: 101096 - DNA, 24 bp, Artificial Sequence
  Description of Artificial Sequence: Synthetic oligonucleotide
tgctcagacaggggccgacaggga

SEQ ID NO: 101097 - DNA, 23 bp, Artificial Sequence
  Description of Artificial Sequence: Synthetic oligonucleotide
gctcagacaggggccgacaggga

SEQ ID NO: 101098 - DNA, 23 bp, Artificial Sequence
  Description of Artificial Sequence: Synthetic oligonucleotide
ctcagacaggggccgacagggag

SEQ ID NO: 101099 - DNA, 25 bp, Artificial Sequence
  Description of Artificial Sequence: Synthetic oligonucleotide
tcagacaggggccgacagggaggtt

SEQ ID NO: 101100 - DNA, 24 bp, Artificial Sequence
  Description of Artificial Sequence: Synthetic oligonucleotide
cagacaggggccgacagggaggtt

SEQ ID NO: 101101 - DNA, 25 bp, Artificial Sequence
  Description of Artificial Sequence: Synthetic oligonucleotide
agacaggggccgacagggaggttca

SEQ ID NO: 101102 - DNA, 24 bp, Artificial Sequence
  Description of Artificial Sequence: Synthetic oligonucleotide
gacaggggccgacagggaggttca

SEQ ID NO: 101103 - DNA, 25 bp, Artificial Sequence
  Description of Artificial Sequence: Synthetic oligonucleotide
acaggggccgacagggaggttcaga

SEQ ID NO: 101104 - DNA, 24 bp, Artificial Sequence
  Description of Artificial Sequence: Synthetic oligonucleotide
caggggccgacagggaggttcaga

SEQ ID NO: 101105 - DNA, 24 bp, Artificial Sequence
  Description of Artificial Sequence: Synthetic oligonucleotide
aggggccgacagggaggttcagag

SEQ ID NO: 101106 - DNA, 23 bp, Artificial Sequence
  Description of Artificial Sequence: Synthetic oligonucleotide
ggggccgacagggaggttcagag

SEQ ID NO: 101107 - DNA, 25 bp, Artificial Sequence
  Description of Artificial Sequence: Synthetic oligonucleotide
gggccgacagggaggttcagaggat

SEQ ID NO: 101108 - DNA, 25 bp, Artificial Sequence
  Description of Artificial Sequence: Synthetic oligonucleotide
ggccgacagggaggttcagaggatc

SEQ ID NO: 101109 - DNA, 26 bp, Artificial Sequence
  Description of Artificial Sequence: Synthetic oligonucleotide
gccgacagggaggttcagaggatcct

SEQ ID NO: 101110 - DNA, 26 bp, Artificial Sequence
  Description of Artificial Sequence: Synthetic oligonucleotide
ccgacagggaggttcagaggatcctg

SEQ ID NO: 101111 - DNA, 27 bp, Artificial Sequence
  Description of Artificial Sequence: Synthetic oligonucleotide
cgacagggaggttcagaggatcctgct

SEQ ID NO: 101112 - DNA, 27 bp, Artificial Sequence
  Description of Artificial Sequence: Synthetic oligonucleotide
gacagggaggttcagaggatcctgctg

SEQ ID NO: 101113 - DNA, 27 bp, Artificial Sequence
  Description of Artificial Sequence: Synthetic oligonucleotide
acagggaggttcagaggatcctgctgg

SEQ ID NO: 101114 - DNA, 27 bp, Artificial Sequence
  Description of Artificial Sequence: Synthetic oligonucleotide
cagggaggttcagaggatcctgctgga

SEQ ID NO: 101115 - DNA, 27 bp, Artificial Sequence
  Description of Artificial Sequence: Synthetic oligonucleotide
agggaggttcagaggatcctgctggag

SEQ ID NO: 101116 - DNA, 26 bp, Artificial Sequence
  Description of Artificial Sequence: Synthetic oligonucleotide
gggaggttcagaggatcctgctggag

SEQ ID NO: 101117 - DNA, 27 bp, Artificial Sequence
  Description of Artificial Sequence: Synthetic oligonucleotide
ggaggttcagaggatcctgctggagct

SEQ ID NO: 101118 - DNA, 27 bp, Artificial Sequence
  Description of Artificial Sequence: Synthetic oligonucleotide
gaggttcagaggatcctgctggagctg

SEQ ID NO: 101119 - DNA, 27 bp, Artificial Sequence
  Description of Artificial Sequence: Synthetic oligonucleotide
aggttcagaggatcctgctggagctgc

SEQ ID NO: 101120 - DNA, 27 bp, Artificial Sequence
  Description of Artificial Sequence: Synthetic oligonucleotide
ggttcagaggatcctgctggagctgct

SEQ ID NO: 101121 - DNA, 27 bp, Artificial Sequence
  Description of Artificial Sequence: Synthetic oligonucleotide
gttcagaggatcctgctggagctgctg

SEQ ID NO: 101122 - DNA, 30 bp, Artificial Sequence
  Description of Artificial Sequence: Synthetic oligonucleotide
ttcagaggatcctgctggagctgctgaatc

SEQ ID NO: 101123 - DNA, 29 bp, Artificial Sequence
  Description of Artificial Sequence: Synthetic oligonucleotide
tcagaggatcctgctggagctgctgaatc

SEQ ID NO: 101124 - DNA, 28 bp, Artificial Sequence
  Description of Artificial Sequence: Synthetic oligonucleotide
cagaggatcctgctggagctgctgaatc

SEQ ID NO: 101125 - DNA, 29 bp, Artificial Sequence
  Description of Artificial Sequence: Synthetic oligonucleotide
agaggatcctgctggagctgctgaatcag

SEQ ID NO: 101126 - DNA, 28 bp, Artificial Sequence
  Description of Artificial Sequence: Synthetic oligonucleotide
gaggatcctgctggagctgctgaatcag

SEQ ID NO: 101127 - DNA, 30 bp, Artificial Sequence
  Description of Artificial Sequence: Synthetic oligonucleotide
aggatcctgctggagctgctgaatcagatg

SEQ ID NO: 101128 - DNA, 29 bp, Artificial Sequence
  Description of Artificial Sequence: Synthetic oligonucleotide
ggatcctgctggagctgctgaatcagatg

SEQ ID NO: 101129 - DNA, 29 bp, Artificial Sequence
  Description of Artificial Sequence: Synthetic oligonucleotide
gatcctgctggagctgctgaatcagatgg

SEQ ID NO: 101130 - DNA, 31 bp, Artificial Sequence
  Description of Artificial Sequence: Synthetic oligonucleotide
atcctgctggagctgctgaatcagatggatg

SEQ ID NO: 101131 - DNA, 30 bp, Artificial Sequence
  Description of Artificial Sequence: Synthetic oligonucleotide
tcctgctggagctgctgaatcagatggatg

SEQ ID NO: 101132 - DNA, 29 bp, Artificial Sequence
  Description of Artificial Sequence: Synthetic oligonucleotide
cctgctggagctgctgaatcagatggatg

SEQ ID NO: 101133 - DNA, 29 bp, Artificial Sequence
  Description of Artificial Sequence: Synthetic oligonucleotide
ctgctggagctgctgaatcagatggatgg

SEQ ID NO: 101134 - DNA, 33 bp, Artificial Sequence
  Description of Artificial Sequence: Synthetic oligonucleotide
tgctggagctgctgaatcagatggatggatttg

SEQ ID NO: 101135 - DNA, 32 bp, Artificial Sequence
  Description of Artificial Sequence: Synthetic oligonucleotide
gctggagctgctgaatcagatggatggatttg

SEQ ID NO: 101136 - DNA, 34 bp, Artificial Sequence
  Description of Artificial Sequence: Synthetic oligonucleotide
ctggagctgctgaatcagatggatggatttgatc

SEQ ID NO: 101137 - DNA, 35 bp, Artificial Sequence
  Description of Artificial Sequence: Synthetic oligonucleotide
tggagctgctgaatcagatggatggatttgatcag

SEQ ID NO: 101138 - DNA, 34 bp, Artificial Sequence
  Description of Artificial Sequence: Synthetic oligonucleotide
ggagctgctgaatcagatggatggatttgatcag

SEQ ID NO: 101139 - DNA, 37 bp, Artificial Sequence
  Description of Artificial Sequence: Synthetic oligonucleotide
gagctgctgaatcagatggatggatttgatcagaatg

SEQ ID NO: 101140 - DNA, 38 bp, Artificial Sequence
  Description of Artificial Sequence: Synthetic oligonucleotide
agctgctgaatcagatggatggatttgatcagaatgtc

SEQ ID NO: 101141 - DNA, 37 bp, Artificial Sequence
  Description of Artificial Sequence: Synthetic oligonucleotide
gctgctgaatcagatggatggatttgatcagaatgtc

SEQ ID NO: 101142 - DNA, 40 bp, Artificial Sequence
  Description of Artificial Sequence: Synthetic oligonucleotide
ctgctgaatcagatggatggatttgatcagaatgtcaatg

SEQ ID NO: 101143 - DNA, 41 bp, Artificial Sequence
  Description of Artificial Sequence: Synthetic oligonucleotide
tgctgaatcagatggatggatttgatcagaatgtcaatgtc

SEQ ID NO: 101144 - DNA, 40 bp, Artificial Sequence
  Description of Artificial Sequence: Synthetic oligonucleotide
gctgaatcagatggatggatttgatcagaatgtcaatgtc

SEQ ID NO: 101145 - DNA, 42 bp, Artificial Sequence
  Description of Artificial Sequence: Synthetic oligonucleotide
ctgaatcagatggatggatttgatcagaatgtcaatgtcaag

SEQ ID NO: 101146 - DNA, 42 bp, Artificial Sequence
  Description of Artificial Sequence: Synthetic oligonucleotide
tgaatcagatggatggatttgatcagaatgtcaatgtcaagg

SEQ ID NO: 101147 - DNA, 41 bp, Artificial Sequence
  Description of Artificial Sequence: Synthetic oligonucleotide
gaatcagatggatggatttgatcagaatgtcaatgtcaagg

SEQ ID NO: 101148 - DNA, 45 bp, Artificial Sequence
  Description of Artificial Sequence: Synthetic oligonucleotide
aatcagatggatggatttgatcagaatgtcaatgtcaaggtaatc

SEQ ID NO: 101149 - DNA, 44 bp, Artificial Sequence
  Description of Artificial Sequence: Synthetic oligonucleotide
atcagatggatggatttgatcagaatgtcaatgtcaaggtaatc

SEQ ID NO: 101150 - DNA, 43 bp, Artificial Sequence
  Description of Artificial Sequence: Synthetic oligonucleotide
tcagatggatggatttgatcagaatgtcaatgtcaaggtaatc

SEQ ID NO: 101151 - DNA, 42 bp, Artificial Sequence
  Description of Artificial Sequence: Synthetic oligonucleotide
cagatggatggatttgatcagaatgtcaatgtcaaggtaatc

SEQ ID NO: 101152 - DNA, 44 bp, Artificial Sequence
  Description of Artificial Sequence: Synthetic oligonucleotide
agatggatggatttgatcagaatgtcaatgtcaaggtaatcatg

SEQ ID NO: 101153 - DNA, 43 bp, Artificial Sequence
  Description of Artificial Sequence: Synthetic oligonucleotide
gatggatggatttgatcagaatgtcaatgtcaaggtaatcatg

SEQ ID NO: 101154 - DNA, 43 bp, Artificial Sequence
  Description of Artificial Sequence: Synthetic oligonucleotide
atggatggatttgatcagaatgtcaatgtcaaggtaatcatgg

SEQ ID NO: 101155 - DNA, 42 bp, Artificial Sequence
  Description of Artificial Sequence: Synthetic oligonucleotide
tggatggatttgatcagaatgtcaatgtcaaggtaatcatgg

SEQ ID NO: 101156 - DNA, 41 bp, Artificial Sequence
  Description of Artificial Sequence: Synthetic oligonucleotide
ggatggatttgatcagaatgtcaatgtcaaggtaatcatgg

SEQ ID NO: 101157 - DNA, 41 bp, Artificial Sequence
  Description of Artificial Sequence: Synthetic oligonucleotide
gatggatttgatcagaatgtcaatgtcaaggtaatcatggc

SEQ ID NO: 101158 - DNA, 41 bp, Artificial Sequence
  Description of Artificial Sequence: Synthetic oligonucleotide
atggatttgatcagaatgtcaatgtcaaggtaatcatggcc

SEQ ID NO: 101159 - DNA, 40 bp, Artificial Sequence
  Description of Artificial Sequence: Synthetic oligonucleotide
tggatttgatcagaatgtcaatgtcaaggtaatcatggcc

SEQ ID NO: 101160 - DNA, 39 bp, Artificial Sequence
  Description of Artificial Sequence: Synthetic oligonucleotide
ggatttgatcagaatgtcaatgtcaaggtaatcatggcc

SEQ ID NO: 101161 - DNA, 40 bp, Artificial Sequence
  Description of Artificial Sequence: Synthetic oligonucleotide
gatttgatcagaatgtcaatgtcaaggtaatcatggccac

SEQ ID NO: 101162 - DNA, 43 bp, Artificial Sequence
  Description of Artificial Sequence: Synthetic oligonucleotide
atttgatcagaatgtcaatgtcaaggtaatcatggccacaaac

SEQ ID NO: 101163 - DNA, 42 bp, Artificial Sequence
  Description of Artificial Sequence: Synthetic oligonucleotide
tttgatcagaatgtcaatgtcaaggtaatcatggccacaaac

SEQ ID NO: 101164 - DNA, 41 bp, Artificial Sequence
  Description of Artificial Sequence: Synthetic oligonucleotide
ttgatcagaatgtcaatgtcaaggtaatcatggccacaaac

SEQ ID NO: 101165 - DNA, 40 bp, Artificial Sequence
  Description of Artificial Sequence: Synthetic oligonucleotide
tgatcagaatgtcaatgtcaaggtaatcatggccacaaac

SEQ ID NO: 101166 - DNA, 39 bp, Artificial Sequence
  Description of Artificial Sequence: Synthetic oligonucleotide
gatcagaatgtcaatgtcaaggtaatcatggccacaaac

SEQ ID NO: 101167 - DNA, 40 bp, Artificial Sequence
  Description of Artificial Sequence: Synthetic oligonucleotide
atcagaatgtcaatgtcaaggtaatcatggccacaaacag

SEQ ID NO: 101168 - DNA, 39 bp, Artificial Sequence
  Description of Artificial Sequence: Synthetic oligonucleotide
tcagaatgtcaatgtcaaggtaatcatggccacaaacag

SEQ ID NO: 101169 - DNA, 38 bp, Artificial Sequence
  Description of Artificial Sequence: Synthetic oligonucleotide
cagaatgtcaatgtcaaggtaatcatggccacaaacag

SEQ ID NO: 101170 - DNA, 39 bp, Artificial Sequence
  Description of Artificial Sequence: Synthetic oligonucleotide
agaatgtcaatgtcaaggtaatcatggccacaaacagag

SEQ ID NO: 101171 - DNA, 38 bp, Artificial Sequence
  Description of Artificial Sequence: Synthetic oligonucleotide
gaatgtcaatgtcaaggtaatcatggccacaaacagag

SEQ ID NO: 101172 - DNA, 38 bp, Artificial Sequence
  Description of Artificial Sequence: Synthetic oligonucleotide
aatgtcaatgtcaaggtaatcatggccacaaacagagc

SEQ ID NO: 101173 - DNA, 37 bp, Artificial Sequence
  Description of Artificial Sequence: Synthetic oligonucleotide
atgtcaatgtcaaggtaatcatggccacaaacagagc

SEQ ID NO: 101174 - DNA, 36 bp, Artificial Sequence
  Description of Artificial Sequence: Synthetic oligonucleotide
tgtcaatgtcaaggtaatcatggccacaaacagagc

SEQ ID NO: 101175 - DNA, 35 bp, Artificial Sequence
  Description of Artificial Sequence: Synthetic oligonucleotide
gtcaatgtcaaggtaatcatggccacaaacagagc

SEQ ID NO: 101176 - DNA, 36 bp, Artificial Sequence
  Description of Artificial Sequence: Synthetic oligonucleotide
tcaatgtcaaggtaatcatggccacaaacagagcag

SEQ ID NO: 101177 - DNA, 35 bp, Artificial Sequence
  Description of Artificial Sequence: Synthetic oligonucleotide
caatgtcaaggtaatcatggccacaaacagagcag

SEQ ID NO: 101178 - DNA, 36 bp, Artificial Sequence
  Description of Artificial Sequence: Synthetic oligonucleotide
aatgtcaaggtaatcatggccacaaacagagcagac

SEQ ID NO: 101179 - DNA, 35 bp, Artificial Sequence
  Description of Artificial Sequence: Synthetic oligonucleotide
atgtcaaggtaatcatggccacaaacagagcagac

SEQ ID NO: 101180 - DNA, 34 bp, Artificial Sequence
  Description of Artificial Sequence: Synthetic oligonucleotide
tgtcaaggtaatcatggccacaaacagagcagac

SEQ ID NO: 101181 - DNA, 33 bp, Artificial Sequence
  Description of Artificial Sequence: Synthetic oligonucleotide
gtcaaggtaatcatggccacaaacagagcagac

SEQ ID NO: 101182 - DNA, 34 bp, Artificial Sequence
  Description of Artificial Sequence: Synthetic oligonucleotide
tcaaggtaatcatggccacaaacagagcagacac

SEQ ID NO: 101183 - DNA, 33 bp, Artificial Sequence
  Description of Artificial Sequence: Synthetic oligonucleotide
caaggtaatcatggccacaaacagagcagacac

SEQ ID NO: 101184 - DNA, 33 bp, Artificial Sequence
  Description of Artificial Sequence: Synthetic oligonucleotide
aaggtaatcatggccacaaacagagcagacacc

SEQ ID NO: 101185 - DNA, 32 bp, Artificial Sequence
  Description of Artificial Sequence: Synthetic oligonucleotide
aggtaatcatggccacaaacagagcagacacc

SEQ ID NO: 101186 - DNA, 31 bp, Artificial Sequence
  Description of Artificial Sequence: Synthetic oligonucleotide
ggtaatcatggccacaaacagagcagacacc

SEQ ID NO: 101187 - DNA, 31 bp, Artificial Sequence
  Description of Artificial Sequence: Synthetic oligonucleotide
gtaatcatggccacaaacagagcagacaccc

SEQ ID NO: 101188 - DNA, 32 bp, Artificial Sequence
  Description of Artificial Sequence: Synthetic oligonucleotide
taatcatggccacaaacagagcagacaccctg

SEQ ID NO: 101189 - DNA, 31 bp, Artificial Sequence
  Description of Artificial Sequence: Synthetic oligonucleotide
aatcatggccacaaacagagcagacaccctg

SEQ ID NO: 101190 - DNA, 30 bp, Artificial Sequence
  Description of Artificial Sequence: Synthetic oligonucleotide
atcatggccacaaacagagcagacaccctg

SEQ ID NO: 101191 - DNA, 29 bp, Artificial Sequence
  Description of Artificial Sequence: Synthetic oligonucleotide
tcatggccacaaacagagcagacaccctg

SEQ ID NO: 101192 - DNA, 28 bp, Artificial Sequence
  Description of Artificial Sequence: Synthetic oligonucleotide
catggccacaaacagagcagacaccctg

SEQ ID NO: 101193 - DNA, 28 bp, Artificial Sequence
  Description of Artificial Sequence: Synthetic oligonucleotide
atggccacaaacagagcagacaccctgg

SEQ ID NO: 101194 - DNA, 27 bp, Artificial Sequence
  Description of Artificial Sequence: Synthetic oligonucleotide
tggccacaaacagagcagacaccctgg

SEQ ID NO: 101195 - DNA, 27 bp, Artificial Sequence
  Description of Artificial Sequence: Synthetic oligonucleotide
ggccacaaacagagcagacaccctgga

SEQ ID NO: 101196 - DNA, 28 bp, Artificial Sequence
  Description of Artificial Sequence: Synthetic oligonucleotide
gccacaaacagagcagacaccctggatc

SEQ ID NO: 101197 - DNA, 28 bp, Artificial Sequence
  Description of Artificial Sequence: Synthetic oligonucleotide
ccacaaacagagcagacaccctggatcc

SEQ ID NO: 101198 - DNA, 28 bp, Artificial Sequence
  Description of Artificial Sequence: Synthetic oligonucleotide
cacaaacagagcagacaccctggatccg

SEQ ID NO: 101199 - DNA, 28 bp, Artificial Sequence
  Description of Artificial Sequence: Synthetic oligonucleotide
acaaacagagcagacaccctggatccgg

SEQ ID NO: 101200 - DNA, 27 bp, Artificial Sequence
  Description of Artificial Sequence: Synthetic oligonucleotide
caaacagagcagacaccctggatccgg

SEQ ID NO: 101201 - DNA, 27 bp, Artificial Sequence
  Description of Artificial Sequence: Synthetic oligonucleotide
aaacagagcagacaccctggatccggc

SEQ ID NO: 101202 - DNA, 26 bp, Artificial Sequence
  Description of Artificial Sequence: Synthetic oligonucleotide
aacagagcagacaccctggatccggc

SEQ ID NO: 101203 - DNA, 25 bp, Artificial Sequence
  Description of Artificial Sequence: Synthetic oligonucleotide
acagagcagacaccctggatccggc

SEQ ID NO: 101204 - DNA, 24 bp, Artificial Sequence
  Description of Artificial Sequence: Synthetic oligonucleotide
cagagcagacaccctggatccggc

SEQ ID NO: 101205 - DNA, 24 bp, Artificial Sequence
  Description of Artificial Sequence: Synthetic oligonucleotide
agagcagacaccctggatccggcc

SEQ ID NO: 101206 - DNA, 23 bp, Artificial Sequence
  Description of Artificial Sequence: Synthetic oligonucleotide
gagcagacaccctggatccggcc

SEQ ID NO: 101207 - DNA, 24 bp, Artificial Sequence
  Description of Artificial Sequence: Synthetic oligonucleotide
agcagacaccctggatccggccct

SEQ ID NO: 101208 - DNA, 23 bp, Artificial Sequence
  Description of Artificial Sequence: Synthetic oligonucleotide
gcagacaccctggatccggccct

SEQ ID NO: 101209 - DNA, 23 bp, Artificial Sequence
  Description of Artificial Sequence: Synthetic oligonucleotide
cagacaccctggatccggccctg

SEQ ID NO: 101210 - DNA, 25 bp, Artificial Sequence
  Description of Artificial Sequence: Synthetic oligonucleotide
agacaccctggatccggccctgcta

SEQ ID NO: 101211 - DNA, 24 bp, Artificial Sequence
  Description of Artificial Sequence: Synthetic oligonucleotide
gacaccctggatccggccctgcta

SEQ ID NO: 101212 - DNA, 24 bp, Artificial Sequence
  Description of Artificial Sequence: Synthetic oligonucleotide
acaccctggatccggccctgctac

SEQ ID NO: 101213 - DNA, 23 bp, Artificial Sequence
  Description of Artificial Sequence: Synthetic oligonucleotide
caccctggatccggccctgctac

SEQ ID NO: 101214 - DNA, 23 bp, Artificial Sequence
  Description of Artificial Sequence: Synthetic oligonucleotide
accctggatccggccctgctacg

SEQ ID NO: 101215 - DNA, 22 bp, Artificial Sequence
  Description of Artificial Sequence: Synthetic oligonucleotide
ccctggatccggccctgctacg

SEQ ID NO: 101216 - DNA, 22 bp, Artificial Sequence
  Description of Artificial Sequence: Synthetic oligonucleotide
cctggatccggccctgctacgg

SEQ ID NO: 101217 - DNA, 22 bp, Artificial Sequence
  Description of Artificial Sequence: Synthetic oligonucleotide
ctggatccggccctgctacggc

SEQ ID NO: 101218 - DNA, 23 bp, Artificial Sequence
  Description of Artificial Sequence: Synthetic oligonucleotide
tggatccggccctgctacggcca

SEQ ID NO: 101219 - DNA, 22 bp, Artificial Sequence
  Description of Artificial Sequence: Synthetic oligonucleotide
ggatccggccctgctacggcca

SEQ ID NO: 101220 - DNA, 22 bp, Artificial Sequence
  Description of Artificial Sequence: Synthetic oligonucleotide
gatccggccctgctacggccag

SEQ ID NO: 101221 - DNA, 23 bp, Artificial Sequence
  Description of Artificial Sequence: Synthetic oligonucleotide
atccggccctgctacggccagga

SEQ ID NO: 101222 - DNA, 22 bp, Artificial Sequence
  Description of Artificial Sequence: Synthetic oligonucleotide
tccggccctgctacggccagga

SEQ ID NO: 101223 - DNA, 21 bp, Artificial Sequence
  Description of Artificial Sequence: Synthetic oligonucleotide
ccggccctgctacggccagga

SEQ ID NO: 101224 - DNA, 21 bp, Artificial Sequence
  Description of Artificial Sequence: Synthetic oligonucleotide
cggccctgctacggccaggac

SEQ ID NO: 101225 - DNA, 21 bp, Artificial Sequence
  Description of Artificial Sequence: Synthetic oligonucleotide
ggccctgctacggccaggacg

SEQ ID NO: 101226 - DNA, 21 bp, Artificial Sequence
  Description of Artificial Sequence: Synthetic oligonucleotide
gccctgctacggccaggacgg

SEQ ID NO: 101227 - DNA, 22 bp, Artificial Sequence
  Description of Artificial Sequence: Synthetic oligonucleotide
ccctgctacggccaggacggct

SEQ ID NO: 101228 - DNA, 22 bp, Artificial Sequence
  Description of Artificial Sequence: Synthetic oligonucleotide
cctgctacggccaggacggctg

SEQ ID NO: 101229 - DNA, 23 bp, Artificial Sequence
  Description of Artificial Sequence: Synthetic oligonucleotide
ctgctacggccaggacggctgga

SEQ ID NO: 101230 - DNA, 23 bp, Artificial Sequence
  Description of Artificial Sequence: Synthetic oligonucleotide
tgctacggccaggacggctggac

SEQ ID NO: 101231 - DNA, 22 bp, Artificial Sequence
  Description of Artificial Sequence: Synthetic oligonucleotide
gctacggccaggacggctggac

SEQ ID NO: 101232 - DNA, 22 bp, Artificial Sequence
  Description of Artificial Sequence: Synthetic oligonucleotide
ctacggccaggacggctggacc

SEQ ID NO: 101233 - DNA, 27 bp, Artificial Sequence
  Description of Artificial Sequence: Synthetic oligonucleotide
tacggccaggacggctggaccgtaaaa

SEQ ID NO: 101234 - DNA, 27 bp, Artificial Sequence
  Description of Artificial Sequence: Synthetic oligonucleotide
acggccaggacggctggaccgtaaaat

SEQ ID NO: 101235 - DNA, 27 bp, Artificial Sequence
  Description of Artificial Sequence: Synthetic oligonucleotide
cggccaggacggctggaccgtaaaatt

SEQ ID NO: 101236 - DNA, 27 bp, Artificial Sequence
  Description of Artificial Sequence: Synthetic oligonucleotide
ggccaggacggctggaccgtaaaattg

SEQ ID NO: 101237 - DNA, 32 bp, Artificial Sequence
  Description of Artificial Sequence: Synthetic oligonucleotide
gccaggacggctggaccgtaaaattgaatttc

SEQ ID NO: 101238 - DNA, 32 bp, Artificial Sequence
  Description of Artificial Sequence: Synthetic oligonucleotide
ccaggacggctggaccgtaaaattgaatttcc

SEQ ID NO: 101239 - DNA, 33 bp, Artificial Sequence
  Description of Artificial Sequence: Synthetic oligonucleotide
caggacggctggaccgtaaaattgaatttccac

SEQ ID NO: 101240 - DNA, 35 bp, Artificial Sequence
  Description of Artificial Sequence: Synthetic oligonucleotide
aggacggctggaccgtaaaattgaatttccacttc

SEQ ID NO: 101241 - DNA, 34 bp, Artificial Sequence
  Description of Artificial Sequence: Synthetic oligonucleotide
ggacggctggaccgtaaaattgaatttccacttc

SEQ ID NO: 101242 - DNA, 34 bp, Artificial Sequence
  Description of Artificial Sequence: Synthetic oligonucleotide
gacggctggaccgtaaaattgaatttccacttcc

SEQ ID NO: 101243 - DNA, 35 bp, Artificial Sequence
  Description of Artificial Sequence: Synthetic oligonucleotide
acggctggaccgtaaaattgaatttccacttcctg

SEQ ID NO: 101244 - DNA, 34 bp, Artificial Sequence
  Description of Artificial Sequence: Synthetic oligonucleotide
cggctggaccgtaaaattgaatttccacttcctg

SEQ ID NO: 101245 - DNA, 35 bp, Artificial Sequence
  Description of Artificial Sequence: Synthetic oligonucleotide
ggctggaccgtaaaattgaatttccacttcctgac

SEQ ID NO: 101246 - DNA, 35 bp, Artificial Sequence
  Description of Artificial Sequence: Synthetic oligonucleotide
gctggaccgtaaaattgaatttccacttcctgacc

SEQ ID NO: 101247 - DNA, 35 bp, Artificial Sequence
  Description of Artificial Sequence: Synthetic oligonucleotide
ctggaccgtaaaattgaatttccacttcctgaccg

SEQ ID NO: 101248 - DNA, 35 bp, Artificial Sequence
  Description of Artificial Sequence: Synthetic oligonucleotide
tggaccgtaaaattgaatttccacttcctgaccgc

SEQ ID NO: 101249 - DNA, 34 bp, Artificial Sequence
  Description of Artificial Sequence: Synthetic oligonucleotide
ggaccgtaaaattgaatttccacttcctgaccgc

SEQ ID NO: 101250 - DNA, 34 bp, Artificial Sequence
  Description of Artificial Sequence: Synthetic oligonucleotide
gaccgtaaaattgaatttccacttcctgaccgcc

SEQ ID NO: 101251 - DNA, 34 bp, Artificial Sequence
  Description of Artificial Sequence: Synthetic oligonucleotide
accgtaaaattgaatttccacttcctgaccgccg

SEQ ID NO: 101252 - DNA, 33 bp, Artificial Sequence
  Description of Artificial Sequence: Synthetic oligonucleotide
ccgtaaaattgaatttccacttcctgaccgccg

SEQ ID NO: 101253 - DNA, 33 bp, Artificial Sequence
  Description of Artificial Sequence: Synthetic oligonucleotide
cgtaaaattgaatttccacttcctgaccgccgc

SEQ ID NO: 101254 - DNA, 33 bp, Artificial Sequence
  Description of Artificial Sequence: Synthetic oligonucleotide
gtaaaattgaatttccacttcctgaccgccgcc

SEQ ID NO: 101255 - DNA, 34 bp, Artificial Sequence
  Description of Artificial Sequence: Synthetic oligonucleotide
taaaattgaatttccacttcctgaccgccgccag

SEQ ID NO: 101256 - DNA, 33 bp, Artificial Sequence
  Description of Artificial Sequence: Synthetic oligonucleotide
aaaattgaatttccacttcctgaccgccgccag

SEQ ID NO: 101257 - DNA, 32 bp, Artificial Sequence
  Description of Artificial Sequence: Synthetic oligonucleotide
aaattgaatttccacttcctgaccgccgccag

SEQ ID NO: 101258 - DNA, 31 bp, Artificial Sequence
  Description of Artificial Sequence: Synthetic oligonucleotide
aattgaatttccacttcctgaccgccgccag

SEQ ID NO: 101259 - DNA, 30 bp, Artificial Sequence
  Description of Artificial Sequence: Synthetic oligonucleotide
attgaatttccacttcctgaccgccgccag

SEQ ID NO: 101260 - DNA, 29 bp, Artificial Sequence
  Description of Artificial Sequence: Synthetic oligonucleotide
ttgaatttccacttcctgaccgccgccag

SEQ ID NO: 101261 - DNA, 28 bp, Artificial Sequence
  Description of Artificial Sequence: Synthetic oligonucleotide
tgaatttccacttcctgaccgccgccag

SEQ ID NO: 101262 - DNA, 27 bp, Artificial Sequence
  Description of Artificial Sequence: Synthetic oligonucleotide
gaatttccacttcctgaccgccgccag

SEQ ID NO: 101263 - DNA, 29 bp, Artificial Sequence
  Description of Artificial Sequence: Synthetic oligonucleotide
aatttccacttcctgaccgccgccagaag

SEQ ID NO: 101264 - DNA, 28 bp, Artificial Sequence
  Description of Artificial Sequence: Synthetic oligonucleotide
atttccacttcctgaccgccgccagaag

SEQ ID NO: 101265 - DNA, 27 bp, Artificial Sequence
  Description of Artificial Sequence: Synthetic oligonucleotide
tttccacttcctgaccgccgccagaag

SEQ ID NO: 101266 - DNA, 27 bp, Artificial Sequence
  Description of Artificial Sequence: Synthetic oligonucleotide
ttccacttcctgaccgccgccagaaga

SEQ ID NO: 101267 - DNA, 26 bp, Artificial Sequence
  Description of Artificial Sequence: Synthetic oligonucleotide
tccacttcctgaccgccgccagaaga

SEQ ID NO: 101268 - DNA, 25 bp, Artificial Sequence
  Description of Artificial Sequence: Synthetic oligonucleotide
ccacttcctgaccgccgccagaaga

SEQ ID NO: 101269 - DNA, 27 bp, Artificial Sequence
  Description of Artificial Sequence: Synthetic oligonucleotide
cacttcctgaccgccgccagaagagat

SEQ ID NO: 101270 - DNA, 28 bp, Artificial Sequence
  Description of Artificial Sequence: Synthetic oligonucleotide
acttcctgaccgccgccagaagagattg

SEQ ID NO: 101271 - DNA, 27 bp, Artificial Sequence
  Description of Artificial Sequence: Synthetic oligonucleotide
cttcctgaccgccgccagaagagattg

SEQ ID NO: 101272 - DNA, 32 bp, Artificial Sequence
  Description of Artificial Sequence: Synthetic oligonucleotide
ttcctgaccgccgccagaagagattgattttc

SEQ ID NO: 101273 - DNA, 31 bp, Artificial Sequence
  Description of Artificial Sequence: Synthetic oligonucleotide
tcctgaccgccgccagaagagattgattttc

SEQ ID NO: 101274 - DNA, 30 bp, Artificial Sequence
  Description of Artificial Sequence: Synthetic oligonucleotide
cctgaccgccgccagaagagattgattttc

SEQ ID NO: 101275 - DNA, 31 bp, Artificial Sequence
  Description of Artificial Sequence: Synthetic oligonucleotide
ctgaccgccgccagaagagattgattttctc

SEQ ID NO: 101276 - DNA, 31 bp, Artificial Sequence
  Description of Artificial Sequence: Synthetic oligonucleotide
tgaccgccgccagaagagattgattttctcc

SEQ ID NO: 101277 - DNA, 30 bp, Artificial Sequence
  Description of Artificial Sequence: Synthetic oligonucleotide
gaccgccgccagaagagattgattttctcc

SEQ ID NO: 101278 - DNA, 31 bp, Artificial Sequence
  Description of Artificial Sequence: Synthetic oligonucleotide
accgccgccagaagagattgattttctccac

SEQ ID NO: 101279 - DNA, 30 bp, Artificial Sequence
  Description of Artificial Sequence: Synthetic oligonucleotide
ccgccgccagaagagattgattttctccac

SEQ ID NO: 101280 - DNA, 33 bp, Artificial Sequence
  Description of Artificial Sequence: Synthetic oligonucleotide
cgccgccagaagagattgattttctccactatc

SEQ ID NO: 101281 - DNA, 34 bp, Artificial Sequence
  Description of Artificial Sequence: Synthetic oligonucleotide
gccgccagaagagattgattttctccactatcac

SEQ ID NO: 101282 - DNA, 36 bp, Artificial Sequence
  Description of Artificial Sequence: Synthetic oligonucleotide
ccgccagaagagattgattttctccactatcactag

SEQ ID NO: 101283 - DNA, 36 bp, Artificial Sequence
  Description of Artificial Sequence: Synthetic oligonucleotide
cgccagaagagattgattttctccactatcactagc

SEQ ID NO: 101284 - DNA, 38 bp, Artificial Sequence
  Description of Artificial Sequence: Synthetic oligonucleotide
gccagaagagattgattttctccactatcactagcaag

SEQ ID NO: 101285 - DNA, 40 bp, Artificial Sequence
  Description of Artificial Sequence: Synthetic oligonucleotide
ccagaagagattgattttctccactatcactagcaagatg

SEQ ID NO: 101286 - DNA, 42 bp, Artificial Sequence
  Description of Artificial Sequence: Synthetic oligonucleotide
cagaagagattgattttctccactatcactagcaagatgaac

SEQ ID NO: 101287 - DNA, 42 bp, Artificial Sequence
  Description of Artificial Sequence: Synthetic oligonucleotide
agaagagattgattttctccactatcactagcaagatgaacc

SEQ ID NO: 101288 - DNA, 41 bp, Artificial Sequence
  Description of Artificial Sequence: Synthetic oligonucleotide
gaagagattgattttctccactatcactagcaagatgaacc

SEQ ID NO: 101289 - DNA, 42 bp, Artificial Sequence
  Description of Artificial Sequence: Synthetic oligonucleotide
aagagattgattttctccactatcactagcaagatgaacctc

SEQ ID NO: 101290 - DNA, 41 bp, Artificial Sequence
  Description of Artificial Sequence: Synthetic oligonucleotide
agagattgattttctccactatcactagcaagatgaacctc

SEQ ID NO: 101291 - DNA, 40 bp, Artificial Sequence
  Description of Artificial Sequence: Synthetic oligonucleotide
gagattgattttctccactatcactagcaagatgaacctc

SEQ ID NO: 101292 - DNA, 41 bp, Artificial Sequence
  Description of Artificial Sequence: Synthetic oligonucleotide
agattgattttctccactatcactagcaagatgaacctctc

SEQ ID NO: 101293 - DNA, 40 bp, Artificial Sequence
  Description of Artificial Sequence: Synthetic oligonucleotide
gattgattttctccactatcactagcaagatgaacctctc

SEQ ID NO: 101294 - DNA, 41 bp, Artificial Sequence
  Description of Artificial Sequence: Synthetic oligonucleotide
attgattttctccactatcactagcaagatgaacctctctg

SEQ ID NO: 101295 - DNA, 40 bp, Artificial Sequence
  Description of Artificial Sequence: Synthetic oligonucleotide
ttgattttctccactatcactagcaagatgaacctctctg

SEQ ID NO: 101296 - DNA, 39 bp, Artificial Sequence
  Description of Artificial Sequence: Synthetic oligonucleotide
tgattttctccactatcactagcaagatgaacctctctg

SEQ ID NO: 101297 - DNA, 38 bp, Artificial Sequence
  Description of Artificial Sequence: Synthetic oligonucleotide
gattttctccactatcactagcaagatgaacctctctg

SEQ ID NO: 101298 - DNA, 39 bp, Artificial Sequence
  Description of Artificial Sequence: Synthetic oligonucleotide
attttctccactatcactagcaagatgaacctctctgag

SEQ ID NO: 101299 - DNA, 38 bp, Artificial Sequence
  Description of Artificial Sequence: Synthetic oligonucleotide
ttttctccactatcactagcaagatgaacctctctgag

SEQ ID NO: 101300 - DNA, 37 bp, Artificial Sequence
  Description of Artificial Sequence: Synthetic oligonucleotide
tttctccactatcactagcaagatgaacctctctgag

SEQ ID NO: 101301 - DNA, 36 bp, Artificial Sequence
  Description of Artificial Sequence: Synthetic oligonucleotide
ttctccactatcactagcaagatgaacctctctgag

SEQ ID NO: 101302 - DNA, 35 bp, Artificial Sequence
  Description of Artificial Sequence: Synthetic oligonucleotide
tctccactatcactagcaagatgaacctctctgag

SEQ ID NO: 101303 - DNA, 34 bp, Artificial Sequence
  Description of Artificial Sequence: Synthetic oligonucleotide
ctccactatcactagcaagatgaacctctctgag

SEQ ID NO: 101304 - DNA, 34 bp, Artificial Sequence
  Description of Artificial Sequence: Synthetic oligonucleotide
tccactatcactagcaagatgaacctctctgagg

SEQ ID NO: 101305 - DNA, 33 bp, Artificial Sequence
  Description of Artificial Sequence: Synthetic oligonucleotide
ccactatcactagcaagatgaacctctctgagg

SEQ ID NO: 101306 - DNA, 34 bp, Artificial Sequence
  Description of Artificial Sequence: Synthetic oligonucleotide
cactatcactagcaagatgaacctctctgaggag

SEQ ID NO: 101307 - DNA, 34 bp, Artificial Sequence
  Description of Artificial Sequence: Synthetic oligonucleotide
actatcactagcaagatgaacctctctgaggagg

SEQ ID NO: 101308 - DNA, 33 bp, Artificial Sequence
  Description of Artificial Sequence: Synthetic oligonucleotide
ctatcactagcaagatgaacctctctgaggagg

SEQ ID NO: 101309 - DNA, 35 bp, Artificial Sequence
  Description of Artificial Sequence: Synthetic oligonucleotide
tatcactagcaagatgaacctctctgaggaggttg

SEQ ID NO: 101310 - DNA, 34 bp, Artificial Sequence
  Description of Artificial Sequence: Synthetic oligonucleotide
atcactagcaagatgaacctctctgaggaggttg

SEQ ID NO: 101311 - DNA, 33 bp, Artificial Sequence
  Description of Artificial Sequence: Synthetic oligonucleotide
tcactagcaagatgaacctctctgaggaggttg

SEQ ID NO: 101312 - DNA, 32 bp, Artificial Sequence
  Description of Artificial Sequence: Synthetic oligonucleotide
cactagcaagatgaacctctctgaggaggttg

SEQ ID NO: 101313 - DNA, 33 bp, Artificial Sequence
  Description of Artificial Sequence: Synthetic oligonucleotide
actagcaagatgaacctctctgaggaggttgac

SEQ ID NO: 101314 - DNA, 32 bp, Artificial Sequence
  Description of Artificial Sequence: Synthetic oligonucleotide
ctagcaagatgaacctctctgaggaggttgac

SEQ ID NO: 101315 - DNA, 34 bp, Artificial Sequence
  Description of Artificial Sequence: Synthetic oligonucleotide
tagcaagatgaacctctctgaggaggttgacttg

SEQ ID NO: 101316 - DNA, 33 bp, Artificial Sequence
  Description of Artificial Sequence: Synthetic oligonucleotide
agcaagatgaacctctctgaggaggttgacttg

SEQ ID NO: 101317 - DNA, 32 bp, Artificial Sequence
  Description of Artificial Sequence: Synthetic oligonucleotide
gcaagatgaacctctctgaggaggttgacttg

SEQ ID NO: 101318 - DNA, 32 bp, Artificial Sequence
  Description of Artificial Sequence: Synthetic oligonucleotide
caagatgaacctctctgaggaggttgacttgg

SEQ ID NO: 101319 - DNA, 34 bp, Artificial Sequence
  Description of Artificial Sequence: Synthetic oligonucleotide
aagatgaacctctctgaggaggttgacttggaag

SEQ ID NO: 101320 - DNA, 33 bp, Artificial Sequence
  Description of Artificial Sequence: Synthetic oligonucleotide
agatgaacctctctgaggaggttgacttggaag

SEQ ID NO: 101321 - DNA, 32 bp, Artificial Sequence
  Description of Artificial Sequence: Synthetic oligonucleotide
gatgaacctctctgaggaggttgacttggaag

SEQ ID NO: 101322 - DNA, 33 bp, Artificial Sequence
  Description of Artificial Sequence: Synthetic oligonucleotide
atgaacctctctgaggaggttgacttggaagac

SEQ ID NO: 101323 - DNA, 32 bp, Artificial Sequence
  Description of Artificial Sequence: Synthetic oligonucleotide
tgaacctctctgaggaggttgacttggaagac

SEQ ID NO: 101324 - DNA, 31 bp, Artificial Sequence
  Description of Artificial Sequence: Synthetic oligonucleotide
gaacctctctgaggaggttgacttggaagac

SEQ ID NO: 101325 - DNA, 34 bp, Artificial Sequence
  Description of Artificial Sequence: Synthetic oligonucleotide
aacctctctgaggaggttgacttggaagactatg

SEQ ID NO: 101326 - DNA, 33 bp, Artificial Sequence
  Description of Artificial Sequence: Synthetic oligonucleotide
acctctctgaggaggttgacttggaagactatg

SEQ ID NO: 101327 - DNA, 32 bp, Artificial Sequence
  Description of Artificial Sequence: Synthetic oligonucleotide
cctctctgaggaggttgacttggaagactatg

SEQ ID NO: 101328 - DNA, 33 bp, Artificial Sequence
  Description of Artificial Sequence: Synthetic oligonucleotide
ctctctgaggaggttgacttggaagactatgtg

SEQ ID NO: 101329 - DNA, 33 bp, Artificial Sequence
  Description of Artificial Sequence: Synthetic oligonucleotide
tctctgaggaggttgacttggaagactatgtgg

SEQ ID NO: 101330 - DNA, 32 bp, Artificial Sequence
  Description of Artificial Sequence: Synthetic oligonucleotide
ctctgaggaggttgacttggaagactatgtgg

SEQ ID NO: 101331 - DNA, 32 bp, Artificial Sequence
  Description of Artificial Sequence: Synthetic oligonucleotide
tctgaggaggttgacttggaagactatgtggc

SEQ ID NO: 101332 - DNA, 31 bp, Artificial Sequence
  Description of Artificial Sequence: Synthetic oligonucleotide
ctgaggaggttgacttggaagactatgtggc

SEQ ID NO: 101333 - DNA, 31 bp, Artificial Sequence
  Description of Artificial Sequence: Synthetic oligonucleotide
tgaggaggttgacttggaagactatgtggcc

SEQ ID NO: 101334 - DNA, 30 bp, Artificial Sequence
  Description of Artificial Sequence: Synthetic oligonucleotide
gaggaggttgacttggaagactatgtggcc

SEQ ID NO: 101335 - DNA, 30 bp, Artificial Sequence
  Description of Artificial Sequence: Synthetic oligonucleotide
aggaggttgacttggaagactatgtggccc

SEQ ID NO: 101336 - DNA, 29 bp, Artificial Sequence
  Description of Artificial Sequence: Synthetic oligonucleotide
ggaggttgacttggaagactatgtggccc

SEQ ID NO: 101337 - DNA, 29 bp, Artificial Sequence
  Description of Artificial Sequence: Synthetic oligonucleotide
gaggttgacttggaagactatgtggcccg

SEQ ID NO: 101338 - DNA, 29 bp, Artificial Sequence
  Description of Artificial Sequence: Synthetic oligonucleotide
aggttgacttggaagactatgtggcccgg

SEQ ID NO: 101339 - DNA, 28 bp, Artificial Sequence
  Description of Artificial Sequence: Synthetic oligonucleotide
ggttgacttggaagactatgtggcccgg

SEQ ID NO: 101340 - DNA, 28 bp, Artificial Sequence
  Description of Artificial Sequence: Synthetic oligonucleotide
gttgacttggaagactatgtggcccggc

SEQ ID NO: 101341 - DNA, 28 bp, Artificial Sequence
  Description of Artificial Sequence: Synthetic oligonucleotide
ttgacttggaagactatgtggcccggcc

SEQ ID NO: 101342 - DNA, 27 bp, Artificial Sequence
  Description of Artificial Sequence: Synthetic oligonucleotide
tgacttggaagactatgtggcccggcc

SEQ ID NO: 101343 - DNA, 27 bp, Artificial Sequence
  Description of Artificial Sequence: Synthetic oligonucleotide
gacttggaagactatgtggcccggcca

SEQ ID NO: 101344 - DNA, 27 bp, Artificial Sequence
  Description of Artificial Sequence: Synthetic oligonucleotide
acttggaagactatgtggcccggccag

SEQ ID NO: 101345 - DNA, 27 bp, Artificial Sequence
  Description of Artificial Sequence: Synthetic oligonucleotide
cttggaagactatgtggcccggccaga

SEQ ID NO: 101346 - DNA, 30 bp, Artificial Sequence
  Description of Artificial Sequence: Synthetic oligonucleotide
ttggaagactatgtggcccggccagataag

SEQ ID NO: 101347 - DNA, 29 bp, Artificial Sequence
  Description of Artificial Sequence: Synthetic oligonucleotide
tggaagactatgtggcccggccagataag

SEQ ID NO: 101348 - DNA, 28 bp, Artificial Sequence
  Description of Artificial Sequence: Synthetic oligonucleotide
ggaagactatgtggcccggccagataag

SEQ ID NO: 101349 - DNA, 32 bp, Artificial Sequence
  Description of Artificial Sequence: Synthetic oligonucleotide
gaagactatgtggcccggccagataagatttc

SEQ ID NO: 101350 - DNA, 33 bp, Artificial Sequence
  Description of Artificial Sequence: Synthetic oligonucleotide
aagactatgtggcccggccagataagatttcag

SEQ ID NO: 101351 - DNA, 32 bp, Artificial Sequence
  Description of Artificial Sequence: Synthetic oligonucleotide
agactatgtggcccggccagataagatttcag

SEQ ID NO: 101352 - DNA, 31 bp, Artificial Sequence
  Description of Artificial Sequence: Synthetic oligonucleotide
gactatgtggcccggccagataagatttcag

SEQ ID NO: 101353 - DNA, 31 bp, Artificial Sequence
  Description of Artificial Sequence: Synthetic oligonucleotide
actatgtggcccggccagataagatttcagg

SEQ ID NO: 101354 - DNA, 30 bp, Artificial Sequence
  Description of Artificial Sequence: Synthetic oligonucleotide
ctatgtggcccggccagataagatttcagg

SEQ ID NO: 101355 - DNA, 31 bp, Artificial Sequence
  Description of Artificial Sequence: Synthetic oligonucleotide
tatgtggcccggccagataagatttcaggag

SEQ ID NO: 101356 - DNA, 30 bp, Artificial Sequence
  Description of Artificial Sequence: Synthetic oligonucleotide
atgtggcccggccagataagatttcaggag

SEQ ID NO: 101357 - DNA, 29 bp, Artificial Sequence
  Description of Artificial Sequence: Synthetic oligonucleotide
tgtggcccggccagataagatttcaggag

SEQ ID NO: 101358 - DNA, 28 bp, Artificial Sequence
  Description of Artificial Sequence: Synthetic oligonucleotide
gtggcccggccagataagatttcaggag

SEQ ID NO: 101359 - DNA, 28 bp, Artificial Sequence
  Description of Artificial Sequence: Synthetic oligonucleotide
tggcccggccagataagatttcaggagc

SEQ ID NO: 101360 - DNA, 27 bp, Artificial Sequence
  Description of Artificial Sequence: Synthetic oligonucleotide
ggcccggccagataagatttcaggagc

SEQ ID NO: 101361 - DNA, 28 bp, Artificial Sequence
  Description of Artificial Sequence: Synthetic oligonucleotide
gcccggccagataagatttcaggagctg

SEQ ID NO: 101362 - DNA, 35 bp, Artificial Sequence
  Description of Artificial Sequence: Synthetic oligonucleotide
cccggccagataagatttcaggagctgatattaac

SEQ ID NO: 101363 - DNA, 36 bp, Artificial Sequence
  Description of Artificial Sequence: Synthetic oligonucleotide
ccggccagataagatttcaggagctgatattaactc

SEQ ID NO: 101364 - DNA, 36 bp, Artificial Sequence
  Description of Artificial Sequence: Synthetic oligonucleotide
cggccagataagatttcaggagctgatattaactcc

SEQ ID NO: 101365 - DNA, 38 bp, Artificial Sequence
  Description of Artificial Sequence: Synthetic oligonucleotide
ggccagataagatttcaggagctgatattaactccatc

SEQ ID NO: 101366 - DNA, 39 bp, Artificial Sequence
  Description of Artificial Sequence: Synthetic oligonucleotide
gccagataagatttcaggagctgatattaactccatctg

SEQ ID NO: 101367 - DNA, 40 bp, Artificial Sequence
  Description of Artificial Sequence: Synthetic oligonucleotide
ccagataagatttcaggagctgatattaactccatctgtc

SEQ ID NO: 101368 - DNA, 41 bp, Artificial Sequence
  Description of Artificial Sequence: Synthetic oligonucleotide
cagataagatttcaggagctgatattaactccatctgtcag

SEQ ID NO: 101369 - DNA, 41 bp, Artificial Sequence
  Description of Artificial Sequence: Synthetic oligonucleotide
agataagatttcaggagctgatattaactccatctgtcagg

SEQ ID NO: 101370 - DNA, 40 bp, Artificial Sequence
  Description of Artificial Sequence: Synthetic oligonucleotide
gataagatttcaggagctgatattaactccatctgtcagg

SEQ ID NO: 101371 - DNA, 41 bp, Artificial Sequence
  Description of Artificial Sequence: Synthetic oligonucleotide
ataagatttcaggagctgatattaactccatctgtcaggag

SEQ ID NO: 101372 - DNA, 40 bp, Artificial Sequence
  Description of Artificial Sequence: Synthetic oligonucleotide
taagatttcaggagctgatattaactccatctgtcaggag

SEQ ID NO: 101373 - DNA, 39 bp, Artificial Sequence
  Description of Artificial Sequence: Synthetic oligonucleotide
aagatttcaggagctgatattaactccatctgtcaggag

SEQ ID NO: 101374 - DNA, 38 bp, Artificial Sequence
  Description of Artificial Sequence: Synthetic oligonucleotide
agatttcaggagctgatattaactccatctgtcaggag

SEQ ID NO: 101375 - DNA, 37 bp, Artificial Sequence
  Description of Artificial Sequence: Synthetic oligonucleotide
gatttcaggagctgatattaactccatctgtcaggag

SEQ ID NO: 101376 - DNA, 38 bp, Artificial Sequence
  Description of Artificial Sequence: Synthetic oligonucleotide
atttcaggagctgatattaactccatctgtcaggagag

SEQ ID NO: 101377 - DNA, 37 bp, Artificial Sequence
  Description of Artificial Sequence: Synthetic oligonucleotide
tttcaggagctgatattaactccatctgtcaggagag

SEQ ID NO: 101378 - DNA, 36 bp, Artificial Sequence
  Description of Artificial Sequence: Synthetic oligonucleotide
ttcaggagctgatattaactccatctgtcaggagag

SEQ ID NO: 101379 - DNA, 35 bp, Artificial Sequence
  Description of Artificial Sequence: Synthetic oligonucleotide
tcaggagctgatattaactccatctgtcaggagag

SEQ ID NO: 101380 - DNA, 34 bp, Artificial Sequence
  Description of Artificial Sequence: Synthetic oligonucleotide
caggagctgatattaactccatctgtcaggagag

SEQ ID NO: 101381 - DNA, 35 bp, Artificial Sequence
  Description of Artificial Sequence: Synthetic oligonucleotide
aggagctgatattaactccatctgtcaggagagtg

SEQ ID NO: 101382 - DNA, 34 bp, Artificial Sequence
  Description of Artificial Sequence: Synthetic oligonucleotide
ggagctgatattaactccatctgtcaggagagtg

SEQ ID NO: 101383 - DNA, 34 bp, Artificial Sequence
  Description of Artificial Sequence: Synthetic oligonucleotide
gagctgatattaactccatctgtcaggagagtgg

SEQ ID NO: 101384 - DNA, 37 bp, Artificial Sequence
  Description of Artificial Sequence: Synthetic oligonucleotide
agctgatattaactccatctgtcaggagagtggaatg

SEQ ID NO: 101385 - DNA, 36 bp, Artificial Sequence
  Description of Artificial Sequence: Synthetic oligonucleotide
gctgatattaactccatctgtcaggagagtggaatg

SEQ ID NO: 101386 - DNA, 38 bp, Artificial Sequence
  Description of Artificial Sequence: Synthetic oligonucleotide
ctgatattaactccatctgtcaggagagtggaatgttg

SEQ ID NO: 101387 - DNA, 38 bp, Artificial Sequence
  Description of Artificial Sequence: Synthetic oligonucleotide
tgatattaactccatctgtcaggagagtggaatgttgg

SEQ ID NO: 101388 - DNA, 37 bp, Artificial Sequence
  Description of Artificial Sequence: Synthetic oligonucleotide
gatattaactccatctgtcaggagagtggaatgttgg

SEQ ID NO: 101389 - DNA, 37 bp, Artificial Sequence
  Description of Artificial Sequence: Synthetic oligonucleotide
atattaactccatctgtcaggagagtggaatgttggc

SEQ ID NO: 101390 - DNA, 36 bp, Artificial Sequence
  Description of Artificial Sequence: Synthetic oligonucleotide
tattaactccatctgtcaggagagtggaatgttggc

SEQ ID NO: 101391 - DNA, 35 bp, Artificial Sequence
  Description of Artificial Sequence: Synthetic oligonucleotide
attaactccatctgtcaggagagtggaatgttggc

SEQ ID NO: 101392 - DNA, 34 bp, Artificial Sequence
  Description of Artificial Sequence: Synthetic oligonucleotide
ttaactccatctgtcaggagagtggaatgttggc

SEQ ID NO: 101393 - DNA, 33 bp, Artificial Sequence
  Description of Artificial Sequence: Synthetic oligonucleotide
taactccatctgtcaggagagtggaatgttggc

SEQ ID NO: 101394 - DNA, 32 bp, Artificial Sequence
  Description of Artificial Sequence: Synthetic oligonucleotide
aactccatctgtcaggagagtggaatgttggc

SEQ ID NO: 101395 - DNA, 31 bp, Artificial Sequence
  Description of Artificial Sequence: Synthetic oligonucleotide
actccatctgtcaggagagtggaatgttggc

SEQ ID NO: 101396 - DNA, 30 bp, Artificial Sequence
  Description of Artificial Sequence: Synthetic oligonucleotide
ctccatctgtcaggagagtggaatgttggc

SEQ ID NO: 101397 - DNA, 31 bp, Artificial Sequence
  Description of Artificial Sequence: Synthetic oligonucleotide
tccatctgtcaggagagtggaatgttggctg

SEQ ID NO: 101398 - DNA, 30 bp, Artificial Sequence
  Description of Artificial Sequence: Synthetic oligonucleotide
ccatctgtcaggagagtggaatgttggctg

SEQ ID NO: 101399 - DNA, 31 bp, Artificial Sequence
  Description of Artificial Sequence: Synthetic oligonucleotide
catctgtcaggagagtggaatgttggctgtc

SEQ ID NO: 101400 - DNA, 31 bp, Artificial Sequence
  Description of Artificial Sequence: Synthetic oligonucleotide
atctgtcaggagagtggaatgttggctgtcc

SEQ ID NO: 101401 - DNA, 30 bp, Artificial Sequence
  Description of Artificial Sequence: Synthetic oligonucleotide
tctgtcaggagagtggaatgttggctgtcc

SEQ ID NO: 101402 - DNA, 29 bp, Artificial Sequence
  Description of Artificial Sequence: Synthetic oligonucleotide
ctgtcaggagagtggaatgttggctgtcc

SEQ ID NO: 101403 - DNA, 29 bp, Artificial Sequence
  Description of Artificial Sequence: Synthetic oligonucleotide
tgtcaggagagtggaatgttggctgtccg

SEQ ID NO: 101404 - DNA, 28 bp, Artificial Sequence
  Description of Artificial Sequence: Synthetic oligonucleotide
gtcaggagagtggaatgttggctgtccg

SEQ ID NO: 101405 - DNA, 29 bp, Artificial Sequence
  Description of Artificial Sequence: Synthetic oligonucleotide
tcaggagagtggaatgttggctgtccgtg

SEQ ID NO: 101406 - DNA, 28 bp, Artificial Sequence
  Description of Artificial Sequence: Synthetic oligonucleotide
caggagagtggaatgttggctgtccgtg

SEQ ID NO: 101407 - DNA, 32 bp, Artificial Sequence
  Description of Artificial Sequence: Synthetic oligonucleotide
aggagagtggaatgttggctgtccgtgaaaac

SEQ ID NO: 101408 - DNA, 31 bp, Artificial Sequence
  Description of Artificial Sequence: Synthetic oligonucleotide
ggagagtggaatgttggctgtccgtgaaaac

SEQ ID NO: 101409 - DNA, 31 bp, Artificial Sequence
  Description of Artificial Sequence: Synthetic oligonucleotide
gagagtggaatgttggctgtccgtgaaaacc

SEQ ID NO: 101410 - DNA, 31 bp, Artificial Sequence
  Description of Artificial Sequence: Synthetic oligonucleotide
agagtggaatgttggctgtccgtgaaaaccg

SEQ ID NO: 101411 - DNA, 30 bp, Artificial Sequence
  Description of Artificial Sequence: Synthetic oligonucleotide
gagtggaatgttggctgtccgtgaaaaccg

SEQ ID NO: 101412 - DNA, 30 bp, Artificial Sequence
  Description of Artificial Sequence: Synthetic oligonucleotide
agtggaatgttggctgtccgtgaaaaccgc

SEQ ID NO: 101413 - DNA, 29 bp, Artificial Sequence
  Description of Artificial Sequence: Synthetic oligonucleotide
gtggaatgttggctgtccgtgaaaaccgc

SEQ ID NO: 101414 - DNA, 31 bp, Artificial Sequence
  Description of Artificial Sequence: Synthetic oligonucleotide
tggaatgttggctgtccgtgaaaaccgctac

SEQ ID NO: 101415 - DNA, 30 bp, Artificial Sequence
  Description of Artificial Sequence: Synthetic oligonucleotide
ggaatgttggctgtccgtgaaaaccgctac

SEQ ID NO: 101416 - DNA, 33 bp, Artificial Sequence
  Description of Artificial Sequence: Synthetic oligonucleotide
gaatgttggctgtccgtgaaaaccgctacattg

SEQ ID NO: 101417 - DNA, 34 bp, Artificial Sequence
  Description of Artificial Sequence: Synthetic oligonucleotide
aatgttggctgtccgtgaaaaccgctacattgtc

SEQ ID NO: 101418 - DNA, 33 bp, Artificial Sequence
  Description of Artificial Sequence: Synthetic oligonucleotide
atgttggctgtccgtgaaaaccgctacattgtc

SEQ ID NO: 101419 - DNA, 32 bp, Artificial Sequence
  Description of Artificial Sequence: Synthetic oligonucleotide
tgttggctgtccgtgaaaaccgctacattgtc

SEQ ID NO: 101420 - DNA, 31 bp, Artificial Sequence
  Description of Artificial Sequence: Synthetic oligonucleotide
gttggctgtccgtgaaaaccgctacattgtc

SEQ ID NO: 101421 - DNA, 31 bp, Artificial Sequence
  Description of Artificial Sequence: Synthetic oligonucleotide
ttggctgtccgtgaaaaccgctacattgtcc

SEQ ID NO: 101422 - DNA, 30 bp, Artificial Sequence
  Description of Artificial Sequence: Synthetic oligonucleotide
tggctgtccgtgaaaaccgctacattgtcc

SEQ ID NO: 101423 - DNA, 29 bp, Artificial Sequence
  Description of Artificial Sequence: Synthetic oligonucleotide
ggctgtccgtgaaaaccgctacattgtcc

SEQ ID NO: 101424 - DNA, 30 bp, Artificial Sequence
  Description of Artificial Sequence: Synthetic oligonucleotide
gctgtccgtgaaaaccgctacattgtcctg

SEQ ID NO: 101425 - DNA, 30 bp, Artificial Sequence
  Description of Artificial Sequence: Synthetic oligonucleotide
ctgtccgtgaaaaccgctacattgtcctgg

SEQ ID NO: 101426 - DNA, 30 bp, Artificial Sequence
  Description of Artificial Sequence: Synthetic oligonucleotide
tgtccgtgaaaaccgctacattgtcctggc

SEQ ID NO: 101427 - DNA, 29 bp, Artificial Sequence
  Description of Artificial Sequence: Synthetic oligonucleotide
gtccgtgaaaaccgctacattgtcctggc

SEQ ID NO: 101428 - DNA, 29 bp, Artificial Sequence
  Description of Artificial Sequence: Synthetic oligonucleotide
tccgtgaaaaccgctacattgtcctggcc

SEQ ID NO: 101429 - DNA, 28 bp, Artificial Sequence
  Description of Artificial Sequence: Synthetic oligonucleotide
ccgtgaaaaccgctacattgtcctggcc

SEQ ID NO: 101430 - DNA, 30 bp, Artificial Sequence
  Description of Artificial Sequence: Synthetic oligonucleotide
cgtgaaaaccgctacattgtcctggccaag

SEQ ID NO: 101431 - DNA, 30 bp, Artificial Sequence
  Description of Artificial Sequence: Synthetic oligonucleotide
gtgaaaaccgctacattgtcctggccaagg

SEQ ID NO: 101432 - DNA, 31 bp, Artificial Sequence
  Description of Artificial Sequence: Synthetic oligonucleotide
tgaaaaccgctacattgtcctggccaaggac

SEQ ID NO: 101433 - DNA, 30 bp, Artificial Sequence
  Description of Artificial Sequence: Synthetic oligonucleotide
gaaaaccgctacattgtcctggccaaggac

SEQ ID NO: 101434 - DNA, 32 bp, Artificial Sequence
  Description of Artificial Sequence: Synthetic oligonucleotide
aaaaccgctacattgtcctggccaaggacttc

SEQ ID NO: 101435 - DNA, 31 bp, Artificial Sequence
  Description of Artificial Sequence: Synthetic oligonucleotide
aaaccgctacattgtcctggccaaggacttc

SEQ ID NO: 101436 - DNA, 30 bp, Artificial Sequence
  Description of Artificial Sequence: Synthetic oligonucleotide
aaccgctacattgtcctggccaaggacttc

SEQ ID NO: 101437 - DNA, 29 bp, Artificial Sequence
  Description of Artificial Sequence: Synthetic oligonucleotide
accgctacattgtcctggccaaggacttc

SEQ ID NO: 101438 - DNA, 28 bp, Artificial Sequence
  Description of Artificial Sequence: Synthetic oligonucleotide
ccgctacattgtcctggccaaggacttc

SEQ ID NO: 101439 - DNA, 28 bp, Artificial Sequence
  Description of Artificial Sequence: Synthetic oligonucleotide
cgctacattgtcctggccaaggacttcg

SEQ ID NO: 101440 - DNA, 29 bp, Artificial Sequence
  Description of Artificial Sequence: Synthetic oligonucleotide
gctacattgtcctggccaaggacttcgag

SEQ ID NO: 101441 - DNA, 32 bp, Artificial Sequence
  Description of Artificial Sequence: Synthetic oligonucleotide
ctacattgtcctggccaaggacttcgagaaag

SEQ ID NO: 101442 - DNA, 32 bp, Artificial Sequence
  Description of Artificial Sequence: Synthetic oligonucleotide
tacattgtcctggccaaggacttcgagaaagc

SEQ ID NO: 101443 - DNA, 31 bp, Artificial Sequence
  Description of Artificial Sequence: Synthetic oligonucleotide
acattgtcctggccaaggacttcgagaaagc

SEQ ID NO: 101444 - DNA, 30 bp, Artificial Sequence
  Description of Artificial Sequence: Synthetic oligonucleotide
cattgtcctggccaaggacttcgagaaagc

SEQ ID NO: 101445 - DNA, 33 bp, Artificial Sequence
  Description of Artificial Sequence: Synthetic oligonucleotide
attgtcctggccaaggacttcgagaaagcatac

SEQ ID NO: 101446 - DNA, 32 bp, Artificial Sequence
  Description of Artificial Sequence: Synthetic oligonucleotide
ttgtcctggccaaggacttcgagaaagcatac

SEQ ID NO: 101447 - DNA, 31 bp, Artificial Sequence
  Description of Artificial Sequence: Synthetic oligonucleotide
tgtcctggccaaggacttcgagaaagcatac

SEQ ID NO: 101448 - DNA, 30 bp, Artificial Sequence
  Description of Artificial Sequence: Synthetic oligonucleotide
gtcctggccaaggacttcgagaaagcatac

SEQ ID NO: 101449 - DNA, 32 bp, Artificial Sequence
  Description of Artificial Sequence: Synthetic oligonucleotide
tcctggccaaggacttcgagaaagcatacaag

SEQ ID NO: 101450 - DNA, 31 bp, Artificial Sequence
  Description of Artificial Sequence: Synthetic oligonucleotide
cctggccaaggacttcgagaaagcatacaag

SEQ ID NO: 101451 - DNA, 32 bp, Artificial Sequence
  Description of Artificial Sequence: Synthetic oligonucleotide
ctggccaaggacttcgagaaagcatacaagac

SEQ ID NO: 101452 - DNA, 33 bp, Artificial Sequence
  Description of Artificial Sequence: Synthetic oligonucleotide
tggccaaggacttcgagaaagcatacaagactg

SEQ ID NO: 101453 - DNA, 32 bp, Artificial Sequence
  Description of Artificial Sequence: Synthetic oligonucleotide
ggccaaggacttcgagaaagcatacaagactg

SEQ ID NO: 101454 - DNA, 33 bp, Artificial Sequence
  Description of Artificial Sequence: Synthetic oligonucleotide
gccaaggacttcgagaaagcatacaagactgtc

SEQ ID NO: 101455 - DNA, 35 bp, Artificial Sequence
  Description of Artificial Sequence: Synthetic oligonucleotide
ccaaggacttcgagaaagcatacaagactgtcatc

SEQ ID NO: 101456 - DNA, 37 bp, Artificial Sequence
  Description of Artificial Sequence: Synthetic oligonucleotide
caaggacttcgagaaagcatacaagactgtcatcaag

SEQ ID NO: 101457 - DNA, 39 bp, Artificial Sequence
  Description of Artificial Sequence: Synthetic oligonucleotide
aaggacttcgagaaagcatacaagactgtcatcaagaag

SEQ ID NO: 101458 - DNA, 38 bp, Artificial Sequence
  Description of Artificial Sequence: Synthetic oligonucleotide
aggacttcgagaaagcatacaagactgtcatcaagaag

SEQ ID NO: 101459 - DNA, 37 bp, Artificial Sequence
  Description of Artificial Sequence: Synthetic oligonucleotide
ggacttcgagaaagcatacaagactgtcatcaagaag

SEQ ID NO: 101460 - DNA, 37 bp, Artificial Sequence
  Description of Artificial Sequence: Synthetic oligonucleotide
gacttcgagaaagcatacaagactgtcatcaagaagg

SEQ ID NO: 101461 - DNA, 38 bp, Artificial Sequence
  Description of Artificial Sequence: Synthetic oligonucleotide
acttcgagaaagcatacaagactgtcatcaagaaggac

SEQ ID NO: 101462 - DNA, 37 bp, Artificial Sequence
  Description of Artificial Sequence: Synthetic oligonucleotide
cttcgagaaagcatacaagactgtcatcaagaaggac

SEQ ID NO: 101463 - DNA, 37 bp, Artificial Sequence
  Description of Artificial Sequence: Synthetic oligonucleotide
ttcgagaaagcatacaagactgtcatcaagaaggacg

SEQ ID NO: 101464 - DNA, 36 bp, Artificial Sequence
  Description of Artificial Sequence: Synthetic oligonucleotide
tcgagaaagcatacaagactgtcatcaagaaggacg

SEQ ID NO: 101465 - DNA, 35 bp, Artificial Sequence
  Description of Artificial Sequence: Synthetic oligonucleotide
cgagaaagcatacaagactgtcatcaagaaggacg

SEQ ID NO: 101466 - DNA, 36 bp, Artificial Sequence
  Description of Artificial Sequence: Synthetic oligonucleotide
gagaaagcatacaagactgtcatcaagaaggacgag

SEQ ID NO: 101467 - DNA, 36 bp, Artificial Sequence
  Description of Artificial Sequence: Synthetic oligonucleotide
agaaagcatacaagactgtcatcaagaaggacgagc

SEQ ID NO: 101468 - DNA, 35 bp, Artificial Sequence
  Description of Artificial Sequence: Synthetic oligonucleotide
gaaagcatacaagactgtcatcaagaaggacgagc

SEQ ID NO: 101469 - DNA, 36 bp, Artificial Sequence
  Description of Artificial Sequence: Synthetic oligonucleotide
aaagcatacaagactgtcatcaagaaggacgagcag

SEQ ID NO: 101470 - DNA, 35 bp, Artificial Sequence
  Description of Artificial Sequence: Synthetic oligonucleotide
aagcatacaagactgtcatcaagaaggacgagcag

SEQ ID NO: 101471 - DNA, 34 bp, Artificial Sequence
  Description of Artificial Sequence: Synthetic oligonucleotide
agcatacaagactgtcatcaagaaggacgagcag

SEQ ID NO: 101472 - DNA, 33 bp, Artificial Sequence
  Description of Artificial Sequence: Synthetic oligonucleotide
gcatacaagactgtcatcaagaaggacgagcag

SEQ ID NO: 101473 - DNA, 33 bp, Artificial Sequence
  Description of Artificial Sequence: Synthetic oligonucleotide
catacaagactgtcatcaagaaggacgagcagg

SEQ ID NO: 101474 - DNA, 34 bp, Artificial Sequence
  Description of Artificial Sequence: Synthetic oligonucleotide
atacaagactgtcatcaagaaggacgagcaggag

SEQ ID NO: 101475 - DNA, 33 bp, Artificial Sequence
  Description of Artificial Sequence: Synthetic oligonucleotide
tacaagactgtcatcaagaaggacgagcaggag

SEQ ID NO: 101476 - DNA, 32 bp, Artificial Sequence
  Description of Artificial Sequence: Synthetic oligonucleotide
acaagactgtcatcaagaaggacgagcaggag

SEQ ID NO: 101477 - DNA, 31 bp, Artificial Sequence
  Description of Artificial Sequence: Synthetic oligonucleotide
caagactgtcatcaagaaggacgagcaggag

SEQ ID NO: 101478 - DNA, 31 bp, Artificial Sequence
  Description of Artificial Sequence: Synthetic oligonucleotide
aagactgtcatcaagaaggacgagcaggagc

SEQ ID NO: 101479 - DNA, 30 bp, Artificial Sequence
  Description of Artificial Sequence: Synthetic oligonucleotide
agactgtcatcaagaaggacgagcaggagc

SEQ ID NO: 101480 - DNA, 29 bp, Artificial Sequence
  Description of Artificial Sequence: Synthetic oligonucleotide
gactgtcatcaagaaggacgagcaggagc

SEQ ID NO: 101481 - DNA, 31 bp, Artificial Sequence
  Description of Artificial Sequence: Synthetic oligonucleotide
actgtcatcaagaaggacgagcaggagcatg

SEQ ID NO: 101482 - DNA, 30 bp, Artificial Sequence
  Description of Artificial Sequence: Synthetic oligonucleotide
ctgtcatcaagaaggacgagcaggagcatg

SEQ ID NO: 101483 - DNA, 31 bp, Artificial Sequence
  Description of Artificial Sequence: Synthetic oligonucleotide
tgtcatcaagaaggacgagcaggagcatgag

SEQ ID NO: 101484 - DNA, 30 bp, Artificial Sequence
  Description of Artificial Sequence: Synthetic oligonucleotide
gtcatcaagaaggacgagcaggagcatgag

SEQ ID NO: 101485 - DNA, 35 bp, Artificial Sequence
  Description of Artificial Sequence: Synthetic oligonucleotide
tcatcaagaaggacgagcaggagcatgagttttac

SEQ ID NO: 101486 - DNA, 34 bp, Artificial Sequence
  Description of Artificial Sequence: Synthetic oligonucleotide
catcaagaaggacgagcaggagcatgagttttac

SEQ ID NO: 101487 - DNA, 36 bp, Artificial Sequence
  Description of Artificial Sequence: Synthetic oligonucleotide
atcaagaaggacgagcaggagcatgagttttacaag

SEQ ID NO: 101488 - DNA, 35 bp, Artificial Sequence
  Description of Artificial Sequence: Synthetic oligonucleotide
tcaagaaggacgagcaggagcatgagttttacaag

SEQ ID NO: 101489 - DNA, 34 bp, Artificial Sequence
  Description of Artificial Sequence: Synthetic oligonucleotide
caagaaggacgagcaggagcatgagttttacaag

SEQ ID NO: 101490 - DNA, 35 bp, Artificial Sequence
  Description of Artificial Sequence: Synthetic oligonucleotide
aagaaggacgagcaggagcatgagttttacaagtg

SEQ ID NO: 101491 - DNA, 34 bp, Artificial Sequence
  Description of Artificial Sequence: Synthetic oligonucleotide
agaaggacgagcaggagcatgagttttacaagtg

SEQ ID NO: 101492 - DNA, 33 bp, Artificial Sequence
  Description of Artificial Sequence: Synthetic oligonucleotide
gaaggacgagcaggagcatgagttttacaagtg

SEQ ID NO: 101493 - DNA, 27 bp, Artificial Sequence
  Description of Artificial Sequence: Synthetic oligonucleotide
tggaggacctgtacagccgctacaagg

SEQ ID NO: 101494 - DNA, 27 bp, Artificial Sequence
  Description of Artificial Sequence: Synthetic oligonucleotide
ggaggacctgtacagccgctacaagga

SEQ ID NO: 101495 - DNA, 27 bp, Artificial Sequence
  Description of Artificial Sequence: Synthetic oligonucleotide
gaggacctgtacagccgctacaaggag

SEQ ID NO: 101496 - DNA, 27 bp, Artificial Sequence
  Description of Artificial Sequence: Synthetic oligonucleotide
aggacctgtacagccgctacaaggagg

SEQ ID NO: 101497 - DNA, 27 bp, Artificial Sequence
  Description of Artificial Sequence: Synthetic oligonucleotide
ggacctgtacagccgctacaaggagga

SEQ ID NO: 101498 - DNA, 27 bp, Artificial Sequence
  Description of Artificial Sequence: Synthetic oligonucleotide
gacctgtacagccgctacaaggaggag

SEQ ID NO: 101499 - DNA, 27 bp, Artificial Sequence
  Description of Artificial Sequence: Synthetic oligonucleotide
acctgtacagccgctacaaggaggagg

SEQ ID NO: 101500 - DNA, 27 bp, Artificial Sequence
  Description of Artificial Sequence: Synthetic oligonucleotide
cctgtacagccgctacaaggaggaggt

SEQ ID NO: 101501 - DNA, 27 bp, Artificial Sequence
  Description of Artificial Sequence: Synthetic oligonucleotide
ctgtacagccgctacaaggaggaggtg

SEQ ID NO: 101502 - DNA, 29 bp, Artificial Sequence
  Description of Artificial Sequence: Synthetic oligonucleotide
tgtacagccgctacaaggaggaggtgaag

SEQ ID NO: 101503 - DNA, 28 bp, Artificial Sequence
  Description of Artificial Sequence: Synthetic oligonucleotide
gtacagccgctacaaggaggaggtgaag

SEQ ID NO: 101504 - DNA, 28 bp, Artificial Sequence
  Description of Artificial Sequence: Synthetic oligonucleotide
tacagccgctacaaggaggaggtgaagc

SEQ ID NO: 101505 - DNA, 27 bp, Artificial Sequence
  Description of Artificial Sequence: Synthetic oligonucleotide
acagccgctacaaggaggaggtgaagc

SEQ ID NO: 101506 - DNA, 26 bp, Artificial Sequence
  Description of Artificial Sequence: Synthetic oligonucleotide
cagccgctacaaggaggaggtgaagc

SEQ ID NO: 101507 - DNA, 27 bp, Artificial Sequence
  Description of Artificial Sequence: Synthetic oligonucleotide
agccgctacaaggaggaggtgaagcga

SEQ ID NO: 101508 - DNA, 27 bp, Artificial Sequence
  Description of Artificial Sequence: Synthetic oligonucleotide
gccgctacaaggaggaggtgaagcgaa

SEQ ID NO: 101509 - DNA, 28 bp, Artificial Sequence
  Description of Artificial Sequence: Synthetic oligonucleotide
ccgctacaaggaggaggtgaagcgaatc

SEQ ID NO: 101510 - DNA, 28 bp, Artificial Sequence
  Description of Artificial Sequence: Synthetic oligonucleotide
cgctacaaggaggaggtgaagcgaatcc

SEQ ID NO: 101511 - DNA, 31 bp, Artificial Sequence
  Description of Artificial Sequence: Synthetic oligonucleotide
gctacaaggaggaggtgaagcgaatccaaag

SEQ ID NO: 101512 - DNA, 31 bp, Artificial Sequence
  Description of Artificial Sequence: Synthetic oligonucleotide
ctacaaggaggaggtgaagcgaatccaaagc

SEQ ID NO: 101513 - DNA, 33 bp, Artificial Sequence
  Description of Artificial Sequence: Synthetic oligonucleotide
tacaaggaggaggtgaagcgaatccaaagcatc

SEQ ID NO: 101514 - DNA, 32 bp, Artificial Sequence
  Description of Artificial Sequence: Synthetic oligonucleotide
acaaggaggaggtgaagcgaatccaaagcatc

SEQ ID NO: 101515 - DNA, 31 bp, Artificial Sequence
  Description of Artificial Sequence: Synthetic oligonucleotide
caaggaggaggtgaagcgaatccaaagcatc

SEQ ID NO: 101516 - DNA, 31 bp, Artificial Sequence
  Description of Artificial Sequence: Synthetic oligonucleotide
aaggaggaggtgaagcgaatccaaagcatcc

SEQ ID NO: 101517 - DNA, 32 bp, Artificial Sequence
  Description of Artificial Sequence: Synthetic oligonucleotide
atggaggggtgtgtgtctaacctaatggtctg

SEQ ID NO: 101518 - DNA, 31 bp, Artificial Sequence
  Description of Artificial Sequence: Synthetic oligonucleotide
tggaggggtgtgtgtctaacctaatggtctg

SEQ ID NO: 101519 - DNA, 30 bp, Artificial Sequence
  Description of Artificial Sequence: Synthetic oligonucleotide
ggaggggtgtgtgtctaacctaatggtctg

SEQ ID NO: 101520 - DNA, 30 bp, Artificial Sequence
  Description of Artificial Sequence: Synthetic oligonucleotide
gaggggtgtgtgtctaacctaatggtctgc

SEQ ID NO: 101521 - DNA, 32 bp, Artificial Sequence
  Description of Artificial Sequence: Synthetic oligonucleotide
aggggtgtgtgtctaacctaatggtctgcaac

SEQ ID NO: 101522 - DNA, 31 bp, Artificial Sequence
  Description of Artificial Sequence: Synthetic oligonucleotide
ggggtgtgtgtctaacctaatggtctgcaac

SEQ ID NO: 101523 - DNA, 31 bp, Artificial Sequence
  Description of Artificial Sequence: Synthetic oligonucleotide
gggtgtgtgtctaacctaatggtctgcaacc

SEQ ID NO: 101524 - DNA, 32 bp, Artificial Sequence
  Description of Artificial Sequence: Synthetic oligonucleotide
ggtgtgtgtctaacctaatggtctgcaacctg

SEQ ID NO: 101525 - DNA, 32 bp, Artificial Sequence
  Description of Artificial Sequence: Synthetic oligonucleotide
gtgtgtgtctaacctaatggtctgcaacctgg

SEQ ID NO: 101526 - DNA, 32 bp, Artificial Sequence
  Description of Artificial Sequence: Synthetic oligonucleotide
tgtgtgtctaacctaatggtctgcaacctggc

SEQ ID NO: 101527 - DNA, 31 bp, Artificial Sequence
  Description of Artificial Sequence: Synthetic oligonucleotide
gtgtgtctaacctaatggtctgcaacctggc

SEQ ID NO: 101528 - DNA, 31 bp, Artificial Sequence
  Description of Artificial Sequence: Synthetic oligonucleotide
tgtgtctaacctaatggtctgcaacctggcc

SEQ ID NO: 101529 - DNA, 30 bp, Artificial Sequence
  Description of Artificial Sequence: Synthetic oligonucleotide
gtgtctaacctaatggtctgcaacctggcc

SEQ ID NO: 101530 - DNA, 32 bp, Artificial Sequence
  Description of Artificial Sequence: Synthetic oligonucleotide
tgtctaacctaatggtctgcaacctggcctac

SEQ ID NO: 101531 - DNA, 31 bp, Artificial Sequence
  Description of Artificial Sequence: Synthetic oligonucleotide
gtctaacctaatggtctgcaacctggcctac

SEQ ID NO: 101532 - DNA, 32 bp, Artificial Sequence
  Description of Artificial Sequence: Synthetic oligonucleotide
tctaacctaatggtctgcaacctggcctacag

SEQ ID NO: 101533 - DNA, 31 bp, Artificial Sequence
  Description of Artificial Sequence: Synthetic oligonucleotide
ctaacctaatggtctgcaacctggcctacag

SEQ ID NO: 101534 - DNA, 31 bp, Artificial Sequence
  Description of Artificial Sequence: Synthetic oligonucleotide
taacctaatggtctgcaacctggcctacagc

SEQ ID NO: 101535 - DNA, 30 bp, Artificial Sequence
  Description of Artificial Sequence: Synthetic oligonucleotide
aacctaatggtctgcaacctggcctacagc

SEQ ID NO: 101536 - DNA, 29 bp, Artificial Sequence
  Description of Artificial Sequence: Synthetic oligonucleotide
acctaatggtctgcaacctggcctacagc

SEQ ID NO: 101537 - DNA, 28 bp, Artificial Sequence
  Description of Artificial Sequence: Synthetic oligonucleotide
cctaatggtctgcaacctggcctacagc

SEQ ID NO: 101538 - DNA, 28 bp, Artificial Sequence
  Description of Artificial Sequence: Synthetic oligonucleotide
ctaatggtctgcaacctggcctacagcg

SEQ ID NO: 101539 - DNA, 28 bp, Artificial Sequence
  Description of Artificial Sequence: Synthetic oligonucleotide
taatggtctgcaacctggcctacagcgg

SEQ ID NO: 101540 - DNA, 27 bp, Artificial Sequence
  Description of Artificial Sequence: Synthetic oligonucleotide
aatggtctgcaacctggcctacagcgg

SEQ ID NO: 101541 - DNA, 26 bp, Artificial Sequence
  Description of Artificial Sequence: Synthetic oligonucleotide
atggtctgcaacctggcctacagcgg

SEQ ID NO: 101542 - DNA, 25 bp, Artificial Sequence
  Description of Artificial Sequence: Synthetic oligonucleotide
tggtctgcaacctggcctacagcgg

SEQ ID NO: 101543 - DNA, 24 bp, Artificial Sequence
  Description of Artificial Sequence: Synthetic oligonucleotide
ggtctgcaacctggcctacagcgg

SEQ ID NO: 101544 - DNA, 26 bp, Artificial Sequence
  Description of Artificial Sequence: Synthetic oligonucleotide
gtctgcaacctggcctacagcgggaa

SEQ ID NO: 101545 - DNA, 26 bp, Artificial Sequence
  Description of Artificial Sequence: Synthetic oligonucleotide
tctgcaacctggcctacagcgggaag

SEQ ID NO: 101546 - DNA, 25 bp, Artificial Sequence
  Description of Artificial Sequence: Synthetic oligonucleotide
ctgcaacctggcctacagcgggaag

SEQ ID NO: 101547 - DNA, 26 bp, Artificial Sequence
  Description of Artificial Sequence: Synthetic oligonucleotide
tgcaacctggcctacagcgggaagct

SEQ ID NO: 101548 - DNA, 25 bp, Artificial Sequence
  Description of Artificial Sequence: Synthetic oligonucleotide
gcaacctggcctacagcgggaagct

SEQ ID NO: 101549 - DNA, 25 bp, Artificial Sequence
  Description of Artificial Sequence: Synthetic oligonucleotide
caacctggcctacagcgggaagctg

SEQ ID NO: 101550 - DNA, 27 bp, Artificial Sequence
  Description of Artificial Sequence: Synthetic oligonucleotide
aacctggcctacagcgggaagctggaa

SEQ ID NO: 101551 - DNA, 26 bp, Artificial Sequence
  Description of Artificial Sequence: Synthetic oligonucleotide
acctggcctacagcgggaagctggaa

SEQ ID NO: 101552 - DNA, 25 bp, Artificial Sequence
  Description of Artificial Sequence: Synthetic oligonucleotide
cctggcctacagcgggaagctggaa

SEQ ID NO: 101553 - DNA, 26 bp, Artificial Sequence
  Description of Artificial Sequence: Synthetic oligonucleotide
ctggcctacagcgggaagctggaaga

SEQ ID NO: 101554 - DNA, 27 bp, Artificial Sequence
  Description of Artificial Sequence: Synthetic oligonucleotide
tggcctacagcgggaagctggaagagt

SEQ ID NO: 101555 - DNA, 27 bp, Artificial Sequence
  Description of Artificial Sequence: Synthetic oligonucleotide
ggcctacagcgggaagctggaagagtt

SEQ ID NO: 101556 - DNA, 27 bp, Artificial Sequence
  Description of Artificial Sequence: Synthetic oligonucleotide
gcctacagcgggaagctggaagagttg

SEQ ID NO: 101557 - DNA, 29 bp, Artificial Sequence
  Description of Artificial Sequence: Synthetic oligonucleotide
cctacagcgggaagctggaagagttgaag

SEQ ID NO: 101558 - DNA, 29 bp, Artificial Sequence
  Description of Artificial Sequence: Synthetic oligonucleotide
ctacagcgggaagctggaagagttgaagg

SEQ ID NO: 101559 - DNA, 30 bp, Artificial Sequence
  Description of Artificial Sequence: Synthetic oligonucleotide
tacagcgggaagctggaagagttgaaggag

SEQ ID NO: 101560 - DNA, 29 bp, Artificial Sequence
  Description of Artificial Sequence: Synthetic oligonucleotide
acagcgggaagctggaagagttgaaggag

SEQ ID NO: 101561 - DNA, 28 bp, Artificial Sequence
  Description of Artificial Sequence: Synthetic oligonucleotide
cagcgggaagctggaagagttgaaggag

SEQ ID NO: 101562 - DNA, 29 bp, Artificial Sequence
  Description of Artificial Sequence: Synthetic oligonucleotide
agcgggaagctggaagagttgaaggagag

SEQ ID NO: 101563 - DNA, 28 bp, Artificial Sequence
  Description of Artificial Sequence: Synthetic oligonucleotide
gcgggaagctggaagagttgaaggagag

SEQ ID NO: 101564 - DNA, 32 bp, Artificial Sequence
  Description of Artificial Sequence: Synthetic oligonucleotide
cgggaagctggaagagttgaaggagagtattc

SEQ ID NO: 101565 - DNA, 33 bp, Artificial Sequence
  Description of Artificial Sequence: Synthetic oligonucleotide
gggaagctggaagagttgaaggagagtattctg

SEQ ID NO: 101566 - DNA, 33 bp, Artificial Sequence
  Description of Artificial Sequence: Synthetic oligonucleotide
ggaagctggaagagttgaaggagagtattctgg

SEQ ID NO: 101567 - DNA, 33 bp, Artificial Sequence
  Description of Artificial Sequence: Synthetic oligonucleotide
gaagctggaagagttgaaggagagtattctggc

SEQ ID NO: 101568 - DNA, 33 bp, Artificial Sequence
  Description of Artificial Sequence: Synthetic oligonucleotide
aagctggaagagttgaaggagagtattctggcc

SEQ ID NO: 101569 - DNA, 32 bp, Artificial Sequence
  Description of Artificial Sequence: Synthetic oligonucleotide
agctggaagagttgaaggagagtattctggcc

SEQ ID NO: 101570 - DNA, 31 bp, Artificial Sequence
  Description of Artificial Sequence: Synthetic oligonucleotide
gctggaagagttgaaggagagtattctggcc

SEQ ID NO: 101571 - DNA, 31 bp, Artificial Sequence
  Description of Artificial Sequence: Synthetic oligonucleotide
ctggaagagttgaaggagagtattctggccg

SEQ ID NO: 101572 - DNA, 37 bp, Artificial Sequence
  Description of Artificial Sequence: Synthetic oligonucleotide
tggaagagttgaaggagagtattctggccgataaatc

SEQ ID NO: 101573 - DNA, 36 bp, Artificial Sequence
  Description of Artificial Sequence: Synthetic oligonucleotide
ggaagagttgaaggagagtattctggccgataaatc

SEQ ID NO: 101574 - DNA, 36 bp, Artificial Sequence
  Description of Artificial Sequence: Synthetic oligonucleotide
gaagagttgaaggagagtattctggccgataaatcc

SEQ ID NO: 101575 - DNA, 36 bp, Artificial Sequence
  Description of Artificial Sequence: Synthetic oligonucleotide
aagagttgaaggagagtattctggccgataaatccc

SEQ ID NO: 101576 - DNA, 35 bp, Artificial Sequence
  Description of Artificial Sequence: Synthetic oligonucleotide
agagttgaaggagagtattctggccgataaatccc

SEQ ID NO: 101577 - DNA, 34 bp, Artificial Sequence
  Description of Artificial Sequence: Synthetic oligonucleotide
gagttgaaggagagtattctggccgataaatccc

SEQ ID NO: 101578 - DNA, 35 bp, Artificial Sequence
  Description of Artificial Sequence: Synthetic oligonucleotide
agttgaaggagagtattctggccgataaatccctg

SEQ ID NO: 101579 - DNA, 34 bp, Artificial Sequence
  Description of Artificial Sequence: Synthetic oligonucleotide
gttgaaggagagtattctggccgataaatccctg

SEQ ID NO: 101580 - DNA, 34 bp, Artificial Sequence
  Description of Artificial Sequence: Synthetic oligonucleotide
ttgaaggagagtattctggccgataaatccctgg

SEQ ID NO: 101581 - DNA, 33 bp, Artificial Sequence
  Description of Artificial Sequence: Synthetic oligonucleotide
tgaaggagagtattctggccgataaatccctgg

SEQ ID NO: 101582 - DNA, 32 bp, Artificial Sequence
  Description of Artificial Sequence: Synthetic oligonucleotide
gaaggagagtattctggccgataaatccctgg

SEQ ID NO: 101583 - DNA, 32 bp, Artificial Sequence
  Description of Artificial Sequence: Synthetic oligonucleotide
aaggagagtattctggccgataaatccctggc

SEQ ID NO: 101584 - DNA, 31 bp, Artificial Sequence
  Description of Artificial Sequence: Synthetic oligonucleotide
aggagagtattctggccgataaatccctggc

SEQ ID NO: 101585 - DNA, 30 bp, Artificial Sequence
  Description of Artificial Sequence: Synthetic oligonucleotide
ggagagtattctggccgataaatccctggc

SEQ ID NO: 101586 - DNA, 32 bp, Artificial Sequence
  Description of Artificial Sequence: Synthetic oligonucleotide
gagagtattctggccgataaatccctggctac

SEQ ID NO: 101587 - DNA, 34 bp, Artificial Sequence
  Description of Artificial Sequence: Synthetic oligonucleotide
agagtattctggccgataaatccctggctactag

SEQ ID NO: 101588 - DNA, 33 bp, Artificial Sequence
  Description of Artificial Sequence: Synthetic oligonucleotide
gagtattctggccgataaatccctggctactag

SEQ ID NO: 101589 - DNA, 35 bp, Artificial Sequence
  Description of Artificial Sequence: Synthetic oligonucleotide
agtattctggccgataaatccctggctactagaac

SEQ ID NO: 101590 - DNA, 34 bp, Artificial Sequence
  Description of Artificial Sequence: Synthetic oligonucleotide
gtattctggccgataaatccctggctactagaac

SEQ ID NO: 101591 - DNA, 35 bp, Artificial Sequence
  Description of Artificial Sequence: Synthetic oligonucleotide
tattctggccgataaatccctggctactagaactg

SEQ ID NO: 101592 - DNA, 34 bp, Artificial Sequence
  Description of Artificial Sequence: Synthetic oligonucleotide
attctggccgataaatccctggctactagaactg

SEQ ID NO: 101593 - DNA, 33 bp, Artificial Sequence
  Description of Artificial Sequence: Synthetic oligonucleotide
ttctggccgataaatccctggctactagaactg

SEQ ID NO: 101594 - DNA, 32 bp, Artificial Sequence
  Description of Artificial Sequence: Synthetic oligonucleotide
tctggccgataaatccctggctactagaactg

SEQ ID NO: 101595 - DNA, 31 bp, Artificial Sequence
  Description of Artificial Sequence: Synthetic oligonucleotide
ctggccgataaatccctggctactagaactg

SEQ ID NO: 101596 - DNA, 32 bp, Artificial Sequence
  Description of Artificial Sequence: Synthetic oligonucleotide
tggccgataaatccctggctactagaactgac

SEQ ID NO: 101597 - DNA, 31 bp, Artificial Sequence
  Description of Artificial Sequence: Synthetic oligonucleotide
ggccgataaatccctggctactagaactgac

SEQ ID NO: 101598 - DNA, 31 bp, Artificial Sequence
  Description of Artificial Sequence: Synthetic oligonucleotide
gccgataaatccctggctactagaactgacc

SEQ ID NO: 101599 - DNA, 32 bp, Artificial Sequence
  Description of Artificial Sequence: Synthetic oligonucleotide
ccgataaatccctggctactagaactgaccag

SEQ ID NO: 101600 - DNA, 32 bp, Artificial Sequence
  Description of Artificial Sequence: Synthetic oligonucleotide
cgataaatccctggctactagaactgaccagg

SEQ ID NO: 101601 - DNA, 33 bp, Artificial Sequence
  Description of Artificial Sequence: Synthetic oligonucleotide
gataaatccctggctactagaactgaccaggac

SEQ ID NO: 101602 - DNA, 34 bp, Artificial Sequence
  Description of Artificial Sequence: Synthetic oligonucleotide
ataaatccctggctactagaactgaccaggacag

SEQ ID NO: 101603 - DNA, 33 bp, Artificial Sequence
  Description of Artificial Sequence: Synthetic oligonucleotide
taaatccctggctactagaactgaccaggacag

SEQ ID NO: 101604 - DNA, 32 bp, Artificial Sequence
  Description of Artificial Sequence: Synthetic oligonucleotide
aaatccctggctactagaactgaccaggacag

SEQ ID NO: 101605 - DNA, 31 bp, Artificial Sequence
  Description of Artificial Sequence: Synthetic oligonucleotide
aatccctggctactagaactgaccaggacag

SEQ ID NO: 101606 - DNA, 30 bp, Artificial Sequence
  Description of Artificial Sequence: Synthetic oligonucleotide
atccctggctactagaactgaccaggacag

SEQ ID NO: 101607 - DNA, 29 bp, Artificial Sequence
  Description of Artificial Sequence: Synthetic oligonucleotide
tccctggctactagaactgaccaggacag

SEQ ID NO: 101608 - DNA, 28 bp, Artificial Sequence
  Description of Artificial Sequence: Synthetic oligonucleotide
ccctggctactagaactgaccaggacag

SEQ ID NO: 101609 - DNA, 28 bp, Artificial Sequence
  Description of Artificial Sequence: Synthetic oligonucleotide
cctggctactagaactgaccaggacagc

SEQ ID NO: 101610 - DNA, 29 bp, Artificial Sequence
  Description of Artificial Sequence: Synthetic oligonucleotide
ctggctactagaactgaccaggacagcag

SEQ ID NO: 101611 - DNA, 31 bp, Artificial Sequence
  Description of Artificial Sequence: Synthetic oligonucleotide
tggctactagaactgaccaggacagcagaac

SEQ ID NO: 101612 - DNA, 30 bp, Artificial Sequence
  Description of Artificial Sequence: Synthetic oligonucleotide
ggctactagaactgaccaggacagcagaac

SEQ ID NO: 101613 - DNA, 31 bp, Artificial Sequence
  Description of Artificial Sequence: Synthetic oligonucleotide
gctactagaactgaccaggacagcagaactg

SEQ ID NO: 101614 - DNA, 31 bp, Artificial Sequence
  Description of Artificial Sequence: Synthetic oligonucleotide
ctactagaactgaccaggacagcagaactgc

SEQ ID NO: 101615 - DNA, 34 bp, Artificial Sequence
  Description of Artificial Sequence: Synthetic oligonucleotide
tactagaactgaccaggacagcagaactgcattg

SEQ ID NO: 101616 - DNA, 33 bp, Artificial Sequence
  Description of Artificial Sequence: Synthetic oligonucleotide
actagaactgaccaggacagcagaactgcattg

SEQ ID NO: 101617 - DNA, 32 bp, Artificial Sequence
  Description of Artificial Sequence: Synthetic oligonucleotide
ctagaactgaccaggacagcagaactgcattg

SEQ ID NO: 101618 - DNA, 32 bp, Artificial Sequence
  Description of Artificial Sequence: Synthetic oligonucleotide
tagaactgaccaggacagcagaactgcattgc

SEQ ID NO: 101619 - DNA, 31 bp, Artificial Sequence
  Description of Artificial Sequence: Synthetic oligonucleotide
agaactgaccaggacagcagaactgcattgc

SEQ ID NO: 101620 - DNA, 30 bp, Artificial Sequence
  Description of Artificial Sequence: Synthetic oligonucleotide
gaactgaccaggacagcagaactgcattgc

SEQ ID NO: 101621 - DNA, 31 bp, Artificial Sequence
  Description of Artificial Sequence: Synthetic oligonucleotide
aactgaccaggacagcagaactgcattgcac

SEQ ID NO: 101622 - DNA, 30 bp, Artificial Sequence
  Description of Artificial Sequence: Synthetic oligonucleotide
actgaccaggacagcagaactgcattgcac

SEQ ID NO: 101623 - DNA, 29 bp, Artificial Sequence
  Description of Artificial Sequence: Synthetic oligonucleotide
ctgaccaggacagcagaactgcattgcac

SEQ ID NO: 101624 - DNA, 30 bp, Artificial Sequence
  Description of Artificial Sequence: Synthetic oligonucleotide
tgaccaggacagcagaactgcattgcactg

SEQ ID NO: 101625 - DNA, 29 bp, Artificial Sequence
  Description of Artificial Sequence: Synthetic oligonucleotide
gaccaggacagcagaactgcattgcactg

SEQ ID NO: 101626 - DNA, 29 bp, Artificial Sequence
  Description of Artificial Sequence: Synthetic oligonucleotide
accaggacagcagaactgcattgcactgg

SEQ ID NO: 101627 - DNA, 28 bp, Artificial Sequence
  Description of Artificial Sequence: Synthetic oligonucleotide
ccaggacagcagaactgcattgcactgg

SEQ ID NO: 101628 - DNA, 28 bp, Artificial Sequence
  Description of Artificial Sequence: Synthetic oligonucleotide
caggacagcagaactgcattgcactggg

SEQ ID NO: 101629 - DNA, 28 bp, Artificial Sequence
  Description of Artificial Sequence: Synthetic oligonucleotide
aggacagcagaactgcattgcactgggc

SEQ ID NO: 101630 - DNA, 27 bp, Artificial Sequence
  Description of Artificial Sequence: Synthetic oligonucleotide
ggacagcagaactgcattgcactgggc

SEQ ID NO: 101631 - DNA, 29 bp, Artificial Sequence
  Description of Artificial Sequence: Synthetic oligonucleotide
gacagcagaactgcattgcactgggcatg

SEQ ID NO: 101632 - DNA, 29 bp, Artificial Sequence
  Description of Artificial Sequence: Synthetic oligonucleotide
acagcagaactgcattgcactgggcatgc

SEQ ID NO: 101633 - DNA, 28 bp, Artificial Sequence
  Description of Artificial Sequence: Synthetic oligonucleotide
cagcagaactgcattgcactgggcatgc

SEQ ID NO: 101634 - DNA, 29 bp, Artificial Sequence
  Description of Artificial Sequence: Synthetic oligonucleotide
agcagaactgcattgcactgggcatgctc

SEQ ID NO: 101635 - DNA, 28 bp, Artificial Sequence
  Description of Artificial Sequence: Synthetic oligonucleotide
gcagaactgcattgcactgggcatgctc

SEQ ID NO: 101636 - DNA, 29 bp, Artificial Sequence
  Description of Artificial Sequence: Synthetic oligonucleotide
cagaactgcattgcactgggcatgctcag

SEQ ID NO: 101637 - DNA, 29 bp, Artificial Sequence
  Description of Artificial Sequence: Synthetic oligonucleotide
agaactgcattgcactgggcatgctcagc

SEQ ID NO: 101638 - DNA, 28 bp, Artificial Sequence
  Description of Artificial Sequence: Synthetic oligonucleotide
gaactgcattgcactgggcatgctcagc

SEQ ID NO: 101639 - DNA, 29 bp, Artificial Sequence
  Description of Artificial Sequence: Synthetic oligonucleotide
aactgcattgcactgggcatgctcagctg

SEQ ID NO: 101640 - DNA, 28 bp, Artificial Sequence
  Description of Artificial Sequence: Synthetic oligonucleotide
actgcattgcactgggcatgctcagctg

SEQ ID NO: 101641 - DNA, 27 bp, Artificial Sequence
  Description of Artificial Sequence: Synthetic oligonucleotide
ctgcattgcactgggcatgctcagctg

SEQ ID NO: 101642 - DNA, 27 bp, Artificial Sequence
  Description of Artificial Sequence: Synthetic oligonucleotide
tgcattgcactgggcatgctcagctgg

SEQ ID NO: 101643 - DNA, 27 bp, Artificial Sequence
  Description of Artificial Sequence: Synthetic oligonucleotide
gcattgcactgggcatgctcagctgga

SEQ ID NO: 101644 - DNA, 27 bp, Artificial Sequence
  Description of Artificial Sequence: Synthetic oligonucleotide
cattgcactgggcatgctcagctggac

SEQ ID NO: 101645 - DNA, 30 bp, Artificial Sequence
  Description of Artificial Sequence: Synthetic oligonucleotide
attgcactgggcatgctcagctggacatac

SEQ ID NO: 101646 - DNA, 29 bp, Artificial Sequence
  Description of Artificial Sequence: Synthetic oligonucleotide
ttgcactgggcatgctcagctggacatac

SEQ ID NO: 101647 - DNA, 28 bp, Artificial Sequence
  Description of Artificial Sequence: Synthetic oligonucleotide
tgcactgggcatgctcagctggacatac

SEQ ID NO: 101648 - DNA, 27 bp, Artificial Sequence
  Description of Artificial Sequence: Synthetic oligonucleotide
gcactgggcatgctcagctggacatac

SEQ ID NO: 101649 - DNA, 28 bp, Artificial Sequence
  Description of Artificial Sequence: Synthetic oligonucleotide
cactgggcatgctcagctggacatacag

SEQ ID NO: 101650 - DNA, 33 bp, Artificial Sequence
  Description of Artificial Sequence: Synthetic oligonucleotide
actgggcatgctcagctggacatacagaaattg

SEQ ID NO: 101651 - DNA, 32 bp, Artificial Sequence
  Description of Artificial Sequence: Synthetic oligonucleotide
ctgggcatgctcagctggacatacagaaattg

SEQ ID NO: 101652 - DNA, 34 bp, Artificial Sequence
  Description of Artificial Sequence: Synthetic oligonucleotide
tgggcatgctcagctggacatacagaaattgttg

SEQ ID NO: 101653 - DNA, 33 bp, Artificial Sequence
  Description of Artificial Sequence: Synthetic oligonucleotide
gggcatgctcagctggacatacagaaattgttg

SEQ ID NO: 101654 - DNA, 40 bp, Artificial Sequence
  Description of Artificial Sequence: Synthetic oligonucleotide
ggcatgctcagctggacatacagaaattgttgaatttttg

SEQ ID NO: 101655 - DNA, 42 bp, Artificial Sequence
  Description of Artificial Sequence: Synthetic oligonucleotide
gcatgctcagctggacatacagaaattgttgaatttttgttg

SEQ ID NO: 101656 - DNA, 42 bp, Artificial Sequence
  Description of Artificial Sequence: Synthetic oligonucleotide
catgctcagctggacatacagaaattgttgaatttttgttgc

SEQ ID NO: 101657 - DNA, 44 bp, Artificial Sequence
  Description of Artificial Sequence: Synthetic oligonucleotide
atgctcagctggacatacagaaattgttgaatttttgttgcaac

SEQ ID NO: 101658 - DNA, 43 bp, Artificial Sequence
  Description of Artificial Sequence: Synthetic oligonucleotide
tgctcagctggacatacagaaattgttgaatttttgttgcaac

SEQ ID NO: 101659 - DNA, 42 bp, Artificial Sequence
  Description of Artificial Sequence: Synthetic oligonucleotide
gctcagctggacatacagaaattgttgaatttttgttgcaac

SEQ ID NO: 101660 - DNA, 44 bp, Artificial Sequence
  Description of Artificial Sequence: Synthetic oligonucleotide
ctcagctggacatacagaaattgttgaatttttgttgcaacttg

SEQ ID NO: 101661 - DNA, 44 bp, Artificial Sequence
  Description of Artificial Sequence: Synthetic oligonucleotide
tcagctggacatacagaaattgttgaatttttgttgcaacttgg

SEQ ID NO: 101662 - DNA, 43 bp, Artificial Sequence
  Description of Artificial Sequence: Synthetic oligonucleotide
cagctggacatacagaaattgttgaatttttgttgcaacttgg

SEQ ID NO: 101663 - DNA, 44 bp, Artificial Sequence
  Description of Artificial Sequence: Synthetic oligonucleotide
agctggacatacagaaattgttgaatttttgttgcaacttggag

SEQ ID NO: 101664 - DNA, 43 bp, Artificial Sequence
  Description of Artificial Sequence: Synthetic oligonucleotide
gctggacatacagaaattgttgaatttttgttgcaacttggag

SEQ ID NO: 101665 - DNA, 44 bp, Artificial Sequence
  Description of Artificial Sequence: Synthetic oligonucleotide
ctggacatacagaaattgttgaatttttgttgcaacttggagtg

SEQ ID NO: 101666 - DNA, 44 bp, Artificial Sequence
  Description of Artificial Sequence: Synthetic oligonucleotide
tggacatacagaaattgttgaatttttgttgcaacttggagtgc

SEQ ID NO: 101667 - DNA, 43 bp, Artificial Sequence
  Description of Artificial Sequence: Synthetic oligonucleotide
ggacatacagaaattgttgaatttttgttgcaacttggagtgc

SEQ ID NO: 101668 - DNA, 43 bp, Artificial Sequence
  Description of Artificial Sequence: Synthetic oligonucleotide
gacatacagaaattgttgaatttttgttgcaacttggagtgcc

SEQ ID NO: 101669 - DNA, 44 bp, Artificial Sequence
  Description of Artificial Sequence: Synthetic oligonucleotide
acatacagaaattgttgaatttttgttgcaacttggagtgccag

SEQ ID NO: 101670 - DNA, 43 bp, Artificial Sequence
  Description of Artificial Sequence: Synthetic oligonucleotide
catacagaaattgttgaatttttgttgcaacttggagtgccag

SEQ ID NO: 101671 - DNA, 44 bp, Artificial Sequence
  Description of Artificial Sequence: Synthetic oligonucleotide
atacagaaattgttgaatttttgttgcaacttggagtgccagtg

SEQ ID NO: 101672 - DNA, 43 bp, Artificial Sequence
  Description of Artificial Sequence: Synthetic oligonucleotide
tacagaaattgttgaatttttgttgcaacttggagtgccagtg

SEQ ID NO: 101673 - DNA, 42 bp, Artificial Sequence
  Description of Artificial Sequence: Synthetic oligonucleotide
acagaaattgttgaatttttgttgcaacttggagtgccagtg

SEQ ID NO: 101674 - DNA, 41 bp, Artificial Sequence
  Description of Artificial Sequence: Synthetic oligonucleotide
cagaaattgttgaatttttgttgcaacttggagtgccagtg

SEQ ID NO: 101675 - DNA, 44 bp, Artificial Sequence
  Description of Artificial Sequence: Synthetic oligonucleotide
agaaattgttgaatttttgttgcaacttggagtgccagtgaatg

SEQ ID NO: 101676 - DNA, 43 bp, Artificial Sequence
  Description of Artificial Sequence: Synthetic oligonucleotide
gaaattgttgaatttttgttgcaacttggagtgccagtgaatg

SEQ ID NO: 101677 - DNA, 48 bp, Artificial Sequence
  Description of Artificial Sequence: Synthetic oligonucleotide
aaattgttgaatttttgttgcaacttggagtgccagtgaatgataaag

SEQ ID NO: 101678 - DNA, 47 bp, Artificial Sequence
  Description of Artificial Sequence: Synthetic oligonucleotide
aattgttgaatttttgttgcaacttggagtgccagtgaatgataaag

SEQ ID NO: 101679 - DNA, 46 bp, Artificial Sequence
  Description of Artificial Sequence: Synthetic oligonucleotide
attgttgaatttttgttgcaacttggagtgccagtgaatgataaag

SEQ ID NO: 101680 - DNA, 45 bp, Artificial Sequence
  Description of Artificial Sequence: Synthetic oligonucleotide
ttgttgaatttttgttgcaacttggagtgccagtgaatgataaag

SEQ ID NO: 101681 - DNA, 44 bp, Artificial Sequence
  Description of Artificial Sequence: Synthetic oligonucleotide
tgttgaatttttgttgcaacttggagtgccagtgaatgataaag

SEQ ID NO: 101682 - DNA, 43 bp, Artificial Sequence
  Description of Artificial Sequence: Synthetic oligonucleotide
gttgaatttttgttgcaacttggagtgccagtgaatgataaag

SEQ ID NO: 101683 - DNA, 44 bp, Artificial Sequence
  Description of Artificial Sequence: Synthetic oligonucleotide
ttgaatttttgttgcaacttggagtgccagtgaatgataaagac

SEQ ID NO: 101684 - DNA, 43 bp, Artificial Sequence
  Description of Artificial Sequence: Synthetic oligonucleotide
tgaatttttgttgcaacttggagtgccagtgaatgataaagac

SEQ ID NO: 101685 - DNA, 42 bp, Artificial Sequence
  Description of Artificial Sequence: Synthetic oligonucleotide
gaatttttgttgcaacttggagtgccagtgaatgataaagac

SEQ ID NO: 101686 - DNA, 42 bp, Artificial Sequence
  Description of Artificial Sequence: Synthetic oligonucleotide
aatttttgttgcaacttggagtgccagtgaatgataaagacg

SEQ ID NO: 101687 - DNA, 41 bp, Artificial Sequence
  Description of Artificial Sequence: Synthetic oligonucleotide
atttttgttgcaacttggagtgccagtgaatgataaagacg

SEQ ID NO: 101688 - DNA, 40 bp, Artificial Sequence
  Description of Artificial Sequence: Synthetic oligonucleotide
tttttgttgcaacttggagtgccagtgaatgataaagacg

SEQ ID NO: 101689 - DNA, 39 bp, Artificial Sequence
  Description of Artificial Sequence: Synthetic oligonucleotide
ttttgttgcaacttggagtgccagtgaatgataaagacg

SEQ ID NO: 101690 - DNA, 38 bp, Artificial Sequence
  Description of Artificial Sequence: Synthetic oligonucleotide
tttgttgcaacttggagtgccagtgaatgataaagacg

SEQ ID NO: 101691 - DNA, 37 bp, Artificial Sequence
  Description of Artificial Sequence: Synthetic oligonucleotide
ttgttgcaacttggagtgccagtgaatgataaagacg

SEQ ID NO: 101692 - DNA, 36 bp, Artificial Sequence
  Description of Artificial Sequence: Synthetic oligonucleotide
tgttgcaacttggagtgccagtgaatgataaagacg

SEQ ID NO: 101693 - DNA, 35 bp, Artificial Sequence
  Description of Artificial Sequence: Synthetic oligonucleotide
gttgcaacttggagtgccagtgaatgataaagacg

SEQ ID NO: 101694 - DNA, 37 bp, Artificial Sequence
  Description of Artificial Sequence: Synthetic oligonucleotide
ttgcaacttggagtgccagtgaatgataaagacgatg

SEQ ID NO: 101695 - DNA, 36 bp, Artificial Sequence
  Description of Artificial Sequence: Synthetic oligonucleotide
tgcaacttggagtgccagtgaatgataaagacgatg

SEQ ID NO: 101696 - DNA, 35 bp, Artificial Sequence
  Description of Artificial Sequence: Synthetic oligonucleotide
gcaacttggagtgccagtgaatgataaagacgatg

SEQ ID NO: 101697 - DNA, 35 bp, Artificial Sequence
  Description of Artificial Sequence: Synthetic oligonucleotide
caacttggagtgccagtgaatgataaagacgatgc

SEQ ID NO: 101698 - DNA, 36 bp, Artificial Sequence
  Description of Artificial Sequence: Synthetic oligonucleotide
aacttggagtgccagtgaatgataaagacgatgcag

SEQ ID NO: 101699 - DNA, 35 bp, Artificial Sequence
  Description of Artificial Sequence: Synthetic oligonucleotide
acttggagtgccagtgaatgataaagacgatgcag

SEQ ID NO: 101700 - DNA, 34 bp, Artificial Sequence
  Description of Artificial Sequence: Synthetic oligonucleotide
cttggagtgccagtgaatgataaagacgatgcag

SEQ ID NO: 101701 - DNA, 34 bp, Artificial Sequence
  Description of Artificial Sequence: Synthetic oligonucleotide
ttggagtgccagtgaatgataaagacgatgcagg

SEQ ID NO: 101702 - DNA, 33 bp, Artificial Sequence
  Description of Artificial Sequence: Synthetic oligonucleotide
tggagtgccagtgaatgataaagacgatgcagg

SEQ ID NO: 101703 - DNA, 32 bp, Artificial Sequence
  Description of Artificial Sequence: Synthetic oligonucleotide
ggagtgccagtgaatgataaagacgatgcagg

SEQ ID NO: 101704 - DNA, 34 bp, Artificial Sequence
  Description of Artificial Sequence: Synthetic oligonucleotide
gagtgccagtgaatgataaagacgatgcaggttg

SEQ ID NO: 101705 - DNA, 34 bp, Artificial Sequence
  Description of Artificial Sequence: Synthetic oligonucleotide
agtgccagtgaatgataaagacgatgcaggttgg

SEQ ID NO: 101706 - DNA, 33 bp, Artificial Sequence
  Description of Artificial Sequence: Synthetic oligonucleotide
gtgccagtgaatgataaagacgatgcaggttgg

SEQ ID NO: 101707 - DNA, 34 bp, Artificial Sequence
  Description of Artificial Sequence: Synthetic oligonucleotide
tgccagtgaatgataaagacgatgcaggttggtc

SEQ ID NO: 101708 - DNA, 33 bp, Artificial Sequence
  Description of Artificial Sequence: Synthetic oligonucleotide
gccagtgaatgataaagacgatgcaggttggtc

SEQ ID NO: 101709 - DNA, 34 bp, Artificial Sequence
  Description of Artificial Sequence: Synthetic oligonucleotide
ccagtgaatgataaagacgatgcaggttggtctc

SEQ ID NO: 101710 - DNA, 34 bp, Artificial Sequence
  Description of Artificial Sequence: Synthetic oligonucleotide
cagtgaatgataaagacgatgcaggttggtctcc

SEQ ID NO: 101711 - DNA, 35 bp, Artificial Sequence
  Description of Artificial Sequence: Synthetic oligonucleotide
agtgaatgataaagacgatgcaggttggtctcctc

SEQ ID NO: 101712 - DNA, 34 bp, Artificial Sequence
  Description of Artificial Sequence: Synthetic oligonucleotide
gtgaatgataaagacgatgcaggttggtctcctc

SEQ ID NO: 101713 - DNA, 36 bp, Artificial Sequence
  Description of Artificial Sequence: Synthetic oligonucleotide
tgaatgataaagacgatgcaggttggtctcctcttc

SEQ ID NO: 101714 - DNA, 35 bp, Artificial Sequence
  Description of Artificial Sequence: Synthetic oligonucleotide
gaatgataaagacgatgcaggttggtctcctcttc

SEQ ID NO: 101715 - DNA, 40 bp, Artificial Sequence
  Description of Artificial Sequence: Synthetic oligonucleotide
aatgataaagacgatgcaggttggtctcctcttcatattg

SEQ ID NO: 101716 - DNA, 39 bp, Artificial Sequence
  Description of Artificial Sequence: Synthetic oligonucleotide
atgataaagacgatgcaggttggtctcctcttcatattg

SEQ ID NO: 101717 - DNA, 38 bp, Artificial Sequence
  Description of Artificial Sequence: Synthetic oligonucleotide
tgataaagacgatgcaggttggtctcctcttcatattg

SEQ ID NO: 101718 - DNA, 37 bp, Artificial Sequence
  Description of Artificial Sequence: Synthetic oligonucleotide
gataaagacgatgcaggttggtctcctcttcatattg

SEQ ID NO: 101719 - DNA, 37 bp, Artificial Sequence
  Description of Artificial Sequence: Synthetic oligonucleotide
ataaagacgatgcaggttggtctcctcttcatattgc

SEQ ID NO: 101720 - DNA, 36 bp, Artificial Sequence
  Description of Artificial Sequence: Synthetic oligonucleotide
taaagacgatgcaggttggtctcctcttcatattgc

SEQ ID NO: 101721 - DNA, 35 bp, Artificial Sequence
  Description of Artificial Sequence: Synthetic oligonucleotide
aaagacgatgcaggttggtctcctcttcatattgc

SEQ ID NO: 101722 - DNA, 34 bp, Artificial Sequence
  Description of Artificial Sequence: Synthetic oligonucleotide
aagacgatgcaggttggtctcctcttcatattgc

SEQ ID NO: 101723 - DNA, 33 bp, Artificial Sequence
  Description of Artificial Sequence: Synthetic oligonucleotide
agacgatgcaggttggtctcctcttcatattgc

SEQ ID NO: 101724 - DNA, 32 bp, Artificial Sequence
  Description of Artificial Sequence: Synthetic oligonucleotide
gacgatgcaggttggtctcctcttcatattgc

SEQ ID NO: 101725 - DNA, 32 bp, Artificial Sequence
  Description of Artificial Sequence: Synthetic oligonucleotide
acgatgcaggttggtctcctcttcatattgcg

SEQ ID NO: 101726 - DNA, 31 bp, Artificial Sequence
  Description of Artificial Sequence: Synthetic oligonucleotide
cgatgcaggttggtctcctcttcatattgcg

SEQ ID NO: 101727 - DNA, 31 bp, Artificial Sequence
  Description of Artificial Sequence: Synthetic oligonucleotide
gatgcaggttggtctcctcttcatattgcgg

SEQ ID NO: 101728 - DNA, 31 bp, Artificial Sequence
  Description of Artificial Sequence: Synthetic oligonucleotide
atgcaggttggtctcctcttcatattgcggc

SEQ ID NO: 101729 - DNA, 30 bp, Artificial Sequence
  Description of Artificial Sequence: Synthetic oligonucleotide
tgcaggttggtctcctcttcatattgcggc

SEQ ID NO: 101730 - DNA, 29 bp, Artificial Sequence
  Description of Artificial Sequence: Synthetic oligonucleotide
gcaggttggtctcctcttcatattgcggc

SEQ ID NO: 101731 - DNA, 31 bp, Artificial Sequence
  Description of Artificial Sequence: Synthetic oligonucleotide
caggttggtctcctcttcatattgcggcttc

SEQ ID NO: 101732 - DNA, 32 bp, Artificial Sequence
  Description of Artificial Sequence: Synthetic oligonucleotide
aggttggtctcctcttcatattgcggcttctg

SEQ ID NO: 101733 - DNA, 31 bp, Artificial Sequence
  Description of Artificial Sequence: Synthetic oligonucleotide
ggttggtctcctcttcatattgcggcttctg

SEQ ID NO: 101734 - DNA, 31 bp, Artificial Sequence
  Description of Artificial Sequence: Synthetic oligonucleotide
gttggtctcctcttcatattgcggcttctgc

SEQ ID NO: 101735 - DNA, 32 bp, Artificial Sequence
  Description of Artificial Sequence: Synthetic oligonucleotide
ttggtctcctcttcatattgcggcttctgctg

SEQ ID NO: 101736 - DNA, 31 bp, Artificial Sequence
  Description of Artificial Sequence: Synthetic oligonucleotide
tggtctcctcttcatattgcggcttctgctg

SEQ ID NO: 101737 - DNA, 30 bp, Artificial Sequence
  Description of Artificial Sequence: Synthetic oligonucleotide
ggtctcctcttcatattgcggcttctgctg

SEQ ID NO: 101738 - DNA, 30 bp, Artificial Sequence
  Description of Artificial Sequence: Synthetic oligonucleotide
gtctcctcttcatattgcggcttctgctgg

SEQ ID NO: 101739 - DNA, 30 bp, Artificial Sequence
  Description of Artificial Sequence: Synthetic oligonucleotide
tctcctcttcatattgcggcttctgctggc

SEQ ID NO: 101740 - DNA, 29 bp, Artificial Sequence
  Description of Artificial Sequence: Synthetic oligonucleotide
ctcctcttcatattgcggcttctgctggc

SEQ ID NO: 101741 - DNA, 29 bp, Artificial Sequence
  Description of Artificial Sequence: Synthetic oligonucleotide
tcctcttcatattgcggcttctgctggcc

SEQ ID NO: 101742 - DNA, 28 bp, Artificial Sequence
  Description of Artificial Sequence: Synthetic oligonucleotide
cctcttcatattgcggcttctgctggcc

SEQ ID NO: 101743 - DNA, 28 bp, Artificial Sequence
  Description of Artificial Sequence: Synthetic oligonucleotide
ctcttcatattgcggcttctgctggccg

SEQ ID NO: 101744 - DNA, 28 bp, Artificial Sequence
  Description of Artificial Sequence: Synthetic oligonucleotide
tcttcatattgcggcttctgctggccgg

SEQ ID NO: 101745 - DNA, 27 bp, Artificial Sequence
  Description of Artificial Sequence: Synthetic oligonucleotide
cttcatattgcggcttctgctggccgg

SEQ ID NO: 101746 - DNA, 27 bp, Artificial Sequence
  Description of Artificial Sequence: Synthetic oligonucleotide
ttcatattgcggcttctgctggccggg

SEQ ID NO: 101747 - DNA, 27 bp, Artificial Sequence
  Description of Artificial Sequence: Synthetic oligonucleotide
tcatattgcggcttctgctggccggga

SEQ ID NO: 101748 - DNA, 27 bp, Artificial Sequence
  Description of Artificial Sequence: Synthetic oligonucleotide
catattgcggcttctgctggccgggat

SEQ ID NO: 101749 - DNA, 27 bp, Artificial Sequence
  Description of Artificial Sequence: Synthetic oligonucleotide
atattgcggcttctgctggccgggatg

SEQ ID NO: 101750 - DNA, 27 bp, Artificial Sequence
  Description of Artificial Sequence: Synthetic oligonucleotide
tattgcggcttctgctggccgggatga

SEQ ID NO: 101751 - DNA, 26 bp, Artificial Sequence
  Description of Artificial Sequence: Synthetic oligonucleotide
attgcggcttctgctggccgggatga

SEQ ID NO: 101752 - DNA, 25 bp, Artificial Sequence
  Description of Artificial Sequence: Synthetic oligonucleotide
ttgcggcttctgctggccgggatga

SEQ ID NO: 101753 - DNA, 24 bp, Artificial Sequence
  Description of Artificial Sequence: Synthetic oligonucleotide
tgcggcttctgctggccgggatga

SEQ ID NO: 101754 - DNA, 23 bp, Artificial Sequence
  Description of Artificial Sequence: Synthetic oligonucleotide
gcggcttctgctggccgggatga

SEQ ID NO: 101755 - DNA, 26 bp, Artificial Sequence
  Description of Artificial Sequence: Synthetic oligonucleotide
cggcttctgctggccgggatgagatt

SEQ ID NO: 101756 - DNA, 27 bp, Artificial Sequence
  Description of Artificial Sequence: Synthetic oligonucleotide
ggcttctgctggccgggatgagattgt

SEQ ID NO: 101757 - DNA, 31 bp, Artificial Sequence
  Description of Artificial Sequence: Synthetic oligonucleotide
gcttctgctggccgggatgagattgtaaaag

SEQ ID NO: 101758 - DNA, 31 bp, Artificial Sequence
  Description of Artificial Sequence: Synthetic oligonucleotide
cttctgctggccgggatgagattgtaaaagc

SEQ ID NO: 101759 - DNA, 31 bp, Artificial Sequence
  Description of Artificial Sequence: Synthetic oligonucleotide
ttctgctggccgggatgagattgtaaaagcc

SEQ ID NO: 101760 - DNA, 30 bp, Artificial Sequence
  Description of Artificial Sequence: Synthetic oligonucleotide
tctgctggccgggatgagattgtaaaagcc

SEQ ID NO: 101761 - DNA, 29 bp, Artificial Sequence
  Description of Artificial Sequence: Synthetic oligonucleotide
ctgctggccgggatgagattgtaaaagcc

SEQ ID NO: 101762 - DNA, 29 bp, Artificial Sequence
  Description of Artificial Sequence: Synthetic oligonucleotide
tgctggccgggatgagattgtaaaagccc

SEQ ID NO: 101763 - DNA, 28 bp, Artificial Sequence
  Description of Artificial Sequence: Synthetic oligonucleotide
gctggccgggatgagattgtaaaagccc

SEQ ID NO: 101764 - DNA, 30 bp, Artificial Sequence
  Description of Artificial Sequence: Synthetic oligonucleotide
ctggccgggatgagattgtaaaagcccttc

SEQ ID NO: 101765 - DNA, 31 bp, Artificial Sequence
  Description of Artificial Sequence: Synthetic oligonucleotide
tggccgggatgagattgtaaaagcccttctg

SEQ ID NO: 101766 - DNA, 30 bp, Artificial Sequence
  Description of Artificial Sequence: Synthetic oligonucleotide
ggccgggatgagattgtaaaagcccttctg

SEQ ID NO: 101767 - DNA, 30 bp, Artificial Sequence
  Description of Artificial Sequence: Synthetic oligonucleotide
gccgggatgagattgtaaaagcccttctgg

SEQ ID NO: 101768 - DNA, 30 bp, Artificial Sequence
  Description of Artificial Sequence: Synthetic oligonucleotide
ccgggatgagattgtaaaagcccttctggg

SEQ ID NO: 101769 - DNA, 34 bp, Artificial Sequence
  Description of Artificial Sequence: Synthetic oligonucleotide
cgggatgagattgtaaaagcccttctgggaaaag

SEQ ID NO: 101770 - DNA, 34 bp, Artificial Sequence
  Description of Artificial Sequence: Synthetic oligonucleotide
gggatgagattgtaaaagcccttctgggaaaagg

SEQ ID NO: 101771 - DNA, 35 bp, Artificial Sequence
  Description of Artificial Sequence: Synthetic oligonucleotide
ggatgagattgtaaaagcccttctgggaaaaggtg

SEQ ID NO: 101772 - DNA, 35 bp, Artificial Sequence
  Description of Artificial Sequence: Synthetic oligonucleotide
gatgagattgtaaaagcccttctgggaaaaggtgc

SEQ ID NO: 101773 - DNA, 36 bp, Artificial Sequence
  Description of Artificial Sequence: Synthetic oligonucleotide
atgagattgtaaaagcccttctgggaaaaggtgctc

SEQ ID NO: 101774 - DNA, 35 bp, Artificial Sequence
  Description of Artificial Sequence: Synthetic oligonucleotide
tgagattgtaaaagcccttctgggaaaaggtgctc

SEQ ID NO: 101775 - DNA, 34 bp, Artificial Sequence
  Description of Artificial Sequence: Synthetic oligonucleotide
gagattgtaaaagcccttctgggaaaaggtgctc

SEQ ID NO: 101776 - DNA, 36 bp, Artificial Sequence
  Description of Artificial Sequence: Synthetic oligonucleotide
agattgtaaaagcccttctgggaaaaggtgctcaag

SEQ ID NO: 101777 - DNA, 35 bp, Artificial Sequence
  Description of Artificial Sequence: Synthetic oligonucleotide
gattgtaaaagcccttctgggaaaaggtgctcaag

SEQ ID NO: 101778 - DNA, 36 bp, Artificial Sequence
  Description of Artificial Sequence: Synthetic oligonucleotide
attgtaaaagcccttctgggaaaaggtgctcaagtg

SEQ ID NO: 101779 - DNA, 35 bp, Artificial Sequence
  Description of Artificial Sequence: Synthetic oligonucleotide
ttgtaaaagcccttctgggaaaaggtgctcaagtg

SEQ ID NO: 101780 - DNA, 34 bp, Artificial Sequence
  Description of Artificial Sequence: Synthetic oligonucleotide
tgtaaaagcccttctgggaaaaggtgctcaagtg

SEQ ID NO: 101781 - DNA, 33 bp, Artificial Sequence
  Description of Artificial Sequence: Synthetic oligonucleotide
gtaaaagcccttctgggaaaaggtgctcaagtg

SEQ ID NO: 101782 - DNA, 36 bp, Artificial Sequence
  Description of Artificial Sequence: Synthetic oligonucleotide
taaaagcccttctgggaaaaggtgctcaagtgaatg

SEQ ID NO: 101783 - DNA, 35 bp, Artificial Sequence
  Description of Artificial Sequence: Synthetic oligonucleotide
aaaagcccttctgggaaaaggtgctcaagtgaatg

SEQ ID NO: 101784 - DNA, 34 bp, Artificial Sequence
  Description of Artificial Sequence: Synthetic oligonucleotide
aaagcccttctgggaaaaggtgctcaagtgaatg

SEQ ID NO: 101785 - DNA, 33 bp, Artificial Sequence
  Description of Artificial Sequence: Synthetic oligonucleotide
aagcccttctgggaaaaggtgctcaagtgaatg

SEQ ID NO: 101786 - DNA, 32 bp, Artificial Sequence
  Description of Artificial Sequence: Synthetic oligonucleotide
agcccttctgggaaaaggtgctcaagtgaatg

SEQ ID NO: 101787 - DNA, 31 bp, Artificial Sequence
  Description of Artificial Sequence: Synthetic oligonucleotide
gcccttctgggaaaaggtgctcaagtgaatg

SEQ ID NO: 101788 - DNA, 31 bp, Artificial Sequence
  Description of Artificial Sequence: Synthetic oligonucleotide
cccttctgggaaaaggtgctcaagtgaatgc

SEQ ID NO: 101789 - DNA, 32 bp, Artificial Sequence
  Description of Artificial Sequence: Synthetic oligonucleotide
ccttctgggaaaaggtgctcaagtgaatgctg

SEQ ID NO: 101790 - DNA, 33 bp, Artificial Sequence
  Description of Artificial Sequence: Synthetic oligonucleotide
cttctgggaaaaggtgctcaagtgaatgctgtc

SEQ ID NO: 101791 - DNA, 36 bp, Artificial Sequence
  Description of Artificial Sequence: Synthetic oligonucleotide
ttctgggaaaaggtgctcaagtgaatgctgtcaatc

SEQ ID NO: 101792 - DNA, 35 bp, Artificial Sequence
  Description of Artificial Sequence: Synthetic oligonucleotide
tctgggaaaaggtgctcaagtgaatgctgtcaatc

SEQ ID NO: 101793 - DNA, 34 bp, Artificial Sequence
  Description of Artificial Sequence: Synthetic oligonucleotide
ctgggaaaaggtgctcaagtgaatgctgtcaatc

SEQ ID NO: 101794 - DNA, 39 bp, Artificial Sequence
  Description of Artificial Sequence: Synthetic oligonucleotide
tgggaaaaggtgctcaagtgaatgctgtcaatcaaaatg

SEQ ID NO: 101795 - DNA, 38 bp, Artificial Sequence
  Description of Artificial Sequence: Synthetic oligonucleotide
gggaaaaggtgctcaagtgaatgctgtcaatcaaaatg

SEQ ID NO: 101796 - DNA, 38 bp, Artificial Sequence
  Description of Artificial Sequence: Synthetic oligonucleotide
ggaaaaggtgctcaagtgaatgctgtcaatcaaaatgg

SEQ ID NO: 101797 - DNA, 38 bp, Artificial Sequence
  Description of Artificial Sequence: Synthetic oligonucleotide
gaaaaggtgctcaagtgaatgctgtcaatcaaaatggc

SEQ ID NO: 101798 - DNA, 39 bp, Artificial Sequence
  Description of Artificial Sequence: Synthetic oligonucleotide
aaaaggtgctcaagtgaatgctgtcaatcaaaatggctg

SEQ ID NO: 101799 - DNA, 38 bp, Artificial Sequence
  Description of Artificial Sequence: Synthetic oligonucleotide
aaaggtgctcaagtgaatgctgtcaatcaaaatggctg

SEQ ID NO: 101800 - DNA, 37 bp, Artificial Sequence
  Description of Artificial Sequence: Synthetic oligonucleotide
aaggtgctcaagtgaatgctgtcaatcaaaatggctg

SEQ ID NO: 101801 - DNA, 36 bp, Artificial Sequence
  Description of Artificial Sequence: Synthetic oligonucleotide
aggtgctcaagtgaatgctgtcaatcaaaatggctg

SEQ ID NO: 101802 - DNA, 35 bp, Artificial Sequence
  Description of Artificial Sequence: Synthetic oligonucleotide
ggtgctcaagtgaatgctgtcaatcaaaatggctg

SEQ ID NO: 101803 - DNA, 37 bp, Artificial Sequence
  Description of Artificial Sequence: Synthetic oligonucleotide
gtgctcaagtgaatgctgtcaatcaaaatggctgtac

SEQ ID NO: 101804 - DNA, 38 bp, Artificial Sequence
  Description of Artificial Sequence: Synthetic oligonucleotide
tgctcaagtgaatgctgtcaatcaaaatggctgtactc

SEQ ID NO: 101805 - DNA, 37 bp, Artificial Sequence
  Description of Artificial Sequence: Synthetic oligonucleotide
gctcaagtgaatgctgtcaatcaaaatggctgtactc

SEQ ID NO: 101806 - DNA, 37 bp, Artificial Sequence
  Description of Artificial Sequence: Synthetic oligonucleotide
ctcaagtgaatgctgtcaatcaaaatggctgtactcc

SEQ ID NO: 101807 - DNA, 37 bp, Artificial Sequence
  Description of Artificial Sequence: Synthetic oligonucleotide
tcaagtgaatgctgtcaatcaaaatggctgtactccc

SEQ ID NO: 101808 - DNA, 36 bp, Artificial Sequence
  Description of Artificial Sequence: Synthetic oligonucleotide
caagtgaatgctgtcaatcaaaatggctgtactccc

SEQ ID NO: 101809 - DNA, 39 bp, Artificial Sequence
  Description of Artificial Sequence: Synthetic oligonucleotide
aagtgaatgctgtcaatcaaaatggctgtactcccttac

SEQ ID NO: 101810 - DNA, 38 bp, Artificial Sequence
  Description of Artificial Sequence: Synthetic oligonucleotide
agtgaatgctgtcaatcaaaatggctgtactcccttac

SEQ ID NO: 101811 - DNA, 37 bp, Artificial Sequence
  Description of Artificial Sequence: Synthetic oligonucleotide
gtgaatgctgtcaatcaaaatggctgtactcccttac

SEQ ID NO: 101812 - DNA, 42 bp, Artificial Sequence
  Description of Artificial Sequence: Synthetic oligonucleotide
tgaatgctgtcaatcaaaatggctgtactcccttacattatg

SEQ ID NO: 101813 - DNA, 41 bp, Artificial Sequence
  Description of Artificial Sequence: Synthetic oligonucleotide
gaatgctgtcaatcaaaatggctgtactcccttacattatg

SEQ ID NO: 101814 - DNA, 41 bp, Artificial Sequence
  Description of Artificial Sequence: Synthetic oligonucleotide
aatgctgtcaatcaaaatggctgtactcccttacattatgc

SEQ ID NO: 101815 - DNA, 40 bp, Artificial Sequence
  Description of Artificial Sequence: Synthetic oligonucleotide
atgctgtcaatcaaaatggctgtactcccttacattatgc

SEQ ID NO: 101816 - DNA, 39 bp, Artificial Sequence
  Description of Artificial Sequence: Synthetic oligonucleotide
tgctgtcaatcaaaatggctgtactcccttacattatgc

SEQ ID NO: 101817 - DNA, 38 bp, Artificial Sequence
  Description of Artificial Sequence: Synthetic oligonucleotide
gctgtcaatcaaaatggctgtactcccttacattatgc

SEQ ID NO: 101818 - DNA, 39 bp, Artificial Sequence
  Description of Artificial Sequence: Synthetic oligonucleotide
ctgtcaatcaaaatggctgtactcccttacattatgcag

SEQ ID NO: 101819 - DNA, 39 bp, Artificial Sequence
  Description of Artificial Sequence: Synthetic oligonucleotide
tgtcaatcaaaatggctgtactcccttacattatgcagc

SEQ ID NO: 101820 - DNA, 38 bp, Artificial Sequence
  Description of Artificial Sequence: Synthetic oligonucleotide
gtcaatcaaaatggctgtactcccttacattatgcagc

SEQ ID NO: 101821 - DNA, 40 bp, Artificial Sequence
  Description of Artificial Sequence: Synthetic oligonucleotide
tcaatcaaaatggctgtactcccttacattatgcagcttc

SEQ ID NO: 101822 - DNA, 39 bp, Artificial Sequence
  Description of Artificial Sequence: Synthetic oligonucleotide
caatcaaaatggctgtactcccttacattatgcagcttc

SEQ ID NO: 101823 - DNA, 39 bp, Artificial Sequence
  Description of Artificial Sequence: Synthetic oligonucleotide
aatcaaaatggctgtactcccttacattatgcagcttcg

SEQ ID NO: 101824 - DNA, 38 bp, Artificial Sequence
  Description of Artificial Sequence: Synthetic oligonucleotide
atcaaaatggctgtactcccttacattatgcagcttcg

SEQ ID NO: 101825 - DNA, 37 bp, Artificial Sequence
  Description of Artificial Sequence: Synthetic oligonucleotide
tcaaaatggctgtactcccttacattatgcagcttcg

SEQ ID NO: 101826 - DNA, 36 bp, Artificial Sequence
  Description of Artificial Sequence: Synthetic oligonucleotide
caaaatggctgtactcccttacattatgcagcttcg

SEQ ID NO: 101827 - DNA, 41 bp, Artificial Sequence
  Description of Artificial Sequence: Synthetic oligonucleotide
aaaatggctgtactcccttacattatgcagcttcgaaaaac

SEQ ID NO: 101828 - DNA, 40 bp, Artificial Sequence
  Description of Artificial Sequence: Synthetic oligonucleotide
aaatggctgtactcccttacattatgcagcttcgaaaaac

SEQ ID NO: 101829 - DNA, 39 bp, Artificial Sequence
  Description of Artificial Sequence: Synthetic oligonucleotide
aatggctgtactcccttacattatgcagcttcgaaaaac

SEQ ID NO: 101830 - DNA, 38 bp, Artificial Sequence
  Description of Artificial Sequence: Synthetic oligonucleotide
atggctgtactcccttacattatgcagcttcgaaaaac

SEQ ID NO: 101831 - DNA, 37 bp, Artificial Sequence
  Description of Artificial Sequence: Synthetic oligonucleotide
tggctgtactcccttacattatgcagcttcgaaaaac

SEQ ID NO: 101832 - DNA, 36 bp, Artificial Sequence
  Description of Artificial Sequence: Synthetic oligonucleotide
ggctgtactcccttacattatgcagcttcgaaaaac

SEQ ID NO: 101833 - DNA, 37 bp, Artificial Sequence
  Description of Artificial Sequence: Synthetic oligonucleotide
gctgtactcccttacattatgcagcttcgaaaaacag

SEQ ID NO: 101834 - DNA, 37 bp, Artificial Sequence
  Description of Artificial Sequence: Synthetic oligonucleotide
ctgtactcccttacattatgcagcttcgaaaaacagg

SEQ ID NO: 101835 - DNA, 37 bp, Artificial Sequence
  Description of Artificial Sequence: Synthetic oligonucleotide
tgtactcccttacattatgcagcttcgaaaaacaggc

SEQ ID NO: 101836 - DNA, 36 bp, Artificial Sequence
  Description of Artificial Sequence: Synthetic oligonucleotide
gtactcccttacattatgcagcttcgaaaaacaggc

SEQ ID NO: 101837 - DNA, 38 bp, Artificial Sequence
  Description of Artificial Sequence: Synthetic oligonucleotide
tactcccttacattatgcagcttcgaaaaacaggcatg

SEQ ID NO: 101838 - DNA, 37 bp, Artificial Sequence
  Description of Artificial Sequence: Synthetic oligonucleotide
actcccttacattatgcagcttcgaaaaacaggcatg

SEQ ID NO: 101839 - DNA, 36 bp, Artificial Sequence
  Description of Artificial Sequence: Synthetic oligonucleotide
ctcccttacattatgcagcttcgaaaaacaggcatg

SEQ ID NO: 101840 - DNA, 37 bp, Artificial Sequence
  Description of Artificial Sequence: Synthetic oligonucleotide
tcccttacattatgcagcttcgaaaaacaggcatgag

SEQ ID NO: 101841 - DNA, 36 bp, Artificial Sequence
  Description of Artificial Sequence: Synthetic oligonucleotide
cccttacattatgcagcttcgaaaaacaggcatgag

SEQ ID NO: 101842 - DNA, 38 bp, Artificial Sequence
  Description of Artificial Sequence: Synthetic oligonucleotide
ccttacattatgcagcttcgaaaaacaggcatgagatc

SEQ ID NO: 101843 - DNA, 38 bp, Artificial Sequence
  Description of Artificial Sequence: Synthetic oligonucleotide
cttacattatgcagcttcgaaaaacaggcatgagatcg

SEQ ID NO: 101844 - DNA, 38 bp, Artificial Sequence
  Description of Artificial Sequence: Synthetic oligonucleotide
ttacattatgcagcttcgaaaaacaggcatgagatcgc

SEQ ID NO: 101845 - DNA, 37 bp, Artificial Sequence
  Description of Artificial Sequence: Synthetic oligonucleotide
tacattatgcagcttcgaaaaacaggcatgagatcgc

SEQ ID NO: 101846 - DNA, 36 bp, Artificial Sequence
  Description of Artificial Sequence: Synthetic oligonucleotide
acattatgcagcttcgaaaaacaggcatgagatcgc

SEQ ID NO: 101847 - DNA, 35 bp, Artificial Sequence
  Description of Artificial Sequence: Synthetic oligonucleotide
cattatgcagcttcgaaaaacaggcatgagatcgc

SEQ ID NO: 101848 - DNA, 36 bp, Artificial Sequence
  Description of Artificial Sequence: Synthetic oligonucleotide
attatgcagcttcgaaaaacaggcatgagatcgctg

SEQ ID NO: 101849 - DNA, 35 bp, Artificial Sequence
  Description of Artificial Sequence: Synthetic oligonucleotide
ttatgcagcttcgaaaaacaggcatgagatcgctg

SEQ ID NO: 101850 - DNA, 34 bp, Artificial Sequence
  Description of Artificial Sequence: Synthetic oligonucleotide
tatgcagcttcgaaaaacaggcatgagatcgctg

SEQ ID NO: 101851 - DNA, 33 bp, Artificial Sequence
  Description of Artificial Sequence: Synthetic oligonucleotide
atgcagcttcgaaaaacaggcatgagatcgctg

SEQ ID NO: 101852 - DNA, 32 bp, Artificial Sequence
  Description of Artificial Sequence: Synthetic oligonucleotide
tgcagcttcgaaaaacaggcatgagatcgctg

SEQ ID NO: 101853 - DNA, 31 bp, Artificial Sequence
  Description of Artificial Sequence: Synthetic oligonucleotide
gcagcttcgaaaaacaggcatgagatcgctg

SEQ ID NO: 101854 - DNA, 32 bp, Artificial Sequence
  Description of Artificial Sequence: Synthetic oligonucleotide
cagcttcgaaaaacaggcatgagatcgctgtc

SEQ ID NO: 101855 - DNA, 34 bp, Artificial Sequence
  Description of Artificial Sequence: Synthetic oligonucleotide
agcttcgaaaaacaggcatgagatcgctgtcatg

SEQ ID NO: 101856 - DNA, 33 bp, Artificial Sequence
  Description of Artificial Sequence: Synthetic oligonucleotide
gcttcgaaaaacaggcatgagatcgctgtcatg

SEQ ID NO: 101857 - DNA, 36 bp, Artificial Sequence
  Description of Artificial Sequence: Synthetic oligonucleotide
cttcgaaaaacaggcatgagatcgctgtcatgttac

SEQ ID NO: 101858 - DNA, 37 bp, Artificial Sequence
  Description of Artificial Sequence: Synthetic oligonucleotide
ttcgaaaaacaggcatgagatcgctgtcatgttactg

SEQ ID NO: 101859 - DNA, 36 bp, Artificial Sequence
  Description of Artificial Sequence: Synthetic oligonucleotide
tcgaaaaacaggcatgagatcgctgtcatgttactg

SEQ ID NO: 101860 - DNA, 35 bp, Artificial Sequence
  Description of Artificial Sequence: Synthetic oligonucleotide
cgaaaaacaggcatgagatcgctgtcatgttactg

SEQ ID NO: 101861 - DNA, 35 bp, Artificial Sequence
  Description of Artificial Sequence: Synthetic oligonucleotide
gaaaaacaggcatgagatcgctgtcatgttactgg

SEQ ID NO: 101862 - DNA, 37 bp, Artificial Sequence
  Description of Artificial Sequence: Synthetic oligonucleotide
aaaaacaggcatgagatcgctgtcatgttactggaag

SEQ ID NO: 101863 - DNA, 36 bp, Artificial Sequence
  Description of Artificial Sequence: Synthetic oligonucleotide
aaaacaggcatgagatcgctgtcatgttactggaag

SEQ ID NO: 101864 - DNA, 35 bp, Artificial Sequence
  Description of Artificial Sequence: Synthetic oligonucleotide
aaacaggcatgagatcgctgtcatgttactggaag

SEQ ID NO: 101865 - DNA, 34 bp, Artificial Sequence
  Description of Artificial Sequence: Synthetic oligonucleotide
aacaggcatgagatcgctgtcatgttactggaag

SEQ ID NO: 101866 - DNA, 33 bp, Artificial Sequence
  Description of Artificial Sequence: Synthetic oligonucleotide
acaggcatgagatcgctgtcatgttactggaag

SEQ ID NO: 101867 - DNA, 32 bp, Artificial Sequence
  Description of Artificial Sequence: Synthetic oligonucleotide
caggcatgagatcgctgtcatgttactggaag

SEQ ID NO: 101868 - DNA, 32 bp, Artificial Sequence
  Description of Artificial Sequence: Synthetic oligonucleotide
aggcatgagatcgctgtcatgttactggaagg

SEQ ID NO: 101869 - DNA, 31 bp, Artificial Sequence
  Description of Artificial Sequence: Synthetic oligonucleotide
ggcatgagatcgctgtcatgttactggaagg

SEQ ID NO: 101870 - DNA, 31 bp, Artificial Sequence
  Description of Artificial Sequence: Synthetic oligonucleotide
gcatgagatcgctgtcatgttactggaaggc

SEQ ID NO: 101871 - DNA, 31 bp, Artificial Sequence
  Description of Artificial Sequence: Synthetic oligonucleotide
catgagatcgctgtcatgttactggaaggcg

SEQ ID NO: 101872 - DNA, 31 bp, Artificial Sequence
  Description of Artificial Sequence: Synthetic oligonucleotide
atgagatcgctgtcatgttactggaaggcgg

SEQ ID NO: 101873 - DNA, 30 bp, Artificial Sequence
  Description of Artificial Sequence: Synthetic oligonucleotide
tgagatcgctgtcatgttactggaaggcgg

SEQ ID NO: 101874 - DNA, 29 bp, Artificial Sequence
  Description of Artificial Sequence: Synthetic oligonucleotide
gagatcgctgtcatgttactggaaggcgg

SEQ ID NO: 101875 - DNA, 29 bp, Artificial Sequence
  Description of Artificial Sequence: Synthetic oligonucleotide
agatcgctgtcatgttactggaaggcggg

SEQ ID NO: 101876 - DNA, 28 bp, Artificial Sequence
  Description of Artificial Sequence: Synthetic oligonucleotide
gatcgctgtcatgttactggaaggcggg

SEQ ID NO: 101877 - DNA, 28 bp, Artificial Sequence
  Description of Artificial Sequence: Synthetic oligonucleotide
atcgctgtcatgttactggaaggcgggg

SEQ ID NO: 101878 - DNA, 27 bp, Artificial Sequence
  Description of Artificial Sequence: Synthetic oligonucleotide
tcgctgtcatgttactggaaggcgggg

SEQ ID NO: 101879 - DNA, 26 bp, Artificial Sequence
  Description of Artificial Sequence: Synthetic oligonucleotide
cgctgtcatgttactggaaggcgggg

SEQ ID NO: 101880 - DNA, 27 bp, Artificial Sequence
  Description of Artificial Sequence: Synthetic oligonucleotide
gctgtcatgttactggaaggcggggct

SEQ ID NO: 101881 - DNA, 30 bp, Artificial Sequence
  Description of Artificial Sequence: Synthetic oligonucleotide
ctgtcatgttactggaaggcggggctaatc

SEQ ID NO: 101882 - DNA, 30 bp, Artificial Sequence
  Description of Artificial Sequence: Synthetic oligonucleotide
tgtcatgttactggaaggcggggctaatcc

SEQ ID NO: 101883 - DNA, 29 bp, Artificial Sequence
  Description of Artificial Sequence: Synthetic oligonucleotide
gtcatgttactggaaggcggggctaatcc

SEQ ID NO: 101884 - DNA, 30 bp, Artificial Sequence
  Description of Artificial Sequence: Synthetic oligonucleotide
tcatgttactggaaggcggggctaatccag

SEQ ID NO: 101885 - DNA, 29 bp, Artificial Sequence
  Description of Artificial Sequence: Synthetic oligonucleotide
catgttactggaaggcggggctaatccag

SEQ ID NO: 101886 - DNA, 31 bp, Artificial Sequence
  Description of Artificial Sequence: Synthetic oligonucleotide
atgttactggaaggcggggctaatccagatg

SEQ ID NO: 101887 - DNA, 30 bp, Artificial Sequence
  Description of Artificial Sequence: Synthetic oligonucleotide
tgttactggaaggcggggctaatccagatg

SEQ ID NO: 101888 - DNA, 29 bp, Artificial Sequence
  Description of Artificial Sequence: Synthetic oligonucleotide
gttactggaaggcggggctaatccagatg

SEQ ID NO: 101889 - DNA, 29 bp, Artificial Sequence
  Description of Artificial Sequence: Synthetic oligonucleotide
ttactggaaggcggggctaatccagatgc

SEQ ID NO: 101890 - DNA, 28 bp, Artificial Sequence
  Description of Artificial Sequence: Synthetic oligonucleotide
tactggaaggcggggctaatccagatgc

SEQ ID NO: 101891 - DNA, 27 bp, Artificial Sequence
  Description of Artificial Sequence: Synthetic oligonucleotide
actggaaggcggggctaatccagatgc

SEQ ID NO: 101892 - DNA, 27 bp, Artificial Sequence
  Description of Artificial Sequence: Synthetic oligonucleotide
ctggaaggcggggctaatccagatgct

SEQ ID NO: 101893 - DNA, 29 bp, Artificial Sequence
  Description of Artificial Sequence: Synthetic oligonucleotide
tggaaggcggggctaatccagatgctaag

SEQ ID NO: 101894 - DNA, 28 bp, Artificial Sequence
  Description of Artificial Sequence: Synthetic oligonucleotide
ggaaggcggggctaatccagatgctaag

SEQ ID NO: 101895 - DNA, 28 bp, Artificial Sequence
  Description of Artificial Sequence: Synthetic oligonucleotide
gaaggcggggctaatccagatgctaagg

SEQ ID NO: 101896 - DNA, 29 bp, Artificial Sequence
  Description of Artificial Sequence: Synthetic oligonucleotide
aaggcggggctaatccagatgctaaggac

SEQ ID NO: 101897 - DNA, 28 bp, Artificial Sequence
  Description of Artificial Sequence: Synthetic oligonucleotide
aggcggggctaatccagatgctaaggac

SEQ ID NO: 101898 - DNA, 27 bp, Artificial Sequence
  Description of Artificial Sequence: Synthetic oligonucleotide
ggcggggctaatccagatgctaaggac

SEQ ID NO: 101899 - DNA, 27 bp, Artificial Sequence
  Description of Artificial Sequence: Synthetic oligonucleotide
gcggggctaatccagatgctaaggacc

SEQ ID NO: 101900 - DNA, 32 bp, Artificial Sequence
  Description of Artificial Sequence: Synthetic oligonucleotide
cggggctaatccagatgctaaggaccattatg

SEQ ID NO: 101901 - DNA, 33 bp, Artificial Sequence
  Description of Artificial Sequence: Synthetic oligonucleotide
ggggctaatccagatgctaaggaccattatgag

SEQ ID NO: 101902 - DNA, 33 bp, Artificial Sequence
  Description of Artificial Sequence: Synthetic oligonucleotide
gggctaatccagatgctaaggaccattatgagg

SEQ ID NO: 101903 - DNA, 33 bp, Artificial Sequence
  Description of Artificial Sequence: Synthetic oligonucleotide
ggctaatccagatgctaaggaccattatgaggc

SEQ ID NO: 101904 - DNA, 35 bp, Artificial Sequence
  Description of Artificial Sequence: Synthetic oligonucleotide
gctaatccagatgctaaggaccattatgaggctac

SEQ ID NO: 101905 - DNA, 36 bp, Artificial Sequence
  Description of Artificial Sequence: Synthetic oligonucleotide
ctaatccagatgctaaggaccattatgaggctacag

SEQ ID NO: 101906 - DNA, 36 bp, Artificial Sequence
  Description of Artificial Sequence: Synthetic oligonucleotide
taatccagatgctaaggaccattatgaggctacagc

SEQ ID NO: 101907 - DNA, 35 bp, Artificial Sequence
  Description of Artificial Sequence: Synthetic oligonucleotide
aatccagatgctaaggaccattatgaggctacagc

SEQ ID NO: 101908 - DNA, 34 bp, Artificial Sequence
  Description of Artificial Sequence: Synthetic oligonucleotide
atccagatgctaaggaccattatgaggctacagc

SEQ ID NO: 101909 - DNA, 33 bp, Artificial Sequence
  Description of Artificial Sequence: Synthetic oligonucleotide
tccagatgctaaggaccattatgaggctacagc

SEQ ID NO: 101910 - DNA, 32 bp, Artificial Sequence
  Description of Artificial Sequence: Synthetic oligonucleotide
ccagatgctaaggaccattatgaggctacagc

SEQ ID NO: 101911 - DNA, 35 bp, Artificial Sequence
  Description of Artificial Sequence: Synthetic oligonucleotide
cagatgctaaggaccattatgaggctacagcaatg

SEQ ID NO: 101912 - DNA, 35 bp, Artificial Sequence
  Description of Artificial Sequence: Synthetic oligonucleotide
agatgctaaggaccattatgaggctacagcaatgc

SEQ ID NO: 101913 - DNA, 34 bp, Artificial Sequence
  Description of Artificial Sequence: Synthetic oligonucleotide
gatgctaaggaccattatgaggctacagcaatgc

SEQ ID NO: 101914 - DNA, 35 bp, Artificial Sequence
  Description of Artificial Sequence: Synthetic oligonucleotide
atgctaaggaccattatgaggctacagcaatgcac

SEQ ID NO: 101915 - DNA, 34 bp, Artificial Sequence
  Description of Artificial Sequence: Synthetic oligonucleotide
tgctaaggaccattatgaggctacagcaatgcac

SEQ ID NO: 101916 - DNA, 33 bp, Artificial Sequence
  Description of Artificial Sequence: Synthetic oligonucleotide
gctaaggaccattatgaggctacagcaatgcac

SEQ ID NO: 101917 - DNA, 33 bp, Artificial Sequence
  Description of Artificial Sequence: Synthetic oligonucleotide
ctaaggaccattatgaggctacagcaatgcacc

SEQ ID NO: 101918 - DNA, 33 bp, Artificial Sequence
  Description of Artificial Sequence: Synthetic oligonucleotide
taaggaccattatgaggctacagcaatgcaccg

SEQ ID NO: 101919 - DNA, 32 bp, Artificial Sequence
  Description of Artificial Sequence: Synthetic oligonucleotide
aaggaccattatgaggctacagcaatgcaccg

SEQ ID NO: 101920 - DNA, 31 bp, Artificial Sequence
  Description of Artificial Sequence: Synthetic oligonucleotide
aggaccattatgaggctacagcaatgcaccg

SEQ ID NO: 101921 - DNA, 30 bp, Artificial Sequence
  Description of Artificial Sequence: Synthetic oligonucleotide
ggaccattatgaggctacagcaatgcaccg

SEQ ID NO: 101922 - DNA, 30 bp, Artificial Sequence
  Description of Artificial Sequence: Synthetic oligonucleotide
gaccattatgaggctacagcaatgcaccgg

SEQ ID NO: 101923 - DNA, 30 bp, Artificial Sequence
  Description of Artificial Sequence: Synthetic oligonucleotide
accattatgaggctacagcaatgcaccggg

SEQ ID NO: 101924 - DNA, 29 bp, Artificial Sequence
  Description of Artificial Sequence: Synthetic oligonucleotide
ccattatgaggctacagcaatgcaccggg

SEQ ID NO: 101925 - DNA, 29 bp, Artificial Sequence
  Description of Artificial Sequence: Synthetic oligonucleotide
cattatgaggctacagcaatgcaccgggc

SEQ ID NO: 101926 - DNA, 30 bp, Artificial Sequence
  Description of Artificial Sequence: Synthetic oligonucleotide
attatgaggctacagcaatgcaccgggcag

SEQ ID NO: 101927 - DNA, 29 bp, Artificial Sequence
  Description of Artificial Sequence: Synthetic oligonucleotide
ttatgaggctacagcaatgcaccgggcag

SEQ ID NO: 101928 - DNA, 28 bp, Artificial Sequence
  Description of Artificial Sequence: Synthetic oligonucleotide
tatgaggctacagcaatgcaccgggcag

SEQ ID NO: 101929 - DNA, 27 bp, Artificial Sequence
  Description of Artificial Sequence: Synthetic oligonucleotide
atgaggctacagcaatgcaccgggcag

SEQ ID NO: 101930 - DNA, 26 bp, Artificial Sequence
  Description of Artificial Sequence: Synthetic oligonucleotide
tgaggctacagcaatgcaccgggcag

SEQ ID NO: 101931 - DNA, 25 bp, Artificial Sequence
  Description of Artificial Sequence: Synthetic oligonucleotide
gaggctacagcaatgcaccgggcag

SEQ ID NO: 101932 - DNA, 26 bp, Artificial Sequence
  Description of Artificial Sequence: Synthetic oligonucleotide
aggctacagcaatgcaccgggcagca

SEQ ID NO: 101933 - DNA, 25 bp, Artificial Sequence
  Description of Artificial Sequence: Synthetic oligonucleotide
ggctacagcaatgcaccgggcagca

SEQ ID NO: 101934 - DNA, 25 bp, Artificial Sequence
  Description of Artificial Sequence: Synthetic oligonucleotide
gctacagcaatgcaccgggcagcag

SEQ ID NO: 101935 - DNA, 25 bp, Artificial Sequence
  Description of Artificial Sequence: Synthetic oligonucleotide
ctacagcaatgcaccgggcagcagc

SEQ ID NO: 101936 - DNA, 27 bp, Artificial Sequence
  Description of Artificial Sequence: Synthetic oligonucleotide
tacagcaatgcaccgggcagcagccaa

SEQ ID NO: 101937 - DNA, 26 bp, Artificial Sequence
  Description of Artificial Sequence: Synthetic oligonucleotide
acagcaatgcaccgggcagcagccaa

SEQ ID NO: 101938 - DNA, 25 bp, Artificial Sequence
  Description of Artificial Sequence: Synthetic oligonucleotide
cagcaatgcaccgggcagcagccaa

SEQ ID NO: 101939 - DNA, 25 bp, Artificial Sequence
  Description of Artificial Sequence: Synthetic oligonucleotide
agcaatgcaccgggcagcagccaag

SEQ ID NO: 101940 - DNA, 24 bp, Artificial Sequence
  Description of Artificial Sequence: Synthetic oligonucleotide
gcaatgcaccgggcagcagccaag

SEQ ID NO: 101941 - DNA, 24 bp, Artificial Sequence
  Description of Artificial Sequence: Synthetic oligonucleotide
caatgcaccgggcagcagccaagg

SEQ ID NO: 101942 - DNA, 27 bp, Artificial Sequence
  Description of Artificial Sequence: Synthetic oligonucleotide
aatgcaccgggcagcagccaagggtaa

SEQ ID NO: 101943 - DNA, 26 bp, Artificial Sequence
  Description of Artificial Sequence: Synthetic oligonucleotide
atgcaccgggcagcagccaagggtaa

SEQ ID NO: 101944 - DNA, 25 bp, Artificial Sequence
  Description of Artificial Sequence: Synthetic oligonucleotide
tgcaccgggcagcagccaagggtaa

SEQ ID NO: 101945 - DNA, 24 bp, Artificial Sequence
  Description of Artificial Sequence: Synthetic oligonucleotide
gcaccgggcagcagccaagggtaa

SEQ ID NO: 101946 - DNA, 26 bp, Artificial Sequence
  Description of Artificial Sequence: Synthetic oligonucleotide
caccgggcagcagccaagggtaactt

SEQ ID NO: 101947 - DNA, 27 bp, Artificial Sequence
  Description of Artificial Sequence: Synthetic oligonucleotide
accgggcagcagccaagggtaacttga

SEQ ID NO: 101948 - DNA, 27 bp, Artificial Sequence
  Description of Artificial Sequence: Synthetic oligonucleotide
ccgggcagcagccaagggtaacttgaa

SEQ ID NO: 101949 - DNA, 27 bp, Artificial Sequence
  Description of Artificial Sequence: Synthetic oligonucleotide
cgggcagcagccaagggtaacttgaag

SEQ ID NO: 101950 - DNA, 29 bp, Artificial Sequence
  Description of Artificial Sequence: Synthetic oligonucleotide
gggcagcagccaagggtaacttgaagatg

SEQ ID NO: 101951 - DNA, 32 bp, Artificial Sequence
  Description of Artificial Sequence: Synthetic oligonucleotide
ggcagcagccaagggtaacttgaagatgattc

SEQ ID NO: 101952 - DNA, 36 bp, Artificial Sequence
  Description of Artificial Sequence: Synthetic oligonucleotide
gcagcagccaagggtaacttgaagatgattcatatc

SEQ ID NO: 101953 - DNA, 36 bp, Artificial Sequence
  Description of Artificial Sequence: Synthetic oligonucleotide
cagcagccaagggtaacttgaagatgattcatatcc

SEQ ID NO: 101954 - DNA, 38 bp, Artificial Sequence
  Description of Artificial Sequence: Synthetic oligonucleotide
agcagccaagggtaacttgaagatgattcatatccttc

SEQ ID NO: 101955 - DNA, 37 bp, Artificial Sequence
  Description of Artificial Sequence: Synthetic oligonucleotide
gcagccaagggtaacttgaagatgattcatatccttc

SEQ ID NO: 101956 - DNA, 38 bp, Artificial Sequence
  Description of Artificial Sequence: Synthetic oligonucleotide
cagccaagggtaacttgaagatgattcatatccttctg

SEQ ID NO: 101957 - DNA, 40 bp, Artificial Sequence
  Description of Artificial Sequence: Synthetic oligonucleotide
agccaagggtaacttgaagatgattcatatccttctgtac

SEQ ID NO: 101958 - DNA, 39 bp, Artificial Sequence
  Description of Artificial Sequence: Synthetic oligonucleotide
gccaagggtaacttgaagatgattcatatccttctgtac

SEQ ID NO: 101959 - DNA, 41 bp, Artificial Sequence
  Description of Artificial Sequence: Synthetic oligonucleotide
ccaagggtaacttgaagatgattcatatccttctgtactac

SEQ ID NO: 101960 - DNA, 44 bp, Artificial Sequence
  Description of Artificial Sequence: Synthetic oligonucleotide
caagggtaacttgaagatgattcatatccttctgtactacaaag

SEQ ID NO: 101961 - DNA, 44 bp, Artificial Sequence
  Description of Artificial Sequence: Synthetic oligonucleotide
aagggtaacttgaagatgattcatatccttctgtactacaaagc

SEQ ID NO: 101962 - DNA, 43 bp, Artificial Sequence
  Description of Artificial Sequence: Synthetic oligonucleotide
agggtaacttgaagatgattcatatccttctgtactacaaagc

SEQ ID NO: 101963 - DNA, 42 bp, Artificial Sequence
  Description of Artificial Sequence: Synthetic oligonucleotide
gggtaacttgaagatgattcatatccttctgtactacaaagc

SEQ ID NO: 101964 - DNA, 44 bp, Artificial Sequence
  Description of Artificial Sequence: Synthetic oligonucleotide
ggtaacttgaagatgattcatatccttctgtactacaaagcatc

SEQ ID NO: 101965 - DNA, 44 bp, Artificial Sequence
  Description of Artificial Sequence: Synthetic oligonucleotide
gtaacttgaagatgattcatatccttctgtactacaaagcatcc

SEQ ID NO: 101966 - DNA, 45 bp, Artificial Sequence
  Description of Artificial Sequence: Synthetic oligonucleotide
taacttgaagatgattcatatccttctgtactacaaagcatccac

SEQ ID NO: 101967 - DNA, 44 bp, Artificial Sequence
  Description of Artificial Sequence: Synthetic oligonucleotide
aacttgaagatgattcatatccttctgtactacaaagcatccac

SEQ ID NO: 101968 - DNA, 43 bp, Artificial Sequence
  Description of Artificial Sequence: Synthetic oligonucleotide
acttgaagatgattcatatccttctgtactacaaagcatccac

SEQ ID NO: 101969 - DNA, 42 bp, Artificial Sequence
  Description of Artificial Sequence: Synthetic oligonucleotide
cttgaagatgattcatatccttctgtactacaaagcatccac

SEQ ID NO: 101970 - DNA, 45 bp, Artificial Sequence
  Description of Artificial Sequence: Synthetic oligonucleotide
ttgaagatgattcatatccttctgtactacaaagcatccacaaac

SEQ ID NO: 101971 - DNA, 44 bp, Artificial Sequence
  Description of Artificial Sequence: Synthetic oligonucleotide
tgaagatgattcatatccttctgtactacaaagcatccacaaac

SEQ ID NO: 101972 - DNA, 43 bp, Artificial Sequence
  Description of Artificial Sequence: Synthetic oligonucleotide
gaagatgattcatatccttctgtactacaaagcatccacaaac

SEQ ID NO: 101973 - DNA, 45 bp, Artificial Sequence
  Description of Artificial Sequence: Synthetic oligonucleotide
aagatgattcatatccttctgtactacaaagcatccacaaacatc

SEQ ID NO: 101974 - DNA, 44 bp, Artificial Sequence
  Description of Artificial Sequence: Synthetic oligonucleotide
agatgattcatatccttctgtactacaaagcatccacaaacatc

SEQ ID NO: 101975 - DNA, 43 bp, Artificial Sequence
  Description of Artificial Sequence: Synthetic oligonucleotide
gatgattcatatccttctgtactacaaagcatccacaaacatc

SEQ ID NO: 101976 - DNA, 43 bp, Artificial Sequence
  Description of Artificial Sequence: Synthetic oligonucleotide
atgattcatatccttctgtactacaaagcatccacaaacatcc

SEQ ID NO: 101977 - DNA, 42 bp, Artificial Sequence
  Description of Artificial Sequence: Synthetic oligonucleotide
tgattcatatccttctgtactacaaagcatccacaaacatcc

SEQ ID NO: 101978 - DNA, 41 bp, Artificial Sequence
  Description of Artificial Sequence: Synthetic oligonucleotide
gattcatatccttctgtactacaaagcatccacaaacatcc

SEQ ID NO: 101979 - DNA, 43 bp, Artificial Sequence
  Description of Artificial Sequence: Synthetic oligonucleotide
attcatatccttctgtactacaaagcatccacaaacatccaag

SEQ ID NO: 101980 - DNA, 42 bp, Artificial Sequence
  Description of Artificial Sequence: Synthetic oligonucleotide
ttcatatccttctgtactacaaagcatccacaaacatccaag

SEQ ID NO: 101981 - DNA, 41 bp, Artificial Sequence
  Description of Artificial Sequence: Synthetic oligonucleotide
tcatatccttctgtactacaaagcatccacaaacatccaag

SEQ ID NO: 101982 - DNA, 40 bp, Artificial Sequence
  Description of Artificial Sequence: Synthetic oligonucleotide
catatccttctgtactacaaagcatccacaaacatccaag

SEQ ID NO: 101983 - DNA, 41 bp, Artificial Sequence
  Description of Artificial Sequence: Synthetic oligonucleotide
atatccttctgtactacaaagcatccacaaacatccaagac

SEQ ID NO: 101984 - DNA, 40 bp, Artificial Sequence
  Description of Artificial Sequence: Synthetic oligonucleotide
tatccttctgtactacaaagcatccacaaacatccaagac

SEQ ID NO: 101985 - DNA, 39 bp, Artificial Sequence
  Description of Artificial Sequence: Synthetic oligonucleotide
atccttctgtactacaaagcatccacaaacatccaagac

SEQ ID NO: 101986 - DNA, 38 bp, Artificial Sequence
  Description of Artificial Sequence: Synthetic oligonucleotide
tccttctgtactacaaagcatccacaaacatccaagac

SEQ ID NO: 101987 - DNA, 37 bp, Artificial Sequence
  Description of Artificial Sequence: Synthetic oligonucleotide
ccttctgtactacaaagcatccacaaacatccaagac

SEQ ID NO: 101988 - DNA, 38 bp, Artificial Sequence
  Description of Artificial Sequence: Synthetic oligonucleotide
cttctgtactacaaagcatccacaaacatccaagacac

SEQ ID NO: 101989 - DNA, 39 bp, Artificial Sequence
  Description of Artificial Sequence: Synthetic oligonucleotide
ttctgtactacaaagcatccacaaacatccaagacactg

SEQ ID NO: 101990 - DNA, 38 bp, Artificial Sequence
  Description of Artificial Sequence: Synthetic oligonucleotide
tctgtactacaaagcatccacaaacatccaagacactg

SEQ ID NO: 101991 - DNA, 37 bp, Artificial Sequence
  Description of Artificial Sequence: Synthetic oligonucleotide
ctgtactacaaagcatccacaaacatccaagacactg

SEQ ID NO: 101992 - DNA, 38 bp, Artificial Sequence
  Description of Artificial Sequence: Synthetic oligonucleotide
tgtactacaaagcatccacaaacatccaagacactgag

SEQ ID NO: 101993 - DNA, 37 bp, Artificial Sequence
  Description of Artificial Sequence: Synthetic oligonucleotide
gtactacaaagcatccacaaacatccaagacactgag

SEQ ID NO: 101994 - DNA, 37 bp, Artificial Sequence
  Description of Artificial Sequence: Synthetic oligonucleotide
tactacaaagcatccacaaacatccaagacactgagg

SEQ ID NO: 101995 - DNA, 36 bp, Artificial Sequence
  Description of Artificial Sequence: Synthetic oligonucleotide
actacaaagcatccacaaacatccaagacactgagg

SEQ ID NO: 101996 - DNA, 35 bp, Artificial Sequence
  Description of Artificial Sequence: Synthetic oligonucleotide
ctacaaagcatccacaaacatccaagacactgagg

SEQ ID NO: 101997 - DNA, 35 bp, Artificial Sequence
  Description of Artificial Sequence: Synthetic oligonucleotide
tacaaagcatccacaaacatccaagacactgaggg

SEQ ID NO: 101998 - DNA, 34 bp, Artificial Sequence
  Description of Artificial Sequence: Synthetic oligonucleotide
acaaagcatccacaaacatccaagacactgaggg

SEQ ID NO: 101999 - DNA, 33 bp, Artificial Sequence
  Description of Artificial Sequence: Synthetic oligonucleotide
caaagcatccacaaacatccaagacactgaggg

SEQ ID NO: 102000 - DNA, 36 bp, Artificial Sequence
  Description of Artificial Sequence: Synthetic oligonucleotide
aaagcatccacaaacatccaagacactgagggtaac

SEQ ID NO: 102001 - DNA, 35 bp, Artificial Sequence
  Description of Artificial Sequence: Synthetic oligonucleotide
aagcatccacaaacatccaagacactgagggtaac

SEQ ID NO: 102002 - DNA, 34 bp, Artificial Sequence
  Description of Artificial Sequence: Synthetic oligonucleotide
agcatccacaaacatccaagacactgagggtaac

SEQ ID NO: 102003 - DNA, 33 bp, Artificial Sequence
  Description of Artificial Sequence: Synthetic oligonucleotide
gcatccacaaacatccaagacactgagggtaac

SEQ ID NO: 102004 - DNA, 34 bp, Artificial Sequence
  Description of Artificial Sequence: Synthetic oligonucleotide
catccacaaacatccaagacactgagggtaacac

SEQ ID NO: 102005 - DNA, 35 bp, Artificial Sequence
  Description of Artificial Sequence: Synthetic oligonucleotide
atccacaaacatccaagacactgagggtaacactc

SEQ ID NO: 102006 - DNA, 34 bp, Artificial Sequence
  Description of Artificial Sequence: Synthetic oligonucleotide
tccacaaacatccaagacactgagggtaacactc

SEQ ID NO: 102007 - DNA, 33 bp, Artificial Sequence
  Description of Artificial Sequence: Synthetic oligonucleotide
ccacaaacatccaagacactgagggtaacactc

SEQ ID NO: 102008 - DNA, 33 bp, Artificial Sequence
  Description of Artificial Sequence: Synthetic oligonucleotide
cacaaacatccaagacactgagggtaacactcc

SEQ ID NO: 102009 - DNA, 34 bp, Artificial Sequence
  Description of Artificial Sequence: Synthetic oligonucleotide
acaaacatccaagacactgagggtaacactcctc

SEQ ID NO: 102010 - DNA, 33 bp, Artificial Sequence
  Description of Artificial Sequence: Synthetic oligonucleotide
caaacatccaagacactgagggtaacactcctc

SEQ ID NO: 102011 - DNA, 35 bp, Artificial Sequence
  Description of Artificial Sequence: Synthetic oligonucleotide
aaacatccaagacactgagggtaacactcctctac

SEQ ID NO: 102012 - DNA, 34 bp, Artificial Sequence
  Description of Artificial Sequence: Synthetic oligonucleotide
aacatccaagacactgagggtaacactcctctac

SEQ ID NO: 102013 - DNA, 33 bp, Artificial Sequence
  Description of Artificial Sequence: Synthetic oligonucleotide
acatccaagacactgagggtaacactcctctac

SEQ ID NO: 102014 - DNA, 32 bp, Artificial Sequence
  Description of Artificial Sequence: Synthetic oligonucleotide
catccaagacactgagggtaacactcctctac

SEQ ID NO: 102015 - DNA, 33 bp, Artificial Sequence
  Description of Artificial Sequence: Synthetic oligonucleotide
atccaagacactgagggtaacactcctctacac

SEQ ID NO: 102016 - DNA, 32 bp, Artificial Sequence
  Description of Artificial Sequence: Synthetic oligonucleotide
tccaagacactgagggtaacactcctctacac

SEQ ID NO: 102017 - DNA, 31 bp, Artificial Sequence
  Description of Artificial Sequence: Synthetic oligonucleotide
ccaagacactgagggtaacactcctctacac

SEQ ID NO: 102018 - DNA, 34 bp, Artificial Sequence
  Description of Artificial Sequence: Synthetic oligonucleotide
caagacactgagggtaacactcctctacacttag

SEQ ID NO: 102019 - DNA, 34 bp, Artificial Sequence
  Description of Artificial Sequence: Synthetic oligonucleotide
aagacactgagggtaacactcctctacacttagc

SEQ ID NO: 102020 - DNA, 33 bp, Artificial Sequence
  Description of Artificial Sequence: Synthetic oligonucleotide
agacactgagggtaacactcctctacacttagc

SEQ ID NO: 102021 - DNA, 32 bp, Artificial Sequence
  Description of Artificial Sequence: Synthetic oligonucleotide
gacactgagggtaacactcctctacacttagc

SEQ ID NO: 102022 - DNA, 32 bp, Artificial Sequence
  Description of Artificial Sequence: Synthetic oligonucleotide
acactgagggtaacactcctctacacttagcc

SEQ ID NO: 102023 - DNA, 31 bp, Artificial Sequence
  Description of Artificial Sequence: Synthetic oligonucleotide
cactgagggtaacactcctctacacttagcc

SEQ ID NO: 102024 - DNA, 32 bp, Artificial Sequence
  Description of Artificial Sequence: Synthetic oligonucleotide
actgagggtaacactcctctacacttagcctg

SEQ ID NO: 102025 - DNA, 31 bp, Artificial Sequence
  Description of Artificial Sequence: Synthetic oligonucleotide
ctgagggtaacactcctctacacttagcctg

SEQ ID NO: 102026 - DNA, 32 bp, Artificial Sequence
  Description of Artificial Sequence: Synthetic oligonucleotide
tgagggtaacactcctctacacttagcctgtg

SEQ ID NO: 102027 - DNA, 31 bp, Artificial Sequence
  Description of Artificial Sequence: Synthetic oligonucleotide
gagggtaacactcctctacacttagcctgtg

SEQ ID NO: 102028 - DNA, 33 bp, Artificial Sequence
  Description of Artificial Sequence: Synthetic oligonucleotide
agggtaacactcctctacacttagcctgtgatg

SEQ ID NO: 102029 - DNA, 32 bp, Artificial Sequence
  Description of Artificial Sequence: Synthetic oligonucleotide
gggtaacactcctctacacttagcctgtgatg

SEQ ID NO: 102030 - DNA, 33 bp, Artificial Sequence
  Description of Artificial Sequence: Synthetic oligonucleotide
ggtaacactcctctacacttagcctgtgatgag

SEQ ID NO: 102031 - DNA, 33 bp, Artificial Sequence
  Description of Artificial Sequence: Synthetic oligonucleotide
gtaacactcctctacacttagcctgtgatgagg

SEQ ID NO: 102032 - DNA, 34 bp, Artificial Sequence
  Description of Artificial Sequence: Synthetic oligonucleotide
taacactcctctacacttagcctgtgatgaggag

SEQ ID NO: 102033 - DNA, 33 bp, Artificial Sequence
  Description of Artificial Sequence: Synthetic oligonucleotide
aacactcctctacacttagcctgtgatgaggag

SEQ ID NO: 102034 - DNA, 32 bp, Artificial Sequence
  Description of Artificial Sequence: Synthetic oligonucleotide
acactcctctacacttagcctgtgatgaggag

SEQ ID NO: 102035 - DNA, 31 bp, Artificial Sequence
  Description of Artificial Sequence: Synthetic oligonucleotide
cactcctctacacttagcctgtgatgaggag

SEQ ID NO: 102036 - DNA, 32 bp, Artificial Sequence
  Description of Artificial Sequence: Synthetic oligonucleotide
actcctctacacttagcctgtgatgaggagag

SEQ ID NO: 102037 - DNA, 31 bp, Artificial Sequence
  Description of Artificial Sequence: Synthetic oligonucleotide
ctcctctacacttagcctgtgatgaggagag

SEQ ID NO: 102038 - DNA, 32 bp, Artificial Sequence
  Description of Artificial Sequence: Synthetic oligonucleotide
tcctctacacttagcctgtgatgaggagagag

SEQ ID NO: 102039 - DNA, 31 bp, Artificial Sequence
  Description of Artificial Sequence: Synthetic oligonucleotide
cctctacacttagcctgtgatgaggagagag

SEQ ID NO: 102040 - DNA, 32 bp, Artificial Sequence
  Description of Artificial Sequence: Synthetic oligonucleotide
ctctacacttagcctgtgatgaggagagagtg

SEQ ID NO: 102041 - DNA, 32 bp, Artificial Sequence
  Description of Artificial Sequence: Synthetic oligonucleotide
tctacacttagcctgtgatgaggagagagtgg

SEQ ID NO: 102042 - DNA, 31 bp, Artificial Sequence
  Description of Artificial Sequence: Synthetic oligonucleotide
ctacacttagcctgtgatgaggagagagtgg

SEQ ID NO: 102043 - DNA, 33 bp, Artificial Sequence
  Description of Artificial Sequence: Synthetic oligonucleotide
tacacttagcctgtgatgaggagagagtggaag

SEQ ID NO: 102044 - DNA, 32 bp, Artificial Sequence
  Description of Artificial Sequence: Synthetic oligonucleotide
acacttagcctgtgatgaggagagagtggaag

SEQ ID NO: 102045 - DNA, 31 bp, Artificial Sequence
  Description of Artificial Sequence: Synthetic oligonucleotide
cacttagcctgtgatgaggagagagtggaag

SEQ ID NO: 102046 - DNA, 33 bp, Artificial Sequence
  Description of Artificial Sequence: Synthetic oligonucleotide
acttagcctgtgatgaggagagagtggaagaag

SEQ ID NO: 102047 - DNA, 32 bp, Artificial Sequence
  Description of Artificial Sequence: Synthetic oligonucleotide
cttagcctgtgatgaggagagagtggaagaag

SEQ ID NO: 102048 - DNA, 32 bp, Artificial Sequence
  Description of Artificial Sequence: Synthetic oligonucleotide
ttagcctgtgatgaggagagagtggaagaagc

SEQ ID NO: 102049 - DNA, 31 bp, Artificial Sequence
  Description of Artificial Sequence: Synthetic oligonucleotide
tagcctgtgatgaggagagagtggaagaagc

SEQ ID NO: 102050 - DNA, 30 bp, Artificial Sequence
  Description of Artificial Sequence: Synthetic oligonucleotide
agcctgtgatgaggagagagtggaagaagc

SEQ ID NO: 102051 - DNA, 29 bp, Artificial Sequence
  Description of Artificial Sequence: Synthetic oligonucleotide
gcctgtgatgaggagagagtggaagaagc

SEQ ID NO: 102052 - DNA, 33 bp, Artificial Sequence
  Description of Artificial Sequence: Synthetic oligonucleotide
cctgtgatgaggagagagtggaagaagcaaaac

SEQ ID NO: 102053 - DNA, 34 bp, Artificial Sequence
  Description of Artificial Sequence: Synthetic oligonucleotide
ctgtgatgaggagagagtggaagaagcaaaactg

SEQ ID NO: 102054 - DNA, 34 bp, Artificial Sequence
  Description of Artificial Sequence: Synthetic oligonucleotide
tgtgatgaggagagagtggaagaagcaaaactgc

SEQ ID NO: 102055 - DNA, 33 bp, Artificial Sequence
  Description of Artificial Sequence: Synthetic oligonucleotide
gtgatgaggagagagtggaagaagcaaaactgc

SEQ ID NO: 102056 - DNA, 34 bp, Artificial Sequence
  Description of Artificial Sequence: Synthetic oligonucleotide
tgatgaggagagagtggaagaagcaaaactgctg

SEQ ID NO: 102057 - DNA, 33 bp, Artificial Sequence
  Description of Artificial Sequence: Synthetic oligonucleotide
gatgaggagagagtggaagaagcaaaactgctg

SEQ ID NO: 102058 - DNA, 33 bp, Artificial Sequence
  Description of Artificial Sequence: Synthetic oligonucleotide
atgaggagagagtggaagaagcaaaactgctgg

SEQ ID NO: 102059 - DNA, 32 bp, Artificial Sequence
  Description of Artificial Sequence: Synthetic oligonucleotide
tgaggagagagtggaagaagcaaaactgctgg

SEQ ID NO: 102060 - DNA, 31 bp, Artificial Sequence
  Description of Artificial Sequence: Synthetic oligonucleotide
gaggagagagtggaagaagcaaaactgctgg

SEQ ID NO: 102061 - DNA, 32 bp, Artificial Sequence
  Description of Artificial Sequence: Synthetic oligonucleotide
aggagagagtggaagaagcaaaactgctggtg

SEQ ID NO: 102062 - DNA, 31 bp, Artificial Sequence
  Description of Artificial Sequence: Synthetic oligonucleotide
ggagagagtggaagaagcaaaactgctggtg

SEQ ID NO: 102063 - DNA, 32 bp, Artificial Sequence
  Description of Artificial Sequence: Synthetic oligonucleotide
gagagagtggaagaagcaaaactgctggtgtc

SEQ ID NO: 102064 - DNA, 32 bp, Artificial Sequence
  Description of Artificial Sequence: Synthetic oligonucleotide
agagagtggaagaagcaaaactgctggtgtcc

SEQ ID NO: 102065 - DNA, 31 bp, Artificial Sequence
  Description of Artificial Sequence: Synthetic oligonucleotide
gagagtggaagaagcaaaactgctggtgtcc

SEQ ID NO: 102066 - DNA, 31 bp, Artificial Sequence
  Description of Artificial Sequence: Synthetic oligonucleotide
agagtggaagaagcaaaactgctggtgtccc

SEQ ID NO: 102067 - DNA, 30 bp, Artificial Sequence
  Description of Artificial Sequence: Synthetic oligonucleotide
gagtggaagaagcaaaactgctggtgtccc

SEQ ID NO: 102068 - DNA, 32 bp, Artificial Sequence
  Description of Artificial Sequence: Synthetic oligonucleotide
agtggaagaagcaaaactgctggtgtcccaag

SEQ ID NO: 102069 - DNA, 31 bp, Artificial Sequence
  Description of Artificial Sequence: Synthetic oligonucleotide
gtggaagaagcaaaactgctggtgtcccaag

SEQ ID NO: 102070 - DNA, 31 bp, Artificial Sequence
  Description of Artificial Sequence: Synthetic oligonucleotide
tggaagaagcaaaactgctggtgtcccaagg

SEQ ID NO: 102071 - DNA, 30 bp, Artificial Sequence
  Description of Artificial Sequence: Synthetic oligonucleotide
ggaagaagcaaaactgctggtgtcccaagg

SEQ ID NO: 102072 - DNA, 31 bp, Artificial Sequence
  Description of Artificial Sequence: Synthetic oligonucleotide
gaagaagcaaaactgctggtgtcccaaggag

SEQ ID NO: 102073 - DNA, 31 bp, Artificial Sequence
  Description of Artificial Sequence: Synthetic oligonucleotide
aagaagcaaaactgctggtgtcccaaggagc

SEQ ID NO: 102074 - DNA, 30 bp, Artificial Sequence
  Description of Artificial Sequence: Synthetic oligonucleotide
agaagcaaaactgctggtgtcccaaggagc

SEQ ID NO: 102075 - DNA, 29 bp, Artificial Sequence
  Description of Artificial Sequence: Synthetic oligonucleotide
gaagcaaaactgctggtgtcccaaggagc

SEQ ID NO: 102076 - DNA, 31 bp, Artificial Sequence
  Description of Artificial Sequence: Synthetic oligonucleotide
aagcaaaactgctggtgtcccaaggagcaag

SEQ ID NO: 102077 - DNA, 30 bp, Artificial Sequence
  Description of Artificial Sequence: Synthetic oligonucleotide
agcaaaactgctggtgtcccaaggagcaag

SEQ ID NO: 102078 - DNA, 29 bp, Artificial Sequence
  Description of Artificial Sequence: Synthetic oligonucleotide
gcaaaactgctggtgtcccaaggagcaag

SEQ ID NO: 102079 - DNA, 35 bp, Artificial Sequence
  Description of Artificial Sequence: Synthetic oligonucleotide
caaaactgctggtgtcccaaggagcaagtatttac

SEQ ID NO: 102080 - DNA, 38 bp, Artificial Sequence
  Description of Artificial Sequence: Synthetic oligonucleotide
aaaactgctggtgtcccaaggagcaagtatttacattg

SEQ ID NO: 102081 - DNA, 37 bp, Artificial Sequence
  Description of Artificial Sequence: Synthetic oligonucleotide
aaactgctggtgtcccaaggagcaagtatttacattg

SEQ ID NO: 102082 - DNA, 36 bp, Artificial Sequence
  Description of Artificial Sequence: Synthetic oligonucleotide
aactgctggtgtcccaaggagcaagtatttacattg

SEQ ID NO: 102083 - DNA, 35 bp, Artificial Sequence
  Description of Artificial Sequence: Synthetic oligonucleotide
actgctggtgtcccaaggagcaagtatttacattg

SEQ ID NO: 102084 - DNA, 34 bp, Artificial Sequence
  Description of Artificial Sequence: Synthetic oligonucleotide
ctgctggtgtcccaaggagcaagtatttacattg

SEQ ID NO: 102085 - DNA, 35 bp, Artificial Sequence
  Description of Artificial Sequence: Synthetic oligonucleotide
tgctggtgtcccaaggagcaagtatttacattgag

SEQ ID NO: 102086 - DNA, 34 bp, Artificial Sequence
  Description of Artificial Sequence: Synthetic oligonucleotide
gctggtgtcccaaggagcaagtatttacattgag

SEQ ID NO: 102087 - DNA, 40 bp, Artificial Sequence
  Description of Artificial Sequence: Synthetic oligonucleotide
ctggtgtcccaaggagcaagtatttacattgagaataaag

SEQ ID NO: 102088 - DNA, 42 bp, Artificial Sequence
  Description of Artificial Sequence: Synthetic oligonucleotide
tggtgtcccaaggagcaagtatttacattgagaataaagaag

SEQ ID NO: 102089 - DNA, 41 bp, Artificial Sequence
  Description of Artificial Sequence: Synthetic oligonucleotide
ggtgtcccaaggagcaagtatttacattgagaataaagaag

SEQ ID NO: 102090 - DNA, 45 bp, Artificial Sequence
  Description of Artificial Sequence: Synthetic oligonucleotide
gtgtcccaaggagcaagtatttacattgagaataaagaagaaaag

SEQ ID NO: 102091 - DNA, 46 bp, Artificial Sequence
  Description of Artificial Sequence: Synthetic oligonucleotide
tgtcccaaggagcaagtatttacattgagaataaagaagaaaagac

SEQ ID NO: 102092 - DNA, 45 bp, Artificial Sequence
  Description of Artificial Sequence: Synthetic oligonucleotide
gtcccaaggagcaagtatttacattgagaataaagaagaaaagac

SEQ ID NO: 102093 - DNA, 46 bp, Artificial Sequence
  Description of Artificial Sequence: Synthetic oligonucleotide
tcccaaggagcaagtatttacattgagaataaagaagaaaagacac

SEQ ID NO: 102094 - DNA, 45 bp, Artificial Sequence
  Description of Artificial Sequence: Synthetic oligonucleotide
cccaaggagcaagtatttacattgagaataaagaagaaaagacac

SEQ ID NO: 102095 - DNA, 45 bp, Artificial Sequence
  Description of Artificial Sequence: Synthetic oligonucleotide
ccaaggagcaagtatttacattgagaataaagaagaaaagacacc

SEQ ID NO: 102096 - DNA, 45 bp, Artificial Sequence
  Description of Artificial Sequence: Synthetic oligonucleotide
caaggagcaagtatttacattgagaataaagaagaaaagacaccc

SEQ ID NO: 102097 - DNA, 45 bp, Artificial Sequence
  Description of Artificial Sequence: Synthetic oligonucleotide
aaggagcaagtatttacattgagaataaagaagaaaagacacccc

SEQ ID NO: 102098 - DNA, 44 bp, Artificial Sequence
  Description of Artificial Sequence: Synthetic oligonucleotide
aggagcaagtatttacattgagaataaagaagaaaagacacccc

SEQ ID NO: 102099 - DNA, 43 bp, Artificial Sequence
  Description of Artificial Sequence: Synthetic oligonucleotide
ggagcaagtatttacattgagaataaagaagaaaagacacccc

SEQ ID NO: 102100 - DNA, 44 bp, Artificial Sequence
  Description of Artificial Sequence: Synthetic oligonucleotide
gagcaagtatttacattgagaataaagaagaaaagacacccctg

SEQ ID NO: 102101 - DNA, 44 bp, Artificial Sequence
  Description of Artificial Sequence: Synthetic oligonucleotide
agcaagtatttacattgagaataaagaagaaaagacacccctgc

SEQ ID NO: 102102 - DNA, 43 bp, Artificial Sequence
  Description of Artificial Sequence: Synthetic oligonucleotide
gcaagtatttacattgagaataaagaagaaaagacacccctgc

SEQ ID NO: 102103 - DNA, 45 bp, Artificial Sequence
  Description of Artificial Sequence: Synthetic oligonucleotide
caagtatttacattgagaataaagaagaaaagacacccctgcaag

SEQ ID NO: 102104 - DNA, 46 bp, Artificial Sequence
  Description of Artificial Sequence: Synthetic oligonucleotide
aagtatttacattgagaataaagaagaaaagacacccctgcaagtg

SEQ ID NO: 102105 - DNA, 45 bp, Artificial Sequence
  Description of Artificial Sequence: Synthetic oligonucleotide
agtatttacattgagaataaagaagaaaagacacccctgcaagtg

SEQ ID NO: 102106 - DNA, 44 bp, Artificial Sequence
  Description of Artificial Sequence: Synthetic oligonucleotide
gtatttacattgagaataaagaagaaaagacacccctgcaagtg

SEQ ID NO: 102107 - DNA, 44 bp, Artificial Sequence
  Description of Artificial Sequence: Synthetic oligonucleotide
tatttacattgagaataaagaagaaaagacacccctgcaagtgg

SEQ ID NO: 102108 - DNA, 43 bp, Artificial Sequence
  Description of Artificial Sequence: Synthetic oligonucleotide
atttacattgagaataaagaagaaaagacacccctgcaagtgg

SEQ ID NO: 102109 - DNA, 42 bp, Artificial Sequence
  Description of Artificial Sequence: Synthetic oligonucleotide
tttacattgagaataaagaagaaaagacacccctgcaagtgg

SEQ ID NO: 102110 - DNA, 41 bp, Artificial Sequence
  Description of Artificial Sequence: Synthetic oligonucleotide
ttacattgagaataaagaagaaaagacacccctgcaagtgg

SEQ ID NO: 102111 - DNA, 40 bp, Artificial Sequence
  Description of Artificial Sequence: Synthetic oligonucleotide
tacattgagaataaagaagaaaagacacccctgcaagtgg

SEQ ID NO: 102112 - DNA, 39 bp, Artificial Sequence
  Description of Artificial Sequence: Synthetic oligonucleotide
acattgagaataaagaagaaaagacacccctgcaagtgg

SEQ ID NO: 102113 - DNA, 38 bp, Artificial Sequence
  Description of Artificial Sequence: Synthetic oligonucleotide
cattgagaataaagaagaaaagacacccctgcaagtgg

SEQ ID NO: 102114 - DNA, 38 bp, Artificial Sequence
  Description of Artificial Sequence: Synthetic oligonucleotide
attgagaataaagaagaaaagacacccctgcaagtggc

SEQ ID NO: 102115 - DNA, 37 bp, Artificial Sequence
  Description of Artificial Sequence: Synthetic oligonucleotide
ttgagaataaagaagaaaagacacccctgcaagtggc

SEQ ID NO: 102116 - DNA, 36 bp, Artificial Sequence
  Description of Artificial Sequence: Synthetic oligonucleotide
tgagaataaagaagaaaagacacccctgcaagtggc

SEQ ID NO: 102117 - DNA, 35 bp, Artificial Sequence
  Description of Artificial Sequence: Synthetic oligonucleotide
gagaataaagaagaaaagacacccctgcaagtggc

SEQ ID NO: 102118 - DNA, 35 bp, Artificial Sequence
  Description of Artificial Sequence: Synthetic oligonucleotide
agaataaagaagaaaagacacccctgcaagtggcc

SEQ ID NO: 102119 - DNA, 34 bp, Artificial Sequence
  Description of Artificial Sequence: Synthetic oligonucleotide
gaataaagaagaaaagacacccctgcaagtggcc

SEQ ID NO: 102120 - DNA, 37 bp, Artificial Sequence
  Description of Artificial Sequence: Synthetic oligonucleotide
aataaagaagaaaagacacccctgcaagtggccaaag

SEQ ID NO: 102121 - DNA, 36 bp, Artificial Sequence
  Description of Artificial Sequence: Synthetic oligonucleotide
ataaagaagaaaagacacccctgcaagtggccaaag

SEQ ID NO: 102122 - DNA, 35 bp, Artificial Sequence
  Description of Artificial Sequence: Synthetic oligonucleotide
taaagaagaaaagacacccctgcaagtggccaaag

SEQ ID NO: 102123 - DNA, 34 bp, Artificial Sequence
  Description of Artificial Sequence: Synthetic oligonucleotide
aaagaagaaaagacacccctgcaagtggccaaag

SEQ ID NO: 102124 - DNA, 33 bp, Artificial Sequence
  Description of Artificial Sequence: Synthetic oligonucleotide
aagaagaaaagacacccctgcaagtggccaaag

SEQ ID NO: 102125 - DNA, 32 bp, Artificial Sequence
  Description of Artificial Sequence: Synthetic oligonucleotide
agaagaaaagacacccctgcaagtggccaaag

SEQ ID NO: 102126 - DNA, 31 bp, Artificial Sequence
  Description of Artificial Sequence: Synthetic oligonucleotide
gaagaaaagacacccctgcaagtggccaaag

SEQ ID NO: 102127 - DNA, 31 bp, Artificial Sequence
  Description of Artificial Sequence: Synthetic oligonucleotide
aagaaaagacacccctgcaagtggccaaagg

SEQ ID NO: 102128 - DNA, 30 bp, Artificial Sequence
  Description of Artificial Sequence: Synthetic oligonucleotide
agaaaagacacccctgcaagtggccaaagg

SEQ ID NO: 102129 - DNA, 29 bp, Artificial Sequence
  Description of Artificial Sequence: Synthetic oligonucleotide
gaaaagacacccctgcaagtggccaaagg

SEQ ID NO: 102130 - DNA, 30 bp, Artificial Sequence
  Description of Artificial Sequence: Synthetic oligonucleotide
aaaagacacccctgcaagtggccaaaggtg

SEQ ID NO: 102131 - DNA, 29 bp, Artificial Sequence
  Description of Artificial Sequence: Synthetic oligonucleotide
aaagacacccctgcaagtggccaaaggtg

SEQ ID NO: 102132 - DNA, 28 bp, Artificial Sequence
  Description of Artificial Sequence: Synthetic oligonucleotide
aagacacccctgcaagtggccaaaggtg

SEQ ID NO: 102133 - DNA, 27 bp, Artificial Sequence
  Description of Artificial Sequence: Synthetic oligonucleotide
agacacccctgcaagtggccaaaggtg

SEQ ID NO: 102134 - DNA, 26 bp, Artificial Sequence
  Description of Artificial Sequence: Synthetic oligonucleotide
gacacccctgcaagtggccaaaggtg

SEQ ID NO: 102135 - DNA, 26 bp, Artificial Sequence
  Description of Artificial Sequence: Synthetic oligonucleotide
acacccctgcaagtggccaaaggtgg

SEQ ID NO: 102136 - DNA, 25 bp, Artificial Sequence
  Description of Artificial Sequence: Synthetic oligonucleotide
cacccctgcaagtggccaaaggtgg

SEQ ID NO: 102137 - DNA, 25 bp, Artificial Sequence
  Description of Artificial Sequence: Synthetic oligonucleotide
acccctgcaagtggccaaaggtggc

SEQ ID NO: 102138 - DNA, 24 bp, Artificial Sequence
  Description of Artificial Sequence: Synthetic oligonucleotide
cccctgcaagtggccaaaggtggc

SEQ ID NO: 102139 - DNA, 25 bp, Artificial Sequence
  Description of Artificial Sequence: Synthetic oligonucleotide
ccctgcaagtggccaaaggtggcct

SEQ ID NO: 102140 - DNA, 25 bp, Artificial Sequence
  Description of Artificial Sequence: Synthetic oligonucleotide
cctgcaagtggccaaaggtggcctg

SEQ ID NO: 102141 - DNA, 25 bp, Artificial Sequence
  Description of Artificial Sequence: Synthetic oligonucleotide
ctgcaagtggccaaaggtggcctgg

SEQ ID NO: 102142 - DNA, 27 bp, Artificial Sequence
  Description of Artificial Sequence: Synthetic oligonucleotide
tgcaagtggccaaaggtggcctgggtt

SEQ ID NO: 102143 - DNA, 27 bp, Artificial Sequence
  Description of Artificial Sequence: Synthetic oligonucleotide
gcaagtggccaaaggtggcctgggttt

SEQ ID NO: 102144 - DNA, 31 bp, Artificial Sequence
  Description of Artificial Sequence: Synthetic oligonucleotide
caagtggccaaaggtggcctgggtttaatac

SEQ ID NO: 102145 - DNA, 32 bp, Artificial Sequence
  Description of Artificial Sequence: Synthetic oligonucleotide
aagtggccaaaggtggcctgggtttaatactc

SEQ ID NO: 102146 - DNA, 31 bp, Artificial Sequence
  Description of Artificial Sequence: Synthetic oligonucleotide
agtggccaaaggtggcctgggtttaatactc

SEQ ID NO: 102147 - DNA, 30 bp, Artificial Sequence
  Description of Artificial Sequence: Synthetic oligonucleotide
gtggccaaaggtggcctgggtttaatactc

SEQ ID NO: 102148 - DNA, 32 bp, Artificial Sequence
  Description of Artificial Sequence: Synthetic oligonucleotide
tggccaaaggtggcctgggtttaatactcaag

SEQ ID NO: 102149 - DNA, 31 bp, Artificial Sequence
  Description of Artificial Sequence: Synthetic oligonucleotide
ggccaaaggtggcctgggtttaatactcaag

SEQ ID NO: 102150 - DNA, 32 bp, Artificial Sequence
  Description of Artificial Sequence: Synthetic oligonucleotide
gccaaaggtggcctgggtttaatactcaagag

SEQ ID NO: 102151 - DNA, 35 bp, Artificial Sequence
  Description of Artificial Sequence: Synthetic oligonucleotide
ccaaaggtggcctgggtttaatactcaagagaatg

SEQ ID NO: 102152 - DNA, 35 bp, Artificial Sequence
  Description of Artificial Sequence: Synthetic oligonucleotide
caaaggtggcctgggtttaatactcaagagaatgg

SEQ ID NO: 102153 - DNA, 36 bp, Artificial Sequence
  Description of Artificial Sequence: Synthetic oligonucleotide
aaaggtggcctgggtttaatactcaagagaatggtg

SEQ ID NO: 102154 - DNA, 35 bp, Artificial Sequence
  Description of Artificial Sequence: Synthetic oligonucleotide
aaggtggcctgggtttaatactcaagagaatggtg

SEQ ID NO: 102155 - DNA, 34 bp, Artificial Sequence
  Description of Artificial Sequence: Synthetic oligonucleotide
aggtggcctgggtttaatactcaagagaatggtg

SEQ ID NO: 102156 - DNA, 33 bp, Artificial Sequence
  Description of Artificial Sequence: Synthetic oligonucleotide
ggtggcctgggtttaatactcaagagaatggtg

SEQ ID NO: 102157 - DNA, 33 bp, Artificial Sequence
  Description of Artificial Sequence: Synthetic oligonucleotide
gtggcctgggtttaatactcaagagaatggtgg

SEQ ID NO: 102158 - DNA, 35 bp, Artificial Sequence
  Description of Artificial Sequence: Synthetic oligonucleotide
tggcctgggtttaatactcaagagaatggtggaag

SEQ ID NO: 102159 - DNA, 34 bp, Artificial Sequence
  Description of Artificial Sequence: Synthetic oligonucleotide
ggcctgggtttaatactcaagagaatggtggaag

SEQ ID NO: 102160 - DNA, 34 bp, Artificial Sequence
  Description of Artificial Sequence: Synthetic oligonucleotide
gcctgggtttaatactcaagagaatggtggaagg

SEQ ID NO: 102161 - DNA, 25 bp, Artificial Sequence
  Description of Artificial Sequence: Synthetic oligonucleotide
caatgcaccgggcagcagccaagga

SEQ ID NO: 102162 - DNA, 26 bp, Artificial Sequence
  Description of Artificial Sequence: Synthetic oligonucleotide
aatgcaccgggcagcagccaaggaca

SEQ ID NO: 102163 - DNA, 25 bp, Artificial Sequence
  Description of Artificial Sequence: Synthetic oligonucleotide
atgcaccgggcagcagccaaggaca

SEQ ID NO: 102164 - DNA, 24 bp, Artificial Sequence
  Description of Artificial Sequence: Synthetic oligonucleotide
tgcaccgggcagcagccaaggaca

SEQ ID NO: 102165 - DNA, 23 bp, Artificial Sequence
  Description of Artificial Sequence: Synthetic oligonucleotide
gcaccgggcagcagccaaggaca

SEQ ID NO: 102166 - DNA, 26 bp, Artificial Sequence
  Description of Artificial Sequence: Synthetic oligonucleotide
caccgggcagcagccaaggacactta

SEQ ID NO: 102167 - DNA, 26 bp, Artificial Sequence
  Description of Artificial Sequence: Synthetic oligonucleotide
accgggcagcagccaaggacacttag

SEQ ID NO: 102168 - DNA, 25 bp, Artificial Sequence
  Description of Artificial Sequence: Synthetic oligonucleotide
ccgggcagcagccaaggacacttag

SEQ ID NO: 102169 - DNA, 25 bp, Artificial Sequence
  Description of Artificial Sequence: Synthetic oligonucleotide
cgggcagcagccaaggacacttagc

SEQ ID NO: 102170 - DNA, 26 bp, Artificial Sequence
  Description of Artificial Sequence: Synthetic oligonucleotide
gggcagcagccaaggacacttagcct

SEQ ID NO: 102171 - DNA, 27 bp, Artificial Sequence
  Description of Artificial Sequence: Synthetic oligonucleotide
ggcagcagccaaggacacttagcctgt

SEQ ID NO: 102172 - DNA, 27 bp, Artificial Sequence
  Description of Artificial Sequence: Synthetic oligonucleotide
gcagcagccaaggacacttagcctgtg

SEQ ID NO: 102173 - DNA, 29 bp, Artificial Sequence
  Description of Artificial Sequence: Synthetic oligonucleotide
cagcagccaaggacacttagcctgtgatg

SEQ ID NO: 102174 - DNA, 30 bp, Artificial Sequence
  Description of Artificial Sequence: Synthetic oligonucleotide
agcagccaaggacacttagcctgtgatgag

SEQ ID NO: 102175 - DNA, 29 bp, Artificial Sequence
  Description of Artificial Sequence: Synthetic oligonucleotide
gcagccaaggacacttagcctgtgatgag

SEQ ID NO: 102176 - DNA, 29 bp, Artificial Sequence
  Description of Artificial Sequence: Synthetic oligonucleotide
cagccaaggacacttagcctgtgatgagg

SEQ ID NO: 102177 - DNA, 30 bp, Artificial Sequence
  Description of Artificial Sequence: Synthetic oligonucleotide
agccaaggacacttagcctgtgatgaggag

SEQ ID NO: 102178 - DNA, 29 bp, Artificial Sequence
  Description of Artificial Sequence: Synthetic oligonucleotide
gccaaggacacttagcctgtgatgaggag

SEQ ID NO: 102179 - DNA, 30 bp, Artificial Sequence
  Description of Artificial Sequence: Synthetic oligonucleotide
ccaaggacacttagcctgtgatgaggagag

SEQ ID NO: 102180 - DNA, 31 bp, Artificial Sequence
  Description of Artificial Sequence: Synthetic oligonucleotide
caaggacacttagcctgtgatgaggagagag

SEQ ID NO: 102181 - DNA, 32 bp, Artificial Sequence
  Description of Artificial Sequence: Synthetic oligonucleotide
aaggacacttagcctgtgatgaggagagagtg

SEQ ID NO: 102182 - DNA, 31 bp, Artificial Sequence
  Description of Artificial Sequence: Synthetic oligonucleotide
aggacacttagcctgtgatgaggagagagtg

SEQ ID NO: 102183 - DNA, 30 bp, Artificial Sequence
  Description of Artificial Sequence: Synthetic oligonucleotide
ggacacttagcctgtgatgaggagagagtg

SEQ ID NO: 102184 - DNA, 30 bp, Artificial Sequence
  Description of Artificial Sequence: Synthetic oligonucleotide
gacacttagcctgtgatgaggagagagtgg

SEQ ID NO: 102185 - DNA, 21 bp, Artificial Sequence
  Description of Artificial Sequence: Synthetic oligonucleotide
atggcggacggcggctcggag

SEQ ID NO: 102186 - DNA, 20 bp, Artificial Sequence
  Description of Artificial Sequence: Synthetic oligonucleotide
tggcggacggcggctcggag

SEQ ID NO: 102187 - DNA, 20 bp, Artificial Sequence
  Description of Artificial Sequence: Synthetic oligonucleotide
ggcggacggcggctcggagt

SEQ ID NO: 102188 - DNA, 20 bp, Artificial Sequence
  Description of Artificial Sequence: Synthetic oligonucleotide
gcggacggcggctcggagct

SEQ ID NO: 102189 - DNA, 20 bp, Artificial Sequence
  Description of Artificial Sequence: Synthetic oligonucleotide
cggacggcggctcggagcgt

SEQ ID NO: 102190 - DNA, 20 bp, Artificial Sequence
  Description of Artificial Sequence: Synthetic oligonucleotide
ggacggcggctcggagcggt

SEQ ID NO: 102191 - DNA, 20 bp, Artificial Sequence
  Description of Artificial Sequence: Synthetic oligonucleotide
gacggcggctcggagcgggt

SEQ ID NO: 102192 - DNA, 20 bp, Artificial Sequence
  Description of Artificial Sequence: Synthetic oligonucleotide
acggcggctcggagcgggct

SEQ ID NO: 102193 - DNA, 20 bp, Artificial Sequence
  Description of Artificial Sequence: Synthetic oligonucleotide
cggcggctcggagcgggctt

SEQ ID NO: 102194 - DNA, 20 bp, Artificial Sequence
  Description of Artificial Sequence: Synthetic oligonucleotide
ggcggctcggagcgggctga

SEQ ID NO: 102195 - DNA, 20 bp, Artificial Sequence
  Description of Artificial Sequence: Synthetic oligonucleotide
gcggctcggagcgggctgac

SEQ ID NO: 102196 - DNA, 20 bp, Artificial Sequence
  Description of Artificial Sequence: Synthetic oligonucleotide
cggctcggagcgggctgacg

SEQ ID NO: 102197 - DNA, 20 bp, Artificial Sequence
  Description of Artificial Sequence: Synthetic oligonucleotide
ggctcggagcgggctgacgg

SEQ ID NO: 102198 - DNA, 20 bp, Artificial Sequence
  Description of Artificial Sequence: Synthetic oligonucleotide
gctcggagcgggctgacggg

SEQ ID NO: 102199 - DNA, 20 bp, Artificial Sequence
  Description of Artificial Sequence: Synthetic oligonucleotide
ctcggagcgggctgacgggc

SEQ ID NO: 102200 - DNA, 20 bp, Artificial Sequence
  Description of Artificial Sequence: Synthetic oligonucleotide
tcggagcgggctgacgggcg

SEQ ID NO: 102201 - DNA, 20 bp, Artificial Sequence
  Description of Artificial Sequence: Synthetic oligonucleotide
cggagcgggctgacgggcgt

SEQ ID NO: 102202 - DNA, 21 bp, Artificial Sequence
  Description of Artificial Sequence: Synthetic oligonucleotide
ggagcgggctgacgggcgcat

SEQ ID NO: 102203 - DNA, 21 bp, Artificial Sequence
  Description of Artificial Sequence: Synthetic oligonucleotide
gagcgggctgacgggcgcatc

SEQ ID NO: 102204 - DNA, 22 bp, Artificial Sequence
  Description of Artificial Sequence: Synthetic oligonucleotide
agcgggctgacgggcgcatcgt

SEQ ID NO: 102205 - DNA, 21 bp, Artificial Sequence
  Description of Artificial Sequence: Synthetic oligonucleotide
gcgggctgacgggcgcatcgt

SEQ ID NO: 102206 - DNA, 23 bp, Artificial Sequence
  Description of Artificial Sequence: Synthetic oligonucleotide
cgggctgacgggcgcatcgtcaa

SEQ ID NO: 102207 - DNA, 25 bp, Artificial Sequence
  Description of Artificial Sequence: Synthetic oligonucleotide
gggctgacgggcgcatcgtcaagat

SEQ ID NO: 102208 - DNA, 25 bp, Artificial Sequence
  Description of Artificial Sequence: Synthetic oligonucleotide
ggctgacgggcgcatcgtcaagatg

SEQ ID NO: 102209 - DNA, 26 bp, Artificial Sequence
  Description of Artificial Sequence: Synthetic oligonucleotide
gctgacgggcgcatcgtcaagatgga

SEQ ID NO: 102210 - DNA, 26 bp, Artificial Sequence
  Description of Artificial Sequence: Synthetic oligonucleotide
ctgacgggcgcatcgtcaagatggag

SEQ ID NO: 102211 - DNA, 27 bp, Artificial Sequence
  Description of Artificial Sequence: Synthetic oligonucleotide
tgacgggcgcatcgtcaagatggaggt

SEQ ID NO: 102212 - DNA, 26 bp, Artificial Sequence
  Description of Artificial Sequence: Synthetic oligonucleotide
gacgggcgcatcgtcaagatggaggt

SEQ ID NO: 102213 - DNA, 26 bp, Artificial Sequence
  Description of Artificial Sequence: Synthetic oligonucleotide
acgggcgcatcgtcaagatggaggtg

SEQ ID NO: 102214 - DNA, 25 bp, Artificial Sequence
  Description of Artificial Sequence: Synthetic oligonucleotide
cgggcgcatcgtcaagatggaggtg

SEQ ID NO: 102215 - DNA, 26 bp, Artificial Sequence
  Description of Artificial Sequence: Synthetic oligonucleotide
gggcgcatcgtcaagatggaggtgga

SEQ ID NO: 102216 - DNA, 27 bp, Artificial Sequence
  Description of Artificial Sequence: Synthetic oligonucleotide
ggcgcatcgtcaagatggaggtggact

SEQ ID NO: 102217 - DNA, 28 bp, Artificial Sequence
  Description of Artificial Sequence: Synthetic oligonucleotide
gcgcatcgtcaagatggaggtggactac

SEQ ID NO: 102218 - DNA, 29 bp, Artificial Sequence
  Description of Artificial Sequence: Synthetic oligonucleotide
cgcatcgtcaagatggaggtggactacag

SEQ ID NO: 102219 - DNA, 29 bp, Artificial Sequence
  Description of Artificial Sequence: Synthetic oligonucleotide
gcatcgtcaagatggaggtggactacagc

SEQ ID NO: 102220 - DNA, 29 bp, Artificial Sequence
  Description of Artificial Sequence: Synthetic oligonucleotide
catcgtcaagatggaggtggactacagcg

SEQ ID NO: 102221 - DNA, 29 bp, Artificial Sequence
  Description of Artificial Sequence: Synthetic oligonucleotide
atcgtcaagatggaggtggactacagcgc

SEQ ID NO: 102222 - DNA, 28 bp, Artificial Sequence
  Description of Artificial Sequence: Synthetic oligonucleotide
tcgtcaagatggaggtggactacagcgc

SEQ ID NO: 102223 - DNA, 27 bp, Artificial Sequence
  Description of Artificial Sequence: Synthetic oligonucleotide
cgtcaagatggaggtggactacagcgc

SEQ ID NO: 102224 - DNA, 27 bp, Artificial Sequence
  Description of Artificial Sequence: Synthetic oligonucleotide
gtcaagatggaggtggactacagcgcc

SEQ ID NO: 102225 - DNA, 28 bp, Artificial Sequence
  Description of Artificial Sequence: Synthetic oligonucleotide
tcaagatggaggtggactacagcgccac

SEQ ID NO: 102226 - DNA, 27 bp, Artificial Sequence
  Description of Artificial Sequence: Synthetic oligonucleotide
caagatggaggtggactacagcgccac

SEQ ID NO: 102227 - DNA, 27 bp, Artificial Sequence
  Description of Artificial Sequence: Synthetic oligonucleotide
aagatggaggtggactacagcgccacg

SEQ ID NO: 102228 - DNA, 26 bp, Artificial Sequence
  Description of Artificial Sequence: Synthetic oligonucleotide
agatggaggtggactacagcgccacg

SEQ ID NO: 102229 - DNA, 25 bp, Artificial Sequence
  Description of Artificial Sequence: Synthetic oligonucleotide
gatggaggtggactacagcgccacg

SEQ ID NO: 102230 - DNA, 26 bp, Artificial Sequence
  Description of Artificial Sequence: Synthetic oligonucleotide
atggaggtggactacagcgccacggt

SEQ ID NO: 102231 - DNA, 25 bp, Artificial Sequence
  Description of Artificial Sequence: Synthetic oligonucleotide
tggaggtggactacagcgccacggt

SEQ ID NO: 102232 - DNA, 24 bp, Artificial Sequence
  Description of Artificial Sequence: Synthetic oligonucleotide
ggaggtggactacagcgccacggt

SEQ ID NO: 102233 - DNA, 24 bp, Artificial Sequence
  Description of Artificial Sequence: Synthetic oligonucleotide
gaggtggactacagcgccacggtg

SEQ ID NO: 102234 - DNA, 26 bp, Artificial Sequence
  Description of Artificial Sequence: Synthetic oligonucleotide
aggtggactacagcgccacggtggat

SEQ ID NO: 102235 - DNA, 25 bp, Artificial Sequence
  Description of Artificial Sequence: Synthetic oligonucleotide
ggtggactacagcgccacggtggat

SEQ ID NO: 102236 - DNA, 26 bp, Artificial Sequence
  Description of Artificial Sequence: Synthetic oligonucleotide
gtggactacagcgccacggtggatca

SEQ ID NO: 102237 - DNA, 26 bp, Artificial Sequence
  Description of Artificial Sequence: Synthetic oligonucleotide
tggactacagcgccacggtggatcag

SEQ ID NO: 102238 - DNA, 25 bp, Artificial Sequence
  Description of Artificial Sequence: Synthetic oligonucleotide
ggactacagcgccacggtggatcag

SEQ ID NO: 102239 - DNA, 25 bp, Artificial Sequence
  Description of Artificial Sequence: Synthetic oligonucleotide
gactacagcgccacggtggatcagc

SEQ ID NO: 102240 - DNA, 25 bp, Artificial Sequence
  Description of Artificial Sequence: Synthetic oligonucleotide
actacagcgccacggtggatcagcg

SEQ ID NO: 102241 - DNA, 24 bp, Artificial Sequence
  Description of Artificial Sequence: Synthetic oligonucleotide
ctacagcgccacggtggatcagcg

SEQ ID NO: 102242 - DNA, 24 bp, Artificial Sequence
  Description of Artificial Sequence: Synthetic oligonucleotide
tacagcgccacggtggatcagcgc

SEQ ID NO: 102243 - DNA, 23 bp, Artificial Sequence
  Description of Artificial Sequence: Synthetic oligonucleotide
acagcgccacggtggatcagcgc

SEQ ID NO: 102244 - DNA, 22 bp, Artificial Sequence
  Description of Artificial Sequence: Synthetic oligonucleotide
cagcgccacggtggatcagcgc

SEQ ID NO: 102245 - DNA, 24 bp, Artificial Sequence
  Description of Artificial Sequence: Synthetic oligonucleotide
agcgccacggtggatcagcgccta

SEQ ID NO: 102246 - DNA, 23 bp, Artificial Sequence
  Description of Artificial Sequence: Synthetic oligonucleotide
gcgccacggtggatcagcgccta

SEQ ID NO: 102247 - DNA, 23 bp, Artificial Sequence
  Description of Artificial Sequence: Synthetic oligonucleotide
cgccacggtggatcagcgcctac

SEQ ID NO: 102248 - DNA, 23 bp, Artificial Sequence
  Description of Artificial Sequence: Synthetic oligonucleotide
gccacggtggatcagcgcctacc

SEQ ID NO: 102249 - DNA, 23 bp, Artificial Sequence
  Description of Artificial Sequence: Synthetic oligonucleotide
ccacggtggatcagcgcctaccc

SEQ ID NO: 102250 - DNA, 24 bp, Artificial Sequence
  Description of Artificial Sequence: Synthetic oligonucleotide
cacggtggatcagcgcctacccga

SEQ ID NO: 102251 - DNA, 25 bp, Artificial Sequence
  Description of Artificial Sequence: Synthetic oligonucleotide
acggtggatcagcgcctacccgagt

SEQ ID NO: 102252 - DNA, 24 bp, Artificial Sequence
  Description of Artificial Sequence: Synthetic oligonucleotide
cggtggatcagcgcctacccgagt

SEQ ID NO: 102253 - DNA, 25 bp, Artificial Sequence
  Description of Artificial Sequence: Synthetic oligonucleotide
ggtggatcagcgcctacccgagtgt

SEQ ID NO: 102254 - DNA, 25 bp, Artificial Sequence
  Description of Artificial Sequence: Synthetic oligonucleotide
gtggatcagcgcctacccgagtgtg

SEQ ID NO: 102255 - DNA, 25 bp, Artificial Sequence
  Description of Artificial Sequence: Synthetic oligonucleotide
tggatcagcgcctacccgagtgtgc

SEQ ID NO: 102256 - DNA, 24 bp, Artificial Sequence
  Description of Artificial Sequence: Synthetic oligonucleotide
ggatcagcgcctacccgagtgtgc

SEQ ID NO: 102257 - DNA, 26 bp, Artificial Sequence
  Description of Artificial Sequence: Synthetic oligonucleotide
gatcagcgcctacccgagtgtgcgaa

SEQ ID NO: 102258 - DNA, 26 bp, Artificial Sequence
  Description of Artificial Sequence: Synthetic oligonucleotide
atcagcgcctacccgagtgtgcgaag

SEQ ID NO: 102259 - DNA, 25 bp, Artificial Sequence
  Description of Artificial Sequence: Synthetic oligonucleotide
tcagcgcctacccgagtgtgcgaag

SEQ ID NO: 102260 - DNA, 24 bp, Artificial Sequence
  Description of Artificial Sequence: Synthetic oligonucleotide
cagcgcctacccgagtgtgcgaag

SEQ ID NO: 102261 - DNA, 26 bp, Artificial Sequence
  Description of Artificial Sequence: Synthetic oligonucleotide
agcgcctacccgagtgtgcgaagcta

SEQ ID NO: 102262 - DNA, 25 bp, Artificial Sequence
  Description of Artificial Sequence: Synthetic oligonucleotide
gcgcctacccgagtgtgcgaagcta

SEQ ID NO: 102263 - DNA, 25 bp, Artificial Sequence
  Description of Artificial Sequence: Synthetic oligonucleotide
cgcctacccgagtgtgcgaagctag

SEQ ID NO: 102264 - DNA, 25 bp, Artificial Sequence
  Description of Artificial Sequence: Synthetic oligonucleotide
gcctacccgagtgtgcgaagctagc

SEQ ID NO: 102265 - DNA, 27 bp, Artificial Sequence
  Description of Artificial Sequence: Synthetic oligonucleotide
cctacccgagtgtgcgaagctagccaa

SEQ ID NO: 102266 - DNA, 27 bp, Artificial Sequence
  Description of Artificial Sequence: Synthetic oligonucleotide
ctacccgagtgtgcgaagctagccaag

SEQ ID NO: 102267 - DNA, 27 bp, Artificial Sequence
  Description of Artificial Sequence: Synthetic oligonucleotide
tacccgagtgtgcgaagctagccaagg

SEQ ID NO: 102268 - DNA, 27 bp, Artificial Sequence
  Description of Artificial Sequence: Synthetic oligonucleotide
acccgagtgtgcgaagctagccaagga

SEQ ID NO: 102269 - DNA, 27 bp, Artificial Sequence
  Description of Artificial Sequence: Synthetic oligonucleotide
cccgagtgtgcgaagctagccaaggaa

SEQ ID NO: 102270 - DNA, 27 bp, Artificial Sequence
  Description of Artificial Sequence: Synthetic oligonucleotide
ccgagtgtgcgaagctagccaaggaag

SEQ ID NO: 102271 - DNA, 27 bp, Artificial Sequence
  Description of Artificial Sequence: Synthetic oligonucleotide
cgagtgtgcgaagctagccaaggaagg

SEQ ID NO: 102272 - DNA, 29 bp, Artificial Sequence
  Description of Artificial Sequence: Synthetic oligonucleotide
gagtgtgcgaagctagccaaggaaggaag

SEQ ID NO: 102273 - DNA, 30 bp, Artificial Sequence
  Description of Artificial Sequence: Synthetic oligonucleotide
agtgtgcgaagctagccaaggaaggaagac

SEQ ID NO: 102274 - DNA, 29 bp, Artificial Sequence
  Description of Artificial Sequence: Synthetic oligonucleotide
gtgtgcgaagctagccaaggaaggaagac

SEQ ID NO: 102275 - DNA, 31 bp, Artificial Sequence
  Description of Artificial Sequence: Synthetic oligonucleotide
tgtgcgaagctagccaaggaaggaagacttc

SEQ ID NO: 102276 - DNA, 30 bp, Artificial Sequence
  Description of Artificial Sequence: Synthetic oligonucleotide
gtgcgaagctagccaaggaaggaagacttc

SEQ ID NO: 102277 - DNA, 32 bp, Artificial Sequence
  Description of Artificial Sequence: Synthetic oligonucleotide
tgcgaagctagccaaggaaggaagacttcaag

SEQ ID NO: 102278 - DNA, 31 bp, Artificial Sequence
  Description of Artificial Sequence: Synthetic oligonucleotide
gcgaagctagccaaggaaggaagacttcaag

SEQ ID NO: 102279 - DNA, 33 bp, Artificial Sequence
  Description of Artificial Sequence: Synthetic oligonucleotide
cgaagctagccaaggaaggaagacttcaagaag

SEQ ID NO: 102280 - DNA, 34 bp, Artificial Sequence
  Description of Artificial Sequence: Synthetic oligonucleotide
gaagctagccaaggaaggaagacttcaagaagtc

SEQ ID NO: 102281 - DNA, 37 bp, Artificial Sequence
  Description of Artificial Sequence: Synthetic oligonucleotide
aagctagccaaggaaggaagacttcaagaagtcattg

SEQ ID NO: 102282 - DNA, 36 bp, Artificial Sequence
  Description of Artificial Sequence: Synthetic oligonucleotide
agctagccaaggaaggaagacttcaagaagtcattg

SEQ ID NO: 102283 - DNA, 35 bp, Artificial Sequence
  Description of Artificial Sequence: Synthetic oligonucleotide
gctagccaaggaaggaagacttcaagaagtcattg

SEQ ID NO: 102284 - DNA, 38 bp, Artificial Sequence
  Description of Artificial Sequence: Synthetic oligonucleotide
ctagccaaggaaggaagacttcaagaagtcattgaaac

SEQ ID NO: 102285 - DNA, 38 bp, Artificial Sequence
  Description of Artificial Sequence: Synthetic oligonucleotide
tagccaaggaaggaagacttcaagaagtcattgaaacc

SEQ ID NO: 102286 - DNA, 37 bp, Artificial Sequence
  Description of Artificial Sequence: Synthetic oligonucleotide
agccaaggaaggaagacttcaagaagtcattgaaacc

SEQ ID NO: 102287 - DNA, 36 bp, Artificial Sequence
  Description of Artificial Sequence: Synthetic oligonucleotide
gccaaggaaggaagacttcaagaagtcattgaaacc

SEQ ID NO: 102288 - DNA, 36 bp, Artificial Sequence
  Description of Artificial Sequence: Synthetic oligonucleotide
ccaaggaaggaagacttcaagaagtcattgaaaccc

SEQ ID NO: 102289 - DNA, 38 bp, Artificial Sequence
  Description of Artificial Sequence: Synthetic oligonucleotide
caaggaaggaagacttcaagaagtcattgaaacccttc

SEQ ID NO: 102290 - DNA, 39 bp, Artificial Sequence
  Description of Artificial Sequence: Synthetic oligonucleotide
aaggaaggaagacttcaagaagtcattgaaacccttctc

SEQ ID NO: 102291 - DNA, 38 bp, Artificial Sequence
  Description of Artificial Sequence: Synthetic oligonucleotide
aggaaggaagacttcaagaagtcattgaaacccttctc

SEQ ID NO: 102292 - DNA, 37 bp, Artificial Sequence
  Description of Artificial Sequence: Synthetic oligonucleotide
ggaaggaagacttcaagaagtcattgaaacccttctc

SEQ ID NO: 102293 - DNA, 38 bp, Artificial Sequence
  Description of Artificial Sequence: Synthetic oligonucleotide
gaaggaagacttcaagaagtcattgaaacccttctctc

SEQ ID NO: 102294 - DNA, 39 bp, Artificial Sequence
  Description of Artificial Sequence: Synthetic oligonucleotide
aaggaagacttcaagaagtcattgaaacccttctctctc

SEQ ID NO: 102295 - DNA, 38 bp, Artificial Sequence
  Description of Artificial Sequence: Synthetic oligonucleotide
aggaagacttcaagaagtcattgaaacccttctctctc

SEQ ID NO: 102296 - DNA, 37 bp, Artificial Sequence
  Description of Artificial Sequence: Synthetic oligonucleotide
ggaagacttcaagaagtcattgaaacccttctctctc

SEQ ID NO: 102297 - DNA, 38 bp, Artificial Sequence
  Description of Artificial Sequence: Synthetic oligonucleotide
gaagacttcaagaagtcattgaaacccttctctctctg

SEQ ID NO: 102298 - DNA, 38 bp, Artificial Sequence
  Description of Artificial Sequence: Synthetic oligonucleotide
aagacttcaagaagtcattgaaacccttctctctctgg

SEQ ID NO: 102299 - DNA, 37 bp, Artificial Sequence
  Description of Artificial Sequence: Synthetic oligonucleotide
agacttcaagaagtcattgaaacccttctctctctgg

SEQ ID NO: 102300 - DNA, 36 bp, Artificial Sequence
  Description of Artificial Sequence: Synthetic oligonucleotide
gacttcaagaagtcattgaaacccttctctctctgg

SEQ ID NO: 102301 - DNA, 40 bp, Artificial Sequence
  Description of Artificial Sequence: Synthetic oligonucleotide
acttcaagaagtcattgaaacccttctctctctggaaaag

SEQ ID NO: 102302 - DNA, 39 bp, Artificial Sequence
  Description of Artificial Sequence: Synthetic oligonucleotide
cttcaagaagtcattgaaacccttctctctctggaaaag

SEQ ID NO: 102303 - DNA, 39 bp, Artificial Sequence
  Description of Artificial Sequence: Synthetic oligonucleotide
ttcaagaagtcattgaaacccttctctctctggaaaagc

SEQ ID NO: 102304 - DNA, 38 bp, Artificial Sequence
  Description of Artificial Sequence: Synthetic oligonucleotide
tcaagaagtcattgaaacccttctctctctggaaaagc

SEQ ID NO: 102305 - DNA, 37 bp, Artificial Sequence
  Description of Artificial Sequence: Synthetic oligonucleotide
caagaagtcattgaaacccttctctctctggaaaagc

SEQ ID NO: 102306 - DNA, 38 bp, Artificial Sequence
  Description of Artificial Sequence: Synthetic oligonucleotide
aagaagtcattgaaacccttctctctctggaaaagcag

SEQ ID NO: 102307 - DNA, 37 bp, Artificial Sequence
  Description of Artificial Sequence: Synthetic oligonucleotide
agaagtcattgaaacccttctctctctggaaaagcag

SEQ ID NO: 102308 - DNA, 36 bp, Artificial Sequence
  Description of Artificial Sequence: Synthetic oligonucleotide
gaagtcattgaaacccttctctctctggaaaagcag

SEQ ID NO: 102309 - DNA, 37 bp, Artificial Sequence
  Description of Artificial Sequence: Synthetic oligonucleotide
aagtcattgaaacccttctctctctggaaaagcagac

SEQ ID NO: 102310 - DNA, 36 bp, Artificial Sequence
  Description of Artificial Sequence: Synthetic oligonucleotide
agtcattgaaacccttctctctctggaaaagcagac

SEQ ID NO: 102311 - DNA, 35 bp, Artificial Sequence
  Description of Artificial Sequence: Synthetic oligonucleotide
gtcattgaaacccttctctctctggaaaagcagac

SEQ ID NO: 102312 - DNA, 36 bp, Artificial Sequence
  Description of Artificial Sequence: Synthetic oligonucleotide
tcattgaaacccttctctctctggaaaagcagactc

SEQ ID NO: 102313 - DNA, 35 bp, Artificial Sequence
  Description of Artificial Sequence: Synthetic oligonucleotide
cattgaaacccttctctctctggaaaagcagactc

SEQ ID NO: 102314 - DNA, 35 bp, Artificial Sequence
  Description of Artificial Sequence: Synthetic oligonucleotide
attgaaacccttctctctctggaaaagcagactcg

SEQ ID NO: 102315 - DNA, 34 bp, Artificial Sequence
  Description of Artificial Sequence: Synthetic oligonucleotide
ttgaaacccttctctctctggaaaagcagactcg

SEQ ID NO: 102316 - DNA, 33 bp, Artificial Sequence
  Description of Artificial Sequence: Synthetic oligonucleotide
tgaaacccttctctctctggaaaagcagactcg

SEQ ID NO: 102317 - DNA, 32 bp, Artificial Sequence
  Description of Artificial Sequence: Synthetic oligonucleotide
gaaacccttctctctctggaaaagcagactcg

SEQ ID NO: 102318 - DNA, 34 bp, Artificial Sequence
  Description of Artificial Sequence: Synthetic oligonucleotide
aaacccttctctctctggaaaagcagactcgtac

SEQ ID NO: 102319 - DNA, 33 bp, Artificial Sequence
  Description of Artificial Sequence: Synthetic oligonucleotide
aacccttctctctctggaaaagcagactcgtac

SEQ ID NO: 102320 - DNA, 32 bp, Artificial Sequence
  Description of Artificial Sequence: Synthetic oligonucleotide
acccttctctctctggaaaagcagactcgtac

SEQ ID NO: 102321 - DNA, 31 bp, Artificial Sequence
  Description of Artificial Sequence: Synthetic oligonucleotide
cccttctctctctggaaaagcagactcgtac

SEQ ID NO: 102322 - DNA, 32 bp, Artificial Sequence
  Description of Artificial Sequence: Synthetic oligonucleotide
ccttctctctctggaaaagcagactcgtactg

SEQ ID NO: 102323 - DNA, 32 bp, Artificial Sequence
  Description of Artificial Sequence: Synthetic oligonucleotide
cttctctctctggaaaagcagactcgtactgc

SEQ ID NO: 102324 - DNA, 34 bp, Artificial Sequence
  Description of Artificial Sequence: Synthetic oligonucleotide
ttctctctctggaaaagcagactcgtactgcttc

SEQ ID NO: 102325 - DNA, 33 bp, Artificial Sequence
  Description of Artificial Sequence: Synthetic oligonucleotide
tctctctctggaaaagcagactcgtactgcttc

SEQ ID NO: 102326 - DNA, 32 bp, Artificial Sequence
  Description of Artificial Sequence: Synthetic oligonucleotide
ctctctctggaaaagcagactcgtactgcttc

SEQ ID NO: 102327 - DNA, 32 bp, Artificial Sequence
  Description of Artificial Sequence: Synthetic oligonucleotide
tctctctggaaaagcagactcgtactgcttcc

SEQ ID NO: 102328 - DNA, 31 bp, Artificial Sequence
  Description of Artificial Sequence: Synthetic oligonucleotide
ctctctggaaaagcagactcgtactgcttcc

SEQ ID NO: 102329 - DNA, 31 bp, Artificial Sequence
  Description of Artificial Sequence: Synthetic oligonucleotide
tctctggaaaagcagactcgtactgcttccg

SEQ ID NO: 102330 - DNA, 30 bp, Artificial Sequence
  Description of Artificial Sequence: Synthetic oligonucleotide
ctctggaaaagcagactcgtactgcttccg

SEQ ID NO: 102331 - DNA, 34 bp, Artificial Sequence
  Description of Artificial Sequence: Synthetic oligonucleotide
tctggaaaagcagactcgtactgcttccgatatg

SEQ ID NO: 102332 - DNA, 33 bp, Artificial Sequence
  Description of Artificial Sequence: Synthetic oligonucleotide
ctggaaaagcagactcgtactgcttccgatatg

SEQ ID NO: 102333 - DNA, 33 bp, Artificial Sequence
  Description of Artificial Sequence: Synthetic oligonucleotide
tggaaaagcagactcgtactgcttccgatatgg

SEQ ID NO: 102334 - DNA, 32 bp, Artificial Sequence
  Description of Artificial Sequence: Synthetic oligonucleotide
ggaaaagcagactcgtactgcttccgatatgg

SEQ ID NO: 102335 - DNA, 35 bp, Artificial Sequence
  Description of Artificial Sequence: Synthetic oligonucleotide
gaaaagcagactcgtactgcttccgatatggtatc

SEQ ID NO: 102336 - DNA, 35 bp, Artificial Sequence
  Description of Artificial Sequence: Synthetic oligonucleotide
aaaagcagactcgtactgcttccgatatggtatcg

SEQ ID NO: 102337 - DNA, 34 bp, Artificial Sequence
  Description of Artificial Sequence: Synthetic oligonucleotide
aaagcagactcgtactgcttccgatatggtatcg

SEQ ID NO: 102338 - DNA, 33 bp, Artificial Sequence
  Description of Artificial Sequence: Synthetic oligonucleotide
aagcagactcgtactgcttccgatatggtatcg

SEQ ID NO: 102339 - DNA, 32 bp, Artificial Sequence
  Description of Artificial Sequence: Synthetic oligonucleotide
agcagactcgtactgcttccgatatggtatcg

SEQ ID NO: 102340 - DNA, 31 bp, Artificial Sequence
  Description of Artificial Sequence: Synthetic oligonucleotide
gcagactcgtactgcttccgatatggtatcg

SEQ ID NO: 102341 - DNA, 32 bp, Artificial Sequence
  Description of Artificial Sequence: Synthetic oligonucleotide
cagactcgtactgcttccgatatggtatcgac

SEQ ID NO: 102342 - DNA, 34 bp, Artificial Sequence
  Description of Artificial Sequence: Synthetic oligonucleotide
agactcgtactgcttccgatatggtatcgacatc

SEQ ID NO: 102343 - DNA, 33 bp, Artificial Sequence
  Description of Artificial Sequence: Synthetic oligonucleotide
gactcgtactgcttccgatatggtatcgacatc

SEQ ID NO: 102344 - DNA, 33 bp, Artificial Sequence
  Description of Artificial Sequence: Synthetic oligonucleotide
actcgtactgcttccgatatggtatcgacatcc

SEQ ID NO: 102345 - DNA, 32 bp, Artificial Sequence
  Description of Artificial Sequence: Synthetic oligonucleotide
ctcgtactgcttccgatatggtatcgacatcc

SEQ ID NO: 102346 - DNA, 32 bp, Artificial Sequence
  Description of Artificial Sequence: Synthetic oligonucleotide
tcgtactgcttccgatatggtatcgacatccc

SEQ ID NO: 102347 - DNA, 31 bp, Artificial Sequence
  Description of Artificial Sequence: Synthetic oligonucleotide
cgtactgcttccgatatggtatcgacatccc

SEQ ID NO: 102348 - DNA, 31 bp, Artificial Sequence
  Description of Artificial Sequence: Synthetic oligonucleotide
gtactgcttccgatatggtatcgacatcccg

SEQ ID NO: 102349 - DNA, 34 bp, Artificial Sequence
  Description of Artificial Sequence: Synthetic oligonucleotide
tactgcttccgatatggtatcgacatcccgtatc

SEQ ID NO: 102350 - DNA, 33 bp, Artificial Sequence
  Description of Artificial Sequence: Synthetic oligonucleotide
actgcttccgatatggtatcgacatcccgtatc

SEQ ID NO: 102351 - DNA, 32 bp, Artificial Sequence
  Description of Artificial Sequence: Synthetic oligonucleotide
ctgcttccgatatggtatcgacatcccgtatc

SEQ ID NO: 102352 - DNA, 35 bp, Artificial Sequence
  Description of Artificial Sequence: Synthetic oligonucleotide
tgcttccgatatggtatcgacatcccgtatcttag

SEQ ID NO: 102353 - DNA, 34 bp, Artificial Sequence
  Description of Artificial Sequence: Synthetic oligonucleotide
gcttccgatatggtatcgacatcccgtatcttag

SEQ ID NO: 102354 - DNA, 36 bp, Artificial Sequence
  Description of Artificial Sequence: Synthetic oligonucleotide
cttccgatatggtatcgacatcccgtatcttagttg

SEQ ID NO: 102355 - DNA, 36 bp, Artificial Sequence
  Description of Artificial Sequence: Synthetic oligonucleotide
ttccgatatggtatcgacatcccgtatcttagttgc

SEQ ID NO: 102356 - DNA, 35 bp, Artificial Sequence
  Description of Artificial Sequence: Synthetic oligonucleotide
tccgatatggtatcgacatcccgtatcttagttgc

SEQ ID NO: 102357 - DNA, 34 bp, Artificial Sequence
  Description of Artificial Sequence: Synthetic oligonucleotide
ccgatatggtatcgacatcccgtatcttagttgc

SEQ ID NO: 102358 - DNA, 35 bp, Artificial Sequence
  Description of Artificial Sequence: Synthetic oligonucleotide
cgatatggtatcgacatcccgtatcttagttgcag

SEQ ID NO: 102359 - DNA, 37 bp, Artificial Sequence
  Description of Artificial Sequence: Synthetic oligonucleotide
gatatggtatcgacatcccgtatcttagttgcagtag

SEQ ID NO: 102360 - DNA, 38 bp, Artificial Sequence
  Description of Artificial Sequence: Synthetic oligonucleotide
atatggtatcgacatcccgtatcttagttgcagtagtg

SEQ ID NO: 102361 - DNA, 37 bp, Artificial Sequence
  Description of Artificial Sequence: Synthetic oligonucleotide
tatggtatcgacatcccgtatcttagttgcagtagtg

SEQ ID NO: 102362 - DNA, 36 bp, Artificial Sequence
  Description of Artificial Sequence: Synthetic oligonucleotide
atggtatcgacatcccgtatcttagttgcagtagtg

SEQ ID NO: 102363 - DNA, 35 bp, Artificial Sequence
  Description of Artificial Sequence: Synthetic oligonucleotide
tggtatcgacatcccgtatcttagttgcagtagtg

SEQ ID NO: 102364 - DNA, 34 bp, Artificial Sequence
  Description of Artificial Sequence: Synthetic oligonucleotide
ggtatcgacatcccgtatcttagttgcagtagtg

SEQ ID NO: 102365 - DNA, 36 bp, Artificial Sequence
  Description of Artificial Sequence: Synthetic oligonucleotide
gtatcgacatcccgtatcttagttgcagtagtgaag

SEQ ID NO: 102366 - DNA, 38 bp, Artificial Sequence
  Description of Artificial Sequence: Synthetic oligonucleotide
tatcgacatcccgtatcttagttgcagtagtgaagatg

SEQ ID NO: 102367 - DNA, 37 bp, Artificial Sequence
  Description of Artificial Sequence: Synthetic oligonucleotide
atcgacatcccgtatcttagttgcagtagtgaagatg

SEQ ID NO: 102368 - DNA, 36 bp, Artificial Sequence
  Description of Artificial Sequence: Synthetic oligonucleotide
tcgacatcccgtatcttagttgcagtagtgaagatg

SEQ ID NO: 102369 - DNA, 35 bp, Artificial Sequence
  Description of Artificial Sequence: Synthetic oligonucleotide
cgacatcccgtatcttagttgcagtagtgaagatg

SEQ ID NO: 102370 - DNA, 36 bp, Artificial Sequence
  Description of Artificial Sequence: Synthetic oligonucleotide
gacatcccgtatcttagttgcagtagtgaagatgtg

SEQ ID NO: 102371 - DNA, 36 bp, Artificial Sequence
  Description of Artificial Sequence: Synthetic oligonucleotide
acatcccgtatcttagttgcagtagtgaagatgtgc

SEQ ID NO: 102372 - DNA, 35 bp, Artificial Sequence
  Description of Artificial Sequence: Synthetic oligonucleotide
catcccgtatcttagttgcagtagtgaagatgtgc

SEQ ID NO: 102373 - DNA, 38 bp, Artificial Sequence
  Description of Artificial Sequence: Synthetic oligonucleotide
atcccgtatcttagttgcagtagtgaagatgtgctatg

SEQ ID NO: 102374 - DNA, 37 bp, Artificial Sequence
  Description of Artificial Sequence: Synthetic oligonucleotide
tcccgtatcttagttgcagtagtgaagatgtgctatg

SEQ ID NO: 102375 - DNA, 36 bp, Artificial Sequence
  Description of Artificial Sequence: Synthetic oligonucleotide
cccgtatcttagttgcagtagtgaagatgtgctatg

SEQ ID NO: 102376 - DNA, 37 bp, Artificial Sequence
  Description of Artificial Sequence: Synthetic oligonucleotide
ccgtatcttagttgcagtagtgaagatgtgctatgag

SEQ ID NO: 102377 - DNA, 37 bp, Artificial Sequence
  Description of Artificial Sequence: Synthetic oligonucleotide
cgtatcttagttgcagtagtgaagatgtgctatgagg

SEQ ID NO: 102378 - DNA, 37 bp, Artificial Sequence
  Description of Artificial Sequence: Synthetic oligonucleotide
gtatcttagttgcagtagtgaagatgtgctatgaggc

SEQ ID NO: 102379 - DNA, 41 bp, Artificial Sequence
  Description of Artificial Sequence: Synthetic oligonucleotide
tatcttagttgcagtagtgaagatgtgctatgaggctaaag

SEQ ID NO: 102380 - DNA, 40 bp, Artificial Sequence
  Description of Artificial Sequence: Synthetic oligonucleotide
atcttagttgcagtagtgaagatgtgctatgaggctaaag

SEQ ID NO: 102381 - DNA, 39 bp, Artificial Sequence
  Description of Artificial Sequence: Synthetic oligonucleotide
tcttagttgcagtagtgaagatgtgctatgaggctaaag

SEQ ID NO: 102382 - DNA, 38 bp, Artificial Sequence
  Description of Artificial Sequence: Synthetic oligonucleotide
cttagttgcagtagtgaagatgtgctatgaggctaaag

SEQ ID NO: 102383 - DNA, 41 bp, Artificial Sequence
  Description of Artificial Sequence: Synthetic oligonucleotide
ttagttgcagtagtgaagatgtgctatgaggctaaagaatg

SEQ ID NO: 102384 - DNA, 40 bp, Artificial Sequence
  Description of Artificial Sequence: Synthetic oligonucleotide
tagttgcagtagtgaagatgtgctatgaggctaaagaatg

SEQ ID NO: 102385 - DNA, 39 bp, Artificial Sequence
  Description of Artificial Sequence: Synthetic oligonucleotide
agttgcagtagtgaagatgtgctatgaggctaaagaatg

SEQ ID NO: 102386 - DNA, 38 bp, Artificial Sequence
  Description of Artificial Sequence: Synthetic oligonucleotide
gttgcagtagtgaagatgtgctatgaggctaaagaatg

SEQ ID NO: 102387 - DNA, 38 bp, Artificial Sequence
  Description of Artificial Sequence: Synthetic oligonucleotide
ttgcagtagtgaagatgtgctatgaggctaaagaatgg

SEQ ID NO: 102388 - DNA, 37 bp, Artificial Sequence
  Description of Artificial Sequence: Synthetic oligonucleotide
tgcagtagtgaagatgtgctatgaggctaaagaatgg

SEQ ID NO: 102389 - DNA, 36 bp, Artificial Sequence
  Description of Artificial Sequence: Synthetic oligonucleotide
gcagtagtgaagatgtgctatgaggctaaagaatgg

SEQ ID NO: 102390 - DNA, 36 bp, Artificial Sequence
  Description of Artificial Sequence: Synthetic oligonucleotide
cagtagtgaagatgtgctatgaggctaaagaatggg

SEQ ID NO: 102391 - DNA, 41 bp, Artificial Sequence
  Description of Artificial Sequence: Synthetic oligonucleotide
agtagtgaagatgtgctatgaggctaaagaatgggatttac

SEQ ID NO: 102392 - DNA, 40 bp, Artificial Sequence
  Description of Artificial Sequence: Synthetic oligonucleotide
gtagtgaagatgtgctatgaggctaaagaatgggatttac

SEQ ID NO: 102393 - DNA, 45 bp, Artificial Sequence
  Description of Artificial Sequence: Synthetic oligonucleotide
tagtgaagatgtgctatgaggctaaagaatgggatttacttaatg

SEQ ID NO: 102394 - DNA, 44 bp, Artificial Sequence
  Description of Artificial Sequence: Synthetic oligonucleotide
agtgaagatgtgctatgaggctaaagaatgggatttacttaatg

SEQ ID NO: 102395 - DNA, 43 bp, Artificial Sequence
  Description of Artificial Sequence: Synthetic oligonucleotide
gtgaagatgtgctatgaggctaaagaatgggatttacttaatg

SEQ ID NO: 102396 - DNA, 53 bp, Artificial Sequence
  Description of Artificial Sequence: Synthetic oligonucleotide
tgaagatgtgctatgaggctaaagaatgggatttacttaatgaaaatattatg

SEQ ID NO: 102397 - DNA, 52 bp, Artificial Sequence
  Description of Artificial Sequence: Synthetic oligonucleotide
gaagatgtgctatgaggctaaagaatgggatttacttaatgaaaatattatg

SEQ ID NO: 102398 - DNA, 52 bp, Artificial Sequence
  Description of Artificial Sequence: Synthetic oligonucleotide
aagatgtgctatgaggctaaagaatgggatttacttaatgaaaatattatgc

SEQ ID NO: 102399 - DNA, 51 bp, Artificial Sequence
  Description of Artificial Sequence: Synthetic oligonucleotide
agatgtgctatgaggctaaagaatgggatttacttaatgaaaatattatgc

SEQ ID NO: 102400 - DNA, 50 bp, Artificial Sequence
  Description of Artificial Sequence: Synthetic oligonucleotide
gatgtgctatgaggctaaagaatgggatttacttaatgaaaatattatgc

SEQ ID NO: 102401 - DNA, 54 bp, Artificial Sequence
  Description of Artificial Sequence: Synthetic oligonucleotide
atgtgctatgaggctaaagaatgggatttacttaatgaaaatattatgcttttg

SEQ ID NO: 102402 - DNA, 53 bp, Artificial Sequence
  Description of Artificial Sequence: Synthetic oligonucleotide
tgtgctatgaggctaaagaatgggatttacttaatgaaaatattatgcttttg

SEQ ID NO: 102403 - DNA, 52 bp, Artificial Sequence
  Description of Artificial Sequence: Synthetic oligonucleotide
gtgctatgaggctaaagaatgggatttacttaatgaaaatattatgcttttg

SEQ ID NO: 102404 - DNA, 53 bp, Artificial Sequence
  Description of Artificial Sequence: Synthetic oligonucleotide
tgctatgaggctaaagaatgggatttacttaatgaaaatattatgcttttgtc

SEQ ID NO: 102405 - DNA, 52 bp, Artificial Sequence
  Description of Artificial Sequence: Synthetic oligonucleotide
gctatgaggctaaagaatgggatttacttaatgaaaatattatgcttttgtc

SEQ ID NO: 102406 - DNA, 52 bp, Artificial Sequence
  Description of Artificial Sequence: Synthetic oligonucleotide
ctatgaggctaaagaatgggatttacttaatgaaaatattatgcttttgtcc

SEQ ID NO: 102407 - DNA, 56 bp, Artificial Sequence
  Description of Artificial Sequence: Synthetic oligonucleotide
tatgaggctaaagaatgggatttacttaatgaaaatattatgcttttgtccaaaag

SEQ ID NO: 102408 - DNA, 55 bp, Artificial Sequence
  Description of Artificial Sequence: Synthetic oligonucleotide
atgaggctaaagaatgggatttacttaatgaaaatattatgcttttgtccaaaag

SEQ ID NO: 102409 - DNA, 54 bp, Artificial Sequence
  Description of Artificial Sequence: Synthetic oligonucleotide
tgaggctaaagaatgggatttacttaatgaaaatattatgcttttgtccaaaag

SEQ ID NO: 102410 - DNA, 53 bp, Artificial Sequence
  Description of Artificial Sequence: Synthetic oligonucleotide
gaggctaaagaatgggatttacttaatgaaaatattatgcttttgtccaaaag

SEQ ID NO: 102411 - DNA, 53 bp, Artificial Sequence
  Description of Artificial Sequence: Synthetic oligonucleotide
aggctaaagaatgggatttacttaatgaaaatattatgcttttgtccaaaagg

SEQ ID NO: 102412 - DNA, 52 bp, Artificial Sequence
  Description of Artificial Sequence: Synthetic oligonucleotide
ggctaaagaatgggatttacttaatgaaaatattatgcttttgtccaaaagg

SEQ ID NO: 102413 - DNA, 52 bp, Artificial Sequence
  Description of Artificial Sequence: Synthetic oligonucleotide
gctaaagaatgggatttacttaatgaaaatattatgcttttgtccaaaaggc

SEQ ID NO: 102414 - DNA, 52 bp, Artificial Sequence
  Description of Artificial Sequence: Synthetic oligonucleotide
ctaaagaatgggatttacttaatgaaaatattatgcttttgtccaaaaggcg

SEQ ID NO: 102415 - DNA, 52 bp, Artificial Sequence
  Description of Artificial Sequence: Synthetic oligonucleotide
taaagaatgggatttacttaatgaaaatattatgcttttgtccaaaaggcgg

SEQ ID NO: 102416 - DNA, 51 bp, Artificial Sequence
  Description of Artificial Sequence: Synthetic oligonucleotide
aaagaatgggatttacttaatgaaaatattatgcttttgtccaaaaggcgg

SEQ ID NO: 102417 - DNA, 50 bp, Artificial Sequence
  Description of Artificial Sequence: Synthetic oligonucleotide
aagaatgggatttacttaatgaaaatattatgcttttgtccaaaaggcgg

SEQ ID NO: 102418 - DNA, 49 bp, Artificial Sequence
  Description of Artificial Sequence: Synthetic oligonucleotide
agaatgggatttacttaatgaaaatattatgcttttgtccaaaaggcgg

SEQ ID NO: 102419 - DNA, 48 bp, Artificial Sequence
  Description of Artificial Sequence: Synthetic oligonucleotide
gaatgggatttacttaatgaaaatattatgcttttgtccaaaaggcgg

SEQ ID NO: 102420 - DNA, 49 bp, Artificial Sequence
  Description of Artificial Sequence: Synthetic oligonucleotide
aatgggatttacttaatgaaaatattatgcttttgtccaaaaggcggag

SEQ ID NO: 102421 - DNA, 48 bp, Artificial Sequence
  Description of Artificial Sequence: Synthetic oligonucleotide
atgggatttacttaatgaaaatattatgcttttgtccaaaaggcggag

SEQ ID NO: 102422 - DNA, 47 bp, Artificial Sequence
  Description of Artificial Sequence: Synthetic oligonucleotide
tgggatttacttaatgaaaatattatgcttttgtccaaaaggcggag

SEQ ID NO: 102423 - DNA, 46 bp, Artificial Sequence
  Description of Artificial Sequence: Synthetic oligonucleotide
gggatttacttaatgaaaatattatgcttttgtccaaaaggcggag

SEQ ID NO: 102424 - DNA, 47 bp, Artificial Sequence
  Description of Artificial Sequence: Synthetic oligonucleotide
ggatttacttaatgaaaatattatgcttttgtccaaaaggcggagtc

SEQ ID NO: 102425 - DNA, 48 bp, Artificial Sequence
  Description of Artificial Sequence: Synthetic oligonucleotide
gatttacttaatgaaaatattatgcttttgtccaaaaggcggagtcag

SEQ ID NO: 102426 - DNA, 54 bp, Artificial Sequence
  Description of Artificial Sequence: Synthetic oligonucleotide
atttacttaatgaaaatattatgcttttgtccaaaaggcggagtcagttaaaac

SEQ ID NO: 102427 - DNA, 53 bp, Artificial Sequence
  Description of Artificial Sequence: Synthetic oligonucleotide
tttacttaatgaaaatattatgcttttgtccaaaaggcggagtcagttaaaac

SEQ ID NO: 102428 - DNA, 52 bp, Artificial Sequence
  Description of Artificial Sequence: Synthetic oligonucleotide
ttacttaatgaaaatattatgcttttgtccaaaaggcggagtcagttaaaac

SEQ ID NO: 102429 - DNA, 51 bp, Artificial Sequence
  Description of Artificial Sequence: Synthetic oligonucleotide
tacttaatgaaaatattatgcttttgtccaaaaggcggagtcagttaaaac

SEQ ID NO: 102430 - DNA, 50 bp, Artificial Sequence
  Description of Artificial Sequence: Synthetic oligonucleotide
acttaatgaaaatattatgcttttgtccaaaaggcggagtcagttaaaac

SEQ ID NO: 102431 - DNA, 49 bp, Artificial Sequence
  Description of Artificial Sequence: Synthetic oligonucleotide
cttaatgaaaatattatgcttttgtccaaaaggcggagtcagttaaaac

SEQ ID NO: 102432 - DNA, 51 bp, Artificial Sequence
  Description of Artificial Sequence: Synthetic oligonucleotide
ttaatgaaaatattatgcttttgtccaaaaggcggagtcagttaaaacaag

SEQ ID NO: 102433 - DNA, 50 bp, Artificial Sequence
  Description of Artificial Sequence: Synthetic oligonucleotide
taatgaaaatattatgcttttgtccaaaaggcggagtcagttaaaacaag

SEQ ID NO: 102434 - DNA, 49 bp, Artificial Sequence
  Description of Artificial Sequence: Synthetic oligonucleotide
aatgaaaatattatgcttttgtccaaaaggcggagtcagttaaaacaag

SEQ ID NO: 102435 - DNA, 48 bp, Artificial Sequence
  Description of Artificial Sequence: Synthetic oligonucleotide
atgaaaatattatgcttttgtccaaaaggcggagtcagttaaaacaag

SEQ ID NO: 102436 - DNA, 47 bp, Artificial Sequence
  Description of Artificial Sequence: Synthetic oligonucleotide
tgaaaatattatgcttttgtccaaaaggcggagtcagttaaaacaag

SEQ ID NO: 102437 - DNA, 46 bp, Artificial Sequence
  Description of Artificial Sequence: Synthetic oligonucleotide
gaaaatattatgcttttgtccaaaaggcggagtcagttaaaacaag

SEQ ID NO: 102438 - DNA, 46 bp, Artificial Sequence
  Description of Artificial Sequence: Synthetic oligonucleotide
aaaatattatgcttttgtccaaaaggcggagtcagttaaaacaagc

SEQ ID NO: 102439 - DNA, 45 bp, Artificial Sequence
  Description of Artificial Sequence: Synthetic oligonucleotide
aaatattatgcttttgtccaaaaggcggagtcagttaaaacaagc

SEQ ID NO: 102440 - DNA, 44 bp, Artificial Sequence
  Description of Artificial Sequence: Synthetic oligonucleotide
aatattatgcttttgtccaaaaggcggagtcagttaaaacaagc

SEQ ID NO: 102441 - DNA, 43 bp, Artificial Sequence
  Description of Artificial Sequence: Synthetic oligonucleotide
atattatgcttttgtccaaaaggcggagtcagttaaaacaagc

SEQ ID NO: 102442 - DNA, 42 bp, Artificial Sequence
  Description of Artificial Sequence: Synthetic oligonucleotide
tattatgcttttgtccaaaaggcggagtcagttaaaacaagc

SEQ ID NO: 102443 - DNA, 41 bp, Artificial Sequence
  Description of Artificial Sequence: Synthetic oligonucleotide
attatgcttttgtccaaaaggcggagtcagttaaaacaagc

SEQ ID NO: 102444 - DNA, 40 bp, Artificial Sequence
  Description of Artificial Sequence: Synthetic oligonucleotide
ttatgcttttgtccaaaaggcggagtcagttaaaacaagc

SEQ ID NO: 102445 - DNA, 39 bp, Artificial Sequence
  Description of Artificial Sequence: Synthetic oligonucleotide
tatgcttttgtccaaaaggcggagtcagttaaaacaagc

SEQ ID NO: 102446 - DNA, 38 bp, Artificial Sequence
  Description of Artificial Sequence: Synthetic oligonucleotide
atgcttttgtccaaaaggcggagtcagttaaaacaagc

SEQ ID NO: 102447 - DNA, 37 bp, Artificial Sequence
  Description of Artificial Sequence: Synthetic oligonucleotide
tgcttttgtccaaaaggcggagtcagttaaaacaagc

SEQ ID NO: 102448 - DNA, 36 bp, Artificial Sequence
  Description of Artificial Sequence: Synthetic oligonucleotide
gcttttgtccaaaaggcggagtcagttaaaacaagc

SEQ ID NO: 102449 - DNA, 37 bp, Artificial Sequence
  Description of Artificial Sequence: Synthetic oligonucleotide
cttttgtccaaaaggcggagtcagttaaaacaagctg

SEQ ID NO: 102450 - DNA, 39 bp, Artificial Sequence
  Description of Artificial Sequence: Synthetic oligonucleotide
ttttgtccaaaaggcggagtcagttaaaacaagctgttg

SEQ ID NO: 102451 - DNA, 38 bp, Artificial Sequence
  Description of Artificial Sequence: Synthetic oligonucleotide
tttgtccaaaaggcggagtcagttaaaacaagctgttg

SEQ ID NO: 102452 - DNA, 37 bp, Artificial Sequence
  Description of Artificial Sequence: Synthetic oligonucleotide
ttgtccaaaaggcggagtcagttaaaacaagctgttg

SEQ ID NO: 102453 - DNA, 36 bp, Artificial Sequence
  Description of Artificial Sequence: Synthetic oligonucleotide
tgtccaaaaggcggagtcagttaaaacaagctgttg

SEQ ID NO: 102454 - DNA, 35 bp, Artificial Sequence
  Description of Artificial Sequence: Synthetic oligonucleotide
gtccaaaaggcggagtcagttaaaacaagctgttg

SEQ ID NO: 102455 - DNA, 35 bp, Artificial Sequence
  Description of Artificial Sequence: Synthetic oligonucleotide
tccaaaaggcggagtcagttaaaacaagctgttgc

SEQ ID NO: 102456 - DNA, 34 bp, Artificial Sequence
  Description of Artificial Sequence: Synthetic oligonucleotide
ccaaaaggcggagtcagttaaaacaagctgttgc

SEQ ID NO: 102457 - DNA, 34 bp, Artificial Sequence
  Description of Artificial Sequence: Synthetic oligonucleotide
caaaaggcggagtcagttaaaacaagctgttgcc

SEQ ID NO: 102458 - DNA, 39 bp, Artificial Sequence
  Description of Artificial Sequence: Synthetic oligonucleotide
aaaaggcggagtcagttaaaacaagctgttgccaaaatg

SEQ ID NO: 102459 - DNA, 38 bp, Artificial Sequence
  Description of Artificial Sequence: Synthetic oligonucleotide
aaaggcggagtcagttaaaacaagctgttgccaaaatg

SEQ ID NO: 102460 - DNA, 37 bp, Artificial Sequence
  Description of Artificial Sequence: Synthetic oligonucleotide
aaggcggagtcagttaaaacaagctgttgccaaaatg

SEQ ID NO: 102461 - DNA, 36 bp, Artificial Sequence
  Description of Artificial Sequence: Synthetic oligonucleotide
aggcggagtcagttaaaacaagctgttgccaaaatg

SEQ ID NO: 102462 - DNA, 35 bp, Artificial Sequence
  Description of Artificial Sequence: Synthetic oligonucleotide
ggcggagtcagttaaaacaagctgttgccaaaatg

SEQ ID NO: 102463 - DNA, 35 bp, Artificial Sequence
  Description of Artificial Sequence: Synthetic oligonucleotide
gcggagtcagttaaaacaagctgttgccaaaatgg

SEQ ID NO: 102464 - DNA, 37 bp, Artificial Sequence
  Description of Artificial Sequence: Synthetic oligonucleotide
cggagtcagttaaaacaagctgttgccaaaatggttc

SEQ ID NO: 102465 - DNA, 39 bp, Artificial Sequence
  Description of Artificial Sequence: Synthetic oligonucleotide
ggagtcagttaaaacaagctgttgccaaaatggttcaac

SEQ ID NO: 102466 - DNA, 40 bp, Artificial Sequence
  Description of Artificial Sequence: Synthetic oligonucleotide
gagtcagttaaaacaagctgttgccaaaatggttcaacag

SEQ ID NO: 102467 - DNA, 41 bp, Artificial Sequence
  Description of Artificial Sequence: Synthetic oligonucleotide
agtcagttaaaacaagctgttgccaaaatggttcaacagtg

SEQ ID NO: 102468 - DNA, 40 bp, Artificial Sequence
  Description of Artificial Sequence: Synthetic oligonucleotide
gtcagttaaaacaagctgttgccaaaatggttcaacagtg

SEQ ID NO: 102469 - DNA, 40 bp, Artificial Sequence
  Description of Artificial Sequence: Synthetic oligonucleotide
tcagttaaaacaagctgttgccaaaatggttcaacagtgc

SEQ ID NO: 102470 - DNA, 39 bp, Artificial Sequence
  Description of Artificial Sequence: Synthetic oligonucleotide
cagttaaaacaagctgttgccaaaatggttcaacagtgc

SEQ ID NO: 102471 - DNA, 40 bp, Artificial Sequence
  Description of Artificial Sequence: Synthetic oligonucleotide
agttaaaacaagctgttgccaaaatggttcaacagtgctg

SEQ ID NO: 102472 - DNA, 39 bp, Artificial Sequence
  Description of Artificial Sequence: Synthetic oligonucleotide
gttaaaacaagctgttgccaaaatggttcaacagtgctg

SEQ ID NO: 102473 - DNA, 41 bp, Artificial Sequence
  Description of Artificial Sequence: Synthetic oligonucleotide
ttaaaacaagctgttgccaaaatggttcaacagtgctgtac

SEQ ID NO: 102474 - DNA, 40 bp, Artificial Sequence
  Description of Artificial Sequence: Synthetic oligonucleotide
taaaacaagctgttgccaaaatggttcaacagtgctgtac

SEQ ID NO: 102475 - DNA, 39 bp, Artificial Sequence
  Description of Artificial Sequence: Synthetic oligonucleotide
aaaacaagctgttgccaaaatggttcaacagtgctgtac

SEQ ID NO: 102476 - DNA, 38 bp, Artificial Sequence
  Description of Artificial Sequence: Synthetic oligonucleotide
aaacaagctgttgccaaaatggttcaacagtgctgtac

SEQ ID NO: 102477 - DNA, 37 bp, Artificial Sequence
  Description of Artificial Sequence: Synthetic oligonucleotide
aacaagctgttgccaaaatggttcaacagtgctgtac

SEQ ID NO: 102478 - DNA, 36 bp, Artificial Sequence
  Description of Artificial Sequence: Synthetic oligonucleotide
acaagctgttgccaaaatggttcaacagtgctgtac

SEQ ID NO: 102479 - DNA, 35 bp, Artificial Sequence
  Description of Artificial Sequence: Synthetic oligonucleotide
caagctgttgccaaaatggttcaacagtgctgtac

SEQ ID NO: 102480 - DNA, 39 bp, Artificial Sequence
  Description of Artificial Sequence: Synthetic oligonucleotide
aagctgttgccaaaatggttcaacagtgctgtacttatg

SEQ ID NO: 102481 - DNA, 38 bp, Artificial Sequence
  Description of Artificial Sequence: Synthetic oligonucleotide
agctgttgccaaaatggttcaacagtgctgtacttatg

SEQ ID NO: 102482 - DNA, 37 bp, Artificial Sequence
  Description of Artificial Sequence: Synthetic oligonucleotide
gctgttgccaaaatggttcaacagtgctgtacttatg

SEQ ID NO: 102483 - DNA, 39 bp, Artificial Sequence
  Description of Artificial Sequence: Synthetic oligonucleotide
ctgttgccaaaatggttcaacagtgctgtacttatgttg

SEQ ID NO: 102484 - DNA, 40 bp, Artificial Sequence
  Description of Artificial Sequence: Synthetic oligonucleotide
tgttgccaaaatggttcaacagtgctgtacttatgttgag

SEQ ID NO: 102485 - DNA, 39 bp, Artificial Sequence
  Description of Artificial Sequence: Synthetic oligonucleotide
gttgccaaaatggttcaacagtgctgtacttatgttgag

SEQ ID NO: 102486 - DNA, 39 bp, Artificial Sequence
  Description of Artificial Sequence: Synthetic oligonucleotide
ttgccaaaatggttcaacagtgctgtacttatgttgagg

SEQ ID NO: 102487 - DNA, 38 bp, Artificial Sequence
  Description of Artificial Sequence: Synthetic oligonucleotide
tgccaaaatggttcaacagtgctgtacttatgttgagg

SEQ ID NO: 102488 - DNA, 37 bp, Artificial Sequence
  Description of Artificial Sequence: Synthetic oligonucleotide
gccaaaatggttcaacagtgctgtacttatgttgagg

SEQ ID NO: 102489 - DNA, 41 bp, Artificial Sequence
  Description of Artificial Sequence: Synthetic oligonucleotide
ccaaaatggttcaacagtgctgtacttatgttgaggaaatc

SEQ ID NO: 102490 - DNA, 42 bp, Artificial Sequence
  Description of Artificial Sequence: Synthetic oligonucleotide
caaaatggttcaacagtgctgtacttatgttgaggaaatcac

SEQ ID NO: 102491 - DNA, 43 bp, Artificial Sequence
  Description of Artificial Sequence: Synthetic oligonucleotide
aaaatggttcaacagtgctgtacttatgttgaggaaatcacag

SEQ ID NO: 102492 - DNA, 42 bp, Artificial Sequence
  Description of Artificial Sequence: Synthetic oligonucleotide
aaatggttcaacagtgctgtacttatgttgaggaaatcacag

SEQ ID NO: 102493 - DNA, 41 bp, Artificial Sequence
  Description of Artificial Sequence: Synthetic oligonucleotide
aatggttcaacagtgctgtacttatgttgaggaaatcacag

SEQ ID NO: 102494 - DNA, 40 bp, Artificial Sequence
  Description of Artificial Sequence: Synthetic oligonucleotide
atggttcaacagtgctgtacttatgttgaggaaatcacag

SEQ ID NO: 102495 - DNA, 39 bp, Artificial Sequence
  Description of Artificial Sequence: Synthetic oligonucleotide
tggttcaacagtgctgtacttatgttgaggaaatcacag

SEQ ID NO: 102496 - DNA, 38 bp, Artificial Sequence
  Description of Artificial Sequence: Synthetic oligonucleotide
ggttcaacagtgctgtacttatgttgaggaaatcacag

SEQ ID NO: 102497 - DNA, 39 bp, Artificial Sequence
  Description of Artificial Sequence: Synthetic oligonucleotide
gttcaacagtgctgtacttatgttgaggaaatcacagac

SEQ ID NO: 102498 - DNA, 39 bp, Artificial Sequence
  Description of Artificial Sequence: Synthetic oligonucleotide
ttcaacagtgctgtacttatgttgaggaaatcacagacc

SEQ ID NO: 102499 - DNA, 38 bp, Artificial Sequence
  Description of Artificial Sequence: Synthetic oligonucleotide
tcaacagtgctgtacttatgttgaggaaatcacagacc

SEQ ID NO: 102500 - DNA, 37 bp, Artificial Sequence
  Description of Artificial Sequence: Synthetic oligonucleotide
caacagtgctgtacttatgttgaggaaatcacagacc

SEQ ID NO: 102501 - DNA, 39 bp, Artificial Sequence
  Description of Artificial Sequence: Synthetic oligonucleotide
aacagtgctgtacttatgttgaggaaatcacagaccttc

SEQ ID NO: 102502 - DNA, 38 bp, Artificial Sequence
  Description of Artificial Sequence: Synthetic oligonucleotide
acagtgctgtacttatgttgaggaaatcacagaccttc

SEQ ID NO: 102503 - DNA, 37 bp, Artificial Sequence
  Description of Artificial Sequence: Synthetic oligonucleotide
cagtgctgtacttatgttgaggaaatcacagaccttc

SEQ ID NO: 102504 - DNA, 37 bp, Artificial Sequence
  Description of Artificial Sequence: Synthetic oligonucleotide
agtgctgtacttatgttgaggaaatcacagaccttcc

SEQ ID NO: 102505 - DNA, 36 bp, Artificial Sequence
  Description of Artificial Sequence: Synthetic oligonucleotide
gtgctgtacttatgttgaggaaatcacagaccttcc

SEQ ID NO: 102506 - DNA, 39 bp, Artificial Sequence
  Description of Artificial Sequence: Synthetic oligonucleotide
tgctgtacttatgttgaggaaatcacagaccttcctatc

SEQ ID NO: 102507 - DNA, 38 bp, Artificial Sequence
  Description of Artificial Sequence: Synthetic oligonucleotide
gctgtacttatgttgaggaaatcacagaccttcctatc

SEQ ID NO: 102508 - DNA, 41 bp, Artificial Sequence
  Description of Artificial Sequence: Synthetic oligonucleotide
ctgtacttatgttgaggaaatcacagaccttcctatcaaac

SEQ ID NO: 102509 - DNA, 43 bp, Artificial Sequence
  Description of Artificial Sequence: Synthetic oligonucleotide
tgtacttatgttgaggaaatcacagaccttcctatcaaacttc

SEQ ID NO: 102510 - DNA, 42 bp, Artificial Sequence
  Description of Artificial Sequence: Synthetic oligonucleotide
gtacttatgttgaggaaatcacagaccttcctatcaaacttc

SEQ ID NO: 102511 - DNA, 42 bp, Artificial Sequence
  Description of Artificial Sequence: Synthetic oligonucleotide
tacttatgttgaggaaatcacagaccttcctatcaaacttcg

SEQ ID NO: 102512 - DNA, 41 bp, Artificial Sequence
  Description of Artificial Sequence: Synthetic oligonucleotide
acttatgttgaggaaatcacagaccttcctatcaaacttcg

SEQ ID NO: 102513 - DNA, 40 bp, Artificial Sequence
  Description of Artificial Sequence: Synthetic oligonucleotide
cttatgttgaggaaatcacagaccttcctatcaaacttcg

SEQ ID NO: 102514 - DNA, 47 bp, Artificial Sequence
  Description of Artificial Sequence: Synthetic oligonucleotide
ttatgttgaggaaatcacagaccttcctatcaaacttcgattaattg

SEQ ID NO: 102515 - DNA, 46 bp, Artificial Sequence
  Description of Artificial Sequence: Synthetic oligonucleotide
tatgttgaggaaatcacagaccttcctatcaaacttcgattaattg

SEQ ID NO: 102516 - DNA, 45 bp, Artificial Sequence
  Description of Artificial Sequence: Synthetic oligonucleotide
atgttgaggaaatcacagaccttcctatcaaacttcgattaattg

SEQ ID NO: 102517 - DNA, 44 bp, Artificial Sequence
  Description of Artificial Sequence: Synthetic oligonucleotide
tgttgaggaaatcacagaccttcctatcaaacttcgattaattg

SEQ ID NO: 102518 - DNA, 43 bp, Artificial Sequence
  Description of Artificial Sequence: Synthetic oligonucleotide
gttgaggaaatcacagaccttcctatcaaacttcgattaattg

SEQ ID NO: 102519 - DNA, 46 bp, Artificial Sequence
  Description of Artificial Sequence: Synthetic oligonucleotide
ttgaggaaatcacagaccttcctatcaaacttcgattaattgatac

SEQ ID NO: 102520 - DNA, 45 bp, Artificial Sequence
  Description of Artificial Sequence: Synthetic oligonucleotide
tgaggaaatcacagaccttcctatcaaacttcgattaattgatac

SEQ ID NO: 102521 - DNA, 44 bp, Artificial Sequence
  Description of Artificial Sequence: Synthetic oligonucleotide
gaggaaatcacagaccttcctatcaaacttcgattaattgatac

SEQ ID NO: 102522 - DNA, 45 bp, Artificial Sequence
  Description of Artificial Sequence: Synthetic oligonucleotide
aggaaatcacagaccttcctatcaaacttcgattaattgatactc

SEQ ID NO: 102523 - DNA, 44 bp, Artificial Sequence
  Description of Artificial Sequence: Synthetic oligonucleotide
ggaaatcacagaccttcctatcaaacttcgattaattgatactc

SEQ ID NO: 102524 - DNA, 46 bp, Artificial Sequence
  Description of Artificial Sequence: Synthetic oligonucleotide
gaaatcacagaccttcctatcaaacttcgattaattgatactctac

SEQ ID NO: 102525 - DNA, 46 bp, Artificial Sequence
  Description of Artificial Sequence: Synthetic oligonucleotide
aaatcacagaccttcctatcaaacttcgattaattgatactctacg

SEQ ID NO: 102526 - DNA, 45 bp, Artificial Sequence
  Description of Artificial Sequence: Synthetic oligonucleotide
aatcacagaccttcctatcaaacttcgattaattgatactctacg

SEQ ID NO: 102527 - DNA, 44 bp, Artificial Sequence
  Description of Artificial Sequence: Synthetic oligonucleotide
atcacagaccttcctatcaaacttcgattaattgatactctacg

SEQ ID NO: 102528 - DNA, 43 bp, Artificial Sequence
  Description of Artificial Sequence: Synthetic oligonucleotide
tcacagaccttcctatcaaacttcgattaattgatactctacg

SEQ ID NO: 102529 - DNA, 42 bp, Artificial Sequence
  Description of Artificial Sequence: Synthetic oligonucleotide
cacagaccttcctatcaaacttcgattaattgatactctacg

SEQ ID NO: 102530 - DNA, 45 bp, Artificial Sequence
  Description of Artificial Sequence: Synthetic oligonucleotide
acagaccttcctatcaaacttcgattaattgatactctacgaatg

SEQ ID NO: 102531 - DNA, 44 bp, Artificial Sequence
  Description of Artificial Sequence: Synthetic oligonucleotide
cagaccttcctatcaaacttcgattaattgatactctacgaatg

SEQ ID NO: 102532 - DNA, 44 bp, Artificial Sequence
  Description of Artificial Sequence: Synthetic oligonucleotide
agaccttcctatcaaacttcgattaattgatactctacgaatgg

SEQ ID NO: 102533 - DNA, 43 bp, Artificial Sequence
  Description of Artificial Sequence: Synthetic oligonucleotide
gaccttcctatcaaacttcgattaattgatactctacgaatgg

SEQ ID NO: 102534 - DNA, 46 bp, Artificial Sequence
  Description of Artificial Sequence: Synthetic oligonucleotide
accttcctatcaaacttcgattaattgatactctacgaatggttac

SEQ ID NO: 102535 - DNA, 45 bp, Artificial Sequence
  Description of Artificial Sequence: Synthetic oligonucleotide
ccttcctatcaaacttcgattaattgatactctacgaatggttac

SEQ ID NO: 102536 - DNA, 45 bp, Artificial Sequence
  Description of Artificial Sequence: Synthetic oligonucleotide
cttcctatcaaacttcgattaattgatactctacgaatggttacc

SEQ ID NO: 102537 - DNA, 45 bp, Artificial Sequence
  Description of Artificial Sequence: Synthetic oligonucleotide
ttcctatcaaacttcgattaattgatactctacgaatggttaccg

SEQ ID NO: 102538 - DNA, 44 bp, Artificial Sequence
  Description of Artificial Sequence: Synthetic oligonucleotide
tcctatcaaacttcgattaattgatactctacgaatggttaccg

SEQ ID NO: 102539 - DNA, 43 bp, Artificial Sequence
  Description of Artificial Sequence: Synthetic oligonucleotide
cctatcaaacttcgattaattgatactctacgaatggttaccg

SEQ ID NO: 102540 - DNA, 45 bp, Artificial Sequence
  Description of Artificial Sequence: Synthetic oligonucleotide
ctatcaaacttcgattaattgatactctacgaatggttaccgaag

SEQ ID NO: 102541 - DNA, 45 bp, Artificial Sequence
  Description of Artificial Sequence: Synthetic oligonucleotide
tatcaaacttcgattaattgatactctacgaatggttaccgaagg

SEQ ID NO: 102542 - DNA, 44 bp, Artificial Sequence
  Description of Artificial Sequence: Synthetic oligonucleotide
atcaaacttcgattaattgatactctacgaatggttaccgaagg

SEQ ID NO: 102543 - DNA, 43 bp, Artificial Sequence
  Description of Artificial Sequence: Synthetic oligonucleotide
tcaaacttcgattaattgatactctacgaatggttaccgaagg

SEQ ID NO: 102544 - DNA, 42 bp, Artificial Sequence
  Description of Artificial Sequence: Synthetic oligonucleotide
caaacttcgattaattgatactctacgaatggttaccgaagg

SEQ ID NO: 102545 - DNA, 42 bp, Artificial Sequence
  Description of Artificial Sequence: Synthetic oligonucleotide
aaacttcgattaattgatactctacgaatggttaccgaaggc

SEQ ID NO: 102546 - DNA, 41 bp, Artificial Sequence
  Description of Artificial Sequence: Synthetic oligonucleotide
aacttcgattaattgatactctacgaatggttaccgaaggc

SEQ ID NO: 102547 - DNA, 40 bp, Artificial Sequence
  Description of Artificial Sequence: Synthetic oligonucleotide
acttcgattaattgatactctacgaatggttaccgaaggc

SEQ ID NO: 102548 - DNA, 39 bp, Artificial Sequence
  Description of Artificial Sequence: Synthetic oligonucleotide
cttcgattaattgatactctacgaatggttaccgaaggc

SEQ ID NO: 102549 - DNA, 41 bp, Artificial Sequence
  Description of Artificial Sequence: Synthetic oligonucleotide
ttcgattaattgatactctacgaatggttaccgaaggcaag

SEQ ID NO: 102550 - DNA, 40 bp, Artificial Sequence
  Description of Artificial Sequence: Synthetic oligonucleotide
tcgattaattgatactctacgaatggttaccgaaggcaag

SEQ ID NO: 102551 - DNA, 39 bp, Artificial Sequence
  Description of Artificial Sequence: Synthetic oligonucleotide
cgattaattgatactctacgaatggttaccgaaggcaag

SEQ ID NO: 102552 - DNA, 45 bp, Artificial Sequence
  Description of Artificial Sequence: Synthetic oligonucleotide
gattaattgatactctacgaatggttaccgaaggcaagatttatg

SEQ ID NO: 102553 - DNA, 47 bp, Artificial Sequence
  Description of Artificial Sequence: Synthetic oligonucleotide
attaattgatactctacgaatggttaccgaaggcaagatttatgttg

SEQ ID NO: 102554 - DNA, 46 bp, Artificial Sequence
  Description of Artificial Sequence: Synthetic oligonucleotide
ttaattgatactctacgaatggttaccgaaggcaagatttatgttg

SEQ ID NO: 102555 - DNA, 45 bp, Artificial Sequence
  Description of Artificial Sequence: Synthetic oligonucleotide
taattgatactctacgaatggttaccgaaggcaagatttatgttg

SEQ ID NO: 102556 - DNA, 44 bp, Artificial Sequence
  Description of Artificial Sequence: Synthetic oligonucleotide
aattgatactctacgaatggttaccgaaggcaagatttatgttg

SEQ ID NO: 102557 - DNA, 43 bp, Artificial Sequence
  Description of Artificial Sequence: Synthetic oligonucleotide
attgatactctacgaatggttaccgaaggcaagatttatgttg

SEQ ID NO: 102558 - DNA, 42 bp, Artificial Sequence
  Description of Artificial Sequence: Synthetic oligonucleotide
ttgatactctacgaatggttaccgaaggcaagatttatgttg

SEQ ID NO: 102559 - DNA, 41 bp, Artificial Sequence
  Description of Artificial Sequence: Synthetic oligonucleotide
tgatactctacgaatggttaccgaaggcaagatttatgttg

SEQ ID NO: 102560 - DNA, 40 bp, Artificial Sequence
  Description of Artificial Sequence: Synthetic oligonucleotide
gatactctacgaatggttaccgaaggcaagatttatgttg

SEQ ID NO: 102561 - DNA, 45 bp, Artificial Sequence
  Description of Artificial Sequence: Synthetic oligonucleotide
atactctacgaatggttaccgaaggcaagatttatgttgaaattg

SEQ ID NO: 102562 - DNA, 44 bp, Artificial Sequence
  Description of Artificial Sequence: Synthetic oligonucleotide
tactctacgaatggttaccgaaggcaagatttatgttgaaattg

SEQ ID NO: 102563 - DNA, 43 bp, Artificial Sequence
  Description of Artificial Sequence: Synthetic oligonucleotide
actctacgaatggttaccgaaggcaagatttatgttgaaattg

SEQ ID NO: 102564 - DNA, 42 bp, Artificial Sequence
  Description of Artificial Sequence: Synthetic oligonucleotide
ctctacgaatggttaccgaaggcaagatttatgttgaaattg

SEQ ID NO: 102565 - DNA, 43 bp, Artificial Sequence
  Description of Artificial Sequence: Synthetic oligonucleotide
tctacgaatggttaccgaaggcaagatttatgttgaaattgag

SEQ ID NO: 102566 - DNA, 42 bp, Artificial Sequence
  Description of Artificial Sequence: Synthetic oligonucleotide
ctacgaatggttaccgaaggcaagatttatgttgaaattgag

SEQ ID NO: 102567 - DNA, 42 bp, Artificial Sequence
  Description of Artificial Sequence: Synthetic oligonucleotide
tacgaatggttaccgaaggcaagatttatgttgaaattgagc

SEQ ID NO: 102568 - DNA, 41 bp, Artificial Sequence
  Description of Artificial Sequence: Synthetic oligonucleotide
acgaatggttaccgaaggcaagatttatgttgaaattgagc

SEQ ID NO: 102569 - DNA, 40 bp, Artificial Sequence
  Description of Artificial Sequence: Synthetic oligonucleotide
cgaatggttaccgaaggcaagatttatgttgaaattgagc

SEQ ID NO: 102570 - DNA, 40 bp, Artificial Sequence
  Description of Artificial Sequence: Synthetic oligonucleotide
gaatggttaccgaaggcaagatttatgttgaaattgagcg

SEQ ID NO: 102571 - DNA, 41 bp, Artificial Sequence
  Description of Artificial Sequence: Synthetic oligonucleotide
aatggttaccgaaggcaagatttatgttgaaattgagcgtg

SEQ ID NO: 102572 - DNA, 40 bp, Artificial Sequence
  Description of Artificial Sequence: Synthetic oligonucleotide
atggttaccgaaggcaagatttatgttgaaattgagcgtg

SEQ ID NO: 102573 - DNA, 39 bp, Artificial Sequence
  Description of Artificial Sequence: Synthetic oligonucleotide
tggttaccgaaggcaagatttatgttgaaattgagcgtg

SEQ ID NO: 102574 - DNA, 38 bp, Artificial Sequence
  Description of Artificial Sequence: Synthetic oligonucleotide
ggttaccgaaggcaagatttatgttgaaattgagcgtg

SEQ ID NO: 102575 - DNA, 38 bp, Artificial Sequence
  Description of Artificial Sequence: Synthetic oligonucleotide
gttaccgaaggcaagatttatgttgaaattgagcgtgc

SEQ ID NO: 102576 - DNA, 38 bp, Artificial Sequence
  Description of Artificial Sequence: Synthetic oligonucleotide
ttaccgaaggcaagatttatgttgaaattgagcgtgcg

SEQ ID NO: 102577 - DNA, 37 bp, Artificial Sequence
  Description of Artificial Sequence: Synthetic oligonucleotide
taccgaaggcaagatttatgttgaaattgagcgtgcg

SEQ ID NO: 102578 - DNA, 36 bp, Artificial Sequence
  Description of Artificial Sequence: Synthetic oligonucleotide
accgaaggcaagatttatgttgaaattgagcgtgcg

SEQ ID NO: 102579 - DNA, 35 bp, Artificial Sequence
  Description of Artificial Sequence: Synthetic oligonucleotide
ccgaaggcaagatttatgttgaaattgagcgtgcg

SEQ ID NO: 102580 - DNA, 35 bp, Artificial Sequence
  Description of Artificial Sequence: Synthetic oligonucleotide
cgaaggcaagatttatgttgaaattgagcgtgcgc

SEQ ID NO: 102581 - DNA, 35 bp, Artificial Sequence
  Description of Artificial Sequence: Synthetic oligonucleotide
gaaggcaagatttatgttgaaattgagcgtgcgcg

SEQ ID NO: 102582 - DNA, 36 bp, Artificial Sequence
  Description of Artificial Sequence: Synthetic oligonucleotide
aaggcaagatttatgttgaaattgagcgtgcgcgac

SEQ ID NO: 102583 - DNA, 35 bp, Artificial Sequence
  Description of Artificial Sequence: Synthetic oligonucleotide
aggcaagatttatgttgaaattgagcgtgcgcgac

SEQ ID NO: 102584 - DNA, 34 bp, Artificial Sequence
  Description of Artificial Sequence: Synthetic oligonucleotide
ggcaagatttatgttgaaattgagcgtgcgcgac

SEQ ID NO: 102585 - DNA, 35 bp, Artificial Sequence
  Description of Artificial Sequence: Synthetic oligonucleotide
gcaagatttatgttgaaattgagcgtgcgcgactg

SEQ ID NO: 102586 - DNA, 36 bp, Artificial Sequence
  Description of Artificial Sequence: Synthetic oligonucleotide
caagatttatgttgaaattgagcgtgcgcgactgac

SEQ ID NO: 102587 - DNA, 41 bp, Artificial Sequence
  Description of Artificial Sequence: Synthetic oligonucleotide
aagatttatgttgaaattgagcgtgcgcgactgactaaaac

SEQ ID NO: 102588 - DNA, 40 bp, Artificial Sequence
  Description of Artificial Sequence: Synthetic oligonucleotide
agatttatgttgaaattgagcgtgcgcgactgactaaaac

SEQ ID NO: 102589 - DNA, 39 bp, Artificial Sequence
  Description of Artificial Sequence: Synthetic oligonucleotide
gatttatgttgaaattgagcgtgcgcgactgactaaaac

SEQ ID NO: 102590 - DNA, 43 bp, Artificial Sequence
  Description of Artificial Sequence: Synthetic oligonucleotide
atttatgttgaaattgagcgtgcgcgactgactaaaacattag

SEQ ID NO: 102591 - DNA, 42 bp, Artificial Sequence
  Description of Artificial Sequence: Synthetic oligonucleotide
tttatgttgaaattgagcgtgcgcgactgactaaaacattag

SEQ ID NO: 102592 - DNA, 41 bp, Artificial Sequence
  Description of Artificial Sequence: Synthetic oligonucleotide
ttatgttgaaattgagcgtgcgcgactgactaaaacattag

SEQ ID NO: 102593 - DNA, 40 bp, Artificial Sequence
  Description of Artificial Sequence: Synthetic oligonucleotide
tatgttgaaattgagcgtgcgcgactgactaaaacattag

SEQ ID NO: 102594 - DNA, 39 bp, Artificial Sequence
  Description of Artificial Sequence: Synthetic oligonucleotide
atgttgaaattgagcgtgcgcgactgactaaaacattag

SEQ ID NO: 102595 - DNA, 38 bp, Artificial Sequence
  Description of Artificial Sequence: Synthetic oligonucleotide
tgttgaaattgagcgtgcgcgactgactaaaacattag

SEQ ID NO: 102596 - DNA, 37 bp, Artificial Sequence
  Description of Artificial Sequence: Synthetic oligonucleotide
gttgaaattgagcgtgcgcgactgactaaaacattag

SEQ ID NO: 102597 - DNA, 37 bp, Artificial Sequence
  Description of Artificial Sequence: Synthetic oligonucleotide
ttgaaattgagcgtgcgcgactgactaaaacattagc

SEQ ID NO: 102598 - DNA, 36 bp, Artificial Sequence
  Description of Artificial Sequence: Synthetic oligonucleotide
tgaaattgagcgtgcgcgactgactaaaacattagc

SEQ ID NO: 102599 - DNA, 35 bp, Artificial Sequence
  Description of Artificial Sequence: Synthetic oligonucleotide
gaaattgagcgtgcgcgactgactaaaacattagc

SEQ ID NO: 102600 - DNA, 37 bp, Artificial Sequence
  Description of Artificial Sequence: Synthetic oligonucleotide
aaattgagcgtgcgcgactgactaaaacattagcaac

SEQ ID NO: 102601 - DNA, 36 bp, Artificial Sequence
  Description of Artificial Sequence: Synthetic oligonucleotide
aattgagcgtgcgcgactgactaaaacattagcaac

SEQ ID NO: 102602 - DNA, 35 bp, Artificial Sequence
  Description of Artificial Sequence: Synthetic oligonucleotide
attgagcgtgcgcgactgactaaaacattagcaac

SEQ ID NO: 102603 - DNA, 34 bp, Artificial Sequence
  Description of Artificial Sequence: Synthetic oligonucleotide
ttgagcgtgcgcgactgactaaaacattagcaac

SEQ ID NO: 102604 - DNA, 33 bp, Artificial Sequence
  Description of Artificial Sequence: Synthetic oligonucleotide
tgagcgtgcgcgactgactaaaacattagcaac

SEQ ID NO: 102605 - DNA, 32 bp, Artificial Sequence
  Description of Artificial Sequence: Synthetic oligonucleotide
gagcgtgcgcgactgactaaaacattagcaac

SEQ ID NO: 102606 - DNA, 39 bp, Artificial Sequence
  Description of Artificial Sequence: Synthetic oligonucleotide
agcgtgcgcgactgactaaaacattagcaactataaaag

SEQ ID NO: 102607 - DNA, 38 bp, Artificial Sequence
  Description of Artificial Sequence: Synthetic oligonucleotide
gcgtgcgcgactgactaaaacattagcaactataaaag

SEQ ID NO: 102608 - DNA, 40 bp, Artificial Sequence
  Description of Artificial Sequence: Synthetic oligonucleotide
cgtgcgcgactgactaaaacattagcaactataaaagaac

SEQ ID NO: 102609 - DNA, 45 bp, Artificial Sequence
  Description of Artificial Sequence: Synthetic oligonucleotide
gtgcgcgactgactaaaacattagcaactataaaagaacaaaatg

SEQ ID NO: 102610 - DNA, 45 bp, Artificial Sequence
  Description of Artificial Sequence: Synthetic oligonucleotide
tgcgcgactgactaaaacattagcaactataaaagaacaaaatgg

SEQ ID NO: 102611 - DNA, 44 bp, Artificial Sequence
  Description of Artificial Sequence: Synthetic oligonucleotide
gcgcgactgactaaaacattagcaactataaaagaacaaaatgg

SEQ ID NO: 102612 - DNA, 45 bp, Artificial Sequence
  Description of Artificial Sequence: Synthetic oligonucleotide
cgcgactgactaaaacattagcaactataaaagaacaaaatggtg

SEQ ID NO: 102613 - DNA, 47 bp, Artificial Sequence
  Description of Artificial Sequence: Synthetic oligonucleotide
gcgactgactaaaacattagcaactataaaagaacaaaatggtgatg

SEQ ID NO: 102614 - DNA, 48 bp, Artificial Sequence
  Description of Artificial Sequence: Synthetic oligonucleotide
cgactgactaaaacattagcaactataaaagaacaaaatggtgatgtg

SEQ ID NO: 102615 - DNA, 51 bp, Artificial Sequence
  Description of Artificial Sequence: Synthetic oligonucleotide
gactgactaaaacattagcaactataaaagaacaaaatggtgatgtgaaag

SEQ ID NO: 102616 - DNA, 52 bp, Artificial Sequence
  Description of Artificial Sequence: Synthetic oligonucleotide
actgactaaaacattagcaactataaaagaacaaaatggtgatgtgaaagag

SEQ ID NO: 102617 - DNA, 51 bp, Artificial Sequence
  Description of Artificial Sequence: Synthetic oligonucleotide
ctgactaaaacattagcaactataaaagaacaaaatggtgatgtgaaagag

SEQ ID NO: 102618 - DNA, 51 bp, Artificial Sequence
  Description of Artificial Sequence: Synthetic oligonucleotide
tgactaaaacattagcaactataaaagaacaaaatggtgatgtgaaagagg

SEQ ID NO: 102619 - DNA, 50 bp, Artificial Sequence
  Description of Artificial Sequence: Synthetic oligonucleotide
gactaaaacattagcaactataaaagaacaaaatggtgatgtgaaagagg

SEQ ID NO: 102620 - DNA, 50 bp, Artificial Sequence
  Description of Artificial Sequence: Synthetic oligonucleotide
actaaaacattagcaactataaaagaacaaaatggtgatgtgaaagaggc

SEQ ID NO: 102621 - DNA, 49 bp, Artificial Sequence
  Description of Artificial Sequence: Synthetic oligonucleotide
ctaaaacattagcaactataaaagaacaaaatggtgatgtgaaagaggc

SEQ ID NO: 102622 - DNA, 50 bp, Artificial Sequence
  Description of Artificial Sequence: Synthetic oligonucleotide
taaaacattagcaactataaaagaacaaaatggtgatgtgaaagaggcag

SEQ ID NO: 102623 - DNA, 49 bp, Artificial Sequence
  Description of Artificial Sequence: Synthetic oligonucleotide
aaaacattagcaactataaaagaacaaaatggtgatgtgaaagaggcag

SEQ ID NO: 102624 - DNA, 48 bp, Artificial Sequence
  Description of Artificial Sequence: Synthetic oligonucleotide
aaacattagcaactataaaagaacaaaatggtgatgtgaaagaggcag

SEQ ID NO: 102625 - DNA, 47 bp, Artificial Sequence
  Description of Artificial Sequence: Synthetic oligonucleotide
aacattagcaactataaaagaacaaaatggtgatgtgaaagaggcag

SEQ ID NO: 102626 - DNA, 46 bp, Artificial Sequence
  Description of Artificial Sequence: Synthetic oligonucleotide
acattagcaactataaaagaacaaaatggtgatgtgaaagaggcag

SEQ ID NO: 102627 - DNA, 45 bp, Artificial Sequence
  Description of Artificial Sequence: Synthetic oligonucleotide
cattagcaactataaaagaacaaaatggtgatgtgaaagaggcag

SEQ ID NO: 102628 - DNA, 45 bp, Artificial Sequence
  Description of Artificial Sequence: Synthetic oligonucleotide
attagcaactataaaagaacaaaatggtgatgtgaaagaggcagc

SEQ ID NO: 102629 - DNA, 44 bp, Artificial Sequence
  Description of Artificial Sequence: Synthetic oligonucleotide
ttagcaactataaaagaacaaaatggtgatgtgaaagaggcagc

SEQ ID NO: 102630 - DNA, 43 bp, Artificial Sequence
  Description of Artificial Sequence: Synthetic oligonucleotide
tagcaactataaaagaacaaaatggtgatgtgaaagaggcagc

SEQ ID NO: 102631 - DNA, 42 bp, Artificial Sequence
  Description of Artificial Sequence: Synthetic oligonucleotide
agcaactataaaagaacaaaatggtgatgtgaaagaggcagc

SEQ ID NO: 102632 - DNA, 41 bp, Artificial Sequence
  Description of Artificial Sequence: Synthetic oligonucleotide
gcaactataaaagaacaaaatggtgatgtgaaagaggcagc

SEQ ID NO: 102633 - DNA, 41 bp, Artificial Sequence
  Description of Artificial Sequence: Synthetic oligonucleotide
caactataaaagaacaaaatggtgatgtgaaagaggcagcc

SEQ ID NO: 102634 - DNA, 42 bp, Artificial Sequence
  Description of Artificial Sequence: Synthetic oligonucleotide
aactataaaagaacaaaatggtgatgtgaaagaggcagcctc

SEQ ID NO: 102635 - DNA, 41 bp, Artificial Sequence
  Description of Artificial Sequence: Synthetic oligonucleotide
actataaaagaacaaaatggtgatgtgaaagaggcagcctc

SEQ ID NO: 102636 - DNA, 40 bp, Artificial Sequence
  Description of Artificial Sequence: Synthetic oligonucleotide
ctataaaagaacaaaatggtgatgtgaaagaggcagcctc

SEQ ID NO: 102637 - DNA, 40 bp, Artificial Sequence
  Description of Artificial Sequence: Synthetic oligonucleotide
tataaaagaacaaaatggtgatgtgaaagaggcagcctcc

SEQ ID NO: 102638 - DNA, 39 bp, Artificial Sequence
  Description of Artificial Sequence: Synthetic oligonucleotide
ataaaagaacaaaatggtgatgtgaaagaggcagcctcc

SEQ ID NO: 102639 - DNA, 38 bp, Artificial Sequence
  Description of Artificial Sequence: Synthetic oligonucleotide
taaaagaacaaaatggtgatgtgaaagaggcagcctcc

SEQ ID NO: 102640 - DNA, 37 bp, Artificial Sequence
  Description of Artificial Sequence: Synthetic oligonucleotide
aaaagaacaaaatggtgatgtgaaagaggcagcctcc

SEQ ID NO: 102641 - DNA, 36 bp, Artificial Sequence
  Description of Artificial Sequence: Synthetic oligonucleotide
aaagaacaaaatggtgatgtgaaagaggcagcctcc

SEQ ID NO: 102642 - DNA, 35 bp, Artificial Sequence
  Description of Artificial Sequence: Synthetic oligonucleotide
aagaacaaaatggtgatgtgaaagaggcagcctcc

SEQ ID NO: 102643 - DNA, 34 bp, Artificial Sequence
  Description of Artificial Sequence: Synthetic oligonucleotide
agaacaaaatggtgatgtgaaagaggcagcctcc

SEQ ID NO: 102644 - DNA, 33 bp, Artificial Sequence
  Description of Artificial Sequence: Synthetic oligonucleotide
gaacaaaatggtgatgtgaaagaggcagcctcc

SEQ ID NO: 102645 - DNA, 39 bp, Artificial Sequence
  Description of Artificial Sequence: Synthetic oligonucleotide
aacaaaatggtgatgtgaaagaggcagcctccattttac

SEQ ID NO: 102646 - DNA, 38 bp, Artificial Sequence
  Description of Artificial Sequence: Synthetic oligonucleotide
acaaaatggtgatgtgaaagaggcagcctccattttac

SEQ ID NO: 102647 - DNA, 37 bp, Artificial Sequence
  Description of Artificial Sequence: Synthetic oligonucleotide
caaaatggtgatgtgaaagaggcagcctccattttac

SEQ ID NO: 102648 - DNA, 38 bp, Artificial Sequence
  Description of Artificial Sequence: Synthetic oligonucleotide
aaaatggtgatgtgaaagaggcagcctccattttacag

SEQ ID NO: 102649 - DNA, 37 bp, Artificial Sequence
  Description of Artificial Sequence: Synthetic oligonucleotide
aaatggtgatgtgaaagaggcagcctccattttacag

SEQ ID NO: 102650 - DNA, 36 bp, Artificial Sequence
  Description of Artificial Sequence: Synthetic oligonucleotide
aatggtgatgtgaaagaggcagcctccattttacag

SEQ ID NO: 102651 - DNA, 35 bp, Artificial Sequence
  Description of Artificial Sequence: Synthetic oligonucleotide
atggtgatgtgaaagaggcagcctccattttacag

SEQ ID NO: 102652 - DNA, 34 bp, Artificial Sequence
  Description of Artificial Sequence: Synthetic oligonucleotide
tggtgatgtgaaagaggcagcctccattttacag

SEQ ID NO: 102653 - DNA, 33 bp, Artificial Sequence
  Description of Artificial Sequence: Synthetic oligonucleotide
ggtgatgtgaaagaggcagcctccattttacag

SEQ ID NO: 102654 - DNA, 33 bp, Artificial Sequence
  Description of Artificial Sequence: Synthetic oligonucleotide
gtgatgtgaaagaggcagcctccattttacagg

SEQ ID NO: 102655 - DNA, 34 bp, Artificial Sequence
  Description of Artificial Sequence: Synthetic oligonucleotide
tgatgtgaaagaggcagcctccattttacaggag

SEQ ID NO: 102656 - DNA, 33 bp, Artificial Sequence
  Description of Artificial Sequence: Synthetic oligonucleotide
gatgtgaaagaggcagcctccattttacaggag

SEQ ID NO: 102657 - DNA, 36 bp, Artificial Sequence
  Description of Artificial Sequence: Synthetic oligonucleotide
atgtgaaagaggcagcctccattttacaggagttac

SEQ ID NO: 102658 - DNA, 35 bp, Artificial Sequence
  Description of Artificial Sequence: Synthetic oligonucleotide
tgtgaaagaggcagcctccattttacaggagttac

SEQ ID NO: 102659 - DNA, 34 bp, Artificial Sequence
  Description of Artificial Sequence: Synthetic oligonucleotide
gtgaaagaggcagcctccattttacaggagttac

SEQ ID NO: 102660 - DNA, 35 bp, Artificial Sequence
  Description of Artificial Sequence: Synthetic oligonucleotide
tgaaagaggcagcctccattttacaggagttacag

SEQ ID NO: 102661 - DNA, 34 bp, Artificial Sequence
  Description of Artificial Sequence: Synthetic oligonucleotide
gaaagaggcagcctccattttacaggagttacag

SEQ ID NO: 102662 - DNA, 34 bp, Artificial Sequence
  Description of Artificial Sequence: Synthetic oligonucleotide
aaagaggcagcctccattttacaggagttacagg

SEQ ID NO: 102663 - DNA, 33 bp, Artificial Sequence
  Description of Artificial Sequence: Synthetic oligonucleotide
aagaggcagcctccattttacaggagttacagg

SEQ ID NO: 102664 - DNA, 32 bp, Artificial Sequence
  Description of Artificial Sequence: Synthetic oligonucleotide
agaggcagcctccattttacaggagttacagg

SEQ ID NO: 102665 - DNA, 31 bp, Artificial Sequence
  Description of Artificial Sequence: Synthetic oligonucleotide
gaggcagcctccattttacaggagttacagg

SEQ ID NO: 102666 - DNA, 32 bp, Artificial Sequence
  Description of Artificial Sequence: Synthetic oligonucleotide
aggcagcctccattttacaggagttacaggtg

SEQ ID NO: 102667 - DNA, 31 bp, Artificial Sequence
  Description of Artificial Sequence: Synthetic oligonucleotide
ggcagcctccattttacaggagttacaggtg

SEQ ID NO: 102668 - DNA, 31 bp, Artificial Sequence
  Description of Artificial Sequence: Synthetic oligonucleotide
gcagcctccattttacaggagttacaggtgg

SEQ ID NO: 102669 - DNA, 34 bp, Artificial Sequence
  Description of Artificial Sequence: Synthetic oligonucleotide
cagcctccattttacaggagttacaggtggaaac

SEQ ID NO: 102670 - DNA, 34 bp, Artificial Sequence
  Description of Artificial Sequence: Synthetic oligonucleotide
agcctccattttacaggagttacaggtggaaacc

SEQ ID NO: 102671 - DNA, 33 bp, Artificial Sequence
  Description of Artificial Sequence: Synthetic oligonucleotide
gcctccattttacaggagttacaggtggaaacc

SEQ ID NO: 102672 - DNA, 35 bp, Artificial Sequence
  Description of Artificial Sequence: Synthetic oligonucleotide
cctccattttacaggagttacaggtggaaacctac

SEQ ID NO: 102673 - DNA, 35 bp, Artificial Sequence
  Description of Artificial Sequence: Synthetic oligonucleotide
ctccattttacaggagttacaggtggaaacctacg

SEQ ID NO: 102674 - DNA, 35 bp, Artificial Sequence
  Description of Artificial Sequence: Synthetic oligonucleotide
tccattttacaggagttacaggtggaaacctacgg

SEQ ID NO: 102675 - DNA, 34 bp, Artificial Sequence
  Description of Artificial Sequence: Synthetic oligonucleotide
ccattttacaggagttacaggtggaaacctacgg

SEQ ID NO: 102676 - DNA, 34 bp, Artificial Sequence
  Description of Artificial Sequence: Synthetic oligonucleotide
cattttacaggagttacaggtggaaacctacggg

SEQ ID NO: 102677 - DNA, 35 bp, Artificial Sequence
  Description of Artificial Sequence: Synthetic oligonucleotide
attttacaggagttacaggtggaaacctacgggtc

SEQ ID NO: 102678 - DNA, 34 bp, Artificial Sequence
  Description of Artificial Sequence: Synthetic oligonucleotide
ttttacaggagttacaggtggaaacctacgggtc

SEQ ID NO: 102679 - DNA, 33 bp, Artificial Sequence
  Description of Artificial Sequence: Synthetic oligonucleotide
tttacaggagttacaggtggaaacctacgggtc

SEQ ID NO: 102680 - DNA, 32 bp, Artificial Sequence
  Description of Artificial Sequence: Synthetic oligonucleotide
ttacaggagttacaggtggaaacctacgggtc

SEQ ID NO: 102681 - DNA, 31 bp, Artificial Sequence
  Description of Artificial Sequence: Synthetic oligonucleotide
tacaggagttacaggtggaaacctacgggtc

SEQ ID NO: 102682 - DNA, 30 bp, Artificial Sequence
  Description of Artificial Sequence: Synthetic oligonucleotide
acaggagttacaggtggaaacctacgggtc

SEQ ID NO: 102683 - DNA, 29 bp, Artificial Sequence
  Description of Artificial Sequence: Synthetic oligonucleotide
caggagttacaggtggaaacctacgggtc

SEQ ID NO: 102684 - DNA, 32 bp, Artificial Sequence
  Description of Artificial Sequence: Synthetic oligonucleotide
aggagttacaggtggaaacctacgggtcaatg

SEQ ID NO: 102685 - DNA, 31 bp, Artificial Sequence
  Description of Artificial Sequence: Synthetic oligonucleotide
ggagttacaggtggaaacctacgggtcaatg

SEQ ID NO: 102686 - DNA, 31 bp, Artificial Sequence
  Description of Artificial Sequence: Synthetic oligonucleotide
gagttacaggtggaaacctacgggtcaatgg

SEQ ID NO: 102687 - DNA, 35 bp, Artificial Sequence
  Description of Artificial Sequence: Synthetic oligonucleotide
agttacaggtggaaacctacgggtcaatggaaaag

SEQ ID NO: 102688 - DNA, 34 bp, Artificial Sequence
  Description of Artificial Sequence: Synthetic oligonucleotide
gttacaggtggaaacctacgggtcaatggaaaag

SEQ ID NO: 102689 - DNA, 37 bp, Artificial Sequence
  Description of Artificial Sequence: Synthetic oligonucleotide
ttacaggtggaaacctacgggtcaatggaaaagaaag

SEQ ID NO: 102690 - DNA, 36 bp, Artificial Sequence
  Description of Artificial Sequence: Synthetic oligonucleotide
tacaggtggaaacctacgggtcaatggaaaagaaag

SEQ ID NO: 102691 - DNA, 35 bp, Artificial Sequence
  Description of Artificial Sequence: Synthetic oligonucleotide
acaggtggaaacctacgggtcaatggaaaagaaag

SEQ ID NO: 102692 - DNA, 34 bp, Artificial Sequence
  Description of Artificial Sequence: Synthetic oligonucleotide
caggtggaaacctacgggtcaatggaaaagaaag

SEQ ID NO: 102693 - DNA, 35 bp, Artificial Sequence
  Description of Artificial Sequence: Synthetic oligonucleotide
aggtggaaacctacgggtcaatggaaaagaaagag

SEQ ID NO: 102694 - DNA, 34 bp, Artificial Sequence
  Description of Artificial Sequence: Synthetic oligonucleotide
ggtggaaacctacgggtcaatggaaaagaaagag

SEQ ID NO: 102695 - DNA, 34 bp, Artificial Sequence
  Description of Artificial Sequence: Synthetic oligonucleotide
gtggaaacctacgggtcaatggaaaagaaagagc

SEQ ID NO: 102696 - DNA, 34 bp, Artificial Sequence
  Description of Artificial Sequence: Synthetic oligonucleotide
tggaaacctacgggtcaatggaaaagaaagagcg

SEQ ID NO: 102697 - DNA, 33 bp, Artificial Sequence
  Description of Artificial Sequence: Synthetic oligonucleotide
ggaaacctacgggtcaatggaaaagaaagagcg

SEQ ID NO: 102698 - DNA, 34 bp, Artificial Sequence
  Description of Artificial Sequence: Synthetic oligonucleotide
gaaacctacgggtcaatggaaaagaaagagcgag

SEQ ID NO: 102699 - DNA, 35 bp, Artificial Sequence
  Description of Artificial Sequence: Synthetic oligonucleotide
aaacctacgggtcaatggaaaagaaagagcgagtg

SEQ ID NO: 102700 - DNA, 34 bp, Artificial Sequence
  Description of Artificial Sequence: Synthetic oligonucleotide
aacctacgggtcaatggaaaagaaagagcgagtg

SEQ ID NO: 102701 - DNA, 33 bp, Artificial Sequence
  Description of Artificial Sequence: Synthetic oligonucleotide
acctacgggtcaatggaaaagaaagagcgagtg

SEQ ID NO: 102702 - DNA, 32 bp, Artificial Sequence
  Description of Artificial Sequence: Synthetic oligonucleotide
cctacgggtcaatggaaaagaaagagcgagtg

SEQ ID NO: 102703 - DNA, 32 bp, Artificial Sequence
  Description of Artificial Sequence: Synthetic oligonucleotide
ctacgggtcaatggaaaagaaagagcgagtgg

SEQ ID NO: 102704 - DNA, 42 bp, Artificial Sequence
  Description of Artificial Sequence: Synthetic oligonucleotide
tacgggtcaatggaaaagaaagagcgagtggaatttattttg

SEQ ID NO: 102705 - DNA, 41 bp, Artificial Sequence
  Description of Artificial Sequence: Synthetic oligonucleotide
acgggtcaatggaaaagaaagagcgagtggaatttattttg

SEQ ID NO: 102706 - DNA, 40 bp, Artificial Sequence
  Description of Artificial Sequence: Synthetic oligonucleotide
cgggtcaatggaaaagaaagagcgagtggaatttattttg

SEQ ID NO: 102707 - DNA, 40 bp, Artificial Sequence
  Description of Artificial Sequence: Synthetic oligonucleotide
gggtcaatggaaaagaaagagcgagtggaatttattttgg

SEQ ID NO: 102708 - DNA, 41 bp, Artificial Sequence
  Description of Artificial Sequence: Synthetic oligonucleotide
ggtcaatggaaaagaaagagcgagtggaatttattttggag

SEQ ID NO: 102709 - DNA, 41 bp, Artificial Sequence
  Description of Artificial Sequence: Synthetic oligonucleotide
gtcaatggaaaagaaagagcgagtggaatttattttggagc

SEQ ID NO: 102710 - DNA, 45 bp, Artificial Sequence
  Description of Artificial Sequence: Synthetic oligonucleotide
tcaatggaaaagaaagagcgagtggaatttattttggagcaaatg

SEQ ID NO: 102711 - DNA, 44 bp, Artificial Sequence
  Description of Artificial Sequence: Synthetic oligonucleotide
caatggaaaagaaagagcgagtggaatttattttggagcaaatg

SEQ ID NO: 102712 - DNA, 45 bp, Artificial Sequence
  Description of Artificial Sequence: Synthetic oligonucleotide
aatggaaaagaaagagcgagtggaatttattttggagcaaatgag

SEQ ID NO: 102713 - DNA, 44 bp, Artificial Sequence
  Description of Artificial Sequence: Synthetic oligonucleotide
atggaaaagaaagagcgagtggaatttattttggagcaaatgag

SEQ ID NO: 102714 - DNA, 43 bp, Artificial Sequence
  Description of Artificial Sequence: Synthetic oligonucleotide
tggaaaagaaagagcgagtggaatttattttggagcaaatgag

SEQ ID NO: 102715 - DNA, 42 bp, Artificial Sequence
  Description of Artificial Sequence: Synthetic oligonucleotide
ggaaaagaaagagcgagtggaatttattttggagcaaatgag

SEQ ID NO: 102716 - DNA, 42 bp, Artificial Sequence
  Description of Artificial Sequence: Synthetic oligonucleotide
gaaaagaaagagcgagtggaatttattttggagcaaatgagg

SEQ ID NO: 102717 - DNA, 42 bp, Artificial Sequence
  Description of Artificial Sequence: Synthetic oligonucleotide
aaaagaaagagcgagtggaatttattttggagcaaatgaggc

SEQ ID NO: 102718 - DNA, 41 bp, Artificial Sequence
  Description of Artificial Sequence: Synthetic oligonucleotide
aaagaaagagcgagtggaatttattttggagcaaatgaggc

SEQ ID NO: 102719 - DNA, 40 bp, Artificial Sequence
  Description of Artificial Sequence: Synthetic oligonucleotide
aagaaagagcgagtggaatttattttggagcaaatgaggc

SEQ ID NO: 102720 - DNA, 39 bp, Artificial Sequence
  Description of Artificial Sequence: Synthetic oligonucleotide
agaaagagcgagtggaatttattttggagcaaatgaggc

SEQ ID NO: 102721 - DNA, 38 bp, Artificial Sequence
  Description of Artificial Sequence: Synthetic oligonucleotide
gaaagagcgagtggaatttattttggagcaaatgaggc

SEQ ID NO: 102722 - DNA, 39 bp, Artificial Sequence
  Description of Artificial Sequence: Synthetic oligonucleotide
aaagagcgagtggaatttattttggagcaaatgaggctc

SEQ ID NO: 102723 - DNA, 38 bp, Artificial Sequence
  Description of Artificial Sequence: Synthetic oligonucleotide
aagagcgagtggaatttattttggagcaaatgaggctc

SEQ ID NO: 102724 - DNA, 37 bp, Artificial Sequence
  Description of Artificial Sequence: Synthetic oligonucleotide
agagcgagtggaatttattttggagcaaatgaggctc

SEQ ID NO: 102725 - DNA, 36 bp, Artificial Sequence
  Description of Artificial Sequence: Synthetic oligonucleotide
gagcgagtggaatttattttggagcaaatgaggctc

SEQ ID NO: 102726 - DNA, 37 bp, Artificial Sequence
  Description of Artificial Sequence: Synthetic oligonucleotide
agcgagtggaatttattttggagcaaatgaggctctg

SEQ ID NO: 102727 - DNA, 36 bp, Artificial Sequence
  Description of Artificial Sequence: Synthetic oligonucleotide
gcgagtggaatttattttggagcaaatgaggctctg

SEQ ID NO: 102728 - DNA, 36 bp, Artificial Sequence
  Description of Artificial Sequence: Synthetic oligonucleotide
cgagtggaatttattttggagcaaatgaggctctgc

SEQ ID NO: 102729 - DNA, 36 bp, Artificial Sequence
  Description of Artificial Sequence: Synthetic oligonucleotide
gagtggaatttattttggagcaaatgaggctctgcc

SEQ ID NO: 102730 - DNA, 38 bp, Artificial Sequence
  Description of Artificial Sequence: Synthetic oligonucleotide
agtggaatttattttggagcaaatgaggctctgcctag

SEQ ID NO: 102731 - DNA, 37 bp, Artificial Sequence
  Description of Artificial Sequence: Synthetic oligonucleotide
gtggaatttattttggagcaaatgaggctctgcctag

SEQ ID NO: 102732 - DNA, 37 bp, Artificial Sequence
  Description of Artificial Sequence: Synthetic oligonucleotide
tggaatttattttggagcaaatgaggctctgcctagc

SEQ ID NO: 102733 - DNA, 36 bp, Artificial Sequence
  Description of Artificial Sequence: Synthetic oligonucleotide
ggaatttattttggagcaaatgaggctctgcctagc

SEQ ID NO: 102734 - DNA, 37 bp, Artificial Sequence
  Description of Artificial Sequence: Synthetic oligonucleotide
gaatttattttggagcaaatgaggctctgcctagctg

SEQ ID NO: 102735 - DNA, 38 bp, Artificial Sequence
  Description of Artificial Sequence: Synthetic oligonucleotide
aatttattttggagcaaatgaggctctgcctagctgtg

SEQ ID NO: 102736 - DNA, 37 bp, Artificial Sequence
  Description of Artificial Sequence: Synthetic oligonucleotide
atttattttggagcaaatgaggctctgcctagctgtg

SEQ ID NO: 102737 - DNA, 36 bp, Artificial Sequence
  Description of Artificial Sequence: Synthetic oligonucleotide
tttattttggagcaaatgaggctctgcctagctgtg

SEQ ID NO: 102738 - DNA, 35 bp, Artificial Sequence
  Description of Artificial Sequence: Synthetic oligonucleotide
ttattttggagcaaatgaggctctgcctagctgtg

SEQ ID NO: 102739 - DNA, 34 bp, Artificial Sequence
  Description of Artificial Sequence: Synthetic oligonucleotide
tattttggagcaaatgaggctctgcctagctgtg

SEQ ID NO: 102740 - DNA, 33 bp, Artificial Sequence
  Description of Artificial Sequence: Synthetic oligonucleotide
attttggagcaaatgaggctctgcctagctgtg

SEQ ID NO: 102741 - DNA, 32 bp, Artificial Sequence
  Description of Artificial Sequence: Synthetic oligonucleotide
ttttggagcaaatgaggctctgcctagctgtg

SEQ ID NO: 102742 - DNA, 31 bp, Artificial Sequence
  Description of Artificial Sequence: Synthetic oligonucleotide
tttggagcaaatgaggctctgcctagctgtg

SEQ ID NO: 102743 - DNA, 30 bp, Artificial Sequence
  Description of Artificial Sequence: Synthetic oligonucleotide
ttggagcaaatgaggctctgcctagctgtg

SEQ ID NO: 102744 - DNA, 29 bp, Artificial Sequence
  Description of Artificial Sequence: Synthetic oligonucleotide
tggagcaaatgaggctctgcctagctgtg

SEQ ID NO: 102745 - DNA, 28 bp, Artificial Sequence
  Description of Artificial Sequence: Synthetic oligonucleotide
ggagcaaatgaggctctgcctagctgtg

SEQ ID NO: 102746 - DNA, 30 bp, Artificial Sequence
  Description of Artificial Sequence: Synthetic oligonucleotide
gagcaaatgaggctctgcctagctgtgaag

SEQ ID NO: 102747 - DNA, 30 bp, Artificial Sequence
  Description of Artificial Sequence: Synthetic oligonucleotide
agcaaatgaggctctgcctagctgtgaagg

SEQ ID NO: 102748 - DNA, 29 bp, Artificial Sequence
  Description of Artificial Sequence: Synthetic oligonucleotide
gcaaatgaggctctgcctagctgtgaagg

SEQ ID NO: 102749 - DNA, 33 bp, Artificial Sequence
  Description of Artificial Sequence: Synthetic oligonucleotide
caaatgaggctctgcctagctgtgaaggattac

SEQ ID NO: 102750 - DNA, 36 bp, Artificial Sequence
  Description of Artificial Sequence: Synthetic oligonucleotide
aaatgaggctctgcctagctgtgaaggattacattc

SEQ ID NO: 102751 - DNA, 35 bp, Artificial Sequence
  Description of Artificial Sequence: Synthetic oligonucleotide
aatgaggctctgcctagctgtgaaggattacattc

SEQ ID NO: 102752 - DNA, 34 bp, Artificial Sequence
  Description of Artificial Sequence: Synthetic oligonucleotide
atgaggctctgcctagctgtgaaggattacattc

SEQ ID NO: 102753 - DNA, 33 bp, Artificial Sequence
  Description of Artificial Sequence: Synthetic oligonucleotide
tgaggctctgcctagctgtgaaggattacattc

SEQ ID NO: 102754 - DNA, 32 bp, Artificial Sequence
  Description of Artificial Sequence: Synthetic oligonucleotide
gaggctctgcctagctgtgaaggattacattc

SEQ ID NO: 102755 - DNA, 32 bp, Artificial Sequence
  Description of Artificial Sequence: Synthetic oligonucleotide
aggctctgcctagctgtgaaggattacattcg

SEQ ID NO: 102756 - DNA, 31 bp, Artificial Sequence
  Description of Artificial Sequence: Synthetic oligonucleotide
ggctctgcctagctgtgaaggattacattcg

SEQ ID NO: 102757 - DNA, 33 bp, Artificial Sequence
  Description of Artificial Sequence: Synthetic oligonucleotide
gctctgcctagctgtgaaggattacattcgaac

SEQ ID NO: 102758 - DNA, 34 bp, Artificial Sequence
  Description of Artificial Sequence: Synthetic oligonucleotide
ctctgcctagctgtgaaggattacattcgaacac

SEQ ID NO: 102759 - DNA, 38 bp, Artificial Sequence
  Description of Artificial Sequence: Synthetic oligonucleotide
tctgcctagctgtgaaggattacattcgaacacaaatc

SEQ ID NO: 102760 - DNA, 37 bp, Artificial Sequence
  Description of Artificial Sequence: Synthetic oligonucleotide
ctgcctagctgtgaaggattacattcgaacacaaatc

SEQ ID NO: 102761 - DNA, 39 bp, Artificial Sequence
  Description of Artificial Sequence: Synthetic oligonucleotide
tgcctagctgtgaaggattacattcgaacacaaatcatc

SEQ ID NO: 102762 - DNA, 38 bp, Artificial Sequence
  Description of Artificial Sequence: Synthetic oligonucleotide
gcctagctgtgaaggattacattcgaacacaaatcatc

SEQ ID NO: 102763 - DNA, 39 bp, Artificial Sequence
  Description of Artificial Sequence: Synthetic oligonucleotide
cctagctgtgaaggattacattcgaacacaaatcatcag

SEQ ID NO: 102764 - DNA, 39 bp, Artificial Sequence
  Description of Artificial Sequence: Synthetic oligonucleotide
ctagctgtgaaggattacattcgaacacaaatcatcagc

SEQ ID NO: 102765 - DNA, 41 bp, Artificial Sequence
  Description of Artificial Sequence: Synthetic oligonucleotide
tagctgtgaaggattacattcgaacacaaatcatcagcaag

SEQ ID NO: 102766 - DNA, 40 bp, Artificial Sequence
  Description of Artificial Sequence: Synthetic oligonucleotide
agctgtgaaggattacattcgaacacaaatcatcagcaag

SEQ ID NO: 102767 - DNA, 39 bp, Artificial Sequence
  Description of Artificial Sequence: Synthetic oligonucleotide
gctgtgaaggattacattcgaacacaaatcatcagcaag

SEQ ID NO: 102768 - DNA, 47 bp, Artificial Sequence
  Description of Artificial Sequence: Synthetic oligonucleotide
ctgtgaaggattacattcgaacacaaatcatcagcaagaaaattaac

SEQ ID NO: 102769 - DNA, 48 bp, Artificial Sequence
  Description of Artificial Sequence: Synthetic oligonucleotide
tgtgaaggattacattcgaacacaaatcatcagcaagaaaattaacac

SEQ ID NO: 102770 - DNA, 47 bp, Artificial Sequence
  Description of Artificial Sequence: Synthetic oligonucleotide
gtgaaggattacattcgaacacaaatcatcagcaagaaaattaacac

SEQ ID NO: 102771 - DNA, 47 bp, Artificial Sequence
  Description of Artificial Sequence: Synthetic oligonucleotide
tgaaggattacattcgaacacaaatcatcagcaagaaaattaacacc

SEQ ID NO: 102772 - DNA, 46 bp, Artificial Sequence
  Description of Artificial Sequence: Synthetic oligonucleotide
gaaggattacattcgaacacaaatcatcagcaagaaaattaacacc

SEQ ID NO: 102773 - DNA, 54 bp, Artificial Sequence
  Description of Artificial Sequence: Synthetic oligonucleotide
aaggattacattcgaacacaaatcatcagcaagaaaattaacaccaaatttttc

SEQ ID NO: 102774 - DNA, 53 bp, Artificial Sequence
  Description of Artificial Sequence: Synthetic oligonucleotide
aggattacattcgaacacaaatcatcagcaagaaaattaacaccaaatttttc

SEQ ID NO: 102775 - DNA, 52 bp, Artificial Sequence
  Description of Artificial Sequence: Synthetic oligonucleotide
ggattacattcgaacacaaatcatcagcaagaaaattaacaccaaatttttc

SEQ ID NO: 102776 - DNA, 52 bp, Artificial Sequence
  Description of Artificial Sequence: Synthetic oligonucleotide
gattacattcgaacacaaatcatcagcaagaaaattaacaccaaatttttcc

SEQ ID NO: 102777 - DNA, 53 bp, Artificial Sequence
  Description of Artificial Sequence: Synthetic oligonucleotide
attacattcgaacacaaatcatcagcaagaaaattaacaccaaatttttccag

SEQ ID NO: 102778 - DNA, 52 bp, Artificial Sequence
  Description of Artificial Sequence: Synthetic oligonucleotide
ttacattcgaacacaaatcatcagcaagaaaattaacaccaaatttttccag

SEQ ID NO: 102779 - DNA, 51 bp, Artificial Sequence
  Description of Artificial Sequence: Synthetic oligonucleotide
tacattcgaacacaaatcatcagcaagaaaattaacaccaaatttttccag

SEQ ID NO: 102780 - DNA, 50 bp, Artificial Sequence
  Description of Artificial Sequence: Synthetic oligonucleotide
acattcgaacacaaatcatcagcaagaaaattaacaccaaatttttccag

SEQ ID NO: 102781 - DNA, 49 bp, Artificial Sequence
  Description of Artificial Sequence: Synthetic oligonucleotide
cattcgaacacaaatcatcagcaagaaaattaacaccaaatttttccag

SEQ ID NO: 102782 - DNA, 49 bp, Artificial Sequence
  Description of Artificial Sequence: Synthetic oligonucleotide
attcgaacacaaatcatcagcaagaaaattaacaccaaatttttccagg

SEQ ID NO: 102783 - DNA, 48 bp, Artificial Sequence
  Description of Artificial Sequence: Synthetic oligonucleotide
ttcgaacacaaatcatcagcaagaaaattaacaccaaatttttccagg

SEQ ID NO: 102784 - DNA, 47 bp, Artificial Sequence
  Description of Artificial Sequence: Synthetic oligonucleotide
tcgaacacaaatcatcagcaagaaaattaacaccaaatttttccagg

SEQ ID NO: 102785 - DNA, 46 bp, Artificial Sequence
  Description of Artificial Sequence: Synthetic oligonucleotide
cgaacacaaatcatcagcaagaaaattaacaccaaatttttccagg

SEQ ID NO: 102786 - DNA, 48 bp, Artificial Sequence
  Description of Artificial Sequence: Synthetic oligonucleotide
gaacacaaatcatcagcaagaaaattaacaccaaatttttccaggaag

SEQ ID NO: 102787 - DNA, 54 bp, Artificial Sequence
  Description of Artificial Sequence: Synthetic oligonucleotide
aacacaaatcatcagcaagaaaattaacaccaaatttttccaggaagaaaatac

SEQ ID NO: 102788 - DNA, 53 bp, Artificial Sequence
  Description of Artificial Sequence: Synthetic oligonucleotide
acacaaatcatcagcaagaaaattaacaccaaatttttccaggaagaaaatac

SEQ ID NO: 102789 - DNA, 52 bp, Artificial Sequence
  Description of Artificial Sequence: Synthetic oligonucleotide
cacaaatcatcagcaagaaaattaacaccaaatttttccaggaagaaaatac

SEQ ID NO: 102790 - DNA, 53 bp, Artificial Sequence
  Description of Artificial Sequence: Synthetic oligonucleotide
acaaatcatcagcaagaaaattaacaccaaatttttccaggaagaaaatacag

SEQ ID NO: 102791 - DNA, 52 bp, Artificial Sequence
  Description of Artificial Sequence: Synthetic oligonucleotide
caaatcatcagcaagaaaattaacaccaaatttttccaggaagaaaatacag

SEQ ID NO: 102792 - DNA, 53 bp, Artificial Sequence
  Description of Artificial Sequence: Synthetic oligonucleotide
aaatcatcagcaagaaaattaacaccaaatttttccaggaagaaaatacagag

SEQ ID NO: 102793 - DNA, 52 bp, Artificial Sequence
  Description of Artificial Sequence: Synthetic oligonucleotide
aatcatcagcaagaaaattaacaccaaatttttccaggaagaaaatacagag

SEQ ID NO: 102794 - DNA, 51 bp, Artificial Sequence
  Description of Artificial Sequence: Synthetic oligonucleotide
atcatcagcaagaaaattaacaccaaatttttccaggaagaaaatacagag

SEQ ID NO: 102795 - DNA, 50 bp, Artificial Sequence
  Description of Artificial Sequence: Synthetic oligonucleotide
tcatcagcaagaaaattaacaccaaatttttccaggaagaaaatacagag

SEQ ID NO: 102796 - DNA, 49 bp, Artificial Sequence
  Description of Artificial Sequence: Synthetic oligonucleotide
catcagcaagaaaattaacaccaaatttttccaggaagaaaatacagag

SEQ ID NO: 102797 - DNA, 57 bp, Artificial Sequence
  Description of Artificial Sequence: Synthetic oligonucleotide
atcagcaagaaaattaacaccaaatttttccaggaagaaaatacagagaaattaaag

SEQ ID NO: 102798 - DNA, 56 bp, Artificial Sequence
  Description of Artificial Sequence: Synthetic oligonucleotide
tcagcaagaaaattaacaccaaatttttccaggaagaaaatacagagaaattaaag

SEQ ID NO: 102799 - DNA, 55 bp, Artificial Sequence
  Description of Artificial Sequence: Synthetic oligonucleotide
cagcaagaaaattaacaccaaatttttccaggaagaaaatacagagaaattaaag

SEQ ID NO: 102800 - DNA, 57 bp, Artificial Sequence
  Description of Artificial Sequence: Synthetic oligonucleotide
agcaagaaaattaacaccaaatttttccaggaagaaaatacagagaaattaaagttg

SEQ ID NO: 102801 - DNA, 56 bp, Artificial Sequence
  Description of Artificial Sequence: Synthetic oligonucleotide
gcaagaaaattaacaccaaatttttccaggaagaaaatacagagaaattaaagttg

SEQ ID NO: 102802 - DNA, 58 bp, Artificial Sequence
  Description of Artificial Sequence: Synthetic oligonucleotide
caagaaaattaacaccaaatttttccaggaagaaaatacagagaaattaaagttgaag

SEQ ID NO: 102803 - DNA, 60 bp, Artificial Sequence
  Description of Artificial Sequence: Synthetic oligonucleotide
aagaaaattaacaccaaatttttccaggaagaaaatacagagaaattaaagttgaagtac

SEQ ID NO: 102804 - DNA, 59 bp, Artificial Sequence
  Description of Artificial Sequence: Synthetic oligonucleotide
agaaaattaacaccaaatttttccaggaagaaaatacagagaaattaaagttgaagtac

SEQ ID NO: 102805 - DNA, 58 bp, Artificial Sequence
  Description of Artificial Sequence: Synthetic oligonucleotide
gaaaattaacaccaaatttttccaggaagaaaatacagagaaattaaagttgaagtac

SEQ ID NO: 102806 - DNA, 60 bp, Artificial Sequence
  Description of Artificial Sequence: Synthetic oligonucleotide
aaaattaacaccaaatttttccaggaagaaaatacagagaaattaaagttgaagtactat

SEQ ID NO: 102807 - DNA, 60 bp, Artificial Sequence
  Description of Artificial Sequence: Synthetic oligonucleotide
aaattaacaccaaatttttccaggaagaaaatacagagaaattaaagttgaagtactata

SEQ ID NO: 102808 - DNA, 60 bp, Artificial Sequence
  Description of Artificial Sequence: Synthetic oligonucleotide
aattaacaccaaatttttccaggaagaaaatacagagaaattaaagttgaagtactataa

SEQ ID NO: 102809 - DNA, 60 bp, Artificial Sequence
  Description of Artificial Sequence: Synthetic oligonucleotide
attaacaccaaatttttccaggaagaaaatacagagaaattaaagttgaagtactataat

SEQ ID NO: 102810 - DNA, 60 bp, Artificial Sequence
  Description of Artificial Sequence: Synthetic oligonucleotide
ttaacaccaaatttttccaggaagaaaatacagagaaattaaagttgaagtactataatt

SEQ ID NO: 102811 - DNA, 60 bp, Artificial Sequence
  Description of Artificial Sequence: Synthetic oligonucleotide
taacaccaaatttttccaggaagaaaatacagagaaattaaagttgaagtactataattt

SEQ ID NO: 102812 - DNA, 60 bp, Artificial Sequence
  Description of Artificial Sequence: Synthetic oligonucleotide
aacaccaaatttttccaggaagaaaatacagagaaattaaagttgaagtactataattta

SEQ ID NO: 102813 - DNA, 60 bp, Artificial Sequence
  Description of Artificial Sequence: Synthetic oligonucleotide
acaccaaatttttccaggaagaaaatacagagaaattaaagttgaagtactataatttaa

SEQ ID NO: 102814 - DNA, 60 bp, Artificial Sequence
  Description of Artificial Sequence: Synthetic oligonucleotide
caccaaatttttccaggaagaaaatacagagaaattaaagttgaagtactataatttaat

SEQ ID NO: 102815 - DNA, 60 bp, Artificial Sequence
  Description of Artificial Sequence: Synthetic oligonucleotide
accaaatttttccaggaagaaaatacagagaaattaaagttgaagtactataatttaatg

SEQ ID NO: 102816 - DNA, 60 bp, Artificial Sequence
  Description of Artificial Sequence: Synthetic oligonucleotide
ccaaatttttccaggaagaaaatacagagaaattaaagttgaagtactataatttaatga

SEQ ID NO: 102817 - DNA, 60 bp, Artificial Sequence
  Description of Artificial Sequence: Synthetic oligonucleotide
caaatttttccaggaagaaaatacagagaaattaaagttgaagtactataatttaatgat

SEQ ID NO: 102818 - DNA, 60 bp, Artificial Sequence
  Description of Artificial Sequence: Synthetic oligonucleotide
aaatttttccaggaagaaaatacagagaaattaaagttgaagtactataatttaatgatt

SEQ ID NO: 102819 - DNA, 60 bp, Artificial Sequence
  Description of Artificial Sequence: Synthetic oligonucleotide
aatttttccaggaagaaaatacagagaaattaaagttgaagtactataatttaatgattc

SEQ ID NO: 102820 - DNA, 60 bp, Artificial Sequence
  Description of Artificial Sequence: Synthetic oligonucleotide
atttttccaggaagaaaatacagagaaattaaagttgaagtactataatttaatgattca

SEQ ID NO: 102821 - DNA, 60 bp, Artificial Sequence
  Description of Artificial Sequence: Synthetic oligonucleotide
tttttccaggaagaaaatacagagaaattaaagttgaagtactataatttaatgattcag

SEQ ID NO: 102822 - DNA, 60 bp, Artificial Sequence
  Description of Artificial Sequence: Synthetic oligonucleotide
ttttccaggaagaaaatacagagaaattaaagttgaagtactataatttaatgattcagc

SEQ ID NO: 102823 - DNA, 59 bp, Artificial Sequence
  Description of Artificial Sequence: Synthetic oligonucleotide
tttccaggaagaaaatacagagaaattaaagttgaagtactataatttaatgattcagc

SEQ ID NO: 102824 - DNA, 58 bp, Artificial Sequence
  Description of Artificial Sequence: Synthetic oligonucleotide
ttccaggaagaaaatacagagaaattaaagttgaagtactataatttaatgattcagc

SEQ ID NO: 102825 - DNA, 57 bp, Artificial Sequence
  Description of Artificial Sequence: Synthetic oligonucleotide
tccaggaagaaaatacagagaaattaaagttgaagtactataatttaatgattcagc

SEQ ID NO: 102826 - DNA, 56 bp, Artificial Sequence
  Description of Artificial Sequence: Synthetic oligonucleotide
ccaggaagaaaatacagagaaattaaagttgaagtactataatttaatgattcagc

SEQ ID NO: 102827 - DNA, 57 bp, Artificial Sequence
  Description of Artificial Sequence: Synthetic oligonucleotide
caggaagaaaatacagagaaattaaagttgaagtactataatttaatgattcagctg

SEQ ID NO: 102828 - DNA, 57 bp, Artificial Sequence
  Description of Artificial Sequence: Synthetic oligonucleotide
aggaagaaaatacagagaaattaaagttgaagtactataatttaatgattcagctgg

SEQ ID NO: 102829 - DNA, 56 bp, Artificial Sequence
  Description of Artificial Sequence: Synthetic oligonucleotide
ggaagaaaatacagagaaattaaagttgaagtactataatttaatgattcagctgg

SEQ ID NO: 102830 - DNA, 58 bp, Artificial Sequence
  Description of Artificial Sequence: Synthetic oligonucleotide
gaagaaaatacagagaaattaaagttgaagtactataatttaatgattcagctggatc

SEQ ID NO: 102831 - DNA, 60 bp, Artificial Sequence
  Description of Artificial Sequence: Synthetic oligonucleotide
aagaaaatacagagaaattaaagttgaagtactataatttaatgattcagctggatcaac

SEQ ID NO: 102832 - DNA, 59 bp, Artificial Sequence
  Description of Artificial Sequence: Synthetic oligonucleotide
agaaaatacagagaaattaaagttgaagtactataatttaatgattcagctggatcaac

SEQ ID NO: 102833 - DNA, 58 bp, Artificial Sequence
  Description of Artificial Sequence: Synthetic oligonucleotide
gaaaatacagagaaattaaagttgaagtactataatttaatgattcagctggatcaac

SEQ ID NO: 102834 - DNA, 60 bp, Artificial Sequence
  Description of Artificial Sequence: Synthetic oligonucleotide
aaaatacagagaaattaaagttgaagtactataatttaatgattcagctggatcaacatg

SEQ ID NO: 102835 - DNA, 59 bp, Artificial Sequence
  Description of Artificial Sequence: Synthetic oligonucleotide
aaatacagagaaattaaagttgaagtactataatttaatgattcagctggatcaacatg

SEQ ID NO: 102836 - DNA, 58 bp, Artificial Sequence
  Description of Artificial Sequence: Synthetic oligonucleotide
aatacagagaaattaaagttgaagtactataatttaatgattcagctggatcaacatg

SEQ ID NO: 102837 - DNA, 57 bp, Artificial Sequence
  Description of Artificial Sequence: Synthetic oligonucleotide
atacagagaaattaaagttgaagtactataatttaatgattcagctggatcaacatg

SEQ ID NO: 102838 - DNA, 56 bp, Artificial Sequence
  Description of Artificial Sequence: Synthetic oligonucleotide
tacagagaaattaaagttgaagtactataatttaatgattcagctggatcaacatg

SEQ ID NO: 102839 - DNA, 55 bp, Artificial Sequence
  Description of Artificial Sequence: Synthetic oligonucleotide
acagagaaattaaagttgaagtactataatttaatgattcagctggatcaacatg

SEQ ID NO: 102840 - DNA, 54 bp, Artificial Sequence
  Description of Artificial Sequence: Synthetic oligonucleotide
cagagaaattaaagttgaagtactataatttaatgattcagctggatcaacatg

SEQ ID NO: 102841 - DNA, 55 bp, Artificial Sequence
  Description of Artificial Sequence: Synthetic oligonucleotide
agagaaattaaagttgaagtactataatttaatgattcagctggatcaacatgag

SEQ ID NO: 102842 - DNA, 54 bp, Artificial Sequence
  Description of Artificial Sequence: Synthetic oligonucleotide
gagaaattaaagttgaagtactataatttaatgattcagctggatcaacatgag

SEQ ID NO: 102843 - DNA, 54 bp, Artificial Sequence
  Description of Artificial Sequence: Synthetic oligonucleotide
agaaattaaagttgaagtactataatttaatgattcagctggatcaacatgagg

SEQ ID NO: 102844 - DNA, 53 bp, Artificial Sequence
  Description of Artificial Sequence: Synthetic oligonucleotide
gaaattaaagttgaagtactataatttaatgattcagctggatcaacatgagg

SEQ ID NO: 102845 - DNA, 53 bp, Artificial Sequence
  Description of Artificial Sequence: Synthetic oligonucleotide
aaattaaagttgaagtactataatttaatgattcagctggatcaacatgaggg

SEQ ID NO: 102846 - DNA, 52 bp, Artificial Sequence
  Description of Artificial Sequence: Synthetic oligonucleotide
aattaaagttgaagtactataatttaatgattcagctggatcaacatgaggg

SEQ ID NO: 102847 - DNA, 51 bp, Artificial Sequence
  Description of Artificial Sequence: Synthetic oligonucleotide
attaaagttgaagtactataatttaatgattcagctggatcaacatgaggg

SEQ ID NO: 102848 - DNA, 50 bp, Artificial Sequence
  Description of Artificial Sequence: Synthetic oligonucleotide
ttaaagttgaagtactataatttaatgattcagctggatcaacatgaggg

SEQ ID NO: 102849 - DNA, 49 bp, Artificial Sequence
  Description of Artificial Sequence: Synthetic oligonucleotide
taaagttgaagtactataatttaatgattcagctggatcaacatgaggg

SEQ ID NO: 102850 - DNA, 48 bp, Artificial Sequence
  Description of Artificial Sequence: Synthetic oligonucleotide
aaagttgaagtactataatttaatgattcagctggatcaacatgaggg

SEQ ID NO: 102851 - DNA, 47 bp, Artificial Sequence
  Description of Artificial Sequence: Synthetic oligonucleotide
aagttgaagtactataatttaatgattcagctggatcaacatgaggg

SEQ ID NO: 102852 - DNA, 46 bp, Artificial Sequence
  Description of Artificial Sequence: Synthetic oligonucleotide
agttgaagtactataatttaatgattcagctggatcaacatgaggg

SEQ ID NO: 102853 - DNA, 45 bp, Artificial Sequence
  Description of Artificial Sequence: Synthetic oligonucleotide
gttgaagtactataatttaatgattcagctggatcaacatgaggg

SEQ ID NO: 102854 - DNA, 47 bp, Artificial Sequence
  Description of Artificial Sequence: Synthetic oligonucleotide
ttgaagtactataatttaatgattcagctggatcaacatgagggatc

SEQ ID NO: 102855 - DNA, 46 bp, Artificial Sequence
  Description of Artificial Sequence: Synthetic oligonucleotide
tgaagtactataatttaatgattcagctggatcaacatgagggatc

SEQ ID NO: 102856 - DNA, 45 bp, Artificial Sequence
  Description of Artificial Sequence: Synthetic oligonucleotide
gaagtactataatttaatgattcagctggatcaacatgagggatc

SEQ ID NO: 102857 - DNA, 45 bp, Artificial Sequence
  Description of Artificial Sequence: Synthetic oligonucleotide
aagtactataatttaatgattcagctggatcaacatgagggatcc

SEQ ID NO: 102858 - DNA, 44 bp, Artificial Sequence
  Description of Artificial Sequence: Synthetic oligonucleotide
agtactataatttaatgattcagctggatcaacatgagggatcc

SEQ ID NO: 102859 - DNA, 43 bp, Artificial Sequence
  Description of Artificial Sequence: Synthetic oligonucleotide
gtactataatttaatgattcagctggatcaacatgagggatcc

SEQ ID NO: 102860 - DNA, 48 bp, Artificial Sequence
  Description of Artificial Sequence: Synthetic oligonucleotide
tactataatttaatgattcagctggatcaacatgagggatcctatttg

SEQ ID NO: 102861 - DNA, 47 bp, Artificial Sequence
  Description of Artificial Sequence: Synthetic oligonucleotide
actataatttaatgattcagctggatcaacatgagggatcctatttg

SEQ ID NO: 102862 - DNA, 46 bp, Artificial Sequence
  Description of Artificial Sequence: Synthetic oligonucleotide
ctataatttaatgattcagctggatcaacatgagggatcctatttg

SEQ ID NO: 102863 - DNA, 47 bp, Artificial Sequence
  Description of Artificial Sequence: Synthetic oligonucleotide
tataatttaatgattcagctggatcaacatgagggatcctatttgtc

SEQ ID NO: 102864 - DNA, 46 bp, Artificial Sequence
  Description of Artificial Sequence: Synthetic oligonucleotide
ataatttaatgattcagctggatcaacatgagggatcctatttgtc

SEQ ID NO: 102865 - DNA, 45 bp, Artificial Sequence
  Description of Artificial Sequence: Synthetic oligonucleotide
taatttaatgattcagctggatcaacatgagggatcctatttgtc

SEQ ID NO: 102866 - DNA, 44 bp, Artificial Sequence
  Description of Artificial Sequence: Synthetic oligonucleotide
aatttaatgattcagctggatcaacatgagggatcctatttgtc

SEQ ID NO: 102867 - DNA, 43 bp, Artificial Sequence
  Description of Artificial Sequence: Synthetic oligonucleotide
atttaatgattcagctggatcaacatgagggatcctatttgtc

SEQ ID NO: 102868 - DNA, 42 bp, Artificial Sequence
  Description of Artificial Sequence: Synthetic oligonucleotide
tttaatgattcagctggatcaacatgagggatcctatttgtc

SEQ ID NO: 102869 - DNA, 41 bp, Artificial Sequence
  Description of Artificial Sequence: Synthetic oligonucleotide
ttaatgattcagctggatcaacatgagggatcctatttgtc

SEQ ID NO: 102870 - DNA, 40 bp, Artificial Sequence
  Description of Artificial Sequence: Synthetic oligonucleotide
taatgattcagctggatcaacatgagggatcctatttgtc

SEQ ID NO: 102871 - DNA, 39 bp, Artificial Sequence
  Description of Artificial Sequence: Synthetic oligonucleotide
aatgattcagctggatcaacatgagggatcctatttgtc

SEQ ID NO: 102872 - DNA, 38 bp, Artificial Sequence
  Description of Artificial Sequence: Synthetic oligonucleotide
atgattcagctggatcaacatgagggatcctatttgtc

SEQ ID NO: 102873 - DNA, 37 bp, Artificial Sequence
  Description of Artificial Sequence: Synthetic oligonucleotide
tgattcagctggatcaacatgagggatcctatttgtc

SEQ ID NO: 102874 - DNA, 36 bp, Artificial Sequence
  Description of Artificial Sequence: Synthetic oligonucleotide
gattcagctggatcaacatgagggatcctatttgtc

SEQ ID NO: 102875 - DNA, 41 bp, Artificial Sequence
  Description of Artificial Sequence: Synthetic oligonucleotide
attcagctggatcaacatgagggatcctatttgtctatttg

SEQ ID NO: 102876 - DNA, 40 bp, Artificial Sequence
  Description of Artificial Sequence: Synthetic oligonucleotide
ttcagctggatcaacatgagggatcctatttgtctatttg

SEQ ID NO: 102877 - DNA, 39 bp, Artificial Sequence
  Description of Artificial Sequence: Synthetic oligonucleotide
tcagctggatcaacatgagggatcctatttgtctatttg

SEQ ID NO: 102878 - DNA, 38 bp, Artificial Sequence
  Description of Artificial Sequence: Synthetic oligonucleotide
cagctggatcaacatgagggatcctatttgtctatttg

SEQ ID NO: 102879 - DNA, 41 bp, Artificial Sequence
  Description of Artificial Sequence: Synthetic oligonucleotide
agctggatcaacatgagggatcctatttgtctatttgtaag

SEQ ID NO: 102880 - DNA, 40 bp, Artificial Sequence
  Description of Artificial Sequence: Synthetic oligonucleotide
gctggatcaacatgagggatcctatttgtctatttgtaag

SEQ ID NO: 102881 - DNA, 40 bp, Artificial Sequence
  Description of Artificial Sequence: Synthetic oligonucleotide
ctggatcaacatgagggatcctatttgtctatttgtaagc

SEQ ID NO: 102882 - DNA, 41 bp, Artificial Sequence
  Description of Artificial Sequence: Synthetic oligonucleotide
tggatcaacatgagggatcctatttgtctatttgtaagcac

SEQ ID NO: 102883 - DNA, 40 bp, Artificial Sequence
  Description of Artificial Sequence: Synthetic oligonucleotide
ggatcaacatgagggatcctatttgtctatttgtaagcac

SEQ ID NO: 102884 - DNA, 42 bp, Artificial Sequence
  Description of Artificial Sequence: Synthetic oligonucleotide
gatcaacatgagggatcctatttgtctatttgtaagcactac

SEQ ID NO: 102885 - DNA, 43 bp, Artificial Sequence
  Description of Artificial Sequence: Synthetic oligonucleotide
atcaacatgagggatcctatttgtctatttgtaagcactacag

SEQ ID NO: 102886 - DNA, 42 bp, Artificial Sequence
  Description of Artificial Sequence: Synthetic oligonucleotide
tcaacatgagggatcctatttgtctatttgtaagcactacag

SEQ ID NO: 102887 - DNA, 41 bp, Artificial Sequence
  Description of Artificial Sequence: Synthetic oligonucleotide
caacatgagggatcctatttgtctatttgtaagcactacag

SEQ ID NO: 102888 - DNA, 42 bp, Artificial Sequence
  Description of Artificial Sequence: Synthetic oligonucleotide
aacatgagggatcctatttgtctatttgtaagcactacagag

SEQ ID NO: 102889 - DNA, 41 bp, Artificial Sequence
  Description of Artificial Sequence: Synthetic oligonucleotide
acatgagggatcctatttgtctatttgtaagcactacagag

SEQ ID NO: 102890 - DNA, 40 bp, Artificial Sequence
  Description of Artificial Sequence: Synthetic oligonucleotide
catgagggatcctatttgtctatttgtaagcactacagag

SEQ ID NO: 102891 - DNA, 40 bp, Artificial Sequence
  Description of Artificial Sequence: Synthetic oligonucleotide
atgagggatcctatttgtctatttgtaagcactacagagc

SEQ ID NO: 102892 - DNA, 39 bp, Artificial Sequence
  Description of Artificial Sequence: Synthetic oligonucleotide
tgagggatcctatttgtctatttgtaagcactacagagc

SEQ ID NO: 102893 - DNA, 38 bp, Artificial Sequence
  Description of Artificial Sequence: Synthetic oligonucleotide
gagggatcctatttgtctatttgtaagcactacagagc

SEQ ID NO: 102894 - DNA, 45 bp, Artificial Sequence
  Description of Artificial Sequence: Synthetic oligonucleotide
agggatcctatttgtctatttgtaagcactacagagcaatatatg

SEQ ID NO: 102895 - DNA, 44 bp, Artificial Sequence
  Description of Artificial Sequence: Synthetic oligonucleotide
gggatcctatttgtctatttgtaagcactacagagcaatatatg

SEQ ID NO: 102896 - DNA, 47 bp, Artificial Sequence
  Description of Artificial Sequence: Synthetic oligonucleotide
ggatcctatttgtctatttgtaagcactacagagcaatatatgatac

SEQ ID NO: 102897 - DNA, 48 bp, Artificial Sequence
  Description of Artificial Sequence: Synthetic oligonucleotide
gatcctatttgtctatttgtaagcactacagagcaatatatgatactc

SEQ ID NO: 102898 - DNA, 48 bp, Artificial Sequence
  Description of Artificial Sequence: Synthetic oligonucleotide
atcctatttgtctatttgtaagcactacagagcaatatatgatactcc

SEQ ID NO: 102899 - DNA, 47 bp, Artificial Sequence
  Description of Artificial Sequence: Synthetic oligonucleotide
tcctatttgtctatttgtaagcactacagagcaatatatgatactcc

SEQ ID NO: 102900 - DNA, 46 bp, Artificial Sequence
  Description of Artificial Sequence: Synthetic oligonucleotide
cctatttgtctatttgtaagcactacagagcaatatatgatactcc

SEQ ID NO: 102901 - DNA, 46 bp, Artificial Sequence
  Description of Artificial Sequence: Synthetic oligonucleotide
ctatttgtctatttgtaagcactacagagcaatatatgatactccc

SEQ ID NO: 102902 - DNA, 47 bp, Artificial Sequence
  Description of Artificial Sequence: Synthetic oligonucleotide
tatttgtctatttgtaagcactacagagcaatatatgatactccctg

SEQ ID NO: 102903 - DNA, 46 bp, Artificial Sequence
  Description of Artificial Sequence: Synthetic oligonucleotide
atttgtctatttgtaagcactacagagcaatatatgatactccctg

SEQ ID NO: 102904 - DNA, 45 bp, Artificial Sequence
  Description of Artificial Sequence: Synthetic oligonucleotide
tttgtctatttgtaagcactacagagcaatatatgatactccctg

SEQ ID NO: 102905 - DNA, 44 bp, Artificial Sequence
  Description of Artificial Sequence: Synthetic oligonucleotide
ttgtctatttgtaagcactacagagcaatatatgatactccctg

SEQ ID NO: 102906 - DNA, 43 bp, Artificial Sequence
  Description of Artificial Sequence: Synthetic oligonucleotide
tgtctatttgtaagcactacagagcaatatatgatactccctg

SEQ ID NO: 102907 - DNA, 42 bp, Artificial Sequence
  Description of Artificial Sequence: Synthetic oligonucleotide
gtctatttgtaagcactacagagcaatatatgatactccctg

SEQ ID NO: 102908 - DNA, 46 bp, Artificial Sequence
  Description of Artificial Sequence: Synthetic oligonucleotide
tctatttgtaagcactacagagcaatatatgatactccctgtatac

SEQ ID NO: 102909 - DNA, 45 bp, Artificial Sequence
  Description of Artificial Sequence: Synthetic oligonucleotide
ctatttgtaagcactacagagcaatatatgatactccctgtatac

SEQ ID NO: 102910 - DNA, 46 bp, Artificial Sequence
  Description of Artificial Sequence: Synthetic oligonucleotide
tatttgtaagcactacagagcaatatatgatactccctgtatacag

SEQ ID NO: 102911 - DNA, 45 bp, Artificial Sequence
  Description of Artificial Sequence: Synthetic oligonucleotide
atttgtaagcactacagagcaatatatgatactccctgtatacag

SEQ ID NO: 102912 - DNA, 44 bp, Artificial Sequence
  Description of Artificial Sequence: Synthetic oligonucleotide
tttgtaagcactacagagcaatatatgatactccctgtatacag

SEQ ID NO: 102913 - DNA, 43 bp, Artificial Sequence
  Description of Artificial Sequence: Synthetic oligonucleotide
ttgtaagcactacagagcaatatatgatactccctgtatacag

SEQ ID NO: 102914 - DNA, 42 bp, Artificial Sequence
  Description of Artificial Sequence: Synthetic oligonucleotide
tgtaagcactacagagcaatatatgatactccctgtatacag

SEQ ID NO: 102915 - DNA, 41 bp, Artificial Sequence
  Description of Artificial Sequence: Synthetic oligonucleotide
gtaagcactacagagcaatatatgatactccctgtatacag

SEQ ID NO: 102916 - DNA, 41 bp, Artificial Sequence
  Description of Artificial Sequence: Synthetic oligonucleotide
taagcactacagagcaatatatgatactccctgtatacagg

SEQ ID NO: 102917 - DNA, 40 bp, Artificial Sequence
  Description of Artificial Sequence: Synthetic oligonucleotide
aagcactacagagcaatatatgatactccctgtatacagg

SEQ ID NO: 102918 - DNA, 39 bp, Artificial Sequence
  Description of Artificial Sequence: Synthetic oligonucleotide
agcactacagagcaatatatgatactccctgtatacagg

SEQ ID NO: 102919 - DNA, 38 bp, Artificial Sequence
  Description of Artificial Sequence: Synthetic oligonucleotide
gcactacagagcaatatatgatactccctgtatacagg

SEQ ID NO: 102920 - DNA, 38 bp, Artificial Sequence
  Description of Artificial Sequence: Synthetic oligonucleotide
cactacagagcaatatatgatactccctgtatacaggc

SEQ ID NO: 102921 - DNA, 39 bp, Artificial Sequence
  Description of Artificial Sequence: Synthetic oligonucleotide
actacagagcaatatatgatactccctgtatacaggcag

SEQ ID NO: 102922 - DNA, 38 bp, Artificial Sequence
  Description of Artificial Sequence: Synthetic oligonucleotide
ctacagagcaatatatgatactccctgtatacaggcag

SEQ ID NO: 102923 - DNA, 41 bp, Artificial Sequence
  Description of Artificial Sequence: Synthetic oligonucleotide
tacagagcaatatatgatactccctgtatacaggcagaaag

SEQ ID NO: 102924 - DNA, 40 bp, Artificial Sequence
  Description of Artificial Sequence: Synthetic oligonucleotide
acagagcaatatatgatactccctgtatacaggcagaaag

SEQ ID NO: 102925 - DNA, 39 bp, Artificial Sequence
  Description of Artificial Sequence: Synthetic oligonucleotide
cagagcaatatatgatactccctgtatacaggcagaaag

SEQ ID NO: 102926 - DNA, 40 bp, Artificial Sequence
  Description of Artificial Sequence: Synthetic oligonucleotide
agagcaatatatgatactccctgtatacaggcagaaagtg

SEQ ID NO: 102927 - DNA, 39 bp, Artificial Sequence
  Description of Artificial Sequence: Synthetic oligonucleotide
gagcaatatatgatactccctgtatacaggcagaaagtg

SEQ ID NO: 102928 - DNA, 45 bp, Artificial Sequence
  Description of Artificial Sequence: Synthetic oligonucleotide
agcaatatatgatactccctgtatacaggcagaaagtgaaaaatg

SEQ ID NO: 102929 - DNA, 44 bp, Artificial Sequence
  Description of Artificial Sequence: Synthetic oligonucleotide
gcaatatatgatactccctgtatacaggcagaaagtgaaaaatg

SEQ ID NO: 102930 - DNA, 44 bp, Artificial Sequence
  Description of Artificial Sequence: Synthetic oligonucleotide
caatatatgatactccctgtatacaggcagaaagtgaaaaatgg

SEQ ID NO: 102931 - DNA, 44 bp, Artificial Sequence
  Description of Artificial Sequence: Synthetic oligonucleotide
aatatatgatactccctgtatacaggcagaaagtgaaaaatggc

SEQ ID NO: 102932 - DNA, 43 bp, Artificial Sequence
  Description of Artificial Sequence: Synthetic oligonucleotide
atatatgatactccctgtatacaggcagaaagtgaaaaatggc

SEQ ID NO: 102933 - DNA, 42 bp, Artificial Sequence
  Description of Artificial Sequence: Synthetic oligonucleotide
tatatgatactccctgtatacaggcagaaagtgaaaaatggc

SEQ ID NO: 102934 - DNA, 41 bp, Artificial Sequence
  Description of Artificial Sequence: Synthetic oligonucleotide
atatgatactccctgtatacaggcagaaagtgaaaaatggc

SEQ ID NO: 102935 - DNA, 40 bp, Artificial Sequence
  Description of Artificial Sequence: Synthetic oligonucleotide
tatgatactccctgtatacaggcagaaagtgaaaaatggc

SEQ ID NO: 102936 - DNA, 39 bp, Artificial Sequence
  Description of Artificial Sequence: Synthetic oligonucleotide
atgatactccctgtatacaggcagaaagtgaaaaatggc

SEQ ID NO: 102937 - DNA, 38 bp, Artificial Sequence
  Description of Artificial Sequence: Synthetic oligonucleotide
tgatactccctgtatacaggcagaaagtgaaaaatggc

SEQ ID NO: 102938 - DNA, 37 bp, Artificial Sequence
  Description of Artificial Sequence: Synthetic oligonucleotide
gatactccctgtatacaggcagaaagtgaaaaatggc

SEQ ID NO: 102939 - DNA, 38 bp, Artificial Sequence
  Description of Artificial Sequence: Synthetic oligonucleotide
atactccctgtatacaggcagaaagtgaaaaatggcag

SEQ ID NO: 102940 - DNA, 37 bp, Artificial Sequence
  Description of Artificial Sequence: Synthetic oligonucleotide
tactccctgtatacaggcagaaagtgaaaaatggcag

SEQ ID NO: 102941 - DNA, 36 bp, Artificial Sequence
  Description of Artificial Sequence: Synthetic oligonucleotide
actccctgtatacaggcagaaagtgaaaaatggcag

SEQ ID NO: 102942 - DNA, 35 bp, Artificial Sequence
  Description of Artificial Sequence: Synthetic oligonucleotide
ctccctgtatacaggcagaaagtgaaaaatggcag

SEQ ID NO: 102943 - DNA, 35 bp, Artificial Sequence
  Description of Artificial Sequence: Synthetic oligonucleotide
tccctgtatacaggcagaaagtgaaaaatggcagc

SEQ ID NO: 102944 - DNA, 34 bp, Artificial Sequence
  Description of Artificial Sequence: Synthetic oligonucleotide
ccctgtatacaggcagaaagtgaaaaatggcagc

SEQ ID NO: 102945 - DNA, 35 bp, Artificial Sequence
  Description of Artificial Sequence: Synthetic oligonucleotide
cctgtatacaggcagaaagtgaaaaatggcagcag

SEQ ID NO: 102946 - DNA, 35 bp, Artificial Sequence
  Description of Artificial Sequence: Synthetic oligonucleotide
ctgtatacaggcagaaagtgaaaaatggcagcagg

SEQ ID NO: 102947 - DNA, 35 bp, Artificial Sequence
  Description of Artificial Sequence: Synthetic oligonucleotide
tgtatacaggcagaaagtgaaaaatggcagcaggc

SEQ ID NO: 102948 - DNA, 34 bp, Artificial Sequence
  Description of Artificial Sequence: Synthetic oligonucleotide
gtatacaggcagaaagtgaaaaatggcagcaggc

SEQ ID NO: 102949 - DNA, 35 bp, Artificial Sequence
  Description of Artificial Sequence: Synthetic oligonucleotide
tatacaggcagaaagtgaaaaatggcagcaggctc

SEQ ID NO: 102950 - DNA, 34 bp, Artificial Sequence
  Description of Artificial Sequence: Synthetic oligonucleotide
atacaggcagaaagtgaaaaatggcagcaggctc

SEQ ID NO: 102951 - DNA, 33 bp, Artificial Sequence
  Description of Artificial Sequence: Synthetic oligonucleotide
tacaggcagaaagtgaaaaatggcagcaggctc

SEQ ID NO: 102952 - DNA, 32 bp, Artificial Sequence
  Description of Artificial Sequence: Synthetic oligonucleotide
acaggcagaaagtgaaaaatggcagcaggctc

SEQ ID NO: 102953 - DNA, 31 bp, Artificial Sequence
  Description of Artificial Sequence: Synthetic oligonucleotide
caggcagaaagtgaaaaatggcagcaggctc

SEQ ID NO: 102954 - DNA, 32 bp, Artificial Sequence
  Description of Artificial Sequence: Synthetic oligonucleotide
aggcagaaagtgaaaaatggcagcaggctctg

SEQ ID NO: 102955 - DNA, 31 bp, Artificial Sequence
  Description of Artificial Sequence: Synthetic oligonucleotide
ggcagaaagtgaaaaatggcagcaggctctg

SEQ ID NO: 102956 - DNA, 33 bp, Artificial Sequence
  Description of Artificial Sequence: Synthetic oligonucleotide
gcagaaagtgaaaaatggcagcaggctctgaag

SEQ ID NO: 102957 - DNA, 34 bp, Artificial Sequence
  Description of Artificial Sequence: Synthetic oligonucleotide
cagaaagtgaaaaatggcagcaggctctgaagag

SEQ ID NO: 102958 - DNA, 35 bp, Artificial Sequence
  Description of Artificial Sequence: Synthetic oligonucleotide
agaaagtgaaaaatggcagcaggctctgaagagtg

SEQ ID NO: 102959 - DNA, 34 bp, Artificial Sequence
  Description of Artificial Sequence: Synthetic oligonucleotide
gaaagtgaaaaatggcagcaggctctgaagagtg

SEQ ID NO: 102960 - DNA, 36 bp, Artificial Sequence
  Description of Artificial Sequence: Synthetic oligonucleotide
aaagtgaaaaatggcagcaggctctgaagagtgttg

SEQ ID NO: 102961 - DNA, 35 bp, Artificial Sequence
  Description of Artificial Sequence: Synthetic oligonucleotide
aagtgaaaaatggcagcaggctctgaagagtgttg

SEQ ID NO: 102962 - DNA, 34 bp, Artificial Sequence
  Description of Artificial Sequence: Synthetic oligonucleotide
agtgaaaaatggcagcaggctctgaagagtgttg

SEQ ID NO: 102963 - DNA, 33 bp, Artificial Sequence
  Description of Artificial Sequence: Synthetic oligonucleotide
gtgaaaaatggcagcaggctctgaagagtgttg

SEQ ID NO: 102964 - DNA, 35 bp, Artificial Sequence
  Description of Artificial Sequence: Synthetic oligonucleotide
tgaaaaatggcagcaggctctgaagagtgttgtac

SEQ ID NO: 102965 - DNA, 34 bp, Artificial Sequence
  Description of Artificial Sequence: Synthetic oligonucleotide
gaaaaatggcagcaggctctgaagagtgttgtac

SEQ ID NO: 102966 - DNA, 35 bp, Artificial Sequence
  Description of Artificial Sequence: Synthetic oligonucleotide
aaaaatggcagcaggctctgaagagtgttgtactc

SEQ ID NO: 102967 - DNA, 34 bp, Artificial Sequence
  Description of Artificial Sequence: Synthetic oligonucleotide
aaaatggcagcaggctctgaagagtgttgtactc

SEQ ID NO: 102968 - DNA, 33 bp, Artificial Sequence
  Description of Artificial Sequence: Synthetic oligonucleotide
aaatggcagcaggctctgaagagtgttgtactc

SEQ ID NO: 102969 - DNA, 32 bp, Artificial Sequence
  Description of Artificial Sequence: Synthetic oligonucleotide
aatggcagcaggctctgaagagtgttgtactc

SEQ ID NO: 102970 - DNA, 31 bp, Artificial Sequence
  Description of Artificial Sequence: Synthetic oligonucleotide
atggcagcaggctctgaagagtgttgtactc

SEQ ID NO: 102971 - DNA, 30 bp, Artificial Sequence
  Description of Artificial Sequence: Synthetic oligonucleotide
tggcagcaggctctgaagagtgttgtactc

SEQ ID NO: 102972 - DNA, 29 bp, Artificial Sequence
  Description of Artificial Sequence: Synthetic oligonucleotide
ggcagcaggctctgaagagtgttgtactc

SEQ ID NO: 102973 - DNA, 32 bp, Artificial Sequence
  Description of Artificial Sequence: Synthetic oligonucleotide
gcagcaggctctgaagagtgttgtactctatg

SEQ ID NO: 102974 - DNA, 36 bp, Artificial Sequence
  Description of Artificial Sequence: Synthetic oligonucleotide
cagcaggctctgaagagtgttgtactctatgttatc

SEQ ID NO: 102975 - DNA, 36 bp, Artificial Sequence
  Description of Artificial Sequence: Synthetic oligonucleotide
agcaggctctgaagagtgttgtactctatgttatcc

SEQ ID NO: 102976 - DNA, 35 bp, Artificial Sequence
  Description of Artificial Sequence: Synthetic oligonucleotide
gcaggctctgaagagtgttgtactctatgttatcc

SEQ ID NO: 102977 - DNA, 36 bp, Artificial Sequence
  Description of Artificial Sequence: Synthetic oligonucleotide
caggctctgaagagtgttgtactctatgttatcctg

SEQ ID NO: 102978 - DNA, 36 bp, Artificial Sequence
  Description of Artificial Sequence: Synthetic oligonucleotide
aggctctgaagagtgttgtactctatgttatcctgg

SEQ ID NO: 102979 - DNA, 35 bp, Artificial Sequence
  Description of Artificial Sequence: Synthetic oligonucleotide
ggctctgaagagtgttgtactctatgttatcctgg

SEQ ID NO: 102980 - DNA, 35 bp, Artificial Sequence
  Description of Artificial Sequence: Synthetic oligonucleotide
gctctgaagagtgttgtactctatgttatcctggc

SEQ ID NO: 102981 - DNA, 36 bp, Artificial Sequence
  Description of Artificial Sequence: Synthetic oligonucleotide
ctctgaagagtgttgtactctatgttatcctggctc

SEQ ID NO: 102982 - DNA, 36 bp, Artificial Sequence
  Description of Artificial Sequence: Synthetic oligonucleotide
tctgaagagtgttgtactctatgttatcctggctcc

SEQ ID NO: 102983 - DNA, 35 bp, Artificial Sequence
  Description of Artificial Sequence: Synthetic oligonucleotide
ctgaagagtgttgtactctatgttatcctggctcc

SEQ ID NO: 102984 - DNA, 39 bp, Artificial Sequence
  Description of Artificial Sequence: Synthetic oligonucleotide
tgaagagtgttgtactctatgttatcctggctccttttg

SEQ ID NO: 102985 - DNA, 38 bp, Artificial Sequence
  Description of Artificial Sequence: Synthetic oligonucleotide
gaagagtgttgtactctatgttatcctggctccttttg

SEQ ID NO: 102986 - DNA, 39 bp, Artificial Sequence
  Description of Artificial Sequence: Synthetic oligonucleotide
aagagtgttgtactctatgttatcctggctccttttgac

SEQ ID NO: 102987 - DNA, 38 bp, Artificial Sequence
  Description of Artificial Sequence: Synthetic oligonucleotide
agagtgttgtactctatgttatcctggctccttttgac

SEQ ID NO: 102988 - DNA, 37 bp, Artificial Sequence
  Description of Artificial Sequence: Synthetic oligonucleotide
gagtgttgtactctatgttatcctggctccttttgac

SEQ ID NO: 102989 - DNA, 40 bp, Artificial Sequence
  Description of Artificial Sequence: Synthetic oligonucleotide
agtgttgtactctatgttatcctggctccttttgacaatg

SEQ ID NO: 102990 - DNA, 39 bp, Artificial Sequence
  Description of Artificial Sequence: Synthetic oligonucleotide
gtgttgtactctatgttatcctggctccttttgacaatg

SEQ ID NO: 102991 - DNA, 41 bp, Artificial Sequence
  Description of Artificial Sequence: Synthetic oligonucleotide
tgttgtactctatgttatcctggctccttttgacaatgaac

SEQ ID NO: 102992 - DNA, 40 bp, Artificial Sequence
  Description of Artificial Sequence: Synthetic oligonucleotide
gttgtactctatgttatcctggctccttttgacaatgaac

SEQ ID NO: 102993 - DNA, 41 bp, Artificial Sequence
  Description of Artificial Sequence: Synthetic oligonucleotide
ttgtactctatgttatcctggctccttttgacaatgaacag

SEQ ID NO: 102994 - DNA, 40 bp, Artificial Sequence
  Description of Artificial Sequence: Synthetic oligonucleotide
tgtactctatgttatcctggctccttttgacaatgaacag

SEQ ID NO: 102995 - DNA, 39 bp, Artificial Sequence
  Description of Artificial Sequence: Synthetic oligonucleotide
gtactctatgttatcctggctccttttgacaatgaacag

SEQ ID NO: 102996 - DNA, 40 bp, Artificial Sequence
  Description of Artificial Sequence: Synthetic oligonucleotide
tactctatgttatcctggctccttttgacaatgaacagtc

SEQ ID NO: 102997 - DNA, 39 bp, Artificial Sequence
  Description of Artificial Sequence: Synthetic oligonucleotide
actctatgttatcctggctccttttgacaatgaacagtc

SEQ ID NO: 102998 - DNA, 38 bp, Artificial Sequence
  Description of Artificial Sequence: Synthetic oligonucleotide
ctctatgttatcctggctccttttgacaatgaacagtc

SEQ ID NO: 102999 - DNA, 39 bp, Artificial Sequence
  Description of Artificial Sequence: Synthetic oligonucleotide
tctatgttatcctggctccttttgacaatgaacagtcag

SEQ ID NO: 103000 - DNA, 38 bp, Artificial Sequence
  Description of Artificial Sequence: Synthetic oligonucleotide
ctatgttatcctggctccttttgacaatgaacagtcag

SEQ ID NO: 103001 - DNA, 42 bp, Artificial Sequence
  Description of Artificial Sequence: Synthetic oligonucleotide
tatgttatcctggctccttttgacaatgaacagtcagatttg

SEQ ID NO: 103002 - DNA, 41 bp, Artificial Sequence
  Description of Artificial Sequence: Synthetic oligonucleotide
atgttatcctggctccttttgacaatgaacagtcagatttg

SEQ ID NO: 103003 - DNA, 40 bp, Artificial Sequence
  Description of Artificial Sequence: Synthetic oligonucleotide
tgttatcctggctccttttgacaatgaacagtcagatttg

SEQ ID NO: 103004 - DNA, 39 bp, Artificial Sequence
  Description of Artificial Sequence: Synthetic oligonucleotide
gttatcctggctccttttgacaatgaacagtcagatttg

SEQ ID NO: 103005 - DNA, 39 bp, Artificial Sequence
  Description of Artificial Sequence: Synthetic oligonucleotide
ttatcctggctccttttgacaatgaacagtcagatttgg

SEQ ID NO: 103006 - DNA, 38 bp, Artificial Sequence
  Description of Artificial Sequence: Synthetic oligonucleotide
tatcctggctccttttgacaatgaacagtcagatttgg

SEQ ID NO: 103007 - DNA, 37 bp, Artificial Sequence
  Description of Artificial Sequence: Synthetic oligonucleotide
atcctggctccttttgacaatgaacagtcagatttgg

SEQ ID NO: 103008 - DNA, 36 bp, Artificial Sequence
  Description of Artificial Sequence: Synthetic oligonucleotide
tcctggctccttttgacaatgaacagtcagatttgg

SEQ ID NO: 103009 - DNA, 35 bp, Artificial Sequence
  Description of Artificial Sequence: Synthetic oligonucleotide
cctggctccttttgacaatgaacagtcagatttgg

SEQ ID NO: 103010 - DNA, 37 bp, Artificial Sequence
  Description of Artificial Sequence: Synthetic oligonucleotide
ctggctccttttgacaatgaacagtcagatttggttc

SEQ ID NO: 103011 - DNA, 38 bp, Artificial Sequence
  Description of Artificial Sequence: Synthetic oligonucleotide
tggctccttttgacaatgaacagtcagatttggttcac

SEQ ID NO: 103012 - DNA, 37 bp, Artificial Sequence
  Description of Artificial Sequence: Synthetic oligonucleotide
ggctccttttgacaatgaacagtcagatttggttcac

SEQ ID NO: 103013 - DNA, 37 bp, Artificial Sequence
  Description of Artificial Sequence: Synthetic oligonucleotide
gctccttttgacaatgaacagtcagatttggttcacc

SEQ ID NO: 103014 - DNA, 37 bp, Artificial Sequence
  Description of Artificial Sequence: Synthetic oligonucleotide
ctccttttgacaatgaacagtcagatttggttcaccg

SEQ ID NO: 103015 - DNA, 42 bp, Artificial Sequence
  Description of Artificial Sequence: Synthetic oligonucleotide
tccttttgacaatgaacagtcagatttggttcaccgaataag

SEQ ID NO: 103016 - DNA, 41 bp, Artificial Sequence
  Description of Artificial Sequence: Synthetic oligonucleotide
ccttttgacaatgaacagtcagatttggttcaccgaataag

SEQ ID NO: 103017 - DNA, 42 bp, Artificial Sequence
  Description of Artificial Sequence: Synthetic oligonucleotide
cttttgacaatgaacagtcagatttggttcaccgaataagtg

SEQ ID NO: 103018 - DNA, 42 bp, Artificial Sequence
  Description of Artificial Sequence: Synthetic oligonucleotide
ttttgacaatgaacagtcagatttggttcaccgaataagtgg

SEQ ID NO: 103019 - DNA, 41 bp, Artificial Sequence
  Description of Artificial Sequence: Synthetic oligonucleotide
tttgacaatgaacagtcagatttggttcaccgaataagtgg

SEQ ID NO: 103020 - DNA, 40 bp, Artificial Sequence
  Description of Artificial Sequence: Synthetic oligonucleotide
ttgacaatgaacagtcagatttggttcaccgaataagtgg

SEQ ID NO: 103021 - DNA, 39 bp, Artificial Sequence
  Description of Artificial Sequence: Synthetic oligonucleotide
tgacaatgaacagtcagatttggttcaccgaataagtgg

SEQ ID NO: 103022 - DNA, 38 bp, Artificial Sequence
  Description of Artificial Sequence: Synthetic oligonucleotide
gacaatgaacagtcagatttggttcaccgaataagtgg

SEQ ID NO: 103023 - DNA, 39 bp, Artificial Sequence
  Description of Artificial Sequence: Synthetic oligonucleotide
acaatgaacagtcagatttggttcaccgaataagtggtg

SEQ ID NO: 103024 - DNA, 38 bp, Artificial Sequence
  Description of Artificial Sequence: Synthetic oligonucleotide
caatgaacagtcagatttggttcaccgaataagtggtg

SEQ ID NO: 103025 - DNA, 39 bp, Artificial Sequence
  Description of Artificial Sequence: Synthetic oligonucleotide
aatgaacagtcagatttggttcaccgaataagtggtgac

SEQ ID NO: 103026 - DNA, 38 bp, Artificial Sequence
  Description of Artificial Sequence: Synthetic oligonucleotide
atgaacagtcagatttggttcaccgaataagtggtgac

SEQ ID NO: 103027 - DNA, 37 bp, Artificial Sequence
  Description of Artificial Sequence: Synthetic oligonucleotide
tgaacagtcagatttggttcaccgaataagtggtgac

SEQ ID NO: 103028 - DNA, 36 bp, Artificial Sequence
  Description of Artificial Sequence: Synthetic oligonucleotide
gaacagtcagatttggttcaccgaataagtggtgac

SEQ ID NO: 103029 - DNA, 38 bp, Artificial Sequence
  Description of Artificial Sequence: Synthetic oligonucleotide
aacagtcagatttggttcaccgaataagtggtgacaag

SEQ ID NO: 103030 - DNA, 37 bp, Artificial Sequence
  Description of Artificial Sequence: Synthetic oligonucleotide
acagtcagatttggttcaccgaataagtggtgacaag

SEQ ID NO: 103031 - DNA, 36 bp, Artificial Sequence
  Description of Artificial Sequence: Synthetic oligonucleotide
cagtcagatttggttcaccgaataagtggtgacaag

SEQ ID NO: 103032 - DNA, 38 bp, Artificial Sequence
  Description of Artificial Sequence: Synthetic oligonucleotide
agtcagatttggttcaccgaataagtggtgacaagaag

SEQ ID NO: 103033 - DNA, 37 bp, Artificial Sequence
  Description of Artificial Sequence: Synthetic oligonucleotide
gtcagatttggttcaccgaataagtggtgacaagaag

SEQ ID NO: 103034 - DNA, 40 bp, Artificial Sequence
  Description of Artificial Sequence: Synthetic oligonucleotide
tcagatttggttcaccgaataagtggtgacaagaagttag

SEQ ID NO: 103035 - DNA, 39 bp, Artificial Sequence
  Description of Artificial Sequence: Synthetic oligonucleotide
cagatttggttcaccgaataagtggtgacaagaagttag

SEQ ID NO: 103036 - DNA, 41 bp, Artificial Sequence
  Description of Artificial Sequence: Synthetic oligonucleotide
agatttggttcaccgaataagtggtgacaagaagttagaag

SEQ ID NO: 103037 - DNA, 40 bp, Artificial Sequence
  Description of Artificial Sequence: Synthetic oligonucleotide
gatttggttcaccgaataagtggtgacaagaagttagaag

SEQ ID NO: 103038 - DNA, 45 bp, Artificial Sequence
  Description of Artificial Sequence: Synthetic oligonucleotide
atttggttcaccgaataagtggtgacaagaagttagaagaaattc

SEQ ID NO: 103039 - DNA, 44 bp, Artificial Sequence
  Description of Artificial Sequence: Synthetic oligonucleotide
tttggttcaccgaataagtggtgacaagaagttagaagaaattc

SEQ ID NO: 103040 - DNA, 43 bp, Artificial Sequence
  Description of Artificial Sequence: Synthetic oligonucleotide
ttggttcaccgaataagtggtgacaagaagttagaagaaattc

SEQ ID NO: 103041 - DNA, 42 bp, Artificial Sequence
  Description of Artificial Sequence: Synthetic oligonucleotide
tggttcaccgaataagtggtgacaagaagttagaagaaattc

SEQ ID NO: 103042 - DNA, 41 bp, Artificial Sequence
  Description of Artificial Sequence: Synthetic oligonucleotide
ggttcaccgaataagtggtgacaagaagttagaagaaattc

SEQ ID NO: 103043 - DNA, 41 bp, Artificial Sequence
  Description of Artificial Sequence: Synthetic oligonucleotide
gttcaccgaataagtggtgacaagaagttagaagaaattcc

SEQ ID NO: 103044 - DNA, 41 bp, Artificial Sequence
  Description of Artificial Sequence: Synthetic oligonucleotide
ttcaccgaataagtggtgacaagaagttagaagaaattccc

SEQ ID NO: 103045 - DNA, 40 bp, Artificial Sequence
  Description of Artificial Sequence: Synthetic oligonucleotide
tcaccgaataagtggtgacaagaagttagaagaaattccc

SEQ ID NO: 103046 - DNA, 39 bp, Artificial Sequence
  Description of Artificial Sequence: Synthetic oligonucleotide
caccgaataagtggtgacaagaagttagaagaaattccc

SEQ ID NO: 103047 - DNA, 44 bp, Artificial Sequence
  Description of Artificial Sequence: Synthetic oligonucleotide
accgaataagtggtgacaagaagttagaagaaattcccaaatac

SEQ ID NO: 103048 - DNA, 43 bp, Artificial Sequence
  Description of Artificial Sequence: Synthetic oligonucleotide
ccgaataagtggtgacaagaagttagaagaaattcccaaatac

SEQ ID NO: 103049 - DNA, 45 bp, Artificial Sequence
  Description of Artificial Sequence: Synthetic oligonucleotide
cgaataagtggtgacaagaagttagaagaaattcccaaatacaag

SEQ ID NO: 103050 - DNA, 45 bp, Artificial Sequence
  Description of Artificial Sequence: Synthetic oligonucleotide
gaataagtggtgacaagaagttagaagaaattcccaaatacaagg

SEQ ID NO: 103051 - DNA, 47 bp, Artificial Sequence
  Description of Artificial Sequence: Synthetic oligonucleotide
aataagtggtgacaagaagttagaagaaattcccaaatacaaggatc

SEQ ID NO: 103052 - DNA, 46 bp, Artificial Sequence
  Description of Artificial Sequence: Synthetic oligonucleotide
ataagtggtgacaagaagttagaagaaattcccaaatacaaggatc

SEQ ID NO: 103053 - DNA, 45 bp, Artificial Sequence
  Description of Artificial Sequence: Synthetic oligonucleotide
taagtggtgacaagaagttagaagaaattcccaaatacaaggatc

SEQ ID NO: 103054 - DNA, 44 bp, Artificial Sequence
  Description of Artificial Sequence: Synthetic oligonucleotide
aagtggtgacaagaagttagaagaaattcccaaatacaaggatc

SEQ ID NO: 103055 - DNA, 43 bp, Artificial Sequence
  Description of Artificial Sequence: Synthetic oligonucleotide
agtggtgacaagaagttagaagaaattcccaaatacaaggatc

SEQ ID NO: 103056 - DNA, 42 bp, Artificial Sequence
  Description of Artificial Sequence: Synthetic oligonucleotide
gtggtgacaagaagttagaagaaattcccaaatacaaggatc

SEQ ID NO: 103057 - DNA, 49 bp, Artificial Sequence
  Description of Artificial Sequence: Synthetic oligonucleotide
tggtgacaagaagttagaagaaattcccaaatacaaggatcttttaaag

SEQ ID NO: 103058 - DNA, 48 bp, Artificial Sequence
  Description of Artificial Sequence: Synthetic oligonucleotide
ggtgacaagaagttagaagaaattcccaaatacaaggatcttttaaag

SEQ ID NO: 103059 - DNA, 48 bp, Artificial Sequence
  Description of Artificial Sequence: Synthetic oligonucleotide
gtgacaagaagttagaagaaattcccaaatacaaggatcttttaaagc

SEQ ID NO: 103060 - DNA, 54 bp, Artificial Sequence
  Description of Artificial Sequence: Synthetic oligonucleotide
tgacaagaagttagaagaaattcccaaatacaaggatcttttaaagctttttac

SEQ ID NO: 103061 - DNA, 53 bp, Artificial Sequence
  Description of Artificial Sequence: Synthetic oligonucleotide
gacaagaagttagaagaaattcccaaatacaaggatcttttaaagctttttac

SEQ ID NO: 103062 - DNA, 53 bp, Artificial Sequence
  Description of Artificial Sequence: Synthetic oligonucleotide
acaagaagttagaagaaattcccaaatacaaggatcttttaaagctttttacc

SEQ ID NO: 103063 - DNA, 52 bp, Artificial Sequence
  Description of Artificial Sequence: Synthetic oligonucleotide
caagaagttagaagaaattcccaaatacaaggatcttttaaagctttttacc

SEQ ID NO: 103064 - DNA, 53 bp, Artificial Sequence
  Description of Artificial Sequence: Synthetic oligonucleotide
aagaagttagaagaaattcccaaatacaaggatcttttaaagctttttaccac

SEQ ID NO: 103065 - DNA, 52 bp, Artificial Sequence
  Description of Artificial Sequence: Synthetic oligonucleotide
agaagttagaagaaattcccaaatacaaggatcttttaaagctttttaccac

SEQ ID NO: 103066 - DNA, 51 bp, Artificial Sequence
  Description of Artificial Sequence: Synthetic oligonucleotide
gaagttagaagaaattcccaaatacaaggatcttttaaagctttttaccac

SEQ ID NO: 103067 - DNA, 54 bp, Artificial Sequence
  Description of Artificial Sequence: Synthetic oligonucleotide
aagttagaagaaattcccaaatacaaggatcttttaaagctttttaccacaatg

SEQ ID NO: 103068 - DNA, 53 bp, Artificial Sequence
  Description of Artificial Sequence: Synthetic oligonucleotide
agttagaagaaattcccaaatacaaggatcttttaaagctttttaccacaatg

SEQ ID NO: 103069 - DNA, 52 bp, Artificial Sequence
  Description of Artificial Sequence: Synthetic oligonucleotide
gttagaagaaattcccaaatacaaggatcttttaaagctttttaccacaatg

SEQ ID NO: 103070 - DNA, 52 bp, Artificial Sequence
  Description of Artificial Sequence: Synthetic oligonucleotide
ttagaagaaattcccaaatacaaggatcttttaaagctttttaccacaatgg

SEQ ID NO: 103071 - DNA, 51 bp, Artificial Sequence
  Description of Artificial Sequence: Synthetic oligonucleotide
tagaagaaattcccaaatacaaggatcttttaaagctttttaccacaatgg

SEQ ID NO: 103072 - DNA, 50 bp, Artificial Sequence
  Description of Artificial Sequence: Synthetic oligonucleotide
agaagaaattcccaaatacaaggatcttttaaagctttttaccacaatgg

SEQ ID NO: 103073 - DNA, 49 bp, Artificial Sequence
  Description of Artificial Sequence: Synthetic oligonucleotide
gaagaaattcccaaatacaaggatcttttaaagctttttaccacaatgg

SEQ ID NO: 103074 - DNA, 50 bp, Artificial Sequence
  Description of Artificial Sequence: Synthetic oligonucleotide
aagaaattcccaaatacaaggatcttttaaagctttttaccacaatggag

SEQ ID NO: 103075 - DNA, 49 bp, Artificial Sequence
  Description of Artificial Sequence: Synthetic oligonucleotide
agaaattcccaaatacaaggatcttttaaagctttttaccacaatggag

SEQ ID NO: 103076 - DNA, 48 bp, Artificial Sequence
  Description of Artificial Sequence: Synthetic oligonucleotide
gaaattcccaaatacaaggatcttttaaagctttttaccacaatggag

SEQ ID NO: 103077 - DNA, 50 bp, Artificial Sequence
  Description of Artificial Sequence: Synthetic oligonucleotide
aaattcccaaatacaaggatcttttaaagctttttaccacaatggagttg

SEQ ID NO: 103078 - DNA, 49 bp, Artificial Sequence
  Description of Artificial Sequence: Synthetic oligonucleotide
aattcccaaatacaaggatcttttaaagctttttaccacaatggagttg

SEQ ID NO: 103079 - DNA, 48 bp, Artificial Sequence
  Description of Artificial Sequence: Synthetic oligonucleotide
attcccaaatacaaggatcttttaaagctttttaccacaatggagttg

SEQ ID NO: 103080 - DNA, 47 bp, Artificial Sequence
  Description of Artificial Sequence: Synthetic oligonucleotide
ttcccaaatacaaggatcttttaaagctttttaccacaatggagttg

SEQ ID NO: 103081 - DNA, 46 bp, Artificial Sequence
  Description of Artificial Sequence: Synthetic oligonucleotide
tcccaaatacaaggatcttttaaagctttttaccacaatggagttg

SEQ ID NO: 103082 - DNA, 45 bp, Artificial Sequence
  Description of Artificial Sequence: Synthetic oligonucleotide
cccaaatacaaggatcttttaaagctttttaccacaatggagttg

SEQ ID NO: 103083 - DNA, 47 bp, Artificial Sequence
  Description of Artificial Sequence: Synthetic oligonucleotide
ccaaatacaaggatcttttaaagctttttaccacaatggagttgatg

SEQ ID NO: 103084 - DNA, 47 bp, Artificial Sequence
  Description of Artificial Sequence: Synthetic oligonucleotide
caaatacaaggatcttttaaagctttttaccacaatggagttgatgc

SEQ ID NO: 103085 - DNA, 47 bp, Artificial Sequence
  Description of Artificial Sequence: Synthetic oligonucleotide
aaatacaaggatcttttaaagctttttaccacaatggagttgatgcg

SEQ ID NO: 103086 - DNA, 46 bp, Artificial Sequence
  Description of Artificial Sequence: Synthetic oligonucleotide
aatacaaggatcttttaaagctttttaccacaatggagttgatgcg

SEQ ID NO: 103087 - DNA, 45 bp, Artificial Sequence
  Description of Artificial Sequence: Synthetic oligonucleotide
atacaaggatcttttaaagctttttaccacaatggagttgatgcg

SEQ ID NO: 103088 - DNA, 44 bp, Artificial Sequence
  Description of Artificial Sequence: Synthetic oligonucleotide
tacaaggatcttttaaagctttttaccacaatggagttgatgcg

SEQ ID NO: 103089 - DNA, 43 bp, Artificial Sequence
  Description of Artificial Sequence: Synthetic oligonucleotide
acaaggatcttttaaagctttttaccacaatggagttgatgcg

SEQ ID NO: 103090 - DNA, 42 bp, Artificial Sequence
  Description of Artificial Sequence: Synthetic oligonucleotide
caaggatcttttaaagctttttaccacaatggagttgatgcg

SEQ ID NO: 103091 - DNA, 44 bp, Artificial Sequence
  Description of Artificial Sequence: Synthetic oligonucleotide
aaggatcttttaaagctttttaccacaatggagttgatgcgttg

SEQ ID NO: 103092 - DNA, 43 bp, Artificial Sequence
  Description of Artificial Sequence: Synthetic oligonucleotide
aggatcttttaaagctttttaccacaatggagttgatgcgttg

SEQ ID NO: 103093 - DNA, 42 bp, Artificial Sequence
  Description of Artificial Sequence: Synthetic oligonucleotide
ggatcttttaaagctttttaccacaatggagttgatgcgttg

SEQ ID NO: 103094 - DNA, 42 bp, Artificial Sequence
  Description of Artificial Sequence: Synthetic oligonucleotide
gatcttttaaagctttttaccacaatggagttgatgcgttgg

SEQ ID NO: 103095 - DNA, 43 bp, Artificial Sequence
  Description of Artificial Sequence: Synthetic oligonucleotide
atcttttaaagctttttaccacaatggagttgatgcgttggtc

SEQ ID NO: 103096 - DNA, 42 bp, Artificial Sequence
  Description of Artificial Sequence: Synthetic oligonucleotide
tcttttaaagctttttaccacaatggagttgatgcgttggtc

SEQ ID NO: 103097 - DNA, 41 bp, Artificial Sequence
  Description of Artificial Sequence: Synthetic oligonucleotide
cttttaaagctttttaccacaatggagttgatgcgttggtc

SEQ ID NO: 103098 - DNA, 41 bp, Artificial Sequence
  Description of Artificial Sequence: Synthetic oligonucleotide
ttttaaagctttttaccacaatggagttgatgcgttggtcc

SEQ ID NO: 103099 - DNA, 40 bp, Artificial Sequence
  Description of Artificial Sequence: Synthetic oligonucleotide
tttaaagctttttaccacaatggagttgatgcgttggtcc

SEQ ID NO: 103100 - DNA, 39 bp, Artificial Sequence
  Description of Artificial Sequence: Synthetic oligonucleotide
ttaaagctttttaccacaatggagttgatgcgttggtcc

SEQ ID NO: 103101 - DNA, 38 bp, Artificial Sequence
  Description of Artificial Sequence: Synthetic oligonucleotide
taaagctttttaccacaatggagttgatgcgttggtcc

SEQ ID NO: 103102 - DNA, 37 bp, Artificial Sequence
  Description of Artificial Sequence: Synthetic oligonucleotide
aaagctttttaccacaatggagttgatgcgttggtcc

SEQ ID NO: 103103 - DNA, 36 bp, Artificial Sequence
  Description of Artificial Sequence: Synthetic oligonucleotide
aagctttttaccacaatggagttgatgcgttggtcc

SEQ ID NO: 103104 - DNA, 35 bp, Artificial Sequence
  Description of Artificial Sequence: Synthetic oligonucleotide
agctttttaccacaatggagttgatgcgttggtcc

SEQ ID NO: 103105 - DNA, 34 bp, Artificial Sequence
  Description of Artificial Sequence: Synthetic oligonucleotide
gctttttaccacaatggagttgatgcgttggtcc

SEQ ID NO: 103106 - DNA, 35 bp, Artificial Sequence
  Description of Artificial Sequence: Synthetic oligonucleotide
ctttttaccacaatggagttgatgcgttggtccac

SEQ ID NO: 103107 - DNA, 36 bp, Artificial Sequence
  Description of Artificial Sequence: Synthetic oligonucleotide
tttttaccacaatggagttgatgcgttggtccacac

SEQ ID NO: 103108 - DNA, 35 bp, Artificial Sequence
  Description of Artificial Sequence: Synthetic oligonucleotide
ttttaccacaatggagttgatgcgttggtccacac

SEQ ID NO: 103109 - DNA, 34 bp, Artificial Sequence
  Description of Artificial Sequence: Synthetic oligonucleotide
tttaccacaatggagttgatgcgttggtccacac

SEQ ID NO: 103110 - DNA, 33 bp, Artificial Sequence
  Description of Artificial Sequence: Synthetic oligonucleotide
ttaccacaatggagttgatgcgttggtccacac

SEQ ID NO: 103111 - DNA, 32 bp, Artificial Sequence
  Description of Artificial Sequence: Synthetic oligonucleotide
taccacaatggagttgatgcgttggtccacac

SEQ ID NO: 103112 - DNA, 31 bp, Artificial Sequence
  Description of Artificial Sequence: Synthetic oligonucleotide
accacaatggagttgatgcgttggtccacac

SEQ ID NO: 103113 - DNA, 30 bp, Artificial Sequence
  Description of Artificial Sequence: Synthetic oligonucleotide
ccacaatggagttgatgcgttggtccacac

SEQ ID NO: 103114 - DNA, 32 bp, Artificial Sequence
  Description of Artificial Sequence: Synthetic oligonucleotide
cacaatggagttgatgcgttggtccacacttg

SEQ ID NO: 103115 - DNA, 34 bp, Artificial Sequence
  Description of Artificial Sequence: Synthetic oligonucleotide
acaatggagttgatgcgttggtccacacttgttg

SEQ ID NO: 103116 - DNA, 33 bp, Artificial Sequence
  Description of Artificial Sequence: Synthetic oligonucleotide
caatggagttgatgcgttggtccacacttgttg

SEQ ID NO: 103117 - DNA, 34 bp, Artificial Sequence
  Description of Artificial Sequence: Synthetic oligonucleotide
aatggagttgatgcgttggtccacacttgttgag

SEQ ID NO: 103118 - DNA, 33 bp, Artificial Sequence
  Description of Artificial Sequence: Synthetic oligonucleotide
atggagttgatgcgttggtccacacttgttgag

SEQ ID NO: 103119 - DNA, 32 bp, Artificial Sequence
  Description of Artificial Sequence: Synthetic oligonucleotide
tggagttgatgcgttggtccacacttgttgag

SEQ ID NO: 103120 - DNA, 31 bp, Artificial Sequence
  Description of Artificial Sequence: Synthetic oligonucleotide
ggagttgatgcgttggtccacacttgttgag

SEQ ID NO: 103121 - DNA, 31 bp, Artificial Sequence
  Description of Artificial Sequence: Synthetic oligonucleotide
gagttgatgcgttggtccacacttgttgagg

SEQ ID NO: 103122 - DNA, 32 bp, Artificial Sequence
  Description of Artificial Sequence: Synthetic oligonucleotide
agttgatgcgttggtccacacttgttgaggac

SEQ ID NO: 103123 - DNA, 31 bp, Artificial Sequence
  Description of Artificial Sequence: Synthetic oligonucleotide
gttgatgcgttggtccacacttgttgaggac

SEQ ID NO: 103124 - DNA, 34 bp, Artificial Sequence
  Description of Artificial Sequence: Synthetic oligonucleotide
ttgatgcgttggtccacacttgttgaggactatg

SEQ ID NO: 103125 - DNA, 33 bp, Artificial Sequence
  Description of Artificial Sequence: Synthetic oligonucleotide
tgatgcgttggtccacacttgttgaggactatg

SEQ ID NO: 103126 - DNA, 32 bp, Artificial Sequence
  Description of Artificial Sequence: Synthetic oligonucleotide
gatgcgttggtccacacttgttgaggactatg

SEQ ID NO: 103127 - DNA, 32 bp, Artificial Sequence
  Description of Artificial Sequence: Synthetic oligonucleotide
atgcgttggtccacacttgttgaggactatgg

SEQ ID NO: 103128 - DNA, 31 bp, Artificial Sequence
  Description of Artificial Sequence: Synthetic oligonucleotide
tgcgttggtccacacttgttgaggactatgg

SEQ ID NO: 103129 - DNA, 30 bp, Artificial Sequence
  Description of Artificial Sequence: Synthetic oligonucleotide
gcgttggtccacacttgttgaggactatgg

SEQ ID NO: 103130 - DNA, 33 bp, Artificial Sequence
  Description of Artificial Sequence: Synthetic oligonucleotide
cgttggtccacacttgttgaggactatggaatg

SEQ ID NO: 103131 - DNA, 33 bp, Artificial Sequence
  Description of Artificial Sequence: Synthetic oligonucleotide
gttggtccacacttgttgaggactatggaatgg

SEQ ID NO: 103132 - DNA, 39 bp, Artificial Sequence
  Description of Artificial Sequence: Synthetic oligonucleotide
ttggtccacacttgttgaggactatggaatggaattaag

SEQ ID NO: 103133 - DNA, 38 bp, Artificial Sequence
  Description of Artificial Sequence: Synthetic oligonucleotide
tggtccacacttgttgaggactatggaatggaattaag

SEQ ID NO: 103134 - DNA, 37 bp, Artificial Sequence
  Description of Artificial Sequence: Synthetic oligonucleotide
ggtccacacttgttgaggactatggaatggaattaag

SEQ ID NO: 103135 - DNA, 41 bp, Artificial Sequence
  Description of Artificial Sequence: Synthetic oligonucleotide
gtccacacttgttgaggactatggaatggaattaagaaaag

SEQ ID NO: 103136 - DNA, 41 bp, Artificial Sequence
  Description of Artificial Sequence: Synthetic oligonucleotide
tccacacttgttgaggactatggaatggaattaagaaaagg

SEQ ID NO: 103137 - DNA, 40 bp, Artificial Sequence
  Description of Artificial Sequence: Synthetic oligonucleotide
ccacacttgttgaggactatggaatggaattaagaaaagg

SEQ ID NO: 103138 - DNA, 42 bp, Artificial Sequence
  Description of Artificial Sequence: Synthetic oligonucleotide
cacacttgttgaggactatggaatggaattaagaaaaggttc

SEQ ID NO: 103139 - DNA, 42 bp, Artificial Sequence
  Description of Artificial Sequence: Synthetic oligonucleotide
acacttgttgaggactatggaatggaattaagaaaaggttcc

SEQ ID NO: 103140 - DNA, 41 bp, Artificial Sequence
  Description of Artificial Sequence: Synthetic oligonucleotide
cacttgttgaggactatggaatggaattaagaaaaggttcc

SEQ ID NO: 103141 - DNA, 41 bp, Artificial Sequence
  Description of Artificial Sequence: Synthetic oligonucleotide
acttgttgaggactatggaatggaattaagaaaaggttccc

SEQ ID NO: 103142 - DNA, 40 bp, Artificial Sequence
  Description of Artificial Sequence: Synthetic oligonucleotide
cttgttgaggactatggaatggaattaagaaaaggttccc

SEQ ID NO: 103143 - DNA, 42 bp, Artificial Sequence
  Description of Artificial Sequence: Synthetic oligonucleotide
ttgttgaggactatggaatggaattaagaaaaggttcccttg

SEQ ID NO: 103144 - DNA, 41 bp, Artificial Sequence
  Description of Artificial Sequence: Synthetic oligonucleotide
tgttgaggactatggaatggaattaagaaaaggttcccttg

SEQ ID NO: 103145 - DNA, 40 bp, Artificial Sequence
  Description of Artificial Sequence: Synthetic oligonucleotide
gttgaggactatggaatggaattaagaaaaggttcccttg

SEQ ID NO: 103146 - DNA, 41 bp, Artificial Sequence
  Description of Artificial Sequence: Synthetic oligonucleotide
ttgaggactatggaatggaattaagaaaaggttcccttgag

SEQ ID NO: 103147 - DNA, 40 bp, Artificial Sequence
  Description of Artificial Sequence: Synthetic oligonucleotide
tgaggactatggaatggaattaagaaaaggttcccttgag

SEQ ID NO: 103148 - DNA, 39 bp, Artificial Sequence
  Description of Artificial Sequence: Synthetic oligonucleotide
gaggactatggaatggaattaagaaaaggttcccttgag

SEQ ID NO: 103149 - DNA, 40 bp, Artificial Sequence
  Description of Artificial Sequence: Synthetic oligonucleotide
aggactatggaatggaattaagaaaaggttcccttgagag

SEQ ID NO: 103150 - DNA, 39 bp, Artificial Sequence
  Description of Artificial Sequence: Synthetic oligonucleotide
ggactatggaatggaattaagaaaaggttcccttgagag

SEQ ID NO: 103151 - DNA, 40 bp, Artificial Sequence
  Description of Artificial Sequence: Synthetic oligonucleotide
gactatggaatggaattaagaaaaggttcccttgagagtc

SEQ ID NO: 103152 - DNA, 40 bp, Artificial Sequence
  Description of Artificial Sequence: Synthetic oligonucleotide
actatggaatggaattaagaaaaggttcccttgagagtcc

SEQ ID NO: 103153 - DNA, 39 bp, Artificial Sequence
  Description of Artificial Sequence: Synthetic oligonucleotide
ctatggaatggaattaagaaaaggttcccttgagagtcc

SEQ ID NO: 103154 - DNA, 40 bp, Artificial Sequence
  Description of Artificial Sequence: Synthetic oligonucleotide
tatggaatggaattaagaaaaggttcccttgagagtcctg

SEQ ID NO: 103155 - DNA, 39 bp, Artificial Sequence
  Description of Artificial Sequence: Synthetic oligonucleotide
atggaatggaattaagaaaaggttcccttgagagtcctg

SEQ ID NO: 103156 - DNA, 38 bp, Artificial Sequence
  Description of Artificial Sequence: Synthetic oligonucleotide
tggaatggaattaagaaaaggttcccttgagagtcctg

SEQ ID NO: 103157 - DNA, 37 bp, Artificial Sequence
  Description of Artificial Sequence: Synthetic oligonucleotide
ggaatggaattaagaaaaggttcccttgagagtcctg

SEQ ID NO: 103158 - DNA, 37 bp, Artificial Sequence
  Description of Artificial Sequence: Synthetic oligonucleotide
gaatggaattaagaaaaggttcccttgagagtcctgc

SEQ ID NO: 103159 - DNA, 39 bp, Artificial Sequence
  Description of Artificial Sequence: Synthetic oligonucleotide
aatggaattaagaaaaggttcccttgagagtcctgcaac

SEQ ID NO: 103160 - DNA, 38 bp, Artificial Sequence
  Description of Artificial Sequence: Synthetic oligonucleotide
atggaattaagaaaaggttcccttgagagtcctgcaac

SEQ ID NO: 103161 - DNA, 37 bp, Artificial Sequence
  Description of Artificial Sequence: Synthetic oligonucleotide
tggaattaagaaaaggttcccttgagagtcctgcaac

SEQ ID NO: 103162 - DNA, 36 bp, Artificial Sequence
  Description of Artificial Sequence: Synthetic oligonucleotide
ggaattaagaaaaggttcccttgagagtcctgcaac

SEQ ID NO: 103163 - DNA, 36 bp, Artificial Sequence
  Description of Artificial Sequence: Synthetic oligonucleotide
gaattaagaaaaggttcccttgagagtcctgcaacg

SEQ ID NO: 103164 - DNA, 36 bp, Artificial Sequence
  Description of Artificial Sequence: Synthetic oligonucleotide
aattaagaaaaggttcccttgagagtcctgcaacgg

SEQ ID NO: 103165 - DNA, 35 bp, Artificial Sequence
  Description of Artificial Sequence: Synthetic oligonucleotide
attaagaaaaggttcccttgagagtcctgcaacgg

SEQ ID NO: 103166 - DNA, 34 bp, Artificial Sequence
  Description of Artificial Sequence: Synthetic oligonucleotide
ttaagaaaaggttcccttgagagtcctgcaacgg

SEQ ID NO: 103167 - DNA, 33 bp, Artificial Sequence
  Description of Artificial Sequence: Synthetic oligonucleotide
taagaaaaggttcccttgagagtcctgcaacgg

SEQ ID NO: 103168 - DNA, 32 bp, Artificial Sequence
  Description of Artificial Sequence: Synthetic oligonucleotide
aagaaaaggttcccttgagagtcctgcaacgg

SEQ ID NO: 103169 - DNA, 31 bp, Artificial Sequence
  Description of Artificial Sequence: Synthetic oligonucleotide
agaaaaggttcccttgagagtcctgcaacgg

SEQ ID NO: 103170 - DNA, 30 bp, Artificial Sequence
  Description of Artificial Sequence: Synthetic oligonucleotide
gaaaaggttcccttgagagtcctgcaacgg

SEQ ID NO: 103171 - DNA, 32 bp, Artificial Sequence
  Description of Artificial Sequence: Synthetic oligonucleotide
aaaaggttcccttgagagtcctgcaacggatg

SEQ ID NO: 103172 - DNA, 31 bp, Artificial Sequence
  Description of Artificial Sequence: Synthetic oligonucleotide
aaaggttcccttgagagtcctgcaacggatg

SEQ ID NO: 103173 - DNA, 30 bp, Artificial Sequence
  Description of Artificial Sequence: Synthetic oligonucleotide
aaggttcccttgagagtcctgcaacggatg

SEQ ID NO: 103174 - DNA, 29 bp, Artificial Sequence
  Description of Artificial Sequence: Synthetic oligonucleotide
aggttcccttgagagtcctgcaacggatg

SEQ ID NO: 103175 - DNA, 28 bp, Artificial Sequence
  Description of Artificial Sequence: Synthetic oligonucleotide
ggttcccttgagagtcctgcaacggatg

SEQ ID NO: 103176 - DNA, 33 bp, Artificial Sequence
  Description of Artificial Sequence: Synthetic oligonucleotide
gttcccttgagagtcctgcaacggatgtttttg

SEQ ID NO: 103177 - DNA, 33 bp, Artificial Sequence
  Description of Artificial Sequence: Synthetic oligonucleotide
ttcccttgagagtcctgcaacggatgtttttgg

SEQ ID NO: 103178 - DNA, 32 bp, Artificial Sequence
  Description of Artificial Sequence: Synthetic oligonucleotide
tcccttgagagtcctgcaacggatgtttttgg

SEQ ID NO: 103179 - DNA, 31 bp, Artificial Sequence
  Description of Artificial Sequence: Synthetic oligonucleotide
cccttgagagtcctgcaacggatgtttttgg

SEQ ID NO: 103180 - DNA, 33 bp, Artificial Sequence
  Description of Artificial Sequence: Synthetic oligonucleotide
ccttgagagtcctgcaacggatgtttttggttc

SEQ ID NO: 103181 - DNA, 35 bp, Artificial Sequence
  Description of Artificial Sequence: Synthetic oligonucleotide
cttgagagtcctgcaacggatgtttttggttctac

SEQ ID NO: 103182 - DNA, 36 bp, Artificial Sequence
  Description of Artificial Sequence: Synthetic oligonucleotide
ttgagagtcctgcaacggatgtttttggttctacag

SEQ ID NO: 103183 - DNA, 35 bp, Artificial Sequence
  Description of Artificial Sequence: Synthetic oligonucleotide
tgagagtcctgcaacggatgtttttggttctacag

SEQ ID NO: 103184 - DNA, 34 bp, Artificial Sequence
  Description of Artificial Sequence: Synthetic oligonucleotide
gagagtcctgcaacggatgtttttggttctacag

SEQ ID NO: 103185 - DNA, 35 bp, Artificial Sequence
  Description of Artificial Sequence: Synthetic oligonucleotide
agagtcctgcaacggatgtttttggttctacagag

SEQ ID NO: 103186 - DNA, 34 bp, Artificial Sequence
  Description of Artificial Sequence: Synthetic oligonucleotide
gagtcctgcaacggatgtttttggttctacagag

SEQ ID NO: 103187 - DNA, 34 bp, Artificial Sequence
  Description of Artificial Sequence: Synthetic oligonucleotide
agtcctgcaacggatgtttttggttctacagagg

SEQ ID NO: 103188 - DNA, 33 bp, Artificial Sequence
  Description of Artificial Sequence: Synthetic oligonucleotide
gtcctgcaacggatgtttttggttctacagagg

SEQ ID NO: 103189 - DNA, 35 bp, Artificial Sequence
  Description of Artificial Sequence: Synthetic oligonucleotide
tcctgcaacggatgtttttggttctacagaggaag

SEQ ID NO: 103190 - DNA, 34 bp, Artificial Sequence
  Description of Artificial Sequence: Synthetic oligonucleotide
cctgcaacggatgtttttggttctacagaggaag

SEQ ID NO: 103191 - DNA, 34 bp, Artificial Sequence
  Description of Artificial Sequence: Synthetic oligonucleotide
ctgcaacggatgtttttggttctacagaggaagg

SEQ ID NO: 103192 - DNA, 35 bp, Artificial Sequence
  Description of Artificial Sequence: Synthetic oligonucleotide
tgcaacggatgtttttggttctacagaggaaggtg

SEQ ID NO: 103193 - DNA, 34 bp, Artificial Sequence
  Description of Artificial Sequence: Synthetic oligonucleotide
gcaacggatgtttttggttctacagaggaaggtg

SEQ ID NO: 103194 - DNA, 40 bp, Artificial Sequence
  Description of Artificial Sequence: Synthetic oligonucleotide
caacggatgtttttggttctacagaggaaggtgaaaaaag

SEQ ID NO: 103195 - DNA, 40 bp, Artificial Sequence
  Description of Artificial Sequence: Synthetic oligonucleotide
aacggatgtttttggttctacagaggaaggtgaaaaaagg

SEQ ID NO: 103196 - DNA, 39 bp, Artificial Sequence
  Description of Artificial Sequence: Synthetic oligonucleotide
acggatgtttttggttctacagaggaaggtgaaaaaagg

SEQ ID NO: 103197 - DNA, 38 bp, Artificial Sequence
  Description of Artificial Sequence: Synthetic oligonucleotide
cggatgtttttggttctacagaggaaggtgaaaaaagg

SEQ ID NO: 103198 - DNA, 39 bp, Artificial Sequence
  Description of Artificial Sequence: Synthetic oligonucleotide
ggatgtttttggttctacagaggaaggtgaaaaaaggtg

SEQ ID NO: 103199 - DNA, 39 bp, Artificial Sequence
  Description of Artificial Sequence: Synthetic oligonucleotide
gatgtttttggttctacagaggaaggtgaaaaaaggtgg

SEQ ID NO: 103200 - DNA, 42 bp, Artificial Sequence
  Description of Artificial Sequence: Synthetic oligonucleotide
atgtttttggttctacagaggaaggtgaaaaaaggtggaaag

SEQ ID NO: 103201 - DNA, 41 bp, Artificial Sequence
  Description of Artificial Sequence: Synthetic oligonucleotide
tgtttttggttctacagaggaaggtgaaaaaaggtggaaag

SEQ ID NO: 103202 - DNA, 40 bp, Artificial Sequence
  Description of Artificial Sequence: Synthetic oligonucleotide
gtttttggttctacagaggaaggtgaaaaaaggtggaaag

SEQ ID NO: 103203 - DNA, 41 bp, Artificial Sequence
  Description of Artificial Sequence: Synthetic oligonucleotide
tttttggttctacagaggaaggtgaaaaaaggtggaaagac

SEQ ID NO: 103204 - DNA, 40 bp, Artificial Sequence
  Description of Artificial Sequence: Synthetic oligonucleotide
ttttggttctacagaggaaggtgaaaaaaggtggaaagac

SEQ ID NO: 103205 - DNA, 39 bp, Artificial Sequence
  Description of Artificial Sequence: Synthetic oligonucleotide
tttggttctacagaggaaggtgaaaaaaggtggaaagac

SEQ ID NO: 103206 - DNA, 38 bp, Artificial Sequence
  Description of Artificial Sequence: Synthetic oligonucleotide
ttggttctacagaggaaggtgaaaaaaggtggaaagac

SEQ ID NO: 103207 - DNA, 37 bp, Artificial Sequence
  Description of Artificial Sequence: Synthetic oligonucleotide
tggttctacagaggaaggtgaaaaaaggtggaaagac

SEQ ID NO: 103208 - DNA, 36 bp, Artificial Sequence
  Description of Artificial Sequence: Synthetic oligonucleotide
ggttctacagaggaaggtgaaaaaaggtggaaagac

SEQ ID NO: 103209 - DNA, 38 bp, Artificial Sequence
  Description of Artificial Sequence: Synthetic oligonucleotide
gttctacagaggaaggtgaaaaaaggtggaaagacttg

SEQ ID NO: 103210 - DNA, 40 bp, Artificial Sequence
  Description of Artificial Sequence: Synthetic oligonucleotide
ttctacagaggaaggtgaaaaaaggtggaaagacttgaag

SEQ ID NO: 103211 - DNA, 39 bp, Artificial Sequence
  Description of Artificial Sequence: Synthetic oligonucleotide
tctacagaggaaggtgaaaaaaggtggaaagacttgaag

SEQ ID NO: 103212 - DNA, 38 bp, Artificial Sequence
  Description of Artificial Sequence: Synthetic oligonucleotide
ctacagaggaaggtgaaaaaaggtggaaagacttgaag

SEQ ID NO: 103213 - DNA, 40 bp, Artificial Sequence
  Description of Artificial Sequence: Synthetic oligonucleotide
tacagaggaaggtgaaaaaaggtggaaagacttgaagaac

SEQ ID NO: 103214 - DNA, 39 bp, Artificial Sequence
  Description of Artificial Sequence: Synthetic oligonucleotide
acagaggaaggtgaaaaaaggtggaaagacttgaagaac

SEQ ID NO: 103215 - DNA, 38 bp, Artificial Sequence
  Description of Artificial Sequence: Synthetic oligonucleotide
cagaggaaggtgaaaaaaggtggaaagacttgaagaac

SEQ ID NO: 103216 - DNA, 39 bp, Artificial Sequence
  Description of Artificial Sequence: Synthetic oligonucleotide
agaggaaggtgaaaaaaggtggaaagacttgaagaacag

SEQ ID NO: 103217 - DNA, 38 bp, Artificial Sequence
  Description of Artificial Sequence: Synthetic oligonucleotide
gaggaaggtgaaaaaaggtggaaagacttgaagaacag

SEQ ID NO: 103218 - DNA, 39 bp, Artificial Sequence
  Description of Artificial Sequence: Synthetic oligonucleotide
aggaaggtgaaaaaaggtggaaagacttgaagaacagag

SEQ ID NO: 103219 - DNA, 38 bp, Artificial Sequence
  Description of Artificial Sequence: Synthetic oligonucleotide
ggaaggtgaaaaaaggtggaaagacttgaagaacagag

SEQ ID NO: 103220 - DNA, 40 bp, Artificial Sequence
  Description of Artificial Sequence: Synthetic oligonucleotide
gaaggtgaaaaaaggtggaaagacttgaagaacagagttg

SEQ ID NO: 103221 - DNA, 42 bp, Artificial Sequence
  Description of Artificial Sequence: Synthetic oligonucleotide
aaggtgaaaaaaggtggaaagacttgaagaacagagttgttg

SEQ ID NO: 103222 - DNA, 41 bp, Artificial Sequence
  Description of Artificial Sequence: Synthetic oligonucleotide
aggtgaaaaaaggtggaaagacttgaagaacagagttgttg

SEQ ID NO: 103223 - DNA, 40 bp, Artificial Sequence
  Description of Artificial Sequence: Synthetic oligonucleotide
ggtgaaaaaaggtggaaagacttgaagaacagagttgttg

SEQ ID NO: 103224 - DNA, 42 bp, Artificial Sequence
  Description of Artificial Sequence: Synthetic oligonucleotide
gtgaaaaaaggtggaaagacttgaagaacagagttgttgaac

SEQ ID NO: 103225 - DNA, 51 bp, Artificial Sequence
  Description of Artificial Sequence: Synthetic oligonucleotide
tgaaaaaaggtggaaagacttgaagaacagagttgttgaacataatattag

SEQ ID NO: 103226 - DNA, 50 bp, Artificial Sequence
  Description of Artificial Sequence: Synthetic oligonucleotide
gaaaaaaggtggaaagacttgaagaacagagttgttgaacataatattag

SEQ ID NO: 103227 - DNA, 56 bp, Artificial Sequence
  Description of Artificial Sequence: Synthetic oligonucleotide
aaaaaaggtggaaagacttgaagaacagagttgttgaacataatattagaataatg

SEQ ID NO: 103228 - DNA, 55 bp, Artificial Sequence
  Description of Artificial Sequence: Synthetic oligonucleotide
aaaaaggtggaaagacttgaagaacagagttgttgaacataatattagaataatg

SEQ ID NO: 103229 - DNA, 54 bp, Artificial Sequence
  Description of Artificial Sequence: Synthetic oligonucleotide
aaaaggtggaaagacttgaagaacagagttgttgaacataatattagaataatg

SEQ ID NO: 103230 - DNA, 53 bp, Artificial Sequence
  Description of Artificial Sequence: Synthetic oligonucleotide
aaaggtggaaagacttgaagaacagagttgttgaacataatattagaataatg

SEQ ID NO: 103231 - DNA, 52 bp, Artificial Sequence
  Description of Artificial Sequence: Synthetic oligonucleotide
aaggtggaaagacttgaagaacagagttgttgaacataatattagaataatg

SEQ ID NO: 103232 - DNA, 51 bp, Artificial Sequence
  Description of Artificial Sequence: Synthetic oligonucleotide
aggtggaaagacttgaagaacagagttgttgaacataatattagaataatg

SEQ ID NO: 103233 - DNA, 50 bp, Artificial Sequence
  Description of Artificial Sequence: Synthetic oligonucleotide
ggtggaaagacttgaagaacagagttgttgaacataatattagaataatg

SEQ ID NO: 103234 - DNA, 50 bp, Artificial Sequence
  Description of Artificial Sequence: Synthetic oligonucleotide
gtggaaagacttgaagaacagagttgttgaacataatattagaataatgg

SEQ ID NO: 103235 - DNA, 50 bp, Artificial Sequence
  Description of Artificial Sequence: Synthetic oligonucleotide
tggaaagacttgaagaacagagttgttgaacataatattagaataatggc

SEQ ID NO: 103236 - DNA, 49 bp, Artificial Sequence
  Description of Artificial Sequence: Synthetic oligonucleotide
ggaaagacttgaagaacagagttgttgaacataatattagaataatggc

SEQ ID NO: 103237 - DNA, 49 bp, Artificial Sequence
  Description of Artificial Sequence: Synthetic oligonucleotide
gaaagacttgaagaacagagttgttgaacataatattagaataatggcc

SEQ ID NO: 103238 - DNA, 51 bp, Artificial Sequence
  Description of Artificial Sequence: Synthetic oligonucleotide
aaagacttgaagaacagagttgttgaacataatattagaataatggccaag

SEQ ID NO: 103239 - DNA, 50 bp, Artificial Sequence
  Description of Artificial Sequence: Synthetic oligonucleotide
aagacttgaagaacagagttgttgaacataatattagaataatggccaag

SEQ ID NO: 103240 - DNA, 49 bp, Artificial Sequence
  Description of Artificial Sequence: Synthetic oligonucleotide
agacttgaagaacagagttgttgaacataatattagaataatggccaag

SEQ ID NO: 103241 - DNA, 48 bp, Artificial Sequence
  Description of Artificial Sequence: Synthetic oligonucleotide
gacttgaagaacagagttgttgaacataatattagaataatggccaag

SEQ ID NO: 103242 - DNA, 55 bp, Artificial Sequence
  Description of Artificial Sequence: Synthetic oligonucleotide
acttgaagaacagagttgttgaacataatattagaataatggccaagtattatac

SEQ ID NO: 103243 - DNA, 54 bp, Artificial Sequence
  Description of Artificial Sequence: Synthetic oligonucleotide
cttgaagaacagagttgttgaacataatattagaataatggccaagtattatac

SEQ ID NO: 103244 - DNA, 55 bp, Artificial Sequence
  Description of Artificial Sequence: Synthetic oligonucleotide
ttgaagaacagagttgttgaacataatattagaataatggccaagtattatactc

SEQ ID NO: 103245 - DNA, 54 bp, Artificial Sequence
  Description of Artificial Sequence: Synthetic oligonucleotide
tgaagaacagagttgttgaacataatattagaataatggccaagtattatactc

SEQ ID NO: 103246 - DNA, 53 bp, Artificial Sequence
  Description of Artificial Sequence: Synthetic oligonucleotide
gaagaacagagttgttgaacataatattagaataatggccaagtattatactc

SEQ ID NO: 103247 - DNA, 53 bp, Artificial Sequence
  Description of Artificial Sequence: Synthetic oligonucleotide
aagaacagagttgttgaacataatattagaataatggccaagtattatactcg

SEQ ID NO: 103248 - DNA, 52 bp, Artificial Sequence
  Description of Artificial Sequence: Synthetic oligonucleotide
agaacagagttgttgaacataatattagaataatggccaagtattatactcg

SEQ ID NO: 103249 - DNA, 51 bp, Artificial Sequence
  Description of Artificial Sequence: Synthetic oligonucleotide
gaacagagttgttgaacataatattagaataatggccaagtattatactcg

SEQ ID NO: 103250 - DNA, 51 bp, Artificial Sequence
  Description of Artificial Sequence: Synthetic oligonucleotide
aacagagttgttgaacataatattagaataatggccaagtattatactcgg

SEQ ID NO: 103251 - DNA, 50 bp, Artificial Sequence
  Description of Artificial Sequence: Synthetic oligonucleotide
acagagttgttgaacataatattagaataatggccaagtattatactcgg

SEQ ID NO: 103252 - DNA, 49 bp, Artificial Sequence
  Description of Artificial Sequence: Synthetic oligonucleotide
cagagttgttgaacataatattagaataatggccaagtattatactcgg

SEQ ID NO: 103253 - DNA, 53 bp, Artificial Sequence
  Description of Artificial Sequence: Synthetic oligonucleotide
agagttgttgaacataatattagaataatggccaagtattatactcggataac

SEQ ID NO: 103254 - DNA, 52 bp, Artificial Sequence
  Description of Artificial Sequence: Synthetic oligonucleotide
gagttgttgaacataatattagaataatggccaagtattatactcggataac

SEQ ID NO: 103255 - DNA, 55 bp, Artificial Sequence
  Description of Artificial Sequence: Synthetic oligonucleotide
agttgttgaacataatattagaataatggccaagtattatactcggataacaatg

SEQ ID NO: 103256 - DNA, 54 bp, Artificial Sequence
  Description of Artificial Sequence: Synthetic oligonucleotide
gttgttgaacataatattagaataatggccaagtattatactcggataacaatg

SEQ ID NO: 103257 - DNA, 58 bp, Artificial Sequence
  Description of Artificial Sequence: Synthetic oligonucleotide
ttgttgaacataatattagaataatggccaagtattatactcggataacaatgaaaag

SEQ ID NO: 103258 - DNA, 57 bp, Artificial Sequence
  Description of Artificial Sequence: Synthetic oligonucleotide
tgttgaacataatattagaataatggccaagtattatactcggataacaatgaaaag

SEQ ID NO: 103259 - DNA, 56 bp, Artificial Sequence
  Description of Artificial Sequence: Synthetic oligonucleotide
gttgaacataatattagaataatggccaagtattatactcggataacaatgaaaag

SEQ ID NO: 103260 - DNA, 56 bp, Artificial Sequence
  Description of Artificial Sequence: Synthetic oligonucleotide
ttgaacataatattagaataatggccaagtattatactcggataacaatgaaaagg

SEQ ID NO: 103261 - DNA, 55 bp, Artificial Sequence
  Description of Artificial Sequence: Synthetic oligonucleotide
tgaacataatattagaataatggccaagtattatactcggataacaatgaaaagg

SEQ ID NO: 103262 - DNA, 54 bp, Artificial Sequence
  Description of Artificial Sequence: Synthetic oligonucleotide
gaacataatattagaataatggccaagtattatactcggataacaatgaaaagg

SEQ ID NO: 103263 - DNA, 56 bp, Artificial Sequence
  Description of Artificial Sequence: Synthetic oligonucleotide
aacataatattagaataatggccaagtattatactcggataacaatgaaaaggatg

SEQ ID NO: 103264 - DNA, 55 bp, Artificial Sequence
  Description of Artificial Sequence: Synthetic oligonucleotide
acataatattagaataatggccaagtattatactcggataacaatgaaaaggatg

SEQ ID NO: 103265 - DNA, 54 bp, Artificial Sequence
  Description of Artificial Sequence: Synthetic oligonucleotide
cataatattagaataatggccaagtattatactcggataacaatgaaaaggatg

SEQ ID NO: 103266 - DNA, 54 bp, Artificial Sequence
  Description of Artificial Sequence: Synthetic oligonucleotide
ataatattagaataatggccaagtattatactcggataacaatgaaaaggatgg

SEQ ID NO: 103267 - DNA, 53 bp, Artificial Sequence
  Description of Artificial Sequence: Synthetic oligonucleotide
taatattagaataatggccaagtattatactcggataacaatgaaaaggatgg

SEQ ID NO: 103268 - DNA, 52 bp, Artificial Sequence
  Description of Artificial Sequence: Synthetic oligonucleotide
aatattagaataatggccaagtattatactcggataacaatgaaaaggatgg

SEQ ID NO: 103269 - DNA, 51 bp, Artificial Sequence
  Description of Artificial Sequence: Synthetic oligonucleotide
atattagaataatggccaagtattatactcggataacaatgaaaaggatgg

SEQ ID NO: 103270 - DNA, 50 bp, Artificial Sequence
  Description of Artificial Sequence: Synthetic oligonucleotide
tattagaataatggccaagtattatactcggataacaatgaaaaggatgg

SEQ ID NO: 103271 - DNA, 49 bp, Artificial Sequence
  Description of Artificial Sequence: Synthetic oligonucleotide
attagaataatggccaagtattatactcggataacaatgaaaaggatgg

SEQ ID NO: 103272 - DNA, 48 bp, Artificial Sequence
  Description of Artificial Sequence: Synthetic oligonucleotide
ttagaataatggccaagtattatactcggataacaatgaaaaggatgg

SEQ ID NO: 103273 - DNA, 47 bp, Artificial Sequence
  Description of Artificial Sequence: Synthetic oligonucleotide
tagaataatggccaagtattatactcggataacaatgaaaaggatgg

SEQ ID NO: 103274 - DNA, 46 bp, Artificial Sequence
  Description of Artificial Sequence: Synthetic oligonucleotide
agaataatggccaagtattatactcggataacaatgaaaaggatgg

SEQ ID NO: 103275 - DNA, 45 bp, Artificial Sequence
  Description of Artificial Sequence: Synthetic oligonucleotide
gaataatggccaagtattatactcggataacaatgaaaaggatgg

SEQ ID NO: 103276 - DNA, 45 bp, Artificial Sequence
  Description of Artificial Sequence: Synthetic oligonucleotide
aataatggccaagtattatactcggataacaatgaaaaggatggc

SEQ ID NO: 103277 - DNA, 44 bp, Artificial Sequence
  Description of Artificial Sequence: Synthetic oligonucleotide
ataatggccaagtattatactcggataacaatgaaaaggatggc

SEQ ID NO: 103278 - DNA, 43 bp, Artificial Sequence
  Description of Artificial Sequence: Synthetic oligonucleotide
taatggccaagtattatactcggataacaatgaaaaggatggc

SEQ ID NO: 103279 - DNA, 42 bp, Artificial Sequence
  Description of Artificial Sequence: Synthetic oligonucleotide
aatggccaagtattatactcggataacaatgaaaaggatggc

SEQ ID NO: 103280 - DNA, 41 bp, Artificial Sequence
  Description of Artificial Sequence: Synthetic oligonucleotide
atggccaagtattatactcggataacaatgaaaaggatggc

SEQ ID NO: 103281 - DNA, 40 bp, Artificial Sequence
  Description of Artificial Sequence: Synthetic oligonucleotide
tggccaagtattatactcggataacaatgaaaaggatggc

SEQ ID NO: 103282 - DNA, 39 bp, Artificial Sequence
  Description of Artificial Sequence: Synthetic oligonucleotide
ggccaagtattatactcggataacaatgaaaaggatggc

SEQ ID NO: 103283 - DNA, 40 bp, Artificial Sequence
  Description of Artificial Sequence: Synthetic oligonucleotide
gccaagtattatactcggataacaatgaaaaggatggcac

SEQ ID NO: 103284 - DNA, 41 bp, Artificial Sequence
  Description of Artificial Sequence: Synthetic oligonucleotide
ccaagtattatactcggataacaatgaaaaggatggcacag

SEQ ID NO: 103285 - DNA, 41 bp, Artificial Sequence
  Description of Artificial Sequence: Synthetic oligonucleotide
caagtattatactcggataacaatgaaaaggatggcacagc

SEQ ID NO: 103286 - DNA, 43 bp, Artificial Sequence
  Description of Artificial Sequence: Synthetic oligonucleotide
aagtattatactcggataacaatgaaaaggatggcacagcttc

SEQ ID NO: 103287 - DNA, 42 bp, Artificial Sequence
  Description of Artificial Sequence: Synthetic oligonucleotide
agtattatactcggataacaatgaaaaggatggcacagcttc

SEQ ID NO: 103288 - DNA, 41 bp, Artificial Sequence
  Description of Artificial Sequence: Synthetic oligonucleotide
gtattatactcggataacaatgaaaaggatggcacagcttc

SEQ ID NO: 103289 - DNA, 42 bp, Artificial Sequence
  Description of Artificial Sequence: Synthetic oligonucleotide
tattatactcggataacaatgaaaaggatggcacagcttctg

SEQ ID NO: 103290 - DNA, 41 bp, Artificial Sequence
  Description of Artificial Sequence: Synthetic oligonucleotide
attatactcggataacaatgaaaaggatggcacagcttctg

SEQ ID NO: 103291 - DNA, 40 bp, Artificial Sequence
  Description of Artificial Sequence: Synthetic oligonucleotide
ttatactcggataacaatgaaaaggatggcacagcttctg

SEQ ID NO: 103292 - DNA, 39 bp, Artificial Sequence
  Description of Artificial Sequence: Synthetic oligonucleotide
tatactcggataacaatgaaaaggatggcacagcttctg

SEQ ID NO: 103293 - DNA, 38 bp, Artificial Sequence
  Description of Artificial Sequence: Synthetic oligonucleotide
atactcggataacaatgaaaaggatggcacagcttctg

SEQ ID NO: 103294 - DNA, 37 bp, Artificial Sequence
  Description of Artificial Sequence: Synthetic oligonucleotide
tactcggataacaatgaaaaggatggcacagcttctg

SEQ ID NO: 103295 - DNA, 36 bp, Artificial Sequence
  Description of Artificial Sequence: Synthetic oligonucleotide
actcggataacaatgaaaaggatggcacagcttctg

SEQ ID NO: 103296 - DNA, 35 bp, Artificial Sequence
  Description of Artificial Sequence: Synthetic oligonucleotide
ctcggataacaatgaaaaggatggcacagcttctg

SEQ ID NO: 103297 - DNA, 35 bp, Artificial Sequence
  Description of Artificial Sequence: Synthetic oligonucleotide
tcggataacaatgaaaaggatggcacagcttctgg

SEQ ID NO: 103298 - DNA, 34 bp, Artificial Sequence
  Description of Artificial Sequence: Synthetic oligonucleotide
cggataacaatgaaaaggatggcacagcttctgg

SEQ ID NO: 103299 - DNA, 36 bp, Artificial Sequence
  Description of Artificial Sequence: Synthetic oligonucleotide
ggataacaatgaaaaggatggcacagcttctggatc

SEQ ID NO: 103300 - DNA, 39 bp, Artificial Sequence
  Description of Artificial Sequence: Synthetic oligonucleotide
gataacaatgaaaaggatggcacagcttctggatctatc

SEQ ID NO: 103301 - DNA, 40 bp, Artificial Sequence
  Description of Artificial Sequence: Synthetic oligonucleotide
ataacaatgaaaaggatggcacagcttctggatctatctg

SEQ ID NO: 103302 - DNA, 39 bp, Artificial Sequence
  Description of Artificial Sequence: Synthetic oligonucleotide
taacaatgaaaaggatggcacagcttctggatctatctg

SEQ ID NO: 103303 - DNA, 38 bp, Artificial Sequence
  Description of Artificial Sequence: Synthetic oligonucleotide
aacaatgaaaaggatggcacagcttctggatctatctg

SEQ ID NO: 103304 - DNA, 37 bp, Artificial Sequence
  Description of Artificial Sequence: Synthetic oligonucleotide
acaatgaaaaggatggcacagcttctggatctatctg

SEQ ID NO: 103305 - DNA, 36 bp, Artificial Sequence
  Description of Artificial Sequence: Synthetic oligonucleotide
caatgaaaaggatggcacagcttctggatctatctg

SEQ ID NO: 103306 - DNA, 38 bp, Artificial Sequence
  Description of Artificial Sequence: Synthetic oligonucleotide
aatgaaaaggatggcacagcttctggatctatctgttg

SEQ ID NO: 103307 - DNA, 37 bp, Artificial Sequence
  Description of Artificial Sequence: Synthetic oligonucleotide
atgaaaaggatggcacagcttctggatctatctgttg

SEQ ID NO: 103308 - DNA, 36 bp, Artificial Sequence
  Description of Artificial Sequence: Synthetic oligonucleotide
tgaaaaggatggcacagcttctggatctatctgttg

SEQ ID NO: 103309 - DNA, 35 bp, Artificial Sequence
  Description of Artificial Sequence: Synthetic oligonucleotide
gaaaaggatggcacagcttctggatctatctgttg

SEQ ID NO: 103310 - DNA, 37 bp, Artificial Sequence
  Description of Artificial Sequence: Synthetic oligonucleotide
aaaaggatggcacagcttctggatctatctgttgatg

SEQ ID NO: 103311 - DNA, 36 bp, Artificial Sequence
  Description of Artificial Sequence: Synthetic oligonucleotide
aaaggatggcacagcttctggatctatctgttgatg

SEQ ID NO: 103312 - DNA, 35 bp, Artificial Sequence
  Description of Artificial Sequence: Synthetic oligonucleotide
aaggatggcacagcttctggatctatctgttgatg

SEQ ID NO: 103313 - DNA, 34 bp, Artificial Sequence
  Description of Artificial Sequence: Synthetic oligonucleotide
aggatggcacagcttctggatctatctgttgatg

SEQ ID NO: 103314 - DNA, 33 bp, Artificial Sequence
  Description of Artificial Sequence: Synthetic oligonucleotide
ggatggcacagcttctggatctatctgttgatg

SEQ ID NO: 103315 - DNA, 34 bp, Artificial Sequence
  Description of Artificial Sequence: Synthetic oligonucleotide
gatggcacagcttctggatctatctgttgatgag

SEQ ID NO: 103316 - DNA, 35 bp, Artificial Sequence
  Description of Artificial Sequence: Synthetic oligonucleotide
atggcacagcttctggatctatctgttgatgagtc

SEQ ID NO: 103317 - DNA, 34 bp, Artificial Sequence
  Description of Artificial Sequence: Synthetic oligonucleotide
tggcacagcttctggatctatctgttgatgagtc

SEQ ID NO: 103318 - DNA, 33 bp, Artificial Sequence
  Description of Artificial Sequence: Synthetic oligonucleotide
ggcacagcttctggatctatctgttgatgagtc

SEQ ID NO: 103319 - DNA, 33 bp, Artificial Sequence
  Description of Artificial Sequence: Synthetic oligonucleotide
gcacagcttctggatctatctgttgatgagtcc

SEQ ID NO: 103320 - DNA, 33 bp, Artificial Sequence
  Description of Artificial Sequence: Synthetic oligonucleotide
cacagcttctggatctatctgttgatgagtccg

SEQ ID NO: 103321 - DNA, 35 bp, Artificial Sequence
  Description of Artificial Sequence: Synthetic oligonucleotide
acagcttctggatctatctgttgatgagtccgaag

SEQ ID NO: 103322 - DNA, 34 bp, Artificial Sequence
  Description of Artificial Sequence: Synthetic oligonucleotide
cagcttctggatctatctgttgatgagtccgaag

SEQ ID NO: 103323 - DNA, 34 bp, Artificial Sequence
  Description of Artificial Sequence: Synthetic oligonucleotide
agcttctggatctatctgttgatgagtccgaagc

SEQ ID NO: 103324 - DNA, 33 bp, Artificial Sequence
  Description of Artificial Sequence: Synthetic oligonucleotide
gcttctggatctatctgttgatgagtccgaagc

SEQ ID NO: 103325 - DNA, 33 bp, Artificial Sequence
  Description of Artificial Sequence: Synthetic oligonucleotide
cttctggatctatctgttgatgagtccgaagcc

SEQ ID NO: 103326 - DNA, 36 bp, Artificial Sequence
  Description of Artificial Sequence: Synthetic oligonucleotide
ttctggatctatctgttgatgagtccgaagcctttc

SEQ ID NO: 103327 - DNA, 35 bp, Artificial Sequence
  Description of Artificial Sequence: Synthetic oligonucleotide
tctggatctatctgttgatgagtccgaagcctttc

SEQ ID NO: 103328 - DNA, 34 bp, Artificial Sequence
  Description of Artificial Sequence: Synthetic oligonucleotide
ctggatctatctgttgatgagtccgaagcctttc

SEQ ID NO: 103329 - DNA, 35 bp, Artificial Sequence
  Description of Artificial Sequence: Synthetic oligonucleotide
tggatctatctgttgatgagtccgaagcctttctc

SEQ ID NO: 103330 - DNA, 34 bp, Artificial Sequence
  Description of Artificial Sequence: Synthetic oligonucleotide
ggatctatctgttgatgagtccgaagcctttctc

SEQ ID NO: 103331 - DNA, 35 bp, Artificial Sequence
  Description of Artificial Sequence: Synthetic oligonucleotide
gatctatctgttgatgagtccgaagcctttctctc

SEQ ID NO: 103332 - DNA, 39 bp, Artificial Sequence
  Description of Artificial Sequence: Synthetic oligonucleotide
atctatctgttgatgagtccgaagcctttctctcaaatc

SEQ ID NO: 103333 - DNA, 38 bp, Artificial Sequence
  Description of Artificial Sequence: Synthetic oligonucleotide
tctatctgttgatgagtccgaagcctttctctcaaatc

SEQ ID NO: 103334 - DNA, 37 bp, Artificial Sequence
  Description of Artificial Sequence: Synthetic oligonucleotide
ctatctgttgatgagtccgaagcctttctctcaaatc

SEQ ID NO: 103335 - DNA, 39 bp, Artificial Sequence
  Description of Artificial Sequence: Synthetic oligonucleotide
tatctgttgatgagtccgaagcctttctctcaaatctag

SEQ ID NO: 103336 - DNA, 38 bp, Artificial Sequence
  Description of Artificial Sequence: Synthetic oligonucleotide
atctgttgatgagtccgaagcctttctctcaaatctag

SEQ ID NO: 103337 - DNA, 37 bp, Artificial Sequence
  Description of Artificial Sequence: Synthetic oligonucleotide
tctgttgatgagtccgaagcctttctctcaaatctag

SEQ ID NO: 103338 - DNA, 36 bp, Artificial Sequence
  Description of Artificial Sequence: Synthetic oligonucleotide
ctgttgatgagtccgaagcctttctctcaaatctag

SEQ ID NO: 103339 - DNA, 38 bp, Artificial Sequence
  Description of Artificial Sequence: Synthetic oligonucleotide
tgttgatgagtccgaagcctttctctcaaatctagtag

SEQ ID NO: 103340 - DNA, 37 bp, Artificial Sequence
  Description of Artificial Sequence: Synthetic oligonucleotide
gttgatgagtccgaagcctttctctcaaatctagtag

SEQ ID NO: 103341 - DNA, 41 bp, Artificial Sequence
  Description of Artificial Sequence: Synthetic oligonucleotide
ttgatgagtccgaagcctttctctcaaatctagtagttaac

SEQ ID NO: 103342 - DNA, 40 bp, Artificial Sequence
  Description of Artificial Sequence: Synthetic oligonucleotide
tgatgagtccgaagcctttctctcaaatctagtagttaac

SEQ ID NO: 103343 - DNA, 39 bp, Artificial Sequence
  Description of Artificial Sequence: Synthetic oligonucleotide
gatgagtccgaagcctttctctcaaatctagtagttaac

SEQ ID NO: 103344 - DNA, 41 bp, Artificial Sequence
  Description of Artificial Sequence: Synthetic oligonucleotide
atgagtccgaagcctttctctcaaatctagtagttaacaag

SEQ ID NO: 103345 - DNA, 40 bp, Artificial Sequence
  Description of Artificial Sequence: Synthetic oligonucleotide
tgagtccgaagcctttctctcaaatctagtagttaacaag

SEQ ID NO: 103346 - DNA, 39 bp, Artificial Sequence
  Description of Artificial Sequence: Synthetic oligonucleotide
gagtccgaagcctttctctcaaatctagtagttaacaag

SEQ ID NO: 103347 - DNA, 40 bp, Artificial Sequence
  Description of Artificial Sequence: Synthetic oligonucleotide
agtccgaagcctttctctcaaatctagtagttaacaagac

SEQ ID NO: 103348 - DNA, 39 bp, Artificial Sequence
  Description of Artificial Sequence: Synthetic oligonucleotide
gtccgaagcctttctctcaaatctagtagttaacaagac

SEQ ID NO: 103349 - DNA, 39 bp, Artificial Sequence
  Description of Artificial Sequence: Synthetic oligonucleotide
tccgaagcctttctctcaaatctagtagttaacaagacc

SEQ ID NO: 103350 - DNA, 38 bp, Artificial Sequence
  Description of Artificial Sequence: Synthetic oligonucleotide
ccgaagcctttctctcaaatctagtagttaacaagacc

SEQ ID NO: 103351 - DNA, 40 bp, Artificial Sequence
  Description of Artificial Sequence: Synthetic oligonucleotide
cgaagcctttctctcaaatctagtagttaacaagaccatc

SEQ ID NO: 103352 - DNA, 43 bp, Artificial Sequence
  Description of Artificial Sequence: Synthetic oligonucleotide
gaagcctttctctcaaatctagtagttaacaagaccatctttg

SEQ ID NO: 103353 - DNA, 43 bp, Artificial Sequence
  Description of Artificial Sequence: Synthetic oligonucleotide
aagcctttctctcaaatctagtagttaacaagaccatctttgc

SEQ ID NO: 103354 - DNA, 42 bp, Artificial Sequence
  Description of Artificial Sequence: Synthetic oligonucleotide
agcctttctctcaaatctagtagttaacaagaccatctttgc

SEQ ID NO: 103355 - DNA, 41 bp, Artificial Sequence
  Description of Artificial Sequence: Synthetic oligonucleotide
gcctttctctcaaatctagtagttaacaagaccatctttgc

SEQ ID NO: 103356 - DNA, 45 bp, Artificial Sequence
  Description of Artificial Sequence: Synthetic oligonucleotide
cctttctctcaaatctagtagttaacaagaccatctttgctaaag

SEQ ID NO: 103357 - DNA, 47 bp, Artificial Sequence
  Description of Artificial Sequence: Synthetic oligonucleotide
ctttctctcaaatctagtagttaacaagaccatctttgctaaagtag

SEQ ID NO: 103358 - DNA, 48 bp, Artificial Sequence
  Description of Artificial Sequence: Synthetic oligonucleotide
tttctctcaaatctagtagttaacaagaccatctttgctaaagtagac

SEQ ID NO: 103359 - DNA, 47 bp, Artificial Sequence
  Description of Artificial Sequence: Synthetic oligonucleotide
ttctctcaaatctagtagttaacaagaccatctttgctaaagtagac

SEQ ID NO: 103360 - DNA, 46 bp, Artificial Sequence
  Description of Artificial Sequence: Synthetic oligonucleotide
tctctcaaatctagtagttaacaagaccatctttgctaaagtagac

SEQ ID NO: 103361 - DNA, 45 bp, Artificial Sequence
  Description of Artificial Sequence: Synthetic oligonucleotide
ctctcaaatctagtagttaacaagaccatctttgctaaagtagac

SEQ ID NO: 103362 - DNA, 46 bp, Artificial Sequence
  Description of Artificial Sequence: Synthetic oligonucleotide
tctcaaatctagtagttaacaagaccatctttgctaaagtagacag

SEQ ID NO: 103363 - DNA, 45 bp, Artificial Sequence
  Description of Artificial Sequence: Synthetic oligonucleotide
ctcaaatctagtagttaacaagaccatctttgctaaagtagacag

SEQ ID NO: 103364 - DNA, 49 bp, Artificial Sequence
  Description of Artificial Sequence: Synthetic oligonucleotide
tcaaatctagtagttaacaagaccatctttgctaaagtagacagattag

SEQ ID NO: 103365 - DNA, 48 bp, Artificial Sequence
  Description of Artificial Sequence: Synthetic oligonucleotide
caaatctagtagttaacaagaccatctttgctaaagtagacagattag

SEQ ID NO: 103366 - DNA, 48 bp, Artificial Sequence
  Description of Artificial Sequence: Synthetic oligonucleotide
aaatctagtagttaacaagaccatctttgctaaagtagacagattagc

SEQ ID NO: 103367 - DNA, 47 bp, Artificial Sequence
  Description of Artificial Sequence: Synthetic oligonucleotide
aatctagtagttaacaagaccatctttgctaaagtagacagattagc

SEQ ID NO: 103368 - DNA, 46 bp, Artificial Sequence
  Description of Artificial Sequence: Synthetic oligonucleotide
atctagtagttaacaagaccatctttgctaaagtagacagattagc

SEQ ID NO: 103369 - DNA, 45 bp, Artificial Sequence
  Description of Artificial Sequence: Synthetic oligonucleotide
tctagtagttaacaagaccatctttgctaaagtagacagattagc

SEQ ID NO: 103370 - DNA, 44 bp, Artificial Sequence
  Description of Artificial Sequence: Synthetic oligonucleotide
ctagtagttaacaagaccatctttgctaaagtagacagattagc

SEQ ID NO: 103371 - DNA, 45 bp, Artificial Sequence
  Description of Artificial Sequence: Synthetic oligonucleotide
tagtagttaacaagaccatctttgctaaagtagacagattagcag

SEQ ID NO: 103372 - DNA, 44 bp, Artificial Sequence
  Description of Artificial Sequence: Synthetic oligonucleotide
agtagttaacaagaccatctttgctaaagtagacagattagcag

SEQ ID NO: 103373 - DNA, 43 bp, Artificial Sequence
  Description of Artificial Sequence: Synthetic oligonucleotide
gtagttaacaagaccatctttgctaaagtagacagattagcag

SEQ ID NO: 103374 - DNA, 43 bp, Artificial Sequence
  Description of Artificial Sequence: Synthetic oligonucleotide
tagttaacaagaccatctttgctaaagtagacagattagcagg

SEQ ID NO: 103375 - DNA, 42 bp, Artificial Sequence
  Description of Artificial Sequence: Synthetic oligonucleotide
agttaacaagaccatctttgctaaagtagacagattagcagg

SEQ ID NO: 103376 - DNA, 41 bp, Artificial Sequence
  Description of Artificial Sequence: Synthetic oligonucleotide
gttaacaagaccatctttgctaaagtagacagattagcagg

SEQ ID NO: 103377 - DNA, 47 bp, Artificial Sequence
  Description of Artificial Sequence: Synthetic oligonucleotide
ttaacaagaccatctttgctaaagtagacagattagcaggaattatc

SEQ ID NO: 103378 - DNA, 46 bp, Artificial Sequence
  Description of Artificial Sequence: Synthetic oligonucleotide
taacaagaccatctttgctaaagtagacagattagcaggaattatc

SEQ ID NO: 103379 - DNA, 45 bp, Artificial Sequence
  Description of Artificial Sequence: Synthetic oligonucleotide
aacaagaccatctttgctaaagtagacagattagcaggaattatc

SEQ ID NO: 103380 - DNA, 44 bp, Artificial Sequence
  Description of Artificial Sequence: Synthetic oligonucleotide
acaagaccatctttgctaaagtagacagattagcaggaattatc

SEQ ID NO: 103381 - DNA, 43 bp, Artificial Sequence
  Description of Artificial Sequence: Synthetic oligonucleotide
caagaccatctttgctaaagtagacagattagcaggaattatc

SEQ ID NO: 103382 - DNA, 45 bp, Artificial Sequence
  Description of Artificial Sequence: Synthetic oligonucleotide
aagaccatctttgctaaagtagacagattagcaggaattatcaac

SEQ ID NO: 103383 - DNA, 44 bp, Artificial Sequence
  Description of Artificial Sequence: Synthetic oligonucleotide
agaccatctttgctaaagtagacagattagcaggaattatcaac

SEQ ID NO: 103384 - DNA, 43 bp, Artificial Sequence
  Description of Artificial Sequence: Synthetic oligonucleotide
gaccatctttgctaaagtagacagattagcaggaattatcaac

SEQ ID NO: 103385 - DNA, 45 bp, Artificial Sequence
  Description of Artificial Sequence: Synthetic oligonucleotide
accatctttgctaaagtagacagattagcaggaattatcaacttc

SEQ ID NO: 103386 - DNA, 44 bp, Artificial Sequence
  Description of Artificial Sequence: Synthetic oligonucleotide
ccatctttgctaaagtagacagattagcaggaattatcaacttc

SEQ ID NO: 103387 - DNA, 44 bp, Artificial Sequence
  Description of Artificial Sequence: Synthetic oligonucleotide
catctttgctaaagtagacagattagcaggaattatcaacttcc

SEQ ID NO: 103388 - DNA, 45 bp, Artificial Sequence
  Description of Artificial Sequence: Synthetic oligonucleotide
atctttgctaaagtagacagattagcaggaattatcaacttccag

SEQ ID NO: 103389 - DNA, 44 bp, Artificial Sequence
  Description of Artificial Sequence: Synthetic oligonucleotide
tctttgctaaagtagacagattagcaggaattatcaacttccag

SEQ ID NO: 103390 - DNA, 43 bp, Artificial Sequence
  Description of Artificial Sequence: Synthetic oligonucleotide
ctttgctaaagtagacagattagcaggaattatcaacttccag

SEQ ID NO: 103391 - DNA, 44 bp, Artificial Sequence
  Description of Artificial Sequence: Synthetic oligonucleotide
tttgctaaagtagacagattagcaggaattatcaacttccagag

SEQ ID NO: 103392 - DNA, 43 bp, Artificial Sequence
  Description of Artificial Sequence: Synthetic oligonucleotide
ttgctaaagtagacagattagcaggaattatcaacttccagag

SEQ ID NO: 103393 - DNA, 42 bp, Artificial Sequence
  Description of Artificial Sequence: Synthetic oligonucleotide
tgctaaagtagacagattagcaggaattatcaacttccagag

SEQ ID NO: 103394 - DNA, 41 bp, Artificial Sequence
  Description of Artificial Sequence: Synthetic oligonucleotide
gctaaagtagacagattagcaggaattatcaacttccagag

SEQ ID NO: 103395 - DNA, 42 bp, Artificial Sequence
  Description of Artificial Sequence: Synthetic oligonucleotide
ctaaagtagacagattagcaggaattatcaacttccagagac

SEQ ID NO: 103396 - DNA, 42 bp, Artificial Sequence
  Description of Artificial Sequence: Synthetic oligonucleotide
taaagtagacagattagcaggaattatcaacttccagagacc

SEQ ID NO: 103397 - DNA, 41 bp, Artificial Sequence
  Description of Artificial Sequence: Synthetic oligonucleotide
aaagtagacagattagcaggaattatcaacttccagagacc

SEQ ID NO: 103398 - DNA, 40 bp, Artificial Sequence
  Description of Artificial Sequence: Synthetic oligonucleotide
aagtagacagattagcaggaattatcaacttccagagacc

SEQ ID NO: 103399 - DNA, 39 bp, Artificial Sequence
  Description of Artificial Sequence: Synthetic oligonucleotide
agtagacagattagcaggaattatcaacttccagagacc

SEQ ID NO: 103400 - DNA, 38 bp, Artificial Sequence
  Description of Artificial Sequence: Synthetic oligonucleotide
gtagacagattagcaggaattatcaacttccagagacc

SEQ ID NO: 103401 - DNA, 38 bp, Artificial Sequence
  Description of Artificial Sequence: Synthetic oligonucleotide
tagacagattagcaggaattatcaacttccagagaccc

SEQ ID NO: 103402 - DNA, 37 bp, Artificial Sequence
  Description of Artificial Sequence: Synthetic oligonucleotide
agacagattagcaggaattatcaacttccagagaccc

SEQ ID NO: 103403 - DNA, 36 bp, Artificial Sequence
  Description of Artificial Sequence: Synthetic oligonucleotide
gacagattagcaggaattatcaacttccagagaccc

SEQ ID NO: 103404 - DNA, 38 bp, Artificial Sequence
  Description of Artificial Sequence: Synthetic oligonucleotide
acagattagcaggaattatcaacttccagagacccaag

SEQ ID NO: 103405 - DNA, 37 bp, Artificial Sequence
  Description of Artificial Sequence: Synthetic oligonucleotide
cagattagcaggaattatcaacttccagagacccaag

SEQ ID NO: 103406 - DNA, 37 bp, Artificial Sequence
  Description of Artificial Sequence: Synthetic oligonucleotide
agattagcaggaattatcaacttccagagacccaagg

SEQ ID NO: 103407 - DNA, 36 bp, Artificial Sequence
  Description of Artificial Sequence: Synthetic oligonucleotide
gattagcaggaattatcaacttccagagacccaagg

SEQ ID NO: 103408 - DNA, 38 bp, Artificial Sequence
  Description of Artificial Sequence: Synthetic oligonucleotide
attagcaggaattatcaacttccagagacccaaggatc

SEQ ID NO: 103409 - DNA, 37 bp, Artificial Sequence
  Description of Artificial Sequence: Synthetic oligonucleotide
ttagcaggaattatcaacttccagagacccaaggatc

SEQ ID NO: 103410 - DNA, 36 bp, Artificial Sequence
  Description of Artificial Sequence: Synthetic oligonucleotide
tagcaggaattatcaacttccagagacccaaggatc

SEQ ID NO: 103411 - DNA, 35 bp, Artificial Sequence
  Description of Artificial Sequence: Synthetic oligonucleotide
agcaggaattatcaacttccagagacccaaggatc

SEQ ID NO: 103412 - DNA, 34 bp, Artificial Sequence
  Description of Artificial Sequence: Synthetic oligonucleotide
gcaggaattatcaacttccagagacccaaggatc

SEQ ID NO: 103413 - DNA, 34 bp, Artificial Sequence
  Description of Artificial Sequence: Synthetic oligonucleotide
caggaattatcaacttccagagacccaaggatcc

SEQ ID NO: 103414 - DNA, 50 bp, Artificial Sequence
  Description of Artificial Sequence: Synthetic oligonucleotide
aggaattatcaacttccagagacccaaggatccaaataatttattaaatg

SEQ ID NO: 103415 - DNA, 49 bp, Artificial Sequence
  Description of Artificial Sequence: Synthetic oligonucleotide
ggaattatcaacttccagagacccaaggatccaaataatttattaaatg

SEQ ID NO: 103416 - DNA, 50 bp, Artificial Sequence
  Description of Artificial Sequence: Synthetic oligonucleotide
gaattatcaacttccagagacccaaggatccaaataatttattaaatgac

SEQ ID NO: 103417 - DNA, 51 bp, Artificial Sequence
  Description of Artificial Sequence: Synthetic oligonucleotide
aattatcaacttccagagacccaaggatccaaataatttattaaatgactg

SEQ ID NO: 103418 - DNA, 50 bp, Artificial Sequence
  Description of Artificial Sequence: Synthetic oligonucleotide
attatcaacttccagagacccaaggatccaaataatttattaaatgactg

SEQ ID NO: 103419 - DNA, 49 bp, Artificial Sequence
  Description of Artificial Sequence: Synthetic oligonucleotide
ttatcaacttccagagacccaaggatccaaataatttattaaatgactg

SEQ ID NO: 103420 - DNA, 48 bp, Artificial Sequence
  Description of Artificial Sequence: Synthetic oligonucleotide
tatcaacttccagagacccaaggatccaaataatttattaaatgactg

SEQ ID NO: 103421 - DNA, 47 bp, Artificial Sequence
  Description of Artificial Sequence: Synthetic oligonucleotide
atcaacttccagagacccaaggatccaaataatttattaaatgactg

SEQ ID NO: 103422 - DNA, 46 bp, Artificial Sequence
  Description of Artificial Sequence: Synthetic oligonucleotide
tcaacttccagagacccaaggatccaaataatttattaaatgactg

SEQ ID NO: 103423 - DNA, 45 bp, Artificial Sequence
  Description of Artificial Sequence: Synthetic oligonucleotide
caacttccagagacccaaggatccaaataatttattaaatgactg

SEQ ID NO: 103424 - DNA, 45 bp, Artificial Sequence
  Description of Artificial Sequence: Synthetic oligonucleotide
aacttccagagacccaaggatccaaataatttattaaatgactgg

SEQ ID NO: 103425 - DNA, 44 bp, Artificial Sequence
  Description of Artificial Sequence: Synthetic oligonucleotide
acttccagagacccaaggatccaaataatttattaaatgactgg

SEQ ID NO: 103426 - DNA, 43 bp, Artificial Sequence
  Description of Artificial Sequence: Synthetic oligonucleotide
cttccagagacccaaggatccaaataatttattaaatgactgg

SEQ ID NO: 103427 - DNA, 44 bp, Artificial Sequence
  Description of Artificial Sequence: Synthetic oligonucleotide
ttccagagacccaaggatccaaataatttattaaatgactggtc

SEQ ID NO: 103428 - DNA, 43 bp, Artificial Sequence
  Description of Artificial Sequence: Synthetic oligonucleotide
tccagagacccaaggatccaaataatttattaaatgactggtc

SEQ ID NO: 103429 - DNA, 42 bp, Artificial Sequence
  Description of Artificial Sequence: Synthetic oligonucleotide
ccagagacccaaggatccaaataatttattaaatgactggtc

SEQ ID NO: 103430 - DNA, 43 bp, Artificial Sequence
  Description of Artificial Sequence: Synthetic oligonucleotide
cagagacccaaggatccaaataatttattaaatgactggtctc

SEQ ID NO: 103431 - DNA, 44 bp, Artificial Sequence
  Description of Artificial Sequence: Synthetic oligonucleotide
agagacccaaggatccaaataatttattaaatgactggtctcag

SEQ ID NO: 103432 - DNA, 43 bp, Artificial Sequence
  Description of Artificial Sequence: Synthetic oligonucleotide
gagacccaaggatccaaataatttattaaatgactggtctcag

SEQ ID NO: 103433 - DNA, 46 bp, Artificial Sequence
  Description of Artificial Sequence: Synthetic oligonucleotide
agacccaaggatccaaataatttattaaatgactggtctcagaaac

SEQ ID NO: 103434 - DNA, 45 bp, Artificial Sequence
  Description of Artificial Sequence: Synthetic oligonucleotide
gacccaaggatccaaataatttattaaatgactggtctcagaaac

SEQ ID NO: 103435 - DNA, 46 bp, Artificial Sequence
  Description of Artificial Sequence: Synthetic oligonucleotide
acccaaggatccaaataatttattaaatgactggtctcagaaactg

SEQ ID NO: 103436 - DNA, 45 bp, Artificial Sequence
  Description of Artificial Sequence: Synthetic oligonucleotide
cccaaggatccaaataatttattaaatgactggtctcagaaactg

SEQ ID NO: 103437 - DNA, 47 bp, Artificial Sequence
  Description of Artificial Sequence: Synthetic oligonucleotide
ccaaggatccaaataatttattaaatgactggtctcagaaactgaac

SEQ ID NO: 103438 - DNA, 48 bp, Artificial Sequence
  Description of Artificial Sequence: Synthetic oligonucleotide
caaggatccaaataatttattaaatgactggtctcagaaactgaactc

SEQ ID NO: 103439 - DNA, 54 bp, Artificial Sequence
  Description of Artificial Sequence: Synthetic oligonucleotide
aaggatccaaataatttattaaatgactggtctcagaaactgaactcattaatg

SEQ ID NO: 103440 - DNA, 53 bp, Artificial Sequence
  Description of Artificial Sequence: Synthetic oligonucleotide
aggatccaaataatttattaaatgactggtctcagaaactgaactcattaatg

SEQ ID NO: 103441 - DNA, 52 bp, Artificial Sequence
  Description of Artificial Sequence: Synthetic oligonucleotide
ggatccaaataatttattaaatgactggtctcagaaactgaactcattaatg

SEQ ID NO: 103442 - DNA, 53 bp, Artificial Sequence
  Description of Artificial Sequence: Synthetic oligonucleotide
gatccaaataatttattaaatgactggtctcagaaactgaactcattaatgtc

SEQ ID NO: 103443 - DNA, 54 bp, Artificial Sequence
  Description of Artificial Sequence: Synthetic oligonucleotide
atccaaataatttattaaatgactggtctcagaaactgaactcattaatgtctc

SEQ ID NO: 103444 - DNA, 53 bp, Artificial Sequence
  Description of Artificial Sequence: Synthetic oligonucleotide
tccaaataatttattaaatgactggtctcagaaactgaactcattaatgtctc

SEQ ID NO: 103445 - DNA, 52 bp, Artificial Sequence
  Description of Artificial Sequence: Synthetic oligonucleotide
ccaaataatttattaaatgactggtctcagaaactgaactcattaatgtctc

SEQ ID NO: 103446 - DNA, 53 bp, Artificial Sequence
  Description of Artificial Sequence: Synthetic oligonucleotide
caaataatttattaaatgactggtctcagaaactgaactcattaatgtctctg

SEQ ID NO: 103447 - DNA, 53 bp, Artificial Sequence
  Description of Artificial Sequence: Synthetic oligonucleotide
aaataatttattaaatgactggtctcagaaactgaactcattaatgtctctgg

SEQ ID NO: 103448 - DNA, 52 bp, Artificial Sequence
  Description of Artificial Sequence: Synthetic oligonucleotide
aataatttattaaatgactggtctcagaaactgaactcattaatgtctctgg

SEQ ID NO: 103449 - DNA, 51 bp, Artificial Sequence
  Description of Artificial Sequence: Synthetic oligonucleotide
ataatttattaaatgactggtctcagaaactgaactcattaatgtctctgg

SEQ ID NO: 103450 - DNA, 50 bp, Artificial Sequence
  Description of Artificial Sequence: Synthetic oligonucleotide
taatttattaaatgactggtctcagaaactgaactcattaatgtctctgg

SEQ ID NO: 103451 - DNA, 49 bp, Artificial Sequence
  Description of Artificial Sequence: Synthetic oligonucleotide
aatttattaaatgactggtctcagaaactgaactcattaatgtctctgg

SEQ ID NO: 103452 - DNA, 48 bp, Artificial Sequence
  Description of Artificial Sequence: Synthetic oligonucleotide
atttattaaatgactggtctcagaaactgaactcattaatgtctctgg

SEQ ID NO: 103453 - DNA, 47 bp, Artificial Sequence
  Description of Artificial Sequence: Synthetic oligonucleotide
tttattaaatgactggtctcagaaactgaactcattaatgtctctgg

SEQ ID NO: 103454 - DNA, 46 bp, Artificial Sequence
  Description of Artificial Sequence: Synthetic oligonucleotide
ttattaaatgactggtctcagaaactgaactcattaatgtctctgg

SEQ ID NO: 103455 - DNA, 45 bp, Artificial Sequence
  Description of Artificial Sequence: Synthetic oligonucleotide
tattaaatgactggtctcagaaactgaactcattaatgtctctgg

SEQ ID NO: 103456 - DNA, 44 bp, Artificial Sequence
  Description of Artificial Sequence: Synthetic oligonucleotide
attaaatgactggtctcagaaactgaactcattaatgtctctgg

SEQ ID NO: 103457 - DNA, 43 bp, Artificial Sequence
  Description of Artificial Sequence: Synthetic oligonucleotide
ttaaatgactggtctcagaaactgaactcattaatgtctctgg

SEQ ID NO: 103458 - DNA, 42 bp, Artificial Sequence
  Description of Artificial Sequence: Synthetic oligonucleotide
taaatgactggtctcagaaactgaactcattaatgtctctgg

SEQ ID NO: 103459 - DNA, 41 bp, Artificial Sequence
  Description of Artificial Sequence: Synthetic oligonucleotide
aaatgactggtctcagaaactgaactcattaatgtctctgg

SEQ ID NO: 103460 - DNA, 40 bp, Artificial Sequence
  Description of Artificial Sequence: Synthetic oligonucleotide
aatgactggtctcagaaactgaactcattaatgtctctgg

SEQ ID NO: 103461 - DNA, 39 bp, Artificial Sequence
  Description of Artificial Sequence: Synthetic oligonucleotide
atgactggtctcagaaactgaactcattaatgtctctgg

SEQ ID NO: 103462 - DNA, 38 bp, Artificial Sequence
  Description of Artificial Sequence: Synthetic oligonucleotide
tgactggtctcagaaactgaactcattaatgtctctgg

SEQ ID NO: 103463 - DNA, 37 bp, Artificial Sequence
  Description of Artificial Sequence: Synthetic oligonucleotide
gactggtctcagaaactgaactcattaatgtctctgg

SEQ ID NO: 103464 - DNA, 41 bp, Artificial Sequence
  Description of Artificial Sequence: Synthetic oligonucleotide
actggtctcagaaactgaactcattaatgtctctggttaac

SEQ ID NO: 103465 - DNA, 40 bp, Artificial Sequence
  Description of Artificial Sequence: Synthetic oligonucleotide
ctggtctcagaaactgaactcattaatgtctctggttaac

SEQ ID NO: 103466 - DNA, 44 bp, Artificial Sequence
  Description of Artificial Sequence: Synthetic oligonucleotide
tggtctcagaaactgaactcattaatgtctctggttaacaaaac

SEQ ID NO: 103467 - DNA, 43 bp, Artificial Sequence
  Description of Artificial Sequence: Synthetic oligonucleotide
ggtctcagaaactgaactcattaatgtctctggttaacaaaac

SEQ ID NO: 103468 - DNA, 45 bp, Artificial Sequence
  Description of Artificial Sequence: Synthetic oligonucleotide
gtctcagaaactgaactcattaatgtctctggttaacaaaactac

SEQ ID NO: 103469 - DNA, 45 bp, Artificial Sequence
  Description of Artificial Sequence: Synthetic oligonucleotide
tctcagaaactgaactcattaatgtctctggttaacaaaactacg

SEQ ID NO: 103470 - DNA, 44 bp, Artificial Sequence
  Description of Artificial Sequence: Synthetic oligonucleotide
ctcagaaactgaactcattaatgtctctggttaacaaaactacg

SEQ ID NO: 103471 - DNA, 44 bp, Artificial Sequence
  Description of Artificial Sequence: Synthetic oligonucleotide
tcagaaactgaactcattaatgtctctggttaacaaaactacgc

SEQ ID NO: 103472 - DNA, 43 bp, Artificial Sequence
  Description of Artificial Sequence: Synthetic oligonucleotide
cagaaactgaactcattaatgtctctggttaacaaaactacgc

SEQ ID NO: 103473 - DNA, 45 bp, Artificial Sequence
  Description of Artificial Sequence: Synthetic oligonucleotide
agaaactgaactcattaatgtctctggttaacaaaactacgcatc

SEQ ID NO: 103474 - DNA, 44 bp, Artificial Sequence
  Description of Artificial Sequence: Synthetic oligonucleotide
gaaactgaactcattaatgtctctggttaacaaaactacgcatc

SEQ ID NO: 103475 - DNA, 45 bp, Artificial Sequence
  Description of Artificial Sequence: Synthetic oligonucleotide
aaactgaactcattaatgtctctggttaacaaaactacgcatctc

SEQ ID NO: 103476 - DNA, 44 bp, Artificial Sequence
  Description of Artificial Sequence: Synthetic oligonucleotide
aactgaactcattaatgtctctggttaacaaaactacgcatctc

SEQ ID NO: 103477 - DNA, 43 bp, Artificial Sequence
  Description of Artificial Sequence: Synthetic oligonucleotide
actgaactcattaatgtctctggttaacaaaactacgcatctc

SEQ ID NO: 103478 - DNA, 42 bp, Artificial Sequence
  Description of Artificial Sequence: Synthetic oligonucleotide
ctgaactcattaatgtctctggttaacaaaactacgcatctc

SEQ ID NO: 103479 - DNA, 45 bp, Artificial Sequence
  Description of Artificial Sequence: Synthetic oligonucleotide
tgaactcattaatgtctctggttaacaaaactacgcatctcatag

SEQ ID NO: 103480 - DNA, 44 bp, Artificial Sequence
  Description of Artificial Sequence: Synthetic oligonucleotide
gaactcattaatgtctctggttaacaaaactacgcatctcatag

SEQ ID NO: 103481 - DNA, 44 bp, Artificial Sequence
  Description of Artificial Sequence: Synthetic oligonucleotide
aactcattaatgtctctggttaacaaaactacgcatctcatagc

SEQ ID NO: 103482 - DNA, 43 bp, Artificial Sequence
  Description of Artificial Sequence: Synthetic oligonucleotide
actcattaatgtctctggttaacaaaactacgcatctcatagc

SEQ ID NO: 103483 - DNA, 42 bp, Artificial Sequence
  Description of Artificial Sequence: Synthetic oligonucleotide
ctcattaatgtctctggttaacaaaactacgcatctcatagc

SEQ ID NO: 103484 - DNA, 42 bp, Artificial Sequence
  Description of Artificial Sequence: Synthetic oligonucleotide
tcattaatgtctctggttaacaaaactacgcatctcatagcc

SEQ ID NO: 103485 - DNA, 41 bp, Artificial Sequence
  Description of Artificial Sequence: Synthetic oligonucleotide
cattaatgtctctggttaacaaaactacgcatctcatagcc

SEQ ID NO: 103486 - DNA, 44 bp, Artificial Sequence
  Description of Artificial Sequence: Synthetic oligonucleotide
attaatgtctctggttaacaaaactacgcatctcatagccaaag

SEQ ID NO: 103487 - DNA, 43 bp, Artificial Sequence
  Description of Artificial Sequence: Synthetic oligonucleotide
ttaatgtctctggttaacaaaactacgcatctcatagccaaag

SEQ ID NO: 103488 - DNA, 42 bp, Artificial Sequence
  Description of Artificial Sequence: Synthetic oligonucleotide
taatgtctctggttaacaaaactacgcatctcatagccaaag

SEQ ID NO: 103489 - DNA, 41 bp, Artificial Sequence
  Description of Artificial Sequence: Synthetic oligonucleotide
aatgtctctggttaacaaaactacgcatctcatagccaaag

SEQ ID NO: 103490 - DNA, 40 bp, Artificial Sequence
  Description of Artificial Sequence: Synthetic oligonucleotide
atgtctctggttaacaaaactacgcatctcatagccaaag

SEQ ID NO: 103491 - DNA, 39 bp, Artificial Sequence
  Description of Artificial Sequence: Synthetic oligonucleotide
tgtctctggttaacaaaactacgcatctcatagccaaag

SEQ ID NO: 103492 - DNA, 38 bp, Artificial Sequence
  Description of Artificial Sequence: Synthetic oligonucleotide
gtctctggttaacaaaactacgcatctcatagccaaag

SEQ ID NO: 103493 - DNA, 39 bp, Artificial Sequence
  Description of Artificial Sequence: Synthetic oligonucleotide
tctctggttaacaaaactacgcatctcatagccaaagag

SEQ ID NO: 103494 - DNA, 38 bp, Artificial Sequence
  Description of Artificial Sequence: Synthetic oligonucleotide
ctctggttaacaaaactacgcatctcatagccaaagag

SEQ ID NO: 103495 - DNA, 38 bp, Artificial Sequence
  Description of Artificial Sequence: Synthetic oligonucleotide
tctggttaacaaaactacgcatctcatagccaaagagg

SEQ ID NO: 103496 - DNA, 37 bp, Artificial Sequence
  Description of Artificial Sequence: Synthetic oligonucleotide
ctggttaacaaaactacgcatctcatagccaaagagg

SEQ ID NO: 103497 - DNA, 38 bp, Artificial Sequence
  Description of Artificial Sequence: Synthetic oligonucleotide
tggttaacaaaactacgcatctcatagccaaagaggag

SEQ ID NO: 103498 - DNA, 37 bp, Artificial Sequence
  Description of Artificial Sequence: Synthetic oligonucleotide
ggttaacaaaactacgcatctcatagccaaagaggag

SEQ ID NO: 103499 - DNA, 39 bp, Artificial Sequence
  Description of Artificial Sequence: Synthetic oligonucleotide
gttaacaaaactacgcatctcatagccaaagaggagatg

SEQ ID NO: 103500 - DNA, 42 bp, Artificial Sequence
  Description of Artificial Sequence: Synthetic oligonucleotide
ttaacaaaactacgcatctcatagccaaagaggagatgatac

SEQ ID NO: 103501 - DNA, 41 bp, Artificial Sequence
  Description of Artificial Sequence: Synthetic oligonucleotide
taacaaaactacgcatctcatagccaaagaggagatgatac

SEQ ID NO: 103502 - DNA, 40 bp, Artificial Sequence
  Description of Artificial Sequence: Synthetic oligonucleotide
aacaaaactacgcatctcatagccaaagaggagatgatac

SEQ ID NO: 103503 - DNA, 39 bp, Artificial Sequence
  Description of Artificial Sequence: Synthetic oligonucleotide
acaaaactacgcatctcatagccaaagaggagatgatac

SEQ ID NO: 103504 - DNA, 38 bp, Artificial Sequence
  Description of Artificial Sequence: Synthetic oligonucleotide
caaaactacgcatctcatagccaaagaggagatgatac

SEQ ID NO: 103505 - DNA, 43 bp, Artificial Sequence
  Description of Artificial Sequence: Synthetic oligonucleotide
aaaactacgcatctcatagccaaagaggagatgatacataatc

SEQ ID NO: 103506 - DNA, 42 bp, Artificial Sequence
  Description of Artificial Sequence: Synthetic oligonucleotide
aaactacgcatctcatagccaaagaggagatgatacataatc

SEQ ID NO: 103507 - DNA, 41 bp, Artificial Sequence
  Description of Artificial Sequence: Synthetic oligonucleotide
aactacgcatctcatagccaaagaggagatgatacataatc

SEQ ID NO: 103508 - DNA, 40 bp, Artificial Sequence
  Description of Artificial Sequence: Synthetic oligonucleotide
actacgcatctcatagccaaagaggagatgatacataatc

SEQ ID NO: 103509 - DNA, 39 bp, Artificial Sequence
  Description of Artificial Sequence: Synthetic oligonucleotide
ctacgcatctcatagccaaagaggagatgatacataatc

SEQ ID NO: 103510 - DNA, 41 bp, Artificial Sequence
  Description of Artificial Sequence: Synthetic oligonucleotide
tacgcatctcatagccaaagaggagatgatacataatctac

SEQ ID NO: 103511 - DNA, 40 bp, Artificial Sequence
  Description of Artificial Sequence: Synthetic oligonucleotide
acgcatctcatagccaaagaggagatgatacataatctac

SEQ ID NO: 103512 - DNA, 39 bp, Artificial Sequence
  Description of Artificial Sequence: Synthetic oligonucleotide
cgcatctcatagccaaagaggagatgatacataatctac

SEQ ID NO: 103513 - DNA, 26 bp, Artificial Sequence
  Description of Artificial Sequence: Synthetic oligonucleotide
acccgagtgtgcgaagctagccaagg

SEQ ID NO: 103514 - DNA, 25 bp, Artificial Sequence
  Description of Artificial Sequence: Synthetic oligonucleotide
cccgagtgtgcgaagctagccaagg

SEQ ID NO: 103515 - DNA, 27 bp, Artificial Sequence
  Description of Artificial Sequence: Synthetic oligonucleotide
ccgagtgtgcgaagctagccaaggctt

SEQ ID NO: 103516 - DNA, 27 bp, Artificial Sequence
  Description of Artificial Sequence: Synthetic oligonucleotide
cgagtgtgcgaagctagccaaggcttc

SEQ ID NO: 103517 - DNA, 27 bp, Artificial Sequence
  Description of Artificial Sequence: Synthetic oligonucleotide
gagtgtgcgaagctagccaaggcttcc

SEQ ID NO: 103518 - DNA, 27 bp, Artificial Sequence
  Description of Artificial Sequence: Synthetic oligonucleotide
agtgtgcgaagctagccaaggcttccg

SEQ ID NO: 103519 - DNA, 27 bp, Artificial Sequence
  Description of Artificial Sequence: Synthetic oligonucleotide
gtgtgcgaagctagccaaggcttccga

SEQ ID NO: 103520 - DNA, 30 bp, Artificial Sequence
  Description of Artificial Sequence: Synthetic oligonucleotide
tgtgcgaagctagccaaggcttccgatatg

SEQ ID NO: 103521 - DNA, 29 bp, Artificial Sequence
  Description of Artificial Sequence: Synthetic oligonucleotide
gtgcgaagctagccaaggcttccgatatg

SEQ ID NO: 103522 - DNA, 29 bp, Artificial Sequence
  Description of Artificial Sequence: Synthetic oligonucleotide
tgcgaagctagccaaggcttccgatatgg

SEQ ID NO: 103523 - DNA, 28 bp, Artificial Sequence
  Description of Artificial Sequence: Synthetic oligonucleotide
gcgaagctagccaaggcttccgatatgg

SEQ ID NO: 103524 - DNA, 31 bp, Artificial Sequence
  Description of Artificial Sequence: Synthetic oligonucleotide
cgaagctagccaaggcttccgatatggtatc

SEQ ID NO: 103525 - DNA, 31 bp, Artificial Sequence
  Description of Artificial Sequence: Synthetic oligonucleotide
gaagctagccaaggcttccgatatggtatcg

SEQ ID NO: 103526 - DNA, 32 bp, Artificial Sequence
  Description of Artificial Sequence: Synthetic oligonucleotide
aagctagccaaggcttccgatatggtatcgac

SEQ ID NO: 103527 - DNA, 31 bp, Artificial Sequence
  Description of Artificial Sequence: Synthetic oligonucleotide
agctagccaaggcttccgatatggtatcgac

SEQ ID NO: 103528 - DNA, 30 bp, Artificial Sequence
  Description of Artificial Sequence: Synthetic oligonucleotide
gctagccaaggcttccgatatggtatcgac

SEQ ID NO: 103529 - DNA, 32 bp, Artificial Sequence
  Description of Artificial Sequence: Synthetic oligonucleotide
ctagccaaggcttccgatatggtatcgacatc

SEQ ID NO: 103530 - DNA, 32 bp, Artificial Sequence
  Description of Artificial Sequence: Synthetic oligonucleotide
tagccaaggcttccgatatggtatcgacatcc

SEQ ID NO: 103531 - DNA, 31 bp, Artificial Sequence
  Description of Artificial Sequence: Synthetic oligonucleotide
agccaaggcttccgatatggtatcgacatcc

SEQ ID NO: 103532 - DNA, 30 bp, Artificial Sequence
  Description of Artificial Sequence: Synthetic oligonucleotide
gccaaggcttccgatatggtatcgacatcc

SEQ ID NO: 103533 - DNA, 30 bp, Artificial Sequence
  Description of Artificial Sequence: Synthetic oligonucleotide
ccaaggcttccgatatggtatcgacatccc

SEQ ID NO: 103534 - DNA, 30 bp, Artificial Sequence
  Description of Artificial Sequence: Synthetic oligonucleotide
caaggcttccgatatggtatcgacatcccg

SEQ ID NO: 103535 - DNA, 33 bp, Artificial Sequence
  Description of Artificial Sequence: Synthetic oligonucleotide
aaggcttccgatatggtatcgacatcccgtatc

SEQ ID NO: 103536 - DNA, 32 bp, Artificial Sequence
  Description of Artificial Sequence: Synthetic oligonucleotide
aggcttccgatatggtatcgacatcccgtatc

SEQ ID NO: 103537 - DNA, 31 bp, Artificial Sequence
  Description of Artificial Sequence: Synthetic oligonucleotide
ggcttccgatatggtatcgacatcccgtatc

SEQ ID NO: 103538 - DNA, 28 bp, Artificial Sequence
  Description of Artificial Sequence: Synthetic oligonucleotide
atgaaggacgtaccgggcttcctacagc

SEQ ID NO: 103539 - DNA, 27 bp, Artificial Sequence
  Description of Artificial Sequence: Synthetic oligonucleotide
tgaaggacgtaccgggcttcctacagc

SEQ ID NO: 103540 - DNA, 27 bp, Artificial Sequence
  Description of Artificial Sequence: Synthetic oligonucleotide
gaaggacgtaccgggcttcctacagca

SEQ ID NO: 103541 - DNA, 27 bp, Artificial Sequence
  Description of Artificial Sequence: Synthetic oligonucleotide
aaggacgtaccgggcttcctacagcag

SEQ ID NO: 103542 - DNA, 27 bp, Artificial Sequence
  Description of Artificial Sequence: Synthetic oligonucleotide
aggacgtaccgggcttcctacagcaga

SEQ ID NO: 103543 - DNA, 26 bp, Artificial Sequence
  Description of Artificial Sequence: Synthetic oligonucleotide
ggacgtaccgggcttcctacagcaga

SEQ ID NO: 103544 - DNA, 26 bp, Artificial Sequence
  Description of Artificial Sequence: Synthetic oligonucleotide
gacgtaccgggcttcctacagcagag

SEQ ID NO: 103545 - DNA, 26 bp, Artificial Sequence
  Description of Artificial Sequence: Synthetic oligonucleotide
acgtaccgggcttcctacagcagagc

SEQ ID NO: 103546 - DNA, 25 bp, Artificial Sequence
  Description of Artificial Sequence: Synthetic oligonucleotide
cgtaccgggcttcctacagcagagc

SEQ ID NO: 103547 - DNA, 26 bp, Artificial Sequence
  Description of Artificial Sequence: Synthetic oligonucleotide
gtaccgggcttcctacagcagagcca

SEQ ID NO: 103548 - DNA, 27 bp, Artificial Sequence
  Description of Artificial Sequence: Synthetic oligonucleotide
taccgggcttcctacagcagagccaga

SEQ ID NO: 103549 - DNA, 27 bp, Artificial Sequence
  Description of Artificial Sequence: Synthetic oligonucleotide
accgggcttcctacagcagagccagaa

SEQ ID NO: 103550 - DNA, 26 bp, Artificial Sequence
  Description of Artificial Sequence: Synthetic oligonucleotide
ccgggcttcctacagcagagccagaa

SEQ ID NO: 103551 - DNA, 27 bp, Artificial Sequence
  Description of Artificial Sequence: Synthetic oligonucleotide
cgggcttcctacagcagagccagaact

SEQ ID NO: 103552 - DNA, 27 bp, Artificial Sequence
  Description of Artificial Sequence: Synthetic oligonucleotide
gggcttcctacagcagagccagaactc

SEQ ID NO: 103553 - DNA, 27 bp, Artificial Sequence
  Description of Artificial Sequence: Synthetic oligonucleotide
ggcttcctacagcagagccagaactcc

SEQ ID NO: 103554 - DNA, 27 bp, Artificial Sequence
  Description of Artificial Sequence: Synthetic oligonucleotide
gcttcctacagcagagccagaactccg

SEQ ID NO: 103555 - DNA, 27 bp, Artificial Sequence
  Description of Artificial Sequence: Synthetic oligonucleotide
cttcctacagcagagccagaactccgg

SEQ ID NO: 103556 - DNA, 27 bp, Artificial Sequence
  Description of Artificial Sequence: Synthetic oligonucleotide
ttcctacagcagagccagaactccggg

SEQ ID NO: 103557 - DNA, 26 bp, Artificial Sequence
  Description of Artificial Sequence: Synthetic oligonucleotide
tcctacagcagagccagaactccggg

SEQ ID NO: 103558 - DNA, 25 bp, Artificial Sequence
  Description of Artificial Sequence: Synthetic oligonucleotide
cctacagcagagccagaactccggg

SEQ ID NO: 103559 - DNA, 25 bp, Artificial Sequence
  Description of Artificial Sequence: Synthetic oligonucleotide
ctacagcagagccagaactccgggc

SEQ ID NO: 103560 - DNA, 25 bp, Artificial Sequence
  Description of Artificial Sequence: Synthetic oligonucleotide
tacagcagagccagaactccgggcc

SEQ ID NO: 103561 - DNA, 24 bp, Artificial Sequence
  Description of Artificial Sequence: Synthetic oligonucleotide
acagcagagccagaactccgggcc

SEQ ID NO: 103562 - DNA, 23 bp, Artificial Sequence
  Description of Artificial Sequence: Synthetic oligonucleotide
cagcagagccagaactccgggcc

SEQ ID NO: 103563 - DNA, 23 bp, Artificial Sequence
  Description of Artificial Sequence: Synthetic oligonucleotide
agcagagccagaactccgggccc

SEQ ID NO: 103564 - DNA, 22 bp, Artificial Sequence
  Description of Artificial Sequence: Synthetic oligonucleotide
gcagagccagaactccgggccc

SEQ ID NO: 103565 - DNA, 22 bp, Artificial Sequence
  Description of Artificial Sequence: Synthetic oligonucleotide
cagagccagaactccgggcccg

SEQ ID NO: 103566 - DNA, 22 bp, Artificial Sequence
  Description of Artificial Sequence: Synthetic oligonucleotide
agagccagaactccgggcccgg

SEQ ID NO: 103567 - DNA, 21 bp, Artificial Sequence
  Description of Artificial Sequence: Synthetic oligonucleotide
gagccagaactccgggcccgg

SEQ ID NO: 103568 - DNA, 21 bp, Artificial Sequence
  Description of Artificial Sequence: Synthetic oligonucleotide
agccagaactccgggcccggg

SEQ ID NO: 103569 - DNA, 20 bp, Artificial Sequence
  Description of Artificial Sequence: Synthetic oligonucleotide
gccagaactccgggcccggg

SEQ ID NO: 103570 - DNA, 21 bp, Artificial Sequence
  Description of Artificial Sequence: Synthetic oligonucleotide
ccagaactccgggcccgggca

SEQ ID NO: 103571 - DNA, 21 bp, Artificial Sequence
  Description of Artificial Sequence: Synthetic oligonucleotide
cagaactccgggcccgggcag

SEQ ID NO: 103572 - DNA, 21 bp, Artificial Sequence
  Description of Artificial Sequence: Synthetic oligonucleotide
agaactccgggcccgggcagc

SEQ ID NO: 103573 - DNA, 20 bp, Artificial Sequence
  Description of Artificial Sequence: Synthetic oligonucleotide
gaactccgggcccgggcagc

SEQ ID NO: 103574 - DNA, 20 bp, Artificial Sequence
  Description of Artificial Sequence: Synthetic oligonucleotide
aactccgggcccgggcagcc

SEQ ID NO: 103575 - DNA, 20 bp, Artificial Sequence
  Description of Artificial Sequence: Synthetic oligonucleotide
actccgggcccgggcagcct

SEQ ID NO: 103576 - DNA, 20 bp, Artificial Sequence
  Description of Artificial Sequence: Synthetic oligonucleotide
ctccgggcccgggcagcctt

SEQ ID NO: 103577 - DNA, 20 bp, Artificial Sequence
  Description of Artificial Sequence: Synthetic oligonucleotide
tccgggcccgggcagccctt

SEQ ID NO: 103578 - DNA, 20 bp, Artificial Sequence
  Description of Artificial Sequence: Synthetic oligonucleotide
ccgggcccgggcagcccttt

SEQ ID NO: 103579 - DNA, 20 bp, Artificial Sequence
  Description of Artificial Sequence: Synthetic oligonucleotide
cgggcccgggcagcccgttt

SEQ ID NO: 103580 - DNA, 20 bp, Artificial Sequence
  Description of Artificial Sequence: Synthetic oligonucleotide
gggcccgggcagcccgcttt

SEQ ID NO: 103581 - DNA, 20 bp, Artificial Sequence
  Description of Artificial Sequence: Synthetic oligonucleotide
ggcccgggcagcccgctgtt

SEQ ID NO: 103582 - DNA, 20 bp, Artificial Sequence
  Description of Artificial Sequence: Synthetic oligonucleotide
gcccgggcagcccgctgtgt

SEQ ID NO: 103583 - DNA, 20 bp, Artificial Sequence
  Description of Artificial Sequence: Synthetic oligonucleotide
cccgggcagcccgctgtgtg

SEQ ID NO: 103584 - DNA, 20 bp, Artificial Sequence
  Description of Artificial Sequence: Synthetic oligonucleotide
ccgggcagcccgctgtgtgg

SEQ ID NO: 103585 - DNA, 21 bp, Artificial Sequence
  Description of Artificial Sequence: Synthetic oligonucleotide
cgggcagcccgctgtgtggca

SEQ ID NO: 103586 - DNA, 21 bp, Artificial Sequence
  Description of Artificial Sequence: Synthetic oligonucleotide
gggcagcccgctgtgtggcac

SEQ ID NO: 103587 - DNA, 21 bp, Artificial Sequence
  Description of Artificial Sequence: Synthetic oligonucleotide
ggcagcccgctgtgtggcacc

SEQ ID NO: 103588 - DNA, 22 bp, Artificial Sequence
  Description of Artificial Sequence: Synthetic oligonucleotide
gcagcccgctgtgtggcaccgt

SEQ ID NO: 103589 - DNA, 23 bp, Artificial Sequence
  Description of Artificial Sequence: Synthetic oligonucleotide
cagcccgctgtgtggcaccgtct

SEQ ID NO: 103590 - DNA, 23 bp, Artificial Sequence
  Description of Artificial Sequence: Synthetic oligonucleotide
agcccgctgtgtggcaccgtctg

SEQ ID NO: 103591 - DNA, 22 bp, Artificial Sequence
  Description of Artificial Sequence: Synthetic oligonucleotide
gcccgctgtgtggcaccgtctg

SEQ ID NO: 103592 - DNA, 23 bp, Artificial Sequence
  Description of Artificial Sequence: Synthetic oligonucleotide
cccgctgtgtggcaccgtctgga

SEQ ID NO: 103593 - DNA, 23 bp, Artificial Sequence
  Description of Artificial Sequence: Synthetic oligonucleotide
ccgctgtgtggcaccgtctggag

SEQ ID NO: 103594 - DNA, 24 bp, Artificial Sequence
  Description of Artificial Sequence: Synthetic oligonucleotide
cgctgtgtggcaccgtctggagga

SEQ ID NO: 103595 - DNA, 24 bp, Artificial Sequence
  Description of Artificial Sequence: Synthetic oligonucleotide
gctgtgtggcaccgtctggaggag

SEQ ID NO: 103596 - DNA, 25 bp, Artificial Sequence
  Description of Artificial Sequence: Synthetic oligonucleotide
ctgtgtggcaccgtctggaggagct

SEQ ID NO: 103597 - DNA, 27 bp, Artificial Sequence
  Description of Artificial Sequence: Synthetic oligonucleotide
tgtgtggcaccgtctggaggagctcta

SEQ ID NO: 103598 - DNA, 26 bp, Artificial Sequence
  Description of Artificial Sequence: Synthetic oligonucleotide
gtgtggcaccgtctggaggagctcta

SEQ ID NO: 103599 - DNA, 27 bp, Artificial Sequence
  Description of Artificial Sequence: Synthetic oligonucleotide
tgtggcaccgtctggaggagctctaca

SEQ ID NO: 103600 - DNA, 26 bp, Artificial Sequence
  Description of Artificial Sequence: Synthetic oligonucleotide
gtggcaccgtctggaggagctctaca

SEQ ID NO: 103601 - DNA, 26 bp, Artificial Sequence
  Description of Artificial Sequence: Synthetic oligonucleotide
tggcaccgtctggaggagctctacac

SEQ ID NO: 103602 - DNA, 25 bp, Artificial Sequence
  Description of Artificial Sequence: Synthetic oligonucleotide
ggcaccgtctggaggagctctacac

SEQ ID NO: 103603 - DNA, 27 bp, Artificial Sequence
  Description of Artificial Sequence: Synthetic oligonucleotide
gcaccgtctggaggagctctacacgaa

SEQ ID NO: 103604 - DNA, 27 bp, Artificial Sequence
  Description of Artificial Sequence: Synthetic oligonucleotide
caccgtctggaggagctctacacgaag

SEQ ID NO: 103605 - DNA, 29 bp, Artificial Sequence
  Description of Artificial Sequence: Synthetic oligonucleotide
accgtctggaggagctctacacgaagaag

SEQ ID NO: 103606 - DNA, 28 bp, Artificial Sequence
  Description of Artificial Sequence: Synthetic oligonucleotide
ccgtctggaggagctctacacgaagaag

SEQ ID NO: 103607 - DNA, 30 bp, Artificial Sequence
  Description of Artificial Sequence: Synthetic oligonucleotide
cgtctggaggagctctacacgaagaagttg

SEQ ID NO: 103608 - DNA, 31 bp, Artificial Sequence
  Description of Artificial Sequence: Synthetic oligonucleotide
gtctggaggagctctacacgaagaagttgtg

SEQ ID NO: 103609 - DNA, 31 bp, Artificial Sequence
  Description of Artificial Sequence: Synthetic oligonucleotide
tctggaggagctctacacgaagaagttgtgg

SEQ ID NO: 103610 - DNA, 30 bp, Artificial Sequence
  Description of Artificial Sequence: Synthetic oligonucleotide
ctggaggagctctacacgaagaagttgtgg

SEQ ID NO: 103611 - DNA, 30 bp, Artificial Sequence
  Description of Artificial Sequence: Synthetic oligonucleotide
tggaggagctctacacgaagaagttgtggc

SEQ ID NO: 103612 - DNA, 29 bp, Artificial Sequence
  Description of Artificial Sequence: Synthetic oligonucleotide
ggaggagctctacacgaagaagttgtggc

SEQ ID NO: 103613 - DNA, 31 bp, Artificial Sequence
  Description of Artificial Sequence: Synthetic oligonucleotide
gaggagctctacacgaagaagttgtggcatc

SEQ ID NO: 103614 - DNA, 32 bp, Artificial Sequence
  Description of Artificial Sequence: Synthetic oligonucleotide
aggagctctacacgaagaagttgtggcatcag

SEQ ID NO: 103615 - DNA, 31 bp, Artificial Sequence
  Description of Artificial Sequence: Synthetic oligonucleotide
ggagctctacacgaagaagttgtggcatcag

SEQ ID NO: 103616 - DNA, 31 bp, Artificial Sequence
  Description of Artificial Sequence: Synthetic oligonucleotide
gagctctacacgaagaagttgtggcatcagc

SEQ ID NO: 103617 - DNA, 32 bp, Artificial Sequence
  Description of Artificial Sequence: Synthetic oligonucleotide
agctctacacgaagaagttgtggcatcagctg

SEQ ID NO: 103618 - DNA, 31 bp, Artificial Sequence
  Description of Artificial Sequence: Synthetic oligonucleotide
gctctacacgaagaagttgtggcatcagctg

SEQ ID NO: 103619 - DNA, 32 bp, Artificial Sequence
  Description of Artificial Sequence: Synthetic oligonucleotide
ctctacacgaagaagttgtggcatcagctgac

SEQ ID NO: 103620 - DNA, 33 bp, Artificial Sequence
  Description of Artificial Sequence: Synthetic oligonucleotide
tctacacgaagaagttgtggcatcagctgacac

SEQ ID NO: 103621 - DNA, 32 bp, Artificial Sequence
  Description of Artificial Sequence: Synthetic oligonucleotide
ctacacgaagaagttgtggcatcagctgacac

SEQ ID NO: 103622 - DNA, 34 bp, Artificial Sequence
  Description of Artificial Sequence: Synthetic oligonucleotide
tacacgaagaagttgtggcatcagctgacacttc

SEQ ID NO: 103623 - DNA, 33 bp, Artificial Sequence
  Description of Artificial Sequence: Synthetic oligonucleotide
acacgaagaagttgtggcatcagctgacacttc

SEQ ID NO: 103624 - DNA, 32 bp, Artificial Sequence
  Description of Artificial Sequence: Synthetic oligonucleotide
cacgaagaagttgtggcatcagctgacacttc

SEQ ID NO: 103625 - DNA, 33 bp, Artificial Sequence
  Description of Artificial Sequence: Synthetic oligonucleotide
acgaagaagttgtggcatcagctgacacttcag

SEQ ID NO: 103626 - DNA, 32 bp, Artificial Sequence
  Description of Artificial Sequence: Synthetic oligonucleotide
cgaagaagttgtggcatcagctgacacttcag

SEQ ID NO: 103627 - DNA, 32 bp, Artificial Sequence
  Description of Artificial Sequence: Synthetic oligonucleotide
gaagaagttgtggcatcagctgacacttcagg

SEQ ID NO: 103628 - DNA, 33 bp, Artificial Sequence
  Description of Artificial Sequence: Synthetic oligonucleotide
aagaagttgtggcatcagctgacacttcaggtg

SEQ ID NO: 103629 - DNA, 32 bp, Artificial Sequence
  Description of Artificial Sequence: Synthetic oligonucleotide
agaagttgtggcatcagctgacacttcaggtg

SEQ ID NO: 103630 - DNA, 31 bp, Artificial Sequence
  Description of Artificial Sequence: Synthetic oligonucleotide
gaagttgtggcatcagctgacacttcaggtg

SEQ ID NO: 103631 - DNA, 31 bp, Artificial Sequence
  Description of Artificial Sequence: Synthetic oligonucleotide
aagttgtggcatcagctgacacttcaggtgc

SEQ ID NO: 103632 - DNA, 30 bp, Artificial Sequence
  Description of Artificial Sequence: Synthetic oligonucleotide
agttgtggcatcagctgacacttcaggtgc

SEQ ID NO: 103633 - DNA, 29 bp, Artificial Sequence
  Description of Artificial Sequence: Synthetic oligonucleotide
gttgtggcatcagctgacacttcaggtgc

SEQ ID NO: 103634 - DNA, 31 bp, Artificial Sequence
  Description of Artificial Sequence: Synthetic oligonucleotide
ttgtggcatcagctgacacttcaggtgcttg

SEQ ID NO: 103635 - DNA, 30 bp, Artificial Sequence
  Description of Artificial Sequence: Synthetic oligonucleotide
tgtggcatcagctgacacttcaggtgcttg

SEQ ID NO: 103636 - DNA, 29 bp, Artificial Sequence
  Description of Artificial Sequence: Synthetic oligonucleotide
gtggcatcagctgacacttcaggtgcttg

SEQ ID NO: 103637 - DNA, 34 bp, Artificial Sequence
  Description of Artificial Sequence: Synthetic oligonucleotide
tggcatcagctgacacttcaggtgcttgattttg

SEQ ID NO: 103638 - DNA, 33 bp, Artificial Sequence
  Description of Artificial Sequence: Synthetic oligonucleotide
ggcatcagctgacacttcaggtgcttgattttg

SEQ ID NO: 103639 - DNA, 34 bp, Artificial Sequence
  Description of Artificial Sequence: Synthetic oligonucleotide
gcatcagctgacacttcaggtgcttgattttgtg

SEQ ID NO: 103640 - DNA, 34 bp, Artificial Sequence
  Description of Artificial Sequence: Synthetic oligonucleotide
catcagctgacacttcaggtgcttgattttgtgc

SEQ ID NO: 103641 - DNA, 35 bp, Artificial Sequence
  Description of Artificial Sequence: Synthetic oligonucleotide
atcagctgacacttcaggtgcttgattttgtgcag

SEQ ID NO: 103642 - DNA, 34 bp, Artificial Sequence
  Description of Artificial Sequence: Synthetic oligonucleotide
tcagctgacacttcaggtgcttgattttgtgcag

SEQ ID NO: 103643 - DNA, 33 bp, Artificial Sequence
  Description of Artificial Sequence: Synthetic oligonucleotide
cagctgacacttcaggtgcttgattttgtgcag

SEQ ID NO: 103644 - DNA, 33 bp, Artificial Sequence
  Description of Artificial Sequence: Synthetic oligonucleotide
agctgacacttcaggtgcttgattttgtgcagg

SEQ ID NO: 103645 - DNA, 32 bp, Artificial Sequence
  Description of Artificial Sequence: Synthetic oligonucleotide
gctgacacttcaggtgcttgattttgtgcagg

SEQ ID NO: 103646 - DNA, 34 bp, Artificial Sequence
  Description of Artificial Sequence: Synthetic oligonucleotide
ctgacacttcaggtgcttgattttgtgcaggatc

SEQ ID NO: 103647 - DNA, 34 bp, Artificial Sequence
  Description of Artificial Sequence: Synthetic oligonucleotide
tgacacttcaggtgcttgattttgtgcaggatcc

SEQ ID NO: 103648 - DNA, 33 bp, Artificial Sequence
  Description of Artificial Sequence: Synthetic oligonucleotide
gacacttcaggtgcttgattttgtgcaggatcc

SEQ ID NO: 103649 - DNA, 33 bp, Artificial Sequence
  Description of Artificial Sequence: Synthetic oligonucleotide
acacttcaggtgcttgattttgtgcaggatccg

SEQ ID NO: 103650 - DNA, 32 bp, Artificial Sequence
  Description of Artificial Sequence: Synthetic oligonucleotide
cacttcaggtgcttgattttgtgcaggatccg

SEQ ID NO: 103651 - DNA, 33 bp, Artificial Sequence
  Description of Artificial Sequence: Synthetic oligonucleotide
acttcaggtgcttgattttgtgcaggatccgtg

SEQ ID NO: 103652 - DNA, 32 bp, Artificial Sequence
  Description of Artificial Sequence: Synthetic oligonucleotide
cttcaggtgcttgattttgtgcaggatccgtg

SEQ ID NO: 103653 - DNA, 32 bp, Artificial Sequence
  Description of Artificial Sequence: Synthetic oligonucleotide
ttcaggtgcttgattttgtgcaggatccgtgc

SEQ ID NO: 103654 - DNA, 31 bp, Artificial Sequence
  Description of Artificial Sequence: Synthetic oligonucleotide
tcaggtgcttgattttgtgcaggatccgtgc

SEQ ID NO: 103655 - DNA, 30 bp, Artificial Sequence
  Description of Artificial Sequence: Synthetic oligonucleotide
caggtgcttgattttgtgcaggatccgtgc

SEQ ID NO: 103656 - DNA, 33 bp, Artificial Sequence
  Description of Artificial Sequence: Synthetic oligonucleotide
aggtgcttgattttgtgcaggatccgtgctttg

SEQ ID NO: 103657 - DNA, 32 bp, Artificial Sequence
  Description of Artificial Sequence: Synthetic oligonucleotide
ggtgcttgattttgtgcaggatccgtgctttg

SEQ ID NO: 103658 - DNA, 32 bp, Artificial Sequence
  Description of Artificial Sequence: Synthetic oligonucleotide
gtgcttgattttgtgcaggatccgtgctttgc

SEQ ID NO: 103659 - DNA, 32 bp, Artificial Sequence
  Description of Artificial Sequence: Synthetic oligonucleotide
tgcttgattttgtgcaggatccgtgctttgcc

SEQ ID NO: 103660 - DNA, 31 bp, Artificial Sequence
  Description of Artificial Sequence: Synthetic oligonucleotide
gcttgattttgtgcaggatccgtgctttgcc

SEQ ID NO: 103661 - DNA, 31 bp, Artificial Sequence
  Description of Artificial Sequence: Synthetic oligonucleotide
cttgattttgtgcaggatccgtgctttgccc

SEQ ID NO: 103662 - DNA, 33 bp, Artificial Sequence
  Description of Artificial Sequence: Synthetic oligonucleotide
ttgattttgtgcaggatccgtgctttgcccaag

SEQ ID NO: 103663 - DNA, 32 bp, Artificial Sequence
  Description of Artificial Sequence: Synthetic oligonucleotide
tgattttgtgcaggatccgtgctttgcccaag

SEQ ID NO: 103664 - DNA, 31 bp, Artificial Sequence
  Description of Artificial Sequence: Synthetic oligonucleotide
gattttgtgcaggatccgtgctttgcccaag

SEQ ID NO: 103665 - DNA, 31 bp, Artificial Sequence
  Description of Artificial Sequence: Synthetic oligonucleotide
attttgtgcaggatccgtgctttgcccaagg

SEQ ID NO: 103666 - DNA, 30 bp, Artificial Sequence
  Description of Artificial Sequence: Synthetic oligonucleotide
ttttgtgcaggatccgtgctttgcccaagg

SEQ ID NO: 103667 - DNA, 29 bp, Artificial Sequence
  Description of Artificial Sequence: Synthetic oligonucleotide
tttgtgcaggatccgtgctttgcccaagg

SEQ ID NO: 103668 - DNA, 28 bp, Artificial Sequence
  Description of Artificial Sequence: Synthetic oligonucleotide
ttgtgcaggatccgtgctttgcccaagg

SEQ ID NO: 103669 - DNA, 27 bp, Artificial Sequence
  Description of Artificial Sequence: Synthetic oligonucleotide
tgtgcaggatccgtgctttgcccaagg

SEQ ID NO: 103670 - DNA, 27 bp, Artificial Sequence
  Description of Artificial Sequence: Synthetic oligonucleotide
gtgcaggatccgtgctttgcccaagga

SEQ ID NO: 103671 - DNA, 27 bp, Artificial Sequence
  Description of Artificial Sequence: Synthetic oligonucleotide
tgcaggatccgtgctttgcccaaggag

SEQ ID NO: 103672 - DNA, 27 bp, Artificial Sequence
  Description of Artificial Sequence: Synthetic oligonucleotide
gcaggatccgtgctttgcccaaggaga

SEQ ID NO: 103673 - DNA, 28 bp, Artificial Sequence
  Description of Artificial Sequence: Synthetic oligonucleotide
caggatccgtgctttgcccaaggagatg

SEQ ID NO: 103674 - DNA, 28 bp, Artificial Sequence
  Description of Artificial Sequence: Synthetic oligonucleotide
aggatccgtgctttgcccaaggagatgg

SEQ ID NO: 103675 - DNA, 27 bp, Artificial Sequence
  Description of Artificial Sequence: Synthetic oligonucleotide
ggatccgtgctttgcccaaggagatgg

SEQ ID NO: 103676 - DNA, 28 bp, Artificial Sequence
  Description of Artificial Sequence: Synthetic oligonucleotide
gatccgtgctttgcccaaggagatggtc

SEQ ID NO: 103677 - DNA, 29 bp, Artificial Sequence
  Description of Artificial Sequence: Synthetic oligonucleotide
atccgtgctttgcccaaggagatggtctc

SEQ ID NO: 103678 - DNA, 28 bp, Artificial Sequence
  Description of Artificial Sequence: Synthetic oligonucleotide
tccgtgctttgcccaaggagatggtctc

SEQ ID NO: 103679 - DNA, 27 bp, Artificial Sequence
  Description of Artificial Sequence: Synthetic oligonucleotide
ccgtgctttgcccaaggagatggtctc

SEQ ID NO: 103680 - DNA, 32 bp, Artificial Sequence
  Description of Artificial Sequence: Synthetic oligonucleotide
cgtgctttgcccaaggagatggtctcattaag

SEQ ID NO: 103681 - DNA, 32 bp, Artificial Sequence
  Description of Artificial Sequence: Synthetic oligonucleotide
gtgctttgcccaaggagatggtctcattaagc

SEQ ID NO: 103682 - DNA, 37 bp, Artificial Sequence
  Description of Artificial Sequence: Synthetic oligonucleotide
tgctttgcccaaggagatggtctcattaagctttatg

SEQ ID NO: 103683 - DNA, 36 bp, Artificial Sequence
  Description of Artificial Sequence: Synthetic oligonucleotide
gctttgcccaaggagatggtctcattaagctttatg

SEQ ID NO: 103684 - DNA, 40 bp, Artificial Sequence
  Description of Artificial Sequence: Synthetic oligonucleotide
ctttgcccaaggagatggtctcattaagctttatgaaaac

SEQ ID NO: 103685 - DNA, 45 bp, Artificial Sequence
  Description of Artificial Sequence: Synthetic oligonucleotide
tttgcccaaggagatggtctcattaagctttatgaaaactttatc

SEQ ID NO: 103686 - DNA, 44 bp, Artificial Sequence
  Description of Artificial Sequence: Synthetic oligonucleotide
ttgcccaaggagatggtctcattaagctttatgaaaactttatc

SEQ ID NO: 103687 - DNA, 43 bp, Artificial Sequence
  Description of Artificial Sequence: Synthetic oligonucleotide
tgcccaaggagatggtctcattaagctttatgaaaactttatc

SEQ ID NO: 103688 - DNA, 42 bp, Artificial Sequence
  Description of Artificial Sequence: Synthetic oligonucleotide
gcccaaggagatggtctcattaagctttatgaaaactttatc

SEQ ID NO: 103689 - DNA, 43 bp, Artificial Sequence
  Description of Artificial Sequence: Synthetic oligonucleotide
cccaaggagatggtctcattaagctttatgaaaactttatcag

SEQ ID NO: 103690 - DNA, 44 bp, Artificial Sequence
  Description of Artificial Sequence: Synthetic oligonucleotide
ccaaggagatggtctcattaagctttatgaaaactttatcagtg

SEQ ID NO: 103691 - DNA, 49 bp, Artificial Sequence
  Description of Artificial Sequence: Synthetic oligonucleotide
caaggagatggtctcattaagctttatgaaaactttatcagtgaatttg

SEQ ID NO: 103692 - DNA, 51 bp, Artificial Sequence
  Description of Artificial Sequence: Synthetic oligonucleotide
aaggagatggtctcattaagctttatgaaaactttatcagtgaatttgaac

SEQ ID NO: 103693 - DNA, 50 bp, Artificial Sequence
  Description of Artificial Sequence: Synthetic oligonucleotide
aggagatggtctcattaagctttatgaaaactttatcagtgaatttgaac

SEQ ID NO: 103694 - DNA, 49 bp, Artificial Sequence
  Description of Artificial Sequence: Synthetic oligonucleotide
ggagatggtctcattaagctttatgaaaactttatcagtgaatttgaac

SEQ ID NO: 103695 - DNA, 50 bp, Artificial Sequence
  Description of Artificial Sequence: Synthetic oligonucleotide
gagatggtctcattaagctttatgaaaactttatcagtgaatttgaacac

SEQ ID NO: 103696 - DNA, 51 bp, Artificial Sequence
  Description of Artificial Sequence: Synthetic oligonucleotide
agatggtctcattaagctttatgaaaactttatcagtgaatttgaacacag

SEQ ID NO: 103697 - DNA, 50 bp, Artificial Sequence
  Description of Artificial Sequence: Synthetic oligonucleotide
gatggtctcattaagctttatgaaaactttatcagtgaatttgaacacag

SEQ ID NO: 103698 - DNA, 50 bp, Artificial Sequence
  Description of Artificial Sequence: Synthetic oligonucleotide
atggtctcattaagctttatgaaaactttatcagtgaatttgaacacagg

SEQ ID NO: 103699 - DNA, 49 bp, Artificial Sequence
  Description of Artificial Sequence: Synthetic oligonucleotide
tggtctcattaagctttatgaaaactttatcagtgaatttgaacacagg

SEQ ID NO: 103700 - DNA, 48 bp, Artificial Sequence
  Description of Artificial Sequence: Synthetic oligonucleotide
ggtctcattaagctttatgaaaactttatcagtgaatttgaacacagg

SEQ ID NO: 103701 - DNA, 48 bp, Artificial Sequence
  Description of Artificial Sequence: Synthetic oligonucleotide
gtctcattaagctttatgaaaactttatcagtgaatttgaacacaggg

SEQ ID NO: 103702 - DNA, 49 bp, Artificial Sequence
  Description of Artificial Sequence: Synthetic oligonucleotide
tctcattaagctttatgaaaactttatcagtgaatttgaacacagggtg

SEQ ID NO: 103703 - DNA, 48 bp, Artificial Sequence
  Description of Artificial Sequence: Synthetic oligonucleotide
ctcattaagctttatgaaaactttatcagtgaatttgaacacagggtg

SEQ ID NO: 103704 - DNA, 50 bp, Artificial Sequence
  Description of Artificial Sequence: Synthetic oligonucleotide
tcattaagctttatgaaaactttatcagtgaatttgaacacagggtgaac

SEQ ID NO: 103705 - DNA, 49 bp, Artificial Sequence
  Description of Artificial Sequence: Synthetic oligonucleotide
cattaagctttatgaaaactttatcagtgaatttgaacacagggtgaac

SEQ ID NO: 103706 - DNA, 49 bp, Artificial Sequence
  Description of Artificial Sequence: Synthetic oligonucleotide
attaagctttatgaaaactttatcagtgaatttgaacacagggtgaacc

SEQ ID NO: 103707 - DNA, 48 bp, Artificial Sequence
  Description of Artificial Sequence: Synthetic oligonucleotide
ttaagctttatgaaaactttatcagtgaatttgaacacagggtgaacc

SEQ ID NO: 103708 - DNA, 47 bp, Artificial Sequence
  Description of Artificial Sequence: Synthetic oligonucleotide
taagctttatgaaaactttatcagtgaatttgaacacagggtgaacc

SEQ ID NO: 103709 - DNA, 46 bp, Artificial Sequence
  Description of Artificial Sequence: Synthetic oligonucleotide
aagctttatgaaaactttatcagtgaatttgaacacagggtgaacc

SEQ ID NO: 103710 - DNA, 45 bp, Artificial Sequence
  Description of Artificial Sequence: Synthetic oligonucleotide
agctttatgaaaactttatcagtgaatttgaacacagggtgaacc

SEQ ID NO: 103711 - DNA, 44 bp, Artificial Sequence
  Description of Artificial Sequence: Synthetic oligonucleotide
gctttatgaaaactttatcagtgaatttgaacacagggtgaacc

SEQ ID NO: 103712 - DNA, 44 bp, Artificial Sequence
  Description of Artificial Sequence: Synthetic oligonucleotide
ctttatgaaaactttatcagtgaatttgaacacagggtgaaccc

SEQ ID NO: 103713 - DNA, 47 bp, Artificial Sequence
  Description of Artificial Sequence: Synthetic oligonucleotide
tttatgaaaactttatcagtgaatttgaacacagggtgaaccctttg

SEQ ID NO: 103714 - DNA, 46 bp, Artificial Sequence
  Description of Artificial Sequence: Synthetic oligonucleotide
ttatgaaaactttatcagtgaatttgaacacagggtgaaccctttg

SEQ ID NO: 103715 - DNA, 45 bp, Artificial Sequence
  Description of Artificial Sequence: Synthetic oligonucleotide
tatgaaaactttatcagtgaatttgaacacagggtgaaccctttg

SEQ ID NO: 103716 - DNA, 44 bp, Artificial Sequence
  Description of Artificial Sequence: Synthetic oligonucleotide
atgaaaactttatcagtgaatttgaacacagggtgaaccctttg

SEQ ID NO: 103717 - DNA, 43 bp, Artificial Sequence
  Description of Artificial Sequence: Synthetic oligonucleotide
tgaaaactttatcagtgaatttgaacacagggtgaaccctttg

SEQ ID NO: 103718 - DNA, 42 bp, Artificial Sequence
  Description of Artificial Sequence: Synthetic oligonucleotide
gaaaactttatcagtgaatttgaacacagggtgaaccctttg

SEQ ID NO: 103719 - DNA, 43 bp, Artificial Sequence
  Description of Artificial Sequence: Synthetic oligonucleotide
aaaactttatcagtgaatttgaacacagggtgaaccctttgtc

SEQ ID NO: 103720 - DNA, 42 bp, Artificial Sequence
  Description of Artificial Sequence: Synthetic oligonucleotide
aaactttatcagtgaatttgaacacagggtgaaccctttgtc

SEQ ID NO: 103721 - DNA, 41 bp, Artificial Sequence
  Description of Artificial Sequence: Synthetic oligonucleotide
aactttatcagtgaatttgaacacagggtgaaccctttgtc

SEQ ID NO: 103722 - DNA, 40 bp, Artificial Sequence
  Description of Artificial Sequence: Synthetic oligonucleotide
actttatcagtgaatttgaacacagggtgaaccctttgtc

SEQ ID NO: 103723 - DNA, 39 bp, Artificial Sequence
  Description of Artificial Sequence: Synthetic oligonucleotide
ctttatcagtgaatttgaacacagggtgaaccctttgtc

SEQ ID NO: 103724 - DNA, 39 bp, Artificial Sequence
  Description of Artificial Sequence: Synthetic oligonucleotide
tttatcagtgaatttgaacacagggtgaaccctttgtcc

SEQ ID NO: 103725 - DNA, 38 bp, Artificial Sequence
  Description of Artificial Sequence: Synthetic oligonucleotide
ttatcagtgaatttgaacacagggtgaaccctttgtcc

SEQ ID NO: 103726 - DNA, 37 bp, Artificial Sequence
  Description of Artificial Sequence: Synthetic oligonucleotide
tatcagtgaatttgaacacagggtgaaccctttgtcc

SEQ ID NO: 103727 - DNA, 36 bp, Artificial Sequence
  Description of Artificial Sequence: Synthetic oligonucleotide
atcagtgaatttgaacacagggtgaaccctttgtcc

SEQ ID NO: 103728 - DNA, 35 bp, Artificial Sequence
  Description of Artificial Sequence: Synthetic oligonucleotide
tcagtgaatttgaacacagggtgaaccctttgtcc

SEQ ID NO: 103729 - DNA, 34 bp, Artificial Sequence
  Description of Artificial Sequence: Synthetic oligonucleotide
cagtgaatttgaacacagggtgaaccctttgtcc

SEQ ID NO: 103730 - DNA, 34 bp, Artificial Sequence
  Description of Artificial Sequence: Synthetic oligonucleotide
agtgaatttgaacacagggtgaaccctttgtccc

SEQ ID NO: 103731 - DNA, 33 bp, Artificial Sequence
  Description of Artificial Sequence: Synthetic oligonucleotide
gtgaatttgaacacagggtgaaccctttgtccc

SEQ ID NO: 103732 - DNA, 34 bp, Artificial Sequence
  Description of Artificial Sequence: Synthetic oligonucleotide
tgaatttgaacacagggtgaaccctttgtccctc

SEQ ID NO: 103733 - DNA, 33 bp, Artificial Sequence
  Description of Artificial Sequence: Synthetic oligonucleotide
gaatttgaacacagggtgaaccctttgtccctc

SEQ ID NO: 103734 - DNA, 33 bp, Artificial Sequence
  Description of Artificial Sequence: Synthetic oligonucleotide
aatttgaacacagggtgaaccctttgtccctcg

SEQ ID NO: 103735 - DNA, 32 bp, Artificial Sequence
  Description of Artificial Sequence: Synthetic oligonucleotide
atttgaacacagggtgaaccctttgtccctcg

SEQ ID NO: 103736 - DNA, 31 bp, Artificial Sequence
  Description of Artificial Sequence: Synthetic oligonucleotide
tttgaacacagggtgaaccctttgtccctcg

SEQ ID NO: 103737 - DNA, 30 bp, Artificial Sequence
  Description of Artificial Sequence: Synthetic oligonucleotide
ttgaacacagggtgaaccctttgtccctcg

SEQ ID NO: 103738 - DNA, 29 bp, Artificial Sequence
  Description of Artificial Sequence: Synthetic oligonucleotide
tgaacacagggtgaaccctttgtccctcg

SEQ ID NO: 103739 - DNA, 28 bp, Artificial Sequence
  Description of Artificial Sequence: Synthetic oligonucleotide
gaacacagggtgaaccctttgtccctcg

SEQ ID NO: 103740 - DNA, 29 bp, Artificial Sequence
  Description of Artificial Sequence: Synthetic oligonucleotide
aacacagggtgaaccctttgtccctcgtg

SEQ ID NO: 103741 - DNA, 28 bp, Artificial Sequence
  Description of Artificial Sequence: Synthetic oligonucleotide
acacagggtgaaccctttgtccctcgtg

SEQ ID NO: 103742 - DNA, 27 bp, Artificial Sequence
  Description of Artificial Sequence: Synthetic oligonucleotide
cacagggtgaaccctttgtccctcgtg

SEQ ID NO: 103743 - DNA, 27 bp, Artificial Sequence
  Description of Artificial Sequence: Synthetic oligonucleotide
acagggtgaaccctttgtccctcgtgg

SEQ ID NO: 103744 - DNA, 27 bp, Artificial Sequence
  Description of Artificial Sequence: Synthetic oligonucleotide
cagggtgaaccctttgtccctcgtgga

SEQ ID NO: 103745 - DNA, 30 bp, Artificial Sequence
  Description of Artificial Sequence: Synthetic oligonucleotide
agggtgaaccctttgtccctcgtggaaatc

SEQ ID NO: 103746 - DNA, 29 bp, Artificial Sequence
  Description of Artificial Sequence: Synthetic oligonucleotide
gggtgaaccctttgtccctcgtggaaatc

SEQ ID NO: 103747 - DNA, 32 bp, Artificial Sequence
  Description of Artificial Sequence: Synthetic oligonucleotide
ggtgaaccctttgtccctcgtggaaatcattc

SEQ ID NO: 103748 - DNA, 34 bp, Artificial Sequence
  Description of Artificial Sequence: Synthetic oligonucleotide
gtgaaccctttgtccctcgtggaaatcattcttc

SEQ ID NO: 103749 - DNA, 36 bp, Artificial Sequence
  Description of Artificial Sequence: Synthetic oligonucleotide
tgaaccctttgtccctcgtggaaatcattcttcatg

SEQ ID NO: 103750 - DNA, 35 bp, Artificial Sequence
  Description of Artificial Sequence: Synthetic oligonucleotide
gaaccctttgtccctcgtggaaatcattcttcatg

SEQ ID NO: 103751 - DNA, 37 bp, Artificial Sequence
  Description of Artificial Sequence: Synthetic oligonucleotide
aaccctttgtccctcgtggaaatcattcttcatgtag

SEQ ID NO: 103752 - DNA, 36 bp, Artificial Sequence
  Description of Artificial Sequence: Synthetic oligonucleotide
accctttgtccctcgtggaaatcattcttcatgtag

SEQ ID NO: 103753 - DNA, 35 bp, Artificial Sequence
  Description of Artificial Sequence: Synthetic oligonucleotide
ccctttgtccctcgtggaaatcattcttcatgtag

SEQ ID NO: 103754 - DNA, 38 bp, Artificial Sequence
  Description of Artificial Sequence: Synthetic oligonucleotide
cctttgtccctcgtggaaatcattcttcatgtagttag

SEQ ID NO: 103755 - DNA, 39 bp, Artificial Sequence
  Description of Artificial Sequence: Synthetic oligonucleotide
ctttgtccctcgtggaaatcattcttcatgtagttagac

SEQ ID NO: 103756 - DNA, 40 bp, Artificial Sequence
  Description of Artificial Sequence: Synthetic oligonucleotide
tttgtccctcgtggaaatcattcttcatgtagttagacag

SEQ ID NO: 103757 - DNA, 39 bp, Artificial Sequence
  Description of Artificial Sequence: Synthetic oligonucleotide
ttgtccctcgtggaaatcattcttcatgtagttagacag

SEQ ID NO: 103758 - DNA, 38 bp, Artificial Sequence
  Description of Artificial Sequence: Synthetic oligonucleotide
tgtccctcgtggaaatcattcttcatgtagttagacag

SEQ ID NO: 103759 - DNA, 37 bp, Artificial Sequence
  Description of Artificial Sequence: Synthetic oligonucleotide
gtccctcgtggaaatcattcttcatgtagttagacag

SEQ ID NO: 103760 - DNA, 39 bp, Artificial Sequence
  Description of Artificial Sequence: Synthetic oligonucleotide
tccctcgtggaaatcattcttcatgtagttagacagatg

SEQ ID NO: 103761 - DNA, 38 bp, Artificial Sequence
  Description of Artificial Sequence: Synthetic oligonucleotide
ccctcgtggaaatcattcttcatgtagttagacagatg

SEQ ID NO: 103762 - DNA, 39 bp, Artificial Sequence
  Description of Artificial Sequence: Synthetic oligonucleotide
cctcgtggaaatcattcttcatgtagttagacagatgac

SEQ ID NO: 103763 - DNA, 40 bp, Artificial Sequence
  Description of Artificial Sequence: Synthetic oligonucleotide
ctcgtggaaatcattcttcatgtagttagacagatgactg

SEQ ID NO: 103764 - DNA, 42 bp, Artificial Sequence
  Description of Artificial Sequence: Synthetic oligonucleotide
tcgtggaaatcattcttcatgtagttagacagatgactgatc

SEQ ID NO: 103765 - DNA, 41 bp, Artificial Sequence
  Description of Artificial Sequence: Synthetic oligonucleotide
cgtggaaatcattcttcatgtagttagacagatgactgatc

SEQ ID NO: 103766 - DNA, 41 bp, Artificial Sequence
  Description of Artificial Sequence: Synthetic oligonucleotide
gtggaaatcattcttcatgtagttagacagatgactgatcc

SEQ ID NO: 103767 - DNA, 45 bp, Artificial Sequence
  Description of Artificial Sequence: Synthetic oligonucleotide
tggaaatcattcttcatgtagttagacagatgactgatcctaatg

SEQ ID NO: 103768 - DNA, 44 bp, Artificial Sequence
  Description of Artificial Sequence: Synthetic oligonucleotide
ggaaatcattcttcatgtagttagacagatgactgatcctaatg

SEQ ID NO: 103769 - DNA, 45 bp, Artificial Sequence
  Description of Artificial Sequence: Synthetic oligonucleotide
gaaatcattcttcatgtagttagacagatgactgatcctaatgtg

SEQ ID NO: 103770 - DNA, 45 bp, Artificial Sequence
  Description of Artificial Sequence: Synthetic oligonucleotide
aaatcattcttcatgtagttagacagatgactgatcctaatgtgg

SEQ ID NO: 103771 - DNA, 44 bp, Artificial Sequence
  Description of Artificial Sequence: Synthetic oligonucleotide
aatcattcttcatgtagttagacagatgactgatcctaatgtgg

SEQ ID NO: 103772 - DNA, 43 bp, Artificial Sequence
  Description of Artificial Sequence: Synthetic oligonucleotide
atcattcttcatgtagttagacagatgactgatcctaatgtgg

SEQ ID NO: 103773 - DNA, 42 bp, Artificial Sequence
  Description of Artificial Sequence: Synthetic oligonucleotide
tcattcttcatgtagttagacagatgactgatcctaatgtgg

SEQ ID NO: 103774 - DNA, 41 bp, Artificial Sequence
  Description of Artificial Sequence: Synthetic oligonucleotide
cattcttcatgtagttagacagatgactgatcctaatgtgg

SEQ ID NO: 103775 - DNA, 41 bp, Artificial Sequence
  Description of Artificial Sequence: Synthetic oligonucleotide
attcttcatgtagttagacagatgactgatcctaatgtggc

SEQ ID NO: 103776 - DNA, 40 bp, Artificial Sequence
  Description of Artificial Sequence: Synthetic oligonucleotide
ttcttcatgtagttagacagatgactgatcctaatgtggc

SEQ ID NO: 103777 - DNA, 39 bp, Artificial Sequence
  Description of Artificial Sequence: Synthetic oligonucleotide
tcttcatgtagttagacagatgactgatcctaatgtggc

SEQ ID NO: 103778 - DNA, 38 bp, Artificial Sequence
  Description of Artificial Sequence: Synthetic oligonucleotide
cttcatgtagttagacagatgactgatcctaatgtggc

SEQ ID NO: 103779 - DNA, 39 bp, Artificial Sequence
  Description of Artificial Sequence: Synthetic oligonucleotide
ttcatgtagttagacagatgactgatcctaatgtggctc

SEQ ID NO: 103780 - DNA, 38 bp, Artificial Sequence
  Description of Artificial Sequence: Synthetic oligonucleotide
tcatgtagttagacagatgactgatcctaatgtggctc

SEQ ID NO: 103781 - DNA, 37 bp, Artificial Sequence
  Description of Artificial Sequence: Synthetic oligonucleotide
catgtagttagacagatgactgatcctaatgtggctc

SEQ ID NO: 103782 - DNA, 40 bp, Artificial Sequence
  Description of Artificial Sequence: Synthetic oligonucleotide
atgtagttagacagatgactgatcctaatgtggctcttac

SEQ ID NO: 103783 - DNA, 39 bp, Artificial Sequence
  Description of Artificial Sequence: Synthetic oligonucleotide
tgtagttagacagatgactgatcctaatgtggctcttac

SEQ ID NO: 103784 - DNA, 38 bp, Artificial Sequence
  Description of Artificial Sequence: Synthetic oligonucleotide
gtagttagacagatgactgatcctaatgtggctcttac

SEQ ID NO: 103785 - DNA, 42 bp, Artificial Sequence
  Description of Artificial Sequence: Synthetic oligonucleotide
tagttagacagatgactgatcctaatgtggctcttacttttc

SEQ ID NO: 103786 - DNA, 41 bp, Artificial Sequence
  Description of Artificial Sequence: Synthetic oligonucleotide
agttagacagatgactgatcctaatgtggctcttacttttc

SEQ ID NO: 103787 - DNA, 40 bp, Artificial Sequence
  Description of Artificial Sequence: Synthetic oligonucleotide
gttagacagatgactgatcctaatgtggctcttacttttc

SEQ ID NO: 103788 - DNA, 41 bp, Artificial Sequence
  Description of Artificial Sequence: Synthetic oligonucleotide
ttagacagatgactgatcctaatgtggctcttacttttctg

SEQ ID NO: 103789 - DNA, 40 bp, Artificial Sequence
  Description of Artificial Sequence: Synthetic oligonucleotide
tagacagatgactgatcctaatgtggctcttacttttctg

SEQ ID NO: 103790 - DNA, 39 bp, Artificial Sequence
  Description of Artificial Sequence: Synthetic oligonucleotide
agacagatgactgatcctaatgtggctcttacttttctg

SEQ ID NO: 103791 - DNA, 38 bp, Artificial Sequence
  Description of Artificial Sequence: Synthetic oligonucleotide
gacagatgactgatcctaatgtggctcttacttttctg

SEQ ID NO: 103792 - DNA, 38 bp, Artificial Sequence
  Description of Artificial Sequence: Synthetic oligonucleotide
acagatgactgatcctaatgtggctcttacttttctgg

SEQ ID NO: 103793 - DNA, 37 bp, Artificial Sequence
  Description of Artificial Sequence: Synthetic oligonucleotide
cagatgactgatcctaatgtggctcttacttttctgg

SEQ ID NO: 103794 - DNA, 41 bp, Artificial Sequence
  Description of Artificial Sequence: Synthetic oligonucleotide
agatgactgatcctaatgtggctcttacttttctggaaaag

SEQ ID NO: 103795 - DNA, 40 bp, Artificial Sequence
  Description of Artificial Sequence: Synthetic oligonucleotide
gatgactgatcctaatgtggctcttacttttctggaaaag

SEQ ID NO: 103796 - DNA, 41 bp, Artificial Sequence
  Description of Artificial Sequence: Synthetic oligonucleotide
atgactgatcctaatgtggctcttacttttctggaaaagac

SEQ ID NO: 103797 - DNA, 40 bp, Artificial Sequence
  Description of Artificial Sequence: Synthetic oligonucleotide
tgactgatcctaatgtggctcttacttttctggaaaagac

SEQ ID NO: 103798 - DNA, 39 bp, Artificial Sequence
  Description of Artificial Sequence: Synthetic oligonucleotide
gactgatcctaatgtggctcttacttttctggaaaagac

SEQ ID NO: 103799 - DNA, 40 bp, Artificial Sequence
  Description of Artificial Sequence: Synthetic oligonucleotide
actgatcctaatgtggctcttacttttctggaaaagactc

SEQ ID NO: 103800 - DNA, 39 bp, Artificial Sequence
  Description of Artificial Sequence: Synthetic oligonucleotide
ctgatcctaatgtggctcttacttttctggaaaagactc

SEQ ID NO: 103801 - DNA, 39 bp, Artificial Sequence
  Description of Artificial Sequence: Synthetic oligonucleotide
tgatcctaatgtggctcttacttttctggaaaagactcg

SEQ ID NO: 103802 - DNA, 38 bp, Artificial Sequence
  Description of Artificial Sequence: Synthetic oligonucleotide
gatcctaatgtggctcttacttttctggaaaagactcg

SEQ ID NO: 103803 - DNA, 39 bp, Artificial Sequence
  Description of Artificial Sequence: Synthetic oligonucleotide
atcctaatgtggctcttacttttctggaaaagactcgtg

SEQ ID NO: 103804 - DNA, 38 bp, Artificial Sequence
  Description of Artificial Sequence: Synthetic oligonucleotide
tcctaatgtggctcttacttttctggaaaagactcgtg

SEQ ID NO: 103805 - DNA, 37 bp, Artificial Sequence
  Description of Artificial Sequence: Synthetic oligonucleotide
cctaatgtggctcttacttttctggaaaagactcgtg

SEQ ID NO: 103806 - DNA, 38 bp, Artificial Sequence
  Description of Artificial Sequence: Synthetic oligonucleotide
ctaatgtggctcttacttttctggaaaagactcgtgag

SEQ ID NO: 103807 - DNA, 40 bp, Artificial Sequence
  Description of Artificial Sequence: Synthetic oligonucleotide
taatgtggctcttacttttctggaaaagactcgtgagaag

SEQ ID NO: 103808 - DNA, 39 bp, Artificial Sequence
  Description of Artificial Sequence: Synthetic oligonucleotide
aatgtggctcttacttttctggaaaagactcgtgagaag

SEQ ID NO: 103809 - DNA, 38 bp, Artificial Sequence
  Description of Artificial Sequence: Synthetic oligonucleotide
atgtggctcttacttttctggaaaagactcgtgagaag

SEQ ID NO: 103810 - DNA, 37 bp, Artificial Sequence
  Description of Artificial Sequence: Synthetic oligonucleotide
tgtggctcttacttttctggaaaagactcgtgagaag

SEQ ID NO: 103811 - DNA, 36 bp, Artificial Sequence
  Description of Artificial Sequence: Synthetic oligonucleotide
gtggctcttacttttctggaaaagactcgtgagaag

SEQ ID NO: 103812 - DNA, 36 bp, Artificial Sequence
  Description of Artificial Sequence: Synthetic oligonucleotide
tggctcttacttttctggaaaagactcgtgagaagg

SEQ ID NO: 103813 - DNA, 35 bp, Artificial Sequence
  Description of Artificial Sequence: Synthetic oligonucleotide
ggctcttacttttctggaaaagactcgtgagaagg

SEQ ID NO: 103814 - DNA, 36 bp, Artificial Sequence
  Description of Artificial Sequence: Synthetic oligonucleotide
gctcttacttttctggaaaagactcgtgagaaggtg

SEQ ID NO: 103815 - DNA, 40 bp, Artificial Sequence
  Description of Artificial Sequence: Synthetic oligonucleotide
ctcttacttttctggaaaagactcgtgagaaggtgaaaag

SEQ ID NO: 103816 - DNA, 42 bp, Artificial Sequence
  Description of Artificial Sequence: Synthetic oligonucleotide
tcttacttttctggaaaagactcgtgagaaggtgaaaagtag

SEQ ID NO: 103817 - DNA, 41 bp, Artificial Sequence
  Description of Artificial Sequence: Synthetic oligonucleotide
cttacttttctggaaaagactcgtgagaaggtgaaaagtag

SEQ ID NO: 103818 - DNA, 42 bp, Artificial Sequence
  Description of Artificial Sequence: Synthetic oligonucleotide
ttacttttctggaaaagactcgtgagaaggtgaaaagtagtg

SEQ ID NO: 103819 - DNA, 41 bp, Artificial Sequence
  Description of Artificial Sequence: Synthetic oligonucleotide
tacttttctggaaaagactcgtgagaaggtgaaaagtagtg

SEQ ID NO: 103820 - DNA, 40 bp, Artificial Sequence
  Description of Artificial Sequence: Synthetic oligonucleotide
acttttctggaaaagactcgtgagaaggtgaaaagtagtg

SEQ ID NO: 103821 - DNA, 39 bp, Artificial Sequence
  Description of Artificial Sequence: Synthetic oligonucleotide
cttttctggaaaagactcgtgagaaggtgaaaagtagtg

SEQ ID NO: 103822 - DNA, 41 bp, Artificial Sequence
  Description of Artificial Sequence: Synthetic oligonucleotide
ttttctggaaaagactcgtgagaaggtgaaaagtagtgatg

SEQ ID NO: 103823 - DNA, 40 bp, Artificial Sequence
  Description of Artificial Sequence: Synthetic oligonucleotide
tttctggaaaagactcgtgagaaggtgaaaagtagtgatg

SEQ ID NO: 103824 - DNA, 39 bp, Artificial Sequence
  Description of Artificial Sequence: Synthetic oligonucleotide
ttctggaaaagactcgtgagaaggtgaaaagtagtgatg

SEQ ID NO: 103825 - DNA, 38 bp, Artificial Sequence
  Description of Artificial Sequence: Synthetic oligonucleotide
tctggaaaagactcgtgagaaggtgaaaagtagtgatg

SEQ ID NO: 103826 - DNA, 37 bp, Artificial Sequence
  Description of Artificial Sequence: Synthetic oligonucleotide
ctggaaaagactcgtgagaaggtgaaaagtagtgatg

SEQ ID NO: 103827 - DNA, 38 bp, Artificial Sequence
  Description of Artificial Sequence: Synthetic oligonucleotide
tggaaaagactcgtgagaaggtgaaaagtagtgatgag

SEQ ID NO: 103828 - DNA, 37 bp, Artificial Sequence
  Description of Artificial Sequence: Synthetic oligonucleotide
ggaaaagactcgtgagaaggtgaaaagtagtgatgag

SEQ ID NO: 103829 - DNA, 37 bp, Artificial Sequence
  Description of Artificial Sequence: Synthetic oligonucleotide
gaaaagactcgtgagaaggtgaaaagtagtgatgagg

SEQ ID NO: 103830 - DNA, 37 bp, Artificial Sequence
  Description of Artificial Sequence: Synthetic oligonucleotide
aaaagactcgtgagaaggtgaaaagtagtgatgaggc

SEQ ID NO: 103831 - DNA, 36 bp, Artificial Sequence
  Description of Artificial Sequence: Synthetic oligonucleotide
aaagactcgtgagaaggtgaaaagtagtgatgaggc

SEQ ID NO: 103832 - DNA, 35 bp, Artificial Sequence
  Description of Artificial Sequence: Synthetic oligonucleotide
aagactcgtgagaaggtgaaaagtagtgatgaggc

SEQ ID NO: 103833 - DNA, 34 bp, Artificial Sequence
  Description of Artificial Sequence: Synthetic oligonucleotide
agactcgtgagaaggtgaaaagtagtgatgaggc

SEQ ID NO: 103834 - DNA, 33 bp, Artificial Sequence
  Description of Artificial Sequence: Synthetic oligonucleotide
gactcgtgagaaggtgaaaagtagtgatgaggc

SEQ ID NO: 103835 - DNA, 34 bp, Artificial Sequence
  Description of Artificial Sequence: Synthetic oligonucleotide
actcgtgagaaggtgaaaagtagtgatgaggcag

SEQ ID NO: 103836 - DNA, 33 bp, Artificial Sequence
  Description of Artificial Sequence: Synthetic oligonucleotide
ctcgtgagaaggtgaaaagtagtgatgaggcag

SEQ ID NO: 103837 - DNA, 34 bp, Artificial Sequence
  Description of Artificial Sequence: Synthetic oligonucleotide
tcgtgagaaggtgaaaagtagtgatgaggcagtg

SEQ ID NO: 103838 - DNA, 33 bp, Artificial Sequence
  Description of Artificial Sequence: Synthetic oligonucleotide
cgtgagaaggtgaaaagtagtgatgaggcagtg

SEQ ID NO: 103839 - DNA, 35 bp, Artificial Sequence
  Description of Artificial Sequence: Synthetic oligonucleotide
gtgagaaggtgaaaagtagtgatgaggcagtgatc

SEQ ID NO: 103840 - DNA, 35 bp, Artificial Sequence
  Description of Artificial Sequence: Synthetic oligonucleotide
tgagaaggtgaaaagtagtgatgaggcagtgatcc

SEQ ID NO: 103841 - DNA, 34 bp, Artificial Sequence
  Description of Artificial Sequence: Synthetic oligonucleotide
gagaaggtgaaaagtagtgatgaggcagtgatcc

SEQ ID NO: 103842 - DNA, 35 bp, Artificial Sequence
  Description of Artificial Sequence: Synthetic oligonucleotide
agaaggtgaaaagtagtgatgaggcagtgatcctg

SEQ ID NO: 103843 - DNA, 34 bp, Artificial Sequence
  Description of Artificial Sequence: Synthetic oligonucleotide
gaaggtgaaaagtagtgatgaggcagtgatcctg

SEQ ID NO: 103844 - DNA, 35 bp, Artificial Sequence
  Description of Artificial Sequence: Synthetic oligonucleotide
aaggtgaaaagtagtgatgaggcagtgatcctgtg

SEQ ID NO: 103845 - DNA, 34 bp, Artificial Sequence
  Description of Artificial Sequence: Synthetic oligonucleotide
aggtgaaaagtagtgatgaggcagtgatcctgtg

SEQ ID NO: 103846 - DNA, 33 bp, Artificial Sequence
  Description of Artificial Sequence: Synthetic oligonucleotide
ggtgaaaagtagtgatgaggcagtgatcctgtg

SEQ ID NO: 103847 - DNA, 38 bp, Artificial Sequence
  Description of Artificial Sequence: Synthetic oligonucleotide
gtgaaaagtagtgatgaggcagtgatcctgtgtaaaac

SEQ ID NO: 103848 - DNA, 39 bp, Artificial Sequence
  Description of Artificial Sequence: Synthetic oligonucleotide
tgaaaagtagtgatgaggcagtgatcctgtgtaaaacag

SEQ ID NO: 103849 - DNA, 38 bp, Artificial Sequence
  Description of Artificial Sequence: Synthetic oligonucleotide
gaaaagtagtgatgaggcagtgatcctgtgtaaaacag

SEQ ID NO: 103850 - DNA, 38 bp, Artificial Sequence
  Description of Artificial Sequence: Synthetic oligonucleotide
aaaagtagtgatgaggcagtgatcctgtgtaaaacagc

SEQ ID NO: 103851 - DNA, 37 bp, Artificial Sequence
  Description of Artificial Sequence: Synthetic oligonucleotide
aaagtagtgatgaggcagtgatcctgtgtaaaacagc

SEQ ID NO: 103852 - DNA, 36 bp, Artificial Sequence
  Description of Artificial Sequence: Synthetic oligonucleotide
aagtagtgatgaggcagtgatcctgtgtaaaacagc

SEQ ID NO: 103853 - DNA, 35 bp, Artificial Sequence
  Description of Artificial Sequence: Synthetic oligonucleotide
agtagtgatgaggcagtgatcctgtgtaaaacagc

SEQ ID NO: 103854 - DNA, 34 bp, Artificial Sequence
  Description of Artificial Sequence: Synthetic oligonucleotide
gtagtgatgaggcagtgatcctgtgtaaaacagc

SEQ ID NO: 103855 - DNA, 38 bp, Artificial Sequence
  Description of Artificial Sequence: Synthetic oligonucleotide
tagtgatgaggcagtgatcctgtgtaaaacagcaattg

SEQ ID NO: 103856 - DNA, 37 bp, Artificial Sequence
  Description of Artificial Sequence: Synthetic oligonucleotide
agtgatgaggcagtgatcctgtgtaaaacagcaattg

SEQ ID NO: 103857 - DNA, 36 bp, Artificial Sequence
  Description of Artificial Sequence: Synthetic oligonucleotide
gtgatgaggcagtgatcctgtgtaaaacagcaattg

SEQ ID NO: 103858 - DNA, 36 bp, Artificial Sequence
  Description of Artificial Sequence: Synthetic oligonucleotide
tgatgaggcagtgatcctgtgtaaaacagcaattgg

SEQ ID NO: 103859 - DNA, 35 bp, Artificial Sequence
  Description of Artificial Sequence: Synthetic oligonucleotide
gatgaggcagtgatcctgtgtaaaacagcaattgg

SEQ ID NO: 103860 - DNA, 36 bp, Artificial Sequence
  Description of Artificial Sequence: Synthetic oligonucleotide
atgaggcagtgatcctgtgtaaaacagcaattggag

SEQ ID NO: 103861 - DNA, 35 bp, Artificial Sequence
  Description of Artificial Sequence: Synthetic oligonucleotide
tgaggcagtgatcctgtgtaaaacagcaattggag

SEQ ID NO: 103862 - DNA, 34 bp, Artificial Sequence
  Description of Artificial Sequence: Synthetic oligonucleotide
gaggcagtgatcctgtgtaaaacagcaattggag

SEQ ID NO: 103863 - DNA, 34 bp, Artificial Sequence
  Description of Artificial Sequence: Synthetic oligonucleotide
aggcagtgatcctgtgtaaaacagcaattggagc

SEQ ID NO: 103864 - DNA, 33 bp, Artificial Sequence
  Description of Artificial Sequence: Synthetic oligonucleotide
ggcagtgatcctgtgtaaaacagcaattggagc

SEQ ID NO: 103865 - DNA, 34 bp, Artificial Sequence
  Description of Artificial Sequence: Synthetic oligonucleotide
gcagtgatcctgtgtaaaacagcaattggagctc

SEQ ID NO: 103866 - DNA, 44 bp, Artificial Sequence
  Description of Artificial Sequence: Synthetic oligonucleotide
cagtgatcctgtgtaaaacagcaattggagctctaaaattaaac

SEQ ID NO: 103867 - DNA, 46 bp, Artificial Sequence
  Description of Artificial Sequence: Synthetic oligonucleotide
agtgatcctgtgtaaaacagcaattggagctctaaaattaaacatc

SEQ ID NO: 103868 - DNA, 45 bp, Artificial Sequence
  Description of Artificial Sequence: Synthetic oligonucleotide
gtgatcctgtgtaaaacagcaattggagctctaaaattaaacatc

SEQ ID NO: 103869 - DNA, 45 bp, Artificial Sequence
  Description of Artificial Sequence: Synthetic oligonucleotide
tgatcctgtgtaaaacagcaattggagctctaaaattaaacatcg

SEQ ID NO: 103870 - DNA, 44 bp, Artificial Sequence
  Description of Artificial Sequence: Synthetic oligonucleotide
gatcctgtgtaaaacagcaattggagctctaaaattaaacatcg

SEQ ID NO: 103871 - DNA, 44 bp, Artificial Sequence
  Description of Artificial Sequence: Synthetic oligonucleotide
atcctgtgtaaaacagcaattggagctctaaaattaaacatcgg

SEQ ID NO: 103872 - DNA, 43 bp, Artificial Sequence
  Description of Artificial Sequence: Synthetic oligonucleotide
tcctgtgtaaaacagcaattggagctctaaaattaaacatcgg

SEQ ID NO: 103873 - DNA, 42 bp, Artificial Sequence
  Description of Artificial Sequence: Synthetic oligonucleotide
cctgtgtaaaacagcaattggagctctaaaattaaacatcgg

SEQ ID NO: 103874 - DNA, 42 bp, Artificial Sequence
  Description of Artificial Sequence: Synthetic oligonucleotide
ctgtgtaaaacagcaattggagctctaaaattaaacatcggg

SEQ ID NO: 103875 - DNA, 42 bp, Artificial Sequence
  Description of Artificial Sequence: Synthetic oligonucleotide
tgtgtaaaacagcaattggagctctaaaattaaacatcgggg

SEQ ID NO: 103876 - DNA, 41 bp, Artificial Sequence
  Description of Artificial Sequence: Synthetic oligonucleotide
gtgtaaaacagcaattggagctctaaaattaaacatcgggg

SEQ ID NO: 103877 - DNA, 42 bp, Artificial Sequence
  Description of Artificial Sequence: Synthetic oligonucleotide
tgtaaaacagcaattggagctctaaaattaaacatcggggac

SEQ ID NO: 103878 - DNA, 41 bp, Artificial Sequence
  Description of Artificial Sequence: Synthetic oligonucleotide
gtaaaacagcaattggagctctaaaattaaacatcggggac

SEQ ID NO: 103879 - DNA, 41 bp, Artificial Sequence
  Description of Artificial Sequence: Synthetic oligonucleotide
taaaacagcaattggagctctaaaattaaacatcggggacc

SEQ ID NO: 103880 - DNA, 40 bp, Artificial Sequence
  Description of Artificial Sequence: Synthetic oligonucleotide
aaaacagcaattggagctctaaaattaaacatcggggacc

SEQ ID NO: 103881 - DNA, 39 bp, Artificial Sequence
  Description of Artificial Sequence: Synthetic oligonucleotide
aaacagcaattggagctctaaaattaaacatcggggacc

SEQ ID NO: 103882 - DNA, 38 bp, Artificial Sequence
  Description of Artificial Sequence: Synthetic oligonucleotide
aacagcaattggagctctaaaattaaacatcggggacc

SEQ ID NO: 103883 - DNA, 37 bp, Artificial Sequence
  Description of Artificial Sequence: Synthetic oligonucleotide
acagcaattggagctctaaaattaaacatcggggacc

SEQ ID NO: 103884 - DNA, 36 bp, Artificial Sequence
  Description of Artificial Sequence: Synthetic oligonucleotide
cagcaattggagctctaaaattaaacatcggggacc

SEQ ID NO: 103885 - DNA, 38 bp, Artificial Sequence
  Description of Artificial Sequence: Synthetic oligonucleotide
agcaattggagctctaaaattaaacatcggggacctac

SEQ ID NO: 103886 - DNA, 37 bp, Artificial Sequence
  Description of Artificial Sequence: Synthetic oligonucleotide
gcaattggagctctaaaattaaacatcggggacctac

SEQ ID NO: 103887 - DNA, 38 bp, Artificial Sequence
  Description of Artificial Sequence: Synthetic oligonucleotide
caattggagctctaaaattaaacatcggggacctacag

SEQ ID NO: 103888 - DNA, 38 bp, Artificial Sequence
  Description of Artificial Sequence: Synthetic oligonucleotide
aattggagctctaaaattaaacatcggggacctacagg

SEQ ID NO: 103889 - DNA, 37 bp, Artificial Sequence
  Description of Artificial Sequence: Synthetic oligonucleotide
attggagctctaaaattaaacatcggggacctacagg

SEQ ID NO: 103890 - DNA, 36 bp, Artificial Sequence
  Description of Artificial Sequence: Synthetic oligonucleotide
ttggagctctaaaattaaacatcggggacctacagg

SEQ ID NO: 103891 - DNA, 35 bp, Artificial Sequence
  Description of Artificial Sequence: Synthetic oligonucleotide
tggagctctaaaattaaacatcggggacctacagg

SEQ ID NO: 103892 - DNA, 34 bp, Artificial Sequence
  Description of Artificial Sequence: Synthetic oligonucleotide
ggagctctaaaattaaacatcggggacctacagg

SEQ ID NO: 103893 - DNA, 37 bp, Artificial Sequence
  Description of Artificial Sequence: Synthetic oligonucleotide
gagctctaaaattaaacatcggggacctacaggttac

SEQ ID NO: 103894 - DNA, 40 bp, Artificial Sequence
  Description of Artificial Sequence: Synthetic oligonucleotide
agctctaaaattaaacatcggggacctacaggttacaaag

SEQ ID NO: 103895 - DNA, 39 bp, Artificial Sequence
  Description of Artificial Sequence: Synthetic oligonucleotide
gctctaaaattaaacatcggggacctacaggttacaaag

SEQ ID NO: 103896 - DNA, 39 bp, Artificial Sequence
  Description of Artificial Sequence: Synthetic oligonucleotide
ctctaaaattaaacatcggggacctacaggttacaaagg

SEQ ID NO: 103897 - DNA, 42 bp, Artificial Sequence
  Description of Artificial Sequence: Synthetic oligonucleotide
tctaaaattaaacatcggggacctacaggttacaaaggaaac

SEQ ID NO: 103898 - DNA, 41 bp, Artificial Sequence
  Description of Artificial Sequence: Synthetic oligonucleotide
ctaaaattaaacatcggggacctacaggttacaaaggaaac

SEQ ID NO: 103899 - DNA, 45 bp, Artificial Sequence
  Description of Artificial Sequence: Synthetic oligonucleotide
taaaattaaacatcggggacctacaggttacaaaggaaacaattg

SEQ ID NO: 103900 - DNA, 44 bp, Artificial Sequence
  Description of Artificial Sequence: Synthetic oligonucleotide
aaaattaaacatcggggacctacaggttacaaaggaaacaattg

SEQ ID NO: 103901 - DNA, 43 bp, Artificial Sequence
  Description of Artificial Sequence: Synthetic oligonucleotide
aaattaaacatcggggacctacaggttacaaaggaaacaattg

SEQ ID NO: 103902 - DNA, 42 bp, Artificial Sequence
  Description of Artificial Sequence: Synthetic oligonucleotide
aattaaacatcggggacctacaggttacaaaggaaacaattg

SEQ ID NO: 103903 - DNA, 41 bp, Artificial Sequence
  Description of Artificial Sequence: Synthetic oligonucleotide
attaaacatcggggacctacaggttacaaaggaaacaattg

SEQ ID NO: 103904 - DNA, 40 bp, Artificial Sequence
  Description of Artificial Sequence: Synthetic oligonucleotide
ttaaacatcggggacctacaggttacaaaggaaacaattg

SEQ ID NO: 103905 - DNA, 39 bp, Artificial Sequence
  Description of Artificial Sequence: Synthetic oligonucleotide
taaacatcggggacctacaggttacaaaggaaacaattg

SEQ ID NO: 103906 - DNA, 38 bp, Artificial Sequence
  Description of Artificial Sequence: Synthetic oligonucleotide
aaacatcggggacctacaggttacaaaggaaacaattg

SEQ ID NO: 103907 - DNA, 37 bp, Artificial Sequence
  Description of Artificial Sequence: Synthetic oligonucleotide
aacatcggggacctacaggttacaaaggaaacaattg

SEQ ID NO: 103908 - DNA, 36 bp, Artificial Sequence
  Description of Artificial Sequence: Synthetic oligonucleotide
acatcggggacctacaggttacaaaggaaacaattg

SEQ ID NO: 103909 - DNA, 35 bp, Artificial Sequence
  Description of Artificial Sequence: Synthetic oligonucleotide
catcggggacctacaggttacaaaggaaacaattg

SEQ ID NO: 103910 - DNA, 37 bp, Artificial Sequence
  Description of Artificial Sequence: Synthetic oligonucleotide
atcggggacctacaggttacaaaggaaacaattgaag

SEQ ID NO: 103911 - DNA, 36 bp, Artificial Sequence
  Description of Artificial Sequence: Synthetic oligonucleotide
tcggggacctacaggttacaaaggaaacaattgaag

SEQ ID NO: 103912 - DNA, 35 bp, Artificial Sequence
  Description of Artificial Sequence: Synthetic oligonucleotide
cggggacctacaggttacaaaggaaacaattgaag

SEQ ID NO: 103913 - DNA, 37 bp, Artificial Sequence
  Description of Artificial Sequence: Synthetic oligonucleotide
ggggacctacaggttacaaaggaaacaattgaagatg

SEQ ID NO: 103914 - DNA, 39 bp, Artificial Sequence
  Description of Artificial Sequence: Synthetic oligonucleotide
gggacctacaggttacaaaggaaacaattgaagatgttg

SEQ ID NO: 103915 - DNA, 41 bp, Artificial Sequence
  Description of Artificial Sequence: Synthetic oligonucleotide
ggacctacaggttacaaaggaaacaattgaagatgttgaag

SEQ ID NO: 103916 - DNA, 45 bp, Artificial Sequence
  Description of Artificial Sequence: Synthetic oligonucleotide
gacctacaggttacaaaggaaacaattgaagatgttgaagaaatg

SEQ ID NO: 103917 - DNA, 45 bp, Artificial Sequence
  Description of Artificial Sequence: Synthetic oligonucleotide
acctacaggttacaaaggaaacaattgaagatgttgaagaaatgc

SEQ ID NO: 103918 - DNA, 44 bp, Artificial Sequence
  Description of Artificial Sequence: Synthetic oligonucleotide
cctacaggttacaaaggaaacaattgaagatgttgaagaaatgc

SEQ ID NO: 103919 - DNA, 45 bp, Artificial Sequence
  Description of Artificial Sequence: Synthetic oligonucleotide
ctacaggttacaaaggaaacaattgaagatgttgaagaaatgctc

SEQ ID NO: 103920 - DNA, 47 bp, Artificial Sequence
  Description of Artificial Sequence: Synthetic oligonucleotide
tacaggttacaaaggaaacaattgaagatgttgaagaaatgctcaac

SEQ ID NO: 103921 - DNA, 46 bp, Artificial Sequence
  Description of Artificial Sequence: Synthetic oligonucleotide
acaggttacaaaggaaacaattgaagatgttgaagaaatgctcaac

SEQ ID NO: 103922 - DNA, 45 bp, Artificial Sequence
  Description of Artificial Sequence: Synthetic oligonucleotide
caggttacaaaggaaacaattgaagatgttgaagaaatgctcaac

SEQ ID NO: 103923 - DNA, 47 bp, Artificial Sequence
  Description of Artificial Sequence: Synthetic oligonucleotide
aggttacaaaggaaacaattgaagatgttgaagaaatgctcaacaac

SEQ ID NO: 103924 - DNA, 46 bp, Artificial Sequence
  Description of Artificial Sequence: Synthetic oligonucleotide
ggttacaaaggaaacaattgaagatgttgaagaaatgctcaacaac

SEQ ID NO: 103925 - DNA, 46 bp, Artificial Sequence
  Description of Artificial Sequence: Synthetic oligonucleotide
gttacaaaggaaacaattgaagatgttgaagaaatgctcaacaacc

SEQ ID NO: 103926 - DNA, 48 bp, Artificial Sequence
  Description of Artificial Sequence: Synthetic oligonucleotide
ttacaaaggaaacaattgaagatgttgaagaaatgctcaacaaccttc

SEQ ID NO: 103927 - DNA, 47 bp, Artificial Sequence
  Description of Artificial Sequence: Synthetic oligonucleotide
tacaaaggaaacaattgaagatgttgaagaaatgctcaacaaccttc

SEQ ID NO: 103928 - DNA, 46 bp, Artificial Sequence
  Description of Artificial Sequence: Synthetic oligonucleotide
acaaaggaaacaattgaagatgttgaagaaatgctcaacaaccttc

SEQ ID NO: 103929 - DNA, 45 bp, Artificial Sequence
  Description of Artificial Sequence: Synthetic oligonucleotide
caaaggaaacaattgaagatgttgaagaaatgctcaacaaccttc

SEQ ID NO: 103930 - DNA, 45 bp, Artificial Sequence
  Description of Artificial Sequence: Synthetic oligonucleotide
aaaggaaacaattgaagatgttgaagaaatgctcaacaaccttcc

SEQ ID NO: 103931 - DNA, 44 bp, Artificial Sequence
  Description of Artificial Sequence: Synthetic oligonucleotide
aaggaaacaattgaagatgttgaagaaatgctcaacaaccttcc

SEQ ID NO: 103932 - DNA, 43 bp, Artificial Sequence
  Description of Artificial Sequence: Synthetic oligonucleotide
aggaaacaattgaagatgttgaagaaatgctcaacaaccttcc

SEQ ID NO: 103933 - DNA, 42 bp, Artificial Sequence
  Description of Artificial Sequence: Synthetic oligonucleotide
ggaaacaattgaagatgttgaagaaatgctcaacaaccttcc

SEQ ID NO: 103934 - DNA, 43 bp, Artificial Sequence
  Description of Artificial Sequence: Synthetic oligonucleotide
gaaacaattgaagatgttgaagaaatgctcaacaaccttcctg

SEQ ID NO: 103935 - DNA, 43 bp, Artificial Sequence
  Description of Artificial Sequence: Synthetic oligonucleotide
aaacaattgaagatgttgaagaaatgctcaacaaccttcctgg

SEQ ID NO: 103936 - DNA, 42 bp, Artificial Sequence
  Description of Artificial Sequence: Synthetic oligonucleotide
aacaattgaagatgttgaagaaatgctcaacaaccttcctgg

SEQ ID NO: 103937 - DNA, 41 bp, Artificial Sequence
  Description of Artificial Sequence: Synthetic oligonucleotide
acaattgaagatgttgaagaaatgctcaacaaccttcctgg

SEQ ID NO: 103938 - DNA, 40 bp, Artificial Sequence
  Description of Artificial Sequence: Synthetic oligonucleotide
caattgaagatgttgaagaaatgctcaacaaccttcctgg

SEQ ID NO: 103939 - DNA, 41 bp, Artificial Sequence
  Description of Artificial Sequence: Synthetic oligonucleotide
aattgaagatgttgaagaaatgctcaacaaccttcctggtg

SEQ ID NO: 103940 - DNA, 40 bp, Artificial Sequence
  Description of Artificial Sequence: Synthetic oligonucleotide
attgaagatgttgaagaaatgctcaacaaccttcctggtg

SEQ ID NO: 103941 - DNA, 39 bp, Artificial Sequence
  Description of Artificial Sequence: Synthetic oligonucleotide
ttgaagatgttgaagaaatgctcaacaaccttcctggtg

SEQ ID NO: 103942 - DNA, 38 bp, Artificial Sequence
  Description of Artificial Sequence: Synthetic oligonucleotide
tgaagatgttgaagaaatgctcaacaaccttcctggtg

SEQ ID NO: 103943 - DNA, 37 bp, Artificial Sequence
  Description of Artificial Sequence: Synthetic oligonucleotide
gaagatgttgaagaaatgctcaacaaccttcctggtg

SEQ ID NO: 103944 - DNA, 38 bp, Artificial Sequence
  Description of Artificial Sequence: Synthetic oligonucleotide
aagatgttgaagaaatgctcaacaaccttcctggtgtg

SEQ ID NO: 103945 - DNA, 37 bp, Artificial Sequence
  Description of Artificial Sequence: Synthetic oligonucleotide
agatgttgaagaaatgctcaacaaccttcctggtgtg

SEQ ID NO: 103946 - DNA, 36 bp, Artificial Sequence
  Description of Artificial Sequence: Synthetic oligonucleotide
gatgttgaagaaatgctcaacaaccttcctggtgtg

SEQ ID NO: 103947 - DNA, 37 bp, Artificial Sequence
  Description of Artificial Sequence: Synthetic oligonucleotide
atgttgaagaaatgctcaacaaccttcctggtgtgac

SEQ ID NO: 103948 - DNA, 36 bp, Artificial Sequence
  Description of Artificial Sequence: Synthetic oligonucleotide
tgttgaagaaatgctcaacaaccttcctggtgtgac

SEQ ID NO: 103949 - DNA, 35 bp, Artificial Sequence
  Description of Artificial Sequence: Synthetic oligonucleotide
gttgaagaaatgctcaacaaccttcctggtgtgac

SEQ ID NO: 103950 - DNA, 37 bp, Artificial Sequence
  Description of Artificial Sequence: Synthetic oligonucleotide
ttgaagaaatgctcaacaaccttcctggtgtgacatc

SEQ ID NO: 103951 - DNA, 36 bp, Artificial Sequence
  Description of Artificial Sequence: Synthetic oligonucleotide
tgaagaaatgctcaacaaccttcctggtgtgacatc

SEQ ID NO: 103952 - DNA, 35 bp, Artificial Sequence
  Description of Artificial Sequence: Synthetic oligonucleotide
gaagaaatgctcaacaaccttcctggtgtgacatc

SEQ ID NO: 103953 - DNA, 35 bp, Artificial Sequence
  Description of Artificial Sequence: Synthetic oligonucleotide
aagaaatgctcaacaaccttcctggtgtgacatcg

SEQ ID NO: 103954 - DNA, 34 bp, Artificial Sequence
  Description of Artificial Sequence: Synthetic oligonucleotide
agaaatgctcaacaaccttcctggtgtgacatcg

SEQ ID NO: 103955 - DNA, 33 bp, Artificial Sequence
  Description of Artificial Sequence: Synthetic oligonucleotide
gaaatgctcaacaaccttcctggtgtgacatcg

SEQ ID NO: 103956 - DNA, 33 bp, Artificial Sequence
  Description of Artificial Sequence: Synthetic oligonucleotide
aaatgctcaacaaccttcctggtgtgacatcgg

SEQ ID NO: 103957 - DNA, 32 bp, Artificial Sequence
  Description of Artificial Sequence: Synthetic oligonucleotide
aatgctcaacaaccttcctggtgtgacatcgg

SEQ ID NO: 103958 - DNA, 31 bp, Artificial Sequence
  Description of Artificial Sequence: Synthetic oligonucleotide
atgctcaacaaccttcctggtgtgacatcgg

SEQ ID NO: 103959 - DNA, 30 bp, Artificial Sequence
  Description of Artificial Sequence: Synthetic oligonucleotide
tgctcaacaaccttcctggtgtgacatcgg

SEQ ID NO: 103960 - DNA, 29 bp, Artificial Sequence
  Description of Artificial Sequence: Synthetic oligonucleotide
gctcaacaaccttcctggtgtgacatcgg

SEQ ID NO: 103961 - DNA, 31 bp, Artificial Sequence
  Description of Artificial Sequence: Synthetic oligonucleotide
ctcaacaaccttcctggtgtgacatcggttc

SEQ ID NO: 103962 - DNA, 32 bp, Artificial Sequence
  Description of Artificial Sequence: Synthetic oligonucleotide
tcaacaaccttcctggtgtgacatcggttcac

SEQ ID NO: 103963 - DNA, 31 bp, Artificial Sequence
  Description of Artificial Sequence: Synthetic oligonucleotide
caacaaccttcctggtgtgacatcggttcac

SEQ ID NO: 103964 - DNA, 32 bp, Artificial Sequence
  Description of Artificial Sequence: Synthetic oligonucleotide
aacaaccttcctggtgtgacatcggttcacag

SEQ ID NO: 103965 - DNA, 31 bp, Artificial Sequence
  Description of Artificial Sequence: Synthetic oligonucleotide
acaaccttcctggtgtgacatcggttcacag

SEQ ID NO: 103966 - DNA, 30 bp, Artificial Sequence
  Description of Artificial Sequence: Synthetic oligonucleotide
caaccttcctggtgtgacatcggttcacag

SEQ ID NO: 103967 - DNA, 31 bp, Artificial Sequence
  Description of Artificial Sequence: Synthetic oligonucleotide
aaccttcctggtgtgacatcggttcacagtc

SEQ ID NO: 103968 - DNA, 30 bp, Artificial Sequence
  Description of Artificial Sequence: Synthetic oligonucleotide
accttcctggtgtgacatcggttcacagtc

SEQ ID NO: 103969 - DNA, 29 bp, Artificial Sequence
  Description of Artificial Sequence: Synthetic oligonucleotide
ccttcctggtgtgacatcggttcacagtc

SEQ ID NO: 103970 - DNA, 29 bp, Artificial Sequence
  Description of Artificial Sequence: Synthetic oligonucleotide
cttcctggtgtgacatcggttcacagtcg

SEQ ID NO: 103971 - DNA, 32 bp, Artificial Sequence
  Description of Artificial Sequence: Synthetic oligonucleotide
ttcctggtgtgacatcggttcacagtcgtttc

SEQ ID NO: 103972 - DNA, 31 bp, Artificial Sequence
  Description of Artificial Sequence: Synthetic oligonucleotide
tcctggtgtgacatcggttcacagtcgtttc

SEQ ID NO: 103973 - DNA, 30 bp, Artificial Sequence
  Description of Artificial Sequence: Synthetic oligonucleotide
cctggtgtgacatcggttcacagtcgtttc

SEQ ID NO: 103974 - DNA, 33 bp, Artificial Sequence
  Description of Artificial Sequence: Synthetic oligonucleotide
ctggtgtgacatcggttcacagtcgtttctatg

SEQ ID NO: 103975 - DNA, 35 bp, Artificial Sequence
  Description of Artificial Sequence: Synthetic oligonucleotide
tggtgtgacatcggttcacagtcgtttctatgatc

SEQ ID NO: 103976 - DNA, 34 bp, Artificial Sequence
  Description of Artificial Sequence: Synthetic oligonucleotide
ggtgtgacatcggttcacagtcgtttctatgatc

SEQ ID NO: 103977 - DNA, 35 bp, Artificial Sequence
  Description of Artificial Sequence: Synthetic oligonucleotide
gtgtgacatcggttcacagtcgtttctatgatctc

SEQ ID NO: 103978 - DNA, 36 bp, Artificial Sequence
  Description of Artificial Sequence: Synthetic oligonucleotide
tgtgacatcggttcacagtcgtttctatgatctctc

SEQ ID NO: 103979 - DNA, 35 bp, Artificial Sequence
  Description of Artificial Sequence: Synthetic oligonucleotide
gtgacatcggttcacagtcgtttctatgatctctc

SEQ ID NO: 103980 - DNA, 35 bp, Artificial Sequence
  Description of Artificial Sequence: Synthetic oligonucleotide
tgacatcggttcacagtcgtttctatgatctctcc

SEQ ID NO: 103981 - DNA, 34 bp, Artificial Sequence
  Description of Artificial Sequence: Synthetic oligonucleotide
gacatcggttcacagtcgtttctatgatctctcc

SEQ ID NO: 103982 - DNA, 35 bp, Artificial Sequence
  Description of Artificial Sequence: Synthetic oligonucleotide
acatcggttcacagtcgtttctatgatctctccag

SEQ ID NO: 103983 - DNA, 34 bp, Artificial Sequence
  Description of Artificial Sequence: Synthetic oligonucleotide
catcggttcacagtcgtttctatgatctctccag

SEQ ID NO: 103984 - DNA, 40 bp, Artificial Sequence
  Description of Artificial Sequence: Synthetic oligonucleotide
atcggttcacagtcgtttctatgatctctccagtaaatac

SEQ ID NO: 103985 - DNA, 39 bp, Artificial Sequence
  Description of Artificial Sequence: Synthetic oligonucleotide
tcggttcacagtcgtttctatgatctctccagtaaatac

SEQ ID NO: 103986 - DNA, 38 bp, Artificial Sequence
  Description of Artificial Sequence: Synthetic oligonucleotide
cggttcacagtcgtttctatgatctctccagtaaatac

SEQ ID NO: 103987 - DNA, 41 bp, Artificial Sequence
  Description of Artificial Sequence: Synthetic oligonucleotide
ggttcacagtcgtttctatgatctctccagtaaatactatc

SEQ ID NO: 103988 - DNA, 44 bp, Artificial Sequence
  Description of Artificial Sequence: Synthetic oligonucleotide
gttcacagtcgtttctatgatctctccagtaaatactatcaaac

SEQ ID NO: 103989 - DNA, 47 bp, Artificial Sequence
  Description of Artificial Sequence: Synthetic oligonucleotide
ttcacagtcgtttctatgatctctccagtaaatactatcaaacaatc

SEQ ID NO: 103990 - DNA, 46 bp, Artificial Sequence
  Description of Artificial Sequence: Synthetic oligonucleotide
tcacagtcgtttctatgatctctccagtaaatactatcaaacaatc

SEQ ID NO: 103991 - DNA, 45 bp, Artificial Sequence
  Description of Artificial Sequence: Synthetic oligonucleotide
cacagtcgtttctatgatctctccagtaaatactatcaaacaatc

SEQ ID NO: 103992 - DNA, 45 bp, Artificial Sequence
  Description of Artificial Sequence: Synthetic oligonucleotide
acagtcgtttctatgatctctccagtaaatactatcaaacaatcg

SEQ ID NO: 103993 - DNA, 44 bp, Artificial Sequence
  Description of Artificial Sequence: Synthetic oligonucleotide
cagtcgtttctatgatctctccagtaaatactatcaaacaatcg

SEQ ID NO: 103994 - DNA, 44 bp, Artificial Sequence
  Description of Artificial Sequence: Synthetic oligonucleotide
agtcgtttctatgatctctccagtaaatactatcaaacaatcgg

SEQ ID NO: 103995 - DNA, 43 bp, Artificial Sequence
  Description of Artificial Sequence: Synthetic oligonucleotide
gtcgtttctatgatctctccagtaaatactatcaaacaatcgg

SEQ ID NO: 103996 - DNA, 46 bp, Artificial Sequence
  Description of Artificial Sequence: Synthetic oligonucleotide
tcgtttctatgatctctccagtaaatactatcaaacaatcggaaac

SEQ ID NO: 103997 - DNA, 45 bp, Artificial Sequence
  Description of Artificial Sequence: Synthetic oligonucleotide
cgtttctatgatctctccagtaaatactatcaaacaatcggaaac

SEQ ID NO: 103998 - DNA, 45 bp, Artificial Sequence
  Description of Artificial Sequence: Synthetic oligonucleotide
gtttctatgatctctccagtaaatactatcaaacaatcggaaacc

SEQ ID NO: 103999 - DNA, 46 bp, Artificial Sequence
  Description of Artificial Sequence: Synthetic oligonucleotide
tttctatgatctctccagtaaatactatcaaacaatcggaaaccac

SEQ ID NO: 104000 - DNA, 45 bp, Artificial Sequence
  Description of Artificial Sequence: Synthetic oligonucleotide
ttctatgatctctccagtaaatactatcaaacaatcggaaaccac

SEQ ID NO: 104001 - DNA, 44 bp, Artificial Sequence
  Description of Artificial Sequence: Synthetic oligonucleotide
tctatgatctctccagtaaatactatcaaacaatcggaaaccac

SEQ ID NO: 104002 - DNA, 43 bp, Artificial Sequence
  Description of Artificial Sequence: Synthetic oligonucleotide
ctatgatctctccagtaaatactatcaaacaatcggaaaccac

SEQ ID NO: 104003 - DNA, 43 bp, Artificial Sequence
  Description of Artificial Sequence: Synthetic oligonucleotide
tatgatctctccagtaaatactatcaaacaatcggaaaccacg

SEQ ID NO: 104004 - DNA, 42 bp, Artificial Sequence
  Description of Artificial Sequence: Synthetic oligonucleotide
atgatctctccagtaaatactatcaaacaatcggaaaccacg

SEQ ID NO: 104005 - DNA, 41 bp, Artificial Sequence
  Description of Artificial Sequence: Synthetic oligonucleotide
tgatctctccagtaaatactatcaaacaatcggaaaccacg

SEQ ID NO: 104006 - DNA, 40 bp, Artificial Sequence
  Description of Artificial Sequence: Synthetic oligonucleotide
gatctctccagtaaatactatcaaacaatcggaaaccacg

SEQ ID NO: 104007 - DNA, 40 bp, Artificial Sequence
  Description of Artificial Sequence: Synthetic oligonucleotide
atctctccagtaaatactatcaaacaatcggaaaccacgc

SEQ ID NO: 104008 - DNA, 39 bp, Artificial Sequence
  Description of Artificial Sequence: Synthetic oligonucleotide
tctctccagtaaatactatcaaacaatcggaaaccacgc

SEQ ID NO: 104009 - DNA, 38 bp, Artificial Sequence
  Description of Artificial Sequence: Synthetic oligonucleotide
ctctccagtaaatactatcaaacaatcggaaaccacgc

SEQ ID NO: 104010 - DNA, 38 bp, Artificial Sequence
  Description of Artificial Sequence: Synthetic oligonucleotide
tctccagtaaatactatcaaacaatcggaaaccacgcg

SEQ ID NO: 104011 - DNA, 37 bp, Artificial Sequence
  Description of Artificial Sequence: Synthetic oligonucleotide
ctccagtaaatactatcaaacaatcggaaaccacgcg

SEQ ID NO: 104012 - DNA, 38 bp, Artificial Sequence
  Description of Artificial Sequence: Synthetic oligonucleotide
tccagtaaatactatcaaacaatcggaaaccacgcgtc

SEQ ID NO: 104013 - DNA, 37 bp, Artificial Sequence
  Description of Artificial Sequence: Synthetic oligonucleotide
ccagtaaatactatcaaacaatcggaaaccacgcgtc

SEQ ID NO: 104014 - DNA, 37 bp, Artificial Sequence
  Description of Artificial Sequence: Synthetic oligonucleotide
cagtaaatactatcaaacaatcggaaaccacgcgtcc

SEQ ID NO: 104015 - DNA, 39 bp, Artificial Sequence
  Description of Artificial Sequence: Synthetic oligonucleotide
agtaaatactatcaaacaatcggaaaccacgcgtcctac

SEQ ID NO: 104016 - DNA, 38 bp, Artificial Sequence
  Description of Artificial Sequence: Synthetic oligonucleotide
gtaaatactatcaaacaatcggaaaccacgcgtcctac

SEQ ID NO: 104017 - DNA, 40 bp, Artificial Sequence
  Description of Artificial Sequence: Synthetic oligonucleotide
taaatactatcaaacaatcggaaaccacgcgtcctactac

SEQ ID NO: 104018 - DNA, 39 bp, Artificial Sequence
  Description of Artificial Sequence: Synthetic oligonucleotide
aaatactatcaaacaatcggaaaccacgcgtcctactac

SEQ ID NO: 104019 - DNA, 38 bp, Artificial Sequence
  Description of Artificial Sequence: Synthetic oligonucleotide
aatactatcaaacaatcggaaaccacgcgtcctactac

SEQ ID NO: 104020 - DNA, 37 bp, Artificial Sequence
  Description of Artificial Sequence: Synthetic oligonucleotide
atactatcaaacaatcggaaaccacgcgtcctactac

SEQ ID NO: 104021 - DNA, 36 bp, Artificial Sequence
  Description of Artificial Sequence: Synthetic oligonucleotide
tactatcaaacaatcggaaaccacgcgtcctactac

SEQ ID NO: 104022 - DNA, 35 bp, Artificial Sequence
  Description of Artificial Sequence: Synthetic oligonucleotide
actatcaaacaatcggaaaccacgcgtcctactac

SEQ ID NO: 104023 - DNA, 34 bp, Artificial Sequence
  Description of Artificial Sequence: Synthetic oligonucleotide
ctatcaaacaatcggaaaccacgcgtcctactac

SEQ ID NO: 104024 - DNA, 37 bp, Artificial Sequence
  Description of Artificial Sequence: Synthetic oligonucleotide
tatcaaacaatcggaaaccacgcgtcctactacaaag

SEQ ID NO: 104025 - DNA, 36 bp, Artificial Sequence
  Description of Artificial Sequence: Synthetic oligonucleotide
atcaaacaatcggaaaccacgcgtcctactacaaag

SEQ ID NO: 104026 - DNA, 35 bp, Artificial Sequence
  Description of Artificial Sequence: Synthetic oligonucleotide
tcaaacaatcggaaaccacgcgtcctactacaaag

SEQ ID NO: 104027 - DNA, 34 bp, Artificial Sequence
  Description of Artificial Sequence: Synthetic oligonucleotide
caaacaatcggaaaccacgcgtcctactacaaag

SEQ ID NO: 104028 - DNA, 36 bp, Artificial Sequence
  Description of Artificial Sequence: Synthetic oligonucleotide
aaacaatcggaaaccacgcgtcctactacaaagatg

SEQ ID NO: 104029 - DNA, 35 bp, Artificial Sequence
  Description of Artificial Sequence: Synthetic oligonucleotide
aacaatcggaaaccacgcgtcctactacaaagatg

SEQ ID NO: 104030 - DNA, 34 bp, Artificial Sequence
  Description of Artificial Sequence: Synthetic oligonucleotide
acaatcggaaaccacgcgtcctactacaaagatg

SEQ ID NO: 104031 - DNA, 33 bp, Artificial Sequence
  Description of Artificial Sequence: Synthetic oligonucleotide
caatcggaaaccacgcgtcctactacaaagatg

SEQ ID NO: 104032 - DNA, 33 bp, Artificial Sequence
  Description of Artificial Sequence: Synthetic oligonucleotide
aatcggaaaccacgcgtcctactacaaagatgc

SEQ ID NO: 104033 - DNA, 32 bp, Artificial Sequence
  Description of Artificial Sequence: Synthetic oligonucleotide
atcggaaaccacgcgtcctactacaaagatgc

SEQ ID NO: 104034 - DNA, 31 bp, Artificial Sequence
  Description of Artificial Sequence: Synthetic oligonucleotide
tcggaaaccacgcgtcctactacaaagatgc

SEQ ID NO: 104035 - DNA, 30 bp, Artificial Sequence
  Description of Artificial Sequence: Synthetic oligonucleotide
cggaaaccacgcgtcctactacaaagatgc

SEQ ID NO: 104036 - DNA, 31 bp, Artificial Sequence
  Description of Artificial Sequence: Synthetic oligonucleotide
ggaaaccacgcgtcctactacaaagatgctc

SEQ ID NO: 104037 - DNA, 32 bp, Artificial Sequence
  Description of Artificial Sequence: Synthetic oligonucleotide
gaaaccacgcgtcctactacaaagatgctctg

SEQ ID NO: 104038 - DNA, 32 bp, Artificial Sequence
  Description of Artificial Sequence: Synthetic oligonucleotide
aaaccacgcgtcctactacaaagatgctctgc

SEQ ID NO: 104039 - DNA, 31 bp, Artificial Sequence
  Description of Artificial Sequence: Synthetic oligonucleotide
aaccacgcgtcctactacaaagatgctctgc

SEQ ID NO: 104040 - DNA, 30 bp, Artificial Sequence
  Description of Artificial Sequence: Synthetic oligonucleotide
accacgcgtcctactacaaagatgctctgc

SEQ ID NO: 104041 - DNA, 29 bp, Artificial Sequence
  Description of Artificial Sequence: Synthetic oligonucleotide
ccacgcgtcctactacaaagatgctctgc

SEQ ID NO: 104042 - DNA, 29 bp, Artificial Sequence
  Description of Artificial Sequence: Synthetic oligonucleotide
cacgcgtcctactacaaagatgctctgcg

SEQ ID NO: 104043 - DNA, 29 bp, Artificial Sequence
  Description of Artificial Sequence: Synthetic oligonucleotide
acgcgtcctactacaaagatgctctgcgg

SEQ ID NO: 104044 - DNA, 28 bp, Artificial Sequence
  Description of Artificial Sequence: Synthetic oligonucleotide
cgcgtcctactacaaagatgctctgcgg

SEQ ID NO: 104045 - DNA, 33 bp, Artificial Sequence
  Description of Artificial Sequence: Synthetic oligonucleotide
gcgtcctactacaaagatgctctgcggtttttg

SEQ ID NO: 104046 - DNA, 33 bp, Artificial Sequence
  Description of Artificial Sequence: Synthetic oligonucleotide
cgtcctactacaaagatgctctgcggtttttgg

SEQ ID NO: 104047 - DNA, 33 bp, Artificial Sequence
  Description of Artificial Sequence: Synthetic oligonucleotide
gtcctactacaaagatgctctgcggtttttggg

SEQ ID NO: 104048 - DNA, 33 bp, Artificial Sequence
  Description of Artificial Sequence: Synthetic oligonucleotide
tcctactacaaagatgctctgcggtttttgggc

SEQ ID NO: 104049 - DNA, 32 bp, Artificial Sequence
  Description of Artificial Sequence: Synthetic oligonucleotide
cctactacaaagatgctctgcggtttttgggc

SEQ ID NO: 104050 - DNA, 33 bp, Artificial Sequence
  Description of Artificial Sequence: Synthetic oligonucleotide
ctactacaaagatgctctgcggtttttgggctg

SEQ ID NO: 104051 - DNA, 34 bp, Artificial Sequence
  Description of Artificial Sequence: Synthetic oligonucleotide
tactacaaagatgctctgcggtttttgggctgtg

SEQ ID NO: 104052 - DNA, 33 bp, Artificial Sequence
  Description of Artificial Sequence: Synthetic oligonucleotide
actacaaagatgctctgcggtttttgggctgtg

SEQ ID NO: 104053 - DNA, 32 bp, Artificial Sequence
  Description of Artificial Sequence: Synthetic oligonucleotide
ctacaaagatgctctgcggtttttgggctgtg

SEQ ID NO: 104054 - DNA, 34 bp, Artificial Sequence
  Description of Artificial Sequence: Synthetic oligonucleotide
tacaaagatgctctgcggtttttgggctgtgttg

SEQ ID NO: 104055 - DNA, 33 bp, Artificial Sequence
  Description of Artificial Sequence: Synthetic oligonucleotide
acaaagatgctctgcggtttttgggctgtgttg

SEQ ID NO: 104056 - DNA, 32 bp, Artificial Sequence
  Description of Artificial Sequence: Synthetic oligonucleotide
caaagatgctctgcggtttttgggctgtgttg

SEQ ID NO: 104057 - DNA, 33 bp, Artificial Sequence
  Description of Artificial Sequence: Synthetic oligonucleotide
aaagatgctctgcggtttttgggctgtgttgac

SEQ ID NO: 104058 - DNA, 32 bp, Artificial Sequence
  Description of Artificial Sequence: Synthetic oligonucleotide
aagatgctctgcggtttttgggctgtgttgac

SEQ ID NO: 104059 - DNA, 31 bp, Artificial Sequence
  Description of Artificial Sequence: Synthetic oligonucleotide
agatgctctgcggtttttgggctgtgttgac

SEQ ID NO: 104060 - DNA, 30 bp, Artificial Sequence
  Description of Artificial Sequence: Synthetic oligonucleotide
gatgctctgcggtttttgggctgtgttgac

SEQ ID NO: 104061 - DNA, 32 bp, Artificial Sequence
  Description of Artificial Sequence: Synthetic oligonucleotide
atgctctgcggtttttgggctgtgttgacatc

SEQ ID NO: 104062 - DNA, 31 bp, Artificial Sequence
  Description of Artificial Sequence: Synthetic oligonucleotide
tgctctgcggtttttgggctgtgttgacatc

SEQ ID NO: 104063 - DNA, 30 bp, Artificial Sequence
  Description of Artificial Sequence: Synthetic oligonucleotide
gctctgcggtttttgggctgtgttgacatc

SEQ ID NO: 104064 - DNA, 32 bp, Artificial Sequence
  Description of Artificial Sequence: Synthetic oligonucleotide
ctctgcggtttttgggctgtgttgacatcaag

SEQ ID NO: 104065 - DNA, 32 bp, Artificial Sequence
  Description of Artificial Sequence: Synthetic oligonucleotide
tctgcggtttttgggctgtgttgacatcaagg

SEQ ID NO: 104066 - DNA, 31 bp, Artificial Sequence
  Description of Artificial Sequence: Synthetic oligonucleotide
ctgcggtttttgggctgtgttgacatcaagg

SEQ ID NO: 104067 - DNA, 33 bp, Artificial Sequence
  Description of Artificial Sequence: Synthetic oligonucleotide
tgcggtttttgggctgtgttgacatcaaggatc

SEQ ID NO: 104068 - DNA, 32 bp, Artificial Sequence
  Description of Artificial Sequence: Synthetic oligonucleotide
gcggtttttgggctgtgttgacatcaaggatc

SEQ ID NO: 104069 - DNA, 34 bp, Artificial Sequence
  Description of Artificial Sequence: Synthetic oligonucleotide
cggtttttgggctgtgttgacatcaaggatctac

SEQ ID NO: 104070 - DNA, 34 bp, Artificial Sequence
  Description of Artificial Sequence: Synthetic oligonucleotide
ggtttttgggctgtgttgacatcaaggatctacc

SEQ ID NO: 104071 - DNA, 35 bp, Artificial Sequence
  Description of Artificial Sequence: Synthetic oligonucleotide
gtttttgggctgtgttgacatcaaggatctaccag

SEQ ID NO: 104072 - DNA, 36 bp, Artificial Sequence
  Description of Artificial Sequence: Synthetic oligonucleotide
tttttgggctgtgttgacatcaaggatctaccagtg

SEQ ID NO: 104073 - DNA, 35 bp, Artificial Sequence
  Description of Artificial Sequence: Synthetic oligonucleotide
ttttgggctgtgttgacatcaaggatctaccagtg

SEQ ID NO: 104074 - DNA, 34 bp, Artificial Sequence
  Description of Artificial Sequence: Synthetic oligonucleotide
tttgggctgtgttgacatcaaggatctaccagtg

SEQ ID NO: 104075 - DNA, 33 bp, Artificial Sequence
  Description of Artificial Sequence: Synthetic oligonucleotide
ttgggctgtgttgacatcaaggatctaccagtg

SEQ ID NO: 104076 - DNA, 32 bp, Artificial Sequence
  Description of Artificial Sequence: Synthetic oligonucleotide
tgggctgtgttgacatcaaggatctaccagtg

SEQ ID NO: 104077 - DNA, 31 bp, Artificial Sequence
  Description of Artificial Sequence: Synthetic oligonucleotide
gggctgtgttgacatcaaggatctaccagtg

SEQ ID NO: 104078 - DNA, 32 bp, Artificial Sequence
  Description of Artificial Sequence: Synthetic oligonucleotide
ggctgtgttgacatcaaggatctaccagtgtc

SEQ ID NO: 104079 - DNA, 33 bp, Artificial Sequence
  Description of Artificial Sequence: Synthetic oligonucleotide
gctgtgttgacatcaaggatctaccagtgtctg

SEQ ID NO: 104080 - DNA, 34 bp, Artificial Sequence
  Description of Artificial Sequence: Synthetic oligonucleotide
ctgtgttgacatcaaggatctaccagtgtctgag

SEQ ID NO: 104081 - DNA, 34 bp, Artificial Sequence
  Description of Artificial Sequence: Synthetic oligonucleotide
tgtgttgacatcaaggatctaccagtgtctgagc

SEQ ID NO: 104082 - DNA, 33 bp, Artificial Sequence
  Description of Artificial Sequence: Synthetic oligonucleotide
gtgttgacatcaaggatctaccagtgtctgagc

SEQ ID NO: 104083 - DNA, 34 bp, Artificial Sequence
  Description of Artificial Sequence: Synthetic oligonucleotide
tgttgacatcaaggatctaccagtgtctgagcag

SEQ ID NO: 104084 - DNA, 33 bp, Artificial Sequence
  Description of Artificial Sequence: Synthetic oligonucleotide
gttgacatcaaggatctaccagtgtctgagcag

SEQ ID NO: 104085 - DNA, 33 bp, Artificial Sequence
  Description of Artificial Sequence: Synthetic oligonucleotide
ttgacatcaaggatctaccagtgtctgagcagc

SEQ ID NO: 104086 - DNA, 32 bp, Artificial Sequence
  Description of Artificial Sequence: Synthetic oligonucleotide
tgacatcaaggatctaccagtgtctgagcagc

SEQ ID NO: 104087 - DNA, 31 bp, Artificial Sequence
  Description of Artificial Sequence: Synthetic oligonucleotide
gacatcaaggatctaccagtgtctgagcagc

SEQ ID NO: 104088 - DNA, 32 bp, Artificial Sequence
  Description of Artificial Sequence: Synthetic oligonucleotide
acatcaaggatctaccagtgtctgagcagcag

SEQ ID NO: 104089 - DNA, 31 bp, Artificial Sequence
  Description of Artificial Sequence: Synthetic oligonucleotide
catcaaggatctaccagtgtctgagcagcag

SEQ ID NO: 104090 - DNA, 31 bp, Artificial Sequence
  Description of Artificial Sequence: Synthetic oligonucleotide
atcaaggatctaccagtgtctgagcagcagg

SEQ ID NO: 104091 - DNA, 30 bp, Artificial Sequence
  Description of Artificial Sequence: Synthetic oligonucleotide
tcaaggatctaccagtgtctgagcagcagg

SEQ ID NO: 104092 - DNA, 29 bp, Artificial Sequence
  Description of Artificial Sequence: Synthetic oligonucleotide
caaggatctaccagtgtctgagcagcagg

SEQ ID NO: 104093 - DNA, 30 bp, Artificial Sequence
  Description of Artificial Sequence: Synthetic oligonucleotide
aaggatctaccagtgtctgagcagcaggag

SEQ ID NO: 104094 - DNA, 29 bp, Artificial Sequence
  Description of Artificial Sequence: Synthetic oligonucleotide
aggatctaccagtgtctgagcagcaggag

SEQ ID NO: 104095 - DNA, 28 bp, Artificial Sequence
  Description of Artificial Sequence: Synthetic oligonucleotide
ggatctaccagtgtctgagcagcaggag

SEQ ID NO: 104096 - DNA, 29 bp, Artificial Sequence
  Description of Artificial Sequence: Synthetic oligonucleotide
gatctaccagtgtctgagcagcaggagag

SEQ ID NO: 104097 - DNA, 30 bp, Artificial Sequence
  Description of Artificial Sequence: Synthetic oligonucleotide
atctaccagtgtctgagcagcaggagagag

SEQ ID NO: 104098 - DNA, 29 bp, Artificial Sequence
  Description of Artificial Sequence: Synthetic oligonucleotide
tctaccagtgtctgagcagcaggagagag

SEQ ID NO: 104099 - DNA, 28 bp, Artificial Sequence
  Description of Artificial Sequence: Synthetic oligonucleotide
ctaccagtgtctgagcagcaggagagag

SEQ ID NO: 104100 - DNA, 28 bp, Artificial Sequence
  Description of Artificial Sequence: Synthetic oligonucleotide
taccagtgtctgagcagcaggagagagc

SEQ ID NO: 104101 - DNA, 27 bp, Artificial Sequence
  Description of Artificial Sequence: Synthetic oligonucleotide
accagtgtctgagcagcaggagagagc

SEQ ID NO: 104102 - DNA, 26 bp, Artificial Sequence
  Description of Artificial Sequence: Synthetic oligonucleotide
ccagtgtctgagcagcaggagagagc

SEQ ID NO: 104103 - DNA, 27 bp, Artificial Sequence
  Description of Artificial Sequence: Synthetic oligonucleotide
cagtgtctgagcagcaggagagagcct

SEQ ID NO: 104104 - DNA, 28 bp, Artificial Sequence
  Description of Artificial Sequence: Synthetic oligonucleotide
agtgtctgagcagcaggagagagccttc

SEQ ID NO: 104105 - DNA, 27 bp, Artificial Sequence
  Description of Artificial Sequence: Synthetic oligonucleotide
gtgtctgagcagcaggagagagccttc

SEQ ID NO: 104106 - DNA, 28 bp, Artificial Sequence
  Description of Artificial Sequence: Synthetic oligonucleotide
tgtctgagcagcaggagagagccttcac

SEQ ID NO: 104107 - DNA, 27 bp, Artificial Sequence
  Description of Artificial Sequence: Synthetic oligonucleotide
gtctgagcagcaggagagagccttcac

SEQ ID NO: 104108 - DNA, 27 bp, Artificial Sequence
  Description of Artificial Sequence: Synthetic oligonucleotide
tctgagcagcaggagagagccttcacg

SEQ ID NO: 104109 - DNA, 26 bp, Artificial Sequence
  Description of Artificial Sequence: Synthetic oligonucleotide
ctgagcagcaggagagagccttcacg

SEQ ID NO: 104110 - DNA, 27 bp, Artificial Sequence
  Description of Artificial Sequence: Synthetic oligonucleotide
tgagcagcaggagagagccttcacgct

SEQ ID NO: 104111 - DNA, 26 bp, Artificial Sequence
  Description of Artificial Sequence: Synthetic oligonucleotide
gagcagcaggagagagccttcacgct

SEQ ID NO: 104112 - DNA, 26 bp, Artificial Sequence
  Description of Artificial Sequence: Synthetic oligonucleotide
agcagcaggagagagccttcacgctg

SEQ ID NO: 104113 - DNA, 25 bp, Artificial Sequence
  Description of Artificial Sequence: Synthetic oligonucleotide
gcagcaggagagagccttcacgctg

SEQ ID NO: 104114 - DNA, 25 bp, Artificial Sequence
  Description of Artificial Sequence: Synthetic oligonucleotide
cagcaggagagagccttcacgctgg

SEQ ID NO: 104115 - DNA, 25 bp, Artificial Sequence
  Description of Artificial Sequence: Synthetic oligonucleotide
agcaggagagagccttcacgctggg

SEQ ID NO: 104116 - DNA, 24 bp, Artificial Sequence
  Description of Artificial Sequence: Synthetic oligonucleotide
gcaggagagagccttcacgctggg

SEQ ID NO: 104117 - DNA, 24 bp, Artificial Sequence
  Description of Artificial Sequence: Synthetic oligonucleotide
caggagagagccttcacgctgggg

SEQ ID NO: 104118 - DNA, 26 bp, Artificial Sequence
  Description of Artificial Sequence: Synthetic oligonucleotide
aggagagagccttcacgctggggcta

SEQ ID NO: 104119 - DNA, 25 bp, Artificial Sequence
  Description of Artificial Sequence: Synthetic oligonucleotide
ggagagagccttcacgctggggcta

SEQ ID NO: 104120 - DNA, 25 bp, Artificial Sequence
  Description of Artificial Sequence: Synthetic oligonucleotide
gagagagccttcacgctggggctag

SEQ ID NO: 104121 - DNA, 26 bp, Artificial Sequence
  Description of Artificial Sequence: Synthetic oligonucleotide
agagagccttcacgctggggctagca

SEQ ID NO: 104122 - DNA, 25 bp, Artificial Sequence
  Description of Artificial Sequence: Synthetic oligonucleotide
gagagccttcacgctggggctagca

SEQ ID NO: 104123 - DNA, 25 bp, Artificial Sequence
  Description of Artificial Sequence: Synthetic oligonucleotide
agagccttcacgctggggctagcag

SEQ ID NO: 104124 - DNA, 24 bp, Artificial Sequence
  Description of Artificial Sequence: Synthetic oligonucleotide
gagccttcacgctggggctagcag

SEQ ID NO: 104125 - DNA, 25 bp, Artificial Sequence
  Description of Artificial Sequence: Synthetic oligonucleotide
agccttcacgctggggctagcagga

SEQ ID NO: 104126 - DNA, 24 bp, Artificial Sequence
  Description of Artificial Sequence: Synthetic oligonucleotide
gccttcacgctggggctagcagga

SEQ ID NO: 104127 - DNA, 26 bp, Artificial Sequence
  Description of Artificial Sequence: Synthetic oligonucleotide
ccttcacgctggggctagcaggactt

SEQ ID NO: 104128 - DNA, 27 bp, Artificial Sequence
  Description of Artificial Sequence: Synthetic oligonucleotide
cttcacgctggggctagcaggacttct

SEQ ID NO: 104129 - DNA, 27 bp, Artificial Sequence
  Description of Artificial Sequence: Synthetic oligonucleotide
ttcacgctggggctagcaggacttctc

SEQ ID NO: 104130 - DNA, 26 bp, Artificial Sequence
  Description of Artificial Sequence: Synthetic oligonucleotide
tcacgctggggctagcaggacttctc

SEQ ID NO: 104131 - DNA, 25 bp, Artificial Sequence
  Description of Artificial Sequence: Synthetic oligonucleotide
cacgctggggctagcaggacttctc

SEQ ID NO: 104132 - DNA, 25 bp, Artificial Sequence
  Description of Artificial Sequence: Synthetic oligonucleotide
acgctggggctagcaggacttctcg

SEQ ID NO: 104133 - DNA, 24 bp, Artificial Sequence
  Description of Artificial Sequence: Synthetic oligonucleotide
cgctggggctagcaggacttctcg

SEQ ID NO: 104134 - DNA, 24 bp, Artificial Sequence
  Description of Artificial Sequence: Synthetic oligonucleotide
gctggggctagcaggacttctcgg

SEQ ID NO: 104135 - DNA, 24 bp, Artificial Sequence
  Description of Artificial Sequence: Synthetic oligonucleotide
ctggggctagcaggacttctcggc

SEQ ID NO: 104136 - DNA, 25 bp, Artificial Sequence
  Description of Artificial Sequence: Synthetic oligonucleotide
tggggctagcaggacttctcggcga

SEQ ID NO: 104137 - DNA, 24 bp, Artificial Sequence
  Description of Artificial Sequence: Synthetic oligonucleotide
ggggctagcaggacttctcggcga

SEQ ID NO: 104138 - DNA, 24 bp, Artificial Sequence
  Description of Artificial Sequence: Synthetic oligonucleotide
gggctagcaggacttctcggcgag

SEQ ID NO: 104139 - DNA, 24 bp, Artificial Sequence
  Description of Artificial Sequence: Synthetic oligonucleotide
ggctagcaggacttctcggcgagg

SEQ ID NO: 104140 - DNA, 25 bp, Artificial Sequence
  Description of Artificial Sequence: Synthetic oligonucleotide
gctagcaggacttctcggcgaggga

SEQ ID NO: 104141 - DNA, 27 bp, Artificial Sequence
  Description of Artificial Sequence: Synthetic oligonucleotide
ctagcaggacttctcggcgagggagtt

SEQ ID NO: 104142 - DNA, 32 bp, Artificial Sequence
  Description of Artificial Sequence: Synthetic oligonucleotide
tagcaggacttctcggcgagggagtttttaac

SEQ ID NO: 104143 - DNA, 31 bp, Artificial Sequence
  Description of Artificial Sequence: Synthetic oligonucleotide
agcaggacttctcggcgagggagtttttaac

SEQ ID NO: 104144 - DNA, 30 bp, Artificial Sequence
  Description of Artificial Sequence: Synthetic oligonucleotide
gcaggacttctcggcgagggagtttttaac

SEQ ID NO: 104145 - DNA, 33 bp, Artificial Sequence
  Description of Artificial Sequence: Synthetic oligonucleotide
caggacttctcggcgagggagtttttaactttg

SEQ ID NO: 104146 - DNA, 33 bp, Artificial Sequence
  Description of Artificial Sequence: Synthetic oligonucleotide
aggacttctcggcgagggagtttttaactttgg

SEQ ID NO: 104147 - DNA, 32 bp, Artificial Sequence
  Description of Artificial Sequence: Synthetic oligonucleotide
ggacttctcggcgagggagtttttaactttgg

SEQ ID NO: 104148 - DNA, 33 bp, Artificial Sequence
  Description of Artificial Sequence: Synthetic oligonucleotide
gacttctcggcgagggagtttttaactttggag

SEQ ID NO: 104149 - DNA, 35 bp, Artificial Sequence
  Description of Artificial Sequence: Synthetic oligonucleotide
acttctcggcgagggagtttttaactttggagaac

SEQ ID NO: 104150 - DNA, 34 bp, Artificial Sequence
  Description of Artificial Sequence: Synthetic oligonucleotide
cttctcggcgagggagtttttaactttggagaac

SEQ ID NO: 104151 - DNA, 35 bp, Artificial Sequence
  Description of Artificial Sequence: Synthetic oligonucleotide
ttctcggcgagggagtttttaactttggagaactc

SEQ ID NO: 104152 - DNA, 34 bp, Artificial Sequence
  Description of Artificial Sequence: Synthetic oligonucleotide
tctcggcgagggagtttttaactttggagaactc

SEQ ID NO: 104153 - DNA, 33 bp, Artificial Sequence
  Description of Artificial Sequence: Synthetic oligonucleotide
ctcggcgagggagtttttaactttggagaactc

SEQ ID NO: 104154 - DNA, 33 bp, Artificial Sequence
  Description of Artificial Sequence: Synthetic oligonucleotide
tcggcgagggagtttttaactttggagaactcc

SEQ ID NO: 104155 - DNA, 32 bp, Artificial Sequence
  Description of Artificial Sequence: Synthetic oligonucleotide
cggcgagggagtttttaactttggagaactcc

SEQ ID NO: 104156 - DNA, 33 bp, Artificial Sequence
  Description of Artificial Sequence: Synthetic oligonucleotide
ggcgagggagtttttaactttggagaactcctc

SEQ ID NO: 104157 - DNA, 35 bp, Artificial Sequence
  Description of Artificial Sequence: Synthetic oligonucleotide
gcgagggagtttttaactttggagaactcctcatg

SEQ ID NO: 104158 - DNA, 35 bp, Artificial Sequence
  Description of Artificial Sequence: Synthetic oligonucleotide
cgagggagtttttaactttggagaactcctcatgc

SEQ ID NO: 104159 - DNA, 36 bp, Artificial Sequence
  Description of Artificial Sequence: Synthetic oligonucleotide
gagggagtttttaactttggagaactcctcatgcac

SEQ ID NO: 104160 - DNA, 36 bp, Artificial Sequence
  Description of Artificial Sequence: Synthetic oligonucleotide
agggagtttttaactttggagaactcctcatgcacc

SEQ ID NO: 104161 - DNA, 35 bp, Artificial Sequence
  Description of Artificial Sequence: Synthetic oligonucleotide
gggagtttttaactttggagaactcctcatgcacc

SEQ ID NO: 104162 - DNA, 35 bp, Artificial Sequence
  Description of Artificial Sequence: Synthetic oligonucleotide
ggagtttttaactttggagaactcctcatgcaccc

SEQ ID NO: 104163 - DNA, 36 bp, Artificial Sequence
  Description of Artificial Sequence: Synthetic oligonucleotide
gagtttttaactttggagaactcctcatgcaccctg

SEQ ID NO: 104164 - DNA, 37 bp, Artificial Sequence
  Description of Artificial Sequence: Synthetic oligonucleotide
agtttttaactttggagaactcctcatgcaccctgtg

SEQ ID NO: 104165 - DNA, 36 bp, Artificial Sequence
  Description of Artificial Sequence: Synthetic oligonucleotide
gtttttaactttggagaactcctcatgcaccctgtg

SEQ ID NO: 104166 - DNA, 36 bp, Artificial Sequence
  Description of Artificial Sequence: Synthetic oligonucleotide
tttttaactttggagaactcctcatgcaccctgtgc

SEQ ID NO: 104167 - DNA, 35 bp, Artificial Sequence
  Description of Artificial Sequence: Synthetic oligonucleotide
ttttaactttggagaactcctcatgcaccctgtgc

SEQ ID NO: 104168 - DNA, 34 bp, Artificial Sequence
  Description of Artificial Sequence: Synthetic oligonucleotide
tttaactttggagaactcctcatgcaccctgtgc

SEQ ID NO: 104169 - DNA, 33 bp, Artificial Sequence
  Description of Artificial Sequence: Synthetic oligonucleotide
ttaactttggagaactcctcatgcaccctgtgc

SEQ ID NO: 104170 - DNA, 32 bp, Artificial Sequence
  Description of Artificial Sequence: Synthetic oligonucleotide
taactttggagaactcctcatgcaccctgtgc

SEQ ID NO: 104171 - DNA, 31 bp, Artificial Sequence
  Description of Artificial Sequence: Synthetic oligonucleotide
aactttggagaactcctcatgcaccctgtgc

SEQ ID NO: 104172 - DNA, 30 bp, Artificial Sequence
  Description of Artificial Sequence: Synthetic oligonucleotide
actttggagaactcctcatgcaccctgtgc

SEQ ID NO: 104173 - DNA, 29 bp, Artificial Sequence
  Description of Artificial Sequence: Synthetic oligonucleotide
ctttggagaactcctcatgcaccctgtgc

SEQ ID NO: 104174 - DNA, 30 bp, Artificial Sequence
  Description of Artificial Sequence: Synthetic oligonucleotide
tttggagaactcctcatgcaccctgtgctg

SEQ ID NO: 104175 - DNA, 29 bp, Artificial Sequence
  Description of Artificial Sequence: Synthetic oligonucleotide
ttggagaactcctcatgcaccctgtgctg

SEQ ID NO: 104176 - DNA, 28 bp, Artificial Sequence
  Description of Artificial Sequence: Synthetic oligonucleotide
tggagaactcctcatgcaccctgtgctg

SEQ ID NO: 104177 - DNA, 27 bp, Artificial Sequence
  Description of Artificial Sequence: Synthetic oligonucleotide
ggagaactcctcatgcaccctgtgctg

SEQ ID NO: 104178 - DNA, 27 bp, Artificial Sequence
  Description of Artificial Sequence: Synthetic oligonucleotide
gagaactcctcatgcaccctgtgctgg

SEQ ID NO: 104179 - DNA, 28 bp, Artificial Sequence
  Description of Artificial Sequence: Synthetic oligonucleotide
agaactcctcatgcaccctgtgctggag

SEQ ID NO: 104180 - DNA, 27 bp, Artificial Sequence
  Description of Artificial Sequence: Synthetic oligonucleotide
gaactcctcatgcaccctgtgctggag

SEQ ID NO: 104181 - DNA, 28 bp, Artificial Sequence
  Description of Artificial Sequence: Synthetic oligonucleotide
aactcctcatgcaccctgtgctggagtc

SEQ ID NO: 104182 - DNA, 27 bp, Artificial Sequence
  Description of Artificial Sequence: Synthetic oligonucleotide
actcctcatgcaccctgtgctggagtc

SEQ ID NO: 104183 - DNA, 26 bp, Artificial Sequence
  Description of Artificial Sequence: Synthetic oligonucleotide
ctcctcatgcaccctgtgctggagtc

SEQ ID NO: 104184 - DNA, 26 bp, Artificial Sequence
  Description of Artificial Sequence: Synthetic oligonucleotide
tcctcatgcaccctgtgctggagtcc

SEQ ID NO: 104185 - DNA, 25 bp, Artificial Sequence
  Description of Artificial Sequence: Synthetic oligonucleotide
cctcatgcaccctgtgctggagtcc

SEQ ID NO: 104186 - DNA, 26 bp, Artificial Sequence
  Description of Artificial Sequence: Synthetic oligonucleotide
ctcatgcaccctgtgctggagtccct

SEQ ID NO: 104187 - DNA, 27 bp, Artificial Sequence
  Description of Artificial Sequence: Synthetic oligonucleotide
tcatgcaccctgtgctggagtccctga

SEQ ID NO: 104188 - DNA, 26 bp, Artificial Sequence
  Description of Artificial Sequence: Synthetic oligonucleotide
catgcaccctgtgctggagtccctga

SEQ ID NO: 104189 - DNA, 26 bp, Artificial Sequence
  Description of Artificial Sequence: Synthetic oligonucleotide
atgcaccctgtgctggagtccctgag

SEQ ID NO: 104190 - DNA, 25 bp, Artificial Sequence
  Description of Artificial Sequence: Synthetic oligonucleotide
tgcaccctgtgctggagtccctgag

SEQ ID NO: 104191 - DNA, 24 bp, Artificial Sequence
  Description of Artificial Sequence: Synthetic oligonucleotide
gcaccctgtgctggagtccctgag

SEQ ID NO: 104192 - DNA, 27 bp, Artificial Sequence
  Description of Artificial Sequence: Synthetic oligonucleotide
caccctgtgctggagtccctgaggaat

SEQ ID NO: 104193 - DNA, 28 bp, Artificial Sequence
  Description of Artificial Sequence: Synthetic oligonucleotide
accctgtgctggagtccctgaggaatac

SEQ ID NO: 104194 - DNA, 27 bp, Artificial Sequence
  Description of Artificial Sequence: Synthetic oligonucleotide
ccctgtgctggagtccctgaggaatac

SEQ ID NO: 104195 - DNA, 28 bp, Artificial Sequence
  Description of Artificial Sequence: Synthetic oligonucleotide
cctgtgctggagtccctgaggaatactg

SEQ ID NO: 104196 - DNA, 29 bp, Artificial Sequence
  Description of Artificial Sequence: Synthetic oligonucleotide
ctgtgctggagtccctgaggaatactgac

SEQ ID NO: 104197 - DNA, 29 bp, Artificial Sequence
  Description of Artificial Sequence: Synthetic oligonucleotide
tgtgctggagtccctgaggaatactgacc

SEQ ID NO: 104198 - DNA, 28 bp, Artificial Sequence
  Description of Artificial Sequence: Synthetic oligonucleotide
gtgctggagtccctgaggaatactgacc

SEQ ID NO: 104199 - DNA, 28 bp, Artificial Sequence
  Description of Artificial Sequence: Synthetic oligonucleotide
tgctggagtccctgaggaatactgaccg

SEQ ID NO: 104200 - DNA, 27 bp, Artificial Sequence
  Description of Artificial Sequence: Synthetic oligonucleotide
gctggagtccctgaggaatactgaccg

SEQ ID NO: 104201 - DNA, 27 bp, Artificial Sequence
  Description of Artificial Sequence: Synthetic oligonucleotide
ctggagtccctgaggaatactgaccgg

SEQ ID NO: 104202 - DNA, 27 bp, Artificial Sequence
  Description of Artificial Sequence: Synthetic oligonucleotide
tggagtccctgaggaatactgaccggc

SEQ ID NO: 104203 - DNA, 27 bp, Artificial Sequence
  Description of Artificial Sequence: Synthetic oligonucleotide
ggagtccctgaggaatactgaccggca

SEQ ID NO: 104204 - DNA, 27 bp, Artificial Sequence
  Description of Artificial Sequence: Synthetic oligonucleotide
gagtccctgaggaatactgaccggcag

SEQ ID NO: 104205 - DNA, 28 bp, Artificial Sequence
  Description of Artificial Sequence: Synthetic oligonucleotide
agtccctgaggaatactgaccggcagtg

SEQ ID NO: 104206 - DNA, 27 bp, Artificial Sequence
  Description of Artificial Sequence: Synthetic oligonucleotide
gtccctgaggaatactgaccggcagtg

SEQ ID NO: 104207 - DNA, 27 bp, Artificial Sequence
  Description of Artificial Sequence: Synthetic oligonucleotide
tccctgaggaatactgaccggcagtgg

SEQ ID NO: 104208 - DNA, 26 bp, Artificial Sequence
  Description of Artificial Sequence: Synthetic oligonucleotide
ccctgaggaatactgaccggcagtgg

SEQ ID NO: 104209 - DNA, 27 bp, Artificial Sequence
  Description of Artificial Sequence: Synthetic oligonucleotide
cctgaggaatactgaccggcagtggct

SEQ ID NO: 104210 - DNA, 27 bp, Artificial Sequence
  Description of Artificial Sequence: Synthetic oligonucleotide
ctgaggaatactgaccggcagtggctg

SEQ ID NO: 104211 - DNA, 30 bp, Artificial Sequence
  Description of Artificial Sequence: Synthetic oligonucleotide
tgaggaatactgaccggcagtggctgattg

SEQ ID NO: 104212 - DNA, 29 bp, Artificial Sequence
  Description of Artificial Sequence: Synthetic oligonucleotide
gaggaatactgaccggcagtggctgattg

SEQ ID NO: 104213 - DNA, 30 bp, Artificial Sequence
  Description of Artificial Sequence: Synthetic oligonucleotide
aggaatactgaccggcagtggctgattgac

SEQ ID NO: 104214 - DNA, 29 bp, Artificial Sequence
  Description of Artificial Sequence: Synthetic oligonucleotide
ggaatactgaccggcagtggctgattgac

SEQ ID NO: 104215 - DNA, 30 bp, Artificial Sequence
  Description of Artificial Sequence: Synthetic oligonucleotide
gaatactgaccggcagtggctgattgacac

SEQ ID NO: 104216 - DNA, 30 bp, Artificial Sequence
  Description of Artificial Sequence: Synthetic oligonucleotide
aatactgaccggcagtggctgattgacacc

SEQ ID NO: 104217 - DNA, 29 bp, Artificial Sequence
  Description of Artificial Sequence: Synthetic oligonucleotide
atactgaccggcagtggctgattgacacc

SEQ ID NO: 104218 - DNA, 28 bp, Artificial Sequence
  Description of Artificial Sequence: Synthetic oligonucleotide
tactgaccggcagtggctgattgacacc

SEQ ID NO: 104219 - DNA, 27 bp, Artificial Sequence
  Description of Artificial Sequence: Synthetic oligonucleotide
actgaccggcagtggctgattgacacc

SEQ ID NO: 104220 - DNA, 26 bp, Artificial Sequence
  Description of Artificial Sequence: Synthetic oligonucleotide
ctgaccggcagtggctgattgacacc

SEQ ID NO: 104221 - DNA, 27 bp, Artificial Sequence
  Description of Artificial Sequence: Synthetic oligonucleotide
tgaccggcagtggctgattgacaccct

SEQ ID NO: 104222 - DNA, 26 bp, Artificial Sequence
  Description of Artificial Sequence: Synthetic oligonucleotide
gaccggcagtggctgattgacaccct

SEQ ID NO: 104223 - DNA, 27 bp, Artificial Sequence
  Description of Artificial Sequence: Synthetic oligonucleotide
accggcagtggctgattgacaccctct

SEQ ID NO: 104224 - DNA, 27 bp, Artificial Sequence
  Description of Artificial Sequence: Synthetic oligonucleotide
ccggcagtggctgattgacaccctcta

SEQ ID NO: 104225 - DNA, 28 bp, Artificial Sequence
  Description of Artificial Sequence: Synthetic oligonucleotide
cggcagtggctgattgacaccctctatg

SEQ ID NO: 104226 - DNA, 28 bp, Artificial Sequence
  Description of Artificial Sequence: Synthetic oligonucleotide
ggcagtggctgattgacaccctctatgc

SEQ ID NO: 104227 - DNA, 28 bp, Artificial Sequence
  Description of Artificial Sequence: Synthetic oligonucleotide
gcagtggctgattgacaccctctatgcc

SEQ ID NO: 104228 - DNA, 30 bp, Artificial Sequence
  Description of Artificial Sequence: Synthetic oligonucleotide
cagtggctgattgacaccctctatgccttc

SEQ ID NO: 104229 - DNA, 32 bp, Artificial Sequence
  Description of Artificial Sequence: Synthetic oligonucleotide
agtggctgattgacaccctctatgccttcaac

SEQ ID NO: 104230 - DNA, 31 bp, Artificial Sequence
  Description of Artificial Sequence: Synthetic oligonucleotide
gtggctgattgacaccctctatgccttcaac

SEQ ID NO: 104231 - DNA, 32 bp, Artificial Sequence
  Description of Artificial Sequence: Synthetic oligonucleotide
tggctgattgacaccctctatgccttcaacag

SEQ ID NO: 104232 - DNA, 31 bp, Artificial Sequence
  Description of Artificial Sequence: Synthetic oligonucleotide
ggctgattgacaccctctatgccttcaacag

SEQ ID NO: 104233 - DNA, 32 bp, Artificial Sequence
  Description of Artificial Sequence: Synthetic oligonucleotide
gctgattgacaccctctatgccttcaacagtg

SEQ ID NO: 104234 - DNA, 32 bp, Artificial Sequence
  Description of Artificial Sequence: Synthetic oligonucleotide
ctgattgacaccctctatgccttcaacagtgg

SEQ ID NO: 104235 - DNA, 32 bp, Artificial Sequence
  Description of Artificial Sequence: Synthetic oligonucleotide
tgattgacaccctctatgccttcaacagtggc

SEQ ID NO: 104236 - DNA, 31 bp, Artificial Sequence
  Description of Artificial Sequence: Synthetic oligonucleotide
gattgacaccctctatgccttcaacagtggc

SEQ ID NO: 104237 - DNA, 33 bp, Artificial Sequence
  Description of Artificial Sequence: Synthetic oligonucleotide
attgacaccctctatgccttcaacagtggcaac

SEQ ID NO: 104238 - DNA, 32 bp, Artificial Sequence
  Description of Artificial Sequence: Synthetic oligonucleotide
ttgacaccctctatgccttcaacagtggcaac

SEQ ID NO: 104239 - DNA, 31 bp, Artificial Sequence
  Description of Artificial Sequence: Synthetic oligonucleotide
tgacaccctctatgccttcaacagtggcaac

SEQ ID NO: 104240 - DNA, 30 bp, Artificial Sequence
  Description of Artificial Sequence: Synthetic oligonucleotide
gacaccctctatgccttcaacagtggcaac

SEQ ID NO: 104241 - DNA, 30 bp, Artificial Sequence
  Description of Artificial Sequence: Synthetic oligonucleotide
acaccctctatgccttcaacagtggcaacg

SEQ ID NO: 104242 - DNA, 29 bp, Artificial Sequence
  Description of Artificial Sequence: Synthetic oligonucleotide
caccctctatgccttcaacagtggcaacg

SEQ ID NO: 104243 - DNA, 31 bp, Artificial Sequence
  Description of Artificial Sequence: Synthetic oligonucleotide
accctctatgccttcaacagtggcaacgtag

SEQ ID NO: 104244 - DNA, 30 bp, Artificial Sequence
  Description of Artificial Sequence: Synthetic oligonucleotide
ccctctatgccttcaacagtggcaacgtag

SEQ ID NO: 104245 - DNA, 31 bp, Artificial Sequence
  Description of Artificial Sequence: Synthetic oligonucleotide
cctctatgccttcaacagtggcaacgtagag

SEQ ID NO: 104246 - DNA, 31 bp, Artificial Sequence
  Description of Artificial Sequence: Synthetic oligonucleotide
ctctatgccttcaacagtggcaacgtagagc

SEQ ID NO: 104247 - DNA, 31 bp, Artificial Sequence
  Description of Artificial Sequence: Synthetic oligonucleotide
tctatgccttcaacagtggcaacgtagagcg

SEQ ID NO: 104248 - DNA, 30 bp, Artificial Sequence
  Description of Artificial Sequence: Synthetic oligonucleotide
ctatgccttcaacagtggcaacgtagagcg

SEQ ID NO: 104249 - DNA, 30 bp, Artificial Sequence
  Description of Artificial Sequence: Synthetic oligonucleotide
tatgccttcaacagtggcaacgtagagcgg

SEQ ID NO: 104250 - DNA, 29 bp, Artificial Sequence
  Description of Artificial Sequence: Synthetic oligonucleotide
atgccttcaacagtggcaacgtagagcgg

SEQ ID NO: 104251 - DNA, 28 bp, Artificial Sequence
  Description of Artificial Sequence: Synthetic oligonucleotide
tgccttcaacagtggcaacgtagagcgg

SEQ ID NO: 104252 - DNA, 27 bp, Artificial Sequence
  Description of Artificial Sequence: Synthetic oligonucleotide
gccttcaacagtggcaacgtagagcgg

SEQ ID NO: 104253 - DNA, 29 bp, Artificial Sequence
  Description of Artificial Sequence: Synthetic oligonucleotide
ccttcaacagtggcaacgtagagcggttc

SEQ ID NO: 104254 - DNA, 29 bp, Artificial Sequence
  Description of Artificial Sequence: Synthetic oligonucleotide
cttcaacagtggcaacgtagagcggttcc

SEQ ID NO: 104255 - DNA, 30 bp, Artificial Sequence
  Description of Artificial Sequence: Synthetic oligonucleotide
ttcaacagtggcaacgtagagcggttccag

SEQ ID NO: 104256 - DNA, 29 bp, Artificial Sequence
  Description of Artificial Sequence: Synthetic oligonucleotide
tcaacagtggcaacgtagagcggttccag

SEQ ID NO: 104257 - DNA, 28 bp, Artificial Sequence
  Description of Artificial Sequence: Synthetic oligonucleotide
caacagtggcaacgtagagcggttccag

SEQ ID NO: 104258 - DNA, 29 bp, Artificial Sequence
  Description of Artificial Sequence: Synthetic oligonucleotide
aacagtggcaacgtagagcggttccagac

SEQ ID NO: 104259 - DNA, 28 bp, Artificial Sequence
  Description of Artificial Sequence: Synthetic oligonucleotide
acagtggcaacgtagagcggttccagac

SEQ ID NO: 104260 - DNA, 27 bp, Artificial Sequence
  Description of Artificial Sequence: Synthetic oligonucleotide
cagtggcaacgtagagcggttccagac

SEQ ID NO: 104261 - DNA, 28 bp, Artificial Sequence
  Description of Artificial Sequence: Synthetic oligonucleotide
agtggcaacgtagagcggttccagactc

SEQ ID NO: 104262 - DNA, 27 bp, Artificial Sequence
  Description of Artificial Sequence: Synthetic oligonucleotide
gtggcaacgtagagcggttccagactc

SEQ ID NO: 104263 - DNA, 28 bp, Artificial Sequence
  Description of Artificial Sequence: Synthetic oligonucleotide
tggcaacgtagagcggttccagactctg

SEQ ID NO: 104264 - DNA, 27 bp, Artificial Sequence
  Description of Artificial Sequence: Synthetic oligonucleotide
ggcaacgtagagcggttccagactctg

SEQ ID NO: 104265 - DNA, 29 bp, Artificial Sequence
  Description of Artificial Sequence: Synthetic oligonucleotide
gcaacgtagagcggttccagactctgaag

SEQ ID NO: 104266 - DNA, 30 bp, Artificial Sequence
  Description of Artificial Sequence: Synthetic oligonucleotide
caacgtagagcggttccagactctgaagac

SEQ ID NO: 104267 - DNA, 31 bp, Artificial Sequence
  Description of Artificial Sequence: Synthetic oligonucleotide
aacgtagagcggttccagactctgaagactg

SEQ ID NO: 104268 - DNA, 30 bp, Artificial Sequence
  Description of Artificial Sequence: Synthetic oligonucleotide
acgtagagcggttccagactctgaagactg

SEQ ID NO: 104269 - DNA, 29 bp, Artificial Sequence
  Description of Artificial Sequence: Synthetic oligonucleotide
cgtagagcggttccagactctgaagactg

SEQ ID NO: 104270 - DNA, 29 bp, Artificial Sequence
  Description of Artificial Sequence: Synthetic oligonucleotide
gtagagcggttccagactctgaagactgc

SEQ ID NO: 104271 - DNA, 29 bp, Artificial Sequence
  Description of Artificial Sequence: Synthetic oligonucleotide
tagagcggttccagactctgaagactgcc

SEQ ID NO: 104272 - DNA, 28 bp, Artificial Sequence
  Description of Artificial Sequence: Synthetic oligonucleotide
agagcggttccagactctgaagactgcc

SEQ ID NO: 104273 - DNA, 27 bp, Artificial Sequence
  Description of Artificial Sequence: Synthetic oligonucleotide
gagcggttccagactctgaagactgcc

SEQ ID NO: 104274 - DNA, 28 bp, Artificial Sequence
  Description of Artificial Sequence: Synthetic oligonucleotide
agcggttccagactctgaagactgcctg

SEQ ID NO: 104275 - DNA, 27 bp, Artificial Sequence
  Description of Artificial Sequence: Synthetic oligonucleotide
gcggttccagactctgaagactgcctg

SEQ ID NO: 104276 - DNA, 27 bp, Artificial Sequence
  Description of Artificial Sequence: Synthetic oligonucleotide
cggttccagactctgaagactgcctgg

SEQ ID NO: 104277 - DNA, 27 bp, Artificial Sequence
  Description of Artificial Sequence: Synthetic oligonucleotide
ggttccagactctgaagactgcctggg

SEQ ID NO: 104278 - DNA, 27 bp, Artificial Sequence
  Description of Artificial Sequence: Synthetic oligonucleotide
gttccagactctgaagactgcctgggg

SEQ ID NO: 104279 - DNA, 27 bp, Artificial Sequence
  Description of Artificial Sequence: Synthetic oligonucleotide
ttccagactctgaagactgcctggggc

SEQ ID NO: 104280 - DNA, 26 bp, Artificial Sequence
  Description of Artificial Sequence: Synthetic oligonucleotide
tccagactctgaagactgcctggggc

SEQ ID NO: 104281 - DNA, 25 bp, Artificial Sequence
  Description of Artificial Sequence: Synthetic oligonucleotide
ccagactctgaagactgcctggggc

SEQ ID NO: 104282 - DNA, 26 bp, Artificial Sequence
  Description of Artificial Sequence: Synthetic oligonucleotide
cagactctgaagactgcctggggcca

SEQ ID NO: 104283 - DNA, 26 bp, Artificial Sequence
  Description of Artificial Sequence: Synthetic oligonucleotide
agactctgaagactgcctggggccag

SEQ ID NO: 104284 - DNA, 25 bp, Artificial Sequence
  Description of Artificial Sequence: Synthetic oligonucleotide
gactctgaagactgcctggggccag

SEQ ID NO: 104285 - DNA, 26 bp, Artificial Sequence
  Description of Artificial Sequence: Synthetic oligonucleotide
actctgaagactgcctggggccagca

SEQ ID NO: 104286 - DNA, 25 bp, Artificial Sequence
  Description of Artificial Sequence: Synthetic oligonucleotide
ctctgaagactgcctggggccagca

SEQ ID NO: 104287 - DNA, 25 bp, Artificial Sequence
  Description of Artificial Sequence: Synthetic oligonucleotide
tctgaagactgcctggggccagcag

SEQ ID NO: 104288 - DNA, 24 bp, Artificial Sequence
  Description of Artificial Sequence: Synthetic oligonucleotide
ctgaagactgcctggggccagcag

SEQ ID NO: 104289 - DNA, 24 bp, Artificial Sequence
  Description of Artificial Sequence: Synthetic oligonucleotide
tgaagactgcctggggccagcagc

SEQ ID NO: 104290 - DNA, 23 bp, Artificial Sequence
  Description of Artificial Sequence: Synthetic oligonucleotide
gaagactgcctggggccagcagc

SEQ ID NO: 104291 - DNA, 24 bp, Artificial Sequence
  Description of Artificial Sequence: Synthetic oligonucleotide
aagactgcctggggccagcagcct

SEQ ID NO: 104292 - DNA, 23 bp, Artificial Sequence
  Description of Artificial Sequence: Synthetic oligonucleotide
agactgcctggggccagcagcct

SEQ ID NO: 104293 - DNA, 22 bp, Artificial Sequence
  Description of Artificial Sequence: Synthetic oligonucleotide
gactgcctggggccagcagcct

SEQ ID NO: 104294 - DNA, 27 bp, Artificial Sequence
  Description of Artificial Sequence: Synthetic oligonucleotide
actgcctggggccagcagcctgattta

SEQ ID NO: 104295 - DNA, 26 bp, Artificial Sequence
  Description of Artificial Sequence: Synthetic oligonucleotide
ctgcctggggccagcagcctgattta

SEQ ID NO: 104296 - DNA, 26 bp, Artificial Sequence
  Description of Artificial Sequence: Synthetic oligonucleotide
tgcctggggccagcagcctgatttag

SEQ ID NO: 104297 - DNA, 25 bp, Artificial Sequence
  Description of Artificial Sequence: Synthetic oligonucleotide
gcctggggccagcagcctgatttag

SEQ ID NO: 104298 - DNA, 26 bp, Artificial Sequence
  Description of Artificial Sequence: Synthetic oligonucleotide
cctggggccagcagcctgatttagca

SEQ ID NO: 104299 - DNA, 26 bp, Artificial Sequence
  Description of Artificial Sequence: Synthetic oligonucleotide
ctggggccagcagcctgatttagcag

SEQ ID NO: 104300 - DNA, 27 bp, Artificial Sequence
  Description of Artificial Sequence: Synthetic oligonucleotide
tggggccagcagcctgatttagcagct

SEQ ID NO: 104301 - DNA, 27 bp, Artificial Sequence
  Description of Artificial Sequence: Synthetic oligonucleotide
ggggccagcagcctgatttagcagcta

SEQ ID NO: 104302 - DNA, 29 bp, Artificial Sequence
  Description of Artificial Sequence: Synthetic oligonucleotide
gggccagcagcctgatttagcagctaatg

SEQ ID NO: 104303 - DNA, 31 bp, Artificial Sequence
  Description of Artificial Sequence: Synthetic oligonucleotide
ggccagcagcctgatttagcagctaatgaag

SEQ ID NO: 104304 - DNA, 31 bp, Artificial Sequence
  Description of Artificial Sequence: Synthetic oligonucleotide
gccagcagcctgatttagcagctaatgaagc

SEQ ID NO: 104305 - DNA, 31 bp, Artificial Sequence
  Description of Artificial Sequence: Synthetic oligonucleotide
ccagcagcctgatttagcagctaatgaagcc

SEQ ID NO: 104306 - DNA, 31 bp, Artificial Sequence
  Description of Artificial Sequence: Synthetic oligonucleotide
cagcagcctgatttagcagctaatgaagccc

SEQ ID NO: 104307 - DNA, 32 bp, Artificial Sequence
  Description of Artificial Sequence: Synthetic oligonucleotide
agcagcctgatttagcagctaatgaagcccag

SEQ ID NO: 104308 - DNA, 31 bp, Artificial Sequence
  Description of Artificial Sequence: Synthetic oligonucleotide
gcagcctgatttagcagctaatgaagcccag

SEQ ID NO: 104309 - DNA, 31 bp, Artificial Sequence
  Description of Artificial Sequence: Synthetic oligonucleotide
cagcctgatttagcagctaatgaagcccagc

SEQ ID NO: 104310 - DNA, 33 bp, Artificial Sequence
  Description of Artificial Sequence: Synthetic oligonucleotide
agcctgatttagcagctaatgaagcccagcttc

SEQ ID NO: 104311 - DNA, 32 bp, Artificial Sequence
  Description of Artificial Sequence: Synthetic oligonucleotide
gcctgatttagcagctaatgaagcccagcttc

SEQ ID NO: 104312 - DNA, 33 bp, Artificial Sequence
  Description of Artificial Sequence: Synthetic oligonucleotide
cctgatttagcagctaatgaagcccagcttctg

SEQ ID NO: 104313 - DNA, 34 bp, Artificial Sequence
  Description of Artificial Sequence: Synthetic oligonucleotide
ctgatttagcagctaatgaagcccagcttctgag

SEQ ID NO: 104314 - DNA, 34 bp, Artificial Sequence
  Description of Artificial Sequence: Synthetic oligonucleotide
tgatttagcagctaatgaagcccagcttctgagg

SEQ ID NO: 104315 - DNA, 33 bp, Artificial Sequence
  Description of Artificial Sequence: Synthetic oligonucleotide
gatttagcagctaatgaagcccagcttctgagg

SEQ ID NO: 104316 - DNA, 39 bp, Artificial Sequence
  Description of Artificial Sequence: Synthetic oligonucleotide
atttagcagctaatgaagcccagcttctgaggaaaattc

SEQ ID NO: 104317 - DNA, 38 bp, Artificial Sequence
  Description of Artificial Sequence: Synthetic oligonucleotide
tttagcagctaatgaagcccagcttctgaggaaaattc

SEQ ID NO: 104318 - DNA, 37 bp, Artificial Sequence
  Description of Artificial Sequence: Synthetic oligonucleotide
ttagcagctaatgaagcccagcttctgaggaaaattc

SEQ ID NO: 104319 - DNA, 36 bp, Artificial Sequence
  Description of Artificial Sequence: Synthetic oligonucleotide
tagcagctaatgaagcccagcttctgaggaaaattc

SEQ ID NO: 104320 - DNA, 35 bp, Artificial Sequence
  Description of Artificial Sequence: Synthetic oligonucleotide
agcagctaatgaagcccagcttctgaggaaaattc

SEQ ID NO: 104321 - DNA, 34 bp, Artificial Sequence
  Description of Artificial Sequence: Synthetic oligonucleotide
gcagctaatgaagcccagcttctgaggaaaattc

SEQ ID NO: 104322 - DNA, 35 bp, Artificial Sequence
  Description of Artificial Sequence: Synthetic oligonucleotide
cagctaatgaagcccagcttctgaggaaaattcag

SEQ ID NO: 104323 - DNA, 37 bp, Artificial Sequence
  Description of Artificial Sequence: Synthetic oligonucleotide
agctaatgaagcccagcttctgaggaaaattcagttg

SEQ ID NO: 104324 - DNA, 36 bp, Artificial Sequence
  Description of Artificial Sequence: Synthetic oligonucleotide
gctaatgaagcccagcttctgaggaaaattcagttg

SEQ ID NO: 104325 - DNA, 38 bp, Artificial Sequence
  Description of Artificial Sequence: Synthetic oligonucleotide
ctaatgaagcccagcttctgaggaaaattcagttgttg

SEQ ID NO: 104326 - DNA, 39 bp, Artificial Sequence
  Description of Artificial Sequence: Synthetic oligonucleotide
taatgaagcccagcttctgaggaaaattcagttgttgtg

SEQ ID NO: 104327 - DNA, 38 bp, Artificial Sequence
  Description of Artificial Sequence: Synthetic oligonucleotide
aatgaagcccagcttctgaggaaaattcagttgttgtg

SEQ ID NO: 104328 - DNA, 37 bp, Artificial Sequence
  Description of Artificial Sequence: Synthetic oligonucleotide
atgaagcccagcttctgaggaaaattcagttgttgtg

SEQ ID NO: 104329 - DNA, 36 bp, Artificial Sequence
  Description of Artificial Sequence: Synthetic oligonucleotide
tgaagcccagcttctgaggaaaattcagttgttgtg

SEQ ID NO: 104330 - DNA, 35 bp, Artificial Sequence
  Description of Artificial Sequence: Synthetic oligonucleotide
gaagcccagcttctgaggaaaattcagttgttgtg

SEQ ID NO: 104331 - DNA, 35 bp, Artificial Sequence
  Description of Artificial Sequence: Synthetic oligonucleotide
aagcccagcttctgaggaaaattcagttgttgtgc

SEQ ID NO: 104332 - DNA, 34 bp, Artificial Sequence
  Description of Artificial Sequence: Synthetic oligonucleotide
agcccagcttctgaggaaaattcagttgttgtgc

SEQ ID NO: 104333 - DNA, 33 bp, Artificial Sequence
  Description of Artificial Sequence: Synthetic oligonucleotide
gcccagcttctgaggaaaattcagttgttgtgc

SEQ ID NO: 104334 - DNA, 33 bp, Artificial Sequence
  Description of Artificial Sequence: Synthetic oligonucleotide
cccagcttctgaggaaaattcagttgttgtgcc

SEQ ID NO: 104335 - DNA, 34 bp, Artificial Sequence
  Description of Artificial Sequence: Synthetic oligonucleotide
ccagcttctgaggaaaattcagttgttgtgcctc

SEQ ID NO: 104336 - DNA, 36 bp, Artificial Sequence
  Description of Artificial Sequence: Synthetic oligonucleotide
cagcttctgaggaaaattcagttgttgtgcctcatg

SEQ ID NO: 104337 - DNA, 36 bp, Artificial Sequence
  Description of Artificial Sequence: Synthetic oligonucleotide
agcttctgaggaaaattcagttgttgtgcctcatgg

SEQ ID NO: 104338 - DNA, 35 bp, Artificial Sequence
  Description of Artificial Sequence: Synthetic oligonucleotide
gcttctgaggaaaattcagttgttgtgcctcatgg

SEQ ID NO: 104339 - DNA, 36 bp, Artificial Sequence
  Description of Artificial Sequence: Synthetic oligonucleotide
cttctgaggaaaattcagttgttgtgcctcatggag

SEQ ID NO: 104340 - DNA, 38 bp, Artificial Sequence
  Description of Artificial Sequence: Synthetic oligonucleotide
ttctgaggaaaattcagttgttgtgcctcatggagatg

SEQ ID NO: 104341 - DNA, 37 bp, Artificial Sequence
  Description of Artificial Sequence: Synthetic oligonucleotide
tctgaggaaaattcagttgttgtgcctcatggagatg

SEQ ID NO: 104342 - DNA, 36 bp, Artificial Sequence
  Description of Artificial Sequence: Synthetic oligonucleotide
ctgaggaaaattcagttgttgtgcctcatggagatg

SEQ ID NO: 104343 - DNA, 37 bp, Artificial Sequence
  Description of Artificial Sequence: Synthetic oligonucleotide
tgaggaaaattcagttgttgtgcctcatggagatgac

SEQ ID NO: 104344 - DNA, 36 bp, Artificial Sequence
  Description of Artificial Sequence: Synthetic oligonucleotide
gaggaaaattcagttgttgtgcctcatggagatgac

SEQ ID NO: 104345 - DNA, 39 bp, Artificial Sequence
  Description of Artificial Sequence: Synthetic oligonucleotide
aggaaaattcagttgttgtgcctcatggagatgactttc

SEQ ID NO: 104346 - DNA, 38 bp, Artificial Sequence
  Description of Artificial Sequence: Synthetic oligonucleotide
ggaaaattcagttgttgtgcctcatggagatgactttc

SEQ ID NO: 104347 - DNA, 39 bp, Artificial Sequence
  Description of Artificial Sequence: Synthetic oligonucleotide
gaaaattcagttgttgtgcctcatggagatgactttcac

SEQ ID NO: 104348 - DNA, 40 bp, Artificial Sequence
  Description of Artificial Sequence: Synthetic oligonucleotide
aaaattcagttgttgtgcctcatggagatgactttcacac

SEQ ID NO: 104349 - DNA, 39 bp, Artificial Sequence
  Description of Artificial Sequence: Synthetic oligonucleotide
aaattcagttgttgtgcctcatggagatgactttcacac

SEQ ID NO: 104350 - DNA, 38 bp, Artificial Sequence
  Description of Artificial Sequence: Synthetic oligonucleotide
aattcagttgttgtgcctcatggagatgactttcacac

SEQ ID NO: 104351 - DNA, 37 bp, Artificial Sequence
  Description of Artificial Sequence: Synthetic oligonucleotide
attcagttgttgtgcctcatggagatgactttcacac

SEQ ID NO: 104352 - DNA, 36 bp, Artificial Sequence
  Description of Artificial Sequence: Synthetic oligonucleotide
ttcagttgttgtgcctcatggagatgactttcacac

SEQ ID NO: 104353 - DNA, 35 bp, Artificial Sequence
  Description of Artificial Sequence: Synthetic oligonucleotide
tcagttgttgtgcctcatggagatgactttcacac

SEQ ID NO: 104354 - DNA, 34 bp, Artificial Sequence
  Description of Artificial Sequence: Synthetic oligonucleotide
cagttgttgtgcctcatggagatgactttcacac

SEQ ID NO: 104355 - DNA, 34 bp, Artificial Sequence
  Description of Artificial Sequence: Synthetic oligonucleotide
agttgttgtgcctcatggagatgactttcacacg

SEQ ID NO: 104356 - DNA, 33 bp, Artificial Sequence
  Description of Artificial Sequence: Synthetic oligonucleotide
gttgttgtgcctcatggagatgactttcacacg

SEQ ID NO: 104357 - DNA, 34 bp, Artificial Sequence
  Description of Artificial Sequence: Synthetic oligonucleotide
ttgttgtgcctcatggagatgactttcacacgac

SEQ ID NO: 104358 - DNA, 33 bp, Artificial Sequence
  Description of Artificial Sequence: Synthetic oligonucleotide
tgttgtgcctcatggagatgactttcacacgac

SEQ ID NO: 104359 - DNA, 32 bp, Artificial Sequence
  Description of Artificial Sequence: Synthetic oligonucleotide
gttgtgcctcatggagatgactttcacacgac

SEQ ID NO: 104360 - DNA, 32 bp, Artificial Sequence
  Description of Artificial Sequence: Synthetic oligonucleotide
ttgtgcctcatggagatgactttcacacgacc

SEQ ID NO: 104361 - DNA, 31 bp, Artificial Sequence
  Description of Artificial Sequence: Synthetic oligonucleotide
tgtgcctcatggagatgactttcacacgacc

SEQ ID NO: 104362 - DNA, 30 bp, Artificial Sequence
  Description of Artificial Sequence: Synthetic oligonucleotide
gtgcctcatggagatgactttcacacgacc

SEQ ID NO: 104363 - DNA, 31 bp, Artificial Sequence
  Description of Artificial Sequence: Synthetic oligonucleotide
tgcctcatggagatgactttcacacgacctg

SEQ ID NO: 104364 - DNA, 30 bp, Artificial Sequence
  Description of Artificial Sequence: Synthetic oligonucleotide
gcctcatggagatgactttcacacgacctg

SEQ ID NO: 104365 - DNA, 30 bp, Artificial Sequence
  Description of Artificial Sequence: Synthetic oligonucleotide
cctcatggagatgactttcacacgacctgc

SEQ ID NO: 104366 - DNA, 30 bp, Artificial Sequence
  Description of Artificial Sequence: Synthetic oligonucleotide
ctcatggagatgactttcacacgacctgcc

SEQ ID NO: 104367 - DNA, 33 bp, Artificial Sequence
  Description of Artificial Sequence: Synthetic oligonucleotide
tcatggagatgactttcacacgacctgccaatc

SEQ ID NO: 104368 - DNA, 32 bp, Artificial Sequence
  Description of Artificial Sequence: Synthetic oligonucleotide
catggagatgactttcacacgacctgccaatc

SEQ ID NO: 104369 - DNA, 33 bp, Artificial Sequence
  Description of Artificial Sequence: Synthetic oligonucleotide
atggagatgactttcacacgacctgccaatcac

SEQ ID NO: 104370 - DNA, 32 bp, Artificial Sequence
  Description of Artificial Sequence: Synthetic oligonucleotide
tggagatgactttcacacgacctgccaatcac

SEQ ID NO: 104371 - DNA, 31 bp, Artificial Sequence
  Description of Artificial Sequence: Synthetic oligonucleotide
ggagatgactttcacacgacctgccaatcac

SEQ ID NO: 104372 - DNA, 32 bp, Artificial Sequence
  Description of Artificial Sequence: Synthetic oligonucleotide
gagatgactttcacacgacctgccaatcacag

SEQ ID NO: 104373 - DNA, 33 bp, Artificial Sequence
  Description of Artificial Sequence: Synthetic oligonucleotide
agatgactttcacacgacctgccaatcacagac

SEQ ID NO: 104374 - DNA, 32 bp, Artificial Sequence
  Description of Artificial Sequence: Synthetic oligonucleotide
gatgactttcacacgacctgccaatcacagac

SEQ ID NO: 104375 - DNA, 34 bp, Artificial Sequence
  Description of Artificial Sequence: Synthetic oligonucleotide
atgactttcacacgacctgccaatcacagacaac

SEQ ID NO: 104376 - DNA, 33 bp, Artificial Sequence
  Description of Artificial Sequence: Synthetic oligonucleotide
tgactttcacacgacctgccaatcacagacaac

SEQ ID NO: 104377 - DNA, 32 bp, Artificial Sequence
  Description of Artificial Sequence: Synthetic oligonucleotide
gactttcacacgacctgccaatcacagacaac

SEQ ID NO: 104378 - DNA, 33 bp, Artificial Sequence
  Description of Artificial Sequence: Synthetic oligonucleotide
actttcacacgacctgccaatcacagacaactc

SEQ ID NO: 104379 - DNA, 32 bp, Artificial Sequence
  Description of Artificial Sequence: Synthetic oligonucleotide
ctttcacacgacctgccaatcacagacaactc

SEQ ID NO: 104380 - DNA, 33 bp, Artificial Sequence
  Description of Artificial Sequence: Synthetic oligonucleotide
tttcacacgacctgccaatcacagacaactcac

SEQ ID NO: 104381 - DNA, 32 bp, Artificial Sequence
  Description of Artificial Sequence: Synthetic oligonucleotide
ttcacacgacctgccaatcacagacaactcac

SEQ ID NO: 104382 - DNA, 31 bp, Artificial Sequence
  Description of Artificial Sequence: Synthetic oligonucleotide
tcacacgacctgccaatcacagacaactcac

SEQ ID NO: 104383 - DNA, 30 bp, Artificial Sequence
  Description of Artificial Sequence: Synthetic oligonucleotide
cacacgacctgccaatcacagacaactcac

SEQ ID NO: 104384 - DNA, 34 bp, Artificial Sequence
  Description of Artificial Sequence: Synthetic oligonucleotide
acacgacctgccaatcacagacaactcacttttg

SEQ ID NO: 104385 - DNA, 33 bp, Artificial Sequence
  Description of Artificial Sequence: Synthetic oligonucleotide
cacgacctgccaatcacagacaactcacttttg

SEQ ID NO: 104386 - DNA, 35 bp, Artificial Sequence
  Description of Artificial Sequence: Synthetic oligonucleotide
acgacctgccaatcacagacaactcacttttgaag

SEQ ID NO: 104387 - DNA, 34 bp, Artificial Sequence
  Description of Artificial Sequence: Synthetic oligonucleotide
cgacctgccaatcacagacaactcacttttgaag

SEQ ID NO: 104388 - DNA, 39 bp, Artificial Sequence
  Description of Artificial Sequence: Synthetic oligonucleotide
gacctgccaatcacagacaactcacttttgaagaaattg

SEQ ID NO: 104389 - DNA, 39 bp, Artificial Sequence
  Description of Artificial Sequence: Synthetic oligonucleotide
acctgccaatcacagacaactcacttttgaagaaattgc

SEQ ID NO: 104390 - DNA, 38 bp, Artificial Sequence
  Description of Artificial Sequence: Synthetic oligonucleotide
cctgccaatcacagacaactcacttttgaagaaattgc

SEQ ID NO: 104391 - DNA, 38 bp, Artificial Sequence
  Description of Artificial Sequence: Synthetic oligonucleotide
ctgccaatcacagacaactcacttttgaagaaattgcc

SEQ ID NO: 104392 - DNA, 42 bp, Artificial Sequence
  Description of Artificial Sequence: Synthetic oligonucleotide
tgccaatcacagacaactcacttttgaagaaattgccaaaag

SEQ ID NO: 104393 - DNA, 41 bp, Artificial Sequence
  Description of Artificial Sequence: Synthetic oligonucleotide
gccaatcacagacaactcacttttgaagaaattgccaaaag

SEQ ID NO: 104394 - DNA, 42 bp, Artificial Sequence
  Description of Artificial Sequence: Synthetic oligonucleotide
ccaatcacagacaactcacttttgaagaaattgccaaaagtg

SEQ ID NO: 104395 - DNA, 42 bp, Artificial Sequence
  Description of Artificial Sequence: Synthetic oligonucleotide
caatcacagacaactcacttttgaagaaattgccaaaagtgc

SEQ ID NO: 104396 - DNA, 48 bp, Artificial Sequence
  Description of Artificial Sequence: Synthetic oligonucleotide
aatcacagacaactcacttttgaagaaattgccaaaagtgctaaaatc

SEQ ID NO: 104397 - DNA, 47 bp, Artificial Sequence
  Description of Artificial Sequence: Synthetic oligonucleotide
atcacagacaactcacttttgaagaaattgccaaaagtgctaaaatc

SEQ ID NO: 104398 - DNA, 46 bp, Artificial Sequence
  Description of Artificial Sequence: Synthetic oligonucleotide
tcacagacaactcacttttgaagaaattgccaaaagtgctaaaatc

SEQ ID NO: 104399 - DNA, 45 bp, Artificial Sequence
  Description of Artificial Sequence: Synthetic oligonucleotide
cacagacaactcacttttgaagaaattgccaaaagtgctaaaatc

SEQ ID NO: 104400 - DNA, 46 bp, Artificial Sequence
  Description of Artificial Sequence: Synthetic oligonucleotide
acagacaactcacttttgaagaaattgccaaaagtgctaaaatcac

SEQ ID NO: 104401 - DNA, 45 bp, Artificial Sequence
  Description of Artificial Sequence: Synthetic oligonucleotide
cagacaactcacttttgaagaaattgccaaaagtgctaaaatcac

SEQ ID NO: 104402 - DNA, 46 bp, Artificial Sequence
  Description of Artificial Sequence: Synthetic oligonucleotide
agacaactcacttttgaagaaattgccaaaagtgctaaaatcacag

SEQ ID NO: 104403 - DNA, 45 bp, Artificial Sequence
  Description of Artificial Sequence: Synthetic oligonucleotide
gacaactcacttttgaagaaattgccaaaagtgctaaaatcacag

SEQ ID NO: 104404 - DNA, 46 bp, Artificial Sequence
  Description of Artificial Sequence: Synthetic oligonucleotide
acaactcacttttgaagaaattgccaaaagtgctaaaatcacagtg

SEQ ID NO: 104405 - DNA, 45 bp, Artificial Sequence
  Description of Artificial Sequence: Synthetic oligonucleotide
caactcacttttgaagaaattgccaaaagtgctaaaatcacagtg

SEQ ID NO: 104406 - DNA, 48 bp, Artificial Sequence
  Description of Artificial Sequence: Synthetic oligonucleotide
aactcacttttgaagaaattgccaaaagtgctaaaatcacagtgaatg

SEQ ID NO: 104407 - DNA, 47 bp, Artificial Sequence
  Description of Artificial Sequence: Synthetic oligonucleotide
actcacttttgaagaaattgccaaaagtgctaaaatcacagtgaatg

SEQ ID NO: 104408 - DNA, 46 bp, Artificial Sequence
  Description of Artificial Sequence: Synthetic oligonucleotide
ctcacttttgaagaaattgccaaaagtgctaaaatcacagtgaatg

SEQ ID NO: 104409 - DNA, 47 bp, Artificial Sequence
  Description of Artificial Sequence: Synthetic oligonucleotide
tcacttttgaagaaattgccaaaagtgctaaaatcacagtgaatgag

SEQ ID NO: 104410 - DNA, 46 bp, Artificial Sequence
  Description of Artificial Sequence: Synthetic oligonucleotide
cacttttgaagaaattgccaaaagtgctaaaatcacagtgaatgag

SEQ ID NO: 104411 - DNA, 46 bp, Artificial Sequence
  Description of Artificial Sequence: Synthetic oligonucleotide
acttttgaagaaattgccaaaagtgctaaaatcacagtgaatgagg

SEQ ID NO: 104412 - DNA, 45 bp, Artificial Sequence
  Description of Artificial Sequence: Synthetic oligonucleotide
cttttgaagaaattgccaaaagtgctaaaatcacagtgaatgagg

SEQ ID NO: 104413 - DNA, 46 bp, Artificial Sequence
  Description of Artificial Sequence: Synthetic oligonucleotide
ttttgaagaaattgccaaaagtgctaaaatcacagtgaatgaggtg

SEQ ID NO: 104414 - DNA, 45 bp, Artificial Sequence
  Description of Artificial Sequence: Synthetic oligonucleotide
tttgaagaaattgccaaaagtgctaaaatcacagtgaatgaggtg

SEQ ID NO: 104415 - DNA, 44 bp, Artificial Sequence
  Description of Artificial Sequence: Synthetic oligonucleotide
ttgaagaaattgccaaaagtgctaaaatcacagtgaatgaggtg

SEQ ID NO: 104416 - DNA, 43 bp, Artificial Sequence
  Description of Artificial Sequence: Synthetic oligonucleotide
tgaagaaattgccaaaagtgctaaaatcacagtgaatgaggtg

SEQ ID NO: 104417 - DNA, 42 bp, Artificial Sequence
  Description of Artificial Sequence: Synthetic oligonucleotide
gaagaaattgccaaaagtgctaaaatcacagtgaatgaggtg

SEQ ID NO: 104418 - DNA, 42 bp, Artificial Sequence
  Description of Artificial Sequence: Synthetic oligonucleotide
aagaaattgccaaaagtgctaaaatcacagtgaatgaggtgg

SEQ ID NO: 104419 - DNA, 41 bp, Artificial Sequence
  Description of Artificial Sequence: Synthetic oligonucleotide
agaaattgccaaaagtgctaaaatcacagtgaatgaggtgg

SEQ ID NO: 104420 - DNA, 40 bp, Artificial Sequence
  Description of Artificial Sequence: Synthetic oligonucleotide
gaaattgccaaaagtgctaaaatcacagtgaatgaggtgg

SEQ ID NO: 104421 - DNA, 41 bp, Artificial Sequence
  Description of Artificial Sequence: Synthetic oligonucleotide
aaattgccaaaagtgctaaaatcacagtgaatgaggtggag

SEQ ID NO: 104422 - DNA, 40 bp, Artificial Sequence
  Description of Artificial Sequence: Synthetic oligonucleotide
aattgccaaaagtgctaaaatcacagtgaatgaggtggag

SEQ ID NO: 104423 - DNA, 39 bp, Artificial Sequence
  Description of Artificial Sequence: Synthetic oligonucleotide
attgccaaaagtgctaaaatcacagtgaatgaggtggag

SEQ ID NO: 104424 - DNA, 38 bp, Artificial Sequence
  Description of Artificial Sequence: Synthetic oligonucleotide
ttgccaaaagtgctaaaatcacagtgaatgaggtggag

SEQ ID NO: 104425 - DNA, 37 bp, Artificial Sequence
  Description of Artificial Sequence: Synthetic oligonucleotide
tgccaaaagtgctaaaatcacagtgaatgaggtggag

SEQ ID NO: 104426 - DNA, 36 bp, Artificial Sequence
  Description of Artificial Sequence: Synthetic oligonucleotide
gccaaaagtgctaaaatcacagtgaatgaggtggag

SEQ ID NO: 104427 - DNA, 36 bp, Artificial Sequence
  Description of Artificial Sequence: Synthetic oligonucleotide
ccaaaagtgctaaaatcacagtgaatgaggtggagc

SEQ ID NO: 104428 - DNA, 38 bp, Artificial Sequence
  Description of Artificial Sequence: Synthetic oligonucleotide
caaaagtgctaaaatcacagtgaatgaggtggagcttc

SEQ ID NO: 104429 - DNA, 39 bp, Artificial Sequence
  Description of Artificial Sequence: Synthetic oligonucleotide
aaaagtgctaaaatcacagtgaatgaggtggagcttctg

SEQ ID NO: 104430 - DNA, 38 bp, Artificial Sequence
  Description of Artificial Sequence: Synthetic oligonucleotide
aaagtgctaaaatcacagtgaatgaggtggagcttctg

SEQ ID NO: 104431 - DNA, 37 bp, Artificial Sequence
  Description of Artificial Sequence: Synthetic oligonucleotide
aagtgctaaaatcacagtgaatgaggtggagcttctg

SEQ ID NO: 104432 - DNA, 36 bp, Artificial Sequence
  Description of Artificial Sequence: Synthetic oligonucleotide
agtgctaaaatcacagtgaatgaggtggagcttctg

SEQ ID NO: 104433 - DNA, 35 bp, Artificial Sequence
  Description of Artificial Sequence: Synthetic oligonucleotide
gtgctaaaatcacagtgaatgaggtggagcttctg

SEQ ID NO: 104434 - DNA, 35 bp, Artificial Sequence
  Description of Artificial Sequence: Synthetic oligonucleotide
tgctaaaatcacagtgaatgaggtggagcttctgg

SEQ ID NO: 104435 - DNA, 34 bp, Artificial Sequence
  Description of Artificial Sequence: Synthetic oligonucleotide
gctaaaatcacagtgaatgaggtggagcttctgg

SEQ ID NO: 104436 - DNA, 35 bp, Artificial Sequence
  Description of Artificial Sequence: Synthetic oligonucleotide
ctaaaatcacagtgaatgaggtggagcttctggtg

SEQ ID NO: 104437 - DNA, 37 bp, Artificial Sequence
  Description of Artificial Sequence: Synthetic oligonucleotide
taaaatcacagtgaatgaggtggagcttctggtgatg

SEQ ID NO: 104438 - DNA, 36 bp, Artificial Sequence
  Description of Artificial Sequence: Synthetic oligonucleotide
aaaatcacagtgaatgaggtggagcttctggtgatg

SEQ ID NO: 104439 - DNA, 35 bp, Artificial Sequence
  Description of Artificial Sequence: Synthetic oligonucleotide
aaatcacagtgaatgaggtggagcttctggtgatg

SEQ ID NO: 104440 - DNA, 34 bp, Artificial Sequence
  Description of Artificial Sequence: Synthetic oligonucleotide
aatcacagtgaatgaggtggagcttctggtgatg

SEQ ID NO: 104441 - DNA, 33 bp, Artificial Sequence
  Description of Artificial Sequence: Synthetic oligonucleotide
atcacagtgaatgaggtggagcttctggtgatg

SEQ ID NO: 104442 - DNA, 32 bp, Artificial Sequence
  Description of Artificial Sequence: Synthetic oligonucleotide
tcacagtgaatgaggtggagcttctggtgatg

SEQ ID NO: 104443 - DNA, 31 bp, Artificial Sequence
  Description of Artificial Sequence: Synthetic oligonucleotide
cacagtgaatgaggtggagcttctggtgatg

SEQ ID NO: 104444 - DNA, 33 bp, Artificial Sequence
  Description of Artificial Sequence: Synthetic oligonucleotide
acagtgaatgaggtggagcttctggtgatgaag

SEQ ID NO: 104445 - DNA, 32 bp, Artificial Sequence
  Description of Artificial Sequence: Synthetic oligonucleotide
cagtgaatgaggtggagcttctggtgatgaag

SEQ ID NO: 104446 - DNA, 32 bp, Artificial Sequence
  Description of Artificial Sequence: Synthetic oligonucleotide
agtgaatgaggtggagcttctggtgatgaagg

SEQ ID NO: 104447 - DNA, 31 bp, Artificial Sequence
  Description of Artificial Sequence: Synthetic oligonucleotide
gtgaatgaggtggagcttctggtgatgaagg

SEQ ID NO: 104448 - DNA, 31 bp, Artificial Sequence
  Description of Artificial Sequence: Synthetic oligonucleotide
tgaatgaggtggagcttctggtgatgaaggc

SEQ ID NO: 104449 - DNA, 30 bp, Artificial Sequence
  Description of Artificial Sequence: Synthetic oligonucleotide
gaatgaggtggagcttctggtgatgaaggc

SEQ ID NO: 104450 - DNA, 30 bp, Artificial Sequence
  Description of Artificial Sequence: Synthetic oligonucleotide
aatgaggtggagcttctggtgatgaaggcc

SEQ ID NO: 104451 - DNA, 29 bp, Artificial Sequence
  Description of Artificial Sequence: Synthetic oligonucleotide
atgaggtggagcttctggtgatgaaggcc

SEQ ID NO: 104452 - DNA, 28 bp, Artificial Sequence
  Description of Artificial Sequence: Synthetic oligonucleotide
tgaggtggagcttctggtgatgaaggcc

SEQ ID NO: 104453 - DNA, 27 bp, Artificial Sequence
  Description of Artificial Sequence: Synthetic oligonucleotide
gaggtggagcttctggtgatgaaggcc

SEQ ID NO: 104454 - DNA, 27 bp, Artificial Sequence
  Description of Artificial Sequence: Synthetic oligonucleotide
aggtggagcttctggtgatgaaggccc

SEQ ID NO: 104455 - DNA, 27 bp, Artificial Sequence
  Description of Artificial Sequence: Synthetic oligonucleotide
ggtggagcttctggtgatgaaggccct

SEQ ID NO: 104456 - DNA, 29 bp, Artificial Sequence
  Description of Artificial Sequence: Synthetic oligonucleotide
gtggagcttctggtgatgaaggccctttc

SEQ ID NO: 104457 - DNA, 29 bp, Artificial Sequence
  Description of Artificial Sequence: Synthetic oligonucleotide
tggagcttctggtgatgaaggccctttcg

SEQ ID NO: 104458 - DNA, 28 bp, Artificial Sequence
  Description of Artificial Sequence: Synthetic oligonucleotide
ggagcttctggtgatgaaggccctttcg

SEQ ID NO: 104459 - DNA, 28 bp, Artificial Sequence
  Description of Artificial Sequence: Synthetic oligonucleotide
gagcttctggtgatgaaggccctttcgg

SEQ ID NO: 104460 - DNA, 29 bp, Artificial Sequence
  Description of Artificial Sequence: Synthetic oligonucleotide
agcttctggtgatgaaggccctttcggtg

SEQ ID NO: 104461 - DNA, 28 bp, Artificial Sequence
  Description of Artificial Sequence: Synthetic oligonucleotide
gcttctggtgatgaaggccctttcggtg

SEQ ID NO: 104462 - DNA, 28 bp, Artificial Sequence
  Description of Artificial Sequence: Synthetic oligonucleotide
cttctggtgatgaaggccctttcggtgg

SEQ ID NO: 104463 - DNA, 28 bp, Artificial Sequence
  Description of Artificial Sequence: Synthetic oligonucleotide
ttctggtgatgaaggccctttcggtggg

SEQ ID NO: 104464 - DNA, 27 bp, Artificial Sequence
  Description of Artificial Sequence: Synthetic oligonucleotide
tctggtgatgaaggccctttcggtggg

SEQ ID NO: 104465 - DNA, 26 bp, Artificial Sequence
  Description of Artificial Sequence: Synthetic oligonucleotide
ctggtgatgaaggccctttcggtggg

SEQ ID NO: 104466 - DNA, 26 bp, Artificial Sequence
  Description of Artificial Sequence: Synthetic oligonucleotide
tggtgatgaaggccctttcggtgggg

SEQ ID NO: 104467 - DNA, 25 bp, Artificial Sequence
  Description of Artificial Sequence: Synthetic oligonucleotide
ggtgatgaaggccctttcggtgggg

SEQ ID NO: 104468 - DNA, 26 bp, Artificial Sequence
  Description of Artificial Sequence: Synthetic oligonucleotide
gtgatgaaggccctttcggtggggct

SEQ ID NO: 104469 - DNA, 26 bp, Artificial Sequence
  Description of Artificial Sequence: Synthetic oligonucleotide
tgatgaaggccctttcggtggggctg

SEQ ID NO: 104470 - DNA, 25 bp, Artificial Sequence
  Description of Artificial Sequence: Synthetic oligonucleotide
gatgaaggccctttcggtggggctg

SEQ ID NO: 104471 - DNA, 26 bp, Artificial Sequence
  Description of Artificial Sequence: Synthetic oligonucleotide
atgaaggccctttcggtggggctggt

SEQ ID NO: 104472 - DNA, 25 bp, Artificial Sequence
  Description of Artificial Sequence: Synthetic oligonucleotide
tgaaggccctttcggtggggctggt

SEQ ID NO: 104473 - DNA, 24 bp, Artificial Sequence
  Description of Artificial Sequence: Synthetic oligonucleotide
gaaggccctttcggtggggctggt

SEQ ID NO: 104474 - DNA, 27 bp, Artificial Sequence
  Description of Artificial Sequence: Synthetic oligonucleotide
aaggccctttcggtggggctggtgaaa

SEQ ID NO: 104475 - DNA, 26 bp, Artificial Sequence
  Description of Artificial Sequence: Synthetic oligonucleotide
aggccctttcggtggggctggtgaaa

SEQ ID NO: 104476 - DNA, 25 bp, Artificial Sequence
  Description of Artificial Sequence: Synthetic oligonucleotide
ggccctttcggtggggctggtgaaa

SEQ ID NO: 104477 - DNA, 25 bp, Artificial Sequence
  Description of Artificial Sequence: Synthetic oligonucleotide
gccctttcggtggggctggtgaaag

SEQ ID NO: 104478 - DNA, 25 bp, Artificial Sequence
  Description of Artificial Sequence: Synthetic oligonucleotide
ccctttcggtggggctggtgaaagg

SEQ ID NO: 104479 - DNA, 26 bp, Artificial Sequence
  Description of Artificial Sequence: Synthetic oligonucleotide
cctttcggtggggctggtgaaaggca

SEQ ID NO: 104480 - DNA, 27 bp, Artificial Sequence
  Description of Artificial Sequence: Synthetic oligonucleotide
ctttcggtggggctggtgaaaggcagt

SEQ ID NO: 104481 - DNA, 30 bp, Artificial Sequence
  Description of Artificial Sequence: Synthetic oligonucleotide
tttcggtggggctggtgaaaggcagtatag

SEQ ID NO: 104482 - DNA, 29 bp, Artificial Sequence
  Description of Artificial Sequence: Synthetic oligonucleotide
ttcggtggggctggtgaaaggcagtatag

SEQ ID NO: 104483 - DNA, 28 bp, Artificial Sequence
  Description of Artificial Sequence: Synthetic oligonucleotide
tcggtggggctggtgaaaggcagtatag

SEQ ID NO: 104484 - DNA, 27 bp, Artificial Sequence
  Description of Artificial Sequence: Synthetic oligonucleotide
cggtggggctggtgaaaggcagtatag

SEQ ID NO: 104485 - DNA, 28 bp, Artificial Sequence
  Description of Artificial Sequence: Synthetic oligonucleotide
ggtggggctggtgaaaggcagtatagac

SEQ ID NO: 104486 - DNA, 28 bp, Artificial Sequence
  Description of Artificial Sequence: Synthetic oligonucleotide
gtggggctggtgaaaggcagtatagacg

SEQ ID NO: 104487 - DNA, 29 bp, Artificial Sequence
  Description of Artificial Sequence: Synthetic oligonucleotide
tggggctggtgaaaggcagtatagacgag

SEQ ID NO: 104488 - DNA, 28 bp, Artificial Sequence
  Description of Artificial Sequence: Synthetic oligonucleotide
ggggctggtgaaaggcagtatagacgag

SEQ ID NO: 104489 - DNA, 28 bp, Artificial Sequence
  Description of Artificial Sequence: Synthetic oligonucleotide
gggctggtgaaaggcagtatagacgagg

SEQ ID NO: 104490 - DNA, 29 bp, Artificial Sequence
  Description of Artificial Sequence: Synthetic oligonucleotide
ggctggtgaaaggcagtatagacgaggtg

SEQ ID NO: 104491 - DNA, 29 bp, Artificial Sequence
  Description of Artificial Sequence: Synthetic oligonucleotide
gctggtgaaaggcagtatagacgaggtgg

SEQ ID NO: 104492 - DNA, 30 bp, Artificial Sequence
  Description of Artificial Sequence: Synthetic oligonucleotide
ctggtgaaaggcagtatagacgaggtggac

SEQ ID NO: 104493 - DNA, 33 bp, Artificial Sequence
  Description of Artificial Sequence: Synthetic oligonucleotide
tggtgaaaggcagtatagacgaggtggacaaac

SEQ ID NO: 104494 - DNA, 32 bp, Artificial Sequence
  Description of Artificial Sequence: Synthetic oligonucleotide
ggtgaaaggcagtatagacgaggtggacaaac

SEQ ID NO: 104495 - DNA, 32 bp, Artificial Sequence
  Description of Artificial Sequence: Synthetic oligonucleotide
gtgaaaggcagtatagacgaggtggacaaacg

SEQ ID NO: 104496 - DNA, 33 bp, Artificial Sequence
  Description of Artificial Sequence: Synthetic oligonucleotide
tgaaaggcagtatagacgaggtggacaaacgag

SEQ ID NO: 104497 - DNA, 32 bp, Artificial Sequence
  Description of Artificial Sequence: Synthetic oligonucleotide
gaaaggcagtatagacgaggtggacaaacgag

SEQ ID NO: 104498 - DNA, 33 bp, Artificial Sequence
  Description of Artificial Sequence: Synthetic oligonucleotide
aaaggcagtatagacgaggtggacaaacgagtc

SEQ ID NO: 104499 - DNA, 32 bp, Artificial Sequence
  Description of Artificial Sequence: Synthetic oligonucleotide
aaggcagtatagacgaggtggacaaacgagtc

SEQ ID NO: 104500 - DNA, 31 bp, Artificial Sequence
  Description of Artificial Sequence: Synthetic oligonucleotide
aggcagtatagacgaggtggacaaacgagtc

SEQ ID NO: 104501 - DNA, 30 bp, Artificial Sequence
  Description of Artificial Sequence: Synthetic oligonucleotide
ggcagtatagacgaggtggacaaacgagtc

SEQ ID NO: 104502 - DNA, 30 bp, Artificial Sequence
  Description of Artificial Sequence: Synthetic oligonucleotide
gcagtatagacgaggtggacaaacgagtcc

SEQ ID NO: 104503 - DNA, 31 bp, Artificial Sequence
  Description of Artificial Sequence: Synthetic oligonucleotide
cagtatagacgaggtggacaaacgagtccac

SEQ ID NO: 104504 - DNA, 33 bp, Artificial Sequence
  Description of Artificial Sequence: Synthetic oligonucleotide
agtatagacgaggtggacaaacgagtccacatg

SEQ ID NO: 104505 - DNA, 32 bp, Artificial Sequence
  Description of Artificial Sequence: Synthetic oligonucleotide
gtatagacgaggtggacaaacgagtccacatg

SEQ ID NO: 104506 - DNA, 33 bp, Artificial Sequence
  Description of Artificial Sequence: Synthetic oligonucleotide
tatagacgaggtggacaaacgagtccacatgac

SEQ ID NO: 104507 - DNA, 32 bp, Artificial Sequence
  Description of Artificial Sequence: Synthetic oligonucleotide
atagacgaggtggacaaacgagtccacatgac

SEQ ID NO: 104508 - DNA, 31 bp, Artificial Sequence
  Description of Artificial Sequence: Synthetic oligonucleotide
tagacgaggtggacaaacgagtccacatgac

SEQ ID NO: 104509 - DNA, 30 bp, Artificial Sequence
  Description of Artificial Sequence: Synthetic oligonucleotide
agacgaggtggacaaacgagtccacatgac

SEQ ID NO: 104510 - DNA, 29 bp, Artificial Sequence
  Description of Artificial Sequence: Synthetic oligonucleotide
gacgaggtggacaaacgagtccacatgac

SEQ ID NO: 104511 - DNA, 29 bp, Artificial Sequence
  Description of Artificial Sequence: Synthetic oligonucleotide
acgaggtggacaaacgagtccacatgacc

SEQ ID NO: 104512 - DNA, 28 bp, Artificial Sequence
  Description of Artificial Sequence: Synthetic oligonucleotide
cgaggtggacaaacgagtccacatgacc

SEQ ID NO: 104513 - DNA, 29 bp, Artificial Sequence
  Description of Artificial Sequence: Synthetic oligonucleotide
gaggtggacaaacgagtccacatgacctg

SEQ ID NO: 104514 - DNA, 29 bp, Artificial Sequence
  Description of Artificial Sequence: Synthetic oligonucleotide
aggtggacaaacgagtccacatgacctgg

SEQ ID NO: 104515 - DNA, 28 bp, Artificial Sequence
  Description of Artificial Sequence: Synthetic oligonucleotide
ggtggacaaacgagtccacatgacctgg

SEQ ID NO: 104516 - DNA, 28 bp, Artificial Sequence
  Description of Artificial Sequence: Synthetic oligonucleotide
gtggacaaacgagtccacatgacctggg

SEQ ID NO: 104517 - DNA, 29 bp, Artificial Sequence
  Description of Artificial Sequence: Synthetic oligonucleotide
tggacaaacgagtccacatgacctgggtg

SEQ ID NO: 104518 - DNA, 28 bp, Artificial Sequence
  Description of Artificial Sequence: Synthetic oligonucleotide
ggacaaacgagtccacatgacctgggtg

SEQ ID NO: 104519 - DNA, 28 bp, Artificial Sequence
  Description of Artificial Sequence: Synthetic oligonucleotide
gacaaacgagtccacatgacctgggtgc

SEQ ID NO: 104520 - DNA, 29 bp, Artificial Sequence
  Description of Artificial Sequence: Synthetic oligonucleotide
acaaacgagtccacatgacctgggtgcag

SEQ ID NO: 104521 - DNA, 28 bp, Artificial Sequence
  Description of Artificial Sequence: Synthetic oligonucleotide
caaacgagtccacatgacctgggtgcag

SEQ ID NO: 104522 - DNA, 28 bp, Artificial Sequence
  Description of Artificial Sequence: Synthetic oligonucleotide
aaacgagtccacatgacctgggtgcagc

SEQ ID NO: 104523 - DNA, 27 bp, Artificial Sequence
  Description of Artificial Sequence: Synthetic oligonucleotide
aacgagtccacatgacctgggtgcagc

SEQ ID NO: 104524 - DNA, 26 bp, Artificial Sequence
  Description of Artificial Sequence: Synthetic oligonucleotide
acgagtccacatgacctgggtgcagc

SEQ ID NO: 104525 - DNA, 25 bp, Artificial Sequence
  Description of Artificial Sequence: Synthetic oligonucleotide
cgagtccacatgacctgggtgcagc

SEQ ID NO: 104526 - DNA, 25 bp, Artificial Sequence
  Description of Artificial Sequence: Synthetic oligonucleotide
gagtccacatgacctgggtgcagcc

SEQ ID NO: 104527 - DNA, 25 bp, Artificial Sequence
  Description of Artificial Sequence: Synthetic oligonucleotide
agtccacatgacctgggtgcagccc

SEQ ID NO: 104528 - DNA, 24 bp, Artificial Sequence
  Description of Artificial Sequence: Synthetic oligonucleotide
gtccacatgacctgggtgcagccc

SEQ ID NO: 104529 - DNA, 24 bp, Artificial Sequence
  Description of Artificial Sequence: Synthetic oligonucleotide
tccacatgacctgggtgcagcccc

SEQ ID NO: 104530 - DNA, 23 bp, Artificial Sequence
  Description of Artificial Sequence: Synthetic oligonucleotide
ccacatgacctgggtgcagcccc

SEQ ID NO: 104531 - DNA, 24 bp, Artificial Sequence
  Description of Artificial Sequence: Synthetic oligonucleotide
cacatgacctgggtgcagccccga

SEQ ID NO: 104532 - DNA, 25 bp, Artificial Sequence
  Description of Artificial Sequence: Synthetic oligonucleotide
acatgacctgggtgcagccccgagt

SEQ ID NO: 104533 - DNA, 24 bp, Artificial Sequence
  Description of Artificial Sequence: Synthetic oligonucleotide
catgacctgggtgcagccccgagt

SEQ ID NO: 104534 - DNA, 26 bp, Artificial Sequence
  Description of Artificial Sequence: Synthetic oligonucleotide
atgacctgggtgcagccccgagtgtt

SEQ ID NO: 104535 - DNA, 25 bp, Artificial Sequence
  Description of Artificial Sequence: Synthetic oligonucleotide
tgacctgggtgcagccccgagtgtt

SEQ ID NO: 104536 - DNA, 24 bp, Artificial Sequence
  Description of Artificial Sequence: Synthetic oligonucleotide
gacctgggtgcagccccgagtgtt

SEQ ID NO: 104537 - DNA, 24 bp, Artificial Sequence
  Description of Artificial Sequence: Synthetic oligonucleotide
acctgggtgcagccccgagtgttg

SEQ ID NO: 104538 - DNA, 23 bp, Artificial Sequence
  Description of Artificial Sequence: Synthetic oligonucleotide
cctgggtgcagccccgagtgttg

SEQ ID NO: 104539 - DNA, 27 bp, Artificial Sequence
  Description of Artificial Sequence: Synthetic oligonucleotide
ctgggtgcagccccgagtgttggattt

SEQ ID NO: 104540 - DNA, 27 bp, Artificial Sequence
  Description of Artificial Sequence: Synthetic oligonucleotide
tgggtgcagccccgagtgttggatttg

SEQ ID NO: 104541 - DNA, 26 bp, Artificial Sequence
  Description of Artificial Sequence: Synthetic oligonucleotide
gggtgcagccccgagtgttggatttg

SEQ ID NO: 104542 - DNA, 27 bp, Artificial Sequence
  Description of Artificial Sequence: Synthetic oligonucleotide
ggtgcagccccgagtgttggatttgca

SEQ ID NO: 104543 - DNA, 28 bp, Artificial Sequence
  Description of Artificial Sequence: Synthetic oligonucleotide
gtgcagccccgagtgttggatttgcaac

SEQ ID NO: 104544 - DNA, 29 bp, Artificial Sequence
  Description of Artificial Sequence: Synthetic oligonucleotide
tgcagccccgagtgttggatttgcaacag

SEQ ID NO: 104545 - DNA, 28 bp, Artificial Sequence
  Description of Artificial Sequence: Synthetic oligonucleotide
gcagccccgagtgttggatttgcaacag

SEQ ID NO: 104546 - DNA, 30 bp, Artificial Sequence
  Description of Artificial Sequence: Synthetic oligonucleotide
cagccccgagtgttggatttgcaacagatc

SEQ ID NO: 104547 - DNA, 32 bp, Artificial Sequence
  Description of Artificial Sequence: Synthetic oligonucleotide
agccccgagtgttggatttgcaacagatcaag

SEQ ID NO: 104548 - DNA, 31 bp, Artificial Sequence
  Description of Artificial Sequence: Synthetic oligonucleotide
gccccgagtgttggatttgcaacagatcaag

SEQ ID NO: 104549 - DNA, 31 bp, Artificial Sequence
  Description of Artificial Sequence: Synthetic oligonucleotide
ccccgagtgttggatttgcaacagatcaagg

SEQ ID NO: 104550 - DNA, 31 bp, Artificial Sequence
  Description of Artificial Sequence: Synthetic oligonucleotide
cccgagtgttggatttgcaacagatcaaggg

SEQ ID NO: 104551 - DNA, 34 bp, Artificial Sequence
  Description of Artificial Sequence: Synthetic oligonucleotide
ccgagtgttggatttgcaacagatcaagggaatg

SEQ ID NO: 104552 - DNA, 36 bp, Artificial Sequence
  Description of Artificial Sequence: Synthetic oligonucleotide
cgagtgttggatttgcaacagatcaagggaatgaag

SEQ ID NO: 104553 - DNA, 36 bp, Artificial Sequence
  Description of Artificial Sequence: Synthetic oligonucleotide
gagtgttggatttgcaacagatcaagggaatgaagg

SEQ ID NO: 104554 - DNA, 37 bp, Artificial Sequence
  Description of Artificial Sequence: Synthetic oligonucleotide
agtgttggatttgcaacagatcaagggaatgaaggac

SEQ ID NO: 104555 - DNA, 36 bp, Artificial Sequence
  Description of Artificial Sequence: Synthetic oligonucleotide
gtgttggatttgcaacagatcaagggaatgaaggac

SEQ ID NO: 104556 - DNA, 36 bp, Artificial Sequence
  Description of Artificial Sequence: Synthetic oligonucleotide
tgttggatttgcaacagatcaagggaatgaaggacc

SEQ ID NO: 104557 - DNA, 35 bp, Artificial Sequence
  Description of Artificial Sequence: Synthetic oligonucleotide
gttggatttgcaacagatcaagggaatgaaggacc

SEQ ID NO: 104558 - DNA, 35 bp, Artificial Sequence
  Description of Artificial Sequence: Synthetic oligonucleotide
ttggatttgcaacagatcaagggaatgaaggaccg

SEQ ID NO: 104559 - DNA, 34 bp, Artificial Sequence
  Description of Artificial Sequence: Synthetic oligonucleotide
tggatttgcaacagatcaagggaatgaaggaccg

SEQ ID NO: 104560 - DNA, 33 bp, Artificial Sequence
  Description of Artificial Sequence: Synthetic oligonucleotide
ggatttgcaacagatcaagggaatgaaggaccg

SEQ ID NO: 104561 - DNA, 33 bp, Artificial Sequence
  Description of Artificial Sequence: Synthetic oligonucleotide
gatttgcaacagatcaagggaatgaaggaccgc

SEQ ID NO: 104562 - DNA, 33 bp, Artificial Sequence
  Description of Artificial Sequence: Synthetic oligonucleotide
atttgcaacagatcaagggaatgaaggaccgcc

SEQ ID NO: 104563 - DNA, 32 bp, Artificial Sequence
  Description of Artificial Sequence: Synthetic oligonucleotide
tttgcaacagatcaagggaatgaaggaccgcc

SEQ ID NO: 104564 - DNA, 31 bp, Artificial Sequence
  Description of Artificial Sequence: Synthetic oligonucleotide
ttgcaacagatcaagggaatgaaggaccgcc

SEQ ID NO: 104565 - DNA, 30 bp, Artificial Sequence
  Description of Artificial Sequence: Synthetic oligonucleotide
tgcaacagatcaagggaatgaaggaccgcc

SEQ ID NO: 104566 - DNA, 29 bp, Artificial Sequence
  Description of Artificial Sequence: Synthetic oligonucleotide
gcaacagatcaagggaatgaaggaccgcc

SEQ ID NO: 104567 - DNA, 30 bp, Artificial Sequence
  Description of Artificial Sequence: Synthetic oligonucleotide
caacagatcaagggaatgaaggaccgcctg

SEQ ID NO: 104568 - DNA, 30 bp, Artificial Sequence
  Description of Artificial Sequence: Synthetic oligonucleotide
aacagatcaagggaatgaaggaccgcctgg

SEQ ID NO: 104569 - DNA, 29 bp, Artificial Sequence
  Description of Artificial Sequence: Synthetic oligonucleotide
acagatcaagggaatgaaggaccgcctgg

SEQ ID NO: 104570 - DNA, 28 bp, Artificial Sequence
  Description of Artificial Sequence: Synthetic oligonucleotide
cagatcaagggaatgaaggaccgcctgg

SEQ ID NO: 104571 - DNA, 29 bp, Artificial Sequence
  Description of Artificial Sequence: Synthetic oligonucleotide
agatcaagggaatgaaggaccgcctggag

SEQ ID NO: 104572 - DNA, 28 bp, Artificial Sequence
  Description of Artificial Sequence: Synthetic oligonucleotide
gatcaagggaatgaaggaccgcctggag

SEQ ID NO: 104573 - DNA, 30 bp, Artificial Sequence
  Description of Artificial Sequence: Synthetic oligonucleotide
atcaagggaatgaaggaccgcctggagttc

SEQ ID NO: 104574 - DNA, 29 bp, Artificial Sequence
  Description of Artificial Sequence: Synthetic oligonucleotide
tcaagggaatgaaggaccgcctggagttc

SEQ ID NO: 104575 - DNA, 28 bp, Artificial Sequence
  Description of Artificial Sequence: Synthetic oligonucleotide
caagggaatgaaggaccgcctggagttc

SEQ ID NO: 104576 - DNA, 29 bp, Artificial Sequence
  Description of Artificial Sequence: Synthetic oligonucleotide
aagggaatgaaggaccgcctggagttctg

SEQ ID NO: 104577 - DNA, 28 bp, Artificial Sequence
  Description of Artificial Sequence: Synthetic oligonucleotide
agggaatgaaggaccgcctggagttctg

SEQ ID NO: 104578 - DNA, 27 bp, Artificial Sequence
  Description of Artificial Sequence: Synthetic oligonucleotide
gggaatgaaggaccgcctggagttctg

SEQ ID NO: 104579 - DNA, 27 bp, Artificial Sequence
  Description of Artificial Sequence: Synthetic oligonucleotide
ggaatgaaggaccgcctggagttctgg

SEQ ID NO: 104580 - DNA, 28 bp, Artificial Sequence
  Description of Artificial Sequence: Synthetic oligonucleotide
gaatgaaggaccgcctggagttctggtg

SEQ ID NO: 104581 - DNA, 28 bp, Artificial Sequence
  Description of Artificial Sequence: Synthetic oligonucleotide
aatgaaggaccgcctggagttctggtgc

SEQ ID NO: 104582 - DNA, 27 bp, Artificial Sequence
  Description of Artificial Sequence: Synthetic oligonucleotide
atgaaggaccgcctggagttctggtgc

SEQ ID NO: 104583 - DNA, 27 bp, Artificial Sequence
  Description of Artificial Sequence: Synthetic oligonucleotide
tgaaggaccgcctggagttctggtgca

SEQ ID NO: 104584 - DNA, 26 bp, Artificial Sequence
  Description of Artificial Sequence: Synthetic oligonucleotide
gaaggaccgcctggagttctggtgca

SEQ ID NO: 104585 - DNA, 26 bp, Artificial Sequence
  Description of Artificial Sequence: Synthetic oligonucleotide
aaggaccgcctggagttctggtgcac

SEQ ID NO: 104586 - DNA, 25 bp, Artificial Sequence
  Description of Artificial Sequence: Synthetic oligonucleotide
aggaccgcctggagttctggtgcac

SEQ ID NO: 104587 - DNA, 24 bp, Artificial Sequence
  Description of Artificial Sequence: Synthetic oligonucleotide
ggaccgcctggagttctggtgcac

SEQ ID NO: 104588 - DNA, 24 bp, Artificial Sequence
  Description of Artificial Sequence: Synthetic oligonucleotide
gaccgcctggagttctggtgcacg

SEQ ID NO: 104589 - DNA, 26 bp, Artificial Sequence
  Description of Artificial Sequence: Synthetic oligonucleotide
accgcctggagttctggtgcacggat

SEQ ID NO: 104590 - DNA, 25 bp, Artificial Sequence
  Description of Artificial Sequence: Synthetic oligonucleotide
ccgcctggagttctggtgcacggat

SEQ ID NO: 104591 - DNA, 26 bp, Artificial Sequence
  Description of Artificial Sequence: Synthetic oligonucleotide
cgcctggagttctggtgcacggatgt

SEQ ID NO: 104592 - DNA, 27 bp, Artificial Sequence
  Description of Artificial Sequence: Synthetic oligonucleotide
gcctggagttctggtgcacggatgtga

SEQ ID NO: 104593 - DNA, 28 bp, Artificial Sequence
  Description of Artificial Sequence: Synthetic oligonucleotide
cctggagttctggtgcacggatgtgaag

SEQ ID NO: 104594 - DNA, 29 bp, Artificial Sequence
  Description of Artificial Sequence: Synthetic oligonucleotide
ctggagttctggtgcacggatgtgaagag

SEQ ID NO: 104595 - DNA, 29 bp, Artificial Sequence
  Description of Artificial Sequence: Synthetic oligonucleotide
tggagttctggtgcacggatgtgaagagc

SEQ ID NO: 104596 - DNA, 28 bp, Artificial Sequence
  Description of Artificial Sequence: Synthetic oligonucleotide
ggagttctggtgcacggatgtgaagagc

SEQ ID NO: 104597 - DNA, 30 bp, Artificial Sequence
  Description of Artificial Sequence: Synthetic oligonucleotide
gagttctggtgcacggatgtgaagagcatg

SEQ ID NO: 104598 - DNA, 30 bp, Artificial Sequence
  Description of Artificial Sequence: Synthetic oligonucleotide
agttctggtgcacggatgtgaagagcatgg

SEQ ID NO: 104599 - DNA, 29 bp, Artificial Sequence
  Description of Artificial Sequence: Synthetic oligonucleotide
gttctggtgcacggatgtgaagagcatgg

SEQ ID NO: 104600 - DNA, 30 bp, Artificial Sequence
  Description of Artificial Sequence: Synthetic oligonucleotide
ttctggtgcacggatgtgaagagcatggag

SEQ ID NO: 104601 - DNA, 29 bp, Artificial Sequence
  Description of Artificial Sequence: Synthetic oligonucleotide
tctggtgcacggatgtgaagagcatggag

SEQ ID NO: 104602 - DNA, 28 bp, Artificial Sequence
  Description of Artificial Sequence: Synthetic oligonucleotide
ctggtgcacggatgtgaagagcatggag

SEQ ID NO: 104603 - DNA, 30 bp, Artificial Sequence
  Description of Artificial Sequence: Synthetic oligonucleotide
tggtgcacggatgtgaagagcatggagatg

SEQ ID NO: 104604 - DNA, 29 bp, Artificial Sequence
  Description of Artificial Sequence: Synthetic oligonucleotide
ggtgcacggatgtgaagagcatggagatg

SEQ ID NO: 104605 - DNA, 29 bp, Artificial Sequence
  Description of Artificial Sequence: Synthetic oligonucleotide
gtgcacggatgtgaagagcatggagatgc

SEQ ID NO: 104606 - DNA, 30 bp, Artificial Sequence
  Description of Artificial Sequence: Synthetic oligonucleotide
tgcacggatgtgaagagcatggagatgctg

SEQ ID NO: 104607 - DNA, 29 bp, Artificial Sequence
  Description of Artificial Sequence: Synthetic oligonucleotide
gcacggatgtgaagagcatggagatgctg

SEQ ID NO: 104608 - DNA, 29 bp, Artificial Sequence
  Description of Artificial Sequence: Synthetic oligonucleotide
cacggatgtgaagagcatggagatgctgg

SEQ ID NO: 104609 - DNA, 30 bp, Artificial Sequence
  Description of Artificial Sequence: Synthetic oligonucleotide
acggatgtgaagagcatggagatgctggtg

SEQ ID NO: 104610 - DNA, 29 bp, Artificial Sequence
  Description of Artificial Sequence: Synthetic oligonucleotide
cggatgtgaagagcatggagatgctggtg

SEQ ID NO: 104611 - DNA, 29 bp, Artificial Sequence
  Description of Artificial Sequence: Synthetic oligonucleotide
ggatgtgaagagcatggagatgctggtgg

SEQ ID NO: 104612 - DNA, 30 bp, Artificial Sequence
  Description of Artificial Sequence: Synthetic oligonucleotide
gatgtgaagagcatggagatgctggtggag

SEQ ID NO: 104613 - DNA, 30 bp, Artificial Sequence
  Description of Artificial Sequence: Synthetic oligonucleotide
atgtgaagagcatggagatgctggtggagc

SEQ ID NO: 104614 - DNA, 29 bp, Artificial Sequence
  Description of Artificial Sequence: Synthetic oligonucleotide
tgtgaagagcatggagatgctggtggagc

SEQ ID NO: 104615 - DNA, 28 bp, Artificial Sequence
  Description of Artificial Sequence: Synthetic oligonucleotide
gtgaagagcatggagatgctggtggagc

SEQ ID NO: 104616 - DNA, 29 bp, Artificial Sequence
  Description of Artificial Sequence: Synthetic oligonucleotide
tgaagagcatggagatgctggtggagcac

SEQ ID NO: 104617 - DNA, 28 bp, Artificial Sequence
  Description of Artificial Sequence: Synthetic oligonucleotide
gaagagcatggagatgctggtggagcac

SEQ ID NO: 104618 - DNA, 28 bp, Artificial Sequence
  Description of Artificial Sequence: Synthetic oligonucleotide
aagagcatggagatgctggtggagcacc

SEQ ID NO: 104619 - DNA, 27 bp, Artificial Sequence
  Description of Artificial Sequence: Synthetic oligonucleotide
agagcatggagatgctggtggagcacc

SEQ ID NO: 104620 - DNA, 27 bp, Artificial Sequence
  Description of Artificial Sequence: Synthetic oligonucleotide
gagcatggagatgctggtggagcacca

SEQ ID NO: 104621 - DNA, 27 bp, Artificial Sequence
  Description of Artificial Sequence: Synthetic oligonucleotide
agcatggagatgctggtggagcaccag

SEQ ID NO: 104622 - DNA, 26 bp, Artificial Sequence
  Description of Artificial Sequence: Synthetic oligonucleotide
gcatggagatgctggtggagcaccag

SEQ ID NO: 104623 - DNA, 26 bp, Artificial Sequence
  Description of Artificial Sequence: Synthetic oligonucleotide
catggagatgctggtggagcaccagg

SEQ ID NO: 104624 - DNA, 26 bp, Artificial Sequence
  Description of Artificial Sequence: Synthetic oligonucleotide
atggagatgctggtggagcaccaggc

SEQ ID NO: 104625 - DNA, 25 bp, Artificial Sequence
  Description of Artificial Sequence: Synthetic oligonucleotide
tggagatgctggtggagcaccaggc

SEQ ID NO: 104626 - DNA, 24 bp, Artificial Sequence
  Description of Artificial Sequence: Synthetic oligonucleotide
ggagatgctggtggagcaccaggc

SEQ ID NO: 104627 - DNA, 24 bp, Artificial Sequence
  Description of Artificial Sequence: Synthetic oligonucleotide
gagatgctggtggagcaccaggcc

SEQ ID NO: 104628 - DNA, 26 bp, Artificial Sequence
  Description of Artificial Sequence: Synthetic oligonucleotide
agatgctggtggagcaccaggcccat

SEQ ID NO: 104629 - DNA, 25 bp, Artificial Sequence
  Description of Artificial Sequence: Synthetic oligonucleotide
gatgctggtggagcaccaggcccat

SEQ ID NO: 104630 - DNA, 26 bp, Artificial Sequence
  Description of Artificial Sequence: Synthetic oligonucleotide
atgctggtggagcaccaggcccatga

SEQ ID NO: 104631 - DNA, 25 bp, Artificial Sequence
  Description of Artificial Sequence: Synthetic oligonucleotide
tgctggtggagcaccaggcccatga

SEQ ID NO: 104632 - DNA, 24 bp, Artificial Sequence
  Description of Artificial Sequence: Synthetic oligonucleotide
gctggtggagcaccaggcccatga

SEQ ID NO: 104633 - DNA, 26 bp, Artificial Sequence
  Description of Artificial Sequence: Synthetic oligonucleotide
ctggtggagcaccaggcccatgacat

SEQ ID NO: 104634 - DNA, 26 bp, Artificial Sequence
  Description of Artificial Sequence: Synthetic oligonucleotide
tggtggagcaccaggcccatgacatc

SEQ ID NO: 104635 - DNA, 25 bp, Artificial Sequence
  Description of Artificial Sequence: Synthetic oligonucleotide
ggtggagcaccaggcccatgacatc

SEQ ID NO: 104636 - DNA, 26 bp, Artificial Sequence
  Description of Artificial Sequence: Synthetic oligonucleotide
gtggagcaccaggcccatgacatcct

SEQ ID NO: 104637 - DNA, 27 bp, Artificial Sequence
  Description of Artificial Sequence: Synthetic oligonucleotide
tggagcaccaggcccatgacatcctca

SEQ ID NO: 104638 - DNA, 26 bp, Artificial Sequence
  Description of Artificial Sequence: Synthetic oligonucleotide
ggagcaccaggcccatgacatcctca

SEQ ID NO: 104639 - DNA, 26 bp, Artificial Sequence
  Description of Artificial Sequence: Synthetic oligonucleotide
gagcaccaggcccatgacatcctcac

SEQ ID NO: 104640 - DNA, 27 bp, Artificial Sequence
  Description of Artificial Sequence: Synthetic oligonucleotide
agcaccaggcccatgacatcctcacct

SEQ ID NO: 104641 - DNA, 27 bp, Artificial Sequence
  Description of Artificial Sequence: Synthetic oligonucleotide
gcaccaggcccatgacatcctcaccta

SEQ ID NO: 104642 - DNA, 27 bp, Artificial Sequence
  Description of Artificial Sequence: Synthetic oligonucleotide
caccaggcccatgacatcctcacctag

SEQ ID NO: 104643 - DNA, 29 bp, Artificial Sequence
  Description of Artificial Sequence: Synthetic oligonucleotide
accgtctggaggagctctacacgaagaac

SEQ ID NO: 104644 - DNA, 28 bp, Artificial Sequence
  Description of Artificial Sequence: Synthetic oligonucleotide
ccgtctggaggagctctacacgaagaac

SEQ ID NO: 104645 - DNA, 33 bp, Artificial Sequence
  Description of Artificial Sequence: Synthetic oligonucleotide
cgtctggaggagctctacacgaagaactttatg

SEQ ID NO: 104646 - DNA, 37 bp, Artificial Sequence
  Description of Artificial Sequence: Synthetic oligonucleotide
gtctggaggagctctacacgaagaactttatgaaaac

SEQ ID NO: 104647 - DNA, 42 bp, Artificial Sequence
  Description of Artificial Sequence: Synthetic oligonucleotide
tctggaggagctctacacgaagaactttatgaaaactttatc

SEQ ID NO: 104648 - DNA, 41 bp, Artificial Sequence
  Description of Artificial Sequence: Synthetic oligonucleotide
ctggaggagctctacacgaagaactttatgaaaactttatc

SEQ ID NO: 104649 - DNA, 42 bp, Artificial Sequence
  Description of Artificial Sequence: Synthetic oligonucleotide
tggaggagctctacacgaagaactttatgaaaactttatcag

SEQ ID NO: 104650 - DNA, 41 bp, Artificial Sequence
  Description of Artificial Sequence: Synthetic oligonucleotide
ggaggagctctacacgaagaactttatgaaaactttatcag

SEQ ID NO: 104651 - DNA, 42 bp, Artificial Sequence
  Description of Artificial Sequence: Synthetic oligonucleotide
gaggagctctacacgaagaactttatgaaaactttatcagtg

SEQ ID NO: 104652 - DNA, 47 bp, Artificial Sequence
  Description of Artificial Sequence: Synthetic oligonucleotide
aggagctctacacgaagaactttatgaaaactttatcagtgaatttg

SEQ ID NO: 104653 - DNA, 46 bp, Artificial Sequence
  Description of Artificial Sequence: Synthetic oligonucleotide
ggagctctacacgaagaactttatgaaaactttatcagtgaatttg

SEQ ID NO: 104654 - DNA, 48 bp, Artificial Sequence
  Description of Artificial Sequence: Synthetic oligonucleotide
gagctctacacgaagaactttatgaaaactttatcagtgaatttgaac

SEQ ID NO: 104655 - DNA, 49 bp, Artificial Sequence
  Description of Artificial Sequence: Synthetic oligonucleotide
agctctacacgaagaactttatgaaaactttatcagtgaatttgaacac

SEQ ID NO: 104656 - DNA, 48 bp, Artificial Sequence
  Description of Artificial Sequence: Synthetic oligonucleotide
gctctacacgaagaactttatgaaaactttatcagtgaatttgaacac

SEQ ID NO: 104657 - DNA, 49 bp, Artificial Sequence
  Description of Artificial Sequence: Synthetic oligonucleotide
ctctacacgaagaactttatgaaaactttatcagtgaatttgaacacag

SEQ ID NO: 104658 - DNA, 49 bp, Artificial Sequence
  Description of Artificial Sequence: Synthetic oligonucleotide
tctacacgaagaactttatgaaaactttatcagtgaatttgaacacagg

SEQ ID NO: 104659 - DNA, 48 bp, Artificial Sequence
  Description of Artificial Sequence: Synthetic oligonucleotide
ctacacgaagaactttatgaaaactttatcagtgaatttgaacacagg

SEQ ID NO: 104660 - DNA, 53 bp, Artificial Sequence
  Description of Artificial Sequence: Synthetic oligonucleotide
tacacgaagaactttatgaaaactttatcagtgaatttgaacacaggtaaaag

SEQ ID NO: 104661 - DNA, 52 bp, Artificial Sequence
  Description of Artificial Sequence: Synthetic oligonucleotide
acacgaagaactttatgaaaactttatcagtgaatttgaacacaggtaaaag

SEQ ID NO: 104662 - DNA, 51 bp, Artificial Sequence
  Description of Artificial Sequence: Synthetic oligonucleotide
cacgaagaactttatgaaaactttatcagtgaatttgaacacaggtaaaag

SEQ ID NO: 104663 - DNA, 51 bp, Artificial Sequence
  Description of Artificial Sequence: Synthetic oligonucleotide
acgaagaactttatgaaaactttatcagtgaatttgaacacaggtaaaagc

SEQ ID NO: 104664 - DNA, 50 bp, Artificial Sequence
  Description of Artificial Sequence: Synthetic oligonucleotide
cgaagaactttatgaaaactttatcagtgaatttgaacacaggtaaaagc

SEQ ID NO: 104665 - DNA, 50 bp, Artificial Sequence
  Description of Artificial Sequence: Synthetic oligonucleotide
gaagaactttatgaaaactttatcagtgaatttgaacacaggtaaaagcc

SEQ ID NO: 104666 - DNA, 51 bp, Artificial Sequence
  Description of Artificial Sequence: Synthetic oligonucleotide
aagaactttatgaaaactttatcagtgaatttgaacacaggtaaaagcctc

SEQ ID NO: 104667 - DNA, 50 bp, Artificial Sequence
  Description of Artificial Sequence: Synthetic oligonucleotide
agaactttatgaaaactttatcagtgaatttgaacacaggtaaaagcctc

SEQ ID NO: 104668 - DNA, 49 bp, Artificial Sequence
  Description of Artificial Sequence: Synthetic oligonucleotide
gaactttatgaaaactttatcagtgaatttgaacacaggtaaaagcctc

SEQ ID NO: 104669 - DNA, 50 bp, Artificial Sequence
  Description of Artificial Sequence: Synthetic oligonucleotide
aactttatgaaaactttatcagtgaatttgaacacaggtaaaagcctctc

SEQ ID NO: 104670 - DNA, 49 bp, Artificial Sequence
  Description of Artificial Sequence: Synthetic oligonucleotide
actttatgaaaactttatcagtgaatttgaacacaggtaaaagcctctc

SEQ ID NO: 104671 - DNA, 48 bp, Artificial Sequence
  Description of Artificial Sequence: Synthetic oligonucleotide
ctttatgaaaactttatcagtgaatttgaacacaggtaaaagcctctc

SEQ ID NO: 104672 - DNA, 50 bp, Artificial Sequence
  Description of Artificial Sequence: Synthetic oligonucleotide
tttatgaaaactttatcagtgaatttgaacacaggtaaaagcctctcatc

SEQ ID NO: 104673 - DNA, 49 bp, Artificial Sequence
  Description of Artificial Sequence: Synthetic oligonucleotide
ttatgaaaactttatcagtgaatttgaacacaggtaaaagcctctcatc

SEQ ID NO: 104674 - DNA, 48 bp, Artificial Sequence
  Description of Artificial Sequence: Synthetic oligonucleotide
tatgaaaactttatcagtgaatttgaacacaggtaaaagcctctcatc

SEQ ID NO: 104675 - DNA, 47 bp, Artificial Sequence
  Description of Artificial Sequence: Synthetic oligonucleotide
atgaaaactttatcagtgaatttgaacacaggtaaaagcctctcatc

SEQ ID NO: 104676 - DNA, 46 bp, Artificial Sequence
  Description of Artificial Sequence: Synthetic oligonucleotide
tgaaaactttatcagtgaatttgaacacaggtaaaagcctctcatc

SEQ ID NO: 104677 - DNA, 45 bp, Artificial Sequence
  Description of Artificial Sequence: Synthetic oligonucleotide
gaaaactttatcagtgaatttgaacacaggtaaaagcctctcatc

SEQ ID NO: 104678 - DNA, 45 bp, Artificial Sequence
  Description of Artificial Sequence: Synthetic oligonucleotide
aaaactttatcagtgaatttgaacacaggtaaaagcctctcatcc

SEQ ID NO: 104679 - DNA, 44 bp, Artificial Sequence
  Description of Artificial Sequence: Synthetic oligonucleotide
aaactttatcagtgaatttgaacacaggtaaaagcctctcatcc

SEQ ID NO: 104680 - DNA, 43 bp, Artificial Sequence
  Description of Artificial Sequence: Synthetic oligonucleotide
aactttatcagtgaatttgaacacaggtaaaagcctctcatcc

SEQ ID NO: 104681 - DNA, 42 bp, Artificial Sequence
  Description of Artificial Sequence: Synthetic oligonucleotide
actttatcagtgaatttgaacacaggtaaaagcctctcatcc

SEQ ID NO: 104682 - DNA, 41 bp, Artificial Sequence
  Description of Artificial Sequence: Synthetic oligonucleotide
ctttatcagtgaatttgaacacaggtaaaagcctctcatcc

SEQ ID NO: 104683 - DNA, 41 bp, Artificial Sequence
  Description of Artificial Sequence: Synthetic oligonucleotide
tttatcagtgaatttgaacacaggtaaaagcctctcatccg

SEQ ID NO: 104684 - DNA, 40 bp, Artificial Sequence
  Description of Artificial Sequence: Synthetic oligonucleotide
ttatcagtgaatttgaacacaggtaaaagcctctcatccg

SEQ ID NO: 104685 - DNA, 39 bp, Artificial Sequence
  Description of Artificial Sequence: Synthetic oligonucleotide
tatcagtgaatttgaacacaggtaaaagcctctcatccg

SEQ ID NO: 104686 - DNA, 38 bp, Artificial Sequence
  Description of Artificial Sequence: Synthetic oligonucleotide
atcagtgaatttgaacacaggtaaaagcctctcatccg

SEQ ID NO: 104687 - DNA, 37 bp, Artificial Sequence
  Description of Artificial Sequence: Synthetic oligonucleotide
tcagtgaatttgaacacaggtaaaagcctctcatccg

SEQ ID NO: 104688 - DNA, 36 bp, Artificial Sequence
  Description of Artificial Sequence: Synthetic oligonucleotide
cagtgaatttgaacacaggtaaaagcctctcatccg

SEQ ID NO: 104689 - DNA, 41 bp, Artificial Sequence
  Description of Artificial Sequence: Synthetic oligonucleotide
agtgaatttgaacacaggtaaaagcctctcatccgtttttc

SEQ ID NO: 104690 - DNA, 40 bp, Artificial Sequence
  Description of Artificial Sequence: Synthetic oligonucleotide
gtgaatttgaacacaggtaaaagcctctcatccgtttttc

SEQ ID NO: 104691 - DNA, 41 bp, Artificial Sequence
  Description of Artificial Sequence: Synthetic oligonucleotide
tgaatttgaacacaggtaaaagcctctcatccgtttttcac

SEQ ID NO: 104692 - DNA, 40 bp, Artificial Sequence
  Description of Artificial Sequence: Synthetic oligonucleotide
gaatttgaacacaggtaaaagcctctcatccgtttttcac

SEQ ID NO: 104693 - DNA, 43 bp, Artificial Sequence
  Description of Artificial Sequence: Synthetic oligonucleotide
aatttgaacacaggtaaaagcctctcatccgtttttcactttg

SEQ ID NO: 104694 - DNA, 42 bp, Artificial Sequence
  Description of Artificial Sequence: Synthetic oligonucleotide
atttgaacacaggtaaaagcctctcatccgtttttcactttg

SEQ ID NO: 104695 - DNA, 41 bp, Artificial Sequence
  Description of Artificial Sequence: Synthetic oligonucleotide
tttgaacacaggtaaaagcctctcatccgtttttcactttg

SEQ ID NO: 104696 - DNA, 40 bp, Artificial Sequence
  Description of Artificial Sequence: Synthetic oligonucleotide
ttgaacacaggtaaaagcctctcatccgtttttcactttg

SEQ ID NO: 104697 - DNA, 39 bp, Artificial Sequence
  Description of Artificial Sequence: Synthetic oligonucleotide
tgaacacaggtaaaagcctctcatccgtttttcactttg

SEQ ID NO: 104698 - DNA, 38 bp, Artificial Sequence
  Description of Artificial Sequence: Synthetic oligonucleotide
gaacacaggtaaaagcctctcatccgtttttcactttg

SEQ ID NO: 104699 - DNA, 43 bp, Artificial Sequence
  Description of Artificial Sequence: Synthetic oligonucleotide
aacacaggtaaaagcctctcatccgtttttcactttgaaaatg

SEQ ID NO: 104700 - DNA, 42 bp, Artificial Sequence
  Description of Artificial Sequence: Synthetic oligonucleotide
acacaggtaaaagcctctcatccgtttttcactttgaaaatg

SEQ ID NO: 104701 - DNA, 41 bp, Artificial Sequence
  Description of Artificial Sequence: Synthetic oligonucleotide
cacaggtaaaagcctctcatccgtttttcactttgaaaatg

SEQ ID NO: 104702 - DNA, 42 bp, Artificial Sequence
  Description of Artificial Sequence: Synthetic oligonucleotide
acaggtaaaagcctctcatccgtttttcactttgaaaatgag

SEQ ID NO: 104703 - DNA, 41 bp, Artificial Sequence
  Description of Artificial Sequence: Synthetic oligonucleotide
caggtaaaagcctctcatccgtttttcactttgaaaatgag

SEQ ID NO: 104704 - DNA, 42 bp, Artificial Sequence
  Description of Artificial Sequence: Synthetic oligonucleotide
aggtaaaagcctctcatccgtttttcactttgaaaatgagtg

SEQ ID NO: 104705 - DNA, 41 bp, Artificial Sequence
  Description of Artificial Sequence: Synthetic oligonucleotide
ggtaaaagcctctcatccgtttttcactttgaaaatgagtg

SEQ ID NO: 104706 - DNA, 41 bp, Artificial Sequence
  Description of Artificial Sequence: Synthetic oligonucleotide
gtaaaagcctctcatccgtttttcactttgaaaatgagtgc

SEQ ID NO: 104707 - DNA, 44 bp, Artificial Sequence
  Description of Artificial Sequence: Synthetic oligonucleotide
taaaagcctctcatccgtttttcactttgaaaatgagtgcattg

SEQ ID NO: 104708 - DNA, 43 bp, Artificial Sequence
  Description of Artificial Sequence: Synthetic oligonucleotide
aaaagcctctcatccgtttttcactttgaaaatgagtgcattg

SEQ ID NO: 104709 - DNA, 42 bp, Artificial Sequence
  Description of Artificial Sequence: Synthetic oligonucleotide
aaagcctctcatccgtttttcactttgaaaatgagtgcattg

SEQ ID NO: 104710 - DNA, 41 bp, Artificial Sequence
  Description of Artificial Sequence: Synthetic oligonucleotide
aagcctctcatccgtttttcactttgaaaatgagtgcattg

SEQ ID NO: 104711 - DNA, 40 bp, Artificial Sequence
  Description of Artificial Sequence: Synthetic oligonucleotide
agcctctcatccgtttttcactttgaaaatgagtgcattg

SEQ ID NO: 104712 - DNA, 39 bp, Artificial Sequence
  Description of Artificial Sequence: Synthetic oligonucleotide
gcctctcatccgtttttcactttgaaaatgagtgcattg

SEQ ID NO: 104713 - DNA, 41 bp, Artificial Sequence
  Description of Artificial Sequence: Synthetic oligonucleotide
cctctcatccgtttttcactttgaaaatgagtgcattgatg

SEQ ID NO: 104714 - DNA, 41 bp, Artificial Sequence
  Description of Artificial Sequence: Synthetic oligonucleotide
ctctcatccgtttttcactttgaaaatgagtgcattgatgc

SEQ ID NO: 104715 - DNA, 42 bp, Artificial Sequence
  Description of Artificial Sequence: Synthetic oligonucleotide
tctcatccgtttttcactttgaaaatgagtgcattgatgctc

SEQ ID NO: 104716 - DNA, 41 bp, Artificial Sequence
  Description of Artificial Sequence: Synthetic oligonucleotide
ctcatccgtttttcactttgaaaatgagtgcattgatgctc

SEQ ID NO: 104717 - DNA, 41 bp, Artificial Sequence
  Description of Artificial Sequence: Synthetic oligonucleotide
tcatccgtttttcactttgaaaatgagtgcattgatgctcg

SEQ ID NO: 104718 - DNA, 40 bp, Artificial Sequence
  Description of Artificial Sequence: Synthetic oligonucleotide
catccgtttttcactttgaaaatgagtgcattgatgctcg

SEQ ID NO: 104719 - DNA, 40 bp, Artificial Sequence
  Description of Artificial Sequence: Synthetic oligonucleotide
atccgtttttcactttgaaaatgagtgcattgatgctcgg

SEQ ID NO: 104720 - DNA, 39 bp, Artificial Sequence
  Description of Artificial Sequence: Synthetic oligonucleotide
tccgtttttcactttgaaaatgagtgcattgatgctcgg

SEQ ID NO: 104721 - DNA, 38 bp, Artificial Sequence
  Description of Artificial Sequence: Synthetic oligonucleotide
ccgtttttcactttgaaaatgagtgcattgatgctcgg

SEQ ID NO: 104722 - DNA, 38 bp, Artificial Sequence
  Description of Artificial Sequence: Synthetic oligonucleotide
cgtttttcactttgaaaatgagtgcattgatgctcggc

SEQ ID NO: 104723 - DNA, 38 bp, Artificial Sequence
  Description of Artificial Sequence: Synthetic oligonucleotide
gtttttcactttgaaaatgagtgcattgatgctcggcg

SEQ ID NO: 104724 - DNA, 38 bp, Artificial Sequence
  Description of Artificial Sequence: Synthetic oligonucleotide
tttttcactttgaaaatgagtgcattgatgctcggcgg

SEQ ID NO: 104725 - DNA, 37 bp, Artificial Sequence
  Description of Artificial Sequence: Synthetic oligonucleotide
ttttcactttgaaaatgagtgcattgatgctcggcgg

SEQ ID NO: 104726 - DNA, 36 bp, Artificial Sequence
  Description of Artificial Sequence: Synthetic oligonucleotide
tttcactttgaaaatgagtgcattgatgctcggcgg

SEQ ID NO: 104727 - DNA, 35 bp, Artificial Sequence
  Description of Artificial Sequence: Synthetic oligonucleotide
ttcactttgaaaatgagtgcattgatgctcggcgg

SEQ ID NO: 104728 - DNA, 34 bp, Artificial Sequence
  Description of Artificial Sequence: Synthetic oligonucleotide
tcactttgaaaatgagtgcattgatgctcggcgg

SEQ ID NO: 104729 - DNA, 33 bp, Artificial Sequence
  Description of Artificial Sequence: Synthetic oligonucleotide
cactttgaaaatgagtgcattgatgctcggcgg

SEQ ID NO: 104730 - DNA, 34 bp, Artificial Sequence
  Description of Artificial Sequence: Synthetic oligonucleotide
actttgaaaatgagtgcattgatgctcggcggtg

SEQ ID NO: 104731 - DNA, 33 bp, Artificial Sequence
  Description of Artificial Sequence: Synthetic oligonucleotide
ctttgaaaatgagtgcattgatgctcggcggtg

SEQ ID NO: 104732 - DNA, 33 bp, Artificial Sequence
  Description of Artificial Sequence: Synthetic oligonucleotide
tttgaaaatgagtgcattgatgctcggcggtgc

SEQ ID NO: 104733 - DNA, 32 bp, Artificial Sequence
  Description of Artificial Sequence: Synthetic oligonucleotide
ttgaaaatgagtgcattgatgctcggcggtgc

SEQ ID NO: 104734 - DNA, 31 bp, Artificial Sequence
  Description of Artificial Sequence: Synthetic oligonucleotide
tgaaaatgagtgcattgatgctcggcggtgc

SEQ ID NO: 104735 - DNA, 30 bp, Artificial Sequence
  Description of Artificial Sequence: Synthetic oligonucleotide
gaaaatgagtgcattgatgctcggcggtgc

SEQ ID NO: 104736 - DNA, 31 bp, Artificial Sequence
  Description of Artificial Sequence: Synthetic oligonucleotide
aaaatgagtgcattgatgctcggcggtgctc

SEQ ID NO: 104737 - DNA, 30 bp, Artificial Sequence
  Description of Artificial Sequence: Synthetic oligonucleotide
aaatgagtgcattgatgctcggcggtgctc

SEQ ID NO: 104738 - DNA, 29 bp, Artificial Sequence
  Description of Artificial Sequence: Synthetic oligonucleotide
aatgagtgcattgatgctcggcggtgctc

SEQ ID NO: 104739 - DNA, 28 bp, Artificial Sequence
  Description of Artificial Sequence: Synthetic oligonucleotide
atgagtgcattgatgctcggcggtgctc

SEQ ID NO: 104740 - DNA, 27 bp, Artificial Sequence
  Description of Artificial Sequence: Synthetic oligonucleotide
tgagtgcattgatgctcggcggtgctc

SEQ ID NO: 104741 - DNA, 27 bp, Artificial Sequence
  Description of Artificial Sequence: Synthetic oligonucleotide
gagtgcattgatgctcggcggtgctca

SEQ ID NO: 104742 - DNA, 29 bp, Artificial Sequence
  Description of Artificial Sequence: Synthetic oligonucleotide
agtgcattgatgctcggcggtgctcaaag

SEQ ID NO: 104743 - DNA, 28 bp, Artificial Sequence
  Description of Artificial Sequence: Synthetic oligonucleotide
gtgcattgatgctcggcggtgctcaaag

SEQ ID NO: 104744 - DNA, 28 bp, Artificial Sequence
  Description of Artificial Sequence: Synthetic oligonucleotide
tgcattgatgctcggcggtgctcaaagg

SEQ ID NO: 104745 - DNA, 27 bp, Artificial Sequence
  Description of Artificial Sequence: Synthetic oligonucleotide
gcattgatgctcggcggtgctcaaagg

SEQ ID NO: 104746 - DNA, 27 bp, Artificial Sequence
  Description of Artificial Sequence: Synthetic oligonucleotide
cattgatgctcggcggtgctcaaaggc

SEQ ID NO: 104747 - DNA, 28 bp, Artificial Sequence
  Description of Artificial Sequence: Synthetic oligonucleotide
attgatgctcggcggtgctcaaaggctg

SEQ ID NO: 104748 - DNA, 27 bp, Artificial Sequence
  Description of Artificial Sequence: Synthetic oligonucleotide
ttgatgctcggcggtgctcaaaggctg

SEQ ID NO: 104749 - DNA, 26 bp, Artificial Sequence
  Description of Artificial Sequence: Synthetic oligonucleotide
tgatgctcggcggtgctcaaaggctg

SEQ ID NO: 104750 - DNA, 25 bp, Artificial Sequence
  Description of Artificial Sequence: Synthetic oligonucleotide
gatgctcggcggtgctcaaaggctg

SEQ ID NO: 104751 - DNA, 26 bp, Artificial Sequence
  Description of Artificial Sequence: Synthetic oligonucleotide
atgctcggcggtgctcaaaggctggt

SEQ ID NO: 104752 - DNA, 25 bp, Artificial Sequence
  Description of Artificial Sequence: Synthetic oligonucleotide
tgctcggcggtgctcaaaggctggt

SEQ ID NO: 104753 - DNA, 24 bp, Artificial Sequence
  Description of Artificial Sequence: Synthetic oligonucleotide
gctcggcggtgctcaaaggctggt

SEQ ID NO: 104754 - DNA, 24 bp, Artificial Sequence
  Description of Artificial Sequence: Synthetic oligonucleotide
ctcggcggtgctcaaaggctggtg

SEQ ID NO: 104755 - DNA, 24 bp, Artificial Sequence
  Description of Artificial Sequence: Synthetic oligonucleotide
tcggcggtgctcaaaggctggtgg

SEQ ID NO: 104756 - DNA, 23 bp, Artificial Sequence
  Description of Artificial Sequence: Synthetic oligonucleotide
cggcggtgctcaaaggctggtgg

SEQ ID NO: 104757 - DNA, 27 bp, Artificial Sequence
  Description of Artificial Sequence: Synthetic oligonucleotide
ggcggtgctcaaaggctggtggctttt

SEQ ID NO: 104758 - DNA, 31 bp, Artificial Sequence
  Description of Artificial Sequence: Synthetic oligonucleotide
gcggtgctcaaaggctggtggcttttatttc

SEQ ID NO: 104759 - DNA, 32 bp, Artificial Sequence
  Description of Artificial Sequence: Synthetic oligonucleotide
cggtgctcaaaggctggtggcttttatttcag

SEQ ID NO: 104760 - DNA, 32 bp, Artificial Sequence
  Description of Artificial Sequence: Synthetic oligonucleotide
ggtgctcaaaggctggtggcttttatttcagg

SEQ ID NO: 104761 - DNA, 32 bp, Artificial Sequence
  Description of Artificial Sequence: Synthetic oligonucleotide
gtgctcaaaggctggtggcttttatttcaggg

SEQ ID NO: 104762 - DNA, 33 bp, Artificial Sequence
  Description of Artificial Sequence: Synthetic oligonucleotide
tgctcaaaggctggtggcttttatttcagggtg

SEQ ID NO: 104763 - DNA, 32 bp, Artificial Sequence
  Description of Artificial Sequence: Synthetic oligonucleotide
gctcaaaggctggtggcttttatttcagggtg

SEQ ID NO: 104764 - DNA, 34 bp, Artificial Sequence
  Description of Artificial Sequence: Synthetic oligonucleotide
ctcaaaggctggtggcttttatttcagggtgaac

SEQ ID NO: 104765 - DNA, 34 bp, Artificial Sequence
  Description of Artificial Sequence: Synthetic oligonucleotide
tcaaaggctggtggcttttatttcagggtgaacc

SEQ ID NO: 104766 - DNA, 33 bp, Artificial Sequence
  Description of Artificial Sequence: Synthetic oligonucleotide
caaaggctggtggcttttatttcagggtgaacc

SEQ ID NO: 104767 - DNA, 33 bp, Artificial Sequence
  Description of Artificial Sequence: Synthetic oligonucleotide
aaaggctggtggcttttatttcagggtgaaccc

SEQ ID NO: 104768 - DNA, 32 bp, Artificial Sequence
  Description of Artificial Sequence: Synthetic oligonucleotide
aaggctggtggcttttatttcagggtgaaccc

SEQ ID NO: 104769 - DNA, 31 bp, Artificial Sequence
  Description of Artificial Sequence: Synthetic oligonucleotide
aggctggtggcttttatttcagggtgaaccc

SEQ ID NO: 104770 - DNA, 30 bp, Artificial Sequence
  Description of Artificial Sequence: Synthetic oligonucleotide
ggctggtggcttttatttcagggtgaaccc

SEQ ID NO: 104771 - DNA, 33 bp, Artificial Sequence
  Description of Artificial Sequence: Synthetic oligonucleotide
gctggtggcttttatttcagggtgaaccctttg

SEQ ID NO: 104772 - DNA, 34 bp, Artificial Sequence
  Description of Artificial Sequence: Synthetic oligonucleotide
ctggtggcttttatttcagggtgaaccctttgtc

SEQ ID NO: 104773 - DNA, 34 bp, Artificial Sequence
  Description of Artificial Sequence: Synthetic oligonucleotide
tggtggcttttatttcagggtgaaccctttgtcc

SEQ ID NO: 104774 - DNA, 33 bp, Artificial Sequence
  Description of Artificial Sequence: Synthetic oligonucleotide
ggtggcttttatttcagggtgaaccctttgtcc

SEQ ID NO: 104775 - DNA, 33 bp, Artificial Sequence
  Description of Artificial Sequence: Synthetic oligonucleotide
gtggcttttatttcagggtgaaccctttgtccc

SEQ ID NO: 104776 - DNA, 34 bp, Artificial Sequence
  Description of Artificial Sequence: Synthetic oligonucleotide
tggcttttatttcagggtgaaccctttgtccctc

SEQ ID NO: 104777 - DNA, 33 bp, Artificial Sequence
  Description of Artificial Sequence: Synthetic oligonucleotide
ggcttttatttcagggtgaaccctttgtccctc

SEQ ID NO: 104778 - DNA, 33 bp, Artificial Sequence
  Description of Artificial Sequence: Synthetic oligonucleotide
gcttttatttcagggtgaaccctttgtccctcg

SEQ ID NO: 104779 - DNA, 34 bp, Artificial Sequence
  Description of Artificial Sequence: Synthetic oligonucleotide
cttttatttcagggtgaaccctttgtccctcgtg

SEQ ID NO: 104780 - DNA, 34 bp, Artificial Sequence
  Description of Artificial Sequence: Synthetic oligonucleotide
ttttatttcagggtgaaccctttgtccctcgtgg

SEQ ID NO: 104781 - DNA, 33 bp, Artificial Sequence
  Description of Artificial Sequence: Synthetic oligonucleotide
tttatttcagggtgaaccctttgtccctcgtgg

SEQ ID NO: 104782 - DNA, 32 bp, Artificial Sequence
  Description of Artificial Sequence: Synthetic oligonucleotide
ttatttcagggtgaaccctttgtccctcgtgg

SEQ ID NO: 104783 - DNA, 31 bp, Artificial Sequence
  Description of Artificial Sequence: Synthetic oligonucleotide
tatttcagggtgaaccctttgtccctcgtgg

SEQ ID NO: 104784 - DNA, 30 bp, Artificial Sequence
  Description of Artificial Sequence: Synthetic oligonucleotide
atttcagggtgaaccctttgtccctcgtgg

SEQ ID NO: 104785 - DNA, 29 bp, Artificial Sequence
  Description of Artificial Sequence: Synthetic oligonucleotide
tttcagggtgaaccctttgtccctcgtgg

SEQ ID NO: 104786 - DNA, 28 bp, Artificial Sequence
  Description of Artificial Sequence: Synthetic oligonucleotide
ttcagggtgaaccctttgtccctcgtgg

SEQ ID NO: 104787 - DNA, 27 bp, Artificial Sequence
  Description of Artificial Sequence: Synthetic oligonucleotide
tcagggtgaaccctttgtccctcgtgg

SEQ ID NO: 104788 - DNA, 34 bp, Artificial Sequence
  Description of Artificial Sequence: Synthetic oligonucleotide
atgatcacctcggccgctggaattatttctcttc

SEQ ID NO: 104789 - DNA, 33 bp, Artificial Sequence
  Description of Artificial Sequence: Synthetic oligonucleotide
tgatcacctcggccgctggaattatttctcttc

SEQ ID NO: 104790 - DNA, 32 bp, Artificial Sequence
  Description of Artificial Sequence: Synthetic oligonucleotide
gatcacctcggccgctggaattatttctcttc

SEQ ID NO: 104791 - DNA, 33 bp, Artificial Sequence
  Description of Artificial Sequence: Synthetic oligonucleotide
atcacctcggccgctggaattatttctcttctg

SEQ ID NO: 104792 - DNA, 32 bp, Artificial Sequence
  Description of Artificial Sequence: Synthetic oligonucleotide
tcacctcggccgctggaattatttctcttctg

SEQ ID NO: 104793 - DNA, 31 bp, Artificial Sequence
  Description of Artificial Sequence: Synthetic oligonucleotide
cacctcggccgctggaattatttctcttctg

SEQ ID NO: 104794 - DNA, 31 bp, Artificial Sequence
  Description of Artificial Sequence: Synthetic oligonucleotide
acctcggccgctggaattatttctcttctgg

SEQ ID NO: 104795 - DNA, 30 bp, Artificial Sequence
  Description of Artificial Sequence: Synthetic oligonucleotide
cctcggccgctggaattatttctcttctgg

SEQ ID NO: 104796 - DNA, 32 bp, Artificial Sequence
  Description of Artificial Sequence: Synthetic oligonucleotide
ctcggccgctggaattatttctcttctggatg

SEQ ID NO: 104797 - DNA, 34 bp, Artificial Sequence
  Description of Artificial Sequence: Synthetic oligonucleotide
tcggccgctggaattatttctcttctggatgaag

SEQ ID NO: 104798 - DNA, 33 bp, Artificial Sequence
  Description of Artificial Sequence: Synthetic oligonucleotide
cggccgctggaattatttctcttctggatgaag

SEQ ID NO: 104799 - DNA, 35 bp, Artificial Sequence
  Description of Artificial Sequence: Synthetic oligonucleotide
ggccgctggaattatttctcttctggatgaagatg

SEQ ID NO: 104800 - DNA, 37 bp, Artificial Sequence
  Description of Artificial Sequence: Synthetic oligonucleotide
gccgctggaattatttctcttctggatgaagatgaac

SEQ ID NO: 104801 - DNA, 37 bp, Artificial Sequence
  Description of Artificial Sequence: Synthetic oligonucleotide
ccgctggaattatttctcttctggatgaagatgaacc

SEQ ID NO: 104802 - DNA, 38 bp, Artificial Sequence
  Description of Artificial Sequence: Synthetic oligonucleotide
cgctggaattatttctcttctggatgaagatgaaccac

SEQ ID NO: 104803 - DNA, 39 bp, Artificial Sequence
  Description of Artificial Sequence: Synthetic oligonucleotide
gctggaattatttctcttctggatgaagatgaaccacag

SEQ ID NO: 104804 - DNA, 39 bp, Artificial Sequence
  Description of Artificial Sequence: Synthetic oligonucleotide
ctggaattatttctcttctggatgaagatgaaccacagc

SEQ ID NO: 104805 - DNA, 43 bp, Artificial Sequence
  Description of Artificial Sequence: Synthetic oligonucleotide
tggaattatttctcttctggatgaagatgaaccacagcttaag

SEQ ID NO: 104806 - DNA, 42 bp, Artificial Sequence
  Description of Artificial Sequence: Synthetic oligonucleotide
ggaattatttctcttctggatgaagatgaaccacagcttaag

SEQ ID NO: 104807 - DNA, 42 bp, Artificial Sequence
  Description of Artificial Sequence: Synthetic oligonucleotide
gaattatttctcttctggatgaagatgaaccacagcttaagg

SEQ ID NO: 104808 - DNA, 47 bp, Artificial Sequence
  Description of Artificial Sequence: Synthetic oligonucleotide
aattatttctcttctggatgaagatgaaccacagcttaaggaatttg

SEQ ID NO: 104809 - DNA, 46 bp, Artificial Sequence
  Description of Artificial Sequence: Synthetic oligonucleotide
attatttctcttctggatgaagatgaaccacagcttaaggaatttg

SEQ ID NO: 104810 - DNA, 45 bp, Artificial Sequence
  Description of Artificial Sequence: Synthetic oligonucleotide
ttatttctcttctggatgaagatgaaccacagcttaaggaatttg

SEQ ID NO: 104811 - DNA, 44 bp, Artificial Sequence
  Description of Artificial Sequence: Synthetic oligonucleotide
tatttctcttctggatgaagatgaaccacagcttaaggaatttg

SEQ ID NO: 104812 - DNA, 43 bp, Artificial Sequence
  Description of Artificial Sequence: Synthetic oligonucleotide
atttctcttctggatgaagatgaaccacagcttaaggaatttg

SEQ ID NO: 104813 - DNA, 42 bp, Artificial Sequence
  Description of Artificial Sequence: Synthetic oligonucleotide
tttctcttctggatgaagatgaaccacagcttaaggaatttg

SEQ ID NO: 104814 - DNA, 41 bp, Artificial Sequence
  Description of Artificial Sequence: Synthetic oligonucleotide
ttctcttctggatgaagatgaaccacagcttaaggaatttg

SEQ ID NO: 104815 - DNA, 40 bp, Artificial Sequence
  Description of Artificial Sequence: Synthetic oligonucleotide
tctcttctggatgaagatgaaccacagcttaaggaatttg

SEQ ID NO: 104816 - DNA, 39 bp, Artificial Sequence
  Description of Artificial Sequence: Synthetic oligonucleotide
ctcttctggatgaagatgaaccacagcttaaggaatttg

SEQ ID NO: 104817 - DNA, 39 bp, Artificial Sequence
  Description of Artificial Sequence: Synthetic oligonucleotide
tcttctggatgaagatgaaccacagcttaaggaatttgc

SEQ ID NO: 104818 - DNA, 38 bp, Artificial Sequence
  Description of Artificial Sequence: Synthetic oligonucleotide
cttctggatgaagatgaaccacagcttaaggaatttgc

SEQ ID NO: 104819 - DNA, 39 bp, Artificial Sequence
  Description of Artificial Sequence: Synthetic oligonucleotide
ttctggatgaagatgaaccacagcttaaggaatttgcac

SEQ ID NO: 104820 - DNA, 38 bp, Artificial Sequence
  Description of Artificial Sequence: Synthetic oligonucleotide
tctggatgaagatgaaccacagcttaaggaatttgcac

SEQ ID NO: 104821 - DNA, 37 bp, Artificial Sequence
  Description of Artificial Sequence: Synthetic oligonucleotide
ctggatgaagatgaaccacagcttaaggaatttgcac

SEQ ID NO: 104822 - DNA, 39 bp, Artificial Sequence
  Description of Artificial Sequence: Synthetic oligonucleotide
tggatgaagatgaaccacagcttaaggaatttgcactac

SEQ ID NO: 104823 - DNA, 38 bp, Artificial Sequence
  Description of Artificial Sequence: Synthetic oligonucleotide
ggatgaagatgaaccacagcttaaggaatttgcactac

SEQ ID NO: 104824 - DNA, 39 bp, Artificial Sequence
  Description of Artificial Sequence: Synthetic oligonucleotide
gatgaagatgaaccacagcttaaggaatttgcactacac

SEQ ID NO: 104825 - DNA, 44 bp, Artificial Sequence
  Description of Artificial Sequence: Synthetic oligonucleotide
atgaagatgaaccacagcttaaggaatttgcactacacaaattg

SEQ ID NO: 104826 - DNA, 43 bp, Artificial Sequence
  Description of Artificial Sequence: Synthetic oligonucleotide
tgaagatgaaccacagcttaaggaatttgcactacacaaattg

SEQ ID NO: 104827 - DNA, 42 bp, Artificial Sequence
  Description of Artificial Sequence: Synthetic oligonucleotide
gaagatgaaccacagcttaaggaatttgcactacacaaattg

SEQ ID NO: 104828 - DNA, 45 bp, Artificial Sequence
  Description of Artificial Sequence: Synthetic oligonucleotide
aagatgaaccacagcttaaggaatttgcactacacaaattgaatg

SEQ ID NO: 104829 - DNA, 44 bp, Artificial Sequence
  Description of Artificial Sequence: Synthetic oligonucleotide
agatgaaccacagcttaaggaatttgcactacacaaattgaatg

SEQ ID NO: 104830 - DNA, 43 bp, Artificial Sequence
  Description of Artificial Sequence: Synthetic oligonucleotide
gatgaaccacagcttaaggaatttgcactacacaaattgaatg

SEQ ID NO: 104831 - DNA, 43 bp, Artificial Sequence
  Description of Artificial Sequence: Synthetic oligonucleotide
atgaaccacagcttaaggaatttgcactacacaaattgaatgc

SEQ ID NO: 104832 - DNA, 42 bp, Artificial Sequence
  Description of Artificial Sequence: Synthetic oligonucleotide
tgaaccacagcttaaggaatttgcactacacaaattgaatgc

SEQ ID NO: 104833 - DNA, 41 bp, Artificial Sequence
  Description of Artificial Sequence: Synthetic oligonucleotide
gaaccacagcttaaggaatttgcactacacaaattgaatgc

SEQ ID NO: 104834 - DNA, 42 bp, Artificial Sequence
  Description of Artificial Sequence: Synthetic oligonucleotide
aaccacagcttaaggaatttgcactacacaaattgaatgcag

SEQ ID NO: 104835 - DNA, 41 bp, Artificial Sequence
  Description of Artificial Sequence: Synthetic oligonucleotide
accacagcttaaggaatttgcactacacaaattgaatgcag

SEQ ID NO: 104836 - DNA, 40 bp, Artificial Sequence
  Description of Artificial Sequence: Synthetic oligonucleotide
ccacagcttaaggaatttgcactacacaaattgaatgcag

SEQ ID NO: 104837 - DNA, 42 bp, Artificial Sequence
  Description of Artificial Sequence: Synthetic oligonucleotide
cacagcttaaggaatttgcactacacaaattgaatgcagttg

SEQ ID NO: 104838 - DNA, 47 bp, Artificial Sequence
  Description of Artificial Sequence: Synthetic oligonucleotide
acagcttaaggaatttgcactacacaaattgaatgcagttgttaatg

SEQ ID NO: 104839 - DNA, 46 bp, Artificial Sequence
  Description of Artificial Sequence: Synthetic oligonucleotide
cagcttaaggaatttgcactacacaaattgaatgcagttgttaatg

SEQ ID NO: 104840 - DNA, 47 bp, Artificial Sequence
  Description of Artificial Sequence: Synthetic oligonucleotide
agcttaaggaatttgcactacacaaattgaatgcagttgttaatgac

SEQ ID NO: 104841 - DNA, 46 bp, Artificial Sequence
  Description of Artificial Sequence: Synthetic oligonucleotide
gcttaaggaatttgcactacacaaattgaatgcagttgttaatgac

SEQ ID NO: 104842 - DNA, 48 bp, Artificial Sequence
  Description of Artificial Sequence: Synthetic oligonucleotide
cttaaggaatttgcactacacaaattgaatgcagttgttaatgacttc

SEQ ID NO: 104843 - DNA, 49 bp, Artificial Sequence
  Description of Artificial Sequence: Synthetic oligonucleotide
ttaaggaatttgcactacacaaattgaatgcagttgttaatgacttctg

SEQ ID NO: 104844 - DNA, 48 bp, Artificial Sequence
  Description of Artificial Sequence: Synthetic oligonucleotide
taaggaatttgcactacacaaattgaatgcagttgttaatgacttctg

SEQ ID NO: 104845 - DNA, 47 bp, Artificial Sequence
  Description of Artificial Sequence: Synthetic oligonucleotide
aaggaatttgcactacacaaattgaatgcagttgttaatgacttctg

SEQ ID NO: 104846 - DNA, 46 bp, Artificial Sequence
  Description of Artificial Sequence: Synthetic oligonucleotide
aggaatttgcactacacaaattgaatgcagttgttaatgacttctg

SEQ ID NO: 104847 - DNA, 45 bp, Artificial Sequence
  Description of Artificial Sequence: Synthetic oligonucleotide
ggaatttgcactacacaaattgaatgcagttgttaatgacttctg

SEQ ID NO: 104848 - DNA, 45 bp, Artificial Sequence
  Description of Artificial Sequence: Synthetic oligonucleotide
gaatttgcactacacaaattgaatgcagttgttaatgacttctgg

SEQ ID NO: 104849 - DNA, 45 bp, Artificial Sequence
  Description of Artificial Sequence: Synthetic oligonucleotide
aatttgcactacacaaattgaatgcagttgttaatgacttctggg

SEQ ID NO: 104850 - DNA, 44 bp, Artificial Sequence
  Description of Artificial Sequence: Synthetic oligonucleotide
atttgcactacacaaattgaatgcagttgttaatgacttctggg

SEQ ID NO: 104851 - DNA, 43 bp, Artificial Sequence
  Description of Artificial Sequence: Synthetic oligonucleotide
tttgcactacacaaattgaatgcagttgttaatgacttctggg

SEQ ID NO: 104852 - DNA, 42 bp, Artificial Sequence
  Description of Artificial Sequence: Synthetic oligonucleotide
ttgcactacacaaattgaatgcagttgttaatgacttctggg

SEQ ID NO: 104853 - DNA, 41 bp, Artificial Sequence
  Description of Artificial Sequence: Synthetic oligonucleotide
tgcactacacaaattgaatgcagttgttaatgacttctggg

SEQ ID NO: 104854 - DNA, 40 bp, Artificial Sequence
  Description of Artificial Sequence: Synthetic oligonucleotide
gcactacacaaattgaatgcagttgttaatgacttctggg

SEQ ID NO: 104855 - DNA, 40 bp, Artificial Sequence
  Description of Artificial Sequence: Synthetic oligonucleotide
cactacacaaattgaatgcagttgttaatgacttctgggc

SEQ ID NO: 104856 - DNA, 41 bp, Artificial Sequence
  Description of Artificial Sequence: Synthetic oligonucleotide
actacacaaattgaatgcagttgttaatgacttctgggcag

SEQ ID NO: 104857 - DNA, 40 bp, Artificial Sequence
  Description of Artificial Sequence: Synthetic oligonucleotide
ctacacaaattgaatgcagttgttaatgacttctgggcag

SEQ ID NO: 104858 - DNA, 46 bp, Artificial Sequence
  Description of Artificial Sequence: Synthetic oligonucleotide
tacacaaattgaatgcagttgttaatgacttctgggcagaaatttc

SEQ ID NO: 104859 - DNA, 45 bp, Artificial Sequence
  Description of Artificial Sequence: Synthetic oligonucleotide
acacaaattgaatgcagttgttaatgacttctgggcagaaatttc

SEQ ID NO: 104860 - DNA, 44 bp, Artificial Sequence
  Description of Artificial Sequence: Synthetic oligonucleotide
cacaaattgaatgcagttgttaatgacttctgggcagaaatttc

SEQ ID NO: 104861 - DNA, 44 bp, Artificial Sequence
  Description of Artificial Sequence: Synthetic oligonucleotide
acaaattgaatgcagttgttaatgacttctgggcagaaatttcc

SEQ ID NO: 104862 - DNA, 43 bp, Artificial Sequence
  Description of Artificial Sequence: Synthetic oligonucleotide
caaattgaatgcagttgttaatgacttctgggcagaaatttcc

SEQ ID NO: 104863 - DNA, 43 bp, Artificial Sequence
  Description of Artificial Sequence: Synthetic oligonucleotide
aaattgaatgcagttgttaatgacttctgggcagaaatttccg

SEQ ID NO: 104864 - DNA, 42 bp, Artificial Sequence
  Description of Artificial Sequence: Synthetic oligonucleotide
aattgaatgcagttgttaatgacttctgggcagaaatttccg

SEQ ID NO: 104865 - DNA, 41 bp, Artificial Sequence
  Description of Artificial Sequence: Synthetic oligonucleotide
attgaatgcagttgttaatgacttctgggcagaaatttccg

SEQ ID NO: 104866 - DNA, 40 bp, Artificial Sequence
  Description of Artificial Sequence: Synthetic oligonucleotide
ttgaatgcagttgttaatgacttctgggcagaaatttccg

SEQ ID NO: 104867 - DNA, 39 bp, Artificial Sequence
  Description of Artificial Sequence: Synthetic oligonucleotide
tgaatgcagttgttaatgacttctgggcagaaatttccg

SEQ ID NO: 104868 - DNA, 38 bp, Artificial Sequence
  Description of Artificial Sequence: Synthetic oligonucleotide
gaatgcagttgttaatgacttctgggcagaaatttccg

SEQ ID NO: 104869 - DNA, 39 bp, Artificial Sequence
  Description of Artificial Sequence: Synthetic oligonucleotide
aatgcagttgttaatgacttctgggcagaaatttccgag

SEQ ID NO: 104870 - DNA, 38 bp, Artificial Sequence
  Description of Artificial Sequence: Synthetic oligonucleotide
atgcagttgttaatgacttctgggcagaaatttccgag

SEQ ID NO: 104871 - DNA, 37 bp, Artificial Sequence
  Description of Artificial Sequence: Synthetic oligonucleotide
tgcagttgttaatgacttctgggcagaaatttccgag

SEQ ID NO: 104872 - DNA, 36 bp, Artificial Sequence
  Description of Artificial Sequence: Synthetic oligonucleotide
gcagttgttaatgacttctgggcagaaatttccgag

SEQ ID NO: 104873 - DNA, 37 bp, Artificial Sequence
  Description of Artificial Sequence: Synthetic oligonucleotide
cagttgttaatgacttctgggcagaaatttccgagtc

SEQ ID NO: 104874 - DNA, 37 bp, Artificial Sequence
  Description of Artificial Sequence: Synthetic oligonucleotide
agttgttaatgacttctgggcagaaatttccgagtcc

SEQ ID NO: 104875 - DNA, 36 bp, Artificial Sequence
  Description of Artificial Sequence: Synthetic oligonucleotide
gttgttaatgacttctgggcagaaatttccgagtcc

SEQ ID NO: 104876 - DNA, 36 bp, Artificial Sequence
  Description of Artificial Sequence: Synthetic oligonucleotide
ttgttaatgacttctgggcagaaatttccgagtccg

SEQ ID NO: 104877 - DNA, 35 bp, Artificial Sequence
  Description of Artificial Sequence: Synthetic oligonucleotide
tgttaatgacttctgggcagaaatttccgagtccg

SEQ ID NO: 104878 - DNA, 34 bp, Artificial Sequence
  Description of Artificial Sequence: Synthetic oligonucleotide
gttaatgacttctgggcagaaatttccgagtccg

SEQ ID NO: 104879 - DNA, 36 bp, Artificial Sequence
  Description of Artificial Sequence: Synthetic oligonucleotide
ttaatgacttctgggcagaaatttccgagtccgtag

SEQ ID NO: 104880 - DNA, 35 bp, Artificial Sequence
  Description of Artificial Sequence: Synthetic oligonucleotide
taatgacttctgggcagaaatttccgagtccgtag

SEQ ID NO: 104881 - DNA, 34 bp, Artificial Sequence
  Description of Artificial Sequence: Synthetic oligonucleotide
aatgacttctgggcagaaatttccgagtccgtag

SEQ ID NO: 104882 - DNA, 33 bp, Artificial Sequence
  Description of Artificial Sequence: Synthetic oligonucleotide
atgacttctgggcagaaatttccgagtccgtag

SEQ ID NO: 104883 - DNA, 32 bp, Artificial Sequence
  Description of Artificial Sequence: Synthetic oligonucleotide
tgacttctgggcagaaatttccgagtccgtag

SEQ ID NO: 104884 - DNA, 31 bp, Artificial Sequence
  Description of Artificial Sequence: Synthetic oligonucleotide
gacttctgggcagaaatttccgagtccgtag

SEQ ID NO: 104885 - DNA, 32 bp, Artificial Sequence
  Description of Artificial Sequence: Synthetic oligonucleotide
acttctgggcagaaatttccgagtccgtagac

SEQ ID NO: 104886 - DNA, 31 bp, Artificial Sequence
  Description of Artificial Sequence: Synthetic oligonucleotide
cttctgggcagaaatttccgagtccgtagac

SEQ ID NO: 104887 - DNA, 37 bp, Artificial Sequence
  Description of Artificial Sequence: Synthetic oligonucleotide
ttctgggcagaaatttccgagtccgtagacaaaatag

SEQ ID NO: 104888 - DNA, 36 bp, Artificial Sequence
  Description of Artificial Sequence: Synthetic oligonucleotide
tctgggcagaaatttccgagtccgtagacaaaatag

SEQ ID NO: 104889 - DNA, 35 bp, Artificial Sequence
  Description of Artificial Sequence: Synthetic oligonucleotide
ctgggcagaaatttccgagtccgtagacaaaatag

SEQ ID NO: 104890 - DNA, 36 bp, Artificial Sequence
  Description of Artificial Sequence: Synthetic oligonucleotide
tgggcagaaatttccgagtccgtagacaaaatagag

SEQ ID NO: 104891 - DNA, 35 bp, Artificial Sequence
  Description of Artificial Sequence: Synthetic oligonucleotide
gggcagaaatttccgagtccgtagacaaaatagag

SEQ ID NO: 104892 - DNA, 35 bp, Artificial Sequence
  Description of Artificial Sequence: Synthetic oligonucleotide
ggcagaaatttccgagtccgtagacaaaatagagg

SEQ ID NO: 104893 - DNA, 42 bp, Artificial Sequence
  Description of Artificial Sequence: Synthetic oligonucleotide
gcagaaatttccgagtccgtagacaaaatagaggttttatac

SEQ ID NO: 104894 - DNA, 42 bp, Artificial Sequence
  Description of Artificial Sequence: Synthetic oligonucleotide
cagaaatttccgagtccgtagacaaaatagaggttttatacg

SEQ ID NO: 104895 - DNA, 44 bp, Artificial Sequence
  Description of Artificial Sequence: Synthetic oligonucleotide
agaaatttccgagtccgtagacaaaatagaggttttatacgaag

SEQ ID NO: 104896 - DNA, 43 bp, Artificial Sequence
  Description of Artificial Sequence: Synthetic oligonucleotide
gaaatttccgagtccgtagacaaaatagaggttttatacgaag

SEQ ID NO: 104897 - DNA, 45 bp, Artificial Sequence
  Description of Artificial Sequence: Synthetic oligonucleotide
aaatttccgagtccgtagacaaaatagaggttttatacgaagatg

SEQ ID NO: 104898 - DNA, 44 bp, Artificial Sequence
  Description of Artificial Sequence: Synthetic oligonucleotide
aatttccgagtccgtagacaaaatagaggttttatacgaagatg

SEQ ID NO: 104899 - DNA, 43 bp, Artificial Sequence
  Description of Artificial Sequence: Synthetic oligonucleotide
atttccgagtccgtagacaaaatagaggttttatacgaagatg

SEQ ID NO: 104900 - DNA, 42 bp, Artificial Sequence
  Description of Artificial Sequence: Synthetic oligonucleotide
tttccgagtccgtagacaaaatagaggttttatacgaagatg

SEQ ID NO: 104901 - DNA, 41 bp, Artificial Sequence
  Description of Artificial Sequence: Synthetic oligonucleotide
ttccgagtccgtagacaaaatagaggttttatacgaagatg

SEQ ID NO: 104902 - DNA, 40 bp, Artificial Sequence
  Description of Artificial Sequence: Synthetic oligonucleotide
tccgagtccgtagacaaaatagaggttttatacgaagatg

SEQ ID NO: 104903 - DNA, 39 bp, Artificial Sequence
  Description of Artificial Sequence: Synthetic oligonucleotide
ccgagtccgtagacaaaatagaggttttatacgaagatg

SEQ ID NO: 104904 - DNA, 41 bp, Artificial Sequence
  Description of Artificial Sequence: Synthetic oligonucleotide
cgagtccgtagacaaaatagaggttttatacgaagatgaag

SEQ ID NO: 104905 - DNA, 41 bp, Artificial Sequence
  Description of Artificial Sequence: Synthetic oligonucleotide
gagtccgtagacaaaatagaggttttatacgaagatgaagg

SEQ ID NO: 104906 - DNA, 44 bp, Artificial Sequence
  Description of Artificial Sequence: Synthetic oligonucleotide
agtccgtagacaaaatagaggttttatacgaagatgaaggtttc

SEQ ID NO: 104907 - DNA, 43 bp, Artificial Sequence
  Description of Artificial Sequence: Synthetic oligonucleotide
gtccgtagacaaaatagaggttttatacgaagatgaaggtttc

SEQ ID NO: 104908 - DNA, 43 bp, Artificial Sequence
  Description of Artificial Sequence: Synthetic oligonucleotide
tccgtagacaaaatagaggttttatacgaagatgaaggtttcc

SEQ ID NO: 104909 - DNA, 42 bp, Artificial Sequence
  Description of Artificial Sequence: Synthetic oligonucleotide
ccgtagacaaaatagaggttttatacgaagatgaaggtttcc

SEQ ID NO: 104910 - DNA, 42 bp, Artificial Sequence
  Description of Artificial Sequence: Synthetic oligonucleotide
cgtagacaaaatagaggttttatacgaagatgaaggtttccg

SEQ ID NO: 104911 - DNA, 42 bp, Artificial Sequence
  Description of Artificial Sequence: Synthetic oligonucleotide
gtagacaaaatagaggttttatacgaagatgaaggtttccgg

SEQ ID NO: 104912 - DNA, 43 bp, Artificial Sequence
  Description of Artificial Sequence: Synthetic oligonucleotide
tagacaaaatagaggttttatacgaagatgaaggtttccggag

SEQ ID NO: 104913 - DNA, 42 bp, Artificial Sequence
  Description of Artificial Sequence: Synthetic oligonucleotide
agacaaaatagaggttttatacgaagatgaaggtttccggag

SEQ ID NO: 104914 - DNA, 41 bp, Artificial Sequence
  Description of Artificial Sequence: Synthetic oligonucleotide
gacaaaatagaggttttatacgaagatgaaggtttccggag

SEQ ID NO: 104915 - DNA, 42 bp, Artificial Sequence
  Description of Artificial Sequence: Synthetic oligonucleotide
acaaaatagaggttttatacgaagatgaaggtttccggagtc

SEQ ID NO: 104916 - DNA, 41 bp, Artificial Sequence
  Description of Artificial Sequence: Synthetic oligonucleotide
caaaatagaggttttatacgaagatgaaggtttccggagtc

SEQ ID NO: 104917 - DNA, 41 bp, Artificial Sequence
  Description of Artificial Sequence: Synthetic oligonucleotide
aaaatagaggttttatacgaagatgaaggtttccggagtcg

SEQ ID NO: 104918 - DNA, 40 bp, Artificial Sequence
  Description of Artificial Sequence: Synthetic oligonucleotide
aaatagaggttttatacgaagatgaaggtttccggagtcg

SEQ ID NO: 104919 - DNA, 39 bp, Artificial Sequence
  Description of Artificial Sequence: Synthetic oligonucleotide
aatagaggttttatacgaagatgaaggtttccggagtcg

SEQ ID NO: 104920 - DNA, 38 bp, Artificial Sequence
  Description of Artificial Sequence: Synthetic oligonucleotide
atagaggttttatacgaagatgaaggtttccggagtcg

SEQ ID NO: 104921 - DNA, 37 bp, Artificial Sequence
  Description of Artificial Sequence: Synthetic oligonucleotide
tagaggttttatacgaagatgaaggtttccggagtcg

SEQ ID NO: 104922 - DNA, 36 bp, Artificial Sequence
  Description of Artificial Sequence: Synthetic oligonucleotide
agaggttttatacgaagatgaaggtttccggagtcg

SEQ ID NO: 104923 - DNA, 35 bp, Artificial Sequence
  Description of Artificial Sequence: Synthetic oligonucleotide
gaggttttatacgaagatgaaggtttccggagtcg

SEQ ID NO: 104924 - DNA, 35 bp, Artificial Sequence
  Description of Artificial Sequence: Synthetic oligonucleotide
aggttttatacgaagatgaaggtttccggagtcgg

SEQ ID NO: 104925 - DNA, 34 bp, Artificial Sequence
  Description of Artificial Sequence: Synthetic oligonucleotide
ggttttatacgaagatgaaggtttccggagtcgg

SEQ ID NO: 104926 - DNA, 34 bp, Artificial Sequence
  Description of Artificial Sequence: Synthetic oligonucleotide
gttttatacgaagatgaaggtttccggagtcggc

SEQ ID NO: 104927 - DNA, 35 bp, Artificial Sequence
  Description of Artificial Sequence: Synthetic oligonucleotide
ttttatacgaagatgaaggtttccggagtcggcag

SEQ ID NO: 104928 - DNA, 34 bp, Artificial Sequence
  Description of Artificial Sequence: Synthetic oligonucleotide
tttatacgaagatgaaggtttccggagtcggcag

SEQ ID NO: 104929 - DNA, 33 bp, Artificial Sequence
  Description of Artificial Sequence: Synthetic oligonucleotide
ttatacgaagatgaaggtttccggagtcggcag

SEQ ID NO: 104930 - DNA, 32 bp, Artificial Sequence
  Description of Artificial Sequence: Synthetic oligonucleotide
tatacgaagatgaaggtttccggagtcggcag

SEQ ID NO: 104931 - DNA, 31 bp, Artificial Sequence
  Description of Artificial Sequence: Synthetic oligonucleotide
atacgaagatgaaggtttccggagtcggcag

SEQ ID NO: 104932 - DNA, 30 bp, Artificial Sequence
  Description of Artificial Sequence: Synthetic oligonucleotide
tacgaagatgaaggtttccggagtcggcag

SEQ ID NO: 104933 - DNA, 29 bp, Artificial Sequence
  Description of Artificial Sequence: Synthetic oligonucleotide
acgaagatgaaggtttccggagtcggcag

SEQ ID NO: 104934 - DNA, 28 bp, Artificial Sequence
  Description of Artificial Sequence: Synthetic oligonucleotide
cgaagatgaaggtttccggagtcggcag

SEQ ID NO: 104935 - DNA, 31 bp, Artificial Sequence
  Description of Artificial Sequence: Synthetic oligonucleotide
gaagatgaaggtttccggagtcggcagtttg

SEQ ID NO: 104936 - DNA, 31 bp, Artificial Sequence
  Description of Artificial Sequence: Synthetic oligonucleotide
aagatgaaggtttccggagtcggcagtttgc

SEQ ID NO: 104937 - DNA, 30 bp, Artificial Sequence
  Description of Artificial Sequence: Synthetic oligonucleotide
agatgaaggtttccggagtcggcagtttgc

SEQ ID NO: 104938 - DNA, 29 bp, Artificial Sequence
  Description of Artificial Sequence: Synthetic oligonucleotide
gatgaaggtttccggagtcggcagtttgc

SEQ ID NO: 104939 - DNA, 30 bp, Artificial Sequence
  Description of Artificial Sequence: Synthetic oligonucleotide
atgaaggtttccggagtcggcagtttgcag

SEQ ID NO: 104940 - DNA, 29 bp, Artificial Sequence
  Description of Artificial Sequence: Synthetic oligonucleotide
tgaaggtttccggagtcggcagtttgcag

SEQ ID NO: 104941 - DNA, 28 bp, Artificial Sequence
  Description of Artificial Sequence: Synthetic oligonucleotide
gaaggtttccggagtcggcagtttgcag

SEQ ID NO: 104942 - DNA, 28 bp, Artificial Sequence
  Description of Artificial Sequence: Synthetic oligonucleotide
aaggtttccggagtcggcagtttgcagc

SEQ ID NO: 104943 - DNA, 27 bp, Artificial Sequence
  Description of Artificial Sequence: Synthetic oligonucleotide
aggtttccggagtcggcagtttgcagc

SEQ ID NO: 104944 - DNA, 26 bp, Artificial Sequence
  Description of Artificial Sequence: Synthetic oligonucleotide
ggtttccggagtcggcagtttgcagc

SEQ ID NO: 104945 - DNA, 27 bp, Artificial Sequence
  Description of Artificial Sequence: Synthetic oligonucleotide
gtttccggagtcggcagtttgcagcct

SEQ ID NO: 104946 - DNA, 29 bp, Artificial Sequence
  Description of Artificial Sequence: Synthetic oligonucleotide
tttccggagtcggcagtttgcagccttag

SEQ ID NO: 104947 - DNA, 28 bp, Artificial Sequence
  Description of Artificial Sequence: Synthetic oligonucleotide
ttccggagtcggcagtttgcagccttag

SEQ ID NO: 104948 - DNA, 27 bp, Artificial Sequence
  Description of Artificial Sequence: Synthetic oligonucleotide
tccggagtcggcagtttgcagccttag

SEQ ID NO: 104949 - DNA, 27 bp, Artificial Sequence
  Description of Artificial Sequence: Synthetic oligonucleotide
ccggagtcggcagtttgcagccttagt

SEQ ID NO: 104950 - DNA, 27 bp, Artificial Sequence
  Description of Artificial Sequence: Synthetic oligonucleotide
cggagtcggcagtttgcagccttagtg

SEQ ID NO: 104951 - DNA, 27 bp, Artificial Sequence
  Description of Artificial Sequence: Synthetic oligonucleotide
ggagtcggcagtttgcagccttagtgg

SEQ ID NO: 104952 - DNA, 27 bp, Artificial Sequence
  Description of Artificial Sequence: Synthetic oligonucleotide
gagtcggcagtttgcagccttagtggc

SEQ ID NO: 104953 - DNA, 29 bp, Artificial Sequence
  Description of Artificial Sequence: Synthetic oligonucleotide
agtcggcagtttgcagccttagtggcatc

SEQ ID NO: 104954 - DNA, 28 bp, Artificial Sequence
  Description of Artificial Sequence: Synthetic oligonucleotide
gtcggcagtttgcagccttagtggcatc

SEQ ID NO: 104955 - DNA, 32 bp, Artificial Sequence
  Description of Artificial Sequence: Synthetic oligonucleotide
tcggcagtttgcagccttagtggcatctaaag

SEQ ID NO: 104956 - DNA, 31 bp, Artificial Sequence
  Description of Artificial Sequence: Synthetic oligonucleotide
cggcagtttgcagccttagtggcatctaaag

SEQ ID NO: 104957 - DNA, 39 bp, Artificial Sequence
  Description of Artificial Sequence: Synthetic oligonucleotide
ggcagtttgcagccttagtggcatctaaagtattttatc

SEQ ID NO: 104958 - DNA, 40 bp, Artificial Sequence
  Description of Artificial Sequence: Synthetic oligonucleotide
gcagtttgcagccttagtggcatctaaagtattttatcac

SEQ ID NO: 104959 - DNA, 40 bp, Artificial Sequence
  Description of Artificial Sequence: Synthetic oligonucleotide
cagtttgcagccttagtggcatctaaagtattttatcacc

SEQ ID NO: 104960 - DNA, 41 bp, Artificial Sequence
  Description of Artificial Sequence: Synthetic oligonucleotide
agtttgcagccttagtggcatctaaagtattttatcacctg

SEQ ID NO: 104961 - DNA, 40 bp, Artificial Sequence
  Description of Artificial Sequence: Synthetic oligonucleotide
gtttgcagccttagtggcatctaaagtattttatcacctg

SEQ ID NO: 104962 - DNA, 40 bp, Artificial Sequence
  Description of Artificial Sequence: Synthetic oligonucleotide
tttgcagccttagtggcatctaaagtattttatcacctgg

SEQ ID NO: 104963 - DNA, 39 bp, Artificial Sequence
  Description of Artificial Sequence: Synthetic oligonucleotide
ttgcagccttagtggcatctaaagtattttatcacctgg

SEQ ID NO: 104964 - DNA, 38 bp, Artificial Sequence
  Description of Artificial Sequence: Synthetic oligonucleotide
tgcagccttagtggcatctaaagtattttatcacctgg

SEQ ID NO: 104965 - DNA, 37 bp, Artificial Sequence
  Description of Artificial Sequence: Synthetic oligonucleotide
gcagccttagtggcatctaaagtattttatcacctgg

SEQ ID NO: 104966 - DNA, 37 bp, Artificial Sequence
  Description of Artificial Sequence: Synthetic oligonucleotide
cagccttagtggcatctaaagtattttatcacctggg

SEQ ID NO: 104967 - DNA, 37 bp, Artificial Sequence
  Description of Artificial Sequence: Synthetic oligonucleotide
agccttagtggcatctaaagtattttatcacctgggg

SEQ ID NO: 104968 - DNA, 36 bp, Artificial Sequence
  Description of Artificial Sequence: Synthetic oligonucleotide
gccttagtggcatctaaagtattttatcacctgggg

SEQ ID NO: 104969 - DNA, 36 bp, Artificial Sequence
  Description of Artificial Sequence: Synthetic oligonucleotide
ccttagtggcatctaaagtattttatcacctggggg

SEQ ID NO: 104970 - DNA, 36 bp, Artificial Sequence
  Description of Artificial Sequence: Synthetic oligonucleotide
cttagtggcatctaaagtattttatcacctgggggc

SEQ ID NO: 104971 - DNA, 40 bp, Artificial Sequence
  Description of Artificial Sequence: Synthetic oligonucleotide
ttagtggcatctaaagtattttatcacctgggggcttttg

SEQ ID NO: 104972 - DNA, 39 bp, Artificial Sequence
  Description of Artificial Sequence: Synthetic oligonucleotide
tagtggcatctaaagtattttatcacctgggggcttttg

SEQ ID NO: 104973 - DNA, 38 bp, Artificial Sequence
  Description of Artificial Sequence: Synthetic oligonucleotide
agtggcatctaaagtattttatcacctgggggcttttg

SEQ ID NO: 104974 - DNA, 37 bp, Artificial Sequence
  Description of Artificial Sequence: Synthetic oligonucleotide
gtggcatctaaagtattttatcacctgggggcttttg

SEQ ID NO: 104975 - DNA, 38 bp, Artificial Sequence
  Description of Artificial Sequence: Synthetic oligonucleotide
tggcatctaaagtattttatcacctgggggcttttgag

SEQ ID NO: 104976 - DNA, 37 bp, Artificial Sequence
  Description of Artificial Sequence: Synthetic oligonucleotide
ggcatctaaagtattttatcacctgggggcttttgag

SEQ ID NO: 104977 - DNA, 37 bp, Artificial Sequence
  Description of Artificial Sequence: Synthetic oligonucleotide
gcatctaaagtattttatcacctgggggcttttgagg

SEQ ID NO: 104978 - DNA, 38 bp, Artificial Sequence
  Description of Artificial Sequence: Synthetic oligonucleotide
catctaaagtattttatcacctgggggcttttgaggag

SEQ ID NO: 104979 - DNA, 39 bp, Artificial Sequence
  Description of Artificial Sequence: Synthetic oligonucleotide
atctaaagtattttatcacctgggggcttttgaggagtc

SEQ ID NO: 104980 - DNA, 38 bp, Artificial Sequence
  Description of Artificial Sequence: Synthetic oligonucleotide
tctaaagtattttatcacctgggggcttttgaggagtc

SEQ ID NO: 104981 - DNA, 37 bp, Artificial Sequence
  Description of Artificial Sequence: Synthetic oligonucleotide
ctaaagtattttatcacctgggggcttttgaggagtc

SEQ ID NO: 104982 - DNA, 38 bp, Artificial Sequence
  Description of Artificial Sequence: Synthetic oligonucleotide
taaagtattttatcacctgggggcttttgaggagtctc

SEQ ID NO: 104983 - DNA, 37 bp, Artificial Sequence
  Description of Artificial Sequence: Synthetic oligonucleotide
aaagtattttatcacctgggggcttttgaggagtctc

SEQ ID NO: 104984 - DNA, 36 bp, Artificial Sequence
  Description of Artificial Sequence: Synthetic oligonucleotide
aagtattttatcacctgggggcttttgaggagtctc

SEQ ID NO: 104985 - DNA, 35 bp, Artificial Sequence
  Description of Artificial Sequence: Synthetic oligonucleotide
agtattttatcacctgggggcttttgaggagtctc

SEQ ID NO: 104986 - DNA, 34 bp, Artificial Sequence
  Description of Artificial Sequence: Synthetic oligonucleotide
gtattttatcacctgggggcttttgaggagtctc

SEQ ID NO: 104987 - DNA, 35 bp, Artificial Sequence
  Description of Artificial Sequence: Synthetic oligonucleotide
tattttatcacctgggggcttttgaggagtctctg

SEQ ID NO: 104988 - DNA, 34 bp, Artificial Sequence
  Description of Artificial Sequence: Synthetic oligonucleotide
attttatcacctgggggcttttgaggagtctctg

SEQ ID NO: 104989 - DNA, 33 bp, Artificial Sequence
  Description of Artificial Sequence: Synthetic oligonucleotide
ttttatcacctgggggcttttgaggagtctctg

SEQ ID NO: 104990 - DNA, 32 bp, Artificial Sequence
  Description of Artificial Sequence: Synthetic oligonucleotide
tttatcacctgggggcttttgaggagtctctg

SEQ ID NO: 104991 - DNA, 31 bp, Artificial Sequence
  Description of Artificial Sequence: Synthetic oligonucleotide
ttatcacctgggggcttttgaggagtctctg

SEQ ID NO: 104992 - DNA, 30 bp, Artificial Sequence
  Description of Artificial Sequence: Synthetic oligonucleotide
tatcacctgggggcttttgaggagtctctg

SEQ ID NO: 104993 - DNA, 29 bp, Artificial Sequence
  Description of Artificial Sequence: Synthetic oligonucleotide
atcacctgggggcttttgaggagtctctg

SEQ ID NO: 104994 - DNA, 28 bp, Artificial Sequence
  Description of Artificial Sequence: Synthetic oligonucleotide
tcacctgggggcttttgaggagtctctg

SEQ ID NO: 104995 - DNA, 27 bp, Artificial Sequence
  Description of Artificial Sequence: Synthetic oligonucleotide
cacctgggggcttttgaggagtctctg

SEQ ID NO: 104996 - DNA, 33 bp, Artificial Sequence
  Description of Artificial Sequence: Synthetic oligonucleotide
acctgggggcttttgaggagtctctgaattatg

SEQ ID NO: 104997 - DNA, 32 bp, Artificial Sequence
  Description of Artificial Sequence: Synthetic oligonucleotide
cctgggggcttttgaggagtctctgaattatg

SEQ ID NO: 104998 - DNA, 32 bp, Artificial Sequence
  Description of Artificial Sequence: Synthetic oligonucleotide
ctgggggcttttgaggagtctctgaattatgc

SEQ ID NO: 104999 - DNA, 33 bp, Artificial Sequence
  Description of Artificial Sequence: Synthetic oligonucleotide
tgggggcttttgaggagtctctgaattatgctc

SEQ ID NO: 105000 - DNA, 32 bp, Artificial Sequence
  Description of Artificial Sequence: Synthetic oligonucleotide
gggggcttttgaggagtctctgaattatgctc

SEQ ID NO: 105001 - DNA, 34 bp, Artificial Sequence
  Description of Artificial Sequence: Synthetic oligonucleotide
ggggcttttgaggagtctctgaattatgctcttg

SEQ ID NO: 105002 - DNA, 34 bp, Artificial Sequence
  Description of Artificial Sequence: Synthetic oligonucleotide
gggcttttgaggagtctctgaattatgctcttgg

SEQ ID NO: 105003 - DNA, 35 bp, Artificial Sequence
  Description of Artificial Sequence: Synthetic oligonucleotide
ggcttttgaggagtctctgaattatgctcttggag

SEQ ID NO: 105004 - DNA, 35 bp, Artificial Sequence
  Description of Artificial Sequence: Synthetic oligonucleotide
gcttttgaggagtctctgaattatgctcttggagc

SEQ ID NO: 105005 - DNA, 36 bp, Artificial Sequence
  Description of Artificial Sequence: Synthetic oligonucleotide
cttttgaggagtctctgaattatgctcttggagcag

SEQ ID NO: 105006 - DNA, 36 bp, Artificial Sequence
  Description of Artificial Sequence: Synthetic oligonucleotide
ttttgaggagtctctgaattatgctcttggagcagg

SEQ ID NO: 105007 - DNA, 35 bp, Artificial Sequence
  Description of Artificial Sequence: Synthetic oligonucleotide
tttgaggagtctctgaattatgctcttggagcagg

SEQ ID NO: 105008 - DNA, 34 bp, Artificial Sequence
  Description of Artificial Sequence: Synthetic oligonucleotide
ttgaggagtctctgaattatgctcttggagcagg

SEQ ID NO: 105009 - DNA, 33 bp, Artificial Sequence
  Description of Artificial Sequence: Synthetic oligonucleotide
tgaggagtctctgaattatgctcttggagcagg

SEQ ID NO: 105010 - DNA, 32 bp, Artificial Sequence
  Description of Artificial Sequence: Synthetic oligonucleotide
gaggagtctctgaattatgctcttggagcagg

SEQ ID NO: 105011 - DNA, 32 bp, Artificial Sequence
  Description of Artificial Sequence: Synthetic oligonucleotide
aggagtctctgaattatgctcttggagcaggg

SEQ ID NO: 105012 - DNA, 31 bp, Artificial Sequence
  Description of Artificial Sequence: Synthetic oligonucleotide
ggagtctctgaattatgctcttggagcaggg

SEQ ID NO: 105013 - DNA, 31 bp, Artificial Sequence
  Description of Artificial Sequence: Synthetic oligonucleotide
gagtctctgaattatgctcttggagcagggg

SEQ ID NO: 105014 - DNA, 32 bp, Artificial Sequence
  Description of Artificial Sequence: Synthetic oligonucleotide
agtctctgaattatgctcttggagcaggggac

SEQ ID NO: 105015 - DNA, 31 bp, Artificial Sequence
  Description of Artificial Sequence: Synthetic oligonucleotide
gtctctgaattatgctcttggagcaggggac

SEQ ID NO: 105016 - DNA, 31 bp, Artificial Sequence
  Description of Artificial Sequence: Synthetic oligonucleotide
tctctgaattatgctcttggagcaggggacc

SEQ ID NO: 105017 - DNA, 30 bp, Artificial Sequence
  Description of Artificial Sequence: Synthetic oligonucleotide
ctctgaattatgctcttggagcaggggacc

SEQ ID NO: 105018 - DNA, 31 bp, Artificial Sequence
  Description of Artificial Sequence: Synthetic oligonucleotide
tctgaattatgctcttggagcaggggacctc

SEQ ID NO: 105019 - DNA, 30 bp, Artificial Sequence
  Description of Artificial Sequence: Synthetic oligonucleotide
ctgaattatgctcttggagcaggggacctc

SEQ ID NO: 105020 - DNA, 32 bp, Artificial Sequence
  Description of Artificial Sequence: Synthetic oligonucleotide
tgaattatgctcttggagcaggggacctcttc

SEQ ID NO: 105021 - DNA, 31 bp, Artificial Sequence
  Description of Artificial Sequence: Synthetic oligonucleotide
gaattatgctcttggagcaggggacctcttc

SEQ ID NO: 105022 - DNA, 34 bp, Artificial Sequence
  Description of Artificial Sequence: Synthetic oligonucleotide
aattatgctcttggagcaggggacctcttcaatg

SEQ ID NO: 105023 - DNA, 33 bp, Artificial Sequence
  Description of Artificial Sequence: Synthetic oligonucleotide
attatgctcttggagcaggggacctcttcaatg

SEQ ID NO: 105024 - DNA, 32 bp, Artificial Sequence
  Description of Artificial Sequence: Synthetic oligonucleotide
ttatgctcttggagcaggggacctcttcaatg

SEQ ID NO: 105025 - DNA, 31 bp, Artificial Sequence
  Description of Artificial Sequence: Synthetic oligonucleotide
tatgctcttggagcaggggacctcttcaatg

SEQ ID NO: 105026 - DNA, 30 bp, Artificial Sequence
  Description of Artificial Sequence: Synthetic oligonucleotide
atgctcttggagcaggggacctcttcaatg

SEQ ID NO: 105027 - DNA, 29 bp, Artificial Sequence
  Description of Artificial Sequence: Synthetic oligonucleotide
tgctcttggagcaggggacctcttcaatg

SEQ ID NO: 105028 - DNA, 28 bp, Artificial Sequence
  Description of Artificial Sequence: Synthetic oligonucleotide
gctcttggagcaggggacctcttcaatg

SEQ ID NO: 105029 - DNA, 29 bp, Artificial Sequence
  Description of Artificial Sequence: Synthetic oligonucleotide
ctcttggagcaggggacctcttcaatgtc

SEQ ID NO: 105030 - DNA, 32 bp, Artificial Sequence
  Description of Artificial Sequence: Synthetic oligonucleotide
tcttggagcaggggacctcttcaatgtcaatg

SEQ ID NO: 105031 - DNA, 31 bp, Artificial Sequence
  Description of Artificial Sequence: Synthetic oligonucleotide
cttggagcaggggacctcttcaatgtcaatg

SEQ ID NO: 105032 - DNA, 35 bp, Artificial Sequence
  Description of Artificial Sequence: Synthetic oligonucleotide
ttggagcaggggacctcttcaatgtcaatgataac

SEQ ID NO: 105033 - DNA, 34 bp, Artificial Sequence
  Description of Artificial Sequence: Synthetic oligonucleotide
tggagcaggggacctcttcaatgtcaatgataac

SEQ ID NO: 105034 - DNA, 33 bp, Artificial Sequence
  Description of Artificial Sequence: Synthetic oligonucleotide
ggagcaggggacctcttcaatgtcaatgataac

SEQ ID NO: 105035 - DNA, 34 bp, Artificial Sequence
  Description of Artificial Sequence: Synthetic oligonucleotide
gagcaggggacctcttcaatgtcaatgataactc

SEQ ID NO: 105036 - DNA, 35 bp, Artificial Sequence
  Description of Artificial Sequence: Synthetic oligonucleotide
agcaggggacctcttcaatgtcaatgataactctg

SEQ ID NO: 105037 - DNA, 34 bp, Artificial Sequence
  Description of Artificial Sequence: Synthetic oligonucleotide
gcaggggacctcttcaatgtcaatgataactctg

SEQ ID NO: 105038 - DNA, 39 bp, Artificial Sequence
  Description of Artificial Sequence: Synthetic oligonucleotide
caggggacctcttcaatgtcaatgataactctgaatatg

SEQ ID NO: 105039 - DNA, 40 bp, Artificial Sequence
  Description of Artificial Sequence: Synthetic oligonucleotide
aggggacctcttcaatgtcaatgataactctgaatatgtg

SEQ ID NO: 105040 - DNA, 39 bp, Artificial Sequence
  Description of Artificial Sequence: Synthetic oligonucleotide
ggggacctcttcaatgtcaatgataactctgaatatgtg

SEQ ID NO: 105041 - DNA, 39 bp, Artificial Sequence
  Description of Artificial Sequence: Synthetic oligonucleotide
gggacctcttcaatgtcaatgataactctgaatatgtgg

SEQ ID NO: 105042 - DNA, 42 bp, Artificial Sequence
  Description of Artificial Sequence: Synthetic oligonucleotide
ggacctcttcaatgtcaatgataactctgaatatgtggaaac

SEQ ID NO: 105043 - DNA, 49 bp, Artificial Sequence
  Description of Artificial Sequence: Synthetic oligonucleotide
gacctcttcaatgtcaatgataactctgaatatgtggaaactattatag

SEQ ID NO: 105044 - DNA, 49 bp, Artificial Sequence
  Description of Artificial Sequence: Synthetic oligonucleotide
acctcttcaatgtcaatgataactctgaatatgtggaaactattatagc

SEQ ID NO: 105045 - DNA, 48 bp, Artificial Sequence
  Description of Artificial Sequence: Synthetic oligonucleotide
cctcttcaatgtcaatgataactctgaatatgtggaaactattatagc

SEQ ID NO: 105046 - DNA, 53 bp, Artificial Sequence
  Description of Artificial Sequence: Synthetic oligonucleotide
ctcttcaatgtcaatgataactctgaatatgtggaaactattatagcaaaatg

SEQ ID NO: 105047 - DNA, 53 bp, Artificial Sequence
  Description of Artificial Sequence: Synthetic oligonucleotide
tcttcaatgtcaatgataactctgaatatgtggaaactattatagcaaaatgc

SEQ ID NO: 105048 - DNA, 52 bp, Artificial Sequence
  Description of Artificial Sequence: Synthetic oligonucleotide
cttcaatgtcaatgataactctgaatatgtggaaactattatagcaaaatgc

SEQ ID NO: 105049 - DNA, 55 bp, Artificial Sequence
  Description of Artificial Sequence: Synthetic oligonucleotide
ttcaatgtcaatgataactctgaatatgtggaaactattatagcaaaatgcattg

SEQ ID NO: 105050 - DNA, 54 bp, Artificial Sequence
  Description of Artificial Sequence: Synthetic oligonucleotide
tcaatgtcaatgataactctgaatatgtggaaactattatagcaaaatgcattg

SEQ ID NO: 105051 - DNA, 53 bp, Artificial Sequence
  Description of Artificial Sequence: Synthetic oligonucleotide
caatgtcaatgataactctgaatatgtggaaactattatagcaaaatgcattg

SEQ ID NO: 105052 - DNA, 55 bp, Artificial Sequence
  Description of Artificial Sequence: Synthetic oligonucleotide
aatgtcaatgataactctgaatatgtggaaactattatagcaaaatgcattgatc

SEQ ID NO: 105053 - DNA, 54 bp, Artificial Sequence
  Description of Artificial Sequence: Synthetic oligonucleotide
atgtcaatgataactctgaatatgtggaaactattatagcaaaatgcattgatc

SEQ ID NO: 105054 - DNA, 53 bp, Artificial Sequence
  Description of Artificial Sequence: Synthetic oligonucleotide
tgtcaatgataactctgaatatgtggaaactattatagcaaaatgcattgatc

SEQ ID NO: 105055 - DNA, 52 bp, Artificial Sequence
  Description of Artificial Sequence: Synthetic oligonucleotide
gtcaatgataactctgaatatgtggaaactattatagcaaaatgcattgatc

SEQ ID NO: 105056 - DNA, 53 bp, Artificial Sequence
  Description of Artificial Sequence: Synthetic oligonucleotide
tcaatgataactctgaatatgtggaaactattatagcaaaatgcattgatcac

SEQ ID NO: 105057 - DNA, 52 bp, Artificial Sequence
  Description of Artificial Sequence: Synthetic oligonucleotide
caatgataactctgaatatgtggaaactattatagcaaaatgcattgatcac

SEQ ID NO: 105058 - DNA, 54 bp, Artificial Sequence
  Description of Artificial Sequence: Synthetic oligonucleotide
aatgataactctgaatatgtggaaactattatagcaaaatgcattgatcactac

SEQ ID NO: 105059 - DNA, 53 bp, Artificial Sequence
  Description of Artificial Sequence: Synthetic oligonucleotide
atgataactctgaatatgtggaaactattatagcaaaatgcattgatcactac

SEQ ID NO: 105060 - DNA, 52 bp, Artificial Sequence
  Description of Artificial Sequence: Synthetic oligonucleotide
tgataactctgaatatgtggaaactattatagcaaaatgcattgatcactac

SEQ ID NO: 105061 - DNA, 51 bp, Artificial Sequence
  Description of Artificial Sequence: Synthetic oligonucleotide
gataactctgaatatgtggaaactattatagcaaaatgcattgatcactac

SEQ ID NO: 105062 - DNA, 52 bp, Artificial Sequence
  Description of Artificial Sequence: Synthetic oligonucleotide
ataactctgaatatgtggaaactattatagcaaaatgcattgatcactacac

SEQ ID NO: 105063 - DNA, 51 bp, Artificial Sequence
  Description of Artificial Sequence: Synthetic oligonucleotide
taactctgaatatgtggaaactattatagcaaaatgcattgatcactacac

SEQ ID NO: 105064 - DNA, 50 bp, Artificial Sequence
  Description of Artificial Sequence: Synthetic oligonucleotide
aactctgaatatgtggaaactattatagcaaaatgcattgatcactacac

SEQ ID NO: 105065 - DNA, 49 bp, Artificial Sequence
  Description of Artificial Sequence: Synthetic oligonucleotide
actctgaatatgtggaaactattatagcaaaatgcattgatcactacac

SEQ ID NO: 105066 - DNA, 48 bp, Artificial Sequence
  Description of Artificial Sequence: Synthetic oligonucleotide
ctctgaatatgtggaaactattatagcaaaatgcattgatcactacac

SEQ ID NO: 105067 - DNA, 48 bp, Artificial Sequence
  Description of Artificial Sequence: Synthetic oligonucleotide
tctgaatatgtggaaactattatagcaaaatgcattgatcactacacc

SEQ ID NO: 105068 - DNA, 47 bp, Artificial Sequence
  Description of Artificial Sequence: Synthetic oligonucleotide
ctgaatatgtggaaactattatagcaaaatgcattgatcactacacc

SEQ ID NO: 105069 - DNA, 50 bp, Artificial Sequence
  Description of Artificial Sequence: Synthetic oligonucleotide
tgaatatgtggaaactattatagcaaaatgcattgatcactacaccaaac

SEQ ID NO: 105070 - DNA, 49 bp, Artificial Sequence
  Description of Artificial Sequence: Synthetic oligonucleotide
gaatatgtggaaactattatagcaaaatgcattgatcactacaccaaac

SEQ ID NO: 105071 - DNA, 52 bp, Artificial Sequence
  Description of Artificial Sequence: Synthetic oligonucleotide
aatatgtggaaactattatagcaaaatgcattgatcactacaccaaacaatg

SEQ ID NO: 105072 - DNA, 51 bp, Artificial Sequence
  Description of Artificial Sequence: Synthetic oligonucleotide
atatgtggaaactattatagcaaaatgcattgatcactacaccaaacaatg

SEQ ID NO: 105073 - DNA, 50 bp, Artificial Sequence
  Description of Artificial Sequence: Synthetic oligonucleotide
tatgtggaaactattatagcaaaatgcattgatcactacaccaaacaatg

SEQ ID NO: 105074 - DNA, 49 bp, Artificial Sequence
  Description of Artificial Sequence: Synthetic oligonucleotide
atgtggaaactattatagcaaaatgcattgatcactacaccaaacaatg

SEQ ID NO: 105075 - DNA, 48 bp, Artificial Sequence
  Description of Artificial Sequence: Synthetic oligonucleotide
tgtggaaactattatagcaaaatgcattgatcactacaccaaacaatg

SEQ ID NO: 105076 - DNA, 47 bp, Artificial Sequence
  Description of Artificial Sequence: Synthetic oligonucleotide
gtggaaactattatagcaaaatgcattgatcactacaccaaacaatg

SEQ ID NO: 105077 - DNA, 48 bp, Artificial Sequence
  Description of Artificial Sequence: Synthetic oligonucleotide
tggaaactattatagcaaaatgcattgatcactacaccaaacaatgtg

SEQ ID NO: 105078 - DNA, 47 bp, Artificial Sequence
  Description of Artificial Sequence: Synthetic oligonucleotide
ggaaactattatagcaaaatgcattgatcactacaccaaacaatgtg

SEQ ID NO: 105079 - DNA, 48 bp, Artificial Sequence
  Description of Artificial Sequence: Synthetic oligonucleotide
gaaactattatagcaaaatgcattgatcactacaccaaacaatgtgtg

SEQ ID NO: 105080 - DNA, 48 bp, Artificial Sequence
  Description of Artificial Sequence: Synthetic oligonucleotide
aaactattatagcaaaatgcattgatcactacaccaaacaatgtgtgg

SEQ ID NO: 105081 - DNA, 47 bp, Artificial Sequence
  Description of Artificial Sequence: Synthetic oligonucleotide
aactattatagcaaaatgcattgatcactacaccaaacaatgtgtgg

SEQ ID NO: 105082 - DNA, 46 bp, Artificial Sequence
  Description of Artificial Sequence: Synthetic oligonucleotide
actattatagcaaaatgcattgatcactacaccaaacaatgtgtgg

SEQ ID NO: 105083 - DNA, 45 bp, Artificial Sequence
  Description of Artificial Sequence: Synthetic oligonucleotide
ctattatagcaaaatgcattgatcactacaccaaacaatgtgtgg

SEQ ID NO: 105084 - DNA, 50 bp, Artificial Sequence
  Description of Artificial Sequence: Synthetic oligonucleotide
tattatagcaaaatgcattgatcactacaccaaacaatgtgtggaaaatg

SEQ ID NO: 105085 - DNA, 49 bp, Artificial Sequence
  Description of Artificial Sequence: Synthetic oligonucleotide
attatagcaaaatgcattgatcactacaccaaacaatgtgtggaaaatg

SEQ ID NO: 105086 - DNA, 48 bp, Artificial Sequence
  Description of Artificial Sequence: Synthetic oligonucleotide
ttatagcaaaatgcattgatcactacaccaaacaatgtgtggaaaatg

SEQ ID NO: 105087 - DNA, 47 bp, Artificial Sequence
  Description of Artificial Sequence: Synthetic oligonucleotide
tatagcaaaatgcattgatcactacaccaaacaatgtgtggaaaatg

SEQ ID NO: 105088 - DNA, 46 bp, Artificial Sequence
  Description of Artificial Sequence: Synthetic oligonucleotide
atagcaaaatgcattgatcactacaccaaacaatgtgtggaaaatg

SEQ ID NO: 105089 - DNA, 45 bp, Artificial Sequence
  Description of Artificial Sequence: Synthetic oligonucleotide
tagcaaaatgcattgatcactacaccaaacaatgtgtggaaaatg

SEQ ID NO: 105090 - DNA, 44 bp, Artificial Sequence
  Description of Artificial Sequence: Synthetic oligonucleotide
agcaaaatgcattgatcactacaccaaacaatgtgtggaaaatg

SEQ ID NO: 105091 - DNA, 43 bp, Artificial Sequence
  Description of Artificial Sequence: Synthetic oligonucleotide
gcaaaatgcattgatcactacaccaaacaatgtgtggaaaatg

SEQ ID NO: 105092 - DNA, 43 bp, Artificial Sequence
  Description of Artificial Sequence: Synthetic oligonucleotide
caaaatgcattgatcactacaccaaacaatgtgtggaaaatgc

SEQ ID NO: 105093 - DNA, 44 bp, Artificial Sequence
  Description of Artificial Sequence: Synthetic oligonucleotide
aaaatgcattgatcactacaccaaacaatgtgtggaaaatgcag

SEQ ID NO: 105094 - DNA, 43 bp, Artificial Sequence
  Description of Artificial Sequence: Synthetic oligonucleotide
aaatgcattgatcactacaccaaacaatgtgtggaaaatgcag

SEQ ID NO: 105095 - DNA, 42 bp, Artificial Sequence
  Description of Artificial Sequence: Synthetic oligonucleotide
aatgcattgatcactacaccaaacaatgtgtggaaaatgcag

SEQ ID NO: 105096 - DNA, 41 bp, Artificial Sequence
  Description of Artificial Sequence: Synthetic oligonucleotide
atgcattgatcactacaccaaacaatgtgtggaaaatgcag

SEQ ID NO: 105097 - DNA, 40 bp, Artificial Sequence
  Description of Artificial Sequence: Synthetic oligonucleotide
tgcattgatcactacaccaaacaatgtgtggaaaatgcag

SEQ ID NO: 105098 - DNA, 39 bp, Artificial Sequence
  Description of Artificial Sequence: Synthetic oligonucleotide
gcattgatcactacaccaaacaatgtgtggaaaatgcag

SEQ ID NO: 105099 - DNA, 43 bp, Artificial Sequence
  Description of Artificial Sequence: Synthetic oligonucleotide
cattgatcactacaccaaacaatgtgtggaaaatgcagatttg

SEQ ID NO: 105100 - DNA, 43 bp, Artificial Sequence
  Description of Artificial Sequence: Synthetic oligonucleotide
attgatcactacaccaaacaatgtgtggaaaatgcagatttgc

SEQ ID NO: 105101 - DNA, 42 bp, Artificial Sequence
  Description of Artificial Sequence: Synthetic oligonucleotide
ttgatcactacaccaaacaatgtgtggaaaatgcagatttgc

SEQ ID NO: 105102 - DNA, 41 bp, Artificial Sequence
  Description of Artificial Sequence: Synthetic oligonucleotide
tgatcactacaccaaacaatgtgtggaaaatgcagatttgc

SEQ ID NO: 105103 - DNA, 40 bp, Artificial Sequence
  Description of Artificial Sequence: Synthetic oligonucleotide
gatcactacaccaaacaatgtgtggaaaatgcagatttgc

SEQ ID NO: 105104 - DNA, 40 bp, Artificial Sequence
  Description of Artificial Sequence: Synthetic oligonucleotide
atcactacaccaaacaatgtgtggaaaatgcagatttgcc

SEQ ID NO: 105105 - DNA, 39 bp, Artificial Sequence
  Description of Artificial Sequence: Synthetic oligonucleotide
tcactacaccaaacaatgtgtggaaaatgcagatttgcc

SEQ ID NO: 105106 - DNA, 38 bp, Artificial Sequence
  Description of Artificial Sequence: Synthetic oligonucleotide
cactacaccaaacaatgtgtggaaaatgcagatttgcc

SEQ ID NO: 105107 - DNA, 39 bp, Artificial Sequence
  Description of Artificial Sequence: Synthetic oligonucleotide
actacaccaaacaatgtgtggaaaatgcagatttgcctg

SEQ ID NO: 105108 - DNA, 38 bp, Artificial Sequence
  Description of Artificial Sequence: Synthetic oligonucleotide
ctacaccaaacaatgtgtggaaaatgcagatttgcctg

SEQ ID NO: 105109 - DNA, 40 bp, Artificial Sequence
  Description of Artificial Sequence: Synthetic oligonucleotide
tacaccaaacaatgtgtggaaaatgcagatttgcctgaag

SEQ ID NO: 105110 - DNA, 39 bp, Artificial Sequence
  Description of Artificial Sequence: Synthetic oligonucleotide
acaccaaacaatgtgtggaaaatgcagatttgcctgaag

SEQ ID NO: 105111 - DNA, 38 bp, Artificial Sequence
  Description of Artificial Sequence: Synthetic oligonucleotide
caccaaacaatgtgtggaaaatgcagatttgcctgaag

SEQ ID NO: 105112 - DNA, 38 bp, Artificial Sequence
  Description of Artificial Sequence: Synthetic oligonucleotide
accaaacaatgtgtggaaaatgcagatttgcctgaagg

SEQ ID NO: 105113 - DNA, 37 bp, Artificial Sequence
  Description of Artificial Sequence: Synthetic oligonucleotide
ccaaacaatgtgtggaaaatgcagatttgcctgaagg

SEQ ID NO: 105114 - DNA, 38 bp, Artificial Sequence
  Description of Artificial Sequence: Synthetic oligonucleotide
caaacaatgtgtggaaaatgcagatttgcctgaaggag

SEQ ID NO: 105115 - DNA, 46 bp, Artificial Sequence
  Description of Artificial Sequence: Synthetic oligonucleotide
aaacaatgtgtggaaaatgcagatttgcctgaaggagaaaaaaaac

SEQ ID NO: 105116 - DNA, 45 bp, Artificial Sequence
  Description of Artificial Sequence: Synthetic oligonucleotide
aacaatgtgtggaaaatgcagatttgcctgaaggagaaaaaaaac

SEQ ID NO: 105117 - DNA, 44 bp, Artificial Sequence
  Description of Artificial Sequence: Synthetic oligonucleotide
acaatgtgtggaaaatgcagatttgcctgaaggagaaaaaaaac

SEQ ID NO: 105118 - DNA, 43 bp, Artificial Sequence
  Description of Artificial Sequence: Synthetic oligonucleotide
caatgtgtggaaaatgcagatttgcctgaaggagaaaaaaaac

SEQ ID NO: 105119 - DNA, 43 bp, Artificial Sequence
  Description of Artificial Sequence: Synthetic oligonucleotide
aatgtgtggaaaatgcagatttgcctgaaggagaaaaaaaacc

SEQ ID NO: 105120 - DNA, 42 bp, Artificial Sequence
  Description of Artificial Sequence: Synthetic oligonucleotide
atgtgtggaaaatgcagatttgcctgaaggagaaaaaaaacc

SEQ ID NO: 105121 - DNA, 41 bp, Artificial Sequence
  Description of Artificial Sequence: Synthetic oligonucleotide
tgtgtggaaaatgcagatttgcctgaaggagaaaaaaaacc

SEQ ID NO: 105122 - DNA, 40 bp, Artificial Sequence
  Description of Artificial Sequence: Synthetic oligonucleotide
gtgtggaaaatgcagatttgcctgaaggagaaaaaaaacc

SEQ ID NO: 105123 - DNA, 44 bp, Artificial Sequence
  Description of Artificial Sequence: Synthetic oligonucleotide
tgtggaaaatgcagatttgcctgaaggagaaaaaaaaccaattg

SEQ ID NO: 105124 - DNA, 43 bp, Artificial Sequence
  Description of Artificial Sequence: Synthetic oligonucleotide
gtggaaaatgcagatttgcctgaaggagaaaaaaaaccaattg

SEQ ID NO: 105125 - DNA, 44 bp, Artificial Sequence
  Description of Artificial Sequence: Synthetic oligonucleotide
tggaaaatgcagatttgcctgaaggagaaaaaaaaccaattgac

SEQ ID NO: 105126 - DNA, 43 bp, Artificial Sequence
  Description of Artificial Sequence: Synthetic oligonucleotide
ggaaaatgcagatttgcctgaaggagaaaaaaaaccaattgac

SEQ ID NO: 105127 - DNA, 43 bp, Artificial Sequence
  Description of Artificial Sequence: Synthetic oligonucleotide
gaaaatgcagatttgcctgaaggagaaaaaaaaccaattgacc

SEQ ID NO: 105128 - DNA, 44 bp, Artificial Sequence
  Description of Artificial Sequence: Synthetic oligonucleotide
aaaatgcagatttgcctgaaggagaaaaaaaaccaattgaccag

SEQ ID NO: 105129 - DNA, 43 bp, Artificial Sequence
  Description of Artificial Sequence: Synthetic oligonucleotide
aaatgcagatttgcctgaaggagaaaaaaaaccaattgaccag

SEQ ID NO: 105130 - DNA, 42 bp, Artificial Sequence
  Description of Artificial Sequence: Synthetic oligonucleotide
aatgcagatttgcctgaaggagaaaaaaaaccaattgaccag

SEQ ID NO: 105131 - DNA, 41 bp, Artificial Sequence
  Description of Artificial Sequence: Synthetic oligonucleotide
atgcagatttgcctgaaggagaaaaaaaaccaattgaccag

SEQ ID NO: 105132 - DNA, 40 bp, Artificial Sequence
  Description of Artificial Sequence: Synthetic oligonucleotide
tgcagatttgcctgaaggagaaaaaaaaccaattgaccag

SEQ ID NO: 105133 - DNA, 39 bp, Artificial Sequence
  Description of Artificial Sequence: Synthetic oligonucleotide
gcagatttgcctgaaggagaaaaaaaaccaattgaccag

SEQ ID NO: 105134 - DNA, 40 bp, Artificial Sequence
  Description of Artificial Sequence: Synthetic oligonucleotide
cagatttgcctgaaggagaaaaaaaaccaattgaccagag

SEQ ID NO: 105135 - DNA, 43 bp, Artificial Sequence
  Description of Artificial Sequence: Synthetic oligonucleotide
agatttgcctgaaggagaaaaaaaaccaattgaccagagattg

SEQ ID NO: 105136 - DNA, 42 bp, Artificial Sequence
  Description of Artificial Sequence: Synthetic oligonucleotide
gatttgcctgaaggagaaaaaaaaccaattgaccagagattg

SEQ ID NO: 105137 - DNA, 42 bp, Artificial Sequence
  Description of Artificial Sequence: Synthetic oligonucleotide
atttgcctgaaggagaaaaaaaaccaattgaccagagattgg

SEQ ID NO: 105138 - DNA, 41 bp, Artificial Sequence
  Description of Artificial Sequence: Synthetic oligonucleotide
tttgcctgaaggagaaaaaaaaccaattgaccagagattgg

SEQ ID NO: 105139 - DNA, 40 bp, Artificial Sequence
  Description of Artificial Sequence: Synthetic oligonucleotide
ttgcctgaaggagaaaaaaaaccaattgaccagagattgg

SEQ ID NO: 105140 - DNA, 39 bp, Artificial Sequence
  Description of Artificial Sequence: Synthetic oligonucleotide
tgcctgaaggagaaaaaaaaccaattgaccagagattgg

SEQ ID NO: 105141 - DNA, 38 bp, Artificial Sequence
  Description of Artificial Sequence: Synthetic oligonucleotide
gcctgaaggagaaaaaaaaccaattgaccagagattgg

SEQ ID NO: 105142 - DNA, 40 bp, Artificial Sequence
  Description of Artificial Sequence: Synthetic oligonucleotide
cctgaaggagaaaaaaaaccaattgaccagagattggaag

SEQ ID NO: 105143 - DNA, 40 bp, Artificial Sequence
  Description of Artificial Sequence: Synthetic oligonucleotide
ctgaaggagaaaaaaaaccaattgaccagagattggaagg

SEQ ID NO: 105144 - DNA, 40 bp, Artificial Sequence
  Description of Artificial Sequence: Synthetic oligonucleotide
tgaaggagaaaaaaaaccaattgaccagagattggaaggc

SEQ ID NO: 105145 - DNA, 39 bp, Artificial Sequence
  Description of Artificial Sequence: Synthetic oligonucleotide
gaaggagaaaaaaaaccaattgaccagagattggaaggc

SEQ ID NO: 105146 - DNA, 41 bp, Artificial Sequence
  Description of Artificial Sequence: Synthetic oligonucleotide
aaggagaaaaaaaaccaattgaccagagattggaaggcatc

SEQ ID NO: 105147 - DNA, 40 bp, Artificial Sequence
  Description of Artificial Sequence: Synthetic oligonucleotide
aggagaaaaaaaaccaattgaccagagattggaaggcatc

SEQ ID NO: 105148 - DNA, 39 bp, Artificial Sequence
  Description of Artificial Sequence: Synthetic oligonucleotide
ggagaaaaaaaaccaattgaccagagattggaaggcatc

SEQ ID NO: 105149 - DNA, 39 bp, Artificial Sequence
  Description of Artificial Sequence: Synthetic oligonucleotide
gagaaaaaaaaccaattgaccagagattggaaggcatcg

SEQ ID NO: 105150 - DNA, 49 bp, Artificial Sequence
  Description of Artificial Sequence: Synthetic oligonucleotide
agaaaaaaaaccaattgaccagagattggaaggcatcgtaaataaaatg

SEQ ID NO: 105151 - DNA, 48 bp, Artificial Sequence
  Description of Artificial Sequence: Synthetic oligonucleotide
gaaaaaaaaccaattgaccagagattggaaggcatcgtaaataaaatg

SEQ ID NO: 105152 - DNA, 50 bp, Artificial Sequence
  Description of Artificial Sequence: Synthetic oligonucleotide
aaaaaaaaccaattgaccagagattggaaggcatcgtaaataaaatgttc

SEQ ID NO: 105153 - DNA, 49 bp, Artificial Sequence
  Description of Artificial Sequence: Synthetic oligonucleotide
aaaaaaaccaattgaccagagattggaaggcatcgtaaataaaatgttc

SEQ ID NO: 105154 - DNA, 48 bp, Artificial Sequence
  Description of Artificial Sequence: Synthetic oligonucleotide
aaaaaaccaattgaccagagattggaaggcatcgtaaataaaatgttc

SEQ ID NO: 105155 - DNA, 47 bp, Artificial Sequence
  Description of Artificial Sequence: Synthetic oligonucleotide
aaaaaccaattgaccagagattggaaggcatcgtaaataaaatgttc

SEQ ID NO: 105156 - DNA, 46 bp, Artificial Sequence
  Description of Artificial Sequence: Synthetic oligonucleotide
aaaaccaattgaccagagattggaaggcatcgtaaataaaatgttc

SEQ ID NO: 105157 - DNA, 45 bp, Artificial Sequence
  Description of Artificial Sequence: Synthetic oligonucleotide
aaaccaattgaccagagattggaaggcatcgtaaataaaatgttc

SEQ ID NO: 105158 - DNA, 44 bp, Artificial Sequence
  Description of Artificial Sequence: Synthetic oligonucleotide
aaccaattgaccagagattggaaggcatcgtaaataaaatgttc

SEQ ID NO: 105159 - DNA, 43 bp, Artificial Sequence
  Description of Artificial Sequence: Synthetic oligonucleotide
accaattgaccagagattggaaggcatcgtaaataaaatgttc

SEQ ID NO: 105160 - DNA, 42 bp, Artificial Sequence
  Description of Artificial Sequence: Synthetic oligonucleotide
ccaattgaccagagattggaaggcatcgtaaataaaatgttc

SEQ ID NO: 105161 - DNA, 42 bp, Artificial Sequence
  Description of Artificial Sequence: Synthetic oligonucleotide
caattgaccagagattggaaggcatcgtaaataaaatgttcc

SEQ ID NO: 105162 - DNA, 43 bp, Artificial Sequence
  Description of Artificial Sequence: Synthetic oligonucleotide
aattgaccagagattggaaggcatcgtaaataaaatgttccag

SEQ ID NO: 105163 - DNA, 42 bp, Artificial Sequence
  Description of Artificial Sequence: Synthetic oligonucleotide
attgaccagagattggaaggcatcgtaaataaaatgttccag

SEQ ID NO: 105164 - DNA, 41 bp, Artificial Sequence
  Description of Artificial Sequence: Synthetic oligonucleotide
ttgaccagagattggaaggcatcgtaaataaaatgttccag

SEQ ID NO: 105165 - DNA, 40 bp, Artificial Sequence
  Description of Artificial Sequence: Synthetic oligonucleotide
tgaccagagattggaaggcatcgtaaataaaatgttccag

SEQ ID NO: 105166 - DNA, 39 bp, Artificial Sequence
  Description of Artificial Sequence: Synthetic oligonucleotide
gaccagagattggaaggcatcgtaaataaaatgttccag

SEQ ID NO: 105167 - DNA, 39 bp, Artificial Sequence
  Description of Artificial Sequence: Synthetic oligonucleotide
accagagattggaaggcatcgtaaataaaatgttccagc

SEQ ID NO: 105168 - DNA, 38 bp, Artificial Sequence
  Description of Artificial Sequence: Synthetic oligonucleotide
ccagagattggaaggcatcgtaaataaaatgttccagc

SEQ ID NO: 105169 - DNA, 38 bp, Artificial Sequence
  Description of Artificial Sequence: Synthetic oligonucleotide
cagagattggaaggcatcgtaaataaaatgttccagcg

SEQ ID NO: 105170 - DNA, 40 bp, Artificial Sequence
  Description of Artificial Sequence: Synthetic oligonucleotide
agagattggaaggcatcgtaaataaaatgttccagcgatg

SEQ ID NO: 105171 - DNA, 39 bp, Artificial Sequence
  Description of Artificial Sequence: Synthetic oligonucleotide
gagattggaaggcatcgtaaataaaatgttccagcgatg

SEQ ID NO: 105172 - DNA, 40 bp, Artificial Sequence
  Description of Artificial Sequence: Synthetic oligonucleotide
agattggaaggcatcgtaaataaaatgttccagcgatgtc

SEQ ID NO: 105173 - DNA, 39 bp, Artificial Sequence
  Description of Artificial Sequence: Synthetic oligonucleotide
gattggaaggcatcgtaaataaaatgttccagcgatgtc

SEQ ID NO: 105174 - DNA, 41 bp, Artificial Sequence
  Description of Artificial Sequence: Synthetic oligonucleotide
attggaaggcatcgtaaataaaatgttccagcgatgtctag

SEQ ID NO: 105175 - DNA, 40 bp, Artificial Sequence
  Description of Artificial Sequence: Synthetic oligonucleotide
ttggaaggcatcgtaaataaaatgttccagcgatgtctag

SEQ ID NO: 105176 - DNA, 39 bp, Artificial Sequence
  Description of Artificial Sequence: Synthetic oligonucleotide
tggaaggcatcgtaaataaaatgttccagcgatgtctag

SEQ ID NO: 105177 - DNA, 38 bp, Artificial Sequence
  Description of Artificial Sequence: Synthetic oligonucleotide
ggaaggcatcgtaaataaaatgttccagcgatgtctag

SEQ ID NO: 105178 - DNA, 40 bp, Artificial Sequence
  Description of Artificial Sequence: Synthetic oligonucleotide
gaaggcatcgtaaataaaatgttccagcgatgtctagatg

SEQ ID NO: 105179 - DNA, 42 bp, Artificial Sequence
  Description of Artificial Sequence: Synthetic oligonucleotide
aaggcatcgtaaataaaatgttccagcgatgtctagatgatc

SEQ ID NO: 105180 - DNA, 41 bp, Artificial Sequence
  Description of Artificial Sequence: Synthetic oligonucleotide
aggcatcgtaaataaaatgttccagcgatgtctagatgatc

SEQ ID NO: 105181 - DNA, 40 bp, Artificial Sequence
  Description of Artificial Sequence: Synthetic oligonucleotide
ggcatcgtaaataaaatgttccagcgatgtctagatgatc

SEQ ID NO: 105182 - DNA, 41 bp, Artificial Sequence
  Description of Artificial Sequence: Synthetic oligonucleotide
gcatcgtaaataaaatgttccagcgatgtctagatgatcac

SEQ ID NO: 105183 - DNA, 43 bp, Artificial Sequence
  Description of Artificial Sequence: Synthetic oligonucleotide
catcgtaaataaaatgttccagcgatgtctagatgatcacaag

SEQ ID NO: 105184 - DNA, 49 bp, Artificial Sequence
  Description of Artificial Sequence: Synthetic oligonucleotide
atcgtaaataaaatgttccagcgatgtctagatgatcacaagtataaac

SEQ ID NO: 105185 - DNA, 48 bp, Artificial Sequence
  Description of Artificial Sequence: Synthetic oligonucleotide
tcgtaaataaaatgttccagcgatgtctagatgatcacaagtataaac

SEQ ID NO: 105186 - DNA, 47 bp, Artificial Sequence
  Description of Artificial Sequence: Synthetic oligonucleotide
cgtaaataaaatgttccagcgatgtctagatgatcacaagtataaac

SEQ ID NO: 105187 - DNA, 48 bp, Artificial Sequence
  Description of Artificial Sequence: Synthetic oligonucleotide
gtaaataaaatgttccagcgatgtctagatgatcacaagtataaacag

SEQ ID NO: 105188 - DNA, 48 bp, Artificial Sequence
  Description of Artificial Sequence: Synthetic oligonucleotide
taaataaaatgttccagcgatgtctagatgatcacaagtataaacagg

SEQ ID NO: 105189 - DNA, 47 bp, Artificial Sequence
  Description of Artificial Sequence: Synthetic oligonucleotide
aaataaaatgttccagcgatgtctagatgatcacaagtataaacagg

SEQ ID NO: 105190 - DNA, 46 bp, Artificial Sequence
  Description of Artificial Sequence: Synthetic oligonucleotide
aataaaatgttccagcgatgtctagatgatcacaagtataaacagg

SEQ ID NO: 105191 - DNA, 45 bp, Artificial Sequence
  Description of Artificial Sequence: Synthetic oligonucleotide
ataaaatgttccagcgatgtctagatgatcacaagtataaacagg

SEQ ID NO: 105192 - DNA, 44 bp, Artificial Sequence
  Description of Artificial Sequence: Synthetic oligonucleotide
taaaatgttccagcgatgtctagatgatcacaagtataaacagg

SEQ ID NO: 105193 - DNA, 43 bp, Artificial Sequence
  Description of Artificial Sequence: Synthetic oligonucleotide
aaaatgttccagcgatgtctagatgatcacaagtataaacagg

SEQ ID NO: 105194 - DNA, 42 bp, Artificial Sequence
  Description of Artificial Sequence: Synthetic oligonucleotide
aaatgttccagcgatgtctagatgatcacaagtataaacagg

SEQ ID NO: 105195 - DNA, 41 bp, Artificial Sequence
  Description of Artificial Sequence: Synthetic oligonucleotide
aatgttccagcgatgtctagatgatcacaagtataaacagg

SEQ ID NO: 105196 - DNA, 40 bp, Artificial Sequence
  Description of Artificial Sequence: Synthetic oligonucleotide
atgttccagcgatgtctagatgatcacaagtataaacagg

SEQ ID NO: 105197 - DNA, 39 bp, Artificial Sequence
  Description of Artificial Sequence: Synthetic oligonucleotide
tgttccagcgatgtctagatgatcacaagtataaacagg

SEQ ID NO: 105198 - DNA, 38 bp, Artificial Sequence
  Description of Artificial Sequence: Synthetic oligonucleotide
gttccagcgatgtctagatgatcacaagtataaacagg

SEQ ID NO: 105199 - DNA, 38 bp, Artificial Sequence
  Description of Artificial Sequence: Synthetic oligonucleotide
ttccagcgatgtctagatgatcacaagtataaacaggc

SEQ ID NO: 105200 - DNA, 37 bp, Artificial Sequence
  Description of Artificial Sequence: Synthetic oligonucleotide
tccagcgatgtctagatgatcacaagtataaacaggc

SEQ ID NO: 105201 - DNA, 36 bp, Artificial Sequence
  Description of Artificial Sequence: Synthetic oligonucleotide
ccagcgatgtctagatgatcacaagtataaacaggc

SEQ ID NO: 105202 - DNA, 40 bp, Artificial Sequence
  Description of Artificial Sequence: Synthetic oligonucleotide
cagcgatgtctagatgatcacaagtataaacaggctattg

SEQ ID NO: 105203 - DNA, 40 bp, Artificial Sequence
  Description of Artificial Sequence: Synthetic oligonucleotide
agcgatgtctagatgatcacaagtataaacaggctattgg

SEQ ID NO: 105204 - DNA, 39 bp, Artificial Sequence
  Description of Artificial Sequence: Synthetic oligonucleotide
gcgatgtctagatgatcacaagtataaacaggctattgg

SEQ ID NO: 105205 - DNA, 39 bp, Artificial Sequence
  Description of Artificial Sequence: Synthetic oligonucleotide
cgatgtctagatgatcacaagtataaacaggctattggc

SEQ ID NO: 105206 - DNA, 42 bp, Artificial Sequence
  Description of Artificial Sequence: Synthetic oligonucleotide
gatgtctagatgatcacaagtataaacaggctattggcattg

SEQ ID NO: 105207 - DNA, 42 bp, Artificial Sequence
  Description of Artificial Sequence: Synthetic oligonucleotide
atgtctagatgatcacaagtataaacaggctattggcattgc

SEQ ID NO: 105208 - DNA, 41 bp, Artificial Sequence
  Description of Artificial Sequence: Synthetic oligonucleotide
tgtctagatgatcacaagtataaacaggctattggcattgc

SEQ ID NO: 105209 - DNA, 40 bp, Artificial Sequence
  Description of Artificial Sequence: Synthetic oligonucleotide
gtctagatgatcacaagtataaacaggctattggcattgc

SEQ ID NO: 105210 - DNA, 41 bp, Artificial Sequence
  Description of Artificial Sequence: Synthetic oligonucleotide
tctagatgatcacaagtataaacaggctattggcattgctc

SEQ ID NO: 105211 - DNA, 40 bp, Artificial Sequence
  Description of Artificial Sequence: Synthetic oligonucleotide
ctagatgatcacaagtataaacaggctattggcattgctc

SEQ ID NO: 105212 - DNA, 41 bp, Artificial Sequence
  Description of Artificial Sequence: Synthetic oligonucleotide
tagatgatcacaagtataaacaggctattggcattgctctg

SEQ ID NO: 105213 - DNA, 40 bp, Artificial Sequence
  Description of Artificial Sequence: Synthetic oligonucleotide
agatgatcacaagtataaacaggctattggcattgctctg

SEQ ID NO: 105214 - DNA, 39 bp, Artificial Sequence
  Description of Artificial Sequence: Synthetic oligonucleotide
gatgatcacaagtataaacaggctattggcattgctctg

SEQ ID NO: 105215 - DNA, 39 bp, Artificial Sequence
  Description of Artificial Sequence: Synthetic oligonucleotide
atgatcacaagtataaacaggctattggcattgctctgg

SEQ ID NO: 105216 - DNA, 38 bp, Artificial Sequence
  Description of Artificial Sequence: Synthetic oligonucleotide
tgatcacaagtataaacaggctattggcattgctctgg

SEQ ID NO: 105217 - DNA, 37 bp, Artificial Sequence
  Description of Artificial Sequence: Synthetic oligonucleotide
gatcacaagtataaacaggctattggcattgctctgg

SEQ ID NO: 105218 - DNA, 38 bp, Artificial Sequence
  Description of Artificial Sequence: Synthetic oligonucleotide
atcacaagtataaacaggctattggcattgctctggag

SEQ ID NO: 105219 - DNA, 37 bp, Artificial Sequence
  Description of Artificial Sequence: Synthetic oligonucleotide
tcacaagtataaacaggctattggcattgctctggag

SEQ ID NO: 105220 - DNA, 36 bp, Artificial Sequence
  Description of Artificial Sequence: Synthetic oligonucleotide
cacaagtataaacaggctattggcattgctctggag

SEQ ID NO: 105221 - DNA, 37 bp, Artificial Sequence
  Description of Artificial Sequence: Synthetic oligonucleotide
acaagtataaacaggctattggcattgctctggagac

SEQ ID NO: 105222 - DNA, 36 bp, Artificial Sequence
  Description of Artificial Sequence: Synthetic oligonucleotide
caagtataaacaggctattggcattgctctggagac

SEQ ID NO: 105223 - DNA, 37 bp, Artificial Sequence
  Description of Artificial Sequence: Synthetic oligonucleotide
aagtataaacaggctattggcattgctctggagacac

SEQ ID NO: 105224 - DNA, 36 bp, Artificial Sequence
  Description of Artificial Sequence: Synthetic oligonucleotide
agtataaacaggctattggcattgctctggagacac

SEQ ID NO: 105225 - DNA, 35 bp, Artificial Sequence
  Description of Artificial Sequence: Synthetic oligonucleotide
gtataaacaggctattggcattgctctggagacac

SEQ ID NO: 105226 - DNA, 35 bp, Artificial Sequence
  Description of Artificial Sequence: Synthetic oligonucleotide
tataaacaggctattggcattgctctggagacacg

SEQ ID NO: 105227 - DNA, 34 bp, Artificial Sequence
  Description of Artificial Sequence: Synthetic oligonucleotide
ataaacaggctattggcattgctctggagacacg

SEQ ID NO: 105228 - DNA, 33 bp, Artificial Sequence
  Description of Artificial Sequence: Synthetic oligonucleotide
taaacaggctattggcattgctctggagacacg

SEQ ID NO: 105229 - DNA, 32 bp, Artificial Sequence
  Description of Artificial Sequence: Synthetic oligonucleotide
aaacaggctattggcattgctctggagacacg

SEQ ID NO: 105230 - DNA, 31 bp, Artificial Sequence
  Description of Artificial Sequence: Synthetic oligonucleotide
aacaggctattggcattgctctggagacacg

SEQ ID NO: 105231 - DNA, 30 bp, Artificial Sequence
  Description of Artificial Sequence: Synthetic oligonucleotide
acaggctattggcattgctctggagacacg

SEQ ID NO: 105232 - DNA, 29 bp, Artificial Sequence
  Description of Artificial Sequence: Synthetic oligonucleotide
caggctattggcattgctctggagacacg

SEQ ID NO: 105233 - DNA, 31 bp, Artificial Sequence
  Description of Artificial Sequence: Synthetic oligonucleotide
aggctattggcattgctctggagacacgaag

SEQ ID NO: 105234 - DNA, 30 bp, Artificial Sequence
  Description of Artificial Sequence: Synthetic oligonucleotide
ggctattggcattgctctggagacacgaag

SEQ ID NO: 105235 - DNA, 31 bp, Artificial Sequence
  Description of Artificial Sequence: Synthetic oligonucleotide
gctattggcattgctctggagacacgaagac

SEQ ID NO: 105236 - DNA, 32 bp, Artificial Sequence
  Description of Artificial Sequence: Synthetic oligonucleotide
ctattggcattgctctggagacacgaagactg

SEQ ID NO: 105237 - DNA, 32 bp, Artificial Sequence
  Description of Artificial Sequence: Synthetic oligonucleotide
tattggcattgctctggagacacgaagactgg

SEQ ID NO: 105238 - DNA, 31 bp, Artificial Sequence
  Description of Artificial Sequence: Synthetic oligonucleotide
attggcattgctctggagacacgaagactgg

SEQ ID NO: 105239 - DNA, 30 bp, Artificial Sequence
  Description of Artificial Sequence: Synthetic oligonucleotide
ttggcattgctctggagacacgaagactgg

SEQ ID NO: 105240 - DNA, 29 bp, Artificial Sequence
  Description of Artificial Sequence: Synthetic oligonucleotide
tggcattgctctggagacacgaagactgg

SEQ ID NO: 105241 - DNA, 28 bp, Artificial Sequence
  Description of Artificial Sequence: Synthetic oligonucleotide
ggcattgctctggagacacgaagactgg

SEQ ID NO: 105242 - DNA, 29 bp, Artificial Sequence
  Description of Artificial Sequence: Synthetic oligonucleotide
gcattgctctggagacacgaagactggac

SEQ ID NO: 105243 - DNA, 29 bp, Artificial Sequence
  Description of Artificial Sequence: Synthetic oligonucleotide
cattgctctggagacacgaagactggacg

SEQ ID NO: 105244 - DNA, 30 bp, Artificial Sequence
  Description of Artificial Sequence: Synthetic oligonucleotide
attgctctggagacacgaagactggacgtc

SEQ ID NO: 105245 - DNA, 29 bp, Artificial Sequence
  Description of Artificial Sequence: Synthetic oligonucleotide
ttgctctggagacacgaagactggacgtc

SEQ ID NO: 105246 - DNA, 28 bp, Artificial Sequence
  Description of Artificial Sequence: Synthetic oligonucleotide
tgctctggagacacgaagactggacgtc

SEQ ID NO: 105247 - DNA, 27 bp, Artificial Sequence
  Description of Artificial Sequence: Synthetic oligonucleotide
gctctggagacacgaagactggacgtc

SEQ ID NO: 105248 - DNA, 30 bp, Artificial Sequence
  Description of Artificial Sequence: Synthetic oligonucleotide
ctctggagacacgaagactggacgtctttg

SEQ ID NO: 105249 - DNA, 34 bp, Artificial Sequence
  Description of Artificial Sequence: Synthetic oligonucleotide
tctggagacacgaagactggacgtctttgaaaag

SEQ ID NO: 105250 - DNA, 33 bp, Artificial Sequence
  Description of Artificial Sequence: Synthetic oligonucleotide
ctggagacacgaagactggacgtctttgaaaag

SEQ ID NO: 105251 - DNA, 34 bp, Artificial Sequence
  Description of Artificial Sequence: Synthetic oligonucleotide
tggagacacgaagactggacgtctttgaaaagac

SEQ ID NO: 105252 - DNA, 33 bp, Artificial Sequence
  Description of Artificial Sequence: Synthetic oligonucleotide
ggagacacgaagactggacgtctttgaaaagac

SEQ ID NO: 105253 - DNA, 33 bp, Artificial Sequence
  Description of Artificial Sequence: Synthetic oligonucleotide
gagacacgaagactggacgtctttgaaaagacc

SEQ ID NO: 105254 - DNA, 36 bp, Artificial Sequence
  Description of Artificial Sequence: Synthetic oligonucleotide
agacacgaagactggacgtctttgaaaagaccatac

SEQ ID NO: 105255 - DNA, 35 bp, Artificial Sequence
  Description of Artificial Sequence: Synthetic oligonucleotide
gacacgaagactggacgtctttgaaaagaccatac

SEQ ID NO: 105256 - DNA, 36 bp, Artificial Sequence
  Description of Artificial Sequence: Synthetic oligonucleotide
acacgaagactggacgtctttgaaaagaccatactg

SEQ ID NO: 105257 - DNA, 35 bp, Artificial Sequence
  Description of Artificial Sequence: Synthetic oligonucleotide
cacgaagactggacgtctttgaaaagaccatactg

SEQ ID NO: 105258 - DNA, 35 bp, Artificial Sequence
  Description of Artificial Sequence: Synthetic oligonucleotide
acgaagactggacgtctttgaaaagaccatactgg

SEQ ID NO: 105259 - DNA, 34 bp, Artificial Sequence
  Description of Artificial Sequence: Synthetic oligonucleotide
cgaagactggacgtctttgaaaagaccatactgg

SEQ ID NO: 105260 - DNA, 35 bp, Artificial Sequence
  Description of Artificial Sequence: Synthetic oligonucleotide
gaagactggacgtctttgaaaagaccatactggag

SEQ ID NO: 105261 - DNA, 36 bp, Artificial Sequence
  Description of Artificial Sequence: Synthetic oligonucleotide
aagactggacgtctttgaaaagaccatactggagtc

SEQ ID NO: 105262 - DNA, 35 bp, Artificial Sequence
  Description of Artificial Sequence: Synthetic oligonucleotide
agactggacgtctttgaaaagaccatactggagtc

SEQ ID NO: 105263 - DNA, 34 bp, Artificial Sequence
  Description of Artificial Sequence: Synthetic oligonucleotide
gactggacgtctttgaaaagaccatactggagtc

SEQ ID NO: 105264 - DNA, 34 bp, Artificial Sequence
  Description of Artificial Sequence: Synthetic oligonucleotide
actggacgtctttgaaaagaccatactggagtcg

SEQ ID NO: 105265 - DNA, 33 bp, Artificial Sequence
  Description of Artificial Sequence: Synthetic oligonucleotide
ctggacgtctttgaaaagaccatactggagtcg

SEQ ID NO: 105266 - DNA, 36 bp, Artificial Sequence
  Description of Artificial Sequence: Synthetic oligonucleotide
tggacgtctttgaaaagaccatactggagtcgaatg

SEQ ID NO: 105267 - DNA, 35 bp, Artificial Sequence
  Description of Artificial Sequence: Synthetic oligonucleotide
ggacgtctttgaaaagaccatactggagtcgaatg

SEQ ID NO: 105268 - DNA, 37 bp, Artificial Sequence
  Description of Artificial Sequence: Synthetic oligonucleotide
gacgtctttgaaaagaccatactggagtcgaatgatg

SEQ ID NO: 105269 - DNA, 38 bp, Artificial Sequence
  Description of Artificial Sequence: Synthetic oligonucleotide
acgtctttgaaaagaccatactggagtcgaatgatgtc

SEQ ID NO: 105270 - DNA, 37 bp, Artificial Sequence
  Description of Artificial Sequence: Synthetic oligonucleotide
cgtctttgaaaagaccatactggagtcgaatgatgtc

SEQ ID NO: 105271 - DNA, 37 bp, Artificial Sequence
  Description of Artificial Sequence: Synthetic oligonucleotide
gtctttgaaaagaccatactggagtcgaatgatgtcc

SEQ ID NO: 105272 - DNA, 37 bp, Artificial Sequence
  Description of Artificial Sequence: Synthetic oligonucleotide
tctttgaaaagaccatactggagtcgaatgatgtccc

SEQ ID NO: 105273 - DNA, 36 bp, Artificial Sequence
  Description of Artificial Sequence: Synthetic oligonucleotide
ctttgaaaagaccatactggagtcgaatgatgtccc

SEQ ID NO: 105274 - DNA, 37 bp, Artificial Sequence
  Description of Artificial Sequence: Synthetic oligonucleotide
tttgaaaagaccatactggagtcgaatgatgtcccag

SEQ ID NO: 105275 - DNA, 36 bp, Artificial Sequence
  Description of Artificial Sequence: Synthetic oligonucleotide
ttgaaaagaccatactggagtcgaatgatgtcccag

SEQ ID NO: 105276 - DNA, 35 bp, Artificial Sequence
  Description of Artificial Sequence: Synthetic oligonucleotide
tgaaaagaccatactggagtcgaatgatgtcccag

SEQ ID NO: 105277 - DNA, 34 bp, Artificial Sequence
  Description of Artificial Sequence: Synthetic oligonucleotide
gaaaagaccatactggagtcgaatgatgtcccag

SEQ ID NO: 105278 - DNA, 34 bp, Artificial Sequence
  Description of Artificial Sequence: Synthetic oligonucleotide
aaaagaccatactggagtcgaatgatgtcccagg

SEQ ID NO: 105279 - DNA, 33 bp, Artificial Sequence
  Description of Artificial Sequence: Synthetic oligonucleotide
aaagaccatactggagtcgaatgatgtcccagg

SEQ ID NO: 105280 - DNA, 32 bp, Artificial Sequence
  Description of Artificial Sequence: Synthetic oligonucleotide
aagaccatactggagtcgaatgatgtcccagg

SEQ ID NO: 105281 - DNA, 31 bp, Artificial Sequence
  Description of Artificial Sequence: Synthetic oligonucleotide
agaccatactggagtcgaatgatgtcccagg

SEQ ID NO: 105282 - DNA, 30 bp, Artificial Sequence
  Description of Artificial Sequence: Synthetic oligonucleotide
gaccatactggagtcgaatgatgtcccagg

SEQ ID NO: 105283 - DNA, 33 bp, Artificial Sequence
  Description of Artificial Sequence: Synthetic oligonucleotide
accatactggagtcgaatgatgtcccaggaatg

SEQ ID NO: 105284 - DNA, 32 bp, Artificial Sequence
  Description of Artificial Sequence: Synthetic oligonucleotide
ccatactggagtcgaatgatgtcccaggaatg

SEQ ID NO: 105285 - DNA, 35 bp, Artificial Sequence
  Description of Artificial Sequence: Synthetic oligonucleotide
catactggagtcgaatgatgtcccaggaatgttag

SEQ ID NO: 105286 - DNA, 35 bp, Artificial Sequence
  Description of Artificial Sequence: Synthetic oligonucleotide
atactggagtcgaatgatgtcccaggaatgttagc

SEQ ID NO: 105287 - DNA, 34 bp, Artificial Sequence
  Description of Artificial Sequence: Synthetic oligonucleotide
tactggagtcgaatgatgtcccaggaatgttagc

SEQ ID NO: 105288 - DNA, 33 bp, Artificial Sequence
  Description of Artificial Sequence: Synthetic oligonucleotide
actggagtcgaatgatgtcccaggaatgttagc

SEQ ID NO: 105289 - DNA, 32 bp, Artificial Sequence
  Description of Artificial Sequence: Synthetic oligonucleotide
ctggagtcgaatgatgtcccaggaatgttagc

SEQ ID NO: 105290 - DNA, 37 bp, Artificial Sequence
  Description of Artificial Sequence: Synthetic oligonucleotide
tggagtcgaatgatgtcccaggaatgttagcttatag

SEQ ID NO: 105291 - DNA, 36 bp, Artificial Sequence
  Description of Artificial Sequence: Synthetic oligonucleotide
ggagtcgaatgatgtcccaggaatgttagcttatag

SEQ ID NO: 105292 - DNA, 36 bp, Artificial Sequence
  Description of Artificial Sequence: Synthetic oligonucleotide
gagtcgaatgatgtcccaggaatgttagcttatagc

SEQ ID NO: 105293 - DNA, 36 bp, Artificial Sequence
  Description of Artificial Sequence: Synthetic oligonucleotide
agtcgaatgatgtcccaggaatgttagcttatagcc

SEQ ID NO: 105294 - DNA, 35 bp, Artificial Sequence
  Description of Artificial Sequence: Synthetic oligonucleotide
gtcgaatgatgtcccaggaatgttagcttatagcc

SEQ ID NO: 105295 - DNA, 39 bp, Artificial Sequence
  Description of Artificial Sequence: Synthetic oligonucleotide
tcgaatgatgtcccaggaatgttagcttatagccttaag

SEQ ID NO: 105296 - DNA, 38 bp, Artificial Sequence
  Description of Artificial Sequence: Synthetic oligonucleotide
cgaatgatgtcccaggaatgttagcttatagccttaag

SEQ ID NO: 105297 - DNA, 38 bp, Artificial Sequence
  Description of Artificial Sequence: Synthetic oligonucleotide
gaatgatgtcccaggaatgttagcttatagccttaagc

SEQ ID NO: 105298 - DNA, 39 bp, Artificial Sequence
  Description of Artificial Sequence: Synthetic oligonucleotide
aatgatgtcccaggaatgttagcttatagccttaagctc

SEQ ID NO: 105299 - DNA, 38 bp, Artificial Sequence
  Description of Artificial Sequence: Synthetic oligonucleotide
atgatgtcccaggaatgttagcttatagccttaagctc

SEQ ID NO: 105300 - DNA, 37 bp, Artificial Sequence
  Description of Artificial Sequence: Synthetic oligonucleotide
tgatgtcccaggaatgttagcttatagccttaagctc

SEQ ID NO: 105301 - DNA, 36 bp, Artificial Sequence
  Description of Artificial Sequence: Synthetic oligonucleotide
gatgtcccaggaatgttagcttatagccttaagctc

SEQ ID NO: 105302 - DNA, 37 bp, Artificial Sequence
  Description of Artificial Sequence: Synthetic oligonucleotide
atgtcccaggaatgttagcttatagccttaagctctg

SEQ ID NO: 105303 - DNA, 36 bp, Artificial Sequence
  Description of Artificial Sequence: Synthetic oligonucleotide
tgtcccaggaatgttagcttatagccttaagctctg

SEQ ID NO: 105304 - DNA, 35 bp, Artificial Sequence
  Description of Artificial Sequence: Synthetic oligonucleotide
gtcccaggaatgttagcttatagccttaagctctg

SEQ ID NO: 105305 - DNA, 35 bp, Artificial Sequence
  Description of Artificial Sequence: Synthetic oligonucleotide
tcccaggaatgttagcttatagccttaagctctgc

SEQ ID NO: 105306 - DNA, 34 bp, Artificial Sequence
  Description of Artificial Sequence: Synthetic oligonucleotide
cccaggaatgttagcttatagccttaagctctgc

SEQ ID NO: 105307 - DNA, 36 bp, Artificial Sequence
  Description of Artificial Sequence: Synthetic oligonucleotide
ccaggaatgttagcttatagccttaagctctgcatg

SEQ ID NO: 105308 - DNA, 37 bp, Artificial Sequence
  Description of Artificial Sequence: Synthetic oligonucleotide
caggaatgttagcttatagccttaagctctgcatgtc

SEQ ID NO: 105309 - DNA, 43 bp, Artificial Sequence
  Description of Artificial Sequence: Synthetic oligonucleotide
aggaatgttagcttatagccttaagctctgcatgtctttaatg

SEQ ID NO: 105310 - DNA, 42 bp, Artificial Sequence
  Description of Artificial Sequence: Synthetic oligonucleotide
ggaatgttagcttatagccttaagctctgcatgtctttaatg

SEQ ID NO: 105311 - DNA, 42 bp, Artificial Sequence
  Description of Artificial Sequence: Synthetic oligonucleotide
gaatgttagcttatagccttaagctctgcatgtctttaatgc

SEQ ID NO: 105312 - DNA, 43 bp, Artificial Sequence
  Description of Artificial Sequence: Synthetic oligonucleotide
aatgttagcttatagccttaagctctgcatgtctttaatgcag

SEQ ID NO: 105313 - DNA, 42 bp, Artificial Sequence
  Description of Artificial Sequence: Synthetic oligonucleotide
atgttagcttatagccttaagctctgcatgtctttaatgcag

SEQ ID NO: 105314 - DNA, 41 bp, Artificial Sequence
  Description of Artificial Sequence: Synthetic oligonucleotide
tgttagcttatagccttaagctctgcatgtctttaatgcag

SEQ ID NO: 105315 - DNA, 40 bp, Artificial Sequence
  Description of Artificial Sequence: Synthetic oligonucleotide
gttagcttatagccttaagctctgcatgtctttaatgcag

SEQ ID NO: 105316 - DNA, 46 bp, Artificial Sequence
  Description of Artificial Sequence: Synthetic oligonucleotide
ttagcttatagccttaagctctgcatgtctttaatgcagaataaac

SEQ ID NO: 105317 - DNA, 45 bp, Artificial Sequence
  Description of Artificial Sequence: Synthetic oligonucleotide
tagcttatagccttaagctctgcatgtctttaatgcagaataaac

SEQ ID NO: 105318 - DNA, 44 bp, Artificial Sequence
  Description of Artificial Sequence: Synthetic oligonucleotide
agcttatagccttaagctctgcatgtctttaatgcagaataaac

SEQ ID NO: 105319 - DNA, 43 bp, Artificial Sequence
  Description of Artificial Sequence: Synthetic oligonucleotide
gcttatagccttaagctctgcatgtctttaatgcagaataaac

SEQ ID NO: 105320 - DNA, 44 bp, Artificial Sequence
  Description of Artificial Sequence: Synthetic oligonucleotide
cttatagccttaagctctgcatgtctttaatgcagaataaacag

SEQ ID NO: 105321 - DNA, 47 bp, Artificial Sequence
  Description of Artificial Sequence: Synthetic oligonucleotide
ttatagccttaagctctgcatgtctttaatgcagaataaacagtttc

SEQ ID NO: 105322 - DNA, 46 bp, Artificial Sequence
  Description of Artificial Sequence: Synthetic oligonucleotide
tatagccttaagctctgcatgtctttaatgcagaataaacagtttc

SEQ ID NO: 105323 - DNA, 45 bp, Artificial Sequence
  Description of Artificial Sequence: Synthetic oligonucleotide
atagccttaagctctgcatgtctttaatgcagaataaacagtttc

SEQ ID NO: 105324 - DNA, 44 bp, Artificial Sequence
  Description of Artificial Sequence: Synthetic oligonucleotide
tagccttaagctctgcatgtctttaatgcagaataaacagtttc

SEQ ID NO: 105325 - DNA, 43 bp, Artificial Sequence
  Description of Artificial Sequence: Synthetic oligonucleotide
agccttaagctctgcatgtctttaatgcagaataaacagtttc

SEQ ID NO: 105326 - DNA, 42 bp, Artificial Sequence
  Description of Artificial Sequence: Synthetic oligonucleotide
gccttaagctctgcatgtctttaatgcagaataaacagtttc

SEQ ID NO: 105327 - DNA, 42 bp, Artificial Sequence
  Description of Artificial Sequence: Synthetic oligonucleotide
ccttaagctctgcatgtctttaatgcagaataaacagtttcg

SEQ ID NO: 105328 - DNA, 42 bp, Artificial Sequence
  Description of Artificial Sequence: Synthetic oligonucleotide
cttaagctctgcatgtctttaatgcagaataaacagtttcgg

SEQ ID NO: 105329 - DNA, 48 bp, Artificial Sequence
  Description of Artificial Sequence: Synthetic oligonucleotide
ttaagctctgcatgtctttaatgcagaataaacagtttcggaataaag

SEQ ID NO: 105330 - DNA, 47 bp, Artificial Sequence
  Description of Artificial Sequence: Synthetic oligonucleotide
taagctctgcatgtctttaatgcagaataaacagtttcggaataaag

SEQ ID NO: 105331 - DNA, 46 bp, Artificial Sequence
  Description of Artificial Sequence: Synthetic oligonucleotide
aagctctgcatgtctttaatgcagaataaacagtttcggaataaag

SEQ ID NO: 105332 - DNA, 45 bp, Artificial Sequence
  Description of Artificial Sequence: Synthetic oligonucleotide
agctctgcatgtctttaatgcagaataaacagtttcggaataaag

SEQ ID NO: 105333 - DNA, 44 bp, Artificial Sequence
  Description of Artificial Sequence: Synthetic oligonucleotide
gctctgcatgtctttaatgcagaataaacagtttcggaataaag

SEQ ID NO: 105334 - DNA, 46 bp, Artificial Sequence
  Description of Artificial Sequence: Synthetic oligonucleotide
ctctgcatgtctttaatgcagaataaacagtttcggaataaagtac

SEQ ID NO: 105335 - DNA, 49 bp, Artificial Sequence
  Description of Artificial Sequence: Synthetic oligonucleotide
tctgcatgtctttaatgcagaataaacagtttcggaataaagtactaag

SEQ ID NO: 105336 - DNA, 48 bp, Artificial Sequence
  Description of Artificial Sequence: Synthetic oligonucleotide
ctgcatgtctttaatgcagaataaacagtttcggaataaagtactaag

SEQ ID NO: 105337 - DNA, 49 bp, Artificial Sequence
  Description of Artificial Sequence: Synthetic oligonucleotide
tgcatgtctttaatgcagaataaacagtttcggaataaagtactaagag

SEQ ID NO: 105338 - DNA, 48 bp, Artificial Sequence
  Description of Artificial Sequence: Synthetic oligonucleotide
gcatgtctttaatgcagaataaacagtttcggaataaagtactaagag

SEQ ID NO: 105339 - DNA, 50 bp, Artificial Sequence
  Description of Artificial Sequence: Synthetic oligonucleotide
catgtctttaatgcagaataaacagtttcggaataaagtactaagagttc

SEQ ID NO: 105340 - DNA, 52 bp, Artificial Sequence
  Description of Artificial Sequence: Synthetic oligonucleotide
atgtctttaatgcagaataaacagtttcggaataaagtactaagagttctag

SEQ ID NO: 105341 - DNA, 51 bp, Artificial Sequence
  Description of Artificial Sequence: Synthetic oligonucleotide
tgtctttaatgcagaataaacagtttcggaataaagtactaagagttctag

SEQ ID NO: 105342 - DNA, 50 bp, Artificial Sequence
  Description of Artificial Sequence: Synthetic oligonucleotide
gtctttaatgcagaataaacagtttcggaataaagtactaagagttctag

SEQ ID NO: 105343 - DNA, 57 bp, Artificial Sequence
  Description of Artificial Sequence: Synthetic oligonucleotide
tctttaatgcagaataaacagtttcggaataaagtactaagagttctagttaaaatc

SEQ ID NO: 105344 - DNA, 56 bp, Artificial Sequence
  Description of Artificial Sequence: Synthetic oligonucleotide
ctttaatgcagaataaacagtttcggaataaagtactaagagttctagttaaaatc

SEQ ID NO: 105345 - DNA, 58 bp, Artificial Sequence
  Description of Artificial Sequence: Synthetic oligonucleotide
tttaatgcagaataaacagtttcggaataaagtactaagagttctagttaaaatctac

SEQ ID NO: 105346 - DNA, 57 bp, Artificial Sequence
  Description of Artificial Sequence: Synthetic oligonucleotide
ttaatgcagaataaacagtttcggaataaagtactaagagttctagttaaaatctac

SEQ ID NO: 105347 - DNA, 56 bp, Artificial Sequence
  Description of Artificial Sequence: Synthetic oligonucleotide
taatgcagaataaacagtttcggaataaagtactaagagttctagttaaaatctac

SEQ ID NO: 105348 - DNA, 55 bp, Artificial Sequence
  Description of Artificial Sequence: Synthetic oligonucleotide
aatgcagaataaacagtttcggaataaagtactaagagttctagttaaaatctac

SEQ ID NO: 105349 - DNA, 54 bp, Artificial Sequence
  Description of Artificial Sequence: Synthetic oligonucleotide
atgcagaataaacagtttcggaataaagtactaagagttctagttaaaatctac

SEQ ID NO: 105350 - DNA, 53 bp, Artificial Sequence
  Description of Artificial Sequence: Synthetic oligonucleotide
tgcagaataaacagtttcggaataaagtactaagagttctagttaaaatctac

SEQ ID NO: 105351 - DNA, 52 bp, Artificial Sequence
  Description of Artificial Sequence: Synthetic oligonucleotide
gcagaataaacagtttcggaataaagtactaagagttctagttaaaatctac

SEQ ID NO: 105352 - DNA, 54 bp, Artificial Sequence
  Description of Artificial Sequence: Synthetic oligonucleotide
cagaataaacagtttcggaataaagtactaagagttctagttaaaatctacatg

SEQ ID NO: 105353 - DNA, 56 bp, Artificial Sequence
  Description of Artificial Sequence: Synthetic oligonucleotide
agaataaacagtttcggaataaagtactaagagttctagttaaaatctacatgaac

SEQ ID NO: 105354 - DNA, 55 bp, Artificial Sequence
  Description of Artificial Sequence: Synthetic oligonucleotide
gaataaacagtttcggaataaagtactaagagttctagttaaaatctacatgaac

SEQ ID NO: 105355 - DNA, 57 bp, Artificial Sequence
  Description of Artificial Sequence: Synthetic oligonucleotide
aataaacagtttcggaataaagtactaagagttctagttaaaatctacatgaacttg

SEQ ID NO: 105356 - DNA, 56 bp, Artificial Sequence
  Description of Artificial Sequence: Synthetic oligonucleotide
ataaacagtttcggaataaagtactaagagttctagttaaaatctacatgaacttg

SEQ ID NO: 105357 - DNA, 55 bp, Artificial Sequence
  Description of Artificial Sequence: Synthetic oligonucleotide
taaacagtttcggaataaagtactaagagttctagttaaaatctacatgaacttg

SEQ ID NO: 105358 - DNA, 54 bp, Artificial Sequence
  Description of Artificial Sequence: Synthetic oligonucleotide
aaacagtttcggaataaagtactaagagttctagttaaaatctacatgaacttg

SEQ ID NO: 105359 - DNA, 53 bp, Artificial Sequence
  Description of Artificial Sequence: Synthetic oligonucleotide
aacagtttcggaataaagtactaagagttctagttaaaatctacatgaacttg

SEQ ID NO: 105360 - DNA, 52 bp, Artificial Sequence
  Description of Artificial Sequence: Synthetic oligonucleotide
acagtttcggaataaagtactaagagttctagttaaaatctacatgaacttg

SEQ ID NO: 105361 - DNA, 51 bp, Artificial Sequence
  Description of Artificial Sequence: Synthetic oligonucleotide
cagtttcggaataaagtactaagagttctagttaaaatctacatgaacttg

SEQ ID NO: 105362 - DNA, 51 bp, Artificial Sequence
  Description of Artificial Sequence: Synthetic oligonucleotide
agtttcggaataaagtactaagagttctagttaaaatctacatgaacttgg

SEQ ID NO: 105363 - DNA, 50 bp, Artificial Sequence
  Description of Artificial Sequence: Synthetic oligonucleotide
gtttcggaataaagtactaagagttctagttaaaatctacatgaacttgg

SEQ ID NO: 105364 - DNA, 51 bp, Artificial Sequence
  Description of Artificial Sequence: Synthetic oligonucleotide
tttcggaataaagtactaagagttctagttaaaatctacatgaacttggag

SEQ ID NO: 105365 - DNA, 50 bp, Artificial Sequence
  Description of Artificial Sequence: Synthetic oligonucleotide
ttcggaataaagtactaagagttctagttaaaatctacatgaacttggag

SEQ ID NO: 105366 - DNA, 49 bp, Artificial Sequence
  Description of Artificial Sequence: Synthetic oligonucleotide
tcggaataaagtactaagagttctagttaaaatctacatgaacttggag

SEQ ID NO: 105367 - DNA, 48 bp, Artificial Sequence
  Description of Artificial Sequence: Synthetic oligonucleotide
cggaataaagtactaagagttctagttaaaatctacatgaacttggag

SEQ ID NO: 105368 - DNA, 51 bp, Artificial Sequence
  Description of Artificial Sequence: Synthetic oligonucleotide
ggaataaagtactaagagttctagttaaaatctacatgaacttggagaaac

SEQ ID NO: 105369 - DNA, 51 bp, Artificial Sequence
  Description of Artificial Sequence: Synthetic oligonucleotide
gaataaagtactaagagttctagttaaaatctacatgaacttggagaaacc

SEQ ID NO: 105370 - DNA, 52 bp, Artificial Sequence
  Description of Artificial Sequence: Synthetic oligonucleotide
aataaagtactaagagttctagttaaaatctacatgaacttggagaaacctg

SEQ ID NO: 105371 - DNA, 51 bp, Artificial Sequence
  Description of Artificial Sequence: Synthetic oligonucleotide
ataaagtactaagagttctagttaaaatctacatgaacttggagaaacctg

SEQ ID NO: 105372 - DNA, 50 bp, Artificial Sequence
  Description of Artificial Sequence: Synthetic oligonucleotide
taaagtactaagagttctagttaaaatctacatgaacttggagaaacctg

SEQ ID NO: 105373 - DNA, 49 bp, Artificial Sequence
  Description of Artificial Sequence: Synthetic oligonucleotide
aaagtactaagagttctagttaaaatctacatgaacttggagaaacctg

SEQ ID NO: 105374 - DNA, 48 bp, Artificial Sequence
  Description of Artificial Sequence: Synthetic oligonucleotide
aagtactaagagttctagttaaaatctacatgaacttggagaaacctg

SEQ ID NO: 105375 - DNA, 47 bp, Artificial Sequence
  Description of Artificial Sequence: Synthetic oligonucleotide
agtactaagagttctagttaaaatctacatgaacttggagaaacctg

SEQ ID NO: 105376 - DNA, 46 bp, Artificial Sequence
  Description of Artificial Sequence: Synthetic oligonucleotide
gtactaagagttctagttaaaatctacatgaacttggagaaacctg

SEQ ID NO: 105377 - DNA, 50 bp, Artificial Sequence
  Description of Artificial Sequence: Synthetic oligonucleotide
tactaagagttctagttaaaatctacatgaacttggagaaacctgatttc

SEQ ID NO: 105378 - DNA, 49 bp, Artificial Sequence
  Description of Artificial Sequence: Synthetic oligonucleotide
actaagagttctagttaaaatctacatgaacttggagaaacctgatttc

SEQ ID NO: 105379 - DNA, 48 bp, Artificial Sequence
  Description of Artificial Sequence: Synthetic oligonucleotide
ctaagagttctagttaaaatctacatgaacttggagaaacctgatttc

SEQ ID NO: 105380 - DNA, 50 bp, Artificial Sequence
  Description of Artificial Sequence: Synthetic oligonucleotide
taagagttctagttaaaatctacatgaacttggagaaacctgatttcatc

SEQ ID NO: 105381 - DNA, 49 bp, Artificial Sequence
  Description of Artificial Sequence: Synthetic oligonucleotide
aagagttctagttaaaatctacatgaacttggagaaacctgatttcatc

SEQ ID NO: 105382 - DNA, 48 bp, Artificial Sequence
  Description of Artificial Sequence: Synthetic oligonucleotide
agagttctagttaaaatctacatgaacttggagaaacctgatttcatc

SEQ ID NO: 105383 - DNA, 47 bp, Artificial Sequence
  Description of Artificial Sequence: Synthetic oligonucleotide
gagttctagttaaaatctacatgaacttggagaaacctgatttcatc

SEQ ID NO: 105384 - DNA, 50 bp, Artificial Sequence
  Description of Artificial Sequence: Synthetic oligonucleotide
agttctagttaaaatctacatgaacttggagaaacctgatttcatcaatg

SEQ ID NO: 105385 - DNA, 49 bp, Artificial Sequence
  Description of Artificial Sequence: Synthetic oligonucleotide
gttctagttaaaatctacatgaacttggagaaacctgatttcatcaatg

SEQ ID NO: 105386 - DNA, 52 bp, Artificial Sequence
  Description of Artificial Sequence: Synthetic oligonucleotide
ttctagttaaaatctacatgaacttggagaaacctgatttcatcaatgtttg

SEQ ID NO: 105387 - DNA, 51 bp, Artificial Sequence
  Description of Artificial Sequence: Synthetic oligonucleotide
tctagttaaaatctacatgaacttggagaaacctgatttcatcaatgtttg

SEQ ID NO: 105388 - DNA, 50 bp, Artificial Sequence
  Description of Artificial Sequence: Synthetic oligonucleotide
ctagttaaaatctacatgaacttggagaaacctgatttcatcaatgtttg

SEQ ID NO: 105389 - DNA, 51 bp, Artificial Sequence
  Description of Artificial Sequence: Synthetic oligonucleotide
tagttaaaatctacatgaacttggagaaacctgatttcatcaatgtttgtc

SEQ ID NO: 105390 - DNA, 50 bp, Artificial Sequence
  Description of Artificial Sequence: Synthetic oligonucleotide
agttaaaatctacatgaacttggagaaacctgatttcatcaatgtttgtc

SEQ ID NO: 105391 - DNA, 49 bp, Artificial Sequence
  Description of Artificial Sequence: Synthetic oligonucleotide
gttaaaatctacatgaacttggagaaacctgatttcatcaatgtttgtc

SEQ ID NO: 105392 - DNA, 50 bp, Artificial Sequence
  Description of Artificial Sequence: Synthetic oligonucleotide
ttaaaatctacatgaacttggagaaacctgatttcatcaatgtttgtcag

SEQ ID NO: 105393 - DNA, 49 bp, Artificial Sequence
  Description of Artificial Sequence: Synthetic oligonucleotide
taaaatctacatgaacttggagaaacctgatttcatcaatgtttgtcag

SEQ ID NO: 105394 - DNA, 48 bp, Artificial Sequence
  Description of Artificial Sequence: Synthetic oligonucleotide
aaaatctacatgaacttggagaaacctgatttcatcaatgtttgtcag

SEQ ID NO: 105395 - DNA, 47 bp, Artificial Sequence
  Description of Artificial Sequence: Synthetic oligonucleotide
aaatctacatgaacttggagaaacctgatttcatcaatgtttgtcag

SEQ ID NO: 105396 - DNA, 46 bp, Artificial Sequence
  Description of Artificial Sequence: Synthetic oligonucleotide
aatctacatgaacttggagaaacctgatttcatcaatgtttgtcag

SEQ ID NO: 105397 - DNA, 45 bp, Artificial Sequence
  Description of Artificial Sequence: Synthetic oligonucleotide
atctacatgaacttggagaaacctgatttcatcaatgtttgtcag

SEQ ID NO: 105398 - DNA, 44 bp, Artificial Sequence
  Description of Artificial Sequence: Synthetic oligonucleotide
tctacatgaacttggagaaacctgatttcatcaatgtttgtcag

SEQ ID NO: 105399 - DNA, 43 bp, Artificial Sequence
  Description of Artificial Sequence: Synthetic oligonucleotide
ctacatgaacttggagaaacctgatttcatcaatgtttgtcag

SEQ ID NO: 105400 - DNA, 44 bp, Artificial Sequence
  Description of Artificial Sequence: Synthetic oligonucleotide
tacatgaacttggagaaacctgatttcatcaatgtttgtcagtg

SEQ ID NO: 105401 - DNA, 43 bp, Artificial Sequence
  Description of Artificial Sequence: Synthetic oligonucleotide
acatgaacttggagaaacctgatttcatcaatgtttgtcagtg

SEQ ID NO: 105402 - DNA, 42 bp, Artificial Sequence
  Description of Artificial Sequence: Synthetic oligonucleotide
catgaacttggagaaacctgatttcatcaatgtttgtcagtg

SEQ ID NO: 105403 - DNA, 42 bp, Artificial Sequence
  Description of Artificial Sequence: Synthetic oligonucleotide
atgaacttggagaaacctgatttcatcaatgtttgtcagtgc

SEQ ID NO: 105404 - DNA, 41 bp, Artificial Sequence
  Description of Artificial Sequence: Synthetic oligonucleotide
tgaacttggagaaacctgatttcatcaatgtttgtcagtgc

SEQ ID NO: 105405 - DNA, 40 bp, Artificial Sequence
  Description of Artificial Sequence: Synthetic oligonucleotide
gaacttggagaaacctgatttcatcaatgtttgtcagtgc

SEQ ID NO: 105406 - DNA, 48 bp, Artificial Sequence
  Description of Artificial Sequence: Synthetic oligonucleotide
aacttggagaaacctgatttcatcaatgtttgtcagtgcttaattttc

SEQ ID NO: 105407 - DNA, 47 bp, Artificial Sequence
  Description of Artificial Sequence: Synthetic oligonucleotide
acttggagaaacctgatttcatcaatgtttgtcagtgcttaattttc

SEQ ID NO: 105408 - DNA, 46 bp, Artificial Sequence
  Description of Artificial Sequence: Synthetic oligonucleotide
cttggagaaacctgatttcatcaatgtttgtcagtgcttaattttc

SEQ ID NO: 105409 - DNA, 49 bp, Artificial Sequence
  Description of Artificial Sequence: Synthetic oligonucleotide
ttggagaaacctgatttcatcaatgtttgtcagtgcttaattttcttag

SEQ ID NO: 105410 - DNA, 48 bp, Artificial Sequence
  Description of Artificial Sequence: Synthetic oligonucleotide
tggagaaacctgatttcatcaatgtttgtcagtgcttaattttcttag

SEQ ID NO: 105411 - DNA, 47 bp, Artificial Sequence
  Description of Artificial Sequence: Synthetic oligonucleotide
ggagaaacctgatttcatcaatgtttgtcagtgcttaattttcttag

SEQ ID NO: 105412 - DNA, 49 bp, Artificial Sequence
  Description of Artificial Sequence: Synthetic oligonucleotide
gagaaacctgatttcatcaatgtttgtcagtgcttaattttcttagatg

SEQ ID NO: 105413 - DNA, 51 bp, Artificial Sequence
  Description of Artificial Sequence: Synthetic oligonucleotide
agaaacctgatttcatcaatgtttgtcagtgcttaattttcttagatgatc

SEQ ID NO: 105414 - DNA, 50 bp, Artificial Sequence
  Description of Artificial Sequence: Synthetic oligonucleotide
gaaacctgatttcatcaatgtttgtcagtgcttaattttcttagatgatc

SEQ ID NO: 105415 - DNA, 50 bp, Artificial Sequence
  Description of Artificial Sequence: Synthetic oligonucleotide
aaacctgatttcatcaatgtttgtcagtgcttaattttcttagatgatcc

SEQ ID NO: 105416 - DNA, 49 bp, Artificial Sequence
  Description of Artificial Sequence: Synthetic oligonucleotide
aacctgatttcatcaatgtttgtcagtgcttaattttcttagatgatcc

SEQ ID NO: 105417 - DNA, 48 bp, Artificial Sequence
  Description of Artificial Sequence: Synthetic oligonucleotide
acctgatttcatcaatgtttgtcagtgcttaattttcttagatgatcc

SEQ ID NO: 105418 - DNA, 47 bp, Artificial Sequence
  Description of Artificial Sequence: Synthetic oligonucleotide
cctgatttcatcaatgtttgtcagtgcttaattttcttagatgatcc

SEQ ID NO: 105419 - DNA, 48 bp, Artificial Sequence
  Description of Artificial Sequence: Synthetic oligonucleotide
ctgatttcatcaatgtttgtcagtgcttaattttcttagatgatcctc

SEQ ID NO: 105420 - DNA, 49 bp, Artificial Sequence
  Description of Artificial Sequence: Synthetic oligonucleotide
tgatttcatcaatgtttgtcagtgcttaattttcttagatgatcctcag

SEQ ID NO: 105421 - DNA, 48 bp, Artificial Sequence
  Description of Artificial Sequence: Synthetic oligonucleotide
gatttcatcaatgtttgtcagtgcttaattttcttagatgatcctcag

SEQ ID NO: 105422 - DNA, 48 bp, Artificial Sequence
  Description of Artificial Sequence: Synthetic oligonucleotide
atttcatcaatgtttgtcagtgcttaattttcttagatgatcctcagg

SEQ ID NO: 105423 - DNA, 47 bp, Artificial Sequence
  Description of Artificial Sequence: Synthetic oligonucleotide
tttcatcaatgtttgtcagtgcttaattttcttagatgatcctcagg

SEQ ID NO: 105424 - DNA, 46 bp, Artificial Sequence
  Description of Artificial Sequence: Synthetic oligonucleotide
ttcatcaatgtttgtcagtgcttaattttcttagatgatcctcagg

SEQ ID NO: 105425 - DNA, 45 bp, Artificial Sequence
  Description of Artificial Sequence: Synthetic oligonucleotide
tcatcaatgtttgtcagtgcttaattttcttagatgatcctcagg

SEQ ID NO: 105426 - DNA, 44 bp, Artificial Sequence
  Description of Artificial Sequence: Synthetic oligonucleotide
catcaatgtttgtcagtgcttaattttcttagatgatcctcagg

SEQ ID NO: 105427 - DNA, 44 bp, Artificial Sequence
  Description of Artificial Sequence: Synthetic oligonucleotide
atcaatgtttgtcagtgcttaattttcttagatgatcctcaggc

SEQ ID NO: 105428 - DNA, 43 bp, Artificial Sequence
  Description of Artificial Sequence: Synthetic oligonucleotide
tcaatgtttgtcagtgcttaattttcttagatgatcctcaggc

SEQ ID NO: 105429 - DNA, 42 bp, Artificial Sequence
  Description of Artificial Sequence: Synthetic oligonucleotide
caatgtttgtcagtgcttaattttcttagatgatcctcaggc

SEQ ID NO: 105430 - DNA, 43 bp, Artificial Sequence
  Description of Artificial Sequence: Synthetic oligonucleotide
aatgtttgtcagtgcttaattttcttagatgatcctcaggctg

SEQ ID NO: 105431 - DNA, 42 bp, Artificial Sequence
  Description of Artificial Sequence: Synthetic oligonucleotide
atgtttgtcagtgcttaattttcttagatgatcctcaggctg

SEQ ID NO: 105432 - DNA, 41 bp, Artificial Sequence
  Description of Artificial Sequence: Synthetic oligonucleotide
tgtttgtcagtgcttaattttcttagatgatcctcaggctg

SEQ ID NO: 105433 - DNA, 40 bp, Artificial Sequence
  Description of Artificial Sequence: Synthetic oligonucleotide
gtttgtcagtgcttaattttcttagatgatcctcaggctg

SEQ ID NO: 105434 - DNA, 41 bp, Artificial Sequence
  Description of Artificial Sequence: Synthetic oligonucleotide
tttgtcagtgcttaattttcttagatgatcctcaggctgtg

SEQ ID NO: 105435 - DNA, 40 bp, Artificial Sequence
  Description of Artificial Sequence: Synthetic oligonucleotide
ttgtcagtgcttaattttcttagatgatcctcaggctgtg

SEQ ID NO: 105436 - DNA, 39 bp, Artificial Sequence
  Description of Artificial Sequence: Synthetic oligonucleotide
tgtcagtgcttaattttcttagatgatcctcaggctgtg

SEQ ID NO: 105437 - DNA, 38 bp, Artificial Sequence
  Description of Artificial Sequence: Synthetic oligonucleotide
gtcagtgcttaattttcttagatgatcctcaggctgtg

SEQ ID NO: 105438 - DNA, 39 bp, Artificial Sequence
  Description of Artificial Sequence: Synthetic oligonucleotide
tcagtgcttaattttcttagatgatcctcaggctgtgag

SEQ ID NO: 105439 - DNA, 38 bp, Artificial Sequence
  Description of Artificial Sequence: Synthetic oligonucleotide
cagtgcttaattttcttagatgatcctcaggctgtgag

SEQ ID NO: 105440 - DNA, 39 bp, Artificial Sequence
  Description of Artificial Sequence: Synthetic oligonucleotide
agtgcttaattttcttagatgatcctcaggctgtgagtg

SEQ ID NO: 105441 - DNA, 38 bp, Artificial Sequence
  Description of Artificial Sequence: Synthetic oligonucleotide
gtgcttaattttcttagatgatcctcaggctgtgagtg

SEQ ID NO: 105442 - DNA, 42 bp, Artificial Sequence
  Description of Artificial Sequence: Synthetic oligonucleotide
tgcttaattttcttagatgatcctcaggctgtgagtgatatc

SEQ ID NO: 105443 - DNA, 41 bp, Artificial Sequence
  Description of Artificial Sequence: Synthetic oligonucleotide
gcttaattttcttagatgatcctcaggctgtgagtgatatc

SEQ ID NO: 105444 - DNA, 44 bp, Artificial Sequence
  Description of Artificial Sequence: Synthetic oligonucleotide
cttaattttcttagatgatcctcaggctgtgagtgatatcttag

SEQ ID NO: 105445 - DNA, 45 bp, Artificial Sequence
  Description of Artificial Sequence: Synthetic oligonucleotide
ttaattttcttagatgatcctcaggctgtgagtgatatcttagag

SEQ ID NO: 105446 - DNA, 44 bp, Artificial Sequence
  Description of Artificial Sequence: Synthetic oligonucleotide
taattttcttagatgatcctcaggctgtgagtgatatcttagag

SEQ ID NO: 105447 - DNA, 43 bp, Artificial Sequence
  Description of Artificial Sequence: Synthetic oligonucleotide
aattttcttagatgatcctcaggctgtgagtgatatcttagag

SEQ ID NO: 105448 - DNA, 42 bp, Artificial Sequence
  Description of Artificial Sequence: Synthetic oligonucleotide
attttcttagatgatcctcaggctgtgagtgatatcttagag

SEQ ID NO: 105449 - DNA, 41 bp, Artificial Sequence
  Description of Artificial Sequence: Synthetic oligonucleotide
ttttcttagatgatcctcaggctgtgagtgatatcttagag

SEQ ID NO: 105450 - DNA, 40 bp, Artificial Sequence
  Description of Artificial Sequence: Synthetic oligonucleotide
tttcttagatgatcctcaggctgtgagtgatatcttagag

SEQ ID NO: 105451 - DNA, 39 bp, Artificial Sequence
  Description of Artificial Sequence: Synthetic oligonucleotide
ttcttagatgatcctcaggctgtgagtgatatcttagag

SEQ ID NO: 105452 - DNA, 38 bp, Artificial Sequence
  Description of Artificial Sequence: Synthetic oligonucleotide
tcttagatgatcctcaggctgtgagtgatatcttagag

SEQ ID NO: 105453 - DNA, 37 bp, Artificial Sequence
  Description of Artificial Sequence: Synthetic oligonucleotide
cttagatgatcctcaggctgtgagtgatatcttagag

SEQ ID NO: 105454 - DNA, 40 bp, Artificial Sequence
  Description of Artificial Sequence: Synthetic oligonucleotide
ttagatgatcctcaggctgtgagtgatatcttagagaaac

SEQ ID NO: 105455 - DNA, 39 bp, Artificial Sequence
  Description of Artificial Sequence: Synthetic oligonucleotide
tagatgatcctcaggctgtgagtgatatcttagagaaac

SEQ ID NO: 105456 - DNA, 38 bp, Artificial Sequence
  Description of Artificial Sequence: Synthetic oligonucleotide
agatgatcctcaggctgtgagtgatatcttagagaaac

SEQ ID NO: 105457 - DNA, 37 bp, Artificial Sequence
  Description of Artificial Sequence: Synthetic oligonucleotide
gatgatcctcaggctgtgagtgatatcttagagaaac

SEQ ID NO: 105458 - DNA, 38 bp, Artificial Sequence
  Description of Artificial Sequence: Synthetic oligonucleotide
atgatcctcaggctgtgagtgatatcttagagaaactg

SEQ ID NO: 105459 - DNA, 37 bp, Artificial Sequence
  Description of Artificial Sequence: Synthetic oligonucleotide
tgatcctcaggctgtgagtgatatcttagagaaactg

SEQ ID NO: 105460 - DNA, 36 bp, Artificial Sequence
  Description of Artificial Sequence: Synthetic oligonucleotide
gatcctcaggctgtgagtgatatcttagagaaactg

SEQ ID NO: 105461 - DNA, 36 bp, Artificial Sequence
  Description of Artificial Sequence: Synthetic oligonucleotide
atcctcaggctgtgagtgatatcttagagaaactgg

SEQ ID NO: 105462 - DNA, 35 bp, Artificial Sequence
  Description of Artificial Sequence: Synthetic oligonucleotide
tcctcaggctgtgagtgatatcttagagaaactgg

SEQ ID NO: 105463 - DNA, 34 bp, Artificial Sequence
  Description of Artificial Sequence: Synthetic oligonucleotide
cctcaggctgtgagtgatatcttagagaaactgg

SEQ ID NO: 105464 - DNA, 38 bp, Artificial Sequence
  Description of Artificial Sequence: Synthetic oligonucleotide
ctcaggctgtgagtgatatcttagagaaactggtaaag

SEQ ID NO: 105465 - DNA, 38 bp, Artificial Sequence
  Description of Artificial Sequence: Synthetic oligonucleotide
tcaggctgtgagtgatatcttagagaaactggtaaagg

SEQ ID NO: 105466 - DNA, 37 bp, Artificial Sequence
  Description of Artificial Sequence: Synthetic oligonucleotide
caggctgtgagtgatatcttagagaaactggtaaagg

SEQ ID NO: 105467 - DNA, 39 bp, Artificial Sequence
  Description of Artificial Sequence: Synthetic oligonucleotide
aggctgtgagtgatatcttagagaaactggtaaaggaag

SEQ ID NO: 105468 - DNA, 38 bp, Artificial Sequence
  Description of Artificial Sequence: Synthetic oligonucleotide
ggctgtgagtgatatcttagagaaactggtaaaggaag

SEQ ID NO: 105469 - DNA, 39 bp, Artificial Sequence
  Description of Artificial Sequence: Synthetic oligonucleotide
gctgtgagtgatatcttagagaaactggtaaaggaagac

SEQ ID NO: 105470 - DNA, 41 bp, Artificial Sequence
  Description of Artificial Sequence: Synthetic oligonucleotide
ctgtgagtgatatcttagagaaactggtaaaggaagacaac

SEQ ID NO: 105471 - DNA, 41 bp, Artificial Sequence
  Description of Artificial Sequence: Synthetic oligonucleotide
tgtgagtgatatcttagagaaactggtaaaggaagacaacc

SEQ ID NO: 105472 - DNA, 40 bp, Artificial Sequence
  Description of Artificial Sequence: Synthetic oligonucleotide
gtgagtgatatcttagagaaactggtaaaggaagacaacc

SEQ ID NO: 105473 - DNA, 41 bp, Artificial Sequence
  Description of Artificial Sequence: Synthetic oligonucleotide
tgagtgatatcttagagaaactggtaaaggaagacaacctc

SEQ ID NO: 105474 - DNA, 40 bp, Artificial Sequence
  Description of Artificial Sequence: Synthetic oligonucleotide
gagtgatatcttagagaaactggtaaaggaagacaacctc

SEQ ID NO: 105475 - DNA, 40 bp, Artificial Sequence
  Description of Artificial Sequence: Synthetic oligonucleotide
agtgatatcttagagaaactggtaaaggaagacaacctcc

SEQ ID NO: 105476 - DNA, 39 bp, Artificial Sequence
  Description of Artificial Sequence: Synthetic oligonucleotide
gtgatatcttagagaaactggtaaaggaagacaacctcc

SEQ ID NO: 105477 - DNA, 40 bp, Artificial Sequence
  Description of Artificial Sequence: Synthetic oligonucleotide
tgatatcttagagaaactggtaaaggaagacaacctcctg

SEQ ID NO: 105478 - DNA, 39 bp, Artificial Sequence
  Description of Artificial Sequence: Synthetic oligonucleotide
gatatcttagagaaactggtaaaggaagacaacctcctg

SEQ ID NO: 105479 - DNA, 41 bp, Artificial Sequence
  Description of Artificial Sequence: Synthetic oligonucleotide
atatcttagagaaactggtaaaggaagacaacctcctgatg

SEQ ID NO: 105480 - DNA, 40 bp, Artificial Sequence
  Description of Artificial Sequence: Synthetic oligonucleotide
tatcttagagaaactggtaaaggaagacaacctcctgatg

SEQ ID NO: 105481 - DNA, 39 bp, Artificial Sequence
  Description of Artificial Sequence: Synthetic oligonucleotide
atcttagagaaactggtaaaggaagacaacctcctgatg

SEQ ID NO: 105482 - DNA, 38 bp, Artificial Sequence
  Description of Artificial Sequence: Synthetic oligonucleotide
tcttagagaaactggtaaaggaagacaacctcctgatg

SEQ ID NO: 105483 - DNA, 37 bp, Artificial Sequence
  Description of Artificial Sequence: Synthetic oligonucleotide
cttagagaaactggtaaaggaagacaacctcctgatg

SEQ ID NO: 105484 - DNA, 37 bp, Artificial Sequence
  Description of Artificial Sequence: Synthetic oligonucleotide
ttagagaaactggtaaaggaagacaacctcctgatgg

SEQ ID NO: 105485 - DNA, 36 bp, Artificial Sequence
  Description of Artificial Sequence: Synthetic oligonucleotide
tagagaaactggtaaaggaagacaacctcctgatgg

SEQ ID NO: 105486 - DNA, 35 bp, Artificial Sequence
  Description of Artificial Sequence: Synthetic oligonucleotide
agagaaactggtaaaggaagacaacctcctgatgg

SEQ ID NO: 105487 - DNA, 34 bp, Artificial Sequence
  Description of Artificial Sequence: Synthetic oligonucleotide
gagaaactggtaaaggaagacaacctcctgatgg

SEQ ID NO: 105488 - DNA, 34 bp, Artificial Sequence
  Description of Artificial Sequence: Synthetic oligonucleotide
agaaactggtaaaggaagacaacctcctgatggc

SEQ ID NO: 105489 - DNA, 33 bp, Artificial Sequence
  Description of Artificial Sequence: Synthetic oligonucleotide
gaaactggtaaaggaagacaacctcctgatggc

SEQ ID NO: 105490 - DNA, 37 bp, Artificial Sequence
  Description of Artificial Sequence: Synthetic oligonucleotide
aaactggtaaaggaagacaacctcctgatggcatatc

SEQ ID NO: 105491 - DNA, 36 bp, Artificial Sequence
  Description of Artificial Sequence: Synthetic oligonucleotide
aactggtaaaggaagacaacctcctgatggcatatc

SEQ ID NO: 105492 - DNA, 35 bp, Artificial Sequence
  Description of Artificial Sequence: Synthetic oligonucleotide
actggtaaaggaagacaacctcctgatggcatatc

SEQ ID NO: 105493 - DNA, 34 bp, Artificial Sequence
  Description of Artificial Sequence: Synthetic oligonucleotide
ctggtaaaggaagacaacctcctgatggcatatc

SEQ ID NO: 105494 - DNA, 35 bp, Artificial Sequence
  Description of Artificial Sequence: Synthetic oligonucleotide
tggtaaaggaagacaacctcctgatggcatatcag

SEQ ID NO: 105495 - DNA, 34 bp, Artificial Sequence
  Description of Artificial Sequence: Synthetic oligonucleotide
ggtaaaggaagacaacctcctgatggcatatcag

SEQ ID NO: 105496 - DNA, 38 bp, Artificial Sequence
  Description of Artificial Sequence: Synthetic oligonucleotide
gtaaaggaagacaacctcctgatggcatatcagatttg

SEQ ID NO: 105497 - DNA, 42 bp, Artificial Sequence
  Description of Artificial Sequence: Synthetic oligonucleotide
taaaggaagacaacctcctgatggcatatcagatttgttttg

SEQ ID NO: 105498 - DNA, 41 bp, Artificial Sequence
  Description of Artificial Sequence: Synthetic oligonucleotide
aaaggaagacaacctcctgatggcatatcagatttgttttg

SEQ ID NO: 105499 - DNA, 40 bp, Artificial Sequence
  Description of Artificial Sequence: Synthetic oligonucleotide
aaggaagacaacctcctgatggcatatcagatttgttttg

SEQ ID NO: 105500 - DNA, 39 bp, Artificial Sequence
  Description of Artificial Sequence: Synthetic oligonucleotide
aggaagacaacctcctgatggcatatcagatttgttttg

SEQ ID NO: 105501 - DNA, 38 bp, Artificial Sequence
  Description of Artificial Sequence: Synthetic oligonucleotide
ggaagacaacctcctgatggcatatcagatttgttttg

SEQ ID NO: 105502 - DNA, 42 bp, Artificial Sequence
  Description of Artificial Sequence: Synthetic oligonucleotide
gaagacaacctcctgatggcatatcagatttgttttgatttg

SEQ ID NO: 105503 - DNA, 45 bp, Artificial Sequence
  Description of Artificial Sequence: Synthetic oligonucleotide
aagacaacctcctgatggcatatcagatttgttttgatttgtatg

SEQ ID NO: 105504 - DNA, 44 bp, Artificial Sequence
  Description of Artificial Sequence: Synthetic oligonucleotide
agacaacctcctgatggcatatcagatttgttttgatttgtatg

SEQ ID NO: 105505 - DNA, 43 bp, Artificial Sequence
  Description of Artificial Sequence: Synthetic oligonucleotide
gacaacctcctgatggcatatcagatttgttttgatttgtatg

SEQ ID NO: 105506 - DNA, 46 bp, Artificial Sequence
  Description of Artificial Sequence: Synthetic oligonucleotide
acaacctcctgatggcatatcagatttgttttgatttgtatgaaag

SEQ ID NO: 105507 - DNA, 45 bp, Artificial Sequence
  Description of Artificial Sequence: Synthetic oligonucleotide
caacctcctgatggcatatcagatttgttttgatttgtatgaaag

SEQ ID NO: 105508 - DNA, 46 bp, Artificial Sequence
  Description of Artificial Sequence: Synthetic oligonucleotide
aacctcctgatggcatatcagatttgttttgatttgtatgaaagtg

SEQ ID NO: 105509 - DNA, 45 bp, Artificial Sequence
  Description of Artificial Sequence: Synthetic oligonucleotide
acctcctgatggcatatcagatttgttttgatttgtatgaaagtg

SEQ ID NO: 105510 - DNA, 44 bp, Artificial Sequence
  Description of Artificial Sequence: Synthetic oligonucleotide
cctcctgatggcatatcagatttgttttgatttgtatgaaagtg

SEQ ID NO: 105511 - DNA, 44 bp, Artificial Sequence
  Description of Artificial Sequence: Synthetic oligonucleotide
ctcctgatggcatatcagatttgttttgatttgtatgaaagtgc

SEQ ID NO: 105512 - DNA, 46 bp, Artificial Sequence
  Description of Artificial Sequence: Synthetic oligonucleotide
tcctgatggcatatcagatttgttttgatttgtatgaaagtgctag

SEQ ID NO: 105513 - DNA, 45 bp, Artificial Sequence
  Description of Artificial Sequence: Synthetic oligonucleotide
cctgatggcatatcagatttgttttgatttgtatgaaagtgctag

SEQ ID NO: 105514 - DNA, 45 bp, Artificial Sequence
  Description of Artificial Sequence: Synthetic oligonucleotide
ctgatggcatatcagatttgttttgatttgtatgaaagtgctagc

SEQ ID NO: 105515 - DNA, 45 bp, Artificial Sequence
  Description of Artificial Sequence: Synthetic oligonucleotide
tgatggcatatcagatttgttttgatttgtatgaaagtgctagcc

SEQ ID NO: 105516 - DNA, 44 bp, Artificial Sequence
  Description of Artificial Sequence: Synthetic oligonucleotide
gatggcatatcagatttgttttgatttgtatgaaagtgctagcc

SEQ ID NO: 105517 - DNA, 45 bp, Artificial Sequence
  Description of Artificial Sequence: Synthetic oligonucleotide
atggcatatcagatttgttttgatttgtatgaaagtgctagccag

SEQ ID NO: 105518 - DNA, 44 bp, Artificial Sequence
  Description of Artificial Sequence: Synthetic oligonucleotide
tggcatatcagatttgttttgatttgtatgaaagtgctagccag

SEQ ID NO: 105519 - DNA, 43 bp, Artificial Sequence
  Description of Artificial Sequence: Synthetic oligonucleotide
ggcatatcagatttgttttgatttgtatgaaagtgctagccag

SEQ ID NO: 105520 - DNA, 43 bp, Artificial Sequence
  Description of Artificial Sequence: Synthetic oligonucleotide
gcatatcagatttgttttgatttgtatgaaagtgctagccagc

SEQ ID NO: 105521 - DNA, 44 bp, Artificial Sequence
  Description of Artificial Sequence: Synthetic oligonucleotide
catatcagatttgttttgatttgtatgaaagtgctagccagcag

SEQ ID NO: 105522 - DNA, 49 bp, Artificial Sequence
  Description of Artificial Sequence: Synthetic oligonucleotide
atatcagatttgttttgatttgtatgaaagtgctagccagcagtttttg

SEQ ID NO: 105523 - DNA, 48 bp, Artificial Sequence
  Description of Artificial Sequence: Synthetic oligonucleotide
tatcagatttgttttgatttgtatgaaagtgctagccagcagtttttg

SEQ ID NO: 105524 - DNA, 47 bp, Artificial Sequence
  Description of Artificial Sequence: Synthetic oligonucleotide
atcagatttgttttgatttgtatgaaagtgctagccagcagtttttg

SEQ ID NO: 105525 - DNA, 46 bp, Artificial Sequence
  Description of Artificial Sequence: Synthetic oligonucleotide
tcagatttgttttgatttgtatgaaagtgctagccagcagtttttg

SEQ ID NO: 105526 - DNA, 45 bp, Artificial Sequence
  Description of Artificial Sequence: Synthetic oligonucleotide
cagatttgttttgatttgtatgaaagtgctagccagcagtttttg

SEQ ID NO: 105527 - DNA, 46 bp, Artificial Sequence
  Description of Artificial Sequence: Synthetic oligonucleotide
agatttgttttgatttgtatgaaagtgctagccagcagtttttgtc

SEQ ID NO: 105528 - DNA, 45 bp, Artificial Sequence
  Description of Artificial Sequence: Synthetic oligonucleotide
gatttgttttgatttgtatgaaagtgctagccagcagtttttgtc

SEQ ID NO: 105529 - DNA, 47 bp, Artificial Sequence
  Description of Artificial Sequence: Synthetic oligonucleotide
atttgttttgatttgtatgaaagtgctagccagcagtttttgtcatc

SEQ ID NO: 105530 - DNA, 46 bp, Artificial Sequence
  Description of Artificial Sequence: Synthetic oligonucleotide
tttgttttgatttgtatgaaagtgctagccagcagtttttgtcatc

SEQ ID NO: 105531 - DNA, 45 bp, Artificial Sequence
  Description of Artificial Sequence: Synthetic oligonucleotide
ttgttttgatttgtatgaaagtgctagccagcagtttttgtcatc

SEQ ID NO: 105532 - DNA, 44 bp, Artificial Sequence
  Description of Artificial Sequence: Synthetic oligonucleotide
tgttttgatttgtatgaaagtgctagccagcagtttttgtcatc

SEQ ID NO: 105533 - DNA, 43 bp, Artificial Sequence
  Description of Artificial Sequence: Synthetic oligonucleotide
gttttgatttgtatgaaagtgctagccagcagtttttgtcatc

SEQ ID NO: 105534 - DNA, 44 bp, Artificial Sequence
  Description of Artificial Sequence: Synthetic oligonucleotide
ttttgatttgtatgaaagtgctagccagcagtttttgtcatctg

SEQ ID NO: 105535 - DNA, 43 bp, Artificial Sequence
  Description of Artificial Sequence: Synthetic oligonucleotide
tttgatttgtatgaaagtgctagccagcagtttttgtcatctg

SEQ ID NO: 105536 - DNA, 42 bp, Artificial Sequence
  Description of Artificial Sequence: Synthetic oligonucleotide
ttgatttgtatgaaagtgctagccagcagtttttgtcatctg

SEQ ID NO: 105537 - DNA, 41 bp, Artificial Sequence
  Description of Artificial Sequence: Synthetic oligonucleotide
tgatttgtatgaaagtgctagccagcagtttttgtcatctg

SEQ ID NO: 105538 - DNA, 40 bp, Artificial Sequence
  Description of Artificial Sequence: Synthetic oligonucleotide
gatttgtatgaaagtgctagccagcagtttttgtcatctg

SEQ ID NO: 105539 - DNA, 44 bp, Artificial Sequence
  Description of Artificial Sequence: Synthetic oligonucleotide
atttgtatgaaagtgctagccagcagtttttgtcatctgtaatc

SEQ ID NO: 105540 - DNA, 43 bp, Artificial Sequence
  Description of Artificial Sequence: Synthetic oligonucleotide
tttgtatgaaagtgctagccagcagtttttgtcatctgtaatc

SEQ ID NO: 105541 - DNA, 42 bp, Artificial Sequence
  Description of Artificial Sequence: Synthetic oligonucleotide
ttgtatgaaagtgctagccagcagtttttgtcatctgtaatc

SEQ ID NO: 105542 - DNA, 41 bp, Artificial Sequence
  Description of Artificial Sequence: Synthetic oligonucleotide
tgtatgaaagtgctagccagcagtttttgtcatctgtaatc

SEQ ID NO: 105543 - DNA, 40 bp, Artificial Sequence
  Description of Artificial Sequence: Synthetic oligonucleotide
gtatgaaagtgctagccagcagtttttgtcatctgtaatc

SEQ ID NO: 105544 - DNA, 40 bp, Artificial Sequence
  Description of Artificial Sequence: Synthetic oligonucleotide
tatgaaagtgctagccagcagtttttgtcatctgtaatcc

SEQ ID NO: 105545 - DNA, 39 bp, Artificial Sequence
  Description of Artificial Sequence: Synthetic oligonucleotide
atgaaagtgctagccagcagtttttgtcatctgtaatcc

SEQ ID NO: 105546 - DNA, 38 bp, Artificial Sequence
  Description of Artificial Sequence: Synthetic oligonucleotide
tgaaagtgctagccagcagtttttgtcatctgtaatcc

SEQ ID NO: 105547 - DNA, 37 bp, Artificial Sequence
  Description of Artificial Sequence: Synthetic oligonucleotide
gaaagtgctagccagcagtttttgtcatctgtaatcc

SEQ ID NO: 105548 - DNA, 38 bp, Artificial Sequence
  Description of Artificial Sequence: Synthetic oligonucleotide
aaagtgctagccagcagtttttgtcatctgtaatccag

SEQ ID NO: 105549 - DNA, 37 bp, Artificial Sequence
  Description of Artificial Sequence: Synthetic oligonucleotide
aagtgctagccagcagtttttgtcatctgtaatccag

SEQ ID NO: 105550 - DNA, 36 bp, Artificial Sequence
  Description of Artificial Sequence: Synthetic oligonucleotide
agtgctagccagcagtttttgtcatctgtaatccag

SEQ ID NO: 105551 - DNA, 35 bp, Artificial Sequence
  Description of Artificial Sequence: Synthetic oligonucleotide
gtgctagccagcagtttttgtcatctgtaatccag

SEQ ID NO: 105552 - DNA, 38 bp, Artificial Sequence
  Description of Artificial Sequence: Synthetic oligonucleotide
tgctagccagcagtttttgtcatctgtaatccagaatc

SEQ ID NO: 105553 - DNA, 37 bp, Artificial Sequence
  Description of Artificial Sequence: Synthetic oligonucleotide
gctagccagcagtttttgtcatctgtaatccagaatc

SEQ ID NO: 105554 - DNA, 39 bp, Artificial Sequence
  Description of Artificial Sequence: Synthetic oligonucleotide
ctagccagcagtttttgtcatctgtaatccagaatcttc

SEQ ID NO: 105555 - DNA, 39 bp, Artificial Sequence
  Description of Artificial Sequence: Synthetic oligonucleotide
tagccagcagtttttgtcatctgtaatccagaatcttcg

SEQ ID NO: 105556 - DNA, 38 bp, Artificial Sequence
  Description of Artificial Sequence: Synthetic oligonucleotide
agccagcagtttttgtcatctgtaatccagaatcttcg

SEQ ID NO: 105557 - DNA, 37 bp, Artificial Sequence
  Description of Artificial Sequence: Synthetic oligonucleotide
gccagcagtttttgtcatctgtaatccagaatcttcg

SEQ ID NO: 105558 - DNA, 39 bp, Artificial Sequence
  Description of Artificial Sequence: Synthetic oligonucleotide
ccagcagtttttgtcatctgtaatccagaatcttcgaac

SEQ ID NO: 105559 - DNA, 40 bp, Artificial Sequence
  Description of Artificial Sequence: Synthetic oligonucleotide
cagcagtttttgtcatctgtaatccagaatcttcgaactg

SEQ ID NO: 105560 - DNA, 42 bp, Artificial Sequence
  Description of Artificial Sequence: Synthetic oligonucleotide
agcagtttttgtcatctgtaatccagaatcttcgaactgttg

SEQ ID NO: 105561 - DNA, 41 bp, Artificial Sequence
  Description of Artificial Sequence: Synthetic oligonucleotide
gcagtttttgtcatctgtaatccagaatcttcgaactgttg

SEQ ID NO: 105562 - DNA, 41 bp, Artificial Sequence
  Description of Artificial Sequence: Synthetic oligonucleotide
cagtttttgtcatctgtaatccagaatcttcgaactgttgg

SEQ ID NO: 105563 - DNA, 41 bp, Artificial Sequence
  Description of Artificial Sequence: Synthetic oligonucleotide
agtttttgtcatctgtaatccagaatcttcgaactgttggc

SEQ ID NO: 105564 - DNA, 40 bp, Artificial Sequence
  Description of Artificial Sequence: Synthetic oligonucleotide
gtttttgtcatctgtaatccagaatcttcgaactgttggc

SEQ ID NO: 105565 - DNA, 41 bp, Artificial Sequence
  Description of Artificial Sequence: Synthetic oligonucleotide
tttttgtcatctgtaatccagaatcttcgaactgttggcac

SEQ ID NO: 105566 - DNA, 40 bp, Artificial Sequence
  Description of Artificial Sequence: Synthetic oligonucleotide
ttttgtcatctgtaatccagaatcttcgaactgttggcac

SEQ ID NO: 105567 - DNA, 39 bp, Artificial Sequence
  Description of Artificial Sequence: Synthetic oligonucleotide
tttgtcatctgtaatccagaatcttcgaactgttggcac

SEQ ID NO: 105568 - DNA, 38 bp, Artificial Sequence
  Description of Artificial Sequence: Synthetic oligonucleotide
ttgtcatctgtaatccagaatcttcgaactgttggcac

SEQ ID NO: 105569 - DNA, 37 bp, Artificial Sequence
  Description of Artificial Sequence: Synthetic oligonucleotide
tgtcatctgtaatccagaatcttcgaactgttggcac

SEQ ID NO: 105570 - DNA, 36 bp, Artificial Sequence
  Description of Artificial Sequence: Synthetic oligonucleotide
gtcatctgtaatccagaatcttcgaactgttggcac

SEQ ID NO: 105571 - DNA, 36 bp, Artificial Sequence
  Description of Artificial Sequence: Synthetic oligonucleotide
tcatctgtaatccagaatcttcgaactgttggcacc

SEQ ID NO: 105572 - DNA, 35 bp, Artificial Sequence
  Description of Artificial Sequence: Synthetic oligonucleotide
catctgtaatccagaatcttcgaactgttggcacc

SEQ ID NO: 105573 - DNA, 35 bp, Artificial Sequence
  Description of Artificial Sequence: Synthetic oligonucleotide
atctgtaatccagaatcttcgaactgttggcaccc

SEQ ID NO: 105574 - DNA, 34 bp, Artificial Sequence
  Description of Artificial Sequence: Synthetic oligonucleotide
tctgtaatccagaatcttcgaactgttggcaccc

SEQ ID NO: 105575 - DNA, 33 bp, Artificial Sequence
  Description of Artificial Sequence: Synthetic oligonucleotide
ctgtaatccagaatcttcgaactgttggcaccc

SEQ ID NO: 105576 - DNA, 33 bp, Artificial Sequence
  Description of Artificial Sequence: Synthetic oligonucleotide
tgtaatccagaatcttcgaactgttggcacccc

SEQ ID NO: 105577 - DNA, 32 bp, Artificial Sequence
  Description of Artificial Sequence: Synthetic oligonucleotide
gtaatccagaatcttcgaactgttggcacccc

SEQ ID NO: 105578 - DNA, 36 bp, Artificial Sequence
  Description of Artificial Sequence: Synthetic oligonucleotide
taatccagaatcttcgaactgttggcacccctattg

SEQ ID NO: 105579 - DNA, 35 bp, Artificial Sequence
  Description of Artificial Sequence: Synthetic oligonucleotide
aatccagaatcttcgaactgttggcacccctattg

SEQ ID NO: 105580 - DNA, 34 bp, Artificial Sequence
  Description of Artificial Sequence: Synthetic oligonucleotide
atccagaatcttcgaactgttggcacccctattg

SEQ ID NO: 105581 - DNA, 33 bp, Artificial Sequence
  Description of Artificial Sequence: Synthetic oligonucleotide
tccagaatcttcgaactgttggcacccctattg

SEQ ID NO: 105582 - DNA, 32 bp, Artificial Sequence
  Description of Artificial Sequence: Synthetic oligonucleotide
ccagaatcttcgaactgttggcacccctattg

SEQ ID NO: 105583 - DNA, 32 bp, Artificial Sequence
  Description of Artificial Sequence: Synthetic oligonucleotide
cagaatcttcgaactgttggcacccctattgc

SEQ ID NO: 105584 - DNA, 34 bp, Artificial Sequence
  Description of Artificial Sequence: Synthetic oligonucleotide
agaatcttcgaactgttggcacccctattgcttc

SEQ ID NO: 105585 - DNA, 33 bp, Artificial Sequence
  Description of Artificial Sequence: Synthetic oligonucleotide
gaatcttcgaactgttggcacccctattgcttc

SEQ ID NO: 105586 - DNA, 34 bp, Artificial Sequence
  Description of Artificial Sequence: Synthetic oligonucleotide
aatcttcgaactgttggcacccctattgcttctg

SEQ ID NO: 105587 - DNA, 33 bp, Artificial Sequence
  Description of Artificial Sequence: Synthetic oligonucleotide
atcttcgaactgttggcacccctattgcttctg

SEQ ID NO: 105588 - DNA, 32 bp, Artificial Sequence
  Description of Artificial Sequence: Synthetic oligonucleotide
tcttcgaactgttggcacccctattgcttctg

SEQ ID NO: 105589 - DNA, 31 bp, Artificial Sequence
  Description of Artificial Sequence: Synthetic oligonucleotide
cttcgaactgttggcacccctattgcttctg

SEQ ID NO: 105590 - DNA, 32 bp, Artificial Sequence
  Description of Artificial Sequence: Synthetic oligonucleotide
ttcgaactgttggcacccctattgcttctgtg

SEQ ID NO: 105591 - DNA, 31 bp, Artificial Sequence
  Description of Artificial Sequence: Synthetic oligonucleotide
tcgaactgttggcacccctattgcttctgtg

SEQ ID NO: 105592 - DNA, 30 bp, Artificial Sequence
  Description of Artificial Sequence: Synthetic oligonucleotide
cgaactgttggcacccctattgcttctgtg

SEQ ID NO: 105593 - DNA, 30 bp, Artificial Sequence
  Description of Artificial Sequence: Synthetic oligonucleotide
gaactgttggcacccctattgcttctgtgc

SEQ ID NO: 105594 - DNA, 30 bp, Artificial Sequence
  Description of Artificial Sequence: Synthetic oligonucleotide
aactgttggcacccctattgcttctgtgcc

SEQ ID NO: 105595 - DNA, 29 bp, Artificial Sequence
  Description of Artificial Sequence: Synthetic oligonucleotide
actgttggcacccctattgcttctgtgcc

SEQ ID NO: 105596 - DNA, 28 bp, Artificial Sequence
  Description of Artificial Sequence: Synthetic oligonucleotide
ctgttggcacccctattgcttctgtgcc

SEQ ID NO: 105597 - DNA, 29 bp, Artificial Sequence
  Description of Artificial Sequence: Synthetic oligonucleotide
tgttggcacccctattgcttctgtgcctg

SEQ ID NO: 105598 - DNA, 28 bp, Artificial Sequence
  Description of Artificial Sequence: Synthetic oligonucleotide
gttggcacccctattgcttctgtgcctg

SEQ ID NO: 105599 - DNA, 28 bp, Artificial Sequence
  Description of Artificial Sequence: Synthetic oligonucleotide
ttggcacccctattgcttctgtgcctgg

SEQ ID NO: 105600 - DNA, 27 bp, Artificial Sequence
  Description of Artificial Sequence: Synthetic oligonucleotide
tggcacccctattgcttctgtgcctgg

SEQ ID NO: 105601 - DNA, 27 bp, Artificial Sequence
  Description of Artificial Sequence: Synthetic oligonucleotide
ggcacccctattgcttctgtgcctgga

SEQ ID NO: 105602 - DNA, 28 bp, Artificial Sequence
  Description of Artificial Sequence: Synthetic oligonucleotide
gcacccctattgcttctgtgcctggatc

SEQ ID NO: 105603 - DNA, 28 bp, Artificial Sequence
  Description of Artificial Sequence: Synthetic oligonucleotide
cacccctattgcttctgtgcctggatcc

SEQ ID NO: 105604 - DNA, 29 bp, Artificial Sequence
  Description of Artificial Sequence: Synthetic oligonucleotide
acccctattgcttctgtgcctggatccac

SEQ ID NO: 105605 - DNA, 28 bp, Artificial Sequence
  Description of Artificial Sequence: Synthetic oligonucleotide
cccctattgcttctgtgcctggatccac

SEQ ID NO: 105606 - DNA, 33 bp, Artificial Sequence
  Description of Artificial Sequence: Synthetic oligonucleotide
ccctattgcttctgtgcctggatccactaatac

SEQ ID NO: 105607 - DNA, 33 bp, Artificial Sequence
  Description of Artificial Sequence: Synthetic oligonucleotide
cctattgcttctgtgcctggatccactaatacg

SEQ ID NO: 105608 - DNA, 33 bp, Artificial Sequence
  Description of Artificial Sequence: Synthetic oligonucleotide
ctattgcttctgtgcctggatccactaatacgg

SEQ ID NO: 105609 - DNA, 33 bp, Artificial Sequence
  Description of Artificial Sequence: Synthetic oligonucleotide
tattgcttctgtgcctggatccactaatacggg

SEQ ID NO: 105610 - DNA, 32 bp, Artificial Sequence
  Description of Artificial Sequence: Synthetic oligonucleotide
attgcttctgtgcctggatccactaatacggg

SEQ ID NO: 105611 - DNA, 31 bp, Artificial Sequence
  Description of Artificial Sequence: Synthetic oligonucleotide
ttgcttctgtgcctggatccactaatacggg

SEQ ID NO: 105612 - DNA, 30 bp, Artificial Sequence
  Description of Artificial Sequence: Synthetic oligonucleotide
tgcttctgtgcctggatccactaatacggg

SEQ ID NO: 105613 - DNA, 29 bp, Artificial Sequence
  Description of Artificial Sequence: Synthetic oligonucleotide
gcttctgtgcctggatccactaatacggg

SEQ ID NO: 105614 - DNA, 31 bp, Artificial Sequence
  Description of Artificial Sequence: Synthetic oligonucleotide
cttctgtgcctggatccactaatacgggtac

SEQ ID NO: 105615 - DNA, 32 bp, Artificial Sequence
  Description of Artificial Sequence: Synthetic oligonucleotide
ttctgtgcctggatccactaatacgggtactg

SEQ ID NO: 105616 - DNA, 31 bp, Artificial Sequence
  Description of Artificial Sequence: Synthetic oligonucleotide
tctgtgcctggatccactaatacgggtactg

SEQ ID NO: 105617 - DNA, 30 bp, Artificial Sequence
  Description of Artificial Sequence: Synthetic oligonucleotide
ctgtgcctggatccactaatacgggtactg

SEQ ID NO: 105618 - DNA, 32 bp, Artificial Sequence
  Description of Artificial Sequence: Synthetic oligonucleotide
tgtgcctggatccactaatacgggtactgttc

SEQ ID NO: 105619 - DNA, 31 bp, Artificial Sequence
  Description of Artificial Sequence: Synthetic oligonucleotide
gtgcctggatccactaatacgggtactgttc

SEQ ID NO: 105620 - DNA, 31 bp, Artificial Sequence
  Description of Artificial Sequence: Synthetic oligonucleotide
tgcctggatccactaatacgggtactgttcc

SEQ ID NO: 105621 - DNA, 30 bp, Artificial Sequence
  Description of Artificial Sequence: Synthetic oligonucleotide
gcctggatccactaatacgggtactgttcc

SEQ ID NO: 105622 - DNA, 30 bp, Artificial Sequence
  Description of Artificial Sequence: Synthetic oligonucleotide
cctggatccactaatacgggtactgttccg

SEQ ID NO: 105623 - DNA, 30 bp, Artificial Sequence
  Description of Artificial Sequence: Synthetic oligonucleotide
ctggatccactaatacgggtactgttccgg

SEQ ID NO: 105624 - DNA, 30 bp, Artificial Sequence
  Description of Artificial Sequence: Synthetic oligonucleotide
tggatccactaatacgggtactgttccggg

SEQ ID NO: 105625 - DNA, 29 bp, Artificial Sequence
  Description of Artificial Sequence: Synthetic oligonucleotide
ggatccactaatacgggtactgttccggg

SEQ ID NO: 105626 - DNA, 31 bp, Artificial Sequence
  Description of Artificial Sequence: Synthetic oligonucleotide
gatccactaatacgggtactgttccgggatc

SEQ ID NO: 105627 - DNA, 32 bp, Artificial Sequence
  Description of Artificial Sequence: Synthetic oligonucleotide
atccactaatacgggtactgttccgggatcag

SEQ ID NO: 105628 - DNA, 31 bp, Artificial Sequence
  Description of Artificial Sequence: Synthetic oligonucleotide
tccactaatacgggtactgttccgggatcag

SEQ ID NO: 105629 - DNA, 30 bp, Artificial Sequence
  Description of Artificial Sequence: Synthetic oligonucleotide
ccactaatacgggtactgttccgggatcag

SEQ ID NO: 105630 - DNA, 31 bp, Artificial Sequence
  Description of Artificial Sequence: Synthetic oligonucleotide
cactaatacgggtactgttccgggatcagag

SEQ ID NO: 105631 - DNA, 34 bp, Artificial Sequence
  Description of Artificial Sequence: Synthetic oligonucleotide
actaatacgggtactgttccgggatcagagaaag

SEQ ID NO: 105632 - DNA, 33 bp, Artificial Sequence
  Description of Artificial Sequence: Synthetic oligonucleotide
ctaatacgggtactgttccgggatcagagaaag

SEQ ID NO: 105633 - DNA, 34 bp, Artificial Sequence
  Description of Artificial Sequence: Synthetic oligonucleotide
taatacgggtactgttccgggatcagagaaagac

SEQ ID NO: 105634 - DNA, 33 bp, Artificial Sequence
  Description of Artificial Sequence: Synthetic oligonucleotide
aatacgggtactgttccgggatcagagaaagac

SEQ ID NO: 105635 - DNA, 32 bp, Artificial Sequence
  Description of Artificial Sequence: Synthetic oligonucleotide
atacgggtactgttccgggatcagagaaagac

SEQ ID NO: 105636 - DNA, 31 bp, Artificial Sequence
  Description of Artificial Sequence: Synthetic oligonucleotide
tacgggtactgttccgggatcagagaaagac

SEQ ID NO: 105637 - DNA, 30 bp, Artificial Sequence
  Description of Artificial Sequence: Synthetic oligonucleotide
acgggtactgttccgggatcagagaaagac

SEQ ID NO: 105638 - DNA, 29 bp, Artificial Sequence
  Description of Artificial Sequence: Synthetic oligonucleotide
cgggtactgttccgggatcagagaaagac

SEQ ID NO: 105639 - DNA, 30 bp, Artificial Sequence
  Description of Artificial Sequence: Synthetic oligonucleotide
gggtactgttccgggatcagagaaagacag

SEQ ID NO: 105640 - DNA, 31 bp, Artificial Sequence
  Description of Artificial Sequence: Synthetic oligonucleotide
ggtactgttccgggatcagagaaagacagtg

SEQ ID NO: 105641 - DNA, 32 bp, Artificial Sequence
  Description of Artificial Sequence: Synthetic oligonucleotide
gtactgttccgggatcagagaaagacagtgac

SEQ ID NO: 105642 - DNA, 33 bp, Artificial Sequence
  Description of Artificial Sequence: Synthetic oligonucleotide
tactgttccgggatcagagaaagacagtgactc

SEQ ID NO: 105643 - DNA, 32 bp, Artificial Sequence
  Description of Artificial Sequence: Synthetic oligonucleotide
actgttccgggatcagagaaagacagtgactc

SEQ ID NO: 105644 - DNA, 31 bp, Artificial Sequence
  Description of Artificial Sequence: Synthetic oligonucleotide
ctgttccgggatcagagaaagacagtgactc

SEQ ID NO: 105645 - DNA, 31 bp, Artificial Sequence
  Description of Artificial Sequence: Synthetic oligonucleotide
tgttccgggatcagagaaagacagtgactcg

SEQ ID NO: 105646 - DNA, 30 bp, Artificial Sequence
  Description of Artificial Sequence: Synthetic oligonucleotide
gttccgggatcagagaaagacagtgactcg

SEQ ID NO: 105647 - DNA, 32 bp, Artificial Sequence
  Description of Artificial Sequence: Synthetic oligonucleotide
ttccgggatcagagaaagacagtgactcgatg

SEQ ID NO: 105648 - DNA, 31 bp, Artificial Sequence
  Description of Artificial Sequence: Synthetic oligonucleotide
tccgggatcagagaaagacagtgactcgatg

SEQ ID NO: 105649 - DNA, 30 bp, Artificial Sequence
  Description of Artificial Sequence: Synthetic oligonucleotide
ccgggatcagagaaagacagtgactcgatg

SEQ ID NO: 105650 - DNA, 30 bp, Artificial Sequence
  Description of Artificial Sequence: Synthetic oligonucleotide
cgggatcagagaaagacagtgactcgatgg

SEQ ID NO: 105651 - DNA, 33 bp, Artificial Sequence
  Description of Artificial Sequence: Synthetic oligonucleotide
gggatcagagaaagacagtgactcgatggaaac

SEQ ID NO: 105652 - DNA, 34 bp, Artificial Sequence
  Description of Artificial Sequence: Synthetic oligonucleotide
ggatcagagaaagacagtgactcgatggaaacag

SEQ ID NO: 105653 - DNA, 36 bp, Artificial Sequence
  Description of Artificial Sequence: Synthetic oligonucleotide
gatcagagaaagacagtgactcgatggaaacagaag

SEQ ID NO: 105654 - DNA, 40 bp, Artificial Sequence
  Description of Artificial Sequence: Synthetic oligonucleotide
atcagagaaagacagtgactcgatggaaacagaagaaaag

SEQ ID NO: 105655 - DNA, 39 bp, Artificial Sequence
  Description of Artificial Sequence: Synthetic oligonucleotide
tcagagaaagacagtgactcgatggaaacagaagaaaag

SEQ ID NO: 105656 - DNA, 38 bp, Artificial Sequence
  Description of Artificial Sequence: Synthetic oligonucleotide
cagagaaagacagtgactcgatggaaacagaagaaaag

SEQ ID NO: 105657 - DNA, 39 bp, Artificial Sequence
  Description of Artificial Sequence: Synthetic oligonucleotide
agagaaagacagtgactcgatggaaacagaagaaaagac

SEQ ID NO: 105658 - DNA, 38 bp, Artificial Sequence
  Description of Artificial Sequence: Synthetic oligonucleotide
gagaaagacagtgactcgatggaaacagaagaaaagac

SEQ ID NO: 105659 - DNA, 40 bp, Artificial Sequence
  Description of Artificial Sequence: Synthetic oligonucleotide
agaaagacagtgactcgatggaaacagaagaaaagacaag

SEQ ID NO: 105660 - DNA, 39 bp, Artificial Sequence
  Description of Artificial Sequence: Synthetic oligonucleotide
gaaagacagtgactcgatggaaacagaagaaaagacaag

SEQ ID NO: 105661 - DNA, 39 bp, Artificial Sequence
  Description of Artificial Sequence: Synthetic oligonucleotide
aaagacagtgactcgatggaaacagaagaaaagacaagc

SEQ ID NO: 105662 - DNA, 38 bp, Artificial Sequence
  Description of Artificial Sequence: Synthetic oligonucleotide
aagacagtgactcgatggaaacagaagaaaagacaagc

SEQ ID NO: 105663 - DNA, 37 bp, Artificial Sequence
  Description of Artificial Sequence: Synthetic oligonucleotide
agacagtgactcgatggaaacagaagaaaagacaagc

SEQ ID NO: 105664 - DNA, 36 bp, Artificial Sequence
  Description of Artificial Sequence: Synthetic oligonucleotide
gacagtgactcgatggaaacagaagaaaagacaagc

SEQ ID NO: 105665 - DNA, 37 bp, Artificial Sequence
  Description of Artificial Sequence: Synthetic oligonucleotide
acagtgactcgatggaaacagaagaaaagacaagcag

SEQ ID NO: 105666 - DNA, 36 bp, Artificial Sequence
  Description of Artificial Sequence: Synthetic oligonucleotide
cagtgactcgatggaaacagaagaaaagacaagcag

SEQ ID NO: 105667 - DNA, 37 bp, Artificial Sequence
  Description of Artificial Sequence: Synthetic oligonucleotide
agtgactcgatggaaacagaagaaaagacaagcagtg

SEQ ID NO: 105668 - DNA, 36 bp, Artificial Sequence
  Description of Artificial Sequence: Synthetic oligonucleotide
gtgactcgatggaaacagaagaaaagacaagcagtg

SEQ ID NO: 105669 - DNA, 36 bp, Artificial Sequence
  Description of Artificial Sequence: Synthetic oligonucleotide
tgactcgatggaaacagaagaaaagacaagcagtgc

SEQ ID NO: 105670 - DNA, 35 bp, Artificial Sequence
  Description of Artificial Sequence: Synthetic oligonucleotide
gactcgatggaaacagaagaaaagacaagcagtgc

SEQ ID NO: 105671 - DNA, 39 bp, Artificial Sequence
  Description of Artificial Sequence: Synthetic oligonucleotide
actcgatggaaacagaagaaaagacaagcagtgcatttg

SEQ ID NO: 105672 - DNA, 38 bp, Artificial Sequence
  Description of Artificial Sequence: Synthetic oligonucleotide
ctcgatggaaacagaagaaaagacaagcagtgcatttg

SEQ ID NO: 105673 - DNA, 40 bp, Artificial Sequence
  Description of Artificial Sequence: Synthetic oligonucleotide
tcgatggaaacagaagaaaagacaagcagtgcatttgtag

SEQ ID NO: 105674 - DNA, 39 bp, Artificial Sequence
  Description of Artificial Sequence: Synthetic oligonucleotide
cgatggaaacagaagaaaagacaagcagtgcatttgtag

SEQ ID NO: 105675 - DNA, 39 bp, Artificial Sequence
  Description of Artificial Sequence: Synthetic oligonucleotide
gatggaaacagaagaaaagacaagcagtgcatttgtagg

SEQ ID NO: 105676 - DNA, 42 bp, Artificial Sequence
  Description of Artificial Sequence: Synthetic oligonucleotide
atggaaacagaagaaaagacaagcagtgcatttgtaggaaag

SEQ ID NO: 105677 - DNA, 41 bp, Artificial Sequence
  Description of Artificial Sequence: Synthetic oligonucleotide
tggaaacagaagaaaagacaagcagtgcatttgtaggaaag

SEQ ID NO: 105678 - DNA, 40 bp, Artificial Sequence
  Description of Artificial Sequence: Synthetic oligonucleotide
ggaaacagaagaaaagacaagcagtgcatttgtaggaaag

SEQ ID NO: 105679 - DNA, 41 bp, Artificial Sequence
  Description of Artificial Sequence: Synthetic oligonucleotide
gaaacagaagaaaagacaagcagtgcatttgtaggaaagac

SEQ ID NO: 105680 - DNA, 42 bp, Artificial Sequence
  Description of Artificial Sequence: Synthetic oligonucleotide
aaacagaagaaaagacaagcagtgcatttgtaggaaagacac

SEQ ID NO: 105681 - DNA, 41 bp, Artificial Sequence
  Description of Artificial Sequence: Synthetic oligonucleotide
aacagaagaaaagacaagcagtgcatttgtaggaaagacac

SEQ ID NO: 105682 - DNA, 40 bp, Artificial Sequence
  Description of Artificial Sequence: Synthetic oligonucleotide
acagaagaaaagacaagcagtgcatttgtaggaaagacac

SEQ ID NO: 105683 - DNA, 39 bp, Artificial Sequence
  Description of Artificial Sequence: Synthetic oligonucleotide
cagaagaaaagacaagcagtgcatttgtaggaaagacac

SEQ ID NO: 105684 - DNA, 39 bp, Artificial Sequence
  Description of Artificial Sequence: Synthetic oligonucleotide
agaagaaaagacaagcagtgcatttgtaggaaagacacc

SEQ ID NO: 105685 - DNA, 38 bp, Artificial Sequence
  Description of Artificial Sequence: Synthetic oligonucleotide
gaagaaaagacaagcagtgcatttgtaggaaagacacc

SEQ ID NO: 105686 - DNA, 39 bp, Artificial Sequence
  Description of Artificial Sequence: Synthetic oligonucleotide
aagaaaagacaagcagtgcatttgtaggaaagacaccag

SEQ ID NO: 105687 - DNA, 38 bp, Artificial Sequence
  Description of Artificial Sequence: Synthetic oligonucleotide
agaaaagacaagcagtgcatttgtaggaaagacaccag

SEQ ID NO: 105688 - DNA, 37 bp, Artificial Sequence
  Description of Artificial Sequence: Synthetic oligonucleotide
gaaaagacaagcagtgcatttgtaggaaagacaccag

SEQ ID NO: 105689 - DNA, 39 bp, Artificial Sequence
  Description of Artificial Sequence: Synthetic oligonucleotide
aaaagacaagcagtgcatttgtaggaaagacaccagaag

SEQ ID NO: 105690 - DNA, 38 bp, Artificial Sequence
  Description of Artificial Sequence: Synthetic oligonucleotide
aaagacaagcagtgcatttgtaggaaagacaccagaag

SEQ ID NO: 105691 - DNA, 37 bp, Artificial Sequence
  Description of Artificial Sequence: Synthetic oligonucleotide
aagacaagcagtgcatttgtaggaaagacaccagaag

SEQ ID NO: 105692 - DNA, 36 bp, Artificial Sequence
  Description of Artificial Sequence: Synthetic oligonucleotide
agacaagcagtgcatttgtaggaaagacaccagaag

SEQ ID NO: 105693 - DNA, 35 bp, Artificial Sequence
  Description of Artificial Sequence: Synthetic oligonucleotide
gacaagcagtgcatttgtaggaaagacaccagaag

SEQ ID NO: 105694 - DNA, 35 bp, Artificial Sequence
  Description of Artificial Sequence: Synthetic oligonucleotide
acaagcagtgcatttgtaggaaagacaccagaagc

SEQ ID NO: 105695 - DNA, 34 bp, Artificial Sequence
  Description of Artificial Sequence: Synthetic oligonucleotide
caagcagtgcatttgtaggaaagacaccagaagc

SEQ ID NO: 105696 - DNA, 34 bp, Artificial Sequence
  Description of Artificial Sequence: Synthetic oligonucleotide
aagcagtgcatttgtaggaaagacaccagaagcc

SEQ ID NO: 105697 - DNA, 33 bp, Artificial Sequence
  Description of Artificial Sequence: Synthetic oligonucleotide
agcagtgcatttgtaggaaagacaccagaagcc

SEQ ID NO: 105698 - DNA, 32 bp, Artificial Sequence
  Description of Artificial Sequence: Synthetic oligonucleotide
gcagtgcatttgtaggaaagacaccagaagcc

SEQ ID NO: 105699 - DNA, 33 bp, Artificial Sequence
  Description of Artificial Sequence: Synthetic oligonucleotide
cagtgcatttgtaggaaagacaccagaagccag

SEQ ID NO: 105700 - DNA, 34 bp, Artificial Sequence
  Description of Artificial Sequence: Synthetic oligonucleotide
agtgcatttgtaggaaagacaccagaagccagtc

SEQ ID NO: 105701 - DNA, 33 bp, Artificial Sequence
  Description of Artificial Sequence: Synthetic oligonucleotide
gtgcatttgtaggaaagacaccagaagccagtc

SEQ ID NO: 105702 - DNA, 33 bp, Artificial Sequence
  Description of Artificial Sequence: Synthetic oligonucleotide
tgcatttgtaggaaagacaccagaagccagtcc

SEQ ID NO: 105703 - DNA, 32 bp, Artificial Sequence
  Description of Artificial Sequence: Synthetic oligonucleotide
gcatttgtaggaaagacaccagaagccagtcc

SEQ ID NO: 105704 - DNA, 33 bp, Artificial Sequence
  Description of Artificial Sequence: Synthetic oligonucleotide
catttgtaggaaagacaccagaagccagtccag

SEQ ID NO: 105705 - DNA, 34 bp, Artificial Sequence
  Description of Artificial Sequence: Synthetic oligonucleotide
atttgtaggaaagacaccagaagccagtccagag

SEQ ID NO: 105706 - DNA, 33 bp, Artificial Sequence
  Description of Artificial Sequence: Synthetic oligonucleotide
tttgtaggaaagacaccagaagccagtccagag

SEQ ID NO: 105707 - DNA, 32 bp, Artificial Sequence
  Description of Artificial Sequence: Synthetic oligonucleotide
ttgtaggaaagacaccagaagccagtccagag

SEQ ID NO: 105708 - DNA, 31 bp, Artificial Sequence
  Description of Artificial Sequence: Synthetic oligonucleotide
tgtaggaaagacaccagaagccagtccagag

SEQ ID NO: 105709 - DNA, 30 bp, Artificial Sequence
  Description of Artificial Sequence: Synthetic oligonucleotide
gtaggaaagacaccagaagccagtccagag

SEQ ID NO: 105710 - DNA, 30 bp, Artificial Sequence
  Description of Artificial Sequence: Synthetic oligonucleotide
taggaaagacaccagaagccagtccagagc

SEQ ID NO: 105711 - DNA, 29 bp, Artificial Sequence
  Description of Artificial Sequence: Synthetic oligonucleotide
aggaaagacaccagaagccagtccagagc

SEQ ID NO: 105712 - DNA, 28 bp, Artificial Sequence
  Description of Artificial Sequence: Synthetic oligonucleotide
ggaaagacaccagaagccagtccagagc

SEQ ID NO: 105713 - DNA, 28 bp, Artificial Sequence
  Description of Artificial Sequence: Synthetic oligonucleotide
gaaagacaccagaagccagtccagagcc

SEQ ID NO: 105714 - DNA, 31 bp, Artificial Sequence
  Description of Artificial Sequence: Synthetic oligonucleotide
aaagacaccagaagccagtccagagcctaag

SEQ ID NO: 105715 - DNA, 30 bp, Artificial Sequence
  Description of Artificial Sequence: Synthetic oligonucleotide
aagacaccagaagccagtccagagcctaag

SEQ ID NO: 105716 - DNA, 29 bp, Artificial Sequence
  Description of Artificial Sequence: Synthetic oligonucleotide
agacaccagaagccagtccagagcctaag

SEQ ID NO: 105717 - DNA, 28 bp, Artificial Sequence
  Description of Artificial Sequence: Synthetic oligonucleotide
gacaccagaagccagtccagagcctaag

SEQ ID NO: 105718 - DNA, 28 bp, Artificial Sequence
  Description of Artificial Sequence: Synthetic oligonucleotide
acaccagaagccagtccagagcctaagg

SEQ ID NO: 105719 - DNA, 27 bp, Artificial Sequence
  Description of Artificial Sequence: Synthetic oligonucleotide
caccagaagccagtccagagcctaagg

SEQ ID NO: 105720 - DNA, 28 bp, Artificial Sequence
  Description of Artificial Sequence: Synthetic oligonucleotide
accagaagccagtccagagcctaaggac

SEQ ID NO: 105721 - DNA, 27 bp, Artificial Sequence
  Description of Artificial Sequence: Synthetic oligonucleotide
ccagaagccagtccagagcctaaggac

SEQ ID NO: 105722 - DNA, 27 bp, Artificial Sequence
  Description of Artificial Sequence: Synthetic oligonucleotide
cagaagccagtccagagcctaaggacc

SEQ ID NO: 105723 - DNA, 28 bp, Artificial Sequence
  Description of Artificial Sequence: Synthetic oligonucleotide
agaagccagtccagagcctaaggaccag

SEQ ID NO: 105724 - DNA, 27 bp, Artificial Sequence
  Description of Artificial Sequence: Synthetic oligonucleotide
gaagccagtccagagcctaaggaccag

SEQ ID NO: 105725 - DNA, 28 bp, Artificial Sequence
  Description of Artificial Sequence: Synthetic oligonucleotide
aagccagtccagagcctaaggaccagac

SEQ ID NO: 105726 - DNA, 27 bp, Artificial Sequence
  Description of Artificial Sequence: Synthetic oligonucleotide
agccagtccagagcctaaggaccagac

SEQ ID NO: 105727 - DNA, 27 bp, Artificial Sequence
  Description of Artificial Sequence: Synthetic oligonucleotide
gccagtccagagcctaaggaccagact

SEQ ID NO: 105728 - DNA, 29 bp, Artificial Sequence
  Description of Artificial Sequence: Synthetic oligonucleotide
ccagtccagagcctaaggaccagactttg

SEQ ID NO: 105729 - DNA, 34 bp, Artificial Sequence
  Description of Artificial Sequence: Synthetic oligonucleotide
cagtccagagcctaaggaccagactttgaaaatg

SEQ ID NO: 105730 - DNA, 47 bp, Artificial Sequence
  Description of Artificial Sequence: Synthetic oligonucleotide
agtccagagcctaaggaccagactttgaaaatgattaaaattttaag

SEQ ID NO: 105731 - DNA, 46 bp, Artificial Sequence
  Description of Artificial Sequence: Synthetic oligonucleotide
gtccagagcctaaggaccagactttgaaaatgattaaaattttaag

SEQ ID NO: 105732 - DNA, 47 bp, Artificial Sequence
  Description of Artificial Sequence: Synthetic oligonucleotide
tccagagcctaaggaccagactttgaaaatgattaaaattttaagtg

SEQ ID NO: 105733 - DNA, 46 bp, Artificial Sequence
  Description of Artificial Sequence: Synthetic oligonucleotide
ccagagcctaaggaccagactttgaaaatgattaaaattttaagtg

SEQ ID NO: 105734 - DNA, 46 bp, Artificial Sequence
  Description of Artificial Sequence: Synthetic oligonucleotide
cagagcctaaggaccagactttgaaaatgattaaaattttaagtgg

SEQ ID NO: 105735 - DNA, 47 bp, Artificial Sequence
  Description of Artificial Sequence: Synthetic oligonucleotide
agagcctaaggaccagactttgaaaatgattaaaattttaagtggtg

SEQ ID NO: 105736 - DNA, 46 bp, Artificial Sequence
  Description of Artificial Sequence: Synthetic oligonucleotide
gagcctaaggaccagactttgaaaatgattaaaattttaagtggtg

SEQ ID NO: 105737 - DNA, 50 bp, Artificial Sequence
  Description of Artificial Sequence: Synthetic oligonucleotide
agcctaaggaccagactttgaaaatgattaaaattttaagtggtgaaatg

SEQ ID NO: 105738 - DNA, 49 bp, Artificial Sequence
  Description of Artificial Sequence: Synthetic oligonucleotide
gcctaaggaccagactttgaaaatgattaaaattttaagtggtgaaatg

SEQ ID NO: 105739 - DNA, 49 bp, Artificial Sequence
  Description of Artificial Sequence: Synthetic oligonucleotide
cctaaggaccagactttgaaaatgattaaaattttaagtggtgaaatgg

SEQ ID NO: 105740 - DNA, 49 bp, Artificial Sequence
  Description of Artificial Sequence: Synthetic oligonucleotide
ctaaggaccagactttgaaaatgattaaaattttaagtggtgaaatggc

SEQ ID NO: 105741 - DNA, 53 bp, Artificial Sequence
  Description of Artificial Sequence: Synthetic oligonucleotide
taaggaccagactttgaaaatgattaaaattttaagtggtgaaatggctattg

SEQ ID NO: 105742 - DNA, 52 bp, Artificial Sequence
  Description of Artificial Sequence: Synthetic oligonucleotide
aaggaccagactttgaaaatgattaaaattttaagtggtgaaatggctattg

SEQ ID NO: 105743 - DNA, 51 bp, Artificial Sequence
  Description of Artificial Sequence: Synthetic oligonucleotide
aggaccagactttgaaaatgattaaaattttaagtggtgaaatggctattg

SEQ ID NO: 105744 - DNA, 50 bp, Artificial Sequence
  Description of Artificial Sequence: Synthetic oligonucleotide
ggaccagactttgaaaatgattaaaattttaagtggtgaaatggctattg

SEQ ID NO: 105745 - DNA, 51 bp, Artificial Sequence
  Description of Artificial Sequence: Synthetic oligonucleotide
gaccagactttgaaaatgattaaaattttaagtggtgaaatggctattgag

SEQ ID NO: 105746 - DNA, 54 bp, Artificial Sequence
  Description of Artificial Sequence: Synthetic oligonucleotide
accagactttgaaaatgattaaaattttaagtggtgaaatggctattgagttac

SEQ ID NO: 105747 - DNA, 53 bp, Artificial Sequence
  Description of Artificial Sequence: Synthetic oligonucleotide
ccagactttgaaaatgattaaaattttaagtggtgaaatggctattgagttac

SEQ ID NO: 105748 - DNA, 55 bp, Artificial Sequence
  Description of Artificial Sequence: Synthetic oligonucleotide
cagactttgaaaatgattaaaattttaagtggtgaaatggctattgagttacatc

SEQ ID NO: 105749 - DNA, 56 bp, Artificial Sequence
  Description of Artificial Sequence: Synthetic oligonucleotide
agactttgaaaatgattaaaattttaagtggtgaaatggctattgagttacatctg

SEQ ID NO: 105750 - DNA, 55 bp, Artificial Sequence
  Description of Artificial Sequence: Synthetic oligonucleotide
gactttgaaaatgattaaaattttaagtggtgaaatggctattgagttacatctg

SEQ ID NO: 105751 - DNA, 55 bp, Artificial Sequence
  Description of Artificial Sequence: Synthetic oligonucleotide
actttgaaaatgattaaaattttaagtggtgaaatggctattgagttacatctgc

SEQ ID NO: 105752 - DNA, 54 bp, Artificial Sequence
  Description of Artificial Sequence: Synthetic oligonucleotide
ctttgaaaatgattaaaattttaagtggtgaaatggctattgagttacatctgc

SEQ ID NO: 105753 - DNA, 55 bp, Artificial Sequence
  Description of Artificial Sequence: Synthetic oligonucleotide
tttgaaaatgattaaaattttaagtggtgaaatggctattgagttacatctgcag

SEQ ID NO: 105754 - DNA, 54 bp, Artificial Sequence
  Description of Artificial Sequence: Synthetic oligonucleotide
ttgaaaatgattaaaattttaagtggtgaaatggctattgagttacatctgcag

SEQ ID NO: 105755 - DNA, 53 bp, Artificial Sequence
  Description of Artificial Sequence: Synthetic oligonucleotide
tgaaaatgattaaaattttaagtggtgaaatggctattgagttacatctgcag

SEQ ID NO: 105756 - DNA, 52 bp, Artificial Sequence
  Description of Artificial Sequence: Synthetic oligonucleotide
gaaaatgattaaaattttaagtggtgaaatggctattgagttacatctgcag

SEQ ID NO: 105757 - DNA, 54 bp, Artificial Sequence
  Description of Artificial Sequence: Synthetic oligonucleotide
aaaatgattaaaattttaagtggtgaaatggctattgagttacatctgcagttc

SEQ ID NO: 105758 - DNA, 53 bp, Artificial Sequence
  Description of Artificial Sequence: Synthetic oligonucleotide
aaatgattaaaattttaagtggtgaaatggctattgagttacatctgcagttc

SEQ ID NO: 105759 - DNA, 52 bp, Artificial Sequence
  Description of Artificial Sequence: Synthetic oligonucleotide
aatgattaaaattttaagtggtgaaatggctattgagttacatctgcagttc

SEQ ID NO: 105760 - DNA, 51 bp, Artificial Sequence
  Description of Artificial Sequence: Synthetic oligonucleotide
atgattaaaattttaagtggtgaaatggctattgagttacatctgcagttc

SEQ ID NO: 105761 - DNA, 50 bp, Artificial Sequence
  Description of Artificial Sequence: Synthetic oligonucleotide
tgattaaaattttaagtggtgaaatggctattgagttacatctgcagttc

SEQ ID NO: 105762 - DNA, 49 bp, Artificial Sequence
  Description of Artificial Sequence: Synthetic oligonucleotide
gattaaaattttaagtggtgaaatggctattgagttacatctgcagttc

SEQ ID NO: 105763 - DNA, 55 bp, Artificial Sequence
  Description of Artificial Sequence: Synthetic oligonucleotide
attaaaattttaagtggtgaaatggctattgagttacatctgcagttcttaatac

SEQ ID NO: 105764 - DNA, 54 bp, Artificial Sequence
  Description of Artificial Sequence: Synthetic oligonucleotide
ttaaaattttaagtggtgaaatggctattgagttacatctgcagttcttaatac

SEQ ID NO: 105765 - DNA, 53 bp, Artificial Sequence
  Description of Artificial Sequence: Synthetic oligonucleotide
taaaattttaagtggtgaaatggctattgagttacatctgcagttcttaatac

SEQ ID NO: 105766 - DNA, 52 bp, Artificial Sequence
  Description of Artificial Sequence: Synthetic oligonucleotide
aaaattttaagtggtgaaatggctattgagttacatctgcagttcttaatac

SEQ ID NO: 105767 - DNA, 51 bp, Artificial Sequence
  Description of Artificial Sequence: Synthetic oligonucleotide
aaattttaagtggtgaaatggctattgagttacatctgcagttcttaatac

SEQ ID NO: 105768 - DNA, 50 bp, Artificial Sequence
  Description of Artificial Sequence: Synthetic oligonucleotide
aattttaagtggtgaaatggctattgagttacatctgcagttcttaatac

SEQ ID NO: 105769 - DNA, 49 bp, Artificial Sequence
  Description of Artificial Sequence: Synthetic oligonucleotide
attttaagtggtgaaatggctattgagttacatctgcagttcttaatac

SEQ ID NO: 105770 - DNA, 48 bp, Artificial Sequence
  Description of Artificial Sequence: Synthetic oligonucleotide
ttttaagtggtgaaatggctattgagttacatctgcagttcttaatac

SEQ ID NO: 105771 - DNA, 47 bp, Artificial Sequence
  Description of Artificial Sequence: Synthetic oligonucleotide
tttaagtggtgaaatggctattgagttacatctgcagttcttaatac

SEQ ID NO: 105772 - DNA, 46 bp, Artificial Sequence
  Description of Artificial Sequence: Synthetic oligonucleotide
ttaagtggtgaaatggctattgagttacatctgcagttcttaatac

SEQ ID NO: 105773 - DNA, 45 bp, Artificial Sequence
  Description of Artificial Sequence: Synthetic oligonucleotide
taagtggtgaaatggctattgagttacatctgcagttcttaatac

SEQ ID NO: 105774 - DNA, 44 bp, Artificial Sequence
  Description of Artificial Sequence: Synthetic oligonucleotide
aagtggtgaaatggctattgagttacatctgcagttcttaatac

SEQ ID NO: 105775 - DNA, 43 bp, Artificial Sequence
  Description of Artificial Sequence: Synthetic oligonucleotide
agtggtgaaatggctattgagttacatctgcagttcttaatac

SEQ ID NO: 105776 - DNA, 42 bp, Artificial Sequence
  Description of Artificial Sequence: Synthetic oligonucleotide
gtggtgaaatggctattgagttacatctgcagttcttaatac

SEQ ID NO: 105777 - DNA, 42 bp, Artificial Sequence
  Description of Artificial Sequence: Synthetic oligonucleotide
tggtgaaatggctattgagttacatctgcagttcttaatacg

SEQ ID NO: 105778 - DNA, 41 bp, Artificial Sequence
  Description of Artificial Sequence: Synthetic oligonucleotide
ggtgaaatggctattgagttacatctgcagttcttaatacg

SEQ ID NO: 105779 - DNA, 44 bp, Artificial Sequence
  Description of Artificial Sequence: Synthetic oligonucleotide
gtgaaatggctattgagttacatctgcagttcttaatacgaaac

SEQ ID NO: 105780 - DNA, 51 bp, Artificial Sequence
  Description of Artificial Sequence: Synthetic oligonucleotide
tgaaatggctattgagttacatctgcagttcttaatacgaaacaataatac

SEQ ID NO: 105781 - DNA, 50 bp, Artificial Sequence
  Description of Artificial Sequence: Synthetic oligonucleotide
gaaatggctattgagttacatctgcagttcttaatacgaaacaataatac

SEQ ID NO: 105782 - DNA, 51 bp, Artificial Sequence
  Description of Artificial Sequence: Synthetic oligonucleotide
aaatggctattgagttacatctgcagttcttaatacgaaacaataatacag

SEQ ID NO: 105783 - DNA, 50 bp, Artificial Sequence
  Description of Artificial Sequence: Synthetic oligonucleotide
aatggctattgagttacatctgcagttcttaatacgaaacaataatacag

SEQ ID NO: 105784 - DNA, 49 bp, Artificial Sequence
  Description of Artificial Sequence: Synthetic oligonucleotide
atggctattgagttacatctgcagttcttaatacgaaacaataatacag

SEQ ID NO: 105785 - DNA, 48 bp, Artificial Sequence
  Description of Artificial Sequence: Synthetic oligonucleotide
tggctattgagttacatctgcagttcttaatacgaaacaataatacag

SEQ ID NO: 105786 - DNA, 47 bp, Artificial Sequence
  Description of Artificial Sequence: Synthetic oligonucleotide
ggctattgagttacatctgcagttcttaatacgaaacaataatacag

SEQ ID NO: 105787 - DNA, 48 bp, Artificial Sequence
  Description of Artificial Sequence: Synthetic oligonucleotide
gctattgagttacatctgcagttcttaatacgaaacaataatacagac

SEQ ID NO: 105788 - DNA, 48 bp, Artificial Sequence
  Description of Artificial Sequence: Synthetic oligonucleotide
ctattgagttacatctgcagttcttaatacgaaacaataatacagacc

SEQ ID NO: 105789 - DNA, 49 bp, Artificial Sequence
  Description of Artificial Sequence: Synthetic oligonucleotide
tattgagttacatctgcagttcttaatacgaaacaataatacagacctc

SEQ ID NO: 105790 - DNA, 48 bp, Artificial Sequence
  Description of Artificial Sequence: Synthetic oligonucleotide
attgagttacatctgcagttcttaatacgaaacaataatacagacctc

SEQ ID NO: 105791 - DNA, 47 bp, Artificial Sequence
  Description of Artificial Sequence: Synthetic oligonucleotide
ttgagttacatctgcagttcttaatacgaaacaataatacagacctc

SEQ ID NO: 105792 - DNA, 46 bp, Artificial Sequence
  Description of Artificial Sequence: Synthetic oligonucleotide
tgagttacatctgcagttcttaatacgaaacaataatacagacctc

SEQ ID NO: 105793 - DNA, 45 bp, Artificial Sequence
  Description of Artificial Sequence: Synthetic oligonucleotide
gagttacatctgcagttcttaatacgaaacaataatacagacctc

SEQ ID NO: 105794 - DNA, 47 bp, Artificial Sequence
  Description of Artificial Sequence: Synthetic oligonucleotide
agttacatctgcagttcttaatacgaaacaataatacagacctcatg

SEQ ID NO: 105795 - DNA, 46 bp, Artificial Sequence
  Description of Artificial Sequence: Synthetic oligonucleotide
gttacatctgcagttcttaatacgaaacaataatacagacctcatg

SEQ ID NO: 105796 - DNA, 49 bp, Artificial Sequence
  Description of Artificial Sequence: Synthetic oligonucleotide
ttacatctgcagttcttaatacgaaacaataatacagacctcatgattc

SEQ ID NO: 105797 - DNA, 48 bp, Artificial Sequence
  Description of Artificial Sequence: Synthetic oligonucleotide
tacatctgcagttcttaatacgaaacaataatacagacctcatgattc

SEQ ID NO: 105798 - DNA, 47 bp, Artificial Sequence
  Description of Artificial Sequence: Synthetic oligonucleotide
acatctgcagttcttaatacgaaacaataatacagacctcatgattc

SEQ ID NO: 105799 - DNA, 46 bp, Artificial Sequence
  Description of Artificial Sequence: Synthetic oligonucleotide
catctgcagttcttaatacgaaacaataatacagacctcatgattc

SEQ ID NO: 105800 - DNA, 53 bp, Artificial Sequence
  Description of Artificial Sequence: Synthetic oligonucleotide
atctgcagttcttaatacgaaacaataatacagacctcatgattctaaaaaac

SEQ ID NO: 105801 - DNA, 52 bp, Artificial Sequence
  Description of Artificial Sequence: Synthetic oligonucleotide
tctgcagttcttaatacgaaacaataatacagacctcatgattctaaaaaac

SEQ ID NO: 105802 - DNA, 51 bp, Artificial Sequence
  Description of Artificial Sequence: Synthetic oligonucleotide
ctgcagttcttaatacgaaacaataatacagacctcatgattctaaaaaac

SEQ ID NO: 105803 - DNA, 52 bp, Artificial Sequence
  Description of Artificial Sequence: Synthetic oligonucleotide
tgcagttcttaatacgaaacaataatacagacctcatgattctaaaaaacac

SEQ ID NO: 105804 - DNA, 51 bp, Artificial Sequence
  Description of Artificial Sequence: Synthetic oligonucleotide
gcagttcttaatacgaaacaataatacagacctcatgattctaaaaaacac

SEQ ID NO: 105805 - DNA, 54 bp, Artificial Sequence
  Description of Artificial Sequence: Synthetic oligonucleotide
cagttcttaatacgaaacaataatacagacctcatgattctaaaaaacacaaag

SEQ ID NO: 105806 - DNA, 54 bp, Artificial Sequence
  Description of Artificial Sequence: Synthetic oligonucleotide
agttcttaatacgaaacaataatacagacctcatgattctaaaaaacacaaagg

SEQ ID NO: 105807 - DNA, 53 bp, Artificial Sequence
  Description of Artificial Sequence: Synthetic oligonucleotide
gttcttaatacgaaacaataatacagacctcatgattctaaaaaacacaaagg

SEQ ID NO: 105808 - DNA, 55 bp, Artificial Sequence
  Description of Artificial Sequence: Synthetic oligonucleotide
ttcttaatacgaaacaataatacagacctcatgattctaaaaaacacaaaggatg

SEQ ID NO: 105809 - DNA, 54 bp, Artificial Sequence
  Description of Artificial Sequence: Synthetic oligonucleotide
tcttaatacgaaacaataatacagacctcatgattctaaaaaacacaaaggatg

SEQ ID NO: 105810 - DNA, 53 bp, Artificial Sequence
  Description of Artificial Sequence: Synthetic oligonucleotide
cttaatacgaaacaataatacagacctcatgattctaaaaaacacaaaggatg

SEQ ID NO: 105811 - DNA, 53 bp, Artificial Sequence
  Description of Artificial Sequence: Synthetic oligonucleotide
ttaatacgaaacaataatacagacctcatgattctaaaaaacacaaaggatgc

SEQ ID NO: 105812 - DNA, 52 bp, Artificial Sequence
  Description of Artificial Sequence: Synthetic oligonucleotide
taatacgaaacaataatacagacctcatgattctaaaaaacacaaaggatgc

SEQ ID NO: 105813 - DNA, 51 bp, Artificial Sequence
  Description of Artificial Sequence: Synthetic oligonucleotide
aatacgaaacaataatacagacctcatgattctaaaaaacacaaaggatgc

SEQ ID NO: 105814 - DNA, 50 bp, Artificial Sequence
  Description of Artificial Sequence: Synthetic oligonucleotide
atacgaaacaataatacagacctcatgattctaaaaaacacaaaggatgc

SEQ ID NO: 105815 - DNA, 49 bp, Artificial Sequence
  Description of Artificial Sequence: Synthetic oligonucleotide
tacgaaacaataatacagacctcatgattctaaaaaacacaaaggatgc

SEQ ID NO: 105816 - DNA, 48 bp, Artificial Sequence
  Description of Artificial Sequence: Synthetic oligonucleotide
acgaaacaataatacagacctcatgattctaaaaaacacaaaggatgc

SEQ ID NO: 105817 - DNA, 47 bp, Artificial Sequence
  Description of Artificial Sequence: Synthetic oligonucleotide
cgaaacaataatacagacctcatgattctaaaaaacacaaaggatgc

SEQ ID NO: 105818 - DNA, 48 bp, Artificial Sequence
  Description of Artificial Sequence: Synthetic oligonucleotide
gaaacaataatacagacctcatgattctaaaaaacacaaaggatgcag

SEQ ID NO: 105819 - DNA, 50 bp, Artificial Sequence
  Description of Artificial Sequence: Synthetic oligonucleotide
aaacaataatacagacctcatgattctaaaaaacacaaaggatgcagtac

SEQ ID NO: 105820 - DNA, 49 bp, Artificial Sequence
  Description of Artificial Sequence: Synthetic oligonucleotide
aacaataatacagacctcatgattctaaaaaacacaaaggatgcagtac

SEQ ID NO: 105821 - DNA, 48 bp, Artificial Sequence
  Description of Artificial Sequence: Synthetic oligonucleotide
acaataatacagacctcatgattctaaaaaacacaaaggatgcagtac

SEQ ID NO: 105822 - DNA, 47 bp, Artificial Sequence
  Description of Artificial Sequence: Synthetic oligonucleotide
caataatacagacctcatgattctaaaaaacacaaaggatgcagtac

SEQ ID NO: 105823 - DNA, 47 bp, Artificial Sequence
  Description of Artificial Sequence: Synthetic oligonucleotide
aataatacagacctcatgattctaaaaaacacaaaggatgcagtacg

SEQ ID NO: 105824 - DNA, 46 bp, Artificial Sequence
  Description of Artificial Sequence: Synthetic oligonucleotide
ataatacagacctcatgattctaaaaaacacaaaggatgcagtacg

SEQ ID NO: 105825 - DNA, 45 bp, Artificial Sequence
  Description of Artificial Sequence: Synthetic oligonucleotide
taatacagacctcatgattctaaaaaacacaaaggatgcagtacg

SEQ ID NO: 105826 - DNA, 44 bp, Artificial Sequence
  Description of Artificial Sequence: Synthetic oligonucleotide
aatacagacctcatgattctaaaaaacacaaaggatgcagtacg

SEQ ID NO: 105827 - DNA, 43 bp, Artificial Sequence
  Description of Artificial Sequence: Synthetic oligonucleotide
atacagacctcatgattctaaaaaacacaaaggatgcagtacg

SEQ ID NO: 105828 - DNA, 42 bp, Artificial Sequence
  Description of Artificial Sequence: Synthetic oligonucleotide
tacagacctcatgattctaaaaaacacaaaggatgcagtacg

SEQ ID NO: 105829 - DNA, 41 bp, Artificial Sequence
  Description of Artificial Sequence: Synthetic oligonucleotide
acagacctcatgattctaaaaaacacaaaggatgcagtacg

SEQ ID NO: 105830 - DNA, 40 bp, Artificial Sequence
  Description of Artificial Sequence: Synthetic oligonucleotide
cagacctcatgattctaaaaaacacaaaggatgcagtacg

SEQ ID NO: 105831 - DNA, 40 bp, Artificial Sequence
  Description of Artificial Sequence: Synthetic oligonucleotide
agacctcatgattctaaaaaacacaaaggatgcagtacgg

SEQ ID NO: 105832 - DNA, 39 bp, Artificial Sequence
  Description of Artificial Sequence: Synthetic oligonucleotide
gacctcatgattctaaaaaacacaaaggatgcagtacgg

SEQ ID NO: 105833 - DNA, 43 bp, Artificial Sequence
  Description of Artificial Sequence: Synthetic oligonucleotide
acctcatgattctaaaaaacacaaaggatgcagtacggaattc

SEQ ID NO: 105834 - DNA, 42 bp, Artificial Sequence
  Description of Artificial Sequence: Synthetic oligonucleotide
cctcatgattctaaaaaacacaaaggatgcagtacggaattc

SEQ ID NO: 105835 - DNA, 43 bp, Artificial Sequence
  Description of Artificial Sequence: Synthetic oligonucleotide
ctcatgattctaaaaaacacaaaggatgcagtacggaattctg

SEQ ID NO: 105836 - DNA, 46 bp, Artificial Sequence
  Description of Artificial Sequence: Synthetic oligonucleotide
tcatgattctaaaaaacacaaaggatgcagtacggaattctgtatg

SEQ ID NO: 105837 - DNA, 45 bp, Artificial Sequence
  Description of Artificial Sequence: Synthetic oligonucleotide
catgattctaaaaaacacaaaggatgcagtacggaattctgtatg

SEQ ID NO: 105838 - DNA, 46 bp, Artificial Sequence
  Description of Artificial Sequence: Synthetic oligonucleotide
atgattctaaaaaacacaaaggatgcagtacggaattctgtatgtc

SEQ ID NO: 105839 - DNA, 45 bp, Artificial Sequence
  Description of Artificial Sequence: Synthetic oligonucleotide
tgattctaaaaaacacaaaggatgcagtacggaattctgtatgtc

SEQ ID NO: 105840 - DNA, 44 bp, Artificial Sequence
  Description of Artificial Sequence: Synthetic oligonucleotide
gattctaaaaaacacaaaggatgcagtacggaattctgtatgtc

SEQ ID NO: 105841 - DNA, 47 bp, Artificial Sequence
  Description of Artificial Sequence: Synthetic oligonucleotide
attctaaaaaacacaaaggatgcagtacggaattctgtatgtcatac

SEQ ID NO: 105842 - DNA, 46 bp, Artificial Sequence
  Description of Artificial Sequence: Synthetic oligonucleotide
ttctaaaaaacacaaaggatgcagtacggaattctgtatgtcatac

SEQ ID NO: 105843 - DNA, 45 bp, Artificial Sequence
  Description of Artificial Sequence: Synthetic oligonucleotide
tctaaaaaacacaaaggatgcagtacggaattctgtatgtcatac

SEQ ID NO: 105844 - DNA, 44 bp, Artificial Sequence
  Description of Artificial Sequence: Synthetic oligonucleotide
ctaaaaaacacaaaggatgcagtacggaattctgtatgtcatac

SEQ ID NO: 105845 - DNA, 45 bp, Artificial Sequence
  Description of Artificial Sequence: Synthetic oligonucleotide
taaaaaacacaaaggatgcagtacggaattctgtatgtcatactg

SEQ ID NO: 105846 - DNA, 44 bp, Artificial Sequence
  Description of Artificial Sequence: Synthetic oligonucleotide
aaaaaacacaaaggatgcagtacggaattctgtatgtcatactg

SEQ ID NO: 105847 - DNA, 43 bp, Artificial Sequence
  Description of Artificial Sequence: Synthetic oligonucleotide
aaaaacacaaaggatgcagtacggaattctgtatgtcatactg

SEQ ID NO: 105848 - DNA, 42 bp, Artificial Sequence
  Description of Artificial Sequence: Synthetic oligonucleotide
aaaacacaaaggatgcagtacggaattctgtatgtcatactg

SEQ ID NO: 105849 - DNA, 41 bp, Artificial Sequence
  Description of Artificial Sequence: Synthetic oligonucleotide
aaacacaaaggatgcagtacggaattctgtatgtcatactg

SEQ ID NO: 105850 - DNA, 40 bp, Artificial Sequence
  Description of Artificial Sequence: Synthetic oligonucleotide
aacacaaaggatgcagtacggaattctgtatgtcatactg

SEQ ID NO: 105851 - DNA, 39 bp, Artificial Sequence
  Description of Artificial Sequence: Synthetic oligonucleotide
acacaaaggatgcagtacggaattctgtatgtcatactg

SEQ ID NO: 105852 - DNA, 38 bp, Artificial Sequence
  Description of Artificial Sequence: Synthetic oligonucleotide
cacaaaggatgcagtacggaattctgtatgtcatactg

SEQ ID NO: 105853 - DNA, 38 bp, Artificial Sequence
  Description of Artificial Sequence: Synthetic oligonucleotide
acaaaggatgcagtacggaattctgtatgtcatactgc

SEQ ID NO: 105854 - DNA, 37 bp, Artificial Sequence
  Description of Artificial Sequence: Synthetic oligonucleotide
caaaggatgcagtacggaattctgtatgtcatactgc

SEQ ID NO: 105855 - DNA, 39 bp, Artificial Sequence
  Description of Artificial Sequence: Synthetic oligonucleotide
aaaggatgcagtacggaattctgtatgtcatactgcaac

SEQ ID NO: 105856 - DNA, 38 bp, Artificial Sequence
  Description of Artificial Sequence: Synthetic oligonucleotide
aaggatgcagtacggaattctgtatgtcatactgcaac

SEQ ID NO: 105857 - DNA, 37 bp, Artificial Sequence
  Description of Artificial Sequence: Synthetic oligonucleotide
aggatgcagtacggaattctgtatgtcatactgcaac

SEQ ID NO: 105858 - DNA, 36 bp, Artificial Sequence
  Description of Artificial Sequence: Synthetic oligonucleotide
ggatgcagtacggaattctgtatgtcatactgcaac

SEQ ID NO: 105859 - DNA, 36 bp, Artificial Sequence
  Description of Artificial Sequence: Synthetic oligonucleotide
gatgcagtacggaattctgtatgtcatactgcaacc

SEQ ID NO: 105860 - DNA, 36 bp, Artificial Sequence
  Description of Artificial Sequence: Synthetic oligonucleotide
atgcagtacggaattctgtatgtcatactgcaaccg

SEQ ID NO: 105861 - DNA, 35 bp, Artificial Sequence
  Description of Artificial Sequence: Synthetic oligonucleotide
tgcagtacggaattctgtatgtcatactgcaaccg

SEQ ID NO: 105862 - DNA, 34 bp, Artificial Sequence
  Description of Artificial Sequence: Synthetic oligonucleotide
gcagtacggaattctgtatgtcatactgcaaccg

SEQ ID NO: 105863 - DNA, 39 bp, Artificial Sequence
  Description of Artificial Sequence: Synthetic oligonucleotide
cagtacggaattctgtatgtcatactgcaaccgttatag

SEQ ID NO: 105864 - DNA, 39 bp, Artificial Sequence
  Description of Artificial Sequence: Synthetic oligonucleotide
agtacggaattctgtatgtcatactgcaaccgttatagc

SEQ ID NO: 105865 - DNA, 38 bp, Artificial Sequence
  Description of Artificial Sequence: Synthetic oligonucleotide
gtacggaattctgtatgtcatactgcaaccgttatagc

SEQ ID NO: 105866 - DNA, 41 bp, Artificial Sequence
  Description of Artificial Sequence: Synthetic oligonucleotide
tacggaattctgtatgtcatactgcaaccgttatagcaaac

SEQ ID NO: 105867 - DNA, 40 bp, Artificial Sequence
  Description of Artificial Sequence: Synthetic oligonucleotide
acggaattctgtatgtcatactgcaaccgttatagcaaac

SEQ ID NO: 105868 - DNA, 39 bp, Artificial Sequence
  Description of Artificial Sequence: Synthetic oligonucleotide
cggaattctgtatgtcatactgcaaccgttatagcaaac

SEQ ID NO: 105869 - DNA, 40 bp, Artificial Sequence
  Description of Artificial Sequence: Synthetic oligonucleotide
ggaattctgtatgtcatactgcaaccgttatagcaaactc

SEQ ID NO: 105870 - DNA, 46 bp, Artificial Sequence
  Description of Artificial Sequence: Synthetic oligonucleotide
gaattctgtatgtcatactgcaaccgttatagcaaactcttttatg

SEQ ID NO: 105871 - DNA, 46 bp, Artificial Sequence
  Description of Artificial Sequence: Synthetic oligonucleotide
aattctgtatgtcatactgcaaccgttatagcaaactcttttatgc

SEQ ID NO: 105872 - DNA, 45 bp, Artificial Sequence
  Description of Artificial Sequence: Synthetic oligonucleotide
attctgtatgtcatactgcaaccgttatagcaaactcttttatgc

SEQ ID NO: 105873 - DNA, 44 bp, Artificial Sequence
  Description of Artificial Sequence: Synthetic oligonucleotide
ttctgtatgtcatactgcaaccgttatagcaaactcttttatgc

SEQ ID NO: 105874 - DNA, 43 bp, Artificial Sequence
  Description of Artificial Sequence: Synthetic oligonucleotide
tctgtatgtcatactgcaaccgttatagcaaactcttttatgc

SEQ ID NO: 105875 - DNA, 42 bp, Artificial Sequence
  Description of Artificial Sequence: Synthetic oligonucleotide
ctgtatgtcatactgcaaccgttatagcaaactcttttatgc

SEQ ID NO: 105876 - DNA, 43 bp, Artificial Sequence
  Description of Artificial Sequence: Synthetic oligonucleotide
tgtatgtcatactgcaaccgttatagcaaactcttttatgcac

SEQ ID NO: 105877 - DNA, 42 bp, Artificial Sequence
  Description of Artificial Sequence: Synthetic oligonucleotide
gtatgtcatactgcaaccgttatagcaaactcttttatgcac

SEQ ID NO: 105878 - DNA, 43 bp, Artificial Sequence
  Description of Artificial Sequence: Synthetic oligonucleotide
tatgtcatactgcaaccgttatagcaaactcttttatgcactg

SEQ ID NO: 105879 - DNA, 42 bp, Artificial Sequence
  Description of Artificial Sequence: Synthetic oligonucleotide
atgtcatactgcaaccgttatagcaaactcttttatgcactg

SEQ ID NO: 105880 - DNA, 41 bp, Artificial Sequence
  Description of Artificial Sequence: Synthetic oligonucleotide
tgtcatactgcaaccgttatagcaaactcttttatgcactg

SEQ ID NO: 105881 - DNA, 40 bp, Artificial Sequence
  Description of Artificial Sequence: Synthetic oligonucleotide
gtcatactgcaaccgttatagcaaactcttttatgcactg

SEQ ID NO: 105882 - DNA, 41 bp, Artificial Sequence
  Description of Artificial Sequence: Synthetic oligonucleotide
tcatactgcaaccgttatagcaaactcttttatgcactgtg

SEQ ID NO: 105883 - DNA, 40 bp, Artificial Sequence
  Description of Artificial Sequence: Synthetic oligonucleotide
catactgcaaccgttatagcaaactcttttatgcactgtg

SEQ ID NO: 105884 - DNA, 40 bp, Artificial Sequence
  Description of Artificial Sequence: Synthetic oligonucleotide
atactgcaaccgttatagcaaactcttttatgcactgtgg

SEQ ID NO: 105885 - DNA, 39 bp, Artificial Sequence
  Description of Artificial Sequence: Synthetic oligonucleotide
tactgcaaccgttatagcaaactcttttatgcactgtgg

SEQ ID NO: 105886 - DNA, 38 bp, Artificial Sequence
  Description of Artificial Sequence: Synthetic oligonucleotide
actgcaaccgttatagcaaactcttttatgcactgtgg

SEQ ID NO: 105887 - DNA, 37 bp, Artificial Sequence
  Description of Artificial Sequence: Synthetic oligonucleotide
ctgcaaccgttatagcaaactcttttatgcactgtgg

SEQ ID NO: 105888 - DNA, 37 bp, Artificial Sequence
  Description of Artificial Sequence: Synthetic oligonucleotide
tgcaaccgttatagcaaactcttttatgcactgtggg

SEQ ID NO: 105889 - DNA, 36 bp, Artificial Sequence
  Description of Artificial Sequence: Synthetic oligonucleotide
gcaaccgttatagcaaactcttttatgcactgtggg

SEQ ID NO: 105890 - DNA, 37 bp, Artificial Sequence
  Description of Artificial Sequence: Synthetic oligonucleotide
caaccgttatagcaaactcttttatgcactgtgggac

SEQ ID NO: 105891 - DNA, 39 bp, Artificial Sequence
  Description of Artificial Sequence: Synthetic oligonucleotide
aaccgttatagcaaactcttttatgcactgtgggacaac

SEQ ID NO: 105892 - DNA, 38 bp, Artificial Sequence
  Description of Artificial Sequence: Synthetic oligonucleotide
accgttatagcaaactcttttatgcactgtgggacaac

SEQ ID NO: 105893 - DNA, 37 bp, Artificial Sequence
  Description of Artificial Sequence: Synthetic oligonucleotide
ccgttatagcaaactcttttatgcactgtgggacaac

SEQ ID NO: 105894 - DNA, 37 bp, Artificial Sequence
  Description of Artificial Sequence: Synthetic oligonucleotide
cgttatagcaaactcttttatgcactgtgggacaacc

SEQ ID NO: 105895 - DNA, 38 bp, Artificial Sequence
  Description of Artificial Sequence: Synthetic oligonucleotide
gttatagcaaactcttttatgcactgtgggacaaccag

SEQ ID NO: 105896 - DNA, 39 bp, Artificial Sequence
  Description of Artificial Sequence: Synthetic oligonucleotide
ttatagcaaactcttttatgcactgtgggacaaccagtg

SEQ ID NO: 105897 - DNA, 38 bp, Artificial Sequence
  Description of Artificial Sequence: Synthetic oligonucleotide
tatagcaaactcttttatgcactgtgggacaaccagtg

SEQ ID NO: 105898 - DNA, 37 bp, Artificial Sequence
  Description of Artificial Sequence: Synthetic oligonucleotide
atagcaaactcttttatgcactgtgggacaaccagtg

SEQ ID NO: 105899 - DNA, 36 bp, Artificial Sequence
  Description of Artificial Sequence: Synthetic oligonucleotide
tagcaaactcttttatgcactgtgggacaaccagtg

SEQ ID NO: 105900 - DNA, 35 bp, Artificial Sequence
  Description of Artificial Sequence: Synthetic oligonucleotide
agcaaactcttttatgcactgtgggacaaccagtg

SEQ ID NO: 105901 - DNA, 34 bp, Artificial Sequence
  Description of Artificial Sequence: Synthetic oligonucleotide
gcaaactcttttatgcactgtgggacaaccagtg

SEQ ID NO: 105902 - DNA, 35 bp, Artificial Sequence
  Description of Artificial Sequence: Synthetic oligonucleotide
caaactcttttatgcactgtgggacaaccagtgac

SEQ ID NO: 105903 - DNA, 35 bp, Artificial Sequence
  Description of Artificial Sequence: Synthetic oligonucleotide
aaactcttttatgcactgtgggacaaccagtgacc

SEQ ID NO: 105904 - DNA, 34 bp, Artificial Sequence
  Description of Artificial Sequence: Synthetic oligonucleotide
aactcttttatgcactgtgggacaaccagtgacc

SEQ ID NO: 105905 - DNA, 33 bp, Artificial Sequence
  Description of Artificial Sequence: Synthetic oligonucleotide
actcttttatgcactgtgggacaaccagtgacc

SEQ ID NO: 105906 - DNA, 32 bp, Artificial Sequence
  Description of Artificial Sequence: Synthetic oligonucleotide
ctcttttatgcactgtgggacaaccagtgacc

SEQ ID NO: 105907 - DNA, 33 bp, Artificial Sequence
  Description of Artificial Sequence: Synthetic oligonucleotide
tcttttatgcactgtgggacaaccagtgaccag

SEQ ID NO: 105908 - DNA, 32 bp, Artificial Sequence
  Description of Artificial Sequence: Synthetic oligonucleotide
cttttatgcactgtgggacaaccagtgaccag

SEQ ID NO: 105909 - DNA, 35 bp, Artificial Sequence
  Description of Artificial Sequence: Synthetic oligonucleotide
ttttatgcactgtgggacaaccagtgaccagtttc

SEQ ID NO: 105910 - DNA, 34 bp, Artificial Sequence
  Description of Artificial Sequence: Synthetic oligonucleotide
tttatgcactgtgggacaaccagtgaccagtttc

SEQ ID NO: 105911 - DNA, 33 bp, Artificial Sequence
  Description of Artificial Sequence: Synthetic oligonucleotide
ttatgcactgtgggacaaccagtgaccagtttc

SEQ ID NO: 105912 - DNA, 32 bp, Artificial Sequence
  Description of Artificial Sequence: Synthetic oligonucleotide
tatgcactgtgggacaaccagtgaccagtttc

SEQ ID NO: 105913 - DNA, 31 bp, Artificial Sequence
  Description of Artificial Sequence: Synthetic oligonucleotide
atgcactgtgggacaaccagtgaccagtttc

SEQ ID NO: 105914 - DNA, 30 bp, Artificial Sequence
  Description of Artificial Sequence: Synthetic oligonucleotide
tgcactgtgggacaaccagtgaccagtttc

SEQ ID NO: 105915 - DNA, 29 bp, Artificial Sequence
  Description of Artificial Sequence: Synthetic oligonucleotide
gcactgtgggacaaccagtgaccagtttc

SEQ ID NO: 105916 - DNA, 32 bp, Artificial Sequence
  Description of Artificial Sequence: Synthetic oligonucleotide
cactgtgggacaaccagtgaccagtttcttag

SEQ ID NO: 105917 - DNA, 33 bp, Artificial Sequence
  Description of Artificial Sequence: Synthetic oligonucleotide
actgtgggacaaccagtgaccagtttcttagag

SEQ ID NO: 105918 - DNA, 32 bp, Artificial Sequence
  Description of Artificial Sequence: Synthetic oligonucleotide
ctgtgggacaaccagtgaccagtttcttagag

SEQ ID NO: 105919 - DNA, 39 bp, Artificial Sequence
  Description of Artificial Sequence: Synthetic oligonucleotide
tgtgggacaaccagtgaccagtttcttagagataatttg

SEQ ID NO: 105920 - DNA, 38 bp, Artificial Sequence
  Description of Artificial Sequence: Synthetic oligonucleotide
gtgggacaaccagtgaccagtttcttagagataatttg

SEQ ID NO: 105921 - DNA, 38 bp, Artificial Sequence
  Description of Artificial Sequence: Synthetic oligonucleotide
tgggacaaccagtgaccagtttcttagagataatttgg

SEQ ID NO: 105922 - DNA, 37 bp, Artificial Sequence
  Description of Artificial Sequence: Synthetic oligonucleotide
gggacaaccagtgaccagtttcttagagataatttgg

SEQ ID NO: 105923 - DNA, 40 bp, Artificial Sequence
  Description of Artificial Sequence: Synthetic oligonucleotide
ggacaaccagtgaccagtttcttagagataatttggaatg

SEQ ID NO: 105924 - DNA, 40 bp, Artificial Sequence
  Description of Artificial Sequence: Synthetic oligonucleotide
gacaaccagtgaccagtttcttagagataatttggaatgg

SEQ ID NO: 105925 - DNA, 43 bp, Artificial Sequence
  Description of Artificial Sequence: Synthetic oligonucleotide
acaaccagtgaccagtttcttagagataatttggaatggttag

SEQ ID NO: 105926 - DNA, 42 bp, Artificial Sequence
  Description of Artificial Sequence: Synthetic oligonucleotide
caaccagtgaccagtttcttagagataatttggaatggttag

SEQ ID NO: 105927 - DNA, 42 bp, Artificial Sequence
  Description of Artificial Sequence: Synthetic oligonucleotide
aaccagtgaccagtttcttagagataatttggaatggttagc

SEQ ID NO: 105928 - DNA, 41 bp, Artificial Sequence
  Description of Artificial Sequence: Synthetic oligonucleotide
accagtgaccagtttcttagagataatttggaatggttagc

SEQ ID NO: 105929 - DNA, 40 bp, Artificial Sequence
  Description of Artificial Sequence: Synthetic oligonucleotide
ccagtgaccagtttcttagagataatttggaatggttagc

SEQ ID NO: 105930 - DNA, 40 bp, Artificial Sequence
  Description of Artificial Sequence: Synthetic oligonucleotide
cagtgaccagtttcttagagataatttggaatggttagcc

SEQ ID NO: 105931 - DNA, 41 bp, Artificial Sequence
  Description of Artificial Sequence: Synthetic oligonucleotide
agtgaccagtttcttagagataatttggaatggttagccag

SEQ ID NO: 105932 - DNA, 40 bp, Artificial Sequence
  Description of Artificial Sequence: Synthetic oligonucleotide
gtgaccagtttcttagagataatttggaatggttagccag

SEQ ID NO: 105933 - DNA, 41 bp, Artificial Sequence
  Description of Artificial Sequence: Synthetic oligonucleotide
tgaccagtttcttagagataatttggaatggttagccagag

SEQ ID NO: 105934 - DNA, 40 bp, Artificial Sequence
  Description of Artificial Sequence: Synthetic oligonucleotide
gaccagtttcttagagataatttggaatggttagccagag

SEQ ID NO: 105935 - DNA, 40 bp, Artificial Sequence
  Description of Artificial Sequence: Synthetic oligonucleotide
accagtttcttagagataatttggaatggttagccagagc

SEQ ID NO: 105936 - DNA, 39 bp, Artificial Sequence
  Description of Artificial Sequence: Synthetic oligonucleotide
ccagtttcttagagataatttggaatggttagccagagc

SEQ ID NO: 105937 - DNA, 39 bp, Artificial Sequence
  Description of Artificial Sequence: Synthetic oligonucleotide
cagtttcttagagataatttggaatggttagccagagcc

SEQ ID NO: 105938 - DNA, 40 bp, Artificial Sequence
  Description of Artificial Sequence: Synthetic oligonucleotide
agtttcttagagataatttggaatggttagccagagccac

SEQ ID NO: 105939 - DNA, 39 bp, Artificial Sequence
  Description of Artificial Sequence: Synthetic oligonucleotide
gtttcttagagataatttggaatggttagccagagccac

SEQ ID NO: 105940 - DNA, 42 bp, Artificial Sequence
  Description of Artificial Sequence: Synthetic oligonucleotide
tttcttagagataatttggaatggttagccagagccactaac

SEQ ID NO: 105941 - DNA, 41 bp, Artificial Sequence
  Description of Artificial Sequence: Synthetic oligonucleotide
ttcttagagataatttggaatggttagccagagccactaac

SEQ ID NO: 105942 - DNA, 40 bp, Artificial Sequence
  Description of Artificial Sequence: Synthetic oligonucleotide
tcttagagataatttggaatggttagccagagccactaac

SEQ ID NO: 105943 - DNA, 39 bp, Artificial Sequence
  Description of Artificial Sequence: Synthetic oligonucleotide
cttagagataatttggaatggttagccagagccactaac

SEQ ID NO: 105944 - DNA, 40 bp, Artificial Sequence
  Description of Artificial Sequence: Synthetic oligonucleotide
ttagagataatttggaatggttagccagagccactaactg

SEQ ID NO: 105945 - DNA, 39 bp, Artificial Sequence
  Description of Artificial Sequence: Synthetic oligonucleotide
tagagataatttggaatggttagccagagccactaactg

SEQ ID NO: 105946 - DNA, 38 bp, Artificial Sequence
  Description of Artificial Sequence: Synthetic oligonucleotide
agagataatttggaatggttagccagagccactaactg

SEQ ID NO: 105947 - DNA, 37 bp, Artificial Sequence
  Description of Artificial Sequence: Synthetic oligonucleotide
gagataatttggaatggttagccagagccactaactg

SEQ ID NO: 105948 - DNA, 37 bp, Artificial Sequence
  Description of Artificial Sequence: Synthetic oligonucleotide
agataatttggaatggttagccagagccactaactgg

SEQ ID NO: 105949 - DNA, 36 bp, Artificial Sequence
  Description of Artificial Sequence: Synthetic oligonucleotide
gataatttggaatggttagccagagccactaactgg

SEQ ID NO: 105950 - DNA, 36 bp, Artificial Sequence
  Description of Artificial Sequence: Synthetic oligonucleotide
ataatttggaatggttagccagagccactaactggg

SEQ ID NO: 105951 - DNA, 35 bp, Artificial Sequence
  Description of Artificial Sequence: Synthetic oligonucleotide
taatttggaatggttagccagagccactaactggg

SEQ ID NO: 105952 - DNA, 34 bp, Artificial Sequence
  Description of Artificial Sequence: Synthetic oligonucleotide
aatttggaatggttagccagagccactaactggg

SEQ ID NO: 105953 - DNA, 33 bp, Artificial Sequence
  Description of Artificial Sequence: Synthetic oligonucleotide
atttggaatggttagccagagccactaactggg

SEQ ID NO: 105954 - DNA, 32 bp, Artificial Sequence
  Description of Artificial Sequence: Synthetic oligonucleotide
tttggaatggttagccagagccactaactggg

SEQ ID NO: 105955 - DNA, 31 bp, Artificial Sequence
  Description of Artificial Sequence: Synthetic oligonucleotide
ttggaatggttagccagagccactaactggg

SEQ ID NO: 105956 - DNA, 30 bp, Artificial Sequence
  Description of Artificial Sequence: Synthetic oligonucleotide
tggaatggttagccagagccactaactggg

SEQ ID NO: 105957 - DNA, 29 bp, Artificial Sequence
  Description of Artificial Sequence: Synthetic oligonucleotide
ggaatggttagccagagccactaactggg

SEQ ID NO: 105958 - DNA, 29 bp, Artificial Sequence
  Description of Artificial Sequence: Synthetic oligonucleotide
gaatggttagccagagccactaactgggc

SEQ ID NO: 105959 - DNA, 37 bp, Artificial Sequence
  Description of Artificial Sequence: Synthetic oligonucleotide
aatggttagccagagccactaactgggcaaaatttac

SEQ ID NO: 105960 - DNA, 36 bp, Artificial Sequence
  Description of Artificial Sequence: Synthetic oligonucleotide
atggttagccagagccactaactgggcaaaatttac

SEQ ID NO: 105961 - DNA, 35 bp, Artificial Sequence
  Description of Artificial Sequence: Synthetic oligonucleotide
tggttagccagagccactaactgggcaaaatttac

SEQ ID NO: 105962 - DNA, 34 bp, Artificial Sequence
  Description of Artificial Sequence: Synthetic oligonucleotide
ggttagccagagccactaactgggcaaaatttac

SEQ ID NO: 105963 - DNA, 35 bp, Artificial Sequence
  Description of Artificial Sequence: Synthetic oligonucleotide
gttagccagagccactaactgggcaaaatttactg

SEQ ID NO: 105964 - DNA, 35 bp, Artificial Sequence
  Description of Artificial Sequence: Synthetic oligonucleotide
ttagccagagccactaactgggcaaaatttactgc

SEQ ID NO: 105965 - DNA, 34 bp, Artificial Sequence
  Description of Artificial Sequence: Synthetic oligonucleotide
tagccagagccactaactgggcaaaatttactgc

SEQ ID NO: 105966 - DNA, 33 bp, Artificial Sequence
  Description of Artificial Sequence: Synthetic oligonucleotide
agccagagccactaactgggcaaaatttactgc

SEQ ID NO: 105967 - DNA, 32 bp, Artificial Sequence
  Description of Artificial Sequence: Synthetic oligonucleotide
gccagagccactaactgggcaaaatttactgc

SEQ ID NO: 105968 - DNA, 34 bp, Artificial Sequence
  Description of Artificial Sequence: Synthetic oligonucleotide
ccagagccactaactgggcaaaatttactgctac

SEQ ID NO: 105969 - DNA, 35 bp, Artificial Sequence
  Description of Artificial Sequence: Synthetic oligonucleotide
cagagccactaactgggcaaaatttactgctacag

SEQ ID NO: 105970 - DNA, 35 bp, Artificial Sequence
  Description of Artificial Sequence: Synthetic oligonucleotide
agagccactaactgggcaaaatttactgctacagc

SEQ ID NO: 105971 - DNA, 34 bp, Artificial Sequence
  Description of Artificial Sequence: Synthetic oligonucleotide
gagccactaactgggcaaaatttactgctacagc

SEQ ID NO: 105972 - DNA, 34 bp, Artificial Sequence
  Description of Artificial Sequence: Synthetic oligonucleotide
agccactaactgggcaaaatttactgctacagcc

SEQ ID NO: 105973 - DNA, 33 bp, Artificial Sequence
  Description of Artificial Sequence: Synthetic oligonucleotide
gccactaactgggcaaaatttactgctacagcc

SEQ ID NO: 105974 - DNA, 34 bp, Artificial Sequence
  Description of Artificial Sequence: Synthetic oligonucleotide
ccactaactgggcaaaatttactgctacagccag

SEQ ID NO: 105975 - DNA, 37 bp, Artificial Sequence
  Description of Artificial Sequence: Synthetic oligonucleotide
cactaactgggcaaaatttactgctacagccagtttg

SEQ ID NO: 105976 - DNA, 37 bp, Artificial Sequence
  Description of Artificial Sequence: Synthetic oligonucleotide
actaactgggcaaaatttactgctacagccagtttgg

SEQ ID NO: 105977 - DNA, 36 bp, Artificial Sequence
  Description of Artificial Sequence: Synthetic oligonucleotide
ctaactgggcaaaatttactgctacagccagtttgg

SEQ ID NO: 105978 - DNA, 36 bp, Artificial Sequence
  Description of Artificial Sequence: Synthetic oligonucleotide
taactgggcaaaatttactgctacagccagtttggg

SEQ ID NO: 105979 - DNA, 35 bp, Artificial Sequence
  Description of Artificial Sequence: Synthetic oligonucleotide
aactgggcaaaatttactgctacagccagtttggg

SEQ ID NO: 105980 - DNA, 34 bp, Artificial Sequence
  Description of Artificial Sequence: Synthetic oligonucleotide
actgggcaaaatttactgctacagccagtttggg

SEQ ID NO: 105981 - DNA, 33 bp, Artificial Sequence
  Description of Artificial Sequence: Synthetic oligonucleotide
ctgggcaaaatttactgctacagccagtttggg

SEQ ID NO: 105982 - DNA, 34 bp, Artificial Sequence
  Description of Artificial Sequence: Synthetic oligonucleotide
tgggcaaaatttactgctacagccagtttgggtg

SEQ ID NO: 105983 - DNA, 33 bp, Artificial Sequence
  Description of Artificial Sequence: Synthetic oligonucleotide
gggcaaaatttactgctacagccagtttgggtg

SEQ ID NO: 105984 - DNA, 38 bp, Artificial Sequence
  Description of Artificial Sequence: Synthetic oligonucleotide
ggcaaaatttactgctacagccagtttgggtgtaattc

SEQ ID NO: 105985 - DNA, 42 bp, Artificial Sequence
  Description of Artificial Sequence: Synthetic oligonucleotide
gcaaaatttactgctacagccagtttgggtgtaattcataag

SEQ ID NO: 105986 - DNA, 42 bp, Artificial Sequence
  Description of Artificial Sequence: Synthetic oligonucleotide
caaaatttactgctacagccagtttgggtgtaattcataagg

SEQ ID NO: 105987 - DNA, 42 bp, Artificial Sequence
  Description of Artificial Sequence: Synthetic oligonucleotide
aaaatttactgctacagccagtttgggtgtaattcataaggg

SEQ ID NO: 105988 - DNA, 41 bp, Artificial Sequence
  Description of Artificial Sequence: Synthetic oligonucleotide
aaatttactgctacagccagtttgggtgtaattcataaggg

SEQ ID NO: 105989 - DNA, 40 bp, Artificial Sequence
  Description of Artificial Sequence: Synthetic oligonucleotide
aatttactgctacagccagtttgggtgtaattcataaggg

SEQ ID NO: 105990 - DNA, 39 bp, Artificial Sequence
  Description of Artificial Sequence: Synthetic oligonucleotide
atttactgctacagccagtttgggtgtaattcataaggg

SEQ ID NO: 105991 - DNA, 38 bp, Artificial Sequence
  Description of Artificial Sequence: Synthetic oligonucleotide
tttactgctacagccagtttgggtgtaattcataaggg

SEQ ID NO: 105992 - DNA, 37 bp, Artificial Sequence
  Description of Artificial Sequence: Synthetic oligonucleotide
ttactgctacagccagtttgggtgtaattcataaggg

SEQ ID NO: 105993 - DNA, 36 bp, Artificial Sequence
  Description of Artificial Sequence: Synthetic oligonucleotide
tactgctacagccagtttgggtgtaattcataaggg

SEQ ID NO: 105994 - DNA, 35 bp, Artificial Sequence
  Description of Artificial Sequence: Synthetic oligonucleotide
actgctacagccagtttgggtgtaattcataaggg

SEQ ID NO: 105995 - DNA, 34 bp, Artificial Sequence
  Description of Artificial Sequence: Synthetic oligonucleotide
ctgctacagccagtttgggtgtaattcataaggg

SEQ ID NO: 105996 - DNA, 35 bp, Artificial Sequence
  Description of Artificial Sequence: Synthetic oligonucleotide
tgctacagccagtttgggtgtaattcataagggtc

SEQ ID NO: 105997 - DNA, 34 bp, Artificial Sequence
  Description of Artificial Sequence: Synthetic oligonucleotide
gctacagccagtttgggtgtaattcataagggtc

SEQ ID NO: 105998 - DNA, 36 bp, Artificial Sequence
  Description of Artificial Sequence: Synthetic oligonucleotide
ctacagccagtttgggtgtaattcataagggtcatg

SEQ ID NO: 105999 - DNA, 41 bp, Artificial Sequence
  Description of Artificial Sequence: Synthetic oligonucleotide
tacagccagtttgggtgtaattcataagggtcatgaaaaag

SEQ ID NO: 106000 - DNA, 40 bp, Artificial Sequence
  Description of Artificial Sequence: Synthetic oligonucleotide
acagccagtttgggtgtaattcataagggtcatgaaaaag

SEQ ID NO: 106001 - DNA, 39 bp, Artificial Sequence
  Description of Artificial Sequence: Synthetic oligonucleotide
cagccagtttgggtgtaattcataagggtcatgaaaaag

SEQ ID NO: 106002 - DNA, 41 bp, Artificial Sequence
  Description of Artificial Sequence: Synthetic oligonucleotide
agccagtttgggtgtaattcataagggtcatgaaaaagaag

SEQ ID NO: 106003 - DNA, 40 bp, Artificial Sequence
  Description of Artificial Sequence: Synthetic oligonucleotide
gccagtttgggtgtaattcataagggtcatgaaaaagaag

SEQ ID NO: 106004 - DNA, 40 bp, Artificial Sequence
  Description of Artificial Sequence: Synthetic oligonucleotide
ccagtttgggtgtaattcataagggtcatgaaaaagaagc

SEQ ID NO: 106005 - DNA, 44 bp, Artificial Sequence
  Description of Artificial Sequence: Synthetic oligonucleotide
cagtttgggtgtaattcataagggtcatgaaaaagaagcattac

SEQ ID NO: 106006 - DNA, 45 bp, Artificial Sequence
  Description of Artificial Sequence: Synthetic oligonucleotide
agtttgggtgtaattcataagggtcatgaaaaagaagcattacag

SEQ ID NO: 106007 - DNA, 44 bp, Artificial Sequence
  Description of Artificial Sequence: Synthetic oligonucleotide
gtttgggtgtaattcataagggtcatgaaaaagaagcattacag

SEQ ID NO: 106008 - DNA, 49 bp, Artificial Sequence
  Description of Artificial Sequence: Synthetic oligonucleotide
tttgggtgtaattcataagggtcatgaaaaagaagcattacagttaatg

SEQ ID NO: 106009 - DNA, 48 bp, Artificial Sequence
  Description of Artificial Sequence: Synthetic oligonucleotide
ttgggtgtaattcataagggtcatgaaaaagaagcattacagttaatg

SEQ ID NO: 106010 - DNA, 47 bp, Artificial Sequence
  Description of Artificial Sequence: Synthetic oligonucleotide
tgggtgtaattcataagggtcatgaaaaagaagcattacagttaatg

SEQ ID NO: 106011 - DNA, 46 bp, Artificial Sequence
  Description of Artificial Sequence: Synthetic oligonucleotide
gggtgtaattcataagggtcatgaaaaagaagcattacagttaatg

SEQ ID NO: 106012 - DNA, 46 bp, Artificial Sequence
  Description of Artificial Sequence: Synthetic oligonucleotide
ggtgtaattcataagggtcatgaaaaagaagcattacagttaatgg

SEQ ID NO: 106013 - DNA, 46 bp, Artificial Sequence
  Description of Artificial Sequence: Synthetic oligonucleotide
gtgtaattcataagggtcatgaaaaagaagcattacagttaatggc

SEQ ID NO: 106014 - DNA, 48 bp, Artificial Sequence
  Description of Artificial Sequence: Synthetic oligonucleotide
tgtaattcataagggtcatgaaaaagaagcattacagttaatggcaac

SEQ ID NO: 106015 - DNA, 47 bp, Artificial Sequence
  Description of Artificial Sequence: Synthetic oligonucleotide
gtaattcataagggtcatgaaaaagaagcattacagttaatggcaac

SEQ ID NO: 106016 - DNA, 50 bp, Artificial Sequence
  Description of Artificial Sequence: Synthetic oligonucleotide
taattcataagggtcatgaaaaagaagcattacagttaatggcaacatac

SEQ ID NO: 106017 - DNA, 49 bp, Artificial Sequence
  Description of Artificial Sequence: Synthetic oligonucleotide
aattcataagggtcatgaaaaagaagcattacagttaatggcaacatac

SEQ ID NO: 106018 - DNA, 48 bp, Artificial Sequence
  Description of Artificial Sequence: Synthetic oligonucleotide
attcataagggtcatgaaaaagaagcattacagttaatggcaacatac

SEQ ID NO: 106019 - DNA, 47 bp, Artificial Sequence
  Description of Artificial Sequence: Synthetic oligonucleotide
ttcataagggtcatgaaaaagaagcattacagttaatggcaacatac

SEQ ID NO: 106020 - DNA, 46 bp, Artificial Sequence
  Description of Artificial Sequence: Synthetic oligonucleotide
tcataagggtcatgaaaaagaagcattacagttaatggcaacatac

SEQ ID NO: 106021 - DNA, 45 bp, Artificial Sequence
  Description of Artificial Sequence: Synthetic oligonucleotide
cataagggtcatgaaaaagaagcattacagttaatggcaacatac

SEQ ID NO: 106022 - DNA, 45 bp, Artificial Sequence
  Description of Artificial Sequence: Synthetic oligonucleotide
ataagggtcatgaaaaagaagcattacagttaatggcaacatacc

SEQ ID NO: 106023 - DNA, 44 bp, Artificial Sequence
  Description of Artificial Sequence: Synthetic oligonucleotide
taagggtcatgaaaaagaagcattacagttaatggcaacatacc

SEQ ID NO: 106024 - DNA, 43 bp, Artificial Sequence
  Description of Artificial Sequence: Synthetic oligonucleotide
aagggtcatgaaaaagaagcattacagttaatggcaacatacc

SEQ ID NO: 106025 - DNA, 42 bp, Artificial Sequence
  Description of Artificial Sequence: Synthetic oligonucleotide
agggtcatgaaaaagaagcattacagttaatggcaacatacc

SEQ ID NO: 106026 - DNA, 41 bp, Artificial Sequence
  Description of Artificial Sequence: Synthetic oligonucleotide
gggtcatgaaaaagaagcattacagttaatggcaacatacc

SEQ ID NO: 106027 - DNA, 43 bp, Artificial Sequence
  Description of Artificial Sequence: Synthetic oligonucleotide
ggtcatgaaaaagaagcattacagttaatggcaacataccttc

SEQ ID NO: 106028 - DNA, 43 bp, Artificial Sequence
  Description of Artificial Sequence: Synthetic oligonucleotide
gtcatgaaaaagaagcattacagttaatggcaacataccttcc

SEQ ID NO: 106029 - DNA, 43 bp, Artificial Sequence
  Description of Artificial Sequence: Synthetic oligonucleotide
tcatgaaaaagaagcattacagttaatggcaacataccttccc

SEQ ID NO: 106030 - DNA, 42 bp, Artificial Sequence
  Description of Artificial Sequence: Synthetic oligonucleotide
catgaaaaagaagcattacagttaatggcaacataccttccc

SEQ ID NO: 106031 - DNA, 44 bp, Artificial Sequence
  Description of Artificial Sequence: Synthetic oligonucleotide
atgaaaaagaagcattacagttaatggcaacataccttcccaag

SEQ ID NO: 106032 - DNA, 43 bp, Artificial Sequence
  Description of Artificial Sequence: Synthetic oligonucleotide
tgaaaaagaagcattacagttaatggcaacataccttcccaag

SEQ ID NO: 106033 - DNA, 42 bp, Artificial Sequence
  Description of Artificial Sequence: Synthetic oligonucleotide
gaaaaagaagcattacagttaatggcaacataccttcccaag

SEQ ID NO: 106034 - DNA, 42 bp, Artificial Sequence
  Description of Artificial Sequence: Synthetic oligonucleotide
aaaaagaagcattacagttaatggcaacataccttcccaagg

SEQ ID NO: 106035 - DNA, 41 bp, Artificial Sequence
  Description of Artificial Sequence: Synthetic oligonucleotide
aaaagaagcattacagttaatggcaacataccttcccaagg

SEQ ID NO: 106036 - DNA, 40 bp, Artificial Sequence
  Description of Artificial Sequence: Synthetic oligonucleotide
aaagaagcattacagttaatggcaacataccttcccaagg

SEQ ID NO: 106037 - DNA, 39 bp, Artificial Sequence
  Description of Artificial Sequence: Synthetic oligonucleotide
aagaagcattacagttaatggcaacataccttcccaagg

SEQ ID NO: 106038 - DNA, 38 bp, Artificial Sequence
  Description of Artificial Sequence: Synthetic oligonucleotide
agaagcattacagttaatggcaacataccttcccaagg

SEQ ID NO: 106039 - DNA, 37 bp, Artificial Sequence
  Description of Artificial Sequence: Synthetic oligonucleotide
gaagcattacagttaatggcaacataccttcccaagg

SEQ ID NO: 106040 - DNA, 40 bp, Artificial Sequence
  Description of Artificial Sequence: Synthetic oligonucleotide
aagcattacagttaatggcaacataccttcccaaggatac

SEQ ID NO: 106041 - DNA, 39 bp, Artificial Sequence
  Description of Artificial Sequence: Synthetic oligonucleotide
agcattacagttaatggcaacataccttcccaaggatac

SEQ ID NO: 106042 - DNA, 38 bp, Artificial Sequence
  Description of Artificial Sequence: Synthetic oligonucleotide
gcattacagttaatggcaacataccttcccaaggatac

SEQ ID NO: 106043 - DNA, 40 bp, Artificial Sequence
  Description of Artificial Sequence: Synthetic oligonucleotide
cattacagttaatggcaacataccttcccaaggatacttc

SEQ ID NO: 106044 - DNA, 41 bp, Artificial Sequence
  Description of Artificial Sequence: Synthetic oligonucleotide
attacagttaatggcaacataccttcccaaggatacttctc

SEQ ID NO: 106045 - DNA, 40 bp, Artificial Sequence
  Description of Artificial Sequence: Synthetic oligonucleotide
ttacagttaatggcaacataccttcccaaggatacttctc

SEQ ID NO: 106046 - DNA, 39 bp, Artificial Sequence
  Description of Artificial Sequence: Synthetic oligonucleotide
tacagttaatggcaacataccttcccaaggatacttctc

SEQ ID NO: 106047 - DNA, 38 bp, Artificial Sequence
  Description of Artificial Sequence: Synthetic oligonucleotide
acagttaatggcaacataccttcccaaggatacttctc

SEQ ID NO: 106048 - DNA, 37 bp, Artificial Sequence
  Description of Artificial Sequence: Synthetic oligonucleotide
cagttaatggcaacataccttcccaaggatacttctc

SEQ ID NO: 106049 - DNA, 37 bp, Artificial Sequence
  Description of Artificial Sequence: Synthetic oligonucleotide
agttaatggcaacataccttcccaaggatacttctcc

SEQ ID NO: 106050 - DNA, 36 bp, Artificial Sequence
  Description of Artificial Sequence: Synthetic oligonucleotide
gttaatggcaacataccttcccaaggatacttctcc

SEQ ID NO: 106051 - DNA, 37 bp, Artificial Sequence
  Description of Artificial Sequence: Synthetic oligonucleotide
ttaatggcaacataccttcccaaggatacttctccag

SEQ ID NO: 106052 - DNA, 36 bp, Artificial Sequence
  Description of Artificial Sequence: Synthetic oligonucleotide
taatggcaacataccttcccaaggatacttctccag

SEQ ID NO: 106053 - DNA, 35 bp, Artificial Sequence
  Description of Artificial Sequence: Synthetic oligonucleotide
aatggcaacataccttcccaaggatacttctccag

SEQ ID NO: 106054 - DNA, 34 bp, Artificial Sequence
  Description of Artificial Sequence: Synthetic oligonucleotide
atggcaacataccttcccaaggatacttctccag

SEQ ID NO: 106055 - DNA, 33 bp, Artificial Sequence
  Description of Artificial Sequence: Synthetic oligonucleotide
tggcaacataccttcccaaggatacttctccag

SEQ ID NO: 106056 - DNA, 32 bp, Artificial Sequence
  Description of Artificial Sequence: Synthetic oligonucleotide
ggcaacataccttcccaaggatacttctccag

SEQ ID NO: 106057 - DNA, 32 bp, Artificial Sequence
  Description of Artificial Sequence: Synthetic oligonucleotide
gcaacataccttcccaaggatacttctccagg

SEQ ID NO: 106058 - DNA, 34 bp, Artificial Sequence
  Description of Artificial Sequence: Synthetic oligonucleotide
caacataccttcccaaggatacttctccaggatc

SEQ ID NO: 106059 - DNA, 35 bp, Artificial Sequence
  Description of Artificial Sequence: Synthetic oligonucleotide
aacataccttcccaaggatacttctccaggatcag

SEQ ID NO: 106060 - DNA, 34 bp, Artificial Sequence
  Description of Artificial Sequence: Synthetic oligonucleotide
acataccttcccaaggatacttctccaggatcag

SEQ ID NO: 106061 - DNA, 33 bp, Artificial Sequence
  Description of Artificial Sequence: Synthetic oligonucleotide
cataccttcccaaggatacttctccaggatcag

SEQ ID NO: 106062 - DNA, 33 bp, Artificial Sequence
  Description of Artificial Sequence: Synthetic oligonucleotide
ataccttcccaaggatacttctccaggatcagc

SEQ ID NO: 106063 - DNA, 32 bp, Artificial Sequence
  Description of Artificial Sequence: Synthetic oligonucleotide
taccttcccaaggatacttctccaggatcagc

SEQ ID NO: 106064 - DNA, 31 bp, Artificial Sequence
  Description of Artificial Sequence: Synthetic oligonucleotide
accttcccaaggatacttctccaggatcagc

SEQ ID NO: 106065 - DNA, 30 bp, Artificial Sequence
  Description of Artificial Sequence: Synthetic oligonucleotide
ccttcccaaggatacttctccaggatcagc

SEQ ID NO: 106066 - DNA, 30 bp, Artificial Sequence
  Description of Artificial Sequence: Synthetic oligonucleotide
cttcccaaggatacttctccaggatcagcc

SEQ ID NO: 106067 - DNA, 33 bp, Artificial Sequence
  Description of Artificial Sequence: Synthetic oligonucleotide
ttcccaaggatacttctccaggatcagcctatc

SEQ ID NO: 106068 - DNA, 32 bp, Artificial Sequence
  Description of Artificial Sequence: Synthetic oligonucleotide
tcccaaggatacttctccaggatcagcctatc

SEQ ID NO: 106069 - DNA, 31 bp, Artificial Sequence
  Description of Artificial Sequence: Synthetic oligonucleotide
cccaaggatacttctccaggatcagcctatc

SEQ ID NO: 106070 - DNA, 32 bp, Artificial Sequence
  Description of Artificial Sequence: Synthetic oligonucleotide
ccaaggatacttctccaggatcagcctatcag

SEQ ID NO: 106071 - DNA, 32 bp, Artificial Sequence
  Description of Artificial Sequence: Synthetic oligonucleotide
caaggatacttctccaggatcagcctatcagg

SEQ ID NO: 106072 - DNA, 34 bp, Artificial Sequence
  Description of Artificial Sequence: Synthetic oligonucleotide
aaggatacttctccaggatcagcctatcaggaag

SEQ ID NO: 106073 - DNA, 33 bp, Artificial Sequence
  Description of Artificial Sequence: Synthetic oligonucleotide
aggatacttctccaggatcagcctatcaggaag

SEQ ID NO: 106074 - DNA, 32 bp, Artificial Sequence
  Description of Artificial Sequence: Synthetic oligonucleotide
ggatacttctccaggatcagcctatcaggaag

SEQ ID NO: 106075 - DNA, 32 bp, Artificial Sequence
  Description of Artificial Sequence: Synthetic oligonucleotide
gatacttctccaggatcagcctatcaggaagg

SEQ ID NO: 106076 - DNA, 33 bp, Artificial Sequence
  Description of Artificial Sequence: Synthetic oligonucleotide
atacttctccaggatcagcctatcaggaaggtg

SEQ ID NO: 106077 - DNA, 32 bp, Artificial Sequence
  Description of Artificial Sequence: Synthetic oligonucleotide
tacttctccaggatcagcctatcaggaaggtg

SEQ ID NO: 106078 - DNA, 31 bp, Artificial Sequence
  Description of Artificial Sequence: Synthetic oligonucleotide
acttctccaggatcagcctatcaggaaggtg

SEQ ID NO: 106079 - DNA, 30 bp, Artificial Sequence
  Description of Artificial Sequence: Synthetic oligonucleotide
cttctccaggatcagcctatcaggaaggtg

SEQ ID NO: 106080 - DNA, 30 bp, Artificial Sequence
  Description of Artificial Sequence: Synthetic oligonucleotide
ttctccaggatcagcctatcaggaaggtgg

SEQ ID NO: 106081 - DNA, 29 bp, Artificial Sequence
  Description of Artificial Sequence: Synthetic oligonucleotide
tctccaggatcagcctatcaggaaggtgg

SEQ ID NO: 106082 - DNA, 28 bp, Artificial Sequence
  Description of Artificial Sequence: Synthetic oligonucleotide
ctccaggatcagcctatcaggaaggtgg

SEQ ID NO: 106083 - DNA, 29 bp, Artificial Sequence
  Description of Artificial Sequence: Synthetic oligonucleotide
tccaggatcagcctatcaggaaggtggag

SEQ ID NO: 106084 - DNA, 28 bp, Artificial Sequence
  Description of Artificial Sequence: Synthetic oligonucleotide
ccaggatcagcctatcaggaaggtggag

SEQ ID NO: 106085 - DNA, 28 bp, Artificial Sequence
  Description of Artificial Sequence: Synthetic oligonucleotide
caggatcagcctatcaggaaggtggagg

SEQ ID NO: 106086 - DNA, 29 bp, Artificial Sequence
  Description of Artificial Sequence: Synthetic oligonucleotide
aggatcagcctatcaggaaggtggaggtc

SEQ ID NO: 106087 - DNA, 28 bp, Artificial Sequence
  Description of Artificial Sequence: Synthetic oligonucleotide
ggatcagcctatcaggaaggtggaggtc

SEQ ID NO: 106088 - DNA, 29 bp, Artificial Sequence
  Description of Artificial Sequence: Synthetic oligonucleotide
gatcagcctatcaggaaggtggaggtctc

SEQ ID NO: 106089 - DNA, 32 bp, Artificial Sequence
  Description of Artificial Sequence: Synthetic oligonucleotide
atcagcctatcaggaaggtggaggtctctatg

SEQ ID NO: 106090 - DNA, 31 bp, Artificial Sequence
  Description of Artificial Sequence: Synthetic oligonucleotide
tcagcctatcaggaaggtggaggtctctatg

SEQ ID NO: 106091 - DNA, 30 bp, Artificial Sequence
  Description of Artificial Sequence: Synthetic oligonucleotide
cagcctatcaggaaggtggaggtctctatg

SEQ ID NO: 106092 - DNA, 30 bp, Artificial Sequence
  Description of Artificial Sequence: Synthetic oligonucleotide
agcctatcaggaaggtggaggtctctatgc

SEQ ID NO: 106093 - DNA, 29 bp, Artificial Sequence
  Description of Artificial Sequence: Synthetic oligonucleotide
gcctatcaggaaggtggaggtctctatgc

SEQ ID NO: 106094 - DNA, 30 bp, Artificial Sequence
  Description of Artificial Sequence: Synthetic oligonucleotide
cctatcaggaaggtggaggtctctatgcac

SEQ ID NO: 106095 - DNA, 32 bp, Artificial Sequence
  Description of Artificial Sequence: Synthetic oligonucleotide
ctatcaggaaggtggaggtctctatgcactag

SEQ ID NO: 106096 - DNA, 32 bp, Artificial Sequence
  Description of Artificial Sequence: Synthetic oligonucleotide
tatcaggaaggtggaggtctctatgcactagg

SEQ ID NO: 106097 - DNA, 31 bp, Artificial Sequence
  Description of Artificial Sequence: Synthetic oligonucleotide
atcaggaaggtggaggtctctatgcactagg

SEQ ID NO: 106098 - DNA, 30 bp, Artificial Sequence
  Description of Artificial Sequence: Synthetic oligonucleotide
tcaggaaggtggaggtctctatgcactagg

SEQ ID NO: 106099 - DNA, 29 bp, Artificial Sequence
  Description of Artificial Sequence: Synthetic oligonucleotide
caggaaggtggaggtctctatgcactagg

SEQ ID NO: 106100 - DNA, 30 bp, Artificial Sequence
  Description of Artificial Sequence: Synthetic oligonucleotide
aggaaggtggaggtctctatgcactaggtc

SEQ ID NO: 106101 - DNA, 29 bp, Artificial Sequence
  Description of Artificial Sequence: Synthetic oligonucleotide
ggaaggtggaggtctctatgcactaggtc

SEQ ID NO: 106102 - DNA, 34 bp, Artificial Sequence
  Description of Artificial Sequence: Synthetic oligonucleotide
gaaggtggaggtctctatgcactaggtcttattc

SEQ ID NO: 106103 - DNA, 36 bp, Artificial Sequence
  Description of Artificial Sequence: Synthetic oligonucleotide
aaggtggaggtctctatgcactaggtcttattcatg

SEQ ID NO: 106104 - DNA, 35 bp, Artificial Sequence
  Description of Artificial Sequence: Synthetic oligonucleotide
aggtggaggtctctatgcactaggtcttattcatg

SEQ ID NO: 106105 - DNA, 34 bp, Artificial Sequence
  Description of Artificial Sequence: Synthetic oligonucleotide
ggtggaggtctctatgcactaggtcttattcatg

SEQ ID NO: 106106 - DNA, 34 bp, Artificial Sequence
  Description of Artificial Sequence: Synthetic oligonucleotide
gtggaggtctctatgcactaggtcttattcatgc

SEQ ID NO: 106107 - DNA, 34 bp, Artificial Sequence
  Description of Artificial Sequence: Synthetic oligonucleotide
tggaggtctctatgcactaggtcttattcatgcc

SEQ ID NO: 106108 - DNA, 33 bp, Artificial Sequence
  Description of Artificial Sequence: Synthetic oligonucleotide
ggaggtctctatgcactaggtcttattcatgcc

SEQ ID NO: 106109 - DNA, 36 bp, Artificial Sequence
  Description of Artificial Sequence: Synthetic oligonucleotide
gaggtctctatgcactaggtcttattcatgccaatc

SEQ ID NO: 106110 - DNA, 38 bp, Artificial Sequence
  Description of Artificial Sequence: Synthetic oligonucleotide
aggtctctatgcactaggtcttattcatgccaatcatg

SEQ ID NO: 106111 - DNA, 37 bp, Artificial Sequence
  Description of Artificial Sequence: Synthetic oligonucleotide
ggtctctatgcactaggtcttattcatgccaatcatg

SEQ ID NO: 106112 - DNA, 37 bp, Artificial Sequence
  Description of Artificial Sequence: Synthetic oligonucleotide
gtctctatgcactaggtcttattcatgccaatcatgg

SEQ ID NO: 106113 - DNA, 38 bp, Artificial Sequence
  Description of Artificial Sequence: Synthetic oligonucleotide
tctctatgcactaggtcttattcatgccaatcatggtg

SEQ ID NO: 106114 - DNA, 37 bp, Artificial Sequence
  Description of Artificial Sequence: Synthetic oligonucleotide
ctctatgcactaggtcttattcatgccaatcatggtg

SEQ ID NO: 106115 - DNA, 37 bp, Artificial Sequence
  Description of Artificial Sequence: Synthetic oligonucleotide
tctatgcactaggtcttattcatgccaatcatggtgg

SEQ ID NO: 106116 - DNA, 36 bp, Artificial Sequence
  Description of Artificial Sequence: Synthetic oligonucleotide
ctatgcactaggtcttattcatgccaatcatggtgg

SEQ ID NO: 106117 - DNA, 37 bp, Artificial Sequence
  Description of Artificial Sequence: Synthetic oligonucleotide
tatgcactaggtcttattcatgccaatcatggtggtg

SEQ ID NO: 106118 - DNA, 36 bp, Artificial Sequence
  Description of Artificial Sequence: Synthetic oligonucleotide
atgcactaggtcttattcatgccaatcatggtggtg

SEQ ID NO: 106119 - DNA, 35 bp, Artificial Sequence
  Description of Artificial Sequence: Synthetic oligonucleotide
tgcactaggtcttattcatgccaatcatggtggtg

SEQ ID NO: 106120 - DNA, 34 bp, Artificial Sequence
  Description of Artificial Sequence: Synthetic oligonucleotide
gcactaggtcttattcatgccaatcatggtggtg

SEQ ID NO: 106121 - DNA, 42 bp, Artificial Sequence
  Description of Artificial Sequence: Synthetic oligonucleotide
cactaggtcttattcatgccaatcatggtggtgatataattg

SEQ ID NO: 106122 - DNA, 43 bp, Artificial Sequence
  Description of Artificial Sequence: Synthetic oligonucleotide
actaggtcttattcatgccaatcatggtggtgatataattgac

SEQ ID NO: 106123 - DNA, 42 bp, Artificial Sequence
  Description of Artificial Sequence: Synthetic oligonucleotide
ctaggtcttattcatgccaatcatggtggtgatataattgac

SEQ ID NO: 106124 - DNA, 45 bp, Artificial Sequence
  Description of Artificial Sequence: Synthetic oligonucleotide
taggtcttattcatgccaatcatggtggtgatataattgactatc

SEQ ID NO: 106125 - DNA, 44 bp, Artificial Sequence
  Description of Artificial Sequence: Synthetic oligonucleotide
aggtcttattcatgccaatcatggtggtgatataattgactatc

SEQ ID NO: 106126 - DNA, 43 bp, Artificial Sequence
  Description of Artificial Sequence: Synthetic oligonucleotide
ggtcttattcatgccaatcatggtggtgatataattgactatc

SEQ ID NO: 106127 - DNA, 44 bp, Artificial Sequence
  Description of Artificial Sequence: Synthetic oligonucleotide
gtcttattcatgccaatcatggtggtgatataattgactatctg

SEQ ID NO: 106128 - DNA, 44 bp, Artificial Sequence
  Description of Artificial Sequence: Synthetic oligonucleotide
tcttattcatgccaatcatggtggtgatataattgactatctgc

SEQ ID NO: 106129 - DNA, 43 bp, Artificial Sequence
  Description of Artificial Sequence: Synthetic oligonucleotide
cttattcatgccaatcatggtggtgatataattgactatctgc

SEQ ID NO: 106130 - DNA, 48 bp, Artificial Sequence
  Description of Artificial Sequence: Synthetic oligonucleotide
ttattcatgccaatcatggtggtgatataattgactatctgcttaatc

SEQ ID NO: 106131 - DNA, 47 bp, Artificial Sequence
  Description of Artificial Sequence: Synthetic oligonucleotide
tattcatgccaatcatggtggtgatataattgactatctgcttaatc

SEQ ID NO: 106132 - DNA, 46 bp, Artificial Sequence
  Description of Artificial Sequence: Synthetic oligonucleotide
attcatgccaatcatggtggtgatataattgactatctgcttaatc

SEQ ID NO: 106133 - DNA, 45 bp, Artificial Sequence
  Description of Artificial Sequence: Synthetic oligonucleotide
ttcatgccaatcatggtggtgatataattgactatctgcttaatc

SEQ ID NO: 106134 - DNA, 44 bp, Artificial Sequence
  Description of Artificial Sequence: Synthetic oligonucleotide
tcatgccaatcatggtggtgatataattgactatctgcttaatc

SEQ ID NO: 106135 - DNA, 43 bp, Artificial Sequence
  Description of Artificial Sequence: Synthetic oligonucleotide
catgccaatcatggtggtgatataattgactatctgcttaatc

SEQ ID NO: 106136 - DNA, 44 bp, Artificial Sequence
  Description of Artificial Sequence: Synthetic oligonucleotide
atgccaatcatggtggtgatataattgactatctgcttaatcag

SEQ ID NO: 106137 - DNA, 43 bp, Artificial Sequence
  Description of Artificial Sequence: Synthetic oligonucleotide
tgccaatcatggtggtgatataattgactatctgcttaatcag

SEQ ID NO: 106138 - DNA, 42 bp, Artificial Sequence
  Description of Artificial Sequence: Synthetic oligonucleotide
gccaatcatggtggtgatataattgactatctgcttaatcag

SEQ ID NO: 106139 - DNA, 42 bp, Artificial Sequence
  Description of Artificial Sequence: Synthetic oligonucleotide
ccaatcatggtggtgatataattgactatctgcttaatcagc

SEQ ID NO: 106140 - DNA, 46 bp, Artificial Sequence
  Description of Artificial Sequence: Synthetic oligonucleotide
caatcatggtggtgatataattgactatctgcttaatcagcttaag

SEQ ID NO: 106141 - DNA, 48 bp, Artificial Sequence
  Description of Artificial Sequence: Synthetic oligonucleotide
aatcatggtggtgatataattgactatctgcttaatcagcttaagaac

SEQ ID NO: 106142 - DNA, 47 bp, Artificial Sequence
  Description of Artificial Sequence: Synthetic oligonucleotide
atcatggtggtgatataattgactatctgcttaatcagcttaagaac

SEQ ID NO: 106143 - DNA, 46 bp, Artificial Sequence
  Description of Artificial Sequence: Synthetic oligonucleotide
tcatggtggtgatataattgactatctgcttaatcagcttaagaac

SEQ ID NO: 106144 - DNA, 45 bp, Artificial Sequence
  Description of Artificial Sequence: Synthetic oligonucleotide
catggtggtgatataattgactatctgcttaatcagcttaagaac

SEQ ID NO: 106145 - DNA, 45 bp, Artificial Sequence
  Description of Artificial Sequence: Synthetic oligonucleotide
atggtggtgatataattgactatctgcttaatcagcttaagaacg

SEQ ID NO: 106146 - DNA, 44 bp, Artificial Sequence
  Description of Artificial Sequence: Synthetic oligonucleotide
tggtggtgatataattgactatctgcttaatcagcttaagaacg

SEQ ID NO: 106147 - DNA, 43 bp, Artificial Sequence
  Description of Artificial Sequence: Synthetic oligonucleotide
ggtggtgatataattgactatctgcttaatcagcttaagaacg

SEQ ID NO: 106148 - DNA, 43 bp, Artificial Sequence
  Description of Artificial Sequence: Synthetic oligonucleotide
gtggtgatataattgactatctgcttaatcagcttaagaacgc

SEQ ID NO: 106149 - DNA, 43 bp, Artificial Sequence
  Description of Artificial Sequence: Synthetic oligonucleotide
tggtgatataattgactatctgcttaatcagcttaagaacgcc

SEQ ID NO: 106150 - DNA, 42 bp, Artificial Sequence
  Description of Artificial Sequence: Synthetic oligonucleotide
ggtgatataattgactatctgcttaatcagcttaagaacgcc

SEQ ID NO: 106151 - DNA, 43 bp, Artificial Sequence
  Description of Artificial Sequence: Synthetic oligonucleotide
gtgatataattgactatctgcttaatcagcttaagaacgccag

SEQ ID NO: 106152 - DNA, 43 bp, Artificial Sequence
  Description of Artificial Sequence: Synthetic oligonucleotide
tgatataattgactatctgcttaatcagcttaagaacgccagc

SEQ ID NO: 106153 - DNA, 42 bp, Artificial Sequence
  Description of Artificial Sequence: Synthetic oligonucleotide
gatataattgactatctgcttaatcagcttaagaacgccagc

SEQ ID NO: 106154 - DNA, 45 bp, Artificial Sequence
  Description of Artificial Sequence: Synthetic oligonucleotide
atataattgactatctgcttaatcagcttaagaacgccagcaatg

SEQ ID NO: 106155 - DNA, 44 bp, Artificial Sequence
  Description of Artificial Sequence: Synthetic oligonucleotide
tataattgactatctgcttaatcagcttaagaacgccagcaatg

SEQ ID NO: 106156 - DNA, 43 bp, Artificial Sequence
  Description of Artificial Sequence: Synthetic oligonucleotide
ataattgactatctgcttaatcagcttaagaacgccagcaatg

SEQ ID NO: 106157 - DNA, 42 bp, Artificial Sequence
  Description of Artificial Sequence: Synthetic oligonucleotide
taattgactatctgcttaatcagcttaagaacgccagcaatg

SEQ ID NO: 106158 - DNA, 41 bp, Artificial Sequence
  Description of Artificial Sequence: Synthetic oligonucleotide
aattgactatctgcttaatcagcttaagaacgccagcaatg

SEQ ID NO: 106159 - DNA, 40 bp, Artificial Sequence
  Description of Artificial Sequence: Synthetic oligonucleotide
attgactatctgcttaatcagcttaagaacgccagcaatg

SEQ ID NO: 106160 - DNA, 39 bp, Artificial Sequence
  Description of Artificial Sequence: Synthetic oligonucleotide
ttgactatctgcttaatcagcttaagaacgccagcaatg

SEQ ID NO: 106161 - DNA, 38 bp, Artificial Sequence
  Description of Artificial Sequence: Synthetic oligonucleotide
tgactatctgcttaatcagcttaagaacgccagcaatg

SEQ ID NO: 106162 - DNA, 37 bp, Artificial Sequence
  Description of Artificial Sequence: Synthetic oligonucleotide
gactatctgcttaatcagcttaagaacgccagcaatg

SEQ ID NO: 106163 - DNA, 41 bp, Artificial Sequence
  Description of Artificial Sequence: Synthetic oligonucleotide
actatctgcttaatcagcttaagaacgccagcaatgatatc

SEQ ID NO: 106164 - DNA, 40 bp, Artificial Sequence
  Description of Artificial Sequence: Synthetic oligonucleotide
ctatctgcttaatcagcttaagaacgccagcaatgatatc

SEQ ID NO: 106165 - DNA, 40 bp, Artificial Sequence
  Description of Artificial Sequence: Synthetic oligonucleotide
tatctgcttaatcagcttaagaacgccagcaatgatatcg

SEQ ID NO: 106166 - DNA, 39 bp, Artificial Sequence
  Description of Artificial Sequence: Synthetic oligonucleotide
atctgcttaatcagcttaagaacgccagcaatgatatcg

SEQ ID NO: 106167 - DNA, 38 bp, Artificial Sequence
  Description of Artificial Sequence: Synthetic oligonucleotide
tctgcttaatcagcttaagaacgccagcaatgatatcg

SEQ ID NO: 106168 - DNA, 37 bp, Artificial Sequence
  Description of Artificial Sequence: Synthetic oligonucleotide
ctgcttaatcagcttaagaacgccagcaatgatatcg

SEQ ID NO: 106169 - DNA, 40 bp, Artificial Sequence
  Description of Artificial Sequence: Synthetic oligonucleotide
tgcttaatcagcttaagaacgccagcaatgatatcgttag

SEQ ID NO: 106170 - DNA, 39 bp, Artificial Sequence
  Description of Artificial Sequence: Synthetic oligonucleotide
gcttaatcagcttaagaacgccagcaatgatatcgttag

SEQ ID NO: 106171 - DNA, 40 bp, Artificial Sequence
  Description of Artificial Sequence: Synthetic oligonucleotide
cttaatcagcttaagaacgccagcaatgatatcgttagac

SEQ ID NO: 106172 - DNA, 41 bp, Artificial Sequence
  Description of Artificial Sequence: Synthetic oligonucleotide
ttaatcagcttaagaacgccagcaatgatatcgttagacac

SEQ ID NO: 106173 - DNA, 40 bp, Artificial Sequence
  Description of Artificial Sequence: Synthetic oligonucleotide
taatcagcttaagaacgccagcaatgatatcgttagacac

SEQ ID NO: 106174 - DNA, 39 bp, Artificial Sequence
  Description of Artificial Sequence: Synthetic oligonucleotide
aatcagcttaagaacgccagcaatgatatcgttagacac

SEQ ID NO: 106175 - DNA, 38 bp, Artificial Sequence
  Description of Artificial Sequence: Synthetic oligonucleotide
atcagcttaagaacgccagcaatgatatcgttagacac

SEQ ID NO: 106176 - DNA, 37 bp, Artificial Sequence
  Description of Artificial Sequence: Synthetic oligonucleotide
tcagcttaagaacgccagcaatgatatcgttagacac

SEQ ID NO: 106177 - DNA, 36 bp, Artificial Sequence
  Description of Artificial Sequence: Synthetic oligonucleotide
cagcttaagaacgccagcaatgatatcgttagacac

SEQ ID NO: 106178 - DNA, 36 bp, Artificial Sequence
  Description of Artificial Sequence: Synthetic oligonucleotide
agcttaagaacgccagcaatgatatcgttagacacg

SEQ ID NO: 106179 - DNA, 35 bp, Artificial Sequence
  Description of Artificial Sequence: Synthetic oligonucleotide
gcttaagaacgccagcaatgatatcgttagacacg

SEQ ID NO: 106180 - DNA, 35 bp, Artificial Sequence
  Description of Artificial Sequence: Synthetic oligonucleotide
cttaagaacgccagcaatgatatcgttagacacgg

SEQ ID NO: 106181 - DNA, 36 bp, Artificial Sequence
  Description of Artificial Sequence: Synthetic oligonucleotide
ttaagaacgccagcaatgatatcgttagacacggtg

SEQ ID NO: 106182 - DNA, 35 bp, Artificial Sequence
  Description of Artificial Sequence: Synthetic oligonucleotide
taagaacgccagcaatgatatcgttagacacggtg

SEQ ID NO: 106183 - DNA, 34 bp, Artificial Sequence
  Description of Artificial Sequence: Synthetic oligonucleotide
aagaacgccagcaatgatatcgttagacacggtg

SEQ ID NO: 106184 - DNA, 33 bp, Artificial Sequence
  Description of Artificial Sequence: Synthetic oligonucleotide
agaacgccagcaatgatatcgttagacacggtg

SEQ ID NO: 106185 - DNA, 32 bp, Artificial Sequence
  Description of Artificial Sequence: Synthetic oligonucleotide
gaacgccagcaatgatatcgttagacacggtg

SEQ ID NO: 106186 - DNA, 32 bp, Artificial Sequence
  Description of Artificial Sequence: Synthetic oligonucleotide
aacgccagcaatgatatcgttagacacggtgg

SEQ ID NO: 106187 - DNA, 31 bp, Artificial Sequence
  Description of Artificial Sequence: Synthetic oligonucleotide
acgccagcaatgatatcgttagacacggtgg

SEQ ID NO: 106188 - DNA, 30 bp, Artificial Sequence
  Description of Artificial Sequence: Synthetic oligonucleotide
cgccagcaatgatatcgttagacacggtgg

SEQ ID NO: 106189 - DNA, 30 bp, Artificial Sequence
  Description of Artificial Sequence: Synthetic oligonucleotide
gccagcaatgatatcgttagacacggtggc

SEQ ID NO: 106190 - DNA, 31 bp, Artificial Sequence
  Description of Artificial Sequence: Synthetic oligonucleotide
ccagcaatgatatcgttagacacggtggcag

SEQ ID NO: 106191 - DNA, 32 bp, Artificial Sequence
  Description of Artificial Sequence: Synthetic oligonucleotide
cagcaatgatatcgttagacacggtggcagtc

SEQ ID NO: 106192 - DNA, 33 bp, Artificial Sequence
  Description of Artificial Sequence: Synthetic oligonucleotide
agcaatgatatcgttagacacggtggcagtctg

SEQ ID NO: 106193 - DNA, 32 bp, Artificial Sequence
  Description of Artificial Sequence: Synthetic oligonucleotide
gcaatgatatcgttagacacggtggcagtctg

SEQ ID NO: 106194 - DNA, 32 bp, Artificial Sequence
  Description of Artificial Sequence: Synthetic oligonucleotide
caatgatatcgttagacacggtggcagtctgg

SEQ ID NO: 106195 - DNA, 32 bp, Artificial Sequence
  Description of Artificial Sequence: Synthetic oligonucleotide
aatgatatcgttagacacggtggcagtctggg

SEQ ID NO: 106196 - DNA, 31 bp, Artificial Sequence
  Description of Artificial Sequence: Synthetic oligonucleotide
atgatatcgttagacacggtggcagtctggg

SEQ ID NO: 106197 - DNA, 30 bp, Artificial Sequence
  Description of Artificial Sequence: Synthetic oligonucleotide
tgatatcgttagacacggtggcagtctggg

SEQ ID NO: 106198 - DNA, 29 bp, Artificial Sequence
  Description of Artificial Sequence: Synthetic oligonucleotide
gatatcgttagacacggtggcagtctggg

SEQ ID NO: 106199 - DNA, 29 bp, Artificial Sequence
  Description of Artificial Sequence: Synthetic oligonucleotide
atatcgttagacacggtggcagtctgggc

SEQ ID NO: 106200 - DNA, 28 bp, Artificial Sequence
  Description of Artificial Sequence: Synthetic oligonucleotide
tatcgttagacacggtggcagtctgggc

SEQ ID NO: 106201 - DNA, 27 bp, Artificial Sequence
  Description of Artificial Sequence: Synthetic oligonucleotide
atcgttagacacggtggcagtctgggc

SEQ ID NO: 106202 - DNA, 26 bp, Artificial Sequence
  Description of Artificial Sequence: Synthetic oligonucleotide
tcgttagacacggtggcagtctgggc

SEQ ID NO: 106203 - DNA, 25 bp, Artificial Sequence
  Description of Artificial Sequence: Synthetic oligonucleotide
cgttagacacggtggcagtctgggc

SEQ ID NO: 106204 - DNA, 27 bp, Artificial Sequence
  Description of Artificial Sequence: Synthetic oligonucleotide
gttagacacggtggcagtctgggcctt

SEQ ID NO: 106205 - DNA, 27 bp, Artificial Sequence
  Description of Artificial Sequence: Synthetic oligonucleotide
ttagacacggtggcagtctgggccttg

SEQ ID NO: 106206 - DNA, 26 bp, Artificial Sequence
  Description of Artificial Sequence: Synthetic oligonucleotide
tagacacggtggcagtctgggccttg

SEQ ID NO: 106207 - DNA, 25 bp, Artificial Sequence
  Description of Artificial Sequence: Synthetic oligonucleotide
agacacggtggcagtctgggccttg

SEQ ID NO: 106208 - DNA, 24 bp, Artificial Sequence
  Description of Artificial Sequence: Synthetic oligonucleotide
gacacggtggcagtctgggccttg

SEQ ID NO: 106209 - DNA, 27 bp, Artificial Sequence
  Description of Artificial Sequence: Synthetic oligonucleotide
acacggtggcagtctgggccttggttt

SEQ ID NO: 106210 - DNA, 26 bp, Artificial Sequence
  Description of Artificial Sequence: Synthetic oligonucleotide
cacggtggcagtctgggccttggttt

SEQ ID NO: 106211 - DNA, 26 bp, Artificial Sequence
  Description of Artificial Sequence: Synthetic oligonucleotide
acggtggcagtctgggccttggtttg

SEQ ID NO: 106212 - DNA, 25 bp, Artificial Sequence
  Description of Artificial Sequence: Synthetic oligonucleotide
cggtggcagtctgggccttggtttg

SEQ ID NO: 106213 - DNA, 25 bp, Artificial Sequence
  Description of Artificial Sequence: Synthetic oligonucleotide
ggtggcagtctgggccttggtttgg

SEQ ID NO: 106214 - DNA, 26 bp, Artificial Sequence
  Description of Artificial Sequence: Synthetic oligonucleotide
gtggcagtctgggccttggtttggca

SEQ ID NO: 106215 - DNA, 26 bp, Artificial Sequence
  Description of Artificial Sequence: Synthetic oligonucleotide
tggcagtctgggccttggtttggcag

SEQ ID NO: 106216 - DNA, 25 bp, Artificial Sequence
  Description of Artificial Sequence: Synthetic oligonucleotide
ggcagtctgggccttggtttggcag

SEQ ID NO: 106217 - DNA, 25 bp, Artificial Sequence
  Description of Artificial Sequence: Synthetic oligonucleotide
gcagtctgggccttggtttggcagc

SEQ ID NO: 106218 - DNA, 27 bp, Artificial Sequence
  Description of Artificial Sequence: Synthetic oligonucleotide
cagtctgggccttggtttggcagccat

SEQ ID NO: 106219 - DNA, 27 bp, Artificial Sequence
  Description of Artificial Sequence: Synthetic oligonucleotide
agtctgggccttggtttggcagccatg

SEQ ID NO: 106220 - DNA, 26 bp, Artificial Sequence
  Description of Artificial Sequence: Synthetic oligonucleotide
gtctgggccttggtttggcagccatg

SEQ ID NO: 106221 - DNA, 26 bp, Artificial Sequence
  Description of Artificial Sequence: Synthetic oligonucleotide
tctgggccttggtttggcagccatgg

SEQ ID NO: 106222 - DNA, 25 bp, Artificial Sequence
  Description of Artificial Sequence: Synthetic oligonucleotide
ctgggccttggtttggcagccatgg

SEQ ID NO: 106223 - DNA, 27 bp, Artificial Sequence
  Description of Artificial Sequence: Synthetic oligonucleotide
tgggccttggtttggcagccatgggaa

SEQ ID NO: 106224 - DNA, 26 bp, Artificial Sequence
  Description of Artificial Sequence: Synthetic oligonucleotide
gggccttggtttggcagccatgggaa

SEQ ID NO: 106225 - DNA, 27 bp, Artificial Sequence
  Description of Artificial Sequence: Synthetic oligonucleotide
ggccttggtttggcagccatgggaact

SEQ ID NO: 106226 - DNA, 27 bp, Artificial Sequence
  Description of Artificial Sequence: Synthetic oligonucleotide
gccttggtttggcagccatgggaactg

SEQ ID NO: 106227 - DNA, 27 bp, Artificial Sequence
  Description of Artificial Sequence: Synthetic oligonucleotide
ccttggtttggcagccatgggaactgc

SEQ ID NO: 106228 - DNA, 28 bp, Artificial Sequence
  Description of Artificial Sequence: Synthetic oligonucleotide
cttggtttggcagccatgggaactgcac

SEQ ID NO: 106229 - DNA, 28 bp, Artificial Sequence
  Description of Artificial Sequence: Synthetic oligonucleotide
ttggtttggcagccatgggaactgcacg

SEQ ID NO: 106230 - DNA, 27 bp, Artificial Sequence
  Description of Artificial Sequence: Synthetic oligonucleotide
tggtttggcagccatgggaactgcacg

SEQ ID NO: 106231 - DNA, 27 bp, Artificial Sequence
  Description of Artificial Sequence: Synthetic oligonucleotide
ggtttggcagccatgggaactgcacgt

SEQ ID NO: 106232 - DNA, 27 bp, Artificial Sequence
  Description of Artificial Sequence: Synthetic oligonucleotide
gtttggcagccatgggaactgcacgtc

SEQ ID NO: 106233 - DNA, 29 bp, Artificial Sequence
  Description of Artificial Sequence: Synthetic oligonucleotide
tttggcagccatgggaactgcacgtcaag

SEQ ID NO: 106234 - DNA, 28 bp, Artificial Sequence
  Description of Artificial Sequence: Synthetic oligonucleotide
ttggcagccatgggaactgcacgtcaag

SEQ ID NO: 106235 - DNA, 27 bp, Artificial Sequence
  Description of Artificial Sequence: Synthetic oligonucleotide
tggcagccatgggaactgcacgtcaag

SEQ ID NO: 106236 - DNA, 27 bp, Artificial Sequence
  Description of Artificial Sequence: Synthetic oligonucleotide
ggcagccatgggaactgcacgtcaaga

SEQ ID NO: 106237 - DNA, 28 bp, Artificial Sequence
  Description of Artificial Sequence: Synthetic oligonucleotide
gcagccatgggaactgcacgtcaagatg

SEQ ID NO: 106238 - DNA, 33 bp, Artificial Sequence
  Description of Artificial Sequence: Synthetic oligonucleotide
cagccatgggaactgcacgtcaagatgtttatg

SEQ ID NO: 106239 - DNA, 37 bp, Artificial Sequence
  Description of Artificial Sequence: Synthetic oligonucleotide
agccatgggaactgcacgtcaagatgtttatgatttg

SEQ ID NO: 106240 - DNA, 36 bp, Artificial Sequence
  Description of Artificial Sequence: Synthetic oligonucleotide
gccatgggaactgcacgtcaagatgtttatgatttg

SEQ ID NO: 106241 - DNA, 36 bp, Artificial Sequence
  Description of Artificial Sequence: Synthetic oligonucleotide
ccatgggaactgcacgtcaagatgtttatgatttgc

SEQ ID NO: 106242 - DNA, 42 bp, Artificial Sequence
  Description of Artificial Sequence: Synthetic oligonucleotide
catgggaactgcacgtcaagatgtttatgatttgctaaaaac

SEQ ID NO: 106243 - DNA, 45 bp, Artificial Sequence
  Description of Artificial Sequence: Synthetic oligonucleotide
atgggaactgcacgtcaagatgtttatgatttgctaaaaacaaac

SEQ ID NO: 106244 - DNA, 44 bp, Artificial Sequence
  Description of Artificial Sequence: Synthetic oligonucleotide
tgggaactgcacgtcaagatgtttatgatttgctaaaaacaaac

SEQ ID NO: 106245 - DNA, 43 bp, Artificial Sequence
  Description of Artificial Sequence: Synthetic oligonucleotide
gggaactgcacgtcaagatgtttatgatttgctaaaaacaaac

SEQ ID NO: 106246 - DNA, 43 bp, Artificial Sequence
  Description of Artificial Sequence: Synthetic oligonucleotide
ggaactgcacgtcaagatgtttatgatttgctaaaaacaaacc

SEQ ID NO: 106247 - DNA, 48 bp, Artificial Sequence
  Description of Artificial Sequence: Synthetic oligonucleotide
gaactgcacgtcaagatgtttatgatttgctaaaaacaaacctttatc

SEQ ID NO: 106248 - DNA, 49 bp, Artificial Sequence
  Description of Artificial Sequence: Synthetic oligonucleotide
aactgcacgtcaagatgtttatgatttgctaaaaacaaacctttatcag

SEQ ID NO: 106249 - DNA, 48 bp, Artificial Sequence
  Description of Artificial Sequence: Synthetic oligonucleotide
actgcacgtcaagatgtttatgatttgctaaaaacaaacctttatcag

SEQ ID NO: 106250 - DNA, 47 bp, Artificial Sequence
  Description of Artificial Sequence: Synthetic oligonucleotide
ctgcacgtcaagatgtttatgatttgctaaaaacaaacctttatcag

SEQ ID NO: 106251 - DNA, 47 bp, Artificial Sequence
  Description of Artificial Sequence: Synthetic oligonucleotide
tgcacgtcaagatgtttatgatttgctaaaaacaaacctttatcagg

SEQ ID NO: 106252 - DNA, 46 bp, Artificial Sequence
  Description of Artificial Sequence: Synthetic oligonucleotide
gcacgtcaagatgtttatgatttgctaaaaacaaacctttatcagg

SEQ ID NO: 106253 - DNA, 48 bp, Artificial Sequence
  Description of Artificial Sequence: Synthetic oligonucleotide
cacgtcaagatgtttatgatttgctaaaaacaaacctttatcaggatg

SEQ ID NO: 106254 - DNA, 50 bp, Artificial Sequence
  Description of Artificial Sequence: Synthetic oligonucleotide
acgtcaagatgtttatgatttgctaaaaacaaacctttatcaggatgatg

SEQ ID NO: 106255 - DNA, 49 bp, Artificial Sequence
  Description of Artificial Sequence: Synthetic oligonucleotide
cgtcaagatgtttatgatttgctaaaaacaaacctttatcaggatgatg

SEQ ID NO: 106256 - DNA, 49 bp, Artificial Sequence
  Description of Artificial Sequence: Synthetic oligonucleotide
gtcaagatgtttatgatttgctaaaaacaaacctttatcaggatgatgc

SEQ ID NO: 106257 - DNA, 50 bp, Artificial Sequence
  Description of Artificial Sequence: Synthetic oligonucleotide
tcaagatgtttatgatttgctaaaaacaaacctttatcaggatgatgcag

SEQ ID NO: 106258 - DNA, 49 bp, Artificial Sequence
  Description of Artificial Sequence: Synthetic oligonucleotide
caagatgtttatgatttgctaaaaacaaacctttatcaggatgatgcag

SEQ ID NO: 106259 - DNA, 52 bp, Artificial Sequence
  Description of Artificial Sequence: Synthetic oligonucleotide
aagatgtttatgatttgctaaaaacaaacctttatcaggatgatgcagtaac

SEQ ID NO: 106260 - DNA, 51 bp, Artificial Sequence
  Description of Artificial Sequence: Synthetic oligonucleotide
agatgtttatgatttgctaaaaacaaacctttatcaggatgatgcagtaac

SEQ ID NO: 106261 - DNA, 50 bp, Artificial Sequence
  Description of Artificial Sequence: Synthetic oligonucleotide
gatgtttatgatttgctaaaaacaaacctttatcaggatgatgcagtaac

SEQ ID NO: 106262 - DNA, 51 bp, Artificial Sequence
  Description of Artificial Sequence: Synthetic oligonucleotide
atgtttatgatttgctaaaaacaaacctttatcaggatgatgcagtaacag

SEQ ID NO: 106263 - DNA, 50 bp, Artificial Sequence
  Description of Artificial Sequence: Synthetic oligonucleotide
tgtttatgatttgctaaaaacaaacctttatcaggatgatgcagtaacag

SEQ ID NO: 106264 - DNA, 49 bp, Artificial Sequence
  Description of Artificial Sequence: Synthetic oligonucleotide
gtttatgatttgctaaaaacaaacctttatcaggatgatgcagtaacag

SEQ ID NO: 106265 - DNA, 49 bp, Artificial Sequence
  Description of Artificial Sequence: Synthetic oligonucleotide
tttatgatttgctaaaaacaaacctttatcaggatgatgcagtaacagg

SEQ ID NO: 106266 - DNA, 48 bp, Artificial Sequence
  Description of Artificial Sequence: Synthetic oligonucleotide
ttatgatttgctaaaaacaaacctttatcaggatgatgcagtaacagg

SEQ ID NO: 106267 - DNA, 47 bp, Artificial Sequence
  Description of Artificial Sequence: Synthetic oligonucleotide
tatgatttgctaaaaacaaacctttatcaggatgatgcagtaacagg

SEQ ID NO: 106268 - DNA, 46 bp, Artificial Sequence
  Description of Artificial Sequence: Synthetic oligonucleotide
atgatttgctaaaaacaaacctttatcaggatgatgcagtaacagg

SEQ ID NO: 106269 - DNA, 45 bp, Artificial Sequence
  Description of Artificial Sequence: Synthetic oligonucleotide
tgatttgctaaaaacaaacctttatcaggatgatgcagtaacagg

SEQ ID NO: 106270 - DNA, 44 bp, Artificial Sequence
  Description of Artificial Sequence: Synthetic oligonucleotide
gatttgctaaaaacaaacctttatcaggatgatgcagtaacagg

SEQ ID NO: 106271 - DNA, 44 bp, Artificial Sequence
  Description of Artificial Sequence: Synthetic oligonucleotide
atttgctaaaaacaaacctttatcaggatgatgcagtaacaggg

SEQ ID NO: 106272 - DNA, 43 bp, Artificial Sequence
  Description of Artificial Sequence: Synthetic oligonucleotide
tttgctaaaaacaaacctttatcaggatgatgcagtaacaggg

SEQ ID NO: 106273 - DNA, 42 bp, Artificial Sequence
  Description of Artificial Sequence: Synthetic oligonucleotide
ttgctaaaaacaaacctttatcaggatgatgcagtaacaggg

SEQ ID NO: 106274 - DNA, 41 bp, Artificial Sequence
  Description of Artificial Sequence: Synthetic oligonucleotide
tgctaaaaacaaacctttatcaggatgatgcagtaacaggg

SEQ ID NO: 106275 - DNA, 40 bp, Artificial Sequence
  Description of Artificial Sequence: Synthetic oligonucleotide
gctaaaaacaaacctttatcaggatgatgcagtaacaggg

SEQ ID NO: 106276 - DNA, 40 bp, Artificial Sequence
  Description of Artificial Sequence: Synthetic oligonucleotide
ctaaaaacaaacctttatcaggatgatgcagtaacagggg

SEQ ID NO: 106277 - DNA, 42 bp, Artificial Sequence
  Description of Artificial Sequence: Synthetic oligonucleotide
taaaaacaaacctttatcaggatgatgcagtaacaggggaag

SEQ ID NO: 106278 - DNA, 41 bp, Artificial Sequence
  Description of Artificial Sequence: Synthetic oligonucleotide
aaaaacaaacctttatcaggatgatgcagtaacaggggaag

SEQ ID NO: 106279 - DNA, 40 bp, Artificial Sequence
  Description of Artificial Sequence: Synthetic oligonucleotide
aaaacaaacctttatcaggatgatgcagtaacaggggaag

SEQ ID NO: 106280 - DNA, 39 bp, Artificial Sequence
  Description of Artificial Sequence: Synthetic oligonucleotide
aaacaaacctttatcaggatgatgcagtaacaggggaag

SEQ ID NO: 106281 - DNA, 38 bp, Artificial Sequence
  Description of Artificial Sequence: Synthetic oligonucleotide
aacaaacctttatcaggatgatgcagtaacaggggaag

SEQ ID NO: 106282 - DNA, 37 bp, Artificial Sequence
  Description of Artificial Sequence: Synthetic oligonucleotide
acaaacctttatcaggatgatgcagtaacaggggaag

SEQ ID NO: 106283 - DNA, 36 bp, Artificial Sequence
  Description of Artificial Sequence: Synthetic oligonucleotide
caaacctttatcaggatgatgcagtaacaggggaag

SEQ ID NO: 106284 - DNA, 36 bp, Artificial Sequence
  Description of Artificial Sequence: Synthetic oligonucleotide
aaacctttatcaggatgatgcagtaacaggggaagc

SEQ ID NO: 106285 - DNA, 35 bp, Artificial Sequence
  Description of Artificial Sequence: Synthetic oligonucleotide
aacctttatcaggatgatgcagtaacaggggaagc

SEQ ID NO: 106286 - DNA, 34 bp, Artificial Sequence
  Description of Artificial Sequence: Synthetic oligonucleotide
acctttatcaggatgatgcagtaacaggggaagc

SEQ ID NO: 106287 - DNA, 33 bp, Artificial Sequence
  Description of Artificial Sequence: Synthetic oligonucleotide
cctttatcaggatgatgcagtaacaggggaagc

SEQ ID NO: 106288 - DNA, 34 bp, Artificial Sequence
  Description of Artificial Sequence: Synthetic oligonucleotide
ctttatcaggatgatgcagtaacaggggaagcag

SEQ ID NO: 106289 - DNA, 34 bp, Artificial Sequence
  Description of Artificial Sequence: Synthetic oligonucleotide
tttatcaggatgatgcagtaacaggggaagcagc

SEQ ID NO: 106290 - DNA, 33 bp, Artificial Sequence
  Description of Artificial Sequence: Synthetic oligonucleotide
ttatcaggatgatgcagtaacaggggaagcagc

SEQ ID NO: 106291 - DNA, 32 bp, Artificial Sequence
  Description of Artificial Sequence: Synthetic oligonucleotide
tatcaggatgatgcagtaacaggggaagcagc

SEQ ID NO: 106292 - DNA, 31 bp, Artificial Sequence
  Description of Artificial Sequence: Synthetic oligonucleotide
atcaggatgatgcagtaacaggggaagcagc

SEQ ID NO: 106293 - DNA, 30 bp, Artificial Sequence
  Description of Artificial Sequence: Synthetic oligonucleotide
tcaggatgatgcagtaacaggggaagcagc

SEQ ID NO: 106294 - DNA, 29 bp, Artificial Sequence
  Description of Artificial Sequence: Synthetic oligonucleotide
caggatgatgcagtaacaggggaagcagc

SEQ ID NO: 106295 - DNA, 30 bp, Artificial Sequence
  Description of Artificial Sequence: Synthetic oligonucleotide
aggatgatgcagtaacaggggaagcagctg

SEQ ID NO: 106296 - DNA, 29 bp, Artificial Sequence
  Description of Artificial Sequence: Synthetic oligonucleotide
ggatgatgcagtaacaggggaagcagctg

SEQ ID NO: 106297 - DNA, 29 bp, Artificial Sequence
  Description of Artificial Sequence: Synthetic oligonucleotide
gatgatgcagtaacaggggaagcagctgg

SEQ ID NO: 106298 - DNA, 29 bp, Artificial Sequence
  Description of Artificial Sequence: Synthetic oligonucleotide
atgatgcagtaacaggggaagcagctggc

SEQ ID NO: 106299 - DNA, 28 bp, Artificial Sequence
  Description of Artificial Sequence: Synthetic oligonucleotide
tgatgcagtaacaggggaagcagctggc

SEQ ID NO: 106300 - DNA, 27 bp, Artificial Sequence
  Description of Artificial Sequence: Synthetic oligonucleotide
gatgcagtaacaggggaagcagctggc

SEQ ID NO: 106301 - DNA, 27 bp, Artificial Sequence
  Description of Artificial Sequence: Synthetic oligonucleotide
atgcagtaacaggggaagcagctggcc

SEQ ID NO: 106302 - DNA, 27 bp, Artificial Sequence
  Description of Artificial Sequence: Synthetic oligonucleotide
tgcagtaacaggggaagcagctggcct

SEQ ID NO: 106303 - DNA, 26 bp, Artificial Sequence
  Description of Artificial Sequence: Synthetic oligonucleotide
gcagtaacaggggaagcagctggcct

SEQ ID NO: 106304 - DNA, 26 bp, Artificial Sequence
  Description of Artificial Sequence: Synthetic oligonucleotide
cagtaacaggggaagcagctggcctg

SEQ ID NO: 106305 - DNA, 26 bp, Artificial Sequence
  Description of Artificial Sequence: Synthetic oligonucleotide
agtaacaggggaagcagctggcctgg

SEQ ID NO: 106306 - DNA, 25 bp, Artificial Sequence
  Description of Artificial Sequence: Synthetic oligonucleotide
gtaacaggggaagcagctggcctgg

SEQ ID NO: 106307 - DNA, 25 bp, Artificial Sequence
  Description of Artificial Sequence: Synthetic oligonucleotide
taacaggggaagcagctggcctggc

SEQ ID NO: 106308 - DNA, 24 bp, Artificial Sequence
  Description of Artificial Sequence: Synthetic oligonucleotide
aacaggggaagcagctggcctggc

SEQ ID NO: 106309 - DNA, 23 bp, Artificial Sequence
  Description of Artificial Sequence: Synthetic oligonucleotide
acaggggaagcagctggcctggc

SEQ ID NO: 106310 - DNA, 22 bp, Artificial Sequence
  Description of Artificial Sequence: Synthetic oligonucleotide
caggggaagcagctggcctggc

SEQ ID NO: 106311 - DNA, 22 bp, Artificial Sequence
  Description of Artificial Sequence: Synthetic oligonucleotide
aggggaagcagctggcctggcc

SEQ ID NO: 106312 - DNA, 21 bp, Artificial Sequence
  Description of Artificial Sequence: Synthetic oligonucleotide
ggggaagcagctggcctggcc

SEQ ID NO: 106313 - DNA, 23 bp, Artificial Sequence
  Description of Artificial Sequence: Synthetic oligonucleotide
gggaagcagctggcctggcccta

SEQ ID NO: 106314 - DNA, 23 bp, Artificial Sequence
  Description of Artificial Sequence: Synthetic oligonucleotide
ggaagcagctggcctggccctag

SEQ ID NO: 106315 - DNA, 26 bp, Artificial Sequence
  Description of Artificial Sequence: Synthetic oligonucleotide
gaagcagctggcctggccctaggttt

SEQ ID NO: 106316 - DNA, 26 bp, Artificial Sequence
  Description of Artificial Sequence: Synthetic oligonucleotide
aagcagctggcctggccctaggtttg

SEQ ID NO: 106317 - DNA, 25 bp, Artificial Sequence
  Description of Artificial Sequence: Synthetic oligonucleotide
agcagctggcctggccctaggtttg

SEQ ID NO: 106318 - DNA, 24 bp, Artificial Sequence
  Description of Artificial Sequence: Synthetic oligonucleotide
gcagctggcctggccctaggtttg

SEQ ID NO: 106319 - DNA, 27 bp, Artificial Sequence
  Description of Artificial Sequence: Synthetic oligonucleotide
cagctggcctggccctaggtttggtta

SEQ ID NO: 106320 - DNA, 28 bp, Artificial Sequence
  Description of Artificial Sequence: Synthetic oligonucleotide
agctggcctggccctaggtttggttatg

SEQ ID NO: 106321 - DNA, 27 bp, Artificial Sequence
  Description of Artificial Sequence: Synthetic oligonucleotide
gctggcctggccctaggtttggttatg

SEQ ID NO: 106322 - DNA, 29 bp, Artificial Sequence
  Description of Artificial Sequence: Synthetic oligonucleotide
ctggcctggccctaggtttggttatgttg

SEQ ID NO: 106323 - DNA, 29 bp, Artificial Sequence
  Description of Artificial Sequence: Synthetic oligonucleotide
tggcctggccctaggtttggttatgttgg

SEQ ID NO: 106324 - DNA, 28 bp, Artificial Sequence
  Description of Artificial Sequence: Synthetic oligonucleotide
ggcctggccctaggtttggttatgttgg

SEQ ID NO: 106325 - DNA, 28 bp, Artificial Sequence
  Description of Artificial Sequence: Synthetic oligonucleotide
gcctggccctaggtttggttatgttggg

SEQ ID NO: 106326 - DNA, 28 bp, Artificial Sequence
  Description of Artificial Sequence: Synthetic oligonucleotide
cctggccctaggtttggttatgttgggc

SEQ ID NO: 106327 - DNA, 29 bp, Artificial Sequence
  Description of Artificial Sequence: Synthetic oligonucleotide
ctggccctaggtttggttatgttgggctc

SEQ ID NO: 106328 - DNA, 36 bp, Artificial Sequence
  Description of Artificial Sequence: Synthetic oligonucleotide
tggccctaggtttggttatgttgggctctaaaaatg

SEQ ID NO: 106329 - DNA, 35 bp, Artificial Sequence
  Description of Artificial Sequence: Synthetic oligonucleotide
ggccctaggtttggttatgttgggctctaaaaatg

SEQ ID NO: 106330 - DNA, 35 bp, Artificial Sequence
  Description of Artificial Sequence: Synthetic oligonucleotide
gccctaggtttggttatgttgggctctaaaaatgc

SEQ ID NO: 106331 - DNA, 36 bp, Artificial Sequence
  Description of Artificial Sequence: Synthetic oligonucleotide
ccctaggtttggttatgttgggctctaaaaatgctc

SEQ ID NO: 106332 - DNA, 37 bp, Artificial Sequence
  Description of Artificial Sequence: Synthetic oligonucleotide
cctaggtttggttatgttgggctctaaaaatgctcag

SEQ ID NO: 106333 - DNA, 37 bp, Artificial Sequence
  Description of Artificial Sequence: Synthetic oligonucleotide
ctaggtttggttatgttgggctctaaaaatgctcagg

SEQ ID NO: 106334 - DNA, 37 bp, Artificial Sequence
  Description of Artificial Sequence: Synthetic oligonucleotide
taggtttggttatgttgggctctaaaaatgctcaggc

SEQ ID NO: 106335 - DNA, 36 bp, Artificial Sequence
  Description of Artificial Sequence: Synthetic oligonucleotide
aggtttggttatgttgggctctaaaaatgctcaggc

SEQ ID NO: 106336 - DNA, 35 bp, Artificial Sequence
  Description of Artificial Sequence: Synthetic oligonucleotide
ggtttggttatgttgggctctaaaaatgctcaggc

SEQ ID NO: 106337 - DNA, 39 bp, Artificial Sequence
  Description of Artificial Sequence: Synthetic oligonucleotide
gtttggttatgttgggctctaaaaatgctcaggctattg

SEQ ID NO: 106338 - DNA, 40 bp, Artificial Sequence
  Description of Artificial Sequence: Synthetic oligonucleotide
tttggttatgttgggctctaaaaatgctcaggctattgag

SEQ ID NO: 106339 - DNA, 39 bp, Artificial Sequence
  Description of Artificial Sequence: Synthetic oligonucleotide
ttggttatgttgggctctaaaaatgctcaggctattgag

SEQ ID NO: 106340 - DNA, 38 bp, Artificial Sequence
  Description of Artificial Sequence: Synthetic oligonucleotide
tggttatgttgggctctaaaaatgctcaggctattgag

SEQ ID NO: 106341 - DNA, 37 bp, Artificial Sequence
  Description of Artificial Sequence: Synthetic oligonucleotide
ggttatgttgggctctaaaaatgctcaggctattgag

SEQ ID NO: 106342 - DNA, 37 bp, Artificial Sequence
  Description of Artificial Sequence: Synthetic oligonucleotide
gttatgttgggctctaaaaatgctcaggctattgagg

SEQ ID NO: 106343 - DNA, 38 bp, Artificial Sequence
  Description of Artificial Sequence: Synthetic oligonucleotide
ttatgttgggctctaaaaatgctcaggctattgaggac

SEQ ID NO: 106344 - DNA, 37 bp, Artificial Sequence
  Description of Artificial Sequence: Synthetic oligonucleotide
tatgttgggctctaaaaatgctcaggctattgaggac

SEQ ID NO: 106345 - DNA, 36 bp, Artificial Sequence
  Description of Artificial Sequence: Synthetic oligonucleotide
atgttgggctctaaaaatgctcaggctattgaggac

SEQ ID NO: 106346 - DNA, 35 bp, Artificial Sequence
  Description of Artificial Sequence: Synthetic oligonucleotide
tgttgggctctaaaaatgctcaggctattgaggac

SEQ ID NO: 106347 - DNA, 34 bp, Artificial Sequence
  Description of Artificial Sequence: Synthetic oligonucleotide
gttgggctctaaaaatgctcaggctattgaggac

SEQ ID NO: 106348 - DNA, 36 bp, Artificial Sequence
  Description of Artificial Sequence: Synthetic oligonucleotide
ttgggctctaaaaatgctcaggctattgaggacatg

SEQ ID NO: 106349 - DNA, 35 bp, Artificial Sequence
  Description of Artificial Sequence: Synthetic oligonucleotide
tgggctctaaaaatgctcaggctattgaggacatg

SEQ ID NO: 106350 - DNA, 34 bp, Artificial Sequence
  Description of Artificial Sequence: Synthetic oligonucleotide
gggctctaaaaatgctcaggctattgaggacatg

SEQ ID NO: 106351 - DNA, 34 bp, Artificial Sequence
  Description of Artificial Sequence: Synthetic oligonucleotide
ggctctaaaaatgctcaggctattgaggacatgg

SEQ ID NO: 106352 - DNA, 36 bp, Artificial Sequence
  Description of Artificial Sequence: Synthetic oligonucleotide
gctctaaaaatgctcaggctattgaggacatggttg

SEQ ID NO: 106353 - DNA, 36 bp, Artificial Sequence
  Description of Artificial Sequence: Synthetic oligonucleotide
ctctaaaaatgctcaggctattgaggacatggttgg

SEQ ID NO: 106354 - DNA, 40 bp, Artificial Sequence
  Description of Artificial Sequence: Synthetic oligonucleotide
tctaaaaatgctcaggctattgaggacatggttggttatg

SEQ ID NO: 106355 - DNA, 39 bp, Artificial Sequence
  Description of Artificial Sequence: Synthetic oligonucleotide
ctaaaaatgctcaggctattgaggacatggttggttatg

SEQ ID NO: 106356 - DNA, 39 bp, Artificial Sequence
  Description of Artificial Sequence: Synthetic oligonucleotide
taaaaatgctcaggctattgaggacatggttggttatgc

SEQ ID NO: 106357 - DNA, 38 bp, Artificial Sequence
  Description of Artificial Sequence: Synthetic oligonucleotide
aaaaatgctcaggctattgaggacatggttggttatgc

SEQ ID NO: 106358 - DNA, 37 bp, Artificial Sequence
  Description of Artificial Sequence: Synthetic oligonucleotide
aaaatgctcaggctattgaggacatggttggttatgc

SEQ ID NO: 106359 - DNA, 36 bp, Artificial Sequence
  Description of Artificial Sequence: Synthetic oligonucleotide
aaatgctcaggctattgaggacatggttggttatgc

SEQ ID NO: 106360 - DNA, 35 bp, Artificial Sequence
  Description of Artificial Sequence: Synthetic oligonucleotide
aatgctcaggctattgaggacatggttggttatgc

SEQ ID NO: 106361 - DNA, 34 bp, Artificial Sequence
  Description of Artificial Sequence: Synthetic oligonucleotide
atgctcaggctattgaggacatggttggttatgc

SEQ ID NO: 106362 - DNA, 33 bp, Artificial Sequence
  Description of Artificial Sequence: Synthetic oligonucleotide
tgctcaggctattgaggacatggttggttatgc

SEQ ID NO: 106363 - DNA, 32 bp, Artificial Sequence
  Description of Artificial Sequence: Synthetic oligonucleotide
gctcaggctattgaggacatggttggttatgc

SEQ ID NO: 106364 - DNA, 33 bp, Artificial Sequence
  Description of Artificial Sequence: Synthetic oligonucleotide
ctcaggctattgaggacatggttggttatgcac

SEQ ID NO: 106365 - DNA, 35 bp, Artificial Sequence
  Description of Artificial Sequence: Synthetic oligonucleotide
tcaggctattgaggacatggttggttatgcacaag

SEQ ID NO: 106366 - DNA, 34 bp, Artificial Sequence
  Description of Artificial Sequence: Synthetic oligonucleotide
caggctattgaggacatggttggttatgcacaag

SEQ ID NO: 106367 - DNA, 37 bp, Artificial Sequence
  Description of Artificial Sequence: Synthetic oligonucleotide
aggctattgaggacatggttggttatgcacaagaaac

SEQ ID NO: 106368 - DNA, 36 bp, Artificial Sequence
  Description of Artificial Sequence: Synthetic oligonucleotide
ggctattgaggacatggttggttatgcacaagaaac

SEQ ID NO: 106369 - DNA, 37 bp, Artificial Sequence
  Description of Artificial Sequence: Synthetic oligonucleotide
gctattgaggacatggttggttatgcacaagaaactc

SEQ ID NO: 106370 - DNA, 39 bp, Artificial Sequence
  Description of Artificial Sequence: Synthetic oligonucleotide
ctattgaggacatggttggttatgcacaagaaactcaac

SEQ ID NO: 106371 - DNA, 41 bp, Artificial Sequence
  Description of Artificial Sequence: Synthetic oligonucleotide
tattgaggacatggttggttatgcacaagaaactcaacatg

SEQ ID NO: 106372 - DNA, 40 bp, Artificial Sequence
  Description of Artificial Sequence: Synthetic oligonucleotide
attgaggacatggttggttatgcacaagaaactcaacatg

SEQ ID NO: 106373 - DNA, 39 bp, Artificial Sequence
  Description of Artificial Sequence: Synthetic oligonucleotide
ttgaggacatggttggttatgcacaagaaactcaacatg

SEQ ID NO: 106374 - DNA, 38 bp, Artificial Sequence
  Description of Artificial Sequence: Synthetic oligonucleotide
tgaggacatggttggttatgcacaagaaactcaacatg

SEQ ID NO: 106375 - DNA, 37 bp, Artificial Sequence
  Description of Artificial Sequence: Synthetic oligonucleotide
gaggacatggttggttatgcacaagaaactcaacatg

SEQ ID NO: 106376 - DNA, 38 bp, Artificial Sequence
  Description of Artificial Sequence: Synthetic oligonucleotide
aggacatggttggttatgcacaagaaactcaacatgag

SEQ ID NO: 106377 - DNA, 37 bp, Artificial Sequence
  Description of Artificial Sequence: Synthetic oligonucleotide
ggacatggttggttatgcacaagaaactcaacatgag

SEQ ID NO: 106378 - DNA, 39 bp, Artificial Sequence
  Description of Artificial Sequence: Synthetic oligonucleotide
gacatggttggttatgcacaagaaactcaacatgagaag

SEQ ID NO: 106379 - DNA, 42 bp, Artificial Sequence
  Description of Artificial Sequence: Synthetic oligonucleotide
acatggttggttatgcacaagaaactcaacatgagaagattc

SEQ ID NO: 106380 - DNA, 41 bp, Artificial Sequence
  Description of Artificial Sequence: Synthetic oligonucleotide
catggttggttatgcacaagaaactcaacatgagaagattc

SEQ ID NO: 106381 - DNA, 42 bp, Artificial Sequence
  Description of Artificial Sequence: Synthetic oligonucleotide
atggttggttatgcacaagaaactcaacatgagaagattctg

SEQ ID NO: 106382 - DNA, 41 bp, Artificial Sequence
  Description of Artificial Sequence: Synthetic oligonucleotide
tggttggttatgcacaagaaactcaacatgagaagattctg

SEQ ID NO: 106383 - DNA, 40 bp, Artificial Sequence
  Description of Artificial Sequence: Synthetic oligonucleotide
ggttggttatgcacaagaaactcaacatgagaagattctg

SEQ ID NO: 106384 - DNA, 40 bp, Artificial Sequence
  Description of Artificial Sequence: Synthetic oligonucleotide
gttggttatgcacaagaaactcaacatgagaagattctgc

SEQ ID NO: 106385 - DNA, 40 bp, Artificial Sequence
  Description of Artificial Sequence: Synthetic oligonucleotide
ttggttatgcacaagaaactcaacatgagaagattctgcg

SEQ ID NO: 106386 - DNA, 39 bp, Artificial Sequence
  Description of Artificial Sequence: Synthetic oligonucleotide
tggttatgcacaagaaactcaacatgagaagattctgcg

SEQ ID NO: 106387 - DNA, 38 bp, Artificial Sequence
  Description of Artificial Sequence: Synthetic oligonucleotide
ggttatgcacaagaaactcaacatgagaagattctgcg

SEQ ID NO: 106388 - DNA, 39 bp, Artificial Sequence
  Description of Artificial Sequence: Synthetic oligonucleotide
gttatgcacaagaaactcaacatgagaagattctgcgtg

SEQ ID NO: 106389 - DNA, 39 bp, Artificial Sequence
  Description of Artificial Sequence: Synthetic oligonucleotide
ttatgcacaagaaactcaacatgagaagattctgcgtgg

SEQ ID NO: 106390 - DNA, 38 bp, Artificial Sequence
  Description of Artificial Sequence: Synthetic oligonucleotide
tatgcacaagaaactcaacatgagaagattctgcgtgg

SEQ ID NO: 106391 - DNA, 37 bp, Artificial Sequence
  Description of Artificial Sequence: Synthetic oligonucleotide
atgcacaagaaactcaacatgagaagattctgcgtgg

SEQ ID NO: 106392 - DNA, 36 bp, Artificial Sequence
  Description of Artificial Sequence: Synthetic oligonucleotide
tgcacaagaaactcaacatgagaagattctgcgtgg

SEQ ID NO: 106393 - DNA, 35 bp, Artificial Sequence
  Description of Artificial Sequence: Synthetic oligonucleotide
gcacaagaaactcaacatgagaagattctgcgtgg

SEQ ID NO: 106394 - DNA, 36 bp, Artificial Sequence
  Description of Artificial Sequence: Synthetic oligonucleotide
cacaagaaactcaacatgagaagattctgcgtggtc

SEQ ID NO: 106395 - DNA, 38 bp, Artificial Sequence
  Description of Artificial Sequence: Synthetic oligonucleotide
acaagaaactcaacatgagaagattctgcgtggtcttg

SEQ ID NO: 106396 - DNA, 37 bp, Artificial Sequence
  Description of Artificial Sequence: Synthetic oligonucleotide
caagaaactcaacatgagaagattctgcgtggtcttg

SEQ ID NO: 106397 - DNA, 37 bp, Artificial Sequence
  Description of Artificial Sequence: Synthetic oligonucleotide
aagaaactcaacatgagaagattctgcgtggtcttgc

SEQ ID NO: 106398 - DNA, 36 bp, Artificial Sequence
  Description of Artificial Sequence: Synthetic oligonucleotide
agaaactcaacatgagaagattctgcgtggtcttgc

SEQ ID NO: 106399 - DNA, 35 bp, Artificial Sequence
  Description of Artificial Sequence: Synthetic oligonucleotide
gaaactcaacatgagaagattctgcgtggtcttgc

SEQ ID NO: 106400 - DNA, 36 bp, Artificial Sequence
  Description of Artificial Sequence: Synthetic oligonucleotide
aaactcaacatgagaagattctgcgtggtcttgcag

SEQ ID NO: 106401 - DNA, 35 bp, Artificial Sequence
  Description of Artificial Sequence: Synthetic oligonucleotide
aactcaacatgagaagattctgcgtggtcttgcag

SEQ ID NO: 106402 - DNA, 34 bp, Artificial Sequence
  Description of Artificial Sequence: Synthetic oligonucleotide
actcaacatgagaagattctgcgtggtcttgcag

SEQ ID NO: 106403 - DNA, 33 bp, Artificial Sequence
  Description of Artificial Sequence: Synthetic oligonucleotide
ctcaacatgagaagattctgcgtggtcttgcag

SEQ ID NO: 106404 - DNA, 35 bp, Artificial Sequence
  Description of Artificial Sequence: Synthetic oligonucleotide
tcaacatgagaagattctgcgtggtcttgcagttg

SEQ ID NO: 106405 - DNA, 34 bp, Artificial Sequence
  Description of Artificial Sequence: Synthetic oligonucleotide
caacatgagaagattctgcgtggtcttgcagttg

SEQ ID NO: 106406 - DNA, 34 bp, Artificial Sequence
  Description of Artificial Sequence: Synthetic oligonucleotide
aacatgagaagattctgcgtggtcttgcagttgg

SEQ ID NO: 106407 - DNA, 33 bp, Artificial Sequence
  Description of Artificial Sequence: Synthetic oligonucleotide
acatgagaagattctgcgtggtcttgcagttgg

SEQ ID NO: 106408 - DNA, 32 bp, Artificial Sequence
  Description of Artificial Sequence: Synthetic oligonucleotide
catgagaagattctgcgtggtcttgcagttgg

SEQ ID NO: 106409 - DNA, 32 bp, Artificial Sequence
  Description of Artificial Sequence: Synthetic oligonucleotide
atgagaagattctgcgtggtcttgcagttggc

SEQ ID NO: 106410 - DNA, 31 bp, Artificial Sequence
  Description of Artificial Sequence: Synthetic oligonucleotide
tgagaagattctgcgtggtcttgcagttggc

SEQ ID NO: 106411 - DNA, 30 bp, Artificial Sequence
  Description of Artificial Sequence: Synthetic oligonucleotide
gagaagattctgcgtggtcttgcagttggc

SEQ ID NO: 106412 - DNA, 33 bp, Artificial Sequence
  Description of Artificial Sequence: Synthetic oligonucleotide
agaagattctgcgtggtcttgcagttggcatag

SEQ ID NO: 106413 - DNA, 32 bp, Artificial Sequence
  Description of Artificial Sequence: Synthetic oligonucleotide
gaagattctgcgtggtcttgcagttggcatag

SEQ ID NO: 106414 - DNA, 32 bp, Artificial Sequence
  Description of Artificial Sequence: Synthetic oligonucleotide
aagattctgcgtggtcttgcagttggcatagc

SEQ ID NO: 106415 - DNA, 31 bp, Artificial Sequence
  Description of Artificial Sequence: Synthetic oligonucleotide
agattctgcgtggtcttgcagttggcatagc

SEQ ID NO: 106416 - DNA, 30 bp, Artificial Sequence
  Description of Artificial Sequence: Synthetic oligonucleotide
gattctgcgtggtcttgcagttggcatagc

SEQ ID NO: 106417 - DNA, 34 bp, Artificial Sequence
  Description of Artificial Sequence: Synthetic oligonucleotide
attctgcgtggtcttgcagttggcatagctttag

SEQ ID NO: 106418 - DNA, 33 bp, Artificial Sequence
  Description of Artificial Sequence: Synthetic oligonucleotide
ttctgcgtggtcttgcagttggcatagctttag

SEQ ID NO: 106419 - DNA, 32 bp, Artificial Sequence
  Description of Artificial Sequence: Synthetic oligonucleotide
tctgcgtggtcttgcagttggcatagctttag

SEQ ID NO: 106420 - DNA, 31 bp, Artificial Sequence
  Description of Artificial Sequence: Synthetic oligonucleotide
ctgcgtggtcttgcagttggcatagctttag

SEQ ID NO: 106421 - DNA, 35 bp, Artificial Sequence
  Description of Artificial Sequence: Synthetic oligonucleotide
tgcgtggtcttgcagttggcatagctttagtaatg

SEQ ID NO: 106422 - DNA, 34 bp, Artificial Sequence
  Description of Artificial Sequence: Synthetic oligonucleotide
gcgtggtcttgcagttggcatagctttagtaatg

SEQ ID NO: 106423 - DNA, 37 bp, Artificial Sequence
  Description of Artificial Sequence: Synthetic oligonucleotide
cgtggtcttgcagttggcatagctttagtaatgtatg

SEQ ID NO: 106424 - DNA, 37 bp, Artificial Sequence
  Description of Artificial Sequence: Synthetic oligonucleotide
gtggtcttgcagttggcatagctttagtaatgtatgg

SEQ ID NO: 106425 - DNA, 37 bp, Artificial Sequence
  Description of Artificial Sequence: Synthetic oligonucleotide
tggtcttgcagttggcatagctttagtaatgtatggg

SEQ ID NO: 106426 - DNA, 36 bp, Artificial Sequence
  Description of Artificial Sequence: Synthetic oligonucleotide
ggtcttgcagttggcatagctttagtaatgtatggg

SEQ ID NO: 106427 - DNA, 37 bp, Artificial Sequence
  Description of Artificial Sequence: Synthetic oligonucleotide
gtcttgcagttggcatagctttagtaatgtatgggag

SEQ ID NO: 106428 - DNA, 37 bp, Artificial Sequence
  Description of Artificial Sequence: Synthetic oligonucleotide
tcttgcagttggcatagctttagtaatgtatgggagg

SEQ ID NO: 106429 - DNA, 36 bp, Artificial Sequence
  Description of Artificial Sequence: Synthetic oligonucleotide
cttgcagttggcatagctttagtaatgtatgggagg

SEQ ID NO: 106430 - DNA, 38 bp, Artificial Sequence
  Description of Artificial Sequence: Synthetic oligonucleotide
ttgcagttggcatagctttagtaatgtatgggaggatg

SEQ ID NO: 106431 - DNA, 37 bp, Artificial Sequence
  Description of Artificial Sequence: Synthetic oligonucleotide
tgcagttggcatagctttagtaatgtatgggaggatg

SEQ ID NO: 106432 - DNA, 36 bp, Artificial Sequence
  Description of Artificial Sequence: Synthetic oligonucleotide
gcagttggcatagctttagtaatgtatgggaggatg

SEQ ID NO: 106433 - DNA, 36 bp, Artificial Sequence
  Description of Artificial Sequence: Synthetic oligonucleotide
cagttggcatagctttagtaatgtatgggaggatgg

SEQ ID NO: 106434 - DNA, 38 bp, Artificial Sequence
  Description of Artificial Sequence: Synthetic oligonucleotide
agttggcatagctttagtaatgtatgggaggatggaag

SEQ ID NO: 106435 - DNA, 37 bp, Artificial Sequence
  Description of Artificial Sequence: Synthetic oligonucleotide
gttggcatagctttagtaatgtatgggaggatggaag

SEQ ID NO: 106436 - DNA, 38 bp, Artificial Sequence
  Description of Artificial Sequence: Synthetic oligonucleotide
ttggcatagctttagtaatgtatgggaggatggaagag

SEQ ID NO: 106437 - DNA, 37 bp, Artificial Sequence
  Description of Artificial Sequence: Synthetic oligonucleotide
tggcatagctttagtaatgtatgggaggatggaagag

SEQ ID NO: 106438 - DNA, 36 bp, Artificial Sequence
  Description of Artificial Sequence: Synthetic oligonucleotide
ggcatagctttagtaatgtatgggaggatggaagag

SEQ ID NO: 106439 - DNA, 36 bp, Artificial Sequence
  Description of Artificial Sequence: Synthetic oligonucleotide
gcatagctttagtaatgtatgggaggatggaagagg

SEQ ID NO: 106440 - DNA, 36 bp, Artificial Sequence
  Description of Artificial Sequence: Synthetic oligonucleotide
catagctttagtaatgtatgggaggatggaagaggc

SEQ ID NO: 106441 - DNA, 37 bp, Artificial Sequence
  Description of Artificial Sequence: Synthetic oligonucleotide
atagctttagtaatgtatgggaggatggaagaggctg

SEQ ID NO: 106442 - DNA, 36 bp, Artificial Sequence
  Description of Artificial Sequence: Synthetic oligonucleotide
tagctttagtaatgtatgggaggatggaagaggctg

SEQ ID NO: 106443 - DNA, 35 bp, Artificial Sequence
  Description of Artificial Sequence: Synthetic oligonucleotide
agctttagtaatgtatgggaggatggaagaggctg

SEQ ID NO: 106444 - DNA, 34 bp, Artificial Sequence
  Description of Artificial Sequence: Synthetic oligonucleotide
gctttagtaatgtatgggaggatggaagaggctg

SEQ ID NO: 106445 - DNA, 36 bp, Artificial Sequence
  Description of Artificial Sequence: Synthetic oligonucleotide
ctttagtaatgtatgggaggatggaagaggctgatg

SEQ ID NO: 106446 - DNA, 36 bp, Artificial Sequence
  Description of Artificial Sequence: Synthetic oligonucleotide
tttagtaatgtatgggaggatggaagaggctgatgc

SEQ ID NO: 106447 - DNA, 35 bp, Artificial Sequence
  Description of Artificial Sequence: Synthetic oligonucleotide
ttagtaatgtatgggaggatggaagaggctgatgc

SEQ ID NO: 106448 - DNA, 34 bp, Artificial Sequence
  Description of Artificial Sequence: Synthetic oligonucleotide
tagtaatgtatgggaggatggaagaggctgatgc

SEQ ID NO: 106449 - DNA, 33 bp, Artificial Sequence
  Description of Artificial Sequence: Synthetic oligonucleotide
agtaatgtatgggaggatggaagaggctgatgc

SEQ ID NO: 106450 - DNA, 32 bp, Artificial Sequence
  Description of Artificial Sequence: Synthetic oligonucleotide
gtaatgtatgggaggatggaagaggctgatgc

SEQ ID NO: 106451 - DNA, 33 bp, Artificial Sequence
  Description of Artificial Sequence: Synthetic oligonucleotide
taatgtatgggaggatggaagaggctgatgctc

SEQ ID NO: 106452 - DNA, 32 bp, Artificial Sequence
  Description of Artificial Sequence: Synthetic oligonucleotide
aatgtatgggaggatggaagaggctgatgctc

SEQ ID NO: 106453 - DNA, 31 bp, Artificial Sequence
  Description of Artificial Sequence: Synthetic oligonucleotide
atgtatgggaggatggaagaggctgatgctc

SEQ ID NO: 106454 - DNA, 30 bp, Artificial Sequence
  Description of Artificial Sequence: Synthetic oligonucleotide
tgtatgggaggatggaagaggctgatgctc

SEQ ID NO: 106455 - DNA, 29 bp, Artificial Sequence
  Description of Artificial Sequence: Synthetic oligonucleotide
gtatgggaggatggaagaggctgatgctc

SEQ ID NO: 106456 - DNA, 30 bp, Artificial Sequence
  Description of Artificial Sequence: Synthetic oligonucleotide
tatgggaggatggaagaggctgatgctctc

SEQ ID NO: 106457 - DNA, 29 bp, Artificial Sequence
  Description of Artificial Sequence: Synthetic oligonucleotide
atgggaggatggaagaggctgatgctctc

SEQ ID NO: 106458 - DNA, 28 bp, Artificial Sequence
  Description of Artificial Sequence: Synthetic oligonucleotide
tgggaggatggaagaggctgatgctctc

SEQ ID NO: 106459 - DNA, 27 bp, Artificial Sequence
  Description of Artificial Sequence: Synthetic oligonucleotide
gggaggatggaagaggctgatgctctc

SEQ ID NO: 106460 - DNA, 30 bp, Artificial Sequence
  Description of Artificial Sequence: Synthetic oligonucleotide
ggaggatggaagaggctgatgctctcattg

SEQ ID NO: 106461 - DNA, 33 bp, Artificial Sequence
  Description of Artificial Sequence: Synthetic oligonucleotide
gaggatggaagaggctgatgctctcattgaatc

SEQ ID NO: 106462 - DNA, 34 bp, Artificial Sequence
  Description of Artificial Sequence: Synthetic oligonucleotide
aggatggaagaggctgatgctctcattgaatctc

SEQ ID NO: 106463 - DNA, 33 bp, Artificial Sequence
  Description of Artificial Sequence: Synthetic oligonucleotide
ggatggaagaggctgatgctctcattgaatctc

SEQ ID NO: 106464 - DNA, 34 bp, Artificial Sequence
  Description of Artificial Sequence: Synthetic oligonucleotide
gatggaagaggctgatgctctcattgaatctctc

SEQ ID NO: 106465 - DNA, 35 bp, Artificial Sequence
  Description of Artificial Sequence: Synthetic oligonucleotide
atggaagaggctgatgctctcattgaatctctctg

SEQ ID NO: 106466 - DNA, 34 bp, Artificial Sequence
  Description of Artificial Sequence: Synthetic oligonucleotide
tggaagaggctgatgctctcattgaatctctctg

SEQ ID NO: 106467 - DNA, 33 bp, Artificial Sequence
  Description of Artificial Sequence: Synthetic oligonucleotide
ggaagaggctgatgctctcattgaatctctctg

SEQ ID NO: 106468 - DNA, 34 bp, Artificial Sequence
  Description of Artificial Sequence: Synthetic oligonucleotide
gaagaggctgatgctctcattgaatctctctgtc

SEQ ID NO: 106469 - DNA, 34 bp, Artificial Sequence
  Description of Artificial Sequence: Synthetic oligonucleotide
aagaggctgatgctctcattgaatctctctgtcg

SEQ ID NO: 106470 - DNA, 33 bp, Artificial Sequence
  Description of Artificial Sequence: Synthetic oligonucleotide
agaggctgatgctctcattgaatctctctgtcg

SEQ ID NO: 106471 - DNA, 32 bp, Artificial Sequence
  Description of Artificial Sequence: Synthetic oligonucleotide
gaggctgatgctctcattgaatctctctgtcg

SEQ ID NO: 106472 - DNA, 33 bp, Artificial Sequence
  Description of Artificial Sequence: Synthetic oligonucleotide
aggctgatgctctcattgaatctctctgtcgtg

SEQ ID NO: 106473 - DNA, 32 bp, Artificial Sequence
  Description of Artificial Sequence: Synthetic oligonucleotide
ggctgatgctctcattgaatctctctgtcgtg

SEQ ID NO: 106474 - DNA, 33 bp, Artificial Sequence
  Description of Artificial Sequence: Synthetic oligonucleotide
gctgatgctctcattgaatctctctgtcgtgac

SEQ ID NO: 106475 - DNA, 35 bp, Artificial Sequence
  Description of Artificial Sequence: Synthetic oligonucleotide
ctgatgctctcattgaatctctctgtcgtgacaag

SEQ ID NO: 106476 - DNA, 35 bp, Artificial Sequence
  Description of Artificial Sequence: Synthetic oligonucleotide
tgatgctctcattgaatctctctgtcgtgacaagg

SEQ ID NO: 106477 - DNA, 34 bp, Artificial Sequence
  Description of Artificial Sequence: Synthetic oligonucleotide
gatgctctcattgaatctctctgtcgtgacaagg

SEQ ID NO: 106478 - DNA, 35 bp, Artificial Sequence
  Description of Artificial Sequence: Synthetic oligonucleotide
atgctctcattgaatctctctgtcgtgacaaggac

SEQ ID NO: 106479 - DNA, 34 bp, Artificial Sequence
  Description of Artificial Sequence: Synthetic oligonucleotide
tgctctcattgaatctctctgtcgtgacaaggac

SEQ ID NO: 106480 - DNA, 33 bp, Artificial Sequence
  Description of Artificial Sequence: Synthetic oligonucleotide
gctctcattgaatctctctgtcgtgacaaggac

SEQ ID NO: 106481 - DNA, 33 bp, Artificial Sequence
  Description of Artificial Sequence: Synthetic oligonucleotide
ctctcattgaatctctctgtcgtgacaaggacc

SEQ ID NO: 106482 - DNA, 33 bp, Artificial Sequence
  Description of Artificial Sequence: Synthetic oligonucleotide
tctcattgaatctctctgtcgtgacaaggaccc

SEQ ID NO: 106483 - DNA, 32 bp, Artificial Sequence
  Description of Artificial Sequence: Synthetic oligonucleotide
ctcattgaatctctctgtcgtgacaaggaccc

SEQ ID NO: 106484 - DNA, 36 bp, Artificial Sequence
  Description of Artificial Sequence: Synthetic oligonucleotide
tcattgaatctctctgtcgtgacaaggacccaattc

SEQ ID NO: 106485 - DNA, 35 bp, Artificial Sequence
  Description of Artificial Sequence: Synthetic oligonucleotide
cattgaatctctctgtcgtgacaaggacccaattc

SEQ ID NO: 106486 - DNA, 37 bp, Artificial Sequence
  Description of Artificial Sequence: Synthetic oligonucleotide
attgaatctctctgtcgtgacaaggacccaattcttc

SEQ ID NO: 106487 - DNA, 36 bp, Artificial Sequence
  Description of Artificial Sequence: Synthetic oligonucleotide
ttgaatctctctgtcgtgacaaggacccaattcttc

SEQ ID NO: 106488 - DNA, 35 bp, Artificial Sequence
  Description of Artificial Sequence: Synthetic oligonucleotide
tgaatctctctgtcgtgacaaggacccaattcttc

SEQ ID NO: 106489 - DNA, 34 bp, Artificial Sequence
  Description of Artificial Sequence: Synthetic oligonucleotide
gaatctctctgtcgtgacaaggacccaattcttc

SEQ ID NO: 106490 - DNA, 34 bp, Artificial Sequence
  Description of Artificial Sequence: Synthetic oligonucleotide
aatctctctgtcgtgacaaggacccaattcttcg

SEQ ID NO: 106491 - DNA, 33 bp, Artificial Sequence
  Description of Artificial Sequence: Synthetic oligonucleotide
atctctctgtcgtgacaaggacccaattcttcg

SEQ ID NO: 106492 - DNA, 32 bp, Artificial Sequence
  Description of Artificial Sequence: Synthetic oligonucleotide
tctctctgtcgtgacaaggacccaattcttcg

SEQ ID NO: 106493 - DNA, 31 bp, Artificial Sequence
  Description of Artificial Sequence: Synthetic oligonucleotide
ctctctgtcgtgacaaggacccaattcttcg

SEQ ID NO: 106494 - DNA, 33 bp, Artificial Sequence
  Description of Artificial Sequence: Synthetic oligonucleotide
tctctgtcgtgacaaggacccaattcttcgaag

SEQ ID NO: 106495 - DNA, 32 bp, Artificial Sequence
  Description of Artificial Sequence: Synthetic oligonucleotide
ctctgtcgtgacaaggacccaattcttcgaag

SEQ ID NO: 106496 - DNA, 32 bp, Artificial Sequence
  Description of Artificial Sequence: Synthetic oligonucleotide
tctgtcgtgacaaggacccaattcttcgaagg

SEQ ID NO: 106497 - DNA, 31 bp, Artificial Sequence
  Description of Artificial Sequence: Synthetic oligonucleotide
ctgtcgtgacaaggacccaattcttcgaagg

SEQ ID NO: 106498 - DNA, 32 bp, Artificial Sequence
  Description of Artificial Sequence: Synthetic oligonucleotide
tgtcgtgacaaggacccaattcttcgaaggtc

SEQ ID NO: 106499 - DNA, 31 bp, Artificial Sequence
  Description of Artificial Sequence: Synthetic oligonucleotide
gtcgtgacaaggacccaattcttcgaaggtc

SEQ ID NO: 106500 - DNA, 32 bp, Artificial Sequence
  Description of Artificial Sequence: Synthetic oligonucleotide
tcgtgacaaggacccaattcttcgaaggtctg

SEQ ID NO: 106501 - DNA, 31 bp, Artificial Sequence
  Description of Artificial Sequence: Synthetic oligonucleotide
cgtgacaaggacccaattcttcgaaggtctg

SEQ ID NO: 106502 - DNA, 31 bp, Artificial Sequence
  Description of Artificial Sequence: Synthetic oligonucleotide
gtgacaaggacccaattcttcgaaggtctgg

SEQ ID NO: 106503 - DNA, 34 bp, Artificial Sequence
  Description of Artificial Sequence: Synthetic oligonucleotide
tgacaaggacccaattcttcgaaggtctggaatg

SEQ ID NO: 106504 - DNA, 33 bp, Artificial Sequence
  Description of Artificial Sequence: Synthetic oligonucleotide
gacaaggacccaattcttcgaaggtctggaatg

SEQ ID NO: 106505 - DNA, 37 bp, Artificial Sequence
  Description of Artificial Sequence: Synthetic oligonucleotide
acaaggacccaattcttcgaaggtctggaatgtatac

SEQ ID NO: 106506 - DNA, 36 bp, Artificial Sequence
  Description of Artificial Sequence: Synthetic oligonucleotide
caaggacccaattcttcgaaggtctggaatgtatac

SEQ ID NO: 106507 - DNA, 37 bp, Artificial Sequence
  Description of Artificial Sequence: Synthetic oligonucleotide
aaggacccaattcttcgaaggtctggaatgtatactg

SEQ ID NO: 106508 - DNA, 36 bp, Artificial Sequence
  Description of Artificial Sequence: Synthetic oligonucleotide
aggacccaattcttcgaaggtctggaatgtatactg

SEQ ID NO: 106509 - DNA, 35 bp, Artificial Sequence
  Description of Artificial Sequence: Synthetic oligonucleotide
ggacccaattcttcgaaggtctggaatgtatactg

SEQ ID NO: 106510 - DNA, 37 bp, Artificial Sequence
  Description of Artificial Sequence: Synthetic oligonucleotide
gacccaattcttcgaaggtctggaatgtatactgtag

SEQ ID NO: 106511 - DNA, 37 bp, Artificial Sequence
  Description of Artificial Sequence: Synthetic oligonucleotide
acccaattcttcgaaggtctggaatgtatactgtagc

SEQ ID NO: 106512 - DNA, 36 bp, Artificial Sequence
  Description of Artificial Sequence: Synthetic oligonucleotide
cccaattcttcgaaggtctggaatgtatactgtagc

SEQ ID NO: 106513 - DNA, 36 bp, Artificial Sequence
  Description of Artificial Sequence: Synthetic oligonucleotide
ccaattcttcgaaggtctggaatgtatactgtagcc

SEQ ID NO: 106514 - DNA, 38 bp, Artificial Sequence
  Description of Artificial Sequence: Synthetic oligonucleotide
caattcttcgaaggtctggaatgtatactgtagccatg

SEQ ID NO: 106515 - DNA, 38 bp, Artificial Sequence
  Description of Artificial Sequence: Synthetic oligonucleotide
aattcttcgaaggtctggaatgtatactgtagccatgg

SEQ ID NO: 106516 - DNA, 37 bp, Artificial Sequence
  Description of Artificial Sequence: Synthetic oligonucleotide
attcttcgaaggtctggaatgtatactgtagccatgg

SEQ ID NO: 106517 - DNA, 36 bp, Artificial Sequence
  Description of Artificial Sequence: Synthetic oligonucleotide
ttcttcgaaggtctggaatgtatactgtagccatgg

SEQ ID NO: 106518 - DNA, 35 bp, Artificial Sequence
  Description of Artificial Sequence: Synthetic oligonucleotide
tcttcgaaggtctggaatgtatactgtagccatgg

SEQ ID NO: 106519 - DNA, 34 bp, Artificial Sequence
  Description of Artificial Sequence: Synthetic oligonucleotide
cttcgaaggtctggaatgtatactgtagccatgg

SEQ ID NO: 106520 - DNA, 34 bp, Artificial Sequence
  Description of Artificial Sequence: Synthetic oligonucleotide
ttcgaaggtctggaatgtatactgtagccatggc

SEQ ID NO: 106521 - DNA, 33 bp, Artificial Sequence
  Description of Artificial Sequence: Synthetic oligonucleotide
tcgaaggtctggaatgtatactgtagccatggc

SEQ ID NO: 106522 - DNA, 32 bp, Artificial Sequence
  Description of Artificial Sequence: Synthetic oligonucleotide
cgaaggtctggaatgtatactgtagccatggc

SEQ ID NO: 106523 - DNA, 37 bp, Artificial Sequence
  Description of Artificial Sequence: Synthetic oligonucleotide
gaaggtctggaatgtatactgtagccatggcttattg

SEQ ID NO: 106524 - DNA, 38 bp, Artificial Sequence
  Description of Artificial Sequence: Synthetic oligonucleotide
aaggtctggaatgtatactgtagccatggcttattgtg

SEQ ID NO: 106525 - DNA, 37 bp, Artificial Sequence
  Description of Artificial Sequence: Synthetic oligonucleotide
aggtctggaatgtatactgtagccatggcttattgtg

SEQ ID NO: 106526 - DNA, 36 bp, Artificial Sequence
  Description of Artificial Sequence: Synthetic oligonucleotide
ggtctggaatgtatactgtagccatggcttattgtg

SEQ ID NO: 106527 - DNA, 36 bp, Artificial Sequence
  Description of Artificial Sequence: Synthetic oligonucleotide
gtctggaatgtatactgtagccatggcttattgtgg

SEQ ID NO: 106528 - DNA, 36 bp, Artificial Sequence
  Description of Artificial Sequence: Synthetic oligonucleotide
tctggaatgtatactgtagccatggcttattgtggc

SEQ ID NO: 106529 - DNA, 35 bp, Artificial Sequence
  Description of Artificial Sequence: Synthetic oligonucleotide
ctggaatgtatactgtagccatggcttattgtggc

SEQ ID NO: 106530 - DNA, 36 bp, Artificial Sequence
  Description of Artificial Sequence: Synthetic oligonucleotide
tggaatgtatactgtagccatggcttattgtggctc

SEQ ID NO: 106531 - DNA, 35 bp, Artificial Sequence
  Description of Artificial Sequence: Synthetic oligonucleotide
ggaatgtatactgtagccatggcttattgtggctc

SEQ ID NO: 106532 - DNA, 36 bp, Artificial Sequence
  Description of Artificial Sequence: Synthetic oligonucleotide
gaatgtatactgtagccatggcttattgtggctctg

SEQ ID NO: 106533 - DNA, 36 bp, Artificial Sequence
  Description of Artificial Sequence: Synthetic oligonucleotide
aatgtatactgtagccatggcttattgtggctctgg

SEQ ID NO: 106534 - DNA, 35 bp, Artificial Sequence
  Description of Artificial Sequence: Synthetic oligonucleotide
atgtatactgtagccatggcttattgtggctctgg

SEQ ID NO: 106535 - DNA, 34 bp, Artificial Sequence
  Description of Artificial Sequence: Synthetic oligonucleotide
tgtatactgtagccatggcttattgtggctctgg

SEQ ID NO: 106536 - DNA, 33 bp, Artificial Sequence
  Description of Artificial Sequence: Synthetic oligonucleotide
gtatactgtagccatggcttattgtggctctgg

SEQ ID NO: 106537 - DNA, 36 bp, Artificial Sequence
  Description of Artificial Sequence: Synthetic oligonucleotide
tatactgtagccatggcttattgtggctctggtaac

SEQ ID NO: 106538 - DNA, 35 bp, Artificial Sequence
  Description of Artificial Sequence: Synthetic oligonucleotide
atactgtagccatggcttattgtggctctggtaac

SEQ ID NO: 106539 - DNA, 34 bp, Artificial Sequence
  Description of Artificial Sequence: Synthetic oligonucleotide
tactgtagccatggcttattgtggctctggtaac

SEQ ID NO: 106540 - DNA, 33 bp, Artificial Sequence
  Description of Artificial Sequence: Synthetic oligonucleotide
actgtagccatggcttattgtggctctggtaac

SEQ ID NO: 106541 - DNA, 32 bp, Artificial Sequence
  Description of Artificial Sequence: Synthetic oligonucleotide
ctgtagccatggcttattgtggctctggtaac

SEQ ID NO: 106542 - DNA, 34 bp, Artificial Sequence
  Description of Artificial Sequence: Synthetic oligonucleotide
tgtagccatggcttattgtggctctggtaacaac

SEQ ID NO: 106543 - DNA, 33 bp, Artificial Sequence
  Description of Artificial Sequence: Synthetic oligonucleotide
gtagccatggcttattgtggctctggtaacaac

SEQ ID NO: 106544 - DNA, 36 bp, Artificial Sequence
  Description of Artificial Sequence: Synthetic oligonucleotide
tagccatggcttattgtggctctggtaacaacaaag

SEQ ID NO: 106545 - DNA, 35 bp, Artificial Sequence
  Description of Artificial Sequence: Synthetic oligonucleotide
agccatggcttattgtggctctggtaacaacaaag

SEQ ID NO: 106546 - DNA, 34 bp, Artificial Sequence
  Description of Artificial Sequence: Synthetic oligonucleotide
gccatggcttattgtggctctggtaacaacaaag

SEQ ID NO: 106547 - DNA, 34 bp, Artificial Sequence
  Description of Artificial Sequence: Synthetic oligonucleotide
ccatggcttattgtggctctggtaacaacaaagc

SEQ ID NO: 106548 - DNA, 38 bp, Artificial Sequence
  Description of Artificial Sequence: Synthetic oligonucleotide
catggcttattgtggctctggtaacaacaaagcaattc

SEQ ID NO: 106549 - DNA, 38 bp, Artificial Sequence
  Description of Artificial Sequence: Synthetic oligonucleotide
atggcttattgtggctctggtaacaacaaagcaattcg

SEQ ID NO: 106550 - DNA, 37 bp, Artificial Sequence
  Description of Artificial Sequence: Synthetic oligonucleotide
tggcttattgtggctctggtaacaacaaagcaattcg

SEQ ID NO: 106551 - DNA, 36 bp, Artificial Sequence
  Description of Artificial Sequence: Synthetic oligonucleotide
ggcttattgtggctctggtaacaacaaagcaattcg

SEQ ID NO: 106552 - DNA, 37 bp, Artificial Sequence
  Description of Artificial Sequence: Synthetic oligonucleotide
gcttattgtggctctggtaacaacaaagcaattcgac

SEQ ID NO: 106553 - DNA, 37 bp, Artificial Sequence
  Description of Artificial Sequence: Synthetic oligonucleotide
cttattgtggctctggtaacaacaaagcaattcgacg

SEQ ID NO: 106554 - DNA, 37 bp, Artificial Sequence
  Description of Artificial Sequence: Synthetic oligonucleotide
ttattgtggctctggtaacaacaaagcaattcgacgc

SEQ ID NO: 106555 - DNA, 36 bp, Artificial Sequence
  Description of Artificial Sequence: Synthetic oligonucleotide
tattgtggctctggtaacaacaaagcaattcgacgc

SEQ ID NO: 106556 - DNA, 35 bp, Artificial Sequence
  Description of Artificial Sequence: Synthetic oligonucleotide
attgtggctctggtaacaacaaagcaattcgacgc

SEQ ID NO: 106557 - DNA, 34 bp, Artificial Sequence
  Description of Artificial Sequence: Synthetic oligonucleotide
ttgtggctctggtaacaacaaagcaattcgacgc

SEQ ID NO: 106558 - DNA, 33 bp, Artificial Sequence
  Description of Artificial Sequence: Synthetic oligonucleotide
tgtggctctggtaacaacaaagcaattcgacgc

SEQ ID NO: 106559 - DNA, 32 bp, Artificial Sequence
  Description of Artificial Sequence: Synthetic oligonucleotide
gtggctctggtaacaacaaagcaattcgacgc

SEQ ID NO: 106560 - DNA, 32 bp, Artificial Sequence
  Description of Artificial Sequence: Synthetic oligonucleotide
tggctctggtaacaacaaagcaattcgacgcc

SEQ ID NO: 106561 - DNA, 31 bp, Artificial Sequence
  Description of Artificial Sequence: Synthetic oligonucleotide
ggctctggtaacaacaaagcaattcgacgcc

SEQ ID NO: 106562 - DNA, 32 bp, Artificial Sequence
  Description of Artificial Sequence: Synthetic oligonucleotide
gctctggtaacaacaaagcaattcgacgcctg

SEQ ID NO: 106563 - DNA, 32 bp, Artificial Sequence
  Description of Artificial Sequence: Synthetic oligonucleotide
ctctggtaacaacaaagcaattcgacgcctgc

SEQ ID NO: 106564 - DNA, 34 bp, Artificial Sequence
  Description of Artificial Sequence: Synthetic oligonucleotide
tctggtaacaacaaagcaattcgacgcctgctac

SEQ ID NO: 106565 - DNA, 33 bp, Artificial Sequence
  Description of Artificial Sequence: Synthetic oligonucleotide
ctggtaacaacaaagcaattcgacgcctgctac

SEQ ID NO: 106566 - DNA, 35 bp, Artificial Sequence
  Description of Artificial Sequence: Synthetic oligonucleotide
tggtaacaacaaagcaattcgacgcctgctacatg

SEQ ID NO: 106567 - DNA, 34 bp, Artificial Sequence
  Description of Artificial Sequence: Synthetic oligonucleotide
ggtaacaacaaagcaattcgacgcctgctacatg

SEQ ID NO: 106568 - DNA, 36 bp, Artificial Sequence
  Description of Artificial Sequence: Synthetic oligonucleotide
gtaacaacaaagcaattcgacgcctgctacatgttg

SEQ ID NO: 106569 - DNA, 36 bp, Artificial Sequence
  Description of Artificial Sequence: Synthetic oligonucleotide
taacaacaaagcaattcgacgcctgctacatgttgc

SEQ ID NO: 106570 - DNA, 35 bp, Artificial Sequence
  Description of Artificial Sequence: Synthetic oligonucleotide
aacaacaaagcaattcgacgcctgctacatgttgc

SEQ ID NO: 106571 - DNA, 34 bp, Artificial Sequence
  Description of Artificial Sequence: Synthetic oligonucleotide
acaacaaagcaattcgacgcctgctacatgttgc

SEQ ID NO: 106572 - DNA, 33 bp, Artificial Sequence
  Description of Artificial Sequence: Synthetic oligonucleotide
caacaaagcaattcgacgcctgctacatgttgc

SEQ ID NO: 106573 - DNA, 34 bp, Artificial Sequence
  Description of Artificial Sequence: Synthetic oligonucleotide
aacaaagcaattcgacgcctgctacatgttgctg

SEQ ID NO: 106574 - DNA, 33 bp, Artificial Sequence
  Description of Artificial Sequence: Synthetic oligonucleotide
acaaagcaattcgacgcctgctacatgttgctg

SEQ ID NO: 106575 - DNA, 32 bp, Artificial Sequence
  Description of Artificial Sequence: Synthetic oligonucleotide
caaagcaattcgacgcctgctacatgttgctg

SEQ ID NO: 106576 - DNA, 35 bp, Artificial Sequence
  Description of Artificial Sequence: Synthetic oligonucleotide
aaagcaattcgacgcctgctacatgttgctgtaag

SEQ ID NO: 106577 - DNA, 34 bp, Artificial Sequence
  Description of Artificial Sequence: Synthetic oligonucleotide
aagcaattcgacgcctgctacatgttgctgtaag

SEQ ID NO: 106578 - DNA, 33 bp, Artificial Sequence
  Description of Artificial Sequence: Synthetic oligonucleotide
agcaattcgacgcctgctacatgttgctgtaag

SEQ ID NO: 106579 - DNA, 32 bp, Artificial Sequence
  Description of Artificial Sequence: Synthetic oligonucleotide
gcaattcgacgcctgctacatgttgctgtaag

SEQ ID NO: 106580 - DNA, 33 bp, Artificial Sequence
  Description of Artificial Sequence: Synthetic oligonucleotide
caattcgacgcctgctacatgttgctgtaagtg

SEQ ID NO: 106581 - DNA, 35 bp, Artificial Sequence
  Description of Artificial Sequence: Synthetic oligonucleotide
aattcgacgcctgctacatgttgctgtaagtgatg

SEQ ID NO: 106582 - DNA, 34 bp, Artificial Sequence
  Description of Artificial Sequence: Synthetic oligonucleotide
attcgacgcctgctacatgttgctgtaagtgatg

SEQ ID NO: 106583 - DNA, 33 bp, Artificial Sequence
  Description of Artificial Sequence: Synthetic oligonucleotide
ttcgacgcctgctacatgttgctgtaagtgatg

SEQ ID NO: 106584 - DNA, 32 bp, Artificial Sequence
  Description of Artificial Sequence: Synthetic oligonucleotide
tcgacgcctgctacatgttgctgtaagtgatg

SEQ ID NO: 106585 - DNA, 31 bp, Artificial Sequence
  Description of Artificial Sequence: Synthetic oligonucleotide
cgacgcctgctacatgttgctgtaagtgatg

SEQ ID NO: 106586 - DNA, 36 bp, Artificial Sequence
  Description of Artificial Sequence: Synthetic oligonucleotide
gacgcctgctacatgttgctgtaagtgatgttaatg

SEQ ID NO: 106587 - DNA, 38 bp, Artificial Sequence
  Description of Artificial Sequence: Synthetic oligonucleotide
acgcctgctacatgttgctgtaagtgatgttaatgatg

SEQ ID NO: 106588 - DNA, 37 bp, Artificial Sequence
  Description of Artificial Sequence: Synthetic oligonucleotide
cgcctgctacatgttgctgtaagtgatgttaatgatg

SEQ ID NO: 106589 - DNA, 39 bp, Artificial Sequence
  Description of Artificial Sequence: Synthetic oligonucleotide
gcctgctacatgttgctgtaagtgatgttaatgatgatg

SEQ ID NO: 106590 - DNA, 40 bp, Artificial Sequence
  Description of Artificial Sequence: Synthetic oligonucleotide
cctgctacatgttgctgtaagtgatgttaatgatgatgtc

SEQ ID NO: 106591 - DNA, 41 bp, Artificial Sequence
  Description of Artificial Sequence: Synthetic oligonucleotide
ctgctacatgttgctgtaagtgatgttaatgatgatgtcag

SEQ ID NO: 106592 - DNA, 41 bp, Artificial Sequence
  Description of Artificial Sequence: Synthetic oligonucleotide
tgctacatgttgctgtaagtgatgttaatgatgatgtcagg

SEQ ID NO: 106593 - DNA, 40 bp, Artificial Sequence
  Description of Artificial Sequence: Synthetic oligonucleotide
gctacatgttgctgtaagtgatgttaatgatgatgtcagg

SEQ ID NO: 106594 - DNA, 41 bp, Artificial Sequence
  Description of Artificial Sequence: Synthetic oligonucleotide
ctacatgttgctgtaagtgatgttaatgatgatgtcaggag

SEQ ID NO: 106595 - DNA, 41 bp, Artificial Sequence
  Description of Artificial Sequence: Synthetic oligonucleotide
tacatgttgctgtaagtgatgttaatgatgatgtcaggagg

SEQ ID NO: 106596 - DNA, 40 bp, Artificial Sequence
  Description of Artificial Sequence: Synthetic oligonucleotide
acatgttgctgtaagtgatgttaatgatgatgtcaggagg

SEQ ID NO: 106597 - DNA, 39 bp, Artificial Sequence
  Description of Artificial Sequence: Synthetic oligonucleotide
catgttgctgtaagtgatgttaatgatgatgtcaggagg

SEQ ID NO: 106598 - DNA, 39 bp, Artificial Sequence
  Description of Artificial Sequence: Synthetic oligonucleotide
atgttgctgtaagtgatgttaatgatgatgtcaggaggg

SEQ ID NO: 106599 - DNA, 38 bp, Artificial Sequence
  Description of Artificial Sequence: Synthetic oligonucleotide
tgttgctgtaagtgatgttaatgatgatgtcaggaggg

SEQ ID NO: 106600 - DNA, 37 bp, Artificial Sequence
  Description of Artificial Sequence: Synthetic oligonucleotide
gttgctgtaagtgatgttaatgatgatgtcaggaggg

SEQ ID NO: 106601 - DNA, 37 bp, Artificial Sequence
  Description of Artificial Sequence: Synthetic oligonucleotide
ttgctgtaagtgatgttaatgatgatgtcaggagggc

SEQ ID NO: 106602 - DNA, 36 bp, Artificial Sequence
  Description of Artificial Sequence: Synthetic oligonucleotide
tgctgtaagtgatgttaatgatgatgtcaggagggc

SEQ ID NO: 106603 - DNA, 35 bp, Artificial Sequence
  Description of Artificial Sequence: Synthetic oligonucleotide
gctgtaagtgatgttaatgatgatgtcaggagggc

SEQ ID NO: 106604 - DNA, 36 bp, Artificial Sequence
  Description of Artificial Sequence: Synthetic oligonucleotide
ctgtaagtgatgttaatgatgatgtcaggagggcag

SEQ ID NO: 106605 - DNA, 36 bp, Artificial Sequence
  Description of Artificial Sequence: Synthetic oligonucleotide
tgtaagtgatgttaatgatgatgtcaggagggcagc

SEQ ID NO: 106606 - DNA, 35 bp, Artificial Sequence
  Description of Artificial Sequence: Synthetic oligonucleotide
gtaagtgatgttaatgatgatgtcaggagggcagc

SEQ ID NO: 106607 - DNA, 36 bp, Artificial Sequence
  Description of Artificial Sequence: Synthetic oligonucleotide
taagtgatgttaatgatgatgtcaggagggcagcag

SEQ ID NO: 106608 - DNA, 35 bp, Artificial Sequence
  Description of Artificial Sequence: Synthetic oligonucleotide
aagtgatgttaatgatgatgtcaggagggcagcag

SEQ ID NO: 106609 - DNA, 34 bp, Artificial Sequence
  Description of Artificial Sequence: Synthetic oligonucleotide
agtgatgttaatgatgatgtcaggagggcagcag

SEQ ID NO: 106610 - DNA, 33 bp, Artificial Sequence
  Description of Artificial Sequence: Synthetic oligonucleotide
gtgatgttaatgatgatgtcaggagggcagcag

SEQ ID NO: 106611 - DNA, 35 bp, Artificial Sequence
  Description of Artificial Sequence: Synthetic oligonucleotide
tgatgttaatgatgatgtcaggagggcagcagtag

SEQ ID NO: 106612 - DNA, 34 bp, Artificial Sequence
  Description of Artificial Sequence: Synthetic oligonucleotide
gatgttaatgatgatgtcaggagggcagcagtag

SEQ ID NO: 106613 - DNA, 37 bp, Artificial Sequence
  Description of Artificial Sequence: Synthetic oligonucleotide
atgttaatgatgatgtcaggagggcagcagtagaatc

SEQ ID NO: 106614 - DNA, 36 bp, Artificial Sequence
  Description of Artificial Sequence: Synthetic oligonucleotide
tgttaatgatgatgtcaggagggcagcagtagaatc

SEQ ID NO: 106615 - DNA, 35 bp, Artificial Sequence
  Description of Artificial Sequence: Synthetic oligonucleotide
gttaatgatgatgtcaggagggcagcagtagaatc

SEQ ID NO: 106616 - DNA, 36 bp, Artificial Sequence
  Description of Artificial Sequence: Synthetic oligonucleotide
ttaatgatgatgtcaggagggcagcagtagaatcac

SEQ ID NO: 106617 - DNA, 35 bp, Artificial Sequence
  Description of Artificial Sequence: Synthetic oligonucleotide
taatgatgatgtcaggagggcagcagtagaatcac

SEQ ID NO: 106618 - DNA, 34 bp, Artificial Sequence
  Description of Artificial Sequence: Synthetic oligonucleotide
aatgatgatgtcaggagggcagcagtagaatcac

SEQ ID NO: 106619 - DNA, 33 bp, Artificial Sequence
  Description of Artificial Sequence: Synthetic oligonucleotide
atgatgatgtcaggagggcagcagtagaatcac

SEQ ID NO: 106620 - DNA, 32 bp, Artificial Sequence
  Description of Artificial Sequence: Synthetic oligonucleotide
tgatgatgtcaggagggcagcagtagaatcac

SEQ ID NO: 106621 - DNA, 31 bp, Artificial Sequence
  Description of Artificial Sequence: Synthetic oligonucleotide
gatgatgtcaggagggcagcagtagaatcac

SEQ ID NO: 106622 - DNA, 33 bp, Artificial Sequence
  Description of Artificial Sequence: Synthetic oligonucleotide
atgatgtcaggagggcagcagtagaatcacttg

SEQ ID NO: 106623 - DNA, 32 bp, Artificial Sequence
  Description of Artificial Sequence: Synthetic oligonucleotide
tgatgtcaggagggcagcagtagaatcacttg

SEQ ID NO: 106624 - DNA, 31 bp, Artificial Sequence
  Description of Artificial Sequence: Synthetic oligonucleotide
gatgtcaggagggcagcagtagaatcacttg

SEQ ID NO: 106625 - DNA, 31 bp, Artificial Sequence
  Description of Artificial Sequence: Synthetic oligonucleotide
atgtcaggagggcagcagtagaatcacttgg

SEQ ID NO: 106626 - DNA, 30 bp, Artificial Sequence
  Description of Artificial Sequence: Synthetic oligonucleotide
tgtcaggagggcagcagtagaatcacttgg

SEQ ID NO: 106627 - DNA, 29 bp, Artificial Sequence
  Description of Artificial Sequence: Synthetic oligonucleotide
gtcaggagggcagcagtagaatcacttgg

SEQ ID NO: 106628 - DNA, 29 bp, Artificial Sequence
  Description of Artificial Sequence: Synthetic oligonucleotide
tcaggagggcagcagtagaatcacttggg

SEQ ID NO: 106629 - DNA, 28 bp, Artificial Sequence
  Description of Artificial Sequence: Synthetic oligonucleotide
caggagggcagcagtagaatcacttggg

SEQ ID NO: 106630 - DNA, 30 bp, Artificial Sequence
  Description of Artificial Sequence: Synthetic oligonucleotide
aggagggcagcagtagaatcacttgggttc

SEQ ID NO: 106631 - DNA, 29 bp, Artificial Sequence
  Description of Artificial Sequence: Synthetic oligonucleotide
ggagggcagcagtagaatcacttgggttc

SEQ ID NO: 106632 - DNA, 32 bp, Artificial Sequence
  Description of Artificial Sequence: Synthetic oligonucleotide
gagggcagcagtagaatcacttgggttcattc

SEQ ID NO: 106633 - DNA, 36 bp, Artificial Sequence
  Description of Artificial Sequence: Synthetic oligonucleotide
agggcagcagtagaatcacttgggttcattctattc

SEQ ID NO: 106634 - DNA, 35 bp, Artificial Sequence
  Description of Artificial Sequence: Synthetic oligonucleotide
gggcagcagtagaatcacttgggttcattctattc

SEQ ID NO: 106635 - DNA, 36 bp, Artificial Sequence
  Description of Artificial Sequence: Synthetic oligonucleotide
ggcagcagtagaatcacttgggttcattctattcag

SEQ ID NO: 106636 - DNA, 38 bp, Artificial Sequence
  Description of Artificial Sequence: Synthetic oligonucleotide
gcagcagtagaatcacttgggttcattctattcagaac

SEQ ID NO: 106637 - DNA, 38 bp, Artificial Sequence
  Description of Artificial Sequence: Synthetic oligonucleotide
cagcagtagaatcacttgggttcattctattcagaacc

SEQ ID NO: 106638 - DNA, 38 bp, Artificial Sequence
  Description of Artificial Sequence: Synthetic oligonucleotide
agcagtagaatcacttgggttcattctattcagaaccc

SEQ ID NO: 106639 - DNA, 37 bp, Artificial Sequence
  Description of Artificial Sequence: Synthetic oligonucleotide
gcagtagaatcacttgggttcattctattcagaaccc

SEQ ID NO: 106640 - DNA, 37 bp, Artificial Sequence
  Description of Artificial Sequence: Synthetic oligonucleotide
cagtagaatcacttgggttcattctattcagaacccc

SEQ ID NO: 106641 - DNA, 38 bp, Artificial Sequence
  Description of Artificial Sequence: Synthetic oligonucleotide
agtagaatcacttgggttcattctattcagaacccctg

SEQ ID NO: 106642 - DNA, 37 bp, Artificial Sequence
  Description of Artificial Sequence: Synthetic oligonucleotide
gtagaatcacttgggttcattctattcagaacccctg

SEQ ID NO: 106643 - DNA, 39 bp, Artificial Sequence
  Description of Artificial Sequence: Synthetic oligonucleotide
tagaatcacttgggttcattctattcagaacccctgaac

SEQ ID NO: 106644 - DNA, 38 bp, Artificial Sequence
  Description of Artificial Sequence: Synthetic oligonucleotide
agaatcacttgggttcattctattcagaacccctgaac

SEQ ID NO: 106645 - DNA, 37 bp, Artificial Sequence
  Description of Artificial Sequence: Synthetic oligonucleotide
gaatcacttgggttcattctattcagaacccctgaac

SEQ ID NO: 106646 - DNA, 38 bp, Artificial Sequence
  Description of Artificial Sequence: Synthetic oligonucleotide
aatcacttgggttcattctattcagaacccctgaacag

SEQ ID NO: 106647 - DNA, 37 bp, Artificial Sequence
  Description of Artificial Sequence: Synthetic oligonucleotide
atcacttgggttcattctattcagaacccctgaacag

SEQ ID NO: 106648 - DNA, 36 bp, Artificial Sequence
  Description of Artificial Sequence: Synthetic oligonucleotide
tcacttgggttcattctattcagaacccctgaacag

SEQ ID NO: 106649 - DNA, 35 bp, Artificial Sequence
  Description of Artificial Sequence: Synthetic oligonucleotide
cacttgggttcattctattcagaacccctgaacag

SEQ ID NO: 106650 - DNA, 36 bp, Artificial Sequence
  Description of Artificial Sequence: Synthetic oligonucleotide
acttgggttcattctattcagaacccctgaacagtg

SEQ ID NO: 106651 - DNA, 35 bp, Artificial Sequence
  Description of Artificial Sequence: Synthetic oligonucleotide
cttgggttcattctattcagaacccctgaacagtg

SEQ ID NO: 106652 - DNA, 35 bp, Artificial Sequence
  Description of Artificial Sequence: Synthetic oligonucleotide
ttgggttcattctattcagaacccctgaacagtgc

SEQ ID NO: 106653 - DNA, 34 bp, Artificial Sequence
  Description of Artificial Sequence: Synthetic oligonucleotide
tgggttcattctattcagaacccctgaacagtgc

SEQ ID NO: 106654 - DNA, 33 bp, Artificial Sequence
  Description of Artificial Sequence: Synthetic oligonucleotide
gggttcattctattcagaacccctgaacagtgc

SEQ ID NO: 106655 - DNA, 33 bp, Artificial Sequence
  Description of Artificial Sequence: Synthetic oligonucleotide
ggttcattctattcagaacccctgaacagtgcc

SEQ ID NO: 106656 - DNA, 33 bp, Artificial Sequence
  Description of Artificial Sequence: Synthetic oligonucleotide
gttcattctattcagaacccctgaacagtgccc

SEQ ID NO: 106657 - DNA, 35 bp, Artificial Sequence
  Description of Artificial Sequence: Synthetic oligonucleotide
ttcattctattcagaacccctgaacagtgcccaag

SEQ ID NO: 106658 - DNA, 34 bp, Artificial Sequence
  Description of Artificial Sequence: Synthetic oligonucleotide
tcattctattcagaacccctgaacagtgcccaag

SEQ ID NO: 106659 - DNA, 33 bp, Artificial Sequence
  Description of Artificial Sequence: Synthetic oligonucleotide
cattctattcagaacccctgaacagtgcccaag

SEQ ID NO: 106660 - DNA, 34 bp, Artificial Sequence
  Description of Artificial Sequence: Synthetic oligonucleotide
attctattcagaacccctgaacagtgcccaagtg

SEQ ID NO: 106661 - DNA, 33 bp, Artificial Sequence
  Description of Artificial Sequence: Synthetic oligonucleotide
ttctattcagaacccctgaacagtgcccaagtg

SEQ ID NO: 106662 - DNA, 32 bp, Artificial Sequence
  Description of Artificial Sequence: Synthetic oligonucleotide
tctattcagaacccctgaacagtgcccaagtg

SEQ ID NO: 106663 - DNA, 31 bp, Artificial Sequence
  Description of Artificial Sequence: Synthetic oligonucleotide
ctattcagaacccctgaacagtgcccaagtg

SEQ ID NO: 106664 - DNA, 33 bp, Artificial Sequence
  Description of Artificial Sequence: Synthetic oligonucleotide
tattcagaacccctgaacagtgcccaagtgttg

SEQ ID NO: 106665 - DNA, 32 bp, Artificial Sequence
  Description of Artificial Sequence: Synthetic oligonucleotide
attcagaacccctgaacagtgcccaagtgttg

SEQ ID NO: 106666 - DNA, 31 bp, Artificial Sequence
  Description of Artificial Sequence: Synthetic oligonucleotide
ttcagaacccctgaacagtgcccaagtgttg

SEQ ID NO: 106667 - DNA, 30 bp, Artificial Sequence
  Description of Artificial Sequence: Synthetic oligonucleotide
tcagaacccctgaacagtgcccaagtgttg

SEQ ID NO: 106668 - DNA, 29 bp, Artificial Sequence
  Description of Artificial Sequence: Synthetic oligonucleotide
cagaacccctgaacagtgcccaagtgttg

SEQ ID NO: 106669 - DNA, 30 bp, Artificial Sequence
  Description of Artificial Sequence: Synthetic oligonucleotide
agaacccctgaacagtgcccaagtgttgtc

SEQ ID NO: 106670 - DNA, 29 bp, Artificial Sequence
  Description of Artificial Sequence: Synthetic oligonucleotide
gaacccctgaacagtgcccaagtgttgtc

SEQ ID NO: 106671 - DNA, 30 bp, Artificial Sequence
  Description of Artificial Sequence: Synthetic oligonucleotide
aacccctgaacagtgcccaagtgttgtctc

SEQ ID NO: 106672 - DNA, 29 bp, Artificial Sequence
  Description of Artificial Sequence: Synthetic oligonucleotide
acccctgaacagtgcccaagtgttgtctc

SEQ ID NO: 106673 - DNA, 28 bp, Artificial Sequence
  Description of Artificial Sequence: Synthetic oligonucleotide
cccctgaacagtgcccaagtgttgtctc

SEQ ID NO: 106674 - DNA, 31 bp, Artificial Sequence
  Description of Artificial Sequence: Synthetic oligonucleotide
ccctgaacagtgcccaagtgttgtctctttg

SEQ ID NO: 106675 - DNA, 33 bp, Artificial Sequence
  Description of Artificial Sequence: Synthetic oligonucleotide
cctgaacagtgcccaagtgttgtctctttgttg

SEQ ID NO: 106676 - DNA, 34 bp, Artificial Sequence
  Description of Artificial Sequence: Synthetic oligonucleotide
ctgaacagtgcccaagtgttgtctctttgttgtc

SEQ ID NO: 106677 - DNA, 35 bp, Artificial Sequence
  Description of Artificial Sequence: Synthetic oligonucleotide
tgaacagtgcccaagtgttgtctctttgttgtcag

SEQ ID NO: 106678 - DNA, 34 bp, Artificial Sequence
  Description of Artificial Sequence: Synthetic oligonucleotide
gaacagtgcccaagtgttgtctctttgttgtcag

SEQ ID NO: 106679 - DNA, 35 bp, Artificial Sequence
  Description of Artificial Sequence: Synthetic oligonucleotide
aacagtgcccaagtgttgtctctttgttgtcagag

SEQ ID NO: 106680 - DNA, 34 bp, Artificial Sequence
  Description of Artificial Sequence: Synthetic oligonucleotide
acagtgcccaagtgttgtctctttgttgtcagag

SEQ ID NO: 106681 - DNA, 33 bp, Artificial Sequence
  Description of Artificial Sequence: Synthetic oligonucleotide
cagtgcccaagtgttgtctctttgttgtcagag

SEQ ID NO: 106682 - DNA, 34 bp, Artificial Sequence
  Description of Artificial Sequence: Synthetic oligonucleotide
agtgcccaagtgttgtctctttgttgtcagagag

SEQ ID NO: 106683 - DNA, 33 bp, Artificial Sequence
  Description of Artificial Sequence: Synthetic oligonucleotide
gtgcccaagtgttgtctctttgttgtcagagag

SEQ ID NO: 106684 - DNA, 36 bp, Artificial Sequence
  Description of Artificial Sequence: Synthetic oligonucleotide
tgcccaagtgttgtctctttgttgtcagagagttac

SEQ ID NO: 106685 - DNA, 35 bp, Artificial Sequence
  Description of Artificial Sequence: Synthetic oligonucleotide
gcccaagtgttgtctctttgttgtcagagagttac

SEQ ID NO: 106686 - DNA, 37 bp, Artificial Sequence
  Description of Artificial Sequence: Synthetic oligonucleotide
cccaagtgttgtctctttgttgtcagagagttacaac

SEQ ID NO: 106687 - DNA, 37 bp, Artificial Sequence
  Description of Artificial Sequence: Synthetic oligonucleotide
ccaagtgttgtctctttgttgtcagagagttacaacc

SEQ ID NO: 106688 - DNA, 37 bp, Artificial Sequence
  Description of Artificial Sequence: Synthetic oligonucleotide
caagtgttgtctctttgttgtcagagagttacaaccc

SEQ ID NO: 106689 - DNA, 38 bp, Artificial Sequence
  Description of Artificial Sequence: Synthetic oligonucleotide
aagtgttgtctctttgttgtcagagagttacaaccctc

SEQ ID NO: 106690 - DNA, 37 bp, Artificial Sequence
  Description of Artificial Sequence: Synthetic oligonucleotide
agtgttgtctctttgttgtcagagagttacaaccctc

SEQ ID NO: 106691 - DNA, 36 bp, Artificial Sequence
  Description of Artificial Sequence: Synthetic oligonucleotide
gtgttgtctctttgttgtcagagagttacaaccctc

SEQ ID NO: 106692 - DNA, 38 bp, Artificial Sequence
  Description of Artificial Sequence: Synthetic oligonucleotide
tgttgtctctttgttgtcagagagttacaaccctcatg

SEQ ID NO: 106693 - DNA, 37 bp, Artificial Sequence
  Description of Artificial Sequence: Synthetic oligonucleotide
gttgtctctttgttgtcagagagttacaaccctcatg

SEQ ID NO: 106694 - DNA, 38 bp, Artificial Sequence
  Description of Artificial Sequence: Synthetic oligonucleotide
ttgtctctttgttgtcagagagttacaaccctcatgtg

SEQ ID NO: 106695 - DNA, 37 bp, Artificial Sequence
  Description of Artificial Sequence: Synthetic oligonucleotide
tgtctctttgttgtcagagagttacaaccctcatgtg

SEQ ID NO: 106696 - DNA, 36 bp, Artificial Sequence
  Description of Artificial Sequence: Synthetic oligonucleotide
gtctctttgttgtcagagagttacaaccctcatgtg

SEQ ID NO: 106697 - DNA, 36 bp, Artificial Sequence
  Description of Artificial Sequence: Synthetic oligonucleotide
tctctttgttgtcagagagttacaaccctcatgtgc

SEQ ID NO: 106698 - DNA, 35 bp, Artificial Sequence
  Description of Artificial Sequence: Synthetic oligonucleotide
ctctttgttgtcagagagttacaaccctcatgtgc

SEQ ID NO: 106699 - DNA, 35 bp, Artificial Sequence
  Description of Artificial Sequence: Synthetic oligonucleotide
tctttgttgtcagagagttacaaccctcatgtgcg

SEQ ID NO: 106700 - DNA, 34 bp, Artificial Sequence
  Description of Artificial Sequence: Synthetic oligonucleotide
ctttgttgtcagagagttacaaccctcatgtgcg

SEQ ID NO: 106701 - DNA, 34 bp, Artificial Sequence
  Description of Artificial Sequence: Synthetic oligonucleotide
tttgttgtcagagagttacaaccctcatgtgcgc

SEQ ID NO: 106702 - DNA, 33 bp, Artificial Sequence
  Description of Artificial Sequence: Synthetic oligonucleotide
ttgttgtcagagagttacaaccctcatgtgcgc

SEQ ID NO: 106703 - DNA, 32 bp, Artificial Sequence
  Description of Artificial Sequence: Synthetic oligonucleotide
tgttgtcagagagttacaaccctcatgtgcgc

SEQ ID NO: 106704 - DNA, 31 bp, Artificial Sequence
  Description of Artificial Sequence: Synthetic oligonucleotide
gttgtcagagagttacaaccctcatgtgcgc

SEQ ID NO: 106705 - DNA, 33 bp, Artificial Sequence
  Description of Artificial Sequence: Synthetic oligonucleotide
ttgtcagagagttacaaccctcatgtgcgctac

SEQ ID NO: 106706 - DNA, 32 bp, Artificial Sequence
  Description of Artificial Sequence: Synthetic oligonucleotide
tgtcagagagttacaaccctcatgtgcgctac

SEQ ID NO: 106707 - DNA, 31 bp, Artificial Sequence
  Description of Artificial Sequence: Synthetic oligonucleotide
gtcagagagttacaaccctcatgtgcgctac

SEQ ID NO: 106708 - DNA, 31 bp, Artificial Sequence
  Description of Artificial Sequence: Synthetic oligonucleotide
tcagagagttacaaccctcatgtgcgctacg

SEQ ID NO: 106709 - DNA, 30 bp, Artificial Sequence
  Description of Artificial Sequence: Synthetic oligonucleotide
cagagagttacaaccctcatgtgcgctacg

SEQ ID NO: 106710 - DNA, 30 bp, Artificial Sequence
  Description of Artificial Sequence: Synthetic oligonucleotide
agagagttacaaccctcatgtgcgctacgg

SEQ ID NO: 106711 - DNA, 29 bp, Artificial Sequence
  Description of Artificial Sequence: Synthetic oligonucleotide
gagagttacaaccctcatgtgcgctacgg

SEQ ID NO: 106712 - DNA, 30 bp, Artificial Sequence
  Description of Artificial Sequence: Synthetic oligonucleotide
agagttacaaccctcatgtgcgctacggag

SEQ ID NO: 106713 - DNA, 29 bp, Artificial Sequence
  Description of Artificial Sequence: Synthetic oligonucleotide
gagttacaaccctcatgtgcgctacggag

SEQ ID NO: 106714 - DNA, 29 bp, Artificial Sequence
  Description of Artificial Sequence: Synthetic oligonucleotide
agttacaaccctcatgtgcgctacggagc

SEQ ID NO: 106715 - DNA, 28 bp, Artificial Sequence
  Description of Artificial Sequence: Synthetic oligonucleotide
gttacaaccctcatgtgcgctacggagc

SEQ ID NO: 106716 - DNA, 29 bp, Artificial Sequence
  Description of Artificial Sequence: Synthetic oligonucleotide
ttacaaccctcatgtgcgctacggagctg

SEQ ID NO: 106717 - DNA, 28 bp, Artificial Sequence
  Description of Artificial Sequence: Synthetic oligonucleotide
tacaaccctcatgtgcgctacggagctg

SEQ ID NO: 106718 - DNA, 27 bp, Artificial Sequence
  Description of Artificial Sequence: Synthetic oligonucleotide
acaaccctcatgtgcgctacggagctg

SEQ ID NO: 106719 - DNA, 26 bp, Artificial Sequence
  Description of Artificial Sequence: Synthetic oligonucleotide
caaccctcatgtgcgctacggagctg

SEQ ID NO: 106720 - DNA, 27 bp, Artificial Sequence
  Description of Artificial Sequence: Synthetic oligonucleotide
aaccctcatgtgcgctacggagctgca

SEQ ID NO: 106721 - DNA, 27 bp, Artificial Sequence
  Description of Artificial Sequence: Synthetic oligonucleotide
accctcatgtgcgctacggagctgcaa

SEQ ID NO: 106722 - DNA, 27 bp, Artificial Sequence
  Description of Artificial Sequence: Synthetic oligonucleotide
ccctcatgtgcgctacggagctgcaat

SEQ ID NO: 106723 - DNA, 27 bp, Artificial Sequence
  Description of Artificial Sequence: Synthetic oligonucleotide
cctcatgtgcgctacggagctgcaatg

SEQ ID NO: 106724 - DNA, 27 bp, Artificial Sequence
  Description of Artificial Sequence: Synthetic oligonucleotide
ctcatgtgcgctacggagctgcaatgg

SEQ ID NO: 106725 - DNA, 27 bp, Artificial Sequence
  Description of Artificial Sequence: Synthetic oligonucleotide
tcatgtgcgctacggagctgcaatggc

SEQ ID NO: 106726 - DNA, 26 bp, Artificial Sequence
  Description of Artificial Sequence: Synthetic oligonucleotide
catgtgcgctacggagctgcaatggc

SEQ ID NO: 106727 - DNA, 27 bp, Artificial Sequence
  Description of Artificial Sequence: Synthetic oligonucleotide
atgtgcgctacggagctgcaatggcct

SEQ ID NO: 106728 - DNA, 27 bp, Artificial Sequence
  Description of Artificial Sequence: Synthetic oligonucleotide
tgtgcgctacggagctgcaatggcctt

SEQ ID NO: 106729 - DNA, 26 bp, Artificial Sequence
  Description of Artificial Sequence: Synthetic oligonucleotide
gtgcgctacggagctgcaatggcctt

SEQ ID NO: 106730 - DNA, 26 bp, Artificial Sequence
  Description of Artificial Sequence: Synthetic oligonucleotide
tgcgctacggagctgcaatggccttg

SEQ ID NO: 106731 - DNA, 25 bp, Artificial Sequence
  Description of Artificial Sequence: Synthetic oligonucleotide
gcgctacggagctgcaatggccttg

SEQ ID NO: 106732 - DNA, 25 bp, Artificial Sequence
  Description of Artificial Sequence: Synthetic oligonucleotide
cgctacggagctgcaatggccttgg

SEQ ID NO: 106733 - DNA, 25 bp, Artificial Sequence
  Description of Artificial Sequence: Synthetic oligonucleotide
gctacggagctgcaatggccttggg

SEQ ID NO: 106734 - DNA, 27 bp, Artificial Sequence
  Description of Artificial Sequence: Synthetic oligonucleotide
ctacggagctgcaatggccttggggat

SEQ ID NO: 106735 - DNA, 29 bp, Artificial Sequence
  Description of Artificial Sequence: Synthetic oligonucleotide
tacggagctgcaatggccttggggatatg

SEQ ID NO: 106736 - DNA, 28 bp, Artificial Sequence
  Description of Artificial Sequence: Synthetic oligonucleotide
acggagctgcaatggccttggggatatg

SEQ ID NO: 106737 - DNA, 27 bp, Artificial Sequence
  Description of Artificial Sequence: Synthetic oligonucleotide
cggagctgcaatggccttggggatatg

SEQ ID NO: 106738 - DNA, 27 bp, Artificial Sequence
  Description of Artificial Sequence: Synthetic oligonucleotide
ggagctgcaatggccttggggatatgc

SEQ ID NO: 106739 - DNA, 28 bp, Artificial Sequence
  Description of Artificial Sequence: Synthetic oligonucleotide
gagctgcaatggccttggggatatgctg

SEQ ID NO: 106740 - DNA, 29 bp, Artificial Sequence
  Description of Artificial Sequence: Synthetic oligonucleotide
agctgcaatggccttggggatatgctgtg

SEQ ID NO: 106741 - DNA, 28 bp, Artificial Sequence
  Description of Artificial Sequence: Synthetic oligonucleotide
gctgcaatggccttggggatatgctgtg

SEQ ID NO: 106742 - DNA, 28 bp, Artificial Sequence
  Description of Artificial Sequence: Synthetic oligonucleotide
ctgcaatggccttggggatatgctgtgc

SEQ ID NO: 106743 - DNA, 29 bp, Artificial Sequence
  Description of Artificial Sequence: Synthetic oligonucleotide
tgcaatggccttggggatatgctgtgctg

SEQ ID NO: 106744 - DNA, 28 bp, Artificial Sequence
  Description of Artificial Sequence: Synthetic oligonucleotide
gcaatggccttggggatatgctgtgctg

SEQ ID NO: 106745 - DNA, 28 bp, Artificial Sequence
  Description of Artificial Sequence: Synthetic oligonucleotide
caatggccttggggatatgctgtgctgg

SEQ ID NO: 106746 - DNA, 30 bp, Artificial Sequence
  Description of Artificial Sequence: Synthetic oligonucleotide
aatggccttggggatatgctgtgctggtac

SEQ ID NO: 106747 - DNA, 29 bp, Artificial Sequence
  Description of Artificial Sequence: Synthetic oligonucleotide
atggccttggggatatgctgtgctggtac

SEQ ID NO: 106748 - DNA, 28 bp, Artificial Sequence
  Description of Artificial Sequence: Synthetic oligonucleotide
tggccttggggatatgctgtgctggtac

SEQ ID NO: 106749 - DNA, 27 bp, Artificial Sequence
  Description of Artificial Sequence: Synthetic oligonucleotide
ggccttggggatatgctgtgctggtac

SEQ ID NO: 106750 - DNA, 28 bp, Artificial Sequence
  Description of Artificial Sequence: Synthetic oligonucleotide
gccttggggatatgctgtgctggtacag

SEQ ID NO: 106751 - DNA, 28 bp, Artificial Sequence
  Description of Artificial Sequence: Synthetic oligonucleotide
ccttggggatatgctgtgctggtacagg

SEQ ID NO: 106752 - DNA, 31 bp, Artificial Sequence
  Description of Artificial Sequence: Synthetic oligonucleotide
cttggggatatgctgtgctggtacaggaaac

SEQ ID NO: 106753 - DNA, 33 bp, Artificial Sequence
  Description of Artificial Sequence: Synthetic oligonucleotide
ttggggatatgctgtgctggtacaggaaacaag

SEQ ID NO: 106754 - DNA, 32 bp, Artificial Sequence
  Description of Artificial Sequence: Synthetic oligonucleotide
tggggatatgctgtgctggtacaggaaacaag

SEQ ID NO: 106755 - DNA, 31 bp, Artificial Sequence
  Description of Artificial Sequence: Synthetic oligonucleotide
ggggatatgctgtgctggtacaggaaacaag

SEQ ID NO: 106756 - DNA, 31 bp, Artificial Sequence
  Description of Artificial Sequence: Synthetic oligonucleotide
gggatatgctgtgctggtacaggaaacaagg

SEQ ID NO: 106757 - DNA, 33 bp, Artificial Sequence
  Description of Artificial Sequence: Synthetic oligonucleotide
ggatatgctgtgctggtacaggaaacaaggaag

SEQ ID NO: 106758 - DNA, 33 bp, Artificial Sequence
  Description of Artificial Sequence: Synthetic oligonucleotide
gatatgctgtgctggtacaggaaacaaggaagc

SEQ ID NO: 106759 - DNA, 33 bp, Artificial Sequence
  Description of Artificial Sequence: Synthetic oligonucleotide
atatgctgtgctggtacaggaaacaaggaagcc

SEQ ID NO: 106760 - DNA, 32 bp, Artificial Sequence
  Description of Artificial Sequence: Synthetic oligonucleotide
tatgctgtgctggtacaggaaacaaggaagcc

SEQ ID NO: 106761 - DNA, 31 bp, Artificial Sequence
  Description of Artificial Sequence: Synthetic oligonucleotide
atgctgtgctggtacaggaaacaaggaagcc

SEQ ID NO: 106762 - DNA, 30 bp, Artificial Sequence
  Description of Artificial Sequence: Synthetic oligonucleotide
tgctgtgctggtacaggaaacaaggaagcc

SEQ ID NO: 106763 - DNA, 29 bp, Artificial Sequence
  Description of Artificial Sequence: Synthetic oligonucleotide
gctgtgctggtacaggaaacaaggaagcc

SEQ ID NO: 106764 - DNA, 37 bp, Artificial Sequence
  Description of Artificial Sequence: Synthetic oligonucleotide
ctgtgctggtacaggaaacaaggaagccattaatttg

SEQ ID NO: 106765 - DNA, 37 bp, Artificial Sequence
  Description of Artificial Sequence: Synthetic oligonucleotide
tgtgctggtacaggaaacaaggaagccattaatttgc

SEQ ID NO: 106766 - DNA, 36 bp, Artificial Sequence
  Description of Artificial Sequence: Synthetic oligonucleotide
gtgctggtacaggaaacaaggaagccattaatttgc

SEQ ID NO: 106767 - DNA, 38 bp, Artificial Sequence
  Description of Artificial Sequence: Synthetic oligonucleotide
tgctggtacaggaaacaaggaagccattaatttgctag

SEQ ID NO: 106768 - DNA, 37 bp, Artificial Sequence
  Description of Artificial Sequence: Synthetic oligonucleotide
gctggtacaggaaacaaggaagccattaatttgctag

SEQ ID NO: 106769 - DNA, 39 bp, Artificial Sequence
  Description of Artificial Sequence: Synthetic oligonucleotide
ctggtacaggaaacaaggaagccattaatttgctagaac

SEQ ID NO: 106770 - DNA, 39 bp, Artificial Sequence
  Description of Artificial Sequence: Synthetic oligonucleotide
tggtacaggaaacaaggaagccattaatttgctagaacc

SEQ ID NO: 106771 - DNA, 38 bp, Artificial Sequence
  Description of Artificial Sequence: Synthetic oligonucleotide
ggtacaggaaacaaggaagccattaatttgctagaacc

SEQ ID NO: 106772 - DNA, 41 bp, Artificial Sequence
  Description of Artificial Sequence: Synthetic oligonucleotide
gtacaggaaacaaggaagccattaatttgctagaaccaatg

SEQ ID NO: 106773 - DNA, 42 bp, Artificial Sequence
  Description of Artificial Sequence: Synthetic oligonucleotide
tacaggaaacaaggaagccattaatttgctagaaccaatgac

SEQ ID NO: 106774 - DNA, 41 bp, Artificial Sequence
  Description of Artificial Sequence: Synthetic oligonucleotide
acaggaaacaaggaagccattaatttgctagaaccaatgac

SEQ ID NO: 106775 - DNA, 40 bp, Artificial Sequence
  Description of Artificial Sequence: Synthetic oligonucleotide
caggaaacaaggaagccattaatttgctagaaccaatgac

SEQ ID NO: 106776 - DNA, 43 bp, Artificial Sequence
  Description of Artificial Sequence: Synthetic oligonucleotide
aggaaacaaggaagccattaatttgctagaaccaatgacaaac

SEQ ID NO: 106777 - DNA, 42 bp, Artificial Sequence
  Description of Artificial Sequence: Synthetic oligonucleotide
ggaaacaaggaagccattaatttgctagaaccaatgacaaac

SEQ ID NO: 106778 - DNA, 42 bp, Artificial Sequence
  Description of Artificial Sequence: Synthetic oligonucleotide
gaaacaaggaagccattaatttgctagaaccaatgacaaacg

SEQ ID NO: 106779 - DNA, 43 bp, Artificial Sequence
  Description of Artificial Sequence: Synthetic oligonucleotide
aaacaaggaagccattaatttgctagaaccaatgacaaacgac

SEQ ID NO: 106780 - DNA, 42 bp, Artificial Sequence
  Description of Artificial Sequence: Synthetic oligonucleotide
aacaaggaagccattaatttgctagaaccaatgacaaacgac

SEQ ID NO: 106781 - DNA, 41 bp, Artificial Sequence
  Description of Artificial Sequence: Synthetic oligonucleotide
acaaggaagccattaatttgctagaaccaatgacaaacgac

SEQ ID NO: 106782 - DNA, 40 bp, Artificial Sequence
  Description of Artificial Sequence: Synthetic oligonucleotide
caaggaagccattaatttgctagaaccaatgacaaacgac

SEQ ID NO: 106783 - DNA, 40 bp, Artificial Sequence
  Description of Artificial Sequence: Synthetic oligonucleotide
aaggaagccattaatttgctagaaccaatgacaaacgacc

SEQ ID NO: 106784 - DNA, 39 bp, Artificial Sequence
  Description of Artificial Sequence: Synthetic oligonucleotide
aggaagccattaatttgctagaaccaatgacaaacgacc

SEQ ID NO: 106785 - DNA, 38 bp, Artificial Sequence
  Description of Artificial Sequence: Synthetic oligonucleotide
ggaagccattaatttgctagaaccaatgacaaacgacc

SEQ ID NO: 106786 - DNA, 38 bp, Artificial Sequence
  Description of Artificial Sequence: Synthetic oligonucleotide
gaagccattaatttgctagaaccaatgacaaacgaccc

SEQ ID NO: 106787 - DNA, 38 bp, Artificial Sequence
  Description of Artificial Sequence: Synthetic oligonucleotide
aagccattaatttgctagaaccaatgacaaacgacccc

SEQ ID NO: 106788 - DNA, 37 bp, Artificial Sequence
  Description of Artificial Sequence: Synthetic oligonucleotide
agccattaatttgctagaaccaatgacaaacgacccc

SEQ ID NO: 106789 - DNA, 36 bp, Artificial Sequence
  Description of Artificial Sequence: Synthetic oligonucleotide
gccattaatttgctagaaccaatgacaaacgacccc

SEQ ID NO: 106790 - DNA, 36 bp, Artificial Sequence
  Description of Artificial Sequence: Synthetic oligonucleotide
ccattaatttgctagaaccaatgacaaacgaccccg

SEQ ID NO: 106791 - DNA, 37 bp, Artificial Sequence
  Description of Artificial Sequence: Synthetic oligonucleotide
cattaatttgctagaaccaatgacaaacgaccccgtg

SEQ ID NO: 106792 - DNA, 39 bp, Artificial Sequence
  Description of Artificial Sequence: Synthetic oligonucleotide
attaatttgctagaaccaatgacaaacgaccccgtgaac

SEQ ID NO: 106793 - DNA, 38 bp, Artificial Sequence
  Description of Artificial Sequence: Synthetic oligonucleotide
ttaatttgctagaaccaatgacaaacgaccccgtgaac

SEQ ID NO: 106794 - DNA, 37 bp, Artificial Sequence
  Description of Artificial Sequence: Synthetic oligonucleotide
taatttgctagaaccaatgacaaacgaccccgtgaac

SEQ ID NO: 106795 - DNA, 36 bp, Artificial Sequence
  Description of Artificial Sequence: Synthetic oligonucleotide
aatttgctagaaccaatgacaaacgaccccgtgaac

SEQ ID NO: 106796 - DNA, 35 bp, Artificial Sequence
  Description of Artificial Sequence: Synthetic oligonucleotide
atttgctagaaccaatgacaaacgaccccgtgaac

SEQ ID NO: 106797 - DNA, 34 bp, Artificial Sequence
  Description of Artificial Sequence: Synthetic oligonucleotide
tttgctagaaccaatgacaaacgaccccgtgaac

SEQ ID NO: 106798 - DNA, 33 bp, Artificial Sequence
  Description of Artificial Sequence: Synthetic oligonucleotide
ttgctagaaccaatgacaaacgaccccgtgaac

SEQ ID NO: 106799 - DNA, 32 bp, Artificial Sequence
  Description of Artificial Sequence: Synthetic oligonucleotide
tgctagaaccaatgacaaacgaccccgtgaac

SEQ ID NO: 106800 - DNA, 31 bp, Artificial Sequence
  Description of Artificial Sequence: Synthetic oligonucleotide
gctagaaccaatgacaaacgaccccgtgaac

SEQ ID NO: 106801 - DNA, 33 bp, Artificial Sequence
  Description of Artificial Sequence: Synthetic oligonucleotide
ctagaaccaatgacaaacgaccccgtgaactac

SEQ ID NO: 106802 - DNA, 33 bp, Artificial Sequence
  Description of Artificial Sequence: Synthetic oligonucleotide
tagaaccaatgacaaacgaccccgtgaactacg

SEQ ID NO: 106803 - DNA, 32 bp, Artificial Sequence
  Description of Artificial Sequence: Synthetic oligonucleotide
agaaccaatgacaaacgaccccgtgaactacg

SEQ ID NO: 106804 - DNA, 31 bp, Artificial Sequence
  Description of Artificial Sequence: Synthetic oligonucleotide
gaaccaatgacaaacgaccccgtgaactacg

SEQ ID NO: 106805 - DNA, 32 bp, Artificial Sequence
  Description of Artificial Sequence: Synthetic oligonucleotide
aaccaatgacaaacgaccccgtgaactacgtg

SEQ ID NO: 106806 - DNA, 31 bp, Artificial Sequence
  Description of Artificial Sequence: Synthetic oligonucleotide
accaatgacaaacgaccccgtgaactacgtg

SEQ ID NO: 106807 - DNA, 30 bp, Artificial Sequence
  Description of Artificial Sequence: Synthetic oligonucleotide
ccaatgacaaacgaccccgtgaactacgtg

SEQ ID NO: 106808 - DNA, 31 bp, Artificial Sequence
  Description of Artificial Sequence: Synthetic oligonucleotide
caatgacaaacgaccccgtgaactacgtgag

SEQ ID NO: 106809 - DNA, 31 bp, Artificial Sequence
  Description of Artificial Sequence: Synthetic oligonucleotide
aatgacaaacgaccccgtgaactacgtgagg

SEQ ID NO: 106810 - DNA, 30 bp, Artificial Sequence
  Description of Artificial Sequence: Synthetic oligonucleotide
atgacaaacgaccccgtgaactacgtgagg

SEQ ID NO: 106811 - DNA, 29 bp, Artificial Sequence
  Description of Artificial Sequence: Synthetic oligonucleotide
tgacaaacgaccccgtgaactacgtgagg

SEQ ID NO: 106812 - DNA, 28 bp, Artificial Sequence
  Description of Artificial Sequence: Synthetic oligonucleotide
gacaaacgaccccgtgaactacgtgagg

SEQ ID NO: 106813 - DNA, 28 bp, Artificial Sequence
  Description of Artificial Sequence: Synthetic oligonucleotide
acaaacgaccccgtgaactacgtgaggc

SEQ ID NO: 106814 - DNA, 27 bp, Artificial Sequence
  Description of Artificial Sequence: Synthetic oligonucleotide
caaacgaccccgtgaactacgtgaggc

SEQ ID NO: 106815 - DNA, 29 bp, Artificial Sequence
  Description of Artificial Sequence: Synthetic oligonucleotide
aaacgaccccgtgaactacgtgaggcaag

SEQ ID NO: 106816 - DNA, 28 bp, Artificial Sequence
  Description of Artificial Sequence: Synthetic oligonucleotide
aacgaccccgtgaactacgtgaggcaag

SEQ ID NO: 106817 - DNA, 27 bp, Artificial Sequence
  Description of Artificial Sequence: Synthetic oligonucleotide
acgaccccgtgaactacgtgaggcaag

SEQ ID NO: 106818 - DNA, 26 bp, Artificial Sequence
  Description of Artificial Sequence: Synthetic oligonucleotide
cgaccccgtgaactacgtgaggcaag

SEQ ID NO: 106819 - DNA, 26 bp, Artificial Sequence
  Description of Artificial Sequence: Synthetic oligonucleotide
gaccccgtgaactacgtgaggcaagg

SEQ ID NO: 106820 - DNA, 26 bp, Artificial Sequence
  Description of Artificial Sequence: Synthetic oligonucleotide
accccgtgaactacgtgaggcaaggg

SEQ ID NO: 106821 - DNA, 25 bp, Artificial Sequence
  Description of Artificial Sequence: Synthetic oligonucleotide
ccccgtgaactacgtgaggcaaggg

SEQ ID NO: 106822 - DNA, 25 bp, Artificial Sequence
  Description of Artificial Sequence: Synthetic oligonucleotide
cccgtgaactacgtgaggcaagggg

SEQ ID NO: 106823 - DNA, 26 bp, Artificial Sequence
  Description of Artificial Sequence: Synthetic oligonucleotide
ccgtgaactacgtgaggcaaggggca

SEQ ID NO: 106824 - DNA, 27 bp, Artificial Sequence
  Description of Artificial Sequence: Synthetic oligonucleotide
cgtgaactacgtgaggcaaggggcact

SEQ ID NO: 106825 - DNA, 27 bp, Artificial Sequence
  Description of Artificial Sequence: Synthetic oligonucleotide
gtgaactacgtgaggcaaggggcactc

SEQ ID NO: 106826 - DNA, 30 bp, Artificial Sequence
  Description of Artificial Sequence: Synthetic oligonucleotide
tgaactacgtgaggcaaggggcactcatag

SEQ ID NO: 106827 - DNA, 29 bp, Artificial Sequence
  Description of Artificial Sequence: Synthetic oligonucleotide
gaactacgtgaggcaaggggcactcatag

SEQ ID NO: 106828 - DNA, 29 bp, Artificial Sequence
  Description of Artificial Sequence: Synthetic oligonucleotide
aactacgtgaggcaaggggcactcatagc

SEQ ID NO: 106829 - DNA, 28 bp, Artificial Sequence
  Description of Artificial Sequence: Synthetic oligonucleotide
actacgtgaggcaaggggcactcatagc

SEQ ID NO: 106830 - DNA, 27 bp, Artificial Sequence
  Description of Artificial Sequence: Synthetic oligonucleotide
ctacgtgaggcaaggggcactcatagc

SEQ ID NO: 106831 - DNA, 29 bp, Artificial Sequence
  Description of Artificial Sequence: Synthetic oligonucleotide
tacgtgaggcaaggggcactcatagcttc

SEQ ID NO: 106832 - DNA, 28 bp, Artificial Sequence
  Description of Artificial Sequence: Synthetic oligonucleotide
acgtgaggcaaggggcactcatagcttc

SEQ ID NO: 106833 - DNA, 27 bp, Artificial Sequence
  Description of Artificial Sequence: Synthetic oligonucleotide
cgtgaggcaaggggcactcatagcttc

SEQ ID NO: 106834 - DNA, 28 bp, Artificial Sequence
  Description of Artificial Sequence: Synthetic oligonucleotide
gtgaggcaaggggcactcatagcttcag

SEQ ID NO: 106835 - DNA, 28 bp, Artificial Sequence
  Description of Artificial Sequence: Synthetic oligonucleotide
tgaggcaaggggcactcatagcttcagc

SEQ ID NO: 106836 - DNA, 27 bp, Artificial Sequence
  Description of Artificial Sequence: Synthetic oligonucleotide
gaggcaaggggcactcatagcttcagc

SEQ ID NO: 106837 - DNA, 28 bp, Artificial Sequence
  Description of Artificial Sequence: Synthetic oligonucleotide
aggcaaggggcactcatagcttcagctc

SEQ ID NO: 106838 - DNA, 27 bp, Artificial Sequence
  Description of Artificial Sequence: Synthetic oligonucleotide
ggcaaggggcactcatagcttcagctc

SEQ ID NO: 106839 - DNA, 28 bp, Artificial Sequence
  Description of Artificial Sequence: Synthetic oligonucleotide
gcaaggggcactcatagcttcagctctc

SEQ ID NO: 106840 - DNA, 30 bp, Artificial Sequence
  Description of Artificial Sequence: Synthetic oligonucleotide
caaggggcactcatagcttcagctctcatc

SEQ ID NO: 106841 - DNA, 32 bp, Artificial Sequence
  Description of Artificial Sequence: Synthetic oligonucleotide
aaggggcactcatagcttcagctctcatcatg

SEQ ID NO: 106842 - DNA, 31 bp, Artificial Sequence
  Description of Artificial Sequence: Synthetic oligonucleotide
aggggcactcatagcttcagctctcatcatg

SEQ ID NO: 106843 - DNA, 30 bp, Artificial Sequence
  Description of Artificial Sequence: Synthetic oligonucleotide
ggggcactcatagcttcagctctcatcatg

SEQ ID NO: 106844 - DNA, 32 bp, Artificial Sequence
  Description of Artificial Sequence: Synthetic oligonucleotide
gggcactcatagcttcagctctcatcatgatc

SEQ ID NO: 106845 - DNA, 32 bp, Artificial Sequence
  Description of Artificial Sequence: Synthetic oligonucleotide
ggcactcatagcttcagctctcatcatgatcc

SEQ ID NO: 106846 - DNA, 33 bp, Artificial Sequence
  Description of Artificial Sequence: Synthetic oligonucleotide
gcactcatagcttcagctctcatcatgatccag

SEQ ID NO: 106847 - DNA, 33 bp, Artificial Sequence
  Description of Artificial Sequence: Synthetic oligonucleotide
cactcatagcttcagctctcatcatgatccagc

SEQ ID NO: 106848 - DNA, 34 bp, Artificial Sequence
  Description of Artificial Sequence: Synthetic oligonucleotide
actcatagcttcagctctcatcatgatccagcag

SEQ ID NO: 106849 - DNA, 33 bp, Artificial Sequence
  Description of Artificial Sequence: Synthetic oligonucleotide
ctcatagcttcagctctcatcatgatccagcag

SEQ ID NO: 106850 - DNA, 34 bp, Artificial Sequence
  Description of Artificial Sequence: Synthetic oligonucleotide
tcatagcttcagctctcatcatgatccagcagac

SEQ ID NO: 106851 - DNA, 33 bp, Artificial Sequence
  Description of Artificial Sequence: Synthetic oligonucleotide
catagcttcagctctcatcatgatccagcagac

SEQ ID NO: 106852 - DNA, 34 bp, Artificial Sequence
  Description of Artificial Sequence: Synthetic oligonucleotide
atagcttcagctctcatcatgatccagcagactg

SEQ ID NO: 106853 - DNA, 33 bp, Artificial Sequence
  Description of Artificial Sequence: Synthetic oligonucleotide
tagcttcagctctcatcatgatccagcagactg

SEQ ID NO: 106854 - DNA, 32 bp, Artificial Sequence
  Description of Artificial Sequence: Synthetic oligonucleotide
agcttcagctctcatcatgatccagcagactg

SEQ ID NO: 106855 - DNA, 31 bp, Artificial Sequence
  Description of Artificial Sequence: Synthetic oligonucleotide
gcttcagctctcatcatgatccagcagactg

SEQ ID NO: 106856 - DNA, 35 bp, Artificial Sequence
  Description of Artificial Sequence: Synthetic oligonucleotide
cttcagctctcatcatgatccagcagactgaaatc

SEQ ID NO: 106857 - DNA, 36 bp, Artificial Sequence
  Description of Artificial Sequence: Synthetic oligonucleotide
ttcagctctcatcatgatccagcagactgaaatcac

SEQ ID NO: 106858 - DNA, 35 bp, Artificial Sequence
  Description of Artificial Sequence: Synthetic oligonucleotide
tcagctctcatcatgatccagcagactgaaatcac

SEQ ID NO: 106859 - DNA, 34 bp, Artificial Sequence
  Description of Artificial Sequence: Synthetic oligonucleotide
cagctctcatcatgatccagcagactgaaatcac

SEQ ID NO: 106860 - DNA, 36 bp, Artificial Sequence
  Description of Artificial Sequence: Synthetic oligonucleotide
agctctcatcatgatccagcagactgaaatcacttg

SEQ ID NO: 106861 - DNA, 35 bp, Artificial Sequence
  Description of Artificial Sequence: Synthetic oligonucleotide
gctctcatcatgatccagcagactgaaatcacttg

SEQ ID NO: 106862 - DNA, 36 bp, Artificial Sequence
  Description of Artificial Sequence: Synthetic oligonucleotide
ctctcatcatgatccagcagactgaaatcacttgtc

SEQ ID NO: 106863 - DNA, 36 bp, Artificial Sequence
  Description of Artificial Sequence: Synthetic oligonucleotide
tctcatcatgatccagcagactgaaatcacttgtcc

SEQ ID NO: 106864 - DNA, 35 bp, Artificial Sequence
  Description of Artificial Sequence: Synthetic oligonucleotide
ctcatcatgatccagcagactgaaatcacttgtcc

SEQ ID NO: 106865 - DNA, 38 bp, Artificial Sequence
  Description of Artificial Sequence: Synthetic oligonucleotide
tcatcatgatccagcagactgaaatcacttgtccaaag

SEQ ID NO: 106866 - DNA, 37 bp, Artificial Sequence
  Description of Artificial Sequence: Synthetic oligonucleotide
catcatgatccagcagactgaaatcacttgtccaaag

SEQ ID NO: 106867 - DNA, 37 bp, Artificial Sequence
  Description of Artificial Sequence: Synthetic oligonucleotide
atcatgatccagcagactgaaatcacttgtccaaagg

SEQ ID NO: 106868 - DNA, 36 bp, Artificial Sequence
  Description of Artificial Sequence: Synthetic oligonucleotide
tcatgatccagcagactgaaatcacttgtccaaagg

SEQ ID NO: 106869 - DNA, 35 bp, Artificial Sequence
  Description of Artificial Sequence: Synthetic oligonucleotide
catgatccagcagactgaaatcacttgtccaaagg

SEQ ID NO: 106870 - DNA, 36 bp, Artificial Sequence
  Description of Artificial Sequence: Synthetic oligonucleotide
atgatccagcagactgaaatcacttgtccaaaggtg

SEQ ID NO: 106871 - DNA, 35 bp, Artificial Sequence
  Description of Artificial Sequence: Synthetic oligonucleotide
tgatccagcagactgaaatcacttgtccaaaggtg

SEQ ID NO: 106872 - DNA, 34 bp, Artificial Sequence
  Description of Artificial Sequence: Synthetic oligonucleotide
gatccagcagactgaaatcacttgtccaaaggtg

SEQ ID NO: 106873 - DNA, 37 bp, Artificial Sequence
  Description of Artificial Sequence: Synthetic oligonucleotide
atccagcagactgaaatcacttgtccaaaggtgaatc

SEQ ID NO: 106874 - DNA, 36 bp, Artificial Sequence
  Description of Artificial Sequence: Synthetic oligonucleotide
tccagcagactgaaatcacttgtccaaaggtgaatc

SEQ ID NO: 106875 - DNA, 35 bp, Artificial Sequence
  Description of Artificial Sequence: Synthetic oligonucleotide
ccagcagactgaaatcacttgtccaaaggtgaatc

SEQ ID NO: 106876 - DNA, 36 bp, Artificial Sequence
  Description of Artificial Sequence: Synthetic oligonucleotide
cagcagactgaaatcacttgtccaaaggtgaatcag

SEQ ID NO: 106877 - DNA, 38 bp, Artificial Sequence
  Description of Artificial Sequence: Synthetic oligonucleotide
agcagactgaaatcacttgtccaaaggtgaatcagttc

SEQ ID NO: 106878 - DNA, 37 bp, Artificial Sequence
  Description of Artificial Sequence: Synthetic oligonucleotide
gcagactgaaatcacttgtccaaaggtgaatcagttc

SEQ ID NO: 106879 - DNA, 38 bp, Artificial Sequence
  Description of Artificial Sequence: Synthetic oligonucleotide
cagactgaaatcacttgtccaaaggtgaatcagttcag

SEQ ID NO: 106880 - DNA, 39 bp, Artificial Sequence
  Description of Artificial Sequence: Synthetic oligonucleotide
agactgaaatcacttgtccaaaggtgaatcagttcagac

SEQ ID NO: 106881 - DNA, 38 bp, Artificial Sequence
  Description of Artificial Sequence: Synthetic oligonucleotide
gactgaaatcacttgtccaaaggtgaatcagttcagac

SEQ ID NO: 106882 - DNA, 39 bp, Artificial Sequence
  Description of Artificial Sequence: Synthetic oligonucleotide
actgaaatcacttgtccaaaggtgaatcagttcagacag

SEQ ID NO: 106883 - DNA, 38 bp, Artificial Sequence
  Description of Artificial Sequence: Synthetic oligonucleotide
ctgaaatcacttgtccaaaggtgaatcagttcagacag

SEQ ID NO: 106884 - DNA, 38 bp, Artificial Sequence
  Description of Artificial Sequence: Synthetic oligonucleotide
tgaaatcacttgtccaaaggtgaatcagttcagacagc

SEQ ID NO: 106885 - DNA, 37 bp, Artificial Sequence
  Description of Artificial Sequence: Synthetic oligonucleotide
gaaatcacttgtccaaaggtgaatcagttcagacagc

SEQ ID NO: 106886 - DNA, 38 bp, Artificial Sequence
  Description of Artificial Sequence: Synthetic oligonucleotide
aaatcacttgtccaaaggtgaatcagttcagacagctg

SEQ ID NO: 106887 - DNA, 37 bp, Artificial Sequence
  Description of Artificial Sequence: Synthetic oligonucleotide
aatcacttgtccaaaggtgaatcagttcagacagctg

SEQ ID NO: 106888 - DNA, 36 bp, Artificial Sequence
  Description of Artificial Sequence: Synthetic oligonucleotide
atcacttgtccaaaggtgaatcagttcagacagctg

SEQ ID NO: 106889 - DNA, 35 bp, Artificial Sequence
  Description of Artificial Sequence: Synthetic oligonucleotide
tcacttgtccaaaggtgaatcagttcagacagctg

SEQ ID NO: 106890 - DNA, 34 bp, Artificial Sequence
  Description of Artificial Sequence: Synthetic oligonucleotide
cacttgtccaaaggtgaatcagttcagacagctg

SEQ ID NO: 106891 - DNA, 38 bp, Artificial Sequence
  Description of Artificial Sequence: Synthetic oligonucleotide
acttgtccaaaggtgaatcagttcagacagctgtattc

SEQ ID NO: 106892 - DNA, 37 bp, Artificial Sequence
  Description of Artificial Sequence: Synthetic oligonucleotide
cttgtccaaaggtgaatcagttcagacagctgtattc

SEQ ID NO: 106893 - DNA, 37 bp, Artificial Sequence
  Description of Artificial Sequence: Synthetic oligonucleotide
ttgtccaaaggtgaatcagttcagacagctgtattcc

SEQ ID NO: 106894 - DNA, 36 bp, Artificial Sequence
  Description of Artificial Sequence: Synthetic oligonucleotide
tgtccaaaggtgaatcagttcagacagctgtattcc

SEQ ID NO: 106895 - DNA, 35 bp, Artificial Sequence
  Description of Artificial Sequence: Synthetic oligonucleotide
gtccaaaggtgaatcagttcagacagctgtattcc

SEQ ID NO: 106896 - DNA, 38 bp, Artificial Sequence
  Description of Artificial Sequence: Synthetic oligonucleotide
tccaaaggtgaatcagttcagacagctgtattccaaag

SEQ ID NO: 106897 - DNA, 37 bp, Artificial Sequence
  Description of Artificial Sequence: Synthetic oligonucleotide
ccaaaggtgaatcagttcagacagctgtattccaaag

SEQ ID NO: 106898 - DNA, 38 bp, Artificial Sequence
  Description of Artificial Sequence: Synthetic oligonucleotide
caaaggtgaatcagttcagacagctgtattccaaagtc

SEQ ID NO: 106899 - DNA, 40 bp, Artificial Sequence
  Description of Artificial Sequence: Synthetic oligonucleotide
aaaggtgaatcagttcagacagctgtattccaaagtcatc

SEQ ID NO: 106900 - DNA, 39 bp, Artificial Sequence
  Description of Artificial Sequence: Synthetic oligonucleotide
aaggtgaatcagttcagacagctgtattccaaagtcatc

SEQ ID NO: 106901 - DNA, 38 bp, Artificial Sequence
  Description of Artificial Sequence: Synthetic oligonucleotide
aggtgaatcagttcagacagctgtattccaaagtcatc

SEQ ID NO: 106902 - DNA, 37 bp, Artificial Sequence
  Description of Artificial Sequence: Synthetic oligonucleotide
ggtgaatcagttcagacagctgtattccaaagtcatc

SEQ ID NO: 106903 - DNA, 40 bp, Artificial Sequence
  Description of Artificial Sequence: Synthetic oligonucleotide
gtgaatcagttcagacagctgtattccaaagtcatcaatg

SEQ ID NO: 106904 - DNA, 44 bp, Artificial Sequence
  Description of Artificial Sequence: Synthetic oligonucleotide
tgaatcagttcagacagctgtattccaaagtcatcaatgataag

SEQ ID NO: 106905 - DNA, 43 bp, Artificial Sequence
  Description of Artificial Sequence: Synthetic oligonucleotide
gaatcagttcagacagctgtattccaaagtcatcaatgataag

SEQ ID NO: 106906 - DNA, 43 bp, Artificial Sequence
  Description of Artificial Sequence: Synthetic oligonucleotide
aatcagttcagacagctgtattccaaagtcatcaatgataagc

SEQ ID NO: 106907 - DNA, 42 bp, Artificial Sequence
  Description of Artificial Sequence: Synthetic oligonucleotide
atcagttcagacagctgtattccaaagtcatcaatgataagc

SEQ ID NO: 106908 - DNA, 41 bp, Artificial Sequence
  Description of Artificial Sequence: Synthetic oligonucleotide
tcagttcagacagctgtattccaaagtcatcaatgataagc

SEQ ID NO: 106909 - DNA, 40 bp, Artificial Sequence
  Description of Artificial Sequence: Synthetic oligonucleotide
cagttcagacagctgtattccaaagtcatcaatgataagc

SEQ ID NO: 106910 - DNA, 42 bp, Artificial Sequence
  Description of Artificial Sequence: Synthetic oligonucleotide
agttcagacagctgtattccaaagtcatcaatgataagcatg

SEQ ID NO: 106911 - DNA, 41 bp, Artificial Sequence
  Description of Artificial Sequence: Synthetic oligonucleotide
gttcagacagctgtattccaaagtcatcaatgataagcatg

SEQ ID NO: 106912 - DNA, 43 bp, Artificial Sequence
  Description of Artificial Sequence: Synthetic oligonucleotide
ttcagacagctgtattccaaagtcatcaatgataagcatgatg

SEQ ID NO: 106913 - DNA, 42 bp, Artificial Sequence
  Description of Artificial Sequence: Synthetic oligonucleotide
tcagacagctgtattccaaagtcatcaatgataagcatgatg

SEQ ID NO: 106914 - DNA, 41 bp, Artificial Sequence
  Description of Artificial Sequence: Synthetic oligonucleotide
cagacagctgtattccaaagtcatcaatgataagcatgatg

SEQ ID NO: 106915 - DNA, 43 bp, Artificial Sequence
  Description of Artificial Sequence: Synthetic oligonucleotide
agacagctgtattccaaagtcatcaatgataagcatgatgatg

SEQ ID NO: 106916 - DNA, 42 bp, Artificial Sequence
  Description of Artificial Sequence: Synthetic oligonucleotide
gacagctgtattccaaagtcatcaatgataagcatgatgatg

SEQ ID NO: 106917 - DNA, 43 bp, Artificial Sequence
  Description of Artificial Sequence: Synthetic oligonucleotide
acagctgtattccaaagtcatcaatgataagcatgatgatgtc

SEQ ID NO: 106918 - DNA, 42 bp, Artificial Sequence
  Description of Artificial Sequence: Synthetic oligonucleotide
cagctgtattccaaagtcatcaatgataagcatgatgatgtc

SEQ ID NO: 106919 - DNA, 44 bp, Artificial Sequence
  Description of Artificial Sequence: Synthetic oligonucleotide
agctgtattccaaagtcatcaatgataagcatgatgatgtcatg

SEQ ID NO: 106920 - DNA, 43 bp, Artificial Sequence
  Description of Artificial Sequence: Synthetic oligonucleotide
gctgtattccaaagtcatcaatgataagcatgatgatgtcatg

SEQ ID NO: 106921 - DNA, 43 bp, Artificial Sequence
  Description of Artificial Sequence: Synthetic oligonucleotide
ctgtattccaaagtcatcaatgataagcatgatgatgtcatgg

SEQ ID NO: 106922 - DNA, 43 bp, Artificial Sequence
  Description of Artificial Sequence: Synthetic oligonucleotide
tgtattccaaagtcatcaatgataagcatgatgatgtcatggc

SEQ ID NO: 106923 - DNA, 42 bp, Artificial Sequence
  Description of Artificial Sequence: Synthetic oligonucleotide
gtattccaaagtcatcaatgataagcatgatgatgtcatggc

SEQ ID NO: 106924 - DNA, 42 bp, Artificial Sequence
  Description of Artificial Sequence: Synthetic oligonucleotide
tattccaaagtcatcaatgataagcatgatgatgtcatggcc

SEQ ID NO: 106925 - DNA, 41 bp, Artificial Sequence
  Description of Artificial Sequence: Synthetic oligonucleotide
attccaaagtcatcaatgataagcatgatgatgtcatggcc

SEQ ID NO: 106926 - DNA, 40 bp, Artificial Sequence
  Description of Artificial Sequence: Synthetic oligonucleotide
ttccaaagtcatcaatgataagcatgatgatgtcatggcc

SEQ ID NO: 106927 - DNA, 39 bp, Artificial Sequence
  Description of Artificial Sequence: Synthetic oligonucleotide
tccaaagtcatcaatgataagcatgatgatgtcatggcc

SEQ ID NO: 106928 - DNA, 38 bp, Artificial Sequence
  Description of Artificial Sequence: Synthetic oligonucleotide
ccaaagtcatcaatgataagcatgatgatgtcatggcc

SEQ ID NO: 106929 - DNA, 40 bp, Artificial Sequence
  Description of Artificial Sequence: Synthetic oligonucleotide
caaagtcatcaatgataagcatgatgatgtcatggccaag

SEQ ID NO: 106930 - DNA, 43 bp, Artificial Sequence
  Description of Artificial Sequence: Synthetic oligonucleotide
aaagtcatcaatgataagcatgatgatgtcatggccaagtttg

SEQ ID NO: 106931 - DNA, 42 bp, Artificial Sequence
  Description of Artificial Sequence: Synthetic oligonucleotide
aagtcatcaatgataagcatgatgatgtcatggccaagtttg

SEQ ID NO: 106932 - DNA, 41 bp, Artificial Sequence
  Description of Artificial Sequence: Synthetic oligonucleotide
agtcatcaatgataagcatgatgatgtcatggccaagtttg

SEQ ID NO: 106933 - DNA, 40 bp, Artificial Sequence
  Description of Artificial Sequence: Synthetic oligonucleotide
gtcatcaatgataagcatgatgatgtcatggccaagtttg

SEQ ID NO: 106934 - DNA, 40 bp, Artificial Sequence
  Description of Artificial Sequence: Synthetic oligonucleotide
tcatcaatgataagcatgatgatgtcatggccaagtttgg

SEQ ID NO: 106935 - DNA, 39 bp, Artificial Sequence
  Description of Artificial Sequence: Synthetic oligonucleotide
catcaatgataagcatgatgatgtcatggccaagtttgg

SEQ ID NO: 106936 - DNA, 39 bp, Artificial Sequence
  Description of Artificial Sequence: Synthetic oligonucleotide
atcaatgataagcatgatgatgtcatggccaagtttggc

SEQ ID NO: 106937 - DNA, 38 bp, Artificial Sequence
  Description of Artificial Sequence: Synthetic oligonucleotide
tcaatgataagcatgatgatgtcatggccaagtttggc

SEQ ID NO: 106938 - DNA, 37 bp, Artificial Sequence
  Description of Artificial Sequence: Synthetic oligonucleotide
caatgataagcatgatgatgtcatggccaagtttggc

SEQ ID NO: 106939 - DNA, 37 bp, Artificial Sequence
  Description of Artificial Sequence: Synthetic oligonucleotide
aatgataagcatgatgatgtcatggccaagtttggcg

SEQ ID NO: 106940 - DNA, 36 bp, Artificial Sequence
  Description of Artificial Sequence: Synthetic oligonucleotide
atgataagcatgatgatgtcatggccaagtttggcg

SEQ ID NO: 106941 - DNA, 35 bp, Artificial Sequence
  Description of Artificial Sequence: Synthetic oligonucleotide
tgataagcatgatgatgtcatggccaagtttggcg

SEQ ID NO: 106942 - DNA, 34 bp, Artificial Sequence
  Description of Artificial Sequence: Synthetic oligonucleotide
gataagcatgatgatgtcatggccaagtttggcg

SEQ ID NO: 106943 - DNA, 34 bp, Artificial Sequence
  Description of Artificial Sequence: Synthetic oligonucleotide
ataagcatgatgatgtcatggccaagtttggcgc

SEQ ID NO: 106944 - DNA, 33 bp, Artificial Sequence
  Description of Artificial Sequence: Synthetic oligonucleotide
taagcatgatgatgtcatggccaagtttggcgc

SEQ ID NO: 106945 - DNA, 32 bp, Artificial Sequence
  Description of Artificial Sequence: Synthetic oligonucleotide
aagcatgatgatgtcatggccaagtttggcgc

SEQ ID NO: 106946 - DNA, 31 bp, Artificial Sequence
  Description of Artificial Sequence: Synthetic oligonucleotide
agcatgatgatgtcatggccaagtttggcgc

SEQ ID NO: 106947 - DNA, 30 bp, Artificial Sequence
  Description of Artificial Sequence: Synthetic oligonucleotide
gcatgatgatgtcatggccaagtttggcgc

SEQ ID NO: 106948 - DNA, 34 bp, Artificial Sequence
  Description of Artificial Sequence: Synthetic oligonucleotide
catgatgatgtcatggccaagtttggcgctattc

SEQ ID NO: 106949 - DNA, 35 bp, Artificial Sequence
  Description of Artificial Sequence: Synthetic oligonucleotide
atgatgatgtcatggccaagtttggcgctattctg

SEQ ID NO: 106950 - DNA, 34 bp, Artificial Sequence
  Description of Artificial Sequence: Synthetic oligonucleotide
tgatgatgtcatggccaagtttggcgctattctg

SEQ ID NO: 106951 - DNA, 33 bp, Artificial Sequence
  Description of Artificial Sequence: Synthetic oligonucleotide
gatgatgtcatggccaagtttggcgctattctg

SEQ ID NO: 106952 - DNA, 33 bp, Artificial Sequence
  Description of Artificial Sequence: Synthetic oligonucleotide
atgatgtcatggccaagtttggcgctattctgg

SEQ ID NO: 106953 - DNA, 32 bp, Artificial Sequence
  Description of Artificial Sequence: Synthetic oligonucleotide
tgatgtcatggccaagtttggcgctattctgg

SEQ ID NO: 106954 - DNA, 31 bp, Artificial Sequence
  Description of Artificial Sequence: Synthetic oligonucleotide
gatgtcatggccaagtttggcgctattctgg

SEQ ID NO: 106955 - DNA, 31 bp, Artificial Sequence
  Description of Artificial Sequence: Synthetic oligonucleotide
atgtcatggccaagtttggcgctattctggc

SEQ ID NO: 106956 - DNA, 30 bp, Artificial Sequence
  Description of Artificial Sequence: Synthetic oligonucleotide
tgtcatggccaagtttggcgctattctggc

SEQ ID NO: 106957 - DNA, 29 bp, Artificial Sequence
  Description of Artificial Sequence: Synthetic oligonucleotide
gtcatggccaagtttggcgctattctggc

SEQ ID NO: 106958 - DNA, 29 bp, Artificial Sequence
  Description of Artificial Sequence: Synthetic oligonucleotide
tcatggccaagtttggcgctattctggcc

SEQ ID NO: 106959 - DNA, 28 bp, Artificial Sequence
  Description of Artificial Sequence: Synthetic oligonucleotide
catggccaagtttggcgctattctggcc

SEQ ID NO: 106960 - DNA, 28 bp, Artificial Sequence
  Description of Artificial Sequence: Synthetic oligonucleotide
atggccaagtttggcgctattctggccc

SEQ ID NO: 106961 - DNA, 27 bp, Artificial Sequence
  Description of Artificial Sequence: Synthetic oligonucleotide
tggccaagtttggcgctattctggccc

SEQ ID NO: 106962 - DNA, 27 bp, Artificial Sequence
  Description of Artificial Sequence: Synthetic oligonucleotide
ggccaagtttggcgctattctggccca

SEQ ID NO: 106963 - DNA, 27 bp, Artificial Sequence
  Description of Artificial Sequence: Synthetic oligonucleotide
gccaagtttggcgctattctggcccag

SEQ ID NO: 106964 - DNA, 27 bp, Artificial Sequence
  Description of Artificial Sequence: Synthetic oligonucleotide
ccaagtttggcgctattctggcccagg

SEQ ID NO: 106965 - DNA, 27 bp, Artificial Sequence
  Description of Artificial Sequence: Synthetic oligonucleotide
caagtttggcgctattctggcccaggg

SEQ ID NO: 106966 - DNA, 27 bp, Artificial Sequence
  Description of Artificial Sequence: Synthetic oligonucleotide
aagtttggcgctattctggcccagggc

SEQ ID NO: 106967 - DNA, 27 bp, Artificial Sequence
  Description of Artificial Sequence: Synthetic oligonucleotide
agtttggcgctattctggcccagggca

SEQ ID NO: 106968 - DNA, 27 bp, Artificial Sequence
  Description of Artificial Sequence: Synthetic oligonucleotide
gtttggcgctattctggcccagggcat

SEQ ID NO: 106969 - DNA, 28 bp, Artificial Sequence
  Description of Artificial Sequence: Synthetic oligonucleotide
tttggcgctattctggcccagggcatac

SEQ ID NO: 106970 - DNA, 27 bp, Artificial Sequence
  Description of Artificial Sequence: Synthetic oligonucleotide
ttggcgctattctggcccagggcatac

SEQ ID NO: 106971 - DNA, 27 bp, Artificial Sequence
  Description of Artificial Sequence: Synthetic oligonucleotide
tggcgctattctggcccagggcatact

SEQ ID NO: 106972 - DNA, 26 bp, Artificial Sequence
  Description of Artificial Sequence: Synthetic oligonucleotide
ggcgctattctggcccagggcatact

SEQ ID NO: 106973 - DNA, 26 bp, Artificial Sequence
  Description of Artificial Sequence: Synthetic oligonucleotide
gcgctattctggcccagggcatactg

SEQ ID NO: 106974 - DNA, 27 bp, Artificial Sequence
  Description of Artificial Sequence: Synthetic oligonucleotide
cgctattctggcccagggcatactgga

SEQ ID NO: 106975 - DNA, 28 bp, Artificial Sequence
  Description of Artificial Sequence: Synthetic oligonucleotide
gctattctggcccagggcatactggatg

SEQ ID NO: 106976 - DNA, 28 bp, Artificial Sequence
  Description of Artificial Sequence: Synthetic oligonucleotide
ctattctggcccagggcatactggatgc

SEQ ID NO: 106977 - DNA, 29 bp, Artificial Sequence
  Description of Artificial Sequence: Synthetic oligonucleotide
tattctggcccagggcatactggatgcag

SEQ ID NO: 106978 - DNA, 28 bp, Artificial Sequence
  Description of Artificial Sequence: Synthetic oligonucleotide
attctggcccagggcatactggatgcag

SEQ ID NO: 106979 - DNA, 27 bp, Artificial Sequence
  Description of Artificial Sequence: Synthetic oligonucleotide
ttctggcccagggcatactggatgcag

SEQ ID NO: 106980 - DNA, 26 bp, Artificial Sequence
  Description of Artificial Sequence: Synthetic oligonucleotide
tctggcccagggcatactggatgcag

SEQ ID NO: 106981 - DNA, 25 bp, Artificial Sequence
  Description of Artificial Sequence: Synthetic oligonucleotide
ctggcccagggcatactggatgcag

SEQ ID NO: 106982 - DNA, 26 bp, Artificial Sequence
  Description of Artificial Sequence: Synthetic oligonucleotide
tggcccagggcatactggatgcaggt

SEQ ID NO: 106983 - DNA, 25 bp, Artificial Sequence
  Description of Artificial Sequence: Synthetic oligonucleotide
ggcccagggcatactggatgcaggt

SEQ ID NO: 106984 - DNA, 25 bp, Artificial Sequence
  Description of Artificial Sequence: Synthetic oligonucleotide
gcccagggcatactggatgcaggtg

SEQ ID NO: 106985 - DNA, 26 bp, Artificial Sequence
  Description of Artificial Sequence: Synthetic oligonucleotide
cccagggcatactggatgcaggtggt

SEQ ID NO: 106986 - DNA, 27 bp, Artificial Sequence
  Description of Artificial Sequence: Synthetic oligonucleotide
ccagggcatactggatgcaggtggtca

SEQ ID NO: 106987 - DNA, 31 bp, Artificial Sequence
  Description of Artificial Sequence: Synthetic oligonucleotide
cagggcatactggatgcaggtggtcataatg

SEQ ID NO: 106988 - DNA, 32 bp, Artificial Sequence
  Description of Artificial Sequence: Synthetic oligonucleotide
agggcatactggatgcaggtggtcataatgtc

SEQ ID NO: 106989 - DNA, 31 bp, Artificial Sequence
  Description of Artificial Sequence: Synthetic oligonucleotide
gggcatactggatgcaggtggtcataatgtc

SEQ ID NO: 106990 - DNA, 32 bp, Artificial Sequence
  Description of Artificial Sequence: Synthetic oligonucleotide
ggcatactggatgcaggtggtcataatgtcac

SEQ ID NO: 106991 - DNA, 35 bp, Artificial Sequence
  Description of Artificial Sequence: Synthetic oligonucleotide
gcatactggatgcaggtggtcataatgtcacaatc

SEQ ID NO: 106992 - DNA, 36 bp, Artificial Sequence
  Description of Artificial Sequence: Synthetic oligonucleotide
catactggatgcaggtggtcataatgtcacaatctc

SEQ ID NO: 106993 - DNA, 36 bp, Artificial Sequence
  Description of Artificial Sequence: Synthetic oligonucleotide
atactggatgcaggtggtcataatgtcacaatctcc

SEQ ID NO: 106994 - DNA, 35 bp, Artificial Sequence
  Description of Artificial Sequence: Synthetic oligonucleotide
tactggatgcaggtggtcataatgtcacaatctcc

SEQ ID NO: 106995 - DNA, 34 bp, Artificial Sequence
  Description of Artificial Sequence: Synthetic oligonucleotide
actggatgcaggtggtcataatgtcacaatctcc

SEQ ID NO: 106996 - DNA, 33 bp, Artificial Sequence
  Description of Artificial Sequence: Synthetic oligonucleotide
ctggatgcaggtggtcataatgtcacaatctcc

SEQ ID NO: 106997 - DNA, 35 bp, Artificial Sequence
  Description of Artificial Sequence: Synthetic oligonucleotide
tggatgcaggtggtcataatgtcacaatctccttg

SEQ ID NO: 106998 - DNA, 34 bp, Artificial Sequence
  Description of Artificial Sequence: Synthetic oligonucleotide
ggatgcaggtggtcataatgtcacaatctccttg

SEQ ID NO: 106999 - DNA, 34 bp, Artificial Sequence
  Description of Artificial Sequence: Synthetic oligonucleotide
gatgcaggtggtcataatgtcacaatctccttgc

SEQ ID NO: 107000 - DNA, 35 bp, Artificial Sequence
  Description of Artificial Sequence: Synthetic oligonucleotide
atgcaggtggtcataatgtcacaatctccttgcag

SEQ ID NO: 107001 - DNA, 34 bp, Artificial Sequence
  Description of Artificial Sequence: Synthetic oligonucleotide
tgcaggtggtcataatgtcacaatctccttgcag

SEQ ID NO: 107002 - DNA, 33 bp, Artificial Sequence
  Description of Artificial Sequence: Synthetic oligonucleotide
gcaggtggtcataatgtcacaatctccttgcag

SEQ ID NO: 107003 - DNA, 34 bp, Artificial Sequence
  Description of Artificial Sequence: Synthetic oligonucleotide
caggtggtcataatgtcacaatctccttgcagtc

SEQ ID NO: 107004 - DNA, 34 bp, Artificial Sequence
  Description of Artificial Sequence: Synthetic oligonucleotide
aggtggtcataatgtcacaatctccttgcagtcc

SEQ ID NO: 107005 - DNA, 33 bp, Artificial Sequence
  Description of Artificial Sequence: Synthetic oligonucleotide
ggtggtcataatgtcacaatctccttgcagtcc

SEQ ID NO: 107006 - DNA, 34 bp, Artificial Sequence
  Description of Artificial Sequence: Synthetic oligonucleotide
gtggtcataatgtcacaatctccttgcagtccag

SEQ ID NO: 107007 - DNA, 34 bp, Artificial Sequence
  Description of Artificial Sequence: Synthetic oligonucleotide
tggtcataatgtcacaatctccttgcagtccagg

SEQ ID NO: 107008 - DNA, 33 bp, Artificial Sequence
  Description of Artificial Sequence: Synthetic oligonucleotide
ggtcataatgtcacaatctccttgcagtccagg

SEQ ID NO: 107009 - DNA, 34 bp, Artificial Sequence
  Description of Artificial Sequence: Synthetic oligonucleotide
gtcataatgtcacaatctccttgcagtccaggac

SEQ ID NO: 107010 - DNA, 35 bp, Artificial Sequence
  Description of Artificial Sequence: Synthetic oligonucleotide
tcataatgtcacaatctccttgcagtccaggactg

SEQ ID NO: 107011 - DNA, 34 bp, Artificial Sequence
  Description of Artificial Sequence: Synthetic oligonucleotide
cataatgtcacaatctccttgcagtccaggactg

SEQ ID NO: 107012 - DNA, 34 bp, Artificial Sequence
  Description of Artificial Sequence: Synthetic oligonucleotide
ataatgtcacaatctccttgcagtccaggactgg

SEQ ID NO: 107013 - DNA, 33 bp, Artificial Sequence
  Description of Artificial Sequence: Synthetic oligonucleotide
taatgtcacaatctccttgcagtccaggactgg

SEQ ID NO: 107014 - DNA, 32 bp, Artificial Sequence
  Description of Artificial Sequence: Synthetic oligonucleotide
aatgtcacaatctccttgcagtccaggactgg

SEQ ID NO: 107015 - DNA, 31 bp, Artificial Sequence
  Description of Artificial Sequence: Synthetic oligonucleotide
atgtcacaatctccttgcagtccaggactgg

SEQ ID NO: 107016 - DNA, 30 bp, Artificial Sequence
  Description of Artificial Sequence: Synthetic oligonucleotide
tgtcacaatctccttgcagtccaggactgg

SEQ ID NO: 107017 - DNA, 29 bp, Artificial Sequence
  Description of Artificial Sequence: Synthetic oligonucleotide
gtcacaatctccttgcagtccaggactgg

SEQ ID NO: 107018 - DNA, 29 bp, Artificial Sequence
  Description of Artificial Sequence: Synthetic oligonucleotide
tcacaatctccttgcagtccaggactggg

SEQ ID NO: 107019 - DNA, 28 bp, Artificial Sequence
  Description of Artificial Sequence: Synthetic oligonucleotide
cacaatctccttgcagtccaggactggg

SEQ ID NO: 107020 - DNA, 28 bp, Artificial Sequence
  Description of Artificial Sequence: Synthetic oligonucleotide
acaatctccttgcagtccaggactgggc

SEQ ID NO: 107021 - DNA, 27 bp, Artificial Sequence
  Description of Artificial Sequence: Synthetic oligonucleotide
caatctccttgcagtccaggactgggc

SEQ ID NO: 107022 - DNA, 30 bp, Artificial Sequence
  Description of Artificial Sequence: Synthetic oligonucleotide
aatctccttgcagtccaggactgggcatac

SEQ ID NO: 107023 - DNA, 29 bp, Artificial Sequence
  Description of Artificial Sequence: Synthetic oligonucleotide
atctccttgcagtccaggactgggcatac

SEQ ID NO: 107024 - DNA, 28 bp, Artificial Sequence
  Description of Artificial Sequence: Synthetic oligonucleotide
tctccttgcagtccaggactgggcatac

SEQ ID NO: 107025 - DNA, 27 bp, Artificial Sequence
  Description of Artificial Sequence: Synthetic oligonucleotide
ctccttgcagtccaggactgggcatac

SEQ ID NO: 107026 - DNA, 28 bp, Artificial Sequence
  Description of Artificial Sequence: Synthetic oligonucleotide
tccttgcagtccaggactgggcatactc

SEQ ID NO: 107027 - DNA, 27 bp, Artificial Sequence
  Description of Artificial Sequence: Synthetic oligonucleotide
ccttgcagtccaggactgggcatactc

SEQ ID NO: 107028 - DNA, 31 bp, Artificial Sequence
  Description of Artificial Sequence: Synthetic oligonucleotide
cttgcagtccaggactgggcatactcatatg

SEQ ID NO: 107029 - DNA, 31 bp, Artificial Sequence
  Description of Artificial Sequence: Synthetic oligonucleotide
ttgcagtccaggactgggcatactcatatgc

SEQ ID NO: 107030 - DNA, 30 bp, Artificial Sequence
  Description of Artificial Sequence: Synthetic oligonucleotide
tgcagtccaggactgggcatactcatatgc

SEQ ID NO: 107031 - DNA, 29 bp, Artificial Sequence
  Description of Artificial Sequence: Synthetic oligonucleotide
gcagtccaggactgggcatactcatatgc

SEQ ID NO: 107032 - DNA, 29 bp, Artificial Sequence
  Description of Artificial Sequence: Synthetic oligonucleotide
cagtccaggactgggcatactcatatgcc

SEQ ID NO: 107033 - DNA, 31 bp, Artificial Sequence
  Description of Artificial Sequence: Synthetic oligonucleotide
agtccaggactgggcatactcatatgccttc

SEQ ID NO: 107034 - DNA, 30 bp, Artificial Sequence
  Description of Artificial Sequence: Synthetic oligonucleotide
gtccaggactgggcatactcatatgccttc

SEQ ID NO: 107035 - DNA, 31 bp, Artificial Sequence
  Description of Artificial Sequence: Synthetic oligonucleotide
tccaggactgggcatactcatatgccttctg

SEQ ID NO: 107036 - DNA, 30 bp, Artificial Sequence
  Description of Artificial Sequence: Synthetic oligonucleotide
ccaggactgggcatactcatatgccttctg

SEQ ID NO: 107037 - DNA, 31 bp, Artificial Sequence
  Description of Artificial Sequence: Synthetic oligonucleotide
caggactgggcatactcatatgccttctgtg

SEQ ID NO: 107038 - DNA, 31 bp, Artificial Sequence
  Description of Artificial Sequence: Synthetic oligonucleotide
aggactgggcatactcatatgccttctgtgg

SEQ ID NO: 107039 - DNA, 30 bp, Artificial Sequence
  Description of Artificial Sequence: Synthetic oligonucleotide
ggactgggcatactcatatgccttctgtgg

SEQ ID NO: 107040 - DNA, 32 bp, Artificial Sequence
  Description of Artificial Sequence: Synthetic oligonucleotide
gactgggcatactcatatgccttctgtggttg

SEQ ID NO: 107041 - DNA, 32 bp, Artificial Sequence
  Description of Artificial Sequence: Synthetic oligonucleotide
actgggcatactcatatgccttctgtggttgg

SEQ ID NO: 107042 - DNA, 31 bp, Artificial Sequence
  Description of Artificial Sequence: Synthetic oligonucleotide
ctgggcatactcatatgccttctgtggttgg

SEQ ID NO: 107043 - DNA, 31 bp, Artificial Sequence
  Description of Artificial Sequence: Synthetic oligonucleotide
tgggcatactcatatgccttctgtggttggc

SEQ ID NO: 107044 - DNA, 30 bp, Artificial Sequence
  Description of Artificial Sequence: Synthetic oligonucleotide
gggcatactcatatgccttctgtggttggc

SEQ ID NO: 107045 - DNA, 30 bp, Artificial Sequence
  Description of Artificial Sequence: Synthetic oligonucleotide
ggcatactcatatgccttctgtggttggcg

SEQ ID NO: 107046 - DNA, 31 bp, Artificial Sequence
  Description of Artificial Sequence: Synthetic oligonucleotide
gcatactcatatgccttctgtggttggcgtc

SEQ ID NO: 107047 - DNA, 31 bp, Artificial Sequence
  Description of Artificial Sequence: Synthetic oligonucleotide
catactcatatgccttctgtggttggcgtcc

SEQ ID NO: 107048 - DNA, 33 bp, Artificial Sequence
  Description of Artificial Sequence: Synthetic oligonucleotide
atactcatatgccttctgtggttggcgtccttg

SEQ ID NO: 107049 - DNA, 32 bp, Artificial Sequence
  Description of Artificial Sequence: Synthetic oligonucleotide
tactcatatgccttctgtggttggcgtccttg

SEQ ID NO: 107050 - DNA, 31 bp, Artificial Sequence
  Description of Artificial Sequence: Synthetic oligonucleotide
actcatatgccttctgtggttggcgtccttg

SEQ ID NO: 107051 - DNA, 30 bp, Artificial Sequence
  Description of Artificial Sequence: Synthetic oligonucleotide
ctcatatgccttctgtggttggcgtccttg

SEQ ID NO: 107052 - DNA, 36 bp, Artificial Sequence
  Description of Artificial Sequence: Synthetic oligonucleotide
tcatatgccttctgtggttggcgtccttgtatttac

SEQ ID NO: 107053 - DNA, 35 bp, Artificial Sequence
  Description of Artificial Sequence: Synthetic oligonucleotide
catatgccttctgtggttggcgtccttgtatttac

SEQ ID NO: 107054 - DNA, 35 bp, Artificial Sequence
  Description of Artificial Sequence: Synthetic oligonucleotide
atatgccttctgtggttggcgtccttgtatttacc

SEQ ID NO: 107055 - DNA, 34 bp, Artificial Sequence
  Description of Artificial Sequence: Synthetic oligonucleotide
tatgccttctgtggttggcgtccttgtatttacc

SEQ ID NO: 107056 - DNA, 33 bp, Artificial Sequence
  Description of Artificial Sequence: Synthetic oligonucleotide
atgccttctgtggttggcgtccttgtatttacc

SEQ ID NO: 107057 - DNA, 32 bp, Artificial Sequence
  Description of Artificial Sequence: Synthetic oligonucleotide
tgccttctgtggttggcgtccttgtatttacc

SEQ ID NO: 107058 - DNA, 31 bp, Artificial Sequence
  Description of Artificial Sequence: Synthetic oligonucleotide
gccttctgtggttggcgtccttgtatttacc

SEQ ID NO: 107059 - DNA, 31 bp, Artificial Sequence
  Description of Artificial Sequence: Synthetic oligonucleotide
ccttctgtggttggcgtccttgtatttaccc

SEQ ID NO: 107060 - DNA, 32 bp, Artificial Sequence
  Description of Artificial Sequence: Synthetic oligonucleotide
cttctgtggttggcgtccttgtatttacccag

SEQ ID NO: 107061 - DNA, 36 bp, Artificial Sequence
  Description of Artificial Sequence: Synthetic oligonucleotide
ttctgtggttggcgtccttgtatttacccagttttg

SEQ ID NO: 107062 - DNA, 35 bp, Artificial Sequence
  Description of Artificial Sequence: Synthetic oligonucleotide
tctgtggttggcgtccttgtatttacccagttttg

SEQ ID NO: 107063 - DNA, 34 bp, Artificial Sequence
  Description of Artificial Sequence: Synthetic oligonucleotide
ctgtggttggcgtccttgtatttacccagttttg

SEQ ID NO: 107064 - DNA, 34 bp, Artificial Sequence
  Description of Artificial Sequence: Synthetic oligonucleotide
tgtggttggcgtccttgtatttacccagttttgg

SEQ ID NO: 107065 - DNA, 33 bp, Artificial Sequence
  Description of Artificial Sequence: Synthetic oligonucleotide
gtggttggcgtccttgtatttacccagttttgg

SEQ ID NO: 107066 - DNA, 35 bp, Artificial Sequence
  Description of Artificial Sequence: Synthetic oligonucleotide
tggttggcgtccttgtatttacccagttttggttc

SEQ ID NO: 107067 - DNA, 34 bp, Artificial Sequence
  Description of Artificial Sequence: Synthetic oligonucleotide
ggttggcgtccttgtatttacccagttttggttc

SEQ ID NO: 107068 - DNA, 35 bp, Artificial Sequence
  Description of Artificial Sequence: Synthetic oligonucleotide
gttggcgtccttgtatttacccagttttggttctg

SEQ ID NO: 107069 - DNA, 35 bp, Artificial Sequence
  Description of Artificial Sequence: Synthetic oligonucleotide
ttggcgtccttgtatttacccagttttggttctgg

SEQ ID NO: 107070 - DNA, 34 bp, Artificial Sequence
  Description of Artificial Sequence: Synthetic oligonucleotide
tggcgtccttgtatttacccagttttggttctgg

SEQ ID NO: 107071 - DNA, 33 bp, Artificial Sequence
  Description of Artificial Sequence: Synthetic oligonucleotide
ggcgtccttgtatttacccagttttggttctgg

SEQ ID NO: 107072 - DNA, 36 bp, Artificial Sequence
  Description of Artificial Sequence: Synthetic oligonucleotide
gcgtccttgtatttacccagttttggttctggtttc

SEQ ID NO: 107073 - DNA, 36 bp, Artificial Sequence
  Description of Artificial Sequence: Synthetic oligonucleotide
cgtccttgtatttacccagttttggttctggtttcc

SEQ ID NO: 107074 - DNA, 37 bp, Artificial Sequence
  Description of Artificial Sequence: Synthetic oligonucleotide
gtccttgtatttacccagttttggttctggtttcctc

SEQ ID NO: 107075 - DNA, 40 bp, Artificial Sequence
  Description of Artificial Sequence: Synthetic oligonucleotide
tccttgtatttacccagttttggttctggtttcctctttc

SEQ ID NO: 107076 - DNA, 39 bp, Artificial Sequence
  Description of Artificial Sequence: Synthetic oligonucleotide
ccttgtatttacccagttttggttctggtttcctctttc

SEQ ID NO: 107077 - DNA, 40 bp, Artificial Sequence
  Description of Artificial Sequence: Synthetic oligonucleotide
cttgtatttacccagttttggttctggtttcctctttcac

SEQ ID NO: 107078 - DNA, 41 bp, Artificial Sequence
  Description of Artificial Sequence: Synthetic oligonucleotide
ttgtatttacccagttttggttctggtttcctctttcacac

SEQ ID NO: 107079 - DNA, 40 bp, Artificial Sequence
  Description of Artificial Sequence: Synthetic oligonucleotide
tgtatttacccagttttggttctggtttcctctttcacac

SEQ ID NO: 107080 - DNA, 39 bp, Artificial Sequence
  Description of Artificial Sequence: Synthetic oligonucleotide
gtatttacccagttttggttctggtttcctctttcacac

SEQ ID NO: 107081 - DNA, 41 bp, Artificial Sequence
  Description of Artificial Sequence: Synthetic oligonucleotide
tatttacccagttttggttctggtttcctctttcacacttc

SEQ ID NO: 107082 - DNA, 40 bp, Artificial Sequence
  Description of Artificial Sequence: Synthetic oligonucleotide
atttacccagttttggttctggtttcctctttcacacttc

SEQ ID NO: 107083 - DNA, 39 bp, Artificial Sequence
  Description of Artificial Sequence: Synthetic oligonucleotide
tttacccagttttggttctggtttcctctttcacacttc

SEQ ID NO: 107084 - DNA, 38 bp, Artificial Sequence
  Description of Artificial Sequence: Synthetic oligonucleotide
ttacccagttttggttctggtttcctctttcacacttc

SEQ ID NO: 107085 - DNA, 37 bp, Artificial Sequence
  Description of Artificial Sequence: Synthetic oligonucleotide
tacccagttttggttctggtttcctctttcacacttc

SEQ ID NO: 107086 - DNA, 36 bp, Artificial Sequence
  Description of Artificial Sequence: Synthetic oligonucleotide
acccagttttggttctggtttcctctttcacacttc

SEQ ID NO: 107087 - DNA, 35 bp, Artificial Sequence
  Description of Artificial Sequence: Synthetic oligonucleotide
cccagttttggttctggtttcctctttcacacttc

SEQ ID NO: 107088 - DNA, 35 bp, Artificial Sequence
  Description of Artificial Sequence: Synthetic oligonucleotide
ccagttttggttctggtttcctctttcacacttcc

SEQ ID NO: 107089 - DNA, 36 bp, Artificial Sequence
  Description of Artificial Sequence: Synthetic oligonucleotide
cagttttggttctggtttcctctttcacacttcctg

SEQ ID NO: 107090 - DNA, 37 bp, Artificial Sequence
  Description of Artificial Sequence: Synthetic oligonucleotide
agttttggttctggtttcctctttcacacttcctgtc

SEQ ID NO: 107091 - DNA, 36 bp, Artificial Sequence
  Description of Artificial Sequence: Synthetic oligonucleotide
gttttggttctggtttcctctttcacacttcctgtc

SEQ ID NO: 107092 - DNA, 39 bp, Artificial Sequence
  Description of Artificial Sequence: Synthetic oligonucleotide
ttttggttctggtttcctctttcacacttcctgtcattg

SEQ ID NO: 107093 - DNA, 38 bp, Artificial Sequence
  Description of Artificial Sequence: Synthetic oligonucleotide
tttggttctggtttcctctttcacacttcctgtcattg

SEQ ID NO: 107094 - DNA, 37 bp, Artificial Sequence
  Description of Artificial Sequence: Synthetic oligonucleotide
ttggttctggtttcctctttcacacttcctgtcattg

SEQ ID NO: 107095 - DNA, 36 bp, Artificial Sequence
  Description of Artificial Sequence: Synthetic oligonucleotide
tggttctggtttcctctttcacacttcctgtcattg

SEQ ID NO: 107096 - DNA, 35 bp, Artificial Sequence
  Description of Artificial Sequence: Synthetic oligonucleotide
ggttctggtttcctctttcacacttcctgtcattg

SEQ ID NO: 107097 - DNA, 35 bp, Artificial Sequence
  Description of Artificial Sequence: Synthetic oligonucleotide
gttctggtttcctctttcacacttcctgtcattgg

SEQ ID NO: 107098 - DNA, 35 bp, Artificial Sequence
  Description of Artificial Sequence: Synthetic oligonucleotide
ttctggtttcctctttcacacttcctgtcattggc

SEQ ID NO: 107099 - DNA, 34 bp, Artificial Sequence
  Description of Artificial Sequence: Synthetic oligonucleotide
tctggtttcctctttcacacttcctgtcattggc

SEQ ID NO: 107100 - DNA, 33 bp, Artificial Sequence
  Description of Artificial Sequence: Synthetic oligonucleotide
ctggtttcctctttcacacttcctgtcattggc

SEQ ID NO: 107101 - DNA, 38 bp, Artificial Sequence
  Description of Artificial Sequence: Synthetic oligonucleotide
tggtttcctctttcacacttcctgtcattggcttatac

SEQ ID NO: 107102 - DNA, 37 bp, Artificial Sequence
  Description of Artificial Sequence: Synthetic oligonucleotide
ggtttcctctttcacacttcctgtcattggcttatac

SEQ ID NO: 107103 - DNA, 37 bp, Artificial Sequence
  Description of Artificial Sequence: Synthetic oligonucleotide
gtttcctctttcacacttcctgtcattggcttatacc

SEQ ID NO: 107104 - DNA, 37 bp, Artificial Sequence
  Description of Artificial Sequence: Synthetic oligonucleotide
tttcctctttcacacttcctgtcattggcttataccc

SEQ ID NO: 107105 - DNA, 36 bp, Artificial Sequence
  Description of Artificial Sequence: Synthetic oligonucleotide
ttcctctttcacacttcctgtcattggcttataccc

SEQ ID NO: 107106 - DNA, 35 bp, Artificial Sequence
  Description of Artificial Sequence: Synthetic oligonucleotide
tcctctttcacacttcctgtcattggcttataccc

SEQ ID NO: 107107 - DNA, 34 bp, Artificial Sequence
  Description of Artificial Sequence: Synthetic oligonucleotide
cctctttcacacttcctgtcattggcttataccc

SEQ ID NO: 107108 - DNA, 34 bp, Artificial Sequence
  Description of Artificial Sequence: Synthetic oligonucleotide
ctctttcacacttcctgtcattggcttatacccc

SEQ ID NO: 107109 - DNA, 36 bp, Artificial Sequence
  Description of Artificial Sequence: Synthetic oligonucleotide
tctttcacacttcctgtcattggcttatacccctac

SEQ ID NO: 107110 - DNA, 35 bp, Artificial Sequence
  Description of Artificial Sequence: Synthetic oligonucleotide
ctttcacacttcctgtcattggcttatacccctac

SEQ ID NO: 107111 - DNA, 35 bp, Artificial Sequence
  Description of Artificial Sequence: Synthetic oligonucleotide
tttcacacttcctgtcattggcttatacccctacc

SEQ ID NO: 107112 - DNA, 34 bp, Artificial Sequence
  Description of Artificial Sequence: Synthetic oligonucleotide
ttcacacttcctgtcattggcttatacccctacc

SEQ ID NO: 107113 - DNA, 33 bp, Artificial Sequence
  Description of Artificial Sequence: Synthetic oligonucleotide
tcacacttcctgtcattggcttatacccctacc

SEQ ID NO: 107114 - DNA, 32 bp, Artificial Sequence
  Description of Artificial Sequence: Synthetic oligonucleotide
cacacttcctgtcattggcttatacccctacc

SEQ ID NO: 107115 - DNA, 33 bp, Artificial Sequence
  Description of Artificial Sequence: Synthetic oligonucleotide
acacttcctgtcattggcttatacccctacctg

SEQ ID NO: 107116 - DNA, 32 bp, Artificial Sequence
  Description of Artificial Sequence: Synthetic oligonucleotide
cacttcctgtcattggcttatacccctacctg

SEQ ID NO: 107117 - DNA, 33 bp, Artificial Sequence
  Description of Artificial Sequence: Synthetic oligonucleotide
acttcctgtcattggcttatacccctacctgtg

SEQ ID NO: 107118 - DNA, 32 bp, Artificial Sequence
  Description of Artificial Sequence: Synthetic oligonucleotide
cttcctgtcattggcttatacccctacctgtg

SEQ ID NO: 107119 - DNA, 33 bp, Artificial Sequence
  Description of Artificial Sequence: Synthetic oligonucleotide
ttcctgtcattggcttatacccctacctgtgtc

SEQ ID NO: 107120 - DNA, 32 bp, Artificial Sequence
  Description of Artificial Sequence: Synthetic oligonucleotide
tcctgtcattggcttatacccctacctgtgtc

SEQ ID NO: 107121 - DNA, 31 bp, Artificial Sequence
  Description of Artificial Sequence: Synthetic oligonucleotide
cctgtcattggcttatacccctacctgtgtc

SEQ ID NO: 107122 - DNA, 34 bp, Artificial Sequence
  Description of Artificial Sequence: Synthetic oligonucleotide
ctgtcattggcttatacccctacctgtgtcattg

SEQ ID NO: 107123 - DNA, 34 bp, Artificial Sequence
  Description of Artificial Sequence: Synthetic oligonucleotide
tgtcattggcttatacccctacctgtgtcattgg

SEQ ID NO: 107124 - DNA, 33 bp, Artificial Sequence
  Description of Artificial Sequence: Synthetic oligonucleotide
gtcattggcttatacccctacctgtgtcattgg

SEQ ID NO: 107125 - DNA, 33 bp, Artificial Sequence
  Description of Artificial Sequence: Synthetic oligonucleotide
tcattggcttatacccctacctgtgtcattggc

SEQ ID NO: 107126 - DNA, 32 bp, Artificial Sequence
  Description of Artificial Sequence: Synthetic oligonucleotide
cattggcttatacccctacctgtgtcattggc

SEQ ID NO: 107127 - DNA, 32 bp, Artificial Sequence
  Description of Artificial Sequence: Synthetic oligonucleotide
attggcttatacccctacctgtgtcattggcc

SEQ ID NO: 107128 - DNA, 31 bp, Artificial Sequence
  Description of Artificial Sequence: Synthetic oligonucleotide
ttggcttatacccctacctgtgtcattggcc

SEQ ID NO: 107129 - DNA, 30 bp, Artificial Sequence
  Description of Artificial Sequence: Synthetic oligonucleotide
tggcttatacccctacctgtgtcattggcc

SEQ ID NO: 107130 - DNA, 29 bp, Artificial Sequence
  Description of Artificial Sequence: Synthetic oligonucleotide
ggcttatacccctacctgtgtcattggcc

SEQ ID NO: 107131 - DNA, 33 bp, Artificial Sequence
  Description of Artificial Sequence: Synthetic oligonucleotide
gcttatacccctacctgtgtcattggccttaac

SEQ ID NO: 107132 - DNA, 35 bp, Artificial Sequence
  Description of Artificial Sequence: Synthetic oligonucleotide
cttatacccctacctgtgtcattggccttaacaag

SEQ ID NO: 107133 - DNA, 35 bp, Artificial Sequence
  Description of Artificial Sequence: Synthetic oligonucleotide
ttatacccctacctgtgtcattggccttaacaagg

SEQ ID NO: 107134 - DNA, 34 bp, Artificial Sequence
  Description of Artificial Sequence: Synthetic oligonucleotide
tatacccctacctgtgtcattggccttaacaagg

SEQ ID NO: 107135 - DNA, 33 bp, Artificial Sequence
  Description of Artificial Sequence: Synthetic oligonucleotide
atacccctacctgtgtcattggccttaacaagg

SEQ ID NO: 107136 - DNA, 32 bp, Artificial Sequence
  Description of Artificial Sequence: Synthetic oligonucleotide
tacccctacctgtgtcattggccttaacaagg

SEQ ID NO: 107137 - DNA, 31 bp, Artificial Sequence
  Description of Artificial Sequence: Synthetic oligonucleotide
acccctacctgtgtcattggccttaacaagg

SEQ ID NO: 107138 - DNA, 30 bp, Artificial Sequence
  Description of Artificial Sequence: Synthetic oligonucleotide
cccctacctgtgtcattggccttaacaagg

SEQ ID NO: 107139 - DNA, 31 bp, Artificial Sequence
  Description of Artificial Sequence: Synthetic oligonucleotide
ccctacctgtgtcattggccttaacaaggac

SEQ ID NO: 107140 - DNA, 36 bp, Artificial Sequence
  Description of Artificial Sequence: Synthetic oligonucleotide
cctacctgtgtcattggccttaacaaggacttaaag

SEQ ID NO: 107141 - DNA, 38 bp, Artificial Sequence
  Description of Artificial Sequence: Synthetic oligonucleotide
ctacctgtgtcattggccttaacaaggacttaaagatg

SEQ ID NO: 107142 - DNA, 38 bp, Artificial Sequence
  Description of Artificial Sequence: Synthetic oligonucleotide
tacctgtgtcattggccttaacaaggacttaaagatgc

SEQ ID NO: 107143 - DNA, 37 bp, Artificial Sequence
  Description of Artificial Sequence: Synthetic oligonucleotide
acctgtgtcattggccttaacaaggacttaaagatgc

SEQ ID NO: 107144 - DNA, 36 bp, Artificial Sequence
  Description of Artificial Sequence: Synthetic oligonucleotide
cctgtgtcattggccttaacaaggacttaaagatgc

SEQ ID NO: 107145 - DNA, 36 bp, Artificial Sequence
  Description of Artificial Sequence: Synthetic oligonucleotide
ctgtgtcattggccttaacaaggacttaaagatgcc

SEQ ID NO: 107146 - DNA, 36 bp, Artificial Sequence
  Description of Artificial Sequence: Synthetic oligonucleotide
tgtgtcattggccttaacaaggacttaaagatgccg

SEQ ID NO: 107147 - DNA, 35 bp, Artificial Sequence
  Description of Artificial Sequence: Synthetic oligonucleotide
gtgtcattggccttaacaaggacttaaagatgccg

SEQ ID NO: 107148 - DNA, 38 bp, Artificial Sequence
  Description of Artificial Sequence: Synthetic oligonucleotide
tgtcattggccttaacaaggacttaaagatgccgaaag

SEQ ID NO: 107149 - DNA, 37 bp, Artificial Sequence
  Description of Artificial Sequence: Synthetic oligonucleotide
gtcattggccttaacaaggacttaaagatgccgaaag

SEQ ID NO: 107150 - DNA, 39 bp, Artificial Sequence
  Description of Artificial Sequence: Synthetic oligonucleotide
tcattggccttaacaaggacttaaagatgccgaaagttc

SEQ ID NO: 107151 - DNA, 38 bp, Artificial Sequence
  Description of Artificial Sequence: Synthetic oligonucleotide
cattggccttaacaaggacttaaagatgccgaaagttc

SEQ ID NO: 107152 - DNA, 39 bp, Artificial Sequence
  Description of Artificial Sequence: Synthetic oligonucleotide
attggccttaacaaggacttaaagatgccgaaagttcag

SEQ ID NO: 107153 - DNA, 38 bp, Artificial Sequence
  Description of Artificial Sequence: Synthetic oligonucleotide
ttggccttaacaaggacttaaagatgccgaaagttcag

SEQ ID NO: 107154 - DNA, 37 bp, Artificial Sequence
  Description of Artificial Sequence: Synthetic oligonucleotide
tggccttaacaaggacttaaagatgccgaaagttcag

SEQ ID NO: 107155 - DNA, 36 bp, Artificial Sequence
  Description of Artificial Sequence: Synthetic oligonucleotide
ggccttaacaaggacttaaagatgccgaaagttcag

SEQ ID NO: 107156 - DNA, 43 bp, Artificial Sequence
  Description of Artificial Sequence: Synthetic oligonucleotide
gccttaacaaggacttaaagatgccgaaagttcagtataaatc

SEQ ID NO: 107157 - DNA, 43 bp, Artificial Sequence
  Description of Artificial Sequence: Synthetic oligonucleotide
ccttaacaaggacttaaagatgccgaaagttcagtataaatcg

SEQ ID NO: 107158 - DNA, 45 bp, Artificial Sequence
  Description of Artificial Sequence: Synthetic oligonucleotide
cttaacaaggacttaaagatgccgaaagttcagtataaatcgaac

SEQ ID NO: 107159 - DNA, 46 bp, Artificial Sequence
  Description of Artificial Sequence: Synthetic oligonucleotide
ttaacaaggacttaaagatgccgaaagttcagtataaatcgaactg

SEQ ID NO: 107160 - DNA, 45 bp, Artificial Sequence
  Description of Artificial Sequence: Synthetic oligonucleotide
taacaaggacttaaagatgccgaaagttcagtataaatcgaactg

SEQ ID NO: 107161 - DNA, 44 bp, Artificial Sequence
  Description of Artificial Sequence: Synthetic oligonucleotide
aacaaggacttaaagatgccgaaagttcagtataaatcgaactg

SEQ ID NO: 107162 - DNA, 43 bp, Artificial Sequence
  Description of Artificial Sequence: Synthetic oligonucleotide
acaaggacttaaagatgccgaaagttcagtataaatcgaactg

SEQ ID NO: 107163 - DNA, 42 bp, Artificial Sequence
  Description of Artificial Sequence: Synthetic oligonucleotide
caaggacttaaagatgccgaaagttcagtataaatcgaactg

SEQ ID NO: 107164 - DNA, 46 bp, Artificial Sequence
  Description of Artificial Sequence: Synthetic oligonucleotide
aaggacttaaagatgccgaaagttcagtataaatcgaactgtaaac

SEQ ID NO: 107165 - DNA, 45 bp, Artificial Sequence
  Description of Artificial Sequence: Synthetic oligonucleotide
aggacttaaagatgccgaaagttcagtataaatcgaactgtaaac

SEQ ID NO: 107166 - DNA, 44 bp, Artificial Sequence
  Description of Artificial Sequence: Synthetic oligonucleotide
ggacttaaagatgccgaaagttcagtataaatcgaactgtaaac

SEQ ID NO: 107167 - DNA, 44 bp, Artificial Sequence
  Description of Artificial Sequence: Synthetic oligonucleotide
gacttaaagatgccgaaagttcagtataaatcgaactgtaaacc

SEQ ID NO: 107168 - DNA, 46 bp, Artificial Sequence
  Description of Artificial Sequence: Synthetic oligonucleotide
acttaaagatgccgaaagttcagtataaatcgaactgtaaaccatc

SEQ ID NO: 107169 - DNA, 45 bp, Artificial Sequence
  Description of Artificial Sequence: Synthetic oligonucleotide
cttaaagatgccgaaagttcagtataaatcgaactgtaaaccatc

SEQ ID NO: 107170 - DNA, 45 bp, Artificial Sequence
  Description of Artificial Sequence: Synthetic oligonucleotide
ttaaagatgccgaaagttcagtataaatcgaactgtaaaccatcc

SEQ ID NO: 107171 - DNA, 44 bp, Artificial Sequence
  Description of Artificial Sequence: Synthetic oligonucleotide
taaagatgccgaaagttcagtataaatcgaactgtaaaccatcc

SEQ ID NO: 107172 - DNA, 43 bp, Artificial Sequence
  Description of Artificial Sequence: Synthetic oligonucleotide
aaagatgccgaaagttcagtataaatcgaactgtaaaccatcc

SEQ ID NO: 107173 - DNA, 42 bp, Artificial Sequence
  Description of Artificial Sequence: Synthetic oligonucleotide
aagatgccgaaagttcagtataaatcgaactgtaaaccatcc

SEQ ID NO: 107174 - DNA, 41 bp, Artificial Sequence
  Description of Artificial Sequence: Synthetic oligonucleotide
agatgccgaaagttcagtataaatcgaactgtaaaccatcc

SEQ ID NO: 107175 - DNA, 40 bp, Artificial Sequence
  Description of Artificial Sequence: Synthetic oligonucleotide
gatgccgaaagttcagtataaatcgaactgtaaaccatcc

SEQ ID NO: 107176 - DNA, 41 bp, Artificial Sequence
  Description of Artificial Sequence: Synthetic oligonucleotide
atgccgaaagttcagtataaatcgaactgtaaaccatccac

SEQ ID NO: 107177 - DNA, 40 bp, Artificial Sequence
  Description of Artificial Sequence: Synthetic oligonucleotide
tgccgaaagttcagtataaatcgaactgtaaaccatccac

SEQ ID NO: 107178 - DNA, 39 bp, Artificial Sequence
  Description of Artificial Sequence: Synthetic oligonucleotide
gccgaaagttcagtataaatcgaactgtaaaccatccac

SEQ ID NO: 107179 - DNA, 43 bp, Artificial Sequence
  Description of Artificial Sequence: Synthetic oligonucleotide
ccgaaagttcagtataaatcgaactgtaaaccatccacatttg

SEQ ID NO: 107180 - DNA, 43 bp, Artificial Sequence
  Description of Artificial Sequence: Synthetic oligonucleotide
cgaaagttcagtataaatcgaactgtaaaccatccacatttgc

SEQ ID NO: 107181 - DNA, 47 bp, Artificial Sequence
  Description of Artificial Sequence: Synthetic oligonucleotide
gaaagttcagtataaatcgaactgtaaaccatccacatttgcatatc

SEQ ID NO: 107182 - DNA, 47 bp, Artificial Sequence
  Description of Artificial Sequence: Synthetic oligonucleotide
aaagttcagtataaatcgaactgtaaaccatccacatttgcatatcc

SEQ ID NO: 107183 - DNA, 46 bp, Artificial Sequence
  Description of Artificial Sequence: Synthetic oligonucleotide
aagttcagtataaatcgaactgtaaaccatccacatttgcatatcc

SEQ ID NO: 107184 - DNA, 45 bp, Artificial Sequence
  Description of Artificial Sequence: Synthetic oligonucleotide
agttcagtataaatcgaactgtaaaccatccacatttgcatatcc

SEQ ID NO: 107185 - DNA, 44 bp, Artificial Sequence
  Description of Artificial Sequence: Synthetic oligonucleotide
gttcagtataaatcgaactgtaaaccatccacatttgcatatcc

SEQ ID NO: 107186 - DNA, 45 bp, Artificial Sequence
  Description of Artificial Sequence: Synthetic oligonucleotide
ttcagtataaatcgaactgtaaaccatccacatttgcatatcctg

SEQ ID NO: 107187 - DNA, 44 bp, Artificial Sequence
  Description of Artificial Sequence: Synthetic oligonucleotide
tcagtataaatcgaactgtaaaccatccacatttgcatatcctg

SEQ ID NO: 107188 - DNA, 43 bp, Artificial Sequence
  Description of Artificial Sequence: Synthetic oligonucleotide
cagtataaatcgaactgtaaaccatccacatttgcatatcctg

SEQ ID NO: 107189 - DNA, 43 bp, Artificial Sequence
  Description of Artificial Sequence: Synthetic oligonucleotide
agtataaatcgaactgtaaaccatccacatttgcatatcctgc

SEQ ID NO: 107190 - DNA, 42 bp, Artificial Sequence
  Description of Artificial Sequence: Synthetic oligonucleotide
gtataaatcgaactgtaaaccatccacatttgcatatcctgc

SEQ ID NO: 107191 - DNA, 42 bp, Artificial Sequence
  Description of Artificial Sequence: Synthetic oligonucleotide
tataaatcgaactgtaaaccatccacatttgcatatcctgcc

SEQ ID NO: 107192 - DNA, 41 bp, Artificial Sequence
  Description of Artificial Sequence: Synthetic oligonucleotide
ataaatcgaactgtaaaccatccacatttgcatatcctgcc

SEQ ID NO: 107193 - DNA, 40 bp, Artificial Sequence
  Description of Artificial Sequence: Synthetic oligonucleotide
taaatcgaactgtaaaccatccacatttgcatatcctgcc

SEQ ID NO: 107194 - DNA, 39 bp, Artificial Sequence
  Description of Artificial Sequence: Synthetic oligonucleotide
aaatcgaactgtaaaccatccacatttgcatatcctgcc

SEQ ID NO: 107195 - DNA, 38 bp, Artificial Sequence
  Description of Artificial Sequence: Synthetic oligonucleotide
aatcgaactgtaaaccatccacatttgcatatcctgcc

SEQ ID NO: 107196 - DNA, 37 bp, Artificial Sequence
  Description of Artificial Sequence: Synthetic oligonucleotide
atcgaactgtaaaccatccacatttgcatatcctgcc

SEQ ID NO: 107197 - DNA, 36 bp, Artificial Sequence
  Description of Artificial Sequence: Synthetic oligonucleotide
tcgaactgtaaaccatccacatttgcatatcctgcc

SEQ ID NO: 107198 - DNA, 35 bp, Artificial Sequence
  Description of Artificial Sequence: Synthetic oligonucleotide
cgaactgtaaaccatccacatttgcatatcctgcc

SEQ ID NO: 107199 - DNA, 35 bp, Artificial Sequence
  Description of Artificial Sequence: Synthetic oligonucleotide
gaactgtaaaccatccacatttgcatatcctgccc

SEQ ID NO: 107200 - DNA, 35 bp, Artificial Sequence
  Description of Artificial Sequence: Synthetic oligonucleotide
aactgtaaaccatccacatttgcatatcctgcccc

SEQ ID NO: 107201 - DNA, 34 bp, Artificial Sequence
  Description of Artificial Sequence: Synthetic oligonucleotide
actgtaaaccatccacatttgcatatcctgcccc

SEQ ID NO: 107202 - DNA, 33 bp, Artificial Sequence
  Description of Artificial Sequence: Synthetic oligonucleotide
ctgtaaaccatccacatttgcatatcctgcccc

SEQ ID NO: 107203 - DNA, 34 bp, Artificial Sequence
  Description of Artificial Sequence: Synthetic oligonucleotide
tgtaaaccatccacatttgcatatcctgcccctc

SEQ ID NO: 107204 - DNA, 33 bp, Artificial Sequence
  Description of Artificial Sequence: Synthetic oligonucleotide
gtaaaccatccacatttgcatatcctgcccctc

SEQ ID NO: 107205 - DNA, 34 bp, Artificial Sequence
  Description of Artificial Sequence: Synthetic oligonucleotide
taaaccatccacatttgcatatcctgcccctctg

SEQ ID NO: 107206 - DNA, 33 bp, Artificial Sequence
  Description of Artificial Sequence: Synthetic oligonucleotide
aaaccatccacatttgcatatcctgcccctctg

SEQ ID NO: 107207 - DNA, 32 bp, Artificial Sequence
  Description of Artificial Sequence: Synthetic oligonucleotide
aaccatccacatttgcatatcctgcccctctg

SEQ ID NO: 107208 - DNA, 31 bp, Artificial Sequence
  Description of Artificial Sequence: Synthetic oligonucleotide
accatccacatttgcatatcctgcccctctg

SEQ ID NO: 107209 - DNA, 30 bp, Artificial Sequence
  Description of Artificial Sequence: Synthetic oligonucleotide
ccatccacatttgcatatcctgcccctctg

SEQ ID NO: 107210 - DNA, 30 bp, Artificial Sequence
  Description of Artificial Sequence: Synthetic oligonucleotide
catccacatttgcatatcctgcccctctgg

SEQ ID NO: 107211 - DNA, 32 bp, Artificial Sequence
  Description of Artificial Sequence: Synthetic oligonucleotide
atccacatttgcatatcctgcccctctggaag

SEQ ID NO: 107212 - DNA, 31 bp, Artificial Sequence
  Description of Artificial Sequence: Synthetic oligonucleotide
tccacatttgcatatcctgcccctctggaag

SEQ ID NO: 107213 - DNA, 30 bp, Artificial Sequence
  Description of Artificial Sequence: Synthetic oligonucleotide
ccacatttgcatatcctgcccctctggaag

SEQ ID NO: 107214 - DNA, 32 bp, Artificial Sequence
  Description of Artificial Sequence: Synthetic oligonucleotide
cacatttgcatatcctgcccctctggaagtac

SEQ ID NO: 107215 - DNA, 32 bp, Artificial Sequence
  Description of Artificial Sequence: Synthetic oligonucleotide
acatttgcatatcctgcccctctggaagtacc

SEQ ID NO: 107216 - DNA, 31 bp, Artificial Sequence
  Description of Artificial Sequence: Synthetic oligonucleotide
catttgcatatcctgcccctctggaagtacc

SEQ ID NO: 107217 - DNA, 35 bp, Artificial Sequence
  Description of Artificial Sequence: Synthetic oligonucleotide
atttgcatatcctgcccctctggaagtaccaaaag

SEQ ID NO: 107218 - DNA, 34 bp, Artificial Sequence
  Description of Artificial Sequence: Synthetic oligonucleotide
tttgcatatcctgcccctctggaagtaccaaaag

SEQ ID NO: 107219 - DNA, 33 bp, Artificial Sequence
  Description of Artificial Sequence: Synthetic oligonucleotide
ttgcatatcctgcccctctggaagtaccaaaag

SEQ ID NO: 107220 - DNA, 32 bp, Artificial Sequence
  Description of Artificial Sequence: Synthetic oligonucleotide
tgcatatcctgcccctctggaagtaccaaaag

SEQ ID NO: 107221 - DNA, 31 bp, Artificial Sequence
  Description of Artificial Sequence: Synthetic oligonucleotide
gcatatcctgcccctctggaagtaccaaaag

SEQ ID NO: 107222 - DNA, 36 bp, Artificial Sequence
  Description of Artificial Sequence: Synthetic oligonucleotide
catatcctgcccctctggaagtaccaaaagaaaaag

SEQ ID NO: 107223 - DNA, 40 bp, Artificial Sequence
  Description of Artificial Sequence: Synthetic oligonucleotide
atatcctgcccctctggaagtaccaaaagaaaaagaaaag

SEQ ID NO: 107224 - DNA, 39 bp, Artificial Sequence
  Description of Artificial Sequence: Synthetic oligonucleotide
tatcctgcccctctggaagtaccaaaagaaaaagaaaag

SEQ ID NO: 107225 - DNA, 38 bp, Artificial Sequence
  Description of Artificial Sequence: Synthetic oligonucleotide
atcctgcccctctggaagtaccaaaagaaaaagaaaag

SEQ ID NO: 107226 - DNA, 37 bp, Artificial Sequence
  Description of Artificial Sequence: Synthetic oligonucleotide
tcctgcccctctggaagtaccaaaagaaaaagaaaag

SEQ ID NO: 107227 - DNA, 36 bp, Artificial Sequence
  Description of Artificial Sequence: Synthetic oligonucleotide
cctgcccctctggaagtaccaaaagaaaaagaaaag

SEQ ID NO: 107228 - DNA, 36 bp, Artificial Sequence
  Description of Artificial Sequence: Synthetic oligonucleotide
ctgcccctctggaagtaccaaaagaaaaagaaaagg

SEQ ID NO: 107229 - DNA, 40 bp, Artificial Sequence
  Description of Artificial Sequence: Synthetic oligonucleotide
tgcccctctggaagtaccaaaagaaaaagaaaaggaaaag

SEQ ID NO: 107230 - DNA, 39 bp, Artificial Sequence
  Description of Artificial Sequence: Synthetic oligonucleotide
gcccctctggaagtaccaaaagaaaaagaaaaggaaaag

SEQ ID NO: 107231 - DNA, 39 bp, Artificial Sequence
  Description of Artificial Sequence: Synthetic oligonucleotide
cccctctggaagtaccaaaagaaaaagaaaaggaaaagg

SEQ ID NO: 107232 - DNA, 42 bp, Artificial Sequence
  Description of Artificial Sequence: Synthetic oligonucleotide
ccctctggaagtaccaaaagaaaaagaaaaggaaaaggtttc

SEQ ID NO: 107233 - DNA, 44 bp, Artificial Sequence
  Description of Artificial Sequence: Synthetic oligonucleotide
cctctggaagtaccaaaagaaaaagaaaaggaaaaggtttctac

SEQ ID NO: 107234 - DNA, 45 bp, Artificial Sequence
  Description of Artificial Sequence: Synthetic oligonucleotide
ctctggaagtaccaaaagaaaaagaaaaggaaaaggtttctactg

SEQ ID NO: 107235 - DNA, 45 bp, Artificial Sequence
  Description of Artificial Sequence: Synthetic oligonucleotide
tctggaagtaccaaaagaaaaagaaaaggaaaaggtttctactgc

SEQ ID NO: 107236 - DNA, 44 bp, Artificial Sequence
  Description of Artificial Sequence: Synthetic oligonucleotide
ctggaagtaccaaaagaaaaagaaaaggaaaaggtttctactgc

SEQ ID NO: 107237 - DNA, 45 bp, Artificial Sequence
  Description of Artificial Sequence: Synthetic oligonucleotide
tggaagtaccaaaagaaaaagaaaaggaaaaggtttctactgctg

SEQ ID NO: 107238 - DNA, 44 bp, Artificial Sequence
  Description of Artificial Sequence: Synthetic oligonucleotide
ggaagtaccaaaagaaaaagaaaaggaaaaggtttctactgctg

SEQ ID NO: 107239 - DNA, 50 bp, Artificial Sequence
  Description of Artificial Sequence: Synthetic oligonucleotide
gaagtaccaaaagaaaaagaaaaggaaaaggtttctactgctgtattatc

SEQ ID NO: 107240 - DNA, 55 bp, Artificial Sequence
  Description of Artificial Sequence: Synthetic oligonucleotide
aagtaccaaaagaaaaagaaaaggaaaaggtttctactgctgtattatctataac

SEQ ID NO: 107241 - DNA, 54 bp, Artificial Sequence
  Description of Artificial Sequence: Synthetic oligonucleotide
agtaccaaaagaaaaagaaaaggaaaaggtttctactgctgtattatctataac

SEQ ID NO: 107242 - DNA, 53 bp, Artificial Sequence
  Description of Artificial Sequence: Synthetic oligonucleotide
gtaccaaaagaaaaagaaaaggaaaaggtttctactgctgtattatctataac

SEQ ID NO: 107243 - DNA, 54 bp, Artificial Sequence
  Description of Artificial Sequence: Synthetic oligonucleotide
taccaaaagaaaaagaaaaggaaaaggtttctactgctgtattatctataactg

SEQ ID NO: 107244 - DNA, 53 bp, Artificial Sequence
  Description of Artificial Sequence: Synthetic oligonucleotide
accaaaagaaaaagaaaaggaaaaggtttctactgctgtattatctataactg

SEQ ID NO: 107245 - DNA, 52 bp, Artificial Sequence
  Description of Artificial Sequence: Synthetic oligonucleotide
ccaaaagaaaaagaaaaggaaaaggtttctactgctgtattatctataactg

SEQ ID NO: 107246 - DNA, 52 bp, Artificial Sequence
  Description of Artificial Sequence: Synthetic oligonucleotide
caaaagaaaaagaaaaggaaaaggtttctactgctgtattatctataactgc

SEQ ID NO: 107247 - DNA, 52 bp, Artificial Sequence
  Description of Artificial Sequence: Synthetic oligonucleotide
aaaagaaaaagaaaaggaaaaggtttctactgctgtattatctataactgcc

SEQ ID NO: 107248 - DNA, 51 bp, Artificial Sequence
  Description of Artificial Sequence: Synthetic oligonucleotide
aaagaaaaagaaaaggaaaaggtttctactgctgtattatctataactgcc

SEQ ID NO: 107249 - DNA, 50 bp, Artificial Sequence
  Description of Artificial Sequence: Synthetic oligonucleotide
aagaaaaagaaaaggaaaaggtttctactgctgtattatctataactgcc

SEQ ID NO: 107250 - DNA, 49 bp, Artificial Sequence
  Description of Artificial Sequence: Synthetic oligonucleotide
agaaaaagaaaaggaaaaggtttctactgctgtattatctataactgcc

SEQ ID NO: 107251 - DNA, 48 bp, Artificial Sequence
  Description of Artificial Sequence: Synthetic oligonucleotide
gaaaaagaaaaggaaaaggtttctactgctgtattatctataactgcc

SEQ ID NO: 107252 - DNA, 50 bp, Artificial Sequence
  Description of Artificial Sequence: Synthetic oligonucleotide
aaaaagaaaaggaaaaggtttctactgctgtattatctataactgccaag

SEQ ID NO: 107253 - DNA, 49 bp, Artificial Sequence
  Description of Artificial Sequence: Synthetic oligonucleotide
aaaagaaaaggaaaaggtttctactgctgtattatctataactgccaag

SEQ ID NO: 107254 - DNA, 48 bp, Artificial Sequence
  Description of Artificial Sequence: Synthetic oligonucleotide
aaagaaaaggaaaaggtttctactgctgtattatctataactgccaag

SEQ ID NO: 107255 - DNA, 47 bp, Artificial Sequence
  Description of Artificial Sequence: Synthetic oligonucleotide
aagaaaaggaaaaggtttctactgctgtattatctataactgccaag

SEQ ID NO: 107256 - DNA, 46 bp, Artificial Sequence
  Description of Artificial Sequence: Synthetic oligonucleotide
agaaaaggaaaaggtttctactgctgtattatctataactgccaag

SEQ ID NO: 107257 - DNA, 45 bp, Artificial Sequence
  Description of Artificial Sequence: Synthetic oligonucleotide
gaaaaggaaaaggtttctactgctgtattatctataactgccaag

SEQ ID NO: 107258 - DNA, 45 bp, Artificial Sequence
  Description of Artificial Sequence: Synthetic oligonucleotide
aaaaggaaaaggtttctactgctgtattatctataactgccaagg

SEQ ID NO: 107259 - DNA, 44 bp, Artificial Sequence
  Description of Artificial Sequence: Synthetic oligonucleotide
aaaggaaaaggtttctactgctgtattatctataactgccaagg

SEQ ID NO: 107260 - DNA, 43 bp, Artificial Sequence
  Description of Artificial Sequence: Synthetic oligonucleotide
aaggaaaaggtttctactgctgtattatctataactgccaagg

SEQ ID NO: 107261 - DNA, 42 bp, Artificial Sequence
  Description of Artificial Sequence: Synthetic oligonucleotide
aggaaaaggtttctactgctgtattatctataactgccaagg

SEQ ID NO: 107262 - DNA, 41 bp, Artificial Sequence
  Description of Artificial Sequence: Synthetic oligonucleotide
ggaaaaggtttctactgctgtattatctataactgccaagg

SEQ ID NO: 107263 - DNA, 41 bp, Artificial Sequence
  Description of Artificial Sequence: Synthetic oligonucleotide
gaaaaggtttctactgctgtattatctataactgccaaggc

SEQ ID NO: 107264 - DNA, 47 bp, Artificial Sequence
  Description of Artificial Sequence: Synthetic oligonucleotide
aaaaggtttctactgctgtattatctataactgccaaggctaaaaag

SEQ ID NO: 107265 - DNA, 46 bp, Artificial Sequence
  Description of Artificial Sequence: Synthetic oligonucleotide
aaaggtttctactgctgtattatctataactgccaaggctaaaaag

SEQ ID NO: 107266 - DNA, 45 bp, Artificial Sequence
  Description of Artificial Sequence: Synthetic oligonucleotide
aaggtttctactgctgtattatctataactgccaaggctaaaaag

SEQ ID NO: 107267 - DNA, 44 bp, Artificial Sequence
  Description of Artificial Sequence: Synthetic oligonucleotide
aggtttctactgctgtattatctataactgccaaggctaaaaag

SEQ ID NO: 107268 - DNA, 43 bp, Artificial Sequence
  Description of Artificial Sequence: Synthetic oligonucleotide
ggtttctactgctgtattatctataactgccaaggctaaaaag

SEQ ID NO: 107269 - DNA, 45 bp, Artificial Sequence
  Description of Artificial Sequence: Synthetic oligonucleotide
gtttctactgctgtattatctataactgccaaggctaaaaagaag

SEQ ID NO: 107270 - DNA, 45 bp, Artificial Sequence
  Description of Artificial Sequence: Synthetic oligonucleotide
tttctactgctgtattatctataactgccaaggctaaaaagaagg

SEQ ID NO: 107271 - DNA, 44 bp, Artificial Sequence
  Description of Artificial Sequence: Synthetic oligonucleotide
ttctactgctgtattatctataactgccaaggctaaaaagaagg

SEQ ID NO: 107272 - DNA, 43 bp, Artificial Sequence
  Description of Artificial Sequence: Synthetic oligonucleotide
tctactgctgtattatctataactgccaaggctaaaaagaagg

SEQ ID NO: 107273 - DNA, 42 bp, Artificial Sequence
  Description of Artificial Sequence: Synthetic oligonucleotide
ctactgctgtattatctataactgccaaggctaaaaagaagg

SEQ ID NO: 107274 - DNA, 47 bp, Artificial Sequence
  Description of Artificial Sequence: Synthetic oligonucleotide
tactgctgtattatctataactgccaaggctaaaaagaaggaaaaag

SEQ ID NO: 107275 - DNA, 46 bp, Artificial Sequence
  Description of Artificial Sequence: Synthetic oligonucleotide
actgctgtattatctataactgccaaggctaaaaagaaggaaaaag

SEQ ID NO: 107276 - DNA, 45 bp, Artificial Sequence
  Description of Artificial Sequence: Synthetic oligonucleotide
ctgctgtattatctataactgccaaggctaaaaagaaggaaaaag

SEQ ID NO: 107277 - DNA, 49 bp, Artificial Sequence
  Description of Artificial Sequence: Synthetic oligonucleotide
tgctgtattatctataactgccaaggctaaaaagaaggaaaaagaaaag

SEQ ID NO: 107278 - DNA, 48 bp, Artificial Sequence
  Description of Artificial Sequence: Synthetic oligonucleotide
gctgtattatctataactgccaaggctaaaaagaaggaaaaagaaaag

SEQ ID NO: 107279 - DNA, 48 bp, Artificial Sequence
  Description of Artificial Sequence: Synthetic oligonucleotide
ctgtattatctataactgccaaggctaaaaagaaggaaaaagaaaagg

SEQ ID NO: 107280 - DNA, 55 bp, Artificial Sequence
  Description of Artificial Sequence: Synthetic oligonucleotide
tgtattatctataactgccaaggctaaaaagaaggaaaaagaaaaggaaaaaaag

SEQ ID NO: 107281 - DNA, 54 bp, Artificial Sequence
  Description of Artificial Sequence: Synthetic oligonucleotide
gtattatctataactgccaaggctaaaaagaaggaaaaagaaaaggaaaaaaag

SEQ ID NO: 107282 - DNA, 54 bp, Artificial Sequence
  Description of Artificial Sequence: Synthetic oligonucleotide
tattatctataactgccaaggctaaaaagaaggaaaaagaaaaggaaaaaaagg

SEQ ID NO: 107283 - DNA, 53 bp, Artificial Sequence
  Description of Artificial Sequence: Synthetic oligonucleotide
attatctataactgccaaggctaaaaagaaggaaaaagaaaaggaaaaaaagg

SEQ ID NO: 107284 - DNA, 52 bp, Artificial Sequence
  Description of Artificial Sequence: Synthetic oligonucleotide
ttatctataactgccaaggctaaaaagaaggaaaaagaaaaggaaaaaaagg

SEQ ID NO: 107285 - DNA, 51 bp, Artificial Sequence
  Description of Artificial Sequence: Synthetic oligonucleotide
tatctataactgccaaggctaaaaagaaggaaaaagaaaaggaaaaaaagg

SEQ ID NO: 107286 - DNA, 50 bp, Artificial Sequence
  Description of Artificial Sequence: Synthetic oligonucleotide
atctataactgccaaggctaaaaagaaggaaaaagaaaaggaaaaaaagg

SEQ ID NO: 107287 - DNA, 49 bp, Artificial Sequence
  Description of Artificial Sequence: Synthetic oligonucleotide
tctataactgccaaggctaaaaagaaggaaaaagaaaaggaaaaaaagg

SEQ ID NO: 107288 - DNA, 48 bp, Artificial Sequence
  Description of Artificial Sequence: Synthetic oligonucleotide
ctataactgccaaggctaaaaagaaggaaaaagaaaaggaaaaaaagg

SEQ ID NO: 107289 - DNA, 49 bp, Artificial Sequence
  Description of Artificial Sequence: Synthetic oligonucleotide
tataactgccaaggctaaaaagaaggaaaaagaaaaggaaaaaaaggag

SEQ ID NO: 107290 - DNA, 48 bp, Artificial Sequence
  Description of Artificial Sequence: Synthetic oligonucleotide
ataactgccaaggctaaaaagaaggaaaaagaaaaggaaaaaaaggag

SEQ ID NO: 107291 - DNA, 47 bp, Artificial Sequence
  Description of Artificial Sequence: Synthetic oligonucleotide
taactgccaaggctaaaaagaaggaaaaagaaaaggaaaaaaaggag

SEQ ID NO: 107292 - DNA, 46 bp, Artificial Sequence
  Description of Artificial Sequence: Synthetic oligonucleotide
aactgccaaggctaaaaagaaggaaaaagaaaaggaaaaaaaggag

SEQ ID NO: 107293 - DNA, 45 bp, Artificial Sequence
  Description of Artificial Sequence: Synthetic oligonucleotide
actgccaaggctaaaaagaaggaaaaagaaaaggaaaaaaaggag

SEQ ID NO: 107294 - DNA, 44 bp, Artificial Sequence
  Description of Artificial Sequence: Synthetic oligonucleotide
ctgccaaggctaaaaagaaggaaaaagaaaaggaaaaaaaggag

SEQ ID NO: 107295 - DNA, 44 bp, Artificial Sequence
  Description of Artificial Sequence: Synthetic oligonucleotide
tgccaaggctaaaaagaaggaaaaagaaaaggaaaaaaaggagg

SEQ ID NO: 107296 - DNA, 43 bp, Artificial Sequence
  Description of Artificial Sequence: Synthetic oligonucleotide
gccaaggctaaaaagaaggaaaaagaaaaggaaaaaaaggagg

SEQ ID NO: 107297 - DNA, 44 bp, Artificial Sequence
  Description of Artificial Sequence: Synthetic oligonucleotide
ccaaggctaaaaagaaggaaaaagaaaaggaaaaaaaggaggag

SEQ ID NO: 107298 - DNA, 44 bp, Artificial Sequence
  Description of Artificial Sequence: Synthetic oligonucleotide
caaggctaaaaagaaggaaaaagaaaaggaaaaaaaggaggagg

SEQ ID NO: 107299 - DNA, 45 bp, Artificial Sequence
  Description of Artificial Sequence: Synthetic oligonucleotide
aaggctaaaaagaaggaaaaagaaaaggaaaaaaaggaggaggag

SEQ ID NO: 107300 - DNA, 44 bp, Artificial Sequence
  Description of Artificial Sequence: Synthetic oligonucleotide
aggctaaaaagaaggaaaaagaaaaggaaaaaaaggaggaggag

SEQ ID NO: 107301 - DNA, 43 bp, Artificial Sequence
  Description of Artificial Sequence: Synthetic oligonucleotide
ggctaaaaagaaggaaaaagaaaaggaaaaaaaggaggaggag

SEQ ID NO: 107302 - DNA, 48 bp, Artificial Sequence
  Description of Artificial Sequence: Synthetic oligonucleotide
gctaaaaagaaggaaaaagaaaaggaaaaaaaggaggaggagaaaatg

SEQ ID NO: 107303 - DNA, 48 bp, Artificial Sequence
  Description of Artificial Sequence: Synthetic oligonucleotide
ctaaaaagaaggaaaaagaaaaggaaaaaaaggaggaggagaaaatgg

SEQ ID NO: 107304 - DNA, 50 bp, Artificial Sequence
  Description of Artificial Sequence: Synthetic oligonucleotide
taaaaagaaggaaaaagaaaaggaaaaaaaggaggaggagaaaatggaag

SEQ ID NO: 107305 - DNA, 49 bp, Artificial Sequence
  Description of Artificial Sequence: Synthetic oligonucleotide
aaaaagaaggaaaaagaaaaggaaaaaaaggaggaggagaaaatggaag

SEQ ID NO: 107306 - DNA, 48 bp, Artificial Sequence
  Description of Artificial Sequence: Synthetic oligonucleotide
aaaagaaggaaaaagaaaaggaaaaaaaggaggaggagaaaatggaag

SEQ ID NO: 107307 - DNA, 47 bp, Artificial Sequence
  Description of Artificial Sequence: Synthetic oligonucleotide
aaagaaggaaaaagaaaaggaaaaaaaggaggaggagaaaatggaag

SEQ ID NO: 107308 - DNA, 46 bp, Artificial Sequence
  Description of Artificial Sequence: Synthetic oligonucleotide
aagaaggaaaaagaaaaggaaaaaaaggaggaggagaaaatggaag

SEQ ID NO: 107309 - DNA, 45 bp, Artificial Sequence
  Description of Artificial Sequence: Synthetic oligonucleotide
agaaggaaaaagaaaaggaaaaaaaggaggaggagaaaatggaag

SEQ ID NO: 107310 - DNA, 44 bp, Artificial Sequence
  Description of Artificial Sequence: Synthetic oligonucleotide
gaaggaaaaagaaaaggaaaaaaaggaggaggagaaaatggaag

SEQ ID NO: 107311 - DNA, 45 bp, Artificial Sequence
  Description of Artificial Sequence: Synthetic oligonucleotide
aaggaaaaagaaaaggaaaaaaaggaggaggagaaaatggaagtg

SEQ ID NO: 107312 - DNA, 44 bp, Artificial Sequence
  Description of Artificial Sequence: Synthetic oligonucleotide
aggaaaaagaaaaggaaaaaaaggaggaggagaaaatggaagtg

SEQ ID NO: 107313 - DNA, 43 bp, Artificial Sequence
  Description of Artificial Sequence: Synthetic oligonucleotide
ggaaaaagaaaaggaaaaaaaggaggaggagaaaatggaagtg

SEQ ID NO: 107314 - DNA, 43 bp, Artificial Sequence
  Description of Artificial Sequence: Synthetic oligonucleotide
gaaaaagaaaaggaaaaaaaggaggaggagaaaatggaagtgg

SEQ ID NO: 107315 - DNA, 45 bp, Artificial Sequence
  Description of Artificial Sequence: Synthetic oligonucleotide
aaaaagaaaaggaaaaaaaggaggaggagaaaatggaagtggatg

SEQ ID NO: 107316 - DNA, 44 bp, Artificial Sequence
  Description of Artificial Sequence: Synthetic oligonucleotide
aaaagaaaaggaaaaaaaggaggaggagaaaatggaagtggatg

SEQ ID NO: 107317 - DNA, 43 bp, Artificial Sequence
  Description of Artificial Sequence: Synthetic oligonucleotide
aaagaaaaggaaaaaaaggaggaggagaaaatggaagtggatg

SEQ ID NO: 107318 - DNA, 42 bp, Artificial Sequence
  Description of Artificial Sequence: Synthetic oligonucleotide
aagaaaaggaaaaaaaggaggaggagaaaatggaagtggatg

SEQ ID NO: 107319 - DNA, 41 bp, Artificial Sequence
  Description of Artificial Sequence: Synthetic oligonucleotide
agaaaaggaaaaaaaggaggaggagaaaatggaagtggatg

SEQ ID NO: 107320 - DNA, 40 bp, Artificial Sequence
  Description of Artificial Sequence: Synthetic oligonucleotide
gaaaaggaaaaaaaggaggaggagaaaatggaagtggatg

SEQ ID NO: 107321 - DNA, 41 bp, Artificial Sequence
  Description of Artificial Sequence: Synthetic oligonucleotide
aaaaggaaaaaaaggaggaggagaaaatggaagtggatgag

SEQ ID NO: 107322 - DNA, 40 bp, Artificial Sequence
  Description of Artificial Sequence: Synthetic oligonucleotide
aaaggaaaaaaaggaggaggagaaaatggaagtggatgag

SEQ ID NO: 107323 - DNA, 39 bp, Artificial Sequence
  Description of Artificial Sequence: Synthetic oligonucleotide
aaggaaaaaaaggaggaggagaaaatggaagtggatgag

SEQ ID NO: 107324 - DNA, 38 bp, Artificial Sequence
  Description of Artificial Sequence: Synthetic oligonucleotide
aggaaaaaaaggaggaggagaaaatggaagtggatgag

SEQ ID NO: 107325 - DNA, 37 bp, Artificial Sequence
  Description of Artificial Sequence: Synthetic oligonucleotide
ggaaaaaaaggaggaggagaaaatggaagtggatgag

SEQ ID NO: 107326 - DNA, 37 bp, Artificial Sequence
  Description of Artificial Sequence: Synthetic oligonucleotide
gaaaaaaaggaggaggagaaaatggaagtggatgagg

SEQ ID NO: 107327 - DNA, 37 bp, Artificial Sequence
  Description of Artificial Sequence: Synthetic oligonucleotide
aaaaaaaggaggaggagaaaatggaagtggatgaggc

SEQ ID NO: 107328 - DNA, 36 bp, Artificial Sequence
  Description of Artificial Sequence: Synthetic oligonucleotide
aaaaaaggaggaggagaaaatggaagtggatgaggc

SEQ ID NO: 107329 - DNA, 35 bp, Artificial Sequence
  Description of Artificial Sequence: Synthetic oligonucleotide
aaaaaggaggaggagaaaatggaagtggatgaggc

SEQ ID NO: 107330 - DNA, 34 bp, Artificial Sequence
  Description of Artificial Sequence: Synthetic oligonucleotide
aaaaggaggaggagaaaatggaagtggatgaggc

SEQ ID NO: 107331 - DNA, 33 bp, Artificial Sequence
  Description of Artificial Sequence: Synthetic oligonucleotide
aaaggaggaggagaaaatggaagtggatgaggc

SEQ ID NO: 107332 - DNA, 32 bp, Artificial Sequence
  Description of Artificial Sequence: Synthetic oligonucleotide
aaggaggaggagaaaatggaagtggatgaggc

SEQ ID NO: 107333 - DNA, 31 bp, Artificial Sequence
  Description of Artificial Sequence: Synthetic oligonucleotide
aggaggaggagaaaatggaagtggatgaggc

SEQ ID NO: 107334 - DNA, 30 bp, Artificial Sequence
  Description of Artificial Sequence: Synthetic oligonucleotide
ggaggaggagaaaatggaagtggatgaggc

SEQ ID NO: 107335 - DNA, 31 bp, Artificial Sequence
  Description of Artificial Sequence: Synthetic oligonucleotide
gaggaggagaaaatggaagtggatgaggcag

SEQ ID NO: 107336 - DNA, 32 bp, Artificial Sequence
  Description of Artificial Sequence: Synthetic oligonucleotide
aggaggagaaaatggaagtggatgaggcagag

SEQ ID NO: 107337 - DNA, 31 bp, Artificial Sequence
  Description of Artificial Sequence: Synthetic oligonucleotide
ggaggagaaaatggaagtggatgaggcagag

SEQ ID NO: 107338 - DNA, 36 bp, Artificial Sequence
  Description of Artificial Sequence: Synthetic oligonucleotide
gaggagaaaatggaagtggatgaggcagagaaaaag

SEQ ID NO: 107339 - DNA, 36 bp, Artificial Sequence
  Description of Artificial Sequence: Synthetic oligonucleotide
aggagaaaatggaagtggatgaggcagagaaaaagg

SEQ ID NO: 107340 - DNA, 35 bp, Artificial Sequence
  Description of Artificial Sequence: Synthetic oligonucleotide
ggagaaaatggaagtggatgaggcagagaaaaagg

SEQ ID NO: 107341 - DNA, 36 bp, Artificial Sequence
  Description of Artificial Sequence: Synthetic oligonucleotide
gagaaaatggaagtggatgaggcagagaaaaaggag

SEQ ID NO: 107342 - DNA, 36 bp, Artificial Sequence
  Description of Artificial Sequence: Synthetic oligonucleotide
agaaaatggaagtggatgaggcagagaaaaaggagg

SEQ ID NO: 107343 - DNA, 35 bp, Artificial Sequence
  Description of Artificial Sequence: Synthetic oligonucleotide
gaaaatggaagtggatgaggcagagaaaaaggagg

SEQ ID NO: 107344 - DNA, 40 bp, Artificial Sequence
  Description of Artificial Sequence: Synthetic oligonucleotide
aaaatggaagtggatgaggcagagaaaaaggaggaaaaag

SEQ ID NO: 107345 - DNA, 39 bp, Artificial Sequence
  Description of Artificial Sequence: Synthetic oligonucleotide
aaatggaagtggatgaggcagagaaaaaggaggaaaaag

SEQ ID NO: 107346 - DNA, 38 bp, Artificial Sequence
  Description of Artificial Sequence: Synthetic oligonucleotide
aatggaagtggatgaggcagagaaaaaggaggaaaaag

SEQ ID NO: 107347 - DNA, 37 bp, Artificial Sequence
  Description of Artificial Sequence: Synthetic oligonucleotide
atggaagtggatgaggcagagaaaaaggaggaaaaag

SEQ ID NO: 107348 - DNA, 36 bp, Artificial Sequence
  Description of Artificial Sequence: Synthetic oligonucleotide
tggaagtggatgaggcagagaaaaaggaggaaaaag

SEQ ID NO: 107349 - DNA, 35 bp, Artificial Sequence
  Description of Artificial Sequence: Synthetic oligonucleotide
ggaagtggatgaggcagagaaaaaggaggaaaaag

SEQ ID NO: 107350 - DNA, 36 bp, Artificial Sequence
  Description of Artificial Sequence: Synthetic oligonucleotide
gaagtggatgaggcagagaaaaaggaggaaaaagag

SEQ ID NO: 107351 - DNA, 38 bp, Artificial Sequence
  Description of Artificial Sequence: Synthetic oligonucleotide
aagtggatgaggcagagaaaaaggaggaaaaagagaag

SEQ ID NO: 107352 - DNA, 37 bp, Artificial Sequence
  Description of Artificial Sequence: Synthetic oligonucleotide
agtggatgaggcagagaaaaaggaggaaaaagagaag

SEQ ID NO: 107353 - DNA, 36 bp, Artificial Sequence
  Description of Artificial Sequence: Synthetic oligonucleotide
gtggatgaggcagagaaaaaggaggaaaaagagaag

SEQ ID NO: 107354 - DNA, 42 bp, Artificial Sequence
  Description of Artificial Sequence: Synthetic oligonucleotide
tggatgaggcagagaaaaaggaggaaaaagagaagaaaaaag

SEQ ID NO: 107355 - DNA, 41 bp, Artificial Sequence
  Description of Artificial Sequence: Synthetic oligonucleotide
ggatgaggcagagaaaaaggaggaaaaagagaagaaaaaag

SEQ ID NO: 107356 - DNA, 43 bp, Artificial Sequence
  Description of Artificial Sequence: Synthetic oligonucleotide
gatgaggcagagaaaaaggaggaaaaagagaagaaaaaagaac

SEQ ID NO: 107357 - DNA, 43 bp, Artificial Sequence
  Description of Artificial Sequence: Synthetic oligonucleotide
atgaggcagagaaaaaggaggaaaaagagaagaaaaaagaacc

SEQ ID NO: 107358 - DNA, 42 bp, Artificial Sequence
  Description of Artificial Sequence: Synthetic oligonucleotide
tgaggcagagaaaaaggaggaaaaagagaagaaaaaagaacc

SEQ ID NO: 107359 - DNA, 41 bp, Artificial Sequence
  Description of Artificial Sequence: Synthetic oligonucleotide
gaggcagagaaaaaggaggaaaaagagaagaaaaaagaacc

SEQ ID NO: 107360 - DNA, 42 bp, Artificial Sequence
  Description of Artificial Sequence: Synthetic oligonucleotide
aggcagagaaaaaggaggaaaaagagaagaaaaaagaacctg

SEQ ID NO: 107361 - DNA, 41 bp, Artificial Sequence
  Description of Artificial Sequence: Synthetic oligonucleotide
ggcagagaaaaaggaggaaaaagagaagaaaaaagaacctg

SEQ ID NO: 107362 - DNA, 42 bp, Artificial Sequence
  Description of Artificial Sequence: Synthetic oligonucleotide
gcagagaaaaaggaggaaaaagagaagaaaaaagaacctgag

SEQ ID NO: 107363 - DNA, 42 bp, Artificial Sequence
  Description of Artificial Sequence: Synthetic oligonucleotide
cagagaaaaaggaggaaaaagagaagaaaaaagaacctgagc

SEQ ID NO: 107364 - DNA, 42 bp, Artificial Sequence
  Description of Artificial Sequence: Synthetic oligonucleotide
agagaaaaaggaggaaaaagagaagaaaaaagaacctgagcc

SEQ ID NO: 107365 - DNA, 41 bp, Artificial Sequence
  Description of Artificial Sequence: Synthetic oligonucleotide
gagaaaaaggaggaaaaagagaagaaaaaagaacctgagcc

SEQ ID NO: 107366 - DNA, 44 bp, Artificial Sequence
  Description of Artificial Sequence: Synthetic oligonucleotide
agaaaaaggaggaaaaagagaagaaaaaagaacctgagccaaac

SEQ ID NO: 107367 - DNA, 43 bp, Artificial Sequence
  Description of Artificial Sequence: Synthetic oligonucleotide
gaaaaaggaggaaaaagagaagaaaaaagaacctgagccaaac

SEQ ID NO: 107368 - DNA, 45 bp, Artificial Sequence
  Description of Artificial Sequence: Synthetic oligonucleotide
aaaaaggaggaaaaagagaagaaaaaagaacctgagccaaacttc

SEQ ID NO: 107369 - DNA, 44 bp, Artificial Sequence
  Description of Artificial Sequence: Synthetic oligonucleotide
aaaaggaggaaaaagagaagaaaaaagaacctgagccaaacttc

SEQ ID NO: 107370 - DNA, 43 bp, Artificial Sequence
  Description of Artificial Sequence: Synthetic oligonucleotide
aaaggaggaaaaagagaagaaaaaagaacctgagccaaacttc

SEQ ID NO: 107371 - DNA, 42 bp, Artificial Sequence
  Description of Artificial Sequence: Synthetic oligonucleotide
aaggaggaaaaagagaagaaaaaagaacctgagccaaacttc

SEQ ID NO: 107372 - DNA, 41 bp, Artificial Sequence
  Description of Artificial Sequence: Synthetic oligonucleotide
aggaggaaaaagagaagaaaaaagaacctgagccaaacttc

SEQ ID NO: 107373 - DNA, 40 bp, Artificial Sequence
  Description of Artificial Sequence: Synthetic oligonucleotide
ggaggaaaaagagaagaaaaaagaacctgagccaaacttc

SEQ ID NO: 107374 - DNA, 40 bp, Artificial Sequence
  Description of Artificial Sequence: Synthetic oligonucleotide
gaggaaaaagagaagaaaaaagaacctgagccaaacttcc

SEQ ID NO: 107375 - DNA, 41 bp, Artificial Sequence
  Description of Artificial Sequence: Synthetic oligonucleotide
aggaaaaagagaagaaaaaagaacctgagccaaacttccag

SEQ ID NO: 107376 - DNA, 40 bp, Artificial Sequence
  Description of Artificial Sequence: Synthetic oligonucleotide
ggaaaaagagaagaaaaaagaacctgagccaaacttccag

SEQ ID NO: 107377 - DNA, 45 bp, Artificial Sequence
  Description of Artificial Sequence: Synthetic oligonucleotide
gaaaaagagaagaaaaaagaacctgagccaaacttccagttattg

SEQ ID NO: 107378 - DNA, 45 bp, Artificial Sequence
  Description of Artificial Sequence: Synthetic oligonucleotide
aaaaagagaagaaaaaagaacctgagccaaacttccagttattgg

SEQ ID NO: 107379 - DNA, 44 bp, Artificial Sequence
  Description of Artificial Sequence: Synthetic oligonucleotide
aaaagagaagaaaaaagaacctgagccaaacttccagttattgg

SEQ ID NO: 107380 - DNA, 43 bp, Artificial Sequence
  Description of Artificial Sequence: Synthetic oligonucleotide
aaagagaagaaaaaagaacctgagccaaacttccagttattgg

SEQ ID NO: 107381 - DNA, 42 bp, Artificial Sequence
  Description of Artificial Sequence: Synthetic oligonucleotide
aagagaagaaaaaagaacctgagccaaacttccagttattgg

SEQ ID NO: 107382 - DNA, 41 bp, Artificial Sequence
  Description of Artificial Sequence: Synthetic oligonucleotide
agagaagaaaaaagaacctgagccaaacttccagttattgg

SEQ ID NO: 107383 - DNA, 40 bp, Artificial Sequence
  Description of Artificial Sequence: Synthetic oligonucleotide
gagaagaaaaaagaacctgagccaaacttccagttattgg

SEQ ID NO: 107384 - DNA, 44 bp, Artificial Sequence
  Description of Artificial Sequence: Synthetic oligonucleotide
agaagaaaaaagaacctgagccaaacttccagttattggataac

SEQ ID NO: 107385 - DNA, 43 bp, Artificial Sequence
  Description of Artificial Sequence: Synthetic oligonucleotide
gaagaaaaaagaacctgagccaaacttccagttattggataac

SEQ ID NO: 107386 - DNA, 43 bp, Artificial Sequence
  Description of Artificial Sequence: Synthetic oligonucleotide
aagaaaaaagaacctgagccaaacttccagttattggataacc

SEQ ID NO: 107387 - DNA, 42 bp, Artificial Sequence
  Description of Artificial Sequence: Synthetic oligonucleotide
agaaaaaagaacctgagccaaacttccagttattggataacc

SEQ ID NO: 107388 - DNA, 41 bp, Artificial Sequence
  Description of Artificial Sequence: Synthetic oligonucleotide
gaaaaaagaacctgagccaaacttccagttattggataacc

SEQ ID NO: 107389 - DNA, 41 bp, Artificial Sequence
  Description of Artificial Sequence: Synthetic oligonucleotide
aaaaaagaacctgagccaaacttccagttattggataaccc

SEQ ID NO: 107390 - DNA, 40 bp, Artificial Sequence
  Description of Artificial Sequence: Synthetic oligonucleotide
aaaaagaacctgagccaaacttccagttattggataaccc

SEQ ID NO: 107391 - DNA, 39 bp, Artificial Sequence
  Description of Artificial Sequence: Synthetic oligonucleotide
aaaagaacctgagccaaacttccagttattggataaccc

SEQ ID NO: 107392 - DNA, 38 bp, Artificial Sequence
  Description of Artificial Sequence: Synthetic oligonucleotide
aaagaacctgagccaaacttccagttattggataaccc

SEQ ID NO: 107393 - DNA, 37 bp, Artificial Sequence
  Description of Artificial Sequence: Synthetic oligonucleotide
aagaacctgagccaaacttccagttattggataaccc

SEQ ID NO: 107394 - DNA, 36 bp, Artificial Sequence
  Description of Artificial Sequence: Synthetic oligonucleotide
agaacctgagccaaacttccagttattggataaccc

SEQ ID NO: 107395 - DNA, 35 bp, Artificial Sequence
  Description of Artificial Sequence: Synthetic oligonucleotide
gaacctgagccaaacttccagttattggataaccc

SEQ ID NO: 107396 - DNA, 36 bp, Artificial Sequence
  Description of Artificial Sequence: Synthetic oligonucleotide
aacctgagccaaacttccagttattggataacccag

SEQ ID NO: 107397 - DNA, 35 bp, Artificial Sequence
  Description of Artificial Sequence: Synthetic oligonucleotide
acctgagccaaacttccagttattggataacccag

SEQ ID NO: 107398 - DNA, 34 bp, Artificial Sequence
  Description of Artificial Sequence: Synthetic oligonucleotide
cctgagccaaacttccagttattggataacccag

SEQ ID NO: 107399 - DNA, 34 bp, Artificial Sequence
  Description of Artificial Sequence: Synthetic oligonucleotide
ctgagccaaacttccagttattggataacccagc

SEQ ID NO: 107400 - DNA, 34 bp, Artificial Sequence
  Description of Artificial Sequence: Synthetic oligonucleotide
tgagccaaacttccagttattggataacccagcc

SEQ ID NO: 107401 - DNA, 33 bp, Artificial Sequence
  Description of Artificial Sequence: Synthetic oligonucleotide
gagccaaacttccagttattggataacccagcc

SEQ ID NO: 107402 - DNA, 33 bp, Artificial Sequence
  Description of Artificial Sequence: Synthetic oligonucleotide
agccaaacttccagttattggataacccagccc

SEQ ID NO: 107403 - DNA, 32 bp, Artificial Sequence
  Description of Artificial Sequence: Synthetic oligonucleotide
gccaaacttccagttattggataacccagccc

SEQ ID NO: 107404 - DNA, 32 bp, Artificial Sequence
  Description of Artificial Sequence: Synthetic oligonucleotide
ccaaacttccagttattggataacccagcccg

SEQ ID NO: 107405 - DNA, 33 bp, Artificial Sequence
  Description of Artificial Sequence: Synthetic oligonucleotide
caaacttccagttattggataacccagcccgag

SEQ ID NO: 107406 - DNA, 37 bp, Artificial Sequence
  Description of Artificial Sequence: Synthetic oligonucleotide
aaacttccagttattggataacccagcccgagttatg

SEQ ID NO: 107407 - DNA, 36 bp, Artificial Sequence
  Description of Artificial Sequence: Synthetic oligonucleotide
aacttccagttattggataacccagcccgagttatg

SEQ ID NO: 107408 - DNA, 35 bp, Artificial Sequence
  Description of Artificial Sequence: Synthetic oligonucleotide
acttccagttattggataacccagcccgagttatg

SEQ ID NO: 107409 - DNA, 34 bp, Artificial Sequence
  Description of Artificial Sequence: Synthetic oligonucleotide
cttccagttattggataacccagcccgagttatg

SEQ ID NO: 107410 - DNA, 34 bp, Artificial Sequence
  Description of Artificial Sequence: Synthetic oligonucleotide
ttccagttattggataacccagcccgagttatgc

SEQ ID NO: 107411 - DNA, 33 bp, Artificial Sequence
  Description of Artificial Sequence: Synthetic oligonucleotide
tccagttattggataacccagcccgagttatgc

SEQ ID NO: 107412 - DNA, 32 bp, Artificial Sequence
  Description of Artificial Sequence: Synthetic oligonucleotide
ccagttattggataacccagcccgagttatgc

SEQ ID NO: 107413 - DNA, 32 bp, Artificial Sequence
  Description of Artificial Sequence: Synthetic oligonucleotide
cagttattggataacccagcccgagttatgcc

SEQ ID NO: 107414 - DNA, 33 bp, Artificial Sequence
  Description of Artificial Sequence: Synthetic oligonucleotide
agttattggataacccagcccgagttatgcctg

SEQ ID NO: 107415 - DNA, 32 bp, Artificial Sequence
  Description of Artificial Sequence: Synthetic oligonucleotide
gttattggataacccagcccgagttatgcctg

SEQ ID NO: 107416 - DNA, 32 bp, Artificial Sequence
  Description of Artificial Sequence: Synthetic oligonucleotide
ttattggataacccagcccgagttatgcctgc

SEQ ID NO: 107417 - DNA, 31 bp, Artificial Sequence
  Description of Artificial Sequence: Synthetic oligonucleotide
tattggataacccagcccgagttatgcctgc

SEQ ID NO: 107418 - DNA, 30 bp, Artificial Sequence
  Description of Artificial Sequence: Synthetic oligonucleotide
attggataacccagcccgagttatgcctgc

SEQ ID NO: 107419 - DNA, 29 bp, Artificial Sequence
  Description of Artificial Sequence: Synthetic oligonucleotide
ttggataacccagcccgagttatgcctgc

SEQ ID NO: 107420 - DNA, 28 bp, Artificial Sequence
  Description of Artificial Sequence: Synthetic oligonucleotide
tggataacccagcccgagttatgcctgc

SEQ ID NO: 107421 - DNA, 27 bp, Artificial Sequence
  Description of Artificial Sequence: Synthetic oligonucleotide
ggataacccagcccgagttatgcctgc

SEQ ID NO: 107422 - DNA, 27 bp, Artificial Sequence
  Description of Artificial Sequence: Synthetic oligonucleotide
gataacccagcccgagttatgcctgcc

SEQ ID NO: 107423 - DNA, 27 bp, Artificial Sequence
  Description of Artificial Sequence: Synthetic oligonucleotide
ataacccagcccgagttatgcctgccc

SEQ ID NO: 107424 - DNA, 27 bp, Artificial Sequence
  Description of Artificial Sequence: Synthetic oligonucleotide
taacccagcccgagttatgcctgccca

SEQ ID NO: 107425 - DNA, 26 bp, Artificial Sequence
  Description of Artificial Sequence: Synthetic oligonucleotide
aacccagcccgagttatgcctgccca

SEQ ID NO: 107426 - DNA, 25 bp, Artificial Sequence
  Description of Artificial Sequence: Synthetic oligonucleotide
acccagcccgagttatgcctgccca

SEQ ID NO: 107427 - DNA, 24 bp, Artificial Sequence
  Description of Artificial Sequence: Synthetic oligonucleotide
cccagcccgagttatgcctgccca

SEQ ID NO: 107428 - DNA, 24 bp, Artificial Sequence
  Description of Artificial Sequence: Synthetic oligonucleotide
ccagcccgagttatgcctgcccag

SEQ ID NO: 107429 - DNA, 27 bp, Artificial Sequence
  Description of Artificial Sequence: Synthetic oligonucleotide
cagcccgagttatgcctgcccagctta

SEQ ID NO: 107430 - DNA, 28 bp, Artificial Sequence
  Description of Artificial Sequence: Synthetic oligonucleotide
agcccgagttatgcctgcccagcttaag

SEQ ID NO: 107431 - DNA, 27 bp, Artificial Sequence
  Description of Artificial Sequence: Synthetic oligonucleotide
gcccgagttatgcctgcccagcttaag

SEQ ID NO: 107432 - DNA, 27 bp, Artificial Sequence
  Description of Artificial Sequence: Synthetic oligonucleotide
cccgagttatgcctgcccagcttaagg

SEQ ID NO: 107433 - DNA, 28 bp, Artificial Sequence
  Description of Artificial Sequence: Synthetic oligonucleotide
ccgagttatgcctgcccagcttaaggtc

SEQ ID NO: 107434 - DNA, 28 bp, Artificial Sequence
  Description of Artificial Sequence: Synthetic oligonucleotide
cgagttatgcctgcccagcttaaggtcc

SEQ ID NO: 107435 - DNA, 31 bp, Artificial Sequence
  Description of Artificial Sequence: Synthetic oligonucleotide
gagttatgcctgcccagcttaaggtcctaac

SEQ ID NO: 107436 - DNA, 31 bp, Artificial Sequence
  Description of Artificial Sequence: Synthetic oligonucleotide
agttatgcctgcccagcttaaggtcctaacc

SEQ ID NO: 107437 - DNA, 30 bp, Artificial Sequence
  Description of Artificial Sequence: Synthetic oligonucleotide
gttatgcctgcccagcttaaggtcctaacc

SEQ ID NO: 107438 - DNA, 32 bp, Artificial Sequence
  Description of Artificial Sequence: Synthetic oligonucleotide
ttatgcctgcccagcttaaggtcctaaccatg

SEQ ID NO: 107439 - DNA, 31 bp, Artificial Sequence
  Description of Artificial Sequence: Synthetic oligonucleotide
tatgcctgcccagcttaaggtcctaaccatg

SEQ ID NO: 107440 - DNA, 30 bp, Artificial Sequence
  Description of Artificial Sequence: Synthetic oligonucleotide
atgcctgcccagcttaaggtcctaaccatg

SEQ ID NO: 107441 - DNA, 29 bp, Artificial Sequence
  Description of Artificial Sequence: Synthetic oligonucleotide
tgcctgcccagcttaaggtcctaaccatg

SEQ ID NO: 107442 - DNA, 28 bp, Artificial Sequence
  Description of Artificial Sequence: Synthetic oligonucleotide
gcctgcccagcttaaggtcctaaccatg

SEQ ID NO: 107443 - DNA, 28 bp, Artificial Sequence
  Description of Artificial Sequence: Synthetic oligonucleotide
cctgcccagcttaaggtcctaaccatgc

SEQ ID NO: 107444 - DNA, 28 bp, Artificial Sequence
  Description of Artificial Sequence: Synthetic oligonucleotide
ctgcccagcttaaggtcctaaccatgcc

SEQ ID NO: 107445 - DNA, 28 bp, Artificial Sequence
  Description of Artificial Sequence: Synthetic oligonucleotide
tgcccagcttaaggtcctaaccatgccg

SEQ ID NO: 107446 - DNA, 27 bp, Artificial Sequence
  Description of Artificial Sequence: Synthetic oligonucleotide
gcccagcttaaggtcctaaccatgccg

SEQ ID NO: 107447 - DNA, 27 bp, Artificial Sequence
  Description of Artificial Sequence: Synthetic oligonucleotide
cccagcttaaggtcctaaccatgccgg

SEQ ID NO: 107448 - DNA, 28 bp, Artificial Sequence
  Description of Artificial Sequence: Synthetic oligonucleotide
ccagcttaaggtcctaaccatgccggag

SEQ ID NO: 107449 - DNA, 29 bp, Artificial Sequence
  Description of Artificial Sequence: Synthetic oligonucleotide
cagcttaaggtcctaaccatgccggagac

SEQ ID NO: 107450 - DNA, 29 bp, Artificial Sequence
  Description of Artificial Sequence: Synthetic oligonucleotide
agcttaaggtcctaaccatgccggagacc

SEQ ID NO: 107451 - DNA, 28 bp, Artificial Sequence
  Description of Artificial Sequence: Synthetic oligonucleotide
gcttaaggtcctaaccatgccggagacc

SEQ ID NO: 107452 - DNA, 29 bp, Artificial Sequence
  Description of Artificial Sequence: Synthetic oligonucleotide
cttaaggtcctaaccatgccggagacctg

SEQ ID NO: 107453 - DNA, 31 bp, Artificial Sequence
  Description of Artificial Sequence: Synthetic oligonucleotide
ttaaggtcctaaccatgccggagacctgtag

SEQ ID NO: 107454 - DNA, 30 bp, Artificial Sequence
  Description of Artificial Sequence: Synthetic oligonucleotide
taaggtcctaaccatgccggagacctgtag

SEQ ID NO: 107455 - DNA, 29 bp, Artificial Sequence
  Description of Artificial Sequence: Synthetic oligonucleotide
aaggtcctaaccatgccggagacctgtag

SEQ ID NO: 107456 - DNA, 28 bp, Artificial Sequence
  Description of Artificial Sequence: Synthetic oligonucleotide
aggtcctaaccatgccggagacctgtag

SEQ ID NO: 107457 - DNA, 27 bp, Artificial Sequence
  Description of Artificial Sequence: Synthetic oligonucleotide
ggtcctaaccatgccggagacctgtag

SEQ ID NO: 107458 - DNA, 30 bp, Artificial Sequence
  Description of Artificial Sequence: Synthetic oligonucleotide
gtcctaaccatgccggagacctgtagatac

SEQ ID NO: 107459 - DNA, 30 bp, Artificial Sequence
  Description of Artificial Sequence: Synthetic oligonucleotide
tcctaaccatgccggagacctgtagatacc

SEQ ID NO: 107460 - DNA, 29 bp, Artificial Sequence
  Description of Artificial Sequence: Synthetic oligonucleotide
cctaaccatgccggagacctgtagatacc

SEQ ID NO: 107461 - DNA, 30 bp, Artificial Sequence
  Description of Artificial Sequence: Synthetic oligonucleotide
ctaaccatgccggagacctgtagataccag

SEQ ID NO: 107462 - DNA, 30 bp, Artificial Sequence
  Description of Artificial Sequence: Synthetic oligonucleotide
taaccatgccggagacctgtagataccagc

SEQ ID NO: 107463 - DNA, 29 bp, Artificial Sequence
  Description of Artificial Sequence: Synthetic oligonucleotide
aaccatgccggagacctgtagataccagc

SEQ ID NO: 107464 - DNA, 28 bp, Artificial Sequence
  Description of Artificial Sequence: Synthetic oligonucleotide
accatgccggagacctgtagataccagc

SEQ ID NO: 107465 - DNA, 27 bp, Artificial Sequence
  Description of Artificial Sequence: Synthetic oligonucleotide
ccatgccggagacctgtagataccagc

SEQ ID NO: 107466 - DNA, 27 bp, Artificial Sequence
  Description of Artificial Sequence: Synthetic oligonucleotide
catgccggagacctgtagataccagcc

SEQ ID NO: 107467 - DNA, 30 bp, Artificial Sequence
  Description of Artificial Sequence: Synthetic oligonucleotide
atgccggagacctgtagataccagcctttc

SEQ ID NO: 107468 - DNA, 29 bp, Artificial Sequence
  Description of Artificial Sequence: Synthetic oligonucleotide
tgccggagacctgtagataccagcctttc

SEQ ID NO: 107469 - DNA, 28 bp, Artificial Sequence
  Description of Artificial Sequence: Synthetic oligonucleotide
gccggagacctgtagataccagcctttc

SEQ ID NO: 107470 - DNA, 31 bp, Artificial Sequence
  Description of Artificial Sequence: Synthetic oligonucleotide
ccggagacctgtagataccagcctttcaaac

SEQ ID NO: 107471 - DNA, 31 bp, Artificial Sequence
  Description of Artificial Sequence: Synthetic oligonucleotide
cggagacctgtagataccagcctttcaaacc

SEQ ID NO: 107472 - DNA, 32 bp, Artificial Sequence
  Description of Artificial Sequence: Synthetic oligonucleotide
ggagacctgtagataccagcctttcaaaccac

SEQ ID NO: 107473 - DNA, 33 bp, Artificial Sequence
  Description of Artificial Sequence: Synthetic oligonucleotide
gagacctgtagataccagcctttcaaaccactc

SEQ ID NO: 107474 - DNA, 34 bp, Artificial Sequence
  Description of Artificial Sequence: Synthetic oligonucleotide
agacctgtagataccagcctttcaaaccactctc

SEQ ID NO: 107475 - DNA, 33 bp, Artificial Sequence
  Description of Artificial Sequence: Synthetic oligonucleotide
gacctgtagataccagcctttcaaaccactctc

SEQ ID NO: 107476 - DNA, 37 bp, Artificial Sequence
  Description of Artificial Sequence: Synthetic oligonucleotide
acctgtagataccagcctttcaaaccactctctattg

SEQ ID NO: 107477 - DNA, 36 bp, Artificial Sequence
  Description of Artificial Sequence: Synthetic oligonucleotide
cctgtagataccagcctttcaaaccactctctattg

SEQ ID NO: 107478 - DNA, 36 bp, Artificial Sequence
  Description of Artificial Sequence: Synthetic oligonucleotide
ctgtagataccagcctttcaaaccactctctattgg

SEQ ID NO: 107479 - DNA, 37 bp, Artificial Sequence
  Description of Artificial Sequence: Synthetic oligonucleotide
tgtagataccagcctttcaaaccactctctattggag

SEQ ID NO: 107480 - DNA, 36 bp, Artificial Sequence
  Description of Artificial Sequence: Synthetic oligonucleotide
gtagataccagcctttcaaaccactctctattggag

SEQ ID NO: 107481 - DNA, 36 bp, Artificial Sequence
  Description of Artificial Sequence: Synthetic oligonucleotide
tagataccagcctttcaaaccactctctattggagg

SEQ ID NO: 107482 - DNA, 35 bp, Artificial Sequence
  Description of Artificial Sequence: Synthetic oligonucleotide
agataccagcctttcaaaccactctctattggagg

SEQ ID NO: 107483 - DNA, 34 bp, Artificial Sequence
  Description of Artificial Sequence: Synthetic oligonucleotide
gataccagcctttcaaaccactctctattggagg

SEQ ID NO: 107484 - DNA, 34 bp, Artificial Sequence
  Description of Artificial Sequence: Synthetic oligonucleotide
ataccagcctttcaaaccactctctattggaggc

SEQ ID NO: 107485 - DNA, 33 bp, Artificial Sequence
  Description of Artificial Sequence: Synthetic oligonucleotide
taccagcctttcaaaccactctctattggaggc

SEQ ID NO: 107486 - DNA, 32 bp, Artificial Sequence
  Description of Artificial Sequence: Synthetic oligonucleotide
accagcctttcaaaccactctctattggaggc

SEQ ID NO: 107487 - DNA, 31 bp, Artificial Sequence
  Description of Artificial Sequence: Synthetic oligonucleotide
ccagcctttcaaaccactctctattggaggc

SEQ ID NO: 107488 - DNA, 33 bp, Artificial Sequence
  Description of Artificial Sequence: Synthetic oligonucleotide
cagcctttcaaaccactctctattggaggcatc

SEQ ID NO: 107489 - DNA, 35 bp, Artificial Sequence
  Description of Artificial Sequence: Synthetic oligonucleotide
agcctttcaaaccactctctattggaggcatcatc

SEQ ID NO: 107490 - DNA, 34 bp, Artificial Sequence
  Description of Artificial Sequence: Synthetic oligonucleotide
gcctttcaaaccactctctattggaggcatcatc

SEQ ID NO: 107491 - DNA, 37 bp, Artificial Sequence
  Description of Artificial Sequence: Synthetic oligonucleotide
cctttcaaaccactctctattggaggcatcatcattc

SEQ ID NO: 107492 - DNA, 38 bp, Artificial Sequence
  Description of Artificial Sequence: Synthetic oligonucleotide
ctttcaaaccactctctattggaggcatcatcattctg

SEQ ID NO: 107493 - DNA, 40 bp, Artificial Sequence
  Description of Artificial Sequence: Synthetic oligonucleotide
tttcaaaccactctctattggaggcatcatcattctgaag

SEQ ID NO: 107494 - DNA, 39 bp, Artificial Sequence
  Description of Artificial Sequence: Synthetic oligonucleotide
ttcaaaccactctctattggaggcatcatcattctgaag

SEQ ID NO: 107495 - DNA, 38 bp, Artificial Sequence
  Description of Artificial Sequence: Synthetic oligonucleotide
tcaaaccactctctattggaggcatcatcattctgaag

SEQ ID NO: 107496 - DNA, 37 bp, Artificial Sequence
  Description of Artificial Sequence: Synthetic oligonucleotide
caaaccactctctattggaggcatcatcattctgaag

SEQ ID NO: 107497 - DNA, 37 bp, Artificial Sequence
  Description of Artificial Sequence: Synthetic oligonucleotide
aaaccactctctattggaggcatcatcattctgaagg

SEQ ID NO: 107498 - DNA, 36 bp, Artificial Sequence
  Description of Artificial Sequence: Synthetic oligonucleotide
aaccactctctattggaggcatcatcattctgaagg

SEQ ID NO: 107499 - DNA, 35 bp, Artificial Sequence
  Description of Artificial Sequence: Synthetic oligonucleotide
accactctctattggaggcatcatcattctgaagg

SEQ ID NO: 107500 - DNA, 34 bp, Artificial Sequence
  Description of Artificial Sequence: Synthetic oligonucleotide
ccactctctattggaggcatcatcattctgaagg

SEQ ID NO: 107501 - DNA, 37 bp, Artificial Sequence
  Description of Artificial Sequence: Synthetic oligonucleotide
cactctctattggaggcatcatcattctgaaggatac

SEQ ID NO: 107502 - DNA, 37 bp, Artificial Sequence
  Description of Artificial Sequence: Synthetic oligonucleotide
actctctattggaggcatcatcattctgaaggatacc

SEQ ID NO: 107503 - DNA, 36 bp, Artificial Sequence
  Description of Artificial Sequence: Synthetic oligonucleotide
ctctctattggaggcatcatcattctgaaggatacc

SEQ ID NO: 107504 - DNA, 37 bp, Artificial Sequence
  Description of Artificial Sequence: Synthetic oligonucleotide
tctctattggaggcatcatcattctgaaggataccag

SEQ ID NO: 107505 - DNA, 36 bp, Artificial Sequence
  Description of Artificial Sequence: Synthetic oligonucleotide
ctctattggaggcatcatcattctgaaggataccag

SEQ ID NO: 107506 - DNA, 37 bp, Artificial Sequence
  Description of Artificial Sequence: Synthetic oligonucleotide
tctattggaggcatcatcattctgaaggataccagtg

SEQ ID NO: 107507 - DNA, 36 bp, Artificial Sequence
  Description of Artificial Sequence: Synthetic oligonucleotide
ctattggaggcatcatcattctgaaggataccagtg

SEQ ID NO: 107508 - DNA, 38 bp, Artificial Sequence
  Description of Artificial Sequence: Synthetic oligonucleotide
tattggaggcatcatcattctgaaggataccagtgaag

SEQ ID NO: 107509 - DNA, 37 bp, Artificial Sequence
  Description of Artificial Sequence: Synthetic oligonucleotide
attggaggcatcatcattctgaaggataccagtgaag

SEQ ID NO: 107510 - DNA, 36 bp, Artificial Sequence
  Description of Artificial Sequence: Synthetic oligonucleotide
ttggaggcatcatcattctgaaggataccagtgaag

SEQ ID NO: 107511 - DNA, 35 bp, Artificial Sequence
  Description of Artificial Sequence: Synthetic oligonucleotide
tggaggcatcatcattctgaaggataccagtgaag

SEQ ID NO: 107512 - DNA, 34 bp, Artificial Sequence
  Description of Artificial Sequence: Synthetic oligonucleotide
ggaggcatcatcattctgaaggataccagtgaag

SEQ ID NO: 107513 - DNA, 35 bp, Artificial Sequence
  Description of Artificial Sequence: Synthetic oligonucleotide
gaggcatcatcattctgaaggataccagtgaagac

SEQ ID NO: 107514 - DNA, 38 bp, Artificial Sequence
  Description of Artificial Sequence: Synthetic oligonucleotide
aggcatcatcattctgaaggataccagtgaagacattg

SEQ ID NO: 107515 - DNA, 37 bp, Artificial Sequence
  Description of Artificial Sequence: Synthetic oligonucleotide
ggcatcatcattctgaaggataccagtgaagacattg

SEQ ID NO: 107516 - DNA, 38 bp, Artificial Sequence
  Description of Artificial Sequence: Synthetic oligonucleotide
gcatcatcattctgaaggataccagtgaagacattgag

SEQ ID NO: 107517 - DNA, 38 bp, Artificial Sequence
  Description of Artificial Sequence: Synthetic oligonucleotide
catcatcattctgaaggataccagtgaagacattgagg

SEQ ID NO: 107518 - DNA, 39 bp, Artificial Sequence
  Description of Artificial Sequence: Synthetic oligonucleotide
atcatcattctgaaggataccagtgaagacattgaggag

SEQ ID NO: 107519 - DNA, 38 bp, Artificial Sequence
  Description of Artificial Sequence: Synthetic oligonucleotide
tcatcattctgaaggataccagtgaagacattgaggag

SEQ ID NO: 107520 - DNA, 37 bp, Artificial Sequence
  Description of Artificial Sequence: Synthetic oligonucleotide
catcattctgaaggataccagtgaagacattgaggag

SEQ ID NO: 107521 - DNA, 37 bp, Artificial Sequence
  Description of Artificial Sequence: Synthetic oligonucleotide
atcattctgaaggataccagtgaagacattgaggagc

SEQ ID NO: 107522 - DNA, 36 bp, Artificial Sequence
  Description of Artificial Sequence: Synthetic oligonucleotide
tcattctgaaggataccagtgaagacattgaggagc

SEQ ID NO: 107523 - DNA, 35 bp, Artificial Sequence
  Description of Artificial Sequence: Synthetic oligonucleotide
cattctgaaggataccagtgaagacattgaggagc

SEQ ID NO: 107524 - DNA, 36 bp, Artificial Sequence
  Description of Artificial Sequence: Synthetic oligonucleotide
attctgaaggataccagtgaagacattgaggagctg

SEQ ID NO: 107525 - DNA, 35 bp, Artificial Sequence
  Description of Artificial Sequence: Synthetic oligonucleotide
ttctgaaggataccagtgaagacattgaggagctg

SEQ ID NO: 107526 - DNA, 34 bp, Artificial Sequence
  Description of Artificial Sequence: Synthetic oligonucleotide
tctgaaggataccagtgaagacattgaggagctg

SEQ ID NO: 107527 - DNA, 33 bp, Artificial Sequence
  Description of Artificial Sequence: Synthetic oligonucleotide
ctgaaggataccagtgaagacattgaggagctg

SEQ ID NO: 107528 - DNA, 33 bp, Artificial Sequence
  Description of Artificial Sequence: Synthetic oligonucleotide
tgaaggataccagtgaagacattgaggagctgg

SEQ ID NO: 107529 - DNA, 32 bp, Artificial Sequence
  Description of Artificial Sequence: Synthetic oligonucleotide
gaaggataccagtgaagacattgaggagctgg

SEQ ID NO: 107530 - DNA, 33 bp, Artificial Sequence
  Description of Artificial Sequence: Synthetic oligonucleotide
aaggataccagtgaagacattgaggagctggtg

SEQ ID NO: 107531 - DNA, 32 bp, Artificial Sequence
  Description of Artificial Sequence: Synthetic oligonucleotide
aggataccagtgaagacattgaggagctggtg

SEQ ID NO: 107532 - DNA, 31 bp, Artificial Sequence
  Description of Artificial Sequence: Synthetic oligonucleotide
ggataccagtgaagacattgaggagctggtg

SEQ ID NO: 107533 - DNA, 31 bp, Artificial Sequence
  Description of Artificial Sequence: Synthetic oligonucleotide
gataccagtgaagacattgaggagctggtgg

SEQ ID NO: 107534 - DNA, 33 bp, Artificial Sequence
  Description of Artificial Sequence: Synthetic oligonucleotide
ataccagtgaagacattgaggagctggtggaac

SEQ ID NO: 107535 - DNA, 32 bp, Artificial Sequence
  Description of Artificial Sequence: Synthetic oligonucleotide
taccagtgaagacattgaggagctggtggaac

SEQ ID NO: 107536 - DNA, 31 bp, Artificial Sequence
  Description of Artificial Sequence: Synthetic oligonucleotide
accagtgaagacattgaggagctggtggaac

SEQ ID NO: 107537 - DNA, 30 bp, Artificial Sequence
  Description of Artificial Sequence: Synthetic oligonucleotide
ccagtgaagacattgaggagctggtggaac

SEQ ID NO: 107538 - DNA, 30 bp, Artificial Sequence
  Description of Artificial Sequence: Synthetic oligonucleotide
cagtgaagacattgaggagctggtggaacc

SEQ ID NO: 107539 - DNA, 31 bp, Artificial Sequence
  Description of Artificial Sequence: Synthetic oligonucleotide
agtgaagacattgaggagctggtggaacctg

SEQ ID NO: 107540 - DNA, 30 bp, Artificial Sequence
  Description of Artificial Sequence: Synthetic oligonucleotide
gtgaagacattgaggagctggtggaacctg

SEQ ID NO: 107541 - DNA, 31 bp, Artificial Sequence
  Description of Artificial Sequence: Synthetic oligonucleotide
tgaagacattgaggagctggtggaacctgtg

SEQ ID NO: 107542 - DNA, 30 bp, Artificial Sequence
  Description of Artificial Sequence: Synthetic oligonucleotide
gaagacattgaggagctggtggaacctgtg

SEQ ID NO: 107543 - DNA, 30 bp, Artificial Sequence
  Description of Artificial Sequence: Synthetic oligonucleotide
aagacattgaggagctggtggaacctgtgg

SEQ ID NO: 107544 - DNA, 29 bp, Artificial Sequence
  Description of Artificial Sequence: Synthetic oligonucleotide
agacattgaggagctggtggaacctgtgg

SEQ ID NO: 107545 - DNA, 28 bp, Artificial Sequence
  Description of Artificial Sequence: Synthetic oligonucleotide
gacattgaggagctggtggaacctgtgg

SEQ ID NO: 107546 - DNA, 28 bp, Artificial Sequence
  Description of Artificial Sequence: Synthetic oligonucleotide
acattgaggagctggtggaacctgtggc

SEQ ID NO: 107547 - DNA, 27 bp, Artificial Sequence
  Description of Artificial Sequence: Synthetic oligonucleotide
cattgaggagctggtggaacctgtggc

SEQ ID NO: 107548 - DNA, 28 bp, Artificial Sequence
  Description of Artificial Sequence: Synthetic oligonucleotide
attgaggagctggtggaacctgtggcag

SEQ ID NO: 107549 - DNA, 27 bp, Artificial Sequence
  Description of Artificial Sequence: Synthetic oligonucleotide
ttgaggagctggtggaacctgtggcag

SEQ ID NO: 107550 - DNA, 26 bp, Artificial Sequence
  Description of Artificial Sequence: Synthetic oligonucleotide
tgaggagctggtggaacctgtggcag

SEQ ID NO: 107551 - DNA, 25 bp, Artificial Sequence
  Description of Artificial Sequence: Synthetic oligonucleotide
gaggagctggtggaacctgtggcag

SEQ ID NO: 107552 - DNA, 26 bp, Artificial Sequence
  Description of Artificial Sequence: Synthetic oligonucleotide
aggagctggtggaacctgtggcagca

SEQ ID NO: 107553 - DNA, 25 bp, Artificial Sequence
  Description of Artificial Sequence: Synthetic oligonucleotide
ggagctggtggaacctgtggcagca

SEQ ID NO: 107554 - DNA, 27 bp, Artificial Sequence
  Description of Artificial Sequence: Synthetic oligonucleotide
gagctggtggaacctgtggcagcacat

SEQ ID NO: 107555 - DNA, 27 bp, Artificial Sequence
  Description of Artificial Sequence: Synthetic oligonucleotide
agctggtggaacctgtggcagcacatg

SEQ ID NO: 107556 - DNA, 26 bp, Artificial Sequence
  Description of Artificial Sequence: Synthetic oligonucleotide
gctggtggaacctgtggcagcacatg

SEQ ID NO: 107557 - DNA, 26 bp, Artificial Sequence
  Description of Artificial Sequence: Synthetic oligonucleotide
ctggtggaacctgtggcagcacatgg

SEQ ID NO: 107558 - DNA, 26 bp, Artificial Sequence
  Description of Artificial Sequence: Synthetic oligonucleotide
tggtggaacctgtggcagcacatggc

SEQ ID NO: 107559 - DNA, 25 bp, Artificial Sequence
  Description of Artificial Sequence: Synthetic oligonucleotide
ggtggaacctgtggcagcacatggc

SEQ ID NO: 107560 - DNA, 25 bp, Artificial Sequence
  Description of Artificial Sequence: Synthetic oligonucleotide
gtggaacctgtggcagcacatggcc

SEQ ID NO: 107561 - DNA, 27 bp, Artificial Sequence
  Description of Artificial Sequence: Synthetic oligonucleotide
tggaacctgtggcagcacatggcccaa

SEQ ID NO: 107562 - DNA, 27 bp, Artificial Sequence
  Description of Artificial Sequence: Synthetic oligonucleotide
ggaacctgtggcagcacatggcccaaa

SEQ ID NO: 107563 - DNA, 30 bp, Artificial Sequence
  Description of Artificial Sequence: Synthetic oligonucleotide
gaacctgtggcagcacatggcccaaaaatc

SEQ ID NO: 107564 - DNA, 30 bp, Artificial Sequence
  Description of Artificial Sequence: Synthetic oligonucleotide
aacctgtggcagcacatggcccaaaaatcg

SEQ ID NO: 107565 - DNA, 29 bp, Artificial Sequence
  Description of Artificial Sequence: Synthetic oligonucleotide
acctgtggcagcacatggcccaaaaatcg

SEQ ID NO: 107566 - DNA, 28 bp, Artificial Sequence
  Description of Artificial Sequence: Synthetic oligonucleotide
cctgtggcagcacatggcccaaaaatcg

SEQ ID NO: 107567 - DNA, 29 bp, Artificial Sequence
  Description of Artificial Sequence: Synthetic oligonucleotide
ctgtggcagcacatggcccaaaaatcgag

SEQ ID NO: 107568 - DNA, 29 bp, Artificial Sequence
  Description of Artificial Sequence: Synthetic oligonucleotide
tgtggcagcacatggcccaaaaatcgagg

SEQ ID NO: 107569 - DNA, 28 bp, Artificial Sequence
  Description of Artificial Sequence: Synthetic oligonucleotide
gtggcagcacatggcccaaaaatcgagg

SEQ ID NO: 107570 - DNA, 29 bp, Artificial Sequence
  Description of Artificial Sequence: Synthetic oligonucleotide
tggcagcacatggcccaaaaatcgaggag

SEQ ID NO: 107571 - DNA, 28 bp, Artificial Sequence
  Description of Artificial Sequence: Synthetic oligonucleotide
ggcagcacatggcccaaaaatcgaggag

SEQ ID NO: 107572 - DNA, 28 bp, Artificial Sequence
  Description of Artificial Sequence: Synthetic oligonucleotide
gcagcacatggcccaaaaatcgaggagg

SEQ ID NO: 107573 - DNA, 29 bp, Artificial Sequence
  Description of Artificial Sequence: Synthetic oligonucleotide
cagcacatggcccaaaaatcgaggaggag

SEQ ID NO: 107574 - DNA, 29 bp, Artificial Sequence
  Description of Artificial Sequence: Synthetic oligonucleotide
agcacatggcccaaaaatcgaggaggagg

SEQ ID NO: 107575 - DNA, 28 bp, Artificial Sequence
  Description of Artificial Sequence: Synthetic oligonucleotide
gcacatggcccaaaaatcgaggaggagg

SEQ ID NO: 107576 - DNA, 30 bp, Artificial Sequence
  Description of Artificial Sequence: Synthetic oligonucleotide
cacatggcccaaaaatcgaggaggaggaac

SEQ ID NO: 107577 - DNA, 32 bp, Artificial Sequence
  Description of Artificial Sequence: Synthetic oligonucleotide
acatggcccaaaaatcgaggaggaggaacaag

SEQ ID NO: 107578 - DNA, 31 bp, Artificial Sequence
  Description of Artificial Sequence: Synthetic oligonucleotide
catggcccaaaaatcgaggaggaggaacaag

SEQ ID NO: 107579 - DNA, 32 bp, Artificial Sequence
  Description of Artificial Sequence: Synthetic oligonucleotide
atggcccaaaaatcgaggaggaggaacaagag

SEQ ID NO: 107580 - DNA, 31 bp, Artificial Sequence
  Description of Artificial Sequence: Synthetic oligonucleotide
tggcccaaaaatcgaggaggaggaacaagag

SEQ ID NO: 107581 - DNA, 30 bp, Artificial Sequence
  Description of Artificial Sequence: Synthetic oligonucleotide
ggcccaaaaatcgaggaggaggaacaagag

SEQ ID NO: 107582 - DNA, 30 bp, Artificial Sequence
  Description of Artificial Sequence: Synthetic oligonucleotide
gcccaaaaatcgaggaggaggaacaagagc

SEQ ID NO: 107583 - DNA, 30 bp, Artificial Sequence
  Description of Artificial Sequence: Synthetic oligonucleotide
cccaaaaatcgaggaggaggaacaagagcc

SEQ ID NO: 107584 - DNA, 31 bp, Artificial Sequence
  Description of Artificial Sequence: Synthetic oligonucleotide
ccaaaaatcgaggaggaggaacaagagccag

SEQ ID NO: 107585 - DNA, 33 bp, Artificial Sequence
  Description of Artificial Sequence: Synthetic oligonucleotide
caaaaatcgaggaggaggaacaagagccagaac

SEQ ID NO: 107586 - DNA, 33 bp, Artificial Sequence
  Description of Artificial Sequence: Synthetic oligonucleotide
aaaaatcgaggaggaggaacaagagccagaacc

SEQ ID NO: 107587 - DNA, 32 bp, Artificial Sequence
  Description of Artificial Sequence: Synthetic oligonucleotide
aaaatcgaggaggaggaacaagagccagaacc

SEQ ID NO: 107588 - DNA, 31 bp, Artificial Sequence
  Description of Artificial Sequence: Synthetic oligonucleotide
aaatcgaggaggaggaacaagagccagaacc

SEQ ID NO: 107589 - DNA, 30 bp, Artificial Sequence
  Description of Artificial Sequence: Synthetic oligonucleotide
aatcgaggaggaggaacaagagccagaacc

SEQ ID NO: 107590 - DNA, 29 bp, Artificial Sequence
  Description of Artificial Sequence: Synthetic oligonucleotide
atcgaggaggaggaacaagagccagaacc

SEQ ID NO: 107591 - DNA, 28 bp, Artificial Sequence
  Description of Artificial Sequence: Synthetic oligonucleotide
tcgaggaggaggaacaagagccagaacc

SEQ ID NO: 107592 - DNA, 27 bp, Artificial Sequence
  Description of Artificial Sequence: Synthetic oligonucleotide
cgaggaggaggaacaagagccagaacc

SEQ ID NO: 107593 - DNA, 27 bp, Artificial Sequence
  Description of Artificial Sequence: Synthetic oligonucleotide
gaggaggaggaacaagagccagaaccc

SEQ ID NO: 107594 - DNA, 27 bp, Artificial Sequence
  Description of Artificial Sequence: Synthetic oligonucleotide
aggaggaggaacaagagccagaacccc

SEQ ID NO: 107595 - DNA, 26 bp, Artificial Sequence
  Description of Artificial Sequence: Synthetic oligonucleotide
ggaggaggaacaagagccagaacccc

SEQ ID NO: 107596 - DNA, 27 bp, Artificial Sequence
  Description of Artificial Sequence: Synthetic oligonucleotide
gaggaggaacaagagccagaaccccca

SEQ ID NO: 107597 - DNA, 27 bp, Artificial Sequence
  Description of Artificial Sequence: Synthetic oligonucleotide
aggaggaacaagagccagaacccccag

SEQ ID NO: 107598 - DNA, 27 bp, Artificial Sequence
  Description of Artificial Sequence: Synthetic oligonucleotide
ggaggaacaagagccagaacccccaga

SEQ ID NO: 107599 - DNA, 28 bp, Artificial Sequence
  Description of Artificial Sequence: Synthetic oligonucleotide
gaggaacaagagccagaacccccagaac

SEQ ID NO: 107600 - DNA, 28 bp, Artificial Sequence
  Description of Artificial Sequence: Synthetic oligonucleotide
aggaacaagagccagaacccccagaacc

SEQ ID NO: 107601 - DNA, 27 bp, Artificial Sequence
  Description of Artificial Sequence: Synthetic oligonucleotide
ggaacaagagccagaacccccagaacc

SEQ ID NO: 107602 - DNA, 31 bp, Artificial Sequence
  Description of Artificial Sequence: Synthetic oligonucleotide
gaacaagagccagaacccccagaaccatttg

SEQ ID NO: 107603 - DNA, 32 bp, Artificial Sequence
  Description of Artificial Sequence: Synthetic oligonucleotide
aacaagagccagaacccccagaaccatttgag

SEQ ID NO: 107604 - DNA, 31 bp, Artificial Sequence
  Description of Artificial Sequence: Synthetic oligonucleotide
acaagagccagaacccccagaaccatttgag

SEQ ID NO: 107605 - DNA, 30 bp, Artificial Sequence
  Description of Artificial Sequence: Synthetic oligonucleotide
caagagccagaacccccagaaccatttgag

SEQ ID NO: 107606 - DNA, 36 bp, Artificial Sequence
  Description of Artificial Sequence: Synthetic oligonucleotide
aagagccagaacccccagaaccatttgagtatattg

SEQ ID NO: 107607 - DNA, 35 bp, Artificial Sequence
  Description of Artificial Sequence: Synthetic oligonucleotide
agagccagaacccccagaaccatttgagtatattg

SEQ ID NO: 107608 - DNA, 34 bp, Artificial Sequence
  Description of Artificial Sequence: Synthetic oligonucleotide
gagccagaacccccagaaccatttgagtatattg

SEQ ID NO: 107609 - DNA, 36 bp, Artificial Sequence
  Description of Artificial Sequence: Synthetic oligonucleotide
agccagaacccccagaaccatttgagtatattgatg

SEQ ID NO: 107610 - DNA, 35 bp, Artificial Sequence
  Description of Artificial Sequence: Synthetic oligonucleotide
gccagaacccccagaaccatttgagtatattgatg

SEQ ID NO: 107611 - DNA, 36 bp, Artificial Sequence
  Description of Artificial Sequence: Synthetic oligonucleotide
ctacctgtgtcattggccttaacaaggacttaaagg

SEQ ID NO: 107612 - DNA, 39 bp, Artificial Sequence
  Description of Artificial Sequence: Synthetic oligonucleotide
tacctgtgtcattggccttaacaaggacttaaaggtttc

SEQ ID NO: 107613 - DNA, 38 bp, Artificial Sequence
  Description of Artificial Sequence: Synthetic oligonucleotide
acctgtgtcattggccttaacaaggacttaaaggtttc

SEQ ID NO: 107614 - DNA, 37 bp, Artificial Sequence
  Description of Artificial Sequence: Synthetic oligonucleotide
cctgtgtcattggccttaacaaggacttaaaggtttc

SEQ ID NO: 107615 - DNA, 39 bp, Artificial Sequence
  Description of Artificial Sequence: Synthetic oligonucleotide
ctgtgtcattggccttaacaaggacttaaaggtttctac

SEQ ID NO: 107616 - DNA, 40 bp, Artificial Sequence
  Description of Artificial Sequence: Synthetic oligonucleotide
tgtgtcattggccttaacaaggacttaaaggtttctactg

SEQ ID NO: 107617 - DNA, 39 bp, Artificial Sequence
  Description of Artificial Sequence: Synthetic oligonucleotide
gtgtcattggccttaacaaggacttaaaggtttctactg

SEQ ID NO: 107618 - DNA, 39 bp, Artificial Sequence
  Description of Artificial Sequence: Synthetic oligonucleotide
tgtcattggccttaacaaggacttaaaggtttctactgc

SEQ ID NO: 107619 - DNA, 38 bp, Artificial Sequence
  Description of Artificial Sequence: Synthetic oligonucleotide
gtcattggccttaacaaggacttaaaggtttctactgc

SEQ ID NO: 107620 - DNA, 39 bp, Artificial Sequence
  Description of Artificial Sequence: Synthetic oligonucleotide
tcattggccttaacaaggacttaaaggtttctactgctg

SEQ ID NO: 107621 - DNA, 38 bp, Artificial Sequence
  Description of Artificial Sequence: Synthetic oligonucleotide
cattggccttaacaaggacttaaaggtttctactgctg

SEQ ID NO: 107622 - DNA, 44 bp, Artificial Sequence
  Description of Artificial Sequence: Synthetic oligonucleotide
attggccttaacaaggacttaaaggtttctactgctgtattatc

SEQ ID NO: 107623 - DNA, 43 bp, Artificial Sequence
  Description of Artificial Sequence: Synthetic oligonucleotide
ttggccttaacaaggacttaaaggtttctactgctgtattatc

SEQ ID NO: 107624 - DNA, 42 bp, Artificial Sequence
  Description of Artificial Sequence: Synthetic oligonucleotide
tggccttaacaaggacttaaaggtttctactgctgtattatc

SEQ ID NO: 107625 - DNA, 41 bp, Artificial Sequence
  Description of Artificial Sequence: Synthetic oligonucleotide
ggccttaacaaggacttaaaggtttctactgctgtattatc

SEQ ID NO: 107626 - DNA, 46 bp, Artificial Sequence
  Description of Artificial Sequence: Synthetic oligonucleotide
gccttaacaaggacttaaaggtttctactgctgtattatctataac

SEQ ID NO: 107627 - DNA, 47 bp, Artificial Sequence
  Description of Artificial Sequence: Synthetic oligonucleotide
ccttaacaaggacttaaaggtttctactgctgtattatctataactg

SEQ ID NO: 107628 - DNA, 47 bp, Artificial Sequence
  Description of Artificial Sequence: Synthetic oligonucleotide
cttaacaaggacttaaaggtttctactgctgtattatctataactgc

SEQ ID NO: 107629 - DNA, 47 bp, Artificial Sequence
  Description of Artificial Sequence: Synthetic oligonucleotide
ttaacaaggacttaaaggtttctactgctgtattatctataactgcc

SEQ ID NO: 107630 - DNA, 46 bp, Artificial Sequence
  Description of Artificial Sequence: Synthetic oligonucleotide
taacaaggacttaaaggtttctactgctgtattatctataactgcc

SEQ ID NO: 107631 - DNA, 45 bp, Artificial Sequence
  Description of Artificial Sequence: Synthetic oligonucleotide
aacaaggacttaaaggtttctactgctgtattatctataactgcc

SEQ ID NO: 107632 - DNA, 44 bp, Artificial Sequence
  Description of Artificial Sequence: Synthetic oligonucleotide
acaaggacttaaaggtttctactgctgtattatctataactgcc

SEQ ID NO: 107633 - DNA, 43 bp, Artificial Sequence
  Description of Artificial Sequence: Synthetic oligonucleotide
caaggacttaaaggtttctactgctgtattatctataactgcc

SEQ ID NO: 107634 - DNA, 45 bp, Artificial Sequence
  Description of Artificial Sequence: Synthetic oligonucleotide
aaggacttaaaggtttctactgctgtattatctataactgccaag

SEQ ID NO: 107635 - DNA, 44 bp, Artificial Sequence
  Description of Artificial Sequence: Synthetic oligonucleotide
aggacttaaaggtttctactgctgtattatctataactgccaag

SEQ ID NO: 107636 - DNA, 43 bp, Artificial Sequence
  Description of Artificial Sequence: Synthetic oligonucleotide
ggacttaaaggtttctactgctgtattatctataactgccaag

SEQ ID NO: 107637 - DNA, 43 bp, Artificial Sequence
  Description of Artificial Sequence: Synthetic oligonucleotide
gacttaaaggtttctactgctgtattatctataactgccaagg

SEQ ID NO: 107638 - DNA, 43 bp, Artificial Sequence
  Description of Artificial Sequence: Synthetic oligonucleotide
acttaaaggtttctactgctgtattatctataactgccaaggc

SEQ ID NO: 107639 - DNA, 42 bp, Artificial Sequence
  Description of Artificial Sequence: Synthetic oligonucleotide
cttaaaggtttctactgctgtattatctataactgccaaggc

SEQ ID NO: 107640 - DNA, 48 bp, Artificial Sequence
  Description of Artificial Sequence: Synthetic oligonucleotide
ttaaaggtttctactgctgtattatctataactgccaaggctaaaaag

SEQ ID NO: 107641 - DNA, 47 bp, Artificial Sequence
  Description of Artificial Sequence: Synthetic oligonucleotide
taaaggtttctactgctgtattatctataactgccaaggctaaaaag

SEQ ID NO: 107642 - DNA, 26 bp, Artificial Sequence
  Description of Artificial Sequence: Synthetic oligonucleotide
atggctagctctaggtgtcccgctcc

SEQ ID NO: 107643 - DNA, 25 bp, Artificial Sequence
  Description of Artificial Sequence: Synthetic oligonucleotide
tggctagctctaggtgtcccgctcc

SEQ ID NO: 107644 - DNA, 24 bp, Artificial Sequence
  Description of Artificial Sequence: Synthetic oligonucleotide
ggctagctctaggtgtcccgctcc

SEQ ID NO: 107645 - DNA, 24 bp, Artificial Sequence
  Description of Artificial Sequence: Synthetic oligonucleotide
gctagctctaggtgtcccgctccc

SEQ ID NO: 107646 - DNA, 24 bp, Artificial Sequence
  Description of Artificial Sequence: Synthetic oligonucleotide
ctagctctaggtgtcccgctcccc

SEQ ID NO: 107647 - DNA, 24 bp, Artificial Sequence
  Description of Artificial Sequence: Synthetic oligonucleotide
tagctctaggtgtcccgctccccg

SEQ ID NO: 107648 - DNA, 23 bp, Artificial Sequence
  Description of Artificial Sequence: Synthetic oligonucleotide
agctctaggtgtcccgctccccg

SEQ ID NO: 107649 - DNA, 22 bp, Artificial Sequence
  Description of Artificial Sequence: Synthetic oligonucleotide
gctctaggtgtcccgctccccg

SEQ ID NO: 107650 - DNA, 22 bp, Artificial Sequence
  Description of Artificial Sequence: Synthetic oligonucleotide
ctctaggtgtcccgctccccgc

SEQ ID NO: 107651 - DNA, 22 bp, Artificial Sequence
  Description of Artificial Sequence: Synthetic oligonucleotide
tctaggtgtcccgctccccgcg

SEQ ID NO: 107652 - DNA, 21 bp, Artificial Sequence
  Description of Artificial Sequence: Synthetic oligonucleotide
ctaggtgtcccgctccccgcg

SEQ ID NO: 107653 - DNA, 21 bp, Artificial Sequence
  Description of Artificial Sequence: Synthetic oligonucleotide
taggtgtcccgctccccgcgg

SEQ ID NO: 107654 - DNA, 20 bp, Artificial Sequence
  Description of Artificial Sequence: Synthetic oligonucleotide
aggtgtcccgctccccgcgg

SEQ ID NO: 107655 - DNA, 20 bp, Artificial Sequence
  Description of Artificial Sequence: Synthetic oligonucleotide
ggtgtcccgctccccgcggt

SEQ ID NO: 107656 - DNA, 20 bp, Artificial Sequence
  Description of Artificial Sequence: Synthetic oligonucleotide
gtgtcccgctccccgcgggt

SEQ ID NO: 107657 - DNA, 20 bp, Artificial Sequence
  Description of Artificial Sequence: Synthetic oligonucleotide
tgtcccgctccccgcgggtg

SEQ ID NO: 107658 - DNA, 20 bp, Artificial Sequence
  Description of Artificial Sequence: Synthetic oligonucleotide
gtcccgctccccgcgggtgt

SEQ ID NO: 107659 - DNA, 20 bp, Artificial Sequence
  Description of Artificial Sequence: Synthetic oligonucleotide
tcccgctccccgcgggtgct

SEQ ID NO: 107660 - DNA, 20 bp, Artificial Sequence
  Description of Artificial Sequence: Synthetic oligonucleotide
cccgctccccgcgggtgctt

SEQ ID NO: 107661 - DNA, 20 bp, Artificial Sequence
  Description of Artificial Sequence: Synthetic oligonucleotide
ccgctccccgcgggtgcctt

SEQ ID NO: 107662 - DNA, 20 bp, Artificial Sequence
  Description of Artificial Sequence: Synthetic oligonucleotide
cgctccccgcgggtgccgtt

SEQ ID NO: 107663 - DNA, 20 bp, Artificial Sequence
  Description of Artificial Sequence: Synthetic oligonucleotide
gctccccgcgggtgccgctt

SEQ ID NO: 107664 - DNA, 20 bp, Artificial Sequence
  Description of Artificial Sequence: Synthetic oligonucleotide
ctccccgcgggtgccgctgt

SEQ ID NO: 107665 - DNA, 20 bp, Artificial Sequence
  Description of Artificial Sequence: Synthetic oligonucleotide
tccccgcgggtgccgctgct

SEQ ID NO: 107666 - DNA, 20 bp, Artificial Sequence
  Description of Artificial Sequence: Synthetic oligonucleotide
ccccgcgggtgccgctgctt

SEQ ID NO: 107667 - DNA, 20 bp, Artificial Sequence
  Description of Artificial Sequence: Synthetic oligonucleotide
cccgcgggtgccgctgcctt

SEQ ID NO: 107668 - DNA, 20 bp, Artificial Sequence
  Description of Artificial Sequence: Synthetic oligonucleotide
ccgcgggtgccgctgcctct

SEQ ID NO: 107669 - DNA, 20 bp, Artificial Sequence
  Description of Artificial Sequence: Synthetic oligonucleotide
cgcgggtgccgctgcctcct

SEQ ID NO: 107670 - DNA, 20 bp, Artificial Sequence
  Description of Artificial Sequence: Synthetic oligonucleotide
gcgggtgccgctgcctccct

SEQ ID NO: 107671 - DNA, 20 bp, Artificial Sequence
  Description of Artificial Sequence: Synthetic oligonucleotide
cgggtgccgctgcctcccct

SEQ ID NO: 107672 - DNA, 20 bp, Artificial Sequence
  Description of Artificial Sequence: Synthetic oligonucleotide
gggtgccgctgcctccccgt

SEQ ID NO: 107673 - DNA, 20 bp, Artificial Sequence
  Description of Artificial Sequence: Synthetic oligonucleotide
ggtgccgctgcctccccgga

SEQ ID NO: 107674 - DNA, 20 bp, Artificial Sequence
  Description of Artificial Sequence: Synthetic oligonucleotide
gtgccgctgcctccccggag

SEQ ID NO: 107675 - DNA, 22 bp, Artificial Sequence
  Description of Artificial Sequence: Synthetic oligonucleotide
tgccgctgcctccccggagctt

SEQ ID NO: 107676 - DNA, 21 bp, Artificial Sequence
  Description of Artificial Sequence: Synthetic oligonucleotide
gccgctgcctccccggagctt

SEQ ID NO: 107677 - DNA, 22 bp, Artificial Sequence
  Description of Artificial Sequence: Synthetic oligonucleotide
ccgctgcctccccggagcttct

SEQ ID NO: 107678 - DNA, 23 bp, Artificial Sequence
  Description of Artificial Sequence: Synthetic oligonucleotide
cgctgcctccccggagcttctct

SEQ ID NO: 107679 - DNA, 23 bp, Artificial Sequence
  Description of Artificial Sequence: Synthetic oligonucleotide
gctgcctccccggagcttctctc

SEQ ID NO: 107680 - DNA, 23 bp, Artificial Sequence
  Description of Artificial Sequence: Synthetic oligonucleotide
ctgcctccccggagcttctctcg

SEQ ID NO: 107681 - DNA, 25 bp, Artificial Sequence
  Description of Artificial Sequence: Synthetic oligonucleotide
tgcctccccggagcttctctcgcat

SEQ ID NO: 107682 - DNA, 24 bp, Artificial Sequence
  Description of Artificial Sequence: Synthetic oligonucleotide
gcctccccggagcttctctcgcat

SEQ ID NO: 107683 - DNA, 24 bp, Artificial Sequence
  Description of Artificial Sequence: Synthetic oligonucleotide
cctccccggagcttctctcgcatg

SEQ ID NO: 107684 - DNA, 24 bp, Artificial Sequence
  Description of Artificial Sequence: Synthetic oligonucleotide
ctccccggagcttctctcgcatgg

SEQ ID NO: 107685 - DNA, 25 bp, Artificial Sequence
  Description of Artificial Sequence: Synthetic oligonucleotide
tccccggagcttctctcgcatggct

SEQ ID NO: 107686 - DNA, 24 bp, Artificial Sequence
  Description of Artificial Sequence: Synthetic oligonucleotide
ccccggagcttctctcgcatggct

SEQ ID NO: 107687 - DNA, 24 bp, Artificial Sequence
  Description of Artificial Sequence: Synthetic oligonucleotide
cccggagcttctctcgcatggctg

SEQ ID NO: 107688 - DNA, 24 bp, Artificial Sequence
  Description of Artificial Sequence: Synthetic oligonucleotide
ccggagcttctctcgcatggctgg

SEQ ID NO: 107689 - DNA, 24 bp, Artificial Sequence
  Description of Artificial Sequence: Synthetic oligonucleotide
cggagcttctctcgcatggctggg

SEQ ID NO: 107690 - DNA, 25 bp, Artificial Sequence
  Description of Artificial Sequence: Synthetic oligonucleotide
ggagcttctctcgcatggctgggga

SEQ ID NO: 107691 - DNA, 26 bp, Artificial Sequence
  Description of Artificial Sequence: Synthetic oligonucleotide
gagcttctctcgcatggctggggaca

SEQ ID NO: 107692 - DNA, 27 bp, Artificial Sequence
  Description of Artificial Sequence: Synthetic oligonucleotide
agcttctctcgcatggctggggacagt

SEQ ID NO: 107693 - DNA, 27 bp, Artificial Sequence
  Description of Artificial Sequence: Synthetic oligonucleotide
gcttctctcgcatggctggggacagta

SEQ ID NO: 107694 - DNA, 27 bp, Artificial Sequence
  Description of Artificial Sequence: Synthetic oligonucleotide
cttctctcgcatggctggggacagtac

SEQ ID NO: 107695 - DNA, 28 bp, Artificial Sequence
  Description of Artificial Sequence: Synthetic oligonucleotide
ttctctcgcatggctggggacagtactg

SEQ ID NO: 107696 - DNA, 27 bp, Artificial Sequence
  Description of Artificial Sequence: Synthetic oligonucleotide
tctctcgcatggctggggacagtactg

SEQ ID NO: 107697 - DNA, 26 bp, Artificial Sequence
  Description of Artificial Sequence: Synthetic oligonucleotide
ctctcgcatggctggggacagtactg

SEQ ID NO: 107698 - DNA, 27 bp, Artificial Sequence
  Description of Artificial Sequence: Synthetic oligonucleotide
tctcgcatggctggggacagtactgct

SEQ ID NO: 107699 - DNA, 27 bp, Artificial Sequence
  Description of Artificial Sequence: Synthetic oligonucleotide
ctcgcatggctggggacagtactgcta

SEQ ID NO: 107700 - DNA, 27 bp, Artificial Sequence
  Description of Artificial Sequence: Synthetic oligonucleotide
tcgcatggctggggacagtactgctac

SEQ ID NO: 107701 - DNA, 27 bp, Artificial Sequence
  Description of Artificial Sequence: Synthetic oligonucleotide
cgcatggctggggacagtactgctact

SEQ ID NO: 107702 - DNA, 28 bp, Artificial Sequence
  Description of Artificial Sequence: Synthetic oligonucleotide
gcatggctggggacagtactgctacttc

SEQ ID NO: 107703 - DNA, 29 bp, Artificial Sequence
  Description of Artificial Sequence: Synthetic oligonucleotide
catggctggggacagtactgctacttctc

SEQ ID NO: 107704 - DNA, 29 bp, Artificial Sequence
  Description of Artificial Sequence: Synthetic oligonucleotide
atggctggggacagtactgctacttctcg

SEQ ID NO: 107705 - DNA, 28 bp, Artificial Sequence
  Description of Artificial Sequence: Synthetic oligonucleotide
tggctggggacagtactgctacttctcg

SEQ ID NO: 107706 - DNA, 27 bp, Artificial Sequence
  Description of Artificial Sequence: Synthetic oligonucleotide
ggctggggacagtactgctacttctcg

SEQ ID NO: 107707 - DNA, 27 bp, Artificial Sequence
  Description of Artificial Sequence: Synthetic oligonucleotide
gctggggacagtactgctacttctcgc

SEQ ID NO: 107708 - DNA, 27 bp, Artificial Sequence
  Description of Artificial Sequence: Synthetic oligonucleotide
ctggggacagtactgctacttctcgcc

SEQ ID NO: 107709 - DNA, 27 bp, Artificial Sequence
  Description of Artificial Sequence: Synthetic oligonucleotide
tggggacagtactgctacttctcgccg

SEQ ID NO: 107710 - DNA, 27 bp, Artificial Sequence
  Description of Artificial Sequence: Synthetic oligonucleotide
ggggacagtactgctacttctcgccga

SEQ ID NO: 107711 - DNA, 27 bp, Artificial Sequence
  Description of Artificial Sequence: Synthetic oligonucleotide
gggacagtactgctacttctcgccgac

SEQ ID NO: 107712 - DNA, 28 bp, Artificial Sequence
  Description of Artificial Sequence: Synthetic oligonucleotide
ggacagtactgctacttctcgccgactg

SEQ ID NO: 107713 - DNA, 28 bp, Artificial Sequence
  Description of Artificial Sequence: Synthetic oligonucleotide
gacagtactgctacttctcgccgactgg

SEQ ID NO: 107714 - DNA, 28 bp, Artificial Sequence
  Description of Artificial Sequence: Synthetic oligonucleotide
acagtactgctacttctcgccgactggg

SEQ ID NO: 107715 - DNA, 27 bp, Artificial Sequence
  Description of Artificial Sequence: Synthetic oligonucleotide
cagtactgctacttctcgccgactggg

SEQ ID NO: 107716 - DNA, 28 bp, Artificial Sequence
  Description of Artificial Sequence: Synthetic oligonucleotide
agtactgctacttctcgccgactgggtg

SEQ ID NO: 107717 - DNA, 27 bp, Artificial Sequence
  Description of Artificial Sequence: Synthetic oligonucleotide
gtactgctacttctcgccgactgggtg

SEQ ID NO: 107718 - DNA, 27 bp, Artificial Sequence
  Description of Artificial Sequence: Synthetic oligonucleotide
tactgctacttctcgccgactgggtgc

SEQ ID NO: 107719 - DNA, 27 bp, Artificial Sequence
  Description of Artificial Sequence: Synthetic oligonucleotide
actgctacttctcgccgactgggtgct

SEQ ID NO: 107720 - DNA, 26 bp, Artificial Sequence
  Description of Artificial Sequence: Synthetic oligonucleotide
ctgctacttctcgccgactgggtgct

SEQ ID NO: 107721 - DNA, 26 bp, Artificial Sequence
  Description of Artificial Sequence: Synthetic oligonucleotide
tgctacttctcgccgactgggtgctg

SEQ ID NO: 107722 - DNA, 25 bp, Artificial Sequence
  Description of Artificial Sequence: Synthetic oligonucleotide
gctacttctcgccgactgggtgctg

SEQ ID NO: 107723 - DNA, 26 bp, Artificial Sequence
  Description of Artificial Sequence: Synthetic oligonucleotide
ctacttctcgccgactgggtgctgct

SEQ ID NO: 107724 - DNA, 26 bp, Artificial Sequence
  Description of Artificial Sequence: Synthetic oligonucleotide
tacttctcgccgactgggtgctgctc

SEQ ID NO: 107725 - DNA, 25 bp, Artificial Sequence
  Description of Artificial Sequence: Synthetic oligonucleotide
acttctcgccgactgggtgctgctc

SEQ ID NO: 107726 - DNA, 24 bp, Artificial Sequence
  Description of Artificial Sequence: Synthetic oligonucleotide
cttctcgccgactgggtgctgctc

SEQ ID NO: 107727 - DNA, 24 bp, Artificial Sequence
  Description of Artificial Sequence: Synthetic oligonucleotide
ttctcgccgactgggtgctgctcc

SEQ ID NO: 107728 - DNA, 23 bp, Artificial Sequence
  Description of Artificial Sequence: Synthetic oligonucleotide
tctcgccgactgggtgctgctcc

SEQ ID NO: 107729 - DNA, 22 bp, Artificial Sequence
  Description of Artificial Sequence: Synthetic oligonucleotide
ctcgccgactgggtgctgctcc

SEQ ID NO: 107730 - DNA, 22 bp, Artificial Sequence
  Description of Artificial Sequence: Synthetic oligonucleotide
tcgccgactgggtgctgctccg

SEQ ID NO: 107731 - DNA, 21 bp, Artificial Sequence
  Description of Artificial Sequence: Synthetic oligonucleotide
cgccgactgggtgctgctccg

SEQ ID NO: 107732 - DNA, 22 bp, Artificial Sequence
  Description of Artificial Sequence: Synthetic oligonucleotide
gccgactgggtgctgctccgga

SEQ ID NO: 107733 - DNA, 22 bp, Artificial Sequence
  Description of Artificial Sequence: Synthetic oligonucleotide
ccgactgggtgctgctccggac

SEQ ID NO: 107734 - DNA, 22 bp, Artificial Sequence
  Description of Artificial Sequence: Synthetic oligonucleotide
cgactgggtgctgctccggacc

SEQ ID NO: 107735 - DNA, 22 bp, Artificial Sequence
  Description of Artificial Sequence: Synthetic oligonucleotide
gactgggtgctgctccggaccg

SEQ ID NO: 107736 - DNA, 22 bp, Artificial Sequence
  Description of Artificial Sequence: Synthetic oligonucleotide
actgggtgctgctccggaccgc

SEQ ID NO: 107737 - DNA, 21 bp, Artificial Sequence
  Description of Artificial Sequence: Synthetic oligonucleotide
ctgggtgctgctccggaccgc

SEQ ID NO: 107738 - DNA, 21 bp, Artificial Sequence
  Description of Artificial Sequence: Synthetic oligonucleotide
tgggtgctgctccggaccgcg

SEQ ID NO: 107739 - DNA, 20 bp, Artificial Sequence
  Description of Artificial Sequence: Synthetic oligonucleotide
gggtgctgctccggaccgcg

SEQ ID NO: 107740 - DNA, 21 bp, Artificial Sequence
  Description of Artificial Sequence: Synthetic oligonucleotide
ggtgctgctccggaccgcgct

SEQ ID NO: 107741 - DNA, 21 bp, Artificial Sequence
  Description of Artificial Sequence: Synthetic oligonucleotide
gtgctgctccggaccgcgctg

SEQ ID NO: 107742 - DNA, 21 bp, Artificial Sequence
  Description of Artificial Sequence: Synthetic oligonucleotide
tgctgctccggaccgcgctgc

SEQ ID NO: 107743 - DNA, 20 bp, Artificial Sequence
  Description of Artificial Sequence: Synthetic oligonucleotide
gctgctccggaccgcgctgc

SEQ ID NO: 107744 - DNA, 20 bp, Artificial Sequence
  Description of Artificial Sequence: Synthetic oligonucleotide
ctgctccggaccgcgctgcc

SEQ ID NO: 107745 - DNA, 20 bp, Artificial Sequence
  Description of Artificial Sequence: Synthetic oligonucleotide
tgctccggaccgcgctgccc

SEQ ID NO: 107746 - DNA, 20 bp, Artificial Sequence
  Description of Artificial Sequence: Synthetic oligonucleotide
gctccggaccgcgctgccct

SEQ ID NO: 107747 - DNA, 20 bp, Artificial Sequence
  Description of Artificial Sequence: Synthetic oligonucleotide
ctccggaccgcgctgcccct

SEQ ID NO: 107748 - DNA, 20 bp, Artificial Sequence
  Description of Artificial Sequence: Synthetic oligonucleotide
tccggaccgcgctgccccgt

SEQ ID NO: 107749 - DNA, 20 bp, Artificial Sequence
  Description of Artificial Sequence: Synthetic oligonucleotide
ccggaccgcgctgccccgtt

SEQ ID NO: 107750 - DNA, 23 bp, Artificial Sequence
  Description of Artificial Sequence: Synthetic oligonucleotide
cggaccgcgctgccccgcatatt

SEQ ID NO: 107751 - DNA, 24 bp, Artificial Sequence
  Description of Artificial Sequence: Synthetic oligonucleotide
ggaccgcgctgccccgcatattct

SEQ ID NO: 107752 - DNA, 24 bp, Artificial Sequence
  Description of Artificial Sequence: Synthetic oligonucleotide
gaccgcgctgccccgcatattctc

SEQ ID NO: 107753 - DNA, 24 bp, Artificial Sequence
  Description of Artificial Sequence: Synthetic oligonucleotide
accgcgctgccccgcatattctcc

SEQ ID NO: 107754 - DNA, 23 bp, Artificial Sequence
  Description of Artificial Sequence: Synthetic oligonucleotide
ccgcgctgccccgcatattctcc

SEQ ID NO: 107755 - DNA, 24 bp, Artificial Sequence
  Description of Artificial Sequence: Synthetic oligonucleotide
cgcgctgccccgcatattctccct

SEQ ID NO: 107756 - DNA, 24 bp, Artificial Sequence
  Description of Artificial Sequence: Synthetic oligonucleotide
gcgctgccccgcatattctccctg

SEQ ID NO: 107757 - DNA, 25 bp, Artificial Sequence
  Description of Artificial Sequence: Synthetic oligonucleotide
cgctgccccgcatattctccctgct

SEQ ID NO: 107758 - DNA, 25 bp, Artificial Sequence
  Description of Artificial Sequence: Synthetic oligonucleotide
gctgccccgcatattctccctgctg

SEQ ID NO: 107759 - DNA, 26 bp, Artificial Sequence
  Description of Artificial Sequence: Synthetic oligonucleotide
ctgccccgcatattctccctgctggt

SEQ ID NO: 107760 - DNA, 26 bp, Artificial Sequence
  Description of Artificial Sequence: Synthetic oligonucleotide
tgccccgcatattctccctgctggtg

SEQ ID NO: 107761 - DNA, 25 bp, Artificial Sequence
  Description of Artificial Sequence: Synthetic oligonucleotide
gccccgcatattctccctgctggtg

SEQ ID NO: 107762 - DNA, 25 bp, Artificial Sequence
  Description of Artificial Sequence: Synthetic oligonucleotide
ccccgcatattctccctgctggtgc

SEQ ID NO: 107763 - DNA, 25 bp, Artificial Sequence
  Description of Artificial Sequence: Synthetic oligonucleotide
cccgcatattctccctgctggtgcc

SEQ ID NO: 107764 - DNA, 26 bp, Artificial Sequence
  Description of Artificial Sequence: Synthetic oligonucleotide
ccgcatattctccctgctggtgccca

SEQ ID NO: 107765 - DNA, 26 bp, Artificial Sequence
  Description of Artificial Sequence: Synthetic oligonucleotide
cgcatattctccctgctggtgcccac

SEQ ID NO: 107766 - DNA, 26 bp, Artificial Sequence
  Description of Artificial Sequence: Synthetic oligonucleotide
gcatattctccctgctggtgcccacc

SEQ ID NO: 107767 - DNA, 26 bp, Artificial Sequence
  Description of Artificial Sequence: Synthetic oligonucleotide
catattctccctgctggtgcccaccg

SEQ ID NO: 107768 - DNA, 26 bp, Artificial Sequence
  Description of Artificial Sequence: Synthetic oligonucleotide
atattctccctgctggtgcccaccgc

SEQ ID NO: 107769 - DNA, 25 bp, Artificial Sequence
  Description of Artificial Sequence: Synthetic oligonucleotide
tattctccctgctggtgcccaccgc

SEQ ID NO: 107770 - DNA, 24 bp, Artificial Sequence
  Description of Artificial Sequence: Synthetic oligonucleotide
attctccctgctggtgcccaccgc

SEQ ID NO: 107771 - DNA, 23 bp, Artificial Sequence
  Description of Artificial Sequence: Synthetic oligonucleotide
ttctccctgctggtgcccaccgc

SEQ ID NO: 107772 - DNA, 22 bp, Artificial Sequence
  Description of Artificial Sequence: Synthetic oligonucleotide
tctccctgctggtgcccaccgc

SEQ ID NO: 107773 - DNA, 21 bp, Artificial Sequence
  Description of Artificial Sequence: Synthetic oligonucleotide
ctccctgctggtgcccaccgc

SEQ ID NO: 107774 - DNA, 21 bp, Artificial Sequence
  Description of Artificial Sequence: Synthetic oligonucleotide
tccctgctggtgcccaccgcg

SEQ ID NO: 107775 - DNA, 20 bp, Artificial Sequence
  Description of Artificial Sequence: Synthetic oligonucleotide
ccctgctggtgcccaccgcg

SEQ ID NO: 107776 - DNA, 21 bp, Artificial Sequence
  Description of Artificial Sequence: Synthetic oligonucleotide
cctgctggtgcccaccgcgct

SEQ ID NO: 107777 - DNA, 21 bp, Artificial Sequence
  Description of Artificial Sequence: Synthetic oligonucleotide
ctgctggtgcccaccgcgctg

SEQ ID NO: 107778 - DNA, 21 bp, Artificial Sequence
  Description of Artificial Sequence: Synthetic oligonucleotide
tgctggtgcccaccgcgctgc

SEQ ID NO: 107779 - DNA, 20 bp, Artificial Sequence
  Description of Artificial Sequence: Synthetic oligonucleotide
gctggtgcccaccgcgctgc

SEQ ID NO: 107780 - DNA, 21 bp, Artificial Sequence
  Description of Artificial Sequence: Synthetic oligonucleotide
ctggtgcccaccgcgctgcca

SEQ ID NO: 107781 - DNA, 22 bp, Artificial Sequence
  Description of Artificial Sequence: Synthetic oligonucleotide
tggtgcccaccgcgctgccact

SEQ ID NO: 107782 - DNA, 21 bp, Artificial Sequence
  Description of Artificial Sequence: Synthetic oligonucleotide
ggtgcccaccgcgctgccact

SEQ ID NO: 107783 - DNA, 21 bp, Artificial Sequence
  Description of Artificial Sequence: Synthetic oligonucleotide
gtgcccaccgcgctgccactg

SEQ ID NO: 107784 - DNA, 22 bp, Artificial Sequence
  Description of Artificial Sequence: Synthetic oligonucleotide
tgcccaccgcgctgccactgct

SEQ ID NO: 107785 - DNA, 21 bp, Artificial Sequence
  Description of Artificial Sequence: Synthetic oligonucleotide
gcccaccgcgctgccactgct

SEQ ID NO: 107786 - DNA, 21 bp, Artificial Sequence
  Description of Artificial Sequence: Synthetic oligonucleotide
cccaccgcgctgccactgctc

SEQ ID NO: 107787 - DNA, 21 bp, Artificial Sequence
  Description of Artificial Sequence: Synthetic oligonucleotide
ccaccgcgctgccactgctcc

SEQ ID NO: 107788 - DNA, 21 bp, Artificial Sequence
  Description of Artificial Sequence: Synthetic oligonucleotide
caccgcgctgccactgctccg

SEQ ID NO: 107789 - DNA, 21 bp, Artificial Sequence
  Description of Artificial Sequence: Synthetic oligonucleotide
accgcgctgccactgctccgg

SEQ ID NO: 107790 - DNA, 20 bp, Artificial Sequence
  Description of Artificial Sequence: Synthetic oligonucleotide
ccgcgctgccactgctccgg

SEQ ID NO: 107791 - DNA, 21 bp, Artificial Sequence
  Description of Artificial Sequence: Synthetic oligonucleotide
cgcgctgccactgctccgggt

SEQ ID NO: 107792 - DNA, 22 bp, Artificial Sequence
  Description of Artificial Sequence: Synthetic oligonucleotide
gcgctgccactgctccgggtct

SEQ ID NO: 107793 - DNA, 22 bp, Artificial Sequence
  Description of Artificial Sequence: Synthetic oligonucleotide
cgctgccactgctccgggtctg

SEQ ID NO: 107794 - DNA, 22 bp, Artificial Sequence
  Description of Artificial Sequence: Synthetic oligonucleotide
gctgccactgctccgggtctgg

SEQ ID NO: 107795 - DNA, 22 bp, Artificial Sequence
  Description of Artificial Sequence: Synthetic oligonucleotide
ctgccactgctccgggtctggg

SEQ ID NO: 107796 - DNA, 22 bp, Artificial Sequence
  Description of Artificial Sequence: Synthetic oligonucleotide
tgccactgctccgggtctgggc

SEQ ID NO: 107797 - DNA, 21 bp, Artificial Sequence
  Description of Artificial Sequence: Synthetic oligonucleotide
gccactgctccgggtctgggc

SEQ ID NO: 107798 - DNA, 21 bp, Artificial Sequence
  Description of Artificial Sequence: Synthetic oligonucleotide
ccactgctccgggtctgggcg

SEQ ID NO: 107799 - DNA, 22 bp, Artificial Sequence
  Description of Artificial Sequence: Synthetic oligonucleotide
cactgctccgggtctgggcggt

SEQ ID NO: 107800 - DNA, 22 bp, Artificial Sequence
  Description of Artificial Sequence: Synthetic oligonucleotide
actgctccgggtctgggcggtg

SEQ ID NO: 107801 - DNA, 21 bp, Artificial Sequence
  Description of Artificial Sequence: Synthetic oligonucleotide
ctgctccgggtctgggcggtg

SEQ ID NO: 107802 - DNA, 21 bp, Artificial Sequence
  Description of Artificial Sequence: Synthetic oligonucleotide
tgctccgggtctgggcggtgg

SEQ ID NO: 107803 - DNA, 20 bp, Artificial Sequence
  Description of Artificial Sequence: Synthetic oligonucleotide
gctccgggtctgggcggtgg

SEQ ID NO: 107804 - DNA, 20 bp, Artificial Sequence
  Description of Artificial Sequence: Synthetic oligonucleotide
ctccgggtctgggcggtggg

SEQ ID NO: 107805 - DNA, 20 bp, Artificial Sequence
  Description of Artificial Sequence: Synthetic oligonucleotide
tccgggtctgggcggtgggc

SEQ ID NO: 107806 - DNA, 20 bp, Artificial Sequence
  Description of Artificial Sequence: Synthetic oligonucleotide
ccgggtctgggcggtgggct

SEQ ID NO: 107807 - DNA, 20 bp, Artificial Sequence
  Description of Artificial Sequence: Synthetic oligonucleotide
cgggtctgggcggtgggcct

SEQ ID NO: 107808 - DNA, 21 bp, Artificial Sequence
  Description of Artificial Sequence: Synthetic oligonucleotide
gggtctgggcggtgggcctga

SEQ ID NO: 107809 - DNA, 21 bp, Artificial Sequence
  Description of Artificial Sequence: Synthetic oligonucleotide
ggtctgggcggtgggcctgag

SEQ ID NO: 107810 - DNA, 21 bp, Artificial Sequence
  Description of Artificial Sequence: Synthetic oligonucleotide
gtctgggcggtgggcctgagc

SEQ ID NO: 107811 - DNA, 21 bp, Artificial Sequence
  Description of Artificial Sequence: Synthetic oligonucleotide
tctgggcggtgggcctgagcc

SEQ ID NO: 107812 - DNA, 20 bp, Artificial Sequence
  Description of Artificial Sequence: Synthetic oligonucleotide
ctgggcggtgggcctgagcc

SEQ ID NO: 107813 - DNA, 20 bp, Artificial Sequence
  Description of Artificial Sequence: Synthetic oligonucleotide
tgggcggtgggcctgagccg

SEQ ID NO: 107814 - DNA, 20 bp, Artificial Sequence
  Description of Artificial Sequence: Synthetic oligonucleotide
gggcggtgggcctgagccgt

SEQ ID NO: 107815 - DNA, 20 bp, Artificial Sequence
  Description of Artificial Sequence: Synthetic oligonucleotide
ggcggtgggcctgagccgct

SEQ ID NO: 107816 - DNA, 20 bp, Artificial Sequence
  Description of Artificial Sequence: Synthetic oligonucleotide
gcggtgggcctgagccgctg

SEQ ID NO: 107817 - DNA, 20 bp, Artificial Sequence
  Description of Artificial Sequence: Synthetic oligonucleotide
cggtgggcctgagccgctgg

SEQ ID NO: 107818 - DNA, 20 bp, Artificial Sequence
  Description of Artificial Sequence: Synthetic oligonucleotide
ggtgggcctgagccgctggg

SEQ ID NO: 107819 - DNA, 20 bp, Artificial Sequence
  Description of Artificial Sequence: Synthetic oligonucleotide
gtgggcctgagccgctgggc

SEQ ID NO: 107820 - DNA, 20 bp, Artificial Sequence
  Description of Artificial Sequence: Synthetic oligonucleotide
tgggcctgagccgctgggcc

SEQ ID NO: 107821 - DNA, 20 bp, Artificial Sequence
  Description of Artificial Sequence: Synthetic oligonucleotide
gggcctgagccgctgggcct

SEQ ID NO: 107822 - DNA, 20 bp, Artificial Sequence
  Description of Artificial Sequence: Synthetic oligonucleotide
ggcctgagccgctgggccgt

SEQ ID NO: 107823 - DNA, 20 bp, Artificial Sequence
  Description of Artificial Sequence: Synthetic oligonucleotide
gcctgagccgctgggccgtg

SEQ ID NO: 107824 - DNA, 21 bp, Artificial Sequence
  Description of Artificial Sequence: Synthetic oligonucleotide
cctgagccgctgggccgtgct

SEQ ID NO: 107825 - DNA, 22 bp, Artificial Sequence
  Description of Artificial Sequence: Synthetic oligonucleotide
ctgagccgctgggccgtgctct

SEQ ID NO: 107826 - DNA, 22 bp, Artificial Sequence
  Description of Artificial Sequence: Synthetic oligonucleotide
tgagccgctgggccgtgctctg

SEQ ID NO: 107827 - DNA, 21 bp, Artificial Sequence
  Description of Artificial Sequence: Synthetic oligonucleotide
gagccgctgggccgtgctctg

SEQ ID NO: 107828 - DNA, 21 bp, Artificial Sequence
  Description of Artificial Sequence: Synthetic oligonucleotide
agccgctgggccgtgctctgg

SEQ ID NO: 107829 - DNA, 20 bp, Artificial Sequence
  Description of Artificial Sequence: Synthetic oligonucleotide
gccgctgggccgtgctctgg

SEQ ID NO: 107830 - DNA, 21 bp, Artificial Sequence
  Description of Artificial Sequence: Synthetic oligonucleotide
ccgctgggccgtgctctggct

SEQ ID NO: 107831 - DNA, 21 bp, Artificial Sequence
  Description of Artificial Sequence: Synthetic oligonucleotide
cgctgggccgtgctctggctg

SEQ ID NO: 107832 - DNA, 21 bp, Artificial Sequence
  Description of Artificial Sequence: Synthetic oligonucleotide
gctgggccgtgctctggctgg

SEQ ID NO: 107833 - DNA, 21 bp, Artificial Sequence
  Description of Artificial Sequence: Synthetic oligonucleotide
ctgggccgtgctctggctggg

SEQ ID NO: 107834 - DNA, 21 bp, Artificial Sequence
  Description of Artificial Sequence: Synthetic oligonucleotide
tgggccgtgctctggctgggg

SEQ ID NO: 107835 - DNA, 20 bp, Artificial Sequence
  Description of Artificial Sequence: Synthetic oligonucleotide
gggccgtgctctggctgggg

SEQ ID NO: 107836 - DNA, 20 bp, Artificial Sequence
  Description of Artificial Sequence: Synthetic oligonucleotide
ggccgtgctctggctggggg

SEQ ID NO: 107837 - DNA, 20 bp, Artificial Sequence
  Description of Artificial Sequence: Synthetic oligonucleotide
gccgtgctctggctgggggc

SEQ ID NO: 107838 - DNA, 21 bp, Artificial Sequence
  Description of Artificial Sequence: Synthetic oligonucleotide
ccgtgctctggctgggggcct

SEQ ID NO: 107839 - DNA, 21 bp, Artificial Sequence
  Description of Artificial Sequence: Synthetic oligonucleotide
cgtgctctggctgggggcctg

SEQ ID NO: 107840 - DNA, 21 bp, Artificial Sequence
  Description of Artificial Sequence: Synthetic oligonucleotide
gtgctctggctgggggcctgc

SEQ ID NO: 107841 - DNA, 21 bp, Artificial Sequence
  Description of Artificial Sequence: Synthetic oligonucleotide
tgctctggctgggggcctgcg

SEQ ID NO: 107842 - DNA, 20 bp, Artificial Sequence
  Description of Artificial Sequence: Synthetic oligonucleotide
gctctggctgggggcctgcg

SEQ ID NO: 107843 - DNA, 20 bp, Artificial Sequence
  Description of Artificial Sequence: Synthetic oligonucleotide
ctctggctgggggcctgcgg

SEQ ID NO: 107844 - DNA, 20 bp, Artificial Sequence
  Description of Artificial Sequence: Synthetic oligonucleotide
tctggctgggggcctgcggg

SEQ ID NO: 107845 - DNA, 20 bp, Artificial Sequence
  Description of Artificial Sequence: Synthetic oligonucleotide
ctggctgggggcctgcgggt

SEQ ID NO: 107846 - DNA, 20 bp, Artificial Sequence
  Description of Artificial Sequence: Synthetic oligonucleotide
tggctgggggcctgcggggt

SEQ ID NO: 107847 - DNA, 20 bp, Artificial Sequence
  Description of Artificial Sequence: Synthetic oligonucleotide
ggctgggggcctgcggggtt

SEQ ID NO: 107848 - DNA, 20 bp, Artificial Sequence
  Description of Artificial Sequence: Synthetic oligonucleotide
gctgggggcctgcggggtct

SEQ ID NO: 107849 - DNA, 20 bp, Artificial Sequence
  Description of Artificial Sequence: Synthetic oligonucleotide
ctgggggcctgcggggtcct

SEQ ID NO: 107850 - DNA, 21 bp, Artificial Sequence
  Description of Artificial Sequence: Synthetic oligonucleotide
tgggggcctgcggggtcctca

SEQ ID NO: 107851 - DNA, 20 bp, Artificial Sequence
  Description of Artificial Sequence: Synthetic oligonucleotide
gggggcctgcggggtcctca

SEQ ID NO: 107852 - DNA, 20 bp, Artificial Sequence
  Description of Artificial Sequence: Synthetic oligonucleotide
ggggcctgcggggtcctcag

SEQ ID NO: 107853 - DNA, 20 bp, Artificial Sequence
  Description of Artificial Sequence: Synthetic oligonucleotide
gggcctgcggggtcctcagg

SEQ ID NO: 107854 - DNA, 20 bp, Artificial Sequence
  Description of Artificial Sequence: Synthetic oligonucleotide
ggcctgcggggtcctcaggg

SEQ ID NO: 107855 - DNA, 22 bp, Artificial Sequence
  Description of Artificial Sequence: Synthetic oligonucleotide
gcctgcggggtcctcagggcaa

SEQ ID NO: 107856 - DNA, 22 bp, Artificial Sequence
  Description of Artificial Sequence: Synthetic oligonucleotide
cctgcggggtcctcagggcaac

SEQ ID NO: 107857 - DNA, 22 bp, Artificial Sequence
  Description of Artificial Sequence: Synthetic oligonucleotide
ctgcggggtcctcagggcaacg

SEQ ID NO: 107858 - DNA, 24 bp, Artificial Sequence
  Description of Artificial Sequence: Synthetic oligonucleotide
tgcggggtcctcagggcaacggtt

SEQ ID NO: 107859 - DNA, 23 bp, Artificial Sequence
  Description of Artificial Sequence: Synthetic oligonucleotide
gcggggtcctcagggcaacggtt

SEQ ID NO: 107860 - DNA, 23 bp, Artificial Sequence
  Description of Artificial Sequence: Synthetic oligonucleotide
cggggtcctcagggcaacggttg

SEQ ID NO: 107861 - DNA, 23 bp, Artificial Sequence
  Description of Artificial Sequence: Synthetic oligonucleotide
ggggtcctcagggcaacggttgg

SEQ ID NO: 107862 - DNA, 24 bp, Artificial Sequence
  Description of Artificial Sequence: Synthetic oligonucleotide
gggtcctcagggcaacggttggct

SEQ ID NO: 107863 - DNA, 24 bp, Artificial Sequence
  Description of Artificial Sequence: Synthetic oligonucleotide
ggtcctcagggcaacggttggctc

SEQ ID NO: 107864 - DNA, 26 bp, Artificial Sequence
  Description of Artificial Sequence: Synthetic oligonucleotide
gtcctcagggcaacggttggctccaa

SEQ ID NO: 107865 - DNA, 27 bp, Artificial Sequence
  Description of Artificial Sequence: Synthetic oligonucleotide
tcctcagggcaacggttggctccaaga

SEQ ID NO: 107866 - DNA, 26 bp, Artificial Sequence
  Description of Artificial Sequence: Synthetic oligonucleotide
cctcagggcaacggttggctccaaga

SEQ ID NO: 107867 - DNA, 26 bp, Artificial Sequence
  Description of Artificial Sequence: Synthetic oligonucleotide
ctcagggcaacggttggctccaagag

SEQ ID NO: 107868 - DNA, 26 bp, Artificial Sequence
  Description of Artificial Sequence: Synthetic oligonucleotide
tcagggcaacggttggctccaagagc

SEQ ID NO: 107869 - DNA, 25 bp, Artificial Sequence
  Description of Artificial Sequence: Synthetic oligonucleotide
cagggcaacggttggctccaagagc

SEQ ID NO: 107870 - DNA, 27 bp, Artificial Sequence
  Description of Artificial Sequence: Synthetic oligonucleotide
agggcaacggttggctccaagagcgaa

SEQ ID NO: 107871 - DNA, 27 bp, Artificial Sequence
  Description of Artificial Sequence: Synthetic oligonucleotide
gggcaacggttggctccaagagcgaaa

SEQ ID NO: 107872 - DNA, 28 bp, Artificial Sequence
  Description of Artificial Sequence: Synthetic oligonucleotide
ggcaacggttggctccaagagcgaaaac

SEQ ID NO: 107873 - DNA, 28 bp, Artificial Sequence
  Description of Artificial Sequence: Synthetic oligonucleotide
gcaacggttggctccaagagcgaaaacg

SEQ ID NO: 107874 - DNA, 28 bp, Artificial Sequence
  Description of Artificial Sequence: Synthetic oligonucleotide
caacggttggctccaagagcgaaaacgc

SEQ ID NO: 107875 - DNA, 29 bp, Artificial Sequence
  Description of Artificial Sequence: Synthetic oligonucleotide
aacggttggctccaagagcgaaaacgcag

SEQ ID NO: 107876 - DNA, 28 bp, Artificial Sequence
  Description of Artificial Sequence: Synthetic oligonucleotide
acggttggctccaagagcgaaaacgcag

SEQ ID NO: 107877 - DNA, 27 bp, Artificial Sequence
  Description of Artificial Sequence: Synthetic oligonucleotide
cggttggctccaagagcgaaaacgcag

SEQ ID NO: 107878 - DNA, 27 bp, Artificial Sequence
  Description of Artificial Sequence: Synthetic oligonucleotide
ggttggctccaagagcgaaaacgcagg

SEQ ID NO: 107879 - DNA, 28 bp, Artificial Sequence
  Description of Artificial Sequence: Synthetic oligonucleotide
gttggctccaagagcgaaaacgcaggtg

SEQ ID NO: 107880 - DNA, 28 bp, Artificial Sequence
  Description of Artificial Sequence: Synthetic oligonucleotide
ttggctccaagagcgaaaacgcaggtgc

SEQ ID NO: 107881 - DNA, 27 bp, Artificial Sequence
  Description of Artificial Sequence: Synthetic oligonucleotide
tggctccaagagcgaaaacgcaggtgc

SEQ ID NO: 107882 - DNA, 26 bp, Artificial Sequence
  Description of Artificial Sequence: Synthetic oligonucleotide
ggctccaagagcgaaaacgcaggtgc

SEQ ID NO: 107883 - DNA, 26 bp, Artificial Sequence
  Description of Artificial Sequence: Synthetic oligonucleotide
gctccaagagcgaaaacgcaggtgcc

SEQ ID NO: 107884 - DNA, 27 bp, Artificial Sequence
  Description of Artificial Sequence: Synthetic oligonucleotide
ctccaagagcgaaaacgcaggtgccca

SEQ ID NO: 107885 - DNA, 27 bp, Artificial Sequence
  Description of Artificial Sequence: Synthetic oligonucleotide
tccaagagcgaaaacgcaggtgcccag

SEQ ID NO: 107886 - DNA, 26 bp, Artificial Sequence
  Description of Artificial Sequence: Synthetic oligonucleotide
ccaagagcgaaaacgcaggtgcccag

SEQ ID NO: 107887 - DNA, 26 bp, Artificial Sequence
  Description of Artificial Sequence: Synthetic oligonucleotide
caagagcgaaaacgcaggtgcccagg

SEQ ID NO: 107888 - DNA, 26 bp, Artificial Sequence
  Description of Artificial Sequence: Synthetic oligonucleotide
aagagcgaaaacgcaggtgcccaggg

SEQ ID NO: 107889 - DNA, 25 bp, Artificial Sequence
  Description of Artificial Sequence: Synthetic oligonucleotide
agagcgaaaacgcaggtgcccaggg

SEQ ID NO: 107890 - DNA, 24 bp, Artificial Sequence
  Description of Artificial Sequence: Synthetic oligonucleotide
gagcgaaaacgcaggtgcccaggg

SEQ ID NO: 107891 - DNA, 25 bp, Artificial Sequence
  Description of Artificial Sequence: Synthetic oligonucleotide
agcgaaaacgcaggtgcccagggct

SEQ ID NO: 107892 - DNA, 24 bp, Artificial Sequence
  Description of Artificial Sequence: Synthetic oligonucleotide
gcgaaaacgcaggtgcccagggct

SEQ ID NO: 107893 - DNA, 24 bp, Artificial Sequence
  Description of Artificial Sequence: Synthetic oligonucleotide
cgaaaacgcaggtgcccagggctg

SEQ ID NO: 107894 - DNA, 24 bp, Artificial Sequence
  Description of Artificial Sequence: Synthetic oligonucleotide
gaaaacgcaggtgcccagggctgg

SEQ ID NO: 107895 - DNA, 25 bp, Artificial Sequence
  Description of Artificial Sequence: Synthetic oligonucleotide
aaaacgcaggtgcccagggctggct

SEQ ID NO: 107896 - DNA, 24 bp, Artificial Sequence
  Description of Artificial Sequence: Synthetic oligonucleotide
aaacgcaggtgcccagggctggct

SEQ ID NO: 107897 - DNA, 23 bp, Artificial Sequence
  Description of Artificial Sequence: Synthetic oligonucleotide
aacgcaggtgcccagggctggct

SEQ ID NO: 107898 - DNA, 22 bp, Artificial Sequence
  Description of Artificial Sequence: Synthetic oligonucleotide
acgcaggtgcccagggctggct

SEQ ID NO: 107899 - DNA, 21 bp, Artificial Sequence
  Description of Artificial Sequence: Synthetic oligonucleotide
cgcaggtgcccagggctggct

SEQ ID NO: 107900 - DNA, 21 bp, Artificial Sequence
  Description of Artificial Sequence: Synthetic oligonucleotide
gcaggtgcccagggctggctg

SEQ ID NO: 107901 - DNA, 21 bp, Artificial Sequence
  Description of Artificial Sequence: Synthetic oligonucleotide
caggtgcccagggctggctgg

SEQ ID NO: 107902 - DNA, 22 bp, Artificial Sequence
  Description of Artificial Sequence: Synthetic oligonucleotide
aggtgcccagggctggctggct

SEQ ID NO: 107903 - DNA, 21 bp, Artificial Sequence
  Description of Artificial Sequence: Synthetic oligonucleotide
ggtgcccagggctggctggct

SEQ ID NO: 107904 - DNA, 21 bp, Artificial Sequence
  Description of Artificial Sequence: Synthetic oligonucleotide
gtgcccagggctggctggctg

SEQ ID NO: 107905 - DNA, 24 bp, Artificial Sequence
  Description of Artificial Sequence: Synthetic oligonucleotide
tgcccagggctggctggctgcttt

SEQ ID NO: 107906 - DNA, 23 bp, Artificial Sequence
  Description of Artificial Sequence: Synthetic oligonucleotide
gcccagggctggctggctgcttt

SEQ ID NO: 107907 - DNA, 25 bp, Artificial Sequence
  Description of Artificial Sequence: Synthetic oligonucleotide
cccagggctggctggctgctttgaa

SEQ ID NO: 107908 - DNA, 25 bp, Artificial Sequence
  Description of Artificial Sequence: Synthetic oligonucleotide
ccagggctggctggctgctttgaag

SEQ ID NO: 107909 - DNA, 25 bp, Artificial Sequence
  Description of Artificial Sequence: Synthetic oligonucleotide
cagggctggctggctgctttgaagc

SEQ ID NO: 107910 - DNA, 27 bp, Artificial Sequence
  Description of Artificial Sequence: Synthetic oligonucleotide
agggctggctggctgctttgaagccat

SEQ ID NO: 107911 - DNA, 27 bp, Artificial Sequence
  Description of Artificial Sequence: Synthetic oligonucleotide
gggctggctggctgctttgaagccatt

SEQ ID NO: 107912 - DNA, 28 bp, Artificial Sequence
  Description of Artificial Sequence: Synthetic oligonucleotide
ggctggctggctgctttgaagccattag

SEQ ID NO: 107913 - DNA, 28 bp, Artificial Sequence
  Description of Artificial Sequence: Synthetic oligonucleotide
gctggctggctgctttgaagccattagc

SEQ ID NO: 107914 - DNA, 29 bp, Artificial Sequence
  Description of Artificial Sequence: Synthetic oligonucleotide
ctggctggctgctttgaagccattagctg

SEQ ID NO: 107915 - DNA, 29 bp, Artificial Sequence
  Description of Artificial Sequence: Synthetic oligonucleotide
tggctggctgctttgaagccattagctgc

SEQ ID NO: 107916 - DNA, 28 bp, Artificial Sequence
  Description of Artificial Sequence: Synthetic oligonucleotide
ggctggctgctttgaagccattagctgc

SEQ ID NO: 107917 - DNA, 28 bp, Artificial Sequence
  Description of Artificial Sequence: Synthetic oligonucleotide
gctggctgctttgaagccattagctgcg

SEQ ID NO: 107918 - DNA, 28 bp, Artificial Sequence
  Description of Artificial Sequence: Synthetic oligonucleotide
ctggctgctttgaagccattagctgcgg

SEQ ID NO: 107919 - DNA, 28 bp, Artificial Sequence
  Description of Artificial Sequence: Synthetic oligonucleotide
tggctgctttgaagccattagctgcggc

SEQ ID NO: 107920 - DNA, 27 bp, Artificial Sequence
  Description of Artificial Sequence: Synthetic oligonucleotide
ggctgctttgaagccattagctgcggc

SEQ ID NO: 107921 - DNA, 28 bp, Artificial Sequence
  Description of Artificial Sequence: Synthetic oligonucleotide
gctgctttgaagccattagctgcggcac

SEQ ID NO: 107922 - DNA, 29 bp, Artificial Sequence
  Description of Artificial Sequence: Synthetic oligonucleotide
ctgctttgaagccattagctgcggcactg

SEQ ID NO: 107923 - DNA, 29 bp, Artificial Sequence
  Description of Artificial Sequence: Synthetic oligonucleotide
tgctttgaagccattagctgcggcactgg

SEQ ID NO: 107924 - DNA, 28 bp, Artificial Sequence
  Description of Artificial Sequence: Synthetic oligonucleotide
gctttgaagccattagctgcggcactgg

SEQ ID NO: 107925 - DNA, 28 bp, Artificial Sequence
  Description of Artificial Sequence: Synthetic oligonucleotide
ctttgaagccattagctgcggcactggg

SEQ ID NO: 107926 - DNA, 28 bp, Artificial Sequence
  Description of Artificial Sequence: Synthetic oligonucleotide
tttgaagccattagctgcggcactgggc

SEQ ID NO: 107927 - DNA, 27 bp, Artificial Sequence
  Description of Artificial Sequence: Synthetic oligonucleotide
ttgaagccattagctgcggcactgggc

SEQ ID NO: 107928 - DNA, 27 bp, Artificial Sequence
  Description of Artificial Sequence: Synthetic oligonucleotide
tgaagccattagctgcggcactgggct

SEQ ID NO: 107929 - DNA, 27 bp, Artificial Sequence
  Description of Artificial Sequence: Synthetic oligonucleotide
gaagccattagctgcggcactgggctt

SEQ ID NO: 107930 - DNA, 27 bp, Artificial Sequence
  Description of Artificial Sequence: Synthetic oligonucleotide
aagccattagctgcggcactgggcttg

SEQ ID NO: 107931 - DNA, 26 bp, Artificial Sequence
  Description of Artificial Sequence: Synthetic oligonucleotide
agccattagctgcggcactgggcttg

SEQ ID NO: 107932 - DNA, 25 bp, Artificial Sequence
  Description of Artificial Sequence: Synthetic oligonucleotide
gccattagctgcggcactgggcttg

SEQ ID NO: 107933 - DNA, 25 bp, Artificial Sequence
  Description of Artificial Sequence: Synthetic oligonucleotide
ccattagctgcggcactgggcttgg

SEQ ID NO: 107934 - DNA, 25 bp, Artificial Sequence
  Description of Artificial Sequence: Synthetic oligonucleotide
cattagctgcggcactgggcttggc

SEQ ID NO: 107935 - DNA, 25 bp, Artificial Sequence
  Description of Artificial Sequence: Synthetic oligonucleotide
attagctgcggcactgggcttggcc

SEQ ID NO: 107936 - DNA, 24 bp, Artificial Sequence
  Description of Artificial Sequence: Synthetic oligonucleotide
ttagctgcggcactgggcttggcc

SEQ ID NO: 107937 - DNA, 23 bp, Artificial Sequence
  Description of Artificial Sequence: Synthetic oligonucleotide
tagctgcggcactgggcttggcc

SEQ ID NO: 107938 - DNA, 22 bp, Artificial Sequence
  Description of Artificial Sequence: Synthetic oligonucleotide
agctgcggcactgggcttggcc

SEQ ID NO: 107939 - DNA, 21 bp, Artificial Sequence
  Description of Artificial Sequence: Synthetic oligonucleotide
gctgcggcactgggcttggcc

SEQ ID NO: 107940 - DNA, 22 bp, Artificial Sequence
  Description of Artificial Sequence: Synthetic oligonucleotide
ctgcggcactgggcttggccct

SEQ ID NO: 107941 - DNA, 22 bp, Artificial Sequence
  Description of Artificial Sequence: Synthetic oligonucleotide
tgcggcactgggcttggccctg

SEQ ID NO: 107942 - DNA, 21 bp, Artificial Sequence
  Description of Artificial Sequence: Synthetic oligonucleotide
gcggcactgggcttggccctg

SEQ ID NO: 107943 - DNA, 21 bp, Artificial Sequence
  Description of Artificial Sequence: Synthetic oligonucleotide
cggcactgggcttggccctgc

SEQ ID NO: 107944 - DNA, 21 bp, Artificial Sequence
  Description of Artificial Sequence: Synthetic oligonucleotide
ggcactgggcttggccctgcc

SEQ ID NO: 107945 - DNA, 21 bp, Artificial Sequence
  Description of Artificial Sequence: Synthetic oligonucleotide
gcactgggcttggccctgccg

SEQ ID NO: 107946 - DNA, 21 bp, Artificial Sequence
  Description of Artificial Sequence: Synthetic oligonucleotide
cactgggcttggccctgccgg

SEQ ID NO: 107947 - DNA, 22 bp, Artificial Sequence
  Description of Artificial Sequence: Synthetic oligonucleotide
actgggcttggccctgccggga

SEQ ID NO: 107948 - DNA, 21 bp, Artificial Sequence
  Description of Artificial Sequence: Synthetic oligonucleotide
ctgggcttggccctgccggga

SEQ ID NO: 107949 - DNA, 23 bp, Artificial Sequence
  Description of Artificial Sequence: Synthetic oligonucleotide
tgggcttggccctgccgggactt

SEQ ID NO: 107950 - DNA, 22 bp, Artificial Sequence
  Description of Artificial Sequence: Synthetic oligonucleotide
gggcttggccctgccgggactt

SEQ ID NO: 107951 - DNA, 22 bp, Artificial Sequence
  Description of Artificial Sequence: Synthetic oligonucleotide
ggcttggccctgccgggacttg

SEQ ID NO: 107952 - DNA, 22 bp, Artificial Sequence
  Description of Artificial Sequence: Synthetic oligonucleotide
gcttggccctgccgggacttgc

SEQ ID NO: 107953 - DNA, 24 bp, Artificial Sequence
  Description of Artificial Sequence: Synthetic oligonucleotide
cttggccctgccgggacttgcctt

SEQ ID NO: 107954 - DNA, 26 bp, Artificial Sequence
  Description of Artificial Sequence: Synthetic oligonucleotide
ttggccctgccgggacttgccttgtt

SEQ ID NO: 107955 - DNA, 25 bp, Artificial Sequence
  Description of Artificial Sequence: Synthetic oligonucleotide
tggccctgccgggacttgccttgtt

SEQ ID NO: 107956 - DNA, 24 bp, Artificial Sequence
  Description of Artificial Sequence: Synthetic oligonucleotide
ggccctgccgggacttgccttgtt

SEQ ID NO: 107957 - DNA, 24 bp, Artificial Sequence
  Description of Artificial Sequence: Synthetic oligonucleotide
gccctgccgggacttgccttgttc

SEQ ID NO: 107958 - DNA, 24 bp, Artificial Sequence
  Description of Artificial Sequence: Synthetic oligonucleotide
ccctgccgggacttgccttgttcc

SEQ ID NO: 107959 - DNA, 25 bp, Artificial Sequence
  Description of Artificial Sequence: Synthetic oligonucleotide
cctgccgggacttgccttgttccga

SEQ ID NO: 107960 - DNA, 26 bp, Artificial Sequence
  Description of Artificial Sequence: Synthetic oligonucleotide
ctgccgggacttgccttgttccgaga

SEQ ID NO: 107961 - DNA, 26 bp, Artificial Sequence
  Description of Artificial Sequence: Synthetic oligonucleotide
tgccgggacttgccttgttccgagag

SEQ ID NO: 107962 - DNA, 25 bp, Artificial Sequence
  Description of Artificial Sequence: Synthetic oligonucleotide
gccgggacttgccttgttccgagag

SEQ ID NO: 107963 - DNA, 26 bp, Artificial Sequence
  Description of Artificial Sequence: Synthetic oligonucleotide
ccgggacttgccttgttccgagagct

SEQ ID NO: 107964 - DNA, 27 bp, Artificial Sequence
  Description of Artificial Sequence: Synthetic oligonucleotide
cgggacttgccttgttccgagagctga

SEQ ID NO: 107965 - DNA, 28 bp, Artificial Sequence
  Description of Artificial Sequence: Synthetic oligonucleotide
gggacttgccttgttccgagagctgatc

SEQ ID NO: 107966 - DNA, 29 bp, Artificial Sequence
  Description of Artificial Sequence: Synthetic oligonucleotide
ggacttgccttgttccgagagctgatctc

SEQ ID NO: 107967 - DNA, 31 bp, Artificial Sequence
  Description of Artificial Sequence: Synthetic oligonucleotide
gacttgccttgttccgagagctgatctcatg

SEQ ID NO: 107968 - DNA, 31 bp, Artificial Sequence
  Description of Artificial Sequence: Synthetic oligonucleotide
acttgccttgttccgagagctgatctcatgg

SEQ ID NO: 107969 - DNA, 30 bp, Artificial Sequence
  Description of Artificial Sequence: Synthetic oligonucleotide
cttgccttgttccgagagctgatctcatgg

SEQ ID NO: 107970 - DNA, 30 bp, Artificial Sequence
  Description of Artificial Sequence: Synthetic oligonucleotide
ttgccttgttccgagagctgatctcatggg

SEQ ID NO: 107971 - DNA, 29 bp, Artificial Sequence
  Description of Artificial Sequence: Synthetic oligonucleotide
tgccttgttccgagagctgatctcatggg

SEQ ID NO: 107972 - DNA, 28 bp, Artificial Sequence
  Description of Artificial Sequence: Synthetic oligonucleotide
gccttgttccgagagctgatctcatggg

SEQ ID NO: 107973 - DNA, 28 bp, Artificial Sequence
  Description of Artificial Sequence: Synthetic oligonucleotide
ccttgttccgagagctgatctcatgggg

SEQ ID NO: 107974 - DNA, 29 bp, Artificial Sequence
  Description of Artificial Sequence: Synthetic oligonucleotide
cttgttccgagagctgatctcatggggag

SEQ ID NO: 107975 - DNA, 29 bp, Artificial Sequence
  Description of Artificial Sequence: Synthetic oligonucleotide
ttgttccgagagctgatctcatggggagc

SEQ ID NO: 107976 - DNA, 28 bp, Artificial Sequence
  Description of Artificial Sequence: Synthetic oligonucleotide
tgttccgagagctgatctcatggggagc

SEQ ID NO: 107977 - DNA, 27 bp, Artificial Sequence
  Description of Artificial Sequence: Synthetic oligonucleotide
gttccgagagctgatctcatggggagc

SEQ ID NO: 107978 - DNA, 27 bp, Artificial Sequence
  Description of Artificial Sequence: Synthetic oligonucleotide
ttccgagagctgatctcatggggagcc

SEQ ID NO: 107979 - DNA, 26 bp, Artificial Sequence
  Description of Artificial Sequence: Synthetic oligonucleotide
tccgagagctgatctcatggggagcc

SEQ ID NO: 107980 - DNA, 25 bp, Artificial Sequence
  Description of Artificial Sequence: Synthetic oligonucleotide
ccgagagctgatctcatggggagcc

SEQ ID NO: 107981 - DNA, 25 bp, Artificial Sequence
  Description of Artificial Sequence: Synthetic oligonucleotide
cgagagctgatctcatggggagccc

SEQ ID NO: 107982 - DNA, 25 bp, Artificial Sequence
  Description of Artificial Sequence: Synthetic oligonucleotide
gagagctgatctcatggggagcccc

SEQ ID NO: 107983 - DNA, 25 bp, Artificial Sequence
  Description of Artificial Sequence: Synthetic oligonucleotide
agagctgatctcatggggagccccc

SEQ ID NO: 107984 - DNA, 24 bp, Artificial Sequence
  Description of Artificial Sequence: Synthetic oligonucleotide
gagctgatctcatggggagccccc

SEQ ID NO: 107985 - DNA, 24 bp, Artificial Sequence
  Description of Artificial Sequence: Synthetic oligonucleotide
agctgatctcatggggagcccccg

SEQ ID NO: 107986 - DNA, 23 bp, Artificial Sequence
  Description of Artificial Sequence: Synthetic oligonucleotide
gctgatctcatggggagcccccg

SEQ ID NO: 107987 - DNA, 23 bp, Artificial Sequence
  Description of Artificial Sequence: Synthetic oligonucleotide
ctgatctcatggggagcccccgg

SEQ ID NO: 107988 - DNA, 24 bp, Artificial Sequence
  Description of Artificial Sequence: Synthetic oligonucleotide
tgatctcatggggagcccccgggt

SEQ ID NO: 107989 - DNA, 23 bp, Artificial Sequence
  Description of Artificial Sequence: Synthetic oligonucleotide
gatctcatggggagcccccgggt

SEQ ID NO: 107990 - DNA, 23 bp, Artificial Sequence
  Description of Artificial Sequence: Synthetic oligonucleotide
atctcatggggagcccccgggtc

SEQ ID NO: 107991 - DNA, 22 bp, Artificial Sequence
  Description of Artificial Sequence: Synthetic oligonucleotide
tctcatggggagcccccgggtc

SEQ ID NO: 107992 - DNA, 21 bp, Artificial Sequence
  Description of Artificial Sequence: Synthetic oligonucleotide
ctcatggggagcccccgggtc

SEQ ID NO: 107993 - DNA, 21 bp, Artificial Sequence
  Description of Artificial Sequence: Synthetic oligonucleotide
tcatggggagcccccgggtcc

SEQ ID NO: 107994 - DNA, 20 bp, Artificial Sequence
  Description of Artificial Sequence: Synthetic oligonucleotide
catggggagcccccgggtcc

SEQ ID NO: 107995 - DNA, 20 bp, Artificial Sequence
  Description of Artificial Sequence: Synthetic oligonucleotide
atggggagcccccgggtccg

SEQ ID NO: 107996 - DNA, 20 bp, Artificial Sequence
  Description of Artificial Sequence: Synthetic oligonucleotide
tggggagcccccgggtccgt

SEQ ID NO: 107997 - DNA, 20 bp, Artificial Sequence
  Description of Artificial Sequence: Synthetic oligonucleotide
ggggagcccccgggtccgtt

SEQ ID NO: 107998 - DNA, 20 bp, Artificial Sequence
  Description of Artificial Sequence: Synthetic oligonucleotide
gggagcccccgggtccgctt

SEQ ID NO: 107999 - DNA, 20 bp, Artificial Sequence
  Description of Artificial Sequence: Synthetic oligonucleotide
ggagcccccgggtccgcgtt

SEQ ID NO: 108000 - DNA, 21 bp, Artificial Sequence
  Description of Artificial Sequence: Synthetic oligonucleotide
gagcccccgggtccgcggata

SEQ ID NO: 108001 - DNA, 21 bp, Artificial Sequence
  Description of Artificial Sequence: Synthetic oligonucleotide
agcccccgggtccgcggatag

SEQ ID NO: 108002 - DNA, 20 bp, Artificial Sequence
  Description of Artificial Sequence: Synthetic oligonucleotide
gcccccgggtccgcggatag

SEQ ID NO: 108003 - DNA, 21 bp, Artificial Sequence
  Description of Artificial Sequence: Synthetic oligonucleotide
cccccgggtccgcggatagca

SEQ ID NO: 108004 - DNA, 21 bp, Artificial Sequence
  Description of Artificial Sequence: Synthetic oligonucleotide
ccccgggtccgcggatagcac

SEQ ID NO: 108005 - DNA, 22 bp, Artificial Sequence
  Description of Artificial Sequence: Synthetic oligonucleotide
cccgggtccgcggatagcacca

SEQ ID NO: 108006 - DNA, 22 bp, Artificial Sequence
  Description of Artificial Sequence: Synthetic oligonucleotide
ccgggtccgcggatagcaccag

SEQ ID NO: 108007 - DNA, 22 bp, Artificial Sequence
  Description of Artificial Sequence: Synthetic oligonucleotide
cgggtccgcggatagcaccagg

SEQ ID NO: 108008 - DNA, 24 bp, Artificial Sequence
  Description of Artificial Sequence: Synthetic oligonucleotide
gggtccgcggatagcaccaggcta

SEQ ID NO: 108009 - DNA, 25 bp, Artificial Sequence
  Description of Artificial Sequence: Synthetic oligonucleotide
ggtccgcggatagcaccaggctact

SEQ ID NO: 108010 - DNA, 25 bp, Artificial Sequence
  Description of Artificial Sequence: Synthetic oligonucleotide
gtccgcggatagcaccaggctactg

SEQ ID NO: 108011 - DNA, 26 bp, Artificial Sequence
  Description of Artificial Sequence: Synthetic oligonucleotide
tccgcggatagcaccaggctactgca

SEQ ID NO: 108012 - DNA, 25 bp, Artificial Sequence
  Description of Artificial Sequence: Synthetic oligonucleotide
ccgcggatagcaccaggctactgca

SEQ ID NO: 108013 - DNA, 26 bp, Artificial Sequence
  Description of Artificial Sequence: Synthetic oligonucleotide
cgcggatagcaccaggctactgcact

SEQ ID NO: 108014 - DNA, 26 bp, Artificial Sequence
  Description of Artificial Sequence: Synthetic oligonucleotide
gcggatagcaccaggctactgcactg

SEQ ID NO: 108015 - DNA, 26 bp, Artificial Sequence
  Description of Artificial Sequence: Synthetic oligonucleotide
cggatagcaccaggctactgcactgg

SEQ ID NO: 108016 - DNA, 26 bp, Artificial Sequence
  Description of Artificial Sequence: Synthetic oligonucleotide
ggatagcaccaggctactgcactggg

SEQ ID NO: 108017 - DNA, 27 bp, Artificial Sequence
  Description of Artificial Sequence: Synthetic oligonucleotide
gatagcaccaggctactgcactgggga

SEQ ID NO: 108018 - DNA, 28 bp, Artificial Sequence
  Description of Artificial Sequence: Synthetic oligonucleotide
atagcaccaggctactgcactggggaag

SEQ ID NO: 108019 - DNA, 27 bp, Artificial Sequence
  Description of Artificial Sequence: Synthetic oligonucleotide
tagcaccaggctactgcactggggaag

SEQ ID NO: 108020 - DNA, 27 bp, Artificial Sequence
  Description of Artificial Sequence: Synthetic oligonucleotide
agcaccaggctactgcactggggaagt

SEQ ID NO: 108021 - DNA, 26 bp, Artificial Sequence
  Description of Artificial Sequence: Synthetic oligonucleotide
gcaccaggctactgcactggggaagt

SEQ ID NO: 108022 - DNA, 27 bp, Artificial Sequence
  Description of Artificial Sequence: Synthetic oligonucleotide
caccaggctactgcactggggaagtca

SEQ ID NO: 108023 - DNA, 27 bp, Artificial Sequence
  Description of Artificial Sequence: Synthetic oligonucleotide
accaggctactgcactggggaagtcac

SEQ ID NO: 108024 - DNA, 26 bp, Artificial Sequence
  Description of Artificial Sequence: Synthetic oligonucleotide
ccaggctactgcactggggaagtcac

SEQ ID NO: 108025 - DNA, 26 bp, Artificial Sequence
  Description of Artificial Sequence: Synthetic oligonucleotide
caggctactgcactggggaagtcacc

SEQ ID NO: 108026 - DNA, 27 bp, Artificial Sequence
  Description of Artificial Sequence: Synthetic oligonucleotide
aggctactgcactggggaagtcaccct

SEQ ID NO: 108027 - DNA, 27 bp, Artificial Sequence
  Description of Artificial Sequence: Synthetic oligonucleotide
ggctactgcactggggaagtcacccta

SEQ ID NO: 108028 - DNA, 27 bp, Artificial Sequence
  Description of Artificial Sequence: Synthetic oligonucleotide
gctactgcactggggaagtcaccctac

SEQ ID NO: 108029 - DNA, 27 bp, Artificial Sequence
  Description of Artificial Sequence: Synthetic oligonucleotide
ctactgcactggggaagtcaccctacc

SEQ ID NO: 108030 - DNA, 27 bp, Artificial Sequence
  Description of Artificial Sequence: Synthetic oligonucleotide
tactgcactggggaagtcaccctaccg

SEQ ID NO: 108031 - DNA, 26 bp, Artificial Sequence
  Description of Artificial Sequence: Synthetic oligonucleotide
actgcactggggaagtcaccctaccg

SEQ ID NO: 108032 - DNA, 25 bp, Artificial Sequence
  Description of Artificial Sequence: Synthetic oligonucleotide
ctgcactggggaagtcaccctaccg

SEQ ID NO: 108033 - DNA, 25 bp, Artificial Sequence
  Description of Artificial Sequence: Synthetic oligonucleotide
tgcactggggaagtcaccctaccgc

SEQ ID NO: 108034 - DNA, 24 bp, Artificial Sequence
  Description of Artificial Sequence: Synthetic oligonucleotide
gcactggggaagtcaccctaccgc

SEQ ID NO: 108035 - DNA, 26 bp, Artificial Sequence
  Description of Artificial Sequence: Synthetic oligonucleotide
cactggggaagtcaccctaccgcctt

SEQ ID NO: 108036 - DNA, 26 bp, Artificial Sequence
  Description of Artificial Sequence: Synthetic oligonucleotide
actggggaagtcaccctaccgccttc

SEQ ID NO: 108037 - DNA, 25 bp, Artificial Sequence
  Description of Artificial Sequence: Synthetic oligonucleotide
ctggggaagtcaccctaccgccttc

SEQ ID NO: 108038 - DNA, 27 bp, Artificial Sequence
  Description of Artificial Sequence: Synthetic oligonucleotide
tggggaagtcaccctaccgccttcgtt

SEQ ID NO: 108039 - DNA, 26 bp, Artificial Sequence
  Description of Artificial Sequence: Synthetic oligonucleotide
ggggaagtcaccctaccgccttcgtt

SEQ ID NO: 108040 - DNA, 27 bp, Artificial Sequence
  Description of Artificial Sequence: Synthetic oligonucleotide
gggaagtcaccctaccgccttcgttgt

SEQ ID NO: 108041 - DNA, 27 bp, Artificial Sequence
  Description of Artificial Sequence: Synthetic oligonucleotide
ggaagtcaccctaccgccttcgttgtc

SEQ ID NO: 108042 - DNA, 28 bp, Artificial Sequence
  Description of Artificial Sequence: Synthetic oligonucleotide
gaagtcaccctaccgccttcgttgtcag

SEQ ID NO: 108043 - DNA, 32 bp, Artificial Sequence
  Description of Artificial Sequence: Synthetic oligonucleotide
aagtcaccctaccgccttcgttgtcagttatg

SEQ ID NO: 108044 - DNA, 31 bp, Artificial Sequence
  Description of Artificial Sequence: Synthetic oligonucleotide
agtcaccctaccgccttcgttgtcagttatg

SEQ ID NO: 108045 - DNA, 30 bp, Artificial Sequence
  Description of Artificial Sequence: Synthetic oligonucleotide
gtcaccctaccgccttcgttgtcagttatg

SEQ ID NO: 108046 - DNA, 30 bp, Artificial Sequence
  Description of Artificial Sequence: Synthetic oligonucleotide
tcaccctaccgccttcgttgtcagttatgc

SEQ ID NO: 108047 - DNA, 29 bp, Artificial Sequence
  Description of Artificial Sequence: Synthetic oligonucleotide
caccctaccgccttcgttgtcagttatgc

SEQ ID NO: 108048 - DNA, 30 bp, Artificial Sequence
  Description of Artificial Sequence: Synthetic oligonucleotide
accctaccgccttcgttgtcagttatgcag

SEQ ID NO: 108049 - DNA, 29 bp, Artificial Sequence
  Description of Artificial Sequence: Synthetic oligonucleotide
ccctaccgccttcgttgtcagttatgcag

SEQ ID NO: 108050 - DNA, 29 bp, Artificial Sequence
  Description of Artificial Sequence: Synthetic oligonucleotide
cctaccgccttcgttgtcagttatgcagc

SEQ ID NO: 108051 - DNA, 29 bp, Artificial Sequence
  Description of Artificial Sequence: Synthetic oligonucleotide
ctaccgccttcgttgtcagttatgcagcg

SEQ ID NO: 108052 - DNA, 29 bp, Artificial Sequence
  Description of Artificial Sequence: Synthetic oligonucleotide
taccgccttcgttgtcagttatgcagcgg

SEQ ID NO: 108053 - DNA, 28 bp, Artificial Sequence
  Description of Artificial Sequence: Synthetic oligonucleotide
accgccttcgttgtcagttatgcagcgg

SEQ ID NO: 108054 - DNA, 27 bp, Artificial Sequence
  Description of Artificial Sequence: Synthetic oligonucleotide
ccgccttcgttgtcagttatgcagcgg

SEQ ID NO: 108055 - DNA, 27 bp, Artificial Sequence
  Description of Artificial Sequence: Synthetic oligonucleotide
cgccttcgttgtcagttatgcagcggc

SEQ ID NO: 108056 - DNA, 28 bp, Artificial Sequence
  Description of Artificial Sequence: Synthetic oligonucleotide
gccttcgttgtcagttatgcagcggcac

SEQ ID NO: 108057 - DNA, 29 bp, Artificial Sequence
  Description of Artificial Sequence: Synthetic oligonucleotide
ccttcgttgtcagttatgcagcggcactg

SEQ ID NO: 108058 - DNA, 29 bp, Artificial Sequence
  Description of Artificial Sequence: Synthetic oligonucleotide
cttcgttgtcagttatgcagcggcactgc

SEQ ID NO: 108059 - DNA, 29 bp, Artificial Sequence
  Description of Artificial Sequence: Synthetic oligonucleotide
ttcgttgtcagttatgcagcggcactgcc

SEQ ID NO: 108060 - DNA, 28 bp, Artificial Sequence
  Description of Artificial Sequence: Synthetic oligonucleotide
tcgttgtcagttatgcagcggcactgcc

SEQ ID NO: 108061 - DNA, 27 bp, Artificial Sequence
  Description of Artificial Sequence: Synthetic oligonucleotide
cgttgtcagttatgcagcggcactgcc

SEQ ID NO: 108062 - DNA, 27 bp, Artificial Sequence
  Description of Artificial Sequence: Synthetic oligonucleotide
gttgtcagttatgcagcggcactgccc

SEQ ID NO: 108063 - DNA, 27 bp, Artificial Sequence
  Description of Artificial Sequence: Synthetic oligonucleotide
ttgtcagttatgcagcggcactgcccg

SEQ ID NO: 108064 - DNA, 26 bp, Artificial Sequence
  Description of Artificial Sequence: Synthetic oligonucleotide
tgtcagttatgcagcggcactgcccg

SEQ ID NO: 108065 - DNA, 25 bp, Artificial Sequence
  Description of Artificial Sequence: Synthetic oligonucleotide
gtcagttatgcagcggcactgcccg

SEQ ID NO: 108066 - DNA, 26 bp, Artificial Sequence
  Description of Artificial Sequence: Synthetic oligonucleotide
tcagttatgcagcggcactgcccgca

SEQ ID NO: 108067 - DNA, 25 bp, Artificial Sequence
  Description of Artificial Sequence: Synthetic oligonucleotide
cagttatgcagcggcactgcccgca

SEQ ID NO: 108068 - DNA, 25 bp, Artificial Sequence
  Description of Artificial Sequence: Synthetic oligonucleotide
agttatgcagcggcactgcccgcag

SEQ ID NO: 108069 - DNA, 24 bp, Artificial Sequence
  Description of Artificial Sequence: Synthetic oligonucleotide
gttatgcagcggcactgcccgcag

SEQ ID NO: 108070 - DNA, 25 bp, Artificial Sequence
  Description of Artificial Sequence: Synthetic oligonucleotide
ttatgcagcggcactgcccgcagca

SEQ ID NO: 108071 - DNA, 24 bp, Artificial Sequence
  Description of Artificial Sequence: Synthetic oligonucleotide
tatgcagcggcactgcccgcagca

SEQ ID NO: 108072 - DNA, 23 bp, Artificial Sequence
  Description of Artificial Sequence: Synthetic oligonucleotide
atgcagcggcactgcccgcagca

SEQ ID NO: 108073 - DNA, 22 bp, Artificial Sequence
  Description of Artificial Sequence: Synthetic oligonucleotide
tgcagcggcactgcccgcagca

SEQ ID NO: 108074 - DNA, 21 bp, Artificial Sequence
  Description of Artificial Sequence: Synthetic oligonucleotide
gcagcggcactgcccgcagca

SEQ ID NO: 108075 - DNA, 21 bp, Artificial Sequence
  Description of Artificial Sequence: Synthetic oligonucleotide
cagcggcactgcccgcagcag

SEQ ID NO: 108076 - DNA, 21 bp, Artificial Sequence
  Description of Artificial Sequence: Synthetic oligonucleotide
agcggcactgcccgcagcagc

SEQ ID NO: 108077 - DNA, 20 bp, Artificial Sequence
  Description of Artificial Sequence: Synthetic oligonucleotide
gcggcactgcccgcagcagc

SEQ ID NO: 108078 - DNA, 20 bp, Artificial Sequence
  Description of Artificial Sequence: Synthetic oligonucleotide
cggcactgcccgcagcagcc

SEQ ID NO: 108079 - DNA, 21 bp, Artificial Sequence
  Description of Artificial Sequence: Synthetic oligonucleotide
ggcactgcccgcagcagccct

SEQ ID NO: 108080 - DNA, 22 bp, Artificial Sequence
  Description of Artificial Sequence: Synthetic oligonucleotide
gcactgcccgcagcagccctgt

SEQ ID NO: 108081 - DNA, 22 bp, Artificial Sequence
  Description of Artificial Sequence: Synthetic oligonucleotide
cactgcccgcagcagccctgtg

SEQ ID NO: 108082 - DNA, 22 bp, Artificial Sequence
  Description of Artificial Sequence: Synthetic oligonucleotide
actgcccgcagcagccctgtgg

SEQ ID NO: 108083 - DNA, 21 bp, Artificial Sequence
  Description of Artificial Sequence: Synthetic oligonucleotide
ctgcccgcagcagccctgtgg

SEQ ID NO: 108084 - DNA, 22 bp, Artificial Sequence
  Description of Artificial Sequence: Synthetic oligonucleotide
tgcccgcagcagccctgtggca

SEQ ID NO: 108085 - DNA, 21 bp, Artificial Sequence
  Description of Artificial Sequence: Synthetic oligonucleotide
gcccgcagcagccctgtggca

SEQ ID NO: 108086 - DNA, 24 bp, Artificial Sequence
  Description of Artificial Sequence: Synthetic oligonucleotide
cccgcagcagccctgtggcacaaa

SEQ ID NO: 108087 - DNA, 25 bp, Artificial Sequence
  Description of Artificial Sequence: Synthetic oligonucleotide
ccgcagcagccctgtggcacaaact

SEQ ID NO: 108088 - DNA, 25 bp, Artificial Sequence
  Description of Artificial Sequence: Synthetic oligonucleotide
cgcagcagccctgtggcacaaactc

SEQ ID NO: 108089 - DNA, 25 bp, Artificial Sequence
  Description of Artificial Sequence: Synthetic oligonucleotide
gcagcagccctgtggcacaaactcg

SEQ ID NO: 108090 - DNA, 25 bp, Artificial Sequence
  Description of Artificial Sequence: Synthetic oligonucleotide
cagcagccctgtggcacaaactcgg

SEQ ID NO: 108091 - DNA, 26 bp, Artificial Sequence
  Description of Artificial Sequence: Synthetic oligonucleotide
agcagccctgtggcacaaactcggga

SEQ ID NO: 108092 - DNA, 25 bp, Artificial Sequence
  Description of Artificial Sequence: Synthetic oligonucleotide
gcagccctgtggcacaaactcggga

SEQ ID NO: 108093 - DNA, 25 bp, Artificial Sequence
  Description of Artificial Sequence: Synthetic oligonucleotide
cagccctgtggcacaaactcgggag

SEQ ID NO: 108094 - DNA, 25 bp, Artificial Sequence
  Description of Artificial Sequence: Synthetic oligonucleotide
agccctgtggcacaaactcgggagc

SEQ ID NO: 108095 - DNA, 24 bp, Artificial Sequence
  Description of Artificial Sequence: Synthetic oligonucleotide
gccctgtggcacaaactcgggagc

SEQ ID NO: 108096 - DNA, 25 bp, Artificial Sequence
  Description of Artificial Sequence: Synthetic oligonucleotide
ccctgtggcacaaactcgggagcct

SEQ ID NO: 108097 - DNA, 26 bp, Artificial Sequence
  Description of Artificial Sequence: Synthetic oligonucleotide
cctgtggcacaaactcgggagcctct

SEQ ID NO: 108098 - DNA, 26 bp, Artificial Sequence
  Description of Artificial Sequence: Synthetic oligonucleotide
ctgtggcacaaactcgggagcctctg

SEQ ID NO: 108099 - DNA, 26 bp, Artificial Sequence
  Description of Artificial Sequence: Synthetic oligonucleotide
tgtggcacaaactcgggagcctctgg

SEQ ID NO: 108100 - DNA, 25 bp, Artificial Sequence
  Description of Artificial Sequence: Synthetic oligonucleotide
gtggcacaaactcgggagcctctgg

SEQ ID NO: 108101 - DNA, 26 bp, Artificial Sequence
  Description of Artificial Sequence: Synthetic oligonucleotide
tggcacaaactcgggagcctctgggt

SEQ ID NO: 108102 - DNA, 25 bp, Artificial Sequence
  Description of Artificial Sequence: Synthetic oligonucleotide
ggcacaaactcgggagcctctgggt

SEQ ID NO: 108103 - DNA, 25 bp, Artificial Sequence
  Description of Artificial Sequence: Synthetic oligonucleotide
gcacaaactcgggagcctctgggtg

SEQ ID NO: 108104 - DNA, 25 bp, Artificial Sequence
  Description of Artificial Sequence: Synthetic oligonucleotide
cacaaactcgggagcctctgggtgc

SEQ ID NO: 108105 - DNA, 25 bp, Artificial Sequence
  Description of Artificial Sequence: Synthetic oligonucleotide
acaaactcgggagcctctgggtgcc

SEQ ID NO: 108106 - DNA, 24 bp, Artificial Sequence
  Description of Artificial Sequence: Synthetic oligonucleotide
caaactcgggagcctctgggtgcc

SEQ ID NO: 108107 - DNA, 24 bp, Artificial Sequence
  Description of Artificial Sequence: Synthetic oligonucleotide
aaactcgggagcctctgggtgccc

SEQ ID NO: 108108 - DNA, 23 bp, Artificial Sequence
  Description of Artificial Sequence: Synthetic oligonucleotide
aactcgggagcctctgggtgccc

SEQ ID NO: 108109 - DNA, 22 bp, Artificial Sequence
  Description of Artificial Sequence: Synthetic oligonucleotide
actcgggagcctctgggtgccc

SEQ ID NO: 108110 - DNA, 21 bp, Artificial Sequence
  Description of Artificial Sequence: Synthetic oligonucleotide
ctcgggagcctctgggtgccc

SEQ ID NO: 108111 - DNA, 21 bp, Artificial Sequence
  Description of Artificial Sequence: Synthetic oligonucleotide
tcgggagcctctgggtgcccg

SEQ ID NO: 108112 - DNA, 20 bp, Artificial Sequence
  Description of Artificial Sequence: Synthetic oligonucleotide
cgggagcctctgggtgcccg

SEQ ID NO: 108113 - DNA, 20 bp, Artificial Sequence
  Description of Artificial Sequence: Synthetic oligonucleotide
gggagcctctgggtgcccgg

SEQ ID NO: 108114 - DNA, 20 bp, Artificial Sequence
  Description of Artificial Sequence: Synthetic oligonucleotide
ggagcctctgggtgcccggc

SEQ ID NO: 108115 - DNA, 20 bp, Artificial Sequence
  Description of Artificial Sequence: Synthetic oligonucleotide
gagcctctgggtgcccggcg

SEQ ID NO: 108116 - DNA, 21 bp, Artificial Sequence
  Description of Artificial Sequence: Synthetic oligonucleotide
agcctctgggtgcccggcggt

SEQ ID NO: 108117 - DNA, 20 bp, Artificial Sequence
  Description of Artificial Sequence: Synthetic oligonucleotide
gcctctgggtgcccggcggt

SEQ ID NO: 108118 - DNA, 21 bp, Artificial Sequence
  Description of Artificial Sequence: Synthetic oligonucleotide
cctctgggtgcccggcggtca

SEQ ID NO: 108119 - DNA, 21 bp, Artificial Sequence
  Description of Artificial Sequence: Synthetic oligonucleotide
ctctgggtgcccggcggtcag

SEQ ID NO: 108120 - DNA, 21 bp, Artificial Sequence
  Description of Artificial Sequence: Synthetic oligonucleotide
tctgggtgcccggcggtcagg

SEQ ID NO: 108121 - DNA, 20 bp, Artificial Sequence
  Description of Artificial Sequence: Synthetic oligonucleotide
ctgggtgcccggcggtcagg

SEQ ID NO: 108122 - DNA, 20 bp, Artificial Sequence
  Description of Artificial Sequence: Synthetic oligonucleotide
tgggtgcccggcggtcaggg

SEQ ID NO: 108123 - DNA, 20 bp, Artificial Sequence
  Description of Artificial Sequence: Synthetic oligonucleotide
gggtgcccggcggtcagggt

SEQ ID NO: 108124 - DNA, 20 bp, Artificial Sequence
  Description of Artificial Sequence: Synthetic oligonucleotide
ggtgcccggcggtcagggct

SEQ ID NO: 108125 - DNA, 20 bp, Artificial Sequence
  Description of Artificial Sequence: Synthetic oligonucleotide
gtgcccggcggtcagggcgt

SEQ ID NO: 108126 - DNA, 20 bp, Artificial Sequence
  Description of Artificial Sequence: Synthetic oligonucleotide
tgcccggcggtcagggcggt

SEQ ID NO: 108127 - DNA, 20 bp, Artificial Sequence
  Description of Artificial Sequence: Synthetic oligonucleotide
gcccggcggtcagggcggtt

SEQ ID NO: 108128 - DNA, 20 bp, Artificial Sequence
  Description of Artificial Sequence: Synthetic oligonucleotide
cccggcggtcagggcggctt

SEQ ID NO: 108129 - DNA, 20 bp, Artificial Sequence
  Description of Artificial Sequence: Synthetic oligonucleotide
ccggcggtcagggcggctct

SEQ ID NO: 108130 - DNA, 20 bp, Artificial Sequence
  Description of Artificial Sequence: Synthetic oligonucleotide
cggcggtcagggcggctctg

SEQ ID NO: 108131 - DNA, 23 bp, Artificial Sequence
  Description of Artificial Sequence: Synthetic oligonucleotide
ggcggtcagggcggctctggaaa

SEQ ID NO: 108132 - DNA, 23 bp, Artificial Sequence
  Description of Artificial Sequence: Synthetic oligonucleotide
gcggtcagggcggctctggaaac

SEQ ID NO: 108133 - DNA, 23 bp, Artificial Sequence
  Description of Artificial Sequence: Synthetic oligonucleotide
cggtcagggcggctctggaaacc

SEQ ID NO: 108134 - DNA, 24 bp, Artificial Sequence
  Description of Artificial Sequence: Synthetic oligonucleotide
ggtcagggcggctctggaaaccct

SEQ ID NO: 108135 - DNA, 25 bp, Artificial Sequence
  Description of Artificial Sequence: Synthetic oligonucleotide
gtcagggcggctctggaaaccctgt

SEQ ID NO: 108136 - DNA, 25 bp, Artificial Sequence
  Description of Artificial Sequence: Synthetic oligonucleotide
tcagggcggctctggaaaccctgtg

SEQ ID NO: 108137 - DNA, 24 bp, Artificial Sequence
  Description of Artificial Sequence: Synthetic oligonucleotide
cagggcggctctggaaaccctgtg

SEQ ID NO: 108138 - DNA, 24 bp, Artificial Sequence
  Description of Artificial Sequence: Synthetic oligonucleotide
agggcggctctggaaaccctgtgc

SEQ ID NO: 108139 - DNA, 23 bp, Artificial Sequence
  Description of Artificial Sequence: Synthetic oligonucleotide
gggcggctctggaaaccctgtgc

SEQ ID NO: 108140 - DNA, 24 bp, Artificial Sequence
  Description of Artificial Sequence: Synthetic oligonucleotide
ggcggctctggaaaccctgtgcgt

SEQ ID NO: 108141 - DNA, 24 bp, Artificial Sequence
  Description of Artificial Sequence: Synthetic oligonucleotide
gcggctctggaaaccctgtgcgtc

SEQ ID NO: 108142 - DNA, 24 bp, Artificial Sequence
  Description of Artificial Sequence: Synthetic oligonucleotide
cggctctggaaaccctgtgcgtcg

SEQ ID NO: 108143 - DNA, 24 bp, Artificial Sequence
  Description of Artificial Sequence: Synthetic oligonucleotide
ggctctggaaaccctgtgcgtcgg

SEQ ID NO: 108144 - DNA, 26 bp, Artificial Sequence
  Description of Artificial Sequence: Synthetic oligonucleotide
gctctggaaaccctgtgcgtcggctt

SEQ ID NO: 108145 - DNA, 27 bp, Artificial Sequence
  Description of Artificial Sequence: Synthetic oligonucleotide
ctctggaaaccctgtgcgtcggcttct

SEQ ID NO: 108146 - DNA, 28 bp, Artificial Sequence
  Description of Artificial Sequence: Synthetic oligonucleotide
tctggaaaccctgtgcgtcggcttctag

SEQ ID NO: 108147 - DNA, 27 bp, Artificial Sequence
  Description of Artificial Sequence: Synthetic oligonucleotide
ctggaaaccctgtgcgtcggcttctag

SEQ ID NO: 108148 - DNA, 27 bp, Artificial Sequence
  Description of Artificial Sequence: Synthetic oligonucleotide
tggaaaccctgtgcgtcggcttctagg

SEQ ID NO: 108149 - DNA, 26 bp, Artificial Sequence
  Description of Artificial Sequence: Synthetic oligonucleotide
ggaaaccctgtgcgtcggcttctagg

SEQ ID NO: 108150 - DNA, 27 bp, Artificial Sequence
  Description of Artificial Sequence: Synthetic oligonucleotide
gaaaccctgtgcgtcggcttctaggct

SEQ ID NO: 108151 - DNA, 27 bp, Artificial Sequence
  Description of Artificial Sequence: Synthetic oligonucleotide
aaaccctgtgcgtcggcttctaggctg

SEQ ID NO: 108152 - DNA, 26 bp, Artificial Sequence
  Description of Artificial Sequence: Synthetic oligonucleotide
aaccctgtgcgtcggcttctaggctg

SEQ ID NO: 108153 - DNA, 25 bp, Artificial Sequence
  Description of Artificial Sequence: Synthetic oligonucleotide
accctgtgcgtcggcttctaggctg

SEQ ID NO: 108154 - DNA, 24 bp, Artificial Sequence
  Description of Artificial Sequence: Synthetic oligonucleotide
ccctgtgcgtcggcttctaggctg

SEQ ID NO: 108155 - DNA, 24 bp, Artificial Sequence
  Description of Artificial Sequence: Synthetic oligonucleotide
cctgtgcgtcggcttctaggctgc

SEQ ID NO: 108156 - DNA, 25 bp, Artificial Sequence
  Description of Artificial Sequence: Synthetic oligonucleotide
ctgtgcgtcggcttctaggctgcct

SEQ ID NO: 108157 - DNA, 25 bp, Artificial Sequence
  Description of Artificial Sequence: Synthetic oligonucleotide
tgtgcgtcggcttctaggctgcctg

SEQ ID NO: 108158 - DNA, 24 bp, Artificial Sequence
  Description of Artificial Sequence: Synthetic oligonucleotide
gtgcgtcggcttctaggctgcctg

SEQ ID NO: 108159 - DNA, 24 bp, Artificial Sequence
  Description of Artificial Sequence: Synthetic oligonucleotide
tgcgtcggcttctaggctgcctgg

SEQ ID NO: 108160 - DNA, 23 bp, Artificial Sequence
  Description of Artificial Sequence: Synthetic oligonucleotide
gcgtcggcttctaggctgcctgg

SEQ ID NO: 108161 - DNA, 23 bp, Artificial Sequence
  Description of Artificial Sequence: Synthetic oligonucleotide
cgtcggcttctaggctgcctggg

SEQ ID NO: 108162 - DNA, 24 bp, Artificial Sequence
  Description of Artificial Sequence: Synthetic oligonucleotide
gtcggcttctaggctgcctgggct

SEQ ID NO: 108163 - DNA, 24 bp, Artificial Sequence
  Description of Artificial Sequence: Synthetic oligonucleotide
tcggcttctaggctgcctgggctc

SEQ ID NO: 108164 - DNA, 23 bp, Artificial Sequence
  Description of Artificial Sequence: Synthetic oligonucleotide
cggcttctaggctgcctgggctc

SEQ ID NO: 108165 - DNA, 23 bp, Artificial Sequence
  Description of Artificial Sequence: Synthetic oligonucleotide
ggcttctaggctgcctgggctcg

SEQ ID NO: 108166 - DNA, 24 bp, Artificial Sequence
  Description of Artificial Sequence: Synthetic oligonucleotide
gcttctaggctgcctgggctcgga

SEQ ID NO: 108167 - DNA, 25 bp, Artificial Sequence
  Description of Artificial Sequence: Synthetic oligonucleotide
cttctaggctgcctgggctcggaga

SEQ ID NO: 108168 - DNA, 25 bp, Artificial Sequence
  Description of Artificial Sequence: Synthetic oligonucleotide
ttctaggctgcctgggctcggagac

SEQ ID NO: 108169 - DNA, 24 bp, Artificial Sequence
  Description of Artificial Sequence: Synthetic oligonucleotide
tctaggctgcctgggctcggagac

SEQ ID NO: 108170 - DNA, 23 bp, Artificial Sequence
  Description of Artificial Sequence: Synthetic oligonucleotide
ctaggctgcctgggctcggagac

SEQ ID NO: 108171 - DNA, 23 bp, Artificial Sequence
  Description of Artificial Sequence: Synthetic oligonucleotide
taggctgcctgggctcggagacg

SEQ ID NO: 108172 - DNA, 22 bp, Artificial Sequence
  Description of Artificial Sequence: Synthetic oligonucleotide
aggctgcctgggctcggagacg

SEQ ID NO: 108173 - DNA, 21 bp, Artificial Sequence
  Description of Artificial Sequence: Synthetic oligonucleotide
ggctgcctgggctcggagacg

SEQ ID NO: 108174 - DNA, 21 bp, Artificial Sequence
  Description of Artificial Sequence: Synthetic oligonucleotide
gctgcctgggctcggagacgc

SEQ ID NO: 108175 - DNA, 21 bp, Artificial Sequence
  Description of Artificial Sequence: Synthetic oligonucleotide
ctgcctgggctcggagacgcg

SEQ ID NO: 108176 - DNA, 21 bp, Artificial Sequence
  Description of Artificial Sequence: Synthetic oligonucleotide
tgcctgggctcggagacgcgc

SEQ ID NO: 108177 - DNA, 20 bp, Artificial Sequence
  Description of Artificial Sequence: Synthetic oligonucleotide
gcctgggctcggagacgcgc

SEQ ID NO: 108178 - DNA, 20 bp, Artificial Sequence
  Description of Artificial Sequence: Synthetic oligonucleotide
cctgggctcggagacgcgcc

SEQ ID NO: 108179 - DNA, 20 bp, Artificial Sequence
  Description of Artificial Sequence: Synthetic oligonucleotide
ctgggctcggagacgcgccg

SEQ ID NO: 108180 - DNA, 20 bp, Artificial Sequence
  Description of Artificial Sequence: Synthetic oligonucleotide
tgggctcggagacgcgccgc

SEQ ID NO: 108181 - DNA, 20 bp, Artificial Sequence
  Description of Artificial Sequence: Synthetic oligonucleotide
gggctcggagacgcgccgct

SEQ ID NO: 108182 - DNA, 20 bp, Artificial Sequence
  Description of Artificial Sequence: Synthetic oligonucleotide
ggctcggagacgcgccgcct

SEQ ID NO: 108183 - DNA, 21 bp, Artificial Sequence
  Description of Artificial Sequence: Synthetic oligonucleotide
gctcggagacgcgccgcctct

SEQ ID NO: 108184 - DNA, 21 bp, Artificial Sequence
  Description of Artificial Sequence: Synthetic oligonucleotide
ctcggagacgcgccgcctctc

SEQ ID NO: 108185 - DNA, 21 bp, Artificial Sequence
  Description of Artificial Sequence: Synthetic oligonucleotide
tcggagacgcgccgcctctcg

SEQ ID NO: 108186 - DNA, 20 bp, Artificial Sequence
  Description of Artificial Sequence: Synthetic oligonucleotide
cggagacgcgccgcctctcg

SEQ ID NO: 108187 - DNA, 21 bp, Artificial Sequence
  Description of Artificial Sequence: Synthetic oligonucleotide
ggagacgcgccgcctctcgct

SEQ ID NO: 108188 - DNA, 23 bp, Artificial Sequence
  Description of Artificial Sequence: Synthetic oligonucleotide
gagacgcgccgcctctcgctgtt

SEQ ID NO: 108189 - DNA, 23 bp, Artificial Sequence
  Description of Artificial Sequence: Synthetic oligonucleotide
agacgcgccgcctctcgctgttc

SEQ ID NO: 108190 - DNA, 22 bp, Artificial Sequence
  Description of Artificial Sequence: Synthetic oligonucleotide
gacgcgccgcctctcgctgttc

SEQ ID NO: 108191 - DNA, 23 bp, Artificial Sequence
  Description of Artificial Sequence: Synthetic oligonucleotide
acgcgccgcctctcgctgttcct

SEQ ID NO: 108192 - DNA, 22 bp, Artificial Sequence
  Description of Artificial Sequence: Synthetic oligonucleotide
cgcgccgcctctcgctgttcct

SEQ ID NO: 108193 - DNA, 22 bp, Artificial Sequence
  Description of Artificial Sequence: Synthetic oligonucleotide
gcgccgcctctcgctgttcctg

SEQ ID NO: 108194 - DNA, 23 bp, Artificial Sequence
  Description of Artificial Sequence: Synthetic oligonucleotide
cgccgcctctcgctgttcctggt

SEQ ID NO: 108195 - DNA, 23 bp, Artificial Sequence
  Description of Artificial Sequence: Synthetic oligonucleotide
gccgcctctcgctgttcctggtc

SEQ ID NO: 108196 - DNA, 24 bp, Artificial Sequence
  Description of Artificial Sequence: Synthetic oligonucleotide
ccgcctctcgctgttcctggtcct

SEQ ID NO: 108197 - DNA, 24 bp, Artificial Sequence
  Description of Artificial Sequence: Synthetic oligonucleotide
cgcctctcgctgttcctggtcctg

SEQ ID NO: 108198 - DNA, 25 bp, Artificial Sequence
  Description of Artificial Sequence: Synthetic oligonucleotide
gcctctcgctgttcctggtcctggt

SEQ ID NO: 108199 - DNA, 25 bp, Artificial Sequence
  Description of Artificial Sequence: Synthetic oligonucleotide
cctctcgctgttcctggtcctggtg

SEQ ID NO: 108200 - DNA, 26 bp, Artificial Sequence
  Description of Artificial Sequence: Synthetic oligonucleotide
ctctcgctgttcctggtcctggtggt

SEQ ID NO: 108201 - DNA, 26 bp, Artificial Sequence
  Description of Artificial Sequence: Synthetic oligonucleotide
tctcgctgttcctggtcctggtggtc

SEQ ID NO: 108202 - DNA, 25 bp, Artificial Sequence
  Description of Artificial Sequence: Synthetic oligonucleotide
ctcgctgttcctggtcctggtggtc

SEQ ID NO: 108203 - DNA, 26 bp, Artificial Sequence
  Description of Artificial Sequence: Synthetic oligonucleotide
tcgctgttcctggtcctggtggtcct

SEQ ID NO: 108204 - DNA, 25 bp, Artificial Sequence
  Description of Artificial Sequence: Synthetic oligonucleotide
cgctgttcctggtcctggtggtcct

SEQ ID NO: 108205 - DNA, 26 bp, Artificial Sequence
  Description of Artificial Sequence: Synthetic oligonucleotide
gctgttcctggtcctggtggtcctct

SEQ ID NO: 108206 - DNA, 26 bp, Artificial Sequence
  Description of Artificial Sequence: Synthetic oligonucleotide
ctgttcctggtcctggtggtcctctc

SEQ ID NO: 108207 - DNA, 27 bp, Artificial Sequence
  Description of Artificial Sequence: Synthetic oligonucleotide
tgttcctggtcctggtggtcctctcct

SEQ ID NO: 108208 - DNA, 26 bp, Artificial Sequence
  Description of Artificial Sequence: Synthetic oligonucleotide
gttcctggtcctggtggtcctctcct

SEQ ID NO: 108209 - DNA, 27 bp, Artificial Sequence
  Description of Artificial Sequence: Synthetic oligonucleotide
ttcctggtcctggtggtcctctcctct

SEQ ID NO: 108210 - DNA, 26 bp, Artificial Sequence
  Description of Artificial Sequence: Synthetic oligonucleotide
tcctggtcctggtggtcctctcctct

SEQ ID NO: 108211 - DNA, 25 bp, Artificial Sequence
  Description of Artificial Sequence: Synthetic oligonucleotide
cctggtcctggtggtcctctcctct

SEQ ID NO: 108212 - DNA, 27 bp, Artificial Sequence
  Description of Artificial Sequence: Synthetic oligonucleotide
ctggtcctggtggtcctctcctctctt

SEQ ID NO: 108213 - DNA, 27 bp, Artificial Sequence
  Description of Artificial Sequence: Synthetic oligonucleotide
tggtcctggtggtcctctcctctcttg

SEQ ID NO: 108214 - DNA, 26 bp, Artificial Sequence
  Description of Artificial Sequence: Synthetic oligonucleotide
ggtcctggtggtcctctcctctcttg

SEQ ID NO: 108215 - DNA, 26 bp, Artificial Sequence
  Description of Artificial Sequence: Synthetic oligonucleotide
gtcctggtggtcctctcctctcttgg

SEQ ID NO: 108216 - DNA, 26 bp, Artificial Sequence
  Description of Artificial Sequence: Synthetic oligonucleotide
tcctggtggtcctctcctctcttggg

SEQ ID NO: 108217 - DNA, 25 bp, Artificial Sequence
  Description of Artificial Sequence: Synthetic oligonucleotide
cctggtggtcctctcctctcttggg

SEQ ID NO: 108218 - DNA, 26 bp, Artificial Sequence
  Description of Artificial Sequence: Synthetic oligonucleotide
ctggtggtcctctcctctcttgggga

SEQ ID NO: 108219 - DNA, 27 bp, Artificial Sequence
  Description of Artificial Sequence: Synthetic oligonucleotide
tggtggtcctctcctctcttggggaga

SEQ ID NO: 108220 - DNA, 27 bp, Artificial Sequence
  Description of Artificial Sequence: Synthetic oligonucleotide
ggtggtcctctcctctcttggggagat

SEQ ID NO: 108221 - DNA, 27 bp, Artificial Sequence
  Description of Artificial Sequence: Synthetic oligonucleotide
gtggtcctctcctctcttggggagatg

SEQ ID NO: 108222 - DNA, 27 bp, Artificial Sequence
  Description of Artificial Sequence: Synthetic oligonucleotide
tggtcctctcctctcttggggagatgg

SEQ ID NO: 108223 - DNA, 26 bp, Artificial Sequence
  Description of Artificial Sequence: Synthetic oligonucleotide
ggtcctctcctctcttggggagatgg

SEQ ID NO: 108224 - DNA, 26 bp, Artificial Sequence
  Description of Artificial Sequence: Synthetic oligonucleotide
gtcctctcctctcttggggagatggc

SEQ ID NO: 108225 - DNA, 27 bp, Artificial Sequence
  Description of Artificial Sequence: Synthetic oligonucleotide
tcctctcctctcttggggagatggcca

SEQ ID NO: 108226 - DNA, 27 bp, Artificial Sequence
  Description of Artificial Sequence: Synthetic oligonucleotide
cctctcctctcttggggagatggccat

SEQ ID NO: 108227 - DNA, 28 bp, Artificial Sequence
  Description of Artificial Sequence: Synthetic oligonucleotide
ctctcctctcttggggagatggccattc

SEQ ID NO: 108228 - DNA, 28 bp, Artificial Sequence
  Description of Artificial Sequence: Synthetic oligonucleotide
tctcctctcttggggagatggccattcc

SEQ ID NO: 108229 - DNA, 27 bp, Artificial Sequence
  Description of Artificial Sequence: Synthetic oligonucleotide
ctcctctcttggggagatggccattcc

SEQ ID NO: 108230 - DNA, 30 bp, Artificial Sequence
  Description of Artificial Sequence: Synthetic oligonucleotide
tcctctcttggggagatggccattccattc

SEQ ID NO: 108231 - DNA, 29 bp, Artificial Sequence
  Description of Artificial Sequence: Synthetic oligonucleotide
cctctcttggggagatggccattccattc

SEQ ID NO: 108232 - DNA, 33 bp, Artificial Sequence
  Description of Artificial Sequence: Synthetic oligonucleotide
ctctcttggggagatggccattccattctttac

SEQ ID NO: 108233 - DNA, 33 bp, Artificial Sequence
  Description of Artificial Sequence: Synthetic oligonucleotide
tctcttggggagatggccattccattctttacg

SEQ ID NO: 108234 - DNA, 32 bp, Artificial Sequence
  Description of Artificial Sequence: Synthetic oligonucleotide
ctcttggggagatggccattccattctttacg

SEQ ID NO: 108235 - DNA, 32 bp, Artificial Sequence
  Description of Artificial Sequence: Synthetic oligonucleotide
tcttggggagatggccattccattctttacgg

SEQ ID NO: 108236 - DNA, 31 bp, Artificial Sequence
  Description of Artificial Sequence: Synthetic oligonucleotide
cttggggagatggccattccattctttacgg

SEQ ID NO: 108237 - DNA, 31 bp, Artificial Sequence
  Description of Artificial Sequence: Synthetic oligonucleotide
ttggggagatggccattccattctttacggg

SEQ ID NO: 108238 - DNA, 30 bp, Artificial Sequence
  Description of Artificial Sequence: Synthetic oligonucleotide
tggggagatggccattccattctttacggg

SEQ ID NO: 108239 - DNA, 29 bp, Artificial Sequence
  Description of Artificial Sequence: Synthetic oligonucleotide
ggggagatggccattccattctttacggg

SEQ ID NO: 108240 - DNA, 29 bp, Artificial Sequence
  Description of Artificial Sequence: Synthetic oligonucleotide
gggagatggccattccattctttacgggc

SEQ ID NO: 108241 - DNA, 29 bp, Artificial Sequence
  Description of Artificial Sequence: Synthetic oligonucleotide
ggagatggccattccattctttacgggcc

SEQ ID NO: 108242 - DNA, 29 bp, Artificial Sequence
  Description of Artificial Sequence: Synthetic oligonucleotide
gagatggccattccattctttacgggccg

SEQ ID NO: 108243 - DNA, 29 bp, Artificial Sequence
  Description of Artificial Sequence: Synthetic oligonucleotide
agatggccattccattctttacgggccgc

SEQ ID NO: 108244 - DNA, 28 bp, Artificial Sequence
  Description of Artificial Sequence: Synthetic oligonucleotide
gatggccattccattctttacgggccgc

SEQ ID NO: 108245 - DNA, 28 bp, Artificial Sequence
  Description of Artificial Sequence: Synthetic oligonucleotide
atggccattccattctttacgggccgcc

SEQ ID NO: 108246 - DNA, 27 bp, Artificial Sequence
  Description of Artificial Sequence: Synthetic oligonucleotide
tggccattccattctttacgggccgcc

SEQ ID NO: 108247 - DNA, 27 bp, Artificial Sequence
  Description of Artificial Sequence: Synthetic oligonucleotide
ggccattccattctttacgggccgcct

SEQ ID NO: 108248 - DNA, 27 bp, Artificial Sequence
  Description of Artificial Sequence: Synthetic oligonucleotide
gccattccattctttacgggccgcctc

SEQ ID NO: 108249 - DNA, 28 bp, Artificial Sequence
  Description of Artificial Sequence: Synthetic oligonucleotide
ccattccattctttacgggccgcctcac

SEQ ID NO: 108250 - DNA, 29 bp, Artificial Sequence
  Description of Artificial Sequence: Synthetic oligonucleotide
cattccattctttacgggccgcctcactg

SEQ ID NO: 108251 - DNA, 30 bp, Artificial Sequence
  Description of Artificial Sequence: Synthetic oligonucleotide
attccattctttacgggccgcctcactgac

SEQ ID NO: 108252 - DNA, 29 bp, Artificial Sequence
  Description of Artificial Sequence: Synthetic oligonucleotide
ttccattctttacgggccgcctcactgac

SEQ ID NO: 108253 - DNA, 28 bp, Artificial Sequence
  Description of Artificial Sequence: Synthetic oligonucleotide
tccattctttacgggccgcctcactgac

SEQ ID NO: 108254 - DNA, 27 bp, Artificial Sequence
  Description of Artificial Sequence: Synthetic oligonucleotide
ccattctttacgggccgcctcactgac

SEQ ID NO: 108255 - DNA, 28 bp, Artificial Sequence
  Description of Artificial Sequence: Synthetic oligonucleotide
cattctttacgggccgcctcactgactg

SEQ ID NO: 108256 - DNA, 28 bp, Artificial Sequence
  Description of Artificial Sequence: Synthetic oligonucleotide
attctttacgggccgcctcactgactgg

SEQ ID NO: 108257 - DNA, 27 bp, Artificial Sequence
  Description of Artificial Sequence: Synthetic oligonucleotide
ttctttacgggccgcctcactgactgg

SEQ ID NO: 108258 - DNA, 27 bp, Artificial Sequence
  Description of Artificial Sequence: Synthetic oligonucleotide
tctttacgggccgcctcactgactgga

SEQ ID NO: 108259 - DNA, 27 bp, Artificial Sequence
  Description of Artificial Sequence: Synthetic oligonucleotide
ctttacgggccgcctcactgactggat

SEQ ID NO: 108260 - DNA, 28 bp, Artificial Sequence
  Description of Artificial Sequence: Synthetic oligonucleotide
tttacgggccgcctcactgactggattc

SEQ ID NO: 108261 - DNA, 27 bp, Artificial Sequence
  Description of Artificial Sequence: Synthetic oligonucleotide
ttacgggccgcctcactgactggattc

SEQ ID NO: 108262 - DNA, 27 bp, Artificial Sequence
  Description of Artificial Sequence: Synthetic oligonucleotide
tacgggccgcctcactgactggattct

SEQ ID NO: 108263 - DNA, 27 bp, Artificial Sequence
  Description of Artificial Sequence: Synthetic oligonucleotide
acgggccgcctcactgactggattcta

SEQ ID NO: 108264 - DNA, 26 bp, Artificial Sequence
  Description of Artificial Sequence: Synthetic oligonucleotide
cgggccgcctcactgactggattcta

SEQ ID NO: 108265 - DNA, 27 bp, Artificial Sequence
  Description of Artificial Sequence: Synthetic oligonucleotide
gggccgcctcactgactggattctaca

SEQ ID NO: 108266 - DNA, 28 bp, Artificial Sequence
  Description of Artificial Sequence: Synthetic oligonucleotide
ggccgcctcactgactggattctacaag

SEQ ID NO: 108267 - DNA, 30 bp, Artificial Sequence
  Description of Artificial Sequence: Synthetic oligonucleotide
gccgcctcactgactggattctacaagatg

SEQ ID NO: 108268 - DNA, 30 bp, Artificial Sequence
  Description of Artificial Sequence: Synthetic oligonucleotide
ccgcctcactgactggattctacaagatgg

SEQ ID NO: 108269 - DNA, 30 bp, Artificial Sequence
  Description of Artificial Sequence: Synthetic oligonucleotide
cgcctcactgactggattctacaagatggc

SEQ ID NO: 108270 - DNA, 31 bp, Artificial Sequence
  Description of Artificial Sequence: Synthetic oligonucleotide
gcctcactgactggattctacaagatggctc

SEQ ID NO: 108271 - DNA, 32 bp, Artificial Sequence
  Description of Artificial Sequence: Synthetic oligonucleotide
cctcactgactggattctacaagatggctcag

SEQ ID NO: 108272 - DNA, 32 bp, Artificial Sequence
  Description of Artificial Sequence: Synthetic oligonucleotide
ctcactgactggattctacaagatggctcagc

SEQ ID NO: 108273 - DNA, 32 bp, Artificial Sequence
  Description of Artificial Sequence: Synthetic oligonucleotide
tcactgactggattctacaagatggctcagcc

SEQ ID NO: 108274 - DNA, 31 bp, Artificial Sequence
  Description of Artificial Sequence: Synthetic oligonucleotide
cactgactggattctacaagatggctcagcc

SEQ ID NO: 108275 - DNA, 31 bp, Artificial Sequence
  Description of Artificial Sequence: Synthetic oligonucleotide
actgactggattctacaagatggctcagccg

SEQ ID NO: 108276 - DNA, 30 bp, Artificial Sequence
  Description of Artificial Sequence: Synthetic oligonucleotide
ctgactggattctacaagatggctcagccg

SEQ ID NO: 108277 - DNA, 33 bp, Artificial Sequence
  Description of Artificial Sequence: Synthetic oligonucleotide
tgactggattctacaagatggctcagccgatac

SEQ ID NO: 108278 - DNA, 32 bp, Artificial Sequence
  Description of Artificial Sequence: Synthetic oligonucleotide
gactggattctacaagatggctcagccgatac

SEQ ID NO: 108279 - DNA, 32 bp, Artificial Sequence
  Description of Artificial Sequence: Synthetic oligonucleotide
actggattctacaagatggctcagccgatacc

SEQ ID NO: 108280 - DNA, 31 bp, Artificial Sequence
  Description of Artificial Sequence: Synthetic oligonucleotide
ctggattctacaagatggctcagccgatacc

SEQ ID NO: 108281 - DNA, 33 bp, Artificial Sequence
  Description of Artificial Sequence: Synthetic oligonucleotide
tggattctacaagatggctcagccgataccttc

SEQ ID NO: 108282 - DNA, 32 bp, Artificial Sequence
  Description of Artificial Sequence: Synthetic oligonucleotide
ggattctacaagatggctcagccgataccttc

SEQ ID NO: 108283 - DNA, 33 bp, Artificial Sequence
  Description of Artificial Sequence: Synthetic oligonucleotide
gattctacaagatggctcagccgataccttcac

SEQ ID NO: 108284 - DNA, 34 bp, Artificial Sequence
  Description of Artificial Sequence: Synthetic oligonucleotide
attctacaagatggctcagccgataccttcactc

SEQ ID NO: 108285 - DNA, 33 bp, Artificial Sequence
  Description of Artificial Sequence: Synthetic oligonucleotide
ttctacaagatggctcagccgataccttcactc

SEQ ID NO: 108286 - DNA, 32 bp, Artificial Sequence
  Description of Artificial Sequence: Synthetic oligonucleotide
tctacaagatggctcagccgataccttcactc

SEQ ID NO: 108287 - DNA, 31 bp, Artificial Sequence
  Description of Artificial Sequence: Synthetic oligonucleotide
ctacaagatggctcagccgataccttcactc

SEQ ID NO: 108288 - DNA, 31 bp, Artificial Sequence
  Description of Artificial Sequence: Synthetic oligonucleotide
tacaagatggctcagccgataccttcactcg

SEQ ID NO: 108289 - DNA, 30 bp, Artificial Sequence
  Description of Artificial Sequence: Synthetic oligonucleotide
acaagatggctcagccgataccttcactcg

SEQ ID NO: 108290 - DNA, 29 bp, Artificial Sequence
  Description of Artificial Sequence: Synthetic oligonucleotide
caagatggctcagccgataccttcactcg

SEQ ID NO: 108291 - DNA, 32 bp, Artificial Sequence
  Description of Artificial Sequence: Synthetic oligonucleotide
aagatggctcagccgataccttcactcgaaac

SEQ ID NO: 108292 - DNA, 31 bp, Artificial Sequence
  Description of Artificial Sequence: Synthetic oligonucleotide
agatggctcagccgataccttcactcgaaac

SEQ ID NO: 108293 - DNA, 30 bp, Artificial Sequence
  Description of Artificial Sequence: Synthetic oligonucleotide
gatggctcagccgataccttcactcgaaac

SEQ ID NO: 108294 - DNA, 34 bp, Artificial Sequence
  Description of Artificial Sequence: Synthetic oligonucleotide
atggctcagccgataccttcactcgaaacttaac

SEQ ID NO: 108295 - DNA, 33 bp, Artificial Sequence
  Description of Artificial Sequence: Synthetic oligonucleotide
tggctcagccgataccttcactcgaaacttaac

SEQ ID NO: 108296 - DNA, 32 bp, Artificial Sequence
  Description of Artificial Sequence: Synthetic oligonucleotide
ggctcagccgataccttcactcgaaacttaac

SEQ ID NO: 108297 - DNA, 33 bp, Artificial Sequence
  Description of Artificial Sequence: Synthetic oligonucleotide
gctcagccgataccttcactcgaaacttaactc

SEQ ID NO: 108298 - DNA, 34 bp, Artificial Sequence
  Description of Artificial Sequence: Synthetic oligonucleotide
ctcagccgataccttcactcgaaacttaactctc

SEQ ID NO: 108299 - DNA, 36 bp, Artificial Sequence
  Description of Artificial Sequence: Synthetic oligonucleotide
tcagccgataccttcactcgaaacttaactctcatg

SEQ ID NO: 108300 - DNA, 35 bp, Artificial Sequence
  Description of Artificial Sequence: Synthetic oligonucleotide
cagccgataccttcactcgaaacttaactctcatg

SEQ ID NO: 108301 - DNA, 36 bp, Artificial Sequence
  Description of Artificial Sequence: Synthetic oligonucleotide
agccgataccttcactcgaaacttaactctcatgtc

SEQ ID NO: 108302 - DNA, 35 bp, Artificial Sequence
  Description of Artificial Sequence: Synthetic oligonucleotide
gccgataccttcactcgaaacttaactctcatgtc

SEQ ID NO: 108303 - DNA, 35 bp, Artificial Sequence
  Description of Artificial Sequence: Synthetic oligonucleotide
ccgataccttcactcgaaacttaactctcatgtcc

SEQ ID NO: 108304 - DNA, 38 bp, Artificial Sequence
  Description of Artificial Sequence: Synthetic oligonucleotide
cgataccttcactcgaaacttaactctcatgtccattc

SEQ ID NO: 108305 - DNA, 39 bp, Artificial Sequence
  Description of Artificial Sequence: Synthetic oligonucleotide
gataccttcactcgaaacttaactctcatgtccattctc

SEQ ID NO: 108306 - DNA, 40 bp, Artificial Sequence
  Description of Artificial Sequence: Synthetic oligonucleotide
ataccttcactcgaaacttaactctcatgtccattctcac

SEQ ID NO: 108307 - DNA, 39 bp, Artificial Sequence
  Description of Artificial Sequence: Synthetic oligonucleotide
taccttcactcgaaacttaactctcatgtccattctcac

SEQ ID NO: 108308 - DNA, 38 bp, Artificial Sequence
  Description of Artificial Sequence: Synthetic oligonucleotide
accttcactcgaaacttaactctcatgtccattctcac

SEQ ID NO: 108309 - DNA, 37 bp, Artificial Sequence
  Description of Artificial Sequence: Synthetic oligonucleotide
ccttcactcgaaacttaactctcatgtccattctcac

SEQ ID NO: 108310 - DNA, 37 bp, Artificial Sequence
  Description of Artificial Sequence: Synthetic oligonucleotide
cttcactcgaaacttaactctcatgtccattctcacc

SEQ ID NO: 108311 - DNA, 40 bp, Artificial Sequence
  Description of Artificial Sequence: Synthetic oligonucleotide
ttcactcgaaacttaactctcatgtccattctcaccatag

SEQ ID NO: 108312 - DNA, 39 bp, Artificial Sequence
  Description of Artificial Sequence: Synthetic oligonucleotide
tcactcgaaacttaactctcatgtccattctcaccatag

SEQ ID NO: 108313 - DNA, 38 bp, Artificial Sequence
  Description of Artificial Sequence: Synthetic oligonucleotide
cactcgaaacttaactctcatgtccattctcaccatag

SEQ ID NO: 108314 - DNA, 38 bp, Artificial Sequence
  Description of Artificial Sequence: Synthetic oligonucleotide
actcgaaacttaactctcatgtccattctcaccatagc

SEQ ID NO: 108315 - DNA, 37 bp, Artificial Sequence
  Description of Artificial Sequence: Synthetic oligonucleotide
ctcgaaacttaactctcatgtccattctcaccatagc

SEQ ID NO: 108316 - DNA, 37 bp, Artificial Sequence
  Description of Artificial Sequence: Synthetic oligonucleotide
tcgaaacttaactctcatgtccattctcaccatagcc

SEQ ID NO: 108317 - DNA, 36 bp, Artificial Sequence
  Description of Artificial Sequence: Synthetic oligonucleotide
cgaaacttaactctcatgtccattctcaccatagcc

SEQ ID NO: 108318 - DNA, 37 bp, Artificial Sequence
  Description of Artificial Sequence: Synthetic oligonucleotide
gaaacttaactctcatgtccattctcaccatagccag

SEQ ID NO: 108319 - DNA, 38 bp, Artificial Sequence
  Description of Artificial Sequence: Synthetic oligonucleotide
aaacttaactctcatgtccattctcaccatagccagtg

SEQ ID NO: 108320 - DNA, 37 bp, Artificial Sequence
  Description of Artificial Sequence: Synthetic oligonucleotide
aacttaactctcatgtccattctcaccatagccagtg

SEQ ID NO: 108321 - DNA, 36 bp, Artificial Sequence
  Description of Artificial Sequence: Synthetic oligonucleotide
acttaactctcatgtccattctcaccatagccagtg

SEQ ID NO: 108322 - DNA, 35 bp, Artificial Sequence
  Description of Artificial Sequence: Synthetic oligonucleotide
cttaactctcatgtccattctcaccatagccagtg

SEQ ID NO: 108323 - DNA, 35 bp, Artificial Sequence
  Description of Artificial Sequence: Synthetic oligonucleotide
ttaactctcatgtccattctcaccatagccagtgc

SEQ ID NO: 108324 - DNA, 34 bp, Artificial Sequence
  Description of Artificial Sequence: Synthetic oligonucleotide
taactctcatgtccattctcaccatagccagtgc

SEQ ID NO: 108325 - DNA, 33 bp, Artificial Sequence
  Description of Artificial Sequence: Synthetic oligonucleotide
aactctcatgtccattctcaccatagccagtgc

SEQ ID NO: 108326 - DNA, 32 bp, Artificial Sequence
  Description of Artificial Sequence: Synthetic oligonucleotide
actctcatgtccattctcaccatagccagtgc

SEQ ID NO: 108327 - DNA, 31 bp, Artificial Sequence
  Description of Artificial Sequence: Synthetic oligonucleotide
ctctcatgtccattctcaccatagccagtgc

SEQ ID NO: 108328 - DNA, 32 bp, Artificial Sequence
  Description of Artificial Sequence: Synthetic oligonucleotide
tctcatgtccattctcaccatagccagtgcag

SEQ ID NO: 108329 - DNA, 31 bp, Artificial Sequence
  Description of Artificial Sequence: Synthetic oligonucleotide
ctcatgtccattctcaccatagccagtgcag

SEQ ID NO: 108330 - DNA, 32 bp, Artificial Sequence
  Description of Artificial Sequence: Synthetic oligonucleotide
tcatgtccattctcaccatagccagtgcagtg

SEQ ID NO: 108331 - DNA, 31 bp, Artificial Sequence
  Description of Artificial Sequence: Synthetic oligonucleotide
catgtccattctcaccatagccagtgcagtg

SEQ ID NO: 108332 - DNA, 31 bp, Artificial Sequence
  Description of Artificial Sequence: Synthetic oligonucleotide
atgtccattctcaccatagccagtgcagtgc

SEQ ID NO: 108333 - DNA, 30 bp, Artificial Sequence
  Description of Artificial Sequence: Synthetic oligonucleotide
tgtccattctcaccatagccagtgcagtgc

SEQ ID NO: 108334 - DNA, 29 bp, Artificial Sequence
  Description of Artificial Sequence: Synthetic oligonucleotide
gtccattctcaccatagccagtgcagtgc

SEQ ID NO: 108335 - DNA, 30 bp, Artificial Sequence
  Description of Artificial Sequence: Synthetic oligonucleotide
tccattctcaccatagccagtgcagtgctg

SEQ ID NO: 108336 - DNA, 29 bp, Artificial Sequence
  Description of Artificial Sequence: Synthetic oligonucleotide
ccattctcaccatagccagtgcagtgctg

SEQ ID NO: 108337 - DNA, 29 bp, Artificial Sequence
  Description of Artificial Sequence: Synthetic oligonucleotide
cattctcaccatagccagtgcagtgctgg

SEQ ID NO: 108338 - DNA, 30 bp, Artificial Sequence
  Description of Artificial Sequence: Synthetic oligonucleotide
attctcaccatagccagtgcagtgctggag

SEQ ID NO: 108339 - DNA, 29 bp, Artificial Sequence
  Description of Artificial Sequence: Synthetic oligonucleotide
ttctcaccatagccagtgcagtgctggag

SEQ ID NO: 108340 - DNA, 28 bp, Artificial Sequence
  Description of Artificial Sequence: Synthetic oligonucleotide
tctcaccatagccagtgcagtgctggag

SEQ ID NO: 108341 - DNA, 27 bp, Artificial Sequence
  Description of Artificial Sequence: Synthetic oligonucleotide
ctcaccatagccagtgcagtgctggag

SEQ ID NO: 108342 - DNA, 29 bp, Artificial Sequence
  Description of Artificial Sequence: Synthetic oligonucleotide
tcaccatagccagtgcagtgctggagttc

SEQ ID NO: 108343 - DNA, 28 bp, Artificial Sequence
  Description of Artificial Sequence: Synthetic oligonucleotide
caccatagccagtgcagtgctggagttc

SEQ ID NO: 108344 - DNA, 28 bp, Artificial Sequence
  Description of Artificial Sequence: Synthetic oligonucleotide
accatagccagtgcagtgctggagttcg

SEQ ID NO: 108345 - DNA, 27 bp, Artificial Sequence
  Description of Artificial Sequence: Synthetic oligonucleotide
ccatagccagtgcagtgctggagttcg

SEQ ID NO: 108346 - DNA, 28 bp, Artificial Sequence
  Description of Artificial Sequence: Synthetic oligonucleotide
catagccagtgcagtgctggagttcgtg

SEQ ID NO: 108347 - DNA, 28 bp, Artificial Sequence
  Description of Artificial Sequence: Synthetic oligonucleotide
atagccagtgcagtgctggagttcgtgg

SEQ ID NO: 108348 - DNA, 27 bp, Artificial Sequence
  Description of Artificial Sequence: Synthetic oligonucleotide
tagccagtgcagtgctggagttcgtgg

SEQ ID NO: 108349 - DNA, 26 bp, Artificial Sequence
  Description of Artificial Sequence: Synthetic oligonucleotide
agccagtgcagtgctggagttcgtgg

SEQ ID NO: 108350 - DNA, 25 bp, Artificial Sequence
  Description of Artificial Sequence: Synthetic oligonucleotide
gccagtgcagtgctggagttcgtgg

SEQ ID NO: 108351 - DNA, 26 bp, Artificial Sequence
  Description of Artificial Sequence: Synthetic oligonucleotide
ccagtgcagtgctggagttcgtgggt

SEQ ID NO: 108352 - DNA, 27 bp, Artificial Sequence
  Description of Artificial Sequence: Synthetic oligonucleotide
cagtgcagtgctggagttcgtgggtga

SEQ ID NO: 108353 - DNA, 27 bp, Artificial Sequence
  Description of Artificial Sequence: Synthetic oligonucleotide
agtgcagtgctggagttcgtgggtgac

SEQ ID NO: 108354 - DNA, 26 bp, Artificial Sequence
  Description of Artificial Sequence: Synthetic oligonucleotide
gtgcagtgctggagttcgtgggtgac

SEQ ID NO: 108355 - DNA, 26 bp, Artificial Sequence
  Description of Artificial Sequence: Synthetic oligonucleotide
tgcagtgctggagttcgtgggtgacg

SEQ ID NO: 108356 - DNA, 25 bp, Artificial Sequence
  Description of Artificial Sequence: Synthetic oligonucleotide
gcagtgctggagttcgtgggtgacg

SEQ ID NO: 108357 - DNA, 25 bp, Artificial Sequence
  Description of Artificial Sequence: Synthetic oligonucleotide
cagtgctggagttcgtgggtgacgg

SEQ ID NO: 108358 - DNA, 27 bp, Artificial Sequence
  Description of Artificial Sequence: Synthetic oligonucleotide
agtgctggagttcgtgggtgacgggat

SEQ ID NO: 108359 - DNA, 26 bp, Artificial Sequence
  Description of Artificial Sequence: Synthetic oligonucleotide
gtgctggagttcgtgggtgacgggat

SEQ ID NO: 108360 - DNA, 27 bp, Artificial Sequence
  Description of Artificial Sequence: Synthetic oligonucleotide
tgctggagttcgtgggtgacgggatct

SEQ ID NO: 108361 - DNA, 27 bp, Artificial Sequence
  Description of Artificial Sequence: Synthetic oligonucleotide
gctggagttcgtgggtgacgggatcta

SEQ ID NO: 108362 - DNA, 30 bp, Artificial Sequence
  Description of Artificial Sequence: Synthetic oligonucleotide
ctggagttcgtgggtgacgggatctataac

SEQ ID NO: 108363 - DNA, 32 bp, Artificial Sequence
  Description of Artificial Sequence: Synthetic oligonucleotide
tggagttcgtgggtgacgggatctataacaac

SEQ ID NO: 108364 - DNA, 31 bp, Artificial Sequence
  Description of Artificial Sequence: Synthetic oligonucleotide
ggagttcgtgggtgacgggatctataacaac

SEQ ID NO: 108365 - DNA, 32 bp, Artificial Sequence
  Description of Artificial Sequence: Synthetic oligonucleotide
gagttcgtgggtgacgggatctataacaacac

SEQ ID NO: 108366 - DNA, 32 bp, Artificial Sequence
  Description of Artificial Sequence: Synthetic oligonucleotide
agttcgtgggtgacgggatctataacaacacc

SEQ ID NO: 108367 - DNA, 31 bp, Artificial Sequence
  Description of Artificial Sequence: Synthetic oligonucleotide
gttcgtgggtgacgggatctataacaacacc

SEQ ID NO: 108368 - DNA, 33 bp, Artificial Sequence
  Description of Artificial Sequence: Synthetic oligonucleotide
ttcgtgggtgacgggatctataacaacaccatg

SEQ ID NO: 108369 - DNA, 32 bp, Artificial Sequence
  Description of Artificial Sequence: Synthetic oligonucleotide
tcgtgggtgacgggatctataacaacaccatg

SEQ ID NO: 108370 - DNA, 31 bp, Artificial Sequence
  Description of Artificial Sequence: Synthetic oligonucleotide
cgtgggtgacgggatctataacaacaccatg

SEQ ID NO: 108371 - DNA, 31 bp, Artificial Sequence
  Description of Artificial Sequence: Synthetic oligonucleotide
gtgggtgacgggatctataacaacaccatgg

SEQ ID NO: 108372 - DNA, 31 bp, Artificial Sequence
  Description of Artificial Sequence: Synthetic oligonucleotide
tgggtgacgggatctataacaacaccatggg

SEQ ID NO: 108373 - DNA, 30 bp, Artificial Sequence
  Description of Artificial Sequence: Synthetic oligonucleotide
gggtgacgggatctataacaacaccatggg

SEQ ID NO: 108374 - DNA, 30 bp, Artificial Sequence
  Description of Artificial Sequence: Synthetic oligonucleotide
ggtgacgggatctataacaacaccatgggc

SEQ ID NO: 108375 - DNA, 30 bp, Artificial Sequence
  Description of Artificial Sequence: Synthetic oligonucleotide
gtgacgggatctataacaacaccatgggcc

SEQ ID NO: 108376 - DNA, 31 bp, Artificial Sequence
  Description of Artificial Sequence: Synthetic oligonucleotide
tgacgggatctataacaacaccatgggccac

SEQ ID NO: 108377 - DNA, 30 bp, Artificial Sequence
  Description of Artificial Sequence: Synthetic oligonucleotide
gacgggatctataacaacaccatgggccac

SEQ ID NO: 108378 - DNA, 30 bp, Artificial Sequence
  Description of Artificial Sequence: Synthetic oligonucleotide
acgggatctataacaacaccatgggccacg

SEQ ID NO: 108379 - DNA, 29 bp, Artificial Sequence
  Description of Artificial Sequence: Synthetic oligonucleotide
cgggatctataacaacaccatgggccacg

SEQ ID NO: 108380 - DNA, 30 bp, Artificial Sequence
  Description of Artificial Sequence: Synthetic oligonucleotide
gggatctataacaacaccatgggccacgtg

SEQ ID NO: 108381 - DNA, 30 bp, Artificial Sequence
  Description of Artificial Sequence: Synthetic oligonucleotide
ggatctataacaacaccatgggccacgtgc

SEQ ID NO: 108382 - DNA, 31 bp, Artificial Sequence
  Description of Artificial Sequence: Synthetic oligonucleotide
gatctataacaacaccatgggccacgtgcac

SEQ ID NO: 108383 - DNA, 32 bp, Artificial Sequence
  Description of Artificial Sequence: Synthetic oligonucleotide
atctataacaacaccatgggccacgtgcacag

SEQ ID NO: 108384 - DNA, 31 bp, Artificial Sequence
  Description of Artificial Sequence: Synthetic oligonucleotide
tctataacaacaccatgggccacgtgcacag

SEQ ID NO: 108385 - DNA, 30 bp, Artificial Sequence
  Description of Artificial Sequence: Synthetic oligonucleotide
ctataacaacaccatgggccacgtgcacag

SEQ ID NO: 108386 - DNA, 30 bp, Artificial Sequence
  Description of Artificial Sequence: Synthetic oligonucleotide
tataacaacaccatgggccacgtgcacagc

SEQ ID NO: 108387 - DNA, 29 bp, Artificial Sequence
  Description of Artificial Sequence: Synthetic oligonucleotide
ataacaacaccatgggccacgtgcacagc

SEQ ID NO: 108388 - DNA, 28 bp, Artificial Sequence
  Description of Artificial Sequence: Synthetic oligonucleotide
taacaacaccatgggccacgtgcacagc

SEQ ID NO: 108389 - DNA, 27 bp, Artificial Sequence
  Description of Artificial Sequence: Synthetic oligonucleotide
aacaacaccatgggccacgtgcacagc

SEQ ID NO: 108390 - DNA, 26 bp, Artificial Sequence
  Description of Artificial Sequence: Synthetic oligonucleotide
acaacaccatgggccacgtgcacagc

SEQ ID NO: 108391 - DNA, 25 bp, Artificial Sequence
  Description of Artificial Sequence: Synthetic oligonucleotide
caacaccatgggccacgtgcacagc

SEQ ID NO: 108392 - DNA, 26 bp, Artificial Sequence
  Description of Artificial Sequence: Synthetic oligonucleotide
aacaccatgggccacgtgcacagcca

SEQ ID NO: 108393 - DNA, 25 bp, Artificial Sequence
  Description of Artificial Sequence: Synthetic oligonucleotide
acaccatgggccacgtgcacagcca

SEQ ID NO: 108394 - DNA, 24 bp, Artificial Sequence
  Description of Artificial Sequence: Synthetic oligonucleotide
caccatgggccacgtgcacagcca

SEQ ID NO: 108395 - DNA, 26 bp, Artificial Sequence
  Description of Artificial Sequence: Synthetic oligonucleotide
accatgggccacgtgcacagccactt

SEQ ID NO: 108396 - DNA, 25 bp, Artificial Sequence
  Description of Artificial Sequence: Synthetic oligonucleotide
ccatgggccacgtgcacagccactt

SEQ ID NO: 108397 - DNA, 25 bp, Artificial Sequence
  Description of Artificial Sequence: Synthetic oligonucleotide
catgggccacgtgcacagccacttg

SEQ ID NO: 108398 - DNA, 26 bp, Artificial Sequence
  Description of Artificial Sequence: Synthetic oligonucleotide
atgggccacgtgcacagccacttgca

SEQ ID NO: 108399 - DNA, 25 bp, Artificial Sequence
  Description of Artificial Sequence: Synthetic oligonucleotide
tgggccacgtgcacagccacttgca

SEQ ID NO: 108400 - DNA, 24 bp, Artificial Sequence
  Description of Artificial Sequence: Synthetic oligonucleotide
gggccacgtgcacagccacttgca

SEQ ID NO: 108401 - DNA, 24 bp, Artificial Sequence
  Description of Artificial Sequence: Synthetic oligonucleotide
ggccacgtgcacagccacttgcag

SEQ ID NO: 108402 - DNA, 24 bp, Artificial Sequence
  Description of Artificial Sequence: Synthetic oligonucleotide
gccacgtgcacagccacttgcagg

SEQ ID NO: 108403 - DNA, 25 bp, Artificial Sequence
  Description of Artificial Sequence: Synthetic oligonucleotide
ccacgtgcacagccacttgcaggga

SEQ ID NO: 108404 - DNA, 26 bp, Artificial Sequence
  Description of Artificial Sequence: Synthetic oligonucleotide
cacgtgcacagccacttgcagggaga

SEQ ID NO: 108405 - DNA, 26 bp, Artificial Sequence
  Description of Artificial Sequence: Synthetic oligonucleotide
acgtgcacagccacttgcagggagag

SEQ ID NO: 108406 - DNA, 25 bp, Artificial Sequence
  Description of Artificial Sequence: Synthetic oligonucleotide
cgtgcacagccacttgcagggagag

SEQ ID NO: 108407 - DNA, 26 bp, Artificial Sequence
  Description of Artificial Sequence: Synthetic oligonucleotide
gtgcacagccacttgcagggagaggt

SEQ ID NO: 108408 - DNA, 27 bp, Artificial Sequence
  Description of Artificial Sequence: Synthetic oligonucleotide
tgcacagccacttgcagggagaggtgt

SEQ ID NO: 108409 - DNA, 27 bp, Artificial Sequence
  Description of Artificial Sequence: Synthetic oligonucleotide
gcacagccacttgcagggagaggtgtt

SEQ ID NO: 108410 - DNA, 28 bp, Artificial Sequence
  Description of Artificial Sequence: Synthetic oligonucleotide
cacagccacttgcagggagaggtgtttg

SEQ ID NO: 108411 - DNA, 28 bp, Artificial Sequence
  Description of Artificial Sequence: Synthetic oligonucleotide
acagccacttgcagggagaggtgtttgg

SEQ ID NO: 108412 - DNA, 27 bp, Artificial Sequence
  Description of Artificial Sequence: Synthetic oligonucleotide
cagccacttgcagggagaggtgtttgg

SEQ ID NO: 108413 - DNA, 27 bp, Artificial Sequence
  Description of Artificial Sequence: Synthetic oligonucleotide
agccacttgcagggagaggtgtttggg

SEQ ID NO: 108414 - DNA, 26 bp, Artificial Sequence
  Description of Artificial Sequence: Synthetic oligonucleotide
gccacttgcagggagaggtgtttggg

SEQ ID NO: 108415 - DNA, 26 bp, Artificial Sequence
  Description of Artificial Sequence: Synthetic oligonucleotide
ccacttgcagggagaggtgtttgggg

SEQ ID NO: 108416 - DNA, 27 bp, Artificial Sequence
  Description of Artificial Sequence: Synthetic oligonucleotide
cacttgcagggagaggtgtttggggct

SEQ ID NO: 108417 - DNA, 27 bp, Artificial Sequence
  Description of Artificial Sequence: Synthetic oligonucleotide
acttgcagggagaggtgtttggggctg

SEQ ID NO: 108418 - DNA, 27 bp, Artificial Sequence
  Description of Artificial Sequence: Synthetic oligonucleotide
cttgcagggagaggtgtttggggctgt

SEQ ID NO: 108419 - DNA, 27 bp, Artificial Sequence
  Description of Artificial Sequence: Synthetic oligonucleotide
ttgcagggagaggtgtttggggctgtc

SEQ ID NO: 108420 - DNA, 26 bp, Artificial Sequence
  Description of Artificial Sequence: Synthetic oligonucleotide
tgcagggagaggtgtttggggctgtc

SEQ ID NO: 108421 - DNA, 25 bp, Artificial Sequence
  Description of Artificial Sequence: Synthetic oligonucleotide
gcagggagaggtgtttggggctgtc

SEQ ID NO: 108422 - DNA, 26 bp, Artificial Sequence
  Description of Artificial Sequence: Synthetic oligonucleotide
cagggagaggtgtttggggctgtcct

SEQ ID NO: 108423 - DNA, 26 bp, Artificial Sequence
  Description of Artificial Sequence: Synthetic oligonucleotide
agggagaggtgtttggggctgtcctg

SEQ ID NO: 108424 - DNA, 25 bp, Artificial Sequence
  Description of Artificial Sequence: Synthetic oligonucleotide
gggagaggtgtttggggctgtcctg

SEQ ID NO: 108425 - DNA, 25 bp, Artificial Sequence
  Description of Artificial Sequence: Synthetic oligonucleotide
ggagaggtgtttggggctgtcctgc

SEQ ID NO: 108426 - DNA, 25 bp, Artificial Sequence
  Description of Artificial Sequence: Synthetic oligonucleotide
gagaggtgtttggggctgtcctgcg

SEQ ID NO: 108427 - DNA, 25 bp, Artificial Sequence
  Description of Artificial Sequence: Synthetic oligonucleotide
agaggtgtttggggctgtcctgcgc

SEQ ID NO: 108428 - DNA, 24 bp, Artificial Sequence
  Description of Artificial Sequence: Synthetic oligonucleotide
gaggtgtttggggctgtcctgcgc

SEQ ID NO: 108429 - DNA, 25 bp, Artificial Sequence
  Description of Artificial Sequence: Synthetic oligonucleotide
aggtgtttggggctgtcctgcgcca

SEQ ID NO: 108430 - DNA, 24 bp, Artificial Sequence
  Description of Artificial Sequence: Synthetic oligonucleotide
ggtgtttggggctgtcctgcgcca

SEQ ID NO: 108431 - DNA, 24 bp, Artificial Sequence
  Description of Artificial Sequence: Synthetic oligonucleotide
gtgtttggggctgtcctgcgccag

SEQ ID NO: 108432 - DNA, 25 bp, Artificial Sequence
  Description of Artificial Sequence: Synthetic oligonucleotide
tgtttggggctgtcctgcgccagga

SEQ ID NO: 108433 - DNA, 24 bp, Artificial Sequence
  Description of Artificial Sequence: Synthetic oligonucleotide
gtttggggctgtcctgcgccagga

SEQ ID NO: 108434 - DNA, 25 bp, Artificial Sequence
  Description of Artificial Sequence: Synthetic oligonucleotide
tttggggctgtcctgcgccaggaga

SEQ ID NO: 108435 - DNA, 24 bp, Artificial Sequence
  Description of Artificial Sequence: Synthetic oligonucleotide
ttggggctgtcctgcgccaggaga

SEQ ID NO: 108436 - DNA, 23 bp, Artificial Sequence
  Description of Artificial Sequence: Synthetic oligonucleotide
tggggctgtcctgcgccaggaga

SEQ ID NO: 108437 - DNA, 22 bp, Artificial Sequence
  Description of Artificial Sequence: Synthetic oligonucleotide
ggggctgtcctgcgccaggaga

SEQ ID NO: 108438 - DNA, 22 bp, Artificial Sequence
  Description of Artificial Sequence: Synthetic oligonucleotide
gggctgtcctgcgccaggagac

SEQ ID NO: 108439 - DNA, 22 bp, Artificial Sequence
  Description of Artificial Sequence: Synthetic oligonucleotide
ggctgtcctgcgccaggagacg

SEQ ID NO: 108440 - DNA, 23 bp, Artificial Sequence
  Description of Artificial Sequence: Synthetic oligonucleotide
gctgtcctgcgccaggagacgga

SEQ ID NO: 108441 - DNA, 27 bp, Artificial Sequence
  Description of Artificial Sequence: Synthetic oligonucleotide
ctgtcctgcgccaggagacggagtttt

SEQ ID NO: 108442 - DNA, 28 bp, Artificial Sequence
  Description of Artificial Sequence: Synthetic oligonucleotide
tgtcctgcgccaggagacggagtttttc

SEQ ID NO: 108443 - DNA, 27 bp, Artificial Sequence
  Description of Artificial Sequence: Synthetic oligonucleotide
gtcctgcgccaggagacggagtttttc

SEQ ID NO: 108444 - DNA, 27 bp, Artificial Sequence
  Description of Artificial Sequence: Synthetic oligonucleotide
tcctgcgccaggagacggagtttttcc

SEQ ID NO: 108445 - DNA, 27 bp, Artificial Sequence
  Description of Artificial Sequence: Synthetic oligonucleotide
cctgcgccaggagacggagtttttcca

SEQ ID NO: 108446 - DNA, 28 bp, Artificial Sequence
  Description of Artificial Sequence: Synthetic oligonucleotide
ctgcgccaggagacggagtttttccaac

SEQ ID NO: 108447 - DNA, 29 bp, Artificial Sequence
  Description of Artificial Sequence: Synthetic oligonucleotide
tgcgccaggagacggagtttttccaacag

SEQ ID NO: 108448 - DNA, 28 bp, Artificial Sequence
  Description of Artificial Sequence: Synthetic oligonucleotide
gcgccaggagacggagtttttccaacag

SEQ ID NO: 108449 - DNA, 30 bp, Artificial Sequence
  Description of Artificial Sequence: Synthetic oligonucleotide
cgccaggagacggagtttttccaacagaac

SEQ ID NO: 108450 - DNA, 30 bp, Artificial Sequence
  Description of Artificial Sequence: Synthetic oligonucleotide
gccaggagacggagtttttccaacagaacc

SEQ ID NO: 108451 - DNA, 31 bp, Artificial Sequence
  Description of Artificial Sequence: Synthetic oligonucleotide
ccaggagacggagtttttccaacagaaccag

SEQ ID NO: 108452 - DNA, 32 bp, Artificial Sequence
  Description of Artificial Sequence: Synthetic oligonucleotide
caggagacggagtttttccaacagaaccagac

SEQ ID NO: 108453 - DNA, 33 bp, Artificial Sequence
  Description of Artificial Sequence: Synthetic oligonucleotide
aggagacggagtttttccaacagaaccagacag

SEQ ID NO: 108454 - DNA, 32 bp, Artificial Sequence
  Description of Artificial Sequence: Synthetic oligonucleotide
ggagacggagtttttccaacagaaccagacag

SEQ ID NO: 108455 - DNA, 32 bp, Artificial Sequence
  Description of Artificial Sequence: Synthetic oligonucleotide
gagacggagtttttccaacagaaccagacagg

SEQ ID NO: 108456 - DNA, 35 bp, Artificial Sequence
  Description of Artificial Sequence: Synthetic oligonucleotide
agacggagtttttccaacagaaccagacaggtaac

SEQ ID NO: 108457 - DNA, 34 bp, Artificial Sequence
  Description of Artificial Sequence: Synthetic oligonucleotide
gacggagtttttccaacagaaccagacaggtaac

SEQ ID NO: 108458 - DNA, 36 bp, Artificial Sequence
  Description of Artificial Sequence: Synthetic oligonucleotide
acggagtttttccaacagaaccagacaggtaacatc

SEQ ID NO: 108459 - DNA, 35 bp, Artificial Sequence
  Description of Artificial Sequence: Synthetic oligonucleotide
cggagtttttccaacagaaccagacaggtaacatc

SEQ ID NO: 108460 - DNA, 37 bp, Artificial Sequence
  Description of Artificial Sequence: Synthetic oligonucleotide
ggagtttttccaacagaaccagacaggtaacatcatg

SEQ ID NO: 108461 - DNA, 38 bp, Artificial Sequence
  Description of Artificial Sequence: Synthetic oligonucleotide
gagtttttccaacagaaccagacaggtaacatcatgtc

SEQ ID NO: 108462 - DNA, 39 bp, Artificial Sequence
  Description of Artificial Sequence: Synthetic oligonucleotide
agtttttccaacagaaccagacaggtaacatcatgtctc

SEQ ID NO: 108463 - DNA, 38 bp, Artificial Sequence
  Description of Artificial Sequence: Synthetic oligonucleotide
gtttttccaacagaaccagacaggtaacatcatgtctc

SEQ ID NO: 108464 - DNA, 38 bp, Artificial Sequence
  Description of Artificial Sequence: Synthetic oligonucleotide
tttttccaacagaaccagacaggtaacatcatgtctcg

SEQ ID NO: 108465 - DNA, 37 bp, Artificial Sequence
  Description of Artificial Sequence: Synthetic oligonucleotide
ttttccaacagaaccagacaggtaacatcatgtctcg

SEQ ID NO: 108466 - DNA, 36 bp, Artificial Sequence
  Description of Artificial Sequence: Synthetic oligonucleotide
tttccaacagaaccagacaggtaacatcatgtctcg

SEQ ID NO: 108467 - DNA, 35 bp, Artificial Sequence
  Description of Artificial Sequence: Synthetic oligonucleotide
ttccaacagaaccagacaggtaacatcatgtctcg

SEQ ID NO: 108468 - DNA, 34 bp, Artificial Sequence
  Description of Artificial Sequence: Synthetic oligonucleotide
tccaacagaaccagacaggtaacatcatgtctcg

SEQ ID NO: 108469 - DNA, 33 bp, Artificial Sequence
  Description of Artificial Sequence: Synthetic oligonucleotide
ccaacagaaccagacaggtaacatcatgtctcg

SEQ ID NO: 108470 - DNA, 33 bp, Artificial Sequence
  Description of Artificial Sequence: Synthetic oligonucleotide
caacagaaccagacaggtaacatcatgtctcgg

SEQ ID NO: 108471 - DNA, 33 bp, Artificial Sequence
  Description of Artificial Sequence: Synthetic oligonucleotide
aacagaaccagacaggtaacatcatgtctcggg

SEQ ID NO: 108472 - DNA, 32 bp, Artificial Sequence
  Description of Artificial Sequence: Synthetic oligonucleotide
acagaaccagacaggtaacatcatgtctcggg

SEQ ID NO: 108473 - DNA, 31 bp, Artificial Sequence
  Description of Artificial Sequence: Synthetic oligonucleotide
cagaaccagacaggtaacatcatgtctcggg

SEQ ID NO: 108474 - DNA, 34 bp, Artificial Sequence
  Description of Artificial Sequence: Synthetic oligonucleotide
agaaccagacaggtaacatcatgtctcgggtaac

SEQ ID NO: 108475 - DNA, 33 bp, Artificial Sequence
  Description of Artificial Sequence: Synthetic oligonucleotide
gaaccagacaggtaacatcatgtctcgggtaac

SEQ ID NO: 108476 - DNA, 34 bp, Artificial Sequence
  Description of Artificial Sequence: Synthetic oligonucleotide
aaccagacaggtaacatcatgtctcgggtaacag

SEQ ID NO: 108477 - DNA, 33 bp, Artificial Sequence
  Description of Artificial Sequence: Synthetic oligonucleotide
accagacaggtaacatcatgtctcgggtaacag

SEQ ID NO: 108478 - DNA, 32 bp, Artificial Sequence
  Description of Artificial Sequence: Synthetic oligonucleotide
ccagacaggtaacatcatgtctcgggtaacag

SEQ ID NO: 108479 - DNA, 33 bp, Artificial Sequence
  Description of Artificial Sequence: Synthetic oligonucleotide
cagacaggtaacatcatgtctcgggtaacagag

SEQ ID NO: 108480 - DNA, 33 bp, Artificial Sequence
  Description of Artificial Sequence: Synthetic oligonucleotide
agacaggtaacatcatgtctcgggtaacagagg

SEQ ID NO: 108481 - DNA, 32 bp, Artificial Sequence
  Description of Artificial Sequence: Synthetic oligonucleotide
gacaggtaacatcatgtctcgggtaacagagg

SEQ ID NO: 108482 - DNA, 33 bp, Artificial Sequence
  Description of Artificial Sequence: Synthetic oligonucleotide
acaggtaacatcatgtctcgggtaacagaggac

SEQ ID NO: 108483 - DNA, 32 bp, Artificial Sequence
  Description of Artificial Sequence: Synthetic oligonucleotide
caggtaacatcatgtctcgggtaacagaggac

SEQ ID NO: 108484 - DNA, 33 bp, Artificial Sequence
  Description of Artificial Sequence: Synthetic oligonucleotide
aggtaacatcatgtctcgggtaacagaggacac

SEQ ID NO: 108485 - DNA, 32 bp, Artificial Sequence
  Description of Artificial Sequence: Synthetic oligonucleotide
ggtaacatcatgtctcgggtaacagaggacac

SEQ ID NO: 108486 - DNA, 32 bp, Artificial Sequence
  Description of Artificial Sequence: Synthetic oligonucleotide
gtaacatcatgtctcgggtaacagaggacacg

SEQ ID NO: 108487 - DNA, 33 bp, Artificial Sequence
  Description of Artificial Sequence: Synthetic oligonucleotide
taacatcatgtctcgggtaacagaggacacgtc

SEQ ID NO: 108488 - DNA, 32 bp, Artificial Sequence
  Description of Artificial Sequence: Synthetic oligonucleotide
aacatcatgtctcgggtaacagaggacacgtc

SEQ ID NO: 108489 - DNA, 31 bp, Artificial Sequence
  Description of Artificial Sequence: Synthetic oligonucleotide
acatcatgtctcgggtaacagaggacacgtc

SEQ ID NO: 108490 - DNA, 30 bp, Artificial Sequence
  Description of Artificial Sequence: Synthetic oligonucleotide
catcatgtctcgggtaacagaggacacgtc

SEQ ID NO: 108491 - DNA, 30 bp, Artificial Sequence
  Description of Artificial Sequence: Synthetic oligonucleotide
atcatgtctcgggtaacagaggacacgtcc

SEQ ID NO: 108492 - DNA, 29 bp, Artificial Sequence
  Description of Artificial Sequence: Synthetic oligonucleotide
tcatgtctcgggtaacagaggacacgtcc

SEQ ID NO: 108493 - DNA, 28 bp, Artificial Sequence
  Description of Artificial Sequence: Synthetic oligonucleotide
catgtctcgggtaacagaggacacgtcc

SEQ ID NO: 108494 - DNA, 29 bp, Artificial Sequence
  Description of Artificial Sequence: Synthetic oligonucleotide
atgtctcgggtaacagaggacacgtccac

SEQ ID NO: 108495 - DNA, 28 bp, Artificial Sequence
  Description of Artificial Sequence: Synthetic oligonucleotide
tgtctcgggtaacagaggacacgtccac

SEQ ID NO: 108496 - DNA, 27 bp, Artificial Sequence
  Description of Artificial Sequence: Synthetic oligonucleotide
gtctcgggtaacagaggacacgtccac

SEQ ID NO: 108497 - DNA, 27 bp, Artificial Sequence
  Description of Artificial Sequence: Synthetic oligonucleotide
tctcgggtaacagaggacacgtccacc

SEQ ID NO: 108498 - DNA, 26 bp, Artificial Sequence
  Description of Artificial Sequence: Synthetic oligonucleotide
ctcgggtaacagaggacacgtccacc

SEQ ID NO: 108499 - DNA, 27 bp, Artificial Sequence
  Description of Artificial Sequence: Synthetic oligonucleotide
tcgggtaacagaggacacgtccaccct

SEQ ID NO: 108500 - DNA, 26 bp, Artificial Sequence
  Description of Artificial Sequence: Synthetic oligonucleotide
cgggtaacagaggacacgtccaccct

SEQ ID NO: 108501 - DNA, 27 bp, Artificial Sequence
  Description of Artificial Sequence: Synthetic oligonucleotide
gggtaacagaggacacgtccaccctga

SEQ ID NO: 108502 - DNA, 27 bp, Artificial Sequence
  Description of Artificial Sequence: Synthetic oligonucleotide
ggtaacagaggacacgtccaccctgag

SEQ ID NO: 108503 - DNA, 28 bp, Artificial Sequence
  Description of Artificial Sequence: Synthetic oligonucleotide
gtaacagaggacacgtccaccctgagtg

SEQ ID NO: 108504 - DNA, 31 bp, Artificial Sequence
  Description of Artificial Sequence: Synthetic oligonucleotide
taacagaggacacgtccaccctgagtgattc

SEQ ID NO: 108505 - DNA, 30 bp, Artificial Sequence
  Description of Artificial Sequence: Synthetic oligonucleotide
aacagaggacacgtccaccctgagtgattc

SEQ ID NO: 108506 - DNA, 29 bp, Artificial Sequence
  Description of Artificial Sequence: Synthetic oligonucleotide
acagaggacacgtccaccctgagtgattc

SEQ ID NO: 108507 - DNA, 28 bp, Artificial Sequence
  Description of Artificial Sequence: Synthetic oligonucleotide
cagaggacacgtccaccctgagtgattc

SEQ ID NO: 108508 - DNA, 29 bp, Artificial Sequence
  Description of Artificial Sequence: Synthetic oligonucleotide
agaggacacgtccaccctgagtgattctc

SEQ ID NO: 108509 - DNA, 28 bp, Artificial Sequence
  Description of Artificial Sequence: Synthetic oligonucleotide
gaggacacgtccaccctgagtgattctc

SEQ ID NO: 108510 - DNA, 29 bp, Artificial Sequence
  Description of Artificial Sequence: Synthetic oligonucleotide
aggacacgtccaccctgagtgattctctg

SEQ ID NO: 108511 - DNA, 28 bp, Artificial Sequence
  Description of Artificial Sequence: Synthetic oligonucleotide
ggacacgtccaccctgagtgattctctg

SEQ ID NO: 108512 - DNA, 29 bp, Artificial Sequence
  Description of Artificial Sequence: Synthetic oligonucleotide
gacacgtccaccctgagtgattctctgag

SEQ ID NO: 108513 - DNA, 30 bp, Artificial Sequence
  Description of Artificial Sequence: Synthetic oligonucleotide
acacgtccaccctgagtgattctctgagtg

SEQ ID NO: 108514 - DNA, 29 bp, Artificial Sequence
  Description of Artificial Sequence: Synthetic oligonucleotide
cacgtccaccctgagtgattctctgagtg

SEQ ID NO: 108515 - DNA, 30 bp, Artificial Sequence
  Description of Artificial Sequence: Synthetic oligonucleotide
acgtccaccctgagtgattctctgagtgag

SEQ ID NO: 108516 - DNA, 29 bp, Artificial Sequence
  Description of Artificial Sequence: Synthetic oligonucleotide
cgtccaccctgagtgattctctgagtgag

SEQ ID NO: 108517 - DNA, 32 bp, Artificial Sequence
  Description of Artificial Sequence: Synthetic oligonucleotide
gtccaccctgagtgattctctgagtgagaatc

SEQ ID NO: 108518 - DNA, 33 bp, Artificial Sequence
  Description of Artificial Sequence: Synthetic oligonucleotide
tccaccctgagtgattctctgagtgagaatctg

SEQ ID NO: 108519 - DNA, 32 bp, Artificial Sequence
  Description of Artificial Sequence: Synthetic oligonucleotide
ccaccctgagtgattctctgagtgagaatctg

SEQ ID NO: 108520 - DNA, 33 bp, Artificial Sequence
  Description of Artificial Sequence: Synthetic oligonucleotide
caccctgagtgattctctgagtgagaatctgag

SEQ ID NO: 108521 - DNA, 33 bp, Artificial Sequence
  Description of Artificial Sequence: Synthetic oligonucleotide
accctgagtgattctctgagtgagaatctgagc

SEQ ID NO: 108522 - DNA, 32 bp, Artificial Sequence
  Description of Artificial Sequence: Synthetic oligonucleotide
ccctgagtgattctctgagtgagaatctgagc

SEQ ID NO: 108523 - DNA, 38 bp, Artificial Sequence
  Description of Artificial Sequence: Synthetic oligonucleotide
cctgagtgattctctgagtgagaatctgagcttatttc

SEQ ID NO: 108524 - DNA, 39 bp, Artificial Sequence
  Description of Artificial Sequence: Synthetic oligonucleotide
ctgagtgattctctgagtgagaatctgagcttatttctg

SEQ ID NO: 108525 - DNA, 40 bp, Artificial Sequence
  Description of Artificial Sequence: Synthetic oligonucleotide
tgagtgattctctgagtgagaatctgagcttatttctgtg

SEQ ID NO: 108526 - DNA, 39 bp, Artificial Sequence
  Description of Artificial Sequence: Synthetic oligonucleotide
gagtgattctctgagtgagaatctgagcttatttctgtg

SEQ ID NO: 108527 - DNA, 39 bp, Artificial Sequence
  Description of Artificial Sequence: Synthetic oligonucleotide
agtgattctctgagtgagaatctgagcttatttctgtgg

SEQ ID NO: 108528 - DNA, 38 bp, Artificial Sequence
  Description of Artificial Sequence: Synthetic oligonucleotide
gtgattctctgagtgagaatctgagcttatttctgtgg

SEQ ID NO: 108529 - DNA, 40 bp, Artificial Sequence
  Description of Artificial Sequence: Synthetic oligonucleotide
tgattctctgagtgagaatctgagcttatttctgtggtac

SEQ ID NO: 108530 - DNA, 39 bp, Artificial Sequence
  Description of Artificial Sequence: Synthetic oligonucleotide
gattctctgagtgagaatctgagcttatttctgtggtac

SEQ ID NO: 108531 - DNA, 39 bp, Artificial Sequence
  Description of Artificial Sequence: Synthetic oligonucleotide
attctctgagtgagaatctgagcttatttctgtggtacc

SEQ ID NO: 108532 - DNA, 38 bp, Artificial Sequence
  Description of Artificial Sequence: Synthetic oligonucleotide
ttctctgagtgagaatctgagcttatttctgtggtacc

SEQ ID NO: 108533 - DNA, 37 bp, Artificial Sequence
  Description of Artificial Sequence: Synthetic oligonucleotide
tctctgagtgagaatctgagcttatttctgtggtacc

SEQ ID NO: 108534 - DNA, 36 bp, Artificial Sequence
  Description of Artificial Sequence: Synthetic oligonucleotide
ctctgagtgagaatctgagcttatttctgtggtacc

SEQ ID NO: 108535 - DNA, 37 bp, Artificial Sequence
  Description of Artificial Sequence: Synthetic oligonucleotide
tctgagtgagaatctgagcttatttctgtggtacctg

SEQ ID NO: 108536 - DNA, 36 bp, Artificial Sequence
  Description of Artificial Sequence: Synthetic oligonucleotide
ctgagtgagaatctgagcttatttctgtggtacctg

SEQ ID NO: 108537 - DNA, 36 bp, Artificial Sequence
  Description of Artificial Sequence: Synthetic oligonucleotide
tgagtgagaatctgagcttatttctgtggtacctgg

SEQ ID NO: 108538 - DNA, 35 bp, Artificial Sequence
  Description of Artificial Sequence: Synthetic oligonucleotide
gagtgagaatctgagcttatttctgtggtacctgg

SEQ ID NO: 108539 - DNA, 36 bp, Artificial Sequence
  Description of Artificial Sequence: Synthetic oligonucleotide
agtgagaatctgagcttatttctgtggtacctggtg

SEQ ID NO: 108540 - DNA, 35 bp, Artificial Sequence
  Description of Artificial Sequence: Synthetic oligonucleotide
gtgagaatctgagcttatttctgtggtacctggtg

SEQ ID NO: 108541 - DNA, 35 bp, Artificial Sequence
  Description of Artificial Sequence: Synthetic oligonucleotide
tgagaatctgagcttatttctgtggtacctggtgc

SEQ ID NO: 108542 - DNA, 34 bp, Artificial Sequence
  Description of Artificial Sequence: Synthetic oligonucleotide
gagaatctgagcttatttctgtggtacctggtgc

SEQ ID NO: 108543 - DNA, 34 bp, Artificial Sequence
  Description of Artificial Sequence: Synthetic oligonucleotide
agaatctgagcttatttctgtggtacctggtgcg

SEQ ID NO: 108544 - DNA, 33 bp, Artificial Sequence
  Description of Artificial Sequence: Synthetic oligonucleotide
gaatctgagcttatttctgtggtacctggtgcg

SEQ ID NO: 108545 - DNA, 34 bp, Artificial Sequence
  Description of Artificial Sequence: Synthetic oligonucleotide
aatctgagcttatttctgtggtacctggtgcgag

SEQ ID NO: 108546 - DNA, 33 bp, Artificial Sequence
  Description of Artificial Sequence: Synthetic oligonucleotide
atctgagcttatttctgtggtacctggtgcgag

SEQ ID NO: 108547 - DNA, 32 bp, Artificial Sequence
  Description of Artificial Sequence: Synthetic oligonucleotide
tctgagcttatttctgtggtacctggtgcgag

SEQ ID NO: 108548 - DNA, 31 bp, Artificial Sequence
  Description of Artificial Sequence: Synthetic oligonucleotide
ctgagcttatttctgtggtacctggtgcgag

SEQ ID NO: 108549 - DNA, 31 bp, Artificial Sequence
  Description of Artificial Sequence: Synthetic oligonucleotide
tgagcttatttctgtggtacctggtgcgagg

SEQ ID NO: 108550 - DNA, 30 bp, Artificial Sequence
  Description of Artificial Sequence: Synthetic oligonucleotide
gagcttatttctgtggtacctggtgcgagg

SEQ ID NO: 108551 - DNA, 30 bp, Artificial Sequence
  Description of Artificial Sequence: Synthetic oligonucleotide
agcttatttctgtggtacctggtgcgaggc

SEQ ID NO: 108552 - DNA, 29 bp, Artificial Sequence
  Description of Artificial Sequence: Synthetic oligonucleotide
gcttatttctgtggtacctggtgcgaggc

SEQ ID NO: 108553 - DNA, 29 bp, Artificial Sequence
  Description of Artificial Sequence: Synthetic oligonucleotide
cttatttctgtggtacctggtgcgaggcc

SEQ ID NO: 108554 - DNA, 32 bp, Artificial Sequence
  Description of Artificial Sequence: Synthetic oligonucleotide
ttatttctgtggtacctggtgcgaggcctatg

SEQ ID NO: 108555 - DNA, 31 bp, Artificial Sequence
  Description of Artificial Sequence: Synthetic oligonucleotide
tatttctgtggtacctggtgcgaggcctatg

SEQ ID NO: 108556 - DNA, 30 bp, Artificial Sequence
  Description of Artificial Sequence: Synthetic oligonucleotide
atttctgtggtacctggtgcgaggcctatg

SEQ ID NO: 108557 - DNA, 29 bp, Artificial Sequence
  Description of Artificial Sequence: Synthetic oligonucleotide
tttctgtggtacctggtgcgaggcctatg

SEQ ID NO: 108558 - DNA, 28 bp, Artificial Sequence
  Description of Artificial Sequence: Synthetic oligonucleotide
ttctgtggtacctggtgcgaggcctatg

SEQ ID NO: 108559 - DNA, 27 bp, Artificial Sequence
  Description of Artificial Sequence: Synthetic oligonucleotide
tctgtggtacctggtgcgaggcctatg

SEQ ID NO: 108560 - DNA, 27 bp, Artificial Sequence
  Description of Artificial Sequence: Synthetic oligonucleotide
ctgtggtacctggtgcgaggcctatgt

SEQ ID NO: 108561 - DNA, 27 bp, Artificial Sequence
  Description of Artificial Sequence: Synthetic oligonucleotide
tgtggtacctggtgcgaggcctatgtc

SEQ ID NO: 108562 - DNA, 27 bp, Artificial Sequence
  Description of Artificial Sequence: Synthetic oligonucleotide
gtggtacctggtgcgaggcctatgtct

SEQ ID NO: 108563 - DNA, 27 bp, Artificial Sequence
  Description of Artificial Sequence: Synthetic oligonucleotide
tggtacctggtgcgaggcctatgtctc

SEQ ID NO: 108564 - DNA, 27 bp, Artificial Sequence
  Description of Artificial Sequence: Synthetic oligonucleotide
ggtacctggtgcgaggcctatgtctct

SEQ ID NO: 108565 - DNA, 28 bp, Artificial Sequence
  Description of Artificial Sequence: Synthetic oligonucleotide
gtacctggtgcgaggcctatgtctcttg

SEQ ID NO: 108566 - DNA, 28 bp, Artificial Sequence
  Description of Artificial Sequence: Synthetic oligonucleotide
tacctggtgcgaggcctatgtctcttgg

SEQ ID NO: 108567 - DNA, 27 bp, Artificial Sequence
  Description of Artificial Sequence: Synthetic oligonucleotide
acctggtgcgaggcctatgtctcttgg

SEQ ID NO: 108568 - DNA, 26 bp, Artificial Sequence
  Description of Artificial Sequence: Synthetic oligonucleotide
cctggtgcgaggcctatgtctcttgg

SEQ ID NO: 108569 - DNA, 26 bp, Artificial Sequence
  Description of Artificial Sequence: Synthetic oligonucleotide
ctggtgcgaggcctatgtctcttggg

SEQ ID NO: 108570 - DNA, 27 bp, Artificial Sequence
  Description of Artificial Sequence: Synthetic oligonucleotide
tggtgcgaggcctatgtctcttgggga

SEQ ID NO: 108571 - DNA, 27 bp, Artificial Sequence
  Description of Artificial Sequence: Synthetic oligonucleotide
ggtgcgaggcctatgtctcttggggat

SEQ ID NO: 108572 - DNA, 27 bp, Artificial Sequence
  Description of Artificial Sequence: Synthetic oligonucleotide
gtgcgaggcctatgtctcttggggatc

SEQ ID NO: 108573 - DNA, 29 bp, Artificial Sequence
  Description of Artificial Sequence: Synthetic oligonucleotide
tgcgaggcctatgtctcttggggatcatg

SEQ ID NO: 108574 - DNA, 28 bp, Artificial Sequence
  Description of Artificial Sequence: Synthetic oligonucleotide
gcgaggcctatgtctcttggggatcatg

SEQ ID NO: 108575 - DNA, 28 bp, Artificial Sequence
  Description of Artificial Sequence: Synthetic oligonucleotide
cgaggcctatgtctcttggggatcatgc

SEQ ID NO: 108576 - DNA, 29 bp, Artificial Sequence
  Description of Artificial Sequence: Synthetic oligonucleotide
gaggcctatgtctcttggggatcatgctc

SEQ ID NO: 108577 - DNA, 30 bp, Artificial Sequence
  Description of Artificial Sequence: Synthetic oligonucleotide
aggcctatgtctcttggggatcatgctctg

SEQ ID NO: 108578 - DNA, 29 bp, Artificial Sequence
  Description of Artificial Sequence: Synthetic oligonucleotide
ggcctatgtctcttggggatcatgctctg

SEQ ID NO: 108579 - DNA, 29 bp, Artificial Sequence
  Description of Artificial Sequence: Synthetic oligonucleotide
gcctatgtctcttggggatcatgctctgg

SEQ ID NO: 108580 - DNA, 29 bp, Artificial Sequence
  Description of Artificial Sequence: Synthetic oligonucleotide
cctatgtctcttggggatcatgctctggg

SEQ ID NO: 108581 - DNA, 29 bp, Artificial Sequence
  Description of Artificial Sequence: Synthetic oligonucleotide
ctatgtctcttggggatcatgctctgggg

SEQ ID NO: 108582 - DNA, 31 bp, Artificial Sequence
  Description of Artificial Sequence: Synthetic oligonucleotide
tatgtctcttggggatcatgctctggggatc

SEQ ID NO: 108583 - DNA, 30 bp, Artificial Sequence
  Description of Artificial Sequence: Synthetic oligonucleotide
atgtctcttggggatcatgctctggggatc

SEQ ID NO: 108584 - DNA, 29 bp, Artificial Sequence
  Description of Artificial Sequence: Synthetic oligonucleotide
tgtctcttggggatcatgctctggggatc

SEQ ID NO: 108585 - DNA, 28 bp, Artificial Sequence
  Description of Artificial Sequence: Synthetic oligonucleotide
gtctcttggggatcatgctctggggatc

SEQ ID NO: 108586 - DNA, 29 bp, Artificial Sequence
  Description of Artificial Sequence: Synthetic oligonucleotide
tctcttggggatcatgctctggggatcag

SEQ ID NO: 108587 - DNA, 28 bp, Artificial Sequence
  Description of Artificial Sequence: Synthetic oligonucleotide
ctcttggggatcatgctctggggatcag

SEQ ID NO: 108588 - DNA, 29 bp, Artificial Sequence
  Description of Artificial Sequence: Synthetic oligonucleotide
tcttggggatcatgctctggggatcagtg

SEQ ID NO: 108589 - DNA, 28 bp, Artificial Sequence
  Description of Artificial Sequence: Synthetic oligonucleotide
cttggggatcatgctctggggatcagtg

SEQ ID NO: 108590 - DNA, 29 bp, Artificial Sequence
  Description of Artificial Sequence: Synthetic oligonucleotide
ttggggatcatgctctggggatcagtgtc

SEQ ID NO: 108591 - DNA, 28 bp, Artificial Sequence
  Description of Artificial Sequence: Synthetic oligonucleotide
tggggatcatgctctggggatcagtgtc

SEQ ID NO: 108592 - DNA, 27 bp, Artificial Sequence
  Description of Artificial Sequence: Synthetic oligonucleotide
ggggatcatgctctggggatcagtgtc

SEQ ID NO: 108593 - DNA, 27 bp, Artificial Sequence
  Description of Artificial Sequence: Synthetic oligonucleotide
gggatcatgctctggggatcagtgtcc

SEQ ID NO: 108594 - DNA, 27 bp, Artificial Sequence
  Description of Artificial Sequence: Synthetic oligonucleotide
ggatcatgctctggggatcagtgtccc

SEQ ID NO: 108595 - DNA, 28 bp, Artificial Sequence
  Description of Artificial Sequence: Synthetic oligonucleotide
gatcatgctctggggatcagtgtccctc

SEQ ID NO: 108596 - DNA, 29 bp, Artificial Sequence
  Description of Artificial Sequence: Synthetic oligonucleotide
atcatgctctggggatcagtgtccctcac

SEQ ID NO: 108597 - DNA, 28 bp, Artificial Sequence
  Description of Artificial Sequence: Synthetic oligonucleotide
tcatgctctggggatcagtgtccctcac

SEQ ID NO: 108598 - DNA, 27 bp, Artificial Sequence
  Description of Artificial Sequence: Synthetic oligonucleotide
catgctctggggatcagtgtccctcac

SEQ ID NO: 108599 - DNA, 27 bp, Artificial Sequence
  Description of Artificial Sequence: Synthetic oligonucleotide
atgctctggggatcagtgtccctcacc

SEQ ID NO: 108600 - DNA, 27 bp, Artificial Sequence
  Description of Artificial Sequence: Synthetic oligonucleotide
tgctctggggatcagtgtccctcacca

SEQ ID NO: 108601 - DNA, 27 bp, Artificial Sequence
  Description of Artificial Sequence: Synthetic oligonucleotide
gctctggggatcagtgtccctcaccat

SEQ ID NO: 108602 - DNA, 27 bp, Artificial Sequence
  Description of Artificial Sequence: Synthetic oligonucleotide
ctctggggatcagtgtccctcaccatg

SEQ ID NO: 108603 - DNA, 27 bp, Artificial Sequence
  Description of Artificial Sequence: Synthetic oligonucleotide
tctggggatcagtgtccctcaccatgg

SEQ ID NO: 108604 - DNA, 27 bp, Artificial Sequence
  Description of Artificial Sequence: Synthetic oligonucleotide
ctggggatcagtgtccctcaccatggt

SEQ ID NO: 108605 - DNA, 27 bp, Artificial Sequence
  Description of Artificial Sequence: Synthetic oligonucleotide
tggggatcagtgtccctcaccatggtc

SEQ ID NO: 108606 - DNA, 27 bp, Artificial Sequence
  Description of Artificial Sequence: Synthetic oligonucleotide
ggggatcagtgtccctcaccatggtca

SEQ ID NO: 108607 - DNA, 27 bp, Artificial Sequence
  Description of Artificial Sequence: Synthetic oligonucleotide
gggatcagtgtccctcaccatggtcac

SEQ ID NO: 108608 - DNA, 27 bp, Artificial Sequence
  Description of Artificial Sequence: Synthetic oligonucleotide
ggatcagtgtccctcaccatggtcacc

SEQ ID NO: 108609 - DNA, 27 bp, Artificial Sequence
  Description of Artificial Sequence: Synthetic oligonucleotide
gatcagtgtccctcaccatggtcaccc

SEQ ID NO: 108610 - DNA, 28 bp, Artificial Sequence
  Description of Artificial Sequence: Synthetic oligonucleotide
atcagtgtccctcaccatggtcaccctg

SEQ ID NO: 108611 - DNA, 27 bp, Artificial Sequence
  Description of Artificial Sequence: Synthetic oligonucleotide
tcagtgtccctcaccatggtcaccctg

SEQ ID NO: 108612 - DNA, 27 bp, Artificial Sequence
  Description of Artificial Sequence: Synthetic oligonucleotide
cagtgtccctcaccatggtcaccctga

SEQ ID NO: 108613 - DNA, 28 bp, Artificial Sequence
  Description of Artificial Sequence: Synthetic oligonucleotide
agtgtccctcaccatggtcaccctgatc

SEQ ID NO: 108614 - DNA, 27 bp, Artificial Sequence
  Description of Artificial Sequence: Synthetic oligonucleotide
gtgtccctcaccatggtcaccctgatc

SEQ ID NO: 108615 - DNA, 28 bp, Artificial Sequence
  Description of Artificial Sequence: Synthetic oligonucleotide
tgtccctcaccatggtcaccctgatcac

SEQ ID NO: 108616 - DNA, 27 bp, Artificial Sequence
  Description of Artificial Sequence: Synthetic oligonucleotide
gtccctcaccatggtcaccctgatcac

SEQ ID NO: 108617 - DNA, 27 bp, Artificial Sequence
  Description of Artificial Sequence: Synthetic oligonucleotide
tccctcaccatggtcaccctgatcacc

SEQ ID NO: 108618 - DNA, 26 bp, Artificial Sequence
  Description of Artificial Sequence: Synthetic oligonucleotide
ccctcaccatggtcaccctgatcacc

SEQ ID NO: 108619 - DNA, 27 bp, Artificial Sequence
  Description of Artificial Sequence: Synthetic oligonucleotide
cctcaccatggtcaccctgatcaccct

SEQ ID NO: 108620 - DNA, 27 bp, Artificial Sequence
  Description of Artificial Sequence: Synthetic oligonucleotide
ctcaccatggtcaccctgatcaccctg

SEQ ID NO: 108621 - DNA, 27 bp, Artificial Sequence
  Description of Artificial Sequence: Synthetic oligonucleotide
tcaccatggtcaccctgatcaccctgc

SEQ ID NO: 108622 - DNA, 26 bp, Artificial Sequence
  Description of Artificial Sequence: Synthetic oligonucleotide
caccatggtcaccctgatcaccctgc

SEQ ID NO: 108623 - DNA, 27 bp, Artificial Sequence
  Description of Artificial Sequence: Synthetic oligonucleotide
accatggtcaccctgatcaccctgcct

SEQ ID NO: 108624 - DNA, 26 bp, Artificial Sequence
  Description of Artificial Sequence: Synthetic oligonucleotide
ccatggtcaccctgatcaccctgcct

SEQ ID NO: 108625 - DNA, 27 bp, Artificial Sequence
  Description of Artificial Sequence: Synthetic oligonucleotide
catggtcaccctgatcaccctgcctct

SEQ ID NO: 108626 - DNA, 27 bp, Artificial Sequence
  Description of Artificial Sequence: Synthetic oligonucleotide
atggtcaccctgatcaccctgcctctg

SEQ ID NO: 108627 - DNA, 26 bp, Artificial Sequence
  Description of Artificial Sequence: Synthetic oligonucleotide
tggtcaccctgatcaccctgcctctg

SEQ ID NO: 108628 - DNA, 25 bp, Artificial Sequence
  Description of Artificial Sequence: Synthetic oligonucleotide
ggtcaccctgatcaccctgcctctg

SEQ ID NO: 108629 - DNA, 27 bp, Artificial Sequence
  Description of Artificial Sequence: Synthetic oligonucleotide
gtcaccctgatcaccctgcctctgctt

SEQ ID NO: 108630 - DNA, 29 bp, Artificial Sequence
  Description of Artificial Sequence: Synthetic oligonucleotide
tcaccctgatcaccctgcctctgcttttc

SEQ ID NO: 108631 - DNA, 28 bp, Artificial Sequence
  Description of Artificial Sequence: Synthetic oligonucleotide
caccctgatcaccctgcctctgcttttc

SEQ ID NO: 108632 - DNA, 28 bp, Artificial Sequence
  Description of Artificial Sequence: Synthetic oligonucleotide
accctgatcaccctgcctctgcttttcc

SEQ ID NO: 108633 - DNA, 27 bp, Artificial Sequence
  Description of Artificial Sequence: Synthetic oligonucleotide
ccctgatcaccctgcctctgcttttcc

SEQ ID NO: 108634 - DNA, 29 bp, Artificial Sequence
  Description of Artificial Sequence: Synthetic oligonucleotide
cctgatcaccctgcctctgcttttccttc

SEQ ID NO: 108635 - DNA, 30 bp, Artificial Sequence
  Description of Artificial Sequence: Synthetic oligonucleotide
ctgatcaccctgcctctgcttttccttctg

SEQ ID NO: 108636 - DNA, 30 bp, Artificial Sequence
  Description of Artificial Sequence: Synthetic oligonucleotide
tgatcaccctgcctctgcttttccttctgc

SEQ ID NO: 108637 - DNA, 29 bp, Artificial Sequence
  Description of Artificial Sequence: Synthetic oligonucleotide
gatcaccctgcctctgcttttccttctgc

SEQ ID NO: 108638 - DNA, 29 bp, Artificial Sequence
  Description of Artificial Sequence: Synthetic oligonucleotide
atcaccctgcctctgcttttccttctgcc

SEQ ID NO: 108639 - DNA, 28 bp, Artificial Sequence
  Description of Artificial Sequence: Synthetic oligonucleotide
tcaccctgcctctgcttttccttctgcc

SEQ ID NO: 108640 - DNA, 27 bp, Artificial Sequence
  Description of Artificial Sequence: Synthetic oligonucleotide
caccctgcctctgcttttccttctgcc

SEQ ID NO: 108641 - DNA, 27 bp, Artificial Sequence
  Description of Artificial Sequence: Synthetic oligonucleotide
accctgcctctgcttttccttctgccc

SEQ ID NO: 108642 - DNA, 27 bp, Artificial Sequence
  Description of Artificial Sequence: Synthetic oligonucleotide
ccctgcctctgcttttccttctgccca

SEQ ID NO: 108643 - DNA, 28 bp, Artificial Sequence
  Description of Artificial Sequence: Synthetic oligonucleotide
cctgcctctgcttttccttctgcccaag

SEQ ID NO: 108644 - DNA, 30 bp, Artificial Sequence
  Description of Artificial Sequence: Synthetic oligonucleotide
ctgcctctgcttttccttctgcccaagaag

SEQ ID NO: 108645 - DNA, 30 bp, Artificial Sequence
  Description of Artificial Sequence: Synthetic oligonucleotide
tgcctctgcttttccttctgcccaagaagg

SEQ ID NO: 108646 - DNA, 29 bp, Artificial Sequence
  Description of Artificial Sequence: Synthetic oligonucleotide
gcctctgcttttccttctgcccaagaagg

SEQ ID NO: 108647 - DNA, 30 bp, Artificial Sequence
  Description of Artificial Sequence: Synthetic oligonucleotide
cctctgcttttccttctgcccaagaaggtg

SEQ ID NO: 108648 - DNA, 30 bp, Artificial Sequence
  Description of Artificial Sequence: Synthetic oligonucleotide
ctctgcttttccttctgcccaagaaggtgg

SEQ ID NO: 108649 - DNA, 30 bp, Artificial Sequence
  Description of Artificial Sequence: Synthetic oligonucleotide
tctgcttttccttctgcccaagaaggtggg

SEQ ID NO: 108650 - DNA, 29 bp, Artificial Sequence
  Description of Artificial Sequence: Synthetic oligonucleotide
ctgcttttccttctgcccaagaaggtggg

SEQ ID NO: 108651 - DNA, 34 bp, Artificial Sequence
  Description of Artificial Sequence: Synthetic oligonucleotide
tgcttttccttctgcccaagaaggtgggaaaatg

SEQ ID NO: 108652 - DNA, 33 bp, Artificial Sequence
  Description of Artificial Sequence: Synthetic oligonucleotide
gcttttccttctgcccaagaaggtgggaaaatg

SEQ ID NO: 108653 - DNA, 33 bp, Artificial Sequence
  Description of Artificial Sequence: Synthetic oligonucleotide
cttttccttctgcccaagaaggtgggaaaatgg

SEQ ID NO: 108654 - DNA, 35 bp, Artificial Sequence
  Description of Artificial Sequence: Synthetic oligonucleotide
ttttccttctgcccaagaaggtgggaaaatggtac

SEQ ID NO: 108655 - DNA, 34 bp, Artificial Sequence
  Description of Artificial Sequence: Synthetic oligonucleotide
tttccttctgcccaagaaggtgggaaaatggtac

SEQ ID NO: 108656 - DNA, 33 bp, Artificial Sequence
  Description of Artificial Sequence: Synthetic oligonucleotide
ttccttctgcccaagaaggtgggaaaatggtac

SEQ ID NO: 108657 - DNA, 32 bp, Artificial Sequence
  Description of Artificial Sequence: Synthetic oligonucleotide
tccttctgcccaagaaggtgggaaaatggtac

SEQ ID NO: 108658 - DNA, 31 bp, Artificial Sequence
  Description of Artificial Sequence: Synthetic oligonucleotide
ccttctgcccaagaaggtgggaaaatggtac

SEQ ID NO: 108659 - DNA, 31 bp, Artificial Sequence
  Description of Artificial Sequence: Synthetic oligonucleotide
cttctgcccaagaaggtgggaaaatggtacc

SEQ ID NO: 108660 - DNA, 32 bp, Artificial Sequence
  Description of Artificial Sequence: Synthetic oligonucleotide
ttctgcccaagaaggtgggaaaatggtaccag

SEQ ID NO: 108661 - DNA, 31 bp, Artificial Sequence
  Description of Artificial Sequence: Synthetic oligonucleotide
tctgcccaagaaggtgggaaaatggtaccag

SEQ ID NO: 108662 - DNA, 30 bp, Artificial Sequence
  Description of Artificial Sequence: Synthetic oligonucleotide
ctgcccaagaaggtgggaaaatggtaccag

SEQ ID NO: 108663 - DNA, 32 bp, Artificial Sequence
  Description of Artificial Sequence: Synthetic oligonucleotide
tgcccaagaaggtgggaaaatggtaccagttg

SEQ ID NO: 108664 - DNA, 31 bp, Artificial Sequence
  Description of Artificial Sequence: Synthetic oligonucleotide
gcccaagaaggtgggaaaatggtaccagttg

SEQ ID NO: 108665 - DNA, 31 bp, Artificial Sequence
  Description of Artificial Sequence: Synthetic oligonucleotide
cccaagaaggtgggaaaatggtaccagttgc

SEQ ID NO: 108666 - DNA, 32 bp, Artificial Sequence
  Description of Artificial Sequence: Synthetic oligonucleotide
ccaagaaggtgggaaaatggtaccagttgctg

SEQ ID NO: 108667 - DNA, 32 bp, Artificial Sequence
  Description of Artificial Sequence: Synthetic oligonucleotide
caagaaggtgggaaaatggtaccagttgctgg

SEQ ID NO: 108668 - DNA, 34 bp, Artificial Sequence
  Description of Artificial Sequence: Synthetic oligonucleotide
aagaaggtgggaaaatggtaccagttgctggaag

SEQ ID NO: 108669 - DNA, 33 bp, Artificial Sequence
  Description of Artificial Sequence: Synthetic oligonucleotide
agaaggtgggaaaatggtaccagttgctggaag

SEQ ID NO: 108670 - DNA, 32 bp, Artificial Sequence
  Description of Artificial Sequence: Synthetic oligonucleotide
gaaggtgggaaaatggtaccagttgctggaag

SEQ ID NO: 108671 - DNA, 33 bp, Artificial Sequence
  Description of Artificial Sequence: Synthetic oligonucleotide
aaggtgggaaaatggtaccagttgctggaagtg

SEQ ID NO: 108672 - DNA, 32 bp, Artificial Sequence
  Description of Artificial Sequence: Synthetic oligonucleotide
aggtgggaaaatggtaccagttgctggaagtg

SEQ ID NO: 108673 - DNA, 31 bp, Artificial Sequence
  Description of Artificial Sequence: Synthetic oligonucleotide
ggtgggaaaatggtaccagttgctggaagtg

SEQ ID NO: 108674 - DNA, 31 bp, Artificial Sequence
  Description of Artificial Sequence: Synthetic oligonucleotide
gtgggaaaatggtaccagttgctggaagtgc

SEQ ID NO: 108675 - DNA, 32 bp, Artificial Sequence
  Description of Artificial Sequence: Synthetic oligonucleotide
tgggaaaatggtaccagttgctggaagtgcag

SEQ ID NO: 108676 - DNA, 31 bp, Artificial Sequence
  Description of Artificial Sequence: Synthetic oligonucleotide
gggaaaatggtaccagttgctggaagtgcag

SEQ ID NO: 108677 - DNA, 31 bp, Artificial Sequence
  Description of Artificial Sequence: Synthetic oligonucleotide
ggaaaatggtaccagttgctggaagtgcagg

SEQ ID NO: 108678 - DNA, 32 bp, Artificial Sequence
  Description of Artificial Sequence: Synthetic oligonucleotide
gaaaatggtaccagttgctggaagtgcaggtg

SEQ ID NO: 108679 - DNA, 32 bp, Artificial Sequence
  Description of Artificial Sequence: Synthetic oligonucleotide
aaaatggtaccagttgctggaagtgcaggtgc

SEQ ID NO: 108680 - DNA, 31 bp, Artificial Sequence
  Description of Artificial Sequence: Synthetic oligonucleotide
aaatggtaccagttgctggaagtgcaggtgc

SEQ ID NO: 108681 - DNA, 30 bp, Artificial Sequence
  Description of Artificial Sequence: Synthetic oligonucleotide
aatggtaccagttgctggaagtgcaggtgc

SEQ ID NO: 108682 - DNA, 29 bp, Artificial Sequence
  Description of Artificial Sequence: Synthetic oligonucleotide
atggtaccagttgctggaagtgcaggtgc

SEQ ID NO: 108683 - DNA, 28 bp, Artificial Sequence
  Description of Artificial Sequence: Synthetic oligonucleotide
tggtaccagttgctggaagtgcaggtgc

SEQ ID NO: 108684 - DNA, 27 bp, Artificial Sequence
  Description of Artificial Sequence: Synthetic oligonucleotide
ggtaccagttgctggaagtgcaggtgc

SEQ ID NO: 108685 - DNA, 27 bp, Artificial Sequence
  Description of Artificial Sequence: Synthetic oligonucleotide
gtaccagttgctggaagtgcaggtgcg

SEQ ID NO: 108686 - DNA, 27 bp, Artificial Sequence
  Description of Artificial Sequence: Synthetic oligonucleotide
taccagttgctggaagtgcaggtgcgg

SEQ ID NO: 108687 - DNA, 26 bp, Artificial Sequence
  Description of Artificial Sequence: Synthetic oligonucleotide
accagttgctggaagtgcaggtgcgg

SEQ ID NO: 108688 - DNA, 25 bp, Artificial Sequence
  Description of Artificial Sequence: Synthetic oligonucleotide
ccagttgctggaagtgcaggtgcgg

SEQ ID NO: 108689 - DNA, 27 bp, Artificial Sequence
  Description of Artificial Sequence: Synthetic oligonucleotide
cagttgctggaagtgcaggtgcgggaa

SEQ ID NO: 108690 - DNA, 28 bp, Artificial Sequence
  Description of Artificial Sequence: Synthetic oligonucleotide
agttgctggaagtgcaggtgcgggaatc

SEQ ID NO: 108691 - DNA, 27 bp, Artificial Sequence
  Description of Artificial Sequence: Synthetic oligonucleotide
gttgctggaagtgcaggtgcgggaatc

SEQ ID NO: 108692 - DNA, 28 bp, Artificial Sequence
  Description of Artificial Sequence: Synthetic oligonucleotide
ttgctggaagtgcaggtgcgggaatctc

SEQ ID NO: 108693 - DNA, 27 bp, Artificial Sequence
  Description of Artificial Sequence: Synthetic oligonucleotide
tgctggaagtgcaggtgcgggaatctc

SEQ ID NO: 108694 - DNA, 27 bp, Artificial Sequence
  Description of Artificial Sequence: Synthetic oligonucleotide
gctggaagtgcaggtgcgggaatctct

SEQ ID NO: 108695 - DNA, 27 bp, Artificial Sequence
  Description of Artificial Sequence: Synthetic oligonucleotide
ctggaagtgcaggtgcgggaatctctg

SEQ ID NO: 108696 - DNA, 27 bp, Artificial Sequence
  Description of Artificial Sequence: Synthetic oligonucleotide
tggaagtgcaggtgcgggaatctctgg

SEQ ID NO: 108697 - DNA, 26 bp, Artificial Sequence
  Description of Artificial Sequence: Synthetic oligonucleotide
ggaagtgcaggtgcgggaatctctgg

SEQ ID NO: 108698 - DNA, 27 bp, Artificial Sequence
  Description of Artificial Sequence: Synthetic oligonucleotide
gaagtgcaggtgcgggaatctctggca

SEQ ID NO: 108699 - DNA, 29 bp, Artificial Sequence
  Description of Artificial Sequence: Synthetic oligonucleotide
aagtgcaggtgcgggaatctctggcaaag

SEQ ID NO: 108700 - DNA, 28 bp, Artificial Sequence
  Description of Artificial Sequence: Synthetic oligonucleotide
agtgcaggtgcgggaatctctggcaaag

SEQ ID NO: 108701 - DNA, 27 bp, Artificial Sequence
  Description of Artificial Sequence: Synthetic oligonucleotide
gtgcaggtgcgggaatctctggcaaag

SEQ ID NO: 108702 - DNA, 28 bp, Artificial Sequence
  Description of Artificial Sequence: Synthetic oligonucleotide
tgcaggtgcgggaatctctggcaaagtc

SEQ ID NO: 108703 - DNA, 27 bp, Artificial Sequence
  Description of Artificial Sequence: Synthetic oligonucleotide
gcaggtgcgggaatctctggcaaagtc

SEQ ID NO: 108704 - DNA, 27 bp, Artificial Sequence
  Description of Artificial Sequence: Synthetic oligonucleotide
caggtgcgggaatctctggcaaagtcc

SEQ ID NO: 108705 - DNA, 28 bp, Artificial Sequence
  Description of Artificial Sequence: Synthetic oligonucleotide
aggtgcgggaatctctggcaaagtccag

SEQ ID NO: 108706 - DNA, 27 bp, Artificial Sequence
  Description of Artificial Sequence: Synthetic oligonucleotide
ggtgcgggaatctctggcaaagtccag

SEQ ID NO: 108707 - DNA, 27 bp, Artificial Sequence
  Description of Artificial Sequence: Synthetic oligonucleotide
gtgcgggaatctctggcaaagtccagc

SEQ ID NO: 108708 - DNA, 27 bp, Artificial Sequence
  Description of Artificial Sequence: Synthetic oligonucleotide
tgcgggaatctctggcaaagtccagcc

SEQ ID NO: 108709 - DNA, 27 bp, Artificial Sequence
  Description of Artificial Sequence: Synthetic oligonucleotide
gcgggaatctctggcaaagtccagcca

SEQ ID NO: 108710 - DNA, 27 bp, Artificial Sequence
  Description of Artificial Sequence: Synthetic oligonucleotide
cgggaatctctggcaaagtccagccag

SEQ ID NO: 108711 - DNA, 27 bp, Artificial Sequence
  Description of Artificial Sequence: Synthetic oligonucleotide
gggaatctctggcaaagtccagccagg

SEQ ID NO: 108712 - DNA, 28 bp, Artificial Sequence
  Description of Artificial Sequence: Synthetic oligonucleotide
ggaatctctggcaaagtccagccaggtg

SEQ ID NO: 108713 - DNA, 28 bp, Artificial Sequence
  Description of Artificial Sequence: Synthetic oligonucleotide
gaatctctggcaaagtccagccaggtgg

SEQ ID NO: 108714 - DNA, 28 bp, Artificial Sequence
  Description of Artificial Sequence: Synthetic oligonucleotide
aatctctggcaaagtccagccaggtggc

SEQ ID NO: 108715 - DNA, 27 bp, Artificial Sequence
  Description of Artificial Sequence: Synthetic oligonucleotide
atctctggcaaagtccagccaggtggc

SEQ ID NO: 108716 - DNA, 26 bp, Artificial Sequence
  Description of Artificial Sequence: Synthetic oligonucleotide
tctctggcaaagtccagccaggtggc

SEQ ID NO: 108717 - DNA, 25 bp, Artificial Sequence
  Description of Artificial Sequence: Synthetic oligonucleotide
ctctggcaaagtccagccaggtggc

SEQ ID NO: 108718 - DNA, 27 bp, Artificial Sequence
  Description of Artificial Sequence: Synthetic oligonucleotide
tctggcaaagtccagccaggtggccat

SEQ ID NO: 108719 - DNA, 27 bp, Artificial Sequence
  Description of Artificial Sequence: Synthetic oligonucleotide
ctggcaaagtccagccaggtggccatt

SEQ ID NO: 108720 - DNA, 27 bp, Artificial Sequence
  Description of Artificial Sequence: Synthetic oligonucleotide
tggcaaagtccagccaggtggccattg

SEQ ID NO: 108721 - DNA, 27 bp, Artificial Sequence
  Description of Artificial Sequence: Synthetic oligonucleotide
ggcaaagtccagccaggtggccattga

SEQ ID NO: 108722 - DNA, 27 bp, Artificial Sequence
  Description of Artificial Sequence: Synthetic oligonucleotide
gcaaagtccagccaggtggccattgag

SEQ ID NO: 108723 - DNA, 27 bp, Artificial Sequence
  Description of Artificial Sequence: Synthetic oligonucleotide
caaagtccagccaggtggccattgagg

SEQ ID NO: 108724 - DNA, 27 bp, Artificial Sequence
  Description of Artificial Sequence: Synthetic oligonucleotide
aaagtccagccaggtggccattgaggc

SEQ ID NO: 108725 - DNA, 27 bp, Artificial Sequence
  Description of Artificial Sequence: Synthetic oligonucleotide
aagtccagccaggtggccattgaggct

SEQ ID NO: 108726 - DNA, 26 bp, Artificial Sequence
  Description of Artificial Sequence: Synthetic oligonucleotide
agtccagccaggtggccattgaggct

SEQ ID NO: 108727 - DNA, 25 bp, Artificial Sequence
  Description of Artificial Sequence: Synthetic oligonucleotide
gtccagccaggtggccattgaggct

SEQ ID NO: 108728 - DNA, 26 bp, Artificial Sequence
  Description of Artificial Sequence: Synthetic oligonucleotide
tccagccaggtggccattgaggctct

SEQ ID NO: 108729 - DNA, 25 bp, Artificial Sequence
  Description of Artificial Sequence: Synthetic oligonucleotide
ccagccaggtggccattgaggctct

SEQ ID NO: 108730 - DNA, 26 bp, Artificial Sequence
  Description of Artificial Sequence: Synthetic oligonucleotide
cagccaggtggccattgaggctctgt

SEQ ID NO: 108731 - DNA, 26 bp, Artificial Sequence
  Description of Artificial Sequence: Synthetic oligonucleotide
agccaggtggccattgaggctctgtc

SEQ ID NO: 108732 - DNA, 25 bp, Artificial Sequence
  Description of Artificial Sequence: Synthetic oligonucleotide
gccaggtggccattgaggctctgtc

SEQ ID NO: 108733 - DNA, 25 bp, Artificial Sequence
  Description of Artificial Sequence: Synthetic oligonucleotide
ccaggtggccattgaggctctgtcg

SEQ ID NO: 108734 - DNA, 25 bp, Artificial Sequence
  Description of Artificial Sequence: Synthetic oligonucleotide
caggtggccattgaggctctgtcgg

SEQ ID NO: 108735 - DNA, 25 bp, Artificial Sequence
  Description of Artificial Sequence: Synthetic oligonucleotide
aggtggccattgaggctctgtcggc

SEQ ID NO: 108736 - DNA, 24 bp, Artificial Sequence
  Description of Artificial Sequence: Synthetic oligonucleotide
ggtggccattgaggctctgtcggc

SEQ ID NO: 108737 - DNA, 26 bp, Artificial Sequence
  Description of Artificial Sequence: Synthetic oligonucleotide
gtggccattgaggctctgtcggccat

SEQ ID NO: 108738 - DNA, 26 bp, Artificial Sequence
  Description of Artificial Sequence: Synthetic oligonucleotide
tggccattgaggctctgtcggccatg

SEQ ID NO: 108739 - DNA, 25 bp, Artificial Sequence
  Description of Artificial Sequence: Synthetic oligonucleotide
ggccattgaggctctgtcggccatg

SEQ ID NO: 108740 - DNA, 25 bp, Artificial Sequence
  Description of Artificial Sequence: Synthetic oligonucleotide
gccattgaggctctgtcggccatgc

SEQ ID NO: 108741 - DNA, 27 bp, Artificial Sequence
  Description of Artificial Sequence: Synthetic oligonucleotide
ccattgaggctctgtcggccatgccta

SEQ ID NO: 108742 - DNA, 27 bp, Artificial Sequence
  Description of Artificial Sequence: Synthetic oligonucleotide
cattgaggctctgtcggccatgcctac

SEQ ID NO: 108743 - DNA, 28 bp, Artificial Sequence
  Description of Artificial Sequence: Synthetic oligonucleotide
attgaggctctgtcggccatgcctacag

SEQ ID NO: 108744 - DNA, 27 bp, Artificial Sequence
  Description of Artificial Sequence: Synthetic oligonucleotide
ttgaggctctgtcggccatgcctacag

SEQ ID NO: 108745 - DNA, 27 bp, Artificial Sequence
  Description of Artificial Sequence: Synthetic oligonucleotide
tgaggctctgtcggccatgcctacagt

SEQ ID NO: 108746 - DNA, 27 bp, Artificial Sequence
  Description of Artificial Sequence: Synthetic oligonucleotide
gaggctctgtcggccatgcctacagtt

SEQ ID NO: 108747 - DNA, 27 bp, Artificial Sequence
  Description of Artificial Sequence: Synthetic oligonucleotide
aggctctgtcggccatgcctacagttc

SEQ ID NO: 108748 - DNA, 26 bp, Artificial Sequence
  Description of Artificial Sequence: Synthetic oligonucleotide
ggctctgtcggccatgcctacagttc

SEQ ID NO: 108749 - DNA, 27 bp, Artificial Sequence
  Description of Artificial Sequence: Synthetic oligonucleotide
gctctgtcggccatgcctacagttcga

SEQ ID NO: 108750 - DNA, 28 bp, Artificial Sequence
  Description of Artificial Sequence: Synthetic oligonucleotide
ctctgtcggccatgcctacagttcgaag

SEQ ID NO: 108751 - DNA, 28 bp, Artificial Sequence
  Description of Artificial Sequence: Synthetic oligonucleotide
tctgtcggccatgcctacagttcgaagc

SEQ ID NO: 108752 - DNA, 27 bp, Artificial Sequence
  Description of Artificial Sequence: Synthetic oligonucleotide
ctgtcggccatgcctacagttcgaagc

SEQ ID NO: 108753 - DNA, 30 bp, Artificial Sequence
  Description of Artificial Sequence: Synthetic oligonucleotide
tgtcggccatgcctacagttcgaagctttg

SEQ ID NO: 108754 - DNA, 29 bp, Artificial Sequence
  Description of Artificial Sequence: Synthetic oligonucleotide
gtcggccatgcctacagttcgaagctttg

SEQ ID NO: 108755 - DNA, 29 bp, Artificial Sequence
  Description of Artificial Sequence: Synthetic oligonucleotide
tcggccatgcctacagttcgaagctttgc

SEQ ID NO: 108756 - DNA, 28 bp, Artificial Sequence
  Description of Artificial Sequence: Synthetic oligonucleotide
cggccatgcctacagttcgaagctttgc

SEQ ID NO: 108757 - DNA, 28 bp, Artificial Sequence
  Description of Artificial Sequence: Synthetic oligonucleotide
ggccatgcctacagttcgaagctttgcc

SEQ ID NO: 108758 - DNA, 30 bp, Artificial Sequence
  Description of Artificial Sequence: Synthetic oligonucleotide
gccatgcctacagttcgaagctttgccaac

SEQ ID NO: 108759 - DNA, 30 bp, Artificial Sequence
  Description of Artificial Sequence: Synthetic oligonucleotide
ccatgcctacagttcgaagctttgccaacg

SEQ ID NO: 108760 - DNA, 31 bp, Artificial Sequence
  Description of Artificial Sequence: Synthetic oligonucleotide
catgcctacagttcgaagctttgccaacgag

SEQ ID NO: 108761 - DNA, 31 bp, Artificial Sequence
  Description of Artificial Sequence: Synthetic oligonucleotide
atgcctacagttcgaagctttgccaacgagg

SEQ ID NO: 108762 - DNA, 30 bp, Artificial Sequence
  Description of Artificial Sequence: Synthetic oligonucleotide
tgcctacagttcgaagctttgccaacgagg

SEQ ID NO: 108763 - DNA, 29 bp, Artificial Sequence
  Description of Artificial Sequence: Synthetic oligonucleotide
gcctacagttcgaagctttgccaacgagg

SEQ ID NO: 108764 - DNA, 30 bp, Artificial Sequence
  Description of Artificial Sequence: Synthetic oligonucleotide
cctacagttcgaagctttgccaacgaggag

SEQ ID NO: 108765 - DNA, 30 bp, Artificial Sequence
  Description of Artificial Sequence: Synthetic oligonucleotide
ctacagttcgaagctttgccaacgaggagg

SEQ ID NO: 108766 - DNA, 30 bp, Artificial Sequence
  Description of Artificial Sequence: Synthetic oligonucleotide
tacagttcgaagctttgccaacgaggaggg

SEQ ID NO: 108767 - DNA, 29 bp, Artificial Sequence
  Description of Artificial Sequence: Synthetic oligonucleotide
acagttcgaagctttgccaacgaggaggg

SEQ ID NO: 108768 - DNA, 28 bp, Artificial Sequence
  Description of Artificial Sequence: Synthetic oligonucleotide
cagttcgaagctttgccaacgaggaggg

SEQ ID NO: 108769 - DNA, 28 bp, Artificial Sequence
  Description of Artificial Sequence: Synthetic oligonucleotide
agttcgaagctttgccaacgaggagggc

SEQ ID NO: 108770 - DNA, 27 bp, Artificial Sequence
  Description of Artificial Sequence: Synthetic oligonucleotide
gttcgaagctttgccaacgaggagggc

SEQ ID NO: 108771 - DNA, 27 bp, Artificial Sequence
  Description of Artificial Sequence: Synthetic oligonucleotide
ttcgaagctttgccaacgaggagggcg

SEQ ID NO: 108772 - DNA, 27 bp, Artificial Sequence
  Description of Artificial Sequence: Synthetic oligonucleotide
tcgaagctttgccaacgaggagggcga

SEQ ID NO: 108773 - DNA, 27 bp, Artificial Sequence
  Description of Artificial Sequence: Synthetic oligonucleotide
cgaagctttgccaacgaggagggcgaa

SEQ ID NO: 108774 - DNA, 27 bp, Artificial Sequence
  Description of Artificial Sequence: Synthetic oligonucleotide
gaagctttgccaacgaggagggcgaag

SEQ ID NO: 108775 - DNA, 27 bp, Artificial Sequence
  Description of Artificial Sequence: Synthetic oligonucleotide
aagctttgccaacgaggagggcgaagc

SEQ ID NO: 108776 - DNA, 26 bp, Artificial Sequence
  Description of Artificial Sequence: Synthetic oligonucleotide
agctttgccaacgaggagggcgaagc

SEQ ID NO: 108777 - DNA, 25 bp, Artificial Sequence
  Description of Artificial Sequence: Synthetic oligonucleotide
gctttgccaacgaggagggcgaagc

SEQ ID NO: 108778 - DNA, 25 bp, Artificial Sequence
  Description of Artificial Sequence: Synthetic oligonucleotide
ctttgccaacgaggagggcgaagcc

SEQ ID NO: 108779 - DNA, 26 bp, Artificial Sequence
  Description of Artificial Sequence: Synthetic oligonucleotide
tttgccaacgaggagggcgaagccca

SEQ ID NO: 108780 - DNA, 25 bp, Artificial Sequence
  Description of Artificial Sequence: Synthetic oligonucleotide
ttgccaacgaggagggcgaagccca

SEQ ID NO: 108781 - DNA, 24 bp, Artificial Sequence
  Description of Artificial Sequence: Synthetic oligonucleotide
tgccaacgaggagggcgaagccca

SEQ ID NO: 108782 - DNA, 23 bp, Artificial Sequence
  Description of Artificial Sequence: Synthetic oligonucleotide
gccaacgaggagggcgaagccca

SEQ ID NO: 108783 - DNA, 25 bp, Artificial Sequence
  Description of Artificial Sequence: Synthetic oligonucleotide
ccaacgaggagggcgaagcccagaa

SEQ ID NO: 108784 - DNA, 27 bp, Artificial Sequence
  Description of Artificial Sequence: Synthetic oligonucleotide
caacgaggagggcgaagcccagaagtt

SEQ ID NO: 108785 - DNA, 29 bp, Artificial Sequence
  Description of Artificial Sequence: Synthetic oligonucleotide
aacgaggagggcgaagcccagaagtttag

SEQ ID NO: 108786 - DNA, 28 bp, Artificial Sequence
  Description of Artificial Sequence: Synthetic oligonucleotide
acgaggagggcgaagcccagaagtttag

SEQ ID NO: 108787 - DNA, 27 bp, Artificial Sequence
  Description of Artificial Sequence: Synthetic oligonucleotide
cgaggagggcgaagcccagaagtttag

SEQ ID NO: 108788 - DNA, 27 bp, Artificial Sequence
  Description of Artificial Sequence: Synthetic oligonucleotide
gaggagggcgaagcccagaagtttagg

SEQ ID NO: 108789 - DNA, 27 bp, Artificial Sequence
  Description of Artificial Sequence: Synthetic oligonucleotide
aggagggcgaagcccagaagtttaggg

SEQ ID NO: 108790 - DNA, 27 bp, Artificial Sequence
  Description of Artificial Sequence: Synthetic oligonucleotide
ggagggcgaagcccagaagtttaggga

SEQ ID NO: 108791 - DNA, 30 bp, Artificial Sequence
  Description of Artificial Sequence: Synthetic oligonucleotide
gagggcgaagcccagaagtttagggaaaag

SEQ ID NO: 108792 - DNA, 30 bp, Artificial Sequence
  Description of Artificial Sequence: Synthetic oligonucleotide
agggcgaagcccagaagtttagggaaaagc

SEQ ID NO: 108793 - DNA, 29 bp, Artificial Sequence
  Description of Artificial Sequence: Synthetic oligonucleotide
gggcgaagcccagaagtttagggaaaagc

SEQ ID NO: 108794 - DNA, 30 bp, Artificial Sequence
  Description of Artificial Sequence: Synthetic oligonucleotide
ggcgaagcccagaagtttagggaaaagctg

SEQ ID NO: 108795 - DNA, 30 bp, Artificial Sequence
  Description of Artificial Sequence: Synthetic oligonucleotide
gcgaagcccagaagtttagggaaaagctgc

SEQ ID NO: 108796 - DNA, 32 bp, Artificial Sequence
  Description of Artificial Sequence: Synthetic oligonucleotide
cgaagcccagaagtttagggaaaagctgcaag

SEQ ID NO: 108797 - DNA, 39 bp, Artificial Sequence
  Description of Artificial Sequence: Synthetic oligonucleotide
gaagcccagaagtttagggaaaagctgcaagaaataaag

SEQ ID NO: 108798 - DNA, 40 bp, Artificial Sequence
  Description of Artificial Sequence: Synthetic oligonucleotide
aagcccagaagtttagggaaaagctgcaagaaataaagac

SEQ ID NO: 108799 - DNA, 39 bp, Artificial Sequence
  Description of Artificial Sequence: Synthetic oligonucleotide
agcccagaagtttagggaaaagctgcaagaaataaagac

SEQ ID NO: 108800 - DNA, 38 bp, Artificial Sequence
  Description of Artificial Sequence: Synthetic oligonucleotide
gcccagaagtttagggaaaagctgcaagaaataaagac

SEQ ID NO: 108801 - DNA, 39 bp, Artificial Sequence
  Description of Artificial Sequence: Synthetic oligonucleotide
cccagaagtttagggaaaagctgcaagaaataaagacac

SEQ ID NO: 108802 - DNA, 40 bp, Artificial Sequence
  Description of Artificial Sequence: Synthetic oligonucleotide
ccagaagtttagggaaaagctgcaagaaataaagacactc

SEQ ID NO: 108803 - DNA, 42 bp, Artificial Sequence
  Description of Artificial Sequence: Synthetic oligonucleotide
cagaagtttagggaaaagctgcaagaaataaagacactcaac

SEQ ID NO: 108804 - DNA, 42 bp, Artificial Sequence
  Description of Artificial Sequence: Synthetic oligonucleotide
agaagtttagggaaaagctgcaagaaataaagacactcaacc

SEQ ID NO: 108805 - DNA, 41 bp, Artificial Sequence
  Description of Artificial Sequence: Synthetic oligonucleotide
gaagtttagggaaaagctgcaagaaataaagacactcaacc

SEQ ID NO: 108806 - DNA, 42 bp, Artificial Sequence
  Description of Artificial Sequence: Synthetic oligonucleotide
aagtttagggaaaagctgcaagaaataaagacactcaaccag

SEQ ID NO: 108807 - DNA, 41 bp, Artificial Sequence
  Description of Artificial Sequence: Synthetic oligonucleotide
agtttagggaaaagctgcaagaaataaagacactcaaccag

SEQ ID NO: 108808 - DNA, 40 bp, Artificial Sequence
  Description of Artificial Sequence: Synthetic oligonucleotide
gtttagggaaaagctgcaagaaataaagacactcaaccag

SEQ ID NO: 108809 - DNA, 42 bp, Artificial Sequence
  Description of Artificial Sequence: Synthetic oligonucleotide
tttagggaaaagctgcaagaaataaagacactcaaccagaag

SEQ ID NO: 108810 - DNA, 41 bp, Artificial Sequence
  Description of Artificial Sequence: Synthetic oligonucleotide
ttagggaaaagctgcaagaaataaagacactcaaccagaag

SEQ ID NO: 108811 - DNA, 40 bp, Artificial Sequence
  Description of Artificial Sequence: Synthetic oligonucleotide
tagggaaaagctgcaagaaataaagacactcaaccagaag

SEQ ID NO: 108812 - DNA, 39 bp, Artificial Sequence
  Description of Artificial Sequence: Synthetic oligonucleotide
agggaaaagctgcaagaaataaagacactcaaccagaag

SEQ ID NO: 108813 - DNA, 38 bp, Artificial Sequence
  Description of Artificial Sequence: Synthetic oligonucleotide
gggaaaagctgcaagaaataaagacactcaaccagaag

SEQ ID NO: 108814 - DNA, 38 bp, Artificial Sequence
  Description of Artificial Sequence: Synthetic oligonucleotide
ggaaaagctgcaagaaataaagacactcaaccagaagg

SEQ ID NO: 108815 - DNA, 39 bp, Artificial Sequence
  Description of Artificial Sequence: Synthetic oligonucleotide
gaaaagctgcaagaaataaagacactcaaccagaaggag

SEQ ID NO: 108816 - DNA, 39 bp, Artificial Sequence
  Description of Artificial Sequence: Synthetic oligonucleotide
aaaagctgcaagaaataaagacactcaaccagaaggagg

SEQ ID NO: 108817 - DNA, 38 bp, Artificial Sequence
  Description of Artificial Sequence: Synthetic oligonucleotide
aaagctgcaagaaataaagacactcaaccagaaggagg

SEQ ID NO: 108818 - DNA, 37 bp, Artificial Sequence
  Description of Artificial Sequence: Synthetic oligonucleotide
aagctgcaagaaataaagacactcaaccagaaggagg

SEQ ID NO: 108819 - DNA, 36 bp, Artificial Sequence
  Description of Artificial Sequence: Synthetic oligonucleotide
agctgcaagaaataaagacactcaaccagaaggagg

SEQ ID NO: 108820 - DNA, 35 bp, Artificial Sequence
  Description of Artificial Sequence: Synthetic oligonucleotide
gctgcaagaaataaagacactcaaccagaaggagg

SEQ ID NO: 108821 - DNA, 35 bp, Artificial Sequence
  Description of Artificial Sequence: Synthetic oligonucleotide
ctgcaagaaataaagacactcaaccagaaggaggc

SEQ ID NO: 108822 - DNA, 36 bp, Artificial Sequence
  Description of Artificial Sequence: Synthetic oligonucleotide
tgcaagaaataaagacactcaaccagaaggaggctg

SEQ ID NO: 108823 - DNA, 35 bp, Artificial Sequence
  Description of Artificial Sequence: Synthetic oligonucleotide
gcaagaaataaagacactcaaccagaaggaggctg

SEQ ID NO: 108824 - DNA, 36 bp, Artificial Sequence
  Description of Artificial Sequence: Synthetic oligonucleotide
caagaaataaagacactcaaccagaaggaggctgtg

SEQ ID NO: 108825 - DNA, 36 bp, Artificial Sequence
  Description of Artificial Sequence: Synthetic oligonucleotide
aagaaataaagacactcaaccagaaggaggctgtgg

SEQ ID NO: 108826 - DNA, 35 bp, Artificial Sequence
  Description of Artificial Sequence: Synthetic oligonucleotide
agaaataaagacactcaaccagaaggaggctgtgg

SEQ ID NO: 108827 - DNA, 34 bp, Artificial Sequence
  Description of Artificial Sequence: Synthetic oligonucleotide
gaaataaagacactcaaccagaaggaggctgtgg

SEQ ID NO: 108828 - DNA, 34 bp, Artificial Sequence
  Description of Artificial Sequence: Synthetic oligonucleotide
aaataaagacactcaaccagaaggaggctgtggc

SEQ ID NO: 108829 - DNA, 33 bp, Artificial Sequence
  Description of Artificial Sequence: Synthetic oligonucleotide
aataaagacactcaaccagaaggaggctgtggc

SEQ ID NO: 108830 - DNA, 32 bp, Artificial Sequence
  Description of Artificial Sequence: Synthetic oligonucleotide
ataaagacactcaaccagaaggaggctgtggc

SEQ ID NO: 108831 - DNA, 31 bp, Artificial Sequence
  Description of Artificial Sequence: Synthetic oligonucleotide
taaagacactcaaccagaaggaggctgtggc

SEQ ID NO: 108832 - DNA, 30 bp, Artificial Sequence
  Description of Artificial Sequence: Synthetic oligonucleotide
aaagacactcaaccagaaggaggctgtggc

SEQ ID NO: 108833 - DNA, 29 bp, Artificial Sequence
  Description of Artificial Sequence: Synthetic oligonucleotide
aagacactcaaccagaaggaggctgtggc

SEQ ID NO: 108834 - DNA, 28 bp, Artificial Sequence
  Description of Artificial Sequence: Synthetic oligonucleotide
agacactcaaccagaaggaggctgtggc

SEQ ID NO: 108835 - DNA, 27 bp, Artificial Sequence
  Description of Artificial Sequence: Synthetic oligonucleotide
gacactcaaccagaaggaggctgtggc

SEQ ID NO: 108836 - DNA, 27 bp, Artificial Sequence
  Description of Artificial Sequence: Synthetic oligonucleotide
acactcaaccagaaggaggctgtggcc

SEQ ID NO: 108837 - DNA, 27 bp, Artificial Sequence
  Description of Artificial Sequence: Synthetic oligonucleotide
cactcaaccagaaggaggctgtggcct

SEQ ID NO: 108838 - DNA, 29 bp, Artificial Sequence
  Description of Artificial Sequence: Synthetic oligonucleotide
actcaaccagaaggaggctgtggcctatg

SEQ ID NO: 108839 - DNA, 28 bp, Artificial Sequence
  Description of Artificial Sequence: Synthetic oligonucleotide
ctcaaccagaaggaggctgtggcctatg

SEQ ID NO: 108840 - DNA, 28 bp, Artificial Sequence
  Description of Artificial Sequence: Synthetic oligonucleotide
tcaaccagaaggaggctgtggcctatgc

SEQ ID NO: 108841 - DNA, 27 bp, Artificial Sequence
  Description of Artificial Sequence: Synthetic oligonucleotide
caaccagaaggaggctgtggcctatgc

SEQ ID NO: 108842 - DNA, 28 bp, Artificial Sequence
  Description of Artificial Sequence: Synthetic oligonucleotide
aaccagaaggaggctgtggcctatgcag

SEQ ID NO: 108843 - DNA, 27 bp, Artificial Sequence
  Description of Artificial Sequence: Synthetic oligonucleotide
accagaaggaggctgtggcctatgcag

SEQ ID NO: 108844 - DNA, 27 bp, Artificial Sequence
  Description of Artificial Sequence: Synthetic oligonucleotide
ccagaaggaggctgtggcctatgcagt

SEQ ID NO: 108845 - DNA, 27 bp, Artificial Sequence
  Description of Artificial Sequence: Synthetic oligonucleotide
cagaaggaggctgtggcctatgcagtc

SEQ ID NO: 108846 - DNA, 29 bp, Artificial Sequence
  Description of Artificial Sequence: Synthetic oligonucleotide
agaaggaggctgtggcctatgcagtcaac

SEQ ID NO: 108847 - DNA, 28 bp, Artificial Sequence
  Description of Artificial Sequence: Synthetic oligonucleotide
gaaggaggctgtggcctatgcagtcaac

SEQ ID NO: 108848 - DNA, 29 bp, Artificial Sequence
  Description of Artificial Sequence: Synthetic oligonucleotide
aaggaggctgtggcctatgcagtcaactc

SEQ ID NO: 108849 - DNA, 28 bp, Artificial Sequence
  Description of Artificial Sequence: Synthetic oligonucleotide
aggaggctgtggcctatgcagtcaactc

SEQ ID NO: 108850 - DNA, 27 bp, Artificial Sequence
  Description of Artificial Sequence: Synthetic oligonucleotide
ggaggctgtggcctatgcagtcaactc

SEQ ID NO: 108851 - DNA, 27 bp, Artificial Sequence
  Description of Artificial Sequence: Synthetic oligonucleotide
gaggctgtggcctatgcagtcaactcc

SEQ ID NO: 108852 - DNA, 28 bp, Artificial Sequence
  Description of Artificial Sequence: Synthetic oligonucleotide
aggctgtggcctatgcagtcaactcctg

SEQ ID NO: 108853 - DNA, 27 bp, Artificial Sequence
  Description of Artificial Sequence: Synthetic oligonucleotide
ggctgtggcctatgcagtcaactcctg

SEQ ID NO: 108854 - DNA, 27 bp, Artificial Sequence
  Description of Artificial Sequence: Synthetic oligonucleotide
gctgtggcctatgcagtcaactcctgg

SEQ ID NO: 108855 - DNA, 28 bp, Artificial Sequence
  Description of Artificial Sequence: Synthetic oligonucleotide
ctgtggcctatgcagtcaactcctggac

SEQ ID NO: 108856 - DNA, 28 bp, Artificial Sequence
  Description of Artificial Sequence: Synthetic oligonucleotide
tgtggcctatgcagtcaactcctggacc

SEQ ID NO: 108857 - DNA, 27 bp, Artificial Sequence
  Description of Artificial Sequence: Synthetic oligonucleotide
gtggcctatgcagtcaactcctggacc

SEQ ID NO: 108858 - DNA, 28 bp, Artificial Sequence
  Description of Artificial Sequence: Synthetic oligonucleotide
tggcctatgcagtcaactcctggaccac

SEQ ID NO: 108859 - DNA, 27 bp, Artificial Sequence
  Description of Artificial Sequence: Synthetic oligonucleotide
ggcctatgcagtcaactcctggaccac

SEQ ID NO: 108860 - DNA, 29 bp, Artificial Sequence
  Description of Artificial Sequence: Synthetic oligonucleotide
gcctatgcagtcaactcctggaccactag

SEQ ID NO: 108861 - DNA, 34 bp, Artificial Sequence
  Description of Artificial Sequence: Synthetic oligonucleotide
cctatgcagtcaactcctggaccactagtatttc

SEQ ID NO: 108862 - DNA, 35 bp, Artificial Sequence
  Description of Artificial Sequence: Synthetic oligonucleotide
ctatgcagtcaactcctggaccactagtatttcag

SEQ ID NO: 108863 - DNA, 35 bp, Artificial Sequence
  Description of Artificial Sequence: Synthetic oligonucleotide
tatgcagtcaactcctggaccactagtatttcagg

SEQ ID NO: 108864 - DNA, 34 bp, Artificial Sequence
  Description of Artificial Sequence: Synthetic oligonucleotide
atgcagtcaactcctggaccactagtatttcagg

SEQ ID NO: 108865 - DNA, 33 bp, Artificial Sequence
  Description of Artificial Sequence: Synthetic oligonucleotide
tgcagtcaactcctggaccactagtatttcagg

SEQ ID NO: 108866 - DNA, 32 bp, Artificial Sequence
  Description of Artificial Sequence: Synthetic oligonucleotide
gcagtcaactcctggaccactagtatttcagg

SEQ ID NO: 108867 - DNA, 35 bp, Artificial Sequence
  Description of Artificial Sequence: Synthetic oligonucleotide
cagtcaactcctggaccactagtatttcaggtatg

SEQ ID NO: 108868 - DNA, 35 bp, Artificial Sequence
  Description of Artificial Sequence: Synthetic oligonucleotide
agtcaactcctggaccactagtatttcaggtatgc

SEQ ID NO: 108869 - DNA, 34 bp, Artificial Sequence
  Description of Artificial Sequence: Synthetic oligonucleotide
gtcaactcctggaccactagtatttcaggtatgc

SEQ ID NO: 108870 - DNA, 35 bp, Artificial Sequence
  Description of Artificial Sequence: Synthetic oligonucleotide
tcaactcctggaccactagtatttcaggtatgctg

SEQ ID NO: 108871 - DNA, 34 bp, Artificial Sequence
  Description of Artificial Sequence: Synthetic oligonucleotide
caactcctggaccactagtatttcaggtatgctg

SEQ ID NO: 108872 - DNA, 34 bp, Artificial Sequence
  Description of Artificial Sequence: Synthetic oligonucleotide
aactcctggaccactagtatttcaggtatgctgc

SEQ ID NO: 108873 - DNA, 33 bp, Artificial Sequence
  Description of Artificial Sequence: Synthetic oligonucleotide
actcctggaccactagtatttcaggtatgctgc

SEQ ID NO: 108874 - DNA, 32 bp, Artificial Sequence
  Description of Artificial Sequence: Synthetic oligonucleotide
ctcctggaccactagtatttcaggtatgctgc

SEQ ID NO: 108875 - DNA, 33 bp, Artificial Sequence
  Description of Artificial Sequence: Synthetic oligonucleotide
tcctggaccactagtatttcaggtatgctgctg

SEQ ID NO: 108876 - DNA, 32 bp, Artificial Sequence
  Description of Artificial Sequence: Synthetic oligonucleotide
cctggaccactagtatttcaggtatgctgctg

SEQ ID NO: 108877 - DNA, 35 bp, Artificial Sequence
  Description of Artificial Sequence: Synthetic oligonucleotide
ctggaccactagtatttcaggtatgctgctgaaag

SEQ ID NO: 108878 - DNA, 36 bp, Artificial Sequence
  Description of Artificial Sequence: Synthetic oligonucleotide
tggaccactagtatttcaggtatgctgctgaaagtg

SEQ ID NO: 108879 - DNA, 35 bp, Artificial Sequence
  Description of Artificial Sequence: Synthetic oligonucleotide
ggaccactagtatttcaggtatgctgctgaaagtg

SEQ ID NO: 108880 - DNA, 35 bp, Artificial Sequence
  Description of Artificial Sequence: Synthetic oligonucleotide
gaccactagtatttcaggtatgctgctgaaagtgg

SEQ ID NO: 108881 - DNA, 35 bp, Artificial Sequence
  Description of Artificial Sequence: Synthetic oligonucleotide
accactagtatttcaggtatgctgctgaaagtggg

SEQ ID NO: 108882 - DNA, 34 bp, Artificial Sequence
  Description of Artificial Sequence: Synthetic oligonucleotide
ccactagtatttcaggtatgctgctgaaagtggg

SEQ ID NO: 108883 - DNA, 37 bp, Artificial Sequence
  Description of Artificial Sequence: Synthetic oligonucleotide
cactagtatttcaggtatgctgctgaaagtgggaatc

SEQ ID NO: 108884 - DNA, 37 bp, Artificial Sequence
  Description of Artificial Sequence: Synthetic oligonucleotide
actagtatttcaggtatgctgctgaaagtgggaatcc

SEQ ID NO: 108885 - DNA, 36 bp, Artificial Sequence
  Description of Artificial Sequence: Synthetic oligonucleotide
ctagtatttcaggtatgctgctgaaagtgggaatcc

SEQ ID NO: 108886 - DNA, 37 bp, Artificial Sequence
  Description of Artificial Sequence: Synthetic oligonucleotide
tagtatttcaggtatgctgctgaaagtgggaatcctc

SEQ ID NO: 108887 - DNA, 36 bp, Artificial Sequence
  Description of Artificial Sequence: Synthetic oligonucleotide
agtatttcaggtatgctgctgaaagtgggaatcctc

SEQ ID NO: 108888 - DNA, 35 bp, Artificial Sequence
  Description of Artificial Sequence: Synthetic oligonucleotide
gtatttcaggtatgctgctgaaagtgggaatcctc

SEQ ID NO: 108889 - DNA, 37 bp, Artificial Sequence
  Description of Artificial Sequence: Synthetic oligonucleotide
tatttcaggtatgctgctgaaagtgggaatcctctac

SEQ ID NO: 108890 - DNA, 36 bp, Artificial Sequence
  Description of Artificial Sequence: Synthetic oligonucleotide
atttcaggtatgctgctgaaagtgggaatcctctac

SEQ ID NO: 108891 - DNA, 35 bp, Artificial Sequence
  Description of Artificial Sequence: Synthetic oligonucleotide
tttcaggtatgctgctgaaagtgggaatcctctac

SEQ ID NO: 108892 - DNA, 34 bp, Artificial Sequence
  Description of Artificial Sequence: Synthetic oligonucleotide
ttcaggtatgctgctgaaagtgggaatcctctac

SEQ ID NO: 108893 - DNA, 33 bp, Artificial Sequence
  Description of Artificial Sequence: Synthetic oligonucleotide
tcaggtatgctgctgaaagtgggaatcctctac

SEQ ID NO: 108894 - DNA, 32 bp, Artificial Sequence
  Description of Artificial Sequence: Synthetic oligonucleotide
caggtatgctgctgaaagtgggaatcctctac

SEQ ID NO: 108895 - DNA, 35 bp, Artificial Sequence
  Description of Artificial Sequence: Synthetic oligonucleotide
aggtatgctgctgaaagtgggaatcctctacattg

SEQ ID NO: 108896 - DNA, 34 bp, Artificial Sequence
  Description of Artificial Sequence: Synthetic oligonucleotide
ggtatgctgctgaaagtgggaatcctctacattg

SEQ ID NO: 108897 - DNA, 34 bp, Artificial Sequence
  Description of Artificial Sequence: Synthetic oligonucleotide
gtatgctgctgaaagtgggaatcctctacattgg

SEQ ID NO: 108898 - DNA, 35 bp, Artificial Sequence
  Description of Artificial Sequence: Synthetic oligonucleotide
tatgctgctgaaagtgggaatcctctacattggtg

SEQ ID NO: 108899 - DNA, 34 bp, Artificial Sequence
  Description of Artificial Sequence: Synthetic oligonucleotide
atgctgctgaaagtgggaatcctctacattggtg

SEQ ID NO: 108900 - DNA, 33 bp, Artificial Sequence
  Description of Artificial Sequence: Synthetic oligonucleotide
tgctgctgaaagtgggaatcctctacattggtg

SEQ ID NO: 108901 - DNA, 32 bp, Artificial Sequence
  Description of Artificial Sequence: Synthetic oligonucleotide
gctgctgaaagtgggaatcctctacattggtg

SEQ ID NO: 108902 - DNA, 32 bp, Artificial Sequence
  Description of Artificial Sequence: Synthetic oligonucleotide
ctgctgaaagtgggaatcctctacattggtgg

SEQ ID NO: 108903 - DNA, 32 bp, Artificial Sequence
  Description of Artificial Sequence: Synthetic oligonucleotide
tgctgaaagtgggaatcctctacattggtggg

SEQ ID NO: 108904 - DNA, 31 bp, Artificial Sequence
  Description of Artificial Sequence: Synthetic oligonucleotide
gctgaaagtgggaatcctctacattggtggg

SEQ ID NO: 108905 - DNA, 31 bp, Artificial Sequence
  Description of Artificial Sequence: Synthetic oligonucleotide
ctgaaagtgggaatcctctacattggtgggc

SEQ ID NO: 108906 - DNA, 32 bp, Artificial Sequence
  Description of Artificial Sequence: Synthetic oligonucleotide
tgaaagtgggaatcctctacattggtgggcag

SEQ ID NO: 108907 - DNA, 31 bp, Artificial Sequence
  Description of Artificial Sequence: Synthetic oligonucleotide
gaaagtgggaatcctctacattggtgggcag

SEQ ID NO: 108908 - DNA, 31 bp, Artificial Sequence
  Description of Artificial Sequence: Synthetic oligonucleotide
aaagtgggaatcctctacattggtgggcagc

SEQ ID NO: 108909 - DNA, 30 bp, Artificial Sequence
  Description of Artificial Sequence: Synthetic oligonucleotide
aagtgggaatcctctacattggtgggcagc

SEQ ID NO: 108910 - DNA, 29 bp, Artificial Sequence
  Description of Artificial Sequence: Synthetic oligonucleotide
agtgggaatcctctacattggtgggcagc

SEQ ID NO: 108911 - DNA, 28 bp, Artificial Sequence
  Description of Artificial Sequence: Synthetic oligonucleotide
gtgggaatcctctacattggtgggcagc

SEQ ID NO: 108912 - DNA, 29 bp, Artificial Sequence
  Description of Artificial Sequence: Synthetic oligonucleotide
tgggaatcctctacattggtgggcagctg

SEQ ID NO: 108913 - DNA, 28 bp, Artificial Sequence
  Description of Artificial Sequence: Synthetic oligonucleotide
gggaatcctctacattggtgggcagctg

SEQ ID NO: 108914 - DNA, 28 bp, Artificial Sequence
  Description of Artificial Sequence: Synthetic oligonucleotide
ggaatcctctacattggtgggcagctgg

SEQ ID NO: 108915 - DNA, 29 bp, Artificial Sequence
  Description of Artificial Sequence: Synthetic oligonucleotide
gaatcctctacattggtgggcagctggtg

SEQ ID NO: 108916 - DNA, 30 bp, Artificial Sequence
  Description of Artificial Sequence: Synthetic oligonucleotide
aatcctctacattggtgggcagctggtgac

SEQ ID NO: 108917 - DNA, 29 bp, Artificial Sequence
  Description of Artificial Sequence: Synthetic oligonucleotide
atcctctacattggtgggcagctggtgac

SEQ ID NO: 108918 - DNA, 28 bp, Artificial Sequence
  Description of Artificial Sequence: Synthetic oligonucleotide
tcctctacattggtgggcagctggtgac

SEQ ID NO: 108919 - DNA, 27 bp, Artificial Sequence
  Description of Artificial Sequence: Synthetic oligonucleotide
cctctacattggtgggcagctggtgac

SEQ ID NO: 108920 - DNA, 27 bp, Artificial Sequence
  Description of Artificial Sequence: Synthetic oligonucleotide
ctctacattggtgggcagctggtgacc

SEQ ID NO: 108921 - DNA, 28 bp, Artificial Sequence
  Description of Artificial Sequence: Synthetic oligonucleotide
tctacattggtgggcagctggtgaccag

SEQ ID NO: 108922 - DNA, 27 bp, Artificial Sequence
  Description of Artificial Sequence: Synthetic oligonucleotide
ctacattggtgggcagctggtgaccag

SEQ ID NO: 108923 - DNA, 28 bp, Artificial Sequence
  Description of Artificial Sequence: Synthetic oligonucleotide
tacattggtgggcagctggtgaccagtg

SEQ ID NO: 108924 - DNA, 27 bp, Artificial Sequence
  Description of Artificial Sequence: Synthetic oligonucleotide
acattggtgggcagctggtgaccagtg

SEQ ID NO: 108925 - DNA, 26 bp, Artificial Sequence
  Description of Artificial Sequence: Synthetic oligonucleotide
cattggtgggcagctggtgaccagtg

SEQ ID NO: 108926 - DNA, 26 bp, Artificial Sequence
  Description of Artificial Sequence: Synthetic oligonucleotide
attggtgggcagctggtgaccagtgg

SEQ ID NO: 108927 - DNA, 25 bp, Artificial Sequence
  Description of Artificial Sequence: Synthetic oligonucleotide
ttggtgggcagctggtgaccagtgg

SEQ ID NO: 108928 - DNA, 24 bp, Artificial Sequence
  Description of Artificial Sequence: Synthetic oligonucleotide
tggtgggcagctggtgaccagtgg

SEQ ID NO: 108929 - DNA, 23 bp, Artificial Sequence
  Description of Artificial Sequence: Synthetic oligonucleotide
ggtgggcagctggtgaccagtgg

SEQ ID NO: 108930 - DNA, 23 bp, Artificial Sequence
  Description of Artificial Sequence: Synthetic oligonucleotide
gtgggcagctggtgaccagtggg

SEQ ID NO: 108931 - DNA, 23 bp, Artificial Sequence
  Description of Artificial Sequence: Synthetic oligonucleotide
tgggcagctggtgaccagtgggg

SEQ ID NO: 108932 - DNA, 22 bp, Artificial Sequence
  Description of Artificial Sequence: Synthetic oligonucleotide
gggcagctggtgaccagtgggg

SEQ ID NO: 108933 - DNA, 23 bp, Artificial Sequence
  Description of Artificial Sequence: Synthetic oligonucleotide
ggcagctggtgaccagtggggct

SEQ ID NO: 108934 - DNA, 26 bp, Artificial Sequence
  Description of Artificial Sequence: Synthetic oligonucleotide
gcagctggtgaccagtggggctgtaa

SEQ ID NO: 108935 - DNA, 26 bp, Artificial Sequence
  Description of Artificial Sequence: Synthetic oligonucleotide
cagctggtgaccagtggggctgtaag

SEQ ID NO: 108936 - DNA, 27 bp, Artificial Sequence
  Description of Artificial Sequence: Synthetic oligonucleotide
agctggtgaccagtggggctgtaagca

SEQ ID NO: 108937 - DNA, 26 bp, Artificial Sequence
  Description of Artificial Sequence: Synthetic oligonucleotide
gctggtgaccagtggggctgtaagca

SEQ ID NO: 108938 - DNA, 27 bp, Artificial Sequence
  Description of Artificial Sequence: Synthetic oligonucleotide
ctggtgaccagtggggctgtaagcagt

SEQ ID NO: 108939 - DNA, 27 bp, Artificial Sequence
  Description of Artificial Sequence: Synthetic oligonucleotide
tggtgaccagtggggctgtaagcagtg

SEQ ID NO: 108940 - DNA, 26 bp, Artificial Sequence
  Description of Artificial Sequence: Synthetic oligonucleotide
ggtgaccagtggggctgtaagcagtg

SEQ ID NO: 108941 - DNA, 26 bp, Artificial Sequence
  Description of Artificial Sequence: Synthetic oligonucleotide
gtgaccagtggggctgtaagcagtgg

SEQ ID NO: 108942 - DNA, 27 bp, Artificial Sequence
  Description of Artificial Sequence: Synthetic oligonucleotide
tgaccagtggggctgtaagcagtggga

SEQ ID NO: 108943 - DNA, 27 bp, Artificial Sequence
  Description of Artificial Sequence: Synthetic oligonucleotide
gaccagtggggctgtaagcagtgggaa

SEQ ID NO: 108944 - DNA, 27 bp, Artificial Sequence
  Description of Artificial Sequence: Synthetic oligonucleotide
accagtggggctgtaagcagtgggaac

SEQ ID NO: 108945 - DNA, 26 bp, Artificial Sequence
  Description of Artificial Sequence: Synthetic oligonucleotide
ccagtggggctgtaagcagtgggaac

SEQ ID NO: 108946 - DNA, 27 bp, Artificial Sequence
  Description of Artificial Sequence: Synthetic oligonucleotide
cagtggggctgtaagcagtgggaacct

SEQ ID NO: 108947 - DNA, 28 bp, Artificial Sequence
  Description of Artificial Sequence: Synthetic oligonucleotide
agtggggctgtaagcagtgggaaccttg

SEQ ID NO: 108948 - DNA, 27 bp, Artificial Sequence
  Description of Artificial Sequence: Synthetic oligonucleotide
gtggggctgtaagcagtgggaaccttg

SEQ ID NO: 108949 - DNA, 28 bp, Artificial Sequence
  Description of Artificial Sequence: Synthetic oligonucleotide
tggggctgtaagcagtgggaaccttgtc

SEQ ID NO: 108950 - DNA, 27 bp, Artificial Sequence
  Description of Artificial Sequence: Synthetic oligonucleotide
ggggctgtaagcagtgggaaccttgtc

SEQ ID NO: 108951 - DNA, 28 bp, Artificial Sequence
  Description of Artificial Sequence: Synthetic oligonucleotide
gggctgtaagcagtgggaaccttgtcac

SEQ ID NO: 108952 - DNA, 32 bp, Artificial Sequence
  Description of Artificial Sequence: Synthetic oligonucleotide
ggctgtaagcagtgggaaccttgtcacatttg

SEQ ID NO: 108953 - DNA, 34 bp, Artificial Sequence
  Description of Artificial Sequence: Synthetic oligonucleotide
gctgtaagcagtgggaaccttgtcacatttgttc

SEQ ID NO: 108954 - DNA, 35 bp, Artificial Sequence
  Description of Artificial Sequence: Synthetic oligonucleotide
ctgtaagcagtgggaaccttgtcacatttgttctc

SEQ ID NO: 108955 - DNA, 37 bp, Artificial Sequence
  Description of Artificial Sequence: Synthetic oligonucleotide
tgtaagcagtgggaaccttgtcacatttgttctctac

SEQ ID NO: 108956 - DNA, 36 bp, Artificial Sequence
  Description of Artificial Sequence: Synthetic oligonucleotide
gtaagcagtgggaaccttgtcacatttgttctctac

SEQ ID NO: 108957 - DNA, 36 bp, Artificial Sequence
  Description of Artificial Sequence: Synthetic oligonucleotide
taagcagtgggaaccttgtcacatttgttctctacc

SEQ ID NO: 108958 - DNA, 35 bp, Artificial Sequence
  Description of Artificial Sequence: Synthetic oligonucleotide
aagcagtgggaaccttgtcacatttgttctctacc

SEQ ID NO: 108959 - DNA, 34 bp, Artificial Sequence
  Description of Artificial Sequence: Synthetic oligonucleotide
agcagtgggaaccttgtcacatttgttctctacc

SEQ ID NO: 108960 - DNA, 33 bp, Artificial Sequence
  Description of Artificial Sequence: Synthetic oligonucleotide
gcagtgggaaccttgtcacatttgttctctacc

SEQ ID NO: 108961 - DNA, 34 bp, Artificial Sequence
  Description of Artificial Sequence: Synthetic oligonucleotide
cagtgggaaccttgtcacatttgttctctaccag

SEQ ID NO: 108962 - DNA, 36 bp, Artificial Sequence
  Description of Artificial Sequence: Synthetic oligonucleotide
agtgggaaccttgtcacatttgttctctaccagatg

SEQ ID NO: 108963 - DNA, 35 bp, Artificial Sequence
  Description of Artificial Sequence: Synthetic oligonucleotide
gtgggaaccttgtcacatttgttctctaccagatg

SEQ ID NO: 108964 - DNA, 35 bp, Artificial Sequence
  Description of Artificial Sequence: Synthetic oligonucleotide
tgggaaccttgtcacatttgttctctaccagatgc

SEQ ID NO: 108965 - DNA, 34 bp, Artificial Sequence
  Description of Artificial Sequence: Synthetic oligonucleotide
gggaaccttgtcacatttgttctctaccagatgc

SEQ ID NO: 108966 - DNA, 35 bp, Artificial Sequence
  Description of Artificial Sequence: Synthetic oligonucleotide
ggaaccttgtcacatttgttctctaccagatgcag

SEQ ID NO: 108967 - DNA, 37 bp, Artificial Sequence
  Description of Artificial Sequence: Synthetic oligonucleotide
gaaccttgtcacatttgttctctaccagatgcagttc

SEQ ID NO: 108968 - DNA, 38 bp, Artificial Sequence
  Description of Artificial Sequence: Synthetic oligonucleotide
aaccttgtcacatttgttctctaccagatgcagttcac

SEQ ID NO: 108969 - DNA, 37 bp, Artificial Sequence
  Description of Artificial Sequence: Synthetic oligonucleotide
accttgtcacatttgttctctaccagatgcagttcac

SEQ ID NO: 108970 - DNA, 36 bp, Artificial Sequence
  Description of Artificial Sequence: Synthetic oligonucleotide
ccttgtcacatttgttctctaccagatgcagttcac

SEQ ID NO: 108971 - DNA, 36 bp, Artificial Sequence
  Description of Artificial Sequence: Synthetic oligonucleotide
cttgtcacatttgttctctaccagatgcagttcacc

SEQ ID NO: 108972 - DNA, 36 bp, Artificial Sequence
  Description of Artificial Sequence: Synthetic oligonucleotide
ttgtcacatttgttctctaccagatgcagttcaccc

SEQ ID NO: 108973 - DNA, 35 bp, Artificial Sequence
  Description of Artificial Sequence: Synthetic oligonucleotide
tgtcacatttgttctctaccagatgcagttcaccc

SEQ ID NO: 108974 - DNA, 34 bp, Artificial Sequence
  Description of Artificial Sequence: Synthetic oligonucleotide
gtcacatttgttctctaccagatgcagttcaccc

SEQ ID NO: 108975 - DNA, 35 bp, Artificial Sequence
  Description of Artificial Sequence: Synthetic oligonucleotide
tcacatttgttctctaccagatgcagttcacccag

SEQ ID NO: 108976 - DNA, 34 bp, Artificial Sequence
  Description of Artificial Sequence: Synthetic oligonucleotide
cacatttgttctctaccagatgcagttcacccag

SEQ ID NO: 108977 - DNA, 34 bp, Artificial Sequence
  Description of Artificial Sequence: Synthetic oligonucleotide
acatttgttctctaccagatgcagttcacccagg

SEQ ID NO: 108978 - DNA, 33 bp, Artificial Sequence
  Description of Artificial Sequence: Synthetic oligonucleotide
catttgttctctaccagatgcagttcacccagg

SEQ ID NO: 108979 - DNA, 33 bp, Artificial Sequence
  Description of Artificial Sequence: Synthetic oligonucleotide
atttgttctctaccagatgcagttcacccaggc

SEQ ID NO: 108980 - DNA, 32 bp, Artificial Sequence
  Description of Artificial Sequence: Synthetic oligonucleotide
tttgttctctaccagatgcagttcacccaggc

SEQ ID NO: 108981 - DNA, 31 bp, Artificial Sequence
  Description of Artificial Sequence: Synthetic oligonucleotide
ttgttctctaccagatgcagttcacccaggc

SEQ ID NO: 108982 - DNA, 30 bp, Artificial Sequence
  Description of Artificial Sequence: Synthetic oligonucleotide
tgttctctaccagatgcagttcacccaggc

SEQ ID NO: 108983 - DNA, 29 bp, Artificial Sequence
  Description of Artificial Sequence: Synthetic oligonucleotide
gttctctaccagatgcagttcacccaggc

SEQ ID NO: 108984 - DNA, 30 bp, Artificial Sequence
  Description of Artificial Sequence: Synthetic oligonucleotide
ttctctaccagatgcagttcacccaggctg

SEQ ID NO: 108985 - DNA, 29 bp, Artificial Sequence
  Description of Artificial Sequence: Synthetic oligonucleotide
tctctaccagatgcagttcacccaggctg

SEQ ID NO: 108986 - DNA, 28 bp, Artificial Sequence
  Description of Artificial Sequence: Synthetic oligonucleotide
ctctaccagatgcagttcacccaggctg

SEQ ID NO: 108987 - DNA, 29 bp, Artificial Sequence
  Description of Artificial Sequence: Synthetic oligonucleotide
tctaccagatgcagttcacccaggctgtg

SEQ ID NO: 108988 - DNA, 28 bp, Artificial Sequence
  Description of Artificial Sequence: Synthetic oligonucleotide
ctaccagatgcagttcacccaggctgtg

SEQ ID NO: 108989 - DNA, 28 bp, Artificial Sequence
  Description of Artificial Sequence: Synthetic oligonucleotide
taccagatgcagttcacccaggctgtgg

SEQ ID NO: 108990 - DNA, 27 bp, Artificial Sequence
  Description of Artificial Sequence: Synthetic oligonucleotide
accagatgcagttcacccaggctgtgg

SEQ ID NO: 108991 - DNA, 27 bp, Artificial Sequence
  Description of Artificial Sequence: Synthetic oligonucleotide
ccagatgcagttcacccaggctgtgga

SEQ ID NO: 108992 - DNA, 27 bp, Artificial Sequence
  Description of Artificial Sequence: Synthetic oligonucleotide
cagatgcagttcacccaggctgtggag

SEQ ID NO: 108993 - DNA, 27 bp, Artificial Sequence
  Description of Artificial Sequence: Synthetic oligonucleotide
agatgcagttcacccaggctgtggagg

SEQ ID NO: 108994 - DNA, 27 bp, Artificial Sequence
  Description of Artificial Sequence: Synthetic oligonucleotide
gatgcagttcacccaggctgtggaggt

SEQ ID NO: 108995 - DNA, 28 bp, Artificial Sequence
  Description of Artificial Sequence: Synthetic oligonucleotide
atgcagttcacccaggctgtggaggtac

SEQ ID NO: 108996 - DNA, 27 bp, Artificial Sequence
  Description of Artificial Sequence: Synthetic oligonucleotide
tgcagttcacccaggctgtggaggtac

SEQ ID NO: 108997 - DNA, 27 bp, Artificial Sequence
  Description of Artificial Sequence: Synthetic oligonucleotide
gcagttcacccaggctgtggaggtact

SEQ ID NO: 108998 - DNA, 27 bp, Artificial Sequence
  Description of Artificial Sequence: Synthetic oligonucleotide
cagttcacccaggctgtggaggtactg

SEQ ID NO: 108999 - DNA, 27 bp, Artificial Sequence
  Description of Artificial Sequence: Synthetic oligonucleotide
agttcacccaggctgtggaggtactgc

SEQ ID NO: 109000 - DNA, 27 bp, Artificial Sequence
  Description of Artificial Sequence: Synthetic oligonucleotide
gttcacccaggctgtggaggtactgct

SEQ ID NO: 109001 - DNA, 27 bp, Artificial Sequence
  Description of Artificial Sequence: Synthetic oligonucleotide
ttcacccaggctgtggaggtactgctc

SEQ ID NO: 109002 - DNA, 27 bp, Artificial Sequence
  Description of Artificial Sequence: Synthetic oligonucleotide
tcacccaggctgtggaggtactgctct

SEQ ID NO: 109003 - DNA, 26 bp, Artificial Sequence
  Description of Artificial Sequence: Synthetic oligonucleotide
cacccaggctgtggaggtactgctct

SEQ ID NO: 109004 - DNA, 26 bp, Artificial Sequence
  Description of Artificial Sequence: Synthetic oligonucleotide
acccaggctgtggaggtactgctctc

SEQ ID NO: 109005 - DNA, 25 bp, Artificial Sequence
  Description of Artificial Sequence: Synthetic oligonucleotide
cccaggctgtggaggtactgctctc

SEQ ID NO: 109006 - DNA, 27 bp, Artificial Sequence
  Description of Artificial Sequence: Synthetic oligonucleotide
ccaggctgtggaggtactgctctccat

SEQ ID NO: 109007 - DNA, 27 bp, Artificial Sequence
  Description of Artificial Sequence: Synthetic oligonucleotide
caggctgtggaggtactgctctccatc

SEQ ID NO: 109008 - DNA, 29 bp, Artificial Sequence
  Description of Artificial Sequence: Synthetic oligonucleotide
aggctgtggaggtactgctctccatctac

SEQ ID NO: 109009 - DNA, 28 bp, Artificial Sequence
  Description of Artificial Sequence: Synthetic oligonucleotide
ggctgtggaggtactgctctccatctac

SEQ ID NO: 109010 - DNA, 28 bp, Artificial Sequence
  Description of Artificial Sequence: Synthetic oligonucleotide
gctgtggaggtactgctctccatctacc

SEQ ID NO: 109011 - DNA, 28 bp, Artificial Sequence
  Description of Artificial Sequence: Synthetic oligonucleotide
ctgtggaggtactgctctccatctaccc

SEQ ID NO: 109012 - DNA, 28 bp, Artificial Sequence
  Description of Artificial Sequence: Synthetic oligonucleotide
tgtggaggtactgctctccatctacccc

SEQ ID NO: 109013 - DNA, 27 bp, Artificial Sequence
  Description of Artificial Sequence: Synthetic oligonucleotide
gtggaggtactgctctccatctacccc

SEQ ID NO: 109014 - DNA, 28 bp, Artificial Sequence
  Description of Artificial Sequence: Synthetic oligonucleotide
tggaggtactgctctccatctaccccag

SEQ ID NO: 109015 - DNA, 27 bp, Artificial Sequence
  Description of Artificial Sequence: Synthetic oligonucleotide
ggaggtactgctctccatctaccccag

SEQ ID NO: 109016 - DNA, 28 bp, Artificial Sequence
  Description of Artificial Sequence: Synthetic oligonucleotide
gaggtactgctctccatctaccccagag

SEQ ID NO: 109017 - DNA, 30 bp, Artificial Sequence
  Description of Artificial Sequence: Synthetic oligonucleotide
aggtactgctctccatctaccccagagtac

SEQ ID NO: 109018 - DNA, 29 bp, Artificial Sequence
  Description of Artificial Sequence: Synthetic oligonucleotide
ggtactgctctccatctaccccagagtac

SEQ ID NO: 109019 - DNA, 30 bp, Artificial Sequence
  Description of Artificial Sequence: Synthetic oligonucleotide
gtactgctctccatctaccccagagtacag

SEQ ID NO: 109020 - DNA, 32 bp, Artificial Sequence
  Description of Artificial Sequence: Synthetic oligonucleotide
tactgctctccatctaccccagagtacagaag

SEQ ID NO: 109021 - DNA, 31 bp, Artificial Sequence
  Description of Artificial Sequence: Synthetic oligonucleotide
actgctctccatctaccccagagtacagaag

SEQ ID NO: 109022 - DNA, 30 bp, Artificial Sequence
  Description of Artificial Sequence: Synthetic oligonucleotide
ctgctctccatctaccccagagtacagaag

SEQ ID NO: 109023 - DNA, 30 bp, Artificial Sequence
  Description of Artificial Sequence: Synthetic oligonucleotide
tgctctccatctaccccagagtacagaagg

SEQ ID NO: 109024 - DNA, 29 bp, Artificial Sequence
  Description of Artificial Sequence: Synthetic oligonucleotide
gctctccatctaccccagagtacagaagg

SEQ ID NO: 109025 - DNA, 29 bp, Artificial Sequence
  Description of Artificial Sequence: Synthetic oligonucleotide
ctctccatctaccccagagtacagaaggc

SEQ ID NO: 109026 - DNA, 30 bp, Artificial Sequence
  Description of Artificial Sequence: Synthetic oligonucleotide
tctccatctaccccagagtacagaaggctg

SEQ ID NO: 109027 - DNA, 29 bp, Artificial Sequence
  Description of Artificial Sequence: Synthetic oligonucleotide
ctccatctaccccagagtacagaaggctg

SEQ ID NO: 109028 - DNA, 30 bp, Artificial Sequence
  Description of Artificial Sequence: Synthetic oligonucleotide
tccatctaccccagagtacagaaggctgtg

SEQ ID NO: 109029 - DNA, 29 bp, Artificial Sequence
  Description of Artificial Sequence: Synthetic oligonucleotide
ccatctaccccagagtacagaaggctgtg

SEQ ID NO: 109030 - DNA, 29 bp, Artificial Sequence
  Description of Artificial Sequence: Synthetic oligonucleotide
catctaccccagagtacagaaggctgtgg

SEQ ID NO: 109031 - DNA, 29 bp, Artificial Sequence
  Description of Artificial Sequence: Synthetic oligonucleotide
atctaccccagagtacagaaggctgtggg

SEQ ID NO: 109032 - DNA, 28 bp, Artificial Sequence
  Description of Artificial Sequence: Synthetic oligonucleotide
tctaccccagagtacagaaggctgtggg

SEQ ID NO: 109033 - DNA, 27 bp, Artificial Sequence
  Description of Artificial Sequence: Synthetic oligonucleotide
ctaccccagagtacagaaggctgtggg

SEQ ID NO: 109034 - DNA, 27 bp, Artificial Sequence
  Description of Artificial Sequence: Synthetic oligonucleotide
taccccagagtacagaaggctgtgggc

SEQ ID NO: 109035 - DNA, 27 bp, Artificial Sequence
  Description of Artificial Sequence: Synthetic oligonucleotide
accccagagtacagaaggctgtgggct

SEQ ID NO: 109036 - DNA, 26 bp, Artificial Sequence
  Description of Artificial Sequence: Synthetic oligonucleotide
ccccagagtacagaaggctgtgggct

SEQ ID NO: 109037 - DNA, 26 bp, Artificial Sequence
  Description of Artificial Sequence: Synthetic oligonucleotide
cccagagtacagaaggctgtgggctc

SEQ ID NO: 109038 - DNA, 27 bp, Artificial Sequence
  Description of Artificial Sequence: Synthetic oligonucleotide
ccagagtacagaaggctgtgggctcct

SEQ ID NO: 109039 - DNA, 27 bp, Artificial Sequence
  Description of Artificial Sequence: Synthetic oligonucleotide
cagagtacagaaggctgtgggctcctc

SEQ ID NO: 109040 - DNA, 28 bp, Artificial Sequence
  Description of Artificial Sequence: Synthetic oligonucleotide
agagtacagaaggctgtgggctcctcag

SEQ ID NO: 109041 - DNA, 27 bp, Artificial Sequence
  Description of Artificial Sequence: Synthetic oligonucleotide
gagtacagaaggctgtgggctcctcag

SEQ ID NO: 109042 - DNA, 28 bp, Artificial Sequence
  Description of Artificial Sequence: Synthetic oligonucleotide
agtacagaaggctgtgggctcctcagag

SEQ ID NO: 109043 - DNA, 27 bp, Artificial Sequence
  Description of Artificial Sequence: Synthetic oligonucleotide
gtacagaaggctgtgggctcctcagag

SEQ ID NO: 109044 - DNA, 36 bp, Artificial Sequence
  Description of Artificial Sequence: Synthetic oligonucleotide
tacagaaggctgtgggctcctcagagaaaatatttg

SEQ ID NO: 109045 - DNA, 35 bp, Artificial Sequence
  Description of Artificial Sequence: Synthetic oligonucleotide
acagaaggctgtgggctcctcagagaaaatatttg

SEQ ID NO: 109046 - DNA, 34 bp, Artificial Sequence
  Description of Artificial Sequence: Synthetic oligonucleotide
cagaaggctgtgggctcctcagagaaaatatttg

SEQ ID NO: 109047 - DNA, 35 bp, Artificial Sequence
  Description of Artificial Sequence: Synthetic oligonucleotide
agaaggctgtgggctcctcagagaaaatatttgag

SEQ ID NO: 109048 - DNA, 34 bp, Artificial Sequence
  Description of Artificial Sequence: Synthetic oligonucleotide
gaaggctgtgggctcctcagagaaaatatttgag

SEQ ID NO: 109049 - DNA, 36 bp, Artificial Sequence
  Description of Artificial Sequence: Synthetic oligonucleotide
aaggctgtgggctcctcagagaaaatatttgagtac

SEQ ID NO: 109050 - DNA, 35 bp, Artificial Sequence
  Description of Artificial Sequence: Synthetic oligonucleotide
aggctgtgggctcctcagagaaaatatttgagtac

SEQ ID NO: 109051 - DNA, 34 bp, Artificial Sequence
  Description of Artificial Sequence: Synthetic oligonucleotide
ggctgtgggctcctcagagaaaatatttgagtac

SEQ ID NO: 109052 - DNA, 34 bp, Artificial Sequence
  Description of Artificial Sequence: Synthetic oligonucleotide
gctgtgggctcctcagagaaaatatttgagtacc

SEQ ID NO: 109053 - DNA, 35 bp, Artificial Sequence
  Description of Artificial Sequence: Synthetic oligonucleotide
ctgtgggctcctcagagaaaatatttgagtacctg

SEQ ID NO: 109054 - DNA, 35 bp, Artificial Sequence
  Description of Artificial Sequence: Synthetic oligonucleotide
tgtgggctcctcagagaaaatatttgagtacctgg

SEQ ID NO: 109055 - DNA, 34 bp, Artificial Sequence
  Description of Artificial Sequence: Synthetic oligonucleotide
gtgggctcctcagagaaaatatttgagtacctgg

SEQ ID NO: 109056 - DNA, 35 bp, Artificial Sequence
  Description of Artificial Sequence: Synthetic oligonucleotide
tgggctcctcagagaaaatatttgagtacctggac

SEQ ID NO: 109057 - DNA, 34 bp, Artificial Sequence
  Description of Artificial Sequence: Synthetic oligonucleotide
gggctcctcagagaaaatatttgagtacctggac

SEQ ID NO: 109058 - DNA, 34 bp, Artificial Sequence
  Description of Artificial Sequence: Synthetic oligonucleotide
ggctcctcagagaaaatatttgagtacctggacc

SEQ ID NO: 109059 - DNA, 34 bp, Artificial Sequence
  Description of Artificial Sequence: Synthetic oligonucleotide
gctcctcagagaaaatatttgagtacctggaccg

SEQ ID NO: 109060 - DNA, 34 bp, Artificial Sequence
  Description of Artificial Sequence: Synthetic oligonucleotide
ctcctcagagaaaatatttgagtacctggaccgc

SEQ ID NO: 109061 - DNA, 35 bp, Artificial Sequence
  Description of Artificial Sequence: Synthetic oligonucleotide
tcctcagagaaaatatttgagtacctggaccgcac

SEQ ID NO: 109062 - DNA, 34 bp, Artificial Sequence
  Description of Artificial Sequence: Synthetic oligonucleotide
cctcagagaaaatatttgagtacctggaccgcac

SEQ ID NO: 109063 - DNA, 34 bp, Artificial Sequence
  Description of Artificial Sequence: Synthetic oligonucleotide
ctcagagaaaatatttgagtacctggaccgcacc

SEQ ID NO: 109064 - DNA, 34 bp, Artificial Sequence
  Description of Artificial Sequence: Synthetic oligonucleotide
tcagagaaaatatttgagtacctggaccgcaccc

SEQ ID NO: 109065 - DNA, 33 bp, Artificial Sequence
  Description of Artificial Sequence: Synthetic oligonucleotide
cagagaaaatatttgagtacctggaccgcaccc

SEQ ID NO: 109066 - DNA, 33 bp, Artificial Sequence
  Description of Artificial Sequence: Synthetic oligonucleotide
agagaaaatatttgagtacctggaccgcacccc

SEQ ID NO: 109067 - DNA, 32 bp, Artificial Sequence
  Description of Artificial Sequence: Synthetic oligonucleotide
gagaaaatatttgagtacctggaccgcacccc

SEQ ID NO: 109068 - DNA, 33 bp, Artificial Sequence
  Description of Artificial Sequence: Synthetic oligonucleotide
agaaaatatttgagtacctggaccgcacccctc

SEQ ID NO: 109069 - DNA, 32 bp, Artificial Sequence
  Description of Artificial Sequence: Synthetic oligonucleotide
gaaaatatttgagtacctggaccgcacccctc

SEQ ID NO: 109070 - DNA, 32 bp, Artificial Sequence
  Description of Artificial Sequence: Synthetic oligonucleotide
aaaatatttgagtacctggaccgcacccctcg

SEQ ID NO: 109071 - DNA, 31 bp, Artificial Sequence
  Description of Artificial Sequence: Synthetic oligonucleotide
aaatatttgagtacctggaccgcacccctcg

SEQ ID NO: 109072 - DNA, 30 bp, Artificial Sequence
  Description of Artificial Sequence: Synthetic oligonucleotide
aatatttgagtacctggaccgcacccctcg

SEQ ID NO: 109073 - DNA, 29 bp, Artificial Sequence
  Description of Artificial Sequence: Synthetic oligonucleotide
atatttgagtacctggaccgcacccctcg

SEQ ID NO: 109074 - DNA, 28 bp, Artificial Sequence
  Description of Artificial Sequence: Synthetic oligonucleotide
tatttgagtacctggaccgcacccctcg

SEQ ID NO: 109075 - DNA, 27 bp, Artificial Sequence
  Description of Artificial Sequence: Synthetic oligonucleotide
atttgagtacctggaccgcacccctcg

SEQ ID NO: 109076 - DNA, 26 bp, Artificial Sequence
  Description of Artificial Sequence: Synthetic oligonucleotide
tttgagtacctggaccgcacccctcg

SEQ ID NO: 109077 - DNA, 25 bp, Artificial Sequence
  Description of Artificial Sequence: Synthetic oligonucleotide
ttgagtacctggaccgcacccctcg

SEQ ID NO: 109078 - DNA, 24 bp, Artificial Sequence
  Description of Artificial Sequence: Synthetic oligonucleotide
tgagtacctggaccgcacccctcg

SEQ ID NO: 109079 - DNA, 23 bp, Artificial Sequence
  Description of Artificial Sequence: Synthetic oligonucleotide
gagtacctggaccgcacccctcg

SEQ ID NO: 109080 - DNA, 24 bp, Artificial Sequence
  Description of Artificial Sequence: Synthetic oligonucleotide
agtacctggaccgcacccctcgct

SEQ ID NO: 109081 - DNA, 23 bp, Artificial Sequence
  Description of Artificial Sequence: Synthetic oligonucleotide
gtacctggaccgcacccctcgct

SEQ ID NO: 109082 - DNA, 23 bp, Artificial Sequence
  Description of Artificial Sequence: Synthetic oligonucleotide
tacctggaccgcacccctcgctg

SEQ ID NO: 109083 - DNA, 22 bp, Artificial Sequence
  Description of Artificial Sequence: Synthetic oligonucleotide
acctggaccgcacccctcgctg

SEQ ID NO: 109084 - DNA, 21 bp, Artificial Sequence
  Description of Artificial Sequence: Synthetic oligonucleotide
cctggaccgcacccctcgctg

SEQ ID NO: 109085 - DNA, 21 bp, Artificial Sequence
  Description of Artificial Sequence: Synthetic oligonucleotide
ctggaccgcacccctcgctgc

SEQ ID NO: 109086 - DNA, 21 bp, Artificial Sequence
  Description of Artificial Sequence: Synthetic oligonucleotide
tggaccgcacccctcgctgcc

SEQ ID NO: 109087 - DNA, 20 bp, Artificial Sequence
  Description of Artificial Sequence: Synthetic oligonucleotide
ggaccgcacccctcgctgcc

SEQ ID NO: 109088 - DNA, 21 bp, Artificial Sequence
  Description of Artificial Sequence: Synthetic oligonucleotide
gaccgcacccctcgctgccca

SEQ ID NO: 109089 - DNA, 21 bp, Artificial Sequence
  Description of Artificial Sequence: Synthetic oligonucleotide
accgcacccctcgctgcccac

SEQ ID NO: 109090 - DNA, 20 bp, Artificial Sequence
  Description of Artificial Sequence: Synthetic oligonucleotide
ccgcacccctcgctgcccac

SEQ ID NO: 109091 - DNA, 20 bp, Artificial Sequence
  Description of Artificial Sequence: Synthetic oligonucleotide
cgcacccctcgctgcccacc

SEQ ID NO: 109092 - DNA, 21 bp, Artificial Sequence
  Description of Artificial Sequence: Synthetic oligonucleotide
gcacccctcgctgcccaccca

SEQ ID NO: 109093 - DNA, 22 bp, Artificial Sequence
  Description of Artificial Sequence: Synthetic oligonucleotide
cacccctcgctgcccacccagt

SEQ ID NO: 109094 - DNA, 22 bp, Artificial Sequence
  Description of Artificial Sequence: Synthetic oligonucleotide
acccctcgctgcccacccagtg

SEQ ID NO: 109095 - DNA, 21 bp, Artificial Sequence
  Description of Artificial Sequence: Synthetic oligonucleotide
cccctcgctgcccacccagtg

SEQ ID NO: 109096 - DNA, 22 bp, Artificial Sequence
  Description of Artificial Sequence: Synthetic oligonucleotide
ccctcgctgcccacccagtggt

SEQ ID NO: 109097 - DNA, 23 bp, Artificial Sequence
  Description of Artificial Sequence: Synthetic oligonucleotide
cctcgctgcccacccagtggtct

SEQ ID NO: 109098 - DNA, 25 bp, Artificial Sequence
  Description of Artificial Sequence: Synthetic oligonucleotide
ctcgctgcccacccagtggtctgtt

SEQ ID NO: 109099 - DNA, 26 bp, Artificial Sequence
  Description of Artificial Sequence: Synthetic oligonucleotide
tcgctgcccacccagtggtctgttga

SEQ ID NO: 109100 - DNA, 25 bp, Artificial Sequence
  Description of Artificial Sequence: Synthetic oligonucleotide
cgctgcccacccagtggtctgttga

SEQ ID NO: 109101 - DNA, 26 bp, Artificial Sequence
  Description of Artificial Sequence: Synthetic oligonucleotide
gctgcccacccagtggtctgttgact

SEQ ID NO: 109102 - DNA, 26 bp, Artificial Sequence
  Description of Artificial Sequence: Synthetic oligonucleotide
ctgcccacccagtggtctgttgactc

SEQ ID NO: 109103 - DNA, 26 bp, Artificial Sequence
  Description of Artificial Sequence: Synthetic oligonucleotide
tgcccacccagtggtctgttgactcc

SEQ ID NO: 109104 - DNA, 25 bp, Artificial Sequence
  Description of Artificial Sequence: Synthetic oligonucleotide
gcccacccagtggtctgttgactcc

SEQ ID NO: 109105 - DNA, 27 bp, Artificial Sequence
  Description of Artificial Sequence: Synthetic oligonucleotide
cccacccagtggtctgttgactccctt

SEQ ID NO: 109106 - DNA, 28 bp, Artificial Sequence
  Description of Artificial Sequence: Synthetic oligonucleotide
ccacccagtggtctgttgactcccttac

SEQ ID NO: 109107 - DNA, 29 bp, Artificial Sequence
  Description of Artificial Sequence: Synthetic oligonucleotide
cacccagtggtctgttgactcccttacac

SEQ ID NO: 109108 - DNA, 31 bp, Artificial Sequence
  Description of Artificial Sequence: Synthetic oligonucleotide
acccagtggtctgttgactcccttacacttg

SEQ ID NO: 109109 - DNA, 30 bp, Artificial Sequence
  Description of Artificial Sequence: Synthetic oligonucleotide
cccagtggtctgttgactcccttacacttg

SEQ ID NO: 109110 - DNA, 30 bp, Artificial Sequence
  Description of Artificial Sequence: Synthetic oligonucleotide
ccagtggtctgttgactcccttacacttgg

SEQ ID NO: 109111 - DNA, 31 bp, Artificial Sequence
  Description of Artificial Sequence: Synthetic oligonucleotide
cagtggtctgttgactcccttacacttggag

SEQ ID NO: 109112 - DNA, 31 bp, Artificial Sequence
  Description of Artificial Sequence: Synthetic oligonucleotide
agtggtctgttgactcccttacacttggagg

SEQ ID NO: 109113 - DNA, 30 bp, Artificial Sequence
  Description of Artificial Sequence: Synthetic oligonucleotide
gtggtctgttgactcccttacacttggagg

SEQ ID NO: 109114 - DNA, 30 bp, Artificial Sequence
  Description of Artificial Sequence: Synthetic oligonucleotide
tggtctgttgactcccttacacttggaggg

SEQ ID NO: 109115 - DNA, 29 bp, Artificial Sequence
  Description of Artificial Sequence: Synthetic oligonucleotide
ggtctgttgactcccttacacttggaggg

SEQ ID NO: 109116 - DNA, 29 bp, Artificial Sequence
  Description of Artificial Sequence: Synthetic oligonucleotide
gtctgttgactcccttacacttggagggc

SEQ ID NO: 109117 - DNA, 29 bp, Artificial Sequence
  Description of Artificial Sequence: Synthetic oligonucleotide
tctgttgactcccttacacttggagggcc

SEQ ID NO: 109118 - DNA, 28 bp, Artificial Sequence
  Description of Artificial Sequence: Synthetic oligonucleotide
ctgttgactcccttacacttggagggcc

SEQ ID NO: 109119 - DNA, 30 bp, Artificial Sequence
  Description of Artificial Sequence: Synthetic oligonucleotide
tgttgactcccttacacttggagggccttg

SEQ ID NO: 109120 - DNA, 29 bp, Artificial Sequence
  Description of Artificial Sequence: Synthetic oligonucleotide
gttgactcccttacacttggagggccttg

SEQ ID NO: 109121 - DNA, 30 bp, Artificial Sequence
  Description of Artificial Sequence: Synthetic oligonucleotide
ttgactcccttacacttggagggccttgtc

SEQ ID NO: 109122 - DNA, 29 bp, Artificial Sequence
  Description of Artificial Sequence: Synthetic oligonucleotide
tgactcccttacacttggagggccttgtc

SEQ ID NO: 109123 - DNA, 28 bp, Artificial Sequence
  Description of Artificial Sequence: Synthetic oligonucleotide
gactcccttacacttggagggccttgtc

SEQ ID NO: 109124 - DNA, 28 bp, Artificial Sequence
  Description of Artificial Sequence: Synthetic oligonucleotide
actcccttacacttggagggccttgtcc

SEQ ID NO: 109125 - DNA, 27 bp, Artificial Sequence
  Description of Artificial Sequence: Synthetic oligonucleotide
ctcccttacacttggagggccttgtcc

SEQ ID NO: 109126 - DNA, 28 bp, Artificial Sequence
  Description of Artificial Sequence: Synthetic oligonucleotide
tcccttacacttggagggccttgtccag

SEQ ID NO: 109127 - DNA, 27 bp, Artificial Sequence
  Description of Artificial Sequence: Synthetic oligonucleotide
cccttacacttggagggccttgtccag

SEQ ID NO: 109128 - DNA, 29 bp, Artificial Sequence
  Description of Artificial Sequence: Synthetic oligonucleotide
ccttacacttggagggccttgtccagttc

SEQ ID NO: 109129 - DNA, 29 bp, Artificial Sequence
  Description of Artificial Sequence: Synthetic oligonucleotide
cttacacttggagggccttgtccagttcc

SEQ ID NO: 109130 - DNA, 31 bp, Artificial Sequence
  Description of Artificial Sequence: Synthetic oligonucleotide
ttacacttggagggccttgtccagttccaag

SEQ ID NO: 109131 - DNA, 30 bp, Artificial Sequence
  Description of Artificial Sequence: Synthetic oligonucleotide
tacacttggagggccttgtccagttccaag

SEQ ID NO: 109132 - DNA, 29 bp, Artificial Sequence
  Description of Artificial Sequence: Synthetic oligonucleotide
acacttggagggccttgtccagttccaag

SEQ ID NO: 109133 - DNA, 28 bp, Artificial Sequence
  Description of Artificial Sequence: Synthetic oligonucleotide
cacttggagggccttgtccagttccaag

SEQ ID NO: 109134 - DNA, 30 bp, Artificial Sequence
  Description of Artificial Sequence: Synthetic oligonucleotide
acttggagggccttgtccagttccaagatg

SEQ ID NO: 109135 - DNA, 29 bp, Artificial Sequence
  Description of Artificial Sequence: Synthetic oligonucleotide
cttggagggccttgtccagttccaagatg

SEQ ID NO: 109136 - DNA, 30 bp, Artificial Sequence
  Description of Artificial Sequence: Synthetic oligonucleotide
ttggagggccttgtccagttccaagatgtc

SEQ ID NO: 109137 - DNA, 29 bp, Artificial Sequence
  Description of Artificial Sequence: Synthetic oligonucleotide
tggagggccttgtccagttccaagatgtc

SEQ ID NO: 109138 - DNA, 28 bp, Artificial Sequence
  Description of Artificial Sequence: Synthetic oligonucleotide
ggagggccttgtccagttccaagatgtc

SEQ ID NO: 109139 - DNA, 29 bp, Artificial Sequence
  Description of Artificial Sequence: Synthetic oligonucleotide
gagggccttgtccagttccaagatgtctc

SEQ ID NO: 109140 - DNA, 29 bp, Artificial Sequence
  Description of Artificial Sequence: Synthetic oligonucleotide
agggccttgtccagttccaagatgtctcc

SEQ ID NO: 109141 - DNA, 28 bp, Artificial Sequence
  Description of Artificial Sequence: Synthetic oligonucleotide
gggccttgtccagttccaagatgtctcc

SEQ ID NO: 109142 - DNA, 31 bp, Artificial Sequence
  Description of Artificial Sequence: Synthetic oligonucleotide
ggccttgtccagttccaagatgtctcctttg

SEQ ID NO: 109143 - DNA, 31 bp, Artificial Sequence
  Description of Artificial Sequence: Synthetic oligonucleotide
gccttgtccagttccaagatgtctcctttgc

SEQ ID NO: 109144 - DNA, 31 bp, Artificial Sequence
  Description of Artificial Sequence: Synthetic oligonucleotide
ccttgtccagttccaagatgtctcctttgcc

SEQ ID NO: 109145 - DNA, 33 bp, Artificial Sequence
  Description of Artificial Sequence: Synthetic oligonucleotide
cttgtccagttccaagatgtctcctttgcctac

SEQ ID NO: 109146 - DNA, 33 bp, Artificial Sequence
  Description of Artificial Sequence: Synthetic oligonucleotide
ttgtccagttccaagatgtctcctttgcctacc

SEQ ID NO: 109147 - DNA, 32 bp, Artificial Sequence
  Description of Artificial Sequence: Synthetic oligonucleotide
tgtccagttccaagatgtctcctttgcctacc

SEQ ID NO: 109148 - DNA, 31 bp, Artificial Sequence
  Description of Artificial Sequence: Synthetic oligonucleotide
gtccagttccaagatgtctcctttgcctacc

SEQ ID NO: 109149 - DNA, 31 bp, Artificial Sequence
  Description of Artificial Sequence: Synthetic oligonucleotide
tccagttccaagatgtctcctttgcctaccc

SEQ ID NO: 109150 - DNA, 30 bp, Artificial Sequence
  Description of Artificial Sequence: Synthetic oligonucleotide
ccagttccaagatgtctcctttgcctaccc

SEQ ID NO: 109151 - DNA, 33 bp, Artificial Sequence
  Description of Artificial Sequence: Synthetic oligonucleotide
cagttccaagatgtctcctttgcctacccaaac

SEQ ID NO: 109152 - DNA, 33 bp, Artificial Sequence
  Description of Artificial Sequence: Synthetic oligonucleotide
agttccaagatgtctcctttgcctacccaaacc

SEQ ID NO: 109153 - DNA, 32 bp, Artificial Sequence
  Description of Artificial Sequence: Synthetic oligonucleotide
gttccaagatgtctcctttgcctacccaaacc

SEQ ID NO: 109154 - DNA, 32 bp, Artificial Sequence
  Description of Artificial Sequence: Synthetic oligonucleotide
ttccaagatgtctcctttgcctacccaaaccg

SEQ ID NO: 109155 - DNA, 31 bp, Artificial Sequence
  Description of Artificial Sequence: Synthetic oligonucleotide
tccaagatgtctcctttgcctacccaaaccg

SEQ ID NO: 109156 - DNA, 30 bp, Artificial Sequence
  Description of Artificial Sequence: Synthetic oligonucleotide
ccaagatgtctcctttgcctacccaaaccg

SEQ ID NO: 109157 - DNA, 30 bp, Artificial Sequence
  Description of Artificial Sequence: Synthetic oligonucleotide
caagatgtctcctttgcctacccaaaccgc

SEQ ID NO: 109158 - DNA, 30 bp, Artificial Sequence
  Description of Artificial Sequence: Synthetic oligonucleotide
aagatgtctcctttgcctacccaaaccgcc

SEQ ID NO: 109159 - DNA, 29 bp, Artificial Sequence
  Description of Artificial Sequence: Synthetic oligonucleotide
agatgtctcctttgcctacccaaaccgcc

SEQ ID NO: 109160 - DNA, 28 bp, Artificial Sequence
  Description of Artificial Sequence: Synthetic oligonucleotide
gatgtctcctttgcctacccaaaccgcc

SEQ ID NO: 109161 - DNA, 28 bp, Artificial Sequence
  Description of Artificial Sequence: Synthetic oligonucleotide
atgtctcctttgcctacccaaaccgccc

SEQ ID NO: 109162 - DNA, 27 bp, Artificial Sequence
  Description of Artificial Sequence: Synthetic oligonucleotide
tgtctcctttgcctacccaaaccgccc

SEQ ID NO: 109163 - DNA, 27 bp, Artificial Sequence
  Description of Artificial Sequence: Synthetic oligonucleotide
gtctcctttgcctacccaaaccgccca

SEQ ID NO: 109164 - DNA, 27 bp, Artificial Sequence
  Description of Artificial Sequence: Synthetic oligonucleotide
tctcctttgcctacccaaaccgcccag

SEQ ID NO: 109165 - DNA, 27 bp, Artificial Sequence
  Description of Artificial Sequence: Synthetic oligonucleotide
ctcctttgcctacccaaaccgcccaga

SEQ ID NO: 109166 - DNA, 28 bp, Artificial Sequence
  Description of Artificial Sequence: Synthetic oligonucleotide
tcctttgcctacccaaaccgcccagatg

SEQ ID NO: 109167 - DNA, 27 bp, Artificial Sequence
  Description of Artificial Sequence: Synthetic oligonucleotide
cctttgcctacccaaaccgcccagatg

SEQ ID NO: 109168 - DNA, 28 bp, Artificial Sequence
  Description of Artificial Sequence: Synthetic oligonucleotide
ctttgcctacccaaaccgcccagatgtc

SEQ ID NO: 109169 - DNA, 31 bp, Artificial Sequence
  Description of Artificial Sequence: Synthetic oligonucleotide
tttgcctacccaaaccgcccagatgtcttag

SEQ ID NO: 109170 - DNA, 30 bp, Artificial Sequence
  Description of Artificial Sequence: Synthetic oligonucleotide
ttgcctacccaaaccgcccagatgtcttag

SEQ ID NO: 109171 - DNA, 29 bp, Artificial Sequence
  Description of Artificial Sequence: Synthetic oligonucleotide
tgcctacccaaaccgcccagatgtcttag

SEQ ID NO: 109172 - DNA, 28 bp, Artificial Sequence
  Description of Artificial Sequence: Synthetic oligonucleotide
gcctacccaaaccgcccagatgtcttag

SEQ ID NO: 109173 - DNA, 29 bp, Artificial Sequence
  Description of Artificial Sequence: Synthetic oligonucleotide
cctacccaaaccgcccagatgtcttagtg

SEQ ID NO: 109174 - DNA, 29 bp, Artificial Sequence
  Description of Artificial Sequence: Synthetic oligonucleotide
ctacccaaaccgcccagatgtcttagtgc

SEQ ID NO: 109175 - DNA, 31 bp, Artificial Sequence
  Description of Artificial Sequence: Synthetic oligonucleotide
tacccaaaccgcccagatgtcttagtgctac

SEQ ID NO: 109176 - DNA, 30 bp, Artificial Sequence
  Description of Artificial Sequence: Synthetic oligonucleotide
acccaaaccgcccagatgtcttagtgctac

SEQ ID NO: 109177 - DNA, 29 bp, Artificial Sequence
  Description of Artificial Sequence: Synthetic oligonucleotide
cccaaaccgcccagatgtcttagtgctac

SEQ ID NO: 109178 - DNA, 30 bp, Artificial Sequence
  Description of Artificial Sequence: Synthetic oligonucleotide
ccaaaccgcccagatgtcttagtgctacag

SEQ ID NO: 109179 - DNA, 30 bp, Artificial Sequence
  Description of Artificial Sequence: Synthetic oligonucleotide
caaaccgcccagatgtcttagtgctacagg

SEQ ID NO: 109180 - DNA, 30 bp, Artificial Sequence
  Description of Artificial Sequence: Synthetic oligonucleotide
aaaccgcccagatgtcttagtgctacaggg

SEQ ID NO: 109181 - DNA, 29 bp, Artificial Sequence
  Description of Artificial Sequence: Synthetic oligonucleotide
aaccgcccagatgtcttagtgctacaggg

SEQ ID NO: 109182 - DNA, 28 bp, Artificial Sequence
  Description of Artificial Sequence: Synthetic oligonucleotide
accgcccagatgtcttagtgctacaggg

SEQ ID NO: 109183 - DNA, 27 bp, Artificial Sequence
  Description of Artificial Sequence: Synthetic oligonucleotide
ccgcccagatgtcttagtgctacaggg

SEQ ID NO: 109184 - DNA, 27 bp, Artificial Sequence
  Description of Artificial Sequence: Synthetic oligonucleotide
cgcccagatgtcttagtgctacagggg

SEQ ID NO: 109185 - DNA, 27 bp, Artificial Sequence
  Description of Artificial Sequence: Synthetic oligonucleotide
gcccagatgtcttagtgctacaggggc

SEQ ID NO: 109186 - DNA, 28 bp, Artificial Sequence
  Description of Artificial Sequence: Synthetic oligonucleotide
cccagatgtcttagtgctacaggggctg

SEQ ID NO: 109187 - DNA, 29 bp, Artificial Sequence
  Description of Artificial Sequence: Synthetic oligonucleotide
ccagatgtcttagtgctacaggggctgac

SEQ ID NO: 109188 - DNA, 32 bp, Artificial Sequence
  Description of Artificial Sequence: Synthetic oligonucleotide
cagatgtcttagtgctacaggggctgacattc

SEQ ID NO: 109189 - DNA, 33 bp, Artificial Sequence
  Description of Artificial Sequence: Synthetic oligonucleotide
agatgtcttagtgctacaggggctgacattcac

SEQ ID NO: 109190 - DNA, 32 bp, Artificial Sequence
  Description of Artificial Sequence: Synthetic oligonucleotide
gatgtcttagtgctacaggggctgacattcac

SEQ ID NO: 109191 - DNA, 32 bp, Artificial Sequence
  Description of Artificial Sequence: Synthetic oligonucleotide
atgtcttagtgctacaggggctgacattcacc

SEQ ID NO: 109192 - DNA, 31 bp, Artificial Sequence
  Description of Artificial Sequence: Synthetic oligonucleotide
tgtcttagtgctacaggggctgacattcacc

SEQ ID NO: 109193 - DNA, 30 bp, Artificial Sequence
  Description of Artificial Sequence: Synthetic oligonucleotide
gtcttagtgctacaggggctgacattcacc

SEQ ID NO: 109194 - DNA, 30 bp, Artificial Sequence
  Description of Artificial Sequence: Synthetic oligonucleotide
tcttagtgctacaggggctgacattcaccc

SEQ ID NO: 109195 - DNA, 29 bp, Artificial Sequence
  Description of Artificial Sequence: Synthetic oligonucleotide
cttagtgctacaggggctgacattcaccc

SEQ ID NO: 109196 - DNA, 31 bp, Artificial Sequence
  Description of Artificial Sequence: Synthetic oligonucleotide
ttagtgctacaggggctgacattcaccctac

SEQ ID NO: 109197 - DNA, 30 bp, Artificial Sequence
  Description of Artificial Sequence: Synthetic oligonucleotide
tagtgctacaggggctgacattcaccctac

SEQ ID NO: 109198 - DNA, 29 bp, Artificial Sequence
  Description of Artificial Sequence: Synthetic oligonucleotide
agtgctacaggggctgacattcaccctac

SEQ ID NO: 109199 - DNA, 28 bp, Artificial Sequence
  Description of Artificial Sequence: Synthetic oligonucleotide
gtgctacaggggctgacattcaccctac

SEQ ID NO: 109200 - DNA, 28 bp, Artificial Sequence
  Description of Artificial Sequence: Synthetic oligonucleotide
tgctacaggggctgacattcaccctacg

SEQ ID NO: 109201 - DNA, 27 bp, Artificial Sequence
  Description of Artificial Sequence: Synthetic oligonucleotide
gctacaggggctgacattcaccctacg

SEQ ID NO: 109202 - DNA, 27 bp, Artificial Sequence
  Description of Artificial Sequence: Synthetic oligonucleotide
ctacaggggctgacattcaccctacgc

SEQ ID NO: 109203 - DNA, 27 bp, Artificial Sequence
  Description of Artificial Sequence: Synthetic oligonucleotide
tacaggggctgacattcaccctacgcc

SEQ ID NO: 109204 - DNA, 26 bp, Artificial Sequence
  Description of Artificial Sequence: Synthetic oligonucleotide
acaggggctgacattcaccctacgcc

SEQ ID NO: 109205 - DNA, 25 bp, Artificial Sequence
  Description of Artificial Sequence: Synthetic oligonucleotide
caggggctgacattcaccctacgcc

SEQ ID NO: 109206 - DNA, 26 bp, Artificial Sequence
  Description of Artificial Sequence: Synthetic oligonucleotide
aggggctgacattcaccctacgccct

SEQ ID NO: 109207 - DNA, 25 bp, Artificial Sequence
  Description of Artificial Sequence: Synthetic oligonucleotide
ggggctgacattcaccctacgccct

SEQ ID NO: 109208 - DNA, 25 bp, Artificial Sequence
  Description of Artificial Sequence: Synthetic oligonucleotide
gggctgacattcaccctacgccctg

SEQ ID NO: 109209 - DNA, 25 bp, Artificial Sequence
  Description of Artificial Sequence: Synthetic oligonucleotide
ggctgacattcaccctacgccctgg

SEQ ID NO: 109210 - DNA, 25 bp, Artificial Sequence
  Description of Artificial Sequence: Synthetic oligonucleotide
gctgacattcaccctacgccctggc

SEQ ID NO: 109211 - DNA, 26 bp, Artificial Sequence
  Description of Artificial Sequence: Synthetic oligonucleotide
ctgacattcaccctacgccctggcga

SEQ ID NO: 109212 - DNA, 26 bp, Artificial Sequence
  Description of Artificial Sequence: Synthetic oligonucleotide
tgacattcaccctacgccctggcgag

SEQ ID NO: 109213 - DNA, 25 bp, Artificial Sequence
  Description of Artificial Sequence: Synthetic oligonucleotide
gacattcaccctacgccctggcgag

SEQ ID NO: 109214 - DNA, 26 bp, Artificial Sequence
  Description of Artificial Sequence: Synthetic oligonucleotide
acattcaccctacgccctggcgaggt

SEQ ID NO: 109215 - DNA, 25 bp, Artificial Sequence
  Description of Artificial Sequence: Synthetic oligonucleotide
cattcaccctacgccctggcgaggt

SEQ ID NO: 109216 - DNA, 26 bp, Artificial Sequence
  Description of Artificial Sequence: Synthetic oligonucleotide
attcaccctacgccctggcgaggtga

SEQ ID NO: 109217 - DNA, 25 bp, Artificial Sequence
  Description of Artificial Sequence: Synthetic oligonucleotide
ttcaccctacgccctggcgaggtga

SEQ ID NO: 109218 - DNA, 24 bp, Artificial Sequence
  Description of Artificial Sequence: Synthetic oligonucleotide
tcaccctacgccctggcgaggtga

SEQ ID NO: 109219 - DNA, 23 bp, Artificial Sequence
  Description of Artificial Sequence: Synthetic oligonucleotide
caccctacgccctggcgaggtga

SEQ ID NO: 109220 - DNA, 23 bp, Artificial Sequence
  Description of Artificial Sequence: Synthetic oligonucleotide
accctacgccctggcgaggtgac

SEQ ID NO: 109221 - DNA, 22 bp, Artificial Sequence
  Description of Artificial Sequence: Synthetic oligonucleotide
ccctacgccctggcgaggtgac

SEQ ID NO: 109222 - DNA, 22 bp, Artificial Sequence
  Description of Artificial Sequence: Synthetic oligonucleotide
cctacgccctggcgaggtgacg

SEQ ID NO: 109223 - DNA, 22 bp, Artificial Sequence
  Description of Artificial Sequence: Synthetic oligonucleotide
ctacgccctggcgaggtgacgg

SEQ ID NO: 109224 - DNA, 22 bp, Artificial Sequence
  Description of Artificial Sequence: Synthetic oligonucleotide
tacgccctggcgaggtgacggc

SEQ ID NO: 109225 - DNA, 21 bp, Artificial Sequence
  Description of Artificial Sequence: Synthetic oligonucleotide
acgccctggcgaggtgacggc

SEQ ID NO: 109226 - DNA, 20 bp, Artificial Sequence
  Description of Artificial Sequence: Synthetic oligonucleotide
cgccctggcgaggtgacggc

SEQ ID NO: 109227 - DNA, 20 bp, Artificial Sequence
  Description of Artificial Sequence: Synthetic oligonucleotide
gccctggcgaggtgacggcg

SEQ ID NO: 109228 - DNA, 21 bp, Artificial Sequence
  Description of Artificial Sequence: Synthetic oligonucleotide
ccctggcgaggtgacggcgct

SEQ ID NO: 109229 - DNA, 21 bp, Artificial Sequence
  Description of Artificial Sequence: Synthetic oligonucleotide
cctggcgaggtgacggcgctg

SEQ ID NO: 109230 - DNA, 22 bp, Artificial Sequence
  Description of Artificial Sequence: Synthetic oligonucleotide
ctggcgaggtgacggcgctggt

SEQ ID NO: 109231 - DNA, 22 bp, Artificial Sequence
  Description of Artificial Sequence: Synthetic oligonucleotide
tggcgaggtgacggcgctggtg

SEQ ID NO: 109232 - DNA, 21 bp, Artificial Sequence
  Description of Artificial Sequence: Synthetic oligonucleotide
ggcgaggtgacggcgctggtg

SEQ ID NO: 109233 - DNA, 21 bp, Artificial Sequence
  Description of Artificial Sequence: Synthetic oligonucleotide
gcgaggtgacggcgctggtgg

SEQ ID NO: 109234 - DNA, 22 bp, Artificial Sequence
  Description of Artificial Sequence: Synthetic oligonucleotide
cgaggtgacggcgctggtggga

SEQ ID NO: 109235 - DNA, 22 bp, Artificial Sequence
  Description of Artificial Sequence: Synthetic oligonucleotide
gaggtgacggcgctggtgggac

SEQ ID NO: 109236 - DNA, 22 bp, Artificial Sequence
  Description of Artificial Sequence: Synthetic oligonucleotide
aggtgacggcgctggtgggacc

SEQ ID NO: 109237 - DNA, 21 bp, Artificial Sequence
  Description of Artificial Sequence: Synthetic oligonucleotide
ggtgacggcgctggtgggacc

SEQ ID NO: 109238 - DNA, 24 bp, Artificial Sequence
  Description of Artificial Sequence: Synthetic oligonucleotide
gtgacggcgctggtgggacccaat

SEQ ID NO: 109239 - DNA, 24 bp, Artificial Sequence
  Description of Artificial Sequence: Synthetic oligonucleotide
tgacggcgctggtgggacccaatg

SEQ ID NO: 109240 - DNA, 23 bp, Artificial Sequence
  Description of Artificial Sequence: Synthetic oligonucleotide
gacggcgctggtgggacccaatg

SEQ ID NO: 109241 - DNA, 23 bp, Artificial Sequence
  Description of Artificial Sequence: Synthetic oligonucleotide
acggcgctggtgggacccaatgg

SEQ ID NO: 109242 - DNA, 22 bp, Artificial Sequence
  Description of Artificial Sequence: Synthetic oligonucleotide
cggcgctggtgggacccaatgg

SEQ ID NO: 109243 - DNA, 23 bp, Artificial Sequence
  Description of Artificial Sequence: Synthetic oligonucleotide
ggcgctggtgggacccaatgggt

SEQ ID NO: 109244 - DNA, 24 bp, Artificial Sequence
  Description of Artificial Sequence: Synthetic oligonucleotide
gcgctggtgggacccaatgggtct

SEQ ID NO: 109245 - DNA, 24 bp, Artificial Sequence
  Description of Artificial Sequence: Synthetic oligonucleotide
cgctggtgggacccaatgggtctg

SEQ ID NO: 109246 - DNA, 24 bp, Artificial Sequence
  Description of Artificial Sequence: Synthetic oligonucleotide
gctggtgggacccaatgggtctgg

SEQ ID NO: 109247 - DNA, 26 bp, Artificial Sequence
  Description of Artificial Sequence: Synthetic oligonucleotide
ctggtgggacccaatgggtctgggaa

SEQ ID NO: 109248 - DNA, 27 bp, Artificial Sequence
  Description of Artificial Sequence: Synthetic oligonucleotide
tggtgggacccaatgggtctgggaaga

SEQ ID NO: 109249 - DNA, 26 bp, Artificial Sequence
  Description of Artificial Sequence: Synthetic oligonucleotide
ggtgggacccaatgggtctgggaaga

SEQ ID NO: 109250 - DNA, 26 bp, Artificial Sequence
  Description of Artificial Sequence: Synthetic oligonucleotide
gtgggacccaatgggtctgggaagag

SEQ ID NO: 109251 - DNA, 27 bp, Artificial Sequence
  Description of Artificial Sequence: Synthetic oligonucleotide
tgggacccaatgggtctgggaagagca

SEQ ID NO: 109252 - DNA, 26 bp, Artificial Sequence
  Description of Artificial Sequence: Synthetic oligonucleotide
gggacccaatgggtctgggaagagca

SEQ ID NO: 109253 - DNA, 27 bp, Artificial Sequence
  Description of Artificial Sequence: Synthetic oligonucleotide
ggacccaatgggtctgggaagagcaca

SEQ ID NO: 109254 - DNA, 27 bp, Artificial Sequence
  Description of Artificial Sequence: Synthetic oligonucleotide
gacccaatgggtctgggaagagcacag

SEQ ID NO: 109255 - DNA, 28 bp, Artificial Sequence
  Description of Artificial Sequence: Synthetic oligonucleotide
acccaatgggtctgggaagagcacagtg

SEQ ID NO: 109256 - DNA, 27 bp, Artificial Sequence
  Description of Artificial Sequence: Synthetic oligonucleotide
cccaatgggtctgggaagagcacagtg

SEQ ID NO: 109257 - DNA, 27 bp, Artificial Sequence
  Description of Artificial Sequence: Synthetic oligonucleotide
ccaatgggtctgggaagagcacagtgg

SEQ ID NO: 109258 - DNA, 27 bp, Artificial Sequence
  Description of Artificial Sequence: Synthetic oligonucleotide
caatgggtctgggaagagcacagtggc

SEQ ID NO: 109259 - DNA, 28 bp, Artificial Sequence
  Description of Artificial Sequence: Synthetic oligonucleotide
aatgggtctgggaagagcacagtggctg

SEQ ID NO: 109260 - DNA, 27 bp, Artificial Sequence
  Description of Artificial Sequence: Synthetic oligonucleotide
atgggtctgggaagagcacagtggctg

SEQ ID NO: 109261 - DNA, 26 bp, Artificial Sequence
  Description of Artificial Sequence: Synthetic oligonucleotide
tgggtctgggaagagcacagtggctg

SEQ ID NO: 109262 - DNA, 25 bp, Artificial Sequence
  Description of Artificial Sequence: Synthetic oligonucleotide
gggtctgggaagagcacagtggctg

SEQ ID NO: 109263 - DNA, 25 bp, Artificial Sequence
  Description of Artificial Sequence: Synthetic oligonucleotide
ggtctgggaagagcacagtggctgc

SEQ ID NO: 109264 - DNA, 25 bp, Artificial Sequence
  Description of Artificial Sequence: Synthetic oligonucleotide
gtctgggaagagcacagtggctgcc

SEQ ID NO: 109265 - DNA, 26 bp, Artificial Sequence
  Description of Artificial Sequence: Synthetic oligonucleotide
tctgggaagagcacagtggctgccct

SEQ ID NO: 109266 - DNA, 25 bp, Artificial Sequence
  Description of Artificial Sequence: Synthetic oligonucleotide
ctgggaagagcacagtggctgccct

SEQ ID NO: 109267 - DNA, 25 bp, Artificial Sequence
  Description of Artificial Sequence: Synthetic oligonucleotide
tgggaagagcacagtggctgccctg

SEQ ID NO: 109268 - DNA, 24 bp, Artificial Sequence
  Description of Artificial Sequence: Synthetic oligonucleotide
gggaagagcacagtggctgccctg

SEQ ID NO: 109269 - DNA, 25 bp, Artificial Sequence
  Description of Artificial Sequence: Synthetic oligonucleotide
ggaagagcacagtggctgccctgct

SEQ ID NO: 109270 - DNA, 25 bp, Artificial Sequence
  Description of Artificial Sequence: Synthetic oligonucleotide
gaagagcacagtggctgccctgctg

SEQ ID NO: 109271 - DNA, 26 bp, Artificial Sequence
  Description of Artificial Sequence: Synthetic oligonucleotide
aagagcacagtggctgccctgctgca

SEQ ID NO: 109272 - DNA, 25 bp, Artificial Sequence
  Description of Artificial Sequence: Synthetic oligonucleotide
agagcacagtggctgccctgctgca

SEQ ID NO: 109273 - DNA, 24 bp, Artificial Sequence
  Description of Artificial Sequence: Synthetic oligonucleotide
gagcacagtggctgccctgctgca

SEQ ID NO: 109274 - DNA, 27 bp, Artificial Sequence
  Description of Artificial Sequence: Synthetic oligonucleotide
agcacagtggctgccctgctgcagaat

SEQ ID NO: 109275 - DNA, 26 bp, Artificial Sequence
  Description of Artificial Sequence: Synthetic oligonucleotide
gcacagtggctgccctgctgcagaat

SEQ ID NO: 109276 - DNA, 27 bp, Artificial Sequence
  Description of Artificial Sequence: Synthetic oligonucleotide
cacagtggctgccctgctgcagaatct

SEQ ID NO: 109277 - DNA, 27 bp, Artificial Sequence
  Description of Artificial Sequence: Synthetic oligonucleotide
acagtggctgccctgctgcagaatctg

SEQ ID NO: 109278 - DNA, 27 bp, Artificial Sequence
  Description of Artificial Sequence: Synthetic oligonucleotide
cagtggctgccctgctgcagaatctgt

SEQ ID NO: 109279 - DNA, 28 bp, Artificial Sequence
  Description of Artificial Sequence: Synthetic oligonucleotide
agtggctgccctgctgcagaatctgtac

SEQ ID NO: 109280 - DNA, 27 bp, Artificial Sequence
  Description of Artificial Sequence: Synthetic oligonucleotide
gtggctgccctgctgcagaatctgtac

SEQ ID NO: 109281 - DNA, 27 bp, Artificial Sequence
  Description of Artificial Sequence: Synthetic oligonucleotide
tggctgccctgctgcagaatctgtacc

SEQ ID NO: 109282 - DNA, 27 bp, Artificial Sequence
  Description of Artificial Sequence: Synthetic oligonucleotide
ggctgccctgctgcagaatctgtacca

SEQ ID NO: 109283 - DNA, 27 bp, Artificial Sequence
  Description of Artificial Sequence: Synthetic oligonucleotide
gctgccctgctgcagaatctgtaccag

SEQ ID NO: 109284 - DNA, 27 bp, Artificial Sequence
  Description of Artificial Sequence: Synthetic oligonucleotide
ctgccctgctgcagaatctgtaccagc

SEQ ID NO: 109285 - DNA, 27 bp, Artificial Sequence
  Description of Artificial Sequence: Synthetic oligonucleotide
tgccctgctgcagaatctgtaccagcc

SEQ ID NO: 109286 - DNA, 26 bp, Artificial Sequence
  Description of Artificial Sequence: Synthetic oligonucleotide
gccctgctgcagaatctgtaccagcc

SEQ ID NO: 109287 - DNA, 27 bp, Artificial Sequence
  Description of Artificial Sequence: Synthetic oligonucleotide
ccctgctgcagaatctgtaccagccca

SEQ ID NO: 109288 - DNA, 27 bp, Artificial Sequence
  Description of Artificial Sequence: Synthetic oligonucleotide
cctgctgcagaatctgtaccagcccac

SEQ ID NO: 109289 - DNA, 27 bp, Artificial Sequence
  Description of Artificial Sequence: Synthetic oligonucleotide
ctgctgcagaatctgtaccagcccacc

SEQ ID NO: 109290 - DNA, 27 bp, Artificial Sequence
  Description of Artificial Sequence: Synthetic oligonucleotide
tgctgcagaatctgtaccagcccaccg

SEQ ID NO: 109291 - DNA, 26 bp, Artificial Sequence
  Description of Artificial Sequence: Synthetic oligonucleotide
gctgcagaatctgtaccagcccaccg

SEQ ID NO: 109292 - DNA, 26 bp, Artificial Sequence
  Description of Artificial Sequence: Synthetic oligonucleotide
ctgcagaatctgtaccagcccaccgg

SEQ ID NO: 109293 - DNA, 26 bp, Artificial Sequence
  Description of Artificial Sequence: Synthetic oligonucleotide
tgcagaatctgtaccagcccaccggg

SEQ ID NO: 109294 - DNA, 25 bp, Artificial Sequence
  Description of Artificial Sequence: Synthetic oligonucleotide
gcagaatctgtaccagcccaccggg

SEQ ID NO: 109295 - DNA, 25 bp, Artificial Sequence
  Description of Artificial Sequence: Synthetic oligonucleotide
cagaatctgtaccagcccaccgggg

SEQ ID NO: 109296 - DNA, 26 bp, Artificial Sequence
  Description of Artificial Sequence: Synthetic oligonucleotide
agaatctgtaccagcccaccggggga

SEQ ID NO: 109297 - DNA, 25 bp, Artificial Sequence
  Description of Artificial Sequence: Synthetic oligonucleotide
gaatctgtaccagcccaccggggga

SEQ ID NO: 109298 - DNA, 26 bp, Artificial Sequence
  Description of Artificial Sequence: Synthetic oligonucleotide
aatctgtaccagcccaccgggggaca

SEQ ID NO: 109299 - DNA, 25 bp, Artificial Sequence
  Description of Artificial Sequence: Synthetic oligonucleotide
atctgtaccagcccaccgggggaca

SEQ ID NO: 109300 - DNA, 24 bp, Artificial Sequence
  Description of Artificial Sequence: Synthetic oligonucleotide
tctgtaccagcccaccgggggaca

SEQ ID NO: 109301 - DNA, 23 bp, Artificial Sequence
  Description of Artificial Sequence: Synthetic oligonucleotide
ctgtaccagcccaccgggggaca

SEQ ID NO: 109302 - DNA, 23 bp, Artificial Sequence
  Description of Artificial Sequence: Synthetic oligonucleotide
tgtaccagcccaccgggggacag

SEQ ID NO: 109303 - DNA, 22 bp, Artificial Sequence
  Description of Artificial Sequence: Synthetic oligonucleotide
gtaccagcccaccgggggacag

SEQ ID NO: 109304 - DNA, 23 bp, Artificial Sequence
  Description of Artificial Sequence: Synthetic oligonucleotide
taccagcccaccgggggacagct

SEQ ID NO: 109305 - DNA, 22 bp, Artificial Sequence
  Description of Artificial Sequence: Synthetic oligonucleotide
accagcccaccgggggacagct

SEQ ID NO: 109306 - DNA, 21 bp, Artificial Sequence
  Description of Artificial Sequence: Synthetic oligonucleotide
ccagcccaccgggggacagct

SEQ ID NO: 109307 - DNA, 21 bp, Artificial Sequence
  Description of Artificial Sequence: Synthetic oligonucleotide
cagcccaccgggggacagctg

SEQ ID NO: 109308 - DNA, 22 bp, Artificial Sequence
  Description of Artificial Sequence: Synthetic oligonucleotide
agcccaccgggggacagctgct

SEQ ID NO: 109309 - DNA, 21 bp, Artificial Sequence
  Description of Artificial Sequence: Synthetic oligonucleotide
gcccaccgggggacagctgct

SEQ ID NO: 109310 - DNA, 23 bp, Artificial Sequence
  Description of Artificial Sequence: Synthetic oligonucleotide
cccaccgggggacagctgctgtt

SEQ ID NO: 109311 - DNA, 23 bp, Artificial Sequence
  Description of Artificial Sequence: Synthetic oligonucleotide
ccaccgggggacagctgctgttg

SEQ ID NO: 109312 - DNA, 25 bp, Artificial Sequence
  Description of Artificial Sequence: Synthetic oligonucleotide
caccgggggacagctgctgttggat

SEQ ID NO: 109313 - DNA, 25 bp, Artificial Sequence
  Description of Artificial Sequence: Synthetic oligonucleotide
accgggggacagctgctgttggatg

SEQ ID NO: 109314 - DNA, 24 bp, Artificial Sequence
  Description of Artificial Sequence: Synthetic oligonucleotide
ccgggggacagctgctgttggatg

SEQ ID NO: 109315 - DNA, 24 bp, Artificial Sequence
  Description of Artificial Sequence: Synthetic oligonucleotide
cgggggacagctgctgttggatgg

SEQ ID NO: 109316 - DNA, 26 bp, Artificial Sequence
  Description of Artificial Sequence: Synthetic oligonucleotide
gggggacagctgctgttggatgggaa

SEQ ID NO: 109317 - DNA, 26 bp, Artificial Sequence
  Description of Artificial Sequence: Synthetic oligonucleotide
ggggacagctgctgttggatgggaag

SEQ ID NO: 109318 - DNA, 26 bp, Artificial Sequence
  Description of Artificial Sequence: Synthetic oligonucleotide
gggacagctgctgttggatgggaagc

SEQ ID NO: 109319 - DNA, 26 bp, Artificial Sequence
  Description of Artificial Sequence: Synthetic oligonucleotide
ggacagctgctgttggatgggaagcc

SEQ ID NO: 109320 - DNA, 26 bp, Artificial Sequence
  Description of Artificial Sequence: Synthetic oligonucleotide
gacagctgctgttggatgggaagccc

SEQ ID NO: 109321 - DNA, 27 bp, Artificial Sequence
  Description of Artificial Sequence: Synthetic oligonucleotide
acagctgctgttggatgggaagcccct

SEQ ID NO: 109322 - DNA, 27 bp, Artificial Sequence
  Description of Artificial Sequence: Synthetic oligonucleotide
cagctgctgttggatgggaagcccctt

SEQ ID NO: 109323 - DNA, 27 bp, Artificial Sequence
  Description of Artificial Sequence: Synthetic oligonucleotide
agctgctgttggatgggaagccccttc

SEQ ID NO: 109324 - DNA, 26 bp, Artificial Sequence
  Description of Artificial Sequence: Synthetic oligonucleotide
gctgctgttggatgggaagccccttc

SEQ ID NO: 109325 - DNA, 26 bp, Artificial Sequence
  Description of Artificial Sequence: Synthetic oligonucleotide
ctgctgttggatgggaagccccttcc

SEQ ID NO: 109326 - DNA, 26 bp, Artificial Sequence
  Description of Artificial Sequence: Synthetic oligonucleotide
tgctgttggatgggaagccccttccc

SEQ ID NO: 109327 - DNA, 25 bp, Artificial Sequence
  Description of Artificial Sequence: Synthetic oligonucleotide
gctgttggatgggaagccccttccc

SEQ ID NO: 109328 - DNA, 27 bp, Artificial Sequence
  Description of Artificial Sequence: Synthetic oligonucleotide
ctgttggatgggaagccccttccccaa

SEQ ID NO: 109329 - DNA, 30 bp, Artificial Sequence
  Description of Artificial Sequence: Synthetic oligonucleotide
tgttggatgggaagccccttccccaatatg

SEQ ID NO: 109330 - DNA, 29 bp, Artificial Sequence
  Description of Artificial Sequence: Synthetic oligonucleotide
gttggatgggaagccccttccccaatatg

SEQ ID NO: 109331 - DNA, 30 bp, Artificial Sequence
  Description of Artificial Sequence: Synthetic oligonucleotide
ttggatgggaagccccttccccaatatgag

SEQ ID NO: 109332 - DNA, 29 bp, Artificial Sequence
  Description of Artificial Sequence: Synthetic oligonucleotide
tggatgggaagccccttccccaatatgag

SEQ ID NO: 109333 - DNA, 28 bp, Artificial Sequence
  Description of Artificial Sequence: Synthetic oligonucleotide
ggatgggaagccccttccccaatatgag

SEQ ID NO: 109334 - DNA, 28 bp, Artificial Sequence
  Description of Artificial Sequence: Synthetic oligonucleotide
gatgggaagccccttccccaatatgagc

SEQ ID NO: 109335 - DNA, 29 bp, Artificial Sequence
  Description of Artificial Sequence: Synthetic oligonucleotide
atgggaagccccttccccaatatgagcac

SEQ ID NO: 109336 - DNA, 28 bp, Artificial Sequence
  Description of Artificial Sequence: Synthetic oligonucleotide
tgggaagccccttccccaatatgagcac

SEQ ID NO: 109337 - DNA, 27 bp, Artificial Sequence
  Description of Artificial Sequence: Synthetic oligonucleotide
gggaagccccttccccaatatgagcac

SEQ ID NO: 109338 - DNA, 27 bp, Artificial Sequence
  Description of Artificial Sequence: Synthetic oligonucleotide
ggaagccccttccccaatatgagcacc

SEQ ID NO: 109339 - DNA, 27 bp, Artificial Sequence
  Description of Artificial Sequence: Synthetic oligonucleotide
gaagccccttccccaatatgagcaccg

SEQ ID NO: 109340 - DNA, 27 bp, Artificial Sequence
  Description of Artificial Sequence: Synthetic oligonucleotide
aagccccttccccaatatgagcaccgc

SEQ ID NO: 109341 - DNA, 27 bp, Artificial Sequence
  Description of Artificial Sequence: Synthetic oligonucleotide
agccccttccccaatatgagcaccgct

SEQ ID NO: 109342 - DNA, 27 bp, Artificial Sequence
  Description of Artificial Sequence: Synthetic oligonucleotide
gccccttccccaatatgagcaccgcta

SEQ ID NO: 109343 - DNA, 27 bp, Artificial Sequence
  Description of Artificial Sequence: Synthetic oligonucleotide
ccccttccccaatatgagcaccgctac

SEQ ID NO: 109344 - DNA, 27 bp, Artificial Sequence
  Description of Artificial Sequence: Synthetic oligonucleotide
cccttccccaatatgagcaccgctacc

SEQ ID NO: 109345 - DNA, 28 bp, Artificial Sequence
  Description of Artificial Sequence: Synthetic oligonucleotide
ccttccccaatatgagcaccgctacctg

SEQ ID NO: 109346 - DNA, 28 bp, Artificial Sequence
  Description of Artificial Sequence: Synthetic oligonucleotide
cttccccaatatgagcaccgctacctgc

SEQ ID NO: 109347 - DNA, 29 bp, Artificial Sequence
  Description of Artificial Sequence: Synthetic oligonucleotide
ttccccaatatgagcaccgctacctgcac

SEQ ID NO: 109348 - DNA, 28 bp, Artificial Sequence
  Description of Artificial Sequence: Synthetic oligonucleotide
tccccaatatgagcaccgctacctgcac

SEQ ID NO: 109349 - DNA, 27 bp, Artificial Sequence
  Description of Artificial Sequence: Synthetic oligonucleotide
ccccaatatgagcaccgctacctgcac

SEQ ID NO: 109350 - DNA, 28 bp, Artificial Sequence
  Description of Artificial Sequence: Synthetic oligonucleotide
cccaatatgagcaccgctacctgcacag

SEQ ID NO: 109351 - DNA, 28 bp, Artificial Sequence
  Description of Artificial Sequence: Synthetic oligonucleotide
ccaatatgagcaccgctacctgcacagg

SEQ ID NO: 109352 - DNA, 28 bp, Artificial Sequence
  Description of Artificial Sequence: Synthetic oligonucleotide
caatatgagcaccgctacctgcacaggc

SEQ ID NO: 109353 - DNA, 29 bp, Artificial Sequence
  Description of Artificial Sequence: Synthetic oligonucleotide
aatatgagcaccgctacctgcacaggcag

SEQ ID NO: 109354 - DNA, 28 bp, Artificial Sequence
  Description of Artificial Sequence: Synthetic oligonucleotide
atatgagcaccgctacctgcacaggcag

SEQ ID NO: 109355 - DNA, 27 bp, Artificial Sequence
  Description of Artificial Sequence: Synthetic oligonucleotide
tatgagcaccgctacctgcacaggcag

SEQ ID NO: 109356 - DNA, 26 bp, Artificial Sequence
  Description of Artificial Sequence: Synthetic oligonucleotide
atgagcaccgctacctgcacaggcag

SEQ ID NO: 109357 - DNA, 25 bp, Artificial Sequence
  Description of Artificial Sequence: Synthetic oligonucleotide
tgagcaccgctacctgcacaggcag

SEQ ID NO: 109358 - DNA, 24 bp, Artificial Sequence
  Description of Artificial Sequence: Synthetic oligonucleotide
gagcaccgctacctgcacaggcag

SEQ ID NO: 109359 - DNA, 25 bp, Artificial Sequence
  Description of Artificial Sequence: Synthetic oligonucleotide
agcaccgctacctgcacaggcaggt

SEQ ID NO: 109360 - DNA, 24 bp, Artificial Sequence
  Description of Artificial Sequence: Synthetic oligonucleotide
gcaccgctacctgcacaggcaggt

SEQ ID NO: 109361 - DNA, 24 bp, Artificial Sequence
  Description of Artificial Sequence: Synthetic oligonucleotide
caccgctacctgcacaggcaggtg

SEQ ID NO: 109362 - DNA, 24 bp, Artificial Sequence
  Description of Artificial Sequence: Synthetic oligonucleotide
accgctacctgcacaggcaggtgg

SEQ ID NO: 109363 - DNA, 23 bp, Artificial Sequence
  Description of Artificial Sequence: Synthetic oligonucleotide
ccgctacctgcacaggcaggtgg

SEQ ID NO: 109364 - DNA, 24 bp, Artificial Sequence
  Description of Artificial Sequence: Synthetic oligonucleotide
cgctacctgcacaggcaggtggct

SEQ ID NO: 109365 - DNA, 24 bp, Artificial Sequence
  Description of Artificial Sequence: Synthetic oligonucleotide
gctacctgcacaggcaggtggctg

SEQ ID NO: 109366 - DNA, 25 bp, Artificial Sequence
  Description of Artificial Sequence: Synthetic oligonucleotide
ctacctgcacaggcaggtggctgca

SEQ ID NO: 109367 - DNA, 26 bp, Artificial Sequence
  Description of Artificial Sequence: Synthetic oligonucleotide
tacctgcacaggcaggtggctgcagt

SEQ ID NO: 109368 - DNA, 25 bp, Artificial Sequence
  Description of Artificial Sequence: Synthetic oligonucleotide
acctgcacaggcaggtggctgcagt

SEQ ID NO: 109369 - DNA, 24 bp, Artificial Sequence
  Description of Artificial Sequence: Synthetic oligonucleotide
cctgcacaggcaggtggctgcagt

SEQ ID NO: 109370 - DNA, 24 bp, Artificial Sequence
  Description of Artificial Sequence: Synthetic oligonucleotide
ctgcacaggcaggtggctgcagtg

SEQ ID NO: 109371 - DNA, 24 bp, Artificial Sequence
  Description of Artificial Sequence: Synthetic oligonucleotide
tgcacaggcaggtggctgcagtgg

SEQ ID NO: 109372 - DNA, 23 bp, Artificial Sequence
  Description of Artificial Sequence: Synthetic oligonucleotide
gcacaggcaggtggctgcagtgg

SEQ ID NO: 109373 - DNA, 24 bp, Artificial Sequence
  Description of Artificial Sequence: Synthetic oligonucleotide
cacaggcaggtggctgcagtggga

SEQ ID NO: 109374 - DNA, 26 bp, Artificial Sequence
  Description of Artificial Sequence: Synthetic oligonucleotide
acaggcaggtggctgcagtgggacaa

SEQ ID NO: 109375 - DNA, 25 bp, Artificial Sequence
  Description of Artificial Sequence: Synthetic oligonucleotide
caggcaggtggctgcagtgggacaa

SEQ ID NO: 109376 - DNA, 26 bp, Artificial Sequence
  Description of Artificial Sequence: Synthetic oligonucleotide
aggcaggtggctgcagtgggacaaga

SEQ ID NO: 109377 - DNA, 25 bp, Artificial Sequence
  Description of Artificial Sequence: Synthetic oligonucleotide
ggcaggtggctgcagtgggacaaga

SEQ ID NO: 109378 - DNA, 25 bp, Artificial Sequence
  Description of Artificial Sequence: Synthetic oligonucleotide
gcaggtggctgcagtgggacaagag

SEQ ID NO: 109379 - DNA, 25 bp, Artificial Sequence
  Description of Artificial Sequence: Synthetic oligonucleotide
caggtggctgcagtgggacaagagc

SEQ ID NO: 109380 - DNA, 26 bp, Artificial Sequence
  Description of Artificial Sequence: Synthetic oligonucleotide
aggtggctgcagtgggacaagagcca

SEQ ID NO: 109381 - DNA, 25 bp, Artificial Sequence
  Description of Artificial Sequence: Synthetic oligonucleotide
ggtggctgcagtgggacaagagcca

SEQ ID NO: 109382 - DNA, 26 bp, Artificial Sequence
  Description of Artificial Sequence: Synthetic oligonucleotide
gtggctgcagtgggacaagagccaca

SEQ ID NO: 109383 - DNA, 26 bp, Artificial Sequence
  Description of Artificial Sequence: Synthetic oligonucleotide
tggctgcagtgggacaagagccacag

SEQ ID NO: 109384 - DNA, 25 bp, Artificial Sequence
  Description of Artificial Sequence: Synthetic oligonucleotide
ggctgcagtgggacaagagccacag

SEQ ID NO: 109385 - DNA, 27 bp, Artificial Sequence
  Description of Artificial Sequence: Synthetic oligonucleotide
gctgcagtgggacaagagccacaggta

SEQ ID NO: 109386 - DNA, 30 bp, Artificial Sequence
  Description of Artificial Sequence: Synthetic oligonucleotide
ctgcagtgggacaagagccacaggtatttg

SEQ ID NO: 109387 - DNA, 30 bp, Artificial Sequence
  Description of Artificial Sequence: Synthetic oligonucleotide
tgcagtgggacaagagccacaggtatttgg

SEQ ID NO: 109388 - DNA, 29 bp, Artificial Sequence
  Description of Artificial Sequence: Synthetic oligonucleotide
gcagtgggacaagagccacaggtatttgg

SEQ ID NO: 109389 - DNA, 31 bp, Artificial Sequence
  Description of Artificial Sequence: Synthetic oligonucleotide
cagtgggacaagagccacaggtatttggaag

SEQ ID NO: 109390 - DNA, 33 bp, Artificial Sequence
  Description of Artificial Sequence: Synthetic oligonucleotide
agtgggacaagagccacaggtatttggaagaag

SEQ ID NO: 109391 - DNA, 32 bp, Artificial Sequence
  Description of Artificial Sequence: Synthetic oligonucleotide
gtgggacaagagccacaggtatttggaagaag

SEQ ID NO: 109392 - DNA, 33 bp, Artificial Sequence
  Description of Artificial Sequence: Synthetic oligonucleotide
tgggacaagagccacaggtatttggaagaagtc

SEQ ID NO: 109393 - DNA, 32 bp, Artificial Sequence
  Description of Artificial Sequence: Synthetic oligonucleotide
gggacaagagccacaggtatttggaagaagtc

SEQ ID NO: 109394 - DNA, 34 bp, Artificial Sequence
  Description of Artificial Sequence: Synthetic oligonucleotide
ggacaagagccacaggtatttggaagaagtcttc

SEQ ID NO: 109395 - DNA, 36 bp, Artificial Sequence
  Description of Artificial Sequence: Synthetic oligonucleotide
gacaagagccacaggtatttggaagaagtcttcaag

SEQ ID NO: 109396 - DNA, 44 bp, Artificial Sequence
  Description of Artificial Sequence: Synthetic oligonucleotide
acaagagccacaggtatttggaagaagtcttcaagaaaatattg

SEQ ID NO: 109397 - DNA, 43 bp, Artificial Sequence
  Description of Artificial Sequence: Synthetic oligonucleotide
caagagccacaggtatttggaagaagtcttcaagaaaatattg

SEQ ID NO: 109398 - DNA, 43 bp, Artificial Sequence
  Description of Artificial Sequence: Synthetic oligonucleotide
aagagccacaggtatttggaagaagtcttcaagaaaatattgc

SEQ ID NO: 109399 - DNA, 42 bp, Artificial Sequence
  Description of Artificial Sequence: Synthetic oligonucleotide
agagccacaggtatttggaagaagtcttcaagaaaatattgc

SEQ ID NO: 109400 - DNA, 41 bp, Artificial Sequence
  Description of Artificial Sequence: Synthetic oligonucleotide
gagccacaggtatttggaagaagtcttcaagaaaatattgc

SEQ ID NO: 109401 - DNA, 41 bp, Artificial Sequence
  Description of Artificial Sequence: Synthetic oligonucleotide
agccacaggtatttggaagaagtcttcaagaaaatattgcc

SEQ ID NO: 109402 - DNA, 40 bp, Artificial Sequence
  Description of Artificial Sequence: Synthetic oligonucleotide
gccacaggtatttggaagaagtcttcaagaaaatattgcc

SEQ ID NO: 109403 - DNA, 43 bp, Artificial Sequence
  Description of Artificial Sequence: Synthetic oligonucleotide
ccacaggtatttggaagaagtcttcaagaaaatattgcctatg

SEQ ID NO: 109404 - DNA, 43 bp, Artificial Sequence
  Description of Artificial Sequence: Synthetic oligonucleotide
cacaggtatttggaagaagtcttcaagaaaatattgcctatgg

SEQ ID NO: 109405 - DNA, 43 bp, Artificial Sequence
  Description of Artificial Sequence: Synthetic oligonucleotide
acaggtatttggaagaagtcttcaagaaaatattgcctatggc

SEQ ID NO: 109406 - DNA, 42 bp, Artificial Sequence
  Description of Artificial Sequence: Synthetic oligonucleotide
caggtatttggaagaagtcttcaagaaaatattgcctatggc

SEQ ID NO: 109407 - DNA, 42 bp, Artificial Sequence
  Description of Artificial Sequence: Synthetic oligonucleotide
aggtatttggaagaagtcttcaagaaaatattgcctatggcc

SEQ ID NO: 109408 - DNA, 41 bp, Artificial Sequence
  Description of Artificial Sequence: Synthetic oligonucleotide
ggtatttggaagaagtcttcaagaaaatattgcctatggcc

SEQ ID NO: 109409 - DNA, 42 bp, Artificial Sequence
  Description of Artificial Sequence: Synthetic oligonucleotide
gtatttggaagaagtcttcaagaaaatattgcctatggcctg

SEQ ID NO: 109410 - DNA, 43 bp, Artificial Sequence
  Description of Artificial Sequence: Synthetic oligonucleotide
tatttggaagaagtcttcaagaaaatattgcctatggcctgac

SEQ ID NO: 109411 - DNA, 42 bp, Artificial Sequence
  Description of Artificial Sequence: Synthetic oligonucleotide
atttggaagaagtcttcaagaaaatattgcctatggcctgac

SEQ ID NO: 109412 - DNA, 41 bp, Artificial Sequence
  Description of Artificial Sequence: Synthetic oligonucleotide
tttggaagaagtcttcaagaaaatattgcctatggcctgac

SEQ ID NO: 109413 - DNA, 40 bp, Artificial Sequence
  Description of Artificial Sequence: Synthetic oligonucleotide
ttggaagaagtcttcaagaaaatattgcctatggcctgac

SEQ ID NO: 109414 - DNA, 39 bp, Artificial Sequence
  Description of Artificial Sequence: Synthetic oligonucleotide
tggaagaagtcttcaagaaaatattgcctatggcctgac

SEQ ID NO: 109415 - DNA, 38 bp, Artificial Sequence
  Description of Artificial Sequence: Synthetic oligonucleotide
ggaagaagtcttcaagaaaatattgcctatggcctgac

SEQ ID NO: 109416 - DNA, 38 bp, Artificial Sequence
  Description of Artificial Sequence: Synthetic oligonucleotide
gaagaagtcttcaagaaaatattgcctatggcctgacc

SEQ ID NO: 109417 - DNA, 38 bp, Artificial Sequence
  Description of Artificial Sequence: Synthetic oligonucleotide
aagaagtcttcaagaaaatattgcctatggcctgaccc

SEQ ID NO: 109418 - DNA, 37 bp, Artificial Sequence
  Description of Artificial Sequence: Synthetic oligonucleotide
agaagtcttcaagaaaatattgcctatggcctgaccc

SEQ ID NO: 109419 - DNA, 36 bp, Artificial Sequence
  Description of Artificial Sequence: Synthetic oligonucleotide
gaagtcttcaagaaaatattgcctatggcctgaccc

SEQ ID NO: 109420 - DNA, 37 bp, Artificial Sequence
  Description of Artificial Sequence: Synthetic oligonucleotide
aagtcttcaagaaaatattgcctatggcctgacccag

SEQ ID NO: 109421 - DNA, 36 bp, Artificial Sequence
  Description of Artificial Sequence: Synthetic oligonucleotide
agtcttcaagaaaatattgcctatggcctgacccag

SEQ ID NO: 109422 - DNA, 35 bp, Artificial Sequence
  Description of Artificial Sequence: Synthetic oligonucleotide
gtcttcaagaaaatattgcctatggcctgacccag

SEQ ID NO: 109423 - DNA, 37 bp, Artificial Sequence
  Description of Artificial Sequence: Synthetic oligonucleotide
tcttcaagaaaatattgcctatggcctgacccagaag

SEQ ID NO: 109424 - DNA, 36 bp, Artificial Sequence
  Description of Artificial Sequence: Synthetic oligonucleotide
cttcaagaaaatattgcctatggcctgacccagaag

SEQ ID NO: 109425 - DNA, 36 bp, Artificial Sequence
  Description of Artificial Sequence: Synthetic oligonucleotide
ttcaagaaaatattgcctatggcctgacccagaagc

SEQ ID NO: 109426 - DNA, 35 bp, Artificial Sequence
  Description of Artificial Sequence: Synthetic oligonucleotide
tcaagaaaatattgcctatggcctgacccagaagc

SEQ ID NO: 109427 - DNA, 34 bp, Artificial Sequence
  Description of Artificial Sequence: Synthetic oligonucleotide
caagaaaatattgcctatggcctgacccagaagc

SEQ ID NO: 109428 - DNA, 34 bp, Artificial Sequence
  Description of Artificial Sequence: Synthetic oligonucleotide
aagaaaatattgcctatggcctgacccagaagcc

SEQ ID NO: 109429 - DNA, 33 bp, Artificial Sequence
  Description of Artificial Sequence: Synthetic oligonucleotide
agaaaatattgcctatggcctgacccagaagcc

SEQ ID NO: 109430 - DNA, 32 bp, Artificial Sequence
  Description of Artificial Sequence: Synthetic oligonucleotide
gaaaatattgcctatggcctgacccagaagcc

SEQ ID NO: 109431 - DNA, 34 bp, Artificial Sequence
  Description of Artificial Sequence: Synthetic oligonucleotide
aaaatattgcctatggcctgacccagaagccaac

SEQ ID NO: 109432 - DNA, 33 bp, Artificial Sequence
  Description of Artificial Sequence: Synthetic oligonucleotide
aaatattgcctatggcctgacccagaagccaac

SEQ ID NO: 109433 - DNA, 32 bp, Artificial Sequence
  Description of Artificial Sequence: Synthetic oligonucleotide
aatattgcctatggcctgacccagaagccaac

SEQ ID NO: 109434 - DNA, 31 bp, Artificial Sequence
  Description of Artificial Sequence: Synthetic oligonucleotide
atattgcctatggcctgacccagaagccaac

SEQ ID NO: 109435 - DNA, 30 bp, Artificial Sequence
  Description of Artificial Sequence: Synthetic oligonucleotide
tattgcctatggcctgacccagaagccaac

SEQ ID NO: 109436 - DNA, 29 bp, Artificial Sequence
  Description of Artificial Sequence: Synthetic oligonucleotide
attgcctatggcctgacccagaagccaac

SEQ ID NO: 109437 - DNA, 28 bp, Artificial Sequence
  Description of Artificial Sequence: Synthetic oligonucleotide
ttgcctatggcctgacccagaagccaac

SEQ ID NO: 109438 - DNA, 27 bp, Artificial Sequence
  Description of Artificial Sequence: Synthetic oligonucleotide
tgcctatggcctgacccagaagccaac

SEQ ID NO: 109439 - DNA, 27 bp, Artificial Sequence
  Description of Artificial Sequence: Synthetic oligonucleotide
gcctatggcctgacccagaagccaact

SEQ ID NO: 109440 - DNA, 29 bp, Artificial Sequence
  Description of Artificial Sequence: Synthetic oligonucleotide
cctatggcctgacccagaagccaactatg

SEQ ID NO: 109441 - DNA, 29 bp, Artificial Sequence
  Description of Artificial Sequence: Synthetic oligonucleotide
ctatggcctgacccagaagccaactatgg

SEQ ID NO: 109442 - DNA, 30 bp, Artificial Sequence
  Description of Artificial Sequence: Synthetic oligonucleotide
tatggcctgacccagaagccaactatggag

SEQ ID NO: 109443 - DNA, 29 bp, Artificial Sequence
  Description of Artificial Sequence: Synthetic oligonucleotide
atggcctgacccagaagccaactatggag

SEQ ID NO: 109444 - DNA, 28 bp, Artificial Sequence
  Description of Artificial Sequence: Synthetic oligonucleotide
tggcctgacccagaagccaactatggag

SEQ ID NO: 109445 - DNA, 27 bp, Artificial Sequence
  Description of Artificial Sequence: Synthetic oligonucleotide
ggcctgacccagaagccaactatggag

SEQ ID NO: 109446 - DNA, 27 bp, Artificial Sequence
  Description of Artificial Sequence: Synthetic oligonucleotide
gcctgacccagaagccaactatggagg

SEQ ID NO: 109447 - DNA, 31 bp, Artificial Sequence
  Description of Artificial Sequence: Synthetic oligonucleotide
cctgacccagaagccaactatggaggaaatc

SEQ ID NO: 109448 - DNA, 32 bp, Artificial Sequence
  Description of Artificial Sequence: Synthetic oligonucleotide
ctgacccagaagccaactatggaggaaatcac

SEQ ID NO: 109449 - DNA, 33 bp, Artificial Sequence
  Description of Artificial Sequence: Synthetic oligonucleotide
tgacccagaagccaactatggaggaaatcacag

SEQ ID NO: 109450 - DNA, 32 bp, Artificial Sequence
  Description of Artificial Sequence: Synthetic oligonucleotide
gacccagaagccaactatggaggaaatcacag

SEQ ID NO: 109451 - DNA, 32 bp, Artificial Sequence
  Description of Artificial Sequence: Synthetic oligonucleotide
acccagaagccaactatggaggaaatcacagc

SEQ ID NO: 109452 - DNA, 31 bp, Artificial Sequence
  Description of Artificial Sequence: Synthetic oligonucleotide
cccagaagccaactatggaggaaatcacagc

SEQ ID NO: 109453 - DNA, 32 bp, Artificial Sequence
  Description of Artificial Sequence: Synthetic oligonucleotide
ccagaagccaactatggaggaaatcacagctg

SEQ ID NO: 109454 - DNA, 32 bp, Artificial Sequence
  Description of Artificial Sequence: Synthetic oligonucleotide
cagaagccaactatggaggaaatcacagctgc

SEQ ID NO: 109455 - DNA, 33 bp, Artificial Sequence
  Description of Artificial Sequence: Synthetic oligonucleotide
agaagccaactatggaggaaatcacagctgctg

SEQ ID NO: 109456 - DNA, 32 bp, Artificial Sequence
  Description of Artificial Sequence: Synthetic oligonucleotide
gaagccaactatggaggaaatcacagctgctg

SEQ ID NO: 109457 - DNA, 32 bp, Artificial Sequence
  Description of Artificial Sequence: Synthetic oligonucleotide
aagccaactatggaggaaatcacagctgctgc

SEQ ID NO: 109458 - DNA, 31 bp, Artificial Sequence
  Description of Artificial Sequence: Synthetic oligonucleotide
agccaactatggaggaaatcacagctgctgc

SEQ ID NO: 109459 - DNA, 30 bp, Artificial Sequence
  Description of Artificial Sequence: Synthetic oligonucleotide
gccaactatggaggaaatcacagctgctgc

SEQ ID NO: 109460 - DNA, 31 bp, Artificial Sequence
  Description of Artificial Sequence: Synthetic oligonucleotide
ccaactatggaggaaatcacagctgctgcag

SEQ ID NO: 109461 - DNA, 35 bp, Artificial Sequence
  Description of Artificial Sequence: Synthetic oligonucleotide
caactatggaggaaatcacagctgctgcagtaaag

SEQ ID NO: 109462 - DNA, 36 bp, Artificial Sequence
  Description of Artificial Sequence: Synthetic oligonucleotide
aactatggaggaaatcacagctgctgcagtaaagtc

SEQ ID NO: 109463 - DNA, 35 bp, Artificial Sequence
  Description of Artificial Sequence: Synthetic oligonucleotide
actatggaggaaatcacagctgctgcagtaaagtc

SEQ ID NO: 109464 - DNA, 34 bp, Artificial Sequence
  Description of Artificial Sequence: Synthetic oligonucleotide
ctatggaggaaatcacagctgctgcagtaaagtc

SEQ ID NO: 109465 - DNA, 35 bp, Artificial Sequence
  Description of Artificial Sequence: Synthetic oligonucleotide
tatggaggaaatcacagctgctgcagtaaagtctg

SEQ ID NO: 109466 - DNA, 34 bp, Artificial Sequence
  Description of Artificial Sequence: Synthetic oligonucleotide
atggaggaaatcacagctgctgcagtaaagtctg

SEQ ID NO: 109467 - DNA, 33 bp, Artificial Sequence
  Description of Artificial Sequence: Synthetic oligonucleotide
tggaggaaatcacagctgctgcagtaaagtctg

SEQ ID NO: 109468 - DNA, 32 bp, Artificial Sequence
  Description of Artificial Sequence: Synthetic oligonucleotide
ggaggaaatcacagctgctgcagtaaagtctg

SEQ ID NO: 109469 - DNA, 32 bp, Artificial Sequence
  Description of Artificial Sequence: Synthetic oligonucleotide
gaggaaatcacagctgctgcagtaaagtctgg

SEQ ID NO: 109470 - DNA, 32 bp, Artificial Sequence
  Description of Artificial Sequence: Synthetic oligonucleotide
aggaaatcacagctgctgcagtaaagtctggg

SEQ ID NO: 109471 - DNA, 31 bp, Artificial Sequence
  Description of Artificial Sequence: Synthetic oligonucleotide
ggaaatcacagctgctgcagtaaagtctggg

SEQ ID NO: 109472 - DNA, 31 bp, Artificial Sequence
  Description of Artificial Sequence: Synthetic oligonucleotide
gaaatcacagctgctgcagtaaagtctgggg

SEQ ID NO: 109473 - DNA, 31 bp, Artificial Sequence
  Description of Artificial Sequence: Synthetic oligonucleotide
aaatcacagctgctgcagtaaagtctggggc

SEQ ID NO: 109474 - DNA, 30 bp, Artificial Sequence
  Description of Artificial Sequence: Synthetic oligonucleotide
aatcacagctgctgcagtaaagtctggggc

SEQ ID NO: 109475 - DNA, 29 bp, Artificial Sequence
  Description of Artificial Sequence: Synthetic oligonucleotide
atcacagctgctgcagtaaagtctggggc

SEQ ID NO: 109476 - DNA, 28 bp, Artificial Sequence
  Description of Artificial Sequence: Synthetic oligonucleotide
tcacagctgctgcagtaaagtctggggc

SEQ ID NO: 109477 - DNA, 27 bp, Artificial Sequence
  Description of Artificial Sequence: Synthetic oligonucleotide
cacagctgctgcagtaaagtctggggc

SEQ ID NO: 109478 - DNA, 27 bp, Artificial Sequence
  Description of Artificial Sequence: Synthetic oligonucleotide
acagctgctgcagtaaagtctggggcc

SEQ ID NO: 109479 - DNA, 26 bp, Artificial Sequence
  Description of Artificial Sequence: Synthetic oligonucleotide
cagctgctgcagtaaagtctggggcc

SEQ ID NO: 109480 - DNA, 27 bp, Artificial Sequence
  Description of Artificial Sequence: Synthetic oligonucleotide
agctgctgcagtaaagtctggggccca

SEQ ID NO: 109481 - DNA, 27 bp, Artificial Sequence
  Description of Artificial Sequence: Synthetic oligonucleotide
gctgctgcagtaaagtctggggcccat

SEQ ID NO: 109482 - DNA, 28 bp, Artificial Sequence
  Description of Artificial Sequence: Synthetic oligonucleotide
ctgctgcagtaaagtctggggcccatag

SEQ ID NO: 109483 - DNA, 31 bp, Artificial Sequence
  Description of Artificial Sequence: Synthetic oligonucleotide
tgctgcagtaaagtctggggcccatagtttc

SEQ ID NO: 109484 - DNA, 30 bp, Artificial Sequence
  Description of Artificial Sequence: Synthetic oligonucleotide
gctgcagtaaagtctggggcccatagtttc

SEQ ID NO: 109485 - DNA, 32 bp, Artificial Sequence
  Description of Artificial Sequence: Synthetic oligonucleotide
ctgcagtaaagtctggggcccatagtttcatc

SEQ ID NO: 109486 - DNA, 33 bp, Artificial Sequence
  Description of Artificial Sequence: Synthetic oligonucleotide
tgcagtaaagtctggggcccatagtttcatctc

SEQ ID NO: 109487 - DNA, 32 bp, Artificial Sequence
  Description of Artificial Sequence: Synthetic oligonucleotide
gcagtaaagtctggggcccatagtttcatctc

SEQ ID NO: 109488 - DNA, 33 bp, Artificial Sequence
  Description of Artificial Sequence: Synthetic oligonucleotide
cagtaaagtctggggcccatagtttcatctctg

SEQ ID NO: 109489 - DNA, 33 bp, Artificial Sequence
  Description of Artificial Sequence: Synthetic oligonucleotide
agtaaagtctggggcccatagtttcatctctgg

SEQ ID NO: 109490 - DNA, 32 bp, Artificial Sequence
  Description of Artificial Sequence: Synthetic oligonucleotide
gtaaagtctggggcccatagtttcatctctgg

SEQ ID NO: 109491 - DNA, 33 bp, Artificial Sequence
  Description of Artificial Sequence: Synthetic oligonucleotide
taaagtctggggcccatagtttcatctctggac

SEQ ID NO: 109492 - DNA, 32 bp, Artificial Sequence
  Description of Artificial Sequence: Synthetic oligonucleotide
aaagtctggggcccatagtttcatctctggac

SEQ ID NO: 109493 - DNA, 31 bp, Artificial Sequence
  Description of Artificial Sequence: Synthetic oligonucleotide
aagtctggggcccatagtttcatctctggac

SEQ ID NO: 109494 - DNA, 30 bp, Artificial Sequence
  Description of Artificial Sequence: Synthetic oligonucleotide
agtctggggcccatagtttcatctctggac

SEQ ID NO: 109495 - DNA, 29 bp, Artificial Sequence
  Description of Artificial Sequence: Synthetic oligonucleotide
gtctggggcccatagtttcatctctggac

SEQ ID NO: 109496 - DNA, 30 bp, Artificial Sequence
  Description of Artificial Sequence: Synthetic oligonucleotide
tctggggcccatagtttcatctctggactc

SEQ ID NO: 109497 - DNA, 29 bp, Artificial Sequence
  Description of Artificial Sequence: Synthetic oligonucleotide
ctggggcccatagtttcatctctggactc

SEQ ID NO: 109498 - DNA, 29 bp, Artificial Sequence
  Description of Artificial Sequence: Synthetic oligonucleotide
tggggcccatagtttcatctctggactcc

SEQ ID NO: 109499 - DNA, 28 bp, Artificial Sequence
  Description of Artificial Sequence: Synthetic oligonucleotide
ggggcccatagtttcatctctggactcc

SEQ ID NO: 109500 - DNA, 28 bp, Artificial Sequence
  Description of Artificial Sequence: Synthetic oligonucleotide
gggcccatagtttcatctctggactccc

SEQ ID NO: 109501 - DNA, 29 bp, Artificial Sequence
  Description of Artificial Sequence: Synthetic oligonucleotide
ggcccatagtttcatctctggactccctc

SEQ ID NO: 109502 - DNA, 30 bp, Artificial Sequence
  Description of Artificial Sequence: Synthetic oligonucleotide
gcccatagtttcatctctggactccctcag

SEQ ID NO: 109503 - DNA, 30 bp, Artificial Sequence
  Description of Artificial Sequence: Synthetic oligonucleotide
cccatagtttcatctctggactccctcagg

SEQ ID NO: 109504 - DNA, 30 bp, Artificial Sequence
  Description of Artificial Sequence: Synthetic oligonucleotide
ccatagtttcatctctggactccctcaggg

SEQ ID NO: 109505 - DNA, 30 bp, Artificial Sequence
  Description of Artificial Sequence: Synthetic oligonucleotide
catagtttcatctctggactccctcagggc

SEQ ID NO: 109506 - DNA, 33 bp, Artificial Sequence
  Description of Artificial Sequence: Synthetic oligonucleotide
atagtttcatctctggactccctcagggctatg

SEQ ID NO: 109507 - DNA, 32 bp, Artificial Sequence
  Description of Artificial Sequence: Synthetic oligonucleotide
tagtttcatctctggactccctcagggctatg

SEQ ID NO: 109508 - DNA, 31 bp, Artificial Sequence
  Description of Artificial Sequence: Synthetic oligonucleotide
agtttcatctctggactccctcagggctatg

SEQ ID NO: 109509 - DNA, 30 bp, Artificial Sequence
  Description of Artificial Sequence: Synthetic oligonucleotide
gtttcatctctggactccctcagggctatg

SEQ ID NO: 109510 - DNA, 31 bp, Artificial Sequence
  Description of Artificial Sequence: Synthetic oligonucleotide
tttcatctctggactccctcagggctatgac

SEQ ID NO: 109511 - DNA, 30 bp, Artificial Sequence
  Description of Artificial Sequence: Synthetic oligonucleotide
ttcatctctggactccctcagggctatgac

SEQ ID NO: 109512 - DNA, 29 bp, Artificial Sequence
  Description of Artificial Sequence: Synthetic oligonucleotide
tcatctctggactccctcagggctatgac

SEQ ID NO: 109513 - DNA, 28 bp, Artificial Sequence
  Description of Artificial Sequence: Synthetic oligonucleotide
catctctggactccctcagggctatgac

SEQ ID NO: 109514 - DNA, 29 bp, Artificial Sequence
  Description of Artificial Sequence: Synthetic oligonucleotide
atctctggactccctcagggctatgacac

SEQ ID NO: 109515 - DNA, 28 bp, Artificial Sequence
  Description of Artificial Sequence: Synthetic oligonucleotide
tctctggactccctcagggctatgacac

SEQ ID NO: 109516 - DNA, 27 bp, Artificial Sequence
  Description of Artificial Sequence: Synthetic oligonucleotide
ctctggactccctcagggctatgacac

SEQ ID NO: 109517 - DNA, 28 bp, Artificial Sequence
  Description of Artificial Sequence: Synthetic oligonucleotide
tctggactccctcagggctatgacacag

SEQ ID NO: 109518 - DNA, 27 bp, Artificial Sequence
  Description of Artificial Sequence: Synthetic oligonucleotide
ctggactccctcagggctatgacacag

SEQ ID NO: 109519 - DNA, 28 bp, Artificial Sequence
  Description of Artificial Sequence: Synthetic oligonucleotide
tggactccctcagggctatgacacagag

SEQ ID NO: 109520 - DNA, 27 bp, Artificial Sequence
  Description of Artificial Sequence: Synthetic oligonucleotide
ggactccctcagggctatgacacagag

SEQ ID NO: 109521 - DNA, 27 bp, Artificial Sequence
  Description of Artificial Sequence: Synthetic oligonucleotide
gactccctcagggctatgacacagagg

SEQ ID NO: 109522 - DNA, 29 bp, Artificial Sequence
  Description of Artificial Sequence: Synthetic oligonucleotide
actccctcagggctatgacacagaggtag

SEQ ID NO: 109523 - DNA, 28 bp, Artificial Sequence
  Description of Artificial Sequence: Synthetic oligonucleotide
ctccctcagggctatgacacagaggtag

SEQ ID NO: 109524 - DNA, 29 bp, Artificial Sequence
  Description of Artificial Sequence: Synthetic oligonucleotide
tccctcagggctatgacacagaggtagac

SEQ ID NO: 109525 - DNA, 28 bp, Artificial Sequence
  Description of Artificial Sequence: Synthetic oligonucleotide
ccctcagggctatgacacagaggtagac

SEQ ID NO: 109526 - DNA, 28 bp, Artificial Sequence
  Description of Artificial Sequence: Synthetic oligonucleotide
cctcagggctatgacacagaggtagacg

SEQ ID NO: 109527 - DNA, 29 bp, Artificial Sequence
  Description of Artificial Sequence: Synthetic oligonucleotide
ctcagggctatgacacagaggtagacgag

SEQ ID NO: 109528 - DNA, 29 bp, Artificial Sequence
  Description of Artificial Sequence: Synthetic oligonucleotide
tcagggctatgacacagaggtagacgagg

SEQ ID NO: 109529 - DNA, 28 bp, Artificial Sequence
  Description of Artificial Sequence: Synthetic oligonucleotide
cagggctatgacacagaggtagacgagg

SEQ ID NO: 109530 - DNA, 28 bp, Artificial Sequence
  Description of Artificial Sequence: Synthetic oligonucleotide
agggctatgacacagaggtagacgaggc

SEQ ID NO: 109531 - DNA, 27 bp, Artificial Sequence
  Description of Artificial Sequence: Synthetic oligonucleotide
gggctatgacacagaggtagacgaggc

SEQ ID NO: 109532 - DNA, 28 bp, Artificial Sequence
  Description of Artificial Sequence: Synthetic oligonucleotide
ggctatgacacagaggtagacgaggctg

SEQ ID NO: 109533 - DNA, 28 bp, Artificial Sequence
  Description of Artificial Sequence: Synthetic oligonucleotide
gctatgacacagaggtagacgaggctgg

SEQ ID NO: 109534 - DNA, 28 bp, Artificial Sequence
  Description of Artificial Sequence: Synthetic oligonucleotide
ctatgacacagaggtagacgaggctggg

SEQ ID NO: 109535 - DNA, 29 bp, Artificial Sequence
  Description of Artificial Sequence: Synthetic oligonucleotide
tatgacacagaggtagacgaggctgggag

SEQ ID NO: 109536 - DNA, 28 bp, Artificial Sequence
  Description of Artificial Sequence: Synthetic oligonucleotide
atgacacagaggtagacgaggctgggag

SEQ ID NO: 109537 - DNA, 27 bp, Artificial Sequence
  Description of Artificial Sequence: Synthetic oligonucleotide
tgacacagaggtagacgaggctgggag

SEQ ID NO: 109538 - DNA, 26 bp, Artificial Sequence
  Description of Artificial Sequence: Synthetic oligonucleotide
gacacagaggtagacgaggctgggag

SEQ ID NO: 109539 - DNA, 26 bp, Artificial Sequence
  Description of Artificial Sequence: Synthetic oligonucleotide
acacagaggtagacgaggctgggagc

SEQ ID NO: 109540 - DNA, 25 bp, Artificial Sequence
  Description of Artificial Sequence: Synthetic oligonucleotide
cacagaggtagacgaggctgggagc

SEQ ID NO: 109541 - DNA, 26 bp, Artificial Sequence
  Description of Artificial Sequence: Synthetic oligonucleotide
acagaggtagacgaggctgggagcca

SEQ ID NO: 109542 - DNA, 25 bp, Artificial Sequence
  Description of Artificial Sequence: Synthetic oligonucleotide
cagaggtagacgaggctgggagcca

SEQ ID NO: 109543 - DNA, 25 bp, Artificial Sequence
  Description of Artificial Sequence: Synthetic oligonucleotide
agaggtagacgaggctgggagccag

SEQ ID NO: 109544 - DNA, 24 bp, Artificial Sequence
  Description of Artificial Sequence: Synthetic oligonucleotide
gaggtagacgaggctgggagccag

SEQ ID NO: 109545 - DNA, 25 bp, Artificial Sequence
  Description of Artificial Sequence: Synthetic oligonucleotide
aggtagacgaggctgggagccagct

SEQ ID NO: 109546 - DNA, 24 bp, Artificial Sequence
  Description of Artificial Sequence: Synthetic oligonucleotide
ggtagacgaggctgggagccagct

SEQ ID NO: 109547 - DNA, 25 bp, Artificial Sequence
  Description of Artificial Sequence: Synthetic oligonucleotide
gtagacgaggctgggagccagctgt

SEQ ID NO: 109548 - DNA, 26 bp, Artificial Sequence
  Description of Artificial Sequence: Synthetic oligonucleotide
tagacgaggctgggagccagctgtca

SEQ ID NO: 109549 - DNA, 25 bp, Artificial Sequence
  Description of Artificial Sequence: Synthetic oligonucleotide
agacgaggctgggagccagctgtca

SEQ ID NO: 109550 - DNA, 24 bp, Artificial Sequence
  Description of Artificial Sequence: Synthetic oligonucleotide
gacgaggctgggagccagctgtca

SEQ ID NO: 109551 - DNA, 24 bp, Artificial Sequence
  Description of Artificial Sequence: Synthetic oligonucleotide
acgaggctgggagccagctgtcag

SEQ ID NO: 109552 - DNA, 23 bp, Artificial Sequence
  Description of Artificial Sequence: Synthetic oligonucleotide
cgaggctgggagccagctgtcag

SEQ ID NO: 109553 - DNA, 23 bp, Artificial Sequence
  Description of Artificial Sequence: Synthetic oligonucleotide
gaggctgggagccagctgtcagg

SEQ ID NO: 109554 - DNA, 23 bp, Artificial Sequence
  Description of Artificial Sequence: Synthetic oligonucleotide
aggctgggagccagctgtcaggg

SEQ ID NO: 109555 - DNA, 22 bp, Artificial Sequence
  Description of Artificial Sequence: Synthetic oligonucleotide
ggctgggagccagctgtcaggg

SEQ ID NO: 109556 - DNA, 22 bp, Artificial Sequence
  Description of Artificial Sequence: Synthetic oligonucleotide
gctgggagccagctgtcagggg

SEQ ID NO: 109557 - DNA, 23 bp, Artificial Sequence
  Description of Artificial Sequence: Synthetic oligonucleotide
ctgggagccagctgtcagggggt

SEQ ID NO: 109558 - DNA, 24 bp, Artificial Sequence
  Description of Artificial Sequence: Synthetic oligonucleotide
tgggagccagctgtcagggggtca

SEQ ID NO: 109559 - DNA, 23 bp, Artificial Sequence
  Description of Artificial Sequence: Synthetic oligonucleotide
gggagccagctgtcagggggtca

SEQ ID NO: 109560 - DNA, 23 bp, Artificial Sequence
  Description of Artificial Sequence: Synthetic oligonucleotide
ggagccagctgtcagggggtcag

SEQ ID NO: 109561 - DNA, 23 bp, Artificial Sequence
  Description of Artificial Sequence: Synthetic oligonucleotide
gagccagctgtcagggggtcagc

SEQ ID NO: 109562 - DNA, 24 bp, Artificial Sequence
  Description of Artificial Sequence: Synthetic oligonucleotide
agccagctgtcagggggtcagcga

SEQ ID NO: 109563 - DNA, 23 bp, Artificial Sequence
  Description of Artificial Sequence: Synthetic oligonucleotide
gccagctgtcagggggtcagcga

SEQ ID NO: 109564 - DNA, 24 bp, Artificial Sequence
  Description of Artificial Sequence: Synthetic oligonucleotide
ccagctgtcagggggtcagcgaca

SEQ ID NO: 109565 - DNA, 24 bp, Artificial Sequence
  Description of Artificial Sequence: Synthetic oligonucleotide
cagctgtcagggggtcagcgacag

SEQ ID NO: 109566 - DNA, 24 bp, Artificial Sequence
  Description of Artificial Sequence: Synthetic oligonucleotide
agctgtcagggggtcagcgacagg

SEQ ID NO: 109567 - DNA, 23 bp, Artificial Sequence
  Description of Artificial Sequence: Synthetic oligonucleotide
gctgtcagggggtcagcgacagg

SEQ ID NO: 109568 - DNA, 24 bp, Artificial Sequence
  Description of Artificial Sequence: Synthetic oligonucleotide
ctgtcagggggtcagcgacaggca

SEQ ID NO: 109569 - DNA, 25 bp, Artificial Sequence
  Description of Artificial Sequence: Synthetic oligonucleotide
tgtcagggggtcagcgacaggcagt

SEQ ID NO: 109570 - DNA, 24 bp, Artificial Sequence
  Description of Artificial Sequence: Synthetic oligonucleotide
gtcagggggtcagcgacaggcagt

SEQ ID NO: 109571 - DNA, 24 bp, Artificial Sequence
  Description of Artificial Sequence: Synthetic oligonucleotide
tcagggggtcagcgacaggcagtg

SEQ ID NO: 109572 - DNA, 23 bp, Artificial Sequence
  Description of Artificial Sequence: Synthetic oligonucleotide
cagggggtcagcgacaggcagtg

SEQ ID NO: 109573 - DNA, 23 bp, Artificial Sequence
  Description of Artificial Sequence: Synthetic oligonucleotide
agggggtcagcgacaggcagtgg

SEQ ID NO: 109574 - DNA, 22 bp, Artificial Sequence
  Description of Artificial Sequence: Synthetic oligonucleotide
gggggtcagcgacaggcagtgg

SEQ ID NO: 109575 - DNA, 22 bp, Artificial Sequence
  Description of Artificial Sequence: Synthetic oligonucleotide
ggggtcagcgacaggcagtggc

SEQ ID NO: 109576 - DNA, 24 bp, Artificial Sequence
  Description of Artificial Sequence: Synthetic oligonucleotide
gggtcagcgacaggcagtggcgtt

SEQ ID NO: 109577 - DNA, 24 bp, Artificial Sequence
  Description of Artificial Sequence: Synthetic oligonucleotide
ggtcagcgacaggcagtggcgttg

SEQ ID NO: 109578 - DNA, 24 bp, Artificial Sequence
  Description of Artificial Sequence: Synthetic oligonucleotide
gtcagcgacaggcagtggcgttgg

SEQ ID NO: 109579 - DNA, 24 bp, Artificial Sequence
  Description of Artificial Sequence: Synthetic oligonucleotide
tcagcgacaggcagtggcgttggc

SEQ ID NO: 109580 - DNA, 23 bp, Artificial Sequence
  Description of Artificial Sequence: Synthetic oligonucleotide
cagcgacaggcagtggcgttggc

SEQ ID NO: 109581 - DNA, 23 bp, Artificial Sequence
  Description of Artificial Sequence: Synthetic oligonucleotide
agcgacaggcagtggcgttggcc

SEQ ID NO: 109582 - DNA, 22 bp, Artificial Sequence
  Description of Artificial Sequence: Synthetic oligonucleotide
gcgacaggcagtggcgttggcc

SEQ ID NO: 109583 - DNA, 22 bp, Artificial Sequence
  Description of Artificial Sequence: Synthetic oligonucleotide
cgacaggcagtggcgttggccc

SEQ ID NO: 109584 - DNA, 23 bp, Artificial Sequence
  Description of Artificial Sequence: Synthetic oligonucleotide
gacaggcagtggcgttggcccga

SEQ ID NO: 109585 - DNA, 23 bp, Artificial Sequence
  Description of Artificial Sequence: Synthetic oligonucleotide
acaggcagtggcgttggcccgag

SEQ ID NO: 109586 - DNA, 22 bp, Artificial Sequence
  Description of Artificial Sequence: Synthetic oligonucleotide
caggcagtggcgttggcccgag

SEQ ID NO: 109587 - DNA, 25 bp, Artificial Sequence
  Description of Artificial Sequence: Synthetic oligonucleotide
aggcagtggcgttggcccgagcatt

SEQ ID NO: 109588 - DNA, 24 bp, Artificial Sequence
  Description of Artificial Sequence: Synthetic oligonucleotide
ggcagtggcgttggcccgagcatt

SEQ ID NO: 109589 - DNA, 26 bp, Artificial Sequence
  Description of Artificial Sequence: Synthetic oligonucleotide
gcagtggcgttggcccgagcattgat

SEQ ID NO: 109590 - DNA, 26 bp, Artificial Sequence
  Description of Artificial Sequence: Synthetic oligonucleotide
cagtggcgttggcccgagcattgatc

SEQ ID NO: 109591 - DNA, 26 bp, Artificial Sequence
  Description of Artificial Sequence: Synthetic oligonucleotide
agtggcgttggcccgagcattgatcc

SEQ ID NO: 109592 - DNA, 25 bp, Artificial Sequence
  Description of Artificial Sequence: Synthetic oligonucleotide
gtggcgttggcccgagcattgatcc

SEQ ID NO: 109593 - DNA, 25 bp, Artificial Sequence
  Description of Artificial Sequence: Synthetic oligonucleotide
tggcgttggcccgagcattgatccg

SEQ ID NO: 109594 - DNA, 24 bp, Artificial Sequence
  Description of Artificial Sequence: Synthetic oligonucleotide
ggcgttggcccgagcattgatccg

SEQ ID NO: 109595 - DNA, 27 bp, Artificial Sequence
  Description of Artificial Sequence: Synthetic oligonucleotide
gcgttggcccgagcattgatccggaaa

SEQ ID NO: 109596 - DNA, 27 bp, Artificial Sequence
  Description of Artificial Sequence: Synthetic oligonucleotide
cgttggcccgagcattgatccggaaac

SEQ ID NO: 109597 - DNA, 27 bp, Artificial Sequence
  Description of Artificial Sequence: Synthetic oligonucleotide
gttggcccgagcattgatccggaaacc

SEQ ID NO: 109598 - DNA, 27 bp, Artificial Sequence
  Description of Artificial Sequence: Synthetic oligonucleotide
ttggcccgagcattgatccggaaaccg

SEQ ID NO: 109599 - DNA, 27 bp, Artificial Sequence
  Description of Artificial Sequence: Synthetic oligonucleotide
tggcccgagcattgatccggaaaccgt

SEQ ID NO: 109600 - DNA, 26 bp, Artificial Sequence
  Description of Artificial Sequence: Synthetic oligonucleotide
ggcccgagcattgatccggaaaccgt

SEQ ID NO: 109601 - DNA, 27 bp, Artificial Sequence
  Description of Artificial Sequence: Synthetic oligonucleotide
gcccgagcattgatccggaaaccgtgt

SEQ ID NO: 109602 - DNA, 27 bp, Artificial Sequence
  Description of Artificial Sequence: Synthetic oligonucleotide
cccgagcattgatccggaaaccgtgtg

SEQ ID NO: 109603 - DNA, 29 bp, Artificial Sequence
  Description of Artificial Sequence: Synthetic oligonucleotide
ccgagcattgatccggaaaccgtgtgtac

SEQ ID NO: 109604 - DNA, 33 bp, Artificial Sequence
  Description of Artificial Sequence: Synthetic oligonucleotide
cgagcattgatccggaaaccgtgtgtacttatc

SEQ ID NO: 109605 - DNA, 33 bp, Artificial Sequence
  Description of Artificial Sequence: Synthetic oligonucleotide
gagcattgatccggaaaccgtgtgtacttatcc

SEQ ID NO: 109606 - DNA, 34 bp, Artificial Sequence
  Description of Artificial Sequence: Synthetic oligonucleotide
agcattgatccggaaaccgtgtgtacttatcctg

SEQ ID NO: 109607 - DNA, 33 bp, Artificial Sequence
  Description of Artificial Sequence: Synthetic oligonucleotide
gcattgatccggaaaccgtgtgtacttatcctg

SEQ ID NO: 109608 - DNA, 33 bp, Artificial Sequence
  Description of Artificial Sequence: Synthetic oligonucleotide
cattgatccggaaaccgtgtgtacttatcctgg

SEQ ID NO: 109609 - DNA, 35 bp, Artificial Sequence
  Description of Artificial Sequence: Synthetic oligonucleotide
attgatccggaaaccgtgtgtacttatcctggatg

SEQ ID NO: 109610 - DNA, 34 bp, Artificial Sequence
  Description of Artificial Sequence: Synthetic oligonucleotide
ttgatccggaaaccgtgtgtacttatcctggatg

SEQ ID NO: 109611 - DNA, 33 bp, Artificial Sequence
  Description of Artificial Sequence: Synthetic oligonucleotide
tgatccggaaaccgtgtgtacttatcctggatg

SEQ ID NO: 109612 - DNA, 32 bp, Artificial Sequence
  Description of Artificial Sequence: Synthetic oligonucleotide
gatccggaaaccgtgtgtacttatcctggatg

SEQ ID NO: 109613 - DNA, 34 bp, Artificial Sequence
  Description of Artificial Sequence: Synthetic oligonucleotide
atccggaaaccgtgtgtacttatcctggatgatg

SEQ ID NO: 109614 - DNA, 33 bp, Artificial Sequence
  Description of Artificial Sequence: Synthetic oligonucleotide
tccggaaaccgtgtgtacttatcctggatgatg

SEQ ID NO: 109615 - DNA, 32 bp, Artificial Sequence
  Description of Artificial Sequence: Synthetic oligonucleotide
ccggaaaccgtgtgtacttatcctggatgatg

SEQ ID NO: 109616 - DNA, 32 bp, Artificial Sequence
  Description of Artificial Sequence: Synthetic oligonucleotide
cggaaaccgtgtgtacttatcctggatgatgc

SEQ ID NO: 109617 - DNA, 32 bp, Artificial Sequence
  Description of Artificial Sequence: Synthetic oligonucleotide
ggaaaccgtgtgtacttatcctggatgatgcc

SEQ ID NO: 109618 - DNA, 33 bp, Artificial Sequence
  Description of Artificial Sequence: Synthetic oligonucleotide
gaaaccgtgtgtacttatcctggatgatgccac

SEQ ID NO: 109619 - DNA, 33 bp, Artificial Sequence
  Description of Artificial Sequence: Synthetic oligonucleotide
aaaccgtgtgtacttatcctggatgatgccacc

SEQ ID NO: 109620 - DNA, 32 bp, Artificial Sequence
  Description of Artificial Sequence: Synthetic oligonucleotide
aaccgtgtgtacttatcctggatgatgccacc

SEQ ID NO: 109621 - DNA, 31 bp, Artificial Sequence
  Description of Artificial Sequence: Synthetic oligonucleotide
accgtgtgtacttatcctggatgatgccacc

SEQ ID NO: 109622 - DNA, 30 bp, Artificial Sequence
  Description of Artificial Sequence: Synthetic oligonucleotide
ccgtgtgtacttatcctggatgatgccacc

SEQ ID NO: 109623 - DNA, 31 bp, Artificial Sequence
  Description of Artificial Sequence: Synthetic oligonucleotide
cgtgtgtacttatcctggatgatgccaccag

SEQ ID NO: 109624 - DNA, 32 bp, Artificial Sequence
  Description of Artificial Sequence: Synthetic oligonucleotide
gtgtgtacttatcctggatgatgccaccagtg

SEQ ID NO: 109625 - DNA, 32 bp, Artificial Sequence
  Description of Artificial Sequence: Synthetic oligonucleotide
tgtgtacttatcctggatgatgccaccagtgc

SEQ ID NO: 109626 - DNA, 31 bp, Artificial Sequence
  Description of Artificial Sequence: Synthetic oligonucleotide
gtgtacttatcctggatgatgccaccagtgc

SEQ ID NO: 109627 - DNA, 31 bp, Artificial Sequence
  Description of Artificial Sequence: Synthetic oligonucleotide
tgtacttatcctggatgatgccaccagtgcc

SEQ ID NO: 109628 - DNA, 30 bp, Artificial Sequence
  Description of Artificial Sequence: Synthetic oligonucleotide
gtacttatcctggatgatgccaccagtgcc

SEQ ID NO: 109629 - DNA, 30 bp, Artificial Sequence
  Description of Artificial Sequence: Synthetic oligonucleotide
tacttatcctggatgatgccaccagtgccc

SEQ ID NO: 109630 - DNA, 29 bp, Artificial Sequence
  Description of Artificial Sequence: Synthetic oligonucleotide
acttatcctggatgatgccaccagtgccc

SEQ ID NO: 109631 - DNA, 28 bp, Artificial Sequence
  Description of Artificial Sequence: Synthetic oligonucleotide
cttatcctggatgatgccaccagtgccc

SEQ ID NO: 109632 - DNA, 29 bp, Artificial Sequence
  Description of Artificial Sequence: Synthetic oligonucleotide
ttatcctggatgatgccaccagtgccctg

SEQ ID NO: 109633 - DNA, 28 bp, Artificial Sequence
  Description of Artificial Sequence: Synthetic oligonucleotide
tatcctggatgatgccaccagtgccctg

SEQ ID NO: 109634 - DNA, 27 bp, Artificial Sequence
  Description of Artificial Sequence: Synthetic oligonucleotide
atcctggatgatgccaccagtgccctg

SEQ ID NO: 109635 - DNA, 26 bp, Artificial Sequence
  Description of Artificial Sequence: Synthetic oligonucleotide
tcctggatgatgccaccagtgccctg

SEQ ID NO: 109636 - DNA, 25 bp, Artificial Sequence
  Description of Artificial Sequence: Synthetic oligonucleotide
cctggatgatgccaccagtgccctg

SEQ ID NO: 109637 - DNA, 27 bp, Artificial Sequence
  Description of Artificial Sequence: Synthetic oligonucleotide
ctggatgatgccaccagtgccctggat

SEQ ID NO: 109638 - DNA, 27 bp, Artificial Sequence
  Description of Artificial Sequence: Synthetic oligonucleotide
tggatgatgccaccagtgccctggatg

SEQ ID NO: 109639 - DNA, 26 bp, Artificial Sequence
  Description of Artificial Sequence: Synthetic oligonucleotide
ggatgatgccaccagtgccctggatg

SEQ ID NO: 109640 - DNA, 27 bp, Artificial Sequence
  Description of Artificial Sequence: Synthetic oligonucleotide
gatgatgccaccagtgccctggatgca

SEQ ID NO: 109641 - DNA, 29 bp, Artificial Sequence
  Description of Artificial Sequence: Synthetic oligonucleotide
atgatgccaccagtgccctggatgcaaac

SEQ ID NO: 109642 - DNA, 28 bp, Artificial Sequence
  Description of Artificial Sequence: Synthetic oligonucleotide
tgatgccaccagtgccctggatgcaaac

SEQ ID NO: 109643 - DNA, 27 bp, Artificial Sequence
  Description of Artificial Sequence: Synthetic oligonucleotide
gatgccaccagtgccctggatgcaaac

SEQ ID NO: 109644 - DNA, 28 bp, Artificial Sequence
  Description of Artificial Sequence: Synthetic oligonucleotide
atgccaccagtgccctggatgcaaacag

SEQ ID NO: 109645 - DNA, 27 bp, Artificial Sequence
  Description of Artificial Sequence: Synthetic oligonucleotide
tgccaccagtgccctggatgcaaacag

SEQ ID NO: 109646 - DNA, 26 bp, Artificial Sequence
  Description of Artificial Sequence: Synthetic oligonucleotide
gccaccagtgccctggatgcaaacag

SEQ ID NO: 109647 - DNA, 26 bp, Artificial Sequence
  Description of Artificial Sequence: Synthetic oligonucleotide
ccaccagtgccctggatgcaaacagc

SEQ ID NO: 109648 - DNA, 27 bp, Artificial Sequence
  Description of Artificial Sequence: Synthetic oligonucleotide
caccagtgccctggatgcaaacagcca

SEQ ID NO: 109649 - DNA, 27 bp, Artificial Sequence
  Description of Artificial Sequence: Synthetic oligonucleotide
accagtgccctggatgcaaacagccag

SEQ ID NO: 109650 - DNA, 27 bp, Artificial Sequence
  Description of Artificial Sequence: Synthetic oligonucleotide
ccagtgccctggatgcaaacagccagt

SEQ ID NO: 109651 - DNA, 29 bp, Artificial Sequence
  Description of Artificial Sequence: Synthetic oligonucleotide
cagtgccctggatgcaaacagccagttac

SEQ ID NO: 109652 - DNA, 30 bp, Artificial Sequence
  Description of Artificial Sequence: Synthetic oligonucleotide
agtgccctggatgcaaacagccagttacag

SEQ ID NO: 109653 - DNA, 29 bp, Artificial Sequence
  Description of Artificial Sequence: Synthetic oligonucleotide
gtgccctggatgcaaacagccagttacag

SEQ ID NO: 109654 - DNA, 29 bp, Artificial Sequence
  Description of Artificial Sequence: Synthetic oligonucleotide
tgccctggatgcaaacagccagttacagg

SEQ ID NO: 109655 - DNA, 28 bp, Artificial Sequence
  Description of Artificial Sequence: Synthetic oligonucleotide
gccctggatgcaaacagccagttacagg

SEQ ID NO: 109656 - DNA, 29 bp, Artificial Sequence
  Description of Artificial Sequence: Synthetic oligonucleotide
ccctggatgcaaacagccagttacaggtg

SEQ ID NO: 109657 - DNA, 29 bp, Artificial Sequence
  Description of Artificial Sequence: Synthetic oligonucleotide
cctggatgcaaacagccagttacaggtgg

SEQ ID NO: 109658 - DNA, 30 bp, Artificial Sequence
  Description of Artificial Sequence: Synthetic oligonucleotide
ctggatgcaaacagccagttacaggtggag

SEQ ID NO: 109659 - DNA, 30 bp, Artificial Sequence
  Description of Artificial Sequence: Synthetic oligonucleotide
tggatgcaaacagccagttacaggtggagc

SEQ ID NO: 109660 - DNA, 29 bp, Artificial Sequence
  Description of Artificial Sequence: Synthetic oligonucleotide
ggatgcaaacagccagttacaggtggagc

SEQ ID NO: 109661 - DNA, 30 bp, Artificial Sequence
  Description of Artificial Sequence: Synthetic oligonucleotide
gatgcaaacagccagttacaggtggagcag

SEQ ID NO: 109662 - DNA, 30 bp, Artificial Sequence
  Description of Artificial Sequence: Synthetic oligonucleotide
atgcaaacagccagttacaggtggagcagc

SEQ ID NO: 109663 - DNA, 29 bp, Artificial Sequence
  Description of Artificial Sequence: Synthetic oligonucleotide
tgcaaacagccagttacaggtggagcagc

SEQ ID NO: 109664 - DNA, 28 bp, Artificial Sequence
  Description of Artificial Sequence: Synthetic oligonucleotide
gcaaacagccagttacaggtggagcagc

SEQ ID NO: 109665 - DNA, 29 bp, Artificial Sequence
  Description of Artificial Sequence: Synthetic oligonucleotide
caaacagccagttacaggtggagcagctc

SEQ ID NO: 109666 - DNA, 29 bp, Artificial Sequence
  Description of Artificial Sequence: Synthetic oligonucleotide
aaacagccagttacaggtggagcagctcc

SEQ ID NO: 109667 - DNA, 28 bp, Artificial Sequence
  Description of Artificial Sequence: Synthetic oligonucleotide
aacagccagttacaggtggagcagctcc

SEQ ID NO: 109668 - DNA, 27 bp, Artificial Sequence
  Description of Artificial Sequence: Synthetic oligonucleotide
acagccagttacaggtggagcagctcc

SEQ ID NO: 109669 - DNA, 27 bp, Artificial Sequence
  Description of Artificial Sequence: Synthetic oligonucleotide
cagccagttacaggtggagcagctcct

SEQ ID NO: 109670 - DNA, 27 bp, Artificial Sequence
  Description of Artificial Sequence: Synthetic oligonucleotide
agccagttacaggtggagcagctcctg

SEQ ID NO: 109671 - DNA, 27 bp, Artificial Sequence
  Description of Artificial Sequence: Synthetic oligonucleotide
gccagttacaggtggagcagctcctgt

SEQ ID NO: 109672 - DNA, 28 bp, Artificial Sequence
  Description of Artificial Sequence: Synthetic oligonucleotide
ccagttacaggtggagcagctcctgtac

SEQ ID NO: 109673 - DNA, 28 bp, Artificial Sequence
  Description of Artificial Sequence: Synthetic oligonucleotide
cagttacaggtggagcagctcctgtacg

SEQ ID NO: 109674 - DNA, 31 bp, Artificial Sequence
  Description of Artificial Sequence: Synthetic oligonucleotide
agttacaggtggagcagctcctgtacgaaag

SEQ ID NO: 109675 - DNA, 30 bp, Artificial Sequence
  Description of Artificial Sequence: Synthetic oligonucleotide
gttacaggtggagcagctcctgtacgaaag

SEQ ID NO: 109676 - DNA, 30 bp, Artificial Sequence
  Description of Artificial Sequence: Synthetic oligonucleotide
ttacaggtggagcagctcctgtacgaaagc

SEQ ID NO: 109677 - DNA, 29 bp, Artificial Sequence
  Description of Artificial Sequence: Synthetic oligonucleotide
tacaggtggagcagctcctgtacgaaagc

SEQ ID NO: 109678 - DNA, 28 bp, Artificial Sequence
  Description of Artificial Sequence: Synthetic oligonucleotide
acaggtggagcagctcctgtacgaaagc

SEQ ID NO: 109679 - DNA, 27 bp, Artificial Sequence
  Description of Artificial Sequence: Synthetic oligonucleotide
caggtggagcagctcctgtacgaaagc

SEQ ID NO: 109680 - DNA, 27 bp, Artificial Sequence
  Description of Artificial Sequence: Synthetic oligonucleotide
aggtggagcagctcctgtacgaaagcc

SEQ ID NO: 109681 - DNA, 26 bp, Artificial Sequence
  Description of Artificial Sequence: Synthetic oligonucleotide
ggtggagcagctcctgtacgaaagcc

SEQ ID NO: 109682 - DNA, 27 bp, Artificial Sequence
  Description of Artificial Sequence: Synthetic oligonucleotide
gtggagcagctcctgtacgaaagccct

SEQ ID NO: 109683 - DNA, 27 bp, Artificial Sequence
  Description of Artificial Sequence: Synthetic oligonucleotide
tggagcagctcctgtacgaaagccctg

SEQ ID NO: 109684 - DNA, 27 bp, Artificial Sequence
  Description of Artificial Sequence: Synthetic oligonucleotide
ggagcagctcctgtacgaaagccctga

SEQ ID NO: 109685 - DNA, 27 bp, Artificial Sequence
  Description of Artificial Sequence: Synthetic oligonucleotide
gagcagctcctgtacgaaagccctgag

SEQ ID NO: 109686 - DNA, 27 bp, Artificial Sequence
  Description of Artificial Sequence: Synthetic oligonucleotide
agcagctcctgtacgaaagccctgagc

SEQ ID NO: 109687 - DNA, 26 bp, Artificial Sequence
  Description of Artificial Sequence: Synthetic oligonucleotide
gcagctcctgtacgaaagccctgagc

SEQ ID NO: 109688 - DNA, 26 bp, Artificial Sequence
  Description of Artificial Sequence: Synthetic oligonucleotide
cagctcctgtacgaaagccctgagcg

SEQ ID NO: 109689 - DNA, 27 bp, Artificial Sequence
  Description of Artificial Sequence: Synthetic oligonucleotide
agctcctgtacgaaagccctgagcggt

SEQ ID NO: 109690 - DNA, 27 bp, Artificial Sequence
  Description of Artificial Sequence: Synthetic oligonucleotide
gctcctgtacgaaagccctgagcggta

SEQ ID NO: 109691 - DNA, 27 bp, Artificial Sequence
  Description of Artificial Sequence: Synthetic oligonucleotide
ctcctgtacgaaagccctgagcggtac

SEQ ID NO: 109692 - DNA, 28 bp, Artificial Sequence
  Description of Artificial Sequence: Synthetic oligonucleotide
tcctgtacgaaagccctgagcggtactc

SEQ ID NO: 109693 - DNA, 27 bp, Artificial Sequence
  Description of Artificial Sequence: Synthetic oligonucleotide
cctgtacgaaagccctgagcggtactc

SEQ ID NO: 109694 - DNA, 27 bp, Artificial Sequence
  Description of Artificial Sequence: Synthetic oligonucleotide
ctgtacgaaagccctgagcggtactcc

SEQ ID NO: 109695 - DNA, 27 bp, Artificial Sequence
  Description of Artificial Sequence: Synthetic oligonucleotide
tgtacgaaagccctgagcggtactccc

SEQ ID NO: 109696 - DNA, 26 bp, Artificial Sequence
  Description of Artificial Sequence: Synthetic oligonucleotide
gtacgaaagccctgagcggtactccc

SEQ ID NO: 109697 - DNA, 26 bp, Artificial Sequence
  Description of Artificial Sequence: Synthetic oligonucleotide
tacgaaagccctgagcggtactcccg

SEQ ID NO: 109698 - DNA, 25 bp, Artificial Sequence
  Description of Artificial Sequence: Synthetic oligonucleotide
acgaaagccctgagcggtactcccg

SEQ ID NO: 109699 - DNA, 24 bp, Artificial Sequence
  Description of Artificial Sequence: Synthetic oligonucleotide
cgaaagccctgagcggtactcccg

SEQ ID NO: 109700 - DNA, 25 bp, Artificial Sequence
  Description of Artificial Sequence: Synthetic oligonucleotide
gaaagccctgagcggtactcccgct

SEQ ID NO: 109701 - DNA, 26 bp, Artificial Sequence
  Description of Artificial Sequence: Synthetic oligonucleotide
aaagccctgagcggtactcccgctca

SEQ ID NO: 109702 - DNA, 25 bp, Artificial Sequence
  Description of Artificial Sequence: Synthetic oligonucleotide
aagccctgagcggtactcccgctca

SEQ ID NO: 109703 - DNA, 24 bp, Artificial Sequence
  Description of Artificial Sequence: Synthetic oligonucleotide
agccctgagcggtactcccgctca

SEQ ID NO: 109704 - DNA, 23 bp, Artificial Sequence
  Description of Artificial Sequence: Synthetic oligonucleotide
gccctgagcggtactcccgctca

SEQ ID NO: 109705 - DNA, 24 bp, Artificial Sequence
  Description of Artificial Sequence: Synthetic oligonucleotide
ccctgagcggtactcccgctcagt

SEQ ID NO: 109706 - DNA, 24 bp, Artificial Sequence
  Description of Artificial Sequence: Synthetic oligonucleotide
cctgagcggtactcccgctcagtg

SEQ ID NO: 109707 - DNA, 26 bp, Artificial Sequence
  Description of Artificial Sequence: Synthetic oligonucleotide
ctgagcggtactcccgctcagtgctt

SEQ ID NO: 109708 - DNA, 27 bp, Artificial Sequence
  Description of Artificial Sequence: Synthetic oligonucleotide
tgagcggtactcccgctcagtgcttct

SEQ ID NO: 109709 - DNA, 26 bp, Artificial Sequence
  Description of Artificial Sequence: Synthetic oligonucleotide
gagcggtactcccgctcagtgcttct

SEQ ID NO: 109710 - DNA, 27 bp, Artificial Sequence
  Description of Artificial Sequence: Synthetic oligonucleotide
agcggtactcccgctcagtgcttctca

SEQ ID NO: 109711 - DNA, 27 bp, Artificial Sequence
  Description of Artificial Sequence: Synthetic oligonucleotide
gcggtactcccgctcagtgcttctcat

SEQ ID NO: 109712 - DNA, 27 bp, Artificial Sequence
  Description of Artificial Sequence: Synthetic oligonucleotide
cggtactcccgctcagtgcttctcatc

SEQ ID NO: 109713 - DNA, 28 bp, Artificial Sequence
  Description of Artificial Sequence: Synthetic oligonucleotide
ggtactcccgctcagtgcttctcatcac

SEQ ID NO: 109714 - DNA, 28 bp, Artificial Sequence
  Description of Artificial Sequence: Synthetic oligonucleotide
gtactcccgctcagtgcttctcatcacc

SEQ ID NO: 109715 - DNA, 28 bp, Artificial Sequence
  Description of Artificial Sequence: Synthetic oligonucleotide
tactcccgctcagtgcttctcatcaccc

SEQ ID NO: 109716 - DNA, 27 bp, Artificial Sequence
  Description of Artificial Sequence: Synthetic oligonucleotide
actcccgctcagtgcttctcatcaccc

SEQ ID NO: 109717 - DNA, 27 bp, Artificial Sequence
  Description of Artificial Sequence: Synthetic oligonucleotide
ctcccgctcagtgcttctcatcaccca

SEQ ID NO: 109718 - DNA, 27 bp, Artificial Sequence
  Description of Artificial Sequence: Synthetic oligonucleotide
tcccgctcagtgcttctcatcacccag

SEQ ID NO: 109719 - DNA, 26 bp, Artificial Sequence
  Description of Artificial Sequence: Synthetic oligonucleotide
cccgctcagtgcttctcatcacccag

SEQ ID NO: 109720 - DNA, 27 bp, Artificial Sequence
  Description of Artificial Sequence: Synthetic oligonucleotide
ccgctcagtgcttctcatcacccagca

SEQ ID NO: 109721 - DNA, 27 bp, Artificial Sequence
  Description of Artificial Sequence: Synthetic oligonucleotide
cgctcagtgcttctcatcacccagcac

SEQ ID NO: 109722 - DNA, 27 bp, Artificial Sequence
  Description of Artificial Sequence: Synthetic oligonucleotide
gctcagtgcttctcatcacccagcacc

SEQ ID NO: 109723 - DNA, 28 bp, Artificial Sequence
  Description of Artificial Sequence: Synthetic oligonucleotide
ctcagtgcttctcatcacccagcacctc

SEQ ID NO: 109724 - DNA, 29 bp, Artificial Sequence
  Description of Artificial Sequence: Synthetic oligonucleotide
tcagtgcttctcatcacccagcacctcag

SEQ ID NO: 109725 - DNA, 28 bp, Artificial Sequence
  Description of Artificial Sequence: Synthetic oligonucleotide
cagtgcttctcatcacccagcacctcag

SEQ ID NO: 109726 - DNA, 28 bp, Artificial Sequence
  Description of Artificial Sequence: Synthetic oligonucleotide
agtgcttctcatcacccagcacctcagc

SEQ ID NO: 109727 - DNA, 27 bp, Artificial Sequence
  Description of Artificial Sequence: Synthetic oligonucleotide
gtgcttctcatcacccagcacctcagc

SEQ ID NO: 109728 - DNA, 27 bp, Artificial Sequence
  Description of Artificial Sequence: Synthetic oligonucleotide
tgcttctcatcacccagcacctcagcc

SEQ ID NO: 109729 - DNA, 27 bp, Artificial Sequence
  Description of Artificial Sequence: Synthetic oligonucleotide
gcttctcatcacccagcacctcagcct

SEQ ID NO: 109730 - DNA, 27 bp, Artificial Sequence
  Description of Artificial Sequence: Synthetic oligonucleotide
cttctcatcacccagcacctcagcctg

SEQ ID NO: 109731 - DNA, 27 bp, Artificial Sequence
  Description of Artificial Sequence: Synthetic oligonucleotide
ttctcatcacccagcacctcagcctgg

SEQ ID NO: 109732 - DNA, 27 bp, Artificial Sequence
  Description of Artificial Sequence: Synthetic oligonucleotide
tctcatcacccagcacctcagcctggt

SEQ ID NO: 109733 - DNA, 26 bp, Artificial Sequence
  Description of Artificial Sequence: Synthetic oligonucleotide
ctcatcacccagcacctcagcctggt

SEQ ID NO: 109734 - DNA, 26 bp, Artificial Sequence
  Description of Artificial Sequence: Synthetic oligonucleotide
tcatcacccagcacctcagcctggtg

SEQ ID NO: 109735 - DNA, 25 bp, Artificial Sequence
  Description of Artificial Sequence: Synthetic oligonucleotide
catcacccagcacctcagcctggtg

SEQ ID NO: 109736 - DNA, 26 bp, Artificial Sequence
  Description of Artificial Sequence: Synthetic oligonucleotide
atcacccagcacctcagcctggtgga

SEQ ID NO: 109737 - DNA, 25 bp, Artificial Sequence
  Description of Artificial Sequence: Synthetic oligonucleotide
tcacccagcacctcagcctggtgga

SEQ ID NO: 109738 - DNA, 24 bp, Artificial Sequence
  Description of Artificial Sequence: Synthetic oligonucleotide
cacccagcacctcagcctggtgga

SEQ ID NO: 109739 - DNA, 24 bp, Artificial Sequence
  Description of Artificial Sequence: Synthetic oligonucleotide
acccagcacctcagcctggtggag

SEQ ID NO: 109740 - DNA, 23 bp, Artificial Sequence
  Description of Artificial Sequence: Synthetic oligonucleotide
cccagcacctcagcctggtggag

SEQ ID NO: 109741 - DNA, 24 bp, Artificial Sequence
  Description of Artificial Sequence: Synthetic oligonucleotide
ccagcacctcagcctggtggagca

SEQ ID NO: 109742 - DNA, 24 bp, Artificial Sequence
  Description of Artificial Sequence: Synthetic oligonucleotide
cagcacctcagcctggtggagcag

SEQ ID NO: 109743 - DNA, 24 bp, Artificial Sequence
  Description of Artificial Sequence: Synthetic oligonucleotide
agcacctcagcctggtggagcagg

SEQ ID NO: 109744 - DNA, 23 bp, Artificial Sequence
  Description of Artificial Sequence: Synthetic oligonucleotide
gcacctcagcctggtggagcagg

SEQ ID NO: 109745 - DNA, 24 bp, Artificial Sequence
  Description of Artificial Sequence: Synthetic oligonucleotide
cacctcagcctggtggagcaggct

SEQ ID NO: 109746 - DNA, 25 bp, Artificial Sequence
  Description of Artificial Sequence: Synthetic oligonucleotide
acctcagcctggtggagcaggctga

SEQ ID NO: 109747 - DNA, 24 bp, Artificial Sequence
  Description of Artificial Sequence: Synthetic oligonucleotide
cctcagcctggtggagcaggctga

SEQ ID NO: 109748 - DNA, 24 bp, Artificial Sequence
  Description of Artificial Sequence: Synthetic oligonucleotide
ctcagcctggtggagcaggctgac

SEQ ID NO: 109749 - DNA, 25 bp, Artificial Sequence
  Description of Artificial Sequence: Synthetic oligonucleotide
tcagcctggtggagcaggctgacca

SEQ ID NO: 109750 - DNA, 24 bp, Artificial Sequence
  Description of Artificial Sequence: Synthetic oligonucleotide
cagcctggtggagcaggctgacca

SEQ ID NO: 109751 - DNA, 26 bp, Artificial Sequence
  Description of Artificial Sequence: Synthetic oligonucleotide
agcctggtggagcaggctgaccacat

SEQ ID NO: 109752 - DNA, 25 bp, Artificial Sequence
  Description of Artificial Sequence: Synthetic oligonucleotide
gcctggtggagcaggctgaccacat

SEQ ID NO: 109753 - DNA, 25 bp, Artificial Sequence
  Description of Artificial Sequence: Synthetic oligonucleotide
cctggtggagcaggctgaccacatc

SEQ ID NO: 109754 - DNA, 26 bp, Artificial Sequence
  Description of Artificial Sequence: Synthetic oligonucleotide
ctggtggagcaggctgaccacatcct

SEQ ID NO: 109755 - DNA, 27 bp, Artificial Sequence
  Description of Artificial Sequence: Synthetic oligonucleotide
tggtggagcaggctgaccacatcctct

SEQ ID NO: 109756 - DNA, 27 bp, Artificial Sequence
  Description of Artificial Sequence: Synthetic oligonucleotide
ggtggagcaggctgaccacatcctctt

SEQ ID NO: 109757 - DNA, 28 bp, Artificial Sequence
  Description of Artificial Sequence: Synthetic oligonucleotide
gtggagcaggctgaccacatcctctttc

SEQ ID NO: 109758 - DNA, 29 bp, Artificial Sequence
  Description of Artificial Sequence: Synthetic oligonucleotide
tggagcaggctgaccacatcctctttctg

SEQ ID NO: 109759 - DNA, 28 bp, Artificial Sequence
  Description of Artificial Sequence: Synthetic oligonucleotide
ggagcaggctgaccacatcctctttctg

SEQ ID NO: 109760 - DNA, 28 bp, Artificial Sequence
  Description of Artificial Sequence: Synthetic oligonucleotide
gagcaggctgaccacatcctctttctgg

SEQ ID NO: 109761 - DNA, 30 bp, Artificial Sequence
  Description of Artificial Sequence: Synthetic oligonucleotide
agcaggctgaccacatcctctttctggaag

SEQ ID NO: 109762 - DNA, 29 bp, Artificial Sequence
  Description of Artificial Sequence: Synthetic oligonucleotide
gcaggctgaccacatcctctttctggaag

SEQ ID NO: 109763 - DNA, 29 bp, Artificial Sequence
  Description of Artificial Sequence: Synthetic oligonucleotide
caggctgaccacatcctctttctggaagg

SEQ ID NO: 109764 - DNA, 30 bp, Artificial Sequence
  Description of Artificial Sequence: Synthetic oligonucleotide
aggctgaccacatcctctttctggaaggag

SEQ ID NO: 109765 - DNA, 29 bp, Artificial Sequence
  Description of Artificial Sequence: Synthetic oligonucleotide
ggctgaccacatcctctttctggaaggag

SEQ ID NO: 109766 - DNA, 29 bp, Artificial Sequence
  Description of Artificial Sequence: Synthetic oligonucleotide
gctgaccacatcctctttctggaaggagg

SEQ ID NO: 109767 - DNA, 29 bp, Artificial Sequence
  Description of Artificial Sequence: Synthetic oligonucleotide
ctgaccacatcctctttctggaaggaggc

SEQ ID NO: 109768 - DNA, 29 bp, Artificial Sequence
  Description of Artificial Sequence: Synthetic oligonucleotide
tgaccacatcctctttctggaaggaggcg

SEQ ID NO: 109769 - DNA, 28 bp, Artificial Sequence
  Description of Artificial Sequence: Synthetic oligonucleotide
gaccacatcctctttctggaaggaggcg

SEQ ID NO: 109770 - DNA, 28 bp, Artificial Sequence
  Description of Artificial Sequence: Synthetic oligonucleotide
accacatcctctttctggaaggaggcgc

SEQ ID NO: 109771 - DNA, 27 bp, Artificial Sequence
  Description of Artificial Sequence: Synthetic oligonucleotide
ccacatcctctttctggaaggaggcgc

SEQ ID NO: 109772 - DNA, 30 bp, Artificial Sequence
  Description of Artificial Sequence: Synthetic oligonucleotide
cacatcctctttctggaaggaggcgctatc

SEQ ID NO: 109773 - DNA, 30 bp, Artificial Sequence
  Description of Artificial Sequence: Synthetic oligonucleotide
acatcctctttctggaaggaggcgctatcc

SEQ ID NO: 109774 - DNA, 29 bp, Artificial Sequence
  Description of Artificial Sequence: Synthetic oligonucleotide
catcctctttctggaaggaggcgctatcc

SEQ ID NO: 109775 - DNA, 29 bp, Artificial Sequence
  Description of Artificial Sequence: Synthetic oligonucleotide
atcctctttctggaaggaggcgctatccg

SEQ ID NO: 109776 - DNA, 28 bp, Artificial Sequence
  Description of Artificial Sequence: Synthetic oligonucleotide
tcctctttctggaaggaggcgctatccg

SEQ ID NO: 109777 - DNA, 27 bp, Artificial Sequence
  Description of Artificial Sequence: Synthetic oligonucleotide
cctctttctggaaggaggcgctatccg

SEQ ID NO: 109778 - DNA, 27 bp, Artificial Sequence
  Description of Artificial Sequence: Synthetic oligonucleotide
ctctttctggaaggaggcgctatccgg

SEQ ID NO: 109779 - DNA, 27 bp, Artificial Sequence
  Description of Artificial Sequence: Synthetic oligonucleotide
tctttctggaaggaggcgctatccggg

SEQ ID NO: 109780 - DNA, 27 bp, Artificial Sequence
  Description of Artificial Sequence: Synthetic oligonucleotide
ctttctggaaggaggcgctatccggga

SEQ ID NO: 109781 - DNA, 27 bp, Artificial Sequence
  Description of Artificial Sequence: Synthetic oligonucleotide
tttctggaaggaggcgctatccgggag

SEQ ID NO: 109782 - DNA, 26 bp, Artificial Sequence
  Description of Artificial Sequence: Synthetic oligonucleotide
ttctggaaggaggcgctatccgggag

SEQ ID NO: 109783 - DNA, 25 bp, Artificial Sequence
  Description of Artificial Sequence: Synthetic oligonucleotide
tctggaaggaggcgctatccgggag

SEQ ID NO: 109784 - DNA, 24 bp, Artificial Sequence
  Description of Artificial Sequence: Synthetic oligonucleotide
ctggaaggaggcgctatccgggag

SEQ ID NO: 109785 - DNA, 24 bp, Artificial Sequence
  Description of Artificial Sequence: Synthetic oligonucleotide
tggaaggaggcgctatccgggagg

SEQ ID NO: 109786 - DNA, 23 bp, Artificial Sequence
  Description of Artificial Sequence: Synthetic oligonucleotide
ggaaggaggcgctatccgggagg

SEQ ID NO: 109787 - DNA, 23 bp, Artificial Sequence
  Description of Artificial Sequence: Synthetic oligonucleotide
gaaggaggcgctatccgggaggg

SEQ ID NO: 109788 - DNA, 23 bp, Artificial Sequence
  Description of Artificial Sequence: Synthetic oligonucleotide
aaggaggcgctatccgggagggg

SEQ ID NO: 109789 - DNA, 22 bp, Artificial Sequence
  Description of Artificial Sequence: Synthetic oligonucleotide
aggaggcgctatccgggagggg

SEQ ID NO: 109790 - DNA, 21 bp, Artificial Sequence
  Description of Artificial Sequence: Synthetic oligonucleotide
ggaggcgctatccgggagggg

SEQ ID NO: 109791 - DNA, 21 bp, Artificial Sequence
  Description of Artificial Sequence: Synthetic oligonucleotide
gaggcgctatccgggaggggg

SEQ ID NO: 109792 - DNA, 23 bp, Artificial Sequence
  Description of Artificial Sequence: Synthetic oligonucleotide
aggcgctatccgggaggggggaa

SEQ ID NO: 109793 - DNA, 22 bp, Artificial Sequence
  Description of Artificial Sequence: Synthetic oligonucleotide
ggcgctatccgggaggggggaa

SEQ ID NO: 109794 - DNA, 22 bp, Artificial Sequence
  Description of Artificial Sequence: Synthetic oligonucleotide
gcgctatccgggaggggggaac

SEQ ID NO: 109795 - DNA, 22 bp, Artificial Sequence
  Description of Artificial Sequence: Synthetic oligonucleotide
cgctatccgggaggggggaacc

SEQ ID NO: 109796 - DNA, 23 bp, Artificial Sequence
  Description of Artificial Sequence: Synthetic oligonucleotide
gctatccgggaggggggaaccca

SEQ ID NO: 109797 - DNA, 23 bp, Artificial Sequence
  Description of Artificial Sequence: Synthetic oligonucleotide
ctatccgggaggggggaacccac

SEQ ID NO: 109798 - DNA, 24 bp, Artificial Sequence
  Description of Artificial Sequence: Synthetic oligonucleotide
tatccgggaggggggaacccacca

SEQ ID NO: 109799 - DNA, 23 bp, Artificial Sequence
  Description of Artificial Sequence: Synthetic oligonucleotide
atccgggaggggggaacccacca

SEQ ID NO: 109800 - DNA, 22 bp, Artificial Sequence
  Description of Artificial Sequence: Synthetic oligonucleotide
tccgggaggggggaacccacca

SEQ ID NO: 109801 - DNA, 21 bp, Artificial Sequence
  Description of Artificial Sequence: Synthetic oligonucleotide
ccgggaggggggaacccacca

SEQ ID NO: 109802 - DNA, 21 bp, Artificial Sequence
  Description of Artificial Sequence: Synthetic oligonucleotide
cgggaggggggaacccaccag

SEQ ID NO: 109803 - DNA, 22 bp, Artificial Sequence
  Description of Artificial Sequence: Synthetic oligonucleotide
gggaggggggaacccaccagca

SEQ ID NO: 109804 - DNA, 22 bp, Artificial Sequence
  Description of Artificial Sequence: Synthetic oligonucleotide
ggaggggggaacccaccagcag

SEQ ID NO: 109805 - DNA, 23 bp, Artificial Sequence
  Description of Artificial Sequence: Synthetic oligonucleotide
gaggggggaacccaccagcagct

SEQ ID NO: 109806 - DNA, 25 bp, Artificial Sequence
  Description of Artificial Sequence: Synthetic oligonucleotide
aggggggaacccaccagcagctcat

SEQ ID NO: 109807 - DNA, 24 bp, Artificial Sequence
  Description of Artificial Sequence: Synthetic oligonucleotide
ggggggaacccaccagcagctcat

SEQ ID NO: 109808 - DNA, 24 bp, Artificial Sequence
  Description of Artificial Sequence: Synthetic oligonucleotide
gggggaacccaccagcagctcatg

SEQ ID NO: 109809 - DNA, 25 bp, Artificial Sequence
  Description of Artificial Sequence: Synthetic oligonucleotide
ggggaacccaccagcagctcatgga

SEQ ID NO: 109810 - DNA, 27 bp, Artificial Sequence
  Description of Artificial Sequence: Synthetic oligonucleotide
gggaacccaccagcagctcatggagaa

SEQ ID NO: 109811 - DNA, 30 bp, Artificial Sequence
  Description of Artificial Sequence: Synthetic oligonucleotide
ggaacccaccagcagctcatggagaaaaag

SEQ ID NO: 109812 - DNA, 30 bp, Artificial Sequence
  Description of Artificial Sequence: Synthetic oligonucleotide
gaacccaccagcagctcatggagaaaaagg

SEQ ID NO: 109813 - DNA, 30 bp, Artificial Sequence
  Description of Artificial Sequence: Synthetic oligonucleotide
aacccaccagcagctcatggagaaaaaggg

SEQ ID NO: 109814 - DNA, 29 bp, Artificial Sequence
  Description of Artificial Sequence: Synthetic oligonucleotide
acccaccagcagctcatggagaaaaaggg

SEQ ID NO: 109815 - DNA, 28 bp, Artificial Sequence
  Description of Artificial Sequence: Synthetic oligonucleotide
cccaccagcagctcatggagaaaaaggg

SEQ ID NO: 109816 - DNA, 28 bp, Artificial Sequence
  Description of Artificial Sequence: Synthetic oligonucleotide
ccaccagcagctcatggagaaaaagggg

SEQ ID NO: 109817 - DNA, 29 bp, Artificial Sequence
  Description of Artificial Sequence: Synthetic oligonucleotide
caccagcagctcatggagaaaaaggggtg

SEQ ID NO: 109818 - DNA, 29 bp, Artificial Sequence
  Description of Artificial Sequence: Synthetic oligonucleotide
accagcagctcatggagaaaaaggggtgc

SEQ ID NO: 109819 - DNA, 28 bp, Artificial Sequence
  Description of Artificial Sequence: Synthetic oligonucleotide
ccagcagctcatggagaaaaaggggtgc

SEQ ID NO: 109820 - DNA, 30 bp, Artificial Sequence
  Description of Artificial Sequence: Synthetic oligonucleotide
cagcagctcatggagaaaaaggggtgctac

SEQ ID NO: 109821 - DNA, 31 bp, Artificial Sequence
  Description of Artificial Sequence: Synthetic oligonucleotide
agcagctcatggagaaaaaggggtgctactg

SEQ ID NO: 109822 - DNA, 30 bp, Artificial Sequence
  Description of Artificial Sequence: Synthetic oligonucleotide
gcagctcatggagaaaaaggggtgctactg

SEQ ID NO: 109823 - DNA, 30 bp, Artificial Sequence
  Description of Artificial Sequence: Synthetic oligonucleotide
cagctcatggagaaaaaggggtgctactgg

SEQ ID NO: 109824 - DNA, 30 bp, Artificial Sequence
  Description of Artificial Sequence: Synthetic oligonucleotide
agctcatggagaaaaaggggtgctactggg

SEQ ID NO: 109825 - DNA, 29 bp, Artificial Sequence
  Description of Artificial Sequence: Synthetic oligonucleotide
gctcatggagaaaaaggggtgctactggg

SEQ ID NO: 109826 - DNA, 29 bp, Artificial Sequence
  Description of Artificial Sequence: Synthetic oligonucleotide
ctcatggagaaaaaggggtgctactgggc

SEQ ID NO: 109827 - DNA, 29 bp, Artificial Sequence
  Description of Artificial Sequence: Synthetic oligonucleotide
tcatggagaaaaaggggtgctactgggcc

SEQ ID NO: 109828 - DNA, 28 bp, Artificial Sequence
  Description of Artificial Sequence: Synthetic oligonucleotide
catggagaaaaaggggtgctactgggcc

SEQ ID NO: 109829 - DNA, 30 bp, Artificial Sequence
  Description of Artificial Sequence: Synthetic oligonucleotide
atggagaaaaaggggtgctactgggccatg

SEQ ID NO: 109830 - DNA, 29 bp, Artificial Sequence
  Description of Artificial Sequence: Synthetic oligonucleotide
tggagaaaaaggggtgctactgggccatg

SEQ ID NO: 109831 - DNA, 28 bp, Artificial Sequence
  Description of Artificial Sequence: Synthetic oligonucleotide
ggagaaaaaggggtgctactgggccatg

SEQ ID NO: 109832 - DNA, 28 bp, Artificial Sequence
  Description of Artificial Sequence: Synthetic oligonucleotide
gagaaaaaggggtgctactgggccatgg

SEQ ID NO: 109833 - DNA, 29 bp, Artificial Sequence
  Description of Artificial Sequence: Synthetic oligonucleotide
agaaaaaggggtgctactgggccatggtg

SEQ ID NO: 109834 - DNA, 28 bp, Artificial Sequence
  Description of Artificial Sequence: Synthetic oligonucleotide
gaaaaaggggtgctactgggccatggtg

SEQ ID NO: 109835 - DNA, 28 bp, Artificial Sequence
  Description of Artificial Sequence: Synthetic oligonucleotide
aaaaaggggtgctactgggccatggtgc

SEQ ID NO: 109836 - DNA, 27 bp, Artificial Sequence
  Description of Artificial Sequence: Synthetic oligonucleotide
aaaaggggtgctactgggccatggtgc

SEQ ID NO: 109837 - DNA, 27 bp, Artificial Sequence
  Description of Artificial Sequence: Synthetic oligonucleotide
aaaggggtgctactgggccatggtgca

SEQ ID NO: 109838 - DNA, 26 bp, Artificial Sequence
  Description of Artificial Sequence: Synthetic oligonucleotide
aaggggtgctactgggccatggtgca

SEQ ID NO: 109839 - DNA, 25 bp, Artificial Sequence
  Description of Artificial Sequence: Synthetic oligonucleotide
aggggtgctactgggccatggtgca

SEQ ID NO: 109840 - DNA, 24 bp, Artificial Sequence
  Description of Artificial Sequence: Synthetic oligonucleotide
ggggtgctactgggccatggtgca

SEQ ID NO: 109841 - DNA, 24 bp, Artificial Sequence
  Description of Artificial Sequence: Synthetic oligonucleotide
gggtgctactgggccatggtgcag

SEQ ID NO: 109842 - DNA, 24 bp, Artificial Sequence
  Description of Artificial Sequence: Synthetic oligonucleotide
ggtgctactgggccatggtgcagg

SEQ ID NO: 109843 - DNA, 25 bp, Artificial Sequence
  Description of Artificial Sequence: Synthetic oligonucleotide
gtgctactgggccatggtgcaggct

SEQ ID NO: 109844 - DNA, 25 bp, Artificial Sequence
  Description of Artificial Sequence: Synthetic oligonucleotide
tgctactgggccatggtgcaggctc

SEQ ID NO: 109845 - DNA, 24 bp, Artificial Sequence
  Description of Artificial Sequence: Synthetic oligonucleotide
gctactgggccatggtgcaggctc

SEQ ID NO: 109846 - DNA, 25 bp, Artificial Sequence
  Description of Artificial Sequence: Synthetic oligonucleotide
ctactgggccatggtgcaggctcct

SEQ ID NO: 109847 - DNA, 25 bp, Artificial Sequence
  Description of Artificial Sequence: Synthetic oligonucleotide
tactgggccatggtgcaggctcctg

SEQ ID NO: 109848 - DNA, 24 bp, Artificial Sequence
  Description of Artificial Sequence: Synthetic oligonucleotide
actgggccatggtgcaggctcctg

SEQ ID NO: 109849 - DNA, 23 bp, Artificial Sequence
  Description of Artificial Sequence: Synthetic oligonucleotide
ctgggccatggtgcaggctcctg

SEQ ID NO: 109850 - DNA, 24 bp, Artificial Sequence
  Description of Artificial Sequence: Synthetic oligonucleotide
tgggccatggtgcaggctcctgca

SEQ ID NO: 109851 - DNA, 23 bp, Artificial Sequence
  Description of Artificial Sequence: Synthetic oligonucleotide
gggccatggtgcaggctcctgca

SEQ ID NO: 109852 - DNA, 25 bp, Artificial Sequence
  Description of Artificial Sequence: Synthetic oligonucleotide
ggccatggtgcaggctcctgcagat

SEQ ID NO: 109853 - DNA, 25 bp, Artificial Sequence
  Description of Artificial Sequence: Synthetic oligonucleotide
gccatggtgcaggctcctgcagatg

SEQ ID NO: 109854 - DNA, 26 bp, Artificial Sequence
  Description of Artificial Sequence: Synthetic oligonucleotide
ccatggtgcaggctcctgcagatgct

SEQ ID NO: 109855 - DNA, 26 bp, Artificial Sequence
  Description of Artificial Sequence: Synthetic oligonucleotide
catggtgcaggctcctgcagatgctc

SEQ ID NO: 109856 - DNA, 27 bp, Artificial Sequence
  Description of Artificial Sequence: Synthetic oligonucleotide
atggtgcaggctcctgcagatgctcca

SEQ ID NO: 109857 - DNA, 26 bp, Artificial Sequence
  Description of Artificial Sequence: Synthetic oligonucleotide
tggtgcaggctcctgcagatgctcca

SEQ ID NO: 109858 - DNA, 25 bp, Artificial Sequence
  Description of Artificial Sequence: Synthetic oligonucleotide
ggtgcaggctcctgcagatgctcca

SEQ ID NO: 109859 - DNA, 27 bp, Artificial Sequence
  Description of Artificial Sequence: Synthetic oligonucleotide
gtgcaggctcctgcagatgctccagaa

SEQ ID NO: 109860 - DNA, 28 bp, Artificial Sequence
  Description of Artificial Sequence: Synthetic oligonucleotide
tgcaggctcctgcagatgctccagaatg

SEQ ID NO: 109861 - DNA, 27 bp, Artificial Sequence
  Description of Artificial Sequence: Synthetic oligonucleotide
gcaggctcctgcagatgctccagaatg

SEQ ID NO: 109862 - DNA, 27 bp, Artificial Sequence
  Description of Artificial Sequence: Synthetic oligonucleotide
tcctggtggtcctctcctctcttggga

SEQ ID NO: 109863 - DNA, 26 bp, Artificial Sequence
  Description of Artificial Sequence: Synthetic oligonucleotide
cctggtggtcctctcctctcttggga

SEQ ID NO: 109864 - DNA, 27 bp, Artificial Sequence
  Description of Artificial Sequence: Synthetic oligonucleotide
ctggtggtcctctcctctcttgggaga

SEQ ID NO: 109865 - DNA, 28 bp, Artificial Sequence
  Description of Artificial Sequence: Synthetic oligonucleotide
tggtggtcctctcctctcttgggagatg

SEQ ID NO: 109866 - DNA, 27 bp, Artificial Sequence
  Description of Artificial Sequence: Synthetic oligonucleotide
ggtggtcctctcctctcttgggagatg

SEQ ID NO: 109867 - DNA, 27 bp, Artificial Sequence
  Description of Artificial Sequence: Synthetic oligonucleotide
gtggtcctctcctctcttgggagatgg

SEQ ID NO: 109868 - DNA, 27 bp, Artificial Sequence
  Description of Artificial Sequence: Synthetic oligonucleotide
tggtcctctcctctcttgggagatggc

SEQ ID NO: 109869 - DNA, 26 bp, Artificial Sequence
  Description of Artificial Sequence: Synthetic oligonucleotide
ggtcctctcctctcttgggagatggc

SEQ ID NO: 109870 - DNA, 27 bp, Artificial Sequence
  Description of Artificial Sequence: Synthetic oligonucleotide
gtcctctcctctcttgggagatggcca

SEQ ID NO: 109871 - DNA, 29 bp, Artificial Sequence
  Description of Artificial Sequence: Synthetic oligonucleotide
tcctctcctctcttgggagatggccattc

SEQ ID NO: 109872 - DNA, 28 bp, Artificial Sequence
  Description of Artificial Sequence: Synthetic oligonucleotide
cctctcctctcttgggagatggccattc

SEQ ID NO: 109873 - DNA, 28 bp, Artificial Sequence
  Description of Artificial Sequence: Synthetic oligonucleotide
ctctcctctcttgggagatggccattcc

SEQ ID NO: 109874 - DNA, 31 bp, Artificial Sequence
  Description of Artificial Sequence: Synthetic oligonucleotide
tctcctctcttgggagatggccattccattc

SEQ ID NO: 109875 - DNA, 30 bp, Artificial Sequence
  Description of Artificial Sequence: Synthetic oligonucleotide
ctcctctcttgggagatggccattccattc

SEQ ID NO: 109876 - DNA, 34 bp, Artificial Sequence
  Description of Artificial Sequence: Synthetic oligonucleotide
tcctctcttgggagatggccattccattctttac

SEQ ID NO: 109877 - DNA, 33 bp, Artificial Sequence
  Description of Artificial Sequence: Synthetic oligonucleotide
cctctcttgggagatggccattccattctttac

SEQ ID NO: 109878 - DNA, 33 bp, Artificial Sequence
  Description of Artificial Sequence: Synthetic oligonucleotide
ctctcttgggagatggccattccattctttacg

SEQ ID NO: 109879 - DNA, 33 bp, Artificial Sequence
  Description of Artificial Sequence: Synthetic oligonucleotide
tctcttgggagatggccattccattctttacgg

SEQ ID NO: 109880 - DNA, 32 bp, Artificial Sequence
  Description of Artificial Sequence: Synthetic oligonucleotide
ctcttgggagatggccattccattctttacgg

SEQ ID NO: 109881 - DNA, 32 bp, Artificial Sequence
  Description of Artificial Sequence: Synthetic oligonucleotide
tcttgggagatggccattccattctttacggg

SEQ ID NO: 109882 - DNA, 31 bp, Artificial Sequence
  Description of Artificial Sequence: Synthetic oligonucleotide
cttgggagatggccattccattctttacggg

SEQ ID NO: 109883 - DNA, 31 bp, Artificial Sequence
  Description of Artificial Sequence: Synthetic oligonucleotide
ttgggagatggccattccattctttacgggc

SEQ ID NO: 109884 - DNA, 30 bp, Artificial Sequence
  Description of Artificial Sequence: Synthetic oligonucleotide
tgggagatggccattccattctttacgggc

SEQ ID NO: 109885 - DNA, 26 bp, Artificial Sequence
  Description of Artificial Sequence: Synthetic oligonucleotide
cagtgtccctcaccatggtcaccctg

SEQ ID NO: 109886 - DNA, 27 bp, Artificial Sequence
  Description of Artificial Sequence: Synthetic oligonucleotide
agtgtccctcaccatggtcaccctggt

SEQ ID NO: 109887 - DNA, 26 bp, Artificial Sequence
  Description of Artificial Sequence: Synthetic oligonucleotide
gtgtccctcaccatggtcaccctggt

SEQ ID NO: 109888 - DNA, 27 bp, Artificial Sequence
  Description of Artificial Sequence: Synthetic oligonucleotide
tgtccctcaccatggtcaccctggtca

SEQ ID NO: 109889 - DNA, 26 bp, Artificial Sequence
  Description of Artificial Sequence: Synthetic oligonucleotide
gtccctcaccatggtcaccctggtca

SEQ ID NO: 109890 - DNA, 26 bp, Artificial Sequence
  Description of Artificial Sequence: Synthetic oligonucleotide
tccctcaccatggtcaccctggtcac

SEQ ID NO: 109891 - DNA, 25 bp, Artificial Sequence
  Description of Artificial Sequence: Synthetic oligonucleotide
ccctcaccatggtcaccctggtcac

SEQ ID NO: 109892 - DNA, 25 bp, Artificial Sequence
  Description of Artificial Sequence: Synthetic oligonucleotide
cctcaccatggtcaccctggtcacc

SEQ ID NO: 109893 - DNA, 26 bp, Artificial Sequence
  Description of Artificial Sequence: Synthetic oligonucleotide
ctcaccatggtcaccctggtcaccct

SEQ ID NO: 109894 - DNA, 26 bp, Artificial Sequence
  Description of Artificial Sequence: Synthetic oligonucleotide
tcaccatggtcaccctggtcaccctg

SEQ ID NO: 109895 - DNA, 25 bp, Artificial Sequence
  Description of Artificial Sequence: Synthetic oligonucleotide
caccatggtcaccctggtcaccctg

SEQ ID NO: 109896 - DNA, 25 bp, Artificial Sequence
  Description of Artificial Sequence: Synthetic oligonucleotide
accatggtcaccctggtcaccctgc

SEQ ID NO: 109897 - DNA, 24 bp, Artificial Sequence
  Description of Artificial Sequence: Synthetic oligonucleotide
ccatggtcaccctggtcaccctgc

SEQ ID NO: 109898 - DNA, 25 bp, Artificial Sequence
  Description of Artificial Sequence: Synthetic oligonucleotide
catggtcaccctggtcaccctgcct

SEQ ID NO: 109899 - DNA, 26 bp, Artificial Sequence
  Description of Artificial Sequence: Synthetic oligonucleotide
atggtcaccctggtcaccctgcctct

SEQ ID NO: 109900 - DNA, 25 bp, Artificial Sequence
  Description of Artificial Sequence: Synthetic oligonucleotide
tggtcaccctggtcaccctgcctct

SEQ ID NO: 109901 - DNA, 24 bp, Artificial Sequence
  Description of Artificial Sequence: Synthetic oligonucleotide
ggtcaccctggtcaccctgcctct

SEQ ID NO: 109902 - DNA, 24 bp, Artificial Sequence
  Description of Artificial Sequence: Synthetic oligonucleotide
gtcaccctggtcaccctgcctctg

SEQ ID NO: 109903 - DNA, 27 bp, Artificial Sequence
  Description of Artificial Sequence: Synthetic oligonucleotide
tcaccctggtcaccctgcctctgcttt

SEQ ID NO: 109904 - DNA, 27 bp, Artificial Sequence
  Description of Artificial Sequence: Synthetic oligonucleotide
caccctggtcaccctgcctctgctttt

SEQ ID NO: 109905 - DNA, 27 bp, Artificial Sequence
  Description of Artificial Sequence: Synthetic oligonucleotide
accctggtcaccctgcctctgcttttc

SEQ ID NO: 109906 - DNA, 26 bp, Artificial Sequence
  Description of Artificial Sequence: Synthetic oligonucleotide
ccctggtcaccctgcctctgcttttc

SEQ ID NO: 109907 - DNA, 27 bp, Artificial Sequence
  Description of Artificial Sequence: Synthetic oligonucleotide
cctggtcaccctgcctctgcttttcct

SEQ ID NO: 109908 - DNA, 28 bp, Artificial Sequence
  Description of Artificial Sequence: Synthetic oligonucleotide
ctggtcaccctgcctctgcttttccttc

SEQ ID NO: 109909 - DNA, 29 bp, Artificial Sequence
  Description of Artificial Sequence: Synthetic oligonucleotide
tggtcaccctgcctctgcttttccttctg

SEQ ID NO: 109910 - DNA, 28 bp, Artificial Sequence
  Description of Artificial Sequence: Synthetic oligonucleotide
ggtcaccctgcctctgcttttccttctg

SEQ ID NO: 109911 - DNA, 28 bp, Artificial Sequence
  Description of Artificial Sequence: Synthetic oligonucleotide
gtcaccctgcctctgcttttccttctgc

SEQ ID NO: 109912 - DNA, 28 bp, Artificial Sequence
  Description of Artificial Sequence: Synthetic oligonucleotide
tccctcagggctatgacacagaggtagg

SEQ ID NO: 109913 - DNA, 27 bp, Artificial Sequence
  Description of Artificial Sequence: Synthetic oligonucleotide
ccctcagggctatgacacagaggtagg

SEQ ID NO: 109914 - DNA, 27 bp, Artificial Sequence
  Description of Artificial Sequence: Synthetic oligonucleotide
cctcagggctatgacacagaggtaggc

SEQ ID NO: 109915 - DNA, 27 bp, Artificial Sequence
  Description of Artificial Sequence: Synthetic oligonucleotide
ctcagggctatgacacagaggtaggcg

SEQ ID NO: 109916 - DNA, 28 bp, Artificial Sequence
  Description of Artificial Sequence: Synthetic oligonucleotide
tcagggctatgacacagaggtaggcgag

SEQ ID NO: 109917 - DNA, 27 bp, Artificial Sequence
  Description of Artificial Sequence: Synthetic oligonucleotide
cagggctatgacacagaggtaggcgag

SEQ ID NO: 109918 - DNA, 27 bp, Artificial Sequence
  Description of Artificial Sequence: Synthetic oligonucleotide
agggctatgacacagaggtaggcgagg

SEQ ID NO: 109919 - DNA, 26 bp, Artificial Sequence
  Description of Artificial Sequence: Synthetic oligonucleotide
gggctatgacacagaggtaggcgagg

SEQ ID NO: 109920 - DNA, 27 bp, Artificial Sequence
  Description of Artificial Sequence: Synthetic oligonucleotide
ggctatgacacagaggtaggcgaggct

SEQ ID NO: 109921 - DNA, 27 bp, Artificial Sequence
  Description of Artificial Sequence: Synthetic oligonucleotide
gctatgacacagaggtaggcgaggctg

SEQ ID NO: 109922 - DNA, 27 bp, Artificial Sequence
  Description of Artificial Sequence: Synthetic oligonucleotide
ctatgacacagaggtaggcgaggctgg

SEQ ID NO: 109923 - DNA, 27 bp, Artificial Sequence
  Description of Artificial Sequence: Synthetic oligonucleotide
tatgacacagaggtaggcgaggctggg

SEQ ID NO: 109924 - DNA, 27 bp, Artificial Sequence
  Description of Artificial Sequence: Synthetic oligonucleotide
atgacacagaggtaggcgaggctggga

SEQ ID NO: 109925 - DNA, 26 bp, Artificial Sequence
  Description of Artificial Sequence: Synthetic oligonucleotide
tgacacagaggtaggcgaggctggga

SEQ ID NO: 109926 - DNA, 25 bp, Artificial Sequence
  Description of Artificial Sequence: Synthetic oligonucleotide
gacacagaggtaggcgaggctggga

SEQ ID NO: 109927 - DNA, 25 bp, Artificial Sequence
  Description of Artificial Sequence: Synthetic oligonucleotide
acacagaggtaggcgaggctgggag

SEQ ID NO: 109928 - DNA, 24 bp, Artificial Sequence
  Description of Artificial Sequence: Synthetic oligonucleotide
cacagaggtaggcgaggctgggag

SEQ ID NO: 109929 - DNA, 24 bp, Artificial Sequence
  Description of Artificial Sequence: Synthetic oligonucleotide
acagaggtaggcgaggctgggagc

SEQ ID NO: 109930 - DNA, 23 bp, Artificial Sequence
  Description of Artificial Sequence: Synthetic oligonucleotide
cagaggtaggcgaggctgggagc

SEQ ID NO: 109931 - DNA, 24 bp, Artificial Sequence
  Description of Artificial Sequence: Synthetic oligonucleotide
agaggtaggcgaggctgggagcca

SEQ ID NO: 109932 - DNA, 23 bp, Artificial Sequence
  Description of Artificial Sequence: Synthetic oligonucleotide
gaggtaggcgaggctgggagcca

SEQ ID NO: 109933 - DNA, 23 bp, Artificial Sequence
  Description of Artificial Sequence: Synthetic oligonucleotide
aggtaggcgaggctgggagccag

SEQ ID NO: 109934 - DNA, 22 bp, Artificial Sequence
  Description of Artificial Sequence: Synthetic oligonucleotide
ggtaggcgaggctgggagccag

SEQ ID NO: 109935 - DNA, 23 bp, Artificial Sequence
  Description of Artificial Sequence: Synthetic oligonucleotide
gtaggcgaggctgggagccagct

SEQ ID NO: 109936 - DNA, 24 bp, Artificial Sequence
  Description of Artificial Sequence: Synthetic oligonucleotide
taggcgaggctgggagccagctgt

SEQ ID NO: 109937 - DNA, 23 bp, Artificial Sequence
  Description of Artificial Sequence: Synthetic oligonucleotide
aggcgaggctgggagccagctgt

SEQ ID NO: 109938 - DNA, 22 bp, Artificial Sequence
  Description of Artificial Sequence: Synthetic oligonucleotide
ggcgaggctgggagccagctgt

SEQ ID NO: 109939 - DNA, 23 bp, Artificial Sequence
  Description of Artificial Sequence: Synthetic oligonucleotide
gcgaggctgggagccagctgtca

SEQ ID NO: 109940 - DNA, 29 bp, Artificial Sequence
  Description of Artificial Sequence: Synthetic oligonucleotide
ttggcccgagcattgatccggaaaccatg

SEQ ID NO: 109941 - DNA, 28 bp, Artificial Sequence
  Description of Artificial Sequence: Synthetic oligonucleotide
tggcccgagcattgatccggaaaccatg

SEQ ID NO: 109942 - DNA, 27 bp, Artificial Sequence
  Description of Artificial Sequence: Synthetic oligonucleotide
ggcccgagcattgatccggaaaccatg

SEQ ID NO: 109943 - DNA, 28 bp, Artificial Sequence
  Description of Artificial Sequence: Synthetic oligonucleotide
gcccgagcattgatccggaaaccatgtg

SEQ ID NO: 109944 - DNA, 30 bp, Artificial Sequence
  Description of Artificial Sequence: Synthetic oligonucleotide
cccgagcattgatccggaaaccatgtgtac

SEQ ID NO: 109945 - DNA, 34 bp, Artificial Sequence
  Description of Artificial Sequence: Synthetic oligonucleotide
ccgagcattgatccggaaaccatgtgtacttatc

SEQ ID NO: 109946 - DNA, 34 bp, Artificial Sequence
  Description of Artificial Sequence: Synthetic oligonucleotide
cgagcattgatccggaaaccatgtgtacttatcc

SEQ ID NO: 109947 - DNA, 35 bp, Artificial Sequence
  Description of Artificial Sequence: Synthetic oligonucleotide
gagcattgatccggaaaccatgtgtacttatcctg

SEQ ID NO: 109948 - DNA, 35 bp, Artificial Sequence
  Description of Artificial Sequence: Synthetic oligonucleotide
agcattgatccggaaaccatgtgtacttatcctgg

SEQ ID NO: 109949 - DNA, 34 bp, Artificial Sequence
  Description of Artificial Sequence: Synthetic oligonucleotide
gcattgatccggaaaccatgtgtacttatcctgg

SEQ ID NO: 109950 - DNA, 36 bp, Artificial Sequence
  Description of Artificial Sequence: Synthetic oligonucleotide
cattgatccggaaaccatgtgtacttatcctggatg

SEQ ID NO: 109951 - DNA, 38 bp, Artificial Sequence
  Description of Artificial Sequence: Synthetic oligonucleotide
attgatccggaaaccatgtgtacttatcctggatgatg

SEQ ID NO: 109952 - DNA, 37 bp, Artificial Sequence
  Description of Artificial Sequence: Synthetic oligonucleotide
ttgatccggaaaccatgtgtacttatcctggatgatg

SEQ ID NO: 109953 - DNA, 36 bp, Artificial Sequence
  Description of Artificial Sequence: Synthetic oligonucleotide
tgatccggaaaccatgtgtacttatcctggatgatg

SEQ ID NO: 109954 - DNA, 35 bp, Artificial Sequence
  Description of Artificial Sequence: Synthetic oligonucleotide
gatccggaaaccatgtgtacttatcctggatgatg

SEQ ID NO: 109955 - DNA, 35 bp, Artificial Sequence
  Description of Artificial Sequence: Synthetic oligonucleotide
atccggaaaccatgtgtacttatcctggatgatgc

SEQ ID NO: 109956 - DNA, 34 bp, Artificial Sequence
  Description of Artificial Sequence: Synthetic oligonucleotide
tccggaaaccatgtgtacttatcctggatgatgc

SEQ ID NO: 109957 - DNA, 33 bp, Artificial Sequence
  Description of Artificial Sequence: Synthetic oligonucleotide
ccggaaaccatgtgtacttatcctggatgatgc

SEQ ID NO: 109958 - DNA, 33 bp, Artificial Sequence
  Description of Artificial Sequence: Synthetic oligonucleotide
cggaaaccatgtgtacttatcctggatgatgcc

SEQ ID NO: 109959 - DNA, 34 bp, Artificial Sequence
  Description of Artificial Sequence: Synthetic oligonucleotide
ggaaaccatgtgtacttatcctggatgatgccac

SEQ ID NO: 109960 - DNA, 34 bp, Artificial Sequence
  Description of Artificial Sequence: Synthetic oligonucleotide
gaaaccatgtgtacttatcctggatgatgccacc

SEQ ID NO: 109961 - DNA, 35 bp, Artificial Sequence
  Description of Artificial Sequence: Synthetic oligonucleotide
aaaccatgtgtacttatcctggatgatgccaccag

SEQ ID NO: 109962 - DNA, 34 bp, Artificial Sequence
  Description of Artificial Sequence: Synthetic oligonucleotide
aaccatgtgtacttatcctggatgatgccaccag

SEQ ID NO: 109963 - DNA, 33 bp, Artificial Sequence
  Description of Artificial Sequence: Synthetic oligonucleotide
accatgtgtacttatcctggatgatgccaccag

SEQ ID NO: 109964 - DNA, 32 bp, Artificial Sequence
  Description of Artificial Sequence: Synthetic oligonucleotide
ccatgtgtacttatcctggatgatgccaccag

SEQ ID NO: 109965 - DNA, 33 bp, Artificial Sequence
  Description of Artificial Sequence: Synthetic oligonucleotide
catgtgtacttatcctggatgatgccaccagtg

SEQ ID NO: 109966 - DNA, 33 bp, Artificial Sequence
  Description of Artificial Sequence: Synthetic oligonucleotide
atgtgtacttatcctggatgatgccaccagtgc

SEQ ID NO: 109967 - DNA, 32 bp, Artificial Sequence
  Description of Artificial Sequence: Synthetic oligonucleotide
ttctctaccagatgcagttcacccaggctttg

SEQ ID NO: 109968 - DNA, 31 bp, Artificial Sequence
  Description of Artificial Sequence: Synthetic oligonucleotide
tctctaccagatgcagttcacccaggctttg

SEQ ID NO: 109969 - DNA, 30 bp, Artificial Sequence
  Description of Artificial Sequence: Synthetic oligonucleotide
ctctaccagatgcagttcacccaggctttg

SEQ ID NO: 109970 - DNA, 30 bp, Artificial Sequence
  Description of Artificial Sequence: Synthetic oligonucleotide
tctaccagatgcagttcacccaggctttgg

SEQ ID NO: 109971 - DNA, 29 bp, Artificial Sequence
  Description of Artificial Sequence: Synthetic oligonucleotide
ctaccagatgcagttcacccaggctttgg

SEQ ID NO: 109972 - DNA, 30 bp, Artificial Sequence
  Description of Artificial Sequence: Synthetic oligonucleotide
taccagatgcagttcacccaggctttggag

SEQ ID NO: 109973 - DNA, 29 bp, Artificial Sequence
  Description of Artificial Sequence: Synthetic oligonucleotide
accagatgcagttcacccaggctttggag

SEQ ID NO: 109974 - DNA, 28 bp, Artificial Sequence
  Description of Artificial Sequence: Synthetic oligonucleotide
ccagatgcagttcacccaggctttggag

SEQ ID NO: 109975 - DNA, 28 bp, Artificial Sequence
  Description of Artificial Sequence: Synthetic oligonucleotide
cagatgcagttcacccaggctttggagg

SEQ ID NO: 109976 - DNA, 30 bp, Artificial Sequence
  Description of Artificial Sequence: Synthetic oligonucleotide
agatgcagttcacccaggctttggaggtac

SEQ ID NO: 109977 - DNA, 29 bp, Artificial Sequence
  Description of Artificial Sequence: Synthetic oligonucleotide
gatgcagttcacccaggctttggaggtac

SEQ ID NO: 109978 - DNA, 30 bp, Artificial Sequence
  Description of Artificial Sequence: Synthetic oligonucleotide
atgcagttcacccaggctttggaggtactg

SEQ ID NO: 109979 - DNA, 29 bp, Artificial Sequence
  Description of Artificial Sequence: Synthetic oligonucleotide
tgcagttcacccaggctttggaggtactg

SEQ ID NO: 109980 - DNA, 28 bp, Artificial Sequence
  Description of Artificial Sequence: Synthetic oligonucleotide
gcagttcacccaggctttggaggtactg

SEQ ID NO: 109981 - DNA, 28 bp, Artificial Sequence
  Description of Artificial Sequence: Synthetic oligonucleotide
cagttcacccaggctttggaggtactgc

SEQ ID NO: 109982 - DNA, 29 bp, Artificial Sequence
  Description of Artificial Sequence: Synthetic oligonucleotide
agttcacccaggctttggaggtactgctc

SEQ ID NO: 109983 - DNA, 28 bp, Artificial Sequence
  Description of Artificial Sequence: Synthetic oligonucleotide
gttcacccaggctttggaggtactgctc

SEQ ID NO: 109984 - DNA, 29 bp, Artificial Sequence
  Description of Artificial Sequence: Synthetic oligonucleotide
ttcacccaggctttggaggtactgctctc

SEQ ID NO: 109985 - DNA, 28 bp, Artificial Sequence
  Description of Artificial Sequence: Synthetic oligonucleotide
tcacccaggctttggaggtactgctctc

SEQ ID NO: 109986 - DNA, 27 bp, Artificial Sequence
  Description of Artificial Sequence: Synthetic oligonucleotide
cacccaggctttggaggtactgctctc

SEQ ID NO: 109987 - DNA, 27 bp, Artificial Sequence
  Description of Artificial Sequence: Synthetic oligonucleotide
acccaggctttggaggtactgctctcc

SEQ ID NO: 109988 - DNA, 27 bp, Artificial Sequence
  Description of Artificial Sequence: Synthetic oligonucleotide
cccaggctttggaggtactgctctcca

SEQ ID NO: 109989 - DNA, 28 bp, Artificial Sequence
  Description of Artificial Sequence: Synthetic oligonucleotide
ccaggctttggaggtactgctctccatc

SEQ ID NO: 109990 - DNA, 30 bp, Artificial Sequence
  Description of Artificial Sequence: Synthetic oligonucleotide
caggctttggaggtactgctctccatctac

SEQ ID NO: 109991 - DNA, 30 bp, Artificial Sequence
  Description of Artificial Sequence: Synthetic oligonucleotide
aggctttggaggtactgctctccatctacc

SEQ ID NO: 109992 - DNA, 29 bp, Artificial Sequence
  Description of Artificial Sequence: Synthetic oligonucleotide
ggctttggaggtactgctctccatctacc

SEQ ID NO: 109993 - DNA, 29 bp, Artificial Sequence
  Description of Artificial Sequence: Synthetic oligonucleotide
gctttggaggtactgctctccatctaccc

SEQ ID NO: 109994 - DNA, 29 bp, Artificial Sequence
  Description of Artificial Sequence: Synthetic oligonucleotide
ctttggaggtactgctctccatctacccc

SEQ ID NO: 109995 - DNA, 30 bp, Artificial Sequence
  Description of Artificial Sequence: Synthetic oligonucleotide
tttggaggtactgctctccatctaccccag

SEQ ID NO: 109996 - DNA, 29 bp, Artificial Sequence
  Description of Artificial Sequence: Synthetic oligonucleotide
ttggaggtactgctctccatctaccccag

SEQ ID NO: 109997 - DNA, 25 bp, Artificial Sequence
  Description of Artificial Sequence: Synthetic oligonucleotide
gagccagctgtcagggggtcagcaa

SEQ ID NO: 109998 - DNA, 26 bp, Artificial Sequence
  Description of Artificial Sequence: Synthetic oligonucleotide
agccagctgtcagggggtcagcaaca

SEQ ID NO: 109999 - DNA, 25 bp, Artificial Sequence
  Description of Artificial Sequence: Synthetic oligonucleotide
gccagctgtcagggggtcagcaaca

SEQ ID NO: 110000 - DNA, 25 bp, Artificial Sequence
  Description of Artificial Sequence: Synthetic oligonucleotide
ccagctgtcagggggtcagcaacag

SEQ ID NO: 110001 - DNA, 25 bp, Artificial Sequence
  Description of Artificial Sequence: Synthetic oligonucleotide
cagctgtcagggggtcagcaacagg

SEQ ID NO: 110002 - DNA, 26 bp, Artificial Sequence
  Description of Artificial Sequence: Synthetic oligonucleotide
agctgtcagggggtcagcaacaggca

SEQ ID NO: 110003 - DNA, 25 bp, Artificial Sequence
  Description of Artificial Sequence: Synthetic oligonucleotide
gctgtcagggggtcagcaacaggca

SEQ ID NO: 110004 - DNA, 26 bp, Artificial Sequence
  Description of Artificial Sequence: Synthetic oligonucleotide
ctgtcagggggtcagcaacaggcagt

SEQ ID NO: 110005 - DNA, 26 bp, Artificial Sequence
  Description of Artificial Sequence: Synthetic oligonucleotide
tgtcagggggtcagcaacaggcagtg

SEQ ID NO: 110006 - DNA, 25 bp, Artificial Sequence
  Description of Artificial Sequence: Synthetic oligonucleotide
gtcagggggtcagcaacaggcagtg

SEQ ID NO: 110007 - DNA, 25 bp, Artificial Sequence
  Description of Artificial Sequence: Synthetic oligonucleotide
tcagggggtcagcaacaggcagtgg

SEQ ID NO: 110008 - DNA, 24 bp, Artificial Sequence
  Description of Artificial Sequence: Synthetic oligonucleotide
cagggggtcagcaacaggcagtgg

SEQ ID NO: 110009 - DNA, 24 bp, Artificial Sequence
  Description of Artificial Sequence: Synthetic oligonucleotide
agggggtcagcaacaggcagtggc

SEQ ID NO: 110010 - DNA, 23 bp, Artificial Sequence
  Description of Artificial Sequence: Synthetic oligonucleotide
gggggtcagcaacaggcagtggc

SEQ ID NO: 110011 - DNA, 25 bp, Artificial Sequence
  Description of Artificial Sequence: Synthetic oligonucleotide
ggggtcagcaacaggcagtggcgtt

SEQ ID NO: 110012 - DNA, 25 bp, Artificial Sequence
  Description of Artificial Sequence: Synthetic oligonucleotide
gggtcagcaacaggcagtggcgttg

SEQ ID NO: 110013 - DNA, 25 bp, Artificial Sequence
  Description of Artificial Sequence: Synthetic oligonucleotide
ggtcagcaacaggcagtggcgttgg

SEQ ID NO: 110014 - DNA, 25 bp, Artificial Sequence
  Description of Artificial Sequence: Synthetic oligonucleotide
gtcagcaacaggcagtggcgttggc

SEQ ID NO: 110015 - DNA, 25 bp, Artificial Sequence
  Description of Artificial Sequence: Synthetic oligonucleotide
tcagcaacaggcagtggcgttggcc

SEQ ID NO: 110016 - DNA, 24 bp, Artificial Sequence
  Description of Artificial Sequence: Synthetic oligonucleotide
cagcaacaggcagtggcgttggcc

SEQ ID NO: 110017 - DNA, 24 bp, Artificial Sequence
  Description of Artificial Sequence: Synthetic oligonucleotide
agcaacaggcagtggcgttggccc

SEQ ID NO: 110018 - DNA, 23 bp, Artificial Sequence
  Description of Artificial Sequence: Synthetic oligonucleotide
gcaacaggcagtggcgttggccc

SEQ ID NO: 110019 - DNA, 24 bp, Artificial Sequence
  Description of Artificial Sequence: Synthetic oligonucleotide
caacaggcagtggcgttggcccga

SEQ ID NO: 110020 - DNA, 24 bp, Artificial Sequence
  Description of Artificial Sequence: Synthetic oligonucleotide
aacaggcagtggcgttggcccgag

SEQ ID NO: 110021 - DNA, 24 bp, Artificial Sequence
  Description of Artificial Sequence: Synthetic oligonucleotide
ggtccgcggatagcaccaggctac

SEQ ID NO: 110022 - DNA, 24 bp, Artificial Sequence
  Description of Artificial Sequence: Synthetic oligonucleotide
gtccgcggatagcaccaggctacc

SEQ ID NO: 110023 - DNA, 24 bp, Artificial Sequence
  Description of Artificial Sequence: Synthetic oligonucleotide
tccgcggatagcaccaggctaccg

SEQ ID NO: 110024 - DNA, 23 bp, Artificial Sequence
  Description of Artificial Sequence: Synthetic oligonucleotide
ccgcggatagcaccaggctaccg

SEQ ID NO: 110025 - DNA, 24 bp, Artificial Sequence
  Description of Artificial Sequence: Synthetic oligonucleotide
cgcggatagcaccaggctaccgca

SEQ ID NO: 110026 - DNA, 25 bp, Artificial Sequence
  Description of Artificial Sequence: Synthetic oligonucleotide
gcggatagcaccaggctaccgcact

SEQ ID NO: 110027 - DNA, 25 bp, Artificial Sequence
  Description of Artificial Sequence: Synthetic oligonucleotide
cggatagcaccaggctaccgcactg

SEQ ID NO: 110028 - DNA, 25 bp, Artificial Sequence
  Description of Artificial Sequence: Synthetic oligonucleotide
ggatagcaccaggctaccgcactgg

SEQ ID NO: 110029 - DNA, 25 bp, Artificial Sequence
  Description of Artificial Sequence: Synthetic oligonucleotide
gatagcaccaggctaccgcactggg

SEQ ID NO: 110030 - DNA, 27 bp, Artificial Sequence
  Description of Artificial Sequence: Synthetic oligonucleotide
atagcaccaggctaccgcactggggaa

SEQ ID NO: 110031 - DNA, 26 bp, Artificial Sequence
  Description of Artificial Sequence: Synthetic oligonucleotide
tagcaccaggctaccgcactggggaa

SEQ ID NO: 110032 - DNA, 25 bp, Artificial Sequence
  Description of Artificial Sequence: Synthetic oligonucleotide
agcaccaggctaccgcactggggaa

SEQ ID NO: 110033 - DNA, 24 bp, Artificial Sequence
  Description of Artificial Sequence: Synthetic oligonucleotide
gcaccaggctaccgcactggggaa

SEQ ID NO: 110034 - DNA, 25 bp, Artificial Sequence
  Description of Artificial Sequence: Synthetic oligonucleotide
caccaggctaccgcactggggaagt

SEQ ID NO: 110035 - DNA, 26 bp, Artificial Sequence
  Description of Artificial Sequence: Synthetic oligonucleotide
accaggctaccgcactggggaagtca

SEQ ID NO: 110036 - DNA, 25 bp, Artificial Sequence
  Description of Artificial Sequence: Synthetic oligonucleotide
ccaggctaccgcactggggaagtca

SEQ ID NO: 110037 - DNA, 25 bp, Artificial Sequence
  Description of Artificial Sequence: Synthetic oligonucleotide
caggctaccgcactggggaagtcac

SEQ ID NO: 110038 - DNA, 25 bp, Artificial Sequence
  Description of Artificial Sequence: Synthetic oligonucleotide
aggctaccgcactggggaagtcacc

SEQ ID NO: 110039 - DNA, 24 bp, Artificial Sequence
  Description of Artificial Sequence: Synthetic oligonucleotide
ggctaccgcactggggaagtcacc

SEQ ID NO: 110040 - DNA, 26 bp, Artificial Sequence
  Description of Artificial Sequence: Synthetic oligonucleotide
gctaccgcactggggaagtcacccta

SEQ ID NO: 110041 - DNA, 26 bp, Artificial Sequence
  Description of Artificial Sequence: Synthetic oligonucleotide
ctaccgcactggggaagtcaccctac

SEQ ID NO: 110042 - DNA, 26 bp, Artificial Sequence
  Description of Artificial Sequence: Synthetic oligonucleotide
taccgcactggggaagtcaccctacc

SEQ ID NO: 110043 - DNA, 25 bp, Artificial Sequence
  Description of Artificial Sequence: Synthetic oligonucleotide
accgcactggggaagtcaccctacc

SEQ ID NO: 110044 - DNA, 24 bp, Artificial Sequence
  Description of Artificial Sequence: Synthetic oligonucleotide
ccgcactggggaagtcaccctacc

SEQ ID NO: 110045 - DNA, 24 bp, Artificial Sequence
  Description of Artificial Sequence: Synthetic oligonucleotide
cgcactggggaagtcaccctaccg

SEQ ID NO: 110046 - DNA, 26 bp, Artificial Sequence
  Description of Artificial Sequence: Synthetic oligonucleotide
tggggaagtcaccctaccgccttcgt

SEQ ID NO: 110047 - DNA, 25 bp, Artificial Sequence
  Description of Artificial Sequence: Synthetic oligonucleotide
ggggaagtcaccctaccgccttcgt

SEQ ID NO: 110048 - DNA, 25 bp, Artificial Sequence
  Description of Artificial Sequence: Synthetic oligonucleotide
gggaagtcaccctaccgccttcgtc

SEQ ID NO: 110049 - DNA, 26 bp, Artificial Sequence
  Description of Artificial Sequence: Synthetic oligonucleotide
ggaagtcaccctaccgccttcgtcgt

SEQ ID NO: 110050 - DNA, 27 bp, Artificial Sequence
  Description of Artificial Sequence: Synthetic oligonucleotide
gaagtcaccctaccgccttcgtcgtca

SEQ ID NO: 110051 - DNA, 27 bp, Artificial Sequence
  Description of Artificial Sequence: Synthetic oligonucleotide
aagtcaccctaccgccttcgtcgtcag

SEQ ID NO: 110052 - DNA, 27 bp, Artificial Sequence
  Description of Artificial Sequence: Synthetic oligonucleotide
agtcaccctaccgccttcgtcgtcagt

SEQ ID NO: 110053 - DNA, 27 bp, Artificial Sequence
  Description of Artificial Sequence: Synthetic oligonucleotide
gtcaccctaccgccttcgtcgtcagtt

SEQ ID NO: 110054 - DNA, 29 bp, Artificial Sequence
  Description of Artificial Sequence: Synthetic oligonucleotide
tcaccctaccgccttcgtcgtcagttatg

SEQ ID NO: 110055 - DNA, 28 bp, Artificial Sequence
  Description of Artificial Sequence: Synthetic oligonucleotide
caccctaccgccttcgtcgtcagttatg

SEQ ID NO: 110056 - DNA, 28 bp, Artificial Sequence
  Description of Artificial Sequence: Synthetic oligonucleotide
accctaccgccttcgtcgtcagttatgc

SEQ ID NO: 110057 - DNA, 27 bp, Artificial Sequence
  Description of Artificial Sequence: Synthetic oligonucleotide
ccctaccgccttcgtcgtcagttatgc

SEQ ID NO: 110058 - DNA, 28 bp, Artificial Sequence
  Description of Artificial Sequence: Synthetic oligonucleotide
cctaccgccttcgtcgtcagttatgcag

SEQ ID NO: 110059 - DNA, 28 bp, Artificial Sequence
  Description of Artificial Sequence: Synthetic oligonucleotide
ctaccgccttcgtcgtcagttatgcagc

SEQ ID NO: 110060 - DNA, 28 bp, Artificial Sequence
  Description of Artificial Sequence: Synthetic oligonucleotide
taccgccttcgtcgtcagttatgcagcg

SEQ ID NO: 110061 - DNA, 27 bp, Artificial Sequence
  Description of Artificial Sequence: Synthetic oligonucleotide
accgccttcgtcgtcagttatgcagcg

SEQ ID NO: 110062 - DNA, 26 bp, Artificial Sequence
  Description of Artificial Sequence: Synthetic oligonucleotide
ccgccttcgtcgtcagttatgcagcg

SEQ ID NO: 110063 - DNA, 26 bp, Artificial Sequence
  Description of Artificial Sequence: Synthetic oligonucleotide
cgccttcgtcgtcagttatgcagcgg

SEQ ID NO: 110064 - DNA, 27 bp, Artificial Sequence
  Description of Artificial Sequence: Synthetic oligonucleotide
gccttcgtcgtcagttatgcagcggca

SEQ ID NO: 110065 - DNA, 27 bp, Artificial Sequence
  Description of Artificial Sequence: Synthetic oligonucleotide
ccttcgtcgtcagttatgcagcggcac

SEQ ID NO: 110066 - DNA, 28 bp, Artificial Sequence
  Description of Artificial Sequence: Synthetic oligonucleotide
cttcgtcgtcagttatgcagcggcactg

SEQ ID NO: 110067 - DNA, 28 bp, Artificial Sequence
  Description of Artificial Sequence: Synthetic oligonucleotide
ttcgtcgtcagttatgcagcggcactgc

SEQ ID NO: 110068 - DNA, 27 bp, Artificial Sequence
  Description of Artificial Sequence: Synthetic oligonucleotide
tcgtcgtcagttatgcagcggcactgc

SEQ ID NO: 110069 - DNA, 26 bp, Artificial Sequence
  Description of Artificial Sequence: Synthetic oligonucleotide
cgtcgtcagttatgcagcggcactgc

SEQ ID NO: 110070 - DNA, 26 bp, Artificial Sequence
  Description of Artificial Sequence: Synthetic oligonucleotide
gtcgtcagttatgcagcggcactgcc

SEQ ID NO: 110071 - DNA, 26 bp, Artificial Sequence
  Description of Artificial Sequence: Synthetic oligonucleotide
tcgtcagttatgcagcggcactgccc

SEQ ID NO: 110072 - DNA, 25 bp, Artificial Sequence
  Description of Artificial Sequence: Synthetic oligonucleotide
cgtcagttatgcagcggcactgccc

SEQ ID NO: 110073 - DNA, 31 bp, Artificial Sequence
  Description of Artificial Sequence: Synthetic oligonucleotide
ggtgacgggatctataacaacaccatgggtc

SEQ ID NO: 110074 - DNA, 32 bp, Artificial Sequence
  Description of Artificial Sequence: Synthetic oligonucleotide
gtgacgggatctataacaacaccatgggtcac

SEQ ID NO: 110075 - DNA, 32 bp, Artificial Sequence
  Description of Artificial Sequence: Synthetic oligonucleotide
tgacgggatctataacaacaccatgggtcacg

SEQ ID NO: 110076 - DNA, 31 bp, Artificial Sequence
  Description of Artificial Sequence: Synthetic oligonucleotide
gacgggatctataacaacaccatgggtcacg

SEQ ID NO: 110077 - DNA, 32 bp, Artificial Sequence
  Description of Artificial Sequence: Synthetic oligonucleotide
acgggatctataacaacaccatgggtcacgtg

SEQ ID NO: 110078 - DNA, 31 bp, Artificial Sequence
  Description of Artificial Sequence: Synthetic oligonucleotide
cgggatctataacaacaccatgggtcacgtg

SEQ ID NO: 110079 - DNA, 31 bp, Artificial Sequence
  Description of Artificial Sequence: Synthetic oligonucleotide
gggatctataacaacaccatgggtcacgtgc

SEQ ID NO: 110080 - DNA, 32 bp, Artificial Sequence
  Description of Artificial Sequence: Synthetic oligonucleotide
ggatctataacaacaccatgggtcacgtgcac

SEQ ID NO: 110081 - DNA, 33 bp, Artificial Sequence
  Description of Artificial Sequence: Synthetic oligonucleotide
gatctataacaacaccatgggtcacgtgcacag

SEQ ID NO: 110082 - DNA, 33 bp, Artificial Sequence
  Description of Artificial Sequence: Synthetic oligonucleotide
atctataacaacaccatgggtcacgtgcacagc

SEQ ID NO: 110083 - DNA, 32 bp, Artificial Sequence
  Description of Artificial Sequence: Synthetic oligonucleotide
tctataacaacaccatgggtcacgtgcacagc

SEQ ID NO: 110084 - DNA, 31 bp, Artificial Sequence
  Description of Artificial Sequence: Synthetic oligonucleotide
ctataacaacaccatgggtcacgtgcacagc

SEQ ID NO: 110085 - DNA, 31 bp, Artificial Sequence
  Description of Artificial Sequence: Synthetic oligonucleotide
tataacaacaccatgggtcacgtgcacagcc

SEQ ID NO: 110086 - DNA, 30 bp, Artificial Sequence
  Description of Artificial Sequence: Synthetic oligonucleotide
ataacaacaccatgggtcacgtgcacagcc

SEQ ID NO: 110087 - DNA, 29 bp, Artificial Sequence
  Description of Artificial Sequence: Synthetic oligonucleotide
taacaacaccatgggtcacgtgcacagcc

SEQ ID NO: 110088 - DNA, 28 bp, Artificial Sequence
  Description of Artificial Sequence: Synthetic oligonucleotide
aacaacaccatgggtcacgtgcacagcc

SEQ ID NO: 110089 - DNA, 27 bp, Artificial Sequence
  Description of Artificial Sequence: Synthetic oligonucleotide
acaacaccatgggtcacgtgcacagcc

SEQ ID NO: 110090 - DNA, 27 bp, Artificial Sequence
  Description of Artificial Sequence: Synthetic oligonucleotide
caacaccatgggtcacgtgcacagcca

SEQ ID NO: 110091 - DNA, 27 bp, Artificial Sequence
  Description of Artificial Sequence: Synthetic oligonucleotide
aacaccatgggtcacgtgcacagccac

SEQ ID NO: 110092 - DNA, 27 bp, Artificial Sequence
  Description of Artificial Sequence: Synthetic oligonucleotide
acaccatgggtcacgtgcacagccact

SEQ ID NO: 110093 - DNA, 27 bp, Artificial Sequence
  Description of Artificial Sequence: Synthetic oligonucleotide
caccatgggtcacgtgcacagccactt

SEQ ID NO: 110094 - DNA, 27 bp, Artificial Sequence
  Description of Artificial Sequence: Synthetic oligonucleotide
accatgggtcacgtgcacagccacttg

SEQ ID NO: 110095 - DNA, 26 bp, Artificial Sequence
  Description of Artificial Sequence: Synthetic oligonucleotide
ccatgggtcacgtgcacagccacttg

SEQ ID NO: 110096 - DNA, 27 bp, Artificial Sequence
  Description of Artificial Sequence: Synthetic oligonucleotide
catgggtcacgtgcacagccacttgca

SEQ ID NO: 110097 - DNA, 27 bp, Artificial Sequence
  Description of Artificial Sequence: Synthetic oligonucleotide
atgggtcacgtgcacagccacttgcag

SEQ ID NO: 110098 - DNA, 26 bp, Artificial Sequence
  Description of Artificial Sequence: Synthetic oligonucleotide
tgggtcacgtgcacagccacttgcag

SEQ ID NO: 110099 - DNA, 25 bp, Artificial Sequence
  Description of Artificial Sequence: Synthetic oligonucleotide
gggtcacgtgcacagccacttgcag

SEQ ID NO: 110100 - DNA, 25 bp, Artificial Sequence
  Description of Artificial Sequence: Synthetic oligonucleotide
ggtcacgtgcacagccacttgcagg

SEQ ID NO: 110101 - DNA, 26 bp, Artificial Sequence
  Description of Artificial Sequence: Synthetic oligonucleotide
gtcacgtgcacagccacttgcaggga

SEQ ID NO: 110102 - DNA, 27 bp, Artificial Sequence
  Description of Artificial Sequence: Synthetic oligonucleotide
tcacgtgcacagccacttgcagggaga

SEQ ID NO: 110103 - DNA, 28 bp, Artificial Sequence
  Description of Artificial Sequence: Synthetic oligonucleotide
aaagtccagccaggtggccattgaggtc

SEQ ID NO: 110104 - DNA, 27 bp, Artificial Sequence
  Description of Artificial Sequence: Synthetic oligonucleotide
aagtccagccaggtggccattgaggtc

SEQ ID NO: 110105 - DNA, 26 bp, Artificial Sequence
  Description of Artificial Sequence: Synthetic oligonucleotide
agtccagccaggtggccattgaggtc

SEQ ID NO: 110106 - DNA, 25 bp, Artificial Sequence
  Description of Artificial Sequence: Synthetic oligonucleotide
gtccagccaggtggccattgaggtc

SEQ ID NO: 110107 - DNA, 26 bp, Artificial Sequence
  Description of Artificial Sequence: Synthetic oligonucleotide
tccagccaggtggccattgaggtcct

SEQ ID NO: 110108 - DNA, 25 bp, Artificial Sequence
  Description of Artificial Sequence: Synthetic oligonucleotide
ccagccaggtggccattgaggtcct

SEQ ID NO: 110109 - DNA, 26 bp, Artificial Sequence
  Description of Artificial Sequence: Synthetic oligonucleotide
cagccaggtggccattgaggtcctgt

SEQ ID NO: 110110 - DNA, 26 bp, Artificial Sequence
  Description of Artificial Sequence: Synthetic oligonucleotide
agccaggtggccattgaggtcctgtc

SEQ ID NO: 110111 - DNA, 25 bp, Artificial Sequence
  Description of Artificial Sequence: Synthetic oligonucleotide
gccaggtggccattgaggtcctgtc

SEQ ID NO: 110112 - DNA, 25 bp, Artificial Sequence
  Description of Artificial Sequence: Synthetic oligonucleotide
ccaggtggccattgaggtcctgtcg

SEQ ID NO: 110113 - DNA, 25 bp, Artificial Sequence
  Description of Artificial Sequence: Synthetic oligonucleotide
caggtggccattgaggtcctgtcgg

SEQ ID NO: 110114 - DNA, 25 bp, Artificial Sequence
  Description of Artificial Sequence: Synthetic oligonucleotide
aggtggccattgaggtcctgtcggc

SEQ ID NO: 110115 - DNA, 24 bp, Artificial Sequence
  Description of Artificial Sequence: Synthetic oligonucleotide
ggtggccattgaggtcctgtcggc

SEQ ID NO: 110116 - DNA, 26 bp, Artificial Sequence
  Description of Artificial Sequence: Synthetic oligonucleotide
gtggccattgaggtcctgtcggccat

SEQ ID NO: 110117 - DNA, 26 bp, Artificial Sequence
  Description of Artificial Sequence: Synthetic oligonucleotide
tggccattgaggtcctgtcggccatg

SEQ ID NO: 110118 - DNA, 25 bp, Artificial Sequence
  Description of Artificial Sequence: Synthetic oligonucleotide
ggccattgaggtcctgtcggccatg

SEQ ID NO: 110119 - DNA, 25 bp, Artificial Sequence
  Description of Artificial Sequence: Synthetic oligonucleotide
gccattgaggtcctgtcggccatgc

SEQ ID NO: 110120 - DNA, 27 bp, Artificial Sequence
  Description of Artificial Sequence: Synthetic oligonucleotide
ccattgaggtcctgtcggccatgccta

SEQ ID NO: 110121 - DNA, 27 bp, Artificial Sequence
  Description of Artificial Sequence: Synthetic oligonucleotide
cattgaggtcctgtcggccatgcctac

SEQ ID NO: 110122 - DNA, 28 bp, Artificial Sequence
  Description of Artificial Sequence: Synthetic oligonucleotide
attgaggtcctgtcggccatgcctacag

SEQ ID NO: 110123 - DNA, 27 bp, Artificial Sequence
  Description of Artificial Sequence: Synthetic oligonucleotide
ttgaggtcctgtcggccatgcctacag

SEQ ID NO: 110124 - DNA, 27 bp, Artificial Sequence
  Description of Artificial Sequence: Synthetic oligonucleotide
tgaggtcctgtcggccatgcctacagt

SEQ ID NO: 110125 - DNA, 27 bp, Artificial Sequence
  Description of Artificial Sequence: Synthetic oligonucleotide
gaggtcctgtcggccatgcctacagtt

SEQ ID NO: 110126 - DNA, 27 bp, Artificial Sequence
  Description of Artificial Sequence: Synthetic oligonucleotide
aggtcctgtcggccatgcctacagttc

SEQ ID NO: 110127 - DNA, 26 bp, Artificial Sequence
  Description of Artificial Sequence: Synthetic oligonucleotide
ggtcctgtcggccatgcctacagttc

SEQ ID NO: 110128 - DNA, 27 bp, Artificial Sequence
  Description of Artificial Sequence: Synthetic oligonucleotide
gtcctgtcggccatgcctacagttcga

SEQ ID NO: 110129 - DNA, 28 bp, Artificial Sequence
  Description of Artificial Sequence: Synthetic oligonucleotide
tcctgtcggccatgcctacagttcgaag

SEQ ID NO: 110130 - DNA, 27 bp, Artificial Sequence
  Description of Artificial Sequence: Synthetic oligonucleotide
cctgtcggccatgcctacagttcgaag

SEQ ID NO: 110131 - DNA, 30 bp, Artificial Sequence
  Description of Artificial Sequence: Synthetic oligonucleotide
tcctttgcctacccaaaccgcccagatatc

SEQ ID NO: 110132 - DNA, 29 bp, Artificial Sequence
  Description of Artificial Sequence: Synthetic oligonucleotide
cctttgcctacccaaaccgcccagatatc

SEQ ID NO: 110133 - DNA, 32 bp, Artificial Sequence
  Description of Artificial Sequence: Synthetic oligonucleotide
ctttgcctacccaaaccgcccagatatcttag

SEQ ID NO: 110134 - DNA, 33 bp, Artificial Sequence
  Description of Artificial Sequence: Synthetic oligonucleotide
tttgcctacccaaaccgcccagatatcttagtg

SEQ ID NO: 110135 - DNA, 32 bp, Artificial Sequence
  Description of Artificial Sequence: Synthetic oligonucleotide
ttgcctacccaaaccgcccagatatcttagtg

SEQ ID NO: 110136 - DNA, 31 bp, Artificial Sequence
  Description of Artificial Sequence: Synthetic oligonucleotide
tgcctacccaaaccgcccagatatcttagtg

SEQ ID NO: 110137 - DNA, 30 bp, Artificial Sequence
  Description of Artificial Sequence: Synthetic oligonucleotide
gcctacccaaaccgcccagatatcttagtg

SEQ ID NO: 110138 - DNA, 30 bp, Artificial Sequence
  Description of Artificial Sequence: Synthetic oligonucleotide
cctacccaaaccgcccagatatcttagtgc

SEQ ID NO: 110139 - DNA, 32 bp, Artificial Sequence
  Description of Artificial Sequence: Synthetic oligonucleotide
ctacccaaaccgcccagatatcttagtgctac

SEQ ID NO: 110140 - DNA, 33 bp, Artificial Sequence
  Description of Artificial Sequence: Synthetic oligonucleotide
tacccaaaccgcccagatatcttagtgctacag

SEQ ID NO: 110141 - DNA, 32 bp, Artificial Sequence
  Description of Artificial Sequence: Synthetic oligonucleotide
acccaaaccgcccagatatcttagtgctacag

SEQ ID NO: 110142 - DNA, 31 bp, Artificial Sequence
  Description of Artificial Sequence: Synthetic oligonucleotide
cccaaaccgcccagatatcttagtgctacag

SEQ ID NO: 110143 - DNA, 31 bp, Artificial Sequence
  Description of Artificial Sequence: Synthetic oligonucleotide
ccaaaccgcccagatatcttagtgctacagg

SEQ ID NO: 110144 - DNA, 31 bp, Artificial Sequence
  Description of Artificial Sequence: Synthetic oligonucleotide
caaaccgcccagatatcttagtgctacaggg

SEQ ID NO: 110145 - DNA, 31 bp, Artificial Sequence
  Description of Artificial Sequence: Synthetic oligonucleotide
aaaccgcccagatatcttagtgctacagggg

SEQ ID NO: 110146 - DNA, 30 bp, Artificial Sequence
  Description of Artificial Sequence: Synthetic oligonucleotide
aaccgcccagatatcttagtgctacagggg

SEQ ID NO: 110147 - DNA, 29 bp, Artificial Sequence
  Description of Artificial Sequence: Synthetic oligonucleotide
accgcccagatatcttagtgctacagggg

SEQ ID NO: 110148 - DNA, 28 bp, Artificial Sequence
  Description of Artificial Sequence: Synthetic oligonucleotide
ccgcccagatatcttagtgctacagggg

SEQ ID NO: 110149 - DNA, 28 bp, Artificial Sequence
  Description of Artificial Sequence: Synthetic oligonucleotide
cgcccagatatcttagtgctacaggggc

SEQ ID NO: 110150 - DNA, 29 bp, Artificial Sequence
  Description of Artificial Sequence: Synthetic oligonucleotide
gcccagatatcttagtgctacaggggctg

SEQ ID NO: 110151 - DNA, 30 bp, Artificial Sequence
  Description of Artificial Sequence: Synthetic oligonucleotide
cccagatatcttagtgctacaggggctgac

SEQ ID NO: 110152 - DNA, 33 bp, Artificial Sequence
  Description of Artificial Sequence: Synthetic oligonucleotide
ccagatatcttagtgctacaggggctgacattc

SEQ ID NO: 110153 - DNA, 34 bp, Artificial Sequence
  Description of Artificial Sequence: Synthetic oligonucleotide
cagatatcttagtgctacaggggctgacattcac

SEQ ID NO: 110154 - DNA, 34 bp, Artificial Sequence
  Description of Artificial Sequence: Synthetic oligonucleotide
agatatcttagtgctacaggggctgacattcacc

SEQ ID NO: 110155 - DNA, 33 bp, Artificial Sequence
  Description of Artificial Sequence: Synthetic oligonucleotide
gatatcttagtgctacaggggctgacattcacc

SEQ ID NO: 110156 - DNA, 33 bp, Artificial Sequence
  Description of Artificial Sequence: Synthetic oligonucleotide
atatcttagtgctacaggggctgacattcaccc

SEQ ID NO: 110157 - DNA, 32 bp, Artificial Sequence
  Description of Artificial Sequence: Synthetic oligonucleotide
tatcttagtgctacaggggctgacattcaccc

SEQ ID NO: 110158 - DNA, 31 bp, Artificial Sequence
  Description of Artificial Sequence: Synthetic oligonucleotide
atcttagtgctacaggggctgacattcaccc

SEQ ID NO: 110159 - DNA, 25 bp, Artificial Sequence
  Description of Artificial Sequence: Synthetic oligonucleotide
aggtaggcgaggctgggagccagtt

SEQ ID NO: 110160 - DNA, 24 bp, Artificial Sequence
  Description of Artificial Sequence: Synthetic oligonucleotide
ggtaggcgaggctgggagccagtt

SEQ ID NO: 110161 - DNA, 25 bp, Artificial Sequence
  Description of Artificial Sequence: Synthetic oligonucleotide
gtaggcgaggctgggagccagttgt

SEQ ID NO: 110162 - DNA, 26 bp, Artificial Sequence
  Description of Artificial Sequence: Synthetic oligonucleotide
taggcgaggctgggagccagttgtca

SEQ ID NO: 110163 - DNA, 25 bp, Artificial Sequence
  Description of Artificial Sequence: Synthetic oligonucleotide
aggcgaggctgggagccagttgtca

SEQ ID NO: 110164 - DNA, 24 bp, Artificial Sequence
  Description of Artificial Sequence: Synthetic oligonucleotide
ggcgaggctgggagccagttgtca

SEQ ID NO: 110165 - DNA, 24 bp, Artificial Sequence
  Description of Artificial Sequence: Synthetic oligonucleotide
gcgaggctgggagccagttgtcag

SEQ ID NO: 110166 - DNA, 24 bp, Artificial Sequence
  Description of Artificial Sequence: Synthetic oligonucleotide
cgaggctgggagccagttgtcagg

SEQ ID NO: 110167 - DNA, 24 bp, Artificial Sequence
  Description of Artificial Sequence: Synthetic oligonucleotide
gaggctgggagccagttgtcaggg

SEQ ID NO: 110168 - DNA, 24 bp, Artificial Sequence
  Description of Artificial Sequence: Synthetic oligonucleotide
aggctgggagccagttgtcagggg

SEQ ID NO: 110169 - DNA, 23 bp, Artificial Sequence
  Description of Artificial Sequence: Synthetic oligonucleotide
ggctgggagccagttgtcagggg

SEQ ID NO: 110170 - DNA, 24 bp, Artificial Sequence
  Description of Artificial Sequence: Synthetic oligonucleotide
gctgggagccagttgtcagggggt

SEQ ID NO: 110171 - DNA, 25 bp, Artificial Sequence
  Description of Artificial Sequence: Synthetic oligonucleotide
ctgggagccagttgtcagggggtca

SEQ ID NO: 110172 - DNA, 25 bp, Artificial Sequence
  Description of Artificial Sequence: Synthetic oligonucleotide
tgggagccagttgtcagggggtcag

SEQ ID NO: 110173 - DNA, 24 bp, Artificial Sequence
  Description of Artificial Sequence: Synthetic oligonucleotide
gggagccagttgtcagggggtcag

SEQ ID NO: 110174 - DNA, 24 bp, Artificial Sequence
  Description of Artificial Sequence: Synthetic oligonucleotide
ggagccagttgtcagggggtcagc

SEQ ID NO: 110175 - DNA, 25 bp, Artificial Sequence
  Description of Artificial Sequence: Synthetic oligonucleotide
gagccagttgtcagggggtcagcga

SEQ ID NO: 110176 - DNA, 26 bp, Artificial Sequence
  Description of Artificial Sequence: Synthetic oligonucleotide
agccagttgtcagggggtcagcgaca

SEQ ID NO: 110177 - DNA, 25 bp, Artificial Sequence
  Description of Artificial Sequence: Synthetic oligonucleotide
gccagttgtcagggggtcagcgaca

SEQ ID NO: 110178 - DNA, 25 bp, Artificial Sequence
  Description of Artificial Sequence: Synthetic oligonucleotide
ccagttgtcagggggtcagcgacag

SEQ ID NO: 110179 - DNA, 25 bp, Artificial Sequence
  Description of Artificial Sequence: Synthetic oligonucleotide
cagttgtcagggggtcagcgacagg

SEQ ID NO: 110180 - DNA, 26 bp, Artificial Sequence
  Description of Artificial Sequence: Synthetic oligonucleotide
agttgtcagggggtcagcgacaggca

SEQ ID NO: 110181 - DNA, 25 bp, Artificial Sequence
  Description of Artificial Sequence: Synthetic oligonucleotide
gttgtcagggggtcagcgacaggca

SEQ ID NO: 110182 - DNA, 26 bp, Artificial Sequence
  Description of Artificial Sequence: Synthetic oligonucleotide
ttgtcagggggtcagcgacaggcagt

SEQ ID NO: 110183 - DNA, 25 bp, Artificial Sequence
  Description of Artificial Sequence: Synthetic oligonucleotide
atgcggctccctgacctgagaccct

SEQ ID NO: 110184 - DNA, 24 bp, Artificial Sequence
  Description of Artificial Sequence: Synthetic oligonucleotide
tgcggctccctgacctgagaccct

SEQ ID NO: 110185 - DNA, 23 bp, Artificial Sequence
  Description of Artificial Sequence: Synthetic oligonucleotide
gcggctccctgacctgagaccct

SEQ ID NO: 110186 - DNA, 23 bp, Artificial Sequence
  Description of Artificial Sequence: Synthetic oligonucleotide
cggctccctgacctgagaccctg

SEQ ID NO: 110187 - DNA, 24 bp, Artificial Sequence
  Description of Artificial Sequence: Synthetic oligonucleotide
ggctccctgacctgagaccctgga

SEQ ID NO: 110188 - DNA, 24 bp, Artificial Sequence
  Description of Artificial Sequence: Synthetic oligonucleotide
gctccctgacctgagaccctggac

SEQ ID NO: 110189 - DNA, 25 bp, Artificial Sequence
  Description of Artificial Sequence: Synthetic oligonucleotide
ctccctgacctgagaccctggacct

SEQ ID NO: 110190 - DNA, 25 bp, Artificial Sequence
  Description of Artificial Sequence: Synthetic oligonucleotide
tccctgacctgagaccctggacctc

SEQ ID NO: 110191 - DNA, 24 bp, Artificial Sequence
  Description of Artificial Sequence: Synthetic oligonucleotide
ccctgacctgagaccctggacctc

SEQ ID NO: 110192 - DNA, 24 bp, Artificial Sequence
  Description of Artificial Sequence: Synthetic oligonucleotide
cctgacctgagaccctggacctcc

SEQ ID NO: 110193 - DNA, 25 bp, Artificial Sequence
  Description of Artificial Sequence: Synthetic oligonucleotide
ctgacctgagaccctggacctccct

SEQ ID NO: 110194 - DNA, 25 bp, Artificial Sequence
  Description of Artificial Sequence: Synthetic oligonucleotide
tgacctgagaccctggacctccctg

SEQ ID NO: 110195 - DNA, 24 bp, Artificial Sequence
  Description of Artificial Sequence: Synthetic oligonucleotide
gacctgagaccctggacctccctg

SEQ ID NO: 110196 - DNA, 25 bp, Artificial Sequence
  Description of Artificial Sequence: Synthetic oligonucleotide
acctgagaccctggacctccctgct

SEQ ID NO: 110197 - DNA, 24 bp, Artificial Sequence
  Description of Artificial Sequence: Synthetic oligonucleotide
cctgagaccctggacctccctgct

SEQ ID NO: 110198 - DNA, 24 bp, Artificial Sequence
  Description of Artificial Sequence: Synthetic oligonucleotide
ctgagaccctggacctccctgctg

SEQ ID NO: 110199 - DNA, 25 bp, Artificial Sequence
  Description of Artificial Sequence: Synthetic oligonucleotide
tgagaccctggacctccctgctgct

SEQ ID NO: 110200 - DNA, 24 bp, Artificial Sequence
  Description of Artificial Sequence: Synthetic oligonucleotide
gagaccctggacctccctgctgct

SEQ ID NO: 110201 - DNA, 24 bp, Artificial Sequence
  Description of Artificial Sequence: Synthetic oligonucleotide
agaccctggacctccctgctgctg

SEQ ID NO: 110202 - DNA, 23 bp, Artificial Sequence
  Description of Artificial Sequence: Synthetic oligonucleotide
gaccctggacctccctgctgctg

SEQ ID NO: 110203 - DNA, 24 bp, Artificial Sequence
  Description of Artificial Sequence: Synthetic oligonucleotide
accctggacctccctgctgctggt

SEQ ID NO: 110204 - DNA, 23 bp, Artificial Sequence
  Description of Artificial Sequence: Synthetic oligonucleotide
ccctggacctccctgctgctggt

SEQ ID NO: 110205 - DNA, 23 bp, Artificial Sequence
  Description of Artificial Sequence: Synthetic oligonucleotide
cctggacctccctgctgctggtg

SEQ ID NO: 110206 - DNA, 24 bp, Artificial Sequence
  Description of Artificial Sequence: Synthetic oligonucleotide
ctggacctccctgctgctggtgga

SEQ ID NO: 110207 - DNA, 24 bp, Artificial Sequence
  Description of Artificial Sequence: Synthetic oligonucleotide
tggacctccctgctgctggtggac

SEQ ID NO: 110208 - DNA, 23 bp, Artificial Sequence
  Description of Artificial Sequence: Synthetic oligonucleotide
ggacctccctgctgctggtggac

SEQ ID NO: 110209 - DNA, 23 bp, Artificial Sequence
  Description of Artificial Sequence: Synthetic oligonucleotide
gacctccctgctgctggtggacg

SEQ ID NO: 110210 - DNA, 23 bp, Artificial Sequence
  Description of Artificial Sequence: Synthetic oligonucleotide
acctccctgctgctggtggacgc

SEQ ID NO: 110211 - DNA, 22 bp, Artificial Sequence
  Description of Artificial Sequence: Synthetic oligonucleotide
cctccctgctgctggtggacgc

SEQ ID NO: 110212 - DNA, 22 bp, Artificial Sequence
  Description of Artificial Sequence: Synthetic oligonucleotide
ctccctgctgctggtggacgcg

SEQ ID NO: 110213 - DNA, 22 bp, Artificial Sequence
  Description of Artificial Sequence: Synthetic oligonucleotide
tccctgctgctggtggacgcgg

SEQ ID NO: 110214 - DNA, 21 bp, Artificial Sequence
  Description of Artificial Sequence: Synthetic oligonucleotide
ccctgctgctggtggacgcgg

SEQ ID NO: 110215 - DNA, 25 bp, Artificial Sequence
  Description of Artificial Sequence: Synthetic oligonucleotide
cctgctgctggtggacgcggcttta

SEQ ID NO: 110216 - DNA, 26 bp, Artificial Sequence
  Description of Artificial Sequence: Synthetic oligonucleotide
ctgctgctggtggacgcggctttact

SEQ ID NO: 110217 - DNA, 27 bp, Artificial Sequence
  Description of Artificial Sequence: Synthetic oligonucleotide
tgctgctggtggacgcggctttactgt

SEQ ID NO: 110218 - DNA, 26 bp, Artificial Sequence
  Description of Artificial Sequence: Synthetic oligonucleotide
gctgctggtggacgcggctttactgt

SEQ ID NO: 110219 - DNA, 26 bp, Artificial Sequence
  Description of Artificial Sequence: Synthetic oligonucleotide
ctgctggtggacgcggctttactgtg

SEQ ID NO: 110220 - DNA, 26 bp, Artificial Sequence
  Description of Artificial Sequence: Synthetic oligonucleotide
tgctggtggacgcggctttactgtgg

SEQ ID NO: 110221 - DNA, 25 bp, Artificial Sequence
  Description of Artificial Sequence: Synthetic oligonucleotide
gctggtggacgcggctttactgtgg

SEQ ID NO: 110222 - DNA, 26 bp, Artificial Sequence
  Description of Artificial Sequence: Synthetic oligonucleotide
ctggtggacgcggctttactgtggct

SEQ ID NO: 110223 - DNA, 26 bp, Artificial Sequence
  Description of Artificial Sequence: Synthetic oligonucleotide
tggtggacgcggctttactgtggctg

SEQ ID NO: 110224 - DNA, 25 bp, Artificial Sequence
  Description of Artificial Sequence: Synthetic oligonucleotide
ggtggacgcggctttactgtggctg

SEQ ID NO: 110225 - DNA, 27 bp, Artificial Sequence
  Description of Artificial Sequence: Synthetic oligonucleotide
gtggacgcggctttactgtggctgctt

SEQ ID NO: 110226 - DNA, 27 bp, Artificial Sequence
  Description of Artificial Sequence: Synthetic oligonucleotide
tggacgcggctttactgtggctgcttc

SEQ ID NO: 110227 - DNA, 27 bp, Artificial Sequence
  Description of Artificial Sequence: Synthetic oligonucleotide
ggacgcggctttactgtggctgcttca

SEQ ID NO: 110228 - DNA, 27 bp, Artificial Sequence
  Description of Artificial Sequence: Synthetic oligonucleotide
gacgcggctttactgtggctgcttcag

SEQ ID NO: 110229 - DNA, 27 bp, Artificial Sequence
  Description of Artificial Sequence: Synthetic oligonucleotide
acgcggctttactgtggctgcttcagg

SEQ ID NO: 110230 - DNA, 26 bp, Artificial Sequence
  Description of Artificial Sequence: Synthetic oligonucleotide
cgcggctttactgtggctgcttcagg

SEQ ID NO: 110231 - DNA, 26 bp, Artificial Sequence
  Description of Artificial Sequence: Synthetic oligonucleotide
gcggctttactgtggctgcttcaggg

SEQ ID NO: 110232 - DNA, 26 bp, Artificial Sequence
  Description of Artificial Sequence: Synthetic oligonucleotide
cggctttactgtggctgcttcagggc

SEQ ID NO: 110233 - DNA, 26 bp, Artificial Sequence
  Description of Artificial Sequence: Synthetic oligonucleotide
ggctttactgtggctgcttcagggcc

SEQ ID NO: 110234 - DNA, 27 bp, Artificial Sequence
  Description of Artificial Sequence: Synthetic oligonucleotide
gctttactgtggctgcttcagggccct

SEQ ID NO: 110235 - DNA, 27 bp, Artificial Sequence
  Description of Artificial Sequence: Synthetic oligonucleotide
ctttactgtggctgcttcagggccctc

SEQ ID NO: 110236 - DNA, 28 bp, Artificial Sequence
  Description of Artificial Sequence: Synthetic oligonucleotide
tttactgtggctgcttcagggccctctg

SEQ ID NO: 110237 - DNA, 27 bp, Artificial Sequence
  Description of Artificial Sequence: Synthetic oligonucleotide
ttactgtggctgcttcagggccctctg

SEQ ID NO: 110238 - DNA, 26 bp, Artificial Sequence
  Description of Artificial Sequence: Synthetic oligonucleotide
tactgtggctgcttcagggccctctg

SEQ ID NO: 110239 - DNA, 25 bp, Artificial Sequence
  Description of Artificial Sequence: Synthetic oligonucleotide
actgtggctgcttcagggccctctg

SEQ ID NO: 110240 - DNA, 24 bp, Artificial Sequence
  Description of Artificial Sequence: Synthetic oligonucleotide
ctgtggctgcttcagggccctctg

SEQ ID NO: 110241 - DNA, 24 bp, Artificial Sequence
  Description of Artificial Sequence: Synthetic oligonucleotide
tgtggctgcttcagggccctctgg

SEQ ID NO: 110242 - DNA, 23 bp, Artificial Sequence
  Description of Artificial Sequence: Synthetic oligonucleotide
gtggctgcttcagggccctctgg

SEQ ID NO: 110243 - DNA, 23 bp, Artificial Sequence
  Description of Artificial Sequence: Synthetic oligonucleotide
tggctgcttcagggccctctggg

SEQ ID NO: 110244 - DNA, 22 bp, Artificial Sequence
  Description of Artificial Sequence: Synthetic oligonucleotide
ggctgcttcagggccctctggg

SEQ ID NO: 110245 - DNA, 23 bp, Artificial Sequence
  Description of Artificial Sequence: Synthetic oligonucleotide
gctgcttcagggccctctgggga

SEQ ID NO: 110246 - DNA, 26 bp, Artificial Sequence
  Description of Artificial Sequence: Synthetic oligonucleotide
ctgcttcagggccctctggggacttt

SEQ ID NO: 110247 - DNA, 26 bp, Artificial Sequence
  Description of Artificial Sequence: Synthetic oligonucleotide
tgcttcagggccctctggggactttg

SEQ ID NO: 110248 - DNA, 25 bp, Artificial Sequence
  Description of Artificial Sequence: Synthetic oligonucleotide
gcttcagggccctctggggactttg

SEQ ID NO: 110249 - DNA, 27 bp, Artificial Sequence
  Description of Artificial Sequence: Synthetic oligonucleotide
cttcagggccctctggggactttgctt

SEQ ID NO: 110250 - DNA, 27 bp, Artificial Sequence
  Description of Artificial Sequence: Synthetic oligonucleotide
ttcagggccctctggggactttgcttc

SEQ ID NO: 110251 - DNA, 26 bp, Artificial Sequence
  Description of Artificial Sequence: Synthetic oligonucleotide
tcagggccctctggggactttgcttc

SEQ ID NO: 110252 - DNA, 25 bp, Artificial Sequence
  Description of Artificial Sequence: Synthetic oligonucleotide
cagggccctctggggactttgcttc

SEQ ID NO: 110253 - DNA, 26 bp, Artificial Sequence
  Description of Artificial Sequence: Synthetic oligonucleotide
agggccctctggggactttgcttcct

SEQ ID NO: 110254 - DNA, 25 bp, Artificial Sequence
  Description of Artificial Sequence: Synthetic oligonucleotide
gggccctctggggactttgcttcct

SEQ ID NO: 110255 - DNA, 27 bp, Artificial Sequence
  Description of Artificial Sequence: Synthetic oligonucleotide
ggccctctggggactttgcttcctcaa

SEQ ID NO: 110256 - DNA, 27 bp, Artificial Sequence
  Description of Artificial Sequence: Synthetic oligonucleotide
gccctctggggactttgcttcctcaag

SEQ ID NO: 110257 - DNA, 27 bp, Artificial Sequence
  Description of Artificial Sequence: Synthetic oligonucleotide
ccctctggggactttgcttcctcaagg

SEQ ID NO: 110258 - DNA, 27 bp, Artificial Sequence
  Description of Artificial Sequence: Synthetic oligonucleotide
cctctggggactttgcttcctcaaggg

SEQ ID NO: 110259 - DNA, 27 bp, Artificial Sequence
  Description of Artificial Sequence: Synthetic oligonucleotide
ctctggggactttgcttcctcaagggc

SEQ ID NO: 110260 - DNA, 28 bp, Artificial Sequence
  Description of Artificial Sequence: Synthetic oligonucleotide
tctggggactttgcttcctcaagggctg

SEQ ID NO: 110261 - DNA, 27 bp, Artificial Sequence
  Description of Artificial Sequence: Synthetic oligonucleotide
ctggggactttgcttcctcaagggctg

SEQ ID NO: 110262 - DNA, 27 bp, Artificial Sequence
  Description of Artificial Sequence: Synthetic oligonucleotide
tggggactttgcttcctcaagggctgc

SEQ ID NO: 110263 - DNA, 26 bp, Artificial Sequence
  Description of Artificial Sequence: Synthetic oligonucleotide
ggggactttgcttcctcaagggctgc

SEQ ID NO: 110264 - DNA, 27 bp, Artificial Sequence
  Description of Artificial Sequence: Synthetic oligonucleotide
gggactttgcttcctcaagggctgcca

SEQ ID NO: 110265 - DNA, 27 bp, Artificial Sequence
  Description of Artificial Sequence: Synthetic oligonucleotide
ggactttgcttcctcaagggctgccag

SEQ ID NO: 110266 - DNA, 27 bp, Artificial Sequence
  Description of Artificial Sequence: Synthetic oligonucleotide
gactttgcttcctcaagggctgccagg

SEQ ID NO: 110267 - DNA, 28 bp, Artificial Sequence
  Description of Artificial Sequence: Synthetic oligonucleotide
actttgcttcctcaagggctgccaggac

SEQ ID NO: 110268 - DNA, 27 bp, Artificial Sequence
  Description of Artificial Sequence: Synthetic oligonucleotide
ctttgcttcctcaagggctgccaggac

SEQ ID NO: 110269 - DNA, 30 bp, Artificial Sequence
  Description of Artificial Sequence: Synthetic oligonucleotide
tttgcttcctcaagggctgccaggactatg

SEQ ID NO: 110270 - DNA, 29 bp, Artificial Sequence
  Description of Artificial Sequence: Synthetic oligonucleotide
ttgcttcctcaagggctgccaggactatg

SEQ ID NO: 110271 - DNA, 28 bp, Artificial Sequence
  Description of Artificial Sequence: Synthetic oligonucleotide
tgcttcctcaagggctgccaggactatg

SEQ ID NO: 110272 - DNA, 27 bp, Artificial Sequence
  Description of Artificial Sequence: Synthetic oligonucleotide
gcttcctcaagggctgccaggactatg

SEQ ID NO: 110273 - DNA, 27 bp, Artificial Sequence
  Description of Artificial Sequence: Synthetic oligonucleotide
cttcctcaagggctgccaggactatgg

SEQ ID NO: 110274 - DNA, 27 bp, Artificial Sequence
  Description of Artificial Sequence: Synthetic oligonucleotide
ttcctcaagggctgccaggactatggc

SEQ ID NO: 110275 - DNA, 27 bp, Artificial Sequence
  Description of Artificial Sequence: Synthetic oligonucleotide
tcctcaagggctgccaggactatggct

SEQ ID NO: 110276 - DNA, 26 bp, Artificial Sequence
  Description of Artificial Sequence: Synthetic oligonucleotide
cctcaagggctgccaggactatggct

SEQ ID NO: 110277 - DNA, 26 bp, Artificial Sequence
  Description of Artificial Sequence: Synthetic oligonucleotide
ctcaagggctgccaggactatggctg

SEQ ID NO: 110278 - DNA, 27 bp, Artificial Sequence
  Description of Artificial Sequence: Synthetic oligonucleotide
tcaagggctgccaggactatggctgga

SEQ ID NO: 110279 - DNA, 26 bp, Artificial Sequence
  Description of Artificial Sequence: Synthetic oligonucleotide
caagggctgccaggactatggctgga

SEQ ID NO: 110280 - DNA, 26 bp, Artificial Sequence
  Description of Artificial Sequence: Synthetic oligonucleotide
aagggctgccaggactatggctggag

SEQ ID NO: 110281 - DNA, 25 bp, Artificial Sequence
  Description of Artificial Sequence: Synthetic oligonucleotide
agggctgccaggactatggctggag

SEQ ID NO: 110282 - DNA, 24 bp, Artificial Sequence
  Description of Artificial Sequence: Synthetic oligonucleotide
gggctgccaggactatggctggag

SEQ ID NO: 110283 - DNA, 24 bp, Artificial Sequence
  Description of Artificial Sequence: Synthetic oligonucleotide
ggctgccaggactatggctggagg

SEQ ID NO: 110284 - DNA, 24 bp, Artificial Sequence
  Description of Artificial Sequence: Synthetic oligonucleotide
gctgccaggactatggctggaggg

SEQ ID NO: 110285 - DNA, 25 bp, Artificial Sequence
  Description of Artificial Sequence: Synthetic oligonucleotide
ctgccaggactatggctggagggga

SEQ ID NO: 110286 - DNA, 25 bp, Artificial Sequence
  Description of Artificial Sequence: Synthetic oligonucleotide
tgccaggactatggctggaggggac

SEQ ID NO: 110287 - DNA, 24 bp, Artificial Sequence
  Description of Artificial Sequence: Synthetic oligonucleotide
gccaggactatggctggaggggac

SEQ ID NO: 110288 - DNA, 24 bp, Artificial Sequence
  Description of Artificial Sequence: Synthetic oligonucleotide
ccaggactatggctggaggggacc

SEQ ID NO: 110289 - DNA, 25 bp, Artificial Sequence
  Description of Artificial Sequence: Synthetic oligonucleotide
caggactatggctggaggggaccct

SEQ ID NO: 110290 - DNA, 25 bp, Artificial Sequence
  Description of Artificial Sequence: Synthetic oligonucleotide
aggactatggctggaggggaccctg

SEQ ID NO: 110291 - DNA, 24 bp, Artificial Sequence
  Description of Artificial Sequence: Synthetic oligonucleotide
ggactatggctggaggggaccctg

SEQ ID NO: 110292 - DNA, 24 bp, Artificial Sequence
  Description of Artificial Sequence: Synthetic oligonucleotide
gactatggctggaggggaccctgc

SEQ ID NO: 110293 - DNA, 24 bp, Artificial Sequence
  Description of Artificial Sequence: Synthetic oligonucleotide
actatggctggaggggaccctgcg

SEQ ID NO: 110294 - DNA, 23 bp, Artificial Sequence
  Description of Artificial Sequence: Synthetic oligonucleotide
ctatggctggaggggaccctgcg

SEQ ID NO: 110295 - DNA, 23 bp, Artificial Sequence
  Description of Artificial Sequence: Synthetic oligonucleotide
tatggctggaggggaccctgcgg

SEQ ID NO: 110296 - DNA, 22 bp, Artificial Sequence
  Description of Artificial Sequence: Synthetic oligonucleotide
atggctggaggggaccctgcgg

SEQ ID NO: 110297 - DNA, 21 bp, Artificial Sequence
  Description of Artificial Sequence: Synthetic oligonucleotide
tggctggaggggaccctgcgg

SEQ ID NO: 110298 - DNA, 20 bp, Artificial Sequence
  Description of Artificial Sequence: Synthetic oligonucleotide
ggctggaggggaccctgcgg

SEQ ID NO: 110299 - DNA, 21 bp, Artificial Sequence
  Description of Artificial Sequence: Synthetic oligonucleotide
gctggaggggaccctgcggct

SEQ ID NO: 110300 - DNA, 21 bp, Artificial Sequence
  Description of Artificial Sequence: Synthetic oligonucleotide
ctggaggggaccctgcggctg

SEQ ID NO: 110301 - DNA, 21 bp, Artificial Sequence
  Description of Artificial Sequence: Synthetic oligonucleotide
tggaggggaccctgcggctgg

SEQ ID NO: 110302 - DNA, 20 bp, Artificial Sequence
  Description of Artificial Sequence: Synthetic oligonucleotide
ggaggggaccctgcggctgg

SEQ ID NO: 110303 - DNA, 21 bp, Artificial Sequence
  Description of Artificial Sequence: Synthetic oligonucleotide
gaggggaccctgcggctggga

SEQ ID NO: 110304 - DNA, 21 bp, Artificial Sequence
  Description of Artificial Sequence: Synthetic oligonucleotide
aggggaccctgcggctgggag

SEQ ID NO: 110305 - DNA, 20 bp, Artificial Sequence
  Description of Artificial Sequence: Synthetic oligonucleotide
ggggaccctgcggctgggag

SEQ ID NO: 110306 - DNA, 20 bp, Artificial Sequence
  Description of Artificial Sequence: Synthetic oligonucleotide
gggaccctgcggctgggagg

SEQ ID NO: 110307 - DNA, 20 bp, Artificial Sequence
  Description of Artificial Sequence: Synthetic oligonucleotide
ggaccctgcggctgggaggg

SEQ ID NO: 110308 - DNA, 21 bp, Artificial Sequence
  Description of Artificial Sequence: Synthetic oligonucleotide
gaccctgcggctgggagggct

SEQ ID NO: 110309 - DNA, 22 bp, Artificial Sequence
  Description of Artificial Sequence: Synthetic oligonucleotide
accctgcggctgggagggctgt

SEQ ID NO: 110310 - DNA, 21 bp, Artificial Sequence
  Description of Artificial Sequence: Synthetic oligonucleotide
ccctgcggctgggagggctgt

SEQ ID NO: 110311 - DNA, 21 bp, Artificial Sequence
  Description of Artificial Sequence: Synthetic oligonucleotide
cctgcggctgggagggctgtg

SEQ ID NO: 110312 - DNA, 21 bp, Artificial Sequence
  Description of Artificial Sequence: Synthetic oligonucleotide
ctgcggctgggagggctgtgg

SEQ ID NO: 110313 - DNA, 21 bp, Artificial Sequence
  Description of Artificial Sequence: Synthetic oligonucleotide
tgcggctgggagggctgtggg

SEQ ID NO: 110314 - DNA, 20 bp, Artificial Sequence
  Description of Artificial Sequence: Synthetic oligonucleotide
gcggctgggagggctgtggg

SEQ ID NO: 110315 - DNA, 20 bp, Artificial Sequence
  Description of Artificial Sequence: Synthetic oligonucleotide
cggctgggagggctgtgggg

SEQ ID NO: 110316 - DNA, 20 bp, Artificial Sequence
  Description of Artificial Sequence: Synthetic oligonucleotide
ggctgggagggctgtggggg

SEQ ID NO: 110317 - DNA, 21 bp, Artificial Sequence
  Description of Artificial Sequence: Synthetic oligonucleotide
gctgggagggctgtgggggct

SEQ ID NO: 110318 - DNA, 21 bp, Artificial Sequence
  Description of Artificial Sequence: Synthetic oligonucleotide
ctgggagggctgtgggggctg

SEQ ID NO: 110319 - DNA, 25 bp, Artificial Sequence
  Description of Artificial Sequence: Synthetic oligonucleotide
tgggagggctgtgggggctgctaaa

SEQ ID NO: 110320 - DNA, 24 bp, Artificial Sequence
  Description of Artificial Sequence: Synthetic oligonucleotide
gggagggctgtgggggctgctaaa

SEQ ID NO: 110321 - DNA, 24 bp, Artificial Sequence
  Description of Artificial Sequence: Synthetic oligonucleotide
ggagggctgtgggggctgctaaag

SEQ ID NO: 110322 - DNA, 27 bp, Artificial Sequence
  Description of Artificial Sequence: Synthetic oligonucleotide
gagggctgtgggggctgctaaagctaa

SEQ ID NO: 110323 - DNA, 27 bp, Artificial Sequence
  Description of Artificial Sequence: Synthetic oligonucleotide
agggctgtgggggctgctaaagctaag

SEQ ID NO: 110324 - DNA, 27 bp, Artificial Sequence
  Description of Artificial Sequence: Synthetic oligonucleotide
gggctgtgggggctgctaaagctaaga

SEQ ID NO: 110325 - DNA, 27 bp, Artificial Sequence
  Description of Artificial Sequence: Synthetic oligonucleotide
ggctgtgggggctgctaaagctaagag

SEQ ID NO: 110326 - DNA, 27 bp, Artificial Sequence
  Description of Artificial Sequence: Synthetic oligonucleotide
gctgtgggggctgctaaagctaagagg

SEQ ID NO: 110327 - DNA, 27 bp, Artificial Sequence
  Description of Artificial Sequence: Synthetic oligonucleotide
ctgtgggggctgctaaagctaagaggg

SEQ ID NO: 110328 - DNA, 27 bp, Artificial Sequence
  Description of Artificial Sequence: Synthetic oligonucleotide
tgtgggggctgctaaagctaagagggc

SEQ ID NO: 110329 - DNA, 27 bp, Artificial Sequence
  Description of Artificial Sequence: Synthetic oligonucleotide
gtgggggctgctaaagctaagagggct

SEQ ID NO: 110330 - DNA, 27 bp, Artificial Sequence
  Description of Artificial Sequence: Synthetic oligonucleotide
tgggggctgctaaagctaagagggctg

SEQ ID NO: 110331 - DNA, 26 bp, Artificial Sequence
  Description of Artificial Sequence: Synthetic oligonucleotide
gggggctgctaaagctaagagggctg

SEQ ID NO: 110332 - DNA, 27 bp, Artificial Sequence
  Description of Artificial Sequence: Synthetic oligonucleotide
ggggctgctaaagctaagagggctgct

SEQ ID NO: 110333 - DNA, 27 bp, Artificial Sequence
  Description of Artificial Sequence: Synthetic oligonucleotide
gggctgctaaagctaagagggctgctg

SEQ ID NO: 110334 - DNA, 27 bp, Artificial Sequence
  Description of Artificial Sequence: Synthetic oligonucleotide
ggctgctaaagctaagagggctgctgg

SEQ ID NO: 110335 - DNA, 27 bp, Artificial Sequence
  Description of Artificial Sequence: Synthetic oligonucleotide
gctgctaaagctaagagggctgctggg

SEQ ID NO: 110336 - DNA, 31 bp, Artificial Sequence
  Description of Artificial Sequence: Synthetic oligonucleotide
ctgctaaagctaagagggctgctgggatttg

SEQ ID NO: 110337 - DNA, 32 bp, Artificial Sequence
  Description of Artificial Sequence: Synthetic oligonucleotide
tgctaaagctaagagggctgctgggatttgtg

SEQ ID NO: 110338 - DNA, 31 bp, Artificial Sequence
  Description of Artificial Sequence: Synthetic oligonucleotide
gctaaagctaagagggctgctgggatttgtg

SEQ ID NO: 110339 - DNA, 31 bp, Artificial Sequence
  Description of Artificial Sequence: Synthetic oligonucleotide
ctaaagctaagagggctgctgggatttgtgg

SEQ ID NO: 110340 - DNA, 31 bp, Artificial Sequence
  Description of Artificial Sequence: Synthetic oligonucleotide
taaagctaagagggctgctgggatttgtggg

SEQ ID NO: 110341 - DNA, 30 bp, Artificial Sequence
  Description of Artificial Sequence: Synthetic oligonucleotide
aaagctaagagggctgctgggatttgtggg

SEQ ID NO: 110342 - DNA, 29 bp, Artificial Sequence
  Description of Artificial Sequence: Synthetic oligonucleotide
aagctaagagggctgctgggatttgtggg

SEQ ID NO: 110343 - DNA, 28 bp, Artificial Sequence
  Description of Artificial Sequence: Synthetic oligonucleotide
agctaagagggctgctgggatttgtggg

SEQ ID NO: 110344 - DNA, 27 bp, Artificial Sequence
  Description of Artificial Sequence: Synthetic oligonucleotide
gctaagagggctgctgggatttgtggg

SEQ ID NO: 110345 - DNA, 27 bp, Artificial Sequence
  Description of Artificial Sequence: Synthetic oligonucleotide
ctaagagggctgctgggatttgtgggg

SEQ ID NO: 110346 - DNA, 28 bp, Artificial Sequence
  Description of Artificial Sequence: Synthetic oligonucleotide
taagagggctgctgggatttgtggggac

SEQ ID NO: 110347 - DNA, 27 bp, Artificial Sequence
  Description of Artificial Sequence: Synthetic oligonucleotide
aagagggctgctgggatttgtggggac

SEQ ID NO: 110348 - DNA, 27 bp, Artificial Sequence
  Description of Artificial Sequence: Synthetic oligonucleotide
agagggctgctgggatttgtggggaca

SEQ ID NO: 110349 - DNA, 26 bp, Artificial Sequence
  Description of Artificial Sequence: Synthetic oligonucleotide
gagggctgctgggatttgtggggaca

SEQ ID NO: 110350 - DNA, 27 bp, Artificial Sequence
  Description of Artificial Sequence: Synthetic oligonucleotide
agggctgctgggatttgtggggacact

SEQ ID NO: 110351 - DNA, 26 bp, Artificial Sequence
  Description of Artificial Sequence: Synthetic oligonucleotide
gggctgctgggatttgtggggacact

SEQ ID NO: 110352 - DNA, 26 bp, Artificial Sequence
  Description of Artificial Sequence: Synthetic oligonucleotide
ggctgctgggatttgtggggacactg

SEQ ID NO: 110353 - DNA, 27 bp, Artificial Sequence
  Description of Artificial Sequence: Synthetic oligonucleotide
gctgctgggatttgtggggacactgct

SEQ ID NO: 110354 - DNA, 27 bp, Artificial Sequence
  Description of Artificial Sequence: Synthetic oligonucleotide
ctgctgggatttgtggggacactgctg

SEQ ID NO: 110355 - DNA, 27 bp, Artificial Sequence
  Description of Artificial Sequence: Synthetic oligonucleotide
tgctgggatttgtggggacactgctgc

SEQ ID NO: 110356 - DNA, 27 bp, Artificial Sequence
  Description of Artificial Sequence: Synthetic oligonucleotide
gctgggatttgtggggacactgctgct

SEQ ID NO: 110357 - DNA, 27 bp, Artificial Sequence
  Description of Artificial Sequence: Synthetic oligonucleotide
ctgggatttgtggggacactgctgctc

SEQ ID NO: 110358 - DNA, 27 bp, Artificial Sequence
  Description of Artificial Sequence: Synthetic oligonucleotide
tgggatttgtggggacactgctgctcc

SEQ ID NO: 110359 - DNA, 26 bp, Artificial Sequence
  Description of Artificial Sequence: Synthetic oligonucleotide
gggatttgtggggacactgctgctcc

SEQ ID NO: 110360 - DNA, 26 bp, Artificial Sequence
  Description of Artificial Sequence: Synthetic oligonucleotide
ggatttgtggggacactgctgctccc

SEQ ID NO: 110361 - DNA, 26 bp, Artificial Sequence
  Description of Artificial Sequence: Synthetic oligonucleotide
gatttgtggggacactgctgctcccg

SEQ ID NO: 110362 - DNA, 27 bp, Artificial Sequence
  Description of Artificial Sequence: Synthetic oligonucleotide
atttgtggggacactgctgctcccgct

SEQ ID NO: 110363 - DNA, 26 bp, Artificial Sequence
  Description of Artificial Sequence: Synthetic oligonucleotide
tttgtggggacactgctgctcccgct

SEQ ID NO: 110364 - DNA, 25 bp, Artificial Sequence
  Description of Artificial Sequence: Synthetic oligonucleotide
ttgtggggacactgctgctcccgct

SEQ ID NO: 110365 - DNA, 24 bp, Artificial Sequence
  Description of Artificial Sequence: Synthetic oligonucleotide
tgtggggacactgctgctcccgct

SEQ ID NO: 110366 - DNA, 23 bp, Artificial Sequence
  Description of Artificial Sequence: Synthetic oligonucleotide
gtggggacactgctgctcccgct

SEQ ID NO: 110367 - DNA, 24 bp, Artificial Sequence
  Description of Artificial Sequence: Synthetic oligonucleotide
tggggacactgctgctcccgctct

SEQ ID NO: 110368 - DNA, 23 bp, Artificial Sequence
  Description of Artificial Sequence: Synthetic oligonucleotide
ggggacactgctgctcccgctct

SEQ ID NO: 110369 - DNA, 24 bp, Artificial Sequence
  Description of Artificial Sequence: Synthetic oligonucleotide
gggacactgctgctcccgctctgt

SEQ ID NO: 110370 - DNA, 25 bp, Artificial Sequence
  Description of Artificial Sequence: Synthetic oligonucleotide
ggacactgctgctcccgctctgtct

SEQ ID NO: 110371 - DNA, 25 bp, Artificial Sequence
  Description of Artificial Sequence: Synthetic oligonucleotide
gacactgctgctcccgctctgtctg

SEQ ID NO: 110372 - DNA, 25 bp, Artificial Sequence
  Description of Artificial Sequence: Synthetic oligonucleotide
acactgctgctcccgctctgtctgg

SEQ ID NO: 110373 - DNA, 24 bp, Artificial Sequence
  Description of Artificial Sequence: Synthetic oligonucleotide
cactgctgctcccgctctgtctgg

SEQ ID NO: 110374 - DNA, 24 bp, Artificial Sequence
  Description of Artificial Sequence: Synthetic oligonucleotide
actgctgctcccgctctgtctggc

SEQ ID NO: 110375 - DNA, 23 bp, Artificial Sequence
  Description of Artificial Sequence: Synthetic oligonucleotide
ctgctgctcccgctctgtctggc

SEQ ID NO: 110376 - DNA, 24 bp, Artificial Sequence
  Description of Artificial Sequence: Synthetic oligonucleotide
tgctgctcccgctctgtctggcca

SEQ ID NO: 110377 - DNA, 23 bp, Artificial Sequence
  Description of Artificial Sequence: Synthetic oligonucleotide
gctgctcccgctctgtctggcca

SEQ ID NO: 110378 - DNA, 23 bp, Artificial Sequence
  Description of Artificial Sequence: Synthetic oligonucleotide
ctgctcccgctctgtctggccac

SEQ ID NO: 110379 - DNA, 23 bp, Artificial Sequence
  Description of Artificial Sequence: Synthetic oligonucleotide
tgctcccgctctgtctggccacc

SEQ ID NO: 110380 - DNA, 22 bp, Artificial Sequence
  Description of Artificial Sequence: Synthetic oligonucleotide
gctcccgctctgtctggccacc

SEQ ID NO: 110381 - DNA, 22 bp, Artificial Sequence
  Description of Artificial Sequence: Synthetic oligonucleotide
ctcccgctctgtctggccaccc

SEQ ID NO: 110382 - DNA, 22 bp, Artificial Sequence
  Description of Artificial Sequence: Synthetic oligonucleotide
tcccgctctgtctggccacccc

SEQ ID NO: 110383 - DNA, 21 bp, Artificial Sequence
  Description of Artificial Sequence: Synthetic oligonucleotide
cccgctctgtctggccacccc

SEQ ID NO: 110384 - DNA, 21 bp, Artificial Sequence
  Description of Artificial Sequence: Synthetic oligonucleotide
ccgctctgtctggccaccccc

SEQ ID NO: 110385 - DNA, 22 bp, Artificial Sequence
  Description of Artificial Sequence: Synthetic oligonucleotide
cgctctgtctggccacccccct

SEQ ID NO: 110386 - DNA, 23 bp, Artificial Sequence
  Description of Artificial Sequence: Synthetic oligonucleotide
gctctgtctggccacccccctga

SEQ ID NO: 110387 - DNA, 24 bp, Artificial Sequence
  Description of Artificial Sequence: Synthetic oligonucleotide
ctctgtctggccacccccctgact

SEQ ID NO: 110388 - DNA, 25 bp, Artificial Sequence
  Description of Artificial Sequence: Synthetic oligonucleotide
tctgtctggccacccccctgactgt

SEQ ID NO: 110389 - DNA, 24 bp, Artificial Sequence
  Description of Artificial Sequence: Synthetic oligonucleotide
ctgtctggccacccccctgactgt

SEQ ID NO: 110390 - DNA, 25 bp, Artificial Sequence
  Description of Artificial Sequence: Synthetic oligonucleotide
tgtctggccacccccctgactgtct

SEQ ID NO: 110391 - DNA, 24 bp, Artificial Sequence
  Description of Artificial Sequence: Synthetic oligonucleotide
gtctggccacccccctgactgtct

SEQ ID NO: 110392 - DNA, 24 bp, Artificial Sequence
  Description of Artificial Sequence: Synthetic oligonucleotide
tctggccacccccctgactgtctc

SEQ ID NO: 110393 - DNA, 23 bp, Artificial Sequence
  Description of Artificial Sequence: Synthetic oligonucleotide
ctggccacccccctgactgtctc

SEQ ID NO: 110394 - DNA, 23 bp, Artificial Sequence
  Description of Artificial Sequence: Synthetic oligonucleotide
tggccacccccctgactgtctcc

SEQ ID NO: 110395 - DNA, 22 bp, Artificial Sequence
  Description of Artificial Sequence: Synthetic oligonucleotide
ggccacccccctgactgtctcc

SEQ ID NO: 110396 - DNA, 23 bp, Artificial Sequence
  Description of Artificial Sequence: Synthetic oligonucleotide
gccacccccctgactgtctccct

SEQ ID NO: 110397 - DNA, 24 bp, Artificial Sequence
  Description of Artificial Sequence: Synthetic oligonucleotide
ccacccccctgactgtctccctga

SEQ ID NO: 110398 - DNA, 25 bp, Artificial Sequence
  Description of Artificial Sequence: Synthetic oligonucleotide
cacccccctgactgtctccctgaga

SEQ ID NO: 110399 - DNA, 25 bp, Artificial Sequence
  Description of Artificial Sequence: Synthetic oligonucleotide
acccccctgactgtctccctgagag

SEQ ID NO: 110400 - DNA, 24 bp, Artificial Sequence
  Description of Artificial Sequence: Synthetic oligonucleotide
cccccctgactgtctccctgagag

SEQ ID NO: 110401 - DNA, 24 bp, Artificial Sequence
  Description of Artificial Sequence: Synthetic oligonucleotide
ccccctgactgtctccctgagagc

SEQ ID NO: 110402 - DNA, 24 bp, Artificial Sequence
  Description of Artificial Sequence: Synthetic oligonucleotide
cccctgactgtctccctgagagcc

SEQ ID NO: 110403 - DNA, 25 bp, Artificial Sequence
  Description of Artificial Sequence: Synthetic oligonucleotide
ccctgactgtctccctgagagccct

SEQ ID NO: 110404 - DNA, 25 bp, Artificial Sequence
  Description of Artificial Sequence: Synthetic oligonucleotide
cctgactgtctccctgagagccctg

SEQ ID NO: 110405 - DNA, 26 bp, Artificial Sequence
  Description of Artificial Sequence: Synthetic oligonucleotide
ctgactgtctccctgagagccctggt

SEQ ID NO: 110406 - DNA, 26 bp, Artificial Sequence
  Description of Artificial Sequence: Synthetic oligonucleotide
tgactgtctccctgagagccctggtc

SEQ ID NO: 110407 - DNA, 25 bp, Artificial Sequence
  Description of Artificial Sequence: Synthetic oligonucleotide
gactgtctccctgagagccctggtc

SEQ ID NO: 110408 - DNA, 25 bp, Artificial Sequence
  Description of Artificial Sequence: Synthetic oligonucleotide
actgtctccctgagagccctggtcg

SEQ ID NO: 110409 - DNA, 24 bp, Artificial Sequence
  Description of Artificial Sequence: Synthetic oligonucleotide
ctgtctccctgagagccctggtcg

SEQ ID NO: 110410 - DNA, 24 bp, Artificial Sequence
  Description of Artificial Sequence: Synthetic oligonucleotide
tgtctccctgagagccctggtcgc

SEQ ID NO: 110411 - DNA, 23 bp, Artificial Sequence
  Description of Artificial Sequence: Synthetic oligonucleotide
gtctccctgagagccctggtcgc

SEQ ID NO: 110412 - DNA, 23 bp, Artificial Sequence
  Description of Artificial Sequence: Synthetic oligonucleotide
tctccctgagagccctggtcgcg

SEQ ID NO: 110413 - DNA, 22 bp, Artificial Sequence
  Description of Artificial Sequence: Synthetic oligonucleotide
ctccctgagagccctggtcgcg

SEQ ID NO: 110414 - DNA, 22 bp, Artificial Sequence
  Description of Artificial Sequence: Synthetic oligonucleotide
tccctgagagccctggtcgcgg

SEQ ID NO: 110415 - DNA, 21 bp, Artificial Sequence
  Description of Artificial Sequence: Synthetic oligonucleotide
ccctgagagccctggtcgcgg

SEQ ID NO: 110416 - DNA, 21 bp, Artificial Sequence
  Description of Artificial Sequence: Synthetic oligonucleotide
cctgagagccctggtcgcggg

SEQ ID NO: 110417 - DNA, 21 bp, Artificial Sequence
  Description of Artificial Sequence: Synthetic oligonucleotide
ctgagagccctggtcgcgggg

SEQ ID NO: 110418 - DNA, 21 bp, Artificial Sequence
  Description of Artificial Sequence: Synthetic oligonucleotide
tgagagccctggtcgcggggg

SEQ ID NO: 110419 - DNA, 20 bp, Artificial Sequence
  Description of Artificial Sequence: Synthetic oligonucleotide
gagagccctggtcgcggggg

SEQ ID NO: 110420 - DNA, 20 bp, Artificial Sequence
  Description of Artificial Sequence: Synthetic oligonucleotide
agagccctggtcgcgggggc

SEQ ID NO: 110421 - DNA, 20 bp, Artificial Sequence
  Description of Artificial Sequence: Synthetic oligonucleotide
gagccctggtcgcgggggct

SEQ ID NO: 110422 - DNA, 20 bp, Artificial Sequence
  Description of Artificial Sequence: Synthetic oligonucleotide
agccctggtcgcgggggcct

SEQ ID NO: 110423 - DNA, 20 bp, Artificial Sequence
  Description of Artificial Sequence: Synthetic oligonucleotide
gccctggtcgcgggggcctt

SEQ ID NO: 110424 - DNA, 20 bp, Artificial Sequence
  Description of Artificial Sequence: Synthetic oligonucleotide
ccctggtcgcgggggcctca

SEQ ID NO: 110425 - DNA, 20 bp, Artificial Sequence
  Description of Artificial Sequence: Synthetic oligonucleotide
cctggtcgcgggggcctcac

SEQ ID NO: 110426 - DNA, 21 bp, Artificial Sequence
  Description of Artificial Sequence: Synthetic oligonucleotide
ctggtcgcgggggcctcacgt

SEQ ID NO: 110427 - DNA, 21 bp, Artificial Sequence
  Description of Artificial Sequence: Synthetic oligonucleotide
tggtcgcgggggcctcacgtg

SEQ ID NO: 110428 - DNA, 20 bp, Artificial Sequence
  Description of Artificial Sequence: Synthetic oligonucleotide
ggtcgcgggggcctcacgtg

SEQ ID NO: 110429 - DNA, 21 bp, Artificial Sequence
  Description of Artificial Sequence: Synthetic oligonucleotide
gtcgcgggggcctcacgtgct

SEQ ID NO: 110430 - DNA, 21 bp, Artificial Sequence
  Description of Artificial Sequence: Synthetic oligonucleotide
tcgcgggggcctcacgtgctc

SEQ ID NO: 110431 - DNA, 20 bp, Artificial Sequence
  Description of Artificial Sequence: Synthetic oligonucleotide
cgcgggggcctcacgtgctc

SEQ ID NO: 110432 - DNA, 20 bp, Artificial Sequence
  Description of Artificial Sequence: Synthetic oligonucleotide
gcgggggcctcacgtgctcc

SEQ ID NO: 110433 - DNA, 20 bp, Artificial Sequence
  Description of Artificial Sequence: Synthetic oligonucleotide
cgggggcctcacgtgctccc

SEQ ID NO: 110434 - DNA, 20 bp, Artificial Sequence
  Description of Artificial Sequence: Synthetic oligonucleotide
gggggcctcacgtgctcccc

SEQ ID NO: 110435 - DNA, 21 bp, Artificial Sequence
  Description of Artificial Sequence: Synthetic oligonucleotide
ggggcctcacgtgctccccca

SEQ ID NO: 110436 - DNA, 21 bp, Artificial Sequence
  Description of Artificial Sequence: Synthetic oligonucleotide
gggcctcacgtgctcccccag

SEQ ID NO: 110437 - DNA, 21 bp, Artificial Sequence
  Description of Artificial Sequence: Synthetic oligonucleotide
ggcctcacgtgctcccccagc

SEQ ID NO: 110438 - DNA, 22 bp, Artificial Sequence
  Description of Artificial Sequence: Synthetic oligonucleotide
gcctcacgtgctcccccagcca

SEQ ID NO: 110439 - DNA, 23 bp, Artificial Sequence
  Description of Artificial Sequence: Synthetic oligonucleotide
cctcacgtgctcccccagccaga

SEQ ID NO: 110440 - DNA, 24 bp, Artificial Sequence
  Description of Artificial Sequence: Synthetic oligonucleotide
ctcacgtgctcccccagccagagt

SEQ ID NO: 110441 - DNA, 24 bp, Artificial Sequence
  Description of Artificial Sequence: Synthetic oligonucleotide
tcacgtgctcccccagccagagtc

SEQ ID NO: 110442 - DNA, 23 bp, Artificial Sequence
  Description of Artificial Sequence: Synthetic oligonucleotide
cacgtgctcccccagccagagtc

SEQ ID NO: 110443 - DNA, 23 bp, Artificial Sequence
  Description of Artificial Sequence: Synthetic oligonucleotide
acgtgctcccccagccagagtcg

SEQ ID NO: 110444 - DNA, 22 bp, Artificial Sequence
  Description of Artificial Sequence: Synthetic oligonucleotide
cgtgctcccccagccagagtcg

SEQ ID NO: 110445 - DNA, 24 bp, Artificial Sequence
  Description of Artificial Sequence: Synthetic oligonucleotide
gtgctcccccagccagagtcgctt

SEQ ID NO: 110446 - DNA, 25 bp, Artificial Sequence
  Description of Artificial Sequence: Synthetic oligonucleotide
tgctcccccagccagagtcgcttca

SEQ ID NO: 110447 - DNA, 24 bp, Artificial Sequence
  Description of Artificial Sequence: Synthetic oligonucleotide
gctcccccagccagagtcgcttca

SEQ ID NO: 110448 - DNA, 24 bp, Artificial Sequence
  Description of Artificial Sequence: Synthetic oligonucleotide
ctcccccagccagagtcgcttcag

SEQ ID NO: 110449 - DNA, 24 bp, Artificial Sequence
  Description of Artificial Sequence: Synthetic oligonucleotide
tcccccagccagagtcgcttcagc

SEQ ID NO: 110450 - DNA, 23 bp, Artificial Sequence
  Description of Artificial Sequence: Synthetic oligonucleotide
cccccagccagagtcgcttcagc

SEQ ID NO: 110451 - DNA, 23 bp, Artificial Sequence
  Description of Artificial Sequence: Synthetic oligonucleotide
ccccagccagagtcgcttcagcc

SEQ ID NO: 110452 - DNA, 23 bp, Artificial Sequence
  Description of Artificial Sequence: Synthetic oligonucleotide
cccagccagagtcgcttcagccc

SEQ ID NO: 110453 - DNA, 25 bp, Artificial Sequence
  Description of Artificial Sequence: Synthetic oligonucleotide
ccagccagagtcgcttcagcccctt

SEQ ID NO: 110454 - DNA, 25 bp, Artificial Sequence
  Description of Artificial Sequence: Synthetic oligonucleotide
cagccagagtcgcttcagccccttg

SEQ ID NO: 110455 - DNA, 26 bp, Artificial Sequence
  Description of Artificial Sequence: Synthetic oligonucleotide
agccagagtcgcttcagccccttgga

SEQ ID NO: 110456 - DNA, 25 bp, Artificial Sequence
  Description of Artificial Sequence: Synthetic oligonucleotide
gccagagtcgcttcagccccttgga

SEQ ID NO: 110457 - DNA, 25 bp, Artificial Sequence
  Description of Artificial Sequence: Synthetic oligonucleotide
ccagagtcgcttcagccccttggag

SEQ ID NO: 110458 - DNA, 26 bp, Artificial Sequence
  Description of Artificial Sequence: Synthetic oligonucleotide
cagagtcgcttcagccccttggagct

SEQ ID NO: 110459 - DNA, 26 bp, Artificial Sequence
  Description of Artificial Sequence: Synthetic oligonucleotide
agagtcgcttcagccccttggagctg

SEQ ID NO: 110460 - DNA, 25 bp, Artificial Sequence
  Description of Artificial Sequence: Synthetic oligonucleotide
gagtcgcttcagccccttggagctg

SEQ ID NO: 110461 - DNA, 25 bp, Artificial Sequence
  Description of Artificial Sequence: Synthetic oligonucleotide
agtcgcttcagccccttggagctgg

SEQ ID NO: 110462 - DNA, 24 bp, Artificial Sequence
  Description of Artificial Sequence: Synthetic oligonucleotide
gtcgcttcagccccttggagctgg

SEQ ID NO: 110463 - DNA, 25 bp, Artificial Sequence
  Description of Artificial Sequence: Synthetic oligonucleotide
tcgcttcagccccttggagctggct

SEQ ID NO: 110464 - DNA, 24 bp, Artificial Sequence
  Description of Artificial Sequence: Synthetic oligonucleotide
cgcttcagccccttggagctggct

SEQ ID NO: 110465 - DNA, 24 bp, Artificial Sequence
  Description of Artificial Sequence: Synthetic oligonucleotide
gcttcagccccttggagctggctg

SEQ ID NO: 110466 - DNA, 25 bp, Artificial Sequence
  Description of Artificial Sequence: Synthetic oligonucleotide
cttcagccccttggagctggctgct

SEQ ID NO: 110467 - DNA, 25 bp, Artificial Sequence
  Description of Artificial Sequence: Synthetic oligonucleotide
ttcagccccttggagctggctgctg

SEQ ID NO: 110468 - DNA, 24 bp, Artificial Sequence
  Description of Artificial Sequence: Synthetic oligonucleotide
tcagccccttggagctggctgctg

SEQ ID NO: 110469 - DNA, 23 bp, Artificial Sequence
  Description of Artificial Sequence: Synthetic oligonucleotide
cagccccttggagctggctgctg

SEQ ID NO: 110470 - DNA, 24 bp, Artificial Sequence
  Description of Artificial Sequence: Synthetic oligonucleotide
agccccttggagctggctgctggt

SEQ ID NO: 110471 - DNA, 23 bp, Artificial Sequence
  Description of Artificial Sequence: Synthetic oligonucleotide
gccccttggagctggctgctggt

SEQ ID NO: 110472 - DNA, 23 bp, Artificial Sequence
  Description of Artificial Sequence: Synthetic oligonucleotide
ccccttggagctggctgctggtg

SEQ ID NO: 110473 - DNA, 23 bp, Artificial Sequence
  Description of Artificial Sequence: Synthetic oligonucleotide
cccttggagctggctgctggtgg

SEQ ID NO: 110474 - DNA, 23 bp, Artificial Sequence
  Description of Artificial Sequence: Synthetic oligonucleotide
ccttggagctggctgctggtggg

SEQ ID NO: 110475 - DNA, 25 bp, Artificial Sequence
  Description of Artificial Sequence: Synthetic oligonucleotide
cttggagctggctgctggtggggta

SEQ ID NO: 110476 - DNA, 25 bp, Artificial Sequence
  Description of Artificial Sequence: Synthetic oligonucleotide
ttggagctggctgctggtggggtac

SEQ ID NO: 110477 - DNA, 24 bp, Artificial Sequence
  Description of Artificial Sequence: Synthetic oligonucleotide
tggagctggctgctggtggggtac

SEQ ID NO: 110478 - DNA, 23 bp, Artificial Sequence
  Description of Artificial Sequence: Synthetic oligonucleotide
ggagctggctgctggtggggtac

SEQ ID NO: 110479 - DNA, 23 bp, Artificial Sequence
  Description of Artificial Sequence: Synthetic oligonucleotide
gagctggctgctggtggggtacg

SEQ ID NO: 110480 - DNA, 23 bp, Artificial Sequence
  Description of Artificial Sequence: Synthetic oligonucleotide
agctggctgctggtggggtacgg

SEQ ID NO: 110481 - DNA, 22 bp, Artificial Sequence
  Description of Artificial Sequence: Synthetic oligonucleotide
gctggctgctggtggggtacgg

SEQ ID NO: 110482 - DNA, 22 bp, Artificial Sequence
  Description of Artificial Sequence: Synthetic oligonucleotide
ctggctgctggtggggtacggg

SEQ ID NO: 110483 - DNA, 22 bp, Artificial Sequence
  Description of Artificial Sequence: Synthetic oligonucleotide
tggctgctggtggggtacgggg

SEQ ID NO: 110484 - DNA, 21 bp, Artificial Sequence
  Description of Artificial Sequence: Synthetic oligonucleotide
ggctgctggtggggtacgggg

SEQ ID NO: 110485 - DNA, 22 bp, Artificial Sequence
  Description of Artificial Sequence: Synthetic oligonucleotide
gctgctggtggggtacggggct

SEQ ID NO: 110486 - DNA, 22 bp, Artificial Sequence
  Description of Artificial Sequence: Synthetic oligonucleotide
ctgctggtggggtacggggctg

SEQ ID NO: 110487 - DNA, 22 bp, Artificial Sequence
  Description of Artificial Sequence: Synthetic oligonucleotide
tgctggtggggtacggggctgc

SEQ ID NO: 110488 - DNA, 21 bp, Artificial Sequence
  Description of Artificial Sequence: Synthetic oligonucleotide
gctggtggggtacggggctgc

SEQ ID NO: 110489 - DNA, 21 bp, Artificial Sequence
  Description of Artificial Sequence: Synthetic oligonucleotide
ctggtggggtacggggctgcg

SEQ ID NO: 110490 - DNA, 21 bp, Artificial Sequence
  Description of Artificial Sequence: Synthetic oligonucleotide
tggtggggtacggggctgcgg

SEQ ID NO: 110491 - DNA, 20 bp, Artificial Sequence
  Description of Artificial Sequence: Synthetic oligonucleotide
ggtggggtacggggctgcgg

SEQ ID NO: 110492 - DNA, 20 bp, Artificial Sequence
  Description of Artificial Sequence: Synthetic oligonucleotide
gtggggtacggggctgcggg

SEQ ID NO: 110493 - DNA, 20 bp, Artificial Sequence
  Description of Artificial Sequence: Synthetic oligonucleotide
tggggtacggggctgcgggg

SEQ ID NO: 110494 - DNA, 20 bp, Artificial Sequence
  Description of Artificial Sequence: Synthetic oligonucleotide
ggggtacggggctgcggggt

SEQ ID NO: 110495 - DNA, 20 bp, Artificial Sequence
  Description of Artificial Sequence: Synthetic oligonucleotide
gggtacggggctgcggggct

SEQ ID NO: 110496 - DNA, 21 bp, Artificial Sequence
  Description of Artificial Sequence: Synthetic oligonucleotide
ggtacggggctgcggggctca

SEQ ID NO: 110497 - DNA, 21 bp, Artificial Sequence
  Description of Artificial Sequence: Synthetic oligonucleotide
gtacggggctgcggggctcag

SEQ ID NO: 110498 - DNA, 22 bp, Artificial Sequence
  Description of Artificial Sequence: Synthetic oligonucleotide
tacggggctgcggggctcagct

SEQ ID NO: 110499 - DNA, 21 bp, Artificial Sequence
  Description of Artificial Sequence: Synthetic oligonucleotide
acggggctgcggggctcagct

SEQ ID NO: 110500 - DNA, 20 bp, Artificial Sequence
  Description of Artificial Sequence: Synthetic oligonucleotide
cggggctgcggggctcagct

SEQ ID NO: 110501 - DNA, 20 bp, Artificial Sequence
  Description of Artificial Sequence: Synthetic oligonucleotide
ggggctgcggggctcagctg

SEQ ID NO: 110502 - DNA, 21 bp, Artificial Sequence
  Description of Artificial Sequence: Synthetic oligonucleotide
gggctgcggggctcagctggt

SEQ ID NO: 110503 - DNA, 22 bp, Artificial Sequence
  Description of Artificial Sequence: Synthetic oligonucleotide
ggctgcggggctcagctggtca

SEQ ID NO: 110504 - DNA, 23 bp, Artificial Sequence
  Description of Artificial Sequence: Synthetic oligonucleotide
gctgcggggctcagctggtcact

SEQ ID NO: 110505 - DNA, 24 bp, Artificial Sequence
  Description of Artificial Sequence: Synthetic oligonucleotide
ctgcggggctcagctggtcactgt

SEQ ID NO: 110506 - DNA, 24 bp, Artificial Sequence
  Description of Artificial Sequence: Synthetic oligonucleotide
tgcggggctcagctggtcactgtg

SEQ ID NO: 110507 - DNA, 23 bp, Artificial Sequence
  Description of Artificial Sequence: Synthetic oligonucleotide
gcggggctcagctggtcactgtg

SEQ ID NO: 110508 - DNA, 23 bp, Artificial Sequence
  Description of Artificial Sequence: Synthetic oligonucleotide
cggggctcagctggtcactgtgg

SEQ ID NO: 110509 - DNA, 23 bp, Artificial Sequence
  Description of Artificial Sequence: Synthetic oligonucleotide
ggggctcagctggtcactgtggg

SEQ ID NO: 110510 - DNA, 24 bp, Artificial Sequence
  Description of Artificial Sequence: Synthetic oligonucleotide
gggctcagctggtcactgtgggct

SEQ ID NO: 110511 - DNA, 26 bp, Artificial Sequence
  Description of Artificial Sequence: Synthetic oligonucleotide
ggctcagctggtcactgtgggctgtt

SEQ ID NO: 110512 - DNA, 27 bp, Artificial Sequence
  Description of Artificial Sequence: Synthetic oligonucleotide
gctcagctggtcactgtgggctgttct

SEQ ID NO: 110513 - DNA, 27 bp, Artificial Sequence
  Description of Artificial Sequence: Synthetic oligonucleotide
ctcagctggtcactgtgggctgttctg

SEQ ID NO: 110514 - DNA, 28 bp, Artificial Sequence
  Description of Artificial Sequence: Synthetic oligonucleotide
tcagctggtcactgtgggctgttctgag

SEQ ID NO: 110515 - DNA, 27 bp, Artificial Sequence
  Description of Artificial Sequence: Synthetic oligonucleotide
cagctggtcactgtgggctgttctgag

SEQ ID NO: 110516 - DNA, 27 bp, Artificial Sequence
  Description of Artificial Sequence: Synthetic oligonucleotide
agctggtcactgtgggctgttctgagc

SEQ ID NO: 110517 - DNA, 26 bp, Artificial Sequence
  Description of Artificial Sequence: Synthetic oligonucleotide
gctggtcactgtgggctgttctgagc

SEQ ID NO: 110518 - DNA, 26 bp, Artificial Sequence
  Description of Artificial Sequence: Synthetic oligonucleotide
ctggtcactgtgggctgttctgagcc

SEQ ID NO: 110519 - DNA, 27 bp, Artificial Sequence
  Description of Artificial Sequence: Synthetic oligonucleotide
tggtcactgtgggctgttctgagccct

SEQ ID NO: 110520 - DNA, 26 bp, Artificial Sequence
  Description of Artificial Sequence: Synthetic oligonucleotide
ggtcactgtgggctgttctgagccct

SEQ ID NO: 110521 - DNA, 26 bp, Artificial Sequence
  Description of Artificial Sequence: Synthetic oligonucleotide
gtcactgtgggctgttctgagccctc

SEQ ID NO: 110522 - DNA, 27 bp, Artificial Sequence
  Description of Artificial Sequence: Synthetic oligonucleotide
tcactgtgggctgttctgagccctcct

SEQ ID NO: 110523 - DNA, 26 bp, Artificial Sequence
  Description of Artificial Sequence: Synthetic oligonucleotide
cactgtgggctgttctgagccctcct

SEQ ID NO: 110524 - DNA, 26 bp, Artificial Sequence
  Description of Artificial Sequence: Synthetic oligonucleotide
actgtgggctgttctgagccctcctg

SEQ ID NO: 110525 - DNA, 25 bp, Artificial Sequence
  Description of Artificial Sequence: Synthetic oligonucleotide
ctgtgggctgttctgagccctcctg

SEQ ID NO: 110526 - DNA, 26 bp, Artificial Sequence
  Description of Artificial Sequence: Synthetic oligonucleotide
tgtgggctgttctgagccctcctgga

SEQ ID NO: 110527 - DNA, 25 bp, Artificial Sequence
  Description of Artificial Sequence: Synthetic oligonucleotide
gtgggctgttctgagccctcctgga

SEQ ID NO: 110528 - DNA, 25 bp, Artificial Sequence
  Description of Artificial Sequence: Synthetic oligonucleotide
tgggctgttctgagccctcctggag

SEQ ID NO: 110529 - DNA, 24 bp, Artificial Sequence
  Description of Artificial Sequence: Synthetic oligonucleotide
gggctgttctgagccctcctggag

SEQ ID NO: 110530 - DNA, 24 bp, Artificial Sequence
  Description of Artificial Sequence: Synthetic oligonucleotide
ggctgttctgagccctcctggagc

SEQ ID NO: 110531 - DNA, 24 bp, Artificial Sequence
  Description of Artificial Sequence: Synthetic oligonucleotide
gctgttctgagccctcctggagcc

SEQ ID NO: 110532 - DNA, 25 bp, Artificial Sequence
  Description of Artificial Sequence: Synthetic oligonucleotide
ctgttctgagccctcctggagccca

SEQ ID NO: 110533 - DNA, 25 bp, Artificial Sequence
  Description of Artificial Sequence: Synthetic oligonucleotide
tgttctgagccctcctggagcccag

SEQ ID NO: 110534 - DNA, 24 bp, Artificial Sequence
  Description of Artificial Sequence: Synthetic oligonucleotide
gttctgagccctcctggagcccag

SEQ ID NO: 110535 - DNA, 25 bp, Artificial Sequence
  Description of Artificial Sequence: Synthetic oligonucleotide
ttctgagccctcctggagcccagga

SEQ ID NO: 110536 - DNA, 24 bp, Artificial Sequence
  Description of Artificial Sequence: Synthetic oligonucleotide
tctgagccctcctggagcccagga

SEQ ID NO: 110537 - DNA, 23 bp, Artificial Sequence
  Description of Artificial Sequence: Synthetic oligonucleotide
ctgagccctcctggagcccagga

SEQ ID NO: 110538 - DNA, 25 bp, Artificial Sequence
  Description of Artificial Sequence: Synthetic oligonucleotide
tgagccctcctggagcccaggagaa

SEQ ID NO: 110539 - DNA, 24 bp, Artificial Sequence
  Description of Artificial Sequence: Synthetic oligonucleotide
gagccctcctggagcccaggagaa

SEQ ID NO: 110540 - DNA, 24 bp, Artificial Sequence
  Description of Artificial Sequence: Synthetic oligonucleotide
agccctcctggagcccaggagaag

SEQ ID NO: 110541 - DNA, 23 bp, Artificial Sequence
  Description of Artificial Sequence: Synthetic oligonucleotide
gccctcctggagcccaggagaag

SEQ ID NO: 110542 - DNA, 24 bp, Artificial Sequence
  Description of Artificial Sequence: Synthetic oligonucleotide
ccctcctggagcccaggagaagga

SEQ ID NO: 110543 - DNA, 24 bp, Artificial Sequence
  Description of Artificial Sequence: Synthetic oligonucleotide
cctcctggagcccaggagaaggag

SEQ ID NO: 110544 - DNA, 25 bp, Artificial Sequence
  Description of Artificial Sequence: Synthetic oligonucleotide
ctcctggagcccaggagaaggagca

SEQ ID NO: 110545 - DNA, 25 bp, Artificial Sequence
  Description of Artificial Sequence: Synthetic oligonucleotide
tcctggagcccaggagaaggagcag

SEQ ID NO: 110546 - DNA, 24 bp, Artificial Sequence
  Description of Artificial Sequence: Synthetic oligonucleotide
cctggagcccaggagaaggagcag

SEQ ID NO: 110547 - DNA, 25 bp, Artificial Sequence
  Description of Artificial Sequence: Synthetic oligonucleotide
ctggagcccaggagaaggagcagga

SEQ ID NO: 110548 - DNA, 25 bp, Artificial Sequence
  Description of Artificial Sequence: Synthetic oligonucleotide
tggagcccaggagaaggagcaggac

SEQ ID NO: 110549 - DNA, 24 bp, Artificial Sequence
  Description of Artificial Sequence: Synthetic oligonucleotide
ggagcccaggagaaggagcaggac

SEQ ID NO: 110550 - DNA, 25 bp, Artificial Sequence
  Description of Artificial Sequence: Synthetic oligonucleotide
gagcccaggagaaggagcaggacca

SEQ ID NO: 110551 - DNA, 25 bp, Artificial Sequence
  Description of Artificial Sequence: Synthetic oligonucleotide
agcccaggagaaggagcaggaccag

SEQ ID NO: 110552 - DNA, 24 bp, Artificial Sequence
  Description of Artificial Sequence: Synthetic oligonucleotide
gcccaggagaaggagcaggaccag

SEQ ID NO: 110553 - DNA, 25 bp, Artificial Sequence
  Description of Artificial Sequence: Synthetic oligonucleotide
cccaggagaaggagcaggaccaggt

SEQ ID NO: 110554 - DNA, 27 bp, Artificial Sequence
  Description of Artificial Sequence: Synthetic oligonucleotide
ccaggagaaggagcaggaccaggtgaa

SEQ ID NO: 110555 - DNA, 27 bp, Artificial Sequence
  Description of Artificial Sequence: Synthetic oligonucleotide
caggagaaggagcaggaccaggtgaac

SEQ ID NO: 110556 - DNA, 29 bp, Artificial Sequence
  Description of Artificial Sequence: Synthetic oligonucleotide
aggagaaggagcaggaccaggtgaacaac

SEQ ID NO: 110557 - DNA, 28 bp, Artificial Sequence
  Description of Artificial Sequence: Synthetic oligonucleotide
ggagaaggagcaggaccaggtgaacaac

SEQ ID NO: 110558 - DNA, 31 bp, Artificial Sequence
  Description of Artificial Sequence: Synthetic oligonucleotide
gagaaggagcaggaccaggtgaacaacaaag

SEQ ID NO: 110559 - DNA, 32 bp, Artificial Sequence
  Description of Artificial Sequence: Synthetic oligonucleotide
agaaggagcaggaccaggtgaacaacaaagtc

SEQ ID NO: 110560 - DNA, 31 bp, Artificial Sequence
  Description of Artificial Sequence: Synthetic oligonucleotide
gaaggagcaggaccaggtgaacaacaaagtc

SEQ ID NO: 110561 - DNA, 33 bp, Artificial Sequence
  Description of Artificial Sequence: Synthetic oligonucleotide
aaggagcaggaccaggtgaacaacaaagtcttg

SEQ ID NO: 110562 - DNA, 32 bp, Artificial Sequence
  Description of Artificial Sequence: Synthetic oligonucleotide
aggagcaggaccaggtgaacaacaaagtcttg

SEQ ID NO: 110563 - DNA, 31 bp, Artificial Sequence
  Description of Artificial Sequence: Synthetic oligonucleotide
ggagcaggaccaggtgaacaacaaagtcttg

SEQ ID NO: 110564 - DNA, 33 bp, Artificial Sequence
  Description of Artificial Sequence: Synthetic oligonucleotide
gagcaggaccaggtgaacaacaaagtcttgatg

SEQ ID NO: 110565 - DNA, 34 bp, Artificial Sequence
  Description of Artificial Sequence: Synthetic oligonucleotide
agcaggaccaggtgaacaacaaagtcttgatgtg

SEQ ID NO: 110566 - DNA, 33 bp, Artificial Sequence
  Description of Artificial Sequence: Synthetic oligonucleotide
gcaggaccaggtgaacaacaaagtcttgatgtg

SEQ ID NO: 110567 - DNA, 33 bp, Artificial Sequence
  Description of Artificial Sequence: Synthetic oligonucleotide
caggaccaggtgaacaacaaagtcttgatgtgg

SEQ ID NO: 110568 - DNA, 34 bp, Artificial Sequence
  Description of Artificial Sequence: Synthetic oligonucleotide
aggaccaggtgaacaacaaagtcttgatgtggag

SEQ ID NO: 110569 - DNA, 33 bp, Artificial Sequence
  Description of Artificial Sequence: Synthetic oligonucleotide
ggaccaggtgaacaacaaagtcttgatgtggag

SEQ ID NO: 110570 - DNA, 33 bp, Artificial Sequence
  Description of Artificial Sequence: Synthetic oligonucleotide
gaccaggtgaacaacaaagtcttgatgtggagg

SEQ ID NO: 110571 - DNA, 33 bp, Artificial Sequence
  Description of Artificial Sequence: Synthetic oligonucleotide
accaggtgaacaacaaagtcttgatgtggaggc

SEQ ID NO: 110572 - DNA, 32 bp, Artificial Sequence
  Description of Artificial Sequence: Synthetic oligonucleotide
ccaggtgaacaacaaagtcttgatgtggaggc

SEQ ID NO: 110573 - DNA, 33 bp, Artificial Sequence
  Description of Artificial Sequence: Synthetic oligonucleotide
caggtgaacaacaaagtcttgatgtggaggctg

SEQ ID NO: 110574 - DNA, 33 bp, Artificial Sequence
  Description of Artificial Sequence: Synthetic oligonucleotide
aggtgaacaacaaagtcttgatgtggaggctgc

SEQ ID NO: 110575 - DNA, 32 bp, Artificial Sequence
  Description of Artificial Sequence: Synthetic oligonucleotide
ggtgaacaacaaagtcttgatgtggaggctgc

SEQ ID NO: 110576 - DNA, 33 bp, Artificial Sequence
  Description of Artificial Sequence: Synthetic oligonucleotide
gtgaacaacaaagtcttgatgtggaggctgctg

SEQ ID NO: 110577 - DNA, 35 bp, Artificial Sequence
  Description of Artificial Sequence: Synthetic oligonucleotide
tgaacaacaaagtcttgatgtggaggctgctgaag

SEQ ID NO: 110578 - DNA, 34 bp, Artificial Sequence
  Description of Artificial Sequence: Synthetic oligonucleotide
gaacaacaaagtcttgatgtggaggctgctgaag

SEQ ID NO: 110579 - DNA, 34 bp, Artificial Sequence
  Description of Artificial Sequence: Synthetic oligonucleotide
aacaacaaagtcttgatgtggaggctgctgaagc

SEQ ID NO: 110580 - DNA, 33 bp, Artificial Sequence
  Description of Artificial Sequence: Synthetic oligonucleotide
acaacaaagtcttgatgtggaggctgctgaagc

SEQ ID NO: 110581 - DNA, 32 bp, Artificial Sequence
  Description of Artificial Sequence: Synthetic oligonucleotide
caacaaagtcttgatgtggaggctgctgaagc

SEQ ID NO: 110582 - DNA, 33 bp, Artificial Sequence
  Description of Artificial Sequence: Synthetic oligonucleotide
aacaaagtcttgatgtggaggctgctgaagctc

SEQ ID NO: 110583 - DNA, 32 bp, Artificial Sequence
  Description of Artificial Sequence: Synthetic oligonucleotide
acaaagtcttgatgtggaggctgctgaagctc

SEQ ID NO: 110584 - DNA, 31 bp, Artificial Sequence
  Description of Artificial Sequence: Synthetic oligonucleotide
caaagtcttgatgtggaggctgctgaagctc

SEQ ID NO: 110585 - DNA, 32 bp, Artificial Sequence
  Description of Artificial Sequence: Synthetic oligonucleotide
aaagtcttgatgtggaggctgctgaagctctc

SEQ ID NO: 110586 - DNA, 31 bp, Artificial Sequence
  Description of Artificial Sequence: Synthetic oligonucleotide
aagtcttgatgtggaggctgctgaagctctc

SEQ ID NO: 110587 - DNA, 30 bp, Artificial Sequence
  Description of Artificial Sequence: Synthetic oligonucleotide
agtcttgatgtggaggctgctgaagctctc

SEQ ID NO: 110588 - DNA, 29 bp, Artificial Sequence
  Description of Artificial Sequence: Synthetic oligonucleotide
gtcttgatgtggaggctgctgaagctctc

SEQ ID NO: 110589 - DNA, 29 bp, Artificial Sequence
  Description of Artificial Sequence: Synthetic oligonucleotide
tcttgatgtggaggctgctgaagctctcc

SEQ ID NO: 110590 - DNA, 28 bp, Artificial Sequence
  Description of Artificial Sequence: Synthetic oligonucleotide
cttgatgtggaggctgctgaagctctcc

SEQ ID NO: 110591 - DNA, 29 bp, Artificial Sequence
  Description of Artificial Sequence: Synthetic oligonucleotide
ttgatgtggaggctgctgaagctctccag

SEQ ID NO: 110592 - DNA, 28 bp, Artificial Sequence
  Description of Artificial Sequence: Synthetic oligonucleotide
tgatgtggaggctgctgaagctctccag

SEQ ID NO: 110593 - DNA, 27 bp, Artificial Sequence
  Description of Artificial Sequence: Synthetic oligonucleotide
gatgtggaggctgctgaagctctccag

SEQ ID NO: 110594 - DNA, 27 bp, Artificial Sequence
  Description of Artificial Sequence: Synthetic oligonucleotide
atgtggaggctgctgaagctctccagg

SEQ ID NO: 110595 - DNA, 26 bp, Artificial Sequence
  Description of Artificial Sequence: Synthetic oligonucleotide
tgtggaggctgctgaagctctccagg

SEQ ID NO: 110596 - DNA, 25 bp, Artificial Sequence
  Description of Artificial Sequence: Synthetic oligonucleotide
gtggaggctgctgaagctctccagg

SEQ ID NO: 110597 - DNA, 25 bp, Artificial Sequence
  Description of Artificial Sequence: Synthetic oligonucleotide
tggaggctgctgaagctctccaggc

SEQ ID NO: 110598 - DNA, 24 bp, Artificial Sequence
  Description of Artificial Sequence: Synthetic oligonucleotide
ggaggctgctgaagctctccaggc

SEQ ID NO: 110599 - DNA, 24 bp, Artificial Sequence
  Description of Artificial Sequence: Synthetic oligonucleotide
gaggctgctgaagctctccaggcc

SEQ ID NO: 110600 - DNA, 24 bp, Artificial Sequence
  Description of Artificial Sequence: Synthetic oligonucleotide
aggctgctgaagctctccaggccg

SEQ ID NO: 110601 - DNA, 23 bp, Artificial Sequence
  Description of Artificial Sequence: Synthetic oligonucleotide
ggctgctgaagctctccaggccg

SEQ ID NO: 110602 - DNA, 24 bp, Artificial Sequence
  Description of Artificial Sequence: Synthetic oligonucleotide
gctgctgaagctctccaggccgga

SEQ ID NO: 110603 - DNA, 24 bp, Artificial Sequence
  Description of Artificial Sequence: Synthetic oligonucleotide
ctgctgaagctctccaggccggac

SEQ ID NO: 110604 - DNA, 25 bp, Artificial Sequence
  Description of Artificial Sequence: Synthetic oligonucleotide
tgctgaagctctccaggccggacct

SEQ ID NO: 110605 - DNA, 24 bp, Artificial Sequence
  Description of Artificial Sequence: Synthetic oligonucleotide
gctgaagctctccaggccggacct

SEQ ID NO: 110606 - DNA, 24 bp, Artificial Sequence
  Description of Artificial Sequence: Synthetic oligonucleotide
ctgaagctctccaggccggacctg

SEQ ID NO: 110607 - DNA, 24 bp, Artificial Sequence
  Description of Artificial Sequence: Synthetic oligonucleotide
tgaagctctccaggccggacctgc

SEQ ID NO: 110608 - DNA, 23 bp, Artificial Sequence
  Description of Artificial Sequence: Synthetic oligonucleotide
gaagctctccaggccggacctgc

SEQ ID NO: 110609 - DNA, 24 bp, Artificial Sequence
  Description of Artificial Sequence: Synthetic oligonucleotide
aagctctccaggccggacctgcct

SEQ ID NO: 110610 - DNA, 23 bp, Artificial Sequence
  Description of Artificial Sequence: Synthetic oligonucleotide
agctctccaggccggacctgcct

SEQ ID NO: 110611 - DNA, 22 bp, Artificial Sequence
  Description of Artificial Sequence: Synthetic oligonucleotide
gctctccaggccggacctgcct

SEQ ID NO: 110612 - DNA, 23 bp, Artificial Sequence
  Description of Artificial Sequence: Synthetic oligonucleotide
ctctccaggccggacctgcctct

SEQ ID NO: 110613 - DNA, 23 bp, Artificial Sequence
  Description of Artificial Sequence: Synthetic oligonucleotide
tctccaggccggacctgcctctc

SEQ ID NO: 110614 - DNA, 22 bp, Artificial Sequence
  Description of Artificial Sequence: Synthetic oligonucleotide
ctccaggccggacctgcctctc

SEQ ID NO: 110615 - DNA, 23 bp, Artificial Sequence
  Description of Artificial Sequence: Synthetic oligonucleotide
tccaggccggacctgcctctcct

SEQ ID NO: 110616 - DNA, 22 bp, Artificial Sequence
  Description of Artificial Sequence: Synthetic oligonucleotide
ccaggccggacctgcctctcct

SEQ ID NO: 110617 - DNA, 22 bp, Artificial Sequence
  Description of Artificial Sequence: Synthetic oligonucleotide
caggccggacctgcctctcctc

SEQ ID NO: 110618 - DNA, 24 bp, Artificial Sequence
  Description of Artificial Sequence: Synthetic oligonucleotide
aggccggacctgcctctcctcgtt

SEQ ID NO: 110619 - DNA, 23 bp, Artificial Sequence
  Description of Artificial Sequence: Synthetic oligonucleotide
ggccggacctgcctctcctcgtt

SEQ ID NO: 110620 - DNA, 23 bp, Artificial Sequence
  Description of Artificial Sequence: Synthetic oligonucleotide
gccggacctgcctctcctcgttg

SEQ ID NO: 110621 - DNA, 23 bp, Artificial Sequence
  Description of Artificial Sequence: Synthetic oligonucleotide
ccggacctgcctctcctcgttgc

SEQ ID NO: 110622 - DNA, 23 bp, Artificial Sequence
  Description of Artificial Sequence: Synthetic oligonucleotide
cggacctgcctctcctcgttgcc

SEQ ID NO: 110623 - DNA, 23 bp, Artificial Sequence
  Description of Artificial Sequence: Synthetic oligonucleotide
ggacctgcctctcctcgttgccg

SEQ ID NO: 110624 - DNA, 23 bp, Artificial Sequence
  Description of Artificial Sequence: Synthetic oligonucleotide
gacctgcctctcctcgttgccgc

SEQ ID NO: 110625 - DNA, 25 bp, Artificial Sequence
  Description of Artificial Sequence: Synthetic oligonucleotide
acctgcctctcctcgttgccgcctt

SEQ ID NO: 110626 - DNA, 24 bp, Artificial Sequence
  Description of Artificial Sequence: Synthetic oligonucleotide
cctgcctctcctcgttgccgcctt

SEQ ID NO: 110627 - DNA, 26 bp, Artificial Sequence
  Description of Artificial Sequence: Synthetic oligonucleotide
ctgcctctcctcgttgccgccttctt

SEQ ID NO: 110628 - DNA, 27 bp, Artificial Sequence
  Description of Artificial Sequence: Synthetic oligonucleotide
tgcctctcctcgttgccgccttcttct

SEQ ID NO: 110629 - DNA, 27 bp, Artificial Sequence
  Description of Artificial Sequence: Synthetic oligonucleotide
gcctctcctcgttgccgccttcttctt

SEQ ID NO: 110630 - DNA, 27 bp, Artificial Sequence
  Description of Artificial Sequence: Synthetic oligonucleotide
cctctcctcgttgccgccttcttcttc

SEQ ID NO: 110631 - DNA, 27 bp, Artificial Sequence
  Description of Artificial Sequence: Synthetic oligonucleotide
ctctcctcgttgccgccttcttcttcc

SEQ ID NO: 110632 - DNA, 29 bp, Artificial Sequence
  Description of Artificial Sequence: Synthetic oligonucleotide
tctcctcgttgccgccttcttcttccttg

SEQ ID NO: 110633 - DNA, 28 bp, Artificial Sequence
  Description of Artificial Sequence: Synthetic oligonucleotide
ctcctcgttgccgccttcttcttccttg

SEQ ID NO: 110634 - DNA, 29 bp, Artificial Sequence
  Description of Artificial Sequence: Synthetic oligonucleotide
tcctcgttgccgccttcttcttccttgtc

SEQ ID NO: 110635 - DNA, 28 bp, Artificial Sequence
  Description of Artificial Sequence: Synthetic oligonucleotide
cctcgttgccgccttcttcttccttgtc

SEQ ID NO: 110636 - DNA, 28 bp, Artificial Sequence
  Description of Artificial Sequence: Synthetic oligonucleotide
ctcgttgccgccttcttcttccttgtcc

SEQ ID NO: 110637 - DNA, 30 bp, Artificial Sequence
  Description of Artificial Sequence: Synthetic oligonucleotide
tcgttgccgccttcttcttccttgtccttg

SEQ ID NO: 110638 - DNA, 29 bp, Artificial Sequence
  Description of Artificial Sequence: Synthetic oligonucleotide
cgttgccgccttcttcttccttgtccttg

SEQ ID NO: 110639 - DNA, 29 bp, Artificial Sequence
  Description of Artificial Sequence: Synthetic oligonucleotide
gttgccgccttcttcttccttgtccttgc

SEQ ID NO: 110640 - DNA, 30 bp, Artificial Sequence
  Description of Artificial Sequence: Synthetic oligonucleotide
ttgccgccttcttcttccttgtccttgctg

SEQ ID NO: 110641 - DNA, 29 bp, Artificial Sequence
  Description of Artificial Sequence: Synthetic oligonucleotide
tgccgccttcttcttccttgtccttgctg

SEQ ID NO: 110642 - DNA, 28 bp, Artificial Sequence
  Description of Artificial Sequence: Synthetic oligonucleotide
gccgccttcttcttccttgtccttgctg

SEQ ID NO: 110643 - DNA, 29 bp, Artificial Sequence
  Description of Artificial Sequence: Synthetic oligonucleotide
ccgccttcttcttccttgtccttgctgtc

SEQ ID NO: 110644 - DNA, 31 bp, Artificial Sequence
  Description of Artificial Sequence: Synthetic oligonucleotide
cgccttcttcttccttgtccttgctgtcttg

SEQ ID NO: 110645 - DNA, 31 bp, Artificial Sequence
  Description of Artificial Sequence: Synthetic oligonucleotide
gccttcttcttccttgtccttgctgtcttgg

SEQ ID NO: 110646 - DNA, 31 bp, Artificial Sequence
  Description of Artificial Sequence: Synthetic oligonucleotide
ccttcttcttccttgtccttgctgtcttggg

SEQ ID NO: 110647 - DNA, 32 bp, Artificial Sequence
  Description of Artificial Sequence: Synthetic oligonucleotide
cttcttcttccttgtccttgctgtcttgggtg

SEQ ID NO: 110648 - DNA, 33 bp, Artificial Sequence
  Description of Artificial Sequence: Synthetic oligonucleotide
ttcttcttccttgtccttgctgtcttgggtgag

SEQ ID NO: 110649 - DNA, 32 bp, Artificial Sequence
  Description of Artificial Sequence: Synthetic oligonucleotide
tcttcttccttgtccttgctgtcttgggtgag

SEQ ID NO: 110650 - DNA, 31 bp, Artificial Sequence
  Description of Artificial Sequence: Synthetic oligonucleotide
cttcttccttgtccttgctgtcttgggtgag

SEQ ID NO: 110651 - DNA, 32 bp, Artificial Sequence
  Description of Artificial Sequence: Synthetic oligonucleotide
ttcttccttgtccttgctgtcttgggtgagac

SEQ ID NO: 110652 - DNA, 31 bp, Artificial Sequence
  Description of Artificial Sequence: Synthetic oligonucleotide
tcttccttgtccttgctgtcttgggtgagac

SEQ ID NO: 110653 - DNA, 30 bp, Artificial Sequence
  Description of Artificial Sequence: Synthetic oligonucleotide
cttccttgtccttgctgtcttgggtgagac

SEQ ID NO: 110654 - DNA, 36 bp, Artificial Sequence
  Description of Artificial Sequence: Synthetic oligonucleotide
ttccttgtccttgctgtcttgggtgagacattaatc

SEQ ID NO: 110655 - DNA, 35 bp, Artificial Sequence
  Description of Artificial Sequence: Synthetic oligonucleotide
tccttgtccttgctgtcttgggtgagacattaatc

SEQ ID NO: 110656 - DNA, 34 bp, Artificial Sequence
  Description of Artificial Sequence: Synthetic oligonucleotide
ccttgtccttgctgtcttgggtgagacattaatc

SEQ ID NO: 110657 - DNA, 34 bp, Artificial Sequence
  Description of Artificial Sequence: Synthetic oligonucleotide
cttgtccttgctgtcttgggtgagacattaatcc

SEQ ID NO: 110658 - DNA, 34 bp, Artificial Sequence
  Description of Artificial Sequence: Synthetic oligonucleotide
ttgtccttgctgtcttgggtgagacattaatccc

SEQ ID NO: 110659 - DNA, 33 bp, Artificial Sequence
  Description of Artificial Sequence: Synthetic oligonucleotide
tgtccttgctgtcttgggtgagacattaatccc

SEQ ID NO: 110660 - DNA, 32 bp, Artificial Sequence
  Description of Artificial Sequence: Synthetic oligonucleotide
gtccttgctgtcttgggtgagacattaatccc

SEQ ID NO: 110661 - DNA, 33 bp, Artificial Sequence
  Description of Artificial Sequence: Synthetic oligonucleotide
tccttgctgtcttgggtgagacattaatccctc

SEQ ID NO: 110662 - DNA, 32 bp, Artificial Sequence
  Description of Artificial Sequence: Synthetic oligonucleotide
ccttgctgtcttgggtgagacattaatccctc

SEQ ID NO: 110663 - DNA, 33 bp, Artificial Sequence
  Description of Artificial Sequence: Synthetic oligonucleotide
cttgctgtcttgggtgagacattaatccctcac

SEQ ID NO: 110664 - DNA, 37 bp, Artificial Sequence
  Description of Artificial Sequence: Synthetic oligonucleotide
ttgctgtcttgggtgagacattaatccctcactattc

SEQ ID NO: 110665 - DNA, 36 bp, Artificial Sequence
  Description of Artificial Sequence: Synthetic oligonucleotide
tgctgtcttgggtgagacattaatccctcactattc

SEQ ID NO: 110666 - DNA, 35 bp, Artificial Sequence
  Description of Artificial Sequence: Synthetic oligonucleotide
gctgtcttgggtgagacattaatccctcactattc

SEQ ID NO: 110667 - DNA, 36 bp, Artificial Sequence
  Description of Artificial Sequence: Synthetic oligonucleotide
ctgtcttgggtgagacattaatccctcactattctg

SEQ ID NO: 110668 - DNA, 36 bp, Artificial Sequence
  Description of Artificial Sequence: Synthetic oligonucleotide
tgtcttgggtgagacattaatccctcactattctgg

SEQ ID NO: 110669 - DNA, 35 bp, Artificial Sequence
  Description of Artificial Sequence: Synthetic oligonucleotide
gtcttgggtgagacattaatccctcactattctgg

SEQ ID NO: 110670 - DNA, 36 bp, Artificial Sequence
  Description of Artificial Sequence: Synthetic oligonucleotide
tcttgggtgagacattaatccctcactattctggtc

SEQ ID NO: 110671 - DNA, 35 bp, Artificial Sequence
  Description of Artificial Sequence: Synthetic oligonucleotide
cttgggtgagacattaatccctcactattctggtc

SEQ ID NO: 110672 - DNA, 35 bp, Artificial Sequence
  Description of Artificial Sequence: Synthetic oligonucleotide
ttgggtgagacattaatccctcactattctggtcg

SEQ ID NO: 110673 - DNA, 34 bp, Artificial Sequence
  Description of Artificial Sequence: Synthetic oligonucleotide
tgggtgagacattaatccctcactattctggtcg

SEQ ID NO: 110674 - DNA, 33 bp, Artificial Sequence
  Description of Artificial Sequence: Synthetic oligonucleotide
gggtgagacattaatccctcactattctggtcg

SEQ ID NO: 110675 - DNA, 34 bp, Artificial Sequence
  Description of Artificial Sequence: Synthetic oligonucleotide
ggtgagacattaatccctcactattctggtcgtg

SEQ ID NO: 110676 - DNA, 35 bp, Artificial Sequence
  Description of Artificial Sequence: Synthetic oligonucleotide
gtgagacattaatccctcactattctggtcgtgtg

SEQ ID NO: 110677 - DNA, 38 bp, Artificial Sequence
  Description of Artificial Sequence: Synthetic oligonucleotide
tgagacattaatccctcactattctggtcgtgtgattg

SEQ ID NO: 110678 - DNA, 37 bp, Artificial Sequence
  Description of Artificial Sequence: Synthetic oligonucleotide
gagacattaatccctcactattctggtcgtgtgattg

SEQ ID NO: 110679 - DNA, 38 bp, Artificial Sequence
  Description of Artificial Sequence: Synthetic oligonucleotide
agacattaatccctcactattctggtcgtgtgattgac

SEQ ID NO: 110680 - DNA, 37 bp, Artificial Sequence
  Description of Artificial Sequence: Synthetic oligonucleotide
gacattaatccctcactattctggtcgtgtgattgac

SEQ ID NO: 110681 - DNA, 39 bp, Artificial Sequence
  Description of Artificial Sequence: Synthetic oligonucleotide
acattaatccctcactattctggtcgtgtgattgacatc

SEQ ID NO: 110682 - DNA, 38 bp, Artificial Sequence
  Description of Artificial Sequence: Synthetic oligonucleotide
cattaatccctcactattctggtcgtgtgattgacatc

SEQ ID NO: 110683 - DNA, 38 bp, Artificial Sequence
  Description of Artificial Sequence: Synthetic oligonucleotide
attaatccctcactattctggtcgtgtgattgacatcc

SEQ ID NO: 110684 - DNA, 37 bp, Artificial Sequence
  Description of Artificial Sequence: Synthetic oligonucleotide
ttaatccctcactattctggtcgtgtgattgacatcc

SEQ ID NO: 110685 - DNA, 36 bp, Artificial Sequence
  Description of Artificial Sequence: Synthetic oligonucleotide
taatccctcactattctggtcgtgtgattgacatcc

SEQ ID NO: 110686 - DNA, 35 bp, Artificial Sequence
  Description of Artificial Sequence: Synthetic oligonucleotide
aatccctcactattctggtcgtgtgattgacatcc

SEQ ID NO: 110687 - DNA, 34 bp, Artificial Sequence
  Description of Artificial Sequence: Synthetic oligonucleotide
atccctcactattctggtcgtgtgattgacatcc

SEQ ID NO: 110688 - DNA, 33 bp, Artificial Sequence
  Description of Artificial Sequence: Synthetic oligonucleotide
tccctcactattctggtcgtgtgattgacatcc

SEQ ID NO: 110689 - DNA, 32 bp, Artificial Sequence
  Description of Artificial Sequence: Synthetic oligonucleotide
ccctcactattctggtcgtgtgattgacatcc

SEQ ID NO: 110690 - DNA, 33 bp, Artificial Sequence
  Description of Artificial Sequence: Synthetic oligonucleotide
cctcactattctggtcgtgtgattgacatcctg

SEQ ID NO: 110691 - DNA, 33 bp, Artificial Sequence
  Description of Artificial Sequence: Synthetic oligonucleotide
ctcactattctggtcgtgtgattgacatcctgg

SEQ ID NO: 110692 - DNA, 33 bp, Artificial Sequence
  Description of Artificial Sequence: Synthetic oligonucleotide
tcactattctggtcgtgtgattgacatcctggg

SEQ ID NO: 110693 - DNA, 32 bp, Artificial Sequence
  Description of Artificial Sequence: Synthetic oligonucleotide
cactattctggtcgtgtgattgacatcctggg

SEQ ID NO: 110694 - DNA, 33 bp, Artificial Sequence
  Description of Artificial Sequence: Synthetic oligonucleotide
actattctggtcgtgtgattgacatcctgggag

SEQ ID NO: 110695 - DNA, 32 bp, Artificial Sequence
  Description of Artificial Sequence: Synthetic oligonucleotide
ctattctggtcgtgtgattgacatcctgggag

SEQ ID NO: 110696 - DNA, 32 bp, Artificial Sequence
  Description of Artificial Sequence: Synthetic oligonucleotide
tattctggtcgtgtgattgacatcctgggagg

SEQ ID NO: 110697 - DNA, 31 bp, Artificial Sequence
  Description of Artificial Sequence: Synthetic oligonucleotide
attctggtcgtgtgattgacatcctgggagg

SEQ ID NO: 110698 - DNA, 30 bp, Artificial Sequence
  Description of Artificial Sequence: Synthetic oligonucleotide
ttctggtcgtgtgattgacatcctgggagg

SEQ ID NO: 110699 - DNA, 29 bp, Artificial Sequence
  Description of Artificial Sequence: Synthetic oligonucleotide
tctggtcgtgtgattgacatcctgggagg

SEQ ID NO: 110700 - DNA, 28 bp, Artificial Sequence
  Description of Artificial Sequence: Synthetic oligonucleotide
ctggtcgtgtgattgacatcctgggagg

SEQ ID NO: 110701 - DNA, 29 bp, Artificial Sequence
  Description of Artificial Sequence: Synthetic oligonucleotide
tggtcgtgtgattgacatcctgggaggtg

SEQ ID NO: 110702 - DNA, 28 bp, Artificial Sequence
  Description of Artificial Sequence: Synthetic oligonucleotide
ggtcgtgtgattgacatcctgggaggtg

SEQ ID NO: 110703 - DNA, 33 bp, Artificial Sequence
  Description of Artificial Sequence: Synthetic oligonucleotide
gtcgtgtgattgacatcctgggaggtgattttg

SEQ ID NO: 110704 - DNA, 34 bp, Artificial Sequence
  Description of Artificial Sequence: Synthetic oligonucleotide
tcgtgtgattgacatcctgggaggtgattttgac

SEQ ID NO: 110705 - DNA, 33 bp, Artificial Sequence
  Description of Artificial Sequence: Synthetic oligonucleotide
cgtgtgattgacatcctgggaggtgattttgac

SEQ ID NO: 110706 - DNA, 33 bp, Artificial Sequence
  Description of Artificial Sequence: Synthetic oligonucleotide
gtgtgattgacatcctgggaggtgattttgacc

SEQ ID NO: 110707 - DNA, 33 bp, Artificial Sequence
  Description of Artificial Sequence: Synthetic oligonucleotide
tgtgattgacatcctgggaggtgattttgaccc

SEQ ID NO: 110708 - DNA, 32 bp, Artificial Sequence
  Description of Artificial Sequence: Synthetic oligonucleotide
gtgattgacatcctgggaggtgattttgaccc

SEQ ID NO: 110709 - DNA, 32 bp, Artificial Sequence
  Description of Artificial Sequence: Synthetic oligonucleotide
tgattgacatcctgggaggtgattttgacccc

SEQ ID NO: 110710 - DNA, 31 bp, Artificial Sequence
  Description of Artificial Sequence: Synthetic oligonucleotide
gattgacatcctgggaggtgattttgacccc

SEQ ID NO: 110711 - DNA, 31 bp, Artificial Sequence
  Description of Artificial Sequence: Synthetic oligonucleotide
attgacatcctgggaggtgattttgaccccc

SEQ ID NO: 110712 - DNA, 30 bp, Artificial Sequence
  Description of Artificial Sequence: Synthetic oligonucleotide
ttgacatcctgggaggtgattttgaccccc

SEQ ID NO: 110713 - DNA, 29 bp, Artificial Sequence
  Description of Artificial Sequence: Synthetic oligonucleotide
tgacatcctgggaggtgattttgaccccc

SEQ ID NO: 110714 - DNA, 28 bp, Artificial Sequence
  Description of Artificial Sequence: Synthetic oligonucleotide
gacatcctgggaggtgattttgaccccc

SEQ ID NO: 110715 - DNA, 30 bp, Artificial Sequence
  Description of Artificial Sequence: Synthetic oligonucleotide
acatcctgggaggtgattttgacccccatg

SEQ ID NO: 110716 - DNA, 29 bp, Artificial Sequence
  Description of Artificial Sequence: Synthetic oligonucleotide
catcctgggaggtgattttgacccccatg

SEQ ID NO: 110717 - DNA, 29 bp, Artificial Sequence
  Description of Artificial Sequence: Synthetic oligonucleotide
atcctgggaggtgattttgacccccatgc

SEQ ID NO: 110718 - DNA, 28 bp, Artificial Sequence
  Description of Artificial Sequence: Synthetic oligonucleotide
tcctgggaggtgattttgacccccatgc

SEQ ID NO: 110719 - DNA, 27 bp, Artificial Sequence
  Description of Artificial Sequence: Synthetic oligonucleotide
cctgggaggtgattttgacccccatgc

SEQ ID NO: 110720 - DNA, 27 bp, Artificial Sequence
  Description of Artificial Sequence: Synthetic oligonucleotide
ctgggaggtgattttgacccccatgcc

SEQ ID NO: 110721 - DNA, 30 bp, Artificial Sequence
  Description of Artificial Sequence: Synthetic oligonucleotide
tgggaggtgattttgacccccatgcctttg

SEQ ID NO: 110722 - DNA, 29 bp, Artificial Sequence
  Description of Artificial Sequence: Synthetic oligonucleotide
gggaggtgattttgacccccatgcctttg

SEQ ID NO: 110723 - DNA, 29 bp, Artificial Sequence
  Description of Artificial Sequence: Synthetic oligonucleotide
ggaggtgattttgacccccatgcctttgc

SEQ ID NO: 110724 - DNA, 29 bp, Artificial Sequence
  Description of Artificial Sequence: Synthetic oligonucleotide
gaggtgattttgacccccatgcctttgcc

SEQ ID NO: 110725 - DNA, 30 bp, Artificial Sequence
  Description of Artificial Sequence: Synthetic oligonucleotide
aggtgattttgacccccatgcctttgccag

SEQ ID NO: 110726 - DNA, 29 bp, Artificial Sequence
  Description of Artificial Sequence: Synthetic oligonucleotide
ggtgattttgacccccatgcctttgccag

SEQ ID NO: 110727 - DNA, 30 bp, Artificial Sequence
  Description of Artificial Sequence: Synthetic oligonucleotide
gtgattttgacccccatgcctttgccagtg

SEQ ID NO: 110728 - DNA, 30 bp, Artificial Sequence
  Description of Artificial Sequence: Synthetic oligonucleotide
tgattttgacccccatgcctttgccagtgc

SEQ ID NO: 110729 - DNA, 29 bp, Artificial Sequence
  Description of Artificial Sequence: Synthetic oligonucleotide
gattttgacccccatgcctttgccagtgc

SEQ ID NO: 110730 - DNA, 29 bp, Artificial Sequence
  Description of Artificial Sequence: Synthetic oligonucleotide
attttgacccccatgcctttgccagtgcc

SEQ ID NO: 110731 - DNA, 28 bp, Artificial Sequence
  Description of Artificial Sequence: Synthetic oligonucleotide
ttttgacccccatgcctttgccagtgcc

SEQ ID NO: 110732 - DNA, 27 bp, Artificial Sequence
  Description of Artificial Sequence: Synthetic oligonucleotide
tttgacccccatgcctttgccagtgcc

SEQ ID NO: 110733 - DNA, 27 bp, Artificial Sequence
  Description of Artificial Sequence: Synthetic oligonucleotide
ttgacccccatgcctttgccagtgcca

SEQ ID NO: 110734 - DNA, 27 bp, Artificial Sequence
  Description of Artificial Sequence: Synthetic oligonucleotide
tgacccccatgcctttgccagtgccat

SEQ ID NO: 110735 - DNA, 26 bp, Artificial Sequence
  Description of Artificial Sequence: Synthetic oligonucleotide
gacccccatgcctttgccagtgccat

SEQ ID NO: 110736 - DNA, 27 bp, Artificial Sequence
  Description of Artificial Sequence: Synthetic oligonucleotide
acccccatgcctttgccagtgccatct

SEQ ID NO: 110737 - DNA, 27 bp, Artificial Sequence
  Description of Artificial Sequence: Synthetic oligonucleotide
cccccatgcctttgccagtgccatctt

SEQ ID NO: 110738 - DNA, 27 bp, Artificial Sequence
  Description of Artificial Sequence: Synthetic oligonucleotide
ccccatgcctttgccagtgccatcttc

SEQ ID NO: 110739 - DNA, 29 bp, Artificial Sequence
  Description of Artificial Sequence: Synthetic oligonucleotide
cccatgcctttgccagtgccatcttcttc

SEQ ID NO: 110740 - DNA, 31 bp, Artificial Sequence
  Description of Artificial Sequence: Synthetic oligonucleotide
ccatgcctttgccagtgccatcttcttcatg

SEQ ID NO: 110741 - DNA, 32 bp, Artificial Sequence
  Description of Artificial Sequence: Synthetic oligonucleotide
catgcctttgccagtgccatcttcttcatgtg

SEQ ID NO: 110742 - DNA, 32 bp, Artificial Sequence
  Description of Artificial Sequence: Synthetic oligonucleotide
atgcctttgccagtgccatcttcttcatgtgc

SEQ ID NO: 110743 - DNA, 31 bp, Artificial Sequence
  Description of Artificial Sequence: Synthetic oligonucleotide
tgcctttgccagtgccatcttcttcatgtgc

SEQ ID NO: 110744 - DNA, 30 bp, Artificial Sequence
  Description of Artificial Sequence: Synthetic oligonucleotide
gcctttgccagtgccatcttcttcatgtgc

SEQ ID NO: 110745 - DNA, 30 bp, Artificial Sequence
  Description of Artificial Sequence: Synthetic oligonucleotide
cctttgccagtgccatcttcttcatgtgcc

SEQ ID NO: 110746 - DNA, 31 bp, Artificial Sequence
  Description of Artificial Sequence: Synthetic oligonucleotide
ctttgccagtgccatcttcttcatgtgcctc

SEQ ID NO: 110747 - DNA, 33 bp, Artificial Sequence
  Description of Artificial Sequence: Synthetic oligonucleotide
tttgccagtgccatcttcttcatgtgcctcttc

SEQ ID NO: 110748 - DNA, 32 bp, Artificial Sequence
  Description of Artificial Sequence: Synthetic oligonucleotide
ttgccagtgccatcttcttcatgtgcctcttc

SEQ ID NO: 110749 - DNA, 31 bp, Artificial Sequence
  Description of Artificial Sequence: Synthetic oligonucleotide
tgccagtgccatcttcttcatgtgcctcttc

SEQ ID NO: 110750 - DNA, 30 bp, Artificial Sequence
  Description of Artificial Sequence: Synthetic oligonucleotide
gccagtgccatcttcttcatgtgcctcttc

SEQ ID NO: 110751 - DNA, 31 bp, Artificial Sequence
  Description of Artificial Sequence: Synthetic oligonucleotide
ccagtgccatcttcttcatgtgcctcttctc

SEQ ID NO: 110752 - DNA, 31 bp, Artificial Sequence
  Description of Artificial Sequence: Synthetic oligonucleotide
cagtgccatcttcttcatgtgcctcttctcc

SEQ ID NO: 110753 - DNA, 34 bp, Artificial Sequence
  Description of Artificial Sequence: Synthetic oligonucleotide
agtgccatcttcttcatgtgcctcttctcctttg

SEQ ID NO: 110754 - DNA, 33 bp, Artificial Sequence
  Description of Artificial Sequence: Synthetic oligonucleotide
gtgccatcttcttcatgtgcctcttctcctttg

SEQ ID NO: 110755 - DNA, 33 bp, Artificial Sequence
  Description of Artificial Sequence: Synthetic oligonucleotide
tgccatcttcttcatgtgcctcttctcctttgg

SEQ ID NO: 110756 - DNA, 32 bp, Artificial Sequence
  Description of Artificial Sequence: Synthetic oligonucleotide
gccatcttcttcatgtgcctcttctcctttgg

SEQ ID NO: 110757 - DNA, 32 bp, Artificial Sequence
  Description of Artificial Sequence: Synthetic oligonucleotide
ccatcttcttcatgtgcctcttctcctttggc

SEQ ID NO: 110758 - DNA, 33 bp, Artificial Sequence
  Description of Artificial Sequence: Synthetic oligonucleotide
catcttcttcatgtgcctcttctcctttggcag

SEQ ID NO: 110759 - DNA, 33 bp, Artificial Sequence
  Description of Artificial Sequence: Synthetic oligonucleotide
atcttcttcatgtgcctcttctcctttggcagc

SEQ ID NO: 110760 - DNA, 32 bp, Artificial Sequence
  Description of Artificial Sequence: Synthetic oligonucleotide
tcttcttcatgtgcctcttctcctttggcagc

SEQ ID NO: 110761 - DNA, 31 bp, Artificial Sequence
  Description of Artificial Sequence: Synthetic oligonucleotide
cttcttcatgtgcctcttctcctttggcagc

SEQ ID NO: 110762 - DNA, 32 bp, Artificial Sequence
  Description of Artificial Sequence: Synthetic oligonucleotide
ttcttcatgtgcctcttctcctttggcagctc

SEQ ID NO: 110763 - DNA, 31 bp, Artificial Sequence
  Description of Artificial Sequence: Synthetic oligonucleotide
tcttcatgtgcctcttctcctttggcagctc

SEQ ID NO: 110764 - DNA, 30 bp, Artificial Sequence
  Description of Artificial Sequence: Synthetic oligonucleotide
cttcatgtgcctcttctcctttggcagctc

SEQ ID NO: 110765 - DNA, 31 bp, Artificial Sequence
  Description of Artificial Sequence: Synthetic oligonucleotide
ttcatgtgcctcttctcctttggcagctcac

SEQ ID NO: 110766 - DNA, 30 bp, Artificial Sequence
  Description of Artificial Sequence: Synthetic oligonucleotide
tcatgtgcctcttctcctttggcagctcac

SEQ ID NO: 110767 - DNA, 29 bp, Artificial Sequence
  Description of Artificial Sequence: Synthetic oligonucleotide
catgtgcctcttctcctttggcagctcac

SEQ ID NO: 110768 - DNA, 30 bp, Artificial Sequence
  Description of Artificial Sequence: Synthetic oligonucleotide
atgtgcctcttctcctttggcagctcactg

SEQ ID NO: 110769 - DNA, 29 bp, Artificial Sequence
  Description of Artificial Sequence: Synthetic oligonucleotide
tgtgcctcttctcctttggcagctcactg

SEQ ID NO: 110770 - DNA, 28 bp, Artificial Sequence
  Description of Artificial Sequence: Synthetic oligonucleotide
gtgcctcttctcctttggcagctcactg

SEQ ID NO: 110771 - DNA, 29 bp, Artificial Sequence
  Description of Artificial Sequence: Synthetic oligonucleotide
tgcctcttctcctttggcagctcactgtc

SEQ ID NO: 110772 - DNA, 28 bp, Artificial Sequence
  Description of Artificial Sequence: Synthetic oligonucleotide
gcctcttctcctttggcagctcactgtc

SEQ ID NO: 110773 - DNA, 29 bp, Artificial Sequence
  Description of Artificial Sequence: Synthetic oligonucleotide
cctcttctcctttggcagctcactgtctg

SEQ ID NO: 110774 - DNA, 29 bp, Artificial Sequence
  Description of Artificial Sequence: Synthetic oligonucleotide
ctcttctcctttggcagctcactgtctgc

SEQ ID NO: 110775 - DNA, 30 bp, Artificial Sequence
  Description of Artificial Sequence: Synthetic oligonucleotide
tcttctcctttggcagctcactgtctgcag

SEQ ID NO: 110776 - DNA, 29 bp, Artificial Sequence
  Description of Artificial Sequence: Synthetic oligonucleotide
cttctcctttggcagctcactgtctgcag

SEQ ID NO: 110777 - DNA, 29 bp, Artificial Sequence
  Description of Artificial Sequence: Synthetic oligonucleotide
ttctcctttggcagctcactgtctgcagg

SEQ ID NO: 110778 - DNA, 28 bp, Artificial Sequence
  Description of Artificial Sequence: Synthetic oligonucleotide
tctcctttggcagctcactgtctgcagg

SEQ ID NO: 110779 - DNA, 27 bp, Artificial Sequence
  Description of Artificial Sequence: Synthetic oligonucleotide
ctcctttggcagctcactgtctgcagg

SEQ ID NO: 110780 - DNA, 27 bp, Artificial Sequence
  Description of Artificial Sequence: Synthetic oligonucleotide
tcctttggcagctcactgtctgcaggc

SEQ ID NO: 110781 - DNA, 27 bp, Artificial Sequence
  Description of Artificial Sequence: Synthetic oligonucleotide
cctttggcagctcactgtctgcaggct

SEQ ID NO: 110782 - DNA, 27 bp, Artificial Sequence
  Description of Artificial Sequence: Synthetic oligonucleotide
ctttggcagctcactgtctgcaggctg

SEQ ID NO: 110783 - DNA, 27 bp, Artificial Sequence
  Description of Artificial Sequence: Synthetic oligonucleotide
tttggcagctcactgtctgcaggctgc

SEQ ID NO: 110784 - DNA, 26 bp, Artificial Sequence
  Description of Artificial Sequence: Synthetic oligonucleotide
ttggcagctcactgtctgcaggctgc

SEQ ID NO: 110785 - DNA, 25 bp, Artificial Sequence
  Description of Artificial Sequence: Synthetic oligonucleotide
tggcagctcactgtctgcaggctgc

SEQ ID NO: 110786 - DNA, 24 bp, Artificial Sequence
  Description of Artificial Sequence: Synthetic oligonucleotide
ggcagctcactgtctgcaggctgc

SEQ ID NO: 110787 - DNA, 24 bp, Artificial Sequence
  Description of Artificial Sequence: Synthetic oligonucleotide
gcagctcactgtctgcaggctgcc

SEQ ID NO: 110788 - DNA, 25 bp, Artificial Sequence
  Description of Artificial Sequence: Synthetic oligonucleotide
cagctcactgtctgcaggctgccga

SEQ ID NO: 110789 - DNA, 25 bp, Artificial Sequence
  Description of Artificial Sequence: Synthetic oligonucleotide
agctcactgtctgcaggctgccgag

SEQ ID NO: 110790 - DNA, 24 bp, Artificial Sequence
  Description of Artificial Sequence: Synthetic oligonucleotide
gctcactgtctgcaggctgccgag

SEQ ID NO: 110791 - DNA, 25 bp, Artificial Sequence
  Description of Artificial Sequence: Synthetic oligonucleotide
ctcactgtctgcaggctgccgagga

SEQ ID NO: 110792 - DNA, 25 bp, Artificial Sequence
  Description of Artificial Sequence: Synthetic oligonucleotide
tcactgtctgcaggctgccgaggag

SEQ ID NO: 110793 - DNA, 24 bp, Artificial Sequence
  Description of Artificial Sequence: Synthetic oligonucleotide
cactgtctgcaggctgccgaggag

SEQ ID NO: 110794 - DNA, 24 bp, Artificial Sequence
  Description of Artificial Sequence: Synthetic oligonucleotide
actgtctgcaggctgccgaggagg

SEQ ID NO: 110795 - DNA, 23 bp, Artificial Sequence
  Description of Artificial Sequence: Synthetic oligonucleotide
ctgtctgcaggctgccgaggagg

SEQ ID NO: 110796 - DNA, 24 bp, Artificial Sequence
  Description of Artificial Sequence: Synthetic oligonucleotide
tgtctgcaggctgccgaggaggct

SEQ ID NO: 110797 - DNA, 23 bp, Artificial Sequence
  Description of Artificial Sequence: Synthetic oligonucleotide
gtctgcaggctgccgaggaggct

SEQ ID NO: 110798 - DNA, 23 bp, Artificial Sequence
  Description of Artificial Sequence: Synthetic oligonucleotide
tctgcaggctgccgaggaggctg

SEQ ID NO: 110799 - DNA, 22 bp, Artificial Sequence
  Description of Artificial Sequence: Synthetic oligonucleotide
ctgcaggctgccgaggaggctg

SEQ ID NO: 110800 - DNA, 24 bp, Artificial Sequence
  Description of Artificial Sequence: Synthetic oligonucleotide
tgcaggctgccgaggaggctgctt

SEQ ID NO: 110801 - DNA, 23 bp, Artificial Sequence
  Description of Artificial Sequence: Synthetic oligonucleotide
gcaggctgccgaggaggctgctt

SEQ ID NO: 110802 - DNA, 24 bp, Artificial Sequence
  Description of Artificial Sequence: Synthetic oligonucleotide
caggctgccgaggaggctgcttca

SEQ ID NO: 110803 - DNA, 24 bp, Artificial Sequence
  Description of Artificial Sequence: Synthetic oligonucleotide
aggctgccgaggaggctgcttcac

SEQ ID NO: 110804 - DNA, 23 bp, Artificial Sequence
  Description of Artificial Sequence: Synthetic oligonucleotide
ggctgccgaggaggctgcttcac

SEQ ID NO: 110805 - DNA, 25 bp, Artificial Sequence
  Description of Artificial Sequence: Synthetic oligonucleotide
gctgccgaggaggctgcttcaccta

SEQ ID NO: 110806 - DNA, 26 bp, Artificial Sequence
  Description of Artificial Sequence: Synthetic oligonucleotide
ctgccgaggaggctgcttcacctaca

SEQ ID NO: 110807 - DNA, 26 bp, Artificial Sequence
  Description of Artificial Sequence: Synthetic oligonucleotide
tgccgaggaggctgcttcacctacac

SEQ ID NO: 110808 - DNA, 25 bp, Artificial Sequence
  Description of Artificial Sequence: Synthetic oligonucleotide
gccgaggaggctgcttcacctacac

SEQ ID NO: 110809 - DNA, 27 bp, Artificial Sequence
  Description of Artificial Sequence: Synthetic oligonucleotide
ccgaggaggctgcttcacctacaccat

SEQ ID NO: 110810 - DNA, 27 bp, Artificial Sequence
  Description of Artificial Sequence: Synthetic oligonucleotide
cgaggaggctgcttcacctacaccatg

SEQ ID NO: 110811 - DNA, 28 bp, Artificial Sequence
  Description of Artificial Sequence: Synthetic oligonucleotide
gaggaggctgcttcacctacaccatgtc

SEQ ID NO: 110812 - DNA, 29 bp, Artificial Sequence
  Description of Artificial Sequence: Synthetic oligonucleotide
aggaggctgcttcacctacaccatgtctc

SEQ ID NO: 110813 - DNA, 28 bp, Artificial Sequence
  Description of Artificial Sequence: Synthetic oligonucleotide
ggaggctgcttcacctacaccatgtctc

SEQ ID NO: 110814 - DNA, 28 bp, Artificial Sequence
  Description of Artificial Sequence: Synthetic oligonucleotide
gaggctgcttcacctacaccatgtctcg

SEQ ID NO: 110815 - DNA, 31 bp, Artificial Sequence
  Description of Artificial Sequence: Synthetic oligonucleotide
aggctgcttcacctacaccatgtctcgaatc

SEQ ID NO: 110816 - DNA, 30 bp, Artificial Sequence
  Description of Artificial Sequence: Synthetic oligonucleotide
ggctgcttcacctacaccatgtctcgaatc

SEQ ID NO: 110817 - DNA, 32 bp, Artificial Sequence
  Description of Artificial Sequence: Synthetic oligonucleotide
gctgcttcacctacaccatgtctcgaatcaac

SEQ ID NO: 110818 - DNA, 34 bp, Artificial Sequence
  Description of Artificial Sequence: Synthetic oligonucleotide
ctgcttcacctacaccatgtctcgaatcaacttg

SEQ ID NO: 110819 - DNA, 34 bp, Artificial Sequence
  Description of Artificial Sequence: Synthetic oligonucleotide
tgcttcacctacaccatgtctcgaatcaacttgc

SEQ ID NO: 110820 - DNA, 33 bp, Artificial Sequence
  Description of Artificial Sequence: Synthetic oligonucleotide
gcttcacctacaccatgtctcgaatcaacttgc

SEQ ID NO: 110821 - DNA, 33 bp, Artificial Sequence
  Description of Artificial Sequence: Synthetic oligonucleotide
cttcacctacaccatgtctcgaatcaacttgcg

SEQ ID NO: 110822 - DNA, 33 bp, Artificial Sequence
  Description of Artificial Sequence: Synthetic oligonucleotide
ttcacctacaccatgtctcgaatcaacttgcgg

SEQ ID NO: 110823 - DNA, 32 bp, Artificial Sequence
  Description of Artificial Sequence: Synthetic oligonucleotide
tcacctacaccatgtctcgaatcaacttgcgg

SEQ ID NO: 110824 - DNA, 31 bp, Artificial Sequence
  Description of Artificial Sequence: Synthetic oligonucleotide
cacctacaccatgtctcgaatcaacttgcgg

SEQ ID NO: 110825 - DNA, 33 bp, Artificial Sequence
  Description of Artificial Sequence: Synthetic oligonucleotide
acctacaccatgtctcgaatcaacttgcggatc

SEQ ID NO: 110826 - DNA, 32 bp, Artificial Sequence
  Description of Artificial Sequence: Synthetic oligonucleotide
cctacaccatgtctcgaatcaacttgcggatc

SEQ ID NO: 110827 - DNA, 32 bp, Artificial Sequence
  Description of Artificial Sequence: Synthetic oligonucleotide
ctacaccatgtctcgaatcaacttgcggatcc

SEQ ID NO: 110828 - DNA, 32 bp, Artificial Sequence
  Description of Artificial Sequence: Synthetic oligonucleotide
tacaccatgtctcgaatcaacttgcggatccg

SEQ ID NO: 110829 - DNA, 31 bp, Artificial Sequence
  Description of Artificial Sequence: Synthetic oligonucleotide
acaccatgtctcgaatcaacttgcggatccg

SEQ ID NO: 110830 - DNA, 30 bp, Artificial Sequence
  Description of Artificial Sequence: Synthetic oligonucleotide
caccatgtctcgaatcaacttgcggatccg

SEQ ID NO: 110831 - DNA, 30 bp, Artificial Sequence
  Description of Artificial Sequence: Synthetic oligonucleotide
accatgtctcgaatcaacttgcggatccgg

SEQ ID NO: 110832 - DNA, 29 bp, Artificial Sequence
  Description of Artificial Sequence: Synthetic oligonucleotide
ccatgtctcgaatcaacttgcggatccgg

SEQ ID NO: 110833 - DNA, 29 bp, Artificial Sequence
  Description of Artificial Sequence: Synthetic oligonucleotide
catgtctcgaatcaacttgcggatccggg

SEQ ID NO: 110834 - DNA, 30 bp, Artificial Sequence
  Description of Artificial Sequence: Synthetic oligonucleotide
atgtctcgaatcaacttgcggatccgggag

SEQ ID NO: 110835 - DNA, 29 bp, Artificial Sequence
  Description of Artificial Sequence: Synthetic oligonucleotide
tgtctcgaatcaacttgcggatccgggag

SEQ ID NO: 110836 - DNA, 28 bp, Artificial Sequence
  Description of Artificial Sequence: Synthetic oligonucleotide
gtctcgaatcaacttgcggatccgggag

SEQ ID NO: 110837 - DNA, 28 bp, Artificial Sequence
  Description of Artificial Sequence: Synthetic oligonucleotide
tctcgaatcaacttgcggatccgggagc

SEQ ID NO: 110838 - DNA, 27 bp, Artificial Sequence
  Description of Artificial Sequence: Synthetic oligonucleotide
ctcgaatcaacttgcggatccgggagc

SEQ ID NO: 110839 - DNA, 28 bp, Artificial Sequence
  Description of Artificial Sequence: Synthetic oligonucleotide
tcgaatcaacttgcggatccgggagcag

SEQ ID NO: 110840 - DNA, 27 bp, Artificial Sequence
  Description of Artificial Sequence: Synthetic oligonucleotide
cgaatcaacttgcggatccgggagcag

SEQ ID NO: 110841 - DNA, 27 bp, Artificial Sequence
  Description of Artificial Sequence: Synthetic oligonucleotide
gaatcaacttgcggatccgggagcagc

SEQ ID NO: 110842 - DNA, 31 bp, Artificial Sequence
  Description of Artificial Sequence: Synthetic oligonucleotide
aatcaacttgcggatccgggagcagcttttc

SEQ ID NO: 110843 - DNA, 30 bp, Artificial Sequence
  Description of Artificial Sequence: Synthetic oligonucleotide
atcaacttgcggatccgggagcagcttttc

SEQ ID NO: 110844 - DNA, 29 bp, Artificial Sequence
  Description of Artificial Sequence: Synthetic oligonucleotide
tcaacttgcggatccgggagcagcttttc

SEQ ID NO: 110845 - DNA, 28 bp, Artificial Sequence
  Description of Artificial Sequence: Synthetic oligonucleotide
caacttgcggatccgggagcagcttttc

SEQ ID NO: 110846 - DNA, 29 bp, Artificial Sequence
  Description of Artificial Sequence: Synthetic oligonucleotide
aacttgcggatccgggagcagcttttctc

SEQ ID NO: 110847 - DNA, 28 bp, Artificial Sequence
  Description of Artificial Sequence: Synthetic oligonucleotide
acttgcggatccgggagcagcttttctc

SEQ ID NO: 110848 - DNA, 27 bp, Artificial Sequence
  Description of Artificial Sequence: Synthetic oligonucleotide
cttgcggatccgggagcagcttttctc

SEQ ID NO: 110849 - DNA, 27 bp, Artificial Sequence
  Description of Artificial Sequence: Synthetic oligonucleotide
ttgcggatccgggagcagcttttctcc

SEQ ID NO: 110850 - DNA, 27 bp, Artificial Sequence
  Description of Artificial Sequence: Synthetic oligonucleotide
tgcggatccgggagcagcttttctcct

SEQ ID NO: 110851 - DNA, 26 bp, Artificial Sequence
  Description of Artificial Sequence: Synthetic oligonucleotide
gcggatccgggagcagcttttctcct

SEQ ID NO: 110852 - DNA, 26 bp, Artificial Sequence
  Description of Artificial Sequence: Synthetic oligonucleotide
cggatccgggagcagcttttctcctc

SEQ ID NO: 110853 - DNA, 26 bp, Artificial Sequence
  Description of Artificial Sequence: Synthetic oligonucleotide
ggatccgggagcagcttttctcctcc

SEQ ID NO: 110854 - DNA, 27 bp, Artificial Sequence
  Description of Artificial Sequence: Synthetic oligonucleotide
gatccgggagcagcttttctcctccct

SEQ ID NO: 110855 - DNA, 27 bp, Artificial Sequence
  Description of Artificial Sequence: Synthetic oligonucleotide
atccgggagcagcttttctcctccctg

SEQ ID NO: 110856 - DNA, 26 bp, Artificial Sequence
  Description of Artificial Sequence: Synthetic oligonucleotide
tccgggagcagcttttctcctccctg

SEQ ID NO: 110857 - DNA, 25 bp, Artificial Sequence
  Description of Artificial Sequence: Synthetic oligonucleotide
ccgggagcagcttttctcctccctg

SEQ ID NO: 110858 - DNA, 26 bp, Artificial Sequence
  Description of Artificial Sequence: Synthetic oligonucleotide
cgggagcagcttttctcctccctgct

SEQ ID NO: 110859 - DNA, 26 bp, Artificial Sequence
  Description of Artificial Sequence: Synthetic oligonucleotide
gggagcagcttttctcctccctgctg

SEQ ID NO: 110860 - DNA, 26 bp, Artificial Sequence
  Description of Artificial Sequence: Synthetic oligonucleotide
ggagcagcttttctcctccctgctgc

SEQ ID NO: 110861 - DNA, 26 bp, Artificial Sequence
  Description of Artificial Sequence: Synthetic oligonucleotide
gagcagcttttctcctccctgctgcg

SEQ ID NO: 110862 - DNA, 26 bp, Artificial Sequence
  Description of Artificial Sequence: Synthetic oligonucleotide
agcagcttttctcctccctgctgcgc

SEQ ID NO: 110863 - DNA, 25 bp, Artificial Sequence
  Description of Artificial Sequence: Synthetic oligonucleotide
gcagcttttctcctccctgctgcgc

SEQ ID NO: 110864 - DNA, 26 bp, Artificial Sequence
  Description of Artificial Sequence: Synthetic oligonucleotide
cagcttttctcctccctgctgcgcca

SEQ ID NO: 110865 - DNA, 26 bp, Artificial Sequence
  Description of Artificial Sequence: Synthetic oligonucleotide
agcttttctcctccctgctgcgccag

SEQ ID NO: 110866 - DNA, 25 bp, Artificial Sequence
  Description of Artificial Sequence: Synthetic oligonucleotide
gcttttctcctccctgctgcgccag

SEQ ID NO: 110867 - DNA, 26 bp, Artificial Sequence
  Description of Artificial Sequence: Synthetic oligonucleotide
cttttctcctccctgctgcgccagga

SEQ ID NO: 110868 - DNA, 26 bp, Artificial Sequence
  Description of Artificial Sequence: Synthetic oligonucleotide
ttttctcctccctgctgcgccaggac

SEQ ID NO: 110869 - DNA, 25 bp, Artificial Sequence
  Description of Artificial Sequence: Synthetic oligonucleotide
tttctcctccctgctgcgccaggac

SEQ ID NO: 110870 - DNA, 24 bp, Artificial Sequence
  Description of Artificial Sequence: Synthetic oligonucleotide
ttctcctccctgctgcgccaggac

SEQ ID NO: 110871 - DNA, 23 bp, Artificial Sequence
  Description of Artificial Sequence: Synthetic oligonucleotide
tctcctccctgctgcgccaggac

SEQ ID NO: 110872 - DNA, 22 bp, Artificial Sequence
  Description of Artificial Sequence: Synthetic oligonucleotide
ctcctccctgctgcgccaggac

SEQ ID NO: 110873 - DNA, 23 bp, Artificial Sequence
  Description of Artificial Sequence: Synthetic oligonucleotide
tcctccctgctgcgccaggacct

SEQ ID NO: 110874 - DNA, 22 bp, Artificial Sequence
  Description of Artificial Sequence: Synthetic oligonucleotide
cctccctgctgcgccaggacct

SEQ ID NO: 110875 - DNA, 22 bp, Artificial Sequence
  Description of Artificial Sequence: Synthetic oligonucleotide
ctccctgctgcgccaggacctc

SEQ ID NO: 110876 - DNA, 22 bp, Artificial Sequence
  Description of Artificial Sequence: Synthetic oligonucleotide
tccctgctgcgccaggacctcg

SEQ ID NO: 110877 - DNA, 21 bp, Artificial Sequence
  Description of Artificial Sequence: Synthetic oligonucleotide
ccctgctgcgccaggacctcg

SEQ ID NO: 110878 - DNA, 24 bp, Artificial Sequence
  Description of Artificial Sequence: Synthetic oligonucleotide
cctgctgcgccaggacctcggttt

SEQ ID NO: 110879 - DNA, 26 bp, Artificial Sequence
  Description of Artificial Sequence: Synthetic oligonucleotide
ctgctgcgccaggacctcggtttctt

SEQ ID NO: 110880 - DNA, 26 bp, Artificial Sequence
  Description of Artificial Sequence: Synthetic oligonucleotide
tgctgcgccaggacctcggtttcttc

SEQ ID NO: 110881 - DNA, 25 bp, Artificial Sequence
  Description of Artificial Sequence: Synthetic oligonucleotide
gctgcgccaggacctcggtttcttc

SEQ ID NO: 110882 - DNA, 26 bp, Artificial Sequence
  Description of Artificial Sequence: Synthetic oligonucleotide
ctgcgccaggacctcggtttcttcca

SEQ ID NO: 110883 - DNA, 26 bp, Artificial Sequence
  Description of Artificial Sequence: Synthetic oligonucleotide
tgcgccaggacctcggtttcttccag

SEQ ID NO: 110884 - DNA, 25 bp, Artificial Sequence
  Description of Artificial Sequence: Synthetic oligonucleotide
gcgccaggacctcggtttcttccag

SEQ ID NO: 110885 - DNA, 26 bp, Artificial Sequence
  Description of Artificial Sequence: Synthetic oligonucleotide
cgccaggacctcggtttcttccagga

SEQ ID NO: 110886 - DNA, 27 bp, Artificial Sequence
  Description of Artificial Sequence: Synthetic oligonucleotide
gccaggacctcggtttcttccaggaga

SEQ ID NO: 110887 - DNA, 27 bp, Artificial Sequence
  Description of Artificial Sequence: Synthetic oligonucleotide
ccaggacctcggtttcttccaggagac

SEQ ID NO: 110888 - DNA, 30 bp, Artificial Sequence
  Description of Artificial Sequence: Synthetic oligonucleotide
caggacctcggtttcttccaggagactaag

SEQ ID NO: 110889 - DNA, 31 bp, Artificial Sequence
  Description of Artificial Sequence: Synthetic oligonucleotide
aggacctcggtttcttccaggagactaagac

SEQ ID NO: 110890 - DNA, 30 bp, Artificial Sequence
  Description of Artificial Sequence: Synthetic oligonucleotide
ggacctcggtttcttccaggagactaagac

SEQ ID NO: 110891 - DNA, 31 bp, Artificial Sequence
  Description of Artificial Sequence: Synthetic oligonucleotide
gacctcggtttcttccaggagactaagacag

SEQ ID NO: 110892 - DNA, 31 bp, Artificial Sequence
  Description of Artificial Sequence: Synthetic oligonucleotide
acctcggtttcttccaggagactaagacagg

SEQ ID NO: 110893 - DNA, 30 bp, Artificial Sequence
  Description of Artificial Sequence: Synthetic oligonucleotide
cctcggtttcttccaggagactaagacagg

SEQ ID NO: 110894 - DNA, 30 bp, Artificial Sequence
  Description of Artificial Sequence: Synthetic oligonucleotide
ctcggtttcttccaggagactaagacaggg

SEQ ID NO: 110895 - DNA, 30 bp, Artificial Sequence
  Description of Artificial Sequence: Synthetic oligonucleotide
tcggtttcttccaggagactaagacagggg

SEQ ID NO: 110896 - DNA, 29 bp, Artificial Sequence
  Description of Artificial Sequence: Synthetic oligonucleotide
cggtttcttccaggagactaagacagggg

SEQ ID NO: 110897 - DNA, 30 bp, Artificial Sequence
  Description of Artificial Sequence: Synthetic oligonucleotide
ggtttcttccaggagactaagacaggggag

SEQ ID NO: 110898 - DNA, 30 bp, Artificial Sequence
  Description of Artificial Sequence: Synthetic oligonucleotide
gtttcttccaggagactaagacaggggagc

SEQ ID NO: 110899 - DNA, 31 bp, Artificial Sequence
  Description of Artificial Sequence: Synthetic oligonucleotide
tttcttccaggagactaagacaggggagctg

SEQ ID NO: 110900 - DNA, 30 bp, Artificial Sequence
  Description of Artificial Sequence: Synthetic oligonucleotide
ttcttccaggagactaagacaggggagctg

SEQ ID NO: 110901 - DNA, 29 bp, Artificial Sequence
  Description of Artificial Sequence: Synthetic oligonucleotide
tcttccaggagactaagacaggggagctg

SEQ ID NO: 110902 - DNA, 28 bp, Artificial Sequence
  Description of Artificial Sequence: Synthetic oligonucleotide
cttccaggagactaagacaggggagctg

SEQ ID NO: 110903 - DNA, 30 bp, Artificial Sequence
  Description of Artificial Sequence: Synthetic oligonucleotide
ttccaggagactaagacaggggagctgaac

SEQ ID NO: 110904 - DNA, 29 bp, Artificial Sequence
  Description of Artificial Sequence: Synthetic oligonucleotide
tccaggagactaagacaggggagctgaac

SEQ ID NO: 110905 - DNA, 28 bp, Artificial Sequence
  Description of Artificial Sequence: Synthetic oligonucleotide
ccaggagactaagacaggggagctgaac

SEQ ID NO: 110906 - DNA, 29 bp, Artificial Sequence
  Description of Artificial Sequence: Synthetic oligonucleotide
caggagactaagacaggggagctgaactc

SEQ ID NO: 110907 - DNA, 30 bp, Artificial Sequence
  Description of Artificial Sequence: Synthetic oligonucleotide
aggagactaagacaggggagctgaactcac

SEQ ID NO: 110908 - DNA, 29 bp, Artificial Sequence
  Description of Artificial Sequence: Synthetic oligonucleotide
ggagactaagacaggggagctgaactcac

SEQ ID NO: 110909 - DNA, 29 bp, Artificial Sequence
  Description of Artificial Sequence: Synthetic oligonucleotide
gagactaagacaggggagctgaactcacg

SEQ ID NO: 110910 - DNA, 29 bp, Artificial Sequence
  Description of Artificial Sequence: Synthetic oligonucleotide
agactaagacaggggagctgaactcacgg

SEQ ID NO: 110911 - DNA, 28 bp, Artificial Sequence
  Description of Artificial Sequence: Synthetic oligonucleotide
gactaagacaggggagctgaactcacgg

SEQ ID NO: 110912 - DNA, 28 bp, Artificial Sequence
  Description of Artificial Sequence: Synthetic oligonucleotide
actaagacaggggagctgaactcacggc

SEQ ID NO: 110913 - DNA, 27 bp, Artificial Sequence
  Description of Artificial Sequence: Synthetic oligonucleotide
ctaagacaggggagctgaactcacggc

SEQ ID NO: 110914 - DNA, 28 bp, Artificial Sequence
  Description of Artificial Sequence: Synthetic oligonucleotide
taagacaggggagctgaactcacggctg

SEQ ID NO: 110915 - DNA, 27 bp, Artificial Sequence
  Description of Artificial Sequence: Synthetic oligonucleotide
aagacaggggagctgaactcacggctg

SEQ ID NO: 110916 - DNA, 27 bp, Artificial Sequence
  Description of Artificial Sequence: Synthetic oligonucleotide
agacaggggagctgaactcacggctga

SEQ ID NO: 110917 - DNA, 26 bp, Artificial Sequence
  Description of Artificial Sequence: Synthetic oligonucleotide
gacaggggagctgaactcacggctga

SEQ ID NO: 110918 - DNA, 26 bp, Artificial Sequence
  Description of Artificial Sequence: Synthetic oligonucleotide
acaggggagctgaactcacggctgag

SEQ ID NO: 110919 - DNA, 25 bp, Artificial Sequence
  Description of Artificial Sequence: Synthetic oligonucleotide
caggggagctgaactcacggctgag

SEQ ID NO: 110920 - DNA, 26 bp, Artificial Sequence
  Description of Artificial Sequence: Synthetic oligonucleotide
aggggagctgaactcacggctgagct

SEQ ID NO: 110921 - DNA, 25 bp, Artificial Sequence
  Description of Artificial Sequence: Synthetic oligonucleotide
ggggagctgaactcacggctgagct

SEQ ID NO: 110922 - DNA, 25 bp, Artificial Sequence
  Description of Artificial Sequence: Synthetic oligonucleotide
gggagctgaactcacggctgagctc

SEQ ID NO: 110923 - DNA, 25 bp, Artificial Sequence
  Description of Artificial Sequence: Synthetic oligonucleotide
ggagctgaactcacggctgagctcg

SEQ ID NO: 110924 - DNA, 27 bp, Artificial Sequence
  Description of Artificial Sequence: Synthetic oligonucleotide
gagctgaactcacggctgagctcggat

SEQ ID NO: 110925 - DNA, 28 bp, Artificial Sequence
  Description of Artificial Sequence: Synthetic oligonucleotide
agctgaactcacggctgagctcggatac

SEQ ID NO: 110926 - DNA, 27 bp, Artificial Sequence
  Description of Artificial Sequence: Synthetic oligonucleotide
gctgaactcacggctgagctcggatac

SEQ ID NO: 110927 - DNA, 27 bp, Artificial Sequence
  Description of Artificial Sequence: Synthetic oligonucleotide
ctgaactcacggctgagctcggatacc

SEQ ID NO: 110928 - DNA, 28 bp, Artificial Sequence
  Description of Artificial Sequence: Synthetic oligonucleotide
tgaactcacggctgagctcggataccac

SEQ ID NO: 110929 - DNA, 27 bp, Artificial Sequence
  Description of Artificial Sequence: Synthetic oligonucleotide
gaactcacggctgagctcggataccac

SEQ ID NO: 110930 - DNA, 27 bp, Artificial Sequence
  Description of Artificial Sequence: Synthetic oligonucleotide
aactcacggctgagctcggataccacc

SEQ ID NO: 110931 - DNA, 26 bp, Artificial Sequence
  Description of Artificial Sequence: Synthetic oligonucleotide
actcacggctgagctcggataccacc

SEQ ID NO: 110932 - DNA, 25 bp, Artificial Sequence
  Description of Artificial Sequence: Synthetic oligonucleotide
ctcacggctgagctcggataccacc

SEQ ID NO: 110933 - DNA, 26 bp, Artificial Sequence
  Description of Artificial Sequence: Synthetic oligonucleotide
tcacggctgagctcggataccaccct

SEQ ID NO: 110934 - DNA, 25 bp, Artificial Sequence
  Description of Artificial Sequence: Synthetic oligonucleotide
cacggctgagctcggataccaccct

SEQ ID NO: 110935 - DNA, 27 bp, Artificial Sequence
  Description of Artificial Sequence: Synthetic oligonucleotide
acggctgagctcggataccaccctgat

SEQ ID NO: 110936 - DNA, 26 bp, Artificial Sequence
  Description of Artificial Sequence: Synthetic oligonucleotide
cggctgagctcggataccaccctgat

SEQ ID NO: 110937 - DNA, 27 bp, Artificial Sequence
  Description of Artificial Sequence: Synthetic oligonucleotide
ggctgagctcggataccaccctgatga

SEQ ID NO: 110938 - DNA, 27 bp, Artificial Sequence
  Description of Artificial Sequence: Synthetic oligonucleotide
gctgagctcggataccaccctgatgag

SEQ ID NO: 110939 - DNA, 30 bp, Artificial Sequence
  Description of Artificial Sequence: Synthetic oligonucleotide
ctgagctcggataccaccctgatgagtaac

SEQ ID NO: 110940 - DNA, 31 bp, Artificial Sequence
  Description of Artificial Sequence: Synthetic oligonucleotide
tgagctcggataccaccctgatgagtaactg

SEQ ID NO: 110941 - DNA, 30 bp, Artificial Sequence
  Description of Artificial Sequence: Synthetic oligonucleotide
gagctcggataccaccctgatgagtaactg

SEQ ID NO: 110942 - DNA, 30 bp, Artificial Sequence
  Description of Artificial Sequence: Synthetic oligonucleotide
agctcggataccaccctgatgagtaactgg

SEQ ID NO: 110943 - DNA, 29 bp, Artificial Sequence
  Description of Artificial Sequence: Synthetic oligonucleotide
gctcggataccaccctgatgagtaactgg

SEQ ID NO: 110944 - DNA, 29 bp, Artificial Sequence
  Description of Artificial Sequence: Synthetic oligonucleotide
ctcggataccaccctgatgagtaactggc

SEQ ID NO: 110945 - DNA, 31 bp, Artificial Sequence
  Description of Artificial Sequence: Synthetic oligonucleotide
tcggataccaccctgatgagtaactggcttc

SEQ ID NO: 110946 - DNA, 30 bp, Artificial Sequence
  Description of Artificial Sequence: Synthetic oligonucleotide
cggataccaccctgatgagtaactggcttc

SEQ ID NO: 110947 - DNA, 30 bp, Artificial Sequence
  Description of Artificial Sequence: Synthetic oligonucleotide
ggataccaccctgatgagtaactggcttcc

SEQ ID NO: 110948 - DNA, 37 bp, Artificial Sequence
  Description of Artificial Sequence: Synthetic oligonucleotide
gataccaccctgatgagtaactggcttcctttaaatg

SEQ ID NO: 110949 - DNA, 37 bp, Artificial Sequence
  Description of Artificial Sequence: Synthetic oligonucleotide
ataccaccctgatgagtaactggcttcctttaaatgc

SEQ ID NO: 110950 - DNA, 36 bp, Artificial Sequence
  Description of Artificial Sequence: Synthetic oligonucleotide
taccaccctgatgagtaactggcttcctttaaatgc

SEQ ID NO: 110951 - DNA, 35 bp, Artificial Sequence
  Description of Artificial Sequence: Synthetic oligonucleotide
accaccctgatgagtaactggcttcctttaaatgc

SEQ ID NO: 110952 - DNA, 34 bp, Artificial Sequence
  Description of Artificial Sequence: Synthetic oligonucleotide
ccaccctgatgagtaactggcttcctttaaatgc

SEQ ID NO: 110953 - DNA, 34 bp, Artificial Sequence
  Description of Artificial Sequence: Synthetic oligonucleotide
caccctgatgagtaactggcttcctttaaatgcc

SEQ ID NO: 110954 - DNA, 37 bp, Artificial Sequence
  Description of Artificial Sequence: Synthetic oligonucleotide
accctgatgagtaactggcttcctttaaatgccaatg

SEQ ID NO: 110955 - DNA, 36 bp, Artificial Sequence
  Description of Artificial Sequence: Synthetic oligonucleotide
ccctgatgagtaactggcttcctttaaatgccaatg

SEQ ID NO: 110956 - DNA, 37 bp, Artificial Sequence
  Description of Artificial Sequence: Synthetic oligonucleotide
cctgatgagtaactggcttcctttaaatgccaatgtg

SEQ ID NO: 110957 - DNA, 37 bp, Artificial Sequence
  Description of Artificial Sequence: Synthetic oligonucleotide
ctgatgagtaactggcttcctttaaatgccaatgtgc

SEQ ID NO: 110958 - DNA, 38 bp, Artificial Sequence
  Description of Artificial Sequence: Synthetic oligonucleotide
tgatgagtaactggcttcctttaaatgccaatgtgctc

SEQ ID NO: 110959 - DNA, 37 bp, Artificial Sequence
  Description of Artificial Sequence: Synthetic oligonucleotide
gatgagtaactggcttcctttaaatgccaatgtgctc

SEQ ID NO: 110960 - DNA, 39 bp, Artificial Sequence
  Description of Artificial Sequence: Synthetic oligonucleotide
atgagtaactggcttcctttaaatgccaatgtgctcttg

SEQ ID NO: 110961 - DNA, 38 bp, Artificial Sequence
  Description of Artificial Sequence: Synthetic oligonucleotide
tgagtaactggcttcctttaaatgccaatgtgctcttg

SEQ ID NO: 110962 - DNA, 37 bp, Artificial Sequence
  Description of Artificial Sequence: Synthetic oligonucleotide
gagtaactggcttcctttaaatgccaatgtgctcttg

SEQ ID NO: 110963 - DNA, 37 bp, Artificial Sequence
  Description of Artificial Sequence: Synthetic oligonucleotide
agtaactggcttcctttaaatgccaatgtgctcttgc

SEQ ID NO: 110964 - DNA, 36 bp, Artificial Sequence
  Description of Artificial Sequence: Synthetic oligonucleotide
gtaactggcttcctttaaatgccaatgtgctcttgc

SEQ ID NO: 110965 - DNA, 36 bp, Artificial Sequence
  Description of Artificial Sequence: Synthetic oligonucleotide
taactggcttcctttaaatgccaatgtgctcttgcg

SEQ ID NO: 110966 - DNA, 35 bp, Artificial Sequence
  Description of Artificial Sequence: Synthetic oligonucleotide
aactggcttcctttaaatgccaatgtgctcttgcg

SEQ ID NO: 110967 - DNA, 34 bp, Artificial Sequence
  Description of Artificial Sequence: Synthetic oligonucleotide
actggcttcctttaaatgccaatgtgctcttgcg

SEQ ID NO: 110968 - DNA, 33 bp, Artificial Sequence
  Description of Artificial Sequence: Synthetic oligonucleotide
ctggcttcctttaaatgccaatgtgctcttgcg

SEQ ID NO: 110969 - DNA, 35 bp, Artificial Sequence
  Description of Artificial Sequence: Synthetic oligonucleotide
tggcttcctttaaatgccaatgtgctcttgcgaag

SEQ ID NO: 110970 - DNA, 34 bp, Artificial Sequence
  Description of Artificial Sequence: Synthetic oligonucleotide
ggcttcctttaaatgccaatgtgctcttgcgaag

SEQ ID NO: 110971 - DNA, 34 bp, Artificial Sequence
  Description of Artificial Sequence: Synthetic oligonucleotide
gcttcctttaaatgccaatgtgctcttgcgaagc

SEQ ID NO: 110972 - DNA, 34 bp, Artificial Sequence
  Description of Artificial Sequence: Synthetic oligonucleotide
cttcctttaaatgccaatgtgctcttgcgaagcc

SEQ ID NO: 110973 - DNA, 35 bp, Artificial Sequence
  Description of Artificial Sequence: Synthetic oligonucleotide
ttcctttaaatgccaatgtgctcttgcgaagcctg

SEQ ID NO: 110974 - DNA, 34 bp, Artificial Sequence
  Description of Artificial Sequence: Synthetic oligonucleotide
tcctttaaatgccaatgtgctcttgcgaagcctg

SEQ ID NO: 110975 - DNA, 33 bp, Artificial Sequence
  Description of Artificial Sequence: Synthetic oligonucleotide
cctttaaatgccaatgtgctcttgcgaagcctg

SEQ ID NO: 110976 - DNA, 33 bp, Artificial Sequence
  Description of Artificial Sequence: Synthetic oligonucleotide
ctttaaatgccaatgtgctcttgcgaagcctgg

SEQ ID NO: 110977 - DNA, 34 bp, Artificial Sequence
  Description of Artificial Sequence: Synthetic oligonucleotide
tttaaatgccaatgtgctcttgcgaagcctggtg

SEQ ID NO: 110978 - DNA, 33 bp, Artificial Sequence
  Description of Artificial Sequence: Synthetic oligonucleotide
ttaaatgccaatgtgctcttgcgaagcctggtg

SEQ ID NO: 110979 - DNA, 32 bp, Artificial Sequence
  Description of Artificial Sequence: Synthetic oligonucleotide
taaatgccaatgtgctcttgcgaagcctggtg

SEQ ID NO: 110980 - DNA, 31 bp, Artificial Sequence
  Description of Artificial Sequence: Synthetic oligonucleotide
aaatgccaatgtgctcttgcgaagcctggtg

SEQ ID NO: 110981 - DNA, 30 bp, Artificial Sequence
  Description of Artificial Sequence: Synthetic oligonucleotide
aatgccaatgtgctcttgcgaagcctggtg

SEQ ID NO: 110982 - DNA, 29 bp, Artificial Sequence
  Description of Artificial Sequence: Synthetic oligonucleotide
atgccaatgtgctcttgcgaagcctggtg

SEQ ID NO: 110983 - DNA, 28 bp, Artificial Sequence
  Description of Artificial Sequence: Synthetic oligonucleotide
tgccaatgtgctcttgcgaagcctggtg

SEQ ID NO: 110984 - DNA, 27 bp, Artificial Sequence
  Description of Artificial Sequence: Synthetic oligonucleotide
gccaatgtgctcttgcgaagcctggtg

SEQ ID NO: 110985 - DNA, 30 bp, Artificial Sequence
  Description of Artificial Sequence: Synthetic oligonucleotide
ccaatgtgctcttgcgaagcctggtgaaag

SEQ ID NO: 110986 - DNA, 31 bp, Artificial Sequence
  Description of Artificial Sequence: Synthetic oligonucleotide
caatgtgctcttgcgaagcctggtgaaagtg

SEQ ID NO: 110987 - DNA, 31 bp, Artificial Sequence
  Description of Artificial Sequence: Synthetic oligonucleotide
aatgtgctcttgcgaagcctggtgaaagtgg

SEQ ID NO: 110988 - DNA, 30 bp, Artificial Sequence
  Description of Artificial Sequence: Synthetic oligonucleotide
atgtgctcttgcgaagcctggtgaaagtgg

SEQ ID NO: 110989 - DNA, 29 bp, Artificial Sequence
  Description of Artificial Sequence: Synthetic oligonucleotide
tgtgctcttgcgaagcctggtgaaagtgg

SEQ ID NO: 110990 - DNA, 28 bp, Artificial Sequence
  Description of Artificial Sequence: Synthetic oligonucleotide
gtgctcttgcgaagcctggtgaaagtgg

SEQ ID NO: 110991 - DNA, 29 bp, Artificial Sequence
  Description of Artificial Sequence: Synthetic oligonucleotide
tgctcttgcgaagcctggtgaaagtggtg

SEQ ID NO: 110992 - DNA, 28 bp, Artificial Sequence
  Description of Artificial Sequence: Synthetic oligonucleotide
gctcttgcgaagcctggtgaaagtggtg

SEQ ID NO: 110993 - DNA, 28 bp, Artificial Sequence
  Description of Artificial Sequence: Synthetic oligonucleotide
ctcttgcgaagcctggtgaaagtggtgg

SEQ ID NO: 110994 - DNA, 28 bp, Artificial Sequence
  Description of Artificial Sequence: Synthetic oligonucleotide
tcttgcgaagcctggtgaaagtggtggg

SEQ ID NO: 110995 - DNA, 27 bp, Artificial Sequence
  Description of Artificial Sequence: Synthetic oligonucleotide
cttgcgaagcctggtgaaagtggtggg

SEQ ID NO: 110996 - DNA, 27 bp, Artificial Sequence
  Description of Artificial Sequence: Synthetic oligonucleotide
ttgcgaagcctggtgaaagtggtgggg

SEQ ID NO: 110997 - DNA, 26 bp, Artificial Sequence
  Description of Artificial Sequence: Synthetic oligonucleotide
tgcgaagcctggtgaaagtggtgggg

SEQ ID NO: 110998 - DNA, 25 bp, Artificial Sequence
  Description of Artificial Sequence: Synthetic oligonucleotide
gcgaagcctggtgaaagtggtgggg

SEQ ID NO: 110999 - DNA, 26 bp, Artificial Sequence
  Description of Artificial Sequence: Synthetic oligonucleotide
cgaagcctggtgaaagtggtggggct

SEQ ID NO: 111000 - DNA, 27 bp, Artificial Sequence
  Description of Artificial Sequence: Synthetic oligonucleotide
gaagcctggtgaaagtggtggggctgt

SEQ ID NO: 111001 - DNA, 29 bp, Artificial Sequence
  Description of Artificial Sequence: Synthetic oligonucleotide
aagcctggtgaaagtggtggggctgtatg

SEQ ID NO: 111002 - DNA, 28 bp, Artificial Sequence
  Description of Artificial Sequence: Synthetic oligonucleotide
agcctggtgaaagtggtggggctgtatg

SEQ ID NO: 111003 - DNA, 27 bp, Artificial Sequence
  Description of Artificial Sequence: Synthetic oligonucleotide
gcctggtgaaagtggtggggctgtatg

SEQ ID NO: 111004 - DNA, 27 bp, Artificial Sequence
  Description of Artificial Sequence: Synthetic oligonucleotide
cctggtgaaagtggtggggctgtatgg

SEQ ID NO: 111005 - DNA, 27 bp, Artificial Sequence
  Description of Artificial Sequence: Synthetic oligonucleotide
ctggtgaaagtggtggggctgtatggc

SEQ ID NO: 111006 - DNA, 29 bp, Artificial Sequence
  Description of Artificial Sequence: Synthetic oligonucleotide
tggtgaaagtggtggggctgtatggcttc

SEQ ID NO: 111007 - DNA, 28 bp, Artificial Sequence
  Description of Artificial Sequence: Synthetic oligonucleotide
ggtgaaagtggtggggctgtatggcttc

SEQ ID NO: 111008 - DNA, 30 bp, Artificial Sequence
  Description of Artificial Sequence: Synthetic oligonucleotide
gtgaaagtggtggggctgtatggcttcatg

SEQ ID NO: 111009 - DNA, 30 bp, Artificial Sequence
  Description of Artificial Sequence: Synthetic oligonucleotide
tgaaagtggtggggctgtatggcttcatgc

SEQ ID NO: 111010 - DNA, 29 bp, Artificial Sequence
  Description of Artificial Sequence: Synthetic oligonucleotide
gaaagtggtggggctgtatggcttcatgc

SEQ ID NO: 111011 - DNA, 30 bp, Artificial Sequence
  Description of Artificial Sequence: Synthetic oligonucleotide
aaagtggtggggctgtatggcttcatgctc

SEQ ID NO: 111012 - DNA, 29 bp, Artificial Sequence
  Description of Artificial Sequence: Synthetic oligonucleotide
aagtggtggggctgtatggcttcatgctc

SEQ ID NO: 111013 - DNA, 28 bp, Artificial Sequence
  Description of Artificial Sequence: Synthetic oligonucleotide
agtggtggggctgtatggcttcatgctc

SEQ ID NO: 111014 - DNA, 27 bp, Artificial Sequence
  Description of Artificial Sequence: Synthetic oligonucleotide
gtggtggggctgtatggcttcatgctc

SEQ ID NO: 111015 - DNA, 28 bp, Artificial Sequence
  Description of Artificial Sequence: Synthetic oligonucleotide
tggtggggctgtatggcttcatgctcag

SEQ ID NO: 111016 - DNA, 27 bp, Artificial Sequence
  Description of Artificial Sequence: Synthetic oligonucleotide
ggtggggctgtatggcttcatgctcag

SEQ ID NO: 111017 - DNA, 27 bp, Artificial Sequence
  Description of Artificial Sequence: Synthetic oligonucleotide
gtggggctgtatggcttcatgctcagc

SEQ ID NO: 111018 - DNA, 31 bp, Artificial Sequence
  Description of Artificial Sequence: Synthetic oligonucleotide
tggggctgtatggcttcatgctcagcatatc

SEQ ID NO: 111019 - DNA, 30 bp, Artificial Sequence
  Description of Artificial Sequence: Synthetic oligonucleotide
ggggctgtatggcttcatgctcagcatatc

SEQ ID NO: 111020 - DNA, 30 bp, Artificial Sequence
  Description of Artificial Sequence: Synthetic oligonucleotide
gggctgtatggcttcatgctcagcatatcg

SEQ ID NO: 111021 - DNA, 30 bp, Artificial Sequence
  Description of Artificial Sequence: Synthetic oligonucleotide
ggctgtatggcttcatgctcagcatatcgc

SEQ ID NO: 111022 - DNA, 30 bp, Artificial Sequence
  Description of Artificial Sequence: Synthetic oligonucleotide
gctgtatggcttcatgctcagcatatcgcc

SEQ ID NO: 111023 - DNA, 31 bp, Artificial Sequence
  Description of Artificial Sequence: Synthetic oligonucleotide
ctgtatggcttcatgctcagcatatcgcctc

SEQ ID NO: 111024 - DNA, 31 bp, Artificial Sequence
  Description of Artificial Sequence: Synthetic oligonucleotide
tgtatggcttcatgctcagcatatcgcctcg

SEQ ID NO: 111025 - DNA, 30 bp, Artificial Sequence
  Description of Artificial Sequence: Synthetic oligonucleotide
gtatggcttcatgctcagcatatcgcctcg

SEQ ID NO: 111026 - DNA, 31 bp, Artificial Sequence
  Description of Artificial Sequence: Synthetic oligonucleotide
tatggcttcatgctcagcatatcgcctcgac

SEQ ID NO: 111027 - DNA, 30 bp, Artificial Sequence
  Description of Artificial Sequence: Synthetic oligonucleotide
atggcttcatgctcagcatatcgcctcgac

SEQ ID NO: 111028 - DNA, 29 bp, Artificial Sequence
  Description of Artificial Sequence: Synthetic oligonucleotide
tggcttcatgctcagcatatcgcctcgac

SEQ ID NO: 111029 - DNA, 28 bp, Artificial Sequence
  Description of Artificial Sequence: Synthetic oligonucleotide
ggcttcatgctcagcatatcgcctcgac

SEQ ID NO: 111030 - DNA, 29 bp, Artificial Sequence
  Description of Artificial Sequence: Synthetic oligonucleotide
gcttcatgctcagcatatcgcctcgactc

SEQ ID NO: 111031 - DNA, 30 bp, Artificial Sequence
  Description of Artificial Sequence: Synthetic oligonucleotide
cttcatgctcagcatatcgcctcgactcac

SEQ ID NO: 111032 - DNA, 30 bp, Artificial Sequence
  Description of Artificial Sequence: Synthetic oligonucleotide
ttcatgctcagcatatcgcctcgactcacc

SEQ ID NO: 111033 - DNA, 29 bp, Artificial Sequence
  Description of Artificial Sequence: Synthetic oligonucleotide
tcatgctcagcatatcgcctcgactcacc

SEQ ID NO: 111034 - DNA, 28 bp, Artificial Sequence
  Description of Artificial Sequence: Synthetic oligonucleotide
catgctcagcatatcgcctcgactcacc

SEQ ID NO: 111035 - DNA, 28 bp, Artificial Sequence
  Description of Artificial Sequence: Synthetic oligonucleotide
atgctcagcatatcgcctcgactcaccc

SEQ ID NO: 111036 - DNA, 27 bp, Artificial Sequence
  Description of Artificial Sequence: Synthetic oligonucleotide
tgctcagcatatcgcctcgactcaccc

SEQ ID NO: 111037 - DNA, 27 bp, Artificial Sequence
  Description of Artificial Sequence: Synthetic oligonucleotide
gctcagcatatcgcctcgactcaccct

SEQ ID NO: 111038 - DNA, 27 bp, Artificial Sequence
  Description of Artificial Sequence: Synthetic oligonucleotide
ctcagcatatcgcctcgactcaccctc

SEQ ID NO: 111039 - DNA, 27 bp, Artificial Sequence
  Description of Artificial Sequence: Synthetic oligonucleotide
tcagcatatcgcctcgactcaccctcc

SEQ ID NO: 111040 - DNA, 27 bp, Artificial Sequence
  Description of Artificial Sequence: Synthetic oligonucleotide
cagcatatcgcctcgactcaccctcct

SEQ ID NO: 111041 - DNA, 29 bp, Artificial Sequence
  Description of Artificial Sequence: Synthetic oligonucleotide
agcatatcgcctcgactcaccctcctttc

SEQ ID NO: 111042 - DNA, 28 bp, Artificial Sequence
  Description of Artificial Sequence: Synthetic oligonucleotide
gcatatcgcctcgactcaccctcctttc

SEQ ID NO: 111043 - DNA, 29 bp, Artificial Sequence
  Description of Artificial Sequence: Synthetic oligonucleotide
catatcgcctcgactcaccctcctttctc

SEQ ID NO: 111044 - DNA, 30 bp, Artificial Sequence
  Description of Artificial Sequence: Synthetic oligonucleotide
atatcgcctcgactcaccctcctttctctg

SEQ ID NO: 111045 - DNA, 29 bp, Artificial Sequence
  Description of Artificial Sequence: Synthetic oligonucleotide
tatcgcctcgactcaccctcctttctctg

SEQ ID NO: 111046 - DNA, 28 bp, Artificial Sequence
  Description of Artificial Sequence: Synthetic oligonucleotide
atcgcctcgactcaccctcctttctctg

SEQ ID NO: 111047 - DNA, 27 bp, Artificial Sequence
  Description of Artificial Sequence: Synthetic oligonucleotide
tcgcctcgactcaccctcctttctctg

SEQ ID NO: 111048 - DNA, 26 bp, Artificial Sequence
  Description of Artificial Sequence: Synthetic oligonucleotide
cgcctcgactcaccctcctttctctg

SEQ ID NO: 111049 - DNA, 27 bp, Artificial Sequence
  Description of Artificial Sequence: Synthetic oligonucleotide
gcctcgactcaccctcctttctctgct

SEQ ID NO: 111050 - DNA, 27 bp, Artificial Sequence
  Description of Artificial Sequence: Synthetic oligonucleotide
cctcgactcaccctcctttctctgctg

SEQ ID NO: 111051 - DNA, 27 bp, Artificial Sequence
  Description of Artificial Sequence: Synthetic oligonucleotide
ctcgactcaccctcctttctctgctgc

SEQ ID NO: 111052 - DNA, 28 bp, Artificial Sequence
  Description of Artificial Sequence: Synthetic oligonucleotide
tcgactcaccctcctttctctgctgcac

SEQ ID NO: 111053 - DNA, 27 bp, Artificial Sequence
  Description of Artificial Sequence: Synthetic oligonucleotide
cgactcaccctcctttctctgctgcac

SEQ ID NO: 111054 - DNA, 29 bp, Artificial Sequence
  Description of Artificial Sequence: Synthetic oligonucleotide
gactcaccctcctttctctgctgcacatg

SEQ ID NO: 111055 - DNA, 29 bp, Artificial Sequence
  Description of Artificial Sequence: Synthetic oligonucleotide
actcaccctcctttctctgctgcacatgc

SEQ ID NO: 111056 - DNA, 28 bp, Artificial Sequence
  Description of Artificial Sequence: Synthetic oligonucleotide
ctcaccctcctttctctgctgcacatgc

SEQ ID NO: 111057 - DNA, 28 bp, Artificial Sequence
  Description of Artificial Sequence: Synthetic oligonucleotide
tcaccctcctttctctgctgcacatgcc

SEQ ID NO: 111058 - DNA, 27 bp, Artificial Sequence
  Description of Artificial Sequence: Synthetic oligonucleotide
caccctcctttctctgctgcacatgcc

SEQ ID NO: 111059 - DNA, 27 bp, Artificial Sequence
  Description of Artificial Sequence: Synthetic oligonucleotide
accctcctttctctgctgcacatgccc

SEQ ID NO: 111060 - DNA, 27 bp, Artificial Sequence
  Description of Artificial Sequence: Synthetic oligonucleotide
ccctcctttctctgctgcacatgccct

SEQ ID NO: 111061 - DNA, 28 bp, Artificial Sequence
  Description of Artificial Sequence: Synthetic oligonucleotide
cctcctttctctgctgcacatgcccttc

SEQ ID NO: 111062 - DNA, 29 bp, Artificial Sequence
  Description of Artificial Sequence: Synthetic oligonucleotide
ctcctttctctgctgcacatgcccttcac

SEQ ID NO: 111063 - DNA, 33 bp, Artificial Sequence
  Description of Artificial Sequence: Synthetic oligonucleotide
tcctttctctgctgcacatgcccttcacaatag

SEQ ID NO: 111064 - DNA, 32 bp, Artificial Sequence
  Description of Artificial Sequence: Synthetic oligonucleotide
cctttctctgctgcacatgcccttcacaatag

SEQ ID NO: 111065 - DNA, 32 bp, Artificial Sequence
  Description of Artificial Sequence: Synthetic oligonucleotide
ctttctctgctgcacatgcccttcacaatagc

SEQ ID NO: 111066 - DNA, 33 bp, Artificial Sequence
  Description of Artificial Sequence: Synthetic oligonucleotide
tttctctgctgcacatgcccttcacaatagcag

SEQ ID NO: 111067 - DNA, 32 bp, Artificial Sequence
  Description of Artificial Sequence: Synthetic oligonucleotide
ttctctgctgcacatgcccttcacaatagcag

SEQ ID NO: 111068 - DNA, 31 bp, Artificial Sequence
  Description of Artificial Sequence: Synthetic oligonucleotide
tctctgctgcacatgcccttcacaatagcag

SEQ ID NO: 111069 - DNA, 30 bp, Artificial Sequence
  Description of Artificial Sequence: Synthetic oligonucleotide
ctctgctgcacatgcccttcacaatagcag

SEQ ID NO: 111070 - DNA, 30 bp, Artificial Sequence
  Description of Artificial Sequence: Synthetic oligonucleotide
tctgctgcacatgcccttcacaatagcagc

SEQ ID NO: 111071 - DNA, 29 bp, Artificial Sequence
  Description of Artificial Sequence: Synthetic oligonucleotide
ctgctgcacatgcccttcacaatagcagc

SEQ ID NO: 111072 - DNA, 29 bp, Artificial Sequence
  Description of Artificial Sequence: Synthetic oligonucleotide
tgctgcacatgcccttcacaatagcagcg

SEQ ID NO: 111073 - DNA, 28 bp, Artificial Sequence
  Description of Artificial Sequence: Synthetic oligonucleotide
gctgcacatgcccttcacaatagcagcg

SEQ ID NO: 111074 - DNA, 28 bp, Artificial Sequence
  Description of Artificial Sequence: Synthetic oligonucleotide
ctgcacatgcccttcacaatagcagcgg

SEQ ID NO: 111075 - DNA, 29 bp, Artificial Sequence
  Description of Artificial Sequence: Synthetic oligonucleotide
tgcacatgcccttcacaatagcagcggag

SEQ ID NO: 111076 - DNA, 28 bp, Artificial Sequence
  Description of Artificial Sequence: Synthetic oligonucleotide
gcacatgcccttcacaatagcagcggag

SEQ ID NO: 111077 - DNA, 30 bp, Artificial Sequence
  Description of Artificial Sequence: Synthetic oligonucleotide
cacatgcccttcacaatagcagcggagaag

SEQ ID NO: 111078 - DNA, 30 bp, Artificial Sequence
  Description of Artificial Sequence: Synthetic oligonucleotide
acatgcccttcacaatagcagcggagaagg

SEQ ID NO: 111079 - DNA, 29 bp, Artificial Sequence
  Description of Artificial Sequence: Synthetic oligonucleotide
catgcccttcacaatagcagcggagaagg

SEQ ID NO: 111080 - DNA, 30 bp, Artificial Sequence
  Description of Artificial Sequence: Synthetic oligonucleotide
atgcccttcacaatagcagcggagaaggtg

SEQ ID NO: 111081 - DNA, 29 bp, Artificial Sequence
  Description of Artificial Sequence: Synthetic oligonucleotide
tgcccttcacaatagcagcggagaaggtg

SEQ ID NO: 111082 - DNA, 28 bp, Artificial Sequence
  Description of Artificial Sequence: Synthetic oligonucleotide
gcccttcacaatagcagcggagaaggtg

SEQ ID NO: 111083 - DNA, 30 bp, Artificial Sequence
  Description of Artificial Sequence: Synthetic oligonucleotide
cccttcacaatagcagcggagaaggtgtac

SEQ ID NO: 111084 - DNA, 32 bp, Artificial Sequence
  Description of Artificial Sequence: Synthetic oligonucleotide
ccttcacaatagcagcggagaaggtgtacaac

SEQ ID NO: 111085 - DNA, 33 bp, Artificial Sequence
  Description of Artificial Sequence: Synthetic oligonucleotide
cttcacaatagcagcggagaaggtgtacaacac

SEQ ID NO: 111086 - DNA, 33 bp, Artificial Sequence
  Description of Artificial Sequence: Synthetic oligonucleotide
ttcacaatagcagcggagaaggtgtacaacacc

SEQ ID NO: 111087 - DNA, 32 bp, Artificial Sequence
  Description of Artificial Sequence: Synthetic oligonucleotide
tcacaatagcagcggagaaggtgtacaacacc

SEQ ID NO: 111088 - DNA, 31 bp, Artificial Sequence
  Description of Artificial Sequence: Synthetic oligonucleotide
cacaatagcagcggagaaggtgtacaacacc

SEQ ID NO: 111089 - DNA, 31 bp, Artificial Sequence
  Description of Artificial Sequence: Synthetic oligonucleotide
acaatagcagcggagaaggtgtacaacaccc

SEQ ID NO: 111090 - DNA, 30 bp, Artificial Sequence
  Description of Artificial Sequence: Synthetic oligonucleotide
caatagcagcggagaaggtgtacaacaccc

SEQ ID NO: 111091 - DNA, 30 bp, Artificial Sequence
  Description of Artificial Sequence: Synthetic oligonucleotide
aatagcagcggagaaggtgtacaacacccg

SEQ ID NO: 111092 - DNA, 29 bp, Artificial Sequence
  Description of Artificial Sequence: Synthetic oligonucleotide
atagcagcggagaaggtgtacaacacccg

SEQ ID NO: 111093 - DNA, 28 bp, Artificial Sequence
  Description of Artificial Sequence: Synthetic oligonucleotide
tagcagcggagaaggtgtacaacacccg

SEQ ID NO: 111094 - DNA, 27 bp, Artificial Sequence
  Description of Artificial Sequence: Synthetic oligonucleotide
agcagcggagaaggtgtacaacacccg

SEQ ID NO: 111095 - DNA, 26 bp, Artificial Sequence
  Description of Artificial Sequence: Synthetic oligonucleotide
gcagcggagaaggtgtacaacacccg

SEQ ID NO: 111096 - DNA, 26 bp, Artificial Sequence
  Description of Artificial Sequence: Synthetic oligonucleotide
cagcggagaaggtgtacaacacccgc

SEQ ID NO: 111097 - DNA, 27 bp, Artificial Sequence
  Description of Artificial Sequence: Synthetic oligonucleotide
agcggagaaggtgtacaacacccgcca

SEQ ID NO: 111098 - DNA, 27 bp, Artificial Sequence
  Description of Artificial Sequence: Synthetic oligonucleotide
gcggagaaggtgtacaacacccgccat

SEQ ID NO: 111099 - DNA, 27 bp, Artificial Sequence
  Description of Artificial Sequence: Synthetic oligonucleotide
cggagaaggtgtacaacacccgccatc

SEQ ID NO: 111100 - DNA, 28 bp, Artificial Sequence
  Description of Artificial Sequence: Synthetic oligonucleotide
ggagaaggtgtacaacacccgccatcag

SEQ ID NO: 111101 - DNA, 28 bp, Artificial Sequence
  Description of Artificial Sequence: Synthetic oligonucleotide
gagaaggtgtacaacacccgccatcagg

SEQ ID NO: 111102 - DNA, 30 bp, Artificial Sequence
  Description of Artificial Sequence: Synthetic oligonucleotide
agaaggtgtacaacacccgccatcaggaag

SEQ ID NO: 111103 - DNA, 29 bp, Artificial Sequence
  Description of Artificial Sequence: Synthetic oligonucleotide
gaaggtgtacaacacccgccatcaggaag

SEQ ID NO: 111104 - DNA, 30 bp, Artificial Sequence
  Description of Artificial Sequence: Synthetic oligonucleotide
aaggtgtacaacacccgccatcaggaagtg

SEQ ID NO: 111105 - DNA, 29 bp, Artificial Sequence
  Description of Artificial Sequence: Synthetic oligonucleotide
aggtgtacaacacccgccatcaggaagtg

SEQ ID NO: 111106 - DNA, 28 bp, Artificial Sequence
  Description of Artificial Sequence: Synthetic oligonucleotide
ggtgtacaacacccgccatcaggaagtg

SEQ ID NO: 111107 - DNA, 28 bp, Artificial Sequence
  Description of Artificial Sequence: Synthetic oligonucleotide
gtgtacaacacccgccatcaggaagtgc

SEQ ID NO: 111108 - DNA, 30 bp, Artificial Sequence
  Description of Artificial Sequence: Synthetic oligonucleotide
tgtacaacacccgccatcaggaagtgcttc

SEQ ID NO: 111109 - DNA, 29 bp, Artificial Sequence
  Description of Artificial Sequence: Synthetic oligonucleotide
gtacaacacccgccatcaggaagtgcttc

SEQ ID NO: 111110 - DNA, 29 bp, Artificial Sequence
  Description of Artificial Sequence: Synthetic oligonucleotide
tacaacacccgccatcaggaagtgcttcg

SEQ ID NO: 111111 - DNA, 28 bp, Artificial Sequence
  Description of Artificial Sequence: Synthetic oligonucleotide
acaacacccgccatcaggaagtgcttcg

SEQ ID NO: 111112 - DNA, 27 bp, Artificial Sequence
  Description of Artificial Sequence: Synthetic oligonucleotide
caacacccgccatcaggaagtgcttcg

SEQ ID NO: 111113 - DNA, 27 bp, Artificial Sequence
  Description of Artificial Sequence: Synthetic oligonucleotide
aacacccgccatcaggaagtgcttcgg

SEQ ID NO: 111114 - DNA, 26 bp, Artificial Sequence
  Description of Artificial Sequence: Synthetic oligonucleotide
acacccgccatcaggaagtgcttcgg

SEQ ID NO: 111115 - DNA, 25 bp, Artificial Sequence
  Description of Artificial Sequence: Synthetic oligonucleotide
cacccgccatcaggaagtgcttcgg

SEQ ID NO: 111116 - DNA, 26 bp, Artificial Sequence
  Description of Artificial Sequence: Synthetic oligonucleotide
acccgccatcaggaagtgcttcggga

SEQ ID NO: 111117 - DNA, 25 bp, Artificial Sequence
  Description of Artificial Sequence: Synthetic oligonucleotide
cccgccatcaggaagtgcttcggga

SEQ ID NO: 111118 - DNA, 27 bp, Artificial Sequence
  Description of Artificial Sequence: Synthetic oligonucleotide
ccgccatcaggaagtgcttcgggagat

SEQ ID NO: 111119 - DNA, 27 bp, Artificial Sequence
  Description of Artificial Sequence: Synthetic oligonucleotide
cgccatcaggaagtgcttcgggagatc

SEQ ID NO: 111120 - DNA, 27 bp, Artificial Sequence
  Description of Artificial Sequence: Synthetic oligonucleotide
gccatcaggaagtgcttcgggagatcc

SEQ ID NO: 111121 - DNA, 28 bp, Artificial Sequence
  Description of Artificial Sequence: Synthetic oligonucleotide
ccatcaggaagtgcttcgggagatccag

SEQ ID NO: 111122 - DNA, 28 bp, Artificial Sequence
  Description of Artificial Sequence: Synthetic oligonucleotide
catcaggaagtgcttcgggagatccagg

SEQ ID NO: 111123 - DNA, 30 bp, Artificial Sequence
  Description of Artificial Sequence: Synthetic oligonucleotide
atcaggaagtgcttcgggagatccaggatg

SEQ ID NO: 111124 - DNA, 29 bp, Artificial Sequence
  Description of Artificial Sequence: Synthetic oligonucleotide
tcaggaagtgcttcgggagatccaggatg

SEQ ID NO: 111125 - DNA, 28 bp, Artificial Sequence
  Description of Artificial Sequence: Synthetic oligonucleotide
caggaagtgcttcgggagatccaggatg

SEQ ID NO: 111126 - DNA, 28 bp, Artificial Sequence
  Description of Artificial Sequence: Synthetic oligonucleotide
aggaagtgcttcgggagatccaggatgc

SEQ ID NO: 111127 - DNA, 27 bp, Artificial Sequence
  Description of Artificial Sequence: Synthetic oligonucleotide
ggaagtgcttcgggagatccaggatgc

SEQ ID NO: 111128 - DNA, 28 bp, Artificial Sequence
  Description of Artificial Sequence: Synthetic oligonucleotide
gaagtgcttcgggagatccaggatgcag

SEQ ID NO: 111129 - DNA, 29 bp, Artificial Sequence
  Description of Artificial Sequence: Synthetic oligonucleotide
aagtgcttcgggagatccaggatgcagtg

SEQ ID NO: 111130 - DNA, 28 bp, Artificial Sequence
  Description of Artificial Sequence: Synthetic oligonucleotide
agtgcttcgggagatccaggatgcagtg

SEQ ID NO: 111131 - DNA, 27 bp, Artificial Sequence
  Description of Artificial Sequence: Synthetic oligonucleotide
gtgcttcgggagatccaggatgcagtg

SEQ ID NO: 111132 - DNA, 27 bp, Artificial Sequence
  Description of Artificial Sequence: Synthetic oligonucleotide
tgcttcgggagatccaggatgcagtgg

SEQ ID NO: 111133 - DNA, 26 bp, Artificial Sequence
  Description of Artificial Sequence: Synthetic oligonucleotide
gcttcgggagatccaggatgcagtgg

SEQ ID NO: 111134 - DNA, 26 bp, Artificial Sequence
  Description of Artificial Sequence: Synthetic oligonucleotide
cttcgggagatccaggatgcagtggc

SEQ ID NO: 111135 - DNA, 27 bp, Artificial Sequence
  Description of Artificial Sequence: Synthetic oligonucleotide
ttcgggagatccaggatgcagtggcca

SEQ ID NO: 111136 - DNA, 26 bp, Artificial Sequence
  Description of Artificial Sequence: Synthetic oligonucleotide
tcgggagatccaggatgcagtggcca

SEQ ID NO: 111137 - DNA, 25 bp, Artificial Sequence
  Description of Artificial Sequence: Synthetic oligonucleotide
cgggagatccaggatgcagtggcca

SEQ ID NO: 111138 - DNA, 25 bp, Artificial Sequence
  Description of Artificial Sequence: Synthetic oligonucleotide
gggagatccaggatgcagtggccag

SEQ ID NO: 111139 - DNA, 25 bp, Artificial Sequence
  Description of Artificial Sequence: Synthetic oligonucleotide
ggagatccaggatgcagtggccagg

SEQ ID NO: 111140 - DNA, 25 bp, Artificial Sequence
  Description of Artificial Sequence: Synthetic oligonucleotide
gagatccaggatgcagtggccaggg

SEQ ID NO: 111141 - DNA, 25 bp, Artificial Sequence
  Description of Artificial Sequence: Synthetic oligonucleotide
agatccaggatgcagtggccagggc

SEQ ID NO: 111142 - DNA, 24 bp, Artificial Sequence
  Description of Artificial Sequence: Synthetic oligonucleotide
gatccaggatgcagtggccagggc

SEQ ID NO: 111143 - DNA, 24 bp, Artificial Sequence
  Description of Artificial Sequence: Synthetic oligonucleotide
atccaggatgcagtggccagggcg

SEQ ID NO: 111144 - DNA, 23 bp, Artificial Sequence
  Description of Artificial Sequence: Synthetic oligonucleotide
tccaggatgcagtggccagggcg

SEQ ID NO: 111145 - DNA, 22 bp, Artificial Sequence
  Description of Artificial Sequence: Synthetic oligonucleotide
ccaggatgcagtggccagggcg

SEQ ID NO: 111146 - DNA, 22 bp, Artificial Sequence
  Description of Artificial Sequence: Synthetic oligonucleotide
caggatgcagtggccagggcgg

SEQ ID NO: 111147 - DNA, 22 bp, Artificial Sequence
  Description of Artificial Sequence: Synthetic oligonucleotide
aggatgcagtggccagggcggg

SEQ ID NO: 111148 - DNA, 21 bp, Artificial Sequence
  Description of Artificial Sequence: Synthetic oligonucleotide
ggatgcagtggccagggcggg

SEQ ID NO: 111149 - DNA, 21 bp, Artificial Sequence
  Description of Artificial Sequence: Synthetic oligonucleotide
gatgcagtggccagggcgggg

SEQ ID NO: 111150 - DNA, 22 bp, Artificial Sequence
  Description of Artificial Sequence: Synthetic oligonucleotide
atgcagtggccagggcggggca

SEQ ID NO: 111151 - DNA, 21 bp, Artificial Sequence
  Description of Artificial Sequence: Synthetic oligonucleotide
tgcagtggccagggcggggca

SEQ ID NO: 111152 - DNA, 20 bp, Artificial Sequence
  Description of Artificial Sequence: Synthetic oligonucleotide
gcagtggccagggcggggca

SEQ ID NO: 111153 - DNA, 20 bp, Artificial Sequence
  Description of Artificial Sequence: Synthetic oligonucleotide
cagtggccagggcggggcag

SEQ ID NO: 111154 - DNA, 21 bp, Artificial Sequence
  Description of Artificial Sequence: Synthetic oligonucleotide
agtggccagggcggggcaggt

SEQ ID NO: 111155 - DNA, 20 bp, Artificial Sequence
  Description of Artificial Sequence: Synthetic oligonucleotide
gtggccagggcggggcaggt

SEQ ID NO: 111156 - DNA, 20 bp, Artificial Sequence
  Description of Artificial Sequence: Synthetic oligonucleotide
tggccagggcggggcaggtg

SEQ ID NO: 111157 - DNA, 20 bp, Artificial Sequence
  Description of Artificial Sequence: Synthetic oligonucleotide
ggccagggcggggcaggtgt

SEQ ID NO: 111158 - DNA, 20 bp, Artificial Sequence
  Description of Artificial Sequence: Synthetic oligonucleotide
gccagggcggggcaggtggt

SEQ ID NO: 111159 - DNA, 20 bp, Artificial Sequence
  Description of Artificial Sequence: Synthetic oligonucleotide
ccagggcggggcaggtggtg

SEQ ID NO: 111160 - DNA, 20 bp, Artificial Sequence
  Description of Artificial Sequence: Synthetic oligonucleotide
cagggcggggcaggtggtgc

SEQ ID NO: 111161 - DNA, 20 bp, Artificial Sequence
  Description of Artificial Sequence: Synthetic oligonucleotide
agggcggggcaggtggtgcg

SEQ ID NO: 111162 - DNA, 20 bp, Artificial Sequence
  Description of Artificial Sequence: Synthetic oligonucleotide
gggcggggcaggtggtgcgt

SEQ ID NO: 111163 - DNA, 20 bp, Artificial Sequence
  Description of Artificial Sequence: Synthetic oligonucleotide
ggcggggcaggtggtgcggt

SEQ ID NO: 111164 - DNA, 21 bp, Artificial Sequence
  Description of Artificial Sequence: Synthetic oligonucleotide
gcggggcaggtggtgcgggaa

SEQ ID NO: 111165 - DNA, 21 bp, Artificial Sequence
  Description of Artificial Sequence: Synthetic oligonucleotide
cggggcaggtggtgcgggaag

SEQ ID NO: 111166 - DNA, 21 bp, Artificial Sequence
  Description of Artificial Sequence: Synthetic oligonucleotide
ggggcaggtggtgcgggaagc

SEQ ID NO: 111167 - DNA, 21 bp, Artificial Sequence
  Description of Artificial Sequence: Synthetic oligonucleotide
gggcaggtggtgcgggaagcc

SEQ ID NO: 111168 - DNA, 23 bp, Artificial Sequence
  Description of Artificial Sequence: Synthetic oligonucleotide
ggcaggtggtgcgggaagccgtt

SEQ ID NO: 111169 - DNA, 23 bp, Artificial Sequence
  Description of Artificial Sequence: Synthetic oligonucleotide
gcaggtggtgcgggaagccgttg

SEQ ID NO: 111170 - DNA, 24 bp, Artificial Sequence
  Description of Artificial Sequence: Synthetic oligonucleotide
caggtggtgcgggaagccgttgga

SEQ ID NO: 111171 - DNA, 24 bp, Artificial Sequence
  Description of Artificial Sequence: Synthetic oligonucleotide
aggtggtgcgggaagccgttggag

SEQ ID NO: 111172 - DNA, 23 bp, Artificial Sequence
  Description of Artificial Sequence: Synthetic oligonucleotide
ggtggtgcgggaagccgttggag

SEQ ID NO: 111173 - DNA, 23 bp, Artificial Sequence
  Description of Artificial Sequence: Synthetic oligonucleotide
gtggtgcgggaagccgttggagg

SEQ ID NO: 111174 - DNA, 23 bp, Artificial Sequence
  Description of Artificial Sequence: Synthetic oligonucleotide
tggtgcgggaagccgttggaggg

SEQ ID NO: 111175 - DNA, 22 bp, Artificial Sequence
  Description of Artificial Sequence: Synthetic oligonucleotide
ggtgcgggaagccgttggaggg

SEQ ID NO: 111176 - DNA, 23 bp, Artificial Sequence
  Description of Artificial Sequence: Synthetic oligonucleotide
gtgcgggaagccgttggagggct

SEQ ID NO: 111177 - DNA, 23 bp, Artificial Sequence
  Description of Artificial Sequence: Synthetic oligonucleotide
tgcgggaagccgttggagggctg

SEQ ID NO: 111178 - DNA, 22 bp, Artificial Sequence
  Description of Artificial Sequence: Synthetic oligonucleotide
gcgggaagccgttggagggctg

SEQ ID NO: 111179 - DNA, 23 bp, Artificial Sequence
  Description of Artificial Sequence: Synthetic oligonucleotide
cgggaagccgttggagggctgca

SEQ ID NO: 111180 - DNA, 24 bp, Artificial Sequence
  Description of Artificial Sequence: Synthetic oligonucleotide
gggaagccgttggagggctgcaga

SEQ ID NO: 111181 - DNA, 24 bp, Artificial Sequence
  Description of Artificial Sequence: Synthetic oligonucleotide
ggaagccgttggagggctgcagac

SEQ ID NO: 111182 - DNA, 24 bp, Artificial Sequence
  Description of Artificial Sequence: Synthetic oligonucleotide
gaagccgttggagggctgcagacc

SEQ ID NO: 111183 - DNA, 26 bp, Artificial Sequence
  Description of Artificial Sequence: Synthetic oligonucleotide
aagccgttggagggctgcagaccgtt

SEQ ID NO: 111184 - DNA, 25 bp, Artificial Sequence
  Description of Artificial Sequence: Synthetic oligonucleotide
agccgttggagggctgcagaccgtt

SEQ ID NO: 111185 - DNA, 24 bp, Artificial Sequence
  Description of Artificial Sequence: Synthetic oligonucleotide
gccgttggagggctgcagaccgtt

SEQ ID NO: 111186 - DNA, 24 bp, Artificial Sequence
  Description of Artificial Sequence: Synthetic oligonucleotide
ccgttggagggctgcagaccgttc

SEQ ID NO: 111187 - DNA, 24 bp, Artificial Sequence
  Description of Artificial Sequence: Synthetic oligonucleotide
cgttggagggctgcagaccgttcg

SEQ ID NO: 111188 - DNA, 25 bp, Artificial Sequence
  Description of Artificial Sequence: Synthetic oligonucleotide
gttggagggctgcagaccgttcgca

SEQ ID NO: 111189 - DNA, 27 bp, Artificial Sequence
  Description of Artificial Sequence: Synthetic oligonucleotide
ttggagggctgcagaccgttcgcagtt

SEQ ID NO: 111190 - DNA, 27 bp, Artificial Sequence
  Description of Artificial Sequence: Synthetic oligonucleotide
tggagggctgcagaccgttcgcagttt

SEQ ID NO: 111191 - DNA, 27 bp, Artificial Sequence
  Description of Artificial Sequence: Synthetic oligonucleotide
ggagggctgcagaccgttcgcagtttt

SEQ ID NO: 111192 - DNA, 27 bp, Artificial Sequence
  Description of Artificial Sequence: Synthetic oligonucleotide
gagggctgcagaccgttcgcagttttg

SEQ ID NO: 111193 - DNA, 27 bp, Artificial Sequence
  Description of Artificial Sequence: Synthetic oligonucleotide
agggctgcagaccgttcgcagttttgg

SEQ ID NO: 111194 - DNA, 26 bp, Artificial Sequence
  Description of Artificial Sequence: Synthetic oligonucleotide
gggctgcagaccgttcgcagttttgg

SEQ ID NO: 111195 - DNA, 26 bp, Artificial Sequence
  Description of Artificial Sequence: Synthetic oligonucleotide
ggctgcagaccgttcgcagttttggg

SEQ ID NO: 111196 - DNA, 26 bp, Artificial Sequence
  Description of Artificial Sequence: Synthetic oligonucleotide
gctgcagaccgttcgcagttttgggg

SEQ ID NO: 111197 - DNA, 26 bp, Artificial Sequence
  Description of Artificial Sequence: Synthetic oligonucleotide
ctgcagaccgttcgcagttttggggc

SEQ ID NO: 111198 - DNA, 26 bp, Artificial Sequence
  Description of Artificial Sequence: Synthetic oligonucleotide
tgcagaccgttcgcagttttggggcc

SEQ ID NO: 111199 - DNA, 25 bp, Artificial Sequence
  Description of Artificial Sequence: Synthetic oligonucleotide
gcagaccgttcgcagttttggggcc

SEQ ID NO: 111200 - DNA, 26 bp, Artificial Sequence
  Description of Artificial Sequence: Synthetic oligonucleotide
cagaccgttcgcagttttggggccga

SEQ ID NO: 111201 - DNA, 26 bp, Artificial Sequence
  Description of Artificial Sequence: Synthetic oligonucleotide
agaccgttcgcagttttggggccgag

SEQ ID NO: 111202 - DNA, 25 bp, Artificial Sequence
  Description of Artificial Sequence: Synthetic oligonucleotide
gaccgttcgcagttttggggccgag

SEQ ID NO: 111203 - DNA, 26 bp, Artificial Sequence
  Description of Artificial Sequence: Synthetic oligonucleotide
accgttcgcagttttggggccgagga

SEQ ID NO: 111204 - DNA, 25 bp, Artificial Sequence
  Description of Artificial Sequence: Synthetic oligonucleotide
ccgttcgcagttttggggccgagga

SEQ ID NO: 111205 - DNA, 25 bp, Artificial Sequence
  Description of Artificial Sequence: Synthetic oligonucleotide
cgttcgcagttttggggccgaggag

SEQ ID NO: 111206 - DNA, 27 bp, Artificial Sequence
  Description of Artificial Sequence: Synthetic oligonucleotide
gttcgcagttttggggccgaggagcat

SEQ ID NO: 111207 - DNA, 27 bp, Artificial Sequence
  Description of Artificial Sequence: Synthetic oligonucleotide
ttcgcagttttggggccgaggagcatg

SEQ ID NO: 111208 - DNA, 27 bp, Artificial Sequence
  Description of Artificial Sequence: Synthetic oligonucleotide
tcgcagttttggggccgaggagcatga

SEQ ID NO: 111209 - DNA, 27 bp, Artificial Sequence
  Description of Artificial Sequence: Synthetic oligonucleotide
cgcagttttggggccgaggagcatgaa

SEQ ID NO: 111210 - DNA, 27 bp, Artificial Sequence
  Description of Artificial Sequence: Synthetic oligonucleotide
gcagttttggggccgaggagcatgaag

SEQ ID NO: 111211 - DNA, 28 bp, Artificial Sequence
  Description of Artificial Sequence: Synthetic oligonucleotide
cagttttggggccgaggagcatgaagtc

SEQ ID NO: 111212 - DNA, 29 bp, Artificial Sequence
  Description of Artificial Sequence: Synthetic oligonucleotide
agttttggggccgaggagcatgaagtctg

SEQ ID NO: 111213 - DNA, 28 bp, Artificial Sequence
  Description of Artificial Sequence: Synthetic oligonucleotide
gttttggggccgaggagcatgaagtctg

SEQ ID NO: 111214 - DNA, 29 bp, Artificial Sequence
  Description of Artificial Sequence: Synthetic oligonucleotide
ttttggggccgaggagcatgaagtctgtc

SEQ ID NO: 111215 - DNA, 28 bp, Artificial Sequence
  Description of Artificial Sequence: Synthetic oligonucleotide
tttggggccgaggagcatgaagtctgtc

SEQ ID NO: 111216 - DNA, 27 bp, Artificial Sequence
  Description of Artificial Sequence: Synthetic oligonucleotide
ttggggccgaggagcatgaagtctgtc

SEQ ID NO: 111217 - DNA, 26 bp, Artificial Sequence
  Description of Artificial Sequence: Synthetic oligonucleotide
tggggccgaggagcatgaagtctgtc

SEQ ID NO: 111218 - DNA, 25 bp, Artificial Sequence
  Description of Artificial Sequence: Synthetic oligonucleotide
ggggccgaggagcatgaagtctgtc

SEQ ID NO: 111219 - DNA, 25 bp, Artificial Sequence
  Description of Artificial Sequence: Synthetic oligonucleotide
gggccgaggagcatgaagtctgtcg

SEQ ID NO: 111220 - DNA, 27 bp, Artificial Sequence
  Description of Artificial Sequence: Synthetic oligonucleotide
ggccgaggagcatgaagtctgtcgcta

SEQ ID NO: 111221 - DNA, 31 bp, Artificial Sequence
  Description of Artificial Sequence: Synthetic oligonucleotide
gccgaggagcatgaagtctgtcgctataaag

SEQ ID NO: 111222 - DNA, 32 bp, Artificial Sequence
  Description of Artificial Sequence: Synthetic oligonucleotide
ccgaggagcatgaagtctgtcgctataaagag

SEQ ID NO: 111223 - DNA, 32 bp, Artificial Sequence
  Description of Artificial Sequence: Synthetic oligonucleotide
cgaggagcatgaagtctgtcgctataaagagg

SEQ ID NO: 111224 - DNA, 32 bp, Artificial Sequence
  Description of Artificial Sequence: Synthetic oligonucleotide
gaggagcatgaagtctgtcgctataaagaggc

SEQ ID NO: 111225 - DNA, 32 bp, Artificial Sequence
  Description of Artificial Sequence: Synthetic oligonucleotide
aggagcatgaagtctgtcgctataaagaggcc

SEQ ID NO: 111226 - DNA, 31 bp, Artificial Sequence
  Description of Artificial Sequence: Synthetic oligonucleotide
ggagcatgaagtctgtcgctataaagaggcc

SEQ ID NO: 111227 - DNA, 31 bp, Artificial Sequence
  Description of Artificial Sequence: Synthetic oligonucleotide
gagcatgaagtctgtcgctataaagaggccc

SEQ ID NO: 111228 - DNA, 33 bp, Artificial Sequence
  Description of Artificial Sequence: Synthetic oligonucleotide
agcatgaagtctgtcgctataaagaggcccttg

SEQ ID NO: 111229 - DNA, 32 bp, Artificial Sequence
  Description of Artificial Sequence: Synthetic oligonucleotide
gcatgaagtctgtcgctataaagaggcccttg

SEQ ID NO: 111230 - DNA, 34 bp, Artificial Sequence
  Description of Artificial Sequence: Synthetic oligonucleotide
catgaagtctgtcgctataaagaggcccttgaac

SEQ ID NO: 111231 - DNA, 37 bp, Artificial Sequence
  Description of Artificial Sequence: Synthetic oligonucleotide
atgaagtctgtcgctataaagaggcccttgaacaatg

SEQ ID NO: 111232 - DNA, 36 bp, Artificial Sequence
  Description of Artificial Sequence: Synthetic oligonucleotide
tgaagtctgtcgctataaagaggcccttgaacaatg

SEQ ID NO: 111233 - DNA, 35 bp, Artificial Sequence
  Description of Artificial Sequence: Synthetic oligonucleotide
gaagtctgtcgctataaagaggcccttgaacaatg

SEQ ID NO: 111234 - DNA, 36 bp, Artificial Sequence
  Description of Artificial Sequence: Synthetic oligonucleotide
aagtctgtcgctataaagaggcccttgaacaatgtc

SEQ ID NO: 111235 - DNA, 35 bp, Artificial Sequence
  Description of Artificial Sequence: Synthetic oligonucleotide
agtctgtcgctataaagaggcccttgaacaatgtc

SEQ ID NO: 111236 - DNA, 34 bp, Artificial Sequence
  Description of Artificial Sequence: Synthetic oligonucleotide
gtctgtcgctataaagaggcccttgaacaatgtc

SEQ ID NO: 111237 - DNA, 34 bp, Artificial Sequence
  Description of Artificial Sequence: Synthetic oligonucleotide
tctgtcgctataaagaggcccttgaacaatgtcg

SEQ ID NO: 111238 - DNA, 33 bp, Artificial Sequence
  Description of Artificial Sequence: Synthetic oligonucleotide
ctgtcgctataaagaggcccttgaacaatgtcg

SEQ ID NO: 111239 - DNA, 33 bp, Artificial Sequence
  Description of Artificial Sequence: Synthetic oligonucleotide
tgtcgctataaagaggcccttgaacaatgtcgg

SEQ ID NO: 111240 - DNA, 32 bp, Artificial Sequence
  Description of Artificial Sequence: Synthetic oligonucleotide
gtcgctataaagaggcccttgaacaatgtcgg

SEQ ID NO: 111241 - DNA, 32 bp, Artificial Sequence
  Description of Artificial Sequence: Synthetic oligonucleotide
tcgctataaagaggcccttgaacaatgtcggc

SEQ ID NO: 111242 - DNA, 31 bp, Artificial Sequence
  Description of Artificial Sequence: Synthetic oligonucleotide
cgctataaagaggcccttgaacaatgtcggc

SEQ ID NO: 111243 - DNA, 32 bp, Artificial Sequence
  Description of Artificial Sequence: Synthetic oligonucleotide
gctataaagaggcccttgaacaatgtcggcag

SEQ ID NO: 111244 - DNA, 32 bp, Artificial Sequence
  Description of Artificial Sequence: Synthetic oligonucleotide
ctataaagaggcccttgaacaatgtcggcagc

SEQ ID NO: 111245 - DNA, 33 bp, Artificial Sequence
  Description of Artificial Sequence: Synthetic oligonucleotide
tataaagaggcccttgaacaatgtcggcagctg

SEQ ID NO: 111246 - DNA, 32 bp, Artificial Sequence
  Description of Artificial Sequence: Synthetic oligonucleotide
ataaagaggcccttgaacaatgtcggcagctg

SEQ ID NO: 111247 - DNA, 31 bp, Artificial Sequence
  Description of Artificial Sequence: Synthetic oligonucleotide
taaagaggcccttgaacaatgtcggcagctg

SEQ ID NO: 111248 - DNA, 30 bp, Artificial Sequence
  Description of Artificial Sequence: Synthetic oligonucleotide
aaagaggcccttgaacaatgtcggcagctg

SEQ ID NO: 111249 - DNA, 29 bp, Artificial Sequence
  Description of Artificial Sequence: Synthetic oligonucleotide
aagaggcccttgaacaatgtcggcagctg

SEQ ID NO: 111250 - DNA, 28 bp, Artificial Sequence
  Description of Artificial Sequence: Synthetic oligonucleotide
agaggcccttgaacaatgtcggcagctg

SEQ ID NO: 111251 - DNA, 27 bp, Artificial Sequence
  Description of Artificial Sequence: Synthetic oligonucleotide
gaggcccttgaacaatgtcggcagctg

SEQ ID NO: 111252 - DNA, 31 bp, Artificial Sequence
  Description of Artificial Sequence: Synthetic oligonucleotide
aggcccttgaacaatgtcggcagctgtattg

SEQ ID NO: 111253 - DNA, 30 bp, Artificial Sequence
  Description of Artificial Sequence: Synthetic oligonucleotide
ggcccttgaacaatgtcggcagctgtattg

SEQ ID NO: 111254 - DNA, 30 bp, Artificial Sequence
  Description of Artificial Sequence: Synthetic oligonucleotide
gcccttgaacaatgtcggcagctgtattgg

SEQ ID NO: 111255 - DNA, 30 bp, Artificial Sequence
  Description of Artificial Sequence: Synthetic oligonucleotide
cccttgaacaatgtcggcagctgtattggc

SEQ ID NO: 111256 - DNA, 30 bp, Artificial Sequence
  Description of Artificial Sequence: Synthetic oligonucleotide
ccttgaacaatgtcggcagctgtattggcg

SEQ ID NO: 111257 - DNA, 30 bp, Artificial Sequence
  Description of Artificial Sequence: Synthetic oligonucleotide
cttgaacaatgtcggcagctgtattggcgg

SEQ ID NO: 111258 - DNA, 31 bp, Artificial Sequence
  Description of Artificial Sequence: Synthetic oligonucleotide
ttgaacaatgtcggcagctgtattggcggag

SEQ ID NO: 111259 - DNA, 30 bp, Artificial Sequence
  Description of Artificial Sequence: Synthetic oligonucleotide
tgaacaatgtcggcagctgtattggcggag

SEQ ID NO: 111260 - DNA, 29 bp, Artificial Sequence
  Description of Artificial Sequence: Synthetic oligonucleotide
gaacaatgtcggcagctgtattggcggag

SEQ ID NO: 111261 - DNA, 30 bp, Artificial Sequence
  Description of Artificial Sequence: Synthetic oligonucleotide
aacaatgtcggcagctgtattggcggagag

SEQ ID NO: 111262 - DNA, 29 bp, Artificial Sequence
  Description of Artificial Sequence: Synthetic oligonucleotide
acaatgtcggcagctgtattggcggagag

SEQ ID NO: 111263 - DNA, 28 bp, Artificial Sequence
  Description of Artificial Sequence: Synthetic oligonucleotide
caatgtcggcagctgtattggcggagag

SEQ ID NO: 111264 - DNA, 29 bp, Artificial Sequence
  Description of Artificial Sequence: Synthetic oligonucleotide
aatgtcggcagctgtattggcggagagac

SEQ ID NO: 111265 - DNA, 28 bp, Artificial Sequence
  Description of Artificial Sequence: Synthetic oligonucleotide
atgtcggcagctgtattggcggagagac

SEQ ID NO: 111266 - DNA, 27 bp, Artificial Sequence
  Description of Artificial Sequence: Synthetic oligonucleotide
tgtcggcagctgtattggcggagagac

SEQ ID NO: 111267 - DNA, 26 bp, Artificial Sequence
  Description of Artificial Sequence: Synthetic oligonucleotide
gtcggcagctgtattggcggagagac

SEQ ID NO: 111268 - DNA, 27 bp, Artificial Sequence
  Description of Artificial Sequence: Synthetic oligonucleotide
tcggcagctgtattggcggagagacct

SEQ ID NO: 111269 - DNA, 26 bp, Artificial Sequence
  Description of Artificial Sequence: Synthetic oligonucleotide
cggcagctgtattggcggagagacct

SEQ ID NO: 111270 - DNA, 26 bp, Artificial Sequence
  Description of Artificial Sequence: Synthetic oligonucleotide
ggcagctgtattggcggagagacctg

SEQ ID NO: 111271 - DNA, 27 bp, Artificial Sequence
  Description of Artificial Sequence: Synthetic oligonucleotide
gcagctgtattggcggagagacctgga

SEQ ID NO: 111272 - DNA, 28 bp, Artificial Sequence
  Description of Artificial Sequence: Synthetic oligonucleotide
cagctgtattggcggagagacctggaac

SEQ ID NO: 111273 - DNA, 28 bp, Artificial Sequence
  Description of Artificial Sequence: Synthetic oligonucleotide
agctgtattggcggagagacctggaacg

SEQ ID NO: 111274 - DNA, 27 bp, Artificial Sequence
  Description of Artificial Sequence: Synthetic oligonucleotide
gctgtattggcggagagacctggaacg

SEQ ID NO: 111275 - DNA, 27 bp, Artificial Sequence
  Description of Artificial Sequence: Synthetic oligonucleotide
ctgtattggcggagagacctggaacgc

SEQ ID NO: 111276 - DNA, 27 bp, Artificial Sequence
  Description of Artificial Sequence: Synthetic oligonucleotide
tgtattggcggagagacctggaacgcg

SEQ ID NO: 111277 - DNA, 26 bp, Artificial Sequence
  Description of Artificial Sequence: Synthetic oligonucleotide
gtattggcggagagacctggaacgcg

SEQ ID NO: 111278 - DNA, 26 bp, Artificial Sequence
  Description of Artificial Sequence: Synthetic oligonucleotide
tattggcggagagacctggaacgcgc

SEQ ID NO: 111279 - DNA, 25 bp, Artificial Sequence
  Description of Artificial Sequence: Synthetic oligonucleotide
attggcggagagacctggaacgcgc

SEQ ID NO: 111280 - DNA, 24 bp, Artificial Sequence
  Description of Artificial Sequence: Synthetic oligonucleotide
ttggcggagagacctggaacgcgc

SEQ ID NO: 111281 - DNA, 23 bp, Artificial Sequence
  Description of Artificial Sequence: Synthetic oligonucleotide
tggcggagagacctggaacgcgc

SEQ ID NO: 111282 - DNA, 22 bp, Artificial Sequence
  Description of Artificial Sequence: Synthetic oligonucleotide
ggcggagagacctggaacgcgc

SEQ ID NO: 111283 - DNA, 24 bp, Artificial Sequence
  Description of Artificial Sequence: Synthetic oligonucleotide
gcggagagacctggaacgcgcctt

SEQ ID NO: 111284 - DNA, 26 bp, Artificial Sequence
  Description of Artificial Sequence: Synthetic oligonucleotide
cggagagacctggaacgcgccttgta

SEQ ID NO: 111285 - DNA, 26 bp, Artificial Sequence
  Description of Artificial Sequence: Synthetic oligonucleotide
ggagagacctggaacgcgccttgtac

SEQ ID NO: 111286 - DNA, 27 bp, Artificial Sequence
  Description of Artificial Sequence: Synthetic oligonucleotide
gagagacctggaacgcgccttgtacct

SEQ ID NO: 111287 - DNA, 27 bp, Artificial Sequence
  Description of Artificial Sequence: Synthetic oligonucleotide
agagacctggaacgcgccttgtacctg

SEQ ID NO: 111288 - DNA, 26 bp, Artificial Sequence
  Description of Artificial Sequence: Synthetic oligonucleotide
gagacctggaacgcgccttgtacctg

SEQ ID NO: 111289 - DNA, 27 bp, Artificial Sequence
  Description of Artificial Sequence: Synthetic oligonucleotide
agacctggaacgcgccttgtacctgct

SEQ ID NO: 111290 - DNA, 26 bp, Artificial Sequence
  Description of Artificial Sequence: Synthetic oligonucleotide
gacctggaacgcgccttgtacctgct

SEQ ID NO: 111291 - DNA, 26 bp, Artificial Sequence
  Description of Artificial Sequence: Synthetic oligonucleotide
acctggaacgcgccttgtacctgctc

SEQ ID NO: 111292 - DNA, 25 bp, Artificial Sequence
  Description of Artificial Sequence: Synthetic oligonucleotide
cctggaacgcgccttgtacctgctc

SEQ ID NO: 111293 - DNA, 27 bp, Artificial Sequence
  Description of Artificial Sequence: Synthetic oligonucleotide
ctggaacgcgccttgtacctgctcgta

SEQ ID NO: 111294 - DNA, 28 bp, Artificial Sequence
  Description of Artificial Sequence: Synthetic oligonucleotide
tggaacgcgccttgtacctgctcgtaag

SEQ ID NO: 111295 - DNA, 27 bp, Artificial Sequence
  Description of Artificial Sequence: Synthetic oligonucleotide
ggaacgcgccttgtacctgctcgtaag

SEQ ID NO: 111296 - DNA, 27 bp, Artificial Sequence
  Description of Artificial Sequence: Synthetic oligonucleotide
gaacgcgccttgtacctgctcgtaagg

SEQ ID NO: 111297 - DNA, 28 bp, Artificial Sequence
  Description of Artificial Sequence: Synthetic oligonucleotide
aacgcgccttgtacctgctcgtaaggag

SEQ ID NO: 111298 - DNA, 27 bp, Artificial Sequence
  Description of Artificial Sequence: Synthetic oligonucleotide
acgcgccttgtacctgctcgtaaggag

SEQ ID NO: 111299 - DNA, 26 bp, Artificial Sequence
  Description of Artificial Sequence: Synthetic oligonucleotide
cgcgccttgtacctgctcgtaaggag

SEQ ID NO: 111300 - DNA, 26 bp, Artificial Sequence
  Description of Artificial Sequence: Synthetic oligonucleotide
gcgccttgtacctgctcgtaaggagg

SEQ ID NO: 111301 - DNA, 27 bp, Artificial Sequence
  Description of Artificial Sequence: Synthetic oligonucleotide
cgccttgtacctgctcgtaaggagggt

SEQ ID NO: 111302 - DNA, 27 bp, Artificial Sequence
  Description of Artificial Sequence: Synthetic oligonucleotide
gccttgtacctgctcgtaaggagggtg

SEQ ID NO: 111303 - DNA, 27 bp, Artificial Sequence
  Description of Artificial Sequence: Synthetic oligonucleotide
ccttgtacctgctcgtaaggagggtgc

SEQ ID NO: 111304 - DNA, 28 bp, Artificial Sequence
  Description of Artificial Sequence: Synthetic oligonucleotide
cttgtacctgctcgtaaggagggtgctg

SEQ ID NO: 111305 - DNA, 28 bp, Artificial Sequence
  Description of Artificial Sequence: Synthetic oligonucleotide
ttgtacctgctcgtaaggagggtgctgc

SEQ ID NO: 111306 - DNA, 27 bp, Artificial Sequence
  Description of Artificial Sequence: Synthetic oligonucleotide
tgtacctgctcgtaaggagggtgctgc

SEQ ID NO: 111307 - DNA, 27 bp, Artificial Sequence
  Description of Artificial Sequence: Synthetic oligonucleotide
gtacctgctcgtaaggagggtgctgca

SEQ ID NO: 111308 - DNA, 27 bp, Artificial Sequence
  Description of Artificial Sequence: Synthetic oligonucleotide
tacctgctcgtaaggagggtgctgcac

SEQ ID NO: 111309 - DNA, 27 bp, Artificial Sequence
  Description of Artificial Sequence: Synthetic oligonucleotide
acctgctcgtaaggagggtgctgcact

SEQ ID NO: 111310 - DNA, 27 bp, Artificial Sequence
  Description of Artificial Sequence: Synthetic oligonucleotide
cctgctcgtaaggagggtgctgcactt

SEQ ID NO: 111311 - DNA, 27 bp, Artificial Sequence
  Description of Artificial Sequence: Synthetic oligonucleotide
ctgctcgtaaggagggtgctgcacttg

SEQ ID NO: 111312 - DNA, 27 bp, Artificial Sequence
  Description of Artificial Sequence: Synthetic oligonucleotide
tgctcgtaaggagggtgctgcacttgg

SEQ ID NO: 111313 - DNA, 26 bp, Artificial Sequence
  Description of Artificial Sequence: Synthetic oligonucleotide
gctcgtaaggagggtgctgcacttgg

SEQ ID NO: 111314 - DNA, 26 bp, Artificial Sequence
  Description of Artificial Sequence: Synthetic oligonucleotide
ctcgtaaggagggtgctgcacttggg

SEQ ID NO: 111315 - DNA, 26 bp, Artificial Sequence
  Description of Artificial Sequence: Synthetic oligonucleotide
tcgtaaggagggtgctgcacttgggg

SEQ ID NO: 111316 - DNA, 25 bp, Artificial Sequence
  Description of Artificial Sequence: Synthetic oligonucleotide
cgtaaggagggtgctgcacttgggg

SEQ ID NO: 111317 - DNA, 26 bp, Artificial Sequence
  Description of Artificial Sequence: Synthetic oligonucleotide
gtaaggagggtgctgcacttgggggt

SEQ ID NO: 111318 - DNA, 26 bp, Artificial Sequence
  Description of Artificial Sequence: Synthetic oligonucleotide
taaggagggtgctgcacttgggggtg

SEQ ID NO: 111319 - DNA, 25 bp, Artificial Sequence
  Description of Artificial Sequence: Synthetic oligonucleotide
aaggagggtgctgcacttgggggtg

SEQ ID NO: 111320 - DNA, 24 bp, Artificial Sequence
  Description of Artificial Sequence: Synthetic oligonucleotide
aggagggtgctgcacttgggggtg

SEQ ID NO: 111321 - DNA, 23 bp, Artificial Sequence
  Description of Artificial Sequence: Synthetic oligonucleotide
ggagggtgctgcacttgggggtg

SEQ ID NO: 111322 - DNA, 24 bp, Artificial Sequence
  Description of Artificial Sequence: Synthetic oligonucleotide
gagggtgctgcacttgggggtgca

SEQ ID NO: 111323 - DNA, 26 bp, Artificial Sequence
  Description of Artificial Sequence: Synthetic oligonucleotide
agggtgctgcacttgggggtgcagat

SEQ ID NO: 111324 - DNA, 25 bp, Artificial Sequence
  Description of Artificial Sequence: Synthetic oligonucleotide
gggtgctgcacttgggggtgcagat

SEQ ID NO: 111325 - DNA, 25 bp, Artificial Sequence
  Description of Artificial Sequence: Synthetic oligonucleotide
ggtgctgcacttgggggtgcagatg

SEQ ID NO: 111326 - DNA, 26 bp, Artificial Sequence
  Description of Artificial Sequence: Synthetic oligonucleotide
gtgctgcacttgggggtgcagatgct

SEQ ID NO: 111327 - DNA, 27 bp, Artificial Sequence
  Description of Artificial Sequence: Synthetic oligonucleotide
tgctgcacttgggggtgcagatgctga

SEQ ID NO: 111328 - DNA, 27 bp, Artificial Sequence
  Description of Artificial Sequence: Synthetic oligonucleotide
gctgcacttgggggtgcagatgctgat

SEQ ID NO: 111329 - DNA, 27 bp, Artificial Sequence
  Description of Artificial Sequence: Synthetic oligonucleotide
ctgcacttgggggtgcagatgctgatg

SEQ ID NO: 111330 - DNA, 27 bp, Artificial Sequence
  Description of Artificial Sequence: Synthetic oligonucleotide
tgcacttgggggtgcagatgctgatgc

SEQ ID NO: 111331 - DNA, 27 bp, Artificial Sequence
  Description of Artificial Sequence: Synthetic oligonucleotide
gcacttgggggtgcagatgctgatgct

SEQ ID NO: 111332 - DNA, 27 bp, Artificial Sequence
  Description of Artificial Sequence: Synthetic oligonucleotide
cacttgggggtgcagatgctgatgctg

SEQ ID NO: 111333 - DNA, 28 bp, Artificial Sequence
  Description of Artificial Sequence: Synthetic oligonucleotide
acttgggggtgcagatgctgatgctgag

SEQ ID NO: 111334 - DNA, 27 bp, Artificial Sequence
  Description of Artificial Sequence: Synthetic oligonucleotide
cttgggggtgcagatgctgatgctgag

SEQ ID NO: 111335 - DNA, 27 bp, Artificial Sequence
  Description of Artificial Sequence: Synthetic oligonucleotide
ttgggggtgcagatgctgatgctgagc

SEQ ID NO: 111336 - DNA, 27 bp, Artificial Sequence
  Description of Artificial Sequence: Synthetic oligonucleotide
tgggggtgcagatgctgatgctgagct

SEQ ID NO: 111337 - DNA, 26 bp, Artificial Sequence
  Description of Artificial Sequence: Synthetic oligonucleotide
gggggtgcagatgctgatgctgagct

SEQ ID NO: 111338 - DNA, 27 bp, Artificial Sequence
  Description of Artificial Sequence: Synthetic oligonucleotide
ggggtgcagatgctgatgctgagctgt

SEQ ID NO: 111339 - DNA, 27 bp, Artificial Sequence
  Description of Artificial Sequence: Synthetic oligonucleotide
gggtgcagatgctgatgctgagctgtg

SEQ ID NO: 111340 - DNA, 27 bp, Artificial Sequence
  Description of Artificial Sequence: Synthetic oligonucleotide
ggtgcagatgctgatgctgagctgtgg

SEQ ID NO: 111341 - DNA, 27 bp, Artificial Sequence
  Description of Artificial Sequence: Synthetic oligonucleotide
gtgcagatgctgatgctgagctgtggg

SEQ ID NO: 111342 - DNA, 27 bp, Artificial Sequence
  Description of Artificial Sequence: Synthetic oligonucleotide
tgcagatgctgatgctgagctgtgggc

SEQ ID NO: 111343 - DNA, 27 bp, Artificial Sequence
  Description of Artificial Sequence: Synthetic oligonucleotide
gcagatgctgatgctgagctgtgggct

SEQ ID NO: 111344 - DNA, 27 bp, Artificial Sequence
  Description of Artificial Sequence: Synthetic oligonucleotide
cagatgctgatgctgagctgtgggctg

SEQ ID NO: 111345 - DNA, 27 bp, Artificial Sequence
  Description of Artificial Sequence: Synthetic oligonucleotide
agatgctgatgctgagctgtgggctgc

SEQ ID NO: 111346 - DNA, 27 bp, Artificial Sequence
  Description of Artificial Sequence: Synthetic oligonucleotide
gatgctgatgctgagctgtgggctgca

SEQ ID NO: 111347 - DNA, 27 bp, Artificial Sequence
  Description of Artificial Sequence: Synthetic oligonucleotide
atgctgatgctgagctgtgggctgcag

SEQ ID NO: 111348 - DNA, 26 bp, Artificial Sequence
  Description of Artificial Sequence: Synthetic oligonucleotide
tgctgatgctgagctgtgggctgcag

SEQ ID NO: 111349 - DNA, 25 bp, Artificial Sequence
  Description of Artificial Sequence: Synthetic oligonucleotide
gctgatgctgagctgtgggctgcag

SEQ ID NO: 111350 - DNA, 26 bp, Artificial Sequence
  Description of Artificial Sequence: Synthetic oligonucleotide
ctgatgctgagctgtgggctgcagca

SEQ ID NO: 111351 - DNA, 27 bp, Artificial Sequence
  Description of Artificial Sequence: Synthetic oligonucleotide
tgatgctgagctgtgggctgcagcaga

SEQ ID NO: 111352 - DNA, 27 bp, Artificial Sequence
  Description of Artificial Sequence: Synthetic oligonucleotide
gatgctgagctgtgggctgcagcagat

SEQ ID NO: 111353 - DNA, 27 bp, Artificial Sequence
  Description of Artificial Sequence: Synthetic oligonucleotide
atgctgagctgtgggctgcagcagatg

SEQ ID NO: 111354 - DNA, 26 bp, Artificial Sequence
  Description of Artificial Sequence: Synthetic oligonucleotide
tgctgagctgtgggctgcagcagatg

SEQ ID NO: 111355 - DNA, 25 bp, Artificial Sequence
  Description of Artificial Sequence: Synthetic oligonucleotide
gctgagctgtgggctgcagcagatg

SEQ ID NO: 111356 - DNA, 26 bp, Artificial Sequence
  Description of Artificial Sequence: Synthetic oligonucleotide
ctgagctgtgggctgcagcagatgca

SEQ ID NO: 111357 - DNA, 26 bp, Artificial Sequence
  Description of Artificial Sequence: Synthetic oligonucleotide
tgagctgtgggctgcagcagatgcag

SEQ ID NO: 111358 - DNA, 25 bp, Artificial Sequence
  Description of Artificial Sequence: Synthetic oligonucleotide
gagctgtgggctgcagcagatgcag

SEQ ID NO: 111359 - DNA, 27 bp, Artificial Sequence
  Description of Artificial Sequence: Synthetic oligonucleotide
agctgtgggctgcagcagatgcaggat

SEQ ID NO: 111360 - DNA, 26 bp, Artificial Sequence
  Description of Artificial Sequence: Synthetic oligonucleotide
gctgtgggctgcagcagatgcaggat

SEQ ID NO: 111361 - DNA, 26 bp, Artificial Sequence
  Description of Artificial Sequence: Synthetic oligonucleotide
ctgtgggctgcagcagatgcaggatg

SEQ ID NO: 111362 - DNA, 26 bp, Artificial Sequence
  Description of Artificial Sequence: Synthetic oligonucleotide
tgtgggctgcagcagatgcaggatgg

SEQ ID NO: 111363 - DNA, 25 bp, Artificial Sequence
  Description of Artificial Sequence: Synthetic oligonucleotide
gtgggctgcagcagatgcaggatgg

SEQ ID NO: 111364 - DNA, 25 bp, Artificial Sequence
  Description of Artificial Sequence: Synthetic oligonucleotide
tgggctgcagcagatgcaggatggg

SEQ ID NO: 111365 - DNA, 24 bp, Artificial Sequence
  Description of Artificial Sequence: Synthetic oligonucleotide
gggctgcagcagatgcaggatggg

SEQ ID NO: 111366 - DNA, 25 bp, Artificial Sequence
  Description of Artificial Sequence: Synthetic oligonucleotide
ggctgcagcagatgcaggatgggga

SEQ ID NO: 111367 - DNA, 25 bp, Artificial Sequence
  Description of Artificial Sequence: Synthetic oligonucleotide
gctgcagcagatgcaggatggggag

SEQ ID NO: 111368 - DNA, 26 bp, Artificial Sequence
  Description of Artificial Sequence: Synthetic oligonucleotide
ctgcagcagatgcaggatggggagct

SEQ ID NO: 111369 - DNA, 27 bp, Artificial Sequence
  Description of Artificial Sequence: Synthetic oligonucleotide
tgcagcagatgcaggatggggagctca

SEQ ID NO: 111370 - DNA, 26 bp, Artificial Sequence
  Description of Artificial Sequence: Synthetic oligonucleotide
gcagcagatgcaggatggggagctca

SEQ ID NO: 111371 - DNA, 26 bp, Artificial Sequence
  Description of Artificial Sequence: Synthetic oligonucleotide
cagcagatgcaggatggggagctcac

SEQ ID NO: 111372 - DNA, 26 bp, Artificial Sequence
  Description of Artificial Sequence: Synthetic oligonucleotide
agcagatgcaggatggggagctcacc

SEQ ID NO: 111373 - DNA, 25 bp, Artificial Sequence
  Description of Artificial Sequence: Synthetic oligonucleotide
gcagatgcaggatggggagctcacc

SEQ ID NO: 111374 - DNA, 26 bp, Artificial Sequence
  Description of Artificial Sequence: Synthetic oligonucleotide
cagatgcaggatggggagctcaccca

SEQ ID NO: 111375 - DNA, 26 bp, Artificial Sequence
  Description of Artificial Sequence: Synthetic oligonucleotide
agatgcaggatggggagctcacccag

SEQ ID NO: 111376 - DNA, 25 bp, Artificial Sequence
  Description of Artificial Sequence: Synthetic oligonucleotide
gatgcaggatggggagctcacccag

SEQ ID NO: 111377 - DNA, 25 bp, Artificial Sequence
  Description of Artificial Sequence: Synthetic oligonucleotide
atgcaggatggggagctcacccagg

SEQ ID NO: 111378 - DNA, 24 bp, Artificial Sequence
  Description of Artificial Sequence: Synthetic oligonucleotide
tgcaggatggggagctcacccagg

SEQ ID NO: 111379 - DNA, 23 bp, Artificial Sequence
  Description of Artificial Sequence: Synthetic oligonucleotide
gcaggatggggagctcacccagg

SEQ ID NO: 111380 - DNA, 23 bp, Artificial Sequence
  Description of Artificial Sequence: Synthetic oligonucleotide
caggatggggagctcacccaggg

SEQ ID NO: 111381 - DNA, 24 bp, Artificial Sequence
  Description of Artificial Sequence: Synthetic oligonucleotide
aggatggggagctcacccagggca

SEQ ID NO: 111382 - DNA, 23 bp, Artificial Sequence
  Description of Artificial Sequence: Synthetic oligonucleotide
ggatggggagctcacccagggca

SEQ ID NO: 111383 - DNA, 23 bp, Artificial Sequence
  Description of Artificial Sequence: Synthetic oligonucleotide
gatggggagctcacccagggcag

SEQ ID NO: 111384 - DNA, 23 bp, Artificial Sequence
  Description of Artificial Sequence: Synthetic oligonucleotide
atggggagctcacccagggcagc

SEQ ID NO: 111385 - DNA, 22 bp, Artificial Sequence
  Description of Artificial Sequence: Synthetic oligonucleotide
tggggagctcacccagggcagc

SEQ ID NO: 111386 - DNA, 21 bp, Artificial Sequence
  Description of Artificial Sequence: Synthetic oligonucleotide
ggggagctcacccagggcagc

SEQ ID NO: 111387 - DNA, 22 bp, Artificial Sequence
  Description of Artificial Sequence: Synthetic oligonucleotide
gggagctcacccagggcagcct

SEQ ID NO: 111388 - DNA, 22 bp, Artificial Sequence
  Description of Artificial Sequence: Synthetic oligonucleotide
ggagctcacccagggcagcctg

SEQ ID NO: 111389 - DNA, 25 bp, Artificial Sequence
  Description of Artificial Sequence: Synthetic oligonucleotide
gagctcacccagggcagcctgcttt

SEQ ID NO: 111390 - DNA, 25 bp, Artificial Sequence
  Description of Artificial Sequence: Synthetic oligonucleotide
agctcacccagggcagcctgctttc

SEQ ID NO: 111391 - DNA, 24 bp, Artificial Sequence
  Description of Artificial Sequence: Synthetic oligonucleotide
gctcacccagggcagcctgctttc

SEQ ID NO: 111392 - DNA, 27 bp, Artificial Sequence
  Description of Artificial Sequence: Synthetic oligonucleotide
ctcacccagggcagcctgctttccttt

SEQ ID NO: 111393 - DNA, 29 bp, Artificial Sequence
  Description of Artificial Sequence: Synthetic oligonucleotide
tcacccagggcagcctgctttcctttatg

SEQ ID NO: 111394 - DNA, 28 bp, Artificial Sequence
  Description of Artificial Sequence: Synthetic oligonucleotide
cacccagggcagcctgctttcctttatg

SEQ ID NO: 111395 - DNA, 30 bp, Artificial Sequence
  Description of Artificial Sequence: Synthetic oligonucleotide
acccagggcagcctgctttcctttatgatc

SEQ ID NO: 111396 - DNA, 29 bp, Artificial Sequence
  Description of Artificial Sequence: Synthetic oligonucleotide
cccagggcagcctgctttcctttatgatc

SEQ ID NO: 111397 - DNA, 31 bp, Artificial Sequence
  Description of Artificial Sequence: Synthetic oligonucleotide
ccagggcagcctgctttcctttatgatctac

SEQ ID NO: 111398 - DNA, 31 bp, Artificial Sequence
  Description of Artificial Sequence: Synthetic oligonucleotide
cagggcagcctgctttcctttatgatctacc

SEQ ID NO: 111399 - DNA, 32 bp, Artificial Sequence
  Description of Artificial Sequence: Synthetic oligonucleotide
agggcagcctgctttcctttatgatctaccag

SEQ ID NO: 111400 - DNA, 31 bp, Artificial Sequence
  Description of Artificial Sequence: Synthetic oligonucleotide
gggcagcctgctttcctttatgatctaccag

SEQ ID NO: 111401 - DNA, 31 bp, Artificial Sequence
  Description of Artificial Sequence: Synthetic oligonucleotide
ggcagcctgctttcctttatgatctaccagg

SEQ ID NO: 111402 - DNA, 32 bp, Artificial Sequence
  Description of Artificial Sequence: Synthetic oligonucleotide
gcagcctgctttcctttatgatctaccaggag

SEQ ID NO: 111403 - DNA, 33 bp, Artificial Sequence
  Description of Artificial Sequence: Synthetic oligonucleotide
cagcctgctttcctttatgatctaccaggagag

SEQ ID NO: 111404 - DNA, 33 bp, Artificial Sequence
  Description of Artificial Sequence: Synthetic oligonucleotide
agcctgctttcctttatgatctaccaggagagc

SEQ ID NO: 111405 - DNA, 32 bp, Artificial Sequence
  Description of Artificial Sequence: Synthetic oligonucleotide
gcctgctttcctttatgatctaccaggagagc

SEQ ID NO: 111406 - DNA, 32 bp, Artificial Sequence
  Description of Artificial Sequence: Synthetic oligonucleotide
cctgctttcctttatgatctaccaggagagcg

SEQ ID NO: 111407 - DNA, 33 bp, Artificial Sequence
  Description of Artificial Sequence: Synthetic oligonucleotide
ctgctttcctttatgatctaccaggagagcgtg

SEQ ID NO: 111408 - DNA, 33 bp, Artificial Sequence
  Description of Artificial Sequence: Synthetic oligonucleotide
tgctttcctttatgatctaccaggagagcgtgg

SEQ ID NO: 111409 - DNA, 32 bp, Artificial Sequence
  Description of Artificial Sequence: Synthetic oligonucleotide
gctttcctttatgatctaccaggagagcgtgg

SEQ ID NO: 111410 - DNA, 32 bp, Artificial Sequence
  Description of Artificial Sequence: Synthetic oligonucleotide
ctttcctttatgatctaccaggagagcgtggg

SEQ ID NO: 111411 - DNA, 32 bp, Artificial Sequence
  Description of Artificial Sequence: Synthetic oligonucleotide
tttcctttatgatctaccaggagagcgtgggg

SEQ ID NO: 111412 - DNA, 31 bp, Artificial Sequence
  Description of Artificial Sequence: Synthetic oligonucleotide
ttcctttatgatctaccaggagagcgtgggg

SEQ ID NO: 111413 - DNA, 30 bp, Artificial Sequence
  Description of Artificial Sequence: Synthetic oligonucleotide
tcctttatgatctaccaggagagcgtgggg

SEQ ID NO: 111414 - DNA, 29 bp, Artificial Sequence
  Description of Artificial Sequence: Synthetic oligonucleotide
cctttatgatctaccaggagagcgtgggg

SEQ ID NO: 111415 - DNA, 30 bp, Artificial Sequence
  Description of Artificial Sequence: Synthetic oligonucleotide
ctttatgatctaccaggagagcgtggggag

SEQ ID NO: 111416 - DNA, 30 bp, Artificial Sequence
  Description of Artificial Sequence: Synthetic oligonucleotide
tttatgatctaccaggagagcgtggggagc

SEQ ID NO: 111417 - DNA, 29 bp, Artificial Sequence
  Description of Artificial Sequence: Synthetic oligonucleotide
ttatgatctaccaggagagcgtggggagc

SEQ ID NO: 111418 - DNA, 28 bp, Artificial Sequence
  Description of Artificial Sequence: Synthetic oligonucleotide
tatgatctaccaggagagcgtggggagc

SEQ ID NO: 111419 - DNA, 27 bp, Artificial Sequence
  Description of Artificial Sequence: Synthetic oligonucleotide
atgatctaccaggagagcgtggggagc

SEQ ID NO: 111420 - DNA, 27 bp, Artificial Sequence
  Description of Artificial Sequence: Synthetic oligonucleotide
tgatctaccaggagagcgtggggagct

SEQ ID NO: 111421 - DNA, 27 bp, Artificial Sequence
  Description of Artificial Sequence: Synthetic oligonucleotide
gatctaccaggagagcgtggggagcta

SEQ ID NO: 111422 - DNA, 28 bp, Artificial Sequence
  Description of Artificial Sequence: Synthetic oligonucleotide
atctaccaggagagcgtggggagctatg

SEQ ID NO: 111423 - DNA, 27 bp, Artificial Sequence
  Description of Artificial Sequence: Synthetic oligonucleotide
tctaccaggagagcgtggggagctatg

SEQ ID NO: 111424 - DNA, 27 bp, Artificial Sequence
  Description of Artificial Sequence: Synthetic oligonucleotide
ctaccaggagagcgtggggagctatgt

SEQ ID NO: 111425 - DNA, 27 bp, Artificial Sequence
  Description of Artificial Sequence: Synthetic oligonucleotide
taccaggagagcgtggggagctatgtg

SEQ ID NO: 111426 - DNA, 26 bp, Artificial Sequence
  Description of Artificial Sequence: Synthetic oligonucleotide
accaggagagcgtggggagctatgtg

SEQ ID NO: 111427 - DNA, 25 bp, Artificial Sequence
  Description of Artificial Sequence: Synthetic oligonucleotide
ccaggagagcgtggggagctatgtg

SEQ ID NO: 111428 - DNA, 26 bp, Artificial Sequence
  Description of Artificial Sequence: Synthetic oligonucleotide
caggagagcgtggggagctatgtgca

SEQ ID NO: 111429 - DNA, 27 bp, Artificial Sequence
  Description of Artificial Sequence: Synthetic oligonucleotide
aggagagcgtggggagctatgtgcaga

SEQ ID NO: 111430 - DNA, 26 bp, Artificial Sequence
  Description of Artificial Sequence: Synthetic oligonucleotide
ggagagcgtggggagctatgtgcaga

SEQ ID NO: 111431 - DNA, 26 bp, Artificial Sequence
  Description of Artificial Sequence: Synthetic oligonucleotide
gagagcgtggggagctatgtgcagac

SEQ ID NO: 111432 - DNA, 26 bp, Artificial Sequence
  Description of Artificial Sequence: Synthetic oligonucleotide
agagcgtggggagctatgtgcagacc

SEQ ID NO: 111433 - DNA, 25 bp, Artificial Sequence
  Description of Artificial Sequence: Synthetic oligonucleotide
gagcgtggggagctatgtgcagacc

SEQ ID NO: 111434 - DNA, 26 bp, Artificial Sequence
  Description of Artificial Sequence: Synthetic oligonucleotide
agcgtggggagctatgtgcagaccct

SEQ ID NO: 111435 - DNA, 25 bp, Artificial Sequence
  Description of Artificial Sequence: Synthetic oligonucleotide
gcgtggggagctatgtgcagaccct

SEQ ID NO: 111436 - DNA, 25 bp, Artificial Sequence
  Description of Artificial Sequence: Synthetic oligonucleotide
cgtggggagctatgtgcagaccctg

SEQ ID NO: 111437 - DNA, 27 bp, Artificial Sequence
  Description of Artificial Sequence: Synthetic oligonucleotide
gtggggagctatgtgcagaccctggta

SEQ ID NO: 111438 - DNA, 29 bp, Artificial Sequence
  Description of Artificial Sequence: Synthetic oligonucleotide
tggggagctatgtgcagaccctggtatac

SEQ ID NO: 111439 - DNA, 28 bp, Artificial Sequence
  Description of Artificial Sequence: Synthetic oligonucleotide
ggggagctatgtgcagaccctggtatac

SEQ ID NO: 111440 - DNA, 34 bp, Artificial Sequence
  Description of Artificial Sequence: Synthetic oligonucleotide
gggagctatgtgcagaccctggtatacatatatg

SEQ ID NO: 111441 - DNA, 34 bp, Artificial Sequence
  Description of Artificial Sequence: Synthetic oligonucleotide
ggagctatgtgcagaccctggtatacatatatgg

SEQ ID NO: 111442 - DNA, 34 bp, Artificial Sequence
  Description of Artificial Sequence: Synthetic oligonucleotide
gagctatgtgcagaccctggtatacatatatggg

SEQ ID NO: 111443 - DNA, 34 bp, Artificial Sequence
  Description of Artificial Sequence: Synthetic oligonucleotide
agctatgtgcagaccctggtatacatatatgggg

SEQ ID NO: 111444 - DNA, 33 bp, Artificial Sequence
  Description of Artificial Sequence: Synthetic oligonucleotide
gctatgtgcagaccctggtatacatatatgggg

SEQ ID NO: 111445 - DNA, 37 bp, Artificial Sequence
  Description of Artificial Sequence: Synthetic oligonucleotide
ctatgtgcagaccctggtatacatatatggggatatg

SEQ ID NO: 111446 - DNA, 37 bp, Artificial Sequence
  Description of Artificial Sequence: Synthetic oligonucleotide
tatgtgcagaccctggtatacatatatggggatatgc

SEQ ID NO: 111447 - DNA, 36 bp, Artificial Sequence
  Description of Artificial Sequence: Synthetic oligonucleotide
atgtgcagaccctggtatacatatatggggatatgc

SEQ ID NO: 111448 - DNA, 35 bp, Artificial Sequence
  Description of Artificial Sequence: Synthetic oligonucleotide
tgtgcagaccctggtatacatatatggggatatgc

SEQ ID NO: 111449 - DNA, 34 bp, Artificial Sequence
  Description of Artificial Sequence: Synthetic oligonucleotide
gtgcagaccctggtatacatatatggggatatgc

SEQ ID NO: 111450 - DNA, 35 bp, Artificial Sequence
  Description of Artificial Sequence: Synthetic oligonucleotide
tgcagaccctggtatacatatatggggatatgctc

SEQ ID NO: 111451 - DNA, 34 bp, Artificial Sequence
  Description of Artificial Sequence: Synthetic oligonucleotide
gcagaccctggtatacatatatggggatatgctc

SEQ ID NO: 111452 - DNA, 35 bp, Artificial Sequence
  Description of Artificial Sequence: Synthetic oligonucleotide
cagaccctggtatacatatatggggatatgctcag

SEQ ID NO: 111453 - DNA, 35 bp, Artificial Sequence
  Description of Artificial Sequence: Synthetic oligonucleotide
agaccctggtatacatatatggggatatgctcagc

SEQ ID NO: 111454 - DNA, 34 bp, Artificial Sequence
  Description of Artificial Sequence: Synthetic oligonucleotide
gaccctggtatacatatatggggatatgctcagc

SEQ ID NO: 111455 - DNA, 36 bp, Artificial Sequence
  Description of Artificial Sequence: Synthetic oligonucleotide
accctggtatacatatatggggatatgctcagcaac

SEQ ID NO: 111456 - DNA, 35 bp, Artificial Sequence
  Description of Artificial Sequence: Synthetic oligonucleotide
ccctggtatacatatatggggatatgctcagcaac

SEQ ID NO: 111457 - DNA, 35 bp, Artificial Sequence
  Description of Artificial Sequence: Synthetic oligonucleotide
cctggtatacatatatggggatatgctcagcaacg

SEQ ID NO: 111458 - DNA, 36 bp, Artificial Sequence
  Description of Artificial Sequence: Synthetic oligonucleotide
ctggtatacatatatggggatatgctcagcaacgtg

SEQ ID NO: 111459 - DNA, 36 bp, Artificial Sequence
  Description of Artificial Sequence: Synthetic oligonucleotide
tggtatacatatatggggatatgctcagcaacgtgg

SEQ ID NO: 111460 - DNA, 35 bp, Artificial Sequence
  Description of Artificial Sequence: Synthetic oligonucleotide
ggtatacatatatggggatatgctcagcaacgtgg

SEQ ID NO: 111461 - DNA, 35 bp, Artificial Sequence
  Description of Artificial Sequence: Synthetic oligonucleotide
gtatacatatatggggatatgctcagcaacgtggg

SEQ ID NO: 111462 - DNA, 36 bp, Artificial Sequence
  Description of Artificial Sequence: Synthetic oligonucleotide
tatacatatatggggatatgctcagcaacgtgggag

SEQ ID NO: 111463 - DNA, 35 bp, Artificial Sequence
  Description of Artificial Sequence: Synthetic oligonucleotide
atacatatatggggatatgctcagcaacgtgggag

SEQ ID NO: 111464 - DNA, 34 bp, Artificial Sequence
  Description of Artificial Sequence: Synthetic oligonucleotide
tacatatatggggatatgctcagcaacgtgggag

SEQ ID NO: 111465 - DNA, 33 bp, Artificial Sequence
  Description of Artificial Sequence: Synthetic oligonucleotide
acatatatggggatatgctcagcaacgtgggag

SEQ ID NO: 111466 - DNA, 32 bp, Artificial Sequence
  Description of Artificial Sequence: Synthetic oligonucleotide
catatatggggatatgctcagcaacgtgggag

SEQ ID NO: 111467 - DNA, 32 bp, Artificial Sequence
  Description of Artificial Sequence: Synthetic oligonucleotide
atatatggggatatgctcagcaacgtgggagc

SEQ ID NO: 111468 - DNA, 31 bp, Artificial Sequence
  Description of Artificial Sequence: Synthetic oligonucleotide
tatatggggatatgctcagcaacgtgggagc

SEQ ID NO: 111469 - DNA, 30 bp, Artificial Sequence
  Description of Artificial Sequence: Synthetic oligonucleotide
atatggggatatgctcagcaacgtgggagc

SEQ ID NO: 111470 - DNA, 29 bp, Artificial Sequence
  Description of Artificial Sequence: Synthetic oligonucleotide
tatggggatatgctcagcaacgtgggagc

SEQ ID NO: 111471 - DNA, 28 bp, Artificial Sequence
  Description of Artificial Sequence: Synthetic oligonucleotide
atggggatatgctcagcaacgtgggagc

SEQ ID NO: 111472 - DNA, 27 bp, Artificial Sequence
  Description of Artificial Sequence: Synthetic oligonucleotide
tggggatatgctcagcaacgtgggagc

SEQ ID NO: 111473 - DNA, 27 bp, Artificial Sequence
  Description of Artificial Sequence: Synthetic oligonucleotide
ggggatatgctcagcaacgtgggagct

SEQ ID NO: 111474 - DNA, 27 bp, Artificial Sequence
  Description of Artificial Sequence: Synthetic oligonucleotide
gggatatgctcagcaacgtgggagctg

SEQ ID NO: 111475 - DNA, 27 bp, Artificial Sequence
  Description of Artificial Sequence: Synthetic oligonucleotide
ggatatgctcagcaacgtgggagctgc

SEQ ID NO: 111476 - DNA, 28 bp, Artificial Sequence
  Description of Artificial Sequence: Synthetic oligonucleotide
gatatgctcagcaacgtgggagctgcag

SEQ ID NO: 111477 - DNA, 29 bp, Artificial Sequence
  Description of Artificial Sequence: Synthetic oligonucleotide
atatgctcagcaacgtgggagctgcagag

SEQ ID NO: 111478 - DNA, 28 bp, Artificial Sequence
  Description of Artificial Sequence: Synthetic oligonucleotide
tatgctcagcaacgtgggagctgcagag

SEQ ID NO: 111479 - DNA, 27 bp, Artificial Sequence
  Description of Artificial Sequence: Synthetic oligonucleotide
atgctcagcaacgtgggagctgcagag

SEQ ID NO: 111480 - DNA, 27 bp, Artificial Sequence
  Description of Artificial Sequence: Synthetic oligonucleotide
tgctcagcaacgtgggagctgcagaga

SEQ ID NO: 111481 - DNA, 27 bp, Artificial Sequence
  Description of Artificial Sequence: Synthetic oligonucleotide
gctcagcaacgtgggagctgcagagaa

SEQ ID NO: 111482 - DNA, 27 bp, Artificial Sequence
  Description of Artificial Sequence: Synthetic oligonucleotide
ctcagcaacgtgggagctgcagagaag

SEQ ID NO: 111483 - DNA, 27 bp, Artificial Sequence
  Description of Artificial Sequence: Synthetic oligonucleotide
tcagcaacgtgggagctgcagagaagg

SEQ ID NO: 111484 - DNA, 27 bp, Artificial Sequence
  Description of Artificial Sequence: Synthetic oligonucleotide
cagcaacgtgggagctgcagagaaggt

SEQ ID NO: 111485 - DNA, 30 bp, Artificial Sequence
  Description of Artificial Sequence: Synthetic oligonucleotide
agcaacgtgggagctgcagagaaggttttc

SEQ ID NO: 111486 - DNA, 29 bp, Artificial Sequence
  Description of Artificial Sequence: Synthetic oligonucleotide
gcaacgtgggagctgcagagaaggttttc

SEQ ID NO: 111487 - DNA, 30 bp, Artificial Sequence
  Description of Artificial Sequence: Synthetic oligonucleotide
caacgtgggagctgcagagaaggttttctc

SEQ ID NO: 111488 - DNA, 30 bp, Artificial Sequence
  Description of Artificial Sequence: Synthetic oligonucleotide
aacgtgggagctgcagagaaggttttctcc

SEQ ID NO: 111489 - DNA, 29 bp, Artificial Sequence
  Description of Artificial Sequence: Synthetic oligonucleotide
acgtgggagctgcagagaaggttttctcc

SEQ ID NO: 111490 - DNA, 28 bp, Artificial Sequence
  Description of Artificial Sequence: Synthetic oligonucleotide
cgtgggagctgcagagaaggttttctcc

SEQ ID NO: 111491 - DNA, 30 bp, Artificial Sequence
  Description of Artificial Sequence: Synthetic oligonucleotide
gtgggagctgcagagaaggttttctcctac

SEQ ID NO: 111492 - DNA, 32 bp, Artificial Sequence
  Description of Artificial Sequence: Synthetic oligonucleotide
tgggagctgcagagaaggttttctcctacatg

SEQ ID NO: 111493 - DNA, 31 bp, Artificial Sequence
  Description of Artificial Sequence: Synthetic oligonucleotide
gggagctgcagagaaggttttctcctacatg

SEQ ID NO: 111494 - DNA, 31 bp, Artificial Sequence
  Description of Artificial Sequence: Synthetic oligonucleotide
ggagctgcagagaaggttttctcctacatgg

SEQ ID NO: 111495 - DNA, 32 bp, Artificial Sequence
  Description of Artificial Sequence: Synthetic oligonucleotide
gagctgcagagaaggttttctcctacatggac

SEQ ID NO: 111496 - DNA, 32 bp, Artificial Sequence
  Description of Artificial Sequence: Synthetic oligonucleotide
agctgcagagaaggttttctcctacatggacc

SEQ ID NO: 111497 - DNA, 31 bp, Artificial Sequence
  Description of Artificial Sequence: Synthetic oligonucleotide
gctgcagagaaggttttctcctacatggacc

SEQ ID NO: 111498 - DNA, 31 bp, Artificial Sequence
  Description of Artificial Sequence: Synthetic oligonucleotide
ctgcagagaaggttttctcctacatggaccg

SEQ ID NO: 111499 - DNA, 32 bp, Artificial Sequence
  Description of Artificial Sequence: Synthetic oligonucleotide
tgcagagaaggttttctcctacatggaccgac

SEQ ID NO: 111500 - DNA, 31 bp, Artificial Sequence
  Description of Artificial Sequence: Synthetic oligonucleotide
gcagagaaggttttctcctacatggaccgac

SEQ ID NO: 111501 - DNA, 32 bp, Artificial Sequence
  Description of Artificial Sequence: Synthetic oligonucleotide
cagagaaggttttctcctacatggaccgacag

SEQ ID NO: 111502 - DNA, 32 bp, Artificial Sequence
  Description of Artificial Sequence: Synthetic oligonucleotide
agagaaggttttctcctacatggaccgacagc

SEQ ID NO: 111503 - DNA, 31 bp, Artificial Sequence
  Description of Artificial Sequence: Synthetic oligonucleotide
gagaaggttttctcctacatggaccgacagc

SEQ ID NO: 111504 - DNA, 31 bp, Artificial Sequence
  Description of Artificial Sequence: Synthetic oligonucleotide
agaaggttttctcctacatggaccgacagcc

SEQ ID NO: 111505 - DNA, 30 bp, Artificial Sequence
  Description of Artificial Sequence: Synthetic oligonucleotide
gaaggttttctcctacatggaccgacagcc

SEQ ID NO: 111506 - DNA, 34 bp, Artificial Sequence
  Description of Artificial Sequence: Synthetic oligonucleotide
aaggttttctcctacatggaccgacagccaaatc

SEQ ID NO: 111507 - DNA, 33 bp, Artificial Sequence
  Description of Artificial Sequence: Synthetic oligonucleotide
aggttttctcctacatggaccgacagccaaatc

SEQ ID NO: 111508 - DNA, 32 bp, Artificial Sequence
  Description of Artificial Sequence: Synthetic oligonucleotide
ggttttctcctacatggaccgacagccaaatc

SEQ ID NO: 111509 - DNA, 33 bp, Artificial Sequence
  Description of Artificial Sequence: Synthetic oligonucleotide
gttttctcctacatggaccgacagccaaatctg

SEQ ID NO: 111510 - DNA, 33 bp, Artificial Sequence
  Description of Artificial Sequence: Synthetic oligonucleotide
ttttctcctacatggaccgacagccaaatctgc

SEQ ID NO: 111511 - DNA, 32 bp, Artificial Sequence
  Description of Artificial Sequence: Synthetic oligonucleotide
tttctcctacatggaccgacagccaaatctgc

SEQ ID NO: 111512 - DNA, 31 bp, Artificial Sequence
  Description of Artificial Sequence: Synthetic oligonucleotide
ttctcctacatggaccgacagccaaatctgc

SEQ ID NO: 111513 - DNA, 30 bp, Artificial Sequence
  Description of Artificial Sequence: Synthetic oligonucleotide
tctcctacatggaccgacagccaaatctgc

SEQ ID NO: 111514 - DNA, 29 bp, Artificial Sequence
  Description of Artificial Sequence: Synthetic oligonucleotide
ctcctacatggaccgacagccaaatctgc

SEQ ID NO: 111515 - DNA, 29 bp, Artificial Sequence
  Description of Artificial Sequence: Synthetic oligonucleotide
tcctacatggaccgacagccaaatctgcc

SEQ ID NO: 111516 - DNA, 28 bp, Artificial Sequence
  Description of Artificial Sequence: Synthetic oligonucleotide
cctacatggaccgacagccaaatctgcc

SEQ ID NO: 111517 - DNA, 30 bp, Artificial Sequence
  Description of Artificial Sequence: Synthetic oligonucleotide
ctacatggaccgacagccaaatctgccttc

SEQ ID NO: 111518 - DNA, 31 bp, Artificial Sequence
  Description of Artificial Sequence: Synthetic oligonucleotide
tacatggaccgacagccaaatctgccttcac

SEQ ID NO: 111519 - DNA, 30 bp, Artificial Sequence
  Description of Artificial Sequence: Synthetic oligonucleotide
acatggaccgacagccaaatctgccttcac

SEQ ID NO: 111520 - DNA, 29 bp, Artificial Sequence
  Description of Artificial Sequence: Synthetic oligonucleotide
catggaccgacagccaaatctgccttcac

SEQ ID NO: 111521 - DNA, 29 bp, Artificial Sequence
  Description of Artificial Sequence: Synthetic oligonucleotide
atggaccgacagccaaatctgccttcacc

SEQ ID NO: 111522 - DNA, 28 bp, Artificial Sequence
  Description of Artificial Sequence: Synthetic oligonucleotide
tggaccgacagccaaatctgccttcacc

SEQ ID NO: 111523 - DNA, 27 bp, Artificial Sequence
  Description of Artificial Sequence: Synthetic oligonucleotide
ggaccgacagccaaatctgccttcacc

SEQ ID NO: 111524 - DNA, 28 bp, Artificial Sequence
  Description of Artificial Sequence: Synthetic oligonucleotide
gaccgacagccaaatctgccttcacctg

SEQ ID NO: 111525 - DNA, 28 bp, Artificial Sequence
  Description of Artificial Sequence: Synthetic oligonucleotide
accgacagccaaatctgccttcacctgg

SEQ ID NO: 111526 - DNA, 27 bp, Artificial Sequence
  Description of Artificial Sequence: Synthetic oligonucleotide
ccgacagccaaatctgccttcacctgg

SEQ ID NO: 111527 - DNA, 27 bp, Artificial Sequence
  Description of Artificial Sequence: Synthetic oligonucleotide
cgacagccaaatctgccttcacctggc

SEQ ID NO: 111528 - DNA, 28 bp, Artificial Sequence
  Description of Artificial Sequence: Synthetic oligonucleotide
gacagccaaatctgccttcacctggcac

SEQ ID NO: 111529 - DNA, 28 bp, Artificial Sequence
  Description of Artificial Sequence: Synthetic oligonucleotide
acagccaaatctgccttcacctggcacg

SEQ ID NO: 111530 - DNA, 27 bp, Artificial Sequence
  Description of Artificial Sequence: Synthetic oligonucleotide
cagccaaatctgccttcacctggcacg

SEQ ID NO: 111531 - DNA, 27 bp, Artificial Sequence
  Description of Artificial Sequence: Synthetic oligonucleotide
agccaaatctgccttcacctggcacgc

SEQ ID NO: 111532 - DNA, 27 bp, Artificial Sequence
  Description of Artificial Sequence: Synthetic oligonucleotide
gccaaatctgccttcacctggcacgct

SEQ ID NO: 111533 - DNA, 28 bp, Artificial Sequence
  Description of Artificial Sequence: Synthetic oligonucleotide
ccaaatctgccttcacctggcacgcttg

SEQ ID NO: 111534 - DNA, 28 bp, Artificial Sequence
  Description of Artificial Sequence: Synthetic oligonucleotide
caaatctgccttcacctggcacgcttgc

SEQ ID NO: 111535 - DNA, 28 bp, Artificial Sequence
  Description of Artificial Sequence: Synthetic oligonucleotide
aaatctgccttcacctggcacgcttgcc

SEQ ID NO: 111536 - DNA, 27 bp, Artificial Sequence
  Description of Artificial Sequence: Synthetic oligonucleotide
aatctgccttcacctggcacgcttgcc

SEQ ID NO: 111537 - DNA, 26 bp, Artificial Sequence
  Description of Artificial Sequence: Synthetic oligonucleotide
atctgccttcacctggcacgcttgcc

SEQ ID NO: 111538 - DNA, 25 bp, Artificial Sequence
  Description of Artificial Sequence: Synthetic oligonucleotide
tctgccttcacctggcacgcttgcc

SEQ ID NO: 111539 - DNA, 24 bp, Artificial Sequence
  Description of Artificial Sequence: Synthetic oligonucleotide
ctgccttcacctggcacgcttgcc

SEQ ID NO: 111540 - DNA, 24 bp, Artificial Sequence
  Description of Artificial Sequence: Synthetic oligonucleotide
tgccttcacctggcacgcttgccc

SEQ ID NO: 111541 - DNA, 23 bp, Artificial Sequence
  Description of Artificial Sequence: Synthetic oligonucleotide
gccttcacctggcacgcttgccc

SEQ ID NO: 111542 - DNA, 23 bp, Artificial Sequence
  Description of Artificial Sequence: Synthetic oligonucleotide
ccttcacctggcacgcttgcccc

SEQ ID NO: 111543 - DNA, 24 bp, Artificial Sequence
  Description of Artificial Sequence: Synthetic oligonucleotide
cttcacctggcacgcttgccccca

SEQ ID NO: 111544 - DNA, 24 bp, Artificial Sequence
  Description of Artificial Sequence: Synthetic oligonucleotide
ttcacctggcacgcttgcccccac

SEQ ID NO: 111545 - DNA, 23 bp, Artificial Sequence
  Description of Artificial Sequence: Synthetic oligonucleotide
tcacctggcacgcttgcccccac

SEQ ID NO: 111546 - DNA, 22 bp, Artificial Sequence
  Description of Artificial Sequence: Synthetic oligonucleotide
cacctggcacgcttgcccccac

SEQ ID NO: 111547 - DNA, 23 bp, Artificial Sequence
  Description of Artificial Sequence: Synthetic oligonucleotide
acctggcacgcttgcccccacca

SEQ ID NO: 111548 - DNA, 22 bp, Artificial Sequence
  Description of Artificial Sequence: Synthetic oligonucleotide
cctggcacgcttgcccccacca

SEQ ID NO: 111549 - DNA, 23 bp, Artificial Sequence
  Description of Artificial Sequence: Synthetic oligonucleotide
ctggcacgcttgcccccaccact

SEQ ID NO: 111550 - DNA, 24 bp, Artificial Sequence
  Description of Artificial Sequence: Synthetic oligonucleotide
tggcacgcttgcccccaccactct

SEQ ID NO: 111551 - DNA, 23 bp, Artificial Sequence
  Description of Artificial Sequence: Synthetic oligonucleotide
ggcacgcttgcccccaccactct

SEQ ID NO: 111552 - DNA, 23 bp, Artificial Sequence
  Description of Artificial Sequence: Synthetic oligonucleotide
gcacgcttgcccccaccactctg

SEQ ID NO: 111553 - DNA, 24 bp, Artificial Sequence
  Description of Artificial Sequence: Synthetic oligonucleotide
cacgcttgcccccaccactctgca

SEQ ID NO: 111554 - DNA, 24 bp, Artificial Sequence
  Description of Artificial Sequence: Synthetic oligonucleotide
acgcttgcccccaccactctgcag

SEQ ID NO: 111555 - DNA, 23 bp, Artificial Sequence
  Description of Artificial Sequence: Synthetic oligonucleotide
cgcttgcccccaccactctgcag

SEQ ID NO: 111556 - DNA, 23 bp, Artificial Sequence
  Description of Artificial Sequence: Synthetic oligonucleotide
gcttgcccccaccactctgcagg

SEQ ID NO: 111557 - DNA, 23 bp, Artificial Sequence
  Description of Artificial Sequence: Synthetic oligonucleotide
cttgcccccaccactctgcaggg

SEQ ID NO: 111558 - DNA, 23 bp, Artificial Sequence
  Description of Artificial Sequence: Synthetic oligonucleotide
ttgcccccaccactctgcagggg

SEQ ID NO: 111559 - DNA, 22 bp, Artificial Sequence
  Description of Artificial Sequence: Synthetic oligonucleotide
tgcccccaccactctgcagggg

SEQ ID NO: 111560 - DNA, 21 bp, Artificial Sequence
  Description of Artificial Sequence: Synthetic oligonucleotide
gcccccaccactctgcagggg

SEQ ID NO: 111561 - DNA, 23 bp, Artificial Sequence
  Description of Artificial Sequence: Synthetic oligonucleotide
cccccaccactctgcagggggtt

SEQ ID NO: 111562 - DNA, 24 bp, Artificial Sequence
  Description of Artificial Sequence: Synthetic oligonucleotide
ccccaccactctgcagggggttgt

SEQ ID NO: 111563 - DNA, 27 bp, Artificial Sequence
  Description of Artificial Sequence: Synthetic oligonucleotide
cccaccactctgcagggggttgtgaaa

SEQ ID NO: 111564 - DNA, 29 bp, Artificial Sequence
  Description of Artificial Sequence: Synthetic oligonucleotide
ccaccactctgcagggggttgtgaaattc

SEQ ID NO: 111565 - DNA, 29 bp, Artificial Sequence
  Description of Artificial Sequence: Synthetic oligonucleotide
caccactctgcagggggttgtgaaattcc

SEQ ID NO: 111566 - DNA, 31 bp, Artificial Sequence
  Description of Artificial Sequence: Synthetic oligonucleotide
accactctgcagggggttgtgaaattccaag

SEQ ID NO: 111567 - DNA, 30 bp, Artificial Sequence
  Description of Artificial Sequence: Synthetic oligonucleotide
ccactctgcagggggttgtgaaattccaag

SEQ ID NO: 111568 - DNA, 31 bp, Artificial Sequence
  Description of Artificial Sequence: Synthetic oligonucleotide
cactctgcagggggttgtgaaattccaagac

SEQ ID NO: 111569 - DNA, 31 bp, Artificial Sequence
  Description of Artificial Sequence: Synthetic oligonucleotide
actctgcagggggttgtgaaattccaagacg

SEQ ID NO: 111570 - DNA, 30 bp, Artificial Sequence
  Description of Artificial Sequence: Synthetic oligonucleotide
ctctgcagggggttgtgaaattccaagacg

SEQ ID NO: 111571 - DNA, 31 bp, Artificial Sequence
  Description of Artificial Sequence: Synthetic oligonucleotide
tctgcagggggttgtgaaattccaagacgtc

SEQ ID NO: 111572 - DNA, 30 bp, Artificial Sequence
  Description of Artificial Sequence: Synthetic oligonucleotide
ctgcagggggttgtgaaattccaagacgtc

SEQ ID NO: 111573 - DNA, 31 bp, Artificial Sequence
  Description of Artificial Sequence: Synthetic oligonucleotide
tgcagggggttgtgaaattccaagacgtctc

SEQ ID NO: 111574 - DNA, 30 bp, Artificial Sequence
  Description of Artificial Sequence: Synthetic oligonucleotide
gcagggggttgtgaaattccaagacgtctc

SEQ ID NO: 111575 - DNA, 30 bp, Artificial Sequence
  Description of Artificial Sequence: Synthetic oligonucleotide
cagggggttgtgaaattccaagacgtctcc

SEQ ID NO: 111576 - DNA, 33 bp, Artificial Sequence
  Description of Artificial Sequence: Synthetic oligonucleotide
agggggttgtgaaattccaagacgtctcctttg

SEQ ID NO: 111577 - DNA, 32 bp, Artificial Sequence
  Description of Artificial Sequence: Synthetic oligonucleotide
gggggttgtgaaattccaagacgtctcctttg

SEQ ID NO: 111578 - DNA, 32 bp, Artificial Sequence
  Description of Artificial Sequence: Synthetic oligonucleotide
ggggttgtgaaattccaagacgtctcctttgc

SEQ ID NO: 111579 - DNA, 36 bp, Artificial Sequence
  Description of Artificial Sequence: Synthetic oligonucleotide
gggttgtgaaattccaagacgtctcctttgcatatc

SEQ ID NO: 111580 - DNA, 36 bp, Artificial Sequence
  Description of Artificial Sequence: Synthetic oligonucleotide
ggttgtgaaattccaagacgtctcctttgcatatcc

SEQ ID NO: 111581 - DNA, 36 bp, Artificial Sequence
  Description of Artificial Sequence: Synthetic oligonucleotide
gttgtgaaattccaagacgtctcctttgcatatccc

SEQ ID NO: 111582 - DNA, 39 bp, Artificial Sequence
  Description of Artificial Sequence: Synthetic oligonucleotide
ttgtgaaattccaagacgtctcctttgcatatcccaatc

SEQ ID NO: 111583 - DNA, 38 bp, Artificial Sequence
  Description of Artificial Sequence: Synthetic oligonucleotide
tgtgaaattccaagacgtctcctttgcatatcccaatc

SEQ ID NO: 111584 - DNA, 37 bp, Artificial Sequence
  Description of Artificial Sequence: Synthetic oligonucleotide
gtgaaattccaagacgtctcctttgcatatcccaatc

SEQ ID NO: 111585 - DNA, 37 bp, Artificial Sequence
  Description of Artificial Sequence: Synthetic oligonucleotide
tgaaattccaagacgtctcctttgcatatcccaatcg

SEQ ID NO: 111586 - DNA, 36 bp, Artificial Sequence
  Description of Artificial Sequence: Synthetic oligonucleotide
gaaattccaagacgtctcctttgcatatcccaatcg

SEQ ID NO: 111587 - DNA, 36 bp, Artificial Sequence
  Description of Artificial Sequence: Synthetic oligonucleotide
aaattccaagacgtctcctttgcatatcccaatcgc

SEQ ID NO: 111588 - DNA, 35 bp, Artificial Sequence
  Description of Artificial Sequence: Synthetic oligonucleotide
aattccaagacgtctcctttgcatatcccaatcgc

SEQ ID NO: 111589 - DNA, 34 bp, Artificial Sequence
  Description of Artificial Sequence: Synthetic oligonucleotide
attccaagacgtctcctttgcatatcccaatcgc

SEQ ID NO: 111590 - DNA, 33 bp, Artificial Sequence
  Description of Artificial Sequence: Synthetic oligonucleotide
ttccaagacgtctcctttgcatatcccaatcgc

SEQ ID NO: 111591 - DNA, 32 bp, Artificial Sequence
  Description of Artificial Sequence: Synthetic oligonucleotide
tccaagacgtctcctttgcatatcccaatcgc

SEQ ID NO: 111592 - DNA, 31 bp, Artificial Sequence
  Description of Artificial Sequence: Synthetic oligonucleotide
ccaagacgtctcctttgcatatcccaatcgc

SEQ ID NO: 111593 - DNA, 31 bp, Artificial Sequence
  Description of Artificial Sequence: Synthetic oligonucleotide
caagacgtctcctttgcatatcccaatcgcc

SEQ ID NO: 111594 - DNA, 31 bp, Artificial Sequence
  Description of Artificial Sequence: Synthetic oligonucleotide
aagacgtctcctttgcatatcccaatcgccc

SEQ ID NO: 111595 - DNA, 30 bp, Artificial Sequence
  Description of Artificial Sequence: Synthetic oligonucleotide
agacgtctcctttgcatatcccaatcgccc

SEQ ID NO: 111596 - DNA, 29 bp, Artificial Sequence
  Description of Artificial Sequence: Synthetic oligonucleotide
gacgtctcctttgcatatcccaatcgccc

SEQ ID NO: 111597 - DNA, 30 bp, Artificial Sequence
  Description of Artificial Sequence: Synthetic oligonucleotide
acgtctcctttgcatatcccaatcgccctg

SEQ ID NO: 111598 - DNA, 29 bp, Artificial Sequence
  Description of Artificial Sequence: Synthetic oligonucleotide
cgtctcctttgcatatcccaatcgccctg

SEQ ID NO: 111599 - DNA, 30 bp, Artificial Sequence
  Description of Artificial Sequence: Synthetic oligonucleotide
gtctcctttgcatatcccaatcgccctgac

SEQ ID NO: 111600 - DNA, 31 bp, Artificial Sequence
  Description of Artificial Sequence: Synthetic oligonucleotide
tctcctttgcatatcccaatcgccctgacag

SEQ ID NO: 111601 - DNA, 30 bp, Artificial Sequence
  Description of Artificial Sequence: Synthetic oligonucleotide
ctcctttgcatatcccaatcgccctgacag

SEQ ID NO: 111602 - DNA, 30 bp, Artificial Sequence
  Description of Artificial Sequence: Synthetic oligonucleotide
tcctttgcatatcccaatcgccctgacagg

SEQ ID NO: 111603 - DNA, 29 bp, Artificial Sequence
  Description of Artificial Sequence: Synthetic oligonucleotide
cctttgcatatcccaatcgccctgacagg

SEQ ID NO: 111604 - DNA, 29 bp, Artificial Sequence
  Description of Artificial Sequence: Synthetic oligonucleotide
ctttgcatatcccaatcgccctgacaggc

SEQ ID NO: 111605 - DNA, 29 bp, Artificial Sequence
  Description of Artificial Sequence: Synthetic oligonucleotide
tttgcatatcccaatcgccctgacaggcc

SEQ ID NO: 111606 - DNA, 28 bp, Artificial Sequence
  Description of Artificial Sequence: Synthetic oligonucleotide
ttgcatatcccaatcgccctgacaggcc

SEQ ID NO: 111607 - DNA, 27 bp, Artificial Sequence
  Description of Artificial Sequence: Synthetic oligonucleotide
tgcatatcccaatcgccctgacaggcc

SEQ ID NO: 111608 - DNA, 27 bp, Artificial Sequence
  Description of Artificial Sequence: Synthetic oligonucleotide
gcatatcccaatcgccctgacaggcct

SEQ ID NO: 111609 - DNA, 27 bp, Artificial Sequence
  Description of Artificial Sequence: Synthetic oligonucleotide
catatcccaatcgccctgacaggcctg

SEQ ID NO: 111610 - DNA, 28 bp, Artificial Sequence
  Description of Artificial Sequence: Synthetic oligonucleotide
atatcccaatcgccctgacaggcctgtg

SEQ ID NO: 111611 - DNA, 27 bp, Artificial Sequence
  Description of Artificial Sequence: Synthetic oligonucleotide
tatcccaatcgccctgacaggcctgtg

SEQ ID NO: 111612 - DNA, 26 bp, Artificial Sequence
  Description of Artificial Sequence: Synthetic oligonucleotide
atcccaatcgccctgacaggcctgtg

SEQ ID NO: 111613 - DNA, 25 bp, Artificial Sequence
  Description of Artificial Sequence: Synthetic oligonucleotide
tcccaatcgccctgacaggcctgtg

SEQ ID NO: 111614 - DNA, 24 bp, Artificial Sequence
  Description of Artificial Sequence: Synthetic oligonucleotide
cccaatcgccctgacaggcctgtg

SEQ ID NO: 111615 - DNA, 25 bp, Artificial Sequence
  Description of Artificial Sequence: Synthetic oligonucleotide
ccaatcgccctgacaggcctgtgct

SEQ ID NO: 111616 - DNA, 27 bp, Artificial Sequence
  Description of Artificial Sequence: Synthetic oligonucleotide
caatcgccctgacaggcctgtgctcaa

SEQ ID NO: 111617 - DNA, 27 bp, Artificial Sequence
  Description of Artificial Sequence: Synthetic oligonucleotide
aatcgccctgacaggcctgtgctcaag

SEQ ID NO: 111618 - DNA, 26 bp, Artificial Sequence
  Description of Artificial Sequence: Synthetic oligonucleotide
atcgccctgacaggcctgtgctcaag

SEQ ID NO: 111619 - DNA, 25 bp, Artificial Sequence
  Description of Artificial Sequence: Synthetic oligonucleotide
tcgccctgacaggcctgtgctcaag

SEQ ID NO: 111620 - DNA, 24 bp, Artificial Sequence
  Description of Artificial Sequence: Synthetic oligonucleotide
cgccctgacaggcctgtgctcaag

SEQ ID NO: 111621 - DNA, 24 bp, Artificial Sequence
  Description of Artificial Sequence: Synthetic oligonucleotide
gccctgacaggcctgtgctcaagg

SEQ ID NO: 111622 - DNA, 24 bp, Artificial Sequence
  Description of Artificial Sequence: Synthetic oligonucleotide
ccctgacaggcctgtgctcaaggg

SEQ ID NO: 111623 - DNA, 24 bp, Artificial Sequence
  Description of Artificial Sequence: Synthetic oligonucleotide
cctgacaggcctgtgctcaagggg

SEQ ID NO: 111624 - DNA, 25 bp, Artificial Sequence
  Description of Artificial Sequence: Synthetic oligonucleotide
ctgacaggcctgtgctcaaggggct

SEQ ID NO: 111625 - DNA, 26 bp, Artificial Sequence
  Description of Artificial Sequence: Synthetic oligonucleotide
tgacaggcctgtgctcaaggggctga

SEQ ID NO: 111626 - DNA, 25 bp, Artificial Sequence
  Description of Artificial Sequence: Synthetic oligonucleotide
gacaggcctgtgctcaaggggctga

SEQ ID NO: 111627 - DNA, 25 bp, Artificial Sequence
  Description of Artificial Sequence: Synthetic oligonucleotide
acaggcctgtgctcaaggggctgac

SEQ ID NO: 111628 - DNA, 24 bp, Artificial Sequence
  Description of Artificial Sequence: Synthetic oligonucleotide
caggcctgtgctcaaggggctgac

SEQ ID NO: 111629 - DNA, 27 bp, Artificial Sequence
  Description of Artificial Sequence: Synthetic oligonucleotide
aggcctgtgctcaaggggctgacgttt

SEQ ID NO: 111630 - DNA, 27 bp, Artificial Sequence
  Description of Artificial Sequence: Synthetic oligonucleotide
ggcctgtgctcaaggggctgacgttta

SEQ ID NO: 111631 - DNA, 27 bp, Artificial Sequence
  Description of Artificial Sequence: Synthetic oligonucleotide
gcctgtgctcaaggggctgacgtttac

SEQ ID NO: 111632 - DNA, 27 bp, Artificial Sequence
  Description of Artificial Sequence: Synthetic oligonucleotide
cctgtgctcaaggggctgacgtttacc

SEQ ID NO: 111633 - DNA, 27 bp, Artificial Sequence
  Description of Artificial Sequence: Synthetic oligonucleotide
ctgtgctcaaggggctgacgtttaccc

SEQ ID NO: 111634 - DNA, 29 bp, Artificial Sequence
  Description of Artificial Sequence: Synthetic oligonucleotide
tgtgctcaaggggctgacgtttaccctac

SEQ ID NO: 111635 - DNA, 28 bp, Artificial Sequence
  Description of Artificial Sequence: Synthetic oligonucleotide
gtgctcaaggggctgacgtttaccctac

SEQ ID NO: 111636 - DNA, 28 bp, Artificial Sequence
  Description of Artificial Sequence: Synthetic oligonucleotide
tgctcaaggggctgacgtttaccctacg

SEQ ID NO: 111637 - DNA, 27 bp, Artificial Sequence
  Description of Artificial Sequence: Synthetic oligonucleotide
gctcaaggggctgacgtttaccctacg

SEQ ID NO: 111638 - DNA, 28 bp, Artificial Sequence
  Description of Artificial Sequence: Synthetic oligonucleotide
ctcaaggggctgacgtttaccctacgtc

SEQ ID NO: 111639 - DNA, 28 bp, Artificial Sequence
  Description of Artificial Sequence: Synthetic oligonucleotide
tcaaggggctgacgtttaccctacgtcc

SEQ ID NO: 111640 - DNA, 27 bp, Artificial Sequence
  Description of Artificial Sequence: Synthetic oligonucleotide
caaggggctgacgtttaccctacgtcc

SEQ ID NO: 111641 - DNA, 28 bp, Artificial Sequence
  Description of Artificial Sequence: Synthetic oligonucleotide
aaggggctgacgtttaccctacgtcctg

SEQ ID NO: 111642 - DNA, 27 bp, Artificial Sequence
  Description of Artificial Sequence: Synthetic oligonucleotide
aggggctgacgtttaccctacgtcctg

SEQ ID NO: 111643 - DNA, 26 bp, Artificial Sequence
  Description of Artificial Sequence: Synthetic oligonucleotide
ggggctgacgtttaccctacgtcctg

SEQ ID NO: 111644 - DNA, 27 bp, Artificial Sequence
  Description of Artificial Sequence: Synthetic oligonucleotide
gggctgacgtttaccctacgtcctggt

SEQ ID NO: 111645 - DNA, 27 bp, Artificial Sequence
  Description of Artificial Sequence: Synthetic oligonucleotide
ggctgacgtttaccctacgtcctggtg

SEQ ID NO: 111646 - DNA, 28 bp, Artificial Sequence
  Description of Artificial Sequence: Synthetic oligonucleotide
gctgacgtttaccctacgtcctggtgag

SEQ ID NO: 111647 - DNA, 28 bp, Artificial Sequence
  Description of Artificial Sequence: Synthetic oligonucleotide
ctgacgtttaccctacgtcctggtgagg

SEQ ID NO: 111648 - DNA, 29 bp, Artificial Sequence
  Description of Artificial Sequence: Synthetic oligonucleotide
tgacgtttaccctacgtcctggtgaggtg

SEQ ID NO: 111649 - DNA, 28 bp, Artificial Sequence
  Description of Artificial Sequence: Synthetic oligonucleotide
gacgtttaccctacgtcctggtgaggtg

SEQ ID NO: 111650 - DNA, 29 bp, Artificial Sequence
  Description of Artificial Sequence: Synthetic oligonucleotide
acgtttaccctacgtcctggtgaggtgac

SEQ ID NO: 111651 - DNA, 28 bp, Artificial Sequence
  Description of Artificial Sequence: Synthetic oligonucleotide
cgtttaccctacgtcctggtgaggtgac

SEQ ID NO: 111652 - DNA, 28 bp, Artificial Sequence
  Description of Artificial Sequence: Synthetic oligonucleotide
gtttaccctacgtcctggtgaggtgacg

SEQ ID NO: 111653 - DNA, 28 bp, Artificial Sequence
  Description of Artificial Sequence: Synthetic oligonucleotide
tttaccctacgtcctggtgaggtgacgg

SEQ ID NO: 111654 - DNA, 27 bp, Artificial Sequence
  Description of Artificial Sequence: Synthetic oligonucleotide
ttaccctacgtcctggtgaggtgacgg

SEQ ID NO: 111655 - DNA, 26 bp, Artificial Sequence
  Description of Artificial Sequence: Synthetic oligonucleotide
taccctacgtcctggtgaggtgacgg

SEQ ID NO: 111656 - DNA, 25 bp, Artificial Sequence
  Description of Artificial Sequence: Synthetic oligonucleotide
accctacgtcctggtgaggtgacgg

SEQ ID NO: 111657 - DNA, 24 bp, Artificial Sequence
  Description of Artificial Sequence: Synthetic oligonucleotide
ccctacgtcctggtgaggtgacgg

SEQ ID NO: 111658 - DNA, 24 bp, Artificial Sequence
  Description of Artificial Sequence: Synthetic oligonucleotide
cctacgtcctggtgaggtgacggc

SEQ ID NO: 111659 - DNA, 24 bp, Artificial Sequence
  Description of Artificial Sequence: Synthetic oligonucleotide
ctacgtcctggtgaggtgacggcg

SEQ ID NO: 111660 - DNA, 25 bp, Artificial Sequence
  Description of Artificial Sequence: Synthetic oligonucleotide
tacgtcctggtgaggtgacggcgct

SEQ ID NO: 111661 - DNA, 24 bp, Artificial Sequence
  Description of Artificial Sequence: Synthetic oligonucleotide
acgtcctggtgaggtgacggcgct

SEQ ID NO: 111662 - DNA, 23 bp, Artificial Sequence
  Description of Artificial Sequence: Synthetic oligonucleotide
cgtcctggtgaggtgacggcgct

SEQ ID NO: 111663 - DNA, 23 bp, Artificial Sequence
  Description of Artificial Sequence: Synthetic oligonucleotide
gtcctggtgaggtgacggcgctg

SEQ ID NO: 111664 - DNA, 24 bp, Artificial Sequence
  Description of Artificial Sequence: Synthetic oligonucleotide
tcctggtgaggtgacggcgctggt

SEQ ID NO: 111665 - DNA, 23 bp, Artificial Sequence
  Description of Artificial Sequence: Synthetic oligonucleotide
cctggtgaggtgacggcgctggt

SEQ ID NO: 111666 - DNA, 23 bp, Artificial Sequence
  Description of Artificial Sequence: Synthetic oligonucleotide
ctggtgaggtgacggcgctggtg

SEQ ID NO: 111667 - DNA, 23 bp, Artificial Sequence
  Description of Artificial Sequence: Synthetic oligonucleotide
tggtgaggtgacggcgctggtgg

SEQ ID NO: 111668 - DNA, 22 bp, Artificial Sequence
  Description of Artificial Sequence: Synthetic oligonucleotide
ggtgaggtgacggcgctggtgg

SEQ ID NO: 111669 - DNA, 23 bp, Artificial Sequence
  Description of Artificial Sequence: Synthetic oligonucleotide
gtgaggtgacggcgctggtggga

SEQ ID NO: 111670 - DNA, 23 bp, Artificial Sequence
  Description of Artificial Sequence: Synthetic oligonucleotide
tgaggtgacggcgctggtgggac

SEQ ID NO: 111671 - DNA, 28 bp, Artificial Sequence
  Description of Artificial Sequence: Synthetic oligonucleotide
ctgctgcagaatctgtaccagcccacag

SEQ ID NO: 111672 - DNA, 28 bp, Artificial Sequence
  Description of Artificial Sequence: Synthetic oligonucleotide
tgctgcagaatctgtaccagcccacagg

SEQ ID NO: 111673 - DNA, 27 bp, Artificial Sequence
  Description of Artificial Sequence: Synthetic oligonucleotide
gctgcagaatctgtaccagcccacagg

SEQ ID NO: 111674 - DNA, 27 bp, Artificial Sequence
  Description of Artificial Sequence: Synthetic oligonucleotide
ctgcagaatctgtaccagcccacaggg

SEQ ID NO: 111675 - DNA, 27 bp, Artificial Sequence
  Description of Artificial Sequence: Synthetic oligonucleotide
tgcagaatctgtaccagcccacagggg

SEQ ID NO: 111676 - DNA, 26 bp, Artificial Sequence
  Description of Artificial Sequence: Synthetic oligonucleotide
gcagaatctgtaccagcccacagggg

SEQ ID NO: 111677 - DNA, 27 bp, Artificial Sequence
  Description of Artificial Sequence: Synthetic oligonucleotide
cagaatctgtaccagcccacaggggga

SEQ ID NO: 111678 - DNA, 27 bp, Artificial Sequence
  Description of Artificial Sequence: Synthetic oligonucleotide
agaatctgtaccagcccacagggggac

SEQ ID NO: 111679 - DNA, 27 bp, Artificial Sequence
  Description of Artificial Sequence: Synthetic oligonucleotide
gaatctgtaccagcccacagggggaca

SEQ ID NO: 111680 - DNA, 27 bp, Artificial Sequence
  Description of Artificial Sequence: Synthetic oligonucleotide
aatctgtaccagcccacagggggacag

SEQ ID NO: 111681 - DNA, 26 bp, Artificial Sequence
  Description of Artificial Sequence: Synthetic oligonucleotide
atctgtaccagcccacagggggacag

SEQ ID NO: 111682 - DNA, 25 bp, Artificial Sequence
  Description of Artificial Sequence: Synthetic oligonucleotide
tctgtaccagcccacagggggacag

SEQ ID NO: 111683 - DNA, 24 bp, Artificial Sequence
  Description of Artificial Sequence: Synthetic oligonucleotide
ctgtaccagcccacagggggacag

SEQ ID NO: 111684 - DNA, 25 bp, Artificial Sequence
  Description of Artificial Sequence: Synthetic oligonucleotide
tgtaccagcccacagggggacaggt

SEQ ID NO: 111685 - DNA, 24 bp, Artificial Sequence
  Description of Artificial Sequence: Synthetic oligonucleotide
gtaccagcccacagggggacaggt

SEQ ID NO: 111686 - DNA, 24 bp, Artificial Sequence
  Description of Artificial Sequence: Synthetic oligonucleotide
taccagcccacagggggacaggtg

SEQ ID NO: 111687 - DNA, 23 bp, Artificial Sequence
  Description of Artificial Sequence: Synthetic oligonucleotide
accagcccacagggggacaggtg

SEQ ID NO: 111688 - DNA, 22 bp, Artificial Sequence
  Description of Artificial Sequence: Synthetic oligonucleotide
ccagcccacagggggacaggtg

SEQ ID NO: 111689 - DNA, 23 bp, Artificial Sequence
  Description of Artificial Sequence: Synthetic oligonucleotide
cagcccacagggggacaggtgct

SEQ ID NO: 111690 - DNA, 23 bp, Artificial Sequence
  Description of Artificial Sequence: Synthetic oligonucleotide
agcccacagggggacaggtgctg

SEQ ID NO: 111691 - DNA, 22 bp, Artificial Sequence
  Description of Artificial Sequence: Synthetic oligonucleotide
gcccacagggggacaggtgctg

SEQ ID NO: 111692 - DNA, 23 bp, Artificial Sequence
  Description of Artificial Sequence: Synthetic oligonucleotide
cccacagggggacaggtgctgct

SEQ ID NO: 111693 - DNA, 23 bp, Artificial Sequence
  Description of Artificial Sequence: Synthetic oligonucleotide
ccacagggggacaggtgctgctg

SEQ ID NO: 111694 - DNA, 25 bp, Artificial Sequence
  Description of Artificial Sequence: Synthetic oligonucleotide
cacagggggacaggtgctgctggat

SEQ ID NO: 111695 - DNA, 27 bp, Artificial Sequence
  Description of Artificial Sequence: Synthetic oligonucleotide
acagggggacaggtgctgctggatgaa

SEQ ID NO: 111696 - DNA, 27 bp, Artificial Sequence
  Description of Artificial Sequence: Synthetic oligonucleotide
cagggggacaggtgctgctggatgaaa

SEQ ID NO: 111697 - DNA, 28 bp, Artificial Sequence
  Description of Artificial Sequence: Synthetic oligonucleotide
agggggacaggtgctgctggatgaaaag

SEQ ID NO: 111698 - DNA, 27 bp, Artificial Sequence
  Description of Artificial Sequence: Synthetic oligonucleotide
gggggacaggtgctgctggatgaaaag

SEQ ID NO: 111699 - DNA, 27 bp, Artificial Sequence
  Description of Artificial Sequence: Synthetic oligonucleotide
ggggacaggtgctgctggatgaaaagc

SEQ ID NO: 111700 - DNA, 27 bp, Artificial Sequence
  Description of Artificial Sequence: Synthetic oligonucleotide
gggacaggtgctgctggatgaaaagcc

SEQ ID NO: 111701 - DNA, 27 bp, Artificial Sequence
  Description of Artificial Sequence: Synthetic oligonucleotide
ggacaggtgctgctggatgaaaagccc

SEQ ID NO: 111702 - DNA, 29 bp, Artificial Sequence
  Description of Artificial Sequence: Synthetic oligonucleotide
gacaggtgctgctggatgaaaagcccatc

SEQ ID NO: 111703 - DNA, 30 bp, Artificial Sequence
  Description of Artificial Sequence: Synthetic oligonucleotide
acaggtgctgctggatgaaaagcccatctc

SEQ ID NO: 111704 - DNA, 29 bp, Artificial Sequence
  Description of Artificial Sequence: Synthetic oligonucleotide
caggtgctgctggatgaaaagcccatctc

SEQ ID NO: 111705 - DNA, 30 bp, Artificial Sequence
  Description of Artificial Sequence: Synthetic oligonucleotide
aggtgctgctggatgaaaagcccatctcac

SEQ ID NO: 111706 - DNA, 29 bp, Artificial Sequence
  Description of Artificial Sequence: Synthetic oligonucleotide
ggtgctgctggatgaaaagcccatctcac

SEQ ID NO: 111707 - DNA, 30 bp, Artificial Sequence
  Description of Artificial Sequence: Synthetic oligonucleotide
gtgctgctggatgaaaagcccatctcacag

SEQ ID NO: 111708 - DNA, 33 bp, Artificial Sequence
  Description of Artificial Sequence: Synthetic oligonucleotide
tgctgctggatgaaaagcccatctcacagtatg

SEQ ID NO: 111709 - DNA, 32 bp, Artificial Sequence
  Description of Artificial Sequence: Synthetic oligonucleotide
gctgctggatgaaaagcccatctcacagtatg

SEQ ID NO: 111710 - DNA, 34 bp, Artificial Sequence
  Description of Artificial Sequence: Synthetic oligonucleotide
ctgctggatgaaaagcccatctcacagtatgaac

SEQ ID NO: 111711 - DNA, 35 bp, Artificial Sequence
  Description of Artificial Sequence: Synthetic oligonucleotide
tgctggatgaaaagcccatctcacagtatgaacac

SEQ ID NO: 111712 - DNA, 34 bp, Artificial Sequence
  Description of Artificial Sequence: Synthetic oligonucleotide
gctggatgaaaagcccatctcacagtatgaacac

SEQ ID NO: 111713 - DNA, 35 bp, Artificial Sequence
  Description of Artificial Sequence: Synthetic oligonucleotide
ctggatgaaaagcccatctcacagtatgaacactg

SEQ ID NO: 111714 - DNA, 35 bp, Artificial Sequence
  Description of Artificial Sequence: Synthetic oligonucleotide
tggatgaaaagcccatctcacagtatgaacactgc

SEQ ID NO: 111715 - DNA, 34 bp, Artificial Sequence
  Description of Artificial Sequence: Synthetic oligonucleotide
ggatgaaaagcccatctcacagtatgaacactgc

SEQ ID NO: 111716 - DNA, 36 bp, Artificial Sequence
  Description of Artificial Sequence: Synthetic oligonucleotide
gatgaaaagcccatctcacagtatgaacactgctac

SEQ ID NO: 111717 - DNA, 36 bp, Artificial Sequence
  Description of Artificial Sequence: Synthetic oligonucleotide
atgaaaagcccatctcacagtatgaacactgctacc

SEQ ID NO: 111718 - DNA, 35 bp, Artificial Sequence
  Description of Artificial Sequence: Synthetic oligonucleotide
tgaaaagcccatctcacagtatgaacactgctacc

SEQ ID NO: 111719 - DNA, 34 bp, Artificial Sequence
  Description of Artificial Sequence: Synthetic oligonucleotide
gaaaagcccatctcacagtatgaacactgctacc

SEQ ID NO: 111720 - DNA, 35 bp, Artificial Sequence
  Description of Artificial Sequence: Synthetic oligonucleotide
aaaagcccatctcacagtatgaacactgctacctg

SEQ ID NO: 111721 - DNA, 34 bp, Artificial Sequence
  Description of Artificial Sequence: Synthetic oligonucleotide
aaagcccatctcacagtatgaacactgctacctg

SEQ ID NO: 111722 - DNA, 33 bp, Artificial Sequence
  Description of Artificial Sequence: Synthetic oligonucleotide
aagcccatctcacagtatgaacactgctacctg

SEQ ID NO: 111723 - DNA, 32 bp, Artificial Sequence
  Description of Artificial Sequence: Synthetic oligonucleotide
agcccatctcacagtatgaacactgctacctg

SEQ ID NO: 111724 - DNA, 31 bp, Artificial Sequence
  Description of Artificial Sequence: Synthetic oligonucleotide
gcccatctcacagtatgaacactgctacctg

SEQ ID NO: 111725 - DNA, 31 bp, Artificial Sequence
  Description of Artificial Sequence: Synthetic oligonucleotide
cccatctcacagtatgaacactgctacctgc

SEQ ID NO: 111726 - DNA, 32 bp, Artificial Sequence
  Description of Artificial Sequence: Synthetic oligonucleotide
ccatctcacagtatgaacactgctacctgcac

SEQ ID NO: 111727 - DNA, 33 bp, Artificial Sequence
  Description of Artificial Sequence: Synthetic oligonucleotide
catctcacagtatgaacactgctacctgcacag

SEQ ID NO: 111728 - DNA, 33 bp, Artificial Sequence
  Description of Artificial Sequence: Synthetic oligonucleotide
atctcacagtatgaacactgctacctgcacagc

SEQ ID NO: 111729 - DNA, 32 bp, Artificial Sequence
  Description of Artificial Sequence: Synthetic oligonucleotide
tctcacagtatgaacactgctacctgcacagc

SEQ ID NO: 111730 - DNA, 31 bp, Artificial Sequence
  Description of Artificial Sequence: Synthetic oligonucleotide
ctcacagtatgaacactgctacctgcacagc

SEQ ID NO: 111731 - DNA, 31 bp, Artificial Sequence
  Description of Artificial Sequence: Synthetic oligonucleotide
tcacagtatgaacactgctacctgcacagcc

SEQ ID NO: 111732 - DNA, 30 bp, Artificial Sequence
  Description of Artificial Sequence: Synthetic oligonucleotide
cacagtatgaacactgctacctgcacagcc

SEQ ID NO: 111733 - DNA, 31 bp, Artificial Sequence
  Description of Artificial Sequence: Synthetic oligonucleotide
acagtatgaacactgctacctgcacagccag

SEQ ID NO: 111734 - DNA, 30 bp, Artificial Sequence
  Description of Artificial Sequence: Synthetic oligonucleotide
cagtatgaacactgctacctgcacagccag

SEQ ID NO: 111735 - DNA, 30 bp, Artificial Sequence
  Description of Artificial Sequence: Synthetic oligonucleotide
agtatgaacactgctacctgcacagccagg

SEQ ID NO: 111736 - DNA, 29 bp, Artificial Sequence
  Description of Artificial Sequence: Synthetic oligonucleotide
gtatgaacactgctacctgcacagccagg

SEQ ID NO: 111737 - DNA, 30 bp, Artificial Sequence
  Description of Artificial Sequence: Synthetic oligonucleotide
tatgaacactgctacctgcacagccaggtg

SEQ ID NO: 111738 - DNA, 29 bp, Artificial Sequence
  Description of Artificial Sequence: Synthetic oligonucleotide
atgaacactgctacctgcacagccaggtg

SEQ ID NO: 111739 - DNA, 28 bp, Artificial Sequence
  Description of Artificial Sequence: Synthetic oligonucleotide
tgaacactgctacctgcacagccaggtg

SEQ ID NO: 111740 - DNA, 27 bp, Artificial Sequence
  Description of Artificial Sequence: Synthetic oligonucleotide
gaacactgctacctgcacagccaggtg

SEQ ID NO: 111741 - DNA, 27 bp, Artificial Sequence
  Description of Artificial Sequence: Synthetic oligonucleotide
aacactgctacctgcacagccaggtgg

SEQ ID NO: 111742 - DNA, 27 bp, Artificial Sequence
  Description of Artificial Sequence: Synthetic oligonucleotide
acactgctacctgcacagccaggtggt

SEQ ID NO: 111743 - DNA, 27 bp, Artificial Sequence
  Description of Artificial Sequence: Synthetic oligonucleotide
cactgctacctgcacagccaggtggtt

SEQ ID NO: 111744 - DNA, 28 bp, Artificial Sequence
  Description of Artificial Sequence: Synthetic oligonucleotide
actgctacctgcacagccaggtggtttc

SEQ ID NO: 111745 - DNA, 27 bp, Artificial Sequence
  Description of Artificial Sequence: Synthetic oligonucleotide
ctgctacctgcacagccaggtggtttc

SEQ ID NO: 111746 - DNA, 28 bp, Artificial Sequence
  Description of Artificial Sequence: Synthetic oligonucleotide
tgctacctgcacagccaggtggtttcag

SEQ ID NO: 111747 - DNA, 27 bp, Artificial Sequence
  Description of Artificial Sequence: Synthetic oligonucleotide
gctacctgcacagccaggtggtttcag

SEQ ID NO: 111748 - DNA, 29 bp, Artificial Sequence
  Description of Artificial Sequence: Synthetic oligonucleotide
ctacctgcacagccaggtggtttcagttg

SEQ ID NO: 111749 - DNA, 29 bp, Artificial Sequence
  Description of Artificial Sequence: Synthetic oligonucleotide
tacctgcacagccaggtggtttcagttgg

SEQ ID NO: 111750 - DNA, 28 bp, Artificial Sequence
  Description of Artificial Sequence: Synthetic oligonucleotide
acctgcacagccaggtggtttcagttgg

SEQ ID NO: 111751 - DNA, 27 bp, Artificial Sequence
  Description of Artificial Sequence: Synthetic oligonucleotide
cctgcacagccaggtggtttcagttgg

SEQ ID NO: 111752 - DNA, 27 bp, Artificial Sequence
  Description of Artificial Sequence: Synthetic oligonucleotide
ctgcacagccaggtggtttcagttggg

SEQ ID NO: 111753 - DNA, 27 bp, Artificial Sequence
  Description of Artificial Sequence: Synthetic oligonucleotide
tgcacagccaggtggtttcagttgggc

SEQ ID NO: 111754 - DNA, 27 bp, Artificial Sequence
  Description of Artificial Sequence: Synthetic oligonucleotide
gcacagccaggtggtttcagttgggca

SEQ ID NO: 111755 - DNA, 27 bp, Artificial Sequence
  Description of Artificial Sequence: Synthetic oligonucleotide
cacagccaggtggtttcagttgggcag

SEQ ID NO: 111756 - DNA, 27 bp, Artificial Sequence
  Description of Artificial Sequence: Synthetic oligonucleotide
acagccaggtggtttcagttgggcagg

SEQ ID NO: 111757 - DNA, 27 bp, Artificial Sequence
  Description of Artificial Sequence: Synthetic oligonucleotide
cagccaggtggtttcagttgggcagga

SEQ ID NO: 111758 - DNA, 27 bp, Artificial Sequence
  Description of Artificial Sequence: Synthetic oligonucleotide
agccaggtggtttcagttgggcaggag

SEQ ID NO: 111759 - DNA, 26 bp, Artificial Sequence
  Description of Artificial Sequence: Synthetic oligonucleotide
gccaggtggtttcagttgggcaggag

SEQ ID NO: 111760 - DNA, 26 bp, Artificial Sequence
  Description of Artificial Sequence: Synthetic oligonucleotide
ccaggtggtttcagttgggcaggagc

SEQ ID NO: 111761 - DNA, 27 bp, Artificial Sequence
  Description of Artificial Sequence: Synthetic oligonucleotide
caggtggtttcagttgggcaggagcct

SEQ ID NO: 111762 - DNA, 27 bp, Artificial Sequence
  Description of Artificial Sequence: Synthetic oligonucleotide
aggtggtttcagttgggcaggagcctg

SEQ ID NO: 111763 - DNA, 27 bp, Artificial Sequence
  Description of Artificial Sequence: Synthetic oligonucleotide
ggtggtttcagttgggcaggagcctgt

SEQ ID NO: 111764 - DNA, 27 bp, Artificial Sequence
  Description of Artificial Sequence: Synthetic oligonucleotide
gtggtttcagttgggcaggagcctgtg

SEQ ID NO: 111765 - DNA, 27 bp, Artificial Sequence
  Description of Artificial Sequence: Synthetic oligonucleotide
tggtttcagttgggcaggagcctgtgc

SEQ ID NO: 111766 - DNA, 27 bp, Artificial Sequence
  Description of Artificial Sequence: Synthetic oligonucleotide
ggtttcagttgggcaggagcctgtgct

SEQ ID NO: 111767 - DNA, 27 bp, Artificial Sequence
  Description of Artificial Sequence: Synthetic oligonucleotide
gtttcagttgggcaggagcctgtgctg

SEQ ID NO: 111768 - DNA, 29 bp, Artificial Sequence
  Description of Artificial Sequence: Synthetic oligonucleotide
tttcagttgggcaggagcctgtgctgttc

SEQ ID NO: 111769 - DNA, 28 bp, Artificial Sequence
  Description of Artificial Sequence: Synthetic oligonucleotide
ttcagttgggcaggagcctgtgctgttc

SEQ ID NO: 111770 - DNA, 27 bp, Artificial Sequence
  Description of Artificial Sequence: Synthetic oligonucleotide
tcagttgggcaggagcctgtgctgttc

SEQ ID NO: 111771 - DNA, 27 bp, Artificial Sequence
  Description of Artificial Sequence: Synthetic oligonucleotide
cagttgggcaggagcctgtgctgttct

SEQ ID NO: 111772 - DNA, 27 bp, Artificial Sequence
  Description of Artificial Sequence: Synthetic oligonucleotide
agttgggcaggagcctgtgctgttctc

SEQ ID NO: 111773 - DNA, 26 bp, Artificial Sequence
  Description of Artificial Sequence: Synthetic oligonucleotide
gttgggcaggagcctgtgctgttctc

SEQ ID NO: 111774 - DNA, 26 bp, Artificial Sequence
  Description of Artificial Sequence: Synthetic oligonucleotide
ttgggcaggagcctgtgctgttctcc

SEQ ID NO: 111775 - DNA, 25 bp, Artificial Sequence
  Description of Artificial Sequence: Synthetic oligonucleotide
tgggcaggagcctgtgctgttctcc

SEQ ID NO: 111776 - DNA, 24 bp, Artificial Sequence
  Description of Artificial Sequence: Synthetic oligonucleotide
gggcaggagcctgtgctgttctcc

SEQ ID NO: 111777 - DNA, 24 bp, Artificial Sequence
  Description of Artificial Sequence: Synthetic oligonucleotide
ggcaggagcctgtgctgttctccg

SEQ ID NO: 111778 - DNA, 26 bp, Artificial Sequence
  Description of Artificial Sequence: Synthetic oligonucleotide
gcaggagcctgtgctgttctccggtt

SEQ ID NO: 111779 - DNA, 27 bp, Artificial Sequence
  Description of Artificial Sequence: Synthetic oligonucleotide
caggagcctgtgctgttctccggttct

SEQ ID NO: 111780 - DNA, 27 bp, Artificial Sequence
  Description of Artificial Sequence: Synthetic oligonucleotide
aggagcctgtgctgttctccggttctg

SEQ ID NO: 111781 - DNA, 27 bp, Artificial Sequence
  Description of Artificial Sequence: Synthetic oligonucleotide
ggagcctgtgctgttctccggttctgt

SEQ ID NO: 111782 - DNA, 27 bp, Artificial Sequence
  Description of Artificial Sequence: Synthetic oligonucleotide
gagcctgtgctgttctccggttctgtg

SEQ ID NO: 111783 - DNA, 28 bp, Artificial Sequence
  Description of Artificial Sequence: Synthetic oligonucleotide
agcctgtgctgttctccggttctgtgag

SEQ ID NO: 111784 - DNA, 27 bp, Artificial Sequence
  Description of Artificial Sequence: Synthetic oligonucleotide
gcctgtgctgttctccggttctgtgag

SEQ ID NO: 111785 - DNA, 27 bp, Artificial Sequence
  Description of Artificial Sequence: Synthetic oligonucleotide
cctgtgctgttctccggttctgtgagg

SEQ ID NO: 111786 - DNA, 29 bp, Artificial Sequence
  Description of Artificial Sequence: Synthetic oligonucleotide
ctgtgctgttctccggttctgtgaggaac

SEQ ID NO: 111787 - DNA, 31 bp, Artificial Sequence
  Description of Artificial Sequence: Synthetic oligonucleotide
tgtgctgttctccggttctgtgaggaacaac

SEQ ID NO: 111788 - DNA, 30 bp, Artificial Sequence
  Description of Artificial Sequence: Synthetic oligonucleotide
gtgctgttctccggttctgtgaggaacaac

SEQ ID NO: 111789 - DNA, 33 bp, Artificial Sequence
  Description of Artificial Sequence: Synthetic oligonucleotide
tgctgttctccggttctgtgaggaacaacattg

SEQ ID NO: 111790 - DNA, 32 bp, Artificial Sequence
  Description of Artificial Sequence: Synthetic oligonucleotide
gctgttctccggttctgtgaggaacaacattg

SEQ ID NO: 111791 - DNA, 32 bp, Artificial Sequence
  Description of Artificial Sequence: Synthetic oligonucleotide
ctgttctccggttctgtgaggaacaacattgc

SEQ ID NO: 111792 - DNA, 36 bp, Artificial Sequence
  Description of Artificial Sequence: Synthetic oligonucleotide
tgttctccggttctgtgaggaacaacattgcttatg

SEQ ID NO: 111793 - DNA, 35 bp, Artificial Sequence
  Description of Artificial Sequence: Synthetic oligonucleotide
gttctccggttctgtgaggaacaacattgcttatg

SEQ ID NO: 111794 - DNA, 35 bp, Artificial Sequence
  Description of Artificial Sequence: Synthetic oligonucleotide
ttctccggttctgtgaggaacaacattgcttatgg

SEQ ID NO: 111795 - DNA, 34 bp, Artificial Sequence
  Description of Artificial Sequence: Synthetic oligonucleotide
tctccggttctgtgaggaacaacattgcttatgg

SEQ ID NO: 111796 - DNA, 33 bp, Artificial Sequence
  Description of Artificial Sequence: Synthetic oligonucleotide
ctccggttctgtgaggaacaacattgcttatgg

SEQ ID NO: 111797 - DNA, 33 bp, Artificial Sequence
  Description of Artificial Sequence: Synthetic oligonucleotide
tccggttctgtgaggaacaacattgcttatggg

SEQ ID NO: 111798 - DNA, 32 bp, Artificial Sequence
  Description of Artificial Sequence: Synthetic oligonucleotide
ccggttctgtgaggaacaacattgcttatggg

SEQ ID NO: 111799 - DNA, 32 bp, Artificial Sequence
  Description of Artificial Sequence: Synthetic oligonucleotide
cggttctgtgaggaacaacattgcttatgggc

SEQ ID NO: 111800 - DNA, 33 bp, Artificial Sequence
  Description of Artificial Sequence: Synthetic oligonucleotide
ggttctgtgaggaacaacattgcttatgggctg

SEQ ID NO: 111801 - DNA, 33 bp, Artificial Sequence
  Description of Artificial Sequence: Synthetic oligonucleotide
gttctgtgaggaacaacattgcttatgggctgc

SEQ ID NO: 111802 - DNA, 34 bp, Artificial Sequence
  Description of Artificial Sequence: Synthetic oligonucleotide
ttctgtgaggaacaacattgcttatgggctgcag

SEQ ID NO: 111803 - DNA, 33 bp, Artificial Sequence
  Description of Artificial Sequence: Synthetic oligonucleotide
tctgtgaggaacaacattgcttatgggctgcag

SEQ ID NO: 111804 - DNA, 32 bp, Artificial Sequence
  Description of Artificial Sequence: Synthetic oligonucleotide
ctgtgaggaacaacattgcttatgggctgcag

SEQ ID NO: 111805 - DNA, 33 bp, Artificial Sequence
  Description of Artificial Sequence: Synthetic oligonucleotide
tgtgaggaacaacattgcttatgggctgcagag

SEQ ID NO: 111806 - DNA, 32 bp, Artificial Sequence
  Description of Artificial Sequence: Synthetic oligonucleotide
gtgaggaacaacattgcttatgggctgcagag

SEQ ID NO: 111807 - DNA, 32 bp, Artificial Sequence
  Description of Artificial Sequence: Synthetic oligonucleotide
tgaggaacaacattgcttatgggctgcagagc

SEQ ID NO: 111808 - DNA, 31 bp, Artificial Sequence
  Description of Artificial Sequence: Synthetic oligonucleotide
gaggaacaacattgcttatgggctgcagagc

SEQ ID NO: 111809 - DNA, 32 bp, Artificial Sequence
  Description of Artificial Sequence: Synthetic oligonucleotide
aggaacaacattgcttatgggctgcagagctg

SEQ ID NO: 111810 - DNA, 31 bp, Artificial Sequence
  Description of Artificial Sequence: Synthetic oligonucleotide
ggaacaacattgcttatgggctgcagagctg

SEQ ID NO: 111811 - DNA, 31 bp, Artificial Sequence
  Description of Artificial Sequence: Synthetic oligonucleotide
gaacaacattgcttatgggctgcagagctgc

SEQ ID NO: 111812 - DNA, 31 bp, Artificial Sequence
  Description of Artificial Sequence: Synthetic oligonucleotide
aacaacattgcttatgggctgcagagctgcg

SEQ ID NO: 111813 - DNA, 30 bp, Artificial Sequence
  Description of Artificial Sequence: Synthetic oligonucleotide
acaacattgcttatgggctgcagagctgcg

SEQ ID NO: 111814 - DNA, 29 bp, Artificial Sequence
  Description of Artificial Sequence: Synthetic oligonucleotide
caacattgcttatgggctgcagagctgcg

SEQ ID NO: 111815 - DNA, 31 bp, Artificial Sequence
  Description of Artificial Sequence: Synthetic oligonucleotide
aacattgcttatgggctgcagagctgcgaag

SEQ ID NO: 111816 - DNA, 30 bp, Artificial Sequence
  Description of Artificial Sequence: Synthetic oligonucleotide
acattgcttatgggctgcagagctgcgaag

SEQ ID NO: 111817 - DNA, 29 bp, Artificial Sequence
  Description of Artificial Sequence: Synthetic oligonucleotide
cattgcttatgggctgcagagctgcgaag

SEQ ID NO: 111818 - DNA, 31 bp, Artificial Sequence
  Description of Artificial Sequence: Synthetic oligonucleotide
attgcttatgggctgcagagctgcgaagatg

SEQ ID NO: 111819 - DNA, 30 bp, Artificial Sequence
  Description of Artificial Sequence: Synthetic oligonucleotide
ttgcttatgggctgcagagctgcgaagatg

SEQ ID NO: 111820 - DNA, 29 bp, Artificial Sequence
  Description of Artificial Sequence: Synthetic oligonucleotide
tgcttatgggctgcagagctgcgaagatg

SEQ ID NO: 111821 - DNA, 28 bp, Artificial Sequence
  Description of Artificial Sequence: Synthetic oligonucleotide
gcttatgggctgcagagctgcgaagatg

SEQ ID NO: 111822 - DNA, 32 bp, Artificial Sequence
  Description of Artificial Sequence: Synthetic oligonucleotide
cttatgggctgcagagctgcgaagatgataag

SEQ ID NO: 111823 - DNA, 32 bp, Artificial Sequence
  Description of Artificial Sequence: Synthetic oligonucleotide
ttatgggctgcagagctgcgaagatgataagg

SEQ ID NO: 111824 - DNA, 31 bp, Artificial Sequence
  Description of Artificial Sequence: Synthetic oligonucleotide
tatgggctgcagagctgcgaagatgataagg

SEQ ID NO: 111825 - DNA, 30 bp, Artificial Sequence
  Description of Artificial Sequence: Synthetic oligonucleotide
atgggctgcagagctgcgaagatgataagg

SEQ ID NO: 111826 - DNA, 29 bp, Artificial Sequence
  Description of Artificial Sequence: Synthetic oligonucleotide
tgggctgcagagctgcgaagatgataagg

SEQ ID NO: 111827 - DNA, 28 bp, Artificial Sequence
  Description of Artificial Sequence: Synthetic oligonucleotide
gggctgcagagctgcgaagatgataagg

SEQ ID NO: 111828 - DNA, 29 bp, Artificial Sequence
  Description of Artificial Sequence: Synthetic oligonucleotide
ggctgcagagctgcgaagatgataaggtg

SEQ ID NO: 111829 - DNA, 31 bp, Artificial Sequence
  Description of Artificial Sequence: Synthetic oligonucleotide
gctgcagagctgcgaagatgataaggtgatg

SEQ ID NO: 111830 - DNA, 31 bp, Artificial Sequence
  Description of Artificial Sequence: Synthetic oligonucleotide
ctgcagagctgcgaagatgataaggtgatgg

SEQ ID NO: 111831 - DNA, 31 bp, Artificial Sequence
  Description of Artificial Sequence: Synthetic oligonucleotide
tgcagagctgcgaagatgataaggtgatggc

SEQ ID NO: 111832 - DNA, 30 bp, Artificial Sequence
  Description of Artificial Sequence: Synthetic oligonucleotide
gcagagctgcgaagatgataaggtgatggc

SEQ ID NO: 111833 - DNA, 30 bp, Artificial Sequence
  Description of Artificial Sequence: Synthetic oligonucleotide
cagagctgcgaagatgataaggtgatggcg

SEQ ID NO: 111834 - DNA, 30 bp, Artificial Sequence
  Description of Artificial Sequence: Synthetic oligonucleotide
agagctgcgaagatgataaggtgatggcgg

SEQ ID NO: 111835 - DNA, 29 bp, Artificial Sequence
  Description of Artificial Sequence: Synthetic oligonucleotide
gagctgcgaagatgataaggtgatggcgg

SEQ ID NO: 111836 - DNA, 29 bp, Artificial Sequence
  Description of Artificial Sequence: Synthetic oligonucleotide
agctgcgaagatgataaggtgatggcggc

SEQ ID NO: 111837 - DNA, 28 bp, Artificial Sequence
  Description of Artificial Sequence: Synthetic oligonucleotide
gctgcgaagatgataaggtgatggcggc

SEQ ID NO: 111838 - DNA, 29 bp, Artificial Sequence
  Description of Artificial Sequence: Synthetic oligonucleotide
ctgcgaagatgataaggtgatggcggctg

SEQ ID NO: 111839 - DNA, 29 bp, Artificial Sequence
  Description of Artificial Sequence: Synthetic oligonucleotide
tgcgaagatgataaggtgatggcggctgc

SEQ ID NO: 111840 - DNA, 28 bp, Artificial Sequence
  Description of Artificial Sequence: Synthetic oligonucleotide
gcgaagatgataaggtgatggcggctgc

SEQ ID NO: 111841 - DNA, 28 bp, Artificial Sequence
  Description of Artificial Sequence: Synthetic oligonucleotide
cgaagatgataaggtgatggcggctgcc

SEQ ID NO: 111842 - DNA, 28 bp, Artificial Sequence
  Description of Artificial Sequence: Synthetic oligonucleotide
gaagatgataaggtgatggcggctgccc

SEQ ID NO: 111843 - DNA, 29 bp, Artificial Sequence
  Description of Artificial Sequence: Synthetic oligonucleotide
aagatgataaggtgatggcggctgcccag

SEQ ID NO: 111844 - DNA, 28 bp, Artificial Sequence
  Description of Artificial Sequence: Synthetic oligonucleotide
agatgataaggtgatggcggctgcccag

SEQ ID NO: 111845 - DNA, 27 bp, Artificial Sequence
  Description of Artificial Sequence: Synthetic oligonucleotide
gatgataaggtgatggcggctgcccag

SEQ ID NO: 111846 - DNA, 27 bp, Artificial Sequence
  Description of Artificial Sequence: Synthetic oligonucleotide
atgataaggtgatggcggctgcccagg

SEQ ID NO: 111847 - DNA, 26 bp, Artificial Sequence
  Description of Artificial Sequence: Synthetic oligonucleotide
tgataaggtgatggcggctgcccagg

SEQ ID NO: 111848 - DNA, 25 bp, Artificial Sequence
  Description of Artificial Sequence: Synthetic oligonucleotide
gataaggtgatggcggctgcccagg

SEQ ID NO: 111849 - DNA, 26 bp, Artificial Sequence
  Description of Artificial Sequence: Synthetic oligonucleotide
ataaggtgatggcggctgcccaggct

SEQ ID NO: 111850 - DNA, 25 bp, Artificial Sequence
  Description of Artificial Sequence: Synthetic oligonucleotide
taaggtgatggcggctgcccaggct

SEQ ID NO: 111851 - DNA, 24 bp, Artificial Sequence
  Description of Artificial Sequence: Synthetic oligonucleotide
aaggtgatggcggctgcccaggct

SEQ ID NO: 111852 - DNA, 23 bp, Artificial Sequence
  Description of Artificial Sequence: Synthetic oligonucleotide
aggtgatggcggctgcccaggct

SEQ ID NO: 111853 - DNA, 22 bp, Artificial Sequence
  Description of Artificial Sequence: Synthetic oligonucleotide
ggtgatggcggctgcccaggct

SEQ ID NO: 111854 - DNA, 22 bp, Artificial Sequence
  Description of Artificial Sequence: Synthetic oligonucleotide
gtgatggcggctgcccaggctg

SEQ ID NO: 111855 - DNA, 22 bp, Artificial Sequence
  Description of Artificial Sequence: Synthetic oligonucleotide
tgatggcggctgcccaggctgc

SEQ ID NO: 111856 - DNA, 21 bp, Artificial Sequence
  Description of Artificial Sequence: Synthetic oligonucleotide
gatggcggctgcccaggctgc

SEQ ID NO: 111857 - DNA, 21 bp, Artificial Sequence
  Description of Artificial Sequence: Synthetic oligonucleotide
atggcggctgcccaggctgcc

SEQ ID NO: 111858 - DNA, 20 bp, Artificial Sequence
  Description of Artificial Sequence: Synthetic oligonucleotide
tggcggctgcccaggctgcc

SEQ ID NO: 111859 - DNA, 20 bp, Artificial Sequence
  Description of Artificial Sequence: Synthetic oligonucleotide
ggcggctgcccaggctgcct

SEQ ID NO: 111860 - DNA, 20 bp, Artificial Sequence
  Description of Artificial Sequence: Synthetic oligonucleotide
gcggctgcccaggctgccca

SEQ ID NO: 111861 - DNA, 20 bp, Artificial Sequence
  Description of Artificial Sequence: Synthetic oligonucleotide
cggctgcccaggctgcccac

SEQ ID NO: 111862 - DNA, 20 bp, Artificial Sequence
  Description of Artificial Sequence: Synthetic oligonucleotide
ggctgcccaggctgcccacg

SEQ ID NO: 111863 - DNA, 21 bp, Artificial Sequence
  Description of Artificial Sequence: Synthetic oligonucleotide
gctgcccaggctgcccacgca

SEQ ID NO: 111864 - DNA, 23 bp, Artificial Sequence
  Description of Artificial Sequence: Synthetic oligonucleotide
ctgcccaggctgcccacgcagat

SEQ ID NO: 111865 - DNA, 24 bp, Artificial Sequence
  Description of Artificial Sequence: Synthetic oligonucleotide
tgcccaggctgcccacgcagatga

SEQ ID NO: 111866 - DNA, 23 bp, Artificial Sequence
  Description of Artificial Sequence: Synthetic oligonucleotide
gcccaggctgcccacgcagatga

SEQ ID NO: 111867 - DNA, 25 bp, Artificial Sequence
  Description of Artificial Sequence: Synthetic oligonucleotide
cccaggctgcccacgcagatgactt

SEQ ID NO: 111868 - DNA, 27 bp, Artificial Sequence
  Description of Artificial Sequence: Synthetic oligonucleotide
ccaggctgcccacgcagatgacttcat

SEQ ID NO: 111869 - DNA, 27 bp, Artificial Sequence
  Description of Artificial Sequence: Synthetic oligonucleotide
caggctgcccacgcagatgacttcatc

SEQ ID NO: 111870 - DNA, 27 bp, Artificial Sequence
  Description of Artificial Sequence: Synthetic oligonucleotide
aggctgcccacgcagatgacttcatcc

SEQ ID NO: 111871 - DNA, 27 bp, Artificial Sequence
  Description of Artificial Sequence: Synthetic oligonucleotide
ggctgcccacgcagatgacttcatcca

SEQ ID NO: 111872 - DNA, 27 bp, Artificial Sequence
  Description of Artificial Sequence: Synthetic oligonucleotide
gctgcccacgcagatgacttcatccag

SEQ ID NO: 111873 - DNA, 27 bp, Artificial Sequence
  Description of Artificial Sequence: Synthetic oligonucleotide
ctgcccacgcagatgacttcatccagg

SEQ ID NO: 111874 - DNA, 31 bp, Artificial Sequence
  Description of Artificial Sequence: Synthetic oligonucleotide
tgcccacgcagatgacttcatccaggaaatg

SEQ ID NO: 111875 - DNA, 30 bp, Artificial Sequence
  Description of Artificial Sequence: Synthetic oligonucleotide
gcccacgcagatgacttcatccaggaaatg

SEQ ID NO: 111876 - DNA, 30 bp, Artificial Sequence
  Description of Artificial Sequence: Synthetic oligonucleotide
cccacgcagatgacttcatccaggaaatgg

SEQ ID NO: 111877 - DNA, 31 bp, Artificial Sequence
  Description of Artificial Sequence: Synthetic oligonucleotide
ccacgcagatgacttcatccaggaaatggag

SEQ ID NO: 111878 - DNA, 31 bp, Artificial Sequence
  Description of Artificial Sequence: Synthetic oligonucleotide
cacgcagatgacttcatccaggaaatggagc

SEQ ID NO: 111879 - DNA, 33 bp, Artificial Sequence
  Description of Artificial Sequence: Synthetic oligonucleotide
acgcagatgacttcatccaggaaatggagcatg

SEQ ID NO: 111880 - DNA, 32 bp, Artificial Sequence
  Description of Artificial Sequence: Synthetic oligonucleotide
cgcagatgacttcatccaggaaatggagcatg

SEQ ID NO: 111881 - DNA, 32 bp, Artificial Sequence
  Description of Artificial Sequence: Synthetic oligonucleotide
gcagatgacttcatccaggaaatggagcatgg

SEQ ID NO: 111882 - DNA, 38 bp, Artificial Sequence
  Description of Artificial Sequence: Synthetic oligonucleotide
cagatgacttcatccaggaaatggagcatggaatatac

SEQ ID NO: 111883 - DNA, 39 bp, Artificial Sequence
  Description of Artificial Sequence: Synthetic oligonucleotide
agatgacttcatccaggaaatggagcatggaatatacac

SEQ ID NO: 111884 - DNA, 38 bp, Artificial Sequence
  Description of Artificial Sequence: Synthetic oligonucleotide
gatgacttcatccaggaaatggagcatggaatatacac

SEQ ID NO: 111885 - DNA, 39 bp, Artificial Sequence
  Description of Artificial Sequence: Synthetic oligonucleotide
atgacttcatccaggaaatggagcatggaatatacacag

SEQ ID NO: 111886 - DNA, 38 bp, Artificial Sequence
  Description of Artificial Sequence: Synthetic oligonucleotide
tgacttcatccaggaaatggagcatggaatatacacag

SEQ ID NO: 111887 - DNA, 37 bp, Artificial Sequence
  Description of Artificial Sequence: Synthetic oligonucleotide
gacttcatccaggaaatggagcatggaatatacacag

SEQ ID NO: 111888 - DNA, 39 bp, Artificial Sequence
  Description of Artificial Sequence: Synthetic oligonucleotide
acttcatccaggaaatggagcatggaatatacacagatg

SEQ ID NO: 111889 - DNA, 38 bp, Artificial Sequence
  Description of Artificial Sequence: Synthetic oligonucleotide
cttcatccaggaaatggagcatggaatatacacagatg

SEQ ID NO: 111890 - DNA, 40 bp, Artificial Sequence
  Description of Artificial Sequence: Synthetic oligonucleotide
ttcatccaggaaatggagcatggaatatacacagatgtag

SEQ ID NO: 111891 - DNA, 39 bp, Artificial Sequence
  Description of Artificial Sequence: Synthetic oligonucleotide
tcatccaggaaatggagcatggaatatacacagatgtag

SEQ ID NO: 111892 - DNA, 38 bp, Artificial Sequence
  Description of Artificial Sequence: Synthetic oligonucleotide
catccaggaaatggagcatggaatatacacagatgtag

SEQ ID NO: 111893 - DNA, 38 bp, Artificial Sequence
  Description of Artificial Sequence: Synthetic oligonucleotide
atccaggaaatggagcatggaatatacacagatgtagg

SEQ ID NO: 111894 - DNA, 37 bp, Artificial Sequence
  Description of Artificial Sequence: Synthetic oligonucleotide
tccaggaaatggagcatggaatatacacagatgtagg

SEQ ID NO: 111895 - DNA, 36 bp, Artificial Sequence
  Description of Artificial Sequence: Synthetic oligonucleotide
ccaggaaatggagcatggaatatacacagatgtagg

SEQ ID NO: 111896 - DNA, 36 bp, Artificial Sequence
  Description of Artificial Sequence: Synthetic oligonucleotide
caggaaatggagcatggaatatacacagatgtaggg

SEQ ID NO: 111897 - DNA, 36 bp, Artificial Sequence
  Description of Artificial Sequence: Synthetic oligonucleotide
aggaaatggagcatggaatatacacagatgtagggg

SEQ ID NO: 111898 - DNA, 35 bp, Artificial Sequence
  Description of Artificial Sequence: Synthetic oligonucleotide
ggaaatggagcatggaatatacacagatgtagggg

SEQ ID NO: 111899 - DNA, 36 bp, Artificial Sequence
  Description of Artificial Sequence: Synthetic oligonucleotide
gaaatggagcatggaatatacacagatgtaggggag

SEQ ID NO: 111900 - DNA, 38 bp, Artificial Sequence
  Description of Artificial Sequence: Synthetic oligonucleotide
aaatggagcatggaatatacacagatgtaggggagaag

SEQ ID NO: 111901 - DNA, 37 bp, Artificial Sequence
  Description of Artificial Sequence: Synthetic oligonucleotide
aatggagcatggaatatacacagatgtaggggagaag

SEQ ID NO: 111902 - DNA, 36 bp, Artificial Sequence
  Description of Artificial Sequence: Synthetic oligonucleotide
atggagcatggaatatacacagatgtaggggagaag

SEQ ID NO: 111903 - DNA, 35 bp, Artificial Sequence
  Description of Artificial Sequence: Synthetic oligonucleotide
tggagcatggaatatacacagatgtaggggagaag

SEQ ID NO: 111904 - DNA, 34 bp, Artificial Sequence
  Description of Artificial Sequence: Synthetic oligonucleotide
ggagcatggaatatacacagatgtaggggagaag

SEQ ID NO: 111905 - DNA, 34 bp, Artificial Sequence
  Description of Artificial Sequence: Synthetic oligonucleotide
gagcatggaatatacacagatgtaggggagaagg

SEQ ID NO: 111906 - DNA, 34 bp, Artificial Sequence
  Description of Artificial Sequence: Synthetic oligonucleotide
agcatggaatatacacagatgtaggggagaaggg

SEQ ID NO: 111907 - DNA, 33 bp, Artificial Sequence
  Description of Artificial Sequence: Synthetic oligonucleotide
gcatggaatatacacagatgtaggggagaaggg

SEQ ID NO: 111908 - DNA, 35 bp, Artificial Sequence
  Description of Artificial Sequence: Synthetic oligonucleotide
catggaatatacacagatgtaggggagaagggaag

SEQ ID NO: 111909 - DNA, 35 bp, Artificial Sequence
  Description of Artificial Sequence: Synthetic oligonucleotide
atggaatatacacagatgtaggggagaagggaagc

SEQ ID NO: 111910 - DNA, 34 bp, Artificial Sequence
  Description of Artificial Sequence: Synthetic oligonucleotide
tggaatatacacagatgtaggggagaagggaagc

SEQ ID NO: 111911 - DNA, 33 bp, Artificial Sequence
  Description of Artificial Sequence: Synthetic oligonucleotide
ggaatatacacagatgtaggggagaagggaagc

SEQ ID NO: 111912 - DNA, 33 bp, Artificial Sequence
  Description of Artificial Sequence: Synthetic oligonucleotide
gaatatacacagatgtaggggagaagggaagcc

SEQ ID NO: 111913 - DNA, 34 bp, Artificial Sequence
  Description of Artificial Sequence: Synthetic oligonucleotide
aatatacacagatgtaggggagaagggaagccag

SEQ ID NO: 111914 - DNA, 33 bp, Artificial Sequence
  Description of Artificial Sequence: Synthetic oligonucleotide
atatacacagatgtaggggagaagggaagccag

SEQ ID NO: 111915 - DNA, 32 bp, Artificial Sequence
  Description of Artificial Sequence: Synthetic oligonucleotide
tatacacagatgtaggggagaagggaagccag

SEQ ID NO: 111916 - DNA, 31 bp, Artificial Sequence
  Description of Artificial Sequence: Synthetic oligonucleotide
atacacagatgtaggggagaagggaagccag

SEQ ID NO: 111917 - DNA, 30 bp, Artificial Sequence
  Description of Artificial Sequence: Synthetic oligonucleotide
tacacagatgtaggggagaagggaagccag

SEQ ID NO: 111918 - DNA, 29 bp, Artificial Sequence
  Description of Artificial Sequence: Synthetic oligonucleotide
acacagatgtaggggagaagggaagccag

SEQ ID NO: 111919 - DNA, 28 bp, Artificial Sequence
  Description of Artificial Sequence: Synthetic oligonucleotide
cacagatgtaggggagaagggaagccag

SEQ ID NO: 111920 - DNA, 28 bp, Artificial Sequence
  Description of Artificial Sequence: Synthetic oligonucleotide
acagatgtaggggagaagggaagccagc

SEQ ID NO: 111921 - DNA, 27 bp, Artificial Sequence
  Description of Artificial Sequence: Synthetic oligonucleotide
cagatgtaggggagaagggaagccagc

SEQ ID NO: 111922 - DNA, 28 bp, Artificial Sequence
  Description of Artificial Sequence: Synthetic oligonucleotide
agatgtaggggagaagggaagccagctg

SEQ ID NO: 111923 - DNA, 27 bp, Artificial Sequence
  Description of Artificial Sequence: Synthetic oligonucleotide
gatgtaggggagaagggaagccagctg

SEQ ID NO: 111924 - DNA, 27 bp, Artificial Sequence
  Description of Artificial Sequence: Synthetic oligonucleotide
atgtaggggagaagggaagccagctgg

SEQ ID NO: 111925 - DNA, 26 bp, Artificial Sequence
  Description of Artificial Sequence: Synthetic oligonucleotide
tgtaggggagaagggaagccagctgg

SEQ ID NO: 111926 - DNA, 25 bp, Artificial Sequence
  Description of Artificial Sequence: Synthetic oligonucleotide
gtaggggagaagggaagccagctgg

SEQ ID NO: 111927 - DNA, 26 bp, Artificial Sequence
  Description of Artificial Sequence: Synthetic oligonucleotide
taggggagaagggaagccagctggct

SEQ ID NO: 111928 - DNA, 25 bp, Artificial Sequence
  Description of Artificial Sequence: Synthetic oligonucleotide
aggggagaagggaagccagctggct

SEQ ID NO: 111929 - DNA, 24 bp, Artificial Sequence
  Description of Artificial Sequence: Synthetic oligonucleotide
ggggagaagggaagccagctggct

SEQ ID NO: 111930 - DNA, 24 bp, Artificial Sequence
  Description of Artificial Sequence: Synthetic oligonucleotide
gggagaagggaagccagctggctg

SEQ ID NO: 111931 - DNA, 24 bp, Artificial Sequence
  Description of Artificial Sequence: Synthetic oligonucleotide
ggagaagggaagccagctggctgc

SEQ ID NO: 111932 - DNA, 24 bp, Artificial Sequence
  Description of Artificial Sequence: Synthetic oligonucleotide
gagaagggaagccagctggctgcg

SEQ ID NO: 111933 - DNA, 24 bp, Artificial Sequence
  Description of Artificial Sequence: Synthetic oligonucleotide
agaagggaagccagctggctgcgg

SEQ ID NO: 111934 - DNA, 23 bp, Artificial Sequence
  Description of Artificial Sequence: Synthetic oligonucleotide
gaagggaagccagctggctgcgg

SEQ ID NO: 111935 - DNA, 24 bp, Artificial Sequence
  Description of Artificial Sequence: Synthetic oligonucleotide
aagggaagccagctggctgcggga

SEQ ID NO: 111936 - DNA, 23 bp, Artificial Sequence
  Description of Artificial Sequence: Synthetic oligonucleotide
agggaagccagctggctgcggga

SEQ ID NO: 111937 - DNA, 22 bp, Artificial Sequence
  Description of Artificial Sequence: Synthetic oligonucleotide
gggaagccagctggctgcggga

SEQ ID NO: 111938 - DNA, 23 bp, Artificial Sequence
  Description of Artificial Sequence: Synthetic oligonucleotide
ggaagccagctggctgcgggaca

SEQ ID NO: 111939 - DNA, 26 bp, Artificial Sequence
  Description of Artificial Sequence: Synthetic oligonucleotide
gaagccagctggctgcgggacagaaa

SEQ ID NO: 111940 - DNA, 27 bp, Artificial Sequence
  Description of Artificial Sequence: Synthetic oligonucleotide
aagccagctggctgcgggacagaaaca

SEQ ID NO: 111941 - DNA, 27 bp, Artificial Sequence
  Description of Artificial Sequence: Synthetic oligonucleotide
agccagctggctgcgggacagaaacaa

SEQ ID NO: 111942 - DNA, 26 bp, Artificial Sequence
  Description of Artificial Sequence: Synthetic oligonucleotide
gccagctggctgcgggacagaaacaa

SEQ ID NO: 111943 - DNA, 26 bp, Artificial Sequence
  Description of Artificial Sequence: Synthetic oligonucleotide
ccagctggctgcgggacagaaacaac

SEQ ID NO: 111944 - DNA, 27 bp, Artificial Sequence
  Description of Artificial Sequence: Synthetic oligonucleotide
cagctggctgcgggacagaaacaacgt

SEQ ID NO: 111945 - DNA, 27 bp, Artificial Sequence
  Description of Artificial Sequence: Synthetic oligonucleotide
agctggctgcgggacagaaacaacgtc

SEQ ID NO: 111946 - DNA, 27 bp, Artificial Sequence
  Description of Artificial Sequence: Synthetic oligonucleotide
gctggctgcgggacagaaacaacgtct

SEQ ID NO: 111947 - DNA, 27 bp, Artificial Sequence
  Description of Artificial Sequence: Synthetic oligonucleotide
ctggctgcgggacagaaacaacgtctg

SEQ ID NO: 111948 - DNA, 27 bp, Artificial Sequence
  Description of Artificial Sequence: Synthetic oligonucleotide
tggctgcgggacagaaacaacgtctgg

SEQ ID NO: 111949 - DNA, 26 bp, Artificial Sequence
  Description of Artificial Sequence: Synthetic oligonucleotide
ggctgcgggacagaaacaacgtctgg

SEQ ID NO: 111950 - DNA, 26 bp, Artificial Sequence
  Description of Artificial Sequence: Synthetic oligonucleotide
gctgcgggacagaaacaacgtctggc

SEQ ID NO: 111951 - DNA, 27 bp, Artificial Sequence
  Description of Artificial Sequence: Synthetic oligonucleotide
ctgcgggacagaaacaacgtctggcca

SEQ ID NO: 111952 - DNA, 29 bp, Artificial Sequence
  Description of Artificial Sequence: Synthetic oligonucleotide
tgcgggacagaaacaacgtctggccattg

SEQ ID NO: 111953 - DNA, 28 bp, Artificial Sequence
  Description of Artificial Sequence: Synthetic oligonucleotide
gcgggacagaaacaacgtctggccattg

SEQ ID NO: 111954 - DNA, 28 bp, Artificial Sequence
  Description of Artificial Sequence: Synthetic oligonucleotide
cgggacagaaacaacgtctggccattgc

SEQ ID NO: 111955 - DNA, 28 bp, Artificial Sequence
  Description of Artificial Sequence: Synthetic oligonucleotide
gggacagaaacaacgtctggccattgcc

SEQ ID NO: 111956 - DNA, 28 bp, Artificial Sequence
  Description of Artificial Sequence: Synthetic oligonucleotide
ggacagaaacaacgtctggccattgccc

SEQ ID NO: 111957 - DNA, 28 bp, Artificial Sequence
  Description of Artificial Sequence: Synthetic oligonucleotide
gacagaaacaacgtctggccattgcccg

SEQ ID NO: 111958 - DNA, 28 bp, Artificial Sequence
  Description of Artificial Sequence: Synthetic oligonucleotide
acagaaacaacgtctggccattgcccgg

SEQ ID NO: 111959 - DNA, 27 bp, Artificial Sequence
  Description of Artificial Sequence: Synthetic oligonucleotide
cagaaacaacgtctggccattgcccgg

SEQ ID NO: 111960 - DNA, 27 bp, Artificial Sequence
  Description of Artificial Sequence: Synthetic oligonucleotide
agaaacaacgtctggccattgcccggg

SEQ ID NO: 111961 - DNA, 26 bp, Artificial Sequence
  Description of Artificial Sequence: Synthetic oligonucleotide
gaaacaacgtctggccattgcccggg

SEQ ID NO: 111962 - DNA, 26 bp, Artificial Sequence
  Description of Artificial Sequence: Synthetic oligonucleotide
aaacaacgtctggccattgcccgggc

SEQ ID NO: 111963 - DNA, 25 bp, Artificial Sequence
  Description of Artificial Sequence: Synthetic oligonucleotide
aacaacgtctggccattgcccgggc

SEQ ID NO: 111964 - DNA, 24 bp, Artificial Sequence
  Description of Artificial Sequence: Synthetic oligonucleotide
acaacgtctggccattgcccgggc

SEQ ID NO: 111965 - DNA, 23 bp, Artificial Sequence
  Description of Artificial Sequence: Synthetic oligonucleotide
caacgtctggccattgcccgggc

SEQ ID NO: 111966 - DNA, 23 bp, Artificial Sequence
  Description of Artificial Sequence: Synthetic oligonucleotide
aacgtctggccattgcccgggcc

SEQ ID NO: 111967 - DNA, 22 bp, Artificial Sequence
  Description of Artificial Sequence: Synthetic oligonucleotide
acgtctggccattgcccgggcc

SEQ ID NO: 111968 - DNA, 21 bp, Artificial Sequence
  Description of Artificial Sequence: Synthetic oligonucleotide
cgtctggccattgcccgggcc

SEQ ID NO: 111969 - DNA, 23 bp, Artificial Sequence
  Description of Artificial Sequence: Synthetic oligonucleotide
gtctggccattgcccgggccctt

SEQ ID NO: 111970 - DNA, 25 bp, Artificial Sequence
  Description of Artificial Sequence: Synthetic oligonucleotide
tctggccattgcccgggcccttgta

SEQ ID NO: 111971 - DNA, 24 bp, Artificial Sequence
  Description of Artificial Sequence: Synthetic oligonucleotide
ctggccattgcccgggcccttgta

SEQ ID NO: 111972 - DNA, 24 bp, Artificial Sequence
  Description of Artificial Sequence: Synthetic oligonucleotide
tggccattgcccgggcccttgtac

SEQ ID NO: 111973 - DNA, 23 bp, Artificial Sequence
  Description of Artificial Sequence: Synthetic oligonucleotide
ggccattgcccgggcccttgtac

SEQ ID NO: 111974 - DNA, 24 bp, Artificial Sequence
  Description of Artificial Sequence: Synthetic oligonucleotide
gccattgcccgggcccttgtacga

SEQ ID NO: 111975 - DNA, 25 bp, Artificial Sequence
  Description of Artificial Sequence: Synthetic oligonucleotide
ccattgcccgggcccttgtacgaga

SEQ ID NO: 111976 - DNA, 25 bp, Artificial Sequence
  Description of Artificial Sequence: Synthetic oligonucleotide
cattgcccgggcccttgtacgagac

SEQ ID NO: 111977 - DNA, 25 bp, Artificial Sequence
  Description of Artificial Sequence: Synthetic oligonucleotide
attgcccgggcccttgtacgagacc

SEQ ID NO: 111978 - DNA, 24 bp, Artificial Sequence
  Description of Artificial Sequence: Synthetic oligonucleotide
ttgcccgggcccttgtacgagacc

SEQ ID NO: 111979 - DNA, 23 bp, Artificial Sequence
  Description of Artificial Sequence: Synthetic oligonucleotide
tgcccgggcccttgtacgagacc

SEQ ID NO: 111980 - DNA, 22 bp, Artificial Sequence
  Description of Artificial Sequence: Synthetic oligonucleotide
gcccgggcccttgtacgagacc

SEQ ID NO: 111981 - DNA, 22 bp, Artificial Sequence
  Description of Artificial Sequence: Synthetic oligonucleotide
cccgggcccttgtacgagaccc

SEQ ID NO: 111982 - DNA, 22 bp, Artificial Sequence
  Description of Artificial Sequence: Synthetic oligonucleotide
ccgggcccttgtacgagacccg

SEQ ID NO: 111983 - DNA, 22 bp, Artificial Sequence
  Description of Artificial Sequence: Synthetic oligonucleotide
cgggcccttgtacgagacccgc

SEQ ID NO: 111984 - DNA, 22 bp, Artificial Sequence
  Description of Artificial Sequence: Synthetic oligonucleotide
gggcccttgtacgagacccgcg

SEQ ID NO: 111985 - DNA, 22 bp, Artificial Sequence
  Description of Artificial Sequence: Synthetic oligonucleotide
ggcccttgtacgagacccgcgg

SEQ ID NO: 111986 - DNA, 23 bp, Artificial Sequence
  Description of Artificial Sequence: Synthetic oligonucleotide
gcccttgtacgagacccgcgggt

SEQ ID NO: 111987 - DNA, 23 bp, Artificial Sequence
  Description of Artificial Sequence: Synthetic oligonucleotide
cccttgtacgagacccgcgggtc

SEQ ID NO: 111988 - DNA, 24 bp, Artificial Sequence
  Description of Artificial Sequence: Synthetic oligonucleotide
ccttgtacgagacccgcgggtcct

SEQ ID NO: 111989 - DNA, 26 bp, Artificial Sequence
  Description of Artificial Sequence: Synthetic oligonucleotide
cttgtacgagacccgcgggtcctcat

SEQ ID NO: 111990 - DNA, 26 bp, Artificial Sequence
  Description of Artificial Sequence: Synthetic oligonucleotide
ttgtacgagacccgcgggtcctcatc

SEQ ID NO: 111991 - DNA, 25 bp, Artificial Sequence
  Description of Artificial Sequence: Synthetic oligonucleotide
tgtacgagacccgcgggtcctcatc

SEQ ID NO: 111992 - DNA, 24 bp, Artificial Sequence
  Description of Artificial Sequence: Synthetic oligonucleotide
gtacgagacccgcgggtcctcatc

SEQ ID NO: 111993 - DNA, 25 bp, Artificial Sequence
  Description of Artificial Sequence: Synthetic oligonucleotide
tacgagacccgcgggtcctcatcct

SEQ ID NO: 111994 - DNA, 24 bp, Artificial Sequence
  Description of Artificial Sequence: Synthetic oligonucleotide
acgagacccgcgggtcctcatcct

SEQ ID NO: 111995 - DNA, 23 bp, Artificial Sequence
  Description of Artificial Sequence: Synthetic oligonucleotide
cgagacccgcgggtcctcatcct

SEQ ID NO: 111996 - DNA, 23 bp, Artificial Sequence
  Description of Artificial Sequence: Synthetic oligonucleotide
gagacccgcgggtcctcatcctg

SEQ ID NO: 111997 - DNA, 25 bp, Artificial Sequence
  Description of Artificial Sequence: Synthetic oligonucleotide
agacccgcgggtcctcatcctggat

SEQ ID NO: 111998 - DNA, 24 bp, Artificial Sequence
  Description of Artificial Sequence: Synthetic oligonucleotide
gacccgcgggtcctcatcctggat

SEQ ID NO: 111999 - DNA, 25 bp, Artificial Sequence
  Description of Artificial Sequence: Synthetic oligonucleotide
acccgcgggtcctcatcctggatga

SEQ ID NO: 112000 - DNA, 24 bp, Artificial Sequence
  Description of Artificial Sequence: Synthetic oligonucleotide
cccgcgggtcctcatcctggatga

SEQ ID NO: 112001 - DNA, 24 bp, Artificial Sequence
  Description of Artificial Sequence: Synthetic oligonucleotide
ccgcgggtcctcatcctggatgag

SEQ ID NO: 112002 - DNA, 24 bp, Artificial Sequence
  Description of Artificial Sequence: Synthetic oligonucleotide
cgcgggtcctcatcctggatgagg

SEQ ID NO: 112003 - DNA, 26 bp, Artificial Sequence
  Description of Artificial Sequence: Synthetic oligonucleotide
gcgggtcctcatcctggatgaggcta

SEQ ID NO: 112004 - DNA, 27 bp, Artificial Sequence
  Description of Artificial Sequence: Synthetic oligonucleotide
cgggtcctcatcctggatgaggctact

SEQ ID NO: 112005 - DNA, 28 bp, Artificial Sequence
  Description of Artificial Sequence: Synthetic oligonucleotide
gggtcctcatcctggatgaggctactag

SEQ ID NO: 112006 - DNA, 29 bp, Artificial Sequence
  Description of Artificial Sequence: Synthetic oligonucleotide
ggtcctcatcctggatgaggctactagtg

SEQ ID NO: 112007 - DNA, 29 bp, Artificial Sequence
  Description of Artificial Sequence: Synthetic oligonucleotide
gtcctcatcctggatgaggctactagtgc

SEQ ID NO: 112008 - DNA, 29 bp, Artificial Sequence
  Description of Artificial Sequence: Synthetic oligonucleotide
tcctcatcctggatgaggctactagtgcc

SEQ ID NO: 112009 - DNA, 28 bp, Artificial Sequence
  Description of Artificial Sequence: Synthetic oligonucleotide
cctcatcctggatgaggctactagtgcc

SEQ ID NO: 112010 - DNA, 28 bp, Artificial Sequence
  Description of Artificial Sequence: Synthetic oligonucleotide
ctcatcctggatgaggctactagtgccc

SEQ ID NO: 112011 - DNA, 30 bp, Artificial Sequence
  Description of Artificial Sequence: Synthetic oligonucleotide
tcatcctggatgaggctactagtgccctag

SEQ ID NO: 112012 - DNA, 29 bp, Artificial Sequence
  Description of Artificial Sequence: Synthetic oligonucleotide
catcctggatgaggctactagtgccctag

SEQ ID NO: 112013 - DNA, 31 bp, Artificial Sequence
  Description of Artificial Sequence: Synthetic oligonucleotide
atcctggatgaggctactagtgccctagatg

SEQ ID NO: 112014 - DNA, 30 bp, Artificial Sequence
  Description of Artificial Sequence: Synthetic oligonucleotide
tcctggatgaggctactagtgccctagatg

SEQ ID NO: 112015 - DNA, 29 bp, Artificial Sequence
  Description of Artificial Sequence: Synthetic oligonucleotide
cctggatgaggctactagtgccctagatg

SEQ ID NO: 112016 - DNA, 30 bp, Artificial Sequence
  Description of Artificial Sequence: Synthetic oligonucleotide
ctggatgaggctactagtgccctagatgtg

SEQ ID NO: 112017 - DNA, 30 bp, Artificial Sequence
  Description of Artificial Sequence: Synthetic oligonucleotide
tggatgaggctactagtgccctagatgtgc

SEQ ID NO: 112018 - DNA, 29 bp, Artificial Sequence
  Description of Artificial Sequence: Synthetic oligonucleotide
ggatgaggctactagtgccctagatgtgc

SEQ ID NO: 112019 - DNA, 30 bp, Artificial Sequence
  Description of Artificial Sequence: Synthetic oligonucleotide
gatgaggctactagtgccctagatgtgcag

SEQ ID NO: 112020 - DNA, 31 bp, Artificial Sequence
  Description of Artificial Sequence: Synthetic oligonucleotide
atgaggctactagtgccctagatgtgcagtg

SEQ ID NO: 112021 - DNA, 30 bp, Artificial Sequence
  Description of Artificial Sequence: Synthetic oligonucleotide
tgaggctactagtgccctagatgtgcagtg

SEQ ID NO: 112022 - DNA, 29 bp, Artificial Sequence
  Description of Artificial Sequence: Synthetic oligonucleotide
gaggctactagtgccctagatgtgcagtg

SEQ ID NO: 112023 - DNA, 29 bp, Artificial Sequence
  Description of Artificial Sequence: Synthetic oligonucleotide
aggctactagtgccctagatgtgcagtgc

SEQ ID NO: 112024 - DNA, 28 bp, Artificial Sequence
  Description of Artificial Sequence: Synthetic oligonucleotide
ggctactagtgccctagatgtgcagtgc

SEQ ID NO: 112025 - DNA, 28 bp, Artificial Sequence
  Description of Artificial Sequence: Synthetic oligonucleotide
gctactagtgccctagatgtgcagtgcg

SEQ ID NO: 112026 - DNA, 29 bp, Artificial Sequence
  Description of Artificial Sequence: Synthetic oligonucleotide
ctactagtgccctagatgtgcagtgcgag

SEQ ID NO: 112027 - DNA, 29 bp, Artificial Sequence
  Description of Artificial Sequence: Synthetic oligonucleotide
tactagtgccctagatgtgcagtgcgagc

SEQ ID NO: 112028 - DNA, 28 bp, Artificial Sequence
  Description of Artificial Sequence: Synthetic oligonucleotide
actagtgccctagatgtgcagtgcgagc

SEQ ID NO: 112029 - DNA, 27 bp, Artificial Sequence
  Description of Artificial Sequence: Synthetic oligonucleotide
ctagtgccctagatgtgcagtgcgagc

SEQ ID NO: 112030 - DNA, 28 bp, Artificial Sequence
  Description of Artificial Sequence: Synthetic oligonucleotide
tagtgccctagatgtgcagtgcgagcag

SEQ ID NO: 112031 - DNA, 27 bp, Artificial Sequence
  Description of Artificial Sequence: Synthetic oligonucleotide
agtgccctagatgtgcagtgcgagcag

SEQ ID NO: 112032 - DNA, 26 bp, Artificial Sequence
  Description of Artificial Sequence: Synthetic oligonucleotide
gtgccctagatgtgcagtgcgagcag

SEQ ID NO: 112033 - DNA, 26 bp, Artificial Sequence
  Description of Artificial Sequence: Synthetic oligonucleotide
tgccctagatgtgcagtgcgagcagg

SEQ ID NO: 112034 - DNA, 25 bp, Artificial Sequence
  Description of Artificial Sequence: Synthetic oligonucleotide
gccctagatgtgcagtgcgagcagg

SEQ ID NO: 112035 - DNA, 25 bp, Artificial Sequence
  Description of Artificial Sequence: Synthetic oligonucleotide
ccctagatgtgcagtgcgagcaggc

SEQ ID NO: 112036 - DNA, 25 bp, Artificial Sequence
  Description of Artificial Sequence: Synthetic oligonucleotide
cctagatgtgcagtgcgagcaggcc

SEQ ID NO: 112037 - DNA, 26 bp, Artificial Sequence
  Description of Artificial Sequence: Synthetic oligonucleotide
ctagatgtgcagtgcgagcaggccct

SEQ ID NO: 112038 - DNA, 26 bp, Artificial Sequence
  Description of Artificial Sequence: Synthetic oligonucleotide
tagatgtgcagtgcgagcaggccctg

SEQ ID NO: 112039 - DNA, 25 bp, Artificial Sequence
  Description of Artificial Sequence: Synthetic oligonucleotide
agatgtgcagtgcgagcaggccctg

SEQ ID NO: 112040 - DNA, 24 bp, Artificial Sequence
  Description of Artificial Sequence: Synthetic oligonucleotide
gatgtgcagtgcgagcaggccctg

SEQ ID NO: 112041 - DNA, 25 bp, Artificial Sequence
  Description of Artificial Sequence: Synthetic oligonucleotide
atgtgcagtgcgagcaggccctgca

SEQ ID NO: 112042 - DNA, 24 bp, Artificial Sequence
  Description of Artificial Sequence: Synthetic oligonucleotide
tgtgcagtgcgagcaggccctgca

SEQ ID NO: 112043 - DNA, 23 bp, Artificial Sequence
  Description of Artificial Sequence: Synthetic oligonucleotide
gtgcagtgcgagcaggccctgca

SEQ ID NO: 112044 - DNA, 23 bp, Artificial Sequence
  Description of Artificial Sequence: Synthetic oligonucleotide
tgcagtgcgagcaggccctgcag

SEQ ID NO: 112045 - DNA, 22 bp, Artificial Sequence
  Description of Artificial Sequence: Synthetic oligonucleotide
gcagtgcgagcaggccctgcag

SEQ ID NO: 112046 - DNA, 23 bp, Artificial Sequence
  Description of Artificial Sequence: Synthetic oligonucleotide
cagtgcgagcaggccctgcagga

SEQ ID NO: 112047 - DNA, 24 bp, Artificial Sequence
  Description of Artificial Sequence: Synthetic oligonucleotide
agtgcgagcaggccctgcaggact

SEQ ID NO: 112048 - DNA, 23 bp, Artificial Sequence
  Description of Artificial Sequence: Synthetic oligonucleotide
gtgcgagcaggccctgcaggact

SEQ ID NO: 112049 - DNA, 23 bp, Artificial Sequence
  Description of Artificial Sequence: Synthetic oligonucleotide
tgcgagcaggccctgcaggactg

SEQ ID NO: 112050 - DNA, 22 bp, Artificial Sequence
  Description of Artificial Sequence: Synthetic oligonucleotide
gcgagcaggccctgcaggactg

SEQ ID NO: 112051 - DNA, 26 bp, Artificial Sequence
  Description of Artificial Sequence: Synthetic oligonucleotide
cgagcaggccctgcaggactggaatt

SEQ ID NO: 112052 - DNA, 26 bp, Artificial Sequence
  Description of Artificial Sequence: Synthetic oligonucleotide
gagcaggccctgcaggactggaattc

SEQ ID NO: 112053 - DNA, 26 bp, Artificial Sequence
  Description of Artificial Sequence: Synthetic oligonucleotide
agcaggccctgcaggactggaattcc

SEQ ID NO: 112054 - DNA, 25 bp, Artificial Sequence
  Description of Artificial Sequence: Synthetic oligonucleotide
gcaggccctgcaggactggaattcc

SEQ ID NO: 112055 - DNA, 25 bp, Artificial Sequence
  Description of Artificial Sequence: Synthetic oligonucleotide
caggccctgcaggactggaattccc

SEQ ID NO: 112056 - DNA, 26 bp, Artificial Sequence
  Description of Artificial Sequence: Synthetic oligonucleotide
aggccctgcaggactggaattcccgt

SEQ ID NO: 112057 - DNA, 25 bp, Artificial Sequence
  Description of Artificial Sequence: Synthetic oligonucleotide
ggccctgcaggactggaattcccgt

SEQ ID NO: 112058 - DNA, 25 bp, Artificial Sequence
  Description of Artificial Sequence: Synthetic oligonucleotide
gccctgcaggactggaattcccgtg

SEQ ID NO: 112059 - DNA, 25 bp, Artificial Sequence
  Description of Artificial Sequence: Synthetic oligonucleotide
ccctgcaggactggaattcccgtgg

SEQ ID NO: 112060 - DNA, 25 bp, Artificial Sequence
  Description of Artificial Sequence: Synthetic oligonucleotide
cctgcaggactggaattcccgtggg

SEQ ID NO: 112061 - DNA, 27 bp, Artificial Sequence
  Description of Artificial Sequence: Synthetic oligonucleotide
ctgcaggactggaattcccgtggggat

SEQ ID NO: 112062 - DNA, 27 bp, Artificial Sequence
  Description of Artificial Sequence: Synthetic oligonucleotide
tgcaggactggaattcccgtggggatc

SEQ ID NO: 112063 - DNA, 26 bp, Artificial Sequence
  Description of Artificial Sequence: Synthetic oligonucleotide
gcaggactggaattcccgtggggatc

SEQ ID NO: 112064 - DNA, 26 bp, Artificial Sequence
  Description of Artificial Sequence: Synthetic oligonucleotide
caggactggaattcccgtggggatcg

SEQ ID NO: 112065 - DNA, 27 bp, Artificial Sequence
  Description of Artificial Sequence: Synthetic oligonucleotide
aggactggaattcccgtggggatcgca

SEQ ID NO: 112066 - DNA, 26 bp, Artificial Sequence
  Description of Artificial Sequence: Synthetic oligonucleotide
ggactggaattcccgtggggatcgca

SEQ ID NO: 112067 - DNA, 27 bp, Artificial Sequence
  Description of Artificial Sequence: Synthetic oligonucleotide
gactggaattcccgtggggatcgcaca

SEQ ID NO: 112068 - DNA, 27 bp, Artificial Sequence
  Description of Artificial Sequence: Synthetic oligonucleotide
actggaattcccgtggggatcgcacag

SEQ ID NO: 112069 - DNA, 27 bp, Artificial Sequence
  Description of Artificial Sequence: Synthetic oligonucleotide
ctggaattcccgtggggatcgcacagt

SEQ ID NO: 112070 - DNA, 27 bp, Artificial Sequence
  Description of Artificial Sequence: Synthetic oligonucleotide
tggaattcccgtggggatcgcacagtg

SEQ ID NO: 112071 - DNA, 26 bp, Artificial Sequence
  Description of Artificial Sequence: Synthetic oligonucleotide
ggaattcccgtggggatcgcacagtg

SEQ ID NO: 112072 - DNA, 27 bp, Artificial Sequence
  Description of Artificial Sequence: Synthetic oligonucleotide
gaattcccgtggggatcgcacagtgct

SEQ ID NO: 112073 - DNA, 27 bp, Artificial Sequence
  Description of Artificial Sequence: Synthetic oligonucleotide
aattcccgtggggatcgcacagtgctg

SEQ ID NO: 112074 - DNA, 26 bp, Artificial Sequence
  Description of Artificial Sequence: Synthetic oligonucleotide
attcccgtggggatcgcacagtgctg

SEQ ID NO: 112075 - DNA, 25 bp, Artificial Sequence
  Description of Artificial Sequence: Synthetic oligonucleotide
ttcccgtggggatcgcacagtgctg

SEQ ID NO: 112076 - DNA, 24 bp, Artificial Sequence
  Description of Artificial Sequence: Synthetic oligonucleotide
tcccgtggggatcgcacagtgctg

SEQ ID NO: 112077 - DNA, 23 bp, Artificial Sequence
  Description of Artificial Sequence: Synthetic oligonucleotide
cccgtggggatcgcacagtgctg

SEQ ID NO: 112078 - DNA, 24 bp, Artificial Sequence
  Description of Artificial Sequence: Synthetic oligonucleotide
ccgtggggatcgcacagtgctggt

SEQ ID NO: 112079 - DNA, 27 bp, Artificial Sequence
  Description of Artificial Sequence: Synthetic oligonucleotide
cgtggggatcgcacagtgctggtgatt

SEQ ID NO: 112080 - DNA, 27 bp, Artificial Sequence
  Description of Artificial Sequence: Synthetic oligonucleotide
gtggggatcgcacagtgctggtgattg

SEQ ID NO: 112081 - DNA, 27 bp, Artificial Sequence
  Description of Artificial Sequence: Synthetic oligonucleotide
tggggatcgcacagtgctggtgattgc

SEQ ID NO: 112082 - DNA, 27 bp, Artificial Sequence
  Description of Artificial Sequence: Synthetic oligonucleotide
ggggatcgcacagtgctggtgattgct

SEQ ID NO: 112083 - DNA, 27 bp, Artificial Sequence
  Description of Artificial Sequence: Synthetic oligonucleotide
gggatcgcacagtgctggtgattgctc

SEQ ID NO: 112084 - DNA, 28 bp, Artificial Sequence
  Description of Artificial Sequence: Synthetic oligonucleotide
ggatcgcacagtgctggtgattgctcac

SEQ ID NO: 112085 - DNA, 29 bp, Artificial Sequence
  Description of Artificial Sequence: Synthetic oligonucleotide
gatcgcacagtgctggtgattgctcacag

SEQ ID NO: 112086 - DNA, 29 bp, Artificial Sequence
  Description of Artificial Sequence: Synthetic oligonucleotide
atcgcacagtgctggtgattgctcacagg

SEQ ID NO: 112087 - DNA, 28 bp, Artificial Sequence
  Description of Artificial Sequence: Synthetic oligonucleotide
tcgcacagtgctggtgattgctcacagg

SEQ ID NO: 112088 - DNA, 27 bp, Artificial Sequence
  Description of Artificial Sequence: Synthetic oligonucleotide
cgcacagtgctggtgattgctcacagg

SEQ ID NO: 112089 - DNA, 27 bp, Artificial Sequence
  Description of Artificial Sequence: Synthetic oligonucleotide
gcacagtgctggtgattgctcacaggc

SEQ ID NO: 112090 - DNA, 28 bp, Artificial Sequence
  Description of Artificial Sequence: Synthetic oligonucleotide
cacagtgctggtgattgctcacaggctg

SEQ ID NO: 112091 - DNA, 28 bp, Artificial Sequence
  Description of Artificial Sequence: Synthetic oligonucleotide
acagtgctggtgattgctcacaggctgc

SEQ ID NO: 112092 - DNA, 27 bp, Artificial Sequence
  Description of Artificial Sequence: Synthetic oligonucleotide
cagtgctggtgattgctcacaggctgc

SEQ ID NO: 112093 - DNA, 28 bp, Artificial Sequence
  Description of Artificial Sequence: Synthetic oligonucleotide
agtgctggtgattgctcacaggctgcag

SEQ ID NO: 112094 - DNA, 27 bp, Artificial Sequence
  Description of Artificial Sequence: Synthetic oligonucleotide
gtgctggtgattgctcacaggctgcag

SEQ ID NO: 112095 - DNA, 28 bp, Artificial Sequence
  Description of Artificial Sequence: Synthetic oligonucleotide
tgctggtgattgctcacaggctgcagac

SEQ ID NO: 112096 - DNA, 27 bp, Artificial Sequence
  Description of Artificial Sequence: Synthetic oligonucleotide
gctggtgattgctcacaggctgcagac

SEQ ID NO: 112097 - DNA, 28 bp, Artificial Sequence
  Description of Artificial Sequence: Synthetic oligonucleotide
ctggtgattgctcacaggctgcagacag

SEQ ID NO: 112098 - DNA, 30 bp, Artificial Sequence
  Description of Artificial Sequence: Synthetic oligonucleotide
tggtgattgctcacaggctgcagacagttc

SEQ ID NO: 112099 - DNA, 29 bp, Artificial Sequence
  Description of Artificial Sequence: Synthetic oligonucleotide
ggtgattgctcacaggctgcagacagttc

SEQ ID NO: 112100 - DNA, 30 bp, Artificial Sequence
  Description of Artificial Sequence: Synthetic oligonucleotide
gtgattgctcacaggctgcagacagttcag

SEQ ID NO: 112101 - DNA, 30 bp, Artificial Sequence
  Description of Artificial Sequence: Synthetic oligonucleotide
tgattgctcacaggctgcagacagttcagc

SEQ ID NO: 112102 - DNA, 29 bp, Artificial Sequence
  Description of Artificial Sequence: Synthetic oligonucleotide
gattgctcacaggctgcagacagttcagc

SEQ ID NO: 112103 - DNA, 29 bp, Artificial Sequence
  Description of Artificial Sequence: Synthetic oligonucleotide
attgctcacaggctgcagacagttcagcg

SEQ ID NO: 112104 - DNA, 28 bp, Artificial Sequence
  Description of Artificial Sequence: Synthetic oligonucleotide
ttgctcacaggctgcagacagttcagcg

SEQ ID NO: 112105 - DNA, 27 bp, Artificial Sequence
  Description of Artificial Sequence: Synthetic oligonucleotide
tgctcacaggctgcagacagttcagcg

SEQ ID NO: 112106 - DNA, 26 bp, Artificial Sequence
  Description of Artificial Sequence: Synthetic oligonucleotide
gctcacaggctgcagacagttcagcg

SEQ ID NO: 112107 - DNA, 26 bp, Artificial Sequence
  Description of Artificial Sequence: Synthetic oligonucleotide
ctcacaggctgcagacagttcagcgc

SEQ ID NO: 112108 - DNA, 26 bp, Artificial Sequence
  Description of Artificial Sequence: Synthetic oligonucleotide
tcacaggctgcagacagttcagcgcg

SEQ ID NO: 112109 - DNA, 25 bp, Artificial Sequence
  Description of Artificial Sequence: Synthetic oligonucleotide
cacaggctgcagacagttcagcgcg

SEQ ID NO: 112110 - DNA, 25 bp, Artificial Sequence
  Description of Artificial Sequence: Synthetic oligonucleotide
acaggctgcagacagttcagcgcgc

SEQ ID NO: 112111 - DNA, 24 bp, Artificial Sequence
  Description of Artificial Sequence: Synthetic oligonucleotide
caggctgcagacagttcagcgcgc

SEQ ID NO: 112112 - DNA, 24 bp, Artificial Sequence
  Description of Artificial Sequence: Synthetic oligonucleotide
aggctgcagacagttcagcgcgcc

SEQ ID NO: 112113 - DNA, 23 bp, Artificial Sequence
  Description of Artificial Sequence: Synthetic oligonucleotide
ggctgcagacagttcagcgcgcc

SEQ ID NO: 112114 - DNA, 24 bp, Artificial Sequence
  Description of Artificial Sequence: Synthetic oligonucleotide
gctgcagacagttcagcgcgccca

SEQ ID NO: 112115 - DNA, 24 bp, Artificial Sequence
  Description of Artificial Sequence: Synthetic oligonucleotide
ctgcagacagttcagcgcgcccac

SEQ ID NO: 112116 - DNA, 25 bp, Artificial Sequence
  Description of Artificial Sequence: Synthetic oligonucleotide
tgcagacagttcagcgcgcccacca

SEQ ID NO: 112117 - DNA, 24 bp, Artificial Sequence
  Description of Artificial Sequence: Synthetic oligonucleotide
gcagacagttcagcgcgcccacca

SEQ ID NO: 112118 - DNA, 26 bp, Artificial Sequence
  Description of Artificial Sequence: Synthetic oligonucleotide
cagacagttcagcgcgcccaccagat

SEQ ID NO: 112119 - DNA, 26 bp, Artificial Sequence
  Description of Artificial Sequence: Synthetic oligonucleotide
agacagttcagcgcgcccaccagatc

SEQ ID NO: 112120 - DNA, 25 bp, Artificial Sequence
  Description of Artificial Sequence: Synthetic oligonucleotide
gacagttcagcgcgcccaccagatc

SEQ ID NO: 112121 - DNA, 26 bp, Artificial Sequence
  Description of Artificial Sequence: Synthetic oligonucleotide
acagttcagcgcgcccaccagatcct

SEQ ID NO: 112122 - DNA, 25 bp, Artificial Sequence
  Description of Artificial Sequence: Synthetic oligonucleotide
cagttcagcgcgcccaccagatcct

SEQ ID NO: 112123 - DNA, 25 bp, Artificial Sequence
  Description of Artificial Sequence: Synthetic oligonucleotide
agttcagcgcgcccaccagatcctg

SEQ ID NO: 112124 - DNA, 24 bp, Artificial Sequence
  Description of Artificial Sequence: Synthetic oligonucleotide
gttcagcgcgcccaccagatcctg

SEQ ID NO: 112125 - DNA, 25 bp, Artificial Sequence
  Description of Artificial Sequence: Synthetic oligonucleotide
ttcagcgcgcccaccagatcctggt

SEQ ID NO: 112126 - DNA, 24 bp, Artificial Sequence
  Description of Artificial Sequence: Synthetic oligonucleotide
tcagcgcgcccaccagatcctggt

SEQ ID NO: 112127 - DNA, 23 bp, Artificial Sequence
  Description of Artificial Sequence: Synthetic oligonucleotide
cagcgcgcccaccagatcctggt

SEQ ID NO: 112128 - DNA, 23 bp, Artificial Sequence
  Description of Artificial Sequence: Synthetic oligonucleotide
agcgcgcccaccagatcctggtg

SEQ ID NO: 112129 - DNA, 22 bp, Artificial Sequence
  Description of Artificial Sequence: Synthetic oligonucleotide
gcgcgcccaccagatcctggtg

SEQ ID NO: 112130 - DNA, 23 bp, Artificial Sequence
  Description of Artificial Sequence: Synthetic oligonucleotide
cgcgcccaccagatcctggtgct

SEQ ID NO: 112131 - DNA, 23 bp, Artificial Sequence
  Description of Artificial Sequence: Synthetic oligonucleotide
gcgcccaccagatcctggtgctc

SEQ ID NO: 112132 - DNA, 24 bp, Artificial Sequence
  Description of Artificial Sequence: Synthetic oligonucleotide
cgcccaccagatcctggtgctcca

SEQ ID NO: 112133 - DNA, 24 bp, Artificial Sequence
  Description of Artificial Sequence: Synthetic oligonucleotide
gcccaccagatcctggtgctccag

SEQ ID NO: 112134 - DNA, 25 bp, Artificial Sequence
  Description of Artificial Sequence: Synthetic oligonucleotide
cccaccagatcctggtgctccagga

SEQ ID NO: 112135 - DNA, 25 bp, Artificial Sequence
  Description of Artificial Sequence: Synthetic oligonucleotide
ccaccagatcctggtgctccaggag

SEQ ID NO: 112136 - DNA, 25 bp, Artificial Sequence
  Description of Artificial Sequence: Synthetic oligonucleotide
caccagatcctggtgctccaggagg

SEQ ID NO: 112137 - DNA, 25 bp, Artificial Sequence
  Description of Artificial Sequence: Synthetic oligonucleotide
accagatcctggtgctccaggaggg

SEQ ID NO: 112138 - DNA, 24 bp, Artificial Sequence
  Description of Artificial Sequence: Synthetic oligonucleotide
ccagatcctggtgctccaggaggg

SEQ ID NO: 112139 - DNA, 26 bp, Artificial Sequence
  Description of Artificial Sequence: Synthetic oligonucleotide
cagatcctggtgctccaggagggcaa

SEQ ID NO: 112140 - DNA, 26 bp, Artificial Sequence
  Description of Artificial Sequence: Synthetic oligonucleotide
agatcctggtgctccaggagggcaag

SEQ ID NO: 112141 - DNA, 25 bp, Artificial Sequence
  Description of Artificial Sequence: Synthetic oligonucleotide
gatcctggtgctccaggagggcaag

SEQ ID NO: 112142 - DNA, 26 bp, Artificial Sequence
  Description of Artificial Sequence: Synthetic oligonucleotide
atcctggtgctccaggagggcaagct

SEQ ID NO: 112143 - DNA, 25 bp, Artificial Sequence
  Description of Artificial Sequence: Synthetic oligonucleotide
tcctggtgctccaggagggcaagct

SEQ ID NO: 112144 - DNA, 24 bp, Artificial Sequence
  Description of Artificial Sequence: Synthetic oligonucleotide
cctggtgctccaggagggcaagct

SEQ ID NO: 112145 - DNA, 24 bp, Artificial Sequence
  Description of Artificial Sequence: Synthetic oligonucleotide
ctggtgctccaggagggcaagctg

SEQ ID NO: 112146 - DNA, 25 bp, Artificial Sequence
  Description of Artificial Sequence: Synthetic oligonucleotide
tggtgctccaggagggcaagctgca

SEQ ID NO: 112147 - DNA, 24 bp, Artificial Sequence
  Description of Artificial Sequence: Synthetic oligonucleotide
ggtgctccaggagggcaagctgca

SEQ ID NO: 112148 - DNA, 26 bp, Artificial Sequence
  Description of Artificial Sequence: Synthetic oligonucleotide
gtgctccaggagggcaagctgcagaa

SEQ ID NO: 112149 - DNA, 26 bp, Artificial Sequence
  Description of Artificial Sequence: Synthetic oligonucleotide
tgctccaggagggcaagctgcagaag

SEQ ID NO: 112150 - DNA, 25 bp, Artificial Sequence
  Description of Artificial Sequence: Synthetic oligonucleotide
gctccaggagggcaagctgcagaag

SEQ ID NO: 112151 - DNA, 27 bp, Artificial Sequence
  Description of Artificial Sequence: Synthetic oligonucleotide
ctccaggagggcaagctgcagaagctt

SEQ ID NO: 112152 - DNA, 27 bp, Artificial Sequence
  Description of Artificial Sequence: Synthetic oligonucleotide
tccaggagggcaagctgcagaagcttg

SEQ ID NO: 112153 - DNA, 26 bp, Artificial Sequence
  Description of Artificial Sequence: Synthetic oligonucleotide
ccaggagggcaagctgcagaagcttg

SEQ ID NO: 112154 - DNA, 26 bp, Artificial Sequence
  Description of Artificial Sequence: Synthetic oligonucleotide
caggagggcaagctgcagaagcttgc

SEQ ID NO: 112155 - DNA, 26 bp, Artificial Sequence
  Description of Artificial Sequence: Synthetic oligonucleotide
aggagggcaagctgcagaagcttgcc

SEQ ID NO: 112156 - DNA, 25 bp, Artificial Sequence
  Description of Artificial Sequence: Synthetic oligonucleotide
ggagggcaagctgcagaagcttgcc

SEQ ID NO: 112157 - DNA, 26 bp, Artificial Sequence
  Description of Artificial Sequence: Synthetic oligonucleotide
gagggcaagctgcagaagcttgccca

SEQ ID NO: 112158 - DNA, 26 bp, Artificial Sequence
  Description of Artificial Sequence: Synthetic oligonucleotide
agggcaagctgcagaagcttgcccag

SEQ ID NO: 112159 - DNA, 25 bp, Artificial Sequence
  Description of Artificial Sequence: Synthetic oligonucleotide
gggcaagctgcagaagcttgcccag

SEQ ID NO: 112160 - DNA, 26 bp, Artificial Sequence
  Description of Artificial Sequence: Synthetic oligonucleotide
ggcaagctgcagaagcttgcccagct

SEQ ID NO: 112161 - DNA, 27 bp, Artificial Sequence
  Description of Artificial Sequence: Synthetic oligonucleotide
gcaagctgcagaagcttgcccagctct

SEQ ID NO: 112162 - DNA, 28 bp, Artificial Sequence
  Description of Artificial Sequence: Synthetic oligonucleotide
caagctgcagaagcttgcccagctctag

SEQ ID NO: 112163 - DNA, 32 bp, Artificial Sequence
  Description of Artificial Sequence: Synthetic oligonucleotide
ccgccttcttcttccttgtccttgctgttttg

SEQ ID NO: 112164 - DNA, 32 bp, Artificial Sequence
  Description of Artificial Sequence: Synthetic oligonucleotide
cgccttcttcttccttgtccttgctgttttgg

SEQ ID NO: 112165 - DNA, 32 bp, Artificial Sequence
  Description of Artificial Sequence: Synthetic oligonucleotide
gccttcttcttccttgtccttgctgttttggg

SEQ ID NO: 112166 - DNA, 33 bp, Artificial Sequence
  Description of Artificial Sequence: Synthetic oligonucleotide
ccttcttcttccttgtccttgctgttttgggtg

SEQ ID NO: 112167 - DNA, 34 bp, Artificial Sequence
  Description of Artificial Sequence: Synthetic oligonucleotide
cttcttcttccttgtccttgctgttttgggtgag

SEQ ID NO: 112168 - DNA, 35 bp, Artificial Sequence
  Description of Artificial Sequence: Synthetic oligonucleotide
ttcttcttccttgtccttgctgttttgggtgagac

SEQ ID NO: 112169 - DNA, 34 bp, Artificial Sequence
  Description of Artificial Sequence: Synthetic oligonucleotide
tcttcttccttgtccttgctgttttgggtgagac

SEQ ID NO: 112170 - DNA, 33 bp, Artificial Sequence
  Description of Artificial Sequence: Synthetic oligonucleotide
cttcttccttgtccttgctgttttgggtgagac

SEQ ID NO: 112171 - DNA, 39 bp, Artificial Sequence
  Description of Artificial Sequence: Synthetic oligonucleotide
ttcttccttgtccttgctgttttgggtgagacattaatc

SEQ ID NO: 112172 - DNA, 38 bp, Artificial Sequence
  Description of Artificial Sequence: Synthetic oligonucleotide
tcttccttgtccttgctgttttgggtgagacattaatc

SEQ ID NO: 112173 - DNA, 37 bp, Artificial Sequence
  Description of Artificial Sequence: Synthetic oligonucleotide
cttccttgtccttgctgttttgggtgagacattaatc

SEQ ID NO: 112174 - DNA, 37 bp, Artificial Sequence
  Description of Artificial Sequence: Synthetic oligonucleotide
ttccttgtccttgctgttttgggtgagacattaatcc

SEQ ID NO: 112175 - DNA, 36 bp, Artificial Sequence
  Description of Artificial Sequence: Synthetic oligonucleotide
tccttgtccttgctgttttgggtgagacattaatcc

SEQ ID NO: 112176 - DNA, 35 bp, Artificial Sequence
  Description of Artificial Sequence: Synthetic oligonucleotide
ccttgtccttgctgttttgggtgagacattaatcc

SEQ ID NO: 112177 - DNA, 35 bp, Artificial Sequence
  Description of Artificial Sequence: Synthetic oligonucleotide
cttgtccttgctgttttgggtgagacattaatccc

SEQ ID NO: 112178 - DNA, 36 bp, Artificial Sequence
  Description of Artificial Sequence: Synthetic oligonucleotide
ttgtccttgctgttttgggtgagacattaatccctc

SEQ ID NO: 112179 - DNA, 35 bp, Artificial Sequence
  Description of Artificial Sequence: Synthetic oligonucleotide
tgtccttgctgttttgggtgagacattaatccctc

SEQ ID NO: 112180 - DNA, 34 bp, Artificial Sequence
  Description of Artificial Sequence: Synthetic oligonucleotide
gtccttgctgttttgggtgagacattaatccctc

SEQ ID NO: 112181 - DNA, 35 bp, Artificial Sequence
  Description of Artificial Sequence: Synthetic oligonucleotide
tccttgctgttttgggtgagacattaatccctcac

SEQ ID NO: 112182 - DNA, 34 bp, Artificial Sequence
  Description of Artificial Sequence: Synthetic oligonucleotide
ccttgctgttttgggtgagacattaatccctcac

SEQ ID NO: 112183 - DNA, 38 bp, Artificial Sequence
  Description of Artificial Sequence: Synthetic oligonucleotide
cttgctgttttgggtgagacattaatccctcactattc

SEQ ID NO: 112184 - DNA, 39 bp, Artificial Sequence
  Description of Artificial Sequence: Synthetic oligonucleotide
ttgctgttttgggtgagacattaatccctcactattctg

SEQ ID NO: 112185 - DNA, 38 bp, Artificial Sequence
  Description of Artificial Sequence: Synthetic oligonucleotide
tgctgttttgggtgagacattaatccctcactattctg

SEQ ID NO: 112186 - DNA, 37 bp, Artificial Sequence
  Description of Artificial Sequence: Synthetic oligonucleotide
gctgttttgggtgagacattaatccctcactattctg

SEQ ID NO: 112187 - DNA, 37 bp, Artificial Sequence
  Description of Artificial Sequence: Synthetic oligonucleotide
ctgttttgggtgagacattaatccctcactattctgg

SEQ ID NO: 112188 - DNA, 38 bp, Artificial Sequence
  Description of Artificial Sequence: Synthetic oligonucleotide
tgttttgggtgagacattaatccctcactattctggtc

SEQ ID NO: 112189 - DNA, 37 bp, Artificial Sequence
  Description of Artificial Sequence: Synthetic oligonucleotide
gttttgggtgagacattaatccctcactattctggtc

SEQ ID NO: 112190 - DNA, 37 bp, Artificial Sequence
  Description of Artificial Sequence: Synthetic oligonucleotide
ttttgggtgagacattaatccctcactattctggtcg

SEQ ID NO: 112191 - DNA, 36 bp, Artificial Sequence
  Description of Artificial Sequence: Synthetic oligonucleotide
tttgggtgagacattaatccctcactattctggtcg

SEQ ID NO: 112192 - DNA, 27 bp, Artificial Sequence
  Description of Artificial Sequence: Synthetic oligonucleotide
ctcgtaaggagggtgctgcacttgggt

SEQ ID NO: 112193 - DNA, 27 bp, Artificial Sequence
  Description of Artificial Sequence: Synthetic oligonucleotide
tcgtaaggagggtgctgcacttgggtg

SEQ ID NO: 112194 - DNA, 27 bp, Artificial Sequence
  Description of Artificial Sequence: Synthetic oligonucleotide
cgtaaggagggtgctgcacttgggtgt

SEQ ID NO: 112195 - DNA, 27 bp, Artificial Sequence
  Description of Artificial Sequence: Synthetic oligonucleotide
gtaaggagggtgctgcacttgggtgtg

SEQ ID NO: 112196 - DNA, 27 bp, Artificial Sequence
  Description of Artificial Sequence: Synthetic oligonucleotide
taaggagggtgctgcacttgggtgtgc

SEQ ID NO: 112197 - DNA, 27 bp, Artificial Sequence
  Description of Artificial Sequence: Synthetic oligonucleotide
aaggagggtgctgcacttgggtgtgca

SEQ ID NO: 112198 - DNA, 26 bp, Artificial Sequence
  Description of Artificial Sequence: Synthetic oligonucleotide
aggagggtgctgcacttgggtgtgca

SEQ ID NO: 112199 - DNA, 25 bp, Artificial Sequence
  Description of Artificial Sequence: Synthetic oligonucleotide
ggagggtgctgcacttgggtgtgca

SEQ ID NO: 112200 - DNA, 27 bp, Artificial Sequence
  Description of Artificial Sequence: Synthetic oligonucleotide
gagggtgctgcacttgggtgtgcagat

SEQ ID NO: 112201 - DNA, 27 bp, Artificial Sequence
  Description of Artificial Sequence: Synthetic oligonucleotide
agggtgctgcacttgggtgtgcagatg

SEQ ID NO: 112202 - DNA, 26 bp, Artificial Sequence
  Description of Artificial Sequence: Synthetic oligonucleotide
gggtgctgcacttgggtgtgcagatg

SEQ ID NO: 112203 - DNA, 27 bp, Artificial Sequence
  Description of Artificial Sequence: Synthetic oligonucleotide
ggtgctgcacttgggtgtgcagatgct

SEQ ID NO: 112204 - DNA, 27 bp, Artificial Sequence
  Description of Artificial Sequence: Synthetic oligonucleotide
gtgctgcacttgggtgtgcagatgctg

SEQ ID NO: 112205 - DNA, 29 bp, Artificial Sequence
  Description of Artificial Sequence: Synthetic oligonucleotide
tgctgcacttgggtgtgcagatgctgatg

SEQ ID NO: 112206 - DNA, 28 bp, Artificial Sequence
  Description of Artificial Sequence: Synthetic oligonucleotide
gctgcacttgggtgtgcagatgctgatg

SEQ ID NO: 112207 - DNA, 28 bp, Artificial Sequence
  Description of Artificial Sequence: Synthetic oligonucleotide
ctgcacttgggtgtgcagatgctgatgc

SEQ ID NO: 112208 - DNA, 29 bp, Artificial Sequence
  Description of Artificial Sequence: Synthetic oligonucleotide
tgcacttgggtgtgcagatgctgatgctg

SEQ ID NO: 112209 - DNA, 28 bp, Artificial Sequence
  Description of Artificial Sequence: Synthetic oligonucleotide
gcacttgggtgtgcagatgctgatgctg

SEQ ID NO: 112210 - DNA, 29 bp, Artificial Sequence
  Description of Artificial Sequence: Synthetic oligonucleotide
cacttgggtgtgcagatgctgatgctgag

SEQ ID NO: 112211 - DNA, 29 bp, Artificial Sequence
  Description of Artificial Sequence: Synthetic oligonucleotide
acttgggtgtgcagatgctgatgctgagc

SEQ ID NO: 112212 - DNA, 28 bp, Artificial Sequence
  Description of Artificial Sequence: Synthetic oligonucleotide
cttgggtgtgcagatgctgatgctgagc

SEQ ID NO: 112213 - DNA, 29 bp, Artificial Sequence
  Description of Artificial Sequence: Synthetic oligonucleotide
ttgggtgtgcagatgctgatgctgagctg

SEQ ID NO: 112214 - DNA, 28 bp, Artificial Sequence
  Description of Artificial Sequence: Synthetic oligonucleotide
tgggtgtgcagatgctgatgctgagctg

SEQ ID NO: 112215 - DNA, 27 bp, Artificial Sequence
  Description of Artificial Sequence: Synthetic oligonucleotide
gggtgtgcagatgctgatgctgagctg

SEQ ID NO: 112216 - DNA, 28 bp, Artificial Sequence
  Description of Artificial Sequence: Synthetic oligonucleotide
ggtgtgcagatgctgatgctgagctgtg

SEQ ID NO: 112217 - DNA, 28 bp, Artificial Sequence
  Description of Artificial Sequence: Synthetic oligonucleotide
gtgtgcagatgctgatgctgagctgtgg

SEQ ID NO: 112218 - DNA, 28 bp, Artificial Sequence
  Description of Artificial Sequence: Synthetic oligonucleotide
tgtgcagatgctgatgctgagctgtggg

SEQ ID NO: 112219 - DNA, 34 bp, Artificial Sequence
  Description of Artificial Sequence: Synthetic oligonucleotide
tgctgttctccggttctgtgaggaacaacattac

SEQ ID NO: 112220 - DNA, 33 bp, Artificial Sequence
  Description of Artificial Sequence: Synthetic oligonucleotide
gctgttctccggttctgtgaggaacaacattac

SEQ ID NO: 112221 - DNA, 37 bp, Artificial Sequence
  Description of Artificial Sequence: Synthetic oligonucleotide
ctgttctccggttctgtgaggaacaacattacttatg

SEQ ID NO: 112222 - DNA, 37 bp, Artificial Sequence
  Description of Artificial Sequence: Synthetic oligonucleotide
tgttctccggttctgtgaggaacaacattacttatgg

SEQ ID NO: 112223 - DNA, 36 bp, Artificial Sequence
  Description of Artificial Sequence: Synthetic oligonucleotide
gttctccggttctgtgaggaacaacattacttatgg

SEQ ID NO: 112224 - DNA, 36 bp, Artificial Sequence
  Description of Artificial Sequence: Synthetic oligonucleotide
ttctccggttctgtgaggaacaacattacttatggg

SEQ ID NO: 112225 - DNA, 35 bp, Artificial Sequence
  Description of Artificial Sequence: Synthetic oligonucleotide
tctccggttctgtgaggaacaacattacttatggg

SEQ ID NO: 112226 - DNA, 34 bp, Artificial Sequence
  Description of Artificial Sequence: Synthetic oligonucleotide
ctccggttctgtgaggaacaacattacttatggg

SEQ ID NO: 112227 - DNA, 34 bp, Artificial Sequence
  Description of Artificial Sequence: Synthetic oligonucleotide
tccggttctgtgaggaacaacattacttatgggc

SEQ ID NO: 112228 - DNA, 33 bp, Artificial Sequence
  Description of Artificial Sequence: Synthetic oligonucleotide
ccggttctgtgaggaacaacattacttatgggc

SEQ ID NO: 112229 - DNA, 34 bp, Artificial Sequence
  Description of Artificial Sequence: Synthetic oligonucleotide
cggttctgtgaggaacaacattacttatgggctg

SEQ ID NO: 112230 - DNA, 34 bp, Artificial Sequence
  Description of Artificial Sequence: Synthetic oligonucleotide
ggttctgtgaggaacaacattacttatgggctgc

SEQ ID NO: 112231 - DNA, 35 bp, Artificial Sequence
  Description of Artificial Sequence: Synthetic oligonucleotide
gttctgtgaggaacaacattacttatgggctgcag

SEQ ID NO: 112232 - DNA, 36 bp, Artificial Sequence
  Description of Artificial Sequence: Synthetic oligonucleotide
ttctgtgaggaacaacattacttatgggctgcagag

SEQ ID NO: 112233 - DNA, 35 bp, Artificial Sequence
  Description of Artificial Sequence: Synthetic oligonucleotide
tctgtgaggaacaacattacttatgggctgcagag

SEQ ID NO: 112234 - DNA, 34 bp, Artificial Sequence
  Description of Artificial Sequence: Synthetic oligonucleotide
ctgtgaggaacaacattacttatgggctgcagag

SEQ ID NO: 112235 - DNA, 34 bp, Artificial Sequence
  Description of Artificial Sequence: Synthetic oligonucleotide
tgtgaggaacaacattacttatgggctgcagagc

SEQ ID NO: 112236 - DNA, 33 bp, Artificial Sequence
  Description of Artificial Sequence: Synthetic oligonucleotide
gtgaggaacaacattacttatgggctgcagagc

SEQ ID NO: 112237 - DNA, 34 bp, Artificial Sequence
  Description of Artificial Sequence: Synthetic oligonucleotide
tgaggaacaacattacttatgggctgcagagctg

SEQ ID NO: 112238 - DNA, 33 bp, Artificial Sequence
  Description of Artificial Sequence: Synthetic oligonucleotide
gaggaacaacattacttatgggctgcagagctg

SEQ ID NO: 112239 - DNA, 33 bp, Artificial Sequence
  Description of Artificial Sequence: Synthetic oligonucleotide
aggaacaacattacttatgggctgcagagctgc

SEQ ID NO: 112240 - DNA, 32 bp, Artificial Sequence
  Description of Artificial Sequence: Synthetic oligonucleotide
ggaacaacattacttatgggctgcagagctgc

SEQ ID NO: 112241 - DNA, 32 bp, Artificial Sequence
  Description of Artificial Sequence: Synthetic oligonucleotide
gaacaacattacttatgggctgcagagctgcg

SEQ ID NO: 112242 - DNA, 34 bp, Artificial Sequence
  Description of Artificial Sequence: Synthetic oligonucleotide
aacaacattacttatgggctgcagagctgcgaag

SEQ ID NO: 112243 - DNA, 33 bp, Artificial Sequence
  Description of Artificial Sequence: Synthetic oligonucleotide
acaacattacttatgggctgcagagctgcgaag

SEQ ID NO: 112244 - DNA, 32 bp, Artificial Sequence
  Description of Artificial Sequence: Synthetic oligonucleotide
caacattacttatgggctgcagagctgcgaag

SEQ ID NO: 112245 - DNA, 34 bp, Artificial Sequence
  Description of Artificial Sequence: Synthetic oligonucleotide
aacattacttatgggctgcagagctgcgaagatg

SEQ ID NO: 112246 - DNA, 33 bp, Artificial Sequence
  Description of Artificial Sequence: Synthetic oligonucleotide
acattacttatgggctgcagagctgcgaagatg

SEQ ID NO: 112247 - DNA, 32 bp, Artificial Sequence
  Description of Artificial Sequence: Synthetic oligonucleotide
cattacttatgggctgcagagctgcgaagatg

SEQ ID NO: 112248 - DNA, 36 bp, Artificial Sequence
  Description of Artificial Sequence: Synthetic oligonucleotide
attacttatgggctgcagagctgcgaagatgataag

SEQ ID NO: 112249 - DNA, 35 bp, Artificial Sequence
  Description of Artificial Sequence: Synthetic oligonucleotide
ttacttatgggctgcagagctgcgaagatgataag

SEQ ID NO: 112250 - DNA, 34 bp, Artificial Sequence
  Description of Artificial Sequence: Synthetic oligonucleotide
tacttatgggctgcagagctgcgaagatgataag

SEQ ID NO: 112251 - DNA, 33 bp, Artificial Sequence
  Description of Artificial Sequence: Synthetic oligonucleotide
acttatgggctgcagagctgcgaagatgataag

SEQ ID NO: 112252 - DNA, 27 bp, Artificial Sequence
  Description of Artificial Sequence: Synthetic oligonucleotide
agcaggccctgcaggactggaattcct

SEQ ID NO: 112253 - DNA, 26 bp, Artificial Sequence
  Description of Artificial Sequence: Synthetic oligonucleotide
gcaggccctgcaggactggaattcct

SEQ ID NO: 112254 - DNA, 27 bp, Artificial Sequence
  Description of Artificial Sequence: Synthetic oligonucleotide
caggccctgcaggactggaattcctgt

SEQ ID NO: 112255 - DNA, 27 bp, Artificial Sequence
  Description of Artificial Sequence: Synthetic oligonucleotide
aggccctgcaggactggaattcctgtg

SEQ ID NO: 112256 - DNA, 26 bp, Artificial Sequence
  Description of Artificial Sequence: Synthetic oligonucleotide
ggccctgcaggactggaattcctgtg

SEQ ID NO: 112257 - DNA, 26 bp, Artificial Sequence
  Description of Artificial Sequence: Synthetic oligonucleotide
gccctgcaggactggaattcctgtgg

SEQ ID NO: 112258 - DNA, 26 bp, Artificial Sequence
  Description of Artificial Sequence: Synthetic oligonucleotide
ccctgcaggactggaattcctgtggg

SEQ ID NO: 112259 - DNA, 27 bp, Artificial Sequence
  Description of Artificial Sequence: Synthetic oligonucleotide
cctgcaggactggaattcctgtgggga

SEQ ID NO: 112260 - DNA, 28 bp, Artificial Sequence
  Description of Artificial Sequence: Synthetic oligonucleotide
ctgcaggactggaattcctgtggggatc

SEQ ID NO: 112261 - DNA, 28 bp, Artificial Sequence
  Description of Artificial Sequence: Synthetic oligonucleotide
tgcaggactggaattcctgtggggatcg

SEQ ID NO: 112262 - DNA, 27 bp, Artificial Sequence
  Description of Artificial Sequence: Synthetic oligonucleotide
gcaggactggaattcctgtggggatcg

SEQ ID NO: 112263 - DNA, 27 bp, Artificial Sequence
  Description of Artificial Sequence: Synthetic oligonucleotide
caggactggaattcctgtggggatcgc

SEQ ID NO: 112264 - DNA, 28 bp, Artificial Sequence
  Description of Artificial Sequence: Synthetic oligonucleotide
aggactggaattcctgtggggatcgcac

SEQ ID NO: 112265 - DNA, 27 bp, Artificial Sequence
  Description of Artificial Sequence: Synthetic oligonucleotide
ggactggaattcctgtggggatcgcac

SEQ ID NO: 112266 - DNA, 28 bp, Artificial Sequence
  Description of Artificial Sequence: Synthetic oligonucleotide
gactggaattcctgtggggatcgcacag

SEQ ID NO: 112267 - DNA, 29 bp, Artificial Sequence
  Description of Artificial Sequence: Synthetic oligonucleotide
actggaattcctgtggggatcgcacagtg

SEQ ID NO: 112268 - DNA, 28 bp, Artificial Sequence
  Description of Artificial Sequence: Synthetic oligonucleotide
ctggaattcctgtggggatcgcacagtg

SEQ ID NO: 112269 - DNA, 28 bp, Artificial Sequence
  Description of Artificial Sequence: Synthetic oligonucleotide
tggaattcctgtggggatcgcacagtgc

SEQ ID NO: 112270 - DNA, 27 bp, Artificial Sequence
  Description of Artificial Sequence: Synthetic oligonucleotide
ggaattcctgtggggatcgcacagtgc

SEQ ID NO: 112271 - DNA, 28 bp, Artificial Sequence
  Description of Artificial Sequence: Synthetic oligonucleotide
gaattcctgtggggatcgcacagtgctg

SEQ ID NO: 112272 - DNA, 28 bp, Artificial Sequence
  Description of Artificial Sequence: Synthetic oligonucleotide
aattcctgtggggatcgcacagtgctgg

SEQ ID NO: 112273 - DNA, 27 bp, Artificial Sequence
  Description of Artificial Sequence: Synthetic oligonucleotide
attcctgtggggatcgcacagtgctgg

SEQ ID NO: 112274 - DNA, 27 bp, Artificial Sequence
  Description of Artificial Sequence: Synthetic oligonucleotide
ttcctgtggggatcgcacagtgctggt

SEQ ID NO: 112275 - DNA, 26 bp, Artificial Sequence
  Description of Artificial Sequence: Synthetic oligonucleotide
tcctgtggggatcgcacagtgctggt

SEQ ID NO: 112276 - DNA, 25 bp, Artificial Sequence
  Description of Artificial Sequence: Synthetic oligonucleotide
cctgtggggatcgcacagtgctggt

SEQ ID NO: 112277 - DNA, 27 bp, Artificial Sequence
  Description of Artificial Sequence: Synthetic oligonucleotide
ctgtggggatcgcacagtgctggtgat

SEQ ID NO: 112278 - DNA, 28 bp, Artificial Sequence
  Description of Artificial Sequence: Synthetic oligonucleotide
tgtggggatcgcacagtgctggtgattg

SEQ ID NO: 112279 - DNA, 37 bp, Artificial Sequence
  Description of Artificial Sequence: Synthetic oligonucleotide
accctggtatacatatatggggatatgctcagcaatg

SEQ ID NO: 112280 - DNA, 36 bp, Artificial Sequence
  Description of Artificial Sequence: Synthetic oligonucleotide
ccctggtatacatatatggggatatgctcagcaatg

SEQ ID NO: 112281 - DNA, 37 bp, Artificial Sequence
  Description of Artificial Sequence: Synthetic oligonucleotide
cctggtatacatatatggggatatgctcagcaatgtg

SEQ ID NO: 112282 - DNA, 37 bp, Artificial Sequence
  Description of Artificial Sequence: Synthetic oligonucleotide
ctggtatacatatatggggatatgctcagcaatgtgg

SEQ ID NO: 112283 - DNA, 37 bp, Artificial Sequence
  Description of Artificial Sequence: Synthetic oligonucleotide
tggtatacatatatggggatatgctcagcaatgtggg

SEQ ID NO: 112284 - DNA, 36 bp, Artificial Sequence
  Description of Artificial Sequence: Synthetic oligonucleotide
ggtatacatatatggggatatgctcagcaatgtggg

SEQ ID NO: 112285 - DNA, 37 bp, Artificial Sequence
  Description of Artificial Sequence: Synthetic oligonucleotide
gtatacatatatggggatatgctcagcaatgtgggag

SEQ ID NO: 112286 - DNA, 37 bp, Artificial Sequence
  Description of Artificial Sequence: Synthetic oligonucleotide
tatacatatatggggatatgctcagcaatgtgggagc

SEQ ID NO: 112287 - DNA, 36 bp, Artificial Sequence
  Description of Artificial Sequence: Synthetic oligonucleotide
atacatatatggggatatgctcagcaatgtgggagc

SEQ ID NO: 112288 - DNA, 35 bp, Artificial Sequence
  Description of Artificial Sequence: Synthetic oligonucleotide
tacatatatggggatatgctcagcaatgtgggagc

SEQ ID NO: 112289 - DNA, 34 bp, Artificial Sequence
  Description of Artificial Sequence: Synthetic oligonucleotide
acatatatggggatatgctcagcaatgtgggagc

SEQ ID NO: 112290 - DNA, 33 bp, Artificial Sequence
  Description of Artificial Sequence: Synthetic oligonucleotide
catatatggggatatgctcagcaatgtgggagc

SEQ ID NO: 112291 - DNA, 34 bp, Artificial Sequence
  Description of Artificial Sequence: Synthetic oligonucleotide
atatatggggatatgctcagcaatgtgggagctg

SEQ ID NO: 112292 - DNA, 33 bp, Artificial Sequence
  Description of Artificial Sequence: Synthetic oligonucleotide
tatatggggatatgctcagcaatgtgggagctg

SEQ ID NO: 112293 - DNA, 32 bp, Artificial Sequence
  Description of Artificial Sequence: Synthetic oligonucleotide
atatggggatatgctcagcaatgtgggagctg

SEQ ID NO: 112294 - DNA, 31 bp, Artificial Sequence
  Description of Artificial Sequence: Synthetic oligonucleotide
tatggggatatgctcagcaatgtgggagctg

SEQ ID NO: 112295 - DNA, 30 bp, Artificial Sequence
  Description of Artificial Sequence: Synthetic oligonucleotide
atggggatatgctcagcaatgtgggagctg

SEQ ID NO: 112296 - DNA, 29 bp, Artificial Sequence
  Description of Artificial Sequence: Synthetic oligonucleotide
tggggatatgctcagcaatgtgggagctg

SEQ ID NO: 112297 - DNA, 28 bp, Artificial Sequence
  Description of Artificial Sequence: Synthetic oligonucleotide
ggggatatgctcagcaatgtgggagctg

SEQ ID NO: 112298 - DNA, 28 bp, Artificial Sequence
  Description of Artificial Sequence: Synthetic oligonucleotide
gggatatgctcagcaatgtgggagctgc

SEQ ID NO: 112299 - DNA, 29 bp, Artificial Sequence
  Description of Artificial Sequence: Synthetic oligonucleotide
ggatatgctcagcaatgtgggagctgcag

SEQ ID NO: 112300 - DNA, 30 bp, Artificial Sequence
  Description of Artificial Sequence: Synthetic oligonucleotide
gatatgctcagcaatgtgggagctgcagag

SEQ ID NO: 112301 - DNA, 32 bp, Artificial Sequence
  Description of Artificial Sequence: Synthetic oligonucleotide
atatgctcagcaatgtgggagctgcagagaag

SEQ ID NO: 112302 - DNA, 31 bp, Artificial Sequence
  Description of Artificial Sequence: Synthetic oligonucleotide
tatgctcagcaatgtgggagctgcagagaag

SEQ ID NO: 112303 - DNA, 30 bp, Artificial Sequence
  Description of Artificial Sequence: Synthetic oligonucleotide
atgctcagcaatgtgggagctgcagagaag

SEQ ID NO: 112304 - DNA, 29 bp, Artificial Sequence
  Description of Artificial Sequence: Synthetic oligonucleotide
tgctcagcaatgtgggagctgcagagaag

SEQ ID NO: 112305 - DNA, 28 bp, Artificial Sequence
  Description of Artificial Sequence: Synthetic oligonucleotide
gctcagcaatgtgggagctgcagagaag

SEQ ID NO: 112306 - DNA, 28 bp, Artificial Sequence
  Description of Artificial Sequence: Synthetic oligonucleotide
ctcagcaatgtgggagctgcagagaagg

SEQ ID NO: 112307 - DNA, 32 bp, Artificial Sequence
  Description of Artificial Sequence: Synthetic oligonucleotide
tcagcaatgtgggagctgcagagaaggttttc

SEQ ID NO: 112308 - DNA, 31 bp, Artificial Sequence
  Description of Artificial Sequence: Synthetic oligonucleotide
cagcaatgtgggagctgcagagaaggttttc

SEQ ID NO: 112309 - DNA, 32 bp, Artificial Sequence
  Description of Artificial Sequence: Synthetic oligonucleotide
agcaatgtgggagctgcagagaaggttttctc

SEQ ID NO: 112310 - DNA, 31 bp, Artificial Sequence
  Description of Artificial Sequence: Synthetic oligonucleotide
gcaatgtgggagctgcagagaaggttttctc

SEQ ID NO: 112311 - DNA, 31 bp, Artificial Sequence
  Description of Artificial Sequence: Synthetic oligonucleotide
caatgtgggagctgcagagaaggttttctcc

SEQ ID NO: 112312 - DNA, 33 bp, Artificial Sequence
  Description of Artificial Sequence: Synthetic oligonucleotide
aatgtgggagctgcagagaaggttttctcctac

SEQ ID NO: 112313 - DNA, 32 bp, Artificial Sequence
  Description of Artificial Sequence: Synthetic oligonucleotide
atgtgggagctgcagagaaggttttctcctac

SEQ ID NO: 112314 - DNA, 31 bp, Artificial Sequence
  Description of Artificial Sequence: Synthetic oligonucleotide
tgtgggagctgcagagaaggttttctcctac

SEQ ID NO: 112315 - DNA, 33 bp, Artificial Sequence
  Description of Artificial Sequence: Synthetic oligonucleotide
catggaatatacacagatgtaggggagaagggg

SEQ ID NO: 112316 - DNA, 34 bp, Artificial Sequence
  Description of Artificial Sequence: Synthetic oligonucleotide
atggaatatacacagatgtaggggagaaggggag

SEQ ID NO: 112317 - DNA, 33 bp, Artificial Sequence
  Description of Artificial Sequence: Synthetic oligonucleotide
tggaatatacacagatgtaggggagaaggggag

SEQ ID NO: 112318 - DNA, 32 bp, Artificial Sequence
  Description of Artificial Sequence: Synthetic oligonucleotide
ggaatatacacagatgtaggggagaaggggag

SEQ ID NO: 112319 - DNA, 32 bp, Artificial Sequence
  Description of Artificial Sequence: Synthetic oligonucleotide
gaatatacacagatgtaggggagaaggggagc

SEQ ID NO: 112320 - DNA, 32 bp, Artificial Sequence
  Description of Artificial Sequence: Synthetic oligonucleotide
aatatacacagatgtaggggagaaggggagcc

SEQ ID NO: 112321 - DNA, 31 bp, Artificial Sequence
  Description of Artificial Sequence: Synthetic oligonucleotide
atatacacagatgtaggggagaaggggagcc

SEQ ID NO: 112322 - DNA, 30 bp, Artificial Sequence
  Description of Artificial Sequence: Synthetic oligonucleotide
tatacacagatgtaggggagaaggggagcc

SEQ ID NO: 112323 - DNA, 29 bp, Artificial Sequence
  Description of Artificial Sequence: Synthetic oligonucleotide
atacacagatgtaggggagaaggggagcc

SEQ ID NO: 112324 - DNA, 28 bp, Artificial Sequence
  Description of Artificial Sequence: Synthetic oligonucleotide
tacacagatgtaggggagaaggggagcc

SEQ ID NO: 112325 - DNA, 27 bp, Artificial Sequence
  Description of Artificial Sequence: Synthetic oligonucleotide
acacagatgtaggggagaaggggagcc

SEQ ID NO: 112326 - DNA, 27 bp, Artificial Sequence
  Description of Artificial Sequence: Synthetic oligonucleotide
cacagatgtaggggagaaggggagcca

SEQ ID NO: 112327 - DNA, 27 bp, Artificial Sequence
  Description of Artificial Sequence: Synthetic oligonucleotide
acagatgtaggggagaaggggagccag

SEQ ID NO: 112328 - DNA, 26 bp, Artificial Sequence
  Description of Artificial Sequence: Synthetic oligonucleotide
cagatgtaggggagaaggggagccag

SEQ ID NO: 112329 - DNA, 27 bp, Artificial Sequence
  Description of Artificial Sequence: Synthetic oligonucleotide
agatgtaggggagaaggggagccagct

SEQ ID NO: 112330 - DNA, 26 bp, Artificial Sequence
  Description of Artificial Sequence: Synthetic oligonucleotide
gatgtaggggagaaggggagccagct

SEQ ID NO: 112331 - DNA, 26 bp, Artificial Sequence
  Description of Artificial Sequence: Synthetic oligonucleotide
atgtaggggagaaggggagccagctg

SEQ ID NO: 112332 - DNA, 25 bp, Artificial Sequence
  Description of Artificial Sequence: Synthetic oligonucleotide
tgtaggggagaaggggagccagctg

SEQ ID NO: 112333 - DNA, 24 bp, Artificial Sequence
  Description of Artificial Sequence: Synthetic oligonucleotide
gtaggggagaaggggagccagctg

SEQ ID NO: 112334 - DNA, 24 bp, Artificial Sequence
  Description of Artificial Sequence: Synthetic oligonucleotide
taggggagaaggggagccagctgg

SEQ ID NO: 112335 - DNA, 23 bp, Artificial Sequence
  Description of Artificial Sequence: Synthetic oligonucleotide
aggggagaaggggagccagctgg

SEQ ID NO: 112336 - DNA, 22 bp, Artificial Sequence
  Description of Artificial Sequence: Synthetic oligonucleotide
ggggagaaggggagccagctgg

SEQ ID NO: 112337 - DNA, 23 bp, Artificial Sequence
  Description of Artificial Sequence: Synthetic oligonucleotide
gggagaaggggagccagctggct

SEQ ID NO: 112338 - DNA, 23 bp, Artificial Sequence
  Description of Artificial Sequence: Synthetic oligonucleotide
ggagaaggggagccagctggctg

SEQ ID NO: 112339 - DNA, 23 bp, Artificial Sequence
  Description of Artificial Sequence: Synthetic oligonucleotide
gagaaggggagccagctggctgc

SEQ ID NO: 112340 - DNA, 23 bp, Artificial Sequence
  Description of Artificial Sequence: Synthetic oligonucleotide
agaaggggagccagctggctgcg

SEQ ID NO: 112341 - DNA, 22 bp, Artificial Sequence
  Description of Artificial Sequence: Synthetic oligonucleotide
gaaggggagccagctggctgcg

SEQ ID NO: 112342 - DNA, 22 bp, Artificial Sequence
  Description of Artificial Sequence: Synthetic oligonucleotide
aaggggagccagctggctgcgg

SEQ ID NO: 112343 - DNA, 21 bp, Artificial Sequence
  Description of Artificial Sequence: Synthetic oligonucleotide
aggggagccagctggctgcgg

SEQ ID NO: 112344 - DNA, 20 bp, Artificial Sequence
  Description of Artificial Sequence: Synthetic oligonucleotide
ggggagccagctggctgcgg

SEQ ID NO: 112345 - DNA, 21 bp, Artificial Sequence
  Description of Artificial Sequence: Synthetic oligonucleotide
gggagccagctggctgcggga

SEQ ID NO: 112346 - DNA, 22 bp, Artificial Sequence
  Description of Artificial Sequence: Synthetic oligonucleotide
ggagccagctggctgcgggaca

SEQ ID NO: 112347 - DNA, 25 bp, Artificial Sequence
  Description of Artificial Sequence: Synthetic oligonucleotide
gagccagctggctgcgggacagaaa

SEQ ID NO: 112348 - DNA, 27 bp, Artificial Sequence
  Description of Artificial Sequence: Synthetic oligonucleotide
tgctggtgattgctcacaggctgcagg

SEQ ID NO: 112349 - DNA, 26 bp, Artificial Sequence
  Description of Artificial Sequence: Synthetic oligonucleotide
gctggtgattgctcacaggctgcagg

SEQ ID NO: 112350 - DNA, 27 bp, Artificial Sequence
  Description of Artificial Sequence: Synthetic oligonucleotide
ctggtgattgctcacaggctgcaggca

SEQ ID NO: 112351 - DNA, 27 bp, Artificial Sequence
  Description of Artificial Sequence: Synthetic oligonucleotide
tggtgattgctcacaggctgcaggcag

SEQ ID NO: 112352 - DNA, 27 bp, Artificial Sequence
  Description of Artificial Sequence: Synthetic oligonucleotide
ggtgattgctcacaggctgcaggcagt

SEQ ID NO: 112353 - DNA, 28 bp, Artificial Sequence
  Description of Artificial Sequence: Synthetic oligonucleotide
gtgattgctcacaggctgcaggcagttc

SEQ ID NO: 112354 - DNA, 29 bp, Artificial Sequence
  Description of Artificial Sequence: Synthetic oligonucleotide
tgattgctcacaggctgcaggcagttcag

SEQ ID NO: 112355 - DNA, 28 bp, Artificial Sequence
  Description of Artificial Sequence: Synthetic oligonucleotide
gattgctcacaggctgcaggcagttcag

SEQ ID NO: 112356 - DNA, 28 bp, Artificial Sequence
  Description of Artificial Sequence: Synthetic oligonucleotide
attgctcacaggctgcaggcagttcagc

SEQ ID NO: 112357 - DNA, 27 bp, Artificial Sequence
  Description of Artificial Sequence: Synthetic oligonucleotide
ttgctcacaggctgcaggcagttcagc

SEQ ID NO: 112358 - DNA, 26 bp, Artificial Sequence
  Description of Artificial Sequence: Synthetic oligonucleotide
tgctcacaggctgcaggcagttcagc

SEQ ID NO: 112359 - DNA, 25 bp, Artificial Sequence
  Description of Artificial Sequence: Synthetic oligonucleotide
gctcacaggctgcaggcagttcagc

SEQ ID NO: 112360 - DNA, 25 bp, Artificial Sequence
  Description of Artificial Sequence: Synthetic oligonucleotide
ctcacaggctgcaggcagttcagcg

SEQ ID NO: 112361 - DNA, 25 bp, Artificial Sequence
  Description of Artificial Sequence: Synthetic oligonucleotide
tcacaggctgcaggcagttcagcgc

SEQ ID NO: 112362 - DNA, 24 bp, Artificial Sequence
  Description of Artificial Sequence: Synthetic oligonucleotide
cacaggctgcaggcagttcagcgc

SEQ ID NO: 112363 - DNA, 24 bp, Artificial Sequence
  Description of Artificial Sequence: Synthetic oligonucleotide
acaggctgcaggcagttcagcgcg

SEQ ID NO: 112364 - DNA, 23 bp, Artificial Sequence
  Description of Artificial Sequence: Synthetic oligonucleotide
caggctgcaggcagttcagcgcg

SEQ ID NO: 112365 - DNA, 23 bp, Artificial Sequence
  Description of Artificial Sequence: Synthetic oligonucleotide
aggctgcaggcagttcagcgcgc

SEQ ID NO: 112366 - DNA, 22 bp, Artificial Sequence
  Description of Artificial Sequence: Synthetic oligonucleotide
ggctgcaggcagttcagcgcgc

SEQ ID NO: 112367 - DNA, 22 bp, Artificial Sequence
  Description of Artificial Sequence: Synthetic oligonucleotide
gctgcaggcagttcagcgcgcc

SEQ ID NO: 112368 - DNA, 23 bp, Artificial Sequence
  Description of Artificial Sequence: Synthetic oligonucleotide
ctgcaggcagttcagcgcgccca

SEQ ID NO: 112369 - DNA, 23 bp, Artificial Sequence
  Description of Artificial Sequence: Synthetic oligonucleotide
tgcaggcagttcagcgcgcccac

SEQ ID NO: 112370 - DNA, 22 bp, Artificial Sequence
  Description of Artificial Sequence: Synthetic oligonucleotide
gcaggcagttcagcgcgcccac

SEQ ID NO: 112371 - DNA, 23 bp, Artificial Sequence
  Description of Artificial Sequence: Synthetic oligonucleotide
caggcagttcagcgcgcccacca

SEQ ID NO: 112372 - DNA, 25 bp, Artificial Sequence
  Description of Artificial Sequence: Synthetic oligonucleotide
aggcagttcagcgcgcccaccagat

SEQ ID NO: 112373 - DNA, 24 bp, Artificial Sequence
  Description of Artificial Sequence: Synthetic oligonucleotide
ggcagttcagcgcgcccaccagat

SEQ ID NO: 112374 - DNA, 24 bp, Artificial Sequence
  Description of Artificial Sequence: Synthetic oligonucleotide
gcagttcagcgcgcccaccagatc

SEQ ID NO: 112375 - DNA, 26 bp, Artificial Sequence
  Description of Artificial Sequence: Synthetic oligonucleotide
gcaagctgcagaagcttgcccagctc

SEQ ID NO: 112376 - DNA, 27 bp, Artificial Sequence
  Description of Artificial Sequence: Synthetic oligonucleotide
caagctgcagaagcttgcccagctcca

SEQ ID NO: 112377 - DNA, 27 bp, Artificial Sequence
  Description of Artificial Sequence: Synthetic oligonucleotide
aagctgcagaagcttgcccagctccag

SEQ ID NO: 112378 - DNA, 26 bp, Artificial Sequence
  Description of Artificial Sequence: Synthetic oligonucleotide
agctgcagaagcttgcccagctccag

SEQ ID NO: 112379 - DNA, 25 bp, Artificial Sequence
  Description of Artificial Sequence: Synthetic oligonucleotide
gctgcagaagcttgcccagctccag

SEQ ID NO: 112380 - DNA, 26 bp, Artificial Sequence
  Description of Artificial Sequence: Synthetic oligonucleotide
ctgcagaagcttgcccagctccagga

SEQ ID NO: 112381 - DNA, 26 bp, Artificial Sequence
  Description of Artificial Sequence: Synthetic oligonucleotide
tgcagaagcttgcccagctccaggag

SEQ ID NO: 112382 - DNA, 25 bp, Artificial Sequence
  Description of Artificial Sequence: Synthetic oligonucleotide
gcagaagcttgcccagctccaggag

SEQ ID NO: 112383 - DNA, 25 bp, Artificial Sequence
  Description of Artificial Sequence: Synthetic oligonucleotide
cagaagcttgcccagctccaggagg

SEQ ID NO: 112384 - DNA, 26 bp, Artificial Sequence
  Description of Artificial Sequence: Synthetic oligonucleotide
agaagcttgcccagctccaggaggga

SEQ ID NO: 112385 - DNA, 25 bp, Artificial Sequence
  Description of Artificial Sequence: Synthetic oligonucleotide
gaagcttgcccagctccaggaggga

SEQ ID NO: 112386 - DNA, 26 bp, Artificial Sequence
  Description of Artificial Sequence: Synthetic oligonucleotide
aagcttgcccagctccaggagggaca

SEQ ID NO: 112387 - DNA, 25 bp, Artificial Sequence
  Description of Artificial Sequence: Synthetic oligonucleotide
agcttgcccagctccaggagggaca

SEQ ID NO: 112388 - DNA, 24 bp, Artificial Sequence
  Description of Artificial Sequence: Synthetic oligonucleotide
gcttgcccagctccaggagggaca

SEQ ID NO: 112389 - DNA, 24 bp, Artificial Sequence
  Description of Artificial Sequence: Synthetic oligonucleotide
cttgcccagctccaggagggacag

SEQ ID NO: 112390 - DNA, 25 bp, Artificial Sequence
  Description of Artificial Sequence: Synthetic oligonucleotide
ttgcccagctccaggagggacagga

SEQ ID NO: 112391 - DNA, 24 bp, Artificial Sequence
  Description of Artificial Sequence: Synthetic oligonucleotide
tgcccagctccaggagggacagga

SEQ ID NO: 112392 - DNA, 23 bp, Artificial Sequence
  Description of Artificial Sequence: Synthetic oligonucleotide
gcccagctccaggagggacagga

SEQ ID NO: 112393 - DNA, 23 bp, Artificial Sequence
  Description of Artificial Sequence: Synthetic oligonucleotide
cccagctccaggagggacaggac

SEQ ID NO: 112394 - DNA, 24 bp, Artificial Sequence
  Description of Artificial Sequence: Synthetic oligonucleotide
ccagctccaggagggacaggacct

SEQ ID NO: 112395 - DNA, 27 bp, Artificial Sequence
  Description of Artificial Sequence: Synthetic oligonucleotide
cagctccaggagggacaggacctctat

SEQ ID NO: 112396 - DNA, 28 bp, Artificial Sequence
  Description of Artificial Sequence: Synthetic oligonucleotide
agctccaggagggacaggacctctattc

SEQ ID NO: 112397 - DNA, 27 bp, Artificial Sequence
  Description of Artificial Sequence: Synthetic oligonucleotide
gctccaggagggacaggacctctattc

SEQ ID NO: 112398 - DNA, 27 bp, Artificial Sequence
  Description of Artificial Sequence: Synthetic oligonucleotide
ctccaggagggacaggacctctattcc

SEQ ID NO: 112399 - DNA, 27 bp, Artificial Sequence
  Description of Artificial Sequence: Synthetic oligonucleotide
tccaggagggacaggacctctattccc

SEQ ID NO: 112400 - DNA, 26 bp, Artificial Sequence
  Description of Artificial Sequence: Synthetic oligonucleotide
ccaggagggacaggacctctattccc

SEQ ID NO: 112401 - DNA, 26 bp, Artificial Sequence
  Description of Artificial Sequence: Synthetic oligonucleotide
caggagggacaggacctctattcccg

SEQ ID NO: 112402 - DNA, 26 bp, Artificial Sequence
  Description of Artificial Sequence: Synthetic oligonucleotide
aggagggacaggacctctattcccgc

SEQ ID NO: 112403 - DNA, 25 bp, Artificial Sequence
  Description of Artificial Sequence: Synthetic oligonucleotide
ggagggacaggacctctattcccgc

SEQ ID NO: 112404 - DNA, 26 bp, Artificial Sequence
  Description of Artificial Sequence: Synthetic oligonucleotide
gagggacaggacctctattcccgcct

SEQ ID NO: 112405 - DNA, 26 bp, Artificial Sequence
  Description of Artificial Sequence: Synthetic oligonucleotide
agggacaggacctctattcccgcctg

SEQ ID NO: 112406 - DNA, 25 bp, Artificial Sequence
  Description of Artificial Sequence: Synthetic oligonucleotide
gggacaggacctctattcccgcctg

SEQ ID NO: 112407 - DNA, 27 bp, Artificial Sequence
  Description of Artificial Sequence: Synthetic oligonucleotide
ggacaggacctctattcccgcctggtt

SEQ ID NO: 112408 - DNA, 27 bp, Artificial Sequence
  Description of Artificial Sequence: Synthetic oligonucleotide
gacaggacctctattcccgcctggttc

SEQ ID NO: 112409 - DNA, 28 bp, Artificial Sequence
  Description of Artificial Sequence: Synthetic oligonucleotide
acaggacctctattcccgcctggttcag

SEQ ID NO: 112410 - DNA, 27 bp, Artificial Sequence
  Description of Artificial Sequence: Synthetic oligonucleotide
caggacctctattcccgcctggttcag

SEQ ID NO: 112411 - DNA, 27 bp, Artificial Sequence
  Description of Artificial Sequence: Synthetic oligonucleotide
aggacctctattcccgcctggttcagc

SEQ ID NO: 112412 - DNA, 27 bp, Artificial Sequence
  Description of Artificial Sequence: Synthetic oligonucleotide
ggacctctattcccgcctggttcagca

SEQ ID NO: 112413 - DNA, 27 bp, Artificial Sequence
  Description of Artificial Sequence: Synthetic oligonucleotide
gacctctattcccgcctggttcagcag

SEQ ID NO: 112414 - DNA, 27 bp, Artificial Sequence
  Description of Artificial Sequence: Synthetic oligonucleotide
acctctattcccgcctggttcagcagc

SEQ ID NO: 112415 - DNA, 26 bp, Artificial Sequence
  Description of Artificial Sequence: Synthetic oligonucleotide
cctctattcccgcctggttcagcagc

SEQ ID NO: 112416 - DNA, 26 bp, Artificial Sequence
  Description of Artificial Sequence: Synthetic oligonucleotide
ctctattcccgcctggttcagcagcg

SEQ ID NO: 112417 - DNA, 26 bp, Artificial Sequence
  Description of Artificial Sequence: Synthetic oligonucleotide
tctattcccgcctggttcagcagcgg

SEQ ID NO: 112418 - DNA, 25 bp, Artificial Sequence
  Description of Artificial Sequence: Synthetic oligonucleotide
ctattcccgcctggttcagcagcgg

SEQ ID NO: 112419 - DNA, 26 bp, Artificial Sequence
  Description of Artificial Sequence: Synthetic oligonucleotide
tattcccgcctggttcagcagcggct

SEQ ID NO: 112420 - DNA, 25 bp, Artificial Sequence
  Description of Artificial Sequence: Synthetic oligonucleotide
attcccgcctggttcagcagcggct

SEQ ID NO: 112421 - DNA, 24 bp, Artificial Sequence
  Description of Artificial Sequence: Synthetic oligonucleotide
ttcccgcctggttcagcagcggct

SEQ ID NO: 112422 - DNA, 23 bp, Artificial Sequence
  Description of Artificial Sequence: Synthetic oligonucleotide
tcccgcctggttcagcagcggct

SEQ ID NO: 112423 - DNA, 22 bp, Artificial Sequence
  Description of Artificial Sequence: Synthetic oligonucleotide
cccgcctggttcagcagcggct

SEQ ID NO: 112424 - DNA, 24 bp, Artificial Sequence
  Description of Artificial Sequence: Synthetic oligonucleotide
ccgcctggttcagcagcggctgat

SEQ ID NO: 112425 - DNA, 24 bp, Artificial Sequence
  Description of Artificial Sequence: Synthetic oligonucleotide
cgcctggttcagcagcggctgatg

SEQ ID NO: 112426 - DNA, 25 bp, Artificial Sequence
  Description of Artificial Sequence: Synthetic oligonucleotide
gcctggttcagcagcggctgatgga

SEQ ID NO: 112427 - DNA, 26 bp, Artificial Sequence
  Description of Artificial Sequence: Synthetic oligonucleotide
cctggttcagcagcggctgatggact

SEQ ID NO: 112428 - DNA, 27 bp, Artificial Sequence
  Description of Artificial Sequence: Synthetic oligonucleotide
ctggttcagcagcggctgatggactga

SEQ ID NO: 112429 - DNA, 28 bp, Artificial Sequence
  Description of Artificial Sequence: Synthetic oligonucleotide
atgaagtccctgtctctgctcctcgctg

SEQ ID NO: 112430 - DNA, 27 bp, Artificial Sequence
  Description of Artificial Sequence: Synthetic oligonucleotide
tgaagtccctgtctctgctcctcgctg

SEQ ID NO: 112431 - DNA, 27 bp, Artificial Sequence
  Description of Artificial Sequence: Synthetic oligonucleotide
gaagtccctgtctctgctcctcgctgt

SEQ ID NO: 112432 - DNA, 27 bp, Artificial Sequence
  Description of Artificial Sequence: Synthetic oligonucleotide
aagtccctgtctctgctcctcgctgtg

SEQ ID NO: 112433 - DNA, 26 bp, Artificial Sequence
  Description of Artificial Sequence: Synthetic oligonucleotide
agtccctgtctctgctcctcgctgtg

SEQ ID NO: 112434 - DNA, 25 bp, Artificial Sequence
  Description of Artificial Sequence: Synthetic oligonucleotide
gtccctgtctctgctcctcgctgtg

SEQ ID NO: 112435 - DNA, 25 bp, Artificial Sequence
  Description of Artificial Sequence: Synthetic oligonucleotide
tccctgtctctgctcctcgctgtgg

SEQ ID NO: 112436 - DNA, 24 bp, Artificial Sequence
  Description of Artificial Sequence: Synthetic oligonucleotide
ccctgtctctgctcctcgctgtgg

SEQ ID NO: 112437 - DNA, 27 bp, Artificial Sequence
  Description of Artificial Sequence: Synthetic oligonucleotide
cctgtctctgctcctcgctgtggcttt

SEQ ID NO: 112438 - DNA, 27 bp, Artificial Sequence
  Description of Artificial Sequence: Synthetic oligonucleotide
ctgtctctgctcctcgctgtggctttg

SEQ ID NO: 112439 - DNA, 27 bp, Artificial Sequence
  Description of Artificial Sequence: Synthetic oligonucleotide
tgtctctgctcctcgctgtggctttgg

SEQ ID NO: 112440 - DNA, 26 bp, Artificial Sequence
  Description of Artificial Sequence: Synthetic oligonucleotide
gtctctgctcctcgctgtggctttgg

SEQ ID NO: 112441 - DNA, 26 bp, Artificial Sequence
  Description of Artificial Sequence: Synthetic oligonucleotide
tctctgctcctcgctgtggctttggg

SEQ ID NO: 112442 - DNA, 25 bp, Artificial Sequence
  Description of Artificial Sequence: Synthetic oligonucleotide
ctctgctcctcgctgtggctttggg

SEQ ID NO: 112443 - DNA, 25 bp, Artificial Sequence
  Description of Artificial Sequence: Synthetic oligonucleotide
tctgctcctcgctgtggctttgggc

SEQ ID NO: 112444 - DNA, 24 bp, Artificial Sequence
  Description of Artificial Sequence: Synthetic oligonucleotide
ctgctcctcgctgtggctttgggc

SEQ ID NO: 112445 - DNA, 25 bp, Artificial Sequence
  Description of Artificial Sequence: Synthetic oligonucleotide
tgctcctcgctgtggctttgggcct

SEQ ID NO: 112446 - DNA, 24 bp, Artificial Sequence
  Description of Artificial Sequence: Synthetic oligonucleotide
gctcctcgctgtggctttgggcct

SEQ ID NO: 112447 - DNA, 24 bp, Artificial Sequence
  Description of Artificial Sequence: Synthetic oligonucleotide
ctcctcgctgtggctttgggcctg

SEQ ID NO: 112448 - DNA, 24 bp, Artificial Sequence
  Description of Artificial Sequence: Synthetic oligonucleotide
tcctcgctgtggctttgggcctgg

SEQ ID NO: 112449 - DNA, 23 bp, Artificial Sequence
  Description of Artificial Sequence: Synthetic oligonucleotide
cctcgctgtggctttgggcctgg

SEQ ID NO: 112450 - DNA, 23 bp, Artificial Sequence
  Description of Artificial Sequence: Synthetic oligonucleotide
ctcgctgtggctttgggcctggc

SEQ ID NO: 112451 - DNA, 24 bp, Artificial Sequence
  Description of Artificial Sequence: Synthetic oligonucleotide
tcgctgtggctttgggcctggcga

SEQ ID NO: 112452 - DNA, 23 bp, Artificial Sequence
  Description of Artificial Sequence: Synthetic oligonucleotide
cgctgtggctttgggcctggcga

SEQ ID NO: 112453 - DNA, 23 bp, Artificial Sequence
  Description of Artificial Sequence: Synthetic oligonucleotide
gctgtggctttgggcctggcgac

SEQ ID NO: 112454 - DNA, 23 bp, Artificial Sequence
  Description of Artificial Sequence: Synthetic oligonucleotide
ctgtggctttgggcctggcgacc

SEQ ID NO: 112455 - DNA, 23 bp, Artificial Sequence
  Description of Artificial Sequence: Synthetic oligonucleotide
tgtggctttgggcctggcgaccg

SEQ ID NO: 112456 - DNA, 22 bp, Artificial Sequence
  Description of Artificial Sequence: Synthetic oligonucleotide
gtggctttgggcctggcgaccg

SEQ ID NO: 112457 - DNA, 22 bp, Artificial Sequence
  Description of Artificial Sequence: Synthetic oligonucleotide
tggctttgggcctggcgaccgc

SEQ ID NO: 112458 - DNA, 21 bp, Artificial Sequence
  Description of Artificial Sequence: Synthetic oligonucleotide
ggctttgggcctggcgaccgc

SEQ ID NO: 112459 - DNA, 21 bp, Artificial Sequence
  Description of Artificial Sequence: Synthetic oligonucleotide
gctttgggcctggcgaccgcc

SEQ ID NO: 112460 - DNA, 22 bp, Artificial Sequence
  Description of Artificial Sequence: Synthetic oligonucleotide
ctttgggcctggcgaccgccgt

SEQ ID NO: 112461 - DNA, 23 bp, Artificial Sequence
  Description of Artificial Sequence: Synthetic oligonucleotide
tttgggcctggcgaccgccgtct

SEQ ID NO: 112462 - DNA, 22 bp, Artificial Sequence
  Description of Artificial Sequence: Synthetic oligonucleotide
ttgggcctggcgaccgccgtct

SEQ ID NO: 112463 - DNA, 21 bp, Artificial Sequence
  Description of Artificial Sequence: Synthetic oligonucleotide
tgggcctggcgaccgccgtct

SEQ ID NO: 112464 - DNA, 20 bp, Artificial Sequence
  Description of Artificial Sequence: Synthetic oligonucleotide
gggcctggcgaccgccgtct

SEQ ID NO: 112465 - DNA, 21 bp, Artificial Sequence
  Description of Artificial Sequence: Synthetic oligonucleotide
ggcctggcgaccgccgtctca

SEQ ID NO: 112466 - DNA, 21 bp, Artificial Sequence
  Description of Artificial Sequence: Synthetic oligonucleotide
gcctggcgaccgccgtctcag

SEQ ID NO: 112467 - DNA, 22 bp, Artificial Sequence
  Description of Artificial Sequence: Synthetic oligonucleotide
cctggcgaccgccgtctcagca

SEQ ID NO: 112468 - DNA, 22 bp, Artificial Sequence
  Description of Artificial Sequence: Synthetic oligonucleotide
ctggcgaccgccgtctcagcag

SEQ ID NO: 112469 - DNA, 23 bp, Artificial Sequence
  Description of Artificial Sequence: Synthetic oligonucleotide
tggcgaccgccgtctcagcagga

SEQ ID NO: 112470 - DNA, 22 bp, Artificial Sequence
  Description of Artificial Sequence: Synthetic oligonucleotide
ggcgaccgccgtctcagcagga

SEQ ID NO: 112471 - DNA, 22 bp, Artificial Sequence
  Description of Artificial Sequence: Synthetic oligonucleotide
gcgaccgccgtctcagcaggac

SEQ ID NO: 112472 - DNA, 22 bp, Artificial Sequence
  Description of Artificial Sequence: Synthetic oligonucleotide
cgaccgccgtctcagcaggacc

SEQ ID NO: 112473 - DNA, 22 bp, Artificial Sequence
  Description of Artificial Sequence: Synthetic oligonucleotide
gaccgccgtctcagcaggaccc

SEQ ID NO: 112474 - DNA, 22 bp, Artificial Sequence
  Description of Artificial Sequence: Synthetic oligonucleotide
accgccgtctcagcaggacccg

SEQ ID NO: 112475 - DNA, 21 bp, Artificial Sequence
  Description of Artificial Sequence: Synthetic oligonucleotide
ccgccgtctcagcaggacccg

SEQ ID NO: 112476 - DNA, 21 bp, Artificial Sequence
  Description of Artificial Sequence: Synthetic oligonucleotide
cgccgtctcagcaggacccgc

SEQ ID NO: 112477 - DNA, 21 bp, Artificial Sequence
  Description of Artificial Sequence: Synthetic oligonucleotide
gccgtctcagcaggacccgcg

SEQ ID NO: 112478 - DNA, 22 bp, Artificial Sequence
  Description of Artificial Sequence: Synthetic oligonucleotide
ccgtctcagcaggacccgcggt

SEQ ID NO: 112479 - DNA, 24 bp, Artificial Sequence
  Description of Artificial Sequence: Synthetic oligonucleotide
cgtctcagcaggacccgcggtgat

SEQ ID NO: 112480 - DNA, 24 bp, Artificial Sequence
  Description of Artificial Sequence: Synthetic oligonucleotide
gtctcagcaggacccgcggtgatc

SEQ ID NO: 112481 - DNA, 25 bp, Artificial Sequence
  Description of Artificial Sequence: Synthetic oligonucleotide
tctcagcaggacccgcggtgatcga

SEQ ID NO: 112482 - DNA, 24 bp, Artificial Sequence
  Description of Artificial Sequence: Synthetic oligonucleotide
ctcagcaggacccgcggtgatcga

SEQ ID NO: 112483 - DNA, 25 bp, Artificial Sequence
  Description of Artificial Sequence: Synthetic oligonucleotide
tcagcaggacccgcggtgatcgagt

SEQ ID NO: 112484 - DNA, 24 bp, Artificial Sequence
  Description of Artificial Sequence: Synthetic oligonucleotide
cagcaggacccgcggtgatcgagt

SEQ ID NO: 112485 - DNA, 26 bp, Artificial Sequence
  Description of Artificial Sequence: Synthetic oligonucleotide
agcaggacccgcggtgatcgagtgtt

SEQ ID NO: 112486 - DNA, 25 bp, Artificial Sequence
  Description of Artificial Sequence: Synthetic oligonucleotide
gcaggacccgcggtgatcgagtgtt

SEQ ID NO: 112487 - DNA, 25 bp, Artificial Sequence
  Description of Artificial Sequence: Synthetic oligonucleotide
caggacccgcggtgatcgagtgttg

SEQ ID NO: 112488 - DNA, 27 bp, Artificial Sequence
  Description of Artificial Sequence: Synthetic oligonucleotide
aggacccgcggtgatcgagtgttggtt

SEQ ID NO: 112489 - DNA, 26 bp, Artificial Sequence
  Description of Artificial Sequence: Synthetic oligonucleotide
ggacccgcggtgatcgagtgttggtt

SEQ ID NO: 112490 - DNA, 26 bp, Artificial Sequence
  Description of Artificial Sequence: Synthetic oligonucleotide
gacccgcggtgatcgagtgttggttc

SEQ ID NO: 112491 - DNA, 27 bp, Artificial Sequence
  Description of Artificial Sequence: Synthetic oligonucleotide
acccgcggtgatcgagtgttggttcgt

SEQ ID NO: 112492 - DNA, 26 bp, Artificial Sequence
  Description of Artificial Sequence: Synthetic oligonucleotide
cccgcggtgatcgagtgttggttcgt

SEQ ID NO: 112493 - DNA, 26 bp, Artificial Sequence
  Description of Artificial Sequence: Synthetic oligonucleotide
ccgcggtgatcgagtgttggttcgtg

SEQ ID NO: 112494 - DNA, 27 bp, Artificial Sequence
  Description of Artificial Sequence: Synthetic oligonucleotide
cgcggtgatcgagtgttggttcgtgga

SEQ ID NO: 112495 - DNA, 27 bp, Artificial Sequence
  Description of Artificial Sequence: Synthetic oligonucleotide
gcggtgatcgagtgttggttcgtggag

SEQ ID NO: 112496 - DNA, 27 bp, Artificial Sequence
  Description of Artificial Sequence: Synthetic oligonucleotide
cggtgatcgagtgttggttcgtggagg

SEQ ID NO: 112497 - DNA, 29 bp, Artificial Sequence
  Description of Artificial Sequence: Synthetic oligonucleotide
ggtgatcgagtgttggttcgtggaggatg

SEQ ID NO: 112498 - DNA, 29 bp, Artificial Sequence
  Description of Artificial Sequence: Synthetic oligonucleotide
gtgatcgagtgttggttcgtggaggatgc

SEQ ID NO: 112499 - DNA, 29 bp, Artificial Sequence
  Description of Artificial Sequence: Synthetic oligonucleotide
tgatcgagtgttggttcgtggaggatgcg

SEQ ID NO: 112500 - DNA, 28 bp, Artificial Sequence
  Description of Artificial Sequence: Synthetic oligonucleotide
gatcgagtgttggttcgtggaggatgcg

SEQ ID NO: 112501 - DNA, 29 bp, Artificial Sequence
  Description of Artificial Sequence: Synthetic oligonucleotide
atcgagtgttggttcgtggaggatgcgag

SEQ ID NO: 112502 - DNA, 28 bp, Artificial Sequence
  Description of Artificial Sequence: Synthetic oligonucleotide
tcgagtgttggttcgtggaggatgcgag

SEQ ID NO: 112503 - DNA, 27 bp, Artificial Sequence
  Description of Artificial Sequence: Synthetic oligonucleotide
cgagtgttggttcgtggaggatgcgag

SEQ ID NO: 112504 - DNA, 27 bp, Artificial Sequence
  Description of Artificial Sequence: Synthetic oligonucleotide
gagtgttggttcgtggaggatgcgagc

SEQ ID NO: 112505 - DNA, 27 bp, Artificial Sequence
  Description of Artificial Sequence: Synthetic oligonucleotide
agtgttggttcgtggaggatgcgagcg

SEQ ID NO: 112506 - DNA, 26 bp, Artificial Sequence
  Description of Artificial Sequence: Synthetic oligonucleotide
gtgttggttcgtggaggatgcgagcg

SEQ ID NO: 112507 - DNA, 27 bp, Artificial Sequence
  Description of Artificial Sequence: Synthetic oligonucleotide
tgttggttcgtggaggatgcgagcgga

SEQ ID NO: 112508 - DNA, 27 bp, Artificial Sequence
  Description of Artificial Sequence: Synthetic oligonucleotide
gttggttcgtggaggatgcgagcggaa

SEQ ID NO: 112509 - DNA, 28 bp, Artificial Sequence
  Description of Artificial Sequence: Synthetic oligonucleotide
ttggttcgtggaggatgcgagcggaaag

SEQ ID NO: 112510 - DNA, 27 bp, Artificial Sequence
  Description of Artificial Sequence: Synthetic oligonucleotide
tggttcgtggaggatgcgagcggaaag

SEQ ID NO: 112511 - DNA, 26 bp, Artificial Sequence
  Description of Artificial Sequence: Synthetic oligonucleotide
ggttcgtggaggatgcgagcggaaag

SEQ ID NO: 112512 - DNA, 26 bp, Artificial Sequence
  Description of Artificial Sequence: Synthetic oligonucleotide
gttcgtggaggatgcgagcggaaagg

SEQ ID NO: 112513 - DNA, 26 bp, Artificial Sequence
  Description of Artificial Sequence: Synthetic oligonucleotide
ttcgtggaggatgcgagcggaaaggg

SEQ ID NO: 112514 - DNA, 25 bp, Artificial Sequence
  Description of Artificial Sequence: Synthetic oligonucleotide
tcgtggaggatgcgagcggaaaggg

SEQ ID NO: 112515 - DNA, 24 bp, Artificial Sequence
  Description of Artificial Sequence: Synthetic oligonucleotide
cgtggaggatgcgagcggaaaggg

SEQ ID NO: 112516 - DNA, 24 bp, Artificial Sequence
  Description of Artificial Sequence: Synthetic oligonucleotide
gtggaggatgcgagcggaaagggc

SEQ ID NO: 112517 - DNA, 25 bp, Artificial Sequence
  Description of Artificial Sequence: Synthetic oligonucleotide
tggaggatgcgagcggaaagggcct

SEQ ID NO: 112518 - DNA, 24 bp, Artificial Sequence
  Description of Artificial Sequence: Synthetic oligonucleotide
ggaggatgcgagcggaaagggcct

SEQ ID NO: 112519 - DNA, 24 bp, Artificial Sequence
  Description of Artificial Sequence: Synthetic oligonucleotide
gaggatgcgagcggaaagggcctg

SEQ ID NO: 112520 - DNA, 24 bp, Artificial Sequence
  Description of Artificial Sequence: Synthetic oligonucleotide
aggatgcgagcggaaagggcctgg

SEQ ID NO: 112521 - DNA, 23 bp, Artificial Sequence
  Description of Artificial Sequence: Synthetic oligonucleotide
ggatgcgagcggaaagggcctgg

SEQ ID NO: 112522 - DNA, 23 bp, Artificial Sequence
  Description of Artificial Sequence: Synthetic oligonucleotide
gatgcgagcggaaagggcctggc

SEQ ID NO: 112523 - DNA, 25 bp, Artificial Sequence
  Description of Artificial Sequence: Synthetic oligonucleotide
atgcgagcggaaagggcctggccaa

SEQ ID NO: 112524 - DNA, 24 bp, Artificial Sequence
  Description of Artificial Sequence: Synthetic oligonucleotide
tgcgagcggaaagggcctggccaa

SEQ ID NO: 112525 - DNA, 23 bp, Artificial Sequence
  Description of Artificial Sequence: Synthetic oligonucleotide
gcgagcggaaagggcctggccaa

SEQ ID NO: 112526 - DNA, 24 bp, Artificial Sequence
  Description of Artificial Sequence: Synthetic oligonucleotide
cgagcggaaagggcctggccaaga

SEQ ID NO: 112527 - DNA, 25 bp, Artificial Sequence
  Description of Artificial Sequence: Synthetic oligonucleotide
gagcggaaagggcctggccaagaga

SEQ ID NO: 112528 - DNA, 25 bp, Artificial Sequence
  Description of Artificial Sequence: Synthetic oligonucleotide
agcggaaagggcctggccaagagac

SEQ ID NO: 112529 - DNA, 24 bp, Artificial Sequence
  Description of Artificial Sequence: Synthetic oligonucleotide
gcggaaagggcctggccaagagac

SEQ ID NO: 112530 - DNA, 24 bp, Artificial Sequence
  Description of Artificial Sequence: Synthetic oligonucleotide
cggaaagggcctggccaagagacc

SEQ ID NO: 112531 - DNA, 24 bp, Artificial Sequence
  Description of Artificial Sequence: Synthetic oligonucleotide
ggaaagggcctggccaagagaccc

SEQ ID NO: 112532 - DNA, 24 bp, Artificial Sequence
  Description of Artificial Sequence: Synthetic oligonucleotide
gaaagggcctggccaagagacccg

SEQ ID NO: 112533 - DNA, 25 bp, Artificial Sequence
  Description of Artificial Sequence: Synthetic oligonucleotide
aaagggcctggccaagagacccggt

SEQ ID NO: 112534 - DNA, 24 bp, Artificial Sequence
  Description of Artificial Sequence: Synthetic oligonucleotide
aagggcctggccaagagacccggt

SEQ ID NO: 112535 - DNA, 23 bp, Artificial Sequence
  Description of Artificial Sequence: Synthetic oligonucleotide
agggcctggccaagagacccggt

SEQ ID NO: 112536 - DNA, 22 bp, Artificial Sequence
  Description of Artificial Sequence: Synthetic oligonucleotide
gggcctggccaagagacccggt

SEQ ID NO: 112537 - DNA, 22 bp, Artificial Sequence
  Description of Artificial Sequence: Synthetic oligonucleotide
ggcctggccaagagacccggtg

SEQ ID NO: 112538 - DNA, 23 bp, Artificial Sequence
  Description of Artificial Sequence: Synthetic oligonucleotide
gcctggccaagagacccggtgca

SEQ ID NO: 112539 - DNA, 24 bp, Artificial Sequence
  Description of Artificial Sequence: Synthetic oligonucleotide
cctggccaagagacccggtgcact

SEQ ID NO: 112540 - DNA, 24 bp, Artificial Sequence
  Description of Artificial Sequence: Synthetic oligonucleotide
ctggccaagagacccggtgcactg

SEQ ID NO: 112541 - DNA, 25 bp, Artificial Sequence
  Description of Artificial Sequence: Synthetic oligonucleotide
tggccaagagacccggtgcactgct

SEQ ID NO: 112542 - DNA, 24 bp, Artificial Sequence
  Description of Artificial Sequence: Synthetic oligonucleotide
ggccaagagacccggtgcactgct

SEQ ID NO: 112543 - DNA, 26 bp, Artificial Sequence
  Description of Artificial Sequence: Synthetic oligonucleotide
gccaagagacccggtgcactgctgtt

SEQ ID NO: 112544 - DNA, 26 bp, Artificial Sequence
  Description of Artificial Sequence: Synthetic oligonucleotide
ccaagagacccggtgcactgctgttg

SEQ ID NO: 112545 - DNA, 26 bp, Artificial Sequence
  Description of Artificial Sequence: Synthetic oligonucleotide
caagagacccggtgcactgctgttgc

SEQ ID NO: 112546 - DNA, 26 bp, Artificial Sequence
  Description of Artificial Sequence: Synthetic oligonucleotide
aagagacccggtgcactgctgttgcg

SEQ ID NO: 112547 - DNA, 25 bp, Artificial Sequence
  Description of Artificial Sequence: Synthetic oligonucleotide
agagacccggtgcactgctgttgcg

SEQ ID NO: 112548 - DNA, 24 bp, Artificial Sequence
  Description of Artificial Sequence: Synthetic oligonucleotide
gagacccggtgcactgctgttgcg

SEQ ID NO: 112549 - DNA, 24 bp, Artificial Sequence
  Description of Artificial Sequence: Synthetic oligonucleotide
agacccggtgcactgctgttgcgc

SEQ ID NO: 112550 - DNA, 23 bp, Artificial Sequence
  Description of Artificial Sequence: Synthetic oligonucleotide
gacccggtgcactgctgttgcgc

SEQ ID NO: 112551 - DNA, 24 bp, Artificial Sequence
  Description of Artificial Sequence: Synthetic oligonucleotide
acccggtgcactgctgttgcgcca

SEQ ID NO: 112552 - DNA, 23 bp, Artificial Sequence
  Description of Artificial Sequence: Synthetic oligonucleotide
cccggtgcactgctgttgcgcca

SEQ ID NO: 112553 - DNA, 23 bp, Artificial Sequence
  Description of Artificial Sequence: Synthetic oligonucleotide
ccggtgcactgctgttgcgccag

SEQ ID NO: 112554 - DNA, 23 bp, Artificial Sequence
  Description of Artificial Sequence: Synthetic oligonucleotide
cggtgcactgctgttgcgccagg

SEQ ID NO: 112555 - DNA, 24 bp, Artificial Sequence
  Description of Artificial Sequence: Synthetic oligonucleotide
ggtgcactgctgttgcgccaggga

SEQ ID NO: 112556 - DNA, 24 bp, Artificial Sequence
  Description of Artificial Sequence: Synthetic oligonucleotide
gtgcactgctgttgcgccagggac

SEQ ID NO: 112557 - DNA, 24 bp, Artificial Sequence
  Description of Artificial Sequence: Synthetic oligonucleotide
tgcactgctgttgcgccagggacc

SEQ ID NO: 112558 - DNA, 23 bp, Artificial Sequence
  Description of Artificial Sequence: Synthetic oligonucleotide
gcactgctgttgcgccagggacc

SEQ ID NO: 112559 - DNA, 23 bp, Artificial Sequence
  Description of Artificial Sequence: Synthetic oligonucleotide
cactgctgttgcgccagggaccg

SEQ ID NO: 112560 - DNA, 23 bp, Artificial Sequence
  Description of Artificial Sequence: Synthetic oligonucleotide
actgctgttgcgccagggaccgg

SEQ ID NO: 112561 - DNA, 22 bp, Artificial Sequence
  Description of Artificial Sequence: Synthetic oligonucleotide
ctgctgttgcgccagggaccgg

SEQ ID NO: 112562 - DNA, 22 bp, Artificial Sequence
  Description of Artificial Sequence: Synthetic oligonucleotide
tgctgttgcgccagggaccggg

SEQ ID NO: 112563 - DNA, 21 bp, Artificial Sequence
  Description of Artificial Sequence: Synthetic oligonucleotide
gctgttgcgccagggaccggg

SEQ ID NO: 112564 - DNA, 21 bp, Artificial Sequence
  Description of Artificial Sequence: Synthetic oligonucleotide
ctgttgcgccagggaccgggg

SEQ ID NO: 112565 - DNA, 23 bp, Artificial Sequence
  Description of Artificial Sequence: Synthetic oligonucleotide
tgttgcgccagggaccgggggaa

SEQ ID NO: 112566 - DNA, 22 bp, Artificial Sequence
  Description of Artificial Sequence: Synthetic oligonucleotide
gttgcgccagggaccgggggaa

SEQ ID NO: 112567 - DNA, 22 bp, Artificial Sequence
  Description of Artificial Sequence: Synthetic oligonucleotide
ttgcgccagggaccgggggaac

SEQ ID NO: 112568 - DNA, 21 bp, Artificial Sequence
  Description of Artificial Sequence: Synthetic oligonucleotide
tgcgccagggaccgggggaac

SEQ ID NO: 112569 - DNA, 20 bp, Artificial Sequence
  Description of Artificial Sequence: Synthetic oligonucleotide
gcgccagggaccgggggaac

SEQ ID NO: 112570 - DNA, 20 bp, Artificial Sequence
  Description of Artificial Sequence: Synthetic oligonucleotide
cgccagggaccgggggaacc

SEQ ID NO: 112571 - DNA, 20 bp, Artificial Sequence
  Description of Artificial Sequence: Synthetic oligonucleotide
gccagggaccgggggaaccg

SEQ ID NO: 112572 - DNA, 20 bp, Artificial Sequence
  Description of Artificial Sequence: Synthetic oligonucleotide
ccagggaccgggggaaccgc

SEQ ID NO: 112573 - DNA, 20 bp, Artificial Sequence
  Description of Artificial Sequence: Synthetic oligonucleotide
cagggaccgggggaaccgcc

SEQ ID NO: 112574 - DNA, 20 bp, Artificial Sequence
  Description of Artificial Sequence: Synthetic oligonucleotide
agggaccgggggaaccgccg

SEQ ID NO: 112575 - DNA, 20 bp, Artificial Sequence
  Description of Artificial Sequence: Synthetic oligonucleotide
gggaccgggggaaccgccgt

SEQ ID NO: 112576 - DNA, 20 bp, Artificial Sequence
  Description of Artificial Sequence: Synthetic oligonucleotide
ggaccgggggaaccgccgct

SEQ ID NO: 112577 - DNA, 20 bp, Artificial Sequence
  Description of Artificial Sequence: Synthetic oligonucleotide
gaccgggggaaccgccgcct

SEQ ID NO: 112578 - DNA, 20 bp, Artificial Sequence
  Description of Artificial Sequence: Synthetic oligonucleotide
accgggggaaccgccgccct

SEQ ID NO: 112579 - DNA, 20 bp, Artificial Sequence
  Description of Artificial Sequence: Synthetic oligonucleotide
ccgggggaaccgccgccctt

SEQ ID NO: 112580 - DNA, 20 bp, Artificial Sequence
  Description of Artificial Sequence: Synthetic oligonucleotide
cgggggaaccgccgcccctt

SEQ ID NO: 112581 - DNA, 20 bp, Artificial Sequence
  Description of Artificial Sequence: Synthetic oligonucleotide
gggggaaccgccgccccgtt

SEQ ID NO: 112582 - DNA, 20 bp, Artificial Sequence
  Description of Artificial Sequence: Synthetic oligonucleotide
ggggaaccgccgccccggtt

SEQ ID NO: 112583 - DNA, 20 bp, Artificial Sequence
  Description of Artificial Sequence: Synthetic oligonucleotide
gggaaccgccgccccggctt

SEQ ID NO: 112584 - DNA, 20 bp, Artificial Sequence
  Description of Artificial Sequence: Synthetic oligonucleotide
ggaaccgccgccccggcctt

SEQ ID NO: 112585 - DNA, 20 bp, Artificial Sequence
  Description of Artificial Sequence: Synthetic oligonucleotide
gaaccgccgccccggccgtt

SEQ ID NO: 112586 - DNA, 20 bp, Artificial Sequence
  Description of Artificial Sequence: Synthetic oligonucleotide
aaccgccgccccggccggat

SEQ ID NO: 112587 - DNA, 20 bp, Artificial Sequence
  Description of Artificial Sequence: Synthetic oligonucleotide
accgccgccccggccggatt

SEQ ID NO: 112588 - DNA, 20 bp, Artificial Sequence
  Description of Artificial Sequence: Synthetic oligonucleotide
ccgccgccccggccggattt

SEQ ID NO: 112589 - DNA, 20 bp, Artificial Sequence
  Description of Artificial Sequence: Synthetic oligonucleotide
cgccgccccggccggacttt

SEQ ID NO: 112590 - DNA, 20 bp, Artificial Sequence
  Description of Artificial Sequence: Synthetic oligonucleotide
gccgccccggccggaccttt

SEQ ID NO: 112591 - DNA, 20 bp, Artificial Sequence
  Description of Artificial Sequence: Synthetic oligonucleotide
ccgccccggccggacctctt

SEQ ID NO: 112592 - DNA, 20 bp, Artificial Sequence
  Description of Artificial Sequence: Synthetic oligonucleotide
cgccccggccggacctcgat

SEQ ID NO: 112593 - DNA, 20 bp, Artificial Sequence
  Description of Artificial Sequence: Synthetic oligonucleotide
gccccggccggacctcgact

SEQ ID NO: 112594 - DNA, 20 bp, Artificial Sequence
  Description of Artificial Sequence: Synthetic oligonucleotide
ccccggccggacctcgacct

SEQ ID NO: 112595 - DNA, 20 bp, Artificial Sequence
  Description of Artificial Sequence: Synthetic oligonucleotide
cccggccggacctcgaccct

SEQ ID NO: 112596 - DNA, 21 bp, Artificial Sequence
  Description of Artificial Sequence: Synthetic oligonucleotide
ccggccggacctcgaccctga

SEQ ID NO: 112597 - DNA, 21 bp, Artificial Sequence
  Description of Artificial Sequence: Synthetic oligonucleotide
cggccggacctcgaccctgag

SEQ ID NO: 112598 - DNA, 22 bp, Artificial Sequence
  Description of Artificial Sequence: Synthetic oligonucleotide
ggccggacctcgaccctgagct

SEQ ID NO: 112599 - DNA, 25 bp, Artificial Sequence
  Description of Artificial Sequence: Synthetic oligonucleotide
gccggacctcgaccctgagctctat

SEQ ID NO: 112600 - DNA, 26 bp, Artificial Sequence
  Description of Artificial Sequence: Synthetic oligonucleotide
ccggacctcgaccctgagctctatct

SEQ ID NO: 112601 - DNA, 27 bp, Artificial Sequence
  Description of Artificial Sequence: Synthetic oligonucleotide
cggacctcgaccctgagctctatctca

SEQ ID NO: 112602 - DNA, 27 bp, Artificial Sequence
  Description of Artificial Sequence: Synthetic oligonucleotide
ggacctcgaccctgagctctatctcag

SEQ ID NO: 112603 - DNA, 28 bp, Artificial Sequence
  Description of Artificial Sequence: Synthetic oligonucleotide
gacctcgaccctgagctctatctcagtg

SEQ ID NO: 112604 - DNA, 30 bp, Artificial Sequence
  Description of Artificial Sequence: Synthetic oligonucleotide
acctcgaccctgagctctatctcagtgtac

SEQ ID NO: 112605 - DNA, 29 bp, Artificial Sequence
  Description of Artificial Sequence: Synthetic oligonucleotide
cctcgaccctgagctctatctcagtgtac

SEQ ID NO: 112606 - DNA, 30 bp, Artificial Sequence
  Description of Artificial Sequence: Synthetic oligonucleotide
ctcgaccctgagctctatctcagtgtacac

SEQ ID NO: 112607 - DNA, 30 bp, Artificial Sequence
  Description of Artificial Sequence: Synthetic oligonucleotide
tcgaccctgagctctatctcagtgtacacg

SEQ ID NO: 112608 - DNA, 29 bp, Artificial Sequence
  Description of Artificial Sequence: Synthetic oligonucleotide
cgaccctgagctctatctcagtgtacacg

SEQ ID NO: 112609 - DNA, 30 bp, Artificial Sequence
  Description of Artificial Sequence: Synthetic oligonucleotide
gaccctgagctctatctcagtgtacacgac

SEQ ID NO: 112610 - DNA, 30 bp, Artificial Sequence
  Description of Artificial Sequence: Synthetic oligonucleotide
accctgagctctatctcagtgtacacgacc

SEQ ID NO: 112611 - DNA, 29 bp, Artificial Sequence
  Description of Artificial Sequence: Synthetic oligonucleotide
ccctgagctctatctcagtgtacacgacc

SEQ ID NO: 112612 - DNA, 29 bp, Artificial Sequence
  Description of Artificial Sequence: Synthetic oligonucleotide
cctgagctctatctcagtgtacacgaccc

SEQ ID NO: 112613 - DNA, 29 bp, Artificial Sequence
  Description of Artificial Sequence: Synthetic oligonucleotide
ctgagctctatctcagtgtacacgacccc

SEQ ID NO: 112614 - DNA, 29 bp, Artificial Sequence
  Description of Artificial Sequence: Synthetic oligonucleotide
tgagctctatctcagtgtacacgaccccg

SEQ ID NO: 112615 - DNA, 28 bp, Artificial Sequence
  Description of Artificial Sequence: Synthetic oligonucleotide
gagctctatctcagtgtacacgaccccg

SEQ ID NO: 112616 - DNA, 28 bp, Artificial Sequence
  Description of Artificial Sequence: Synthetic oligonucleotide
agctctatctcagtgtacacgaccccgc

SEQ ID NO: 112617 - DNA, 27 bp, Artificial Sequence
  Description of Artificial Sequence: Synthetic oligonucleotide
gctctatctcagtgtacacgaccccgc

SEQ ID NO: 112618 - DNA, 27 bp, Artificial Sequence
  Description of Artificial Sequence: Synthetic oligonucleotide
ctctatctcagtgtacacgaccccgcg

SEQ ID NO: 112619 - DNA, 27 bp, Artificial Sequence
  Description of Artificial Sequence: Synthetic oligonucleotide
tctatctcagtgtacacgaccccgcgg

SEQ ID NO: 112620 - DNA, 26 bp, Artificial Sequence
  Description of Artificial Sequence: Synthetic oligonucleotide
ctatctcagtgtacacgaccccgcgg

SEQ ID NO: 112621 - DNA, 26 bp, Artificial Sequence
  Description of Artificial Sequence: Synthetic oligonucleotide
tatctcagtgtacacgaccccgcggg

SEQ ID NO: 112622 - DNA, 25 bp, Artificial Sequence
  Description of Artificial Sequence: Synthetic oligonucleotide
atctcagtgtacacgaccccgcggg

SEQ ID NO: 112623 - DNA, 24 bp, Artificial Sequence
  Description of Artificial Sequence: Synthetic oligonucleotide
tctcagtgtacacgaccccgcggg

SEQ ID NO: 112624 - DNA, 23 bp, Artificial Sequence
  Description of Artificial Sequence: Synthetic oligonucleotide
ctcagtgtacacgaccccgcggg

SEQ ID NO: 112625 - DNA, 23 bp, Artificial Sequence
  Description of Artificial Sequence: Synthetic oligonucleotide
tcagtgtacacgaccccgcgggc

SEQ ID NO: 112626 - DNA, 22 bp, Artificial Sequence
  Description of Artificial Sequence: Synthetic oligonucleotide
cagtgtacacgaccccgcgggc

SEQ ID NO: 112627 - DNA, 22 bp, Artificial Sequence
  Description of Artificial Sequence: Synthetic oligonucleotide
agtgtacacgaccccgcgggcg

SEQ ID NO: 112628 - DNA, 21 bp, Artificial Sequence
  Description of Artificial Sequence: Synthetic oligonucleotide
gtgtacacgaccccgcgggcg

SEQ ID NO: 112629 - DNA, 21 bp, Artificial Sequence
  Description of Artificial Sequence: Synthetic oligonucleotide
tgtacacgaccccgcgggcgc

SEQ ID NO: 112630 - DNA, 20 bp, Artificial Sequence
  Description of Artificial Sequence: Synthetic oligonucleotide
gtacacgaccccgcgggcgc

SEQ ID NO: 112631 - DNA, 20 bp, Artificial Sequence
  Description of Artificial Sequence: Synthetic oligonucleotide
tacacgaccccgcgggcgcc

SEQ ID NO: 112632 - DNA, 20 bp, Artificial Sequence
  Description of Artificial Sequence: Synthetic oligonucleotide
acacgaccccgcgggcgcct

SEQ ID NO: 112633 - DNA, 20 bp, Artificial Sequence
  Description of Artificial Sequence: Synthetic oligonucleotide
cacgaccccgcgggcgcctt

SEQ ID NO: 112634 - DNA, 20 bp, Artificial Sequence
  Description of Artificial Sequence: Synthetic oligonucleotide
acgaccccgcgggcgccctt

SEQ ID NO: 112635 - DNA, 20 bp, Artificial Sequence
  Description of Artificial Sequence: Synthetic oligonucleotide
cgaccccgcgggcgcccttt

SEQ ID NO: 112636 - DNA, 20 bp, Artificial Sequence
  Description of Artificial Sequence: Synthetic oligonucleotide
gaccccgcgggcgccctctt

SEQ ID NO: 112637 - DNA, 20 bp, Artificial Sequence
  Description of Artificial Sequence: Synthetic oligonucleotide
accccgcgggcgccctccat

SEQ ID NO: 112638 - DNA, 20 bp, Artificial Sequence
  Description of Artificial Sequence: Synthetic oligonucleotide
ccccgcgggcgccctccatt

SEQ ID NO: 112639 - DNA, 20 bp, Artificial Sequence
  Description of Artificial Sequence: Synthetic oligonucleotide
cccgcgggcgccctccagtt

SEQ ID NO: 112640 - DNA, 20 bp, Artificial Sequence
  Description of Artificial Sequence: Synthetic oligonucleotide
ccgcgggcgccctccaggtt

SEQ ID NO: 112641 - DNA, 20 bp, Artificial Sequence
  Description of Artificial Sequence: Synthetic oligonucleotide
cgcgggcgccctccaggctt

SEQ ID NO: 112642 - DNA, 20 bp, Artificial Sequence
  Description of Artificial Sequence: Synthetic oligonucleotide
gcgggcgccctccaggctgt

SEQ ID NO: 112643 - DNA, 20 bp, Artificial Sequence
  Description of Artificial Sequence: Synthetic oligonucleotide
cgggcgccctccaggctgct

SEQ ID NO: 112644 - DNA, 21 bp, Artificial Sequence
  Description of Artificial Sequence: Synthetic oligonucleotide
gggcgccctccaggctgcctt

SEQ ID NO: 112645 - DNA, 22 bp, Artificial Sequence
  Description of Artificial Sequence: Synthetic oligonucleotide
ggcgccctccaggctgccttca

SEQ ID NO: 112646 - DNA, 22 bp, Artificial Sequence
  Description of Artificial Sequence: Synthetic oligonucleotide
gcgccctccaggctgccttcag

SEQ ID NO: 112647 - DNA, 22 bp, Artificial Sequence
  Description of Artificial Sequence: Synthetic oligonucleotide
cgccctccaggctgccttcagg

SEQ ID NO: 112648 - DNA, 22 bp, Artificial Sequence
  Description of Artificial Sequence: Synthetic oligonucleotide
gccctccaggctgccttcaggc

SEQ ID NO: 112649 - DNA, 22 bp, Artificial Sequence
  Description of Artificial Sequence: Synthetic oligonucleotide
ccctccaggctgccttcaggcg

SEQ ID NO: 112650 - DNA, 25 bp, Artificial Sequence
  Description of Artificial Sequence: Synthetic oligonucleotide
cctccaggctgccttcaggcggtat

SEQ ID NO: 112651 - DNA, 25 bp, Artificial Sequence
  Description of Artificial Sequence: Synthetic oligonucleotide
ctccaggctgccttcaggcggtatc

SEQ ID NO: 112652 - DNA, 25 bp, Artificial Sequence
  Description of Artificial Sequence: Synthetic oligonucleotide
tccaggctgccttcaggcggtatcc

SEQ ID NO: 112653 - DNA, 24 bp, Artificial Sequence
  Description of Artificial Sequence: Synthetic oligonucleotide
ccaggctgccttcaggcggtatcc

SEQ ID NO: 112654 - DNA, 24 bp, Artificial Sequence
  Description of Artificial Sequence: Synthetic oligonucleotide
caggctgccttcaggcggtatccc

SEQ ID NO: 112655 - DNA, 24 bp, Artificial Sequence
  Description of Artificial Sequence: Synthetic oligonucleotide
aggctgccttcaggcggtatcccc

SEQ ID NO: 112656 - DNA, 23 bp, Artificial Sequence
  Description of Artificial Sequence: Synthetic oligonucleotide
ggctgccttcaggcggtatcccc

SEQ ID NO: 112657 - DNA, 23 bp, Artificial Sequence
  Description of Artificial Sequence: Synthetic oligonucleotide
gctgccttcaggcggtatccccg

SEQ ID NO: 112658 - DNA, 23 bp, Artificial Sequence
  Description of Artificial Sequence: Synthetic oligonucleotide
ctgccttcaggcggtatccccgg

SEQ ID NO: 112659 - DNA, 23 bp, Artificial Sequence
  Description of Artificial Sequence: Synthetic oligonucleotide
tgccttcaggcggtatccccggg

SEQ ID NO: 112660 - DNA, 22 bp, Artificial Sequence
  Description of Artificial Sequence: Synthetic oligonucleotide
gccttcaggcggtatccccggg

SEQ ID NO: 112661 - DNA, 22 bp, Artificial Sequence
  Description of Artificial Sequence: Synthetic oligonucleotide
ccttcaggcggtatccccgggg

SEQ ID NO: 112662 - DNA, 22 bp, Artificial Sequence
  Description of Artificial Sequence: Synthetic oligonucleotide
cttcaggcggtatccccggggc

SEQ ID NO: 112663 - DNA, 22 bp, Artificial Sequence
  Description of Artificial Sequence: Synthetic oligonucleotide
ttcaggcggtatccccggggcg

SEQ ID NO: 112664 - DNA, 21 bp, Artificial Sequence
  Description of Artificial Sequence: Synthetic oligonucleotide
tcaggcggtatccccggggcg

SEQ ID NO: 112665 - DNA, 20 bp, Artificial Sequence
  Description of Artificial Sequence: Synthetic oligonucleotide
caggcggtatccccggggcg

SEQ ID NO: 112666 - DNA, 20 bp, Artificial Sequence
  Description of Artificial Sequence: Synthetic oligonucleotide
aggcggtatccccggggcgc

SEQ ID NO: 112667 - DNA, 20 bp, Artificial Sequence
  Description of Artificial Sequence: Synthetic oligonucleotide
ggcggtatccccggggcgct

SEQ ID NO: 112668 - DNA, 20 bp, Artificial Sequence
  Description of Artificial Sequence: Synthetic oligonucleotide
gcggtatccccggggcgcct

SEQ ID NO: 112669 - DNA, 20 bp, Artificial Sequence
  Description of Artificial Sequence: Synthetic oligonucleotide
cggtatccccggggcgccct

SEQ ID NO: 112670 - DNA, 20 bp, Artificial Sequence
  Description of Artificial Sequence: Synthetic oligonucleotide
ggtatccccggggcgcccct

SEQ ID NO: 112671 - DNA, 20 bp, Artificial Sequence
  Description of Artificial Sequence: Synthetic oligonucleotide
gtatccccggggcgccccct

SEQ ID NO: 112672 - DNA, 20 bp, Artificial Sequence
  Description of Artificial Sequence: Synthetic oligonucleotide
tatccccggggcgcccccgt

SEQ ID NO: 112673 - DNA, 20 bp, Artificial Sequence
  Description of Artificial Sequence: Synthetic oligonucleotide
atccccggggcgcccccgtt

SEQ ID NO: 112674 - DNA, 20 bp, Artificial Sequence
  Description of Artificial Sequence: Synthetic oligonucleotide
tccccggggcgcccccgttt

SEQ ID NO: 112675 - DNA, 20 bp, Artificial Sequence
  Description of Artificial Sequence: Synthetic oligonucleotide
ccccggggcgcccccgtttt

SEQ ID NO: 112676 - DNA, 20 bp, Artificial Sequence
  Description of Artificial Sequence: Synthetic oligonucleotide
cccggggcgcccccgcattt

SEQ ID NO: 112677 - DNA, 20 bp, Artificial Sequence
  Description of Artificial Sequence: Synthetic oligonucleotide
ccggggcgcccccgcacttt

SEQ ID NO: 112678 - DNA, 20 bp, Artificial Sequence
  Description of Artificial Sequence: Synthetic oligonucleotide
cggggcgcccccgcaccatt

SEQ ID NO: 112679 - DNA, 20 bp, Artificial Sequence
  Description of Artificial Sequence: Synthetic oligonucleotide
ggggcgcccccgcaccacat

SEQ ID NO: 112680 - DNA, 20 bp, Artificial Sequence
  Description of Artificial Sequence: Synthetic oligonucleotide
gggcgcccccgcaccacact

SEQ ID NO: 112681 - DNA, 20 bp, Artificial Sequence
  Description of Artificial Sequence: Synthetic oligonucleotide
ggcgcccccgcaccacactg

SEQ ID NO: 112682 - DNA, 20 bp, Artificial Sequence
  Description of Artificial Sequence: Synthetic oligonucleotide
gcgcccccgcaccacactgc

SEQ ID NO: 112683 - DNA, 21 bp, Artificial Sequence
  Description of Artificial Sequence: Synthetic oligonucleotide
cgcccccgcaccacactgcga

SEQ ID NO: 112684 - DNA, 23 bp, Artificial Sequence
  Description of Artificial Sequence: Synthetic oligonucleotide
gcccccgcaccacactgcgagat

SEQ ID NO: 112685 - DNA, 24 bp, Artificial Sequence
  Description of Artificial Sequence: Synthetic oligonucleotide
cccccgcaccacactgcgagatga

SEQ ID NO: 112686 - DNA, 24 bp, Artificial Sequence
  Description of Artificial Sequence: Synthetic oligonucleotide
ccccgcaccacactgcgagatgag

SEQ ID NO: 112687 - DNA, 24 bp, Artificial Sequence
  Description of Artificial Sequence: Synthetic oligonucleotide
cccgcaccacactgcgagatgagc

SEQ ID NO: 112688 - DNA, 24 bp, Artificial Sequence
  Description of Artificial Sequence: Synthetic oligonucleotide
ccgcaccacactgcgagatgagcc

SEQ ID NO: 112689 - DNA, 24 bp, Artificial Sequence
  Description of Artificial Sequence: Synthetic oligonucleotide
cgcaccacactgcgagatgagccg

SEQ ID NO: 112690 - DNA, 26 bp, Artificial Sequence
  Description of Artificial Sequence: Synthetic oligonucleotide
gcaccacactgcgagatgagccgctt

SEQ ID NO: 112691 - DNA, 26 bp, Artificial Sequence
  Description of Artificial Sequence: Synthetic oligonucleotide
caccacactgcgagatgagccgcttc

SEQ ID NO: 112692 - DNA, 27 bp, Artificial Sequence
  Description of Artificial Sequence: Synthetic oligonucleotide
accacactgcgagatgagccgcttcgt

SEQ ID NO: 112693 - DNA, 26 bp, Artificial Sequence
  Description of Artificial Sequence: Synthetic oligonucleotide
ccacactgcgagatgagccgcttcgt

SEQ ID NO: 112694 - DNA, 26 bp, Artificial Sequence
  Description of Artificial Sequence: Synthetic oligonucleotide
cacactgcgagatgagccgcttcgtg

SEQ ID NO: 112695 - DNA, 26 bp, Artificial Sequence
  Description of Artificial Sequence: Synthetic oligonucleotide
acactgcgagatgagccgcttcgtgc

SEQ ID NO: 112696 - DNA, 25 bp, Artificial Sequence
  Description of Artificial Sequence: Synthetic oligonucleotide
cactgcgagatgagccgcttcgtgc

SEQ ID NO: 112697 - DNA, 26 bp, Artificial Sequence
  Description of Artificial Sequence: Synthetic oligonucleotide
actgcgagatgagccgcttcgtgcct

SEQ ID NO: 112698 - DNA, 25 bp, Artificial Sequence
  Description of Artificial Sequence: Synthetic oligonucleotide
ctgcgagatgagccgcttcgtgcct

SEQ ID NO: 112699 - DNA, 26 bp, Artificial Sequence
  Description of Artificial Sequence: Synthetic oligonucleotide
tgcgagatgagccgcttcgtgcctct

SEQ ID NO: 112700 - DNA, 25 bp, Artificial Sequence
  Description of Artificial Sequence: Synthetic oligonucleotide
gcgagatgagccgcttcgtgcctct

SEQ ID NO: 112701 - DNA, 25 bp, Artificial Sequence
  Description of Artificial Sequence: Synthetic oligonucleotide
cgagatgagccgcttcgtgcctctc

SEQ ID NO: 112702 - DNA, 25 bp, Artificial Sequence
  Description of Artificial Sequence: Synthetic oligonucleotide
gagatgagccgcttcgtgcctctcc

SEQ ID NO: 112703 - DNA, 25 bp, Artificial Sequence
  Description of Artificial Sequence: Synthetic oligonucleotide
agatgagccgcttcgtgcctctccc

SEQ ID NO: 112704 - DNA, 24 bp, Artificial Sequence
  Description of Artificial Sequence: Synthetic oligonucleotide
gatgagccgcttcgtgcctctccc

SEQ ID NO: 112705 - DNA, 24 bp, Artificial Sequence
  Description of Artificial Sequence: Synthetic oligonucleotide
atgagccgcttcgtgcctctcccc

SEQ ID NO: 112706 - DNA, 23 bp, Artificial Sequence
  Description of Artificial Sequence: Synthetic oligonucleotide
tgagccgcttcgtgcctctcccc

SEQ ID NO: 112707 - DNA, 22 bp, Artificial Sequence
  Description of Artificial Sequence: Synthetic oligonucleotide
gagccgcttcgtgcctctcccc

SEQ ID NO: 112708 - DNA, 22 bp, Artificial Sequence
  Description of Artificial Sequence: Synthetic oligonucleotide
agccgcttcgtgcctctccccg

SEQ ID NO: 112709 - DNA, 21 bp, Artificial Sequence
  Description of Artificial Sequence: Synthetic oligonucleotide
gccgcttcgtgcctctccccg

SEQ ID NO: 112710 - DNA, 21 bp, Artificial Sequence
  Description of Artificial Sequence: Synthetic oligonucleotide
ccgcttcgtgcctctccccgc

SEQ ID NO: 112711 - DNA, 22 bp, Artificial Sequence
  Description of Artificial Sequence: Synthetic oligonucleotide
cgcttcgtgcctctccccgcct

SEQ ID NO: 112712 - DNA, 23 bp, Artificial Sequence
  Description of Artificial Sequence: Synthetic oligonucleotide
gcttcgtgcctctccccgcctct

SEQ ID NO: 112713 - DNA, 23 bp, Artificial Sequence
  Description of Artificial Sequence: Synthetic oligonucleotide
cttcgtgcctctccccgcctctg

SEQ ID NO: 112714 - DNA, 23 bp, Artificial Sequence
  Description of Artificial Sequence: Synthetic oligonucleotide
ttcgtgcctctccccgcctctgc

SEQ ID NO: 112715 - DNA, 22 bp, Artificial Sequence
  Description of Artificial Sequence: Synthetic oligonucleotide
tcgtgcctctccccgcctctgc

SEQ ID NO: 112716 - DNA, 21 bp, Artificial Sequence
  Description of Artificial Sequence: Synthetic oligonucleotide
cgtgcctctccccgcctctgc

SEQ ID NO: 112717 - DNA, 25 bp, Artificial Sequence
  Description of Artificial Sequence: Synthetic oligonucleotide
gtgcctctccccgcctctgcgaaat

SEQ ID NO: 112718 - DNA, 25 bp, Artificial Sequence
  Description of Artificial Sequence: Synthetic oligonucleotide
tgcctctccccgcctctgcgaaatg

SEQ ID NO: 112719 - DNA, 24 bp, Artificial Sequence
  Description of Artificial Sequence: Synthetic oligonucleotide
gcctctccccgcctctgcgaaatg

SEQ ID NO: 112720 - DNA, 24 bp, Artificial Sequence
  Description of Artificial Sequence: Synthetic oligonucleotide
cctctccccgcctctgcgaaatgg

SEQ ID NO: 112721 - DNA, 24 bp, Artificial Sequence
  Description of Artificial Sequence: Synthetic oligonucleotide
ctctccccgcctctgcgaaatggg

SEQ ID NO: 112722 - DNA, 24 bp, Artificial Sequence
  Description of Artificial Sequence: Synthetic oligonucleotide
tctccccgcctctgcgaaatgggc

SEQ ID NO: 112723 - DNA, 23 bp, Artificial Sequence
  Description of Artificial Sequence: Synthetic oligonucleotide
ctccccgcctctgcgaaatgggc

SEQ ID NO: 112724 - DNA, 24 bp, Artificial Sequence
  Description of Artificial Sequence: Synthetic oligonucleotide
tccccgcctctgcgaaatgggcca

SEQ ID NO: 112725 - DNA, 23 bp, Artificial Sequence
  Description of Artificial Sequence: Synthetic oligonucleotide
ccccgcctctgcgaaatgggcca

SEQ ID NO: 112726 - DNA, 23 bp, Artificial Sequence
  Description of Artificial Sequence: Synthetic oligonucleotide
cccgcctctgcgaaatgggccag

SEQ ID NO: 112727 - DNA, 23 bp, Artificial Sequence
  Description of Artificial Sequence: Synthetic oligonucleotide
ccgcctctgcgaaatgggccagc

SEQ ID NO: 112728 - DNA, 23 bp, Artificial Sequence
  Description of Artificial Sequence: Synthetic oligonucleotide
cgcctctgcgaaatgggccagcg

SEQ ID NO: 112729 - DNA, 23 bp, Artificial Sequence
  Description of Artificial Sequence: Synthetic oligonucleotide
gcctctgcgaaatgggccagcgg

SEQ ID NO: 112730 - DNA, 23 bp, Artificial Sequence
  Description of Artificial Sequence: Synthetic oligonucleotide
cctctgcgaaatgggccagcggc

SEQ ID NO: 112731 - DNA, 24 bp, Artificial Sequence
  Description of Artificial Sequence: Synthetic oligonucleotide
ctctgcgaaatgggccagcggcct

SEQ ID NO: 112732 - DNA, 25 bp, Artificial Sequence
  Description of Artificial Sequence: Synthetic oligonucleotide
tctgcgaaatgggccagcggcctga

SEQ ID NO: 112733 - DNA, 24 bp, Artificial Sequence
  Description of Artificial Sequence: Synthetic oligonucleotide
ctgcgaaatgggccagcggcctga

SEQ ID NO: 112734 - DNA, 24 bp, Artificial Sequence
  Description of Artificial Sequence: Synthetic oligonucleotide
tgcgaaatgggccagcggcctgac

SEQ ID NO: 112735 - DNA, 23 bp, Artificial Sequence
  Description of Artificial Sequence: Synthetic oligonucleotide
gcgaaatgggccagcggcctgac

SEQ ID NO: 112736 - DNA, 23 bp, Artificial Sequence
  Description of Artificial Sequence: Synthetic oligonucleotide
cgaaatgggccagcggcctgacc

SEQ ID NO: 112737 - DNA, 23 bp, Artificial Sequence
  Description of Artificial Sequence: Synthetic oligonucleotide
gaaatgggccagcggcctgaccc

SEQ ID NO: 112738 - DNA, 23 bp, Artificial Sequence
  Description of Artificial Sequence: Synthetic oligonucleotide
aaatgggccagcggcctgacccc

SEQ ID NO: 112739 - DNA, 22 bp, Artificial Sequence
  Description of Artificial Sequence: Synthetic oligonucleotide
aatgggccagcggcctgacccc

SEQ ID NO: 112740 - DNA, 21 bp, Artificial Sequence
  Description of Artificial Sequence: Synthetic oligonucleotide
atgggccagcggcctgacccc

SEQ ID NO: 112741 - DNA, 20 bp, Artificial Sequence
  Description of Artificial Sequence: Synthetic oligonucleotide
tgggccagcggcctgacccc

SEQ ID NO: 112742 - DNA, 20 bp, Artificial Sequence
  Description of Artificial Sequence: Synthetic oligonucleotide
gggccagcggcctgacccct

SEQ ID NO: 112743 - DNA, 20 bp, Artificial Sequence
  Description of Artificial Sequence: Synthetic oligonucleotide
ggccagcggcctgaccccct

SEQ ID NO: 112744 - DNA, 20 bp, Artificial Sequence
  Description of Artificial Sequence: Synthetic oligonucleotide
gccagcggcctgacccccgt

SEQ ID NO: 112745 - DNA, 20 bp, Artificial Sequence
  Description of Artificial Sequence: Synthetic oligonucleotide
ccagcggcctgacccccgct

SEQ ID NO: 112746 - DNA, 20 bp, Artificial Sequence
  Description of Artificial Sequence: Synthetic oligonucleotide
cagcggcctgacccccgcgt

SEQ ID NO: 112747 - DNA, 20 bp, Artificial Sequence
  Description of Artificial Sequence: Synthetic oligonucleotide
agcggcctgacccccgcgca

SEQ ID NO: 112748 - DNA, 20 bp, Artificial Sequence
  Description of Artificial Sequence: Synthetic oligonucleotide
gcggcctgacccccgcgcat

SEQ ID NO: 112749 - DNA, 21 bp, Artificial Sequence
  Description of Artificial Sequence: Synthetic oligonucleotide
cggcctgacccccgcgcagaa

SEQ ID NO: 112750 - DNA, 22 bp, Artificial Sequence
  Description of Artificial Sequence: Synthetic oligonucleotide
ggcctgacccccgcgcagaact

SEQ ID NO: 112751 - DNA, 22 bp, Artificial Sequence
  Description of Artificial Sequence: Synthetic oligonucleotide
gcctgacccccgcgcagaactg

SEQ ID NO: 112752 - DNA, 22 bp, Artificial Sequence
  Description of Artificial Sequence: Synthetic oligonucleotide
cctgacccccgcgcagaactgc

SEQ ID NO: 112753 - DNA, 22 bp, Artificial Sequence
  Description of Artificial Sequence: Synthetic oligonucleotide
ctgacccccgcgcagaactgcc

SEQ ID NO: 112754 - DNA, 22 bp, Artificial Sequence
  Description of Artificial Sequence: Synthetic oligonucleotide
tgacccccgcgcagaactgccc

SEQ ID NO: 112755 - DNA, 21 bp, Artificial Sequence
  Description of Artificial Sequence: Synthetic oligonucleotide
gacccccgcgcagaactgccc

SEQ ID NO: 112756 - DNA, 21 bp, Artificial Sequence
  Description of Artificial Sequence: Synthetic oligonucleotide
acccccgcgcagaactgcccg

SEQ ID NO: 112757 - DNA, 20 bp, Artificial Sequence
  Description of Artificial Sequence: Synthetic oligonucleotide
cccccgcgcagaactgcccg

SEQ ID NO: 112758 - DNA, 20 bp, Artificial Sequence
  Description of Artificial Sequence: Synthetic oligonucleotide
ccccgcgcagaactgcccgc

SEQ ID NO: 112759 - DNA, 20 bp, Artificial Sequence
  Description of Artificial Sequence: Synthetic oligonucleotide
cccgcgcagaactgcccgcg

SEQ ID NO: 112760 - DNA, 20 bp, Artificial Sequence
  Description of Artificial Sequence: Synthetic oligonucleotide
ccgcgcagaactgcccgcgg

SEQ ID NO: 112761 - DNA, 20 bp, Artificial Sequence
  Description of Artificial Sequence: Synthetic oligonucleotide
cgcgcagaactgcccgcggg

SEQ ID NO: 112762 - DNA, 20 bp, Artificial Sequence
  Description of Artificial Sequence: Synthetic oligonucleotide
gcgcagaactgcccgcgggc

SEQ ID NO: 112763 - DNA, 20 bp, Artificial Sequence
  Description of Artificial Sequence: Synthetic oligonucleotide
cgcagaactgcccgcgggcc

SEQ ID NO: 112764 - DNA, 21 bp, Artificial Sequence
  Description of Artificial Sequence: Synthetic oligonucleotide
gcagaactgcccgcgggccct

SEQ ID NO: 112765 - DNA, 21 bp, Artificial Sequence
  Description of Artificial Sequence: Synthetic oligonucleotide
cagaactgcccgcgggccctg

SEQ ID NO: 112766 - DNA, 23 bp, Artificial Sequence
  Description of Artificial Sequence: Synthetic oligonucleotide
agaactgcccgcgggccctggat

SEQ ID NO: 112767 - DNA, 22 bp, Artificial Sequence
  Description of Artificial Sequence: Synthetic oligonucleotide
gaactgcccgcgggccctggat

SEQ ID NO: 112768 - DNA, 22 bp, Artificial Sequence
  Description of Artificial Sequence: Synthetic oligonucleotide
aactgcccgcgggccctggatg

SEQ ID NO: 112769 - DNA, 21 bp, Artificial Sequence
  Description of Artificial Sequence: Synthetic oligonucleotide
actgcccgcgggccctggatg

SEQ ID NO: 112770 - DNA, 20 bp, Artificial Sequence
  Description of Artificial Sequence: Synthetic oligonucleotide
ctgcccgcgggccctggatg

SEQ ID NO: 112771 - DNA, 20 bp, Artificial Sequence
  Description of Artificial Sequence: Synthetic oligonucleotide
tgcccgcgggccctggatgg

SEQ ID NO: 112772 - DNA, 20 bp, Artificial Sequence
  Description of Artificial Sequence: Synthetic oligonucleotide
gcccgcgggccctggatggt

SEQ ID NO: 112773 - DNA, 20 bp, Artificial Sequence
  Description of Artificial Sequence: Synthetic oligonucleotide
cccgcgggccctggatgggt

SEQ ID NO: 112774 - DNA, 20 bp, Artificial Sequence
  Description of Artificial Sequence: Synthetic oligonucleotide
ccgcgggccctggatggggt

SEQ ID NO: 112775 - DNA, 21 bp, Artificial Sequence
  Description of Artificial Sequence: Synthetic oligonucleotide
cgcgggccctggatggggctt

SEQ ID NO: 112776 - DNA, 21 bp, Artificial Sequence
  Description of Artificial Sequence: Synthetic oligonucleotide
gcgggccctggatggggcttg

SEQ ID NO: 112777 - DNA, 21 bp, Artificial Sequence
  Description of Artificial Sequence: Synthetic oligonucleotide
cgggccctggatggggcttgg

SEQ ID NO: 112778 - DNA, 22 bp, Artificial Sequence
  Description of Artificial Sequence: Synthetic oligonucleotide
gggccctggatggggcttggct

SEQ ID NO: 112779 - DNA, 24 bp, Artificial Sequence
  Description of Artificial Sequence: Synthetic oligonucleotide
ggccctggatggggcttggctgat

SEQ ID NO: 112780 - DNA, 24 bp, Artificial Sequence
  Description of Artificial Sequence: Synthetic oligonucleotide
gccctggatggggcttggctgatg

SEQ ID NO: 112781 - DNA, 25 bp, Artificial Sequence
  Description of Artificial Sequence: Synthetic oligonucleotide
ccctggatggggcttggctgatggt

SEQ ID NO: 112782 - DNA, 26 bp, Artificial Sequence
  Description of Artificial Sequence: Synthetic oligonucleotide
cctggatggggcttggctgatggtca

SEQ ID NO: 112783 - DNA, 26 bp, Artificial Sequence
  Description of Artificial Sequence: Synthetic oligonucleotide
ctggatggggcttggctgatggtcag

SEQ ID NO: 112784 - DNA, 27 bp, Artificial Sequence
  Description of Artificial Sequence: Synthetic oligonucleotide
tggatggggcttggctgatggtcagca

SEQ ID NO: 112785 - DNA, 27 bp, Artificial Sequence
  Description of Artificial Sequence: Synthetic oligonucleotide
ggatggggcttggctgatggtcagcat

SEQ ID NO: 112786 - DNA, 29 bp, Artificial Sequence
  Description of Artificial Sequence: Synthetic oligonucleotide
gatggggcttggctgatggtcagcatatc

SEQ ID NO: 112787 - DNA, 29 bp, Artificial Sequence
  Description of Artificial Sequence: Synthetic oligonucleotide
atggggcttggctgatggtcagcatatcc

SEQ ID NO: 112788 - DNA, 28 bp, Artificial Sequence
  Description of Artificial Sequence: Synthetic oligonucleotide
tggggcttggctgatggtcagcatatcc

SEQ ID NO: 112789 - DNA, 27 bp, Artificial Sequence
  Description of Artificial Sequence: Synthetic oligonucleotide
ggggcttggctgatggtcagcatatcc

SEQ ID NO: 112790 - DNA, 28 bp, Artificial Sequence
  Description of Artificial Sequence: Synthetic oligonucleotide
gggcttggctgatggtcagcatatccag

SEQ ID NO: 112791 - DNA, 28 bp, Artificial Sequence
  Description of Artificial Sequence: Synthetic oligonucleotide
ggcttggctgatggtcagcatatccagc

SEQ ID NO: 112792 - DNA, 28 bp, Artificial Sequence
  Description of Artificial Sequence: Synthetic oligonucleotide
gcttggctgatggtcagcatatccagcc

SEQ ID NO: 112793 - DNA, 28 bp, Artificial Sequence
  Description of Artificial Sequence: Synthetic oligonucleotide
cttggctgatggtcagcatatccagccc

SEQ ID NO: 112794 - DNA, 29 bp, Artificial Sequence
  Description of Artificial Sequence: Synthetic oligonucleotide
ttggctgatggtcagcatatccagcccag

SEQ ID NO: 112795 - DNA, 28 bp, Artificial Sequence
  Description of Artificial Sequence: Synthetic oligonucleotide
tggctgatggtcagcatatccagcccag

SEQ ID NO: 112796 - DNA, 27 bp, Artificial Sequence
  Description of Artificial Sequence: Synthetic oligonucleotide
ggctgatggtcagcatatccagcccag

SEQ ID NO: 112797 - DNA, 28 bp, Artificial Sequence
  Description of Artificial Sequence: Synthetic oligonucleotide
gctgatggtcagcatatccagcccagtc

SEQ ID NO: 112798 - DNA, 28 bp, Artificial Sequence
  Description of Artificial Sequence: Synthetic oligonucleotide
ctgatggtcagcatatccagcccagtcc

SEQ ID NO: 112799 - DNA, 29 bp, Artificial Sequence
  Description of Artificial Sequence: Synthetic oligonucleotide
tgatggtcagcatatccagcccagtcctc

SEQ ID NO: 112800 - DNA, 28 bp, Artificial Sequence
  Description of Artificial Sequence: Synthetic oligonucleotide
gatggtcagcatatccagcccagtcctc

SEQ ID NO: 112801 - DNA, 29 bp, Artificial Sequence
  Description of Artificial Sequence: Synthetic oligonucleotide
atggtcagcatatccagcccagtcctcag

SEQ ID NO: 112802 - DNA, 28 bp, Artificial Sequence
  Description of Artificial Sequence: Synthetic oligonucleotide
tggtcagcatatccagcccagtcctcag

SEQ ID NO: 112803 - DNA, 27 bp, Artificial Sequence
  Description of Artificial Sequence: Synthetic oligonucleotide
ggtcagcatatccagcccagtcctcag

SEQ ID NO: 112804 - DNA, 27 bp, Artificial Sequence
  Description of Artificial Sequence: Synthetic oligonucleotide
gtcagcatatccagcccagtcctcagc

SEQ ID NO: 112805 - DNA, 27 bp, Artificial Sequence
  Description of Artificial Sequence: Synthetic oligonucleotide
tcagcatatccagcccagtcctcagcc

SEQ ID NO: 112806 - DNA, 27 bp, Artificial Sequence
  Description of Artificial Sequence: Synthetic oligonucleotide
cagcatatccagcccagtcctcagcct

SEQ ID NO: 112807 - DNA, 27 bp, Artificial Sequence
  Description of Artificial Sequence: Synthetic oligonucleotide
agcatatccagcccagtcctcagcctc

SEQ ID NO: 112808 - DNA, 27 bp, Artificial Sequence
  Description of Artificial Sequence: Synthetic oligonucleotide
gcatatccagcccagtcctcagcctct

SEQ ID NO: 112809 - DNA, 27 bp, Artificial Sequence
  Description of Artificial Sequence: Synthetic oligonucleotide
catatccagcccagtcctcagcctctc

SEQ ID NO: 112810 - DNA, 27 bp, Artificial Sequence
  Description of Artificial Sequence: Synthetic oligonucleotide
atatccagcccagtcctcagcctctcc

SEQ ID NO: 112811 - DNA, 27 bp, Artificial Sequence
  Description of Artificial Sequence: Synthetic oligonucleotide
tatccagcccagtcctcagcctctcca

SEQ ID NO: 112812 - DNA, 26 bp, Artificial Sequence
  Description of Artificial Sequence: Synthetic oligonucleotide
atccagcccagtcctcagcctctcca

SEQ ID NO: 112813 - DNA, 25 bp, Artificial Sequence
  Description of Artificial Sequence: Synthetic oligonucleotide
tccagcccagtcctcagcctctcca

SEQ ID NO: 112814 - DNA, 24 bp, Artificial Sequence
  Description of Artificial Sequence: Synthetic oligonucleotide
ccagcccagtcctcagcctctcca

SEQ ID NO: 112815 - DNA, 24 bp, Artificial Sequence
  Description of Artificial Sequence: Synthetic oligonucleotide
cagcccagtcctcagcctctccag

SEQ ID NO: 112816 - DNA, 24 bp, Artificial Sequence
  Description of Artificial Sequence: Synthetic oligonucleotide
agcccagtcctcagcctctccagc

SEQ ID NO: 112817 - DNA, 23 bp, Artificial Sequence
  Description of Artificial Sequence: Synthetic oligonucleotide
gcccagtcctcagcctctccagc

SEQ ID NO: 112818 - DNA, 24 bp, Artificial Sequence
  Description of Artificial Sequence: Synthetic oligonucleotide
cccagtcctcagcctctccagcct

SEQ ID NO: 112819 - DNA, 26 bp, Artificial Sequence
  Description of Artificial Sequence: Synthetic oligonucleotide
ccagtcctcagcctctccagcctctt

SEQ ID NO: 112820 - DNA, 26 bp, Artificial Sequence
  Description of Artificial Sequence: Synthetic oligonucleotide
cagtcctcagcctctccagcctcttg

SEQ ID NO: 112821 - DNA, 26 bp, Artificial Sequence
  Description of Artificial Sequence: Synthetic oligonucleotide
agtcctcagcctctccagcctcttgc

SEQ ID NO: 112822 - DNA, 25 bp, Artificial Sequence
  Description of Artificial Sequence: Synthetic oligonucleotide
gtcctcagcctctccagcctcttgc

SEQ ID NO: 112823 - DNA, 26 bp, Artificial Sequence
  Description of Artificial Sequence: Synthetic oligonucleotide
tcctcagcctctccagcctcttgcga

SEQ ID NO: 112824 - DNA, 25 bp, Artificial Sequence
  Description of Artificial Sequence: Synthetic oligonucleotide
cctcagcctctccagcctcttgcga

SEQ ID NO: 112825 - DNA, 25 bp, Artificial Sequence
  Description of Artificial Sequence: Synthetic oligonucleotide
ctcagcctctccagcctcttgcgac

SEQ ID NO: 112826 - DNA, 26 bp, Artificial Sequence
  Description of Artificial Sequence: Synthetic oligonucleotide
tcagcctctccagcctcttgcgacca

SEQ ID NO: 112827 - DNA, 25 bp, Artificial Sequence
  Description of Artificial Sequence: Synthetic oligonucleotide
cagcctctccagcctcttgcgacca

SEQ ID NO: 112828 - DNA, 26 bp, Artificial Sequence
  Description of Artificial Sequence: Synthetic oligonucleotide
agcctctccagcctcttgcgaccaca

SEQ ID NO: 112829 - DNA, 25 bp, Artificial Sequence
  Description of Artificial Sequence: Synthetic oligonucleotide
gcctctccagcctcttgcgaccaca

SEQ ID NO: 112830 - DNA, 25 bp, Artificial Sequence
  Description of Artificial Sequence: Synthetic oligonucleotide
cctctccagcctcttgcgaccacag

SEQ ID NO: 112831 - DNA, 25 bp, Artificial Sequence
  Description of Artificial Sequence: Synthetic oligonucleotide
ctctccagcctcttgcgaccacagc

SEQ ID NO: 112832 - DNA, 26 bp, Artificial Sequence
  Description of Artificial Sequence: Synthetic oligonucleotide
tctccagcctcttgcgaccacagcca

SEQ ID NO: 112833 - DNA, 25 bp, Artificial Sequence
  Description of Artificial Sequence: Synthetic oligonucleotide
ctccagcctcttgcgaccacagcca

SEQ ID NO: 112834 - DNA, 26 bp, Artificial Sequence
  Description of Artificial Sequence: Synthetic oligonucleotide
tccagcctcttgcgaccacagccaga

SEQ ID NO: 112835 - DNA, 25 bp, Artificial Sequence
  Description of Artificial Sequence: Synthetic oligonucleotide
ccagcctcttgcgaccacagccaga

SEQ ID NO: 112836 - DNA, 25 bp, Artificial Sequence
  Description of Artificial Sequence: Synthetic oligonucleotide
cagcctcttgcgaccacagccagag

SEQ ID NO: 112837 - DNA, 25 bp, Artificial Sequence
  Description of Artificial Sequence: Synthetic oligonucleotide
agcctcttgcgaccacagccagagc

SEQ ID NO: 112838 - DNA, 24 bp, Artificial Sequence
  Description of Artificial Sequence: Synthetic oligonucleotide
gcctcttgcgaccacagccagagc

SEQ ID NO: 112839 - DNA, 25 bp, Artificial Sequence
  Description of Artificial Sequence: Synthetic oligonucleotide
cctcttgcgaccacagccagagcct

SEQ ID NO: 112840 - DNA, 26 bp, Artificial Sequence
  Description of Artificial Sequence: Synthetic oligonucleotide
ctcttgcgaccacagccagagcctca

SEQ ID NO: 112841 - DNA, 26 bp, Artificial Sequence
  Description of Artificial Sequence: Synthetic oligonucleotide
tcttgcgaccacagccagagcctcag

SEQ ID NO: 112842 - DNA, 25 bp, Artificial Sequence
  Description of Artificial Sequence: Synthetic oligonucleotide
cttgcgaccacagccagagcctcag

SEQ ID NO: 112843 - DNA, 26 bp, Artificial Sequence
  Description of Artificial Sequence: Synthetic oligonucleotide
ttgcgaccacagccagagcctcagca

SEQ ID NO: 112844 - DNA, 25 bp, Artificial Sequence
  Description of Artificial Sequence: Synthetic oligonucleotide
tgcgaccacagccagagcctcagca

SEQ ID NO: 112845 - DNA, 24 bp, Artificial Sequence
  Description of Artificial Sequence: Synthetic oligonucleotide
gcgaccacagccagagcctcagca

SEQ ID NO: 112846 - DNA, 24 bp, Artificial Sequence
  Description of Artificial Sequence: Synthetic oligonucleotide
cgaccacagccagagcctcagcag

SEQ ID NO: 112847 - DNA, 25 bp, Artificial Sequence
  Description of Artificial Sequence: Synthetic oligonucleotide
gaccacagccagagcctcagcagga

SEQ ID NO: 112848 - DNA, 25 bp, Artificial Sequence
  Description of Artificial Sequence: Synthetic oligonucleotide
accacagccagagcctcagcaggag

SEQ ID NO: 112849 - DNA, 24 bp, Artificial Sequence
  Description of Artificial Sequence: Synthetic oligonucleotide
ccacagccagagcctcagcaggag

SEQ ID NO: 112850 - DNA, 24 bp, Artificial Sequence
  Description of Artificial Sequence: Synthetic oligonucleotide
cacagccagagcctcagcaggagc

SEQ ID NO: 112851 - DNA, 25 bp, Artificial Sequence
  Description of Artificial Sequence: Synthetic oligonucleotide
acagccagagcctcagcaggagcct

SEQ ID NO: 112852 - DNA, 24 bp, Artificial Sequence
  Description of Artificial Sequence: Synthetic oligonucleotide
cagccagagcctcagcaggagcct

SEQ ID NO: 112853 - DNA, 26 bp, Artificial Sequence
  Description of Artificial Sequence: Synthetic oligonucleotide
agccagagcctcagcaggagcctgtt

SEQ ID NO: 112854 - DNA, 25 bp, Artificial Sequence
  Description of Artificial Sequence: Synthetic oligonucleotide
gccagagcctcagcaggagcctgtt

SEQ ID NO: 112855 - DNA, 26 bp, Artificial Sequence
  Description of Artificial Sequence: Synthetic oligonucleotide
ccagagcctcagcaggagcctgttct

SEQ ID NO: 112856 - DNA, 27 bp, Artificial Sequence
  Description of Artificial Sequence: Synthetic oligonucleotide
cagagcctcagcaggagcctgttctca

SEQ ID NO: 112857 - DNA, 28 bp, Artificial Sequence
  Description of Artificial Sequence: Synthetic oligonucleotide
agagcctcagcaggagcctgttctcatc

SEQ ID NO: 112858 - DNA, 27 bp, Artificial Sequence
  Description of Artificial Sequence: Synthetic oligonucleotide
gagcctcagcaggagcctgttctcatc

SEQ ID NO: 112859 - DNA, 28 bp, Artificial Sequence
  Description of Artificial Sequence: Synthetic oligonucleotide
agcctcagcaggagcctgttctcatcac

SEQ ID NO: 112860 - DNA, 27 bp, Artificial Sequence
  Description of Artificial Sequence: Synthetic oligonucleotide
gcctcagcaggagcctgttctcatcac

SEQ ID NO: 112861 - DNA, 27 bp, Artificial Sequence
  Description of Artificial Sequence: Synthetic oligonucleotide
cctcagcaggagcctgttctcatcacc

SEQ ID NO: 112862 - DNA, 29 bp, Artificial Sequence
  Description of Artificial Sequence: Synthetic oligonucleotide
ctcagcaggagcctgttctcatcaccatg

SEQ ID NO: 112863 - DNA, 29 bp, Artificial Sequence
  Description of Artificial Sequence: Synthetic oligonucleotide
tcagcaggagcctgttctcatcaccatgg

SEQ ID NO: 112864 - DNA, 28 bp, Artificial Sequence
  Description of Artificial Sequence: Synthetic oligonucleotide
cagcaggagcctgttctcatcaccatgg

SEQ ID NO: 112865 - DNA, 28 bp, Artificial Sequence
  Description of Artificial Sequence: Synthetic oligonucleotide
agcaggagcctgttctcatcaccatggc

SEQ ID NO: 112866 - DNA, 27 bp, Artificial Sequence
  Description of Artificial Sequence: Synthetic oligonucleotide
gcaggagcctgttctcatcaccatggc

SEQ ID NO: 112867 - DNA, 29 bp, Artificial Sequence
  Description of Artificial Sequence: Synthetic oligonucleotide
caggagcctgttctcatcaccatggcaac

SEQ ID NO: 112868 - DNA, 30 bp, Artificial Sequence
  Description of Artificial Sequence: Synthetic oligonucleotide
aggagcctgttctcatcaccatggcaacag

SEQ ID NO: 112869 - DNA, 29 bp, Artificial Sequence
  Description of Artificial Sequence: Synthetic oligonucleotide
ggagcctgttctcatcaccatggcaacag

SEQ ID NO: 112870 - DNA, 30 bp, Artificial Sequence
  Description of Artificial Sequence: Synthetic oligonucleotide
gagcctgttctcatcaccatggcaacagtg

SEQ ID NO: 112871 - DNA, 30 bp, Artificial Sequence
  Description of Artificial Sequence: Synthetic oligonucleotide
agcctgttctcatcaccatggcaacagtgg

SEQ ID NO: 112872 - DNA, 29 bp, Artificial Sequence
  Description of Artificial Sequence: Synthetic oligonucleotide
gcctgttctcatcaccatggcaacagtgg

SEQ ID NO: 112873 - DNA, 31 bp, Artificial Sequence
  Description of Artificial Sequence: Synthetic oligonucleotide
cctgttctcatcaccatggcaacagtggtac

SEQ ID NO: 112874 - DNA, 32 bp, Artificial Sequence
  Description of Artificial Sequence: Synthetic oligonucleotide
ctgttctcatcaccatggcaacagtggtactg

SEQ ID NO: 112875 - DNA, 33 bp, Artificial Sequence
  Description of Artificial Sequence: Synthetic oligonucleotide
tgttctcatcaccatggcaacagtggtactgac

SEQ ID NO: 112876 - DNA, 32 bp, Artificial Sequence
  Description of Artificial Sequence: Synthetic oligonucleotide
gttctcatcaccatggcaacagtggtactgac

SEQ ID NO: 112877 - DNA, 33 bp, Artificial Sequence
  Description of Artificial Sequence: Synthetic oligonucleotide
ttctcatcaccatggcaacagtggtactgactg

SEQ ID NO: 112878 - DNA, 32 bp, Artificial Sequence
  Description of Artificial Sequence: Synthetic oligonucleotide
tctcatcaccatggcaacagtggtactgactg

SEQ ID NO: 112879 - DNA, 31 bp, Artificial Sequence
  Description of Artificial Sequence: Synthetic oligonucleotide
ctcatcaccatggcaacagtggtactgactg

SEQ ID NO: 112880 - DNA, 32 bp, Artificial Sequence
  Description of Artificial Sequence: Synthetic oligonucleotide
tcatcaccatggcaacagtggtactgactgtc

SEQ ID NO: 112881 - DNA, 31 bp, Artificial Sequence
  Description of Artificial Sequence: Synthetic oligonucleotide
catcaccatggcaacagtggtactgactgtc

SEQ ID NO: 112882 - DNA, 31 bp, Artificial Sequence
  Description of Artificial Sequence: Synthetic oligonucleotide
atcaccatggcaacagtggtactgactgtcc

SEQ ID NO: 112883 - DNA, 30 bp, Artificial Sequence
  Description of Artificial Sequence: Synthetic oligonucleotide
tcaccatggcaacagtggtactgactgtcc

SEQ ID NO: 112884 - DNA, 29 bp, Artificial Sequence
  Description of Artificial Sequence: Synthetic oligonucleotide
caccatggcaacagtggtactgactgtcc

SEQ ID NO: 112885 - DNA, 30 bp, Artificial Sequence
  Description of Artificial Sequence: Synthetic oligonucleotide
accatggcaacagtggtactgactgtcctc

SEQ ID NO: 112886 - DNA, 29 bp, Artificial Sequence
  Description of Artificial Sequence: Synthetic oligonucleotide
ccatggcaacagtggtactgactgtcctc

SEQ ID NO: 112887 - DNA, 30 bp, Artificial Sequence
  Description of Artificial Sequence: Synthetic oligonucleotide
catggcaacagtggtactgactgtcctcac

SEQ ID NO: 112888 - DNA, 30 bp, Artificial Sequence
  Description of Artificial Sequence: Synthetic oligonucleotide
atggcaacagtggtactgactgtcctcacc

SEQ ID NO: 112889 - DNA, 29 bp, Artificial Sequence
  Description of Artificial Sequence: Synthetic oligonucleotide
tggcaacagtggtactgactgtcctcacc

SEQ ID NO: 112890 - DNA, 28 bp, Artificial Sequence
  Description of Artificial Sequence: Synthetic oligonucleotide
ggcaacagtggtactgactgtcctcacc

SEQ ID NO: 112891 - DNA, 28 bp, Artificial Sequence
  Description of Artificial Sequence: Synthetic oligonucleotide
gcaacagtggtactgactgtcctcaccc

SEQ ID NO: 112892 - DNA, 29 bp, Artificial Sequence
  Description of Artificial Sequence: Synthetic oligonucleotide
caacagtggtactgactgtcctcacccac

SEQ ID NO: 112893 - DNA, 30 bp, Artificial Sequence
  Description of Artificial Sequence: Synthetic oligonucleotide
aacagtggtactgactgtcctcacccacac

SEQ ID NO: 112894 - DNA, 29 bp, Artificial Sequence
  Description of Artificial Sequence: Synthetic oligonucleotide
acagtggtactgactgtcctcacccacac

SEQ ID NO: 112895 - DNA, 28 bp, Artificial Sequence
  Description of Artificial Sequence: Synthetic oligonucleotide
cagtggtactgactgtcctcacccacac

SEQ ID NO: 112896 - DNA, 28 bp, Artificial Sequence
  Description of Artificial Sequence: Synthetic oligonucleotide
agtggtactgactgtcctcacccacacc

SEQ ID NO: 112897 - DNA, 27 bp, Artificial Sequence
  Description of Artificial Sequence: Synthetic oligonucleotide
gtggtactgactgtcctcacccacacc

SEQ ID NO: 112898 - DNA, 27 bp, Artificial Sequence
  Description of Artificial Sequence: Synthetic oligonucleotide
tggtactgactgtcctcacccacaccc

SEQ ID NO: 112899 - DNA, 26 bp, Artificial Sequence
  Description of Artificial Sequence: Synthetic oligonucleotide
ggtactgactgtcctcacccacaccc

SEQ ID NO: 112900 - DNA, 27 bp, Artificial Sequence
  Description of Artificial Sequence: Synthetic oligonucleotide
gtactgactgtcctcacccacacccct

SEQ ID NO: 112901 - DNA, 27 bp, Artificial Sequence
  Description of Artificial Sequence: Synthetic oligonucleotide
tactgactgtcctcacccacacccctg

SEQ ID NO: 112902 - DNA, 26 bp, Artificial Sequence
  Description of Artificial Sequence: Synthetic oligonucleotide
actgactgtcctcacccacacccctg

SEQ ID NO: 112903 - DNA, 25 bp, Artificial Sequence
  Description of Artificial Sequence: Synthetic oligonucleotide
ctgactgtcctcacccacacccctg

SEQ ID NO: 112904 - DNA, 25 bp, Artificial Sequence
  Description of Artificial Sequence: Synthetic oligonucleotide
tgactgtcctcacccacacccctgc

SEQ ID NO: 112905 - DNA, 24 bp, Artificial Sequence
  Description of Artificial Sequence: Synthetic oligonucleotide
gactgtcctcacccacacccctgc

SEQ ID NO: 112906 - DNA, 24 bp, Artificial Sequence
  Description of Artificial Sequence: Synthetic oligonucleotide
actgtcctcacccacacccctgcc

SEQ ID NO: 112907 - DNA, 23 bp, Artificial Sequence
  Description of Artificial Sequence: Synthetic oligonucleotide
ctgtcctcacccacacccctgcc

SEQ ID NO: 112908 - DNA, 23 bp, Artificial Sequence
  Description of Artificial Sequence: Synthetic oligonucleotide
tgtcctcacccacacccctgccc

SEQ ID NO: 112909 - DNA, 22 bp, Artificial Sequence
  Description of Artificial Sequence: Synthetic oligonucleotide
gtcctcacccacacccctgccc

SEQ ID NO: 112910 - DNA, 23 bp, Artificial Sequence
  Description of Artificial Sequence: Synthetic oligonucleotide
tcctcacccacacccctgcccct

SEQ ID NO: 112911 - DNA, 22 bp, Artificial Sequence
  Description of Artificial Sequence: Synthetic oligonucleotide
cctcacccacacccctgcccct

SEQ ID NO: 112912 - DNA, 22 bp, Artificial Sequence
  Description of Artificial Sequence: Synthetic oligonucleotide
ctcacccacacccctgcccctc

SEQ ID NO: 112913 - DNA, 23 bp, Artificial Sequence
  Description of Artificial Sequence: Synthetic oligonucleotide
tcacccacacccctgcccctcga

SEQ ID NO: 112914 - DNA, 22 bp, Artificial Sequence
  Description of Artificial Sequence: Synthetic oligonucleotide
cacccacacccctgcccctcga

SEQ ID NO: 112915 - DNA, 23 bp, Artificial Sequence
  Description of Artificial Sequence: Synthetic oligonucleotide
acccacacccctgcccctcgagt

SEQ ID NO: 112916 - DNA, 22 bp, Artificial Sequence
  Description of Artificial Sequence: Synthetic oligonucleotide
cccacacccctgcccctcgagt

SEQ ID NO: 112917 - DNA, 23 bp, Artificial Sequence
  Description of Artificial Sequence: Synthetic oligonucleotide
ccacacccctgcccctcgagtga

SEQ ID NO: 112918 - DNA, 24 bp, Artificial Sequence
  Description of Artificial Sequence: Synthetic oligonucleotide
cacacccctgcccctcgagtgaga

SEQ ID NO: 112919 - DNA, 25 bp, Artificial Sequence
  Description of Artificial Sequence: Synthetic oligonucleotide
acacccctgcccctcgagtgagact

SEQ ID NO: 112920 - DNA, 24 bp, Artificial Sequence
  Description of Artificial Sequence: Synthetic oligonucleotide
cacccctgcccctcgagtgagact

SEQ ID NO: 112921 - DNA, 24 bp, Artificial Sequence
  Description of Artificial Sequence: Synthetic oligonucleotide
acccctgcccctcgagtgagactg

SEQ ID NO: 112922 - DNA, 23 bp, Artificial Sequence
  Description of Artificial Sequence: Synthetic oligonucleotide
cccctgcccctcgagtgagactg

SEQ ID NO: 112923 - DNA, 23 bp, Artificial Sequence
  Description of Artificial Sequence: Synthetic oligonucleotide
ccctgcccctcgagtgagactgg

SEQ ID NO: 112924 - DNA, 24 bp, Artificial Sequence
  Description of Artificial Sequence: Synthetic oligonucleotide
cctgcccctcgagtgagactggga

SEQ ID NO: 112925 - DNA, 26 bp, Artificial Sequence
  Description of Artificial Sequence: Synthetic oligonucleotide
ctgcccctcgagtgagactgggacaa

SEQ ID NO: 112926 - DNA, 27 bp, Artificial Sequence
  Description of Artificial Sequence: Synthetic oligonucleotide
tgcccctcgagtgagactgggacaaga

SEQ ID NO: 112927 - DNA, 27 bp, Artificial Sequence
  Description of Artificial Sequence: Synthetic oligonucleotide
gcccctcgagtgagactgggacaagat

SEQ ID NO: 112928 - DNA, 27 bp, Artificial Sequence
  Description of Artificial Sequence: Synthetic oligonucleotide
cccctcgagtgagactgggacaagatg

SEQ ID NO: 112929 - DNA, 27 bp, Artificial Sequence
  Description of Artificial Sequence: Synthetic oligonucleotide
ccctcgagtgagactgggacaagatgc

SEQ ID NO: 112930 - DNA, 28 bp, Artificial Sequence
  Description of Artificial Sequence: Synthetic oligonucleotide
cctcgagtgagactgggacaagatgctc

SEQ ID NO: 112931 - DNA, 29 bp, Artificial Sequence
  Description of Artificial Sequence: Synthetic oligonucleotide
ctcgagtgagactgggacaagatgctctg

SEQ ID NO: 112932 - DNA, 29 bp, Artificial Sequence
  Description of Artificial Sequence: Synthetic oligonucleotide
tcgagtgagactgggacaagatgctctgc

SEQ ID NO: 112933 - DNA, 28 bp, Artificial Sequence
  Description of Artificial Sequence: Synthetic oligonucleotide
cgagtgagactgggacaagatgctctgc

SEQ ID NO: 112934 - DNA, 29 bp, Artificial Sequence
  Description of Artificial Sequence: Synthetic oligonucleotide
gagtgagactgggacaagatgctctgctg

SEQ ID NO: 112935 - DNA, 29 bp, Artificial Sequence
  Description of Artificial Sequence: Synthetic oligonucleotide
agtgagactgggacaagatgctctgctgg

SEQ ID NO: 112936 - DNA, 28 bp, Artificial Sequence
  Description of Artificial Sequence: Synthetic oligonucleotide
gtgagactgggacaagatgctctgctgg

SEQ ID NO: 112937 - DNA, 29 bp, Artificial Sequence
  Description of Artificial Sequence: Synthetic oligonucleotide
tgagactgggacaagatgctctgctggac

SEQ ID NO: 112938 - DNA, 28 bp, Artificial Sequence
  Description of Artificial Sequence: Synthetic oligonucleotide
gagactgggacaagatgctctgctggac

SEQ ID NO: 112939 - DNA, 30 bp, Artificial Sequence
  Description of Artificial Sequence: Synthetic oligonucleotide
agactgggacaagatgctctgctggacttg

SEQ ID NO: 112940 - DNA, 29 bp, Artificial Sequence
  Description of Artificial Sequence: Synthetic oligonucleotide
gactgggacaagatgctctgctggacttg

SEQ ID NO: 112941 - DNA, 30 bp, Artificial Sequence
  Description of Artificial Sequence: Synthetic oligonucleotide
actgggacaagatgctctgctggacttgag

SEQ ID NO: 112942 - DNA, 29 bp, Artificial Sequence
  Description of Artificial Sequence: Synthetic oligonucleotide
ctgggacaagatgctctgctggacttgag

SEQ ID NO: 112943 - DNA, 29 bp, Artificial Sequence
  Description of Artificial Sequence: Synthetic oligonucleotide
tgggacaagatgctctgctggacttgagc

SEQ ID NO: 112944 - DNA, 28 bp, Artificial Sequence
  Description of Artificial Sequence: Synthetic oligonucleotide
gggacaagatgctctgctggacttgagc

SEQ ID NO: 112945 - DNA, 31 bp, Artificial Sequence
  Description of Artificial Sequence: Synthetic oligonucleotide
ggacaagatgctctgctggacttgagctttg

SEQ ID NO: 112946 - DNA, 31 bp, Artificial Sequence
  Description of Artificial Sequence: Synthetic oligonucleotide
gacaagatgctctgctggacttgagctttgc

SEQ ID NO: 112947 - DNA, 31 bp, Artificial Sequence
  Description of Artificial Sequence: Synthetic oligonucleotide
acaagatgctctgctggacttgagctttgcc

SEQ ID NO: 112948 - DNA, 30 bp, Artificial Sequence
  Description of Artificial Sequence: Synthetic oligonucleotide
caagatgctctgctggacttgagctttgcc

SEQ ID NO: 112949 - DNA, 32 bp, Artificial Sequence
  Description of Artificial Sequence: Synthetic oligonucleotide
aagatgctctgctggacttgagctttgcctac

SEQ ID NO: 112950 - DNA, 31 bp, Artificial Sequence
  Description of Artificial Sequence: Synthetic oligonucleotide
agatgctctgctggacttgagctttgcctac

SEQ ID NO: 112951 - DNA, 30 bp, Artificial Sequence
  Description of Artificial Sequence: Synthetic oligonucleotide
gatgctctgctggacttgagctttgcctac

SEQ ID NO: 112952 - DNA, 32 bp, Artificial Sequence
  Description of Artificial Sequence: Synthetic oligonucleotide
atgctctgctggacttgagctttgcctacatg

SEQ ID NO: 112953 - DNA, 31 bp, Artificial Sequence
  Description of Artificial Sequence: Synthetic oligonucleotide
tgctctgctggacttgagctttgcctacatg

SEQ ID NO: 112954 - DNA, 30 bp, Artificial Sequence
  Description of Artificial Sequence: Synthetic oligonucleotide
gctctgctggacttgagctttgcctacatg

SEQ ID NO: 112955 - DNA, 30 bp, Artificial Sequence
  Description of Artificial Sequence: Synthetic oligonucleotide
ctctgctggacttgagctttgcctacatgc

SEQ ID NO: 112956 - DNA, 30 bp, Artificial Sequence
  Description of Artificial Sequence: Synthetic oligonucleotide
tctgctggacttgagctttgcctacatgcc

SEQ ID NO: 112957 - DNA, 29 bp, Artificial Sequence
  Description of Artificial Sequence: Synthetic oligonucleotide
ctgctggacttgagctttgcctacatgcc

SEQ ID NO: 112958 - DNA, 29 bp, Artificial Sequence
  Description of Artificial Sequence: Synthetic oligonucleotide
tgctggacttgagctttgcctacatgccc

SEQ ID NO: 112959 - DNA, 28 bp, Artificial Sequence
  Description of Artificial Sequence: Synthetic oligonucleotide
gctggacttgagctttgcctacatgccc

SEQ ID NO: 112960 - DNA, 28 bp, Artificial Sequence
  Description of Artificial Sequence: Synthetic oligonucleotide
ctggacttgagctttgcctacatgcccc

SEQ ID NO: 112961 - DNA, 28 bp, Artificial Sequence
  Description of Artificial Sequence: Synthetic oligonucleotide
tggacttgagctttgcctacatgccccc

SEQ ID NO: 112962 - DNA, 27 bp, Artificial Sequence
  Description of Artificial Sequence: Synthetic oligonucleotide
ggacttgagctttgcctacatgccccc

SEQ ID NO: 112963 - DNA, 27 bp, Artificial Sequence
  Description of Artificial Sequence: Synthetic oligonucleotide
gacttgagctttgcctacatgcccccc

SEQ ID NO: 112964 - DNA, 28 bp, Artificial Sequence
  Description of Artificial Sequence: Synthetic oligonucleotide
acttgagctttgcctacatgccccccac

SEQ ID NO: 112965 - DNA, 27 bp, Artificial Sequence
  Description of Artificial Sequence: Synthetic oligonucleotide
cttgagctttgcctacatgccccccac

SEQ ID NO: 112966 - DNA, 27 bp, Artificial Sequence
  Description of Artificial Sequence: Synthetic oligonucleotide
ttgagctttgcctacatgccccccacc

SEQ ID NO: 112967 - DNA, 27 bp, Artificial Sequence
  Description of Artificial Sequence: Synthetic oligonucleotide
tgagctttgcctacatgccccccacct

SEQ ID NO: 112968 - DNA, 26 bp, Artificial Sequence
  Description of Artificial Sequence: Synthetic oligonucleotide
gagctttgcctacatgccccccacct

SEQ ID NO: 112969 - DNA, 26 bp, Artificial Sequence
  Description of Artificial Sequence: Synthetic oligonucleotide
agctttgcctacatgccccccacctc

SEQ ID NO: 112970 - DNA, 25 bp, Artificial Sequence
  Description of Artificial Sequence: Synthetic oligonucleotide
gctttgcctacatgccccccacctc

SEQ ID NO: 112971 - DNA, 25 bp, Artificial Sequence
  Description of Artificial Sequence: Synthetic oligonucleotide
ctttgcctacatgccccccacctcc

SEQ ID NO: 112972 - DNA, 26 bp, Artificial Sequence
  Description of Artificial Sequence: Synthetic oligonucleotide
tttgcctacatgccccccacctccga

SEQ ID NO: 112973 - DNA, 25 bp, Artificial Sequence
  Description of Artificial Sequence: Synthetic oligonucleotide
ttgcctacatgccccccacctccga

SEQ ID NO: 112974 - DNA, 24 bp, Artificial Sequence
  Description of Artificial Sequence: Synthetic oligonucleotide
tgcctacatgccccccacctccga

SEQ ID NO: 112975 - DNA, 23 bp, Artificial Sequence
  Description of Artificial Sequence: Synthetic oligonucleotide
gcctacatgccccccacctccga

SEQ ID NO: 112976 - DNA, 23 bp, Artificial Sequence
  Description of Artificial Sequence: Synthetic oligonucleotide
cctacatgccccccacctccgag

SEQ ID NO: 112977 - DNA, 23 bp, Artificial Sequence
  Description of Artificial Sequence: Synthetic oligonucleotide
ctacatgccccccacctccgagg

SEQ ID NO: 112978 - DNA, 23 bp, Artificial Sequence
  Description of Artificial Sequence: Synthetic oligonucleotide
tacatgccccccacctccgaggc

SEQ ID NO: 112979 - DNA, 22 bp, Artificial Sequence
  Description of Artificial Sequence: Synthetic oligonucleotide
acatgccccccacctccgaggc

SEQ ID NO: 112980 - DNA, 21 bp, Artificial Sequence
  Description of Artificial Sequence: Synthetic oligonucleotide
catgccccccacctccgaggc

SEQ ID NO: 112981 - DNA, 21 bp, Artificial Sequence
  Description of Artificial Sequence: Synthetic oligonucleotide
atgccccccacctccgaggcc

SEQ ID NO: 112982 - DNA, 20 bp, Artificial Sequence
  Description of Artificial Sequence: Synthetic oligonucleotide
tgccccccacctccgaggcc

SEQ ID NO: 112983 - DNA, 20 bp, Artificial Sequence
  Description of Artificial Sequence: Synthetic oligonucleotide
gccccccacctccgaggcct

SEQ ID NO: 112984 - DNA, 20 bp, Artificial Sequence
  Description of Artificial Sequence: Synthetic oligonucleotide
ccccccacctccgaggccgt

SEQ ID NO: 112985 - DNA, 20 bp, Artificial Sequence
  Description of Artificial Sequence: Synthetic oligonucleotide
cccccacctccgaggccgct

SEQ ID NO: 112986 - DNA, 20 bp, Artificial Sequence
  Description of Artificial Sequence: Synthetic oligonucleotide
ccccacctccgaggccgcct

SEQ ID NO: 112987 - DNA, 22 bp, Artificial Sequence
  Description of Artificial Sequence: Synthetic oligonucleotide
cccacctccgaggccgcctcat

SEQ ID NO: 112988 - DNA, 23 bp, Artificial Sequence
  Description of Artificial Sequence: Synthetic oligonucleotide
ccacctccgaggccgcctcatct

SEQ ID NO: 112989 - DNA, 24 bp, Artificial Sequence
  Description of Artificial Sequence: Synthetic oligonucleotide
cacctccgaggccgcctcatctct

SEQ ID NO: 112990 - DNA, 24 bp, Artificial Sequence
  Description of Artificial Sequence: Synthetic oligonucleotide
acctccgaggccgcctcatctctg

SEQ ID NO: 112991 - DNA, 23 bp, Artificial Sequence
  Description of Artificial Sequence: Synthetic oligonucleotide
cctccgaggccgcctcatctctg

SEQ ID NO: 112992 - DNA, 23 bp, Artificial Sequence
  Description of Artificial Sequence: Synthetic oligonucleotide
ctccgaggccgcctcatctctgg

SEQ ID NO: 112993 - DNA, 24 bp, Artificial Sequence
  Description of Artificial Sequence: Synthetic oligonucleotide
tccgaggccgcctcatctctggct

SEQ ID NO: 112994 - DNA, 23 bp, Artificial Sequence
  Description of Artificial Sequence: Synthetic oligonucleotide
ccgaggccgcctcatctctggct

SEQ ID NO: 112995 - DNA, 23 bp, Artificial Sequence
  Description of Artificial Sequence: Synthetic oligonucleotide
cgaggccgcctcatctctggctc

SEQ ID NO: 112996 - DNA, 23 bp, Artificial Sequence
  Description of Artificial Sequence: Synthetic oligonucleotide
gaggccgcctcatctctggctcc

SEQ ID NO: 112997 - DNA, 23 bp, Artificial Sequence
  Description of Artificial Sequence: Synthetic oligonucleotide
aggccgcctcatctctggctccg

SEQ ID NO: 112998 - DNA, 22 bp, Artificial Sequence
  Description of Artificial Sequence: Synthetic oligonucleotide
ggccgcctcatctctggctccg

SEQ ID NO: 112999 - DNA, 22 bp, Artificial Sequence
  Description of Artificial Sequence: Synthetic oligonucleotide
gccgcctcatctctggctccgg

SEQ ID NO: 113000 - DNA, 23 bp, Artificial Sequence
  Description of Artificial Sequence: Synthetic oligonucleotide
ccgcctcatctctggctccgggt

SEQ ID NO: 113001 - DNA, 23 bp, Artificial Sequence
  Description of Artificial Sequence: Synthetic oligonucleotide
cgcctcatctctggctccgggtc

SEQ ID NO: 113002 - DNA, 23 bp, Artificial Sequence
  Description of Artificial Sequence: Synthetic oligonucleotide
gcctcatctctggctccgggtcc

SEQ ID NO: 113003 - DNA, 23 bp, Artificial Sequence
  Description of Artificial Sequence: Synthetic oligonucleotide
cctcatctctggctccgggtccc

SEQ ID NO: 113004 - DNA, 23 bp, Artificial Sequence
  Description of Artificial Sequence: Synthetic oligonucleotide
ctcatctctggctccgggtcccc

SEQ ID NO: 113005 - DNA, 24 bp, Artificial Sequence
  Description of Artificial Sequence: Synthetic oligonucleotide
tcatctctggctccgggtccccct

SEQ ID NO: 113006 - DNA, 23 bp, Artificial Sequence
  Description of Artificial Sequence: Synthetic oligonucleotide
catctctggctccgggtccccct

SEQ ID NO: 113007 - DNA, 23 bp, Artificial Sequence
  Description of Artificial Sequence: Synthetic oligonucleotide
atctctggctccgggtccccctc

SEQ ID NO: 113008 - DNA, 22 bp, Artificial Sequence
  Description of Artificial Sequence: Synthetic oligonucleotide
tctctggctccgggtccccctc

SEQ ID NO: 113009 - DNA, 21 bp, Artificial Sequence
  Description of Artificial Sequence: Synthetic oligonucleotide
ctctggctccgggtccccctc

SEQ ID NO: 113010 - DNA, 21 bp, Artificial Sequence
  Description of Artificial Sequence: Synthetic oligonucleotide
tctggctccgggtccccctcc

SEQ ID NO: 113011 - DNA, 20 bp, Artificial Sequence
  Description of Artificial Sequence: Synthetic oligonucleotide
ctggctccgggtccccctcc

SEQ ID NO: 113012 - DNA, 23 bp, Artificial Sequence
  Description of Artificial Sequence: Synthetic oligonucleotide
tggctccgggtccccctcccttt

SEQ ID NO: 113013 - DNA, 22 bp, Artificial Sequence
  Description of Artificial Sequence: Synthetic oligonucleotide
ggctccgggtccccctcccttt

SEQ ID NO: 113014 - DNA, 22 bp, Artificial Sequence
  Description of Artificial Sequence: Synthetic oligonucleotide
gctccgggtccccctccctttg

SEQ ID NO: 113015 - DNA, 22 bp, Artificial Sequence
  Description of Artificial Sequence: Synthetic oligonucleotide
ctccgggtccccctccctttgg

SEQ ID NO: 113016 - DNA, 22 bp, Artificial Sequence
  Description of Artificial Sequence: Synthetic oligonucleotide
tccgggtccccctccctttggg

SEQ ID NO: 113017 - DNA, 21 bp, Artificial Sequence
  Description of Artificial Sequence: Synthetic oligonucleotide
ccgggtccccctccctttggg

SEQ ID NO: 113018 - DNA, 23 bp, Artificial Sequence
  Description of Artificial Sequence: Synthetic oligonucleotide
cgggtccccctccctttgggcta

SEQ ID NO: 113019 - DNA, 24 bp, Artificial Sequence
  Description of Artificial Sequence: Synthetic oligonucleotide
gggtccccctccctttgggctaga

SEQ ID NO: 113020 - DNA, 25 bp, Artificial Sequence
  Description of Artificial Sequence: Synthetic oligonucleotide
ggtccccctccctttgggctagagt

SEQ ID NO: 113021 - DNA, 25 bp, Artificial Sequence
  Description of Artificial Sequence: Synthetic oligonucleotide
gtccccctccctttgggctagagtg

SEQ ID NO: 113022 - DNA, 25 bp, Artificial Sequence
  Description of Artificial Sequence: Synthetic oligonucleotide
tccccctccctttgggctagagtgg

SEQ ID NO: 113023 - DNA, 24 bp, Artificial Sequence
  Description of Artificial Sequence: Synthetic oligonucleotide
ccccctccctttgggctagagtgg

SEQ ID NO: 113024 - DNA, 24 bp, Artificial Sequence
  Description of Artificial Sequence: Synthetic oligonucleotide
cccctccctttgggctagagtggc

SEQ ID NO: 113025 - DNA, 25 bp, Artificial Sequence
  Description of Artificial Sequence: Synthetic oligonucleotide
ccctccctttgggctagagtggcga

SEQ ID NO: 113026 - DNA, 25 bp, Artificial Sequence
  Description of Artificial Sequence: Synthetic oligonucleotide
cctccctttgggctagagtggcgac

SEQ ID NO: 113027 - DNA, 25 bp, Artificial Sequence
  Description of Artificial Sequence: Synthetic oligonucleotide
ctccctttgggctagagtggcgacg

SEQ ID NO: 113028 - DNA, 25 bp, Artificial Sequence
  Description of Artificial Sequence: Synthetic oligonucleotide
tccctttgggctagagtggcgacgc

SEQ ID NO: 113029 - DNA, 24 bp, Artificial Sequence
  Description of Artificial Sequence: Synthetic oligonucleotide
ccctttgggctagagtggcgacgc

SEQ ID NO: 113030 - DNA, 25 bp, Artificial Sequence
  Description of Artificial Sequence: Synthetic oligonucleotide
cctttgggctagagtggcgacgcca

SEQ ID NO: 113031 - DNA, 25 bp, Artificial Sequence
  Description of Artificial Sequence: Synthetic oligonucleotide
ctttgggctagagtggcgacgccag

SEQ ID NO: 113032 - DNA, 26 bp, Artificial Sequence
  Description of Artificial Sequence: Synthetic oligonucleotide
tttgggctagagtggcgacgccagca

SEQ ID NO: 113033 - DNA, 25 bp, Artificial Sequence
  Description of Artificial Sequence: Synthetic oligonucleotide
ttgggctagagtggcgacgccagca

SEQ ID NO: 113034 - DNA, 24 bp, Artificial Sequence
  Description of Artificial Sequence: Synthetic oligonucleotide
tgggctagagtggcgacgccagca

SEQ ID NO: 113035 - DNA, 23 bp, Artificial Sequence
  Description of Artificial Sequence: Synthetic oligonucleotide
gggctagagtggcgacgccagca

SEQ ID NO: 113036 - DNA, 23 bp, Artificial Sequence
  Description of Artificial Sequence: Synthetic oligonucleotide
ggctagagtggcgacgccagcac

SEQ ID NO: 113037 - DNA, 24 bp, Artificial Sequence
  Description of Artificial Sequence: Synthetic oligonucleotide
gctagagtggcgacgccagcacct

SEQ ID NO: 113038 - DNA, 24 bp, Artificial Sequence
  Description of Artificial Sequence: Synthetic oligonucleotide
ctagagtggcgacgccagcacctg

SEQ ID NO: 113039 - DNA, 24 bp, Artificial Sequence
  Description of Artificial Sequence: Synthetic oligonucleotide
tagagtggcgacgccagcacctgg

SEQ ID NO: 113040 - DNA, 23 bp, Artificial Sequence
  Description of Artificial Sequence: Synthetic oligonucleotide
agagtggcgacgccagcacctgg

SEQ ID NO: 113041 - DNA, 22 bp, Artificial Sequence
  Description of Artificial Sequence: Synthetic oligonucleotide
gagtggcgacgccagcacctgg

SEQ ID NO: 113042 - DNA, 25 bp, Artificial Sequence
  Description of Artificial Sequence: Synthetic oligonucleotide
agtggcgacgccagcacctgggtaa

SEQ ID NO: 113043 - DNA, 24 bp, Artificial Sequence
  Description of Artificial Sequence: Synthetic oligonucleotide
gtggcgacgccagcacctgggtaa

SEQ ID NO: 113044 - DNA, 24 bp, Artificial Sequence
  Description of Artificial Sequence: Synthetic oligonucleotide
tggcgacgccagcacctgggtaag

SEQ ID NO: 113045 - DNA, 23 bp, Artificial Sequence
  Description of Artificial Sequence: Synthetic oligonucleotide
ggcgacgccagcacctgggtaag

SEQ ID NO: 113046 - DNA, 23 bp, Artificial Sequence
  Description of Artificial Sequence: Synthetic oligonucleotide
gcgacgccagcacctgggtaagg

SEQ ID NO: 113047 - DNA, 24 bp, Artificial Sequence
  Description of Artificial Sequence: Synthetic oligonucleotide
cgacgccagcacctgggtaaggga

SEQ ID NO: 113048 - DNA, 26 bp, Artificial Sequence
  Description of Artificial Sequence: Synthetic oligonucleotide
gacgccagcacctgggtaagggacat

SEQ ID NO: 113049 - DNA, 27 bp, Artificial Sequence
  Description of Artificial Sequence: Synthetic oligonucleotide
acgccagcacctgggtaagggacatct

SEQ ID NO: 113050 - DNA, 26 bp, Artificial Sequence
  Description of Artificial Sequence: Synthetic oligonucleotide
cgccagcacctgggtaagggacatct

SEQ ID NO: 113051 - DNA, 26 bp, Artificial Sequence
  Description of Artificial Sequence: Synthetic oligonucleotide
gccagcacctgggtaagggacatctg

SEQ ID NO: 113052 - DNA, 27 bp, Artificial Sequence
  Description of Artificial Sequence: Synthetic oligonucleotide
ccagcacctgggtaagggacatctgct

SEQ ID NO: 113053 - DNA, 27 bp, Artificial Sequence
  Description of Artificial Sequence: Synthetic oligonucleotide
cagcacctgggtaagggacatctgctc

SEQ ID NO: 113054 - DNA, 27 bp, Artificial Sequence
  Description of Artificial Sequence: Synthetic oligonucleotide
agcacctgggtaagggacatctgctcc

SEQ ID NO: 113055 - DNA, 27 bp, Artificial Sequence
  Description of Artificial Sequence: Synthetic oligonucleotide
gcacctgggtaagggacatctgctcct

SEQ ID NO: 113056 - DNA, 27 bp, Artificial Sequence
  Description of Artificial Sequence: Synthetic oligonucleotide
cacctgggtaagggacatctgctcctg

SEQ ID NO: 113057 - DNA, 27 bp, Artificial Sequence
  Description of Artificial Sequence: Synthetic oligonucleotide
acctgggtaagggacatctgctcctgg

SEQ ID NO: 113058 - DNA, 26 bp, Artificial Sequence
  Description of Artificial Sequence: Synthetic oligonucleotide
cctgggtaagggacatctgctcctgg

SEQ ID NO: 113059 - DNA, 27 bp, Artificial Sequence
  Description of Artificial Sequence: Synthetic oligonucleotide
ctgggtaagggacatctgctcctggct

SEQ ID NO: 113060 - DNA, 27 bp, Artificial Sequence
  Description of Artificial Sequence: Synthetic oligonucleotide
tgggtaagggacatctgctcctggctg

SEQ ID NO: 113061 - DNA, 26 bp, Artificial Sequence
  Description of Artificial Sequence: Synthetic oligonucleotide
gggtaagggacatctgctcctggctg

SEQ ID NO: 113062 - DNA, 27 bp, Artificial Sequence
  Description of Artificial Sequence: Synthetic oligonucleotide
ggtaagggacatctgctcctggctgca

SEQ ID NO: 113063 - DNA, 28 bp, Artificial Sequence
  Description of Artificial Sequence: Synthetic oligonucleotide
gtaagggacatctgctcctggctgcaac

SEQ ID NO: 113064 - DNA, 29 bp, Artificial Sequence
  Description of Artificial Sequence: Synthetic oligonucleotide
taagggacatctgctcctggctgcaactc

SEQ ID NO: 113065 - DNA, 28 bp, Artificial Sequence
  Description of Artificial Sequence: Synthetic oligonucleotide
aagggacatctgctcctggctgcaactc

SEQ ID NO: 113066 - DNA, 27 bp, Artificial Sequence
  Description of Artificial Sequence: Synthetic oligonucleotide
agggacatctgctcctggctgcaactc

SEQ ID NO: 113067 - DNA, 26 bp, Artificial Sequence
  Description of Artificial Sequence: Synthetic oligonucleotide
gggacatctgctcctggctgcaactc

SEQ ID NO: 113068 - DNA, 27 bp, Artificial Sequence
  Description of Artificial Sequence: Synthetic oligonucleotide
ggacatctgctcctggctgcaactcct

SEQ ID NO: 113069 - DNA, 27 bp, Artificial Sequence
  Description of Artificial Sequence: Synthetic oligonucleotide
gacatctgctcctggctgcaactcctg

SEQ ID NO: 113070 - DNA, 27 bp, Artificial Sequence
  Description of Artificial Sequence: Synthetic oligonucleotide
acatctgctcctggctgcaactcctgg

SEQ ID NO: 113071 - DNA, 26 bp, Artificial Sequence
  Description of Artificial Sequence: Synthetic oligonucleotide
catctgctcctggctgcaactcctgg

SEQ ID NO: 113072 - DNA, 26 bp, Artificial Sequence
  Description of Artificial Sequence: Synthetic oligonucleotide
atctgctcctggctgcaactcctggg

SEQ ID NO: 113073 - DNA, 25 bp, Artificial Sequence
  Description of Artificial Sequence: Synthetic oligonucleotide
tctgctcctggctgcaactcctggg

SEQ ID NO: 113074 - DNA, 24 bp, Artificial Sequence
  Description of Artificial Sequence: Synthetic oligonucleotide
ctgctcctggctgcaactcctggg

SEQ ID NO: 113075 - DNA, 25 bp, Artificial Sequence
  Description of Artificial Sequence: Synthetic oligonucleotide
tgctcctggctgcaactcctgggct

SEQ ID NO: 113076 - DNA, 24 bp, Artificial Sequence
  Description of Artificial Sequence: Synthetic oligonucleotide
gctcctggctgcaactcctgggct

SEQ ID NO: 113077 - DNA, 27 bp, Artificial Sequence
  Description of Artificial Sequence: Synthetic oligonucleotide
ctcctggctgcaactcctgggctgaat

SEQ ID NO: 113078 - DNA, 27 bp, Artificial Sequence
  Description of Artificial Sequence: Synthetic oligonucleotide
tcctggctgcaactcctgggctgaatg

SEQ ID NO: 113079 - DNA, 26 bp, Artificial Sequence
  Description of Artificial Sequence: Synthetic oligonucleotide
cctggctgcaactcctgggctgaatg

SEQ ID NO: 113080 - DNA, 26 bp, Artificial Sequence
  Description of Artificial Sequence: Synthetic oligonucleotide
ctggctgcaactcctgggctgaatgg

SEQ ID NO: 113081 - DNA, 26 bp, Artificial Sequence
  Description of Artificial Sequence: Synthetic oligonucleotide
tggctgcaactcctgggctgaatggc

SEQ ID NO: 113082 - DNA, 25 bp, Artificial Sequence
  Description of Artificial Sequence: Synthetic oligonucleotide
ggctgcaactcctgggctgaatggc

SEQ ID NO: 113083 - DNA, 26 bp, Artificial Sequence
  Description of Artificial Sequence: Synthetic oligonucleotide
gctgcaactcctgggctgaatggcca

SEQ ID NO: 113084 - DNA, 27 bp, Artificial Sequence
  Description of Artificial Sequence: Synthetic oligonucleotide
ctgcaactcctgggctgaatggccaga

SEQ ID NO: 113085 - DNA, 28 bp, Artificial Sequence
  Description of Artificial Sequence: Synthetic oligonucleotide
tgcaactcctgggctgaatggccagatg

SEQ ID NO: 113086 - DNA, 27 bp, Artificial Sequence
  Description of Artificial Sequence: Synthetic oligonucleotide
gcaactcctgggctgaatggccagatg

SEQ ID NO: 113087 - DNA, 27 bp, Artificial Sequence
  Description of Artificial Sequence: Synthetic oligonucleotide
caactcctgggctgaatggccagatgc

SEQ ID NO: 113088 - DNA, 27 bp, Artificial Sequence
  Description of Artificial Sequence: Synthetic oligonucleotide
aactcctgggctgaatggccagatgcc

SEQ ID NO: 113089 - DNA, 27 bp, Artificial Sequence
  Description of Artificial Sequence: Synthetic oligonucleotide
actcctgggctgaatggccagatgcca

SEQ ID NO: 113090 - DNA, 26 bp, Artificial Sequence
  Description of Artificial Sequence: Synthetic oligonucleotide
ctcctgggctgaatggccagatgcca

SEQ ID NO: 113091 - DNA, 26 bp, Artificial Sequence
  Description of Artificial Sequence: Synthetic oligonucleotide
tcctgggctgaatggccagatgccag

SEQ ID NO: 113092 - DNA, 25 bp, Artificial Sequence
  Description of Artificial Sequence: Synthetic oligonucleotide
cctgggctgaatggccagatgccag

SEQ ID NO: 113093 - DNA, 26 bp, Artificial Sequence
  Description of Artificial Sequence: Synthetic oligonucleotide
ctgggctgaatggccagatgccagca

SEQ ID NO: 113094 - DNA, 26 bp, Artificial Sequence
  Description of Artificial Sequence: Synthetic oligonucleotide
tgggctgaatggccagatgccagcag

SEQ ID NO: 113095 - DNA, 25 bp, Artificial Sequence
  Description of Artificial Sequence: Synthetic oligonucleotide
gggctgaatggccagatgccagcag

SEQ ID NO: 113096 - DNA, 25 bp, Artificial Sequence
  Description of Artificial Sequence: Synthetic oligonucleotide
ggctgaatggccagatgccagcagc

SEQ ID NO: 113097 - DNA, 25 bp, Artificial Sequence
  Description of Artificial Sequence: Synthetic oligonucleotide
gctgaatggccagatgccagcagcc

SEQ ID NO: 113098 - DNA, 27 bp, Artificial Sequence
  Description of Artificial Sequence: Synthetic oligonucleotide
ctgaatggccagatgccagcagcccaa

SEQ ID NO: 113099 - DNA, 27 bp, Artificial Sequence
  Description of Artificial Sequence: Synthetic oligonucleotide
tgaatggccagatgccagcagcccaag

SEQ ID NO: 113100 - DNA, 27 bp, Artificial Sequence
  Description of Artificial Sequence: Synthetic oligonucleotide
gaatggccagatgccagcagcccaaga

SEQ ID NO: 113101 - DNA, 28 bp, Artificial Sequence
  Description of Artificial Sequence: Synthetic oligonucleotide
aatggccagatgccagcagcccaagaag

SEQ ID NO: 113102 - DNA, 27 bp, Artificial Sequence
  Description of Artificial Sequence: Synthetic oligonucleotide
atggccagatgccagcagcccaagaag

SEQ ID NO: 113103 - DNA, 26 bp, Artificial Sequence
  Description of Artificial Sequence: Synthetic oligonucleotide
tggccagatgccagcagcccaagaag

SEQ ID NO: 113104 - DNA, 25 bp, Artificial Sequence
  Description of Artificial Sequence: Synthetic oligonucleotide
ggccagatgccagcagcccaagaag

SEQ ID NO: 113105 - DNA, 25 bp, Artificial Sequence
  Description of Artificial Sequence: Synthetic oligonucleotide
gccagatgccagcagcccaagaagg

SEQ ID NO: 113106 - DNA, 25 bp, Artificial Sequence
  Description of Artificial Sequence: Synthetic oligonucleotide
ccagatgccagcagcccaagaaggg

SEQ ID NO: 113107 - DNA, 25 bp, Artificial Sequence
  Description of Artificial Sequence: Synthetic oligonucleotide
cagatgccagcagcccaagaagggg

SEQ ID NO: 113108 - DNA, 25 bp, Artificial Sequence
  Description of Artificial Sequence: Synthetic oligonucleotide
agatgccagcagcccaagaaggggc

SEQ ID NO: 113109 - DNA, 24 bp, Artificial Sequence
  Description of Artificial Sequence: Synthetic oligonucleotide
gatgccagcagcccaagaaggggc

SEQ ID NO: 113110 - DNA, 24 bp, Artificial Sequence
  Description of Artificial Sequence: Synthetic oligonucleotide
atgccagcagcccaagaaggggcc

SEQ ID NO: 113111 - DNA, 23 bp, Artificial Sequence
  Description of Artificial Sequence: Synthetic oligonucleotide
tgccagcagcccaagaaggggcc

SEQ ID NO: 113112 - DNA, 22 bp, Artificial Sequence
  Description of Artificial Sequence: Synthetic oligonucleotide
gccagcagcccaagaaggggcc

SEQ ID NO: 113113 - DNA, 23 bp, Artificial Sequence
  Description of Artificial Sequence: Synthetic oligonucleotide
ccagcagcccaagaaggggccgt

SEQ ID NO: 113114 - DNA, 23 bp, Artificial Sequence
  Description of Artificial Sequence: Synthetic oligonucleotide
cagcagcccaagaaggggccgtg

SEQ ID NO: 113115 - DNA, 23 bp, Artificial Sequence
  Description of Artificial Sequence: Synthetic oligonucleotide
agcagcccaagaaggggccgtgg

SEQ ID NO: 113116 - DNA, 22 bp, Artificial Sequence
  Description of Artificial Sequence: Synthetic oligonucleotide
gcagcccaagaaggggccgtgg

SEQ ID NO: 113117 - DNA, 26 bp, Artificial Sequence
  Description of Artificial Sequence: Synthetic oligonucleotide
cagcccaagaaggggccgtggcattt

SEQ ID NO: 113118 - DNA, 26 bp, Artificial Sequence
  Description of Artificial Sequence: Synthetic oligonucleotide
agcccaagaaggggccgtggcatttg

SEQ ID NO: 113119 - DNA, 25 bp, Artificial Sequence
  Description of Artificial Sequence: Synthetic oligonucleotide
gcccaagaaggggccgtggcatttg

SEQ ID NO: 113120 - DNA, 26 bp, Artificial Sequence
  Description of Artificial Sequence: Synthetic oligonucleotide
cccaagaaggggccgtggcatttgct

SEQ ID NO: 113121 - DNA, 26 bp, Artificial Sequence
  Description of Artificial Sequence: Synthetic oligonucleotide
ccaagaaggggccgtggcatttgctg

SEQ ID NO: 113122 - DNA, 27 bp, Artificial Sequence
  Description of Artificial Sequence: Synthetic oligonucleotide
caagaaggggccgtggcatttgctgct

SEQ ID NO: 113123 - DNA, 28 bp, Artificial Sequence
  Description of Artificial Sequence: Synthetic oligonucleotide
aagaaggggccgtggcatttgctgcttg

SEQ ID NO: 113124 - DNA, 27 bp, Artificial Sequence
  Description of Artificial Sequence: Synthetic oligonucleotide
agaaggggccgtggcatttgctgcttg

SEQ ID NO: 113125 - DNA, 26 bp, Artificial Sequence
  Description of Artificial Sequence: Synthetic oligonucleotide
gaaggggccgtggcatttgctgcttg

SEQ ID NO: 113126 - DNA, 26 bp, Artificial Sequence
  Description of Artificial Sequence: Synthetic oligonucleotide
aaggggccgtggcatttgctgcttgg

SEQ ID NO: 113127 - DNA, 25 bp, Artificial Sequence
  Description of Artificial Sequence: Synthetic oligonucleotide
aggggccgtggcatttgctgcttgg

SEQ ID NO: 113128 - DNA, 24 bp, Artificial Sequence
  Description of Artificial Sequence: Synthetic oligonucleotide
ggggccgtggcatttgctgcttgg

SEQ ID NO: 113129 - DNA, 26 bp, Artificial Sequence
  Description of Artificial Sequence: Synthetic oligonucleotide
gggccgtggcatttgctgcttgggat

SEQ ID NO: 113130 - DNA, 27 bp, Artificial Sequence
  Description of Artificial Sequence: Synthetic oligonucleotide
ggccgtggcatttgctgcttgggatga

SEQ ID NO: 113131 - DNA, 28 bp, Artificial Sequence
  Description of Artificial Sequence: Synthetic oligonucleotide
gccgtggcatttgctgcttgggatgatg

SEQ ID NO: 113132 - DNA, 30 bp, Artificial Sequence
  Description of Artificial Sequence: Synthetic oligonucleotide
ccgtggcatttgctgcttgggatgatgatg

SEQ ID NO: 113133 - DNA, 31 bp, Artificial Sequence
  Description of Artificial Sequence: Synthetic oligonucleotide
cgtggcatttgctgcttgggatgatgatgag

SEQ ID NO: 113134 - DNA, 31 bp, Artificial Sequence
  Description of Artificial Sequence: Synthetic oligonucleotide
gtggcatttgctgcttgggatgatgatgagc

SEQ ID NO: 113135 - DNA, 31 bp, Artificial Sequence
  Description of Artificial Sequence: Synthetic oligonucleotide
tggcatttgctgcttgggatgatgatgagcc

SEQ ID NO: 113136 - DNA, 30 bp, Artificial Sequence
  Description of Artificial Sequence: Synthetic oligonucleotide
ggcatttgctgcttgggatgatgatgagcc

SEQ ID NO: 113137 - DNA, 32 bp, Artificial Sequence
  Description of Artificial Sequence: Synthetic oligonucleotide
gcatttgctgcttgggatgatgatgagccatg

SEQ ID NO: 113138 - DNA, 32 bp, Artificial Sequence
  Description of Artificial Sequence: Synthetic oligonucleotide
catttgctgcttgggatgatgatgagccatgg

SEQ ID NO: 113139 - DNA, 32 bp, Artificial Sequence
  Description of Artificial Sequence: Synthetic oligonucleotide
atttgctgcttgggatgatgatgagccatggg

SEQ ID NO: 113140 - DNA, 31 bp, Artificial Sequence
  Description of Artificial Sequence: Synthetic oligonucleotide
tttgctgcttgggatgatgatgagccatggg

SEQ ID NO: 113141 - DNA, 30 bp, Artificial Sequence
  Description of Artificial Sequence: Synthetic oligonucleotide
ttgctgcttgggatgatgatgagccatggg

SEQ ID NO: 113142 - DNA, 29 bp, Artificial Sequence
  Description of Artificial Sequence: Synthetic oligonucleotide
tgctgcttgggatgatgatgagccatggg

SEQ ID NO: 113143 - DNA, 28 bp, Artificial Sequence
  Description of Artificial Sequence: Synthetic oligonucleotide
gctgcttgggatgatgatgagccatggg

SEQ ID NO: 113144 - DNA, 28 bp, Artificial Sequence
  Description of Artificial Sequence: Synthetic oligonucleotide
ctgcttgggatgatgatgagccatgggg

SEQ ID NO: 113145 - DNA, 28 bp, Artificial Sequence
  Description of Artificial Sequence: Synthetic oligonucleotide
tgcttgggatgatgatgagccatggggc

SEQ ID NO: 113146 - DNA, 27 bp, Artificial Sequence
  Description of Artificial Sequence: Synthetic oligonucleotide
gcttgggatgatgatgagccatggggc

SEQ ID NO: 113147 - DNA, 27 bp, Artificial Sequence
  Description of Artificial Sequence: Synthetic oligonucleotide
cttgggatgatgatgagccatggggcc

SEQ ID NO: 113148 - DNA, 27 bp, Artificial Sequence
  Description of Artificial Sequence: Synthetic oligonucleotide
ttgggatgatgatgagccatggggccc

SEQ ID NO: 113149 - DNA, 27 bp, Artificial Sequence
  Description of Artificial Sequence: Synthetic oligonucleotide
tgggatgatgatgagccatggggccca

SEQ ID NO: 113150 - DNA, 27 bp, Artificial Sequence
  Description of Artificial Sequence: Synthetic oligonucleotide
gggatgatgatgagccatggggcccat

SEQ ID NO: 113151 - DNA, 27 bp, Artificial Sequence
  Description of Artificial Sequence: Synthetic oligonucleotide
ggatgatgatgagccatggggcccatg

SEQ ID NO: 113152 - DNA, 27 bp, Artificial Sequence
  Description of Artificial Sequence: Synthetic oligonucleotide
gatgatgatgagccatggggcccatgg

SEQ ID NO: 113153 - DNA, 28 bp, Artificial Sequence
  Description of Artificial Sequence: Synthetic oligonucleotide
atgatgatgagccatggggcccatggac

SEQ ID NO: 113154 - DNA, 27 bp, Artificial Sequence
  Description of Artificial Sequence: Synthetic oligonucleotide
tgatgatgagccatggggcccatggac

SEQ ID NO: 113155 - DNA, 26 bp, Artificial Sequence
  Description of Artificial Sequence: Synthetic oligonucleotide
gatgatgagccatggggcccatggac

SEQ ID NO: 113156 - DNA, 26 bp, Artificial Sequence
  Description of Artificial Sequence: Synthetic oligonucleotide
atgatgagccatggggcccatggacc

SEQ ID NO: 113157 - DNA, 25 bp, Artificial Sequence
  Description of Artificial Sequence: Synthetic oligonucleotide
tgatgagccatggggcccatggacc

SEQ ID NO: 113158 - DNA, 24 bp, Artificial Sequence
  Description of Artificial Sequence: Synthetic oligonucleotide
gatgagccatggggcccatggacc

SEQ ID NO: 113159 - DNA, 24 bp, Artificial Sequence
  Description of Artificial Sequence: Synthetic oligonucleotide
atgagccatggggcccatggaccg

SEQ ID NO: 113160 - DNA, 23 bp, Artificial Sequence
  Description of Artificial Sequence: Synthetic oligonucleotide
tgagccatggggcccatggaccg

SEQ ID NO: 113161 - DNA, 22 bp, Artificial Sequence
  Description of Artificial Sequence: Synthetic oligonucleotide
gagccatggggcccatggaccg

SEQ ID NO: 113162 - DNA, 26 bp, Artificial Sequence
  Description of Artificial Sequence: Synthetic oligonucleotide
agccatggggcccatggaccggaaat

SEQ ID NO: 113163 - DNA, 25 bp, Artificial Sequence
  Description of Artificial Sequence: Synthetic oligonucleotide
gccatggggcccatggaccggaaat

SEQ ID NO: 113164 - DNA, 25 bp, Artificial Sequence
  Description of Artificial Sequence: Synthetic oligonucleotide
ccatggggcccatggaccggaaatg

SEQ ID NO: 113165 - DNA, 25 bp, Artificial Sequence
  Description of Artificial Sequence: Synthetic oligonucleotide
catggggcccatggaccggaaatgg

SEQ ID NO: 113166 - DNA, 26 bp, Artificial Sequence
  Description of Artificial Sequence: Synthetic oligonucleotide
atggggcccatggaccggaaatggga

SEQ ID NO: 113167 - DNA, 25 bp, Artificial Sequence
  Description of Artificial Sequence: Synthetic oligonucleotide
tggggcccatggaccggaaatggga

SEQ ID NO: 113168 - DNA, 24 bp, Artificial Sequence
  Description of Artificial Sequence: Synthetic oligonucleotide
ggggcccatggaccggaaatggga

SEQ ID NO: 113169 - DNA, 24 bp, Artificial Sequence
  Description of Artificial Sequence: Synthetic oligonucleotide
gggcccatggaccggaaatgggac

SEQ ID NO: 113170 - DNA, 26 bp, Artificial Sequence
  Description of Artificial Sequence: Synthetic oligonucleotide
ggcccatggaccggaaatgggacctt

SEQ ID NO: 113171 - DNA, 27 bp, Artificial Sequence
  Description of Artificial Sequence: Synthetic oligonucleotide
gcccatggaccggaaatgggaccttct

SEQ ID NO: 113172 - DNA, 27 bp, Artificial Sequence
  Description of Artificial Sequence: Synthetic oligonucleotide
cccatggaccggaaatgggaccttctg

SEQ ID NO: 113173 - DNA, 27 bp, Artificial Sequence
  Description of Artificial Sequence: Synthetic oligonucleotide
ccatggaccggaaatgggaccttctgg

SEQ ID NO: 113174 - DNA, 27 bp, Artificial Sequence
  Description of Artificial Sequence: Synthetic oligonucleotide
catggaccggaaatgggaccttctggc

SEQ ID NO: 113175 - DNA, 28 bp, Artificial Sequence
  Description of Artificial Sequence: Synthetic oligonucleotide
atggaccggaaatgggaccttctggctg

SEQ ID NO: 113176 - DNA, 27 bp, Artificial Sequence
  Description of Artificial Sequence: Synthetic oligonucleotide
tggaccggaaatgggaccttctggctg

SEQ ID NO: 113177 - DNA, 26 bp, Artificial Sequence
  Description of Artificial Sequence: Synthetic oligonucleotide
ggaccggaaatgggaccttctggctg

SEQ ID NO: 113178 - DNA, 26 bp, Artificial Sequence
  Description of Artificial Sequence: Synthetic oligonucleotide
gaccggaaatgggaccttctggctgc

SEQ ID NO: 113179 - DNA, 27 bp, Artificial Sequence
  Description of Artificial Sequence: Synthetic oligonucleotide
accggaaatgggaccttctggctgcct

SEQ ID NO: 113180 - DNA, 27 bp, Artificial Sequence
  Description of Artificial Sequence: Synthetic oligonucleotide
ccggaaatgggaccttctggctgccta

SEQ ID NO: 113181 - DNA, 27 bp, Artificial Sequence
  Description of Artificial Sequence: Synthetic oligonucleotide
cggaaatgggaccttctggctgcctac

SEQ ID NO: 113182 - DNA, 28 bp, Artificial Sequence
  Description of Artificial Sequence: Synthetic oligonucleotide
ggaaatgggaccttctggctgcctacag

SEQ ID NO: 113183 - DNA, 30 bp, Artificial Sequence
  Description of Artificial Sequence: Synthetic oligonucleotide
gaaatgggaccttctggctgcctacagttc

SEQ ID NO: 113184 - DNA, 32 bp, Artificial Sequence
  Description of Artificial Sequence: Synthetic oligonucleotide
aaatgggaccttctggctgcctacagttcaac

SEQ ID NO: 113185 - DNA, 31 bp, Artificial Sequence
  Description of Artificial Sequence: Synthetic oligonucleotide
aatgggaccttctggctgcctacagttcaac

SEQ ID NO: 113186 - DNA, 30 bp, Artificial Sequence
  Description of Artificial Sequence: Synthetic oligonucleotide
atgggaccttctggctgcctacagttcaac

SEQ ID NO: 113187 - DNA, 29 bp, Artificial Sequence
  Description of Artificial Sequence: Synthetic oligonucleotide
tgggaccttctggctgcctacagttcaac

SEQ ID NO: 113188 - DNA, 28 bp, Artificial Sequence
  Description of Artificial Sequence: Synthetic oligonucleotide
gggaccttctggctgcctacagttcaac

SEQ ID NO: 113189 - DNA, 28 bp, Artificial Sequence
  Description of Artificial Sequence: Synthetic oligonucleotide
ggaccttctggctgcctacagttcaacc

SEQ ID NO: 113190 - DNA, 28 bp, Artificial Sequence
  Description of Artificial Sequence: Synthetic oligonucleotide
gaccttctggctgcctacagttcaaccc

SEQ ID NO: 113191 - DNA, 31 bp, Artificial Sequence
  Description of Artificial Sequence: Synthetic oligonucleotide
accttctggctgcctacagttcaaccctttc

SEQ ID NO: 113192 - DNA, 30 bp, Artificial Sequence
  Description of Artificial Sequence: Synthetic oligonucleotide
ccttctggctgcctacagttcaaccctttc

SEQ ID NO: 113193 - DNA, 31 bp, Artificial Sequence
  Description of Artificial Sequence: Synthetic oligonucleotide
cttctggctgcctacagttcaaccctttcag

SEQ ID NO: 113194 - DNA, 31 bp, Artificial Sequence
  Description of Artificial Sequence: Synthetic oligonucleotide
ttctggctgcctacagttcaaccctttcagg

SEQ ID NO: 113195 - DNA, 30 bp, Artificial Sequence
  Description of Artificial Sequence: Synthetic oligonucleotide
tctggctgcctacagttcaaccctttcagg

SEQ ID NO: 113196 - DNA, 29 bp, Artificial Sequence
  Description of Artificial Sequence: Synthetic oligonucleotide
ctggctgcctacagttcaaccctttcagg

SEQ ID NO: 113197 - DNA, 30 bp, Artificial Sequence
  Description of Artificial Sequence: Synthetic oligonucleotide
tggctgcctacagttcaaccctttcaggag

SEQ ID NO: 113198 - DNA, 29 bp, Artificial Sequence
  Description of Artificial Sequence: Synthetic oligonucleotide
ggctgcctacagttcaaccctttcaggag

SEQ ID NO: 113199 - DNA, 29 bp, Artificial Sequence
  Description of Artificial Sequence: Synthetic oligonucleotide
gctgcctacagttcaaccctttcaggagg

SEQ ID NO: 113200 - DNA, 29 bp, Artificial Sequence
  Description of Artificial Sequence: Synthetic oligonucleotide
ctgcctacagttcaaccctttcaggaggg

SEQ ID NO: 113201 - DNA, 29 bp, Artificial Sequence
  Description of Artificial Sequence: Synthetic oligonucleotide
tgcctacagttcaaccctttcaggagggc

SEQ ID NO: 113202 - DNA, 28 bp, Artificial Sequence
  Description of Artificial Sequence: Synthetic oligonucleotide
gcctacagttcaaccctttcaggagggc

SEQ ID NO: 113203 - DNA, 29 bp, Artificial Sequence
  Description of Artificial Sequence: Synthetic oligonucleotide
cctacagttcaaccctttcaggagggcac

SEQ ID NO: 113204 - DNA, 29 bp, Artificial Sequence
  Description of Artificial Sequence: Synthetic oligonucleotide
ctacagttcaaccctttcaggagggcacc

SEQ ID NO: 113205 - DNA, 32 bp, Artificial Sequence
  Description of Artificial Sequence: Synthetic oligonucleotide
tacagttcaaccctttcaggagggcacctatc

SEQ ID NO: 113206 - DNA, 31 bp, Artificial Sequence
  Description of Artificial Sequence: Synthetic oligonucleotide
acagttcaaccctttcaggagggcacctatc

SEQ ID NO: 113207 - DNA, 30 bp, Artificial Sequence
  Description of Artificial Sequence: Synthetic oligonucleotide
cagttcaaccctttcaggagggcacctatc

SEQ ID NO: 113208 - DNA, 31 bp, Artificial Sequence
  Description of Artificial Sequence: Synthetic oligonucleotide
agttcaaccctttcaggagggcacctatctg

SEQ ID NO: 113209 - DNA, 30 bp, Artificial Sequence
  Description of Artificial Sequence: Synthetic oligonucleotide
gttcaaccctttcaggagggcacctatctg

SEQ ID NO: 113210 - DNA, 30 bp, Artificial Sequence
  Description of Artificial Sequence: Synthetic oligonucleotide
ttcaaccctttcaggagggcacctatctgg

SEQ ID NO: 113211 - DNA, 29 bp, Artificial Sequence
  Description of Artificial Sequence: Synthetic oligonucleotide
tcaaccctttcaggagggcacctatctgg

SEQ ID NO: 113212 - DNA, 28 bp, Artificial Sequence
  Description of Artificial Sequence: Synthetic oligonucleotide
caaccctttcaggagggcacctatctgg

SEQ ID NO: 113213 - DNA, 28 bp, Artificial Sequence
  Description of Artificial Sequence: Synthetic oligonucleotide
aaccctttcaggagggcacctatctggc

SEQ ID NO: 113214 - DNA, 27 bp, Artificial Sequence
  Description of Artificial Sequence: Synthetic oligonucleotide
accctttcaggagggcacctatctggc

SEQ ID NO: 113215 - DNA, 26 bp, Artificial Sequence
  Description of Artificial Sequence: Synthetic oligonucleotide
ccctttcaggagggcacctatctggc

SEQ ID NO: 113216 - DNA, 27 bp, Artificial Sequence
  Description of Artificial Sequence: Synthetic oligonucleotide
cctttcaggagggcacctatctggcca

SEQ ID NO: 113217 - DNA, 27 bp, Artificial Sequence
  Description of Artificial Sequence: Synthetic oligonucleotide
ctttcaggagggcacctatctggccac

SEQ ID NO: 113218 - DNA, 27 bp, Artificial Sequence
  Description of Artificial Sequence: Synthetic oligonucleotide
tttcaggagggcacctatctggccacc

SEQ ID NO: 113219 - DNA, 27 bp, Artificial Sequence
  Description of Artificial Sequence: Synthetic oligonucleotide
ttcaggagggcacctatctggccacca

SEQ ID NO: 113220 - DNA, 27 bp, Artificial Sequence
  Description of Artificial Sequence: Synthetic oligonucleotide
tcaggagggcacctatctggccaccat

SEQ ID NO: 113221 - DNA, 27 bp, Artificial Sequence
  Description of Artificial Sequence: Synthetic oligonucleotide
caggagggcacctatctggccaccata

SEQ ID NO: 113222 - DNA, 27 bp, Artificial Sequence
  Description of Artificial Sequence: Synthetic oligonucleotide
aggagggcacctatctggccaccatac

SEQ ID NO: 113223 - DNA, 27 bp, Artificial Sequence
  Description of Artificial Sequence: Synthetic oligonucleotide
ggagggcacctatctggccaccataca

SEQ ID NO: 113224 - DNA, 27 bp, Artificial Sequence
  Description of Artificial Sequence: Synthetic oligonucleotide
gagggcacctatctggccaccatacac

SEQ ID NO: 113225 - DNA, 27 bp, Artificial Sequence
  Description of Artificial Sequence: Synthetic oligonucleotide
agggcacctatctggccaccatacacc

SEQ ID NO: 113226 - DNA, 27 bp, Artificial Sequence
  Description of Artificial Sequence: Synthetic oligonucleotide
gggcacctatctggccaccatacacct

SEQ ID NO: 113227 - DNA, 27 bp, Artificial Sequence
  Description of Artificial Sequence: Synthetic oligonucleotide
ggcacctatctggccaccatacacctg

SEQ ID NO: 113228 - DNA, 27 bp, Artificial Sequence
  Description of Artificial Sequence: Synthetic oligonucleotide
gcacctatctggccaccatacacctgc

SEQ ID NO: 113229 - DNA, 27 bp, Artificial Sequence
  Description of Artificial Sequence: Synthetic oligonucleotide
cacctatctggccaccatacacctgcc

SEQ ID NO: 113230 - DNA, 30 bp, Artificial Sequence
  Description of Artificial Sequence: Synthetic oligonucleotide
acctatctggccaccatacacctgccatac

SEQ ID NO: 113231 - DNA, 29 bp, Artificial Sequence
  Description of Artificial Sequence: Synthetic oligonucleotide
cctatctggccaccatacacctgccatac

SEQ ID NO: 113232 - DNA, 29 bp, Artificial Sequence
  Description of Artificial Sequence: Synthetic oligonucleotide
ctatctggccaccatacacctgccatacc

SEQ ID NO: 113233 - DNA, 30 bp, Artificial Sequence
  Description of Artificial Sequence: Synthetic oligonucleotide
tatctggccaccatacacctgccatacctg

SEQ ID NO: 113234 - DNA, 29 bp, Artificial Sequence
  Description of Artificial Sequence: Synthetic oligonucleotide
atctggccaccatacacctgccatacctg

SEQ ID NO: 113235 - DNA, 28 bp, Artificial Sequence
  Description of Artificial Sequence: Synthetic oligonucleotide
tctggccaccatacacctgccatacctg

SEQ ID NO: 113236 - DNA, 27 bp, Artificial Sequence
  Description of Artificial Sequence: Synthetic oligonucleotide
ctggccaccatacacctgccatacctg

SEQ ID NO: 113237 - DNA, 27 bp, Artificial Sequence
  Description of Artificial Sequence: Synthetic oligonucleotide
tggccaccatacacctgccatacctgc

SEQ ID NO: 113238 - DNA, 27 bp, Artificial Sequence
  Description of Artificial Sequence: Synthetic oligonucleotide
ggccaccatacacctgccatacctgca

SEQ ID NO: 113239 - DNA, 28 bp, Artificial Sequence
  Description of Artificial Sequence: Synthetic oligonucleotide
gccaccatacacctgccatacctgcaag

SEQ ID NO: 113240 - DNA, 28 bp, Artificial Sequence
  Description of Artificial Sequence: Synthetic oligonucleotide
ccaccatacacctgccatacctgcaagg

SEQ ID NO: 113241 - DNA, 29 bp, Artificial Sequence
  Description of Artificial Sequence: Synthetic oligonucleotide
caccatacacctgccatacctgcaaggac

SEQ ID NO: 113242 - DNA, 30 bp, Artificial Sequence
  Description of Artificial Sequence: Synthetic oligonucleotide
accatacacctgccatacctgcaaggacag

SEQ ID NO: 113243 - DNA, 29 bp, Artificial Sequence
  Description of Artificial Sequence: Synthetic oligonucleotide
ccatacacctgccatacctgcaaggacag

SEQ ID NO: 113244 - DNA, 29 bp, Artificial Sequence
  Description of Artificial Sequence: Synthetic oligonucleotide
catacacctgccatacctgcaaggacagg

SEQ ID NO: 113245 - DNA, 30 bp, Artificial Sequence
  Description of Artificial Sequence: Synthetic oligonucleotide
atacacctgccatacctgcaaggacaggtc

SEQ ID NO: 113246 - DNA, 29 bp, Artificial Sequence
  Description of Artificial Sequence: Synthetic oligonucleotide
tacacctgccatacctgcaaggacaggtc

SEQ ID NO: 113247 - DNA, 28 bp, Artificial Sequence
  Description of Artificial Sequence: Synthetic oligonucleotide
acacctgccatacctgcaaggacaggtc

SEQ ID NO: 113248 - DNA, 27 bp, Artificial Sequence
  Description of Artificial Sequence: Synthetic oligonucleotide
cacctgccatacctgcaaggacaggtc

SEQ ID NO: 113249 - DNA, 28 bp, Artificial Sequence
  Description of Artificial Sequence: Synthetic oligonucleotide
acctgccatacctgcaaggacaggtcac

SEQ ID NO: 113250 - DNA, 27 bp, Artificial Sequence
  Description of Artificial Sequence: Synthetic oligonucleotide
cctgccatacctgcaaggacaggtcac

SEQ ID NO: 113251 - DNA, 27 bp, Artificial Sequence
  Description of Artificial Sequence: Synthetic oligonucleotide
ctgccatacctgcaaggacaggtcacc

SEQ ID NO: 113252 - DNA, 27 bp, Artificial Sequence
  Description of Artificial Sequence: Synthetic oligonucleotide
tgccatacctgcaaggacaggtcaccc

SEQ ID NO: 113253 - DNA, 27 bp, Artificial Sequence
  Description of Artificial Sequence: Synthetic oligonucleotide
gccatacctgcaaggacaggtcaccct

SEQ ID NO: 113254 - DNA, 27 bp, Artificial Sequence
  Description of Artificial Sequence: Synthetic oligonucleotide
ccatacctgcaaggacaggtcaccctg

SEQ ID NO: 113255 - DNA, 27 bp, Artificial Sequence
  Description of Artificial Sequence: Synthetic oligonucleotide
catacctgcaaggacaggtcaccctgg

SEQ ID NO: 113256 - DNA, 28 bp, Artificial Sequence
  Description of Artificial Sequence: Synthetic oligonucleotide
atacctgcaaggacaggtcaccctggag

SEQ ID NO: 113257 - DNA, 27 bp, Artificial Sequence
  Description of Artificial Sequence: Synthetic oligonucleotide
tacctgcaaggacaggtcaccctggag

SEQ ID NO: 113258 - DNA, 26 bp, Artificial Sequence
  Description of Artificial Sequence: Synthetic oligonucleotide
acctgcaaggacaggtcaccctggag

SEQ ID NO: 113259 - DNA, 25 bp, Artificial Sequence
  Description of Artificial Sequence: Synthetic oligonucleotide
cctgcaaggacaggtcaccctggag

SEQ ID NO: 113260 - DNA, 27 bp, Artificial Sequence
  Description of Artificial Sequence: Synthetic oligonucleotide
ctgcaaggacaggtcaccctggagctt

SEQ ID NO: 113261 - DNA, 27 bp, Artificial Sequence
  Description of Artificial Sequence: Synthetic oligonucleotide
tgcaaggacaggtcaccctggagcttg

SEQ ID NO: 113262 - DNA, 26 bp, Artificial Sequence
  Description of Artificial Sequence: Synthetic oligonucleotide
gcaaggacaggtcaccctggagcttg

SEQ ID NO: 113263 - DNA, 27 bp, Artificial Sequence
  Description of Artificial Sequence: Synthetic oligonucleotide
caaggacaggtcaccctggagcttgct

SEQ ID NO: 113264 - DNA, 27 bp, Artificial Sequence
  Description of Artificial Sequence: Synthetic oligonucleotide
aaggacaggtcaccctggagcttgctg

SEQ ID NO: 113265 - DNA, 27 bp, Artificial Sequence
  Description of Artificial Sequence: Synthetic oligonucleotide
aggacaggtcaccctggagcttgctgt

SEQ ID NO: 113266 - DNA, 26 bp, Artificial Sequence
  Description of Artificial Sequence: Synthetic oligonucleotide
ggacaggtcaccctggagcttgctgt

SEQ ID NO: 113267 - DNA, 27 bp, Artificial Sequence
  Description of Artificial Sequence: Synthetic oligonucleotide
gacaggtcaccctggagcttgctgtgt

SEQ ID NO: 113268 - DNA, 28 bp, Artificial Sequence
  Description of Artificial Sequence: Synthetic oligonucleotide
acaggtcaccctggagcttgctgtgtac

SEQ ID NO: 113269 - DNA, 27 bp, Artificial Sequence
  Description of Artificial Sequence: Synthetic oligonucleotide
caggtcaccctggagcttgctgtgtac

SEQ ID NO: 113270 - DNA, 30 bp, Artificial Sequence
  Description of Artificial Sequence: Synthetic oligonucleotide
aggtcaccctggagcttgctgtgtacaaac

SEQ ID NO: 113271 - DNA, 29 bp, Artificial Sequence
  Description of Artificial Sequence: Synthetic oligonucleotide
ggtcaccctggagcttgctgtgtacaaac

SEQ ID NO: 113272 - DNA, 29 bp, Artificial Sequence
  Description of Artificial Sequence: Synthetic oligonucleotide
gtcaccctggagcttgctgtgtacaaacc

SEQ ID NO: 113273 - DNA, 29 bp, Artificial Sequence
  Description of Artificial Sequence: Synthetic oligonucleotide
tcaccctggagcttgctgtgtacaaaccc

SEQ ID NO: 113274 - DNA, 28 bp, Artificial Sequence
  Description of Artificial Sequence: Synthetic oligonucleotide
caccctggagcttgctgtgtacaaaccc

SEQ ID NO: 113275 - DNA, 28 bp, Artificial Sequence
  Description of Artificial Sequence: Synthetic oligonucleotide
accctggagcttgctgtgtacaaacccc

SEQ ID NO: 113276 - DNA, 27 bp, Artificial Sequence
  Description of Artificial Sequence: Synthetic oligonucleotide
ccctggagcttgctgtgtacaaacccc

SEQ ID NO: 113277 - DNA, 27 bp, Artificial Sequence
  Description of Artificial Sequence: Synthetic oligonucleotide
cctggagcttgctgtgtacaaaccccc

SEQ ID NO: 113278 - DNA, 27 bp, Artificial Sequence
  Description of Artificial Sequence: Synthetic oligonucleotide
ctggagcttgctgtgtacaaacccccc

SEQ ID NO: 113279 - DNA, 30 bp, Artificial Sequence
  Description of Artificial Sequence: Synthetic oligonucleotide
tggagcttgctgtgtacaaaccccccaaag

SEQ ID NO: 113280 - DNA, 29 bp, Artificial Sequence
  Description of Artificial Sequence: Synthetic oligonucleotide
ggagcttgctgtgtacaaaccccccaaag

SEQ ID NO: 113281 - DNA, 30 bp, Artificial Sequence
  Description of Artificial Sequence: Synthetic oligonucleotide
gagcttgctgtgtacaaaccccccaaagtg

SEQ ID NO: 113282 - DNA, 31 bp, Artificial Sequence
  Description of Artificial Sequence: Synthetic oligonucleotide
agcttgctgtgtacaaaccccccaaagtgtc

SEQ ID NO: 113283 - DNA, 30 bp, Artificial Sequence
  Description of Artificial Sequence: Synthetic oligonucleotide
gcttgctgtgtacaaaccccccaaagtgtc

SEQ ID NO: 113284 - DNA, 30 bp, Artificial Sequence
  Description of Artificial Sequence: Synthetic oligonucleotide
cttgctgtgtacaaaccccccaaagtgtcc

SEQ ID NO: 113285 - DNA, 30 bp, Artificial Sequence
  Description of Artificial Sequence: Synthetic oligonucleotide
ttgctgtgtacaaaccccccaaagtgtccc

SEQ ID NO: 113286 - DNA, 29 bp, Artificial Sequence
  Description of Artificial Sequence: Synthetic oligonucleotide
tgctgtgtacaaaccccccaaagtgtccc

SEQ ID NO: 113287 - DNA, 28 bp, Artificial Sequence
  Description of Artificial Sequence: Synthetic oligonucleotide
gctgtgtacaaaccccccaaagtgtccc

SEQ ID NO: 113288 - DNA, 29 bp, Artificial Sequence
  Description of Artificial Sequence: Synthetic oligonucleotide
ctgtgtacaaaccccccaaagtgtccctg

SEQ ID NO: 113289 - DNA, 31 bp, Artificial Sequence
  Description of Artificial Sequence: Synthetic oligonucleotide
tgtgtacaaaccccccaaagtgtccctgatg

SEQ ID NO: 113290 - DNA, 30 bp, Artificial Sequence
  Description of Artificial Sequence: Synthetic oligonucleotide
gtgtacaaaccccccaaagtgtccctgatg

SEQ ID NO: 113291 - DNA, 30 bp, Artificial Sequence
  Description of Artificial Sequence: Synthetic oligonucleotide
tgtacaaaccccccaaagtgtccctgatgc

SEQ ID NO: 113292 - DNA, 29 bp, Artificial Sequence
  Description of Artificial Sequence: Synthetic oligonucleotide
gtacaaaccccccaaagtgtccctgatgc

SEQ ID NO: 113293 - DNA, 29 bp, Artificial Sequence
  Description of Artificial Sequence: Synthetic oligonucleotide
tacaaaccccccaaagtgtccctgatgcc

SEQ ID NO: 113294 - DNA, 28 bp, Artificial Sequence
  Description of Artificial Sequence: Synthetic oligonucleotide
acaaaccccccaaagtgtccctgatgcc

SEQ ID NO: 113295 - DNA, 27 bp, Artificial Sequence
  Description of Artificial Sequence: Synthetic oligonucleotide
caaaccccccaaagtgtccctgatgcc

SEQ ID NO: 113296 - DNA, 28 bp, Artificial Sequence
  Description of Artificial Sequence: Synthetic oligonucleotide
aaaccccccaaagtgtccctgatgccag

SEQ ID NO: 113297 - DNA, 27 bp, Artificial Sequence
  Description of Artificial Sequence: Synthetic oligonucleotide
aaccccccaaagtgtccctgatgccag

SEQ ID NO: 113298 - DNA, 26 bp, Artificial Sequence
  Description of Artificial Sequence: Synthetic oligonucleotide
accccccaaagtgtccctgatgccag

SEQ ID NO: 113299 - DNA, 25 bp, Artificial Sequence
  Description of Artificial Sequence: Synthetic oligonucleotide
ccccccaaagtgtccctgatgccag

SEQ ID NO: 113300 - DNA, 27 bp, Artificial Sequence
  Description of Artificial Sequence: Synthetic oligonucleotide
cccccaaagtgtccctgatgccagcaa

SEQ ID NO: 113301 - DNA, 27 bp, Artificial Sequence
  Description of Artificial Sequence: Synthetic oligonucleotide
ccccaaagtgtccctgatgccagcaac

SEQ ID NO: 113302 - DNA, 27 bp, Artificial Sequence
  Description of Artificial Sequence: Synthetic oligonucleotide
cccaaagtgtccctgatgccagcaacc

SEQ ID NO: 113303 - DNA, 27 bp, Artificial Sequence
  Description of Artificial Sequence: Synthetic oligonucleotide
ccaaagtgtccctgatgccagcaaccc

SEQ ID NO: 113304 - DNA, 29 bp, Artificial Sequence
  Description of Artificial Sequence: Synthetic oligonucleotide
caaagtgtccctgatgccagcaacccttg

SEQ ID NO: 113305 - DNA, 29 bp, Artificial Sequence
  Description of Artificial Sequence: Synthetic oligonucleotide
aaagtgtccctgatgccagcaacccttgc

SEQ ID NO: 113306 - DNA, 28 bp, Artificial Sequence
  Description of Artificial Sequence: Synthetic oligonucleotide
aagtgtccctgatgccagcaacccttgc

SEQ ID NO: 113307 - DNA, 27 bp, Artificial Sequence
  Description of Artificial Sequence: Synthetic oligonucleotide
agtgtccctgatgccagcaacccttgc

SEQ ID NO: 113308 - DNA, 27 bp, Artificial Sequence
  Description of Artificial Sequence: Synthetic oligonucleotide
gtgtccctgatgccagcaacccttgca

SEQ ID NO: 113309 - DNA, 27 bp, Artificial Sequence
  Description of Artificial Sequence: Synthetic oligonucleotide
tgtccctgatgccagcaacccttgcac

SEQ ID NO: 113310 - DNA, 26 bp, Artificial Sequence
  Description of Artificial Sequence: Synthetic oligonucleotide
gtccctgatgccagcaacccttgcac

SEQ ID NO: 113311 - DNA, 26 bp, Artificial Sequence
  Description of Artificial Sequence: Synthetic oligonucleotide
tccctgatgccagcaacccttgcacg

SEQ ID NO: 113312 - DNA, 25 bp, Artificial Sequence
  Description of Artificial Sequence: Synthetic oligonucleotide
ccctgatgccagcaacccttgcacg

SEQ ID NO: 113313 - DNA, 25 bp, Artificial Sequence
  Description of Artificial Sequence: Synthetic oligonucleotide
cctgatgccagcaacccttgcacgg

SEQ ID NO: 113314 - DNA, 25 bp, Artificial Sequence
  Description of Artificial Sequence: Synthetic oligonucleotide
ctgatgccagcaacccttgcacggg

SEQ ID NO: 113315 - DNA, 25 bp, Artificial Sequence
  Description of Artificial Sequence: Synthetic oligonucleotide
tgatgccagcaacccttgcacgggc

SEQ ID NO: 113316 - DNA, 24 bp, Artificial Sequence
  Description of Artificial Sequence: Synthetic oligonucleotide
gatgccagcaacccttgcacgggc

SEQ ID NO: 113317 - DNA, 24 bp, Artificial Sequence
  Description of Artificial Sequence: Synthetic oligonucleotide
atgccagcaacccttgcacgggcc

SEQ ID NO: 113318 - DNA, 23 bp, Artificial Sequence
  Description of Artificial Sequence: Synthetic oligonucleotide
tgccagcaacccttgcacgggcc

SEQ ID NO: 113319 - DNA, 22 bp, Artificial Sequence
  Description of Artificial Sequence: Synthetic oligonucleotide
gccagcaacccttgcacgggcc

SEQ ID NO: 113320 - DNA, 22 bp, Artificial Sequence
  Description of Artificial Sequence: Synthetic oligonucleotide
ccagcaacccttgcacgggccg

SEQ ID NO: 113321 - DNA, 22 bp, Artificial Sequence
  Description of Artificial Sequence: Synthetic oligonucleotide
cagcaacccttgcacgggccgc

SEQ ID NO: 113322 - DNA, 22 bp, Artificial Sequence
  Description of Artificial Sequence: Synthetic oligonucleotide
agcaacccttgcacgggccgcc

SEQ ID NO: 113323 - DNA, 21 bp, Artificial Sequence
  Description of Artificial Sequence: Synthetic oligonucleotide
gcaacccttgcacgggccgcc

SEQ ID NO: 113324 - DNA, 21 bp, Artificial Sequence
  Description of Artificial Sequence: Synthetic oligonucleotide
caacccttgcacgggccgccc

SEQ ID NO: 113325 - DNA, 22 bp, Artificial Sequence
  Description of Artificial Sequence: Synthetic oligonucleotide
aacccttgcacgggccgcccca

SEQ ID NO: 113326 - DNA, 21 bp, Artificial Sequence
  Description of Artificial Sequence: Synthetic oligonucleotide
acccttgcacgggccgcccca

SEQ ID NO: 113327 - DNA, 20 bp, Artificial Sequence
  Description of Artificial Sequence: Synthetic oligonucleotide
cccttgcacgggccgcccca

SEQ ID NO: 113328 - DNA, 20 bp, Artificial Sequence
  Description of Artificial Sequence: Synthetic oligonucleotide
ccttgcacgggccgccccag

SEQ ID NO: 113329 - DNA, 20 bp, Artificial Sequence
  Description of Artificial Sequence: Synthetic oligonucleotide
cttgcacgggccgccccagg

SEQ ID NO: 113330 - DNA, 20 bp, Artificial Sequence
  Description of Artificial Sequence: Synthetic oligonucleotide
ttgcacgggccgccccaggg

SEQ ID NO: 113331 - DNA, 20 bp, Artificial Sequence
  Description of Artificial Sequence: Synthetic oligonucleotide
tgcacgggccgccccagggt

SEQ ID NO: 113332 - DNA, 20 bp, Artificial Sequence
  Description of Artificial Sequence: Synthetic oligonucleotide
gcacgggccgccccagggtt

SEQ ID NO: 113333 - DNA, 20 bp, Artificial Sequence
  Description of Artificial Sequence: Synthetic oligonucleotide
cacgggccgccccaggggat

SEQ ID NO: 113334 - DNA, 20 bp, Artificial Sequence
  Description of Artificial Sequence: Synthetic oligonucleotide
acgggccgccccaggggagt

SEQ ID NO: 113335 - DNA, 20 bp, Artificial Sequence
  Description of Artificial Sequence: Synthetic oligonucleotide
cgggccgccccaggggagtt

SEQ ID NO: 113336 - DNA, 20 bp, Artificial Sequence
  Description of Artificial Sequence: Synthetic oligonucleotide
gggccgccccaggggaggtt

SEQ ID NO: 113337 - DNA, 20 bp, Artificial Sequence
  Description of Artificial Sequence: Synthetic oligonucleotide
ggccgccccaggggaggcat

SEQ ID NO: 113338 - DNA, 20 bp, Artificial Sequence
  Description of Artificial Sequence: Synthetic oligonucleotide
gccgccccaggggaggcact

SEQ ID NO: 113339 - DNA, 20 bp, Artificial Sequence
  Description of Artificial Sequence: Synthetic oligonucleotide
ccgccccaggggaggcacct

SEQ ID NO: 113340 - DNA, 20 bp, Artificial Sequence
  Description of Artificial Sequence: Synthetic oligonucleotide
cgccccaggggaggcaccct

SEQ ID NO: 113341 - DNA, 20 bp, Artificial Sequence
  Description of Artificial Sequence: Synthetic oligonucleotide
gccccaggggaggcacccct

SEQ ID NO: 113342 - DNA, 20 bp, Artificial Sequence
  Description of Artificial Sequence: Synthetic oligonucleotide
ccccaggggaggcaccccct

SEQ ID NO: 113343 - DNA, 20 bp, Artificial Sequence
  Description of Artificial Sequence: Synthetic oligonucleotide
cccaggggaggcacccccgt

SEQ ID NO: 113344 - DNA, 23 bp, Artificial Sequence
  Description of Artificial Sequence: Synthetic oligonucleotide
ccaggggaggcacccccggaatt

SEQ ID NO: 113345 - DNA, 23 bp, Artificial Sequence
  Description of Artificial Sequence: Synthetic oligonucleotide
caggggaggcacccccggaattg

SEQ ID NO: 113346 - DNA, 24 bp, Artificial Sequence
  Description of Artificial Sequence: Synthetic oligonucleotide
aggggaggcacccccggaattgct

SEQ ID NO: 113347 - DNA, 23 bp, Artificial Sequence
  Description of Artificial Sequence: Synthetic oligonucleotide
ggggaggcacccccggaattgct

SEQ ID NO: 113348 - DNA, 24 bp, Artificial Sequence
  Description of Artificial Sequence: Synthetic oligonucleotide
gggaggcacccccggaattgctct

SEQ ID NO: 113349 - DNA, 24 bp, Artificial Sequence
  Description of Artificial Sequence: Synthetic oligonucleotide
ggaggcacccccggaattgctctg

SEQ ID NO: 113350 - DNA, 24 bp, Artificial Sequence
  Description of Artificial Sequence: Synthetic oligonucleotide
gaggcacccccggaattgctctgc

SEQ ID NO: 113351 - DNA, 26 bp, Artificial Sequence
  Description of Artificial Sequence: Synthetic oligonucleotide
aggcacccccggaattgctctgcctt

SEQ ID NO: 113352 - DNA, 25 bp, Artificial Sequence
  Description of Artificial Sequence: Synthetic oligonucleotide
ggcacccccggaattgctctgcctt

SEQ ID NO: 113353 - DNA, 26 bp, Artificial Sequence
  Description of Artificial Sequence: Synthetic oligonucleotide
gcacccccggaattgctctgccttgt

SEQ ID NO: 113354 - DNA, 27 bp, Artificial Sequence
  Description of Artificial Sequence: Synthetic oligonucleotide
cacccccggaattgctctgccttgtgt

SEQ ID NO: 113355 - DNA, 27 bp, Artificial Sequence
  Description of Artificial Sequence: Synthetic oligonucleotide
acccccggaattgctctgccttgtgtc

SEQ ID NO: 113356 - DNA, 26 bp, Artificial Sequence
  Description of Artificial Sequence: Synthetic oligonucleotide
cccccggaattgctctgccttgtgtc

SEQ ID NO: 113357 - DNA, 26 bp, Artificial Sequence
  Description of Artificial Sequence: Synthetic oligonucleotide
ccccggaattgctctgccttgtgtcc

SEQ ID NO: 113358 - DNA, 27 bp, Artificial Sequence
  Description of Artificial Sequence: Synthetic oligonucleotide
cccggaattgctctgccttgtgtccca

SEQ ID NO: 113359 - DNA, 27 bp, Artificial Sequence
  Description of Artificial Sequence: Synthetic oligonucleotide
ccggaattgctctgccttgtgtcccac

SEQ ID NO: 113360 - DNA, 29 bp, Artificial Sequence
  Description of Artificial Sequence: Synthetic oligonucleotide
cggaattgctctgccttgtgtcccacttc

SEQ ID NO: 113361 - DNA, 31 bp, Artificial Sequence
  Description of Artificial Sequence: Synthetic oligonucleotide
ggaattgctctgccttgtgtcccacttctac

SEQ ID NO: 113362 - DNA, 31 bp, Artificial Sequence
  Description of Artificial Sequence: Synthetic oligonucleotide
gaattgctctgccttgtgtcccacttctacc

SEQ ID NO: 113363 - DNA, 31 bp, Artificial Sequence
  Description of Artificial Sequence: Synthetic oligonucleotide
aattgctctgccttgtgtcccacttctaccc

SEQ ID NO: 113364 - DNA, 30 bp, Artificial Sequence
  Description of Artificial Sequence: Synthetic oligonucleotide
attgctctgccttgtgtcccacttctaccc

SEQ ID NO: 113365 - DNA, 29 bp, Artificial Sequence
  Description of Artificial Sequence: Synthetic oligonucleotide
ttgctctgccttgtgtcccacttctaccc

SEQ ID NO: 113366 - DNA, 28 bp, Artificial Sequence
  Description of Artificial Sequence: Synthetic oligonucleotide
tgctctgccttgtgtcccacttctaccc

SEQ ID NO: 113367 - DNA, 27 bp, Artificial Sequence
  Description of Artificial Sequence: Synthetic oligonucleotide
gctctgccttgtgtcccacttctaccc

SEQ ID NO: 113368 - DNA, 29 bp, Artificial Sequence
  Description of Artificial Sequence: Synthetic oligonucleotide
ctctgccttgtgtcccacttctacccttc

SEQ ID NO: 113369 - DNA, 30 bp, Artificial Sequence
  Description of Artificial Sequence: Synthetic oligonucleotide
tctgccttgtgtcccacttctacccttctg

SEQ ID NO: 113370 - DNA, 29 bp, Artificial Sequence
  Description of Artificial Sequence: Synthetic oligonucleotide
ctgccttgtgtcccacttctacccttctg

SEQ ID NO: 113371 - DNA, 29 bp, Artificial Sequence
  Description of Artificial Sequence: Synthetic oligonucleotide
tgccttgtgtcccacttctacccttctgg

SEQ ID NO: 113372 - DNA, 28 bp, Artificial Sequence
  Description of Artificial Sequence: Synthetic oligonucleotide
gccttgtgtcccacttctacccttctgg

SEQ ID NO: 113373 - DNA, 28 bp, Artificial Sequence
  Description of Artificial Sequence: Synthetic oligonucleotide
ccttgtgtcccacttctacccttctggg

SEQ ID NO: 113374 - DNA, 28 bp, Artificial Sequence
  Description of Artificial Sequence: Synthetic oligonucleotide
cttgtgtcccacttctacccttctgggg

SEQ ID NO: 113375 - DNA, 28 bp, Artificial Sequence
  Description of Artificial Sequence: Synthetic oligonucleotide
ttgtgtcccacttctacccttctggggg

SEQ ID NO: 113376 - DNA, 27 bp, Artificial Sequence
  Description of Artificial Sequence: Synthetic oligonucleotide
tgtgtcccacttctacccttctggggg

SEQ ID NO: 113377 - DNA, 26 bp, Artificial Sequence
  Description of Artificial Sequence: Synthetic oligonucleotide
gtgtcccacttctacccttctggggg

SEQ ID NO: 113378 - DNA, 26 bp, Artificial Sequence
  Description of Artificial Sequence: Synthetic oligonucleotide
tgtcccacttctacccttctgggggc

SEQ ID NO: 113379 - DNA, 25 bp, Artificial Sequence
  Description of Artificial Sequence: Synthetic oligonucleotide
gtcccacttctacccttctgggggc

SEQ ID NO: 113380 - DNA, 26 bp, Artificial Sequence
  Description of Artificial Sequence: Synthetic oligonucleotide
tcccacttctacccttctgggggcct

SEQ ID NO: 113381 - DNA, 25 bp, Artificial Sequence
  Description of Artificial Sequence: Synthetic oligonucleotide
cccacttctacccttctgggggcct

SEQ ID NO: 113382 - DNA, 25 bp, Artificial Sequence
  Description of Artificial Sequence: Synthetic oligonucleotide
ccacttctacccttctgggggcctg

SEQ ID NO: 113383 - DNA, 26 bp, Artificial Sequence
  Description of Artificial Sequence: Synthetic oligonucleotide
cacttctacccttctgggggcctgga

SEQ ID NO: 113384 - DNA, 26 bp, Artificial Sequence
  Description of Artificial Sequence: Synthetic oligonucleotide
acttctacccttctgggggcctggag

SEQ ID NO: 113385 - DNA, 25 bp, Artificial Sequence
  Description of Artificial Sequence: Synthetic oligonucleotide
cttctacccttctgggggcctggag

SEQ ID NO: 113386 - DNA, 26 bp, Artificial Sequence
  Description of Artificial Sequence: Synthetic oligonucleotide
ttctacccttctgggggcctggaggt

SEQ ID NO: 113387 - DNA, 25 bp, Artificial Sequence
  Description of Artificial Sequence: Synthetic oligonucleotide
tctacccttctgggggcctggaggt

SEQ ID NO: 113388 - DNA, 24 bp, Artificial Sequence
  Description of Artificial Sequence: Synthetic oligonucleotide
ctacccttctgggggcctggaggt

SEQ ID NO: 113389 - DNA, 24 bp, Artificial Sequence
  Description of Artificial Sequence: Synthetic oligonucleotide
tacccttctgggggcctggaggtg

SEQ ID NO: 113390 - DNA, 23 bp, Artificial Sequence
  Description of Artificial Sequence: Synthetic oligonucleotide
acccttctgggggcctggaggtg

SEQ ID NO: 113391 - DNA, 22 bp, Artificial Sequence
  Description of Artificial Sequence: Synthetic oligonucleotide
cccttctgggggcctggaggtg

SEQ ID NO: 113392 - DNA, 23 bp, Artificial Sequence
  Description of Artificial Sequence: Synthetic oligonucleotide
ccttctgggggcctggaggtgga

SEQ ID NO: 113393 - DNA, 24 bp, Artificial Sequence
  Description of Artificial Sequence: Synthetic oligonucleotide
cttctgggggcctggaggtggagt

SEQ ID NO: 113394 - DNA, 24 bp, Artificial Sequence
  Description of Artificial Sequence: Synthetic oligonucleotide
ttctgggggcctggaggtggagtg

SEQ ID NO: 113395 - DNA, 23 bp, Artificial Sequence
  Description of Artificial Sequence: Synthetic oligonucleotide
tctgggggcctggaggtggagtg

SEQ ID NO: 113396 - DNA, 22 bp, Artificial Sequence
  Description of Artificial Sequence: Synthetic oligonucleotide
ctgggggcctggaggtggagtg

SEQ ID NO: 113397 - DNA, 22 bp, Artificial Sequence
  Description of Artificial Sequence: Synthetic oligonucleotide
tgggggcctggaggtggagtgg

SEQ ID NO: 113398 - DNA, 21 bp, Artificial Sequence
  Description of Artificial Sequence: Synthetic oligonucleotide
gggggcctggaggtggagtgg

SEQ ID NO: 113399 - DNA, 23 bp, Artificial Sequence
  Description of Artificial Sequence: Synthetic oligonucleotide
ggggcctggaggtggagtgggaa

SEQ ID NO: 113400 - DNA, 24 bp, Artificial Sequence
  Description of Artificial Sequence: Synthetic oligonucleotide
gggcctggaggtggagtgggaact

SEQ ID NO: 113401 - DNA, 24 bp, Artificial Sequence
  Description of Artificial Sequence: Synthetic oligonucleotide
ggcctggaggtggagtgggaactc

SEQ ID NO: 113402 - DNA, 24 bp, Artificial Sequence
  Description of Artificial Sequence: Synthetic oligonucleotide
gcctggaggtggagtgggaactcc

SEQ ID NO: 113403 - DNA, 24 bp, Artificial Sequence
  Description of Artificial Sequence: Synthetic oligonucleotide
cctggaggtggagtgggaactccg

SEQ ID NO: 113404 - DNA, 24 bp, Artificial Sequence
  Description of Artificial Sequence: Synthetic oligonucleotide
ctggaggtggagtgggaactccgg

SEQ ID NO: 113405 - DNA, 24 bp, Artificial Sequence
  Description of Artificial Sequence: Synthetic oligonucleotide
tggaggtggagtgggaactccggg

SEQ ID NO: 113406 - DNA, 23 bp, Artificial Sequence
  Description of Artificial Sequence: Synthetic oligonucleotide
ggaggtggagtgggaactccggg

SEQ ID NO: 113407 - DNA, 24 bp, Artificial Sequence
  Description of Artificial Sequence: Synthetic oligonucleotide
gaggtggagtgggaactccggggt

SEQ ID NO: 113408 - DNA, 24 bp, Artificial Sequence
  Description of Artificial Sequence: Synthetic oligonucleotide
aggtggagtgggaactccggggtg

SEQ ID NO: 113409 - DNA, 23 bp, Artificial Sequence
  Description of Artificial Sequence: Synthetic oligonucleotide
ggtggagtgggaactccggggtg

SEQ ID NO: 113410 - DNA, 23 bp, Artificial Sequence
  Description of Artificial Sequence: Synthetic oligonucleotide
gtggagtgggaactccggggtgg

SEQ ID NO: 113411 - DNA, 23 bp, Artificial Sequence
  Description of Artificial Sequence: Synthetic oligonucleotide
tggagtgggaactccggggtggc

SEQ ID NO: 113412 - DNA, 22 bp, Artificial Sequence
  Description of Artificial Sequence: Synthetic oligonucleotide
ggagtgggaactccggggtggc

SEQ ID NO: 113413 - DNA, 22 bp, Artificial Sequence
  Description of Artificial Sequence: Synthetic oligonucleotide
gagtgggaactccggggtggcc

SEQ ID NO: 113414 - DNA, 23 bp, Artificial Sequence
  Description of Artificial Sequence: Synthetic oligonucleotide
agtgggaactccggggtggccca

SEQ ID NO: 113415 - DNA, 22 bp, Artificial Sequence
  Description of Artificial Sequence: Synthetic oligonucleotide
gtgggaactccggggtggccca

SEQ ID NO: 113416 - DNA, 22 bp, Artificial Sequence
  Description of Artificial Sequence: Synthetic oligonucleotide
tgggaactccggggtggcccag

SEQ ID NO: 113417 - DNA, 21 bp, Artificial Sequence
  Description of Artificial Sequence: Synthetic oligonucleotide
gggaactccggggtggcccag

SEQ ID NO: 113418 - DNA, 21 bp, Artificial Sequence
  Description of Artificial Sequence: Synthetic oligonucleotide
ggaactccggggtggcccagg

SEQ ID NO: 113419 - DNA, 21 bp, Artificial Sequence
  Description of Artificial Sequence: Synthetic oligonucleotide
gaactccggggtggcccaggg

SEQ ID NO: 113420 - DNA, 21 bp, Artificial Sequence
  Description of Artificial Sequence: Synthetic oligonucleotide
aactccggggtggcccagggg

SEQ ID NO: 113421 - DNA, 20 bp, Artificial Sequence
  Description of Artificial Sequence: Synthetic oligonucleotide
actccggggtggcccagggg

SEQ ID NO: 113422 - DNA, 20 bp, Artificial Sequence
  Description of Artificial Sequence: Synthetic oligonucleotide
ctccggggtggcccaggggt

SEQ ID NO: 113423 - DNA, 20 bp, Artificial Sequence
  Description of Artificial Sequence: Synthetic oligonucleotide
tccggggtggcccagggggt

SEQ ID NO: 113424 - DNA, 20 bp, Artificial Sequence
  Description of Artificial Sequence: Synthetic oligonucleotide
ccggggtggcccagggggtt

SEQ ID NO: 113425 - DNA, 20 bp, Artificial Sequence
  Description of Artificial Sequence: Synthetic oligonucleotide
cggggtggcccagggggctt

SEQ ID NO: 113426 - DNA, 20 bp, Artificial Sequence
  Description of Artificial Sequence: Synthetic oligonucleotide
ggggtggcccagggggcctt

SEQ ID NO: 113427 - DNA, 20 bp, Artificial Sequence
  Description of Artificial Sequence: Synthetic oligonucleotide
gggtggcccagggggccgtt

SEQ ID NO: 113428 - DNA, 20 bp, Artificial Sequence
  Description of Artificial Sequence: Synthetic oligonucleotide
ggtggcccagggggccgctt

SEQ ID NO: 113429 - DNA, 20 bp, Artificial Sequence
  Description of Artificial Sequence: Synthetic oligonucleotide
gtggcccagggggccgctct

SEQ ID NO: 113430 - DNA, 21 bp, Artificial Sequence
  Description of Artificial Sequence: Synthetic oligonucleotide
tggcccagggggccgctctca

SEQ ID NO: 113431 - DNA, 20 bp, Artificial Sequence
  Description of Artificial Sequence: Synthetic oligonucleotide
ggcccagggggccgctctca

SEQ ID NO: 113432 - DNA, 22 bp, Artificial Sequence
  Description of Artificial Sequence: Synthetic oligonucleotide
gcccagggggccgctctcagaa

SEQ ID NO: 113433 - DNA, 22 bp, Artificial Sequence
  Description of Artificial Sequence: Synthetic oligonucleotide
cccagggggccgctctcagaag

SEQ ID NO: 113434 - DNA, 22 bp, Artificial Sequence
  Description of Artificial Sequence: Synthetic oligonucleotide
ccagggggccgctctcagaagg

SEQ ID NO: 113435 - DNA, 22 bp, Artificial Sequence
  Description of Artificial Sequence: Synthetic oligonucleotide
cagggggccgctctcagaaggc

SEQ ID NO: 113436 - DNA, 22 bp, Artificial Sequence
  Description of Artificial Sequence: Synthetic oligonucleotide
agggggccgctctcagaaggcc

SEQ ID NO: 113437 - DNA, 21 bp, Artificial Sequence
  Description of Artificial Sequence: Synthetic oligonucleotide
gggggccgctctcagaaggcc

SEQ ID NO: 113438 - DNA, 22 bp, Artificial Sequence
  Description of Artificial Sequence: Synthetic oligonucleotide
ggggccgctctcagaaggccga

SEQ ID NO: 113439 - DNA, 22 bp, Artificial Sequence
  Description of Artificial Sequence: Synthetic oligonucleotide
gggccgctctcagaaggccgag

SEQ ID NO: 113440 - DNA, 22 bp, Artificial Sequence
  Description of Artificial Sequence: Synthetic oligonucleotide
ggccgctctcagaaggccgagg

SEQ ID NO: 113441 - DNA, 22 bp, Artificial Sequence
  Description of Artificial Sequence: Synthetic oligonucleotide
gccgctctcagaaggccgaggg

SEQ ID NO: 113442 - DNA, 22 bp, Artificial Sequence
  Description of Artificial Sequence: Synthetic oligonucleotide
ccgctctcagaaggccgagggg

SEQ ID NO: 113443 - DNA, 23 bp, Artificial Sequence
  Description of Artificial Sequence: Synthetic oligonucleotide
cgctctcagaaggccgaggggca

SEQ ID NO: 113444 - DNA, 24 bp, Artificial Sequence
  Description of Artificial Sequence: Synthetic oligonucleotide
gctctcagaaggccgaggggcaga

SEQ ID NO: 113445 - DNA, 24 bp, Artificial Sequence
  Description of Artificial Sequence: Synthetic oligonucleotide
ctctcagaaggccgaggggcagag

SEQ ID NO: 113446 - DNA, 25 bp, Artificial Sequence
  Description of Artificial Sequence: Synthetic oligonucleotide
tctcagaaggccgaggggcagaggt

SEQ ID NO: 113447 - DNA, 24 bp, Artificial Sequence
  Description of Artificial Sequence: Synthetic oligonucleotide
ctcagaaggccgaggggcagaggt

SEQ ID NO: 113448 - DNA, 24 bp, Artificial Sequence
  Description of Artificial Sequence: Synthetic oligonucleotide
tcagaaggccgaggggcagaggtg

SEQ ID NO: 113449 - DNA, 23 bp, Artificial Sequence
  Description of Artificial Sequence: Synthetic oligonucleotide
cagaaggccgaggggcagaggtg

SEQ ID NO: 113450 - DNA, 23 bp, Artificial Sequence
  Description of Artificial Sequence: Synthetic oligonucleotide
agaaggccgaggggcagaggtgg

SEQ ID NO: 113451 - DNA, 22 bp, Artificial Sequence
  Description of Artificial Sequence: Synthetic oligonucleotide
gaaggccgaggggcagaggtgg

SEQ ID NO: 113452 - DNA, 23 bp, Artificial Sequence
  Description of Artificial Sequence: Synthetic oligonucleotide
aaggccgaggggcagaggtggct

SEQ ID NO: 113453 - DNA, 22 bp, Artificial Sequence
  Description of Artificial Sequence: Synthetic oligonucleotide
aggccgaggggcagaggtggct

SEQ ID NO: 113454 - DNA, 21 bp, Artificial Sequence
  Description of Artificial Sequence: Synthetic oligonucleotide
ggccgaggggcagaggtggct

SEQ ID NO: 113455 - DNA, 22 bp, Artificial Sequence
  Description of Artificial Sequence: Synthetic oligonucleotide
gccgaggggcagaggtggctct

SEQ ID NO: 113456 - DNA, 22 bp, Artificial Sequence
  Description of Artificial Sequence: Synthetic oligonucleotide
ccgaggggcagaggtggctctc

SEQ ID NO: 113457 - DNA, 22 bp, Artificial Sequence
  Description of Artificial Sequence: Synthetic oligonucleotide
cgaggggcagaggtggctctcg

SEQ ID NO: 113458 - DNA, 22 bp, Artificial Sequence
  Description of Artificial Sequence: Synthetic oligonucleotide
gaggggcagaggtggctctcgg

SEQ ID NO: 113459 - DNA, 22 bp, Artificial Sequence
  Description of Artificial Sequence: Synthetic oligonucleotide
aggggcagaggtggctctcggc

SEQ ID NO: 113460 - DNA, 21 bp, Artificial Sequence
  Description of Artificial Sequence: Synthetic oligonucleotide
ggggcagaggtggctctcggc

SEQ ID NO: 113461 - DNA, 21 bp, Artificial Sequence
  Description of Artificial Sequence: Synthetic oligonucleotide
gggcagaggtggctctcggcc

SEQ ID NO: 113462 - DNA, 22 bp, Artificial Sequence
  Description of Artificial Sequence: Synthetic oligonucleotide
ggcagaggtggctctcggccct

SEQ ID NO: 113463 - DNA, 22 bp, Artificial Sequence
  Description of Artificial Sequence: Synthetic oligonucleotide
gcagaggtggctctcggccctg

SEQ ID NO: 113464 - DNA, 22 bp, Artificial Sequence
  Description of Artificial Sequence: Synthetic oligonucleotide
cagaggtggctctcggccctgc

SEQ ID NO: 113465 - DNA, 22 bp, Artificial Sequence
  Description of Artificial Sequence: Synthetic oligonucleotide
agaggtggctctcggccctgcg

SEQ ID NO: 113466 - DNA, 21 bp, Artificial Sequence
  Description of Artificial Sequence: Synthetic oligonucleotide
gaggtggctctcggccctgcg

SEQ ID NO: 113467 - DNA, 21 bp, Artificial Sequence
  Description of Artificial Sequence: Synthetic oligonucleotide
aggtggctctcggccctgcgc

SEQ ID NO: 113468 - DNA, 20 bp, Artificial Sequence
  Description of Artificial Sequence: Synthetic oligonucleotide
ggtggctctcggccctgcgc

SEQ ID NO: 113469 - DNA, 21 bp, Artificial Sequence
  Description of Artificial Sequence: Synthetic oligonucleotide
gtggctctcggccctgcgcca

SEQ ID NO: 113470 - DNA, 21 bp, Artificial Sequence
  Description of Artificial Sequence: Synthetic oligonucleotide
tggctctcggccctgcgccac

SEQ ID NO: 113471 - DNA, 20 bp, Artificial Sequence
  Description of Artificial Sequence: Synthetic oligonucleotide
ggctctcggccctgcgccac

SEQ ID NO: 113472 - DNA, 23 bp, Artificial Sequence
  Description of Artificial Sequence: Synthetic oligonucleotide
gctctcggccctgcgccaccatt

SEQ ID NO: 113473 - DNA, 23 bp, Artificial Sequence
  Description of Artificial Sequence: Synthetic oligonucleotide
ctctcggccctgcgccaccattc

SEQ ID NO: 113474 - DNA, 23 bp, Artificial Sequence
  Description of Artificial Sequence: Synthetic oligonucleotide
tctcggccctgcgccaccattcc

SEQ ID NO: 113475 - DNA, 22 bp, Artificial Sequence
  Description of Artificial Sequence: Synthetic oligonucleotide
ctcggccctgcgccaccattcc

SEQ ID NO: 113476 - DNA, 24 bp, Artificial Sequence
  Description of Artificial Sequence: Synthetic oligonucleotide
tcggccctgcgccaccattccgat

SEQ ID NO: 113477 - DNA, 23 bp, Artificial Sequence
  Description of Artificial Sequence: Synthetic oligonucleotide
cggccctgcgccaccattccgat

SEQ ID NO: 113478 - DNA, 23 bp, Artificial Sequence
  Description of Artificial Sequence: Synthetic oligonucleotide
ggccctgcgccaccattccgatg

SEQ ID NO: 113479 - DNA, 23 bp, Artificial Sequence
  Description of Artificial Sequence: Synthetic oligonucleotide
gccctgcgccaccattccgatgg

SEQ ID NO: 113480 - DNA, 24 bp, Artificial Sequence
  Description of Artificial Sequence: Synthetic oligonucleotide
ccctgcgccaccattccgatggct

SEQ ID NO: 113481 - DNA, 25 bp, Artificial Sequence
  Description of Artificial Sequence: Synthetic oligonucleotide
cctgcgccaccattccgatggctct

SEQ ID NO: 113482 - DNA, 26 bp, Artificial Sequence
  Description of Artificial Sequence: Synthetic oligonucleotide
ctgcgccaccattccgatggctctgt

SEQ ID NO: 113483 - DNA, 27 bp, Artificial Sequence
  Description of Artificial Sequence: Synthetic oligonucleotide
tgcgccaccattccgatggctctgtca

SEQ ID NO: 113484 - DNA, 26 bp, Artificial Sequence
  Description of Artificial Sequence: Synthetic oligonucleotide
gcgccaccattccgatggctctgtca

SEQ ID NO: 113485 - DNA, 26 bp, Artificial Sequence
  Description of Artificial Sequence: Synthetic oligonucleotide
cgccaccattccgatggctctgtcag

SEQ ID NO: 113486 - DNA, 26 bp, Artificial Sequence
  Description of Artificial Sequence: Synthetic oligonucleotide
gccaccattccgatggctctgtcagc

SEQ ID NO: 113487 - DNA, 27 bp, Artificial Sequence
  Description of Artificial Sequence: Synthetic oligonucleotide
ccaccattccgatggctctgtcagcct

SEQ ID NO: 113488 - DNA, 27 bp, Artificial Sequence
  Description of Artificial Sequence: Synthetic oligonucleotide
caccattccgatggctctgtcagcctc

SEQ ID NO: 113489 - DNA, 28 bp, Artificial Sequence
  Description of Artificial Sequence: Synthetic oligonucleotide
accattccgatggctctgtcagcctctc

SEQ ID NO: 113490 - DNA, 27 bp, Artificial Sequence
  Description of Artificial Sequence: Synthetic oligonucleotide
ccattccgatggctctgtcagcctctc

SEQ ID NO: 113491 - DNA, 28 bp, Artificial Sequence
  Description of Artificial Sequence: Synthetic oligonucleotide
cattccgatggctctgtcagcctctctg

SEQ ID NO: 113492 - DNA, 28 bp, Artificial Sequence
  Description of Artificial Sequence: Synthetic oligonucleotide
attccgatggctctgtcagcctctctgg

SEQ ID NO: 113493 - DNA, 27 bp, Artificial Sequence
  Description of Artificial Sequence: Synthetic oligonucleotide
ttccgatggctctgtcagcctctctgg

SEQ ID NO: 113494 - DNA, 26 bp, Artificial Sequence
  Description of Artificial Sequence: Synthetic oligonucleotide
tccgatggctctgtcagcctctctgg

SEQ ID NO: 113495 - DNA, 25 bp, Artificial Sequence
  Description of Artificial Sequence: Synthetic oligonucleotide
ccgatggctctgtcagcctctctgg

SEQ ID NO: 113496 - DNA, 25 bp, Artificial Sequence
  Description of Artificial Sequence: Synthetic oligonucleotide
cgatggctctgtcagcctctctggg

SEQ ID NO: 113497 - DNA, 26 bp, Artificial Sequence
  Description of Artificial Sequence: Synthetic oligonucleotide
gatggctctgtcagcctctctgggca

SEQ ID NO: 113498 - DNA, 27 bp, Artificial Sequence
  Description of Artificial Sequence: Synthetic oligonucleotide
atggctctgtcagcctctctgggcact

SEQ ID NO: 113499 - DNA, 27 bp, Artificial Sequence
  Description of Artificial Sequence: Synthetic oligonucleotide
tggctctgtcagcctctctgggcactt

SEQ ID NO: 113500 - DNA, 26 bp, Artificial Sequence
  Description of Artificial Sequence: Synthetic oligonucleotide
ggctctgtcagcctctctgggcactt

SEQ ID NO: 113501 - DNA, 26 bp, Artificial Sequence
  Description of Artificial Sequence: Synthetic oligonucleotide
gctctgtcagcctctctgggcacttg

SEQ ID NO: 113502 - DNA, 27 bp, Artificial Sequence
  Description of Artificial Sequence: Synthetic oligonucleotide
ctctgtcagcctctctgggcacttgca

SEQ ID NO: 113503 - DNA, 27 bp, Artificial Sequence
  Description of Artificial Sequence: Synthetic oligonucleotide
tctgtcagcctctctgggcacttgcag

SEQ ID NO: 113504 - DNA, 26 bp, Artificial Sequence
  Description of Artificial Sequence: Synthetic oligonucleotide
ctgtcagcctctctgggcacttgcag

SEQ ID NO: 113505 - DNA, 26 bp, Artificial Sequence
  Description of Artificial Sequence: Synthetic oligonucleotide
tgtcagcctctctgggcacttgcagc

SEQ ID NO: 113506 - DNA, 25 bp, Artificial Sequence
  Description of Artificial Sequence: Synthetic oligonucleotide
gtcagcctctctgggcacttgcagc

SEQ ID NO: 113507 - DNA, 25 bp, Artificial Sequence
  Description of Artificial Sequence: Synthetic oligonucleotide
tcagcctctctgggcacttgcagcc

SEQ ID NO: 113508 - DNA, 24 bp, Artificial Sequence
  Description of Artificial Sequence: Synthetic oligonucleotide
cagcctctctgggcacttgcagcc

SEQ ID NO: 113509 - DNA, 24 bp, Artificial Sequence
  Description of Artificial Sequence: Synthetic oligonucleotide
agcctctctgggcacttgcagccg

SEQ ID NO: 113510 - DNA, 23 bp, Artificial Sequence
  Description of Artificial Sequence: Synthetic oligonucleotide
gcctctctgggcacttgcagccg

SEQ ID NO: 113511 - DNA, 23 bp, Artificial Sequence
  Description of Artificial Sequence: Synthetic oligonucleotide
cctctctgggcacttgcagccgc

SEQ ID NO: 113512 - DNA, 23 bp, Artificial Sequence
  Description of Artificial Sequence: Synthetic oligonucleotide
ctctctgggcacttgcagccgcc

SEQ ID NO: 113513 - DNA, 23 bp, Artificial Sequence
  Description of Artificial Sequence: Synthetic oligonucleotide
tctctgggcacttgcagccgccc

SEQ ID NO: 113514 - DNA, 22 bp, Artificial Sequence
  Description of Artificial Sequence: Synthetic oligonucleotide
ctctgggcacttgcagccgccc

SEQ ID NO: 113515 - DNA, 22 bp, Artificial Sequence
  Description of Artificial Sequence: Synthetic oligonucleotide
tctgggcacttgcagccgcccc

SEQ ID NO: 113516 - DNA, 21 bp, Artificial Sequence
  Description of Artificial Sequence: Synthetic oligonucleotide
ctgggcacttgcagccgcccc

SEQ ID NO: 113517 - DNA, 22 bp, Artificial Sequence
  Description of Artificial Sequence: Synthetic oligonucleotide
tgggcacttgcagccgccccca

SEQ ID NO: 113518 - DNA, 21 bp, Artificial Sequence
  Description of Artificial Sequence: Synthetic oligonucleotide
gggcacttgcagccgccccca

SEQ ID NO: 113519 - DNA, 22 bp, Artificial Sequence
  Description of Artificial Sequence: Synthetic oligonucleotide
ggcacttgcagccgcccccagt

SEQ ID NO: 113520 - DNA, 23 bp, Artificial Sequence
  Description of Artificial Sequence: Synthetic oligonucleotide
gcacttgcagccgcccccagtca

SEQ ID NO: 113521 - DNA, 23 bp, Artificial Sequence
  Description of Artificial Sequence: Synthetic oligonucleotide
cacttgcagccgcccccagtcac

SEQ ID NO: 113522 - DNA, 24 bp, Artificial Sequence
  Description of Artificial Sequence: Synthetic oligonucleotide
acttgcagccgcccccagtcacca

SEQ ID NO: 113523 - DNA, 23 bp, Artificial Sequence
  Description of Artificial Sequence: Synthetic oligonucleotide
cttgcagccgcccccagtcacca

SEQ ID NO: 113524 - DNA, 24 bp, Artificial Sequence
  Description of Artificial Sequence: Synthetic oligonucleotide
ttgcagccgcccccagtcaccact

SEQ ID NO: 113525 - DNA, 23 bp, Artificial Sequence
  Description of Artificial Sequence: Synthetic oligonucleotide
tgcagccgcccccagtcaccact

SEQ ID NO: 113526 - DNA, 22 bp, Artificial Sequence
  Description of Artificial Sequence: Synthetic oligonucleotide
gcagccgcccccagtcaccact

SEQ ID NO: 113527 - DNA, 23 bp, Artificial Sequence
  Description of Artificial Sequence: Synthetic oligonucleotide
cagccgcccccagtcaccactga

SEQ ID NO: 113528 - DNA, 23 bp, Artificial Sequence
  Description of Artificial Sequence: Synthetic oligonucleotide
agccgcccccagtcaccactgag

SEQ ID NO: 113529 - DNA, 22 bp, Artificial Sequence
  Description of Artificial Sequence: Synthetic oligonucleotide
gccgcccccagtcaccactgag

SEQ ID NO: 113530 - DNA, 23 bp, Artificial Sequence
  Description of Artificial Sequence: Synthetic oligonucleotide
ccgcccccagtcaccactgagca

SEQ ID NO: 113531 - DNA, 23 bp, Artificial Sequence
  Description of Artificial Sequence: Synthetic oligonucleotide
cgcccccagtcaccactgagcag

SEQ ID NO: 113532 - DNA, 25 bp, Artificial Sequence
  Description of Artificial Sequence: Synthetic oligonucleotide
gcccccagtcaccactgagcagcat

SEQ ID NO: 113533 - DNA, 25 bp, Artificial Sequence
  Description of Artificial Sequence: Synthetic oligonucleotide
cccccagtcaccactgagcagcatg

SEQ ID NO: 113534 - DNA, 25 bp, Artificial Sequence
  Description of Artificial Sequence: Synthetic oligonucleotide
ccccagtcaccactgagcagcatgg

SEQ ID NO: 113535 - DNA, 25 bp, Artificial Sequence
  Description of Artificial Sequence: Synthetic oligonucleotide
cccagtcaccactgagcagcatggg

SEQ ID NO: 113536 - DNA, 25 bp, Artificial Sequence
  Description of Artificial Sequence: Synthetic oligonucleotide
ccagtcaccactgagcagcatgggg

SEQ ID NO: 113537 - DNA, 26 bp, Artificial Sequence
  Description of Artificial Sequence: Synthetic oligonucleotide
cagtcaccactgagcagcatggggca

SEQ ID NO: 113538 - DNA, 26 bp, Artificial Sequence
  Description of Artificial Sequence: Synthetic oligonucleotide
agtcaccactgagcagcatggggcac

SEQ ID NO: 113539 - DNA, 25 bp, Artificial Sequence
  Description of Artificial Sequence: Synthetic oligonucleotide
gtcaccactgagcagcatggggcac

SEQ ID NO: 113540 - DNA, 25 bp, Artificial Sequence
  Description of Artificial Sequence: Synthetic oligonucleotide
tcaccactgagcagcatggggcacg

SEQ ID NO: 113541 - DNA, 24 bp, Artificial Sequence
  Description of Artificial Sequence: Synthetic oligonucleotide
caccactgagcagcatggggcacg

SEQ ID NO: 113542 - DNA, 27 bp, Artificial Sequence
  Description of Artificial Sequence: Synthetic oligonucleotide
accactgagcagcatggggcacgctat

SEQ ID NO: 113543 - DNA, 26 bp, Artificial Sequence
  Description of Artificial Sequence: Synthetic oligonucleotide
ccactgagcagcatggggcacgctat

SEQ ID NO: 113544 - DNA, 26 bp, Artificial Sequence
  Description of Artificial Sequence: Synthetic oligonucleotide
cactgagcagcatggggcacgctatg

SEQ ID NO: 113545 - DNA, 26 bp, Artificial Sequence
  Description of Artificial Sequence: Synthetic oligonucleotide
actgagcagcatggggcacgctatgc

SEQ ID NO: 113546 - DNA, 25 bp, Artificial Sequence
  Description of Artificial Sequence: Synthetic oligonucleotide
ctgagcagcatggggcacgctatgc

SEQ ID NO: 113547 - DNA, 26 bp, Artificial Sequence
  Description of Artificial Sequence: Synthetic oligonucleotide
tgagcagcatggggcacgctatgcct

SEQ ID NO: 113548 - DNA, 25 bp, Artificial Sequence
  Description of Artificial Sequence: Synthetic oligonucleotide
gagcagcatggggcacgctatgcct

SEQ ID NO: 113549 - DNA, 26 bp, Artificial Sequence
  Description of Artificial Sequence: Synthetic oligonucleotide
agcagcatggggcacgctatgcctgt

SEQ ID NO: 113550 - DNA, 25 bp, Artificial Sequence
  Description of Artificial Sequence: Synthetic oligonucleotide
gcagcatggggcacgctatgcctgt

SEQ ID NO: 113551 - DNA, 25 bp, Artificial Sequence
  Description of Artificial Sequence: Synthetic oligonucleotide
cagcatggggcacgctatgcctgtc

SEQ ID NO: 113552 - DNA, 27 bp, Artificial Sequence
  Description of Artificial Sequence: Synthetic oligonucleotide
agcatggggcacgctatgcctgtcgaa

SEQ ID NO: 113553 - DNA, 27 bp, Artificial Sequence
  Description of Artificial Sequence: Synthetic oligonucleotide
gcatggggcacgctatgcctgtcgaat

SEQ ID NO: 113554 - DNA, 28 bp, Artificial Sequence
  Description of Artificial Sequence: Synthetic oligonucleotide
catggggcacgctatgcctgtcgaattc

SEQ ID NO: 113555 - DNA, 29 bp, Artificial Sequence
  Description of Artificial Sequence: Synthetic oligonucleotide
atggggcacgctatgcctgtcgaattcac

SEQ ID NO: 113556 - DNA, 28 bp, Artificial Sequence
  Description of Artificial Sequence: Synthetic oligonucleotide
tggggcacgctatgcctgtcgaattcac

SEQ ID NO: 113557 - DNA, 27 bp, Artificial Sequence
  Description of Artificial Sequence: Synthetic oligonucleotide
ggggcacgctatgcctgtcgaattcac

SEQ ID NO: 113558 - DNA, 27 bp, Artificial Sequence
  Description of Artificial Sequence: Synthetic oligonucleotide
gggcacgctatgcctgtcgaattcacc

SEQ ID NO: 113559 - DNA, 29 bp, Artificial Sequence
  Description of Artificial Sequence: Synthetic oligonucleotide
ggcacgctatgcctgtcgaattcaccatc

SEQ ID NO: 113560 - DNA, 29 bp, Artificial Sequence
  Description of Artificial Sequence: Synthetic oligonucleotide
gcacgctatgcctgtcgaattcaccatcc

SEQ ID NO: 113561 - DNA, 29 bp, Artificial Sequence
  Description of Artificial Sequence: Synthetic oligonucleotide
cacgctatgcctgtcgaattcaccatccc

SEQ ID NO: 113562 - DNA, 30 bp, Artificial Sequence
  Description of Artificial Sequence: Synthetic oligonucleotide
acgctatgcctgtcgaattcaccatcccag

SEQ ID NO: 113563 - DNA, 29 bp, Artificial Sequence
  Description of Artificial Sequence: Synthetic oligonucleotide
cgctatgcctgtcgaattcaccatcccag

SEQ ID NO: 113564 - DNA, 29 bp, Artificial Sequence
  Description of Artificial Sequence: Synthetic oligonucleotide
gctatgcctgtcgaattcaccatcccagc

SEQ ID NO: 113565 - DNA, 29 bp, Artificial Sequence
  Description of Artificial Sequence: Synthetic oligonucleotide
ctatgcctgtcgaattcaccatcccagcc

SEQ ID NO: 113566 - DNA, 30 bp, Artificial Sequence
  Description of Artificial Sequence: Synthetic oligonucleotide
tatgcctgtcgaattcaccatcccagcctg

SEQ ID NO: 113567 - DNA, 29 bp, Artificial Sequence
  Description of Artificial Sequence: Synthetic oligonucleotide
atgcctgtcgaattcaccatcccagcctg

SEQ ID NO: 113568 - DNA, 28 bp, Artificial Sequence
  Description of Artificial Sequence: Synthetic oligonucleotide
tgcctgtcgaattcaccatcccagcctg

SEQ ID NO: 113569 - DNA, 27 bp, Artificial Sequence
  Description of Artificial Sequence: Synthetic oligonucleotide
gcctgtcgaattcaccatcccagcctg

SEQ ID NO: 113570 - DNA, 27 bp, Artificial Sequence
  Description of Artificial Sequence: Synthetic oligonucleotide
cctgtcgaattcaccatcccagcctgc

SEQ ID NO: 113571 - DNA, 27 bp, Artificial Sequence
  Description of Artificial Sequence: Synthetic oligonucleotide
ctgtcgaattcaccatcccagcctgcc

SEQ ID NO: 113572 - DNA, 28 bp, Artificial Sequence
  Description of Artificial Sequence: Synthetic oligonucleotide
tgtcgaattcaccatcccagcctgcctg

SEQ ID NO: 113573 - DNA, 27 bp, Artificial Sequence
  Description of Artificial Sequence: Synthetic oligonucleotide
gtcgaattcaccatcccagcctgcctg

SEQ ID NO: 113574 - DNA, 27 bp, Artificial Sequence
  Description of Artificial Sequence: Synthetic oligonucleotide
tcgaattcaccatcccagcctgcctgc

SEQ ID NO: 113575 - DNA, 26 bp, Artificial Sequence
  Description of Artificial Sequence: Synthetic oligonucleotide
cgaattcaccatcccagcctgcctgc

SEQ ID NO: 113576 - DNA, 27 bp, Artificial Sequence
  Description of Artificial Sequence: Synthetic oligonucleotide
gaattcaccatcccagcctgcctgcct

SEQ ID NO: 113577 - DNA, 27 bp, Artificial Sequence
  Description of Artificial Sequence: Synthetic oligonucleotide
aattcaccatcccagcctgcctgcctc

SEQ ID NO: 113578 - DNA, 26 bp, Artificial Sequence
  Description of Artificial Sequence: Synthetic oligonucleotide
attcaccatcccagcctgcctgcctc

SEQ ID NO: 113579 - DNA, 25 bp, Artificial Sequence
  Description of Artificial Sequence: Synthetic oligonucleotide
ttcaccatcccagcctgcctgcctc

SEQ ID NO: 113580 - DNA, 24 bp, Artificial Sequence
  Description of Artificial Sequence: Synthetic oligonucleotide
tcaccatcccagcctgcctgcctc

SEQ ID NO: 113581 - DNA, 23 bp, Artificial Sequence
  Description of Artificial Sequence: Synthetic oligonucleotide
caccatcccagcctgcctgcctc

SEQ ID NO: 113582 - DNA, 23 bp, Artificial Sequence
  Description of Artificial Sequence: Synthetic oligonucleotide
accatcccagcctgcctgcctcg

SEQ ID NO: 113583 - DNA, 22 bp, Artificial Sequence
  Description of Artificial Sequence: Synthetic oligonucleotide
ccatcccagcctgcctgcctcg

SEQ ID NO: 113584 - DNA, 22 bp, Artificial Sequence
  Description of Artificial Sequence: Synthetic oligonucleotide
catcccagcctgcctgcctcgg

SEQ ID NO: 113585 - DNA, 22 bp, Artificial Sequence
  Description of Artificial Sequence: Synthetic oligonucleotide
atcccagcctgcctgcctcggg

SEQ ID NO: 113586 - DNA, 21 bp, Artificial Sequence
  Description of Artificial Sequence: Synthetic oligonucleotide
tcccagcctgcctgcctcggg

SEQ ID NO: 113587 - DNA, 20 bp, Artificial Sequence
  Description of Artificial Sequence: Synthetic oligonucleotide
cccagcctgcctgcctcggg

SEQ ID NO: 113588 - DNA, 20 bp, Artificial Sequence
  Description of Artificial Sequence: Synthetic oligonucleotide
ccagcctgcctgcctcgggg

SEQ ID NO: 113589 - DNA, 20 bp, Artificial Sequence
  Description of Artificial Sequence: Synthetic oligonucleotide
cagcctgcctgcctcggggc

SEQ ID NO: 113590 - DNA, 20 bp, Artificial Sequence
  Description of Artificial Sequence: Synthetic oligonucleotide
agcctgcctgcctcggggcg

SEQ ID NO: 113591 - DNA, 20 bp, Artificial Sequence
  Description of Artificial Sequence: Synthetic oligonucleotide
gcctgcctgcctcggggcgt

SEQ ID NO: 113592 - DNA, 20 bp, Artificial Sequence
  Description of Artificial Sequence: Synthetic oligonucleotide
cctgcctgcctcggggcgca

SEQ ID NO: 113593 - DNA, 20 bp, Artificial Sequence
  Description of Artificial Sequence: Synthetic oligonucleotide
ctgcctgcctcggggcgcag

SEQ ID NO: 113594 - DNA, 20 bp, Artificial Sequence
  Description of Artificial Sequence: Synthetic oligonucleotide
tgcctgcctcggggcgcagc

SEQ ID NO: 113595 - DNA, 20 bp, Artificial Sequence
  Description of Artificial Sequence: Synthetic oligonucleotide
gcctgcctcggggcgcagct

SEQ ID NO: 113596 - DNA, 20 bp, Artificial Sequence
  Description of Artificial Sequence: Synthetic oligonucleotide
cctgcctcggggcgcagcgt

SEQ ID NO: 113597 - DNA, 20 bp, Artificial Sequence
  Description of Artificial Sequence: Synthetic oligonucleotide
ctgcctcggggcgcagcgct

SEQ ID NO: 113598 - DNA, 21 bp, Artificial Sequence
  Description of Artificial Sequence: Synthetic oligonucleotide
tgcctcggggcgcagcgctga

SEQ ID NO: 113599 - DNA, 20 bp, Artificial Sequence
  Description of Artificial Sequence: Synthetic oligonucleotide
gcctcggggcgcagcgctga

SEQ ID NO: 113600 - DNA, 20 bp, Artificial Sequence
  Description of Artificial Sequence: Synthetic oligonucleotide
cctcggggcgcagcgctgag

SEQ ID NO: 113601 - DNA, 21 bp, Artificial Sequence
  Description of Artificial Sequence: Synthetic oligonucleotide
ctcggggcgcagcgctgaggt

SEQ ID NO: 113602 - DNA, 22 bp, Artificial Sequence
  Description of Artificial Sequence: Synthetic oligonucleotide
tcggggcgcagcgctgaggtca

SEQ ID NO: 113603 - DNA, 21 bp, Artificial Sequence
  Description of Artificial Sequence: Synthetic oligonucleotide
cggggcgcagcgctgaggtca

SEQ ID NO: 113604 - DNA, 21 bp, Artificial Sequence
  Description of Artificial Sequence: Synthetic oligonucleotide
ggggcgcagcgctgaggtcac

SEQ ID NO: 113605 - DNA, 21 bp, Artificial Sequence
  Description of Artificial Sequence: Synthetic oligonucleotide
gggcgcagcgctgaggtcacc

SEQ ID NO: 113606 - DNA, 22 bp, Artificial Sequence
  Description of Artificial Sequence: Synthetic oligonucleotide
ggcgcagcgctgaggtcaccct

SEQ ID NO: 113607 - DNA, 22 bp, Artificial Sequence
  Description of Artificial Sequence: Synthetic oligonucleotide
gcgcagcgctgaggtcaccctg

SEQ ID NO: 113608 - DNA, 23 bp, Artificial Sequence
  Description of Artificial Sequence: Synthetic oligonucleotide
cgcagcgctgaggtcaccctgga

SEQ ID NO: 113609 - DNA, 23 bp, Artificial Sequence
  Description of Artificial Sequence: Synthetic oligonucleotide
gcagcgctgaggtcaccctggag

SEQ ID NO: 113610 - DNA, 25 bp, Artificial Sequence
  Description of Artificial Sequence: Synthetic oligonucleotide
cagcgctgaggtcaccctggaggta

SEQ ID NO: 113611 - DNA, 25 bp, Artificial Sequence
  Description of Artificial Sequence: Synthetic oligonucleotide
agcgctgaggtcaccctggaggtag

SEQ ID NO: 113612 - DNA, 24 bp, Artificial Sequence
  Description of Artificial Sequence: Synthetic oligonucleotide
gcgctgaggtcaccctggaggtag

SEQ ID NO: 113613 - DNA, 25 bp, Artificial Sequence
  Description of Artificial Sequence: Synthetic oligonucleotide
cgctgaggtcaccctggaggtagca

SEQ ID NO: 113614 - DNA, 25 bp, Artificial Sequence
  Description of Artificial Sequence: Synthetic oligonucleotide
gctgaggtcaccctggaggtagcag

SEQ ID NO: 113615 - DNA, 26 bp, Artificial Sequence
  Description of Artificial Sequence: Synthetic oligonucleotide
ctgaggtcaccctggaggtagcaggt

SEQ ID NO: 113616 - DNA, 27 bp, Artificial Sequence
  Description of Artificial Sequence: Synthetic oligonucleotide
tgaggtcaccctggaggtagcaggtct

SEQ ID NO: 113617 - DNA, 27 bp, Artificial Sequence
  Description of Artificial Sequence: Synthetic oligonucleotide
gaggtcaccctggaggtagcaggtctt

SEQ ID NO: 113618 - DNA, 28 bp, Artificial Sequence
  Description of Artificial Sequence: Synthetic oligonucleotide
aggtcaccctggaggtagcaggtctttc

SEQ ID NO: 113619 - DNA, 27 bp, Artificial Sequence
  Description of Artificial Sequence: Synthetic oligonucleotide
ggtcaccctggaggtagcaggtctttc

SEQ ID NO: 113620 - DNA, 28 bp, Artificial Sequence
  Description of Artificial Sequence: Synthetic oligonucleotide
gtcaccctggaggtagcaggtctttcag

SEQ ID NO: 113621 - DNA, 28 bp, Artificial Sequence
  Description of Artificial Sequence: Synthetic oligonucleotide
tcaccctggaggtagcaggtctttcagg

SEQ ID NO: 113622 - DNA, 27 bp, Artificial Sequence
  Description of Artificial Sequence: Synthetic oligonucleotide
caccctggaggtagcaggtctttcagg

SEQ ID NO: 113623 - DNA, 27 bp, Artificial Sequence
  Description of Artificial Sequence: Synthetic oligonucleotide
accctggaggtagcaggtctttcaggg

SEQ ID NO: 113624 - DNA, 26 bp, Artificial Sequence
  Description of Artificial Sequence: Synthetic oligonucleotide
ccctggaggtagcaggtctttcaggg

SEQ ID NO: 113625 - DNA, 26 bp, Artificial Sequence
  Description of Artificial Sequence: Synthetic oligonucleotide
cctggaggtagcaggtctttcagggc

SEQ ID NO: 113626 - DNA, 26 bp, Artificial Sequence
  Description of Artificial Sequence: Synthetic oligonucleotide
ctggaggtagcaggtctttcagggcc

SEQ ID NO: 113627 - DNA, 27 bp, Artificial Sequence
  Description of Artificial Sequence: Synthetic oligonucleotide
tggaggtagcaggtctttcagggccct

SEQ ID NO: 113628 - DNA, 26 bp, Artificial Sequence
  Description of Artificial Sequence: Synthetic oligonucleotide
ggaggtagcaggtctttcagggccct

SEQ ID NO: 113629 - DNA, 26 bp, Artificial Sequence
  Description of Artificial Sequence: Synthetic oligonucleotide
gaggtagcaggtctttcagggccctc

SEQ ID NO: 113630 - DNA, 26 bp, Artificial Sequence
  Description of Artificial Sequence: Synthetic oligonucleotide
aggtagcaggtctttcagggccctcc

SEQ ID NO: 113631 - DNA, 25 bp, Artificial Sequence
  Description of Artificial Sequence: Synthetic oligonucleotide
ggtagcaggtctttcagggccctcc

SEQ ID NO: 113632 - DNA, 27 bp, Artificial Sequence
  Description of Artificial Sequence: Synthetic oligonucleotide
gtagcaggtctttcagggccctccctt

SEQ ID NO: 113633 - DNA, 27 bp, Artificial Sequence
  Description of Artificial Sequence: Synthetic oligonucleotide
tagcaggtctttcagggccctcccttg

SEQ ID NO: 113634 - DNA, 27 bp, Artificial Sequence
  Description of Artificial Sequence: Synthetic oligonucleotide
agcaggtctttcagggccctcccttga

SEQ ID NO: 113635 - DNA, 26 bp, Artificial Sequence
  Description of Artificial Sequence: Synthetic oligonucleotide
gcaggtctttcagggccctcccttga

SEQ ID NO: 113636 - DNA, 26 bp, Artificial Sequence
  Description of Artificial Sequence: Synthetic oligonucleotide
caggtctttcagggccctcccttgag

SEQ ID NO: 113637 - DNA, 27 bp, Artificial Sequence
  Description of Artificial Sequence: Synthetic oligonucleotide
aggtctttcagggccctcccttgagga

SEQ ID NO: 113638 - DNA, 26 bp, Artificial Sequence
  Description of Artificial Sequence: Synthetic oligonucleotide
ggtctttcagggccctcccttgagga

SEQ ID NO: 113639 - DNA, 27 bp, Artificial Sequence
  Description of Artificial Sequence: Synthetic oligonucleotide
gtctttcagggccctcccttgaggaca

SEQ ID NO: 113640 - DNA, 27 bp, Artificial Sequence
  Description of Artificial Sequence: Synthetic oligonucleotide
tctttcagggccctcccttgaggacag

SEQ ID NO: 113641 - DNA, 26 bp, Artificial Sequence
  Description of Artificial Sequence: Synthetic oligonucleotide
ctttcagggccctcccttgaggacag

SEQ ID NO: 113642 - DNA, 26 bp, Artificial Sequence
  Description of Artificial Sequence: Synthetic oligonucleotide
tttcagggccctcccttgaggacagc

SEQ ID NO: 113643 - DNA, 25 bp, Artificial Sequence
  Description of Artificial Sequence: Synthetic oligonucleotide
ttcagggccctcccttgaggacagc

SEQ ID NO: 113644 - DNA, 24 bp, Artificial Sequence
  Description of Artificial Sequence: Synthetic oligonucleotide
tcagggccctcccttgaggacagc

SEQ ID NO: 113645 - DNA, 23 bp, Artificial Sequence
  Description of Artificial Sequence: Synthetic oligonucleotide
cagggccctcccttgaggacagc

SEQ ID NO: 113646 - DNA, 25 bp, Artificial Sequence
  Description of Artificial Sequence: Synthetic oligonucleotide
agggccctcccttgaggacagcgta

SEQ ID NO: 113647 - DNA, 24 bp, Artificial Sequence
  Description of Artificial Sequence: Synthetic oligonucleotide
gggccctcccttgaggacagcgta

SEQ ID NO: 113648 - DNA, 24 bp, Artificial Sequence
  Description of Artificial Sequence: Synthetic oligonucleotide
ggccctcccttgaggacagcgtag

SEQ ID NO: 113649 - DNA, 24 bp, Artificial Sequence
  Description of Artificial Sequence: Synthetic oligonucleotide
gccctcccttgaggacagcgtagg

SEQ ID NO: 113650 - DNA, 24 bp, Artificial Sequence
  Description of Artificial Sequence: Synthetic oligonucleotide
ccctcccttgaggacagcgtaggc

SEQ ID NO: 113651 - DNA, 27 bp, Artificial Sequence
  Description of Artificial Sequence: Synthetic oligonucleotide
cctcccttgaggacagcgtaggccttt

SEQ ID NO: 113652 - DNA, 28 bp, Artificial Sequence
  Description of Artificial Sequence: Synthetic oligonucleotide
ctcccttgaggacagcgtaggccttttc

SEQ ID NO: 113653 - DNA, 28 bp, Artificial Sequence
  Description of Artificial Sequence: Synthetic oligonucleotide
tcccttgaggacagcgtaggccttttcc

SEQ ID NO: 113654 - DNA, 27 bp, Artificial Sequence
  Description of Artificial Sequence: Synthetic oligonucleotide
cccttgaggacagcgtaggccttttcc

SEQ ID NO: 113655 - DNA, 28 bp, Artificial Sequence
  Description of Artificial Sequence: Synthetic oligonucleotide
ccttgaggacagcgtaggccttttcctg

SEQ ID NO: 113656 - DNA, 29 bp, Artificial Sequence
  Description of Artificial Sequence: Synthetic oligonucleotide
cttgaggacagcgtaggccttttcctgtc

SEQ ID NO: 113657 - DNA, 30 bp, Artificial Sequence
  Description of Artificial Sequence: Synthetic oligonucleotide
ttgaggacagcgtaggccttttcctgtctg

SEQ ID NO: 113658 - DNA, 29 bp, Artificial Sequence
  Description of Artificial Sequence: Synthetic oligonucleotide
tgaggacagcgtaggccttttcctgtctg

SEQ ID NO: 113659 - DNA, 28 bp, Artificial Sequence
  Description of Artificial Sequence: Synthetic oligonucleotide
gaggacagcgtaggccttttcctgtctg

SEQ ID NO: 113660 - DNA, 28 bp, Artificial Sequence
  Description of Artificial Sequence: Synthetic oligonucleotide
aggacagcgtaggccttttcctgtctgc

SEQ ID NO: 113661 - DNA, 27 bp, Artificial Sequence
  Description of Artificial Sequence: Synthetic oligonucleotide
ggacagcgtaggccttttcctgtctgc

SEQ ID NO: 113662 - DNA, 27 bp, Artificial Sequence
  Description of Artificial Sequence: Synthetic oligonucleotide
gacagcgtaggccttttcctgtctgcc

SEQ ID NO: 113663 - DNA, 30 bp, Artificial Sequence
  Description of Artificial Sequence: Synthetic oligonucleotide
acagcgtaggccttttcctgtctgcctttc

SEQ ID NO: 113664 - DNA, 29 bp, Artificial Sequence
  Description of Artificial Sequence: Synthetic oligonucleotide
cagcgtaggccttttcctgtctgcctttc

SEQ ID NO: 113665 - DNA, 31 bp, Artificial Sequence
  Description of Artificial Sequence: Synthetic oligonucleotide
agcgtaggccttttcctgtctgcctttcttc

SEQ ID NO: 113666 - DNA, 30 bp, Artificial Sequence
  Description of Artificial Sequence: Synthetic oligonucleotide
gcgtaggccttttcctgtctgcctttcttc

SEQ ID NO: 113667 - DNA, 31 bp, Artificial Sequence
  Description of Artificial Sequence: Synthetic oligonucleotide
cgtaggccttttcctgtctgcctttcttctg

SEQ ID NO: 113668 - DNA, 31 bp, Artificial Sequence
  Description of Artificial Sequence: Synthetic oligonucleotide
gtaggccttttcctgtctgcctttcttctgc

SEQ ID NO: 113669 - DNA, 33 bp, Artificial Sequence
  Description of Artificial Sequence: Synthetic oligonucleotide
taggccttttcctgtctgcctttcttctgcttg

SEQ ID NO: 113670 - DNA, 32 bp, Artificial Sequence
  Description of Artificial Sequence: Synthetic oligonucleotide
aggccttttcctgtctgcctttcttctgcttg

SEQ ID NO: 113671 - DNA, 31 bp, Artificial Sequence
  Description of Artificial Sequence: Synthetic oligonucleotide
ggccttttcctgtctgcctttcttctgcttg

SEQ ID NO: 113672 - DNA, 31 bp, Artificial Sequence
  Description of Artificial Sequence: Synthetic oligonucleotide
gccttttcctgtctgcctttcttctgcttgg

SEQ ID NO: 113673 - DNA, 31 bp, Artificial Sequence
  Description of Artificial Sequence: Synthetic oligonucleotide
ccttttcctgtctgcctttcttctgcttggg

SEQ ID NO: 113674 - DNA, 31 bp, Artificial Sequence
  Description of Artificial Sequence: Synthetic oligonucleotide
cttttcctgtctgcctttcttctgcttgggc

SEQ ID NO: 113675 - DNA, 32 bp, Artificial Sequence
  Description of Artificial Sequence: Synthetic oligonucleotide
ttttcctgtctgcctttcttctgcttgggctc

SEQ ID NO: 113676 - DNA, 31 bp, Artificial Sequence
  Description of Artificial Sequence: Synthetic oligonucleotide
tttcctgtctgcctttcttctgcttgggctc

SEQ ID NO: 113677 - DNA, 30 bp, Artificial Sequence
  Description of Artificial Sequence: Synthetic oligonucleotide
ttcctgtctgcctttcttctgcttgggctc

SEQ ID NO: 113678 - DNA, 29 bp, Artificial Sequence
  Description of Artificial Sequence: Synthetic oligonucleotide
tcctgtctgcctttcttctgcttgggctc

SEQ ID NO: 113679 - DNA, 28 bp, Artificial Sequence
  Description of Artificial Sequence: Synthetic oligonucleotide
cctgtctgcctttcttctgcttgggctc

SEQ ID NO: 113680 - DNA, 30 bp, Artificial Sequence
  Description of Artificial Sequence: Synthetic oligonucleotide
ctgtctgcctttcttctgcttgggctcttc

SEQ ID NO: 113681 - DNA, 32 bp, Artificial Sequence
  Description of Artificial Sequence: Synthetic oligonucleotide
tgtctgcctttcttctgcttgggctcttcaag

SEQ ID NO: 113682 - DNA, 31 bp, Artificial Sequence
  Description of Artificial Sequence: Synthetic oligonucleotide
gtctgcctttcttctgcttgggctcttcaag

SEQ ID NO: 113683 - DNA, 31 bp, Artificial Sequence
  Description of Artificial Sequence: Synthetic oligonucleotide
tctgcctttcttctgcttgggctcttcaagg

SEQ ID NO: 113684 - DNA, 30 bp, Artificial Sequence
  Description of Artificial Sequence: Synthetic oligonucleotide
ctgcctttcttctgcttgggctcttcaagg

SEQ ID NO: 113685 - DNA, 30 bp, Artificial Sequence
  Description of Artificial Sequence: Synthetic oligonucleotide
tgcctttcttctgcttgggctcttcaaggc

SEQ ID NO: 113686 - DNA, 29 bp, Artificial Sequence
  Description of Artificial Sequence: Synthetic oligonucleotide
gcctttcttctgcttgggctcttcaaggc

SEQ ID NO: 113687 - DNA, 30 bp, Artificial Sequence
  Description of Artificial Sequence: Synthetic oligonucleotide
cctttcttctgcttgggctcttcaaggcac

SEQ ID NO: 113688 - DNA, 31 bp, Artificial Sequence
  Description of Artificial Sequence: Synthetic oligonucleotide
ctttcttctgcttgggctcttcaaggcactg

SEQ ID NO: 113689 - DNA, 31 bp, Artificial Sequence
  Description of Artificial Sequence: Synthetic oligonucleotide
tttcttctgcttgggctcttcaaggcactgg

SEQ ID NO: 113690 - DNA, 30 bp, Artificial Sequence
  Description of Artificial Sequence: Synthetic oligonucleotide
ttcttctgcttgggctcttcaaggcactgg

SEQ ID NO: 113691 - DNA, 29 bp, Artificial Sequence
  Description of Artificial Sequence: Synthetic oligonucleotide
tcttctgcttgggctcttcaaggcactgg

SEQ ID NO: 113692 - DNA, 28 bp, Artificial Sequence
  Description of Artificial Sequence: Synthetic oligonucleotide
cttctgcttgggctcttcaaggcactgg

SEQ ID NO: 113693 - DNA, 28 bp, Artificial Sequence
  Description of Artificial Sequence: Synthetic oligonucleotide
ttctgcttgggctcttcaaggcactggg

SEQ ID NO: 113694 - DNA, 27 bp, Artificial Sequence
  Description of Artificial Sequence: Synthetic oligonucleotide
tctgcttgggctcttcaaggcactggg

SEQ ID NO: 113695 - DNA, 26 bp, Artificial Sequence
  Description of Artificial Sequence: Synthetic oligonucleotide
ctgcttgggctcttcaaggcactggg

SEQ ID NO: 113696 - DNA, 27 bp, Artificial Sequence
  Description of Artificial Sequence: Synthetic oligonucleotide
tgcttgggctcttcaaggcactgggct

SEQ ID NO: 113697 - DNA, 26 bp, Artificial Sequence
  Description of Artificial Sequence: Synthetic oligonucleotide
gcttgggctcttcaaggcactgggct

SEQ ID NO: 113698 - DNA, 26 bp, Artificial Sequence
  Description of Artificial Sequence: Synthetic oligonucleotide
cttgggctcttcaaggcactgggctg

SEQ ID NO: 113699 - DNA, 26 bp, Artificial Sequence
  Description of Artificial Sequence: Synthetic oligonucleotide
ttgggctcttcaaggcactgggctgg

SEQ ID NO: 113700 - DNA, 25 bp, Artificial Sequence
  Description of Artificial Sequence: Synthetic oligonucleotide
tgggctcttcaaggcactgggctgg

SEQ ID NO: 113701 - DNA, 24 bp, Artificial Sequence
  Description of Artificial Sequence: Synthetic oligonucleotide
gggctcttcaaggcactgggctgg

SEQ ID NO: 113702 - DNA, 24 bp, Artificial Sequence
  Description of Artificial Sequence: Synthetic oligonucleotide
ggctcttcaaggcactgggctggg

SEQ ID NO: 113703 - DNA, 25 bp, Artificial Sequence
  Description of Artificial Sequence: Synthetic oligonucleotide
gctcttcaaggcactgggctgggct

SEQ ID NO: 113704 - DNA, 25 bp, Artificial Sequence
  Description of Artificial Sequence: Synthetic oligonucleotide
ctcttcaaggcactgggctgggctg

SEQ ID NO: 113705 - DNA, 26 bp, Artificial Sequence
  Description of Artificial Sequence: Synthetic oligonucleotide
tcttcaaggcactgggctgggctgct

SEQ ID NO: 113706 - DNA, 25 bp, Artificial Sequence
  Description of Artificial Sequence: Synthetic oligonucleotide
cttcaaggcactgggctgggctgct

SEQ ID NO: 113707 - DNA, 26 bp, Artificial Sequence
  Description of Artificial Sequence: Synthetic oligonucleotide
ttcaaggcactgggctgggctgctgt

SEQ ID NO: 113708 - DNA, 25 bp, Artificial Sequence
  Description of Artificial Sequence: Synthetic oligonucleotide
tcaaggcactgggctgggctgctgt

SEQ ID NO: 113709 - DNA, 24 bp, Artificial Sequence
  Description of Artificial Sequence: Synthetic oligonucleotide
caaggcactgggctgggctgctgt

SEQ ID NO: 113710 - DNA, 26 bp, Artificial Sequence
  Description of Artificial Sequence: Synthetic oligonucleotide
aaggcactgggctgggctgctgtcta

SEQ ID NO: 113711 - DNA, 25 bp, Artificial Sequence
  Description of Artificial Sequence: Synthetic oligonucleotide
aggcactgggctgggctgctgtcta

SEQ ID NO: 113712 - DNA, 24 bp, Artificial Sequence
  Description of Artificial Sequence: Synthetic oligonucleotide
ggcactgggctgggctgctgtcta

SEQ ID NO: 113713 - DNA, 24 bp, Artificial Sequence
  Description of Artificial Sequence: Synthetic oligonucleotide
gcactgggctgggctgctgtctac

SEQ ID NO: 113714 - DNA, 25 bp, Artificial Sequence
  Description of Artificial Sequence: Synthetic oligonucleotide
cactgggctgggctgctgtctacct

SEQ ID NO: 113715 - DNA, 26 bp, Artificial Sequence
  Description of Artificial Sequence: Synthetic oligonucleotide
actgggctgggctgctgtctacctgt

SEQ ID NO: 113716 - DNA, 25 bp, Artificial Sequence
  Description of Artificial Sequence: Synthetic oligonucleotide
ctgggctgggctgctgtctacctgt

SEQ ID NO: 113717 - DNA, 25 bp, Artificial Sequence
  Description of Artificial Sequence: Synthetic oligonucleotide
tgggctgggctgctgtctacctgtc

SEQ ID NO: 113718 - DNA, 24 bp, Artificial Sequence
  Description of Artificial Sequence: Synthetic oligonucleotide
gggctgggctgctgtctacctgtc

SEQ ID NO: 113719 - DNA, 25 bp, Artificial Sequence
  Description of Artificial Sequence: Synthetic oligonucleotide
ggctgggctgctgtctacctgtcca

SEQ ID NO: 113720 - DNA, 25 bp, Artificial Sequence
  Description of Artificial Sequence: Synthetic oligonucleotide
gctgggctgctgtctacctgtccac

SEQ ID NO: 113721 - DNA, 26 bp, Artificial Sequence
  Description of Artificial Sequence: Synthetic oligonucleotide
ctgggctgctgtctacctgtccacct

SEQ ID NO: 113722 - DNA, 26 bp, Artificial Sequence
  Description of Artificial Sequence: Synthetic oligonucleotide
tgggctgctgtctacctgtccacctg

SEQ ID NO: 113723 - DNA, 25 bp, Artificial Sequence
  Description of Artificial Sequence: Synthetic oligonucleotide
gggctgctgtctacctgtccacctg

SEQ ID NO: 113724 - DNA, 27 bp, Artificial Sequence
  Description of Artificial Sequence: Synthetic oligonucleotide
ggctgctgtctacctgtccacctgcaa

SEQ ID NO: 113725 - DNA, 27 bp, Artificial Sequence
  Description of Artificial Sequence: Synthetic oligonucleotide
gctgctgtctacctgtccacctgcaag

SEQ ID NO: 113726 - DNA, 27 bp, Artificial Sequence
  Description of Artificial Sequence: Synthetic oligonucleotide
ctgctgtctacctgtccacctgcaagg

SEQ ID NO: 113727 - DNA, 30 bp, Artificial Sequence
  Description of Artificial Sequence: Synthetic oligonucleotide
tgctgtctacctgtccacctgcaaggattc

SEQ ID NO: 113728 - DNA, 29 bp, Artificial Sequence
  Description of Artificial Sequence: Synthetic oligonucleotide
gctgtctacctgtccacctgcaaggattc

SEQ ID NO: 113729 - DNA, 32 bp, Artificial Sequence
  Description of Artificial Sequence: Synthetic oligonucleotide
ctgtctacctgtccacctgcaaggattcaaag

SEQ ID NO: 113730 - DNA, 34 bp, Artificial Sequence
  Description of Artificial Sequence: Synthetic oligonucleotide
tgtctacctgtccacctgcaaggattcaaagaag

SEQ ID NO: 113731 - DNA, 33 bp, Artificial Sequence
  Description of Artificial Sequence: Synthetic oligonucleotide
gtctacctgtccacctgcaaggattcaaagaag

SEQ ID NO: 113732 - DNA, 36 bp, Artificial Sequence
  Description of Artificial Sequence: Synthetic oligonucleotide
tctacctgtccacctgcaaggattcaaagaagaaag

SEQ ID NO: 113733 - DNA, 35 bp, Artificial Sequence
  Description of Artificial Sequence: Synthetic oligonucleotide
ctacctgtccacctgcaaggattcaaagaagaaag

SEQ ID NO: 113734 - DNA, 35 bp, Artificial Sequence
  Description of Artificial Sequence: Synthetic oligonucleotide
tacctgtccacctgcaaggattcaaagaagaaagc

SEQ ID NO: 113735 - DNA, 34 bp, Artificial Sequence
  Description of Artificial Sequence: Synthetic oligonucleotide
acctgtccacctgcaaggattcaaagaagaaagc

SEQ ID NO: 113736 - DNA, 33 bp, Artificial Sequence
  Description of Artificial Sequence: Synthetic oligonucleotide
cctgtccacctgcaaggattcaaagaagaaagc

SEQ ID NO: 113737 - DNA, 34 bp, Artificial Sequence
  Description of Artificial Sequence: Synthetic oligonucleotide
ctgtccacctgcaaggattcaaagaagaaagcag

SEQ ID NO: 113738 - DNA, 35 bp, Artificial Sequence
  Description of Artificial Sequence: Synthetic oligonucleotide
tgtccacctgcaaggattcaaagaagaaagcagag

SEQ ID NO: 113739 - DNA, 34 bp, Artificial Sequence
  Description of Artificial Sequence: Synthetic oligonucleotide
gtccacctgcaaggattcaaagaagaaagcagag

SEQ ID NO: 113740 - DNA, 35 bp, Artificial Sequence
  Description of Artificial Sequence: Synthetic oligonucleotide
tccacctgcaaggattcaaagaagaaagcagagtg

SEQ ID NO: 113741 - DNA, 34 bp, Artificial Sequence
  Description of Artificial Sequence: Synthetic oligonucleotide
ccacctgcaaggattcaaagaagaaagcagagtg

SEQ ID NO: 113742 - DNA, 33 bp, Artificial Sequence
  Description of Artificial Sequence: Synthetic oligonucleotide
tctacctgtccacctgcaaggattcaaagaagg

SEQ ID NO: 113743 - DNA, 32 bp, Artificial Sequence
  Description of Artificial Sequence: Synthetic oligonucleotide
ctacctgtccacctgcaaggattcaaagaagg

SEQ ID NO: 113744 - DNA, 34 bp, Artificial Sequence
  Description of Artificial Sequence: Synthetic oligonucleotide
tacctgtccacctgcaaggattcaaagaaggtac

SEQ ID NO: 113745 - DNA, 33 bp, Artificial Sequence
  Description of Artificial Sequence: Synthetic oligonucleotide
acctgtccacctgcaaggattcaaagaaggtac

SEQ ID NO: 113746 - DNA, 32 bp, Artificial Sequence
  Description of Artificial Sequence: Synthetic oligonucleotide
cctgtccacctgcaaggattcaaagaaggtac

SEQ ID NO: 113747 - DNA, 33 bp, Artificial Sequence
  Description of Artificial Sequence: Synthetic oligonucleotide
ctgtccacctgcaaggattcaaagaaggtacag

SEQ ID NO: 113748 - DNA, 34 bp, Artificial Sequence
  Description of Artificial Sequence: Synthetic oligonucleotide
tgtccacctgcaaggattcaaagaaggtacagtg

SEQ ID NO: 113749 - DNA, 33 bp, Artificial Sequence
  Description of Artificial Sequence: Synthetic oligonucleotide
gtccacctgcaaggattcaaagaaggtacagtg

SEQ ID NO: 113750 - DNA, 33 bp, Artificial Sequence
  Description of Artificial Sequence: Synthetic oligonucleotide
tccacctgcaaggattcaaagaaggtacagtgc

SEQ ID NO: 113751 - DNA, 32 bp, Artificial Sequence
  Description of Artificial Sequence: Synthetic oligonucleotide
ccacctgcaaggattcaaagaaggtacagtgc

SEQ ID NO: 113752 - DNA, 33 bp, Artificial Sequence
  Description of Artificial Sequence: Synthetic oligonucleotide
cacctgcaaggattcaaagaaggtacagtgctc

SEQ ID NO: 113753 - DNA, 33 bp, Artificial Sequence
  Description of Artificial Sequence: Synthetic oligonucleotide
acctgcaaggattcaaagaaggtacagtgctcc

SEQ ID NO: 113754 - DNA, 32 bp, Artificial Sequence
  Description of Artificial Sequence: Synthetic oligonucleotide
cctgcaaggattcaaagaaggtacagtgctcc

SEQ ID NO: 113755 - DNA, 33 bp, Artificial Sequence
  Description of Artificial Sequence: Synthetic oligonucleotide
ctgcaaggattcaaagaaggtacagtgctccac

SEQ ID NO: 113756 - DNA, 33 bp, Artificial Sequence
  Description of Artificial Sequence: Synthetic oligonucleotide
tgcaaggattcaaagaaggtacagtgctccacc

SEQ ID NO: 113757 - DNA, 32 bp, Artificial Sequence
  Description of Artificial Sequence: Synthetic oligonucleotide
gcaaggattcaaagaaggtacagtgctccacc

SEQ ID NO: 113758 - DNA, 33 bp, Artificial Sequence
  Description of Artificial Sequence: Synthetic oligonucleotide
caaggattcaaagaaggtacagtgctccacctc

SEQ ID NO: 113759 - DNA, 34 bp, Artificial Sequence
  Description of Artificial Sequence: Synthetic oligonucleotide
aaggattcaaagaaggtacagtgctccacctctc

SEQ ID NO: 113760 - DNA, 33 bp, Artificial Sequence
  Description of Artificial Sequence: Synthetic oligonucleotide
aggattcaaagaaggtacagtgctccacctctc

SEQ ID NO: 113761 - DNA, 32 bp, Artificial Sequence
  Description of Artificial Sequence: Synthetic oligonucleotide
ggattcaaagaaggtacagtgctccacctctc

SEQ ID NO: 113762 - DNA, 33 bp, Artificial Sequence
  Description of Artificial Sequence: Synthetic oligonucleotide
gattcaaagaaggtacagtgctccacctctctg

SEQ ID NO: 113763 - DNA, 36 bp, Artificial Sequence
  Description of Artificial Sequence: Synthetic oligonucleotide
attcaaagaaggtacagtgctccacctctctgtatc

SEQ ID NO: 113764 - DNA, 35 bp, Artificial Sequence
  Description of Artificial Sequence: Synthetic oligonucleotide
ttcaaagaaggtacagtgctccacctctctgtatc

SEQ ID NO: 113765 - DNA, 34 bp, Artificial Sequence
  Description of Artificial Sequence: Synthetic oligonucleotide
tcaaagaaggtacagtgctccacctctctgtatc

SEQ ID NO: 113766 - DNA, 33 bp, Artificial Sequence
  Description of Artificial Sequence: Synthetic oligonucleotide
caaagaaggtacagtgctccacctctctgtatc

SEQ ID NO: 113767 - DNA, 36 bp, Artificial Sequence
  Description of Artificial Sequence: Synthetic oligonucleotide
aaagaaggtacagtgctccacctctctgtatctttc

SEQ ID NO: 113768 - DNA, 35 bp, Artificial Sequence
  Description of Artificial Sequence: Synthetic oligonucleotide
aagaaggtacagtgctccacctctctgtatctttc

SEQ ID NO: 113769 - DNA, 34 bp, Artificial Sequence
  Description of Artificial Sequence: Synthetic oligonucleotide
agaaggtacagtgctccacctctctgtatctttc

SEQ ID NO: 113770 - DNA, 33 bp, Artificial Sequence
  Description of Artificial Sequence: Synthetic oligonucleotide
gaaggtacagtgctccacctctctgtatctttc

SEQ ID NO: 113771 - DNA, 33 bp, Artificial Sequence
  Description of Artificial Sequence: Synthetic oligonucleotide
aaggtacagtgctccacctctctgtatctttcc

SEQ ID NO: 113772 - DNA, 32 bp, Artificial Sequence
  Description of Artificial Sequence: Synthetic oligonucleotide
aggtacagtgctccacctctctgtatctttcc

SEQ ID NO: 113773 - DNA, 31 bp, Artificial Sequence
  Description of Artificial Sequence: Synthetic oligonucleotide
ggtacagtgctccacctctctgtatctttcc

SEQ ID NO: 113774 - DNA, 31 bp, Artificial Sequence
  Description of Artificial Sequence: Synthetic oligonucleotide
gtacagtgctccacctctctgtatctttccc

SEQ ID NO: 113775 - DNA, 33 bp, Artificial Sequence
  Description of Artificial Sequence: Synthetic oligonucleotide
tacagtgctccacctctctgtatctttcccttg

SEQ ID NO: 113776 - DNA, 32 bp, Artificial Sequence
  Description of Artificial Sequence: Synthetic oligonucleotide
acagtgctccacctctctgtatctttcccttg

SEQ ID NO: 113777 - DNA, 31 bp, Artificial Sequence
  Description of Artificial Sequence: Synthetic oligonucleotide
cagtgctccacctctctgtatctttcccttg

SEQ ID NO: 113778 - DNA, 32 bp, Artificial Sequence
  Description of Artificial Sequence: Synthetic oligonucleotide
agtgctccacctctctgtatctttcccttgtc

SEQ ID NO: 113779 - DNA, 31 bp, Artificial Sequence
  Description of Artificial Sequence: Synthetic oligonucleotide
gtgctccacctctctgtatctttcccttgtc

SEQ ID NO: 113780 - DNA, 32 bp, Artificial Sequence
  Description of Artificial Sequence: Synthetic oligonucleotide
tgctccacctctctgtatctttcccttgtcac

SEQ ID NO: 113781 - DNA, 31 bp, Artificial Sequence
  Description of Artificial Sequence: Synthetic oligonucleotide
gctccacctctctgtatctttcccttgtcac

SEQ ID NO: 113782 - DNA, 36 bp, Artificial Sequence
  Description of Artificial Sequence: Synthetic oligonucleotide
ctccacctctctgtatctttcccttgtcactttatc

SEQ ID NO: 113783 - DNA, 37 bp, Artificial Sequence
  Description of Artificial Sequence: Synthetic oligonucleotide
tccacctctctgtatctttcccttgtcactttatctc

SEQ ID NO: 113784 - DNA, 36 bp, Artificial Sequence
  Description of Artificial Sequence: Synthetic oligonucleotide
ccacctctctgtatctttcccttgtcactttatctc

SEQ ID NO: 113785 - DNA, 36 bp, Artificial Sequence
  Description of Artificial Sequence: Synthetic oligonucleotide
cacctctctgtatctttcccttgtcactttatctcc

SEQ ID NO: 113786 - DNA, 37 bp, Artificial Sequence
  Description of Artificial Sequence: Synthetic oligonucleotide
acctctctgtatctttcccttgtcactttatctcctc

SEQ ID NO: 113787 - DNA, 36 bp, Artificial Sequence
  Description of Artificial Sequence: Synthetic oligonucleotide
cctctctgtatctttcccttgtcactttatctcctc

SEQ ID NO: 113788 - DNA, 38 bp, Artificial Sequence
  Description of Artificial Sequence: Synthetic oligonucleotide
ctctctgtatctttcccttgtcactttatctcctcatc

SEQ ID NO: 113789 - DNA, 38 bp, Artificial Sequence
  Description of Artificial Sequence: Synthetic oligonucleotide
tctctgtatctttcccttgtcactttatctcctcatcc

SEQ ID NO: 113790 - DNA, 37 bp, Artificial Sequence
  Description of Artificial Sequence: Synthetic oligonucleotide
ctctgtatctttcccttgtcactttatctcctcatcc

SEQ ID NO: 113791 - DNA, 40 bp, Artificial Sequence
  Description of Artificial Sequence: Synthetic oligonucleotide
tctgtatctttcccttgtcactttatctcctcatcctatc

SEQ ID NO: 113792 - DNA, 39 bp, Artificial Sequence
  Description of Artificial Sequence: Synthetic oligonucleotide
ctgtatctttcccttgtcactttatctcctcatcctatc

SEQ ID NO: 113793 - DNA, 40 bp, Artificial Sequence
  Description of Artificial Sequence: Synthetic oligonucleotide
tgtatctttcccttgtcactttatctcctcatcctatctc

SEQ ID NO: 113794 - DNA, 39 bp, Artificial Sequence
  Description of Artificial Sequence: Synthetic oligonucleotide
gtatctttcccttgtcactttatctcctcatcctatctc

SEQ ID NO: 113795 - DNA, 43 bp, Artificial Sequence
  Description of Artificial Sequence: Synthetic oligonucleotide
tatctttcccttgtcactttatctcctcatcctatctcaaaac

SEQ ID NO: 113796 - DNA, 42 bp, Artificial Sequence
  Description of Artificial Sequence: Synthetic oligonucleotide
atctttcccttgtcactttatctcctcatcctatctcaaaac

SEQ ID NO: 113797 - DNA, 41 bp, Artificial Sequence
  Description of Artificial Sequence: Synthetic oligonucleotide
tctttcccttgtcactttatctcctcatcctatctcaaaac

SEQ ID NO: 113798 - DNA, 40 bp, Artificial Sequence
  Description of Artificial Sequence: Synthetic oligonucleotide
ctttcccttgtcactttatctcctcatcctatctcaaaac

SEQ ID NO: 113799 - DNA, 40 bp, Artificial Sequence
  Description of Artificial Sequence: Synthetic oligonucleotide
tttcccttgtcactttatctcctcatcctatctcaaaacc

SEQ ID NO: 113800 - DNA, 39 bp, Artificial Sequence
  Description of Artificial Sequence: Synthetic oligonucleotide
ttcccttgtcactttatctcctcatcctatctcaaaacc

SEQ ID NO: 113801 - DNA, 38 bp, Artificial Sequence
  Description of Artificial Sequence: Synthetic oligonucleotide
tcccttgtcactttatctcctcatcctatctcaaaacc

SEQ ID NO: 113802 - DNA, 37 bp, Artificial Sequence
  Description of Artificial Sequence: Synthetic oligonucleotide
cccttgtcactttatctcctcatcctatctcaaaacc

SEQ ID NO: 113803 - DNA, 37 bp, Artificial Sequence
  Description of Artificial Sequence: Synthetic oligonucleotide
ccttgtcactttatctcctcatcctatctcaaaaccc

SEQ ID NO: 113804 - DNA, 39 bp, Artificial Sequence
  Description of Artificial Sequence: Synthetic oligonucleotide
cttgtcactttatctcctcatcctatctcaaaacccatg

SEQ ID NO: 113805 - DNA, 39 bp, Artificial Sequence
  Description of Artificial Sequence: Synthetic oligonucleotide
ttgtcactttatctcctcatcctatctcaaaacccatgg

SEQ ID NO: 113806 - DNA, 38 bp, Artificial Sequence
  Description of Artificial Sequence: Synthetic oligonucleotide
tgtcactttatctcctcatcctatctcaaaacccatgg

SEQ ID NO: 113807 - DNA, 37 bp, Artificial Sequence
  Description of Artificial Sequence: Synthetic oligonucleotide
gtcactttatctcctcatcctatctcaaaacccatgg

SEQ ID NO: 113808 - DNA, 38 bp, Artificial Sequence
  Description of Artificial Sequence: Synthetic oligonucleotide
tcactttatctcctcatcctatctcaaaacccatggag

SEQ ID NO: 113809 - DNA, 37 bp, Artificial Sequence
  Description of Artificial Sequence: Synthetic oligonucleotide
cactttatctcctcatcctatctcaaaacccatggag

SEQ ID NO: 113810 - DNA, 37 bp, Artificial Sequence
  Description of Artificial Sequence: Synthetic oligonucleotide
actttatctcctcatcctatctcaaaacccatggagg

SEQ ID NO: 113811 - DNA, 36 bp, Artificial Sequence
  Description of Artificial Sequence: Synthetic oligonucleotide
ctttatctcctcatcctatctcaaaacccatggagg

SEQ ID NO: 113812 - DNA, 36 bp, Artificial Sequence
  Description of Artificial Sequence: Synthetic oligonucleotide
tttatctcctcatcctatctcaaaacccatggaggg

SEQ ID NO: 113813 - DNA, 35 bp, Artificial Sequence
  Description of Artificial Sequence: Synthetic oligonucleotide
ttatctcctcatcctatctcaaaacccatggaggg

SEQ ID NO: 113814 - DNA, 34 bp, Artificial Sequence
  Description of Artificial Sequence: Synthetic oligonucleotide
tatctcctcatcctatctcaaaacccatggaggg

SEQ ID NO: 113815 - DNA, 33 bp, Artificial Sequence
  Description of Artificial Sequence: Synthetic oligonucleotide
atctcctcatcctatctcaaaacccatggaggg

SEQ ID NO: 113816 - DNA, 32 bp, Artificial Sequence
  Description of Artificial Sequence: Synthetic oligonucleotide
tctcctcatcctatctcaaaacccatggaggg

SEQ ID NO: 113817 - DNA, 31 bp, Artificial Sequence
  Description of Artificial Sequence: Synthetic oligonucleotide
ctcctcatcctatctcaaaacccatggaggg

SEQ ID NO: 113818 - DNA, 32 bp, Artificial Sequence
  Description of Artificial Sequence: Synthetic oligonucleotide
tcctcatcctatctcaaaacccatggagggag

SEQ ID NO: 113819 - DNA, 31 bp, Artificial Sequence
  Description of Artificial Sequence: Synthetic oligonucleotide
cctcatcctatctcaaaacccatggagggag

SEQ ID NO: 113820 - DNA, 31 bp, Artificial Sequence
  Description of Artificial Sequence: Synthetic oligonucleotide
ctcatcctatctcaaaacccatggagggagg

SEQ ID NO: 113821 - DNA, 31 bp, Artificial Sequence
  Description of Artificial Sequence: Synthetic oligonucleotide
tcatcctatctcaaaacccatggagggaggc

SEQ ID NO: 113822 - DNA, 30 bp, Artificial Sequence
  Description of Artificial Sequence: Synthetic oligonucleotide
catcctatctcaaaacccatggagggaggc

SEQ ID NO: 113823 - DNA, 31 bp, Artificial Sequence
  Description of Artificial Sequence: Synthetic oligonucleotide
atcctatctcaaaacccatggagggaggctg

SEQ ID NO: 113824 - DNA, 30 bp, Artificial Sequence
  Description of Artificial Sequence: Synthetic oligonucleotide
tcctatctcaaaacccatggagggaggctg

SEQ ID NO: 113825 - DNA, 29 bp, Artificial Sequence
  Description of Artificial Sequence: Synthetic oligonucleotide
cctatctcaaaacccatggagggaggctg

SEQ ID NO: 113826 - DNA, 29 bp, Artificial Sequence
  Description of Artificial Sequence: Synthetic oligonucleotide
ctatctcaaaacccatggagggaggctgc

SEQ ID NO: 113827 - DNA, 30 bp, Artificial Sequence
  Description of Artificial Sequence: Synthetic oligonucleotide
tatctcaaaacccatggagggaggctgctg

SEQ ID NO: 113828 - DNA, 29 bp, Artificial Sequence
  Description of Artificial Sequence: Synthetic oligonucleotide
atctcaaaacccatggagggaggctgctg

SEQ ID NO: 113829 - DNA, 28 bp, Artificial Sequence
  Description of Artificial Sequence: Synthetic oligonucleotide
tctcaaaacccatggagggaggctgctg

SEQ ID NO: 113830 - DNA, 27 bp, Artificial Sequence
  Description of Artificial Sequence: Synthetic oligonucleotide
ctcaaaacccatggagggaggctgctg

SEQ ID NO: 113831 - DNA, 27 bp, Artificial Sequence
  Description of Artificial Sequence: Synthetic oligonucleotide
tcaaaacccatggagggaggctgctgg

SEQ ID NO: 113832 - DNA, 27 bp, Artificial Sequence
  Description of Artificial Sequence: Synthetic oligonucleotide
caaaacccatggagggaggctgctggt

SEQ ID NO: 113833 - DNA, 27 bp, Artificial Sequence
  Description of Artificial Sequence: Synthetic oligonucleotide
aaaacccatggagggaggctgctggtg

SEQ ID NO: 113834 - DNA, 27 bp, Artificial Sequence
  Description of Artificial Sequence: Synthetic oligonucleotide
aaacccatggagggaggctgctggtgt

SEQ ID NO: 113835 - DNA, 26 bp, Artificial Sequence
  Description of Artificial Sequence: Synthetic oligonucleotide
aacccatggagggaggctgctggtgt

SEQ ID NO: 113836 - DNA, 25 bp, Artificial Sequence
  Description of Artificial Sequence: Synthetic oligonucleotide
acccatggagggaggctgctggtgt

SEQ ID NO: 113837 - DNA, 24 bp, Artificial Sequence
  Description of Artificial Sequence: Synthetic oligonucleotide
cccatggagggaggctgctggtgt

SEQ ID NO: 113838 - DNA, 24 bp, Artificial Sequence
  Description of Artificial Sequence: Synthetic oligonucleotide
ccatggagggaggctgctggtgtg

SEQ ID NO: 113839 - DNA, 26 bp, Artificial Sequence
  Description of Artificial Sequence: Synthetic oligonucleotide
catggagggaggctgctggtgtggta

SEQ ID NO: 113840 - DNA, 26 bp, Artificial Sequence
  Description of Artificial Sequence: Synthetic oligonucleotide
atggagggaggctgctggtgtggtag

SEQ ID NO: 113841 - DNA, 25 bp, Artificial Sequence
  Description of Artificial Sequence: Synthetic oligonucleotide
tggagggaggctgctggtgtggtag

SEQ ID NO: 113842 - DNA, 24 bp, Artificial Sequence
  Description of Artificial Sequence: Synthetic oligonucleotide
ggagggaggctgctggtgtggtag

SEQ ID NO: 113843 - DNA, 24 bp, Artificial Sequence
  Description of Artificial Sequence: Synthetic oligonucleotide
gagggaggctgctggtgtggtagg

SEQ ID NO: 113844 - DNA, 25 bp, Artificial Sequence
  Description of Artificial Sequence: Synthetic oligonucleotide
agggaggctgctggtgtggtaggca

SEQ ID NO: 113845 - DNA, 24 bp, Artificial Sequence
  Description of Artificial Sequence: Synthetic oligonucleotide
gggaggctgctggtgtggtaggca

SEQ ID NO: 113846 - DNA, 26 bp, Artificial Sequence
  Description of Artificial Sequence: Synthetic oligonucleotide
ggaggctgctggtgtggtaggcagaa

SEQ ID NO: 113847 - DNA, 26 bp, Artificial Sequence
  Description of Artificial Sequence: Synthetic oligonucleotide
gaggctgctggtgtggtaggcagaac

SEQ ID NO: 113848 - DNA, 27 bp, Artificial Sequence
  Description of Artificial Sequence: Synthetic oligonucleotide
aggctgctggtgtggtaggcagaacct

SEQ ID NO: 113849 - DNA, 27 bp, Artificial Sequence
  Description of Artificial Sequence: Synthetic oligonucleotide
ggctgctggtgtggtaggcagaaccta

SEQ ID NO: 113850 - DNA, 27 bp, Artificial Sequence
  Description of Artificial Sequence: Synthetic oligonucleotide
gctgctggtgtggtaggcagaacctag

SEQ ID NO: 113851 - DNA, 27 bp, Artificial Sequence
  Description of Artificial Sequence: Synthetic oligonucleotide
ctgctggtgtggtaggcagaacctagg

SEQ ID NO: 113852 - DNA, 27 bp, Artificial Sequence
  Description of Artificial Sequence: Synthetic oligonucleotide
tgctggtgtggtaggcagaacctaggc

SEQ ID NO: 113853 - DNA, 27 bp, Artificial Sequence
  Description of Artificial Sequence: Synthetic oligonucleotide
gctggtgtggtaggcagaacctaggct

SEQ ID NO: 113854 - DNA, 28 bp, Artificial Sequence
  Description of Artificial Sequence: Synthetic oligonucleotide
ctggtgtggtaggcagaacctaggcttg

SEQ ID NO: 113855 - DNA, 28 bp, Artificial Sequence
  Description of Artificial Sequence: Synthetic oligonucleotide
tggtgtggtaggcagaacctaggcttgg

SEQ ID NO: 113856 - DNA, 27 bp, Artificial Sequence
  Description of Artificial Sequence: Synthetic oligonucleotide
ggtgtggtaggcagaacctaggcttgg

SEQ ID NO: 113857 - DNA, 31 bp, Artificial Sequence
  Description of Artificial Sequence: Synthetic oligonucleotide
gtgtggtaggcagaacctaggcttggaattc

SEQ ID NO: 113858 - DNA, 32 bp, Artificial Sequence
  Description of Artificial Sequence: Synthetic oligonucleotide
tgtggtaggcagaacctaggcttggaattcac

SEQ ID NO: 113859 - DNA, 31 bp, Artificial Sequence
  Description of Artificial Sequence: Synthetic oligonucleotide
gtggtaggcagaacctaggcttggaattcac

SEQ ID NO: 113860 - DNA, 32 bp, Artificial Sequence
  Description of Artificial Sequence: Synthetic oligonucleotide
tggtaggcagaacctaggcttggaattcacac

SEQ ID NO: 113861 - DNA, 31 bp, Artificial Sequence
  Description of Artificial Sequence: Synthetic oligonucleotide
ggtaggcagaacctaggcttggaattcacac

SEQ ID NO: 113862 - DNA, 32 bp, Artificial Sequence
  Description of Artificial Sequence: Synthetic oligonucleotide
gtaggcagaacctaggcttggaattcacactg

SEQ ID NO: 113863 - DNA, 34 bp, Artificial Sequence
  Description of Artificial Sequence: Synthetic oligonucleotide
taggcagaacctaggcttggaattcacactgatc

SEQ ID NO: 113864 - DNA, 33 bp, Artificial Sequence
  Description of Artificial Sequence: Synthetic oligonucleotide
aggcagaacctaggcttggaattcacactgatc

SEQ ID NO: 113865 - DNA, 32 bp, Artificial Sequence
  Description of Artificial Sequence: Synthetic oligonucleotide
ggcagaacctaggcttggaattcacactgatc

SEQ ID NO: 113866 - DNA, 33 bp, Artificial Sequence
  Description of Artificial Sequence: Synthetic oligonucleotide
gcagaacctaggcttggaattcacactgatctg

SEQ ID NO: 113867 - DNA, 33 bp, Artificial Sequence
  Description of Artificial Sequence: Synthetic oligonucleotide
cagaacctaggcttggaattcacactgatctgg

SEQ ID NO: 113868 - DNA, 33 bp, Artificial Sequence
  Description of Artificial Sequence: Synthetic oligonucleotide
agaacctaggcttggaattcacactgatctggg

SEQ ID NO: 113869 - DNA, 32 bp, Artificial Sequence
  Description of Artificial Sequence: Synthetic oligonucleotide
gaacctaggcttggaattcacactgatctggg

SEQ ID NO: 113870 - DNA, 38 bp, Artificial Sequence
  Description of Artificial Sequence: Synthetic oligonucleotide
aacctaggcttggaattcacactgatctgggttaaaac

SEQ ID NO: 113871 - DNA, 37 bp, Artificial Sequence
  Description of Artificial Sequence: Synthetic oligonucleotide
acctaggcttggaattcacactgatctgggttaaaac

SEQ ID NO: 113872 - DNA, 36 bp, Artificial Sequence
  Description of Artificial Sequence: Synthetic oligonucleotide
cctaggcttggaattcacactgatctgggttaaaac

SEQ ID NO: 113873 - DNA, 36 bp, Artificial Sequence
  Description of Artificial Sequence: Synthetic oligonucleotide
ctaggcttggaattcacactgatctgggttaaaacc

SEQ ID NO: 113874 - DNA, 37 bp, Artificial Sequence
  Description of Artificial Sequence: Synthetic oligonucleotide
taggcttggaattcacactgatctgggttaaaacctg

SEQ ID NO: 113875 - DNA, 36 bp, Artificial Sequence
  Description of Artificial Sequence: Synthetic oligonucleotide
aggcttggaattcacactgatctgggttaaaacctg

SEQ ID NO: 113876 - DNA, 35 bp, Artificial Sequence
  Description of Artificial Sequence: Synthetic oligonucleotide
ggcttggaattcacactgatctgggttaaaacctg

SEQ ID NO: 113877 - DNA, 35 bp, Artificial Sequence
  Description of Artificial Sequence: Synthetic oligonucleotide
gcttggaattcacactgatctgggttaaaacctgg

SEQ ID NO: 113878 - DNA, 35 bp, Artificial Sequence
  Description of Artificial Sequence: Synthetic oligonucleotide
cttggaattcacactgatctgggttaaaacctggc

SEQ ID NO: 113879 - DNA, 36 bp, Artificial Sequence
  Description of Artificial Sequence: Synthetic oligonucleotide
ttggaattcacactgatctgggttaaaacctggcac

SEQ ID NO: 113880 - DNA, 35 bp, Artificial Sequence
  Description of Artificial Sequence: Synthetic oligonucleotide
tggaattcacactgatctgggttaaaacctggcac

SEQ ID NO: 113881 - DNA, 34 bp, Artificial Sequence
  Description of Artificial Sequence: Synthetic oligonucleotide
ggaattcacactgatctgggttaaaacctggcac

SEQ ID NO: 113882 - DNA, 39 bp, Artificial Sequence
  Description of Artificial Sequence: Synthetic oligonucleotide
gaattcacactgatctgggttaaaacctggcactatatc

SEQ ID NO: 113883 - DNA, 39 bp, Artificial Sequence
  Description of Artificial Sequence: Synthetic oligonucleotide
aattcacactgatctgggttaaaacctggcactatatcc

SEQ ID NO: 113884 - DNA, 38 bp, Artificial Sequence
  Description of Artificial Sequence: Synthetic oligonucleotide
attcacactgatctgggttaaaacctggcactatatcc

SEQ ID NO: 113885 - DNA, 37 bp, Artificial Sequence
  Description of Artificial Sequence: Synthetic oligonucleotide
ttcacactgatctgggttaaaacctggcactatatcc

SEQ ID NO: 113886 - DNA, 36 bp, Artificial Sequence
  Description of Artificial Sequence: Synthetic oligonucleotide
tcacactgatctgggttaaaacctggcactatatcc

SEQ ID NO: 113887 - DNA, 35 bp, Artificial Sequence
  Description of Artificial Sequence: Synthetic oligonucleotide
cacactgatctgggttaaaacctggcactatatcc

SEQ ID NO: 113888 - DNA, 38 bp, Artificial Sequence
  Description of Artificial Sequence: Synthetic oligonucleotide
acactgatctgggttaaaacctggcactatatcctaac

SEQ ID NO: 113889 - DNA, 37 bp, Artificial Sequence
  Description of Artificial Sequence: Synthetic oligonucleotide
cactgatctgggttaaaacctggcactatatcctaac

SEQ ID NO: 113890 - DNA, 38 bp, Artificial Sequence
  Description of Artificial Sequence: Synthetic oligonucleotide
actgatctgggttaaaacctggcactatatcctaactg

SEQ ID NO: 113891 - DNA, 37 bp, Artificial Sequence
  Description of Artificial Sequence: Synthetic oligonucleotide
ctgatctgggttaaaacctggcactatatcctaactg

SEQ ID NO: 113892 - DNA, 39 bp, Artificial Sequence
  Description of Artificial Sequence: Synthetic oligonucleotide
tgatctgggttaaaacctggcactatatcctaactgtag

SEQ ID NO: 113893 - DNA, 38 bp, Artificial Sequence
  Description of Artificial Sequence: Synthetic oligonucleotide
gatctgggttaaaacctggcactatatcctaactgtag

SEQ ID NO: 113894 - DNA, 38 bp, Artificial Sequence
  Description of Artificial Sequence: Synthetic oligonucleotide
atctgggttaaaacctggcactatatcctaactgtagg

SEQ ID NO: 113895 - DNA, 37 bp, Artificial Sequence
  Description of Artificial Sequence: Synthetic oligonucleotide
tctgggttaaaacctggcactatatcctaactgtagg

SEQ ID NO: 113896 - DNA, 36 bp, Artificial Sequence
  Description of Artificial Sequence: Synthetic oligonucleotide
ctgggttaaaacctggcactatatcctaactgtagg

SEQ ID NO: 113897 - DNA, 37 bp, Artificial Sequence
  Description of Artificial Sequence: Synthetic oligonucleotide
tgggttaaaacctggcactatatcctaactgtaggac

SEQ ID NO: 113898 - DNA, 36 bp, Artificial Sequence
  Description of Artificial Sequence: Synthetic oligonucleotide
gggttaaaacctggcactatatcctaactgtaggac

SEQ ID NO: 113899 - DNA, 37 bp, Artificial Sequence
  Description of Artificial Sequence: Synthetic oligonucleotide
ggttaaaacctggcactatatcctaactgtaggactc

SEQ ID NO: 113900 - DNA, 40 bp, Artificial Sequence
  Description of Artificial Sequence: Synthetic oligonucleotide
gttaaaacctggcactatatcctaactgtaggactctttg

SEQ ID NO: 113901 - DNA, 41 bp, Artificial Sequence
  Description of Artificial Sequence: Synthetic oligonucleotide
ttaaaacctggcactatatcctaactgtaggactctttgag

SEQ ID NO: 113902 - DNA, 40 bp, Artificial Sequence
  Description of Artificial Sequence: Synthetic oligonucleotide
taaaacctggcactatatcctaactgtaggactctttgag

SEQ ID NO: 113903 - DNA, 39 bp, Artificial Sequence
  Description of Artificial Sequence: Synthetic oligonucleotide
aaaacctggcactatatcctaactgtaggactctttgag

SEQ ID NO: 113904 - DNA, 38 bp, Artificial Sequence
  Description of Artificial Sequence: Synthetic oligonucleotide
aaacctggcactatatcctaactgtaggactctttgag

SEQ ID NO: 113905 - DNA, 37 bp, Artificial Sequence
  Description of Artificial Sequence: Synthetic oligonucleotide
aacctggcactatatcctaactgtaggactctttgag

SEQ ID NO: 113906 - DNA, 36 bp, Artificial Sequence
  Description of Artificial Sequence: Synthetic oligonucleotide
acctggcactatatcctaactgtaggactctttgag

SEQ ID NO: 113907 - DNA, 35 bp, Artificial Sequence
  Description of Artificial Sequence: Synthetic oligonucleotide
cctggcactatatcctaactgtaggactctttgag

SEQ ID NO: 113908 - DNA, 35 bp, Artificial Sequence
  Description of Artificial Sequence: Synthetic oligonucleotide
ctggcactatatcctaactgtaggactctttgagc

SEQ ID NO: 113909 - DNA, 37 bp, Artificial Sequence
  Description of Artificial Sequence: Synthetic oligonucleotide
tggcactatatcctaactgtaggactctttgagcatg

SEQ ID NO: 113910 - DNA, 36 bp, Artificial Sequence
  Description of Artificial Sequence: Synthetic oligonucleotide
ggcactatatcctaactgtaggactctttgagcatg

SEQ ID NO: 113911 - DNA, 36 bp, Artificial Sequence
  Description of Artificial Sequence: Synthetic oligonucleotide
gcactatatcctaactgtaggactctttgagcatgc

SEQ ID NO: 113912 - DNA, 38 bp, Artificial Sequence
  Description of Artificial Sequence: Synthetic oligonucleotide
cactatatcctaactgtaggactctttgagcatgctac

SEQ ID NO: 113913 - DNA, 30 bp, Artificial Sequence
  Description of Artificial Sequence: Synthetic oligonucleotide
gaccctgagctctatctcagtgtacacgtg

SEQ ID NO: 113914 - DNA, 30 bp, Artificial Sequence
  Description of Artificial Sequence: Synthetic oligonucleotide
accctgagctctatctcagtgtacacgtgg

SEQ ID NO: 113915 - DNA, 29 bp, Artificial Sequence
  Description of Artificial Sequence: Synthetic oligonucleotide
ccctgagctctatctcagtgtacacgtgg

SEQ ID NO: 113916 - DNA, 31 bp, Artificial Sequence
  Description of Artificial Sequence: Synthetic oligonucleotide
cctgagctctatctcagtgtacacgtggtac

SEQ ID NO: 113917 - DNA, 32 bp, Artificial Sequence
  Description of Artificial Sequence: Synthetic oligonucleotide
ctgagctctatctcagtgtacacgtggtactg

SEQ ID NO: 113918 - DNA, 33 bp, Artificial Sequence
  Description of Artificial Sequence: Synthetic oligonucleotide
tgagctctatctcagtgtacacgtggtactgac

SEQ ID NO: 113919 - DNA, 32 bp, Artificial Sequence
  Description of Artificial Sequence: Synthetic oligonucleotide
gagctctatctcagtgtacacgtggtactgac

SEQ ID NO: 113920 - DNA, 33 bp, Artificial Sequence
  Description of Artificial Sequence: Synthetic oligonucleotide
agctctatctcagtgtacacgtggtactgactg

SEQ ID NO: 113921 - DNA, 32 bp, Artificial Sequence
  Description of Artificial Sequence: Synthetic oligonucleotide
gctctatctcagtgtacacgtggtactgactg

SEQ ID NO: 113922 - DNA, 33 bp, Artificial Sequence
  Description of Artificial Sequence: Synthetic oligonucleotide
ctctatctcagtgtacacgtggtactgactgtc

SEQ ID NO: 113923 - DNA, 33 bp, Artificial Sequence
  Description of Artificial Sequence: Synthetic oligonucleotide
tctatctcagtgtacacgtggtactgactgtcc

SEQ ID NO: 113924 - DNA, 32 bp, Artificial Sequence
  Description of Artificial Sequence: Synthetic oligonucleotide
ctatctcagtgtacacgtggtactgactgtcc

SEQ ID NO: 113925 - DNA, 33 bp, Artificial Sequence
  Description of Artificial Sequence: Synthetic oligonucleotide
tatctcagtgtacacgtggtactgactgtcctc

SEQ ID NO: 113926 - DNA, 32 bp, Artificial Sequence
  Description of Artificial Sequence: Synthetic oligonucleotide
atctcagtgtacacgtggtactgactgtcctc

SEQ ID NO: 113927 - DNA, 31 bp, Artificial Sequence
  Description of Artificial Sequence: Synthetic oligonucleotide
tctcagtgtacacgtggtactgactgtcctc

SEQ ID NO: 113928 - DNA, 30 bp, Artificial Sequence
  Description of Artificial Sequence: Synthetic oligonucleotide
ctcagtgtacacgtggtactgactgtcctc

SEQ ID NO: 113929 - DNA, 31 bp, Artificial Sequence
  Description of Artificial Sequence: Synthetic oligonucleotide
tcagtgtacacgtggtactgactgtcctcac

SEQ ID NO: 113930 - DNA, 30 bp, Artificial Sequence
  Description of Artificial Sequence: Synthetic oligonucleotide
cagtgtacacgtggtactgactgtcctcac

SEQ ID NO: 113931 - DNA, 30 bp, Artificial Sequence
  Description of Artificial Sequence: Synthetic oligonucleotide
agtgtacacgtggtactgactgtcctcacc

SEQ ID NO: 113932 - DNA, 29 bp, Artificial Sequence
  Description of Artificial Sequence: Synthetic oligonucleotide
gtgtacacgtggtactgactgtcctcacc

SEQ ID NO: 113933 - DNA, 29 bp, Artificial Sequence
  Description of Artificial Sequence: Synthetic oligonucleotide
tgtacacgtggtactgactgtcctcaccc

SEQ ID NO: 113934 - DNA, 28 bp, Artificial Sequence
  Description of Artificial Sequence: Synthetic oligonucleotide
gtacacgtggtactgactgtcctcaccc

SEQ ID NO: 113935 - DNA, 29 bp, Artificial Sequence
  Description of Artificial Sequence: Synthetic oligonucleotide
tacacgtggtactgactgtcctcacccac

SEQ ID NO: 113936 - DNA, 28 bp, Artificial Sequence
  Description of Artificial Sequence: Synthetic oligonucleotide
acacgtggtactgactgtcctcacccac

SEQ ID NO: 113937 - DNA, 27 bp, Artificial Sequence
  Description of Artificial Sequence: Synthetic oligonucleotide
cacgtggtactgactgtcctcacccac

SEQ ID NO: 113938 - DNA, 28 bp, Artificial Sequence
  Description of Artificial Sequence: Synthetic oligonucleotide
acgtggtactgactgtcctcacccacac

SEQ ID NO: 113939 - DNA, 27 bp, Artificial Sequence
  Description of Artificial Sequence: Synthetic oligonucleotide
cgtggtactgactgtcctcacccacac

SEQ ID NO: 113940 - DNA, 24 bp, Artificial Sequence
  Description of Artificial Sequence: Synthetic oligonucleotide
atggccaccgctgcgactgaggag

SEQ ID NO: 113941 - DNA, 23 bp, Artificial Sequence
  Description of Artificial Sequence: Synthetic oligonucleotide
tggccaccgctgcgactgaggag

SEQ ID NO: 113942 - DNA, 22 bp, Artificial Sequence
  Description of Artificial Sequence: Synthetic oligonucleotide
ggccaccgctgcgactgaggag

SEQ ID NO: 113943 - DNA, 22 bp, Artificial Sequence
  Description of Artificial Sequence: Synthetic oligonucleotide
gccaccgctgcgactgaggagc

SEQ ID NO: 113944 - DNA, 22 bp, Artificial Sequence
  Description of Artificial Sequence: Synthetic oligonucleotide
ccaccgctgcgactgaggagcc

SEQ ID NO: 113945 - DNA, 24 bp, Artificial Sequence
  Description of Artificial Sequence: Synthetic oligonucleotide
caccgctgcgactgaggagccctt

SEQ ID NO: 113946 - DNA, 24 bp, Artificial Sequence
  Description of Artificial Sequence: Synthetic oligonucleotide
accgctgcgactgaggagcccttc

SEQ ID NO: 113947 - DNA, 23 bp, Artificial Sequence
  Description of Artificial Sequence: Synthetic oligonucleotide
ccgctgcgactgaggagcccttc

SEQ ID NO: 113948 - DNA, 23 bp, Artificial Sequence
  Description of Artificial Sequence: Synthetic oligonucleotide
cgctgcgactgaggagcccttcc

SEQ ID NO: 113949 - DNA, 27 bp, Artificial Sequence
  Description of Artificial Sequence: Synthetic oligonucleotide
gctgcgactgaggagcccttccctttt

SEQ ID NO: 113950 - DNA, 27 bp, Artificial Sequence
  Description of Artificial Sequence: Synthetic oligonucleotide
ctgcgactgaggagcccttcccttttc

SEQ ID NO: 113951 - DNA, 28 bp, Artificial Sequence
  Description of Artificial Sequence: Synthetic oligonucleotide
tgcgactgaggagcccttcccttttcac

SEQ ID NO: 113952 - DNA, 27 bp, Artificial Sequence
  Description of Artificial Sequence: Synthetic oligonucleotide
gcgactgaggagcccttcccttttcac

SEQ ID NO: 113953 - DNA, 27 bp, Artificial Sequence
  Description of Artificial Sequence: Synthetic oligonucleotide
cgactgaggagcccttcccttttcacg

SEQ ID NO: 113954 - DNA, 27 bp, Artificial Sequence
  Description of Artificial Sequence: Synthetic oligonucleotide
gactgaggagcccttcccttttcacgg

SEQ ID NO: 113955 - DNA, 28 bp, Artificial Sequence
  Description of Artificial Sequence: Synthetic oligonucleotide
actgaggagcccttcccttttcacggtc

SEQ ID NO: 113956 - DNA, 27 bp, Artificial Sequence
  Description of Artificial Sequence: Synthetic oligonucleotide
ctgaggagcccttcccttttcacggtc

SEQ ID NO: 113957 - DNA, 28 bp, Artificial Sequence
  Description of Artificial Sequence: Synthetic oligonucleotide
tgaggagcccttcccttttcacggtctc

SEQ ID NO: 113958 - DNA, 27 bp, Artificial Sequence
  Description of Artificial Sequence: Synthetic oligonucleotide
gaggagcccttcccttttcacggtctc

SEQ ID NO: 113959 - DNA, 27 bp, Artificial Sequence
  Description of Artificial Sequence: Synthetic oligonucleotide
aggagcccttcccttttcacggtctcc

SEQ ID NO: 113960 - DNA, 27 bp, Artificial Sequence
  Description of Artificial Sequence: Synthetic oligonucleotide
ggagcccttcccttttcacggtctcct

SEQ ID NO: 113961 - DNA, 27 bp, Artificial Sequence
  Description of Artificial Sequence: Synthetic oligonucleotide
gagcccttcccttttcacggtctcctg

SEQ ID NO: 113962 - DNA, 27 bp, Artificial Sequence
  Description of Artificial Sequence: Synthetic oligonucleotide
agcccttcccttttcacggtctcctgc

SEQ ID NO: 113963 - DNA, 26 bp, Artificial Sequence
  Description of Artificial Sequence: Synthetic oligonucleotide
gcccttcccttttcacggtctcctgc

SEQ ID NO: 113964 - DNA, 26 bp, Artificial Sequence
  Description of Artificial Sequence: Synthetic oligonucleotide
cccttcccttttcacggtctcctgcc

SEQ ID NO: 113965 - DNA, 27 bp, Artificial Sequence
  Description of Artificial Sequence: Synthetic oligonucleotide
ccttcccttttcacggtctcctgccga

SEQ ID NO: 113966 - DNA, 28 bp, Artificial Sequence
  Description of Artificial Sequence: Synthetic oligonucleotide
cttcccttttcacggtctcctgccgaag

SEQ ID NO: 113967 - DNA, 30 bp, Artificial Sequence
  Description of Artificial Sequence: Synthetic oligonucleotide
ttcccttttcacggtctcctgccgaagaag

SEQ ID NO: 113968 - DNA, 29 bp, Artificial Sequence
  Description of Artificial Sequence: Synthetic oligonucleotide
tcccttttcacggtctcctgccgaagaag

SEQ ID NO: 113969 - DNA, 28 bp, Artificial Sequence
  Description of Artificial Sequence: Synthetic oligonucleotide
cccttttcacggtctcctgccgaagaag

SEQ ID NO: 113970 - DNA, 28 bp, Artificial Sequence
  Description of Artificial Sequence: Synthetic oligonucleotide
ccttttcacggtctcctgccgaagaagg

SEQ ID NO: 113971 - DNA, 29 bp, Artificial Sequence
  Description of Artificial Sequence: Synthetic oligonucleotide
cttttcacggtctcctgccgaagaaggag

SEQ ID NO: 113972 - DNA, 30 bp, Artificial Sequence
  Description of Artificial Sequence: Synthetic oligonucleotide
ttttcacggtctcctgccgaagaaggagac

SEQ ID NO: 113973 - DNA, 29 bp, Artificial Sequence
  Description of Artificial Sequence: Synthetic oligonucleotide
tttcacggtctcctgccgaagaaggagac

SEQ ID NO: 113974 - DNA, 28 bp, Artificial Sequence
  Description of Artificial Sequence: Synthetic oligonucleotide
ttcacggtctcctgccgaagaaggagac

SEQ ID NO: 113975 - DNA, 27 bp, Artificial Sequence
  Description of Artificial Sequence: Synthetic oligonucleotide
tcacggtctcctgccgaagaaggagac

SEQ ID NO: 113976 - DNA, 26 bp, Artificial Sequence
  Description of Artificial Sequence: Synthetic oligonucleotide
cacggtctcctgccgaagaaggagac

SEQ ID NO: 113977 - DNA, 26 bp, Artificial Sequence
  Description of Artificial Sequence: Synthetic oligonucleotide
acggtctcctgccgaagaaggagacc

SEQ ID NO: 113978 - DNA, 25 bp, Artificial Sequence
  Description of Artificial Sequence: Synthetic oligonucleotide
cggtctcctgccgaagaaggagacc

SEQ ID NO: 113979 - DNA, 25 bp, Artificial Sequence
  Description of Artificial Sequence: Synthetic oligonucleotide
ggtctcctgccgaagaaggagaccg

SEQ ID NO: 113980 - DNA, 26 bp, Artificial Sequence
  Description of Artificial Sequence: Synthetic oligonucleotide
gtctcctgccgaagaaggagaccgga

SEQ ID NO: 113981 - DNA, 26 bp, Artificial Sequence
  Description of Artificial Sequence: Synthetic oligonucleotide
tctcctgccgaagaaggagaccggag

SEQ ID NO: 113982 - DNA, 25 bp, Artificial Sequence
  Description of Artificial Sequence: Synthetic oligonucleotide
ctcctgccgaagaaggagaccggag

SEQ ID NO: 113983 - DNA, 25 bp, Artificial Sequence
  Description of Artificial Sequence: Synthetic oligonucleotide
tcctgccgaagaaggagaccggagc

SEQ ID NO: 113984 - DNA, 24 bp, Artificial Sequence
  Description of Artificial Sequence: Synthetic oligonucleotide
cctgccgaagaaggagaccggagc

SEQ ID NO: 113985 - DNA, 24 bp, Artificial Sequence
  Description of Artificial Sequence: Synthetic oligonucleotide
ctgccgaagaaggagaccggagcc

SEQ ID NO: 113986 - DNA, 24 bp, Artificial Sequence
  Description of Artificial Sequence: Synthetic oligonucleotide
tgccgaagaaggagaccggagccg

SEQ ID NO: 113987 - DNA, 23 bp, Artificial Sequence
  Description of Artificial Sequence: Synthetic oligonucleotide
gccgaagaaggagaccggagccg

SEQ ID NO: 113988 - DNA, 23 bp, Artificial Sequence
  Description of Artificial Sequence: Synthetic oligonucleotide
ccgaagaaggagaccggagccgc

SEQ ID NO: 113989 - DNA, 24 bp, Artificial Sequence
  Description of Artificial Sequence: Synthetic oligonucleotide
cgaagaaggagaccggagccgcct

SEQ ID NO: 113990 - DNA, 24 bp, Artificial Sequence
  Description of Artificial Sequence: Synthetic oligonucleotide
gaagaaggagaccggagccgcctc

SEQ ID NO: 113991 - DNA, 26 bp, Artificial Sequence
  Description of Artificial Sequence: Synthetic oligonucleotide
aagaaggagaccggagccgcctcctt

SEQ ID NO: 113992 - DNA, 25 bp, Artificial Sequence
  Description of Artificial Sequence: Synthetic oligonucleotide
agaaggagaccggagccgcctcctt

SEQ ID NO: 113993 - DNA, 24 bp, Artificial Sequence
  Description of Artificial Sequence: Synthetic oligonucleotide
gaaggagaccggagccgcctcctt

SEQ ID NO: 113994 - DNA, 24 bp, Artificial Sequence
  Description of Artificial Sequence: Synthetic oligonucleotide
aaggagaccggagccgcctccttc

SEQ ID NO: 113995 - DNA, 23 bp, Artificial Sequence
  Description of Artificial Sequence: Synthetic oligonucleotide
aggagaccggagccgcctccttc

SEQ ID NO: 113996 - DNA, 22 bp, Artificial Sequence
  Description of Artificial Sequence: Synthetic oligonucleotide
ggagaccggagccgcctccttc

SEQ ID NO: 113997 - DNA, 23 bp, Artificial Sequence
  Description of Artificial Sequence: Synthetic oligonucleotide
gagaccggagccgcctccttcct

SEQ ID NO: 113998 - DNA, 24 bp, Artificial Sequence
  Description of Artificial Sequence: Synthetic oligonucleotide
agaccggagccgcctccttcctct

SEQ ID NO: 113999 - DNA, 23 bp, Artificial Sequence
  Description of Artificial Sequence: Synthetic oligonucleotide
gaccggagccgcctccttcctct

SEQ ID NO: 114000 - DNA, 23 bp, Artificial Sequence
  Description of Artificial Sequence: Synthetic oligonucleotide
accggagccgcctccttcctctg

SEQ ID NO: 114001 - DNA, 22 bp, Artificial Sequence
  Description of Artificial Sequence: Synthetic oligonucleotide
ccggagccgcctccttcctctg

SEQ ID NO: 114002 - DNA, 22 bp, Artificial Sequence
  Description of Artificial Sequence: Synthetic oligonucleotide
cggagccgcctccttcctctgc

SEQ ID NO: 114003 - DNA, 22 bp, Artificial Sequence
  Description of Artificial Sequence: Synthetic oligonucleotide
ggagccgcctccttcctctgcc

SEQ ID NO: 114004 - DNA, 22 bp, Artificial Sequence
  Description of Artificial Sequence: Synthetic oligonucleotide
gagccgcctccttcctctgccg

SEQ ID NO: 114005 - DNA, 24 bp, Artificial Sequence
  Description of Artificial Sequence: Synthetic oligonucleotide
agccgcctccttcctctgccgcta

SEQ ID NO: 114006 - DNA, 23 bp, Artificial Sequence
  Description of Artificial Sequence: Synthetic oligonucleotide
gccgcctccttcctctgccgcta

SEQ ID NO: 114007 - DNA, 23 bp, Artificial Sequence
  Description of Artificial Sequence: Synthetic oligonucleotide
ccgcctccttcctctgccgctac

SEQ ID NO: 114008 - DNA, 23 bp, Artificial Sequence
  Description of Artificial Sequence: Synthetic oligonucleotide
cgcctccttcctctgccgctacc

SEQ ID NO: 114009 - DNA, 23 bp, Artificial Sequence
  Description of Artificial Sequence: Synthetic oligonucleotide
gcctccttcctctgccgctaccc

SEQ ID NO: 114010 - DNA, 23 bp, Artificial Sequence
  Description of Artificial Sequence: Synthetic oligonucleotide
cctccttcctctgccgctacccg

SEQ ID NO: 114011 - DNA, 24 bp, Artificial Sequence
  Description of Artificial Sequence: Synthetic oligonucleotide
ctccttcctctgccgctacccgga

SEQ ID NO: 114012 - DNA, 27 bp, Artificial Sequence
  Description of Artificial Sequence: Synthetic oligonucleotide
tccttcctctgccgctacccggagtat

SEQ ID NO: 114013 - DNA, 26 bp, Artificial Sequence
  Description of Artificial Sequence: Synthetic oligonucleotide
ccttcctctgccgctacccggagtat

SEQ ID NO: 114014 - DNA, 27 bp, Artificial Sequence
  Description of Artificial Sequence: Synthetic oligonucleotide
cttcctctgccgctacccggagtatga

SEQ ID NO: 114015 - DNA, 28 bp, Artificial Sequence
  Description of Artificial Sequence: Synthetic oligonucleotide
ttcctctgccgctacccggagtatgatg

SEQ ID NO: 114016 - DNA, 27 bp, Artificial Sequence
  Description of Artificial Sequence: Synthetic oligonucleotide
tcctctgccgctacccggagtatgatg

SEQ ID NO: 114017 - DNA, 26 bp, Artificial Sequence
  Description of Artificial Sequence: Synthetic oligonucleotide
cctctgccgctacccggagtatgatg

SEQ ID NO: 114018 - DNA, 26 bp, Artificial Sequence
  Description of Artificial Sequence: Synthetic oligonucleotide
ctctgccgctacccggagtatgatgg

SEQ ID NO: 114019 - DNA, 26 bp, Artificial Sequence
  Description of Artificial Sequence: Synthetic oligonucleotide
tctgccgctacccggagtatgatggg

SEQ ID NO: 114020 - DNA, 25 bp, Artificial Sequence
  Description of Artificial Sequence: Synthetic oligonucleotide
ctgccgctacccggagtatgatggg

SEQ ID NO: 114021 - DNA, 25 bp, Artificial Sequence
  Description of Artificial Sequence: Synthetic oligonucleotide
tgccgctacccggagtatgatgggc

SEQ ID NO: 114022 - DNA, 24 bp, Artificial Sequence
  Description of Artificial Sequence: Synthetic oligonucleotide
gccgctacccggagtatgatgggc

SEQ ID NO: 114023 - DNA, 24 bp, Artificial Sequence
  Description of Artificial Sequence: Synthetic oligonucleotide
ccgctacccggagtatgatgggcg

SEQ ID NO: 114024 - DNA, 24 bp, Artificial Sequence
  Description of Artificial Sequence: Synthetic oligonucleotide
cgctacccggagtatgatgggcgg

SEQ ID NO: 114025 - DNA, 24 bp, Artificial Sequence
  Description of Artificial Sequence: Synthetic oligonucleotide
gctacccggagtatgatgggcggg

SEQ ID NO: 114026 - DNA, 24 bp, Artificial Sequence
  Description of Artificial Sequence: Synthetic oligonucleotide
ctacccggagtatgatgggcgggg

SEQ ID NO: 114027 - DNA, 24 bp, Artificial Sequence
  Description of Artificial Sequence: Synthetic oligonucleotide
tacccggagtatgatgggcggggg

SEQ ID NO: 114028 - DNA, 23 bp, Artificial Sequence
  Description of Artificial Sequence: Synthetic oligonucleotide
acccggagtatgatgggcggggg

SEQ ID NO: 114029 - DNA, 22 bp, Artificial Sequence
  Description of Artificial Sequence: Synthetic oligonucleotide
cccggagtatgatgggcggggg

SEQ ID NO: 114030 - DNA, 23 bp, Artificial Sequence
  Description of Artificial Sequence: Synthetic oligonucleotide
ccggagtatgatgggcggggggt

SEQ ID NO: 114031 - DNA, 23 bp, Artificial Sequence
  Description of Artificial Sequence: Synthetic oligonucleotide
cggagtatgatgggcggggggtg

SEQ ID NO: 114032 - DNA, 24 bp, Artificial Sequence
  Description of Artificial Sequence: Synthetic oligonucleotide
ggagtatgatgggcggggggtgct

SEQ ID NO: 114033 - DNA, 26 bp, Artificial Sequence
  Description of Artificial Sequence: Synthetic oligonucleotide
gagtatgatgggcggggggtgctcat

SEQ ID NO: 114034 - DNA, 26 bp, Artificial Sequence
  Description of Artificial Sequence: Synthetic oligonucleotide
agtatgatgggcggggggtgctcatc

SEQ ID NO: 114035 - DNA, 25 bp, Artificial Sequence
  Description of Artificial Sequence: Synthetic oligonucleotide
gtatgatgggcggggggtgctcatc

SEQ ID NO: 114036 - DNA, 25 bp, Artificial Sequence
  Description of Artificial Sequence: Synthetic oligonucleotide
tatgatgggcggggggtgctcatcg

SEQ ID NO: 114037 - DNA, 24 bp, Artificial Sequence
  Description of Artificial Sequence: Synthetic oligonucleotide
atgatgggcggggggtgctcatcg

SEQ ID NO: 114038 - DNA, 23 bp, Artificial Sequence
  Description of Artificial Sequence: Synthetic oligonucleotide
tgatgggcggggggtgctcatcg

SEQ ID NO: 114039 - DNA, 22 bp, Artificial Sequence
  Description of Artificial Sequence: Synthetic oligonucleotide
gatgggcggggggtgctcatcg

SEQ ID NO: 114040 - DNA, 23 bp, Artificial Sequence
  Description of Artificial Sequence: Synthetic oligonucleotide
atgggcggggggtgctcatcgca

SEQ ID NO: 114041 - DNA, 22 bp, Artificial Sequence
  Description of Artificial Sequence: Synthetic oligonucleotide
tgggcggggggtgctcatcgca

SEQ ID NO: 114042 - DNA, 21 bp, Artificial Sequence
  Description of Artificial Sequence: Synthetic oligonucleotide
gggcggggggtgctcatcgca

SEQ ID NO: 114043 - DNA, 22 bp, Artificial Sequence
  Description of Artificial Sequence: Synthetic oligonucleotide
ggcggggggtgctcatcgcagt

SEQ ID NO: 114044 - DNA, 22 bp, Artificial Sequence
  Description of Artificial Sequence: Synthetic oligonucleotide
gcggggggtgctcatcgcagtc

SEQ ID NO: 114045 - DNA, 23 bp, Artificial Sequence
  Description of Artificial Sequence: Synthetic oligonucleotide
cggggggtgctcatcgcagtcct

SEQ ID NO: 114046 - DNA, 23 bp, Artificial Sequence
  Description of Artificial Sequence: Synthetic oligonucleotide
ggggggtgctcatcgcagtcctg

SEQ ID NO: 114047 - DNA, 24 bp, Artificial Sequence
  Description of Artificial Sequence: Synthetic oligonucleotide
gggggtgctcatcgcagtcctgga

SEQ ID NO: 114048 - DNA, 25 bp, Artificial Sequence
  Description of Artificial Sequence: Synthetic oligonucleotide
ggggtgctcatcgcagtcctggaca

SEQ ID NO: 114049 - DNA, 25 bp, Artificial Sequence
  Description of Artificial Sequence: Synthetic oligonucleotide
gggtgctcatcgcagtcctggacac

SEQ ID NO: 114050 - DNA, 25 bp, Artificial Sequence
  Description of Artificial Sequence: Synthetic oligonucleotide
ggtgctcatcgcagtcctggacacg

SEQ ID NO: 114051 - DNA, 25 bp, Artificial Sequence
  Description of Artificial Sequence: Synthetic oligonucleotide
gtgctcatcgcagtcctggacacgg

SEQ ID NO: 114052 - DNA, 25 bp, Artificial Sequence
  Description of Artificial Sequence: Synthetic oligonucleotide
tgctcatcgcagtcctggacacggg

SEQ ID NO: 114053 - DNA, 24 bp, Artificial Sequence
  Description of Artificial Sequence: Synthetic oligonucleotide
gctcatcgcagtcctggacacggg

SEQ ID NO: 114054 - DNA, 24 bp, Artificial Sequence
  Description of Artificial Sequence: Synthetic oligonucleotide
ctcatcgcagtcctggacacgggg

SEQ ID NO: 114055 - DNA, 25 bp, Artificial Sequence
  Description of Artificial Sequence: Synthetic oligonucleotide
tcatcgcagtcctggacacgggggt

SEQ ID NO: 114056 - DNA, 24 bp, Artificial Sequence
  Description of Artificial Sequence: Synthetic oligonucleotide
catcgcagtcctggacacgggggt

SEQ ID NO: 114057 - DNA, 24 bp, Artificial Sequence
  Description of Artificial Sequence: Synthetic oligonucleotide
atcgcagtcctggacacgggggtc

SEQ ID NO: 114058 - DNA, 23 bp, Artificial Sequence
  Description of Artificial Sequence: Synthetic oligonucleotide
tcgcagtcctggacacgggggtc

SEQ ID NO: 114059 - DNA, 22 bp, Artificial Sequence
  Description of Artificial Sequence: Synthetic oligonucleotide
cgcagtcctggacacgggggtc

SEQ ID NO: 114060 - DNA, 23 bp, Artificial Sequence
  Description of Artificial Sequence: Synthetic oligonucleotide
gcagtcctggacacgggggtcga

SEQ ID NO: 114061 - DNA, 23 bp, Artificial Sequence
  Description of Artificial Sequence: Synthetic oligonucleotide
cagtcctggacacgggggtcgac

SEQ ID NO: 114062 - DNA, 23 bp, Artificial Sequence
  Description of Artificial Sequence: Synthetic oligonucleotide
agtcctggacacgggggtcgacc

SEQ ID NO: 114063 - DNA, 22 bp, Artificial Sequence
  Description of Artificial Sequence: Synthetic oligonucleotide
gtcctggacacgggggtcgacc

SEQ ID NO: 114064 - DNA, 22 bp, Artificial Sequence
  Description of Artificial Sequence: Synthetic oligonucleotide
tcctggacacgggggtcgaccc

SEQ ID NO: 114065 - DNA, 21 bp, Artificial Sequence
  Description of Artificial Sequence: Synthetic oligonucleotide
cctggacacgggggtcgaccc

SEQ ID NO: 114066 - DNA, 21 bp, Artificial Sequence
  Description of Artificial Sequence: Synthetic oligonucleotide
ctggacacgggggtcgacccg

SEQ ID NO: 114067 - DNA, 21 bp, Artificial Sequence
  Description of Artificial Sequence: Synthetic oligonucleotide
tggacacgggggtcgacccgg

SEQ ID NO: 114068 - DNA, 20 bp, Artificial Sequence
  Description of Artificial Sequence: Synthetic oligonucleotide
ggacacgggggtcgacccgg

SEQ ID NO: 114069 - DNA, 20 bp, Artificial Sequence
  Description of Artificial Sequence: Synthetic oligonucleotide
gacacgggggtcgacccggg

SEQ ID NO: 114070 - DNA, 20 bp, Artificial Sequence
  Description of Artificial Sequence: Synthetic oligonucleotide
acacgggggtcgacccgggg

SEQ ID NO: 114071 - DNA, 20 bp, Artificial Sequence
  Description of Artificial Sequence: Synthetic oligonucleotide
cacgggggtcgacccggggt

SEQ ID NO: 114072 - DNA, 20 bp, Artificial Sequence
  Description of Artificial Sequence: Synthetic oligonucleotide
acgggggtcgacccgggggt

SEQ ID NO: 114073 - DNA, 20 bp, Artificial Sequence
  Description of Artificial Sequence: Synthetic oligonucleotide
cgggggtcgacccgggggtt

SEQ ID NO: 114074 - DNA, 20 bp, Artificial Sequence
  Description of Artificial Sequence: Synthetic oligonucleotide
gggggtcgacccgggggctt

SEQ ID NO: 114075 - DNA, 20 bp, Artificial Sequence
  Description of Artificial Sequence: Synthetic oligonucleotide
ggggtcgacccgggggctct

SEQ ID NO: 114076 - DNA, 20 bp, Artificial Sequence
  Description of Artificial Sequence: Synthetic oligonucleotide
gggtcgacccgggggctcct

SEQ ID NO: 114077 - DNA, 20 bp, Artificial Sequence
  Description of Artificial Sequence: Synthetic oligonucleotide
ggtcgacccgggggctccgt

SEQ ID NO: 114078 - DNA, 20 bp, Artificial Sequence
  Description of Artificial Sequence: Synthetic oligonucleotide
gtcgacccgggggctccggt

SEQ ID NO: 114079 - DNA, 20 bp, Artificial Sequence
  Description of Artificial Sequence: Synthetic oligonucleotide
tcgacccgggggctccgggt

SEQ ID NO: 114080 - DNA, 20 bp, Artificial Sequence
  Description of Artificial Sequence: Synthetic oligonucleotide
cgacccgggggctccgggtt

SEQ ID NO: 114081 - DNA, 20 bp, Artificial Sequence
  Description of Artificial Sequence: Synthetic oligonucleotide
gacccgggggctccgggcat

SEQ ID NO: 114082 - DNA, 20 bp, Artificial Sequence
  Description of Artificial Sequence: Synthetic oligonucleotide
acccgggggctccgggcatg

SEQ ID NO: 114083 - DNA, 20 bp, Artificial Sequence
  Description of Artificial Sequence: Synthetic oligonucleotide
cccgggggctccgggcatgt

SEQ ID NO: 114084 - DNA, 20 bp, Artificial Sequence
  Description of Artificial Sequence: Synthetic oligonucleotide
ccgggggctccgggcatgca

SEQ ID NO: 114085 - DNA, 20 bp, Artificial Sequence
  Description of Artificial Sequence: Synthetic oligonucleotide
cgggggctccgggcatgcag

SEQ ID NO: 114086 - DNA, 23 bp, Artificial Sequence
  Description of Artificial Sequence: Synthetic oligonucleotide
gggggctccgggcatgcaggtta

SEQ ID NO: 114087 - DNA, 25 bp, Artificial Sequence
  Description of Artificial Sequence: Synthetic oligonucleotide
ggggctccgggcatgcaggttacaa

SEQ ID NO: 114088 - DNA, 26 bp, Artificial Sequence
  Description of Artificial Sequence: Synthetic oligonucleotide
gggctccgggcatgcaggttacaact

SEQ ID NO: 114089 - DNA, 27 bp, Artificial Sequence
  Description of Artificial Sequence: Synthetic oligonucleotide
ggctccgggcatgcaggttacaactga

SEQ ID NO: 114090 - DNA, 28 bp, Artificial Sequence
  Description of Artificial Sequence: Synthetic oligonucleotide
gctccgggcatgcaggttacaactgatg

SEQ ID NO: 114091 - DNA, 28 bp, Artificial Sequence
  Description of Artificial Sequence: Synthetic oligonucleotide
ctccgggcatgcaggttacaactgatgg

SEQ ID NO: 114092 - DNA, 32 bp, Artificial Sequence
  Description of Artificial Sequence: Synthetic oligonucleotide
tccgggcatgcaggttacaactgatggaaaac

SEQ ID NO: 114093 - DNA, 31 bp, Artificial Sequence
  Description of Artificial Sequence: Synthetic oligonucleotide
ccgggcatgcaggttacaactgatggaaaac

SEQ ID NO: 114094 - DNA, 31 bp, Artificial Sequence
  Description of Artificial Sequence: Synthetic oligonucleotide
cgggcatgcaggttacaactgatggaaaacc

SEQ ID NO: 114095 - DNA, 37 bp, Artificial Sequence
  Description of Artificial Sequence: Synthetic oligonucleotide
gggcatgcaggttacaactgatggaaaaccaaaaatc

SEQ ID NO: 114096 - DNA, 37 bp, Artificial Sequence
  Description of Artificial Sequence: Synthetic oligonucleotide
ggcatgcaggttacaactgatggaaaaccaaaaatcg

SEQ ID NO: 114097 - DNA, 39 bp, Artificial Sequence
  Description of Artificial Sequence: Synthetic oligonucleotide
gcatgcaggttacaactgatggaaaaccaaaaatcgttg

SEQ ID NO: 114098 - DNA, 43 bp, Artificial Sequence
  Description of Artificial Sequence: Synthetic oligonucleotide
catgcaggttacaactgatggaaaaccaaaaatcgttgatatc

SEQ ID NO: 114099 - DNA, 46 bp, Artificial Sequence
  Description of Artificial Sequence: Synthetic oligonucleotide
atgcaggttacaactgatggaaaaccaaaaatcgttgatatcattg

SEQ ID NO: 114100 - DNA, 45 bp, Artificial Sequence
  Description of Artificial Sequence: Synthetic oligonucleotide
tgcaggttacaactgatggaaaaccaaaaatcgttgatatcattg

SEQ ID NO: 114101 - DNA, 44 bp, Artificial Sequence
  Description of Artificial Sequence: Synthetic oligonucleotide
gcaggttacaactgatggaaaaccaaaaatcgttgatatcattg

SEQ ID NO: 114102 - DNA, 47 bp, Artificial Sequence
  Description of Artificial Sequence: Synthetic oligonucleotide
caggttacaactgatggaaaaccaaaaatcgttgatatcattgatac

SEQ ID NO: 114103 - DNA, 49 bp, Artificial Sequence
  Description of Artificial Sequence: Synthetic oligonucleotide
aggttacaactgatggaaaaccaaaaatcgttgatatcattgatacaac

SEQ ID NO: 114104 - DNA, 48 bp, Artificial Sequence
  Description of Artificial Sequence: Synthetic oligonucleotide
ggttacaactgatggaaaaccaaaaatcgttgatatcattgatacaac

SEQ ID NO: 114105 - DNA, 49 bp, Artificial Sequence
  Description of Artificial Sequence: Synthetic oligonucleotide
gttacaactgatggaaaaccaaaaatcgttgatatcattgatacaacag

SEQ ID NO: 114106 - DNA, 49 bp, Artificial Sequence
  Description of Artificial Sequence: Synthetic oligonucleotide
ttacaactgatggaaaaccaaaaatcgttgatatcattgatacaacagg

SEQ ID NO: 114107 - DNA, 48 bp, Artificial Sequence
  Description of Artificial Sequence: Synthetic oligonucleotide
tacaactgatggaaaaccaaaaatcgttgatatcattgatacaacagg

SEQ ID NO: 114108 - DNA, 47 bp, Artificial Sequence
  Description of Artificial Sequence: Synthetic oligonucleotide
acaactgatggaaaaccaaaaatcgttgatatcattgatacaacagg

SEQ ID NO: 114109 - DNA, 46 bp, Artificial Sequence
  Description of Artificial Sequence: Synthetic oligonucleotide
caactgatggaaaaccaaaaatcgttgatatcattgatacaacagg

SEQ ID NO: 114110 - DNA, 48 bp, Artificial Sequence
  Description of Artificial Sequence: Synthetic oligonucleotide
aactgatggaaaaccaaaaatcgttgatatcattgatacaacaggaag

SEQ ID NO: 114111 - DNA, 47 bp, Artificial Sequence
  Description of Artificial Sequence: Synthetic oligonucleotide
actgatggaaaaccaaaaatcgttgatatcattgatacaacaggaag

SEQ ID NO: 114112 - DNA, 46 bp, Artificial Sequence
  Description of Artificial Sequence: Synthetic oligonucleotide
ctgatggaaaaccaaaaatcgttgatatcattgatacaacaggaag

SEQ ID NO: 114113 - DNA, 47 bp, Artificial Sequence
  Description of Artificial Sequence: Synthetic oligonucleotide
tgatggaaaaccaaaaatcgttgatatcattgatacaacaggaagtg

SEQ ID NO: 114114 - DNA, 46 bp, Artificial Sequence
  Description of Artificial Sequence: Synthetic oligonucleotide
gatggaaaaccaaaaatcgttgatatcattgatacaacaggaagtg

SEQ ID NO: 114115 - DNA, 46 bp, Artificial Sequence
  Description of Artificial Sequence: Synthetic oligonucleotide
atggaaaaccaaaaatcgttgatatcattgatacaacaggaagtgg

SEQ ID NO: 114116 - DNA, 45 bp, Artificial Sequence
  Description of Artificial Sequence: Synthetic oligonucleotide
tggaaaaccaaaaatcgttgatatcattgatacaacaggaagtgg

SEQ ID NO: 114117 - DNA, 44 bp, Artificial Sequence
  Description of Artificial Sequence: Synthetic oligonucleotide
ggaaaaccaaaaatcgttgatatcattgatacaacaggaagtgg

SEQ ID NO: 114118 - DNA, 44 bp, Artificial Sequence
  Description of Artificial Sequence: Synthetic oligonucleotide
gaaaaccaaaaatcgttgatatcattgatacaacaggaagtggc

SEQ ID NO: 114119 - DNA, 44 bp, Artificial Sequence
  Description of Artificial Sequence: Synthetic oligonucleotide
aaaaccaaaaatcgttgatatcattgatacaacaggaagtggcg

SEQ ID NO: 114120 - DNA, 43 bp, Artificial Sequence
  Description of Artificial Sequence: Synthetic oligonucleotide
aaaccaaaaatcgttgatatcattgatacaacaggaagtggcg

SEQ ID NO: 114121 - DNA, 42 bp, Artificial Sequence
  Description of Artificial Sequence: Synthetic oligonucleotide
aaccaaaaatcgttgatatcattgatacaacaggaagtggcg

SEQ ID NO: 114122 - DNA, 41 bp, Artificial Sequence
  Description of Artificial Sequence: Synthetic oligonucleotide
accaaaaatcgttgatatcattgatacaacaggaagtggcg

SEQ ID NO: 114123 - DNA, 40 bp, Artificial Sequence
  Description of Artificial Sequence: Synthetic oligonucleotide
ccaaaaatcgttgatatcattgatacaacaggaagtggcg

SEQ ID NO: 114124 - DNA, 42 bp, Artificial Sequence
  Description of Artificial Sequence: Synthetic oligonucleotide
caaaaatcgttgatatcattgatacaacaggaagtggcgatg

SEQ ID NO: 114125 - DNA, 43 bp, Artificial Sequence
  Description of Artificial Sequence: Synthetic oligonucleotide
aaaaatcgttgatatcattgatacaacaggaagtggcgatgtg

SEQ ID NO: 114126 - DNA, 42 bp, Artificial Sequence
  Description of Artificial Sequence: Synthetic oligonucleotide
aaaatcgttgatatcattgatacaacaggaagtggcgatgtg

SEQ ID NO: 114127 - DNA, 41 bp, Artificial Sequence
  Description of Artificial Sequence: Synthetic oligonucleotide
aaatcgttgatatcattgatacaacaggaagtggcgatgtg

SEQ ID NO: 114128 - DNA, 40 bp, Artificial Sequence
  Description of Artificial Sequence: Synthetic oligonucleotide
aatcgttgatatcattgatacaacaggaagtggcgatgtg

SEQ ID NO: 114129 - DNA, 39 bp, Artificial Sequence
  Description of Artificial Sequence: Synthetic oligonucleotide
atcgttgatatcattgatacaacaggaagtggcgatgtg

SEQ ID NO: 114130 - DNA, 38 bp, Artificial Sequence
  Description of Artificial Sequence: Synthetic oligonucleotide
tcgttgatatcattgatacaacaggaagtggcgatgtg

SEQ ID NO: 114131 - DNA, 37 bp, Artificial Sequence
  Description of Artificial Sequence: Synthetic oligonucleotide
cgttgatatcattgatacaacaggaagtggcgatgtg

SEQ ID NO: 114132 - DNA, 41 bp, Artificial Sequence
  Description of Artificial Sequence: Synthetic oligonucleotide
gttgatatcattgatacaacaggaagtggcgatgtgaatac

SEQ ID NO: 114133 - DNA, 42 bp, Artificial Sequence
  Description of Artificial Sequence: Synthetic oligonucleotide
ttgatatcattgatacaacaggaagtggcgatgtgaatactg

SEQ ID NO: 114134 - DNA, 41 bp, Artificial Sequence
  Description of Artificial Sequence: Synthetic oligonucleotide
tgatatcattgatacaacaggaagtggcgatgtgaatactg

SEQ ID NO: 114135 - DNA, 40 bp, Artificial Sequence
  Description of Artificial Sequence: Synthetic oligonucleotide
gatatcattgatacaacaggaagtggcgatgtgaatactg

SEQ ID NO: 114136 - DNA, 40 bp, Artificial Sequence
  Description of Artificial Sequence: Synthetic oligonucleotide
atatcattgatacaacaggaagtggcgatgtgaatactgc

SEQ ID NO: 114137 - DNA, 39 bp, Artificial Sequence
  Description of Artificial Sequence: Synthetic oligonucleotide
tatcattgatacaacaggaagtggcgatgtgaatactgc

SEQ ID NO: 114138 - DNA, 38 bp, Artificial Sequence
  Description of Artificial Sequence: Synthetic oligonucleotide
atcattgatacaacaggaagtggcgatgtgaatactgc

SEQ ID NO: 114139 - DNA, 37 bp, Artificial Sequence
  Description of Artificial Sequence: Synthetic oligonucleotide
tcattgatacaacaggaagtggcgatgtgaatactgc

SEQ ID NO: 114140 - DNA, 36 bp, Artificial Sequence
  Description of Artificial Sequence: Synthetic oligonucleotide
cattgatacaacaggaagtggcgatgtgaatactgc

SEQ ID NO: 114141 - DNA, 38 bp, Artificial Sequence
  Description of Artificial Sequence: Synthetic oligonucleotide
attgatacaacaggaagtggcgatgtgaatactgctac

SEQ ID NO: 114142 - DNA, 37 bp, Artificial Sequence
  Description of Artificial Sequence: Synthetic oligonucleotide
ttgatacaacaggaagtggcgatgtgaatactgctac

SEQ ID NO: 114143 - DNA, 36 bp, Artificial Sequence
  Description of Artificial Sequence: Synthetic oligonucleotide
tgatacaacaggaagtggcgatgtgaatactgctac

SEQ ID NO: 114144 - DNA, 35 bp, Artificial Sequence
  Description of Artificial Sequence: Synthetic oligonucleotide
gatacaacaggaagtggcgatgtgaatactgctac

SEQ ID NO: 114145 - DNA, 36 bp, Artificial Sequence
  Description of Artificial Sequence: Synthetic oligonucleotide
atacaacaggaagtggcgatgtgaatactgctacag

SEQ ID NO: 114146 - DNA, 35 bp, Artificial Sequence
  Description of Artificial Sequence: Synthetic oligonucleotide
tacaacaggaagtggcgatgtgaatactgctacag

SEQ ID NO: 114147 - DNA, 34 bp, Artificial Sequence
  Description of Artificial Sequence: Synthetic oligonucleotide
acaacaggaagtggcgatgtgaatactgctacag

SEQ ID NO: 114148 - DNA, 33 bp, Artificial Sequence
  Description of Artificial Sequence: Synthetic oligonucleotide
caacaggaagtggcgatgtgaatactgctacag

SEQ ID NO: 114149 - DNA, 35 bp, Artificial Sequence
  Description of Artificial Sequence: Synthetic oligonucleotide
aacaggaagtggcgatgtgaatactgctacagaag

SEQ ID NO: 114150 - DNA, 34 bp, Artificial Sequence
  Description of Artificial Sequence: Synthetic oligonucleotide
acaggaagtggcgatgtgaatactgctacagaag

SEQ ID NO: 114151 - DNA, 33 bp, Artificial Sequence
  Description of Artificial Sequence: Synthetic oligonucleotide
caggaagtggcgatgtgaatactgctacagaag

SEQ ID NO: 114152 - DNA, 35 bp, Artificial Sequence
  Description of Artificial Sequence: Synthetic oligonucleotide
aggaagtggcgatgtgaatactgctacagaagtag

SEQ ID NO: 114153 - DNA, 34 bp, Artificial Sequence
  Description of Artificial Sequence: Synthetic oligonucleotide
ggaagtggcgatgtgaatactgctacagaagtag

SEQ ID NO: 114154 - DNA, 35 bp, Artificial Sequence
  Description of Artificial Sequence: Synthetic oligonucleotide
gaagtggcgatgtgaatactgctacagaagtagag

SEQ ID NO: 114155 - DNA, 35 bp, Artificial Sequence
  Description of Artificial Sequence: Synthetic oligonucleotide
aagtggcgatgtgaatactgctacagaagtagagc

SEQ ID NO: 114156 - DNA, 34 bp, Artificial Sequence
  Description of Artificial Sequence: Synthetic oligonucleotide
agtggcgatgtgaatactgctacagaagtagagc

SEQ ID NO: 114157 - DNA, 33 bp, Artificial Sequence
  Description of Artificial Sequence: Synthetic oligonucleotide
gtggcgatgtgaatactgctacagaagtagagc

SEQ ID NO: 114158 - DNA, 33 bp, Artificial Sequence
  Description of Artificial Sequence: Synthetic oligonucleotide
tggcgatgtgaatactgctacagaagtagagcc

SEQ ID NO: 114159 - DNA, 32 bp, Artificial Sequence
  Description of Artificial Sequence: Synthetic oligonucleotide
ggcgatgtgaatactgctacagaagtagagcc

SEQ ID NO: 114160 - DNA, 35 bp, Artificial Sequence
  Description of Artificial Sequence: Synthetic oligonucleotide
gcgatgtgaatactgctacagaagtagagccaaag

SEQ ID NO: 114161 - DNA, 35 bp, Artificial Sequence
  Description of Artificial Sequence: Synthetic oligonucleotide
cgatgtgaatactgctacagaagtagagccaaagg

SEQ ID NO: 114162 - DNA, 37 bp, Artificial Sequence
  Description of Artificial Sequence: Synthetic oligonucleotide
gatgtgaatactgctacagaagtagagccaaaggatg

SEQ ID NO: 114163 - DNA, 37 bp, Artificial Sequence
  Description of Artificial Sequence: Synthetic oligonucleotide
atgtgaatactgctacagaagtagagccaaaggatgg

SEQ ID NO: 114164 - DNA, 36 bp, Artificial Sequence
  Description of Artificial Sequence: Synthetic oligonucleotide
tgtgaatactgctacagaagtagagccaaaggatgg

SEQ ID NO: 114165 - DNA, 35 bp, Artificial Sequence
  Description of Artificial Sequence: Synthetic oligonucleotide
gtgaatactgctacagaagtagagccaaaggatgg

SEQ ID NO: 114166 - DNA, 36 bp, Artificial Sequence
  Description of Artificial Sequence: Synthetic oligonucleotide
tgaatactgctacagaagtagagccaaaggatggtg

SEQ ID NO: 114167 - DNA, 35 bp, Artificial Sequence
  Description of Artificial Sequence: Synthetic oligonucleotide
gaatactgctacagaagtagagccaaaggatggtg

SEQ ID NO: 114168 - DNA, 36 bp, Artificial Sequence
  Description of Artificial Sequence: Synthetic oligonucleotide
aatactgctacagaagtagagccaaaggatggtgag

SEQ ID NO: 114169 - DNA, 35 bp, Artificial Sequence
  Description of Artificial Sequence: Synthetic oligonucleotide
atactgctacagaagtagagccaaaggatggtgag

SEQ ID NO: 114170 - DNA, 34 bp, Artificial Sequence
  Description of Artificial Sequence: Synthetic oligonucleotide
tactgctacagaagtagagccaaaggatggtgag

SEQ ID NO: 114171 - DNA, 33 bp, Artificial Sequence
  Description of Artificial Sequence: Synthetic oligonucleotide
actgctacagaagtagagccaaaggatggtgag

SEQ ID NO: 114172 - DNA, 32 bp, Artificial Sequence
  Description of Artificial Sequence: Synthetic oligonucleotide
ctgctacagaagtagagccaaaggatggtgag

SEQ ID NO: 114173 - DNA, 35 bp, Artificial Sequence
  Description of Artificial Sequence: Synthetic oligonucleotide
tgctacagaagtagagccaaaggatggtgagattg

SEQ ID NO: 114174 - DNA, 34 bp, Artificial Sequence
  Description of Artificial Sequence: Synthetic oligonucleotide
gctacagaagtagagccaaaggatggtgagattg

SEQ ID NO: 114175 - DNA, 36 bp, Artificial Sequence
  Description of Artificial Sequence: Synthetic oligonucleotide
ctacagaagtagagccaaaggatggtgagattgttg

SEQ ID NO: 114176 - DNA, 36 bp, Artificial Sequence
  Description of Artificial Sequence: Synthetic oligonucleotide
tacagaagtagagccaaaggatggtgagattgttgg

SEQ ID NO: 114177 - DNA, 35 bp, Artificial Sequence
  Description of Artificial Sequence: Synthetic oligonucleotide
acagaagtagagccaaaggatggtgagattgttgg

SEQ ID NO: 114178 - DNA, 34 bp, Artificial Sequence
  Description of Artificial Sequence: Synthetic oligonucleotide
cagaagtagagccaaaggatggtgagattgttgg

SEQ ID NO: 114179 - DNA, 34 bp, Artificial Sequence
  Description of Artificial Sequence: Synthetic oligonucleotide
agaagtagagccaaaggatggtgagattgttggc

SEQ ID NO: 114180 - DNA, 33 bp, Artificial Sequence
  Description of Artificial Sequence: Synthetic oligonucleotide
gaagtagagccaaaggatggtgagattgttggc

SEQ ID NO: 114181 - DNA, 33 bp, Artificial Sequence
  Description of Artificial Sequence: Synthetic oligonucleotide
aagtagagccaaaggatggtgagattgttggcc

SEQ ID NO: 114182 - DNA, 32 bp, Artificial Sequence
  Description of Artificial Sequence: Synthetic oligonucleotide
agtagagccaaaggatggtgagattgttggcc

SEQ ID NO: 114183 - DNA, 31 bp, Artificial Sequence
  Description of Artificial Sequence: Synthetic oligonucleotide
gtagagccaaaggatggtgagattgttggcc

SEQ ID NO: 114184 - DNA, 34 bp, Artificial Sequence
  Description of Artificial Sequence: Synthetic oligonucleotide
tagagccaaaggatggtgagattgttggcctttc

SEQ ID NO: 114185 - DNA, 33 bp, Artificial Sequence
  Description of Artificial Sequence: Synthetic oligonucleotide
agagccaaaggatggtgagattgttggcctttc

SEQ ID NO: 114186 - DNA, 32 bp, Artificial Sequence
  Description of Artificial Sequence: Synthetic oligonucleotide
gagccaaaggatggtgagattgttggcctttc

SEQ ID NO: 114187 - DNA, 33 bp, Artificial Sequence
  Description of Artificial Sequence: Synthetic oligonucleotide
agccaaaggatggtgagattgttggcctttcag

SEQ ID NO: 114188 - DNA, 32 bp, Artificial Sequence
  Description of Artificial Sequence: Synthetic oligonucleotide
gccaaaggatggtgagattgttggcctttcag

SEQ ID NO: 114189 - DNA, 32 bp, Artificial Sequence
  Description of Artificial Sequence: Synthetic oligonucleotide
ccaaaggatggtgagattgttggcctttcagg

SEQ ID NO: 114190 - DNA, 34 bp, Artificial Sequence
  Description of Artificial Sequence: Synthetic oligonucleotide
caaaggatggtgagattgttggcctttcaggaag

SEQ ID NO: 114191 - DNA, 35 bp, Artificial Sequence
  Description of Artificial Sequence: Synthetic oligonucleotide
aaaggatggtgagattgttggcctttcaggaagag

SEQ ID NO: 114192 - DNA, 34 bp, Artificial Sequence
  Description of Artificial Sequence: Synthetic oligonucleotide
aaggatggtgagattgttggcctttcaggaagag

SEQ ID NO: 114193 - DNA, 33 bp, Artificial Sequence
  Description of Artificial Sequence: Synthetic oligonucleotide
aggatggtgagattgttggcctttcaggaagag

SEQ ID NO: 114194 - DNA, 32 bp, Artificial Sequence
  Description of Artificial Sequence: Synthetic oligonucleotide
ggatggtgagattgttggcctttcaggaagag

SEQ ID NO: 114195 - DNA, 33 bp, Artificial Sequence
  Description of Artificial Sequence: Synthetic oligonucleotide
gatggtgagattgttggcctttcaggaagagtg

SEQ ID NO: 114196 - DNA, 33 bp, Artificial Sequence
  Description of Artificial Sequence: Synthetic oligonucleotide
atggtgagattgttggcctttcaggaagagtgc

SEQ ID NO: 114197 - DNA, 32 bp, Artificial Sequence
  Description of Artificial Sequence: Synthetic oligonucleotide
tggtgagattgttggcctttcaggaagagtgc

SEQ ID NO: 114198 - DNA, 31 bp, Artificial Sequence
  Description of Artificial Sequence: Synthetic oligonucleotide
ggtgagattgttggcctttcaggaagagtgc

SEQ ID NO: 114199 - DNA, 35 bp, Artificial Sequence
  Description of Artificial Sequence: Synthetic oligonucleotide
gtgagattgttggcctttcaggaagagtgcttaag

SEQ ID NO: 114200 - DNA, 38 bp, Artificial Sequence
  Description of Artificial Sequence: Synthetic oligonucleotide
tgagattgttggcctttcaggaagagtgcttaagattc

SEQ ID NO: 114201 - DNA, 37 bp, Artificial Sequence
  Description of Artificial Sequence: Synthetic oligonucleotide
gagattgttggcctttcaggaagagtgcttaagattc

SEQ ID NO: 114202 - DNA, 37 bp, Artificial Sequence
  Description of Artificial Sequence: Synthetic oligonucleotide
agattgttggcctttcaggaagagtgcttaagattcc

SEQ ID NO: 114203 - DNA, 36 bp, Artificial Sequence
  Description of Artificial Sequence: Synthetic oligonucleotide
gattgttggcctttcaggaagagtgcttaagattcc

SEQ ID NO: 114204 - DNA, 37 bp, Artificial Sequence
  Description of Artificial Sequence: Synthetic oligonucleotide
attgttggcctttcaggaagagtgcttaagattcctg

SEQ ID NO: 114205 - DNA, 36 bp, Artificial Sequence
  Description of Artificial Sequence: Synthetic oligonucleotide
ttgttggcctttcaggaagagtgcttaagattcctg

SEQ ID NO: 114206 - DNA, 35 bp, Artificial Sequence
  Description of Artificial Sequence: Synthetic oligonucleotide
tgttggcctttcaggaagagtgcttaagattcctg

SEQ ID NO: 114207 - DNA, 34 bp, Artificial Sequence
  Description of Artificial Sequence: Synthetic oligonucleotide
gttggcctttcaggaagagtgcttaagattcctg

SEQ ID NO: 114208 - DNA, 34 bp, Artificial Sequence
  Description of Artificial Sequence: Synthetic oligonucleotide
ttggcctttcaggaagagtgcttaagattcctgc

SEQ ID NO: 114209 - DNA, 33 bp, Artificial Sequence
  Description of Artificial Sequence: Synthetic oligonucleotide
tggcctttcaggaagagtgcttaagattcctgc

SEQ ID NO: 114210 - DNA, 32 bp, Artificial Sequence
  Description of Artificial Sequence: Synthetic oligonucleotide
ggcctttcaggaagagtgcttaagattcctgc

SEQ ID NO: 114211 - DNA, 34 bp, Artificial Sequence
  Description of Artificial Sequence: Synthetic oligonucleotide
gcctttcaggaagagtgcttaagattcctgcaag

SEQ ID NO: 114212 - DNA, 34 bp, Artificial Sequence
  Description of Artificial Sequence: Synthetic oligonucleotide
cctttcaggaagagtgcttaagattcctgcaagc

SEQ ID NO: 114213 - DNA, 35 bp, Artificial Sequence
  Description of Artificial Sequence: Synthetic oligonucleotide
ctttcaggaagagtgcttaagattcctgcaagctg

SEQ ID NO: 114214 - DNA, 35 bp, Artificial Sequence
  Description of Artificial Sequence: Synthetic oligonucleotide
tttcaggaagagtgcttaagattcctgcaagctgg

SEQ ID NO: 114215 - DNA, 34 bp, Artificial Sequence
  Description of Artificial Sequence: Synthetic oligonucleotide
ttcaggaagagtgcttaagattcctgcaagctgg

SEQ ID NO: 114216 - DNA, 33 bp, Artificial Sequence
  Description of Artificial Sequence: Synthetic oligonucleotide
tcaggaagagtgcttaagattcctgcaagctgg

SEQ ID NO: 114217 - DNA, 32 bp, Artificial Sequence
  Description of Artificial Sequence: Synthetic oligonucleotide
caggaagagtgcttaagattcctgcaagctgg

SEQ ID NO: 114218 - DNA, 33 bp, Artificial Sequence
  Description of Artificial Sequence: Synthetic oligonucleotide
aggaagagtgcttaagattcctgcaagctggac

SEQ ID NO: 114219 - DNA, 32 bp, Artificial Sequence
  Description of Artificial Sequence: Synthetic oligonucleotide
ggaagagtgcttaagattcctgcaagctggac

SEQ ID NO: 114220 - DNA, 36 bp, Artificial Sequence
  Description of Artificial Sequence: Synthetic oligonucleotide
gaagagtgcttaagattcctgcaagctggacaaatc

SEQ ID NO: 114221 - DNA, 36 bp, Artificial Sequence
  Description of Artificial Sequence: Synthetic oligonucleotide
aagagtgcttaagattcctgcaagctggacaaatcc

SEQ ID NO: 114222 - DNA, 35 bp, Artificial Sequence
  Description of Artificial Sequence: Synthetic oligonucleotide
agagtgcttaagattcctgcaagctggacaaatcc

SEQ ID NO: 114223 - DNA, 34 bp, Artificial Sequence
  Description of Artificial Sequence: Synthetic oligonucleotide
gagtgcttaagattcctgcaagctggacaaatcc

SEQ ID NO: 114224 - DNA, 34 bp, Artificial Sequence
  Description of Artificial Sequence: Synthetic oligonucleotide
agtgcttaagattcctgcaagctggacaaatccc

SEQ ID NO: 114225 - DNA, 33 bp, Artificial Sequence
  Description of Artificial Sequence: Synthetic oligonucleotide
gtgcttaagattcctgcaagctggacaaatccc

SEQ ID NO: 114226 - DNA, 34 bp, Artificial Sequence
  Description of Artificial Sequence: Synthetic oligonucleotide
tgcttaagattcctgcaagctggacaaatccctc

SEQ ID NO: 114227 - DNA, 33 bp, Artificial Sequence
  Description of Artificial Sequence: Synthetic oligonucleotide
gcttaagattcctgcaagctggacaaatccctc

SEQ ID NO: 114228 - DNA, 34 bp, Artificial Sequence
  Description of Artificial Sequence: Synthetic oligonucleotide
cttaagattcctgcaagctggacaaatccctcag

SEQ ID NO: 114229 - DNA, 34 bp, Artificial Sequence
  Description of Artificial Sequence: Synthetic oligonucleotide
ttaagattcctgcaagctggacaaatccctcagg

SEQ ID NO: 114230 - DNA, 33 bp, Artificial Sequence
  Description of Artificial Sequence: Synthetic oligonucleotide
taagattcctgcaagctggacaaatccctcagg

SEQ ID NO: 114231 - DNA, 32 bp, Artificial Sequence
  Description of Artificial Sequence: Synthetic oligonucleotide
aagattcctgcaagctggacaaatccctcagg

SEQ ID NO: 114232 - DNA, 31 bp, Artificial Sequence
  Description of Artificial Sequence: Synthetic oligonucleotide
agattcctgcaagctggacaaatccctcagg

SEQ ID NO: 114233 - DNA, 30 bp, Artificial Sequence
  Description of Artificial Sequence: Synthetic oligonucleotide
gattcctgcaagctggacaaatccctcagg

SEQ ID NO: 114234 - DNA, 30 bp, Artificial Sequence
  Description of Artificial Sequence: Synthetic oligonucleotide
attcctgcaagctggacaaatccctcaggc

SEQ ID NO: 114235 - DNA, 29 bp, Artificial Sequence
  Description of Artificial Sequence: Synthetic oligonucleotide
ttcctgcaagctggacaaatccctcaggc

SEQ ID NO: 114236 - DNA, 28 bp, Artificial Sequence
  Description of Artificial Sequence: Synthetic oligonucleotide
tcctgcaagctggacaaatccctcaggc

SEQ ID NO: 114237 - DNA, 27 bp, Artificial Sequence
  Description of Artificial Sequence: Synthetic oligonucleotide
cctgcaagctggacaaatccctcaggc

SEQ ID NO: 114238 - DNA, 33 bp, Artificial Sequence
  Description of Artificial Sequence: Synthetic oligonucleotide
ctgcaagctggacaaatccctcaggcaaatatc

SEQ ID NO: 114239 - DNA, 38 bp, Artificial Sequence
  Description of Artificial Sequence: Synthetic oligonucleotide
tgcaagctggacaaatccctcaggcaaatatcatattg

SEQ ID NO: 114240 - DNA, 37 bp, Artificial Sequence
  Description of Artificial Sequence: Synthetic oligonucleotide
gcaagctggacaaatccctcaggcaaatatcatattg

SEQ ID NO: 114241 - DNA, 37 bp, Artificial Sequence
  Description of Artificial Sequence: Synthetic oligonucleotide
caagctggacaaatccctcaggcaaatatcatattgg

SEQ ID NO: 114242 - DNA, 37 bp, Artificial Sequence
  Description of Artificial Sequence: Synthetic oligonucleotide
aagctggacaaatccctcaggcaaatatcatattggc

SEQ ID NO: 114243 - DNA, 36 bp, Artificial Sequence
  Description of Artificial Sequence: Synthetic oligonucleotide
agctggacaaatccctcaggcaaatatcatattggc

SEQ ID NO: 114244 - DNA, 35 bp, Artificial Sequence
  Description of Artificial Sequence: Synthetic oligonucleotide
gctggacaaatccctcaggcaaatatcatattggc

SEQ ID NO: 114245 - DNA, 44 bp, Artificial Sequence
  Description of Artificial Sequence: Synthetic oligonucleotide
ctggacaaatccctcaggcaaatatcatattggcataaaaaatg

SEQ ID NO: 114246 - DNA, 44 bp, Artificial Sequence
  Description of Artificial Sequence: Synthetic oligonucleotide
tggacaaatccctcaggcaaatatcatattggcataaaaaatgg

SEQ ID NO: 114247 - DNA, 43 bp, Artificial Sequence
  Description of Artificial Sequence: Synthetic oligonucleotide
ggacaaatccctcaggcaaatatcatattggcataaaaaatgg

SEQ ID NO: 114248 - DNA, 43 bp, Artificial Sequence
  Description of Artificial Sequence: Synthetic oligonucleotide
gacaaatccctcaggcaaatatcatattggcataaaaaatggc

SEQ ID NO: 114249 - DNA, 46 bp, Artificial Sequence
  Description of Artificial Sequence: Synthetic oligonucleotide
acaaatccctcaggcaaatatcatattggcataaaaaatggctatg

SEQ ID NO: 114250 - DNA, 45 bp, Artificial Sequence
  Description of Artificial Sequence: Synthetic oligonucleotide
caaatccctcaggcaaatatcatattggcataaaaaatggctatg

SEQ ID NO: 114251 - DNA, 46 bp, Artificial Sequence
  Description of Artificial Sequence: Synthetic oligonucleotide
aaatccctcaggcaaatatcatattggcataaaaaatggctatgac

SEQ ID NO: 114252 - DNA, 45 bp, Artificial Sequence
  Description of Artificial Sequence: Synthetic oligonucleotide
aatccctcaggcaaatatcatattggcataaaaaatggctatgac

SEQ ID NO: 114253 - DNA, 44 bp, Artificial Sequence
  Description of Artificial Sequence: Synthetic oligonucleotide
atccctcaggcaaatatcatattggcataaaaaatggctatgac

SEQ ID NO: 114254 - DNA, 43 bp, Artificial Sequence
  Description of Artificial Sequence: Synthetic oligonucleotide
tccctcaggcaaatatcatattggcataaaaaatggctatgac

SEQ ID NO: 114255 - DNA, 42 bp, Artificial Sequence
  Description of Artificial Sequence: Synthetic oligonucleotide
ccctcaggcaaatatcatattggcataaaaaatggctatgac

SEQ ID NO: 114256 - DNA, 44 bp, Artificial Sequence
  Description of Artificial Sequence: Synthetic oligonucleotide
cctcaggcaaatatcatattggcataaaaaatggctatgacttc

SEQ ID NO: 114257 - DNA, 47 bp, Artificial Sequence
  Description of Artificial Sequence: Synthetic oligonucleotide
ctcaggcaaatatcatattggcataaaaaatggctatgacttctatc

SEQ ID NO: 114258 - DNA, 47 bp, Artificial Sequence
  Description of Artificial Sequence: Synthetic oligonucleotide
tcaggcaaatatcatattggcataaaaaatggctatgacttctatcc

SEQ ID NO: 114259 - DNA, 46 bp, Artificial Sequence
  Description of Artificial Sequence: Synthetic oligonucleotide
caggcaaatatcatattggcataaaaaatggctatgacttctatcc

SEQ ID NO: 114260 - DNA, 49 bp, Artificial Sequence
  Description of Artificial Sequence: Synthetic oligonucleotide
aggcaaatatcatattggcataaaaaatggctatgacttctatcctaag

SEQ ID NO: 114261 - DNA, 48 bp, Artificial Sequence
  Description of Artificial Sequence: Synthetic oligonucleotide
ggcaaatatcatattggcataaaaaatggctatgacttctatcctaag

SEQ ID NO: 114262 - DNA, 48 bp, Artificial Sequence
  Description of Artificial Sequence: Synthetic oligonucleotide
gcaaatatcatattggcataaaaaatggctatgacttctatcctaagg

SEQ ID NO: 114263 - DNA, 48 bp, Artificial Sequence
  Description of Artificial Sequence: Synthetic oligonucleotide
caaatatcatattggcataaaaaatggctatgacttctatcctaaggc

SEQ ID NO: 114264 - DNA, 49 bp, Artificial Sequence
  Description of Artificial Sequence: Synthetic oligonucleotide
aaatatcatattggcataaaaaatggctatgacttctatcctaaggcac

SEQ ID NO: 114265 - DNA, 48 bp, Artificial Sequence
  Description of Artificial Sequence: Synthetic oligonucleotide
aatatcatattggcataaaaaatggctatgacttctatcctaaggcac

SEQ ID NO: 114266 - DNA, 47 bp, Artificial Sequence
  Description of Artificial Sequence: Synthetic oligonucleotide
atatcatattggcataaaaaatggctatgacttctatcctaaggcac

SEQ ID NO: 114267 - DNA, 46 bp, Artificial Sequence
  Description of Artificial Sequence: Synthetic oligonucleotide
tatcatattggcataaaaaatggctatgacttctatcctaaggcac

SEQ ID NO: 114268 - DNA, 45 bp, Artificial Sequence
  Description of Artificial Sequence: Synthetic oligonucleotide
atcatattggcataaaaaatggctatgacttctatcctaaggcac

SEQ ID NO: 114269 - DNA, 44 bp, Artificial Sequence
  Description of Artificial Sequence: Synthetic oligonucleotide
tcatattggcataaaaaatggctatgacttctatcctaaggcac

SEQ ID NO: 114270 - DNA, 43 bp, Artificial Sequence
  Description of Artificial Sequence: Synthetic oligonucleotide
catattggcataaaaaatggctatgacttctatcctaaggcac

SEQ ID NO: 114271 - DNA, 44 bp, Artificial Sequence
  Description of Artificial Sequence: Synthetic oligonucleotide
atattggcataaaaaatggctatgacttctatcctaaggcactc

SEQ ID NO: 114272 - DNA, 43 bp, Artificial Sequence
  Description of Artificial Sequence: Synthetic oligonucleotide
tattggcataaaaaatggctatgacttctatcctaaggcactc

SEQ ID NO: 114273 - DNA, 42 bp, Artificial Sequence
  Description of Artificial Sequence: Synthetic oligonucleotide
attggcataaaaaatggctatgacttctatcctaaggcactc

SEQ ID NO: 114274 - DNA, 41 bp, Artificial Sequence
  Description of Artificial Sequence: Synthetic oligonucleotide
ttggcataaaaaatggctatgacttctatcctaaggcactc

SEQ ID NO: 114275 - DNA, 40 bp, Artificial Sequence
  Description of Artificial Sequence: Synthetic oligonucleotide
tggcataaaaaatggctatgacttctatcctaaggcactc

SEQ ID NO: 114276 - DNA, 39 bp, Artificial Sequence
  Description of Artificial Sequence: Synthetic oligonucleotide
ggcataaaaaatggctatgacttctatcctaaggcactc

SEQ ID NO: 114277 - DNA, 41 bp, Artificial Sequence
  Description of Artificial Sequence: Synthetic oligonucleotide
gcataaaaaatggctatgacttctatcctaaggcactcaag

SEQ ID NO: 114278 - DNA, 41 bp, Artificial Sequence
  Description of Artificial Sequence: Synthetic oligonucleotide
cataaaaaatggctatgacttctatcctaaggcactcaagg

SEQ ID NO: 114279 - DNA, 44 bp, Artificial Sequence
  Description of Artificial Sequence: Synthetic oligonucleotide
ataaaaaatggctatgacttctatcctaaggcactcaaggaaag

SEQ ID NO: 114280 - DNA, 43 bp, Artificial Sequence
  Description of Artificial Sequence: Synthetic oligonucleotide
taaaaaatggctatgacttctatcctaaggcactcaaggaaag

SEQ ID NO: 114281 - DNA, 42 bp, Artificial Sequence
  Description of Artificial Sequence: Synthetic oligonucleotide
aaaaaatggctatgacttctatcctaaggcactcaaggaaag

SEQ ID NO: 114282 - DNA, 41 bp, Artificial Sequence
  Description of Artificial Sequence: Synthetic oligonucleotide
aaaaatggctatgacttctatcctaaggcactcaaggaaag

SEQ ID NO: 114283 - DNA, 40 bp, Artificial Sequence
  Description of Artificial Sequence: Synthetic oligonucleotide
aaaatggctatgacttctatcctaaggcactcaaggaaag

SEQ ID NO: 114284 - DNA, 39 bp, Artificial Sequence
  Description of Artificial Sequence: Synthetic oligonucleotide
aaatggctatgacttctatcctaaggcactcaaggaaag

SEQ ID NO: 114285 - DNA, 38 bp, Artificial Sequence
  Description of Artificial Sequence: Synthetic oligonucleotide
aatggctatgacttctatcctaaggcactcaaggaaag

SEQ ID NO: 114286 - DNA, 37 bp, Artificial Sequence
  Description of Artificial Sequence: Synthetic oligonucleotide
atggctatgacttctatcctaaggcactcaaggaaag

SEQ ID NO: 114287 - DNA, 36 bp, Artificial Sequence
  Description of Artificial Sequence: Synthetic oligonucleotide
tggctatgacttctatcctaaggcactcaaggaaag

SEQ ID NO: 114288 - DNA, 35 bp, Artificial Sequence
  Description of Artificial Sequence: Synthetic oligonucleotide
ggctatgacttctatcctaaggcactcaaggaaag

SEQ ID NO: 114289 - DNA, 35 bp, Artificial Sequence
  Description of Artificial Sequence: Synthetic oligonucleotide
gctatgacttctatcctaaggcactcaaggaaagg

SEQ ID NO: 114290 - DNA, 38 bp, Artificial Sequence
  Description of Artificial Sequence: Synthetic oligonucleotide
ctatgacttctatcctaaggcactcaaggaaaggatac

SEQ ID NO: 114291 - DNA, 39 bp, Artificial Sequence
  Description of Artificial Sequence: Synthetic oligonucleotide
tatgacttctatcctaaggcactcaaggaaaggatacag

SEQ ID NO: 114292 - DNA, 38 bp, Artificial Sequence
  Description of Artificial Sequence: Synthetic oligonucleotide
atgacttctatcctaaggcactcaaggaaaggatacag

SEQ ID NO: 114293 - DNA, 37 bp, Artificial Sequence
  Description of Artificial Sequence: Synthetic oligonucleotide
tgacttctatcctaaggcactcaaggaaaggatacag

SEQ ID NO: 114294 - DNA, 36 bp, Artificial Sequence
  Description of Artificial Sequence: Synthetic oligonucleotide
gacttctatcctaaggcactcaaggaaaggatacag

SEQ ID NO: 114295 - DNA, 39 bp, Artificial Sequence
  Description of Artificial Sequence: Synthetic oligonucleotide
acttctatcctaaggcactcaaggaaaggatacagaaag

SEQ ID NO: 114296 - DNA, 38 bp, Artificial Sequence
  Description of Artificial Sequence: Synthetic oligonucleotide
cttctatcctaaggcactcaaggaaaggatacagaaag

SEQ ID NO: 114297 - DNA, 40 bp, Artificial Sequence
  Description of Artificial Sequence: Synthetic oligonucleotide
ttctatcctaaggcactcaaggaaaggatacagaaagaac

SEQ ID NO: 114298 - DNA, 39 bp, Artificial Sequence
  Description of Artificial Sequence: Synthetic oligonucleotide
tctatcctaaggcactcaaggaaaggatacagaaagaac

SEQ ID NO: 114299 - DNA, 38 bp, Artificial Sequence
  Description of Artificial Sequence: Synthetic oligonucleotide
ctatcctaaggcactcaaggaaaggatacagaaagaac

SEQ ID NO: 114300 - DNA, 38 bp, Artificial Sequence
  Description of Artificial Sequence: Synthetic oligonucleotide
tatcctaaggcactcaaggaaaggatacagaaagaacg

SEQ ID NO: 114301 - DNA, 37 bp, Artificial Sequence
  Description of Artificial Sequence: Synthetic oligonucleotide
atcctaaggcactcaaggaaaggatacagaaagaacg

SEQ ID NO: 114302 - DNA, 36 bp, Artificial Sequence
  Description of Artificial Sequence: Synthetic oligonucleotide
tcctaaggcactcaaggaaaggatacagaaagaacg

SEQ ID NO: 114303 - DNA, 35 bp, Artificial Sequence
  Description of Artificial Sequence: Synthetic oligonucleotide
cctaaggcactcaaggaaaggatacagaaagaacg

SEQ ID NO: 114304 - DNA, 35 bp, Artificial Sequence
  Description of Artificial Sequence: Synthetic oligonucleotide
ctaaggcactcaaggaaaggatacagaaagaacgg

SEQ ID NO: 114305 - DNA, 37 bp, Artificial Sequence
  Description of Artificial Sequence: Synthetic oligonucleotide
taaggcactcaaggaaaggatacagaaagaacggaag

SEQ ID NO: 114306 - DNA, 36 bp, Artificial Sequence
  Description of Artificial Sequence: Synthetic oligonucleotide
aaggcactcaaggaaaggatacagaaagaacggaag

SEQ ID NO: 114307 - DNA, 35 bp, Artificial Sequence
  Description of Artificial Sequence: Synthetic oligonucleotide
aggcactcaaggaaaggatacagaaagaacggaag

SEQ ID NO: 114308 - DNA, 34 bp, Artificial Sequence
  Description of Artificial Sequence: Synthetic oligonucleotide
ggcactcaaggaaaggatacagaaagaacggaag

SEQ ID NO: 114309 - DNA, 34 bp, Artificial Sequence
  Description of Artificial Sequence: Synthetic oligonucleotide
gcactcaaggaaaggatacagaaagaacggaagg

SEQ ID NO: 114310 - DNA, 41 bp, Artificial Sequence
  Description of Artificial Sequence: Synthetic oligonucleotide
cactcaaggaaaggatacagaaagaacggaaggaaaaaatc

SEQ ID NO: 114311 - DNA, 42 bp, Artificial Sequence
  Description of Artificial Sequence: Synthetic oligonucleotide
actcaaggaaaggatacagaaagaacggaaggaaaaaatctg

SEQ ID NO: 114312 - DNA, 41 bp, Artificial Sequence
  Description of Artificial Sequence: Synthetic oligonucleotide
ctcaaggaaaggatacagaaagaacggaaggaaaaaatctg

SEQ ID NO: 114313 - DNA, 41 bp, Artificial Sequence
  Description of Artificial Sequence: Synthetic oligonucleotide
tcaaggaaaggatacagaaagaacggaaggaaaaaatctgg

SEQ ID NO: 114314 - DNA, 40 bp, Artificial Sequence
  Description of Artificial Sequence: Synthetic oligonucleotide
caaggaaaggatacagaaagaacggaaggaaaaaatctgg

SEQ ID NO: 114315 - DNA, 40 bp, Artificial Sequence
  Description of Artificial Sequence: Synthetic oligonucleotide
aaggaaaggatacagaaagaacggaaggaaaaaatctggg

SEQ ID NO: 114316 - DNA, 39 bp, Artificial Sequence
  Description of Artificial Sequence: Synthetic oligonucleotide
aggaaaggatacagaaagaacggaaggaaaaaatctggg

SEQ ID NO: 114317 - DNA, 38 bp, Artificial Sequence
  Description of Artificial Sequence: Synthetic oligonucleotide
ggaaaggatacagaaagaacggaaggaaaaaatctggg

SEQ ID NO: 114318 - DNA, 39 bp, Artificial Sequence
  Description of Artificial Sequence: Synthetic oligonucleotide
gaaaggatacagaaagaacggaaggaaaaaatctgggac

SEQ ID NO: 114319 - DNA, 39 bp, Artificial Sequence
  Description of Artificial Sequence: Synthetic oligonucleotide
aaaggatacagaaagaacggaaggaaaaaatctgggacc

SEQ ID NO: 114320 - DNA, 38 bp, Artificial Sequence
  Description of Artificial Sequence: Synthetic oligonucleotide
aaggatacagaaagaacggaaggaaaaaatctgggacc

SEQ ID NO: 114321 - DNA, 37 bp, Artificial Sequence
  Description of Artificial Sequence: Synthetic oligonucleotide
aggatacagaaagaacggaaggaaaaaatctgggacc

SEQ ID NO: 114322 - DNA, 36 bp, Artificial Sequence
  Description of Artificial Sequence: Synthetic oligonucleotide
ggatacagaaagaacggaaggaaaaaatctgggacc

SEQ ID NO: 114323 - DNA, 36 bp, Artificial Sequence
  Description of Artificial Sequence: Synthetic oligonucleotide
gatacagaaagaacggaaggaaaaaatctgggaccc

SEQ ID NO: 114324 - DNA, 37 bp, Artificial Sequence
  Description of Artificial Sequence: Synthetic oligonucleotide
atacagaaagaacggaaggaaaaaatctgggaccctg

SEQ ID NO: 114325 - DNA, 36 bp, Artificial Sequence
  Description of Artificial Sequence: Synthetic oligonucleotide
tacagaaagaacggaaggaaaaaatctgggaccctg

SEQ ID NO: 114326 - DNA, 35 bp, Artificial Sequence
  Description of Artificial Sequence: Synthetic oligonucleotide
acagaaagaacggaaggaaaaaatctgggaccctg

SEQ ID NO: 114327 - DNA, 34 bp, Artificial Sequence
  Description of Artificial Sequence: Synthetic oligonucleotide
cagaaagaacggaaggaaaaaatctgggaccctg

SEQ ID NO: 114328 - DNA, 36 bp, Artificial Sequence
  Description of Artificial Sequence: Synthetic oligonucleotide
agaaagaacggaaggaaaaaatctgggaccctgttc

SEQ ID NO: 114329 - DNA, 35 bp, Artificial Sequence
  Description of Artificial Sequence: Synthetic oligonucleotide
gaaagaacggaaggaaaaaatctgggaccctgttc

SEQ ID NO: 114330 - DNA, 36 bp, Artificial Sequence
  Description of Artificial Sequence: Synthetic oligonucleotide
aaagaacggaaggaaaaaatctgggaccctgttcac

SEQ ID NO: 114331 - DNA, 35 bp, Artificial Sequence
  Description of Artificial Sequence: Synthetic oligonucleotide
aagaacggaaggaaaaaatctgggaccctgttcac

SEQ ID NO: 114332 - DNA, 34 bp, Artificial Sequence
  Description of Artificial Sequence: Synthetic oligonucleotide
agaacggaaggaaaaaatctgggaccctgttcac

SEQ ID NO: 114333 - DNA, 33 bp, Artificial Sequence
  Description of Artificial Sequence: Synthetic oligonucleotide
gaacggaaggaaaaaatctgggaccctgttcac

SEQ ID NO: 114334 - DNA, 34 bp, Artificial Sequence
  Description of Artificial Sequence: Synthetic oligonucleotide
aacggaaggaaaaaatctgggaccctgttcacag

SEQ ID NO: 114335 - DNA, 33 bp, Artificial Sequence
  Description of Artificial Sequence: Synthetic oligonucleotide
acggaaggaaaaaatctgggaccctgttcacag

SEQ ID NO: 114336 - DNA, 32 bp, Artificial Sequence
  Description of Artificial Sequence: Synthetic oligonucleotide
cggaaggaaaaaatctgggaccctgttcacag

SEQ ID NO: 114337 - DNA, 33 bp, Artificial Sequence
  Description of Artificial Sequence: Synthetic oligonucleotide
ggaaggaaaaaatctgggaccctgttcacagag

SEQ ID NO: 114338 - DNA, 34 bp, Artificial Sequence
  Description of Artificial Sequence: Synthetic oligonucleotide
gaaggaaaaaatctgggaccctgttcacagagtg

SEQ ID NO: 114339 - DNA, 34 bp, Artificial Sequence
  Description of Artificial Sequence: Synthetic oligonucleotide
aaggaaaaaatctgggaccctgttcacagagtgg

SEQ ID NO: 114340 - DNA, 33 bp, Artificial Sequence
  Description of Artificial Sequence: Synthetic oligonucleotide
aggaaaaaatctgggaccctgttcacagagtgg

SEQ ID NO: 114341 - DNA, 32 bp, Artificial Sequence
  Description of Artificial Sequence: Synthetic oligonucleotide
ggaaaaaatctgggaccctgttcacagagtgg

SEQ ID NO: 114342 - DNA, 32 bp, Artificial Sequence
  Description of Artificial Sequence: Synthetic oligonucleotide
gaaaaaatctgggaccctgttcacagagtggc

SEQ ID NO: 114343 - DNA, 32 bp, Artificial Sequence
  Description of Artificial Sequence: Synthetic oligonucleotide
aaaaaatctgggaccctgttcacagagtggcc

SEQ ID NO: 114344 - DNA, 31 bp, Artificial Sequence
  Description of Artificial Sequence: Synthetic oligonucleotide
aaaaatctgggaccctgttcacagagtggcc

SEQ ID NO: 114345 - DNA, 30 bp, Artificial Sequence
  Description of Artificial Sequence: Synthetic oligonucleotide
aaaatctgggaccctgttcacagagtggcc

SEQ ID NO: 114346 - DNA, 29 bp, Artificial Sequence
  Description of Artificial Sequence: Synthetic oligonucleotide
aaatctgggaccctgttcacagagtggcc

SEQ ID NO: 114347 - DNA, 28 bp, Artificial Sequence
  Description of Artificial Sequence: Synthetic oligonucleotide
aatctgggaccctgttcacagagtggcc

SEQ ID NO: 114348 - DNA, 27 bp, Artificial Sequence
  Description of Artificial Sequence: Synthetic oligonucleotide
atctgggaccctgttcacagagtggcc

SEQ ID NO: 114349 - DNA, 26 bp, Artificial Sequence
  Description of Artificial Sequence: Synthetic oligonucleotide
tctgggaccctgttcacagagtggcc

SEQ ID NO: 114350 - DNA, 25 bp, Artificial Sequence
  Description of Artificial Sequence: Synthetic oligonucleotide
ctgggaccctgttcacagagtggcc

SEQ ID NO: 114351 - DNA, 27 bp, Artificial Sequence
  Description of Artificial Sequence: Synthetic oligonucleotide
tgggaccctgttcacagagtggccctt

SEQ ID NO: 114352 - DNA, 26 bp, Artificial Sequence
  Description of Artificial Sequence: Synthetic oligonucleotide
gggaccctgttcacagagtggccctt

SEQ ID NO: 114353 - DNA, 26 bp, Artificial Sequence
  Description of Artificial Sequence: Synthetic oligonucleotide
ggaccctgttcacagagtggcccttg

SEQ ID NO: 114354 - DNA, 27 bp, Artificial Sequence
  Description of Artificial Sequence: Synthetic oligonucleotide
gaccctgttcacagagtggcccttgca

SEQ ID NO: 114355 - DNA, 27 bp, Artificial Sequence
  Description of Artificial Sequence: Synthetic oligonucleotide
accctgttcacagagtggcccttgcag

SEQ ID NO: 114356 - DNA, 27 bp, Artificial Sequence
  Description of Artificial Sequence: Synthetic oligonucleotide
ccctgttcacagagtggcccttgcaga

SEQ ID NO: 114357 - DNA, 28 bp, Artificial Sequence
  Description of Artificial Sequence: Synthetic oligonucleotide
cctgttcacagagtggcccttgcagaag

SEQ ID NO: 114358 - DNA, 28 bp, Artificial Sequence
  Description of Artificial Sequence: Synthetic oligonucleotide
ctgttcacagagtggcccttgcagaagc

SEQ ID NO: 114359 - DNA, 28 bp, Artificial Sequence
  Description of Artificial Sequence: Synthetic oligonucleotide
tgttcacagagtggcccttgcagaagcc

SEQ ID NO: 114360 - DNA, 27 bp, Artificial Sequence
  Description of Artificial Sequence: Synthetic oligonucleotide
gttcacagagtggcccttgcagaagcc

SEQ ID NO: 114361 - DNA, 28 bp, Artificial Sequence
  Description of Artificial Sequence: Synthetic oligonucleotide
ttcacagagtggcccttgcagaagcctg

SEQ ID NO: 114362 - DNA, 27 bp, Artificial Sequence
  Description of Artificial Sequence: Synthetic oligonucleotide
tcacagagtggcccttgcagaagcctg

SEQ ID NO: 114363 - DNA, 27 bp, Artificial Sequence
  Description of Artificial Sequence: Synthetic oligonucleotide
cacagagtggcccttgcagaagcctgt

SEQ ID NO: 114364 - DNA, 28 bp, Artificial Sequence
  Description of Artificial Sequence: Synthetic oligonucleotide
acagagtggcccttgcagaagcctgtag

SEQ ID NO: 114365 - DNA, 27 bp, Artificial Sequence
  Description of Artificial Sequence: Synthetic oligonucleotide
cagagtggcccttgcagaagcctgtag

SEQ ID NO: 114366 - DNA, 31 bp, Artificial Sequence
  Description of Artificial Sequence: Synthetic oligonucleotide
agagtggcccttgcagaagcctgtagaaaac

SEQ ID NO: 114367 - DNA, 30 bp, Artificial Sequence
  Description of Artificial Sequence: Synthetic oligonucleotide
gagtggcccttgcagaagcctgtagaaaac

SEQ ID NO: 114368 - DNA, 31 bp, Artificial Sequence
  Description of Artificial Sequence: Synthetic oligonucleotide
agtggcccttgcagaagcctgtagaaaacag

SEQ ID NO: 114369 - DNA, 30 bp, Artificial Sequence
  Description of Artificial Sequence: Synthetic oligonucleotide
gtggcccttgcagaagcctgtagaaaacag

SEQ ID NO: 114370 - DNA, 30 bp, Artificial Sequence
  Description of Artificial Sequence: Synthetic oligonucleotide
tggcccttgcagaagcctgtagaaaacagg

SEQ ID NO: 114371 - DNA, 29 bp, Artificial Sequence
  Description of Artificial Sequence: Synthetic oligonucleotide
ggcccttgcagaagcctgtagaaaacagg

SEQ ID NO: 114372 - DNA, 31 bp, Artificial Sequence
  Description of Artificial Sequence: Synthetic oligonucleotide
gcccttgcagaagcctgtagaaaacaggaag

SEQ ID NO: 114373 - DNA, 36 bp, Artificial Sequence
  Description of Artificial Sequence: Synthetic oligonucleotide
cccttgcagaagcctgtagaaaacaggaagaatttg

SEQ ID NO: 114374 - DNA, 38 bp, Artificial Sequence
  Description of Artificial Sequence: Synthetic oligonucleotide
ccttgcagaagcctgtagaaaacaggaagaatttgatg

SEQ ID NO: 114375 - DNA, 40 bp, Artificial Sequence
  Description of Artificial Sequence: Synthetic oligonucleotide
cttgcagaagcctgtagaaaacaggaagaatttgatgttg

SEQ ID NO: 114376 - DNA, 40 bp, Artificial Sequence
  Description of Artificial Sequence: Synthetic oligonucleotide
ttgcagaagcctgtagaaaacaggaagaatttgatgttgc

SEQ ID NO: 114377 - DNA, 39 bp, Artificial Sequence
  Description of Artificial Sequence: Synthetic oligonucleotide
tgcagaagcctgtagaaaacaggaagaatttgatgttgc

SEQ ID NO: 114378 - DNA, 38 bp, Artificial Sequence
  Description of Artificial Sequence: Synthetic oligonucleotide
gcagaagcctgtagaaaacaggaagaatttgatgttgc

SEQ ID NO: 114379 - DNA, 38 bp, Artificial Sequence
  Description of Artificial Sequence: Synthetic oligonucleotide
cagaagcctgtagaaaacaggaagaatttgatgttgcc

SEQ ID NO: 114380 - DNA, 40 bp, Artificial Sequence
  Description of Artificial Sequence: Synthetic oligonucleotide
agaagcctgtagaaaacaggaagaatttgatgttgccaac

SEQ ID NO: 114381 - DNA, 39 bp, Artificial Sequence
  Description of Artificial Sequence: Synthetic oligonucleotide
gaagcctgtagaaaacaggaagaatttgatgttgccaac

SEQ ID NO: 114382 - DNA, 41 bp, Artificial Sequence
  Description of Artificial Sequence: Synthetic oligonucleotide
aagcctgtagaaaacaggaagaatttgatgttgccaacaac

SEQ ID NO: 114383 - DNA, 40 bp, Artificial Sequence
  Description of Artificial Sequence: Synthetic oligonucleotide
agcctgtagaaaacaggaagaatttgatgttgccaacaac

SEQ ID NO: 114384 - DNA, 39 bp, Artificial Sequence
  Description of Artificial Sequence: Synthetic oligonucleotide
gcctgtagaaaacaggaagaatttgatgttgccaacaac

SEQ ID NO: 114385 - DNA, 39 bp, Artificial Sequence
  Description of Artificial Sequence: Synthetic oligonucleotide
cctgtagaaaacaggaagaatttgatgttgccaacaacg

SEQ ID NO: 114386 - DNA, 39 bp, Artificial Sequence
  Description of Artificial Sequence: Synthetic oligonucleotide
ctgtagaaaacaggaagaatttgatgttgccaacaacgg

SEQ ID NO: 114387 - DNA, 39 bp, Artificial Sequence
  Description of Artificial Sequence: Synthetic oligonucleotide
tgtagaaaacaggaagaatttgatgttgccaacaacggc

SEQ ID NO: 114388 - DNA, 38 bp, Artificial Sequence
  Description of Artificial Sequence: Synthetic oligonucleotide
gtagaaaacaggaagaatttgatgttgccaacaacggc

SEQ ID NO: 114389 - DNA, 39 bp, Artificial Sequence
  Description of Artificial Sequence: Synthetic oligonucleotide
tagaaaacaggaagaatttgatgttgccaacaacggctc

SEQ ID NO: 114390 - DNA, 38 bp, Artificial Sequence
  Description of Artificial Sequence: Synthetic oligonucleotide
agaaaacaggaagaatttgatgttgccaacaacggctc

SEQ ID NO: 114391 - DNA, 37 bp, Artificial Sequence
  Description of Artificial Sequence: Synthetic oligonucleotide
gaaaacaggaagaatttgatgttgccaacaacggctc

SEQ ID NO: 114392 - DNA, 39 bp, Artificial Sequence
  Description of Artificial Sequence: Synthetic oligonucleotide
aaaacaggaagaatttgatgttgccaacaacggctcttc

SEQ ID NO: 114393 - DNA, 38 bp, Artificial Sequence
  Description of Artificial Sequence: Synthetic oligonucleotide
aaacaggaagaatttgatgttgccaacaacggctcttc

SEQ ID NO: 114394 - DNA, 37 bp, Artificial Sequence
  Description of Artificial Sequence: Synthetic oligonucleotide
aacaggaagaatttgatgttgccaacaacggctcttc

SEQ ID NO: 114395 - DNA, 36 bp, Artificial Sequence
  Description of Artificial Sequence: Synthetic oligonucleotide
acaggaagaatttgatgttgccaacaacggctcttc

SEQ ID NO: 114396 - DNA, 35 bp, Artificial Sequence
  Description of Artificial Sequence: Synthetic oligonucleotide
caggaagaatttgatgttgccaacaacggctcttc

SEQ ID NO: 114397 - DNA, 36 bp, Artificial Sequence
  Description of Artificial Sequence: Synthetic oligonucleotide
aggaagaatttgatgttgccaacaacggctcttctc

SEQ ID NO: 114398 - DNA, 35 bp, Artificial Sequence
  Description of Artificial Sequence: Synthetic oligonucleotide
ggaagaatttgatgttgccaacaacggctcttctc

SEQ ID NO: 114399 - DNA, 37 bp, Artificial Sequence
  Description of Artificial Sequence: Synthetic oligonucleotide
gaagaatttgatgttgccaacaacggctcttctcaag

SEQ ID NO: 114400 - DNA, 37 bp, Artificial Sequence
  Description of Artificial Sequence: Synthetic oligonucleotide
aagaatttgatgttgccaacaacggctcttctcaagc

SEQ ID NO: 114401 - DNA, 36 bp, Artificial Sequence
  Description of Artificial Sequence: Synthetic oligonucleotide
agaatttgatgttgccaacaacggctcttctcaagc

SEQ ID NO: 114402 - DNA, 35 bp, Artificial Sequence
  Description of Artificial Sequence: Synthetic oligonucleotide
gaatttgatgttgccaacaacggctcttctcaagc

SEQ ID NO: 114403 - DNA, 42 bp, Artificial Sequence
  Description of Artificial Sequence: Synthetic oligonucleotide
aatttgatgttgccaacaacggctcttctcaagcaaataaac

SEQ ID NO: 114404 - DNA, 41 bp, Artificial Sequence
  Description of Artificial Sequence: Synthetic oligonucleotide
atttgatgttgccaacaacggctcttctcaagcaaataaac

SEQ ID NO: 114405 - DNA, 40 bp, Artificial Sequence
  Description of Artificial Sequence: Synthetic oligonucleotide
tttgatgttgccaacaacggctcttctcaagcaaataaac

SEQ ID NO: 114406 - DNA, 39 bp, Artificial Sequence
  Description of Artificial Sequence: Synthetic oligonucleotide
ttgatgttgccaacaacggctcttctcaagcaaataaac

SEQ ID NO: 114407 - DNA, 38 bp, Artificial Sequence
  Description of Artificial Sequence: Synthetic oligonucleotide
tgatgttgccaacaacggctcttctcaagcaaataaac

SEQ ID NO: 114408 - DNA, 37 bp, Artificial Sequence
  Description of Artificial Sequence: Synthetic oligonucleotide
gatgttgccaacaacggctcttctcaagcaaataaac

SEQ ID NO: 114409 - DNA, 41 bp, Artificial Sequence
  Description of Artificial Sequence: Synthetic oligonucleotide
atgttgccaacaacggctcttctcaagcaaataaactaatc

SEQ ID NO: 114410 - DNA, 40 bp, Artificial Sequence
  Description of Artificial Sequence: Synthetic oligonucleotide
tgttgccaacaacggctcttctcaagcaaataaactaatc

SEQ ID NO: 114411 - DNA, 39 bp, Artificial Sequence
  Description of Artificial Sequence: Synthetic oligonucleotide
gttgccaacaacggctcttctcaagcaaataaactaatc

SEQ ID NO: 114412 - DNA, 41 bp, Artificial Sequence
  Description of Artificial Sequence: Synthetic oligonucleotide
ttgccaacaacggctcttctcaagcaaataaactaatcaag

SEQ ID NO: 114413 - DNA, 40 bp, Artificial Sequence
  Description of Artificial Sequence: Synthetic oligonucleotide
tgccaacaacggctcttctcaagcaaataaactaatcaag

SEQ ID NO: 114414 - DNA, 39 bp, Artificial Sequence
  Description of Artificial Sequence: Synthetic oligonucleotide
gccaacaacggctcttctcaagcaaataaactaatcaag

SEQ ID NO: 114415 - DNA, 39 bp, Artificial Sequence
  Description of Artificial Sequence: Synthetic oligonucleotide
ccaacaacggctcttctcaagcaaataaactaatcaagg

SEQ ID NO: 114416 - DNA, 40 bp, Artificial Sequence
  Description of Artificial Sequence: Synthetic oligonucleotide
caacaacggctcttctcaagcaaataaactaatcaaggag

SEQ ID NO: 114417 - DNA, 40 bp, Artificial Sequence
  Description of Artificial Sequence: Synthetic oligonucleotide
aacaacggctcttctcaagcaaataaactaatcaaggagg

SEQ ID NO: 114418 - DNA, 39 bp, Artificial Sequence
  Description of Artificial Sequence: Synthetic oligonucleotide
acaacggctcttctcaagcaaataaactaatcaaggagg

SEQ ID NO: 114419 - DNA, 38 bp, Artificial Sequence
  Description of Artificial Sequence: Synthetic oligonucleotide
caacggctcttctcaagcaaataaactaatcaaggagg

SEQ ID NO: 114420 - DNA, 40 bp, Artificial Sequence
  Description of Artificial Sequence: Synthetic oligonucleotide
aacggctcttctcaagcaaataaactaatcaaggaggaac

SEQ ID NO: 114421 - DNA, 39 bp, Artificial Sequence
  Description of Artificial Sequence: Synthetic oligonucleotide
acggctcttctcaagcaaataaactaatcaaggaggaac

SEQ ID NO: 114422 - DNA, 38 bp, Artificial Sequence
  Description of Artificial Sequence: Synthetic oligonucleotide
cggctcttctcaagcaaataaactaatcaaggaggaac

SEQ ID NO: 114423 - DNA, 40 bp, Artificial Sequence
  Description of Artificial Sequence: Synthetic oligonucleotide
ggctcttctcaagcaaataaactaatcaaggaggaacttc

SEQ ID NO: 114424 - DNA, 43 bp, Artificial Sequence
  Description of Artificial Sequence: Synthetic oligonucleotide
gctcttctcaagcaaataaactaatcaaggaggaacttcaaag

SEQ ID NO: 114425 - DNA, 44 bp, Artificial Sequence
  Description of Artificial Sequence: Synthetic oligonucleotide
ctcttctcaagcaaataaactaatcaaggaggaacttcaaagtc

SEQ ID NO: 114426 - DNA, 46 bp, Artificial Sequence
  Description of Artificial Sequence: Synthetic oligonucleotide
tcttctcaagcaaataaactaatcaaggaggaacttcaaagtcaag

SEQ ID NO: 114427 - DNA, 45 bp, Artificial Sequence
  Description of Artificial Sequence: Synthetic oligonucleotide
cttctcaagcaaataaactaatcaaggaggaacttcaaagtcaag

SEQ ID NO: 114428 - DNA, 46 bp, Artificial Sequence
  Description of Artificial Sequence: Synthetic oligonucleotide
ttctcaagcaaataaactaatcaaggaggaacttcaaagtcaagtg

SEQ ID NO: 114429 - DNA, 45 bp, Artificial Sequence
  Description of Artificial Sequence: Synthetic oligonucleotide
tctcaagcaaataaactaatcaaggaggaacttcaaagtcaagtg

SEQ ID NO: 114430 - DNA, 44 bp, Artificial Sequence
  Description of Artificial Sequence: Synthetic oligonucleotide
ctcaagcaaataaactaatcaaggaggaacttcaaagtcaagtg

SEQ ID NO: 114431 - DNA, 44 bp, Artificial Sequence
  Description of Artificial Sequence: Synthetic oligonucleotide
tcaagcaaataaactaatcaaggaggaacttcaaagtcaagtgg

SEQ ID NO: 114432 - DNA, 43 bp, Artificial Sequence
  Description of Artificial Sequence: Synthetic oligonucleotide
caagcaaataaactaatcaaggaggaacttcaaagtcaagtgg

SEQ ID NO: 114433 - DNA, 47 bp, Artificial Sequence
  Description of Artificial Sequence: Synthetic oligonucleotide
aagcaaataaactaatcaaggaggaacttcaaagtcaagtggaattg

SEQ ID NO: 114434 - DNA, 46 bp, Artificial Sequence
  Description of Artificial Sequence: Synthetic oligonucleotide
agcaaataaactaatcaaggaggaacttcaaagtcaagtggaattg

SEQ ID NO: 114435 - DNA, 45 bp, Artificial Sequence
  Description of Artificial Sequence: Synthetic oligonucleotide
gcaaataaactaatcaaggaggaacttcaaagtcaagtggaattg

SEQ ID NO: 114436 - DNA, 45 bp, Artificial Sequence
  Description of Artificial Sequence: Synthetic oligonucleotide
caaataaactaatcaaggaggaacttcaaagtcaagtggaattgc

SEQ ID NO: 114437 - DNA, 51 bp, Artificial Sequence
  Description of Artificial Sequence: Synthetic oligonucleotide
aaataaactaatcaaggaggaacttcaaagtcaagtggaattgctaaattc

SEQ ID NO: 114438 - DNA, 50 bp, Artificial Sequence
  Description of Artificial Sequence: Synthetic oligonucleotide
aataaactaatcaaggaggaacttcaaagtcaagtggaattgctaaattc

SEQ ID NO: 114439 - DNA, 49 bp, Artificial Sequence
  Description of Artificial Sequence: Synthetic oligonucleotide
ataaactaatcaaggaggaacttcaaagtcaagtggaattgctaaattc

SEQ ID NO: 114440 - DNA, 48 bp, Artificial Sequence
  Description of Artificial Sequence: Synthetic oligonucleotide
taaactaatcaaggaggaacttcaaagtcaagtggaattgctaaattc

SEQ ID NO: 114441 - DNA, 47 bp, Artificial Sequence
  Description of Artificial Sequence: Synthetic oligonucleotide
aaactaatcaaggaggaacttcaaagtcaagtggaattgctaaattc

SEQ ID NO: 114442 - DNA, 46 bp, Artificial Sequence
  Description of Artificial Sequence: Synthetic oligonucleotide
aactaatcaaggaggaacttcaaagtcaagtggaattgctaaattc

SEQ ID NO: 114443 - DNA, 45 bp, Artificial Sequence
  Description of Artificial Sequence: Synthetic oligonucleotide
actaatcaaggaggaacttcaaagtcaagtggaattgctaaattc

SEQ ID NO: 114444 - DNA, 44 bp, Artificial Sequence
  Description of Artificial Sequence: Synthetic oligonucleotide
ctaatcaaggaggaacttcaaagtcaagtggaattgctaaattc

SEQ ID NO: 114445 - DNA, 48 bp, Artificial Sequence
  Description of Artificial Sequence: Synthetic oligonucleotide
taatcaaggaggaacttcaaagtcaagtggaattgctaaattcttttg

SEQ ID NO: 114446 - DNA, 47 bp, Artificial Sequence
  Description of Artificial Sequence: Synthetic oligonucleotide
aatcaaggaggaacttcaaagtcaagtggaattgctaaattcttttg

SEQ ID NO: 114447 - DNA, 46 bp, Artificial Sequence
  Description of Artificial Sequence: Synthetic oligonucleotide
atcaaggaggaacttcaaagtcaagtggaattgctaaattcttttg

SEQ ID NO: 114448 - DNA, 45 bp, Artificial Sequence
  Description of Artificial Sequence: Synthetic oligonucleotide
tcaaggaggaacttcaaagtcaagtggaattgctaaattcttttg

SEQ ID NO: 114449 - DNA, 44 bp, Artificial Sequence
  Description of Artificial Sequence: Synthetic oligonucleotide
caaggaggaacttcaaagtcaagtggaattgctaaattcttttg

SEQ ID NO: 114450 - DNA, 45 bp, Artificial Sequence
  Description of Artificial Sequence: Synthetic oligonucleotide
aaggaggaacttcaaagtcaagtggaattgctaaattcttttgag

SEQ ID NO: 114451 - DNA, 44 bp, Artificial Sequence
  Description of Artificial Sequence: Synthetic oligonucleotide
aggaggaacttcaaagtcaagtggaattgctaaattcttttgag

SEQ ID NO: 114452 - DNA, 43 bp, Artificial Sequence
  Description of Artificial Sequence: Synthetic oligonucleotide
ggaggaacttcaaagtcaagtggaattgctaaattcttttgag

SEQ ID NO: 114453 - DNA, 45 bp, Artificial Sequence
  Description of Artificial Sequence: Synthetic oligonucleotide
gaggaacttcaaagtcaagtggaattgctaaattcttttgagaag

SEQ ID NO: 114454 - DNA, 50 bp, Artificial Sequence
  Description of Artificial Sequence: Synthetic oligonucleotide
aggaacttcaaagtcaagtggaattgctaaattcttttgagaagaaatac

SEQ ID NO: 114455 - DNA, 49 bp, Artificial Sequence
  Description of Artificial Sequence: Synthetic oligonucleotide
ggaacttcaaagtcaagtggaattgctaaattcttttgagaagaaatac

SEQ ID NO: 114456 - DNA, 50 bp, Artificial Sequence
  Description of Artificial Sequence: Synthetic oligonucleotide
gaacttcaaagtcaagtggaattgctaaattcttttgagaagaaatacag

SEQ ID NO: 114457 - DNA, 50 bp, Artificial Sequence
  Description of Artificial Sequence: Synthetic oligonucleotide
aacttcaaagtcaagtggaattgctaaattcttttgagaagaaatacagc

SEQ ID NO: 114458 - DNA, 49 bp, Artificial Sequence
  Description of Artificial Sequence: Synthetic oligonucleotide
acttcaaagtcaagtggaattgctaaattcttttgagaagaaatacagc

SEQ ID NO: 114459 - DNA, 48 bp, Artificial Sequence
  Description of Artificial Sequence: Synthetic oligonucleotide
cttcaaagtcaagtggaattgctaaattcttttgagaagaaatacagc

SEQ ID NO: 114460 - DNA, 48 bp, Artificial Sequence
  Description of Artificial Sequence: Synthetic oligonucleotide
ttcaaagtcaagtggaattgctaaattcttttgagaagaaatacagcg

SEQ ID NO: 114461 - DNA, 47 bp, Artificial Sequence
  Description of Artificial Sequence: Synthetic oligonucleotide
tcaaagtcaagtggaattgctaaattcttttgagaagaaatacagcg

SEQ ID NO: 114462 - DNA, 46 bp, Artificial Sequence
  Description of Artificial Sequence: Synthetic oligonucleotide
caaagtcaagtggaattgctaaattcttttgagaagaaatacagcg

SEQ ID NO: 114463 - DNA, 48 bp, Artificial Sequence
  Description of Artificial Sequence: Synthetic oligonucleotide
aaagtcaagtggaattgctaaattcttttgagaagaaatacagcgatc

SEQ ID NO: 114464 - DNA, 47 bp, Artificial Sequence
  Description of Artificial Sequence: Synthetic oligonucleotide
aagtcaagtggaattgctaaattcttttgagaagaaatacagcgatc

SEQ ID NO: 114465 - DNA, 46 bp, Artificial Sequence
  Description of Artificial Sequence: Synthetic oligonucleotide
agtcaagtggaattgctaaattcttttgagaagaaatacagcgatc

SEQ ID NO: 114466 - DNA, 45 bp, Artificial Sequence
  Description of Artificial Sequence: Synthetic oligonucleotide
gtcaagtggaattgctaaattcttttgagaagaaatacagcgatc

SEQ ID NO: 114467 - DNA, 45 bp, Artificial Sequence
  Description of Artificial Sequence: Synthetic oligonucleotide
tcaagtggaattgctaaattcttttgagaagaaatacagcgatcc

SEQ ID NO: 114468 - DNA, 44 bp, Artificial Sequence
  Description of Artificial Sequence: Synthetic oligonucleotide
caagtggaattgctaaattcttttgagaagaaatacagcgatcc

SEQ ID NO: 114469 - DNA, 45 bp, Artificial Sequence
  Description of Artificial Sequence: Synthetic oligonucleotide
aagtggaattgctaaattcttttgagaagaaatacagcgatcctg

SEQ ID NO: 114470 - DNA, 44 bp, Artificial Sequence
  Description of Artificial Sequence: Synthetic oligonucleotide
agtggaattgctaaattcttttgagaagaaatacagcgatcctg

SEQ ID NO: 114471 - DNA, 43 bp, Artificial Sequence
  Description of Artificial Sequence: Synthetic oligonucleotide
gtggaattgctaaattcttttgagaagaaatacagcgatcctg

SEQ ID NO: 114472 - DNA, 43 bp, Artificial Sequence
  Description of Artificial Sequence: Synthetic oligonucleotide
tggaattgctaaattcttttgagaagaaatacagcgatcctgg

SEQ ID NO: 114473 - DNA, 42 bp, Artificial Sequence
  Description of Artificial Sequence: Synthetic oligonucleotide
ggaattgctaaattcttttgagaagaaatacagcgatcctgg

SEQ ID NO: 114474 - DNA, 42 bp, Artificial Sequence
  Description of Artificial Sequence: Synthetic oligonucleotide
gaattgctaaattcttttgagaagaaatacagcgatcctggc

SEQ ID NO: 114475 - DNA, 42 bp, Artificial Sequence
  Description of Artificial Sequence: Synthetic oligonucleotide
aattgctaaattcttttgagaagaaatacagcgatcctggcc

SEQ ID NO: 114476 - DNA, 41 bp, Artificial Sequence
  Description of Artificial Sequence: Synthetic oligonucleotide
attgctaaattcttttgagaagaaatacagcgatcctggcc

SEQ ID NO: 114477 - DNA, 40 bp, Artificial Sequence
  Description of Artificial Sequence: Synthetic oligonucleotide
ttgctaaattcttttgagaagaaatacagcgatcctggcc

SEQ ID NO: 114478 - DNA, 39 bp, Artificial Sequence
  Description of Artificial Sequence: Synthetic oligonucleotide
tgctaaattcttttgagaagaaatacagcgatcctggcc

SEQ ID NO: 114479 - DNA, 38 bp, Artificial Sequence
  Description of Artificial Sequence: Synthetic oligonucleotide
gctaaattcttttgagaagaaatacagcgatcctggcc

SEQ ID NO: 114480 - DNA, 38 bp, Artificial Sequence
  Description of Artificial Sequence: Synthetic oligonucleotide
ctaaattcttttgagaagaaatacagcgatcctggccc

SEQ ID NO: 114481 - DNA, 39 bp, Artificial Sequence
  Description of Artificial Sequence: Synthetic oligonucleotide
taaattcttttgagaagaaatacagcgatcctggccctg

SEQ ID NO: 114482 - DNA, 38 bp, Artificial Sequence
  Description of Artificial Sequence: Synthetic oligonucleotide
aaattcttttgagaagaaatacagcgatcctggccctg

SEQ ID NO: 114483 - DNA, 37 bp, Artificial Sequence
  Description of Artificial Sequence: Synthetic oligonucleotide
aattcttttgagaagaaatacagcgatcctggccctg

SEQ ID NO: 114484 - DNA, 36 bp, Artificial Sequence
  Description of Artificial Sequence: Synthetic oligonucleotide
attcttttgagaagaaatacagcgatcctggccctg

SEQ ID NO: 114485 - DNA, 35 bp, Artificial Sequence
  Description of Artificial Sequence: Synthetic oligonucleotide
ttcttttgagaagaaatacagcgatcctggccctg

SEQ ID NO: 114486 - DNA, 34 bp, Artificial Sequence
  Description of Artificial Sequence: Synthetic oligonucleotide
tcttttgagaagaaatacagcgatcctggccctg

SEQ ID NO: 114487 - DNA, 33 bp, Artificial Sequence
  Description of Artificial Sequence: Synthetic oligonucleotide
cttttgagaagaaatacagcgatcctggccctg

SEQ ID NO: 114488 - DNA, 38 bp, Artificial Sequence
  Description of Artificial Sequence: Synthetic oligonucleotide
ttttgagaagaaatacagcgatcctggccctgtatatg

SEQ ID NO: 114489 - DNA, 37 bp, Artificial Sequence
  Description of Artificial Sequence: Synthetic oligonucleotide
tttgagaagaaatacagcgatcctggccctgtatatg

SEQ ID NO: 114490 - DNA, 36 bp, Artificial Sequence
  Description of Artificial Sequence: Synthetic oligonucleotide
ttgagaagaaatacagcgatcctggccctgtatatg

SEQ ID NO: 114491 - DNA, 35 bp, Artificial Sequence
  Description of Artificial Sequence: Synthetic oligonucleotide
tgagaagaaatacagcgatcctggccctgtatatg

SEQ ID NO: 114492 - DNA, 34 bp, Artificial Sequence
  Description of Artificial Sequence: Synthetic oligonucleotide
gagaagaaatacagcgatcctggccctgtatatg

SEQ ID NO: 114493 - DNA, 35 bp, Artificial Sequence
  Description of Artificial Sequence: Synthetic oligonucleotide
agaagaaatacagcgatcctggccctgtatatgac

SEQ ID NO: 114494 - DNA, 34 bp, Artificial Sequence
  Description of Artificial Sequence: Synthetic oligonucleotide
gaagaaatacagcgatcctggccctgtatatgac

SEQ ID NO: 114495 - DNA, 35 bp, Artificial Sequence
  Description of Artificial Sequence: Synthetic oligonucleotide
aagaaatacagcgatcctggccctgtatatgactg

SEQ ID NO: 114496 - DNA, 34 bp, Artificial Sequence
  Description of Artificial Sequence: Synthetic oligonucleotide
agaaatacagcgatcctggccctgtatatgactg

SEQ ID NO: 114497 - DNA, 33 bp, Artificial Sequence
  Description of Artificial Sequence: Synthetic oligonucleotide
gaaatacagcgatcctggccctgtatatgactg

SEQ ID NO: 114498 - DNA, 33 bp, Artificial Sequence
  Description of Artificial Sequence: Synthetic oligonucleotide
aaatacagcgatcctggccctgtatatgactgc

SEQ ID NO: 114499 - DNA, 32 bp, Artificial Sequence
  Description of Artificial Sequence: Synthetic oligonucleotide
aatacagcgatcctggccctgtatatgactgc

SEQ ID NO: 114500 - DNA, 31 bp, Artificial Sequence
  Description of Artificial Sequence: Synthetic oligonucleotide
atacagcgatcctggccctgtatatgactgc

SEQ ID NO: 114501 - DNA, 30 bp, Artificial Sequence
  Description of Artificial Sequence: Synthetic oligonucleotide
tacagcgatcctggccctgtatatgactgc

SEQ ID NO: 114502 - DNA, 29 bp, Artificial Sequence
  Description of Artificial Sequence: Synthetic oligonucleotide
acagcgatcctggccctgtatatgactgc

SEQ ID NO: 114503 - DNA, 28 bp, Artificial Sequence
  Description of Artificial Sequence: Synthetic oligonucleotide
cagcgatcctggccctgtatatgactgc

SEQ ID NO: 114504 - DNA, 30 bp, Artificial Sequence
  Description of Artificial Sequence: Synthetic oligonucleotide
agcgatcctggccctgtatatgactgcttg

SEQ ID NO: 114505 - DNA, 29 bp, Artificial Sequence
  Description of Artificial Sequence: Synthetic oligonucleotide
gcgatcctggccctgtatatgactgcttg

SEQ ID NO: 114506 - DNA, 29 bp, Artificial Sequence
  Description of Artificial Sequence: Synthetic oligonucleotide
cgatcctggccctgtatatgactgcttgg

SEQ ID NO: 114507 - DNA, 32 bp, Artificial Sequence
  Description of Artificial Sequence: Synthetic oligonucleotide
gatcctggccctgtatatgactgcttggtatg

SEQ ID NO: 114508 - DNA, 32 bp, Artificial Sequence
  Description of Artificial Sequence: Synthetic oligonucleotide
atcctggccctgtatatgactgcttggtatgg

SEQ ID NO: 114509 - DNA, 31 bp, Artificial Sequence
  Description of Artificial Sequence: Synthetic oligonucleotide
tcctggccctgtatatgactgcttggtatgg

SEQ ID NO: 114510 - DNA, 30 bp, Artificial Sequence
  Description of Artificial Sequence: Synthetic oligonucleotide
cctggccctgtatatgactgcttggtatgg

SEQ ID NO: 114511 - DNA, 30 bp, Artificial Sequence
  Description of Artificial Sequence: Synthetic oligonucleotide
ctggccctgtatatgactgcttggtatggc

SEQ ID NO: 114512 - DNA, 32 bp, Artificial Sequence
  Description of Artificial Sequence: Synthetic oligonucleotide
tggccctgtatatgactgcttggtatggcatg

SEQ ID NO: 114513 - DNA, 31 bp, Artificial Sequence
  Description of Artificial Sequence: Synthetic oligonucleotide
ggccctgtatatgactgcttggtatggcatg

SEQ ID NO: 114514 - DNA, 33 bp, Artificial Sequence
  Description of Artificial Sequence: Synthetic oligonucleotide
gccctgtatatgactgcttggtatggcatgatg

SEQ ID NO: 114515 - DNA, 33 bp, Artificial Sequence
  Description of Artificial Sequence: Synthetic oligonucleotide
ccctgtatatgactgcttggtatggcatgatgg

SEQ ID NO: 114516 - DNA, 33 bp, Artificial Sequence
  Description of Artificial Sequence: Synthetic oligonucleotide
cctgtatatgactgcttggtatggcatgatggc

SEQ ID NO: 114517 - DNA, 33 bp, Artificial Sequence
  Description of Artificial Sequence: Synthetic oligonucleotide
ctgtatatgactgcttggtatggcatgatggcg

SEQ ID NO: 114518 - DNA, 35 bp, Artificial Sequence
  Description of Artificial Sequence: Synthetic oligonucleotide
tgtatatgactgcttggtatggcatgatggcgaag

SEQ ID NO: 114519 - DNA, 34 bp, Artificial Sequence
  Description of Artificial Sequence: Synthetic oligonucleotide
gtatatgactgcttggtatggcatgatggcgaag

SEQ ID NO: 114520 - DNA, 35 bp, Artificial Sequence
  Description of Artificial Sequence: Synthetic oligonucleotide
tatatgactgcttggtatggcatgatggcgaagtc

SEQ ID NO: 114521 - DNA, 34 bp, Artificial Sequence
  Description of Artificial Sequence: Synthetic oligonucleotide
atatgactgcttggtatggcatgatggcgaagtc

SEQ ID NO: 114522 - DNA, 33 bp, Artificial Sequence
  Description of Artificial Sequence: Synthetic oligonucleotide
tatgactgcttggtatggcatgatggcgaagtc

SEQ ID NO: 114523 - DNA, 32 bp, Artificial Sequence
  Description of Artificial Sequence: Synthetic oligonucleotide
atgactgcttggtatggcatgatggcgaagtc

SEQ ID NO: 114524 - DNA, 31 bp, Artificial Sequence
  Description of Artificial Sequence: Synthetic oligonucleotide
tgactgcttggtatggcatgatggcgaagtc

SEQ ID NO: 114525 - DNA, 30 bp, Artificial Sequence
  Description of Artificial Sequence: Synthetic oligonucleotide
gactgcttggtatggcatgatggcgaagtc

SEQ ID NO: 114526 - DNA, 31 bp, Artificial Sequence
  Description of Artificial Sequence: Synthetic oligonucleotide
actgcttggtatggcatgatggcgaagtctg

SEQ ID NO: 114527 - DNA, 30 bp, Artificial Sequence
  Description of Artificial Sequence: Synthetic oligonucleotide
ctgcttggtatggcatgatggcgaagtctg

SEQ ID NO: 114528 - DNA, 30 bp, Artificial Sequence
  Description of Artificial Sequence: Synthetic oligonucleotide
tgcttggtatggcatgatggcgaagtctgg

SEQ ID NO: 114529 - DNA, 29 bp, Artificial Sequence
  Description of Artificial Sequence: Synthetic oligonucleotide
gcttggtatggcatgatggcgaagtctgg

SEQ ID NO: 114530 - DNA, 30 bp, Artificial Sequence
  Description of Artificial Sequence: Synthetic oligonucleotide
cttggtatggcatgatggcgaagtctggag

SEQ ID NO: 114531 - DNA, 31 bp, Artificial Sequence
  Description of Artificial Sequence: Synthetic oligonucleotide
ttggtatggcatgatggcgaagtctggagag

SEQ ID NO: 114532 - DNA, 30 bp, Artificial Sequence
  Description of Artificial Sequence: Synthetic oligonucleotide
tggtatggcatgatggcgaagtctggagag

SEQ ID NO: 114533 - DNA, 29 bp, Artificial Sequence
  Description of Artificial Sequence: Synthetic oligonucleotide
ggtatggcatgatggcgaagtctggagag

SEQ ID NO: 114534 - DNA, 29 bp, Artificial Sequence
  Description of Artificial Sequence: Synthetic oligonucleotide
gtatggcatgatggcgaagtctggagagc

SEQ ID NO: 114535 - DNA, 29 bp, Artificial Sequence
  Description of Artificial Sequence: Synthetic oligonucleotide
tatggcatgatggcgaagtctggagagcc

SEQ ID NO: 114536 - DNA, 28 bp, Artificial Sequence
  Description of Artificial Sequence: Synthetic oligonucleotide
atggcatgatggcgaagtctggagagcc

SEQ ID NO: 114537 - DNA, 27 bp, Artificial Sequence
  Description of Artificial Sequence: Synthetic oligonucleotide
tggcatgatggcgaagtctggagagcc

SEQ ID NO: 114538 - DNA, 27 bp, Artificial Sequence
  Description of Artificial Sequence: Synthetic oligonucleotide
ggcatgatggcgaagtctggagagcct

SEQ ID NO: 114539 - DNA, 27 bp, Artificial Sequence
  Description of Artificial Sequence: Synthetic oligonucleotide
gcatgatggcgaagtctggagagcctg

SEQ ID NO: 114540 - DNA, 27 bp, Artificial Sequence
  Description of Artificial Sequence: Synthetic oligonucleotide
catgatggcgaagtctggagagcctgc

SEQ ID NO: 114541 - DNA, 30 bp, Artificial Sequence
  Description of Artificial Sequence: Synthetic oligonucleotide
atgatggcgaagtctggagagcctgcattg

SEQ ID NO: 114542 - DNA, 29 bp, Artificial Sequence
  Description of Artificial Sequence: Synthetic oligonucleotide
tgatggcgaagtctggagagcctgcattg

SEQ ID NO: 114543 - DNA, 28 bp, Artificial Sequence
  Description of Artificial Sequence: Synthetic oligonucleotide
gatggcgaagtctggagagcctgcattg

SEQ ID NO: 114544 - DNA, 31 bp, Artificial Sequence
  Description of Artificial Sequence: Synthetic oligonucleotide
atggcgaagtctggagagcctgcattgattc

SEQ ID NO: 114545 - DNA, 30 bp, Artificial Sequence
  Description of Artificial Sequence: Synthetic oligonucleotide
tggcgaagtctggagagcctgcattgattc

SEQ ID NO: 114546 - DNA, 29 bp, Artificial Sequence
  Description of Artificial Sequence: Synthetic oligonucleotide
ggcgaagtctggagagcctgcattgattc

SEQ ID NO: 114547 - DNA, 33 bp, Artificial Sequence
  Description of Artificial Sequence: Synthetic oligonucleotide
gcgaagtctggagagcctgcattgattctaatg

SEQ ID NO: 114548 - DNA, 35 bp, Artificial Sequence
  Description of Artificial Sequence: Synthetic oligonucleotide
cgaagtctggagagcctgcattgattctaatgaag

SEQ ID NO: 114549 - DNA, 37 bp, Artificial Sequence
  Description of Artificial Sequence: Synthetic oligonucleotide
gaagtctggagagcctgcattgattctaatgaagatg

SEQ ID NO: 114550 - DNA, 37 bp, Artificial Sequence
  Description of Artificial Sequence: Synthetic oligonucleotide
aagtctggagagcctgcattgattctaatgaagatgg

SEQ ID NO: 114551 - DNA, 36 bp, Artificial Sequence
  Description of Artificial Sequence: Synthetic oligonucleotide
agtctggagagcctgcattgattctaatgaagatgg

SEQ ID NO: 114552 - DNA, 35 bp, Artificial Sequence
  Description of Artificial Sequence: Synthetic oligonucleotide
gtctggagagcctgcattgattctaatgaagatgg

SEQ ID NO: 114553 - DNA, 35 bp, Artificial Sequence
  Description of Artificial Sequence: Synthetic oligonucleotide
tctggagagcctgcattgattctaatgaagatggg

SEQ ID NO: 114554 - DNA, 34 bp, Artificial Sequence
  Description of Artificial Sequence: Synthetic oligonucleotide
ctggagagcctgcattgattctaatgaagatggg

SEQ ID NO: 114555 - DNA, 34 bp, Artificial Sequence
  Description of Artificial Sequence: Synthetic oligonucleotide
tggagagcctgcattgattctaatgaagatgggg

SEQ ID NO: 114556 - DNA, 33 bp, Artificial Sequence
  Description of Artificial Sequence: Synthetic oligonucleotide
ggagagcctgcattgattctaatgaagatgggg

SEQ ID NO: 114557 - DNA, 34 bp, Artificial Sequence
  Description of Artificial Sequence: Synthetic oligonucleotide
gagagcctgcattgattctaatgaagatggggac

SEQ ID NO: 114558 - DNA, 36 bp, Artificial Sequence
  Description of Artificial Sequence: Synthetic oligonucleotide
agagcctgcattgattctaatgaagatggggacttg

SEQ ID NO: 114559 - DNA, 35 bp, Artificial Sequence
  Description of Artificial Sequence: Synthetic oligonucleotide
gagcctgcattgattctaatgaagatggggacttg

SEQ ID NO: 114560 - DNA, 36 bp, Artificial Sequence
  Description of Artificial Sequence: Synthetic oligonucleotide
agcctgcattgattctaatgaagatggggacttgag

SEQ ID NO: 114561 - DNA, 35 bp, Artificial Sequence
  Description of Artificial Sequence: Synthetic oligonucleotide
gcctgcattgattctaatgaagatggggacttgag

SEQ ID NO: 114562 - DNA, 40 bp, Artificial Sequence
  Description of Artificial Sequence: Synthetic oligonucleotide
cctgcattgattctaatgaagatggggacttgagtaaatc

SEQ ID NO: 114563 - DNA, 42 bp, Artificial Sequence
  Description of Artificial Sequence: Synthetic oligonucleotide
ctgcattgattctaatgaagatggggacttgagtaaatctac

SEQ ID NO: 114564 - DNA, 42 bp, Artificial Sequence
  Description of Artificial Sequence: Synthetic oligonucleotide
tgcattgattctaatgaagatggggacttgagtaaatctacc

SEQ ID NO: 114565 - DNA, 41 bp, Artificial Sequence
  Description of Artificial Sequence: Synthetic oligonucleotide
gcattgattctaatgaagatggggacttgagtaaatctacc

SEQ ID NO: 114566 - DNA, 41 bp, Artificial Sequence
  Description of Artificial Sequence: Synthetic oligonucleotide
cattgattctaatgaagatggggacttgagtaaatctaccg

SEQ ID NO: 114567 - DNA, 42 bp, Artificial Sequence
  Description of Artificial Sequence: Synthetic oligonucleotide
attgattctaatgaagatggggacttgagtaaatctaccgtg

SEQ ID NO: 114568 - DNA, 41 bp, Artificial Sequence
  Description of Artificial Sequence: Synthetic oligonucleotide
ttgattctaatgaagatggggacttgagtaaatctaccgtg

SEQ ID NO: 114569 - DNA, 40 bp, Artificial Sequence
  Description of Artificial Sequence: Synthetic oligonucleotide
tgattctaatgaagatggggacttgagtaaatctaccgtg

SEQ ID NO: 114570 - DNA, 39 bp, Artificial Sequence
  Description of Artificial Sequence: Synthetic oligonucleotide
gattctaatgaagatggggacttgagtaaatctaccgtg

SEQ ID NO: 114571 - DNA, 41 bp, Artificial Sequence
  Description of Artificial Sequence: Synthetic oligonucleotide
attctaatgaagatggggacttgagtaaatctaccgtgttg

SEQ ID NO: 114572 - DNA, 40 bp, Artificial Sequence
  Description of Artificial Sequence: Synthetic oligonucleotide
ttctaatgaagatggggacttgagtaaatctaccgtgttg

SEQ ID NO: 114573 - DNA, 39 bp, Artificial Sequence
  Description of Artificial Sequence: Synthetic oligonucleotide
tctaatgaagatggggacttgagtaaatctaccgtgttg

SEQ ID NO: 114574 - DNA, 38 bp, Artificial Sequence
  Description of Artificial Sequence: Synthetic oligonucleotide
ctaatgaagatggggacttgagtaaatctaccgtgttg

SEQ ID NO: 114575 - DNA, 39 bp, Artificial Sequence
  Description of Artificial Sequence: Synthetic oligonucleotide
taatgaagatggggacttgagtaaatctaccgtgttgag

SEQ ID NO: 114576 - DNA, 38 bp, Artificial Sequence
  Description of Artificial Sequence: Synthetic oligonucleotide
aatgaagatggggacttgagtaaatctaccgtgttgag

SEQ ID NO: 114577 - DNA, 37 bp, Artificial Sequence
  Description of Artificial Sequence: Synthetic oligonucleotide
atgaagatggggacttgagtaaatctaccgtgttgag

SEQ ID NO: 114578 - DNA, 36 bp, Artificial Sequence
  Description of Artificial Sequence: Synthetic oligonucleotide
tgaagatggggacttgagtaaatctaccgtgttgag

SEQ ID NO: 114579 - DNA, 35 bp, Artificial Sequence
  Description of Artificial Sequence: Synthetic oligonucleotide
gaagatggggacttgagtaaatctaccgtgttgag

SEQ ID NO: 114580 - DNA, 38 bp, Artificial Sequence
  Description of Artificial Sequence: Synthetic oligonucleotide
aagatggggacttgagtaaatctaccgtgttgagaaac

SEQ ID NO: 114581 - DNA, 37 bp, Artificial Sequence
  Description of Artificial Sequence: Synthetic oligonucleotide
agatggggacttgagtaaatctaccgtgttgagaaac

SEQ ID NO: 114582 - DNA, 36 bp, Artificial Sequence
  Description of Artificial Sequence: Synthetic oligonucleotide
gatggggacttgagtaaatctaccgtgttgagaaac

SEQ ID NO: 114583 - DNA, 38 bp, Artificial Sequence
  Description of Artificial Sequence: Synthetic oligonucleotide
atggggacttgagtaaatctaccgtgttgagaaactac

SEQ ID NO: 114584 - DNA, 37 bp, Artificial Sequence
  Description of Artificial Sequence: Synthetic oligonucleotide
tggggacttgagtaaatctaccgtgttgagaaactac

SEQ ID NO: 114585 - DNA, 36 bp, Artificial Sequence
  Description of Artificial Sequence: Synthetic oligonucleotide
ggggacttgagtaaatctaccgtgttgagaaactac

SEQ ID NO: 114586 - DNA, 39 bp, Artificial Sequence
  Description of Artificial Sequence: Synthetic oligonucleotide
gggacttgagtaaatctaccgtgttgagaaactacaaag

SEQ ID NO: 114587 - DNA, 41 bp, Artificial Sequence
  Description of Artificial Sequence: Synthetic oligonucleotide
ggacttgagtaaatctaccgtgttgagaaactacaaagaag

SEQ ID NO: 114588 - DNA, 41 bp, Artificial Sequence
  Description of Artificial Sequence: Synthetic oligonucleotide
gacttgagtaaatctaccgtgttgagaaactacaaagaagc

SEQ ID NO: 114589 - DNA, 41 bp, Artificial Sequence
  Description of Artificial Sequence: Synthetic oligonucleotide
acttgagtaaatctaccgtgttgagaaactacaaagaagcc

SEQ ID NO: 114590 - DNA, 40 bp, Artificial Sequence
  Description of Artificial Sequence: Synthetic oligonucleotide
cttgagtaaatctaccgtgttgagaaactacaaagaagcc

SEQ ID NO: 114591 - DNA, 40 bp, Artificial Sequence
  Description of Artificial Sequence: Synthetic oligonucleotide
ttgagtaaatctaccgtgttgagaaactacaaagaagccc

SEQ ID NO: 114592 - DNA, 39 bp, Artificial Sequence
  Description of Artificial Sequence: Synthetic oligonucleotide
tgagtaaatctaccgtgttgagaaactacaaagaagccc

SEQ ID NO: 114593 - DNA, 38 bp, Artificial Sequence
  Description of Artificial Sequence: Synthetic oligonucleotide
gagtaaatctaccgtgttgagaaactacaaagaagccc

SEQ ID NO: 114594 - DNA, 40 bp, Artificial Sequence
  Description of Artificial Sequence: Synthetic oligonucleotide
agtaaatctaccgtgttgagaaactacaaagaagcccaag

SEQ ID NO: 114595 - DNA, 39 bp, Artificial Sequence
  Description of Artificial Sequence: Synthetic oligonucleotide
gtaaatctaccgtgttgagaaactacaaagaagcccaag

SEQ ID NO: 114596 - DNA, 44 bp, Artificial Sequence
  Description of Artificial Sequence: Synthetic oligonucleotide
taaatctaccgtgttgagaaactacaaagaagcccaagaatatg

SEQ ID NO: 114597 - DNA, 43 bp, Artificial Sequence
  Description of Artificial Sequence: Synthetic oligonucleotide
aaatctaccgtgttgagaaactacaaagaagcccaagaatatg

SEQ ID NO: 114598 - DNA, 42 bp, Artificial Sequence
  Description of Artificial Sequence: Synthetic oligonucleotide
aatctaccgtgttgagaaactacaaagaagcccaagaatatg

SEQ ID NO: 114599 - DNA, 41 bp, Artificial Sequence
  Description of Artificial Sequence: Synthetic oligonucleotide
atctaccgtgttgagaaactacaaagaagcccaagaatatg

SEQ ID NO: 114600 - DNA, 40 bp, Artificial Sequence
  Description of Artificial Sequence: Synthetic oligonucleotide
tctaccgtgttgagaaactacaaagaagcccaagaatatg

SEQ ID NO: 114601 - DNA, 39 bp, Artificial Sequence
  Description of Artificial Sequence: Synthetic oligonucleotide
ctaccgtgttgagaaactacaaagaagcccaagaatatg

SEQ ID NO: 114602 - DNA, 39 bp, Artificial Sequence
  Description of Artificial Sequence: Synthetic oligonucleotide
taccgtgttgagaaactacaaagaagcccaagaatatgg

SEQ ID NO: 114603 - DNA, 38 bp, Artificial Sequence
  Description of Artificial Sequence: Synthetic oligonucleotide
accgtgttgagaaactacaaagaagcccaagaatatgg

SEQ ID NO: 114604 - DNA, 37 bp, Artificial Sequence
  Description of Artificial Sequence: Synthetic oligonucleotide
ccgtgttgagaaactacaaagaagcccaagaatatgg

SEQ ID NO: 114605 - DNA, 37 bp, Artificial Sequence
  Description of Artificial Sequence: Synthetic oligonucleotide
cgtgttgagaaactacaaagaagcccaagaatatggc

SEQ ID NO: 114606 - DNA, 38 bp, Artificial Sequence
  Description of Artificial Sequence: Synthetic oligonucleotide
gtgttgagaaactacaaagaagcccaagaatatggctc

SEQ ID NO: 114607 - DNA, 42 bp, Artificial Sequence
  Description of Artificial Sequence: Synthetic oligonucleotide
tgttgagaaactacaaagaagcccaagaatatggctcttttg

SEQ ID NO: 114608 - DNA, 41 bp, Artificial Sequence
  Description of Artificial Sequence: Synthetic oligonucleotide
gttgagaaactacaaagaagcccaagaatatggctcttttg

SEQ ID NO: 114609 - DNA, 41 bp, Artificial Sequence
  Description of Artificial Sequence: Synthetic oligonucleotide
ttgagaaactacaaagaagcccaagaatatggctcttttgg

SEQ ID NO: 114610 - DNA, 40 bp, Artificial Sequence
  Description of Artificial Sequence: Synthetic oligonucleotide
tgagaaactacaaagaagcccaagaatatggctcttttgg

SEQ ID NO: 114611 - DNA, 39 bp, Artificial Sequence
  Description of Artificial Sequence: Synthetic oligonucleotide
gagaaactacaaagaagcccaagaatatggctcttttgg

SEQ ID NO: 114612 - DNA, 39 bp, Artificial Sequence
  Description of Artificial Sequence: Synthetic oligonucleotide
agaaactacaaagaagcccaagaatatggctcttttggc

SEQ ID NO: 114613 - DNA, 38 bp, Artificial Sequence
  Description of Artificial Sequence: Synthetic oligonucleotide
gaaactacaaagaagcccaagaatatggctcttttggc

SEQ ID NO: 114614 - DNA, 39 bp, Artificial Sequence
  Description of Artificial Sequence: Synthetic oligonucleotide
aaactacaaagaagcccaagaatatggctcttttggcac

SEQ ID NO: 114615 - DNA, 38 bp, Artificial Sequence
  Description of Artificial Sequence: Synthetic oligonucleotide
aactacaaagaagcccaagaatatggctcttttggcac

SEQ ID NO: 114616 - DNA, 37 bp, Artificial Sequence
  Description of Artificial Sequence: Synthetic oligonucleotide
actacaaagaagcccaagaatatggctcttttggcac

SEQ ID NO: 114617 - DNA, 36 bp, Artificial Sequence
  Description of Artificial Sequence: Synthetic oligonucleotide
ctacaaagaagcccaagaatatggctcttttggcac

SEQ ID NO: 114618 - DNA, 37 bp, Artificial Sequence
  Description of Artificial Sequence: Synthetic oligonucleotide
tacaaagaagcccaagaatatggctcttttggcacag

SEQ ID NO: 114619 - DNA, 36 bp, Artificial Sequence
  Description of Artificial Sequence: Synthetic oligonucleotide
acaaagaagcccaagaatatggctcttttggcacag

SEQ ID NO: 114620 - DNA, 35 bp, Artificial Sequence
  Description of Artificial Sequence: Synthetic oligonucleotide
caaagaagcccaagaatatggctcttttggcacag

SEQ ID NO: 114621 - DNA, 35 bp, Artificial Sequence
  Description of Artificial Sequence: Synthetic oligonucleotide
aaagaagcccaagaatatggctcttttggcacagc

SEQ ID NO: 114622 - DNA, 34 bp, Artificial Sequence
  Description of Artificial Sequence: Synthetic oligonucleotide
aagaagcccaagaatatggctcttttggcacagc

SEQ ID NO: 114623 - DNA, 33 bp, Artificial Sequence
  Description of Artificial Sequence: Synthetic oligonucleotide
agaagcccaagaatatggctcttttggcacagc

SEQ ID NO: 114624 - DNA, 32 bp, Artificial Sequence
  Description of Artificial Sequence: Synthetic oligonucleotide
gaagcccaagaatatggctcttttggcacagc

SEQ ID NO: 114625 - DNA, 33 bp, Artificial Sequence
  Description of Artificial Sequence: Synthetic oligonucleotide
aagcccaagaatatggctcttttggcacagctg

SEQ ID NO: 114626 - DNA, 32 bp, Artificial Sequence
  Description of Artificial Sequence: Synthetic oligonucleotide
agcccaagaatatggctcttttggcacagctg

SEQ ID NO: 114627 - DNA, 31 bp, Artificial Sequence
  Description of Artificial Sequence: Synthetic oligonucleotide
gcccaagaatatggctcttttggcacagctg

SEQ ID NO: 114628 - DNA, 32 bp, Artificial Sequence
  Description of Artificial Sequence: Synthetic oligonucleotide
cccaagaatatggctcttttggcacagctgag

SEQ ID NO: 114629 - DNA, 34 bp, Artificial Sequence
  Description of Artificial Sequence: Synthetic oligonucleotide
ccaagaatatggctcttttggcacagctgagatg

SEQ ID NO: 114630 - DNA, 36 bp, Artificial Sequence
  Description of Artificial Sequence: Synthetic oligonucleotide
caagaatatggctcttttggcacagctgagatgttg

SEQ ID NO: 114631 - DNA, 41 bp, Artificial Sequence
  Description of Artificial Sequence: Synthetic oligonucleotide
aagaatatggctcttttggcacagctgagatgttgaattac

SEQ ID NO: 114632 - DNA, 40 bp, Artificial Sequence
  Description of Artificial Sequence: Synthetic oligonucleotide
agaatatggctcttttggcacagctgagatgttgaattac

SEQ ID NO: 114633 - DNA, 39 bp, Artificial Sequence
  Description of Artificial Sequence: Synthetic oligonucleotide
gaatatggctcttttggcacagctgagatgttgaattac

SEQ ID NO: 114634 - DNA, 40 bp, Artificial Sequence
  Description of Artificial Sequence: Synthetic oligonucleotide
aatatggctcttttggcacagctgagatgttgaattactc

SEQ ID NO: 114635 - DNA, 39 bp, Artificial Sequence
  Description of Artificial Sequence: Synthetic oligonucleotide
atatggctcttttggcacagctgagatgttgaattactc

SEQ ID NO: 114636 - DNA, 38 bp, Artificial Sequence
  Description of Artificial Sequence: Synthetic oligonucleotide
tatggctcttttggcacagctgagatgttgaattactc

SEQ ID NO: 114637 - DNA, 37 bp, Artificial Sequence
  Description of Artificial Sequence: Synthetic oligonucleotide
atggctcttttggcacagctgagatgttgaattactc

SEQ ID NO: 114638 - DNA, 36 bp, Artificial Sequence
  Description of Artificial Sequence: Synthetic oligonucleotide
tggctcttttggcacagctgagatgttgaattactc

SEQ ID NO: 114639 - DNA, 35 bp, Artificial Sequence
  Description of Artificial Sequence: Synthetic oligonucleotide
ggctcttttggcacagctgagatgttgaattactc

SEQ ID NO: 114640 - DNA, 35 bp, Artificial Sequence
  Description of Artificial Sequence: Synthetic oligonucleotide
gctcttttggcacagctgagatgttgaattactcc

SEQ ID NO: 114641 - DNA, 35 bp, Artificial Sequence
  Description of Artificial Sequence: Synthetic oligonucleotide
ctcttttggcacagctgagatgttgaattactccg

SEQ ID NO: 114642 - DNA, 45 bp, Artificial Sequence
  Description of Artificial Sequence: Synthetic oligonucleotide
tcttttggcacagctgagatgttgaattactccgttaatatatac

SEQ ID NO: 114643 - DNA, 44 bp, Artificial Sequence
  Description of Artificial Sequence: Synthetic oligonucleotide
cttttggcacagctgagatgttgaattactccgttaatatatac

SEQ ID NO: 114644 - DNA, 44 bp, Artificial Sequence
  Description of Artificial Sequence: Synthetic oligonucleotide
ttttggcacagctgagatgttgaattactccgttaatatatacg

SEQ ID NO: 114645 - DNA, 43 bp, Artificial Sequence
  Description of Artificial Sequence: Synthetic oligonucleotide
tttggcacagctgagatgttgaattactccgttaatatatacg

SEQ ID NO: 114646 - DNA, 42 bp, Artificial Sequence
  Description of Artificial Sequence: Synthetic oligonucleotide
ttggcacagctgagatgttgaattactccgttaatatatacg

SEQ ID NO: 114647 - DNA, 41 bp, Artificial Sequence
  Description of Artificial Sequence: Synthetic oligonucleotide
tggcacagctgagatgttgaattactccgttaatatatacg

SEQ ID NO: 114648 - DNA, 40 bp, Artificial Sequence
  Description of Artificial Sequence: Synthetic oligonucleotide
ggcacagctgagatgttgaattactccgttaatatatacg

SEQ ID NO: 114649 - DNA, 42 bp, Artificial Sequence
  Description of Artificial Sequence: Synthetic oligonucleotide
gcacagctgagatgttgaattactccgttaatatatacgatg

SEQ ID NO: 114650 - DNA, 44 bp, Artificial Sequence
  Description of Artificial Sequence: Synthetic oligonucleotide
cacagctgagatgttgaattactccgttaatatatacgatgatg

SEQ ID NO: 114651 - DNA, 44 bp, Artificial Sequence
  Description of Artificial Sequence: Synthetic oligonucleotide
acagctgagatgttgaattactccgttaatatatacgatgatgg

SEQ ID NO: 114652 - DNA, 43 bp, Artificial Sequence
  Description of Artificial Sequence: Synthetic oligonucleotide
cagctgagatgttgaattactccgttaatatatacgatgatgg

SEQ ID NO: 114653 - DNA, 46 bp, Artificial Sequence
  Description of Artificial Sequence: Synthetic oligonucleotide
agctgagatgttgaattactccgttaatatatacgatgatggaaac

SEQ ID NO: 114654 - DNA, 45 bp, Artificial Sequence
  Description of Artificial Sequence: Synthetic oligonucleotide
gctgagatgttgaattactccgttaatatatacgatgatggaaac

SEQ ID NO: 114655 - DNA, 45 bp, Artificial Sequence
  Description of Artificial Sequence: Synthetic oligonucleotide
ctgagatgttgaattactccgttaatatatacgatgatggaaacc

SEQ ID NO: 114656 - DNA, 46 bp, Artificial Sequence
  Description of Artificial Sequence: Synthetic oligonucleotide
tgagatgttgaattactccgttaatatatacgatgatggaaacctg

SEQ ID NO: 114657 - DNA, 45 bp, Artificial Sequence
  Description of Artificial Sequence: Synthetic oligonucleotide
gagatgttgaattactccgttaatatatacgatgatggaaacctg

SEQ ID NO: 114658 - DNA, 45 bp, Artificial Sequence
  Description of Artificial Sequence: Synthetic oligonucleotide
agatgttgaattactccgttaatatatacgatgatggaaacctgc

SEQ ID NO: 114659 - DNA, 44 bp, Artificial Sequence
  Description of Artificial Sequence: Synthetic oligonucleotide
gatgttgaattactccgttaatatatacgatgatggaaacctgc

SEQ ID NO: 114660 - DNA, 45 bp, Artificial Sequence
  Description of Artificial Sequence: Synthetic oligonucleotide
atgttgaattactccgttaatatatacgatgatggaaacctgctc

SEQ ID NO: 114661 - DNA, 44 bp, Artificial Sequence
  Description of Artificial Sequence: Synthetic oligonucleotide
tgttgaattactccgttaatatatacgatgatggaaacctgctc

SEQ ID NO: 114662 - DNA, 43 bp, Artificial Sequence
  Description of Artificial Sequence: Synthetic oligonucleotide
gttgaattactccgttaatatatacgatgatggaaacctgctc

SEQ ID NO: 114663 - DNA, 44 bp, Artificial Sequence
  Description of Artificial Sequence: Synthetic oligonucleotide
ttgaattactccgttaatatatacgatgatggaaacctgctctc

SEQ ID NO: 114664 - DNA, 43 bp, Artificial Sequence
  Description of Artificial Sequence: Synthetic oligonucleotide
tgaattactccgttaatatatacgatgatggaaacctgctctc

SEQ ID NO: 114665 - DNA, 42 bp, Artificial Sequence
  Description of Artificial Sequence: Synthetic oligonucleotide
gaattactccgttaatatatacgatgatggaaacctgctctc

SEQ ID NO: 114666 - DNA, 42 bp, Artificial Sequence
  Description of Artificial Sequence: Synthetic oligonucleotide
aattactccgttaatatatacgatgatggaaacctgctctcc

SEQ ID NO: 114667 - DNA, 41 bp, Artificial Sequence
  Description of Artificial Sequence: Synthetic oligonucleotide
attactccgttaatatatacgatgatggaaacctgctctcc

SEQ ID NO: 114668 - DNA, 40 bp, Artificial Sequence
  Description of Artificial Sequence: Synthetic oligonucleotide
ttactccgttaatatatacgatgatggaaacctgctctcc

SEQ ID NO: 114669 - DNA, 39 bp, Artificial Sequence
  Description of Artificial Sequence: Synthetic oligonucleotide
tactccgttaatatatacgatgatggaaacctgctctcc

SEQ ID NO: 114670 - DNA, 38 bp, Artificial Sequence
  Description of Artificial Sequence: Synthetic oligonucleotide
actccgttaatatatacgatgatggaaacctgctctcc

SEQ ID NO: 114671 - DNA, 37 bp, Artificial Sequence
  Description of Artificial Sequence: Synthetic oligonucleotide
ctccgttaatatatacgatgatggaaacctgctctcc

SEQ ID NO: 114672 - DNA, 40 bp, Artificial Sequence
  Description of Artificial Sequence: Synthetic oligonucleotide
tccgttaatatatacgatgatggaaacctgctctccattg

SEQ ID NO: 114673 - DNA, 39 bp, Artificial Sequence
  Description of Artificial Sequence: Synthetic oligonucleotide
ccgttaatatatacgatgatggaaacctgctctccattg

SEQ ID NO: 114674 - DNA, 40 bp, Artificial Sequence
  Description of Artificial Sequence: Synthetic oligonucleotide
cgttaatatatacgatgatggaaacctgctctccattgtg

SEQ ID NO: 114675 - DNA, 41 bp, Artificial Sequence
  Description of Artificial Sequence: Synthetic oligonucleotide
gttaatatatacgatgatggaaacctgctctccattgtgac

SEQ ID NO: 114676 - DNA, 41 bp, Artificial Sequence
  Description of Artificial Sequence: Synthetic oligonucleotide
ttaatatatacgatgatggaaacctgctctccattgtgacc

SEQ ID NO: 114677 - DNA, 40 bp, Artificial Sequence
  Description of Artificial Sequence: Synthetic oligonucleotide
taatatatacgatgatggaaacctgctctccattgtgacc

SEQ ID NO: 114678 - DNA, 39 bp, Artificial Sequence
  Description of Artificial Sequence: Synthetic oligonucleotide
aatatatacgatgatggaaacctgctctccattgtgacc

SEQ ID NO: 114679 - DNA, 38 bp, Artificial Sequence
  Description of Artificial Sequence: Synthetic oligonucleotide
atatatacgatgatggaaacctgctctccattgtgacc

SEQ ID NO: 114680 - DNA, 37 bp, Artificial Sequence
  Description of Artificial Sequence: Synthetic oligonucleotide
tatatacgatgatggaaacctgctctccattgtgacc

SEQ ID NO: 114681 - DNA, 36 bp, Artificial Sequence
  Description of Artificial Sequence: Synthetic oligonucleotide
atatacgatgatggaaacctgctctccattgtgacc

SEQ ID NO: 114682 - DNA, 35 bp, Artificial Sequence
  Description of Artificial Sequence: Synthetic oligonucleotide
tatacgatgatggaaacctgctctccattgtgacc

SEQ ID NO: 114683 - DNA, 34 bp, Artificial Sequence
  Description of Artificial Sequence: Synthetic oligonucleotide
atacgatgatggaaacctgctctccattgtgacc

SEQ ID NO: 114684 - DNA, 33 bp, Artificial Sequence
  Description of Artificial Sequence: Synthetic oligonucleotide
tacgatgatggaaacctgctctccattgtgacc

SEQ ID NO: 114685 - DNA, 32 bp, Artificial Sequence
  Description of Artificial Sequence: Synthetic oligonucleotide
acgatgatggaaacctgctctccattgtgacc

SEQ ID NO: 114686 - DNA, 31 bp, Artificial Sequence
  Description of Artificial Sequence: Synthetic oligonucleotide
cgatgatggaaacctgctctccattgtgacc

SEQ ID NO: 114687 - DNA, 32 bp, Artificial Sequence
  Description of Artificial Sequence: Synthetic oligonucleotide
gatgatggaaacctgctctccattgtgaccag

SEQ ID NO: 114688 - DNA, 33 bp, Artificial Sequence
  Description of Artificial Sequence: Synthetic oligonucleotide
atgatggaaacctgctctccattgtgaccagtg

SEQ ID NO: 114689 - DNA, 32 bp, Artificial Sequence
  Description of Artificial Sequence: Synthetic oligonucleotide
tgatggaaacctgctctccattgtgaccagtg

SEQ ID NO: 114690 - DNA, 31 bp, Artificial Sequence
  Description of Artificial Sequence: Synthetic oligonucleotide
gatggaaacctgctctccattgtgaccagtg

SEQ ID NO: 114691 - DNA, 31 bp, Artificial Sequence
  Description of Artificial Sequence: Synthetic oligonucleotide
atggaaacctgctctccattgtgaccagtgg

SEQ ID NO: 114692 - DNA, 30 bp, Artificial Sequence
  Description of Artificial Sequence: Synthetic oligonucleotide
tggaaacctgctctccattgtgaccagtgg

SEQ ID NO: 114693 - DNA, 29 bp, Artificial Sequence
  Description of Artificial Sequence: Synthetic oligonucleotide
ggaaacctgctctccattgtgaccagtgg

SEQ ID NO: 114694 - DNA, 30 bp, Artificial Sequence
  Description of Artificial Sequence: Synthetic oligonucleotide
gaaacctgctctccattgtgaccagtggag

SEQ ID NO: 114695 - DNA, 30 bp, Artificial Sequence
  Description of Artificial Sequence: Synthetic oligonucleotide
aaacctgctctccattgtgaccagtggagg

SEQ ID NO: 114696 - DNA, 29 bp, Artificial Sequence
  Description of Artificial Sequence: Synthetic oligonucleotide
aacctgctctccattgtgaccagtggagg

SEQ ID NO: 114697 - DNA, 28 bp, Artificial Sequence
  Description of Artificial Sequence: Synthetic oligonucleotide
acctgctctccattgtgaccagtggagg

SEQ ID NO: 114698 - DNA, 27 bp, Artificial Sequence
  Description of Artificial Sequence: Synthetic oligonucleotide
cctgctctccattgtgaccagtggagg

SEQ ID NO: 114699 - DNA, 28 bp, Artificial Sequence
  Description of Artificial Sequence: Synthetic oligonucleotide
ctgctctccattgtgaccagtggaggag

SEQ ID NO: 114700 - DNA, 28 bp, Artificial Sequence
  Description of Artificial Sequence: Synthetic oligonucleotide
tgctctccattgtgaccagtggaggagc

SEQ ID NO: 114701 - DNA, 27 bp, Artificial Sequence
  Description of Artificial Sequence: Synthetic oligonucleotide
gctctccattgtgaccagtggaggagc

SEQ ID NO: 114702 - DNA, 28 bp, Artificial Sequence
  Description of Artificial Sequence: Synthetic oligonucleotide
ctctccattgtgaccagtggaggagctc

SEQ ID NO: 114703 - DNA, 30 bp, Artificial Sequence
  Description of Artificial Sequence: Synthetic oligonucleotide
tctccattgtgaccagtggaggagctcatg

SEQ ID NO: 114704 - DNA, 29 bp, Artificial Sequence
  Description of Artificial Sequence: Synthetic oligonucleotide
ctccattgtgaccagtggaggagctcatg

SEQ ID NO: 114705 - DNA, 29 bp, Artificial Sequence
  Description of Artificial Sequence: Synthetic oligonucleotide
tccattgtgaccagtggaggagctcatgg

SEQ ID NO: 114706 - DNA, 28 bp, Artificial Sequence
  Description of Artificial Sequence: Synthetic oligonucleotide
ccattgtgaccagtggaggagctcatgg

SEQ ID NO: 114707 - DNA, 28 bp, Artificial Sequence
  Description of Artificial Sequence: Synthetic oligonucleotide
cattgtgaccagtggaggagctcatggg

SEQ ID NO: 114708 - DNA, 29 bp, Artificial Sequence
  Description of Artificial Sequence: Synthetic oligonucleotide
attgtgaccagtggaggagctcatgggac

SEQ ID NO: 114709 - DNA, 28 bp, Artificial Sequence
  Description of Artificial Sequence: Synthetic oligonucleotide
ttgtgaccagtggaggagctcatgggac

SEQ ID NO: 114710 - DNA, 27 bp, Artificial Sequence
  Description of Artificial Sequence: Synthetic oligonucleotide
tgtgaccagtggaggagctcatgggac

SEQ ID NO: 114711 - DNA, 27 bp, Artificial Sequence
  Description of Artificial Sequence: Synthetic oligonucleotide
gtgaccagtggaggagctcatgggaca

SEQ ID NO: 114712 - DNA, 27 bp, Artificial Sequence
  Description of Artificial Sequence: Synthetic oligonucleotide
tgaccagtggaggagctcatgggacac

SEQ ID NO: 114713 - DNA, 27 bp, Artificial Sequence
  Description of Artificial Sequence: Synthetic oligonucleotide
gaccagtggaggagctcatgggacaca

SEQ ID NO: 114714 - DNA, 28 bp, Artificial Sequence
  Description of Artificial Sequence: Synthetic oligonucleotide
accagtggaggagctcatgggacacatg

SEQ ID NO: 114715 - DNA, 27 bp, Artificial Sequence
  Description of Artificial Sequence: Synthetic oligonucleotide
ccagtggaggagctcatgggacacatg

SEQ ID NO: 114716 - DNA, 29 bp, Artificial Sequence
  Description of Artificial Sequence: Synthetic oligonucleotide
cagtggaggagctcatgggacacatgtag

SEQ ID NO: 114717 - DNA, 29 bp, Artificial Sequence
  Description of Artificial Sequence: Synthetic oligonucleotide
agtggaggagctcatgggacacatgtagc

SEQ ID NO: 114718 - DNA, 28 bp, Artificial Sequence
  Description of Artificial Sequence: Synthetic oligonucleotide
gtggaggagctcatgggacacatgtagc

SEQ ID NO: 114719 - DNA, 30 bp, Artificial Sequence
  Description of Artificial Sequence: Synthetic oligonucleotide
tggaggagctcatgggacacatgtagctag

SEQ ID NO: 114720 - DNA, 29 bp, Artificial Sequence
  Description of Artificial Sequence: Synthetic oligonucleotide
ggaggagctcatgggacacatgtagctag

SEQ ID NO: 114721 - DNA, 33 bp, Artificial Sequence
  Description of Artificial Sequence: Synthetic oligonucleotide
gaggagctcatgggacacatgtagctagtatag

SEQ ID NO: 114722 - DNA, 33 bp, Artificial Sequence
  Description of Artificial Sequence: Synthetic oligonucleotide
aggagctcatgggacacatgtagctagtatagc

SEQ ID NO: 114723 - DNA, 32 bp, Artificial Sequence
  Description of Artificial Sequence: Synthetic oligonucleotide
ggagctcatgggacacatgtagctagtatagc

SEQ ID NO: 114724 - DNA, 33 bp, Artificial Sequence
  Description of Artificial Sequence: Synthetic oligonucleotide
gagctcatgggacacatgtagctagtatagctg

SEQ ID NO: 114725 - DNA, 33 bp, Artificial Sequence
  Description of Artificial Sequence: Synthetic oligonucleotide
agctcatgggacacatgtagctagtatagctgc

SEQ ID NO: 114726 - DNA, 32 bp, Artificial Sequence
  Description of Artificial Sequence: Synthetic oligonucleotide
gctcatgggacacatgtagctagtatagctgc

SEQ ID NO: 114727 - DNA, 33 bp, Artificial Sequence
  Description of Artificial Sequence: Synthetic oligonucleotide
ctcatgggacacatgtagctagtatagctgctg

SEQ ID NO: 114728 - DNA, 33 bp, Artificial Sequence
  Description of Artificial Sequence: Synthetic oligonucleotide
tcatgggacacatgtagctagtatagctgctgg

SEQ ID NO: 114729 - DNA, 32 bp, Artificial Sequence
  Description of Artificial Sequence: Synthetic oligonucleotide
catgggacacatgtagctagtatagctgctgg

SEQ ID NO: 114730 - DNA, 33 bp, Artificial Sequence
  Description of Artificial Sequence: Synthetic oligonucleotide
atgggacacatgtagctagtatagctgctggac

SEQ ID NO: 114731 - DNA, 32 bp, Artificial Sequence
  Description of Artificial Sequence: Synthetic oligonucleotide
tgggacacatgtagctagtatagctgctggac

SEQ ID NO: 114732 - DNA, 31 bp, Artificial Sequence
  Description of Artificial Sequence: Synthetic oligonucleotide
gggacacatgtagctagtatagctgctggac

SEQ ID NO: 114733 - DNA, 32 bp, Artificial Sequence
  Description of Artificial Sequence: Synthetic oligonucleotide
ggacacatgtagctagtatagctgctggacac

SEQ ID NO: 114734 - DNA, 35 bp, Artificial Sequence
  Description of Artificial Sequence: Synthetic oligonucleotide
gacacatgtagctagtatagctgctggacactttc

SEQ ID NO: 114735 - DNA, 35 bp, Artificial Sequence
  Description of Artificial Sequence: Synthetic oligonucleotide
acacatgtagctagtatagctgctggacactttcc

SEQ ID NO: 114736 - DNA, 34 bp, Artificial Sequence
  Description of Artificial Sequence: Synthetic oligonucleotide
cacatgtagctagtatagctgctggacactttcc

SEQ ID NO: 114737 - DNA, 35 bp, Artificial Sequence
  Description of Artificial Sequence: Synthetic oligonucleotide
acatgtagctagtatagctgctggacactttccag

SEQ ID NO: 114738 - DNA, 34 bp, Artificial Sequence
  Description of Artificial Sequence: Synthetic oligonucleotide
catgtagctagtatagctgctggacactttccag

SEQ ID NO: 114739 - DNA, 36 bp, Artificial Sequence
  Description of Artificial Sequence: Synthetic oligonucleotide
atgtagctagtatagctgctggacactttccagaag

SEQ ID NO: 114740 - DNA, 35 bp, Artificial Sequence
  Description of Artificial Sequence: Synthetic oligonucleotide
tgtagctagtatagctgctggacactttccagaag

SEQ ID NO: 114741 - DNA, 34 bp, Artificial Sequence
  Description of Artificial Sequence: Synthetic oligonucleotide
gtagctagtatagctgctggacactttccagaag

SEQ ID NO: 114742 - DNA, 36 bp, Artificial Sequence
  Description of Artificial Sequence: Synthetic oligonucleotide
tagctagtatagctgctggacactttccagaagaac

SEQ ID NO: 114743 - DNA, 35 bp, Artificial Sequence
  Description of Artificial Sequence: Synthetic oligonucleotide
agctagtatagctgctggacactttccagaagaac

SEQ ID NO: 114744 - DNA, 34 bp, Artificial Sequence
  Description of Artificial Sequence: Synthetic oligonucleotide
gctagtatagctgctggacactttccagaagaac

SEQ ID NO: 114745 - DNA, 34 bp, Artificial Sequence
  Description of Artificial Sequence: Synthetic oligonucleotide
ctagtatagctgctggacactttccagaagaacc

SEQ ID NO: 114746 - DNA, 35 bp, Artificial Sequence
  Description of Artificial Sequence: Synthetic oligonucleotide
tagtatagctgctggacactttccagaagaacctg

SEQ ID NO: 114747 - DNA, 34 bp, Artificial Sequence
  Description of Artificial Sequence: Synthetic oligonucleotide
agtatagctgctggacactttccagaagaacctg

SEQ ID NO: 114748 - DNA, 33 bp, Artificial Sequence
  Description of Artificial Sequence: Synthetic oligonucleotide
gtatagctgctggacactttccagaagaacctg

SEQ ID NO: 114749 - DNA, 35 bp, Artificial Sequence
  Description of Artificial Sequence: Synthetic oligonucleotide
tatagctgctggacactttccagaagaacctgaac

SEQ ID NO: 114750 - DNA, 34 bp, Artificial Sequence
  Description of Artificial Sequence: Synthetic oligonucleotide
atagctgctggacactttccagaagaacctgaac

SEQ ID NO: 114751 - DNA, 33 bp, Artificial Sequence
  Description of Artificial Sequence: Synthetic oligonucleotide
tagctgctggacactttccagaagaacctgaac

SEQ ID NO: 114752 - DNA, 32 bp, Artificial Sequence
  Description of Artificial Sequence: Synthetic oligonucleotide
agctgctggacactttccagaagaacctgaac

SEQ ID NO: 114753 - DNA, 31 bp, Artificial Sequence
  Description of Artificial Sequence: Synthetic oligonucleotide
gctgctggacactttccagaagaacctgaac

SEQ ID NO: 114754 - DNA, 31 bp, Artificial Sequence
  Description of Artificial Sequence: Synthetic oligonucleotide
ctgctggacactttccagaagaacctgaacg

SEQ ID NO: 114755 - DNA, 31 bp, Artificial Sequence
  Description of Artificial Sequence: Synthetic oligonucleotide
tgctggacactttccagaagaacctgaacgg

SEQ ID NO: 114756 - DNA, 30 bp, Artificial Sequence
  Description of Artificial Sequence: Synthetic oligonucleotide
gctggacactttccagaagaacctgaacgg

SEQ ID NO: 114757 - DNA, 33 bp, Artificial Sequence
  Description of Artificial Sequence: Synthetic oligonucleotide
ctggacactttccagaagaacctgaacggaatg

SEQ ID NO: 114758 - DNA, 33 bp, Artificial Sequence
  Description of Artificial Sequence: Synthetic oligonucleotide
tggacactttccagaagaacctgaacggaatgg

SEQ ID NO: 114759 - DNA, 32 bp, Artificial Sequence
  Description of Artificial Sequence: Synthetic oligonucleotide
ggacactttccagaagaacctgaacggaatgg

SEQ ID NO: 114760 - DNA, 32 bp, Artificial Sequence
  Description of Artificial Sequence: Synthetic oligonucleotide
gacactttccagaagaacctgaacggaatggg

SEQ ID NO: 114761 - DNA, 32 bp, Artificial Sequence
  Description of Artificial Sequence: Synthetic oligonucleotide
acactttccagaagaacctgaacggaatgggg

SEQ ID NO: 114762 - DNA, 31 bp, Artificial Sequence
  Description of Artificial Sequence: Synthetic oligonucleotide
cactttccagaagaacctgaacggaatgggg

SEQ ID NO: 114763 - DNA, 33 bp, Artificial Sequence
  Description of Artificial Sequence: Synthetic oligonucleotide
actttccagaagaacctgaacggaatggggtag

SEQ ID NO: 114764 - DNA, 32 bp, Artificial Sequence
  Description of Artificial Sequence: Synthetic oligonucleotide
ctttccagaagaacctgaacggaatggggtag

SEQ ID NO: 114765 - DNA, 32 bp, Artificial Sequence
  Description of Artificial Sequence: Synthetic oligonucleotide
tttccagaagaacctgaacggaatggggtagc

SEQ ID NO: 114766 - DNA, 31 bp, Artificial Sequence
  Description of Artificial Sequence: Synthetic oligonucleotide
ttccagaagaacctgaacggaatggggtagc

SEQ ID NO: 114767 - DNA, 30 bp, Artificial Sequence
  Description of Artificial Sequence: Synthetic oligonucleotide
tccagaagaacctgaacggaatggggtagc

SEQ ID NO: 114768 - DNA, 29 bp, Artificial Sequence
  Description of Artificial Sequence: Synthetic oligonucleotide
ccagaagaacctgaacggaatggggtagc

SEQ ID NO: 114769 - DNA, 30 bp, Artificial Sequence
  Description of Artificial Sequence: Synthetic oligonucleotide
cagaagaacctgaacggaatggggtagctc

SEQ ID NO: 114770 - DNA, 30 bp, Artificial Sequence
  Description of Artificial Sequence: Synthetic oligonucleotide
agaagaacctgaacggaatggggtagctcc

SEQ ID NO: 114771 - DNA, 29 bp, Artificial Sequence
  Description of Artificial Sequence: Synthetic oligonucleotide
gaagaacctgaacggaatggggtagctcc

SEQ ID NO: 114772 - DNA, 30 bp, Artificial Sequence
  Description of Artificial Sequence: Synthetic oligonucleotide
aagaacctgaacggaatggggtagctcctg

SEQ ID NO: 114773 - DNA, 29 bp, Artificial Sequence
  Description of Artificial Sequence: Synthetic oligonucleotide
agaacctgaacggaatggggtagctcctg

SEQ ID NO: 114774 - DNA, 28 bp, Artificial Sequence
  Description of Artificial Sequence: Synthetic oligonucleotide
gaacctgaacggaatggggtagctcctg

SEQ ID NO: 114775 - DNA, 28 bp, Artificial Sequence
  Description of Artificial Sequence: Synthetic oligonucleotide
aacctgaacggaatggggtagctcctgg

SEQ ID NO: 114776 - DNA, 27 bp, Artificial Sequence
  Description of Artificial Sequence: Synthetic oligonucleotide
acctgaacggaatggggtagctcctgg

SEQ ID NO: 114777 - DNA, 27 bp, Artificial Sequence
  Description of Artificial Sequence: Synthetic oligonucleotide
cctgaacggaatggggtagctcctggt

SEQ ID NO: 114778 - DNA, 27 bp, Artificial Sequence
  Description of Artificial Sequence: Synthetic oligonucleotide
ctgaacggaatggggtagctcctggtg

SEQ ID NO: 114779 - DNA, 27 bp, Artificial Sequence
  Description of Artificial Sequence: Synthetic oligonucleotide
tgaacggaatggggtagctcctggtgc

SEQ ID NO: 114780 - DNA, 27 bp, Artificial Sequence
  Description of Artificial Sequence: Synthetic oligonucleotide
gaacggaatggggtagctcctggtgct

SEQ ID NO: 114781 - DNA, 27 bp, Artificial Sequence
  Description of Artificial Sequence: Synthetic oligonucleotide
aacggaatggggtagctcctggtgctc

SEQ ID NO: 114782 - DNA, 27 bp, Artificial Sequence
  Description of Artificial Sequence: Synthetic oligonucleotide
acggaatggggtagctcctggtgctca

SEQ ID NO: 114783 - DNA, 27 bp, Artificial Sequence
  Description of Artificial Sequence: Synthetic oligonucleotide
cggaatggggtagctcctggtgctcaa

SEQ ID NO: 114784 - DNA, 30 bp, Artificial Sequence
  Description of Artificial Sequence: Synthetic oligonucleotide
ggaatggggtagctcctggtgctcaaattc

SEQ ID NO: 114785 - DNA, 33 bp, Artificial Sequence
  Description of Artificial Sequence: Synthetic oligonucleotide
gaatggggtagctcctggtgctcaaattctttc

SEQ ID NO: 114786 - DNA, 33 bp, Artificial Sequence
  Description of Artificial Sequence: Synthetic oligonucleotide
aatggggtagctcctggtgctcaaattctttcc

SEQ ID NO: 114787 - DNA, 32 bp, Artificial Sequence
  Description of Artificial Sequence: Synthetic oligonucleotide
atggggtagctcctggtgctcaaattctttcc

SEQ ID NO: 114788 - DNA, 31 bp, Artificial Sequence
  Description of Artificial Sequence: Synthetic oligonucleotide
tggggtagctcctggtgctcaaattctttcc

SEQ ID NO: 114789 - DNA, 30 bp, Artificial Sequence
  Description of Artificial Sequence: Synthetic oligonucleotide
ggggtagctcctggtgctcaaattctttcc

SEQ ID NO: 114790 - DNA, 32 bp, Artificial Sequence
  Description of Artificial Sequence: Synthetic oligonucleotide
gggtagctcctggtgctcaaattctttccatc

SEQ ID NO: 114791 - DNA, 34 bp, Artificial Sequence
  Description of Artificial Sequence: Synthetic oligonucleotide
ggtagctcctggtgctcaaattctttccatcaag

SEQ ID NO: 114792 - DNA, 37 bp, Artificial Sequence
  Description of Artificial Sequence: Synthetic oligonucleotide
gtagctcctggtgctcaaattctttccatcaagattg

SEQ ID NO: 114793 - DNA, 37 bp, Artificial Sequence
  Description of Artificial Sequence: Synthetic oligonucleotide
tagctcctggtgctcaaattctttccatcaagattgg

SEQ ID NO: 114794 - DNA, 36 bp, Artificial Sequence
  Description of Artificial Sequence: Synthetic oligonucleotide
agctcctggtgctcaaattctttccatcaagattgg

SEQ ID NO: 114795 - DNA, 35 bp, Artificial Sequence
  Description of Artificial Sequence: Synthetic oligonucleotide
gctcctggtgctcaaattctttccatcaagattgg

SEQ ID NO: 114796 - DNA, 36 bp, Artificial Sequence
  Description of Artificial Sequence: Synthetic oligonucleotide
ctcctggtgctcaaattctttccatcaagattggtg

SEQ ID NO: 114797 - DNA, 39 bp, Artificial Sequence
  Description of Artificial Sequence: Synthetic oligonucleotide
tcctggtgctcaaattctttccatcaagattggtgatac

SEQ ID NO: 114798 - DNA, 38 bp, Artificial Sequence
  Description of Artificial Sequence: Synthetic oligonucleotide
cctggtgctcaaattctttccatcaagattggtgatac

SEQ ID NO: 114799 - DNA, 40 bp, Artificial Sequence
  Description of Artificial Sequence: Synthetic oligonucleotide
ctggtgctcaaattctttccatcaagattggtgatacaag

SEQ ID NO: 114800 - DNA, 41 bp, Artificial Sequence
  Description of Artificial Sequence: Synthetic oligonucleotide
tggtgctcaaattctttccatcaagattggtgatacaagac

SEQ ID NO: 114801 - DNA, 40 bp, Artificial Sequence
  Description of Artificial Sequence: Synthetic oligonucleotide
ggtgctcaaattctttccatcaagattggtgatacaagac

SEQ ID NO: 114802 - DNA, 43 bp, Artificial Sequence
  Description of Artificial Sequence: Synthetic oligonucleotide
gtgctcaaattctttccatcaagattggtgatacaagactaag

SEQ ID NO: 114803 - DNA, 43 bp, Artificial Sequence
  Description of Artificial Sequence: Synthetic oligonucleotide
tgctcaaattctttccatcaagattggtgatacaagactaagc

SEQ ID NO: 114804 - DNA, 42 bp, Artificial Sequence
  Description of Artificial Sequence: Synthetic oligonucleotide
gctcaaattctttccatcaagattggtgatacaagactaagc

SEQ ID NO: 114805 - DNA, 43 bp, Artificial Sequence
  Description of Artificial Sequence: Synthetic oligonucleotide
ctcaaattctttccatcaagattggtgatacaagactaagcac

SEQ ID NO: 114806 - DNA, 46 bp, Artificial Sequence
  Description of Artificial Sequence: Synthetic oligonucleotide
tcaaattctttccatcaagattggtgatacaagactaagcacaatg

SEQ ID NO: 114807 - DNA, 45 bp, Artificial Sequence
  Description of Artificial Sequence: Synthetic oligonucleotide
caaattctttccatcaagattggtgatacaagactaagcacaatg

SEQ ID NO: 114808 - DNA, 45 bp, Artificial Sequence
  Description of Artificial Sequence: Synthetic oligonucleotide
aaattctttccatcaagattggtgatacaagactaagcacaatgg

SEQ ID NO: 114809 - DNA, 44 bp, Artificial Sequence
  Description of Artificial Sequence: Synthetic oligonucleotide
aattctttccatcaagattggtgatacaagactaagcacaatgg

SEQ ID NO: 114810 - DNA, 43 bp, Artificial Sequence
  Description of Artificial Sequence: Synthetic oligonucleotide
attctttccatcaagattggtgatacaagactaagcacaatgg

SEQ ID NO: 114811 - DNA, 42 bp, Artificial Sequence
  Description of Artificial Sequence: Synthetic oligonucleotide
ttctttccatcaagattggtgatacaagactaagcacaatgg

SEQ ID NO: 114812 - DNA, 41 bp, Artificial Sequence
  Description of Artificial Sequence: Synthetic oligonucleotide
tctttccatcaagattggtgatacaagactaagcacaatgg

SEQ ID NO: 114813 - DNA, 40 bp, Artificial Sequence
  Description of Artificial Sequence: Synthetic oligonucleotide
ctttccatcaagattggtgatacaagactaagcacaatgg

SEQ ID NO: 114814 - DNA, 43 bp, Artificial Sequence
  Description of Artificial Sequence: Synthetic oligonucleotide
tttccatcaagattggtgatacaagactaagcacaatggaaac

SEQ ID NO: 114815 - DNA, 42 bp, Artificial Sequence
  Description of Artificial Sequence: Synthetic oligonucleotide
ttccatcaagattggtgatacaagactaagcacaatggaaac

SEQ ID NO: 114816 - DNA, 41 bp, Artificial Sequence
  Description of Artificial Sequence: Synthetic oligonucleotide
tccatcaagattggtgatacaagactaagcacaatggaaac

SEQ ID NO: 114817 - DNA, 40 bp, Artificial Sequence
  Description of Artificial Sequence: Synthetic oligonucleotide
ccatcaagattggtgatacaagactaagcacaatggaaac

SEQ ID NO: 114818 - DNA, 41 bp, Artificial Sequence
  Description of Artificial Sequence: Synthetic oligonucleotide
catcaagattggtgatacaagactaagcacaatggaaacag

SEQ ID NO: 114819 - DNA, 41 bp, Artificial Sequence
  Description of Artificial Sequence: Synthetic oligonucleotide
atcaagattggtgatacaagactaagcacaatggaaacagg

SEQ ID NO: 114820 - DNA, 40 bp, Artificial Sequence
  Description of Artificial Sequence: Synthetic oligonucleotide
tcaagattggtgatacaagactaagcacaatggaaacagg

SEQ ID NO: 114821 - DNA, 39 bp, Artificial Sequence
  Description of Artificial Sequence: Synthetic oligonucleotide
caagattggtgatacaagactaagcacaatggaaacagg

SEQ ID NO: 114822 - DNA, 39 bp, Artificial Sequence
  Description of Artificial Sequence: Synthetic oligonucleotide
aagattggtgatacaagactaagcacaatggaaacaggc

SEQ ID NO: 114823 - DNA, 38 bp, Artificial Sequence
  Description of Artificial Sequence: Synthetic oligonucleotide
agattggtgatacaagactaagcacaatggaaacaggc

SEQ ID NO: 114824 - DNA, 37 bp, Artificial Sequence
  Description of Artificial Sequence: Synthetic oligonucleotide
gattggtgatacaagactaagcacaatggaaacaggc

SEQ ID NO: 114825 - DNA, 38 bp, Artificial Sequence
  Description of Artificial Sequence: Synthetic oligonucleotide
attggtgatacaagactaagcacaatggaaacaggcac

SEQ ID NO: 114826 - DNA, 37 bp, Artificial Sequence
  Description of Artificial Sequence: Synthetic oligonucleotide
ttggtgatacaagactaagcacaatggaaacaggcac

SEQ ID NO: 114827 - DNA, 36 bp, Artificial Sequence
  Description of Artificial Sequence: Synthetic oligonucleotide
tggtgatacaagactaagcacaatggaaacaggcac

SEQ ID NO: 114828 - DNA, 35 bp, Artificial Sequence
  Description of Artificial Sequence: Synthetic oligonucleotide
ggtgatacaagactaagcacaatggaaacaggcac

SEQ ID NO: 114829 - DNA, 36 bp, Artificial Sequence
  Description of Artificial Sequence: Synthetic oligonucleotide
gtgatacaagactaagcacaatggaaacaggcacag

SEQ ID NO: 114830 - DNA, 36 bp, Artificial Sequence
  Description of Artificial Sequence: Synthetic oligonucleotide
tgatacaagactaagcacaatggaaacaggcacagg

SEQ ID NO: 114831 - DNA, 35 bp, Artificial Sequence
  Description of Artificial Sequence: Synthetic oligonucleotide
gatacaagactaagcacaatggaaacaggcacagg

SEQ ID NO: 114832 - DNA, 35 bp, Artificial Sequence
  Description of Artificial Sequence: Synthetic oligonucleotide
atacaagactaagcacaatggaaacaggcacaggc

SEQ ID NO: 114833 - DNA, 34 bp, Artificial Sequence
  Description of Artificial Sequence: Synthetic oligonucleotide
tacaagactaagcacaatggaaacaggcacaggc

SEQ ID NO: 114834 - DNA, 33 bp, Artificial Sequence
  Description of Artificial Sequence: Synthetic oligonucleotide
acaagactaagcacaatggaaacaggcacaggc

SEQ ID NO: 114835 - DNA, 32 bp, Artificial Sequence
  Description of Artificial Sequence: Synthetic oligonucleotide
caagactaagcacaatggaaacaggcacaggc

SEQ ID NO: 114836 - DNA, 32 bp, Artificial Sequence
  Description of Artificial Sequence: Synthetic oligonucleotide
aagactaagcacaatggaaacaggcacaggcc

SEQ ID NO: 114837 - DNA, 31 bp, Artificial Sequence
  Description of Artificial Sequence: Synthetic oligonucleotide
agactaagcacaatggaaacaggcacaggcc

SEQ ID NO: 114838 - DNA, 30 bp, Artificial Sequence
  Description of Artificial Sequence: Synthetic oligonucleotide
gactaagcacaatggaaacaggcacaggcc

SEQ ID NO: 114839 - DNA, 31 bp, Artificial Sequence
  Description of Artificial Sequence: Synthetic oligonucleotide
actaagcacaatggaaacaggcacaggcctc

SEQ ID NO: 114840 - DNA, 30 bp, Artificial Sequence
  Description of Artificial Sequence: Synthetic oligonucleotide
ctaagcacaatggaaacaggcacaggcctc

SEQ ID NO: 114841 - DNA, 34 bp, Artificial Sequence
  Description of Artificial Sequence: Synthetic oligonucleotide
taagcacaatggaaacaggcacaggcctcataag

SEQ ID NO: 114842 - DNA, 33 bp, Artificial Sequence
  Description of Artificial Sequence: Synthetic oligonucleotide
aagcacaatggaaacaggcacaggcctcataag

SEQ ID NO: 114843 - DNA, 32 bp, Artificial Sequence
  Description of Artificial Sequence: Synthetic oligonucleotide
agcacaatggaaacaggcacaggcctcataag

SEQ ID NO: 114844 - DNA, 31 bp, Artificial Sequence
  Description of Artificial Sequence: Synthetic oligonucleotide
gcacaatggaaacaggcacaggcctcataag

SEQ ID NO: 114845 - DNA, 32 bp, Artificial Sequence
  Description of Artificial Sequence: Synthetic oligonucleotide
cacaatggaaacaggcacaggcctcataagag

SEQ ID NO: 114846 - DNA, 32 bp, Artificial Sequence
  Description of Artificial Sequence: Synthetic oligonucleotide
acaatggaaacaggcacaggcctcataagagc

SEQ ID NO: 114847 - DNA, 31 bp, Artificial Sequence
  Description of Artificial Sequence: Synthetic oligonucleotide
caatggaaacaggcacaggcctcataagagc

SEQ ID NO: 114848 - DNA, 34 bp, Artificial Sequence
  Description of Artificial Sequence: Synthetic oligonucleotide
aatggaaacaggcacaggcctcataagagctatg

SEQ ID NO: 114849 - DNA, 33 bp, Artificial Sequence
  Description of Artificial Sequence: Synthetic oligonucleotide
atggaaacaggcacaggcctcataagagctatg

SEQ ID NO: 114850 - DNA, 32 bp, Artificial Sequence
  Description of Artificial Sequence: Synthetic oligonucleotide
tggaaacaggcacaggcctcataagagctatg

SEQ ID NO: 114851 - DNA, 31 bp, Artificial Sequence
  Description of Artificial Sequence: Synthetic oligonucleotide
ggaaacaggcacaggcctcataagagctatg

SEQ ID NO: 114852 - DNA, 34 bp, Artificial Sequence
  Description of Artificial Sequence: Synthetic oligonucleotide
gaaacaggcacaggcctcataagagctatgatag

SEQ ID NO: 114853 - DNA, 36 bp, Artificial Sequence
  Description of Artificial Sequence: Synthetic oligonucleotide
aaacaggcacaggcctcataagagctatgatagaag

SEQ ID NO: 114854 - DNA, 35 bp, Artificial Sequence
  Description of Artificial Sequence: Synthetic oligonucleotide
aacaggcacaggcctcataagagctatgatagaag

SEQ ID NO: 114855 - DNA, 34 bp, Artificial Sequence
  Description of Artificial Sequence: Synthetic oligonucleotide
acaggcacaggcctcataagagctatgatagaag

SEQ ID NO: 114856 - DNA, 33 bp, Artificial Sequence
  Description of Artificial Sequence: Synthetic oligonucleotide
caggcacaggcctcataagagctatgatagaag

SEQ ID NO: 114857 - DNA, 41 bp, Artificial Sequence
  Description of Artificial Sequence: Synthetic oligonucleotide
aggcacaggcctcataagagctatgatagaagttataaatc

SEQ ID NO: 114858 - DNA, 40 bp, Artificial Sequence
  Description of Artificial Sequence: Synthetic oligonucleotide
ggcacaggcctcataagagctatgatagaagttataaatc

SEQ ID NO: 114859 - DNA, 44 bp, Artificial Sequence
  Description of Artificial Sequence: Synthetic oligonucleotide
gcacaggcctcataagagctatgatagaagttataaatcataag

SEQ ID NO: 114860 - DNA, 45 bp, Artificial Sequence
  Description of Artificial Sequence: Synthetic oligonucleotide
cacaggcctcataagagctatgatagaagttataaatcataagtg

SEQ ID NO: 114861 - DNA, 46 bp, Artificial Sequence
  Description of Artificial Sequence: Synthetic oligonucleotide
acaggcctcataagagctatgatagaagttataaatcataagtgtg

SEQ ID NO: 114862 - DNA, 45 bp, Artificial Sequence
  Description of Artificial Sequence: Synthetic oligonucleotide
caggcctcataagagctatgatagaagttataaatcataagtgtg

SEQ ID NO: 114863 - DNA, 47 bp, Artificial Sequence
  Description of Artificial Sequence: Synthetic oligonucleotide
aggcctcataagagctatgatagaagttataaatcataagtgtgatc

SEQ ID NO: 114864 - DNA, 46 bp, Artificial Sequence
  Description of Artificial Sequence: Synthetic oligonucleotide
ggcctcataagagctatgatagaagttataaatcataagtgtgatc

SEQ ID NO: 114865 - DNA, 48 bp, Artificial Sequence
  Description of Artificial Sequence: Synthetic oligonucleotide
gcctcataagagctatgatagaagttataaatcataagtgtgatcttg

SEQ ID NO: 114866 - DNA, 49 bp, Artificial Sequence
  Description of Artificial Sequence: Synthetic oligonucleotide
cctcataagagctatgatagaagttataaatcataagtgtgatcttgtc

SEQ ID NO: 114867 - DNA, 51 bp, Artificial Sequence
  Description of Artificial Sequence: Synthetic oligonucleotide
ctcataagagctatgatagaagttataaatcataagtgtgatcttgtcaac

SEQ ID NO: 114868 - DNA, 53 bp, Artificial Sequence
  Description of Artificial Sequence: Synthetic oligonucleotide
tcataagagctatgatagaagttataaatcataagtgtgatcttgtcaactac

SEQ ID NO: 114869 - DNA, 52 bp, Artificial Sequence
  Description of Artificial Sequence: Synthetic oligonucleotide
cataagagctatgatagaagttataaatcataagtgtgatcttgtcaactac

SEQ ID NO: 114870 - DNA, 53 bp, Artificial Sequence
  Description of Artificial Sequence: Synthetic oligonucleotide
ataagagctatgatagaagttataaatcataagtgtgatcttgtcaactacag

SEQ ID NO: 114871 - DNA, 52 bp, Artificial Sequence
  Description of Artificial Sequence: Synthetic oligonucleotide
taagagctatgatagaagttataaatcataagtgtgatcttgtcaactacag

SEQ ID NO: 114872 - DNA, 51 bp, Artificial Sequence
  Description of Artificial Sequence: Synthetic oligonucleotide
aagagctatgatagaagttataaatcataagtgtgatcttgtcaactacag

SEQ ID NO: 114873 - DNA, 50 bp, Artificial Sequence
  Description of Artificial Sequence: Synthetic oligonucleotide
agagctatgatagaagttataaatcataagtgtgatcttgtcaactacag

SEQ ID NO: 114874 - DNA, 49 bp, Artificial Sequence
  Description of Artificial Sequence: Synthetic oligonucleotide
gagctatgatagaagttataaatcataagtgtgatcttgtcaactacag

SEQ ID NO: 114875 - DNA, 52 bp, Artificial Sequence
  Description of Artificial Sequence: Synthetic oligonucleotide
agctatgatagaagttataaatcataagtgtgatcttgtcaactacagttac

SEQ ID NO: 114876 - DNA, 51 bp, Artificial Sequence
  Description of Artificial Sequence: Synthetic oligonucleotide
gctatgatagaagttataaatcataagtgtgatcttgtcaactacagttac

SEQ ID NO: 114877 - DNA, 51 bp, Artificial Sequence
  Description of Artificial Sequence: Synthetic oligonucleotide
ctatgatagaagttataaatcataagtgtgatcttgtcaactacagttacg

SEQ ID NO: 114878 - DNA, 51 bp, Artificial Sequence
  Description of Artificial Sequence: Synthetic oligonucleotide
tatgatagaagttataaatcataagtgtgatcttgtcaactacagttacgg

SEQ ID NO: 114879 - DNA, 50 bp, Artificial Sequence
  Description of Artificial Sequence: Synthetic oligonucleotide
atgatagaagttataaatcataagtgtgatcttgtcaactacagttacgg

SEQ ID NO: 114880 - DNA, 49 bp, Artificial Sequence
  Description of Artificial Sequence: Synthetic oligonucleotide
tgatagaagttataaatcataagtgtgatcttgtcaactacagttacgg

SEQ ID NO: 114881 - DNA, 48 bp, Artificial Sequence
  Description of Artificial Sequence: Synthetic oligonucleotide
gatagaagttataaatcataagtgtgatcttgtcaactacagttacgg

SEQ ID NO: 114882 - DNA, 49 bp, Artificial Sequence
  Description of Artificial Sequence: Synthetic oligonucleotide
atagaagttataaatcataagtgtgatcttgtcaactacagttacggag

SEQ ID NO: 114883 - DNA, 48 bp, Artificial Sequence
  Description of Artificial Sequence: Synthetic oligonucleotide
tagaagttataaatcataagtgtgatcttgtcaactacagttacggag

SEQ ID NO: 114884 - DNA, 47 bp, Artificial Sequence
  Description of Artificial Sequence: Synthetic oligonucleotide
agaagttataaatcataagtgtgatcttgtcaactacagttacggag

SEQ ID NO: 114885 - DNA, 46 bp, Artificial Sequence
  Description of Artificial Sequence: Synthetic oligonucleotide
gaagttataaatcataagtgtgatcttgtcaactacagttacggag

SEQ ID NO: 114886 - DNA, 48 bp, Artificial Sequence
  Description of Artificial Sequence: Synthetic oligonucleotide
aagttataaatcataagtgtgatcttgtcaactacagttacggagaag

SEQ ID NO: 114887 - DNA, 47 bp, Artificial Sequence
  Description of Artificial Sequence: Synthetic oligonucleotide
agttataaatcataagtgtgatcttgtcaactacagttacggagaag

SEQ ID NO: 114888 - DNA, 46 bp, Artificial Sequence
  Description of Artificial Sequence: Synthetic oligonucleotide
gttataaatcataagtgtgatcttgtcaactacagttacggagaag

SEQ ID NO: 114889 - DNA, 46 bp, Artificial Sequence
  Description of Artificial Sequence: Synthetic oligonucleotide
ttataaatcataagtgtgatcttgtcaactacagttacggagaagc

SEQ ID NO: 114890 - DNA, 45 bp, Artificial Sequence
  Description of Artificial Sequence: Synthetic oligonucleotide
tataaatcataagtgtgatcttgtcaactacagttacggagaagc

SEQ ID NO: 114891 - DNA, 44 bp, Artificial Sequence
  Description of Artificial Sequence: Synthetic oligonucleotide
ataaatcataagtgtgatcttgtcaactacagttacggagaagc

SEQ ID NO: 114892 - DNA, 43 bp, Artificial Sequence
  Description of Artificial Sequence: Synthetic oligonucleotide
taaatcataagtgtgatcttgtcaactacagttacggagaagc

SEQ ID NO: 114893 - DNA, 42 bp, Artificial Sequence
  Description of Artificial Sequence: Synthetic oligonucleotide
aaatcataagtgtgatcttgtcaactacagttacggagaagc

SEQ ID NO: 114894 - DNA, 41 bp, Artificial Sequence
  Description of Artificial Sequence: Synthetic oligonucleotide
aatcataagtgtgatcttgtcaactacagttacggagaagc

SEQ ID NO: 114895 - DNA, 40 bp, Artificial Sequence
  Description of Artificial Sequence: Synthetic oligonucleotide
atcataagtgtgatcttgtcaactacagttacggagaagc

SEQ ID NO: 114896 - DNA, 39 bp, Artificial Sequence
  Description of Artificial Sequence: Synthetic oligonucleotide
tcataagtgtgatcttgtcaactacagttacggagaagc

SEQ ID NO: 114897 - DNA, 38 bp, Artificial Sequence
  Description of Artificial Sequence: Synthetic oligonucleotide
cataagtgtgatcttgtcaactacagttacggagaagc

SEQ ID NO: 114898 - DNA, 40 bp, Artificial Sequence
  Description of Artificial Sequence: Synthetic oligonucleotide
ataagtgtgatcttgtcaactacagttacggagaagcaac

SEQ ID NO: 114899 - DNA, 39 bp, Artificial Sequence
  Description of Artificial Sequence: Synthetic oligonucleotide
taagtgtgatcttgtcaactacagttacggagaagcaac

SEQ ID NO: 114900 - DNA, 38 bp, Artificial Sequence
  Description of Artificial Sequence: Synthetic oligonucleotide
aagtgtgatcttgtcaactacagttacggagaagcaac

SEQ ID NO: 114901 - DNA, 37 bp, Artificial Sequence
  Description of Artificial Sequence: Synthetic oligonucleotide
agtgtgatcttgtcaactacagttacggagaagcaac

SEQ ID NO: 114902 - DNA, 36 bp, Artificial Sequence
  Description of Artificial Sequence: Synthetic oligonucleotide
gtgtgatcttgtcaactacagttacggagaagcaac

SEQ ID NO: 114903 - DNA, 37 bp, Artificial Sequence
  Description of Artificial Sequence: Synthetic oligonucleotide
tgtgatcttgtcaactacagttacggagaagcaactc

SEQ ID NO: 114904 - DNA, 36 bp, Artificial Sequence
  Description of Artificial Sequence: Synthetic oligonucleotide
gtgatcttgtcaactacagttacggagaagcaactc

SEQ ID NO: 114905 - DNA, 37 bp, Artificial Sequence
  Description of Artificial Sequence: Synthetic oligonucleotide
tgatcttgtcaactacagttacggagaagcaactcac

SEQ ID NO: 114906 - DNA, 36 bp, Artificial Sequence
  Description of Artificial Sequence: Synthetic oligonucleotide
gatcttgtcaactacagttacggagaagcaactcac

SEQ ID NO: 114907 - DNA, 37 bp, Artificial Sequence
  Description of Artificial Sequence: Synthetic oligonucleotide
atcttgtcaactacagttacggagaagcaactcactg

SEQ ID NO: 114908 - DNA, 36 bp, Artificial Sequence
  Description of Artificial Sequence: Synthetic oligonucleotide
tcttgtcaactacagttacggagaagcaactcactg

SEQ ID NO: 114909 - DNA, 35 bp, Artificial Sequence
  Description of Artificial Sequence: Synthetic oligonucleotide
cttgtcaactacagttacggagaagcaactcactg

SEQ ID NO: 114910 - DNA, 35 bp, Artificial Sequence
  Description of Artificial Sequence: Synthetic oligonucleotide
ttgtcaactacagttacggagaagcaactcactgg

SEQ ID NO: 114911 - DNA, 34 bp, Artificial Sequence
  Description of Artificial Sequence: Synthetic oligonucleotide
tgtcaactacagttacggagaagcaactcactgg

SEQ ID NO: 114912 - DNA, 33 bp, Artificial Sequence
  Description of Artificial Sequence: Synthetic oligonucleotide
gtcaactacagttacggagaagcaactcactgg

SEQ ID NO: 114913 - DNA, 33 bp, Artificial Sequence
  Description of Artificial Sequence: Synthetic oligonucleotide
tcaactacagttacggagaagcaactcactggc

SEQ ID NO: 114914 - DNA, 32 bp, Artificial Sequence
  Description of Artificial Sequence: Synthetic oligonucleotide
caactacagttacggagaagcaactcactggc

SEQ ID NO: 114915 - DNA, 32 bp, Artificial Sequence
  Description of Artificial Sequence: Synthetic oligonucleotide
aactacagttacggagaagcaactcactggcc

SEQ ID NO: 114916 - DNA, 31 bp, Artificial Sequence
  Description of Artificial Sequence: Synthetic oligonucleotide
actacagttacggagaagcaactcactggcc

SEQ ID NO: 114917 - DNA, 30 bp, Artificial Sequence
  Description of Artificial Sequence: Synthetic oligonucleotide
ctacagttacggagaagcaactcactggcc

SEQ ID NO: 114918 - DNA, 35 bp, Artificial Sequence
  Description of Artificial Sequence: Synthetic oligonucleotide
tacagttacggagaagcaactcactggccaaattc

SEQ ID NO: 114919 - DNA, 34 bp, Artificial Sequence
  Description of Artificial Sequence: Synthetic oligonucleotide
acagttacggagaagcaactcactggccaaattc

SEQ ID NO: 114920 - DNA, 33 bp, Artificial Sequence
  Description of Artificial Sequence: Synthetic oligonucleotide
cagttacggagaagcaactcactggccaaattc

SEQ ID NO: 114921 - DNA, 34 bp, Artificial Sequence
  Description of Artificial Sequence: Synthetic oligonucleotide
agttacggagaagcaactcactggccaaattctg

SEQ ID NO: 114922 - DNA, 33 bp, Artificial Sequence
  Description of Artificial Sequence: Synthetic oligonucleotide
gttacggagaagcaactcactggccaaattctg

SEQ ID NO: 114923 - DNA, 33 bp, Artificial Sequence
  Description of Artificial Sequence: Synthetic oligonucleotide
ttacggagaagcaactcactggccaaattctgg

SEQ ID NO: 114924 - DNA, 32 bp, Artificial Sequence
  Description of Artificial Sequence: Synthetic oligonucleotide
tacggagaagcaactcactggccaaattctgg

SEQ ID NO: 114925 - DNA, 31 bp, Artificial Sequence
  Description of Artificial Sequence: Synthetic oligonucleotide
acggagaagcaactcactggccaaattctgg

SEQ ID NO: 114926 - DNA, 30 bp, Artificial Sequence
  Description of Artificial Sequence: Synthetic oligonucleotide
cggagaagcaactcactggccaaattctgg

SEQ ID NO: 114927 - DNA, 30 bp, Artificial Sequence
  Description of Artificial Sequence: Synthetic oligonucleotide
ggagaagcaactcactggccaaattctggg

SEQ ID NO: 114928 - DNA, 31 bp, Artificial Sequence
  Description of Artificial Sequence: Synthetic oligonucleotide
gagaagcaactcactggccaaattctgggag

SEQ ID NO: 114929 - DNA, 36 bp, Artificial Sequence
  Description of Artificial Sequence: Synthetic oligonucleotide
agaagcaactcactggccaaattctgggagaatttg

SEQ ID NO: 114930 - DNA, 35 bp, Artificial Sequence
  Description of Artificial Sequence: Synthetic oligonucleotide
gaagcaactcactggccaaattctgggagaatttg

SEQ ID NO: 114931 - DNA, 36 bp, Artificial Sequence
  Description of Artificial Sequence: Synthetic oligonucleotide
aagcaactcactggccaaattctgggagaatttgtg

SEQ ID NO: 114932 - DNA, 35 bp, Artificial Sequence
  Description of Artificial Sequence: Synthetic oligonucleotide
agcaactcactggccaaattctgggagaatttgtg

SEQ ID NO: 114933 - DNA, 34 bp, Artificial Sequence
  Description of Artificial Sequence: Synthetic oligonucleotide
gcaactcactggccaaattctgggagaatttgtg

SEQ ID NO: 114934 - DNA, 36 bp, Artificial Sequence
  Description of Artificial Sequence: Synthetic oligonucleotide
caactcactggccaaattctgggagaatttgtgaag

SEQ ID NO: 114935 - DNA, 44 bp, Artificial Sequence
  Description of Artificial Sequence: Synthetic oligonucleotide
aactcactggccaaattctgggagaatttgtgaagtaattaatg

SEQ ID NO: 114936 - DNA, 43 bp, Artificial Sequence
  Description of Artificial Sequence: Synthetic oligonucleotide
actcactggccaaattctgggagaatttgtgaagtaattaatg

SEQ ID NO: 114937 - DNA, 42 bp, Artificial Sequence
  Description of Artificial Sequence: Synthetic oligonucleotide
ctcactggccaaattctgggagaatttgtgaagtaattaatg

SEQ ID NO: 114938 - DNA, 44 bp, Artificial Sequence
  Description of Artificial Sequence: Synthetic oligonucleotide
tcactggccaaattctgggagaatttgtgaagtaattaatgaag

SEQ ID NO: 114939 - DNA, 43 bp, Artificial Sequence
  Description of Artificial Sequence: Synthetic oligonucleotide
cactggccaaattctgggagaatttgtgaagtaattaatgaag

SEQ ID NO: 114940 - DNA, 43 bp, Artificial Sequence
  Description of Artificial Sequence: Synthetic oligonucleotide
actggccaaattctgggagaatttgtgaagtaattaatgaagc

SEQ ID NO: 114941 - DNA, 42 bp, Artificial Sequence
  Description of Artificial Sequence: Synthetic oligonucleotide
ctggccaaattctgggagaatttgtgaagtaattaatgaagc

SEQ ID NO: 114942 - DNA, 43 bp, Artificial Sequence
  Description of Artificial Sequence: Synthetic oligonucleotide
tggccaaattctgggagaatttgtgaagtaattaatgaagcag

SEQ ID NO: 114943 - DNA, 42 bp, Artificial Sequence
  Description of Artificial Sequence: Synthetic oligonucleotide
ggccaaattctgggagaatttgtgaagtaattaatgaagcag

SEQ ID NO: 114944 - DNA, 45 bp, Artificial Sequence
  Description of Artificial Sequence: Synthetic oligonucleotide
gccaaattctgggagaatttgtgaagtaattaatgaagcagtatg

SEQ ID NO: 114945 - DNA, 45 bp, Artificial Sequence
  Description of Artificial Sequence: Synthetic oligonucleotide
ccaaattctgggagaatttgtgaagtaattaatgaagcagtatgg

SEQ ID NO: 114946 - DNA, 47 bp, Artificial Sequence
  Description of Artificial Sequence: Synthetic oligonucleotide
caaattctgggagaatttgtgaagtaattaatgaagcagtatggaag

SEQ ID NO: 114947 - DNA, 47 bp, Artificial Sequence
  Description of Artificial Sequence: Synthetic oligonucleotide
aaattctgggagaatttgtgaagtaattaatgaagcagtatggaagc

SEQ ID NO: 114948 - DNA, 46 bp, Artificial Sequence
  Description of Artificial Sequence: Synthetic oligonucleotide
aattctgggagaatttgtgaagtaattaatgaagcagtatggaagc

SEQ ID NO: 114949 - DNA, 45 bp, Artificial Sequence
  Description of Artificial Sequence: Synthetic oligonucleotide
attctgggagaatttgtgaagtaattaatgaagcagtatggaagc

SEQ ID NO: 114950 - DNA, 44 bp, Artificial Sequence
  Description of Artificial Sequence: Synthetic oligonucleotide
ttctgggagaatttgtgaagtaattaatgaagcagtatggaagc

SEQ ID NO: 114951 - DNA, 43 bp, Artificial Sequence
  Description of Artificial Sequence: Synthetic oligonucleotide
tctgggagaatttgtgaagtaattaatgaagcagtatggaagc

SEQ ID NO: 114952 - DNA, 42 bp, Artificial Sequence
  Description of Artificial Sequence: Synthetic oligonucleotide
ctgggagaatttgtgaagtaattaatgaagcagtatggaagc

SEQ ID NO: 114953 - DNA, 56 bp, Artificial Sequence
  Description of Artificial Sequence: Synthetic oligonucleotide
tgggagaatttgtgaagtaattaatgaagcagtatggaagcataatataatttatg

SEQ ID NO: 114954 - DNA, 55 bp, Artificial Sequence
  Description of Artificial Sequence: Synthetic oligonucleotide
gggagaatttgtgaagtaattaatgaagcagtatggaagcataatataatttatg

SEQ ID NO: 114955 - DNA, 58 bp, Artificial Sequence
  Description of Artificial Sequence: Synthetic oligonucleotide
ggagaatttgtgaagtaattaatgaagcagtatggaagcataatataatttatgtttc

SEQ ID NO: 114956 - DNA, 60 bp, Artificial Sequence
  Description of Artificial Sequence: Synthetic oligonucleotide
gagaatttgtgaagtaattaatgaagcagtatggaagcataatataatttatgtttcaag

SEQ ID NO: 114957 - DNA, 60 bp, Artificial Sequence
  Description of Artificial Sequence: Synthetic oligonucleotide
agaatttgtgaagtaattaatgaagcagtatggaagcataatataatttatgtttcaagt

SEQ ID NO: 114958 - DNA, 60 bp, Artificial Sequence
  Description of Artificial Sequence: Synthetic oligonucleotide
gaatttgtgaagtaattaatgaagcagtatggaagcataatataatttatgtttcaagtg

SEQ ID NO: 114959 - DNA, 60 bp, Artificial Sequence
  Description of Artificial Sequence: Synthetic oligonucleotide
aatttgtgaagtaattaatgaagcagtatggaagcataatataatttatgtttcaagtgc

SEQ ID NO: 114960 - DNA, 59 bp, Artificial Sequence
  Description of Artificial Sequence: Synthetic oligonucleotide
atttgtgaagtaattaatgaagcagtatggaagcataatataatttatgtttcaagtgc

SEQ ID NO: 114961 - DNA, 58 bp, Artificial Sequence
  Description of Artificial Sequence: Synthetic oligonucleotide
tttgtgaagtaattaatgaagcagtatggaagcataatataatttatgtttcaagtgc

SEQ ID NO: 114962 - DNA, 57 bp, Artificial Sequence
  Description of Artificial Sequence: Synthetic oligonucleotide
ttgtgaagtaattaatgaagcagtatggaagcataatataatttatgtttcaagtgc

SEQ ID NO: 114963 - DNA, 56 bp, Artificial Sequence
  Description of Artificial Sequence: Synthetic oligonucleotide
tgtgaagtaattaatgaagcagtatggaagcataatataatttatgtttcaagtgc

SEQ ID NO: 114964 - DNA, 55 bp, Artificial Sequence
  Description of Artificial Sequence: Synthetic oligonucleotide
gtgaagtaattaatgaagcagtatggaagcataatataatttatgtttcaagtgc

SEQ ID NO: 114965 - DNA, 56 bp, Artificial Sequence
  Description of Artificial Sequence: Synthetic oligonucleotide
tgaagtaattaatgaagcagtatggaagcataatataatttatgtttcaagtgctg

SEQ ID NO: 114966 - DNA, 55 bp, Artificial Sequence
  Description of Artificial Sequence: Synthetic oligonucleotide
gaagtaattaatgaagcagtatggaagcataatataatttatgtttcaagtgctg

SEQ ID NO: 114967 - DNA, 55 bp, Artificial Sequence
  Description of Artificial Sequence: Synthetic oligonucleotide
aagtaattaatgaagcagtatggaagcataatataatttatgtttcaagtgctgg

SEQ ID NO: 114968 - DNA, 54 bp, Artificial Sequence
  Description of Artificial Sequence: Synthetic oligonucleotide
agtaattaatgaagcagtatggaagcataatataatttatgtttcaagtgctgg

SEQ ID NO: 114969 - DNA, 53 bp, Artificial Sequence
  Description of Artificial Sequence: Synthetic oligonucleotide
gtaattaatgaagcagtatggaagcataatataatttatgtttcaagtgctgg

SEQ ID NO: 114970 - DNA, 60 bp, Artificial Sequence
  Description of Artificial Sequence: Synthetic oligonucleotide
taattaatgaagcagtatggaagcataatataatttatgtttcaagtgctggaaataatg

SEQ ID NO: 114971 - DNA, 59 bp, Artificial Sequence
  Description of Artificial Sequence: Synthetic oligonucleotide
aattaatgaagcagtatggaagcataatataatttatgtttcaagtgctggaaataatg

SEQ ID NO: 114972 - DNA, 58 bp, Artificial Sequence
  Description of Artificial Sequence: Synthetic oligonucleotide
attaatgaagcagtatggaagcataatataatttatgtttcaagtgctggaaataatg

SEQ ID NO: 114973 - DNA, 57 bp, Artificial Sequence
  Description of Artificial Sequence: Synthetic oligonucleotide
ttaatgaagcagtatggaagcataatataatttatgtttcaagtgctggaaataatg

SEQ ID NO: 114974 - DNA, 56 bp, Artificial Sequence
  Description of Artificial Sequence: Synthetic oligonucleotide
taatgaagcagtatggaagcataatataatttatgtttcaagtgctggaaataatg

SEQ ID NO: 114975 - DNA, 55 bp, Artificial Sequence
  Description of Artificial Sequence: Synthetic oligonucleotide
aatgaagcagtatggaagcataatataatttatgtttcaagtgctggaaataatg

SEQ ID NO: 114976 - DNA, 54 bp, Artificial Sequence
  Description of Artificial Sequence: Synthetic oligonucleotide
atgaagcagtatggaagcataatataatttatgtttcaagtgctggaaataatg

SEQ ID NO: 114977 - DNA, 53 bp, Artificial Sequence
  Description of Artificial Sequence: Synthetic oligonucleotide
tgaagcagtatggaagcataatataatttatgtttcaagtgctggaaataatg

SEQ ID NO: 114978 - DNA, 52 bp, Artificial Sequence
  Description of Artificial Sequence: Synthetic oligonucleotide
gaagcagtatggaagcataatataatttatgtttcaagtgctggaaataatg

SEQ ID NO: 114979 - DNA, 52 bp, Artificial Sequence
  Description of Artificial Sequence: Synthetic oligonucleotide
aagcagtatggaagcataatataatttatgtttcaagtgctggaaataatgg

SEQ ID NO: 114980 - DNA, 51 bp, Artificial Sequence
  Description of Artificial Sequence: Synthetic oligonucleotide
agcagtatggaagcataatataatttatgtttcaagtgctggaaataatgg

SEQ ID NO: 114981 - DNA, 50 bp, Artificial Sequence
  Description of Artificial Sequence: Synthetic oligonucleotide
gcagtatggaagcataatataatttatgtttcaagtgctggaaataatgg

SEQ ID NO: 114982 - DNA, 51 bp, Artificial Sequence
  Description of Artificial Sequence: Synthetic oligonucleotide
cagtatggaagcataatataatttatgtttcaagtgctggaaataatggtc

SEQ ID NO: 114983 - DNA, 51 bp, Artificial Sequence
  Description of Artificial Sequence: Synthetic oligonucleotide
agtatggaagcataatataatttatgtttcaagtgctggaaataatggtcc

SEQ ID NO: 114984 - DNA, 50 bp, Artificial Sequence
  Description of Artificial Sequence: Synthetic oligonucleotide
gtatggaagcataatataatttatgtttcaagtgctggaaataatggtcc

SEQ ID NO: 114985 - DNA, 52 bp, Artificial Sequence
  Description of Artificial Sequence: Synthetic oligonucleotide
tatggaagcataatataatttatgtttcaagtgctggaaataatggtccatg

SEQ ID NO: 114986 - DNA, 51 bp, Artificial Sequence
  Description of Artificial Sequence: Synthetic oligonucleotide
atggaagcataatataatttatgtttcaagtgctggaaataatggtccatg

SEQ ID NO: 114987 - DNA, 50 bp, Artificial Sequence
  Description of Artificial Sequence: Synthetic oligonucleotide
tggaagcataatataatttatgtttcaagtgctggaaataatggtccatg

SEQ ID NO: 114988 - DNA, 49 bp, Artificial Sequence
  Description of Artificial Sequence: Synthetic oligonucleotide
ggaagcataatataatttatgtttcaagtgctggaaataatggtccatg

SEQ ID NO: 114989 - DNA, 49 bp, Artificial Sequence
  Description of Artificial Sequence: Synthetic oligonucleotide
gaagcataatataatttatgtttcaagtgctggaaataatggtccatgc

SEQ ID NO: 114990 - DNA, 49 bp, Artificial Sequence
  Description of Artificial Sequence: Synthetic oligonucleotide
aagcataatataatttatgtttcaagtgctggaaataatggtccatgcc

SEQ ID NO: 114991 - DNA, 48 bp, Artificial Sequence
  Description of Artificial Sequence: Synthetic oligonucleotide
agcataatataatttatgtttcaagtgctggaaataatggtccatgcc

SEQ ID NO: 114992 - DNA, 47 bp, Artificial Sequence
  Description of Artificial Sequence: Synthetic oligonucleotide
gcataatataatttatgtttcaagtgctggaaataatggtccatgcc

SEQ ID NO: 114993 - DNA, 48 bp, Artificial Sequence
  Description of Artificial Sequence: Synthetic oligonucleotide
cataatataatttatgtttcaagtgctggaaataatggtccatgcctg

SEQ ID NO: 114994 - DNA, 49 bp, Artificial Sequence
  Description of Artificial Sequence: Synthetic oligonucleotide
ataatataatttatgtttcaagtgctggaaataatggtccatgcctgtc

SEQ ID NO: 114995 - DNA, 48 bp, Artificial Sequence
  Description of Artificial Sequence: Synthetic oligonucleotide
taatataatttatgtttcaagtgctggaaataatggtccatgcctgtc

SEQ ID NO: 114996 - DNA, 47 bp, Artificial Sequence
  Description of Artificial Sequence: Synthetic oligonucleotide
aatataatttatgtttcaagtgctggaaataatggtccatgcctgtc

SEQ ID NO: 114997 - DNA, 46 bp, Artificial Sequence
  Description of Artificial Sequence: Synthetic oligonucleotide
atataatttatgtttcaagtgctggaaataatggtccatgcctgtc

SEQ ID NO: 114998 - DNA, 45 bp, Artificial Sequence
  Description of Artificial Sequence: Synthetic oligonucleotide
tataatttatgtttcaagtgctggaaataatggtccatgcctgtc

SEQ ID NO: 114999 - DNA, 44 bp, Artificial Sequence
  Description of Artificial Sequence: Synthetic oligonucleotide
ataatttatgtttcaagtgctggaaataatggtccatgcctgtc

SEQ ID NO: 115000 - DNA, 43 bp, Artificial Sequence
  Description of Artificial Sequence: Synthetic oligonucleotide
taatttatgtttcaagtgctggaaataatggtccatgcctgtc

SEQ ID NO: 115001 - DNA, 42 bp, Artificial Sequence
  Description of Artificial Sequence: Synthetic oligonucleotide
aatttatgtttcaagtgctggaaataatggtccatgcctgtc

SEQ ID NO: 115002 - DNA, 41 bp, Artificial Sequence
  Description of Artificial Sequence: Synthetic oligonucleotide
atttatgtttcaagtgctggaaataatggtccatgcctgtc

SEQ ID NO: 115003 - DNA, 40 bp, Artificial Sequence
  Description of Artificial Sequence: Synthetic oligonucleotide
tttatgtttcaagtgctggaaataatggtccatgcctgtc

SEQ ID NO: 115004 - DNA, 39 bp, Artificial Sequence
  Description of Artificial Sequence: Synthetic oligonucleotide
ttatgtttcaagtgctggaaataatggtccatgcctgtc

SEQ ID NO: 115005 - DNA, 38 bp, Artificial Sequence
  Description of Artificial Sequence: Synthetic oligonucleotide
tatgtttcaagtgctggaaataatggtccatgcctgtc

SEQ ID NO: 115006 - DNA, 37 bp, Artificial Sequence
  Description of Artificial Sequence: Synthetic oligonucleotide
atgtttcaagtgctggaaataatggtccatgcctgtc

SEQ ID NO: 115007 - DNA, 36 bp, Artificial Sequence
  Description of Artificial Sequence: Synthetic oligonucleotide
tgtttcaagtgctggaaataatggtccatgcctgtc

SEQ ID NO: 115008 - DNA, 35 bp, Artificial Sequence
  Description of Artificial Sequence: Synthetic oligonucleotide
gtttcaagtgctggaaataatggtccatgcctgtc

SEQ ID NO: 115009 - DNA, 37 bp, Artificial Sequence
  Description of Artificial Sequence: Synthetic oligonucleotide
tttcaagtgctggaaataatggtccatgcctgtctac

SEQ ID NO: 115010 - DNA, 36 bp, Artificial Sequence
  Description of Artificial Sequence: Synthetic oligonucleotide
ttcaagtgctggaaataatggtccatgcctgtctac

SEQ ID NO: 115011 - DNA, 35 bp, Artificial Sequence
  Description of Artificial Sequence: Synthetic oligonucleotide
tcaagtgctggaaataatggtccatgcctgtctac

SEQ ID NO: 115012 - DNA, 34 bp, Artificial Sequence
  Description of Artificial Sequence: Synthetic oligonucleotide
caagtgctggaaataatggtccatgcctgtctac

SEQ ID NO: 115013 - DNA, 35 bp, Artificial Sequence
  Description of Artificial Sequence: Synthetic oligonucleotide
aagtgctggaaataatggtccatgcctgtctacag

SEQ ID NO: 115014 - DNA, 34 bp, Artificial Sequence
  Description of Artificial Sequence: Synthetic oligonucleotide
agtgctggaaataatggtccatgcctgtctacag

SEQ ID NO: 115015 - DNA, 33 bp, Artificial Sequence
  Description of Artificial Sequence: Synthetic oligonucleotide
gtgctggaaataatggtccatgcctgtctacag

SEQ ID NO: 115016 - DNA, 35 bp, Artificial Sequence
  Description of Artificial Sequence: Synthetic oligonucleotide
tgctggaaataatggtccatgcctgtctacagttg

SEQ ID NO: 115017 - DNA, 34 bp, Artificial Sequence
  Description of Artificial Sequence: Synthetic oligonucleotide
gctggaaataatggtccatgcctgtctacagttg

SEQ ID NO: 115018 - DNA, 34 bp, Artificial Sequence
  Description of Artificial Sequence: Synthetic oligonucleotide
ctggaaataatggtccatgcctgtctacagttgg

SEQ ID NO: 115019 - DNA, 36 bp, Artificial Sequence
  Description of Artificial Sequence: Synthetic oligonucleotide
tggaaataatggtccatgcctgtctacagttggttg

SEQ ID NO: 115020 - DNA, 35 bp, Artificial Sequence
  Description of Artificial Sequence: Synthetic oligonucleotide
ggaaataatggtccatgcctgtctacagttggttg

SEQ ID NO: 115021 - DNA, 36 bp, Artificial Sequence
  Description of Artificial Sequence: Synthetic oligonucleotide
gaaataatggtccatgcctgtctacagttggttgtc

SEQ ID NO: 115022 - DNA, 36 bp, Artificial Sequence
  Description of Artificial Sequence: Synthetic oligonucleotide
aaataatggtccatgcctgtctacagttggttgtcc

SEQ ID NO: 115023 - DNA, 35 bp, Artificial Sequence
  Description of Artificial Sequence: Synthetic oligonucleotide
aataatggtccatgcctgtctacagttggttgtcc

SEQ ID NO: 115024 - DNA, 34 bp, Artificial Sequence
  Description of Artificial Sequence: Synthetic oligonucleotide
ataatggtccatgcctgtctacagttggttgtcc

SEQ ID NO: 115025 - DNA, 33 bp, Artificial Sequence
  Description of Artificial Sequence: Synthetic oligonucleotide
taatggtccatgcctgtctacagttggttgtcc

SEQ ID NO: 115026 - DNA, 32 bp, Artificial Sequence
  Description of Artificial Sequence: Synthetic oligonucleotide
aatggtccatgcctgtctacagttggttgtcc

SEQ ID NO: 115027 - DNA, 31 bp, Artificial Sequence
  Description of Artificial Sequence: Synthetic oligonucleotide
atggtccatgcctgtctacagttggttgtcc

SEQ ID NO: 115028 - DNA, 30 bp, Artificial Sequence
  Description of Artificial Sequence: Synthetic oligonucleotide
tggtccatgcctgtctacagttggttgtcc

SEQ ID NO: 115029 - DNA, 29 bp, Artificial Sequence
  Description of Artificial Sequence: Synthetic oligonucleotide
ggtccatgcctgtctacagttggttgtcc

SEQ ID NO: 115030 - DNA, 30 bp, Artificial Sequence
  Description of Artificial Sequence: Synthetic oligonucleotide
gtccatgcctgtctacagttggttgtccag

SEQ ID NO: 115031 - DNA, 30 bp, Artificial Sequence
  Description of Artificial Sequence: Synthetic oligonucleotide
tccatgcctgtctacagttggttgtccagg

SEQ ID NO: 115032 - DNA, 29 bp, Artificial Sequence
  Description of Artificial Sequence: Synthetic oligonucleotide
ccatgcctgtctacagttggttgtccagg

SEQ ID NO: 115033 - DNA, 30 bp, Artificial Sequence
  Description of Artificial Sequence: Synthetic oligonucleotide
catgcctgtctacagttggttgtccaggtg

SEQ ID NO: 115034 - DNA, 30 bp, Artificial Sequence
  Description of Artificial Sequence: Synthetic oligonucleotide
atgcctgtctacagttggttgtccaggtgg

SEQ ID NO: 115035 - DNA, 29 bp, Artificial Sequence
  Description of Artificial Sequence: Synthetic oligonucleotide
tgcctgtctacagttggttgtccaggtgg

SEQ ID NO: 115036 - DNA, 28 bp, Artificial Sequence
  Description of Artificial Sequence: Synthetic oligonucleotide
gcctgtctacagttggttgtccaggtgg

SEQ ID NO: 115037 - DNA, 30 bp, Artificial Sequence
  Description of Artificial Sequence: Synthetic oligonucleotide
cctgtctacagttggttgtccaggtggaac

SEQ ID NO: 115038 - DNA, 32 bp, Artificial Sequence
  Description of Artificial Sequence: Synthetic oligonucleotide
ctgtctacagttggttgtccaggtggaactac

SEQ ID NO: 115039 - DNA, 34 bp, Artificial Sequence
  Description of Artificial Sequence: Synthetic oligonucleotide
tgtctacagttggttgtccaggtggaactacatc

SEQ ID NO: 115040 - DNA, 33 bp, Artificial Sequence
  Description of Artificial Sequence: Synthetic oligonucleotide
gtctacagttggttgtccaggtggaactacatc

SEQ ID NO: 115041 - DNA, 35 bp, Artificial Sequence
  Description of Artificial Sequence: Synthetic oligonucleotide
tctacagttggttgtccaggtggaactacatcaag

SEQ ID NO: 115042 - DNA, 34 bp, Artificial Sequence
  Description of Artificial Sequence: Synthetic oligonucleotide
ctacagttggttgtccaggtggaactacatcaag

SEQ ID NO: 115043 - DNA, 35 bp, Artificial Sequence
  Description of Artificial Sequence: Synthetic oligonucleotide
tacagttggttgtccaggtggaactacatcaagtg

SEQ ID NO: 115044 - DNA, 34 bp, Artificial Sequence
  Description of Artificial Sequence: Synthetic oligonucleotide
acagttggttgtccaggtggaactacatcaagtg

SEQ ID NO: 115045 - DNA, 33 bp, Artificial Sequence
  Description of Artificial Sequence: Synthetic oligonucleotide
cagttggttgtccaggtggaactacatcaagtg

SEQ ID NO: 115046 - DNA, 34 bp, Artificial Sequence
  Description of Artificial Sequence: Synthetic oligonucleotide
agttggttgtccaggtggaactacatcaagtgtg

SEQ ID NO: 115047 - DNA, 33 bp, Artificial Sequence
  Description of Artificial Sequence: Synthetic oligonucleotide
gttggttgtccaggtggaactacatcaagtgtg

SEQ ID NO: 115048 - DNA, 36 bp, Artificial Sequence
  Description of Artificial Sequence: Synthetic oligonucleotide
ttggttgtccaggtggaactacatcaagtgtgatag

SEQ ID NO: 115049 - DNA, 35 bp, Artificial Sequence
  Description of Artificial Sequence: Synthetic oligonucleotide
tggttgtccaggtggaactacatcaagtgtgatag

SEQ ID NO: 115050 - DNA, 34 bp, Artificial Sequence
  Description of Artificial Sequence: Synthetic oligonucleotide
ggttgtccaggtggaactacatcaagtgtgatag

SEQ ID NO: 115051 - DNA, 34 bp, Artificial Sequence
  Description of Artificial Sequence: Synthetic oligonucleotide
gttgtccaggtggaactacatcaagtgtgatagg

SEQ ID NO: 115052 - DNA, 35 bp, Artificial Sequence
  Description of Artificial Sequence: Synthetic oligonucleotide
ttgtccaggtggaactacatcaagtgtgataggtg

SEQ ID NO: 115053 - DNA, 34 bp, Artificial Sequence
  Description of Artificial Sequence: Synthetic oligonucleotide
tgtccaggtggaactacatcaagtgtgataggtg

SEQ ID NO: 115054 - DNA, 33 bp, Artificial Sequence
  Description of Artificial Sequence: Synthetic oligonucleotide
gtccaggtggaactacatcaagtgtgataggtg

SEQ ID NO: 115055 - DNA, 35 bp, Artificial Sequence
  Description of Artificial Sequence: Synthetic oligonucleotide
tccaggtggaactacatcaagtgtgataggtgttg

SEQ ID NO: 115056 - DNA, 34 bp, Artificial Sequence
  Description of Artificial Sequence: Synthetic oligonucleotide
ccaggtggaactacatcaagtgtgataggtgttg

SEQ ID NO: 115057 - DNA, 34 bp, Artificial Sequence
  Description of Artificial Sequence: Synthetic oligonucleotide
caggtggaactacatcaagtgtgataggtgttgg

SEQ ID NO: 115058 - DNA, 35 bp, Artificial Sequence
  Description of Artificial Sequence: Synthetic oligonucleotide
aggtggaactacatcaagtgtgataggtgttggtg

SEQ ID NO: 115059 - DNA, 34 bp, Artificial Sequence
  Description of Artificial Sequence: Synthetic oligonucleotide
ggtggaactacatcaagtgtgataggtgttggtg

SEQ ID NO: 115060 - DNA, 34 bp, Artificial Sequence
  Description of Artificial Sequence: Synthetic oligonucleotide
gtggaactacatcaagtgtgataggtgttggtgc

SEQ ID NO: 115061 - DNA, 38 bp, Artificial Sequence
  Description of Artificial Sequence: Synthetic oligonucleotide
tggaactacatcaagtgtgataggtgttggtgcttatg

SEQ ID NO: 115062 - DNA, 37 bp, Artificial Sequence
  Description of Artificial Sequence: Synthetic oligonucleotide
ggaactacatcaagtgtgataggtgttggtgcttatg

SEQ ID NO: 115063 - DNA, 40 bp, Artificial Sequence
  Description of Artificial Sequence: Synthetic oligonucleotide
gaactacatcaagtgtgataggtgttggtgcttatgtttc

SEQ ID NO: 115064 - DNA, 41 bp, Artificial Sequence
  Description of Artificial Sequence: Synthetic oligonucleotide
aactacatcaagtgtgataggtgttggtgcttatgtttctc

SEQ ID NO: 115065 - DNA, 40 bp, Artificial Sequence
  Description of Artificial Sequence: Synthetic oligonucleotide
actacatcaagtgtgataggtgttggtgcttatgtttctc

SEQ ID NO: 115066 - DNA, 39 bp, Artificial Sequence
  Description of Artificial Sequence: Synthetic oligonucleotide
ctacatcaagtgtgataggtgttggtgcttatgtttctc

SEQ ID NO: 115067 - DNA, 39 bp, Artificial Sequence
  Description of Artificial Sequence: Synthetic oligonucleotide
tacatcaagtgtgataggtgttggtgcttatgtttctcc

SEQ ID NO: 115068 - DNA, 38 bp, Artificial Sequence
  Description of Artificial Sequence: Synthetic oligonucleotide
acatcaagtgtgataggtgttggtgcttatgtttctcc

SEQ ID NO: 115069 - DNA, 37 bp, Artificial Sequence
  Description of Artificial Sequence: Synthetic oligonucleotide
catcaagtgtgataggtgttggtgcttatgtttctcc

SEQ ID NO: 115070 - DNA, 38 bp, Artificial Sequence
  Description of Artificial Sequence: Synthetic oligonucleotide
atcaagtgtgataggtgttggtgcttatgtttctcctg

SEQ ID NO: 115071 - DNA, 37 bp, Artificial Sequence
  Description of Artificial Sequence: Synthetic oligonucleotide
tcaagtgtgataggtgttggtgcttatgtttctcctg

SEQ ID NO: 115072 - DNA, 36 bp, Artificial Sequence
  Description of Artificial Sequence: Synthetic oligonucleotide
caagtgtgataggtgttggtgcttatgtttctcctg

SEQ ID NO: 115073 - DNA, 40 bp, Artificial Sequence
  Description of Artificial Sequence: Synthetic oligonucleotide
aagtgtgataggtgttggtgcttatgtttctcctgatatg

SEQ ID NO: 115074 - DNA, 39 bp, Artificial Sequence
  Description of Artificial Sequence: Synthetic oligonucleotide
agtgtgataggtgttggtgcttatgtttctcctgatatg

SEQ ID NO: 115075 - DNA, 38 bp, Artificial Sequence
  Description of Artificial Sequence: Synthetic oligonucleotide
gtgtgataggtgttggtgcttatgtttctcctgatatg

SEQ ID NO: 115076 - DNA, 40 bp, Artificial Sequence
  Description of Artificial Sequence: Synthetic oligonucleotide
tgtgataggtgttggtgcttatgtttctcctgatatgatg

SEQ ID NO: 115077 - DNA, 39 bp, Artificial Sequence
  Description of Artificial Sequence: Synthetic oligonucleotide
gtgataggtgttggtgcttatgtttctcctgatatgatg

SEQ ID NO: 115078 - DNA, 39 bp, Artificial Sequence
  Description of Artificial Sequence: Synthetic oligonucleotide
tgataggtgttggtgcttatgtttctcctgatatgatgg

SEQ ID NO: 115079 - DNA, 38 bp, Artificial Sequence
  Description of Artificial Sequence: Synthetic oligonucleotide
gataggtgttggtgcttatgtttctcctgatatgatgg

SEQ ID NO: 115080 - DNA, 40 bp, Artificial Sequence
  Description of Artificial Sequence: Synthetic oligonucleotide
ataggtgttggtgcttatgtttctcctgatatgatggttg

SEQ ID NO: 115081 - DNA, 39 bp, Artificial Sequence
  Description of Artificial Sequence: Synthetic oligonucleotide
taggtgttggtgcttatgtttctcctgatatgatggttg

SEQ ID NO: 115082 - DNA, 38 bp, Artificial Sequence
  Description of Artificial Sequence: Synthetic oligonucleotide
aggtgttggtgcttatgtttctcctgatatgatggttg

SEQ ID NO: 115083 - DNA, 37 bp, Artificial Sequence
  Description of Artificial Sequence: Synthetic oligonucleotide
ggtgttggtgcttatgtttctcctgatatgatggttg

SEQ ID NO: 115084 - DNA, 37 bp, Artificial Sequence
  Description of Artificial Sequence: Synthetic oligonucleotide
gtgttggtgcttatgtttctcctgatatgatggttgc

SEQ ID NO: 115085 - DNA, 38 bp, Artificial Sequence
  Description of Artificial Sequence: Synthetic oligonucleotide
tgttggtgcttatgtttctcctgatatgatggttgctg

SEQ ID NO: 115086 - DNA, 37 bp, Artificial Sequence
  Description of Artificial Sequence: Synthetic oligonucleotide
gttggtgcttatgtttctcctgatatgatggttgctg

SEQ ID NO: 115087 - DNA, 38 bp, Artificial Sequence
  Description of Artificial Sequence: Synthetic oligonucleotide
ttggtgcttatgtttctcctgatatgatggttgctgag

SEQ ID NO: 115088 - DNA, 37 bp, Artificial Sequence
  Description of Artificial Sequence: Synthetic oligonucleotide
tggtgcttatgtttctcctgatatgatggttgctgag

SEQ ID NO: 115089 - DNA, 36 bp, Artificial Sequence
  Description of Artificial Sequence: Synthetic oligonucleotide
ggtgcttatgtttctcctgatatgatggttgctgag

SEQ ID NO: 115090 - DNA, 40 bp, Artificial Sequence
  Description of Artificial Sequence: Synthetic oligonucleotide
gtgcttatgtttctcctgatatgatggttgctgagtattc

SEQ ID NO: 115091 - DNA, 41 bp, Artificial Sequence
  Description of Artificial Sequence: Synthetic oligonucleotide
tgcttatgtttctcctgatatgatggttgctgagtattcac

SEQ ID NO: 115092 - DNA, 40 bp, Artificial Sequence
  Description of Artificial Sequence: Synthetic oligonucleotide
gcttatgtttctcctgatatgatggttgctgagtattcac

SEQ ID NO: 115093 - DNA, 41 bp, Artificial Sequence
  Description of Artificial Sequence: Synthetic oligonucleotide
cttatgtttctcctgatatgatggttgctgagtattcactg

SEQ ID NO: 115094 - DNA, 42 bp, Artificial Sequence
  Description of Artificial Sequence: Synthetic oligonucleotide
ttatgtttctcctgatatgatggttgctgagtattcactgag

SEQ ID NO: 115095 - DNA, 41 bp, Artificial Sequence
  Description of Artificial Sequence: Synthetic oligonucleotide
tatgtttctcctgatatgatggttgctgagtattcactgag

SEQ ID NO: 115096 - DNA, 40 bp, Artificial Sequence
  Description of Artificial Sequence: Synthetic oligonucleotide
atgtttctcctgatatgatggttgctgagtattcactgag

SEQ ID NO: 115097 - DNA, 39 bp, Artificial Sequence
  Description of Artificial Sequence: Synthetic oligonucleotide
tgtttctcctgatatgatggttgctgagtattcactgag

SEQ ID NO: 115098 - DNA, 38 bp, Artificial Sequence
  Description of Artificial Sequence: Synthetic oligonucleotide
gtttctcctgatatgatggttgctgagtattcactgag

SEQ ID NO: 115099 - DNA, 39 bp, Artificial Sequence
  Description of Artificial Sequence: Synthetic oligonucleotide
tttctcctgatatgatggttgctgagtattcactgagag

SEQ ID NO: 115100 - DNA, 38 bp, Artificial Sequence
  Description of Artificial Sequence: Synthetic oligonucleotide
ttctcctgatatgatggttgctgagtattcactgagag

SEQ ID NO: 115101 - DNA, 37 bp, Artificial Sequence
  Description of Artificial Sequence: Synthetic oligonucleotide
tctcctgatatgatggttgctgagtattcactgagag

SEQ ID NO: 115102 - DNA, 36 bp, Artificial Sequence
  Description of Artificial Sequence: Synthetic oligonucleotide
ctcctgatatgatggttgctgagtattcactgagag

SEQ ID NO: 115103 - DNA, 37 bp, Artificial Sequence
  Description of Artificial Sequence: Synthetic oligonucleotide
tcctgatatgatggttgctgagtattcactgagagag

SEQ ID NO: 115104 - DNA, 36 bp, Artificial Sequence
  Description of Artificial Sequence: Synthetic oligonucleotide
cctgatatgatggttgctgagtattcactgagagag

SEQ ID NO: 115105 - DNA, 42 bp, Artificial Sequence
  Description of Artificial Sequence: Synthetic oligonucleotide
ctgatatgatggttgctgagtattcactgagagagaaattac

SEQ ID NO: 115106 - DNA, 42 bp, Artificial Sequence
  Description of Artificial Sequence: Synthetic oligonucleotide
tgatatgatggttgctgagtattcactgagagagaaattacc

SEQ ID NO: 115107 - DNA, 41 bp, Artificial Sequence
  Description of Artificial Sequence: Synthetic oligonucleotide
gatatgatggttgctgagtattcactgagagagaaattacc

SEQ ID NO: 115108 - DNA, 42 bp, Artificial Sequence
  Description of Artificial Sequence: Synthetic oligonucleotide
atatgatggttgctgagtattcactgagagagaaattacctg

SEQ ID NO: 115109 - DNA, 41 bp, Artificial Sequence
  Description of Artificial Sequence: Synthetic oligonucleotide
tatgatggttgctgagtattcactgagagagaaattacctg

SEQ ID NO: 115110 - DNA, 40 bp, Artificial Sequence
  Description of Artificial Sequence: Synthetic oligonucleotide
atgatggttgctgagtattcactgagagagaaattacctg

SEQ ID NO: 115111 - DNA, 39 bp, Artificial Sequence
  Description of Artificial Sequence: Synthetic oligonucleotide
tgatggttgctgagtattcactgagagagaaattacctg

SEQ ID NO: 115112 - DNA, 38 bp, Artificial Sequence
  Description of Artificial Sequence: Synthetic oligonucleotide
gatggttgctgagtattcactgagagagaaattacctg

SEQ ID NO: 115113 - DNA, 38 bp, Artificial Sequence
  Description of Artificial Sequence: Synthetic oligonucleotide
atggttgctgagtattcactgagagagaaattacctgc

SEQ ID NO: 115114 - DNA, 37 bp, Artificial Sequence
  Description of Artificial Sequence: Synthetic oligonucleotide
tggttgctgagtattcactgagagagaaattacctgc

SEQ ID NO: 115115 - DNA, 36 bp, Artificial Sequence
  Description of Artificial Sequence: Synthetic oligonucleotide
ggttgctgagtattcactgagagagaaattacctgc

SEQ ID NO: 115116 - DNA, 40 bp, Artificial Sequence
  Description of Artificial Sequence: Synthetic oligonucleotide
gttgctgagtattcactgagagagaaattacctgcaaatc

SEQ ID NO: 115117 - DNA, 46 bp, Artificial Sequence
  Description of Artificial Sequence: Synthetic oligonucleotide
ttgctgagtattcactgagagagaaattacctgcaaatcaatatac

SEQ ID NO: 115118 - DNA, 45 bp, Artificial Sequence
  Description of Artificial Sequence: Synthetic oligonucleotide
tgctgagtattcactgagagagaaattacctgcaaatcaatatac

SEQ ID NO: 115119 - DNA, 44 bp, Artificial Sequence
  Description of Artificial Sequence: Synthetic oligonucleotide
gctgagtattcactgagagagaaattacctgcaaatcaatatac

SEQ ID NO: 115120 - DNA, 46 bp, Artificial Sequence
  Description of Artificial Sequence: Synthetic oligonucleotide
ctgagtattcactgagagagaaattacctgcaaatcaatatacttg

SEQ ID NO: 115121 - DNA, 46 bp, Artificial Sequence
  Description of Artificial Sequence: Synthetic oligonucleotide
tgagtattcactgagagagaaattacctgcaaatcaatatacttgg

SEQ ID NO: 115122 - DNA, 45 bp, Artificial Sequence
  Description of Artificial Sequence: Synthetic oligonucleotide
gagtattcactgagagagaaattacctgcaaatcaatatacttgg

SEQ ID NO: 115123 - DNA, 46 bp, Artificial Sequence
  Description of Artificial Sequence: Synthetic oligonucleotide
agtattcactgagagagaaattacctgcaaatcaatatacttggtc

SEQ ID NO: 115124 - DNA, 45 bp, Artificial Sequence
  Description of Artificial Sequence: Synthetic oligonucleotide
gtattcactgagagagaaattacctgcaaatcaatatacttggtc

SEQ ID NO: 115125 - DNA, 47 bp, Artificial Sequence
  Description of Artificial Sequence: Synthetic oligonucleotide
tattcactgagagagaaattacctgcaaatcaatatacttggtcttc

SEQ ID NO: 115126 - DNA, 46 bp, Artificial Sequence
  Description of Artificial Sequence: Synthetic oligonucleotide
attcactgagagagaaattacctgcaaatcaatatacttggtcttc

SEQ ID NO: 115127 - DNA, 45 bp, Artificial Sequence
  Description of Artificial Sequence: Synthetic oligonucleotide
ttcactgagagagaaattacctgcaaatcaatatacttggtcttc

SEQ ID NO: 115128 - DNA, 44 bp, Artificial Sequence
  Description of Artificial Sequence: Synthetic oligonucleotide
tcactgagagagaaattacctgcaaatcaatatacttggtcttc

SEQ ID NO: 115129 - DNA, 43 bp, Artificial Sequence
  Description of Artificial Sequence: Synthetic oligonucleotide
cactgagagagaaattacctgcaaatcaatatacttggtcttc

SEQ ID NO: 115130 - DNA, 45 bp, Artificial Sequence
  Description of Artificial Sequence: Synthetic oligonucleotide
actgagagagaaattacctgcaaatcaatatacttggtcttctag

SEQ ID NO: 115131 - DNA, 44 bp, Artificial Sequence
  Description of Artificial Sequence: Synthetic oligonucleotide
ctgagagagaaattacctgcaaatcaatatacttggtcttctag

SEQ ID NO: 115132 - DNA, 45 bp, Artificial Sequence
  Description of Artificial Sequence: Synthetic oligonucleotide
tgagagagaaattacctgcaaatcaatatacttggtcttctagag

SEQ ID NO: 115133 - DNA, 44 bp, Artificial Sequence
  Description of Artificial Sequence: Synthetic oligonucleotide
gagagagaaattacctgcaaatcaatatacttggtcttctagag

SEQ ID NO: 115134 - DNA, 44 bp, Artificial Sequence
  Description of Artificial Sequence: Synthetic oligonucleotide
agagagaaattacctgcaaatcaatatacttggtcttctagagg

SEQ ID NO: 115135 - DNA, 43 bp, Artificial Sequence
  Description of Artificial Sequence: Synthetic oligonucleotide
gagagaaattacctgcaaatcaatatacttggtcttctagagg

SEQ ID NO: 115136 - DNA, 44 bp, Artificial Sequence
  Description of Artificial Sequence: Synthetic oligonucleotide
agagaaattacctgcaaatcaatatacttggtcttctagaggac

SEQ ID NO: 115137 - DNA, 43 bp, Artificial Sequence
  Description of Artificial Sequence: Synthetic oligonucleotide
gagaaattacctgcaaatcaatatacttggtcttctagaggac

SEQ ID NO: 115138 - DNA, 43 bp, Artificial Sequence
  Description of Artificial Sequence: Synthetic oligonucleotide
agaaattacctgcaaatcaatatacttggtcttctagaggacc

SEQ ID NO: 115139 - DNA, 42 bp, Artificial Sequence
  Description of Artificial Sequence: Synthetic oligonucleotide
gaaattacctgcaaatcaatatacttggtcttctagaggacc

SEQ ID NO: 115140 - DNA, 44 bp, Artificial Sequence
  Description of Artificial Sequence: Synthetic oligonucleotide
aaattacctgcaaatcaatatacttggtcttctagaggacctag

SEQ ID NO: 115141 - DNA, 43 bp, Artificial Sequence
  Description of Artificial Sequence: Synthetic oligonucleotide
aattacctgcaaatcaatatacttggtcttctagaggacctag

SEQ ID NO: 115142 - DNA, 42 bp, Artificial Sequence
  Description of Artificial Sequence: Synthetic oligonucleotide
attacctgcaaatcaatatacttggtcttctagaggacctag

SEQ ID NO: 115143 - DNA, 41 bp, Artificial Sequence
  Description of Artificial Sequence: Synthetic oligonucleotide
ttacctgcaaatcaatatacttggtcttctagaggacctag

SEQ ID NO: 115144 - DNA, 40 bp, Artificial Sequence
  Description of Artificial Sequence: Synthetic oligonucleotide
tacctgcaaatcaatatacttggtcttctagaggacctag

SEQ ID NO: 115145 - DNA, 39 bp, Artificial Sequence
  Description of Artificial Sequence: Synthetic oligonucleotide
acctgcaaatcaatatacttggtcttctagaggacctag

SEQ ID NO: 115146 - DNA, 38 bp, Artificial Sequence
  Description of Artificial Sequence: Synthetic oligonucleotide
cctgcaaatcaatatacttggtcttctagaggacctag

SEQ ID NO: 115147 - DNA, 39 bp, Artificial Sequence
  Description of Artificial Sequence: Synthetic oligonucleotide
ctgcaaatcaatatacttggtcttctagaggacctagtg

SEQ ID NO: 115148 - DNA, 39 bp, Artificial Sequence
  Description of Artificial Sequence: Synthetic oligonucleotide
tgcaaatcaatatacttggtcttctagaggacctagtgc

SEQ ID NO: 115149 - DNA, 38 bp, Artificial Sequence
  Description of Artificial Sequence: Synthetic oligonucleotide
gcaaatcaatatacttggtcttctagaggacctagtgc

SEQ ID NO: 115150 - DNA, 39 bp, Artificial Sequence
  Description of Artificial Sequence: Synthetic oligonucleotide
caaatcaatatacttggtcttctagaggacctagtgctg

SEQ ID NO: 115151 - DNA, 40 bp, Artificial Sequence
  Description of Artificial Sequence: Synthetic oligonucleotide
aaatcaatatacttggtcttctagaggacctagtgctgac

SEQ ID NO: 115152 - DNA, 39 bp, Artificial Sequence
  Description of Artificial Sequence: Synthetic oligonucleotide
aatcaatatacttggtcttctagaggacctagtgctgac

SEQ ID NO: 115153 - DNA, 38 bp, Artificial Sequence
  Description of Artificial Sequence: Synthetic oligonucleotide
atcaatatacttggtcttctagaggacctagtgctgac

SEQ ID NO: 115154 - DNA, 37 bp, Artificial Sequence
  Description of Artificial Sequence: Synthetic oligonucleotide
tcaatatacttggtcttctagaggacctagtgctgac

SEQ ID NO: 115155 - DNA, 36 bp, Artificial Sequence
  Description of Artificial Sequence: Synthetic oligonucleotide
caatatacttggtcttctagaggacctagtgctgac

SEQ ID NO: 115156 - DNA, 36 bp, Artificial Sequence
  Description of Artificial Sequence: Synthetic oligonucleotide
aatatacttggtcttctagaggacctagtgctgacg

SEQ ID NO: 115157 - DNA, 35 bp, Artificial Sequence
  Description of Artificial Sequence: Synthetic oligonucleotide
atatacttggtcttctagaggacctagtgctgacg

SEQ ID NO: 115158 - DNA, 34 bp, Artificial Sequence
  Description of Artificial Sequence: Synthetic oligonucleotide
tatacttggtcttctagaggacctagtgctgacg

SEQ ID NO: 115159 - DNA, 33 bp, Artificial Sequence
  Description of Artificial Sequence: Synthetic oligonucleotide
atacttggtcttctagaggacctagtgctgacg

SEQ ID NO: 115160 - DNA, 32 bp, Artificial Sequence
  Description of Artificial Sequence: Synthetic oligonucleotide
tacttggtcttctagaggacctagtgctgacg

SEQ ID NO: 115161 - DNA, 31 bp, Artificial Sequence
  Description of Artificial Sequence: Synthetic oligonucleotide
acttggtcttctagaggacctagtgctgacg

SEQ ID NO: 115162 - DNA, 30 bp, Artificial Sequence
  Description of Artificial Sequence: Synthetic oligonucleotide
cttggtcttctagaggacctagtgctgacg

SEQ ID NO: 115163 - DNA, 30 bp, Artificial Sequence
  Description of Artificial Sequence: Synthetic oligonucleotide
ttggtcttctagaggacctagtgctgacgg

SEQ ID NO: 115164 - DNA, 29 bp, Artificial Sequence
  Description of Artificial Sequence: Synthetic oligonucleotide
tggtcttctagaggacctagtgctgacgg

SEQ ID NO: 115165 - DNA, 28 bp, Artificial Sequence
  Description of Artificial Sequence: Synthetic oligonucleotide
ggtcttctagaggacctagtgctgacgg

SEQ ID NO: 115166 - DNA, 28 bp, Artificial Sequence
  Description of Artificial Sequence: Synthetic oligonucleotide
gtcttctagaggacctagtgctgacggg

SEQ ID NO: 115167 - DNA, 28 bp, Artificial Sequence
  Description of Artificial Sequence: Synthetic oligonucleotide
tcttctagaggacctagtgctgacgggg

SEQ ID NO: 115168 - DNA, 27 bp, Artificial Sequence
  Description of Artificial Sequence: Synthetic oligonucleotide
cttctagaggacctagtgctgacgggg

SEQ ID NO: 115169 - DNA, 27 bp, Artificial Sequence
  Description of Artificial Sequence: Synthetic oligonucleotide
ttctagaggacctagtgctgacggggc

SEQ ID NO: 115170 - DNA, 26 bp, Artificial Sequence
  Description of Artificial Sequence: Synthetic oligonucleotide
tctagaggacctagtgctgacggggc

SEQ ID NO: 115171 - DNA, 25 bp, Artificial Sequence
  Description of Artificial Sequence: Synthetic oligonucleotide
ctagaggacctagtgctgacggggc

SEQ ID NO: 115172 - DNA, 25 bp, Artificial Sequence
  Description of Artificial Sequence: Synthetic oligonucleotide
tagaggacctagtgctgacggggcc

SEQ ID NO: 115173 - DNA, 24 bp, Artificial Sequence
  Description of Artificial Sequence: Synthetic oligonucleotide
agaggacctagtgctgacggggcc

SEQ ID NO: 115174 - DNA, 23 bp, Artificial Sequence
  Description of Artificial Sequence: Synthetic oligonucleotide
gaggacctagtgctgacggggcc

SEQ ID NO: 115175 - DNA, 25 bp, Artificial Sequence
  Description of Artificial Sequence: Synthetic oligonucleotide
aggacctagtgctgacggggccctt

SEQ ID NO: 115176 - DNA, 24 bp, Artificial Sequence
  Description of Artificial Sequence: Synthetic oligonucleotide
ggacctagtgctgacggggccctt

SEQ ID NO: 115177 - DNA, 24 bp, Artificial Sequence
  Description of Artificial Sequence: Synthetic oligonucleotide
gacctagtgctgacggggcccttg

SEQ ID NO: 115178 - DNA, 25 bp, Artificial Sequence
  Description of Artificial Sequence: Synthetic oligonucleotide
acctagtgctgacggggcccttggt

SEQ ID NO: 115179 - DNA, 24 bp, Artificial Sequence
  Description of Artificial Sequence: Synthetic oligonucleotide
cctagtgctgacggggcccttggt

SEQ ID NO: 115180 - DNA, 25 bp, Artificial Sequence
  Description of Artificial Sequence: Synthetic oligonucleotide
ctagtgctgacggggcccttggtgt

SEQ ID NO: 115181 - DNA, 26 bp, Artificial Sequence
  Description of Artificial Sequence: Synthetic oligonucleotide
tagtgctgacggggcccttggtgtga

SEQ ID NO: 115182 - DNA, 25 bp, Artificial Sequence
  Description of Artificial Sequence: Synthetic oligonucleotide
agtgctgacggggcccttggtgtga

SEQ ID NO: 115183 - DNA, 24 bp, Artificial Sequence
  Description of Artificial Sequence: Synthetic oligonucleotide
gtgctgacggggcccttggtgtga

SEQ ID NO: 115184 - DNA, 27 bp, Artificial Sequence
  Description of Artificial Sequence: Synthetic oligonucleotide
tgctgacggggcccttggtgtgagtat

SEQ ID NO: 115185 - DNA, 26 bp, Artificial Sequence
  Description of Artificial Sequence: Synthetic oligonucleotide
gctgacggggcccttggtgtgagtat

SEQ ID NO: 115186 - DNA, 27 bp, Artificial Sequence
  Description of Artificial Sequence: Synthetic oligonucleotide
ctgacggggcccttggtgtgagtatca

SEQ ID NO: 115187 - DNA, 27 bp, Artificial Sequence
  Description of Artificial Sequence: Synthetic oligonucleotide
tgacggggcccttggtgtgagtatcag

SEQ ID NO: 115188 - DNA, 27 bp, Artificial Sequence
  Description of Artificial Sequence: Synthetic oligonucleotide
gacggggcccttggtgtgagtatcagt

SEQ ID NO: 115189 - DNA, 27 bp, Artificial Sequence
  Description of Artificial Sequence: Synthetic oligonucleotide
acggggcccttggtgtgagtatcagtg

SEQ ID NO: 115190 - DNA, 26 bp, Artificial Sequence
  Description of Artificial Sequence: Synthetic oligonucleotide
cggggcccttggtgtgagtatcagtg

SEQ ID NO: 115191 - DNA, 26 bp, Artificial Sequence
  Description of Artificial Sequence: Synthetic oligonucleotide
ggggcccttggtgtgagtatcagtgc

SEQ ID NO: 115192 - DNA, 26 bp, Artificial Sequence
  Description of Artificial Sequence: Synthetic oligonucleotide
gggcccttggtgtgagtatcagtgcg

SEQ ID NO: 115193 - DNA, 26 bp, Artificial Sequence
  Description of Artificial Sequence: Synthetic oligonucleotide
ggcccttggtgtgagtatcagtgcgc

SEQ ID NO: 115194 - DNA, 27 bp, Artificial Sequence
  Description of Artificial Sequence: Synthetic oligonucleotide
gcccttggtgtgagtatcagtgcgcca

SEQ ID NO: 115195 - DNA, 27 bp, Artificial Sequence
  Description of Artificial Sequence: Synthetic oligonucleotide
cccttggtgtgagtatcagtgcgccag

SEQ ID NO: 115196 - DNA, 27 bp, Artificial Sequence
  Description of Artificial Sequence: Synthetic oligonucleotide
ccttggtgtgagtatcagtgcgccagg

SEQ ID NO: 115197 - DNA, 28 bp, Artificial Sequence
  Description of Artificial Sequence: Synthetic oligonucleotide
cttggtgtgagtatcagtgcgccaggag

SEQ ID NO: 115198 - DNA, 28 bp, Artificial Sequence
  Description of Artificial Sequence: Synthetic oligonucleotide
ttggtgtgagtatcagtgcgccaggagg

SEQ ID NO: 115199 - DNA, 27 bp, Artificial Sequence
  Description of Artificial Sequence: Synthetic oligonucleotide
tggtgtgagtatcagtgcgccaggagg

SEQ ID NO: 115200 - DNA, 27 bp, Artificial Sequence
  Description of Artificial Sequence: Synthetic oligonucleotide
ggtgtgagtatcagtgcgccaggagga

SEQ ID NO: 115201 - DNA, 27 bp, Artificial Sequence
  Description of Artificial Sequence: Synthetic oligonucleotide
gtgtgagtatcagtgcgccaggaggag

SEQ ID NO: 115202 - DNA, 27 bp, Artificial Sequence
  Description of Artificial Sequence: Synthetic oligonucleotide
tgtgagtatcagtgcgccaggaggagc

SEQ ID NO: 115203 - DNA, 26 bp, Artificial Sequence
  Description of Artificial Sequence: Synthetic oligonucleotide
gtgagtatcagtgcgccaggaggagc

SEQ ID NO: 115204 - DNA, 27 bp, Artificial Sequence
  Description of Artificial Sequence: Synthetic oligonucleotide
tgagtatcagtgcgccaggaggagcca

SEQ ID NO: 115205 - DNA, 27 bp, Artificial Sequence
  Description of Artificial Sequence: Synthetic oligonucleotide
gagtatcagtgcgccaggaggagccat

SEQ ID NO: 115206 - DNA, 28 bp, Artificial Sequence
  Description of Artificial Sequence: Synthetic oligonucleotide
agtatcagtgcgccaggaggagccattg

SEQ ID NO: 115207 - DNA, 27 bp, Artificial Sequence
  Description of Artificial Sequence: Synthetic oligonucleotide
gtatcagtgcgccaggaggagccattg

SEQ ID NO: 115208 - DNA, 27 bp, Artificial Sequence
  Description of Artificial Sequence: Synthetic oligonucleotide
tatcagtgcgccaggaggagccattgc

SEQ ID NO: 115209 - DNA, 27 bp, Artificial Sequence
  Description of Artificial Sequence: Synthetic oligonucleotide
atcagtgcgccaggaggagccattgct

SEQ ID NO: 115210 - DNA, 27 bp, Artificial Sequence
  Description of Artificial Sequence: Synthetic oligonucleotide
tcagtgcgccaggaggagccattgctt

SEQ ID NO: 115211 - DNA, 26 bp, Artificial Sequence
  Description of Artificial Sequence: Synthetic oligonucleotide
cagtgcgccaggaggagccattgctt

SEQ ID NO: 115212 - DNA, 27 bp, Artificial Sequence
  Description of Artificial Sequence: Synthetic oligonucleotide
agtgcgccaggaggagccattgcttct

SEQ ID NO: 115213 - DNA, 26 bp, Artificial Sequence
  Description of Artificial Sequence: Synthetic oligonucleotide
gtgcgccaggaggagccattgcttct

SEQ ID NO: 115214 - DNA, 27 bp, Artificial Sequence
  Description of Artificial Sequence: Synthetic oligonucleotide
tgcgccaggaggagccattgcttctgt

SEQ ID NO: 115215 - DNA, 27 bp, Artificial Sequence
  Description of Artificial Sequence: Synthetic oligonucleotide
gcgccaggaggagccattgcttctgtt

SEQ ID NO: 115216 - DNA, 27 bp, Artificial Sequence
  Description of Artificial Sequence: Synthetic oligonucleotide
cgccaggaggagccattgcttctgttc

SEQ ID NO: 115217 - DNA, 27 bp, Artificial Sequence
  Description of Artificial Sequence: Synthetic oligonucleotide
gccaggaggagccattgcttctgttcc

SEQ ID NO: 115218 - DNA, 30 bp, Artificial Sequence
  Description of Artificial Sequence: Synthetic oligonucleotide
ccaggaggagccattgcttctgttcctaac

SEQ ID NO: 115219 - DNA, 31 bp, Artificial Sequence
  Description of Artificial Sequence: Synthetic oligonucleotide
caggaggagccattgcttctgttcctaactg

SEQ ID NO: 115220 - DNA, 31 bp, Artificial Sequence
  Description of Artificial Sequence: Synthetic oligonucleotide
aggaggagccattgcttctgttcctaactgg

SEQ ID NO: 115221 - DNA, 30 bp, Artificial Sequence
  Description of Artificial Sequence: Synthetic oligonucleotide
ggaggagccattgcttctgttcctaactgg

SEQ ID NO: 115222 - DNA, 31 bp, Artificial Sequence
  Description of Artificial Sequence: Synthetic oligonucleotide
gaggagccattgcttctgttcctaactggac

SEQ ID NO: 115223 - DNA, 32 bp, Artificial Sequence
  Description of Artificial Sequence: Synthetic oligonucleotide
aggagccattgcttctgttcctaactggacac

SEQ ID NO: 115224 - DNA, 31 bp, Artificial Sequence
  Description of Artificial Sequence: Synthetic oligonucleotide
ggagccattgcttctgttcctaactggacac

SEQ ID NO: 115225 - DNA, 32 bp, Artificial Sequence
  Description of Artificial Sequence: Synthetic oligonucleotide
gagccattgcttctgttcctaactggacactg

SEQ ID NO: 115226 - DNA, 33 bp, Artificial Sequence
  Description of Artificial Sequence: Synthetic oligonucleotide
agccattgcttctgttcctaactggacactgag

SEQ ID NO: 115227 - DNA, 32 bp, Artificial Sequence
  Description of Artificial Sequence: Synthetic oligonucleotide
gccattgcttctgttcctaactggacactgag

SEQ ID NO: 115228 - DNA, 33 bp, Artificial Sequence
  Description of Artificial Sequence: Synthetic oligonucleotide
ccattgcttctgttcctaactggacactgagag

SEQ ID NO: 115229 - DNA, 33 bp, Artificial Sequence
  Description of Artificial Sequence: Synthetic oligonucleotide
cattgcttctgttcctaactggacactgagagg

SEQ ID NO: 115230 - DNA, 33 bp, Artificial Sequence
  Description of Artificial Sequence: Synthetic oligonucleotide
attgcttctgttcctaactggacactgagaggg

SEQ ID NO: 115231 - DNA, 32 bp, Artificial Sequence
  Description of Artificial Sequence: Synthetic oligonucleotide
ttgcttctgttcctaactggacactgagaggg

SEQ ID NO: 115232 - DNA, 31 bp, Artificial Sequence
  Description of Artificial Sequence: Synthetic oligonucleotide
tgcttctgttcctaactggacactgagaggg

SEQ ID NO: 115233 - DNA, 30 bp, Artificial Sequence
  Description of Artificial Sequence: Synthetic oligonucleotide
gcttctgttcctaactggacactgagaggg

SEQ ID NO: 115234 - DNA, 31 bp, Artificial Sequence
  Description of Artificial Sequence: Synthetic oligonucleotide
cttctgttcctaactggacactgagagggac

SEQ ID NO: 115235 - DNA, 31 bp, Artificial Sequence
  Description of Artificial Sequence: Synthetic oligonucleotide
ttctgttcctaactggacactgagagggacg

SEQ ID NO: 115236 - DNA, 30 bp, Artificial Sequence
  Description of Artificial Sequence: Synthetic oligonucleotide
tctgttcctaactggacactgagagggacg

SEQ ID NO: 115237 - DNA, 29 bp, Artificial Sequence
  Description of Artificial Sequence: Synthetic oligonucleotide
ctgttcctaactggacactgagagggacg

SEQ ID NO: 115238 - DNA, 29 bp, Artificial Sequence
  Description of Artificial Sequence: Synthetic oligonucleotide
tgttcctaactggacactgagagggacgc

SEQ ID NO: 115239 - DNA, 28 bp, Artificial Sequence
  Description of Artificial Sequence: Synthetic oligonucleotide
gttcctaactggacactgagagggacgc

SEQ ID NO: 115240 - DNA, 29 bp, Artificial Sequence
  Description of Artificial Sequence: Synthetic oligonucleotide
ttcctaactggacactgagagggacgcag

SEQ ID NO: 115241 - DNA, 28 bp, Artificial Sequence
  Description of Artificial Sequence: Synthetic oligonucleotide
tcctaactggacactgagagggacgcag

SEQ ID NO: 115242 - DNA, 27 bp, Artificial Sequence
  Description of Artificial Sequence: Synthetic oligonucleotide
cctaactggacactgagagggacgcag

SEQ ID NO: 115243 - DNA, 27 bp, Artificial Sequence
  Description of Artificial Sequence: Synthetic oligonucleotide
ctaactggacactgagagggacgcagc

SEQ ID NO: 115244 - DNA, 28 bp, Artificial Sequence
  Description of Artificial Sequence: Synthetic oligonucleotide
taactggacactgagagggacgcagctg

SEQ ID NO: 115245 - DNA, 27 bp, Artificial Sequence
  Description of Artificial Sequence: Synthetic oligonucleotide
aactggacactgagagggacgcagctg

SEQ ID NO: 115246 - DNA, 27 bp, Artificial Sequence
  Description of Artificial Sequence: Synthetic oligonucleotide
actggacactgagagggacgcagctga

SEQ ID NO: 115247 - DNA, 27 bp, Artificial Sequence
  Description of Artificial Sequence: Synthetic oligonucleotide
ctggacactgagagggacgcagctgat

SEQ ID NO: 115248 - DNA, 27 bp, Artificial Sequence
  Description of Artificial Sequence: Synthetic oligonucleotide
tggacactgagagggacgcagctgatg

SEQ ID NO: 115249 - DNA, 27 bp, Artificial Sequence
  Description of Artificial Sequence: Synthetic oligonucleotide
ggacactgagagggacgcagctgatga

SEQ ID NO: 115250 - DNA, 29 bp, Artificial Sequence
  Description of Artificial Sequence: Synthetic oligonucleotide
gacactgagagggacgcagctgatgaatg

SEQ ID NO: 115251 - DNA, 29 bp, Artificial Sequence
  Description of Artificial Sequence: Synthetic oligonucleotide
acactgagagggacgcagctgatgaatgg

SEQ ID NO: 115252 - DNA, 28 bp, Artificial Sequence
  Description of Artificial Sequence: Synthetic oligonucleotide
cactgagagggacgcagctgatgaatgg

SEQ ID NO: 115253 - DNA, 30 bp, Artificial Sequence
  Description of Artificial Sequence: Synthetic oligonucleotide
actgagagggacgcagctgatgaatggaac

SEQ ID NO: 115254 - DNA, 29 bp, Artificial Sequence
  Description of Artificial Sequence: Synthetic oligonucleotide
ctgagagggacgcagctgatgaatggaac

SEQ ID NO: 115255 - DNA, 31 bp, Artificial Sequence
  Description of Artificial Sequence: Synthetic oligonucleotide
tgagagggacgcagctgatgaatggaacatc

SEQ ID NO: 115256 - DNA, 30 bp, Artificial Sequence
  Description of Artificial Sequence: Synthetic oligonucleotide
gagagggacgcagctgatgaatggaacatc

SEQ ID NO: 115257 - DNA, 33 bp, Artificial Sequence
  Description of Artificial Sequence: Synthetic oligonucleotide
agagggacgcagctgatgaatggaacatctatg

SEQ ID NO: 115258 - DNA, 32 bp, Artificial Sequence
  Description of Artificial Sequence: Synthetic oligonucleotide
gagggacgcagctgatgaatggaacatctatg

SEQ ID NO: 115259 - DNA, 33 bp, Artificial Sequence
  Description of Artificial Sequence: Synthetic oligonucleotide
agggacgcagctgatgaatggaacatctatgtc

SEQ ID NO: 115260 - DNA, 32 bp, Artificial Sequence
  Description of Artificial Sequence: Synthetic oligonucleotide
gggacgcagctgatgaatggaacatctatgtc

SEQ ID NO: 115261 - DNA, 34 bp, Artificial Sequence
  Description of Artificial Sequence: Synthetic oligonucleotide
ggacgcagctgatgaatggaacatctatgtcttc

SEQ ID NO: 115262 - DNA, 34 bp, Artificial Sequence
  Description of Artificial Sequence: Synthetic oligonucleotide
gacgcagctgatgaatggaacatctatgtcttcc

SEQ ID NO: 115263 - DNA, 34 bp, Artificial Sequence
  Description of Artificial Sequence: Synthetic oligonucleotide
acgcagctgatgaatggaacatctatgtcttccc

SEQ ID NO: 115264 - DNA, 33 bp, Artificial Sequence
  Description of Artificial Sequence: Synthetic oligonucleotide
cgcagctgatgaatggaacatctatgtcttccc

SEQ ID NO: 115265 - DNA, 33 bp, Artificial Sequence
  Description of Artificial Sequence: Synthetic oligonucleotide
gcagctgatgaatggaacatctatgtcttcccc

SEQ ID NO: 115266 - DNA, 33 bp, Artificial Sequence
  Description of Artificial Sequence: Synthetic oligonucleotide
cagctgatgaatggaacatctatgtcttccccc

SEQ ID NO: 115267 - DNA, 36 bp, Artificial Sequence
  Description of Artificial Sequence: Synthetic oligonucleotide
agctgatgaatggaacatctatgtcttcccccaatg

SEQ ID NO: 115268 - DNA, 35 bp, Artificial Sequence
  Description of Artificial Sequence: Synthetic oligonucleotide
gctgatgaatggaacatctatgtcttcccccaatg

SEQ ID NO: 115269 - DNA, 35 bp, Artificial Sequence
  Description of Artificial Sequence: Synthetic oligonucleotide
ctgatgaatggaacatctatgtcttcccccaatgc

SEQ ID NO: 115270 - DNA, 37 bp, Artificial Sequence
  Description of Artificial Sequence: Synthetic oligonucleotide
tgatgaatggaacatctatgtcttcccccaatgcatg

SEQ ID NO: 115271 - DNA, 36 bp, Artificial Sequence
  Description of Artificial Sequence: Synthetic oligonucleotide
gatgaatggaacatctatgtcttcccccaatgcatg

SEQ ID NO: 115272 - DNA, 37 bp, Artificial Sequence
  Description of Artificial Sequence: Synthetic oligonucleotide
atgaatggaacatctatgtcttcccccaatgcatgtg

SEQ ID NO: 115273 - DNA, 36 bp, Artificial Sequence
  Description of Artificial Sequence: Synthetic oligonucleotide
tgaatggaacatctatgtcttcccccaatgcatgtg

SEQ ID NO: 115274 - DNA, 35 bp, Artificial Sequence
  Description of Artificial Sequence: Synthetic oligonucleotide
gaatggaacatctatgtcttcccccaatgcatgtg

SEQ ID NO: 115275 - DNA, 35 bp, Artificial Sequence
  Description of Artificial Sequence: Synthetic oligonucleotide
aatggaacatctatgtcttcccccaatgcatgtgg

SEQ ID NO: 115276 - DNA, 34 bp, Artificial Sequence
  Description of Artificial Sequence: Synthetic oligonucleotide
atggaacatctatgtcttcccccaatgcatgtgg

SEQ ID NO: 115277 - DNA, 33 bp, Artificial Sequence
  Description of Artificial Sequence: Synthetic oligonucleotide
tggaacatctatgtcttcccccaatgcatgtgg

SEQ ID NO: 115278 - DNA, 32 bp, Artificial Sequence
  Description of Artificial Sequence: Synthetic oligonucleotide
ggaacatctatgtcttcccccaatgcatgtgg

SEQ ID NO: 115279 - DNA, 33 bp, Artificial Sequence
  Description of Artificial Sequence: Synthetic oligonucleotide
gaacatctatgtcttcccccaatgcatgtggag

SEQ ID NO: 115280 - DNA, 33 bp, Artificial Sequence
  Description of Artificial Sequence: Synthetic oligonucleotide
aacatctatgtcttcccccaatgcatgtggagg

SEQ ID NO: 115281 - DNA, 32 bp, Artificial Sequence
  Description of Artificial Sequence: Synthetic oligonucleotide
acatctatgtcttcccccaatgcatgtggagg

SEQ ID NO: 115282 - DNA, 31 bp, Artificial Sequence
  Description of Artificial Sequence: Synthetic oligonucleotide
catctatgtcttcccccaatgcatgtggagg

SEQ ID NO: 115283 - DNA, 31 bp, Artificial Sequence
  Description of Artificial Sequence: Synthetic oligonucleotide
atctatgtcttcccccaatgcatgtggaggc

SEQ ID NO: 115284 - DNA, 30 bp, Artificial Sequence
  Description of Artificial Sequence: Synthetic oligonucleotide
tctatgtcttcccccaatgcatgtggaggc

SEQ ID NO: 115285 - DNA, 29 bp, Artificial Sequence
  Description of Artificial Sequence: Synthetic oligonucleotide
ctatgtcttcccccaatgcatgtggaggc

SEQ ID NO: 115286 - DNA, 32 bp, Artificial Sequence
  Description of Artificial Sequence: Synthetic oligonucleotide
tatgtcttcccccaatgcatgtggaggcattg

SEQ ID NO: 115287 - DNA, 31 bp, Artificial Sequence
  Description of Artificial Sequence: Synthetic oligonucleotide
atgtcttcccccaatgcatgtggaggcattg

SEQ ID NO: 115288 - DNA, 30 bp, Artificial Sequence
  Description of Artificial Sequence: Synthetic oligonucleotide
tgtcttcccccaatgcatgtggaggcattg

SEQ ID NO: 115289 - DNA, 29 bp, Artificial Sequence
  Description of Artificial Sequence: Synthetic oligonucleotide
gtcttcccccaatgcatgtggaggcattg

SEQ ID NO: 115290 - DNA, 29 bp, Artificial Sequence
  Description of Artificial Sequence: Synthetic oligonucleotide
tcttcccccaatgcatgtggaggcattgc

SEQ ID NO: 115291 - DNA, 28 bp, Artificial Sequence
  Description of Artificial Sequence: Synthetic oligonucleotide
cttcccccaatgcatgtggaggcattgc

SEQ ID NO: 115292 - DNA, 28 bp, Artificial Sequence
  Description of Artificial Sequence: Synthetic oligonucleotide
ttcccccaatgcatgtggaggcattgcc

SEQ ID NO: 115293 - DNA, 27 bp, Artificial Sequence
  Description of Artificial Sequence: Synthetic oligonucleotide
tcccccaatgcatgtggaggcattgcc

SEQ ID NO: 115294 - DNA, 26 bp, Artificial Sequence
  Description of Artificial Sequence: Synthetic oligonucleotide
cccccaatgcatgtggaggcattgcc

SEQ ID NO: 115295 - DNA, 27 bp, Artificial Sequence
  Description of Artificial Sequence: Synthetic oligonucleotide
ccccaatgcatgtggaggcattgccct

SEQ ID NO: 115296 - DNA, 27 bp, Artificial Sequence
  Description of Artificial Sequence: Synthetic oligonucleotide
cccaatgcatgtggaggcattgccctg

SEQ ID NO: 115297 - DNA, 29 bp, Artificial Sequence
  Description of Artificial Sequence: Synthetic oligonucleotide
ccaatgcatgtggaggcattgccctgatc

SEQ ID NO: 115298 - DNA, 29 bp, Artificial Sequence
  Description of Artificial Sequence: Synthetic oligonucleotide
caatgcatgtggaggcattgccctgatcc

SEQ ID NO: 115299 - DNA, 32 bp, Artificial Sequence
  Description of Artificial Sequence: Synthetic oligonucleotide
aatgcatgtggaggcattgccctgatcctttc

SEQ ID NO: 115300 - DNA, 31 bp, Artificial Sequence
  Description of Artificial Sequence: Synthetic oligonucleotide
atgcatgtggaggcattgccctgatcctttc

SEQ ID NO: 115301 - DNA, 30 bp, Artificial Sequence
  Description of Artificial Sequence: Synthetic oligonucleotide
tgcatgtggaggcattgccctgatcctttc

SEQ ID NO: 115302 - DNA, 29 bp, Artificial Sequence
  Description of Artificial Sequence: Synthetic oligonucleotide
gcatgtggaggcattgccctgatcctttc

SEQ ID NO: 115303 - DNA, 30 bp, Artificial Sequence
  Description of Artificial Sequence: Synthetic oligonucleotide
catgtggaggcattgccctgatcctttcag

SEQ ID NO: 115304 - DNA, 30 bp, Artificial Sequence
  Description of Artificial Sequence: Synthetic oligonucleotide
atgtggaggcattgccctgatcctttcagg

SEQ ID NO: 115305 - DNA, 29 bp, Artificial Sequence
  Description of Artificial Sequence: Synthetic oligonucleotide
tgtggaggcattgccctgatcctttcagg

SEQ ID NO: 115306 - DNA, 28 bp, Artificial Sequence
  Description of Artificial Sequence: Synthetic oligonucleotide
gtggaggcattgccctgatcctttcagg

SEQ ID NO: 115307 - DNA, 29 bp, Artificial Sequence
  Description of Artificial Sequence: Synthetic oligonucleotide
tggaggcattgccctgatcctttcaggtc

SEQ ID NO: 115308 - DNA, 28 bp, Artificial Sequence
  Description of Artificial Sequence: Synthetic oligonucleotide
ggaggcattgccctgatcctttcaggtc

SEQ ID NO: 115309 - DNA, 29 bp, Artificial Sequence
  Description of Artificial Sequence: Synthetic oligonucleotide
gaggcattgccctgatcctttcaggtctg

SEQ ID NO: 115310 - DNA, 32 bp, Artificial Sequence
  Description of Artificial Sequence: Synthetic oligonucleotide
aggcattgccctgatcctttcaggtctgaaag

SEQ ID NO: 115311 - DNA, 31 bp, Artificial Sequence
  Description of Artificial Sequence: Synthetic oligonucleotide
ggcattgccctgatcctttcaggtctgaaag

SEQ ID NO: 115312 - DNA, 31 bp, Artificial Sequence
  Description of Artificial Sequence: Synthetic oligonucleotide
gcattgccctgatcctttcaggtctgaaagc

SEQ ID NO: 115313 - DNA, 37 bp, Artificial Sequence
  Description of Artificial Sequence: Synthetic oligonucleotide
cattgccctgatcctttcaggtctgaaagctaataac

SEQ ID NO: 115314 - DNA, 40 bp, Artificial Sequence
  Description of Artificial Sequence: Synthetic oligonucleotide
attgccctgatcctttcaggtctgaaagctaataacattg

SEQ ID NO: 115315 - DNA, 39 bp, Artificial Sequence
  Description of Artificial Sequence: Synthetic oligonucleotide
ttgccctgatcctttcaggtctgaaagctaataacattg

SEQ ID NO: 115316 - DNA, 38 bp, Artificial Sequence
  Description of Artificial Sequence: Synthetic oligonucleotide
tgccctgatcctttcaggtctgaaagctaataacattg

SEQ ID NO: 115317 - DNA, 37 bp, Artificial Sequence
  Description of Artificial Sequence: Synthetic oligonucleotide
gccctgatcctttcaggtctgaaagctaataacattg

SEQ ID NO: 115318 - DNA, 38 bp, Artificial Sequence
  Description of Artificial Sequence: Synthetic oligonucleotide
ccctgatcctttcaggtctgaaagctaataacattgac

SEQ ID NO: 115319 - DNA, 40 bp, Artificial Sequence
  Description of Artificial Sequence: Synthetic oligonucleotide
cctgatcctttcaggtctgaaagctaataacattgactac

SEQ ID NO: 115320 - DNA, 41 bp, Artificial Sequence
  Description of Artificial Sequence: Synthetic oligonucleotide
ctgatcctttcaggtctgaaagctaataacattgactacac

SEQ ID NO: 115321 - DNA, 42 bp, Artificial Sequence
  Description of Artificial Sequence: Synthetic oligonucleotide
tgatcctttcaggtctgaaagctaataacattgactacacag

SEQ ID NO: 115322 - DNA, 41 bp, Artificial Sequence
  Description of Artificial Sequence: Synthetic oligonucleotide
gatcctttcaggtctgaaagctaataacattgactacacag

SEQ ID NO: 115323 - DNA, 43 bp, Artificial Sequence
  Description of Artificial Sequence: Synthetic oligonucleotide
atcctttcaggtctgaaagctaataacattgactacacagttc

SEQ ID NO: 115324 - DNA, 42 bp, Artificial Sequence
  Description of Artificial Sequence: Synthetic oligonucleotide
tcctttcaggtctgaaagctaataacattgactacacagttc

SEQ ID NO: 115325 - DNA, 41 bp, Artificial Sequence
  Description of Artificial Sequence: Synthetic oligonucleotide
cctttcaggtctgaaagctaataacattgactacacagttc

SEQ ID NO: 115326 - DNA, 44 bp, Artificial Sequence
  Description of Artificial Sequence: Synthetic oligonucleotide
ctttcaggtctgaaagctaataacattgactacacagttcattc

SEQ ID NO: 115327 - DNA, 45 bp, Artificial Sequence
  Description of Artificial Sequence: Synthetic oligonucleotide
tttcaggtctgaaagctaataacattgactacacagttcattcag

SEQ ID NO: 115328 - DNA, 44 bp, Artificial Sequence
  Description of Artificial Sequence: Synthetic oligonucleotide
ttcaggtctgaaagctaataacattgactacacagttcattcag

SEQ ID NO: 115329 - DNA, 43 bp, Artificial Sequence
  Description of Artificial Sequence: Synthetic oligonucleotide
tcaggtctgaaagctaataacattgactacacagttcattcag

SEQ ID NO: 115330 - DNA, 42 bp, Artificial Sequence
  Description of Artificial Sequence: Synthetic oligonucleotide
caggtctgaaagctaataacattgactacacagttcattcag

SEQ ID NO: 115331 - DNA, 43 bp, Artificial Sequence
  Description of Artificial Sequence: Synthetic oligonucleotide
aggtctgaaagctaataacattgactacacagttcattcagtc

SEQ ID NO: 115332 - DNA, 42 bp, Artificial Sequence
  Description of Artificial Sequence: Synthetic oligonucleotide
ggtctgaaagctaataacattgactacacagttcattcagtc

SEQ ID NO: 115333 - DNA, 43 bp, Artificial Sequence
  Description of Artificial Sequence: Synthetic oligonucleotide
gtctgaaagctaataacattgactacacagttcattcagtcag

SEQ ID NO: 115334 - DNA, 45 bp, Artificial Sequence
  Description of Artificial Sequence: Synthetic oligonucleotide
tctgaaagctaataacattgactacacagttcattcagtcagaag

SEQ ID NO: 115335 - DNA, 44 bp, Artificial Sequence
  Description of Artificial Sequence: Synthetic oligonucleotide
ctgaaagctaataacattgactacacagttcattcagtcagaag

SEQ ID NO: 115336 - DNA, 45 bp, Artificial Sequence
  Description of Artificial Sequence: Synthetic oligonucleotide
tgaaagctaataacattgactacacagttcattcagtcagaagag

SEQ ID NO: 115337 - DNA, 44 bp, Artificial Sequence
  Description of Artificial Sequence: Synthetic oligonucleotide
gaaagctaataacattgactacacagttcattcagtcagaagag

SEQ ID NO: 115338 - DNA, 44 bp, Artificial Sequence
  Description of Artificial Sequence: Synthetic oligonucleotide
aaagctaataacattgactacacagttcattcagtcagaagagc

SEQ ID NO: 115339 - DNA, 43 bp, Artificial Sequence
  Description of Artificial Sequence: Synthetic oligonucleotide
aagctaataacattgactacacagttcattcagtcagaagagc

SEQ ID NO: 115340 - DNA, 42 bp, Artificial Sequence
  Description of Artificial Sequence: Synthetic oligonucleotide
agctaataacattgactacacagttcattcagtcagaagagc

SEQ ID NO: 115341 - DNA, 41 bp, Artificial Sequence
  Description of Artificial Sequence: Synthetic oligonucleotide
gctaataacattgactacacagttcattcagtcagaagagc

SEQ ID NO: 115342 - DNA, 42 bp, Artificial Sequence
  Description of Artificial Sequence: Synthetic oligonucleotide
ctaataacattgactacacagttcattcagtcagaagagctc

SEQ ID NO: 115343 - DNA, 44 bp, Artificial Sequence
  Description of Artificial Sequence: Synthetic oligonucleotide
taataacattgactacacagttcattcagtcagaagagctctag

SEQ ID NO: 115344 - DNA, 43 bp, Artificial Sequence
  Description of Artificial Sequence: Synthetic oligonucleotide
aataacattgactacacagttcattcagtcagaagagctctag

SEQ ID NO: 115345 - DNA, 42 bp, Artificial Sequence
  Description of Artificial Sequence: Synthetic oligonucleotide
ataacattgactacacagttcattcagtcagaagagctctag

SEQ ID NO: 115346 - DNA, 41 bp, Artificial Sequence
  Description of Artificial Sequence: Synthetic oligonucleotide
taacattgactacacagttcattcagtcagaagagctctag

SEQ ID NO: 115347 - DNA, 40 bp, Artificial Sequence
  Description of Artificial Sequence: Synthetic oligonucleotide
aacattgactacacagttcattcagtcagaagagctctag

SEQ ID NO: 115348 - DNA, 39 bp, Artificial Sequence
  Description of Artificial Sequence: Synthetic oligonucleotide
acattgactacacagttcattcagtcagaagagctctag

SEQ ID NO: 115349 - DNA, 38 bp, Artificial Sequence
  Description of Artificial Sequence: Synthetic oligonucleotide
cattgactacacagttcattcagtcagaagagctctag

SEQ ID NO: 115350 - DNA, 42 bp, Artificial Sequence
  Description of Artificial Sequence: Synthetic oligonucleotide
attgactacacagttcattcagtcagaagagctctagaaaac

SEQ ID NO: 115351 - DNA, 41 bp, Artificial Sequence
  Description of Artificial Sequence: Synthetic oligonucleotide
ttgactacacagttcattcagtcagaagagctctagaaaac

SEQ ID NO: 115352 - DNA, 40 bp, Artificial Sequence
  Description of Artificial Sequence: Synthetic oligonucleotide
tgactacacagttcattcagtcagaagagctctagaaaac

SEQ ID NO: 115353 - DNA, 39 bp, Artificial Sequence
  Description of Artificial Sequence: Synthetic oligonucleotide
gactacacagttcattcagtcagaagagctctagaaaac

SEQ ID NO: 115354 - DNA, 40 bp, Artificial Sequence
  Description of Artificial Sequence: Synthetic oligonucleotide
actacacagttcattcagtcagaagagctctagaaaacac

SEQ ID NO: 115355 - DNA, 39 bp, Artificial Sequence
  Description of Artificial Sequence: Synthetic oligonucleotide
ctacacagttcattcagtcagaagagctctagaaaacac

SEQ ID NO: 115356 - DNA, 40 bp, Artificial Sequence
  Description of Artificial Sequence: Synthetic oligonucleotide
tacacagttcattcagtcagaagagctctagaaaacactg

SEQ ID NO: 115357 - DNA, 39 bp, Artificial Sequence
  Description of Artificial Sequence: Synthetic oligonucleotide
acacagttcattcagtcagaagagctctagaaaacactg

SEQ ID NO: 115358 - DNA, 38 bp, Artificial Sequence
  Description of Artificial Sequence: Synthetic oligonucleotide
cacagttcattcagtcagaagagctctagaaaacactg

SEQ ID NO: 115359 - DNA, 38 bp, Artificial Sequence
  Description of Artificial Sequence: Synthetic oligonucleotide
acagttcattcagtcagaagagctctagaaaacactgc

SEQ ID NO: 115360 - DNA, 37 bp, Artificial Sequence
  Description of Artificial Sequence: Synthetic oligonucleotide
cagttcattcagtcagaagagctctagaaaacactgc

SEQ ID NO: 115361 - DNA, 38 bp, Artificial Sequence
  Description of Artificial Sequence: Synthetic oligonucleotide
agttcattcagtcagaagagctctagaaaacactgcag

SEQ ID NO: 115362 - DNA, 37 bp, Artificial Sequence
  Description of Artificial Sequence: Synthetic oligonucleotide
gttcattcagtcagaagagctctagaaaacactgcag

SEQ ID NO: 115363 - DNA, 38 bp, Artificial Sequence
  Description of Artificial Sequence: Synthetic oligonucleotide
ttcattcagtcagaagagctctagaaaacactgcagtg

SEQ ID NO: 115364 - DNA, 37 bp, Artificial Sequence
  Description of Artificial Sequence: Synthetic oligonucleotide
tcattcagtcagaagagctctagaaaacactgcagtg

SEQ ID NO: 115365 - DNA, 36 bp, Artificial Sequence
  Description of Artificial Sequence: Synthetic oligonucleotide
cattcagtcagaagagctctagaaaacactgcagtg

SEQ ID NO: 115366 - DNA, 38 bp, Artificial Sequence
  Description of Artificial Sequence: Synthetic oligonucleotide
attcagtcagaagagctctagaaaacactgcagtgaag

SEQ ID NO: 115367 - DNA, 37 bp, Artificial Sequence
  Description of Artificial Sequence: Synthetic oligonucleotide
ttcagtcagaagagctctagaaaacactgcagtgaag

SEQ ID NO: 115368 - DNA, 36 bp, Artificial Sequence
  Description of Artificial Sequence: Synthetic oligonucleotide
tcagtcagaagagctctagaaaacactgcagtgaag

SEQ ID NO: 115369 - DNA, 35 bp, Artificial Sequence
  Description of Artificial Sequence: Synthetic oligonucleotide
cagtcagaagagctctagaaaacactgcagtgaag

SEQ ID NO: 115370 - DNA, 35 bp, Artificial Sequence
  Description of Artificial Sequence: Synthetic oligonucleotide
agtcagaagagctctagaaaacactgcagtgaagg

SEQ ID NO: 115371 - DNA, 34 bp, Artificial Sequence
  Description of Artificial Sequence: Synthetic oligonucleotide
gtcagaagagctctagaaaacactgcagtgaagg

SEQ ID NO: 115372 - DNA, 34 bp, Artificial Sequence
  Description of Artificial Sequence: Synthetic oligonucleotide
tcagaagagctctagaaaacactgcagtgaaggc

SEQ ID NO: 115373 - DNA, 33 bp, Artificial Sequence
  Description of Artificial Sequence: Synthetic oligonucleotide
cagaagagctctagaaaacactgcagtgaaggc

SEQ ID NO: 115374 - DNA, 34 bp, Artificial Sequence
  Description of Artificial Sequence: Synthetic oligonucleotide
agaagagctctagaaaacactgcagtgaaggctg

SEQ ID NO: 115375 - DNA, 33 bp, Artificial Sequence
  Description of Artificial Sequence: Synthetic oligonucleotide
gaagagctctagaaaacactgcagtgaaggctg

SEQ ID NO: 115376 - DNA, 34 bp, Artificial Sequence
  Description of Artificial Sequence: Synthetic oligonucleotide
aagagctctagaaaacactgcagtgaaggctgac

SEQ ID NO: 115377 - DNA, 33 bp, Artificial Sequence
  Description of Artificial Sequence: Synthetic oligonucleotide
agagctctagaaaacactgcagtgaaggctgac

SEQ ID NO: 115378 - DNA, 32 bp, Artificial Sequence
  Description of Artificial Sequence: Synthetic oligonucleotide
gagctctagaaaacactgcagtgaaggctgac

SEQ ID NO: 115379 - DNA, 38 bp, Artificial Sequence
  Description of Artificial Sequence: Synthetic oligonucleotide
agctctagaaaacactgcagtgaaggctgacaatatag

SEQ ID NO: 115380 - DNA, 37 bp, Artificial Sequence
  Description of Artificial Sequence: Synthetic oligonucleotide
gctctagaaaacactgcagtgaaggctgacaatatag

SEQ ID NO: 115381 - DNA, 39 bp, Artificial Sequence
  Description of Artificial Sequence: Synthetic oligonucleotide
ctctagaaaacactgcagtgaaggctgacaatatagaag

SEQ ID NO: 115382 - DNA, 44 bp, Artificial Sequence
  Description of Artificial Sequence: Synthetic oligonucleotide
tctagaaaacactgcagtgaaggctgacaatatagaagtatttg

SEQ ID NO: 115383 - DNA, 43 bp, Artificial Sequence
  Description of Artificial Sequence: Synthetic oligonucleotide
ctagaaaacactgcagtgaaggctgacaatatagaagtatttg

SEQ ID NO: 115384 - DNA, 43 bp, Artificial Sequence
  Description of Artificial Sequence: Synthetic oligonucleotide
tagaaaacactgcagtgaaggctgacaatatagaagtatttgc

SEQ ID NO: 115385 - DNA, 42 bp, Artificial Sequence
  Description of Artificial Sequence: Synthetic oligonucleotide
agaaaacactgcagtgaaggctgacaatatagaagtatttgc

SEQ ID NO: 115386 - DNA, 41 bp, Artificial Sequence
  Description of Artificial Sequence: Synthetic oligonucleotide
gaaaacactgcagtgaaggctgacaatatagaagtatttgc

SEQ ID NO: 115387 - DNA, 42 bp, Artificial Sequence
  Description of Artificial Sequence: Synthetic oligonucleotide
aaaacactgcagtgaaggctgacaatatagaagtatttgctc

SEQ ID NO: 115388 - DNA, 41 bp, Artificial Sequence
  Description of Artificial Sequence: Synthetic oligonucleotide
aaacactgcagtgaaggctgacaatatagaagtatttgctc

SEQ ID NO: 115389 - DNA, 40 bp, Artificial Sequence
  Description of Artificial Sequence: Synthetic oligonucleotide
aacactgcagtgaaggctgacaatatagaagtatttgctc

SEQ ID NO: 115390 - DNA, 39 bp, Artificial Sequence
  Description of Artificial Sequence: Synthetic oligonucleotide
acactgcagtgaaggctgacaatatagaagtatttgctc

SEQ ID NO: 115391 - DNA, 38 bp, Artificial Sequence
  Description of Artificial Sequence: Synthetic oligonucleotide
cactgcagtgaaggctgacaatatagaagtatttgctc

SEQ ID NO: 115392 - DNA, 40 bp, Artificial Sequence
  Description of Artificial Sequence: Synthetic oligonucleotide
actgcagtgaaggctgacaatatagaagtatttgctcaag

SEQ ID NO: 115393 - DNA, 39 bp, Artificial Sequence
  Description of Artificial Sequence: Synthetic oligonucleotide
ctgcagtgaaggctgacaatatagaagtatttgctcaag

SEQ ID NO: 115394 - DNA, 39 bp, Artificial Sequence
  Description of Artificial Sequence: Synthetic oligonucleotide
tgcagtgaaggctgacaatatagaagtatttgctcaagg

SEQ ID NO: 115395 - DNA, 38 bp, Artificial Sequence
  Description of Artificial Sequence: Synthetic oligonucleotide
gcagtgaaggctgacaatatagaagtatttgctcaagg

SEQ ID NO: 115396 - DNA, 39 bp, Artificial Sequence
  Description of Artificial Sequence: Synthetic oligonucleotide
cagtgaaggctgacaatatagaagtatttgctcaaggac

SEQ ID NO: 115397 - DNA, 41 bp, Artificial Sequence
  Description of Artificial Sequence: Synthetic oligonucleotide
agtgaaggctgacaatatagaagtatttgctcaaggacatg

SEQ ID NO: 115398 - DNA, 40 bp, Artificial Sequence
  Description of Artificial Sequence: Synthetic oligonucleotide
gtgaaggctgacaatatagaagtatttgctcaaggacatg

SEQ ID NO: 115399 - DNA, 40 bp, Artificial Sequence
  Description of Artificial Sequence: Synthetic oligonucleotide
tgaaggctgacaatatagaagtatttgctcaaggacatgg

SEQ ID NO: 115400 - DNA, 39 bp, Artificial Sequence
  Description of Artificial Sequence: Synthetic oligonucleotide
gaaggctgacaatatagaagtatttgctcaaggacatgg

SEQ ID NO: 115401 - DNA, 46 bp, Artificial Sequence
  Description of Artificial Sequence: Synthetic oligonucleotide
aaggctgacaatatagaagtatttgctcaaggacatggtattattc

SEQ ID NO: 115402 - DNA, 45 bp, Artificial Sequence
  Description of Artificial Sequence: Synthetic oligonucleotide
aggctgacaatatagaagtatttgctcaaggacatggtattattc

SEQ ID NO: 115403 - DNA, 44 bp, Artificial Sequence
  Description of Artificial Sequence: Synthetic oligonucleotide
ggctgacaatatagaagtatttgctcaaggacatggtattattc

SEQ ID NO: 115404 - DNA, 45 bp, Artificial Sequence
  Description of Artificial Sequence: Synthetic oligonucleotide
gctgacaatatagaagtatttgctcaaggacatggtattattcag

SEQ ID NO: 115405 - DNA, 45 bp, Artificial Sequence
  Description of Artificial Sequence: Synthetic oligonucleotide
ctgacaatatagaagtatttgctcaaggacatggtattattcagg

SEQ ID NO: 115406 - DNA, 47 bp, Artificial Sequence
  Description of Artificial Sequence: Synthetic oligonucleotide
tgacaatatagaagtatttgctcaaggacatggtattattcaggttg

SEQ ID NO: 115407 - DNA, 46 bp, Artificial Sequence
  Description of Artificial Sequence: Synthetic oligonucleotide
gacaatatagaagtatttgctcaaggacatggtattattcaggttg

SEQ ID NO: 115408 - DNA, 51 bp, Artificial Sequence
  Description of Artificial Sequence: Synthetic oligonucleotide
acaatatagaagtatttgctcaaggacatggtattattcaggttgataaag

SEQ ID NO: 115409 - DNA, 50 bp, Artificial Sequence
  Description of Artificial Sequence: Synthetic oligonucleotide
caatatagaagtatttgctcaaggacatggtattattcaggttgataaag

SEQ ID NO: 115410 - DNA, 50 bp, Artificial Sequence
  Description of Artificial Sequence: Synthetic oligonucleotide
aatatagaagtatttgctcaaggacatggtattattcaggttgataaagc

SEQ ID NO: 115411 - DNA, 49 bp, Artificial Sequence
  Description of Artificial Sequence: Synthetic oligonucleotide
atatagaagtatttgctcaaggacatggtattattcaggttgataaagc

SEQ ID NO: 115412 - DNA, 48 bp, Artificial Sequence
  Description of Artificial Sequence: Synthetic oligonucleotide
tatagaagtatttgctcaaggacatggtattattcaggttgataaagc

SEQ ID NO: 115413 - DNA, 47 bp, Artificial Sequence
  Description of Artificial Sequence: Synthetic oligonucleotide
atagaagtatttgctcaaggacatggtattattcaggttgataaagc

SEQ ID NO: 115414 - DNA, 46 bp, Artificial Sequence
  Description of Artificial Sequence: Synthetic oligonucleotide
tagaagtatttgctcaaggacatggtattattcaggttgataaagc

SEQ ID NO: 115415 - DNA, 45 bp, Artificial Sequence
  Description of Artificial Sequence: Synthetic oligonucleotide
agaagtatttgctcaaggacatggtattattcaggttgataaagc

SEQ ID NO: 115416 - DNA, 44 bp, Artificial Sequence
  Description of Artificial Sequence: Synthetic oligonucleotide
gaagtatttgctcaaggacatggtattattcaggttgataaagc

SEQ ID NO: 115417 - DNA, 44 bp, Artificial Sequence
  Description of Artificial Sequence: Synthetic oligonucleotide
aagtatttgctcaaggacatggtattattcaggttgataaagcc

SEQ ID NO: 115418 - DNA, 43 bp, Artificial Sequence
  Description of Artificial Sequence: Synthetic oligonucleotide
agtatttgctcaaggacatggtattattcaggttgataaagcc

SEQ ID NO: 115419 - DNA, 42 bp, Artificial Sequence
  Description of Artificial Sequence: Synthetic oligonucleotide
gtatttgctcaaggacatggtattattcaggttgataaagcc

SEQ ID NO: 115420 - DNA, 45 bp, Artificial Sequence
  Description of Artificial Sequence: Synthetic oligonucleotide
tatttgctcaaggacatggtattattcaggttgataaagcctatg

SEQ ID NO: 115421 - DNA, 44 bp, Artificial Sequence
  Description of Artificial Sequence: Synthetic oligonucleotide
atttgctcaaggacatggtattattcaggttgataaagcctatg

SEQ ID NO: 115422 - DNA, 43 bp, Artificial Sequence
  Description of Artificial Sequence: Synthetic oligonucleotide
tttgctcaaggacatggtattattcaggttgataaagcctatg

SEQ ID NO: 115423 - DNA, 42 bp, Artificial Sequence
  Description of Artificial Sequence: Synthetic oligonucleotide
ttgctcaaggacatggtattattcaggttgataaagcctatg

SEQ ID NO: 115424 - DNA, 41 bp, Artificial Sequence
  Description of Artificial Sequence: Synthetic oligonucleotide
tgctcaaggacatggtattattcaggttgataaagcctatg

SEQ ID NO: 115425 - DNA, 40 bp, Artificial Sequence
  Description of Artificial Sequence: Synthetic oligonucleotide
gctcaaggacatggtattattcaggttgataaagcctatg

SEQ ID NO: 115426 - DNA, 41 bp, Artificial Sequence
  Description of Artificial Sequence: Synthetic oligonucleotide
ctcaaggacatggtattattcaggttgataaagcctatgac

SEQ ID NO: 115427 - DNA, 43 bp, Artificial Sequence
  Description of Artificial Sequence: Synthetic oligonucleotide
tcaaggacatggtattattcaggttgataaagcctatgactac

SEQ ID NO: 115428 - DNA, 42 bp, Artificial Sequence
  Description of Artificial Sequence: Synthetic oligonucleotide
caaggacatggtattattcaggttgataaagcctatgactac

SEQ ID NO: 115429 - DNA, 42 bp, Artificial Sequence
  Description of Artificial Sequence: Synthetic oligonucleotide
aaggacatggtattattcaggttgataaagcctatgactacc

SEQ ID NO: 115430 - DNA, 41 bp, Artificial Sequence
  Description of Artificial Sequence: Synthetic oligonucleotide
aggacatggtattattcaggttgataaagcctatgactacc

SEQ ID NO: 115431 - DNA, 40 bp, Artificial Sequence
  Description of Artificial Sequence: Synthetic oligonucleotide
ggacatggtattattcaggttgataaagcctatgactacc

SEQ ID NO: 115432 - DNA, 41 bp, Artificial Sequence
  Description of Artificial Sequence: Synthetic oligonucleotide
gacatggtattattcaggttgataaagcctatgactacctc

SEQ ID NO: 115433 - DNA, 41 bp, Artificial Sequence
  Description of Artificial Sequence: Synthetic oligonucleotide
acatggtattattcaggttgataaagcctatgactacctcg

SEQ ID NO: 115434 - DNA, 40 bp, Artificial Sequence
  Description of Artificial Sequence: Synthetic oligonucleotide
catggtattattcaggttgataaagcctatgactacctcg

SEQ ID NO: 115435 - DNA, 42 bp, Artificial Sequence
  Description of Artificial Sequence: Synthetic oligonucleotide
atggtattattcaggttgataaagcctatgactacctcgttc

SEQ ID NO: 115436 - DNA, 41 bp, Artificial Sequence
  Description of Artificial Sequence: Synthetic oligonucleotide
tggtattattcaggttgataaagcctatgactacctcgttc

SEQ ID NO: 115437 - DNA, 40 bp, Artificial Sequence
  Description of Artificial Sequence: Synthetic oligonucleotide
ggtattattcaggttgataaagcctatgactacctcgttc

SEQ ID NO: 115438 - DNA, 41 bp, Artificial Sequence
  Description of Artificial Sequence: Synthetic oligonucleotide
gtattattcaggttgataaagcctatgactacctcgttcag

SEQ ID NO: 115439 - DNA, 45 bp, Artificial Sequence
  Description of Artificial Sequence: Synthetic oligonucleotide
tattattcaggttgataaagcctatgactacctcgttcagaatac

SEQ ID NO: 115440 - DNA, 44 bp, Artificial Sequence
  Description of Artificial Sequence: Synthetic oligonucleotide
attattcaggttgataaagcctatgactacctcgttcagaatac

SEQ ID NO: 115441 - DNA, 43 bp, Artificial Sequence
  Description of Artificial Sequence: Synthetic oligonucleotide
ttattcaggttgataaagcctatgactacctcgttcagaatac

SEQ ID NO: 115442 - DNA, 42 bp, Artificial Sequence
  Description of Artificial Sequence: Synthetic oligonucleotide
tattcaggttgataaagcctatgactacctcgttcagaatac

SEQ ID NO: 115443 - DNA, 41 bp, Artificial Sequence
  Description of Artificial Sequence: Synthetic oligonucleotide
attcaggttgataaagcctatgactacctcgttcagaatac

SEQ ID NO: 115444 - DNA, 40 bp, Artificial Sequence
  Description of Artificial Sequence: Synthetic oligonucleotide
ttcaggttgataaagcctatgactacctcgttcagaatac

SEQ ID NO: 115445 - DNA, 39 bp, Artificial Sequence
  Description of Artificial Sequence: Synthetic oligonucleotide
tcaggttgataaagcctatgactacctcgttcagaatac

SEQ ID NO: 115446 - DNA, 38 bp, Artificial Sequence
  Description of Artificial Sequence: Synthetic oligonucleotide
caggttgataaagcctatgactacctcgttcagaatac

SEQ ID NO: 115447 - DNA, 40 bp, Artificial Sequence
  Description of Artificial Sequence: Synthetic oligonucleotide
aggttgataaagcctatgactacctcgttcagaatacatc

SEQ ID NO: 115448 - DNA, 39 bp, Artificial Sequence
  Description of Artificial Sequence: Synthetic oligonucleotide
ggttgataaagcctatgactacctcgttcagaatacatc

SEQ ID NO: 115449 - DNA, 43 bp, Artificial Sequence
  Description of Artificial Sequence: Synthetic oligonucleotide
gttgataaagcctatgactacctcgttcagaatacatcatttg

SEQ ID NO: 115450 - DNA, 43 bp, Artificial Sequence
  Description of Artificial Sequence: Synthetic oligonucleotide
ttgataaagcctatgactacctcgttcagaatacatcatttgc

SEQ ID NO: 115451 - DNA, 42 bp, Artificial Sequence
  Description of Artificial Sequence: Synthetic oligonucleotide
tgataaagcctatgactacctcgttcagaatacatcatttgc

SEQ ID NO: 115452 - DNA, 41 bp, Artificial Sequence
  Description of Artificial Sequence: Synthetic oligonucleotide
gataaagcctatgactacctcgttcagaatacatcatttgc

SEQ ID NO: 115453 - DNA, 51 bp, Artificial Sequence
  Description of Artificial Sequence: Synthetic oligonucleotide
ataaagcctatgactacctcgttcagaatacatcatttgctaataaattag

SEQ ID NO: 115454 - DNA, 50 bp, Artificial Sequence
  Description of Artificial Sequence: Synthetic oligonucleotide
taaagcctatgactacctcgttcagaatacatcatttgctaataaattag

SEQ ID NO: 115455 - DNA, 49 bp, Artificial Sequence
  Description of Artificial Sequence: Synthetic oligonucleotide
aaagcctatgactacctcgttcagaatacatcatttgctaataaattag

SEQ ID NO: 115456 - DNA, 48 bp, Artificial Sequence
  Description of Artificial Sequence: Synthetic oligonucleotide
aagcctatgactacctcgttcagaatacatcatttgctaataaattag

SEQ ID NO: 115457 - DNA, 47 bp, Artificial Sequence
  Description of Artificial Sequence: Synthetic oligonucleotide
agcctatgactacctcgttcagaatacatcatttgctaataaattag

SEQ ID NO: 115458 - DNA, 46 bp, Artificial Sequence
  Description of Artificial Sequence: Synthetic oligonucleotide
gcctatgactacctcgttcagaatacatcatttgctaataaattag

SEQ ID NO: 115459 - DNA, 46 bp, Artificial Sequence
  Description of Artificial Sequence: Synthetic oligonucleotide
cctatgactacctcgttcagaatacatcatttgctaataaattagg

SEQ ID NO: 115460 - DNA, 51 bp, Artificial Sequence
  Description of Artificial Sequence: Synthetic oligonucleotide
ctatgactacctcgttcagaatacatcatttgctaataaattaggttttac

SEQ ID NO: 115461 - DNA, 52 bp, Artificial Sequence
  Description of Artificial Sequence: Synthetic oligonucleotide
tatgactacctcgttcagaatacatcatttgctaataaattaggttttactg

SEQ ID NO: 115462 - DNA, 51 bp, Artificial Sequence
  Description of Artificial Sequence: Synthetic oligonucleotide
atgactacctcgttcagaatacatcatttgctaataaattaggttttactg

SEQ ID NO: 115463 - DNA, 50 bp, Artificial Sequence
  Description of Artificial Sequence: Synthetic oligonucleotide
tgactacctcgttcagaatacatcatttgctaataaattaggttttactg

SEQ ID NO: 115464 - DNA, 49 bp, Artificial Sequence
  Description of Artificial Sequence: Synthetic oligonucleotide
gactacctcgttcagaatacatcatttgctaataaattaggttttactg

SEQ ID NO: 115465 - DNA, 52 bp, Artificial Sequence
  Description of Artificial Sequence: Synthetic oligonucleotide
actacctcgttcagaatacatcatttgctaataaattaggttttactgttac

SEQ ID NO: 115466 - DNA, 51 bp, Artificial Sequence
  Description of Artificial Sequence: Synthetic oligonucleotide
ctacctcgttcagaatacatcatttgctaataaattaggttttactgttac

SEQ ID NO: 115467 - DNA, 52 bp, Artificial Sequence
  Description of Artificial Sequence: Synthetic oligonucleotide
tacctcgttcagaatacatcatttgctaataaattaggttttactgttactg

SEQ ID NO: 115468 - DNA, 51 bp, Artificial Sequence
  Description of Artificial Sequence: Synthetic oligonucleotide
acctcgttcagaatacatcatttgctaataaattaggttttactgttactg

SEQ ID NO: 115469 - DNA, 50 bp, Artificial Sequence
  Description of Artificial Sequence: Synthetic oligonucleotide
cctcgttcagaatacatcatttgctaataaattaggttttactgttactg

SEQ ID NO: 115470 - DNA, 52 bp, Artificial Sequence
  Description of Artificial Sequence: Synthetic oligonucleotide
ctcgttcagaatacatcatttgctaataaattaggttttactgttactgttg

SEQ ID NO: 115471 - DNA, 52 bp, Artificial Sequence
  Description of Artificial Sequence: Synthetic oligonucleotide
tcgttcagaatacatcatttgctaataaattaggttttactgttactgttgg

SEQ ID NO: 115472 - DNA, 51 bp, Artificial Sequence
  Description of Artificial Sequence: Synthetic oligonucleotide
cgttcagaatacatcatttgctaataaattaggttttactgttactgttgg

SEQ ID NO: 115473 - DNA, 57 bp, Artificial Sequence
  Description of Artificial Sequence: Synthetic oligonucleotide
gttcagaatacatcatttgctaataaattaggttttactgttactgttggaaataac

SEQ ID NO: 115474 - DNA, 57 bp, Artificial Sequence
  Description of Artificial Sequence: Synthetic oligonucleotide
ttcagaatacatcatttgctaataaattaggttttactgttactgttggaaataacc

SEQ ID NO: 115475 - DNA, 56 bp, Artificial Sequence
  Description of Artificial Sequence: Synthetic oligonucleotide
tcagaatacatcatttgctaataaattaggttttactgttactgttggaaataacc

SEQ ID NO: 115476 - DNA, 55 bp, Artificial Sequence
  Description of Artificial Sequence: Synthetic oligonucleotide
cagaatacatcatttgctaataaattaggttttactgttactgttggaaataacc

SEQ ID NO: 115477 - DNA, 55 bp, Artificial Sequence
  Description of Artificial Sequence: Synthetic oligonucleotide
agaatacatcatttgctaataaattaggttttactgttactgttggaaataaccg

SEQ ID NO: 115478 - DNA, 54 bp, Artificial Sequence
  Description of Artificial Sequence: Synthetic oligonucleotide
gaatacatcatttgctaataaattaggttttactgttactgttggaaataaccg

SEQ ID NO: 115479 - DNA, 55 bp, Artificial Sequence
  Description of Artificial Sequence: Synthetic oligonucleotide
aatacatcatttgctaataaattaggttttactgttactgttggaaataaccgtg

SEQ ID NO: 115480 - DNA, 54 bp, Artificial Sequence
  Description of Artificial Sequence: Synthetic oligonucleotide
atacatcatttgctaataaattaggttttactgttactgttggaaataaccgtg

SEQ ID NO: 115481 - DNA, 53 bp, Artificial Sequence
  Description of Artificial Sequence: Synthetic oligonucleotide
tacatcatttgctaataaattaggttttactgttactgttggaaataaccgtg

SEQ ID NO: 115482 - DNA, 52 bp, Artificial Sequence
  Description of Artificial Sequence: Synthetic oligonucleotide
acatcatttgctaataaattaggttttactgttactgttggaaataaccgtg

SEQ ID NO: 115483 - DNA, 51 bp, Artificial Sequence
  Description of Artificial Sequence: Synthetic oligonucleotide
catcatttgctaataaattaggttttactgttactgttggaaataaccgtg

SEQ ID NO: 115484 - DNA, 51 bp, Artificial Sequence
  Description of Artificial Sequence: Synthetic oligonucleotide
atcatttgctaataaattaggttttactgttactgttggaaataaccgtgg

SEQ ID NO: 115485 - DNA, 50 bp, Artificial Sequence
  Description of Artificial Sequence: Synthetic oligonucleotide
tcatttgctaataaattaggttttactgttactgttggaaataaccgtgg

SEQ ID NO: 115486 - DNA, 49 bp, Artificial Sequence
  Description of Artificial Sequence: Synthetic oligonucleotide
catttgctaataaattaggttttactgttactgttggaaataaccgtgg

SEQ ID NO: 115487 - DNA, 49 bp, Artificial Sequence
  Description of Artificial Sequence: Synthetic oligonucleotide
atttgctaataaattaggttttactgttactgttggaaataaccgtggc

SEQ ID NO: 115488 - DNA, 48 bp, Artificial Sequence
  Description of Artificial Sequence: Synthetic oligonucleotide
tttgctaataaattaggttttactgttactgttggaaataaccgtggc

SEQ ID NO: 115489 - DNA, 47 bp, Artificial Sequence
  Description of Artificial Sequence: Synthetic oligonucleotide
ttgctaataaattaggttttactgttactgttggaaataaccgtggc

SEQ ID NO: 115490 - DNA, 46 bp, Artificial Sequence
  Description of Artificial Sequence: Synthetic oligonucleotide
tgctaataaattaggttttactgttactgttggaaataaccgtggc

SEQ ID NO: 115491 - DNA, 45 bp, Artificial Sequence
  Description of Artificial Sequence: Synthetic oligonucleotide
gctaataaattaggttttactgttactgttggaaataaccgtggc

SEQ ID NO: 115492 - DNA, 47 bp, Artificial Sequence
  Description of Artificial Sequence: Synthetic oligonucleotide
ctaataaattaggttttactgttactgttggaaataaccgtggcatc

SEQ ID NO: 115493 - DNA, 49 bp, Artificial Sequence
  Description of Artificial Sequence: Synthetic oligonucleotide
taataaattaggttttactgttactgttggaaataaccgtggcatctac

SEQ ID NO: 115494 - DNA, 48 bp, Artificial Sequence
  Description of Artificial Sequence: Synthetic oligonucleotide
aataaattaggttttactgttactgttggaaataaccgtggcatctac

SEQ ID NO: 115495 - DNA, 47 bp, Artificial Sequence
  Description of Artificial Sequence: Synthetic oligonucleotide
ataaattaggttttactgttactgttggaaataaccgtggcatctac

SEQ ID NO: 115496 - DNA, 46 bp, Artificial Sequence
  Description of Artificial Sequence: Synthetic oligonucleotide
taaattaggttttactgttactgttggaaataaccgtggcatctac

SEQ ID NO: 115497 - DNA, 45 bp, Artificial Sequence
  Description of Artificial Sequence: Synthetic oligonucleotide
aaattaggttttactgttactgttggaaataaccgtggcatctac

SEQ ID NO: 115498 - DNA, 44 bp, Artificial Sequence
  Description of Artificial Sequence: Synthetic oligonucleotide
aattaggttttactgttactgttggaaataaccgtggcatctac

SEQ ID NO: 115499 - DNA, 43 bp, Artificial Sequence
  Description of Artificial Sequence: Synthetic oligonucleotide
attaggttttactgttactgttggaaataaccgtggcatctac

SEQ ID NO: 115500 - DNA, 42 bp, Artificial Sequence
  Description of Artificial Sequence: Synthetic oligonucleotide
ttaggttttactgttactgttggaaataaccgtggcatctac

SEQ ID NO: 115501 - DNA, 41 bp, Artificial Sequence
  Description of Artificial Sequence: Synthetic oligonucleotide
taggttttactgttactgttggaaataaccgtggcatctac

SEQ ID NO: 115502 - DNA, 40 bp, Artificial Sequence
  Description of Artificial Sequence: Synthetic oligonucleotide
aggttttactgttactgttggaaataaccgtggcatctac

SEQ ID NO: 115503 - DNA, 39 bp, Artificial Sequence
  Description of Artificial Sequence: Synthetic oligonucleotide
ggttttactgttactgttggaaataaccgtggcatctac

SEQ ID NO: 115504 - DNA, 39 bp, Artificial Sequence
  Description of Artificial Sequence: Synthetic oligonucleotide
gttttactgttactgttggaaataaccgtggcatctacc

SEQ ID NO: 115505 - DNA, 40 bp, Artificial Sequence
  Description of Artificial Sequence: Synthetic oligonucleotide
ttttactgttactgttggaaataaccgtggcatctacctc

SEQ ID NO: 115506 - DNA, 39 bp, Artificial Sequence
  Description of Artificial Sequence: Synthetic oligonucleotide
tttactgttactgttggaaataaccgtggcatctacctc

SEQ ID NO: 115507 - DNA, 38 bp, Artificial Sequence
  Description of Artificial Sequence: Synthetic oligonucleotide
ttactgttactgttggaaataaccgtggcatctacctc

SEQ ID NO: 115508 - DNA, 37 bp, Artificial Sequence
  Description of Artificial Sequence: Synthetic oligonucleotide
tactgttactgttggaaataaccgtggcatctacctc

SEQ ID NO: 115509 - DNA, 36 bp, Artificial Sequence
  Description of Artificial Sequence: Synthetic oligonucleotide
actgttactgttggaaataaccgtggcatctacctc

SEQ ID NO: 115510 - DNA, 35 bp, Artificial Sequence
  Description of Artificial Sequence: Synthetic oligonucleotide
ctgttactgttggaaataaccgtggcatctacctc

SEQ ID NO: 115511 - DNA, 35 bp, Artificial Sequence
  Description of Artificial Sequence: Synthetic oligonucleotide
tgttactgttggaaataaccgtggcatctacctcc

SEQ ID NO: 115512 - DNA, 34 bp, Artificial Sequence
  Description of Artificial Sequence: Synthetic oligonucleotide
gttactgttggaaataaccgtggcatctacctcc

SEQ ID NO: 115513 - DNA, 34 bp, Artificial Sequence
  Description of Artificial Sequence: Synthetic oligonucleotide
ttactgttggaaataaccgtggcatctacctccg

SEQ ID NO: 115514 - DNA, 33 bp, Artificial Sequence
  Description of Artificial Sequence: Synthetic oligonucleotide
tactgttggaaataaccgtggcatctacctccg

SEQ ID NO: 115515 - DNA, 32 bp, Artificial Sequence
  Description of Artificial Sequence: Synthetic oligonucleotide
actgttggaaataaccgtggcatctacctccg

SEQ ID NO: 115516 - DNA, 31 bp, Artificial Sequence
  Description of Artificial Sequence: Synthetic oligonucleotide
ctgttggaaataaccgtggcatctacctccg

SEQ ID NO: 115517 - DNA, 32 bp, Artificial Sequence
  Description of Artificial Sequence: Synthetic oligonucleotide
tgttggaaataaccgtggcatctacctccgag

SEQ ID NO: 115518 - DNA, 31 bp, Artificial Sequence
  Description of Artificial Sequence: Synthetic oligonucleotide
gttggaaataaccgtggcatctacctccgag

SEQ ID NO: 115519 - DNA, 33 bp, Artificial Sequence
  Description of Artificial Sequence: Synthetic oligonucleotide
ttggaaataaccgtggcatctacctccgagatc

SEQ ID NO: 115520 - DNA, 32 bp, Artificial Sequence
  Description of Artificial Sequence: Synthetic oligonucleotide
tggaaataaccgtggcatctacctccgagatc

SEQ ID NO: 115521 - DNA, 31 bp, Artificial Sequence
  Description of Artificial Sequence: Synthetic oligonucleotide
ggaaataaccgtggcatctacctccgagatc

SEQ ID NO: 115522 - DNA, 31 bp, Artificial Sequence
  Description of Artificial Sequence: Synthetic oligonucleotide
gaaataaccgtggcatctacctccgagatcc

SEQ ID NO: 115523 - DNA, 32 bp, Artificial Sequence
  Description of Artificial Sequence: Synthetic oligonucleotide
aaataaccgtggcatctacctccgagatcctg

SEQ ID NO: 115524 - DNA, 31 bp, Artificial Sequence
  Description of Artificial Sequence: Synthetic oligonucleotide
aataaccgtggcatctacctccgagatcctg

SEQ ID NO: 115525 - DNA, 30 bp, Artificial Sequence
  Description of Artificial Sequence: Synthetic oligonucleotide
ataaccgtggcatctacctccgagatcctg

SEQ ID NO: 115526 - DNA, 29 bp, Artificial Sequence
  Description of Artificial Sequence: Synthetic oligonucleotide
taaccgtggcatctacctccgagatcctg

SEQ ID NO: 115527 - DNA, 28 bp, Artificial Sequence
  Description of Artificial Sequence: Synthetic oligonucleotide
aaccgtggcatctacctccgagatcctg

SEQ ID NO: 115528 - DNA, 27 bp, Artificial Sequence
  Description of Artificial Sequence: Synthetic oligonucleotide
accgtggcatctacctccgagatcctg

SEQ ID NO: 115529 - DNA, 27 bp, Artificial Sequence
  Description of Artificial Sequence: Synthetic oligonucleotide
ccgtggcatctacctccgagatcctgt

SEQ ID NO: 115530 - DNA, 28 bp, Artificial Sequence
  Description of Artificial Sequence: Synthetic oligonucleotide
cgtggcatctacctccgagatcctgttc

SEQ ID NO: 115531 - DNA, 29 bp, Artificial Sequence
  Description of Artificial Sequence: Synthetic oligonucleotide
gtggcatctacctccgagatcctgttcag

SEQ ID NO: 115532 - DNA, 29 bp, Artificial Sequence
  Description of Artificial Sequence: Synthetic oligonucleotide
tggcatctacctccgagatcctgttcagg

SEQ ID NO: 115533 - DNA, 28 bp, Artificial Sequence
  Description of Artificial Sequence: Synthetic oligonucleotide
ggcatctacctccgagatcctgttcagg

SEQ ID NO: 115534 - DNA, 29 bp, Artificial Sequence
  Description of Artificial Sequence: Synthetic oligonucleotide
gcatctacctccgagatcctgttcaggtg

SEQ ID NO: 115535 - DNA, 29 bp, Artificial Sequence
  Description of Artificial Sequence: Synthetic oligonucleotide
catctacctccgagatcctgttcaggtgg

SEQ ID NO: 115536 - DNA, 29 bp, Artificial Sequence
  Description of Artificial Sequence: Synthetic oligonucleotide
atctacctccgagatcctgttcaggtggc

SEQ ID NO: 115537 - DNA, 28 bp, Artificial Sequence
  Description of Artificial Sequence: Synthetic oligonucleotide
tctacctccgagatcctgttcaggtggc

SEQ ID NO: 115538 - DNA, 27 bp, Artificial Sequence
  Description of Artificial Sequence: Synthetic oligonucleotide
ctacctccgagatcctgttcaggtggc

SEQ ID NO: 115539 - DNA, 28 bp, Artificial Sequence
  Description of Artificial Sequence: Synthetic oligonucleotide
tacctccgagatcctgttcaggtggctg

SEQ ID NO: 115540 - DNA, 27 bp, Artificial Sequence
  Description of Artificial Sequence: Synthetic oligonucleotide
acctccgagatcctgttcaggtggctg

SEQ ID NO: 115541 - DNA, 26 bp, Artificial Sequence
  Description of Artificial Sequence: Synthetic oligonucleotide
cctccgagatcctgttcaggtggctg

SEQ ID NO: 115542 - DNA, 27 bp, Artificial Sequence
  Description of Artificial Sequence: Synthetic oligonucleotide
ctccgagatcctgttcaggtggctgca

SEQ ID NO: 115543 - DNA, 27 bp, Artificial Sequence
  Description of Artificial Sequence: Synthetic oligonucleotide
tccgagatcctgttcaggtggctgcac

SEQ ID NO: 115544 - DNA, 26 bp, Artificial Sequence
  Description of Artificial Sequence: Synthetic oligonucleotide
ccgagatcctgttcaggtggctgcac

SEQ ID NO: 115545 - DNA, 27 bp, Artificial Sequence
  Description of Artificial Sequence: Synthetic oligonucleotide
cgagatcctgttcaggtggctgcacct

SEQ ID NO: 115546 - DNA, 28 bp, Artificial Sequence
  Description of Artificial Sequence: Synthetic oligonucleotide
gagatcctgttcaggtggctgcaccttc

SEQ ID NO: 115547 - DNA, 29 bp, Artificial Sequence
  Description of Artificial Sequence: Synthetic oligonucleotide
agatcctgttcaggtggctgcaccttcag

SEQ ID NO: 115548 - DNA, 28 bp, Artificial Sequence
  Description of Artificial Sequence: Synthetic oligonucleotide
gatcctgttcaggtggctgcaccttcag

SEQ ID NO: 115549 - DNA, 30 bp, Artificial Sequence
  Description of Artificial Sequence: Synthetic oligonucleotide
atcctgttcaggtggctgcaccttcagatc

SEQ ID NO: 115550 - DNA, 29 bp, Artificial Sequence
  Description of Artificial Sequence: Synthetic oligonucleotide
tcctgttcaggtggctgcaccttcagatc

SEQ ID NO: 115551 - DNA, 28 bp, Artificial Sequence
  Description of Artificial Sequence: Synthetic oligonucleotide
cctgttcaggtggctgcaccttcagatc

SEQ ID NO: 115552 - DNA, 30 bp, Artificial Sequence
  Description of Artificial Sequence: Synthetic oligonucleotide
ctgttcaggtggctgcaccttcagatcatg

SEQ ID NO: 115553 - DNA, 30 bp, Artificial Sequence
  Description of Artificial Sequence: Synthetic oligonucleotide
tgttcaggtggctgcaccttcagatcatgg

SEQ ID NO: 115554 - DNA, 29 bp, Artificial Sequence
  Description of Artificial Sequence: Synthetic oligonucleotide
gttcaggtggctgcaccttcagatcatgg

SEQ ID NO: 115555 - DNA, 29 bp, Artificial Sequence
  Description of Artificial Sequence: Synthetic oligonucleotide
ttcaggtggctgcaccttcagatcatggc

SEQ ID NO: 115556 - DNA, 28 bp, Artificial Sequence
  Description of Artificial Sequence: Synthetic oligonucleotide
tcaggtggctgcaccttcagatcatggc

SEQ ID NO: 115557 - DNA, 27 bp, Artificial Sequence
  Description of Artificial Sequence: Synthetic oligonucleotide
caggtggctgcaccttcagatcatggc

SEQ ID NO: 115558 - DNA, 27 bp, Artificial Sequence
  Description of Artificial Sequence: Synthetic oligonucleotide
aggtggctgcaccttcagatcatggcg

SEQ ID NO: 115559 - DNA, 27 bp, Artificial Sequence
  Description of Artificial Sequence: Synthetic oligonucleotide
ggtggctgcaccttcagatcatggcgt

SEQ ID NO: 115560 - DNA, 28 bp, Artificial Sequence
  Description of Artificial Sequence: Synthetic oligonucleotide
gtggctgcaccttcagatcatggcgttg

SEQ ID NO: 115561 - DNA, 28 bp, Artificial Sequence
  Description of Artificial Sequence: Synthetic oligonucleotide
tggctgcaccttcagatcatggcgttgg

SEQ ID NO: 115562 - DNA, 27 bp, Artificial Sequence
  Description of Artificial Sequence: Synthetic oligonucleotide
ggctgcaccttcagatcatggcgttgg

SEQ ID NO: 115563 - DNA, 27 bp, Artificial Sequence
  Description of Artificial Sequence: Synthetic oligonucleotide
gctgcaccttcagatcatggcgttggc

SEQ ID NO: 115564 - DNA, 30 bp, Artificial Sequence
  Description of Artificial Sequence: Synthetic oligonucleotide
ctgcaccttcagatcatggcgttggcattg

SEQ ID NO: 115565 - DNA, 32 bp, Artificial Sequence
  Description of Artificial Sequence: Synthetic oligonucleotide
tgcaccttcagatcatggcgttggcattgaac

SEQ ID NO: 115566 - DNA, 31 bp, Artificial Sequence
  Description of Artificial Sequence: Synthetic oligonucleotide
gcaccttcagatcatggcgttggcattgaac

SEQ ID NO: 115567 - DNA, 31 bp, Artificial Sequence
  Description of Artificial Sequence: Synthetic oligonucleotide
caccttcagatcatggcgttggcattgaacc

SEQ ID NO: 115568 - DNA, 32 bp, Artificial Sequence
  Description of Artificial Sequence: Synthetic oligonucleotide
accttcagatcatggcgttggcattgaacctg

SEQ ID NO: 115569 - DNA, 31 bp, Artificial Sequence
  Description of Artificial Sequence: Synthetic oligonucleotide
ccttcagatcatggcgttggcattgaacctg

SEQ ID NO: 115570 - DNA, 36 bp, Artificial Sequence
  Description of Artificial Sequence: Synthetic oligonucleotide
cttcagatcatggcgttggcattgaacctgtatttc

SEQ ID NO: 115571 - DNA, 36 bp, Artificial Sequence
  Description of Artificial Sequence: Synthetic oligonucleotide
ttcagatcatggcgttggcattgaacctgtatttcc

SEQ ID NO: 115572 - DNA, 35 bp, Artificial Sequence
  Description of Artificial Sequence: Synthetic oligonucleotide
tcagatcatggcgttggcattgaacctgtatttcc

SEQ ID NO: 115573 - DNA, 34 bp, Artificial Sequence
  Description of Artificial Sequence: Synthetic oligonucleotide
cagatcatggcgttggcattgaacctgtatttcc

SEQ ID NO: 115574 - DNA, 34 bp, Artificial Sequence
  Description of Artificial Sequence: Synthetic oligonucleotide
agatcatggcgttggcattgaacctgtatttccg

SEQ ID NO: 115575 - DNA, 33 bp, Artificial Sequence
  Description of Artificial Sequence: Synthetic oligonucleotide
gatcatggcgttggcattgaacctgtatttccg

SEQ ID NO: 115576 - DNA, 33 bp, Artificial Sequence
  Description of Artificial Sequence: Synthetic oligonucleotide
atcatggcgttggcattgaacctgtatttccgg

SEQ ID NO: 115577 - DNA, 32 bp, Artificial Sequence
  Description of Artificial Sequence: Synthetic oligonucleotide
tcatggcgttggcattgaacctgtatttccgg

SEQ ID NO: 115578 - DNA, 31 bp, Artificial Sequence
  Description of Artificial Sequence: Synthetic oligonucleotide
catggcgttggcattgaacctgtatttccgg

SEQ ID NO: 115579 - DNA, 32 bp, Artificial Sequence
  Description of Artificial Sequence: Synthetic oligonucleotide
atggcgttggcattgaacctgtatttccggag

SEQ ID NO: 115580 - DNA, 31 bp, Artificial Sequence
  Description of Artificial Sequence: Synthetic oligonucleotide
tggcgttggcattgaacctgtatttccggag

SEQ ID NO: 115581 - DNA, 30 bp, Artificial Sequence
  Description of Artificial Sequence: Synthetic oligonucleotide
ggcgttggcattgaacctgtatttccggag

SEQ ID NO: 115582 - DNA, 32 bp, Artificial Sequence
  Description of Artificial Sequence: Synthetic oligonucleotide
gcgttggcattgaacctgtatttccggagaac

SEQ ID NO: 115583 - DNA, 33 bp, Artificial Sequence
  Description of Artificial Sequence: Synthetic oligonucleotide
cgttggcattgaacctgtatttccggagaacac

SEQ ID NO: 115584 - DNA, 34 bp, Artificial Sequence
  Description of Artificial Sequence: Synthetic oligonucleotide
gttggcattgaacctgtatttccggagaacacag

SEQ ID NO: 115585 - DNA, 38 bp, Artificial Sequence
  Description of Artificial Sequence: Synthetic oligonucleotide
ttggcattgaacctgtatttccggagaacacagaaaac

SEQ ID NO: 115586 - DNA, 37 bp, Artificial Sequence
  Description of Artificial Sequence: Synthetic oligonucleotide
tggcattgaacctgtatttccggagaacacagaaaac

SEQ ID NO: 115587 - DNA, 36 bp, Artificial Sequence
  Description of Artificial Sequence: Synthetic oligonucleotide
ggcattgaacctgtatttccggagaacacagaaaac

SEQ ID NO: 115588 - DNA, 37 bp, Artificial Sequence
  Description of Artificial Sequence: Synthetic oligonucleotide
gcattgaacctgtatttccggagaacacagaaaactc

SEQ ID NO: 115589 - DNA, 38 bp, Artificial Sequence
  Description of Artificial Sequence: Synthetic oligonucleotide
cattgaacctgtatttccggagaacacagaaaactctg

SEQ ID NO: 115590 - DNA, 47 bp, Artificial Sequence
  Description of Artificial Sequence: Synthetic oligonucleotide
attgaacctgtatttccggagaacacagaaaactctgaaaaaatatc

SEQ ID NO: 115591 - DNA, 46 bp, Artificial Sequence
  Description of Artificial Sequence: Synthetic oligonucleotide
ttgaacctgtatttccggagaacacagaaaactctgaaaaaatatc

SEQ ID NO: 115592 - DNA, 45 bp, Artificial Sequence
  Description of Artificial Sequence: Synthetic oligonucleotide
tgaacctgtatttccggagaacacagaaaactctgaaaaaatatc

SEQ ID NO: 115593 - DNA, 44 bp, Artificial Sequence
  Description of Artificial Sequence: Synthetic oligonucleotide
gaacctgtatttccggagaacacagaaaactctgaaaaaatatc

SEQ ID NO: 115594 - DNA, 44 bp, Artificial Sequence
  Description of Artificial Sequence: Synthetic oligonucleotide
aacctgtatttccggagaacacagaaaactctgaaaaaatatcc

SEQ ID NO: 115595 - DNA, 43 bp, Artificial Sequence
  Description of Artificial Sequence: Synthetic oligonucleotide
acctgtatttccggagaacacagaaaactctgaaaaaatatcc

SEQ ID NO: 115596 - DNA, 42 bp, Artificial Sequence
  Description of Artificial Sequence: Synthetic oligonucleotide
cctgtatttccggagaacacagaaaactctgaaaaaatatcc

SEQ ID NO: 115597 - DNA, 42 bp, Artificial Sequence
  Description of Artificial Sequence: Synthetic oligonucleotide
ctgtatttccggagaacacagaaaactctgaaaaaatatccc

SEQ ID NO: 115598 - DNA, 44 bp, Artificial Sequence
  Description of Artificial Sequence: Synthetic oligonucleotide
tgtatttccggagaacacagaaaactctgaaaaaatatcccttc

SEQ ID NO: 115599 - DNA, 43 bp, Artificial Sequence
  Description of Artificial Sequence: Synthetic oligonucleotide
gtatttccggagaacacagaaaactctgaaaaaatatcccttc

SEQ ID NO: 115600 - DNA, 44 bp, Artificial Sequence
  Description of Artificial Sequence: Synthetic oligonucleotide
tatttccggagaacacagaaaactctgaaaaaatatcccttcag

SEQ ID NO: 115601 - DNA, 43 bp, Artificial Sequence
  Description of Artificial Sequence: Synthetic oligonucleotide
atttccggagaacacagaaaactctgaaaaaatatcccttcag

SEQ ID NO: 115602 - DNA, 42 bp, Artificial Sequence
  Description of Artificial Sequence: Synthetic oligonucleotide
tttccggagaacacagaaaactctgaaaaaatatcccttcag

SEQ ID NO: 115603 - DNA, 41 bp, Artificial Sequence
  Description of Artificial Sequence: Synthetic oligonucleotide
ttccggagaacacagaaaactctgaaaaaatatcccttcag

SEQ ID NO: 115604 - DNA, 40 bp, Artificial Sequence
  Description of Artificial Sequence: Synthetic oligonucleotide
tccggagaacacagaaaactctgaaaaaatatcccttcag

SEQ ID NO: 115605 - DNA, 39 bp, Artificial Sequence
  Description of Artificial Sequence: Synthetic oligonucleotide
ccggagaacacagaaaactctgaaaaaatatcccttcag

SEQ ID NO: 115606 - DNA, 39 bp, Artificial Sequence
  Description of Artificial Sequence: Synthetic oligonucleotide
cggagaacacagaaaactctgaaaaaatatcccttcagc

SEQ ID NO: 115607 - DNA, 41 bp, Artificial Sequence
  Description of Artificial Sequence: Synthetic oligonucleotide
ggagaacacagaaaactctgaaaaaatatcccttcagcttc

SEQ ID NO: 115608 - DNA, 46 bp, Artificial Sequence
  Description of Artificial Sequence: Synthetic oligonucleotide
gagaacacagaaaactctgaaaaaatatcccttcagcttcatttag

SEQ ID NO: 115609 - DNA, 46 bp, Artificial Sequence
  Description of Artificial Sequence: Synthetic oligonucleotide
agaacacagaaaactctgaaaaaatatcccttcagcttcatttagc

SEQ ID NO: 115610 - DNA, 45 bp, Artificial Sequence
  Description of Artificial Sequence: Synthetic oligonucleotide
gaacacagaaaactctgaaaaaatatcccttcagcttcatttagc

SEQ ID NO: 115611 - DNA, 46 bp, Artificial Sequence
  Description of Artificial Sequence: Synthetic oligonucleotide
aacacagaaaactctgaaaaaatatcccttcagcttcatttagctc

SEQ ID NO: 115612 - DNA, 45 bp, Artificial Sequence
  Description of Artificial Sequence: Synthetic oligonucleotide
acacagaaaactctgaaaaaatatcccttcagcttcatttagctc

SEQ ID NO: 115613 - DNA, 44 bp, Artificial Sequence
  Description of Artificial Sequence: Synthetic oligonucleotide
cacagaaaactctgaaaaaatatcccttcagcttcatttagctc

SEQ ID NO: 115614 - DNA, 45 bp, Artificial Sequence
  Description of Artificial Sequence: Synthetic oligonucleotide
acagaaaactctgaaaaaatatcccttcagcttcatttagctctg

SEQ ID NO: 115615 - DNA, 44 bp, Artificial Sequence
  Description of Artificial Sequence: Synthetic oligonucleotide
cagaaaactctgaaaaaatatcccttcagcttcatttagctctg

SEQ ID NO: 115616 - DNA, 45 bp, Artificial Sequence
  Description of Artificial Sequence: Synthetic oligonucleotide
agaaaactctgaaaaaatatcccttcagcttcatttagctctgac

SEQ ID NO: 115617 - DNA, 44 bp, Artificial Sequence
  Description of Artificial Sequence: Synthetic oligonucleotide
gaaaactctgaaaaaatatcccttcagcttcatttagctctgac

SEQ ID NO: 115618 - DNA, 46 bp, Artificial Sequence
  Description of Artificial Sequence: Synthetic oligonucleotide
aaaactctgaaaaaatatcccttcagcttcatttagctctgacttc

SEQ ID NO: 115619 - DNA, 45 bp, Artificial Sequence
  Description of Artificial Sequence: Synthetic oligonucleotide
aaactctgaaaaaatatcccttcagcttcatttagctctgacttc

SEQ ID NO: 115620 - DNA, 44 bp, Artificial Sequence
  Description of Artificial Sequence: Synthetic oligonucleotide
aactctgaaaaaatatcccttcagcttcatttagctctgacttc

SEQ ID NO: 115621 - DNA, 43 bp, Artificial Sequence
  Description of Artificial Sequence: Synthetic oligonucleotide
actctgaaaaaatatcccttcagcttcatttagctctgacttc

SEQ ID NO: 115622 - DNA, 42 bp, Artificial Sequence
  Description of Artificial Sequence: Synthetic oligonucleotide
ctctgaaaaaatatcccttcagcttcatttagctctgacttc

SEQ ID NO: 115623 - DNA, 47 bp, Artificial Sequence
  Description of Artificial Sequence: Synthetic oligonucleotide
tctgaaaaaatatcccttcagcttcatttagctctgacttcaaattc

SEQ ID NO: 115624 - DNA, 46 bp, Artificial Sequence
  Description of Artificial Sequence: Synthetic oligonucleotide
ctgaaaaaatatcccttcagcttcatttagctctgacttcaaattc

SEQ ID NO: 115625 - DNA, 48 bp, Artificial Sequence
  Description of Artificial Sequence: Synthetic oligonucleotide
tgaaaaaatatcccttcagcttcatttagctctgacttcaaattcatc

SEQ ID NO: 115626 - DNA, 47 bp, Artificial Sequence
  Description of Artificial Sequence: Synthetic oligonucleotide
gaaaaaatatcccttcagcttcatttagctctgacttcaaattcatc

SEQ ID NO: 115627 - DNA, 49 bp, Artificial Sequence
  Description of Artificial Sequence: Synthetic oligonucleotide
aaaaaatatcccttcagcttcatttagctctgacttcaaattcatcttg

SEQ ID NO: 115628 - DNA, 48 bp, Artificial Sequence
  Description of Artificial Sequence: Synthetic oligonucleotide
aaaaatatcccttcagcttcatttagctctgacttcaaattcatcttg

SEQ ID NO: 115629 - DNA, 47 bp, Artificial Sequence
  Description of Artificial Sequence: Synthetic oligonucleotide
aaaatatcccttcagcttcatttagctctgacttcaaattcatcttg

SEQ ID NO: 115630 - DNA, 46 bp, Artificial Sequence
  Description of Artificial Sequence: Synthetic oligonucleotide
aaatatcccttcagcttcatttagctctgacttcaaattcatcttg

SEQ ID NO: 115631 - DNA, 45 bp, Artificial Sequence
  Description of Artificial Sequence: Synthetic oligonucleotide
aatatcccttcagcttcatttagctctgacttcaaattcatcttg

SEQ ID NO: 115632 - DNA, 44 bp, Artificial Sequence
  Description of Artificial Sequence: Synthetic oligonucleotide
atatcccttcagcttcatttagctctgacttcaaattcatcttg

SEQ ID NO: 115633 - DNA, 43 bp, Artificial Sequence
  Description of Artificial Sequence: Synthetic oligonucleotide
tatcccttcagcttcatttagctctgacttcaaattcatcttg

SEQ ID NO: 115634 - DNA, 42 bp, Artificial Sequence
  Description of Artificial Sequence: Synthetic oligonucleotide
atcccttcagcttcatttagctctgacttcaaattcatcttg

SEQ ID NO: 115635 - DNA, 41 bp, Artificial Sequence
  Description of Artificial Sequence: Synthetic oligonucleotide
tcccttcagcttcatttagctctgacttcaaattcatcttg

SEQ ID NO: 115636 - DNA, 40 bp, Artificial Sequence
  Description of Artificial Sequence: Synthetic oligonucleotide
cccttcagcttcatttagctctgacttcaaattcatcttg

SEQ ID NO: 115637 - DNA, 40 bp, Artificial Sequence
  Description of Artificial Sequence: Synthetic oligonucleotide
ccttcagcttcatttagctctgacttcaaattcatcttgg

SEQ ID NO: 115638 - DNA, 40 bp, Artificial Sequence
  Description of Artificial Sequence: Synthetic oligonucleotide
cttcagcttcatttagctctgacttcaaattcatcttggg

SEQ ID NO: 115639 - DNA, 42 bp, Artificial Sequence
  Description of Artificial Sequence: Synthetic oligonucleotide
ttcagcttcatttagctctgacttcaaattcatcttgggttc

SEQ ID NO: 115640 - DNA, 41 bp, Artificial Sequence
  Description of Artificial Sequence: Synthetic oligonucleotide
tcagcttcatttagctctgacttcaaattcatcttgggttc

SEQ ID NO: 115641 - DNA, 40 bp, Artificial Sequence
  Description of Artificial Sequence: Synthetic oligonucleotide
cagcttcatttagctctgacttcaaattcatcttgggttc

SEQ ID NO: 115642 - DNA, 41 bp, Artificial Sequence
  Description of Artificial Sequence: Synthetic oligonucleotide
agcttcatttagctctgacttcaaattcatcttgggttcag

SEQ ID NO: 115643 - DNA, 40 bp, Artificial Sequence
  Description of Artificial Sequence: Synthetic oligonucleotide
gcttcatttagctctgacttcaaattcatcttgggttcag

SEQ ID NO: 115644 - DNA, 41 bp, Artificial Sequence
  Description of Artificial Sequence: Synthetic oligonucleotide
cttcatttagctctgacttcaaattcatcttgggttcagtg

SEQ ID NO: 115645 - DNA, 42 bp, Artificial Sequence
  Description of Artificial Sequence: Synthetic oligonucleotide
ttcatttagctctgacttcaaattcatcttgggttcagtgtc

SEQ ID NO: 115646 - DNA, 41 bp, Artificial Sequence
  Description of Artificial Sequence: Synthetic oligonucleotide
tcatttagctctgacttcaaattcatcttgggttcagtgtc

SEQ ID NO: 115647 - DNA, 40 bp, Artificial Sequence
  Description of Artificial Sequence: Synthetic oligonucleotide
catttagctctgacttcaaattcatcttgggttcagtgtc

SEQ ID NO: 115648 - DNA, 40 bp, Artificial Sequence
  Description of Artificial Sequence: Synthetic oligonucleotide
atttagctctgacttcaaattcatcttgggttcagtgtcc

SEQ ID NO: 115649 - DNA, 39 bp, Artificial Sequence
  Description of Artificial Sequence: Synthetic oligonucleotide
tttagctctgacttcaaattcatcttgggttcagtgtcc

SEQ ID NO: 115650 - DNA, 38 bp, Artificial Sequence
  Description of Artificial Sequence: Synthetic oligonucleotide
ttagctctgacttcaaattcatcttgggttcagtgtcc

SEQ ID NO: 115651 - DNA, 37 bp, Artificial Sequence
  Description of Artificial Sequence: Synthetic oligonucleotide
tagctctgacttcaaattcatcttgggttcagtgtcc

SEQ ID NO: 115652 - DNA, 36 bp, Artificial Sequence
  Description of Artificial Sequence: Synthetic oligonucleotide
agctctgacttcaaattcatcttgggttcagtgtcc

SEQ ID NO: 115653 - DNA, 35 bp, Artificial Sequence
  Description of Artificial Sequence: Synthetic oligonucleotide
gctctgacttcaaattcatcttgggttcagtgtcc

SEQ ID NO: 115654 - DNA, 35 bp, Artificial Sequence
  Description of Artificial Sequence: Synthetic oligonucleotide
ctctgacttcaaattcatcttgggttcagtgtccc

SEQ ID NO: 115655 - DNA, 36 bp, Artificial Sequence
  Description of Artificial Sequence: Synthetic oligonucleotide
tctgacttcaaattcatcttgggttcagtgtcccag

SEQ ID NO: 115656 - DNA, 35 bp, Artificial Sequence
  Description of Artificial Sequence: Synthetic oligonucleotide
ctgacttcaaattcatcttgggttcagtgtcccag

SEQ ID NO: 115657 - DNA, 35 bp, Artificial Sequence
  Description of Artificial Sequence: Synthetic oligonucleotide
tgacttcaaattcatcttgggttcagtgtcccagc

SEQ ID NO: 115658 - DNA, 34 bp, Artificial Sequence
  Description of Artificial Sequence: Synthetic oligonucleotide
gacttcaaattcatcttgggttcagtgtcccagc

SEQ ID NO: 115659 - DNA, 34 bp, Artificial Sequence
  Description of Artificial Sequence: Synthetic oligonucleotide
acttcaaattcatcttgggttcagtgtcccagcc

SEQ ID NO: 115660 - DNA, 33 bp, Artificial Sequence
  Description of Artificial Sequence: Synthetic oligonucleotide
cttcaaattcatcttgggttcagtgtcccagcc

SEQ ID NO: 115661 - DNA, 37 bp, Artificial Sequence
  Description of Artificial Sequence: Synthetic oligonucleotide
ttcaaattcatcttgggttcagtgtcccagccatttg

SEQ ID NO: 115662 - DNA, 36 bp, Artificial Sequence
  Description of Artificial Sequence: Synthetic oligonucleotide
tcaaattcatcttgggttcagtgtcccagccatttg

SEQ ID NO: 115663 - DNA, 35 bp, Artificial Sequence
  Description of Artificial Sequence: Synthetic oligonucleotide
caaattcatcttgggttcagtgtcccagccatttg

SEQ ID NO: 115664 - DNA, 35 bp, Artificial Sequence
  Description of Artificial Sequence: Synthetic oligonucleotide
aaattcatcttgggttcagtgtcccagccatttgg

SEQ ID NO: 115665 - DNA, 34 bp, Artificial Sequence
  Description of Artificial Sequence: Synthetic oligonucleotide
aattcatcttgggttcagtgtcccagccatttgg

SEQ ID NO: 115666 - DNA, 33 bp, Artificial Sequence
  Description of Artificial Sequence: Synthetic oligonucleotide
attcatcttgggttcagtgtcccagccatttgg

SEQ ID NO: 115667 - DNA, 32 bp, Artificial Sequence
  Description of Artificial Sequence: Synthetic oligonucleotide
ttcatcttgggttcagtgtcccagccatttgg

SEQ ID NO: 115668 - DNA, 31 bp, Artificial Sequence
  Description of Artificial Sequence: Synthetic oligonucleotide
tcatcttgggttcagtgtcccagccatttgg

SEQ ID NO: 115669 - DNA, 30 bp, Artificial Sequence
  Description of Artificial Sequence: Synthetic oligonucleotide
catcttgggttcagtgtcccagccatttgg

SEQ ID NO: 115670 - DNA, 32 bp, Artificial Sequence
  Description of Artificial Sequence: Synthetic oligonucleotide
atcttgggttcagtgtcccagccatttggaac

SEQ ID NO: 115671 - DNA, 31 bp, Artificial Sequence
  Description of Artificial Sequence: Synthetic oligonucleotide
tcttgggttcagtgtcccagccatttggaac

SEQ ID NO: 115672 - DNA, 30 bp, Artificial Sequence
  Description of Artificial Sequence: Synthetic oligonucleotide
cttgggttcagtgtcccagccatttggaac

SEQ ID NO: 115673 - DNA, 31 bp, Artificial Sequence
  Description of Artificial Sequence: Synthetic oligonucleotide
ttgggttcagtgtcccagccatttggaactc

SEQ ID NO: 115674 - DNA, 30 bp, Artificial Sequence
  Description of Artificial Sequence: Synthetic oligonucleotide
tgggttcagtgtcccagccatttggaactc

SEQ ID NO: 115675 - DNA, 29 bp, Artificial Sequence
  Description of Artificial Sequence: Synthetic oligonucleotide
gggttcagtgtcccagccatttggaactc

SEQ ID NO: 115676 - DNA, 31 bp, Artificial Sequence
  Description of Artificial Sequence: Synthetic oligonucleotide
ggttcagtgtcccagccatttggaactcatg

SEQ ID NO: 115677 - DNA, 34 bp, Artificial Sequence
  Description of Artificial Sequence: Synthetic oligonucleotide
gttcagtgtcccagccatttggaactcatgaatc

SEQ ID NO: 115678 - DNA, 37 bp, Artificial Sequence
  Description of Artificial Sequence: Synthetic oligonucleotide
ttcagtgtcccagccatttggaactcatgaatcaatg

SEQ ID NO: 115679 - DNA, 36 bp, Artificial Sequence
  Description of Artificial Sequence: Synthetic oligonucleotide
tcagtgtcccagccatttggaactcatgaatcaatg

SEQ ID NO: 115680 - DNA, 35 bp, Artificial Sequence
  Description of Artificial Sequence: Synthetic oligonucleotide
cagtgtcccagccatttggaactcatgaatcaatg

SEQ ID NO: 115681 - DNA, 37 bp, Artificial Sequence
  Description of Artificial Sequence: Synthetic oligonucleotide
agtgtcccagccatttggaactcatgaatcaatgtag

SEQ ID NO: 115682 - DNA, 36 bp, Artificial Sequence
  Description of Artificial Sequence: Synthetic oligonucleotide
gtgtcccagccatttggaactcatgaatcaatgtag

SEQ ID NO: 115683 - DNA, 37 bp, Artificial Sequence
  Description of Artificial Sequence: Synthetic oligonucleotide
tgtcccagccatttggaactcatgaatcaatgtagac

SEQ ID NO: 115684 - DNA, 36 bp, Artificial Sequence
  Description of Artificial Sequence: Synthetic oligonucleotide
gtcccagccatttggaactcatgaatcaatgtagac

SEQ ID NO: 115685 - DNA, 37 bp, Artificial Sequence
  Description of Artificial Sequence: Synthetic oligonucleotide
tcccagccatttggaactcatgaatcaatgtagacac

SEQ ID NO: 115686 - DNA, 36 bp, Artificial Sequence
  Description of Artificial Sequence: Synthetic oligonucleotide
cccagccatttggaactcatgaatcaatgtagacac

SEQ ID NO: 115687 - DNA, 41 bp, Artificial Sequence
  Description of Artificial Sequence: Synthetic oligonucleotide
ccagccatttggaactcatgaatcaatgtagacacataaac

SEQ ID NO: 115688 - DNA, 44 bp, Artificial Sequence
  Description of Artificial Sequence: Synthetic oligonucleotide
cagccatttggaactcatgaatcaatgtagacacataaacatac

SEQ ID NO: 115689 - DNA, 44 bp, Artificial Sequence
  Description of Artificial Sequence: Synthetic oligonucleotide
agccatttggaactcatgaatcaatgtagacacataaacatacg

SEQ ID NO: 115690 - DNA, 43 bp, Artificial Sequence
  Description of Artificial Sequence: Synthetic oligonucleotide
gccatttggaactcatgaatcaatgtagacacataaacatacg

SEQ ID NO: 115691 - DNA, 44 bp, Artificial Sequence
  Description of Artificial Sequence: Synthetic oligonucleotide
ccatttggaactcatgaatcaatgtagacacataaacatacgtg

SEQ ID NO: 115692 - DNA, 45 bp, Artificial Sequence
  Description of Artificial Sequence: Synthetic oligonucleotide
catttggaactcatgaatcaatgtagacacataaacatacgtgtg

SEQ ID NO: 115693 - DNA, 45 bp, Artificial Sequence
  Description of Artificial Sequence: Synthetic oligonucleotide
atttggaactcatgaatcaatgtagacacataaacatacgtgtgg

SEQ ID NO: 115694 - DNA, 44 bp, Artificial Sequence
  Description of Artificial Sequence: Synthetic oligonucleotide
tttggaactcatgaatcaatgtagacacataaacatacgtgtgg

SEQ ID NO: 115695 - DNA, 43 bp, Artificial Sequence
  Description of Artificial Sequence: Synthetic oligonucleotide
ttggaactcatgaatcaatgtagacacataaacatacgtgtgg

SEQ ID NO: 115696 - DNA, 42 bp, Artificial Sequence
  Description of Artificial Sequence: Synthetic oligonucleotide
tggaactcatgaatcaatgtagacacataaacatacgtgtgg

SEQ ID NO: 115697 - DNA, 41 bp, Artificial Sequence
  Description of Artificial Sequence: Synthetic oligonucleotide
ggaactcatgaatcaatgtagacacataaacatacgtgtgg

SEQ ID NO: 115698 - DNA, 43 bp, Artificial Sequence
  Description of Artificial Sequence: Synthetic oligonucleotide
gaactcatgaatcaatgtagacacataaacatacgtgtggatc

SEQ ID NO: 115699 - DNA, 43 bp, Artificial Sequence
  Description of Artificial Sequence: Synthetic oligonucleotide
aactcatgaatcaatgtagacacataaacatacgtgtggatcc

SEQ ID NO: 115700 - DNA, 42 bp, Artificial Sequence
  Description of Artificial Sequence: Synthetic oligonucleotide
actcatgaatcaatgtagacacataaacatacgtgtggatcc

SEQ ID NO: 115701 - DNA, 41 bp, Artificial Sequence
  Description of Artificial Sequence: Synthetic oligonucleotide
ctcatgaatcaatgtagacacataaacatacgtgtggatcc

SEQ ID NO: 115702 - DNA, 41 bp, Artificial Sequence
  Description of Artificial Sequence: Synthetic oligonucleotide
tcatgaatcaatgtagacacataaacatacgtgtggatccc

SEQ ID NO: 115703 - DNA, 40 bp, Artificial Sequence
  Description of Artificial Sequence: Synthetic oligonucleotide
catgaatcaatgtagacacataaacatacgtgtggatccc

SEQ ID NO: 115704 - DNA, 41 bp, Artificial Sequence
  Description of Artificial Sequence: Synthetic oligonucleotide
atgaatcaatgtagacacataaacatacgtgtggatcccag

SEQ ID NO: 115705 - DNA, 40 bp, Artificial Sequence
  Description of Artificial Sequence: Synthetic oligonucleotide
tgaatcaatgtagacacataaacatacgtgtggatcccag

SEQ ID NO: 115706 - DNA, 39 bp, Artificial Sequence
  Description of Artificial Sequence: Synthetic oligonucleotide
gaatcaatgtagacacataaacatacgtgtggatcccag

SEQ ID NO: 115707 - DNA, 39 bp, Artificial Sequence
  Description of Artificial Sequence: Synthetic oligonucleotide
aatcaatgtagacacataaacatacgtgtggatcccagg

SEQ ID NO: 115708 - DNA, 38 bp, Artificial Sequence
  Description of Artificial Sequence: Synthetic oligonucleotide
atcaatgtagacacataaacatacgtgtggatcccagg

SEQ ID NO: 115709 - DNA, 37 bp, Artificial Sequence
  Description of Artificial Sequence: Synthetic oligonucleotide
tcaatgtagacacataaacatacgtgtggatcccagg

SEQ ID NO: 115710 - DNA, 36 bp, Artificial Sequence
  Description of Artificial Sequence: Synthetic oligonucleotide
caatgtagacacataaacatacgtgtggatcccagg

SEQ ID NO: 115711 - DNA, 36 bp, Artificial Sequence
  Description of Artificial Sequence: Synthetic oligonucleotide
aatgtagacacataaacatacgtgtggatcccaggg

SEQ ID NO: 115712 - DNA, 35 bp, Artificial Sequence
  Description of Artificial Sequence: Synthetic oligonucleotide
atgtagacacataaacatacgtgtggatcccaggg

SEQ ID NO: 115713 - DNA, 34 bp, Artificial Sequence
  Description of Artificial Sequence: Synthetic oligonucleotide
tgtagacacataaacatacgtgtggatcccaggg

SEQ ID NO: 115714 - DNA, 33 bp, Artificial Sequence
  Description of Artificial Sequence: Synthetic oligonucleotide
gtagacacataaacatacgtgtggatcccaggg

SEQ ID NO: 115715 - DNA, 33 bp, Artificial Sequence
  Description of Artificial Sequence: Synthetic oligonucleotide
tagacacataaacatacgtgtggatcccagggg

SEQ ID NO: 115716 - DNA, 32 bp, Artificial Sequence
  Description of Artificial Sequence: Synthetic oligonucleotide
agacacataaacatacgtgtggatcccagggg

SEQ ID NO: 115717 - DNA, 31 bp, Artificial Sequence
  Description of Artificial Sequence: Synthetic oligonucleotide
gacacataaacatacgtgtggatcccagggg

SEQ ID NO: 115718 - DNA, 31 bp, Artificial Sequence
  Description of Artificial Sequence: Synthetic oligonucleotide
acacataaacatacgtgtggatcccaggggc

SEQ ID NO: 115719 - DNA, 30 bp, Artificial Sequence
  Description of Artificial Sequence: Synthetic oligonucleotide
cacataaacatacgtgtggatcccaggggc

SEQ ID NO: 115720 - DNA, 34 bp, Artificial Sequence
  Description of Artificial Sequence: Synthetic oligonucleotide
acataaacatacgtgtggatcccaggggcttaag

SEQ ID NO: 115721 - DNA, 33 bp, Artificial Sequence
  Description of Artificial Sequence: Synthetic oligonucleotide
cataaacatacgtgtggatcccaggggcttaag

SEQ ID NO: 115722 - DNA, 34 bp, Artificial Sequence
  Description of Artificial Sequence: Synthetic oligonucleotide
ataaacatacgtgtggatcccaggggcttaagag

SEQ ID NO: 115723 - DNA, 33 bp, Artificial Sequence
  Description of Artificial Sequence: Synthetic oligonucleotide
taaacatacgtgtggatcccaggggcttaagag

SEQ ID NO: 115724 - DNA, 32 bp, Artificial Sequence
  Description of Artificial Sequence: Synthetic oligonucleotide
aaacatacgtgtggatcccaggggcttaagag

SEQ ID NO: 115725 - DNA, 31 bp, Artificial Sequence
  Description of Artificial Sequence: Synthetic oligonucleotide
aacatacgtgtggatcccaggggcttaagag

SEQ ID NO: 115726 - DNA, 30 bp, Artificial Sequence
  Description of Artificial Sequence: Synthetic oligonucleotide
acatacgtgtggatcccaggggcttaagag

SEQ ID NO: 115727 - DNA, 29 bp, Artificial Sequence
  Description of Artificial Sequence: Synthetic oligonucleotide
catacgtgtggatcccaggggcttaagag

SEQ ID NO: 115728 - DNA, 31 bp, Artificial Sequence
  Description of Artificial Sequence: Synthetic oligonucleotide
atacgtgtggatcccaggggcttaagagaag

SEQ ID NO: 115729 - DNA, 30 bp, Artificial Sequence
  Description of Artificial Sequence: Synthetic oligonucleotide
tacgtgtggatcccaggggcttaagagaag

SEQ ID NO: 115730 - DNA, 29 bp, Artificial Sequence
  Description of Artificial Sequence: Synthetic oligonucleotide
acgtgtggatcccaggggcttaagagaag

SEQ ID NO: 115731 - DNA, 28 bp, Artificial Sequence
  Description of Artificial Sequence: Synthetic oligonucleotide
cgtgtggatcccaggggcttaagagaag

SEQ ID NO: 115732 - DNA, 28 bp, Artificial Sequence
  Description of Artificial Sequence: Synthetic oligonucleotide
gtgtggatcccaggggcttaagagaagg

SEQ ID NO: 115733 - DNA, 31 bp, Artificial Sequence
  Description of Artificial Sequence: Synthetic oligonucleotide
tgtggatcccaggggcttaagagaaggattg

SEQ ID NO: 115734 - DNA, 30 bp, Artificial Sequence
  Description of Artificial Sequence: Synthetic oligonucleotide
gtggatcccaggggcttaagagaaggattg

SEQ ID NO: 115735 - DNA, 30 bp, Artificial Sequence
  Description of Artificial Sequence: Synthetic oligonucleotide
tggatcccaggggcttaagagaaggattgc

SEQ ID NO: 115736 - DNA, 29 bp, Artificial Sequence
  Description of Artificial Sequence: Synthetic oligonucleotide
ggatcccaggggcttaagagaaggattgc

SEQ ID NO: 115737 - DNA, 35 bp, Artificial Sequence
  Description of Artificial Sequence: Synthetic oligonucleotide
gatcccaggggcttaagagaaggattgcattatac

SEQ ID NO: 115738 - DNA, 36 bp, Artificial Sequence
  Description of Artificial Sequence: Synthetic oligonucleotide
atcccaggggcttaagagaaggattgcattatacag

SEQ ID NO: 115739 - DNA, 35 bp, Artificial Sequence
  Description of Artificial Sequence: Synthetic oligonucleotide
tcccaggggcttaagagaaggattgcattatacag

SEQ ID NO: 115740 - DNA, 34 bp, Artificial Sequence
  Description of Artificial Sequence: Synthetic oligonucleotide
cccaggggcttaagagaaggattgcattatacag

SEQ ID NO: 115741 - DNA, 35 bp, Artificial Sequence
  Description of Artificial Sequence: Synthetic oligonucleotide
ccaggggcttaagagaaggattgcattatacagag

SEQ ID NO: 115742 - DNA, 35 bp, Artificial Sequence
  Description of Artificial Sequence: Synthetic oligonucleotide
caggggcttaagagaaggattgcattatacagagg

SEQ ID NO: 115743 - DNA, 38 bp, Artificial Sequence
  Description of Artificial Sequence: Synthetic oligonucleotide
aggggcttaagagaaggattgcattatacagaggtatg

SEQ ID NO: 115744 - DNA, 37 bp, Artificial Sequence
  Description of Artificial Sequence: Synthetic oligonucleotide
ggggcttaagagaaggattgcattatacagaggtatg

SEQ ID NO: 115745 - DNA, 38 bp, Artificial Sequence
  Description of Artificial Sequence: Synthetic oligonucleotide
gggcttaagagaaggattgcattatacagaggtatgtg

SEQ ID NO: 115746 - DNA, 38 bp, Artificial Sequence
  Description of Artificial Sequence: Synthetic oligonucleotide
ggcttaagagaaggattgcattatacagaggtatgtgg

SEQ ID NO: 115747 - DNA, 38 bp, Artificial Sequence
  Description of Artificial Sequence: Synthetic oligonucleotide
gcttaagagaaggattgcattatacagaggtatgtggc

SEQ ID NO: 115748 - DNA, 41 bp, Artificial Sequence
  Description of Artificial Sequence: Synthetic oligonucleotide
cttaagagaaggattgcattatacagaggtatgtggctatg

SEQ ID NO: 115749 - DNA, 46 bp, Artificial Sequence
  Description of Artificial Sequence: Synthetic oligonucleotide
ttaagagaaggattgcattatacagaggtatgtggctatgatatag

SEQ ID NO: 115750 - DNA, 45 bp, Artificial Sequence
  Description of Artificial Sequence: Synthetic oligonucleotide
taagagaaggattgcattatacagaggtatgtggctatgatatag

SEQ ID NO: 115751 - DNA, 44 bp, Artificial Sequence
  Description of Artificial Sequence: Synthetic oligonucleotide
aagagaaggattgcattatacagaggtatgtggctatgatatag

SEQ ID NO: 115752 - DNA, 43 bp, Artificial Sequence
  Description of Artificial Sequence: Synthetic oligonucleotide
agagaaggattgcattatacagaggtatgtggctatgatatag

SEQ ID NO: 115753 - DNA, 42 bp, Artificial Sequence
  Description of Artificial Sequence: Synthetic oligonucleotide
gagaaggattgcattatacagaggtatgtggctatgatatag

SEQ ID NO: 115754 - DNA, 42 bp, Artificial Sequence
  Description of Artificial Sequence: Synthetic oligonucleotide
agaaggattgcattatacagaggtatgtggctatgatatagc

SEQ ID NO: 115755 - DNA, 41 bp, Artificial Sequence
  Description of Artificial Sequence: Synthetic oligonucleotide
gaaggattgcattatacagaggtatgtggctatgatatagc

SEQ ID NO: 115756 - DNA, 43 bp, Artificial Sequence
  Description of Artificial Sequence: Synthetic oligonucleotide
aaggattgcattatacagaggtatgtggctatgatatagcatc

SEQ ID NO: 115757 - DNA, 42 bp, Artificial Sequence
  Description of Artificial Sequence: Synthetic oligonucleotide
aggattgcattatacagaggtatgtggctatgatatagcatc

SEQ ID NO: 115758 - DNA, 41 bp, Artificial Sequence
  Description of Artificial Sequence: Synthetic oligonucleotide
ggattgcattatacagaggtatgtggctatgatatagcatc

SEQ ID NO: 115759 - DNA, 41 bp, Artificial Sequence
  Description of Artificial Sequence: Synthetic oligonucleotide
gattgcattatacagaggtatgtggctatgatatagcatcc

SEQ ID NO: 115760 - DNA, 41 bp, Artificial Sequence
  Description of Artificial Sequence: Synthetic oligonucleotide
attgcattatacagaggtatgtggctatgatatagcatccc

SEQ ID NO: 115761 - DNA, 40 bp, Artificial Sequence
  Description of Artificial Sequence: Synthetic oligonucleotide
ttgcattatacagaggtatgtggctatgatatagcatccc

SEQ ID NO: 115762 - DNA, 39 bp, Artificial Sequence
  Description of Artificial Sequence: Synthetic oligonucleotide
tgcattatacagaggtatgtggctatgatatagcatccc

SEQ ID NO: 115763 - DNA, 38 bp, Artificial Sequence
  Description of Artificial Sequence: Synthetic oligonucleotide
gcattatacagaggtatgtggctatgatatagcatccc

SEQ ID NO: 115764 - DNA, 38 bp, Artificial Sequence
  Description of Artificial Sequence: Synthetic oligonucleotide
cattatacagaggtatgtggctatgatatagcatcccc

SEQ ID NO: 115765 - DNA, 41 bp, Artificial Sequence
  Description of Artificial Sequence: Synthetic oligonucleotide
attatacagaggtatgtggctatgatatagcatcccctaac

SEQ ID NO: 115766 - DNA, 40 bp, Artificial Sequence
  Description of Artificial Sequence: Synthetic oligonucleotide
ttatacagaggtatgtggctatgatatagcatcccctaac

SEQ ID NO: 115767 - DNA, 39 bp, Artificial Sequence
  Description of Artificial Sequence: Synthetic oligonucleotide
tatacagaggtatgtggctatgatatagcatcccctaac

SEQ ID NO: 115768 - DNA, 38 bp, Artificial Sequence
  Description of Artificial Sequence: Synthetic oligonucleotide
atacagaggtatgtggctatgatatagcatcccctaac

SEQ ID NO: 115769 - DNA, 37 bp, Artificial Sequence
  Description of Artificial Sequence: Synthetic oligonucleotide
tacagaggtatgtggctatgatatagcatcccctaac

SEQ ID NO: 115770 - DNA, 36 bp, Artificial Sequence
  Description of Artificial Sequence: Synthetic oligonucleotide
acagaggtatgtggctatgatatagcatcccctaac

SEQ ID NO: 115771 - DNA, 35 bp, Artificial Sequence
  Description of Artificial Sequence: Synthetic oligonucleotide
cagaggtatgtggctatgatatagcatcccctaac

SEQ ID NO: 115772 - DNA, 35 bp, Artificial Sequence
  Description of Artificial Sequence: Synthetic oligonucleotide
agaggtatgtggctatgatatagcatcccctaacg

SEQ ID NO: 115773 - DNA, 34 bp, Artificial Sequence
  Description of Artificial Sequence: Synthetic oligonucleotide
gaggtatgtggctatgatatagcatcccctaacg

SEQ ID NO: 115774 - DNA, 34 bp, Artificial Sequence
  Description of Artificial Sequence: Synthetic oligonucleotide
aggtatgtggctatgatatagcatcccctaacgc

SEQ ID NO: 115775 - DNA, 33 bp, Artificial Sequence
  Description of Artificial Sequence: Synthetic oligonucleotide
ggtatgtggctatgatatagcatcccctaacgc

SEQ ID NO: 115776 - DNA, 34 bp, Artificial Sequence
  Description of Artificial Sequence: Synthetic oligonucleotide
gtatgtggctatgatatagcatcccctaacgcag

SEQ ID NO: 115777 - DNA, 34 bp, Artificial Sequence
  Description of Artificial Sequence: Synthetic oligonucleotide
tatgtggctatgatatagcatcccctaacgcagg

SEQ ID NO: 115778 - DNA, 33 bp, Artificial Sequence
  Description of Artificial Sequence: Synthetic oligonucleotide
atgtggctatgatatagcatcccctaacgcagg

SEQ ID NO: 115779 - DNA, 32 bp, Artificial Sequence
  Description of Artificial Sequence: Synthetic oligonucleotide
tgtggctatgatatagcatcccctaacgcagg

SEQ ID NO: 115780 - DNA, 31 bp, Artificial Sequence
  Description of Artificial Sequence: Synthetic oligonucleotide
gtggctatgatatagcatcccctaacgcagg

SEQ ID NO: 115781 - DNA, 32 bp, Artificial Sequence
  Description of Artificial Sequence: Synthetic oligonucleotide
tggctatgatatagcatcccctaacgcaggtc

SEQ ID NO: 115782 - DNA, 31 bp, Artificial Sequence
  Description of Artificial Sequence: Synthetic oligonucleotide
ggctatgatatagcatcccctaacgcaggtc

SEQ ID NO: 115783 - DNA, 31 bp, Artificial Sequence
  Description of Artificial Sequence: Synthetic oligonucleotide
gctatgatatagcatcccctaacgcaggtcc

SEQ ID NO: 115784 - DNA, 31 bp, Artificial Sequence
  Description of Artificial Sequence: Synthetic oligonucleotide
ctatgatatagcatcccctaacgcaggtccg

SEQ ID NO: 115785 - DNA, 31 bp, Artificial Sequence
  Description of Artificial Sequence: Synthetic oligonucleotide
tatgatatagcatcccctaacgcaggtccgc

SEQ ID NO: 115786 - DNA, 30 bp, Artificial Sequence
  Description of Artificial Sequence: Synthetic oligonucleotide
atgatatagcatcccctaacgcaggtccgc

SEQ ID NO: 115787 - DNA, 29 bp, Artificial Sequence
  Description of Artificial Sequence: Synthetic oligonucleotide
tgatatagcatcccctaacgcaggtccgc

SEQ ID NO: 115788 - DNA, 28 bp, Artificial Sequence
  Description of Artificial Sequence: Synthetic oligonucleotide
gatatagcatcccctaacgcaggtccgc

SEQ ID NO: 115789 - DNA, 29 bp, Artificial Sequence
  Description of Artificial Sequence: Synthetic oligonucleotide
atatagcatcccctaacgcaggtccgctc

SEQ ID NO: 115790 - DNA, 28 bp, Artificial Sequence
  Description of Artificial Sequence: Synthetic oligonucleotide
tatagcatcccctaacgcaggtccgctc

SEQ ID NO: 115791 - DNA, 27 bp, Artificial Sequence
  Description of Artificial Sequence: Synthetic oligonucleotide
atagcatcccctaacgcaggtccgctc

SEQ ID NO: 115792 - DNA, 27 bp, Artificial Sequence
  Description of Artificial Sequence: Synthetic oligonucleotide
tagcatcccctaacgcaggtccgctct

SEQ ID NO: 115793 - DNA, 27 bp, Artificial Sequence
  Description of Artificial Sequence: Synthetic oligonucleotide
agcatcccctaacgcaggtccgctctt

SEQ ID NO: 115794 - DNA, 26 bp, Artificial Sequence
  Description of Artificial Sequence: Synthetic oligonucleotide
gcatcccctaacgcaggtccgctctt

SEQ ID NO: 115795 - DNA, 27 bp, Artificial Sequence
  Description of Artificial Sequence: Synthetic oligonucleotide
catcccctaacgcaggtccgctcttca

SEQ ID NO: 115796 - DNA, 27 bp, Artificial Sequence
  Description of Artificial Sequence: Synthetic oligonucleotide
atcccctaacgcaggtccgctcttcag

SEQ ID NO: 115797 - DNA, 27 bp, Artificial Sequence
  Description of Artificial Sequence: Synthetic oligonucleotide
tcccctaacgcaggtccgctcttcaga

SEQ ID NO: 115798 - DNA, 26 bp, Artificial Sequence
  Description of Artificial Sequence: Synthetic oligonucleotide
cccctaacgcaggtccgctcttcaga

SEQ ID NO: 115799 - DNA, 27 bp, Artificial Sequence
  Description of Artificial Sequence: Synthetic oligonucleotide
ccctaacgcaggtccgctcttcagagt

SEQ ID NO: 115800 - DNA, 28 bp, Artificial Sequence
  Description of Artificial Sequence: Synthetic oligonucleotide
cctaacgcaggtccgctcttcagagttc

SEQ ID NO: 115801 - DNA, 28 bp, Artificial Sequence
  Description of Artificial Sequence: Synthetic oligonucleotide
ctaacgcaggtccgctcttcagagttcc

SEQ ID NO: 115802 - DNA, 28 bp, Artificial Sequence
  Description of Artificial Sequence: Synthetic oligonucleotide
taacgcaggtccgctcttcagagttccg

SEQ ID NO: 115803 - DNA, 27 bp, Artificial Sequence
  Description of Artificial Sequence: Synthetic oligonucleotide
aacgcaggtccgctcttcagagttccg

SEQ ID NO: 115804 - DNA, 27 bp, Artificial Sequence
  Description of Artificial Sequence: Synthetic oligonucleotide
acgcaggtccgctcttcagagttccga

SEQ ID NO: 115805 - DNA, 27 bp, Artificial Sequence
  Description of Artificial Sequence: Synthetic oligonucleotide
cgcaggtccgctcttcagagttccgat

SEQ ID NO: 115806 - DNA, 27 bp, Artificial Sequence
  Description of Artificial Sequence: Synthetic oligonucleotide
gcaggtccgctcttcagagttccgatc

SEQ ID NO: 115807 - DNA, 28 bp, Artificial Sequence
  Description of Artificial Sequence: Synthetic oligonucleotide
caggtccgctcttcagagttccgatcac

SEQ ID NO: 115808 - DNA, 29 bp, Artificial Sequence
  Description of Artificial Sequence: Synthetic oligonucleotide
aggtccgctcttcagagttccgatcactg

SEQ ID NO: 115809 - DNA, 28 bp, Artificial Sequence
  Description of Artificial Sequence: Synthetic oligonucleotide
ggtccgctcttcagagttccgatcactg

SEQ ID NO: 115810 - DNA, 28 bp, Artificial Sequence
  Description of Artificial Sequence: Synthetic oligonucleotide
gtccgctcttcagagttccgatcactgc

SEQ ID NO: 115811 - DNA, 29 bp, Artificial Sequence
  Description of Artificial Sequence: Synthetic oligonucleotide
tccgctcttcagagttccgatcactgcag

SEQ ID NO: 115812 - DNA, 28 bp, Artificial Sequence
  Description of Artificial Sequence: Synthetic oligonucleotide
ccgctcttcagagttccgatcactgcag

SEQ ID NO: 115813 - DNA, 33 bp, Artificial Sequence
  Description of Artificial Sequence: Synthetic oligonucleotide
cgctcttcagagttccgatcactgcagttatag

SEQ ID NO: 115814 - DNA, 33 bp, Artificial Sequence
  Description of Artificial Sequence: Synthetic oligonucleotide
gctcttcagagttccgatcactgcagttatagc

SEQ ID NO: 115815 - DNA, 34 bp, Artificial Sequence
  Description of Artificial Sequence: Synthetic oligonucleotide
ctcttcagagttccgatcactgcagttatagcag

SEQ ID NO: 115816 - DNA, 34 bp, Artificial Sequence
  Description of Artificial Sequence: Synthetic oligonucleotide
tcttcagagttccgatcactgcagttatagcagc

SEQ ID NO: 115817 - DNA, 33 bp, Artificial Sequence
  Description of Artificial Sequence: Synthetic oligonucleotide
cttcagagttccgatcactgcagttatagcagc

SEQ ID NO: 115818 - DNA, 37 bp, Artificial Sequence
  Description of Artificial Sequence: Synthetic oligonucleotide
ttcagagttccgatcactgcagttatagcagcaaaag

SEQ ID NO: 115819 - DNA, 36 bp, Artificial Sequence
  Description of Artificial Sequence: Synthetic oligonucleotide
tcagagttccgatcactgcagttatagcagcaaaag

SEQ ID NO: 115820 - DNA, 35 bp, Artificial Sequence
  Description of Artificial Sequence: Synthetic oligonucleotide
cagagttccgatcactgcagttatagcagcaaaag

SEQ ID NO: 115821 - DNA, 40 bp, Artificial Sequence
  Description of Artificial Sequence: Synthetic oligonucleotide
agagttccgatcactgcagttatagcagcaaaagtaaatg

SEQ ID NO: 115822 - DNA, 39 bp, Artificial Sequence
  Description of Artificial Sequence: Synthetic oligonucleotide
gagttccgatcactgcagttatagcagcaaaagtaaatg

SEQ ID NO: 115823 - DNA, 42 bp, Artificial Sequence
  Description of Artificial Sequence: Synthetic oligonucleotide
agttccgatcactgcagttatagcagcaaaagtaaatgaatc

SEQ ID NO: 115824 - DNA, 41 bp, Artificial Sequence
  Description of Artificial Sequence: Synthetic oligonucleotide
gttccgatcactgcagttatagcagcaaaagtaaatgaatc

SEQ ID NO: 115825 - DNA, 43 bp, Artificial Sequence
  Description of Artificial Sequence: Synthetic oligonucleotide
ttccgatcactgcagttatagcagcaaaagtaaatgaatcatc

SEQ ID NO: 115826 - DNA, 42 bp, Artificial Sequence
  Description of Artificial Sequence: Synthetic oligonucleotide
tccgatcactgcagttatagcagcaaaagtaaatgaatcatc

SEQ ID NO: 115827 - DNA, 41 bp, Artificial Sequence
  Description of Artificial Sequence: Synthetic oligonucleotide
ccgatcactgcagttatagcagcaaaagtaaatgaatcatc

SEQ ID NO: 115828 - DNA, 42 bp, Artificial Sequence
  Description of Artificial Sequence: Synthetic oligonucleotide
cgatcactgcagttatagcagcaaaagtaaatgaatcatcac

SEQ ID NO: 115829 - DNA, 47 bp, Artificial Sequence
  Description of Artificial Sequence: Synthetic oligonucleotide
gatcactgcagttatagcagcaaaagtaaatgaatcatcacattatg

SEQ ID NO: 115830 - DNA, 49 bp, Artificial Sequence
  Description of Artificial Sequence: Synthetic oligonucleotide
atcactgcagttatagcagcaaaagtaaatgaatcatcacattatgatc

SEQ ID NO: 115831 - DNA, 48 bp, Artificial Sequence
  Description of Artificial Sequence: Synthetic oligonucleotide
tcactgcagttatagcagcaaaagtaaatgaatcatcacattatgatc

SEQ ID NO: 115832 - DNA, 47 bp, Artificial Sequence
  Description of Artificial Sequence: Synthetic oligonucleotide
cactgcagttatagcagcaaaagtaaatgaatcatcacattatgatc

SEQ ID NO: 115833 - DNA, 49 bp, Artificial Sequence
  Description of Artificial Sequence: Synthetic oligonucleotide
actgcagttatagcagcaaaagtaaatgaatcatcacattatgatctag

SEQ ID NO: 115834 - DNA, 48 bp, Artificial Sequence
  Description of Artificial Sequence: Synthetic oligonucleotide
ctgcagttatagcagcaaaagtaaatgaatcatcacattatgatctag

SEQ ID NO: 115835 - DNA, 48 bp, Artificial Sequence
  Description of Artificial Sequence: Synthetic oligonucleotide
tgcagttatagcagcaaaagtaaatgaatcatcacattatgatctagc

SEQ ID NO: 115836 - DNA, 47 bp, Artificial Sequence
  Description of Artificial Sequence: Synthetic oligonucleotide
gcagttatagcagcaaaagtaaatgaatcatcacattatgatctagc

SEQ ID NO: 115837 - DNA, 47 bp, Artificial Sequence
  Description of Artificial Sequence: Synthetic oligonucleotide
cagttatagcagcaaaagtaaatgaatcatcacattatgatctagcc

SEQ ID NO: 115838 - DNA, 51 bp, Artificial Sequence
  Description of Artificial Sequence: Synthetic oligonucleotide
agttatagcagcaaaagtaaatgaatcatcacattatgatctagcctttac

SEQ ID NO: 115839 - DNA, 50 bp, Artificial Sequence
  Description of Artificial Sequence: Synthetic oligonucleotide
gttatagcagcaaaagtaaatgaatcatcacattatgatctagcctttac

SEQ ID NO: 115840 - DNA, 51 bp, Artificial Sequence
  Description of Artificial Sequence: Synthetic oligonucleotide
ttatagcagcaaaagtaaatgaatcatcacattatgatctagcctttacag

SEQ ID NO: 115841 - DNA, 50 bp, Artificial Sequence
  Description of Artificial Sequence: Synthetic oligonucleotide
tatagcagcaaaagtaaatgaatcatcacattatgatctagcctttacag

SEQ ID NO: 115842 - DNA, 49 bp, Artificial Sequence
  Description of Artificial Sequence: Synthetic oligonucleotide
atagcagcaaaagtaaatgaatcatcacattatgatctagcctttacag

SEQ ID NO: 115843 - DNA, 48 bp, Artificial Sequence
  Description of Artificial Sequence: Synthetic oligonucleotide
tagcagcaaaagtaaatgaatcatcacattatgatctagcctttacag

SEQ ID NO: 115844 - DNA, 47 bp, Artificial Sequence
  Description of Artificial Sequence: Synthetic oligonucleotide
agcagcaaaagtaaatgaatcatcacattatgatctagcctttacag

SEQ ID NO: 115845 - DNA, 46 bp, Artificial Sequence
  Description of Artificial Sequence: Synthetic oligonucleotide
gcagcaaaagtaaatgaatcatcacattatgatctagcctttacag

SEQ ID NO: 115846 - DNA, 48 bp, Artificial Sequence
  Description of Artificial Sequence: Synthetic oligonucleotide
cagcaaaagtaaatgaatcatcacattatgatctagcctttacagatg

SEQ ID NO: 115847 - DNA, 50 bp, Artificial Sequence
  Description of Artificial Sequence: Synthetic oligonucleotide
agcaaaagtaaatgaatcatcacattatgatctagcctttacagatgtac

SEQ ID NO: 115848 - DNA, 49 bp, Artificial Sequence
  Description of Artificial Sequence: Synthetic oligonucleotide
gcaaaagtaaatgaatcatcacattatgatctagcctttacagatgtac

SEQ ID NO: 115849 - DNA, 50 bp, Artificial Sequence
  Description of Artificial Sequence: Synthetic oligonucleotide
caaaagtaaatgaatcatcacattatgatctagcctttacagatgtacac

SEQ ID NO: 115850 - DNA, 56 bp, Artificial Sequence
  Description of Artificial Sequence: Synthetic oligonucleotide
aaaagtaaatgaatcatcacattatgatctagcctttacagatgtacactttaaac

SEQ ID NO: 115851 - DNA, 55 bp, Artificial Sequence
  Description of Artificial Sequence: Synthetic oligonucleotide
aaagtaaatgaatcatcacattatgatctagcctttacagatgtacactttaaac

SEQ ID NO: 115852 - DNA, 54 bp, Artificial Sequence
  Description of Artificial Sequence: Synthetic oligonucleotide
aagtaaatgaatcatcacattatgatctagcctttacagatgtacactttaaac

SEQ ID NO: 115853 - DNA, 53 bp, Artificial Sequence
  Description of Artificial Sequence: Synthetic oligonucleotide
agtaaatgaatcatcacattatgatctagcctttacagatgtacactttaaac

SEQ ID NO: 115854 - DNA, 52 bp, Artificial Sequence
  Description of Artificial Sequence: Synthetic oligonucleotide
gtaaatgaatcatcacattatgatctagcctttacagatgtacactttaaac

SEQ ID NO: 115855 - DNA, 52 bp, Artificial Sequence
  Description of Artificial Sequence: Synthetic oligonucleotide
taaatgaatcatcacattatgatctagcctttacagatgtacactttaaacc

SEQ ID NO: 115856 - DNA, 51 bp, Artificial Sequence
  Description of Artificial Sequence: Synthetic oligonucleotide
aaatgaatcatcacattatgatctagcctttacagatgtacactttaaacc

SEQ ID NO: 115857 - DNA, 50 bp, Artificial Sequence
  Description of Artificial Sequence: Synthetic oligonucleotide
aatgaatcatcacattatgatctagcctttacagatgtacactttaaacc

SEQ ID NO: 115858 - DNA, 49 bp, Artificial Sequence
  Description of Artificial Sequence: Synthetic oligonucleotide
atgaatcatcacattatgatctagcctttacagatgtacactttaaacc

SEQ ID NO: 115859 - DNA, 48 bp, Artificial Sequence
  Description of Artificial Sequence: Synthetic oligonucleotide
tgaatcatcacattatgatctagcctttacagatgtacactttaaacc

SEQ ID NO: 115860 - DNA, 47 bp, Artificial Sequence
  Description of Artificial Sequence: Synthetic oligonucleotide
gaatcatcacattatgatctagcctttacagatgtacactttaaacc

SEQ ID NO: 115861 - DNA, 48 bp, Artificial Sequence
  Description of Artificial Sequence: Synthetic oligonucleotide
aatcatcacattatgatctagcctttacagatgtacactttaaacctg

SEQ ID NO: 115862 - DNA, 47 bp, Artificial Sequence
  Description of Artificial Sequence: Synthetic oligonucleotide
atcatcacattatgatctagcctttacagatgtacactttaaacctg

SEQ ID NO: 115863 - DNA, 46 bp, Artificial Sequence
  Description of Artificial Sequence: Synthetic oligonucleotide
tcatcacattatgatctagcctttacagatgtacactttaaacctg

SEQ ID NO: 115864 - DNA, 45 bp, Artificial Sequence
  Description of Artificial Sequence: Synthetic oligonucleotide
catcacattatgatctagcctttacagatgtacactttaaacctg

SEQ ID NO: 115865 - DNA, 45 bp, Artificial Sequence
  Description of Artificial Sequence: Synthetic oligonucleotide
atcacattatgatctagcctttacagatgtacactttaaacctgg

SEQ ID NO: 115866 - DNA, 44 bp, Artificial Sequence
  Description of Artificial Sequence: Synthetic oligonucleotide
tcacattatgatctagcctttacagatgtacactttaaacctgg

SEQ ID NO: 115867 - DNA, 43 bp, Artificial Sequence
  Description of Artificial Sequence: Synthetic oligonucleotide
cacattatgatctagcctttacagatgtacactttaaacctgg

SEQ ID NO: 115868 - DNA, 44 bp, Artificial Sequence
  Description of Artificial Sequence: Synthetic oligonucleotide
acattatgatctagcctttacagatgtacactttaaacctggtc

SEQ ID NO: 115869 - DNA, 43 bp, Artificial Sequence
  Description of Artificial Sequence: Synthetic oligonucleotide
cattatgatctagcctttacagatgtacactttaaacctggtc

SEQ ID NO: 115870 - DNA, 48 bp, Artificial Sequence
  Description of Artificial Sequence: Synthetic oligonucleotide
attatgatctagcctttacagatgtacactttaaacctggtcaaattc

SEQ ID NO: 115871 - DNA, 47 bp, Artificial Sequence
  Description of Artificial Sequence: Synthetic oligonucleotide
ttatgatctagcctttacagatgtacactttaaacctggtcaaattc

SEQ ID NO: 115872 - DNA, 46 bp, Artificial Sequence
  Description of Artificial Sequence: Synthetic oligonucleotide
tatgatctagcctttacagatgtacactttaaacctggtcaaattc

SEQ ID NO: 115873 - DNA, 45 bp, Artificial Sequence
  Description of Artificial Sequence: Synthetic oligonucleotide
atgatctagcctttacagatgtacactttaaacctggtcaaattc

SEQ ID NO: 115874 - DNA, 44 bp, Artificial Sequence
  Description of Artificial Sequence: Synthetic oligonucleotide
tgatctagcctttacagatgtacactttaaacctggtcaaattc

SEQ ID NO: 115875 - DNA, 43 bp, Artificial Sequence
  Description of Artificial Sequence: Synthetic oligonucleotide
gatctagcctttacagatgtacactttaaacctggtcaaattc

SEQ ID NO: 115876 - DNA, 43 bp, Artificial Sequence
  Description of Artificial Sequence: Synthetic oligonucleotide
atctagcctttacagatgtacactttaaacctggtcaaattcg

SEQ ID NO: 115877 - DNA, 42 bp, Artificial Sequence
  Description of Artificial Sequence: Synthetic oligonucleotide
tctagcctttacagatgtacactttaaacctggtcaaattcg

SEQ ID NO: 115878 - DNA, 41 bp, Artificial Sequence
  Description of Artificial Sequence: Synthetic oligonucleotide
ctagcctttacagatgtacactttaaacctggtcaaattcg

SEQ ID NO: 115879 - DNA, 43 bp, Artificial Sequence
  Description of Artificial Sequence: Synthetic oligonucleotide
tagcctttacagatgtacactttaaacctggtcaaattcgaag

SEQ ID NO: 115880 - DNA, 42 bp, Artificial Sequence
  Description of Artificial Sequence: Synthetic oligonucleotide
agcctttacagatgtacactttaaacctggtcaaattcgaag

SEQ ID NO: 115881 - DNA, 41 bp, Artificial Sequence
  Description of Artificial Sequence: Synthetic oligonucleotide
gcctttacagatgtacactttaaacctggtcaaattcgaag

SEQ ID NO: 115882 - DNA, 41 bp, Artificial Sequence
  Description of Artificial Sequence: Synthetic oligonucleotide
cctttacagatgtacactttaaacctggtcaaattcgaagg

SEQ ID NO: 115883 - DNA, 41 bp, Artificial Sequence
  Description of Artificial Sequence: Synthetic oligonucleotide
ctttacagatgtacactttaaacctggtcaaattcgaaggc

SEQ ID NO: 115884 - DNA, 49 bp, Artificial Sequence
  Description of Artificial Sequence: Synthetic oligonucleotide
tttacagatgtacactttaaacctggtcaaattcgaaggcattttattg

SEQ ID NO: 115885 - DNA, 48 bp, Artificial Sequence
  Description of Artificial Sequence: Synthetic oligonucleotide
ttacagatgtacactttaaacctggtcaaattcgaaggcattttattg

SEQ ID NO: 115886 - DNA, 47 bp, Artificial Sequence
  Description of Artificial Sequence: Synthetic oligonucleotide
tacagatgtacactttaaacctggtcaaattcgaaggcattttattg

SEQ ID NO: 115887 - DNA, 46 bp, Artificial Sequence
  Description of Artificial Sequence: Synthetic oligonucleotide
acagatgtacactttaaacctggtcaaattcgaaggcattttattg

SEQ ID NO: 115888 - DNA, 45 bp, Artificial Sequence
  Description of Artificial Sequence: Synthetic oligonucleotide
cagatgtacactttaaacctggtcaaattcgaaggcattttattg

SEQ ID NO: 115889 - DNA, 46 bp, Artificial Sequence
  Description of Artificial Sequence: Synthetic oligonucleotide
agatgtacactttaaacctggtcaaattcgaaggcattttattgag

SEQ ID NO: 115890 - DNA, 45 bp, Artificial Sequence
  Description of Artificial Sequence: Synthetic oligonucleotide
gatgtacactttaaacctggtcaaattcgaaggcattttattgag

SEQ ID NO: 115891 - DNA, 45 bp, Artificial Sequence
  Description of Artificial Sequence: Synthetic oligonucleotide
atgtacactttaaacctggtcaaattcgaaggcattttattgagg

SEQ ID NO: 115892 - DNA, 44 bp, Artificial Sequence
  Description of Artificial Sequence: Synthetic oligonucleotide
tgtacactttaaacctggtcaaattcgaaggcattttattgagg

SEQ ID NO: 115893 - DNA, 43 bp, Artificial Sequence
  Description of Artificial Sequence: Synthetic oligonucleotide
gtacactttaaacctggtcaaattcgaaggcattttattgagg

SEQ ID NO: 115894 - DNA, 45 bp, Artificial Sequence
  Description of Artificial Sequence: Synthetic oligonucleotide
tacactttaaacctggtcaaattcgaaggcattttattgaggttc

SEQ ID NO: 115895 - DNA, 44 bp, Artificial Sequence
  Description of Artificial Sequence: Synthetic oligonucleotide
acactttaaacctggtcaaattcgaaggcattttattgaggttc

SEQ ID NO: 115896 - DNA, 43 bp, Artificial Sequence
  Description of Artificial Sequence: Synthetic oligonucleotide
cactttaaacctggtcaaattcgaaggcattttattgaggttc

SEQ ID NO: 115897 - DNA, 43 bp, Artificial Sequence
  Description of Artificial Sequence: Synthetic oligonucleotide
actttaaacctggtcaaattcgaaggcattttattgaggttcc

SEQ ID NO: 115898 - DNA, 42 bp, Artificial Sequence
  Description of Artificial Sequence: Synthetic oligonucleotide
ctttaaacctggtcaaattcgaaggcattttattgaggttcc

SEQ ID NO: 115899 - DNA, 43 bp, Artificial Sequence
  Description of Artificial Sequence: Synthetic oligonucleotide
tttaaacctggtcaaattcgaaggcattttattgaggttcctg

SEQ ID NO: 115900 - DNA, 42 bp, Artificial Sequence
  Description of Artificial Sequence: Synthetic oligonucleotide
ttaaacctggtcaaattcgaaggcattttattgaggttcctg

SEQ ID NO: 115901 - DNA, 41 bp, Artificial Sequence
  Description of Artificial Sequence: Synthetic oligonucleotide
taaacctggtcaaattcgaaggcattttattgaggttcctg

SEQ ID NO: 115902 - DNA, 40 bp, Artificial Sequence
  Description of Artificial Sequence: Synthetic oligonucleotide
aaacctggtcaaattcgaaggcattttattgaggttcctg

SEQ ID NO: 115903 - DNA, 39 bp, Artificial Sequence
  Description of Artificial Sequence: Synthetic oligonucleotide
aacctggtcaaattcgaaggcattttattgaggttcctg

SEQ ID NO: 115904 - DNA, 38 bp, Artificial Sequence
  Description of Artificial Sequence: Synthetic oligonucleotide
acctggtcaaattcgaaggcattttattgaggttcctg

SEQ ID NO: 115905 - DNA, 37 bp, Artificial Sequence
  Description of Artificial Sequence: Synthetic oligonucleotide
cctggtcaaattcgaaggcattttattgaggttcctg

SEQ ID NO: 115906 - DNA, 38 bp, Artificial Sequence
  Description of Artificial Sequence: Synthetic oligonucleotide
ctggtcaaattcgaaggcattttattgaggttcctgag

SEQ ID NO: 115907 - DNA, 38 bp, Artificial Sequence
  Description of Artificial Sequence: Synthetic oligonucleotide
tggtcaaattcgaaggcattttattgaggttcctgagg

SEQ ID NO: 115908 - DNA, 37 bp, Artificial Sequence
  Description of Artificial Sequence: Synthetic oligonucleotide
ggtcaaattcgaaggcattttattgaggttcctgagg

SEQ ID NO: 115909 - DNA, 37 bp, Artificial Sequence
  Description of Artificial Sequence: Synthetic oligonucleotide
gtcaaattcgaaggcattttattgaggttcctgaggg

SEQ ID NO: 115910 - DNA, 38 bp, Artificial Sequence
  Description of Artificial Sequence: Synthetic oligonucleotide
tcaaattcgaaggcattttattgaggttcctgagggtg

SEQ ID NO: 115911 - DNA, 37 bp, Artificial Sequence
  Description of Artificial Sequence: Synthetic oligonucleotide
caaattcgaaggcattttattgaggttcctgagggtg

SEQ ID NO: 115912 - DNA, 37 bp, Artificial Sequence
  Description of Artificial Sequence: Synthetic oligonucleotide
aaattcgaaggcattttattgaggttcctgagggtgc

SEQ ID NO: 115913 - DNA, 36 bp, Artificial Sequence
  Description of Artificial Sequence: Synthetic oligonucleotide
aattcgaaggcattttattgaggttcctgagggtgc

SEQ ID NO: 115914 - DNA, 35 bp, Artificial Sequence
  Description of Artificial Sequence: Synthetic oligonucleotide
attcgaaggcattttattgaggttcctgagggtgc

SEQ ID NO: 115915 - DNA, 34 bp, Artificial Sequence
  Description of Artificial Sequence: Synthetic oligonucleotide
ttcgaaggcattttattgaggttcctgagggtgc

SEQ ID NO: 115916 - DNA, 33 bp, Artificial Sequence
  Description of Artificial Sequence: Synthetic oligonucleotide
tcgaaggcattttattgaggttcctgagggtgc

SEQ ID NO: 115917 - DNA, 32 bp, Artificial Sequence
  Description of Artificial Sequence: Synthetic oligonucleotide
cgaaggcattttattgaggttcctgagggtgc

SEQ ID NO: 115918 - DNA, 34 bp, Artificial Sequence
  Description of Artificial Sequence: Synthetic oligonucleotide
gaaggcattttattgaggttcctgagggtgcaac

SEQ ID NO: 115919 - DNA, 36 bp, Artificial Sequence
  Description of Artificial Sequence: Synthetic oligonucleotide
aaggcattttattgaggttcctgagggtgcaacatg

SEQ ID NO: 115920 - DNA, 35 bp, Artificial Sequence
  Description of Artificial Sequence: Synthetic oligonucleotide
aggcattttattgaggttcctgagggtgcaacatg

SEQ ID NO: 115921 - DNA, 34 bp, Artificial Sequence
  Description of Artificial Sequence: Synthetic oligonucleotide
ggcattttattgaggttcctgagggtgcaacatg

SEQ ID NO: 115922 - DNA, 34 bp, Artificial Sequence
  Description of Artificial Sequence: Synthetic oligonucleotide
gcattttattgaggttcctgagggtgcaacatgg

SEQ ID NO: 115923 - DNA, 34 bp, Artificial Sequence
  Description of Artificial Sequence: Synthetic oligonucleotide
cattttattgaggttcctgagggtgcaacatggg

SEQ ID NO: 115924 - DNA, 34 bp, Artificial Sequence
  Description of Artificial Sequence: Synthetic oligonucleotide
attttattgaggttcctgagggtgcaacatgggc

SEQ ID NO: 115925 - DNA, 33 bp, Artificial Sequence
  Description of Artificial Sequence: Synthetic oligonucleotide
ttttattgaggttcctgagggtgcaacatgggc

SEQ ID NO: 115926 - DNA, 32 bp, Artificial Sequence
  Description of Artificial Sequence: Synthetic oligonucleotide
tttattgaggttcctgagggtgcaacatgggc

SEQ ID NO: 115927 - DNA, 31 bp, Artificial Sequence
  Description of Artificial Sequence: Synthetic oligonucleotide
ttattgaggttcctgagggtgcaacatgggc

SEQ ID NO: 115928 - DNA, 30 bp, Artificial Sequence
  Description of Artificial Sequence: Synthetic oligonucleotide
tattgaggttcctgagggtgcaacatgggc

SEQ ID NO: 115929 - DNA, 29 bp, Artificial Sequence
  Description of Artificial Sequence: Synthetic oligonucleotide
attgaggttcctgagggtgcaacatgggc

SEQ ID NO: 115930 - DNA, 28 bp, Artificial Sequence
  Description of Artificial Sequence: Synthetic oligonucleotide
ttgaggttcctgagggtgcaacatgggc

SEQ ID NO: 115931 - DNA, 27 bp, Artificial Sequence
  Description of Artificial Sequence: Synthetic oligonucleotide
tgaggttcctgagggtgcaacatgggc

SEQ ID NO: 115932 - DNA, 27 bp, Artificial Sequence
  Description of Artificial Sequence: Synthetic oligonucleotide
gaggttcctgagggtgcaacatgggct

SEQ ID NO: 115933 - DNA, 27 bp, Artificial Sequence
  Description of Artificial Sequence: Synthetic oligonucleotide
aggttcctgagggtgcaacatgggctg

SEQ ID NO: 115934 - DNA, 27 bp, Artificial Sequence
  Description of Artificial Sequence: Synthetic oligonucleotide
ggttcctgagggtgcaacatgggctga

SEQ ID NO: 115935 - DNA, 28 bp, Artificial Sequence
  Description of Artificial Sequence: Synthetic oligonucleotide
gttcctgagggtgcaacatgggctgaag

SEQ ID NO: 115936 - DNA, 29 bp, Artificial Sequence
  Description of Artificial Sequence: Synthetic oligonucleotide
ttcctgagggtgcaacatgggctgaagtg

SEQ ID NO: 115937 - DNA, 28 bp, Artificial Sequence
  Description of Artificial Sequence: Synthetic oligonucleotide
tcctgagggtgcaacatgggctgaagtg

SEQ ID NO: 115938 - DNA, 27 bp, Artificial Sequence
  Description of Artificial Sequence: Synthetic oligonucleotide
cctgagggtgcaacatgggctgaagtg

SEQ ID NO: 115939 - DNA, 28 bp, Artificial Sequence
  Description of Artificial Sequence: Synthetic oligonucleotide
ctgagggtgcaacatgggctgaagtgac

SEQ ID NO: 115940 - DNA, 29 bp, Artificial Sequence
  Description of Artificial Sequence: Synthetic oligonucleotide
tgagggtgcaacatgggctgaagtgacag

SEQ ID NO: 115941 - DNA, 28 bp, Artificial Sequence
  Description of Artificial Sequence: Synthetic oligonucleotide
gagggtgcaacatgggctgaagtgacag

SEQ ID NO: 115942 - DNA, 29 bp, Artificial Sequence
  Description of Artificial Sequence: Synthetic oligonucleotide
agggtgcaacatgggctgaagtgacagtg

SEQ ID NO: 115943 - DNA, 28 bp, Artificial Sequence
  Description of Artificial Sequence: Synthetic oligonucleotide
gggtgcaacatgggctgaagtgacagtg

SEQ ID NO: 115944 - DNA, 29 bp, Artificial Sequence
  Description of Artificial Sequence: Synthetic oligonucleotide
ggtgcaacatgggctgaagtgacagtgtg

SEQ ID NO: 115945 - DNA, 31 bp, Artificial Sequence
  Description of Artificial Sequence: Synthetic oligonucleotide
gtgcaacatgggctgaagtgacagtgtgttc

SEQ ID NO: 115946 - DNA, 31 bp, Artificial Sequence
  Description of Artificial Sequence: Synthetic oligonucleotide
tgcaacatgggctgaagtgacagtgtgttcg

SEQ ID NO: 115947 - DNA, 30 bp, Artificial Sequence
  Description of Artificial Sequence: Synthetic oligonucleotide
gcaacatgggctgaagtgacagtgtgttcg

SEQ ID NO: 115948 - DNA, 31 bp, Artificial Sequence
  Description of Artificial Sequence: Synthetic oligonucleotide
caacatgggctgaagtgacagtgtgttcgtg

SEQ ID NO: 115949 - DNA, 33 bp, Artificial Sequence
  Description of Artificial Sequence: Synthetic oligonucleotide
aacatgggctgaagtgacagtgtgttcgtgttc

SEQ ID NO: 115950 - DNA, 32 bp, Artificial Sequence
  Description of Artificial Sequence: Synthetic oligonucleotide
acatgggctgaagtgacagtgtgttcgtgttc

SEQ ID NO: 115951 - DNA, 31 bp, Artificial Sequence
  Description of Artificial Sequence: Synthetic oligonucleotide
catgggctgaagtgacagtgtgttcgtgttc

SEQ ID NO: 115952 - DNA, 33 bp, Artificial Sequence
  Description of Artificial Sequence: Synthetic oligonucleotide
atgggctgaagtgacagtgtgttcgtgttcttc

SEQ ID NO: 115953 - DNA, 32 bp, Artificial Sequence
  Description of Artificial Sequence: Synthetic oligonucleotide
tgggctgaagtgacagtgtgttcgtgttcttc

SEQ ID NO: 115954 - DNA, 31 bp, Artificial Sequence
  Description of Artificial Sequence: Synthetic oligonucleotide
gggctgaagtgacagtgtgttcgtgttcttc

SEQ ID NO: 115955 - DNA, 32 bp, Artificial Sequence
  Description of Artificial Sequence: Synthetic oligonucleotide
ggctgaagtgacagtgtgttcgtgttcttctg

SEQ ID NO: 115956 - DNA, 33 bp, Artificial Sequence
  Description of Artificial Sequence: Synthetic oligonucleotide
gctgaagtgacagtgtgttcgtgttcttctgag

SEQ ID NO: 115957 - DNA, 33 bp, Artificial Sequence
  Description of Artificial Sequence: Synthetic oligonucleotide
ctgaagtgacagtgtgttcgtgttcttctgagg

SEQ ID NO: 115958 - DNA, 34 bp, Artificial Sequence
  Description of Artificial Sequence: Synthetic oligonucleotide
tgaagtgacagtgtgttcgtgttcttctgaggtg

SEQ ID NO: 115959 - DNA, 33 bp, Artificial Sequence
  Description of Artificial Sequence: Synthetic oligonucleotide
gaagtgacagtgtgttcgtgttcttctgaggtg

SEQ ID NO: 115960 - DNA, 34 bp, Artificial Sequence
  Description of Artificial Sequence: Synthetic oligonucleotide
aagtgacagtgtgttcgtgttcttctgaggtgtc

SEQ ID NO: 115961 - DNA, 33 bp, Artificial Sequence
  Description of Artificial Sequence: Synthetic oligonucleotide
agtgacagtgtgttcgtgttcttctgaggtgtc

SEQ ID NO: 115962 - DNA, 32 bp, Artificial Sequence
  Description of Artificial Sequence: Synthetic oligonucleotide
gtgacagtgtgttcgtgttcttctgaggtgtc

SEQ ID NO: 115963 - DNA, 33 bp, Artificial Sequence
  Description of Artificial Sequence: Synthetic oligonucleotide
tgacagtgtgttcgtgttcttctgaggtgtcag

SEQ ID NO: 115964 - DNA, 32 bp, Artificial Sequence
  Description of Artificial Sequence: Synthetic oligonucleotide
gacagtgtgttcgtgttcttctgaggtgtcag

SEQ ID NO: 115965 - DNA, 32 bp, Artificial Sequence
  Description of Artificial Sequence: Synthetic oligonucleotide
acagtgtgttcgtgttcttctgaggtgtcagc

SEQ ID NO: 115966 - DNA, 31 bp, Artificial Sequence
  Description of Artificial Sequence: Synthetic oligonucleotide
cagtgtgttcgtgttcttctgaggtgtcagc

SEQ ID NO: 115967 - DNA, 34 bp, Artificial Sequence
  Description of Artificial Sequence: Synthetic oligonucleotide
agtgtgttcgtgttcttctgaggtgtcagcaaag

SEQ ID NO: 115968 - DNA, 33 bp, Artificial Sequence
  Description of Artificial Sequence: Synthetic oligonucleotide
gtgtgttcgtgttcttctgaggtgtcagcaaag

SEQ ID NO: 115969 - DNA, 36 bp, Artificial Sequence
  Description of Artificial Sequence: Synthetic oligonucleotide
tgtgttcgtgttcttctgaggtgtcagcaaagtttg

SEQ ID NO: 115970 - DNA, 35 bp, Artificial Sequence
  Description of Artificial Sequence: Synthetic oligonucleotide
gtgttcgtgttcttctgaggtgtcagcaaagtttg

SEQ ID NO: 115971 - DNA, 37 bp, Artificial Sequence
  Description of Artificial Sequence: Synthetic oligonucleotide
tgttcgtgttcttctgaggtgtcagcaaagtttgttc

SEQ ID NO: 115972 - DNA, 36 bp, Artificial Sequence
  Description of Artificial Sequence: Synthetic oligonucleotide
gttcgtgttcttctgaggtgtcagcaaagtttgttc

SEQ ID NO: 115973 - DNA, 38 bp, Artificial Sequence
  Description of Artificial Sequence: Synthetic oligonucleotide
ttcgtgttcttctgaggtgtcagcaaagtttgttctac

SEQ ID NO: 115974 - DNA, 37 bp, Artificial Sequence
  Description of Artificial Sequence: Synthetic oligonucleotide
tcgtgttcttctgaggtgtcagcaaagtttgttctac

SEQ ID NO: 115975 - DNA, 36 bp, Artificial Sequence
  Description of Artificial Sequence: Synthetic oligonucleotide
cgtgttcttctgaggtgtcagcaaagtttgttctac

SEQ ID NO: 115976 - DNA, 38 bp, Artificial Sequence
  Description of Artificial Sequence: Synthetic oligonucleotide
gtgttcttctgaggtgtcagcaaagtttgttctacatg

SEQ ID NO: 115977 - DNA, 38 bp, Artificial Sequence
  Description of Artificial Sequence: Synthetic oligonucleotide
tgttcttctgaggtgtcagcaaagtttgttctacatgc

SEQ ID NO: 115978 - DNA, 37 bp, Artificial Sequence
  Description of Artificial Sequence: Synthetic oligonucleotide
gttcttctgaggtgtcagcaaagtttgttctacatgc

SEQ ID NO: 115979 - DNA, 38 bp, Artificial Sequence
  Description of Artificial Sequence: Synthetic oligonucleotide
ttcttctgaggtgtcagcaaagtttgttctacatgcag

SEQ ID NO: 115980 - DNA, 37 bp, Artificial Sequence
  Description of Artificial Sequence: Synthetic oligonucleotide
tcttctgaggtgtcagcaaagtttgttctacatgcag

SEQ ID NO: 115981 - DNA, 36 bp, Artificial Sequence
  Description of Artificial Sequence: Synthetic oligonucleotide
cttctgaggtgtcagcaaagtttgttctacatgcag

SEQ ID NO: 115982 - DNA, 37 bp, Artificial Sequence
  Description of Artificial Sequence: Synthetic oligonucleotide
ttctgaggtgtcagcaaagtttgttctacatgcagtc

SEQ ID NO: 115983 - DNA, 36 bp, Artificial Sequence
  Description of Artificial Sequence: Synthetic oligonucleotide
tctgaggtgtcagcaaagtttgttctacatgcagtc

SEQ ID NO: 115984 - DNA, 35 bp, Artificial Sequence
  Description of Artificial Sequence: Synthetic oligonucleotide
ctgaggtgtcagcaaagtttgttctacatgcagtc

SEQ ID NO: 115985 - DNA, 35 bp, Artificial Sequence
  Description of Artificial Sequence: Synthetic oligonucleotide
tgaggtgtcagcaaagtttgttctacatgcagtcc

SEQ ID NO: 115986 - DNA, 34 bp, Artificial Sequence
  Description of Artificial Sequence: Synthetic oligonucleotide
gaggtgtcagcaaagtttgttctacatgcagtcc

SEQ ID NO: 115987 - DNA, 35 bp, Artificial Sequence
  Description of Artificial Sequence: Synthetic oligonucleotide
aggtgtcagcaaagtttgttctacatgcagtccag

SEQ ID NO: 115988 - DNA, 34 bp, Artificial Sequence
  Description of Artificial Sequence: Synthetic oligonucleotide
ggtgtcagcaaagtttgttctacatgcagtccag

SEQ ID NO: 115989 - DNA, 34 bp, Artificial Sequence
  Description of Artificial Sequence: Synthetic oligonucleotide
gtgtcagcaaagtttgttctacatgcagtccagc

SEQ ID NO: 115990 - DNA, 36 bp, Artificial Sequence
  Description of Artificial Sequence: Synthetic oligonucleotide
tgtcagcaaagtttgttctacatgcagtccagcttg

SEQ ID NO: 115991 - DNA, 35 bp, Artificial Sequence
  Description of Artificial Sequence: Synthetic oligonucleotide
gtcagcaaagtttgttctacatgcagtccagcttg

SEQ ID NO: 115992 - DNA, 36 bp, Artificial Sequence
  Description of Artificial Sequence: Synthetic oligonucleotide
tcagcaaagtttgttctacatgcagtccagcttgtg

SEQ ID NO: 115993 - DNA, 35 bp, Artificial Sequence
  Description of Artificial Sequence: Synthetic oligonucleotide
cagcaaagtttgttctacatgcagtccagcttgtg

SEQ ID NO: 115994 - DNA, 37 bp, Artificial Sequence
  Description of Artificial Sequence: Synthetic oligonucleotide
agcaaagtttgttctacatgcagtccagcttgtgaag

SEQ ID NO: 115995 - DNA, 36 bp, Artificial Sequence
  Description of Artificial Sequence: Synthetic oligonucleotide
gcaaagtttgttctacatgcagtccagcttgtgaag

SEQ ID NO: 115996 - DNA, 36 bp, Artificial Sequence
  Description of Artificial Sequence: Synthetic oligonucleotide
caaagtttgttctacatgcagtccagcttgtgaagc

SEQ ID NO: 115997 - DNA, 39 bp, Artificial Sequence
  Description of Artificial Sequence: Synthetic oligonucleotide
aaagtttgttctacatgcagtccagcttgtgaagcaaag

SEQ ID NO: 115998 - DNA, 38 bp, Artificial Sequence
  Description of Artificial Sequence: Synthetic oligonucleotide
aagtttgttctacatgcagtccagcttgtgaagcaaag

SEQ ID NO: 115999 - DNA, 37 bp, Artificial Sequence
  Description of Artificial Sequence: Synthetic oligonucleotide
agtttgttctacatgcagtccagcttgtgaagcaaag

SEQ ID NO: 116000 - DNA, 36 bp, Artificial Sequence
  Description of Artificial Sequence: Synthetic oligonucleotide
gtttgttctacatgcagtccagcttgtgaagcaaag

SEQ ID NO: 116001 - DNA, 37 bp, Artificial Sequence
  Description of Artificial Sequence: Synthetic oligonucleotide
tttgttctacatgcagtccagcttgtgaagcaaagag

SEQ ID NO: 116002 - DNA, 36 bp, Artificial Sequence
  Description of Artificial Sequence: Synthetic oligonucleotide
ttgttctacatgcagtccagcttgtgaagcaaagag

SEQ ID NO: 116003 - DNA, 35 bp, Artificial Sequence
  Description of Artificial Sequence: Synthetic oligonucleotide
tgttctacatgcagtccagcttgtgaagcaaagag

SEQ ID NO: 116004 - DNA, 34 bp, Artificial Sequence
  Description of Artificial Sequence: Synthetic oligonucleotide
gttctacatgcagtccagcttgtgaagcaaagag

SEQ ID NO: 116005 - DNA, 34 bp, Artificial Sequence
  Description of Artificial Sequence: Synthetic oligonucleotide
ttctacatgcagtccagcttgtgaagcaaagagc

SEQ ID NO: 116006 - DNA, 33 bp, Artificial Sequence
  Description of Artificial Sequence: Synthetic oligonucleotide
tctacatgcagtccagcttgtgaagcaaagagc

SEQ ID NO: 116007 - DNA, 32 bp, Artificial Sequence
  Description of Artificial Sequence: Synthetic oligonucleotide
ctacatgcagtccagcttgtgaagcaaagagc

SEQ ID NO: 116008 - DNA, 36 bp, Artificial Sequence
  Description of Artificial Sequence: Synthetic oligonucleotide
tacatgcagtccagcttgtgaagcaaagagcatatc

SEQ ID NO: 116009 - DNA, 35 bp, Artificial Sequence
  Description of Artificial Sequence: Synthetic oligonucleotide
acatgcagtccagcttgtgaagcaaagagcatatc

SEQ ID NO: 116010 - DNA, 34 bp, Artificial Sequence
  Description of Artificial Sequence: Synthetic oligonucleotide
catgcagtccagcttgtgaagcaaagagcatatc

SEQ ID NO: 116011 - DNA, 34 bp, Artificial Sequence
  Description of Artificial Sequence: Synthetic oligonucleotide
atgcagtccagcttgtgaagcaaagagcatatcg

SEQ ID NO: 116012 - DNA, 33 bp, Artificial Sequence
  Description of Artificial Sequence: Synthetic oligonucleotide
tgcagtccagcttgtgaagcaaagagcatatcg

SEQ ID NO: 116013 - DNA, 32 bp, Artificial Sequence
  Description of Artificial Sequence: Synthetic oligonucleotide
gcagtccagcttgtgaagcaaagagcatatcg

SEQ ID NO: 116014 - DNA, 34 bp, Artificial Sequence
  Description of Artificial Sequence: Synthetic oligonucleotide
cagtccagcttgtgaagcaaagagcatatcgaag

SEQ ID NO: 116015 - DNA, 34 bp, Artificial Sequence
  Description of Artificial Sequence: Synthetic oligonucleotide
agtccagcttgtgaagcaaagagcatatcgaagc

SEQ ID NO: 116016 - DNA, 33 bp, Artificial Sequence
  Description of Artificial Sequence: Synthetic oligonucleotide
gtccagcttgtgaagcaaagagcatatcgaagc

SEQ ID NO: 116017 - DNA, 33 bp, Artificial Sequence
  Description of Artificial Sequence: Synthetic oligonucleotide
tccagcttgtgaagcaaagagcatatcgaagcc

SEQ ID NO: 116018 - DNA, 32 bp, Artificial Sequence
  Description of Artificial Sequence: Synthetic oligonucleotide
ccagcttgtgaagcaaagagcatatcgaagcc

SEQ ID NO: 116019 - DNA, 34 bp, Artificial Sequence
  Description of Artificial Sequence: Synthetic oligonucleotide
cagcttgtgaagcaaagagcatatcgaagccatg

SEQ ID NO: 116020 - DNA, 38 bp, Artificial Sequence
  Description of Artificial Sequence: Synthetic oligonucleotide
agcttgtgaagcaaagagcatatcgaagccatgaattc

SEQ ID NO: 116021 - DNA, 37 bp, Artificial Sequence
  Description of Artificial Sequence: Synthetic oligonucleotide
gcttgtgaagcaaagagcatatcgaagccatgaattc

SEQ ID NO: 116022 - DNA, 42 bp, Artificial Sequence
  Description of Artificial Sequence: Synthetic oligonucleotide
cttgtgaagcaaagagcatatcgaagccatgaattctataag

SEQ ID NO: 116023 - DNA, 46 bp, Artificial Sequence
  Description of Artificial Sequence: Synthetic oligonucleotide
ttgtgaagcaaagagcatatcgaagccatgaattctataagttttg

SEQ ID NO: 116024 - DNA, 45 bp, Artificial Sequence
  Description of Artificial Sequence: Synthetic oligonucleotide
tgtgaagcaaagagcatatcgaagccatgaattctataagttttg

SEQ ID NO: 116025 - DNA, 44 bp, Artificial Sequence
  Description of Artificial Sequence: Synthetic oligonucleotide
gtgaagcaaagagcatatcgaagccatgaattctataagttttg

SEQ ID NO: 116026 - DNA, 46 bp, Artificial Sequence
  Description of Artificial Sequence: Synthetic oligonucleotide
tgaagcaaagagcatatcgaagccatgaattctataagttttgttc

SEQ ID NO: 116027 - DNA, 45 bp, Artificial Sequence
  Description of Artificial Sequence: Synthetic oligonucleotide
gaagcaaagagcatatcgaagccatgaattctataagttttgttc

SEQ ID NO: 116028 - DNA, 46 bp, Artificial Sequence
  Description of Artificial Sequence: Synthetic oligonucleotide
aagcaaagagcatatcgaagccatgaattctataagttttgttctc

SEQ ID NO: 116029 - DNA, 45 bp, Artificial Sequence
  Description of Artificial Sequence: Synthetic oligonucleotide
agcaaagagcatatcgaagccatgaattctataagttttgttctc

SEQ ID NO: 116030 - DNA, 44 bp, Artificial Sequence
  Description of Artificial Sequence: Synthetic oligonucleotide
gcaaagagcatatcgaagccatgaattctataagttttgttctc

SEQ ID NO: 116031 - DNA, 46 bp, Artificial Sequence
  Description of Artificial Sequence: Synthetic oligonucleotide
caaagagcatatcgaagccatgaattctataagttttgttctcttc

SEQ ID NO: 116032 - DNA, 46 bp, Artificial Sequence
  Description of Artificial Sequence: Synthetic oligonucleotide
aaagagcatatcgaagccatgaattctataagttttgttctcttcc

SEQ ID NO: 116033 - DNA, 45 bp, Artificial Sequence
  Description of Artificial Sequence: Synthetic oligonucleotide
aagagcatatcgaagccatgaattctataagttttgttctcttcc

SEQ ID NO: 116034 - DNA, 44 bp, Artificial Sequence
  Description of Artificial Sequence: Synthetic oligonucleotide
agagcatatcgaagccatgaattctataagttttgttctcttcc

SEQ ID NO: 116035 - DNA, 43 bp, Artificial Sequence
  Description of Artificial Sequence: Synthetic oligonucleotide
gagcatatcgaagccatgaattctataagttttgttctcttcc

SEQ ID NO: 116036 - DNA, 44 bp, Artificial Sequence
  Description of Artificial Sequence: Synthetic oligonucleotide
agcatatcgaagccatgaattctataagttttgttctcttccag

SEQ ID NO: 116037 - DNA, 43 bp, Artificial Sequence
  Description of Artificial Sequence: Synthetic oligonucleotide
gcatatcgaagccatgaattctataagttttgttctcttccag

SEQ ID NO: 116038 - DNA, 44 bp, Artificial Sequence
  Description of Artificial Sequence: Synthetic oligonucleotide
catatcgaagccatgaattctataagttttgttctcttccagag

SEQ ID NO: 116039 - DNA, 47 bp, Artificial Sequence
  Description of Artificial Sequence: Synthetic oligonucleotide
atatcgaagccatgaattctataagttttgttctcttccagagaaag

SEQ ID NO: 116040 - DNA, 46 bp, Artificial Sequence
  Description of Artificial Sequence: Synthetic oligonucleotide
tatcgaagccatgaattctataagttttgttctcttccagagaaag

SEQ ID NO: 116041 - DNA, 45 bp, Artificial Sequence
  Description of Artificial Sequence: Synthetic oligonucleotide
atcgaagccatgaattctataagttttgttctcttccagagaaag

SEQ ID NO: 116042 - DNA, 44 bp, Artificial Sequence
  Description of Artificial Sequence: Synthetic oligonucleotide
tcgaagccatgaattctataagttttgttctcttccagagaaag

SEQ ID NO: 116043 - DNA, 43 bp, Artificial Sequence
  Description of Artificial Sequence: Synthetic oligonucleotide
cgaagccatgaattctataagttttgttctcttccagagaaag

SEQ ID NO: 116044 - DNA, 43 bp, Artificial Sequence
  Description of Artificial Sequence: Synthetic oligonucleotide
gaagccatgaattctataagttttgttctcttccagagaaagg

SEQ ID NO: 116045 - DNA, 45 bp, Artificial Sequence
  Description of Artificial Sequence: Synthetic oligonucleotide
aagccatgaattctataagttttgttctcttccagagaaaggaac

SEQ ID NO: 116046 - DNA, 44 bp, Artificial Sequence
  Description of Artificial Sequence: Synthetic oligonucleotide
agccatgaattctataagttttgttctcttccagagaaaggaac

SEQ ID NO: 116047 - DNA, 43 bp, Artificial Sequence
  Description of Artificial Sequence: Synthetic oligonucleotide
gccatgaattctataagttttgttctcttccagagaaaggaac

SEQ ID NO: 116048 - DNA, 44 bp, Artificial Sequence
  Description of Artificial Sequence: Synthetic oligonucleotide
ccatgaattctataagttttgttctcttccagagaaaggaacac

SEQ ID NO: 116049 - DNA, 45 bp, Artificial Sequence
  Description of Artificial Sequence: Synthetic oligonucleotide
catgaattctataagttttgttctcttccagagaaaggaacactg

SEQ ID NO: 116050 - DNA, 46 bp, Artificial Sequence
  Description of Artificial Sequence: Synthetic oligonucleotide
atgaattctataagttttgttctcttccagagaaaggaacactgac

SEQ ID NO: 116051 - DNA, 45 bp, Artificial Sequence
  Description of Artificial Sequence: Synthetic oligonucleotide
tgaattctataagttttgttctcttccagagaaaggaacactgac

SEQ ID NO: 116052 - DNA, 44 bp, Artificial Sequence
  Description of Artificial Sequence: Synthetic oligonucleotide
gaattctataagttttgttctcttccagagaaaggaacactgac

SEQ ID NO: 116053 - DNA, 45 bp, Artificial Sequence
  Description of Artificial Sequence: Synthetic oligonucleotide
aattctataagttttgttctcttccagagaaaggaacactgactg

SEQ ID NO: 116054 - DNA, 44 bp, Artificial Sequence
  Description of Artificial Sequence: Synthetic oligonucleotide
attctataagttttgttctcttccagagaaaggaacactgactg

SEQ ID NO: 116055 - DNA, 43 bp, Artificial Sequence
  Description of Artificial Sequence: Synthetic oligonucleotide
ttctataagttttgttctcttccagagaaaggaacactgactg

SEQ ID NO: 116056 - DNA, 42 bp, Artificial Sequence
  Description of Artificial Sequence: Synthetic oligonucleotide
tctataagttttgttctcttccagagaaaggaacactgactg

SEQ ID NO: 116057 - DNA, 41 bp, Artificial Sequence
  Description of Artificial Sequence: Synthetic oligonucleotide
ctataagttttgttctcttccagagaaaggaacactgactg

SEQ ID NO: 116058 - DNA, 43 bp, Artificial Sequence
  Description of Artificial Sequence: Synthetic oligonucleotide
tataagttttgttctcttccagagaaaggaacactgactgaag

SEQ ID NO: 116059 - DNA, 42 bp, Artificial Sequence
  Description of Artificial Sequence: Synthetic oligonucleotide
ataagttttgttctcttccagagaaaggaacactgactgaag

SEQ ID NO: 116060 - DNA, 41 bp, Artificial Sequence
  Description of Artificial Sequence: Synthetic oligonucleotide
taagttttgttctcttccagagaaaggaacactgactgaag

SEQ ID NO: 116061 - DNA, 40 bp, Artificial Sequence
  Description of Artificial Sequence: Synthetic oligonucleotide
aagttttgttctcttccagagaaaggaacactgactgaag

SEQ ID NO: 116062 - DNA, 39 bp, Artificial Sequence
  Description of Artificial Sequence: Synthetic oligonucleotide
agttttgttctcttccagagaaaggaacactgactgaag

SEQ ID NO: 116063 - DNA, 38 bp, Artificial Sequence
  Description of Artificial Sequence: Synthetic oligonucleotide
gttttgttctcttccagagaaaggaacactgactgaag

SEQ ID NO: 116064 - DNA, 38 bp, Artificial Sequence
  Description of Artificial Sequence: Synthetic oligonucleotide
ttttgttctcttccagagaaaggaacactgactgaagc

SEQ ID NO: 116065 - DNA, 37 bp, Artificial Sequence
  Description of Artificial Sequence: Synthetic oligonucleotide
tttgttctcttccagagaaaggaacactgactgaagc

SEQ ID NO: 116066 - DNA, 36 bp, Artificial Sequence
  Description of Artificial Sequence: Synthetic oligonucleotide
ttgttctcttccagagaaaggaacactgactgaagc

SEQ ID NO: 116067 - DNA, 35 bp, Artificial Sequence
  Description of Artificial Sequence: Synthetic oligonucleotide
tgttctcttccagagaaaggaacactgactgaagc

SEQ ID NO: 116068 - DNA, 34 bp, Artificial Sequence
  Description of Artificial Sequence: Synthetic oligonucleotide
gttctcttccagagaaaggaacactgactgaagc

SEQ ID NO: 116069 - DNA, 38 bp, Artificial Sequence
  Description of Artificial Sequence: Synthetic oligonucleotide
ttctcttccagagaaaggaacactgactgaagcttttc

SEQ ID NO: 116070 - DNA, 37 bp, Artificial Sequence
  Description of Artificial Sequence: Synthetic oligonucleotide
tctcttccagagaaaggaacactgactgaagcttttc

SEQ ID NO: 116071 - DNA, 36 bp, Artificial Sequence
  Description of Artificial Sequence: Synthetic oligonucleotide
ctcttccagagaaaggaacactgactgaagcttttc

SEQ ID NO: 116072 - DNA, 36 bp, Artificial Sequence
  Description of Artificial Sequence: Synthetic oligonucleotide
tcttccagagaaaggaacactgactgaagcttttcc

SEQ ID NO: 116073 - DNA, 35 bp, Artificial Sequence
  Description of Artificial Sequence: Synthetic oligonucleotide
cttccagagaaaggaacactgactgaagcttttcc

SEQ ID NO: 116074 - DNA, 36 bp, Artificial Sequence
  Description of Artificial Sequence: Synthetic oligonucleotide
ttccagagaaaggaacactgactgaagcttttcctg

SEQ ID NO: 116075 - DNA, 35 bp, Artificial Sequence
  Description of Artificial Sequence: Synthetic oligonucleotide
tccagagaaaggaacactgactgaagcttttcctg

SEQ ID NO: 116076 - DNA, 34 bp, Artificial Sequence
  Description of Artificial Sequence: Synthetic oligonucleotide
ccagagaaaggaacactgactgaagcttttcctg

SEQ ID NO: 116077 - DNA, 35 bp, Artificial Sequence
  Description of Artificial Sequence: Synthetic oligonucleotide
cagagaaaggaacactgactgaagcttttcctgtc

SEQ ID NO: 116078 - DNA, 35 bp, Artificial Sequence
  Description of Artificial Sequence: Synthetic oligonucleotide
agagaaaggaacactgactgaagcttttcctgtcc

SEQ ID NO: 116079 - DNA, 34 bp, Artificial Sequence
  Description of Artificial Sequence: Synthetic oligonucleotide
gagaaaggaacactgactgaagcttttcctgtcc

SEQ ID NO: 116080 - DNA, 36 bp, Artificial Sequence
  Description of Artificial Sequence: Synthetic oligonucleotide
agaaaggaacactgactgaagcttttcctgtcctag

SEQ ID NO: 116081 - DNA, 35 bp, Artificial Sequence
  Description of Artificial Sequence: Synthetic oligonucleotide
gaaaggaacactgactgaagcttttcctgtcctag

SEQ ID NO: 116082 - DNA, 35 bp, Artificial Sequence
  Description of Artificial Sequence: Synthetic oligonucleotide
aaaggaacactgactgaagcttttcctgtcctagg

SEQ ID NO: 116083 - DNA, 34 bp, Artificial Sequence
  Description of Artificial Sequence: Synthetic oligonucleotide
aaggaacactgactgaagcttttcctgtcctagg

SEQ ID NO: 116084 - DNA, 33 bp, Artificial Sequence
  Description of Artificial Sequence: Synthetic oligonucleotide
aggaacactgactgaagcttttcctgtcctagg

SEQ ID NO: 116085 - DNA, 32 bp, Artificial Sequence
  Description of Artificial Sequence: Synthetic oligonucleotide
ggaacactgactgaagcttttcctgtcctagg

SEQ ID NO: 116086 - DNA, 33 bp, Artificial Sequence
  Description of Artificial Sequence: Synthetic oligonucleotide
gaacactgactgaagcttttcctgtcctaggtg

SEQ ID NO: 116087 - DNA, 33 bp, Artificial Sequence
  Description of Artificial Sequence: Synthetic oligonucleotide
aacactgactgaagcttttcctgtcctaggtgg

SEQ ID NO: 116088 - DNA, 32 bp, Artificial Sequence
  Description of Artificial Sequence: Synthetic oligonucleotide
acactgactgaagcttttcctgtcctaggtgg

SEQ ID NO: 116089 - DNA, 31 bp, Artificial Sequence
  Description of Artificial Sequence: Synthetic oligonucleotide
cactgactgaagcttttcctgtcctaggtgg

SEQ ID NO: 116090 - DNA, 35 bp, Artificial Sequence
  Description of Artificial Sequence: Synthetic oligonucleotide
actgactgaagcttttcctgtcctaggtggaaaag

SEQ ID NO: 116091 - DNA, 34 bp, Artificial Sequence
  Description of Artificial Sequence: Synthetic oligonucleotide
ctgactgaagcttttcctgtcctaggtggaaaag

SEQ ID NO: 116092 - DNA, 34 bp, Artificial Sequence
  Description of Artificial Sequence: Synthetic oligonucleotide
tgactgaagcttttcctgtcctaggtggaaaagc

SEQ ID NO: 116093 - DNA, 33 bp, Artificial Sequence
  Description of Artificial Sequence: Synthetic oligonucleotide
gactgaagcttttcctgtcctaggtggaaaagc

SEQ ID NO: 116094 - DNA, 37 bp, Artificial Sequence
  Description of Artificial Sequence: Synthetic oligonucleotide
actgaagcttttcctgtcctaggtggaaaagcaattg

SEQ ID NO: 116095 - DNA, 36 bp, Artificial Sequence
  Description of Artificial Sequence: Synthetic oligonucleotide
ctgaagcttttcctgtcctaggtggaaaagcaattg

SEQ ID NO: 116096 - DNA, 42 bp, Artificial Sequence
  Description of Artificial Sequence: Synthetic oligonucleotide
tgaagcttttcctgtcctaggtggaaaagcaattgaattttg

SEQ ID NO: 116097 - DNA, 41 bp, Artificial Sequence
  Description of Artificial Sequence: Synthetic oligonucleotide
gaagcttttcctgtcctaggtggaaaagcaattgaattttg

SEQ ID NO: 116098 - DNA, 41 bp, Artificial Sequence
  Description of Artificial Sequence: Synthetic oligonucleotide
aagcttttcctgtcctaggtggaaaagcaattgaattttgc

SEQ ID NO: 116099 - DNA, 40 bp, Artificial Sequence
  Description of Artificial Sequence: Synthetic oligonucleotide
agcttttcctgtcctaggtggaaaagcaattgaattttgc

SEQ ID NO: 116100 - DNA, 39 bp, Artificial Sequence
  Description of Artificial Sequence: Synthetic oligonucleotide
gcttttcctgtcctaggtggaaaagcaattgaattttgc

SEQ ID NO: 116101 - DNA, 42 bp, Artificial Sequence
  Description of Artificial Sequence: Synthetic oligonucleotide
cttttcctgtcctaggtggaaaagcaattgaattttgcattg

SEQ ID NO: 116102 - DNA, 42 bp, Artificial Sequence
  Description of Artificial Sequence: Synthetic oligonucleotide
ttttcctgtcctaggtggaaaagcaattgaattttgcattgc

SEQ ID NO: 116103 - DNA, 41 bp, Artificial Sequence
  Description of Artificial Sequence: Synthetic oligonucleotide
tttcctgtcctaggtggaaaagcaattgaattttgcattgc

SEQ ID NO: 116104 - DNA, 40 bp, Artificial Sequence
  Description of Artificial Sequence: Synthetic oligonucleotide
ttcctgtcctaggtggaaaagcaattgaattttgcattgc

SEQ ID NO: 116105 - DNA, 39 bp, Artificial Sequence
  Description of Artificial Sequence: Synthetic oligonucleotide
tcctgtcctaggtggaaaagcaattgaattttgcattgc

SEQ ID NO: 116106 - DNA, 38 bp, Artificial Sequence
  Description of Artificial Sequence: Synthetic oligonucleotide
cctgtcctaggtggaaaagcaattgaattttgcattgc

SEQ ID NO: 116107 - DNA, 39 bp, Artificial Sequence
  Description of Artificial Sequence: Synthetic oligonucleotide
ctgtcctaggtggaaaagcaattgaattttgcattgctc

SEQ ID NO: 116108 - DNA, 39 bp, Artificial Sequence
  Description of Artificial Sequence: Synthetic oligonucleotide
tgtcctaggtggaaaagcaattgaattttgcattgctcg

SEQ ID NO: 116109 - DNA, 38 bp, Artificial Sequence
  Description of Artificial Sequence: Synthetic oligonucleotide
gtcctaggtggaaaagcaattgaattttgcattgctcg

SEQ ID NO: 116110 - DNA, 40 bp, Artificial Sequence
  Description of Artificial Sequence: Synthetic oligonucleotide
tcctaggtggaaaagcaattgaattttgcattgctcgttg

SEQ ID NO: 116111 - DNA, 39 bp, Artificial Sequence
  Description of Artificial Sequence: Synthetic oligonucleotide
cctaggtggaaaagcaattgaattttgcattgctcgttg

SEQ ID NO: 116112 - DNA, 39 bp, Artificial Sequence
  Description of Artificial Sequence: Synthetic oligonucleotide
ctaggtggaaaagcaattgaattttgcattgctcgttgg

SEQ ID NO: 116113 - DNA, 40 bp, Artificial Sequence
  Description of Artificial Sequence: Synthetic oligonucleotide
taggtggaaaagcaattgaattttgcattgctcgttggtg

SEQ ID NO: 116114 - DNA, 39 bp, Artificial Sequence
  Description of Artificial Sequence: Synthetic oligonucleotide
aggtggaaaagcaattgaattttgcattgctcgttggtg

SEQ ID NO: 116115 - DNA, 38 bp, Artificial Sequence
  Description of Artificial Sequence: Synthetic oligonucleotide
ggtggaaaagcaattgaattttgcattgctcgttggtg

SEQ ID NO: 116116 - DNA, 38 bp, Artificial Sequence
  Description of Artificial Sequence: Synthetic oligonucleotide
gtggaaaagcaattgaattttgcattgctcgttggtgg

SEQ ID NO: 116117 - DNA, 38 bp, Artificial Sequence
  Description of Artificial Sequence: Synthetic oligonucleotide
tggaaaagcaattgaattttgcattgctcgttggtggg

SEQ ID NO: 116118 - DNA, 37 bp, Artificial Sequence
  Description of Artificial Sequence: Synthetic oligonucleotide
ggaaaagcaattgaattttgcattgctcgttggtggg

SEQ ID NO: 116119 - DNA, 37 bp, Artificial Sequence
  Description of Artificial Sequence: Synthetic oligonucleotide
gaaaagcaattgaattttgcattgctcgttggtgggc

SEQ ID NO: 116120 - DNA, 39 bp, Artificial Sequence
  Description of Artificial Sequence: Synthetic oligonucleotide
aaaagcaattgaattttgcattgctcgttggtgggcaag

SEQ ID NO: 116121 - DNA, 38 bp, Artificial Sequence
  Description of Artificial Sequence: Synthetic oligonucleotide
aaagcaattgaattttgcattgctcgttggtgggcaag

SEQ ID NO: 116122 - DNA, 37 bp, Artificial Sequence
  Description of Artificial Sequence: Synthetic oligonucleotide
aagcaattgaattttgcattgctcgttggtgggcaag

SEQ ID NO: 116123 - DNA, 36 bp, Artificial Sequence
  Description of Artificial Sequence: Synthetic oligonucleotide
agcaattgaattttgcattgctcgttggtgggcaag

SEQ ID NO: 116124 - DNA, 35 bp, Artificial Sequence
  Description of Artificial Sequence: Synthetic oligonucleotide
gcaattgaattttgcattgctcgttggtgggcaag

SEQ ID NO: 116125 - DNA, 36 bp, Artificial Sequence
  Description of Artificial Sequence: Synthetic oligonucleotide
caattgaattttgcattgctcgttggtgggcaagtc

SEQ ID NO: 116126 - DNA, 37 bp, Artificial Sequence
  Description of Artificial Sequence: Synthetic oligonucleotide
aattgaattttgcattgctcgttggtgggcaagtctc

SEQ ID NO: 116127 - DNA, 36 bp, Artificial Sequence
  Description of Artificial Sequence: Synthetic oligonucleotide
attgaattttgcattgctcgttggtgggcaagtctc

SEQ ID NO: 116128 - DNA, 35 bp, Artificial Sequence
  Description of Artificial Sequence: Synthetic oligonucleotide
ttgaattttgcattgctcgttggtgggcaagtctc

SEQ ID NO: 116129 - DNA, 34 bp, Artificial Sequence
  Description of Artificial Sequence: Synthetic oligonucleotide
tgaattttgcattgctcgttggtgggcaagtctc

SEQ ID NO: 116130 - DNA, 33 bp, Artificial Sequence
  Description of Artificial Sequence: Synthetic oligonucleotide
gaattttgcattgctcgttggtgggcaagtctc

SEQ ID NO: 116131 - DNA, 34 bp, Artificial Sequence
  Description of Artificial Sequence: Synthetic oligonucleotide
aattttgcattgctcgttggtgggcaagtctcag

SEQ ID NO: 116132 - DNA, 33 bp, Artificial Sequence
  Description of Artificial Sequence: Synthetic oligonucleotide
attttgcattgctcgttggtgggcaagtctcag

SEQ ID NO: 116133 - DNA, 32 bp, Artificial Sequence
  Description of Artificial Sequence: Synthetic oligonucleotide
ttttgcattgctcgttggtgggcaagtctcag

SEQ ID NO: 116134 - DNA, 31 bp, Artificial Sequence
  Description of Artificial Sequence: Synthetic oligonucleotide
tttgcattgctcgttggtgggcaagtctcag

SEQ ID NO: 116135 - DNA, 30 bp, Artificial Sequence
  Description of Artificial Sequence: Synthetic oligonucleotide
ttgcattgctcgttggtgggcaagtctcag

SEQ ID NO: 116136 - DNA, 29 bp, Artificial Sequence
  Description of Artificial Sequence: Synthetic oligonucleotide
tgcattgctcgttggtgggcaagtctcag

SEQ ID NO: 116137 - DNA, 28 bp, Artificial Sequence
  Description of Artificial Sequence: Synthetic oligonucleotide
gcattgctcgttggtgggcaagtctcag

SEQ ID NO: 116138 - DNA, 29 bp, Artificial Sequence
  Description of Artificial Sequence: Synthetic oligonucleotide
cattgctcgttggtgggcaagtctcagtg

SEQ ID NO: 116139 - DNA, 31 bp, Artificial Sequence
  Description of Artificial Sequence: Synthetic oligonucleotide
attgctcgttggtgggcaagtctcagtgatg

SEQ ID NO: 116140 - DNA, 30 bp, Artificial Sequence
  Description of Artificial Sequence: Synthetic oligonucleotide
ttgctcgttggtgggcaagtctcagtgatg

SEQ ID NO: 116141 - DNA, 29 bp, Artificial Sequence
  Description of Artificial Sequence: Synthetic oligonucleotide
tgctcgttggtgggcaagtctcagtgatg

SEQ ID NO: 116142 - DNA, 28 bp, Artificial Sequence
  Description of Artificial Sequence: Synthetic oligonucleotide
gctcgttggtgggcaagtctcagtgatg

SEQ ID NO: 116143 - DNA, 29 bp, Artificial Sequence
  Description of Artificial Sequence: Synthetic oligonucleotide
ctcgttggtgggcaagtctcagtgatgtc

SEQ ID NO: 116144 - DNA, 31 bp, Artificial Sequence
  Description of Artificial Sequence: Synthetic oligonucleotide
tcgttggtgggcaagtctcagtgatgtcaac

SEQ ID NO: 116145 - DNA, 30 bp, Artificial Sequence
  Description of Artificial Sequence: Synthetic oligonucleotide
cgttggtgggcaagtctcagtgatgtcaac

SEQ ID NO: 116146 - DNA, 33 bp, Artificial Sequence
  Description of Artificial Sequence: Synthetic oligonucleotide
gttggtgggcaagtctcagtgatgtcaacattg

SEQ ID NO: 116147 - DNA, 39 bp, Artificial Sequence
  Description of Artificial Sequence: Synthetic oligonucleotide
ttggtgggcaagtctcagtgatgtcaacattgattatac

SEQ ID NO: 116148 - DNA, 38 bp, Artificial Sequence
  Description of Artificial Sequence: Synthetic oligonucleotide
tggtgggcaagtctcagtgatgtcaacattgattatac

SEQ ID NO: 116149 - DNA, 37 bp, Artificial Sequence
  Description of Artificial Sequence: Synthetic oligonucleotide
ggtgggcaagtctcagtgatgtcaacattgattatac

SEQ ID NO: 116150 - DNA, 37 bp, Artificial Sequence
  Description of Artificial Sequence: Synthetic oligonucleotide
gtgggcaagtctcagtgatgtcaacattgattatacc

SEQ ID NO: 116151 - DNA, 41 bp, Artificial Sequence
  Description of Artificial Sequence: Synthetic oligonucleotide
tgggcaagtctcagtgatgtcaacattgattataccatttc

SEQ ID NO: 116152 - DNA, 40 bp, Artificial Sequence
  Description of Artificial Sequence: Synthetic oligonucleotide
gggcaagtctcagtgatgtcaacattgattataccatttc

SEQ ID NO: 116153 - DNA, 43 bp, Artificial Sequence
  Description of Artificial Sequence: Synthetic oligonucleotide
ggcaagtctcagtgatgtcaacattgattataccatttctttc

SEQ ID NO: 116154 - DNA, 43 bp, Artificial Sequence
  Description of Artificial Sequence: Synthetic oligonucleotide
gcaagtctcagtgatgtcaacattgattataccatttctttcc

SEQ ID NO: 116155 - DNA, 45 bp, Artificial Sequence
  Description of Artificial Sequence: Synthetic oligonucleotide
caagtctcagtgatgtcaacattgattataccatttctttccatg

SEQ ID NO: 116156 - DNA, 45 bp, Artificial Sequence
  Description of Artificial Sequence: Synthetic oligonucleotide
aagtctcagtgatgtcaacattgattataccatttctttccatgg

SEQ ID NO: 116157 - DNA, 44 bp, Artificial Sequence
  Description of Artificial Sequence: Synthetic oligonucleotide
agtctcagtgatgtcaacattgattataccatttctttccatgg

SEQ ID NO: 116158 - DNA, 43 bp, Artificial Sequence
  Description of Artificial Sequence: Synthetic oligonucleotide
gtctcagtgatgtcaacattgattataccatttctttccatgg

SEQ ID NO: 116159 - DNA, 43 bp, Artificial Sequence
  Description of Artificial Sequence: Synthetic oligonucleotide
tctcagtgatgtcaacattgattataccatttctttccatggg

SEQ ID NO: 116160 - DNA, 42 bp, Artificial Sequence
  Description of Artificial Sequence: Synthetic oligonucleotide
ctcagtgatgtcaacattgattataccatttctttccatggg

SEQ ID NO: 116161 - DNA, 45 bp, Artificial Sequence
  Description of Artificial Sequence: Synthetic oligonucleotide
tcagtgatgtcaacattgattataccatttctttccatgggatag

SEQ ID NO: 116162 - DNA, 44 bp, Artificial Sequence
  Description of Artificial Sequence: Synthetic oligonucleotide
cagtgatgtcaacattgattataccatttctttccatgggatag

SEQ ID NO: 116163 - DNA, 45 bp, Artificial Sequence
  Description of Artificial Sequence: Synthetic oligonucleotide
agtgatgtcaacattgattataccatttctttccatgggatagtg

SEQ ID NO: 116164 - DNA, 44 bp, Artificial Sequence
  Description of Artificial Sequence: Synthetic oligonucleotide
gtgatgtcaacattgattataccatttctttccatgggatagtg

SEQ ID NO: 116165 - DNA, 45 bp, Artificial Sequence
  Description of Artificial Sequence: Synthetic oligonucleotide
tgatgtcaacattgattataccatttctttccatgggatagtgtg

SEQ ID NO: 116166 - DNA, 44 bp, Artificial Sequence
  Description of Artificial Sequence: Synthetic oligonucleotide
gatgtcaacattgattataccatttctttccatgggatagtgtg

SEQ ID NO: 116167 - DNA, 46 bp, Artificial Sequence
  Description of Artificial Sequence: Synthetic oligonucleotide
atgtcaacattgattataccatttctttccatgggatagtgtgtac

SEQ ID NO: 116168 - DNA, 45 bp, Artificial Sequence
  Description of Artificial Sequence: Synthetic oligonucleotide
tgtcaacattgattataccatttctttccatgggatagtgtgtac

SEQ ID NO: 116169 - DNA, 44 bp, Artificial Sequence
  Description of Artificial Sequence: Synthetic oligonucleotide
gtcaacattgattataccatttctttccatgggatagtgtgtac

SEQ ID NO: 116170 - DNA, 45 bp, Artificial Sequence
  Description of Artificial Sequence: Synthetic oligonucleotide
tcaacattgattataccatttctttccatgggatagtgtgtactg

SEQ ID NO: 116171 - DNA, 44 bp, Artificial Sequence
  Description of Artificial Sequence: Synthetic oligonucleotide
caacattgattataccatttctttccatgggatagtgtgtactg

SEQ ID NO: 116172 - DNA, 44 bp, Artificial Sequence
  Description of Artificial Sequence: Synthetic oligonucleotide
aacattgattataccatttctttccatgggatagtgtgtactgc

SEQ ID NO: 116173 - DNA, 43 bp, Artificial Sequence
  Description of Artificial Sequence: Synthetic oligonucleotide
acattgattataccatttctttccatgggatagtgtgtactgc

SEQ ID NO: 116174 - DNA, 42 bp, Artificial Sequence
  Description of Artificial Sequence: Synthetic oligonucleotide
cattgattataccatttctttccatgggatagtgtgtactgc

SEQ ID NO: 116175 - DNA, 43 bp, Artificial Sequence
  Description of Artificial Sequence: Synthetic oligonucleotide
attgattataccatttctttccatgggatagtgtgtactgctc

SEQ ID NO: 116176 - DNA, 42 bp, Artificial Sequence
  Description of Artificial Sequence: Synthetic oligonucleotide
ttgattataccatttctttccatgggatagtgtgtactgctc

SEQ ID NO: 116177 - DNA, 41 bp, Artificial Sequence
  Description of Artificial Sequence: Synthetic oligonucleotide
tgattataccatttctttccatgggatagtgtgtactgctc

SEQ ID NO: 116178 - DNA, 40 bp, Artificial Sequence
  Description of Artificial Sequence: Synthetic oligonucleotide
gattataccatttctttccatgggatagtgtgtactgctc

SEQ ID NO: 116179 - DNA, 40 bp, Artificial Sequence
  Description of Artificial Sequence: Synthetic oligonucleotide
attataccatttctttccatgggatagtgtgtactgctcc

SEQ ID NO: 116180 - DNA, 39 bp, Artificial Sequence
  Description of Artificial Sequence: Synthetic oligonucleotide
ttataccatttctttccatgggatagtgtgtactgctcc

SEQ ID NO: 116181 - DNA, 38 bp, Artificial Sequence
  Description of Artificial Sequence: Synthetic oligonucleotide
tataccatttctttccatgggatagtgtgtactgctcc

SEQ ID NO: 116182 - DNA, 37 bp, Artificial Sequence
  Description of Artificial Sequence: Synthetic oligonucleotide
ataccatttctttccatgggatagtgtgtactgctcc

SEQ ID NO: 116183 - DNA, 36 bp, Artificial Sequence
  Description of Artificial Sequence: Synthetic oligonucleotide
taccatttctttccatgggatagtgtgtactgctcc

SEQ ID NO: 116184 - DNA, 35 bp, Artificial Sequence
  Description of Artificial Sequence: Synthetic oligonucleotide
accatttctttccatgggatagtgtgtactgctcc

SEQ ID NO: 116185 - DNA, 34 bp, Artificial Sequence
  Description of Artificial Sequence: Synthetic oligonucleotide
ccatttctttccatgggatagtgtgtactgctcc

SEQ ID NO: 116186 - DNA, 35 bp, Artificial Sequence
  Description of Artificial Sequence: Synthetic oligonucleotide
catttctttccatgggatagtgtgtactgctcctc

SEQ ID NO: 116187 - DNA, 36 bp, Artificial Sequence
  Description of Artificial Sequence: Synthetic oligonucleotide
atttctttccatgggatagtgtgtactgctcctcag

SEQ ID NO: 116188 - DNA, 35 bp, Artificial Sequence
  Description of Artificial Sequence: Synthetic oligonucleotide
tttctttccatgggatagtgtgtactgctcctcag

SEQ ID NO: 116189 - DNA, 34 bp, Artificial Sequence
  Description of Artificial Sequence: Synthetic oligonucleotide
ttctttccatgggatagtgtgtactgctcctcag

SEQ ID NO: 116190 - DNA, 33 bp, Artificial Sequence
  Description of Artificial Sequence: Synthetic oligonucleotide
tctttccatgggatagtgtgtactgctcctcag

SEQ ID NO: 116191 - DNA, 32 bp, Artificial Sequence
  Description of Artificial Sequence: Synthetic oligonucleotide
ctttccatgggatagtgtgtactgctcctcag

SEQ ID NO: 116192 - DNA, 37 bp, Artificial Sequence
  Description of Artificial Sequence: Synthetic oligonucleotide
tttccatgggatagtgtgtactgctcctcagttaaac

SEQ ID NO: 116193 - DNA, 36 bp, Artificial Sequence
  Description of Artificial Sequence: Synthetic oligonucleotide
ttccatgggatagtgtgtactgctcctcagttaaac

SEQ ID NO: 116194 - DNA, 35 bp, Artificial Sequence
  Description of Artificial Sequence: Synthetic oligonucleotide
tccatgggatagtgtgtactgctcctcagttaaac

SEQ ID NO: 116195 - DNA, 34 bp, Artificial Sequence
  Description of Artificial Sequence: Synthetic oligonucleotide
ccatgggatagtgtgtactgctcctcagttaaac

SEQ ID NO: 116196 - DNA, 37 bp, Artificial Sequence
  Description of Artificial Sequence: Synthetic oligonucleotide
catgggatagtgtgtactgctcctcagttaaacattc

SEQ ID NO: 116197 - DNA, 39 bp, Artificial Sequence
  Description of Artificial Sequence: Synthetic oligonucleotide
atgggatagtgtgtactgctcctcagttaaacattcatg

SEQ ID NO: 116198 - DNA, 38 bp, Artificial Sequence
  Description of Artificial Sequence: Synthetic oligonucleotide
tgggatagtgtgtactgctcctcagttaaacattcatg

SEQ ID NO: 116199 - DNA, 37 bp, Artificial Sequence
  Description of Artificial Sequence: Synthetic oligonucleotide
gggatagtgtgtactgctcctcagttaaacattcatg

SEQ ID NO: 116200 - DNA, 37 bp, Artificial Sequence
  Description of Artificial Sequence: Synthetic oligonucleotide
ggatagtgtgtactgctcctcagttaaacattcatgc

SEQ ID NO: 116201 - DNA, 39 bp, Artificial Sequence
  Description of Artificial Sequence: Synthetic oligonucleotide
gatagtgtgtactgctcctcagttaaacattcatgcatc

SEQ ID NO: 116202 - DNA, 39 bp, Artificial Sequence
  Description of Artificial Sequence: Synthetic oligonucleotide
atagtgtgtactgctcctcagttaaacattcatgcatcg

SEQ ID NO: 116203 - DNA, 38 bp, Artificial Sequence
  Description of Artificial Sequence: Synthetic oligonucleotide
tagtgtgtactgctcctcagttaaacattcatgcatcg

SEQ ID NO: 116204 - DNA, 37 bp, Artificial Sequence
  Description of Artificial Sequence: Synthetic oligonucleotide
agtgtgtactgctcctcagttaaacattcatgcatcg

SEQ ID NO: 116205 - DNA, 36 bp, Artificial Sequence
  Description of Artificial Sequence: Synthetic oligonucleotide
gtgtgtactgctcctcagttaaacattcatgcatcg

SEQ ID NO: 116206 - DNA, 36 bp, Artificial Sequence
  Description of Artificial Sequence: Synthetic oligonucleotide
tgtgtactgctcctcagttaaacattcatgcatcgg

SEQ ID NO: 116207 - DNA, 35 bp, Artificial Sequence
  Description of Artificial Sequence: Synthetic oligonucleotide
gtgtactgctcctcagttaaacattcatgcatcgg

SEQ ID NO: 116208 - DNA, 37 bp, Artificial Sequence
  Description of Artificial Sequence: Synthetic oligonucleotide
tgtactgctcctcagttaaacattcatgcatcggaag

SEQ ID NO: 116209 - DNA, 36 bp, Artificial Sequence
  Description of Artificial Sequence: Synthetic oligonucleotide
gtactgctcctcagttaaacattcatgcatcggaag

SEQ ID NO: 116210 - DNA, 36 bp, Artificial Sequence
  Description of Artificial Sequence: Synthetic oligonucleotide
tactgctcctcagttaaacattcatgcatcggaagg

SEQ ID NO: 116211 - DNA, 35 bp, Artificial Sequence
  Description of Artificial Sequence: Synthetic oligonucleotide
actgctcctcagttaaacattcatgcatcggaagg

SEQ ID NO: 116212 - DNA, 34 bp, Artificial Sequence
  Description of Artificial Sequence: Synthetic oligonucleotide
ctgctcctcagttaaacattcatgcatcggaagg

SEQ ID NO: 116213 - DNA, 37 bp, Artificial Sequence
  Description of Artificial Sequence: Synthetic oligonucleotide
tgctcctcagttaaacattcatgcatcggaaggaatc

SEQ ID NO: 116214 - DNA, 36 bp, Artificial Sequence
  Description of Artificial Sequence: Synthetic oligonucleotide
gctcctcagttaaacattcatgcatcggaaggaatc

SEQ ID NO: 116215 - DNA, 38 bp, Artificial Sequence
  Description of Artificial Sequence: Synthetic oligonucleotide
ctcctcagttaaacattcatgcatcggaaggaatcaac

SEQ ID NO: 116216 - DNA, 38 bp, Artificial Sequence
  Description of Artificial Sequence: Synthetic oligonucleotide
tcctcagttaaacattcatgcatcggaaggaatcaacc

SEQ ID NO: 116217 - DNA, 37 bp, Artificial Sequence
  Description of Artificial Sequence: Synthetic oligonucleotide
cctcagttaaacattcatgcatcggaaggaatcaacc

SEQ ID NO: 116218 - DNA, 37 bp, Artificial Sequence
  Description of Artificial Sequence: Synthetic oligonucleotide
ctcagttaaacattcatgcatcggaaggaatcaaccg

SEQ ID NO: 116219 - DNA, 37 bp, Artificial Sequence
  Description of Artificial Sequence: Synthetic oligonucleotide
tcagttaaacattcatgcatcggaaggaatcaaccgc

SEQ ID NO: 116220 - DNA, 36 bp, Artificial Sequence
  Description of Artificial Sequence: Synthetic oligonucleotide
cagttaaacattcatgcatcggaaggaatcaaccgc

SEQ ID NO: 116221 - DNA, 39 bp, Artificial Sequence
  Description of Artificial Sequence: Synthetic oligonucleotide
agttaaacattcatgcatcggaaggaatcaaccgctttg

SEQ ID NO: 116222 - DNA, 38 bp, Artificial Sequence
  Description of Artificial Sequence: Synthetic oligonucleotide
gttaaacattcatgcatcggaaggaatcaaccgctttg

SEQ ID NO: 116223 - DNA, 40 bp, Artificial Sequence
  Description of Artificial Sequence: Synthetic oligonucleotide
ttaaacattcatgcatcggaaggaatcaaccgctttgatg

SEQ ID NO: 116224 - DNA, 39 bp, Artificial Sequence
  Description of Artificial Sequence: Synthetic oligonucleotide
taaacattcatgcatcggaaggaatcaaccgctttgatg

SEQ ID NO: 116225 - DNA, 38 bp, Artificial Sequence
  Description of Artificial Sequence: Synthetic oligonucleotide
aaacattcatgcatcggaaggaatcaaccgctttgatg

SEQ ID NO: 116226 - DNA, 37 bp, Artificial Sequence
  Description of Artificial Sequence: Synthetic oligonucleotide
aacattcatgcatcggaaggaatcaaccgctttgatg

SEQ ID NO: 116227 - DNA, 36 bp, Artificial Sequence
  Description of Artificial Sequence: Synthetic oligonucleotide
acattcatgcatcggaaggaatcaaccgctttgatg

SEQ ID NO: 116228 - DNA, 35 bp, Artificial Sequence
  Description of Artificial Sequence: Synthetic oligonucleotide
cattcatgcatcggaaggaatcaaccgctttgatg

SEQ ID NO: 116229 - DNA, 37 bp, Artificial Sequence
  Description of Artificial Sequence: Synthetic oligonucleotide
attcatgcatcggaaggaatcaaccgctttgatgttc

SEQ ID NO: 116230 - DNA, 36 bp, Artificial Sequence
  Description of Artificial Sequence: Synthetic oligonucleotide
ttcatgcatcggaaggaatcaaccgctttgatgttc

SEQ ID NO: 116231 - DNA, 35 bp, Artificial Sequence
  Description of Artificial Sequence: Synthetic oligonucleotide
tcatgcatcggaaggaatcaaccgctttgatgttc

SEQ ID NO: 116232 - DNA, 34 bp, Artificial Sequence
  Description of Artificial Sequence: Synthetic oligonucleotide
catgcatcggaaggaatcaaccgctttgatgttc

SEQ ID NO: 116233 - DNA, 35 bp, Artificial Sequence
  Description of Artificial Sequence: Synthetic oligonucleotide
atgcatcggaaggaatcaaccgctttgatgttcag

SEQ ID NO: 116234 - DNA, 34 bp, Artificial Sequence
  Description of Artificial Sequence: Synthetic oligonucleotide
tgcatcggaaggaatcaaccgctttgatgttcag

SEQ ID NO: 116235 - DNA, 33 bp, Artificial Sequence
  Description of Artificial Sequence: Synthetic oligonucleotide
gcatcggaaggaatcaaccgctttgatgttcag

SEQ ID NO: 116236 - DNA, 34 bp, Artificial Sequence
  Description of Artificial Sequence: Synthetic oligonucleotide
catcggaaggaatcaaccgctttgatgttcagtc

SEQ ID NO: 116237 - DNA, 34 bp, Artificial Sequence
  Description of Artificial Sequence: Synthetic oligonucleotide
atcggaaggaatcaaccgctttgatgttcagtcc

SEQ ID NO: 116238 - DNA, 33 bp, Artificial Sequence
  Description of Artificial Sequence: Synthetic oligonucleotide
tcggaaggaatcaaccgctttgatgttcagtcc

SEQ ID NO: 116239 - DNA, 32 bp, Artificial Sequence
  Description of Artificial Sequence: Synthetic oligonucleotide
cggaaggaatcaaccgctttgatgttcagtcc

SEQ ID NO: 116240 - DNA, 33 bp, Artificial Sequence
  Description of Artificial Sequence: Synthetic oligonucleotide
ggaaggaatcaaccgctttgatgttcagtcctc

SEQ ID NO: 116241 - DNA, 33 bp, Artificial Sequence
  Description of Artificial Sequence: Synthetic oligonucleotide
gaaggaatcaaccgctttgatgttcagtcctcc

SEQ ID NO: 116242 - DNA, 35 bp, Artificial Sequence
  Description of Artificial Sequence: Synthetic oligonucleotide
aaggaatcaaccgctttgatgttcagtcctccttg

SEQ ID NO: 116243 - DNA, 34 bp, Artificial Sequence
  Description of Artificial Sequence: Synthetic oligonucleotide
aggaatcaaccgctttgatgttcagtcctccttg

SEQ ID NO: 116244 - DNA, 33 bp, Artificial Sequence
  Description of Artificial Sequence: Synthetic oligonucleotide
ggaatcaaccgctttgatgttcagtcctccttg

SEQ ID NO: 116245 - DNA, 38 bp, Artificial Sequence
  Description of Artificial Sequence: Synthetic oligonucleotide
gaatcaaccgctttgatgttcagtcctccttgaaatac

SEQ ID NO: 116246 - DNA, 38 bp, Artificial Sequence
  Description of Artificial Sequence: Synthetic oligonucleotide
aatcaaccgctttgatgttcagtcctccttgaaatacg

SEQ ID NO: 116247 - DNA, 37 bp, Artificial Sequence
  Description of Artificial Sequence: Synthetic oligonucleotide
atcaaccgctttgatgttcagtcctccttgaaatacg

SEQ ID NO: 116248 - DNA, 36 bp, Artificial Sequence
  Description of Artificial Sequence: Synthetic oligonucleotide
tcaaccgctttgatgttcagtcctccttgaaatacg

SEQ ID NO: 116249 - DNA, 35 bp, Artificial Sequence
  Description of Artificial Sequence: Synthetic oligonucleotide
caaccgctttgatgttcagtcctccttgaaatacg

SEQ ID NO: 116250 - DNA, 37 bp, Artificial Sequence
  Description of Artificial Sequence: Synthetic oligonucleotide
aaccgctttgatgttcagtcctccttgaaatacgaag

SEQ ID NO: 116251 - DNA, 36 bp, Artificial Sequence
  Description of Artificial Sequence: Synthetic oligonucleotide
accgctttgatgttcagtcctccttgaaatacgaag

SEQ ID NO: 116252 - DNA, 35 bp, Artificial Sequence
  Description of Artificial Sequence: Synthetic oligonucleotide
ccgctttgatgttcagtcctccttgaaatacgaag

SEQ ID NO: 116253 - DNA, 37 bp, Artificial Sequence
  Description of Artificial Sequence: Synthetic oligonucleotide
cgctttgatgttcagtcctccttgaaatacgaagatc

SEQ ID NO: 116254 - DNA, 38 bp, Artificial Sequence
  Description of Artificial Sequence: Synthetic oligonucleotide
gctttgatgttcagtcctccttgaaatacgaagatctg

SEQ ID NO: 116255 - DNA, 38 bp, Artificial Sequence
  Description of Artificial Sequence: Synthetic oligonucleotide
ctttgatgttcagtcctccttgaaatacgaagatctgg

SEQ ID NO: 116256 - DNA, 38 bp, Artificial Sequence
  Description of Artificial Sequence: Synthetic oligonucleotide
tttgatgttcagtcctccttgaaatacgaagatctggc

SEQ ID NO: 116257 - DNA, 37 bp, Artificial Sequence
  Description of Artificial Sequence: Synthetic oligonucleotide
ttgatgttcagtcctccttgaaatacgaagatctggc

SEQ ID NO: 116258 - DNA, 36 bp, Artificial Sequence
  Description of Artificial Sequence: Synthetic oligonucleotide
tgatgttcagtcctccttgaaatacgaagatctggc

SEQ ID NO: 116259 - DNA, 35 bp, Artificial Sequence
  Description of Artificial Sequence: Synthetic oligonucleotide
gatgttcagtcctccttgaaatacgaagatctggc

SEQ ID NO: 116260 - DNA, 36 bp, Artificial Sequence
  Description of Artificial Sequence: Synthetic oligonucleotide
atgttcagtcctccttgaaatacgaagatctggctc

SEQ ID NO: 116261 - DNA, 35 bp, Artificial Sequence
  Description of Artificial Sequence: Synthetic oligonucleotide
tgttcagtcctccttgaaatacgaagatctggctc

SEQ ID NO: 116262 - DNA, 34 bp, Artificial Sequence
  Description of Artificial Sequence: Synthetic oligonucleotide
gttcagtcctccttgaaatacgaagatctggctc

SEQ ID NO: 116263 - DNA, 34 bp, Artificial Sequence
  Description of Artificial Sequence: Synthetic oligonucleotide
ttcagtcctccttgaaatacgaagatctggctcc

SEQ ID NO: 116264 - DNA, 33 bp, Artificial Sequence
  Description of Artificial Sequence: Synthetic oligonucleotide
tcagtcctccttgaaatacgaagatctggctcc

SEQ ID NO: 116265 - DNA, 32 bp, Artificial Sequence
  Description of Artificial Sequence: Synthetic oligonucleotide
cagtcctccttgaaatacgaagatctggctcc

SEQ ID NO: 116266 - DNA, 32 bp, Artificial Sequence
  Description of Artificial Sequence: Synthetic oligonucleotide
agtcctccttgaaatacgaagatctggctccc

SEQ ID NO: 116267 - DNA, 31 bp, Artificial Sequence
  Description of Artificial Sequence: Synthetic oligonucleotide
gtcctccttgaaatacgaagatctggctccc

SEQ ID NO: 116268 - DNA, 32 bp, Artificial Sequence
  Description of Artificial Sequence: Synthetic oligonucleotide
tcctccttgaaatacgaagatctggctccctg

SEQ ID NO: 116269 - DNA, 31 bp, Artificial Sequence
  Description of Artificial Sequence: Synthetic oligonucleotide
cctccttgaaatacgaagatctggctccctg

SEQ ID NO: 116270 - DNA, 31 bp, Artificial Sequence
  Description of Artificial Sequence: Synthetic oligonucleotide
ctccttgaaatacgaagatctggctccctgc

SEQ ID NO: 116271 - DNA, 35 bp, Artificial Sequence
  Description of Artificial Sequence: Synthetic oligonucleotide
tccttgaaatacgaagatctggctccctgcataac

SEQ ID NO: 116272 - DNA, 34 bp, Artificial Sequence
  Description of Artificial Sequence: Synthetic oligonucleotide
ccttgaaatacgaagatctggctccctgcataac

SEQ ID NO: 116273 - DNA, 37 bp, Artificial Sequence
  Description of Artificial Sequence: Synthetic oligonucleotide
cttgaaatacgaagatctggctccctgcataactttg

SEQ ID NO: 116274 - DNA, 39 bp, Artificial Sequence
  Description of Artificial Sequence: Synthetic oligonucleotide
ttgaaatacgaagatctggctccctgcataactttgaag

SEQ ID NO: 116275 - DNA, 38 bp, Artificial Sequence
  Description of Artificial Sequence: Synthetic oligonucleotide
tgaaatacgaagatctggctccctgcataactttgaag

SEQ ID NO: 116276 - DNA, 37 bp, Artificial Sequence
  Description of Artificial Sequence: Synthetic oligonucleotide
gaaatacgaagatctggctccctgcataactttgaag

SEQ ID NO: 116277 - DNA, 39 bp, Artificial Sequence
  Description of Artificial Sequence: Synthetic oligonucleotide
aaatacgaagatctggctccctgcataactttgaagaac

SEQ ID NO: 116278 - DNA, 38 bp, Artificial Sequence
  Description of Artificial Sequence: Synthetic oligonucleotide
aatacgaagatctggctccctgcataactttgaagaac

SEQ ID NO: 116279 - DNA, 37 bp, Artificial Sequence
  Description of Artificial Sequence: Synthetic oligonucleotide
atacgaagatctggctccctgcataactttgaagaac

SEQ ID NO: 116280 - DNA, 36 bp, Artificial Sequence
  Description of Artificial Sequence: Synthetic oligonucleotide
tacgaagatctggctccctgcataactttgaagaac

SEQ ID NO: 116281 - DNA, 35 bp, Artificial Sequence
  Description of Artificial Sequence: Synthetic oligonucleotide
acgaagatctggctccctgcataactttgaagaac

SEQ ID NO: 116282 - DNA, 34 bp, Artificial Sequence
  Description of Artificial Sequence: Synthetic oligonucleotide
cgaagatctggctccctgcataactttgaagaac

SEQ ID NO: 116283 - DNA, 35 bp, Artificial Sequence
  Description of Artificial Sequence: Synthetic oligonucleotide
gaagatctggctccctgcataactttgaagaactg

SEQ ID NO: 116284 - DNA, 35 bp, Artificial Sequence
  Description of Artificial Sequence: Synthetic oligonucleotide
aagatctggctccctgcataactttgaagaactgg

SEQ ID NO: 116285 - DNA, 34 bp, Artificial Sequence
  Description of Artificial Sequence: Synthetic oligonucleotide
agatctggctccctgcataactttgaagaactgg

SEQ ID NO: 116286 - DNA, 33 bp, Artificial Sequence
  Description of Artificial Sequence: Synthetic oligonucleotide
gatctggctccctgcataactttgaagaactgg

SEQ ID NO: 116287 - DNA, 33 bp, Artificial Sequence
  Description of Artificial Sequence: Synthetic oligonucleotide
atctggctccctgcataactttgaagaactggg

SEQ ID NO: 116288 - DNA, 32 bp, Artificial Sequence
  Description of Artificial Sequence: Synthetic oligonucleotide
tctggctccctgcataactttgaagaactggg

SEQ ID NO: 116289 - DNA, 31 bp, Artificial Sequence
  Description of Artificial Sequence: Synthetic oligonucleotide
ctggctccctgcataactttgaagaactggg

SEQ ID NO: 116290 - DNA, 32 bp, Artificial Sequence
  Description of Artificial Sequence: Synthetic oligonucleotide
tggctccctgcataactttgaagaactgggtc

SEQ ID NO: 116291 - DNA, 31 bp, Artificial Sequence
  Description of Artificial Sequence: Synthetic oligonucleotide
ggctccctgcataactttgaagaactgggtc

SEQ ID NO: 116292 - DNA, 31 bp, Artificial Sequence
  Description of Artificial Sequence: Synthetic oligonucleotide
gctccctgcataactttgaagaactgggtcc

SEQ ID NO: 116293 - DNA, 34 bp, Artificial Sequence
  Description of Artificial Sequence: Synthetic oligonucleotide
ctccctgcataactttgaagaactgggtccaaac

SEQ ID NO: 116294 - DNA, 35 bp, Artificial Sequence
  Description of Artificial Sequence: Synthetic oligonucleotide
tccctgcataactttgaagaactgggtccaaacac

SEQ ID NO: 116295 - DNA, 34 bp, Artificial Sequence
  Description of Artificial Sequence: Synthetic oligonucleotide
ccctgcataactttgaagaactgggtccaaacac

SEQ ID NO: 116296 - DNA, 35 bp, Artificial Sequence
  Description of Artificial Sequence: Synthetic oligonucleotide
cctgcataactttgaagaactgggtccaaacactg

SEQ ID NO: 116297 - DNA, 35 bp, Artificial Sequence
  Description of Artificial Sequence: Synthetic oligonucleotide
ctgcataactttgaagaactgggtccaaacactgc

SEQ ID NO: 116298 - DNA, 35 bp, Artificial Sequence
  Description of Artificial Sequence: Synthetic oligonucleotide
tgcataactttgaagaactgggtccaaacactgcg

SEQ ID NO: 116299 - DNA, 34 bp, Artificial Sequence
  Description of Artificial Sequence: Synthetic oligonucleotide
gcataactttgaagaactgggtccaaacactgcg

SEQ ID NO: 116300 - DNA, 34 bp, Artificial Sequence
  Description of Artificial Sequence: Synthetic oligonucleotide
cataactttgaagaactgggtccaaacactgcgc

SEQ ID NO: 116301 - DNA, 34 bp, Artificial Sequence
  Description of Artificial Sequence: Synthetic oligonucleotide
ataactttgaagaactgggtccaaacactgcgcc

SEQ ID NO: 116302 - DNA, 33 bp, Artificial Sequence
  Description of Artificial Sequence: Synthetic oligonucleotide
taactttgaagaactgggtccaaacactgcgcc

SEQ ID NO: 116303 - DNA, 32 bp, Artificial Sequence
  Description of Artificial Sequence: Synthetic oligonucleotide
aactttgaagaactgggtccaaacactgcgcc

SEQ ID NO: 116304 - DNA, 31 bp, Artificial Sequence
  Description of Artificial Sequence: Synthetic oligonucleotide
actttgaagaactgggtccaaacactgcgcc

SEQ ID NO: 116305 - DNA, 30 bp, Artificial Sequence
  Description of Artificial Sequence: Synthetic oligonucleotide
ctttgaagaactgggtccaaacactgcgcc

SEQ ID NO: 116306 - DNA, 30 bp, Artificial Sequence
  Description of Artificial Sequence: Synthetic oligonucleotide
tttgaagaactgggtccaaacactgcgccc

SEQ ID NO: 116307 - DNA, 29 bp, Artificial Sequence
  Description of Artificial Sequence: Synthetic oligonucleotide
ttgaagaactgggtccaaacactgcgccc

SEQ ID NO: 116308 - DNA, 28 bp, Artificial Sequence
  Description of Artificial Sequence: Synthetic oligonucleotide
tgaagaactgggtccaaacactgcgccc

SEQ ID NO: 116309 - DNA, 27 bp, Artificial Sequence
  Description of Artificial Sequence: Synthetic oligonucleotide
gaagaactgggtccaaacactgcgccc

SEQ ID NO: 116310 - DNA, 28 bp, Artificial Sequence
  Description of Artificial Sequence: Synthetic oligonucleotide
aagaactgggtccaaacactgcgcccag

SEQ ID NO: 116311 - DNA, 27 bp, Artificial Sequence
  Description of Artificial Sequence: Synthetic oligonucleotide
agaactgggtccaaacactgcgcccag

SEQ ID NO: 116312 - DNA, 27 bp, Artificial Sequence
  Description of Artificial Sequence: Synthetic oligonucleotide
gaactgggtccaaacactgcgcccagt

SEQ ID NO: 116313 - DNA, 27 bp, Artificial Sequence
  Description of Artificial Sequence: Synthetic oligonucleotide
aactgggtccaaacactgcgcccagtg

SEQ ID NO: 116314 - DNA, 27 bp, Artificial Sequence
  Description of Artificial Sequence: Synthetic oligonucleotide
actgggtccaaacactgcgcccagtga

SEQ ID NO: 116315 - DNA, 26 bp, Artificial Sequence
  Description of Artificial Sequence: Synthetic oligonucleotide
ctgggtccaaacactgcgcccagtga

SEQ ID NO: 116316 - DNA, 27 bp, Artificial Sequence
  Description of Artificial Sequence: Synthetic oligonucleotide
tgggtccaaacactgcgcccagtgagt

SEQ ID NO: 116317 - DNA, 26 bp, Artificial Sequence
  Description of Artificial Sequence: Synthetic oligonucleotide
gggtccaaacactgcgcccagtgagt

SEQ ID NO: 116318 - DNA, 26 bp, Artificial Sequence
  Description of Artificial Sequence: Synthetic oligonucleotide
ggtccaaacactgcgcccagtgagtg

SEQ ID NO: 116319 - DNA, 27 bp, Artificial Sequence
  Description of Artificial Sequence: Synthetic oligonucleotide
gtccaaacactgcgcccagtgagtgca

SEQ ID NO: 116320 - DNA, 31 bp, Artificial Sequence
  Description of Artificial Sequence: Synthetic oligonucleotide
tccaaacactgcgcccagtgagtgcaaaaac

SEQ ID NO: 116321 - DNA, 30 bp, Artificial Sequence
  Description of Artificial Sequence: Synthetic oligonucleotide
ccaaacactgcgcccagtgagtgcaaaaac

SEQ ID NO: 116322 - DNA, 34 bp, Artificial Sequence
  Description of Artificial Sequence: Synthetic oligonucleotide
caaacactgcgcccagtgagtgcaaaaacaaaac

SEQ ID NO: 116323 - DNA, 34 bp, Artificial Sequence
  Description of Artificial Sequence: Synthetic oligonucleotide
aaacactgcgcccagtgagtgcaaaaacaaaacc

SEQ ID NO: 116324 - DNA, 33 bp, Artificial Sequence
  Description of Artificial Sequence: Synthetic oligonucleotide
aacactgcgcccagtgagtgcaaaaacaaaacc

SEQ ID NO: 116325 - DNA, 32 bp, Artificial Sequence
  Description of Artificial Sequence: Synthetic oligonucleotide
acactgcgcccagtgagtgcaaaaacaaaacc

SEQ ID NO: 116326 - DNA, 31 bp, Artificial Sequence
  Description of Artificial Sequence: Synthetic oligonucleotide
cactgcgcccagtgagtgcaaaaacaaaacc

SEQ ID NO: 116327 - DNA, 35 bp, Artificial Sequence
  Description of Artificial Sequence: Synthetic oligonucleotide
actgcgcccagtgagtgcaaaaacaaaacctttag

SEQ ID NO: 116328 - DNA, 34 bp, Artificial Sequence
  Description of Artificial Sequence: Synthetic oligonucleotide
ctgcgcccagtgagtgcaaaaacaaaacctttag

SEQ ID NO: 116329 - DNA, 34 bp, Artificial Sequence
  Description of Artificial Sequence: Synthetic oligonucleotide
tgcgcccagtgagtgcaaaaacaaaacctttagg

SEQ ID NO: 116330 - DNA, 33 bp, Artificial Sequence
  Description of Artificial Sequence: Synthetic oligonucleotide
gcgcccagtgagtgcaaaaacaaaacctttagg

SEQ ID NO: 116331 - DNA, 35 bp, Artificial Sequence
  Description of Artificial Sequence: Synthetic oligonucleotide
cgcccagtgagtgcaaaaacaaaacctttaggatc

SEQ ID NO: 116332 - DNA, 37 bp, Artificial Sequence
  Description of Artificial Sequence: Synthetic oligonucleotide
gcccagtgagtgcaaaaacaaaacctttaggatcaag

SEQ ID NO: 116333 - DNA, 38 bp, Artificial Sequence
  Description of Artificial Sequence: Synthetic oligonucleotide
cccagtgagtgcaaaaacaaaacctttaggatcaagag

SEQ ID NO: 116334 - DNA, 40 bp, Artificial Sequence
  Description of Artificial Sequence: Synthetic oligonucleotide
ccagtgagtgcaaaaacaaaacctttaggatcaagagatg

SEQ ID NO: 116335 - DNA, 44 bp, Artificial Sequence
  Description of Artificial Sequence: Synthetic oligonucleotide
cagtgagtgcaaaaacaaaacctttaggatcaagagatgttttg

SEQ ID NO: 116336 - DNA, 44 bp, Artificial Sequence
  Description of Artificial Sequence: Synthetic oligonucleotide
agtgagtgcaaaaacaaaacctttaggatcaagagatgttttgc

SEQ ID NO: 116337 - DNA, 43 bp, Artificial Sequence
  Description of Artificial Sequence: Synthetic oligonucleotide
gtgagtgcaaaaacaaaacctttaggatcaagagatgttttgc

SEQ ID NO: 116338 - DNA, 43 bp, Artificial Sequence
  Description of Artificial Sequence: Synthetic oligonucleotide
tgagtgcaaaaacaaaacctttaggatcaagagatgttttgcc

SEQ ID NO: 116339 - DNA, 42 bp, Artificial Sequence
  Description of Artificial Sequence: Synthetic oligonucleotide
gagtgcaaaaacaaaacctttaggatcaagagatgttttgcc

SEQ ID NO: 116340 - DNA, 48 bp, Artificial Sequence
  Description of Artificial Sequence: Synthetic oligonucleotide
agtgcaaaaacaaaacctttaggatcaagagatgttttgccaaataac

SEQ ID NO: 116341 - DNA, 47 bp, Artificial Sequence
  Description of Artificial Sequence: Synthetic oligonucleotide
gtgcaaaaacaaaacctttaggatcaagagatgttttgccaaataac

SEQ ID NO: 116342 - DNA, 47 bp, Artificial Sequence
  Description of Artificial Sequence: Synthetic oligonucleotide
tgcaaaaacaaaacctttaggatcaagagatgttttgccaaataacc

SEQ ID NO: 116343 - DNA, 46 bp, Artificial Sequence
  Description of Artificial Sequence: Synthetic oligonucleotide
gcaaaaacaaaacctttaggatcaagagatgttttgccaaataacc

SEQ ID NO: 116344 - DNA, 46 bp, Artificial Sequence
  Description of Artificial Sequence: Synthetic oligonucleotide
caaaaacaaaacctttaggatcaagagatgttttgccaaataaccg

SEQ ID NO: 116345 - DNA, 47 bp, Artificial Sequence
  Description of Artificial Sequence: Synthetic oligonucleotide
aaaaacaaaacctttaggatcaagagatgttttgccaaataaccgtc

SEQ ID NO: 116346 - DNA, 46 bp, Artificial Sequence
  Description of Artificial Sequence: Synthetic oligonucleotide
aaaacaaaacctttaggatcaagagatgttttgccaaataaccgtc

SEQ ID NO: 116347 - DNA, 45 bp, Artificial Sequence
  Description of Artificial Sequence: Synthetic oligonucleotide
aaacaaaacctttaggatcaagagatgttttgccaaataaccgtc

SEQ ID NO: 116348 - DNA, 44 bp, Artificial Sequence
  Description of Artificial Sequence: Synthetic oligonucleotide
aacaaaacctttaggatcaagagatgttttgccaaataaccgtc

SEQ ID NO: 116349 - DNA, 43 bp, Artificial Sequence
  Description of Artificial Sequence: Synthetic oligonucleotide
acaaaacctttaggatcaagagatgttttgccaaataaccgtc

SEQ ID NO: 116350 - DNA, 42 bp, Artificial Sequence
  Description of Artificial Sequence: Synthetic oligonucleotide
caaaacctttaggatcaagagatgttttgccaaataaccgtc

SEQ ID NO: 116351 - DNA, 44 bp, Artificial Sequence
  Description of Artificial Sequence: Synthetic oligonucleotide
aaaacctttaggatcaagagatgttttgccaaataaccgtcaac

SEQ ID NO: 116352 - DNA, 43 bp, Artificial Sequence
  Description of Artificial Sequence: Synthetic oligonucleotide
aaacctttaggatcaagagatgttttgccaaataaccgtcaac

SEQ ID NO: 116353 - DNA, 42 bp, Artificial Sequence
  Description of Artificial Sequence: Synthetic oligonucleotide
aacctttaggatcaagagatgttttgccaaataaccgtcaac

SEQ ID NO: 116354 - DNA, 41 bp, Artificial Sequence
  Description of Artificial Sequence: Synthetic oligonucleotide
acctttaggatcaagagatgttttgccaaataaccgtcaac

SEQ ID NO: 116355 - DNA, 40 bp, Artificial Sequence
  Description of Artificial Sequence: Synthetic oligonucleotide
cctttaggatcaagagatgttttgccaaataaccgtcaac

SEQ ID NO: 116356 - DNA, 45 bp, Artificial Sequence
  Description of Artificial Sequence: Synthetic oligonucleotide
ctttaggatcaagagatgttttgccaaataaccgtcaactttatg

SEQ ID NO: 116357 - DNA, 46 bp, Artificial Sequence
  Description of Artificial Sequence: Synthetic oligonucleotide
tttaggatcaagagatgttttgccaaataaccgtcaactttatgag

SEQ ID NO: 116358 - DNA, 45 bp, Artificial Sequence
  Description of Artificial Sequence: Synthetic oligonucleotide
ttaggatcaagagatgttttgccaaataaccgtcaactttatgag

SEQ ID NO: 116359 - DNA, 44 bp, Artificial Sequence
  Description of Artificial Sequence: Synthetic oligonucleotide
taggatcaagagatgttttgccaaataaccgtcaactttatgag

SEQ ID NO: 116360 - DNA, 43 bp, Artificial Sequence
  Description of Artificial Sequence: Synthetic oligonucleotide
aggatcaagagatgttttgccaaataaccgtcaactttatgag

SEQ ID NO: 116361 - DNA, 42 bp, Artificial Sequence
  Description of Artificial Sequence: Synthetic oligonucleotide
ggatcaagagatgttttgccaaataaccgtcaactttatgag

SEQ ID NO: 116362 - DNA, 44 bp, Artificial Sequence
  Description of Artificial Sequence: Synthetic oligonucleotide
gatcaagagatgttttgccaaataaccgtcaactttatgagatg

SEQ ID NO: 116363 - DNA, 44 bp, Artificial Sequence
  Description of Artificial Sequence: Synthetic oligonucleotide
atcaagagatgttttgccaaataaccgtcaactttatgagatgg

SEQ ID NO: 116364 - DNA, 43 bp, Artificial Sequence
  Description of Artificial Sequence: Synthetic oligonucleotide
tcaagagatgttttgccaaataaccgtcaactttatgagatgg

SEQ ID NO: 116365 - DNA, 42 bp, Artificial Sequence
  Description of Artificial Sequence: Synthetic oligonucleotide
caagagatgttttgccaaataaccgtcaactttatgagatgg

SEQ ID NO: 116366 - DNA, 43 bp, Artificial Sequence
  Description of Artificial Sequence: Synthetic oligonucleotide
aagagatgttttgccaaataaccgtcaactttatgagatggtc

SEQ ID NO: 116367 - DNA, 42 bp, Artificial Sequence
  Description of Artificial Sequence: Synthetic oligonucleotide
agagatgttttgccaaataaccgtcaactttatgagatggtc

SEQ ID NO: 116368 - DNA, 41 bp, Artificial Sequence
  Description of Artificial Sequence: Synthetic oligonucleotide
gagatgttttgccaaataaccgtcaactttatgagatggtc

SEQ ID NO: 116369 - DNA, 41 bp, Artificial Sequence
  Description of Artificial Sequence: Synthetic oligonucleotide
agatgttttgccaaataaccgtcaactttatgagatggtcc

SEQ ID NO: 116370 - DNA, 40 bp, Artificial Sequence
  Description of Artificial Sequence: Synthetic oligonucleotide
gatgttttgccaaataaccgtcaactttatgagatggtcc

SEQ ID NO: 116371 - DNA, 41 bp, Artificial Sequence
  Description of Artificial Sequence: Synthetic oligonucleotide
atgttttgccaaataaccgtcaactttatgagatggtcctg

SEQ ID NO: 116372 - DNA, 40 bp, Artificial Sequence
  Description of Artificial Sequence: Synthetic oligonucleotide
tgttttgccaaataaccgtcaactttatgagatggtcctg

SEQ ID NO: 116373 - DNA, 39 bp, Artificial Sequence
  Description of Artificial Sequence: Synthetic oligonucleotide
gttttgccaaataaccgtcaactttatgagatggtcctg

SEQ ID NO: 116374 - DNA, 40 bp, Artificial Sequence
  Description of Artificial Sequence: Synthetic oligonucleotide
ttttgccaaataaccgtcaactttatgagatggtcctgac

SEQ ID NO: 116375 - DNA, 39 bp, Artificial Sequence
  Description of Artificial Sequence: Synthetic oligonucleotide
tttgccaaataaccgtcaactttatgagatggtcctgac

SEQ ID NO: 116376 - DNA, 38 bp, Artificial Sequence
  Description of Artificial Sequence: Synthetic oligonucleotide
ttgccaaataaccgtcaactttatgagatggtcctgac

SEQ ID NO: 116377 - DNA, 37 bp, Artificial Sequence
  Description of Artificial Sequence: Synthetic oligonucleotide
tgccaaataaccgtcaactttatgagatggtcctgac

SEQ ID NO: 116378 - DNA, 36 bp, Artificial Sequence
  Description of Artificial Sequence: Synthetic oligonucleotide
gccaaataaccgtcaactttatgagatggtcctgac

SEQ ID NO: 116379 - DNA, 42 bp, Artificial Sequence
  Description of Artificial Sequence: Synthetic oligonucleotide
ccaaataaccgtcaactttatgagatggtcctgacatataac

SEQ ID NO: 116380 - DNA, 45 bp, Artificial Sequence
  Description of Artificial Sequence: Synthetic oligonucleotide
caaataaccgtcaactttatgagatggtcctgacatataactttc

SEQ ID NO: 116381 - DNA, 47 bp, Artificial Sequence
  Description of Artificial Sequence: Synthetic oligonucleotide
aaataaccgtcaactttatgagatggtcctgacatataactttcatc

SEQ ID NO: 116382 - DNA, 46 bp, Artificial Sequence
  Description of Artificial Sequence: Synthetic oligonucleotide
aataaccgtcaactttatgagatggtcctgacatataactttcatc

SEQ ID NO: 116383 - DNA, 45 bp, Artificial Sequence
  Description of Artificial Sequence: Synthetic oligonucleotide
ataaccgtcaactttatgagatggtcctgacatataactttcatc

SEQ ID NO: 116384 - DNA, 44 bp, Artificial Sequence
  Description of Artificial Sequence: Synthetic oligonucleotide
taaccgtcaactttatgagatggtcctgacatataactttcatc

SEQ ID NO: 116385 - DNA, 43 bp, Artificial Sequence
  Description of Artificial Sequence: Synthetic oligonucleotide
aaccgtcaactttatgagatggtcctgacatataactttcatc

SEQ ID NO: 116386 - DNA, 42 bp, Artificial Sequence
  Description of Artificial Sequence: Synthetic oligonucleotide
accgtcaactttatgagatggtcctgacatataactttcatc

SEQ ID NO: 116387 - DNA, 41 bp, Artificial Sequence
  Description of Artificial Sequence: Synthetic oligonucleotide
ccgtcaactttatgagatggtcctgacatataactttcatc

SEQ ID NO: 116388 - DNA, 43 bp, Artificial Sequence
  Description of Artificial Sequence: Synthetic oligonucleotide
cgtcaactttatgagatggtcctgacatataactttcatcaac

SEQ ID NO: 116389 - DNA, 43 bp, Artificial Sequence
  Description of Artificial Sequence: Synthetic oligonucleotide
gtcaactttatgagatggtcctgacatataactttcatcaacc

SEQ ID NO: 116390 - DNA, 43 bp, Artificial Sequence
  Description of Artificial Sequence: Synthetic oligonucleotide
tcaactttatgagatggtcctgacatataactttcatcaaccc

SEQ ID NO: 116391 - DNA, 42 bp, Artificial Sequence
  Description of Artificial Sequence: Synthetic oligonucleotide
caactttatgagatggtcctgacatataactttcatcaaccc

SEQ ID NO: 116392 - DNA, 44 bp, Artificial Sequence
  Description of Artificial Sequence: Synthetic oligonucleotide
aactttatgagatggtcctgacatataactttcatcaacccaag

SEQ ID NO: 116393 - DNA, 43 bp, Artificial Sequence
  Description of Artificial Sequence: Synthetic oligonucleotide
actttatgagatggtcctgacatataactttcatcaacccaag

SEQ ID NO: 116394 - DNA, 42 bp, Artificial Sequence
  Description of Artificial Sequence: Synthetic oligonucleotide
ctttatgagatggtcctgacatataactttcatcaacccaag

SEQ ID NO: 116395 - DNA, 43 bp, Artificial Sequence
  Description of Artificial Sequence: Synthetic oligonucleotide
tttatgagatggtcctgacatataactttcatcaacccaagag

SEQ ID NO: 116396 - DNA, 42 bp, Artificial Sequence
  Description of Artificial Sequence: Synthetic oligonucleotide
ttatgagatggtcctgacatataactttcatcaacccaagag

SEQ ID NO: 116397 - DNA, 41 bp, Artificial Sequence
  Description of Artificial Sequence: Synthetic oligonucleotide
tatgagatggtcctgacatataactttcatcaacccaagag

SEQ ID NO: 116398 - DNA, 40 bp, Artificial Sequence
  Description of Artificial Sequence: Synthetic oligonucleotide
atgagatggtcctgacatataactttcatcaacccaagag

SEQ ID NO: 116399 - DNA, 39 bp, Artificial Sequence
  Description of Artificial Sequence: Synthetic oligonucleotide
tgagatggtcctgacatataactttcatcaacccaagag

SEQ ID NO: 116400 - DNA, 38 bp, Artificial Sequence
  Description of Artificial Sequence: Synthetic oligonucleotide
gagatggtcctgacatataactttcatcaacccaagag

SEQ ID NO: 116401 - DNA, 39 bp, Artificial Sequence
  Description of Artificial Sequence: Synthetic oligonucleotide
agatggtcctgacatataactttcatcaacccaagagtg

SEQ ID NO: 116402 - DNA, 38 bp, Artificial Sequence
  Description of Artificial Sequence: Synthetic oligonucleotide
gatggtcctgacatataactttcatcaacccaagagtg

SEQ ID NO: 116403 - DNA, 38 bp, Artificial Sequence
  Description of Artificial Sequence: Synthetic oligonucleotide
atggtcctgacatataactttcatcaacccaagagtgg

SEQ ID NO: 116404 - DNA, 37 bp, Artificial Sequence
  Description of Artificial Sequence: Synthetic oligonucleotide
tggtcctgacatataactttcatcaacccaagagtgg

SEQ ID NO: 116405 - DNA, 36 bp, Artificial Sequence
  Description of Artificial Sequence: Synthetic oligonucleotide
ggtcctgacatataactttcatcaacccaagagtgg

SEQ ID NO: 116406 - DNA, 36 bp, Artificial Sequence
  Description of Artificial Sequence: Synthetic oligonucleotide
gtcctgacatataactttcatcaacccaagagtggg

SEQ ID NO: 116407 - DNA, 36 bp, Artificial Sequence
  Description of Artificial Sequence: Synthetic oligonucleotide
tcctgacatataactttcatcaacccaagagtgggg

SEQ ID NO: 116408 - DNA, 35 bp, Artificial Sequence
  Description of Artificial Sequence: Synthetic oligonucleotide
cctgacatataactttcatcaacccaagagtgggg

SEQ ID NO: 116409 - DNA, 37 bp, Artificial Sequence
  Description of Artificial Sequence: Synthetic oligonucleotide
ctgacatataactttcatcaacccaagagtggggaag

SEQ ID NO: 116410 - DNA, 40 bp, Artificial Sequence
  Description of Artificial Sequence: Synthetic oligonucleotide
tgacatataactttcatcaacccaagagtggggaagtaac

SEQ ID NO: 116411 - DNA, 39 bp, Artificial Sequence
  Description of Artificial Sequence: Synthetic oligonucleotide
gacatataactttcatcaacccaagagtggggaagtaac

SEQ ID NO: 116412 - DNA, 40 bp, Artificial Sequence
  Description of Artificial Sequence: Synthetic oligonucleotide
acatataactttcatcaacccaagagtggggaagtaactc

SEQ ID NO: 116413 - DNA, 39 bp, Artificial Sequence
  Description of Artificial Sequence: Synthetic oligonucleotide
catataactttcatcaacccaagagtggggaagtaactc

SEQ ID NO: 116414 - DNA, 39 bp, Artificial Sequence
  Description of Artificial Sequence: Synthetic oligonucleotide
atataactttcatcaacccaagagtggggaagtaactcc

SEQ ID NO: 116415 - DNA, 38 bp, Artificial Sequence
  Description of Artificial Sequence: Synthetic oligonucleotide
tataactttcatcaacccaagagtggggaagtaactcc

SEQ ID NO: 116416 - DNA, 37 bp, Artificial Sequence
  Description of Artificial Sequence: Synthetic oligonucleotide
ataactttcatcaacccaagagtggggaagtaactcc

SEQ ID NO: 116417 - DNA, 36 bp, Artificial Sequence
  Description of Artificial Sequence: Synthetic oligonucleotide
taactttcatcaacccaagagtggggaagtaactcc

SEQ ID NO: 116418 - DNA, 35 bp, Artificial Sequence
  Description of Artificial Sequence: Synthetic oligonucleotide
aactttcatcaacccaagagtggggaagtaactcc

SEQ ID NO: 116419 - DNA, 34 bp, Artificial Sequence
  Description of Artificial Sequence: Synthetic oligonucleotide
actttcatcaacccaagagtggggaagtaactcc

SEQ ID NO: 116420 - DNA, 33 bp, Artificial Sequence
  Description of Artificial Sequence: Synthetic oligonucleotide
ctttcatcaacccaagagtggggaagtaactcc

SEQ ID NO: 116421 - DNA, 35 bp, Artificial Sequence
  Description of Artificial Sequence: Synthetic oligonucleotide
tttcatcaacccaagagtggggaagtaactccaag

SEQ ID NO: 116422 - DNA, 34 bp, Artificial Sequence
  Description of Artificial Sequence: Synthetic oligonucleotide
ttcatcaacccaagagtggggaagtaactccaag

SEQ ID NO: 116423 - DNA, 33 bp, Artificial Sequence
  Description of Artificial Sequence: Synthetic oligonucleotide
tcatcaacccaagagtggggaagtaactccaag

SEQ ID NO: 116424 - DNA, 32 bp, Artificial Sequence
  Description of Artificial Sequence: Synthetic oligonucleotide
catcaacccaagagtggggaagtaactccaag

SEQ ID NO: 116425 - DNA, 32 bp, Artificial Sequence
  Description of Artificial Sequence: Synthetic oligonucleotide
atcaacccaagagtggggaagtaactccaagc

SEQ ID NO: 116426 - DNA, 31 bp, Artificial Sequence
  Description of Artificial Sequence: Synthetic oligonucleotide
tcaacccaagagtggggaagtaactccaagc

SEQ ID NO: 116427 - DNA, 30 bp, Artificial Sequence
  Description of Artificial Sequence: Synthetic oligonucleotide
caacccaagagtggggaagtaactccaagc

SEQ ID NO: 116428 - DNA, 31 bp, Artificial Sequence
  Description of Artificial Sequence: Synthetic oligonucleotide
aacccaagagtggggaagtaactccaagctg

SEQ ID NO: 116429 - DNA, 30 bp, Artificial Sequence
  Description of Artificial Sequence: Synthetic oligonucleotide
acccaagagtggggaagtaactccaagctg

SEQ ID NO: 116430 - DNA, 29 bp, Artificial Sequence
  Description of Artificial Sequence: Synthetic oligonucleotide
cccaagagtggggaagtaactccaagctg

SEQ ID NO: 116431 - DNA, 29 bp, Artificial Sequence
  Description of Artificial Sequence: Synthetic oligonucleotide
ccaagagtggggaagtaactccaagctgc

SEQ ID NO: 116432 - DNA, 29 bp, Artificial Sequence
  Description of Artificial Sequence: Synthetic oligonucleotide
caagagtggggaagtaactccaagctgcc

SEQ ID NO: 116433 - DNA, 29 bp, Artificial Sequence
  Description of Artificial Sequence: Synthetic oligonucleotide
aagagtggggaagtaactccaagctgccc

SEQ ID NO: 116434 - DNA, 28 bp, Artificial Sequence
  Description of Artificial Sequence: Synthetic oligonucleotide
agagtggggaagtaactccaagctgccc

SEQ ID NO: 116435 - DNA, 27 bp, Artificial Sequence
  Description of Artificial Sequence: Synthetic oligonucleotide
gagtggggaagtaactccaagctgccc

SEQ ID NO: 116436 - DNA, 28 bp, Artificial Sequence
  Description of Artificial Sequence: Synthetic oligonucleotide
agtggggaagtaactccaagctgcccac

SEQ ID NO: 116437 - DNA, 27 bp, Artificial Sequence
  Description of Artificial Sequence: Synthetic oligonucleotide
gtggggaagtaactccaagctgcccac

SEQ ID NO: 116438 - DNA, 29 bp, Artificial Sequence
  Description of Artificial Sequence: Synthetic oligonucleotide
tggggaagtaactccaagctgcccactac

SEQ ID NO: 116439 - DNA, 28 bp, Artificial Sequence
  Description of Artificial Sequence: Synthetic oligonucleotide
ggggaagtaactccaagctgcccactac

SEQ ID NO: 116440 - DNA, 31 bp, Artificial Sequence
  Description of Artificial Sequence: Synthetic oligonucleotide
gggaagtaactccaagctgcccactactttg

SEQ ID NO: 116441 - DNA, 32 bp, Artificial Sequence
  Description of Artificial Sequence: Synthetic oligonucleotide
ggaagtaactccaagctgcccactactttgtg

SEQ ID NO: 116442 - DNA, 34 bp, Artificial Sequence
  Description of Artificial Sequence: Synthetic oligonucleotide
gaagtaactccaagctgcccactactttgtgaac

SEQ ID NO: 116443 - DNA, 42 bp, Artificial Sequence
  Description of Artificial Sequence: Synthetic oligonucleotide
aagtaactccaagctgcccactactttgtgaactattatatg

SEQ ID NO: 116444 - DNA, 41 bp, Artificial Sequence
  Description of Artificial Sequence: Synthetic oligonucleotide
agtaactccaagctgcccactactttgtgaactattatatg

SEQ ID NO: 116445 - DNA, 40 bp, Artificial Sequence
  Description of Artificial Sequence: Synthetic oligonucleotide
gtaactccaagctgcccactactttgtgaactattatatg

SEQ ID NO: 116446 - DNA, 43 bp, Artificial Sequence
  Description of Artificial Sequence: Synthetic oligonucleotide
taactccaagctgcccactactttgtgaactattatatgaatc

SEQ ID NO: 116447 - DNA, 42 bp, Artificial Sequence
  Description of Artificial Sequence: Synthetic oligonucleotide
aactccaagctgcccactactttgtgaactattatatgaatc

SEQ ID NO: 116448 - DNA, 41 bp, Artificial Sequence
  Description of Artificial Sequence: Synthetic oligonucleotide
actccaagctgcccactactttgtgaactattatatgaatc

SEQ ID NO: 116449 - DNA, 40 bp, Artificial Sequence
  Description of Artificial Sequence: Synthetic oligonucleotide
ctccaagctgcccactactttgtgaactattatatgaatc

SEQ ID NO: 116450 - DNA, 41 bp, Artificial Sequence
  Description of Artificial Sequence: Synthetic oligonucleotide
tccaagctgcccactactttgtgaactattatatgaatctg

SEQ ID NO: 116451 - DNA, 40 bp, Artificial Sequence
  Description of Artificial Sequence: Synthetic oligonucleotide
ccaagctgcccactactttgtgaactattatatgaatctg

SEQ ID NO: 116452 - DNA, 45 bp, Artificial Sequence
  Description of Artificial Sequence: Synthetic oligonucleotide
caagctgcccactactttgtgaactattatatgaatctgaatttg

SEQ ID NO: 116453 - DNA, 46 bp, Artificial Sequence
  Description of Artificial Sequence: Synthetic oligonucleotide
aagctgcccactactttgtgaactattatatgaatctgaatttgac

SEQ ID NO: 116454 - DNA, 45 bp, Artificial Sequence
  Description of Artificial Sequence: Synthetic oligonucleotide
agctgcccactactttgtgaactattatatgaatctgaatttgac

SEQ ID NO: 116455 - DNA, 44 bp, Artificial Sequence
  Description of Artificial Sequence: Synthetic oligonucleotide
gctgcccactactttgtgaactattatatgaatctgaatttgac

SEQ ID NO: 116456 - DNA, 45 bp, Artificial Sequence
  Description of Artificial Sequence: Synthetic oligonucleotide
ctgcccactactttgtgaactattatatgaatctgaatttgacag

SEQ ID NO: 116457 - DNA, 45 bp, Artificial Sequence
  Description of Artificial Sequence: Synthetic oligonucleotide
tgcccactactttgtgaactattatatgaatctgaatttgacagc

SEQ ID NO: 116458 - DNA, 44 bp, Artificial Sequence
  Description of Artificial Sequence: Synthetic oligonucleotide
gcccactactttgtgaactattatatgaatctgaatttgacagc

SEQ ID NO: 116459 - DNA, 44 bp, Artificial Sequence
  Description of Artificial Sequence: Synthetic oligonucleotide
cccactactttgtgaactattatatgaatctgaatttgacagcc

SEQ ID NO: 116460 - DNA, 46 bp, Artificial Sequence
  Description of Artificial Sequence: Synthetic oligonucleotide
ccactactttgtgaactattatatgaatctgaatttgacagccaac

SEQ ID NO: 116461 - DNA, 47 bp, Artificial Sequence
  Description of Artificial Sequence: Synthetic oligonucleotide
cactactttgtgaactattatatgaatctgaatttgacagccaactg

SEQ ID NO: 116462 - DNA, 48 bp, Artificial Sequence
  Description of Artificial Sequence: Synthetic oligonucleotide
actactttgtgaactattatatgaatctgaatttgacagccaactgtg

SEQ ID NO: 116463 - DNA, 47 bp, Artificial Sequence
  Description of Artificial Sequence: Synthetic oligonucleotide
ctactttgtgaactattatatgaatctgaatttgacagccaactgtg

SEQ ID NO: 116464 - DNA, 47 bp, Artificial Sequence
  Description of Artificial Sequence: Synthetic oligonucleotide
tactttgtgaactattatatgaatctgaatttgacagccaactgtgg

SEQ ID NO: 116465 - DNA, 46 bp, Artificial Sequence
  Description of Artificial Sequence: Synthetic oligonucleotide
actttgtgaactattatatgaatctgaatttgacagccaactgtgg

SEQ ID NO: 116466 - DNA, 45 bp, Artificial Sequence
  Description of Artificial Sequence: Synthetic oligonucleotide
ctttgtgaactattatatgaatctgaatttgacagccaactgtgg

SEQ ID NO: 116467 - DNA, 54 bp, Artificial Sequence
  Description of Artificial Sequence: Synthetic oligonucleotide
tttgtgaactattatatgaatctgaatttgacagccaactgtggattatttttg

SEQ ID NO: 116468 - DNA, 53 bp, Artificial Sequence
  Description of Artificial Sequence: Synthetic oligonucleotide
ttgtgaactattatatgaatctgaatttgacagccaactgtggattatttttg

SEQ ID NO: 116469 - DNA, 52 bp, Artificial Sequence
  Description of Artificial Sequence: Synthetic oligonucleotide
tgtgaactattatatgaatctgaatttgacagccaactgtggattatttttg

SEQ ID NO: 116470 - DNA, 51 bp, Artificial Sequence
  Description of Artificial Sequence: Synthetic oligonucleotide
gtgaactattatatgaatctgaatttgacagccaactgtggattatttttg

SEQ ID NO: 116471 - DNA, 52 bp, Artificial Sequence
  Description of Artificial Sequence: Synthetic oligonucleotide
tgaactattatatgaatctgaatttgacagccaactgtggattatttttgac

SEQ ID NO: 116472 - DNA, 51 bp, Artificial Sequence
  Description of Artificial Sequence: Synthetic oligonucleotide
gaactattatatgaatctgaatttgacagccaactgtggattatttttgac

SEQ ID NO: 116473 - DNA, 51 bp, Artificial Sequence
  Description of Artificial Sequence: Synthetic oligonucleotide
aactattatatgaatctgaatttgacagccaactgtggattatttttgacc

SEQ ID NO: 116474 - DNA, 50 bp, Artificial Sequence
  Description of Artificial Sequence: Synthetic oligonucleotide
actattatatgaatctgaatttgacagccaactgtggattatttttgacc

SEQ ID NO: 116475 - DNA, 49 bp, Artificial Sequence
  Description of Artificial Sequence: Synthetic oligonucleotide
ctattatatgaatctgaatttgacagccaactgtggattatttttgacc

SEQ ID NO: 116476 - DNA, 50 bp, Artificial Sequence
  Description of Artificial Sequence: Synthetic oligonucleotide
tattatatgaatctgaatttgacagccaactgtggattatttttgaccag

SEQ ID NO: 116477 - DNA, 49 bp, Artificial Sequence
  Description of Artificial Sequence: Synthetic oligonucleotide
attatatgaatctgaatttgacagccaactgtggattatttttgaccag

SEQ ID NO: 116478 - DNA, 48 bp, Artificial Sequence
  Description of Artificial Sequence: Synthetic oligonucleotide
ttatatgaatctgaatttgacagccaactgtggattatttttgaccag

SEQ ID NO: 116479 - DNA, 47 bp, Artificial Sequence
  Description of Artificial Sequence: Synthetic oligonucleotide
tatatgaatctgaatttgacagccaactgtggattatttttgaccag

SEQ ID NO: 116480 - DNA, 46 bp, Artificial Sequence
  Description of Artificial Sequence: Synthetic oligonucleotide
atatgaatctgaatttgacagccaactgtggattatttttgaccag

SEQ ID NO: 116481 - DNA, 45 bp, Artificial Sequence
  Description of Artificial Sequence: Synthetic oligonucleotide
tatgaatctgaatttgacagccaactgtggattatttttgaccag

SEQ ID NO: 116482 - DNA, 44 bp, Artificial Sequence
  Description of Artificial Sequence: Synthetic oligonucleotide
atgaatctgaatttgacagccaactgtggattatttttgaccag

SEQ ID NO: 116483 - DNA, 43 bp, Artificial Sequence
  Description of Artificial Sequence: Synthetic oligonucleotide
tgaatctgaatttgacagccaactgtggattatttttgaccag

SEQ ID NO: 116484 - DNA, 42 bp, Artificial Sequence
  Description of Artificial Sequence: Synthetic oligonucleotide
gaatctgaatttgacagccaactgtggattatttttgaccag

SEQ ID NO: 116485 - DNA, 44 bp, Artificial Sequence
  Description of Artificial Sequence: Synthetic oligonucleotide
aatctgaatttgacagccaactgtggattatttttgaccagaac

SEQ ID NO: 116486 - DNA, 43 bp, Artificial Sequence
  Description of Artificial Sequence: Synthetic oligonucleotide
atctgaatttgacagccaactgtggattatttttgaccagaac

SEQ ID NO: 116487 - DNA, 42 bp, Artificial Sequence
  Description of Artificial Sequence: Synthetic oligonucleotide
tctgaatttgacagccaactgtggattatttttgaccagaac

SEQ ID NO: 116488 - DNA, 41 bp, Artificial Sequence
  Description of Artificial Sequence: Synthetic oligonucleotide
ctgaatttgacagccaactgtggattatttttgaccagaac

SEQ ID NO: 116489 - DNA, 45 bp, Artificial Sequence
  Description of Artificial Sequence: Synthetic oligonucleotide
tgaatttgacagccaactgtggattatttttgaccagaacaaaag

SEQ ID NO: 116490 - DNA, 44 bp, Artificial Sequence
  Description of Artificial Sequence: Synthetic oligonucleotide
gaatttgacagccaactgtggattatttttgaccagaacaaaag

SEQ ID NO: 116491 - DNA, 45 bp, Artificial Sequence
  Description of Artificial Sequence: Synthetic oligonucleotide
aatttgacagccaactgtggattatttttgaccagaacaaaagac

SEQ ID NO: 116492 - DNA, 44 bp, Artificial Sequence
  Description of Artificial Sequence: Synthetic oligonucleotide
atttgacagccaactgtggattatttttgaccagaacaaaagac

SEQ ID NO: 116493 - DNA, 43 bp, Artificial Sequence
  Description of Artificial Sequence: Synthetic oligonucleotide
tttgacagccaactgtggattatttttgaccagaacaaaagac

SEQ ID NO: 116494 - DNA, 42 bp, Artificial Sequence
  Description of Artificial Sequence: Synthetic oligonucleotide
ttgacagccaactgtggattatttttgaccagaacaaaagac

SEQ ID NO: 116495 - DNA, 41 bp, Artificial Sequence
  Description of Artificial Sequence: Synthetic oligonucleotide
tgacagccaactgtggattatttttgaccagaacaaaagac

SEQ ID NO: 116496 - DNA, 40 bp, Artificial Sequence
  Description of Artificial Sequence: Synthetic oligonucleotide
gacagccaactgtggattatttttgaccagaacaaaagac

SEQ ID NO: 116497 - DNA, 41 bp, Artificial Sequence
  Description of Artificial Sequence: Synthetic oligonucleotide
acagccaactgtggattatttttgaccagaacaaaagacag

SEQ ID NO: 116498 - DNA, 40 bp, Artificial Sequence
  Description of Artificial Sequence: Synthetic oligonucleotide
cagccaactgtggattatttttgaccagaacaaaagacag

SEQ ID NO: 116499 - DNA, 42 bp, Artificial Sequence
  Description of Artificial Sequence: Synthetic oligonucleotide
agccaactgtggattatttttgaccagaacaaaagacagatg

SEQ ID NO: 116500 - DNA, 41 bp, Artificial Sequence
  Description of Artificial Sequence: Synthetic oligonucleotide
gccaactgtggattatttttgaccagaacaaaagacagatg

SEQ ID NO: 116501 - DNA, 41 bp, Artificial Sequence
  Description of Artificial Sequence: Synthetic oligonucleotide
ccaactgtggattatttttgaccagaacaaaagacagatgg

SEQ ID NO: 116502 - DNA, 41 bp, Artificial Sequence
  Description of Artificial Sequence: Synthetic oligonucleotide
caactgtggattatttttgaccagaacaaaagacagatggg

SEQ ID NO: 116503 - DNA, 43 bp, Artificial Sequence
  Description of Artificial Sequence: Synthetic oligonucleotide
aactgtggattatttttgaccagaacaaaagacagatgggttc

SEQ ID NO: 116504 - DNA, 42 bp, Artificial Sequence
  Description of Artificial Sequence: Synthetic oligonucleotide
actgtggattatttttgaccagaacaaaagacagatgggttc

SEQ ID NO: 116505 - DNA, 41 bp, Artificial Sequence
  Description of Artificial Sequence: Synthetic oligonucleotide
ctgtggattatttttgaccagaacaaaagacagatgggttc

SEQ ID NO: 116506 - DNA, 42 bp, Artificial Sequence
  Description of Artificial Sequence: Synthetic oligonucleotide
tgtggattatttttgaccagaacaaaagacagatgggttcag

SEQ ID NO: 116507 - DNA, 41 bp, Artificial Sequence
  Description of Artificial Sequence: Synthetic oligonucleotide
gtggattatttttgaccagaacaaaagacagatgggttcag

SEQ ID NO: 116508 - DNA, 41 bp, Artificial Sequence
  Description of Artificial Sequence: Synthetic oligonucleotide
tggattatttttgaccagaacaaaagacagatgggttcagg

SEQ ID NO: 116509 - DNA, 40 bp, Artificial Sequence
  Description of Artificial Sequence: Synthetic oligonucleotide
ggattatttttgaccagaacaaaagacagatgggttcagg

SEQ ID NO: 116510 - DNA, 40 bp, Artificial Sequence
  Description of Artificial Sequence: Synthetic oligonucleotide
gattatttttgaccagaacaaaagacagatgggttcaggc

SEQ ID NO: 116511 - DNA, 40 bp, Artificial Sequence
  Description of Artificial Sequence: Synthetic oligonucleotide
attatttttgaccagaacaaaagacagatgggttcaggcg

SEQ ID NO: 116512 - DNA, 39 bp, Artificial Sequence
  Description of Artificial Sequence: Synthetic oligonucleotide
ttatttttgaccagaacaaaagacagatgggttcaggcg

SEQ ID NO: 116513 - DNA, 38 bp, Artificial Sequence
  Description of Artificial Sequence: Synthetic oligonucleotide
tatttttgaccagaacaaaagacagatgggttcaggcg

SEQ ID NO: 116514 - DNA, 37 bp, Artificial Sequence
  Description of Artificial Sequence: Synthetic oligonucleotide
atttttgaccagaacaaaagacagatgggttcaggcg

SEQ ID NO: 116515 - DNA, 36 bp, Artificial Sequence
  Description of Artificial Sequence: Synthetic oligonucleotide
tttttgaccagaacaaaagacagatgggttcaggcg

SEQ ID NO: 116516 - DNA, 35 bp, Artificial Sequence
  Description of Artificial Sequence: Synthetic oligonucleotide
ttttgaccagaacaaaagacagatgggttcaggcg

SEQ ID NO: 116517 - DNA, 34 bp, Artificial Sequence
  Description of Artificial Sequence: Synthetic oligonucleotide
tttgaccagaacaaaagacagatgggttcaggcg

SEQ ID NO: 116518 - DNA, 33 bp, Artificial Sequence
  Description of Artificial Sequence: Synthetic oligonucleotide
ttgaccagaacaaaagacagatgggttcaggcg

SEQ ID NO: 116519 - DNA, 32 bp, Artificial Sequence
  Description of Artificial Sequence: Synthetic oligonucleotide
tgaccagaacaaaagacagatgggttcaggcg

SEQ ID NO: 116520 - DNA, 31 bp, Artificial Sequence
  Description of Artificial Sequence: Synthetic oligonucleotide
gaccagaacaaaagacagatgggttcaggcg

SEQ ID NO: 116521 - DNA, 33 bp, Artificial Sequence
  Description of Artificial Sequence: Synthetic oligonucleotide
accagaacaaaagacagatgggttcaggcgatg

SEQ ID NO: 116522 - DNA, 32 bp, Artificial Sequence
  Description of Artificial Sequence: Synthetic oligonucleotide
ccagaacaaaagacagatgggttcaggcgatg

SEQ ID NO: 116523 - DNA, 32 bp, Artificial Sequence
  Description of Artificial Sequence: Synthetic oligonucleotide
cagaacaaaagacagatgggttcaggcgatgc

SEQ ID NO: 116524 - DNA, 32 bp, Artificial Sequence
  Description of Artificial Sequence: Synthetic oligonucleotide
agaacaaaagacagatgggttcaggcgatgcc

SEQ ID NO: 116525 - DNA, 31 bp, Artificial Sequence
  Description of Artificial Sequence: Synthetic oligonucleotide
gaacaaaagacagatgggttcaggcgatgcc

SEQ ID NO: 116526 - DNA, 34 bp, Artificial Sequence
  Description of Artificial Sequence: Synthetic oligonucleotide
aacaaaagacagatgggttcaggcgatgcctatc

SEQ ID NO: 116527 - DNA, 33 bp, Artificial Sequence
  Description of Artificial Sequence: Synthetic oligonucleotide
acaaaagacagatgggttcaggcgatgcctatc

SEQ ID NO: 116528 - DNA, 32 bp, Artificial Sequence
  Description of Artificial Sequence: Synthetic oligonucleotide
caaaagacagatgggttcaggcgatgcctatc

SEQ ID NO: 116529 - DNA, 32 bp, Artificial Sequence
  Description of Artificial Sequence: Synthetic oligonucleotide
aaaagacagatgggttcaggcgatgcctatcc

SEQ ID NO: 116530 - DNA, 31 bp, Artificial Sequence
  Description of Artificial Sequence: Synthetic oligonucleotide
aaagacagatgggttcaggcgatgcctatcc

SEQ ID NO: 116531 - DNA, 30 bp, Artificial Sequence
  Description of Artificial Sequence: Synthetic oligonucleotide
aagacagatgggttcaggcgatgcctatcc

SEQ ID NO: 116532 - DNA, 29 bp, Artificial Sequence
  Description of Artificial Sequence: Synthetic oligonucleotide
agacagatgggttcaggcgatgcctatcc

SEQ ID NO: 116533 - DNA, 28 bp, Artificial Sequence
  Description of Artificial Sequence: Synthetic oligonucleotide
gacagatgggttcaggcgatgcctatcc

SEQ ID NO: 116534 - DNA, 29 bp, Artificial Sequence
  Description of Artificial Sequence: Synthetic oligonucleotide
acagatgggttcaggcgatgcctatccac

SEQ ID NO: 116535 - DNA, 28 bp, Artificial Sequence
  Description of Artificial Sequence: Synthetic oligonucleotide
cagatgggttcaggcgatgcctatccac

SEQ ID NO: 116536 - DNA, 30 bp, Artificial Sequence
  Description of Artificial Sequence: Synthetic oligonucleotide
agatgggttcaggcgatgcctatccacatc

SEQ ID NO: 116537 - DNA, 29 bp, Artificial Sequence
  Description of Artificial Sequence: Synthetic oligonucleotide
gatgggttcaggcgatgcctatccacatc

SEQ ID NO: 116538 - DNA, 30 bp, Artificial Sequence
  Description of Artificial Sequence: Synthetic oligonucleotide
atgggttcaggcgatgcctatccacatcag

SEQ ID NO: 116539 - DNA, 29 bp, Artificial Sequence
  Description of Artificial Sequence: Synthetic oligonucleotide
tgggttcaggcgatgcctatccacatcag

SEQ ID NO: 116540 - DNA, 28 bp, Artificial Sequence
  Description of Artificial Sequence: Synthetic oligonucleotide
gggttcaggcgatgcctatccacatcag

SEQ ID NO: 116541 - DNA, 32 bp, Artificial Sequence
  Description of Artificial Sequence: Synthetic oligonucleotide
ggttcaggcgatgcctatccacatcagtattc

SEQ ID NO: 116542 - DNA, 35 bp, Artificial Sequence
  Description of Artificial Sequence: Synthetic oligonucleotide
gttcaggcgatgcctatccacatcagtattctttg

SEQ ID NO: 116543 - DNA, 38 bp, Artificial Sequence
  Description of Artificial Sequence: Synthetic oligonucleotide
ttcaggcgatgcctatccacatcagtattctttgaaac

SEQ ID NO: 116544 - DNA, 37 bp, Artificial Sequence
  Description of Artificial Sequence: Synthetic oligonucleotide
tcaggcgatgcctatccacatcagtattctttgaaac

SEQ ID NO: 116545 - DNA, 36 bp, Artificial Sequence
  Description of Artificial Sequence: Synthetic oligonucleotide
caggcgatgcctatccacatcagtattctttgaaac

SEQ ID NO: 116546 - DNA, 37 bp, Artificial Sequence
  Description of Artificial Sequence: Synthetic oligonucleotide
aggcgatgcctatccacatcagtattctttgaaactg

SEQ ID NO: 116547 - DNA, 36 bp, Artificial Sequence
  Description of Artificial Sequence: Synthetic oligonucleotide
ggcgatgcctatccacatcagtattctttgaaactg

SEQ ID NO: 116548 - DNA, 36 bp, Artificial Sequence
  Description of Artificial Sequence: Synthetic oligonucleotide
gcgatgcctatccacatcagtattctttgaaactgg

SEQ ID NO: 116549 - DNA, 37 bp, Artificial Sequence
  Description of Artificial Sequence: Synthetic oligonucleotide
cgatgcctatccacatcagtattctttgaaactggag

SEQ ID NO: 116550 - DNA, 40 bp, Artificial Sequence
  Description of Artificial Sequence: Synthetic oligonucleotide
gatgcctatccacatcagtattctttgaaactggagaaag

SEQ ID NO: 116551 - DNA, 40 bp, Artificial Sequence
  Description of Artificial Sequence: Synthetic oligonucleotide
atgcctatccacatcagtattctttgaaactggagaaagg

SEQ ID NO: 116552 - DNA, 39 bp, Artificial Sequence
  Description of Artificial Sequence: Synthetic oligonucleotide
tgcctatccacatcagtattctttgaaactggagaaagg

SEQ ID NO: 116553 - DNA, 38 bp, Artificial Sequence
  Description of Artificial Sequence: Synthetic oligonucleotide
gcctatccacatcagtattctttgaaactggagaaagg

SEQ ID NO: 116554 - DNA, 39 bp, Artificial Sequence
  Description of Artificial Sequence: Synthetic oligonucleotide
cctatccacatcagtattctttgaaactggagaaaggag

SEQ ID NO: 116555 - DNA, 45 bp, Artificial Sequence
  Description of Artificial Sequence: Synthetic oligonucleotide
ctatccacatcagtattctttgaaactggagaaaggagattatac

SEQ ID NO: 116556 - DNA, 49 bp, Artificial Sequence
  Description of Artificial Sequence: Synthetic oligonucleotide
tatccacatcagtattctttgaaactggagaaaggagattatacaattc

SEQ ID NO: 116557 - DNA, 48 bp, Artificial Sequence
  Description of Artificial Sequence: Synthetic oligonucleotide
atccacatcagtattctttgaaactggagaaaggagattatacaattc

SEQ ID NO: 116558 - DNA, 47 bp, Artificial Sequence
  Description of Artificial Sequence: Synthetic oligonucleotide
tccacatcagtattctttgaaactggagaaaggagattatacaattc

SEQ ID NO: 116559 - DNA, 46 bp, Artificial Sequence
  Description of Artificial Sequence: Synthetic oligonucleotide
ccacatcagtattctttgaaactggagaaaggagattatacaattc

SEQ ID NO: 116560 - DNA, 46 bp, Artificial Sequence
  Description of Artificial Sequence: Synthetic oligonucleotide
cacatcagtattctttgaaactggagaaaggagattatacaattcg

SEQ ID NO: 116561 - DNA, 47 bp, Artificial Sequence
  Description of Artificial Sequence: Synthetic oligonucleotide
acatcagtattctttgaaactggagaaaggagattatacaattcgac

SEQ ID NO: 116562 - DNA, 46 bp, Artificial Sequence
  Description of Artificial Sequence: Synthetic oligonucleotide
catcagtattctttgaaactggagaaaggagattatacaattcgac

SEQ ID NO: 116563 - DNA, 48 bp, Artificial Sequence
  Description of Artificial Sequence: Synthetic oligonucleotide
atcagtattctttgaaactggagaaaggagattatacaattcgactac

SEQ ID NO: 116564 - DNA, 47 bp, Artificial Sequence
  Description of Artificial Sequence: Synthetic oligonucleotide
tcagtattctttgaaactggagaaaggagattatacaattcgactac

SEQ ID NO: 116565 - DNA, 46 bp, Artificial Sequence
  Description of Artificial Sequence: Synthetic oligonucleotide
cagtattctttgaaactggagaaaggagattatacaattcgactac

SEQ ID NO: 116566 - DNA, 47 bp, Artificial Sequence
  Description of Artificial Sequence: Synthetic oligonucleotide
agtattctttgaaactggagaaaggagattatacaattcgactacag

SEQ ID NO: 116567 - DNA, 46 bp, Artificial Sequence
  Description of Artificial Sequence: Synthetic oligonucleotide
gtattctttgaaactggagaaaggagattatacaattcgactacag

SEQ ID NO: 116568 - DNA, 49 bp, Artificial Sequence
  Description of Artificial Sequence: Synthetic oligonucleotide
tattctttgaaactggagaaaggagattatacaattcgactacagattc

SEQ ID NO: 116569 - DNA, 48 bp, Artificial Sequence
  Description of Artificial Sequence: Synthetic oligonucleotide
attctttgaaactggagaaaggagattatacaattcgactacagattc

SEQ ID NO: 116570 - DNA, 47 bp, Artificial Sequence
  Description of Artificial Sequence: Synthetic oligonucleotide
ttctttgaaactggagaaaggagattatacaattcgactacagattc

SEQ ID NO: 116571 - DNA, 46 bp, Artificial Sequence
  Description of Artificial Sequence: Synthetic oligonucleotide
tctttgaaactggagaaaggagattatacaattcgactacagattc

SEQ ID NO: 116572 - DNA, 45 bp, Artificial Sequence
  Description of Artificial Sequence: Synthetic oligonucleotide
ctttgaaactggagaaaggagattatacaattcgactacagattc

SEQ ID NO: 116573 - DNA, 45 bp, Artificial Sequence
  Description of Artificial Sequence: Synthetic oligonucleotide
tttgaaactggagaaaggagattatacaattcgactacagattcg

SEQ ID NO: 116574 - DNA, 44 bp, Artificial Sequence
  Description of Artificial Sequence: Synthetic oligonucleotide
ttgaaactggagaaaggagattatacaattcgactacagattcg

SEQ ID NO: 116575 - DNA, 43 bp, Artificial Sequence
  Description of Artificial Sequence: Synthetic oligonucleotide
tgaaactggagaaaggagattatacaattcgactacagattcg

SEQ ID NO: 116576 - DNA, 42 bp, Artificial Sequence
  Description of Artificial Sequence: Synthetic oligonucleotide
gaaactggagaaaggagattatacaattcgactacagattcg

SEQ ID NO: 116577 - DNA, 42 bp, Artificial Sequence
  Description of Artificial Sequence: Synthetic oligonucleotide
aaactggagaaaggagattatacaattcgactacagattcgc

SEQ ID NO: 116578 - DNA, 41 bp, Artificial Sequence
  Description of Artificial Sequence: Synthetic oligonucleotide
aactggagaaaggagattatacaattcgactacagattcgc

SEQ ID NO: 116579 - DNA, 40 bp, Artificial Sequence
  Description of Artificial Sequence: Synthetic oligonucleotide
actggagaaaggagattatacaattcgactacagattcgc

SEQ ID NO: 116580 - DNA, 39 bp, Artificial Sequence
  Description of Artificial Sequence: Synthetic oligonucleotide
ctggagaaaggagattatacaattcgactacagattcgc

SEQ ID NO: 116581 - DNA, 39 bp, Artificial Sequence
  Description of Artificial Sequence: Synthetic oligonucleotide
tggagaaaggagattatacaattcgactacagattcgcc

SEQ ID NO: 116582 - DNA, 38 bp, Artificial Sequence
  Description of Artificial Sequence: Synthetic oligonucleotide
ggagaaaggagattatacaattcgactacagattcgcc

SEQ ID NO: 116583 - DNA, 40 bp, Artificial Sequence
  Description of Artificial Sequence: Synthetic oligonucleotide
gagaaaggagattatacaattcgactacagattcgccatg

SEQ ID NO: 116584 - DNA, 41 bp, Artificial Sequence
  Description of Artificial Sequence: Synthetic oligonucleotide
agaaaggagattatacaattcgactacagattcgccatgag

SEQ ID NO: 116585 - DNA, 40 bp, Artificial Sequence
  Description of Artificial Sequence: Synthetic oligonucleotide
gaaaggagattatacaattcgactacagattcgccatgag

SEQ ID NO: 116586 - DNA, 40 bp, Artificial Sequence
  Description of Artificial Sequence: Synthetic oligonucleotide
aaaggagattatacaattcgactacagattcgccatgagc

SEQ ID NO: 116587 - DNA, 39 bp, Artificial Sequence
  Description of Artificial Sequence: Synthetic oligonucleotide
aaggagattatacaattcgactacagattcgccatgagc

SEQ ID NO: 116588 - DNA, 38 bp, Artificial Sequence
  Description of Artificial Sequence: Synthetic oligonucleotide
aggagattatacaattcgactacagattcgccatgagc

SEQ ID NO: 116589 - DNA, 37 bp, Artificial Sequence
  Description of Artificial Sequence: Synthetic oligonucleotide
ggagattatacaattcgactacagattcgccatgagc

SEQ ID NO: 116590 - DNA, 41 bp, Artificial Sequence
  Description of Artificial Sequence: Synthetic oligonucleotide
gagattatacaattcgactacagattcgccatgagcaaatc

SEQ ID NO: 116591 - DNA, 42 bp, Artificial Sequence
  Description of Artificial Sequence: Synthetic oligonucleotide
agattatacaattcgactacagattcgccatgagcaaatcag

SEQ ID NO: 116592 - DNA, 41 bp, Artificial Sequence
  Description of Artificial Sequence: Synthetic oligonucleotide
gattatacaattcgactacagattcgccatgagcaaatcag

SEQ ID NO: 116593 - DNA, 42 bp, Artificial Sequence
  Description of Artificial Sequence: Synthetic oligonucleotide
attatacaattcgactacagattcgccatgagcaaatcagtg

SEQ ID NO: 116594 - DNA, 41 bp, Artificial Sequence
  Description of Artificial Sequence: Synthetic oligonucleotide
ttatacaattcgactacagattcgccatgagcaaatcagtg

SEQ ID NO: 116595 - DNA, 40 bp, Artificial Sequence
  Description of Artificial Sequence: Synthetic oligonucleotide
tatacaattcgactacagattcgccatgagcaaatcagtg

SEQ ID NO: 116596 - DNA, 39 bp, Artificial Sequence
  Description of Artificial Sequence: Synthetic oligonucleotide
atacaattcgactacagattcgccatgagcaaatcagtg

SEQ ID NO: 116597 - DNA, 38 bp, Artificial Sequence
  Description of Artificial Sequence: Synthetic oligonucleotide
tacaattcgactacagattcgccatgagcaaatcagtg

SEQ ID NO: 116598 - DNA, 37 bp, Artificial Sequence
  Description of Artificial Sequence: Synthetic oligonucleotide
acaattcgactacagattcgccatgagcaaatcagtg

SEQ ID NO: 116599 - DNA, 36 bp, Artificial Sequence
  Description of Artificial Sequence: Synthetic oligonucleotide
caattcgactacagattcgccatgagcaaatcagtg

SEQ ID NO: 116600 - DNA, 40 bp, Artificial Sequence
  Description of Artificial Sequence: Synthetic oligonucleotide
aattcgactacagattcgccatgagcaaatcagtgatttg

SEQ ID NO: 116601 - DNA, 39 bp, Artificial Sequence
  Description of Artificial Sequence: Synthetic oligonucleotide
attcgactacagattcgccatgagcaaatcagtgatttg

SEQ ID NO: 116602 - DNA, 38 bp, Artificial Sequence
  Description of Artificial Sequence: Synthetic oligonucleotide
ttcgactacagattcgccatgagcaaatcagtgatttg

SEQ ID NO: 116603 - DNA, 37 bp, Artificial Sequence
  Description of Artificial Sequence: Synthetic oligonucleotide
tcgactacagattcgccatgagcaaatcagtgatttg

SEQ ID NO: 116604 - DNA, 36 bp, Artificial Sequence
  Description of Artificial Sequence: Synthetic oligonucleotide
cgactacagattcgccatgagcaaatcagtgatttg

SEQ ID NO: 116605 - DNA, 36 bp, Artificial Sequence
  Description of Artificial Sequence: Synthetic oligonucleotide
gactacagattcgccatgagcaaatcagtgatttgg

SEQ ID NO: 116606 - DNA, 38 bp, Artificial Sequence
  Description of Artificial Sequence: Synthetic oligonucleotide
actacagattcgccatgagcaaatcagtgatttggaac

SEQ ID NO: 116607 - DNA, 37 bp, Artificial Sequence
  Description of Artificial Sequence: Synthetic oligonucleotide
ctacagattcgccatgagcaaatcagtgatttggaac

SEQ ID NO: 116608 - DNA, 37 bp, Artificial Sequence
  Description of Artificial Sequence: Synthetic oligonucleotide
tacagattcgccatgagcaaatcagtgatttggaacg

SEQ ID NO: 116609 - DNA, 36 bp, Artificial Sequence
  Description of Artificial Sequence: Synthetic oligonucleotide
acagattcgccatgagcaaatcagtgatttggaacg

SEQ ID NO: 116610 - DNA, 35 bp, Artificial Sequence
  Description of Artificial Sequence: Synthetic oligonucleotide
cagattcgccatgagcaaatcagtgatttggaacg

SEQ ID NO: 116611 - DNA, 35 bp, Artificial Sequence
  Description of Artificial Sequence: Synthetic oligonucleotide
agattcgccatgagcaaatcagtgatttggaacgc

SEQ ID NO: 116612 - DNA, 34 bp, Artificial Sequence
  Description of Artificial Sequence: Synthetic oligonucleotide
gattcgccatgagcaaatcagtgatttggaacgc

SEQ ID NO: 116613 - DNA, 34 bp, Artificial Sequence
  Description of Artificial Sequence: Synthetic oligonucleotide
attcgccatgagcaaatcagtgatttggaacgcc

SEQ ID NO: 116614 - DNA, 33 bp, Artificial Sequence
  Description of Artificial Sequence: Synthetic oligonucleotide
ttcgccatgagcaaatcagtgatttggaacgcc

SEQ ID NO: 116615 - DNA, 32 bp, Artificial Sequence
  Description of Artificial Sequence: Synthetic oligonucleotide
tcgccatgagcaaatcagtgatttggaacgcc

SEQ ID NO: 116616 - DNA, 31 bp, Artificial Sequence
  Description of Artificial Sequence: Synthetic oligonucleotide
cgccatgagcaaatcagtgatttggaacgcc

SEQ ID NO: 116617 - DNA, 36 bp, Artificial Sequence
  Description of Artificial Sequence: Synthetic oligonucleotide
gccatgagcaaatcagtgatttggaacgccttaaag

SEQ ID NO: 116618 - DNA, 37 bp, Artificial Sequence
  Description of Artificial Sequence: Synthetic oligonucleotide
ccatgagcaaatcagtgatttggaacgccttaaagac

SEQ ID NO: 116619 - DNA, 37 bp, Artificial Sequence
  Description of Artificial Sequence: Synthetic oligonucleotide
catgagcaaatcagtgatttggaacgccttaaagacc

SEQ ID NO: 116620 - DNA, 39 bp, Artificial Sequence
  Description of Artificial Sequence: Synthetic oligonucleotide
atgagcaaatcagtgatttggaacgccttaaagaccttc

SEQ ID NO: 116621 - DNA, 38 bp, Artificial Sequence
  Description of Artificial Sequence: Synthetic oligonucleotide
tgagcaaatcagtgatttggaacgccttaaagaccttc

SEQ ID NO: 116622 - DNA, 37 bp, Artificial Sequence
  Description of Artificial Sequence: Synthetic oligonucleotide
gagcaaatcagtgatttggaacgccttaaagaccttc

SEQ ID NO: 116623 - DNA, 37 bp, Artificial Sequence
  Description of Artificial Sequence: Synthetic oligonucleotide
agcaaatcagtgatttggaacgccttaaagaccttcc

SEQ ID NO: 116624 - DNA, 36 bp, Artificial Sequence
  Description of Artificial Sequence: Synthetic oligonucleotide
gcaaatcagtgatttggaacgccttaaagaccttcc

SEQ ID NO: 116625 - DNA, 43 bp, Artificial Sequence
  Description of Artificial Sequence: Synthetic oligonucleotide
caaatcagtgatttggaacgccttaaagaccttccatttattg

SEQ ID NO: 116626 - DNA, 46 bp, Artificial Sequence
  Description of Artificial Sequence: Synthetic oligonucleotide
aaatcagtgatttggaacgccttaaagaccttccatttattgtttc

SEQ ID NO: 116627 - DNA, 45 bp, Artificial Sequence
  Description of Artificial Sequence: Synthetic oligonucleotide
aatcagtgatttggaacgccttaaagaccttccatttattgtttc

SEQ ID NO: 116628 - DNA, 44 bp, Artificial Sequence
  Description of Artificial Sequence: Synthetic oligonucleotide
atcagtgatttggaacgccttaaagaccttccatttattgtttc

SEQ ID NO: 116629 - DNA, 43 bp, Artificial Sequence
  Description of Artificial Sequence: Synthetic oligonucleotide
tcagtgatttggaacgccttaaagaccttccatttattgtttc

SEQ ID NO: 116630 - DNA, 42 bp, Artificial Sequence
  Description of Artificial Sequence: Synthetic oligonucleotide
cagtgatttggaacgccttaaagaccttccatttattgtttc

SEQ ID NO: 116631 - DNA, 43 bp, Artificial Sequence
  Description of Artificial Sequence: Synthetic oligonucleotide
agtgatttggaacgccttaaagaccttccatttattgtttctc

SEQ ID NO: 116632 - DNA, 42 bp, Artificial Sequence
  Description of Artificial Sequence: Synthetic oligonucleotide
gtgatttggaacgccttaaagaccttccatttattgtttctc

SEQ ID NO: 116633 - DNA, 45 bp, Artificial Sequence
  Description of Artificial Sequence: Synthetic oligonucleotide
tgatttggaacgccttaaagaccttccatttattgtttctcatag

SEQ ID NO: 116634 - DNA, 44 bp, Artificial Sequence
  Description of Artificial Sequence: Synthetic oligonucleotide
gatttggaacgccttaaagaccttccatttattgtttctcatag

SEQ ID NO: 116635 - DNA, 47 bp, Artificial Sequence
  Description of Artificial Sequence: Synthetic oligonucleotide
atttggaacgccttaaagaccttccatttattgtttctcatagattg

SEQ ID NO: 116636 - DNA, 46 bp, Artificial Sequence
  Description of Artificial Sequence: Synthetic oligonucleotide
tttggaacgccttaaagaccttccatttattgtttctcatagattg

SEQ ID NO: 116637 - DNA, 45 bp, Artificial Sequence
  Description of Artificial Sequence: Synthetic oligonucleotide
ttggaacgccttaaagaccttccatttattgtttctcatagattg

SEQ ID NO: 116638 - DNA, 44 bp, Artificial Sequence
  Description of Artificial Sequence: Synthetic oligonucleotide
tggaacgccttaaagaccttccatttattgtttctcatagattg

SEQ ID NO: 116639 - DNA, 43 bp, Artificial Sequence
  Description of Artificial Sequence: Synthetic oligonucleotide
ggaacgccttaaagaccttccatttattgtttctcatagattg

SEQ ID NO: 116640 - DNA, 44 bp, Artificial Sequence
  Description of Artificial Sequence: Synthetic oligonucleotide
gaacgccttaaagaccttccatttattgtttctcatagattgtc

SEQ ID NO: 116641 - DNA, 49 bp, Artificial Sequence
  Description of Artificial Sequence: Synthetic oligonucleotide
aacgccttaaagaccttccatttattgtttctcatagattgtctaatac

SEQ ID NO: 116642 - DNA, 48 bp, Artificial Sequence
  Description of Artificial Sequence: Synthetic oligonucleotide
acgccttaaagaccttccatttattgtttctcatagattgtctaatac

SEQ ID NO: 116643 - DNA, 47 bp, Artificial Sequence
  Description of Artificial Sequence: Synthetic oligonucleotide
cgccttaaagaccttccatttattgtttctcatagattgtctaatac

SEQ ID NO: 116644 - DNA, 47 bp, Artificial Sequence
  Description of Artificial Sequence: Synthetic oligonucleotide
gccttaaagaccttccatttattgtttctcatagattgtctaatacc

SEQ ID NO: 116645 - DNA, 49 bp, Artificial Sequence
  Description of Artificial Sequence: Synthetic oligonucleotide
ccttaaagaccttccatttattgtttctcatagattgtctaataccttg

SEQ ID NO: 116646 - DNA, 50 bp, Artificial Sequence
  Description of Artificial Sequence: Synthetic oligonucleotide
cttaaagaccttccatttattgtttctcatagattgtctaataccttgag

SEQ ID NO: 116647 - DNA, 50 bp, Artificial Sequence
  Description of Artificial Sequence: Synthetic oligonucleotide
ttaaagaccttccatttattgtttctcatagattgtctaataccttgagc

SEQ ID NO: 116648 - DNA, 49 bp, Artificial Sequence
  Description of Artificial Sequence: Synthetic oligonucleotide
taaagaccttccatttattgtttctcatagattgtctaataccttgagc

SEQ ID NO: 116649 - DNA, 48 bp, Artificial Sequence
  Description of Artificial Sequence: Synthetic oligonucleotide
aaagaccttccatttattgtttctcatagattgtctaataccttgagc

SEQ ID NO: 116650 - DNA, 47 bp, Artificial Sequence
  Description of Artificial Sequence: Synthetic oligonucleotide
aagaccttccatttattgtttctcatagattgtctaataccttgagc

SEQ ID NO: 116651 - DNA, 46 bp, Artificial Sequence
  Description of Artificial Sequence: Synthetic oligonucleotide
agaccttccatttattgtttctcatagattgtctaataccttgagc

SEQ ID NO: 116652 - DNA, 45 bp, Artificial Sequence
  Description of Artificial Sequence: Synthetic oligonucleotide
gaccttccatttattgtttctcatagattgtctaataccttgagc

SEQ ID NO: 116653 - DNA, 48 bp, Artificial Sequence
  Description of Artificial Sequence: Synthetic oligonucleotide
accttccatttattgtttctcatagattgtctaataccttgagcttag

SEQ ID NO: 116654 - DNA, 47 bp, Artificial Sequence
  Description of Artificial Sequence: Synthetic oligonucleotide
ccttccatttattgtttctcatagattgtctaataccttgagcttag

SEQ ID NO: 116655 - DNA, 52 bp, Artificial Sequence
  Description of Artificial Sequence: Synthetic oligonucleotide
cttccatttattgtttctcatagattgtctaataccttgagcttagatattc

SEQ ID NO: 116656 - DNA, 54 bp, Artificial Sequence
  Description of Artificial Sequence: Synthetic oligonucleotide
ttccatttattgtttctcatagattgtctaataccttgagcttagatattcatg

SEQ ID NO: 116657 - DNA, 53 bp, Artificial Sequence
  Description of Artificial Sequence: Synthetic oligonucleotide
tccatttattgtttctcatagattgtctaataccttgagcttagatattcatg

SEQ ID NO: 116658 - DNA, 52 bp, Artificial Sequence
  Description of Artificial Sequence: Synthetic oligonucleotide
ccatttattgtttctcatagattgtctaataccttgagcttagatattcatg

SEQ ID NO: 116659 - DNA, 57 bp, Artificial Sequence
  Description of Artificial Sequence: Synthetic oligonucleotide
catttattgtttctcatagattgtctaataccttgagcttagatattcatgaaaatc

SEQ ID NO: 116660 - DNA, 60 bp, Artificial Sequence
  Description of Artificial Sequence: Synthetic oligonucleotide
atttattgtttctcatagattgtctaataccttgagcttagatattcatgaaaatcatag

SEQ ID NO: 116661 - DNA, 59 bp, Artificial Sequence
  Description of Artificial Sequence: Synthetic oligonucleotide
tttattgtttctcatagattgtctaataccttgagcttagatattcatgaaaatcatag

SEQ ID NO: 116662 - DNA, 58 bp, Artificial Sequence
  Description of Artificial Sequence: Synthetic oligonucleotide
ttattgtttctcatagattgtctaataccttgagcttagatattcatgaaaatcatag

SEQ ID NO: 116663 - DNA, 57 bp, Artificial Sequence
  Description of Artificial Sequence: Synthetic oligonucleotide
tattgtttctcatagattgtctaataccttgagcttagatattcatgaaaatcatag

SEQ ID NO: 116664 - DNA, 56 bp, Artificial Sequence
  Description of Artificial Sequence: Synthetic oligonucleotide
attgtttctcatagattgtctaataccttgagcttagatattcatgaaaatcatag

SEQ ID NO: 116665 - DNA, 55 bp, Artificial Sequence
  Description of Artificial Sequence: Synthetic oligonucleotide
ttgtttctcatagattgtctaataccttgagcttagatattcatgaaaatcatag

SEQ ID NO: 116666 - DNA, 54 bp, Artificial Sequence
  Description of Artificial Sequence: Synthetic oligonucleotide
tgtttctcatagattgtctaataccttgagcttagatattcatgaaaatcatag

SEQ ID NO: 116667 - DNA, 53 bp, Artificial Sequence
  Description of Artificial Sequence: Synthetic oligonucleotide
gtttctcatagattgtctaataccttgagcttagatattcatgaaaatcatag

SEQ ID NO: 116668 - DNA, 57 bp, Artificial Sequence
  Description of Artificial Sequence: Synthetic oligonucleotide
tttctcatagattgtctaataccttgagcttagatattcatgaaaatcatagttttg

SEQ ID NO: 116669 - DNA, 56 bp, Artificial Sequence
  Description of Artificial Sequence: Synthetic oligonucleotide
ttctcatagattgtctaataccttgagcttagatattcatgaaaatcatagttttg

SEQ ID NO: 116670 - DNA, 55 bp, Artificial Sequence
  Description of Artificial Sequence: Synthetic oligonucleotide
tctcatagattgtctaataccttgagcttagatattcatgaaaatcatagttttg

SEQ ID NO: 116671 - DNA, 54 bp, Artificial Sequence
  Description of Artificial Sequence: Synthetic oligonucleotide
ctcatagattgtctaataccttgagcttagatattcatgaaaatcatagttttg

SEQ ID NO: 116672 - DNA, 54 bp, Artificial Sequence
  Description of Artificial Sequence: Synthetic oligonucleotide
tcatagattgtctaataccttgagcttagatattcatgaaaatcatagttttgc

SEQ ID NO: 116673 - DNA, 53 bp, Artificial Sequence
  Description of Artificial Sequence: Synthetic oligonucleotide
catagattgtctaataccttgagcttagatattcatgaaaatcatagttttgc

SEQ ID NO: 116674 - DNA, 54 bp, Artificial Sequence
  Description of Artificial Sequence: Synthetic oligonucleotide
atagattgtctaataccttgagcttagatattcatgaaaatcatagttttgcac

SEQ ID NO: 116675 - DNA, 53 bp, Artificial Sequence
  Description of Artificial Sequence: Synthetic oligonucleotide
tagattgtctaataccttgagcttagatattcatgaaaatcatagttttgcac

SEQ ID NO: 116676 - DNA, 52 bp, Artificial Sequence
  Description of Artificial Sequence: Synthetic oligonucleotide
agattgtctaataccttgagcttagatattcatgaaaatcatagttttgcac

SEQ ID NO: 116677 - DNA, 51 bp, Artificial Sequence
  Description of Artificial Sequence: Synthetic oligonucleotide
gattgtctaataccttgagcttagatattcatgaaaatcatagttttgcac

SEQ ID NO: 116678 - DNA, 53 bp, Artificial Sequence
  Description of Artificial Sequence: Synthetic oligonucleotide
attgtctaataccttgagcttagatattcatgaaaatcatagttttgcacttc

SEQ ID NO: 116679 - DNA, 52 bp, Artificial Sequence
  Description of Artificial Sequence: Synthetic oligonucleotide
ttgtctaataccttgagcttagatattcatgaaaatcatagttttgcacttc

SEQ ID NO: 116680 - DNA, 51 bp, Artificial Sequence
  Description of Artificial Sequence: Synthetic oligonucleotide
tgtctaataccttgagcttagatattcatgaaaatcatagttttgcacttc

SEQ ID NO: 116681 - DNA, 50 bp, Artificial Sequence
  Description of Artificial Sequence: Synthetic oligonucleotide
gtctaataccttgagcttagatattcatgaaaatcatagttttgcacttc

SEQ ID NO: 116682 - DNA, 52 bp, Artificial Sequence
  Description of Artificial Sequence: Synthetic oligonucleotide
tctaataccttgagcttagatattcatgaaaatcatagttttgcacttctag

SEQ ID NO: 116683 - DNA, 51 bp, Artificial Sequence
  Description of Artificial Sequence: Synthetic oligonucleotide
ctaataccttgagcttagatattcatgaaaatcatagttttgcacttctag

SEQ ID NO: 116684 - DNA, 51 bp, Artificial Sequence
  Description of Artificial Sequence: Synthetic oligonucleotide
taataccttgagcttagatattcatgaaaatcatagttttgcacttctagg

SEQ ID NO: 116685 - DNA, 50 bp, Artificial Sequence
  Description of Artificial Sequence: Synthetic oligonucleotide
aataccttgagcttagatattcatgaaaatcatagttttgcacttctagg

SEQ ID NO: 116686 - DNA, 49 bp, Artificial Sequence
  Description of Artificial Sequence: Synthetic oligonucleotide
ataccttgagcttagatattcatgaaaatcatagttttgcacttctagg

SEQ ID NO: 116687 - DNA, 48 bp, Artificial Sequence
  Description of Artificial Sequence: Synthetic oligonucleotide
taccttgagcttagatattcatgaaaatcatagttttgcacttctagg

SEQ ID NO: 116688 - DNA, 47 bp, Artificial Sequence
  Description of Artificial Sequence: Synthetic oligonucleotide
accttgagcttagatattcatgaaaatcatagttttgcacttctagg

SEQ ID NO: 116689 - DNA, 46 bp, Artificial Sequence
  Description of Artificial Sequence: Synthetic oligonucleotide
ccttgagcttagatattcatgaaaatcatagttttgcacttctagg

SEQ ID NO: 116690 - DNA, 46 bp, Artificial Sequence
  Description of Artificial Sequence: Synthetic oligonucleotide
cttgagcttagatattcatgaaaatcatagttttgcacttctaggg

SEQ ID NO: 116691 - DNA, 48 bp, Artificial Sequence
  Description of Artificial Sequence: Synthetic oligonucleotide
ttgagcttagatattcatgaaaatcatagttttgcacttctagggaag

SEQ ID NO: 116692 - DNA, 47 bp, Artificial Sequence
  Description of Artificial Sequence: Synthetic oligonucleotide
tgagcttagatattcatgaaaatcatagttttgcacttctagggaag

SEQ ID NO: 116693 - DNA, 46 bp, Artificial Sequence
  Description of Artificial Sequence: Synthetic oligonucleotide
gagcttagatattcatgaaaatcatagttttgcacttctagggaag

SEQ ID NO: 116694 - DNA, 48 bp, Artificial Sequence
  Description of Artificial Sequence: Synthetic oligonucleotide
agcttagatattcatgaaaatcatagttttgcacttctagggaagaag

SEQ ID NO: 116695 - DNA, 47 bp, Artificial Sequence
  Description of Artificial Sequence: Synthetic oligonucleotide
gcttagatattcatgaaaatcatagttttgcacttctagggaagaag

SEQ ID NO: 116696 - DNA, 51 bp, Artificial Sequence
  Description of Artificial Sequence: Synthetic oligonucleotide
cttagatattcatgaaaatcatagttttgcacttctagggaagaagaaatc

SEQ ID NO: 116697 - DNA, 53 bp, Artificial Sequence
  Description of Artificial Sequence: Synthetic oligonucleotide
ttagatattcatgaaaatcatagttttgcacttctagggaagaagaaatcaag

SEQ ID NO: 116698 - DNA, 52 bp, Artificial Sequence
  Description of Artificial Sequence: Synthetic oligonucleotide
tagatattcatgaaaatcatagttttgcacttctagggaagaagaaatcaag

SEQ ID NO: 116699 - DNA, 51 bp, Artificial Sequence
  Description of Artificial Sequence: Synthetic oligonucleotide
agatattcatgaaaatcatagttttgcacttctagggaagaagaaatcaag

SEQ ID NO: 116700 - DNA, 50 bp, Artificial Sequence
  Description of Artificial Sequence: Synthetic oligonucleotide
gatattcatgaaaatcatagttttgcacttctagggaagaagaaatcaag

SEQ ID NO: 116701 - DNA, 50 bp, Artificial Sequence
  Description of Artificial Sequence: Synthetic oligonucleotide
atattcatgaaaatcatagttttgcacttctagggaagaagaaatcaagc

SEQ ID NO: 116702 - DNA, 49 bp, Artificial Sequence
  Description of Artificial Sequence: Synthetic oligonucleotide
tattcatgaaaatcatagttttgcacttctagggaagaagaaatcaagc

SEQ ID NO: 116703 - DNA, 48 bp, Artificial Sequence
  Description of Artificial Sequence: Synthetic oligonucleotide
attcatgaaaatcatagttttgcacttctagggaagaagaaatcaagc

SEQ ID NO: 116704 - DNA, 47 bp, Artificial Sequence
  Description of Artificial Sequence: Synthetic oligonucleotide
ttcatgaaaatcatagttttgcacttctagggaagaagaaatcaagc

SEQ ID NO: 116705 - DNA, 46 bp, Artificial Sequence
  Description of Artificial Sequence: Synthetic oligonucleotide
tcatgaaaatcatagttttgcacttctagggaagaagaaatcaagc

SEQ ID NO: 116706 - DNA, 45 bp, Artificial Sequence
  Description of Artificial Sequence: Synthetic oligonucleotide
catgaaaatcatagttttgcacttctagggaagaagaaatcaagc

SEQ ID NO: 116707 - DNA, 50 bp, Artificial Sequence
  Description of Artificial Sequence: Synthetic oligonucleotide
atgaaaatcatagttttgcacttctagggaagaagaaatcaagcaatttg

SEQ ID NO: 116708 - DNA, 49 bp, Artificial Sequence
  Description of Artificial Sequence: Synthetic oligonucleotide
tgaaaatcatagttttgcacttctagggaagaagaaatcaagcaatttg

SEQ ID NO: 116709 - DNA, 48 bp, Artificial Sequence
  Description of Artificial Sequence: Synthetic oligonucleotide
gaaaatcatagttttgcacttctagggaagaagaaatcaagcaatttg

SEQ ID NO: 116710 - DNA, 49 bp, Artificial Sequence
  Description of Artificial Sequence: Synthetic oligonucleotide
aaaatcatagttttgcacttctagggaagaagaaatcaagcaatttgac

SEQ ID NO: 116711 - DNA, 48 bp, Artificial Sequence
  Description of Artificial Sequence: Synthetic oligonucleotide
aaatcatagttttgcacttctagggaagaagaaatcaagcaatttgac

SEQ ID NO: 116712 - DNA, 47 bp, Artificial Sequence
  Description of Artificial Sequence: Synthetic oligonucleotide
aatcatagttttgcacttctagggaagaagaaatcaagcaatttgac

SEQ ID NO: 116713 - DNA, 46 bp, Artificial Sequence
  Description of Artificial Sequence: Synthetic oligonucleotide
atcatagttttgcacttctagggaagaagaaatcaagcaatttgac

SEQ ID NO: 116714 - DNA, 45 bp, Artificial Sequence
  Description of Artificial Sequence: Synthetic oligonucleotide
tcatagttttgcacttctagggaagaagaaatcaagcaatttgac

SEQ ID NO: 116715 - DNA, 44 bp, Artificial Sequence
  Description of Artificial Sequence: Synthetic oligonucleotide
catagttttgcacttctagggaagaagaaatcaagcaatttgac

SEQ ID NO: 116716 - DNA, 48 bp, Artificial Sequence
  Description of Artificial Sequence: Synthetic oligonucleotide
atagttttgcacttctagggaagaagaaatcaagcaatttgacattac

SEQ ID NO: 116717 - DNA, 47 bp, Artificial Sequence
  Description of Artificial Sequence: Synthetic oligonucleotide
tagttttgcacttctagggaagaagaaatcaagcaatttgacattac

SEQ ID NO: 116718 - DNA, 46 bp, Artificial Sequence
  Description of Artificial Sequence: Synthetic oligonucleotide
agttttgcacttctagggaagaagaaatcaagcaatttgacattac

SEQ ID NO: 116719 - DNA, 45 bp, Artificial Sequence
  Description of Artificial Sequence: Synthetic oligonucleotide
gttttgcacttctagggaagaagaaatcaagcaatttgacattac

SEQ ID NO: 116720 - DNA, 45 bp, Artificial Sequence
  Description of Artificial Sequence: Synthetic oligonucleotide
ttttgcacttctagggaagaagaaatcaagcaatttgacattacc

SEQ ID NO: 116721 - DNA, 44 bp, Artificial Sequence
  Description of Artificial Sequence: Synthetic oligonucleotide
tttgcacttctagggaagaagaaatcaagcaatttgacattacc

SEQ ID NO: 116722 - DNA, 43 bp, Artificial Sequence
  Description of Artificial Sequence: Synthetic oligonucleotide
ttgcacttctagggaagaagaaatcaagcaatttgacattacc

SEQ ID NO: 116723 - DNA, 42 bp, Artificial Sequence
  Description of Artificial Sequence: Synthetic oligonucleotide
tgcacttctagggaagaagaaatcaagcaatttgacattacc

SEQ ID NO: 116724 - DNA, 41 bp, Artificial Sequence
  Description of Artificial Sequence: Synthetic oligonucleotide
gcacttctagggaagaagaaatcaagcaatttgacattacc

SEQ ID NO: 116725 - DNA, 42 bp, Artificial Sequence
  Description of Artificial Sequence: Synthetic oligonucleotide
cacttctagggaagaagaaatcaagcaatttgacattaccac

SEQ ID NO: 116726 - DNA, 42 bp, Artificial Sequence
  Description of Artificial Sequence: Synthetic oligonucleotide
acttctagggaagaagaaatcaagcaatttgacattaccacc

SEQ ID NO: 116727 - DNA, 41 bp, Artificial Sequence
  Description of Artificial Sequence: Synthetic oligonucleotide
cttctagggaagaagaaatcaagcaatttgacattaccacc

SEQ ID NO: 116728 - DNA, 41 bp, Artificial Sequence
  Description of Artificial Sequence: Synthetic oligonucleotide
ttctagggaagaagaaatcaagcaatttgacattaccaccc

SEQ ID NO: 116729 - DNA, 40 bp, Artificial Sequence
  Description of Artificial Sequence: Synthetic oligonucleotide
tctagggaagaagaaatcaagcaatttgacattaccaccc

SEQ ID NO: 116730 - DNA, 39 bp, Artificial Sequence
  Description of Artificial Sequence: Synthetic oligonucleotide
ctagggaagaagaaatcaagcaatttgacattaccaccc

SEQ ID NO: 116731 - DNA, 47 bp, Artificial Sequence
  Description of Artificial Sequence: Synthetic oligonucleotide
tagggaagaagaaatcaagcaatttgacattaccacccaaatataac

SEQ ID NO: 116732 - DNA, 46 bp, Artificial Sequence
  Description of Artificial Sequence: Synthetic oligonucleotide
agggaagaagaaatcaagcaatttgacattaccacccaaatataac

SEQ ID NO: 116733 - DNA, 45 bp, Artificial Sequence
  Description of Artificial Sequence: Synthetic oligonucleotide
gggaagaagaaatcaagcaatttgacattaccacccaaatataac

SEQ ID NO: 116734 - DNA, 45 bp, Artificial Sequence
  Description of Artificial Sequence: Synthetic oligonucleotide
ggaagaagaaatcaagcaatttgacattaccacccaaatataacc

SEQ ID NO: 116735 - DNA, 46 bp, Artificial Sequence
  Description of Artificial Sequence: Synthetic oligonucleotide
gaagaagaaatcaagcaatttgacattaccacccaaatataaccag

SEQ ID NO: 116736 - DNA, 46 bp, Artificial Sequence
  Description of Artificial Sequence: Synthetic oligonucleotide
aagaagaaatcaagcaatttgacattaccacccaaatataaccagc

SEQ ID NO: 116737 - DNA, 45 bp, Artificial Sequence
  Description of Artificial Sequence: Synthetic oligonucleotide
agaagaaatcaagcaatttgacattaccacccaaatataaccagc

SEQ ID NO: 116738 - DNA, 44 bp, Artificial Sequence
  Description of Artificial Sequence: Synthetic oligonucleotide
gaagaaatcaagcaatttgacattaccacccaaatataaccagc

SEQ ID NO: 116739 - DNA, 44 bp, Artificial Sequence
  Description of Artificial Sequence: Synthetic oligonucleotide
aagaaatcaagcaatttgacattaccacccaaatataaccagcc

SEQ ID NO: 116740 - DNA, 43 bp, Artificial Sequence
  Description of Artificial Sequence: Synthetic oligonucleotide
agaaatcaagcaatttgacattaccacccaaatataaccagcc

SEQ ID NO: 116741 - DNA, 42 bp, Artificial Sequence
  Description of Artificial Sequence: Synthetic oligonucleotide
gaaatcaagcaatttgacattaccacccaaatataaccagcc

SEQ ID NO: 116742 - DNA, 45 bp, Artificial Sequence
  Description of Artificial Sequence: Synthetic oligonucleotide
aaatcaagcaatttgacattaccacccaaatataaccagccattc

SEQ ID NO: 116743 - DNA, 44 bp, Artificial Sequence
  Description of Artificial Sequence: Synthetic oligonucleotide
aatcaagcaatttgacattaccacccaaatataaccagccattc

SEQ ID NO: 116744 - DNA, 43 bp, Artificial Sequence
  Description of Artificial Sequence: Synthetic oligonucleotide
atcaagcaatttgacattaccacccaaatataaccagccattc

SEQ ID NO: 116745 - DNA, 42 bp, Artificial Sequence
  Description of Artificial Sequence: Synthetic oligonucleotide
tcaagcaatttgacattaccacccaaatataaccagccattc

SEQ ID NO: 116746 - DNA, 41 bp, Artificial Sequence
  Description of Artificial Sequence: Synthetic oligonucleotide
caagcaatttgacattaccacccaaatataaccagccattc

SEQ ID NO: 116747 - DNA, 44 bp, Artificial Sequence
  Description of Artificial Sequence: Synthetic oligonucleotide
aagcaatttgacattaccacccaaatataaccagccattctttg

SEQ ID NO: 116748 - DNA, 43 bp, Artificial Sequence
  Description of Artificial Sequence: Synthetic oligonucleotide
agcaatttgacattaccacccaaatataaccagccattctttg

SEQ ID NO: 116749 - DNA, 42 bp, Artificial Sequence
  Description of Artificial Sequence: Synthetic oligonucleotide
gcaatttgacattaccacccaaatataaccagccattctttg

SEQ ID NO: 116750 - DNA, 45 bp, Artificial Sequence
  Description of Artificial Sequence: Synthetic oligonucleotide
caatttgacattaccacccaaatataaccagccattctttgttac

SEQ ID NO: 116751 - DNA, 47 bp, Artificial Sequence
  Description of Artificial Sequence: Synthetic oligonucleotide
aatttgacattaccacccaaatataaccagccattctttgttacttc

SEQ ID NO: 116752 - DNA, 46 bp, Artificial Sequence
  Description of Artificial Sequence: Synthetic oligonucleotide
atttgacattaccacccaaatataaccagccattctttgttacttc

SEQ ID NO: 116753 - DNA, 45 bp, Artificial Sequence
  Description of Artificial Sequence: Synthetic oligonucleotide
tttgacattaccacccaaatataaccagccattctttgttacttc

SEQ ID NO: 116754 - DNA, 44 bp, Artificial Sequence
  Description of Artificial Sequence: Synthetic oligonucleotide
ttgacattaccacccaaatataaccagccattctttgttacttc

SEQ ID NO: 116755 - DNA, 43 bp, Artificial Sequence
  Description of Artificial Sequence: Synthetic oligonucleotide
tgacattaccacccaaatataaccagccattctttgttacttc

SEQ ID NO: 116756 - DNA, 42 bp, Artificial Sequence
  Description of Artificial Sequence: Synthetic oligonucleotide
gacattaccacccaaatataaccagccattctttgttacttc

SEQ ID NO: 116757 - DNA, 42 bp, Artificial Sequence
  Description of Artificial Sequence: Synthetic oligonucleotide
acattaccacccaaatataaccagccattctttgttacttcc

SEQ ID NO: 116758 - DNA, 41 bp, Artificial Sequence
  Description of Artificial Sequence: Synthetic oligonucleotide
cattaccacccaaatataaccagccattctttgttacttcc

SEQ ID NO: 116759 - DNA, 44 bp, Artificial Sequence
  Description of Artificial Sequence: Synthetic oligonucleotide
attaccacccaaatataaccagccattctttgttacttccttac

SEQ ID NO: 116760 - DNA, 43 bp, Artificial Sequence
  Description of Artificial Sequence: Synthetic oligonucleotide
ttaccacccaaatataaccagccattctttgttacttccttac

SEQ ID NO: 116761 - DNA, 42 bp, Artificial Sequence
  Description of Artificial Sequence: Synthetic oligonucleotide
taccacccaaatataaccagccattctttgttacttccttac

SEQ ID NO: 116762 - DNA, 41 bp, Artificial Sequence
  Description of Artificial Sequence: Synthetic oligonucleotide
accacccaaatataaccagccattctttgttacttccttac

SEQ ID NO: 116763 - DNA, 40 bp, Artificial Sequence
  Description of Artificial Sequence: Synthetic oligonucleotide
ccacccaaatataaccagccattctttgttacttccttac

SEQ ID NO: 116764 - DNA, 40 bp, Artificial Sequence
  Description of Artificial Sequence: Synthetic oligonucleotide
cacccaaatataaccagccattctttgttacttccttacc

SEQ ID NO: 116765 - DNA, 41 bp, Artificial Sequence
  Description of Artificial Sequence: Synthetic oligonucleotide
acccaaatataaccagccattctttgttacttccttacctg

SEQ ID NO: 116766 - DNA, 40 bp, Artificial Sequence
  Description of Artificial Sequence: Synthetic oligonucleotide
cccaaatataaccagccattctttgttacttccttacctg

SEQ ID NO: 116767 - DNA, 42 bp, Artificial Sequence
  Description of Artificial Sequence: Synthetic oligonucleotide
ccaaatataaccagccattctttgttacttccttacctgatg

SEQ ID NO: 116768 - DNA, 50 bp, Artificial Sequence
  Description of Artificial Sequence: Synthetic oligonucleotide
caaatataaccagccattctttgttacttccttacctgatgataaaatac

SEQ ID NO: 116769 - DNA, 50 bp, Artificial Sequence
  Description of Artificial Sequence: Synthetic oligonucleotide
aaatataaccagccattctttgttacttccttacctgatgataaaatacc

SEQ ID NO: 116770 - DNA, 49 bp, Artificial Sequence
  Description of Artificial Sequence: Synthetic oligonucleotide
aatataaccagccattctttgttacttccttacctgatgataaaatacc

SEQ ID NO: 116771 - DNA, 48 bp, Artificial Sequence
  Description of Artificial Sequence: Synthetic oligonucleotide
atataaccagccattctttgttacttccttacctgatgataaaatacc

SEQ ID NO: 116772 - DNA, 47 bp, Artificial Sequence
  Description of Artificial Sequence: Synthetic oligonucleotide
tataaccagccattctttgttacttccttacctgatgataaaatacc

SEQ ID NO: 116773 - DNA, 46 bp, Artificial Sequence
  Description of Artificial Sequence: Synthetic oligonucleotide
ataaccagccattctttgttacttccttacctgatgataaaatacc

SEQ ID NO: 116774 - DNA, 45 bp, Artificial Sequence
  Description of Artificial Sequence: Synthetic oligonucleotide
taaccagccattctttgttacttccttacctgatgataaaatacc

SEQ ID NO: 116775 - DNA, 44 bp, Artificial Sequence
  Description of Artificial Sequence: Synthetic oligonucleotide
aaccagccattctttgttacttccttacctgatgataaaatacc

SEQ ID NO: 116776 - DNA, 43 bp, Artificial Sequence
  Description of Artificial Sequence: Synthetic oligonucleotide
accagccattctttgttacttccttacctgatgataaaatacc

SEQ ID NO: 116777 - DNA, 42 bp, Artificial Sequence
  Description of Artificial Sequence: Synthetic oligonucleotide
ccagccattctttgttacttccttacctgatgataaaatacc

SEQ ID NO: 116778 - DNA, 46 bp, Artificial Sequence
  Description of Artificial Sequence: Synthetic oligonucleotide
cagccattctttgttacttccttacctgatgataaaatacctaaag

SEQ ID NO: 116779 - DNA, 46 bp, Artificial Sequence
  Description of Artificial Sequence: Synthetic oligonucleotide
agccattctttgttacttccttacctgatgataaaatacctaaagg

SEQ ID NO: 116780 - DNA, 45 bp, Artificial Sequence
  Description of Artificial Sequence: Synthetic oligonucleotide
gccattctttgttacttccttacctgatgataaaatacctaaagg

SEQ ID NO: 116781 - DNA, 45 bp, Artificial Sequence
  Description of Artificial Sequence: Synthetic oligonucleotide
ccattctttgttacttccttacctgatgataaaatacctaaaggg

SEQ ID NO: 116782 - DNA, 45 bp, Artificial Sequence
  Description of Artificial Sequence: Synthetic oligonucleotide
cattctttgttacttccttacctgatgataaaatacctaaagggg

SEQ ID NO: 116783 - DNA, 45 bp, Artificial Sequence
  Description of Artificial Sequence: Synthetic oligonucleotide
attctttgttacttccttacctgatgataaaatacctaaaggggc

SEQ ID NO: 116784 - DNA, 44 bp, Artificial Sequence
  Description of Artificial Sequence: Synthetic oligonucleotide
ttctttgttacttccttacctgatgataaaatacctaaaggggc

SEQ ID NO: 116785 - DNA, 43 bp, Artificial Sequence
  Description of Artificial Sequence: Synthetic oligonucleotide
tctttgttacttccttacctgatgataaaatacctaaaggggc

SEQ ID NO: 116786 - DNA, 42 bp, Artificial Sequence
  Description of Artificial Sequence: Synthetic oligonucleotide
ctttgttacttccttacctgatgataaaatacctaaaggggc

SEQ ID NO: 116787 - DNA, 43 bp, Artificial Sequence
  Description of Artificial Sequence: Synthetic oligonucleotide
tttgttacttccttacctgatgataaaatacctaaaggggcag

SEQ ID NO: 116788 - DNA, 42 bp, Artificial Sequence
  Description of Artificial Sequence: Synthetic oligonucleotide
ttgttacttccttacctgatgataaaatacctaaaggggcag

SEQ ID NO: 116789 - DNA, 41 bp, Artificial Sequence
  Description of Artificial Sequence: Synthetic oligonucleotide
tgttacttccttacctgatgataaaatacctaaaggggcag

SEQ ID NO: 116790 - DNA, 40 bp, Artificial Sequence
  Description of Artificial Sequence: Synthetic oligonucleotide
gttacttccttacctgatgataaaatacctaaaggggcag

SEQ ID NO: 116791 - DNA, 40 bp, Artificial Sequence
  Description of Artificial Sequence: Synthetic oligonucleotide
ttacttccttacctgatgataaaatacctaaaggggcagg

SEQ ID NO: 116792 - DNA, 39 bp, Artificial Sequence
  Description of Artificial Sequence: Synthetic oligonucleotide
tacttccttacctgatgataaaatacctaaaggggcagg

SEQ ID NO: 116793 - DNA, 38 bp, Artificial Sequence
  Description of Artificial Sequence: Synthetic oligonucleotide
acttccttacctgatgataaaatacctaaaggggcagg

SEQ ID NO: 116794 - DNA, 37 bp, Artificial Sequence
  Description of Artificial Sequence: Synthetic oligonucleotide
cttccttacctgatgataaaatacctaaaggggcagg

SEQ ID NO: 116795 - DNA, 38 bp, Artificial Sequence
  Description of Artificial Sequence: Synthetic oligonucleotide
ttccttacctgatgataaaatacctaaaggggcaggac

SEQ ID NO: 116796 - DNA, 37 bp, Artificial Sequence
  Description of Artificial Sequence: Synthetic oligonucleotide
tccttacctgatgataaaatacctaaaggggcaggac

SEQ ID NO: 116797 - DNA, 36 bp, Artificial Sequence
  Description of Artificial Sequence: Synthetic oligonucleotide
ccttacctgatgataaaatacctaaaggggcaggac

SEQ ID NO: 116798 - DNA, 36 bp, Artificial Sequence
  Description of Artificial Sequence: Synthetic oligonucleotide
cttacctgatgataaaatacctaaaggggcaggacc

SEQ ID NO: 116799 - DNA, 37 bp, Artificial Sequence
  Description of Artificial Sequence: Synthetic oligonucleotide
ttacctgatgataaaatacctaaaggggcaggacctg

SEQ ID NO: 116800 - DNA, 36 bp, Artificial Sequence
  Description of Artificial Sequence: Synthetic oligonucleotide
tacctgatgataaaatacctaaaggggcaggacctg

SEQ ID NO: 116801 - DNA, 35 bp, Artificial Sequence
  Description of Artificial Sequence: Synthetic oligonucleotide
acctgatgataaaatacctaaaggggcaggacctg

SEQ ID NO: 116802 - DNA, 34 bp, Artificial Sequence
  Description of Artificial Sequence: Synthetic oligonucleotide
cctgatgataaaatacctaaaggggcaggacctg

SEQ ID NO: 116803 - DNA, 34 bp, Artificial Sequence
  Description of Artificial Sequence: Synthetic oligonucleotide
ctgatgataaaatacctaaaggggcaggacctgg

SEQ ID NO: 116804 - DNA, 36 bp, Artificial Sequence
  Description of Artificial Sequence: Synthetic oligonucleotide
tgatgataaaatacctaaaggggcaggacctggatg

SEQ ID NO: 116805 - DNA, 35 bp, Artificial Sequence
  Description of Artificial Sequence: Synthetic oligonucleotide
gatgataaaatacctaaaggggcaggacctggatg

SEQ ID NO: 116806 - DNA, 35 bp, Artificial Sequence
  Description of Artificial Sequence: Synthetic oligonucleotide
atgataaaatacctaaaggggcaggacctggatgc

SEQ ID NO: 116807 - DNA, 34 bp, Artificial Sequence
  Description of Artificial Sequence: Synthetic oligonucleotide
tgataaaatacctaaaggggcaggacctggatgc

SEQ ID NO: 116808 - DNA, 33 bp, Artificial Sequence
  Description of Artificial Sequence: Synthetic oligonucleotide
gataaaatacctaaaggggcaggacctggatgc

SEQ ID NO: 116809 - DNA, 36 bp, Artificial Sequence
  Description of Artificial Sequence: Synthetic oligonucleotide
ataaaatacctaaaggggcaggacctggatgctatc

SEQ ID NO: 116810 - DNA, 35 bp, Artificial Sequence
  Description of Artificial Sequence: Synthetic oligonucleotide
taaaatacctaaaggggcaggacctggatgctatc

SEQ ID NO: 116811 - DNA, 34 bp, Artificial Sequence
  Description of Artificial Sequence: Synthetic oligonucleotide
aaaatacctaaaggggcaggacctggatgctatc

SEQ ID NO: 116812 - DNA, 33 bp, Artificial Sequence
  Description of Artificial Sequence: Synthetic oligonucleotide
aaatacctaaaggggcaggacctggatgctatc

SEQ ID NO: 116813 - DNA, 32 bp, Artificial Sequence
  Description of Artificial Sequence: Synthetic oligonucleotide
aatacctaaaggggcaggacctggatgctatc

SEQ ID NO: 116814 - DNA, 31 bp, Artificial Sequence
  Description of Artificial Sequence: Synthetic oligonucleotide
atacctaaaggggcaggacctggatgctatc

SEQ ID NO: 116815 - DNA, 30 bp, Artificial Sequence
  Description of Artificial Sequence: Synthetic oligonucleotide
tacctaaaggggcaggacctggatgctatc

SEQ ID NO: 116816 - DNA, 29 bp, Artificial Sequence
  Description of Artificial Sequence: Synthetic oligonucleotide
acctaaaggggcaggacctggatgctatc

SEQ ID NO: 116817 - DNA, 28 bp, Artificial Sequence
  Description of Artificial Sequence: Synthetic oligonucleotide
cctaaaggggcaggacctggatgctatc

SEQ ID NO: 116818 - DNA, 30 bp, Artificial Sequence
  Description of Artificial Sequence: Synthetic oligonucleotide
ctaaaggggcaggacctggatgctatcttg

SEQ ID NO: 116819 - DNA, 30 bp, Artificial Sequence
  Description of Artificial Sequence: Synthetic oligonucleotide
taaaggggcaggacctggatgctatcttgc

SEQ ID NO: 116820 - DNA, 29 bp, Artificial Sequence
  Description of Artificial Sequence: Synthetic oligonucleotide
aaaggggcaggacctggatgctatcttgc

SEQ ID NO: 116821 - DNA, 28 bp, Artificial Sequence
  Description of Artificial Sequence: Synthetic oligonucleotide
aaggggcaggacctggatgctatcttgc

SEQ ID NO: 116822 - DNA, 27 bp, Artificial Sequence
  Description of Artificial Sequence: Synthetic oligonucleotide
aggggcaggacctggatgctatcttgc

SEQ ID NO: 116823 - DNA, 27 bp, Artificial Sequence
  Description of Artificial Sequence: Synthetic oligonucleotide
ggggcaggacctggatgctatcttgca

SEQ ID NO: 116824 - DNA, 27 bp, Artificial Sequence
  Description of Artificial Sequence: Synthetic oligonucleotide
gggcaggacctggatgctatcttgcag

SEQ ID NO: 116825 - DNA, 27 bp, Artificial Sequence
  Description of Artificial Sequence: Synthetic oligonucleotide
ggcaggacctggatgctatcttgcagg

SEQ ID NO: 116826 - DNA, 29 bp, Artificial Sequence
  Description of Artificial Sequence: Synthetic oligonucleotide
gcaggacctggatgctatcttgcaggatc

SEQ ID NO: 116827 - DNA, 29 bp, Artificial Sequence
  Description of Artificial Sequence: Synthetic oligonucleotide
caggacctggatgctatcttgcaggatcc

SEQ ID NO: 116828 - DNA, 33 bp, Artificial Sequence
  Description of Artificial Sequence: Synthetic oligonucleotide
aggacctggatgctatcttgcaggatccttaac

SEQ ID NO: 116829 - DNA, 32 bp, Artificial Sequence
  Description of Artificial Sequence: Synthetic oligonucleotide
ggacctggatgctatcttgcaggatccttaac

SEQ ID NO: 116830 - DNA, 35 bp, Artificial Sequence
  Description of Artificial Sequence: Synthetic oligonucleotide
gacctggatgctatcttgcaggatccttaacattg

SEQ ID NO: 116831 - DNA, 36 bp, Artificial Sequence
  Description of Artificial Sequence: Synthetic oligonucleotide
acctggatgctatcttgcaggatccttaacattgtc

SEQ ID NO: 116832 - DNA, 35 bp, Artificial Sequence
  Description of Artificial Sequence: Synthetic oligonucleotide
cctggatgctatcttgcaggatccttaacattgtc

SEQ ID NO: 116833 - DNA, 38 bp, Artificial Sequence
  Description of Artificial Sequence: Synthetic oligonucleotide
ctggatgctatcttgcaggatccttaacattgtcaaag

SEQ ID NO: 116834 - DNA, 39 bp, Artificial Sequence
  Description of Artificial Sequence: Synthetic oligonucleotide
tggatgctatcttgcaggatccttaacattgtcaaagac

SEQ ID NO: 116835 - DNA, 38 bp, Artificial Sequence
  Description of Artificial Sequence: Synthetic oligonucleotide
ggatgctatcttgcaggatccttaacattgtcaaagac

SEQ ID NO: 116836 - DNA, 39 bp, Artificial Sequence
  Description of Artificial Sequence: Synthetic oligonucleotide
gatgctatcttgcaggatccttaacattgtcaaagactg

SEQ ID NO: 116837 - DNA, 41 bp, Artificial Sequence
  Description of Artificial Sequence: Synthetic oligonucleotide
atgctatcttgcaggatccttaacattgtcaaagactgaac

SEQ ID NO: 116838 - DNA, 40 bp, Artificial Sequence
  Description of Artificial Sequence: Synthetic oligonucleotide
tgctatcttgcaggatccttaacattgtcaaagactgaac

SEQ ID NO: 116839 - DNA, 39 bp, Artificial Sequence
  Description of Artificial Sequence: Synthetic oligonucleotide
gctatcttgcaggatccttaacattgtcaaagactgaac

SEQ ID NO: 116840 - DNA, 41 bp, Artificial Sequence
  Description of Artificial Sequence: Synthetic oligonucleotide
ctatcttgcaggatccttaacattgtcaaagactgaactag

SEQ ID NO: 116841 - DNA, 41 bp, Artificial Sequence
  Description of Artificial Sequence: Synthetic oligonucleotide
tatcttgcaggatccttaacattgtcaaagactgaactagg

SEQ ID NO: 116842 - DNA, 40 bp, Artificial Sequence
  Description of Artificial Sequence: Synthetic oligonucleotide
atcttgcaggatccttaacattgtcaaagactgaactagg

SEQ ID NO: 116843 - DNA, 39 bp, Artificial Sequence
  Description of Artificial Sequence: Synthetic oligonucleotide
tcttgcaggatccttaacattgtcaaagactgaactagg

SEQ ID NO: 116844 - DNA, 38 bp, Artificial Sequence
  Description of Artificial Sequence: Synthetic oligonucleotide
cttgcaggatccttaacattgtcaaagactgaactagg

SEQ ID NO: 116845 - DNA, 41 bp, Artificial Sequence
  Description of Artificial Sequence: Synthetic oligonucleotide
ttgcaggatccttaacattgtcaaagactgaactaggaaag

SEQ ID NO: 116846 - DNA, 40 bp, Artificial Sequence
  Description of Artificial Sequence: Synthetic oligonucleotide
tgcaggatccttaacattgtcaaagactgaactaggaaag

SEQ ID NO: 116847 - DNA, 39 bp, Artificial Sequence
  Description of Artificial Sequence: Synthetic oligonucleotide
gcaggatccttaacattgtcaaagactgaactaggaaag

SEQ ID NO: 116848 - DNA, 42 bp, Artificial Sequence
  Description of Artificial Sequence: Synthetic oligonucleotide
caggatccttaacattgtcaaagactgaactaggaaagaaag

SEQ ID NO: 116849 - DNA, 42 bp, Artificial Sequence
  Description of Artificial Sequence: Synthetic oligonucleotide
aggatccttaacattgtcaaagactgaactaggaaagaaagc

SEQ ID NO: 116850 - DNA, 41 bp, Artificial Sequence
  Description of Artificial Sequence: Synthetic oligonucleotide
ggatccttaacattgtcaaagactgaactaggaaagaaagc

SEQ ID NO: 116851 - DNA, 42 bp, Artificial Sequence
  Description of Artificial Sequence: Synthetic oligonucleotide
gatccttaacattgtcaaagactgaactaggaaagaaagctg

SEQ ID NO: 116852 - DNA, 44 bp, Artificial Sequence
  Description of Artificial Sequence: Synthetic oligonucleotide
atccttaacattgtcaaagactgaactaggaaagaaagctgatg

SEQ ID NO: 116853 - DNA, 43 bp, Artificial Sequence
  Description of Artificial Sequence: Synthetic oligonucleotide
tccttaacattgtcaaagactgaactaggaaagaaagctgatg

SEQ ID NO: 116854 - DNA, 42 bp, Artificial Sequence
  Description of Artificial Sequence: Synthetic oligonucleotide
ccttaacattgtcaaagactgaactaggaaagaaagctgatg

SEQ ID NO: 116855 - DNA, 46 bp, Artificial Sequence
  Description of Artificial Sequence: Synthetic oligonucleotide
cttaacattgtcaaagactgaactaggaaagaaagctgatgtaatc

SEQ ID NO: 116856 - DNA, 46 bp, Artificial Sequence
  Description of Artificial Sequence: Synthetic oligonucleotide
ttaacattgtcaaagactgaactaggaaagaaagctgatgtaatcc

SEQ ID NO: 116857 - DNA, 45 bp, Artificial Sequence
  Description of Artificial Sequence: Synthetic oligonucleotide
taacattgtcaaagactgaactaggaaagaaagctgatgtaatcc

SEQ ID NO: 116858 - DNA, 44 bp, Artificial Sequence
  Description of Artificial Sequence: Synthetic oligonucleotide
aacattgtcaaagactgaactaggaaagaaagctgatgtaatcc

SEQ ID NO: 116859 - DNA, 43 bp, Artificial Sequence
  Description of Artificial Sequence: Synthetic oligonucleotide
acattgtcaaagactgaactaggaaagaaagctgatgtaatcc

SEQ ID NO: 116860 - DNA, 42 bp, Artificial Sequence
  Description of Artificial Sequence: Synthetic oligonucleotide
cattgtcaaagactgaactaggaaagaaagctgatgtaatcc

SEQ ID NO: 116861 - DNA, 42 bp, Artificial Sequence
  Description of Artificial Sequence: Synthetic oligonucleotide
attgtcaaagactgaactaggaaagaaagctgatgtaatccc

SEQ ID NO: 116862 - DNA, 41 bp, Artificial Sequence
  Description of Artificial Sequence: Synthetic oligonucleotide
ttgtcaaagactgaactaggaaagaaagctgatgtaatccc

SEQ ID NO: 116863 - DNA, 40 bp, Artificial Sequence
  Description of Artificial Sequence: Synthetic oligonucleotide
tgtcaaagactgaactaggaaagaaagctgatgtaatccc

SEQ ID NO: 116864 - DNA, 39 bp, Artificial Sequence
  Description of Artificial Sequence: Synthetic oligonucleotide
gtcaaagactgaactaggaaagaaagctgatgtaatccc

SEQ ID NO: 116865 - DNA, 40 bp, Artificial Sequence
  Description of Artificial Sequence: Synthetic oligonucleotide
tcaaagactgaactaggaaagaaagctgatgtaatccctg

SEQ ID NO: 116866 - DNA, 39 bp, Artificial Sequence
  Description of Artificial Sequence: Synthetic oligonucleotide
caaagactgaactaggaaagaaagctgatgtaatccctg

SEQ ID NO: 116867 - DNA, 41 bp, Artificial Sequence
  Description of Artificial Sequence: Synthetic oligonucleotide
aaagactgaactaggaaagaaagctgatgtaatccctgttc

SEQ ID NO: 116868 - DNA, 40 bp, Artificial Sequence
  Description of Artificial Sequence: Synthetic oligonucleotide
aagactgaactaggaaagaaagctgatgtaatccctgttc

SEQ ID NO: 116869 - DNA, 39 bp, Artificial Sequence
  Description of Artificial Sequence: Synthetic oligonucleotide
agactgaactaggaaagaaagctgatgtaatccctgttc

SEQ ID NO: 116870 - DNA, 38 bp, Artificial Sequence
  Description of Artificial Sequence: Synthetic oligonucleotide
gactgaactaggaaagaaagctgatgtaatccctgttc

SEQ ID NO: 116871 - DNA, 42 bp, Artificial Sequence
  Description of Artificial Sequence: Synthetic oligonucleotide
actgaactaggaaagaaagctgatgtaatccctgttcattac

SEQ ID NO: 116872 - DNA, 41 bp, Artificial Sequence
  Description of Artificial Sequence: Synthetic oligonucleotide
ctgaactaggaaagaaagctgatgtaatccctgttcattac

SEQ ID NO: 116873 - DNA, 43 bp, Artificial Sequence
  Description of Artificial Sequence: Synthetic oligonucleotide
tgaactaggaaagaaagctgatgtaatccctgttcattactac

SEQ ID NO: 116874 - DNA, 42 bp, Artificial Sequence
  Description of Artificial Sequence: Synthetic oligonucleotide
gaactaggaaagaaagctgatgtaatccctgttcattactac

SEQ ID NO: 116875 - DNA, 48 bp, Artificial Sequence
  Description of Artificial Sequence: Synthetic oligonucleotide
aactaggaaagaaagctgatgtaatccctgttcattactacttaatac

SEQ ID NO: 116876 - DNA, 47 bp, Artificial Sequence
  Description of Artificial Sequence: Synthetic oligonucleotide
actaggaaagaaagctgatgtaatccctgttcattactacttaatac

SEQ ID NO: 116877 - DNA, 46 bp, Artificial Sequence
  Description of Artificial Sequence: Synthetic oligonucleotide
ctaggaaagaaagctgatgtaatccctgttcattactacttaatac

SEQ ID NO: 116878 - DNA, 46 bp, Artificial Sequence
  Description of Artificial Sequence: Synthetic oligonucleotide
taggaaagaaagctgatgtaatccctgttcattactacttaatacc

SEQ ID NO: 116879 - DNA, 45 bp, Artificial Sequence
  Description of Artificial Sequence: Synthetic oligonucleotide
aggaaagaaagctgatgtaatccctgttcattactacttaatacc

SEQ ID NO: 116880 - DNA, 44 bp, Artificial Sequence
  Description of Artificial Sequence: Synthetic oligonucleotide
ggaaagaaagctgatgtaatccctgttcattactacttaatacc

SEQ ID NO: 116881 - DNA, 45 bp, Artificial Sequence
  Description of Artificial Sequence: Synthetic oligonucleotide
gaaagaaagctgatgtaatccctgttcattactacttaatacctc

SEQ ID NO: 116882 - DNA, 45 bp, Artificial Sequence
  Description of Artificial Sequence: Synthetic oligonucleotide
aaagaaagctgatgtaatccctgttcattactacttaatacctcc

SEQ ID NO: 116883 - DNA, 44 bp, Artificial Sequence
  Description of Artificial Sequence: Synthetic oligonucleotide
aagaaagctgatgtaatccctgttcattactacttaatacctcc

SEQ ID NO: 116884 - DNA, 43 bp, Artificial Sequence
  Description of Artificial Sequence: Synthetic oligonucleotide
agaaagctgatgtaatccctgttcattactacttaatacctcc

SEQ ID NO: 116885 - DNA, 42 bp, Artificial Sequence
  Description of Artificial Sequence: Synthetic oligonucleotide
gaaagctgatgtaatccctgttcattactacttaatacctcc

SEQ ID NO: 116886 - DNA, 43 bp, Artificial Sequence
  Description of Artificial Sequence: Synthetic oligonucleotide
aaagctgatgtaatccctgttcattactacttaatacctccac

SEQ ID NO: 116887 - DNA, 42 bp, Artificial Sequence
  Description of Artificial Sequence: Synthetic oligonucleotide
aagctgatgtaatccctgttcattactacttaatacctccac

SEQ ID NO: 116888 - DNA, 41 bp, Artificial Sequence
  Description of Artificial Sequence: Synthetic oligonucleotide
agctgatgtaatccctgttcattactacttaatacctccac

SEQ ID NO: 116889 - DNA, 40 bp, Artificial Sequence
  Description of Artificial Sequence: Synthetic oligonucleotide
gctgatgtaatccctgttcattactacttaatacctccac

SEQ ID NO: 116890 - DNA, 40 bp, Artificial Sequence
  Description of Artificial Sequence: Synthetic oligonucleotide
ctgatgtaatccctgttcattactacttaatacctccacc

SEQ ID NO: 116891 - DNA, 42 bp, Artificial Sequence
  Description of Artificial Sequence: Synthetic oligonucleotide
tgatgtaatccctgttcattactacttaatacctccaccaac

SEQ ID NO: 116892 - DNA, 41 bp, Artificial Sequence
  Description of Artificial Sequence: Synthetic oligonucleotide
gatgtaatccctgttcattactacttaatacctccaccaac

SEQ ID NO: 116893 - DNA, 44 bp, Artificial Sequence
  Description of Artificial Sequence: Synthetic oligonucleotide
atgtaatccctgttcattactacttaatacctccaccaacaaag

SEQ ID NO: 116894 - DNA, 43 bp, Artificial Sequence
  Description of Artificial Sequence: Synthetic oligonucleotide
tgtaatccctgttcattactacttaatacctccaccaacaaag

SEQ ID NO: 116895 - DNA, 42 bp, Artificial Sequence
  Description of Artificial Sequence: Synthetic oligonucleotide
gtaatccctgttcattactacttaatacctccaccaacaaag

SEQ ID NO: 116896 - DNA, 43 bp, Artificial Sequence
  Description of Artificial Sequence: Synthetic oligonucleotide
taatccctgttcattactacttaatacctccaccaacaaagac

SEQ ID NO: 116897 - DNA, 42 bp, Artificial Sequence
  Description of Artificial Sequence: Synthetic oligonucleotide
aatccctgttcattactacttaatacctccaccaacaaagac

SEQ ID NO: 116898 - DNA, 41 bp, Artificial Sequence
  Description of Artificial Sequence: Synthetic oligonucleotide
atccctgttcattactacttaatacctccaccaacaaagac

SEQ ID NO: 116899 - DNA, 40 bp, Artificial Sequence
  Description of Artificial Sequence: Synthetic oligonucleotide
tccctgttcattactacttaatacctccaccaacaaagac

SEQ ID NO: 116900 - DNA, 39 bp, Artificial Sequence
  Description of Artificial Sequence: Synthetic oligonucleotide
ccctgttcattactacttaatacctccaccaacaaagac

SEQ ID NO: 116901 - DNA, 42 bp, Artificial Sequence
  Description of Artificial Sequence: Synthetic oligonucleotide
cctgttcattactacttaatacctccaccaacaaagactaag

SEQ ID NO: 116902 - DNA, 45 bp, Artificial Sequence
  Description of Artificial Sequence: Synthetic oligonucleotide
ctgttcattactacttaatacctccaccaacaaagactaagaatg

SEQ ID NO: 116903 - DNA, 45 bp, Artificial Sequence
  Description of Artificial Sequence: Synthetic oligonucleotide
tgttcattactacttaatacctccaccaacaaagactaagaatgg

SEQ ID NO: 116904 - DNA, 44 bp, Artificial Sequence
  Description of Artificial Sequence: Synthetic oligonucleotide
gttcattactacttaatacctccaccaacaaagactaagaatgg

SEQ ID NO: 116905 - DNA, 44 bp, Artificial Sequence
  Description of Artificial Sequence: Synthetic oligonucleotide
ttcattactacttaatacctccaccaacaaagactaagaatggc

SEQ ID NO: 116906 - DNA, 43 bp, Artificial Sequence
  Description of Artificial Sequence: Synthetic oligonucleotide
tcattactacttaatacctccaccaacaaagactaagaatggc

SEQ ID NO: 116907 - DNA, 42 bp, Artificial Sequence
  Description of Artificial Sequence: Synthetic oligonucleotide
cattactacttaatacctccaccaacaaagactaagaatggc

SEQ ID NO: 116908 - DNA, 43 bp, Artificial Sequence
  Description of Artificial Sequence: Synthetic oligonucleotide
attactacttaatacctccaccaacaaagactaagaatggcag

SEQ ID NO: 116909 - DNA, 42 bp, Artificial Sequence
  Description of Artificial Sequence: Synthetic oligonucleotide
ttactacttaatacctccaccaacaaagactaagaatggcag

SEQ ID NO: 116910 - DNA, 41 bp, Artificial Sequence
  Description of Artificial Sequence: Synthetic oligonucleotide
tactacttaatacctccaccaacaaagactaagaatggcag

SEQ ID NO: 116911 - DNA, 40 bp, Artificial Sequence
  Description of Artificial Sequence: Synthetic oligonucleotide
actacttaatacctccaccaacaaagactaagaatggcag

SEQ ID NO: 116912 - DNA, 39 bp, Artificial Sequence
  Description of Artificial Sequence: Synthetic oligonucleotide
ctacttaatacctccaccaacaaagactaagaatggcag

SEQ ID NO: 116913 - DNA, 39 bp, Artificial Sequence
  Description of Artificial Sequence: Synthetic oligonucleotide
tacttaatacctccaccaacaaagactaagaatggcagc

SEQ ID NO: 116914 - DNA, 38 bp, Artificial Sequence
  Description of Artificial Sequence: Synthetic oligonucleotide
acttaatacctccaccaacaaagactaagaatggcagc

SEQ ID NO: 116915 - DNA, 37 bp, Artificial Sequence
  Description of Artificial Sequence: Synthetic oligonucleotide
cttaatacctccaccaacaaagactaagaatggcagc

SEQ ID NO: 116916 - DNA, 40 bp, Artificial Sequence
  Description of Artificial Sequence: Synthetic oligonucleotide
ttaatacctccaccaacaaagactaagaatggcagcaaag

SEQ ID NO: 116917 - DNA, 39 bp, Artificial Sequence
  Description of Artificial Sequence: Synthetic oligonucleotide
taatacctccaccaacaaagactaagaatggcagcaaag

SEQ ID NO: 116918 - DNA, 38 bp, Artificial Sequence
  Description of Artificial Sequence: Synthetic oligonucleotide
aatacctccaccaacaaagactaagaatggcagcaaag

SEQ ID NO: 116919 - DNA, 37 bp, Artificial Sequence
  Description of Artificial Sequence: Synthetic oligonucleotide
atacctccaccaacaaagactaagaatggcagcaaag

SEQ ID NO: 116920 - DNA, 36 bp, Artificial Sequence
  Description of Artificial Sequence: Synthetic oligonucleotide
tacctccaccaacaaagactaagaatggcagcaaag

SEQ ID NO: 116921 - DNA, 35 bp, Artificial Sequence
  Description of Artificial Sequence: Synthetic oligonucleotide
acctccaccaacaaagactaagaatggcagcaaag

SEQ ID NO: 116922 - DNA, 34 bp, Artificial Sequence
  Description of Artificial Sequence: Synthetic oligonucleotide
cctccaccaacaaagactaagaatggcagcaaag

SEQ ID NO: 116923 - DNA, 38 bp, Artificial Sequence
  Description of Artificial Sequence: Synthetic oligonucleotide
ctccaccaacaaagactaagaatggcagcaaagataag

SEQ ID NO: 116924 - DNA, 38 bp, Artificial Sequence
  Description of Artificial Sequence: Synthetic oligonucleotide
tccaccaacaaagactaagaatggcagcaaagataagg

SEQ ID NO: 116925 - DNA, 37 bp, Artificial Sequence
  Description of Artificial Sequence: Synthetic oligonucleotide
ccaccaacaaagactaagaatggcagcaaagataagg

SEQ ID NO: 116926 - DNA, 42 bp, Artificial Sequence
  Description of Artificial Sequence: Synthetic oligonucleotide
caccaacaaagactaagaatggcagcaaagataaggaaaaag

SEQ ID NO: 116927 - DNA, 45 bp, Artificial Sequence
  Description of Artificial Sequence: Synthetic oligonucleotide
accaacaaagactaagaatggcagcaaagataaggaaaaagattc

SEQ ID NO: 116928 - DNA, 44 bp, Artificial Sequence
  Description of Artificial Sequence: Synthetic oligonucleotide
ccaacaaagactaagaatggcagcaaagataaggaaaaagattc

SEQ ID NO: 116929 - DNA, 45 bp, Artificial Sequence
  Description of Artificial Sequence: Synthetic oligonucleotide
caacaaagactaagaatggcagcaaagataaggaaaaagattcag

SEQ ID NO: 116930 - DNA, 50 bp, Artificial Sequence
  Description of Artificial Sequence: Synthetic oligonucleotide
aacaaagactaagaatggcagcaaagataaggaaaaagattcagaaaaag

SEQ ID NO: 116931 - DNA, 49 bp, Artificial Sequence
  Description of Artificial Sequence: Synthetic oligonucleotide
acaaagactaagaatggcagcaaagataaggaaaaagattcagaaaaag

SEQ ID NO: 116932 - DNA, 48 bp, Artificial Sequence
  Description of Artificial Sequence: Synthetic oligonucleotide
caaagactaagaatggcagcaaagataaggaaaaagattcagaaaaag

SEQ ID NO: 116933 - DNA, 49 bp, Artificial Sequence
  Description of Artificial Sequence: Synthetic oligonucleotide
aaagactaagaatggcagcaaagataaggaaaaagattcagaaaaagag

SEQ ID NO: 116934 - DNA, 48 bp, Artificial Sequence
  Description of Artificial Sequence: Synthetic oligonucleotide
aagactaagaatggcagcaaagataaggaaaaagattcagaaaaagag

SEQ ID NO: 116935 - DNA, 47 bp, Artificial Sequence
  Description of Artificial Sequence: Synthetic oligonucleotide
agactaagaatggcagcaaagataaggaaaaagattcagaaaaagag

SEQ ID NO: 116936 - DNA, 46 bp, Artificial Sequence
  Description of Artificial Sequence: Synthetic oligonucleotide
gactaagaatggcagcaaagataaggaaaaagattcagaaaaagag

SEQ ID NO: 116937 - DNA, 49 bp, Artificial Sequence
  Description of Artificial Sequence: Synthetic oligonucleotide
actaagaatggcagcaaagataaggaaaaagattcagaaaaagagaaag

SEQ ID NO: 116938 - DNA, 48 bp, Artificial Sequence
  Description of Artificial Sequence: Synthetic oligonucleotide
ctaagaatggcagcaaagataaggaaaaagattcagaaaaagagaaag

SEQ ID NO: 116939 - DNA, 56 bp, Artificial Sequence
  Description of Artificial Sequence: Synthetic oligonucleotide
taagaatggcagcaaagataaggaaaaagattcagaaaaagagaaagatttaaaag

SEQ ID NO: 116940 - DNA, 55 bp, Artificial Sequence
  Description of Artificial Sequence: Synthetic oligonucleotide
aagaatggcagcaaagataaggaaaaagattcagaaaaagagaaagatttaaaag

SEQ ID NO: 116941 - DNA, 54 bp, Artificial Sequence
  Description of Artificial Sequence: Synthetic oligonucleotide
agaatggcagcaaagataaggaaaaagattcagaaaaagagaaagatttaaaag

SEQ ID NO: 116942 - DNA, 53 bp, Artificial Sequence
  Description of Artificial Sequence: Synthetic oligonucleotide
gaatggcagcaaagataaggaaaaagattcagaaaaagagaaagatttaaaag

SEQ ID NO: 116943 - DNA, 55 bp, Artificial Sequence
  Description of Artificial Sequence: Synthetic oligonucleotide
aatggcagcaaagataaggaaaaagattcagaaaaagagaaagatttaaaagaag

SEQ ID NO: 116944 - DNA, 54 bp, Artificial Sequence
  Description of Artificial Sequence: Synthetic oligonucleotide
atggcagcaaagataaggaaaaagattcagaaaaagagaaagatttaaaagaag

SEQ ID NO: 116945 - DNA, 53 bp, Artificial Sequence
  Description of Artificial Sequence: Synthetic oligonucleotide
tggcagcaaagataaggaaaaagattcagaaaaagagaaagatttaaaagaag

SEQ ID NO: 116946 - DNA, 52 bp, Artificial Sequence
  Description of Artificial Sequence: Synthetic oligonucleotide
ggcagcaaagataaggaaaaagattcagaaaaagagaaagatttaaaagaag

SEQ ID NO: 116947 - DNA, 53 bp, Artificial Sequence
  Description of Artificial Sequence: Synthetic oligonucleotide
gcagcaaagataaggaaaaagattcagaaaaagagaaagatttaaaagaagag

SEQ ID NO: 116948 - DNA, 57 bp, Artificial Sequence
  Description of Artificial Sequence: Synthetic oligonucleotide
cagcaaagataaggaaaaagattcagaaaaagagaaagatttaaaagaagagtttac

SEQ ID NO: 116949 - DNA, 58 bp, Artificial Sequence
  Description of Artificial Sequence: Synthetic oligonucleotide
agcaaagataaggaaaaagattcagaaaaagagaaagatttaaaagaagagtttactg

SEQ ID NO: 116950 - DNA, 57 bp, Artificial Sequence
  Description of Artificial Sequence: Synthetic oligonucleotide
gcaaagataaggaaaaagattcagaaaaagagaaagatttaaaagaagagtttactg

SEQ ID NO: 116951 - DNA, 59 bp, Artificial Sequence
  Description of Artificial Sequence: Synthetic oligonucleotide
caaagataaggaaaaagattcagaaaaagagaaagatttaaaagaagagtttactgaag

SEQ ID NO: 116952 - DNA, 59 bp, Artificial Sequence
  Description of Artificial Sequence: Synthetic oligonucleotide
aaagataaggaaaaagattcagaaaaagagaaagatttaaaagaagagtttactgaagc

SEQ ID NO: 116953 - DNA, 58 bp, Artificial Sequence
  Description of Artificial Sequence: Synthetic oligonucleotide
aagataaggaaaaagattcagaaaaagagaaagatttaaaagaagagtttactgaagc

SEQ ID NO: 116954 - DNA, 57 bp, Artificial Sequence
  Description of Artificial Sequence: Synthetic oligonucleotide
agataaggaaaaagattcagaaaaagagaaagatttaaaagaagagtttactgaagc

SEQ ID NO: 116955 - DNA, 56 bp, Artificial Sequence
  Description of Artificial Sequence: Synthetic oligonucleotide
gataaggaaaaagattcagaaaaagagaaagatttaaaagaagagtttactgaagc

SEQ ID NO: 116956 - DNA, 60 bp, Artificial Sequence
  Description of Artificial Sequence: Synthetic oligonucleotide
ataaggaaaaagattcagaaaaagagaaagatttaaaagaagagtttactgaagcattac

SEQ ID NO: 116957 - DNA, 59 bp, Artificial Sequence
  Description of Artificial Sequence: Synthetic oligonucleotide
taaggaaaaagattcagaaaaagagaaagatttaaaagaagagtttactgaagcattac

SEQ ID NO: 116958 - DNA, 58 bp, Artificial Sequence
  Description of Artificial Sequence: Synthetic oligonucleotide
aaggaaaaagattcagaaaaagagaaagatttaaaagaagagtttactgaagcattac

SEQ ID NO: 116959 - DNA, 57 bp, Artificial Sequence
  Description of Artificial Sequence: Synthetic oligonucleotide
aggaaaaagattcagaaaaagagaaagatttaaaagaagagtttactgaagcattac

SEQ ID NO: 116960 - DNA, 56 bp, Artificial Sequence
  Description of Artificial Sequence: Synthetic oligonucleotide
ggaaaaagattcagaaaaagagaaagatttaaaagaagagtttactgaagcattac

SEQ ID NO: 116961 - DNA, 56 bp, Artificial Sequence
  Description of Artificial Sequence: Synthetic oligonucleotide
gaaaaagattcagaaaaagagaaagatttaaaagaagagtttactgaagcattacg

SEQ ID NO: 116962 - DNA, 57 bp, Artificial Sequence
  Description of Artificial Sequence: Synthetic oligonucleotide
aaaaagattcagaaaaagagaaagatttaaaagaagagtttactgaagcattacgag

SEQ ID NO: 116963 - DNA, 56 bp, Artificial Sequence
  Description of Artificial Sequence: Synthetic oligonucleotide
aaaagattcagaaaaagagaaagatttaaaagaagagtttactgaagcattacgag

SEQ ID NO: 116964 - DNA, 55 bp, Artificial Sequence
  Description of Artificial Sequence: Synthetic oligonucleotide
aaagattcagaaaaagagaaagatttaaaagaagagtttactgaagcattacgag

SEQ ID NO: 116965 - DNA, 54 bp, Artificial Sequence
  Description of Artificial Sequence: Synthetic oligonucleotide
aagattcagaaaaagagaaagatttaaaagaagagtttactgaagcattacgag

SEQ ID NO: 116966 - DNA, 53 bp, Artificial Sequence
  Description of Artificial Sequence: Synthetic oligonucleotide
agattcagaaaaagagaaagatttaaaagaagagtttactgaagcattacgag

SEQ ID NO: 116967 - DNA, 52 bp, Artificial Sequence
  Description of Artificial Sequence: Synthetic oligonucleotide
gattcagaaaaagagaaagatttaaaagaagagtttactgaagcattacgag

SEQ ID NO: 116968 - DNA, 54 bp, Artificial Sequence
  Description of Artificial Sequence: Synthetic oligonucleotide
attcagaaaaagagaaagatttaaaagaagagtttactgaagcattacgagatc

SEQ ID NO: 116969 - DNA, 53 bp, Artificial Sequence
  Description of Artificial Sequence: Synthetic oligonucleotide
ttcagaaaaagagaaagatttaaaagaagagtttactgaagcattacgagatc

SEQ ID NO: 116970 - DNA, 52 bp, Artificial Sequence
  Description of Artificial Sequence: Synthetic oligonucleotide
tcagaaaaagagaaagatttaaaagaagagtttactgaagcattacgagatc

SEQ ID NO: 116971 - DNA, 51 bp, Artificial Sequence
  Description of Artificial Sequence: Synthetic oligonucleotide
cagaaaaagagaaagatttaaaagaagagtttactgaagcattacgagatc

SEQ ID NO: 116972 - DNA, 59 bp, Artificial Sequence
  Description of Artificial Sequence: Synthetic oligonucleotide
agaaaaagagaaagatttaaaagaagagtttactgaagcattacgagatcttaaaattc

SEQ ID NO: 116973 - DNA, 58 bp, Artificial Sequence
  Description of Artificial Sequence: Synthetic oligonucleotide
gaaaaagagaaagatttaaaagaagagtttactgaagcattacgagatcttaaaattc

SEQ ID NO: 116974 - DNA, 59 bp, Artificial Sequence
  Description of Artificial Sequence: Synthetic oligonucleotide
aaaaagagaaagatttaaaagaagagtttactgaagcattacgagatcttaaaattcag

SEQ ID NO: 116975 - DNA, 58 bp, Artificial Sequence
  Description of Artificial Sequence: Synthetic oligonucleotide
aaaagagaaagatttaaaagaagagtttactgaagcattacgagatcttaaaattcag

SEQ ID NO: 116976 - DNA, 57 bp, Artificial Sequence
  Description of Artificial Sequence: Synthetic oligonucleotide
aaagagaaagatttaaaagaagagtttactgaagcattacgagatcttaaaattcag

SEQ ID NO: 116977 - DNA, 56 bp, Artificial Sequence
  Description of Artificial Sequence: Synthetic oligonucleotide
aagagaaagatttaaaagaagagtttactgaagcattacgagatcttaaaattcag

SEQ ID NO: 116978 - DNA, 55 bp, Artificial Sequence
  Description of Artificial Sequence: Synthetic oligonucleotide
agagaaagatttaaaagaagagtttactgaagcattacgagatcttaaaattcag

SEQ ID NO: 116979 - DNA, 54 bp, Artificial Sequence
  Description of Artificial Sequence: Synthetic oligonucleotide
gagaaagatttaaaagaagagtttactgaagcattacgagatcttaaaattcag

SEQ ID NO: 116980 - DNA, 55 bp, Artificial Sequence
  Description of Artificial Sequence: Synthetic oligonucleotide
agaaagatttaaaagaagagtttactgaagcattacgagatcttaaaattcagtg

SEQ ID NO: 116981 - DNA, 54 bp, Artificial Sequence
  Description of Artificial Sequence: Synthetic oligonucleotide
gaaagatttaaaagaagagtttactgaagcattacgagatcttaaaattcagtg

SEQ ID NO: 116982 - DNA, 54 bp, Artificial Sequence
  Description of Artificial Sequence: Synthetic oligonucleotide
aaagatttaaaagaagagtttactgaagcattacgagatcttaaaattcagtgg

SEQ ID NO: 116983 - DNA, 53 bp, Artificial Sequence
  Description of Artificial Sequence: Synthetic oligonucleotide
aagatttaaaagaagagtttactgaagcattacgagatcttaaaattcagtgg

SEQ ID NO: 116984 - DNA, 52 bp, Artificial Sequence
  Description of Artificial Sequence: Synthetic oligonucleotide
agatttaaaagaagagtttactgaagcattacgagatcttaaaattcagtgg

SEQ ID NO: 116985 - DNA, 51 bp, Artificial Sequence
  Description of Artificial Sequence: Synthetic oligonucleotide
gatttaaaagaagagtttactgaagcattacgagatcttaaaattcagtgg

SEQ ID NO: 116986 - DNA, 53 bp, Artificial Sequence
  Description of Artificial Sequence: Synthetic oligonucleotide
atttaaaagaagagtttactgaagcattacgagatcttaaaattcagtggatg

SEQ ID NO: 116987 - DNA, 52 bp, Artificial Sequence
  Description of Artificial Sequence: Synthetic oligonucleotide
tttaaaagaagagtttactgaagcattacgagatcttaaaattcagtggatg

SEQ ID NO: 116988 - DNA, 51 bp, Artificial Sequence
  Description of Artificial Sequence: Synthetic oligonucleotide
ttaaaagaagagtttactgaagcattacgagatcttaaaattcagtggatg

SEQ ID NO: 116989 - DNA, 50 bp, Artificial Sequence
  Description of Artificial Sequence: Synthetic oligonucleotide
taaaagaagagtttactgaagcattacgagatcttaaaattcagtggatg

SEQ ID NO: 116990 - DNA, 49 bp, Artificial Sequence
  Description of Artificial Sequence: Synthetic oligonucleotide
aaaagaagagtttactgaagcattacgagatcttaaaattcagtggatg

SEQ ID NO: 116991 - DNA, 48 bp, Artificial Sequence
  Description of Artificial Sequence: Synthetic oligonucleotide
aaagaagagtttactgaagcattacgagatcttaaaattcagtggatg

SEQ ID NO: 116992 - DNA, 47 bp, Artificial Sequence
  Description of Artificial Sequence: Synthetic oligonucleotide
aagaagagtttactgaagcattacgagatcttaaaattcagtggatg

SEQ ID NO: 116993 - DNA, 46 bp, Artificial Sequence
  Description of Artificial Sequence: Synthetic oligonucleotide
agaagagtttactgaagcattacgagatcttaaaattcagtggatg

SEQ ID NO: 116994 - DNA, 45 bp, Artificial Sequence
  Description of Artificial Sequence: Synthetic oligonucleotide
gaagagtttactgaagcattacgagatcttaaaattcagtggatg

SEQ ID NO: 116995 - DNA, 46 bp, Artificial Sequence
  Description of Artificial Sequence: Synthetic oligonucleotide
aagagtttactgaagcattacgagatcttaaaattcagtggatgac

SEQ ID NO: 116996 - DNA, 45 bp, Artificial Sequence
  Description of Artificial Sequence: Synthetic oligonucleotide
agagtttactgaagcattacgagatcttaaaattcagtggatgac

SEQ ID NO: 116997 - DNA, 44 bp, Artificial Sequence
  Description of Artificial Sequence: Synthetic oligonucleotide
gagtttactgaagcattacgagatcttaaaattcagtggatgac

SEQ ID NO: 116998 - DNA, 47 bp, Artificial Sequence
  Description of Artificial Sequence: Synthetic oligonucleotide
agtttactgaagcattacgagatcttaaaattcagtggatgacaaag

SEQ ID NO: 116999 - DNA, 46 bp, Artificial Sequence
  Description of Artificial Sequence: Synthetic oligonucleotide
gtttactgaagcattacgagatcttaaaattcagtggatgacaaag

SEQ ID NO: 117000 - DNA, 46 bp, Artificial Sequence
  Description of Artificial Sequence: Synthetic oligonucleotide
tttactgaagcattacgagatcttaaaattcagtggatgacaaagc

SEQ ID NO: 117001 - DNA, 45 bp, Artificial Sequence
  Description of Artificial Sequence: Synthetic oligonucleotide
ttactgaagcattacgagatcttaaaattcagtggatgacaaagc

SEQ ID NO: 117002 - DNA, 44 bp, Artificial Sequence
  Description of Artificial Sequence: Synthetic oligonucleotide
tactgaagcattacgagatcttaaaattcagtggatgacaaagc

SEQ ID NO: 117003 - DNA, 43 bp, Artificial Sequence
  Description of Artificial Sequence: Synthetic oligonucleotide
actgaagcattacgagatcttaaaattcagtggatgacaaagc

SEQ ID NO: 117004 - DNA, 42 bp, Artificial Sequence
  Description of Artificial Sequence: Synthetic oligonucleotide
ctgaagcattacgagatcttaaaattcagtggatgacaaagc

SEQ ID NO: 117005 - DNA, 43 bp, Artificial Sequence
  Description of Artificial Sequence: Synthetic oligonucleotide
tgaagcattacgagatcttaaaattcagtggatgacaaagctg

SEQ ID NO: 117006 - DNA, 42 bp, Artificial Sequence
  Description of Artificial Sequence: Synthetic oligonucleotide
gaagcattacgagatcttaaaattcagtggatgacaaagctg

SEQ ID NO: 117007 - DNA, 42 bp, Artificial Sequence
  Description of Artificial Sequence: Synthetic oligonucleotide
aagcattacgagatcttaaaattcagtggatgacaaagctgg

SEQ ID NO: 117008 - DNA, 41 bp, Artificial Sequence
  Description of Artificial Sequence: Synthetic oligonucleotide
agcattacgagatcttaaaattcagtggatgacaaagctgg

SEQ ID NO: 117009 - DNA, 40 bp, Artificial Sequence
  Description of Artificial Sequence: Synthetic oligonucleotide
gcattacgagatcttaaaattcagtggatgacaaagctgg

SEQ ID NO: 117010 - DNA, 43 bp, Artificial Sequence
  Description of Artificial Sequence: Synthetic oligonucleotide
cattacgagatcttaaaattcagtggatgacaaagctggattc

SEQ ID NO: 117011 - DNA, 45 bp, Artificial Sequence
  Description of Artificial Sequence: Synthetic oligonucleotide
attacgagatcttaaaattcagtggatgacaaagctggattctag

SEQ ID NO: 117012 - DNA, 44 bp, Artificial Sequence
  Description of Artificial Sequence: Synthetic oligonucleotide
ttacgagatcttaaaattcagtggatgacaaagctggattctag

SEQ ID NO: 117013 - DNA, 43 bp, Artificial Sequence
  Description of Artificial Sequence: Synthetic oligonucleotide
tacgagatcttaaaattcagtggatgacaaagctggattctag

SEQ ID NO: 117014 - DNA, 42 bp, Artificial Sequence
  Description of Artificial Sequence: Synthetic oligonucleotide
acgagatcttaaaattcagtggatgacaaagctggattctag

SEQ ID NO: 117015 - DNA, 41 bp, Artificial Sequence
  Description of Artificial Sequence: Synthetic oligonucleotide
cgagatcttaaaattcagtggatgacaaagctggattctag

SEQ ID NO: 117016 - DNA, 42 bp, Artificial Sequence
  Description of Artificial Sequence: Synthetic oligonucleotide
gagatcttaaaattcagtggatgacaaagctggattctagtg

SEQ ID NO: 117017 - DNA, 43 bp, Artificial Sequence
  Description of Artificial Sequence: Synthetic oligonucleotide
agatcttaaaattcagtggatgacaaagctggattctagtgac

SEQ ID NO: 117018 - DNA, 42 bp, Artificial Sequence
  Description of Artificial Sequence: Synthetic oligonucleotide
gatcttaaaattcagtggatgacaaagctggattctagtgac

SEQ ID NO: 117019 - DNA, 50 bp, Artificial Sequence
  Description of Artificial Sequence: Synthetic oligonucleotide
atcttaaaattcagtggatgacaaagctggattctagtgacatttataac

SEQ ID NO: 117020 - DNA, 49 bp, Artificial Sequence
  Description of Artificial Sequence: Synthetic oligonucleotide
tcttaaaattcagtggatgacaaagctggattctagtgacatttataac

SEQ ID NO: 117021 - DNA, 48 bp, Artificial Sequence
  Description of Artificial Sequence: Synthetic oligonucleotide
cttaaaattcagtggatgacaaagctggattctagtgacatttataac

SEQ ID NO: 117022 - DNA, 48 bp, Artificial Sequence
  Description of Artificial Sequence: Synthetic oligonucleotide
ttaaaattcagtggatgacaaagctggattctagtgacatttataacg

SEQ ID NO: 117023 - DNA, 47 bp, Artificial Sequence
  Description of Artificial Sequence: Synthetic oligonucleotide
taaaattcagtggatgacaaagctggattctagtgacatttataacg

SEQ ID NO: 117024 - DNA, 46 bp, Artificial Sequence
  Description of Artificial Sequence: Synthetic oligonucleotide
aaaattcagtggatgacaaagctggattctagtgacatttataacg

SEQ ID NO: 117025 - DNA, 45 bp, Artificial Sequence
  Description of Artificial Sequence: Synthetic oligonucleotide
aaattcagtggatgacaaagctggattctagtgacatttataacg

SEQ ID NO: 117026 - DNA, 44 bp, Artificial Sequence
  Description of Artificial Sequence: Synthetic oligonucleotide
aattcagtggatgacaaagctggattctagtgacatttataacg

SEQ ID NO: 117027 - DNA, 43 bp, Artificial Sequence
  Description of Artificial Sequence: Synthetic oligonucleotide
attcagtggatgacaaagctggattctagtgacatttataacg

SEQ ID NO: 117028 - DNA, 42 bp, Artificial Sequence
  Description of Artificial Sequence: Synthetic oligonucleotide
ttcagtggatgacaaagctggattctagtgacatttataacg

SEQ ID NO: 117029 - DNA, 41 bp, Artificial Sequence
  Description of Artificial Sequence: Synthetic oligonucleotide
tcagtggatgacaaagctggattctagtgacatttataacg

SEQ ID NO: 117030 - DNA, 40 bp, Artificial Sequence
  Description of Artificial Sequence: Synthetic oligonucleotide
cagtggatgacaaagctggattctagtgacatttataacg

SEQ ID NO: 117031 - DNA, 44 bp, Artificial Sequence
  Description of Artificial Sequence: Synthetic oligonucleotide
agtggatgacaaagctggattctagtgacatttataacgaattg

SEQ ID NO: 117032 - DNA, 43 bp, Artificial Sequence
  Description of Artificial Sequence: Synthetic oligonucleotide
gtggatgacaaagctggattctagtgacatttataacgaattg

SEQ ID NO: 117033 - DNA, 46 bp, Artificial Sequence
  Description of Artificial Sequence: Synthetic oligonucleotide
tggatgacaaagctggattctagtgacatttataacgaattgaaag

SEQ ID NO: 117034 - DNA, 45 bp, Artificial Sequence
  Description of Artificial Sequence: Synthetic oligonucleotide
ggatgacaaagctggattctagtgacatttataacgaattgaaag

SEQ ID NO: 117035 - DNA, 48 bp, Artificial Sequence
  Description of Artificial Sequence: Synthetic oligonucleotide
gatgacaaagctggattctagtgacatttataacgaattgaaagaaac

SEQ ID NO: 117036 - DNA, 52 bp, Artificial Sequence
  Description of Artificial Sequence: Synthetic oligonucleotide
atgacaaagctggattctagtgacatttataacgaattgaaagaaacatatc

SEQ ID NO: 117037 - DNA, 51 bp, Artificial Sequence
  Description of Artificial Sequence: Synthetic oligonucleotide
tgacaaagctggattctagtgacatttataacgaattgaaagaaacatatc

SEQ ID NO: 117038 - DNA, 50 bp, Artificial Sequence
  Description of Artificial Sequence: Synthetic oligonucleotide
gacaaagctggattctagtgacatttataacgaattgaaagaaacatatc

SEQ ID NO: 117039 - DNA, 50 bp, Artificial Sequence
  Description of Artificial Sequence: Synthetic oligonucleotide
acaaagctggattctagtgacatttataacgaattgaaagaaacatatcc

SEQ ID NO: 117040 - DNA, 49 bp, Artificial Sequence
  Description of Artificial Sequence: Synthetic oligonucleotide
caaagctggattctagtgacatttataacgaattgaaagaaacatatcc

SEQ ID NO: 117041 - DNA, 56 bp, Artificial Sequence
  Description of Artificial Sequence: Synthetic oligonucleotide
aaagctggattctagtgacatttataacgaattgaaagaaacatatcctaattatc

SEQ ID NO: 117042 - DNA, 55 bp, Artificial Sequence
  Description of Artificial Sequence: Synthetic oligonucleotide
aagctggattctagtgacatttataacgaattgaaagaaacatatcctaattatc

SEQ ID NO: 117043 - DNA, 54 bp, Artificial Sequence
  Description of Artificial Sequence: Synthetic oligonucleotide
agctggattctagtgacatttataacgaattgaaagaaacatatcctaattatc

SEQ ID NO: 117044 - DNA, 53 bp, Artificial Sequence
  Description of Artificial Sequence: Synthetic oligonucleotide
gctggattctagtgacatttataacgaattgaaagaaacatatcctaattatc

SEQ ID NO: 117045 - DNA, 55 bp, Artificial Sequence
  Description of Artificial Sequence: Synthetic oligonucleotide
ctggattctagtgacatttataacgaattgaaagaaacatatcctaattatcttc

SEQ ID NO: 117046 - DNA, 55 bp, Artificial Sequence
  Description of Artificial Sequence: Synthetic oligonucleotide
tggattctagtgacatttataacgaattgaaagaaacatatcctaattatcttcc

SEQ ID NO: 117047 - DNA, 54 bp, Artificial Sequence
  Description of Artificial Sequence: Synthetic oligonucleotide
ggattctagtgacatttataacgaattgaaagaaacatatcctaattatcttcc

SEQ ID NO: 117048 - DNA, 55 bp, Artificial Sequence
  Description of Artificial Sequence: Synthetic oligonucleotide
gattctagtgacatttataacgaattgaaagaaacatatcctaattatcttcctc

SEQ ID NO: 117049 - DNA, 56 bp, Artificial Sequence
  Description of Artificial Sequence: Synthetic oligonucleotide
attctagtgacatttataacgaattgaaagaaacatatcctaattatcttcctctg

SEQ ID NO: 117050 - DNA, 55 bp, Artificial Sequence
  Description of Artificial Sequence: Synthetic oligonucleotide
ttctagtgacatttataacgaattgaaagaaacatatcctaattatcttcctctg

SEQ ID NO: 117051 - DNA, 54 bp, Artificial Sequence
  Description of Artificial Sequence: Synthetic oligonucleotide
tctagtgacatttataacgaattgaaagaaacatatcctaattatcttcctctg

SEQ ID NO: 117052 - DNA, 53 bp, Artificial Sequence
  Description of Artificial Sequence: Synthetic oligonucleotide
ctagtgacatttataacgaattgaaagaaacatatcctaattatcttcctctg

SEQ ID NO: 117053 - DNA, 55 bp, Artificial Sequence
  Description of Artificial Sequence: Synthetic oligonucleotide
tagtgacatttataacgaattgaaagaaacatatcctaattatcttcctctgtac

SEQ ID NO: 117054 - DNA, 54 bp, Artificial Sequence
  Description of Artificial Sequence: Synthetic oligonucleotide
agtgacatttataacgaattgaaagaaacatatcctaattatcttcctctgtac

SEQ ID NO: 117055 - DNA, 53 bp, Artificial Sequence
  Description of Artificial Sequence: Synthetic oligonucleotide
gtgacatttataacgaattgaaagaaacatatcctaattatcttcctctgtac

SEQ ID NO: 117056 - DNA, 53 bp, Artificial Sequence
  Description of Artificial Sequence: Synthetic oligonucleotide
tgacatttataacgaattgaaagaaacatatcctaattatcttcctctgtacg

SEQ ID NO: 117057 - DNA, 52 bp, Artificial Sequence
  Description of Artificial Sequence: Synthetic oligonucleotide
gacatttataacgaattgaaagaaacatatcctaattatcttcctctgtacg

SEQ ID NO: 117058 - DNA, 54 bp, Artificial Sequence
  Description of Artificial Sequence: Synthetic oligonucleotide
acatttataacgaattgaaagaaacatatcctaattatcttcctctgtacgttg

SEQ ID NO: 117059 - DNA, 53 bp, Artificial Sequence
  Description of Artificial Sequence: Synthetic oligonucleotide
catttataacgaattgaaagaaacatatcctaattatcttcctctgtacgttg

SEQ ID NO: 117060 - DNA, 53 bp, Artificial Sequence
  Description of Artificial Sequence: Synthetic oligonucleotide
atttataacgaattgaaagaaacatatcctaattatcttcctctgtacgttgc

SEQ ID NO: 117061 - DNA, 52 bp, Artificial Sequence
  Description of Artificial Sequence: Synthetic oligonucleotide
tttataacgaattgaaagaaacatatcctaattatcttcctctgtacgttgc

SEQ ID NO: 117062 - DNA, 51 bp, Artificial Sequence
  Description of Artificial Sequence: Synthetic oligonucleotide
ttataacgaattgaaagaaacatatcctaattatcttcctctgtacgttgc

SEQ ID NO: 117063 - DNA, 50 bp, Artificial Sequence
  Description of Artificial Sequence: Synthetic oligonucleotide
tataacgaattgaaagaaacatatcctaattatcttcctctgtacgttgc

SEQ ID NO: 117064 - DNA, 49 bp, Artificial Sequence
  Description of Artificial Sequence: Synthetic oligonucleotide
ataacgaattgaaagaaacatatcctaattatcttcctctgtacgttgc

SEQ ID NO: 117065 - DNA, 48 bp, Artificial Sequence
  Description of Artificial Sequence: Synthetic oligonucleotide
taacgaattgaaagaaacatatcctaattatcttcctctgtacgttgc

SEQ ID NO: 117066 - DNA, 47 bp, Artificial Sequence
  Description of Artificial Sequence: Synthetic oligonucleotide
aacgaattgaaagaaacatatcctaattatcttcctctgtacgttgc

SEQ ID NO: 117067 - DNA, 46 bp, Artificial Sequence
  Description of Artificial Sequence: Synthetic oligonucleotide
acgaattgaaagaaacatatcctaattatcttcctctgtacgttgc

SEQ ID NO: 117068 - DNA, 45 bp, Artificial Sequence
  Description of Artificial Sequence: Synthetic oligonucleotide
cgaattgaaagaaacatatcctaattatcttcctctgtacgttgc

SEQ ID NO: 117069 - DNA, 46 bp, Artificial Sequence
  Description of Artificial Sequence: Synthetic oligonucleotide
gaattgaaagaaacatatcctaattatcttcctctgtacgttgcac

SEQ ID NO: 117070 - DNA, 46 bp, Artificial Sequence
  Description of Artificial Sequence: Synthetic oligonucleotide
aattgaaagaaacatatcctaattatcttcctctgtacgttgcacg

SEQ ID NO: 117071 - DNA, 45 bp, Artificial Sequence
  Description of Artificial Sequence: Synthetic oligonucleotide
attgaaagaaacatatcctaattatcttcctctgtacgttgcacg

SEQ ID NO: 117072 - DNA, 44 bp, Artificial Sequence
  Description of Artificial Sequence: Synthetic oligonucleotide
ttgaaagaaacatatcctaattatcttcctctgtacgttgcacg

SEQ ID NO: 117073 - DNA, 43 bp, Artificial Sequence
  Description of Artificial Sequence: Synthetic oligonucleotide
tgaaagaaacatatcctaattatcttcctctgtacgttgcacg

SEQ ID NO: 117074 - DNA, 42 bp, Artificial Sequence
  Description of Artificial Sequence: Synthetic oligonucleotide
gaaagaaacatatcctaattatcttcctctgtacgttgcacg

SEQ ID NO: 117075 - DNA, 43 bp, Artificial Sequence
  Description of Artificial Sequence: Synthetic oligonucleotide
aaagaaacatatcctaattatcttcctctgtacgttgcacgac

SEQ ID NO: 117076 - DNA, 42 bp, Artificial Sequence
  Description of Artificial Sequence: Synthetic oligonucleotide
aagaaacatatcctaattatcttcctctgtacgttgcacgac

SEQ ID NO: 117077 - DNA, 41 bp, Artificial Sequence
  Description of Artificial Sequence: Synthetic oligonucleotide
agaaacatatcctaattatcttcctctgtacgttgcacgac

SEQ ID NO: 117078 - DNA, 40 bp, Artificial Sequence
  Description of Artificial Sequence: Synthetic oligonucleotide
gaaacatatcctaattatcttcctctgtacgttgcacgac

SEQ ID NO: 117079 - DNA, 42 bp, Artificial Sequence
  Description of Artificial Sequence: Synthetic oligonucleotide
aaacatatcctaattatcttcctctgtacgttgcacgacttc

SEQ ID NO: 117080 - DNA, 41 bp, Artificial Sequence
  Description of Artificial Sequence: Synthetic oligonucleotide
aacatatcctaattatcttcctctgtacgttgcacgacttc

SEQ ID NO: 117081 - DNA, 40 bp, Artificial Sequence
  Description of Artificial Sequence: Synthetic oligonucleotide
acatatcctaattatcttcctctgtacgttgcacgacttc

SEQ ID NO: 117082 - DNA, 39 bp, Artificial Sequence
  Description of Artificial Sequence: Synthetic oligonucleotide
catatcctaattatcttcctctgtacgttgcacgacttc

SEQ ID NO: 117083 - DNA, 41 bp, Artificial Sequence
  Description of Artificial Sequence: Synthetic oligonucleotide
atatcctaattatcttcctctgtacgttgcacgacttcatc

SEQ ID NO: 117084 - DNA, 40 bp, Artificial Sequence
  Description of Artificial Sequence: Synthetic oligonucleotide
tatcctaattatcttcctctgtacgttgcacgacttcatc

SEQ ID NO: 117085 - DNA, 39 bp, Artificial Sequence
  Description of Artificial Sequence: Synthetic oligonucleotide
atcctaattatcttcctctgtacgttgcacgacttcatc

SEQ ID NO: 117086 - DNA, 38 bp, Artificial Sequence
  Description of Artificial Sequence: Synthetic oligonucleotide
tcctaattatcttcctctgtacgttgcacgacttcatc

SEQ ID NO: 117087 - DNA, 37 bp, Artificial Sequence
  Description of Artificial Sequence: Synthetic oligonucleotide
cctaattatcttcctctgtacgttgcacgacttcatc

SEQ ID NO: 117088 - DNA, 41 bp, Artificial Sequence
  Description of Artificial Sequence: Synthetic oligonucleotide
ctaattatcttcctctgtacgttgcacgacttcatcaattg

SEQ ID NO: 117089 - DNA, 41 bp, Artificial Sequence
  Description of Artificial Sequence: Synthetic oligonucleotide
taattatcttcctctgtacgttgcacgacttcatcaattgg

SEQ ID NO: 117090 - DNA, 40 bp, Artificial Sequence
  Description of Artificial Sequence: Synthetic oligonucleotide
aattatcttcctctgtacgttgcacgacttcatcaattgg

SEQ ID NO: 117091 - DNA, 39 bp, Artificial Sequence
  Description of Artificial Sequence: Synthetic oligonucleotide
attatcttcctctgtacgttgcacgacttcatcaattgg

SEQ ID NO: 117092 - DNA, 38 bp, Artificial Sequence
  Description of Artificial Sequence: Synthetic oligonucleotide
ttatcttcctctgtacgttgcacgacttcatcaattgg

SEQ ID NO: 117093 - DNA, 37 bp, Artificial Sequence
  Description of Artificial Sequence: Synthetic oligonucleotide
tatcttcctctgtacgttgcacgacttcatcaattgg

SEQ ID NO: 117094 - DNA, 36 bp, Artificial Sequence
  Description of Artificial Sequence: Synthetic oligonucleotide
atcttcctctgtacgttgcacgacttcatcaattgg

SEQ ID NO: 117095 - DNA, 35 bp, Artificial Sequence
  Description of Artificial Sequence: Synthetic oligonucleotide
tcttcctctgtacgttgcacgacttcatcaattgg

SEQ ID NO: 117096 - DNA, 34 bp, Artificial Sequence
  Description of Artificial Sequence: Synthetic oligonucleotide
cttcctctgtacgttgcacgacttcatcaattgg

SEQ ID NO: 117097 - DNA, 36 bp, Artificial Sequence
  Description of Artificial Sequence: Synthetic oligonucleotide
ttcctctgtacgttgcacgacttcatcaattggatg

SEQ ID NO: 117098 - DNA, 35 bp, Artificial Sequence
  Description of Artificial Sequence: Synthetic oligonucleotide
tcctctgtacgttgcacgacttcatcaattggatg

SEQ ID NO: 117099 - DNA, 34 bp, Artificial Sequence
  Description of Artificial Sequence: Synthetic oligonucleotide
cctctgtacgttgcacgacttcatcaattggatg

SEQ ID NO: 117100 - DNA, 34 bp, Artificial Sequence
  Description of Artificial Sequence: Synthetic oligonucleotide
ctctgtacgttgcacgacttcatcaattggatgc

SEQ ID NO: 117101 - DNA, 35 bp, Artificial Sequence
  Description of Artificial Sequence: Synthetic oligonucleotide
tctgtacgttgcacgacttcatcaattggatgctg

SEQ ID NO: 117102 - DNA, 34 bp, Artificial Sequence
  Description of Artificial Sequence: Synthetic oligonucleotide
ctgtacgttgcacgacttcatcaattggatgctg

SEQ ID NO: 117103 - DNA, 38 bp, Artificial Sequence
  Description of Artificial Sequence: Synthetic oligonucleotide
tgtacgttgcacgacttcatcaattggatgctgaaaag

SEQ ID NO: 117104 - DNA, 37 bp, Artificial Sequence
  Description of Artificial Sequence: Synthetic oligonucleotide
gtacgttgcacgacttcatcaattggatgctgaaaag

SEQ ID NO: 117105 - DNA, 37 bp, Artificial Sequence
  Description of Artificial Sequence: Synthetic oligonucleotide
tacgttgcacgacttcatcaattggatgctgaaaagg

SEQ ID NO: 117106 - DNA, 36 bp, Artificial Sequence
  Description of Artificial Sequence: Synthetic oligonucleotide
acgttgcacgacttcatcaattggatgctgaaaagg

SEQ ID NO: 117107 - DNA, 35 bp, Artificial Sequence
  Description of Artificial Sequence: Synthetic oligonucleotide
cgttgcacgacttcatcaattggatgctgaaaagg

SEQ ID NO: 117108 - DNA, 37 bp, Artificial Sequence
  Description of Artificial Sequence: Synthetic oligonucleotide
gttgcacgacttcatcaattggatgctgaaaaggaac

SEQ ID NO: 117109 - DNA, 37 bp, Artificial Sequence
  Description of Artificial Sequence: Synthetic oligonucleotide
ttgcacgacttcatcaattggatgctgaaaaggaacg

SEQ ID NO: 117110 - DNA, 36 bp, Artificial Sequence
  Description of Artificial Sequence: Synthetic oligonucleotide
tgcacgacttcatcaattggatgctgaaaaggaacg

SEQ ID NO: 117111 - DNA, 35 bp, Artificial Sequence
  Description of Artificial Sequence: Synthetic oligonucleotide
gcacgacttcatcaattggatgctgaaaaggaacg

SEQ ID NO: 117112 - DNA, 38 bp, Artificial Sequence
  Description of Artificial Sequence: Synthetic oligonucleotide
cacgacttcatcaattggatgctgaaaaggaacgaatg

SEQ ID NO: 117113 - DNA, 42 bp, Artificial Sequence
  Description of Artificial Sequence: Synthetic oligonucleotide
acgacttcatcaattggatgctgaaaaggaacgaatgaaaag

SEQ ID NO: 117114 - DNA, 41 bp, Artificial Sequence
  Description of Artificial Sequence: Synthetic oligonucleotide
cgacttcatcaattggatgctgaaaaggaacgaatgaaaag

SEQ ID NO: 117115 - DNA, 42 bp, Artificial Sequence
  Description of Artificial Sequence: Synthetic oligonucleotide
gacttcatcaattggatgctgaaaaggaacgaatgaaaagac

SEQ ID NO: 117116 - DNA, 47 bp, Artificial Sequence
  Description of Artificial Sequence: Synthetic oligonucleotide
acttcatcaattggatgctgaaaaggaacgaatgaaaagacttaatg

SEQ ID NO: 117117 - DNA, 46 bp, Artificial Sequence
  Description of Artificial Sequence: Synthetic oligonucleotide
cttcatcaattggatgctgaaaaggaacgaatgaaaagacttaatg

SEQ ID NO: 117118 - DNA, 51 bp, Artificial Sequence
  Description of Artificial Sequence: Synthetic oligonucleotide
ttcatcaattggatgctgaaaaggaacgaatgaaaagacttaatgaaattg

SEQ ID NO: 117119 - DNA, 50 bp, Artificial Sequence
  Description of Artificial Sequence: Synthetic oligonucleotide
tcatcaattggatgctgaaaaggaacgaatgaaaagacttaatgaaattg

SEQ ID NO: 117120 - DNA, 49 bp, Artificial Sequence
  Description of Artificial Sequence: Synthetic oligonucleotide
catcaattggatgctgaaaaggaacgaatgaaaagacttaatgaaattg

SEQ ID NO: 117121 - DNA, 51 bp, Artificial Sequence
  Description of Artificial Sequence: Synthetic oligonucleotide
atcaattggatgctgaaaaggaacgaatgaaaagacttaatgaaattgttg

SEQ ID NO: 117122 - DNA, 50 bp, Artificial Sequence
  Description of Artificial Sequence: Synthetic oligonucleotide
tcaattggatgctgaaaaggaacgaatgaaaagacttaatgaaattgttg

SEQ ID NO: 117123 - DNA, 49 bp, Artificial Sequence
  Description of Artificial Sequence: Synthetic oligonucleotide
caattggatgctgaaaaggaacgaatgaaaagacttaatgaaattgttg

SEQ ID NO: 117124 - DNA, 51 bp, Artificial Sequence
  Description of Artificial Sequence: Synthetic oligonucleotide
aattggatgctgaaaaggaacgaatgaaaagacttaatgaaattgttgatg

SEQ ID NO: 117125 - DNA, 50 bp, Artificial Sequence
  Description of Artificial Sequence: Synthetic oligonucleotide
attggatgctgaaaaggaacgaatgaaaagacttaatgaaattgttgatg

SEQ ID NO: 117126 - DNA, 49 bp, Artificial Sequence
  Description of Artificial Sequence: Synthetic oligonucleotide
ttggatgctgaaaaggaacgaatgaaaagacttaatgaaattgttgatg

SEQ ID NO: 117127 - DNA, 48 bp, Artificial Sequence
  Description of Artificial Sequence: Synthetic oligonucleotide
tggatgctgaaaaggaacgaatgaaaagacttaatgaaattgttgatg

SEQ ID NO: 117128 - DNA, 47 bp, Artificial Sequence
  Description of Artificial Sequence: Synthetic oligonucleotide
ggatgctgaaaaggaacgaatgaaaagacttaatgaaattgttgatg

SEQ ID NO: 117129 - DNA, 47 bp, Artificial Sequence
  Description of Artificial Sequence: Synthetic oligonucleotide
gatgctgaaaaggaacgaatgaaaagacttaatgaaattgttgatgc

SEQ ID NO: 117130 - DNA, 47 bp, Artificial Sequence
  Description of Artificial Sequence: Synthetic oligonucleotide
atgctgaaaaggaacgaatgaaaagacttaatgaaattgttgatgcg

SEQ ID NO: 117131 - DNA, 46 bp, Artificial Sequence
  Description of Artificial Sequence: Synthetic oligonucleotide
tgctgaaaaggaacgaatgaaaagacttaatgaaattgttgatgcg

SEQ ID NO: 117132 - DNA, 45 bp, Artificial Sequence
  Description of Artificial Sequence: Synthetic oligonucleotide
gctgaaaaggaacgaatgaaaagacttaatgaaattgttgatgcg

SEQ ID NO: 117133 - DNA, 45 bp, Artificial Sequence
  Description of Artificial Sequence: Synthetic oligonucleotide
ctgaaaaggaacgaatgaaaagacttaatgaaattgttgatgcgg

SEQ ID NO: 117134 - DNA, 45 bp, Artificial Sequence
  Description of Artificial Sequence: Synthetic oligonucleotide
tgaaaaggaacgaatgaaaagacttaatgaaattgttgatgcggc

SEQ ID NO: 117135 - DNA, 44 bp, Artificial Sequence
  Description of Artificial Sequence: Synthetic oligonucleotide
gaaaaggaacgaatgaaaagacttaatgaaattgttgatgcggc

SEQ ID NO: 117136 - DNA, 48 bp, Artificial Sequence
  Description of Artificial Sequence: Synthetic oligonucleotide
aaaaggaacgaatgaaaagacttaatgaaattgttgatgcggcaaatg

SEQ ID NO: 117137 - DNA, 47 bp, Artificial Sequence
  Description of Artificial Sequence: Synthetic oligonucleotide
aaaggaacgaatgaaaagacttaatgaaattgttgatgcggcaaatg

SEQ ID NO: 117138 - DNA, 46 bp, Artificial Sequence
  Description of Artificial Sequence: Synthetic oligonucleotide
aaggaacgaatgaaaagacttaatgaaattgttgatgcggcaaatg

SEQ ID NO: 117139 - DNA, 45 bp, Artificial Sequence
  Description of Artificial Sequence: Synthetic oligonucleotide
aggaacgaatgaaaagacttaatgaaattgttgatgcggcaaatg

SEQ ID NO: 117140 - DNA, 44 bp, Artificial Sequence
  Description of Artificial Sequence: Synthetic oligonucleotide
ggaacgaatgaaaagacttaatgaaattgttgatgcggcaaatg

SEQ ID NO: 117141 - DNA, 44 bp, Artificial Sequence
  Description of Artificial Sequence: Synthetic oligonucleotide
gaacgaatgaaaagacttaatgaaattgttgatgcggcaaatgc

SEQ ID NO: 117142 - DNA, 45 bp, Artificial Sequence
  Description of Artificial Sequence: Synthetic oligonucleotide
aacgaatgaaaagacttaatgaaattgttgatgcggcaaatgctg

SEQ ID NO: 117143 - DNA, 44 bp, Artificial Sequence
  Description of Artificial Sequence: Synthetic oligonucleotide
acgaatgaaaagacttaatgaaattgttgatgcggcaaatgctg

SEQ ID NO: 117144 - DNA, 43 bp, Artificial Sequence
  Description of Artificial Sequence: Synthetic oligonucleotide
cgaatgaaaagacttaatgaaattgttgatgcggcaaatgctg

SEQ ID NO: 117145 - DNA, 49 bp, Artificial Sequence
  Description of Artificial Sequence: Synthetic oligonucleotide
gaatgaaaagacttaatgaaattgttgatgcggcaaatgctgttatttc

SEQ ID NO: 117146 - DNA, 50 bp, Artificial Sequence
  Description of Artificial Sequence: Synthetic oligonucleotide
aatgaaaagacttaatgaaattgttgatgcggcaaatgctgttatttctc

SEQ ID NO: 117147 - DNA, 49 bp, Artificial Sequence
  Description of Artificial Sequence: Synthetic oligonucleotide
atgaaaagacttaatgaaattgttgatgcggcaaatgctgttatttctc

SEQ ID NO: 117148 - DNA, 48 bp, Artificial Sequence
  Description of Artificial Sequence: Synthetic oligonucleotide
tgaaaagacttaatgaaattgttgatgcggcaaatgctgttatttctc

SEQ ID NO: 117149 - DNA, 47 bp, Artificial Sequence
  Description of Artificial Sequence: Synthetic oligonucleotide
gaaaagacttaatgaaattgttgatgcggcaaatgctgttatttctc

SEQ ID NO: 117150 - DNA, 52 bp, Artificial Sequence
  Description of Artificial Sequence: Synthetic oligonucleotide
aaaagacttaatgaaattgttgatgcggcaaatgctgttatttctcatatag

SEQ ID NO: 117151 - DNA, 51 bp, Artificial Sequence
  Description of Artificial Sequence: Synthetic oligonucleotide
aaagacttaatgaaattgttgatgcggcaaatgctgttatttctcatatag

SEQ ID NO: 117152 - DNA, 50 bp, Artificial Sequence
  Description of Artificial Sequence: Synthetic oligonucleotide
aagacttaatgaaattgttgatgcggcaaatgctgttatttctcatatag

SEQ ID NO: 117153 - DNA, 49 bp, Artificial Sequence
  Description of Artificial Sequence: Synthetic oligonucleotide
agacttaatgaaattgttgatgcggcaaatgctgttatttctcatatag

SEQ ID NO: 117154 - DNA, 48 bp, Artificial Sequence
  Description of Artificial Sequence: Synthetic oligonucleotide
gacttaatgaaattgttgatgcggcaaatgctgttatttctcatatag

SEQ ID NO: 117155 - DNA, 50 bp, Artificial Sequence
  Description of Artificial Sequence: Synthetic oligonucleotide
acttaatgaaattgttgatgcggcaaatgctgttatttctcatatagatc

SEQ ID NO: 117156 - DNA, 49 bp, Artificial Sequence
  Description of Artificial Sequence: Synthetic oligonucleotide
cttaatgaaattgttgatgcggcaaatgctgttatttctcatatagatc

SEQ ID NO: 117157 - DNA, 52 bp, Artificial Sequence
  Description of Artificial Sequence: Synthetic oligonucleotide
ttaatgaaattgttgatgcggcaaatgctgttatttctcatatagatcaaac

SEQ ID NO: 117158 - DNA, 51 bp, Artificial Sequence
  Description of Artificial Sequence: Synthetic oligonucleotide
taatgaaattgttgatgcggcaaatgctgttatttctcatatagatcaaac

SEQ ID NO: 117159 - DNA, 50 bp, Artificial Sequence
  Description of Artificial Sequence: Synthetic oligonucleotide
aatgaaattgttgatgcggcaaatgctgttatttctcatatagatcaaac

SEQ ID NO: 117160 - DNA, 49 bp, Artificial Sequence
  Description of Artificial Sequence: Synthetic oligonucleotide
atgaaattgttgatgcggcaaatgctgttatttctcatatagatcaaac

SEQ ID NO: 117161 - DNA, 48 bp, Artificial Sequence
  Description of Artificial Sequence: Synthetic oligonucleotide
tgaaattgttgatgcggcaaatgctgttatttctcatatagatcaaac

SEQ ID NO: 117162 - DNA, 47 bp, Artificial Sequence
  Description of Artificial Sequence: Synthetic oligonucleotide
gaaattgttgatgcggcaaatgctgttatttctcatatagatcaaac

SEQ ID NO: 117163 - DNA, 48 bp, Artificial Sequence
  Description of Artificial Sequence: Synthetic oligonucleotide
aaattgttgatgcggcaaatgctgttatttctcatatagatcaaacag

SEQ ID NO: 117164 - DNA, 47 bp, Artificial Sequence
  Description of Artificial Sequence: Synthetic oligonucleotide
aattgttgatgcggcaaatgctgttatttctcatatagatcaaacag

SEQ ID NO: 117165 - DNA, 46 bp, Artificial Sequence
  Description of Artificial Sequence: Synthetic oligonucleotide
attgttgatgcggcaaatgctgttatttctcatatagatcaaacag

SEQ ID NO: 117166 - DNA, 45 bp, Artificial Sequence
  Description of Artificial Sequence: Synthetic oligonucleotide
ttgttgatgcggcaaatgctgttatttctcatatagatcaaacag

SEQ ID NO: 117167 - DNA, 44 bp, Artificial Sequence
  Description of Artificial Sequence: Synthetic oligonucleotide
tgttgatgcggcaaatgctgttatttctcatatagatcaaacag

SEQ ID NO: 117168 - DNA, 43 bp, Artificial Sequence
  Description of Artificial Sequence: Synthetic oligonucleotide
gttgatgcggcaaatgctgttatttctcatatagatcaaacag

SEQ ID NO: 117169 - DNA, 43 bp, Artificial Sequence
  Description of Artificial Sequence: Synthetic oligonucleotide
ttgatgcggcaaatgctgttatttctcatatagatcaaacagc

SEQ ID NO: 117170 - DNA, 42 bp, Artificial Sequence
  Description of Artificial Sequence: Synthetic oligonucleotide
tgatgcggcaaatgctgttatttctcatatagatcaaacagc

SEQ ID NO: 117171 - DNA, 41 bp, Artificial Sequence
  Description of Artificial Sequence: Synthetic oligonucleotide
gatgcggcaaatgctgttatttctcatatagatcaaacagc

SEQ ID NO: 117172 - DNA, 41 bp, Artificial Sequence
  Description of Artificial Sequence: Synthetic oligonucleotide
atgcggcaaatgctgttatttctcatatagatcaaacagcc

SEQ ID NO: 117173 - DNA, 40 bp, Artificial Sequence
  Description of Artificial Sequence: Synthetic oligonucleotide
tgcggcaaatgctgttatttctcatatagatcaaacagcc

SEQ ID NO: 117174 - DNA, 39 bp, Artificial Sequence
  Description of Artificial Sequence: Synthetic oligonucleotide
gcggcaaatgctgttatttctcatatagatcaaacagcc

SEQ ID NO: 117175 - DNA, 39 bp, Artificial Sequence
  Description of Artificial Sequence: Synthetic oligonucleotide
cggcaaatgctgttatttctcatatagatcaaacagccc

SEQ ID NO: 117176 - DNA, 41 bp, Artificial Sequence
  Description of Artificial Sequence: Synthetic oligonucleotide
ggcaaatgctgttatttctcatatagatcaaacagccctag

SEQ ID NO: 117177 - DNA, 41 bp, Artificial Sequence
  Description of Artificial Sequence: Synthetic oligonucleotide
gcaaatgctgttatttctcatatagatcaaacagccctagc

SEQ ID NO: 117178 - DNA, 42 bp, Artificial Sequence
  Description of Artificial Sequence: Synthetic oligonucleotide
caaatgctgttatttctcatatagatcaaacagccctagcag

SEQ ID NO: 117179 - DNA, 50 bp, Artificial Sequence
  Description of Artificial Sequence: Synthetic oligonucleotide
aaatgctgttatttctcatatagatcaaacagccctagcagtttatattg

SEQ ID NO: 117180 - DNA, 49 bp, Artificial Sequence
  Description of Artificial Sequence: Synthetic oligonucleotide
aatgctgttatttctcatatagatcaaacagccctagcagtttatattg

SEQ ID NO: 117181 - DNA, 48 bp, Artificial Sequence
  Description of Artificial Sequence: Synthetic oligonucleotide
atgctgttatttctcatatagatcaaacagccctagcagtttatattg

SEQ ID NO: 117182 - DNA, 47 bp, Artificial Sequence
  Description of Artificial Sequence: Synthetic oligonucleotide
tgctgttatttctcatatagatcaaacagccctagcagtttatattg

SEQ ID NO: 117183 - DNA, 46 bp, Artificial Sequence
  Description of Artificial Sequence: Synthetic oligonucleotide
gctgttatttctcatatagatcaaacagccctagcagtttatattg

SEQ ID NO: 117184 - DNA, 46 bp, Artificial Sequence
  Description of Artificial Sequence: Synthetic oligonucleotide
ctgttatttctcatatagatcaaacagccctagcagtttatattgc

SEQ ID NO: 117185 - DNA, 49 bp, Artificial Sequence
  Description of Artificial Sequence: Synthetic oligonucleotide
tgttatttctcatatagatcaaacagccctagcagtttatattgcaatg

SEQ ID NO: 117186 - DNA, 48 bp, Artificial Sequence
  Description of Artificial Sequence: Synthetic oligonucleotide
gttatttctcatatagatcaaacagccctagcagtttatattgcaatg

SEQ ID NO: 117187 - DNA, 50 bp, Artificial Sequence
  Description of Artificial Sequence: Synthetic oligonucleotide
ttatttctcatatagatcaaacagccctagcagtttatattgcaatgaag

SEQ ID NO: 117188 - DNA, 49 bp, Artificial Sequence
  Description of Artificial Sequence: Synthetic oligonucleotide
tatttctcatatagatcaaacagccctagcagtttatattgcaatgaag

SEQ ID NO: 117189 - DNA, 48 bp, Artificial Sequence
  Description of Artificial Sequence: Synthetic oligonucleotide
atttctcatatagatcaaacagccctagcagtttatattgcaatgaag

SEQ ID NO: 117190 - DNA, 47 bp, Artificial Sequence
  Description of Artificial Sequence: Synthetic oligonucleotide
tttctcatatagatcaaacagccctagcagtttatattgcaatgaag

SEQ ID NO: 117191 - DNA, 46 bp, Artificial Sequence
  Description of Artificial Sequence: Synthetic oligonucleotide
ttctcatatagatcaaacagccctagcagtttatattgcaatgaag

SEQ ID NO: 117192 - DNA, 45 bp, Artificial Sequence
  Description of Artificial Sequence: Synthetic oligonucleotide
tctcatatagatcaaacagccctagcagtttatattgcaatgaag

SEQ ID NO: 117193 - DNA, 44 bp, Artificial Sequence
  Description of Artificial Sequence: Synthetic oligonucleotide
ctcatatagatcaaacagccctagcagtttatattgcaatgaag

SEQ ID NO: 117194 - DNA, 45 bp, Artificial Sequence
  Description of Artificial Sequence: Synthetic oligonucleotide
tcatatagatcaaacagccctagcagtttatattgcaatgaagac

SEQ ID NO: 117195 - DNA, 44 bp, Artificial Sequence
  Description of Artificial Sequence: Synthetic oligonucleotide
catatagatcaaacagccctagcagtttatattgcaatgaagac

SEQ ID NO: 117196 - DNA, 45 bp, Artificial Sequence
  Description of Artificial Sequence: Synthetic oligonucleotide
atatagatcaaacagccctagcagtttatattgcaatgaagactg

SEQ ID NO: 117197 - DNA, 44 bp, Artificial Sequence
  Description of Artificial Sequence: Synthetic oligonucleotide
tatagatcaaacagccctagcagtttatattgcaatgaagactg

SEQ ID NO: 117198 - DNA, 43 bp, Artificial Sequence
  Description of Artificial Sequence: Synthetic oligonucleotide
atagatcaaacagccctagcagtttatattgcaatgaagactg

SEQ ID NO: 117199 - DNA, 42 bp, Artificial Sequence
  Description of Artificial Sequence: Synthetic oligonucleotide
tagatcaaacagccctagcagtttatattgcaatgaagactg

SEQ ID NO: 117200 - DNA, 41 bp, Artificial Sequence
  Description of Artificial Sequence: Synthetic oligonucleotide
agatcaaacagccctagcagtttatattgcaatgaagactg

SEQ ID NO: 117201 - DNA, 40 bp, Artificial Sequence
  Description of Artificial Sequence: Synthetic oligonucleotide
gatcaaacagccctagcagtttatattgcaatgaagactg

SEQ ID NO: 117202 - DNA, 42 bp, Artificial Sequence
  Description of Artificial Sequence: Synthetic oligonucleotide
atcaaacagccctagcagtttatattgcaatgaagactgatc

SEQ ID NO: 117203 - DNA, 41 bp, Artificial Sequence
  Description of Artificial Sequence: Synthetic oligonucleotide
tcaaacagccctagcagtttatattgcaatgaagactgatc

SEQ ID NO: 117204 - DNA, 40 bp, Artificial Sequence
  Description of Artificial Sequence: Synthetic oligonucleotide
caaacagccctagcagtttatattgcaatgaagactgatc

SEQ ID NO: 117205 - DNA, 40 bp, Artificial Sequence
  Description of Artificial Sequence: Synthetic oligonucleotide
aaacagccctagcagtttatattgcaatgaagactgatcc

SEQ ID NO: 117206 - DNA, 39 bp, Artificial Sequence
  Description of Artificial Sequence: Synthetic oligonucleotide
aacagccctagcagtttatattgcaatgaagactgatcc

SEQ ID NO: 117207 - DNA, 38 bp, Artificial Sequence
  Description of Artificial Sequence: Synthetic oligonucleotide
acagccctagcagtttatattgcaatgaagactgatcc

SEQ ID NO: 117208 - DNA, 37 bp, Artificial Sequence
  Description of Artificial Sequence: Synthetic oligonucleotide
cagccctagcagtttatattgcaatgaagactgatcc

SEQ ID NO: 117209 - DNA, 37 bp, Artificial Sequence
  Description of Artificial Sequence: Synthetic oligonucleotide
agccctagcagtttatattgcaatgaagactgatccc

SEQ ID NO: 117210 - DNA, 36 bp, Artificial Sequence
  Description of Artificial Sequence: Synthetic oligonucleotide
gccctagcagtttatattgcaatgaagactgatccc

SEQ ID NO: 117211 - DNA, 37 bp, Artificial Sequence
  Description of Artificial Sequence: Synthetic oligonucleotide
ccctagcagtttatattgcaatgaagactgatcccag

SEQ ID NO: 117212 - DNA, 37 bp, Artificial Sequence
  Description of Artificial Sequence: Synthetic oligonucleotide
cctagcagtttatattgcaatgaagactgatcccagg

SEQ ID NO: 117213 - DNA, 37 bp, Artificial Sequence
  Description of Artificial Sequence: Synthetic oligonucleotide
ctagcagtttatattgcaatgaagactgatcccaggc

SEQ ID NO: 117214 - DNA, 37 bp, Artificial Sequence
  Description of Artificial Sequence: Synthetic oligonucleotide
tagcagtttatattgcaatgaagactgatcccaggcc

SEQ ID NO: 117215 - DNA, 36 bp, Artificial Sequence
  Description of Artificial Sequence: Synthetic oligonucleotide
agcagtttatattgcaatgaagactgatcccaggcc

SEQ ID NO: 117216 - DNA, 35 bp, Artificial Sequence
  Description of Artificial Sequence: Synthetic oligonucleotide
gcagtttatattgcaatgaagactgatcccaggcc

SEQ ID NO: 117217 - DNA, 36 bp, Artificial Sequence
  Description of Artificial Sequence: Synthetic oligonucleotide
cagtttatattgcaatgaagactgatcccaggcctg

SEQ ID NO: 117218 - DNA, 38 bp, Artificial Sequence
  Description of Artificial Sequence: Synthetic oligonucleotide
agtttatattgcaatgaagactgatcccaggcctgatg

SEQ ID NO: 117219 - DNA, 37 bp, Artificial Sequence
  Description of Artificial Sequence: Synthetic oligonucleotide
gtttatattgcaatgaagactgatcccaggcctgatg

SEQ ID NO: 117220 - DNA, 37 bp, Artificial Sequence
  Description of Artificial Sequence: Synthetic oligonucleotide
tttatattgcaatgaagactgatcccaggcctgatgc

SEQ ID NO: 117221 - DNA, 36 bp, Artificial Sequence
  Description of Artificial Sequence: Synthetic oligonucleotide
ttatattgcaatgaagactgatcccaggcctgatgc

SEQ ID NO: 117222 - DNA, 35 bp, Artificial Sequence
  Description of Artificial Sequence: Synthetic oligonucleotide
tatattgcaatgaagactgatcccaggcctgatgc

SEQ ID NO: 117223 - DNA, 34 bp, Artificial Sequence
  Description of Artificial Sequence: Synthetic oligonucleotide
atattgcaatgaagactgatcccaggcctgatgc

SEQ ID NO: 117224 - DNA, 33 bp, Artificial Sequence
  Description of Artificial Sequence: Synthetic oligonucleotide
tattgcaatgaagactgatcccaggcctgatgc

SEQ ID NO: 117225 - DNA, 32 bp, Artificial Sequence
  Description of Artificial Sequence: Synthetic oligonucleotide
attgcaatgaagactgatcccaggcctgatgc

SEQ ID NO: 117226 - DNA, 31 bp, Artificial Sequence
  Description of Artificial Sequence: Synthetic oligonucleotide
ttgcaatgaagactgatcccaggcctgatgc

SEQ ID NO: 117227 - DNA, 30 bp, Artificial Sequence
  Description of Artificial Sequence: Synthetic oligonucleotide
tgcaatgaagactgatcccaggcctgatgc

SEQ ID NO: 117228 - DNA, 29 bp, Artificial Sequence
  Description of Artificial Sequence: Synthetic oligonucleotide
gcaatgaagactgatcccaggcctgatgc

SEQ ID NO: 117229 - DNA, 30 bp, Artificial Sequence
  Description of Artificial Sequence: Synthetic oligonucleotide
caatgaagactgatcccaggcctgatgcag

SEQ ID NO: 117230 - DNA, 30 bp, Artificial Sequence
  Description of Artificial Sequence: Synthetic oligonucleotide
aatgaagactgatcccaggcctgatgcagc

SEQ ID NO: 117231 - DNA, 29 bp, Artificial Sequence
  Description of Artificial Sequence: Synthetic oligonucleotide
atgaagactgatcccaggcctgatgcagc

SEQ ID NO: 117232 - DNA, 28 bp, Artificial Sequence
  Description of Artificial Sequence: Synthetic oligonucleotide
tgaagactgatcccaggcctgatgcagc

SEQ ID NO: 117233 - DNA, 27 bp, Artificial Sequence
  Description of Artificial Sequence: Synthetic oligonucleotide
gaagactgatcccaggcctgatgcagc

SEQ ID NO: 117234 - DNA, 29 bp, Artificial Sequence
  Description of Artificial Sequence: Synthetic oligonucleotide
aagactgatcccaggcctgatgcagctac

SEQ ID NO: 117235 - DNA, 28 bp, Artificial Sequence
  Description of Artificial Sequence: Synthetic oligonucleotide
agactgatcccaggcctgatgcagctac

SEQ ID NO: 117236 - DNA, 27 bp, Artificial Sequence
  Description of Artificial Sequence: Synthetic oligonucleotide
gactgatcccaggcctgatgcagctac

SEQ ID NO: 117237 - DNA, 37 bp, Artificial Sequence
  Description of Artificial Sequence: Synthetic oligonucleotide
actgatcccaggcctgatgcagctactataaaaaatg

SEQ ID NO: 117238 - DNA, 36 bp, Artificial Sequence
  Description of Artificial Sequence: Synthetic oligonucleotide
ctgatcccaggcctgatgcagctactataaaaaatg

SEQ ID NO: 117239 - DNA, 37 bp, Artificial Sequence
  Description of Artificial Sequence: Synthetic oligonucleotide
tgatcccaggcctgatgcagctactataaaaaatgac

SEQ ID NO: 117240 - DNA, 36 bp, Artificial Sequence
  Description of Artificial Sequence: Synthetic oligonucleotide
gatcccaggcctgatgcagctactataaaaaatgac

SEQ ID NO: 117241 - DNA, 38 bp, Artificial Sequence
  Description of Artificial Sequence: Synthetic oligonucleotide
atcccaggcctgatgcagctactataaaaaatgacatg

SEQ ID NO: 117242 - DNA, 37 bp, Artificial Sequence
  Description of Artificial Sequence: Synthetic oligonucleotide
tcccaggcctgatgcagctactataaaaaatgacatg

SEQ ID NO: 117243 - DNA, 36 bp, Artificial Sequence
  Description of Artificial Sequence: Synthetic oligonucleotide
cccaggcctgatgcagctactataaaaaatgacatg

SEQ ID NO: 117244 - DNA, 36 bp, Artificial Sequence
  Description of Artificial Sequence: Synthetic oligonucleotide
ccaggcctgatgcagctactataaaaaatgacatgg

SEQ ID NO: 117245 - DNA, 37 bp, Artificial Sequence
  Description of Artificial Sequence: Synthetic oligonucleotide
caggcctgatgcagctactataaaaaatgacatggac

SEQ ID NO: 117246 - DNA, 40 bp, Artificial Sequence
  Description of Artificial Sequence: Synthetic oligonucleotide
aggcctgatgcagctactataaaaaatgacatggacaaac

SEQ ID NO: 117247 - DNA, 39 bp, Artificial Sequence
  Description of Artificial Sequence: Synthetic oligonucleotide
ggcctgatgcagctactataaaaaatgacatggacaaac

SEQ ID NO: 117248 - DNA, 45 bp, Artificial Sequence
  Description of Artificial Sequence: Synthetic oligonucleotide
gcctgatgcagctactataaaaaatgacatggacaaacaaaaatc

SEQ ID NO: 117249 - DNA, 45 bp, Artificial Sequence
  Description of Artificial Sequence: Synthetic oligonucleotide
cctgatgcagctactataaaaaatgacatggacaaacaaaaatcc

SEQ ID NO: 117250 - DNA, 46 bp, Artificial Sequence
  Description of Artificial Sequence: Synthetic oligonucleotide
ctgatgcagctactataaaaaatgacatggacaaacaaaaatccac

SEQ ID NO: 117251 - DNA, 46 bp, Artificial Sequence
  Description of Artificial Sequence: Synthetic oligonucleotide
tgatgcagctactataaaaaatgacatggacaaacaaaaatccacc

SEQ ID NO: 117252 - DNA, 45 bp, Artificial Sequence
  Description of Artificial Sequence: Synthetic oligonucleotide
gatgcagctactataaaaaatgacatggacaaacaaaaatccacc

SEQ ID NO: 117253 - DNA, 45 bp, Artificial Sequence
  Description of Artificial Sequence: Synthetic oligonucleotide
atgcagctactataaaaaatgacatggacaaacaaaaatccaccc

SEQ ID NO: 117254 - DNA, 44 bp, Artificial Sequence
  Description of Artificial Sequence: Synthetic oligonucleotide
tgcagctactataaaaaatgacatggacaaacaaaaatccaccc

SEQ ID NO: 117255 - DNA, 43 bp, Artificial Sequence
  Description of Artificial Sequence: Synthetic oligonucleotide
gcagctactataaaaaatgacatggacaaacaaaaatccaccc

SEQ ID NO: 117256 - DNA, 44 bp, Artificial Sequence
  Description of Artificial Sequence: Synthetic oligonucleotide
cagctactataaaaaatgacatggacaaacaaaaatccaccctc

SEQ ID NO: 117257 - DNA, 44 bp, Artificial Sequence
  Description of Artificial Sequence: Synthetic oligonucleotide
agctactataaaaaatgacatggacaaacaaaaatccaccctcg

SEQ ID NO: 117258 - DNA, 43 bp, Artificial Sequence
  Description of Artificial Sequence: Synthetic oligonucleotide
gctactataaaaaatgacatggacaaacaaaaatccaccctcg

SEQ ID NO: 117259 - DNA, 45 bp, Artificial Sequence
  Description of Artificial Sequence: Synthetic oligonucleotide
ctactataaaaaatgacatggacaaacaaaaatccaccctcgtag

SEQ ID NO: 117260 - DNA, 47 bp, Artificial Sequence
  Description of Artificial Sequence: Synthetic oligonucleotide
tactataaaaaatgacatggacaaacaaaaatccaccctcgtagatg

SEQ ID NO: 117261 - DNA, 46 bp, Artificial Sequence
  Description of Artificial Sequence: Synthetic oligonucleotide
actataaaaaatgacatggacaaacaaaaatccaccctcgtagatg

SEQ ID NO: 117262 - DNA, 45 bp, Artificial Sequence
  Description of Artificial Sequence: Synthetic oligonucleotide
ctataaaaaatgacatggacaaacaaaaatccaccctcgtagatg

SEQ ID NO: 117263 - DNA, 45 bp, Artificial Sequence
  Description of Artificial Sequence: Synthetic oligonucleotide
tataaaaaatgacatggacaaacaaaaatccaccctcgtagatgc

SEQ ID NO: 117264 - DNA, 44 bp, Artificial Sequence
  Description of Artificial Sequence: Synthetic oligonucleotide
ataaaaaatgacatggacaaacaaaaatccaccctcgtagatgc

SEQ ID NO: 117265 - DNA, 43 bp, Artificial Sequence
  Description of Artificial Sequence: Synthetic oligonucleotide
taaaaaatgacatggacaaacaaaaatccaccctcgtagatgc

SEQ ID NO: 117266 - DNA, 42 bp, Artificial Sequence
  Description of Artificial Sequence: Synthetic oligonucleotide
aaaaaatgacatggacaaacaaaaatccaccctcgtagatgc

SEQ ID NO: 117267 - DNA, 41 bp, Artificial Sequence
  Description of Artificial Sequence: Synthetic oligonucleotide
aaaaatgacatggacaaacaaaaatccaccctcgtagatgc

SEQ ID NO: 117268 - DNA, 40 bp, Artificial Sequence
  Description of Artificial Sequence: Synthetic oligonucleotide
aaaatgacatggacaaacaaaaatccaccctcgtagatgc

SEQ ID NO: 117269 - DNA, 39 bp, Artificial Sequence
  Description of Artificial Sequence: Synthetic oligonucleotide
aaatgacatggacaaacaaaaatccaccctcgtagatgc

SEQ ID NO: 117270 - DNA, 38 bp, Artificial Sequence
  Description of Artificial Sequence: Synthetic oligonucleotide
aatgacatggacaaacaaaaatccaccctcgtagatgc

SEQ ID NO: 117271 - DNA, 37 bp, Artificial Sequence
  Description of Artificial Sequence: Synthetic oligonucleotide
atgacatggacaaacaaaaatccaccctcgtagatgc

SEQ ID NO: 117272 - DNA, 36 bp, Artificial Sequence
  Description of Artificial Sequence: Synthetic oligonucleotide
tgacatggacaaacaaaaatccaccctcgtagatgc

SEQ ID NO: 117273 - DNA, 35 bp, Artificial Sequence
  Description of Artificial Sequence: Synthetic oligonucleotide
gacatggacaaacaaaaatccaccctcgtagatgc

SEQ ID NO: 117274 - DNA, 35 bp, Artificial Sequence
  Description of Artificial Sequence: Synthetic oligonucleotide
acatggacaaacaaaaatccaccctcgtagatgcc

SEQ ID NO: 117275 - DNA, 34 bp, Artificial Sequence
  Description of Artificial Sequence: Synthetic oligonucleotide
catggacaaacaaaaatccaccctcgtagatgcc

SEQ ID NO: 117276 - DNA, 34 bp, Artificial Sequence
  Description of Artificial Sequence: Synthetic oligonucleotide
atggacaaacaaaaatccaccctcgtagatgccc

SEQ ID NO: 117277 - DNA, 33 bp, Artificial Sequence
  Description of Artificial Sequence: Synthetic oligonucleotide
tggacaaacaaaaatccaccctcgtagatgccc

SEQ ID NO: 117278 - DNA, 32 bp, Artificial Sequence
  Description of Artificial Sequence: Synthetic oligonucleotide
ggacaaacaaaaatccaccctcgtagatgccc

SEQ ID NO: 117279 - DNA, 35 bp, Artificial Sequence
  Description of Artificial Sequence: Synthetic oligonucleotide
gacaaacaaaaatccaccctcgtagatgccctttg

SEQ ID NO: 117280 - DNA, 37 bp, Artificial Sequence
  Description of Artificial Sequence: Synthetic oligonucleotide
acaaacaaaaatccaccctcgtagatgccctttgtag

SEQ ID NO: 117281 - DNA, 36 bp, Artificial Sequence
  Description of Artificial Sequence: Synthetic oligonucleotide
caaacaaaaatccaccctcgtagatgccctttgtag

SEQ ID NO: 117282 - DNA, 36 bp, Artificial Sequence
  Description of Artificial Sequence: Synthetic oligonucleotide
aaacaaaaatccaccctcgtagatgccctttgtagg

SEQ ID NO: 117283 - DNA, 35 bp, Artificial Sequence
  Description of Artificial Sequence: Synthetic oligonucleotide
aacaaaaatccaccctcgtagatgccctttgtagg

SEQ ID NO: 117284 - DNA, 34 bp, Artificial Sequence
  Description of Artificial Sequence: Synthetic oligonucleotide
acaaaaatccaccctcgtagatgccctttgtagg

SEQ ID NO: 117285 - DNA, 33 bp, Artificial Sequence
  Description of Artificial Sequence: Synthetic oligonucleotide
caaaaatccaccctcgtagatgccctttgtagg

SEQ ID NO: 117286 - DNA, 36 bp, Artificial Sequence
  Description of Artificial Sequence: Synthetic oligonucleotide
aaaaatccaccctcgtagatgccctttgtaggaaag

SEQ ID NO: 117287 - DNA, 35 bp, Artificial Sequence
  Description of Artificial Sequence: Synthetic oligonucleotide
aaaatccaccctcgtagatgccctttgtaggaaag

SEQ ID NO: 117288 - DNA, 34 bp, Artificial Sequence
  Description of Artificial Sequence: Synthetic oligonucleotide
aaatccaccctcgtagatgccctttgtaggaaag

SEQ ID NO: 117289 - DNA, 33 bp, Artificial Sequence
  Description of Artificial Sequence: Synthetic oligonucleotide
aatccaccctcgtagatgccctttgtaggaaag

SEQ ID NO: 117290 - DNA, 32 bp, Artificial Sequence
  Description of Artificial Sequence: Synthetic oligonucleotide
atccaccctcgtagatgccctttgtaggaaag

SEQ ID NO: 117291 - DNA, 31 bp, Artificial Sequence
  Description of Artificial Sequence: Synthetic oligonucleotide
tccaccctcgtagatgccctttgtaggaaag

SEQ ID NO: 117292 - DNA, 30 bp, Artificial Sequence
  Description of Artificial Sequence: Synthetic oligonucleotide
ccaccctcgtagatgccctttgtaggaaag

SEQ ID NO: 117293 - DNA, 30 bp, Artificial Sequence
  Description of Artificial Sequence: Synthetic oligonucleotide
caccctcgtagatgccctttgtaggaaagg

SEQ ID NO: 117294 - DNA, 32 bp, Artificial Sequence
  Description of Artificial Sequence: Synthetic oligonucleotide
accctcgtagatgccctttgtaggaaaggttg

SEQ ID NO: 117295 - DNA, 31 bp, Artificial Sequence
  Description of Artificial Sequence: Synthetic oligonucleotide
ccctcgtagatgccctttgtaggaaaggttg

SEQ ID NO: 117296 - DNA, 32 bp, Artificial Sequence
  Description of Artificial Sequence: Synthetic oligonucleotide
cctcgtagatgccctttgtaggaaaggttgtg

SEQ ID NO: 117297 - DNA, 32 bp, Artificial Sequence
  Description of Artificial Sequence: Synthetic oligonucleotide
ctcgtagatgccctttgtaggaaaggttgtgc

SEQ ID NO: 117298 - DNA, 32 bp, Artificial Sequence
  Description of Artificial Sequence: Synthetic oligonucleotide
tcgtagatgccctttgtaggaaaggttgtgcc

SEQ ID NO: 117299 - DNA, 31 bp, Artificial Sequence
  Description of Artificial Sequence: Synthetic oligonucleotide
cgtagatgccctttgtaggaaaggttgtgcc

SEQ ID NO: 117300 - DNA, 31 bp, Artificial Sequence
  Description of Artificial Sequence: Synthetic oligonucleotide
gtagatgccctttgtaggaaaggttgtgccc

SEQ ID NO: 117301 - DNA, 32 bp, Artificial Sequence
  Description of Artificial Sequence: Synthetic oligonucleotide
tagatgccctttgtaggaaaggttgtgccctg

SEQ ID NO: 117302 - DNA, 31 bp, Artificial Sequence
  Description of Artificial Sequence: Synthetic oligonucleotide
agatgccctttgtaggaaaggttgtgccctg

SEQ ID NO: 117303 - DNA, 30 bp, Artificial Sequence
  Description of Artificial Sequence: Synthetic oligonucleotide
gatgccctttgtaggaaaggttgtgccctg

SEQ ID NO: 117304 - DNA, 30 bp, Artificial Sequence
  Description of Artificial Sequence: Synthetic oligonucleotide
atgccctttgtaggaaaggttgtgccctgg

SEQ ID NO: 117305 - DNA, 29 bp, Artificial Sequence
  Description of Artificial Sequence: Synthetic oligonucleotide
tgccctttgtaggaaaggttgtgccctgg

SEQ ID NO: 117306 - DNA, 28 bp, Artificial Sequence
  Description of Artificial Sequence: Synthetic oligonucleotide
gccctttgtaggaaaggttgtgccctgg

SEQ ID NO: 117307 - DNA, 28 bp, Artificial Sequence
  Description of Artificial Sequence: Synthetic oligonucleotide
ccctttgtaggaaaggttgtgccctggc

SEQ ID NO: 117308 - DNA, 29 bp, Artificial Sequence
  Description of Artificial Sequence: Synthetic oligonucleotide
cctttgtaggaaaggttgtgccctggcag

SEQ ID NO: 117309 - DNA, 30 bp, Artificial Sequence
  Description of Artificial Sequence: Synthetic oligonucleotide
ctttgtaggaaaggttgtgccctggcagac

SEQ ID NO: 117310 - DNA, 30 bp, Artificial Sequence
  Description of Artificial Sequence: Synthetic oligonucleotide
tttgtaggaaaggttgtgccctggcagacc

SEQ ID NO: 117311 - DNA, 29 bp, Artificial Sequence
  Description of Artificial Sequence: Synthetic oligonucleotide
ttgtaggaaaggttgtgccctggcagacc

SEQ ID NO: 117312 - DNA, 28 bp, Artificial Sequence
  Description of Artificial Sequence: Synthetic oligonucleotide
tgtaggaaaggttgtgccctggcagacc

SEQ ID NO: 117313 - DNA, 27 bp, Artificial Sequence
  Description of Artificial Sequence: Synthetic oligonucleotide
gtaggaaaggttgtgccctggcagacc

SEQ ID NO: 117314 - DNA, 29 bp, Artificial Sequence
  Description of Artificial Sequence: Synthetic oligonucleotide
taggaaaggttgtgccctggcagaccatc

SEQ ID NO: 117315 - DNA, 28 bp, Artificial Sequence
  Description of Artificial Sequence: Synthetic oligonucleotide
aggaaaggttgtgccctggcagaccatc

SEQ ID NO: 117316 - DNA, 27 bp, Artificial Sequence
  Description of Artificial Sequence: Synthetic oligonucleotide
ggaaaggttgtgccctggcagaccatc

SEQ ID NO: 117317 - DNA, 29 bp, Artificial Sequence
  Description of Artificial Sequence: Synthetic oligonucleotide
gaaaggttgtgccctggcagaccatcttc

SEQ ID NO: 117318 - DNA, 31 bp, Artificial Sequence
  Description of Artificial Sequence: Synthetic oligonucleotide
aaaggttgtgccctggcagaccatcttcttc

SEQ ID NO: 117319 - DNA, 30 bp, Artificial Sequence
  Description of Artificial Sequence: Synthetic oligonucleotide
aaggttgtgccctggcagaccatcttcttc

SEQ ID NO: 117320 - DNA, 29 bp, Artificial Sequence
  Description of Artificial Sequence: Synthetic oligonucleotide
aggttgtgccctggcagaccatcttcttc

SEQ ID NO: 117321 - DNA, 28 bp, Artificial Sequence
  Description of Artificial Sequence: Synthetic oligonucleotide
ggttgtgccctggcagaccatcttcttc

SEQ ID NO: 117322 - DNA, 29 bp, Artificial Sequence
  Description of Artificial Sequence: Synthetic oligonucleotide
gttgtgccctggcagaccatcttcttcac

SEQ ID NO: 117323 - DNA, 30 bp, Artificial Sequence
  Description of Artificial Sequence: Synthetic oligonucleotide
ttgtgccctggcagaccatcttcttcacac

SEQ ID NO: 117324 - DNA, 29 bp, Artificial Sequence
  Description of Artificial Sequence: Synthetic oligonucleotide
tgtgccctggcagaccatcttcttcacac

SEQ ID NO: 117325 - DNA, 28 bp, Artificial Sequence
  Description of Artificial Sequence: Synthetic oligonucleotide
gtgccctggcagaccatcttcttcacac

SEQ ID NO: 117326 - DNA, 28 bp, Artificial Sequence
  Description of Artificial Sequence: Synthetic oligonucleotide
tgccctggcagaccatcttcttcacacc

SEQ ID NO: 117327 - DNA, 27 bp, Artificial Sequence
  Description of Artificial Sequence: Synthetic oligonucleotide
gccctggcagaccatcttcttcacacc

SEQ ID NO: 117328 - DNA, 27 bp, Artificial Sequence
  Description of Artificial Sequence: Synthetic oligonucleotide
ccctggcagaccatcttcttcacaccc

SEQ ID NO: 117329 - DNA, 28 bp, Artificial Sequence
  Description of Artificial Sequence: Synthetic oligonucleotide
cctggcagaccatcttcttcacacccag

SEQ ID NO: 117330 - DNA, 28 bp, Artificial Sequence
  Description of Artificial Sequence: Synthetic oligonucleotide
ctggcagaccatcttcttcacacccagg

SEQ ID NO: 117331 - DNA, 28 bp, Artificial Sequence
  Description of Artificial Sequence: Synthetic oligonucleotide
tggcagaccatcttcttcacacccaggc

SEQ ID NO: 117332 - DNA, 27 bp, Artificial Sequence
  Description of Artificial Sequence: Synthetic oligonucleotide
ggcagaccatcttcttcacacccaggc

SEQ ID NO: 117333 - DNA, 28 bp, Artificial Sequence
  Description of Artificial Sequence: Synthetic oligonucleotide
gcagaccatcttcttcacacccaggctc

SEQ ID NO: 117334 - DNA, 30 bp, Artificial Sequence
  Description of Artificial Sequence: Synthetic oligonucleotide
cagaccatcttcttcacacccaggctcaag

SEQ ID NO: 117335 - DNA, 31 bp, Artificial Sequence
  Description of Artificial Sequence: Synthetic oligonucleotide
agaccatcttcttcacacccaggctcaagac

SEQ ID NO: 117336 - DNA, 30 bp, Artificial Sequence
  Description of Artificial Sequence: Synthetic oligonucleotide
gaccatcttcttcacacccaggctcaagac

SEQ ID NO: 117337 - DNA, 30 bp, Artificial Sequence
  Description of Artificial Sequence: Synthetic oligonucleotide
accatcttcttcacacccaggctcaagacg

SEQ ID NO: 117338 - DNA, 29 bp, Artificial Sequence
  Description of Artificial Sequence: Synthetic oligonucleotide
ccatcttcttcacacccaggctcaagacg

SEQ ID NO: 117339 - DNA, 29 bp, Artificial Sequence
  Description of Artificial Sequence: Synthetic oligonucleotide
catcttcttcacacccaggctcaagacgg

SEQ ID NO: 117340 - DNA, 30 bp, Artificial Sequence
  Description of Artificial Sequence: Synthetic oligonucleotide
atcttcttcacacccaggctcaagacggag

SEQ ID NO: 117341 - DNA, 29 bp, Artificial Sequence
  Description of Artificial Sequence: Synthetic oligonucleotide
tcttcttcacacccaggctcaagacggag

SEQ ID NO: 117342 - DNA, 28 bp, Artificial Sequence
  Description of Artificial Sequence: Synthetic oligonucleotide
cttcttcacacccaggctcaagacggag

SEQ ID NO: 117343 - DNA, 28 bp, Artificial Sequence
  Description of Artificial Sequence: Synthetic oligonucleotide
ttcttcacacccaggctcaagacggagc

SEQ ID NO: 117344 - DNA, 27 bp, Artificial Sequence
  Description of Artificial Sequence: Synthetic oligonucleotide
tcttcacacccaggctcaagacggagc

SEQ ID NO: 117345 - DNA, 26 bp, Artificial Sequence
  Description of Artificial Sequence: Synthetic oligonucleotide
cttcacacccaggctcaagacggagc

SEQ ID NO: 117346 - DNA, 27 bp, Artificial Sequence
  Description of Artificial Sequence: Synthetic oligonucleotide
ttcacacccaggctcaagacggagcca

SEQ ID NO: 117347 - DNA, 27 bp, Artificial Sequence
  Description of Artificial Sequence: Synthetic oligonucleotide
tcacacccaggctcaagacggagccat

SEQ ID NO: 117348 - DNA, 27 bp, Artificial Sequence
  Description of Artificial Sequence: Synthetic oligonucleotide
cacacccaggctcaagacggagccatt

SEQ ID NO: 117349 - DNA, 28 bp, Artificial Sequence
  Description of Artificial Sequence: Synthetic oligonucleotide
acacccaggctcaagacggagccatttc

SEQ ID NO: 117350 - DNA, 27 bp, Artificial Sequence
  Description of Artificial Sequence: Synthetic oligonucleotide
cacccaggctcaagacggagccatttc

SEQ ID NO: 117351 - DNA, 27 bp, Artificial Sequence
  Description of Artificial Sequence: Synthetic oligonucleotide
acccaggctcaagacggagccatttcc

SEQ ID NO: 117352 - DNA, 27 bp, Artificial Sequence
  Description of Artificial Sequence: Synthetic oligonucleotide
cccaggctcaagacggagccatttcca

SEQ ID NO: 117353 - DNA, 27 bp, Artificial Sequence
  Description of Artificial Sequence: Synthetic oligonucleotide
ccaggctcaagacggagccatttccac

SEQ ID NO: 117354 - DNA, 28 bp, Artificial Sequence
  Description of Artificial Sequence: Synthetic oligonucleotide
caggctcaagacggagccatttccactg

SEQ ID NO: 117355 - DNA, 30 bp, Artificial Sequence
  Description of Artificial Sequence: Synthetic oligonucleotide
aggctcaagacggagccatttccactgatg

SEQ ID NO: 117356 - DNA, 29 bp, Artificial Sequence
  Description of Artificial Sequence: Synthetic oligonucleotide
ggctcaagacggagccatttccactgatg

SEQ ID NO: 117357 - DNA, 29 bp, Artificial Sequence
  Description of Artificial Sequence: Synthetic oligonucleotide
gctcaagacggagccatttccactgatgc

SEQ ID NO: 117358 - DNA, 30 bp, Artificial Sequence
  Description of Artificial Sequence: Synthetic oligonucleotide
ctcaagacggagccatttccactgatgcag

SEQ ID NO: 117359 - DNA, 32 bp, Artificial Sequence
  Description of Artificial Sequence: Synthetic oligonucleotide
tcaagacggagccatttccactgatgcagaag

SEQ ID NO: 117360 - DNA, 31 bp, Artificial Sequence
  Description of Artificial Sequence: Synthetic oligonucleotide
caagacggagccatttccactgatgcagaag

SEQ ID NO: 117361 - DNA, 31 bp, Artificial Sequence
  Description of Artificial Sequence: Synthetic oligonucleotide
aagacggagccatttccactgatgcagaagg

SEQ ID NO: 117362 - DNA, 30 bp, Artificial Sequence
  Description of Artificial Sequence: Synthetic oligonucleotide
agacggagccatttccactgatgcagaagg

SEQ ID NO: 117363 - DNA, 29 bp, Artificial Sequence
  Description of Artificial Sequence: Synthetic oligonucleotide
gacggagccatttccactgatgcagaagg

SEQ ID NO: 117364 - DNA, 32 bp, Artificial Sequence
  Description of Artificial Sequence: Synthetic oligonucleotide
acggagccatttccactgatgcagaaggaaag

SEQ ID NO: 117365 - DNA, 31 bp, Artificial Sequence
  Description of Artificial Sequence: Synthetic oligonucleotide
cggagccatttccactgatgcagaaggaaag

SEQ ID NO: 117366 - DNA, 31 bp, Artificial Sequence
  Description of Artificial Sequence: Synthetic oligonucleotide
ggagccatttccactgatgcagaaggaaagg

SEQ ID NO: 117367 - DNA, 32 bp, Artificial Sequence
  Description of Artificial Sequence: Synthetic oligonucleotide
gagccatttccactgatgcagaaggaaaggag

SEQ ID NO: 117368 - DNA, 32 bp, Artificial Sequence
  Description of Artificial Sequence: Synthetic oligonucleotide
agccatttccactgatgcagaaggaaaggagg

SEQ ID NO: 117369 - DNA, 31 bp, Artificial Sequence
  Description of Artificial Sequence: Synthetic oligonucleotide
gccatttccactgatgcagaaggaaaggagg

SEQ ID NO: 117370 - DNA, 32 bp, Artificial Sequence
  Description of Artificial Sequence: Synthetic oligonucleotide
ccatttccactgatgcagaaggaaaggaggag

SEQ ID NO: 117371 - DNA, 32 bp, Artificial Sequence
  Description of Artificial Sequence: Synthetic oligonucleotide
catttccactgatgcagaaggaaaggaggagg

SEQ ID NO: 117372 - DNA, 34 bp, Artificial Sequence
  Description of Artificial Sequence: Synthetic oligonucleotide
atttccactgatgcagaaggaaaggaggaggaag

SEQ ID NO: 117373 - DNA, 33 bp, Artificial Sequence
  Description of Artificial Sequence: Synthetic oligonucleotide
tttccactgatgcagaaggaaaggaggaggaag

SEQ ID NO: 117374 - DNA, 32 bp, Artificial Sequence
  Description of Artificial Sequence: Synthetic oligonucleotide
ttccactgatgcagaaggaaaggaggaggaag

SEQ ID NO: 117375 - DNA, 31 bp, Artificial Sequence
  Description of Artificial Sequence: Synthetic oligonucleotide
tccactgatgcagaaggaaaggaggaggaag

SEQ ID NO: 117376 - DNA, 30 bp, Artificial Sequence
  Description of Artificial Sequence: Synthetic oligonucleotide
ccactgatgcagaaggaaaggaggaggaag

SEQ ID NO: 117377 - DNA, 30 bp, Artificial Sequence
  Description of Artificial Sequence: Synthetic oligonucleotide
cactgatgcagaaggaaaggaggaggaagg

SEQ ID NO: 117378 - DNA, 31 bp, Artificial Sequence
  Description of Artificial Sequence: Synthetic oligonucleotide
actgatgcagaaggaaaggaggaggaaggag

SEQ ID NO: 117379 - DNA, 30 bp, Artificial Sequence
  Description of Artificial Sequence: Synthetic oligonucleotide
ctgatgcagaaggaaaggaggaggaaggag

SEQ ID NO: 117380 - DNA, 33 bp, Artificial Sequence
  Description of Artificial Sequence: Synthetic oligonucleotide
tgatgcagaaggaaaggaggaggaaggagaaag

SEQ ID NO: 117381 - DNA, 32 bp, Artificial Sequence
  Description of Artificial Sequence: Synthetic oligonucleotide
gatgcagaaggaaaggaggaggaaggagaaag

SEQ ID NO: 117382 - DNA, 33 bp, Artificial Sequence
  Description of Artificial Sequence: Synthetic oligonucleotide
atgcagaaggaaaggaggaggaaggagaaagtc

SEQ ID NO: 117383 - DNA, 32 bp, Artificial Sequence
  Description of Artificial Sequence: Synthetic oligonucleotide
tgcagaaggaaaggaggaggaaggagaaagtc

SEQ ID NO: 117384 - DNA, 31 bp, Artificial Sequence
  Description of Artificial Sequence: Synthetic oligonucleotide
gcagaaggaaaggaggaggaaggagaaagtc

SEQ ID NO: 117385 - DNA, 31 bp, Artificial Sequence
  Description of Artificial Sequence: Synthetic oligonucleotide
cagaaggaaaggaggaggaaggagaaagtcc

SEQ ID NO: 117386 - DNA, 34 bp, Artificial Sequence
  Description of Artificial Sequence: Synthetic oligonucleotide
agaaggaaaggaggaggaaggagaaagtcctttg

SEQ ID NO: 117387 - DNA, 33 bp, Artificial Sequence
  Description of Artificial Sequence: Synthetic oligonucleotide
gaaggaaaggaggaggaaggagaaagtcctttg

SEQ ID NO: 117388 - DNA, 33 bp, Artificial Sequence
  Description of Artificial Sequence: Synthetic oligonucleotide
aaggaaaggaggaggaaggagaaagtcctttgg

SEQ ID NO: 117389 - DNA, 32 bp, Artificial Sequence
  Description of Artificial Sequence: Synthetic oligonucleotide
aggaaaggaggaggaaggagaaagtcctttgg

SEQ ID NO: 117390 - DNA, 31 bp, Artificial Sequence
  Description of Artificial Sequence: Synthetic oligonucleotide
ggaaaggaggaggaaggagaaagtcctttgg

SEQ ID NO: 117391 - DNA, 34 bp, Artificial Sequence
  Description of Artificial Sequence: Synthetic oligonucleotide
gaaaggaggaggaaggagaaagtcctttggattc

SEQ ID NO: 117392 - DNA, 35 bp, Artificial Sequence
  Description of Artificial Sequence: Synthetic oligonucleotide
aaaggaggaggaaggagaaagtcctttggattctc

SEQ ID NO: 117393 - DNA, 34 bp, Artificial Sequence
  Description of Artificial Sequence: Synthetic oligonucleotide
aaggaggaggaaggagaaagtcctttggattctc

SEQ ID NO: 117394 - DNA, 33 bp, Artificial Sequence
  Description of Artificial Sequence: Synthetic oligonucleotide
aggaggaggaaggagaaagtcctttggattctc

SEQ ID NO: 117395 - DNA, 32 bp, Artificial Sequence
  Description of Artificial Sequence: Synthetic oligonucleotide
ggaggaggaaggagaaagtcctttggattctc

SEQ ID NO: 117396 - DNA, 33 bp, Artificial Sequence
  Description of Artificial Sequence: Synthetic oligonucleotide
gaggaggaaggagaaagtcctttggattctctg

SEQ ID NO: 117397 - DNA, 33 bp, Artificial Sequence
  Description of Artificial Sequence: Synthetic oligonucleotide
aggaggaaggagaaagtcctttggattctctgg

SEQ ID NO: 117398 - DNA, 32 bp, Artificial Sequence
  Description of Artificial Sequence: Synthetic oligonucleotide
ggaggaaggagaaagtcctttggattctctgg

SEQ ID NO: 117399 - DNA, 32 bp, Artificial Sequence
  Description of Artificial Sequence: Synthetic oligonucleotide
gaggaaggagaaagtcctttggattctctggc

SEQ ID NO: 117400 - DNA, 33 bp, Artificial Sequence
  Description of Artificial Sequence: Synthetic oligonucleotide
aggaaggagaaagtcctttggattctctggcag

SEQ ID NO: 117401 - DNA, 32 bp, Artificial Sequence
  Description of Artificial Sequence: Synthetic oligonucleotide
ggaaggagaaagtcctttggattctctggcag

SEQ ID NO: 117402 - DNA, 35 bp, Artificial Sequence
  Description of Artificial Sequence: Synthetic oligonucleotide
gaaggagaaagtcctttggattctctggcagaaac

SEQ ID NO: 117403 - DNA, 40 bp, Artificial Sequence
  Description of Artificial Sequence: Synthetic oligonucleotide
aaggagaaagtcctttggattctctggcagaaacattttg

SEQ ID NO: 117404 - DNA, 39 bp, Artificial Sequence
  Description of Artificial Sequence: Synthetic oligonucleotide
aggagaaagtcctttggattctctggcagaaacattttg

SEQ ID NO: 117405 - DNA, 38 bp, Artificial Sequence
  Description of Artificial Sequence: Synthetic oligonucleotide
ggagaaagtcctttggattctctggcagaaacattttg

SEQ ID NO: 117406 - DNA, 38 bp, Artificial Sequence
  Description of Artificial Sequence: Synthetic oligonucleotide
gagaaagtcctttggattctctggcagaaacattttgg

SEQ ID NO: 117407 - DNA, 38 bp, Artificial Sequence
  Description of Artificial Sequence: Synthetic oligonucleotide
agaaagtcctttggattctctggcagaaacattttggg

SEQ ID NO: 117408 - DNA, 37 bp, Artificial Sequence
  Description of Artificial Sequence: Synthetic oligonucleotide
gaaagtcctttggattctctggcagaaacattttggg

SEQ ID NO: 117409 - DNA, 40 bp, Artificial Sequence
  Description of Artificial Sequence: Synthetic oligonucleotide
aaagtcctttggattctctggcagaaacattttgggaaac

SEQ ID NO: 117410 - DNA, 39 bp, Artificial Sequence
  Description of Artificial Sequence: Synthetic oligonucleotide
aagtcctttggattctctggcagaaacattttgggaaac

SEQ ID NO: 117411 - DNA, 38 bp, Artificial Sequence
  Description of Artificial Sequence: Synthetic oligonucleotide
agtcctttggattctctggcagaaacattttgggaaac

SEQ ID NO: 117412 - DNA, 37 bp, Artificial Sequence
  Description of Artificial Sequence: Synthetic oligonucleotide
gtcctttggattctctggcagaaacattttgggaaac

SEQ ID NO: 117413 - DNA, 39 bp, Artificial Sequence
  Description of Artificial Sequence: Synthetic oligonucleotide
tcctttggattctctggcagaaacattttgggaaactac

SEQ ID NO: 117414 - DNA, 38 bp, Artificial Sequence
  Description of Artificial Sequence: Synthetic oligonucleotide
cctttggattctctggcagaaacattttgggaaactac

SEQ ID NO: 117415 - DNA, 43 bp, Artificial Sequence
  Description of Artificial Sequence: Synthetic oligonucleotide
ctttggattctctggcagaaacattttgggaaactactaaatg

SEQ ID NO: 117416 - DNA, 43 bp, Artificial Sequence
  Description of Artificial Sequence: Synthetic oligonucleotide
tttggattctctggcagaaacattttgggaaactactaaatgg

SEQ ID NO: 117417 - DNA, 42 bp, Artificial Sequence
  Description of Artificial Sequence: Synthetic oligonucleotide
ttggattctctggcagaaacattttgggaaactactaaatgg

SEQ ID NO: 117418 - DNA, 41 bp, Artificial Sequence
  Description of Artificial Sequence: Synthetic oligonucleotide
tggattctctggcagaaacattttgggaaactactaaatgg

SEQ ID NO: 117419 - DNA, 40 bp, Artificial Sequence
  Description of Artificial Sequence: Synthetic oligonucleotide
ggattctctggcagaaacattttgggaaactactaaatgg

SEQ ID NO: 117420 - DNA, 41 bp, Artificial Sequence
  Description of Artificial Sequence: Synthetic oligonucleotide
gattctctggcagaaacattttgggaaactactaaatggac

SEQ ID NO: 117421 - DNA, 42 bp, Artificial Sequence
  Description of Artificial Sequence: Synthetic oligonucleotide
attctctggcagaaacattttgggaaactactaaatggactg

SEQ ID NO: 117422 - DNA, 41 bp, Artificial Sequence
  Description of Artificial Sequence: Synthetic oligonucleotide
ttctctggcagaaacattttgggaaactactaaatggactg

SEQ ID NO: 117423 - DNA, 40 bp, Artificial Sequence
  Description of Artificial Sequence: Synthetic oligonucleotide
tctctggcagaaacattttgggaaactactaaatggactg

SEQ ID NO: 117424 - DNA, 39 bp, Artificial Sequence
  Description of Artificial Sequence: Synthetic oligonucleotide
ctctggcagaaacattttgggaaactactaaatggactg

SEQ ID NO: 117425 - DNA, 41 bp, Artificial Sequence
  Description of Artificial Sequence: Synthetic oligonucleotide
tctggcagaaacattttgggaaactactaaatggactgatc

SEQ ID NO: 117426 - DNA, 40 bp, Artificial Sequence
  Description of Artificial Sequence: Synthetic oligonucleotide
ctggcagaaacattttgggaaactactaaatggactgatc

SEQ ID NO: 117427 - DNA, 41 bp, Artificial Sequence
  Description of Artificial Sequence: Synthetic oligonucleotide
tggcagaaacattttgggaaactactaaatggactgatctc

SEQ ID NO: 117428 - DNA, 40 bp, Artificial Sequence
  Description of Artificial Sequence: Synthetic oligonucleotide
ggcagaaacattttgggaaactactaaatggactgatctc

SEQ ID NO: 117429 - DNA, 43 bp, Artificial Sequence
  Description of Artificial Sequence: Synthetic oligonucleotide
gcagaaacattttgggaaactactaaatggactgatctctttg

SEQ ID NO: 117430 - DNA, 44 bp, Artificial Sequence
  Description of Artificial Sequence: Synthetic oligonucleotide
cagaaacattttgggaaactactaaatggactgatctctttgac

SEQ ID NO: 117431 - DNA, 49 bp, Artificial Sequence
  Description of Artificial Sequence: Synthetic oligonucleotide
agaaacattttgggaaactactaaatggactgatctctttgacaataag

SEQ ID NO: 117432 - DNA, 48 bp, Artificial Sequence
  Description of Artificial Sequence: Synthetic oligonucleotide
gaaacattttgggaaactactaaatggactgatctctttgacaataag

SEQ ID NO: 117433 - DNA, 48 bp, Artificial Sequence
  Description of Artificial Sequence: Synthetic oligonucleotide
aaacattttgggaaactactaaatggactgatctctttgacaataagg

SEQ ID NO: 117434 - DNA, 47 bp, Artificial Sequence
  Description of Artificial Sequence: Synthetic oligonucleotide
aacattttgggaaactactaaatggactgatctctttgacaataagg

SEQ ID NO: 117435 - DNA, 46 bp, Artificial Sequence
  Description of Artificial Sequence: Synthetic oligonucleotide
acattttgggaaactactaaatggactgatctctttgacaataagg

SEQ ID NO: 117436 - DNA, 45 bp, Artificial Sequence
  Description of Artificial Sequence: Synthetic oligonucleotide
cattttgggaaactactaaatggactgatctctttgacaataagg

SEQ ID NO: 117437 - DNA, 49 bp, Artificial Sequence
  Description of Artificial Sequence: Synthetic oligonucleotide
attttgggaaactactaaatggactgatctctttgacaataaggttttg

SEQ ID NO: 117438 - DNA, 48 bp, Artificial Sequence
  Description of Artificial Sequence: Synthetic oligonucleotide
ttttgggaaactactaaatggactgatctctttgacaataaggttttg

SEQ ID NO: 117439 - DNA, 47 bp, Artificial Sequence
  Description of Artificial Sequence: Synthetic oligonucleotide
tttgggaaactactaaatggactgatctctttgacaataaggttttg

SEQ ID NO: 117440 - DNA, 46 bp, Artificial Sequence
  Description of Artificial Sequence: Synthetic oligonucleotide
ttgggaaactactaaatggactgatctctttgacaataaggttttg

SEQ ID NO: 117441 - DNA, 45 bp, Artificial Sequence
  Description of Artificial Sequence: Synthetic oligonucleotide
tgggaaactactaaatggactgatctctttgacaataaggttttg

SEQ ID NO: 117442 - DNA, 44 bp, Artificial Sequence
  Description of Artificial Sequence: Synthetic oligonucleotide
gggaaactactaaatggactgatctctttgacaataaggttttg

SEQ ID NO: 117443 - DNA, 45 bp, Artificial Sequence
  Description of Artificial Sequence: Synthetic oligonucleotide
ggaaactactaaatggactgatctctttgacaataaggttttgac

SEQ ID NO: 117444 - DNA, 49 bp, Artificial Sequence
  Description of Artificial Sequence: Synthetic oligonucleotide
gaaactactaaatggactgatctctttgacaataaggttttgacatttg

SEQ ID NO: 117445 - DNA, 49 bp, Artificial Sequence
  Description of Artificial Sequence: Synthetic oligonucleotide
aaactactaaatggactgatctctttgacaataaggttttgacatttgc

SEQ ID NO: 117446 - DNA, 48 bp, Artificial Sequence
  Description of Artificial Sequence: Synthetic oligonucleotide
aactactaaatggactgatctctttgacaataaggttttgacatttgc

SEQ ID NO: 117447 - DNA, 47 bp, Artificial Sequence
  Description of Artificial Sequence: Synthetic oligonucleotide
actactaaatggactgatctctttgacaataaggttttgacatttgc

SEQ ID NO: 117448 - DNA, 46 bp, Artificial Sequence
  Description of Artificial Sequence: Synthetic oligonucleotide
ctactaaatggactgatctctttgacaataaggttttgacatttgc

SEQ ID NO: 117449 - DNA, 53 bp, Artificial Sequence
  Description of Artificial Sequence: Synthetic oligonucleotide
tactaaatggactgatctctttgacaataaggttttgacatttgcatataaac

SEQ ID NO: 117450 - DNA, 52 bp, Artificial Sequence
  Description of Artificial Sequence: Synthetic oligonucleotide
actaaatggactgatctctttgacaataaggttttgacatttgcatataaac

SEQ ID NO: 117451 - DNA, 51 bp, Artificial Sequence
  Description of Artificial Sequence: Synthetic oligonucleotide
ctaaatggactgatctctttgacaataaggttttgacatttgcatataaac

SEQ ID NO: 117452 - DNA, 53 bp, Artificial Sequence
  Description of Artificial Sequence: Synthetic oligonucleotide
taaatggactgatctctttgacaataaggttttgacatttgcatataaacatg

SEQ ID NO: 117453 - DNA, 52 bp, Artificial Sequence
  Description of Artificial Sequence: Synthetic oligonucleotide
aaatggactgatctctttgacaataaggttttgacatttgcatataaacatg

SEQ ID NO: 117454 - DNA, 51 bp, Artificial Sequence
  Description of Artificial Sequence: Synthetic oligonucleotide
aatggactgatctctttgacaataaggttttgacatttgcatataaacatg

SEQ ID NO: 117455 - DNA, 50 bp, Artificial Sequence
  Description of Artificial Sequence: Synthetic oligonucleotide
atggactgatctctttgacaataaggttttgacatttgcatataaacatg

SEQ ID NO: 117456 - DNA, 49 bp, Artificial Sequence
  Description of Artificial Sequence: Synthetic oligonucleotide
tggactgatctctttgacaataaggttttgacatttgcatataaacatg

SEQ ID NO: 117457 - DNA, 48 bp, Artificial Sequence
  Description of Artificial Sequence: Synthetic oligonucleotide
ggactgatctctttgacaataaggttttgacatttgcatataaacatg

SEQ ID NO: 117458 - DNA, 48 bp, Artificial Sequence
  Description of Artificial Sequence: Synthetic oligonucleotide
gactgatctctttgacaataaggttttgacatttgcatataaacatgc

SEQ ID NO: 117459 - DNA, 52 bp, Artificial Sequence
  Description of Artificial Sequence: Synthetic oligonucleotide
actgatctctttgacaataaggttttgacatttgcatataaacatgcattag

SEQ ID NO: 117460 - DNA, 51 bp, Artificial Sequence
  Description of Artificial Sequence: Synthetic oligonucleotide
ctgatctctttgacaataaggttttgacatttgcatataaacatgcattag

SEQ ID NO: 117461 - DNA, 60 bp, Artificial Sequence
  Description of Artificial Sequence: Synthetic oligonucleotide
tgatctctttgacaataaggttttgacatttgcatataaacatgcattagtaaataaaat

SEQ ID NO: 117462 - DNA, 60 bp, Artificial Sequence
  Description of Artificial Sequence: Synthetic oligonucleotide
gatctctttgacaataaggttttgacatttgcatataaacatgcattagtaaataaaatg

SEQ ID NO: 117463 - DNA, 60 bp, Artificial Sequence
  Description of Artificial Sequence: Synthetic oligonucleotide
atctctttgacaataaggttttgacatttgcatataaacatgcattagtaaataaaatgt

SEQ ID NO: 117464 - DNA, 60 bp, Artificial Sequence
  Description of Artificial Sequence: Synthetic oligonucleotide
tctctttgacaataaggttttgacatttgcatataaacatgcattagtaaataaaatgta

SEQ ID NO: 117465 - DNA, 60 bp, Artificial Sequence
  Description of Artificial Sequence: Synthetic oligonucleotide
ctctttgacaataaggttttgacatttgcatataaacatgcattagtaaataaaatgtat

SEQ ID NO: 117466 - DNA, 60 bp, Artificial Sequence
  Description of Artificial Sequence: Synthetic oligonucleotide
tctttgacaataaggttttgacatttgcatataaacatgcattagtaaataaaatgtatg

SEQ ID NO: 117467 - DNA, 60 bp, Artificial Sequence
  Description of Artificial Sequence: Synthetic oligonucleotide
ctttgacaataaggttttgacatttgcatataaacatgcattagtaaataaaatgtatgg

SEQ ID NO: 117468 - DNA, 60 bp, Artificial Sequence
  Description of Artificial Sequence: Synthetic oligonucleotide
tttgacaataaggttttgacatttgcatataaacatgcattagtaaataaaatgtatggg

SEQ ID NO: 117469 - DNA, 59 bp, Artificial Sequence
  Description of Artificial Sequence: Synthetic oligonucleotide
ttgacaataaggttttgacatttgcatataaacatgcattagtaaataaaatgtatggg

SEQ ID NO: 117470 - DNA, 58 bp, Artificial Sequence
  Description of Artificial Sequence: Synthetic oligonucleotide
tgacaataaggttttgacatttgcatataaacatgcattagtaaataaaatgtatggg

SEQ ID NO: 117471 - DNA, 57 bp, Artificial Sequence
  Description of Artificial Sequence: Synthetic oligonucleotide
gacaataaggttttgacatttgcatataaacatgcattagtaaataaaatgtatggg

SEQ ID NO: 117472 - DNA, 58 bp, Artificial Sequence
  Description of Artificial Sequence: Synthetic oligonucleotide
acaataaggttttgacatttgcatataaacatgcattagtaaataaaatgtatgggag

SEQ ID NO: 117473 - DNA, 57 bp, Artificial Sequence
  Description of Artificial Sequence: Synthetic oligonucleotide
caataaggttttgacatttgcatataaacatgcattagtaaataaaatgtatgggag

SEQ ID NO: 117474 - DNA, 58 bp, Artificial Sequence
  Description of Artificial Sequence: Synthetic oligonucleotide
aataaggttttgacatttgcatataaacatgcattagtaaataaaatgtatgggagag

SEQ ID NO: 117475 - DNA, 57 bp, Artificial Sequence
  Description of Artificial Sequence: Synthetic oligonucleotide
ataaggttttgacatttgcatataaacatgcattagtaaataaaatgtatgggagag

SEQ ID NO: 117476 - DNA, 56 bp, Artificial Sequence
  Description of Artificial Sequence: Synthetic oligonucleotide
taaggttttgacatttgcatataaacatgcattagtaaataaaatgtatgggagag

SEQ ID NO: 117477 - DNA, 55 bp, Artificial Sequence
  Description of Artificial Sequence: Synthetic oligonucleotide
aaggttttgacatttgcatataaacatgcattagtaaataaaatgtatgggagag

SEQ ID NO: 117478 - DNA, 54 bp, Artificial Sequence
  Description of Artificial Sequence: Synthetic oligonucleotide
aggttttgacatttgcatataaacatgcattagtaaataaaatgtatgggagag

SEQ ID NO: 117479 - DNA, 53 bp, Artificial Sequence
  Description of Artificial Sequence: Synthetic oligonucleotide
ggttttgacatttgcatataaacatgcattagtaaataaaatgtatgggagag

SEQ ID NO: 117480 - DNA, 53 bp, Artificial Sequence
  Description of Artificial Sequence: Synthetic oligonucleotide
gttttgacatttgcatataaacatgcattagtaaataaaatgtatgggagagg

SEQ ID NO: 117481 - DNA, 53 bp, Artificial Sequence
  Description of Artificial Sequence: Synthetic oligonucleotide
ttttgacatttgcatataaacatgcattagtaaataaaatgtatgggagaggc

SEQ ID NO: 117482 - DNA, 52 bp, Artificial Sequence
  Description of Artificial Sequence: Synthetic oligonucleotide
tttgacatttgcatataaacatgcattagtaaataaaatgtatgggagaggc

SEQ ID NO: 117483 - DNA, 51 bp, Artificial Sequence
  Description of Artificial Sequence: Synthetic oligonucleotide
ttgacatttgcatataaacatgcattagtaaataaaatgtatgggagaggc

SEQ ID NO: 117484 - DNA, 50 bp, Artificial Sequence
  Description of Artificial Sequence: Synthetic oligonucleotide
tgacatttgcatataaacatgcattagtaaataaaatgtatgggagaggc

SEQ ID NO: 117485 - DNA, 49 bp, Artificial Sequence
  Description of Artificial Sequence: Synthetic oligonucleotide
gacatttgcatataaacatgcattagtaaataaaatgtatgggagaggc

SEQ ID NO: 117486 - DNA, 49 bp, Artificial Sequence
  Description of Artificial Sequence: Synthetic oligonucleotide
acatttgcatataaacatgcattagtaaataaaatgtatgggagaggcc

SEQ ID NO: 117487 - DNA, 48 bp, Artificial Sequence
  Description of Artificial Sequence: Synthetic oligonucleotide
catttgcatataaacatgcattagtaaataaaatgtatgggagaggcc

SEQ ID NO: 117488 - DNA, 56 bp, Artificial Sequence
  Description of Artificial Sequence: Synthetic oligonucleotide
atttgcatataaacatgcattagtaaataaaatgtatgggagaggccttaaatttg

SEQ ID NO: 117489 - DNA, 55 bp, Artificial Sequence
  Description of Artificial Sequence: Synthetic oligonucleotide
tttgcatataaacatgcattagtaaataaaatgtatgggagaggccttaaatttg

SEQ ID NO: 117490 - DNA, 54 bp, Artificial Sequence
  Description of Artificial Sequence: Synthetic oligonucleotide
ttgcatataaacatgcattagtaaataaaatgtatgggagaggccttaaatttg

SEQ ID NO: 117491 - DNA, 53 bp, Artificial Sequence
  Description of Artificial Sequence: Synthetic oligonucleotide
tgcatataaacatgcattagtaaataaaatgtatgggagaggccttaaatttg

SEQ ID NO: 117492 - DNA, 52 bp, Artificial Sequence
  Description of Artificial Sequence: Synthetic oligonucleotide
gcatataaacatgcattagtaaataaaatgtatgggagaggccttaaatttg

SEQ ID NO: 117493 - DNA, 52 bp, Artificial Sequence
  Description of Artificial Sequence: Synthetic oligonucleotide
catataaacatgcattagtaaataaaatgtatgggagaggccttaaatttgc

SEQ ID NO: 117494 - DNA, 54 bp, Artificial Sequence
  Description of Artificial Sequence: Synthetic oligonucleotide
atataaacatgcattagtaaataaaatgtatgggagaggccttaaatttgcaac

SEQ ID NO: 117495 - DNA, 53 bp, Artificial Sequence
  Description of Artificial Sequence: Synthetic oligonucleotide
tataaacatgcattagtaaataaaatgtatgggagaggccttaaatttgcaac

SEQ ID NO: 117496 - DNA, 52 bp, Artificial Sequence
  Description of Artificial Sequence: Synthetic oligonucleotide
ataaacatgcattagtaaataaaatgtatgggagaggccttaaatttgcaac

SEQ ID NO: 117497 - DNA, 51 bp, Artificial Sequence
  Description of Artificial Sequence: Synthetic oligonucleotide
taaacatgcattagtaaataaaatgtatgggagaggccttaaatttgcaac

SEQ ID NO: 117498 - DNA, 50 bp, Artificial Sequence
  Description of Artificial Sequence: Synthetic oligonucleotide
aaacatgcattagtaaataaaatgtatgggagaggccttaaatttgcaac

SEQ ID NO: 117499 - DNA, 49 bp, Artificial Sequence
  Description of Artificial Sequence: Synthetic oligonucleotide
aacatgcattagtaaataaaatgtatgggagaggccttaaatttgcaac

SEQ ID NO: 117500 - DNA, 48 bp, Artificial Sequence
  Description of Artificial Sequence: Synthetic oligonucleotide
acatgcattagtaaataaaatgtatgggagaggccttaaatttgcaac

SEQ ID NO: 117501 - DNA, 47 bp, Artificial Sequence
  Description of Artificial Sequence: Synthetic oligonucleotide
catgcattagtaaataaaatgtatgggagaggccttaaatttgcaac

SEQ ID NO: 117502 - DNA, 51 bp, Artificial Sequence
  Description of Artificial Sequence: Synthetic oligonucleotide
atgcattagtaaataaaatgtatgggagaggccttaaatttgcaactaaac

SEQ ID NO: 117503 - DNA, 50 bp, Artificial Sequence
  Description of Artificial Sequence: Synthetic oligonucleotide
tgcattagtaaataaaatgtatgggagaggccttaaatttgcaactaaac

SEQ ID NO: 117504 - DNA, 49 bp, Artificial Sequence
  Description of Artificial Sequence: Synthetic oligonucleotide
gcattagtaaataaaatgtatgggagaggccttaaatttgcaactaaac

SEQ ID NO: 117505 - DNA, 51 bp, Artificial Sequence
  Description of Artificial Sequence: Synthetic oligonucleotide
cattagtaaataaaatgtatgggagaggccttaaatttgcaactaaacttg

SEQ ID NO: 117506 - DNA, 52 bp, Artificial Sequence
  Description of Artificial Sequence: Synthetic oligonucleotide
attagtaaataaaatgtatgggagaggccttaaatttgcaactaaacttgtg

SEQ ID NO: 117507 - DNA, 51 bp, Artificial Sequence
  Description of Artificial Sequence: Synthetic oligonucleotide
ttagtaaataaaatgtatgggagaggccttaaatttgcaactaaacttgtg

SEQ ID NO: 117508 - DNA, 50 bp, Artificial Sequence
  Description of Artificial Sequence: Synthetic oligonucleotide
tagtaaataaaatgtatgggagaggccttaaatttgcaactaaacttgtg

SEQ ID NO: 117509 - DNA, 49 bp, Artificial Sequence
  Description of Artificial Sequence: Synthetic oligonucleotide
agtaaataaaatgtatgggagaggccttaaatttgcaactaaacttgtg

SEQ ID NO: 117510 - DNA, 48 bp, Artificial Sequence
  Description of Artificial Sequence: Synthetic oligonucleotide
gtaaataaaatgtatgggagaggccttaaatttgcaactaaacttgtg

SEQ ID NO: 117511 - DNA, 48 bp, Artificial Sequence
  Description of Artificial Sequence: Synthetic oligonucleotide
taaataaaatgtatgggagaggccttaaatttgcaactaaacttgtgg

SEQ ID NO: 117512 - DNA, 47 bp, Artificial Sequence
  Description of Artificial Sequence: Synthetic oligonucleotide
aaataaaatgtatgggagaggccttaaatttgcaactaaacttgtgg

SEQ ID NO: 117513 - DNA, 46 bp, Artificial Sequence
  Description of Artificial Sequence: Synthetic oligonucleotide
aataaaatgtatgggagaggccttaaatttgcaactaaacttgtgg

SEQ ID NO: 117514 - DNA, 45 bp, Artificial Sequence
  Description of Artificial Sequence: Synthetic oligonucleotide
ataaaatgtatgggagaggccttaaatttgcaactaaacttgtgg

SEQ ID NO: 117515 - DNA, 44 bp, Artificial Sequence
  Description of Artificial Sequence: Synthetic oligonucleotide
taaaatgtatgggagaggccttaaatttgcaactaaacttgtgg

SEQ ID NO: 117516 - DNA, 43 bp, Artificial Sequence
  Description of Artificial Sequence: Synthetic oligonucleotide
aaaatgtatgggagaggccttaaatttgcaactaaacttgtgg

SEQ ID NO: 117517 - DNA, 42 bp, Artificial Sequence
  Description of Artificial Sequence: Synthetic oligonucleotide
aaatgtatgggagaggccttaaatttgcaactaaacttgtgg

SEQ ID NO: 117518 - DNA, 41 bp, Artificial Sequence
  Description of Artificial Sequence: Synthetic oligonucleotide
aatgtatgggagaggccttaaatttgcaactaaacttgtgg

SEQ ID NO: 117519 - DNA, 40 bp, Artificial Sequence
  Description of Artificial Sequence: Synthetic oligonucleotide
atgtatgggagaggccttaaatttgcaactaaacttgtgg

SEQ ID NO: 117520 - DNA, 39 bp, Artificial Sequence
  Description of Artificial Sequence: Synthetic oligonucleotide
tgtatgggagaggccttaaatttgcaactaaacttgtgg

SEQ ID NO: 117521 - DNA, 38 bp, Artificial Sequence
  Description of Artificial Sequence: Synthetic oligonucleotide
gtatgggagaggccttaaatttgcaactaaacttgtgg

SEQ ID NO: 117522 - DNA, 40 bp, Artificial Sequence
  Description of Artificial Sequence: Synthetic oligonucleotide
tatgggagaggccttaaatttgcaactaaacttgtggaag

SEQ ID NO: 117523 - DNA, 39 bp, Artificial Sequence
  Description of Artificial Sequence: Synthetic oligonucleotide
atgggagaggccttaaatttgcaactaaacttgtggaag

SEQ ID NO: 117524 - DNA, 38 bp, Artificial Sequence
  Description of Artificial Sequence: Synthetic oligonucleotide
tgggagaggccttaaatttgcaactaaacttgtggaag

SEQ ID NO: 117525 - DNA, 37 bp, Artificial Sequence
  Description of Artificial Sequence: Synthetic oligonucleotide
gggagaggccttaaatttgcaactaaacttgtggaag

SEQ ID NO: 117526 - DNA, 42 bp, Artificial Sequence
  Description of Artificial Sequence: Synthetic oligonucleotide
ggagaggccttaaatttgcaactaaacttgtggaagaaaaac

SEQ ID NO: 117527 - DNA, 42 bp, Artificial Sequence
  Description of Artificial Sequence: Synthetic oligonucleotide
gagaggccttaaatttgcaactaaacttgtggaagaaaaacc

SEQ ID NO: 117528 - DNA, 44 bp, Artificial Sequence
  Description of Artificial Sequence: Synthetic oligonucleotide
agaggccttaaatttgcaactaaacttgtggaagaaaaaccaac

SEQ ID NO: 117529 - DNA, 43 bp, Artificial Sequence
  Description of Artificial Sequence: Synthetic oligonucleotide
gaggccttaaatttgcaactaaacttgtggaagaaaaaccaac

SEQ ID NO: 117530 - DNA, 47 bp, Artificial Sequence
  Description of Artificial Sequence: Synthetic oligonucleotide
aggccttaaatttgcaactaaacttgtggaagaaaaaccaacaaaag

SEQ ID NO: 117531 - DNA, 46 bp, Artificial Sequence
  Description of Artificial Sequence: Synthetic oligonucleotide
ggccttaaatttgcaactaaacttgtggaagaaaaaccaacaaaag

SEQ ID NO: 117532 - DNA, 50 bp, Artificial Sequence
  Description of Artificial Sequence: Synthetic oligonucleotide
gccttaaatttgcaactaaacttgtggaagaaaaaccaacaaaagaaaac

SEQ ID NO: 117533 - DNA, 51 bp, Artificial Sequence
  Description of Artificial Sequence: Synthetic oligonucleotide
ccttaaatttgcaactaaacttgtggaagaaaaaccaacaaaagaaaactg

SEQ ID NO: 117534 - DNA, 51 bp, Artificial Sequence
  Description of Artificial Sequence: Synthetic oligonucleotide
cttaaatttgcaactaaacttgtggaagaaaaaccaacaaaagaaaactgg

SEQ ID NO: 117535 - DNA, 58 bp, Artificial Sequence
  Description of Artificial Sequence: Synthetic oligonucleotide
ttaaatttgcaactaaacttgtggaagaaaaaccaacaaaagaaaactggaaaaattg

SEQ ID NO: 117536 - DNA, 57 bp, Artificial Sequence
  Description of Artificial Sequence: Synthetic oligonucleotide
taaatttgcaactaaacttgtggaagaaaaaccaacaaaagaaaactggaaaaattg

SEQ ID NO: 117537 - DNA, 56 bp, Artificial Sequence
  Description of Artificial Sequence: Synthetic oligonucleotide
aaatttgcaactaaacttgtggaagaaaaaccaacaaaagaaaactggaaaaattg

SEQ ID NO: 117538 - DNA, 55 bp, Artificial Sequence
  Description of Artificial Sequence: Synthetic oligonucleotide
aatttgcaactaaacttgtggaagaaaaaccaacaaaagaaaactggaaaaattg

SEQ ID NO: 117539 - DNA, 54 bp, Artificial Sequence
  Description of Artificial Sequence: Synthetic oligonucleotide
atttgcaactaaacttgtggaagaaaaaccaacaaaagaaaactggaaaaattg

SEQ ID NO: 117540 - DNA, 53 bp, Artificial Sequence
  Description of Artificial Sequence: Synthetic oligonucleotide
tttgcaactaaacttgtggaagaaaaaccaacaaaagaaaactggaaaaattg

SEQ ID NO: 117541 - DNA, 52 bp, Artificial Sequence
  Description of Artificial Sequence: Synthetic oligonucleotide
ttgcaactaaacttgtggaagaaaaaccaacaaaagaaaactggaaaaattg

SEQ ID NO: 117542 - DNA, 51 bp, Artificial Sequence
  Description of Artificial Sequence: Synthetic oligonucleotide
tgcaactaaacttgtggaagaaaaaccaacaaaagaaaactggaaaaattg

SEQ ID NO: 117543 - DNA, 50 bp, Artificial Sequence
  Description of Artificial Sequence: Synthetic oligonucleotide
gcaactaaacttgtggaagaaaaaccaacaaaagaaaactggaaaaattg

SEQ ID NO: 117544 - DNA, 54 bp, Artificial Sequence
  Description of Artificial Sequence: Synthetic oligonucleotide
caactaaacttgtggaagaaaaaccaacaaaagaaaactggaaaaattgtattc

SEQ ID NO: 117545 - DNA, 56 bp, Artificial Sequence
  Description of Artificial Sequence: Synthetic oligonucleotide
aactaaacttgtggaagaaaaaccaacaaaagaaaactggaaaaattgtattcaac

SEQ ID NO: 117546 - DNA, 55 bp, Artificial Sequence
  Description of Artificial Sequence: Synthetic oligonucleotide
actaaacttgtggaagaaaaaccaacaaaagaaaactggaaaaattgtattcaac

SEQ ID NO: 117547 - DNA, 54 bp, Artificial Sequence
  Description of Artificial Sequence: Synthetic oligonucleotide
ctaaacttgtggaagaaaaaccaacaaaagaaaactggaaaaattgtattcaac

SEQ ID NO: 117548 - DNA, 55 bp, Artificial Sequence
  Description of Artificial Sequence: Synthetic oligonucleotide
taaacttgtggaagaaaaaccaacaaaagaaaactggaaaaattgtattcaactg

SEQ ID NO: 117549 - DNA, 54 bp, Artificial Sequence
  Description of Artificial Sequence: Synthetic oligonucleotide
aaacttgtggaagaaaaaccaacaaaagaaaactggaaaaattgtattcaactg

SEQ ID NO: 117550 - DNA, 53 bp, Artificial Sequence
  Description of Artificial Sequence: Synthetic oligonucleotide
aacttgtggaagaaaaaccaacaaaagaaaactggaaaaattgtattcaactg

SEQ ID NO: 117551 - DNA, 52 bp, Artificial Sequence
  Description of Artificial Sequence: Synthetic oligonucleotide
acttgtggaagaaaaaccaacaaaagaaaactggaaaaattgtattcaactg

SEQ ID NO: 117552 - DNA, 51 bp, Artificial Sequence
  Description of Artificial Sequence: Synthetic oligonucleotide
cttgtggaagaaaaaccaacaaaagaaaactggaaaaattgtattcaactg

SEQ ID NO: 117553 - DNA, 53 bp, Artificial Sequence
  Description of Artificial Sequence: Synthetic oligonucleotide
ttgtggaagaaaaaccaacaaaagaaaactggaaaaattgtattcaactgatg

SEQ ID NO: 117554 - DNA, 52 bp, Artificial Sequence
  Description of Artificial Sequence: Synthetic oligonucleotide
tgtggaagaaaaaccaacaaaagaaaactggaaaaattgtattcaactgatg

SEQ ID NO: 117555 - DNA, 51 bp, Artificial Sequence
  Description of Artificial Sequence: Synthetic oligonucleotide
gtggaagaaaaaccaacaaaagaaaactggaaaaattgtattcaactgatg

SEQ ID NO: 117556 - DNA, 53 bp, Artificial Sequence
  Description of Artificial Sequence: Synthetic oligonucleotide
tggaagaaaaaccaacaaaagaaaactggaaaaattgtattcaactgatgaag

SEQ ID NO: 117557 - DNA, 52 bp, Artificial Sequence
  Description of Artificial Sequence: Synthetic oligonucleotide
ggaagaaaaaccaacaaaagaaaactggaaaaattgtattcaactgatgaag

SEQ ID NO: 117558 - DNA, 55 bp, Artificial Sequence
  Description of Artificial Sequence: Synthetic oligonucleotide
gaagaaaaaccaacaaaagaaaactggaaaaattgtattcaactgatgaagttac

SEQ ID NO: 117559 - DNA, 57 bp, Artificial Sequence
  Description of Artificial Sequence: Synthetic oligonucleotide
aagaaaaaccaacaaaagaaaactggaaaaattgtattcaactgatgaagttacttg

SEQ ID NO: 117560 - DNA, 56 bp, Artificial Sequence
  Description of Artificial Sequence: Synthetic oligonucleotide
agaaaaaccaacaaaagaaaactggaaaaattgtattcaactgatgaagttacttg

SEQ ID NO: 117561 - DNA, 55 bp, Artificial Sequence
  Description of Artificial Sequence: Synthetic oligonucleotide
gaaaaaccaacaaaagaaaactggaaaaattgtattcaactgatgaagttacttg

SEQ ID NO: 117562 - DNA, 55 bp, Artificial Sequence
  Description of Artificial Sequence: Synthetic oligonucleotide
aaaaaccaacaaaagaaaactggaaaaattgtattcaactgatgaagttacttgg

SEQ ID NO: 117563 - DNA, 54 bp, Artificial Sequence
  Description of Artificial Sequence: Synthetic oligonucleotide
aaaaccaacaaaagaaaactggaaaaattgtattcaactgatgaagttacttgg

SEQ ID NO: 117564 - DNA, 53 bp, Artificial Sequence
  Description of Artificial Sequence: Synthetic oligonucleotide
aaaccaacaaaagaaaactggaaaaattgtattcaactgatgaagttacttgg

SEQ ID NO: 117565 - DNA, 52 bp, Artificial Sequence
  Description of Artificial Sequence: Synthetic oligonucleotide
aaccaacaaaagaaaactggaaaaattgtattcaactgatgaagttacttgg

SEQ ID NO: 117566 - DNA, 51 bp, Artificial Sequence
  Description of Artificial Sequence: Synthetic oligonucleotide
accaacaaaagaaaactggaaaaattgtattcaactgatgaagttacttgg

SEQ ID NO: 117567 - DNA, 50 bp, Artificial Sequence
  Description of Artificial Sequence: Synthetic oligonucleotide
ccaacaaaagaaaactggaaaaattgtattcaactgatgaagttacttgg

SEQ ID NO: 117568 - DNA, 52 bp, Artificial Sequence
  Description of Artificial Sequence: Synthetic oligonucleotide
caacaaaagaaaactggaaaaattgtattcaactgatgaagttacttggatg

SEQ ID NO: 117569 - DNA, 52 bp, Artificial Sequence
  Description of Artificial Sequence: Synthetic oligonucleotide
aacaaaagaaaactggaaaaattgtattcaactgatgaagttacttggatgg

SEQ ID NO: 117570 - DNA, 51 bp, Artificial Sequence
  Description of Artificial Sequence: Synthetic oligonucleotide
acaaaagaaaactggaaaaattgtattcaactgatgaagttacttggatgg

SEQ ID NO: 117571 - DNA, 50 bp, Artificial Sequence
  Description of Artificial Sequence: Synthetic oligonucleotide
caaaagaaaactggaaaaattgtattcaactgatgaagttacttggatgg

SEQ ID NO: 117572 - DNA, 51 bp, Artificial Sequence
  Description of Artificial Sequence: Synthetic oligonucleotide
aaaagaaaactggaaaaattgtattcaactgatgaagttacttggatggac

SEQ ID NO: 117573 - DNA, 50 bp, Artificial Sequence
  Description of Artificial Sequence: Synthetic oligonucleotide
aaagaaaactggaaaaattgtattcaactgatgaagttacttggatggac

SEQ ID NO: 117574 - DNA, 49 bp, Artificial Sequence
  Description of Artificial Sequence: Synthetic oligonucleotide
aagaaaactggaaaaattgtattcaactgatgaagttacttggatggac

SEQ ID NO: 117575 - DNA, 48 bp, Artificial Sequence
  Description of Artificial Sequence: Synthetic oligonucleotide
agaaaactggaaaaattgtattcaactgatgaagttacttggatggac

SEQ ID NO: 117576 - DNA, 47 bp, Artificial Sequence
  Description of Artificial Sequence: Synthetic oligonucleotide
gaaaactggaaaaattgtattcaactgatgaagttacttggatggac

SEQ ID NO: 117577 - DNA, 47 bp, Artificial Sequence
  Description of Artificial Sequence: Synthetic oligonucleotide
aaaactggaaaaattgtattcaactgatgaagttacttggatggacc

SEQ ID NO: 117578 - DNA, 46 bp, Artificial Sequence
  Description of Artificial Sequence: Synthetic oligonucleotide
aaactggaaaaattgtattcaactgatgaagttacttggatggacc

SEQ ID NO: 117579 - DNA, 45 bp, Artificial Sequence
  Description of Artificial Sequence: Synthetic oligonucleotide
aactggaaaaattgtattcaactgatgaagttacttggatggacc

SEQ ID NO: 117580 - DNA, 44 bp, Artificial Sequence
  Description of Artificial Sequence: Synthetic oligonucleotide
actggaaaaattgtattcaactgatgaagttacttggatggacc

SEQ ID NO: 117581 - DNA, 43 bp, Artificial Sequence
  Description of Artificial Sequence: Synthetic oligonucleotide
ctggaaaaattgtattcaactgatgaagttacttggatggacc

SEQ ID NO: 117582 - DNA, 43 bp, Artificial Sequence
  Description of Artificial Sequence: Synthetic oligonucleotide
tggaaaaattgtattcaactgatgaagttacttggatggaccc

SEQ ID NO: 117583 - DNA, 42 bp, Artificial Sequence
  Description of Artificial Sequence: Synthetic oligonucleotide
ggaaaaattgtattcaactgatgaagttacttggatggaccc

SEQ ID NO: 117584 - DNA, 45 bp, Artificial Sequence
  Description of Artificial Sequence: Synthetic oligonucleotide
gaaaaattgtattcaactgatgaagttacttggatggacccattg

SEQ ID NO: 117585 - DNA, 46 bp, Artificial Sequence
  Description of Artificial Sequence: Synthetic oligonucleotide
aaaaattgtattcaactgatgaagttacttggatggacccattgtg

SEQ ID NO: 117586 - DNA, 45 bp, Artificial Sequence
  Description of Artificial Sequence: Synthetic oligonucleotide
aaaattgtattcaactgatgaagttacttggatggacccattgtg

SEQ ID NO: 117587 - DNA, 44 bp, Artificial Sequence
  Description of Artificial Sequence: Synthetic oligonucleotide
aaattgtattcaactgatgaagttacttggatggacccattgtg

SEQ ID NO: 117588 - DNA, 43 bp, Artificial Sequence
  Description of Artificial Sequence: Synthetic oligonucleotide
aattgtattcaactgatgaagttacttggatggacccattgtg

SEQ ID NO: 117589 - DNA, 42 bp, Artificial Sequence
  Description of Artificial Sequence: Synthetic oligonucleotide
attgtattcaactgatgaagttacttggatggacccattgtg

SEQ ID NO: 117590 - DNA, 41 bp, Artificial Sequence
  Description of Artificial Sequence: Synthetic oligonucleotide
ttgtattcaactgatgaagttacttggatggacccattgtg

SEQ ID NO: 117591 - DNA, 40 bp, Artificial Sequence
  Description of Artificial Sequence: Synthetic oligonucleotide
tgtattcaactgatgaagttacttggatggacccattgtg

SEQ ID NO: 117592 - DNA, 39 bp, Artificial Sequence
  Description of Artificial Sequence: Synthetic oligonucleotide
gtattcaactgatgaagttacttggatggacccattgtg

SEQ ID NO: 117593 - DNA, 39 bp, Artificial Sequence
  Description of Artificial Sequence: Synthetic oligonucleotide
tattcaactgatgaagttacttggatggacccattgtgc

SEQ ID NO: 117594 - DNA, 38 bp, Artificial Sequence
  Description of Artificial Sequence: Synthetic oligonucleotide
attcaactgatgaagttacttggatggacccattgtgc

SEQ ID NO: 117595 - DNA, 37 bp, Artificial Sequence
  Description of Artificial Sequence: Synthetic oligonucleotide
ttcaactgatgaagttacttggatggacccattgtgc

SEQ ID NO: 117596 - DNA, 36 bp, Artificial Sequence
  Description of Artificial Sequence: Synthetic oligonucleotide
tcaactgatgaagttacttggatggacccattgtgc

SEQ ID NO: 117597 - DNA, 35 bp, Artificial Sequence
  Description of Artificial Sequence: Synthetic oligonucleotide
caactgatgaagttacttggatggacccattgtgc

SEQ ID NO: 117598 - DNA, 37 bp, Artificial Sequence
  Description of Artificial Sequence: Synthetic oligonucleotide
aactgatgaagttacttggatggacccattgtgcatc

SEQ ID NO: 117599 - DNA, 36 bp, Artificial Sequence
  Description of Artificial Sequence: Synthetic oligonucleotide
actgatgaagttacttggatggacccattgtgcatc

SEQ ID NO: 117600 - DNA, 35 bp, Artificial Sequence
  Description of Artificial Sequence: Synthetic oligonucleotide
ctgatgaagttacttggatggacccattgtgcatc

SEQ ID NO: 117601 - DNA, 40 bp, Artificial Sequence
  Description of Artificial Sequence: Synthetic oligonucleotide
tgatgaagttacttggatggacccattgtgcatcttttac

SEQ ID NO: 117602 - DNA, 39 bp, Artificial Sequence
  Description of Artificial Sequence: Synthetic oligonucleotide
gatgaagttacttggatggacccattgtgcatcttttac

SEQ ID NO: 117603 - DNA, 40 bp, Artificial Sequence
  Description of Artificial Sequence: Synthetic oligonucleotide
atgaagttacttggatggacccattgtgcatcttttactg

SEQ ID NO: 117604 - DNA, 39 bp, Artificial Sequence
  Description of Artificial Sequence: Synthetic oligonucleotide
tgaagttacttggatggacccattgtgcatcttttactg

SEQ ID NO: 117605 - DNA, 38 bp, Artificial Sequence
  Description of Artificial Sequence: Synthetic oligonucleotide
gaagttacttggatggacccattgtgcatcttttactg

SEQ ID NO: 117606 - DNA, 42 bp, Artificial Sequence
  Description of Artificial Sequence: Synthetic oligonucleotide
aagttacttggatggacccattgtgcatcttttactgaaaac

SEQ ID NO: 117607 - DNA, 41 bp, Artificial Sequence
  Description of Artificial Sequence: Synthetic oligonucleotide
agttacttggatggacccattgtgcatcttttactgaaaac

SEQ ID NO: 117608 - DNA, 40 bp, Artificial Sequence
  Description of Artificial Sequence: Synthetic oligonucleotide
gttacttggatggacccattgtgcatcttttactgaaaac

SEQ ID NO: 117609 - DNA, 41 bp, Artificial Sequence
  Description of Artificial Sequence: Synthetic oligonucleotide
ttacttggatggacccattgtgcatcttttactgaaaactg

SEQ ID NO: 117610 - DNA, 40 bp, Artificial Sequence
  Description of Artificial Sequence: Synthetic oligonucleotide
tacttggatggacccattgtgcatcttttactgaaaactg

SEQ ID NO: 117611 - DNA, 39 bp, Artificial Sequence
  Description of Artificial Sequence: Synthetic oligonucleotide
acttggatggacccattgtgcatcttttactgaaaactg

SEQ ID NO: 117612 - DNA, 38 bp, Artificial Sequence
  Description of Artificial Sequence: Synthetic oligonucleotide
cttggatggacccattgtgcatcttttactgaaaactg

SEQ ID NO: 117613 - DNA, 38 bp, Artificial Sequence
  Description of Artificial Sequence: Synthetic oligonucleotide
ttggatggacccattgtgcatcttttactgaaaactgg

SEQ ID NO: 117614 - DNA, 37 bp, Artificial Sequence
  Description of Artificial Sequence: Synthetic oligonucleotide
tggatggacccattgtgcatcttttactgaaaactgg

SEQ ID NO: 117615 - DNA, 36 bp, Artificial Sequence
  Description of Artificial Sequence: Synthetic oligonucleotide
ggatggacccattgtgcatcttttactgaaaactgg

SEQ ID NO: 117616 - DNA, 36 bp, Artificial Sequence
  Description of Artificial Sequence: Synthetic oligonucleotide
gatggacccattgtgcatcttttactgaaaactggc

SEQ ID NO: 117617 - DNA, 37 bp, Artificial Sequence
  Description of Artificial Sequence: Synthetic oligonucleotide
atggacccattgtgcatcttttactgaaaactggctc

SEQ ID NO: 117618 - DNA, 36 bp, Artificial Sequence
  Description of Artificial Sequence: Synthetic oligonucleotide
tggacccattgtgcatcttttactgaaaactggctc

SEQ ID NO: 117619 - DNA, 35 bp, Artificial Sequence
  Description of Artificial Sequence: Synthetic oligonucleotide
ggacccattgtgcatcttttactgaaaactggctc

SEQ ID NO: 117620 - DNA, 35 bp, Artificial Sequence
  Description of Artificial Sequence: Synthetic oligonucleotide
gacccattgtgcatcttttactgaaaactggctcc

SEQ ID NO: 117621 - DNA, 35 bp, Artificial Sequence
  Description of Artificial Sequence: Synthetic oligonucleotide
acccattgtgcatcttttactgaaaactggctccc

SEQ ID NO: 117622 - DNA, 34 bp, Artificial Sequence
  Description of Artificial Sequence: Synthetic oligonucleotide
cccattgtgcatcttttactgaaaactggctccc

SEQ ID NO: 117623 - DNA, 34 bp, Artificial Sequence
  Description of Artificial Sequence: Synthetic oligonucleotide
ccattgtgcatcttttactgaaaactggctcccc

SEQ ID NO: 117624 - DNA, 36 bp, Artificial Sequence
  Description of Artificial Sequence: Synthetic oligonucleotide
cattgtgcatcttttactgaaaactggctccccatc

SEQ ID NO: 117625 - DNA, 38 bp, Artificial Sequence
  Description of Artificial Sequence: Synthetic oligonucleotide
attgtgcatcttttactgaaaactggctccccatcatg

SEQ ID NO: 117626 - DNA, 37 bp, Artificial Sequence
  Description of Artificial Sequence: Synthetic oligonucleotide
ttgtgcatcttttactgaaaactggctccccatcatg

SEQ ID NO: 117627 - DNA, 36 bp, Artificial Sequence
  Description of Artificial Sequence: Synthetic oligonucleotide
tgtgcatcttttactgaaaactggctccccatcatg

SEQ ID NO: 117628 - DNA, 35 bp, Artificial Sequence
  Description of Artificial Sequence: Synthetic oligonucleotide
gtgcatcttttactgaaaactggctccccatcatg

SEQ ID NO: 117629 - DNA, 38 bp, Artificial Sequence
  Description of Artificial Sequence: Synthetic oligonucleotide
tgcatcttttactgaaaactggctccccatcatgtatc

SEQ ID NO: 117630 - DNA, 37 bp, Artificial Sequence
  Description of Artificial Sequence: Synthetic oligonucleotide
gcatcttttactgaaaactggctccccatcatgtatc

SEQ ID NO: 117631 - DNA, 37 bp, Artificial Sequence
  Description of Artificial Sequence: Synthetic oligonucleotide
catcttttactgaaaactggctccccatcatgtatcc

SEQ ID NO: 117632 - DNA, 38 bp, Artificial Sequence
  Description of Artificial Sequence: Synthetic oligonucleotide
atcttttactgaaaactggctccccatcatgtatcctc

SEQ ID NO: 117633 - DNA, 37 bp, Artificial Sequence
  Description of Artificial Sequence: Synthetic oligonucleotide
tcttttactgaaaactggctccccatcatgtatcctc

SEQ ID NO: 117634 - DNA, 36 bp, Artificial Sequence
  Description of Artificial Sequence: Synthetic oligonucleotide
cttttactgaaaactggctccccatcatgtatcctc

SEQ ID NO: 117635 - DNA, 36 bp, Artificial Sequence
  Description of Artificial Sequence: Synthetic oligonucleotide
ttttactgaaaactggctccccatcatgtatcctcc

SEQ ID NO: 117636 - DNA, 35 bp, Artificial Sequence
  Description of Artificial Sequence: Synthetic oligonucleotide
tttactgaaaactggctccccatcatgtatcctcc

SEQ ID NO: 117637 - DNA, 34 bp, Artificial Sequence
  Description of Artificial Sequence: Synthetic oligonucleotide
ttactgaaaactggctccccatcatgtatcctcc

SEQ ID NO: 117638 - DNA, 33 bp, Artificial Sequence
  Description of Artificial Sequence: Synthetic oligonucleotide
tactgaaaactggctccccatcatgtatcctcc

SEQ ID NO: 117639 - DNA, 32 bp, Artificial Sequence
  Description of Artificial Sequence: Synthetic oligonucleotide
actgaaaactggctccccatcatgtatcctcc

SEQ ID NO: 117640 - DNA, 31 bp, Artificial Sequence
  Description of Artificial Sequence: Synthetic oligonucleotide
ctgaaaactggctccccatcatgtatcctcc

SEQ ID NO: 117641 - DNA, 31 bp, Artificial Sequence
  Description of Artificial Sequence: Synthetic oligonucleotide
tgaaaactggctccccatcatgtatcctccc

SEQ ID NO: 117642 - DNA, 30 bp, Artificial Sequence
  Description of Artificial Sequence: Synthetic oligonucleotide
gaaaactggctccccatcatgtatcctccc

SEQ ID NO: 117643 - DNA, 30 bp, Artificial Sequence
  Description of Artificial Sequence: Synthetic oligonucleotide
aaaactggctccccatcatgtatcctcccg

SEQ ID NO: 117644 - DNA, 29 bp, Artificial Sequence
  Description of Artificial Sequence: Synthetic oligonucleotide
aaactggctccccatcatgtatcctcccg

SEQ ID NO: 117645 - DNA, 28 bp, Artificial Sequence
  Description of Artificial Sequence: Synthetic oligonucleotide
aactggctccccatcatgtatcctcccg

SEQ ID NO: 117646 - DNA, 27 bp, Artificial Sequence
  Description of Artificial Sequence: Synthetic oligonucleotide
actggctccccatcatgtatcctcccg

SEQ ID NO: 117647 - DNA, 27 bp, Artificial Sequence
  Description of Artificial Sequence: Synthetic oligonucleotide
ctggctccccatcatgtatcctcccga

SEQ ID NO: 117648 - DNA, 32 bp, Artificial Sequence
  Description of Artificial Sequence: Synthetic oligonucleotide
tggctccccatcatgtatcctcccgattattg

SEQ ID NO: 117649 - DNA, 31 bp, Artificial Sequence
  Description of Artificial Sequence: Synthetic oligonucleotide
ggctccccatcatgtatcctcccgattattg

SEQ ID NO: 117650 - DNA, 31 bp, Artificial Sequence
  Description of Artificial Sequence: Synthetic oligonucleotide
gctccccatcatgtatcctcccgattattgc

SEQ ID NO: 117651 - DNA, 31 bp, Artificial Sequence
  Description of Artificial Sequence: Synthetic oligonucleotide
ctccccatcatgtatcctcccgattattgcg

SEQ ID NO: 117652 - DNA, 35 bp, Artificial Sequence
  Description of Artificial Sequence: Synthetic oligonucleotide
tccccatcatgtatcctcccgattattgcgtattc

SEQ ID NO: 117653 - DNA, 34 bp, Artificial Sequence
  Description of Artificial Sequence: Synthetic oligonucleotide
ccccatcatgtatcctcccgattattgcgtattc

SEQ ID NO: 117654 - DNA, 30 bp, Artificial Sequence
  Description of Artificial Sequence: Synthetic oligonucleotide
atgagcagctcgggactgaattcggagaag

SEQ ID NO: 117655 - DNA, 29 bp, Artificial Sequence
  Description of Artificial Sequence: Synthetic oligonucleotide
tgagcagctcgggactgaattcggagaag

SEQ ID NO: 117656 - DNA, 28 bp, Artificial Sequence
  Description of Artificial Sequence: Synthetic oligonucleotide
gagcagctcgggactgaattcggagaag

SEQ ID NO: 117657 - DNA, 28 bp, Artificial Sequence
  Description of Artificial Sequence: Synthetic oligonucleotide
agcagctcgggactgaattcggagaagg

SEQ ID NO: 117658 - DNA, 27 bp, Artificial Sequence
  Description of Artificial Sequence: Synthetic oligonucleotide
gcagctcgggactgaattcggagaagg

SEQ ID NO: 117659 - DNA, 29 bp, Artificial Sequence
  Description of Artificial Sequence: Synthetic oligonucleotide
cagctcgggactgaattcggagaaggtag

SEQ ID NO: 117660 - DNA, 29 bp, Artificial Sequence
  Description of Artificial Sequence: Synthetic oligonucleotide
agctcgggactgaattcggagaaggtagc

SEQ ID NO: 117661 - DNA, 28 bp, Artificial Sequence
  Description of Artificial Sequence: Synthetic oligonucleotide
gctcgggactgaattcggagaaggtagc

SEQ ID NO: 117662 - DNA, 29 bp, Artificial Sequence
  Description of Artificial Sequence: Synthetic oligonucleotide
ctcgggactgaattcggagaaggtagctg

SEQ ID NO: 117663 - DNA, 29 bp, Artificial Sequence
  Description of Artificial Sequence: Synthetic oligonucleotide
tcgggactgaattcggagaaggtagctgc

SEQ ID NO: 117664 - DNA, 28 bp, Artificial Sequence
  Description of Artificial Sequence: Synthetic oligonucleotide
cgggactgaattcggagaaggtagctgc

SEQ ID NO: 117665 - DNA, 29 bp, Artificial Sequence
  Description of Artificial Sequence: Synthetic oligonucleotide
gggactgaattcggagaaggtagctgctc

SEQ ID NO: 117666 - DNA, 30 bp, Artificial Sequence
  Description of Artificial Sequence: Synthetic oligonucleotide
ggactgaattcggagaaggtagctgctctg

SEQ ID NO: 117667 - DNA, 33 bp, Artificial Sequence
  Description of Artificial Sequence: Synthetic oligonucleotide
gactgaattcggagaaggtagctgctctgatac

SEQ ID NO: 117668 - DNA, 34 bp, Artificial Sequence
  Description of Artificial Sequence: Synthetic oligonucleotide
actgaattcggagaaggtagctgctctgatacag

SEQ ID NO: 117669 - DNA, 33 bp, Artificial Sequence
  Description of Artificial Sequence: Synthetic oligonucleotide
ctgaattcggagaaggtagctgctctgatacag

SEQ ID NO: 117670 - DNA, 36 bp, Artificial Sequence
  Description of Artificial Sequence: Synthetic oligonucleotide
tgaattcggagaaggtagctgctctgatacagaaac

SEQ ID NO: 117671 - DNA, 35 bp, Artificial Sequence
  Description of Artificial Sequence: Synthetic oligonucleotide
gaattcggagaaggtagctgctctgatacagaaac

SEQ ID NO: 117672 - DNA, 36 bp, Artificial Sequence
  Description of Artificial Sequence: Synthetic oligonucleotide
aattcggagaaggtagctgctctgatacagaaactg

SEQ ID NO: 117673 - DNA, 35 bp, Artificial Sequence
  Description of Artificial Sequence: Synthetic oligonucleotide
attcggagaaggtagctgctctgatacagaaactg

SEQ ID NO: 117674 - DNA, 34 bp, Artificial Sequence
  Description of Artificial Sequence: Synthetic oligonucleotide
ttcggagaaggtagctgctctgatacagaaactg

SEQ ID NO: 117675 - DNA, 33 bp, Artificial Sequence
  Description of Artificial Sequence: Synthetic oligonucleotide
tcggagaaggtagctgctctgatacagaaactg

SEQ ID NO: 117676 - DNA, 32 bp, Artificial Sequence
  Description of Artificial Sequence: Synthetic oligonucleotide
cggagaaggtagctgctctgatacagaaactg

SEQ ID NO: 117677 - DNA, 36 bp, Artificial Sequence
  Description of Artificial Sequence: Synthetic oligonucleotide
ggagaaggtagctgctctgatacagaaactgaattc

SEQ ID NO: 117678 - DNA, 36 bp, Artificial Sequence
  Description of Artificial Sequence: Synthetic oligonucleotide
gagaaggtagctgctctgatacagaaactgaattcc

SEQ ID NO: 117679 - DNA, 36 bp, Artificial Sequence
  Description of Artificial Sequence: Synthetic oligonucleotide
agaaggtagctgctctgatacagaaactgaattccg

SEQ ID NO: 117680 - DNA, 35 bp, Artificial Sequence
  Description of Artificial Sequence: Synthetic oligonucleotide
gaaggtagctgctctgatacagaaactgaattccg

SEQ ID NO: 117681 - DNA, 36 bp, Artificial Sequence
  Description of Artificial Sequence: Synthetic oligonucleotide
aaggtagctgctctgatacagaaactgaattccgac

SEQ ID NO: 117682 - DNA, 35 bp, Artificial Sequence
  Description of Artificial Sequence: Synthetic oligonucleotide
aggtagctgctctgatacagaaactgaattccgac

SEQ ID NO: 117683 - DNA, 34 bp, Artificial Sequence
  Description of Artificial Sequence: Synthetic oligonucleotide
ggtagctgctctgatacagaaactgaattccgac

SEQ ID NO: 117684 - DNA, 34 bp, Artificial Sequence
  Description of Artificial Sequence: Synthetic oligonucleotide
gtagctgctctgatacagaaactgaattccgacc

SEQ ID NO: 117685 - DNA, 34 bp, Artificial Sequence
  Description of Artificial Sequence: Synthetic oligonucleotide
tagctgctctgatacagaaactgaattccgaccc

SEQ ID NO: 117686 - DNA, 33 bp, Artificial Sequence
  Description of Artificial Sequence: Synthetic oligonucleotide
agctgctctgatacagaaactgaattccgaccc

SEQ ID NO: 117687 - DNA, 32 bp, Artificial Sequence
  Description of Artificial Sequence: Synthetic oligonucleotide
gctgctctgatacagaaactgaattccgaccc

SEQ ID NO: 117688 - DNA, 32 bp, Artificial Sequence
  Description of Artificial Sequence: Synthetic oligonucleotide
ctgctctgatacagaaactgaattccgacccc

SEQ ID NO: 117689 - DNA, 32 bp, Artificial Sequence
  Description of Artificial Sequence: Synthetic oligonucleotide
tgctctgatacagaaactgaattccgaccccc

SEQ ID NO: 117690 - DNA, 31 bp, Artificial Sequence
  Description of Artificial Sequence: Synthetic oligonucleotide
gctctgatacagaaactgaattccgaccccc

SEQ ID NO: 117691 - DNA, 32 bp, Artificial Sequence
  Description of Artificial Sequence: Synthetic oligonucleotide
ctctgatacagaaactgaattccgacccccag

SEQ ID NO: 117692 - DNA, 34 bp, Artificial Sequence
  Description of Artificial Sequence: Synthetic oligonucleotide
tctgatacagaaactgaattccgacccccagttc

SEQ ID NO: 117693 - DNA, 33 bp, Artificial Sequence
  Description of Artificial Sequence: Synthetic oligonucleotide
ctgatacagaaactgaattccgacccccagttc

SEQ ID NO: 117694 - DNA, 33 bp, Artificial Sequence
  Description of Artificial Sequence: Synthetic oligonucleotide
tgatacagaaactgaattccgacccccagttcg

SEQ ID NO: 117695 - DNA, 32 bp, Artificial Sequence
  Description of Artificial Sequence: Synthetic oligonucleotide
gatacagaaactgaattccgacccccagttcg

SEQ ID NO: 117696 - DNA, 34 bp, Artificial Sequence
  Description of Artificial Sequence: Synthetic oligonucleotide
atacagaaactgaattccgacccccagttcgtac

SEQ ID NO: 117697 - DNA, 33 bp, Artificial Sequence
  Description of Artificial Sequence: Synthetic oligonucleotide
tacagaaactgaattccgacccccagttcgtac

SEQ ID NO: 117698 - DNA, 32 bp, Artificial Sequence
  Description of Artificial Sequence: Synthetic oligonucleotide
acagaaactgaattccgacccccagttcgtac

SEQ ID NO: 117699 - DNA, 31 bp, Artificial Sequence
  Description of Artificial Sequence: Synthetic oligonucleotide
cagaaactgaattccgacccccagttcgtac

SEQ ID NO: 117700 - DNA, 33 bp, Artificial Sequence
  Description of Artificial Sequence: Synthetic oligonucleotide
agaaactgaattccgacccccagttcgtacttg

SEQ ID NO: 117701 - DNA, 32 bp, Artificial Sequence
  Description of Artificial Sequence: Synthetic oligonucleotide
gaaactgaattccgacccccagttcgtacttg

SEQ ID NO: 117702 - DNA, 32 bp, Artificial Sequence
  Description of Artificial Sequence: Synthetic oligonucleotide
aaactgaattccgacccccagttcgtacttgc

SEQ ID NO: 117703 - DNA, 31 bp, Artificial Sequence
  Description of Artificial Sequence: Synthetic oligonucleotide
aactgaattccgacccccagttcgtacttgc

SEQ ID NO: 117704 - DNA, 30 bp, Artificial Sequence
  Description of Artificial Sequence: Synthetic oligonucleotide
actgaattccgacccccagttcgtacttgc

SEQ ID NO: 117705 - DNA, 29 bp, Artificial Sequence
  Description of Artificial Sequence: Synthetic oligonucleotide
ctgaattccgacccccagttcgtacttgc

SEQ ID NO: 117706 - DNA, 29 bp, Artificial Sequence
  Description of Artificial Sequence: Synthetic oligonucleotide
tgaattccgacccccagttcgtacttgcc

SEQ ID NO: 117707 - DNA, 28 bp, Artificial Sequence
  Description of Artificial Sequence: Synthetic oligonucleotide
gaattccgacccccagttcgtacttgcc

SEQ ID NO: 117708 - DNA, 28 bp, Artificial Sequence
  Description of Artificial Sequence: Synthetic oligonucleotide
aattccgacccccagttcgtacttgccc

SEQ ID NO: 117709 - DNA, 27 bp, Artificial Sequence
  Description of Artificial Sequence: Synthetic oligonucleotide
attccgacccccagttcgtacttgccc

SEQ ID NO: 117710 - DNA, 27 bp, Artificial Sequence
  Description of Artificial Sequence: Synthetic oligonucleotide
ttccgacccccagttcgtacttgccca

SEQ ID NO: 117711 - DNA, 26 bp, Artificial Sequence
  Description of Artificial Sequence: Synthetic oligonucleotide
tccgacccccagttcgtacttgccca

SEQ ID NO: 117712 - DNA, 25 bp, Artificial Sequence
  Description of Artificial Sequence: Synthetic oligonucleotide
ccgacccccagttcgtacttgccca

SEQ ID NO: 117713 - DNA, 27 bp, Artificial Sequence
  Description of Artificial Sequence: Synthetic oligonucleotide
cgacccccagttcgtacttgcccagaa

SEQ ID NO: 117714 - DNA, 28 bp, Artificial Sequence
  Description of Artificial Sequence: Synthetic oligonucleotide
gacccccagttcgtacttgcccagaatg

SEQ ID NO: 117715 - DNA, 29 bp, Artificial Sequence
  Description of Artificial Sequence: Synthetic oligonucleotide
acccccagttcgtacttgcccagaatgtc

SEQ ID NO: 117716 - DNA, 28 bp, Artificial Sequence
  Description of Artificial Sequence: Synthetic oligonucleotide
cccccagttcgtacttgcccagaatgtc

SEQ ID NO: 117717 - DNA, 28 bp, Artificial Sequence
  Description of Artificial Sequence: Synthetic oligonucleotide
ccccagttcgtacttgcccagaatgtcg

SEQ ID NO: 117718 - DNA, 28 bp, Artificial Sequence
  Description of Artificial Sequence: Synthetic oligonucleotide
cccagttcgtacttgcccagaatgtcgg

SEQ ID NO: 117719 - DNA, 28 bp, Artificial Sequence
  Description of Artificial Sequence: Synthetic oligonucleotide
ccagttcgtacttgcccagaatgtcggg

SEQ ID NO: 117720 - DNA, 29 bp, Artificial Sequence
  Description of Artificial Sequence: Synthetic oligonucleotide
cagttcgtacttgcccagaatgtcgggac

SEQ ID NO: 117721 - DNA, 29 bp, Artificial Sequence
  Description of Artificial Sequence: Synthetic oligonucleotide
agttcgtacttgcccagaatgtcgggacc

SEQ ID NO: 117722 - DNA, 28 bp, Artificial Sequence
  Description of Artificial Sequence: Synthetic oligonucleotide
gttcgtacttgcccagaatgtcgggacc

SEQ ID NO: 117723 - DNA, 29 bp, Artificial Sequence
  Description of Artificial Sequence: Synthetic oligonucleotide
ttcgtacttgcccagaatgtcgggaccac

SEQ ID NO: 117724 - DNA, 28 bp, Artificial Sequence
  Description of Artificial Sequence: Synthetic oligonucleotide
tcgtacttgcccagaatgtcgggaccac

SEQ ID NO: 117725 - DNA, 27 bp, Artificial Sequence
  Description of Artificial Sequence: Synthetic oligonucleotide
cgtacttgcccagaatgtcgggaccac

SEQ ID NO: 117726 - DNA, 27 bp, Artificial Sequence
  Description of Artificial Sequence: Synthetic oligonucleotide
gtacttgcccagaatgtcgggaccacc

SEQ ID NO: 117727 - DNA, 27 bp, Artificial Sequence
  Description of Artificial Sequence: Synthetic oligonucleotide
tacttgcccagaatgtcgggaccaccc

SEQ ID NO: 117728 - DNA, 27 bp, Artificial Sequence
  Description of Artificial Sequence: Synthetic oligonucleotide
acttgcccagaatgtcgggaccaccca

SEQ ID NO: 117729 - DNA, 26 bp, Artificial Sequence
  Description of Artificial Sequence: Synthetic oligonucleotide
cttgcccagaatgtcgggaccaccca

SEQ ID NO: 117730 - DNA, 26 bp, Artificial Sequence
  Description of Artificial Sequence: Synthetic oligonucleotide
ttgcccagaatgtcgggaccacccac

SEQ ID NO: 117731 - DNA, 25 bp, Artificial Sequence
  Description of Artificial Sequence: Synthetic oligonucleotide
tgcccagaatgtcgggaccacccac

SEQ ID NO: 117732 - DNA, 24 bp, Artificial Sequence
  Description of Artificial Sequence: Synthetic oligonucleotide
gcccagaatgtcgggaccacccac

SEQ ID NO: 117733 - DNA, 25 bp, Artificial Sequence
  Description of Artificial Sequence: Synthetic oligonucleotide
cccagaatgtcgggaccacccacga

SEQ ID NO: 117734 - DNA, 25 bp, Artificial Sequence
  Description of Artificial Sequence: Synthetic oligonucleotide
ccagaatgtcgggaccacccacgac

SEQ ID NO: 117735 - DNA, 26 bp, Artificial Sequence
  Description of Artificial Sequence: Synthetic oligonucleotide
cagaatgtcgggaccacccacgacct

SEQ ID NO: 117736 - DNA, 26 bp, Artificial Sequence
  Description of Artificial Sequence: Synthetic oligonucleotide
agaatgtcgggaccacccacgacctg

SEQ ID NO: 117737 - DNA, 25 bp, Artificial Sequence
  Description of Artificial Sequence: Synthetic oligonucleotide
gaatgtcgggaccacccacgacctg

SEQ ID NO: 117738 - DNA, 26 bp, Artificial Sequence
  Description of Artificial Sequence: Synthetic oligonucleotide
aatgtcgggaccacccacgacctgct

SEQ ID NO: 117739 - DNA, 25 bp, Artificial Sequence
  Description of Artificial Sequence: Synthetic oligonucleotide
atgtcgggaccacccacgacctgct

SEQ ID NO: 117740 - DNA, 24 bp, Artificial Sequence
  Description of Artificial Sequence: Synthetic oligonucleotide
tgtcgggaccacccacgacctgct

SEQ ID NO: 117741 - DNA, 23 bp, Artificial Sequence
  Description of Artificial Sequence: Synthetic oligonucleotide
gtcgggaccacccacgacctgct

SEQ ID NO: 117742 - DNA, 23 bp, Artificial Sequence
  Description of Artificial Sequence: Synthetic oligonucleotide
tcgggaccacccacgacctgctg

SEQ ID NO: 117743 - DNA, 22 bp, Artificial Sequence
  Description of Artificial Sequence: Synthetic oligonucleotide
cgggaccacccacgacctgctg

SEQ ID NO: 117744 - DNA, 23 bp, Artificial Sequence
  Description of Artificial Sequence: Synthetic oligonucleotide
gggaccacccacgacctgctgga

SEQ ID NO: 117745 - DNA, 25 bp, Artificial Sequence
  Description of Artificial Sequence: Synthetic oligonucleotide
ggaccacccacgacctgctggacat

SEQ ID NO: 117746 - DNA, 26 bp, Artificial Sequence
  Description of Artificial Sequence: Synthetic oligonucleotide
gaccacccacgacctgctggacatct

SEQ ID NO: 117747 - DNA, 27 bp, Artificial Sequence
  Description of Artificial Sequence: Synthetic oligonucleotide
accacccacgacctgctggacatctgt

SEQ ID NO: 117748 - DNA, 26 bp, Artificial Sequence
  Description of Artificial Sequence: Synthetic oligonucleotide
ccacccacgacctgctggacatctgt

SEQ ID NO: 117749 - DNA, 27 bp, Artificial Sequence
  Description of Artificial Sequence: Synthetic oligonucleotide
cacccacgacctgctggacatctgtct

SEQ ID NO: 117750 - DNA, 27 bp, Artificial Sequence
  Description of Artificial Sequence: Synthetic oligonucleotide
acccacgacctgctggacatctgtctg

SEQ ID NO: 117751 - DNA, 27 bp, Artificial Sequence
  Description of Artificial Sequence: Synthetic oligonucleotide
cccacgacctgctggacatctgtctga

SEQ ID NO: 117752 - DNA, 28 bp, Artificial Sequence
  Description of Artificial Sequence: Synthetic oligonucleotide
ccacgacctgctggacatctgtctgaag

SEQ ID NO: 117753 - DNA, 28 bp, Artificial Sequence
  Description of Artificial Sequence: Synthetic oligonucleotide
cacgacctgctggacatctgtctgaagc

SEQ ID NO: 117754 - DNA, 28 bp, Artificial Sequence
  Description of Artificial Sequence: Synthetic oligonucleotide
acgacctgctggacatctgtctgaagcg

SEQ ID NO: 117755 - DNA, 27 bp, Artificial Sequence
  Description of Artificial Sequence: Synthetic oligonucleotide
cgacctgctggacatctgtctgaagcg

SEQ ID NO: 117756 - DNA, 27 bp, Artificial Sequence
  Description of Artificial Sequence: Synthetic oligonucleotide
gacctgctggacatctgtctgaagcgg

SEQ ID NO: 117757 - DNA, 27 bp, Artificial Sequence
  Description of Artificial Sequence: Synthetic oligonucleotide
acctgctggacatctgtctgaagcggg

SEQ ID NO: 117758 - DNA, 26 bp, Artificial Sequence
  Description of Artificial Sequence: Synthetic oligonucleotide
cctgctggacatctgtctgaagcggg

SEQ ID NO: 117759 - DNA, 26 bp, Artificial Sequence
  Description of Artificial Sequence: Synthetic oligonucleotide
ctgctggacatctgtctgaagcgggc

SEQ ID NO: 117760 - DNA, 27 bp, Artificial Sequence
  Description of Artificial Sequence: Synthetic oligonucleotide
tgctggacatctgtctgaagcgggcca

SEQ ID NO: 117761 - DNA, 26 bp, Artificial Sequence
  Description of Artificial Sequence: Synthetic oligonucleotide
gctggacatctgtctgaagcgggcca

SEQ ID NO: 117762 - DNA, 26 bp, Artificial Sequence
  Description of Artificial Sequence: Synthetic oligonucleotide
ctggacatctgtctgaagcgggccac

SEQ ID NO: 117763 - DNA, 26 bp, Artificial Sequence
  Description of Artificial Sequence: Synthetic oligonucleotide
tggacatctgtctgaagcgggccacg

SEQ ID NO: 117764 - DNA, 25 bp, Artificial Sequence
  Description of Artificial Sequence: Synthetic oligonucleotide
ggacatctgtctgaagcgggccacg

SEQ ID NO: 117765 - DNA, 26 bp, Artificial Sequence
  Description of Artificial Sequence: Synthetic oligonucleotide
gacatctgtctgaagcgggccacggt

SEQ ID NO: 117766 - DNA, 26 bp, Artificial Sequence
  Description of Artificial Sequence: Synthetic oligonucleotide
acatctgtctgaagcgggccacggtg

SEQ ID NO: 117767 - DNA, 25 bp, Artificial Sequence
  Description of Artificial Sequence: Synthetic oligonucleotide
catctgtctgaagcgggccacggtg

SEQ ID NO: 117768 - DNA, 26 bp, Artificial Sequence
  Description of Artificial Sequence: Synthetic oligonucleotide
atctgtctgaagcgggccacggtgca

SEQ ID NO: 117769 - DNA, 25 bp, Artificial Sequence
  Description of Artificial Sequence: Synthetic oligonucleotide
tctgtctgaagcgggccacggtgca

SEQ ID NO: 117770 - DNA, 24 bp, Artificial Sequence
  Description of Artificial Sequence: Synthetic oligonucleotide
ctgtctgaagcgggccacggtgca

SEQ ID NO: 117771 - DNA, 24 bp, Artificial Sequence
  Description of Artificial Sequence: Synthetic oligonucleotide
tgtctgaagcgggccacggtgcag

SEQ ID NO: 117772 - DNA, 23 bp, Artificial Sequence
  Description of Artificial Sequence: Synthetic oligonucleotide
gtctgaagcgggccacggtgcag

SEQ ID NO: 117773 - DNA, 23 bp, Artificial Sequence
  Description of Artificial Sequence: Synthetic oligonucleotide
tctgaagcgggccacggtgcagc

SEQ ID NO: 117774 - DNA, 22 bp, Artificial Sequence
  Description of Artificial Sequence: Synthetic oligonucleotide
ctgaagcgggccacggtgcagc

SEQ ID NO: 117775 - DNA, 22 bp, Artificial Sequence
  Description of Artificial Sequence: Synthetic oligonucleotide
tgaagcgggccacggtgcagcg

SEQ ID NO: 117776 - DNA, 21 bp, Artificial Sequence
  Description of Artificial Sequence: Synthetic oligonucleotide
gaagcgggccacggtgcagcg

SEQ ID NO: 117777 - DNA, 21 bp, Artificial Sequence
  Description of Artificial Sequence: Synthetic oligonucleotide
aagcgggccacggtgcagcgc

SEQ ID NO: 117778 - DNA, 20 bp, Artificial Sequence
  Description of Artificial Sequence: Synthetic oligonucleotide
agcgggccacggtgcagcgc

SEQ ID NO: 117779 - DNA, 20 bp, Artificial Sequence
  Description of Artificial Sequence: Synthetic oligonucleotide
gcgggccacggtgcagcgct

SEQ ID NO: 117780 - DNA, 20 bp, Artificial Sequence
  Description of Artificial Sequence: Synthetic oligonucleotide
cgggccacggtgcagcgcgt

SEQ ID NO: 117781 - DNA, 20 bp, Artificial Sequence
  Description of Artificial Sequence: Synthetic oligonucleotide
gggccacggtgcagcgcgct

SEQ ID NO: 117782 - DNA, 20 bp, Artificial Sequence
  Description of Artificial Sequence: Synthetic oligonucleotide
ggccacggtgcagcgcgcgt

SEQ ID NO: 117783 - DNA, 20 bp, Artificial Sequence
  Description of Artificial Sequence: Synthetic oligonucleotide
gccacggtgcagcgcgcgca

SEQ ID NO: 117784 - DNA, 20 bp, Artificial Sequence
  Description of Artificial Sequence: Synthetic oligonucleotide
ccacggtgcagcgcgcgcag

SEQ ID NO: 117785 - DNA, 22 bp, Artificial Sequence
  Description of Artificial Sequence: Synthetic oligonucleotide
cacggtgcagcgcgcgcagcat

SEQ ID NO: 117786 - DNA, 23 bp, Artificial Sequence
  Description of Artificial Sequence: Synthetic oligonucleotide
acggtgcagcgcgcgcagcatgt

SEQ ID NO: 117787 - DNA, 22 bp, Artificial Sequence
  Description of Artificial Sequence: Synthetic oligonucleotide
cggtgcagcgcgcgcagcatgt

SEQ ID NO: 117788 - DNA, 24 bp, Artificial Sequence
  Description of Artificial Sequence: Synthetic oligonucleotide
ggtgcagcgcgcgcagcatgtgtt

SEQ ID NO: 117789 - DNA, 24 bp, Artificial Sequence
  Description of Artificial Sequence: Synthetic oligonucleotide
gtgcagcgcgcgcagcatgtgttc

SEQ ID NO: 117790 - DNA, 25 bp, Artificial Sequence
  Description of Artificial Sequence: Synthetic oligonucleotide
tgcagcgcgcgcagcatgtgttcca

SEQ ID NO: 117791 - DNA, 24 bp, Artificial Sequence
  Description of Artificial Sequence: Synthetic oligonucleotide
gcagcgcgcgcagcatgtgttcca

SEQ ID NO: 117792 - DNA, 24 bp, Artificial Sequence
  Description of Artificial Sequence: Synthetic oligonucleotide
cagcgcgcgcagcatgtgttccag

SEQ ID NO: 117793 - DNA, 25 bp, Artificial Sequence
  Description of Artificial Sequence: Synthetic oligonucleotide
agcgcgcgcagcatgtgttccagca

SEQ ID NO: 117794 - DNA, 24 bp, Artificial Sequence
  Description of Artificial Sequence: Synthetic oligonucleotide
gcgcgcgcagcatgtgttccagca

SEQ ID NO: 117795 - DNA, 24 bp, Artificial Sequence
  Description of Artificial Sequence: Synthetic oligonucleotide
cgcgcgcagcatgtgttccagcac

SEQ ID NO: 117796 - DNA, 24 bp, Artificial Sequence
  Description of Artificial Sequence: Synthetic oligonucleotide
gcgcgcagcatgtgttccagcacg

SEQ ID NO: 117797 - DNA, 24 bp, Artificial Sequence
  Description of Artificial Sequence: Synthetic oligonucleotide
cgcgcagcatgtgttccagcacgc

SEQ ID NO: 117798 - DNA, 24 bp, Artificial Sequence
  Description of Artificial Sequence: Synthetic oligonucleotide
gcgcagcatgtgttccagcacgcc

SEQ ID NO: 117799 - DNA, 25 bp, Artificial Sequence
  Description of Artificial Sequence: Synthetic oligonucleotide
cgcagcatgtgttccagcacgccgt

SEQ ID NO: 117800 - DNA, 25 bp, Artificial Sequence
  Description of Artificial Sequence: Synthetic oligonucleotide
gcagcatgtgttccagcacgccgtg

SEQ ID NO: 117801 - DNA, 25 bp, Artificial Sequence
  Description of Artificial Sequence: Synthetic oligonucleotide
cagcatgtgttccagcacgccgtgc

SEQ ID NO: 117802 - DNA, 25 bp, Artificial Sequence
  Description of Artificial Sequence: Synthetic oligonucleotide
agcatgtgttccagcacgccgtgcc

SEQ ID NO: 117803 - DNA, 24 bp, Artificial Sequence
  Description of Artificial Sequence: Synthetic oligonucleotide
gcatgtgttccagcacgccgtgcc

SEQ ID NO: 117804 - DNA, 24 bp, Artificial Sequence
  Description of Artificial Sequence: Synthetic oligonucleotide
catgtgttccagcacgccgtgccc

SEQ ID NO: 117805 - DNA, 25 bp, Artificial Sequence
  Description of Artificial Sequence: Synthetic oligonucleotide
atgtgttccagcacgccgtgcccca

SEQ ID NO: 117806 - DNA, 24 bp, Artificial Sequence
  Description of Artificial Sequence: Synthetic oligonucleotide
tgtgttccagcacgccgtgcccca

SEQ ID NO: 117807 - DNA, 23 bp, Artificial Sequence
  Description of Artificial Sequence: Synthetic oligonucleotide
gtgttccagcacgccgtgcccca

SEQ ID NO: 117808 - DNA, 23 bp, Artificial Sequence
  Description of Artificial Sequence: Synthetic oligonucleotide
tgttccagcacgccgtgccccag

SEQ ID NO: 117809 - DNA, 22 bp, Artificial Sequence
  Description of Artificial Sequence: Synthetic oligonucleotide
gttccagcacgccgtgccccag

SEQ ID NO: 117810 - DNA, 23 bp, Artificial Sequence
  Description of Artificial Sequence: Synthetic oligonucleotide
ttccagcacgccgtgccccagga

SEQ ID NO: 117811 - DNA, 22 bp, Artificial Sequence
  Description of Artificial Sequence: Synthetic oligonucleotide
tccagcacgccgtgccccagga

SEQ ID NO: 117812 - DNA, 21 bp, Artificial Sequence
  Description of Artificial Sequence: Synthetic oligonucleotide
ccagcacgccgtgccccagga

SEQ ID NO: 117813 - DNA, 21 bp, Artificial Sequence
  Description of Artificial Sequence: Synthetic oligonucleotide
cagcacgccgtgccccaggag

SEQ ID NO: 117814 - DNA, 21 bp, Artificial Sequence
  Description of Artificial Sequence: Synthetic oligonucleotide
agcacgccgtgccccaggagg

SEQ ID NO: 117815 - DNA, 20 bp, Artificial Sequence
  Description of Artificial Sequence: Synthetic oligonucleotide
gcacgccgtgccccaggagg

SEQ ID NO: 117816 - DNA, 20 bp, Artificial Sequence
  Description of Artificial Sequence: Synthetic oligonucleotide
cacgccgtgccccaggaggg

SEQ ID NO: 117817 - DNA, 22 bp, Artificial Sequence
  Description of Artificial Sequence: Synthetic oligonucleotide
acgccgtgccccaggagggcaa

SEQ ID NO: 117818 - DNA, 21 bp, Artificial Sequence
  Description of Artificial Sequence: Synthetic oligonucleotide
cgccgtgccccaggagggcaa

SEQ ID NO: 117819 - DNA, 21 bp, Artificial Sequence
  Description of Artificial Sequence: Synthetic oligonucleotide
gccgtgccccaggagggcaag

SEQ ID NO: 117820 - DNA, 21 bp, Artificial Sequence
  Description of Artificial Sequence: Synthetic oligonucleotide
ccgtgccccaggagggcaagc

SEQ ID NO: 117821 - DNA, 24 bp, Artificial Sequence
  Description of Artificial Sequence: Synthetic oligonucleotide
cgtgccccaggagggcaagccaat

SEQ ID NO: 117822 - DNA, 25 bp, Artificial Sequence
  Description of Artificial Sequence: Synthetic oligonucleotide
gtgccccaggagggcaagccaatca

SEQ ID NO: 117823 - DNA, 25 bp, Artificial Sequence
  Description of Artificial Sequence: Synthetic oligonucleotide
tgccccaggagggcaagccaatcac

SEQ ID NO: 117824 - DNA, 24 bp, Artificial Sequence
  Description of Artificial Sequence: Synthetic oligonucleotide
gccccaggagggcaagccaatcac

SEQ ID NO: 117825 - DNA, 26 bp, Artificial Sequence
  Description of Artificial Sequence: Synthetic oligonucleotide
ccccaggagggcaagccaatcaccaa

SEQ ID NO: 117826 - DNA, 26 bp, Artificial Sequence
  Description of Artificial Sequence: Synthetic oligonucleotide
cccaggagggcaagccaatcaccaac

SEQ ID NO: 117827 - DNA, 27 bp, Artificial Sequence
  Description of Artificial Sequence: Synthetic oligonucleotide
ccaggagggcaagccaatcaccaacca

SEQ ID NO: 117828 - DNA, 27 bp, Artificial Sequence
  Description of Artificial Sequence: Synthetic oligonucleotide
caggagggcaagccaatcaccaaccag

SEQ ID NO: 117829 - DNA, 29 bp, Artificial Sequence
  Description of Artificial Sequence: Synthetic oligonucleotide
aggagggcaagccaatcaccaaccagaag

SEQ ID NO: 117830 - DNA, 28 bp, Artificial Sequence
  Description of Artificial Sequence: Synthetic oligonucleotide
ggagggcaagccaatcaccaaccagaag

SEQ ID NO: 117831 - DNA, 29 bp, Artificial Sequence
  Description of Artificial Sequence: Synthetic oligonucleotide
gagggcaagccaatcaccaaccagaagag

SEQ ID NO: 117832 - DNA, 29 bp, Artificial Sequence
  Description of Artificial Sequence: Synthetic oligonucleotide
agggcaagccaatcaccaaccagaagagc

SEQ ID NO: 117833 - DNA, 28 bp, Artificial Sequence
  Description of Artificial Sequence: Synthetic oligonucleotide
gggcaagccaatcaccaaccagaagagc

SEQ ID NO: 117834 - DNA, 29 bp, Artificial Sequence
  Description of Artificial Sequence: Synthetic oligonucleotide
ggcaagccaatcaccaaccagaagagctc

SEQ ID NO: 117835 - DNA, 30 bp, Artificial Sequence
  Description of Artificial Sequence: Synthetic oligonucleotide
gcaagccaatcaccaaccagaagagctcag

SEQ ID NO: 117836 - DNA, 30 bp, Artificial Sequence
  Description of Artificial Sequence: Synthetic oligonucleotide
caagccaatcaccaaccagaagagctcagg

SEQ ID NO: 117837 - DNA, 30 bp, Artificial Sequence
  Description of Artificial Sequence: Synthetic oligonucleotide
aagccaatcaccaaccagaagagctcaggg

SEQ ID NO: 117838 - DNA, 29 bp, Artificial Sequence
  Description of Artificial Sequence: Synthetic oligonucleotide
agccaatcaccaaccagaagagctcaggg

SEQ ID NO: 117839 - DNA, 28 bp, Artificial Sequence
  Description of Artificial Sequence: Synthetic oligonucleotide
gccaatcaccaaccagaagagctcaggg

SEQ ID NO: 117840 - DNA, 28 bp, Artificial Sequence
  Description of Artificial Sequence: Synthetic oligonucleotide
ccaatcaccaaccagaagagctcagggc

SEQ ID NO: 117841 - DNA, 28 bp, Artificial Sequence
  Description of Artificial Sequence: Synthetic oligonucleotide
caatcaccaaccagaagagctcagggcg

SEQ ID NO: 117842 - DNA, 30 bp, Artificial Sequence
  Description of Artificial Sequence: Synthetic oligonucleotide
aatcaccaaccagaagagctcagggcgatg

SEQ ID NO: 117843 - DNA, 29 bp, Artificial Sequence
  Description of Artificial Sequence: Synthetic oligonucleotide
atcaccaaccagaagagctcagggcgatg

SEQ ID NO: 117844 - DNA, 28 bp, Artificial Sequence
  Description of Artificial Sequence: Synthetic oligonucleotide
tcaccaaccagaagagctcagggcgatg

SEQ ID NO: 117845 - DNA, 27 bp, Artificial Sequence
  Description of Artificial Sequence: Synthetic oligonucleotide
caccaaccagaagagctcagggcgatg

SEQ ID NO: 117846 - DNA, 27 bp, Artificial Sequence
  Description of Artificial Sequence: Synthetic oligonucleotide
accaaccagaagagctcagggcgatgc

SEQ ID NO: 117847 - DNA, 27 bp, Artificial Sequence
  Description of Artificial Sequence: Synthetic oligonucleotide
ccaaccagaagagctcagggcgatgct

SEQ ID NO: 117848 - DNA, 27 bp, Artificial Sequence
  Description of Artificial Sequence: Synthetic oligonucleotide
caaccagaagagctcagggcgatgctg

SEQ ID NO: 117849 - DNA, 27 bp, Artificial Sequence
  Description of Artificial Sequence: Synthetic oligonucleotide
aaccagaagagctcagggcgatgctgg

SEQ ID NO: 117850 - DNA, 27 bp, Artificial Sequence
  Description of Artificial Sequence: Synthetic oligonucleotide
accagaagagctcagggcgatgctgga

SEQ ID NO: 117851 - DNA, 27 bp, Artificial Sequence
  Description of Artificial Sequence: Synthetic oligonucleotide
ccagaagagctcagggcgatgctggat

SEQ ID NO: 117852 - DNA, 27 bp, Artificial Sequence
  Description of Artificial Sequence: Synthetic oligonucleotide
cagaagagctcagggcgatgctggatc

SEQ ID NO: 117853 - DNA, 31 bp, Artificial Sequence
  Description of Artificial Sequence: Synthetic oligonucleotide
agaagagctcagggcgatgctggatcttttc

SEQ ID NO: 117854 - DNA, 30 bp, Artificial Sequence
  Description of Artificial Sequence: Synthetic oligonucleotide
gaagagctcagggcgatgctggatcttttc

SEQ ID NO: 117855 - DNA, 32 bp, Artificial Sequence
  Description of Artificial Sequence: Synthetic oligonucleotide
aagagctcagggcgatgctggatcttttcttg

SEQ ID NO: 117856 - DNA, 31 bp, Artificial Sequence
  Description of Artificial Sequence: Synthetic oligonucleotide
agagctcagggcgatgctggatcttttcttg

SEQ ID NO: 117857 - DNA, 30 bp, Artificial Sequence
  Description of Artificial Sequence: Synthetic oligonucleotide
gagctcagggcgatgctggatcttttcttg

SEQ ID NO: 117858 - DNA, 31 bp, Artificial Sequence
  Description of Artificial Sequence: Synthetic oligonucleotide
agctcagggcgatgctggatcttttcttgtc

SEQ ID NO: 117859 - DNA, 30 bp, Artificial Sequence
  Description of Artificial Sequence: Synthetic oligonucleotide
gctcagggcgatgctggatcttttcttgtc

SEQ ID NO: 117860 - DNA, 31 bp, Artificial Sequence
  Description of Artificial Sequence: Synthetic oligonucleotide
ctcagggcgatgctggatcttttcttgtctg

SEQ ID NO: 117861 - DNA, 34 bp, Artificial Sequence
  Description of Artificial Sequence: Synthetic oligonucleotide
tcagggcgatgctggatcttttcttgtctgaatg

SEQ ID NO: 117862 - DNA, 33 bp, Artificial Sequence
  Description of Artificial Sequence: Synthetic oligonucleotide
cagggcgatgctggatcttttcttgtctgaatg

SEQ ID NO: 117863 - DNA, 37 bp, Artificial Sequence
  Description of Artificial Sequence: Synthetic oligonucleotide
agggcgatgctggatcttttcttgtctgaatgttatg

SEQ ID NO: 117864 - DNA, 36 bp, Artificial Sequence
  Description of Artificial Sequence: Synthetic oligonucleotide
gggcgatgctggatcttttcttgtctgaatgttatg

SEQ ID NO: 117865 - DNA, 37 bp, Artificial Sequence
  Description of Artificial Sequence: Synthetic oligonucleotide
ggcgatgctggatcttttcttgtctgaatgttatgag

SEQ ID NO: 117866 - DNA, 37 bp, Artificial Sequence
  Description of Artificial Sequence: Synthetic oligonucleotide
gcgatgctggatcttttcttgtctgaatgttatgagg

SEQ ID NO: 117867 - DNA, 37 bp, Artificial Sequence
  Description of Artificial Sequence: Synthetic oligonucleotide
cgatgctggatcttttcttgtctgaatgttatgaggc

SEQ ID NO: 117868 - DNA, 39 bp, Artificial Sequence
  Description of Artificial Sequence: Synthetic oligonucleotide
gatgctggatcttttcttgtctgaatgttatgaggcttc

SEQ ID NO: 117869 - DNA, 39 bp, Artificial Sequence
  Description of Artificial Sequence: Synthetic oligonucleotide
atgctggatcttttcttgtctgaatgttatgaggcttcc

SEQ ID NO: 117870 - DNA, 38 bp, Artificial Sequence
  Description of Artificial Sequence: Synthetic oligonucleotide
tgctggatcttttcttgtctgaatgttatgaggcttcc

SEQ ID NO: 117871 - DNA, 37 bp, Artificial Sequence
  Description of Artificial Sequence: Synthetic oligonucleotide
gctggatcttttcttgtctgaatgttatgaggcttcc

SEQ ID NO: 117872 - DNA, 40 bp, Artificial Sequence
  Description of Artificial Sequence: Synthetic oligonucleotide
ctggatcttttcttgtctgaatgttatgaggcttccattc

SEQ ID NO: 117873 - DNA, 42 bp, Artificial Sequence
  Description of Artificial Sequence: Synthetic oligonucleotide
tggatcttttcttgtctgaatgttatgaggcttccattcatg

SEQ ID NO: 117874 - DNA, 41 bp, Artificial Sequence
  Description of Artificial Sequence: Synthetic oligonucleotide
ggatcttttcttgtctgaatgttatgaggcttccattcatg

SEQ ID NO: 117875 - DNA, 46 bp, Artificial Sequence
  Description of Artificial Sequence: Synthetic oligonucleotide
gatcttttcttgtctgaatgttatgaggcttccattcatgaaaaag

SEQ ID NO: 117876 - DNA, 55 bp, Artificial Sequence
  Description of Artificial Sequence: Synthetic oligonucleotide
atcttttcttgtctgaatgttatgaggcttccattcatgaaaaagttaaatattg

SEQ ID NO: 117877 - DNA, 54 bp, Artificial Sequence
  Description of Artificial Sequence: Synthetic oligonucleotide
tcttttcttgtctgaatgttatgaggcttccattcatgaaaaagttaaatattg

SEQ ID NO: 117878 - DNA, 53 bp, Artificial Sequence
  Description of Artificial Sequence: Synthetic oligonucleotide
cttttcttgtctgaatgttatgaggcttccattcatgaaaaagttaaatattg

SEQ ID NO: 117879 - DNA, 55 bp, Artificial Sequence
  Description of Artificial Sequence: Synthetic oligonucleotide
ttttcttgtctgaatgttatgaggcttccattcatgaaaaagttaaatattgaag

SEQ ID NO: 117880 - DNA, 54 bp, Artificial Sequence
  Description of Artificial Sequence: Synthetic oligonucleotide
tttcttgtctgaatgttatgaggcttccattcatgaaaaagttaaatattgaag

SEQ ID NO: 117881 - DNA, 53 bp, Artificial Sequence
  Description of Artificial Sequence: Synthetic oligonucleotide
ttcttgtctgaatgttatgaggcttccattcatgaaaaagttaaatattgaag

SEQ ID NO: 117882 - DNA, 52 bp, Artificial Sequence
  Description of Artificial Sequence: Synthetic oligonucleotide
tcttgtctgaatgttatgaggcttccattcatgaaaaagttaaatattgaag

SEQ ID NO: 117883 - DNA, 51 bp, Artificial Sequence
  Description of Artificial Sequence: Synthetic oligonucleotide
cttgtctgaatgttatgaggcttccattcatgaaaaagttaaatattgaag

SEQ ID NO: 117884 - DNA, 56 bp, Artificial Sequence
  Description of Artificial Sequence: Synthetic oligonucleotide
ttgtctgaatgttatgaggcttccattcatgaaaaagttaaatattgaagaatttg

SEQ ID NO: 117885 - DNA, 55 bp, Artificial Sequence
  Description of Artificial Sequence: Synthetic oligonucleotide
tgtctgaatgttatgaggcttccattcatgaaaaagttaaatattgaagaatttg

SEQ ID NO: 117886 - DNA, 54 bp, Artificial Sequence
  Description of Artificial Sequence: Synthetic oligonucleotide
gtctgaatgttatgaggcttccattcatgaaaaagttaaatattgaagaatttg

SEQ ID NO: 117887 - DNA, 55 bp, Artificial Sequence
  Description of Artificial Sequence: Synthetic oligonucleotide
tctgaatgttatgaggcttccattcatgaaaaagttaaatattgaagaatttgag

SEQ ID NO: 117888 - DNA, 54 bp, Artificial Sequence
  Description of Artificial Sequence: Synthetic oligonucleotide
ctgaatgttatgaggcttccattcatgaaaaagttaaatattgaagaatttgag

SEQ ID NO: 117889 - DNA, 58 bp, Artificial Sequence
  Description of Artificial Sequence: Synthetic oligonucleotide
tgaatgttatgaggcttccattcatgaaaaagttaaatattgaagaatttgagtttag

SEQ ID NO: 117890 - DNA, 57 bp, Artificial Sequence
  Description of Artificial Sequence: Synthetic oligonucleotide
gaatgttatgaggcttccattcatgaaaaagttaaatattgaagaatttgagtttag

SEQ ID NO: 117891 - DNA, 57 bp, Artificial Sequence
  Description of Artificial Sequence: Synthetic oligonucleotide
aatgttatgaggcttccattcatgaaaaagttaaatattgaagaatttgagtttagc

SEQ ID NO: 117892 - DNA, 56 bp, Artificial Sequence
  Description of Artificial Sequence: Synthetic oligonucleotide
atgttatgaggcttccattcatgaaaaagttaaatattgaagaatttgagtttagc

SEQ ID NO: 117893 - DNA, 55 bp, Artificial Sequence
  Description of Artificial Sequence: Synthetic oligonucleotide
tgttatgaggcttccattcatgaaaaagttaaatattgaagaatttgagtttagc

SEQ ID NO: 117894 - DNA, 54 bp, Artificial Sequence
  Description of Artificial Sequence: Synthetic oligonucleotide
gttatgaggcttccattcatgaaaaagttaaatattgaagaatttgagtttagc

SEQ ID NO: 117895 - DNA, 54 bp, Artificial Sequence
  Description of Artificial Sequence: Synthetic oligonucleotide
ttatgaggcttccattcatgaaaaagttaaatattgaagaatttgagtttagcc

SEQ ID NO: 117896 - DNA, 53 bp, Artificial Sequence
  Description of Artificial Sequence: Synthetic oligonucleotide
tatgaggcttccattcatgaaaaagttaaatattgaagaatttgagtttagcc

SEQ ID NO: 117897 - DNA, 52 bp, Artificial Sequence
  Description of Artificial Sequence: Synthetic oligonucleotide
atgaggcttccattcatgaaaaagttaaatattgaagaatttgagtttagcc

SEQ ID NO: 117898 - DNA, 51 bp, Artificial Sequence
  Description of Artificial Sequence: Synthetic oligonucleotide
tgaggcttccattcatgaaaaagttaaatattgaagaatttgagtttagcc

SEQ ID NO: 117899 - DNA, 50 bp, Artificial Sequence
  Description of Artificial Sequence: Synthetic oligonucleotide
gaggcttccattcatgaaaaagttaaatattgaagaatttgagtttagcc

SEQ ID NO: 117900 - DNA, 53 bp, Artificial Sequence
  Description of Artificial Sequence: Synthetic oligonucleotide
aggcttccattcatgaaaaagttaaatattgaagaatttgagtttagccaatc

SEQ ID NO: 117901 - DNA, 52 bp, Artificial Sequence
  Description of Artificial Sequence: Synthetic oligonucleotide
ggcttccattcatgaaaaagttaaatattgaagaatttgagtttagccaatc

SEQ ID NO: 117902 - DNA, 55 bp, Artificial Sequence
  Description of Artificial Sequence: Synthetic oligonucleotide
gcttccattcatgaaaaagttaaatattgaagaatttgagtttagccaatcttac

SEQ ID NO: 117903 - DNA, 55 bp, Artificial Sequence
  Description of Artificial Sequence: Synthetic oligonucleotide
cttccattcatgaaaaagttaaatattgaagaatttgagtttagccaatcttacc

SEQ ID NO: 117904 - DNA, 56 bp, Artificial Sequence
  Description of Artificial Sequence: Synthetic oligonucleotide
ttccattcatgaaaaagttaaatattgaagaatttgagtttagccaatcttacctg

SEQ ID NO: 117905 - DNA, 55 bp, Artificial Sequence
  Description of Artificial Sequence: Synthetic oligonucleotide
tccattcatgaaaaagttaaatattgaagaatttgagtttagccaatcttacctg

SEQ ID NO: 117906 - DNA, 54 bp, Artificial Sequence
  Description of Artificial Sequence: Synthetic oligonucleotide
ccattcatgaaaaagttaaatattgaagaatttgagtttagccaatcttacctg

SEQ ID NO: 117907 - DNA, 60 bp, Artificial Sequence
  Description of Artificial Sequence: Synthetic oligonucleotide
cattcatgaaaaagttaaatattgaagaatttgagtttagccaatcttacctgttttttt

SEQ ID NO: 117908 - DNA, 60 bp, Artificial Sequence
  Description of Artificial Sequence: Synthetic oligonucleotide
attcatgaaaaagttaaatattgaagaatttgagtttagccaatcttacctgtttttttg

SEQ ID NO: 117909 - DNA, 60 bp, Artificial Sequence
  Description of Artificial Sequence: Synthetic oligonucleotide
ttcatgaaaaagttaaatattgaagaatttgagtttagccaatcttacctgtttttttgg

SEQ ID NO: 117910 - DNA, 59 bp, Artificial Sequence
  Description of Artificial Sequence: Synthetic oligonucleotide
tcatgaaaaagttaaatattgaagaatttgagtttagccaatcttacctgtttttttgg

SEQ ID NO: 117911 - DNA, 58 bp, Artificial Sequence
  Description of Artificial Sequence: Synthetic oligonucleotide
catgaaaaagttaaatattgaagaatttgagtttagccaatcttacctgtttttttgg

SEQ ID NO: 117912 - DNA, 58 bp, Artificial Sequence
  Description of Artificial Sequence: Synthetic oligonucleotide
atgaaaaagttaaatattgaagaatttgagtttagccaatcttacctgtttttttggg

SEQ ID NO: 117913 - DNA, 57 bp, Artificial Sequence
  Description of Artificial Sequence: Synthetic oligonucleotide
tgaaaaagttaaatattgaagaatttgagtttagccaatcttacctgtttttttggg

SEQ ID NO: 117914 - DNA, 56 bp, Artificial Sequence
  Description of Artificial Sequence: Synthetic oligonucleotide
gaaaaagttaaatattgaagaatttgagtttagccaatcttacctgtttttttggg

SEQ ID NO: 117915 - DNA, 57 bp, Artificial Sequence
  Description of Artificial Sequence: Synthetic oligonucleotide
aaaaagttaaatattgaagaatttgagtttagccaatcttacctgtttttttgggac

SEQ ID NO: 117916 - DNA, 56 bp, Artificial Sequence
  Description of Artificial Sequence: Synthetic oligonucleotide
aaaagttaaatattgaagaatttgagtttagccaatcttacctgtttttttgggac

SEQ ID NO: 117917 - DNA, 55 bp, Artificial Sequence
  Description of Artificial Sequence: Synthetic oligonucleotide
aaagttaaatattgaagaatttgagtttagccaatcttacctgtttttttgggac

SEQ ID NO: 117918 - DNA, 54 bp, Artificial Sequence
  Description of Artificial Sequence: Synthetic oligonucleotide
aagttaaatattgaagaatttgagtttagccaatcttacctgtttttttgggac

SEQ ID NO: 117919 - DNA, 53 bp, Artificial Sequence
  Description of Artificial Sequence: Synthetic oligonucleotide
agttaaatattgaagaatttgagtttagccaatcttacctgtttttttgggac

SEQ ID NO: 117920 - DNA, 52 bp, Artificial Sequence
  Description of Artificial Sequence: Synthetic oligonucleotide
gttaaatattgaagaatttgagtttagccaatcttacctgtttttttgggac

SEQ ID NO: 117921 - DNA, 54 bp, Artificial Sequence
  Description of Artificial Sequence: Synthetic oligonucleotide
ttaaatattgaagaatttgagtttagccaatcttacctgtttttttgggacaag

SEQ ID NO: 117922 - DNA, 53 bp, Artificial Sequence
  Description of Artificial Sequence: Synthetic oligonucleotide
taaatattgaagaatttgagtttagccaatcttacctgtttttttgggacaag

SEQ ID NO: 117923 - DNA, 52 bp, Artificial Sequence
  Description of Artificial Sequence: Synthetic oligonucleotide
aaatattgaagaatttgagtttagccaatcttacctgtttttttgggacaag

SEQ ID NO: 117924 - DNA, 51 bp, Artificial Sequence
  Description of Artificial Sequence: Synthetic oligonucleotide
aatattgaagaatttgagtttagccaatcttacctgtttttttgggacaag

SEQ ID NO: 117925 - DNA, 50 bp, Artificial Sequence
  Description of Artificial Sequence: Synthetic oligonucleotide
atattgaagaatttgagtttagccaatcttacctgtttttttgggacaag

SEQ ID NO: 117926 - DNA, 49 bp, Artificial Sequence
  Description of Artificial Sequence: Synthetic oligonucleotide
tattgaagaatttgagtttagccaatcttacctgtttttttgggacaag

SEQ ID NO: 117927 - DNA, 48 bp, Artificial Sequence
  Description of Artificial Sequence: Synthetic oligonucleotide
attgaagaatttgagtttagccaatcttacctgtttttttgggacaag

SEQ ID NO: 117928 - DNA, 47 bp, Artificial Sequence
  Description of Artificial Sequence: Synthetic oligonucleotide
ttgaagaatttgagtttagccaatcttacctgtttttttgggacaag

SEQ ID NO: 117929 - DNA, 46 bp, Artificial Sequence
  Description of Artificial Sequence: Synthetic oligonucleotide
tgaagaatttgagtttagccaatcttacctgtttttttgggacaag

SEQ ID NO: 117930 - DNA, 45 bp, Artificial Sequence
  Description of Artificial Sequence: Synthetic oligonucleotide
gaagaatttgagtttagccaatcttacctgtttttttgggacaag

SEQ ID NO: 117931 - DNA, 45 bp, Artificial Sequence
  Description of Artificial Sequence: Synthetic oligonucleotide
aagaatttgagtttagccaatcttacctgtttttttgggacaagg

SEQ ID NO: 117932 - DNA, 44 bp, Artificial Sequence
  Description of Artificial Sequence: Synthetic oligonucleotide
agaatttgagtttagccaatcttacctgtttttttgggacaagg

SEQ ID NO: 117933 - DNA, 43 bp, Artificial Sequence
  Description of Artificial Sequence: Synthetic oligonucleotide
gaatttgagtttagccaatcttacctgtttttttgggacaagg

SEQ ID NO: 117934 - DNA, 45 bp, Artificial Sequence
  Description of Artificial Sequence: Synthetic oligonucleotide
aatttgagtttagccaatcttacctgtttttttgggacaaggttg

SEQ ID NO: 117935 - DNA, 44 bp, Artificial Sequence
  Description of Artificial Sequence: Synthetic oligonucleotide
atttgagtttagccaatcttacctgtttttttgggacaaggttg

SEQ ID NO: 117936 - DNA, 43 bp, Artificial Sequence
  Description of Artificial Sequence: Synthetic oligonucleotide
tttgagtttagccaatcttacctgtttttttgggacaaggttg

SEQ ID NO: 117937 - DNA, 42 bp, Artificial Sequence
  Description of Artificial Sequence: Synthetic oligonucleotide
ttgagtttagccaatcttacctgtttttttgggacaaggttg

SEQ ID NO: 117938 - DNA, 41 bp, Artificial Sequence
  Description of Artificial Sequence: Synthetic oligonucleotide
tgagtttagccaatcttacctgtttttttgggacaaggttg

SEQ ID NO: 117939 - DNA, 40 bp, Artificial Sequence
  Description of Artificial Sequence: Synthetic oligonucleotide
gagtttagccaatcttacctgtttttttgggacaaggttg

SEQ ID NO: 117940 - DNA, 42 bp, Artificial Sequence
  Description of Artificial Sequence: Synthetic oligonucleotide
agtttagccaatcttacctgtttttttgggacaaggttgaac

SEQ ID NO: 117941 - DNA, 41 bp, Artificial Sequence
  Description of Artificial Sequence: Synthetic oligonucleotide
gtttagccaatcttacctgtttttttgggacaaggttgaac

SEQ ID NO: 117942 - DNA, 41 bp, Artificial Sequence
  Description of Artificial Sequence: Synthetic oligonucleotide
tttagccaatcttacctgtttttttgggacaaggttgaacg

SEQ ID NO: 117943 - DNA, 40 bp, Artificial Sequence
  Description of Artificial Sequence: Synthetic oligonucleotide
ttagccaatcttacctgtttttttgggacaaggttgaacg

SEQ ID NO: 117944 - DNA, 39 bp, Artificial Sequence
  Description of Artificial Sequence: Synthetic oligonucleotide
tagccaatcttacctgtttttttgggacaaggttgaacg

SEQ ID NO: 117945 - DNA, 38 bp, Artificial Sequence
  Description of Artificial Sequence: Synthetic oligonucleotide
agccaatcttacctgtttttttgggacaaggttgaacg

SEQ ID NO: 117946 - DNA, 37 bp, Artificial Sequence
  Description of Artificial Sequence: Synthetic oligonucleotide
gccaatcttacctgtttttttgggacaaggttgaacg

SEQ ID NO: 117947 - DNA, 37 bp, Artificial Sequence
  Description of Artificial Sequence: Synthetic oligonucleotide
ccaatcttacctgtttttttgggacaaggttgaacgc

SEQ ID NO: 117948 - DNA, 38 bp, Artificial Sequence
  Description of Artificial Sequence: Synthetic oligonucleotide
caatcttacctgtttttttgggacaaggttgaacgctg

SEQ ID NO: 117949 - DNA, 44 bp, Artificial Sequence
  Description of Artificial Sequence: Synthetic oligonucleotide
aatcttacctgtttttttgggacaaggttgaacgctgttatttc

SEQ ID NO: 117950 - DNA, 43 bp, Artificial Sequence
  Description of Artificial Sequence: Synthetic oligonucleotide
atcttacctgtttttttgggacaaggttgaacgctgttatttc

SEQ ID NO: 117951 - DNA, 42 bp, Artificial Sequence
  Description of Artificial Sequence: Synthetic oligonucleotide
tcttacctgtttttttgggacaaggttgaacgctgttatttc

SEQ ID NO: 117952 - DNA, 41 bp, Artificial Sequence
  Description of Artificial Sequence: Synthetic oligonucleotide
cttacctgtttttttgggacaaggttgaacgctgttatttc

SEQ ID NO: 117953 - DNA, 43 bp, Artificial Sequence
  Description of Artificial Sequence: Synthetic oligonucleotide
ttacctgtttttttgggacaaggttgaacgctgttatttcttc

SEQ ID NO: 117954 - DNA, 42 bp, Artificial Sequence
  Description of Artificial Sequence: Synthetic oligonucleotide
tacctgtttttttgggacaaggttgaacgctgttatttcttc

SEQ ID NO: 117955 - DNA, 41 bp, Artificial Sequence
  Description of Artificial Sequence: Synthetic oligonucleotide
acctgtttttttgggacaaggttgaacgctgttatttcttc

SEQ ID NO: 117956 - DNA, 40 bp, Artificial Sequence
  Description of Artificial Sequence: Synthetic oligonucleotide
cctgtttttttgggacaaggttgaacgctgttatttcttc

SEQ ID NO: 117957 - DNA, 42 bp, Artificial Sequence
  Description of Artificial Sequence: Synthetic oligonucleotide
ctgtttttttgggacaaggttgaacgctgttatttcttcttg

SEQ ID NO: 117958 - DNA, 43 bp, Artificial Sequence
  Description of Artificial Sequence: Synthetic oligonucleotide
tgtttttttgggacaaggttgaacgctgttatttcttcttgag

SEQ ID NO: 117959 - DNA, 42 bp, Artificial Sequence
  Description of Artificial Sequence: Synthetic oligonucleotide
gtttttttgggacaaggttgaacgctgttatttcttcttgag

SEQ ID NO: 117960 - DNA, 43 bp, Artificial Sequence
  Description of Artificial Sequence: Synthetic oligonucleotide
tttttttgggacaaggttgaacgctgttatttcttcttgagtg

SEQ ID NO: 117961 - DNA, 42 bp, Artificial Sequence
  Description of Artificial Sequence: Synthetic oligonucleotide
ttttttgggacaaggttgaacgctgttatttcttcttgagtg

SEQ ID NO: 117962 - DNA, 41 bp, Artificial Sequence
  Description of Artificial Sequence: Synthetic oligonucleotide
tttttgggacaaggttgaacgctgttatttcttcttgagtg

SEQ ID NO: 117963 - DNA, 40 bp, Artificial Sequence
  Description of Artificial Sequence: Synthetic oligonucleotide
ttttgggacaaggttgaacgctgttatttcttcttgagtg

SEQ ID NO: 117964 - DNA, 39 bp, Artificial Sequence
  Description of Artificial Sequence: Synthetic oligonucleotide
tttgggacaaggttgaacgctgttatttcttcttgagtg

SEQ ID NO: 117965 - DNA, 38 bp, Artificial Sequence
  Description of Artificial Sequence: Synthetic oligonucleotide
ttgggacaaggttgaacgctgttatttcttcttgagtg

SEQ ID NO: 117966 - DNA, 37 bp, Artificial Sequence
  Description of Artificial Sequence: Synthetic oligonucleotide
tgggacaaggttgaacgctgttatttcttcttgagtg

SEQ ID NO: 117967 - DNA, 36 bp, Artificial Sequence
  Description of Artificial Sequence: Synthetic oligonucleotide
gggacaaggttgaacgctgttatttcttcttgagtg

SEQ ID NO: 117968 - DNA, 36 bp, Artificial Sequence
  Description of Artificial Sequence: Synthetic oligonucleotide
ggacaaggttgaacgctgttatttcttcttgagtgc

SEQ ID NO: 117969 - DNA, 40 bp, Artificial Sequence
  Description of Artificial Sequence: Synthetic oligonucleotide
gacaaggttgaacgctgttatttcttcttgagtgcttttg

SEQ ID NO: 117970 - DNA, 41 bp, Artificial Sequence
  Description of Artificial Sequence: Synthetic oligonucleotide
acaaggttgaacgctgttatttcttcttgagtgcttttgtg

SEQ ID NO: 117971 - DNA, 40 bp, Artificial Sequence
  Description of Artificial Sequence: Synthetic oligonucleotide
caaggttgaacgctgttatttcttcttgagtgcttttgtg

SEQ ID NO: 117972 - DNA, 40 bp, Artificial Sequence
  Description of Artificial Sequence: Synthetic oligonucleotide
aaggttgaacgctgttatttcttcttgagtgcttttgtgg

SEQ ID NO: 117973 - DNA, 39 bp, Artificial Sequence
  Description of Artificial Sequence: Synthetic oligonucleotide
aggttgaacgctgttatttcttcttgagtgcttttgtgg

SEQ ID NO: 117974 - DNA, 38 bp, Artificial Sequence
  Description of Artificial Sequence: Synthetic oligonucleotide
ggttgaacgctgttatttcttcttgagtgcttttgtgg

SEQ ID NO: 117975 - DNA, 39 bp, Artificial Sequence
  Description of Artificial Sequence: Synthetic oligonucleotide
gttgaacgctgttatttcttcttgagtgcttttgtggac

SEQ ID NO: 117976 - DNA, 40 bp, Artificial Sequence
  Description of Artificial Sequence: Synthetic oligonucleotide
ttgaacgctgttatttcttcttgagtgcttttgtggacac

SEQ ID NO: 117977 - DNA, 39 bp, Artificial Sequence
  Description of Artificial Sequence: Synthetic oligonucleotide
tgaacgctgttatttcttcttgagtgcttttgtggacac

SEQ ID NO: 117978 - DNA, 38 bp, Artificial Sequence
  Description of Artificial Sequence: Synthetic oligonucleotide
gaacgctgttatttcttcttgagtgcttttgtggacac

SEQ ID NO: 117979 - DNA, 39 bp, Artificial Sequence
  Description of Artificial Sequence: Synthetic oligonucleotide
aacgctgttatttcttcttgagtgcttttgtggacacag

SEQ ID NO: 117980 - DNA, 38 bp, Artificial Sequence
  Description of Artificial Sequence: Synthetic oligonucleotide
acgctgttatttcttcttgagtgcttttgtggacacag

SEQ ID NO: 117981 - DNA, 37 bp, Artificial Sequence
  Description of Artificial Sequence: Synthetic oligonucleotide
cgctgttatttcttcttgagtgcttttgtggacacag

SEQ ID NO: 117982 - DNA, 37 bp, Artificial Sequence
  Description of Artificial Sequence: Synthetic oligonucleotide
gctgttatttcttcttgagtgcttttgtggacacagc

SEQ ID NO: 117983 - DNA, 37 bp, Artificial Sequence
  Description of Artificial Sequence: Synthetic oligonucleotide
ctgttatttcttcttgagtgcttttgtggacacagcc

SEQ ID NO: 117984 - DNA, 37 bp, Artificial Sequence
  Description of Artificial Sequence: Synthetic oligonucleotide
tgttatttcttcttgagtgcttttgtggacacagccc

SEQ ID NO: 117985 - DNA, 36 bp, Artificial Sequence
  Description of Artificial Sequence: Synthetic oligonucleotide
gttatttcttcttgagtgcttttgtggacacagccc

SEQ ID NO: 117986 - DNA, 37 bp, Artificial Sequence
  Description of Artificial Sequence: Synthetic oligonucleotide
ttatttcttcttgagtgcttttgtggacacagcccag

SEQ ID NO: 117987 - DNA, 36 bp, Artificial Sequence
  Description of Artificial Sequence: Synthetic oligonucleotide
tatttcttcttgagtgcttttgtggacacagcccag

SEQ ID NO: 117988 - DNA, 35 bp, Artificial Sequence
  Description of Artificial Sequence: Synthetic oligonucleotide
atttcttcttgagtgcttttgtggacacagcccag

SEQ ID NO: 117989 - DNA, 34 bp, Artificial Sequence
  Description of Artificial Sequence: Synthetic oligonucleotide
tttcttcttgagtgcttttgtggacacagcccag

SEQ ID NO: 117990 - DNA, 33 bp, Artificial Sequence
  Description of Artificial Sequence: Synthetic oligonucleotide
ttcttcttgagtgcttttgtggacacagcccag

SEQ ID NO: 117991 - DNA, 32 bp, Artificial Sequence
  Description of Artificial Sequence: Synthetic oligonucleotide
tcttcttgagtgcttttgtggacacagcccag

SEQ ID NO: 117992 - DNA, 31 bp, Artificial Sequence
  Description of Artificial Sequence: Synthetic oligonucleotide
cttcttgagtgcttttgtggacacagcccag

SEQ ID NO: 117993 - DNA, 32 bp, Artificial Sequence
  Description of Artificial Sequence: Synthetic oligonucleotide
ttcttgagtgcttttgtggacacagcccagag

SEQ ID NO: 117994 - DNA, 31 bp, Artificial Sequence
  Description of Artificial Sequence: Synthetic oligonucleotide
tcttgagtgcttttgtggacacagcccagag

SEQ ID NO: 117995 - DNA, 30 bp, Artificial Sequence
  Description of Artificial Sequence: Synthetic oligonucleotide
cttgagtgcttttgtggacacagcccagag

SEQ ID NO: 117996 - DNA, 33 bp, Artificial Sequence
  Description of Artificial Sequence: Synthetic oligonucleotide
ttgagtgcttttgtggacacagcccagagaaag

SEQ ID NO: 117997 - DNA, 32 bp, Artificial Sequence
  Description of Artificial Sequence: Synthetic oligonucleotide
tgagtgcttttgtggacacagcccagagaaag

SEQ ID NO: 117998 - DNA, 31 bp, Artificial Sequence
  Description of Artificial Sequence: Synthetic oligonucleotide
gagtgcttttgtggacacagcccagagaaag

SEQ ID NO: 117999 - DNA, 31 bp, Artificial Sequence
  Description of Artificial Sequence: Synthetic oligonucleotide
agtgcttttgtggacacagcccagagaaagg

SEQ ID NO: 118000 - DNA, 30 bp, Artificial Sequence
  Description of Artificial Sequence: Synthetic oligonucleotide
gtgcttttgtggacacagcccagagaaagg

SEQ ID NO: 118001 - DNA, 31 bp, Artificial Sequence
  Description of Artificial Sequence: Synthetic oligonucleotide
tgcttttgtggacacagcccagagaaaggag

SEQ ID NO: 118002 - DNA, 30 bp, Artificial Sequence
  Description of Artificial Sequence: Synthetic oligonucleotide
gcttttgtggacacagcccagagaaaggag

SEQ ID NO: 118003 - DNA, 30 bp, Artificial Sequence
  Description of Artificial Sequence: Synthetic oligonucleotide
cttttgtggacacagcccagagaaaggagc

SEQ ID NO: 118004 - DNA, 30 bp, Artificial Sequence
  Description of Artificial Sequence: Synthetic oligonucleotide
ttttgtggacacagcccagagaaaggagcc

SEQ ID NO: 118005 - DNA, 29 bp, Artificial Sequence
  Description of Artificial Sequence: Synthetic oligonucleotide
tttgtggacacagcccagagaaaggagcc

SEQ ID NO: 118006 - DNA, 28 bp, Artificial Sequence
  Description of Artificial Sequence: Synthetic oligonucleotide
ttgtggacacagcccagagaaaggagcc

SEQ ID NO: 118007 - DNA, 27 bp, Artificial Sequence
  Description of Artificial Sequence: Synthetic oligonucleotide
tgtggacacagcccagagaaaggagcc

SEQ ID NO: 118008 - DNA, 27 bp, Artificial Sequence
  Description of Artificial Sequence: Synthetic oligonucleotide
gtggacacagcccagagaaaggagcct

SEQ ID NO: 118009 - DNA, 27 bp, Artificial Sequence
  Description of Artificial Sequence: Synthetic oligonucleotide
tggacacagcccagagaaaggagcctg

SEQ ID NO: 118010 - DNA, 27 bp, Artificial Sequence
  Description of Artificial Sequence: Synthetic oligonucleotide
ggacacagcccagagaaaggagcctga

SEQ ID NO: 118011 - DNA, 27 bp, Artificial Sequence
  Description of Artificial Sequence: Synthetic oligonucleotide
gacacagcccagagaaaggagcctgag

SEQ ID NO: 118012 - DNA, 27 bp, Artificial Sequence
  Description of Artificial Sequence: Synthetic oligonucleotide
acacagcccagagaaaggagcctgagg

SEQ ID NO: 118013 - DNA, 27 bp, Artificial Sequence
  Description of Artificial Sequence: Synthetic oligonucleotide
cacagcccagagaaaggagcctgagga

SEQ ID NO: 118014 - DNA, 28 bp, Artificial Sequence
  Description of Artificial Sequence: Synthetic oligonucleotide
acagcccagagaaaggagcctgaggatg

SEQ ID NO: 118015 - DNA, 27 bp, Artificial Sequence
  Description of Artificial Sequence: Synthetic oligonucleotide
cagcccagagaaaggagcctgaggatg

SEQ ID NO: 118016 - DNA, 27 bp, Artificial Sequence
  Description of Artificial Sequence: Synthetic oligonucleotide
agcccagagaaaggagcctgaggatgg

SEQ ID NO: 118017 - DNA, 26 bp, Artificial Sequence
  Description of Artificial Sequence: Synthetic oligonucleotide
gcccagagaaaggagcctgaggatgg

SEQ ID NO: 118018 - DNA, 27 bp, Artificial Sequence
  Description of Artificial Sequence: Synthetic oligonucleotide
cccagagaaaggagcctgaggatggga

SEQ ID NO: 118019 - DNA, 27 bp, Artificial Sequence
  Description of Artificial Sequence: Synthetic oligonucleotide
ccagagaaaggagcctgaggatgggag

SEQ ID NO: 118020 - DNA, 27 bp, Artificial Sequence
  Description of Artificial Sequence: Synthetic oligonucleotide
cagagaaaggagcctgaggatgggagg

SEQ ID NO: 118021 - DNA, 27 bp, Artificial Sequence
  Description of Artificial Sequence: Synthetic oligonucleotide
agagaaaggagcctgaggatgggaggc

SEQ ID NO: 118022 - DNA, 27 bp, Artificial Sequence
  Description of Artificial Sequence: Synthetic oligonucleotide
gagaaaggagcctgaggatgggaggct

SEQ ID NO: 118023 - DNA, 27 bp, Artificial Sequence
  Description of Artificial Sequence: Synthetic oligonucleotide
agaaaggagcctgaggatgggaggctg

SEQ ID NO: 118024 - DNA, 26 bp, Artificial Sequence
  Description of Artificial Sequence: Synthetic oligonucleotide
gaaaggagcctgaggatgggaggctg

SEQ ID NO: 118025 - DNA, 27 bp, Artificial Sequence
  Description of Artificial Sequence: Synthetic oligonucleotide
aaaggagcctgaggatgggaggctggt

SEQ ID NO: 118026 - DNA, 26 bp, Artificial Sequence
  Description of Artificial Sequence: Synthetic oligonucleotide
aaggagcctgaggatgggaggctggt

SEQ ID NO: 118027 - DNA, 25 bp, Artificial Sequence
  Description of Artificial Sequence: Synthetic oligonucleotide
aggagcctgaggatgggaggctggt

SEQ ID NO: 118028 - DNA, 24 bp, Artificial Sequence
  Description of Artificial Sequence: Synthetic oligonucleotide
ggagcctgaggatgggaggctggt

SEQ ID NO: 118029 - DNA, 24 bp, Artificial Sequence
  Description of Artificial Sequence: Synthetic oligonucleotide
gagcctgaggatgggaggctggtg

SEQ ID NO: 118030 - DNA, 25 bp, Artificial Sequence
  Description of Artificial Sequence: Synthetic oligonucleotide
agcctgaggatgggaggctggtgca

SEQ ID NO: 118031 - DNA, 24 bp, Artificial Sequence
  Description of Artificial Sequence: Synthetic oligonucleotide
gcctgaggatgggaggctggtgca

SEQ ID NO: 118032 - DNA, 27 bp, Artificial Sequence
  Description of Artificial Sequence: Synthetic oligonucleotide
cctgaggatgggaggctggtgcagttt

SEQ ID NO: 118033 - DNA, 29 bp, Artificial Sequence
  Description of Artificial Sequence: Synthetic oligonucleotide
ctgaggatgggaggctggtgcagtttttg

SEQ ID NO: 118034 - DNA, 29 bp, Artificial Sequence
  Description of Artificial Sequence: Synthetic oligonucleotide
tgaggatgggaggctggtgcagtttttgc

SEQ ID NO: 118035 - DNA, 28 bp, Artificial Sequence
  Description of Artificial Sequence: Synthetic oligonucleotide
gaggatgggaggctggtgcagtttttgc

SEQ ID NO: 118036 - DNA, 32 bp, Artificial Sequence
  Description of Artificial Sequence: Synthetic oligonucleotide
aggatgggaggctggtgcagtttttgcttatg

SEQ ID NO: 118037 - DNA, 31 bp, Artificial Sequence
  Description of Artificial Sequence: Synthetic oligonucleotide
ggatgggaggctggtgcagtttttgcttatg

SEQ ID NO: 118038 - DNA, 33 bp, Artificial Sequence
  Description of Artificial Sequence: Synthetic oligonucleotide
gatgggaggctggtgcagtttttgcttatgaac

SEQ ID NO: 118039 - DNA, 33 bp, Artificial Sequence
  Description of Artificial Sequence: Synthetic oligonucleotide
atgggaggctggtgcagtttttgcttatgaacc

SEQ ID NO: 118040 - DNA, 32 bp, Artificial Sequence
  Description of Artificial Sequence: Synthetic oligonucleotide
tgggaggctggtgcagtttttgcttatgaacc

SEQ ID NO: 118041 - DNA, 31 bp, Artificial Sequence
  Description of Artificial Sequence: Synthetic oligonucleotide
gggaggctggtgcagtttttgcttatgaacc

SEQ ID NO: 118042 - DNA, 31 bp, Artificial Sequence
  Description of Artificial Sequence: Synthetic oligonucleotide
ggaggctggtgcagtttttgcttatgaaccc

SEQ ID NO: 118043 - DNA, 32 bp, Artificial Sequence
  Description of Artificial Sequence: Synthetic oligonucleotide
gaggctggtgcagtttttgcttatgaaccctg

SEQ ID NO: 118044 - DNA, 32 bp, Artificial Sequence
  Description of Artificial Sequence: Synthetic oligonucleotide
aggctggtgcagtttttgcttatgaaccctgc

SEQ ID NO: 118045 - DNA, 31 bp, Artificial Sequence
  Description of Artificial Sequence: Synthetic oligonucleotide
ggctggtgcagtttttgcttatgaaccctgc

SEQ ID NO: 118046 - DNA, 35 bp, Artificial Sequence
  Description of Artificial Sequence: Synthetic oligonucleotide
gctggtgcagtttttgcttatgaaccctgcaaatg

SEQ ID NO: 118047 - DNA, 37 bp, Artificial Sequence
  Description of Artificial Sequence: Synthetic oligonucleotide
ctggtgcagtttttgcttatgaaccctgcaaatgatg

SEQ ID NO: 118048 - DNA, 37 bp, Artificial Sequence
  Description of Artificial Sequence: Synthetic oligonucleotide
tggtgcagtttttgcttatgaaccctgcaaatgatgg

SEQ ID NO: 118049 - DNA, 36 bp, Artificial Sequence
  Description of Artificial Sequence: Synthetic oligonucleotide
ggtgcagtttttgcttatgaaccctgcaaatgatgg

SEQ ID NO: 118050 - DNA, 37 bp, Artificial Sequence
  Description of Artificial Sequence: Synthetic oligonucleotide
gtgcagtttttgcttatgaaccctgcaaatgatggtg

SEQ ID NO: 118051 - DNA, 37 bp, Artificial Sequence
  Description of Artificial Sequence: Synthetic oligonucleotide
tgcagtttttgcttatgaaccctgcaaatgatggtgg

SEQ ID NO: 118052 - DNA, 36 bp, Artificial Sequence
  Description of Artificial Sequence: Synthetic oligonucleotide
gcagtttttgcttatgaaccctgcaaatgatggtgg

SEQ ID NO: 118053 - DNA, 36 bp, Artificial Sequence
  Description of Artificial Sequence: Synthetic oligonucleotide
cagtttttgcttatgaaccctgcaaatgatggtggc

SEQ ID NO: 118054 - DNA, 36 bp, Artificial Sequence
  Description of Artificial Sequence: Synthetic oligonucleotide
agtttttgcttatgaaccctgcaaatgatggtggcc

SEQ ID NO: 118055 - DNA, 35 bp, Artificial Sequence
  Description of Artificial Sequence: Synthetic oligonucleotide
gtttttgcttatgaaccctgcaaatgatggtggcc

SEQ ID NO: 118056 - DNA, 38 bp, Artificial Sequence
  Description of Artificial Sequence: Synthetic oligonucleotide
tttttgcttatgaaccctgcaaatgatggtggccaatg

SEQ ID NO: 118057 - DNA, 37 bp, Artificial Sequence
  Description of Artificial Sequence: Synthetic oligonucleotide
ttttgcttatgaaccctgcaaatgatggtggccaatg

SEQ ID NO: 118058 - DNA, 36 bp, Artificial Sequence
  Description of Artificial Sequence: Synthetic oligonucleotide
tttgcttatgaaccctgcaaatgatggtggccaatg

SEQ ID NO: 118059 - DNA, 35 bp, Artificial Sequence
  Description of Artificial Sequence: Synthetic oligonucleotide
ttgcttatgaaccctgcaaatgatggtggccaatg

SEQ ID NO: 118060 - DNA, 34 bp, Artificial Sequence
  Description of Artificial Sequence: Synthetic oligonucleotide
tgcttatgaaccctgcaaatgatggtggccaatg

SEQ ID NO: 118061 - DNA, 33 bp, Artificial Sequence
  Description of Artificial Sequence: Synthetic oligonucleotide
gcttatgaaccctgcaaatgatggtggccaatg

SEQ ID NO: 118062 - DNA, 33 bp, Artificial Sequence
  Description of Artificial Sequence: Synthetic oligonucleotide
cttatgaaccctgcaaatgatggtggccaatgg

SEQ ID NO: 118063 - DNA, 33 bp, Artificial Sequence
  Description of Artificial Sequence: Synthetic oligonucleotide
ttatgaaccctgcaaatgatggtggccaatggg

SEQ ID NO: 118064 - DNA, 32 bp, Artificial Sequence
  Description of Artificial Sequence: Synthetic oligonucleotide
tatgaaccctgcaaatgatggtggccaatggg

SEQ ID NO: 118065 - DNA, 31 bp, Artificial Sequence
  Description of Artificial Sequence: Synthetic oligonucleotide
atgaaccctgcaaatgatggtggccaatggg

SEQ ID NO: 118066 - DNA, 30 bp, Artificial Sequence
  Description of Artificial Sequence: Synthetic oligonucleotide
tgaaccctgcaaatgatggtggccaatggg

SEQ ID NO: 118067 - DNA, 29 bp, Artificial Sequence
  Description of Artificial Sequence: Synthetic oligonucleotide
gaaccctgcaaatgatggtggccaatggg

SEQ ID NO: 118068 - DNA, 33 bp, Artificial Sequence
  Description of Artificial Sequence: Synthetic oligonucleotide
aaccctgcaaatgatggtggccaatgggatatg

SEQ ID NO: 118069 - DNA, 32 bp, Artificial Sequence
  Description of Artificial Sequence: Synthetic oligonucleotide
accctgcaaatgatggtggccaatgggatatg

SEQ ID NO: 118070 - DNA, 31 bp, Artificial Sequence
  Description of Artificial Sequence: Synthetic oligonucleotide
ccctgcaaatgatggtggccaatgggatatg

SEQ ID NO: 118071 - DNA, 31 bp, Artificial Sequence
  Description of Artificial Sequence: Synthetic oligonucleotide
cctgcaaatgatggtggccaatgggatatgc

SEQ ID NO: 118072 - DNA, 33 bp, Artificial Sequence
  Description of Artificial Sequence: Synthetic oligonucleotide
ctgcaaatgatggtggccaatgggatatgcttg

SEQ ID NO: 118073 - DNA, 41 bp, Artificial Sequence
  Description of Artificial Sequence: Synthetic oligonucleotide
tgcaaatgatggtggccaatgggatatgcttgttaatattg

SEQ ID NO: 118074 - DNA, 40 bp, Artificial Sequence
  Description of Artificial Sequence: Synthetic oligonucleotide
gcaaatgatggtggccaatgggatatgcttgttaatattg

SEQ ID NO: 118075 - DNA, 42 bp, Artificial Sequence
  Description of Artificial Sequence: Synthetic oligonucleotide
caaatgatggtggccaatgggatatgcttgttaatattgttg

SEQ ID NO: 118076 - DNA, 50 bp, Artificial Sequence
  Description of Artificial Sequence: Synthetic oligonucleotide
aaatgatggtggccaatgggatatgcttgttaatattgttgaaaaatatg

SEQ ID NO: 118077 - DNA, 49 bp, Artificial Sequence
  Description of Artificial Sequence: Synthetic oligonucleotide
aatgatggtggccaatgggatatgcttgttaatattgttgaaaaatatg

SEQ ID NO: 118078 - DNA, 48 bp, Artificial Sequence
  Description of Artificial Sequence: Synthetic oligonucleotide
atgatggtggccaatgggatatgcttgttaatattgttgaaaaatatg

SEQ ID NO: 118079 - DNA, 47 bp, Artificial Sequence
  Description of Artificial Sequence: Synthetic oligonucleotide
tgatggtggccaatgggatatgcttgttaatattgttgaaaaatatg

SEQ ID NO: 118080 - DNA, 46 bp, Artificial Sequence
  Description of Artificial Sequence: Synthetic oligonucleotide
gatggtggccaatgggatatgcttgttaatattgttgaaaaatatg

SEQ ID NO: 118081 - DNA, 46 bp, Artificial Sequence
  Description of Artificial Sequence: Synthetic oligonucleotide
atggtggccaatgggatatgcttgttaatattgttgaaaaatatgg

SEQ ID NO: 118082 - DNA, 45 bp, Artificial Sequence
  Description of Artificial Sequence: Synthetic oligonucleotide
tggtggccaatgggatatgcttgttaatattgttgaaaaatatgg

SEQ ID NO: 118083 - DNA, 44 bp, Artificial Sequence
  Description of Artificial Sequence: Synthetic oligonucleotide
ggtggccaatgggatatgcttgttaatattgttgaaaaatatgg

SEQ ID NO: 118084 - DNA, 45 bp, Artificial Sequence
  Description of Artificial Sequence: Synthetic oligonucleotide
gtggccaatgggatatgcttgttaatattgttgaaaaatatggtg

SEQ ID NO: 118085 - DNA, 49 bp, Artificial Sequence
  Description of Artificial Sequence: Synthetic oligonucleotide
tggccaatgggatatgcttgttaatattgttgaaaaatatggtgttatc

SEQ ID NO: 118086 - DNA, 48 bp, Artificial Sequence
  Description of Artificial Sequence: Synthetic oligonucleotide
ggccaatgggatatgcttgttaatattgttgaaaaatatggtgttatc

SEQ ID NO: 118087 - DNA, 48 bp, Artificial Sequence
  Description of Artificial Sequence: Synthetic oligonucleotide
gccaatgggatatgcttgttaatattgttgaaaaatatggtgttatcc

SEQ ID NO: 118088 - DNA, 48 bp, Artificial Sequence
  Description of Artificial Sequence: Synthetic oligonucleotide
ccaatgggatatgcttgttaatattgttgaaaaatatggtgttatccc

SEQ ID NO: 118089 - DNA, 51 bp, Artificial Sequence
  Description of Artificial Sequence: Synthetic oligonucleotide
caatgggatatgcttgttaatattgttgaaaaatatggtgttatccctaag

SEQ ID NO: 118090 - DNA, 55 bp, Artificial Sequence
  Description of Artificial Sequence: Synthetic oligonucleotide
aatgggatatgcttgttaatattgttgaaaaatatggtgttatccctaagaaatg

SEQ ID NO: 118091 - DNA, 54 bp, Artificial Sequence
  Description of Artificial Sequence: Synthetic oligonucleotide
atgggatatgcttgttaatattgttgaaaaatatggtgttatccctaagaaatg

SEQ ID NO: 118092 - DNA, 53 bp, Artificial Sequence
  Description of Artificial Sequence: Synthetic oligonucleotide
tgggatatgcttgttaatattgttgaaaaatatggtgttatccctaagaaatg

SEQ ID NO: 118093 - DNA, 52 bp, Artificial Sequence
  Description of Artificial Sequence: Synthetic oligonucleotide
gggatatgcttgttaatattgttgaaaaatatggtgttatccctaagaaatg

SEQ ID NO: 118094 - DNA, 52 bp, Artificial Sequence
  Description of Artificial Sequence: Synthetic oligonucleotide
ggatatgcttgttaatattgttgaaaaatatggtgttatccctaagaaatgc

SEQ ID NO: 118095 - DNA, 54 bp, Artificial Sequence
  Description of Artificial Sequence: Synthetic oligonucleotide
gatatgcttgttaatattgttgaaaaatatggtgttatccctaagaaatgcttc

SEQ ID NO: 118096 - DNA, 54 bp, Artificial Sequence
  Description of Artificial Sequence: Synthetic oligonucleotide
atatgcttgttaatattgttgaaaaatatggtgttatccctaagaaatgcttcc

SEQ ID NO: 118097 - DNA, 53 bp, Artificial Sequence
  Description of Artificial Sequence: Synthetic oligonucleotide
tatgcttgttaatattgttgaaaaatatggtgttatccctaagaaatgcttcc

SEQ ID NO: 118098 - DNA, 52 bp, Artificial Sequence
  Description of Artificial Sequence: Synthetic oligonucleotide
atgcttgttaatattgttgaaaaatatggtgttatccctaagaaatgcttcc

SEQ ID NO: 118099 - DNA, 51 bp, Artificial Sequence
  Description of Artificial Sequence: Synthetic oligonucleotide
tgcttgttaatattgttgaaaaatatggtgttatccctaagaaatgcttcc

SEQ ID NO: 118100 - DNA, 50 bp, Artificial Sequence
  Description of Artificial Sequence: Synthetic oligonucleotide
gcttgttaatattgttgaaaaatatggtgttatccctaagaaatgcttcc

SEQ ID NO: 118101 - DNA, 50 bp, Artificial Sequence
  Description of Artificial Sequence: Synthetic oligonucleotide
cttgttaatattgttgaaaaatatggtgttatccctaagaaatgcttccc

SEQ ID NO: 118102 - DNA, 51 bp, Artificial Sequence
  Description of Artificial Sequence: Synthetic oligonucleotide
ttgttaatattgttgaaaaatatggtgttatccctaagaaatgcttccctg

SEQ ID NO: 118103 - DNA, 50 bp, Artificial Sequence
  Description of Artificial Sequence: Synthetic oligonucleotide
tgttaatattgttgaaaaatatggtgttatccctaagaaatgcttccctg

SEQ ID NO: 118104 - DNA, 49 bp, Artificial Sequence
  Description of Artificial Sequence: Synthetic oligonucleotide
gttaatattgttgaaaaatatggtgttatccctaagaaatgcttccctg

SEQ ID NO: 118105 - DNA, 52 bp, Artificial Sequence
  Description of Artificial Sequence: Synthetic oligonucleotide
ttaatattgttgaaaaatatggtgttatccctaagaaatgcttccctgaatc

SEQ ID NO: 118106 - DNA, 51 bp, Artificial Sequence
  Description of Artificial Sequence: Synthetic oligonucleotide
taatattgttgaaaaatatggtgttatccctaagaaatgcttccctgaatc

SEQ ID NO: 118107 - DNA, 50 bp, Artificial Sequence
  Description of Artificial Sequence: Synthetic oligonucleotide
aatattgttgaaaaatatggtgttatccctaagaaatgcttccctgaatc

SEQ ID NO: 118108 - DNA, 49 bp, Artificial Sequence
  Description of Artificial Sequence: Synthetic oligonucleotide
atattgttgaaaaatatggtgttatccctaagaaatgcttccctgaatc

SEQ ID NO: 118109 - DNA, 48 bp, Artificial Sequence
  Description of Artificial Sequence: Synthetic oligonucleotide
tattgttgaaaaatatggtgttatccctaagaaatgcttccctgaatc

SEQ ID NO: 118110 - DNA, 47 bp, Artificial Sequence
  Description of Artificial Sequence: Synthetic oligonucleotide
attgttgaaaaatatggtgttatccctaagaaatgcttccctgaatc

SEQ ID NO: 118111 - DNA, 46 bp, Artificial Sequence
  Description of Artificial Sequence: Synthetic oligonucleotide
ttgttgaaaaatatggtgttatccctaagaaatgcttccctgaatc

SEQ ID NO: 118112 - DNA, 45 bp, Artificial Sequence
  Description of Artificial Sequence: Synthetic oligonucleotide
tgttgaaaaatatggtgttatccctaagaaatgcttccctgaatc

SEQ ID NO: 118113 - DNA, 44 bp, Artificial Sequence
  Description of Artificial Sequence: Synthetic oligonucleotide
gttgaaaaatatggtgttatccctaagaaatgcttccctgaatc

SEQ ID NO: 118114 - DNA, 49 bp, Artificial Sequence
  Description of Artificial Sequence: Synthetic oligonucleotide
ttgaaaaatatggtgttatccctaagaaatgcttccctgaatcttatac

SEQ ID NO: 118115 - DNA, 48 bp, Artificial Sequence
  Description of Artificial Sequence: Synthetic oligonucleotide
tgaaaaatatggtgttatccctaagaaatgcttccctgaatcttatac

SEQ ID NO: 118116 - DNA, 47 bp, Artificial Sequence
  Description of Artificial Sequence: Synthetic oligonucleotide
gaaaaatatggtgttatccctaagaaatgcttccctgaatcttatac

SEQ ID NO: 118117 - DNA, 49 bp, Artificial Sequence
  Description of Artificial Sequence: Synthetic oligonucleotide
aaaaatatggtgttatccctaagaaatgcttccctgaatcttatacaac

SEQ ID NO: 118118 - DNA, 48 bp, Artificial Sequence
  Description of Artificial Sequence: Synthetic oligonucleotide
aaaatatggtgttatccctaagaaatgcttccctgaatcttatacaac

SEQ ID NO: 118119 - DNA, 47 bp, Artificial Sequence
  Description of Artificial Sequence: Synthetic oligonucleotide
aaatatggtgttatccctaagaaatgcttccctgaatcttatacaac

SEQ ID NO: 118120 - DNA, 46 bp, Artificial Sequence
  Description of Artificial Sequence: Synthetic oligonucleotide
aatatggtgttatccctaagaaatgcttccctgaatcttatacaac

SEQ ID NO: 118121 - DNA, 45 bp, Artificial Sequence
  Description of Artificial Sequence: Synthetic oligonucleotide
atatggtgttatccctaagaaatgcttccctgaatcttatacaac

SEQ ID NO: 118122 - DNA, 44 bp, Artificial Sequence
  Description of Artificial Sequence: Synthetic oligonucleotide
tatggtgttatccctaagaaatgcttccctgaatcttatacaac

SEQ ID NO: 118123 - DNA, 43 bp, Artificial Sequence
  Description of Artificial Sequence: Synthetic oligonucleotide
atggtgttatccctaagaaatgcttccctgaatcttatacaac

SEQ ID NO: 118124 - DNA, 42 bp, Artificial Sequence
  Description of Artificial Sequence: Synthetic oligonucleotide
tggtgttatccctaagaaatgcttccctgaatcttatacaac

SEQ ID NO: 118125 - DNA, 41 bp, Artificial Sequence
  Description of Artificial Sequence: Synthetic oligonucleotide
ggtgttatccctaagaaatgcttccctgaatcttatacaac

SEQ ID NO: 118126 - DNA, 42 bp, Artificial Sequence
  Description of Artificial Sequence: Synthetic oligonucleotide
gtgttatccctaagaaatgcttccctgaatcttatacaacag

SEQ ID NO: 118127 - DNA, 43 bp, Artificial Sequence
  Description of Artificial Sequence: Synthetic oligonucleotide
tgttatccctaagaaatgcttccctgaatcttatacaacagag

SEQ ID NO: 118128 - DNA, 42 bp, Artificial Sequence
  Description of Artificial Sequence: Synthetic oligonucleotide
gttatccctaagaaatgcttccctgaatcttatacaacagag

SEQ ID NO: 118129 - DNA, 42 bp, Artificial Sequence
  Description of Artificial Sequence: Synthetic oligonucleotide
ttatccctaagaaatgcttccctgaatcttatacaacagagg

SEQ ID NO: 118130 - DNA, 41 bp, Artificial Sequence
  Description of Artificial Sequence: Synthetic oligonucleotide
tatccctaagaaatgcttccctgaatcttatacaacagagg

SEQ ID NO: 118131 - DNA, 40 bp, Artificial Sequence
  Description of Artificial Sequence: Synthetic oligonucleotide
atccctaagaaatgcttccctgaatcttatacaacagagg

SEQ ID NO: 118132 - DNA, 39 bp, Artificial Sequence
  Description of Artificial Sequence: Synthetic oligonucleotide
tccctaagaaatgcttccctgaatcttatacaacagagg

SEQ ID NO: 118133 - DNA, 38 bp, Artificial Sequence
  Description of Artificial Sequence: Synthetic oligonucleotide
ccctaagaaatgcttccctgaatcttatacaacagagg

SEQ ID NO: 118134 - DNA, 38 bp, Artificial Sequence
  Description of Artificial Sequence: Synthetic oligonucleotide
cctaagaaatgcttccctgaatcttatacaacagaggc

SEQ ID NO: 118135 - DNA, 40 bp, Artificial Sequence
  Description of Artificial Sequence: Synthetic oligonucleotide
ctaagaaatgcttccctgaatcttatacaacagaggcaac

SEQ ID NO: 118136 - DNA, 40 bp, Artificial Sequence
  Description of Artificial Sequence: Synthetic oligonucleotide
taagaaatgcttccctgaatcttatacaacagaggcaacc

SEQ ID NO: 118137 - DNA, 39 bp, Artificial Sequence
  Description of Artificial Sequence: Synthetic oligonucleotide
aagaaatgcttccctgaatcttatacaacagaggcaacc

SEQ ID NO: 118138 - DNA, 38 bp, Artificial Sequence
  Description of Artificial Sequence: Synthetic oligonucleotide
agaaatgcttccctgaatcttatacaacagaggcaacc

SEQ ID NO: 118139 - DNA, 37 bp, Artificial Sequence
  Description of Artificial Sequence: Synthetic oligonucleotide
gaaatgcttccctgaatcttatacaacagaggcaacc

SEQ ID NO: 118140 - DNA, 38 bp, Artificial Sequence
  Description of Artificial Sequence: Synthetic oligonucleotide
aaatgcttccctgaatcttatacaacagaggcaaccag

SEQ ID NO: 118141 - DNA, 37 bp, Artificial Sequence
  Description of Artificial Sequence: Synthetic oligonucleotide
aatgcttccctgaatcttatacaacagaggcaaccag

SEQ ID NO: 118142 - DNA, 36 bp, Artificial Sequence
  Description of Artificial Sequence: Synthetic oligonucleotide
atgcttccctgaatcttatacaacagaggcaaccag

SEQ ID NO: 118143 - DNA, 35 bp, Artificial Sequence
  Description of Artificial Sequence: Synthetic oligonucleotide
tgcttccctgaatcttatacaacagaggcaaccag

SEQ ID NO: 118144 - DNA, 34 bp, Artificial Sequence
  Description of Artificial Sequence: Synthetic oligonucleotide
gcttccctgaatcttatacaacagaggcaaccag

SEQ ID NO: 118145 - DNA, 36 bp, Artificial Sequence
  Description of Artificial Sequence: Synthetic oligonucleotide
cttccctgaatcttatacaacagaggcaaccagaag

SEQ ID NO: 118146 - DNA, 36 bp, Artificial Sequence
  Description of Artificial Sequence: Synthetic oligonucleotide
ttccctgaatcttatacaacagaggcaaccagaagg

SEQ ID NO: 118147 - DNA, 35 bp, Artificial Sequence
  Description of Artificial Sequence: Synthetic oligonucleotide
tccctgaatcttatacaacagaggcaaccagaagg

SEQ ID NO: 118148 - DNA, 34 bp, Artificial Sequence
  Description of Artificial Sequence: Synthetic oligonucleotide
ccctgaatcttatacaacagaggcaaccagaagg

SEQ ID NO: 118149 - DNA, 36 bp, Artificial Sequence
  Description of Artificial Sequence: Synthetic oligonucleotide
cctgaatcttatacaacagaggcaaccagaaggatg

SEQ ID NO: 118150 - DNA, 39 bp, Artificial Sequence
  Description of Artificial Sequence: Synthetic oligonucleotide
ctgaatcttatacaacagaggcaaccagaaggatgaatg

SEQ ID NO: 118151 - DNA, 44 bp, Artificial Sequence
  Description of Artificial Sequence: Synthetic oligonucleotide
tgaatcttatacaacagaggcaaccagaaggatgaatgatattc

SEQ ID NO: 118152 - DNA, 43 bp, Artificial Sequence
  Description of Artificial Sequence: Synthetic oligonucleotide
gaatcttatacaacagaggcaaccagaaggatgaatgatattc

SEQ ID NO: 118153 - DNA, 44 bp, Artificial Sequence
  Description of Artificial Sequence: Synthetic oligonucleotide
aatcttatacaacagaggcaaccagaaggatgaatgatattctg

SEQ ID NO: 118154 - DNA, 43 bp, Artificial Sequence
  Description of Artificial Sequence: Synthetic oligonucleotide
atcttatacaacagaggcaaccagaaggatgaatgatattctg

SEQ ID NO: 118155 - DNA, 42 bp, Artificial Sequence
  Description of Artificial Sequence: Synthetic oligonucleotide
tcttatacaacagaggcaaccagaaggatgaatgatattctg

SEQ ID NO: 118156 - DNA, 41 bp, Artificial Sequence
  Description of Artificial Sequence: Synthetic oligonucleotide
cttatacaacagaggcaaccagaaggatgaatgatattctg

SEQ ID NO: 118157 - DNA, 44 bp, Artificial Sequence
  Description of Artificial Sequence: Synthetic oligonucleotide
ttatacaacagaggcaaccagaaggatgaatgatattctgaatc

SEQ ID NO: 118158 - DNA, 43 bp, Artificial Sequence
  Description of Artificial Sequence: Synthetic oligonucleotide
tatacaacagaggcaaccagaaggatgaatgatattctgaatc

SEQ ID NO: 118159 - DNA, 42 bp, Artificial Sequence
  Description of Artificial Sequence: Synthetic oligonucleotide
atacaacagaggcaaccagaaggatgaatgatattctgaatc

SEQ ID NO: 118160 - DNA, 41 bp, Artificial Sequence
  Description of Artificial Sequence: Synthetic oligonucleotide
tacaacagaggcaaccagaaggatgaatgatattctgaatc

SEQ ID NO: 118161 - DNA, 40 bp, Artificial Sequence
  Description of Artificial Sequence: Synthetic oligonucleotide
acaacagaggcaaccagaaggatgaatgatattctgaatc

SEQ ID NO: 118162 - DNA, 39 bp, Artificial Sequence
  Description of Artificial Sequence: Synthetic oligonucleotide
caacagaggcaaccagaaggatgaatgatattctgaatc

SEQ ID NO: 118163 - DNA, 40 bp, Artificial Sequence
  Description of Artificial Sequence: Synthetic oligonucleotide
aacagaggcaaccagaaggatgaatgatattctgaatcac

SEQ ID NO: 118164 - DNA, 39 bp, Artificial Sequence
  Description of Artificial Sequence: Synthetic oligonucleotide
acagaggcaaccagaaggatgaatgatattctgaatcac

SEQ ID NO: 118165 - DNA, 38 bp, Artificial Sequence
  Description of Artificial Sequence: Synthetic oligonucleotide
cagaggcaaccagaaggatgaatgatattctgaatcac

SEQ ID NO: 118166 - DNA, 40 bp, Artificial Sequence
  Description of Artificial Sequence: Synthetic oligonucleotide
agaggcaaccagaaggatgaatgatattctgaatcacaag

SEQ ID NO: 118167 - DNA, 39 bp, Artificial Sequence
  Description of Artificial Sequence: Synthetic oligonucleotide
gaggcaaccagaaggatgaatgatattctgaatcacaag

SEQ ID NO: 118168 - DNA, 41 bp, Artificial Sequence
  Description of Artificial Sequence: Synthetic oligonucleotide
aggcaaccagaaggatgaatgatattctgaatcacaagatg

SEQ ID NO: 118169 - DNA, 40 bp, Artificial Sequence
  Description of Artificial Sequence: Synthetic oligonucleotide
ggcaaccagaaggatgaatgatattctgaatcacaagatg

SEQ ID NO: 118170 - DNA, 41 bp, Artificial Sequence
  Description of Artificial Sequence: Synthetic oligonucleotide
gcaaccagaaggatgaatgatattctgaatcacaagatgag

SEQ ID NO: 118171 - DNA, 42 bp, Artificial Sequence
  Description of Artificial Sequence: Synthetic oligonucleotide
caaccagaaggatgaatgatattctgaatcacaagatgagag

SEQ ID NO: 118172 - DNA, 46 bp, Artificial Sequence
  Description of Artificial Sequence: Synthetic oligonucleotide
aaccagaaggatgaatgatattctgaatcacaagatgagagaattc

SEQ ID NO: 118173 - DNA, 45 bp, Artificial Sequence
  Description of Artificial Sequence: Synthetic oligonucleotide
accagaaggatgaatgatattctgaatcacaagatgagagaattc

SEQ ID NO: 118174 - DNA, 44 bp, Artificial Sequence
  Description of Artificial Sequence: Synthetic oligonucleotide
ccagaaggatgaatgatattctgaatcacaagatgagagaattc

SEQ ID NO: 118175 - DNA, 45 bp, Artificial Sequence
  Description of Artificial Sequence: Synthetic oligonucleotide
cagaaggatgaatgatattctgaatcacaagatgagagaattctg

SEQ ID NO: 118176 - DNA, 49 bp, Artificial Sequence
  Description of Artificial Sequence: Synthetic oligonucleotide
agaaggatgaatgatattctgaatcacaagatgagagaattctgtatac

SEQ ID NO: 118177 - DNA, 48 bp, Artificial Sequence
  Description of Artificial Sequence: Synthetic oligonucleotide
gaaggatgaatgatattctgaatcacaagatgagagaattctgtatac

SEQ ID NO: 118178 - DNA, 48 bp, Artificial Sequence
  Description of Artificial Sequence: Synthetic oligonucleotide
aaggatgaatgatattctgaatcacaagatgagagaattctgtatacg

SEQ ID NO: 118179 - DNA, 47 bp, Artificial Sequence
  Description of Artificial Sequence: Synthetic oligonucleotide
aggatgaatgatattctgaatcacaagatgagagaattctgtatacg

SEQ ID NO: 118180 - DNA, 46 bp, Artificial Sequence
  Description of Artificial Sequence: Synthetic oligonucleotide
ggatgaatgatattctgaatcacaagatgagagaattctgtatacg

SEQ ID NO: 118181 - DNA, 47 bp, Artificial Sequence
  Description of Artificial Sequence: Synthetic oligonucleotide
gatgaatgatattctgaatcacaagatgagagaattctgtatacgac

SEQ ID NO: 118182 - DNA, 48 bp, Artificial Sequence
  Description of Artificial Sequence: Synthetic oligonucleotide
atgaatgatattctgaatcacaagatgagagaattctgtatacgactg

SEQ ID NO: 118183 - DNA, 47 bp, Artificial Sequence
  Description of Artificial Sequence: Synthetic oligonucleotide
tgaatgatattctgaatcacaagatgagagaattctgtatacgactg

SEQ ID NO: 118184 - DNA, 46 bp, Artificial Sequence
  Description of Artificial Sequence: Synthetic oligonucleotide
gaatgatattctgaatcacaagatgagagaattctgtatacgactg

SEQ ID NO: 118185 - DNA, 46 bp, Artificial Sequence
  Description of Artificial Sequence: Synthetic oligonucleotide
aatgatattctgaatcacaagatgagagaattctgtatacgactgc

SEQ ID NO: 118186 - DNA, 45 bp, Artificial Sequence
  Description of Artificial Sequence: Synthetic oligonucleotide
atgatattctgaatcacaagatgagagaattctgtatacgactgc

SEQ ID NO: 118187 - DNA, 44 bp, Artificial Sequence
  Description of Artificial Sequence: Synthetic oligonucleotide
tgatattctgaatcacaagatgagagaattctgtatacgactgc

SEQ ID NO: 118188 - DNA, 43 bp, Artificial Sequence
  Description of Artificial Sequence: Synthetic oligonucleotide
gatattctgaatcacaagatgagagaattctgtatacgactgc

SEQ ID NO: 118189 - DNA, 43 bp, Artificial Sequence
  Description of Artificial Sequence: Synthetic oligonucleotide
atattctgaatcacaagatgagagaattctgtatacgactgcg

SEQ ID NO: 118190 - DNA, 42 bp, Artificial Sequence
  Description of Artificial Sequence: Synthetic oligonucleotide
tattctgaatcacaagatgagagaattctgtatacgactgcg

SEQ ID NO: 118191 - DNA, 41 bp, Artificial Sequence
  Description of Artificial Sequence: Synthetic oligonucleotide
attctgaatcacaagatgagagaattctgtatacgactgcg

SEQ ID NO: 118192 - DNA, 40 bp, Artificial Sequence
  Description of Artificial Sequence: Synthetic oligonucleotide
ttctgaatcacaagatgagagaattctgtatacgactgcg

SEQ ID NO: 118193 - DNA, 39 bp, Artificial Sequence
  Description of Artificial Sequence: Synthetic oligonucleotide
tctgaatcacaagatgagagaattctgtatacgactgcg

SEQ ID NO: 118194 - DNA, 38 bp, Artificial Sequence
  Description of Artificial Sequence: Synthetic oligonucleotide
ctgaatcacaagatgagagaattctgtatacgactgcg

SEQ ID NO: 118195 - DNA, 38 bp, Artificial Sequence
  Description of Artificial Sequence: Synthetic oligonucleotide
tgaatcacaagatgagagaattctgtatacgactgcgg

SEQ ID NO: 118196 - DNA, 37 bp, Artificial Sequence
  Description of Artificial Sequence: Synthetic oligonucleotide
gaatcacaagatgagagaattctgtatacgactgcgg

SEQ ID NO: 118197 - DNA, 39 bp, Artificial Sequence
  Description of Artificial Sequence: Synthetic oligonucleotide
aatcacaagatgagagaattctgtatacgactgcggaac

SEQ ID NO: 118198 - DNA, 38 bp, Artificial Sequence
  Description of Artificial Sequence: Synthetic oligonucleotide
atcacaagatgagagaattctgtatacgactgcggaac

SEQ ID NO: 118199 - DNA, 37 bp, Artificial Sequence
  Description of Artificial Sequence: Synthetic oligonucleotide
tcacaagatgagagaattctgtatacgactgcggaac

SEQ ID NO: 118200 - DNA, 36 bp, Artificial Sequence
  Description of Artificial Sequence: Synthetic oligonucleotide
cacaagatgagagaattctgtatacgactgcggaac

SEQ ID NO: 118201 - DNA, 36 bp, Artificial Sequence
  Description of Artificial Sequence: Synthetic oligonucleotide
acaagatgagagaattctgtatacgactgcggaacc

SEQ ID NO: 118202 - DNA, 35 bp, Artificial Sequence
  Description of Artificial Sequence: Synthetic oligonucleotide
caagatgagagaattctgtatacgactgcggaacc

SEQ ID NO: 118203 - DNA, 36 bp, Artificial Sequence
  Description of Artificial Sequence: Synthetic oligonucleotide
aagatgagagaattctgtatacgactgcggaacctg

SEQ ID NO: 118204 - DNA, 35 bp, Artificial Sequence
  Description of Artificial Sequence: Synthetic oligonucleotide
agatgagagaattctgtatacgactgcggaacctg

SEQ ID NO: 118205 - DNA, 34 bp, Artificial Sequence
  Description of Artificial Sequence: Synthetic oligonucleotide
gatgagagaattctgtatacgactgcggaacctg

SEQ ID NO: 118206 - DNA, 34 bp, Artificial Sequence
  Description of Artificial Sequence: Synthetic oligonucleotide
atgagagaattctgtatacgactgcggaacctgg

SEQ ID NO: 118207 - DNA, 33 bp, Artificial Sequence
  Description of Artificial Sequence: Synthetic oligonucleotide
tgagagaattctgtatacgactgcggaacctgg

SEQ ID NO: 118208 - DNA, 32 bp, Artificial Sequence
  Description of Artificial Sequence: Synthetic oligonucleotide
gagagaattctgtatacgactgcggaacctgg

SEQ ID NO: 118209 - DNA, 34 bp, Artificial Sequence
  Description of Artificial Sequence: Synthetic oligonucleotide
agagaattctgtatacgactgcggaacctggtac

SEQ ID NO: 118210 - DNA, 33 bp, Artificial Sequence
  Description of Artificial Sequence: Synthetic oligonucleotide
gagaattctgtatacgactgcggaacctggtac

SEQ ID NO: 118211 - DNA, 34 bp, Artificial Sequence
  Description of Artificial Sequence: Synthetic oligonucleotide
agaattctgtatacgactgcggaacctggtacac

SEQ ID NO: 118212 - DNA, 33 bp, Artificial Sequence
  Description of Artificial Sequence: Synthetic oligonucleotide
gaattctgtatacgactgcggaacctggtacac

SEQ ID NO: 118213 - DNA, 34 bp, Artificial Sequence
  Description of Artificial Sequence: Synthetic oligonucleotide
aattctgtatacgactgcggaacctggtacacag

SEQ ID NO: 118214 - DNA, 33 bp, Artificial Sequence
  Description of Artificial Sequence: Synthetic oligonucleotide
attctgtatacgactgcggaacctggtacacag

SEQ ID NO: 118215 - DNA, 32 bp, Artificial Sequence
  Description of Artificial Sequence: Synthetic oligonucleotide
ttctgtatacgactgcggaacctggtacacag

SEQ ID NO: 118216 - DNA, 31 bp, Artificial Sequence
  Description of Artificial Sequence: Synthetic oligonucleotide
tctgtatacgactgcggaacctggtacacag

SEQ ID NO: 118217 - DNA, 30 bp, Artificial Sequence
  Description of Artificial Sequence: Synthetic oligonucleotide
ctgtatacgactgcggaacctggtacacag

SEQ ID NO: 118218 - DNA, 31 bp, Artificial Sequence
  Description of Artificial Sequence: Synthetic oligonucleotide
tgtatacgactgcggaacctggtacacagtg

SEQ ID NO: 118219 - DNA, 30 bp, Artificial Sequence
  Description of Artificial Sequence: Synthetic oligonucleotide
gtatacgactgcggaacctggtacacagtg

SEQ ID NO: 118220 - DNA, 30 bp, Artificial Sequence
  Description of Artificial Sequence: Synthetic oligonucleotide
tatacgactgcggaacctggtacacagtgg

SEQ ID NO: 118221 - DNA, 29 bp, Artificial Sequence
  Description of Artificial Sequence: Synthetic oligonucleotide
atacgactgcggaacctggtacacagtgg

SEQ ID NO: 118222 - DNA, 28 bp, Artificial Sequence
  Description of Artificial Sequence: Synthetic oligonucleotide
tacgactgcggaacctggtacacagtgg

SEQ ID NO: 118223 - DNA, 27 bp, Artificial Sequence
  Description of Artificial Sequence: Synthetic oligonucleotide
acgactgcggaacctggtacacagtgg

SEQ ID NO: 118224 - DNA, 27 bp, Artificial Sequence
  Description of Artificial Sequence: Synthetic oligonucleotide
cgactgcggaacctggtacacagtgga

SEQ ID NO: 118225 - DNA, 27 bp, Artificial Sequence
  Description of Artificial Sequence: Synthetic oligonucleotide
gactgcggaacctggtacacagtggag

SEQ ID NO: 118226 - DNA, 27 bp, Artificial Sequence
  Description of Artificial Sequence: Synthetic oligonucleotide
actgcggaacctggtacacagtggagc

SEQ ID NO: 118227 - DNA, 27 bp, Artificial Sequence
  Description of Artificial Sequence: Synthetic oligonucleotide
ctgcggaacctggtacacagtggagca

SEQ ID NO: 118228 - DNA, 28 bp, Artificial Sequence
  Description of Artificial Sequence: Synthetic oligonucleotide
tgcggaacctggtacacagtggagcaac

SEQ ID NO: 118229 - DNA, 27 bp, Artificial Sequence
  Description of Artificial Sequence: Synthetic oligonucleotide
gcggaacctggtacacagtggagcaac

SEQ ID NO: 118230 - DNA, 27 bp, Artificial Sequence
  Description of Artificial Sequence: Synthetic oligonucleotide
cggaacctggtacacagtggagcaacc

SEQ ID NO: 118231 - DNA, 30 bp, Artificial Sequence
  Description of Artificial Sequence: Synthetic oligonucleotide
ggaacctggtacacagtggagcaaccaaag

SEQ ID NO: 118232 - DNA, 30 bp, Artificial Sequence
  Description of Artificial Sequence: Synthetic oligonucleotide
gaacctggtacacagtggagcaaccaaagg

SEQ ID NO: 118233 - DNA, 31 bp, Artificial Sequence
  Description of Artificial Sequence: Synthetic oligonucleotide
aacctggtacacagtggagcaaccaaaggag

SEQ ID NO: 118234 - DNA, 30 bp, Artificial Sequence
  Description of Artificial Sequence: Synthetic oligonucleotide
acctggtacacagtggagcaaccaaaggag

SEQ ID NO: 118235 - DNA, 29 bp, Artificial Sequence
  Description of Artificial Sequence: Synthetic oligonucleotide
cctggtacacagtggagcaaccaaaggag

SEQ ID NO: 118236 - DNA, 33 bp, Artificial Sequence
  Description of Artificial Sequence: Synthetic oligonucleotide
ctggtacacagtggagcaaccaaaggagaaatc

SEQ ID NO: 118237 - DNA, 34 bp, Artificial Sequence
  Description of Artificial Sequence: Synthetic oligonucleotide
tggtacacagtggagcaaccaaaggagaaatctc

SEQ ID NO: 118238 - DNA, 33 bp, Artificial Sequence
  Description of Artificial Sequence: Synthetic oligonucleotide
ggtacacagtggagcaaccaaaggagaaatctc

SEQ ID NO: 118239 - DNA, 33 bp, Artificial Sequence
  Description of Artificial Sequence: Synthetic oligonucleotide
gtacacagtggagcaaccaaaggagaaatctcg

SEQ ID NO: 118240 - DNA, 33 bp, Artificial Sequence
  Description of Artificial Sequence: Synthetic oligonucleotide
tacacagtggagcaaccaaaggagaaatctcgg

SEQ ID NO: 118241 - DNA, 32 bp, Artificial Sequence
  Description of Artificial Sequence: Synthetic oligonucleotide
acacagtggagcaaccaaaggagaaatctcgg

SEQ ID NO: 118242 - DNA, 31 bp, Artificial Sequence
  Description of Artificial Sequence: Synthetic oligonucleotide
cacagtggagcaaccaaaggagaaatctcgg

SEQ ID NO: 118243 - DNA, 31 bp, Artificial Sequence
  Description of Artificial Sequence: Synthetic oligonucleotide
acagtggagcaaccaaaggagaaatctcggc

SEQ ID NO: 118244 - DNA, 30 bp, Artificial Sequence
  Description of Artificial Sequence: Synthetic oligonucleotide
cagtggagcaaccaaaggagaaatctcggc

SEQ ID NO: 118245 - DNA, 30 bp, Artificial Sequence
  Description of Artificial Sequence: Synthetic oligonucleotide
agtggagcaaccaaaggagaaatctcggcc

SEQ ID NO: 118246 - DNA, 29 bp, Artificial Sequence
  Description of Artificial Sequence: Synthetic oligonucleotide
gtggagcaaccaaaggagaaatctcggcc

SEQ ID NO: 118247 - DNA, 30 bp, Artificial Sequence
  Description of Artificial Sequence: Synthetic oligonucleotide
tggagcaaccaaaggagaaatctcggccac

SEQ ID NO: 118248 - DNA, 29 bp, Artificial Sequence
  Description of Artificial Sequence: Synthetic oligonucleotide
ggagcaaccaaaggagaaatctcggccac

SEQ ID NO: 118249 - DNA, 30 bp, Artificial Sequence
  Description of Artificial Sequence: Synthetic oligonucleotide
gagcaaccaaaggagaaatctcggccacac

SEQ ID NO: 118250 - DNA, 31 bp, Artificial Sequence
  Description of Artificial Sequence: Synthetic oligonucleotide
agcaaccaaaggagaaatctcggccacacag

SEQ ID NO: 118251 - DNA, 30 bp, Artificial Sequence
  Description of Artificial Sequence: Synthetic oligonucleotide
gcaaccaaaggagaaatctcggccacacag

SEQ ID NO: 118252 - DNA, 30 bp, Artificial Sequence
  Description of Artificial Sequence: Synthetic oligonucleotide
caaccaaaggagaaatctcggccacacagg

SEQ ID NO: 118253 - DNA, 31 bp, Artificial Sequence
  Description of Artificial Sequence: Synthetic oligonucleotide
aaccaaaggagaaatctcggccacacaggac

SEQ ID NO: 118254 - DNA, 30 bp, Artificial Sequence
  Description of Artificial Sequence: Synthetic oligonucleotide
accaaaggagaaatctcggccacacaggac

SEQ ID NO: 118255 - DNA, 29 bp, Artificial Sequence
  Description of Artificial Sequence: Synthetic oligonucleotide
ccaaaggagaaatctcggccacacaggac

SEQ ID NO: 118256 - DNA, 29 bp, Artificial Sequence
  Description of Artificial Sequence: Synthetic oligonucleotide
caaaggagaaatctcggccacacaggacg

SEQ ID NO: 118257 - DNA, 30 bp, Artificial Sequence
  Description of Artificial Sequence: Synthetic oligonucleotide
aaaggagaaatctcggccacacaggacgtc

SEQ ID NO: 118258 - DNA, 29 bp, Artificial Sequence
  Description of Artificial Sequence: Synthetic oligonucleotide
aaggagaaatctcggccacacaggacgtc

SEQ ID NO: 118259 - DNA, 28 bp, Artificial Sequence
  Description of Artificial Sequence: Synthetic oligonucleotide
aggagaaatctcggccacacaggacgtc

SEQ ID NO: 118260 - DNA, 27 bp, Artificial Sequence
  Description of Artificial Sequence: Synthetic oligonucleotide
ggagaaatctcggccacacaggacgtc

SEQ ID NO: 118261 - DNA, 29 bp, Artificial Sequence
  Description of Artificial Sequence: Synthetic oligonucleotide
gagaaatctcggccacacaggacgtcatg

SEQ ID NO: 118262 - DNA, 31 bp, Artificial Sequence
  Description of Artificial Sequence: Synthetic oligonucleotide
agaaatctcggccacacaggacgtcatgatg

SEQ ID NO: 118263 - DNA, 30 bp, Artificial Sequence
  Description of Artificial Sequence: Synthetic oligonucleotide
gaaatctcggccacacaggacgtcatgatg

SEQ ID NO: 118264 - DNA, 30 bp, Artificial Sequence
  Description of Artificial Sequence: Synthetic oligonucleotide
aaatctcggccacacaggacgtcatgatgg

SEQ ID NO: 118265 - DNA, 29 bp, Artificial Sequence
  Description of Artificial Sequence: Synthetic oligonucleotide
aatctcggccacacaggacgtcatgatgg

SEQ ID NO: 118266 - DNA, 28 bp, Artificial Sequence
  Description of Artificial Sequence: Synthetic oligonucleotide
atctcggccacacaggacgtcatgatgg

SEQ ID NO: 118267 - DNA, 27 bp, Artificial Sequence
  Description of Artificial Sequence: Synthetic oligonucleotide
tctcggccacacaggacgtcatgatgg

SEQ ID NO: 118268 - DNA, 27 bp, Artificial Sequence
  Description of Artificial Sequence: Synthetic oligonucleotide
ctcggccacacaggacgtcatgatgga

SEQ ID NO: 118269 - DNA, 27 bp, Artificial Sequence
  Description of Artificial Sequence: Synthetic oligonucleotide
tcggccacacaggacgtcatgatggag

SEQ ID NO: 118270 - DNA, 26 bp, Artificial Sequence
  Description of Artificial Sequence: Synthetic oligonucleotide
cggccacacaggacgtcatgatggag

SEQ ID NO: 118271 - DNA, 27 bp, Artificial Sequence
  Description of Artificial Sequence: Synthetic oligonucleotide
ggccacacaggacgtcatgatggagga

SEQ ID NO: 118272 - DNA, 27 bp, Artificial Sequence
  Description of Artificial Sequence: Synthetic oligonucleotide
gccacacaggacgtcatgatggaggag

SEQ ID NO: 118273 - DNA, 32 bp, Artificial Sequence
  Description of Artificial Sequence: Synthetic oligonucleotide
ccacacaggacgtcatgatggaggagatattc

SEQ ID NO: 118274 - DNA, 32 bp, Artificial Sequence
  Description of Artificial Sequence: Synthetic oligonucleotide
cacacaggacgtcatgatggaggagatattcc

SEQ ID NO: 118275 - DNA, 32 bp, Artificial Sequence
  Description of Artificial Sequence: Synthetic oligonucleotide
acacaggacgtcatgatggaggagatattccg

SEQ ID NO: 118276 - DNA, 31 bp, Artificial Sequence
  Description of Artificial Sequence: Synthetic oligonucleotide
cacaggacgtcatgatggaggagatattccg

SEQ ID NO: 118277 - DNA, 32 bp, Artificial Sequence
  Description of Artificial Sequence: Synthetic oligonucleotide
acaggacgtcatgatggaggagatattccgag

SEQ ID NO: 118278 - DNA, 31 bp, Artificial Sequence
  Description of Artificial Sequence: Synthetic oligonucleotide
caggacgtcatgatggaggagatattccgag

SEQ ID NO: 118279 - DNA, 32 bp, Artificial Sequence
  Description of Artificial Sequence: Synthetic oligonucleotide
aggacgtcatgatggaggagatattccgagtg

SEQ ID NO: 118280 - DNA, 31 bp, Artificial Sequence
  Description of Artificial Sequence: Synthetic oligonucleotide
ggacgtcatgatggaggagatattccgagtg

SEQ ID NO: 118281 - DNA, 31 bp, Artificial Sequence
  Description of Artificial Sequence: Synthetic oligonucleotide
gacgtcatgatggaggagatattccgagtgg

SEQ ID NO: 118282 - DNA, 32 bp, Artificial Sequence
  Description of Artificial Sequence: Synthetic oligonucleotide
acgtcatgatggaggagatattccgagtggtg

SEQ ID NO: 118283 - DNA, 31 bp, Artificial Sequence
  Description of Artificial Sequence: Synthetic oligonucleotide
cgtcatgatggaggagatattccgagtggtg

SEQ ID NO: 118284 - DNA, 32 bp, Artificial Sequence
  Description of Artificial Sequence: Synthetic oligonucleotide
gtcatgatggaggagatattccgagtggtgtg

SEQ ID NO: 118285 - DNA, 32 bp, Artificial Sequence
  Description of Artificial Sequence: Synthetic oligonucleotide
tcatgatggaggagatattccgagtggtgtgc

SEQ ID NO: 118286 - DNA, 31 bp, Artificial Sequence
  Description of Artificial Sequence: Synthetic oligonucleotide
catgatggaggagatattccgagtggtgtgc

SEQ ID NO: 118287 - DNA, 33 bp, Artificial Sequence
  Description of Artificial Sequence: Synthetic oligonucleotide
atgatggaggagatattccgagtggtgtgcatc

SEQ ID NO: 118288 - DNA, 32 bp, Artificial Sequence
  Description of Artificial Sequence: Synthetic oligonucleotide
tgatggaggagatattccgagtggtgtgcatc

SEQ ID NO: 118289 - DNA, 31 bp, Artificial Sequence
  Description of Artificial Sequence: Synthetic oligonucleotide
gatggaggagatattccgagtggtgtgcatc

SEQ ID NO: 118290 - DNA, 32 bp, Artificial Sequence
  Description of Artificial Sequence: Synthetic oligonucleotide
atggaggagatattccgagtggtgtgcatctg

SEQ ID NO: 118291 - DNA, 31 bp, Artificial Sequence
  Description of Artificial Sequence: Synthetic oligonucleotide
tggaggagatattccgagtggtgtgcatctg

SEQ ID NO: 118292 - DNA, 30 bp, Artificial Sequence
  Description of Artificial Sequence: Synthetic oligonucleotide
ggaggagatattccgagtggtgtgcatctg

SEQ ID NO: 118293 - DNA, 33 bp, Artificial Sequence
  Description of Artificial Sequence: Synthetic oligonucleotide
gaggagatattccgagtggtgtgcatctgtttg

SEQ ID NO: 118294 - DNA, 33 bp, Artificial Sequence
  Description of Artificial Sequence: Synthetic oligonucleotide
aggagatattccgagtggtgtgcatctgtttgg

SEQ ID NO: 118295 - DNA, 32 bp, Artificial Sequence
  Description of Artificial Sequence: Synthetic oligonucleotide
ggagatattccgagtggtgtgcatctgtttgg

SEQ ID NO: 118296 - DNA, 32 bp, Artificial Sequence
  Description of Artificial Sequence: Synthetic oligonucleotide
gagatattccgagtggtgtgcatctgtttggg

SEQ ID NO: 118297 - DNA, 36 bp, Artificial Sequence
  Description of Artificial Sequence: Synthetic oligonucleotide
agatattccgagtggtgtgcatctgtttgggtaatc

SEQ ID NO: 118298 - DNA, 35 bp, Artificial Sequence
  Description of Artificial Sequence: Synthetic oligonucleotide
gatattccgagtggtgtgcatctgtttgggtaatc

SEQ ID NO: 118299 - DNA, 35 bp, Artificial Sequence
  Description of Artificial Sequence: Synthetic oligonucleotide
atattccgagtggtgtgcatctgtttgggtaatcc

SEQ ID NO: 118300 - DNA, 34 bp, Artificial Sequence
  Description of Artificial Sequence: Synthetic oligonucleotide
tattccgagtggtgtgcatctgtttgggtaatcc

SEQ ID NO: 118301 - DNA, 33 bp, Artificial Sequence
  Description of Artificial Sequence: Synthetic oligonucleotide
attccgagtggtgtgcatctgtttgggtaatcc

SEQ ID NO: 118302 - DNA, 32 bp, Artificial Sequence
  Description of Artificial Sequence: Synthetic oligonucleotide
ttccgagtggtgtgcatctgtttgggtaatcc

SEQ ID NO: 118303 - DNA, 31 bp, Artificial Sequence
  Description of Artificial Sequence: Synthetic oligonucleotide
tccgagtggtgtgcatctgtttgggtaatcc

SEQ ID NO: 118304 - DNA, 30 bp, Artificial Sequence
  Description of Artificial Sequence: Synthetic oligonucleotide
ccgagtggtgtgcatctgtttgggtaatcc

SEQ ID NO: 118305 - DNA, 31 bp, Artificial Sequence
  Description of Artificial Sequence: Synthetic oligonucleotide
cgagtggtgtgcatctgtttgggtaatccac

SEQ ID NO: 118306 - DNA, 31 bp, Artificial Sequence
  Description of Artificial Sequence: Synthetic oligonucleotide
gagtggtgtgcatctgtttgggtaatccacc

SEQ ID NO: 118307 - DNA, 32 bp, Artificial Sequence
  Description of Artificial Sequence: Synthetic oligonucleotide
agtggtgtgcatctgtttgggtaatccaccag

SEQ ID NO: 118308 - DNA, 31 bp, Artificial Sequence
  Description of Artificial Sequence: Synthetic oligonucleotide
gtggtgtgcatctgtttgggtaatccaccag

SEQ ID NO: 118309 - DNA, 32 bp, Artificial Sequence
  Description of Artificial Sequence: Synthetic oligonucleotide
tggtgtgcatctgtttgggtaatccaccagag

SEQ ID NO: 118310 - DNA, 31 bp, Artificial Sequence
  Description of Artificial Sequence: Synthetic oligonucleotide
ggtgtgcatctgtttgggtaatccaccagag

SEQ ID NO: 118311 - DNA, 32 bp, Artificial Sequence
  Description of Artificial Sequence: Synthetic oligonucleotide
gtgtgcatctgtttgggtaatccaccagagac

SEQ ID NO: 118312 - DNA, 35 bp, Artificial Sequence
  Description of Artificial Sequence: Synthetic oligonucleotide
tgtgcatctgtttgggtaatccaccagagacattc

SEQ ID NO: 118313 - DNA, 34 bp, Artificial Sequence
  Description of Artificial Sequence: Synthetic oligonucleotide
gtgcatctgtttgggtaatccaccagagacattc

SEQ ID NO: 118314 - DNA, 35 bp, Artificial Sequence
  Description of Artificial Sequence: Synthetic oligonucleotide
tgcatctgtttgggtaatccaccagagacattcac

SEQ ID NO: 118315 - DNA, 34 bp, Artificial Sequence
  Description of Artificial Sequence: Synthetic oligonucleotide
gcatctgtttgggtaatccaccagagacattcac

SEQ ID NO: 118316 - DNA, 34 bp, Artificial Sequence
  Description of Artificial Sequence: Synthetic oligonucleotide
catctgtttgggtaatccaccagagacattcacc

SEQ ID NO: 118317 - DNA, 35 bp, Artificial Sequence
  Description of Artificial Sequence: Synthetic oligonucleotide
atctgtttgggtaatccaccagagacattcacctg

SEQ ID NO: 118318 - DNA, 34 bp, Artificial Sequence
  Description of Artificial Sequence: Synthetic oligonucleotide
tctgtttgggtaatccaccagagacattcacctg

SEQ ID NO: 118319 - DNA, 33 bp, Artificial Sequence
  Description of Artificial Sequence: Synthetic oligonucleotide
ctgtttgggtaatccaccagagacattcacctg

SEQ ID NO: 118320 - DNA, 33 bp, Artificial Sequence
  Description of Artificial Sequence: Synthetic oligonucleotide
tgtttgggtaatccaccagagacattcacctgg

SEQ ID NO: 118321 - DNA, 32 bp, Artificial Sequence
  Description of Artificial Sequence: Synthetic oligonucleotide
gtttgggtaatccaccagagacattcacctgg

SEQ ID NO: 118322 - DNA, 32 bp, Artificial Sequence
  Description of Artificial Sequence: Synthetic oligonucleotide
tttgggtaatccaccagagacattcacctggg

SEQ ID NO: 118323 - DNA, 31 bp, Artificial Sequence
  Description of Artificial Sequence: Synthetic oligonucleotide
ttgggtaatccaccagagacattcacctggg

SEQ ID NO: 118324 - DNA, 30 bp, Artificial Sequence
  Description of Artificial Sequence: Synthetic oligonucleotide
tgggtaatccaccagagacattcacctggg

SEQ ID NO: 118325 - DNA, 29 bp, Artificial Sequence
  Description of Artificial Sequence: Synthetic oligonucleotide
gggtaatccaccagagacattcacctggg

SEQ ID NO: 118326 - DNA, 34 bp, Artificial Sequence
  Description of Artificial Sequence: Synthetic oligonucleotide
ggtaatccaccagagacattcacctgggaatatc

SEQ ID NO: 118327 - DNA, 34 bp, Artificial Sequence
  Description of Artificial Sequence: Synthetic oligonucleotide
gtaatccaccagagacattcacctgggaatatcg

SEQ ID NO: 118328 - DNA, 35 bp, Artificial Sequence
  Description of Artificial Sequence: Synthetic oligonucleotide
taatccaccagagacattcacctgggaatatcgag

SEQ ID NO: 118329 - DNA, 34 bp, Artificial Sequence
  Description of Artificial Sequence: Synthetic oligonucleotide
aatccaccagagacattcacctgggaatatcgag

SEQ ID NO: 118330 - DNA, 33 bp, Artificial Sequence
  Description of Artificial Sequence: Synthetic oligonucleotide
atccaccagagacattcacctgggaatatcgag

SEQ ID NO: 118331 - DNA, 32 bp, Artificial Sequence
  Description of Artificial Sequence: Synthetic oligonucleotide
tccaccagagacattcacctgggaatatcgag

SEQ ID NO: 118332 - DNA, 31 bp, Artificial Sequence
  Description of Artificial Sequence: Synthetic oligonucleotide
ccaccagagacattcacctgggaatatcgag

SEQ ID NO: 118333 - DNA, 32 bp, Artificial Sequence
  Description of Artificial Sequence: Synthetic oligonucleotide
caccagagacattcacctgggaatatcgagac

SEQ ID NO: 118334 - DNA, 35 bp, Artificial Sequence
  Description of Artificial Sequence: Synthetic oligonucleotide
accagagacattcacctgggaatatcgagacaaag

SEQ ID NO: 118335 - DNA, 34 bp, Artificial Sequence
  Description of Artificial Sequence: Synthetic oligonucleotide
ccagagacattcacctgggaatatcgagacaaag

SEQ ID NO: 118336 - DNA, 45 bp, Artificial Sequence
  Description of Artificial Sequence: Synthetic oligonucleotide
cagagacattcacctgggaatatcgagacaaagataaaaattatc

SEQ ID NO: 118337 - DNA, 46 bp, Artificial Sequence
  Description of Artificial Sequence: Synthetic oligonucleotide
agagacattcacctgggaatatcgagacaaagataaaaattatcag

SEQ ID NO: 118338 - DNA, 45 bp, Artificial Sequence
  Description of Artificial Sequence: Synthetic oligonucleotide
gagacattcacctgggaatatcgagacaaagataaaaattatcag

SEQ ID NO: 118339 - DNA, 51 bp, Artificial Sequence
  Description of Artificial Sequence: Synthetic oligonucleotide
agacattcacctgggaatatcgagacaaagataaaaattatcagaaaattg

SEQ ID NO: 118340 - DNA, 50 bp, Artificial Sequence
  Description of Artificial Sequence: Synthetic oligonucleotide
gacattcacctgggaatatcgagacaaagataaaaattatcagaaaattg

SEQ ID NO: 118341 - DNA, 50 bp, Artificial Sequence
  Description of Artificial Sequence: Synthetic oligonucleotide
acattcacctgggaatatcgagacaaagataaaaattatcagaaaattgg

SEQ ID NO: 118342 - DNA, 49 bp, Artificial Sequence
  Description of Artificial Sequence: Synthetic oligonucleotide
cattcacctgggaatatcgagacaaagataaaaattatcagaaaattgg

SEQ ID NO: 118343 - DNA, 49 bp, Artificial Sequence
  Description of Artificial Sequence: Synthetic oligonucleotide
attcacctgggaatatcgagacaaagataaaaattatcagaaaattggc

SEQ ID NO: 118344 - DNA, 48 bp, Artificial Sequence
  Description of Artificial Sequence: Synthetic oligonucleotide
ttcacctgggaatatcgagacaaagataaaaattatcagaaaattggc

SEQ ID NO: 118345 - DNA, 47 bp, Artificial Sequence
  Description of Artificial Sequence: Synthetic oligonucleotide
tcacctgggaatatcgagacaaagataaaaattatcagaaaattggc

SEQ ID NO: 118346 - DNA, 46 bp, Artificial Sequence
  Description of Artificial Sequence: Synthetic oligonucleotide
cacctgggaatatcgagacaaagataaaaattatcagaaaattggc

SEQ ID NO: 118347 - DNA, 46 bp, Artificial Sequence
  Description of Artificial Sequence: Synthetic oligonucleotide
acctgggaatatcgagacaaagataaaaattatcagaaaattggcc

SEQ ID NO: 118348 - DNA, 45 bp, Artificial Sequence
  Description of Artificial Sequence: Synthetic oligonucleotide
cctgggaatatcgagacaaagataaaaattatcagaaaattggcc

SEQ ID NO: 118349 - DNA, 45 bp, Artificial Sequence
  Description of Artificial Sequence: Synthetic oligonucleotide
ctgggaatatcgagacaaagataaaaattatcagaaaattggccc

SEQ ID NO: 118350 - DNA, 45 bp, Artificial Sequence
  Description of Artificial Sequence: Synthetic oligonucleotide
tgggaatatcgagacaaagataaaaattatcagaaaattggcccc

SEQ ID NO: 118351 - DNA, 44 bp, Artificial Sequence
  Description of Artificial Sequence: Synthetic oligonucleotide
gggaatatcgagacaaagataaaaattatcagaaaattggcccc

SEQ ID NO: 118352 - DNA, 48 bp, Artificial Sequence
  Description of Artificial Sequence: Synthetic oligonucleotide
ggaatatcgagacaaagataaaaattatcagaaaattggccccataac

SEQ ID NO: 118353 - DNA, 49 bp, Artificial Sequence
  Description of Artificial Sequence: Synthetic oligonucleotide
gaatatcgagacaaagataaaaattatcagaaaattggccccataacac

SEQ ID NO: 118354 - DNA, 49 bp, Artificial Sequence
  Description of Artificial Sequence: Synthetic oligonucleotide
aatatcgagacaaagataaaaattatcagaaaattggccccataacacc

SEQ ID NO: 118355 - DNA, 48 bp, Artificial Sequence
  Description of Artificial Sequence: Synthetic oligonucleotide
atatcgagacaaagataaaaattatcagaaaattggccccataacacc

SEQ ID NO: 118356 - DNA, 47 bp, Artificial Sequence
  Description of Artificial Sequence: Synthetic oligonucleotide
tatcgagacaaagataaaaattatcagaaaattggccccataacacc

SEQ ID NO: 118357 - DNA, 46 bp, Artificial Sequence
  Description of Artificial Sequence: Synthetic oligonucleotide
atcgagacaaagataaaaattatcagaaaattggccccataacacc

SEQ ID NO: 118358 - DNA, 45 bp, Artificial Sequence
  Description of Artificial Sequence: Synthetic oligonucleotide
tcgagacaaagataaaaattatcagaaaattggccccataacacc

SEQ ID NO: 118359 - DNA, 44 bp, Artificial Sequence
  Description of Artificial Sequence: Synthetic oligonucleotide
cgagacaaagataaaaattatcagaaaattggccccataacacc

SEQ ID NO: 118360 - DNA, 44 bp, Artificial Sequence
  Description of Artificial Sequence: Synthetic oligonucleotide
gagacaaagataaaaattatcagaaaattggccccataacaccc

SEQ ID NO: 118361 - DNA, 46 bp, Artificial Sequence
  Description of Artificial Sequence: Synthetic oligonucleotide
agacaaagataaaaattatcagaaaattggccccataacacccttg

SEQ ID NO: 118362 - DNA, 45 bp, Artificial Sequence
  Description of Artificial Sequence: Synthetic oligonucleotide
gacaaagataaaaattatcagaaaattggccccataacacccttg

SEQ ID NO: 118363 - DNA, 45 bp, Artificial Sequence
  Description of Artificial Sequence: Synthetic oligonucleotide
acaaagataaaaattatcagaaaattggccccataacacccttgg

SEQ ID NO: 118364 - DNA, 44 bp, Artificial Sequence
  Description of Artificial Sequence: Synthetic oligonucleotide
caaagataaaaattatcagaaaattggccccataacacccttgg

SEQ ID NO: 118365 - DNA, 45 bp, Artificial Sequence
  Description of Artificial Sequence: Synthetic oligonucleotide
aaagataaaaattatcagaaaattggccccataacacccttggag

SEQ ID NO: 118366 - DNA, 44 bp, Artificial Sequence
  Description of Artificial Sequence: Synthetic oligonucleotide
aagataaaaattatcagaaaattggccccataacacccttggag

SEQ ID NO: 118367 - DNA, 43 bp, Artificial Sequence
  Description of Artificial Sequence: Synthetic oligonucleotide
agataaaaattatcagaaaattggccccataacacccttggag

SEQ ID NO: 118368 - DNA, 42 bp, Artificial Sequence
  Description of Artificial Sequence: Synthetic oligonucleotide
gataaaaattatcagaaaattggccccataacacccttggag

SEQ ID NO: 118369 - DNA, 47 bp, Artificial Sequence
  Description of Artificial Sequence: Synthetic oligonucleotide
ataaaaattatcagaaaattggccccataacacccttggagttttac

SEQ ID NO: 118370 - DNA, 46 bp, Artificial Sequence
  Description of Artificial Sequence: Synthetic oligonucleotide
taaaaattatcagaaaattggccccataacacccttggagttttac

SEQ ID NO: 118371 - DNA, 45 bp, Artificial Sequence
  Description of Artificial Sequence: Synthetic oligonucleotide
aaaaattatcagaaaattggccccataacacccttggagttttac

SEQ ID NO: 118372 - DNA, 44 bp, Artificial Sequence
  Description of Artificial Sequence: Synthetic oligonucleotide
aaaattatcagaaaattggccccataacacccttggagttttac

SEQ ID NO: 118373 - DNA, 43 bp, Artificial Sequence
  Description of Artificial Sequence: Synthetic oligonucleotide
aaattatcagaaaattggccccataacacccttggagttttac

SEQ ID NO: 118374 - DNA, 42 bp, Artificial Sequence
  Description of Artificial Sequence: Synthetic oligonucleotide
aattatcagaaaattggccccataacacccttggagttttac

SEQ ID NO: 118375 - DNA, 41 bp, Artificial Sequence
  Description of Artificial Sequence: Synthetic oligonucleotide
attatcagaaaattggccccataacacccttggagttttac

SEQ ID NO: 118376 - DNA, 40 bp, Artificial Sequence
  Description of Artificial Sequence: Synthetic oligonucleotide
ttatcagaaaattggccccataacacccttggagttttac

SEQ ID NO: 118377 - DNA, 39 bp, Artificial Sequence
  Description of Artificial Sequence: Synthetic oligonucleotide
tatcagaaaattggccccataacacccttggagttttac

SEQ ID NO: 118378 - DNA, 38 bp, Artificial Sequence
  Description of Artificial Sequence: Synthetic oligonucleotide
atcagaaaattggccccataacacccttggagttttac

SEQ ID NO: 118379 - DNA, 37 bp, Artificial Sequence
  Description of Artificial Sequence: Synthetic oligonucleotide
tcagaaaattggccccataacacccttggagttttac

SEQ ID NO: 118380 - DNA, 36 bp, Artificial Sequence
  Description of Artificial Sequence: Synthetic oligonucleotide
cagaaaattggccccataacacccttggagttttac

SEQ ID NO: 118381 - DNA, 37 bp, Artificial Sequence
  Description of Artificial Sequence: Synthetic oligonucleotide
agaaaattggccccataacacccttggagttttacag

SEQ ID NO: 118382 - DNA, 36 bp, Artificial Sequence
  Description of Artificial Sequence: Synthetic oligonucleotide
gaaaattggccccataacacccttggagttttacag

SEQ ID NO: 118383 - DNA, 36 bp, Artificial Sequence
  Description of Artificial Sequence: Synthetic oligonucleotide
aaaattggccccataacacccttggagttttacagg

SEQ ID NO: 118384 - DNA, 35 bp, Artificial Sequence
  Description of Artificial Sequence: Synthetic oligonucleotide
aaattggccccataacacccttggagttttacagg

SEQ ID NO: 118385 - DNA, 34 bp, Artificial Sequence
  Description of Artificial Sequence: Synthetic oligonucleotide
aattggccccataacacccttggagttttacagg

SEQ ID NO: 118386 - DNA, 33 bp, Artificial Sequence
  Description of Artificial Sequence: Synthetic oligonucleotide
attggccccataacacccttggagttttacagg

SEQ ID NO: 118387 - DNA, 32 bp, Artificial Sequence
  Description of Artificial Sequence: Synthetic oligonucleotide
ttggccccataacacccttggagttttacagg

SEQ ID NO: 118388 - DNA, 31 bp, Artificial Sequence
  Description of Artificial Sequence: Synthetic oligonucleotide
tggccccataacacccttggagttttacagg

SEQ ID NO: 118389 - DNA, 30 bp, Artificial Sequence
  Description of Artificial Sequence: Synthetic oligonucleotide
ggccccataacacccttggagttttacagg

SEQ ID NO: 118390 - DNA, 30 bp, Artificial Sequence
  Description of Artificial Sequence: Synthetic oligonucleotide
gccccataacacccttggagttttacaggg

SEQ ID NO: 118391 - DNA, 32 bp, Artificial Sequence
  Description of Artificial Sequence: Synthetic oligonucleotide
ccccataacacccttggagttttacagggaac

SEQ ID NO: 118392 - DNA, 34 bp, Artificial Sequence
  Description of Artificial Sequence: Synthetic oligonucleotide
cccataacacccttggagttttacagggaacatg

SEQ ID NO: 118393 - DNA, 35 bp, Artificial Sequence
  Description of Artificial Sequence: Synthetic oligonucleotide
ccataacacccttggagttttacagggaacatgtc

SEQ ID NO: 118394 - DNA, 37 bp, Artificial Sequence
  Description of Artificial Sequence: Synthetic oligonucleotide
cataacacccttggagttttacagggaacatgtcaag

SEQ ID NO: 118395 - DNA, 37 bp, Artificial Sequence
  Description of Artificial Sequence: Synthetic oligonucleotide
ataacacccttggagttttacagggaacatgtcaagc

SEQ ID NO: 118396 - DNA, 36 bp, Artificial Sequence
  Description of Artificial Sequence: Synthetic oligonucleotide
taacacccttggagttttacagggaacatgtcaagc

SEQ ID NO: 118397 - DNA, 35 bp, Artificial Sequence
  Description of Artificial Sequence: Synthetic oligonucleotide
aacacccttggagttttacagggaacatgtcaagc

SEQ ID NO: 118398 - DNA, 34 bp, Artificial Sequence
  Description of Artificial Sequence: Synthetic oligonucleotide
acacccttggagttttacagggaacatgtcaagc

SEQ ID NO: 118399 - DNA, 33 bp, Artificial Sequence
  Description of Artificial Sequence: Synthetic oligonucleotide
cacccttggagttttacagggaacatgtcaagc

SEQ ID NO: 118400 - DNA, 33 bp, Artificial Sequence
  Description of Artificial Sequence: Synthetic oligonucleotide
acccttggagttttacagggaacatgtcaagcc

SEQ ID NO: 118401 - DNA, 32 bp, Artificial Sequence
  Description of Artificial Sequence: Synthetic oligonucleotide
cccttggagttttacagggaacatgtcaagcc

SEQ ID NO: 118402 - DNA, 33 bp, Artificial Sequence
  Description of Artificial Sequence: Synthetic oligonucleotide
ccttggagttttacagggaacatgtcaagccac

SEQ ID NO: 118403 - DNA, 34 bp, Artificial Sequence
  Description of Artificial Sequence: Synthetic oligonucleotide
cttggagttttacagggaacatgtcaagccactc

SEQ ID NO: 118404 - DNA, 36 bp, Artificial Sequence
  Description of Artificial Sequence: Synthetic oligonucleotide
ttggagttttacagggaacatgtcaagccactcttc

SEQ ID NO: 118405 - DNA, 35 bp, Artificial Sequence
  Description of Artificial Sequence: Synthetic oligonucleotide
tggagttttacagggaacatgtcaagccactcttc

SEQ ID NO: 118406 - DNA, 34 bp, Artificial Sequence
  Description of Artificial Sequence: Synthetic oligonucleotide
ggagttttacagggaacatgtcaagccactcttc

SEQ ID NO: 118407 - DNA, 39 bp, Artificial Sequence
  Description of Artificial Sequence: Synthetic oligonucleotide
gagttttacagggaacatgtcaagccactcttcaatatg

SEQ ID NO: 118408 - DNA, 39 bp, Artificial Sequence
  Description of Artificial Sequence: Synthetic oligonucleotide
agttttacagggaacatgtcaagccactcttcaatatgg

SEQ ID NO: 118409 - DNA, 38 bp, Artificial Sequence
  Description of Artificial Sequence: Synthetic oligonucleotide
gttttacagggaacatgtcaagccactcttcaatatgg

SEQ ID NO: 118410 - DNA, 40 bp, Artificial Sequence
  Description of Artificial Sequence: Synthetic oligonucleotide
ttttacagggaacatgtcaagccactcttcaatatggaag

SEQ ID NO: 118411 - DNA, 39 bp, Artificial Sequence
  Description of Artificial Sequence: Synthetic oligonucleotide
tttacagggaacatgtcaagccactcttcaatatggaag

SEQ ID NO: 118412 - DNA, 38 bp, Artificial Sequence
  Description of Artificial Sequence: Synthetic oligonucleotide
ttacagggaacatgtcaagccactcttcaatatggaag

SEQ ID NO: 118413 - DNA, 37 bp, Artificial Sequence
  Description of Artificial Sequence: Synthetic oligonucleotide
tacagggaacatgtcaagccactcttcaatatggaag

SEQ ID NO: 118414 - DNA, 36 bp, Artificial Sequence
  Description of Artificial Sequence: Synthetic oligonucleotide
acagggaacatgtcaagccactcttcaatatggaag

SEQ ID NO: 118415 - DNA, 35 bp, Artificial Sequence
  Description of Artificial Sequence: Synthetic oligonucleotide
cagggaacatgtcaagccactcttcaatatggaag

SEQ ID NO: 118416 - DNA, 39 bp, Artificial Sequence
  Description of Artificial Sequence: Synthetic oligonucleotide
agggaacatgtcaagccactcttcaatatggaagataag

SEQ ID NO: 118417 - DNA, 38 bp, Artificial Sequence
  Description of Artificial Sequence: Synthetic oligonucleotide
gggaacatgtcaagccactcttcaatatggaagataag

SEQ ID NO: 118418 - DNA, 42 bp, Artificial Sequence
  Description of Artificial Sequence: Synthetic oligonucleotide
ggaacatgtcaagccactcttcaatatggaagataagatttg

SEQ ID NO: 118419 - DNA, 46 bp, Artificial Sequence
  Description of Artificial Sequence: Synthetic oligonucleotide
gaacatgtcaagccactcttcaatatggaagataagatttgtttag

SEQ ID NO: 118420 - DNA, 47 bp, Artificial Sequence
  Description of Artificial Sequence: Synthetic oligonucleotide
aacatgtcaagccactcttcaatatggaagataagatttgtttagtg

SEQ ID NO: 118421 - DNA, 46 bp, Artificial Sequence
  Description of Artificial Sequence: Synthetic oligonucleotide
acatgtcaagccactcttcaatatggaagataagatttgtttagtg

SEQ ID NO: 118422 - DNA, 45 bp, Artificial Sequence
  Description of Artificial Sequence: Synthetic oligonucleotide
catgtcaagccactcttcaatatggaagataagatttgtttagtg

SEQ ID NO: 118423 - DNA, 48 bp, Artificial Sequence
  Description of Artificial Sequence: Synthetic oligonucleotide
atgtcaagccactcttcaatatggaagataagatttgtttagtgaatg

SEQ ID NO: 118424 - DNA, 47 bp, Artificial Sequence
  Description of Artificial Sequence: Synthetic oligonucleotide
tgtcaagccactcttcaatatggaagataagatttgtttagtgaatg

SEQ ID NO: 118425 - DNA, 46 bp, Artificial Sequence
  Description of Artificial Sequence: Synthetic oligonucleotide
gtcaagccactcttcaatatggaagataagatttgtttagtgaatg

SEQ ID NO: 118426 - DNA, 47 bp, Artificial Sequence
  Description of Artificial Sequence: Synthetic oligonucleotide
tcaagccactcttcaatatggaagataagatttgtttagtgaatgac

SEQ ID NO: 118427 - DNA, 46 bp, Artificial Sequence
  Description of Artificial Sequence: Synthetic oligonucleotide
caagccactcttcaatatggaagataagatttgtttagtgaatgac

SEQ ID NO: 118428 - DNA, 46 bp, Artificial Sequence
  Description of Artificial Sequence: Synthetic oligonucleotide
aagccactcttcaatatggaagataagatttgtttagtgaatgacc

SEQ ID NO: 118429 - DNA, 45 bp, Artificial Sequence
  Description of Artificial Sequence: Synthetic oligonucleotide
agccactcttcaatatggaagataagatttgtttagtgaatgacc

SEQ ID NO: 118430 - DNA, 44 bp, Artificial Sequence
  Description of Artificial Sequence: Synthetic oligonucleotide
gccactcttcaatatggaagataagatttgtttagtgaatgacc

SEQ ID NO: 118431 - DNA, 44 bp, Artificial Sequence
  Description of Artificial Sequence: Synthetic oligonucleotide
ccactcttcaatatggaagataagatttgtttagtgaatgaccc

SEQ ID NO: 118432 - DNA, 46 bp, Artificial Sequence
  Description of Artificial Sequence: Synthetic oligonucleotide
cactcttcaatatggaagataagatttgtttagtgaatgaccctag

SEQ ID NO: 118433 - DNA, 46 bp, Artificial Sequence
  Description of Artificial Sequence: Synthetic oligonucleotide
actcttcaatatggaagataagatttgtttagtgaatgaccctagg

SEQ ID NO: 118434 - DNA, 45 bp, Artificial Sequence
  Description of Artificial Sequence: Synthetic oligonucleotide
ctcttcaatatggaagataagatttgtttagtgaatgaccctagg

SEQ ID NO: 118435 - DNA, 45 bp, Artificial Sequence
  Description of Artificial Sequence: Synthetic oligonucleotide
tcttcaatatggaagataagatttgtttagtgaatgaccctaggc

SEQ ID NO: 118436 - DNA, 44 bp, Artificial Sequence
  Description of Artificial Sequence: Synthetic oligonucleotide
cttcaatatggaagataagatttgtttagtgaatgaccctaggc

SEQ ID NO: 118437 - DNA, 44 bp, Artificial Sequence
  Description of Artificial Sequence: Synthetic oligonucleotide
ttcaatatggaagataagatttgtttagtgaatgaccctaggcc

SEQ ID NO: 118438 - DNA, 43 bp, Artificial Sequence
  Description of Artificial Sequence: Synthetic oligonucleotide
tcaatatggaagataagatttgtttagtgaatgaccctaggcc

SEQ ID NO: 118439 - DNA, 42 bp, Artificial Sequence
  Description of Artificial Sequence: Synthetic oligonucleotide
caatatggaagataagatttgtttagtgaatgaccctaggcc

SEQ ID NO: 118440 - DNA, 42 bp, Artificial Sequence
  Description of Artificial Sequence: Synthetic oligonucleotide
aatatggaagataagatttgtttagtgaatgaccctaggccc

SEQ ID NO: 118441 - DNA, 41 bp, Artificial Sequence
  Description of Artificial Sequence: Synthetic oligonucleotide
atatggaagataagatttgtttagtgaatgaccctaggccc

SEQ ID NO: 118442 - DNA, 40 bp, Artificial Sequence
  Description of Artificial Sequence: Synthetic oligonucleotide
tatggaagataagatttgtttagtgaatgaccctaggccc

SEQ ID NO: 118443 - DNA, 39 bp, Artificial Sequence
  Description of Artificial Sequence: Synthetic oligonucleotide
atggaagataagatttgtttagtgaatgaccctaggccc

SEQ ID NO: 118444 - DNA, 38 bp, Artificial Sequence
  Description of Artificial Sequence: Synthetic oligonucleotide
tggaagataagatttgtttagtgaatgaccctaggccc

SEQ ID NO: 118445 - DNA, 37 bp, Artificial Sequence
  Description of Artificial Sequence: Synthetic oligonucleotide
ggaagataagatttgtttagtgaatgaccctaggccc

SEQ ID NO: 118446 - DNA, 37 bp, Artificial Sequence
  Description of Artificial Sequence: Synthetic oligonucleotide
gaagataagatttgtttagtgaatgaccctaggcccc

SEQ ID NO: 118447 - DNA, 38 bp, Artificial Sequence
  Description of Artificial Sequence: Synthetic oligonucleotide
aagataagatttgtttagtgaatgaccctaggccccag

SEQ ID NO: 118448 - DNA, 37 bp, Artificial Sequence
  Description of Artificial Sequence: Synthetic oligonucleotide
agataagatttgtttagtgaatgaccctaggccccag

SEQ ID NO: 118449 - DNA, 36 bp, Artificial Sequence
  Description of Artificial Sequence: Synthetic oligonucleotide
gataagatttgtttagtgaatgaccctaggccccag

SEQ ID NO: 118450 - DNA, 36 bp, Artificial Sequence
  Description of Artificial Sequence: Synthetic oligonucleotide
ataagatttgtttagtgaatgaccctaggccccagc

SEQ ID NO: 118451 - DNA, 35 bp, Artificial Sequence
  Description of Artificial Sequence: Synthetic oligonucleotide
taagatttgtttagtgaatgaccctaggccccagc

SEQ ID NO: 118452 - DNA, 34 bp, Artificial Sequence
  Description of Artificial Sequence: Synthetic oligonucleotide
aagatttgtttagtgaatgaccctaggccccagc

SEQ ID NO: 118453 - DNA, 33 bp, Artificial Sequence
  Description of Artificial Sequence: Synthetic oligonucleotide
agatttgtttagtgaatgaccctaggccccagc

SEQ ID NO: 118454 - DNA, 32 bp, Artificial Sequence
  Description of Artificial Sequence: Synthetic oligonucleotide
gatttgtttagtgaatgaccctaggccccagc

SEQ ID NO: 118455 - DNA, 33 bp, Artificial Sequence
  Description of Artificial Sequence: Synthetic oligonucleotide
atttgtttagtgaatgaccctaggccccagcac

SEQ ID NO: 118456 - DNA, 32 bp, Artificial Sequence
  Description of Artificial Sequence: Synthetic oligonucleotide
tttgtttagtgaatgaccctaggccccagcac

SEQ ID NO: 118457 - DNA, 31 bp, Artificial Sequence
  Description of Artificial Sequence: Synthetic oligonucleotide
ttgtttagtgaatgaccctaggccccagcac

SEQ ID NO: 118458 - DNA, 30 bp, Artificial Sequence
  Description of Artificial Sequence: Synthetic oligonucleotide
tgtttagtgaatgaccctaggccccagcac

SEQ ID NO: 118459 - DNA, 29 bp, Artificial Sequence
  Description of Artificial Sequence: Synthetic oligonucleotide
gtttagtgaatgaccctaggccccagcac

SEQ ID NO: 118460 - DNA, 31 bp, Artificial Sequence
  Description of Artificial Sequence: Synthetic oligonucleotide
tttagtgaatgaccctaggccccagcacaag

SEQ ID NO: 118461 - DNA, 30 bp, Artificial Sequence
  Description of Artificial Sequence: Synthetic oligonucleotide
ttagtgaatgaccctaggccccagcacaag

SEQ ID NO: 118462 - DNA, 29 bp, Artificial Sequence
  Description of Artificial Sequence: Synthetic oligonucleotide
tagtgaatgaccctaggccccagcacaag

SEQ ID NO: 118463 - DNA, 28 bp, Artificial Sequence
  Description of Artificial Sequence: Synthetic oligonucleotide
agtgaatgaccctaggccccagcacaag

SEQ ID NO: 118464 - DNA, 27 bp, Artificial Sequence
  Description of Artificial Sequence: Synthetic oligonucleotide
gtgaatgaccctaggccccagcacaag

SEQ ID NO: 118465 - DNA, 29 bp, Artificial Sequence
  Description of Artificial Sequence: Synthetic oligonucleotide
tgaatgaccctaggccccagcacaagtac

SEQ ID NO: 118466 - DNA, 28 bp, Artificial Sequence
  Description of Artificial Sequence: Synthetic oligonucleotide
gaatgaccctaggccccagcacaagtac

SEQ ID NO: 118467 - DNA, 30 bp, Artificial Sequence
  Description of Artificial Sequence: Synthetic oligonucleotide
aatgaccctaggccccagcacaagtacaac

SEQ ID NO: 118468 - DNA, 29 bp, Artificial Sequence
  Description of Artificial Sequence: Synthetic oligonucleotide
atgaccctaggccccagcacaagtacaac

SEQ ID NO: 118469 - DNA, 28 bp, Artificial Sequence
  Description of Artificial Sequence: Synthetic oligonucleotide
tgaccctaggccccagcacaagtacaac

SEQ ID NO: 118470 - DNA, 27 bp, Artificial Sequence
  Description of Artificial Sequence: Synthetic oligonucleotide
gaccctaggccccagcacaagtacaac

SEQ ID NO: 118471 - DNA, 30 bp, Artificial Sequence
  Description of Artificial Sequence: Synthetic oligonucleotide
accctaggccccagcacaagtacaacaaac

SEQ ID NO: 118472 - DNA, 29 bp, Artificial Sequence
  Description of Artificial Sequence: Synthetic oligonucleotide
ccctaggccccagcacaagtacaacaaac

SEQ ID NO: 118473 - DNA, 33 bp, Artificial Sequence
  Description of Artificial Sequence: Synthetic oligonucleotide
cctaggccccagcacaagtacaacaaactttac

SEQ ID NO: 118474 - DNA, 34 bp, Artificial Sequence
  Description of Artificial Sequence: Synthetic oligonucleotide
ctaggccccagcacaagtacaacaaactttacac

SEQ ID NO: 118475 - DNA, 35 bp, Artificial Sequence
  Description of Artificial Sequence: Synthetic oligonucleotide
taggccccagcacaagtacaacaaactttacacag

SEQ ID NO: 118476 - DNA, 34 bp, Artificial Sequence
  Description of Artificial Sequence: Synthetic oligonucleotide
aggccccagcacaagtacaacaaactttacacag

SEQ ID NO: 118477 - DNA, 33 bp, Artificial Sequence
  Description of Artificial Sequence: Synthetic oligonucleotide
ggccccagcacaagtacaacaaactttacacag

SEQ ID NO: 118478 - DNA, 34 bp, Artificial Sequence
  Description of Artificial Sequence: Synthetic oligonucleotide
gccccagcacaagtacaacaaactttacacagtg

SEQ ID NO: 118479 - DNA, 34 bp, Artificial Sequence
  Description of Artificial Sequence: Synthetic oligonucleotide
ccccagcacaagtacaacaaactttacacagtgg

SEQ ID NO: 118480 - DNA, 38 bp, Artificial Sequence
  Description of Artificial Sequence: Synthetic oligonucleotide
cccagcacaagtacaacaaactttacacagtggaatac

SEQ ID NO: 118481 - DNA, 42 bp, Artificial Sequence
  Description of Artificial Sequence: Synthetic oligonucleotide
ccagcacaagtacaacaaactttacacagtggaatacttaag

SEQ ID NO: 118482 - DNA, 42 bp, Artificial Sequence
  Description of Artificial Sequence: Synthetic oligonucleotide
cagcacaagtacaacaaactttacacagtggaatacttaagc

SEQ ID NO: 118483 - DNA, 47 bp, Artificial Sequence
  Description of Artificial Sequence: Synthetic oligonucleotide
agcacaagtacaacaaactttacacagtggaatacttaagcaatatg

SEQ ID NO: 118484 - DNA, 46 bp, Artificial Sequence
  Description of Artificial Sequence: Synthetic oligonucleotide
gcacaagtacaacaaactttacacagtggaatacttaagcaatatg

SEQ ID NO: 118485 - DNA, 46 bp, Artificial Sequence
  Description of Artificial Sequence: Synthetic oligonucleotide
cacaagtacaacaaactttacacagtggaatacttaagcaatatgg

SEQ ID NO: 118486 - DNA, 48 bp, Artificial Sequence
  Description of Artificial Sequence: Synthetic oligonucleotide
acaagtacaacaaactttacacagtggaatacttaagcaatatggttg

SEQ ID NO: 118487 - DNA, 47 bp, Artificial Sequence
  Description of Artificial Sequence: Synthetic oligonucleotide
caagtacaacaaactttacacagtggaatacttaagcaatatggttg

SEQ ID NO: 118488 - DNA, 47 bp, Artificial Sequence
  Description of Artificial Sequence: Synthetic oligonucleotide
aagtacaacaaactttacacagtggaatacttaagcaatatggttgg

SEQ ID NO: 118489 - DNA, 46 bp, Artificial Sequence
  Description of Artificial Sequence: Synthetic oligonucleotide
agtacaacaaactttacacagtggaatacttaagcaatatggttgg

SEQ ID NO: 118490 - DNA, 45 bp, Artificial Sequence
  Description of Artificial Sequence: Synthetic oligonucleotide
gtacaacaaactttacacagtggaatacttaagcaatatggttgg

SEQ ID NO: 118491 - DNA, 46 bp, Artificial Sequence
  Description of Artificial Sequence: Synthetic oligonucleotide
tacaacaaactttacacagtggaatacttaagcaatatggttggag

SEQ ID NO: 118492 - DNA, 45 bp, Artificial Sequence
  Description of Artificial Sequence: Synthetic oligonucleotide
acaacaaactttacacagtggaatacttaagcaatatggttggag

SEQ ID NO: 118493 - DNA, 44 bp, Artificial Sequence
  Description of Artificial Sequence: Synthetic oligonucleotide
caacaaactttacacagtggaatacttaagcaatatggttggag

SEQ ID NO: 118494 - DNA, 44 bp, Artificial Sequence
  Description of Artificial Sequence: Synthetic oligonucleotide
aacaaactttacacagtggaatacttaagcaatatggttggagg

SEQ ID NO: 118495 - DNA, 43 bp, Artificial Sequence
  Description of Artificial Sequence: Synthetic oligonucleotide
acaaactttacacagtggaatacttaagcaatatggttggagg

SEQ ID NO: 118496 - DNA, 42 bp, Artificial Sequence
  Description of Artificial Sequence: Synthetic oligonucleotide
caaactttacacagtggaatacttaagcaatatggttggagg

SEQ ID NO: 118497 - DNA, 42 bp, Artificial Sequence
  Description of Artificial Sequence: Synthetic oligonucleotide
aaactttacacagtggaatacttaagcaatatggttggaggg

SEQ ID NO: 118498 - DNA, 41 bp, Artificial Sequence
  Description of Artificial Sequence: Synthetic oligonucleotide
aactttacacagtggaatacttaagcaatatggttggaggg

SEQ ID NO: 118499 - DNA, 40 bp, Artificial Sequence
  Description of Artificial Sequence: Synthetic oligonucleotide
actttacacagtggaatacttaagcaatatggttggaggg

SEQ ID NO: 118500 - DNA, 39 bp, Artificial Sequence
  Description of Artificial Sequence: Synthetic oligonucleotide
ctttacacagtggaatacttaagcaatatggttggaggg

SEQ ID NO: 118501 - DNA, 40 bp, Artificial Sequence
  Description of Artificial Sequence: Synthetic oligonucleotide
tttacacagtggaatacttaagcaatatggttggagggag

SEQ ID NO: 118502 - DNA, 39 bp, Artificial Sequence
  Description of Artificial Sequence: Synthetic oligonucleotide
ttacacagtggaatacttaagcaatatggttggagggag

SEQ ID NO: 118503 - DNA, 38 bp, Artificial Sequence
  Description of Artificial Sequence: Synthetic oligonucleotide
tacacagtggaatacttaagcaatatggttggagggag

SEQ ID NO: 118504 - DNA, 37 bp, Artificial Sequence
  Description of Artificial Sequence: Synthetic oligonucleotide
acacagtggaatacttaagcaatatggttggagggag

SEQ ID NO: 118505 - DNA, 36 bp, Artificial Sequence
  Description of Artificial Sequence: Synthetic oligonucleotide
cacagtggaatacttaagcaatatggttggagggag

SEQ ID NO: 118506 - DNA, 41 bp, Artificial Sequence
  Description of Artificial Sequence: Synthetic oligonucleotide
acagtggaatacttaagcaatatggttggagggagaaaaac

SEQ ID NO: 118507 - DNA, 40 bp, Artificial Sequence
  Description of Artificial Sequence: Synthetic oligonucleotide
cagtggaatacttaagcaatatggttggagggagaaaaac

SEQ ID NO: 118508 - DNA, 41 bp, Artificial Sequence
  Description of Artificial Sequence: Synthetic oligonucleotide
agtggaatacttaagcaatatggttggagggagaaaaactc

SEQ ID NO: 118509 - DNA, 40 bp, Artificial Sequence
  Description of Artificial Sequence: Synthetic oligonucleotide
gtggaatacttaagcaatatggttggagggagaaaaactc

SEQ ID NO: 118510 - DNA, 44 bp, Artificial Sequence
  Description of Artificial Sequence: Synthetic oligonucleotide
tggaatacttaagcaatatggttggagggagaaaaactctatac

SEQ ID NO: 118511 - DNA, 43 bp, Artificial Sequence
  Description of Artificial Sequence: Synthetic oligonucleotide
ggaatacttaagcaatatggttggagggagaaaaactctatac

SEQ ID NO: 118512 - DNA, 45 bp, Artificial Sequence
  Description of Artificial Sequence: Synthetic oligonucleotide
gaatacttaagcaatatggttggagggagaaaaactctatacaac

SEQ ID NO: 118513 - DNA, 47 bp, Artificial Sequence
  Description of Artificial Sequence: Synthetic oligonucleotide
aatacttaagcaatatggttggagggagaaaaactctatacaacaac

SEQ ID NO: 118514 - DNA, 46 bp, Artificial Sequence
  Description of Artificial Sequence: Synthetic oligonucleotide
atacttaagcaatatggttggagggagaaaaactctatacaacaac

SEQ ID NO: 118515 - DNA, 45 bp, Artificial Sequence
  Description of Artificial Sequence: Synthetic oligonucleotide
tacttaagcaatatggttggagggagaaaaactctatacaacaac

SEQ ID NO: 118516 - DNA, 44 bp, Artificial Sequence
  Description of Artificial Sequence: Synthetic oligonucleotide
acttaagcaatatggttggagggagaaaaactctatacaacaac

SEQ ID NO: 118517 - DNA, 43 bp, Artificial Sequence
  Description of Artificial Sequence: Synthetic oligonucleotide
cttaagcaatatggttggagggagaaaaactctatacaacaac

SEQ ID NO: 118518 - DNA, 43 bp, Artificial Sequence
  Description of Artificial Sequence: Synthetic oligonucleotide
ttaagcaatatggttggagggagaaaaactctatacaacaacc

SEQ ID NO: 118519 - DNA, 42 bp, Artificial Sequence
  Description of Artificial Sequence: Synthetic oligonucleotide
taagcaatatggttggagggagaaaaactctatacaacaacc

SEQ ID NO: 118520 - DNA, 41 bp, Artificial Sequence
  Description of Artificial Sequence: Synthetic oligonucleotide
aagcaatatggttggagggagaaaaactctatacaacaacc

SEQ ID NO: 118521 - DNA, 40 bp, Artificial Sequence
  Description of Artificial Sequence: Synthetic oligonucleotide
agcaatatggttggagggagaaaaactctatacaacaacc

SEQ ID NO: 118522 - DNA, 39 bp, Artificial Sequence
  Description of Artificial Sequence: Synthetic oligonucleotide
gcaatatggttggagggagaaaaactctatacaacaacc

SEQ ID NO: 118523 - DNA, 40 bp, Artificial Sequence
  Description of Artificial Sequence: Synthetic oligonucleotide
caatatggttggagggagaaaaactctatacaacaaccag

SEQ ID NO: 118524 - DNA, 40 bp, Artificial Sequence
  Description of Artificial Sequence: Synthetic oligonucleotide
aatatggttggagggagaaaaactctatacaacaaccagc

SEQ ID NO: 118525 - DNA, 39 bp, Artificial Sequence
  Description of Artificial Sequence: Synthetic oligonucleotide
atatggttggagggagaaaaactctatacaacaaccagc

SEQ ID NO: 118526 - DNA, 38 bp, Artificial Sequence
  Description of Artificial Sequence: Synthetic oligonucleotide
tatggttggagggagaaaaactctatacaacaaccagc

SEQ ID NO: 118527 - DNA, 37 bp, Artificial Sequence
  Description of Artificial Sequence: Synthetic oligonucleotide
atggttggagggagaaaaactctatacaacaaccagc

SEQ ID NO: 118528 - DNA, 36 bp, Artificial Sequence
  Description of Artificial Sequence: Synthetic oligonucleotide
tggttggagggagaaaaactctatacaacaaccagc

SEQ ID NO: 118529 - DNA, 35 bp, Artificial Sequence
  Description of Artificial Sequence: Synthetic oligonucleotide
ggttggagggagaaaaactctatacaacaaccagc

SEQ ID NO: 118530 - DNA, 35 bp, Artificial Sequence
  Description of Artificial Sequence: Synthetic oligonucleotide
gttggagggagaaaaactctatacaacaaccagcc

SEQ ID NO: 118531 - DNA, 35 bp, Artificial Sequence
  Description of Artificial Sequence: Synthetic oligonucleotide
ttggagggagaaaaactctatacaacaaccagccc

SEQ ID NO: 118532 - DNA, 34 bp, Artificial Sequence
  Description of Artificial Sequence: Synthetic oligonucleotide
tggagggagaaaaactctatacaacaaccagccc

SEQ ID NO: 118533 - DNA, 33 bp, Artificial Sequence
  Description of Artificial Sequence: Synthetic oligonucleotide
ggagggagaaaaactctatacaacaaccagccc

SEQ ID NO: 118534 - DNA, 36 bp, Artificial Sequence
  Description of Artificial Sequence: Synthetic oligonucleotide
gagggagaaaaactctatacaacaaccagcccattg

SEQ ID NO: 118535 - DNA, 37 bp, Artificial Sequence
  Description of Artificial Sequence: Synthetic oligonucleotide
agggagaaaaactctatacaacaaccagcccattgac

SEQ ID NO: 118536 - DNA, 36 bp, Artificial Sequence
  Description of Artificial Sequence: Synthetic oligonucleotide
gggagaaaaactctatacaacaaccagcccattgac

SEQ ID NO: 118537 - DNA, 38 bp, Artificial Sequence
  Description of Artificial Sequence: Synthetic oligonucleotide
ggagaaaaactctatacaacaaccagcccattgacttc

SEQ ID NO: 118538 - DNA, 38 bp, Artificial Sequence
  Description of Artificial Sequence: Synthetic oligonucleotide
gagaaaaactctatacaacaaccagcccattgacttcc

SEQ ID NO: 118539 - DNA, 39 bp, Artificial Sequence
  Description of Artificial Sequence: Synthetic oligonucleotide
agaaaaactctatacaacaaccagcccattgacttcctg

SEQ ID NO: 118540 - DNA, 38 bp, Artificial Sequence
  Description of Artificial Sequence: Synthetic oligonucleotide
gaaaaactctatacaacaaccagcccattgacttcctg

SEQ ID NO: 118541 - DNA, 43 bp, Artificial Sequence
  Description of Artificial Sequence: Synthetic oligonucleotide
aaaaactctatacaacaaccagcccattgacttcctgaaaaag

SEQ ID NO: 118542 - DNA, 42 bp, Artificial Sequence
  Description of Artificial Sequence: Synthetic oligonucleotide
aaaactctatacaacaaccagcccattgacttcctgaaaaag

SEQ ID NO: 118543 - DNA, 41 bp, Artificial Sequence
  Description of Artificial Sequence: Synthetic oligonucleotide
aaactctatacaacaaccagcccattgacttcctgaaaaag

SEQ ID NO: 118544 - DNA, 40 bp, Artificial Sequence
  Description of Artificial Sequence: Synthetic oligonucleotide
aactctatacaacaaccagcccattgacttcctgaaaaag

SEQ ID NO: 118545 - DNA, 39 bp, Artificial Sequence
  Description of Artificial Sequence: Synthetic oligonucleotide
actctatacaacaaccagcccattgacttcctgaaaaag

SEQ ID NO: 118546 - DNA, 38 bp, Artificial Sequence
  Description of Artificial Sequence: Synthetic oligonucleotide
ctctatacaacaaccagcccattgacttcctgaaaaag

SEQ ID NO: 118547 - DNA, 40 bp, Artificial Sequence
  Description of Artificial Sequence: Synthetic oligonucleotide
tctatacaacaaccagcccattgacttcctgaaaaagatg

SEQ ID NO: 118548 - DNA, 39 bp, Artificial Sequence
  Description of Artificial Sequence: Synthetic oligonucleotide
ctatacaacaaccagcccattgacttcctgaaaaagatg

SEQ ID NO: 118549 - DNA, 39 bp, Artificial Sequence
  Description of Artificial Sequence: Synthetic oligonucleotide
tatacaacaaccagcccattgacttcctgaaaaagatgg

SEQ ID NO: 118550 - DNA, 38 bp, Artificial Sequence
  Description of Artificial Sequence: Synthetic oligonucleotide
atacaacaaccagcccattgacttcctgaaaaagatgg

SEQ ID NO: 118551 - DNA, 37 bp, Artificial Sequence
  Description of Artificial Sequence: Synthetic oligonucleotide
tacaacaaccagcccattgacttcctgaaaaagatgg

SEQ ID NO: 118552 - DNA, 36 bp, Artificial Sequence
  Description of Artificial Sequence: Synthetic oligonucleotide
acaacaaccagcccattgacttcctgaaaaagatgg

SEQ ID NO: 118553 - DNA, 35 bp, Artificial Sequence
  Description of Artificial Sequence: Synthetic oligonucleotide
caacaaccagcccattgacttcctgaaaaagatgg

SEQ ID NO: 118554 - DNA, 37 bp, Artificial Sequence
  Description of Artificial Sequence: Synthetic oligonucleotide
aacaaccagcccattgacttcctgaaaaagatggttg

SEQ ID NO: 118555 - DNA, 36 bp, Artificial Sequence
  Description of Artificial Sequence: Synthetic oligonucleotide
acaaccagcccattgacttcctgaaaaagatggttg

SEQ ID NO: 118556 - DNA, 35 bp, Artificial Sequence
  Description of Artificial Sequence: Synthetic oligonucleotide
caaccagcccattgacttcctgaaaaagatggttg

SEQ ID NO: 118557 - DNA, 35 bp, Artificial Sequence
  Description of Artificial Sequence: Synthetic oligonucleotide
aaccagcccattgacttcctgaaaaagatggttgc

SEQ ID NO: 118558 - DNA, 34 bp, Artificial Sequence
  Description of Artificial Sequence: Synthetic oligonucleotide
accagcccattgacttcctgaaaaagatggttgc

SEQ ID NO: 118559 - DNA, 33 bp, Artificial Sequence
  Description of Artificial Sequence: Synthetic oligonucleotide
ccagcccattgacttcctgaaaaagatggttgc

SEQ ID NO: 118560 - DNA, 34 bp, Artificial Sequence
  Description of Artificial Sequence: Synthetic oligonucleotide
cagcccattgacttcctgaaaaagatggttgctg

SEQ ID NO: 118561 - DNA, 34 bp, Artificial Sequence
  Description of Artificial Sequence: Synthetic oligonucleotide
agcccattgacttcctgaaaaagatggttgctgc

SEQ ID NO: 118562 - DNA, 33 bp, Artificial Sequence
  Description of Artificial Sequence: Synthetic oligonucleotide
gcccattgacttcctgaaaaagatggttgctgc

SEQ ID NO: 118563 - DNA, 33 bp, Artificial Sequence
  Description of Artificial Sequence: Synthetic oligonucleotide
cccattgacttcctgaaaaagatggttgctgcc

SEQ ID NO: 118564 - DNA, 34 bp, Artificial Sequence
  Description of Artificial Sequence: Synthetic oligonucleotide
ccattgacttcctgaaaaagatggttgctgcctc

SEQ ID NO: 118565 - DNA, 34 bp, Artificial Sequence
  Description of Artificial Sequence: Synthetic oligonucleotide
cattgacttcctgaaaaagatggttgctgcctcc

SEQ ID NO: 118566 - DNA, 36 bp, Artificial Sequence
  Description of Artificial Sequence: Synthetic oligonucleotide
attgacttcctgaaaaagatggttgctgcctccatc

SEQ ID NO: 118567 - DNA, 35 bp, Artificial Sequence
  Description of Artificial Sequence: Synthetic oligonucleotide
ttgacttcctgaaaaagatggttgctgcctccatc

SEQ ID NO: 118568 - DNA, 34 bp, Artificial Sequence
  Description of Artificial Sequence: Synthetic oligonucleotide
tgacttcctgaaaaagatggttgctgcctccatc

SEQ ID NO: 118569 - DNA, 33 bp, Artificial Sequence
  Description of Artificial Sequence: Synthetic oligonucleotide
gacttcctgaaaaagatggttgctgcctccatc

SEQ ID NO: 118570 - DNA, 36 bp, Artificial Sequence
  Description of Artificial Sequence: Synthetic oligonucleotide
acttcctgaaaaagatggttgctgcctccatcaaag

SEQ ID NO: 118571 - DNA, 35 bp, Artificial Sequence
  Description of Artificial Sequence: Synthetic oligonucleotide
cttcctgaaaaagatggttgctgcctccatcaaag

SEQ ID NO: 118572 - DNA, 37 bp, Artificial Sequence
  Description of Artificial Sequence: Synthetic oligonucleotide
ttcctgaaaaagatggttgctgcctccatcaaagatg

SEQ ID NO: 118573 - DNA, 36 bp, Artificial Sequence
  Description of Artificial Sequence: Synthetic oligonucleotide
tcctgaaaaagatggttgctgcctccatcaaagatg

SEQ ID NO: 118574 - DNA, 35 bp, Artificial Sequence
  Description of Artificial Sequence: Synthetic oligonucleotide
cctgaaaaagatggttgctgcctccatcaaagatg

SEQ ID NO: 118575 - DNA, 35 bp, Artificial Sequence
  Description of Artificial Sequence: Synthetic oligonucleotide
ctgaaaaagatggttgctgcctccatcaaagatgg

SEQ ID NO: 118576 - DNA, 36 bp, Artificial Sequence
  Description of Artificial Sequence: Synthetic oligonucleotide
tgaaaaagatggttgctgcctccatcaaagatggag

SEQ ID NO: 118577 - DNA, 35 bp, Artificial Sequence
  Description of Artificial Sequence: Synthetic oligonucleotide
gaaaaagatggttgctgcctccatcaaagatggag

SEQ ID NO: 118578 - DNA, 36 bp, Artificial Sequence
  Description of Artificial Sequence: Synthetic oligonucleotide
aaaaagatggttgctgcctccatcaaagatggagag

SEQ ID NO: 118579 - DNA, 35 bp, Artificial Sequence
  Description of Artificial Sequence: Synthetic oligonucleotide
aaaagatggttgctgcctccatcaaagatggagag

SEQ ID NO: 118580 - DNA, 34 bp, Artificial Sequence
  Description of Artificial Sequence: Synthetic oligonucleotide
aaagatggttgctgcctccatcaaagatggagag

SEQ ID NO: 118581 - DNA, 33 bp, Artificial Sequence
  Description of Artificial Sequence: Synthetic oligonucleotide
aagatggttgctgcctccatcaaagatggagag

SEQ ID NO: 118582 - DNA, 32 bp, Artificial Sequence
  Description of Artificial Sequence: Synthetic oligonucleotide
agatggttgctgcctccatcaaagatggagag

SEQ ID NO: 118583 - DNA, 31 bp, Artificial Sequence
  Description of Artificial Sequence: Synthetic oligonucleotide
gatggttgctgcctccatcaaagatggagag

SEQ ID NO: 118584 - DNA, 31 bp, Artificial Sequence
  Description of Artificial Sequence: Synthetic oligonucleotide
atggttgctgcctccatcaaagatggagagg

SEQ ID NO: 118585 - DNA, 30 bp, Artificial Sequence
  Description of Artificial Sequence: Synthetic oligonucleotide
tggttgctgcctccatcaaagatggagagg

SEQ ID NO: 118586 - DNA, 29 bp, Artificial Sequence
  Description of Artificial Sequence: Synthetic oligonucleotide
ggttgctgcctccatcaaagatggagagg

SEQ ID NO: 118587 - DNA, 29 bp, Artificial Sequence
  Description of Artificial Sequence: Synthetic oligonucleotide
gttgctgcctccatcaaagatggagaggc

SEQ ID NO: 118588 - DNA, 30 bp, Artificial Sequence
  Description of Artificial Sequence: Synthetic oligonucleotide
ttgctgcctccatcaaagatggagaggctg

SEQ ID NO: 118589 - DNA, 29 bp, Artificial Sequence
  Description of Artificial Sequence: Synthetic oligonucleotide
tgctgcctccatcaaagatggagaggctg

SEQ ID NO: 118590 - DNA, 28 bp, Artificial Sequence
  Description of Artificial Sequence: Synthetic oligonucleotide
gctgcctccatcaaagatggagaggctg

SEQ ID NO: 118591 - DNA, 29 bp, Artificial Sequence
  Description of Artificial Sequence: Synthetic oligonucleotide
ctgcctccatcaaagatggagaggctgtg

SEQ ID NO: 118592 - DNA, 30 bp, Artificial Sequence
  Description of Artificial Sequence: Synthetic oligonucleotide
tgcctccatcaaagatggagaggctgtgtg

SEQ ID NO: 118593 - DNA, 29 bp, Artificial Sequence
  Description of Artificial Sequence: Synthetic oligonucleotide
gcctccatcaaagatggagaggctgtgtg

SEQ ID NO: 118594 - DNA, 29 bp, Artificial Sequence
  Description of Artificial Sequence: Synthetic oligonucleotide
cctccatcaaagatggagaggctgtgtgg

SEQ ID NO: 118595 - DNA, 32 bp, Artificial Sequence
  Description of Artificial Sequence: Synthetic oligonucleotide
ctccatcaaagatggagaggctgtgtggtttg

SEQ ID NO: 118596 - DNA, 32 bp, Artificial Sequence
  Description of Artificial Sequence: Synthetic oligonucleotide
tccatcaaagatggagaggctgtgtggtttgg

SEQ ID NO: 118597 - DNA, 31 bp, Artificial Sequence
  Description of Artificial Sequence: Synthetic oligonucleotide
ccatcaaagatggagaggctgtgtggtttgg

SEQ ID NO: 118598 - DNA, 31 bp, Artificial Sequence
  Description of Artificial Sequence: Synthetic oligonucleotide
catcaaagatggagaggctgtgtggtttggc

SEQ ID NO: 118599 - DNA, 32 bp, Artificial Sequence
  Description of Artificial Sequence: Synthetic oligonucleotide
atcaaagatggagaggctgtgtggtttggctg

SEQ ID NO: 118600 - DNA, 31 bp, Artificial Sequence
  Description of Artificial Sequence: Synthetic oligonucleotide
tcaaagatggagaggctgtgtggtttggctg

SEQ ID NO: 118601 - DNA, 30 bp, Artificial Sequence
  Description of Artificial Sequence: Synthetic oligonucleotide
caaagatggagaggctgtgtggtttggctg

SEQ ID NO: 118602 - DNA, 31 bp, Artificial Sequence
  Description of Artificial Sequence: Synthetic oligonucleotide
aaagatggagaggctgtgtggtttggctgtg

SEQ ID NO: 118603 - DNA, 30 bp, Artificial Sequence
  Description of Artificial Sequence: Synthetic oligonucleotide
aagatggagaggctgtgtggtttggctgtg

SEQ ID NO: 118604 - DNA, 29 bp, Artificial Sequence
  Description of Artificial Sequence: Synthetic oligonucleotide
agatggagaggctgtgtggtttggctgtg

SEQ ID NO: 118605 - DNA, 28 bp, Artificial Sequence
  Description of Artificial Sequence: Synthetic oligonucleotide
gatggagaggctgtgtggtttggctgtg

SEQ ID NO: 118606 - DNA, 30 bp, Artificial Sequence
  Description of Artificial Sequence: Synthetic oligonucleotide
atggagaggctgtgtggtttggctgtgatg

SEQ ID NO: 118607 - DNA, 29 bp, Artificial Sequence
  Description of Artificial Sequence: Synthetic oligonucleotide
tggagaggctgtgtggtttggctgtgatg

SEQ ID NO: 118608 - DNA, 28 bp, Artificial Sequence
  Description of Artificial Sequence: Synthetic oligonucleotide
ggagaggctgtgtggtttggctgtgatg

SEQ ID NO: 118609 - DNA, 30 bp, Artificial Sequence
  Description of Artificial Sequence: Synthetic oligonucleotide
gagaggctgtgtggtttggctgtgatgttg

SEQ ID NO: 118610 - DNA, 30 bp, Artificial Sequence
  Description of Artificial Sequence: Synthetic oligonucleotide
agaggctgtgtggtttggctgtgatgttgg

SEQ ID NO: 118611 - DNA, 29 bp, Artificial Sequence
  Description of Artificial Sequence: Synthetic oligonucleotide
gaggctgtgtggtttggctgtgatgttgg

SEQ ID NO: 118612 - DNA, 33 bp, Artificial Sequence
  Description of Artificial Sequence: Synthetic oligonucleotide
aggctgtgtggtttggctgtgatgttggaaaac

SEQ ID NO: 118613 - DNA, 32 bp, Artificial Sequence
  Description of Artificial Sequence: Synthetic oligonucleotide
ggctgtgtggtttggctgtgatgttggaaaac

SEQ ID NO: 118614 - DNA, 33 bp, Artificial Sequence
  Description of Artificial Sequence: Synthetic oligonucleotide
gctgtgtggtttggctgtgatgttggaaaacac

SEQ ID NO: 118615 - DNA, 35 bp, Artificial Sequence
  Description of Artificial Sequence: Synthetic oligonucleotide
ctgtgtggtttggctgtgatgttggaaaacacttc

SEQ ID NO: 118616 - DNA, 39 bp, Artificial Sequence
  Description of Artificial Sequence: Synthetic oligonucleotide
tgtgtggtttggctgtgatgttggaaaacacttcaatag

SEQ ID NO: 118617 - DNA, 38 bp, Artificial Sequence
  Description of Artificial Sequence: Synthetic oligonucleotide
gtgtggtttggctgtgatgttggaaaacacttcaatag

SEQ ID NO: 118618 - DNA, 38 bp, Artificial Sequence
  Description of Artificial Sequence: Synthetic oligonucleotide
tgtggtttggctgtgatgttggaaaacacttcaatagc

SEQ ID NO: 118619 - DNA, 37 bp, Artificial Sequence
  Description of Artificial Sequence: Synthetic oligonucleotide
gtggtttggctgtgatgttggaaaacacttcaatagc

SEQ ID NO: 118620 - DNA, 39 bp, Artificial Sequence
  Description of Artificial Sequence: Synthetic oligonucleotide
tggtttggctgtgatgttggaaaacacttcaatagcaag

SEQ ID NO: 118621 - DNA, 38 bp, Artificial Sequence
  Description of Artificial Sequence: Synthetic oligonucleotide
ggtttggctgtgatgttggaaaacacttcaatagcaag

SEQ ID NO: 118622 - DNA, 38 bp, Artificial Sequence
  Description of Artificial Sequence: Synthetic oligonucleotide
gtttggctgtgatgttggaaaacacttcaatagcaagc

SEQ ID NO: 118623 - DNA, 39 bp, Artificial Sequence
  Description of Artificial Sequence: Synthetic oligonucleotide
tttggctgtgatgttggaaaacacttcaatagcaagctg

SEQ ID NO: 118624 - DNA, 38 bp, Artificial Sequence
  Description of Artificial Sequence: Synthetic oligonucleotide
ttggctgtgatgttggaaaacacttcaatagcaagctg

SEQ ID NO: 118625 - DNA, 37 bp, Artificial Sequence
  Description of Artificial Sequence: Synthetic oligonucleotide
tggctgtgatgttggaaaacacttcaatagcaagctg

SEQ ID NO: 118626 - DNA, 36 bp, Artificial Sequence
  Description of Artificial Sequence: Synthetic oligonucleotide
ggctgtgatgttggaaaacacttcaatagcaagctg

SEQ ID NO: 118627 - DNA, 36 bp, Artificial Sequence
  Description of Artificial Sequence: Synthetic oligonucleotide
gctgtgatgttggaaaacacttcaatagcaagctgg

SEQ ID NO: 118628 - DNA, 36 bp, Artificial Sequence
  Description of Artificial Sequence: Synthetic oligonucleotide
ctgtgatgttggaaaacacttcaatagcaagctggg

SEQ ID NO: 118629 - DNA, 36 bp, Artificial Sequence
  Description of Artificial Sequence: Synthetic oligonucleotide
tgtgatgttggaaaacacttcaatagcaagctgggc

SEQ ID NO: 118630 - DNA, 35 bp, Artificial Sequence
  Description of Artificial Sequence: Synthetic oligonucleotide
gtgatgttggaaaacacttcaatagcaagctgggc

SEQ ID NO: 118631 - DNA, 35 bp, Artificial Sequence
  Description of Artificial Sequence: Synthetic oligonucleotide
tgatgttggaaaacacttcaatagcaagctgggcc

SEQ ID NO: 118632 - DNA, 34 bp, Artificial Sequence
  Description of Artificial Sequence: Synthetic oligonucleotide
gatgttggaaaacacttcaatagcaagctgggcc

SEQ ID NO: 118633 - DNA, 35 bp, Artificial Sequence
  Description of Artificial Sequence: Synthetic oligonucleotide
atgttggaaaacacttcaatagcaagctgggcctc

SEQ ID NO: 118634 - DNA, 34 bp, Artificial Sequence
  Description of Artificial Sequence: Synthetic oligonucleotide
tgttggaaaacacttcaatagcaagctgggcctc

SEQ ID NO: 118635 - DNA, 33 bp, Artificial Sequence
  Description of Artificial Sequence: Synthetic oligonucleotide
gttggaaaacacttcaatagcaagctgggcctc

SEQ ID NO: 118636 - DNA, 34 bp, Artificial Sequence
  Description of Artificial Sequence: Synthetic oligonucleotide
ttggaaaacacttcaatagcaagctgggcctcag

SEQ ID NO: 118637 - DNA, 33 bp, Artificial Sequence
  Description of Artificial Sequence: Synthetic oligonucleotide
tggaaaacacttcaatagcaagctgggcctcag

SEQ ID NO: 118638 - DNA, 32 bp, Artificial Sequence
  Description of Artificial Sequence: Synthetic oligonucleotide
ggaaaacacttcaatagcaagctgggcctcag

SEQ ID NO: 118639 - DNA, 33 bp, Artificial Sequence
  Description of Artificial Sequence: Synthetic oligonucleotide
gaaaacacttcaatagcaagctgggcctcagtg

SEQ ID NO: 118640 - DNA, 34 bp, Artificial Sequence
  Description of Artificial Sequence: Synthetic oligonucleotide
aaaacacttcaatagcaagctgggcctcagtgac

SEQ ID NO: 118641 - DNA, 33 bp, Artificial Sequence
  Description of Artificial Sequence: Synthetic oligonucleotide
aaacacttcaatagcaagctgggcctcagtgac

SEQ ID NO: 118642 - DNA, 32 bp, Artificial Sequence
  Description of Artificial Sequence: Synthetic oligonucleotide
aacacttcaatagcaagctgggcctcagtgac

SEQ ID NO: 118643 - DNA, 31 bp, Artificial Sequence
  Description of Artificial Sequence: Synthetic oligonucleotide
acacttcaatagcaagctgggcctcagtgac

SEQ ID NO: 118644 - DNA, 30 bp, Artificial Sequence
  Description of Artificial Sequence: Synthetic oligonucleotide
cacttcaatagcaagctgggcctcagtgac

SEQ ID NO: 118645 - DNA, 32 bp, Artificial Sequence
  Description of Artificial Sequence: Synthetic oligonucleotide
acttcaatagcaagctgggcctcagtgacatg

SEQ ID NO: 118646 - DNA, 31 bp, Artificial Sequence
  Description of Artificial Sequence: Synthetic oligonucleotide
cttcaatagcaagctgggcctcagtgacatg

SEQ ID NO: 118647 - DNA, 34 bp, Artificial Sequence
  Description of Artificial Sequence: Synthetic oligonucleotide
ttcaatagcaagctgggcctcagtgacatgaatc

SEQ ID NO: 118648 - DNA, 33 bp, Artificial Sequence
  Description of Artificial Sequence: Synthetic oligonucleotide
tcaatagcaagctgggcctcagtgacatgaatc

SEQ ID NO: 118649 - DNA, 32 bp, Artificial Sequence
  Description of Artificial Sequence: Synthetic oligonucleotide
caatagcaagctgggcctcagtgacatgaatc

SEQ ID NO: 118650 - DNA, 33 bp, Artificial Sequence
  Description of Artificial Sequence: Synthetic oligonucleotide
aatagcaagctgggcctcagtgacatgaatctc

SEQ ID NO: 118651 - DNA, 32 bp, Artificial Sequence
  Description of Artificial Sequence: Synthetic oligonucleotide
atagcaagctgggcctcagtgacatgaatctc

SEQ ID NO: 118652 - DNA, 31 bp, Artificial Sequence
  Description of Artificial Sequence: Synthetic oligonucleotide
tagcaagctgggcctcagtgacatgaatctc

SEQ ID NO: 118653 - DNA, 30 bp, Artificial Sequence
  Description of Artificial Sequence: Synthetic oligonucleotide
agcaagctgggcctcagtgacatgaatctc

SEQ ID NO: 118654 - DNA, 29 bp, Artificial Sequence
  Description of Artificial Sequence: Synthetic oligonucleotide
gcaagctgggcctcagtgacatgaatctc

SEQ ID NO: 118655 - DNA, 32 bp, Artificial Sequence
  Description of Artificial Sequence: Synthetic oligonucleotide
caagctgggcctcagtgacatgaatctctatg

SEQ ID NO: 118656 - DNA, 33 bp, Artificial Sequence
  Description of Artificial Sequence: Synthetic oligonucleotide
aagctgggcctcagtgacatgaatctctatgac

SEQ ID NO: 118657 - DNA, 32 bp, Artificial Sequence
  Description of Artificial Sequence: Synthetic oligonucleotide
agctgggcctcagtgacatgaatctctatgac

SEQ ID NO: 118658 - DNA, 31 bp, Artificial Sequence
  Description of Artificial Sequence: Synthetic oligonucleotide
gctgggcctcagtgacatgaatctctatgac

SEQ ID NO: 118659 - DNA, 31 bp, Artificial Sequence
  Description of Artificial Sequence: Synthetic oligonucleotide
ctgggcctcagtgacatgaatctctatgacc

SEQ ID NO: 118660 - DNA, 33 bp, Artificial Sequence
  Description of Artificial Sequence: Synthetic oligonucleotide
tgggcctcagtgacatgaatctctatgaccatg

SEQ ID NO: 118661 - DNA, 32 bp, Artificial Sequence
  Description of Artificial Sequence: Synthetic oligonucleotide
gggcctcagtgacatgaatctctatgaccatg

SEQ ID NO: 118662 - DNA, 33 bp, Artificial Sequence
  Description of Artificial Sequence: Synthetic oligonucleotide
ggcctcagtgacatgaatctctatgaccatgag

SEQ ID NO: 118663 - DNA, 36 bp, Artificial Sequence
  Description of Artificial Sequence: Synthetic oligonucleotide
gcctcagtgacatgaatctctatgaccatgagttag

SEQ ID NO: 118664 - DNA, 37 bp, Artificial Sequence
  Description of Artificial Sequence: Synthetic oligonucleotide
cctcagtgacatgaatctctatgaccatgagttagtg

SEQ ID NO: 118665 - DNA, 40 bp, Artificial Sequence
  Description of Artificial Sequence: Synthetic oligonucleotide
ctcagtgacatgaatctctatgaccatgagttagtgtttg

SEQ ID NO: 118666 - DNA, 40 bp, Artificial Sequence
  Description of Artificial Sequence: Synthetic oligonucleotide
tcagtgacatgaatctctatgaccatgagttagtgtttgg

SEQ ID NO: 118667 - DNA, 39 bp, Artificial Sequence
  Description of Artificial Sequence: Synthetic oligonucleotide
cagtgacatgaatctctatgaccatgagttagtgtttgg

SEQ ID NO: 118668 - DNA, 40 bp, Artificial Sequence
  Description of Artificial Sequence: Synthetic oligonucleotide
agtgacatgaatctctatgaccatgagttagtgtttggtg

SEQ ID NO: 118669 - DNA, 39 bp, Artificial Sequence
  Description of Artificial Sequence: Synthetic oligonucleotide
gtgacatgaatctctatgaccatgagttagtgtttggtg

SEQ ID NO: 118670 - DNA, 40 bp, Artificial Sequence
  Description of Artificial Sequence: Synthetic oligonucleotide
tgacatgaatctctatgaccatgagttagtgtttggtgtc

SEQ ID NO: 118671 - DNA, 39 bp, Artificial Sequence
  Description of Artificial Sequence: Synthetic oligonucleotide
gacatgaatctctatgaccatgagttagtgtttggtgtc

SEQ ID NO: 118672 - DNA, 40 bp, Artificial Sequence
  Description of Artificial Sequence: Synthetic oligonucleotide
acatgaatctctatgaccatgagttagtgtttggtgtctc

SEQ ID NO: 118673 - DNA, 39 bp, Artificial Sequence
  Description of Artificial Sequence: Synthetic oligonucleotide
catgaatctctatgaccatgagttagtgtttggtgtctc

SEQ ID NO: 118674 - DNA, 39 bp, Artificial Sequence
  Description of Artificial Sequence: Synthetic oligonucleotide
atgaatctctatgaccatgagttagtgtttggtgtctcc

SEQ ID NO: 118675 - DNA, 38 bp, Artificial Sequence
  Description of Artificial Sequence: Synthetic oligonucleotide
tgaatctctatgaccatgagttagtgtttggtgtctcc

SEQ ID NO: 118676 - DNA, 37 bp, Artificial Sequence
  Description of Artificial Sequence: Synthetic oligonucleotide
gaatctctatgaccatgagttagtgtttggtgtctcc

SEQ ID NO: 118677 - DNA, 39 bp, Artificial Sequence
  Description of Artificial Sequence: Synthetic oligonucleotide
aatctctatgaccatgagttagtgtttggtgtctccttg

SEQ ID NO: 118678 - DNA, 38 bp, Artificial Sequence
  Description of Artificial Sequence: Synthetic oligonucleotide
atctctatgaccatgagttagtgtttggtgtctccttg

SEQ ID NO: 118679 - DNA, 37 bp, Artificial Sequence
  Description of Artificial Sequence: Synthetic oligonucleotide
tctctatgaccatgagttagtgtttggtgtctccttg

SEQ ID NO: 118680 - DNA, 36 bp, Artificial Sequence
  Description of Artificial Sequence: Synthetic oligonucleotide
ctctatgaccatgagttagtgtttggtgtctccttg

SEQ ID NO: 118681 - DNA, 38 bp, Artificial Sequence
  Description of Artificial Sequence: Synthetic oligonucleotide
tctatgaccatgagttagtgtttggtgtctccttgaag

SEQ ID NO: 118682 - DNA, 37 bp, Artificial Sequence
  Description of Artificial Sequence: Synthetic oligonucleotide
ctatgaccatgagttagtgtttggtgtctccttgaag

SEQ ID NO: 118683 - DNA, 39 bp, Artificial Sequence
  Description of Artificial Sequence: Synthetic oligonucleotide
tatgaccatgagttagtgtttggtgtctccttgaagaac

SEQ ID NO: 118684 - DNA, 38 bp, Artificial Sequence
  Description of Artificial Sequence: Synthetic oligonucleotide
atgaccatgagttagtgtttggtgtctccttgaagaac

SEQ ID NO: 118685 - DNA, 37 bp, Artificial Sequence
  Description of Artificial Sequence: Synthetic oligonucleotide
tgaccatgagttagtgtttggtgtctccttgaagaac

SEQ ID NO: 118686 - DNA, 36 bp, Artificial Sequence
  Description of Artificial Sequence: Synthetic oligonucleotide
gaccatgagttagtgtttggtgtctccttgaagaac

SEQ ID NO: 118687 - DNA, 38 bp, Artificial Sequence
  Description of Artificial Sequence: Synthetic oligonucleotide
accatgagttagtgtttggtgtctccttgaagaacatg

SEQ ID NO: 118688 - DNA, 37 bp, Artificial Sequence
  Description of Artificial Sequence: Synthetic oligonucleotide
ccatgagttagtgtttggtgtctccttgaagaacatg

SEQ ID NO: 118689 - DNA, 43 bp, Artificial Sequence
  Description of Artificial Sequence: Synthetic oligonucleotide
catgagttagtgtttggtgtctccttgaagaacatgaataaag

SEQ ID NO: 118690 - DNA, 43 bp, Artificial Sequence
  Description of Artificial Sequence: Synthetic oligonucleotide
atgagttagtgtttggtgtctccttgaagaacatgaataaagc

SEQ ID NO: 118691 - DNA, 42 bp, Artificial Sequence
  Description of Artificial Sequence: Synthetic oligonucleotide
tgagttagtgtttggtgtctccttgaagaacatgaataaagc

SEQ ID NO: 118692 - DNA, 41 bp, Artificial Sequence
  Description of Artificial Sequence: Synthetic oligonucleotide
gagttagtgtttggtgtctccttgaagaacatgaataaagc

SEQ ID NO: 118693 - DNA, 41 bp, Artificial Sequence
  Description of Artificial Sequence: Synthetic oligonucleotide
agttagtgtttggtgtctccttgaagaacatgaataaagcg

SEQ ID NO: 118694 - DNA, 40 bp, Artificial Sequence
  Description of Artificial Sequence: Synthetic oligonucleotide
gttagtgtttggtgtctccttgaagaacatgaataaagcg

SEQ ID NO: 118695 - DNA, 40 bp, Artificial Sequence
  Description of Artificial Sequence: Synthetic oligonucleotide
ttagtgtttggtgtctccttgaagaacatgaataaagcgg

SEQ ID NO: 118696 - DNA, 39 bp, Artificial Sequence
  Description of Artificial Sequence: Synthetic oligonucleotide
tagtgtttggtgtctccttgaagaacatgaataaagcgg

SEQ ID NO: 118697 - DNA, 38 bp, Artificial Sequence
  Description of Artificial Sequence: Synthetic oligonucleotide
agtgtttggtgtctccttgaagaacatgaataaagcgg

SEQ ID NO: 118698 - DNA, 37 bp, Artificial Sequence
  Description of Artificial Sequence: Synthetic oligonucleotide
gtgtttggtgtctccttgaagaacatgaataaagcgg

SEQ ID NO: 118699 - DNA, 38 bp, Artificial Sequence
  Description of Artificial Sequence: Synthetic oligonucleotide
tgtttggtgtctccttgaagaacatgaataaagcggag

SEQ ID NO: 118700 - DNA, 37 bp, Artificial Sequence
  Description of Artificial Sequence: Synthetic oligonucleotide
gtttggtgtctccttgaagaacatgaataaagcggag

SEQ ID NO: 118701 - DNA, 38 bp, Artificial Sequence
  Description of Artificial Sequence: Synthetic oligonucleotide
tttggtgtctccttgaagaacatgaataaagcggagag

SEQ ID NO: 118702 - DNA, 37 bp, Artificial Sequence
  Description of Artificial Sequence: Synthetic oligonucleotide
ttggtgtctccttgaagaacatgaataaagcggagag

SEQ ID NO: 118703 - DNA, 36 bp, Artificial Sequence
  Description of Artificial Sequence: Synthetic oligonucleotide
tggtgtctccttgaagaacatgaataaagcggagag

SEQ ID NO: 118704 - DNA, 35 bp, Artificial Sequence
  Description of Artificial Sequence: Synthetic oligonucleotide
ggtgtctccttgaagaacatgaataaagcggagag

SEQ ID NO: 118705 - DNA, 35 bp, Artificial Sequence
  Description of Artificial Sequence: Synthetic oligonucleotide
gtgtctccttgaagaacatgaataaagcggagagg

SEQ ID NO: 118706 - DNA, 35 bp, Artificial Sequence
  Description of Artificial Sequence: Synthetic oligonucleotide
tgtctccttgaagaacatgaataaagcggagaggc

SEQ ID NO: 118707 - DNA, 34 bp, Artificial Sequence
  Description of Artificial Sequence: Synthetic oligonucleotide
gtctccttgaagaacatgaataaagcggagaggc

SEQ ID NO: 118708 - DNA, 35 bp, Artificial Sequence
  Description of Artificial Sequence: Synthetic oligonucleotide
tctccttgaagaacatgaataaagcggagaggctg

SEQ ID NO: 118709 - DNA, 34 bp, Artificial Sequence
  Description of Artificial Sequence: Synthetic oligonucleotide
ctccttgaagaacatgaataaagcggagaggctg

SEQ ID NO: 118710 - DNA, 35 bp, Artificial Sequence
  Description of Artificial Sequence: Synthetic oligonucleotide
tccttgaagaacatgaataaagcggagaggctgac

SEQ ID NO: 118711 - DNA, 34 bp, Artificial Sequence
  Description of Artificial Sequence: Synthetic oligonucleotide
ccttgaagaacatgaataaagcggagaggctgac

SEQ ID NO: 118712 - DNA, 38 bp, Artificial Sequence
  Description of Artificial Sequence: Synthetic oligonucleotide
cttgaagaacatgaataaagcggagaggctgacttttg

SEQ ID NO: 118713 - DNA, 38 bp, Artificial Sequence
  Description of Artificial Sequence: Synthetic oligonucleotide
ttgaagaacatgaataaagcggagaggctgacttttgg

SEQ ID NO: 118714 - DNA, 37 bp, Artificial Sequence
  Description of Artificial Sequence: Synthetic oligonucleotide
tgaagaacatgaataaagcggagaggctgacttttgg

SEQ ID NO: 118715 - DNA, 36 bp, Artificial Sequence
  Description of Artificial Sequence: Synthetic oligonucleotide
gaagaacatgaataaagcggagaggctgacttttgg

SEQ ID NO: 118716 - DNA, 37 bp, Artificial Sequence
  Description of Artificial Sequence: Synthetic oligonucleotide
aagaacatgaataaagcggagaggctgacttttggtg

SEQ ID NO: 118717 - DNA, 36 bp, Artificial Sequence
  Description of Artificial Sequence: Synthetic oligonucleotide
agaacatgaataaagcggagaggctgacttttggtg

SEQ ID NO: 118718 - DNA, 35 bp, Artificial Sequence
  Description of Artificial Sequence: Synthetic oligonucleotide
gaacatgaataaagcggagaggctgacttttggtg

SEQ ID NO: 118719 - DNA, 36 bp, Artificial Sequence
  Description of Artificial Sequence: Synthetic oligonucleotide
aacatgaataaagcggagaggctgacttttggtgag

SEQ ID NO: 118720 - DNA, 35 bp, Artificial Sequence
  Description of Artificial Sequence: Synthetic oligonucleotide
acatgaataaagcggagaggctgacttttggtgag

SEQ ID NO: 118721 - DNA, 34 bp, Artificial Sequence
  Description of Artificial Sequence: Synthetic oligonucleotide
catgaataaagcggagaggctgacttttggtgag

SEQ ID NO: 118722 - DNA, 35 bp, Artificial Sequence
  Description of Artificial Sequence: Synthetic oligonucleotide
atgaataaagcggagaggctgacttttggtgagtc

SEQ ID NO: 118723 - DNA, 34 bp, Artificial Sequence
  Description of Artificial Sequence: Synthetic oligonucleotide
tgaataaagcggagaggctgacttttggtgagtc

SEQ ID NO: 118724 - DNA, 33 bp, Artificial Sequence
  Description of Artificial Sequence: Synthetic oligonucleotide
gaataaagcggagaggctgacttttggtgagtc

SEQ ID NO: 118725 - DNA, 34 bp, Artificial Sequence
  Description of Artificial Sequence: Synthetic oligonucleotide
aataaagcggagaggctgacttttggtgagtcac

SEQ ID NO: 118726 - DNA, 33 bp, Artificial Sequence
  Description of Artificial Sequence: Synthetic oligonucleotide
ataaagcggagaggctgacttttggtgagtcac

SEQ ID NO: 118727 - DNA, 32 bp, Artificial Sequence
  Description of Artificial Sequence: Synthetic oligonucleotide
taaagcggagaggctgacttttggtgagtcac

SEQ ID NO: 118728 - DNA, 31 bp, Artificial Sequence
  Description of Artificial Sequence: Synthetic oligonucleotide
aaagcggagaggctgacttttggtgagtcac

SEQ ID NO: 118729 - DNA, 30 bp, Artificial Sequence
  Description of Artificial Sequence: Synthetic oligonucleotide
aagcggagaggctgacttttggtgagtcac

SEQ ID NO: 118730 - DNA, 29 bp, Artificial Sequence
  Description of Artificial Sequence: Synthetic oligonucleotide
agcggagaggctgacttttggtgagtcac

SEQ ID NO: 118731 - DNA, 28 bp, Artificial Sequence
  Description of Artificial Sequence: Synthetic oligonucleotide
gcggagaggctgacttttggtgagtcac

SEQ ID NO: 118732 - DNA, 32 bp, Artificial Sequence
  Description of Artificial Sequence: Synthetic oligonucleotide
cggagaggctgacttttggtgagtcacttatg

SEQ ID NO: 118733 - DNA, 33 bp, Artificial Sequence
  Description of Artificial Sequence: Synthetic oligonucleotide
ggagaggctgacttttggtgagtcacttatgac

SEQ ID NO: 118734 - DNA, 33 bp, Artificial Sequence
  Description of Artificial Sequence: Synthetic oligonucleotide
gagaggctgacttttggtgagtcacttatgacc

SEQ ID NO: 118735 - DNA, 33 bp, Artificial Sequence
  Description of Artificial Sequence: Synthetic oligonucleotide
agaggctgacttttggtgagtcacttatgaccc

SEQ ID NO: 118736 - DNA, 32 bp, Artificial Sequence
  Description of Artificial Sequence: Synthetic oligonucleotide
gaggctgacttttggtgagtcacttatgaccc

SEQ ID NO: 118737 - DNA, 33 bp, Artificial Sequence
  Description of Artificial Sequence: Synthetic oligonucleotide
aggctgacttttggtgagtcacttatgacccac

SEQ ID NO: 118738 - DNA, 32 bp, Artificial Sequence
  Description of Artificial Sequence: Synthetic oligonucleotide
ggctgacttttggtgagtcacttatgacccac

SEQ ID NO: 118739 - DNA, 32 bp, Artificial Sequence
  Description of Artificial Sequence: Synthetic oligonucleotide
gctgacttttggtgagtcacttatgacccacg

SEQ ID NO: 118740 - DNA, 32 bp, Artificial Sequence
  Description of Artificial Sequence: Synthetic oligonucleotide
ctgacttttggtgagtcacttatgacccacgc

SEQ ID NO: 118741 - DNA, 32 bp, Artificial Sequence
  Description of Artificial Sequence: Synthetic oligonucleotide
tgacttttggtgagtcacttatgacccacgcc

SEQ ID NO: 118742 - DNA, 31 bp, Artificial Sequence
  Description of Artificial Sequence: Synthetic oligonucleotide
gacttttggtgagtcacttatgacccacgcc

SEQ ID NO: 118743 - DNA, 33 bp, Artificial Sequence
  Description of Artificial Sequence: Synthetic oligonucleotide
acttttggtgagtcacttatgacccacgccatg

SEQ ID NO: 118744 - DNA, 32 bp, Artificial Sequence
  Description of Artificial Sequence: Synthetic oligonucleotide
cttttggtgagtcacttatgacccacgccatg

SEQ ID NO: 118745 - DNA, 33 bp, Artificial Sequence
  Description of Artificial Sequence: Synthetic oligonucleotide
ttttggtgagtcacttatgacccacgccatgac

SEQ ID NO: 118746 - DNA, 32 bp, Artificial Sequence
  Description of Artificial Sequence: Synthetic oligonucleotide
tttggtgagtcacttatgacccacgccatgac

SEQ ID NO: 118747 - DNA, 31 bp, Artificial Sequence
  Description of Artificial Sequence: Synthetic oligonucleotide
ttggtgagtcacttatgacccacgccatgac

SEQ ID NO: 118748 - DNA, 30 bp, Artificial Sequence
  Description of Artificial Sequence: Synthetic oligonucleotide
tggtgagtcacttatgacccacgccatgac

SEQ ID NO: 118749 - DNA, 29 bp, Artificial Sequence
  Description of Artificial Sequence: Synthetic oligonucleotide
ggtgagtcacttatgacccacgccatgac

SEQ ID NO: 118750 - DNA, 29 bp, Artificial Sequence
  Description of Artificial Sequence: Synthetic oligonucleotide
gtgagtcacttatgacccacgccatgacc

SEQ ID NO: 118751 - DNA, 31 bp, Artificial Sequence
  Description of Artificial Sequence: Synthetic oligonucleotide
tgagtcacttatgacccacgccatgaccttc

SEQ ID NO: 118752 - DNA, 30 bp, Artificial Sequence
  Description of Artificial Sequence: Synthetic oligonucleotide
gagtcacttatgacccacgccatgaccttc

SEQ ID NO: 118753 - DNA, 31 bp, Artificial Sequence
  Description of Artificial Sequence: Synthetic oligonucleotide
agtcacttatgacccacgccatgaccttcac

SEQ ID NO: 118754 - DNA, 30 bp, Artificial Sequence
  Description of Artificial Sequence: Synthetic oligonucleotide
gtcacttatgacccacgccatgaccttcac

SEQ ID NO: 118755 - DNA, 31 bp, Artificial Sequence
  Description of Artificial Sequence: Synthetic oligonucleotide
tcacttatgacccacgccatgaccttcactg

SEQ ID NO: 118756 - DNA, 30 bp, Artificial Sequence
  Description of Artificial Sequence: Synthetic oligonucleotide
cacttatgacccacgccatgaccttcactg

SEQ ID NO: 118757 - DNA, 30 bp, Artificial Sequence
  Description of Artificial Sequence: Synthetic oligonucleotide
acttatgacccacgccatgaccttcactgc

SEQ ID NO: 118758 - DNA, 29 bp, Artificial Sequence
  Description of Artificial Sequence: Synthetic oligonucleotide
cttatgacccacgccatgaccttcactgc

SEQ ID NO: 118759 - DNA, 30 bp, Artificial Sequence
  Description of Artificial Sequence: Synthetic oligonucleotide
ttatgacccacgccatgaccttcactgctg

SEQ ID NO: 118760 - DNA, 29 bp, Artificial Sequence
  Description of Artificial Sequence: Synthetic oligonucleotide
tatgacccacgccatgaccttcactgctg

SEQ ID NO: 118761 - DNA, 28 bp, Artificial Sequence
  Description of Artificial Sequence: Synthetic oligonucleotide
atgacccacgccatgaccttcactgctg

SEQ ID NO: 118762 - DNA, 27 bp, Artificial Sequence
  Description of Artificial Sequence: Synthetic oligonucleotide
tgacccacgccatgaccttcactgctg

SEQ ID NO: 118763 - DNA, 27 bp, Artificial Sequence
  Description of Artificial Sequence: Synthetic oligonucleotide
gacccacgccatgaccttcactgctgt

SEQ ID NO: 118764 - DNA, 27 bp, Artificial Sequence
  Description of Artificial Sequence: Synthetic oligonucleotide
acccacgccatgaccttcactgctgtc

SEQ ID NO: 118765 - DNA, 27 bp, Artificial Sequence
  Description of Artificial Sequence: Synthetic oligonucleotide
cccacgccatgaccttcactgctgtct

SEQ ID NO: 118766 - DNA, 27 bp, Artificial Sequence
  Description of Artificial Sequence: Synthetic oligonucleotide
ccacgccatgaccttcactgctgtctc

SEQ ID NO: 118767 - DNA, 28 bp, Artificial Sequence
  Description of Artificial Sequence: Synthetic oligonucleotide
cacgccatgaccttcactgctgtctcag

SEQ ID NO: 118768 - DNA, 29 bp, Artificial Sequence
  Description of Artificial Sequence: Synthetic oligonucleotide
acgccatgaccttcactgctgtctcagag

SEQ ID NO: 118769 - DNA, 28 bp, Artificial Sequence
  Description of Artificial Sequence: Synthetic oligonucleotide
cgccatgaccttcactgctgtctcagag

SEQ ID NO: 118770 - DNA, 30 bp, Artificial Sequence
  Description of Artificial Sequence: Synthetic oligonucleotide
gccatgaccttcactgctgtctcagagaag

SEQ ID NO: 118771 - DNA, 30 bp, Artificial Sequence
  Description of Artificial Sequence: Synthetic oligonucleotide
ccatgaccttcactgctgtctcagagaagg

SEQ ID NO: 118772 - DNA, 32 bp, Artificial Sequence
  Description of Artificial Sequence: Synthetic oligonucleotide
catgaccttcactgctgtctcagagaaggatg

SEQ ID NO: 118773 - DNA, 34 bp, Artificial Sequence
  Description of Artificial Sequence: Synthetic oligonucleotide
atgaccttcactgctgtctcagagaaggatgatc

SEQ ID NO: 118774 - DNA, 33 bp, Artificial Sequence
  Description of Artificial Sequence: Synthetic oligonucleotide
tgaccttcactgctgtctcagagaaggatgatc

SEQ ID NO: 118775 - DNA, 32 bp, Artificial Sequence
  Description of Artificial Sequence: Synthetic oligonucleotide
gaccttcactgctgtctcagagaaggatgatc

SEQ ID NO: 118776 - DNA, 33 bp, Artificial Sequence
  Description of Artificial Sequence: Synthetic oligonucleotide
accttcactgctgtctcagagaaggatgatcag

SEQ ID NO: 118777 - DNA, 32 bp, Artificial Sequence
  Description of Artificial Sequence: Synthetic oligonucleotide
ccttcactgctgtctcagagaaggatgatcag

SEQ ID NO: 118778 - DNA, 32 bp, Artificial Sequence
  Description of Artificial Sequence: Synthetic oligonucleotide
cttcactgctgtctcagagaaggatgatcagg

SEQ ID NO: 118779 - DNA, 34 bp, Artificial Sequence
  Description of Artificial Sequence: Synthetic oligonucleotide
ttcactgctgtctcagagaaggatgatcaggatg

SEQ ID NO: 118780 - DNA, 33 bp, Artificial Sequence
  Description of Artificial Sequence: Synthetic oligonucleotide
tcactgctgtctcagagaaggatgatcaggatg

SEQ ID NO: 118781 - DNA, 32 bp, Artificial Sequence
  Description of Artificial Sequence: Synthetic oligonucleotide
cactgctgtctcagagaaggatgatcaggatg

SEQ ID NO: 118782 - DNA, 32 bp, Artificial Sequence
  Description of Artificial Sequence: Synthetic oligonucleotide
actgctgtctcagagaaggatgatcaggatgg

SEQ ID NO: 118783 - DNA, 31 bp, Artificial Sequence
  Description of Artificial Sequence: Synthetic oligonucleotide
ctgctgtctcagagaaggatgatcaggatgg

SEQ ID NO: 118784 - DNA, 32 bp, Artificial Sequence
  Description of Artificial Sequence: Synthetic oligonucleotide
tgctgtctcagagaaggatgatcaggatggtg

SEQ ID NO: 118785 - DNA, 31 bp, Artificial Sequence
  Description of Artificial Sequence: Synthetic oligonucleotide
gctgtctcagagaaggatgatcaggatggtg

SEQ ID NO: 118786 - DNA, 31 bp, Artificial Sequence
  Description of Artificial Sequence: Synthetic oligonucleotide
ctgtctcagagaaggatgatcaggatggtgc

SEQ ID NO: 118787 - DNA, 34 bp, Artificial Sequence
  Description of Artificial Sequence: Synthetic oligonucleotide
tgtctcagagaaggatgatcaggatggtgctttc

SEQ ID NO: 118788 - DNA, 33 bp, Artificial Sequence
  Description of Artificial Sequence: Synthetic oligonucleotide
gtctcagagaaggatgatcaggatggtgctttc

SEQ ID NO: 118789 - DNA, 34 bp, Artificial Sequence
  Description of Artificial Sequence: Synthetic oligonucleotide
tctcagagaaggatgatcaggatggtgctttcac

SEQ ID NO: 118790 - DNA, 33 bp, Artificial Sequence
  Description of Artificial Sequence: Synthetic oligonucleotide
ctcagagaaggatgatcaggatggtgctttcac

SEQ ID NO: 118791 - DNA, 38 bp, Artificial Sequence
  Description of Artificial Sequence: Synthetic oligonucleotide
tcagagaaggatgatcaggatggtgctttcacaaaatg

SEQ ID NO: 118792 - DNA, 37 bp, Artificial Sequence
  Description of Artificial Sequence: Synthetic oligonucleotide
cagagaaggatgatcaggatggtgctttcacaaaatg

SEQ ID NO: 118793 - DNA, 37 bp, Artificial Sequence
  Description of Artificial Sequence: Synthetic oligonucleotide
agagaaggatgatcaggatggtgctttcacaaaatgg

SEQ ID NO: 118794 - DNA, 36 bp, Artificial Sequence
  Description of Artificial Sequence: Synthetic oligonucleotide
gagaaggatgatcaggatggtgctttcacaaaatgg

SEQ ID NO: 118795 - DNA, 37 bp, Artificial Sequence
  Description of Artificial Sequence: Synthetic oligonucleotide
agaaggatgatcaggatggtgctttcacaaaatggag

SEQ ID NO: 118796 - DNA, 36 bp, Artificial Sequence
  Description of Artificial Sequence: Synthetic oligonucleotide
gaaggatgatcaggatggtgctttcacaaaatggag

SEQ ID NO: 118797 - DNA, 37 bp, Artificial Sequence
  Description of Artificial Sequence: Synthetic oligonucleotide
aaggatgatcaggatggtgctttcacaaaatggagag

SEQ ID NO: 118798 - DNA, 36 bp, Artificial Sequence
  Description of Artificial Sequence: Synthetic oligonucleotide
aggatgatcaggatggtgctttcacaaaatggagag

SEQ ID NO: 118799 - DNA, 35 bp, Artificial Sequence
  Description of Artificial Sequence: Synthetic oligonucleotide
ggatgatcaggatggtgctttcacaaaatggagag

SEQ ID NO: 118800 - DNA, 36 bp, Artificial Sequence
  Description of Artificial Sequence: Synthetic oligonucleotide
gatgatcaggatggtgctttcacaaaatggagagtg

SEQ ID NO: 118801 - DNA, 36 bp, Artificial Sequence
  Description of Artificial Sequence: Synthetic oligonucleotide
atgatcaggatggtgctttcacaaaatggagagtgg

SEQ ID NO: 118802 - DNA, 35 bp, Artificial Sequence
  Description of Artificial Sequence: Synthetic oligonucleotide
tgatcaggatggtgctttcacaaaatggagagtgg

SEQ ID NO: 118803 - DNA, 34 bp, Artificial Sequence
  Description of Artificial Sequence: Synthetic oligonucleotide
gatcaggatggtgctttcacaaaatggagagtgg

SEQ ID NO: 118804 - DNA, 35 bp, Artificial Sequence
  Description of Artificial Sequence: Synthetic oligonucleotide
atcaggatggtgctttcacaaaatggagagtggag

SEQ ID NO: 118805 - DNA, 34 bp, Artificial Sequence
  Description of Artificial Sequence: Synthetic oligonucleotide
tcaggatggtgctttcacaaaatggagagtggag

SEQ ID NO: 118806 - DNA, 33 bp, Artificial Sequence
  Description of Artificial Sequence: Synthetic oligonucleotide
caggatggtgctttcacaaaatggagagtggag

SEQ ID NO: 118807 - DNA, 37 bp, Artificial Sequence
  Description of Artificial Sequence: Synthetic oligonucleotide
aggatggtgctttcacaaaatggagagtggagaattc

SEQ ID NO: 118808 - DNA, 36 bp, Artificial Sequence
  Description of Artificial Sequence: Synthetic oligonucleotide
ggatggtgctttcacaaaatggagagtggagaattc

SEQ ID NO: 118809 - DNA, 38 bp, Artificial Sequence
  Description of Artificial Sequence: Synthetic oligonucleotide
gatggtgctttcacaaaatggagagtggagaattcatg

SEQ ID NO: 118810 - DNA, 38 bp, Artificial Sequence
  Description of Artificial Sequence: Synthetic oligonucleotide
atggtgctttcacaaaatggagagtggagaattcatgg

SEQ ID NO: 118811 - DNA, 37 bp, Artificial Sequence
  Description of Artificial Sequence: Synthetic oligonucleotide
tggtgctttcacaaaatggagagtggagaattcatgg

SEQ ID NO: 118812 - DNA, 36 bp, Artificial Sequence
  Description of Artificial Sequence: Synthetic oligonucleotide
ggtgctttcacaaaatggagagtggagaattcatgg

SEQ ID NO: 118813 - DNA, 36 bp, Artificial Sequence
  Description of Artificial Sequence: Synthetic oligonucleotide
gtgctttcacaaaatggagagtggagaattcatggg

SEQ ID NO: 118814 - DNA, 36 bp, Artificial Sequence
  Description of Artificial Sequence: Synthetic oligonucleotide
tgctttcacaaaatggagagtggagaattcatgggg

SEQ ID NO: 118815 - DNA, 35 bp, Artificial Sequence
  Description of Artificial Sequence: Synthetic oligonucleotide
gctttcacaaaatggagagtggagaattcatgggg

SEQ ID NO: 118816 - DNA, 36 bp, Artificial Sequence
  Description of Artificial Sequence: Synthetic oligonucleotide
ctttcacaaaatggagagtggagaattcatggggtg

SEQ ID NO: 118817 - DNA, 38 bp, Artificial Sequence
  Description of Artificial Sequence: Synthetic oligonucleotide
tttcacaaaatggagagtggagaattcatggggtgaag

SEQ ID NO: 118818 - DNA, 37 bp, Artificial Sequence
  Description of Artificial Sequence: Synthetic oligonucleotide
ttcacaaaatggagagtggagaattcatggggtgaag

SEQ ID NO: 118819 - DNA, 36 bp, Artificial Sequence
  Description of Artificial Sequence: Synthetic oligonucleotide
tcacaaaatggagagtggagaattcatggggtgaag

SEQ ID NO: 118820 - DNA, 35 bp, Artificial Sequence
  Description of Artificial Sequence: Synthetic oligonucleotide
cacaaaatggagagtggagaattcatggggtgaag

SEQ ID NO: 118821 - DNA, 36 bp, Artificial Sequence
  Description of Artificial Sequence: Synthetic oligonucleotide
acaaaatggagagtggagaattcatggggtgaagac

SEQ ID NO: 118822 - DNA, 35 bp, Artificial Sequence
  Description of Artificial Sequence: Synthetic oligonucleotide
caaaatggagagtggagaattcatggggtgaagac

SEQ ID NO: 118823 - DNA, 35 bp, Artificial Sequence
  Description of Artificial Sequence: Synthetic oligonucleotide
aaaatggagagtggagaattcatggggtgaagacc

SEQ ID NO: 118824 - DNA, 34 bp, Artificial Sequence
  Description of Artificial Sequence: Synthetic oligonucleotide
aaatggagagtggagaattcatggggtgaagacc

SEQ ID NO: 118825 - DNA, 33 bp, Artificial Sequence
  Description of Artificial Sequence: Synthetic oligonucleotide
aatggagagtggagaattcatggggtgaagacc

SEQ ID NO: 118826 - DNA, 32 bp, Artificial Sequence
  Description of Artificial Sequence: Synthetic oligonucleotide
atggagagtggagaattcatggggtgaagacc

SEQ ID NO: 118827 - DNA, 31 bp, Artificial Sequence
  Description of Artificial Sequence: Synthetic oligonucleotide
tggagagtggagaattcatggggtgaagacc

SEQ ID NO: 118828 - DNA, 30 bp, Artificial Sequence
  Description of Artificial Sequence: Synthetic oligonucleotide
ggagagtggagaattcatggggtgaagacc

SEQ ID NO: 118829 - DNA, 32 bp, Artificial Sequence
  Description of Artificial Sequence: Synthetic oligonucleotide
gagagtggagaattcatggggtgaagaccatg

SEQ ID NO: 118830 - DNA, 32 bp, Artificial Sequence
  Description of Artificial Sequence: Synthetic oligonucleotide
agagtggagaattcatggggtgaagaccatgg

SEQ ID NO: 118831 - DNA, 31 bp, Artificial Sequence
  Description of Artificial Sequence: Synthetic oligonucleotide
gagtggagaattcatggggtgaagaccatgg

SEQ ID NO: 118832 - DNA, 31 bp, Artificial Sequence
  Description of Artificial Sequence: Synthetic oligonucleotide
agtggagaattcatggggtgaagaccatggc

SEQ ID NO: 118833 - DNA, 30 bp, Artificial Sequence
  Description of Artificial Sequence: Synthetic oligonucleotide
gtggagaattcatggggtgaagaccatggc

SEQ ID NO: 118834 - DNA, 30 bp, Artificial Sequence
  Description of Artificial Sequence: Synthetic oligonucleotide
tggagaattcatggggtgaagaccatggcc

SEQ ID NO: 118835 - DNA, 29 bp, Artificial Sequence
  Description of Artificial Sequence: Synthetic oligonucleotide
ggagaattcatggggtgaagaccatggcc

SEQ ID NO: 118836 - DNA, 30 bp, Artificial Sequence
  Description of Artificial Sequence: Synthetic oligonucleotide
gagaattcatggggtgaagaccatggccac

SEQ ID NO: 118837 - DNA, 33 bp, Artificial Sequence
  Description of Artificial Sequence: Synthetic oligonucleotide
agaattcatggggtgaagaccatggccacaaag

SEQ ID NO: 118838 - DNA, 32 bp, Artificial Sequence
  Description of Artificial Sequence: Synthetic oligonucleotide
gaattcatggggtgaagaccatggccacaaag

SEQ ID NO: 118839 - DNA, 32 bp, Artificial Sequence
  Description of Artificial Sequence: Synthetic oligonucleotide
aattcatggggtgaagaccatggccacaaagg

SEQ ID NO: 118840 - DNA, 31 bp, Artificial Sequence
  Description of Artificial Sequence: Synthetic oligonucleotide
attcatggggtgaagaccatggccacaaagg

SEQ ID NO: 118841 - DNA, 30 bp, Artificial Sequence
  Description of Artificial Sequence: Synthetic oligonucleotide
ttcatggggtgaagaccatggccacaaagg

SEQ ID NO: 118842 - DNA, 29 bp, Artificial Sequence
  Description of Artificial Sequence: Synthetic oligonucleotide
tcatggggtgaagaccatggccacaaagg

SEQ ID NO: 118843 - DNA, 28 bp, Artificial Sequence
  Description of Artificial Sequence: Synthetic oligonucleotide
catggggtgaagaccatggccacaaagg

SEQ ID NO: 118844 - DNA, 31 bp, Artificial Sequence
  Description of Artificial Sequence: Synthetic oligonucleotide
atggggtgaagaccatggccacaaaggttac

SEQ ID NO: 118845 - DNA, 30 bp, Artificial Sequence
  Description of Artificial Sequence: Synthetic oligonucleotide
tggggtgaagaccatggccacaaaggttac

SEQ ID NO: 118846 - DNA, 29 bp, Artificial Sequence
  Description of Artificial Sequence: Synthetic oligonucleotide
ggggtgaagaccatggccacaaaggttac

SEQ ID NO: 118847 - DNA, 29 bp, Artificial Sequence
  Description of Artificial Sequence: Synthetic oligonucleotide
gggtgaagaccatggccacaaaggttacc

SEQ ID NO: 118848 - DNA, 30 bp, Artificial Sequence
  Description of Artificial Sequence: Synthetic oligonucleotide
ggtgaagaccatggccacaaaggttacctg

SEQ ID NO: 118849 - DNA, 31 bp, Artificial Sequence
  Description of Artificial Sequence: Synthetic oligonucleotide
gtgaagaccatggccacaaaggttacctgtg

SEQ ID NO: 118850 - DNA, 31 bp, Artificial Sequence
  Description of Artificial Sequence: Synthetic oligonucleotide
tgaagaccatggccacaaaggttacctgtgc

SEQ ID NO: 118851 - DNA, 30 bp, Artificial Sequence
  Description of Artificial Sequence: Synthetic oligonucleotide
gaagaccatggccacaaaggttacctgtgc

SEQ ID NO: 118852 - DNA, 32 bp, Artificial Sequence
  Description of Artificial Sequence: Synthetic oligonucleotide
aagaccatggccacaaaggttacctgtgcatg

SEQ ID NO: 118853 - DNA, 31 bp, Artificial Sequence
  Description of Artificial Sequence: Synthetic oligonucleotide
agaccatggccacaaaggttacctgtgcatg

SEQ ID NO: 118854 - DNA, 30 bp, Artificial Sequence
  Description of Artificial Sequence: Synthetic oligonucleotide
gaccatggccacaaaggttacctgtgcatg

SEQ ID NO: 118855 - DNA, 31 bp, Artificial Sequence
  Description of Artificial Sequence: Synthetic oligonucleotide
accatggccacaaaggttacctgtgcatgac

SEQ ID NO: 118856 - DNA, 30 bp, Artificial Sequence
  Description of Artificial Sequence: Synthetic oligonucleotide
ccatggccacaaaggttacctgtgcatgac

SEQ ID NO: 118857 - DNA, 31 bp, Artificial Sequence
  Description of Artificial Sequence: Synthetic oligonucleotide
catggccacaaaggttacctgtgcatgacag

SEQ ID NO: 118858 - DNA, 33 bp, Artificial Sequence
  Description of Artificial Sequence: Synthetic oligonucleotide
atggccacaaaggttacctgtgcatgacagatg

SEQ ID NO: 118859 - DNA, 32 bp, Artificial Sequence
  Description of Artificial Sequence: Synthetic oligonucleotide
tggccacaaaggttacctgtgcatgacagatg

SEQ ID NO: 118860 - DNA, 31 bp, Artificial Sequence
  Description of Artificial Sequence: Synthetic oligonucleotide
ggccacaaaggttacctgtgcatgacagatg

SEQ ID NO: 118861 - DNA, 32 bp, Artificial Sequence
  Description of Artificial Sequence: Synthetic oligonucleotide
gccacaaaggttacctgtgcatgacagatgag

SEQ ID NO: 118862 - DNA, 33 bp, Artificial Sequence
  Description of Artificial Sequence: Synthetic oligonucleotide
ccacaaaggttacctgtgcatgacagatgagtg

SEQ ID NO: 118863 - DNA, 33 bp, Artificial Sequence
  Description of Artificial Sequence: Synthetic oligonucleotide
cacaaaggttacctgtgcatgacagatgagtgg

SEQ ID NO: 118864 - DNA, 35 bp, Artificial Sequence
  Description of Artificial Sequence: Synthetic oligonucleotide
acaaaggttacctgtgcatgacagatgagtggttc

SEQ ID NO: 118865 - DNA, 34 bp, Artificial Sequence
  Description of Artificial Sequence: Synthetic oligonucleotide
caaaggttacctgtgcatgacagatgagtggttc

SEQ ID NO: 118866 - DNA, 35 bp, Artificial Sequence
  Description of Artificial Sequence: Synthetic oligonucleotide
aaaggttacctgtgcatgacagatgagtggttctc

SEQ ID NO: 118867 - DNA, 34 bp, Artificial Sequence
  Description of Artificial Sequence: Synthetic oligonucleotide
aaggttacctgtgcatgacagatgagtggttctc

SEQ ID NO: 118868 - DNA, 33 bp, Artificial Sequence
  Description of Artificial Sequence: Synthetic oligonucleotide
aggttacctgtgcatgacagatgagtggttctc

SEQ ID NO: 118869 - DNA, 32 bp, Artificial Sequence
  Description of Artificial Sequence: Synthetic oligonucleotide
ggttacctgtgcatgacagatgagtggttctc

SEQ ID NO: 118870 - DNA, 33 bp, Artificial Sequence
  Description of Artificial Sequence: Synthetic oligonucleotide
gttacctgtgcatgacagatgagtggttctctg

SEQ ID NO: 118871 - DNA, 34 bp, Artificial Sequence
  Description of Artificial Sequence: Synthetic oligonucleotide
ttacctgtgcatgacagatgagtggttctctgag

SEQ ID NO: 118872 - DNA, 33 bp, Artificial Sequence
  Description of Artificial Sequence: Synthetic oligonucleotide
tacctgtgcatgacagatgagtggttctctgag

SEQ ID NO: 118873 - DNA, 32 bp, Artificial Sequence
  Description of Artificial Sequence: Synthetic oligonucleotide
acctgtgcatgacagatgagtggttctctgag

SEQ ID NO: 118874 - DNA, 31 bp, Artificial Sequence
  Description of Artificial Sequence: Synthetic oligonucleotide
cctgtgcatgacagatgagtggttctctgag

SEQ ID NO: 118875 - DNA, 34 bp, Artificial Sequence
  Description of Artificial Sequence: Synthetic oligonucleotide
ctgtgcatgacagatgagtggttctctgagtatg

SEQ ID NO: 118876 - DNA, 35 bp, Artificial Sequence
  Description of Artificial Sequence: Synthetic oligonucleotide
tgtgcatgacagatgagtggttctctgagtatgtc

SEQ ID NO: 118877 - DNA, 34 bp, Artificial Sequence
  Description of Artificial Sequence: Synthetic oligonucleotide
gtgcatgacagatgagtggttctctgagtatgtc

SEQ ID NO: 118878 - DNA, 36 bp, Artificial Sequence
  Description of Artificial Sequence: Synthetic oligonucleotide
tgcatgacagatgagtggttctctgagtatgtctac

SEQ ID NO: 118879 - DNA, 35 bp, Artificial Sequence
  Description of Artificial Sequence: Synthetic oligonucleotide
gcatgacagatgagtggttctctgagtatgtctac

SEQ ID NO: 118880 - DNA, 35 bp, Artificial Sequence
  Description of Artificial Sequence: Synthetic oligonucleotide
catgacagatgagtggttctctgagtatgtctacg

SEQ ID NO: 118881 - DNA, 37 bp, Artificial Sequence
  Description of Artificial Sequence: Synthetic oligonucleotide
atgacagatgagtggttctctgagtatgtctacgaag

SEQ ID NO: 118882 - DNA, 36 bp, Artificial Sequence
  Description of Artificial Sequence: Synthetic oligonucleotide
tgacagatgagtggttctctgagtatgtctacgaag

SEQ ID NO: 118883 - DNA, 35 bp, Artificial Sequence
  Description of Artificial Sequence: Synthetic oligonucleotide
gacagatgagtggttctctgagtatgtctacgaag

SEQ ID NO: 118884 - DNA, 36 bp, Artificial Sequence
  Description of Artificial Sequence: Synthetic oligonucleotide
acagatgagtggttctctgagtatgtctacgaagtg

SEQ ID NO: 118885 - DNA, 35 bp, Artificial Sequence
  Description of Artificial Sequence: Synthetic oligonucleotide
cagatgagtggttctctgagtatgtctacgaagtg

SEQ ID NO: 118886 - DNA, 35 bp, Artificial Sequence
  Description of Artificial Sequence: Synthetic oligonucleotide
agatgagtggttctctgagtatgtctacgaagtgg

SEQ ID NO: 118887 - DNA, 34 bp, Artificial Sequence
  Description of Artificial Sequence: Synthetic oligonucleotide
gatgagtggttctctgagtatgtctacgaagtgg

SEQ ID NO: 118888 - DNA, 35 bp, Artificial Sequence
  Description of Artificial Sequence: Synthetic oligonucleotide
atgagtggttctctgagtatgtctacgaagtggtg

SEQ ID NO: 118889 - DNA, 34 bp, Artificial Sequence
  Description of Artificial Sequence: Synthetic oligonucleotide
tgagtggttctctgagtatgtctacgaagtggtg

SEQ ID NO: 118890 - DNA, 33 bp, Artificial Sequence
  Description of Artificial Sequence: Synthetic oligonucleotide
gagtggttctctgagtatgtctacgaagtggtg

SEQ ID NO: 118891 - DNA, 33 bp, Artificial Sequence
  Description of Artificial Sequence: Synthetic oligonucleotide
agtggttctctgagtatgtctacgaagtggtgg

SEQ ID NO: 118892 - DNA, 32 bp, Artificial Sequence
  Description of Artificial Sequence: Synthetic oligonucleotide
gtggttctctgagtatgtctacgaagtggtgg

SEQ ID NO: 118893 - DNA, 33 bp, Artificial Sequence
  Description of Artificial Sequence: Synthetic oligonucleotide
tggttctctgagtatgtctacgaagtggtggtg

SEQ ID NO: 118894 - DNA, 32 bp, Artificial Sequence
  Description of Artificial Sequence: Synthetic oligonucleotide
ggttctctgagtatgtctacgaagtggtggtg

SEQ ID NO: 118895 - DNA, 32 bp, Artificial Sequence
  Description of Artificial Sequence: Synthetic oligonucleotide
gttctctgagtatgtctacgaagtggtggtgg

SEQ ID NO: 118896 - DNA, 33 bp, Artificial Sequence
  Description of Artificial Sequence: Synthetic oligonucleotide
ttctctgagtatgtctacgaagtggtggtggac

SEQ ID NO: 118897 - DNA, 32 bp, Artificial Sequence
  Description of Artificial Sequence: Synthetic oligonucleotide
tctctgagtatgtctacgaagtggtggtggac

SEQ ID NO: 118898 - DNA, 31 bp, Artificial Sequence
  Description of Artificial Sequence: Synthetic oligonucleotide
ctctgagtatgtctacgaagtggtggtggac

SEQ ID NO: 118899 - DNA, 32 bp, Artificial Sequence
  Description of Artificial Sequence: Synthetic oligonucleotide
tctgagtatgtctacgaagtggtggtggacag

SEQ ID NO: 118900 - DNA, 31 bp, Artificial Sequence
  Description of Artificial Sequence: Synthetic oligonucleotide
ctgagtatgtctacgaagtggtggtggacag

SEQ ID NO: 118901 - DNA, 31 bp, Artificial Sequence
  Description of Artificial Sequence: Synthetic oligonucleotide
tgagtatgtctacgaagtggtggtggacagg

SEQ ID NO: 118902 - DNA, 30 bp, Artificial Sequence
  Description of Artificial Sequence: Synthetic oligonucleotide
gagtatgtctacgaagtggtggtggacagg

SEQ ID NO: 118903 - DNA, 32 bp, Artificial Sequence
  Description of Artificial Sequence: Synthetic oligonucleotide
agtatgtctacgaagtggtggtggacaggaag

SEQ ID NO: 118904 - DNA, 31 bp, Artificial Sequence
  Description of Artificial Sequence: Synthetic oligonucleotide
gtatgtctacgaagtggtggtggacaggaag

SEQ ID NO: 118905 - DNA, 31 bp, Artificial Sequence
  Description of Artificial Sequence: Synthetic oligonucleotide
tatgtctacgaagtggtggtggacaggaagc

SEQ ID NO: 118906 - DNA, 30 bp, Artificial Sequence
  Description of Artificial Sequence: Synthetic oligonucleotide
atgtctacgaagtggtggtggacaggaagc

SEQ ID NO: 118907 - DNA, 29 bp, Artificial Sequence
  Description of Artificial Sequence: Synthetic oligonucleotide
tgtctacgaagtggtggtggacaggaagc

SEQ ID NO: 118908 - DNA, 28 bp, Artificial Sequence
  Description of Artificial Sequence: Synthetic oligonucleotide
gtctacgaagtggtggtggacaggaagc

SEQ ID NO: 118909 - DNA, 30 bp, Artificial Sequence
  Description of Artificial Sequence: Synthetic oligonucleotide
tctacgaagtggtggtggacaggaagcatg

SEQ ID NO: 118910 - DNA, 29 bp, Artificial Sequence
  Description of Artificial Sequence: Synthetic oligonucleotide
ctacgaagtggtggtggacaggaagcatg

SEQ ID NO: 118911 - DNA, 30 bp, Artificial Sequence
  Description of Artificial Sequence: Synthetic oligonucleotide
tacgaagtggtggtggacaggaagcatgtc

SEQ ID NO: 118912 - DNA, 29 bp, Artificial Sequence
  Description of Artificial Sequence: Synthetic oligonucleotide
acgaagtggtggtggacaggaagcatgtc

SEQ ID NO: 118913 - DNA, 28 bp, Artificial Sequence
  Description of Artificial Sequence: Synthetic oligonucleotide
cgaagtggtggtggacaggaagcatgtc

SEQ ID NO: 118914 - DNA, 28 bp, Artificial Sequence
  Description of Artificial Sequence: Synthetic oligonucleotide
gaagtggtggtggacaggaagcatgtcc

SEQ ID NO: 118915 - DNA, 28 bp, Artificial Sequence
  Description of Artificial Sequence: Synthetic oligonucleotide
aagtggtggtggacaggaagcatgtccc

SEQ ID NO: 118916 - DNA, 27 bp, Artificial Sequence
  Description of Artificial Sequence: Synthetic oligonucleotide
agtggtggtggacaggaagcatgtccc

SEQ ID NO: 118917 - DNA, 27 bp, Artificial Sequence
  Description of Artificial Sequence: Synthetic oligonucleotide
gtggtggtggacaggaagcatgtccct

SEQ ID NO: 118918 - DNA, 27 bp, Artificial Sequence
  Description of Artificial Sequence: Synthetic oligonucleotide
tggtggtggacaggaagcatgtccctg

SEQ ID NO: 118919 - DNA, 27 bp, Artificial Sequence
  Description of Artificial Sequence: Synthetic oligonucleotide
ggtggtggacaggaagcatgtccctga

SEQ ID NO: 118920 - DNA, 28 bp, Artificial Sequence
  Description of Artificial Sequence: Synthetic oligonucleotide
gtggtggacaggaagcatgtccctgaag

SEQ ID NO: 118921 - DNA, 29 bp, Artificial Sequence
  Description of Artificial Sequence: Synthetic oligonucleotide
tggtggacaggaagcatgtccctgaagag

SEQ ID NO: 118922 - DNA, 28 bp, Artificial Sequence
  Description of Artificial Sequence: Synthetic oligonucleotide
ggtggacaggaagcatgtccctgaagag

SEQ ID NO: 118923 - DNA, 28 bp, Artificial Sequence
  Description of Artificial Sequence: Synthetic oligonucleotide
gtggacaggaagcatgtccctgaagagg

SEQ ID NO: 118924 - DNA, 29 bp, Artificial Sequence
  Description of Artificial Sequence: Synthetic oligonucleotide
tggacaggaagcatgtccctgaagaggtg

SEQ ID NO: 118925 - DNA, 28 bp, Artificial Sequence
  Description of Artificial Sequence: Synthetic oligonucleotide
ggacaggaagcatgtccctgaagaggtg

SEQ ID NO: 118926 - DNA, 28 bp, Artificial Sequence
  Description of Artificial Sequence: Synthetic oligonucleotide
gacaggaagcatgtccctgaagaggtgc

SEQ ID NO: 118927 - DNA, 30 bp, Artificial Sequence
  Description of Artificial Sequence: Synthetic oligonucleotide
acaggaagcatgtccctgaagaggtgctag

SEQ ID NO: 118928 - DNA, 29 bp, Artificial Sequence
  Description of Artificial Sequence: Synthetic oligonucleotide
caggaagcatgtccctgaagaggtgctag

SEQ ID NO: 118929 - DNA, 29 bp, Artificial Sequence
  Description of Artificial Sequence: Synthetic oligonucleotide
aggaagcatgtccctgaagaggtgctagc

SEQ ID NO: 118930 - DNA, 28 bp, Artificial Sequence
  Description of Artificial Sequence: Synthetic oligonucleotide
ggaagcatgtccctgaagaggtgctagc

SEQ ID NO: 118931 - DNA, 29 bp, Artificial Sequence
  Description of Artificial Sequence: Synthetic oligonucleotide
gaagcatgtccctgaagaggtgctagctg

SEQ ID NO: 118932 - DNA, 30 bp, Artificial Sequence
  Description of Artificial Sequence: Synthetic oligonucleotide
aagcatgtccctgaagaggtgctagctgtg

SEQ ID NO: 118933 - DNA, 29 bp, Artificial Sequence
  Description of Artificial Sequence: Synthetic oligonucleotide
agcatgtccctgaagaggtgctagctgtg

SEQ ID NO: 118934 - DNA, 28 bp, Artificial Sequence
  Description of Artificial Sequence: Synthetic oligonucleotide
gcatgtccctgaagaggtgctagctgtg

SEQ ID NO: 118935 - DNA, 31 bp, Artificial Sequence
  Description of Artificial Sequence: Synthetic oligonucleotide
catgtccctgaagaggtgctagctgtgttag

SEQ ID NO: 118936 - DNA, 32 bp, Artificial Sequence
  Description of Artificial Sequence: Synthetic oligonucleotide
atgtccctgaagaggtgctagctgtgttagag

SEQ ID NO: 118937 - DNA, 31 bp, Artificial Sequence
  Description of Artificial Sequence: Synthetic oligonucleotide
tgtccctgaagaggtgctagctgtgttagag

SEQ ID NO: 118938 - DNA, 30 bp, Artificial Sequence
  Description of Artificial Sequence: Synthetic oligonucleotide
gtccctgaagaggtgctagctgtgttagag

SEQ ID NO: 118939 - DNA, 30 bp, Artificial Sequence
  Description of Artificial Sequence: Synthetic oligonucleotide
tccctgaagaggtgctagctgtgttagagc

SEQ ID NO: 118940 - DNA, 29 bp, Artificial Sequence
  Description of Artificial Sequence: Synthetic oligonucleotide
ccctgaagaggtgctagctgtgttagagc

SEQ ID NO: 118941 - DNA, 30 bp, Artificial Sequence
  Description of Artificial Sequence: Synthetic oligonucleotide
cctgaagaggtgctagctgtgttagagcag

SEQ ID NO: 118942 - DNA, 30 bp, Artificial Sequence
  Description of Artificial Sequence: Synthetic oligonucleotide
ctgaagaggtgctagctgtgttagagcagg

SEQ ID NO: 118943 - DNA, 32 bp, Artificial Sequence
  Description of Artificial Sequence: Synthetic oligonucleotide
tgaagaggtgctagctgtgttagagcaggaac

SEQ ID NO: 118944 - DNA, 31 bp, Artificial Sequence
  Description of Artificial Sequence: Synthetic oligonucleotide
gaagaggtgctagctgtgttagagcaggaac

SEQ ID NO: 118945 - DNA, 31 bp, Artificial Sequence
  Description of Artificial Sequence: Synthetic oligonucleotide
aagaggtgctagctgtgttagagcaggaacc

SEQ ID NO: 118946 - DNA, 30 bp, Artificial Sequence
  Description of Artificial Sequence: Synthetic oligonucleotide
agaggtgctagctgtgttagagcaggaacc

SEQ ID NO: 118947 - DNA, 29 bp, Artificial Sequence
  Description of Artificial Sequence: Synthetic oligonucleotide
gaggtgctagctgtgttagagcaggaacc

SEQ ID NO: 118948 - DNA, 29 bp, Artificial Sequence
  Description of Artificial Sequence: Synthetic oligonucleotide
aggtgctagctgtgttagagcaggaaccc

SEQ ID NO: 118949 - DNA, 28 bp, Artificial Sequence
  Description of Artificial Sequence: Synthetic oligonucleotide
ggtgctagctgtgttagagcaggaaccc

SEQ ID NO: 118950 - DNA, 33 bp, Artificial Sequence
  Description of Artificial Sequence: Synthetic oligonucleotide
gtgctagctgtgttagagcaggaacccattatc

SEQ ID NO: 118951 - DNA, 33 bp, Artificial Sequence
  Description of Artificial Sequence: Synthetic oligonucleotide
tgctagctgtgttagagcaggaacccattatcc

SEQ ID NO: 118952 - DNA, 32 bp, Artificial Sequence
  Description of Artificial Sequence: Synthetic oligonucleotide
gctagctgtgttagagcaggaacccattatcc

SEQ ID NO: 118953 - DNA, 33 bp, Artificial Sequence
  Description of Artificial Sequence: Synthetic oligonucleotide
ctagctgtgttagagcaggaacccattatcctg

SEQ ID NO: 118954 - DNA, 33 bp, Artificial Sequence
  Description of Artificial Sequence: Synthetic oligonucleotide
tagctgtgttagagcaggaacccattatcctgc

SEQ ID NO: 118955 - DNA, 32 bp, Artificial Sequence
  Description of Artificial Sequence: Synthetic oligonucleotide
agctgtgttagagcaggaacccattatcctgc

SEQ ID NO: 118956 - DNA, 31 bp, Artificial Sequence
  Description of Artificial Sequence: Synthetic oligonucleotide
gctgtgttagagcaggaacccattatcctgc

SEQ ID NO: 118957 - DNA, 31 bp, Artificial Sequence
  Description of Artificial Sequence: Synthetic oligonucleotide
ctgtgttagagcaggaacccattatcctgcc

SEQ ID NO: 118958 - DNA, 32 bp, Artificial Sequence
  Description of Artificial Sequence: Synthetic oligonucleotide
tgtgttagagcaggaacccattatcctgccag

SEQ ID NO: 118959 - DNA, 31 bp, Artificial Sequence
  Description of Artificial Sequence: Synthetic oligonucleotide
gtgttagagcaggaacccattatcctgccag

SEQ ID NO: 118960 - DNA, 31 bp, Artificial Sequence
  Description of Artificial Sequence: Synthetic oligonucleotide
tgttagagcaggaacccattatcctgccagc

SEQ ID NO: 118961 - DNA, 30 bp, Artificial Sequence
  Description of Artificial Sequence: Synthetic oligonucleotide
gttagagcaggaacccattatcctgccagc

SEQ ID NO: 118962 - DNA, 32 bp, Artificial Sequence
  Description of Artificial Sequence: Synthetic oligonucleotide
ttagagcaggaacccattatcctgccagcatg

SEQ ID NO: 118963 - DNA, 31 bp, Artificial Sequence
  Description of Artificial Sequence: Synthetic oligonucleotide
tagagcaggaacccattatcctgccagcatg

SEQ ID NO: 118964 - DNA, 30 bp, Artificial Sequence
  Description of Artificial Sequence: Synthetic oligonucleotide
agagcaggaacccattatcctgccagcatg

SEQ ID NO: 118965 - DNA, 29 bp, Artificial Sequence
  Description of Artificial Sequence: Synthetic oligonucleotide
gagcaggaacccattatcctgccagcatg

SEQ ID NO: 118966 - DNA, 29 bp, Artificial Sequence
  Description of Artificial Sequence: Synthetic oligonucleotide
agcaggaacccattatcctgccagcatgg

SEQ ID NO: 118967 - DNA, 28 bp, Artificial Sequence
  Description of Artificial Sequence: Synthetic oligonucleotide
gcaggaacccattatcctgccagcatgg

SEQ ID NO: 118968 - DNA, 28 bp, Artificial Sequence
  Description of Artificial Sequence: Synthetic oligonucleotide
caggaacccattatcctgccagcatggg

SEQ ID NO: 118969 - DNA, 29 bp, Artificial Sequence
  Description of Artificial Sequence: Synthetic oligonucleotide
aggaacccattatcctgccagcatgggac

SEQ ID NO: 118970 - DNA, 28 bp, Artificial Sequence
  Description of Artificial Sequence: Synthetic oligonucleotide
ggaacccattatcctgccagcatgggac

SEQ ID NO: 118971 - DNA, 28 bp, Artificial Sequence
  Description of Artificial Sequence: Synthetic oligonucleotide
gaacccattatcctgccagcatgggacc

SEQ ID NO: 118972 - DNA, 28 bp, Artificial Sequence
  Description of Artificial Sequence: Synthetic oligonucleotide
aacccattatcctgccagcatgggaccc

SEQ ID NO: 118973 - DNA, 27 bp, Artificial Sequence
  Description of Artificial Sequence: Synthetic oligonucleotide
acccattatcctgccagcatgggaccc

SEQ ID NO: 118974 - DNA, 26 bp, Artificial Sequence
  Description of Artificial Sequence: Synthetic oligonucleotide
cccattatcctgccagcatgggaccc

SEQ ID NO: 118975 - DNA, 27 bp, Artificial Sequence
  Description of Artificial Sequence: Synthetic oligonucleotide
ccattatcctgccagcatgggacccca

SEQ ID NO: 118976 - DNA, 28 bp, Artificial Sequence
  Description of Artificial Sequence: Synthetic oligonucleotide
cattatcctgccagcatgggaccccatg

SEQ ID NO: 118977 - DNA, 28 bp, Artificial Sequence
  Description of Artificial Sequence: Synthetic oligonucleotide
attatcctgccagcatgggaccccatgg

SEQ ID NO: 118978 - DNA, 27 bp, Artificial Sequence
  Description of Artificial Sequence: Synthetic oligonucleotide
ttatcctgccagcatgggaccccatgg

SEQ ID NO: 118979 - DNA, 26 bp, Artificial Sequence
  Description of Artificial Sequence: Synthetic oligonucleotide
tatcctgccagcatgggaccccatgg

SEQ ID NO: 118980 - DNA, 25 bp, Artificial Sequence
  Description of Artificial Sequence: Synthetic oligonucleotide
atcctgccagcatgggaccccatgg

SEQ ID NO: 118981 - DNA, 24 bp, Artificial Sequence
  Description of Artificial Sequence: Synthetic oligonucleotide
tcctgccagcatgggaccccatgg

SEQ ID NO: 118982 - DNA, 23 bp, Artificial Sequence
  Description of Artificial Sequence: Synthetic oligonucleotide
cctgccagcatgggaccccatgg

SEQ ID NO: 118983 - DNA, 24 bp, Artificial Sequence
  Description of Artificial Sequence: Synthetic oligonucleotide
ctgccagcatgggaccccatggga

SEQ ID NO: 118984 - DNA, 24 bp, Artificial Sequence
  Description of Artificial Sequence: Synthetic oligonucleotide
tgccagcatgggaccccatgggag

SEQ ID NO: 118985 - DNA, 23 bp, Artificial Sequence
  Description of Artificial Sequence: Synthetic oligonucleotide
gccagcatgggaccccatgggag

SEQ ID NO: 118986 - DNA, 26 bp, Artificial Sequence
  Description of Artificial Sequence: Synthetic oligonucleotide
ccagcatgggaccccatgggagcttt

SEQ ID NO: 118987 - DNA, 26 bp, Artificial Sequence
  Description of Artificial Sequence: Synthetic oligonucleotide
cagcatgggaccccatgggagctttg

SEQ ID NO: 118988 - DNA, 26 bp, Artificial Sequence
  Description of Artificial Sequence: Synthetic oligonucleotide
agcatgggaccccatgggagctttgg

SEQ ID NO: 118989 - DNA, 25 bp, Artificial Sequence
  Description of Artificial Sequence: Synthetic oligonucleotide
gcatgggaccccatgggagctttgg

SEQ ID NO: 118990 - DNA, 26 bp, Artificial Sequence
  Description of Artificial Sequence: Synthetic oligonucleotide
catgggaccccatgggagctttggct

SEQ ID NO: 118991 - DNA, 27 bp, Artificial Sequence
  Description of Artificial Sequence: Synthetic oligonucleotide
atgggaccccatgggagctttggctga

SEQ ID NO: 118992 - DNA, 26 bp, Artificial Sequence
  Description of Artificial Sequence: Synthetic oligonucleotide
tgggaccccatgggagctttggctga

SEQ ID NO: 118993 - DNA, 25 bp, Artificial Sequence
  Description of Artificial Sequence: Synthetic oligonucleotide
gggaccccatgggagctttggctga

SEQ ID NO: 118994 - DNA, 26 bp, Artificial Sequence
  Description of Artificial Sequence: Synthetic oligonucleotide
ggaccccatgggagctttggctgagt

SEQ ID NO: 118995 - DNA, 27 bp, Artificial Sequence
  Description of Artificial Sequence: Synthetic oligonucleotide
gaccccatgggagctttggctgagtga

SEQ ID NO: 118996 - DNA, 27 bp, Artificial Sequence
  Description of Artificial Sequence: Synthetic oligonucleotide
atgttcttgctgcctcttccggctgcg

SEQ ID NO: 118997 - DNA, 26 bp, Artificial Sequence
  Description of Artificial Sequence: Synthetic oligonucleotide
tgttcttgctgcctcttccggctgcg

SEQ ID NO: 118998 - DNA, 25 bp, Artificial Sequence
  Description of Artificial Sequence: Synthetic oligonucleotide
gttcttgctgcctcttccggctgcg

SEQ ID NO: 118999 - DNA, 25 bp, Artificial Sequence
  Description of Artificial Sequence: Synthetic oligonucleotide
ttcttgctgcctcttccggctgcgg

SEQ ID NO: 119000 - DNA, 24 bp, Artificial Sequence
  Description of Artificial Sequence: Synthetic oligonucleotide
tcttgctgcctcttccggctgcgg

SEQ ID NO: 119001 - DNA, 23 bp, Artificial Sequence
  Description of Artificial Sequence: Synthetic oligonucleotide
cttgctgcctcttccggctgcgg

SEQ ID NO: 119002 - DNA, 23 bp, Artificial Sequence
  Description of Artificial Sequence: Synthetic oligonucleotide
ttgctgcctcttccggctgcggg

SEQ ID NO: 119003 - DNA, 22 bp, Artificial Sequence
  Description of Artificial Sequence: Synthetic oligonucleotide
tgctgcctcttccggctgcggg

SEQ ID NO: 119004 - DNA, 21 bp, Artificial Sequence
  Description of Artificial Sequence: Synthetic oligonucleotide
gctgcctcttccggctgcggg

SEQ ID NO: 119005 - DNA, 21 bp, Artificial Sequence
  Description of Artificial Sequence: Synthetic oligonucleotide
ctgcctcttccggctgcgggg

SEQ ID NO: 119006 - DNA, 21 bp, Artificial Sequence
  Description of Artificial Sequence: Synthetic oligonucleotide
tgcctcttccggctgcggggc

SEQ ID NO: 119007 - DNA, 20 bp, Artificial Sequence
  Description of Artificial Sequence: Synthetic oligonucleotide
gcctcttccggctgcggggc

SEQ ID NO: 119008 - DNA, 21 bp, Artificial Sequence
  Description of Artificial Sequence: Synthetic oligonucleotide
cctcttccggctgcggggcga

SEQ ID NO: 119009 - DNA, 23 bp, Artificial Sequence
  Description of Artificial Sequence: Synthetic oligonucleotide
ctcttccggctgcggggcgagta

SEQ ID NO: 119010 - DNA, 24 bp, Artificial Sequence
  Description of Artificial Sequence: Synthetic oligonucleotide
tcttccggctgcggggcgagtagt

SEQ ID NO: 119011 - DNA, 23 bp, Artificial Sequence
  Description of Artificial Sequence: Synthetic oligonucleotide
cttccggctgcggggcgagtagt

SEQ ID NO: 119012 - DNA, 23 bp, Artificial Sequence
  Description of Artificial Sequence: Synthetic oligonucleotide
ttccggctgcggggcgagtagtc

SEQ ID NO: 119013 - DNA, 22 bp, Artificial Sequence
  Description of Artificial Sequence: Synthetic oligonucleotide
tccggctgcggggcgagtagtc

SEQ ID NO: 119014 - DNA, 21 bp, Artificial Sequence
  Description of Artificial Sequence: Synthetic oligonucleotide
ccggctgcggggcgagtagtc

SEQ ID NO: 119015 - DNA, 22 bp, Artificial Sequence
  Description of Artificial Sequence: Synthetic oligonucleotide
cggctgcggggcgagtagtcgt

SEQ ID NO: 119016 - DNA, 22 bp, Artificial Sequence
  Description of Artificial Sequence: Synthetic oligonucleotide
ggctgcggggcgagtagtcgtc

SEQ ID NO: 119017 - DNA, 22 bp, Artificial Sequence
  Description of Artificial Sequence: Synthetic oligonucleotide
gctgcggggcgagtagtcgtcc

SEQ ID NO: 119018 - DNA, 23 bp, Artificial Sequence
  Description of Artificial Sequence: Synthetic oligonucleotide
ctgcggggcgagtagtcgtccga

SEQ ID NO: 119019 - DNA, 23 bp, Artificial Sequence
  Description of Artificial Sequence: Synthetic oligonucleotide
tgcggggcgagtagtcgtccgac

SEQ ID NO: 119020 - DNA, 22 bp, Artificial Sequence
  Description of Artificial Sequence: Synthetic oligonucleotide
gcggggcgagtagtcgtccgac

SEQ ID NO: 119021 - DNA, 23 bp, Artificial Sequence
  Description of Artificial Sequence: Synthetic oligonucleotide
cggggcgagtagtcgtccgacgt

SEQ ID NO: 119022 - DNA, 24 bp, Artificial Sequence
  Description of Artificial Sequence: Synthetic oligonucleotide
ggggcgagtagtcgtccgacgtct

SEQ ID NO: 119023 - DNA, 24 bp, Artificial Sequence
  Description of Artificial Sequence: Synthetic oligonucleotide
gggcgagtagtcgtccgacgtctg

SEQ ID NO: 119024 - DNA, 24 bp, Artificial Sequence
  Description of Artificial Sequence: Synthetic oligonucleotide
ggcgagtagtcgtccgacgtctgg

SEQ ID NO: 119025 - DNA, 24 bp, Artificial Sequence
  Description of Artificial Sequence: Synthetic oligonucleotide
gcgagtagtcgtccgacgtctggc

SEQ ID NO: 119026 - DNA, 24 bp, Artificial Sequence
  Description of Artificial Sequence: Synthetic oligonucleotide
cgagtagtcgtccgacgtctggcc

SEQ ID NO: 119027 - DNA, 25 bp, Artificial Sequence
  Description of Artificial Sequence: Synthetic oligonucleotide
gagtagtcgtccgacgtctggccgt

SEQ ID NO: 119028 - DNA, 26 bp, Artificial Sequence
  Description of Artificial Sequence: Synthetic oligonucleotide
agtagtcgtccgacgtctggccgtga

SEQ ID NO: 119029 - DNA, 25 bp, Artificial Sequence
  Description of Artificial Sequence: Synthetic oligonucleotide
gtagtcgtccgacgtctggccgtga

SEQ ID NO: 119030 - DNA, 26 bp, Artificial Sequence
  Description of Artificial Sequence: Synthetic oligonucleotide
tagtcgtccgacgtctggccgtgaga

SEQ ID NO: 119031 - DNA, 25 bp, Artificial Sequence
  Description of Artificial Sequence: Synthetic oligonucleotide
agtcgtccgacgtctggccgtgaga

SEQ ID NO: 119032 - DNA, 24 bp, Artificial Sequence
  Description of Artificial Sequence: Synthetic oligonucleotide
gtcgtccgacgtctggccgtgaga

SEQ ID NO: 119033 - DNA, 24 bp, Artificial Sequence
  Description of Artificial Sequence: Synthetic oligonucleotide
tcgtccgacgtctggccgtgagac

SEQ ID NO: 119034 - DNA, 23 bp, Artificial Sequence
  Description of Artificial Sequence: Synthetic oligonucleotide
cgtccgacgtctggccgtgagac

SEQ ID NO: 119035 - DNA, 26 bp, Artificial Sequence
  Description of Artificial Sequence: Synthetic oligonucleotide
gtccgacgtctggccgtgagacgttt

SEQ ID NO: 119036 - DNA, 26 bp, Artificial Sequence
  Description of Artificial Sequence: Synthetic oligonucleotide
tccgacgtctggccgtgagacgtttc

SEQ ID NO: 119037 - DNA, 25 bp, Artificial Sequence
  Description of Artificial Sequence: Synthetic oligonucleotide
ccgacgtctggccgtgagacgtttc

SEQ ID NO: 119038 - DNA, 25 bp, Artificial Sequence
  Description of Artificial Sequence: Synthetic oligonucleotide
cgacgtctggccgtgagacgtttcg

SEQ ID NO: 119039 - DNA, 25 bp, Artificial Sequence
  Description of Artificial Sequence: Synthetic oligonucleotide
gacgtctggccgtgagacgtttcgg

SEQ ID NO: 119040 - DNA, 26 bp, Artificial Sequence
  Description of Artificial Sequence: Synthetic oligonucleotide
acgtctggccgtgagacgtttcggga

SEQ ID NO: 119041 - DNA, 25 bp, Artificial Sequence
  Description of Artificial Sequence: Synthetic oligonucleotide
cgtctggccgtgagacgtttcggga

SEQ ID NO: 119042 - DNA, 25 bp, Artificial Sequence
  Description of Artificial Sequence: Synthetic oligonucleotide
gtctggccgtgagacgtttcgggag

SEQ ID NO: 119043 - DNA, 25 bp, Artificial Sequence
  Description of Artificial Sequence: Synthetic oligonucleotide
tctggccgtgagacgtttcgggagc

SEQ ID NO: 119044 - DNA, 24 bp, Artificial Sequence
  Description of Artificial Sequence: Synthetic oligonucleotide
ctggccgtgagacgtttcgggagc

SEQ ID NO: 119045 - DNA, 24 bp, Artificial Sequence
  Description of Artificial Sequence: Synthetic oligonucleotide
tggccgtgagacgtttcgggagcc

SEQ ID NO: 119046 - DNA, 23 bp, Artificial Sequence
  Description of Artificial Sequence: Synthetic oligonucleotide
ggccgtgagacgtttcgggagcc

SEQ ID NO: 119047 - DNA, 23 bp, Artificial Sequence
  Description of Artificial Sequence: Synthetic oligonucleotide
gccgtgagacgtttcgggagccg

SEQ ID NO: 119048 - DNA, 24 bp, Artificial Sequence
  Description of Artificial Sequence: Synthetic oligonucleotide
ccgtgagacgtttcgggagccgga

SEQ ID NO: 119049 - DNA, 25 bp, Artificial Sequence
  Description of Artificial Sequence: Synthetic oligonucleotide
cgtgagacgtttcgggagccggagt

SEQ ID NO: 119050 - DNA, 26 bp, Artificial Sequence
  Description of Artificial Sequence: Synthetic oligonucleotide
gtgagacgtttcgggagccggagtct

SEQ ID NO: 119051 - DNA, 27 bp, Artificial Sequence
  Description of Artificial Sequence: Synthetic oligonucleotide
tgagacgtttcgggagccggagtctct

SEQ ID NO: 119052 - DNA, 26 bp, Artificial Sequence
  Description of Artificial Sequence: Synthetic oligonucleotide
gagacgtttcgggagccggagtctct

SEQ ID NO: 119053 - DNA, 26 bp, Artificial Sequence
  Description of Artificial Sequence: Synthetic oligonucleotide
agacgtttcgggagccggagtctctc

SEQ ID NO: 119054 - DNA, 25 bp, Artificial Sequence
  Description of Artificial Sequence: Synthetic oligonucleotide
gacgtttcgggagccggagtctctc

SEQ ID NO: 119055 - DNA, 26 bp, Artificial Sequence
  Description of Artificial Sequence: Synthetic oligonucleotide
acgtttcgggagccggagtctctcca

SEQ ID NO: 119056 - DNA, 25 bp, Artificial Sequence
  Description of Artificial Sequence: Synthetic oligonucleotide
cgtttcgggagccggagtctctcca

SEQ ID NO: 119057 - DNA, 25 bp, Artificial Sequence
  Description of Artificial Sequence: Synthetic oligonucleotide
gtttcgggagccggagtctctccac

SEQ ID NO: 119058 - DNA, 25 bp, Artificial Sequence
  Description of Artificial Sequence: Synthetic oligonucleotide
tttcgggagccggagtctctccacc

SEQ ID NO: 119059 - DNA, 24 bp, Artificial Sequence
  Description of Artificial Sequence: Synthetic oligonucleotide
ttcgggagccggagtctctccacc

SEQ ID NO: 119060 - DNA, 23 bp, Artificial Sequence
  Description of Artificial Sequence: Synthetic oligonucleotide
tcgggagccggagtctctccacc

SEQ ID NO: 119061 - DNA, 22 bp, Artificial Sequence
  Description of Artificial Sequence: Synthetic oligonucleotide
cgggagccggagtctctccacc

SEQ ID NO: 119062 - DNA, 22 bp, Artificial Sequence
  Description of Artificial Sequence: Synthetic oligonucleotide
gggagccggagtctctccaccg

SEQ ID NO: 119063 - DNA, 23 bp, Artificial Sequence
  Description of Artificial Sequence: Synthetic oligonucleotide
ggagccggagtctctccaccgca

SEQ ID NO: 119064 - DNA, 24 bp, Artificial Sequence
  Description of Artificial Sequence: Synthetic oligonucleotide
gagccggagtctctccaccgcaga

SEQ ID NO: 119065 - DNA, 26 bp, Artificial Sequence
  Description of Artificial Sequence: Synthetic oligonucleotide
agccggagtctctccaccgcagacat

SEQ ID NO: 119066 - DNA, 25 bp, Artificial Sequence
  Description of Artificial Sequence: Synthetic oligonucleotide
gccggagtctctccaccgcagacat

SEQ ID NO: 119067 - DNA, 26 bp, Artificial Sequence
  Description of Artificial Sequence: Synthetic oligonucleotide
ccggagtctctccaccgcagacatga

SEQ ID NO: 119068 - DNA, 26 bp, Artificial Sequence
  Description of Artificial Sequence: Synthetic oligonucleotide
cggagtctctccaccgcagacatgac

SEQ ID NO: 119069 - DNA, 27 bp, Artificial Sequence
  Description of Artificial Sequence: Synthetic oligonucleotide
ggagtctctccaccgcagacatgacga

SEQ ID NO: 119070 - DNA, 28 bp, Artificial Sequence
  Description of Artificial Sequence: Synthetic oligonucleotide
gagtctctccaccgcagacatgacgaag

SEQ ID NO: 119071 - DNA, 28 bp, Artificial Sequence
  Description of Artificial Sequence: Synthetic oligonucleotide
agtctctccaccgcagacatgacgaagg

SEQ ID NO: 119072 - DNA, 27 bp, Artificial Sequence
  Description of Artificial Sequence: Synthetic oligonucleotide
gtctctccaccgcagacatgacgaagg

SEQ ID NO: 119073 - DNA, 27 bp, Artificial Sequence
  Description of Artificial Sequence: Synthetic oligonucleotide
tctctccaccgcagacatgacgaaggg

SEQ ID NO: 119074 - DNA, 26 bp, Artificial Sequence
  Description of Artificial Sequence: Synthetic oligonucleotide
ctctccaccgcagacatgacgaaggg

SEQ ID NO: 119075 - DNA, 26 bp, Artificial Sequence
  Description of Artificial Sequence: Synthetic oligonucleotide
tctccaccgcagacatgacgaagggc

SEQ ID NO: 119076 - DNA, 25 bp, Artificial Sequence
  Description of Artificial Sequence: Synthetic oligonucleotide
ctccaccgcagacatgacgaagggc

SEQ ID NO: 119077 - DNA, 27 bp, Artificial Sequence
  Description of Artificial Sequence: Synthetic oligonucleotide
tccaccgcagacatgacgaagggcctt

SEQ ID NO: 119078 - DNA, 26 bp, Artificial Sequence
  Description of Artificial Sequence: Synthetic oligonucleotide
ccaccgcagacatgacgaagggcctt

SEQ ID NO: 119079 - DNA, 27 bp, Artificial Sequence
  Description of Artificial Sequence: Synthetic oligonucleotide
caccgcagacatgacgaagggccttgt

SEQ ID NO: 119080 - DNA, 31 bp, Artificial Sequence
  Description of Artificial Sequence: Synthetic oligonucleotide
accgcagacatgacgaagggccttgttttag

SEQ ID NO: 119081 - DNA, 30 bp, Artificial Sequence
  Description of Artificial Sequence: Synthetic oligonucleotide
ccgcagacatgacgaagggccttgttttag

SEQ ID NO: 119082 - DNA, 30 bp, Artificial Sequence
  Description of Artificial Sequence: Synthetic oligonucleotide
cgcagacatgacgaagggccttgttttagg

SEQ ID NO: 119083 - DNA, 33 bp, Artificial Sequence
  Description of Artificial Sequence: Synthetic oligonucleotide
gcagacatgacgaagggccttgttttaggaatc

SEQ ID NO: 119084 - DNA, 37 bp, Artificial Sequence
  Description of Artificial Sequence: Synthetic oligonucleotide
cagacatgacgaagggccttgttttaggaatctattc

SEQ ID NO: 119085 - DNA, 37 bp, Artificial Sequence
  Description of Artificial Sequence: Synthetic oligonucleotide
agacatgacgaagggccttgttttaggaatctattcc

SEQ ID NO: 119086 - DNA, 36 bp, Artificial Sequence
  Description of Artificial Sequence: Synthetic oligonucleotide
gacatgacgaagggccttgttttaggaatctattcc

SEQ ID NO: 119087 - DNA, 39 bp, Artificial Sequence
  Description of Artificial Sequence: Synthetic oligonucleotide
acatgacgaagggccttgttttaggaatctattccaaag

SEQ ID NO: 119088 - DNA, 38 bp, Artificial Sequence
  Description of Artificial Sequence: Synthetic oligonucleotide
catgacgaagggccttgttttaggaatctattccaaag

SEQ ID NO: 119089 - DNA, 43 bp, Artificial Sequence
  Description of Artificial Sequence: Synthetic oligonucleotide
atgacgaagggccttgttttaggaatctattccaaagaaaaag

SEQ ID NO: 119090 - DNA, 42 bp, Artificial Sequence
  Description of Artificial Sequence: Synthetic oligonucleotide
tgacgaagggccttgttttaggaatctattccaaagaaaaag

SEQ ID NO: 119091 - DNA, 41 bp, Artificial Sequence
  Description of Artificial Sequence: Synthetic oligonucleotide
gacgaagggccttgttttaggaatctattccaaagaaaaag

SEQ ID NO: 119092 - DNA, 43 bp, Artificial Sequence
  Description of Artificial Sequence: Synthetic oligonucleotide
acgaagggccttgttttaggaatctattccaaagaaaaagaag

SEQ ID NO: 119093 - DNA, 42 bp, Artificial Sequence
  Description of Artificial Sequence: Synthetic oligonucleotide
cgaagggccttgttttaggaatctattccaaagaaaaagaag

SEQ ID NO: 119094 - DNA, 44 bp, Artificial Sequence
  Description of Artificial Sequence: Synthetic oligonucleotide
gaagggccttgttttaggaatctattccaaagaaaaagaagatg

SEQ ID NO: 119095 - DNA, 46 bp, Artificial Sequence
  Description of Artificial Sequence: Synthetic oligonucleotide
aagggccttgttttaggaatctattccaaagaaaaagaagatgatg

SEQ ID NO: 119096 - DNA, 45 bp, Artificial Sequence
  Description of Artificial Sequence: Synthetic oligonucleotide
agggccttgttttaggaatctattccaaagaaaaagaagatgatg

SEQ ID NO: 119097 - DNA, 44 bp, Artificial Sequence
  Description of Artificial Sequence: Synthetic oligonucleotide
gggccttgttttaggaatctattccaaagaaaaagaagatgatg

SEQ ID NO: 119098 - DNA, 45 bp, Artificial Sequence
  Description of Artificial Sequence: Synthetic oligonucleotide
ggccttgttttaggaatctattccaaagaaaaagaagatgatgtg

SEQ ID NO: 119099 - DNA, 45 bp, Artificial Sequence
  Description of Artificial Sequence: Synthetic oligonucleotide
gccttgttttaggaatctattccaaagaaaaagaagatgatgtgc

SEQ ID NO: 119100 - DNA, 45 bp, Artificial Sequence
  Description of Artificial Sequence: Synthetic oligonucleotide
ccttgttttaggaatctattccaaagaaaaagaagatgatgtgcc

SEQ ID NO: 119101 - DNA, 46 bp, Artificial Sequence
  Description of Artificial Sequence: Synthetic oligonucleotide
cttgttttaggaatctattccaaagaaaaagaagatgatgtgccac

SEQ ID NO: 119102 - DNA, 47 bp, Artificial Sequence
  Description of Artificial Sequence: Synthetic oligonucleotide
ttgttttaggaatctattccaaagaaaaagaagatgatgtgccacag

SEQ ID NO: 119103 - DNA, 46 bp, Artificial Sequence
  Description of Artificial Sequence: Synthetic oligonucleotide
tgttttaggaatctattccaaagaaaaagaagatgatgtgccacag

SEQ ID NO: 119104 - DNA, 45 bp, Artificial Sequence
  Description of Artificial Sequence: Synthetic oligonucleotide
gttttaggaatctattccaaagaaaaagaagatgatgtgccacag

SEQ ID NO: 119105 - DNA, 47 bp, Artificial Sequence
  Description of Artificial Sequence: Synthetic oligonucleotide
ttttaggaatctattccaaagaaaaagaagatgatgtgccacagttc

SEQ ID NO: 119106 - DNA, 46 bp, Artificial Sequence
  Description of Artificial Sequence: Synthetic oligonucleotide
tttaggaatctattccaaagaaaaagaagatgatgtgccacagttc

SEQ ID NO: 119107 - DNA, 45 bp, Artificial Sequence
  Description of Artificial Sequence: Synthetic oligonucleotide
ttaggaatctattccaaagaaaaagaagatgatgtgccacagttc

SEQ ID NO: 119108 - DNA, 44 bp, Artificial Sequence
  Description of Artificial Sequence: Synthetic oligonucleotide
taggaatctattccaaagaaaaagaagatgatgtgccacagttc

SEQ ID NO: 119109 - DNA, 43 bp, Artificial Sequence
  Description of Artificial Sequence: Synthetic oligonucleotide
aggaatctattccaaagaaaaagaagatgatgtgccacagttc

SEQ ID NO: 119110 - DNA, 42 bp, Artificial Sequence
  Description of Artificial Sequence: Synthetic oligonucleotide
ggaatctattccaaagaaaaagaagatgatgtgccacagttc

SEQ ID NO: 119111 - DNA, 43 bp, Artificial Sequence
  Description of Artificial Sequence: Synthetic oligonucleotide
gaatctattccaaagaaaaagaagatgatgtgccacagttcac

SEQ ID NO: 119112 - DNA, 45 bp, Artificial Sequence
  Description of Artificial Sequence: Synthetic oligonucleotide
aatctattccaaagaaaaagaagatgatgtgccacagttcacaag

SEQ ID NO: 119113 - DNA, 44 bp, Artificial Sequence
  Description of Artificial Sequence: Synthetic oligonucleotide
atctattccaaagaaaaagaagatgatgtgccacagttcacaag

SEQ ID NO: 119114 - DNA, 43 bp, Artificial Sequence
  Description of Artificial Sequence: Synthetic oligonucleotide
tctattccaaagaaaaagaagatgatgtgccacagttcacaag

SEQ ID NO: 119115 - DNA, 42 bp, Artificial Sequence
  Description of Artificial Sequence: Synthetic oligonucleotide
ctattccaaagaaaaagaagatgatgtgccacagttcacaag

SEQ ID NO: 119116 - DNA, 43 bp, Artificial Sequence
  Description of Artificial Sequence: Synthetic oligonucleotide
tattccaaagaaaaagaagatgatgtgccacagttcacaagtg

SEQ ID NO: 119117 - DNA, 42 bp, Artificial Sequence
  Description of Artificial Sequence: Synthetic oligonucleotide
attccaaagaaaaagaagatgatgtgccacagttcacaagtg

SEQ ID NO: 119118 - DNA, 41 bp, Artificial Sequence
  Description of Artificial Sequence: Synthetic oligonucleotide
ttccaaagaaaaagaagatgatgtgccacagttcacaagtg

SEQ ID NO: 119119 - DNA, 40 bp, Artificial Sequence
  Description of Artificial Sequence: Synthetic oligonucleotide
tccaaagaaaaagaagatgatgtgccacagttcacaagtg

SEQ ID NO: 119120 - DNA, 39 bp, Artificial Sequence
  Description of Artificial Sequence: Synthetic oligonucleotide
ccaaagaaaaagaagatgatgtgccacagttcacaagtg

SEQ ID NO: 119121 - DNA, 39 bp, Artificial Sequence
  Description of Artificial Sequence: Synthetic oligonucleotide
caaagaaaaagaagatgatgtgccacagttcacaagtgc

SEQ ID NO: 119122 - DNA, 40 bp, Artificial Sequence
  Description of Artificial Sequence: Synthetic oligonucleotide
aaagaaaaagaagatgatgtgccacagttcacaagtgcag

SEQ ID NO: 119123 - DNA, 39 bp, Artificial Sequence
  Description of Artificial Sequence: Synthetic oligonucleotide
aagaaaaagaagatgatgtgccacagttcacaagtgcag

SEQ ID NO: 119124 - DNA, 38 bp, Artificial Sequence
  Description of Artificial Sequence: Synthetic oligonucleotide
agaaaaagaagatgatgtgccacagttcacaagtgcag

SEQ ID NO: 119125 - DNA, 37 bp, Artificial Sequence
  Description of Artificial Sequence: Synthetic oligonucleotide
gaaaaagaagatgatgtgccacagttcacaagtgcag

SEQ ID NO: 119126 - DNA, 37 bp, Artificial Sequence
  Description of Artificial Sequence: Synthetic oligonucleotide
aaaaagaagatgatgtgccacagttcacaagtgcagg

SEQ ID NO: 119127 - DNA, 36 bp, Artificial Sequence
  Description of Artificial Sequence: Synthetic oligonucleotide
aaaagaagatgatgtgccacagttcacaagtgcagg

SEQ ID NO: 119128 - DNA, 35 bp, Artificial Sequence
  Description of Artificial Sequence: Synthetic oligonucleotide
aaagaagatgatgtgccacagttcacaagtgcagg

SEQ ID NO: 119129 - DNA, 34 bp, Artificial Sequence
  Description of Artificial Sequence: Synthetic oligonucleotide
aagaagatgatgtgccacagttcacaagtgcagg

SEQ ID NO: 119130 - DNA, 33 bp, Artificial Sequence
  Description of Artificial Sequence: Synthetic oligonucleotide
agaagatgatgtgccacagttcacaagtgcagg

SEQ ID NO: 119131 - DNA, 32 bp, Artificial Sequence
  Description of Artificial Sequence: Synthetic oligonucleotide
gaagatgatgtgccacagttcacaagtgcagg

SEQ ID NO: 119132 - DNA, 33 bp, Artificial Sequence
  Description of Artificial Sequence: Synthetic oligonucleotide
aagatgatgtgccacagttcacaagtgcaggag

SEQ ID NO: 119133 - DNA, 32 bp, Artificial Sequence
  Description of Artificial Sequence: Synthetic oligonucleotide
agatgatgtgccacagttcacaagtgcaggag

SEQ ID NO: 119134 - DNA, 31 bp, Artificial Sequence
  Description of Artificial Sequence: Synthetic oligonucleotide
gatgatgtgccacagttcacaagtgcaggag

SEQ ID NO: 119135 - DNA, 32 bp, Artificial Sequence
  Description of Artificial Sequence: Synthetic oligonucleotide
atgatgtgccacagttcacaagtgcaggagag

SEQ ID NO: 119136 - DNA, 31 bp, Artificial Sequence
  Description of Artificial Sequence: Synthetic oligonucleotide
tgatgtgccacagttcacaagtgcaggagag

SEQ ID NO: 119137 - DNA, 30 bp, Artificial Sequence
  Description of Artificial Sequence: Synthetic oligonucleotide
gatgtgccacagttcacaagtgcaggagag

SEQ ID NO: 119138 - DNA, 36 bp, Artificial Sequence
  Description of Artificial Sequence: Synthetic oligonucleotide
atgtgccacagttcacaagtgcaggagagaattttg

SEQ ID NO: 119139 - DNA, 35 bp, Artificial Sequence
  Description of Artificial Sequence: Synthetic oligonucleotide
tgtgccacagttcacaagtgcaggagagaattttg

SEQ ID NO: 119140 - DNA, 34 bp, Artificial Sequence
  Description of Artificial Sequence: Synthetic oligonucleotide
gtgccacagttcacaagtgcaggagagaattttg

SEQ ID NO: 119141 - DNA, 41 bp, Artificial Sequence
  Description of Artificial Sequence: Synthetic oligonucleotide
tgccacagttcacaagtgcaggagagaattttgataaattg

SEQ ID NO: 119142 - DNA, 40 bp, Artificial Sequence
  Description of Artificial Sequence: Synthetic oligonucleotide
gccacagttcacaagtgcaggagagaattttgataaattg

SEQ ID NO: 119143 - DNA, 43 bp, Artificial Sequence
  Description of Artificial Sequence: Synthetic oligonucleotide
ccacagttcacaagtgcaggagagaattttgataaattgttag

SEQ ID NO: 119144 - DNA, 43 bp, Artificial Sequence
  Description of Artificial Sequence: Synthetic oligonucleotide
cacagttcacaagtgcaggagagaattttgataaattgttagc

SEQ ID NO: 119145 - DNA, 44 bp, Artificial Sequence
  Description of Artificial Sequence: Synthetic oligonucleotide
acagttcacaagtgcaggagagaattttgataaattgttagctg

SEQ ID NO: 119146 - DNA, 43 bp, Artificial Sequence
  Description of Artificial Sequence: Synthetic oligonucleotide
cagttcacaagtgcaggagagaattttgataaattgttagctg

SEQ ID NO: 119147 - DNA, 43 bp, Artificial Sequence
  Description of Artificial Sequence: Synthetic oligonucleotide
agttcacaagtgcaggagagaattttgataaattgttagctgg

SEQ ID NO: 119148 - DNA, 42 bp, Artificial Sequence
  Description of Artificial Sequence: Synthetic oligonucleotide
gttcacaagtgcaggagagaattttgataaattgttagctgg

SEQ ID NO: 119149 - DNA, 45 bp, Artificial Sequence
  Description of Artificial Sequence: Synthetic oligonucleotide
ttcacaagtgcaggagagaattttgataaattgttagctggaaag

SEQ ID NO: 119150 - DNA, 44 bp, Artificial Sequence
  Description of Artificial Sequence: Synthetic oligonucleotide
tcacaagtgcaggagagaattttgataaattgttagctggaaag

SEQ ID NO: 119151 - DNA, 43 bp, Artificial Sequence
  Description of Artificial Sequence: Synthetic oligonucleotide
cacaagtgcaggagagaattttgataaattgttagctggaaag

SEQ ID NO: 119152 - DNA, 43 bp, Artificial Sequence
  Description of Artificial Sequence: Synthetic oligonucleotide
acaagtgcaggagagaattttgataaattgttagctggaaagc

SEQ ID NO: 119153 - DNA, 42 bp, Artificial Sequence
  Description of Artificial Sequence: Synthetic oligonucleotide
caagtgcaggagagaattttgataaattgttagctggaaagc

SEQ ID NO: 119154 - DNA, 43 bp, Artificial Sequence
  Description of Artificial Sequence: Synthetic oligonucleotide
aagtgcaggagagaattttgataaattgttagctggaaagctg

SEQ ID NO: 119155 - DNA, 42 bp, Artificial Sequence
  Description of Artificial Sequence: Synthetic oligonucleotide
agtgcaggagagaattttgataaattgttagctggaaagctg

SEQ ID NO: 119156 - DNA, 41 bp, Artificial Sequence
  Description of Artificial Sequence: Synthetic oligonucleotide
gtgcaggagagaattttgataaattgttagctggaaagctg

SEQ ID NO: 119157 - DNA, 42 bp, Artificial Sequence
  Description of Artificial Sequence: Synthetic oligonucleotide
tgcaggagagaattttgataaattgttagctggaaagctgag

SEQ ID NO: 119158 - DNA, 41 bp, Artificial Sequence
  Description of Artificial Sequence: Synthetic oligonucleotide
gcaggagagaattttgataaattgttagctggaaagctgag

SEQ ID NO: 119159 - DNA, 42 bp, Artificial Sequence
  Description of Artificial Sequence: Synthetic oligonucleotide
caggagagaattttgataaattgttagctggaaagctgagag

SEQ ID NO: 119160 - DNA, 43 bp, Artificial Sequence
  Description of Artificial Sequence: Synthetic oligonucleotide
aggagagaattttgataaattgttagctggaaagctgagagag

SEQ ID NO: 119161 - DNA, 42 bp, Artificial Sequence
  Description of Artificial Sequence: Synthetic oligonucleotide
ggagagaattttgataaattgttagctggaaagctgagagag

SEQ ID NO: 119162 - DNA, 43 bp, Artificial Sequence
  Description of Artificial Sequence: Synthetic oligonucleotide
gagagaattttgataaattgttagctggaaagctgagagagac

SEQ ID NO: 119163 - DNA, 46 bp, Artificial Sequence
  Description of Artificial Sequence: Synthetic oligonucleotide
agagaattttgataaattgttagctggaaagctgagagagactttg

SEQ ID NO: 119164 - DNA, 45 bp, Artificial Sequence
  Description of Artificial Sequence: Synthetic oligonucleotide
gagaattttgataaattgttagctggaaagctgagagagactttg

SEQ ID NO: 119165 - DNA, 47 bp, Artificial Sequence
  Description of Artificial Sequence: Synthetic oligonucleotide
agaattttgataaattgttagctggaaagctgagagagactttgaac

SEQ ID NO: 119166 - DNA, 46 bp, Artificial Sequence
  Description of Artificial Sequence: Synthetic oligonucleotide
gaattttgataaattgttagctggaaagctgagagagactttgaac

SEQ ID NO: 119167 - DNA, 50 bp, Artificial Sequence
  Description of Artificial Sequence: Synthetic oligonucleotide
aattttgataaattgttagctggaaagctgagagagactttgaacatatc

SEQ ID NO: 119168 - DNA, 49 bp, Artificial Sequence
  Description of Artificial Sequence: Synthetic oligonucleotide
attttgataaattgttagctggaaagctgagagagactttgaacatatc

SEQ ID NO: 119169 - DNA, 48 bp, Artificial Sequence
  Description of Artificial Sequence: Synthetic oligonucleotide
ttttgataaattgttagctggaaagctgagagagactttgaacatatc

SEQ ID NO: 119170 - DNA, 47 bp, Artificial Sequence
  Description of Artificial Sequence: Synthetic oligonucleotide
tttgataaattgttagctggaaagctgagagagactttgaacatatc

SEQ ID NO: 119171 - DNA, 46 bp, Artificial Sequence
  Description of Artificial Sequence: Synthetic oligonucleotide
ttgataaattgttagctggaaagctgagagagactttgaacatatc

SEQ ID NO: 119172 - DNA, 45 bp, Artificial Sequence
  Description of Artificial Sequence: Synthetic oligonucleotide
tgataaattgttagctggaaagctgagagagactttgaacatatc

SEQ ID NO: 119173 - DNA, 44 bp, Artificial Sequence
  Description of Artificial Sequence: Synthetic oligonucleotide
gataaattgttagctggaaagctgagagagactttgaacatatc

SEQ ID NO: 119174 - DNA, 45 bp, Artificial Sequence
  Description of Artificial Sequence: Synthetic oligonucleotide
ataaattgttagctggaaagctgagagagactttgaacatatctg

SEQ ID NO: 119175 - DNA, 44 bp, Artificial Sequence
  Description of Artificial Sequence: Synthetic oligonucleotide
taaattgttagctggaaagctgagagagactttgaacatatctg

SEQ ID NO: 119176 - DNA, 43 bp, Artificial Sequence
  Description of Artificial Sequence: Synthetic oligonucleotide
aaattgttagctggaaagctgagagagactttgaacatatctg

SEQ ID NO: 119177 - DNA, 42 bp, Artificial Sequence
  Description of Artificial Sequence: Synthetic oligonucleotide
aattgttagctggaaagctgagagagactttgaacatatctg

SEQ ID NO: 119178 - DNA, 41 bp, Artificial Sequence
  Description of Artificial Sequence: Synthetic oligonucleotide
attgttagctggaaagctgagagagactttgaacatatctg

SEQ ID NO: 119179 - DNA, 40 bp, Artificial Sequence
  Description of Artificial Sequence: Synthetic oligonucleotide
ttgttagctggaaagctgagagagactttgaacatatctg

SEQ ID NO: 119180 - DNA, 39 bp, Artificial Sequence
  Description of Artificial Sequence: Synthetic oligonucleotide
tgttagctggaaagctgagagagactttgaacatatctg

SEQ ID NO: 119181 - DNA, 38 bp, Artificial Sequence
  Description of Artificial Sequence: Synthetic oligonucleotide
gttagctggaaagctgagagagactttgaacatatctg

SEQ ID NO: 119182 - DNA, 38 bp, Artificial Sequence
  Description of Artificial Sequence: Synthetic oligonucleotide
ttagctggaaagctgagagagactttgaacatatctgg

SEQ ID NO: 119183 - DNA, 37 bp, Artificial Sequence
  Description of Artificial Sequence: Synthetic oligonucleotide
tagctggaaagctgagagagactttgaacatatctgg

SEQ ID NO: 119184 - DNA, 36 bp, Artificial Sequence
  Description of Artificial Sequence: Synthetic oligonucleotide
agctggaaagctgagagagactttgaacatatctgg

SEQ ID NO: 119185 - DNA, 35 bp, Artificial Sequence
  Description of Artificial Sequence: Synthetic oligonucleotide
gctggaaagctgagagagactttgaacatatctgg

SEQ ID NO: 119186 - DNA, 36 bp, Artificial Sequence
  Description of Artificial Sequence: Synthetic oligonucleotide
ctggaaagctgagagagactttgaacatatctggac

SEQ ID NO: 119187 - DNA, 36 bp, Artificial Sequence
  Description of Artificial Sequence: Synthetic oligonucleotide
tggaaagctgagagagactttgaacatatctggacc

SEQ ID NO: 119188 - DNA, 35 bp, Artificial Sequence
  Description of Artificial Sequence: Synthetic oligonucleotide
ggaaagctgagagagactttgaacatatctggacc

SEQ ID NO: 119189 - DNA, 36 bp, Artificial Sequence
  Description of Artificial Sequence: Synthetic oligonucleotide
gaaagctgagagagactttgaacatatctggaccac

SEQ ID NO: 119190 - DNA, 36 bp, Artificial Sequence
  Description of Artificial Sequence: Synthetic oligonucleotide
aaagctgagagagactttgaacatatctggaccacc

SEQ ID NO: 119191 - DNA, 35 bp, Artificial Sequence
  Description of Artificial Sequence: Synthetic oligonucleotide
aagctgagagagactttgaacatatctggaccacc

SEQ ID NO: 119192 - DNA, 34 bp, Artificial Sequence
  Description of Artificial Sequence: Synthetic oligonucleotide
agctgagagagactttgaacatatctggaccacc

SEQ ID NO: 119193 - DNA, 33 bp, Artificial Sequence
  Description of Artificial Sequence: Synthetic oligonucleotide
gctgagagagactttgaacatatctggaccacc

SEQ ID NO: 119194 - DNA, 34 bp, Artificial Sequence
  Description of Artificial Sequence: Synthetic oligonucleotide
ctgagagagactttgaacatatctggaccacctc

SEQ ID NO: 119195 - DNA, 35 bp, Artificial Sequence
  Description of Artificial Sequence: Synthetic oligonucleotide
tgagagagactttgaacatatctggaccacctctg

SEQ ID NO: 119196 - DNA, 34 bp, Artificial Sequence
  Description of Artificial Sequence: Synthetic oligonucleotide
gagagagactttgaacatatctggaccacctctg

SEQ ID NO: 119197 - DNA, 36 bp, Artificial Sequence
  Description of Artificial Sequence: Synthetic oligonucleotide
agagagactttgaacatatctggaccacctctgaag

SEQ ID NO: 119198 - DNA, 35 bp, Artificial Sequence
  Description of Artificial Sequence: Synthetic oligonucleotide
gagagactttgaacatatctggaccacctctgaag

SEQ ID NO: 119199 - DNA, 35 bp, Artificial Sequence
  Description of Artificial Sequence: Synthetic oligonucleotide
agagactttgaacatatctggaccacctctgaagg

SEQ ID NO: 119200 - DNA, 34 bp, Artificial Sequence
  Description of Artificial Sequence: Synthetic oligonucleotide
gagactttgaacatatctggaccacctctgaagg

SEQ ID NO: 119201 - DNA, 34 bp, Artificial Sequence
  Description of Artificial Sequence: Synthetic oligonucleotide
agactttgaacatatctggaccacctctgaaggc

SEQ ID NO: 119202 - DNA, 33 bp, Artificial Sequence
  Description of Artificial Sequence: Synthetic oligonucleotide
gactttgaacatatctggaccacctctgaaggc

SEQ ID NO: 119203 - DNA, 34 bp, Artificial Sequence
  Description of Artificial Sequence: Synthetic oligonucleotide
actttgaacatatctggaccacctctgaaggcag

SEQ ID NO: 119204 - DNA, 33 bp, Artificial Sequence
  Description of Artificial Sequence: Synthetic oligonucleotide
ctttgaacatatctggaccacctctgaaggcag

SEQ ID NO: 119205 - DNA, 33 bp, Artificial Sequence
  Description of Artificial Sequence: Synthetic oligonucleotide
tttgaacatatctggaccacctctgaaggcagg

SEQ ID NO: 119206 - DNA, 32 bp, Artificial Sequence
  Description of Artificial Sequence: Synthetic oligonucleotide
ttgaacatatctggaccacctctgaaggcagg

SEQ ID NO: 119207 - DNA, 31 bp, Artificial Sequence
  Description of Artificial Sequence: Synthetic oligonucleotide
tgaacatatctggaccacctctgaaggcagg

SEQ ID NO: 119208 - DNA, 30 bp, Artificial Sequence
  Description of Artificial Sequence: Synthetic oligonucleotide
gaacatatctggaccacctctgaaggcagg

SEQ ID NO: 119209 - DNA, 30 bp, Artificial Sequence
  Description of Artificial Sequence: Synthetic oligonucleotide
aacatatctggaccacctctgaaggcaggg

SEQ ID NO: 119210 - DNA, 29 bp, Artificial Sequence
  Description of Artificial Sequence: Synthetic oligonucleotide
acatatctggaccacctctgaaggcaggg

SEQ ID NO: 119211 - DNA, 28 bp, Artificial Sequence
  Description of Artificial Sequence: Synthetic oligonucleotide
catatctggaccacctctgaaggcaggg

SEQ ID NO: 119212 - DNA, 30 bp, Artificial Sequence
  Description of Artificial Sequence: Synthetic oligonucleotide
atatctggaccacctctgaaggcagggaag

SEQ ID NO: 119213 - DNA, 29 bp, Artificial Sequence
  Description of Artificial Sequence: Synthetic oligonucleotide
tatctggaccacctctgaaggcagggaag

SEQ ID NO: 119214 - DNA, 28 bp, Artificial Sequence
  Description of Artificial Sequence: Synthetic oligonucleotide
atctggaccacctctgaaggcagggaag

SEQ ID NO: 119215 - DNA, 27 bp, Artificial Sequence
  Description of Artificial Sequence: Synthetic oligonucleotide
tctggaccacctctgaaggcagggaag

SEQ ID NO: 119216 - DNA, 27 bp, Artificial Sequence
  Description of Artificial Sequence: Synthetic oligonucleotide
ctggaccacctctgaaggcagggaaga

SEQ ID NO: 119217 - DNA, 27 bp, Artificial Sequence
  Description of Artificial Sequence: Synthetic oligonucleotide
tggaccacctctgaaggcagggaagac

SEQ ID NO: 119218 - DNA, 27 bp, Artificial Sequence
  Description of Artificial Sequence: Synthetic oligonucleotide
ggaccacctctgaaggcagggaagact

SEQ ID NO: 119219 - DNA, 27 bp, Artificial Sequence
  Description of Artificial Sequence: Synthetic oligonucleotide
gaccacctctgaaggcagggaagactc

SEQ ID NO: 119220 - DNA, 27 bp, Artificial Sequence
  Description of Artificial Sequence: Synthetic oligonucleotide
accacctctgaaggcagggaagactcg

SEQ ID NO: 119221 - DNA, 27 bp, Artificial Sequence
  Description of Artificial Sequence: Synthetic oligonucleotide
ccacctctgaaggcagggaagactcga

SEQ ID NO: 119222 - DNA, 28 bp, Artificial Sequence
  Description of Artificial Sequence: Synthetic oligonucleotide
cacctctgaaggcagggaagactcgaac

SEQ ID NO: 119223 - DNA, 28 bp, Artificial Sequence
  Description of Artificial Sequence: Synthetic oligonucleotide
acctctgaaggcagggaagactcgaacc

SEQ ID NO: 119224 - DNA, 27 bp, Artificial Sequence
  Description of Artificial Sequence: Synthetic oligonucleotide
cctctgaaggcagggaagactcgaacc

SEQ ID NO: 119225 - DNA, 33 bp, Artificial Sequence
  Description of Artificial Sequence: Synthetic oligonucleotide
ctctgaaggcagggaagactcgaaccttttatg

SEQ ID NO: 119226 - DNA, 33 bp, Artificial Sequence
  Description of Artificial Sequence: Synthetic oligonucleotide
tctgaaggcagggaagactcgaaccttttatgg

SEQ ID NO: 119227 - DNA, 32 bp, Artificial Sequence
  Description of Artificial Sequence: Synthetic oligonucleotide
ctgaaggcagggaagactcgaaccttttatgg

SEQ ID NO: 119228 - DNA, 33 bp, Artificial Sequence
  Description of Artificial Sequence: Synthetic oligonucleotide
tgaaggcagggaagactcgaaccttttatggtc

SEQ ID NO: 119229 - DNA, 32 bp, Artificial Sequence
  Description of Artificial Sequence: Synthetic oligonucleotide
gaaggcagggaagactcgaaccttttatggtc

SEQ ID NO: 119230 - DNA, 33 bp, Artificial Sequence
  Description of Artificial Sequence: Synthetic oligonucleotide
aaggcagggaagactcgaaccttttatggtctg

SEQ ID NO: 119231 - DNA, 32 bp, Artificial Sequence
  Description of Artificial Sequence: Synthetic oligonucleotide
aggcagggaagactcgaaccttttatggtctg

SEQ ID NO: 119232 - DNA, 31 bp, Artificial Sequence
  Description of Artificial Sequence: Synthetic oligonucleotide
ggcagggaagactcgaaccttttatggtctg

SEQ ID NO: 119233 - DNA, 31 bp, Artificial Sequence
  Description of Artificial Sequence: Synthetic oligonucleotide
gcagggaagactcgaaccttttatggtctgc

SEQ ID NO: 119234 - DNA, 33 bp, Artificial Sequence
  Description of Artificial Sequence: Synthetic oligonucleotide
cagggaagactcgaaccttttatggtctgcatc

SEQ ID NO: 119235 - DNA, 34 bp, Artificial Sequence
  Description of Artificial Sequence: Synthetic oligonucleotide
agggaagactcgaaccttttatggtctgcatcag

SEQ ID NO: 119236 - DNA, 33 bp, Artificial Sequence
  Description of Artificial Sequence: Synthetic oligonucleotide
gggaagactcgaaccttttatggtctgcatcag

SEQ ID NO: 119237 - DNA, 33 bp, Artificial Sequence
  Description of Artificial Sequence: Synthetic oligonucleotide
ggaagactcgaaccttttatggtctgcatcagg

SEQ ID NO: 119238 - DNA, 34 bp, Artificial Sequence
  Description of Artificial Sequence: Synthetic oligonucleotide
gaagactcgaaccttttatggtctgcatcaggac

SEQ ID NO: 119239 - DNA, 36 bp, Artificial Sequence
  Description of Artificial Sequence: Synthetic oligonucleotide
aagactcgaaccttttatggtctgcatcaggacttc

SEQ ID NO: 119240 - DNA, 35 bp, Artificial Sequence
  Description of Artificial Sequence: Synthetic oligonucleotide
agactcgaaccttttatggtctgcatcaggacttc

SEQ ID NO: 119241 - DNA, 34 bp, Artificial Sequence
  Description of Artificial Sequence: Synthetic oligonucleotide
gactcgaaccttttatggtctgcatcaggacttc

SEQ ID NO: 119242 - DNA, 34 bp, Artificial Sequence
  Description of Artificial Sequence: Synthetic oligonucleotide
actcgaaccttttatggtctgcatcaggacttcc

SEQ ID NO: 119243 - DNA, 33 bp, Artificial Sequence
  Description of Artificial Sequence: Synthetic oligonucleotide
ctcgaaccttttatggtctgcatcaggacttcc

SEQ ID NO: 119244 - DNA, 33 bp, Artificial Sequence
  Description of Artificial Sequence: Synthetic oligonucleotide
tcgaaccttttatggtctgcatcaggacttccc

SEQ ID NO: 119245 - DNA, 32 bp, Artificial Sequence
  Description of Artificial Sequence: Synthetic oligonucleotide
cgaaccttttatggtctgcatcaggacttccc

SEQ ID NO: 119246 - DNA, 32 bp, Artificial Sequence
  Description of Artificial Sequence: Synthetic oligonucleotide
gaaccttttatggtctgcatcaggacttcccc

SEQ ID NO: 119247 - DNA, 33 bp, Artificial Sequence
  Description of Artificial Sequence: Synthetic oligonucleotide
aaccttttatggtctgcatcaggacttccccag

SEQ ID NO: 119248 - DNA, 32 bp, Artificial Sequence
  Description of Artificial Sequence: Synthetic oligonucleotide
accttttatggtctgcatcaggacttccccag

SEQ ID NO: 119249 - DNA, 31 bp, Artificial Sequence
  Description of Artificial Sequence: Synthetic oligonucleotide
ccttttatggtctgcatcaggacttccccag

SEQ ID NO: 119250 - DNA, 31 bp, Artificial Sequence
  Description of Artificial Sequence: Synthetic oligonucleotide
cttttatggtctgcatcaggacttccccagc

SEQ ID NO: 119251 - DNA, 31 bp, Artificial Sequence
  Description of Artificial Sequence: Synthetic oligonucleotide
ttttatggtctgcatcaggacttccccagcg

SEQ ID NO: 119252 - DNA, 30 bp, Artificial Sequence
  Description of Artificial Sequence: Synthetic oligonucleotide
tttatggtctgcatcaggacttccccagcg

SEQ ID NO: 119253 - DNA, 29 bp, Artificial Sequence
  Description of Artificial Sequence: Synthetic oligonucleotide
ttatggtctgcatcaggacttccccagcg

SEQ ID NO: 119254 - DNA, 28 bp, Artificial Sequence
  Description of Artificial Sequence: Synthetic oligonucleotide
tatggtctgcatcaggacttccccagcg

SEQ ID NO: 119255 - DNA, 27 bp, Artificial Sequence
  Description of Artificial Sequence: Synthetic oligonucleotide
atggtctgcatcaggacttccccagcg

SEQ ID NO: 119256 - DNA, 27 bp, Artificial Sequence
  Description of Artificial Sequence: Synthetic oligonucleotide
tggtctgcatcaggacttccccagcgt

SEQ ID NO: 119257 - DNA, 26 bp, Artificial Sequence
  Description of Artificial Sequence: Synthetic oligonucleotide
ggtctgcatcaggacttccccagcgt

SEQ ID NO: 119258 - DNA, 26 bp, Artificial Sequence
  Description of Artificial Sequence: Synthetic oligonucleotide
gtctgcatcaggacttccccagcgtg

SEQ ID NO: 119259 - DNA, 27 bp, Artificial Sequence
  Description of Artificial Sequence: Synthetic oligonucleotide
tctgcatcaggacttccccagcgtggt

SEQ ID NO: 119260 - DNA, 26 bp, Artificial Sequence
  Description of Artificial Sequence: Synthetic oligonucleotide
ctgcatcaggacttccccagcgtggt

SEQ ID NO: 119261 - DNA, 26 bp, Artificial Sequence
  Description of Artificial Sequence: Synthetic oligonucleotide
tgcatcaggacttccccagcgtggtg

SEQ ID NO: 119262 - DNA, 25 bp, Artificial Sequence
  Description of Artificial Sequence: Synthetic oligonucleotide
gcatcaggacttccccagcgtggtg

SEQ ID NO: 119263 - DNA, 27 bp, Artificial Sequence
  Description of Artificial Sequence: Synthetic oligonucleotide
catcaggacttccccagcgtggtgcta

SEQ ID NO: 119264 - DNA, 27 bp, Artificial Sequence
  Description of Artificial Sequence: Synthetic oligonucleotide
atcaggacttccccagcgtggtgctag

SEQ ID NO: 119265 - DNA, 27 bp, Artificial Sequence
  Description of Artificial Sequence: Synthetic oligonucleotide
tcaggacttccccagcgtggtgctagt

SEQ ID NO: 119266 - DNA, 27 bp, Artificial Sequence
  Description of Artificial Sequence: Synthetic oligonucleotide
caggacttccccagcgtggtgctagtt

SEQ ID NO: 119267 - DNA, 27 bp, Artificial Sequence
  Description of Artificial Sequence: Synthetic oligonucleotide
aggacttccccagcgtggtgctagttg

SEQ ID NO: 119268 - DNA, 26 bp, Artificial Sequence
  Description of Artificial Sequence: Synthetic oligonucleotide
ggacttccccagcgtggtgctagttg

SEQ ID NO: 119269 - DNA, 26 bp, Artificial Sequence
  Description of Artificial Sequence: Synthetic oligonucleotide
gacttccccagcgtggtgctagttgg

SEQ ID NO: 119270 - DNA, 26 bp, Artificial Sequence
  Description of Artificial Sequence: Synthetic oligonucleotide
acttccccagcgtggtgctagttggc

SEQ ID NO: 119271 - DNA, 25 bp, Artificial Sequence
  Description of Artificial Sequence: Synthetic oligonucleotide
cttccccagcgtggtgctagttggc

SEQ ID NO: 119272 - DNA, 26 bp, Artificial Sequence
  Description of Artificial Sequence: Synthetic oligonucleotide
ttccccagcgtggtgctagttggcct

SEQ ID NO: 119273 - DNA, 25 bp, Artificial Sequence
  Description of Artificial Sequence: Synthetic oligonucleotide
tccccagcgtggtgctagttggcct

SEQ ID NO: 119274 - DNA, 24 bp, Artificial Sequence
  Description of Artificial Sequence: Synthetic oligonucleotide
ccccagcgtggtgctagttggcct

SEQ ID NO: 119275 - DNA, 24 bp, Artificial Sequence
  Description of Artificial Sequence: Synthetic oligonucleotide
cccagcgtggtgctagttggcctc

SEQ ID NO: 119276 - DNA, 24 bp, Artificial Sequence
  Description of Artificial Sequence: Synthetic oligonucleotide
ccagcgtggtgctagttggcctcg

SEQ ID NO: 119277 - DNA, 24 bp, Artificial Sequence
  Description of Artificial Sequence: Synthetic oligonucleotide
cagcgtggtgctagttggcctcgg

SEQ ID NO: 119278 - DNA, 27 bp, Artificial Sequence
  Description of Artificial Sequence: Synthetic oligonucleotide
agcgtggtgctagttggcctcggcaaa

SEQ ID NO: 119279 - DNA, 27 bp, Artificial Sequence
  Description of Artificial Sequence: Synthetic oligonucleotide
gcgtggtgctagttggcctcggcaaaa

SEQ ID NO: 119280 - DNA, 28 bp, Artificial Sequence
  Description of Artificial Sequence: Synthetic oligonucleotide
cgtggtgctagttggcctcggcaaaaag

SEQ ID NO: 119281 - DNA, 28 bp, Artificial Sequence
  Description of Artificial Sequence: Synthetic oligonucleotide
gtggtgctagttggcctcggcaaaaagg

SEQ ID NO: 119282 - DNA, 28 bp, Artificial Sequence
  Description of Artificial Sequence: Synthetic oligonucleotide
tggtgctagttggcctcggcaaaaaggc

SEQ ID NO: 119283 - DNA, 27 bp, Artificial Sequence
  Description of Artificial Sequence: Synthetic oligonucleotide
ggtgctagttggcctcggcaaaaaggc

SEQ ID NO: 119284 - DNA, 28 bp, Artificial Sequence
  Description of Artificial Sequence: Synthetic oligonucleotide
gtgctagttggcctcggcaaaaaggcag

SEQ ID NO: 119285 - DNA, 28 bp, Artificial Sequence
  Description of Artificial Sequence: Synthetic oligonucleotide
tgctagttggcctcggcaaaaaggcagc

SEQ ID NO: 119286 - DNA, 27 bp, Artificial Sequence
  Description of Artificial Sequence: Synthetic oligonucleotide
gctagttggcctcggcaaaaaggcagc

SEQ ID NO: 119287 - DNA, 28 bp, Artificial Sequence
  Description of Artificial Sequence: Synthetic oligonucleotide
ctagttggcctcggcaaaaaggcagctg

SEQ ID NO: 119288 - DNA, 28 bp, Artificial Sequence
  Description of Artificial Sequence: Synthetic oligonucleotide
tagttggcctcggcaaaaaggcagctgg

SEQ ID NO: 119289 - DNA, 27 bp, Artificial Sequence
  Description of Artificial Sequence: Synthetic oligonucleotide
agttggcctcggcaaaaaggcagctgg

SEQ ID NO: 119290 - DNA, 27 bp, Artificial Sequence
  Description of Artificial Sequence: Synthetic oligonucleotide
gttggcctcggcaaaaaggcagctgga

SEQ ID NO: 119291 - DNA, 29 bp, Artificial Sequence
  Description of Artificial Sequence: Synthetic oligonucleotide
ttggcctcggcaaaaaggcagctggaatc

SEQ ID NO: 119292 - DNA, 28 bp, Artificial Sequence
  Description of Artificial Sequence: Synthetic oligonucleotide
tggcctcggcaaaaaggcagctggaatc

SEQ ID NO: 119293 - DNA, 27 bp, Artificial Sequence
  Description of Artificial Sequence: Synthetic oligonucleotide
ggcctcggcaaaaaggcagctggaatc

SEQ ID NO: 119294 - DNA, 27 bp, Artificial Sequence
  Description of Artificial Sequence: Synthetic oligonucleotide
gcctcggcaaaaaggcagctggaatcg

SEQ ID NO: 119295 - DNA, 28 bp, Artificial Sequence
  Description of Artificial Sequence: Synthetic oligonucleotide
cctcggcaaaaaggcagctggaatcgac

SEQ ID NO: 119296 - DNA, 28 bp, Artificial Sequence
  Description of Artificial Sequence: Synthetic oligonucleotide
ctcggcaaaaaggcagctggaatcgacg

SEQ ID NO: 119297 - DNA, 30 bp, Artificial Sequence
  Description of Artificial Sequence: Synthetic oligonucleotide
tcggcaaaaaggcagctggaatcgacgaac

SEQ ID NO: 119298 - DNA, 29 bp, Artificial Sequence
  Description of Artificial Sequence: Synthetic oligonucleotide
cggcaaaaaggcagctggaatcgacgaac

SEQ ID NO: 119299 - DNA, 30 bp, Artificial Sequence
  Description of Artificial Sequence: Synthetic oligonucleotide
ggcaaaaaggcagctggaatcgacgaacag

SEQ ID NO: 119300 - DNA, 30 bp, Artificial Sequence
  Description of Artificial Sequence: Synthetic oligonucleotide
gcaaaaaggcagctggaatcgacgaacagg

SEQ ID NO: 119301 - DNA, 34 bp, Artificial Sequence
  Description of Artificial Sequence: Synthetic oligonucleotide
caaaaaggcagctggaatcgacgaacaggaaaac

SEQ ID NO: 119302 - DNA, 35 bp, Artificial Sequence
  Description of Artificial Sequence: Synthetic oligonucleotide
aaaaaggcagctggaatcgacgaacaggaaaactg

SEQ ID NO: 119303 - DNA, 34 bp, Artificial Sequence
  Description of Artificial Sequence: Synthetic oligonucleotide
aaaaggcagctggaatcgacgaacaggaaaactg

SEQ ID NO: 119304 - DNA, 33 bp, Artificial Sequence
  Description of Artificial Sequence: Synthetic oligonucleotide
aaaggcagctggaatcgacgaacaggaaaactg

SEQ ID NO: 119305 - DNA, 32 bp, Artificial Sequence
  Description of Artificial Sequence: Synthetic oligonucleotide
aaggcagctggaatcgacgaacaggaaaactg

SEQ ID NO: 119306 - DNA, 31 bp, Artificial Sequence
  Description of Artificial Sequence: Synthetic oligonucleotide
aggcagctggaatcgacgaacaggaaaactg

SEQ ID NO: 119307 - DNA, 30 bp, Artificial Sequence
  Description of Artificial Sequence: Synthetic oligonucleotide
ggcagctggaatcgacgaacaggaaaactg

SEQ ID NO: 119308 - DNA, 30 bp, Artificial Sequence
  Description of Artificial Sequence: Synthetic oligonucleotide
gcagctggaatcgacgaacaggaaaactgg

SEQ ID NO: 119309 - DNA, 30 bp, Artificial Sequence
  Description of Artificial Sequence: Synthetic oligonucleotide
cagctggaatcgacgaacaggaaaactggc

SEQ ID NO: 119310 - DNA, 32 bp, Artificial Sequence
  Description of Artificial Sequence: Synthetic oligonucleotide
agctggaatcgacgaacaggaaaactggcatg

SEQ ID NO: 119311 - DNA, 31 bp, Artificial Sequence
  Description of Artificial Sequence: Synthetic oligonucleotide
gctggaatcgacgaacaggaaaactggcatg

SEQ ID NO: 119312 - DNA, 33 bp, Artificial Sequence
  Description of Artificial Sequence: Synthetic oligonucleotide
ctggaatcgacgaacaggaaaactggcatgaag

SEQ ID NO: 119313 - DNA, 33 bp, Artificial Sequence
  Description of Artificial Sequence: Synthetic oligonucleotide
tggaatcgacgaacaggaaaactggcatgaagg

SEQ ID NO: 119314 - DNA, 32 bp, Artificial Sequence
  Description of Artificial Sequence: Synthetic oligonucleotide
ggaatcgacgaacaggaaaactggcatgaagg

SEQ ID NO: 119315 - DNA, 32 bp, Artificial Sequence
  Description of Artificial Sequence: Synthetic oligonucleotide
gaatcgacgaacaggaaaactggcatgaaggc

SEQ ID NO: 119316 - DNA, 35 bp, Artificial Sequence
  Description of Artificial Sequence: Synthetic oligonucleotide
aatcgacgaacaggaaaactggcatgaaggcaaag

SEQ ID NO: 119317 - DNA, 34 bp, Artificial Sequence
  Description of Artificial Sequence: Synthetic oligonucleotide
atcgacgaacaggaaaactggcatgaaggcaaag

SEQ ID NO: 119318 - DNA, 33 bp, Artificial Sequence
  Description of Artificial Sequence: Synthetic oligonucleotide
tcgacgaacaggaaaactggcatgaaggcaaag

SEQ ID NO: 119319 - DNA, 32 bp, Artificial Sequence
  Description of Artificial Sequence: Synthetic oligonucleotide
cgacgaacaggaaaactggcatgaaggcaaag

SEQ ID NO: 119320 - DNA, 36 bp, Artificial Sequence
  Description of Artificial Sequence: Synthetic oligonucleotide
gacgaacaggaaaactggcatgaaggcaaagaaaac

SEQ ID NO: 119321 - DNA, 38 bp, Artificial Sequence
  Description of Artificial Sequence: Synthetic oligonucleotide
acgaacaggaaaactggcatgaaggcaaagaaaacatc

SEQ ID NO: 119322 - DNA, 37 bp, Artificial Sequence
  Description of Artificial Sequence: Synthetic oligonucleotide
cgaacaggaaaactggcatgaaggcaaagaaaacatc

SEQ ID NO: 119323 - DNA, 38 bp, Artificial Sequence
  Description of Artificial Sequence: Synthetic oligonucleotide
gaacaggaaaactggcatgaaggcaaagaaaacatcag

SEQ ID NO: 119324 - DNA, 39 bp, Artificial Sequence
  Description of Artificial Sequence: Synthetic oligonucleotide
aacaggaaaactggcatgaaggcaaagaaaacatcagag

SEQ ID NO: 119325 - DNA, 38 bp, Artificial Sequence
  Description of Artificial Sequence: Synthetic oligonucleotide
acaggaaaactggcatgaaggcaaagaaaacatcagag

SEQ ID NO: 119326 - DNA, 37 bp, Artificial Sequence
  Description of Artificial Sequence: Synthetic oligonucleotide
caggaaaactggcatgaaggcaaagaaaacatcagag

SEQ ID NO: 119327 - DNA, 37 bp, Artificial Sequence
  Description of Artificial Sequence: Synthetic oligonucleotide
aggaaaactggcatgaaggcaaagaaaacatcagagc

SEQ ID NO: 119328 - DNA, 36 bp, Artificial Sequence
  Description of Artificial Sequence: Synthetic oligonucleotide
ggaaaactggcatgaaggcaaagaaaacatcagagc

SEQ ID NO: 119329 - DNA, 37 bp, Artificial Sequence
  Description of Artificial Sequence: Synthetic oligonucleotide
gaaaactggcatgaaggcaaagaaaacatcagagctg

SEQ ID NO: 119330 - DNA, 37 bp, Artificial Sequence
  Description of Artificial Sequence: Synthetic oligonucleotide
aaaactggcatgaaggcaaagaaaacatcagagctgc

SEQ ID NO: 119331 - DNA, 36 bp, Artificial Sequence
  Description of Artificial Sequence: Synthetic oligonucleotide
aaactggcatgaaggcaaagaaaacatcagagctgc

SEQ ID NO: 119332 - DNA, 35 bp, Artificial Sequence
  Description of Artificial Sequence: Synthetic oligonucleotide
aactggcatgaaggcaaagaaaacatcagagctgc

SEQ ID NO: 119333 - DNA, 34 bp, Artificial Sequence
  Description of Artificial Sequence: Synthetic oligonucleotide
actggcatgaaggcaaagaaaacatcagagctgc

SEQ ID NO: 119334 - DNA, 33 bp, Artificial Sequence
  Description of Artificial Sequence: Synthetic oligonucleotide
ctggcatgaaggcaaagaaaacatcagagctgc

SEQ ID NO: 119335 - DNA, 34 bp, Artificial Sequence
  Description of Artificial Sequence: Synthetic oligonucleotide
tggcatgaaggcaaagaaaacatcagagctgctg

SEQ ID NO: 119336 - DNA, 33 bp, Artificial Sequence
  Description of Artificial Sequence: Synthetic oligonucleotide
ggcatgaaggcaaagaaaacatcagagctgctg

SEQ ID NO: 119337 - DNA, 35 bp, Artificial Sequence
  Description of Artificial Sequence: Synthetic oligonucleotide
gcatgaaggcaaagaaaacatcagagctgctgttg

SEQ ID NO: 119338 - DNA, 35 bp, Artificial Sequence
  Description of Artificial Sequence: Synthetic oligonucleotide
catgaaggcaaagaaaacatcagagctgctgttgc

SEQ ID NO: 119339 - DNA, 36 bp, Artificial Sequence
  Description of Artificial Sequence: Synthetic oligonucleotide
atgaaggcaaagaaaacatcagagctgctgttgcag

SEQ ID NO: 119340 - DNA, 35 bp, Artificial Sequence
  Description of Artificial Sequence: Synthetic oligonucleotide
tgaaggcaaagaaaacatcagagctgctgttgcag

SEQ ID NO: 119341 - DNA, 34 bp, Artificial Sequence
  Description of Artificial Sequence: Synthetic oligonucleotide
gaaggcaaagaaaacatcagagctgctgttgcag

SEQ ID NO: 119342 - DNA, 34 bp, Artificial Sequence
  Description of Artificial Sequence: Synthetic oligonucleotide
aaggcaaagaaaacatcagagctgctgttgcagc

SEQ ID NO: 119343 - DNA, 33 bp, Artificial Sequence
  Description of Artificial Sequence: Synthetic oligonucleotide
aggcaaagaaaacatcagagctgctgttgcagc

SEQ ID NO: 119344 - DNA, 32 bp, Artificial Sequence
  Description of Artificial Sequence: Synthetic oligonucleotide
ggcaaagaaaacatcagagctgctgttgcagc

SEQ ID NO: 119345 - DNA, 32 bp, Artificial Sequence
  Description of Artificial Sequence: Synthetic oligonucleotide
gcaaagaaaacatcagagctgctgttgcagcg

SEQ ID NO: 119346 - DNA, 32 bp, Artificial Sequence
  Description of Artificial Sequence: Synthetic oligonucleotide
caaagaaaacatcagagctgctgttgcagcgg

SEQ ID NO: 119347 - DNA, 32 bp, Artificial Sequence
  Description of Artificial Sequence: Synthetic oligonucleotide
aaagaaaacatcagagctgctgttgcagcggg

SEQ ID NO: 119348 - DNA, 31 bp, Artificial Sequence
  Description of Artificial Sequence: Synthetic oligonucleotide
aagaaaacatcagagctgctgttgcagcggg

SEQ ID NO: 119349 - DNA, 30 bp, Artificial Sequence
  Description of Artificial Sequence: Synthetic oligonucleotide
agaaaacatcagagctgctgttgcagcggg

SEQ ID NO: 119350 - DNA, 29 bp, Artificial Sequence
  Description of Artificial Sequence: Synthetic oligonucleotide
gaaaacatcagagctgctgttgcagcggg

SEQ ID NO: 119351 - DNA, 29 bp, Artificial Sequence
  Description of Artificial Sequence: Synthetic oligonucleotide
aaaacatcagagctgctgttgcagcgggg

SEQ ID NO: 119352 - DNA, 28 bp, Artificial Sequence
  Description of Artificial Sequence: Synthetic oligonucleotide
aaacatcagagctgctgttgcagcgggg

SEQ ID NO: 119353 - DNA, 27 bp, Artificial Sequence
  Description of Artificial Sequence: Synthetic oligonucleotide
aacatcagagctgctgttgcagcgggg

SEQ ID NO: 119354 - DNA, 27 bp, Artificial Sequence
  Description of Artificial Sequence: Synthetic oligonucleotide
acatcagagctgctgttgcagcggggt

SEQ ID NO: 119355 - DNA, 26 bp, Artificial Sequence
  Description of Artificial Sequence: Synthetic oligonucleotide
catcagagctgctgttgcagcggggt

SEQ ID NO: 119356 - DNA, 26 bp, Artificial Sequence
  Description of Artificial Sequence: Synthetic oligonucleotide
atcagagctgctgttgcagcggggtg

SEQ ID NO: 119357 - DNA, 25 bp, Artificial Sequence
  Description of Artificial Sequence: Synthetic oligonucleotide
tcagagctgctgttgcagcggggtg

SEQ ID NO: 119358 - DNA, 24 bp, Artificial Sequence
  Description of Artificial Sequence: Synthetic oligonucleotide
cagagctgctgttgcagcggggtg

SEQ ID NO: 119359 - DNA, 25 bp, Artificial Sequence
  Description of Artificial Sequence: Synthetic oligonucleotide
agagctgctgttgcagcggggtgca

SEQ ID NO: 119360 - DNA, 24 bp, Artificial Sequence
  Description of Artificial Sequence: Synthetic oligonucleotide
gagctgctgttgcagcggggtgca

SEQ ID NO: 119361 - DNA, 24 bp, Artificial Sequence
  Description of Artificial Sequence: Synthetic oligonucleotide
agctgctgttgcagcggggtgcag

SEQ ID NO: 119362 - DNA, 23 bp, Artificial Sequence
  Description of Artificial Sequence: Synthetic oligonucleotide
gctgctgttgcagcggggtgcag

SEQ ID NO: 119363 - DNA, 23 bp, Artificial Sequence
  Description of Artificial Sequence: Synthetic oligonucleotide
ctgctgttgcagcggggtgcagg

SEQ ID NO: 119364 - DNA, 24 bp, Artificial Sequence
  Description of Artificial Sequence: Synthetic oligonucleotide
tgctgttgcagcggggtgcaggca

SEQ ID NO: 119365 - DNA, 23 bp, Artificial Sequence
  Description of Artificial Sequence: Synthetic oligonucleotide
gctgttgcagcggggtgcaggca

SEQ ID NO: 119366 - DNA, 26 bp, Artificial Sequence
  Description of Artificial Sequence: Synthetic oligonucleotide
ctgttgcagcggggtgcaggcagatt

SEQ ID NO: 119367 - DNA, 27 bp, Artificial Sequence
  Description of Artificial Sequence: Synthetic oligonucleotide
tgttgcagcggggtgcaggcagattca

SEQ ID NO: 119368 - DNA, 27 bp, Artificial Sequence
  Description of Artificial Sequence: Synthetic oligonucleotide
gttgcagcggggtgcaggcagattcaa

SEQ ID NO: 119369 - DNA, 27 bp, Artificial Sequence
  Description of Artificial Sequence: Synthetic oligonucleotide
ttgcagcggggtgcaggcagattcaag

SEQ ID NO: 119370 - DNA, 27 bp, Artificial Sequence
  Description of Artificial Sequence: Synthetic oligonucleotide
tgcagcggggtgcaggcagattcaaga

SEQ ID NO: 119371 - DNA, 26 bp, Artificial Sequence
  Description of Artificial Sequence: Synthetic oligonucleotide
gcagcggggtgcaggcagattcaaga

SEQ ID NO: 119372 - DNA, 26 bp, Artificial Sequence
  Description of Artificial Sequence: Synthetic oligonucleotide
cagcggggtgcaggcagattcaagac

SEQ ID NO: 119373 - DNA, 27 bp, Artificial Sequence
  Description of Artificial Sequence: Synthetic oligonucleotide
agcggggtgcaggcagattcaagacct

SEQ ID NO: 119374 - DNA, 26 bp, Artificial Sequence
  Description of Artificial Sequence: Synthetic oligonucleotide
gcggggtgcaggcagattcaagacct

SEQ ID NO: 119375 - DNA, 26 bp, Artificial Sequence
  Description of Artificial Sequence: Synthetic oligonucleotide
cggggtgcaggcagattcaagacctg

SEQ ID NO: 119376 - DNA, 27 bp, Artificial Sequence
  Description of Artificial Sequence: Synthetic oligonucleotide
ggggtgcaggcagattcaagacctgga

SEQ ID NO: 119377 - DNA, 27 bp, Artificial Sequence
  Description of Artificial Sequence: Synthetic oligonucleotide
gggtgcaggcagattcaagacctggag

SEQ ID NO: 119378 - DNA, 27 bp, Artificial Sequence
  Description of Artificial Sequence: Synthetic oligonucleotide
ggtgcaggcagattcaagacctggagc

SEQ ID NO: 119379 - DNA, 28 bp, Artificial Sequence
  Description of Artificial Sequence: Synthetic oligonucleotide
gtgcaggcagattcaagacctggagctc

SEQ ID NO: 119380 - DNA, 29 bp, Artificial Sequence
  Description of Artificial Sequence: Synthetic oligonucleotide
tgcaggcagattcaagacctggagctctc

SEQ ID NO: 119381 - DNA, 28 bp, Artificial Sequence
  Description of Artificial Sequence: Synthetic oligonucleotide
gcaggcagattcaagacctggagctctc

SEQ ID NO: 119382 - DNA, 28 bp, Artificial Sequence
  Description of Artificial Sequence: Synthetic oligonucleotide
caggcagattcaagacctggagctctcg

SEQ ID NO: 119383 - DNA, 29 bp, Artificial Sequence
  Description of Artificial Sequence: Synthetic oligonucleotide
aggcagattcaagacctggagctctcgtc

SEQ ID NO: 119384 - DNA, 28 bp, Artificial Sequence
  Description of Artificial Sequence: Synthetic oligonucleotide
ggcagattcaagacctggagctctcgtc

SEQ ID NO: 119385 - DNA, 29 bp, Artificial Sequence
  Description of Artificial Sequence: Synthetic oligonucleotide
gcagattcaagacctggagctctcgtctg

SEQ ID NO: 119386 - DNA, 30 bp, Artificial Sequence
  Description of Artificial Sequence: Synthetic oligonucleotide
cagattcaagacctggagctctcgtctgtg

SEQ ID NO: 119387 - DNA, 30 bp, Artificial Sequence
  Description of Artificial Sequence: Synthetic oligonucleotide
agattcaagacctggagctctcgtctgtgg

SEQ ID NO: 119388 - DNA, 29 bp, Artificial Sequence
  Description of Artificial Sequence: Synthetic oligonucleotide
gattcaagacctggagctctcgtctgtgg

SEQ ID NO: 119389 - DNA, 30 bp, Artificial Sequence
  Description of Artificial Sequence: Synthetic oligonucleotide
attcaagacctggagctctcgtctgtggag

SEQ ID NO: 119390 - DNA, 29 bp, Artificial Sequence
  Description of Artificial Sequence: Synthetic oligonucleotide
ttcaagacctggagctctcgtctgtggag

SEQ ID NO: 119391 - DNA, 28 bp, Artificial Sequence
  Description of Artificial Sequence: Synthetic oligonucleotide
tcaagacctggagctctcgtctgtggag

SEQ ID NO: 119392 - DNA, 27 bp, Artificial Sequence
  Description of Artificial Sequence: Synthetic oligonucleotide
caagacctggagctctcgtctgtggag

SEQ ID NO: 119393 - DNA, 27 bp, Artificial Sequence
  Description of Artificial Sequence: Synthetic oligonucleotide
aagacctggagctctcgtctgtggagg

SEQ ID NO: 119394 - DNA, 27 bp, Artificial Sequence
  Description of Artificial Sequence: Synthetic oligonucleotide
agacctggagctctcgtctgtggaggt

SEQ ID NO: 119395 - DNA, 26 bp, Artificial Sequence
  Description of Artificial Sequence: Synthetic oligonucleotide
gacctggagctctcgtctgtggaggt

SEQ ID NO: 119396 - DNA, 26 bp, Artificial Sequence
  Description of Artificial Sequence: Synthetic oligonucleotide
acctggagctctcgtctgtggaggtg

SEQ ID NO: 119397 - DNA, 25 bp, Artificial Sequence
  Description of Artificial Sequence: Synthetic oligonucleotide
cctggagctctcgtctgtggaggtg

SEQ ID NO: 119398 - DNA, 27 bp, Artificial Sequence
  Description of Artificial Sequence: Synthetic oligonucleotide
ctggagctctcgtctgtggaggtggat

SEQ ID NO: 119399 - DNA, 27 bp, Artificial Sequence
  Description of Artificial Sequence: Synthetic oligonucleotide
tggagctctcgtctgtggaggtggatc

SEQ ID NO: 119400 - DNA, 26 bp, Artificial Sequence
  Description of Artificial Sequence: Synthetic oligonucleotide
ggagctctcgtctgtggaggtggatc

SEQ ID NO: 119401 - DNA, 26 bp, Artificial Sequence
  Description of Artificial Sequence: Synthetic oligonucleotide
gagctctcgtctgtggaggtggatcc

SEQ ID NO: 119402 - DNA, 27 bp, Artificial Sequence
  Description of Artificial Sequence: Synthetic oligonucleotide
agctctcgtctgtggaggtggatccct

SEQ ID NO: 119403 - DNA, 26 bp, Artificial Sequence
  Description of Artificial Sequence: Synthetic oligonucleotide
gctctcgtctgtggaggtggatccct

SEQ ID NO: 119404 - DNA, 27 bp, Artificial Sequence
  Description of Artificial Sequence: Synthetic oligonucleotide
ctctcgtctgtggaggtggatccctgt

SEQ ID NO: 119405 - DNA, 27 bp, Artificial Sequence
  Description of Artificial Sequence: Synthetic oligonucleotide
tctcgtctgtggaggtggatccctgtg

SEQ ID NO: 119406 - DNA, 26 bp, Artificial Sequence
  Description of Artificial Sequence: Synthetic oligonucleotide
ctcgtctgtggaggtggatccctgtg

SEQ ID NO: 119407 - DNA, 27 bp, Artificial Sequence
  Description of Artificial Sequence: Synthetic oligonucleotide
tcgtctgtggaggtggatccctgtgga

SEQ ID NO: 119408 - DNA, 26 bp, Artificial Sequence
  Description of Artificial Sequence: Synthetic oligonucleotide
cgtctgtggaggtggatccctgtgga

SEQ ID NO: 119409 - DNA, 27 bp, Artificial Sequence
  Description of Artificial Sequence: Synthetic oligonucleotide
gtctgtggaggtggatccctgtggaga

SEQ ID NO: 119410 - DNA, 27 bp, Artificial Sequence
  Description of Artificial Sequence: Synthetic oligonucleotide
tctgtggaggtggatccctgtggagac

SEQ ID NO: 119411 - DNA, 26 bp, Artificial Sequence
  Description of Artificial Sequence: Synthetic oligonucleotide
ctgtggaggtggatccctgtggagac

SEQ ID NO: 119412 - DNA, 26 bp, Artificial Sequence
  Description of Artificial Sequence: Synthetic oligonucleotide
tgtggaggtggatccctgtggagacg

SEQ ID NO: 119413 - DNA, 25 bp, Artificial Sequence
  Description of Artificial Sequence: Synthetic oligonucleotide
gtggaggtggatccctgtggagacg

SEQ ID NO: 119414 - DNA, 26 bp, Artificial Sequence
  Description of Artificial Sequence: Synthetic oligonucleotide
tggaggtggatccctgtggagacgct

SEQ ID NO: 119415 - DNA, 25 bp, Artificial Sequence
  Description of Artificial Sequence: Synthetic oligonucleotide
ggaggtggatccctgtggagacgct

SEQ ID NO: 119416 - DNA, 26 bp, Artificial Sequence
  Description of Artificial Sequence: Synthetic oligonucleotide
gaggtggatccctgtggagacgctca

SEQ ID NO: 119417 - DNA, 26 bp, Artificial Sequence
  Description of Artificial Sequence: Synthetic oligonucleotide
aggtggatccctgtggagacgctcag

SEQ ID NO: 119418 - DNA, 25 bp, Artificial Sequence
  Description of Artificial Sequence: Synthetic oligonucleotide
ggtggatccctgtggagacgctcag

SEQ ID NO: 119419 - DNA, 25 bp, Artificial Sequence
  Description of Artificial Sequence: Synthetic oligonucleotide
gtggatccctgtggagacgctcagg

SEQ ID NO: 119420 - DNA, 26 bp, Artificial Sequence
  Description of Artificial Sequence: Synthetic oligonucleotide
tggatccctgtggagacgctcaggct

SEQ ID NO: 119421 - DNA, 25 bp, Artificial Sequence
  Description of Artificial Sequence: Synthetic oligonucleotide
ggatccctgtggagacgctcaggct

SEQ ID NO: 119422 - DNA, 25 bp, Artificial Sequence
  Description of Artificial Sequence: Synthetic oligonucleotide
gatccctgtggagacgctcaggctg

SEQ ID NO: 119423 - DNA, 26 bp, Artificial Sequence
  Description of Artificial Sequence: Synthetic oligonucleotide
atccctgtggagacgctcaggctgct

SEQ ID NO: 119424 - DNA, 25 bp, Artificial Sequence
  Description of Artificial Sequence: Synthetic oligonucleotide
tccctgtggagacgctcaggctgct

SEQ ID NO: 119425 - DNA, 24 bp, Artificial Sequence
  Description of Artificial Sequence: Synthetic oligonucleotide
ccctgtggagacgctcaggctgct

SEQ ID NO: 119426 - DNA, 24 bp, Artificial Sequence
  Description of Artificial Sequence: Synthetic oligonucleotide
cctgtggagacgctcaggctgctg

SEQ ID NO: 119427 - DNA, 24 bp, Artificial Sequence
  Description of Artificial Sequence: Synthetic oligonucleotide
ctgtggagacgctcaggctgctgc

SEQ ID NO: 119428 - DNA, 24 bp, Artificial Sequence
  Description of Artificial Sequence: Synthetic oligonucleotide
tgtggagacgctcaggctgctgcg

SEQ ID NO: 119429 - DNA, 23 bp, Artificial Sequence
  Description of Artificial Sequence: Synthetic oligonucleotide
gtggagacgctcaggctgctgcg

SEQ ID NO: 119430 - DNA, 24 bp, Artificial Sequence
  Description of Artificial Sequence: Synthetic oligonucleotide
tggagacgctcaggctgctgcgga

SEQ ID NO: 119431 - DNA, 23 bp, Artificial Sequence
  Description of Artificial Sequence: Synthetic oligonucleotide
ggagacgctcaggctgctgcgga

SEQ ID NO: 119432 - DNA, 23 bp, Artificial Sequence
  Description of Artificial Sequence: Synthetic oligonucleotide
gagacgctcaggctgctgcggag

SEQ ID NO: 119433 - DNA, 23 bp, Artificial Sequence
  Description of Artificial Sequence: Synthetic oligonucleotide
agacgctcaggctgctgcggagg

SEQ ID NO: 119434 - DNA, 22 bp, Artificial Sequence
  Description of Artificial Sequence: Synthetic oligonucleotide
gacgctcaggctgctgcggagg

SEQ ID NO: 119435 - DNA, 23 bp, Artificial Sequence
  Description of Artificial Sequence: Synthetic oligonucleotide
acgctcaggctgctgcggaggga

SEQ ID NO: 119436 - DNA, 22 bp, Artificial Sequence
  Description of Artificial Sequence: Synthetic oligonucleotide
cgctcaggctgctgcggaggga

SEQ ID NO: 119437 - DNA, 22 bp, Artificial Sequence
  Description of Artificial Sequence: Synthetic oligonucleotide
gctcaggctgctgcggagggag

SEQ ID NO: 119438 - DNA, 22 bp, Artificial Sequence
  Description of Artificial Sequence: Synthetic oligonucleotide
ctcaggctgctgcggagggagc

SEQ ID NO: 119439 - DNA, 22 bp, Artificial Sequence
  Description of Artificial Sequence: Synthetic oligonucleotide
tcaggctgctgcggagggagcg

SEQ ID NO: 119440 - DNA, 21 bp, Artificial Sequence
  Description of Artificial Sequence: Synthetic oligonucleotide
caggctgctgcggagggagcg

SEQ ID NO: 119441 - DNA, 22 bp, Artificial Sequence
  Description of Artificial Sequence: Synthetic oligonucleotide
aggctgctgcggagggagcggt

SEQ ID NO: 119442 - DNA, 21 bp, Artificial Sequence
  Description of Artificial Sequence: Synthetic oligonucleotide
ggctgctgcggagggagcggt

SEQ ID NO: 119443 - DNA, 21 bp, Artificial Sequence
  Description of Artificial Sequence: Synthetic oligonucleotide
gctgctgcggagggagcggtg

SEQ ID NO: 119444 - DNA, 23 bp, Artificial Sequence
  Description of Artificial Sequence: Synthetic oligonucleotide
ctgctgcggagggagcggtgctt

SEQ ID NO: 119445 - DNA, 23 bp, Artificial Sequence
  Description of Artificial Sequence: Synthetic oligonucleotide
tgctgcggagggagcggtgcttg

SEQ ID NO: 119446 - DNA, 22 bp, Artificial Sequence
  Description of Artificial Sequence: Synthetic oligonucleotide
gctgcggagggagcggtgcttg

SEQ ID NO: 119447 - DNA, 23 bp, Artificial Sequence
  Description of Artificial Sequence: Synthetic oligonucleotide
ctgcggagggagcggtgcttggt

SEQ ID NO: 119448 - DNA, 24 bp, Artificial Sequence
  Description of Artificial Sequence: Synthetic oligonucleotide
tgcggagggagcggtgcttggtct

SEQ ID NO: 119449 - DNA, 23 bp, Artificial Sequence
  Description of Artificial Sequence: Synthetic oligonucleotide
gcggagggagcggtgcttggtct

SEQ ID NO: 119450 - DNA, 26 bp, Artificial Sequence
  Description of Artificial Sequence: Synthetic oligonucleotide
cggagggagcggtgcttggtctctat

SEQ ID NO: 119451 - DNA, 27 bp, Artificial Sequence
  Description of Artificial Sequence: Synthetic oligonucleotide
ggagggagcggtgcttggtctctatga

SEQ ID NO: 119452 - DNA, 30 bp, Artificial Sequence
  Description of Artificial Sequence: Synthetic oligonucleotide
gagggagcggtgcttggtctctatgaatac

SEQ ID NO: 119453 - DNA, 30 bp, Artificial Sequence
  Description of Artificial Sequence: Synthetic oligonucleotide
agggagcggtgcttggtctctatgaatacg

SEQ ID NO: 119454 - DNA, 29 bp, Artificial Sequence
  Description of Artificial Sequence: Synthetic oligonucleotide
gggagcggtgcttggtctctatgaatacg

SEQ ID NO: 119455 - DNA, 31 bp, Artificial Sequence
  Description of Artificial Sequence: Synthetic oligonucleotide
ggagcggtgcttggtctctatgaatacgatg

SEQ ID NO: 119456 - DNA, 32 bp, Artificial Sequence
  Description of Artificial Sequence: Synthetic oligonucleotide
gagcggtgcttggtctctatgaatacgatgac

SEQ ID NO: 119457 - DNA, 32 bp, Artificial Sequence
  Description of Artificial Sequence: Synthetic oligonucleotide
agcggtgcttggtctctatgaatacgatgacc

SEQ ID NO: 119458 - DNA, 31 bp, Artificial Sequence
  Description of Artificial Sequence: Synthetic oligonucleotide
gcggtgcttggtctctatgaatacgatgacc

SEQ ID NO: 119459 - DNA, 35 bp, Artificial Sequence
  Description of Artificial Sequence: Synthetic oligonucleotide
cggtgcttggtctctatgaatacgatgacctaaag

SEQ ID NO: 119460 - DNA, 35 bp, Artificial Sequence
  Description of Artificial Sequence: Synthetic oligonucleotide
ggtgcttggtctctatgaatacgatgacctaaagc

SEQ ID NO: 119461 - DNA, 42 bp, Artificial Sequence
  Description of Artificial Sequence: Synthetic oligonucleotide
gtgcttggtctctatgaatacgatgacctaaagcaaaaaaag

SEQ ID NO: 119462 - DNA, 44 bp, Artificial Sequence
  Description of Artificial Sequence: Synthetic oligonucleotide
tgcttggtctctatgaatacgatgacctaaagcaaaaaaagaag

SEQ ID NO: 119463 - DNA, 43 bp, Artificial Sequence
  Description of Artificial Sequence: Synthetic oligonucleotide
gcttggtctctatgaatacgatgacctaaagcaaaaaaagaag

SEQ ID NO: 119464 - DNA, 45 bp, Artificial Sequence
  Description of Artificial Sequence: Synthetic oligonucleotide
cttggtctctatgaatacgatgacctaaagcaaaaaaagaagatg

SEQ ID NO: 119465 - DNA, 45 bp, Artificial Sequence
  Description of Artificial Sequence: Synthetic oligonucleotide
ttggtctctatgaatacgatgacctaaagcaaaaaaagaagatgg

SEQ ID NO: 119466 - DNA, 44 bp, Artificial Sequence
  Description of Artificial Sequence: Synthetic oligonucleotide
tggtctctatgaatacgatgacctaaagcaaaaaaagaagatgg

SEQ ID NO: 119467 - DNA, 43 bp, Artificial Sequence
  Description of Artificial Sequence: Synthetic oligonucleotide
ggtctctatgaatacgatgacctaaagcaaaaaaagaagatgg

SEQ ID NO: 119468 - DNA, 43 bp, Artificial Sequence
  Description of Artificial Sequence: Synthetic oligonucleotide
gtctctatgaatacgatgacctaaagcaaaaaaagaagatggc

SEQ ID NO: 119469 - DNA, 44 bp, Artificial Sequence
  Description of Artificial Sequence: Synthetic oligonucleotide
tctctatgaatacgatgacctaaagcaaaaaaagaagatggctg

SEQ ID NO: 119470 - DNA, 43 bp, Artificial Sequence
  Description of Artificial Sequence: Synthetic oligonucleotide
ctctatgaatacgatgacctaaagcaaaaaaagaagatggctg

SEQ ID NO: 119471 - DNA, 44 bp, Artificial Sequence
  Description of Artificial Sequence: Synthetic oligonucleotide
tctatgaatacgatgacctaaagcaaaaaaagaagatggctgtg

SEQ ID NO: 119472 - DNA, 43 bp, Artificial Sequence
  Description of Artificial Sequence: Synthetic oligonucleotide
ctatgaatacgatgacctaaagcaaaaaaagaagatggctgtg

SEQ ID NO: 119473 - DNA, 44 bp, Artificial Sequence
  Description of Artificial Sequence: Synthetic oligonucleotide
tatgaatacgatgacctaaagcaaaaaaagaagatggctgtgtc

SEQ ID NO: 119474 - DNA, 43 bp, Artificial Sequence
  Description of Artificial Sequence: Synthetic oligonucleotide
atgaatacgatgacctaaagcaaaaaaagaagatggctgtgtc

SEQ ID NO: 119475 - DNA, 42 bp, Artificial Sequence
  Description of Artificial Sequence: Synthetic oligonucleotide
tgaatacgatgacctaaagcaaaaaaagaagatggctgtgtc

SEQ ID NO: 119476 - DNA, 41 bp, Artificial Sequence
  Description of Artificial Sequence: Synthetic oligonucleotide
gaatacgatgacctaaagcaaaaaaagaagatggctgtgtc

SEQ ID NO: 119477 - DNA, 41 bp, Artificial Sequence
  Description of Artificial Sequence: Synthetic oligonucleotide
aatacgatgacctaaagcaaaaaaagaagatggctgtgtcg

SEQ ID NO: 119478 - DNA, 40 bp, Artificial Sequence
  Description of Artificial Sequence: Synthetic oligonucleotide
atacgatgacctaaagcaaaaaaagaagatggctgtgtcg

SEQ ID NO: 119479 - DNA, 39 bp, Artificial Sequence
  Description of Artificial Sequence: Synthetic oligonucleotide
tacgatgacctaaagcaaaaaaagaagatggctgtgtcg

SEQ ID NO: 119480 - DNA, 38 bp, Artificial Sequence
  Description of Artificial Sequence: Synthetic oligonucleotide
acgatgacctaaagcaaaaaaagaagatggctgtgtcg

SEQ ID NO: 119481 - DNA, 37 bp, Artificial Sequence
  Description of Artificial Sequence: Synthetic oligonucleotide
cgatgacctaaagcaaaaaaagaagatggctgtgtcg

SEQ ID NO: 119482 - DNA, 37 bp, Artificial Sequence
  Description of Artificial Sequence: Synthetic oligonucleotide
gatgacctaaagcaaaaaaagaagatggctgtgtcgg

SEQ ID NO: 119483 - DNA, 37 bp, Artificial Sequence
  Description of Artificial Sequence: Synthetic oligonucleotide
atgacctaaagcaaaaaaagaagatggctgtgtcggc

SEQ ID NO: 119484 - DNA, 36 bp, Artificial Sequence
  Description of Artificial Sequence: Synthetic oligonucleotide
tgacctaaagcaaaaaaagaagatggctgtgtcggc

SEQ ID NO: 119485 - DNA, 35 bp, Artificial Sequence
  Description of Artificial Sequence: Synthetic oligonucleotide
gacctaaagcaaaaaaagaagatggctgtgtcggc

SEQ ID NO: 119486 - DNA, 38 bp, Artificial Sequence
  Description of Artificial Sequence: Synthetic oligonucleotide
acctaaagcaaaaaaagaagatggctgtgtcggcaaag

SEQ ID NO: 119487 - DNA, 37 bp, Artificial Sequence
  Description of Artificial Sequence: Synthetic oligonucleotide
cctaaagcaaaaaaagaagatggctgtgtcggcaaag

SEQ ID NO: 119488 - DNA, 37 bp, Artificial Sequence
  Description of Artificial Sequence: Synthetic oligonucleotide
ctaaagcaaaaaaagaagatggctgtgtcggcaaagc

SEQ ID NO: 119489 - DNA, 38 bp, Artificial Sequence
  Description of Artificial Sequence: Synthetic oligonucleotide
taaagcaaaaaaagaagatggctgtgtcggcaaagctc

SEQ ID NO: 119490 - DNA, 37 bp, Artificial Sequence
  Description of Artificial Sequence: Synthetic oligonucleotide
aaagcaaaaaaagaagatggctgtgtcggcaaagctc

SEQ ID NO: 119491 - DNA, 36 bp, Artificial Sequence
  Description of Artificial Sequence: Synthetic oligonucleotide
aagcaaaaaaagaagatggctgtgtcggcaaagctc

SEQ ID NO: 119492 - DNA, 35 bp, Artificial Sequence
  Description of Artificial Sequence: Synthetic oligonucleotide
agcaaaaaaagaagatggctgtgtcggcaaagctc

SEQ ID NO: 119493 - DNA, 34 bp, Artificial Sequence
  Description of Artificial Sequence: Synthetic oligonucleotide
gcaaaaaaagaagatggctgtgtcggcaaagctc

SEQ ID NO: 119494 - DNA, 37 bp, Artificial Sequence
  Description of Artificial Sequence: Synthetic oligonucleotide
caaaaaaagaagatggctgtgtcggcaaagctctatg

SEQ ID NO: 119495 - DNA, 37 bp, Artificial Sequence
  Description of Artificial Sequence: Synthetic oligonucleotide
aaaaaaagaagatggctgtgtcggcaaagctctatgg

SEQ ID NO: 119496 - DNA, 36 bp, Artificial Sequence
  Description of Artificial Sequence: Synthetic oligonucleotide
aaaaaagaagatggctgtgtcggcaaagctctatgg

SEQ ID NO: 119497 - DNA, 35 bp, Artificial Sequence
  Description of Artificial Sequence: Synthetic oligonucleotide
aaaaagaagatggctgtgtcggcaaagctctatgg

SEQ ID NO: 119498 - DNA, 34 bp, Artificial Sequence
  Description of Artificial Sequence: Synthetic oligonucleotide
aaaagaagatggctgtgtcggcaaagctctatgg

SEQ ID NO: 119499 - DNA, 33 bp, Artificial Sequence
  Description of Artificial Sequence: Synthetic oligonucleotide
aaagaagatggctgtgtcggcaaagctctatgg

SEQ ID NO: 119500 - DNA, 32 bp, Artificial Sequence
  Description of Artificial Sequence: Synthetic oligonucleotide
aagaagatggctgtgtcggcaaagctctatgg

SEQ ID NO: 119501 - DNA, 31 bp, Artificial Sequence
  Description of Artificial Sequence: Synthetic oligonucleotide
agaagatggctgtgtcggcaaagctctatgg

SEQ ID NO: 119502 - DNA, 30 bp, Artificial Sequence
  Description of Artificial Sequence: Synthetic oligonucleotide
gaagatggctgtgtcggcaaagctctatgg

SEQ ID NO: 119503 - DNA, 32 bp, Artificial Sequence
  Description of Artificial Sequence: Synthetic oligonucleotide
aagatggctgtgtcggcaaagctctatggaag

SEQ ID NO: 119504 - DNA, 31 bp, Artificial Sequence
  Description of Artificial Sequence: Synthetic oligonucleotide
agatggctgtgtcggcaaagctctatggaag

SEQ ID NO: 119505 - DNA, 30 bp, Artificial Sequence
  Description of Artificial Sequence: Synthetic oligonucleotide
gatggctgtgtcggcaaagctctatggaag

SEQ ID NO: 119506 - DNA, 31 bp, Artificial Sequence
  Description of Artificial Sequence: Synthetic oligonucleotide
atggctgtgtcggcaaagctctatggaagtg

SEQ ID NO: 119507 - DNA, 30 bp, Artificial Sequence
  Description of Artificial Sequence: Synthetic oligonucleotide
tggctgtgtcggcaaagctctatggaagtg

SEQ ID NO: 119508 - DNA, 29 bp, Artificial Sequence
  Description of Artificial Sequence: Synthetic oligonucleotide
ggctgtgtcggcaaagctctatggaagtg

SEQ ID NO: 119509 - DNA, 29 bp, Artificial Sequence
  Description of Artificial Sequence: Synthetic oligonucleotide
gctgtgtcggcaaagctctatggaagtgg

SEQ ID NO: 119510 - DNA, 29 bp, Artificial Sequence
  Description of Artificial Sequence: Synthetic oligonucleotide
ctgtgtcggcaaagctctatggaagtggg

SEQ ID NO: 119511 - DNA, 29 bp, Artificial Sequence
  Description of Artificial Sequence: Synthetic oligonucleotide
tgtgtcggcaaagctctatggaagtgggg

SEQ ID NO: 119512 - DNA, 28 bp, Artificial Sequence
  Description of Artificial Sequence: Synthetic oligonucleotide
gtgtcggcaaagctctatggaagtgggg

SEQ ID NO: 119513 - DNA, 30 bp, Artificial Sequence
  Description of Artificial Sequence: Synthetic oligonucleotide
tgtcggcaaagctctatggaagtggggatc

SEQ ID NO: 119514 - DNA, 29 bp, Artificial Sequence
  Description of Artificial Sequence: Synthetic oligonucleotide
gtcggcaaagctctatggaagtggggatc

SEQ ID NO: 119515 - DNA, 30 bp, Artificial Sequence
  Description of Artificial Sequence: Synthetic oligonucleotide
tcggcaaagctctatggaagtggggatcag

SEQ ID NO: 119516 - DNA, 29 bp, Artificial Sequence
  Description of Artificial Sequence: Synthetic oligonucleotide
cggcaaagctctatggaagtggggatcag

SEQ ID NO: 119517 - DNA, 29 bp, Artificial Sequence
  Description of Artificial Sequence: Synthetic oligonucleotide
ggcaaagctctatggaagtggggatcagg

SEQ ID NO: 119518 - DNA, 30 bp, Artificial Sequence
  Description of Artificial Sequence: Synthetic oligonucleotide
gcaaagctctatggaagtggggatcaggag

SEQ ID NO: 119519 - DNA, 30 bp, Artificial Sequence
  Description of Artificial Sequence: Synthetic oligonucleotide
caaagctctatggaagtggggatcaggagg

SEQ ID NO: 119520 - DNA, 30 bp, Artificial Sequence
  Description of Artificial Sequence: Synthetic oligonucleotide
aaagctctatggaagtggggatcaggaggc

SEQ ID NO: 119521 - DNA, 29 bp, Artificial Sequence
  Description of Artificial Sequence: Synthetic oligonucleotide
aagctctatggaagtggggatcaggaggc

SEQ ID NO: 119522 - DNA, 28 bp, Artificial Sequence
  Description of Artificial Sequence: Synthetic oligonucleotide
agctctatggaagtggggatcaggaggc

SEQ ID NO: 119523 - DNA, 27 bp, Artificial Sequence
  Description of Artificial Sequence: Synthetic oligonucleotide
gctctatggaagtggggatcaggaggc

SEQ ID NO: 119524 - DNA, 27 bp, Artificial Sequence
  Description of Artificial Sequence: Synthetic oligonucleotide
ctctatggaagtggggatcaggaggcc

SEQ ID NO: 119525 - DNA, 28 bp, Artificial Sequence
  Description of Artificial Sequence: Synthetic oligonucleotide
tctatggaagtggggatcaggaggcctg

SEQ ID NO: 119526 - DNA, 27 bp, Artificial Sequence
  Description of Artificial Sequence: Synthetic oligonucleotide
ctatggaagtggggatcaggaggcctg

SEQ ID NO: 119527 - DNA, 27 bp, Artificial Sequence
  Description of Artificial Sequence: Synthetic oligonucleotide
tatggaagtggggatcaggaggcctgg

SEQ ID NO: 119528 - DNA, 26 bp, Artificial Sequence
  Description of Artificial Sequence: Synthetic oligonucleotide
atggaagtggggatcaggaggcctgg

SEQ ID NO: 119529 - DNA, 25 bp, Artificial Sequence
  Description of Artificial Sequence: Synthetic oligonucleotide
tggaagtggggatcaggaggcctgg

SEQ ID NO: 119530 - DNA, 24 bp, Artificial Sequence
  Description of Artificial Sequence: Synthetic oligonucleotide
ggaagtggggatcaggaggcctgg

SEQ ID NO: 119531 - DNA, 25 bp, Artificial Sequence
  Description of Artificial Sequence: Synthetic oligonucleotide
gaagtggggatcaggaggcctggca

SEQ ID NO: 119532 - DNA, 27 bp, Artificial Sequence
  Description of Artificial Sequence: Synthetic oligonucleotide
aagtggggatcaggaggcctggcagaa

SEQ ID NO: 119533 - DNA, 27 bp, Artificial Sequence
  Description of Artificial Sequence: Synthetic oligonucleotide
agtggggatcaggaggcctggcagaaa

SEQ ID NO: 119534 - DNA, 26 bp, Artificial Sequence
  Description of Artificial Sequence: Synthetic oligonucleotide
gtggggatcaggaggcctggcagaaa

SEQ ID NO: 119535 - DNA, 26 bp, Artificial Sequence
  Description of Artificial Sequence: Synthetic oligonucleotide
tggggatcaggaggcctggcagaaag

SEQ ID NO: 119536 - DNA, 25 bp, Artificial Sequence
  Description of Artificial Sequence: Synthetic oligonucleotide
ggggatcaggaggcctggcagaaag

SEQ ID NO: 119537 - DNA, 26 bp, Artificial Sequence
  Description of Artificial Sequence: Synthetic oligonucleotide
gggatcaggaggcctggcagaaagga

SEQ ID NO: 119538 - DNA, 27 bp, Artificial Sequence
  Description of Artificial Sequence: Synthetic oligonucleotide
ggatcaggaggcctggcagaaaggagt

SEQ ID NO: 119539 - DNA, 27 bp, Artificial Sequence
  Description of Artificial Sequence: Synthetic oligonucleotide
gatcaggaggcctggcagaaaggagtc

SEQ ID NO: 119540 - DNA, 27 bp, Artificial Sequence
  Description of Artificial Sequence: Synthetic oligonucleotide
atcaggaggcctggcagaaaggagtcc

SEQ ID NO: 119541 - DNA, 27 bp, Artificial Sequence
  Description of Artificial Sequence: Synthetic oligonucleotide
tcaggaggcctggcagaaaggagtcct

SEQ ID NO: 119542 - DNA, 26 bp, Artificial Sequence
  Description of Artificial Sequence: Synthetic oligonucleotide
caggaggcctggcagaaaggagtcct

SEQ ID NO: 119543 - DNA, 27 bp, Artificial Sequence
  Description of Artificial Sequence: Synthetic oligonucleotide
aggaggcctggcagaaaggagtcctgt

SEQ ID NO: 119544 - DNA, 27 bp, Artificial Sequence
  Description of Artificial Sequence: Synthetic oligonucleotide
ggaggcctggcagaaaggagtcctgtt

SEQ ID NO: 119545 - DNA, 28 bp, Artificial Sequence
  Description of Artificial Sequence: Synthetic oligonucleotide
gaggcctggcagaaaggagtcctgtttg

SEQ ID NO: 119546 - DNA, 28 bp, Artificial Sequence
  Description of Artificial Sequence: Synthetic oligonucleotide
aggcctggcagaaaggagtcctgtttgc

SEQ ID NO: 119547 - DNA, 27 bp, Artificial Sequence
  Description of Artificial Sequence: Synthetic oligonucleotide
ggcctggcagaaaggagtcctgtttgc

SEQ ID NO: 119548 - DNA, 29 bp, Artificial Sequence
  Description of Artificial Sequence: Synthetic oligonucleotide
gcctggcagaaaggagtcctgtttgcttc

SEQ ID NO: 119549 - DNA, 30 bp, Artificial Sequence
  Description of Artificial Sequence: Synthetic oligonucleotide
cctggcagaaaggagtcctgtttgcttctg

SEQ ID NO: 119550 - DNA, 30 bp, Artificial Sequence
  Description of Artificial Sequence: Synthetic oligonucleotide
ctggcagaaaggagtcctgtttgcttctgg

SEQ ID NO: 119551 - DNA, 30 bp, Artificial Sequence
  Description of Artificial Sequence: Synthetic oligonucleotide
tggcagaaaggagtcctgtttgcttctggg

SEQ ID NO: 119552 - DNA, 29 bp, Artificial Sequence
  Description of Artificial Sequence: Synthetic oligonucleotide
ggcagaaaggagtcctgtttgcttctggg

SEQ ID NO: 119553 - DNA, 29 bp, Artificial Sequence
  Description of Artificial Sequence: Synthetic oligonucleotide
gcagaaaggagtcctgtttgcttctgggc

SEQ ID NO: 119554 - DNA, 30 bp, Artificial Sequence
  Description of Artificial Sequence: Synthetic oligonucleotide
cagaaaggagtcctgtttgcttctgggcag

SEQ ID NO: 119555 - DNA, 32 bp, Artificial Sequence
  Description of Artificial Sequence: Synthetic oligonucleotide
agaaaggagtcctgtttgcttctgggcagaac

SEQ ID NO: 119556 - DNA, 31 bp, Artificial Sequence
  Description of Artificial Sequence: Synthetic oligonucleotide
gaaaggagtcctgtttgcttctgggcagaac

SEQ ID NO: 119557 - DNA, 33 bp, Artificial Sequence
  Description of Artificial Sequence: Synthetic oligonucleotide
aaaggagtcctgtttgcttctgggcagaacttg

SEQ ID NO: 119558 - DNA, 32 bp, Artificial Sequence
  Description of Artificial Sequence: Synthetic oligonucleotide
aaggagtcctgtttgcttctgggcagaacttg

SEQ ID NO: 119559 - DNA, 31 bp, Artificial Sequence
  Description of Artificial Sequence: Synthetic oligonucleotide
aggagtcctgtttgcttctgggcagaacttg

SEQ ID NO: 119560 - DNA, 30 bp, Artificial Sequence
  Description of Artificial Sequence: Synthetic oligonucleotide
ggagtcctgtttgcttctgggcagaacttg

SEQ ID NO: 119561 - DNA, 30 bp, Artificial Sequence
  Description of Artificial Sequence: Synthetic oligonucleotide
gagtcctgtttgcttctgggcagaacttgg

SEQ ID NO: 119562 - DNA, 30 bp, Artificial Sequence
  Description of Artificial Sequence: Synthetic oligonucleotide
agtcctgtttgcttctgggcagaacttggc

SEQ ID NO: 119563 - DNA, 29 bp, Artificial Sequence
  Description of Artificial Sequence: Synthetic oligonucleotide
gtcctgtttgcttctgggcagaacttggc

SEQ ID NO: 119564 - DNA, 30 bp, Artificial Sequence
  Description of Artificial Sequence: Synthetic oligonucleotide
tcctgtttgcttctgggcagaacttggcac

SEQ ID NO: 119565 - DNA, 29 bp, Artificial Sequence
  Description of Artificial Sequence: Synthetic oligonucleotide
cctgtttgcttctgggcagaacttggcac

SEQ ID NO: 119566 - DNA, 29 bp, Artificial Sequence
  Description of Artificial Sequence: Synthetic oligonucleotide
ctgtttgcttctgggcagaacttggcacg

SEQ ID NO: 119567 - DNA, 29 bp, Artificial Sequence
  Description of Artificial Sequence: Synthetic oligonucleotide
tgtttgcttctgggcagaacttggcacgc

SEQ ID NO: 119568 - DNA, 28 bp, Artificial Sequence
  Description of Artificial Sequence: Synthetic oligonucleotide
gtttgcttctgggcagaacttggcacgc

SEQ ID NO: 119569 - DNA, 28 bp, Artificial Sequence
  Description of Artificial Sequence: Synthetic oligonucleotide
tttgcttctgggcagaacttggcacgcc

SEQ ID NO: 119570 - DNA, 27 bp, Artificial Sequence
  Description of Artificial Sequence: Synthetic oligonucleotide
ttgcttctgggcagaacttggcacgcc

SEQ ID NO: 119571 - DNA, 27 bp, Artificial Sequence
  Description of Artificial Sequence: Synthetic oligonucleotide
tgcttctgggcagaacttggcacgcca

SEQ ID NO: 119572 - DNA, 27 bp, Artificial Sequence
  Description of Artificial Sequence: Synthetic oligonucleotide
gcttctgggcagaacttggcacgccaa

SEQ ID NO: 119573 - DNA, 29 bp, Artificial Sequence
  Description of Artificial Sequence: Synthetic oligonucleotide
cttctgggcagaacttggcacgccaattg

SEQ ID NO: 119574 - DNA, 31 bp, Artificial Sequence
  Description of Artificial Sequence: Synthetic oligonucleotide
ttctgggcagaacttggcacgccaattgatg

SEQ ID NO: 119575 - DNA, 30 bp, Artificial Sequence
  Description of Artificial Sequence: Synthetic oligonucleotide
tctgggcagaacttggcacgccaattgatg

SEQ ID NO: 119576 - DNA, 29 bp, Artificial Sequence
  Description of Artificial Sequence: Synthetic oligonucleotide
ctgggcagaacttggcacgccaattgatg

SEQ ID NO: 119577 - DNA, 29 bp, Artificial Sequence
  Description of Artificial Sequence: Synthetic oligonucleotide
tgggcagaacttggcacgccaattgatgg

SEQ ID NO: 119578 - DNA, 28 bp, Artificial Sequence
  Description of Artificial Sequence: Synthetic oligonucleotide
gggcagaacttggcacgccaattgatgg

SEQ ID NO: 119579 - DNA, 29 bp, Artificial Sequence
  Description of Artificial Sequence: Synthetic oligonucleotide
ggcagaacttggcacgccaattgatggag

SEQ ID NO: 119580 - DNA, 30 bp, Artificial Sequence
  Description of Artificial Sequence: Synthetic oligonucleotide
gcagaacttggcacgccaattgatggagac

SEQ ID NO: 119581 - DNA, 30 bp, Artificial Sequence
  Description of Artificial Sequence: Synthetic oligonucleotide
cagaacttggcacgccaattgatggagacg

SEQ ID NO: 119582 - DNA, 30 bp, Artificial Sequence
  Description of Artificial Sequence: Synthetic oligonucleotide
agaacttggcacgccaattgatggagacgc

SEQ ID NO: 119583 - DNA, 29 bp, Artificial Sequence
  Description of Artificial Sequence: Synthetic oligonucleotide
gaacttggcacgccaattgatggagacgc

SEQ ID NO: 119584 - DNA, 29 bp, Artificial Sequence
  Description of Artificial Sequence: Synthetic oligonucleotide
aacttggcacgccaattgatggagacgcc

SEQ ID NO: 119585 - DNA, 28 bp, Artificial Sequence
  Description of Artificial Sequence: Synthetic oligonucleotide
acttggcacgccaattgatggagacgcc

SEQ ID NO: 119586 - DNA, 27 bp, Artificial Sequence
  Description of Artificial Sequence: Synthetic oligonucleotide
cttggcacgccaattgatggagacgcc

SEQ ID NO: 119587 - DNA, 28 bp, Artificial Sequence
  Description of Artificial Sequence: Synthetic oligonucleotide
ttggcacgccaattgatggagacgccag

SEQ ID NO: 119588 - DNA, 27 bp, Artificial Sequence
  Description of Artificial Sequence: Synthetic oligonucleotide
tggcacgccaattgatggagacgccag

SEQ ID NO: 119589 - DNA, 26 bp, Artificial Sequence
  Description of Artificial Sequence: Synthetic oligonucleotide
ggcacgccaattgatggagacgccag

SEQ ID NO: 119590 - DNA, 26 bp, Artificial Sequence
  Description of Artificial Sequence: Synthetic oligonucleotide
gcacgccaattgatggagacgccagc

SEQ ID NO: 119591 - DNA, 27 bp, Artificial Sequence
  Description of Artificial Sequence: Synthetic oligonucleotide
cacgccaattgatggagacgccagcca

SEQ ID NO: 119592 - DNA, 29 bp, Artificial Sequence
  Description of Artificial Sequence: Synthetic oligonucleotide
acgccaattgatggagacgccagccaatg

SEQ ID NO: 119593 - DNA, 28 bp, Artificial Sequence
  Description of Artificial Sequence: Synthetic oligonucleotide
cgccaattgatggagacgccagccaatg

SEQ ID NO: 119594 - DNA, 29 bp, Artificial Sequence
  Description of Artificial Sequence: Synthetic oligonucleotide
gccaattgatggagacgccagccaatgag

SEQ ID NO: 119595 - DNA, 31 bp, Artificial Sequence
  Description of Artificial Sequence: Synthetic oligonucleotide
ccaattgatggagacgccagccaatgagatg

SEQ ID NO: 119596 - DNA, 32 bp, Artificial Sequence
  Description of Artificial Sequence: Synthetic oligonucleotide
caattgatggagacgccagccaatgagatgac

SEQ ID NO: 119597 - DNA, 32 bp, Artificial Sequence
  Description of Artificial Sequence: Synthetic oligonucleotide
aattgatggagacgccagccaatgagatgacg

SEQ ID NO: 119598 - DNA, 31 bp, Artificial Sequence
  Description of Artificial Sequence: Synthetic oligonucleotide
attgatggagacgccagccaatgagatgacg

SEQ ID NO: 119599 - DNA, 30 bp, Artificial Sequence
  Description of Artificial Sequence: Synthetic oligonucleotide
ttgatggagacgccagccaatgagatgacg

SEQ ID NO: 119600 - DNA, 29 bp, Artificial Sequence
  Description of Artificial Sequence: Synthetic oligonucleotide
tgatggagacgccagccaatgagatgacg

SEQ ID NO: 119601 - DNA, 28 bp, Artificial Sequence
  Description of Artificial Sequence: Synthetic oligonucleotide
gatggagacgccagccaatgagatgacg

SEQ ID NO: 119602 - DNA, 28 bp, Artificial Sequence
  Description of Artificial Sequence: Synthetic oligonucleotide
atggagacgccagccaatgagatgacgc

SEQ ID NO: 119603 - DNA, 27 bp, Artificial Sequence
  Description of Artificial Sequence: Synthetic oligonucleotide
tggagacgccagccaatgagatgacgc

SEQ ID NO: 119604 - DNA, 26 bp, Artificial Sequence
  Description of Artificial Sequence: Synthetic oligonucleotide
ggagacgccagccaatgagatgacgc

SEQ ID NO: 119605 - DNA, 27 bp, Artificial Sequence
  Description of Artificial Sequence: Synthetic oligonucleotide
gagacgccagccaatgagatgacgcca

SEQ ID NO: 119606 - DNA, 28 bp, Artificial Sequence
  Description of Artificial Sequence: Synthetic oligonucleotide
agacgccagccaatgagatgacgccaac

SEQ ID NO: 119607 - DNA, 27 bp, Artificial Sequence
  Description of Artificial Sequence: Synthetic oligonucleotide
gacgccagccaatgagatgacgccaac

SEQ ID NO: 119608 - DNA, 27 bp, Artificial Sequence
  Description of Artificial Sequence: Synthetic oligonucleotide
acgccagccaatgagatgacgccaacc

SEQ ID NO: 119609 - DNA, 27 bp, Artificial Sequence
  Description of Artificial Sequence: Synthetic oligonucleotide
cgccagccaatgagatgacgccaacca

SEQ ID NO: 119610 - DNA, 27 bp, Artificial Sequence
  Description of Artificial Sequence: Synthetic oligonucleotide
gccagccaatgagatgacgccaaccag

SEQ ID NO: 119611 - DNA, 31 bp, Artificial Sequence
  Description of Artificial Sequence: Synthetic oligonucleotide
ccagccaatgagatgacgccaaccagatttg

SEQ ID NO: 119612 - DNA, 31 bp, Artificial Sequence
  Description of Artificial Sequence: Synthetic oligonucleotide
cagccaatgagatgacgccaaccagatttgc

SEQ ID NO: 119613 - DNA, 32 bp, Artificial Sequence
  Description of Artificial Sequence: Synthetic oligonucleotide
agccaatgagatgacgccaaccagatttgctg

SEQ ID NO: 119614 - DNA, 31 bp, Artificial Sequence
  Description of Artificial Sequence: Synthetic oligonucleotide
gccaatgagatgacgccaaccagatttgctg

SEQ ID NO: 119615 - DNA, 39 bp, Artificial Sequence
  Description of Artificial Sequence: Synthetic oligonucleotide
ccaatgagatgacgccaaccagatttgctgaaattattg

SEQ ID NO: 119616 - DNA, 40 bp, Artificial Sequence
  Description of Artificial Sequence: Synthetic oligonucleotide
caatgagatgacgccaaccagatttgctgaaattattgag

SEQ ID NO: 119617 - DNA, 42 bp, Artificial Sequence
  Description of Artificial Sequence: Synthetic oligonucleotide
aatgagatgacgccaaccagatttgctgaaattattgagaag

SEQ ID NO: 119618 - DNA, 41 bp, Artificial Sequence
  Description of Artificial Sequence: Synthetic oligonucleotide
atgagatgacgccaaccagatttgctgaaattattgagaag

SEQ ID NO: 119619 - DNA, 40 bp, Artificial Sequence
  Description of Artificial Sequence: Synthetic oligonucleotide
tgagatgacgccaaccagatttgctgaaattattgagaag

SEQ ID NO: 119620 - DNA, 39 bp, Artificial Sequence
  Description of Artificial Sequence: Synthetic oligonucleotide
gagatgacgccaaccagatttgctgaaattattgagaag

SEQ ID NO: 119621 - DNA, 42 bp, Artificial Sequence
  Description of Artificial Sequence: Synthetic oligonucleotide
agatgacgccaaccagatttgctgaaattattgagaagaatc

SEQ ID NO: 119622 - DNA, 41 bp, Artificial Sequence
  Description of Artificial Sequence: Synthetic oligonucleotide
gatgacgccaaccagatttgctgaaattattgagaagaatc

SEQ ID NO: 119623 - DNA, 42 bp, Artificial Sequence
  Description of Artificial Sequence: Synthetic oligonucleotide
atgacgccaaccagatttgctgaaattattgagaagaatctc

SEQ ID NO: 119624 - DNA, 41 bp, Artificial Sequence
  Description of Artificial Sequence: Synthetic oligonucleotide
tgacgccaaccagatttgctgaaattattgagaagaatctc

SEQ ID NO: 119625 - DNA, 40 bp, Artificial Sequence
  Description of Artificial Sequence: Synthetic oligonucleotide
gacgccaaccagatttgctgaaattattgagaagaatctc

SEQ ID NO: 119626 - DNA, 44 bp, Artificial Sequence
  Description of Artificial Sequence: Synthetic oligonucleotide
acgccaaccagatttgctgaaattattgagaagaatctcaaaag

SEQ ID NO: 119627 - DNA, 43 bp, Artificial Sequence
  Description of Artificial Sequence: Synthetic oligonucleotide
cgccaaccagatttgctgaaattattgagaagaatctcaaaag

SEQ ID NO: 119628 - DNA, 44 bp, Artificial Sequence
  Description of Artificial Sequence: Synthetic oligonucleotide
gccaaccagatttgctgaaattattgagaagaatctcaaaagtg

SEQ ID NO: 119629 - DNA, 44 bp, Artificial Sequence
  Description of Artificial Sequence: Synthetic oligonucleotide
ccaaccagatttgctgaaattattgagaagaatctcaaaagtgc

SEQ ID NO: 119630 - DNA, 46 bp, Artificial Sequence
  Description of Artificial Sequence: Synthetic oligonucleotide
caaccagatttgctgaaattattgagaagaatctcaaaagtgctag

SEQ ID NO: 119631 - DNA, 48 bp, Artificial Sequence
  Description of Artificial Sequence: Synthetic oligonucleotide
aaccagatttgctgaaattattgagaagaatctcaaaagtgctagtag

SEQ ID NO: 119632 - DNA, 47 bp, Artificial Sequence
  Description of Artificial Sequence: Synthetic oligonucleotide
accagatttgctgaaattattgagaagaatctcaaaagtgctagtag

SEQ ID NO: 119633 - DNA, 46 bp, Artificial Sequence
  Description of Artificial Sequence: Synthetic oligonucleotide
ccagatttgctgaaattattgagaagaatctcaaaagtgctagtag

SEQ ID NO: 119634 - DNA, 51 bp, Artificial Sequence
  Description of Artificial Sequence: Synthetic oligonucleotide
cagatttgctgaaattattgagaagaatctcaaaagtgctagtagtaaaac

SEQ ID NO: 119635 - DNA, 51 bp, Artificial Sequence
  Description of Artificial Sequence: Synthetic oligonucleotide
agatttgctgaaattattgagaagaatctcaaaagtgctagtagtaaaacc

SEQ ID NO: 119636 - DNA, 50 bp, Artificial Sequence
  Description of Artificial Sequence: Synthetic oligonucleotide
gatttgctgaaattattgagaagaatctcaaaagtgctagtagtaaaacc

SEQ ID NO: 119637 - DNA, 50 bp, Artificial Sequence
  Description of Artificial Sequence: Synthetic oligonucleotide
atttgctgaaattattgagaagaatctcaaaagtgctagtagtaaaaccg

SEQ ID NO: 119638 - DNA, 49 bp, Artificial Sequence
  Description of Artificial Sequence: Synthetic oligonucleotide
tttgctgaaattattgagaagaatctcaaaagtgctagtagtaaaaccg

SEQ ID NO: 119639 - DNA, 48 bp, Artificial Sequence
  Description of Artificial Sequence: Synthetic oligonucleotide
ttgctgaaattattgagaagaatctcaaaagtgctagtagtaaaaccg

SEQ ID NO: 119640 - DNA, 47 bp, Artificial Sequence
  Description of Artificial Sequence: Synthetic oligonucleotide
tgctgaaattattgagaagaatctcaaaagtgctagtagtaaaaccg

SEQ ID NO: 119641 - DNA, 46 bp, Artificial Sequence
  Description of Artificial Sequence: Synthetic oligonucleotide
gctgaaattattgagaagaatctcaaaagtgctagtagtaaaaccg

SEQ ID NO: 119642 - DNA, 47 bp, Artificial Sequence
  Description of Artificial Sequence: Synthetic oligonucleotide
ctgaaattattgagaagaatctcaaaagtgctagtagtaaaaccgag

SEQ ID NO: 119643 - DNA, 47 bp, Artificial Sequence
  Description of Artificial Sequence: Synthetic oligonucleotide
tgaaattattgagaagaatctcaaaagtgctagtagtaaaaccgagg

SEQ ID NO: 119644 - DNA, 46 bp, Artificial Sequence
  Description of Artificial Sequence: Synthetic oligonucleotide
gaaattattgagaagaatctcaaaagtgctagtagtaaaaccgagg

SEQ ID NO: 119645 - DNA, 47 bp, Artificial Sequence
  Description of Artificial Sequence: Synthetic oligonucleotide
aaattattgagaagaatctcaaaagtgctagtagtaaaaccgaggtc

SEQ ID NO: 119646 - DNA, 46 bp, Artificial Sequence
  Description of Artificial Sequence: Synthetic oligonucleotide
aattattgagaagaatctcaaaagtgctagtagtaaaaccgaggtc

SEQ ID NO: 119647 - DNA, 45 bp, Artificial Sequence
  Description of Artificial Sequence: Synthetic oligonucleotide
attattgagaagaatctcaaaagtgctagtagtaaaaccgaggtc

SEQ ID NO: 119648 - DNA, 44 bp, Artificial Sequence
  Description of Artificial Sequence: Synthetic oligonucleotide
ttattgagaagaatctcaaaagtgctagtagtaaaaccgaggtc

SEQ ID NO: 119649 - DNA, 43 bp, Artificial Sequence
  Description of Artificial Sequence: Synthetic oligonucleotide
tattgagaagaatctcaaaagtgctagtagtaaaaccgaggtc

SEQ ID NO: 119650 - DNA, 42 bp, Artificial Sequence
  Description of Artificial Sequence: Synthetic oligonucleotide
attgagaagaatctcaaaagtgctagtagtaaaaccgaggtc

SEQ ID NO: 119651 - DNA, 41 bp, Artificial Sequence
  Description of Artificial Sequence: Synthetic oligonucleotide
ttgagaagaatctcaaaagtgctagtagtaaaaccgaggtc

SEQ ID NO: 119652 - DNA, 40 bp, Artificial Sequence
  Description of Artificial Sequence: Synthetic oligonucleotide
tgagaagaatctcaaaagtgctagtagtaaaaccgaggtc

SEQ ID NO: 119653 - DNA, 39 bp, Artificial Sequence
  Description of Artificial Sequence: Synthetic oligonucleotide
gagaagaatctcaaaagtgctagtagtaaaaccgaggtc

SEQ ID NO: 119654 - DNA, 39 bp, Artificial Sequence
  Description of Artificial Sequence: Synthetic oligonucleotide
agaagaatctcaaaagtgctagtagtaaaaccgaggtcc

SEQ ID NO: 119655 - DNA, 38 bp, Artificial Sequence
  Description of Artificial Sequence: Synthetic oligonucleotide
gaagaatctcaaaagtgctagtagtaaaaccgaggtcc

SEQ ID NO: 119656 - DNA, 42 bp, Artificial Sequence
  Description of Artificial Sequence: Synthetic oligonucleotide
aagaatctcaaaagtgctagtagtaaaaccgaggtccatatc

SEQ ID NO: 119657 - DNA, 41 bp, Artificial Sequence
  Description of Artificial Sequence: Synthetic oligonucleotide
agaatctcaaaagtgctagtagtaaaaccgaggtccatatc

SEQ ID NO: 119658 - DNA, 40 bp, Artificial Sequence
  Description of Artificial Sequence: Synthetic oligonucleotide
gaatctcaaaagtgctagtagtaaaaccgaggtccatatc

SEQ ID NO: 119659 - DNA, 41 bp, Artificial Sequence
  Description of Artificial Sequence: Synthetic oligonucleotide
aatctcaaaagtgctagtagtaaaaccgaggtccatatcag

SEQ ID NO: 119660 - DNA, 40 bp, Artificial Sequence
  Description of Artificial Sequence: Synthetic oligonucleotide
atctcaaaagtgctagtagtaaaaccgaggtccatatcag

SEQ ID NO: 119661 - DNA, 39 bp, Artificial Sequence
  Description of Artificial Sequence: Synthetic oligonucleotide
tctcaaaagtgctagtagtaaaaccgaggtccatatcag

SEQ ID NO: 119662 - DNA, 38 bp, Artificial Sequence
  Description of Artificial Sequence: Synthetic oligonucleotide
ctcaaaagtgctagtagtaaaaccgaggtccatatcag

SEQ ID NO: 119663 - DNA, 39 bp, Artificial Sequence
  Description of Artificial Sequence: Synthetic oligonucleotide
tcaaaagtgctagtagtaaaaccgaggtccatatcagac

SEQ ID NO: 119664 - DNA, 38 bp, Artificial Sequence
  Description of Artificial Sequence: Synthetic oligonucleotide
caaaagtgctagtagtaaaaccgaggtccatatcagac

SEQ ID NO: 119665 - DNA, 38 bp, Artificial Sequence
  Description of Artificial Sequence: Synthetic oligonucleotide
aaaagtgctagtagtaaaaccgaggtccatatcagacc

SEQ ID NO: 119666 - DNA, 37 bp, Artificial Sequence
  Description of Artificial Sequence: Synthetic oligonucleotide
aaagtgctagtagtaaaaccgaggtccatatcagacc

SEQ ID NO: 119667 - DNA, 36 bp, Artificial Sequence
  Description of Artificial Sequence: Synthetic oligonucleotide
aagtgctagtagtaaaaccgaggtccatatcagacc

SEQ ID NO: 119668 - DNA, 35 bp, Artificial Sequence
  Description of Artificial Sequence: Synthetic oligonucleotide
agtgctagtagtaaaaccgaggtccatatcagacc

SEQ ID NO: 119669 - DNA, 34 bp, Artificial Sequence
  Description of Artificial Sequence: Synthetic oligonucleotide
gtgctagtagtaaaaccgaggtccatatcagacc

SEQ ID NO: 119670 - DNA, 34 bp, Artificial Sequence
  Description of Artificial Sequence: Synthetic oligonucleotide
tgctagtagtaaaaccgaggtccatatcagaccc

SEQ ID NO: 119671 - DNA, 33 bp, Artificial Sequence
  Description of Artificial Sequence: Synthetic oligonucleotide
gctagtagtaaaaccgaggtccatatcagaccc

SEQ ID NO: 119672 - DNA, 35 bp, Artificial Sequence
  Description of Artificial Sequence: Synthetic oligonucleotide
ctagtagtaaaaccgaggtccatatcagacccaag

SEQ ID NO: 119673 - DNA, 36 bp, Artificial Sequence
  Description of Artificial Sequence: Synthetic oligonucleotide
tagtagtaaaaccgaggtccatatcagacccaagtc

SEQ ID NO: 119674 - DNA, 35 bp, Artificial Sequence
  Description of Artificial Sequence: Synthetic oligonucleotide
agtagtaaaaccgaggtccatatcagacccaagtc

SEQ ID NO: 119675 - DNA, 34 bp, Artificial Sequence
  Description of Artificial Sequence: Synthetic oligonucleotide
gtagtaaaaccgaggtccatatcagacccaagtc

SEQ ID NO: 119676 - DNA, 36 bp, Artificial Sequence
  Description of Artificial Sequence: Synthetic oligonucleotide
tagtaaaaccgaggtccatatcagacccaagtcttg

SEQ ID NO: 119677 - DNA, 35 bp, Artificial Sequence
  Description of Artificial Sequence: Synthetic oligonucleotide
agtaaaaccgaggtccatatcagacccaagtcttg

SEQ ID NO: 119678 - DNA, 34 bp, Artificial Sequence
  Description of Artificial Sequence: Synthetic oligonucleotide
gtaaaaccgaggtccatatcagacccaagtcttg

SEQ ID NO: 119679 - DNA, 34 bp, Artificial Sequence
  Description of Artificial Sequence: Synthetic oligonucleotide
taaaaccgaggtccatatcagacccaagtcttgg

SEQ ID NO: 119680 - DNA, 33 bp, Artificial Sequence
  Description of Artificial Sequence: Synthetic oligonucleotide
aaaaccgaggtccatatcagacccaagtcttgg

SEQ ID NO: 119681 - DNA, 32 bp, Artificial Sequence
  Description of Artificial Sequence: Synthetic oligonucleotide
aaaccgaggtccatatcagacccaagtcttgg

SEQ ID NO: 119682 - DNA, 31 bp, Artificial Sequence
  Description of Artificial Sequence: Synthetic oligonucleotide
aaccgaggtccatatcagacccaagtcttgg

SEQ ID NO: 119683 - DNA, 30 bp, Artificial Sequence
  Description of Artificial Sequence: Synthetic oligonucleotide
accgaggtccatatcagacccaagtcttgg

SEQ ID NO: 119684 - DNA, 29 bp, Artificial Sequence
  Description of Artificial Sequence: Synthetic oligonucleotide
ccgaggtccatatcagacccaagtcttgg

SEQ ID NO: 119685 - DNA, 32 bp, Artificial Sequence
  Description of Artificial Sequence: Synthetic oligonucleotide
cgaggtccatatcagacccaagtcttggattg

SEQ ID NO: 119686 - DNA, 33 bp, Artificial Sequence
  Description of Artificial Sequence: Synthetic oligonucleotide
gaggtccatatcagacccaagtcttggattgag

SEQ ID NO: 119687 - DNA, 33 bp, Artificial Sequence
  Description of Artificial Sequence: Synthetic oligonucleotide
aggtccatatcagacccaagtcttggattgagg

SEQ ID NO: 119688 - DNA, 32 bp, Artificial Sequence
  Description of Artificial Sequence: Synthetic oligonucleotide
ggtccatatcagacccaagtcttggattgagg

SEQ ID NO: 119689 - DNA, 34 bp, Artificial Sequence
  Description of Artificial Sequence: Synthetic oligonucleotide
gtccatatcagacccaagtcttggattgaggaac

SEQ ID NO: 119690 - DNA, 35 bp, Artificial Sequence
  Description of Artificial Sequence: Synthetic oligonucleotide
tccatatcagacccaagtcttggattgaggaacag

SEQ ID NO: 119691 - DNA, 34 bp, Artificial Sequence
  Description of Artificial Sequence: Synthetic oligonucleotide
ccatatcagacccaagtcttggattgaggaacag

SEQ ID NO: 119692 - DNA, 34 bp, Artificial Sequence
  Description of Artificial Sequence: Synthetic oligonucleotide
catatcagacccaagtcttggattgaggaacagg

SEQ ID NO: 119693 - DNA, 34 bp, Artificial Sequence
  Description of Artificial Sequence: Synthetic oligonucleotide
atatcagacccaagtcttggattgaggaacaggc

SEQ ID NO: 119694 - DNA, 33 bp, Artificial Sequence
  Description of Artificial Sequence: Synthetic oligonucleotide
tatcagacccaagtcttggattgaggaacaggc

SEQ ID NO: 119695 - DNA, 32 bp, Artificial Sequence
  Description of Artificial Sequence: Synthetic oligonucleotide
atcagacccaagtcttggattgaggaacaggc

SEQ ID NO: 119696 - DNA, 31 bp, Artificial Sequence
  Description of Artificial Sequence: Synthetic oligonucleotide
tcagacccaagtcttggattgaggaacaggc

SEQ ID NO: 119697 - DNA, 30 bp, Artificial Sequence
  Description of Artificial Sequence: Synthetic oligonucleotide
cagacccaagtcttggattgaggaacaggc

SEQ ID NO: 119698 - DNA, 33 bp, Artificial Sequence
  Description of Artificial Sequence: Synthetic oligonucleotide
agacccaagtcttggattgaggaacaggcaatg

SEQ ID NO: 119699 - DNA, 32 bp, Artificial Sequence
  Description of Artificial Sequence: Synthetic oligonucleotide
gacccaagtcttggattgaggaacaggcaatg

SEQ ID NO: 119700 - DNA, 32 bp, Artificial Sequence
  Description of Artificial Sequence: Synthetic oligonucleotide
acccaagtcttggattgaggaacaggcaatgg

SEQ ID NO: 119701 - DNA, 31 bp, Artificial Sequence
  Description of Artificial Sequence: Synthetic oligonucleotide
cccaagtcttggattgaggaacaggcaatgg

SEQ ID NO: 119702 - DNA, 31 bp, Artificial Sequence
  Description of Artificial Sequence: Synthetic oligonucleotide
ccaagtcttggattgaggaacaggcaatggg

SEQ ID NO: 119703 - DNA, 33 bp, Artificial Sequence
  Description of Artificial Sequence: Synthetic oligonucleotide
caagtcttggattgaggaacaggcaatgggatc

SEQ ID NO: 119704 - DNA, 36 bp, Artificial Sequence
  Description of Artificial Sequence: Synthetic oligonucleotide
aagtcttggattgaggaacaggcaatgggatcattc

SEQ ID NO: 119705 - DNA, 35 bp, Artificial Sequence
  Description of Artificial Sequence: Synthetic oligonucleotide
agtcttggattgaggaacaggcaatgggatcattc

SEQ ID NO: 119706 - DNA, 34 bp, Artificial Sequence
  Description of Artificial Sequence: Synthetic oligonucleotide
gtcttggattgaggaacaggcaatgggatcattc

SEQ ID NO: 119707 - DNA, 34 bp, Artificial Sequence
  Description of Artificial Sequence: Synthetic oligonucleotide
tcttggattgaggaacaggcaatgggatcattcc

SEQ ID NO: 119708 - DNA, 33 bp, Artificial Sequence
  Description of Artificial Sequence: Synthetic oligonucleotide
cttggattgaggaacaggcaatgggatcattcc

SEQ ID NO: 119709 - DNA, 34 bp, Artificial Sequence
  Description of Artificial Sequence: Synthetic oligonucleotide
ttggattgaggaacaggcaatgggatcattcctc

SEQ ID NO: 119710 - DNA, 33 bp, Artificial Sequence
  Description of Artificial Sequence: Synthetic oligonucleotide
tggattgaggaacaggcaatgggatcattcctc

SEQ ID NO: 119711 - DNA, 32 bp, Artificial Sequence
  Description of Artificial Sequence: Synthetic oligonucleotide
ggattgaggaacaggcaatgggatcattcctc

SEQ ID NO: 119712 - DNA, 33 bp, Artificial Sequence
  Description of Artificial Sequence: Synthetic oligonucleotide
gattgaggaacaggcaatgggatcattcctcag

SEQ ID NO: 119713 - DNA, 34 bp, Artificial Sequence
  Description of Artificial Sequence: Synthetic oligonucleotide
attgaggaacaggcaatgggatcattcctcagtg

SEQ ID NO: 119714 - DNA, 33 bp, Artificial Sequence
  Description of Artificial Sequence: Synthetic oligonucleotide
ttgaggaacaggcaatgggatcattcctcagtg

SEQ ID NO: 119715 - DNA, 32 bp, Artificial Sequence
  Description of Artificial Sequence: Synthetic oligonucleotide
tgaggaacaggcaatgggatcattcctcagtg

SEQ ID NO: 119716 - DNA, 31 bp, Artificial Sequence
  Description of Artificial Sequence: Synthetic oligonucleotide
gaggaacaggcaatgggatcattcctcagtg

SEQ ID NO: 119717 - DNA, 32 bp, Artificial Sequence
  Description of Artificial Sequence: Synthetic oligonucleotide
aggaacaggcaatgggatcattcctcagtgtg

SEQ ID NO: 119718 - DNA, 31 bp, Artificial Sequence
  Description of Artificial Sequence: Synthetic oligonucleotide
ggaacaggcaatgggatcattcctcagtgtg

SEQ ID NO: 119719 - DNA, 31 bp, Artificial Sequence
  Description of Artificial Sequence: Synthetic oligonucleotide
gaacaggcaatgggatcattcctcagtgtgg

SEQ ID NO: 119720 - DNA, 31 bp, Artificial Sequence
  Description of Artificial Sequence: Synthetic oligonucleotide
aacaggcaatgggatcattcctcagtgtggc

SEQ ID NO: 119721 - DNA, 30 bp, Artificial Sequence
  Description of Artificial Sequence: Synthetic oligonucleotide
acaggcaatgggatcattcctcagtgtggc

SEQ ID NO: 119722 - DNA, 29 bp, Artificial Sequence
  Description of Artificial Sequence: Synthetic oligonucleotide
caggcaatgggatcattcctcagtgtggc

SEQ ID NO: 119723 - DNA, 29 bp, Artificial Sequence
  Description of Artificial Sequence: Synthetic oligonucleotide
aggcaatgggatcattcctcagtgtggcc

SEQ ID NO: 119724 - DNA, 28 bp, Artificial Sequence
  Description of Artificial Sequence: Synthetic oligonucleotide
ggcaatgggatcattcctcagtgtggcc

SEQ ID NO: 119725 - DNA, 31 bp, Artificial Sequence
  Description of Artificial Sequence: Synthetic oligonucleotide
gcaatgggatcattcctcagtgtggccaaag

SEQ ID NO: 119726 - DNA, 31 bp, Artificial Sequence
  Description of Artificial Sequence: Synthetic oligonucleotide
caatgggatcattcctcagtgtggccaaagg

SEQ ID NO: 119727 - DNA, 33 bp, Artificial Sequence
  Description of Artificial Sequence: Synthetic oligonucleotide
aatgggatcattcctcagtgtggccaaaggatc

SEQ ID NO: 119728 - DNA, 32 bp, Artificial Sequence
  Description of Artificial Sequence: Synthetic oligonucleotide
atgggatcattcctcagtgtggccaaaggatc

SEQ ID NO: 119729 - DNA, 31 bp, Artificial Sequence
  Description of Artificial Sequence: Synthetic oligonucleotide
tgggatcattcctcagtgtggccaaaggatc

SEQ ID NO: 119730 - DNA, 30 bp, Artificial Sequence
  Description of Artificial Sequence: Synthetic oligonucleotide
gggatcattcctcagtgtggccaaaggatc

SEQ ID NO: 119731 - DNA, 31 bp, Artificial Sequence
  Description of Artificial Sequence: Synthetic oligonucleotide
ggatcattcctcagtgtggccaaaggatctg

SEQ ID NO: 119732 - DNA, 32 bp, Artificial Sequence
  Description of Artificial Sequence: Synthetic oligonucleotide
gatcattcctcagtgtggccaaaggatctgac

SEQ ID NO: 119733 - DNA, 32 bp, Artificial Sequence
  Description of Artificial Sequence: Synthetic oligonucleotide
atcattcctcagtgtggccaaaggatctgacg

SEQ ID NO: 119734 - DNA, 31 bp, Artificial Sequence
  Description of Artificial Sequence: Synthetic oligonucleotide
tcattcctcagtgtggccaaaggatctgacg

SEQ ID NO: 119735 - DNA, 30 bp, Artificial Sequence
  Description of Artificial Sequence: Synthetic oligonucleotide
cattcctcagtgtggccaaaggatctgacg

SEQ ID NO: 119736 - DNA, 31 bp, Artificial Sequence
  Description of Artificial Sequence: Synthetic oligonucleotide
attcctcagtgtggccaaaggatctgacgag

SEQ ID NO: 119737 - DNA, 30 bp, Artificial Sequence
  Description of Artificial Sequence: Synthetic oligonucleotide
ttcctcagtgtggccaaaggatctgacgag

SEQ ID NO: 119738 - DNA, 29 bp, Artificial Sequence
  Description of Artificial Sequence: Synthetic oligonucleotide
tcctcagtgtggccaaaggatctgacgag

SEQ ID NO: 119739 - DNA, 28 bp, Artificial Sequence
  Description of Artificial Sequence: Synthetic oligonucleotide
cctcagtgtggccaaaggatctgacgag

SEQ ID NO: 119740 - DNA, 28 bp, Artificial Sequence
  Description of Artificial Sequence: Synthetic oligonucleotide
ctcagtgtggccaaaggatctgacgagc

SEQ ID NO: 119741 - DNA, 28 bp, Artificial Sequence
  Description of Artificial Sequence: Synthetic oligonucleotide
tcagtgtggccaaaggatctgacgagcc

SEQ ID NO: 119742 - DNA, 27 bp, Artificial Sequence
  Description of Artificial Sequence: Synthetic oligonucleotide
cagtgtggccaaaggatctgacgagcc

SEQ ID NO: 119743 - DNA, 27 bp, Artificial Sequence
  Description of Artificial Sequence: Synthetic oligonucleotide
agtgtggccaaaggatctgacgagccc

SEQ ID NO: 119744 - DNA, 26 bp, Artificial Sequence
  Description of Artificial Sequence: Synthetic oligonucleotide
gtgtggccaaaggatctgacgagccc

SEQ ID NO: 119745 - DNA, 26 bp, Artificial Sequence
  Description of Artificial Sequence: Synthetic oligonucleotide
tgtggccaaaggatctgacgagcccc

SEQ ID NO: 119746 - DNA, 25 bp, Artificial Sequence
  Description of Artificial Sequence: Synthetic oligonucleotide
gtggccaaaggatctgacgagcccc

SEQ ID NO: 119747 - DNA, 26 bp, Artificial Sequence
  Description of Artificial Sequence: Synthetic oligonucleotide
tggccaaaggatctgacgagccccca

SEQ ID NO: 119748 - DNA, 25 bp, Artificial Sequence
  Description of Artificial Sequence: Synthetic oligonucleotide
ggccaaaggatctgacgagccccca

SEQ ID NO: 119749 - DNA, 26 bp, Artificial Sequence
  Description of Artificial Sequence: Synthetic oligonucleotide
gccaaaggatctgacgagcccccagt

SEQ ID NO: 119750 - DNA, 27 bp, Artificial Sequence
  Description of Artificial Sequence: Synthetic oligonucleotide
ccaaaggatctgacgagcccccagtct

SEQ ID NO: 119751 - DNA, 28 bp, Artificial Sequence
  Description of Artificial Sequence: Synthetic oligonucleotide
caaaggatctgacgagcccccagtcttc

SEQ ID NO: 119752 - DNA, 30 bp, Artificial Sequence
  Description of Artificial Sequence: Synthetic oligonucleotide
aaaggatctgacgagcccccagtcttcttg

SEQ ID NO: 119753 - DNA, 29 bp, Artificial Sequence
  Description of Artificial Sequence: Synthetic oligonucleotide
aaggatctgacgagcccccagtcttcttg

SEQ ID NO: 119754 - DNA, 28 bp, Artificial Sequence
  Description of Artificial Sequence: Synthetic oligonucleotide
aggatctgacgagcccccagtcttcttg

SEQ ID NO: 119755 - DNA, 27 bp, Artificial Sequence
  Description of Artificial Sequence: Synthetic oligonucleotide
ggatctgacgagcccccagtcttcttg

SEQ ID NO: 119756 - DNA, 27 bp, Artificial Sequence
  Description of Artificial Sequence: Synthetic oligonucleotide
gatctgacgagcccccagtcttcttgg

SEQ ID NO: 119757 - DNA, 32 bp, Artificial Sequence
  Description of Artificial Sequence: Synthetic oligonucleotide
atctgacgagcccccagtcttcttggaaattc

SEQ ID NO: 119758 - DNA, 31 bp, Artificial Sequence
  Description of Artificial Sequence: Synthetic oligonucleotide
tctgacgagcccccagtcttcttggaaattc

SEQ ID NO: 119759 - DNA, 30 bp, Artificial Sequence
  Description of Artificial Sequence: Synthetic oligonucleotide
ctgacgagcccccagtcttcttggaaattc

SEQ ID NO: 119760 - DNA, 31 bp, Artificial Sequence
  Description of Artificial Sequence: Synthetic oligonucleotide
tgacgagcccccagtcttcttggaaattcac

SEQ ID NO: 119761 - DNA, 30 bp, Artificial Sequence
  Description of Artificial Sequence: Synthetic oligonucleotide
gacgagcccccagtcttcttggaaattcac

SEQ ID NO: 119762 - DNA, 32 bp, Artificial Sequence
  Description of Artificial Sequence: Synthetic oligonucleotide
acgagcccccagtcttcttggaaattcactac

SEQ ID NO: 119763 - DNA, 31 bp, Artificial Sequence
  Description of Artificial Sequence: Synthetic oligonucleotide
cgagcccccagtcttcttggaaattcactac

SEQ ID NO: 119764 - DNA, 34 bp, Artificial Sequence
  Description of Artificial Sequence: Synthetic oligonucleotide
gagcccccagtcttcttggaaattcactacaaag

SEQ ID NO: 119765 - DNA, 34 bp, Artificial Sequence
  Description of Artificial Sequence: Synthetic oligonucleotide
agcccccagtcttcttggaaattcactacaaagg

SEQ ID NO: 119766 - DNA, 33 bp, Artificial Sequence
  Description of Artificial Sequence: Synthetic oligonucleotide
gcccccagtcttcttggaaattcactacaaagg

SEQ ID NO: 119767 - DNA, 33 bp, Artificial Sequence
  Description of Artificial Sequence: Synthetic oligonucleotide
cccccagtcttcttggaaattcactacaaaggc

SEQ ID NO: 119768 - DNA, 34 bp, Artificial Sequence
  Description of Artificial Sequence: Synthetic oligonucleotide
ccccagtcttcttggaaattcactacaaaggcag

SEQ ID NO: 119769 - DNA, 34 bp, Artificial Sequence
  Description of Artificial Sequence: Synthetic oligonucleotide
cccagtcttcttggaaattcactacaaaggcagc

SEQ ID NO: 119770 - DNA, 34 bp, Artificial Sequence
  Description of Artificial Sequence: Synthetic oligonucleotide
ccagtcttcttggaaattcactacaaaggcagcc

SEQ ID NO: 119771 - DNA, 34 bp, Artificial Sequence
  Description of Artificial Sequence: Synthetic oligonucleotide
cagtcttcttggaaattcactacaaaggcagccc

SEQ ID NO: 119772 - DNA, 34 bp, Artificial Sequence
  Description of Artificial Sequence: Synthetic oligonucleotide
agtcttcttggaaattcactacaaaggcagcccc

SEQ ID NO: 119773 - DNA, 33 bp, Artificial Sequence
  Description of Artificial Sequence: Synthetic oligonucleotide
gtcttcttggaaattcactacaaaggcagcccc

SEQ ID NO: 119774 - DNA, 36 bp, Artificial Sequence
  Description of Artificial Sequence: Synthetic oligonucleotide
tcttcttggaaattcactacaaaggcagccccaatg

SEQ ID NO: 119775 - DNA, 35 bp, Artificial Sequence
  Description of Artificial Sequence: Synthetic oligonucleotide
cttcttggaaattcactacaaaggcagccccaatg

SEQ ID NO: 119776 - DNA, 35 bp, Artificial Sequence
  Description of Artificial Sequence: Synthetic oligonucleotide
ttcttggaaattcactacaaaggcagccccaatgc

SEQ ID NO: 119777 - DNA, 34 bp, Artificial Sequence
  Description of Artificial Sequence: Synthetic oligonucleotide
tcttggaaattcactacaaaggcagccccaatgc

SEQ ID NO: 119778 - DNA, 33 bp, Artificial Sequence
  Description of Artificial Sequence: Synthetic oligonucleotide
cttggaaattcactacaaaggcagccccaatgc

SEQ ID NO: 119779 - DNA, 36 bp, Artificial Sequence
  Description of Artificial Sequence: Synthetic oligonucleotide
ttggaaattcactacaaaggcagccccaatgcaaac

SEQ ID NO: 119780 - DNA, 35 bp, Artificial Sequence
  Description of Artificial Sequence: Synthetic oligonucleotide
tggaaattcactacaaaggcagccccaatgcaaac

SEQ ID NO: 119781 - DNA, 34 bp, Artificial Sequence
  Description of Artificial Sequence: Synthetic oligonucleotide
ggaaattcactacaaaggcagccccaatgcaaac

SEQ ID NO: 119782 - DNA, 34 bp, Artificial Sequence
  Description of Artificial Sequence: Synthetic oligonucleotide
gaaattcactacaaaggcagccccaatgcaaacg

SEQ ID NO: 119783 - DNA, 36 bp, Artificial Sequence
  Description of Artificial Sequence: Synthetic oligonucleotide
aaattcactacaaaggcagccccaatgcaaacgaac

SEQ ID NO: 119784 - DNA, 35 bp, Artificial Sequence
  Description of Artificial Sequence: Synthetic oligonucleotide
aattcactacaaaggcagccccaatgcaaacgaac

SEQ ID NO: 119785 - DNA, 34 bp, Artificial Sequence
  Description of Artificial Sequence: Synthetic oligonucleotide
attcactacaaaggcagccccaatgcaaacgaac

SEQ ID NO: 119786 - DNA, 33 bp, Artificial Sequence
  Description of Artificial Sequence: Synthetic oligonucleotide
ttcactacaaaggcagccccaatgcaaacgaac

SEQ ID NO: 119787 - DNA, 32 bp, Artificial Sequence
  Description of Artificial Sequence: Synthetic oligonucleotide
tcactacaaaggcagccccaatgcaaacgaac

SEQ ID NO: 119788 - DNA, 31 bp, Artificial Sequence
  Description of Artificial Sequence: Synthetic oligonucleotide
cactacaaaggcagccccaatgcaaacgaac

SEQ ID NO: 119789 - DNA, 31 bp, Artificial Sequence
  Description of Artificial Sequence: Synthetic oligonucleotide
actacaaaggcagccccaatgcaaacgaacc

SEQ ID NO: 119790 - DNA, 30 bp, Artificial Sequence
  Description of Artificial Sequence: Synthetic oligonucleotide
ctacaaaggcagccccaatgcaaacgaacc

SEQ ID NO: 119791 - DNA, 31 bp, Artificial Sequence
  Description of Artificial Sequence: Synthetic oligonucleotide
tacaaaggcagccccaatgcaaacgaaccac

SEQ ID NO: 119792 - DNA, 30 bp, Artificial Sequence
  Description of Artificial Sequence: Synthetic oligonucleotide
acaaaggcagccccaatgcaaacgaaccac

SEQ ID NO: 119793 - DNA, 29 bp, Artificial Sequence
  Description of Artificial Sequence: Synthetic oligonucleotide
caaaggcagccccaatgcaaacgaaccac

SEQ ID NO: 119794 - DNA, 29 bp, Artificial Sequence
  Description of Artificial Sequence: Synthetic oligonucleotide
aaaggcagccccaatgcaaacgaaccacc

SEQ ID NO: 119795 - DNA, 28 bp, Artificial Sequence
  Description of Artificial Sequence: Synthetic oligonucleotide
aaggcagccccaatgcaaacgaaccacc

SEQ ID NO: 119796 - DNA, 27 bp, Artificial Sequence
  Description of Artificial Sequence: Synthetic oligonucleotide
aggcagccccaatgcaaacgaaccacc

SEQ ID NO: 119797 - DNA, 26 bp, Artificial Sequence
  Description of Artificial Sequence: Synthetic oligonucleotide
ggcagccccaatgcaaacgaaccacc

SEQ ID NO: 119798 - DNA, 26 bp, Artificial Sequence
  Description of Artificial Sequence: Synthetic oligonucleotide
gcagccccaatgcaaacgaaccaccc

SEQ ID NO: 119799 - DNA, 27 bp, Artificial Sequence
  Description of Artificial Sequence: Synthetic oligonucleotide
cagccccaatgcaaacgaaccacccct

SEQ ID NO: 119800 - DNA, 27 bp, Artificial Sequence
  Description of Artificial Sequence: Synthetic oligonucleotide
agccccaatgcaaacgaaccacccctg

SEQ ID NO: 119801 - DNA, 26 bp, Artificial Sequence
  Description of Artificial Sequence: Synthetic oligonucleotide
gccccaatgcaaacgaaccacccctg

SEQ ID NO: 119802 - DNA, 27 bp, Artificial Sequence
  Description of Artificial Sequence: Synthetic oligonucleotide
ccccaatgcaaacgaaccacccctggt

SEQ ID NO: 119803 - DNA, 27 bp, Artificial Sequence
  Description of Artificial Sequence: Synthetic oligonucleotide
cccaatgcaaacgaaccacccctggtg

SEQ ID NO: 119804 - DNA, 30 bp, Artificial Sequence
  Description of Artificial Sequence: Synthetic oligonucleotide
ccaatgcaaacgaaccacccctggtgtttg

SEQ ID NO: 119805 - DNA, 32 bp, Artificial Sequence
  Description of Artificial Sequence: Synthetic oligonucleotide
caatgcaaacgaaccacccctggtgtttgttg

SEQ ID NO: 119806 - DNA, 32 bp, Artificial Sequence
  Description of Artificial Sequence: Synthetic oligonucleotide
aatgcaaacgaaccacccctggtgtttgttgg

SEQ ID NO: 119807 - DNA, 31 bp, Artificial Sequence
  Description of Artificial Sequence: Synthetic oligonucleotide
atgcaaacgaaccacccctggtgtttgttgg

SEQ ID NO: 119808 - DNA, 30 bp, Artificial Sequence
  Description of Artificial Sequence: Synthetic oligonucleotide
tgcaaacgaaccacccctggtgtttgttgg

SEQ ID NO: 119809 - DNA, 29 bp, Artificial Sequence
  Description of Artificial Sequence: Synthetic oligonucleotide
gcaaacgaaccacccctggtgtttgttgg

SEQ ID NO: 119810 - DNA, 29 bp, Artificial Sequence
  Description of Artificial Sequence: Synthetic oligonucleotide
caaacgaaccacccctggtgtttgttggg

SEQ ID NO: 119811 - DNA, 32 bp, Artificial Sequence
  Description of Artificial Sequence: Synthetic oligonucleotide
aaacgaaccacccctggtgtttgttgggaaag

SEQ ID NO: 119812 - DNA, 31 bp, Artificial Sequence
  Description of Artificial Sequence: Synthetic oligonucleotide
aacgaaccacccctggtgtttgttgggaaag

SEQ ID NO: 119813 - DNA, 30 bp, Artificial Sequence
  Description of Artificial Sequence: Synthetic oligonucleotide
acgaaccacccctggtgtttgttgggaaag

SEQ ID NO: 119814 - DNA, 29 bp, Artificial Sequence
  Description of Artificial Sequence: Synthetic oligonucleotide
cgaaccacccctggtgtttgttgggaaag

SEQ ID NO: 119815 - DNA, 29 bp, Artificial Sequence
  Description of Artificial Sequence: Synthetic oligonucleotide
gaaccacccctggtgtttgttgggaaagg

SEQ ID NO: 119816 - DNA, 34 bp, Artificial Sequence
  Description of Artificial Sequence: Synthetic oligonucleotide
aaccacccctggtgtttgttgggaaaggaattac

SEQ ID NO: 119817 - DNA, 33 bp, Artificial Sequence
  Description of Artificial Sequence: Synthetic oligonucleotide
accacccctggtgtttgttgggaaaggaattac

SEQ ID NO: 119818 - DNA, 32 bp, Artificial Sequence
  Description of Artificial Sequence: Synthetic oligonucleotide
ccacccctggtgtttgttgggaaaggaattac

SEQ ID NO: 119819 - DNA, 32 bp, Artificial Sequence
  Description of Artificial Sequence: Synthetic oligonucleotide
cacccctggtgtttgttgggaaaggaattacc

SEQ ID NO: 119820 - DNA, 35 bp, Artificial Sequence
  Description of Artificial Sequence: Synthetic oligonucleotide
acccctggtgtttgttgggaaaggaattacctttg

SEQ ID NO: 119821 - DNA, 34 bp, Artificial Sequence
  Description of Artificial Sequence: Synthetic oligonucleotide
cccctggtgtttgttgggaaaggaattacctttg

SEQ ID NO: 119822 - DNA, 35 bp, Artificial Sequence
  Description of Artificial Sequence: Synthetic oligonucleotide
ccctggtgtttgttgggaaaggaattacctttgac

SEQ ID NO: 119823 - DNA, 36 bp, Artificial Sequence
  Description of Artificial Sequence: Synthetic oligonucleotide
cctggtgtttgttgggaaaggaattacctttgacag

SEQ ID NO: 119824 - DNA, 37 bp, Artificial Sequence
  Description of Artificial Sequence: Synthetic oligonucleotide
ctggtgtttgttgggaaaggaattacctttgacagtg

SEQ ID NO: 119825 - DNA, 37 bp, Artificial Sequence
  Description of Artificial Sequence: Synthetic oligonucleotide
tggtgtttgttgggaaaggaattacctttgacagtgg

SEQ ID NO: 119826 - DNA, 36 bp, Artificial Sequence
  Description of Artificial Sequence: Synthetic oligonucleotide
ggtgtttgttgggaaaggaattacctttgacagtgg

SEQ ID NO: 119827 - DNA, 37 bp, Artificial Sequence
  Description of Artificial Sequence: Synthetic oligonucleotide
gtgtttgttgggaaaggaattacctttgacagtggtg

SEQ ID NO: 119828 - DNA, 37 bp, Artificial Sequence
  Description of Artificial Sequence: Synthetic oligonucleotide
tgtttgttgggaaaggaattacctttgacagtggtgg

SEQ ID NO: 119829 - DNA, 36 bp, Artificial Sequence
  Description of Artificial Sequence: Synthetic oligonucleotide
gtttgttgggaaaggaattacctttgacagtggtgg

SEQ ID NO: 119830 - DNA, 39 bp, Artificial Sequence
  Description of Artificial Sequence: Synthetic oligonucleotide
tttgttgggaaaggaattacctttgacagtggtggtatc

SEQ ID NO: 119831 - DNA, 38 bp, Artificial Sequence
  Description of Artificial Sequence: Synthetic oligonucleotide
ttgttgggaaaggaattacctttgacagtggtggtatc

SEQ ID NO: 119832 - DNA, 37 bp, Artificial Sequence
  Description of Artificial Sequence: Synthetic oligonucleotide
tgttgggaaaggaattacctttgacagtggtggtatc

SEQ ID NO: 119833 - DNA, 36 bp, Artificial Sequence
  Description of Artificial Sequence: Synthetic oligonucleotide
gttgggaaaggaattacctttgacagtggtggtatc

SEQ ID NO: 119834 - DNA, 37 bp, Artificial Sequence
  Description of Artificial Sequence: Synthetic oligonucleotide
ttgggaaaggaattacctttgacagtggtggtatctc

SEQ ID NO: 119835 - DNA, 36 bp, Artificial Sequence
  Description of Artificial Sequence: Synthetic oligonucleotide
tgggaaaggaattacctttgacagtggtggtatctc

SEQ ID NO: 119836 - DNA, 35 bp, Artificial Sequence
  Description of Artificial Sequence: Synthetic oligonucleotide
gggaaaggaattacctttgacagtggtggtatctc

SEQ ID NO: 119837 - DNA, 35 bp, Artificial Sequence
  Description of Artificial Sequence: Synthetic oligonucleotide
ggaaaggaattacctttgacagtggtggtatctcc

SEQ ID NO: 119838 - DNA, 37 bp, Artificial Sequence
  Description of Artificial Sequence: Synthetic oligonucleotide
gaaaggaattacctttgacagtggtggtatctccatc

SEQ ID NO: 119839 - DNA, 39 bp, Artificial Sequence
  Description of Artificial Sequence: Synthetic oligonucleotide
aaaggaattacctttgacagtggtggtatctccatcaag

SEQ ID NO: 119840 - DNA, 38 bp, Artificial Sequence
  Description of Artificial Sequence: Synthetic oligonucleotide
aaggaattacctttgacagtggtggtatctccatcaag

SEQ ID NO: 119841 - DNA, 37 bp, Artificial Sequence
  Description of Artificial Sequence: Synthetic oligonucleotide
aggaattacctttgacagtggtggtatctccatcaag

SEQ ID NO: 119842 - DNA, 36 bp, Artificial Sequence
  Description of Artificial Sequence: Synthetic oligonucleotide
ggaattacctttgacagtggtggtatctccatcaag

SEQ ID NO: 119843 - DNA, 36 bp, Artificial Sequence
  Description of Artificial Sequence: Synthetic oligonucleotide
gaattacctttgacagtggtggtatctccatcaagg

SEQ ID NO: 119844 - DNA, 36 bp, Artificial Sequence
  Description of Artificial Sequence: Synthetic oligonucleotide
aattacctttgacagtggtggtatctccatcaaggc

SEQ ID NO: 119845 - DNA, 35 bp, Artificial Sequence
  Description of Artificial Sequence: Synthetic oligonucleotide
attacctttgacagtggtggtatctccatcaaggc

SEQ ID NO: 119846 - DNA, 34 bp, Artificial Sequence
  Description of Artificial Sequence: Synthetic oligonucleotide
ttacctttgacagtggtggtatctccatcaaggc

SEQ ID NO: 119847 - DNA, 33 bp, Artificial Sequence
  Description of Artificial Sequence: Synthetic oligonucleotide
tacctttgacagtggtggtatctccatcaaggc

SEQ ID NO: 119848 - DNA, 32 bp, Artificial Sequence
  Description of Artificial Sequence: Synthetic oligonucleotide
acctttgacagtggtggtatctccatcaaggc

SEQ ID NO: 119849 - DNA, 31 bp, Artificial Sequence
  Description of Artificial Sequence: Synthetic oligonucleotide
cctttgacagtggtggtatctccatcaaggc

SEQ ID NO: 119850 - DNA, 33 bp, Artificial Sequence
  Description of Artificial Sequence: Synthetic oligonucleotide
ctttgacagtggtggtatctccatcaaggcttc

SEQ ID NO: 119851 - DNA, 34 bp, Artificial Sequence
  Description of Artificial Sequence: Synthetic oligonucleotide
tttgacagtggtggtatctccatcaaggcttctg

SEQ ID NO: 119852 - DNA, 33 bp, Artificial Sequence
  Description of Artificial Sequence: Synthetic oligonucleotide
ttgacagtggtggtatctccatcaaggcttctg

SEQ ID NO: 119853 - DNA, 32 bp, Artificial Sequence
  Description of Artificial Sequence: Synthetic oligonucleotide
tgacagtggtggtatctccatcaaggcttctg

SEQ ID NO: 119854 - DNA, 31 bp, Artificial Sequence
  Description of Artificial Sequence: Synthetic oligonucleotide
gacagtggtggtatctccatcaaggcttctg

SEQ ID NO: 119855 - DNA, 31 bp, Artificial Sequence
  Description of Artificial Sequence: Synthetic oligonucleotide
acagtggtggtatctccatcaaggcttctgc

SEQ ID NO: 119856 - DNA, 30 bp, Artificial Sequence
  Description of Artificial Sequence: Synthetic oligonucleotide
cagtggtggtatctccatcaaggcttctgc

SEQ ID NO: 119857 - DNA, 36 bp, Artificial Sequence
  Description of Artificial Sequence: Synthetic oligonucleotide
agtggtggtatctccatcaaggcttctgcaaatatg

SEQ ID NO: 119858 - DNA, 35 bp, Artificial Sequence
  Description of Artificial Sequence: Synthetic oligonucleotide
gtggtggtatctccatcaaggcttctgcaaatatg

SEQ ID NO: 119859 - DNA, 35 bp, Artificial Sequence
  Description of Artificial Sequence: Synthetic oligonucleotide
tggtggtatctccatcaaggcttctgcaaatatgg

SEQ ID NO: 119860 - DNA, 34 bp, Artificial Sequence
  Description of Artificial Sequence: Synthetic oligonucleotide
ggtggtatctccatcaaggcttctgcaaatatgg

SEQ ID NO: 119861 - DNA, 35 bp, Artificial Sequence
  Description of Artificial Sequence: Synthetic oligonucleotide
gtggtatctccatcaaggcttctgcaaatatggac

SEQ ID NO: 119862 - DNA, 35 bp, Artificial Sequence
  Description of Artificial Sequence: Synthetic oligonucleotide
tggtatctccatcaaggcttctgcaaatatggacc

SEQ ID NO: 119863 - DNA, 34 bp, Artificial Sequence
  Description of Artificial Sequence: Synthetic oligonucleotide
ggtatctccatcaaggcttctgcaaatatggacc

SEQ ID NO: 119864 - DNA, 35 bp, Artificial Sequence
  Description of Artificial Sequence: Synthetic oligonucleotide
gtatctccatcaaggcttctgcaaatatggacctc

SEQ ID NO: 119865 - DNA, 37 bp, Artificial Sequence
  Description of Artificial Sequence: Synthetic oligonucleotide
tatctccatcaaggcttctgcaaatatggacctcatg

SEQ ID NO: 119866 - DNA, 36 bp, Artificial Sequence
  Description of Artificial Sequence: Synthetic oligonucleotide
atctccatcaaggcttctgcaaatatggacctcatg

SEQ ID NO: 119867 - DNA, 35 bp, Artificial Sequence
  Description of Artificial Sequence: Synthetic oligonucleotide
tctccatcaaggcttctgcaaatatggacctcatg

SEQ ID NO: 119868 - DNA, 34 bp, Artificial Sequence
  Description of Artificial Sequence: Synthetic oligonucleotide
ctccatcaaggcttctgcaaatatggacctcatg

SEQ ID NO: 119869 - DNA, 35 bp, Artificial Sequence
  Description of Artificial Sequence: Synthetic oligonucleotide
tccatcaaggcttctgcaaatatggacctcatgag

SEQ ID NO: 119870 - DNA, 34 bp, Artificial Sequence
  Description of Artificial Sequence: Synthetic oligonucleotide
ccatcaaggcttctgcaaatatggacctcatgag

SEQ ID NO: 119871 - DNA, 34 bp, Artificial Sequence
  Description of Artificial Sequence: Synthetic oligonucleotide
catcaaggcttctgcaaatatggacctcatgagg

SEQ ID NO: 119872 - DNA, 34 bp, Artificial Sequence
  Description of Artificial Sequence: Synthetic oligonucleotide
atcaaggcttctgcaaatatggacctcatgaggg

SEQ ID NO: 119873 - DNA, 33 bp, Artificial Sequence
  Description of Artificial Sequence: Synthetic oligonucleotide
tcaaggcttctgcaaatatggacctcatgaggg

SEQ ID NO: 119874 - DNA, 32 bp, Artificial Sequence
  Description of Artificial Sequence: Synthetic oligonucleotide
caaggcttctgcaaatatggacctcatgaggg

SEQ ID NO: 119875 - DNA, 32 bp, Artificial Sequence
  Description of Artificial Sequence: Synthetic oligonucleotide
aaggcttctgcaaatatggacctcatgagggc

SEQ ID NO: 119876 - DNA, 31 bp, Artificial Sequence
  Description of Artificial Sequence: Synthetic oligonucleotide
aggcttctgcaaatatggacctcatgagggc

SEQ ID NO: 119877 - DNA, 30 bp, Artificial Sequence
  Description of Artificial Sequence: Synthetic oligonucleotide
ggcttctgcaaatatggacctcatgagggc

SEQ ID NO: 119878 - DNA, 31 bp, Artificial Sequence
  Description of Artificial Sequence: Synthetic oligonucleotide
gcttctgcaaatatggacctcatgagggctg

SEQ ID NO: 119879 - DNA, 32 bp, Artificial Sequence
  Description of Artificial Sequence: Synthetic oligonucleotide
cttctgcaaatatggacctcatgagggctgac

SEQ ID NO: 119880 - DNA, 34 bp, Artificial Sequence
  Description of Artificial Sequence: Synthetic oligonucleotide
ttctgcaaatatggacctcatgagggctgacatg

SEQ ID NO: 119881 - DNA, 33 bp, Artificial Sequence
  Description of Artificial Sequence: Synthetic oligonucleotide
tctgcaaatatggacctcatgagggctgacatg

SEQ ID NO: 119882 - DNA, 32 bp, Artificial Sequence
  Description of Artificial Sequence: Synthetic oligonucleotide
ctgcaaatatggacctcatgagggctgacatg

SEQ ID NO: 119883 - DNA, 32 bp, Artificial Sequence
  Description of Artificial Sequence: Synthetic oligonucleotide
tgcaaatatggacctcatgagggctgacatgg

SEQ ID NO: 119884 - DNA, 31 bp, Artificial Sequence
  Description of Artificial Sequence: Synthetic oligonucleotide
gcaaatatggacctcatgagggctgacatgg

SEQ ID NO: 119885 - DNA, 31 bp, Artificial Sequence
  Description of Artificial Sequence: Synthetic oligonucleotide
caaatatggacctcatgagggctgacatggg

SEQ ID NO: 119886 - DNA, 32 bp, Artificial Sequence
  Description of Artificial Sequence: Synthetic oligonucleotide
aaatatggacctcatgagggctgacatgggag

SEQ ID NO: 119887 - DNA, 31 bp, Artificial Sequence
  Description of Artificial Sequence: Synthetic oligonucleotide
aatatggacctcatgagggctgacatgggag

SEQ ID NO: 119888 - DNA, 30 bp, Artificial Sequence
  Description of Artificial Sequence: Synthetic oligonucleotide
atatggacctcatgagggctgacatgggag

SEQ ID NO: 119889 - DNA, 29 bp, Artificial Sequence
  Description of Artificial Sequence: Synthetic oligonucleotide
tatggacctcatgagggctgacatgggag

SEQ ID NO: 119890 - DNA, 28 bp, Artificial Sequence
  Description of Artificial Sequence: Synthetic oligonucleotide
atggacctcatgagggctgacatgggag

SEQ ID NO: 119891 - DNA, 27 bp, Artificial Sequence
  Description of Artificial Sequence: Synthetic oligonucleotide
tggacctcatgagggctgacatgggag

SEQ ID NO: 119892 - DNA, 26 bp, Artificial Sequence
  Description of Artificial Sequence: Synthetic oligonucleotide
ggacctcatgagggctgacatgggag

SEQ ID NO: 119893 - DNA, 27 bp, Artificial Sequence
  Description of Artificial Sequence: Synthetic oligonucleotide
gacctcatgagggctgacatgggagga

SEQ ID NO: 119894 - DNA, 27 bp, Artificial Sequence
  Description of Artificial Sequence: Synthetic oligonucleotide
acctcatgagggctgacatgggaggag

SEQ ID NO: 119895 - DNA, 26 bp, Artificial Sequence
  Description of Artificial Sequence: Synthetic oligonucleotide
cctcatgagggctgacatgggaggag

SEQ ID NO: 119896 - DNA, 27 bp, Artificial Sequence
  Description of Artificial Sequence: Synthetic oligonucleotide
ctcatgagggctgacatgggaggagct

SEQ ID NO: 119897 - DNA, 27 bp, Artificial Sequence
  Description of Artificial Sequence: Synthetic oligonucleotide
tcatgagggctgacatgggaggagctg

SEQ ID NO: 119898 - DNA, 26 bp, Artificial Sequence
  Description of Artificial Sequence: Synthetic oligonucleotide
catgagggctgacatgggaggagctg

SEQ ID NO: 119899 - DNA, 27 bp, Artificial Sequence
  Description of Artificial Sequence: Synthetic oligonucleotide
atgagggctgacatgggaggagctgca

SEQ ID NO: 119900 - DNA, 27 bp, Artificial Sequence
  Description of Artificial Sequence: Synthetic oligonucleotide
tgagggctgacatgggaggagctgcaa

SEQ ID NO: 119901 - DNA, 26 bp, Artificial Sequence
  Description of Artificial Sequence: Synthetic oligonucleotide
gagggctgacatgggaggagctgcaa

SEQ ID NO: 119902 - DNA, 27 bp, Artificial Sequence
  Description of Artificial Sequence: Synthetic oligonucleotide
agggctgacatgggaggagctgcaact

SEQ ID NO: 119903 - DNA, 27 bp, Artificial Sequence
  Description of Artificial Sequence: Synthetic oligonucleotide
gggctgacatgggaggagctgcaacta

SEQ ID NO: 119904 - DNA, 30 bp, Artificial Sequence
  Description of Artificial Sequence: Synthetic oligonucleotide
ggctgacatgggaggagctgcaactatatg

SEQ ID NO: 119905 - DNA, 30 bp, Artificial Sequence
  Description of Artificial Sequence: Synthetic oligonucleotide
gctgacatgggaggagctgcaactatatgc

SEQ ID NO: 119906 - DNA, 31 bp, Artificial Sequence
  Description of Artificial Sequence: Synthetic oligonucleotide
ctgacatgggaggagctgcaactatatgctc

SEQ ID NO: 119907 - DNA, 32 bp, Artificial Sequence
  Description of Artificial Sequence: Synthetic oligonucleotide
tgacatgggaggagctgcaactatatgctcag

SEQ ID NO: 119908 - DNA, 31 bp, Artificial Sequence
  Description of Artificial Sequence: Synthetic oligonucleotide
gacatgggaggagctgcaactatatgctcag

SEQ ID NO: 119909 - DNA, 31 bp, Artificial Sequence
  Description of Artificial Sequence: Synthetic oligonucleotide
acatgggaggagctgcaactatatgctcagc

SEQ ID NO: 119910 - DNA, 30 bp, Artificial Sequence
  Description of Artificial Sequence: Synthetic oligonucleotide
catgggaggagctgcaactatatgctcagc

SEQ ID NO: 119911 - DNA, 30 bp, Artificial Sequence
  Description of Artificial Sequence: Synthetic oligonucleotide
atgggaggagctgcaactatatgctcagcc

SEQ ID NO: 119912 - DNA, 29 bp, Artificial Sequence
  Description of Artificial Sequence: Synthetic oligonucleotide
tgggaggagctgcaactatatgctcagcc

SEQ ID NO: 119913 - DNA, 28 bp, Artificial Sequence
  Description of Artificial Sequence: Synthetic oligonucleotide
gggaggagctgcaactatatgctcagcc

SEQ ID NO: 119914 - DNA, 30 bp, Artificial Sequence
  Description of Artificial Sequence: Synthetic oligonucleotide
ggaggagctgcaactatatgctcagccatc

SEQ ID NO: 119915 - DNA, 30 bp, Artificial Sequence
  Description of Artificial Sequence: Synthetic oligonucleotide
gaggagctgcaactatatgctcagccatcg

SEQ ID NO: 119916 - DNA, 31 bp, Artificial Sequence
  Description of Artificial Sequence: Synthetic oligonucleotide
aggagctgcaactatatgctcagccatcgtg

SEQ ID NO: 119917 - DNA, 30 bp, Artificial Sequence
  Description of Artificial Sequence: Synthetic oligonucleotide
ggagctgcaactatatgctcagccatcgtg

SEQ ID NO: 119918 - DNA, 31 bp, Artificial Sequence
  Description of Artificial Sequence: Synthetic oligonucleotide
gagctgcaactatatgctcagccatcgtgtc

SEQ ID NO: 119919 - DNA, 32 bp, Artificial Sequence
  Description of Artificial Sequence: Synthetic oligonucleotide
agctgcaactatatgctcagccatcgtgtctg

SEQ ID NO: 119920 - DNA, 31 bp, Artificial Sequence
  Description of Artificial Sequence: Synthetic oligonucleotide
gctgcaactatatgctcagccatcgtgtctg

SEQ ID NO: 119921 - DNA, 31 bp, Artificial Sequence
  Description of Artificial Sequence: Synthetic oligonucleotide
ctgcaactatatgctcagccatcgtgtctgc

SEQ ID NO: 119922 - DNA, 32 bp, Artificial Sequence
  Description of Artificial Sequence: Synthetic oligonucleotide
tgcaactatatgctcagccatcgtgtctgctg

SEQ ID NO: 119923 - DNA, 31 bp, Artificial Sequence
  Description of Artificial Sequence: Synthetic oligonucleotide
gcaactatatgctcagccatcgtgtctgctg

SEQ ID NO: 119924 - DNA, 31 bp, Artificial Sequence
  Description of Artificial Sequence: Synthetic oligonucleotide
caactatatgctcagccatcgtgtctgctgc

SEQ ID NO: 119925 - DNA, 34 bp, Artificial Sequence
  Description of Artificial Sequence: Synthetic oligonucleotide
aactatatgctcagccatcgtgtctgctgcaaag

SEQ ID NO: 119926 - DNA, 33 bp, Artificial Sequence
  Description of Artificial Sequence: Synthetic oligonucleotide
actatatgctcagccatcgtgtctgctgcaaag

SEQ ID NO: 119927 - DNA, 32 bp, Artificial Sequence
  Description of Artificial Sequence: Synthetic oligonucleotide
ctatatgctcagccatcgtgtctgctgcaaag

SEQ ID NO: 119928 - DNA, 32 bp, Artificial Sequence
  Description of Artificial Sequence: Synthetic oligonucleotide
tatatgctcagccatcgtgtctgctgcaaagc

SEQ ID NO: 119929 - DNA, 31 bp, Artificial Sequence
  Description of Artificial Sequence: Synthetic oligonucleotide
atatgctcagccatcgtgtctgctgcaaagc

SEQ ID NO: 119930 - DNA, 30 bp, Artificial Sequence
  Description of Artificial Sequence: Synthetic oligonucleotide
tatgctcagccatcgtgtctgctgcaaagc

SEQ ID NO: 119931 - DNA, 29 bp, Artificial Sequence
  Description of Artificial Sequence: Synthetic oligonucleotide
atgctcagccatcgtgtctgctgcaaagc

SEQ ID NO: 119932 - DNA, 28 bp, Artificial Sequence
  Description of Artificial Sequence: Synthetic oligonucleotide
tgctcagccatcgtgtctgctgcaaagc

SEQ ID NO: 119933 - DNA, 27 bp, Artificial Sequence
  Description of Artificial Sequence: Synthetic oligonucleotide
gctcagccatcgtgtctgctgcaaagc

SEQ ID NO: 119934 - DNA, 34 bp, Artificial Sequence
  Description of Artificial Sequence: Synthetic oligonucleotide
ctcagccatcgtgtctgctgcaaagcttaatttg

SEQ ID NO: 119935 - DNA, 34 bp, Artificial Sequence
  Description of Artificial Sequence: Synthetic oligonucleotide
tcagccatcgtgtctgctgcaaagcttaatttgc

SEQ ID NO: 119936 - DNA, 33 bp, Artificial Sequence
  Description of Artificial Sequence: Synthetic oligonucleotide
cagccatcgtgtctgctgcaaagcttaatttgc

SEQ ID NO: 119937 - DNA, 33 bp, Artificial Sequence
  Description of Artificial Sequence: Synthetic oligonucleotide
agccatcgtgtctgctgcaaagcttaatttgcc

SEQ ID NO: 119938 - DNA, 32 bp, Artificial Sequence
  Description of Artificial Sequence: Synthetic oligonucleotide
gccatcgtgtctgctgcaaagcttaatttgcc

SEQ ID NO: 119939 - DNA, 32 bp, Artificial Sequence
  Description of Artificial Sequence: Synthetic oligonucleotide
ccatcgtgtctgctgcaaagcttaatttgccc

SEQ ID NO: 119940 - DNA, 44 bp, Artificial Sequence
  Description of Artificial Sequence: Synthetic oligonucleotide
catcgtgtctgctgcaaagcttaatttgcccattaatattatag

SEQ ID NO: 119941 - DNA, 44 bp, Artificial Sequence
  Description of Artificial Sequence: Synthetic oligonucleotide
atcgtgtctgctgcaaagcttaatttgcccattaatattatagg

SEQ ID NO: 119942 - DNA, 43 bp, Artificial Sequence
  Description of Artificial Sequence: Synthetic oligonucleotide
tcgtgtctgctgcaaagcttaatttgcccattaatattatagg

SEQ ID NO: 119943 - DNA, 42 bp, Artificial Sequence
  Description of Artificial Sequence: Synthetic oligonucleotide
cgtgtctgctgcaaagcttaatttgcccattaatattatagg

SEQ ID NO: 119944 - DNA, 43 bp, Artificial Sequence
  Description of Artificial Sequence: Synthetic oligonucleotide
gtgtctgctgcaaagcttaatttgcccattaatattataggtc

SEQ ID NO: 119945 - DNA, 44 bp, Artificial Sequence
  Description of Artificial Sequence: Synthetic oligonucleotide
tgtctgctgcaaagcttaatttgcccattaatattataggtctg

SEQ ID NO: 119946 - DNA, 43 bp, Artificial Sequence
  Description of Artificial Sequence: Synthetic oligonucleotide
gtctgctgcaaagcttaatttgcccattaatattataggtctg

SEQ ID NO: 119947 - DNA, 43 bp, Artificial Sequence
  Description of Artificial Sequence: Synthetic oligonucleotide
tctgctgcaaagcttaatttgcccattaatattataggtctgg

SEQ ID NO: 119948 - DNA, 42 bp, Artificial Sequence
  Description of Artificial Sequence: Synthetic oligonucleotide
ctgctgcaaagcttaatttgcccattaatattataggtctgg

SEQ ID NO: 119949 - DNA, 42 bp, Artificial Sequence
  Description of Artificial Sequence: Synthetic oligonucleotide
tgctgcaaagcttaatttgcccattaatattataggtctggc

SEQ ID NO: 119950 - DNA, 41 bp, Artificial Sequence
  Description of Artificial Sequence: Synthetic oligonucleotide
gctgcaaagcttaatttgcccattaatattataggtctggc

SEQ ID NO: 119951 - DNA, 41 bp, Artificial Sequence
  Description of Artificial Sequence: Synthetic oligonucleotide
ctgcaaagcttaatttgcccattaatattataggtctggcc

SEQ ID NO: 119952 - DNA, 41 bp, Artificial Sequence
  Description of Artificial Sequence: Synthetic oligonucleotide
tgcaaagcttaatttgcccattaatattataggtctggccc

SEQ ID NO: 119953 - DNA, 40 bp, Artificial Sequence
  Description of Artificial Sequence: Synthetic oligonucleotide
gcaaagcttaatttgcccattaatattataggtctggccc

SEQ ID NO: 119954 - DNA, 40 bp, Artificial Sequence
  Description of Artificial Sequence: Synthetic oligonucleotide
caaagcttaatttgcccattaatattataggtctggcccc

SEQ ID NO: 119955 - DNA, 41 bp, Artificial Sequence
  Description of Artificial Sequence: Synthetic oligonucleotide
aaagcttaatttgcccattaatattataggtctggcccctc

SEQ ID NO: 119956 - DNA, 40 bp, Artificial Sequence
  Description of Artificial Sequence: Synthetic oligonucleotide
aagcttaatttgcccattaatattataggtctggcccctc

SEQ ID NO: 119957 - DNA, 39 bp, Artificial Sequence
  Description of Artificial Sequence: Synthetic oligonucleotide
agcttaatttgcccattaatattataggtctggcccctc

SEQ ID NO: 119958 - DNA, 38 bp, Artificial Sequence
  Description of Artificial Sequence: Synthetic oligonucleotide
gcttaatttgcccattaatattataggtctggcccctc

SEQ ID NO: 119959 - DNA, 41 bp, Artificial Sequence
  Description of Artificial Sequence: Synthetic oligonucleotide
cttaatttgcccattaatattataggtctggcccctctttg

SEQ ID NO: 119960 - DNA, 42 bp, Artificial Sequence
  Description of Artificial Sequence: Synthetic oligonucleotide
ttaatttgcccattaatattataggtctggcccctctttgtg

SEQ ID NO: 119961 - DNA, 41 bp, Artificial Sequence
  Description of Artificial Sequence: Synthetic oligonucleotide
taatttgcccattaatattataggtctggcccctctttgtg

SEQ ID NO: 119962 - DNA, 40 bp, Artificial Sequence
  Description of Artificial Sequence: Synthetic oligonucleotide
aatttgcccattaatattataggtctggcccctctttgtg

SEQ ID NO: 119963 - DNA, 39 bp, Artificial Sequence
  Description of Artificial Sequence: Synthetic oligonucleotide
atttgcccattaatattataggtctggcccctctttgtg

SEQ ID NO: 119964 - DNA, 38 bp, Artificial Sequence
  Description of Artificial Sequence: Synthetic oligonucleotide
tttgcccattaatattataggtctggcccctctttgtg

SEQ ID NO: 119965 - DNA, 37 bp, Artificial Sequence
  Description of Artificial Sequence: Synthetic oligonucleotide
ttgcccattaatattataggtctggcccctctttgtg

SEQ ID NO: 119966 - DNA, 36 bp, Artificial Sequence
  Description of Artificial Sequence: Synthetic oligonucleotide
tgcccattaatattataggtctggcccctctttgtg

SEQ ID NO: 119967 - DNA, 35 bp, Artificial Sequence
  Description of Artificial Sequence: Synthetic oligonucleotide
gcccattaatattataggtctggcccctctttgtg

SEQ ID NO: 119968 - DNA, 42 bp, Artificial Sequence
  Description of Artificial Sequence: Synthetic oligonucleotide
cccattaatattataggtctggcccctctttgtgaaaatatg

SEQ ID NO: 119969 - DNA, 42 bp, Artificial Sequence
  Description of Artificial Sequence: Synthetic oligonucleotide
ccattaatattataggtctggcccctctttgtgaaaatatgc

SEQ ID NO: 119970 - DNA, 42 bp, Artificial Sequence
  Description of Artificial Sequence: Synthetic oligonucleotide
cattaatattataggtctggcccctctttgtgaaaatatgcc

SEQ ID NO: 119971 - DNA, 42 bp, Artificial Sequence
  Description of Artificial Sequence: Synthetic oligonucleotide
attaatattataggtctggcccctctttgtgaaaatatgccc

SEQ ID NO: 119972 - DNA, 41 bp, Artificial Sequence
  Description of Artificial Sequence: Synthetic oligonucleotide
ttaatattataggtctggcccctctttgtgaaaatatgccc

SEQ ID NO: 119973 - DNA, 40 bp, Artificial Sequence
  Description of Artificial Sequence: Synthetic oligonucleotide
taatattataggtctggcccctctttgtgaaaatatgccc

SEQ ID NO: 119974 - DNA, 39 bp, Artificial Sequence
  Description of Artificial Sequence: Synthetic oligonucleotide
aatattataggtctggcccctctttgtgaaaatatgccc

SEQ ID NO: 119975 - DNA, 38 bp, Artificial Sequence
  Description of Artificial Sequence: Synthetic oligonucleotide
atattataggtctggcccctctttgtgaaaatatgccc

SEQ ID NO: 119976 - DNA, 37 bp, Artificial Sequence
  Description of Artificial Sequence: Synthetic oligonucleotide
tattataggtctggcccctctttgtgaaaatatgccc

SEQ ID NO: 119977 - DNA, 36 bp, Artificial Sequence
  Description of Artificial Sequence: Synthetic oligonucleotide
attataggtctggcccctctttgtgaaaatatgccc

SEQ ID NO: 119978 - DNA, 35 bp, Artificial Sequence
  Description of Artificial Sequence: Synthetic oligonucleotide
ttataggtctggcccctctttgtgaaaatatgccc

SEQ ID NO: 119979 - DNA, 34 bp, Artificial Sequence
  Description of Artificial Sequence: Synthetic oligonucleotide
tataggtctggcccctctttgtgaaaatatgccc

SEQ ID NO: 119980 - DNA, 33 bp, Artificial Sequence
  Description of Artificial Sequence: Synthetic oligonucleotide
ataggtctggcccctctttgtgaaaatatgccc

SEQ ID NO: 119981 - DNA, 32 bp, Artificial Sequence
  Description of Artificial Sequence: Synthetic oligonucleotide
taggtctggcccctctttgtgaaaatatgccc

SEQ ID NO: 119982 - DNA, 31 bp, Artificial Sequence
  Description of Artificial Sequence: Synthetic oligonucleotide
aggtctggcccctctttgtgaaaatatgccc

SEQ ID NO: 119983 - DNA, 30 bp, Artificial Sequence
  Description of Artificial Sequence: Synthetic oligonucleotide
ggtctggcccctctttgtgaaaatatgccc

SEQ ID NO: 119984 - DNA, 31 bp, Artificial Sequence
  Description of Artificial Sequence: Synthetic oligonucleotide
gtctggcccctctttgtgaaaatatgcccag

SEQ ID NO: 119985 - DNA, 31 bp, Artificial Sequence
  Description of Artificial Sequence: Synthetic oligonucleotide
tctggcccctctttgtgaaaatatgcccagc

SEQ ID NO: 119986 - DNA, 30 bp, Artificial Sequence
  Description of Artificial Sequence: Synthetic oligonucleotide
ctggcccctctttgtgaaaatatgcccagc

SEQ ID NO: 119987 - DNA, 30 bp, Artificial Sequence
  Description of Artificial Sequence: Synthetic oligonucleotide
tggcccctctttgtgaaaatatgcccagcg

SEQ ID NO: 119988 - DNA, 29 bp, Artificial Sequence
  Description of Artificial Sequence: Synthetic oligonucleotide
ggcccctctttgtgaaaatatgcccagcg

SEQ ID NO: 119989 - DNA, 29 bp, Artificial Sequence
  Description of Artificial Sequence: Synthetic oligonucleotide
gcccctctttgtgaaaatatgcccagcgg

SEQ ID NO: 119990 - DNA, 29 bp, Artificial Sequence
  Description of Artificial Sequence: Synthetic oligonucleotide
cccctctttgtgaaaatatgcccagcggc

SEQ ID NO: 119991 - DNA, 31 bp, Artificial Sequence
  Description of Artificial Sequence: Synthetic oligonucleotide
ccctctttgtgaaaatatgcccagcggcaag

SEQ ID NO: 119992 - DNA, 31 bp, Artificial Sequence
  Description of Artificial Sequence: Synthetic oligonucleotide
cctctttgtgaaaatatgcccagcggcaagg

SEQ ID NO: 119993 - DNA, 31 bp, Artificial Sequence
  Description of Artificial Sequence: Synthetic oligonucleotide
ctctttgtgaaaatatgcccagcggcaaggc

SEQ ID NO: 119994 - DNA, 31 bp, Artificial Sequence
  Description of Artificial Sequence: Synthetic oligonucleotide
tctttgtgaaaatatgcccagcggcaaggcc

SEQ ID NO: 119995 - DNA, 30 bp, Artificial Sequence
  Description of Artificial Sequence: Synthetic oligonucleotide
ctttgtgaaaatatgcccagcggcaaggcc

SEQ ID NO: 119996 - DNA, 32 bp, Artificial Sequence
  Description of Artificial Sequence: Synthetic oligonucleotide
tttgtgaaaatatgcccagcggcaaggccaac

SEQ ID NO: 119997 - DNA, 31 bp, Artificial Sequence
  Description of Artificial Sequence: Synthetic oligonucleotide
ttgtgaaaatatgcccagcggcaaggccaac

SEQ ID NO: 119998 - DNA, 30 bp, Artificial Sequence
  Description of Artificial Sequence: Synthetic oligonucleotide
tgtgaaaatatgcccagcggcaaggccaac

SEQ ID NO: 119999 - DNA, 29 bp, Artificial Sequence
  Description of Artificial Sequence: Synthetic oligonucleotide
gtgaaaatatgcccagcggcaaggccaac

SEQ ID NO: 120000 - DNA, 31 bp, Artificial Sequence
  Description of Artificial Sequence: Synthetic oligonucleotide
tgaaaatatgcccagcggcaaggccaacaag

SEQ ID NO: 120001 - DNA, 30 bp, Artificial Sequence
  Description of Artificial Sequence: Synthetic oligonucleotide
gaaaatatgcccagcggcaaggccaacaag

SEQ ID NO: 120002 - DNA, 30 bp, Artificial Sequence
  Description of Artificial Sequence: Synthetic oligonucleotide
aaaatatgcccagcggcaaggccaacaagc

SEQ ID NO: 120003 - DNA, 29 bp, Artificial Sequence
  Description of Artificial Sequence: Synthetic oligonucleotide
aaatatgcccagcggcaaggccaacaagc

SEQ ID NO: 120004 - DNA, 28 bp, Artificial Sequence
  Description of Artificial Sequence: Synthetic oligonucleotide
aatatgcccagcggcaaggccaacaagc

SEQ ID NO: 120005 - DNA, 27 bp, Artificial Sequence
  Description of Artificial Sequence: Synthetic oligonucleotide
atatgcccagcggcaaggccaacaagc

SEQ ID NO: 120006 - DNA, 26 bp, Artificial Sequence
  Description of Artificial Sequence: Synthetic oligonucleotide
tatgcccagcggcaaggccaacaagc

SEQ ID NO: 120007 - DNA, 25 bp, Artificial Sequence
  Description of Artificial Sequence: Synthetic oligonucleotide
atgcccagcggcaaggccaacaagc

SEQ ID NO: 120008 - DNA, 24 bp, Artificial Sequence
  Description of Artificial Sequence: Synthetic oligonucleotide
tgcccagcggcaaggccaacaagc

SEQ ID NO: 120009 - DNA, 23 bp, Artificial Sequence
  Description of Artificial Sequence: Synthetic oligonucleotide
gcccagcggcaaggccaacaagc

SEQ ID NO: 120010 - DNA, 23 bp, Artificial Sequence
  Description of Artificial Sequence: Synthetic oligonucleotide
cccagcggcaaggccaacaagcc

SEQ ID NO: 120011 - DNA, 23 bp, Artificial Sequence
  Description of Artificial Sequence: Synthetic oligonucleotide
ccagcggcaaggccaacaagccg

SEQ ID NO: 120012 - DNA, 23 bp, Artificial Sequence
  Description of Artificial Sequence: Synthetic oligonucleotide
cagcggcaaggccaacaagccgg

SEQ ID NO: 120013 - DNA, 23 bp, Artificial Sequence
  Description of Artificial Sequence: Synthetic oligonucleotide
agcggcaaggccaacaagccggg

SEQ ID NO: 120014 - DNA, 22 bp, Artificial Sequence
  Description of Artificial Sequence: Synthetic oligonucleotide
gcggcaaggccaacaagccggg

SEQ ID NO: 120015 - DNA, 22 bp, Artificial Sequence
  Description of Artificial Sequence: Synthetic oligonucleotide
cggcaaggccaacaagccgggg

SEQ ID NO: 120016 - DNA, 24 bp, Artificial Sequence
  Description of Artificial Sequence: Synthetic oligonucleotide
ggcaaggccaacaagccgggggat

SEQ ID NO: 120017 - DNA, 26 bp, Artificial Sequence
  Description of Artificial Sequence: Synthetic oligonucleotide
gcaaggccaacaagccgggggatgtt

SEQ ID NO: 120018 - DNA, 27 bp, Artificial Sequence
  Description of Artificial Sequence: Synthetic oligonucleotide
caaggccaacaagccgggggatgttgt

SEQ ID NO: 120019 - DNA, 29 bp, Artificial Sequence
  Description of Artificial Sequence: Synthetic oligonucleotide
aaggccaacaagccgggggatgttgttag

SEQ ID NO: 120020 - DNA, 28 bp, Artificial Sequence
  Description of Artificial Sequence: Synthetic oligonucleotide
aggccaacaagccgggggatgttgttag

SEQ ID NO: 120021 - DNA, 27 bp, Artificial Sequence
  Description of Artificial Sequence: Synthetic oligonucleotide
ggccaacaagccgggggatgttgttag

SEQ ID NO: 120022 - DNA, 28 bp, Artificial Sequence
  Description of Artificial Sequence: Synthetic oligonucleotide
gccaacaagccgggggatgttgttagag

SEQ ID NO: 120023 - DNA, 28 bp, Artificial Sequence
  Description of Artificial Sequence: Synthetic oligonucleotide
ccaacaagccgggggatgttgttagagc

SEQ ID NO: 120024 - DNA, 28 bp, Artificial Sequence
  Description of Artificial Sequence: Synthetic oligonucleotide
caacaagccgggggatgttgttagagcc

SEQ ID NO: 120025 - DNA, 33 bp, Artificial Sequence
  Description of Artificial Sequence: Synthetic oligonucleotide
aacaagccgggggatgttgttagagccaaaaac

SEQ ID NO: 120026 - DNA, 32 bp, Artificial Sequence
  Description of Artificial Sequence: Synthetic oligonucleotide
acaagccgggggatgttgttagagccaaaaac

SEQ ID NO: 120027 - DNA, 31 bp, Artificial Sequence
  Description of Artificial Sequence: Synthetic oligonucleotide
caagccgggggatgttgttagagccaaaaac

SEQ ID NO: 120028 - DNA, 31 bp, Artificial Sequence
  Description of Artificial Sequence: Synthetic oligonucleotide
aagccgggggatgttgttagagccaaaaacg

SEQ ID NO: 120029 - DNA, 30 bp, Artificial Sequence
  Description of Artificial Sequence: Synthetic oligonucleotide
agccgggggatgttgttagagccaaaaacg

SEQ ID NO: 120030 - DNA, 29 bp, Artificial Sequence
  Description of Artificial Sequence: Synthetic oligonucleotide
gccgggggatgttgttagagccaaaaacg

SEQ ID NO: 120031 - DNA, 29 bp, Artificial Sequence
  Description of Artificial Sequence: Synthetic oligonucleotide
ccgggggatgttgttagagccaaaaacgg

SEQ ID NO: 120032 - DNA, 29 bp, Artificial Sequence
  Description of Artificial Sequence: Synthetic oligonucleotide
cgggggatgttgttagagccaaaaacggg

SEQ ID NO: 120033 - DNA, 31 bp, Artificial Sequence
  Description of Artificial Sequence: Synthetic oligonucleotide
gggggatgttgttagagccaaaaacgggaag

SEQ ID NO: 120034 - DNA, 32 bp, Artificial Sequence
  Description of Artificial Sequence: Synthetic oligonucleotide
ggggatgttgttagagccaaaaacgggaagac

SEQ ID NO: 120035 - DNA, 32 bp, Artificial Sequence
  Description of Artificial Sequence: Synthetic oligonucleotide
gggatgttgttagagccaaaaacgggaagacc

SEQ ID NO: 120036 - DNA, 34 bp, Artificial Sequence
  Description of Artificial Sequence: Synthetic oligonucleotide
ggatgttgttagagccaaaaacgggaagaccatc

SEQ ID NO: 120037 - DNA, 34 bp, Artificial Sequence
  Description of Artificial Sequence: Synthetic oligonucleotide
gatgttgttagagccaaaaacgggaagaccatcc

SEQ ID NO: 120038 - DNA, 35 bp, Artificial Sequence
  Description of Artificial Sequence: Synthetic oligonucleotide
atgttgttagagccaaaaacgggaagaccatccag

SEQ ID NO: 120039 - DNA, 34 bp, Artificial Sequence
  Description of Artificial Sequence: Synthetic oligonucleotide
tgttgttagagccaaaaacgggaagaccatccag

SEQ ID NO: 120040 - DNA, 33 bp, Artificial Sequence
  Description of Artificial Sequence: Synthetic oligonucleotide
gttgttagagccaaaaacgggaagaccatccag

SEQ ID NO: 120041 - DNA, 33 bp, Artificial Sequence
  Description of Artificial Sequence: Synthetic oligonucleotide
ttgttagagccaaaaacgggaagaccatccagg

SEQ ID NO: 120042 - DNA, 32 bp, Artificial Sequence
  Description of Artificial Sequence: Synthetic oligonucleotide
tgttagagccaaaaacgggaagaccatccagg

SEQ ID NO: 120043 - DNA, 31 bp, Artificial Sequence
  Description of Artificial Sequence: Synthetic oligonucleotide
gttagagccaaaaacgggaagaccatccagg

SEQ ID NO: 120044 - DNA, 33 bp, Artificial Sequence
  Description of Artificial Sequence: Synthetic oligonucleotide
ttagagccaaaaacgggaagaccatccaggttg

SEQ ID NO: 120045 - DNA, 32 bp, Artificial Sequence
  Description of Artificial Sequence: Synthetic oligonucleotide
tagagccaaaaacgggaagaccatccaggttg

SEQ ID NO: 120046 - DNA, 31 bp, Artificial Sequence
  Description of Artificial Sequence: Synthetic oligonucleotide
agagccaaaaacgggaagaccatccaggttg

SEQ ID NO: 120047 - DNA, 30 bp, Artificial Sequence
  Description of Artificial Sequence: Synthetic oligonucleotide
gagccaaaaacgggaagaccatccaggttg

SEQ ID NO: 120048 - DNA, 34 bp, Artificial Sequence
  Description of Artificial Sequence: Synthetic oligonucleotide
agccaaaaacgggaagaccatccaggttgataac

SEQ ID NO: 120049 - DNA, 33 bp, Artificial Sequence
  Description of Artificial Sequence: Synthetic oligonucleotide
gccaaaaacgggaagaccatccaggttgataac

SEQ ID NO: 120050 - DNA, 34 bp, Artificial Sequence
  Description of Artificial Sequence: Synthetic oligonucleotide
ccaaaaacgggaagaccatccaggttgataacac

SEQ ID NO: 120051 - DNA, 35 bp, Artificial Sequence
  Description of Artificial Sequence: Synthetic oligonucleotide
caaaaacgggaagaccatccaggttgataacactg

SEQ ID NO: 120052 - DNA, 37 bp, Artificial Sequence
  Description of Artificial Sequence: Synthetic oligonucleotide
aaaaacgggaagaccatccaggttgataacactgatg

SEQ ID NO: 120053 - DNA, 36 bp, Artificial Sequence
  Description of Artificial Sequence: Synthetic oligonucleotide
aaaacgggaagaccatccaggttgataacactgatg

SEQ ID NO: 120054 - DNA, 35 bp, Artificial Sequence
  Description of Artificial Sequence: Synthetic oligonucleotide
aaacgggaagaccatccaggttgataacactgatg

SEQ ID NO: 120055 - DNA, 34 bp, Artificial Sequence
  Description of Artificial Sequence: Synthetic oligonucleotide
aacgggaagaccatccaggttgataacactgatg

SEQ ID NO: 120056 - DNA, 33 bp, Artificial Sequence
  Description of Artificial Sequence: Synthetic oligonucleotide
acgggaagaccatccaggttgataacactgatg

SEQ ID NO: 120057 - DNA, 32 bp, Artificial Sequence
  Description of Artificial Sequence: Synthetic oligonucleotide
cgggaagaccatccaggttgataacactgatg

SEQ ID NO: 120058 - DNA, 32 bp, Artificial Sequence
  Description of Artificial Sequence: Synthetic oligonucleotide
gggaagaccatccaggttgataacactgatgc

SEQ ID NO: 120059 - DNA, 33 bp, Artificial Sequence
  Description of Artificial Sequence: Synthetic oligonucleotide
ggaagaccatccaggttgataacactgatgctg

SEQ ID NO: 120060 - DNA, 34 bp, Artificial Sequence
  Description of Artificial Sequence: Synthetic oligonucleotide
gaagaccatccaggttgataacactgatgctgag

SEQ ID NO: 120061 - DNA, 34 bp, Artificial Sequence
  Description of Artificial Sequence: Synthetic oligonucleotide
aagaccatccaggttgataacactgatgctgagg

SEQ ID NO: 120062 - DNA, 33 bp, Artificial Sequence
  Description of Artificial Sequence: Synthetic oligonucleotide
agaccatccaggttgataacactgatgctgagg

SEQ ID NO: 120063 - DNA, 32 bp, Artificial Sequence
  Description of Artificial Sequence: Synthetic oligonucleotide
gaccatccaggttgataacactgatgctgagg

SEQ ID NO: 120064 - DNA, 32 bp, Artificial Sequence
  Description of Artificial Sequence: Synthetic oligonucleotide
accatccaggttgataacactgatgctgaggg

SEQ ID NO: 120065 - DNA, 31 bp, Artificial Sequence
  Description of Artificial Sequence: Synthetic oligonucleotide
ccatccaggttgataacactgatgctgaggg

SEQ ID NO: 120066 - DNA, 31 bp, Artificial Sequence
  Description of Artificial Sequence: Synthetic oligonucleotide
catccaggttgataacactgatgctgagggg

SEQ ID NO: 120067 - DNA, 32 bp, Artificial Sequence
  Description of Artificial Sequence: Synthetic oligonucleotide
atccaggttgataacactgatgctgaggggag

SEQ ID NO: 120068 - DNA, 31 bp, Artificial Sequence
  Description of Artificial Sequence: Synthetic oligonucleotide
tccaggttgataacactgatgctgaggggag

SEQ ID NO: 120069 - DNA, 30 bp, Artificial Sequence
  Description of Artificial Sequence: Synthetic oligonucleotide
ccaggttgataacactgatgctgaggggag

SEQ ID NO: 120070 - DNA, 30 bp, Artificial Sequence
  Description of Artificial Sequence: Synthetic oligonucleotide
caggttgataacactgatgctgaggggagg

SEQ ID NO: 120071 - DNA, 30 bp, Artificial Sequence
  Description of Artificial Sequence: Synthetic oligonucleotide
aggttgataacactgatgctgaggggaggc

SEQ ID NO: 120072 - DNA, 29 bp, Artificial Sequence
  Description of Artificial Sequence: Synthetic oligonucleotide
ggttgataacactgatgctgaggggaggc

SEQ ID NO: 120073 - DNA, 30 bp, Artificial Sequence
  Description of Artificial Sequence: Synthetic oligonucleotide
gttgataacactgatgctgaggggaggctc

SEQ ID NO: 120074 - DNA, 33 bp, Artificial Sequence
  Description of Artificial Sequence: Synthetic oligonucleotide
ttgataacactgatgctgaggggaggctcatac

SEQ ID NO: 120075 - DNA, 32 bp, Artificial Sequence
  Description of Artificial Sequence: Synthetic oligonucleotide
tgataacactgatgctgaggggaggctcatac

SEQ ID NO: 120076 - DNA, 31 bp, Artificial Sequence
  Description of Artificial Sequence: Synthetic oligonucleotide
gataacactgatgctgaggggaggctcatac

SEQ ID NO: 120077 - DNA, 32 bp, Artificial Sequence
  Description of Artificial Sequence: Synthetic oligonucleotide
ataacactgatgctgaggggaggctcatactg

SEQ ID NO: 120078 - DNA, 31 bp, Artificial Sequence
  Description of Artificial Sequence: Synthetic oligonucleotide
taacactgatgctgaggggaggctcatactg

SEQ ID NO: 120079 - DNA, 30 bp, Artificial Sequence
  Description of Artificial Sequence: Synthetic oligonucleotide
aacactgatgctgaggggaggctcatactg

SEQ ID NO: 120080 - DNA, 29 bp, Artificial Sequence
  Description of Artificial Sequence: Synthetic oligonucleotide
acactgatgctgaggggaggctcatactg

SEQ ID NO: 120081 - DNA, 28 bp, Artificial Sequence
  Description of Artificial Sequence: Synthetic oligonucleotide
cactgatgctgaggggaggctcatactg

SEQ ID NO: 120082 - DNA, 28 bp, Artificial Sequence
  Description of Artificial Sequence: Synthetic oligonucleotide
actgatgctgaggggaggctcatactgg

SEQ ID NO: 120083 - DNA, 27 bp, Artificial Sequence
  Description of Artificial Sequence: Synthetic oligonucleotide
ctgatgctgaggggaggctcatactgg

SEQ ID NO: 120084 - DNA, 27 bp, Artificial Sequence
  Description of Artificial Sequence: Synthetic oligonucleotide
tgatgctgaggggaggctcatactggc

SEQ ID NO: 120085 - DNA, 27 bp, Artificial Sequence
  Description of Artificial Sequence: Synthetic oligonucleotide
gatgctgaggggaggctcatactggct

SEQ ID NO: 120086 - DNA, 27 bp, Artificial Sequence
  Description of Artificial Sequence: Synthetic oligonucleotide
atgctgaggggaggctcatactggctg

SEQ ID NO: 120087 - DNA, 27 bp, Artificial Sequence
  Description of Artificial Sequence: Synthetic oligonucleotide
tgctgaggggaggctcatactggctga

SEQ ID NO: 120088 - DNA, 27 bp, Artificial Sequence
  Description of Artificial Sequence: Synthetic oligonucleotide
gctgaggggaggctcatactggctgat

SEQ ID NO: 120089 - DNA, 27 bp, Artificial Sequence
  Description of Artificial Sequence: Synthetic oligonucleotide
ctgaggggaggctcatactggctgatg

SEQ ID NO: 120090 - DNA, 27 bp, Artificial Sequence
  Description of Artificial Sequence: Synthetic oligonucleotide
tgaggggaggctcatactggctgatgc

SEQ ID NO: 120091 - DNA, 26 bp, Artificial Sequence
  Description of Artificial Sequence: Synthetic oligonucleotide
gaggggaggctcatactggctgatgc

SEQ ID NO: 120092 - DNA, 26 bp, Artificial Sequence
  Description of Artificial Sequence: Synthetic oligonucleotide
aggggaggctcatactggctgatgcg

SEQ ID NO: 120093 - DNA, 25 bp, Artificial Sequence
  Description of Artificial Sequence: Synthetic oligonucleotide
ggggaggctcatactggctgatgcg

SEQ ID NO: 120094 - DNA, 26 bp, Artificial Sequence
  Description of Artificial Sequence: Synthetic oligonucleotide
gggaggctcatactggctgatgcgct

SEQ ID NO: 120095 - DNA, 27 bp, Artificial Sequence
  Description of Artificial Sequence: Synthetic oligonucleotide
ggaggctcatactggctgatgcgctct

SEQ ID NO: 120096 - DNA, 27 bp, Artificial Sequence
  Description of Artificial Sequence: Synthetic oligonucleotide
gaggctcatactggctgatgcgctctg

SEQ ID NO: 120097 - DNA, 30 bp, Artificial Sequence
  Description of Artificial Sequence: Synthetic oligonucleotide
aggctcatactggctgatgcgctctgttac

SEQ ID NO: 120098 - DNA, 29 bp, Artificial Sequence
  Description of Artificial Sequence: Synthetic oligonucleotide
ggctcatactggctgatgcgctctgttac

SEQ ID NO: 120099 - DNA, 29 bp, Artificial Sequence
  Description of Artificial Sequence: Synthetic oligonucleotide
gctcatactggctgatgcgctctgttacg

SEQ ID NO: 120100 - DNA, 29 bp, Artificial Sequence
  Description of Artificial Sequence: Synthetic oligonucleotide
ctcatactggctgatgcgctctgttacgc

SEQ ID NO: 120101 - DNA, 30 bp, Artificial Sequence
  Description of Artificial Sequence: Synthetic oligonucleotide
tcatactggctgatgcgctctgttacgcac

SEQ ID NO: 120102 - DNA, 29 bp, Artificial Sequence
  Description of Artificial Sequence: Synthetic oligonucleotide
catactggctgatgcgctctgttacgcac

SEQ ID NO: 120103 - DNA, 30 bp, Artificial Sequence
  Description of Artificial Sequence: Synthetic oligonucleotide
atactggctgatgcgctctgttacgcacac

SEQ ID NO: 120104 - DNA, 29 bp, Artificial Sequence
  Description of Artificial Sequence: Synthetic oligonucleotide
tactggctgatgcgctctgttacgcacac

SEQ ID NO: 120105 - DNA, 28 bp, Artificial Sequence
  Description of Artificial Sequence: Synthetic oligonucleotide
actggctgatgcgctctgttacgcacac

SEQ ID NO: 120106 - DNA, 27 bp, Artificial Sequence
  Description of Artificial Sequence: Synthetic oligonucleotide
ctggctgatgcgctctgttacgcacac

SEQ ID NO: 120107 - DNA, 28 bp, Artificial Sequence
  Description of Artificial Sequence: Synthetic oligonucleotide
tggctgatgcgctctgttacgcacacac

SEQ ID NO: 120108 - DNA, 27 bp, Artificial Sequence
  Description of Artificial Sequence: Synthetic oligonucleotide
ggctgatgcgctctgttacgcacacac

SEQ ID NO: 120109 - DNA, 27 bp, Artificial Sequence
  Description of Artificial Sequence: Synthetic oligonucleotide
gctgatgcgctctgttacgcacacacg

SEQ ID NO: 120110 - DNA, 32 bp, Artificial Sequence
  Description of Artificial Sequence: Synthetic oligonucleotide
ctgatgcgctctgttacgcacacacgtttaac

SEQ ID NO: 120111 - DNA, 32 bp, Artificial Sequence
  Description of Artificial Sequence: Synthetic oligonucleotide
tgatgcgctctgttacgcacacacgtttaacc

SEQ ID NO: 120112 - DNA, 31 bp, Artificial Sequence
  Description of Artificial Sequence: Synthetic oligonucleotide
gatgcgctctgttacgcacacacgtttaacc

SEQ ID NO: 120113 - DNA, 31 bp, Artificial Sequence
  Description of Artificial Sequence: Synthetic oligonucleotide
atgcgctctgttacgcacacacgtttaaccc

SEQ ID NO: 120114 - DNA, 30 bp, Artificial Sequence
  Description of Artificial Sequence: Synthetic oligonucleotide
tgcgctctgttacgcacacacgtttaaccc

SEQ ID NO: 120115 - DNA, 29 bp, Artificial Sequence
  Description of Artificial Sequence: Synthetic oligonucleotide
gcgctctgttacgcacacacgtttaaccc

SEQ ID NO: 120116 - DNA, 29 bp, Artificial Sequence
  Description of Artificial Sequence: Synthetic oligonucleotide
cgctctgttacgcacacacgtttaacccg

SEQ ID NO: 120117 - DNA, 31 bp, Artificial Sequence
  Description of Artificial Sequence: Synthetic oligonucleotide
gctctgttacgcacacacgtttaacccgaag

SEQ ID NO: 120118 - DNA, 31 bp, Artificial Sequence
  Description of Artificial Sequence: Synthetic oligonucleotide
ctctgttacgcacacacgtttaacccgaagg

SEQ ID NO: 120119 - DNA, 32 bp, Artificial Sequence
  Description of Artificial Sequence: Synthetic oligonucleotide
tctgttacgcacacacgtttaacccgaaggtc

SEQ ID NO: 120120 - DNA, 31 bp, Artificial Sequence
  Description of Artificial Sequence: Synthetic oligonucleotide
ctgttacgcacacacgtttaacccgaaggtc

SEQ ID NO: 120121 - DNA, 33 bp, Artificial Sequence
  Description of Artificial Sequence: Synthetic oligonucleotide
tgttacgcacacacgtttaacccgaaggtcatc

SEQ ID NO: 120122 - DNA, 32 bp, Artificial Sequence
  Description of Artificial Sequence: Synthetic oligonucleotide
gttacgcacacacgtttaacccgaaggtcatc

SEQ ID NO: 120123 - DNA, 32 bp, Artificial Sequence
  Description of Artificial Sequence: Synthetic oligonucleotide
ttacgcacacacgtttaacccgaaggtcatcc

SEQ ID NO: 120124 - DNA, 31 bp, Artificial Sequence
  Description of Artificial Sequence: Synthetic oligonucleotide
tacgcacacacgtttaacccgaaggtcatcc

SEQ ID NO: 120125 - DNA, 30 bp, Artificial Sequence
  Description of Artificial Sequence: Synthetic oligonucleotide
acgcacacacgtttaacccgaaggtcatcc

SEQ ID NO: 120126 - DNA, 29 bp, Artificial Sequence
  Description of Artificial Sequence: Synthetic oligonucleotide
cgcacacacgtttaacccgaaggtcatcc

SEQ ID NO: 120127 - DNA, 30 bp, Artificial Sequence
  Description of Artificial Sequence: Synthetic oligonucleotide
gcacacacgtttaacccgaaggtcatcctc

SEQ ID NO: 120128 - DNA, 33 bp, Artificial Sequence
  Description of Artificial Sequence: Synthetic oligonucleotide
cacacacgtttaacccgaaggtcatcctcaatg

SEQ ID NO: 120129 - DNA, 33 bp, Artificial Sequence
  Description of Artificial Sequence: Synthetic oligonucleotide
acacacgtttaacccgaaggtcatcctcaatgc

SEQ ID NO: 120130 - DNA, 32 bp, Artificial Sequence
  Description of Artificial Sequence: Synthetic oligonucleotide
cacacgtttaacccgaaggtcatcctcaatgc

SEQ ID NO: 120131 - DNA, 32 bp, Artificial Sequence
  Description of Artificial Sequence: Synthetic oligonucleotide
acacgtttaacccgaaggtcatcctcaatgcc

SEQ ID NO: 120132 - DNA, 31 bp, Artificial Sequence
  Description of Artificial Sequence: Synthetic oligonucleotide
cacgtttaacccgaaggtcatcctcaatgcc

SEQ ID NO: 120133 - DNA, 31 bp, Artificial Sequence
  Description of Artificial Sequence: Synthetic oligonucleotide
acgtttaacccgaaggtcatcctcaatgccg

SEQ ID NO: 120134 - DNA, 30 bp, Artificial Sequence
  Description of Artificial Sequence: Synthetic oligonucleotide
cgtttaacccgaaggtcatcctcaatgccg

SEQ ID NO: 120135 - DNA, 30 bp, Artificial Sequence
  Description of Artificial Sequence: Synthetic oligonucleotide
gtttaacccgaaggtcatcctcaatgccgc

SEQ ID NO: 120136 - DNA, 30 bp, Artificial Sequence
  Description of Artificial Sequence: Synthetic oligonucleotide
tttaacccgaaggtcatcctcaatgccgcc

SEQ ID NO: 120137 - DNA, 29 bp, Artificial Sequence
  Description of Artificial Sequence: Synthetic oligonucleotide
ttaacccgaaggtcatcctcaatgccgcc

SEQ ID NO: 120138 - DNA, 28 bp, Artificial Sequence
  Description of Artificial Sequence: Synthetic oligonucleotide
taacccgaaggtcatcctcaatgccgcc

SEQ ID NO: 120139 - DNA, 27 bp, Artificial Sequence
  Description of Artificial Sequence: Synthetic oligonucleotide
aacccgaaggtcatcctcaatgccgcc

SEQ ID NO: 120140 - DNA, 27 bp, Artificial Sequence
  Description of Artificial Sequence: Synthetic oligonucleotide
acccgaaggtcatcctcaatgccgcca

SEQ ID NO: 120141 - DNA, 26 bp, Artificial Sequence
  Description of Artificial Sequence: Synthetic oligonucleotide
cccgaaggtcatcctcaatgccgcca

SEQ ID NO: 120142 - DNA, 26 bp, Artificial Sequence
  Description of Artificial Sequence: Synthetic oligonucleotide
ccgaaggtcatcctcaatgccgccac

SEQ ID NO: 120143 - DNA, 27 bp, Artificial Sequence
  Description of Artificial Sequence: Synthetic oligonucleotide
cgaaggtcatcctcaatgccgccacct

SEQ ID NO: 120144 - DNA, 30 bp, Artificial Sequence
  Description of Artificial Sequence: Synthetic oligonucleotide
gaaggtcatcctcaatgccgccaccttaac

SEQ ID NO: 120145 - DNA, 31 bp, Artificial Sequence
  Description of Artificial Sequence: Synthetic oligonucleotide
aaggtcatcctcaatgccgccaccttaacag

SEQ ID NO: 120146 - DNA, 30 bp, Artificial Sequence
  Description of Artificial Sequence: Synthetic oligonucleotide
aggtcatcctcaatgccgccaccttaacag

SEQ ID NO: 120147 - DNA, 29 bp, Artificial Sequence
  Description of Artificial Sequence: Synthetic oligonucleotide
ggtcatcctcaatgccgccaccttaacag

SEQ ID NO: 120148 - DNA, 29 bp, Artificial Sequence
  Description of Artificial Sequence: Synthetic oligonucleotide
gtcatcctcaatgccgccaccttaacagg

SEQ ID NO: 120149 - DNA, 30 bp, Artificial Sequence
  Description of Artificial Sequence: Synthetic oligonucleotide
tcatcctcaatgccgccaccttaacaggtg

SEQ ID NO: 120150 - DNA, 29 bp, Artificial Sequence
  Description of Artificial Sequence: Synthetic oligonucleotide
catcctcaatgccgccaccttaacaggtg

SEQ ID NO: 120151 - DNA, 29 bp, Artificial Sequence
  Description of Artificial Sequence: Synthetic oligonucleotide
atcctcaatgccgccaccttaacaggtgc

SEQ ID NO: 120152 - DNA, 28 bp, Artificial Sequence
  Description of Artificial Sequence: Synthetic oligonucleotide
tcctcaatgccgccaccttaacaggtgc

SEQ ID NO: 120153 - DNA, 27 bp, Artificial Sequence
  Description of Artificial Sequence: Synthetic oligonucleotide
cctcaatgccgccaccttaacaggtgc

SEQ ID NO: 120154 - DNA, 27 bp, Artificial Sequence
  Description of Artificial Sequence: Synthetic oligonucleotide
ctcaatgccgccaccttaacaggtgcc

SEQ ID NO: 120155 - DNA, 29 bp, Artificial Sequence
  Description of Artificial Sequence: Synthetic oligonucleotide
tcaatgccgccaccttaacaggtgccatg

SEQ ID NO: 120156 - DNA, 28 bp, Artificial Sequence
  Description of Artificial Sequence: Synthetic oligonucleotide
caatgccgccaccttaacaggtgccatg

SEQ ID NO: 120157 - DNA, 28 bp, Artificial Sequence
  Description of Artificial Sequence: Synthetic oligonucleotide
aatgccgccaccttaacaggtgccatgg

SEQ ID NO: 120158 - DNA, 27 bp, Artificial Sequence
  Description of Artificial Sequence: Synthetic oligonucleotide
atgccgccaccttaacaggtgccatgg

SEQ ID NO: 120159 - DNA, 27 bp, Artificial Sequence
  Description of Artificial Sequence: Synthetic oligonucleotide
tgccgccaccttaacaggtgccatgga

SEQ ID NO: 120160 - DNA, 27 bp, Artificial Sequence
  Description of Artificial Sequence: Synthetic oligonucleotide
gccgccaccttaacaggtgccatggat

SEQ ID NO: 120161 - DNA, 27 bp, Artificial Sequence
  Description of Artificial Sequence: Synthetic oligonucleotide
ccgccaccttaacaggtgccatggatg

SEQ ID NO: 120162 - DNA, 29 bp, Artificial Sequence
  Description of Artificial Sequence: Synthetic oligonucleotide
cgccaccttaacaggtgccatggatgtag

SEQ ID NO: 120163 - DNA, 29 bp, Artificial Sequence
  Description of Artificial Sequence: Synthetic oligonucleotide
gccaccttaacaggtgccatggatgtagc

SEQ ID NO: 120164 - DNA, 32 bp, Artificial Sequence
  Description of Artificial Sequence: Synthetic oligonucleotide
ccaccttaacaggtgccatggatgtagctttg

SEQ ID NO: 120165 - DNA, 32 bp, Artificial Sequence
  Description of Artificial Sequence: Synthetic oligonucleotide
caccttaacaggtgccatggatgtagctttgg

SEQ ID NO: 120166 - DNA, 32 bp, Artificial Sequence
  Description of Artificial Sequence: Synthetic oligonucleotide
accttaacaggtgccatggatgtagctttggg

SEQ ID NO: 120167 - DNA, 31 bp, Artificial Sequence
  Description of Artificial Sequence: Synthetic oligonucleotide
ccttaacaggtgccatggatgtagctttggg

SEQ ID NO: 120168 - DNA, 33 bp, Artificial Sequence
  Description of Artificial Sequence: Synthetic oligonucleotide
cttaacaggtgccatggatgtagctttgggatc

SEQ ID NO: 120169 - DNA, 34 bp, Artificial Sequence
  Description of Artificial Sequence: Synthetic oligonucleotide
ttaacaggtgccatggatgtagctttgggatcag

SEQ ID NO: 120170 - DNA, 33 bp, Artificial Sequence
  Description of Artificial Sequence: Synthetic oligonucleotide
taacaggtgccatggatgtagctttgggatcag

SEQ ID NO: 120171 - DNA, 32 bp, Artificial Sequence
  Description of Artificial Sequence: Synthetic oligonucleotide
aacaggtgccatggatgtagctttgggatcag

SEQ ID NO: 120172 - DNA, 31 bp, Artificial Sequence
  Description of Artificial Sequence: Synthetic oligonucleotide
acaggtgccatggatgtagctttgggatcag

SEQ ID NO: 120173 - DNA, 30 bp, Artificial Sequence
  Description of Artificial Sequence: Synthetic oligonucleotide
caggtgccatggatgtagctttgggatcag

SEQ ID NO: 120174 - DNA, 30 bp, Artificial Sequence
  Description of Artificial Sequence: Synthetic oligonucleotide
aggtgccatggatgtagctttgggatcagg

SEQ ID NO: 120175 - DNA, 29 bp, Artificial Sequence
  Description of Artificial Sequence: Synthetic oligonucleotide
ggtgccatggatgtagctttgggatcagg

SEQ ID NO: 120176 - DNA, 30 bp, Artificial Sequence
  Description of Artificial Sequence: Synthetic oligonucleotide
gtgccatggatgtagctttgggatcaggtg

SEQ ID NO: 120177 - DNA, 30 bp, Artificial Sequence
  Description of Artificial Sequence: Synthetic oligonucleotide
tgccatggatgtagctttgggatcaggtgc

SEQ ID NO: 120178 - DNA, 29 bp, Artificial Sequence
  Description of Artificial Sequence: Synthetic oligonucleotide
gccatggatgtagctttgggatcaggtgc

SEQ ID NO: 120179 - DNA, 29 bp, Artificial Sequence
  Description of Artificial Sequence: Synthetic oligonucleotide
ccatggatgtagctttgggatcaggtgcc

SEQ ID NO: 120180 - DNA, 30 bp, Artificial Sequence
  Description of Artificial Sequence: Synthetic oligonucleotide
catggatgtagctttgggatcaggtgccac

SEQ ID NO: 120181 - DNA, 31 bp, Artificial Sequence
  Description of Artificial Sequence: Synthetic oligonucleotide
atggatgtagctttgggatcaggtgccactg

SEQ ID NO: 120182 - DNA, 30 bp, Artificial Sequence
  Description of Artificial Sequence: Synthetic oligonucleotide
tggatgtagctttgggatcaggtgccactg

SEQ ID NO: 120183 - DNA, 29 bp, Artificial Sequence
  Description of Artificial Sequence: Synthetic oligonucleotide
ggatgtagctttgggatcaggtgccactg

SEQ ID NO: 120184 - DNA, 29 bp, Artificial Sequence
  Description of Artificial Sequence: Synthetic oligonucleotide
gatgtagctttgggatcaggtgccactgg

SEQ ID NO: 120185 - DNA, 29 bp, Artificial Sequence
  Description of Artificial Sequence: Synthetic oligonucleotide
atgtagctttgggatcaggtgccactggg

SEQ ID NO: 120186 - DNA, 28 bp, Artificial Sequence
  Description of Artificial Sequence: Synthetic oligonucleotide
tgtagctttgggatcaggtgccactggg

SEQ ID NO: 120187 - DNA, 27 bp, Artificial Sequence
  Description of Artificial Sequence: Synthetic oligonucleotide
gtagctttgggatcaggtgccactggg

SEQ ID NO: 120188 - DNA, 27 bp, Artificial Sequence
  Description of Artificial Sequence: Synthetic oligonucleotide
tagctttgggatcaggtgccactgggg

SEQ ID NO: 120189 - DNA, 27 bp, Artificial Sequence
  Description of Artificial Sequence: Synthetic oligonucleotide
agctttgggatcaggtgccactggggt

SEQ ID NO: 120190 - DNA, 26 bp, Artificial Sequence
  Description of Artificial Sequence: Synthetic oligonucleotide
gctttgggatcaggtgccactggggt

SEQ ID NO: 120191 - DNA, 27 bp, Artificial Sequence
  Description of Artificial Sequence: Synthetic oligonucleotide
ctttgggatcaggtgccactggggtct

SEQ ID NO: 120192 - DNA, 30 bp, Artificial Sequence
  Description of Artificial Sequence: Synthetic oligonucleotide
tttgggatcaggtgccactggggtctttac

SEQ ID NO: 120193 - DNA, 29 bp, Artificial Sequence
  Description of Artificial Sequence: Synthetic oligonucleotide
ttgggatcaggtgccactggggtctttac

SEQ ID NO: 120194 - DNA, 28 bp, Artificial Sequence
  Description of Artificial Sequence: Synthetic oligonucleotide
tgggatcaggtgccactggggtctttac

SEQ ID NO: 120195 - DNA, 27 bp, Artificial Sequence
  Description of Artificial Sequence: Synthetic oligonucleotide
gggatcaggtgccactggggtctttac

SEQ ID NO: 120196 - DNA, 27 bp, Artificial Sequence
  Description of Artificial Sequence: Synthetic oligonucleotide
ggatcaggtgccactggggtctttacc

SEQ ID NO: 120197 - DNA, 31 bp, Artificial Sequence
  Description of Artificial Sequence: Synthetic oligonucleotide
gatcaggtgccactggggtctttaccaattc

SEQ ID NO: 120198 - DNA, 33 bp, Artificial Sequence
  Description of Artificial Sequence: Synthetic oligonucleotide
atcaggtgccactggggtctttaccaattcatc

SEQ ID NO: 120199 - DNA, 32 bp, Artificial Sequence
  Description of Artificial Sequence: Synthetic oligonucleotide
tcaggtgccactggggtctttaccaattcatc

SEQ ID NO: 120200 - DNA, 31 bp, Artificial Sequence
  Description of Artificial Sequence: Synthetic oligonucleotide
caggtgccactggggtctttaccaattcatc

SEQ ID NO: 120201 - DNA, 31 bp, Artificial Sequence
  Description of Artificial Sequence: Synthetic oligonucleotide
aggtgccactggggtctttaccaattcatcc

SEQ ID NO: 120202 - DNA, 30 bp, Artificial Sequence
  Description of Artificial Sequence: Synthetic oligonucleotide
ggtgccactggggtctttaccaattcatcc

SEQ ID NO: 120203 - DNA, 31 bp, Artificial Sequence
  Description of Artificial Sequence: Synthetic oligonucleotide
gtgccactggggtctttaccaattcatcctg

SEQ ID NO: 120204 - DNA, 31 bp, Artificial Sequence
  Description of Artificial Sequence: Synthetic oligonucleotide
tgccactggggtctttaccaattcatcctgg

SEQ ID NO: 120205 - DNA, 30 bp, Artificial Sequence
  Description of Artificial Sequence: Synthetic oligonucleotide
gccactggggtctttaccaattcatcctgg

SEQ ID NO: 120206 - DNA, 30 bp, Artificial Sequence
  Description of Artificial Sequence: Synthetic oligonucleotide
ccactggggtctttaccaattcatcctggc

SEQ ID NO: 120207 - DNA, 31 bp, Artificial Sequence
  Description of Artificial Sequence: Synthetic oligonucleotide
cactggggtctttaccaattcatcctggctc

SEQ ID NO: 120208 - DNA, 32 bp, Artificial Sequence
  Description of Artificial Sequence: Synthetic oligonucleotide
actggggtctttaccaattcatcctggctctg

SEQ ID NO: 120209 - DNA, 31 bp, Artificial Sequence
  Description of Artificial Sequence: Synthetic oligonucleotide
ctggggtctttaccaattcatcctggctctg

SEQ ID NO: 120210 - DNA, 31 bp, Artificial Sequence
  Description of Artificial Sequence: Synthetic oligonucleotide
tggggtctttaccaattcatcctggctctgg

SEQ ID NO: 120211 - DNA, 30 bp, Artificial Sequence
  Description of Artificial Sequence: Synthetic oligonucleotide
ggggtctttaccaattcatcctggctctgg

SEQ ID NO: 120212 - DNA, 32 bp, Artificial Sequence
  Description of Artificial Sequence: Synthetic oligonucleotide
gggtctttaccaattcatcctggctctggaac

SEQ ID NO: 120213 - DNA, 35 bp, Artificial Sequence
  Description of Artificial Sequence: Synthetic oligonucleotide
ggtctttaccaattcatcctggctctggaacaaac

SEQ ID NO: 120214 - DNA, 36 bp, Artificial Sequence
  Description of Artificial Sequence: Synthetic oligonucleotide
gtctttaccaattcatcctggctctggaacaaactc

SEQ ID NO: 120215 - DNA, 38 bp, Artificial Sequence
  Description of Artificial Sequence: Synthetic oligonucleotide
tctttaccaattcatcctggctctggaacaaactcttc

SEQ ID NO: 120216 - DNA, 37 bp, Artificial Sequence
  Description of Artificial Sequence: Synthetic oligonucleotide
ctttaccaattcatcctggctctggaacaaactcttc

SEQ ID NO: 120217 - DNA, 37 bp, Artificial Sequence
  Description of Artificial Sequence: Synthetic oligonucleotide
tttaccaattcatcctggctctggaacaaactcttcg

SEQ ID NO: 120218 - DNA, 36 bp, Artificial Sequence
  Description of Artificial Sequence: Synthetic oligonucleotide
ttaccaattcatcctggctctggaacaaactcttcg

SEQ ID NO: 120219 - DNA, 35 bp, Artificial Sequence
  Description of Artificial Sequence: Synthetic oligonucleotide
taccaattcatcctggctctggaacaaactcttcg

SEQ ID NO: 120220 - DNA, 34 bp, Artificial Sequence
  Description of Artificial Sequence: Synthetic oligonucleotide
accaattcatcctggctctggaacaaactcttcg

SEQ ID NO: 120221 - DNA, 33 bp, Artificial Sequence
  Description of Artificial Sequence: Synthetic oligonucleotide
ccaattcatcctggctctggaacaaactcttcg

SEQ ID NO: 120222 - DNA, 34 bp, Artificial Sequence
  Description of Artificial Sequence: Synthetic oligonucleotide
caattcatcctggctctggaacaaactcttcgag

SEQ ID NO: 120223 - DNA, 34 bp, Artificial Sequence
  Description of Artificial Sequence: Synthetic oligonucleotide
aattcatcctggctctggaacaaactcttcgagg

SEQ ID NO: 120224 - DNA, 33 bp, Artificial Sequence
  Description of Artificial Sequence: Synthetic oligonucleotide
attcatcctggctctggaacaaactcttcgagg

SEQ ID NO: 120225 - DNA, 32 bp, Artificial Sequence
  Description of Artificial Sequence: Synthetic oligonucleotide
ttcatcctggctctggaacaaactcttcgagg

SEQ ID NO: 120226 - DNA, 31 bp, Artificial Sequence
  Description of Artificial Sequence: Synthetic oligonucleotide
tcatcctggctctggaacaaactcttcgagg

SEQ ID NO: 120227 - DNA, 30 bp, Artificial Sequence
  Description of Artificial Sequence: Synthetic oligonucleotide
catcctggctctggaacaaactcttcgagg

SEQ ID NO: 120228 - DNA, 30 bp, Artificial Sequence
  Description of Artificial Sequence: Synthetic oligonucleotide
atcctggctctggaacaaactcttcgaggc

SEQ ID NO: 120229 - DNA, 29 bp, Artificial Sequence
  Description of Artificial Sequence: Synthetic oligonucleotide
tcctggctctggaacaaactcttcgaggc

SEQ ID NO: 120230 - DNA, 28 bp, Artificial Sequence
  Description of Artificial Sequence: Synthetic oligonucleotide
cctggctctggaacaaactcttcgaggc

SEQ ID NO: 120231 - DNA, 28 bp, Artificial Sequence
  Description of Artificial Sequence: Synthetic oligonucleotide
ctggctctggaacaaactcttcgaggcc

SEQ ID NO: 120232 - DNA, 29 bp, Artificial Sequence
  Description of Artificial Sequence: Synthetic oligonucleotide
tggctctggaacaaactcttcgaggccag

SEQ ID NO: 120233 - DNA, 28 bp, Artificial Sequence
  Description of Artificial Sequence: Synthetic oligonucleotide
ggctctggaacaaactcttcgaggccag

SEQ ID NO: 120234 - DNA, 28 bp, Artificial Sequence
  Description of Artificial Sequence: Synthetic oligonucleotide
gctctggaacaaactcttcgaggccagc

SEQ ID NO: 120235 - DNA, 31 bp, Artificial Sequence
  Description of Artificial Sequence: Synthetic oligonucleotide
ctctggaacaaactcttcgaggccagcattg

SEQ ID NO: 120236 - DNA, 34 bp, Artificial Sequence
  Description of Artificial Sequence: Synthetic oligonucleotide
tctggaacaaactcttcgaggccagcattgaaac

SEQ ID NO: 120237 - DNA, 33 bp, Artificial Sequence
  Description of Artificial Sequence: Synthetic oligonucleotide
ctggaacaaactcttcgaggccagcattgaaac

SEQ ID NO: 120238 - DNA, 34 bp, Artificial Sequence
  Description of Artificial Sequence: Synthetic oligonucleotide
tggaacaaactcttcgaggccagcattgaaacag

SEQ ID NO: 120239 - DNA, 33 bp, Artificial Sequence
  Description of Artificial Sequence: Synthetic oligonucleotide
ggaacaaactcttcgaggccagcattgaaacag

SEQ ID NO: 120240 - DNA, 33 bp, Artificial Sequence
  Description of Artificial Sequence: Synthetic oligonucleotide
gaacaaactcttcgaggccagcattgaaacagg

SEQ ID NO: 120241 - DNA, 33 bp, Artificial Sequence
  Description of Artificial Sequence: Synthetic oligonucleotide
aacaaactcttcgaggccagcattgaaacaggg

SEQ ID NO: 120242 - DNA, 32 bp, Artificial Sequence
  Description of Artificial Sequence: Synthetic oligonucleotide
acaaactcttcgaggccagcattgaaacaggg

SEQ ID NO: 120243 - DNA, 31 bp, Artificial Sequence
  Description of Artificial Sequence: Synthetic oligonucleotide
caaactcttcgaggccagcattgaaacaggg

SEQ ID NO: 120244 - DNA, 31 bp, Artificial Sequence
  Description of Artificial Sequence: Synthetic oligonucleotide
aaactcttcgaggccagcattgaaacagggg

SEQ ID NO: 120245 - DNA, 30 bp, Artificial Sequence
  Description of Artificial Sequence: Synthetic oligonucleotide
aactcttcgaggccagcattgaaacagggg

SEQ ID NO: 120246 - DNA, 29 bp, Artificial Sequence
  Description of Artificial Sequence: Synthetic oligonucleotide
actcttcgaggccagcattgaaacagggg

SEQ ID NO: 120247 - DNA, 28 bp, Artificial Sequence
  Description of Artificial Sequence: Synthetic oligonucleotide
ctcttcgaggccagcattgaaacagggg

SEQ ID NO: 120248 - DNA, 29 bp, Artificial Sequence
  Description of Artificial Sequence: Synthetic oligonucleotide
tcttcgaggccagcattgaaacaggggac

SEQ ID NO: 120249 - DNA, 28 bp, Artificial Sequence
  Description of Artificial Sequence: Synthetic oligonucleotide
cttcgaggccagcattgaaacaggggac

SEQ ID NO: 120250 - DNA, 28 bp, Artificial Sequence
  Description of Artificial Sequence: Synthetic oligonucleotide
ttcgaggccagcattgaaacaggggacc

SEQ ID NO: 120251 - DNA, 27 bp, Artificial Sequence
  Description of Artificial Sequence: Synthetic oligonucleotide
tcgaggccagcattgaaacaggggacc

SEQ ID NO: 120252 - DNA, 26 bp, Artificial Sequence
  Description of Artificial Sequence: Synthetic oligonucleotide
cgaggccagcattgaaacaggggacc

SEQ ID NO: 120253 - DNA, 27 bp, Artificial Sequence
  Description of Artificial Sequence: Synthetic oligonucleotide
gaggccagcattgaaacaggggaccgt

SEQ ID NO: 120254 - DNA, 27 bp, Artificial Sequence
  Description of Artificial Sequence: Synthetic oligonucleotide
aggccagcattgaaacaggggaccgtg

SEQ ID NO: 120255 - DNA, 27 bp, Artificial Sequence
  Description of Artificial Sequence: Synthetic oligonucleotide
ggccagcattgaaacaggggaccgtgt

SEQ ID NO: 120256 - DNA, 27 bp, Artificial Sequence
  Description of Artificial Sequence: Synthetic oligonucleotide
gccagcattgaaacaggggaccgtgtc

SEQ ID NO: 120257 - DNA, 28 bp, Artificial Sequence
  Description of Artificial Sequence: Synthetic oligonucleotide
ccagcattgaaacaggggaccgtgtctg

SEQ ID NO: 120258 - DNA, 28 bp, Artificial Sequence
  Description of Artificial Sequence: Synthetic oligonucleotide
cagcattgaaacaggggaccgtgtctgg

SEQ ID NO: 120259 - DNA, 29 bp, Artificial Sequence
  Description of Artificial Sequence: Synthetic oligonucleotide
agcattgaaacaggggaccgtgtctggag

SEQ ID NO: 120260 - DNA, 28 bp, Artificial Sequence
  Description of Artificial Sequence: Synthetic oligonucleotide
gcattgaaacaggggaccgtgtctggag

SEQ ID NO: 120261 - DNA, 28 bp, Artificial Sequence
  Description of Artificial Sequence: Synthetic oligonucleotide
cattgaaacaggggaccgtgtctggagg

SEQ ID NO: 120262 - DNA, 30 bp, Artificial Sequence
  Description of Artificial Sequence: Synthetic oligonucleotide
attgaaacaggggaccgtgtctggaggatg

SEQ ID NO: 120263 - DNA, 29 bp, Artificial Sequence
  Description of Artificial Sequence: Synthetic oligonucleotide
ttgaaacaggggaccgtgtctggaggatg

SEQ ID NO: 120264 - DNA, 28 bp, Artificial Sequence
  Description of Artificial Sequence: Synthetic oligonucleotide
tgaaacaggggaccgtgtctggaggatg

SEQ ID NO: 120265 - DNA, 27 bp, Artificial Sequence
  Description of Artificial Sequence: Synthetic oligonucleotide
gaaacaggggaccgtgtctggaggatg

SEQ ID NO: 120266 - DNA, 27 bp, Artificial Sequence
  Description of Artificial Sequence: Synthetic oligonucleotide
aaacaggggaccgtgtctggaggatgc

SEQ ID NO: 120267 - DNA, 26 bp, Artificial Sequence
  Description of Artificial Sequence: Synthetic oligonucleotide
aacaggggaccgtgtctggaggatgc

SEQ ID NO: 120268 - DNA, 25 bp, Artificial Sequence
  Description of Artificial Sequence: Synthetic oligonucleotide
acaggggaccgtgtctggaggatgc

SEQ ID NO: 120269 - DNA, 24 bp, Artificial Sequence
  Description of Artificial Sequence: Synthetic oligonucleotide
caggggaccgtgtctggaggatgc

SEQ ID NO: 120270 - DNA, 25 bp, Artificial Sequence
  Description of Artificial Sequence: Synthetic oligonucleotide
aggggaccgtgtctggaggatgcct

SEQ ID NO: 120271 - DNA, 24 bp, Artificial Sequence
  Description of Artificial Sequence: Synthetic oligonucleotide
ggggaccgtgtctggaggatgcct

SEQ ID NO: 120272 - DNA, 25 bp, Artificial Sequence
  Description of Artificial Sequence: Synthetic oligonucleotide
gggaccgtgtctggaggatgcctct

SEQ ID NO: 120273 - DNA, 27 bp, Artificial Sequence
  Description of Artificial Sequence: Synthetic oligonucleotide
ggaccgtgtctggaggatgcctctctt

SEQ ID NO: 120274 - DNA, 27 bp, Artificial Sequence
  Description of Artificial Sequence: Synthetic oligonucleotide
gaccgtgtctggaggatgcctctcttc

SEQ ID NO: 120275 - DNA, 27 bp, Artificial Sequence
  Description of Artificial Sequence: Synthetic oligonucleotide
accgtgtctggaggatgcctctcttcg

SEQ ID NO: 120276 - DNA, 27 bp, Artificial Sequence
  Description of Artificial Sequence: Synthetic oligonucleotide
ccgtgtctggaggatgcctctcttcga

SEQ ID NO: 120277 - DNA, 28 bp, Artificial Sequence
  Description of Artificial Sequence: Synthetic oligonucleotide
cgtgtctggaggatgcctctcttcgaac

SEQ ID NO: 120278 - DNA, 34 bp, Artificial Sequence
  Description of Artificial Sequence: Synthetic oligonucleotide
gtgtctggaggatgcctctcttcgaacattatac

SEQ ID NO: 120279 - DNA, 36 bp, Artificial Sequence
  Description of Artificial Sequence: Synthetic oligonucleotide
tgtctggaggatgcctctcttcgaacattatacaag

SEQ ID NO: 120280 - DNA, 35 bp, Artificial Sequence
  Description of Artificial Sequence: Synthetic oligonucleotide
gtctggaggatgcctctcttcgaacattatacaag

SEQ ID NO: 120281 - DNA, 36 bp, Artificial Sequence
  Description of Artificial Sequence: Synthetic oligonucleotide
tctggaggatgcctctcttcgaacattatacaagac

SEQ ID NO: 120282 - DNA, 35 bp, Artificial Sequence
  Description of Artificial Sequence: Synthetic oligonucleotide
ctggaggatgcctctcttcgaacattatacaagac

SEQ ID NO: 120283 - DNA, 36 bp, Artificial Sequence
  Description of Artificial Sequence: Synthetic oligonucleotide
tggaggatgcctctcttcgaacattatacaagacag

SEQ ID NO: 120284 - DNA, 35 bp, Artificial Sequence
  Description of Artificial Sequence: Synthetic oligonucleotide
ggaggatgcctctcttcgaacattatacaagacag

SEQ ID NO: 120285 - DNA, 35 bp, Artificial Sequence
  Description of Artificial Sequence: Synthetic oligonucleotide
gaggatgcctctcttcgaacattatacaagacagg

SEQ ID NO: 120286 - DNA, 37 bp, Artificial Sequence
  Description of Artificial Sequence: Synthetic oligonucleotide
aggatgcctctcttcgaacattatacaagacaggttg

SEQ ID NO: 120287 - DNA, 36 bp, Artificial Sequence
  Description of Artificial Sequence: Synthetic oligonucleotide
ggatgcctctcttcgaacattatacaagacaggttg

SEQ ID NO: 120288 - DNA, 38 bp, Artificial Sequence
  Description of Artificial Sequence: Synthetic oligonucleotide
gatgcctctcttcgaacattatacaagacaggttgtag

SEQ ID NO: 120289 - DNA, 41 bp, Artificial Sequence
  Description of Artificial Sequence: Synthetic oligonucleotide
atgcctctcttcgaacattatacaagacaggttgtagattg

SEQ ID NO: 120290 - DNA, 40 bp, Artificial Sequence
  Description of Artificial Sequence: Synthetic oligonucleotide
tgcctctcttcgaacattatacaagacaggttgtagattg

SEQ ID NO: 120291 - DNA, 39 bp, Artificial Sequence
  Description of Artificial Sequence: Synthetic oligonucleotide
gcctctcttcgaacattatacaagacaggttgtagattg

SEQ ID NO: 120292 - DNA, 39 bp, Artificial Sequence
  Description of Artificial Sequence: Synthetic oligonucleotide
cctctcttcgaacattatacaagacaggttgtagattgc

SEQ ID NO: 120293 - DNA, 39 bp, Artificial Sequence
  Description of Artificial Sequence: Synthetic oligonucleotide
ctctcttcgaacattatacaagacaggttgtagattgcc

SEQ ID NO: 120294 - DNA, 40 bp, Artificial Sequence
  Description of Artificial Sequence: Synthetic oligonucleotide
tctcttcgaacattatacaagacaggttgtagattgccag

SEQ ID NO: 120295 - DNA, 39 bp, Artificial Sequence
  Description of Artificial Sequence: Synthetic oligonucleotide
ctcttcgaacattatacaagacaggttgtagattgccag

SEQ ID NO: 120296 - DNA, 39 bp, Artificial Sequence
  Description of Artificial Sequence: Synthetic oligonucleotide
tcttcgaacattatacaagacaggttgtagattgccagc

SEQ ID NO: 120297 - DNA, 38 bp, Artificial Sequence
  Description of Artificial Sequence: Synthetic oligonucleotide
cttcgaacattatacaagacaggttgtagattgccagc

SEQ ID NO: 120298 - DNA, 40 bp, Artificial Sequence
  Description of Artificial Sequence: Synthetic oligonucleotide
ttcgaacattatacaagacaggttgtagattgccagcttg

SEQ ID NO: 120299 - DNA, 39 bp, Artificial Sequence
  Description of Artificial Sequence: Synthetic oligonucleotide
tcgaacattatacaagacaggttgtagattgccagcttg

SEQ ID NO: 120300 - DNA, 38 bp, Artificial Sequence
  Description of Artificial Sequence: Synthetic oligonucleotide
cgaacattatacaagacaggttgtagattgccagcttg

SEQ ID NO: 120301 - DNA, 38 bp, Artificial Sequence
  Description of Artificial Sequence: Synthetic oligonucleotide
gaacattatacaagacaggttgtagattgccagcttgc

SEQ ID NO: 120302 - DNA, 39 bp, Artificial Sequence
  Description of Artificial Sequence: Synthetic oligonucleotide
aacattatacaagacaggttgtagattgccagcttgctg

SEQ ID NO: 120303 - DNA, 38 bp, Artificial Sequence
  Description of Artificial Sequence: Synthetic oligonucleotide
acattatacaagacaggttgtagattgccagcttgctg

SEQ ID NO: 120304 - DNA, 37 bp, Artificial Sequence
  Description of Artificial Sequence: Synthetic oligonucleotide
cattatacaagacaggttgtagattgccagcttgctg

SEQ ID NO: 120305 - DNA, 39 bp, Artificial Sequence
  Description of Artificial Sequence: Synthetic oligonucleotide
attatacaagacaggttgtagattgccagcttgctgatg

SEQ ID NO: 120306 - DNA, 38 bp, Artificial Sequence
  Description of Artificial Sequence: Synthetic oligonucleotide
ttatacaagacaggttgtagattgccagcttgctgatg

SEQ ID NO: 120307 - DNA, 37 bp, Artificial Sequence
  Description of Artificial Sequence: Synthetic oligonucleotide
tatacaagacaggttgtagattgccagcttgctgatg

SEQ ID NO: 120308 - DNA, 36 bp, Artificial Sequence
  Description of Artificial Sequence: Synthetic oligonucleotide
atacaagacaggttgtagattgccagcttgctgatg

SEQ ID NO: 120309 - DNA, 35 bp, Artificial Sequence
  Description of Artificial Sequence: Synthetic oligonucleotide
tacaagacaggttgtagattgccagcttgctgatg

SEQ ID NO: 120310 - DNA, 34 bp, Artificial Sequence
  Description of Artificial Sequence: Synthetic oligonucleotide
acaagacaggttgtagattgccagcttgctgatg

SEQ ID NO: 120311 - DNA, 33 bp, Artificial Sequence
  Description of Artificial Sequence: Synthetic oligonucleotide
caagacaggttgtagattgccagcttgctgatg

SEQ ID NO: 120312 - DNA, 37 bp, Artificial Sequence
  Description of Artificial Sequence: Synthetic oligonucleotide
aagacaggttgtagattgccagcttgctgatgttaac

SEQ ID NO: 120313 - DNA, 36 bp, Artificial Sequence
  Description of Artificial Sequence: Synthetic oligonucleotide
agacaggttgtagattgccagcttgctgatgttaac

SEQ ID NO: 120314 - DNA, 35 bp, Artificial Sequence
  Description of Artificial Sequence: Synthetic oligonucleotide
gacaggttgtagattgccagcttgctgatgttaac

SEQ ID NO: 120315 - DNA, 37 bp, Artificial Sequence
  Description of Artificial Sequence: Synthetic oligonucleotide
acaggttgtagattgccagcttgctgatgttaacaac

SEQ ID NO: 120316 - DNA, 36 bp, Artificial Sequence
  Description of Artificial Sequence: Synthetic oligonucleotide
caggttgtagattgccagcttgctgatgttaacaac

SEQ ID NO: 120317 - DNA, 39 bp, Artificial Sequence
  Description of Artificial Sequence: Synthetic oligonucleotide
aggttgtagattgccagcttgctgatgttaacaacattg

SEQ ID NO: 120318 - DNA, 38 bp, Artificial Sequence
  Description of Artificial Sequence: Synthetic oligonucleotide
ggttgtagattgccagcttgctgatgttaacaacattg

SEQ ID NO: 120319 - DNA, 38 bp, Artificial Sequence
  Description of Artificial Sequence: Synthetic oligonucleotide
gttgtagattgccagcttgctgatgttaacaacattgg

SEQ ID NO: 120320 - DNA, 44 bp, Artificial Sequence
  Description of Artificial Sequence: Synthetic oligonucleotide
ttgtagattgccagcttgctgatgttaacaacattggaaaatac

SEQ ID NO: 120321 - DNA, 43 bp, Artificial Sequence
  Description of Artificial Sequence: Synthetic oligonucleotide
tgtagattgccagcttgctgatgttaacaacattggaaaatac

SEQ ID NO: 120322 - DNA, 42 bp, Artificial Sequence
  Description of Artificial Sequence: Synthetic oligonucleotide
gtagattgccagcttgctgatgttaacaacattggaaaatac

SEQ ID NO: 120323 - DNA, 43 bp, Artificial Sequence
  Description of Artificial Sequence: Synthetic oligonucleotide
tagattgccagcttgctgatgttaacaacattggaaaatacag

SEQ ID NO: 120324 - DNA, 42 bp, Artificial Sequence
  Description of Artificial Sequence: Synthetic oligonucleotide
agattgccagcttgctgatgttaacaacattggaaaatacag

SEQ ID NO: 120325 - DNA, 41 bp, Artificial Sequence
  Description of Artificial Sequence: Synthetic oligonucleotide
gattgccagcttgctgatgttaacaacattggaaaatacag

SEQ ID NO: 120326 - DNA, 43 bp, Artificial Sequence
  Description of Artificial Sequence: Synthetic oligonucleotide
attgccagcttgctgatgttaacaacattggaaaatacagatc

SEQ ID NO: 120327 - DNA, 42 bp, Artificial Sequence
  Description of Artificial Sequence: Synthetic oligonucleotide
ttgccagcttgctgatgttaacaacattggaaaatacagatc

SEQ ID NO: 120328 - DNA, 41 bp, Artificial Sequence
  Description of Artificial Sequence: Synthetic oligonucleotide
tgccagcttgctgatgttaacaacattggaaaatacagatc

SEQ ID NO: 120329 - DNA, 40 bp, Artificial Sequence
  Description of Artificial Sequence: Synthetic oligonucleotide
gccagcttgctgatgttaacaacattggaaaatacagatc

SEQ ID NO: 120330 - DNA, 41 bp, Artificial Sequence
  Description of Artificial Sequence: Synthetic oligonucleotide
ccagcttgctgatgttaacaacattggaaaatacagatctg

SEQ ID NO: 120331 - DNA, 41 bp, Artificial Sequence
  Description of Artificial Sequence: Synthetic oligonucleotide
cagcttgctgatgttaacaacattggaaaatacagatctgc

SEQ ID NO: 120332 - DNA, 42 bp, Artificial Sequence
  Description of Artificial Sequence: Synthetic oligonucleotide
agcttgctgatgttaacaacattggaaaatacagatctgcag

SEQ ID NO: 120333 - DNA, 41 bp, Artificial Sequence
  Description of Artificial Sequence: Synthetic oligonucleotide
gcttgctgatgttaacaacattggaaaatacagatctgcag

SEQ ID NO: 120334 - DNA, 41 bp, Artificial Sequence
  Description of Artificial Sequence: Synthetic oligonucleotide
cttgctgatgttaacaacattggaaaatacagatctgcagg

SEQ ID NO: 120335 - DNA, 42 bp, Artificial Sequence
  Description of Artificial Sequence: Synthetic oligonucleotide
ttgctgatgttaacaacattggaaaatacagatctgcaggag

SEQ ID NO: 120336 - DNA, 41 bp, Artificial Sequence
  Description of Artificial Sequence: Synthetic oligonucleotide
tgctgatgttaacaacattggaaaatacagatctgcaggag

SEQ ID NO: 120337 - DNA, 40 bp, Artificial Sequence
  Description of Artificial Sequence: Synthetic oligonucleotide
gctgatgttaacaacattggaaaatacagatctgcaggag

SEQ ID NO: 120338 - DNA, 40 bp, Artificial Sequence
  Description of Artificial Sequence: Synthetic oligonucleotide
ctgatgttaacaacattggaaaatacagatctgcaggagc

SEQ ID NO: 120339 - DNA, 42 bp, Artificial Sequence
  Description of Artificial Sequence: Synthetic oligonucleotide
tgatgttaacaacattggaaaatacagatctgcaggagcatg

SEQ ID NO: 120340 - DNA, 41 bp, Artificial Sequence
  Description of Artificial Sequence: Synthetic oligonucleotide
gatgttaacaacattggaaaatacagatctgcaggagcatg

SEQ ID NO: 120341 - DNA, 43 bp, Artificial Sequence
  Description of Artificial Sequence: Synthetic oligonucleotide
atgttaacaacattggaaaatacagatctgcaggagcatgtac

SEQ ID NO: 120342 - DNA, 42 bp, Artificial Sequence
  Description of Artificial Sequence: Synthetic oligonucleotide
tgttaacaacattggaaaatacagatctgcaggagcatgtac

SEQ ID NO: 120343 - DNA, 41 bp, Artificial Sequence
  Description of Artificial Sequence: Synthetic oligonucleotide
gttaacaacattggaaaatacagatctgcaggagcatgtac

SEQ ID NO: 120344 - DNA, 42 bp, Artificial Sequence
  Description of Artificial Sequence: Synthetic oligonucleotide
ttaacaacattggaaaatacagatctgcaggagcatgtacag

SEQ ID NO: 120345 - DNA, 41 bp, Artificial Sequence
  Description of Artificial Sequence: Synthetic oligonucleotide
taacaacattggaaaatacagatctgcaggagcatgtacag

SEQ ID NO: 120346 - DNA, 40 bp, Artificial Sequence
  Description of Artificial Sequence: Synthetic oligonucleotide
aacaacattggaaaatacagatctgcaggagcatgtacag

SEQ ID NO: 120347 - DNA, 39 bp, Artificial Sequence
  Description of Artificial Sequence: Synthetic oligonucleotide
acaacattggaaaatacagatctgcaggagcatgtacag

SEQ ID NO: 120348 - DNA, 38 bp, Artificial Sequence
  Description of Artificial Sequence: Synthetic oligonucleotide
caacattggaaaatacagatctgcaggagcatgtacag

SEQ ID NO: 120349 - DNA, 38 bp, Artificial Sequence
  Description of Artificial Sequence: Synthetic oligonucleotide
aacattggaaaatacagatctgcaggagcatgtacagc

SEQ ID NO: 120350 - DNA, 37 bp, Artificial Sequence
  Description of Artificial Sequence: Synthetic oligonucleotide
acattggaaaatacagatctgcaggagcatgtacagc

SEQ ID NO: 120351 - DNA, 36 bp, Artificial Sequence
  Description of Artificial Sequence: Synthetic oligonucleotide
cattggaaaatacagatctgcaggagcatgtacagc

SEQ ID NO: 120352 - DNA, 37 bp, Artificial Sequence
  Description of Artificial Sequence: Synthetic oligonucleotide
attggaaaatacagatctgcaggagcatgtacagctg

SEQ ID NO: 120353 - DNA, 36 bp, Artificial Sequence
  Description of Artificial Sequence: Synthetic oligonucleotide
ttggaaaatacagatctgcaggagcatgtacagctg

SEQ ID NO: 120354 - DNA, 35 bp, Artificial Sequence
  Description of Artificial Sequence: Synthetic oligonucleotide
tggaaaatacagatctgcaggagcatgtacagctg

SEQ ID NO: 120355 - DNA, 34 bp, Artificial Sequence
  Description of Artificial Sequence: Synthetic oligonucleotide
ggaaaatacagatctgcaggagcatgtacagctg

SEQ ID NO: 120356 - DNA, 34 bp, Artificial Sequence
  Description of Artificial Sequence: Synthetic oligonucleotide
gaaaatacagatctgcaggagcatgtacagctgc

SEQ ID NO: 120357 - DNA, 35 bp, Artificial Sequence
  Description of Artificial Sequence: Synthetic oligonucleotide
aaaatacagatctgcaggagcatgtacagctgcag

SEQ ID NO: 120358 - DNA, 34 bp, Artificial Sequence
  Description of Artificial Sequence: Synthetic oligonucleotide
aaatacagatctgcaggagcatgtacagctgcag

SEQ ID NO: 120359 - DNA, 33 bp, Artificial Sequence
  Description of Artificial Sequence: Synthetic oligonucleotide
aatacagatctgcaggagcatgtacagctgcag

SEQ ID NO: 120360 - DNA, 32 bp, Artificial Sequence
  Description of Artificial Sequence: Synthetic oligonucleotide
atacagatctgcaggagcatgtacagctgcag

SEQ ID NO: 120361 - DNA, 31 bp, Artificial Sequence
  Description of Artificial Sequence: Synthetic oligonucleotide
tacagatctgcaggagcatgtacagctgcag

SEQ ID NO: 120362 - DNA, 30 bp, Artificial Sequence
  Description of Artificial Sequence: Synthetic oligonucleotide
acagatctgcaggagcatgtacagctgcag

SEQ ID NO: 120363 - DNA, 29 bp, Artificial Sequence
  Description of Artificial Sequence: Synthetic oligonucleotide
cagatctgcaggagcatgtacagctgcag

SEQ ID NO: 120364 - DNA, 29 bp, Artificial Sequence
  Description of Artificial Sequence: Synthetic oligonucleotide
agatctgcaggagcatgtacagctgcagc

SEQ ID NO: 120365 - DNA, 28 bp, Artificial Sequence
  Description of Artificial Sequence: Synthetic oligonucleotide
gatctgcaggagcatgtacagctgcagc

SEQ ID NO: 120366 - DNA, 31 bp, Artificial Sequence
  Description of Artificial Sequence: Synthetic oligonucleotide
atctgcaggagcatgtacagctgcagcattc

SEQ ID NO: 120367 - DNA, 30 bp, Artificial Sequence
  Description of Artificial Sequence: Synthetic oligonucleotide
tctgcaggagcatgtacagctgcagcattc

SEQ ID NO: 120368 - DNA, 29 bp, Artificial Sequence
  Description of Artificial Sequence: Synthetic oligonucleotide
ctgcaggagcatgtacagctgcagcattc

SEQ ID NO: 120369 - DNA, 29 bp, Artificial Sequence
  Description of Artificial Sequence: Synthetic oligonucleotide
tgcaggagcatgtacagctgcagcattcc

SEQ ID NO: 120370 - DNA, 28 bp, Artificial Sequence
  Description of Artificial Sequence: Synthetic oligonucleotide
gcaggagcatgtacagctgcagcattcc

SEQ ID NO: 120371 - DNA, 29 bp, Artificial Sequence
  Description of Artificial Sequence: Synthetic oligonucleotide
caggagcatgtacagctgcagcattcctg

SEQ ID NO: 120372 - DNA, 32 bp, Artificial Sequence
  Description of Artificial Sequence: Synthetic oligonucleotide
aggagcatgtacagctgcagcattcctgaaag

SEQ ID NO: 120373 - DNA, 31 bp, Artificial Sequence
  Description of Artificial Sequence: Synthetic oligonucleotide
ggagcatgtacagctgcagcattcctgaaag

SEQ ID NO: 120374 - DNA, 35 bp, Artificial Sequence
  Description of Artificial Sequence: Synthetic oligonucleotide
gagcatgtacagctgcagcattcctgaaagaattc

SEQ ID NO: 120375 - DNA, 35 bp, Artificial Sequence
  Description of Artificial Sequence: Synthetic oligonucleotide
agcatgtacagctgcagcattcctgaaagaattcg

SEQ ID NO: 120376 - DNA, 34 bp, Artificial Sequence
  Description of Artificial Sequence: Synthetic oligonucleotide
gcatgtacagctgcagcattcctgaaagaattcg

SEQ ID NO: 120377 - DNA, 37 bp, Artificial Sequence
  Description of Artificial Sequence: Synthetic oligonucleotide
catgtacagctgcagcattcctgaaagaattcgtaac

SEQ ID NO: 120378 - DNA, 38 bp, Artificial Sequence
  Description of Artificial Sequence: Synthetic oligonucleotide
atgtacagctgcagcattcctgaaagaattcgtaactc

SEQ ID NO: 120379 - DNA, 37 bp, Artificial Sequence
  Description of Artificial Sequence: Synthetic oligonucleotide
tgtacagctgcagcattcctgaaagaattcgtaactc

SEQ ID NO: 120380 - DNA, 36 bp, Artificial Sequence
  Description of Artificial Sequence: Synthetic oligonucleotide
gtacagctgcagcattcctgaaagaattcgtaactc

SEQ ID NO: 120381 - DNA, 38 bp, Artificial Sequence
  Description of Artificial Sequence: Synthetic oligonucleotide
tacagctgcagcattcctgaaagaattcgtaactcatc

SEQ ID NO: 120382 - DNA, 37 bp, Artificial Sequence
  Description of Artificial Sequence: Synthetic oligonucleotide
acagctgcagcattcctgaaagaattcgtaactcatc

SEQ ID NO: 120383 - DNA, 36 bp, Artificial Sequence
  Description of Artificial Sequence: Synthetic oligonucleotide
cagctgcagcattcctgaaagaattcgtaactcatc

SEQ ID NO: 120384 - DNA, 36 bp, Artificial Sequence
  Description of Artificial Sequence: Synthetic oligonucleotide
agctgcagcattcctgaaagaattcgtaactcatcc

SEQ ID NO: 120385 - DNA, 35 bp, Artificial Sequence
  Description of Artificial Sequence: Synthetic oligonucleotide
gctgcagcattcctgaaagaattcgtaactcatcc

SEQ ID NO: 120386 - DNA, 38 bp, Artificial Sequence
  Description of Artificial Sequence: Synthetic oligonucleotide
ctgcagcattcctgaaagaattcgtaactcatcctaag

SEQ ID NO: 120387 - DNA, 39 bp, Artificial Sequence
  Description of Artificial Sequence: Synthetic oligonucleotide
tgcagcattcctgaaagaattcgtaactcatcctaagtg

SEQ ID NO: 120388 - DNA, 38 bp, Artificial Sequence
  Description of Artificial Sequence: Synthetic oligonucleotide
gcagcattcctgaaagaattcgtaactcatcctaagtg

SEQ ID NO: 120389 - DNA, 38 bp, Artificial Sequence
  Description of Artificial Sequence: Synthetic oligonucleotide
cagcattcctgaaagaattcgtaactcatcctaagtgg

SEQ ID NO: 120390 - DNA, 38 bp, Artificial Sequence
  Description of Artificial Sequence: Synthetic oligonucleotide
agcattcctgaaagaattcgtaactcatcctaagtggg

SEQ ID NO: 120391 - DNA, 37 bp, Artificial Sequence
  Description of Artificial Sequence: Synthetic oligonucleotide
gcattcctgaaagaattcgtaactcatcctaagtggg

SEQ ID NO: 120392 - DNA, 37 bp, Artificial Sequence
  Description of Artificial Sequence: Synthetic oligonucleotide
cattcctgaaagaattcgtaactcatcctaagtgggc

SEQ ID NO: 120393 - DNA, 38 bp, Artificial Sequence
  Description of Artificial Sequence: Synthetic oligonucleotide
attcctgaaagaattcgtaactcatcctaagtgggcac

SEQ ID NO: 120394 - DNA, 37 bp, Artificial Sequence
  Description of Artificial Sequence: Synthetic oligonucleotide
ttcctgaaagaattcgtaactcatcctaagtgggcac

SEQ ID NO: 120395 - DNA, 36 bp, Artificial Sequence
  Description of Artificial Sequence: Synthetic oligonucleotide
tcctgaaagaattcgtaactcatcctaagtgggcac

SEQ ID NO: 120396 - DNA, 35 bp, Artificial Sequence
  Description of Artificial Sequence: Synthetic oligonucleotide
cctgaaagaattcgtaactcatcctaagtgggcac

SEQ ID NO: 120397 - DNA, 40 bp, Artificial Sequence
  Description of Artificial Sequence: Synthetic oligonucleotide
ctgaaagaattcgtaactcatcctaagtgggcacatttag

SEQ ID NO: 120398 - DNA, 41 bp, Artificial Sequence
  Description of Artificial Sequence: Synthetic oligonucleotide
tgaaagaattcgtaactcatcctaagtgggcacatttagac

SEQ ID NO: 120399 - DNA, 40 bp, Artificial Sequence
  Description of Artificial Sequence: Synthetic oligonucleotide
gaaagaattcgtaactcatcctaagtgggcacatttagac

SEQ ID NO: 120400 - DNA, 43 bp, Artificial Sequence
  Description of Artificial Sequence: Synthetic oligonucleotide
aaagaattcgtaactcatcctaagtgggcacatttagacatag

SEQ ID NO: 120401 - DNA, 42 bp, Artificial Sequence
  Description of Artificial Sequence: Synthetic oligonucleotide
aagaattcgtaactcatcctaagtgggcacatttagacatag

SEQ ID NO: 120402 - DNA, 41 bp, Artificial Sequence
  Description of Artificial Sequence: Synthetic oligonucleotide
agaattcgtaactcatcctaagtgggcacatttagacatag

SEQ ID NO: 120403 - DNA, 40 bp, Artificial Sequence
  Description of Artificial Sequence: Synthetic oligonucleotide
gaattcgtaactcatcctaagtgggcacatttagacatag

SEQ ID NO: 120404 - DNA, 40 bp, Artificial Sequence
  Description of Artificial Sequence: Synthetic oligonucleotide
aattcgtaactcatcctaagtgggcacatttagacatagc

SEQ ID NO: 120405 - DNA, 39 bp, Artificial Sequence
  Description of Artificial Sequence: Synthetic oligonucleotide
attcgtaactcatcctaagtgggcacatttagacatagc

SEQ ID NO: 120406 - DNA, 38 bp, Artificial Sequence
  Description of Artificial Sequence: Synthetic oligonucleotide
ttcgtaactcatcctaagtgggcacatttagacatagc

SEQ ID NO: 120407 - DNA, 37 bp, Artificial Sequence
  Description of Artificial Sequence: Synthetic oligonucleotide
tcgtaactcatcctaagtgggcacatttagacatagc

SEQ ID NO: 120408 - DNA, 36 bp, Artificial Sequence
  Description of Artificial Sequence: Synthetic oligonucleotide
cgtaactcatcctaagtgggcacatttagacatagc

SEQ ID NO: 120409 - DNA, 37 bp, Artificial Sequence
  Description of Artificial Sequence: Synthetic oligonucleotide
gtaactcatcctaagtgggcacatttagacatagcag

SEQ ID NO: 120410 - DNA, 37 bp, Artificial Sequence
  Description of Artificial Sequence: Synthetic oligonucleotide
taactcatcctaagtgggcacatttagacatagcagg

SEQ ID NO: 120411 - DNA, 36 bp, Artificial Sequence
  Description of Artificial Sequence: Synthetic oligonucleotide
aactcatcctaagtgggcacatttagacatagcagg

SEQ ID NO: 120412 - DNA, 35 bp, Artificial Sequence
  Description of Artificial Sequence: Synthetic oligonucleotide
actcatcctaagtgggcacatttagacatagcagg

SEQ ID NO: 120413 - DNA, 34 bp, Artificial Sequence
  Description of Artificial Sequence: Synthetic oligonucleotide
ctcatcctaagtgggcacatttagacatagcagg

SEQ ID NO: 120414 - DNA, 34 bp, Artificial Sequence
  Description of Artificial Sequence: Synthetic oligonucleotide
tcatcctaagtgggcacatttagacatagcaggc

SEQ ID NO: 120415 - DNA, 33 bp, Artificial Sequence
  Description of Artificial Sequence: Synthetic oligonucleotide
catcctaagtgggcacatttagacatagcaggc

SEQ ID NO: 120416 - DNA, 33 bp, Artificial Sequence
  Description of Artificial Sequence: Synthetic oligonucleotide
atcctaagtgggcacatttagacatagcaggcg

SEQ ID NO: 120417 - DNA, 32 bp, Artificial Sequence
  Description of Artificial Sequence: Synthetic oligonucleotide
tcctaagtgggcacatttagacatagcaggcg

SEQ ID NO: 120418 - DNA, 31 bp, Artificial Sequence
  Description of Artificial Sequence: Synthetic oligonucleotide
cctaagtgggcacatttagacatagcaggcg

SEQ ID NO: 120419 - DNA, 32 bp, Artificial Sequence
  Description of Artificial Sequence: Synthetic oligonucleotide
ctaagtgggcacatttagacatagcaggcgtg

SEQ ID NO: 120420 - DNA, 34 bp, Artificial Sequence
  Description of Artificial Sequence: Synthetic oligonucleotide
taagtgggcacatttagacatagcaggcgtgatg

SEQ ID NO: 120421 - DNA, 33 bp, Artificial Sequence
  Description of Artificial Sequence: Synthetic oligonucleotide
aagtgggcacatttagacatagcaggcgtgatg

SEQ ID NO: 120422 - DNA, 32 bp, Artificial Sequence
  Description of Artificial Sequence: Synthetic oligonucleotide
agtgggcacatttagacatagcaggcgtgatg

SEQ ID NO: 120423 - DNA, 31 bp, Artificial Sequence
  Description of Artificial Sequence: Synthetic oligonucleotide
gtgggcacatttagacatagcaggcgtgatg

SEQ ID NO: 120424 - DNA, 32 bp, Artificial Sequence
  Description of Artificial Sequence: Synthetic oligonucleotide
tgggcacatttagacatagcaggcgtgatgac

SEQ ID NO: 120425 - DNA, 31 bp, Artificial Sequence
  Description of Artificial Sequence: Synthetic oligonucleotide
gggcacatttagacatagcaggcgtgatgac

SEQ ID NO: 120426 - DNA, 31 bp, Artificial Sequence
  Description of Artificial Sequence: Synthetic oligonucleotide
ggcacatttagacatagcaggcgtgatgacc

SEQ ID NO: 120427 - DNA, 33 bp, Artificial Sequence
  Description of Artificial Sequence: Synthetic oligonucleotide
gcacatttagacatagcaggcgtgatgaccaac

SEQ ID NO: 120428 - DNA, 36 bp, Artificial Sequence
  Description of Artificial Sequence: Synthetic oligonucleotide
cacatttagacatagcaggcgtgatgaccaacaaag

SEQ ID NO: 120429 - DNA, 38 bp, Artificial Sequence
  Description of Artificial Sequence: Synthetic oligonucleotide
acatttagacatagcaggcgtgatgaccaacaaagatg

SEQ ID NO: 120430 - DNA, 37 bp, Artificial Sequence
  Description of Artificial Sequence: Synthetic oligonucleotide
catttagacatagcaggcgtgatgaccaacaaagatg

SEQ ID NO: 120431 - DNA, 39 bp, Artificial Sequence
  Description of Artificial Sequence: Synthetic oligonucleotide
atttagacatagcaggcgtgatgaccaacaaagatgaag

SEQ ID NO: 120432 - DNA, 38 bp, Artificial Sequence
  Description of Artificial Sequence: Synthetic oligonucleotide
tttagacatagcaggcgtgatgaccaacaaagatgaag

SEQ ID NO: 120433 - DNA, 37 bp, Artificial Sequence
  Description of Artificial Sequence: Synthetic oligonucleotide
ttagacatagcaggcgtgatgaccaacaaagatgaag

SEQ ID NO: 120434 - DNA, 36 bp, Artificial Sequence
  Description of Artificial Sequence: Synthetic oligonucleotide
tagacatagcaggcgtgatgaccaacaaagatgaag

SEQ ID NO: 120435 - DNA, 35 bp, Artificial Sequence
  Description of Artificial Sequence: Synthetic oligonucleotide
agacatagcaggcgtgatgaccaacaaagatgaag

SEQ ID NO: 120436 - DNA, 34 bp, Artificial Sequence
  Description of Artificial Sequence: Synthetic oligonucleotide
gacatagcaggcgtgatgaccaacaaagatgaag

SEQ ID NO: 120437 - DNA, 36 bp, Artificial Sequence
  Description of Artificial Sequence: Synthetic oligonucleotide
acatagcaggcgtgatgaccaacaaagatgaagttc

SEQ ID NO: 120438 - DNA, 35 bp, Artificial Sequence
  Description of Artificial Sequence: Synthetic oligonucleotide
catagcaggcgtgatgaccaacaaagatgaagttc

SEQ ID NO: 120439 - DNA, 35 bp, Artificial Sequence
  Description of Artificial Sequence: Synthetic oligonucleotide
atagcaggcgtgatgaccaacaaagatgaagttcc

SEQ ID NO: 120440 - DNA, 34 bp, Artificial Sequence
  Description of Artificial Sequence: Synthetic oligonucleotide
tagcaggcgtgatgaccaacaaagatgaagttcc

SEQ ID NO: 120441 - DNA, 33 bp, Artificial Sequence
  Description of Artificial Sequence: Synthetic oligonucleotide
agcaggcgtgatgaccaacaaagatgaagttcc
